United States Patent 7,709,616 (MICRORNAS AND USES THEREOF) - sequence listing, part 10

SEQ ID NO: 267962 - RNA, 64 nt, hsa
cccaauacguuucauagaaaauaaguaagaacuauuuuuaaaauauucaaacaaaacuaaaaca

SEQ ID NO: 267963 - RNA, 64 nt, hsa
cagauaagcuauaguuggggaaauuuguggguuuuuuuuaaauaagaaauguuuauuuuugucc

SEQ ID NO: 267964 - RNA, 64 nt, hsa
aaaugaauucagaagaaaacucaucaggugcuucuuuuuaaaacuagaacuuggcuauauugaa

SEQ ID NO: 267965 - RNA, 64 nt, hsa
aaagaucaggaaguuguauucagguacaaaucuuuuuuuaaauaaguauuuuguugagguugaa

SEQ ID NO: 267966 - RNA, 64 nt, hsa
ccuaguuuuauuaaauauuacacuugagagacacuuuuuaaaaauguguuaaugucaauaugau

SEQ ID NO: 267967 - RNA, 64 nt, hsa
ggguauugugugagugcauguguuuuuuuuuuuuuuuuuaaagcgugugugaacaaauggaaau

SEQ ID NO: 267968 - RNA, 64 nt, hsa
guuugccguuuguccuuaacuuucuuuuuuuuuuuuuuuaaaaaaagaaaacuuuaaaaaaacu

SEQ ID NO: 267969 - RNA, 64 nt, hsa
cuuaucuucaaggcuggcuuaaguauaaaauuguuuuuuaaacacuugaaaaauuaaaggauuu

SEQ ID NO: 267970 - RNA, 64 nt, hsa
gcgggugcuugaguuguugucguuuuuuguuuguuuuuuaaauguaaacugguaaauuuugugc

SEQ ID NO: 267971 - RNA, 64 nt, hsa
aaaauuuaaagaaaagcuagaggaaaaaaaaauuuuuuuaaaaauacuuauuagaagcaaacug

SEQ ID NO: 267972 - RNA, 64 nt, hsa
acuagggguacauucuuacaaaauaaauaaacaguuuuuaaaauuguuuagacacagauauuug

SEQ ID NO: 267973 - RNA, 64 nt, hsa
cugaaaggguuuuuguaaauuuuuuggccaaaauuuuuuaaaacauacuuacuuuggacuaggg

SEQ ID NO: 267974 - RNA, 64 nt, hsa
uuaaacauuugcauuugcuggacaauugcaauuuuuuuuaaaaaauuccccuaccccuguuuaa

SEQ ID NO: 267975 - RNA, 64 nt, hsa
guguuguuuuauuuccaugguuccucaaguuuccuuuuuaaacauuugcauuugcuggacaauu

SEQ ID NO: 267976 - RNA, 64 nt, hsa
auuaaauuuagacuauguaguaugugacagaauuuuuuuaaaauuauaaaaagauuuuauuuag

SEQ ID NO: 267977 - RNA, 64 nt, hsa
aaaaauucccccucauuagaauguuuaagaaaucuuuuuaaaaaguaaaauucugucagacuac

SEQ ID NO: 267978 - RNA, 64 nt, hsa
cugucacgcuucuucccauuauuuagagcacaguuuuuuaaagcaacuguacaauuucucagcc

SEQ ID NO: 267979 - RNA, 64 nt, hsa
guguauaauuauugccucauaaacucucucuuuguuuuuaaaggaaacaucuauuaugguaaua

SEQ ID NO: 267980 - RNA, 64 nt, hsa
acucugccaugacucuuaaaguagucuuacuuguuuuuuaaaaugcugguauuaaacuaaaugg

SEQ ID NO: 267981 - RNA, 64 nt, hsa
cuuauauuuuuaaggaaguaaguuauagcauacuuuuuuaaaaguaggaaccacaaucuuuaua

SEQ ID NO: 267982 - RNA, 64 nt, hsa
auauuuagcauaagacgugauauuuuuaauuucuuuuuuaaaaaauuauauuugucucuuagag

SEQ ID NO: 267983 - RNA, 64 nt, hsa
aaugcucauuuuuacaugcugcuacuagcuuuuuuuuuuaaaaaaaguaaaaguugcugcuuuc

SEQ ID NO: 267984 - RNA, 64 nt, hsa
ccaugcuguucucaugguaagaacuggaguuauguuuuuaaauuuggaaauaugacauuuuaug

SEQ ID NO: 267985 - RNA, 64 nt, hsa
acugaagacaaacuuguuucaaugauagucuucauuuuuaaaaacaaaaaggcaggcagacaga

SEQ ID NO: 267986 - RNA, 63 nt, hsa
uuccuggaauucaugaaaauauaauuaaaacacauuuuuaaacacuuggugaacuuuuuuuac

SEQ ID NO: 267987 - RNA, 64 nt, hsa
aaguuccuuggcuuuggaaugauuuucaaauguauuuuuaaacuuguauuugggucucccuuug

SEQ ID NO: 267988 - RNA, 64 nt, hsa
gaauuaaagcaagaaaaucugaaguauugucuuguuuuuaaaaaauacaguuccuaguguuuuu

SEQ ID NO: 267989 - RNA, 64 nt, hsa
aguuauuauuauuuaaaauuacuucaacuuuguguuuuuaaauguuuugacgauuucaauacaa

SEQ ID NO: 267990 - RNA, 64 nt, hsa
gucuguuggugccucaacuguugguaacuuuuuuuuuuuaaauuuacaacuuuccacaacuugu

SEQ ID NO: 267991 - RNA, 64 nt, hsa
auugugcuggguuaguuuugcaagcaauugauaauuuuuaaaaaauuaucaauauguauaauuu

SEQ ID NO: 267992 - RNA, 64 nt, hsa
uauguuugcuuuaauguguauugaagaaaagcacuuuuuaaaaaguacucuuuaagagugaaau

SEQ ID NO: 267993 - RNA, 64 nt, hsa
uugacaugaacagaaacaauaagggaaccgucuguuuuuaaaugaugauuccuugagcauuuua

SEQ ID NO: 267994 - RNA, 64 nt, hsa
aguagcucugaagugucacauuuaauaucaguuuuuuuuaaacaugauucuaguuaaauguaga

SEQ ID NO: 267995 - RNA, 64 nt, hsa
uguuguuaguggggacuaugauacuguaauaauauuuuuaaaaauuuacaucaagagaggcagu

SEQ ID NO: 267996 - RNA, 64 nt, hsa
aaacaaucucaaacaaaagacuugcuucaagguguuuuuaaauagcagugauucagaauuuuuu

SEQ ID NO: 267997 - RNA, 64 nt, hsa
cguggccuagugccuuggauuuuacauauuuuucuuuuuaaaugcaaaaccuuuucaacaaaau

SEQ ID NO: 267998 - RNA, 64 nt, hsa
uguaaauauaaagaggaacuucaauuaugaaaaauuuuuaaaagauauauauaucuauauaucu

SEQ ID NO: 267999 - RNA, 64 nt, hsa
agaaggcacauacauaguuaagaauacuaaaguauuuuuaaaaaucaaggaagaaauaaauguu

SEQ ID NO: 268000 - RNA, 64 nt, hsa
uuugcguuuguaccuuaccacagucuuauauuguuuuuuaaacucugccaugaaauuuggagac

SEQ ID NO: 268001 - RNA, 64 nt, hsa
uuuuugauuugucauugcuauuguagauggcaucuuuuuaaaaaguuauauuuucuaaagaaaa

SEQ ID NO: 268002 - RNA, 64 nt, hsa
ggcgugugccacuacacccggcuaauuuuuguacuuuuuaaaguagagacggggcuuugccaua

SEQ ID NO: 268003 - RNA, 64 nt, hsa
uguuuuugguacacugggcagacuucagagcaguuuuuuaaaaaaauaaauauucuaauguagc

SEQ ID NO: 268004 - RNA, 64 nt, hsa
uauaagaguuacuguugcauuuucugaccuacuauuuuuaaaauuccuguugaguuucuuugug

SEQ ID NO: 268005 - RNA, 64 nt, hsa
ugugguagcucuuacaaaguuuauugauuugauuuuuuuaaaaaucaaaagccaauugaacaac

SEQ ID NO: 268006 - RNA, 64 nt, hsa
acuuugcaaacauuuaaugaggauacacuguucauuuuuaaaauuccuucacacuguaauuuaa

SEQ ID NO: 268007 - RNA, 64 nt, hsa
gucucucccguuaaacugaguguagaaaucugaauuuuuaaaagagcuguaacuaguuguaagu

SEQ ID NO: 268008 - RNA, 64 nt, hsa
cauauaaacuuguauuauuuuucuuauuuuaaauuuuuuaaaauuucuguagguacauaguaug

SEQ ID NO: 268009 - RNA, 64 nt, hsa
gggugugagccaucguaccuggccacuuuaauuauuuuuaaaugugcaauuauuuuuuuacuac

SEQ ID NO: 268010 - RNA, 64 nt, hsa
aagcaugcaaucgcucugaauggcaguuuccucauuuuuaaacagggauaauaaaacuaauauu

SEQ ID NO: 268011 - RNA, 64 nt, hsa
cauuuuaauguaugguuagguuuuauauuuuuauuuuuuaaaaaagaaauagucaguguuuucc

SEQ ID NO: 268012 - RNA, 64 nt, hsa
uacuugguccuuaaaaaauaugcucuccccucccuuuuuaaacaaauggcuuguucagucacuu

SEQ ID NO: 268013 - RNA, 64 nt, hsa
ggcuuguucagucacuuguuuguguuugaauugauuuuuaaacagcagguugugugugugugca

SEQ ID NO: 268014 - RNA, 64 nt, hsa
aauaauaccucaagauaaucugauuuauuagcuauuuuuaaacauuuuuaaucacaagcuguau

SEQ ID NO: 268015 - RNA, 64 nt, hsa
caaucuaagcaaagcacccaacaaugguaaauguuuuuuaaaaaugcagaacuaagauuuuuga

SEQ ID NO: 268016 - RNA, 64 nt, hsa
caauguuaauuauuuagauauuuaauuucgcagauuuuuaaacuuuauuuucauaauuucugcu

SEQ ID NO: 268017 - RNA, 64 nt, hsa
ucagaaaagauaccccuuuugucauugcaacuauuuuuuaaauccagaaaucuuuguacugaug

SEQ ID NO: 268018 - RNA, 64 nt, hsa
gaauaguuugcugccaacuauuuauauuaaguaauuuuuaaauauuuguaauauuguugacuga

SEQ ID NO: 268019 - RNA, 64 nt, hsa
gaguaagagaaacaaacuguuuagaauuaucauguuuuuaaaacaucauaguaauauaaaucug

SEQ ID NO: 268020 - RNA, 64 nt, hsa
uguagugaggaaaaaaccuaagaaauuuccccuuuuuuuaaaaaauggaaauauucaauugaga

SEQ ID NO: 268021 - RNA, 64 nt, hsa
aagaagucuguaucuagugauaaauauaccaguuuuuuuaaaaagaugcuguugugccuauauc

SEQ ID NO: 268022 - RNA, 64 nt, hsa
uuauuuccguaaguacuucuguggccuugaguauuuuuuaaaaggcucaacuguaagccucuua

SEQ ID NO: 268023 - RNA, 64 nt, hsa
aucuucaauauucuggcuaaaucuugguaugugguuuuuaaacagucacuccguuucaaagucu

SEQ ID NO: 268024 - RNA, 64 nt, hsa
ccuagauauuuccaugggccagugugaugacuuuuuuuuaaaugagguucaguaccauaauguu

SEQ ID NO: 268025 - RNA, 64 nt, hsa
cccucuugaaaccugaugucagcugcuguugaacuuuuuaaagaagugcaugaaaaaccauuuu

SEQ ID NO: 268026 - RNA, 64 nt, hsa
aaucaaagccggccugagaaacacuauuugugacuuuuuaaacgauuagugauguccuuaaaau

SEQ ID NO: 268027 - RNA, 64 nt, hsa
uggcuggugaugagaauauucuuguugcaggcuguuuuuaaacuagugucagugacacuaggaa

SEQ ID NO: 268028 - RNA, 64 nt, hsa
aaagcagaauuugcaguggcaucuaaagagaucuuuuuuaaauaaaaauuauguauuguggcau

SEQ ID NO: 268029 - RNA, 64 nt, hsa
cugaugcuguguuacuaaaauuacaaggaccugcuuuuuaaaaggccagaacaauugucugaaa

SEQ ID NO: 268030 - RNA, 64 nt, hsa
aagcauuggaaggucaaauuauuuugaagugauuuuuuuaaaaaaaagucuucuguuuauuaac

SEQ ID NO: 268031 - RNA, 64 nt, hsa
cuauacacuugauaaggguaaauuuaucuuaguguuuuuaaacuugguuuugguuacuugagga

SEQ ID NO: 268032 - RNA, 64 nt, hsa
uuacacuaaacacuuuuggcagcuuaauaugaccuuuuuaaauuuuuuuuauuuuuuuuauuuu

SEQ ID NO: 268033 - RNA, 64 nt, hsa
aguggaaauuaucacuuggauguggagguuuuacuuuuuaaaaacauucagcuuaauuaccuua

SEQ ID NO: 268034 - RNA, 64 nt, hsa
aguuuuuaaucguuuuuguuuuaaggaaaaaagauuuuuaaaaugaaucuuaugcaaaacuuuu

SEQ ID NO: 268035 - RNA, 64 nt, hsa
aaacuuuuugaccaguuucuuuucuuuuguuuuuuuuuuaaaaaagacauuuaaagacaaagac

SEQ ID NO: 268036 - RNA, 64 nt, hsa
uauggggccuaaccugccacuuauuuuuugucaauuuuuaaaacuuuuuuuuaauuacuguaaa

SEQ ID NO: 268037 - RNA, 64 nt, hsa
caaauccuuucaauauucugggaacccagggaaguuuuuaaaaaugucauuacuuucaaaggaa

SEQ ID NO: 268038 - RNA, 64 nt, hsa
uuauuuauuugaaucuacaaaaaacaacaaauaauuuuuaaauauaaggauuuuccuagauauu

SEQ ID NO: 268039 - RNA, 64 nt, hsa
aauagauucuuauaauauuauuuaaaugacugcauuuuuaaauacaaggcuuuauauuuuuaac

SEQ ID NO: 268040 - RNA, 64 nt, hsa
uagugucugacuuuuguuaaauucaguaaugcaguuuuuaaaaaccuguaucugacccacuuug

SEQ ID NO: 268041 - RNA, 64 nt, hsa
uguacaaacaguauuucugguguauauuuuaauguuuuuaaaaagaguaauuucauuuaaauau

SEQ ID NO: 268042 - RNA, 64 nt, hsa
cuacuggaccaacauucuuguuuuugcuuuuguuuuuuuaaauaauucuagucuggagcuaacu

SEQ ID NO: 268043 - RNA, 64 nt, hsa
acacuuuuaaauugucucuugcaucacuaaaauuuuuuuaaaaugagcauaacaacgaaaggca

SEQ ID NO: 268044 - RNA, 64 nt, hsa
auaaaaagucaaaagaaacaaauagaagcuuuuuuuuuuaaaaaauguauugcuucugaacuuu

SEQ ID NO: 268045 - RNA, 64 nt, hsa
caaagucuaguuuguauguagguaugaagggaauuuuuuaaauaaauugaaaagcugugaacag

SEQ ID NO: 268046 - RNA, 64 nt, hsa
ucauauauguaagcugcauguuagacauuugucuuuuuuaaacuaaaguaauuguauugaugug

SEQ ID NO: 268047 - RNA, 64 nt, hsa
ggugcugauaccuucaauuuguuacuuuucaagauuuuuaaaaauaacuaguguagcuuaucuu

SEQ ID NO: 268048 - RNA, 64 nt, hsa
cucuuaaaugucaaacacauuuuuguuguuuuguuuuuuaaaugaucagugucuauuugaugug

SEQ ID NO: 268049 - RNA, 64 nt, hsa
gguguaugaauggucuagaaacauuucuauuuuuuuuuuaaaccagcaggauacaaguugcaaa

SEQ ID NO: 268050 - RNA, 64 nt, hsa
gguuauuauuggaaacauuacuuugagugcaguguuuuuaaaagccaauucuuuuuuaucccuu

SEQ ID NO: 268051 - RNA, 64 nt, hsa
cauuuauucauguuauaaagcaaagcccugguccuuuuuaaacuacuaguuuuaaaaaccugug

SEQ ID NO: 268052 - RNA, 64 nt, hsa
uugcuguuacgguuguauauagaggucugaaggauuuuuaaaaugauuugcacuuuuucacugc

SEQ ID NO: 268053 - RNA, 64 nt, hsa
gucuuuaguaggaaauggaagaacacuguuuuauuuuuuaaaguguuuaauguuucuguccuuu

SEQ ID NO: 268054 - RNA, 64 nt, hsa
agguugauugaauugugccuuugagugaacccaguuuuuaaauaccgcuguguuuguuucgcca

SEQ ID NO: 268055 - RNA, 64 nt, hsa
uguguugcacucugcuggaugaaauggcaguggauuuuuaaacuuuaauuucccaaaugucucu

SEQ ID NO: 268056 - RNA, 64 nt, hsa
augaaggauuguagauuuuugcuuuuucuuuuuguuuuuaaaacuuauuccaauugcuaaauug

SEQ ID NO: 268057 - RNA, 64 nt, hsa
uaaaauagaaaaugcuuguggcauuuauuuucucuuuuuaaaagguucagaaauuuggcagguc

SEQ ID NO: 268058 - RNA, 64 nt, hsa
uuagguaguauaauaaagguaaaugaagguacaauuuuuaaaccauuauuuucacccuguuggg

SEQ ID NO: 268059 - RNA, 64 nt, hsa
uagaaacugauuucuucagaauuagauggcuuauuuuuuaaaauauuugaaugaaaacauuuua

SEQ ID NO: 268060 - RNA, 64 nt, hsa
uuauuuuuuaaaauauuugaaugaaaacauuuuauuuuuaaaauauuacacaggaggcuucgga

SEQ ID NO: 268061 - RNA, 64 nt, hsa
aaagaaacaccacuuaaucuucucucuugauugauuuuuaaaguuuaaauaccaguacuugagg

SEQ ID NO: 268062 - RNA, 64 nt, hsa
gcucuuauaaaaucaauaagagaacucuccucuuuuuuuaaaaauaaaucuaaaugauuaucuu

SEQ ID NO: 268063 - RNA, 64 nt, hsa
aaguuagaagaacggaucaugugccaacuguaguuuuuuaaaaaaaacgcuccuuuguaggguu

SEQ ID NO: 268064 - RNA, 64 nt, hsa
cgugagccaccacaccuggccuuucugcaacauuuuuuuaaaaaaaucuaauaaaucuuagauu

SEQ ID NO: 268065 - RNA, 64 nt, hsa
aacauuuuuuuaaaaaaaucuaauaaaucuuagauuuuuaaaaaagaauuaaaaugugggaguu

SEQ ID NO: 268066 - RNA, 64 nt, hsa
aaaaaccaucuuaaguauucaaaauuuccuugguuuuuuaaaggugauaauuuugcuuuguguu

SEQ ID NO: 268067 - RNA, 64 nt, hsa
gauaccuuauccuauuccuccccacccacccauguuuuuaaacuaauuuauauaaaaucuggag

SEQ ID NO: 268068 - RNA, 64 nt, hsa
cucaguuguuucaggcaagcccaagacuuuguaauuuuuaaagggcccaagauuuuuuuuuuuu

SEQ ID NO: 268069 - RNA, 64 nt, hsa
cagcuguaguaacuaugauggguguaacaacauuuuuuuaaagaagggaaucuguuuaucgcuu

SEQ ID NO: 268070 - RNA, 64 nt, hsa
caauuuguuuuaauuuuuuauauauauguuuuuauuuuuaaaaaacauaccaguugaauggggu

SEQ ID NO: 268071 - RNA, 64 nt, hsa
ccaaaaugauagcuaucuaacaacuaauuacuaauuuuuaaagaacaaaucacacauuuaaaaa

SEQ ID NO: 268072 - RNA, 64 nt, hsa
aagaauugaugcuagagguaaaaaaaaauacuuguuuuuaaaaaauccuuuacgucuuguguaa

SEQ ID NO: 268073 - RNA, 64 nt, hsa
cagcaucacugugucuguauuucaaguacaaauguuuuuaaaaaggauucuuuauacauaugug

SEQ ID NO: 268074 - RNA, 64 nt, hsa
ucacgguaccaaaugcugaccaguguugcuccauuuuuuaaaucuugaaaaggguuucuguacu

SEQ ID NO: 268075 - RNA, 64 nt, hsa
cuacugcaaaacaccacuguuggaaaaauagguauuuuuaaauuguuuuuaaucuuuuuuggug

SEQ ID NO: 268076 - RNA, 64 nt, hsa
aauuagauuaguauuuuccacgucacuguuuauuuuuuuaaaacacaaauucuaaagcuacaac

SEQ ID NO: 268077 - RNA, 64 nt, hsa
uuacucaaagaauuuuuuaagaacuguauuuuauuuuuuaaaugguguuuuauuacaagggacc

SEQ ID NO: 268078 - RNA, 64 nt, hsa
uuuuaacguggacaucucuuccuugguacagugguuuuuaaauacugagaagaaccaagucagg

SEQ ID NO: 268079 - RNA, 64 nt, hsa
ugguuuuuaaauacugagaagaaccaagucagguuuuuuaaagcagacuaaaagcaugaaauug

SEQ ID NO: 268080 - RNA, 64 nt, hsa
aaaggaaugugcauaauggagagaagacauauuuuuuuuaaaacugaagauauuggcacaaaug

SEQ ID NO: 268081 - RNA, 64 nt, hsa
auuauuauuguugauguugucaugguuaaucuauuuuuuaaaauugaaaugaagcagaaguagg

SEQ ID NO: 268082 - RNA, 64 nt, hsa
ugaggaugaauuuucugcuuuaaaggcauguguguuuuuaaaauuaaugaauguagauguguga

SEQ ID NO: 268083 - RNA, 64 nt, hsa
cuccuacccgugugcuaggaaugugcacuagcucuuuuuaaauuccaugcuacacuuugaggac

SEQ ID NO: 268084 - RNA, 64 nt, hsa
uuacuuacugcuccaggcauuuuauuaaauuaauuuuuuaaauuauuuuccacccuacaucagu

SEQ ID NO: 268085 - RNA, 64 nt, hsa
uguugacauuuguuggcagugugcuaaguaauguuuuuuaaagcacaggcuugaggacuauggu

SEQ ID NO: 268086 - RNA, 64 nt, hsa
uuauuuuuaauauuacuacuauaugaauuaucuuuuuuuaaacuuguagauaaaaguguuccag

SEQ ID NO: 268087 - RNA, 64 nt, hsa
cugauagaagauuuuuguccaugcuugauuuuuuuuuuuaaagaaaaacuuucauggguuagca

SEQ ID NO: 268088 - RNA, 64 nt, hsa
uuuuauuaucuuuaaacuuguugcauuuaaaauauuuuuaaaaccuucuuaacaaaacuucuua

SEQ ID NO: 268089 - RNA, 64 nt, hsa
auggauaauauaaaaagaguaccugagauguauuuuuuuaaacucuuagagauaucuguaacuc

SEQ ID NO: 268090 - RNA, 64 nt, hsa
gccucuguaaaggaagagucucauuagacaaugauuuuuaaagcauuggaaaaauauuuugccu

SEQ ID NO: 268091 - RNA, 64 nt, hsa
augagccaccaugccuggcccaaaguucuagaauuuuuuaaagguauucauggugacucaggaa

SEQ ID NO: 268092 - RNA, 64 nt, hsa
auuugauaggcaauacaucuacccacuccauuauuuuuuaaaacuucauuuaauaguuuaaaca

SEQ ID NO: 268093 - RNA, 64 nt, hsa
auuuuagugacagcucugccuguuagacucuuacuuuuuaaaaucuuuucuauuuucccucgcu

SEQ ID NO: 268094 - RNA, 64 nt, hsa
ucuggaugcauuucucugggguauuuggggcuuauuuuuaaaauuuuaauauggguucuuuuuu

SEQ ID NO: 268095 - RNA, 64 nt, hsa
cagagaggcuuucccagaaaaaaaaaaaaaaccauuuuuaaaaagaagaaagccuaaagacucu

SEQ ID NO: 268096 - RNA, 64 nt, hsa
gccgcuggguccucgggggcuuacucaucucccuuuuuuaaacaaaaagcaaaaaaguaaaaug

SEQ ID NO: 268097 - RNA, 64 nt, hsa
uugaagaugugauguugcucggccuuuggaauaauuuuuaaaucuguaaaugucuauaugagca

SEQ ID NO: 268098 - RNA, 64 nt, hsa
guuaauacugccaauaaaaucauuuucaacuuauuuuuuaaaguagguuuucuuacuuuggugg

SEQ ID NO: 268099 - RNA, 64 nt, hsa
gguuuuauucauuguaugaaaauuccugugauuuuuuuuaaaugugcaguacacaucagccuca

SEQ ID NO: 268100 - RNA, 64 nt, hsa
cgaacuggugcuuuaguaauguggauuuuuuucuuuuuuaaaagagauguagcagaauaauucu

SEQ ID NO: 268101 - RNA, 64 nt, hsa
ucaacaguaguuuugaaacuagaagucaaaaaucuuuuuaaaaugcuguuuuguuuuaauuuuu

SEQ ID NO: 268102 - RNA, 64 nt, hsa
agauauuuauucuuuaaaucaaaguaaauuagaauuuuuaaaaagcacaaaacugcaggacagu

SEQ ID NO: 268103 - RNA, 64 nt, hsa
acaggguccuguuguuuuguuugauuuuuagauuuuuuuaaauuauuauuaagguuguaauguu

SEQ ID NO: 268104 - RNA, 64 nt, hsa
auuuauuguaguggcugccuaaaaaccacuggaguuuuuaaaagaagcaaggaguuaaaugucc

SEQ ID NO: 268105 - RNA, 64 nt, hsa
ucuugugcugcacaugggcugaauuuuuaaauuuuuuuuaaaaacuugaagcagaaccuuguaa

SEQ ID NO: 268106 - RNA, 64 nt, hsa
guuuugcauauucuugugcugcacaugggcugaauuuuuaaauuuuuuuuaaaaacuugaagca

SEQ ID NO: 268107 - RNA, 64 nt, hsa
gucaccagauuuuuauuaauguaaaaaaaaucaauuuuuaaaaaauaguuggacuuuggcagcu

SEQ ID NO: 268108 - RNA, 64 nt, hsa
uacacaggaaaaaauagaagucuacugaauuaauuuuuuaaaagaaaagagaucagauuaaaua

SEQ ID NO: 268109 - RNA, 64 nt, hsa
uuauuuuaaguuaaagacagauuucuuuaauaaguuuuuaaaauugaucaacuuuaaauuaagc

SEQ ID NO: 268110 - RNA, 64 nt, hsa
ccaaguauaaguuucaccaccuugagaaauaauuuuuuuaaaaaaucuuccucuuucucugggg

SEQ ID NO: 268111 - RNA, 64 nt, hsa
gcaugauuauacacguguauuggaaauaucuaguuuuuuaaauuuuuaauuaauuuauuuauaa

SEQ ID NO: 268112 - RNA, 64 nt, hsa
caagauauuguauucccaagaagaaauugauuuauuuuuaaacuaucaguuacugaagacuuau

SEQ ID NO: 268113 - RNA, 64 nt, hsa
ucaauaaucaagauaccuaauauuuaagugaauauuuuuaaaacucaaaauuaaugcaaaagau

SEQ ID NO: 268114 - RNA, 64 nt, hsa
aagaugaugaaaaugcagaaugucuuuuuaaauguuuuuaaauauaaacaaauauucuuuacua

SEQ ID NO: 268115 - RNA, 64 nt, hsa
aguuugcuaaaagaugaugaaaaugcagaaugucuuuuuaaauguuuuuaaauauaaacaaaua

SEQ ID NO: 268116 - RNA, 64 nt, hsa
auuggauugacuuacuaccuaacacugagcgcuguuuuuaaaugaaaagaaugagauuuauaac

SEQ ID NO: 268117 - RNA, 64 nt, hsa
gcaaauaaaaucaaaagucauguuuaaagacguguuuuuaaaauuccacuaucccuuuucuaaa

SEQ ID NO: 268118 - RNA, 64 nt, hsa
ccugugggucaauuuugaacuggccuuacuuugauuuuuaaaacaagagacucagggaaaguac

SEQ ID NO: 268119 - RNA, 64 nt, hsa
augacuugaccccaaaccuuuguuuauguaagaauuuuuaaacauaaaaguguuuguuucuguu

SEQ ID NO: 268120 - RNA, 64 nt, hsa
uuuaaaauauuuaaaaaaauuuucaguuucuucauuuuuaaauugugauuuuuagauuuguuag

SEQ ID NO: 268121 - RNA, 64 nt, hsa
aauuuaaaaaguaucugauuuuuaaaguaaauauuuuuuaaaguuuugacauuuaaauuacuug

SEQ ID NO: 268122 - RNA, 64 nt, hsa
ucaaaaaauaaaauuuaauuuaaaaaguaucugauuuuuaaaguaaauauuuuuuaaaguuuug

SEQ ID NO: 268123 - RNA, 64 nt, hsa
ccaaaggaagacauauacauggucaauaaguauauuuuuaaaaugcucaacauuaacuauucau

SEQ ID NO: 268124 - RNA, 64 nt, hsa
uaagagucuuaaaagaaauuaagccauuuaacauuuuuuaaauagguaagauaccauuauauuu

SEQ ID NO: 268125 - RNA, 64 nt, hsa
agacccaguaaaucacuucuucuuucucuuugccuuuuuaaacccaugcuuugauccacuuauc

SEQ ID NO: 268126 - RNA, 64 nt, hsa
auauuaagaagacauugcuaucuaauuuuuaaucuuuuuaaaugaaaaauuccuauguucagua

SEQ ID NO: 268127 - RNA, 64 nt, hsa
uagcagccucuuguuuuuuuccccauugccucuuuuuuuaaaaaacuuauaaagucacuuuuua

SEQ ID NO: 268128 - RNA, 64 nt, hsa
ucuagauaggaaaaaaaucagucuccucauuugcuuuuuaaauggaguaguacaucccauauuu

SEQ ID NO: 268129 - RNA, 64 nt, hsa
aauuuugcuguauuugauuacuuagagauaggaauuuuuaaaaaucaaaacaaaaaauaccaca

SEQ ID NO: 268130 - RNA, 64 nt, hsa
ccucuagaugauuuguagcaguguuauucuacacuuuuuaaaagaagcguccuccuuuugucca

SEQ ID NO: 268131 - RNA, 64 nt, hsa
uuaguuuacagagaaaaggcuugguggugggauuuuuuuaaauguguguuauguacauauauau

SEQ ID NO: 268132 - RNA, 64 nt, hsa
caucccucacuuaccaauuaauuauaaauauguuuuuuuaaauccccaaagacauuaucugugg

SEQ ID NO: 268133 - RNA, 64 nt, hsa
gcucuuagcagcugugguuuuuuuuuccauauuuuuuuuaaauuuguuggcucuuaagaugaau

SEQ ID NO: 268134 - RNA, 64 nt, hsa
gauuuaaauguguaugugauuuuuuuuguuuuuguuuuuaaagccucaguaguuucuagauaau

SEQ ID NO: 268135 - RNA, 64 nt, hsa
aagaacauuuuauuuucucuuauuucuguugugauuuuuaaaaacuuuuuuuuggaccuaaaua

SEQ ID NO: 268136 - RNA, 64 nt, hsa
agcauuuuuuuaaaagaagcuuuguaauaaaacauuuuuaaaaauugucauuuuauuaagagug

SEQ ID NO: 268137 - RNA, 64 nt, hsa
ugucauuccaguuugaguuaaugugcugagcauuuuuuuaaaagaagcuuuguaauaaaacauu

SEQ ID NO: 268138 - RNA, 64 nt, hsa
ugccaguuguuaaaaugagcauugauguacccauuuuuuaaaaaagcaaggcacagccuuugcc

SEQ ID NO: 268139 - RNA, 64 nt, hsa
caguuuauuuuuucuucuguuuucuucuuuucuuuuuuuaaacaguaaaccuuaacagaugcgu

SEQ ID NO: 268140 - RNA, 64 nt, hsa
auuuaacagugcaaaaggaucguuuuuuuuugcuuuuuuaaacuugaauuuuuuuaauuuacac

SEQ ID NO: 268141 - RNA, 64 nt, hsa
aagagccaaguuccaaaauaaagcauaaaaagguuuuuuaaaaggaaauguaaaagcacaugag

SEQ ID NO: 268142 - RNA, 64 nt, hsa
cacuuaaccucugugugccuaaacaaguugugcuuuuuuaaaaggaguuauguuugggcaaagc

SEQ ID NO: 268143 - RNA, 64 nt, hsa
guuugguccccucuaguaugugucacugagaaauuuuuuaaagacaugguagaucguguuuaga

SEQ ID NO: 268144 - RNA, 64 nt, hsa
uaaauuuugccuaaaauucaguauguuccuuaaguuuuuaaaauucugaguguguacaaauauc

SEQ ID NO: 268145 - RNA, 64 nt, hsa
uaagagaaauaauuguauuuguuaacagugucuuuuuuuaaaaaguuaaggcacucugaaacaa

SEQ ID NO: 268146 - RNA, 64 nt, hsa
auuuuaaugaauuuuuggcaaguggcuguuuuaauuuuuaaauugagaaguaauauguggaaaa

SEQ ID NO: 268147 - RNA, 64 nt, hsa
aauugaacuuucuaaaacuaaaagagucuuuuuauuuuuaaaacacaaguagaaugauuuaaau

SEQ ID NO: 268148 - RNA, 64 nt, hsa
uuuuuauaucuaaaaauauuugagauauaauggcuuuuuaaaguaaugcuucuauuucuuuuga

SEQ ID NO: 268149 - RNA, 64 nt, hsa
uuuccuucuuuccuuucuucuuucucuuucuuucuuuuuaaaauauauugaagacaaccagaua

SEQ ID NO: 268150 - RNA, 64 nt, hsa
gcuucaucauccugaaaagaaggagacagggauuuuuuuaaagagcaagaaagucacaauauua

SEQ ID NO: 268151 - RNA, 64 nt, hsa
gcugcuguuguuuuuuauucuauuuacaggaugauuuuuaaacugucaaaugaaguaguguuaa

SEQ ID NO: 268152 - RNA, 64 nt, hsa
cuaaguaaggcagcagucauuuguguauucaggcuuuuuaaauaaaauuagagcuguaaggaaa

SEQ ID NO: 268153 - RNA, 64 nt, hsa
agagguaucaaguaaauacugaaacccaaugguguuuuuaaacuguuucuguuuuuauucaucu

SEQ ID NO: 268154 - RNA, 64 nt, hsa
guuuuuggcauguuguuugauuucuuuggcaauuuuuuuaaagauuauuuguaguuuacuuucc

SEQ ID NO: 268155 - RNA, 64 nt, hsa
gucagccauuuacucucccacuaauugggauuauuuuuuaaaagaggucuuucuccccgaaaua

SEQ ID NO: 268156 - RNA, 64 nt, hsa
gaagguugguuucgcuuuuuuuccuuuaaguuuguuuuuaaauguauuaguccaggggauuuug

SEQ ID NO: 268157 - RNA, 64 nt, hsa
gugcauuauucauaaaaaauaaugguguccagucuuuuuaaacuuguaaagacacaucuuauug

SEQ ID NO: 268158 - RNA, 64 nt, hsa
ggugugagccaccgugcccggccaaguaaaauguuuuuuaaaaugguuaugugcauuauucaua

SEQ ID NO: 268159 - RNA, 64 nt, hsa
gguugaagaugaaaucauuccuaaauuaaccuuuuuuuuaaaaaaaaacaauguauauuauguu

SEQ ID NO: 268160 - RNA, 64 nt, hsa
caauuguuuacaaggcuuaacuaauuuauuugcuuuuuuaaacuugaacuuuucguauaauaga

SEQ ID NO: 268161 - RNA, 64 nt, hsa
aaguucauuuccugggauucacuucuccagggauuuuuuaaaguuaauuugggaaauuaacagc

SEQ ID NO: 268162 - RNA, 64 nt, hsa
cuggcuggagaaucucacaagcggaccagagaucuuuuuaaaucccugcuacugucccuucuca

SEQ ID NO: 268163 - RNA, 64 nt, hsa
acauaauaaaagaucggcccuaaguaaagagcacuuuuuaaacugccauuaaagauggguuuca

SEQ ID NO: 268164 - RNA, 64 nt, hsa
aauuguuucuuugugcuucagcucauuuuccauauuuuuaaaacccugugguaaaagccucaau

SEQ ID NO: 268165 - RNA, 64 nt, hsa
ucacauaaguuauauuuaagggaggagggaauuuuuuuuaaacaagcuuagguccuuucccgag

SEQ ID NO: 268166 - RNA, 64 nt, hsa
guugguugcaucuuguaggccaucugacuuccuguuuuuaaaacgggggucuggucuugcuaaa

SEQ ID NO: 268167 - RNA, 64 nt, hsa
cguuguauucacacaaaccugaacaaagcaaauuuuuuuaaaagcagcguauguaagcaccgac

SEQ ID NO: 268168 - RNA, 64 nt, hsa
uagcacuuugcauaggcaaaauacuuuucaggccuuuuuaaaaaauucauuacagcaaacagcu

SEQ ID NO: 268169 - RNA, 64 nt, hsa
aucuuguaaaaacacuuuuuugguuuaauauauauuuuuaaaacauuucacuagugauugaauu

SEQ ID NO: 268170 - RNA, 64 nt, hsa
uuccauaugacacugguuccgauuuuaaaaauuauuuuuaaauaaccgauuauugauuacugua

SEQ ID NO: 268171 - RNA, 64 nt, hsa
ugaaaguaaaaugaaguaguauauaugaaaaugcuuuuuaaacacaaaagcuuuauacaaaaua

SEQ ID NO: 268172 - RNA, 64 nt, hsa
acacaaguuuaccauuuuuaucaucuuuagauuauuuuuaaaucucacuaccuugaaguuugcc

SEQ ID NO: 268173 - RNA, 64 nt, hsa
aggacucagcuucagugauucuguuuucauaggcuuuuuaaagcccuuuucagucaaauuagau

SEQ ID NO: 268174 - RNA, 64 nt, hsa
ugccagauuuuauccuagacccugaggauauagcuuuuuaaaacccccuccuguuucagagcuu

SEQ ID NO: 268175 - RNA, 64 nt, hsa
guuaaaaggcauucuuagauucauuuuaaccacauuuuuaaaaacucacaguugguuaacauga

SEQ ID NO: 268176 - RNA, 64 nt, hsa
ucugcauuauuggaauauaauuguuuuaucugaauuuuuaaacaaguauuuguuaauuuagaaa

SEQ ID NO: 268177 - RNA, 64 nt, hsa
gaagaaucucaucucagugaagaauacuucucauuuuuuaaaaaagcuuaaaacuuugaaguua

SEQ ID NO: 268178 - RNA, 64 nt, hsa
cucauuuuuguugaguaagcaaaauuacaaaguguuuuuaaaaaaaccuguacaaauauguuua

SEQ ID NO: 268179 - RNA, 64 nt, hsa
acccccaagcugugagaguguguuuauuuuuaauuuuuuaaaagguauuuaauuuccaaccaca

SEQ ID NO: 268180 - RNA, 64 nt, hsa
acuguugaauucauaccauauaaaacuuguuagguuuuuaaacauagcaaucaaggcuacaaaa

SEQ ID NO: 268181 - RNA, 64 nt, hsa
gacaagucucgguguucccuuuauucuuaguuuguuuuuaaauauuaauuuuggcauucuaaaa

SEQ ID NO: 268182 - RNA, 64 nt, hsa
ccggauuuuuguuaauauucauuuuuguuauccuuuuuuaaaaguaaauguacaggaugccagu

SEQ ID NO: 268183 - RNA, 64 nt, hsa
ucauacacaagucuaacaguuaauuaguuaacaguuuuuaaacuagguuuguggguauuuuuuu

SEQ ID NO: 268184 - RNA, 64 nt, hsa
agugagaaguucauauuucuuuggcuuuuuuguguuuuuaaaaguuacuccuuuuagggagcug

SEQ ID NO: 268185 - RNA, 64 nt, hsa
caugggacaaaguuccaaaaugccaaauucuuauuuuuuaaaaagcuaguucuauaaaauacug

SEQ ID NO: 268186 - RNA, 64 nt, hsa
caaaacaaaaaaaaacucauuuauaccuguguauuuuuuaaagcuacaaucuguucaauguuuu

SEQ ID NO: 268187 - RNA, 64 nt, hsa
cuguguauuuuuuaaagcuacaaucuguucaauguuuuuaaaaaucuguuuauaugacauuguu

SEQ ID NO: 268188 - RNA, 64 nt, hsa
auucucaguaaaaaugaaguuuuuguaggauuaauuuuuaaauuauuuccagugucuauguuga

SEQ ID NO: 268189 - RNA, 64 nt, hsa
cauauuaauaaaguauaagugauguuuuauaugauuuuuaaaaaaaauucucaagugcaaugug

SEQ ID NO: 268190 - RNA, 64 nt, hsa
acaugaguuuuaugguauuuugugagggaugcauuuuuuaaaagauuaauuuuggaaacagaag

SEQ ID NO: 268191 - RNA, 64 nt, hsa
ccaaugcagagcaguuugcuuugaaaaauaguuguuuuuaaaaguuuaauguaaauaauuauuu

SEQ ID NO: 268192 - RNA, 64 nt, hsa
uguaaauaauuauuuuuuagaaguuuuuuuuuuuuuuuuaaagacagggucucgcuuuaucgcc

SEQ ID NO: 268193 - RNA, 64 nt, hsa
cuggauuaggaaaugaauuuguuuaauauuuuuguuuuuaaacaugauugaaaucacugcuuau

SEQ ID NO: 268194 - RNA, 64 nt, hsa
caugauugaaaucacugcuuauaaaugugugauuuuuuuaaaacgaccaaaacuguucugaaga

SEQ ID NO: 268195 - RNA, 64 nt, hsa
uuuuuguaaugcuaaaaaaucaguaucuagaugguuuuuaaauguauucucuggaaauuguuuu

SEQ ID NO: 268196 - RNA, 64 nt, hsa
gugaaggcuaaucauagaaaaaaaaccucuaguuuuuuuaaaaauagaauuuggaaacuuauuu

SEQ ID NO: 268197 - RNA, 64 nt, hsa
aaauguguaugguuugcagcuuuuaaaaaccauuuuuuuaaaacuaauaaauagugacugaacc

SEQ ID NO: 268198 - RNA, 64 nt, hsa
aguuaaugcaguagaaaguagugguaauaauuccuuuuuaaaaaaauuucgguagucauauagu

SEQ ID NO: 268199 - RNA, 64 nt, hsa
aaggauugugauauuagaggcuggaaauccuuauuuuuuaaaaaaucagauaggcauaaauagu

SEQ ID NO: 268200 - RNA, 64 nt, hsa
aguuauuuaauaugaguuugagagagaaaauuguuuuuuaaaaauauaugugcauugaaaugau

SEQ ID NO: 268201 - RNA, 64 nt, hsa
aagguuugauguauauagaaauuccauguuugauuuuuuaaaauauguguauaagucugucaug

SEQ ID NO: 268202 - RNA, 64 nt, hsa
uugcuuuuuucauaguucuuguuuucauguuuuauuuuuaaaaagacauauaaagauugcauau

SEQ ID NO: 268203 - RNA, 64 nt, hsa
auuuccuaauaaaccccuuugauuuaaaaauguauuuuuaaaaauguuuacauugaugaugagu

SEQ ID NO: 268204 - RNA, 64 nt, hsa
gcuacaugacgacaaagcugcuaaaucuccuauuuuuuuaaaaucacuaacauuauauugcaau

SEQ ID NO: 268205 - RNA, 64 nt, hsa
augaaggaaauaaaaaagucucuauuuaaauucuuuuuuaaauuuucuucaguugguguguuuu

SEQ ID NO: 268206 - RNA, 64 nt, hsa
uaacucacuccuaggaauguauuuugcuucaggauuuuuaaauucaaauaaggauggcagugcc

SEQ ID NO: 268207 - RNA, 64 nt, hsa
ugucuuugagagagauacaggucuuggaauucacuuuuuaaauguuacguuccaaccuuauaug

SEQ ID NO: 268208 - RNA, 64 nt, hsa
auguuccaaggugcagugcacugugaaucuuuuauuuuuaaaaaaauuuguaggugcuuuuaug

SEQ ID NO: 268209 - RNA, 64 nt, hsa
auuuuaaacaaacaauuugaaguuaaacauuucauuuuuaaaaacacugaauuacaguucuuau

SEQ ID NO: 268210 - RNA, 64 nt, hsa
aaacaaguucaaaauuuaaacaaguucauacaaguuuuuaaaaauucucaacugguagcuugcu

SEQ ID NO: 268211 - RNA, 64 nt, hsa
agccagagucaaaagaacucuucuuguaaaucacuuuuuaaauuuucucucacugaugcccuuu

SEQ ID NO: 268212 - RNA, 64 nt, hsa
cauuuuggggugauaucuguauauauaacuuguuuuuuuaaaagaugccguuuaaaagcaugau

SEQ ID NO: 268213 - RNA, 64 nt, hsa
cauguacccaacuuuucauuaauuuguauuuccauuuuuaaauugcauauucuauguuuuguag

SEQ ID NO: 268214 - RNA, 64 nt, hsa
cccaaagagccacaguagcugucaauuauugagauuuuuaaaugguaaauauugcaaaaguuaa

SEQ ID NO: 268215 - RNA, 64 nt, hsa
uaaaaucauaaaaaaucaaguuuuaagguuauauuuuuuaaaauaaugaauuuucuaucucuag

SEQ ID NO: 268216 - RNA, 64 nt, hsa
gcuucauuuugauaugacugaauugcaaucuauauuuuuaaaaagaaaaaucaaaauacauuag

SEQ ID NO: 268217 - RNA, 64 nt, hsa
ccuuagccuccugguuugugucuuuuuuuuuuuuuuuuuaaaacagaaucacucuggcaauugu

SEQ ID NO: 268218 - RNA, 64 nt, hsa
ugggaaaugagaaaguuuuaauaaguaaaaugauuuuuuaaauaacagcaacugccuagaaucu

SEQ ID NO: 268219 - RNA, 64 nt, hsa
uguggugguuuuguaauuugaugcuuuuauucuguuuuuaaauugaaaugagguaaugcaacuu

SEQ ID NO: 268220 - RNA, 64 nt, hsa
ggguggcuauuuugauuuggcaugacuacuuaauuuuuuaaaaaaauugugguuugugaauugc

SEQ ID NO: 268221 - RNA, 64 nt, hsa
uuuuaaagauaugaaaucuguuuacucaaccaauuuuuuaaaugucauauugugauaaugcucu

SEQ ID NO: 268222 - RNA, 64 nt, hsa
aaauauugaaugccuuauuuuugaauucuuuagauuuuuaaauuggagaaaagcacuuaaaguu

SEQ ID NO: 268223 - RNA, 64 nt, hsa
gggcaacauaauaagacuuuucucuacuuuaaauuuuuuaaaaaauuaguugggcauaguggca

SEQ ID NO: 268224 - RNA, 64 nt, hsa
ugucugcaguuuacaauguauuguaaaugaagauuuuuuaaauucuaucuugcugauuuuuuuu

SEQ ID NO: 268225 - RNA, 64 nt, hsa
aaugaagauuuuuuaaauucuaucuugcugauuuuuuuuaaauauaagaaacugguacuuggua

SEQ ID NO: 268226 - RNA, 64 nt, hsa
cuucaugcuauauaucuuuuguaagacauuuccuuuuuuaaaaaaauuuuugcaaauaacugau

SEQ ID NO: 268227 - RNA, 64 nt, hsa
aucuauguauaggagauaaaauuugcuaguaagauuuuuaaaaacuggcuagugaaaggaaagu

SEQ ID NO: 268228 - RNA, 64 nt, hsa
uacccauuauagcacaaaaucagccaaagcagaauuuuuaaaaauuggcuuuuuuaggauucuu

SEQ ID NO: 268229 - RNA, 64 nt, hsa
gcuguuuauauguucacaguuacuuuuuuuuuuuuuuuuaaauaaaagucauuuaauguagaau

SEQ ID NO: 268230 - RNA, 64 nt, hsa
gaaaauaaugguucuuuguuuuuaauguuaaccuuuuuuaaauacaauacugauaguuagaaga

SEQ ID NO: 268231 - RNA, 64 nt, hsa
ucauauuuucaagauguaauuuuacauuucugcauuuuuaaaacaguuuggccauaauccuaga

SEQ ID NO: 268232 - RNA, 64 nt, hsa
uugaaauucaguuuacagaaauuggagaaaaugcuuuuuaaacaaguguuuccuuucuucaaga

SEQ ID NO: 268233 - RNA, 64 nt, hsa
guucugucaguaauccauaagacagaaaucuguuuuuuuaaaaauaucuuuuucuccucucagc

SEQ ID NO: 268234 - RNA, 64 nt, hsa
gccaguaacguuuauuuaaaacaaaauauuuuaauuuuuaaauuuucccuuaaaacacacuuuu

SEQ ID NO: 268235 - RNA, 64 nt, hsa
uuaaauuuuguaaaaauaacuuauuuauaaauaauuuuuaaagagaaaaaucucauauaauuug

SEQ ID NO: 268236 - RNA, 64 nt, hsa
acuuugcagauauggacagccuuuacaaaaauaauuuuuaaaugcuuaauuauuuuaauuuguu

SEQ ID NO: 268237 - RNA, 64 nt, hsa
cagaagcauagacuguagaguaucuuuuuaagcauuuuuaaaaaaugcuuuuaaugcaucauac

SEQ ID NO: 268238 - RNA, 64 nt, hsa
cauuuguaauacauuuuccugauuugaaaguuuguuuuuaaaaguuuucuauuaauuauagugc

SEQ ID NO: 268239 - RNA, 64 nt, hsa
acccuaguuucagaagcauagauuguaguguaccuuuuuaaacuuuauuuuuuuaaaaaaaguu

SEQ ID NO: 268240 - RNA, 64 nt, hsa
gcauagauuguaguguaccuuuuuaaacuuuauuuuuuuaaaaaaaguuguuuuaugaaucaua

SEQ ID NO: 268241 - RNA, 64 nt, hsa
caugugguacuacugaagaaggugcauugauacauuuuuaaauguaaguugagaaaaauuuaua

SEQ ID NO: 268242 - RNA, 64 nt, hsa
acuacaguaguuccaguccuaacuuucugaauuauuuuuaaagaucuucucuaacaagcuaugg

SEQ ID NO: 268243 - RNA, 64 nt, hsa
agucacggugcacacauugcauuuucuaacuauguuuuuaaaaccucuuugaaugcugaaaggu

SEQ ID NO: 268244 - RNA, 64 nt, hsa
aaugcugaaaggucuucccucagcucacuuugaguuuuuaaaugacauuguuuuugaggcccua

SEQ ID NO: 268245 - RNA, 64 nt, hsa
gggauuggugggaaaugucaaaacaugcccuuuauuuuuaaaggcauucacaaacucucugacu

SEQ ID NO: 268246 - RNA, 64 nt, hsa
gucauuuguggcuagauagguuaagacaggugauuuuuuaaaguagacugucuuugcauuuugc

SEQ ID NO: 268247 - RNA, 64 nt, hsa
ggagcuuuuacauuaaaaaucuacuaacgccuacuuuuuaaaaaaugagauucuuucuaaucuu

SEQ ID NO: 268248 - RNA, 64 nt, hsa
cacaaacuauggugugcuuauguuuuuguuuugcuuuuuaaacugauguauagcuuuaacauuu

SEQ ID NO: 268249 - RNA, 64 nt, hsa
uaaauauacagcaugagauuguacauuuuuuacuuuuuuaaaauuguguucuuaaaauauugug

SEQ ID NO: 268250 - RNA, 64 nt, hsa
gaaaauacauuguguuuuccuaaacacacuuuucuuuuuaaaugugcuucauuguuugauuugg

SEQ ID NO: 268251 - RNA, 64 nt, hsa
uuucauuaguuuauuuguguuggguucuuuuuuuuuuuuaaaugaaaaguauaguauguggcac

SEQ ID NO: 268252 - RNA, 64 nt, hsa
uuuuuuuuuaaaugaaaaguauaguauguggcacuuuuuaaagaacaaaggaaauaguuuugua

SEQ ID NO: 268253 - RNA, 64 nt, hsa
cauguaaugcuuaguuuucuuguauuuacuucuuuuuuuaaauguaaggaccaaacuucuaaac

SEQ ID NO: 268254 - RNA, 64 nt, hsa
aacuucuaaacuaauuguucuuuuguugcuuuaauuuuuaaaaauuacauucuucugauguaac

SEQ ID NO: 268255 - RNA, 64 nt, hsa
ggaagucaaugcacuaacucaauaccaagaugaguuuuuaaauaaugaauauuauuuaauacca

SEQ ID NO: 268256 - RNA, 64 nt, hsa
aaaugugguuguaugagccaaucauauuugugauuuuuuaaaaaaaguuuaaaaggaaauaucu

SEQ ID NO: 268257 - RNA, 64 nt, hsa
guaggcagagcuagguuuauuuucucuuaaacaauuuuuaaaauucagaauguaaaaauugggu

SEQ ID NO: 268258 - RNA, 64 nt, hsa
aaaauaacaaaauugucuacagcuucuuacuaaguuuuuaaaauuauucauaaaaugcagacau

SEQ ID NO: 268259 - RNA, 64 nt, hsa
aaucaaucuuucuacuaauguaaauuugagauuauuuuuaaaaauggaauaaaagagguuuugg

SEQ ID NO: 268260 - RNA, 64 nt, hsa
gacaauauuguauucaacuguuuuauuuuuuauauuuuuaaaauuuaaaguauaauuaguuuuu

SEQ ID NO: 268261 - RNA, 64 nt, hsa
aagcaaacuaacuuuuuuuuuuuuaacaucuuuguuuuuaaaauagaaugauagaacuuugcca

SEQ ID NO: 268262 - RNA, 64 nt, hsa
uagggagaugaguugcaguuuuuauaauagauuuuuuuuaaaguuugguauuguaaaacauuca

SEQ ID NO: 268263 - RNA, 64 nt, hsa
cuguucaaauuuuuuuuuaacguggcuuguagaauuuuuaaaaaagugaucuuagguuuguuuu

SEQ ID NO: 268264 - RNA, 64 nt, hsa
uguaaaagaugaaggcuguaucuauuuuuuuuucuuuuuaaaguuuguucacuuaaauucuuuu

SEQ ID NO: 268265 - RNA, 64 nt, hsa
gcagaauuauuugcaauuuguagcauagaaaagauuuuuaaauuuuuuuacaaaagguuuuuaa

SEQ ID NO: 268266 - RNA, 64 nt, hsa
cauagaaaagauuuuuaaauuuuuuuacaaaagguuuuuaaacagauuaggguaggugaugguu

SEQ ID NO: 268267 - RNA, 64 nt, hsa
gaaaugauuguauuguaaacugaggcuaaauuuuuuuuuaaaccuguuucauguguuauaaagg

SEQ ID NO: 268268 - RNA, 64 nt, hsa
cuuaggguuuuguuagcccuuuuguacuacuuucuuuuuaaauugagaacaugguucuuuacau

SEQ ID NO: 268269 - RNA, 64 nt, hsa
ugaauguaaugguugauauauguacauucugauauuuuuaaaucuuuaacuuuuuaaaguuaaa

SEQ ID NO: 268270 - RNA, 64 nt, hsa
uauauguacauucugauauuuuuaaaucuuuaacuuuuuaaaguuaaaaaccuacagcugcuua

SEQ ID NO: 268271 - RNA, 64 nt, hsa
gcaugcagagaaaaucugugcauccucuuuuauauuuuuaaaauacuguuuaacauuugugaga

SEQ ID NO: 268272 - RNA, 64 nt, hsa
ucaaaacaggucccuaagacaauucuucagaucauuuuuaaaaugacuaagucauuuuaguaug

SEQ ID NO: 268273 - RNA, 64 nt, hsa
ugcuuuuauugaauggagugcuuuacaauuuuuauuuuuaaaugggguugggauccuuggaaua

SEQ ID NO: 268274 - RNA, 64 nt, hsa
uuguuaagccuguauuggucuuaaggugcaguauuuuuuaaauuauuauuuauagaaagaaucu

SEQ ID NO: 268275 - RNA, 64 nt, hsa
agaagauuaaaaaaaaaucucaauguaucagcuuuuuuuaaaggacauuacuagaaaauuaaac

SEQ ID NO: 268276 - RNA, 64 nt, hsa
ucucacccccaccguguauauacaugagcuaacuuuuuuaaauugucacaaaagcgcaucucca

SEQ ID NO: 268277 - RNA, 64 nt, hsa
caccuucuucuaauucaaaagguuuucuuuuucuuuuuuaaacuguaugcuaaaacguauuugu

SEQ ID NO: 268278 - RNA, 64 nt, hsa
gucguggaggcuaaaauacaaccgagaggggagauuuuuaaaaaagaaaaagaaacacaaauau

SEQ ID NO: 268279 - RNA, 64 nt, hsa
ggauaauuagcauugucagacuauaaaccuuugcuuuuuaaaguuuauuuuuacuauuucuuua

SEQ ID NO: 268280 - RNA, 64 nt, hsa
guacucuuugccuaugcauccccuuguuagauuuuuuuuaaauuuuaucuuacuguuuuuauaa

SEQ ID NO: 268281 - RNA, 64 nt, hsa
agacuucaguugagauguauacuuagcaaaauuauuuuuaaauugaaacagcacaguaaauacu

SEQ ID NO: 268282 - RNA, 64 nt, hsa
gauucugcugguacgagaggccuuccucuuucuguuuuuaaaaaaaguuuuacugccauauugg

SEQ ID NO: 268283 - RNA, 64 nt, hsa
aucaauuaauuuuuuuugaagcucauauuguaucuuuuuaaaaaccauguuguggaaaaaagcc

SEQ ID NO: 268284 - RNA, 64 nt, hsa
ucaucaugccacauuaucugauccaguccucacauuuuuaaauauaaaacuaaagagagaaugc

SEQ ID NO: 268285 - RNA, 64 nt, hsa
uaaaauuuacacuucuaagacuagagacccacauuuuuuaaaaaucauuuuauuuugugauaca

SEQ ID NO: 268286 - RNA, 64 nt, hsa
gauugagaauuauguaaauucaguacaaugucaguuuuuaaaagucaaaguuagaucaagagaa

SEQ ID NO: 268287 - RNA, 64 nt, hsa
acuucagucccauguuucagaagcuuuugucuauuuuuuaaacucauugauuaaauaaugauua

SEQ ID NO: 268288 - RNA, 64 nt, hsa
uuguuucaauuaccgcuagauuuuuuuuucucuuuuuuuaaaauccauuuuacuggaaaguugg

SEQ ID NO: 268289 - RNA, 64 nt, hsa
uuuuaugcauggcaccucuuuauaaugaagacacuuuuuaaaguuuuuguuuuuguuucaauua

SEQ ID NO: 268290 - RNA, 64 nt, hsa
uauaaguaaugaucuacauuuuuuaugaagaugguuuuuaaaacuuuuguuuuauuggaaugca

SEQ ID NO: 268291 - RNA, 64 nt, hsa
ccuuaccacaaaugagucauuuuuaaaauaugcauuuuuaaaugaauggcuuuuacagauaggu

SEQ ID NO: 268292 - RNA, 64 nt, hsa
guuacaguaaguaauccuuaccacaaaugagucauuuuuaaaauaugcauuuuuaaaugaaugg

SEQ ID NO: 268293 - RNA, 64 nt, hsa
agcauaauguuccugauguuaacagaagacuguauuuuuaaaguuacaaauuuguauauggaau

SEQ ID NO: 268294 - RNA, 64 nt, hsa
auaaguggucacauuuguuuugggcuuaaauuacuuuuuaaagauacuggauuuuccuaagauu

SEQ ID NO: 268295 - RNA, 64 nt, hsa
gauaugacuucccccccaaauuuuauuaugaacauuuuuaaaaacagaaaaauugaaaaacugu

SEQ ID NO: 268296 - RNA, 64 nt, hsa
aaaaucuuauuccuacuauuuuucuaauuauugcuuuuuaaauguauuguuuguuuacauuuaa

SEQ ID NO: 268297 - RNA, 64 nt, hsa
uacauuaagaugugcuuucauugcugguugucaguuuuuaaauucucuuuuucccuuauguuuc

SEQ ID NO: 268298 - RNA, 64 nt, hsa
uagggauaguuggaacuaauguacagaacuaaauuuuuuaaacuuuauuugcuguuaaauucug

SEQ ID NO: 268299 - RNA, 64 nt, hsa
uuuaaagaauaaaugaaacauuuuucugguuacuuuuuuaaaaauuuaaaauggaagggaagaa

SEQ ID NO: 268300 - RNA, 64 nt, hsa
uaccucuuuggccauuuguaugcaugauguuugguuuuuaaacaugguauaaugaauuguguac

SEQ ID NO: 268301 - RNA, 64 nt, hsa
uuugaaaguaagugaaauguaaauaaacuuauuuuuuuuaaaaaugccauaccucguguuucuu

SEQ ID NO: 268302 - RNA, 64 nt, hsa
aagacuacugaaauauagauaaagauugccuuaguuuuuaaaaauguuuggccauuaguauuuu

SEQ ID NO: 268303 - RNA, 64 nt, hsa
guauguauaaugguagguguuugugugugauucauuuuuaaagaaauauuuuucucaagcuccu

SEQ ID NO: 268304 - RNA, 64 nt, hsa
guaaauaaaaaugugugcucuuuacuguuuuucauuuuuaaagaauauuauuauggaagcacga

SEQ ID NO: 268305 - RNA, 64 nt, hsa
uguauacuucagugcucacccguaggcaaaucucuuuuuaaaaaacucuuuggugcacaaguaa

SEQ ID NO: 268306 - RNA, 64 nt, hsa
agcauaacuggaggguggguuggggagggguggauuuuuaaaaugucaagacagggaaggauga

SEQ ID NO: 268307 - RNA, 64 nt, hsa
gcuccaugcuuugaauacuauguggcugaaugaauuuuuaaaaucucaaagcaguuaaacagca

SEQ ID NO: 268308 - RNA, 64 nt, hsa
aggcgugagccacugagccagccagcauuaguaauuuuuaaaaacacuuuaucaguauuuuaaa

SEQ ID NO: 268309 - RNA, 64 nt, hsa
ugguuaaaauguuaaguuuuauguuuuauuacaauuuuuaaaugugucaaccaacuuuauagua

SEQ ID NO: 268310 - RNA, 64 nt, hsa
gauuacaggcaugagucaccaugccuggccucauuuuuuaaaacaaaugaauaaauggacaaau

SEQ ID NO: 268311 - RNA, 64 nt, hsa
ggcaagugaauuauuuuaaugauguaauaaaauauuuuuaaauuuugacauagugaucauuuaa

SEQ ID NO: 268312 - RNA, 64 nt, hsa
gcuguacaaugccugugauguugaggaggguucuuuuuuaaaguguaugcuugaguaacugacu

SEQ ID NO: 268313 - RNA, 64 nt, hsa
ccuuuuuguguucaacacagugaagauuaucugcuuuuuaaauuaauuuauuuacgauaucuag

SEQ ID NO: 268314 - RNA, 64 nt, hsa
uuugugcacuguguuuugcuuugcuuuguuuugguuuuuaaacagacuuaccuguaaaguuauc

SEQ ID NO: 268315 - RNA, 64 nt, hsa
aaucaaagaaagaaggccacguauguugggguaauuuuuaaaaauuuucagauuggcuaaauau

SEQ ID NO: 268316 - RNA, 64 nt, hsa
aaccacugaccauuuuuaucauauuuuaggccuuuuuuuaaaaaaucaggguauaguaggcacu

SEQ ID NO: 268317 - RNA, 64 nt, hsa
cuuuuacuuaacaugcauauguacuacagagggauuuuuaaauuaauugcaaaaugugcauuag

SEQ ID NO: 268318 - RNA, 64 nt, hsa
ccccuuuaaaauguauuucuuuagaggcauuacuuuuuuaaaaauauuggucaauuccugacau

SEQ ID NO: 268319 - RNA, 64 nt, hsa
guuguuguauuuuagaaggaauucagcucugauguuuuuaaagaaaaccagcaucucugauguu

SEQ ID NO: 268320 - RNA, 64 nt, hsa
aaguuccacaaaauccaaauuuaccauauuauuguuuuuaaaaaagcaguuuagagcaaacugu

SEQ ID NO: 268321 - RNA, 64 nt, hsa
aaaauuaauguuuaaaauguuuuuguaacaauaauuuuuaaaacccacacucuuccauauaugg

SEQ ID NO: 268322 - RNA, 64 nt, hsa
gauuacaggcgugagccaccgugccuggccgacauuuuuaaaaaaguuuuauuuugcacggcuc

SEQ ID NO: 268323 - RNA, 64 nt, hsa
aaacuuuaaguaauuauuuuuaaaguucuuauacuuuuuaaaagcuaucacacaaagacuuuuu

SEQ ID NO: 268324 - RNA, 64 nt, hsa
gcauaugagugaggaaauaaacuuuaaguaauuauuuuuaaaguucuuauacuuuuuaaaagcu

SEQ ID NO: 268325 - RNA, 64 nt, hsa
uguauuuuauauacucaguuuuauaaggugauacuuuuuaaauaagcgcuuuaaugaaaauggu

SEQ ID NO: 268326 - RNA, 64 nt, hsa
uaugaauuuaaaaccagguuuaccauguaauuuguuuuuaaauuuauguauacuagccuggccu

SEQ ID NO: 268327 - RNA, 64 nt, hsa
cucaagccuuguacaagcacauaugauguagacauuuuuaaaugugaagcuuuaacaggaauag

SEQ ID NO: 268328 - RNA, 64 nt, hsa
uuuuauaucauguuuauguccuaagagaagauauuuuuuaaaugccuuauggauaggaauuagu

SEQ ID NO: 268329 - RNA, 64 nt, hsa
gggauuauucuuugaaaacagaugaccauaauuuuuuuuaaagaagagugacuuauuuugucuu

SEQ ID NO: 268330 - RNA, 64 nt, hsa
uugaggcaaauuaacuguauguguguagguuaucuuuuuaaaaacucuucagugcaaauuguau

SEQ ID NO: 268331 - RNA, 64 nt, hsa
aguuuaaaagccauguauaaccaagugugcucuuuuuuuaaaagguagagucuuacaaucaaau

SEQ ID NO: 268332 - RNA, 64 nt, hsa
cauuagacuuuuugguuaaauaauugagauuuaauuuuuaaaagauauucuuacucauuugcua

SEQ ID NO: 268333 - RNA, 64 nt, hsa
caucuuaauauaucaugcaguaaaaggaagaaucuuuuuaaagugacccaccuuucaugcugcu

SEQ ID NO: 268334 - RNA, 64 nt, hsa
cugccaaacuuggggcaauugaugcuaaaugguauuuuuaaaauaaauguuuuuauucuuuacu

SEQ ID NO: 268335 - RNA, 64 nt, hsa
aggcguauaacugugugaguggccagauauucacuuuuuaaaucaaaaaccucucuuauggaag

SEQ ID NO: 268336 - RNA, 64 nt, hsa
auaaaaucagaaauagaugugagaaugguggaacuuuuuaaaagaacccagucaaauguauuuu

SEQ ID NO: 268337 - RNA, 64 nt, hsa
auugaaccuugaacaaaaacuuguaugacagacauuuuuaaaaaugugacaacacuuuuauucu

SEQ ID NO: 268338 - RNA, 64 nt, hsa
cagaauacauauuugaacaucauaguuguauauauuuuuaaaguagaauaaauaauggaaagca

SEQ ID NO: 268339 - RNA, 64 nt, hsa
auuuuagguacugaagaacuuaauauuggcaacauuuuuaaauccuuacucauacacuuguugg

SEQ ID NO: 268340 - RNA, 64 nt, hsa
cauacuguaaaccaugagcaguguuguuguuguuuuuuuaaacaguauauuugguggucucuuu

SEQ ID NO: 268341 - RNA, 64 nt, hsa
gguuugcguuccaaccugcaaaacacaaauacauuuuuuaaaaucaagaaaauuuaaaaagaca

SEQ ID NO: 268342 - RNA, 64 nt, hsa
guuauccacccaaguguacauauguaccuauuuuuuuuuaaaaagcagaaauagaaauacaaga

SEQ ID NO: 268343 - RNA, 64 nt, hsa
uuucuuuuugacuggacuuuuggguggugguagauuuuuaaacaaaugaaauuaaagcaacaau

SEQ ID NO: 268344 - RNA, 64 nt, hsa
aggcugagcaaacucauauuccaguuaguuggaguuuuuaaaggcucuguuugccuggagaagc

SEQ ID NO: 268345 - RNA, 64 nt, hsa
uguuuuguguauuuaucugccauuugcaucaugguuuuuaaaauuuauuauuauuauuauuauu

SEQ ID NO: 268346 - RNA, 64 nt, hsa
uucaguagcuccagguagaugagccuuuuuuuuuuuuuuaaaaauaccauauucaagggagucu

SEQ ID NO: 268347 - RNA, 64 nt, hsa
auaaagaacaaauagguccugcauuuuauaagacuuuuuaaagcuuuaauuauucaacuaagaa

SEQ ID NO: 268348 - RNA, 64 nt, hsa
uuaaaaaagaaaaguaguaaauuagcagcuuuuuuuuuuaaaugaagagaacuucaugaugauu

SEQ ID NO: 268349 - RNA, 64 nt, hsa
auaguauauucauuuauggaguuagcuguauuuuuuuuuaaaaaagaaaaguaguaaauuagca

SEQ ID NO: 268350 - RNA, 64 nt, hsa
uggguguccaagagaaaugguuuuugccaaacucuuuuuaaaaaacaaauuguugcuauuuccu

SEQ ID NO: 268351 - RNA, 64 nt, hsa
cuauaaauaagacuccauguuuuaauuuaugauguuuuuaaagcuguguaaaggaagaaugaag

SEQ ID NO: 268352 - RNA, 64 nt, hsa
aggccuuuuuaagaggaaucacaauaacugcagauuuuuaaacaaacaaaaucaccgaccuugc

SEQ ID NO: 268353 - RNA, 64 nt, hsa
acuuuuuuuaaacuuaagcauugucauaugcuauuuuuuaaaauuuggcuuuccuaggauuuua

SEQ ID NO: 268354 - RNA, 64 nt, hsa
uucuuccugguuuggagacuaagcugagaaacuuuuuuuaaacuuaagcauugucauaugcuau

SEQ ID NO: 268355 - RNA, 64 nt, hsa
auuucaauugcuuugugacuucuucuucuuuguuuuuuuaaauauuaugcugcuuuaacagugg

SEQ ID NO: 268356 - RNA, 64 nt, hsa
ccuuuccuaucuuuacaucuauguguauguugacuuuuuaaaauucugagugauccaggguaug

SEQ ID NO: 268357 - RNA, 64 nt, hsa
gccuucaguguacuguuucuuauuaacuuuacuuuuuuuaaaucaacuugcuauagacuuuaua

SEQ ID NO: 268358 - RNA, 64 nt, hsa
gcauaaaccuuccacucuugaacaaagcagcugcuuuuuaaaagcgguaauugcuucuuuaccu

SEQ ID NO: 268359 - RNA, 64 nt, hsa
auaaagucuuuugugaacaaggcauuuguagccauuuuuaaaaguuuuugucuucagugcuggu

SEQ ID NO: 268360 - RNA, 64 nt, hsa
cauucucuauggcuauauaauguacguaaaucuauuuuuaaagguucagaggaauccauaccaa

SEQ ID NO: 268361 - RNA, 64 nt, hsa
agagggaacuuuagcuuuauccauaacauuaauuuuuuuaaaaaauaaggucuuaauguuucau

SEQ ID NO: 268362 - RNA, 64 nt, hsa
gugugaucuaccacaccugucuaaaaaguauguauuuuuaaauuuuuuuguagagacaggaucu

SEQ ID NO: 268363 - RNA, 64 nt, hsa
uaucaagucauauugcuauguuaauugguuuuuuuuuuuaaaagguaaguuagugauuacuguu

SEQ ID NO: 268364 - RNA, 64 nt, hsa
ugcccuucacagugaaaaaaagaaaaaucuuucauuuuuaaaauuaggagauguuacguaacuu

SEQ ID NO: 268365 - RNA, 64 nt, hsa
caaacuucagaagaaagcugacauuuuaaugaauuuuuuaaaaaauuaauaaacaaauugucua

SEQ ID NO: 268366 - RNA, 64 nt, hsa
ugaauuuuuucauaauguaaugccguauuuauuguuuuuaaaaugaaaggaauacuaauaaguc

SEQ ID NO: 268367 - RNA, 64 nt, hsa
ggaggggagaacccagcgcaccccucccccccuuuuuuuaaacgcgugaugaagacagaaggcu

SEQ ID NO: 268368 - RNA, 64 nt, hsa
cuuuuaaagauuucuguauaagacuguugagcaguuuuuaaaauaguguaggauaauauaaaaa

SEQ ID NO: 268369 - RNA, 64 nt, hsa
ugccuuuuuaaggcaguuccguuaaggguuuuuguuuuuaaacuuuuuuuugccauccauccug

SEQ ID NO: 268370 - RNA, 64 nt, hsa
uuuuuuuuagaggcaggaucuugcuguccaauuuuuuuuaaaaagcuaaaauugccaacuuuag

SEQ ID NO: 268371 - RNA, 64 nt, hsa
auccaaccccagcaauuuauacaacgcugucauauuuuuaaaaaaacaaaaguaagccauccuc

SEQ ID NO: 268372 - RNA, 64 nt, hsa
uacuuauagugacucuacuguuugaaauacuauuuuuuuaaaucaaguuuuauaaaaguguaga

SEQ ID NO: 268373 - RNA, 64 nt, hsa
uagauuguugccuauuuccugcugaaaguaaauguuuuuaaaaaguaucauauaaagcugaaua

SEQ ID NO: 268374 - RNA, 64 nt, hsa
acuuauguggcuuuuugaccuuugaauagggaauuuuuuaaauuuuuuaaaaauuaaaauaaaa

SEQ ID NO: 268375 - RNA, 64 nt, hsa
gcuuuuugaccuuugaauagggaauuuuuuaaauuuuuuaaaaauuaaaauaaaaaaaacacau

SEQ ID NO: 268376 - RNA, 64 nt, hsa
cuucccauuuccuuugauguuauuuuguuacagcuuuuuaaauauuuuuuaaaauuauuuaacc

SEQ ID NO: 268377 - RNA, 64 nt, hsa
cuuugauguuauuuuguuacagcuuuuuaaauauuuuuuaaaauuauuuaaccccugggggcag

SEQ ID NO: 268378 - RNA, 64 nt, hsa
cuggggagaucacugccauuuuuacacacuugacuuuuuaaaaauacaaccaaccaaccaccac

SEQ ID NO: 268379 - RNA, 64 nt, hsa
ucucugaauauuuuagucucucucugagucucauuuuuuaaaaugcucuuuuagaacgggaaac

SEQ ID NO: 268380 - RNA, 64 nt, hsa
aagugcuuauaggcauuuuguuuauuuguuuuguuuuuuaaaaacacuguaacucaaugagacc

SEQ ID NO: 268381 - RNA, 64 nt, hsa
cuuacuaaaaucaaacgagacggauagaagcuacuuuuuaaagaauaucccacugcaucugcaa

SEQ ID NO: 268382 - RNA, 64 nt, hsa
ggagacgaagugaaaacaaaucuauaaauauauauuuuuaaaauauuuaacuuuuuuuuauggc

SEQ ID NO: 268383 - RNA, 64 nt, hsa
caguucucccagggagugagcagcuacuguaacuuuuuuaaauuaagacaaaaagccuugaaga

SEQ ID NO: 268384 - RNA, 64 nt, hsa
ccuuauuucuuaacugugcugggauugcaaacacuuuuuaaaaaauuguuugcuugaaaauacu

SEQ ID NO: 268385 - RNA, 64 nt, hsa
gugcacaguaguuuuuuuauugaaacuuguauuauuuuuaaagagaucuauacuauaaauaugg

SEQ ID NO: 268386 - RNA, 64 nt, hsa
gguaacaucuaaaacacaaguggguuuauuuaaauuuuuaaaauuugaaauuuuuuauuugcaa

SEQ ID NO: 268387 - RNA, 64 nt, hsa
auuuuaaugaauuaccuacuuuauuuuguuugucuuuuuaaagaagauaagauucugggcuugg

SEQ ID NO: 268388 - RNA, 64 nt, hsa
uacaacauacggauauaguauuuccuccucuuuguuuuuaaaaguuauaacauggcugaaaaga

SEQ ID NO: 268389 - RNA, 64 nt, hsa
aauguuucuuucaagaaaauauauuuggauggccuuuuuaaaguaacaggauauuuaauaagag

SEQ ID NO: 268390 - RNA, 64 nt, hsa
uucauagguucccacaauucaguaugggauaggcuuuuuaaaaagcacauacagaccaggcgug

SEQ ID NO: 268391 - RNA, 64 nt, hsa
auguagaauaugcucuuuaauuuaguaaaauauuuuuuuaaaagguagagaugcuuuguuauug

SEQ ID NO: 268392 - RNA, 64 nt, hsa
aacuuuaauacuaaaagcacuuuccauuauauacuuuuuaaaggucuagauaauuuugaaccaa

SEQ ID NO: 268393 - RNA, 64 nt, hsa
uuuuggcuaauuuuuaaccugagguuuuguuuuuuuuuuaaaggaaaugcagccuagucuugag

SEQ ID NO: 268394 - RNA, 64 nt, hsa
cauaccaacggucccuaguuauaggaauuuaauauuuuuaaaaguuuuacauugcuguauauuc

SEQ ID NO: 268395 - RNA, 64 nt, hsa
ugugugcucuguaaguuuguuuuaaauugcacuguuuuuaaagaaacuguagaggagcaacaaa

SEQ ID NO: 268396 - RNA, 64 nt, hsa
caaaaucaacucuguauaauagcacauucucuacuuuuuaaagaucagaaaugcuagaauucuu

SEQ ID NO: 268397 - RNA, 64 nt, hsa
aagguagugaugguggccacgugccucguugcuauuuuuaaaguaauauucagaugugguuuua

SEQ ID NO: 268398 - RNA, 64 nt, hsa
ugauuaaaguuuaauaguuaucaaaaucaccuaauuuuuaaaaauagcuuucguuuugaguucu

SEQ ID NO: 268399 - RNA, 64 nt, hsa
ucaguauauacuauuaguuauauuuaaaaauauuuuuuuaaauucuuuacagauaauauuauac

SEQ ID NO: 268400 - RNA, 64 nt, hsa
uuauaaaauagaccagaugacaaaauuuauuuuauuuuuaaacagugguuuugacacaaauuau

SEQ ID NO: 268401 - RNA, 64 nt, hsa
ccucucuaggguaacguguauauuuugguggagauuuuuaaaagcucagcaugagcaaucauuc

SEQ ID NO: 268402 - RNA, 64 nt, hsa
uauucucauggucuuaaauuaaauuauucaaguauuuuuaaauauccaauuuguugugauuuuc

SEQ ID NO: 268403 - RNA, 64 nt, hsa
uauggauuggaacacaaaaaaucuuuuuuuaaucuuuuuaaaaacugcugugguuuugcugcua

SEQ ID NO: 268404 - RNA, 64 nt, hsa
gagcuugggggacacaccuggcgagcaagcucgcuuuuuaaaaaugaaauuugggggcagggga

SEQ ID NO: 268405 - RNA, 64 nt, hsa
aauauauacaacagaacuuuuuaagauuaaaaaauuuuuaaaccucuaugucugaaaaaaaaaa

SEQ ID NO: 268406 - RNA, 64 nt, hsa
acuguuucuaaaguaaguguguauaaaagucuccuuuuuaaaaagaucauauuuuuaaauaaag

SEQ ID NO: 268407 - RNA, 64 nt, hsa
uguguauaaaagucuccuuuuuaaaaagaucauauuuuuaaauaaagcauuuuuuguagaaagu

SEQ ID NO: 268408 - RNA, 64 nt, hsa
uauggauaauggaauauguguuuguacauuccuguuuuuaaaagggcucagguuucacaugguc

SEQ ID NO: 268409 - RNA, 64 nt, hsa
auaacccacaggaaauucuuggaaacaucaauacuuuuuaaagagugucaagggguaugaagac

SEQ ID NO: 268410 - RNA, 64 nt, hsa
cuuauucuuagggcuuuuguguaugucugacuuguuuuuaaauaacuuccucagcaaugcagac

SEQ ID NO: 268411 - RNA, 64 nt, hsa
cuuccucagcaaugcagaccuuaauuuuuauauuuuuuuaaaguagcuaacauagcaguaggca

SEQ ID NO: 268412 - RNA, 64 nt, hsa
acagcacuuaaagggaauauaugagguuuuuuuuuuuuuaaaaaaaaacuuuuauuuauuauuu

SEQ ID NO: 268413 - RNA, 64 nt, hsa
ucuuaaaagggacucaguauauuaauuucugcauuuuuuaaaucaaaugaaaaacgucaaauug

SEQ ID NO: 268414 - RNA, 64 nt, hsa
ugaagucuucuuggauuucacccaacuaaaaggauuuuuaaaaauaaauaacagucuuaccuaa

SEQ ID NO: 268415 - RNA, 64 nt, hsa
auuguagccaguuguuaauaucuuaaugcagauuuuuuuaaaaaaaacauaaaaugauuuaucu

SEQ ID NO: 268416 - RNA, 64 nt, hsa
uucacuuuucucgaucacuaaacauaugcauauauuuuuaaaaaucaguaaaagcauuacucua

SEQ ID NO: 268417 - RNA, 64 nt, hsa
auauaauauacccuuacauuauguaugagggauuuuuuuaaauuauauugaaaugcugcccuag

SEQ ID NO: 268418 - RNA, 64 nt, hsa
guauacacugcuugcauaaacucaaccagcugccuuuuuaaagggagcucuaguccuuuuugug

SEQ ID NO: 268419 - RNA, 64 nt, hsa
gcuuuuaaguagcauuagcuaugcacacuugacauuuuuaaauaucccuuuccuaguguaccag

SEQ ID NO: 268420 - RNA, 64 nt, hsa
gaauaaggacuaguuauuuuuuuagugcugcauuuuuuuaaaguuggauugcugcuauuuaaaa

SEQ ID NO: 268421 - RNA, 64 nt, hsa
uuuuaauugucuaugcuuaaucaucuuuaaacacuuuuuaaauuucuaaccacaagaccucucu

SEQ ID NO: 268422 - RNA, 64 nt, hsa
acaaagcauuuagauuauuccagguuauaucauuuuuuuaaagauuuuccacagcuacuugagu

SEQ ID NO: 268423 - RNA, 64 nt, hsa
acaucccuaauaucacagggcuugugcauucagauuuuuaaaaaauuaggauagauaaggaaac

SEQ ID NO: 268424 - RNA, 64 nt, hsa
gacagagugagacucugucucaauuaauuuuuuuuuuuuaaaggaggaggaucuccauggguaa

SEQ ID NO: 268425 - RNA, 64 nt, hsa
aauuaaaaugauuuuauuuuggucugauggauguuuuuuaaaaggaaaauuauuauuaugaacc

SEQ ID NO: 268426 - RNA, 64 nt, hsa
gccaaugagguccaagaaguucucacccauugaauuuuuaaauggcuguucaguucauguugua

SEQ ID NO: 268427 - RNA, 64 nt, hsa
auaacugaaaaagacauuaccauagugcuuuacauuuuuaaaguaauguuacaaggucuggaau

SEQ ID NO: 268428 - RNA, 64 nt, hsa
uuuuaucucacagguuuguguaauuguuggaaaauuuuuaaacuucuaagugaaaguagucuga

SEQ ID NO: 268429 - RNA, 64 nt, hsa
agaggcuugugucuguugcacauuucuugaagcauuuuuaaaauaacauguaaccuguaaccuu

SEQ ID NO: 268430 - RNA, 64 nt, hsa
uauuguacaguuuaaaauguuagauguuuuuaauuuuuuaaauaaauggaauacuuuuuuuuuu

SEQ ID NO: 268431 - RNA, 64 nt, hsa
uaauuuuuuaaauaaauggaauacuuuuuuuuuuuuuuuaaagaaagcaacuuuacugagacaa

SEQ ID NO: 268432 - RNA, 64 nt, hsa
ucuucaaugacauagaaaguucauggaacucauguuuuuaaagggcuauguaaauauaugaaca

SEQ ID NO: 268433 - RNA, 64 nt, hsa
augcaaaauaaugucuuaagauucaaagucuguauuuuuaaagcauggcuuuggcuuugcaaaa

SEQ ID NO: 268434 - RNA, 64 nt, hsa
guacccuugccucccccacccccuucuuuuuuuuuuuuuaaacaaaucaguuuguuuugguacc

SEQ ID NO: 268435 - RNA, 64 nt, hsa
aguuuuuauauuucuaccagaaaaguaaaaaucuuuuuuaaaaguguuguuuuucuaauuuaua

SEQ ID NO: 268436 - RNA, 64 nt, hsa
uucaaguuuuucuaugguuauuuuuaaaucucuuuuuuuaaaugcuaaaauuaauguccucauu

SEQ ID NO: 268437 - RNA, 64 nt, hsa
ggcuugucaggguuuucaaguuuuucuaugguuauuuuuaaaucucuuuuuuuaaaugcuaaaa

SEQ ID NO: 268438 - RNA, 64 nt, hsa
gcacacuuaauaaguagccuauuuuuuaaaugucuuuuuaaaauguaaauauuuggaugaaguu

SEQ ID NO: 268439 - RNA, 64 nt, hsa
ugguuuguucaagcacacuuaauaaguagccuauuuuuuaaaugucuuuuuaaaauguaaauau

SEQ ID NO: 268440 - RNA, 64 nt, hsa
uuacuccuaaucaaugaagaaagugaguuggauauuuuuaaagcaguuaacuaauuuuuucuua

SEQ ID NO: 268441 - RNA, 64 nt, hsa
agagagaauuuuucucuccuuaauagaagcauccuuuuuaaagagaaguugccuugguccacac

SEQ ID NO: 268442 - RNA, 64 nt, hsa
gcauucauuuuucuaaaguaacaaauuugguuuuuuuuuaaaccauuaaaaucuaugugugugc

SEQ ID NO: 268443 - RNA, 64 nt, hsa
acuguaaagcauaucuauuaauaauucccccaauuuuuuaaacuaacaaaauggaauguuaacu

SEQ ID NO: 268444 - RNA, 64 nt, hsa
gaugaagucacuucaucuucucuccugccuuauuuuuuuaaauaaguuuuuagguccugacacu

SEQ ID NO: 268445 - RNA, 64 nt, hsa
guauuacucuuugccgucuuguauguagaggcuauuuuuaaaucauuaaauuuuuagaucucug

SEQ ID NO: 268446 - RNA, 64 nt, hsa
uugauugaucuacgcuaaguggagacauuucacauuuuuaaaaccaaauguucaaucuguauua

SEQ ID NO: 268447 - RNA, 64 nt, hsa
cagccgucuuuuguucuuucuuuccuguuuuccauuuuuaaacuaguaacagcaggccuuuugc

SEQ ID NO: 268448 - RNA, 64 nt, hsa
uucuugcagucauacugcuuauuuagugcuguauuuuuuaaacguuucuguucagagaacuugc

SEQ ID NO: 268449 - RNA, 64 nt, hsa
ugcuuuaaaaaaaaguuuuauaaguagggagaaauuuuuaaauauucuuacuuggauggcugca

SEQ ID NO: 268450 - RNA, 64 nt, hsa
uguuugguacaaacccagaaaggguauuucauaguuuuuaaaccuuucauucccagagauccga

SEQ ID NO: 268451 - RNA, 64 nt, hsa
uccauaaagacauuuauauaugugagcaagauuuuuuuuaaacaauuacuuuauuauuguuguu

SEQ ID NO: 268452 - RNA, 64 nt, hsa
ccccuauggggccugacugcacugauauauauuuuuuuuaaagagcaacugccacaugcgggau

SEQ ID NO: 268453 - RNA, 64 nt, hsa
uauaaaguuuuuuuauuucuuuugugcagaucacuuuuuaaacucacauagguagguaucuuua

SEQ ID NO: 268454 - RNA, 64 nt, hsa
cagcaugacaaaagugacagauguuauuuuuguauuuuuaaaaaacaauugguuguauauaaag

SEQ ID NO: 268455 - RNA, 64 nt, hsa
cuucuuuuuuggauauaaagauuuuuaaaugcauuuuuuaaaugcuaacaaaaaauaaaaacuu

SEQ ID NO: 268456 - RNA, 64 nt, hsa
auccaugguuguacuucuuuuuuggauauaaagauuuuuaaaugcauuuuuuaaaugcuaacaa

SEQ ID NO: 268457 - RNA, 64 nt, hsa
uaucugaacuacuuaaugauugcuuuacuuuuacuuuuuaaaaaauucagaaauccaauaaagg

SEQ ID NO: 268458 - RNA, 64 nt, hsa
ucucguuguaagagaauucacaccggagaacaacuuuuuaaaugccuucagugucaguugugcu

SEQ ID NO: 268459 - RNA, 64 nt, hsa
ugccaucuuccccugugagugacaugucuuuaauuuuuuaaaaaacuacuauuugaaaauugga

SEQ ID NO: 268460 - RNA, 64 nt, hsa
auuauugacugggcuuugggguugaacuuuuuuuuuuuuaaagaaagaaaaagaaacccuggga

SEQ ID NO: 268461 - RNA, 64 nt, hsa
uguuaauuuuuuucccucuuuccccacuuuuauuuuuuuaaauaagggauaacauauucuuuau

SEQ ID NO: 268462 - RNA, 64 nt, hsa
ggaaaaaguuuaaaaugggggaaaaaaagccaucuuuuuaaacaaaaauuauuuugccuacaga

SEQ ID NO: 268463 - RNA, 64 nt, hsa
ugccaagucagcauaugaggaauuaaagacauuguuuuuaaaaaaaaaaaaucauuuagaugca

SEQ ID NO: 268464 - RNA, 64 nt, hsa
aggaaccauuugcuuaaaccuggaacaucucaccuuuuuaaauccuaaaaaacacuggcaguua

SEQ ID NO: 268465 - RNA, 64 nt, hsa
caaaaaaauuuugacuuuuuaguacuaagcuuaauuuuuaaaaacaaaaucuguaggguugaca

SEQ ID NO: 268466 - RNA, 64 nt, hsa
uggguaggguaggggaaggaggauaagcuuuuguuuuuuaaaugacugaagugcuauaaaugua

SEQ ID NO: 268467 - RNA, 64 nt, hsa
guggucuuccccgccaugauucacauuugaugaguuuuuaaaaaucaaagugauuuugaaaauc

SEQ ID NO: 268468 - RNA, 64 nt, hsa
auuacuucccuucaaaucugccuuugaaucaucauuuuuaaaaaaaaauuaacauguuuuuguu

SEQ ID NO: 268469 - RNA, 64 nt, hsa
ugagagaaaguauuugaaaaugauuuuuaaauguuuuuuaaaagacacaucugacauuuuuaac

SEQ ID NO: 268470 - RNA, 64 nt, hsa
agaaaucuagaugagagaaaguauuugaaaaugauuuuuaaauguuuuuuaaaagacacaucug

SEQ ID NO: 268471 - RNA, 64 nt, hsa
gauuagccaacaucuuugcuaucaagaccacuuguuuuuaaauaaagaugcaagugucaguugu

SEQ ID NO: 268472 - RNA, 64 nt, hsa
agcagucuuuaugucucuuaacauucacaccuacuuuuuaaaaacaaauauuauuacuauuuuu

SEQ ID NO: 268473 - RNA, 64 nt, hsa
cuugaguucuuucuccuucucucucucucuuuuuuuuuuaaauaacucuucugggaaguugguu

SEQ ID NO: 268474 - RNA, 64 nt, hsa
uuaagcaagacccuucugaaauaaaaaauguugcuuuuuaaauaguuuguccuaagguguuuaa

SEQ ID NO: 268475 - RNA, 64 nt, hsa
auuuauguaggaagaaacuugauuuucaaauaauuuuuuaaauguaucucuugccuaaaggacu

SEQ ID NO: 268476 - RNA, 64 nt, hsa
uuuagcauuuuauacagucaacuuuguaaugaacuuuuuaaaaauuaauugauuuuccuuuggg

SEQ ID NO: 268477 - RNA, 64 nt, hsa
acuaagacaugucaauauucuuuuuuaaaguuuuuuuuuaaaauauugauuugaaugcaguagg

SEQ ID NO: 268478 - RNA, 64 nt, hsa
guuauucuucugaacuaagacaugucaauauucuuuuuuaaaguuuuuuuuuaaaauauugauu

SEQ ID NO: 268479 - RNA, 64 nt, hsa
cucuagucagaguauaauuuugguuguaauuaaauuuuuaaaaucugcugaucucuguagaauc

SEQ ID NO: 268480 - RNA, 64 nt, hsa
uguuuuauuuaugaaguuuuuauuuuaaacauuuuuuuuaaaaauuagccuugauauucuccag

SEQ ID NO: 268481 - RNA, 64 nt, hsa
caaaaauguauuuauauucaccugaguuuuaauguuuuuaaacaaaguuuucuccugcagugcu

SEQ ID NO: 268482 - RNA, 64 nt, hsa
guccuuuauguguuguucuccugggagacuucuuuuuuuaaaugccagggcuacuucugcuuua

SEQ ID NO: 268483 - RNA, 64 nt, hsa
gacuguggcuugauguugauacacauuugaauuuuuuuuaaaaaaagaaaguuaucguagccag

SEQ ID NO: 268484 - RNA, 64 nt, hsa
uacccuagaaggaagaggugaaggaucuggcuuguuuuuaaagcuuuauuuauuaaaccauauu

SEQ ID NO: 268485 - RNA, 64 nt, hsa
ucaagaaaaugcaaguugccaagagcucugauauuuuuuaaaaagaauuuuuuuguaaagauca

SEQ ID NO: 268486 - RNA, 64 nt, hsa
uauuuuccuuaaauaugugauuucagacuauuccuuuuuaaaaucauuuguguuuauucuucau

SEQ ID NO: 268487 - RNA, 64 nt, hsa
uugagcucucuaaccuccuuuuugucuuauagacuuuuuaaaauguacauaaagaauuuaagaa

SEQ ID NO: 268488 - RNA, 64 nt, hsa
gagccacuuagccugaaugggaaacgugagacuauuuuuaaacacacaccucuaaggaagaagc

SEQ ID NO: 268489 - RNA, 64 nt, hsa
gcucaucuagggucaccucauuuuccuaaauauguuuuuaaagcaauuauuguaguaauuucau

SEQ ID NO: 268490 - RNA, 64 nt, hsa
gaaauuguaagcuuuauuuggauuuuuaaauacauuuuuaaaauuucagauguaauuuaacauc

SEQ ID NO: 268491 - RNA, 64 nt, hsa
aaaggaaauaaggaaauuguaagcuuuauuuggauuuuuaaauacauuuuuaaaauuucagaug

SEQ ID NO: 268492 - RNA, 64 nt, hsa
auguagcauuaucacacuguauuuaaauugucauuuuuuaaaggaauauuuucuucuuaagaua

SEQ ID NO: 268493 - RNA, 64 nt, hsa
uuuugaaaccacugauugcaaaccucccugacaauuuuuaaaaguaguaagccacauuacauuu

SEQ ID NO: 268494 - RNA, 64 nt, hsa
caagcucuuaagaaauacaaggacuucagauccauuuuuaaauaagaauuuucgauuuuucuuu

SEQ ID NO: 268495 - RNA, 64 nt, hsa
gaauugcuuuugaagucugucaguauuacugguauuuuuaaauaaagaagaauuuuucuccaau

SEQ ID NO: 268496 - RNA, 64 nt, hsa
auuuugaugguaacaguuaauuucuuucauuaguuuuuuaaauucaggguucuggauauuaaau

SEQ ID NO: 268497 - RNA, 64 nt, hsa
uuucacaauucauuuucuacuaaauguguaccauuuuuuaaauuguuuuaacagaaauauagag

SEQ ID NO: 268498 - RNA, 64 nt, hsa
acuuuguagccagcaugugucuguaauuguaugauuuuuaaaucaucaucaaaagauuaaauua

SEQ ID NO: 268499 - RNA, 64 nt, hsa
agucacaaauauaacaaaguucauuguuuuaggguuuuuaaaaaacguguuguaccuaaggcca

SEQ ID NO: 268500 - RNA, 64 nt, hsa
uucugauagucuccugcuguuuuaccccuuccauuuuuuaaaauaagaaauuagcagcccucug

SEQ ID NO: 268501 - RNA, 64 nt, hsa
aauagcugauuauuguauaugcaaauuacaugcauuuuuaaaaacuauucuuucugaacuuauc

SEQ ID NO: 268502 - RNA, 64 nt, hsa
uccauucguauuuguauuagauauagagugacuauuuuuaaagcauguuaaaaauuuagguuuu

SEQ ID NO: 268503 - RNA, 64 nt, hsa
aaauaaaaaaggaauuauguggucagugcauuguuuuuuaaacuggaaaucauuuuguuuuaaa

SEQ ID NO: 268504 - RNA, 64 nt, hsa
uaguaccacguguagcauuuugaaacauuauuuuuuuuuaaaaaaugcugucuugcuuuagcua

SEQ ID NO: 268505 - RNA, 64 nt, hsa
aaaaacuaagguuauuugaauguucuguuuucucuuuuuaaauauuuuauaacuuuuaaaugga

SEQ ID NO: 268506 - RNA, 64 nt, hsa
gauaaaauaauaccauugauauucuuguuuauucuuuuuaaauaaaaaugucacaaguuuaaua

SEQ ID NO: 268507 - RNA, 64 nt, hsa
augauguaauucuucaauuuuuauaaucuuaaaauuuuuaaauuuuauauuuguaaauacagua

SEQ ID NO: 268508 - RNA, 64 nt, hsa
aaucaugcuuaaaugguugauucuccaauuucuuuuuuuaaaaauaaguuaauugcuuuugcag

SEQ ID NO: 268509 - RNA, 64 nt, hsa
guugcauuguaggagcaaacaaggcuucauauucuuuuuaaaaugacuugaaauuuuauuauaa

SEQ ID NO: 268510 - RNA, 64 nt, hsa
uucaaaauauguagaaacauuacuaugaaaucaguuuuuaaaagauauacuuucucuuuguccu

SEQ ID NO: 268511 - RNA, 64 nt, hsa
uaauuaaaaacaagcaaaacaaaacaagacuuaguuuuuaaaugaccaaacuuguccuuaaaga

SEQ ID NO: 268512 - RNA, 64 nt, hsa
augcuccuggccuuaaacaucaccguaggaaggguuuuuaaaauuuuacgcgcaaaacuccgug

SEQ ID NO: 268513 - RNA, 64 nt, hsa
guguauauuuuuuaugaaacauuacaguuagagauuuuuaaauaaagaauuuuaaaacucguuu

SEQ ID NO: 268514 - RNA, 64 nt, hsa
cacuuuuggcuuguaaaguacagacuuuuuuuuuuuuuuaaacaaaaaaagcauuguaacuuau

SEQ ID NO: 268515 - RNA, 64 nt, hsa
uauuaaugaguuuuaaagauguaaaaccuaaccuuuuuuaaagcuccauugucuuauguuuuua

SEQ ID NO: 268516 - RNA, 54 nt, hsa
uccaucaugcauucagauaauugauuuuuaaaguguauuuuucguauucuggaa

SEQ ID NO: 268517 - RNA, 64 nt, hsa
uuuguuuuauaguuaugcuuuuuaaaauucauuguuuuuaaauuuagacuucuuauuuccacac

SEQ ID NO: 268518 - RNA, 64 nt, hsa
agcacaagcauuaacuuuuguuuuauaguuaugcuuuuuaaaauucauuguuuuuaaauuuaga

SEQ ID NO: 268519 - RNA, 64 nt, hsa
uuagauaggccuuucaguaacacaggugaagaaauuuuuaaaaauacauugauuauuaucuagg

SEQ ID NO: 268520 - RNA, 64 nt, hsa
guuuucuggaggguuuuuuuuccaucuuuguauuuuuuuaaauuugauucuuuucuuugcaaug

SEQ ID NO: 268521 - RNA, 64 nt, hsa
cugugaacuuaaaacugcucuaaaaaaaauaucuuuuuuaaaaaagagagaauuagcauugugu

SEQ ID NO: 268522 - RNA, 64 nt, hsa
gauuugggguggaaauauuuugaauauuaauuuauuuuuaaagaugcaagauaggacuuugugc

SEQ ID NO: 268523 - RNA, 64 nt, hsa
gaugcuauuaagagguuuaaauaaagaguuuuaauuuuuaaaagggcaugggauauaaacaguc

SEQ ID NO: 268524 - RNA, 64 nt, hsa
cuagguguaaaaaucauguguugcagcuuuauaguuuuuaaaauauuuuagauaauucuuaaac

SEQ ID NO: 268525 - RNA, 64 nt, hsa
acagcgugggacccuucagccacuacaacagaauuuuuuaaauugacaguugcagaauugugga

SEQ ID NO: 268526 - RNA, 64 nt, hsa
gugcagagggagaaaugguuuuguuuuuguuuuguuuuuaaauggagcccugaggcaucagcua

SEQ ID NO: 268527 - RNA, 64 nt, hsa
guaucugcucauguaugugauuugacaaaccaguuuuuuaaaauaaauggcuuuuuaaaaaucu

SEQ ID NO: 268528 - RNA, 64 nt, hsa
ugauuugacaaaccaguuuuuuaaaauaaauggcuuuuuaaaaaucugggcuuauauugucaga

SEQ ID NO: 268529 - RNA, 64 nt, hsa
aaaaaaaucugaggauagugcuuuacucuuucuguuuuuaaagggcacucuaugaauugauuua

SEQ ID NO: 268530 - RNA, 64 nt, hsa
uuuaaaaauguuacugcuaaagauacauuauccuuuuuuaaaaagucuccauucaaauuaaauu

SEQ ID NO: 268531 - RNA, 64 nt, hsa
uguuauaagucucuuccuuucucaaauaaaguuuuuuuuaaaagauccccuuucauacacuugg

SEQ ID NO: 268532 - RNA, 57 nt, hsa
cuuucaggugcaacuucuaaaaaaagauuuuuaaacacuuaaugggaaacuggaauu

SEQ ID NO: 268533 - RNA, 64 nt, hsa
aacagauacaaccuuaaucuuaaaagauuauugcuuuuuaaaguguguaguuuuaugcaugugu

SEQ ID NO: 268534 - RNA, 64 nt, hsa
auauaacuaguuucaguuuuaucuaauaacuuacuuuuuaaaucaauauuuaucaacaaucuuu

SEQ ID NO: 268535 - RNA, 64 nt, hsa
cgaguauuuuaaauacugaauucauaguuguuguuuuuuaaauuccaacaguaacagcugaaug

SEQ ID NO: 268536 - RNA, 64 nt, hsa
ucuuuacugcaugcauagcacuuaauaaaauggauuuuuaaaaaauccacuaguaauaucagaa

SEQ ID NO: 268537 - RNA, 64 nt, hsa
gacuucuacauaggaaagcuaaaauauguuaauauuuuuaaauuaaagguuuaauaucagaaug

SEQ ID NO: 268538 - RNA, 64 nt, hsa
cagauaaucuggagguuagcauuugauaaaugauuuuuuaaaguagauaugaagauuuuguuaa

SEQ ID NO: 268539 - RNA, 64 nt, hsa
uuuuucccccuacuuucuugcuucuguuucacauuuuuuaaaagggcaaguacaggagcaacug

SEQ ID NO: 268540 - RNA, 64 nt, hsa
gaaaucuaauuauucaguuauucaugacaauauuuuuuuaaaaguaagaaauucugaguugucu

SEQ ID NO: 268541 - RNA, 64 nt, hsa
aauuauuaagucaccuaucaccuuuaaacgccuuuuuuuaaaauuauaaaauauuguaaagcag

SEQ ID NO: 268542 - RNA, 64 nt, hsa
aaaaaucaccaauuuuuuacauauaaaagauaccuuuuuaaaaaaauagguuuuaagagcucuu

SEQ ID NO: 268543 - RNA, 64 nt, hsa
caccguguccggccguaguuuauuuuaaaauauauuuuuaaaagcuuuguaaaaauuaugucau

SEQ ID NO: 268544 - RNA, 64 nt, hsa
cuauuuccuaaauaucauucuauacaaaagauauuuuuuaaacgguaaggauuaagacaaucac

SEQ ID NO: 268545 - RNA, 64 nt, hsa
gugucccucaccaguuccuugcaggauuccuucguuuuuaaaugcccuugaaucuagcuuugcc

SEQ ID NO: 268546 - RNA, 64 nt, hsa
guagauguuagaaaaccuaaauuaaugaaccauauuuuuaaaauccuauuuuucccaaacaggg

SEQ ID NO: 268547 - RNA, 64 nt, hsa
cacagcuccaacugugcaugcucaaaaugugcacuuuuuaaaauuguuacuuuuaaugcguauc

SEQ ID NO: 268548 - RNA, 64 nt, hsa
aauuacaugaaacaugaaacaguuuuugcaauuuuuuuuaaacugggcaucugguuucuaaaaa

SEQ ID NO: 268549 - RNA, 64 nt, hsa
uuauuaucuuguacccucuuuuuuuuuuuuuuuuuuuuuaaagacagagucuugcucugucacc

SEQ ID NO: 268550 - RNA, 64 nt, hsa
uacuuguguaaaagggcuucaagaauauauccaauuuuuaaauauuuuaauauaucuccuaucu

SEQ ID NO: 268551 - RNA, 64 nt, hsa
uuuuuaugagaaguauauuauauuaaaugugaauuuuuuaaauuuugcuucuuauacuggaagg

SEQ ID NO: 268552 - RNA, 64 nt, hsa
uuauauauauagcgaauaaaucuaguuguauaaauuuuuaaaugccgucaguagaaagcacaca

SEQ ID NO: 268553 - RNA, 64 nt, hsa
uucuuuaguguuucugauuugcuaucaguagcuguuuuuaaagccguccaaggaaaauaauuau

SEQ ID NO: 268554 - RNA, 64 nt, hsa
aaaauauauacguacugagguuuguaaacuguccuuuuuaaaucaaacugaaaacaaaaagcuu

SEQ ID NO: 268555 - RNA, 64 nt, hsa
acugaaaacaaaaagcuuuaaccuuucaacagaauuuuuaaaaaggcaguuaguucuaaauuau

SEQ ID NO: 268556 - RNA, 64 nt, hsa
ucaggguggcauuaaaauggacuccaaaaacauuuuuuuaaauguucuguaagauaaacuguau

SEQ ID NO: 268557 - RNA, 64 nt, hsa
aaacuguauauuucauauguaccuguuaagguacuuuuuaaagcuuguacaugaaccuuuguau

SEQ ID NO: 268558 - RNA, 64 nt, hsa
cagugcucuuucguuguauuuuucucauuuuugcuuuuuaaaauuccuuuaaaaaaugugcugu

SEQ ID NO: 268559 - RNA, 64 nt, hsa
uugaucuugacauuuaaugucacaaaguuuuguuuuuuuaaaaagugauuuaaacuuaagaucc

SEQ ID NO: 268560 - RNA, 64 nt, hsa
auaguaagaaaguaugguucuguauggcaauagguuuuuaaaauuauuagcuauucaucaugug

SEQ ID NO: 268561 - RNA, 64 nt, hsa
ucugagcuauuucaucuauuuuuggcagucugaauuuuuaaaacccauuuaaauuuuuuuccuu

SEQ ID NO: 268562 - RNA, 64 nt, hsa
guguacauaacugaaaaugugcuauacugcauacuuuuuaaauguaaagauauuuuuaucuuua

SEQ ID NO: 268563 - RNA, 64 nt, hsa
uauuggaguccaaaacuugaauucuggguugaauuuuuuaaaaaucagguaccacuugauuuca

SEQ ID NO: 268564 - RNA, 64 nt, hsa
augaaugugaacauguagauguuuuguguguauuuuuuuaaaugaaaacucaaaauaagacaag

SEQ ID NO: 268565 - RNA, 64 nt, hsa
acucaaaauaagacaaguaauuuguugauaaauauuuuuaaagauaacucagcauguuuguaaa

SEQ ID NO: 268566 - RNA, 64 nt, hsa
gguuauuuagcuagcuuaguguugaacuaaauuuuuuuuaaacaaggcaaggucuaaugcuguu

SEQ ID NO: 268567 - RNA, 64 nt, hsa
caauaaaauauuucauuagcuugaauuguauagauuuuuaaaaauucaaugaaagcauguuguu

SEQ ID NO: 268568 - RNA, 64 nt, hsa
uuaaaaauucaaugaaagcauguuguuuaauuucuuuuuaaaaucacuguugggcuuugaaagc

SEQ ID NO: 268569 - RNA, 64 nt, hsa
agucagugcuucuaaaaagaauuuaagauaaugguuuuuaaaaugccuuuauaauaagcuuugu

SEQ ID NO: 268570 - RNA, 64 nt, hsa
uaaaauugcaauuguauuagguguuaaaauaaaguuuuuaaaaaauuacuuguauuuauacuuu

SEQ ID NO: 268571 - RNA, 64 nt, hsa
acaggacucaauaauggugggugaacauuagucauuuuuaaaagacaccucuuauagcaauaag

SEQ ID NO: 268572 - RNA, 64 nt, hsa
uuaaauauuucaguauuauauagaaaaaaauagauuuuuaaaauucagaauggacaaagagaau

SEQ ID NO: 268573 - RNA, 64 nt, hsa
cgacuuuggaaggaaaguuuuguuaaccuuuuuuuuuuuaaaaggaagaaagcggauuuuggaa

SEQ ID NO: 268574 - RNA, 64 nt, hsa
uuuaaaaggaagaaagcggauuuuggaauugcauuuuuuaaagcaccacucuugauuuucuggg

SEQ ID NO: 268575 - RNA, 64 nt, hsa
aaagaccuaugagcaaauggugcugaauacuuuuuuuuuaaagccacauuucauugucuuaguc

SEQ ID NO: 268576 - RNA, 64 nt, hsa
agcaggauuauuaagugauuauuuaaaauucguuuuuuuaaauuagcaacuucaaguauaacaa

SEQ ID NO: 268577 - RNA, 64 nt, hsa
uguaaacaaauggggacaaugcauccaaaaaaucuuuuuaaacagauuacacaaaaauuauuuc

SEQ ID NO: 268578 - RNA, 64 nt, hsa
aauuuuaaacaugauguuuuagaaguguuucugauuuuuaaaccugguuuacagguauuacuuc

SEQ ID NO: 268579 - RNA, 64 nt, hsa
guucuagauuuuacuaaguuuuauuuugucagguuuuuuaaauuuuuucagugagcguggugac

SEQ ID NO: 268580 - RNA, 64 nt, hsa
uaugguguaauaggaauaauauuuauccaaaagauuuuuaaaaauagggcuguguuuaaaaaaa

SEQ ID NO: 268581 - RNA, 64 nt, hsa
uuccuggaguuaauuuguuuuacaggaauuuuguuuuuuaaaaaaauaggaucauucugaacuu

SEQ ID NO: 268582 - RNA, 64 nt, hsa
ucauuucuuaucaucacuuuuugucuuuucuuguuuuuuaaaauauacauuuuauuuuugaagg

SEQ ID NO: 268583 - RNA, 64 nt, hsa
uaauaguuuuacguuguacauaauaguguaaaccuuuuuaaaaaggaaaguauaaaaacaaaag

SEQ ID NO: 268584 - RNA, 64 nt, hsa
gugcaguuauaaagaaauugaugagguuuuuaccuuuuuaaaauauugguuagaaguucaaaaa

SEQ ID NO: 268585 - RNA, 64 nt, hsa
uagaaugacuaaacagcugucuuucaggguaucauuuuuaaagguauaaggaacaaacuuuaau

SEQ ID NO: 268586 - RNA, 64 nt, hsa
ggcuucaccuuauuacaugcuauuuuauuuugcuuuuuuaaaaacucaggacauuaacuaauuu

SEQ ID NO: 268587 - RNA, 64 nt, hsa
uaauuuucuuuaguguauuuuaaacacgauucaguuuuuaaaagaucgaucuacauacaauaga

SEQ ID NO: 268588 - RNA, 64 nt, hsa
ucucaguauuugauuuuuuuccccaauauuugauuuuuuaaaaauauacacauaggugcugcau

SEQ ID NO: 268589 - RNA, 64 nt, hsa
uuuauauacuuuauaaugauagaaguccaaccguuuuuuaaaaaauaaauuuaaaauuuaacag

SEQ ID NO: 268590 - RNA, 64 nt, hsa
uuaaaggaacccggguucuuagauuuuguuagacuuuuuaaacucaaggaugagcauaagugcu

SEQ ID NO: 268591 - RNA, 64 nt, hsa
ugcauacuuauuucuacaugguuuaaaucgacuguuuuuaaaaugacacuuauaaauccuaaua

SEQ ID NO: 268592 - RNA, 64 nt, hsa
ucucaucauccacaguagaauuuuuaaacagauuuuuuuaaagcuuuucuuuuaaauuuuucuc

SEQ ID NO: 268593 - RNA, 64 nt, hsa
gacuauuucucuacucucaucauccacaguagaauuuuuaaacagauuuuuuuaaagcuuuucu

SEQ ID NO: 268594 - RNA, 64 nt, hsa
gggcgggaaauaauuguguacauaaaauuaggcuuuuuuaaaaaaauagauuaugaugcagaau

SEQ ID NO: 268595 - RNA, 64 nt, hsa
ggcaaguaaccccgccuccacaaucuuaguauuuuuuuuaaacugcaugccugccccuuauuug

SEQ ID NO: 268596 - RNA, 64 nt, hsa
ccaucuaagaauacagaaccaaauuggauccauuuuuuuaaaaaaaugguuuugcauggaaccu

SEQ ID NO: 268597 - RNA, 64 nt, hsa
auguugcuauagugacaugcaguuauauauuuuguuuuuaaaagggggggagcaaaagaaacac

SEQ ID NO: 268598 - RNA, 64 nt, hsa
uauuccuaugacaaaaaaaauuaagucuucaaauuuuuuaaagguuuuuuuuuuuuaauuuaau

SEQ ID NO: 268599 - RNA, 64 nt, hsa
auuuaagcagcuugaaugguuuuucuuuucuuuauuuuuaaagaaaugcacuugccuaugauac

SEQ ID NO: 268600 - RNA, 64 nt, hsa
uaagauaucuuaccuguuuguuauuaaccaaauauuuuuaaaaauauuuccuccauaaauauuc

SEQ ID NO: 268601 - RNA, 64 nt, hsa
cuacaaauaauuauuuaaacauuuuuauacaauguuuuuaaaacuguuggauuaucaccagauu

SEQ ID NO: 268602 - RNA, 64 nt, hsa
aauaauaacugaaaagacuauguagugaaauguauuuuuaaaaacuauauucaguaaaagccug

SEQ ID NO: 268603 - RNA, 64 nt, hsa
uugacuggauaaacuuuacauaaaauuaacuaauuuuuuaaauaaaugcauugcuuaaugguuu

SEQ ID NO: 268604 - RNA, 64 nt, hsa
aguaagcagguacuacauuuauaauggaaggaauuuuuuaaaaaauuuuaagcuguacacuuuc

SEQ ID NO: 268605 - RNA, 64 nt, hsa
uucuauaugcuuuccuuuuaaaaucagauuuuaguuuuuaaaauacugauacauccauuuugau

SEQ ID NO: 268606 - RNA, 64 nt, hsa
gccaaaauauuuugcuuuauguauauuacaguucuuuuuaaaacacuggaagacucauguuaaa

SEQ ID NO: 268607 - RNA, 64 nt, hsa
ucauauugauuaaaacaguuaacaaacuuuuuucuuuuuaaaaugugagaucagugaacucugg

SEQ ID NO: 268608 - RNA, 64 nt, hsa
uauuaggagacuaaacauugaaaacuuucacugauuuuuaaauuggaguaauagccuaaauaag

SEQ ID NO: 268609 - RNA, 64 nt, hsa
gaccuaccucugaaaaauguguagauuaaaugaguuuuuaaagcacuuuagaaaauauaaggga

SEQ ID NO: 268610 - RNA, 64 nt, hsa
guggcuaugagaauaugauuuaugccauuuucuguuuuuaaaucuagaagaucuucuaagcaca

SEQ ID NO: 268611 - RNA, 64 nt, hsa
gcauuaaugcacccaugaccaccauucacuuaaauuuuuaaaagaacaguauauucuuuuuuuc

SEQ ID NO: 268612 - RNA, 64 nt, hsa
uauuuagguaagcauaaaaacauaggggcuaucauuuuuaaagacuugauuuucucuauugugg

SEQ ID NO: 268613 - RNA, 64 nt, hsa
auggcucuuguuccacuauuaacauuguuuuuaauuuuuaaaauccuaucagcagccuccuaau

SEQ ID NO: 268614 - RNA, 64 nt, hsa
uuggcugcacauucauaccaaucaccaggggauuuuuuuaaaauccugaugcccaacuugcacu

SEQ ID NO: 268615 - RNA, 64 nt, hsa
ucaaaauuaaaguuauaucuaauaucuuugacauuuuuuaaaguguguucauuugucagugaau

SEQ ID NO: 268616 - RNA, 64 nt, hsa
uuccauaggaaaaauuuugacaauguggaguuuuuuuuuaaaaagugguuuguuacuuugacuu

SEQ ID NO: 268617 - RNA, 64 nt, hsa
aacuuauucuugaaacuaaauauaguaaagaggguuuuuaaaauaauauuuaacauacgaauua

SEQ ID NO: 268618 - RNA, 64 nt, hsa
aaauauguacaaauauuauauaucaauaaauaaauuuuuaaagaguaagugcuauuggcauucc

SEQ ID NO: 268619 - RNA, 64 nt, hsa
uuacuggaaaugacaaguuuuugcuugauuuuuuuuuuuaaacaaaaaaugaaauauaacaaga

SEQ ID NO: 268620 - RNA, 64 nt, hsa
ugaugaaauaggcuauccacucgggauggcuuacuuuuuaaaaggguagggggaggggcugggg

SEQ ID NO: 268621 - RNA, 64 nt, hsa
agagcauguccuaguucaauguugacuuuuuuuuuuuuuaaagaaaagcauuaagacauaaaau

SEQ ID NO: 268622 - RNA, 64 nt, hsa
uuugaagaaaauaucuuguuuucugccaauagauuuuuuaaaauguagucagcaaaaugggggu

SEQ ID NO: 268623 - RNA, 64 nt, hsa
aaacaaaaagaaaagaaaauuuuuguaguagcguuuuuuaaauguauacuauaguaccaguagg

SEQ ID NO: 268624 - RNA, 64 nt, hsa
gaauaggucagaucuuggccucccaaaccccuuauuuuuaaaauacuuugcgccuugcuuugau

SEQ ID NO: 268625 - RNA, 64 nt, hsa
uugcuguguuuucuucagagcaagaagguuauauuuuuuaaaauuuacuuaguaaugcacauuc

SEQ ID NO: 268626 - RNA, 64 nt, hsa
gguaugagccaccaugcccggcuggcaguuguauuuuuuaaagcccuucugaugauuccaaugu

SEQ ID NO: 268627 - RNA, 64 nt, hsa
gauuuuuaccuuauaggcuauauguauacucaguuuuuuaaagcauuuuuuucagagaucacuu

SEQ ID NO: 268628 - RNA, 64 nt, hsa
cauaaucuacgaagaacuuggcuauggcugaucuuuuuuaaauuuaacuuucugauggacccug

SEQ ID NO: 268629 - RNA, 64 nt, hsa
gcuuuagagcuguguguugagcuaaaaauauaauuuuuuaaaaauugacuagcaaaaucuaugg

SEQ ID NO: 268630 - RNA, 64 nt, hsa
caggagauacguaaaguaggccccacaaauaauauuuuuaaaauacaaaggaucaccacaaucc

SEQ ID NO: 268631 - RNA, 64 nt, hsa
uuuaaucagaagaacauuguuguuugauuauauguuuuuaaaaaccugaagcuuuuuugguggc

SEQ ID NO: 268632 - RNA, 64 nt, hsa
uaauagacauucaugucagaucccauaugggggauuuuuaaacauuucuuugaacuuugaggcc

SEQ ID NO: 268633 - RNA, 64 nt, hsa
gauguugauagauaugcuuauaccuaauuuuuaguuuuuaaacuauuuuaaaauauacuaugau

SEQ ID NO: 268634 - RNA, 64 nt, hsa
uuuguuuucuuuuaauuucuaugaauaaaagaaauuuuuaaaaacuuuaaaauuuuaaauauua

SEQ ID NO: 268635 - RNA, 64 nt, hsa
aaucuaacuuuuuauauugucauuauuauuguuguuuuuaaacgguucuuugucuuuucuguuu

SEQ ID NO: 268636 - RNA, 64 nt, hsa
ucccuuuacaguucugcaguuccaucacaguauuuuuuuaaauaacucagguguaugagaagaa

SEQ ID NO: 268637 - RNA, 64 nt, hsa
ggguuuucuuuuguauuuuuuuuuguuuguuuuguuuuuaaacauucaaaagcaauuaaugauc

SEQ ID NO: 268638 - RNA, 64 nt, hsa
cuugcccaguuuuuuuuuuuuuuuuuuuuuuuuuuuuuuaaagccuggauuguaaccagauuuu

SEQ ID NO: 268639 - RNA, 64 nt, hsa
aaagugaauugcccagagcugccuuuuucuuuucuuuuuaaaaauuuuaagaaguuuucuuugu

SEQ ID NO: 268640 - RNA, 64 nt, hsa
gggccggggucagggagagucuuuuuuuuuuuuuuuuuuaaauacuaaauuggaacauuuaauu

SEQ ID NO: 268641 - RNA, 64 nt, hsa
uggggaguacuuggcaguugggauaugauccauuuuuuuaaacaaguuuuuuguagaucccuug

SEQ ID NO: 268642 - RNA, 64 nt, hsa
ucuuuuuuuuuagauguuugauacauuuuaaguauuuuuaaauagaugaaaauucuaaaugauu

SEQ ID NO: 268643 - RNA, 64 nt, hsa
ugauaaaaggacucuauucacuaaguagccuguguuuuuaaauccagggcugcaggcagcaacg

SEQ ID NO: 268644 - RNA, 64 nt, hsa
gaagugauucauauucaguacuguuuuuaaucacuuuuuaaaauauaaggaccgaaugcaagga

SEQ ID NO: 268645 - RNA, 64 nt, hsa
augaaccacuccaaaaaucagugcauuuugcauauuuuuaaacaaagacagcuuguugaauacu

SEQ ID NO: 268646 - RNA, 64 nt, hsa
caaaaagguuugacuggccuccagauuccaguuauuuuuaaaaagcaacuuaccacuaaauccu

SEQ ID NO: 268647 - RNA, 64 nt, hsa
aaaacacuuguacuucuggaaauggacuggagacuuuuuaaauuugaguccacuauugacaugg

SEQ ID NO: 268648 - RNA, 64 nt, hsa
ggccauuuuccuguuaccugauccuucuacaggauuuuuaaaaaguaagagaguuucagagaag

SEQ ID NO: 268649 - RNA, 64 nt, hsa
gagucacacugcuucaacuuuuucuuuguuguaguuuuuaaauugucgauuuuuagcuauuuga

SEQ ID NO: 268650 - RNA, 64 nt, hsa
uuucauuuauauaauuuuauuuuguacaauguuuuuuuuaaaugugcaaauacuguauucaagu

SEQ ID NO: 268651 - RNA, 64 nt, hsa
gcuaagcaaauauuuuuccaggcugugcugugcauuuuuaaaaggucuaauuuaauugcuuuua

SEQ ID NO: 268652 - RNA, 64 nt, hsa
cugccuuuccgcccuaugaaaaucaagaaaaucuuuuuuaaaaauggaguccugcuauuuucca

SEQ ID NO: 268653 - RNA, 64 nt, hsa
ugauuaaaauuuauauucuuguuuaauaagcuuauuuuuaaacaauuuaaaagcuauuauucuu

SEQ ID NO: 268654 - RNA, 64 nt, hsa
caauuuaaaagcuauuauucuuagcauuaaccuauuuuuaaagaaaccuuuuuugcuauugacu

SEQ ID NO: 268655 - RNA, 64 nt, hsa
uucagugaaauaggagauacauaguaguauuuuauuuuuaaaauuaauuucucauuugguuuug

SEQ ID NO: 268656 - RNA, 64 nt, hsa
guuguaucuaaaucauauuuuaaaauuauuuuuauuuuuaaaaaauuaugguaaaaacauauaa

SEQ ID NO: 268657 - RNA, 64 nt, hsa
gacauuuuauggauucuaaacuuguguuguuucuuuuuuaaaucaacuuuuuaaaaaaauaaag

SEQ ID NO: 268658 - RNA, 64 nt, hsa
uucuaaacuuguguuguuucuuuuuuaaaucaacuuuuuaaaaaaauaaaguguaaauuaaccg

SEQ ID NO: 268659 - RNA, 64 nt, hsa
aucuagaauacauagcagcucugcaaaggaacaguuuuuaaaaaugggaacuucuacauugaaa

SEQ ID NO: 268660 - RNA, 64 nt, hsa
ugauaauaugauucaguagucaacuugagggaaauuuuuaaaaaacuauucucaauuauauacg

SEQ ID NO: 268661 - RNA, 64 nt, hsa
aauauaacggguauauuuguuauucuaacucuauuuuuuaaaguuaauaauauaaaguggccau

SEQ ID NO: 268662 - RNA, 64 nt, hsa
ucacauccaauuauuugaacacaugcaaaauaauuuuuuaaauuauguuauuguuuaaauuuga

SEQ ID NO: 268663 - RNA, 64 nt, hsa
ucagaaaucucaguuuaauauaaaaugagcuaaguuuuuaaaaauaaauuauaaacuuggagau

SEQ ID NO: 268664 - RNA, 64 nt, hsa
aaugaaaaaugugaacuucuuacucauagugugguuuuuaaauauaugcaguugagugaugauu

SEQ ID NO: 268665 - RNA, 64 nt, hsa
uuggaaaaacuggucgaguaauuaucaauaauuuuuuuuaaaaagaggaucccaaacuguaaaa

SEQ ID NO: 268666 - RNA, 64 nt, hsa
aacuguaaaagauugaaauaaucuuucucaggauuuuuuaaaugucuaagauuaugaugucaua

SEQ ID NO: 268667 - RNA, 64 nt, hsa
ugauguacauuacugugaauuuuuauaccacucauuuuuaaaagggcugucuuuucauuuuagu

SEQ ID NO: 268668 - RNA, 64 nt, hsa
auacuguggugguguacacaggauagaacacccuuuuuuaaaacacagucuuuccccuugcuca

SEQ ID NO: 268669 - RNA, 64 nt, hsa
cuagguuauaggaaagaucuguuuauguaguuuguuuuuaaaaugugccaaugccuguacauua

SEQ ID NO: 268670 - RNA, 64 nt, hsa
uuuaaaaugugccaaugccuguacauuaacaagauuuuuaaaaauaaaauuguauaaaacauuc

SEQ ID NO: 268671 - RNA, 64 nt, hsa
aggaccacaggcaugcacaagcaugccuggcuaauuuuuaaauuuuuuuuuuuuaagaaauagg

SEQ ID NO: 268672 - RNA, 64 nt, hsa
caaguaaaauacauugucuuuugaaaauaguuucuuuuuaaaggaauacuaauuaauuguaacu

SEQ ID NO: 268673 - RNA, 64 nt, hsa
uaauuguaacuuguaaaaccaaaaguucuaaugguuuuuaaaaaccaguguugaguggaaaagu

SEQ ID NO: 268674 - RNA, 64 nt, hsa
gguuuaaauguguuaaaaugguuauauugccuccuuuuuaaacaaauuaaagaguuguaaauac

SEQ ID NO: 268675 - RNA, 64 nt, hsa
guacugaaugagcaggaaaaggcacauacucaguuuuuuaaauguacaaucaacaaguaaaaau

SEQ ID NO: 268676 - RNA, 64 nt, hsa
uuuucuccuuuuuuuaagaaccauuuucaucugauuuuuaaacucacgauaccaguuaucuguu

SEQ ID NO: 268677 - RNA, 64 nt, hsa
cagauuuuucuggaagaaacccuuuuuuuuuuuuuuuuuaaacaguaacauccagagugacaaa

SEQ ID NO: 268678 - RNA, 64 nt, hsa
uaacuagaacugucaaauaacaaaacggcucauguuuuuaaaauauauguaacucauuuuaaaa

SEQ ID NO: 268679 - RNA, 64 nt, hsa
caauucucaaaugauauacauuuaaagggcagauuuuuuaaaaagauacuacuauaauaaacau

SEQ ID NO: 268680 - RNA, 64 nt, hsa
guaaacuuucaugguauuuagccuuucuuaaauuuuuuuaaaauuuaaacuuucuaaccuaugu

SEQ ID NO: 268681 - RNA, 64 nt, hsa
aacauguacagaguuuuauauaaauuuaaaccaauuuuuaaaacaaaacugcggacaccaccau

SEQ ID NO: 268682 - RNA, 64 nt, hsa
uuguuuaacuaaacugucaugguuuaguuuacaauuuuuaaaaaguucuuaaaauacugaaaau

SEQ ID NO: 268683 - RNA, 64 nt, hsa
agggcugcauuuugccaccauaaagggcugcauuuuuuuaaaaagccuaggcagcucuaacauc

SEQ ID NO: 268684 - RNA, 64 nt, hsa
accaccacagguaugcaccaccauaccuggcugauuuuuaaaauuuuuucuagagaugaggucu

SEQ ID NO: 268685 - RNA, 64 nt, hsa
auucucccacaguggucuguaucucaacauuuucuuuuuaaaggaaaaaauauauauauauagu

SEQ ID NO: 268686 - RNA, 64 nt, hsa
ggccuacaggugcgugcuaccacgccuggccaauuuuuuaaauuuuagcacagaugaggucuca

SEQ ID NO: 268687 - RNA, 64 nt, hsa
auauguuuacagaccaaagugugauuucacacuguuuuuaaaucuagcauuauucauuuugcuu

SEQ ID NO: 268688 - RNA, 64 nt, hsa
guuguggucuuuuguuuuuucucuuaguauagcauuuuuaaaaaaauauaaaagcuaccaaucu

SEQ ID NO: 268689 - RNA, 64 nt, hsa
auuuugguuaaucuucaugaauugaauaauuguuuuuuuaaagcaaaauaaaguuuuuuaaaua

SEQ ID NO: 268690 - RNA, 64 nt, hsa
auugaauaauuguuuuuuuaaagcaaaauaaaguuuuuuaaauaaauguuaauauuugauuaau

SEQ ID NO: 268691 - RNA, 64 nt, hsa
uuuuuuucuuuaacagauuuguauuuaagaauuguuuuuaaaaaauuuuaagauuuacacaaug

SEQ ID NO: 268692 - RNA, 64 nt, hsa
aaacccuaauuuuuuuuauuuaaguacauuuugcuuuuuaaaguugauuuuuuucuauuguuuu

SEQ ID NO: 268693 - RNA, 64 nt, hsa
acuggaaaagcuucauuucugaagaugaauuuuauuuuuaaaaaauacaugcacacucaaaacu

SEQ ID NO: 268694 - RNA, 64 nt, hsa
ugguuaacaugaaauguuaccuuuuaacagacuguuuuuaaaaauuaaaaauguauguauaggu

SEQ ID NO: 268695 - RNA, 64 nt, hsa
aaaaauuaaaaauguauguauagguuuugaaauuuuuuuaaaaggggagaaagacuguuaagag

SEQ ID NO: 268696 - RNA, 64 nt, hsa
uggcuccucucauuucauuaucuuuuuuuuuuuuuuuuuaaagacagauucucacucaguugcc

SEQ ID NO: 268697 - RNA, 64 nt, hsa
gcgugagccaccaugccuggccuucauuaucucuuuuuuaaaaaugaaaaaguuuauaauuuac

SEQ ID NO: 268698 - RNA, 64 nt, hsa
aaaacauuauuugcaaaacagaggguauuauuuguuuuuaaagcuuuuguaaauaaaggcuuca

SEQ ID NO: 268699 - RNA, 64 nt, hsa
uucaugauauuacagugcuguaacugggugguccuuuuuaaacaaaacauuauuugcaaaacag

SEQ ID NO: 268700 - RNA, 64 nt, hsa
uauuuuuauuccaucaccauuuacccuuuuuuuuuuuuuaaauuuuguagccauucuuaugaug

SEQ ID NO: 268701 - RNA, 64 nt, hsa
cugaaaauugcauuuuauuaccauuucaaacuauuuuuuaaaaauaaauacaguuaacauagag

SEQ ID NO: 268702 - RNA, 64 nt, hsa
uccaccccaggccagguggaaguaacugaauuauuuuuuaaauuaagcaguucuacucgaucac

SEQ ID NO: 268703 - RNA, 64 nt, hsa
uaaugccaauauaauauaguuaaugaaaacagcauuuuuaaaaaccgaaauauugaaauggugu

SEQ ID NO: 268704 - RNA, 64 nt, hsa
aaggaacaaaggucuggaguuuacagaaugucuguuuuuaaagucacuuuaugcguuuuccacu

SEQ ID NO: 268705 - RNA, 64 nt, hsa
gggggcagauucugaauuggcuaaaagacaugcauuuuuaaaacuagcaacucuuauuucuuuc

SEQ ID NO: 268706 - RNA, 64 nt, hsa
uuuuccgucuccccaaagcuuuaucugucuugacuuuuuaaaaaaguuugggggcagauucuga

SEQ ID NO: 268707 - RNA, 64 nt, hsa
ugucuuccaaguauuauuuuuacuguuaaaaaauuuuuuaaaaaugugaaauguaauguuuuua

SEQ ID NO: 268708 - RNA, 64 nt, hsa
aaauggcuucuucuuaaagcccagagaaagagguuuuuuaaaagacugucgccaaauagcugag

SEQ ID NO: 268709 - RNA, 64 nt, hsa
aaagcaauuuucucccauugugcgaacauuuuauuuuuuaaaaaaaagaaacaaaaauauuuuu

SEQ ID NO: 268710 - RNA, 64 nt, hsa
ggaggaagaaagggaagaauuagguuugaauugcuuuuuaaaaaaaaaagaaaagaaaaagaca

SEQ ID NO: 268711 - RNA, 64 nt, hsa
uuuguugucguuguuguaguuaaaggaauuucauuuuuuaaaagaaaucuucgaaggugugguu

SEQ ID NO: 268712 - RNA, 64 nt, hsa
gucauauauuuuuugcuacuuuugcuguuuuauuuuuuuaaauuauguucuaaaccuauuuuca

SEQ ID NO: 268713 - RNA, 64 nt, hsa
auauuaaaaacaaaaaagaaaaaaaaggaaaauguuuuuaaaaaggucauauauuuuuugcuac

SEQ ID NO: 268714 - RNA, 64 nt, hsa
aaaguguauaaaucugaguauauauuuacaugucuuuuuaaaagggucguuaccagagauuuac

SEQ ID NO: 268715 - RNA, 64 nt, hsa
uagcaugggaggugaggauuccaaaaacauuuuauuuuuaaaauauccuguguaacacuuggcu

SEQ ID NO: 268716 - RNA, 64 nt, hsa
uaggauucuaaucucauguuuuuuccuuuucacauuuuuaaaagaacaaugacaaacacccacu

SEQ ID NO: 268717 - RNA, 64 nt, hsa
ucuugaaucaaguguaauauaauuuuuuucuucuuuuuuaaaauauucccacucagcacucaga

SEQ ID NO: 268718 - RNA, 64 nt, hsa
uuccccucacuguuugcagcucccaauguugucauuuuuaaauguuauauacaucucaaggguu

SEQ ID NO: 268719 - RNA, 64 nt, hsa
aaacaaccugaagacuugugaaaucaauguuucuuuuuuaaaaaacaauuuucaaguuuuuuuu

SEQ ID NO: 268720 - RNA, 64 nt, hsa
caaaugcaauaauacaauaccccuuccaagugccuuuuuaaauuguauaguugaugagucaaug

SEQ ID NO: 268721 - RNA, 64 nt, hsa
cuuuuuuugauuaccuguagugcuuuaaaguauauuuuuaaaagggaggaaaaaaauaacaaga

SEQ ID NO: 268722 - RNA, 64 nt, hsa
uauuuaauuucuucauaaaaauaaguuaaauauuuuuuuaaauauguauaucuaauaguacaaa

SEQ ID NO: 268723 - RNA, 64 nt, hsa
gccucaguagauacuaaagcaaauuguuucaguuuuuuuaaaugcccuuugauguuucaaaaaa

SEQ ID NO: 268724 - RNA, 64 nt, hsa
ugcauaucauuuuguuguaauacagaaagcagcauuuuuaaauguccguguuaagaauuggccc

SEQ ID NO: 268725 - RNA, 64 nt, hsa
cuaggccaagcaacuaguuuuccugcaaaucaaauuuuuaaagcaacuuggguuagacuuuguu

SEQ ID NO: 268726 - RNA, 64 nt, hsa
cuagugagcaauacacauauuauaggccaauauuuuuuuaaaaaauagagcuuggucaaccucu

SEQ ID NO: 268727 - RNA, 64 nt, hsa
uagugauauauuguguuaauuuggacaguagcgguuuuuaaaaaccauauacugacugaaacau

SEQ ID NO: 268728 - RNA, 64 nt, hsa
acuuucauuuuaaaauccuauuaccaaguucaguuuuuuaaaacuucaauuguccuggcugauu

SEQ ID NO: 268729 - RNA, 64 nt, hsa
acacuucagaguaagagggaauucagcuaauuuguuuuuaaaauugacuguaguggucacuaaa

SEQ ID NO: 268730 - RNA, 64 nt, hsa
aaaaauuggugacagagcacaaauagaaaaccuauuuuuaaauagaaaucacaaauagcaagug

SEQ ID NO: 268731 - RNA, 64 nt, hsa
gcauuaaaauuauauauguuaauaaggaaguacauuuuuaaauuuuucaaacugcuccuagcuu

SEQ ID NO: 268732 - RNA, 64 nt, hsa
gguuaaauuggcaaacauucauauuuuuacuucauuuuuaaaacaacugacugauaguucuaua

SEQ ID NO: 268733 - RNA, 64 nt, hsa
ucauaauggguguuuauaugaaacuacuaaagacuuuuuaaauggcuugauguagcagucauag

SEQ ID NO: 268734 - RNA, 64 nt, hsa
ugauguuaccugcuugugaguaucaauuacuuaguuuuuaaauuuuuaagguauugccuacuuu

SEQ ID NO: 268735 - RNA, 64 nt, hsa
cacaaagaaguuuuagaauaggguuucuuuuaaguuuuuaaauaucauccuuugucuuuccaua

SEQ ID NO: 268736 - RNA, 64 nt, hsa
uccuaaauuuucucccuaucaaaacagcaggaaauuuuuaaacuuuuauauuguacacuauuuu

SEQ ID NO: 268737 - RNA, 64 nt, hsa
ucucucauuccccauacucccuauuuucauuccuuuuuuaaaaaauaauauaagcuacagaaac

SEQ ID NO: 268738 - RNA, 64 nt, hsa
agauuaagauuuuaucugggggaaagaaaagaauuuuuuaaaaaauuaaacuaaagauguuuua

SEQ ID NO: 268739 - RNA, 64 nt, hsa
cagcuuuauugagguauaauucacccaccagacuuuuuuaaacaucaaauaauugaagagacaa

SEQ ID NO: 268740 - RNA, 64 nt, hsa
aucuguacaucucuacuuauuuaugaacagacuuuuuuuaaaaagauaaaaaaacagcuuuauu

SEQ ID NO: 268741 - RNA, 64 nt, hsa
agucugcuucccucauuauugcauugcuaaggccuuuuuaaaaagcuuaugcuuacauaauaua

SEQ ID NO: 268742 - RNA, 64 nt, hsa
aguagcuguaauuuugcuaccagaaugucuuaauuuuuuaaauuuguuuuuauuucuaagcucu

SEQ ID NO: 268743 - RNA, 64 nt, hsa
aagagaagaggagguacuguguguuacaaaaauuuuuuuaaauaaagaauucagugucacuagu

SEQ ID NO: 268744 - RNA, 64 nt, hsa
uacauauuacuuguuucugguaaucaagucuuauuuuuuaaaagccuauuguuuuucagaauug

SEQ ID NO: 268745 - RNA, 64 nt, hsa
agagagaaggauuguuuucaguuuuuaagagaauuuuuuaaaaauacauuuuaugguucucuua

SEQ ID NO: 268746 - RNA, 64 nt, hsa
uaccaugugaguuaaugauacuacaacuaaguucuuuuuaaaaagugauuaauguauuuuauaa

SEQ ID NO: 268747 - RNA, 64 nt, hsa
ucccauuuauaaauauauguaugauuuauaagcuuuuuuaaaacaaagcucaaauuguugguau

SEQ ID NO: 268748 - RNA, 64 nt, hsa
aaacccuauagcuccuuacgcugggaaagcugguuuuuuaaaaaaauaauaauaaaauauuuaa

SEQ ID NO: 268749 - RNA, 64 nt, hsa
gccauguuggagagcaaaacuuaauaauaauucuuuuuuaaaaucugcugaagcagccccaucc

SEQ ID NO: 268750 - RNA, 64 nt, hsa
uuaauguuuuuuucaucaugucauguauuagcaguuuuuaaaaacuaguuguuaaauuuuguuc

SEQ ID NO: 268751 - RNA, 64 nt, hsa
aaaaaggaaaaagguacacuuucagauaauuuuuuuuuuaaagacuaaagguuuguugguuuac

SEQ ID NO: 268752 - RNA, 64 nt, hsa
uguuuaaaacacugaugguuuuuaaagacucaccuuuuuaaaugguacuuggagcuccugauuc

SEQ ID NO: 268753 - RNA, 64 nt, hsa
cuuuuuucuaaucaaguguuuaaaacacugaugguuuuuaaagacucaccuuuuuaaaugguac

SEQ ID NO: 268754 - RNA, 64 nt, hsa
agcauucaauaagaacuagcugcggauguaauuuuuuuuaaaaaaguccaaaagcagcuauggg

SEQ ID NO: 268755 - RNA, 64 nt, hsa
uauuuuccauaggcaaugggaggaaagguggaucuuuuuaaauaauagaaguuuuaaacagucc

SEQ ID NO: 268756 - RNA, 64 nt, hsa
ccagcugcaagggaguuagggaaaugaaggucuuuuuuuaaaagcuucucagccuuccuaggga

SEQ ID NO: 268757 - RNA, 64 nt, hsa
uuccagggauuuuugaguccuauucaaauuccuauuuuuaaauaauuuccuacacaaaugauag

SEQ ID NO: 268758 - RNA, 64 nt, hsa
uguuuucaggcuuugucauugcaucuuuuuuucauuuuuaaauguguuuuguuuauuaaauagu

SEQ ID NO: 268759 - RNA, 64 nt, hsa
uauuguuacgguaugaagucuucuguauaguuuguuuuuaaacuaauauuuguuucaguauuuu

SEQ ID NO: 268760 - RNA, 64 nt, hsa
aacuugaauuucuacaaauggugaaauuuaauguuuuuuaaacuaguuuauuugccuugccaua

SEQ ID NO: 268761 - RNA, 64 nt, hsa
uuacaaaauuuuaagucugucuaauggagaguuuuuuuuaaacugucuaccucauauaauacaa

SEQ ID NO: 268762 - RNA, 64 nt, hsa
cguuauaugcacucaaauguuauaauuucuaauauuuuuaaaguuuauauucgaguuguacaaa

SEQ ID NO: 268763 - RNA, 64 nt, hsa
auugguucagauuguaauuaucaguuaggcaauguuuuuaaaacuuaguaaugagaaacuguga

SEQ ID NO: 268764 - RNA, 64 nt, hsa
uugcagaaguucugguuaaaucacaacuuaaaaguuuuuaaaagugcuuugagcauauguauau

SEQ ID NO: 268765 - RNA, 64 nt, hsa
uuaacuuguaaaacugcuguuaacucgguuuaaauuuuuaaauuaauauaauagaaagaacacu

SEQ ID NO: 268766 - RNA, 64 nt, hsa
uuuaaaaaucauuuucuuguuuaaauaguuucuuuuuuuaaaaaaaugguuacauuaguuuuaa

SEQ ID NO: 268767 - RNA, 64 nt, hsa
ucaucuuugcuuguacuagauuucuuacuuagaauuuuuaaaaaucauuuucuuguuuaaauag

SEQ ID NO: 268768 - RNA, 64 nt, hsa
aaaauaaagcuauucacauuguuaagaaaaauacuuuuuaaaguuuaccaucaagucuuuuuua

SEQ ID NO: 268769 - RNA, 64 nt, hsa
ucuccuucaguccauucccuuaggcaauuuuuaauuuuuaaaaauuauuaucaggggagaaaaa

SEQ ID NO: 268770 - RNA, 64 nt, hsa
gccuacaauuguggacuuaucauauuuuuauauauuuuuaaauuucuguaccuuuauuguuaaa

SEQ ID NO: 268771 - RNA, 64 nt, hsa
acucugagagugcuuacucacaguuuauuugcuuuuuuuaaaaaggagauuauucuaaaauaua

SEQ ID NO: 268772 - RNA, 64 nt, hsa
uuuacuuuucugccaaaauaaaccuguucuuccuuuuuuaaaauaaaauaaguucuuaaaaaau

SEQ ID NO: 268773 - RNA, 64 nt, hsa
uggcugugcuguauuuugauauaauuguacuguguuuuuaaauuuuguaugccaaucuuaaaga

SEQ ID NO: 268774 - RNA, 64 nt, hsa
aacaugaugcuuggaaauuaagagacuaaagcuuuuuuuaaaaaaagguggaaaauaggaacug

SEQ ID NO: 268775 - RNA, 64 nt, hsa
uaacuuauuguggcuugaucuucuuaggacaucuuuuuuaaaaagcuguuuaguaucauuuugu

SEQ ID NO: 268776 - RNA, 64 nt, hsa
ugguuucccuuguaucuauuuguggugaauguguuuuuuaaauggaacuaucuccaaauuuuuc

SEQ ID NO: 268777 - RNA, 64 nt, hsa
auuuaagcuuaagccauaaaauagauuagauuguuuuuuaaaaauggauagcucauuaagaagu

SEQ ID NO: 268778 - RNA, 64 nt, hsa
uguaaagugaauaacuucauuucuaauuguuuaauuuuuaaaauucugauuuuuauauauugag

SEQ ID NO: 268779 - RNA, 64 nt, hsa
uauuaggaauauguaacaugcuaaaacuuuuuuuuuuuuaaagaguacugagucacaacauguu

SEQ ID NO: 268780 - RNA, 64 nt, hsa
cuuauuuguuucaaauugcaguuuuuauaaaacauuuuuaaaacacaaauggcauguaugcuaa

SEQ ID NO: 268781 - RNA, 64 nt, hsa
uuauauauuuaaagagggagaucuggggcuguuauuuuuaaacacuuuuuuucauaauacauau

SEQ ID NO: 268782 - RNA, 64 nt, hsa
gcauaguuuugaacuaauguaacaugauuuuucuuuuuuaaaacagccugaaaauguacuagug

SEQ ID NO: 268783 - RNA, 64 nt, hsa
cccaaauccagcaugaccaaaaguaaaugauguuuuuuuaaagugucuuucuucaaguuucuuc

SEQ ID NO: 268784 - RNA, 64 nt, hsa
aaucuacauugggcaucuggucauucaaucuguuuuuuuaaauguuauuuuugccuuucaaugu

SEQ ID NO: 268785 - RNA, 64 nt, hsa
uggagacucuuagacaucuuuucauuguuguccauuuuuaaaguugaugauugcuggaaacauu

SEQ ID NO: 268786 - RNA, 64 nt, hsa
acuaagaaguguuauaggcaaugacuugaaaugguuuuuaaauuguauggauuguuaagaauug

SEQ ID NO: 268787 - RNA, 64 nt, hsa
aucaucuuauguuauuagcaagguuaagacaucuuuuuuaaaaaaauuauagcuucuaccaaga

SEQ ID NO: 268788 - RNA, 64 nt, hsa
agacuuuaaacaagaauuaaaaucaugugcuguauuuuuaaaaucuagccaaauuaaauaguac

SEQ ID NO: 268789 - RNA, 64 nt, hsa
gucagaaaacauuuucaucuuauugagagauauguuuuuaaacuuuuaucaucauuuguaaaug

SEQ ID NO: 268790 - RNA, 64 nt, hsa
guauuucugaacuuggcaaaauuggaaauuaaaauuuuuaaaaauuacaaauauacaaaguuau

SEQ ID NO: 268791 - RNA, 64 nt, hsa
guucuugagaaucagccauuugguacaaaaaagauuuuuaaagcuuuuauguuauaccauggag

SEQ ID NO: 268792 - RNA, 64 nt, hsa
aaaugucccgauuguuaaaaaguuggcucaauuauuuuuaaaacauuuuguaagccaacaaaag

SEQ ID NO: 268793 - RNA, 64 nt, hsa
gcauauuuuucauagaauguagcguguaaauagcuuuuuaaauaacuucuuuuuuauaagagua

SEQ ID NO: 268794 - RNA, 64 nt, hsa
ucucacggggccccaggcuuauucagaacugguguuuuuaaaguuuccuuuacccugcccuugu

SEQ ID NO: 268795 - RNA, 64 nt, hsa
uauauuuguuacgaagaaggcuauugcuacaauauuuuuaaagguuucuuuuuuaacuuugaaa

SEQ ID NO: 268796 - RNA, 64 nt, hsa
auauuuggcugcuuucuuacaaugagaauuaagauuuuuaaacugaaguugaccauacagguug

SEQ ID NO: 268797 - RNA, 64 nt, hsa
auaauggcuguuugcuuccauaaacaagugcaauuuuuuaaagugcugucuuacuaagucuugu

SEQ ID NO: 268798 - RNA, 64 nt, hsa
gguuaaggagacaauuuuggagagcaagcaaaucuuuuuaaaaaauaguaugaaugugaauacu

SEQ ID NO: 268799 - RNA, 64 nt, hsa
uuuuuguuagcuuuaaaucauuuuugcuuuagucuuuuuaaaggaaaauaacaaaacuaugcug

SEQ ID NO: 268800 - RNA, 64 nt, hsa
acacugaccaugugauguacauuuauuaugucuuuuuuuaaagaauggaaauauuuauuucaga

SEQ ID NO: 268801 - RNA, 64 nt, hsa
caguuuuggacuguuuaguagucuuuguuuuauguuuuuaaauacagaaauugcuuucacaaau

SEQ ID NO: 268802 - RNA, 64 nt, hsa
auucuaccaguuaaacuacuuuaauacacauucauuuuuaaagaaaauguuuguuuuaacauaa

SEQ ID NO: 268803 - RNA, 64 nt, hsa
ucuguuuaugcgauaacuccuuuuuguuacaauuuuuuuaaaaaaagcuauuuuuguuaaugua

SEQ ID NO: 268804 - RNA, 64 nt, hsa
uuuguuaauguaaaguaaauauuucagagcaaauuuuuuaaacuuauugcacuaaauacaggcu

SEQ ID NO: 268805 - RNA, 64 nt, hsa
ccccacccuuugaagaguucaaguucuguacagguuuuuaaaacgugaaguaauguuugaacug

SEQ ID NO: 268806 - RNA, 64 nt, hsa
cccaauuuuaaugacacuaaaauauuaauagaauuuuuuaaauauacucuaauuuuuaaaacau

SEQ ID NO: 268807 - RNA, 64 nt, hsa
aaaauauuaauagaauuuuuuaaauauacucuaauuuuuaaaacauacucuuuauuaucuucau

SEQ ID NO: 268808 - RNA, 64 nt, hsa
ucuuaaaagcuagaaaaaccauaauguaauauucuuuuuaaacccucuuauuuuauaacuaaau

SEQ ID NO: 268809 - RNA, 64 nt, hsa
ccccccuaguuucacuuucuggaaagugaacaguuuuuuaaauccuaaauguuauaaauccuua

SEQ ID NO: 268810 - RNA, 64 nt, hsa
ugaauaguuuuauauuaauaaaagaagacaaaauuuuuuaaauguuagaaaaagcagaucuguc

SEQ ID NO: 268811 - RNA, 64 nt, hsa
aauuuuaagcuuuuaaaaauguagauuuuucauauuuuuaaaauuugaaucuauuugagcuuua

SEQ ID NO: 268812 - RNA, 64 nt, hsa
aaugacaaucaauuugagaaaauagaaauagauauuuuuaaauaaaaccauucacaguuuacuu

SEQ ID NO: 268813 - RNA, 64 nt, hsa
uuuuuacuagccuguaugaaaucacuaguccuuauuuuuaaaggucuaugguuucuuggaagua

SEQ ID NO: 268814 - RNA, 64 nt, hsa
cuuguuugaaacaaaagaaaauaaugcauuguguuuuuuaaaaagaguaucuuauacauguauc

SEQ ID NO: 268815 - RNA, 64 nt, hsa
auugcuuggguauggaacgguagaaauuuggguguuuuuaaaaccuuguuugggguuguuccug

SEQ ID NO: 268816 - RNA, 64 nt, hsa
cuaaauagaacacugauggauuccaaccuuccuuuuuuuaaauuuucuccagucccugggagca

SEQ ID NO: 268817 - RNA, 64 nt, hsa
uugacauucucuauuguaauuuuguuccuguuuauuuuuaaauuuucuuuuuguuucacuggaa

SEQ ID NO: 268818 - RNA, 64 nt, hsa
cauugugcccuugauuuuuaucuccaaguggcaguuuuuaaaauuggccuuuuaccuggauaua

SEQ ID NO: 268819 - RNA, 64 nt, hsa
cccaccacuaacuuuggagaaaauguggguuugcuuuuuaaaggaauccuauaucuaguccuau

SEQ ID NO: 268820 - RNA, 64 nt, hsa
caaagugauuuuagaauaaaaugcaggaaaaacuuuuuuaaagauguuagucuuguagcgugaa

SEQ ID NO: 268821 - RNA, 64 nt, hsa
cuggcaggucauauacuuuuuuuuggcauauaccuuuuuaaagacuguaauuagugcaguaaca

SEQ ID NO: 268822 - RNA, 64 nt, hsa
cugucacauuaguagauucugagauuaaaaaaaauuuuuaaagagugaucauuuaaauaauuuc

SEQ ID NO: 268823 - RNA, 64 nt, hsa
ccuugaagcugcuugucucauguguaugaugugcuuuuuaaaucaugccccucguugccugccu

SEQ ID NO: 268824 - RNA, 64 nt, hsa
uuuuuccauuagaauacugcaaaacccauauaucuuuuuaaaaaauuuauguacucacagucuu

SEQ ID NO: 268825 - RNA, 64 nt, hsa
ccuuuucuagugcaguuauauuagaaugcauauguuuuuaaaaugcuaguauaacuagauagua

SEQ ID NO: 268826 - RNA, 64 nt, hsa
uaaaauaaccuuuccuuuuaaaugugcugcaacguuuuuaaaaaugcagcagcauaggagugaa

SEQ ID NO: 268827 - RNA, 64 nt, hsa
ccacaggccaauuuguuggccaccagaaaaccgcuuuuuaaaaaaacacuuggugauucuuuca

SEQ ID NO: 268828 - RNA, 64 nt, hsa
uccuuaaacuauugccauacuucaguaagugucuuuuuuaaaaaaaauucacuuguauaaaaau

SEQ ID NO: 268829 - RNA, 64 nt, hsa
gaggugcuggcaugcuuuacagcacagaucugauuuuuuaaaauguccuguacuaguacauaaa

SEQ ID NO: 268830 - RNA, 64 nt, hsa
uagcucuauucauuuauguuagcauuaaugcacauuuuuaaaaaaagaaaaaaacauggucuug

SEQ ID NO: 268831 - RNA, 64 nt, hsa
aagcacucaaucauuagaggcuacaagaauaauauuuuuaaaguuacaguauuuuacaauuauu

SEQ ID NO: 268832 - RNA, 64 nt, hsa
ccaaaaucaugaaugauacacaugaagauaacuuuuuuuaaaaaaaagcagaaauacacaauga

SEQ ID NO: 268833 - RNA, 64 nt, hsa
aacaagaaucagacauuuuccuaugcaguauuuuuuuuuaaaguuuauuuuaguaaaguuaaaa

SEQ ID NO: 268834 - RNA, 64 nt, hsa
auacugcuagcagcuuauuuaaaacuugggguccuuuuuaaauaagaaaaauuauauaaauuuu

SEQ ID NO: 268835 - RNA, 64 nt, hsa
auggguaaugcguuugauuguuugagauuuucuguuuuuaaaaauguagcacuugacuuuuugc

SEQ ID NO: 268836 - RNA, 64 nt, hsa
uguuccucccuugaacugucuguuuagucugagguuuuuaaacuugcaggcagcugacugugau

SEQ ID NO: 268837 - RNA, 64 nt, hsa
cgaauguuuugguucaagaaagaauguuuaaagcuuuuuaaaagacuucaguucuuaauguaac

SEQ ID NO: 268838 - RNA, 64 nt, hsa
guauaaucuuuggcuaguguuaugugccuguauuuuuuuaaaaugguacaccagaaaaggacug

SEQ ID NO: 268839 - RNA, 64 nt, hsa
cagauuuuguccugcaucuguccaguuuauuugcuuuuuaaacauuagccuaugguaguaauuu

SEQ ID NO: 268840 - RNA, 64 nt, hsa
cuacugcaugcaucacuucugcauuuauuguaauuuuuuaaaaacaucaccuuuuauaguuggg

SEQ ID NO: 268841 - RNA, 64 nt, hsa
uauuuuuauagacauguuuuuuaaaaauccuaaguuuuuaaauaacuauggauuuguguauuuu

SEQ ID NO: 268842 - RNA, 64 nt, hsa
aacugccuuaaacguuguauuuuuauagacauguuuuuuaaaaauccuaaguuuuuaaauaacu

SEQ ID NO: 268843 - RNA, 64 nt, hsa
auuuuuauaaauuguaugcuucagaaauaauuuauuuuuaaaaagaaauuaaaaguuuuaaacu

SEQ ID NO: 268844 - RNA, 64 nt, hsa
agaguuugaggaguuaguaucacagaauuagauuuuuuuaaagcauuuguacguuuccauuccc

SEQ ID NO: 268845 - RNA, 64 nt, hsa
uccaaaguggaccacacuugguccauuuuacacuuuuuuaaaggggauuaaaaaacacagccuc

SEQ ID NO: 268846 - RNA, 64 nt, hsa
accugugcuuauuacucaaauggucuucaacaucuuuuuaaacaacacauacuuuuugaauguu

SEQ ID NO: 268847 - RNA, 64 nt, hsa
accaauugugugaccaugagaaggaugcuuauuuuuuuuaaaaagaaaacacaucuaaaagccc

SEQ ID NO: 268848 - RNA, 64 nt, hsa
cacagagugguggccaguggcuacacaauagcgauuuuuaaaugauugguuaagugaaaaccag

SEQ ID NO: 268849 - RNA, 64 nt, hsa
gguacugaccccucccucuugggcagcaccucccuuuuuaaaaaaauuuuuuuuucuuccaaag

SEQ ID NO: 268850 - RNA, 64 nt, hsa; identical to SEQ ID NO: 268457

SEQ ID NO: 268851 - RNA, 64 nt, hsa; identical to SEQ ID NO: 268458

SEQ ID NO: 268852 - RNA, 64 nt, hsa
gcuaagguugucaagaaggcuuuuuuuuuuuucuuuuuuaaaccugagggcaaaaaggaaugga

SEQ ID NO: 268853 - RNA, 64 nt, hsa
gugcuuggaugaaaggacagcguggauaaaaagguuuuuaaaacauggauguuaaggcuguuuu

SEQ ID NO: 268854 - RNA, 64 nt, hsa
auuaauauuuauaauggauauuuaaugauuguuauuuuuaaaaaccagcuuauaauuccucguu

SEQ ID NO: 268855 - RNA, 64 nt, hsa
ugauuauuaggauauauucccaugaaggauucuuuuuuuaaaaaaaugugaaaugucaucuugu

SEQ ID NO: 268856 - RNA, 64 nt, hsa
acaacuucauuuauauacaggcuucccuuuuuuauuuuuaaaggauacguuucacuuaauaaac

SEQ ID NO: 268857 - RNA, 64 nt, hsa
gguugucucuuaaaaagaaagauagcaaauacuuuuuuuaaauuacaaaagugauagauguuca

SEQ ID NO: 268858 - RNA, 64 nt, hsa
agaccuuuuuuuauauuauuaaauauucuacaacuuuuuaaaaaugucuauuaauauuccaucg

SEQ ID NO: 268859 - RNA, 64 nt, hsa
gguguuuucuguguauacauggauauuuuguuuguuuuuaaacaaaacgaugggaucauucuga

SEQ ID NO: 268860 - RNA, 64 nt, hsa
uuuaacaagguaacuuuuuguuuaaccuagauuuuuuuuaaaacuuuuuuuuuuuuucauauug

SEQ ID NO: 268861 - RNA, 64 nt, hsa
auuuacuggucugggaaacaggauguguuuccuuuuuuuaaaagccaauugacagauuacaccu

SEQ ID NO: 268862 - RNA, 64 nt, hsa
cuuugcugcugaaaugcugccucuugccuuuuuuuuuuuaaauuuuaaauuaucuaaauuuauu

SEQ ID NO: 268863 - RNA, 64 nt, hsa
ggcucugccuccugugcuuauaucauccaaaaacuuuuuaaaaagguccagaauucuauuuuaa

SEQ ID NO: 268864 - RNA, 64 nt, hsa
uaugcuuguauccccccgucacuccuccgccuguuuuuuaaacuuuuccaccaccugcguccaa

SEQ ID NO: 268865 - RNA, 64 nt, hsa
aggcccaggcaggugaagaggaaguggcuuuggguuuuuaaaguaggugagcgugagccucucu

SEQ ID NO: 268866 - RNA, 64 nt, hsa
auagccuauggcagaaaaaaugucuguaaauauguuuuuaaagguggauuuuguuuaaaaaauc

SEQ ID NO: 268867 - RNA, 64 nt, hsa
cgcucuguggaugccagggccgaccagaggagccuuuuuaaaacacauguuuuuauacaaaaua

SEQ ID NO: 268868 - RNA, 64 nt, hsa
auauacagauuacuguuaaauugcaguccuuuuuuuuuuaaagauauuuucuugaauuauuuag

SEQ ID NO: 268869 - RNA, 64 nt, hsa
uguauguguguguguguguguauauauauauauauuuuuaaaucacauuaauuuuaccaaguga

SEQ ID NO: 268870 - RNA, 64 nt, hsa
cauacuguuuuugagccaauuaagaaaauugccauuuuuaaaguguagcauuucaggguaaaga

SEQ ID NO: 268871 - RNA, 64 nt, hsa
ugaccaaauaccuagcaccaguuccugcugccacuuuuuaaagugccauaugacuuucuacgaa

SEQ ID NO: 268872 - RNA, 64 nt, hsa
auuaauaaucauuuuguuuagaauuacaaaauaguuuuuaaauauugucugagaaaagccaaag

SEQ ID NO: 268873 - RNA, 64 nt, hsa
guauccagcccugauauuuuguguaaauaaaauguuuuuaaaaccuguuaguuaaaacacuuag

SEQ ID NO: 268874 - RNA, 64 nt, hsa
aaugcaaauguccuucaccaguaaagcaagcaaauuuuuaaaaucucuguuuuugaaaucuacu

SEQ ID NO: 268875 - RNA, 64 nt, hsa
cuuacuuuguuucuuucauugcacucuauaaugauuuuuaaauuaagaauuuuuuaucuuaggc

SEQ ID NO: 268876 - RNA, 64 nt, hsa
ucuuugguuuccaacaccaugaugaagcucuugcuuuuuaaaaaguaguuaguaaauucugcau

SEQ ID NO: 268877 - RNA, 64 nt, hsa
aaaugcauauugaucacuauaauucuaaaacaauuuuuuaaauaaaccagcagguugcuaaaag

SEQ ID NO: 268878 - RNA, 64 nt, hsa
aauagaagcuauuuauuaugagcuucuacagguauuuuuaaauagagcaagcauguugaauuua

SEQ ID NO: 268879 - RNA, 64 nt, hsa
uaucgggaccggcagaaauggaaguauccauacauuuuuaaaaagcaacaaguuugcacagcua

SEQ ID NO: 268880 - RNA, 64 nt, hsa
ucaguuccuggaggggcucuuauuauuuucucucuuuuuaaaaaacuuccaguagaaguaaagu

SEQ ID NO: 268881 - RNA, 64 nt, hsa
gggaaaaaaagcaauucacaaaaccauuucauauuuuuuaaaauauugugcuuaaagauggucc

SEQ ID NO: 268882 - RNA, 64 nt, hsa
agaaagcaguacagaggaaaacaggaaccugauuuuuuuaaaauaaauuuuaaauaaaauagaa

SEQ ID NO: 268883 - RNA, 64 nt, hsa
cuguacuuguacaaacucaacacuaacuuuuuuuuuuuuaaaaaaaaaaagguacuaaguaucu

SEQ ID NO: 268884 - RNA, 64 nt, hsa
uaauuuuuuuuguuuugucuagugaguuucaacauuuuuaaaguuuucaaaaagccaucggaau

SEQ ID NO: 268885 - RNA, 64 nt, hsa
guuacgcuaaacuuuugauucuuuaacacaauuauuuuuaaacacuggcauuuuccaaaacugu

SEQ ID NO: 268886 - RNA, 64 nt, hsa
aacacuggcauuuuccaaaacuguggcagcuaacuuuuuaaaaucucaaaugacaugcagugug

SEQ ID NO: 268887 - RNA, 64 nt, hsa
augauuaaucuugggacaaagaauuuuauagaaauuuuuaaacaucugaaaaagaagcuuaagu

SEQ ID NO: 268888 - RNA, 64 nt, hsa
uggccauaaaauggcuuuaaagaauauauauauauuuuuaaaguagcuugagaagcaaauuggc

SEQ ID NO: 268889 - RNA, 64 nt, hsa
gaggacgacccgagucccaagagugggguuuugcuuuuuaaaaggagagaggaggggugauggc

SEQ ID NO: 268890 - RNA, 64 nt, hsa
uuuccauguguuuuccuccuguuguuuuagaacuuuuuuaaaaaaacagaccucguuuuagauu

SEQ ID NO: 268891 - RNA, 64 nt, hsa
ugugugaucuuucagggaauguuuuguuuauuuguuuuuaaaaguauugggaaucagauuaaga

SEQ ID NO: 268892 - RNA, 64 nt, hsa
guguuuucaacucaggaccuauccaaaugaggaauuuuuaaauauucuuuuuuuuuuccuauuu

SEQ ID NO: 268893 - RNA, 64 nt, hsa
uuacaggcgugagccaccuugcccagccaauuuuuuuuuaaagagacauggucuugcuauguug

SEQ ID NO: 268894 - RNA, 64 nt, hsa
gcggcaacuucuaacuuugcuccaagccacucucuuuuuaaacagcaacaauuuaaagcuauga

SEQ ID NO: 268895 - RNA, 64 nt, hsa
cauuuucaugaccugguuauagccuuugcugguguuuuuaaaauaccuggacucaaugacaaag

SEQ ID NO: 268896 - RNA, 64 nt, hsa
ccuggacucaaugacaaagaccgagucuucuuuuuuuuuaaacaaaaacaaaaaaagcaaccag

SEQ ID NO: 268897 - RNA, 64 nt, hsa
cuuugacaaagcucaccaacuuuaaaauauuaaguuuuuaaaaaaucaaauaugaaguauguuc

SEQ ID NO: 268898 - RNA, 64 nt, hsa
guaaauuaaagcauuacacaguauuuaucaguauuuuuuaaacauccuguccuuuuuuaaaauc

SEQ ID NO: 268899 - RNA, 64 nt, hsa
aguauuuaucaguauuuuuuaaacauccuguccuuuuuuaaaaucuuugcuuagucagucauau

SEQ ID NO: 268900 - RNA, 64 nt, hsa
cuagcaccuuaaucacuguuuaguuuuguauucauuuuuaaaagcaauuauugaagccauuuuc

SEQ ID NO: 268901 - RNA, 64 nt, hsa
aauuagucacugccuugcuaacuuugcuguaauuuuuuuaaacgucuuguuuuuaauauagcaa

SEQ ID NO: 268902 - RNA, 64 nt, hsa
ccaaaacauuuuauggcuaguaauauuuauguaauuuuuaaaauguauuuuugguacugauggg

SEQ ID NO: 268903 - RNA, 64 nt, hsa
ucucuaaaugaaauagaagacuuuggaguauauguuuuuaaaguaauuuuuuaaaauaugguaa

SEQ ID NO: 268904 - RNA, 64 nt, hsa
uagaagacuuuggaguauauguuuuuaaaguaauuuuuuaaaauaugguaauguauuaaacuua

SEQ ID NO: 268905 - RNA, 64 nt, hsa
uauauacuaaaauuaaggguggagaagaucuuauuuuuuaaaucauggucauaauuuuucuuuu

SEQ ID NO: 268906 - RNA, 64 nt, hsa
gaaaauuguuuucugaaaguaucaucacuuuuccuuuuuaaagaaggcugcuaauuggauuuug

SEQ ID NO: 268907 - RNA, 64 nt, hsa
ggggugggauggggugguuggagaaccagaacuauuuuuaaaacauuagguuucaauauaaaua

SEQ ID NO: 268908 - RNA, 64 nt, hsa
aacuaaucacagcacagaaguaccuugauuuaauuuuuuaaacguguucucgggaaguuagggc

SEQ ID NO: 268909 - RNA, 64 nt, hsa
ggucccaaaugggcccauuccccuaauaguuuuauuuuuaaagaaagccauacauagaaugcuu

SEQ ID NO: 268910 - RNA, 64 nt, hsa
cugcaaagauguccagaagccauguauauaauguuuuuuaaacagaacuucauuccccguugaa

SEQ ID NO: 268911 - RNA, 64 nt, hsa
gaagccaaggggagagucuaaaagggcuagagcauuuuuaaaaauagacacagggucuugggac

SEQ ID NO: 268912 - RNA, 64 nt, hsa
augaccuuuagauugugcgacuuuuguuuuuguuuuuuuaaauuuuuuuaaaccaagaaugauu

SEQ ID NO: 268913 - RNA, 64 nt, hsa
gauugugcgacuuuuguuuuuguuuuuuuaaauuuuuuuaaaccaagaaugauuucuccugcuu

SEQ ID NO: 268914 - RNA, 64 nt, hsa
aaauuguugcgauuuauuuuuucaagagaucauguuuuuaaagugucuuuugcagaguuuuaag

SEQ ID NO: 268915 - RNA, 64 nt, hsa
uacugugugccgagaaggcauuucuagacccguguuuuuaaaggagggaacuuuggggauugcc

SEQ ID NO: 268916 - RNA, 64 nt, hsa
gaaucuauagcauuaguauacacuggcacauaauuuuuuaaaaaguuuuaagaaaagauucauu

SEQ ID NO: 268917 - RNA, 64 nt, hsa
aaauaguaaccugugaacuaugcuuuuccauaacuuuuuaaaaauauauauaucuaaaugaaug

SEQ ID NO: 268918 - RNA, 64 nt, hsa
uauauaucuaaaugaaugcaaugugcauaaauauuuuuuaaacauaacagugaacuauugcacc

SEQ ID NO: 268919 - RNA, 64 nt, hsa
acuguuuauauguguugaaaaccaaaaugacaucuuuuuaaagcuuauccauaaaaaaaaauag

SEQ ID NO: 268920 - RNA, 64 nt, hsa
ggugguguagauuguaugaguaagaaguauuaauuuuuuaaaagacaaaucaacuuugaagaca

SEQ ID NO: 268921 - RNA, 64 nt, hsa
uucugacauuuuauaaaccuacauuuaaggggaauuuuuaaaggaaauguuuuuucuuuuuuuu

SEQ ID NO: 268922 - RNA, 64 nt, hsa
uaaaaaaagaaaguuauuucuuugucuuaaagaauuuuuaaaaaauuagucaugagacuuauuc

SEQ ID NO: 268923 - RNA, 64 nt, hsa
gcuaauuccccuuccauucccaacucucucucucuuuuuaaagaaaaaugcuaagggcagcccu

SEQ ID NO: 268924 - RNA, 64 nt, hsa
augucagcacauguugcuaaugacaguggauuuuuuuuuaaauaaaaaaguuuacagaucaaau

SEQ ID NO: 268925 - RNA, 64 nt, hsa
ccuugugagccaccgugcccaacccuaacaauuauuuuuaaaaggaggaauuuaaaugagcugu

SEQ ID NO: 268926 - RNA, 64 nt, hsa
aacaaaaaaguucuaacaaaauaauaaggcugaauuuuuaaagucucuuccgcaucuucuguuc

SEQ ID NO: 268927 - RNA, 64 nt, hsa
caagcacuuuguaccaaguuauuaaguaacauaauuuuuaaaauuuaaagaaugugucuucaac

SEQ ID NO: 268928 - RNA, 64 nt, hsa
uuucugaaaguucccuaucccucuuuaccauaauuuuuuaaauguagccacauuguaauaguaa

SEQ ID NO: 268929 - RNA, 64 nt, hsa
auacaaguuuuuagauguuuaugcuuugccuuucuuuuuaaagguguuuuccugcuuuguaguc

SEQ ID NO: 268930 - RNA, 64 nt, hsa
aguuuacuaauagaggaguagagauuguugaccauuuuuaaaaaacgauagccacucuuuuucu

SEQ ID NO: 268931 - RNA, 64 nt, hsa
augaauggaggcacuuuacuaggucuagaauauuuuuuuaaaagccucugaacugagcuuaaaa

SEQ ID NO: 268932 - RNA, 64 nt, hsa
ccucuccacuacucaggcagccacuauucaucuauuuuuaaaguaccccauuuucaggccgggu

SEQ ID NO: 268933 - RNA, 64 nt, hsa
caccugcuauacaguuguuaaaucuuaaauaugcuuuuuaaaaauuggaauaauguauuaaggu

SEQ ID NO: 268934 - RNA, 64 nt, hsa
agaaaagaauccuuaaaaucuagauuuauaccauuuuuuaaagucccaccuuucaauguuuaau

SEQ ID NO: 268935 - RNA, 64 nt, hsa
ugcauaccaguguuuuaaaagguauuuuuauguguuuuuaaacacuuuuuuaaaugagccugac

SEQ ID NO: 268936 - RNA, 64 nt, hsa
uuuuaaaagguauuuuuauguguuuuuaaacacuuuuuuaaaugagccugacaccuguguuuca

SEQ ID NO: 268937 - RNA, 64 nt, hsa
gacauuaaguagaaauauugguuuuuuuuuuuuuuuuuuaaauaagucacaguccuguugucaa

SEQ ID NO: 268938 - RNA, 64 nt, hsa
uuuuauauauauauaaauauauauaaauauauacuuuuuaaaaauaauuuauaaaucuuaccaa

SEQ ID NO: 268939 - RNA, 64 nt, hsa
aaucacuuauuucagagugcaacacaaggcugcauuuuuaaaaaaaagacacauucaaucuugc

SEQ ID NO: 268940 - RNA, 64 nt, hsa
aaggucaggaugggaucucuguaucauguuuuucuuuuuaaaucacuuauuucagagugcaaca

SEQ ID NO: 268941 - RNA, 64 nt, hsa
ucauuuacaauucaauauauaauuacacaaauaauuuuuaaauauaaucaauaguaaagacugu

SEQ ID NO: 268942 - RNA, 64 nt, hsa
gaaucuuuagacacuuaucucuugccgcauaggcuuuuuaaaggugcuuucacauagcacaggc

SEQ ID NO: 268943 - RNA, 64 nt, hsa
ucuuaaucuagacagaaauagcuguuugguuuuguuuuuaaauagaucuauuucccuuaucacu

SEQ ID NO: 268944 - RNA, 64 nt, hsa
aaucauaacaucugauuaaacagaaaaagcaagauuuuuaaaacuaacuauauaaggauggucc

SEQ ID NO: 268945 - RNA, 64 nt, hsa
acaugaagcaaucaucgaagacucacugguaauauuuuuaaaaaguauacagaucaaagcaaaa

SEQ ID NO: 268946 - RNA, 64 nt, hsa
auuggaaaauuauauguauaaaaccaaagugcuauuuuuaaaagcaucauuuaaaaaaaaauga

SEQ ID NO: 268947 - RNA, 64 nt, hsa
uugagcuuuauucuaauguaucccaaaccuaaucuuuuuaaaagauagaagauacuuuuaagac

SEQ ID NO: 268948 - RNA, 64 nt, hsa
uguucaguuuauauuguuuuagauuguuuuguaauuuuuaaagguguaaaauaacauauuuuuu

SEQ ID NO: 268949 - RNA, 64 nt, hsa
cagaaggaaagcacuaagaaacacucguuuguuguuuuuaaaggcaacagacuuaaaguugucc

SEQ ID NO: 268950 - RNA, 64 nt, hsa
ucgugcauaggcaaagaaggauuaggcuguuuucuuuuuaaaguacuguagccucaguacuggu

SEQ ID NO: 268951 - RNA, 64 nt, hsa
uugaagauuuuuuuuguuucuugguacuuuuuucuuuuuaaauuaggacuaauguuucuuuugu

SEQ ID NO: 268952 - RNA, 64 nt, hsa
ccacucaacucuuaauaugcuugcauuguuuaaguuuuuaaauucugaaaauuaauaauuaggg

SEQ ID NO: 268953 - RNA, 64 nt, hsa
aauggaaaaacauuuauucuuuuaaauaauaauuuuuuuaaaacccaagaggucaggggauuuu

SEQ ID NO: 268954 - RNA, 64 nt, hsa
agccuuaagaauugcaguggagcaaauuggucauuuuuuaaaaaaauauauuuuaaccuacagu

SEQ ID NO: 268955 - RNA, 64 nt, hsa
uuggauuaaaaaguauuauaucauggacauacauuuuuuaaaguaccaaagguauuugguaagc

SEQ ID NO: 268956 - RNA, 64 nt, hsa
cuuaguuaacucugggaaagauguuaccuuuggguuuuuaaaagacaagucaucauuugaaaau

SEQ ID NO: 268957 - RNA, 64 nt, hsa
gacauuuuccccuuacauuucaaaggcaucacuauuuuuaaauguuuacauauguuuacauguu

SEQ ID NO: 268958 - RNA, 64 nt, hsa
uguauuuuaauaucuugcaagggcaaagaaggcauuuuuaaaauucuaaaugcacaccuccuaa

SEQ ID NO: 268959 - RNA, 64 nt, hsa
cuaaaggauauuauuguuugaauuuuuggguuauuuuuuaaaacuucauugcuguuuuugacag

SEQ ID NO: 268960 - RNA, 64 nt, hsa
uaaauugcugcccuguguauaaucucuugagaucuuuuuaaagcuagcaagaacucuauuugga

SEQ ID NO: 268961 - RNA, 64 nt, hsa
aaaguuggccaugguaaauaauuuucagaauucuuuuuuaaaauuuuaauuagauuuccuuuuc

SEQ ID NO: 268962 - RNA, 64 nt, hsa
acuggauaauaggaaaaacacuucuuuccuucauuuuuuaaauaaaauuaauguuguauuuaaa

SEQ ID NO: 268963 - RNA, 64 nt, hsa
ucaugcuguucaaaguuuuuaauuguuaucaugguuuuuaaaagacugacaguguuuauuauua

SEQ ID NO: 268964 - RNA, 64 nt, hsa
auuuacuugguccagaguuuucuauucuuuuuuuuuuuuaaacuaaugaaugacauuuagauac

SEQ ID NO: 268965 - RNA, 64 nt, hsa
ccacugugguugauucaaaagaaagugauucuauuuuuuaaagaaagcguuguuaauguaauug

SEQ ID NO: 268966 - RNA, 64 nt, hsa
gaaaggaaguucgguaaggaaaugucaaaucugguuuuuaaacaagguccaacccugcaaugaa

SEQ ID NO: 268967 - RNA, 64 nt, hsa
gauaaccacccucccagaguuucucucggcucuuuuuuuaaaagucccccaacaaauaggauuc

SEQ ID NO: 268968 - RNA, 64 nt, hsa
ggcauauaugaagauauauauauauauagucuacuuuuuaaacucugcagggauuugguuaagu

SEQ ID NO: 268969 - RNA, 64 nt, hsa
guacaaguccuuucagugaugagggaauugauuuuuuuuaaaagucuuuuucuuagaaagccaa

SEQ ID NO: 268970 - RNA, 64 nt, hsa
aaaugcucaccacuuagccuguuuuuuuaucccuuuuuuaaaaugacagaugauuuuguucagg

SEQ ID NO: 268971 - RNA, 64 nt, hsa
gaucuucuaaguugauuuuuuuccucccaagucuuuuuuaaagaaaguauacuguauuuuacca

SEQ ID NO: 268972 - RNA, 64 nt, hsa
cauuuacaaacaacaaacuugaucuuuaaaaauguuuuuaaaacucucugagucucagugacuu

SEQ ID NO: 268973 - RNA, 64 nt, hsa
augcauuuguggcuagaaauuuuaaucuaaacuuuuuuuaaaaaaaaucauaauaguuaggaua

SEQ ID NO: 268974 - RNA, 64 nt, hsa
uuuucauucuguaguucucaccccuuuguucauauuuuuaaagggaagaccuucugcugcuuuu

SEQ ID NO: 268975 - RNA, 64 nt, hsa
gaugaauguugacucccaggagaccagaacuauuuuuuuaaagccugacaaacuucauaaaugg

SEQ ID NO: 268976 - RNA, 64 nt, hsa
ccucaguguuuaacaguuuuuuguuuuguuuuguuuuuuaaauaauaacuaauugucgagcacu

SEQ ID NO: 268977 - RNA, 64 nt, hsa
aaucggggcucuuguaucagugccagcuguaauguuuuuaaaugcaguggcugccuucuauugu

SEQ ID NO: 268978 - RNA, 64 nt, hsa
uauauuaaaagagaggguccuucaaaaaaauuauuuuuuaaaacacagagguguucugaccugc

SEQ ID NO: 268979 - RNA, 64 nt, hsa
accaggauugugaaagaguucuucuguuuguauuuuuuuaaagagaacuuuuuuaguuuauuaa

SEQ ID NO: 268980 - RNA, 64 nt, hsa
ccccucuuucauguauuaaaauaacacugagauuuuuuuaaaagcuggaagauuguacagcaua

SEQ ID NO: 268981 - RNA, 64 nt, hsa
auuaagaaucuauauaagcuauaaaaauacucauuuuuuaaaaaaaguuuuuuucauucaaaga

SEQ ID NO: 268982 - RNA, 64 nt, hsa
acaguguucuggaaaucugugcauucguucucgauuuuuaaagaagaauugggucuuuuuauua

SEQ ID NO: 268983 - RNA, 64 nt, hsa
ggaucuaauuaccuuaaacaagcagauuuagccauuuuuaaacagacauucccagucauccugg

SEQ ID NO: 268984 - RNA, 64 nt, hsa
auaguuguuaaaguuacaacuucuuuuauuuuauuuuuuaaaggcuucagauuaaacaagagcc

SEQ ID NO: 268985 - RNA, 64 nt, hsa
acacuuugucuuuacaaugaaacauuuugcuuaauuuuuaaaguaagacauuaugauaccucug

SEQ ID NO: 268986 - RNA, 64 nt, hsa
aguuguuuaacauuuucaagccucaguuuuugcuuuuuuaaaggaggggaaauauuugccucau

SEQ ID NO: 268987 - RNA, 64 nt, hsa
uucugaagaguaauaccaaaugccuaaaauuuuauuuuuaaaaaggaaaauuguuuaaaguauu

SEQ ID NO: 268988 - RNA, 64 nt, hsa
uugugaacaaauguucccuuggcuuuagcagauguuuuuaaaguuucuuuuguagaccgaacuu

SEQ ID NO: 268989 - RNA, 64 nt, hsa
ggcuuugaauauggcccgacacaaauucguaaacuuuuuaaaaaacauuguaagauucuuucug

SEQ ID NO: 268990 - RNA, 64 nt, hsa
uguuagcuuuaaaagaguauuuauguuggaauaauuuuuaaauaauguuuacauaacuguaagu

SEQ ID NO: 268991 - RNA, 64 nt, hsa
cuuucuguccagaaggcaaaauuaccgaaugccauuuuuaaaaguaugcuauaaacuaugcuac

SEQ ID NO: 268992 - RNA, 64 nt, hsa
acuuuuuuuuuuucccaauccaacagcauccuuuuuuuuaaaagagagaauuagaaaauauuaa

SEQ ID NO: 268993 - RNA, 64 nt, hsa
cuugagucuaaauuuauauguugaaaugcuaccuuuuuuaaaauaagaaacuaaauaaaauuau

SEQ ID NO: 268994 - RNA, 64 nt, hsa
cacaguauuguaucauaauuacaggaaguuuuuauuuuuaaaacuggaucugggguauauucau

SEQ ID NO: 268995 - RNA, 64 nt, hsa
gguuucuaagacuuacuaugggcuguaaaccuguuuuuuaaaacuauuuuagaaaccugagacu

SEQ ID NO: 268996 - RNA, 64 nt, hsa
auaauuauugguuuauuaugguaauuauggugauuuuuuaaauaucauguaauguuaaaacguu

SEQ ID NO: 268997 - RNA, 64 nt, hsa
cuguuuugccuuauacauuuuagaaacuggaaauuuuuuaaagaaaaugcuuuaguuuucuucu

SEQ ID NO: 268998 - RNA, 64 nt, hsa
uuucagauucugauuguuugaguuaaugguugaauuuuuaaaguuuuuaguuacuuaaaauaug

SEQ ID NO: 268999 - RNA, 64 nt, hsa
ggugaccuuuuaccaaguggugaguuaguuagguuuuuuaaaauaaaauguucauuguauuuga

SEQ ID NO: 269000 - RNA, 64 nt, hsa
uuuuuugaaguugucaucaauugcuuuacuaagauuuuuaaauagugaaaaccuccuguuuaga

SEQ ID NO: 269001 - RNA, 64 nt, hsa
cuucuguuacauaauuaaacuauuucugcuauuauuuuuaaagcaguauuauuuuauaaccaau

SEQ ID NO: 269002 - RNA, 64 nt, hsa
ugcaugcccaaaacacuacuaccaacaagaggauuuuuuaaaaucacagaauugauauuuaucu

SEQ ID NO: 269003 - RNA, 64 nt, hsa
uuucccguuugaggucuugguaguuuuuuuuuuuuuuuuaaacauggugccacuuuuaauuaac

SEQ ID NO: 269004 - RNA, 64 nt, hsa
uucucuuuccccaaaagugaugaucucaaguccuuuuuuaaagaaugacaaauuuuaggagacu

SEQ ID NO: 269005 - RNA, 64 nt, hsa
uuagaguagauguuuggaaaagcuaaguagaaauuuuuuaaaauagaaguuguauuuuaaacgu

SEQ ID NO: 269006 - RNA, 64 nt, hsa
gaggggcagaacagauagauuacgacagguuugguuuuuaaauuuuccaaccaaguggaaaggc

SEQ ID NO: 269007 - RNA, 64 nt, hsa
uguaacuuguucugguaauguccuucccggacucuuuuuaaaugucucccccuaaguuuuauac

SEQ ID NO: 269008 - RNA, 64 nt, hsa
ccuaaguuuuauacuugauuguauuauuagucuguuuuuaaauguuuugcccgguuuuucucuu

SEQ ID NO: 269009 - RNA, 64 nt, hsa
ggaaguuaugaaagaauguaauucacuaaauuauuuuuuaaaugaaaccuuuuuuuuucuuuuu

SEQ ID NO: 269010 - RNA, 64 nt, hsa
gguuuacuccuugcucuuacaacauuucuaaggauuuuuaaaaguuuacuucuugucuuguucu

SEQ ID NO: 269011 - RNA, 64 nt, hsa
aaaccuuaggagcaaauaaaccgugcuuucauguuuuuuaaauggugcuuuccuuacccgagag

SEQ ID NO: 269012 - RNA, 64 nt, hsa
aaagugcugcauuuugaugaauuuuuucuagccauuuuuaaagagaaaacuaggaauugaguau

SEQ ID NO: 269013 - RNA, 64 nt, hsa
cggucacauguuuuuccuucagcuugaaagcuuuuuuuuaaaaggaaaagauaccaaaugccug

SEQ ID NO: 269014 - RNA, 64 nt, hsa
aauguauaucuuuuaugucucuacucagaccauauuuuuaaaggggugccucauuauggggcag

SEQ ID NO: 269015 - RNA, 64 nt, hsa
aauauaaaucaucucauguggauaugaaacuucuuuuuuaaaacuuaaaaagguagaauguuau

SEQ ID NO: 269016 - RNA, 64 nt, hsa
auaucuuggcuugcuauauaagauucaaaagagcuuuuuaaauuuuucuaauaauaucuuacau

SEQ ID NO: 269017 - RNA, 64 nt, hsa
gggauuacauuuuuauggggcagggguaagcaaguuuuuaaaucauuugugugcucuggcucuu

SEQ ID NO: 269018 - RNA, 64 nt, hsa
ucccucaaggggcuccccucccgugcauggacauuuuuuaaaccaccgauuccaagaggaugag

SEQ ID NO: 269019 - RNA, 64 nt, hsa
ugugcaauugcucgcccuggagggaaccagaucauuuuuaaaccagaaauaauuuuuuuuauua

SEQ ID NO: 269020 - RNA, 64 nt, hsa
acauuuuaaaaacauagaaaaauucagcaaaccauuuuuaaaguagaagaggguuuuagguaga

SEQ ID NO: 269021 - RNA, 64 nt, hsa
uuaaggguuaucuuagauguuucacaccggaagguuuuuaaacacuaaaauauauaauuuauag

SEQ ID NO: 269022 - RNA, 64 nt, hsa
ucugccuuugauguuacagauuuaauacaguuuauuuuuaaagauagauccuuuuauaggugag

SEQ ID NO: 269023 - RNA, 64 nt, hsa
caguguuucaacaagauguugcugcaggagcagcuuuuuaaaacaagauaaaacucacagggga

SEQ ID NO: 269024 - RNA, 64 nt, hsa
uuaaaacaagauaaaacucacaggggaauguacuuuuuuaaaaaaaaaugaaaaagaaaaaaaa

SEQ ID NO: 269025 - RNA, 64 nt, hsa
uaguuguauuuugaaaugaugugucaggaaaaguuuuuuaaaaacuuguauguuuuugcaaauc

SEQ ID NO: 269026 - RNA, 64 nt, hsa
ugacaaguuguggcaaaggaaacuauacuuuucauuuuuaaaaauguaaauagaaaaguuuuua

SEQ ID NO: 269027 - RNA, 64 nt, hsa
caguuuaaauaaaaugagaaagguauguuuuucuuuuuuaaaaaagcugcuguuggaucuagaa

SEQ ID NO: 269028 - RNA, 64 nt, hsa
uaacaaauauauuuaaguacuaaaggugauuuuuuuuuuaaagacuuuuucaaauugucaaaug

SEQ ID NO: 269029 - RNA, 64 nt, hsa
gcacaaagaagagauaacuuccaaaagagugcuguuuuuaaaaauaauaauuaggaaauguuua

SEQ ID NO: 269030 - RNA, 64 nt, hsa
uuaaaauauuacuaacuuaaggguuucuaugugcuuuuuaaaauauuccuucuuugauguugac

SEQ ID NO: 269031 - RNA, 64 nt, hsa
auaggcaagcucuccuuauaaguaaggcuuucaauuuuuaaaacagacauccugcuuuaacaau

SEQ ID NO: 269032 - RNA, 64 nt, hsa
uucuucugucuuuauguuuuucuauaaccuggauuuuuuaaaucauauuaaaauuacagaugug

SEQ ID NO: 269033 - RNA, 64 nt, hsa
agauguaaauuauauauauaguauauuauauauauuuuuaaagcuuuauaugccucaaauauca

SEQ ID NO: 269034 - RNA, 64 nt, hsa
aacagauuaccaguuuuuuacuugugggugugauuuuuuaaaauaguucuuuauauauaauuaa

SEQ ID NO: 269035 - RNA, 64 nt, hsa
uaugcuauaggcagugcuugcuugaaaagucucauuuuuaaaucucccuggcaugaggugccca

SEQ ID NO: 269036 - RNA, 64 nt, hsa
uaagugcacuuguauugcuuuuuaaucuguuaauuuuuuaaagacccaagcagucauuuugagu

SEQ ID NO: 269037 - RNA, 64 nt, hsa
uaaccuuuuauaaauuuaaagucaauaaagcaccuuuuuaaaggaaacacugcaacuuuccuua

SEQ ID NO: 269038 - RNA, 64 nt, hsa
ggaugaaaugaggaaaaacaggaaaagaauucacuuuuuaaaugaagaaauuagugaaaaaauu

SEQ ID NO: 269039 - RNA, 64 nt, hsa
aaaugaauaaauaaaauaaaaauaaaaauguuacuuuuuaaaaaguaacuuuuuuaauaauaua

SEQ ID NO: 269040 - RNA, 64 nt, hsa
uauccuuuuuuagguuucccugcuuuccaguuaauuuuuaaaaugguagcgcuuuguaugcauu

SEQ ID NO: 269041 - RNA, 64 nt, hsa
gucuacaggaguaauaaugguuuccaaagaguauuuuuuaaaggaacaaaacgagcaugaauua

SEQ ID NO: 269042 - RNA, 64 nt, hsa
cuuguuuaguaucaaauuuuauuucacgaaaguuuuuuuaaagaacagaaacuuuuccaauuaa

SEQ ID NO: 269043 - RNA, 64 nt, hsa
cuuggcaaaugaauccauauugacauauuugauuuuuuuaaaaacauggaaacguacuguuuug

SEQ ID NO: 269044 - RNA, 64 nt, hsa
auuuuugccaauguaauuaaaaaaugguaugucauuuuuaaaauuuguauuucuuucauuacaa

SEQ ID NO: 269045 - RNA, 64 nt, hsa
auauucaugcacugaaaaaugcuguuaucuuuuguuuuuaaaaaaugcaauuaaaacuagaaau

SEQ ID NO: 269046 - RNA, 64 nt, hsa
uuuaguuguuguuaaaugaugaggaguuuuuuuuuuuuuaaauauggcuggaaagcuuguuuug

SEQ ID NO: 269047 - RNA, 64 nt, hsa
uacauauauauuuauauauuuuaaaaauaaacauuuuuuaaaucgucagaaggcaacauuuacc

SEQ ID NO: 269048 - RNA, 64 nt, hsa
aauuauuuuauaucuuauuugauguuaaguaauauuuuuaaaguaugguuuuugaagauaguag

SEQ ID NO: 269049 - RNA, 64 nt, hsa
gcuuuuuaagaugucuauuauauuuacuuauuaguuuuuaaaaauugcgcuacuugccugggaa

SEQ ID NO: 269050 - RNA, 64 nt, hsa
gggaaacauagcagaccucguuucuacuaaaaauuuuuuaaaaaagaaaauuagggcaaggugu

SEQ ID NO: 269051 - RNA, 64 nt, hsa
gcaacaugaugugaaaacccaucucuacaaaaauuuuuuaaaaaauaagccagggauuguggca

SEQ ID NO: 269052 - RNA, 64 nt, hsa
guagacuucugaauaagaugauagacgagaauuuuuuuuaaaaaaggaauuuaaaggaaucuug

SEQ ID NO: 269053 - RNA, 64 nt, hsa
gauuguaagccuuuucuggcaagcuuuucuucuuuuuuuaaacucuuuuccugaaacuuuuuau

SEQ ID NO: 269054 - RNA, 64 nt, hsa
uauuuuccccuuguuaagacauaggaagacuuaauuuuuaaacggucaguguccaguugaaggc

SEQ ID NO: 269055 - RNA, 64 nt, hsa
acuucauagggagaagcacuuaugacaaggcuauuuuuuaaaccgcgguauuauccuaauuuaa

SEQ ID NO: 269056 - RNA, 64 nt, hsa
ugagguuuuuuuguaaauccuuguauuccuauuuuuuuuaaagaaaaaaaaaaaaccuuaagcu

SEQ ID NO: 269057 - RNA, 64 nt, hsa
ucccuaaauauaguuauauuucauacuuaguuuguuuuuaaaaaguuuucucuguagaaaauuu

SEQ ID NO: 269058 - RNA, 64 nt, hsa
ccaguuuuguuugaaaguuguuuguccguaugauuuuuuaaaagucaaguuuaauuucaaaaaa

SEQ ID NO: 269059 - RNA, 64 nt, hsa
aaagacggggaauuaaauuacuaauuuuuuuuuuuuuuuaaaugaugacaguggucccagaacu

SEQ ID NO: 269060 - RNA, 64 nt, hsa
uacauuugggcugucuguauguuuuuauagcugguuuuuaaaaagcauaauaugccuauagcug

SEQ ID NO: 269061 - RNA, 64 nt, hsa
ggccuacagcauccuguguaucuugcaguugggauuuuuaaacauacuauaaagucuguguugg

SEQ ID NO: 269062 - RNA, 64 nt, hsa
uuauaagugacaaaauuaggccaaaggugauuuuuuuuuaaaucaggaagcugguuacuggcuc

SEQ ID NO: 269063 - RNA, 64 nt, hsa
uugauacccuaaucuugcuucuggaucuguucuuuuuuuaaaaaaacuuccuucaccgcgccua

SEQ ID NO: 269064 - RNA, 64 nt, hsa
aaugaucuauugcagauauuugauguaguuuucuuuuuuaaauuaaucagaaaccccacuucca

SEQ ID NO: 269065 - RNA, 64 nt, hsa
gcuuuuauuuaaagaaaaaaaaggcaguauucccuuuuuaaaugagcuuucaggaaguugcuga

SEQ ID NO: 269066 - RNA, 64 nt, hsa
aaauauauugucauacaauguuaaauaaccuauuuuuuuaaaaaaguucaacuuaagguagaag

SEQ ID NO: 269067 - RNA, 64 nt, hsa
aauugcgaaaucaagucugucaaguacaauaacauuuuuaaaagaaaauggaucccacuguucc

SEQ ID NO: 269068 - RNA, 64 nt, hsa
gcauguuuuaacagguuuuucuuuucuuuuuucuuuuuuaaaauguuuuauuuauuuaacccgc

SEQ ID NO: 269069 - RNA, 64 nt, hsa
ugccccgucgcauuaaugaggcccuuccacaucauuuuuaaacuaauguuuuucuauauuaaca

SEQ ID NO: 269070 - RNA, 64 nt, hsa
auguacacuuuuuguauucuguacagcuuugucuuuuuuaaauaugaaguacuuaaauguacuu

SEQ ID NO: 269071 - RNA, 64 nt, hsa
uuggugaguaacacacauauagugggagucguuuuuuuuaaaaaaauuuuuuaauuaaauucaa

SEQ ID NO: 269072 - RNA, 64 nt, hsa
cuuuuuuaaagaccaaagguagcugaaugguuuuuuuuuaaaugaguacaacucuagcauuuug

SEQ ID NO: 269073 - RNA, 64 nt, hsa
acauaacaauguuuaggauauugcaguguaggcuuuuuuaaagaccaaagguagcugaaugguu

SEQ ID NO: 269074 - RNA, 64 nt, hsa
uuaucagagauaauugcaguuucacaagguuuacuuuuuaaaguauaaacaaauuauguauuua

SEQ ID NO: 269075 - RNA, 64 nt, hsa
acuuucuuaaaacauucuggaauuuuuuuguaauuuuuuaaaucuuagcagcuaucauuagugu

SEQ ID NO: 269076 - RNA, 64 nt, hsa
uuuaagcaauuuauaaaucuaaaaccugaagauguuuuuaaaacaauauuaacagcuguuaggu

SEQ ID NO: 269077 - RNA, 64 nt, hsa
uauuaagcacaagauaaagaacagcuguuaauauuuuuuaaaaaucuauuuuaaaaugugauuu

SEQ ID NO: 269078 - RNA, 64 nt, hsa
caagaacuuugagacuaauuuguauugacucgguuuuuuaaaauaacuggcaaaugcuaugcuu

SEQ ID NO: 269079 - RNA, 64 nt, hsa
cuggcgugagccaccaugcccagccucaaauauguuuuuaaaaaauaucauuguccuccuccuc

SEQ ID NO: 269080 - RNA, 64 nt, hsa
uggauauucauuuauacugauuuaugaaaguaaguuuuuaaacacugaaacaaucauugcuaaa

SEQ ID NO: 269081 - RNA, 64 nt, hsa
caaaugcagauuuugucauaaaguuguuauagauuuuuuaaaaugcuuuuuuaauauuaaaaug

SEQ ID NO: 269082 - RNA, 64 nt, hsa
uauaauauauguuuuaaauauagaauuuuuaauguuuuuaaauauauuuucaaaguacauaaaa

SEQ ID NO: 269083 - RNA, 64 nt, hsa
cuguuguguucguucuuguucuguuuuguuuuguuuuuuaaagucuugcuguggucucuuugug

SEQ ID NO: 269084 - RNA, 64 nt, hsa
aguaaaugguagugaguuaaauuaucuuuauuauuuuuuaaaaauaagaauuuagaagugguaa

SEQ ID NO: 269085 - RNA, 64 nt, hsa
auaaaauuucaaaagaaaagguugucuuuuaaguuuuuuaaauauuuguugccuuuuaaaaucc

SEQ ID NO: 269086 - RNA, 64 nt, hsa
uuuuuuauauauacucucagagaauuccucuuaauuuuuaaagaugcuggugauaauaaaauuc

SEQ ID NO: 269087 - RNA, 64 nt, hsa
gaaaugaaaauuuuauacucuauguuucuguuuauuuuuaaauccuuaacagcaaaauauuugc

SEQ ID NO: 269088 - RNA, 64 nt, hsa
gcuaaacguaauuauuauuuaaaugaaagcuauuuuuuuaaaugaauugaaauuuuucaugaug

SEQ ID NO: 269089 - RNA, 64 nt, hsa
uacuuucacuuuuuuacaaccuggccagaggcauuuuuuaaaucaggcccaauaucaguauucu

SEQ ID NO: 269090 - RNA, 64 nt, hsa
uauaauacuaaaauguaacuuuuuaaucaucugguuuuuaaaagauaaacaguuuagcccaucu

SEQ ID NO: 269091 - RNA, 64 nt, hsa
aauauugauuuucccauuaacaauuuuuuuuuguuuuuuaaauacuaauauguuucacacuaua

SEQ ID NO: 269092 - RNA, 64 nt, hsa
acuauuucuguggaauaauuauaaaaguaugaccuuuuuaaaucaaccuuauuuggaugcaucu

SEQ ID NO: 269093 - RNA, 64 nt, hsa
ugacuuuuuaaggguccuucuuuccagcacauuuuuuuuaaaaacucagguuagaacaaaaaug

SEQ ID NO: 269094 - RNA, 64 nt, hsa
agugaagacagaaccagagggaauaaggaucuuuuuuuuaaagacagcauggaaaguuuaagau

SEQ ID NO: 269095 - RNA, 64 nt, hsa
cacuggagaagauauguguagaauuuuuguuuuauuuuuaaaauguguaaaacaucuuuuguuu

SEQ ID NO: 269096 - RNA, 64 nt, hsa
agguggucaaauucuggaaguaagcauuuccucuuuuuuaaaaauuugguuugagccuuaugcc

SEQ ID NO: 269097 - RNA, 64 nt, hsa
cucagaaugauagugccuuuaaaaauuuuuuuauuuuuuaaagcauaagaauguuaucagaauc

SEQ ID NO: 269098 - RNA, 64 nt, hsa
auaauuaucaaaacuuuuaaaauagaugcucauauuuuuaaaauaaaguuuuaaaaauaacugc

SEQ ID NO: 269099 - RNA, 64 nt, hsa
uauuuuuuaaaaucaaugugaaaacauagacuuauuuuuaaauuguaccaaucacaagaaaaua

SEQ ID NO: 269100 - RNA, 64 nt, hsa
uugcuuaaucauuuguaauucaaacaugcuauauuuuuuaaaaucaaugugaaaacauagacuu

SEQ ID NO: 269101 - RNA, 64 nt, hsa
ugauuuuaaaggauuuugccuuuucuuugaagcauuuuuaaaccauaauauguuguaaggaaaa

SEQ ID NO: 269102 - RNA, 64 nt, hsa
uaaugcaaguucuacaaugauaauauauuaaagauuuuuaaaaguuuaucuuuucacuuagugu

SEQ ID NO: 269103 - RNA, 64 nt, hsa
aguauguauauuaaaaaagagacauccaaauuuuuuuuuaaagcagucuacuagauugugaucc

SEQ ID NO: 269104 - RNA, 55 nt, hsa
auuccauuuugugguguuaagugucuuuuuaaaaauuguuauuuaaauccugaag

SEQ ID NO: 269105 - RNA, 64 nt, hsa
aacagcaaauauuuauauuuuuuccauuuugcucuuuuuaaaucuauguuuagaacuuuauauc

SEQ ID NO: 269106 - RNA, 64 nt, hsa
ugcuaaaggcuaauggcauuuuaaacaucuuacauuuuuaaaaauuuauauugccucugccaaa

SEQ ID NO: 269107 - RNA, 64 nt, hsa
aaauauuuacuuaaucuggaaaacaauguaacuauuuuuaaagugguuacaucuauucuugcug

SEQ ID NO: 269108 - RNA, 64 nt, hsa
auuaaagguggcauggagacuguggagggaauauuuuuuaaagcacuacucauauccuuuaaac

SEQ ID NO: 269109 - RNA, 64 nt, hsa
guaauauaauaauguccuuucccuggagucaguuuuuuuaaaaaguuaacucuuaguuuuuacu

SEQ ID NO: 269110 - RNA, 64 nt, hsa
ucuugcuuguaaaaauauguauuauacaucuguauuuuuaaauucugcuccugaaaaaugacug

SEQ ID NO: 269111 - RNA, 64 nt, hsa
ccccuucgauagcaagucccaucagccuauuauuuuuuuaaagaaaacuugcacuuguuuuucu

SEQ ID NO: 269112 - RNA, 64 nt, hsa
acgaagggacaucuuuggaaaacgcugguuuugguuuuuaaaaagcccaacuuuuuuuuuuuaa

SEQ ID NO: 269113 - RNA, 64 nt, hsa
ucucccuuccccgugguggccccgcucccuaaauuuuuuaaaaagacaaaaacaaaacaacaac

SEQ ID NO: 269114 - RNA, 64 nt, hsa
agcuuagagauguagcgauguaagugucgauguuuuuuuaaaaaaaaaugcaaaaaaauucuua

SEQ ID NO: 269115 - RNA, 64 nt, hsa
uagaagcaagaugaaaaaaaggaaaagcaggugcuuuuuaaaaaucagaacugagguagcuuag

SEQ ID NO: 269116 - RNA, 64 nt, hsa
uauuuuccaacuuguauuuucauauaauuuauauuuuuuaaaagcugaaaauuuagaagcaaga

SEQ ID NO: 269117 - RNA, 64 nt, hsa
ggugguuuauacacuggaaauguugcguuuaugcuuuuuaaaaacacacguuaacuucagagga

SEQ ID NO: 269118 - RNA, 64 nt, hsa
gcuuaacagagaaagagacuaauguguccaaucauuuuuaaaaaucauccaugaaaaagugucu

SEQ ID NO: 269119 - RNA, 64 nt, hsa
gauuguuuaaucuuuuuaaaaaagguuuaaacuuuuuuuaaaaaaaaaaucuuuaaacuggccu

SEQ ID NO: 269120 - RNA, 64 nt, hsa
uugaguaccuuuuugcuagccugauuguuuaaucuuuuuaaaaaagguuuaaacuuuuuuuaaa

SEQ ID NO: 269121 - RNA, 64 nt, hsa
cagauuugaaggaaaaaaauuuugauguaacaauuuuuuaaauaaaauuuuguuuuucuguaau

SEQ ID NO: 269122 - RNA, 64 nt, hsa
agugaugacuucuaaugcuuauaucucaagguauuuuuuaaaaaagcaacggucccuaauagag

SEQ ID NO: 269123 - RNA, 64 nt, hsa
acagcauguugcaguuucuuuucgguuuugguuuuuuuuaaauguuuuauuuugcuuucccagc

SEQ ID NO: 269124 - RNA, 64 nt, hsa
gaauucaggucaguuucaguauuuuucaaauauuuuuuuaaaacugaauugcaauugugccaag

SEQ ID NO: 269125 - RNA, 64 nt, hsa
uucaaauauucugggauaagguagcaagaucuuguuuuuaaacaaucucuugaaggcaauucca

SEQ ID NO: 269126 - RNA, 64 nt, hsa
uccuuggacuuuuagcuguuaaaugguaucucauuuuuuaaaacacauuucacauuuaaaguca

SEQ ID NO: 269127 - RNA, 64 nt, hsa
augccaacguugucuuugauaauauuuaauauauuuuuuaaaaaacaauucuuguaaaauacuu

SEQ ID NO: 269128 - RNA, 64 nt, hsa
cuaucuaaaguuuguuagauagcugcauguggcuuuuuuaaaaaagcaacagaaaccuauccuc

SEQ ID NO: 269129 - RNA, 64 nt, hsa
aaacacagucaaaauaauucuaaaucccucgauauuuuuaaagaucuguaaguaacuucacauu

SEQ ID NO: 269130 - RNA, 64 nt, hsa
cauuagagucaaccccuucuuuuuuuuuuuuuuuuuuuuaaauccaguauuuaggauaauauuu

SEQ ID NO: 269131 - RNA, 64 nt, hsa
agugauauaaaaaccagcaguuuuuacacuaaauuuuuuaaagaaauauuagacaaaaauauag

SEQ ID NO: 269132 - RNA, 64 nt, hsa
uauuauccauuugaucuauagcaaugugauuuuauuuuuaaaaagaaaagcaguguguuuucuu

SEQ ID NO: 269133 - RNA, 64 nt, hsa
guaucugcgaaguaaucugcaaucucuuuuguucuuuuuaaaauuugauuuguuauaaaauugc

SEQ ID NO: 269134 - RNA, 64 nt, hsa
augucaugauguaauuuuucuuucuucuuucuuuuuuuuaaauuuuagcaguggcuuauuauuu

SEQ ID NO: 269135 - RNA, 64 nt, hsa
cauguaacauguuaaaagguuaaacuuauggcuauuuuuaaagggcuauucauuuaaucugagu

SEQ ID NO: 269136 - RNA, 64 nt, hsa
uuauauuucuuauucagaacccuugaugagacuauuuuuaaacauacuagucugcugauagaaa

SEQ ID NO: 269137 - RNA, 64 nt, hsa
gcuuguagaauuaguguauuuuuauuaaacuauuuuuuuaaaugucaaacuucuaucauguaaa

SEQ ID NO: 269138 - RNA, 64 nt, hsa
ccuaauguuugucauaacuguuaauggaugaaauuuuuuaaagauacaaccaugauaaccauua

SEQ ID NO: 269139 - RNA, 64 nt, hsa
guuucccccaacucccccauuuuugguuuguuucuuuuuaaauauuuguugaguacuuacgugu

SEQ ID NO: 269140 - RNA, 64 nt, hsa
uuaugagauuuucucaccccacaucgcuccccuuuuuuuaaaaaggacuguuuugcuaguguga

SEQ ID NO: 269141 - RNA, 64 nt, hsa
gauaggguuucauuuauuucuauacuuuuucuguuuuuuaaacaccugcauauuuuuauguaaa

SEQ ID NO: 269142 - RNA, 64 nt, hsa
gaauugguagaugaaaaaaaccugguucaaguuuuuuuuaaaauguggugucccauuccaaggg

SEQ ID NO: 269143 - RNA, 64 nt, hsa
aaaacugguggaaaaaagagaccaacuuuguuauuuuuuaaauuauugauuuuuaaauuauggg

SEQ ID NO: 269144 - RNA, 64 nt, hsa
aagagaccaacuuuguuauuuuuuaaauuauugauuuuuaaauuaugggagcaaauccaucucc

SEQ ID NO: 269145 - RNA, 64 nt, hsa
augguguuaacuuuucguugcugaagagcuuaacuuuuuaaaggcuuuguccuauacauuuaga

SEQ ID NO: 269146 - RNA, 64 nt, hsa
gaauggcuuuauuuacuuuggugacuguuuauaguuuuuaaauaaaagacugaacauuuucuug

SEQ ID NO: 269147 - RNA, 64 nt, hsa
auguuuuuuuaaccaugaaaugacaauaaaaugauuuuuaaaaugagaauguuuuggauaagug

SEQ ID NO: 269148 - RNA, 64 nt, hsa
agugauaggaucccaaaauucaucucuaaugugguuuuuaaaugcuggaggauuccaaucaaua

SEQ ID NO: 269149 - RNA, 64 nt, hsa
uuaaguguuaaauaauguagaaguaaaaaaauuuuuuuuaaaggcuuaauuugggaggggggac

SEQ ID NO: 269150 - RNA, 64 nt, hsa
uacucaguuugaaacuauucauuucuacacacuauuuuuaaaaauugccuacuaggugaaacau

SEQ ID NO: 269151 - RNA, 64 nt, hsa
acuuaauuacugcacuuaaaaugaaacauuacuuuuuuuaaacaaugugucacaaauguagguc

SEQ ID NO: 269152 - RNA, 64 nt, hsa
gauagcuugaauauuauuucacauuccuuuuucuuuuuuaaauaaacagguuugcuuuggaaag

SEQ ID NO: 269153 - RNA, 64 nt, hsa
aaauucaccugauuauuagauaacuuaaaguuuauuuuuaaaagcugacaacuuuuuaugaauc

SEQ ID NO: 269154 - RNA, 64 nt, hsa
gguguauuuuauaaacuaaagcugccuauguuucuuuuuaaagcucgcauucccagaaucagcu

SEQ ID NO: 269155 - RNA, 64 nt, hsa
guuaaaucguauuauuuuuuucuuaacagaaauauuuuuaaaaaugaaaaaguacucaaaagug

SEQ ID NO: 269156 - RNA, 64 nt, hsa
uuaccccacuguaacaucauguaaacuaaguauguuuuuaaacaauuuuuaagacuuguaauua

SEQ ID NO: 269157 - RNA, 64 nt, hsa
caucuguaauuuaaauguuucuaguaaccacauuuuuuuaaaaguaaaaagaaacccaugguau

SEQ ID NO: 269158 - RNA, 64 nt, hsa
uuuuuuauuuauuugaaguuagacuagauauacguuuuuaaauuuaacaucuggcuggacagug

SEQ ID NO: 269159 - RNA, 64 nt, hsa
aaacucaccaucuccugaagaccuuucuuaccuuuuuuuaaaaacaaaaaaugaaauuauuuug

SEQ ID NO: 269160 - RNA, 64 nt, hsa
aagaguauugaagauugaaaggguuuuucuuucuuuuuuaaaaaagaaaaacaaacuauugauu

SEQ ID NO: 269161 - RNA, 64 nt, hsa
uuacaauuaugaauggaggauauucuacuguacuuuuuuaaaaagaaacuauuuuuguguuuga

SEQ ID NO: 269162 - RNA, 64 nt, hsa
uuuuccuaaguuuuuuucauuuuuuugaaugaguuuuuuaaauuuuuuagaugaccaaaacuug

SEQ ID NO: 269163 - RNA, 64 nt, hsa
aguguucuuuugaaauguucaucaggaauaggcuuuuuuaaaaaauguuguguaucuguauaua

SEQ ID NO: 269164 - RNA, 64 nt, hsa
cugaaugcaaaaaggaaaaaaacccacaaacauguuuuuaaaauaaaauaucuuuuuuugccuu

SEQ ID NO: 269165 - RNA, 64 nt, hsa
ugacuuuaucuaggaguuuguuuuucauuuuguuuuuuuaaaguauuagaaaagguuuuagcug

SEQ ID NO: 269166 - RNA, 64 nt, hsa
gugauauuuuccucaauggcaaauuuuaaauuaguuuuuaaaaacuuacuuauuuggguaguua

SEQ ID NO: 269167 - RNA, 64 nt, hsa
aauuugaaucacuccugaauacagaggcauauucuuuuuaaacuauaaauaccauuuugaguga

SEQ ID NO: 269168 - RNA, 64 nt, hsa
aauaggaaaauuccuguuuggcuuuuugucuuccuuuuuaaaugcuuuuuguauguaauauuuu

SEQ ID NO: 269169 - RNA, 64 nt, hsa
gcugaguaaauuuuacuuguaaucuacaauuggcuuuuuaaaaauaaccuguugauauauaauu

SEQ ID NO: 269170 - RNA, 64 nt, hsa
uuauucauauaaugacuuuuuuuuaagagucucuuuuuuaaaaaaacuuaauucucuaaaaccg

SEQ ID NO: 269171 - RNA, 64 nt, hsa
cuuaauucucuaaaaccgaaaugguucaugcuucuuuuuaaaaaugauuguauaaaauguaugg

SEQ ID NO: 269172 - RNA, 64 nt, hsa
uuuugacaggguacagaguauuuuacuaaaaguauuuuuaaauguuucucaugugauuucugua

SEQ ID NO: 269173 - RNA, 64 nt, hsa
auuucuguaccuucuuccuccugccccuuuugcuuuuuuaaagaaacuggggaaggauuuauga

SEQ ID NO: 269174 - RNA, 64 nt, hsa
aucaaauaguuuucucuuugugucuguguuaguguuuuuaaagcugcucauuucauuuugucca

SEQ ID NO: 269175 - RNA, 64 nt, hsa
guuuugacuacuaauugggggaaauuuuagauaauuuuuaaauucaaaguuauuuauaaaaugc

SEQ ID NO: 269176 - RNA, 64 nt, hsa
cugguuuuauaagguuguuuuuaccacaguggucuuuuuaaaccaccugcccacucccuuaaca

SEQ ID NO: 269177 - RNA, 64 nt, hsa
gcacagucuacuggguagguauuguaaauaauaauuuuuaaaacuugcacaaaucaaaacaaac

SEQ ID NO: 269178 - RNA, 64 nt, hsa
gcuauuaauaguaucagauacagaacccucauaauuuuuaaaugaucugaauuuggcagugaau

SEQ ID NO: 269179 - RNA, 64 nt, hsa
uaaacccaacucuucaugauuugccugugacuuauuuuuaaaacuuuuuuaaaaaagauuuagc

SEQ ID NO: 269180 - RNA, 64 nt, hsa
cuucaugauuugccugugacuuauuuuuaaaacuuuuuuaaaaaagauuuagcuuuaaaauagu

SEQ ID NO: 269181 - RNA, 64 nt, hsa
agaauaaaauaguuaagcauuaauguaguugaacuuuuuaaauuuuugaauuggaaaaaaauuc

SEQ ID NO: 269182 - RNA, 64 nt, hsa
gaaaccugaucuuuccuaauccucacuuuuuucuuuuuuaaaaagcaguuucuccacugcuaaa

SEQ ID NO: 269183 - RNA, 64 nt, hsa
auacaauccuuugcauuguuaaggagguuuuuuguuuuuaaauggugggucaaggagcuaguuu

SEQ ID NO: 269184 - RNA, 64 nt, hsa
cauaguaguuguauggacuucuaaccaguugaguuuuuuaaagcauugaggauuuuuuccucuu

SEQ ID NO: 269185 - RNA, 64 nt, hsa
gaggauuuuuuccucuuaccaacuccucuucagguuuuuaaagacccagcccuucccaaucuca

SEQ ID NO: 269186 - RNA, 64 nt, hsa
aucugaagagucaaaugguuuugugacuccauaguuuuuaaaguaauaagggucaaagacuaca

SEQ ID NO: 269187 - RNA, 64 nt, hsa
aagggucaaagacuacaucagagauucaaauagguuuuuaaagaaaagcuaagcaagagagcca

SEQ ID NO: 269188 - RNA, 64 nt, hsa
uucuuagguaaaguucuucugaaagaauuuucuauuuuuaaaaaauguaucucuuuagccuuuu

SEQ ID NO: 269189 - RNA, 64 nt, hsa
gaaauaaucuggcaaauuuuuaggggugggaacuuuuuuaaauguucauuuaaaaaaaaacaaa

SEQ ID NO: 269190 - RNA, 64 nt, hsa
ucuguguuugagauuuuucuuuauuucuuuuuuuuuuuuaaauaguaagucacagguccacacu

SEQ ID NO: 269191 - RNA, 64 nt, hsa
guuacuagccagagaguaugacuauguuagauuauuuuuaaagaugaaacauguaugauaggau

SEQ ID NO: 269192 - RNA, 64 nt, hsa
uguugauaauuuuacugaucuaaagcugagugauuuuuuaaaagaauuugaauuuggcuuccuc

SEQ ID NO: 269193 - RNA, 64 nt, hsa
uaucgccaugcaaauuacaaucuugaaugaguguuuuuuaaaaauaaaguauuagaaaaaugug

SEQ ID NO: 269194 - RNA, 64 nt, hsa
uaaaauuguccuuguguauaacgugugaaucauuuuuuuaaacugaaauuuaaaaugcaacaua

SEQ ID NO: 269195 - RNA, 64 nt, hsa
uuacacacuuaaucuuagcggauuacuucagauguuuuuaaaaaguauauuaagaugccuuuuc

SEQ ID NO: 269196 - RNA, 64 nt, hsa
gucucaacaggcgcucacugaaguguaugaauauuuuuuaaaaagguuuuugcaguaagcuagu

SEQ ID NO: 269197 - RNA, 64 nt, hsa
gauaauauuuuccaacagcugaaguagggauaguuuuuuaaaaaauuuaaugauggguaaucaa

SEQ ID NO: 269198 - RNA, 64 nt, hsa
gacauacaacaaaugguuaucccacuuguauauuuuuuuaaagacucuuauccuguuacccuua

SEQ ID NO: 269199 - RNA, 64 nt, hsa
uaaaaaucaguuauggcacaauaaagauuuucuguuuuuaaauuguauuucaucugcuuccucc

SEQ ID NO: 269200 - RNA, 64 nt, hsa
uuuauucugaugauaaaaacaguuagccagacuguuuuuaaagcaccuggcgggaagcagaagg

SEQ ID NO: 269201 - RNA, 64 nt, hsa
cuguaacauuuuucuauuguuuaaauagaaagccuuuuuaaaauuuggucaaucuucauagaug

SEQ ID NO: 269202 - RNA, 64 nt, hsa
cuugaucuuacccaugaaugugcacuaccuacauuuuuuaaauagcuagguuuuuacugauuau

SEQ ID NO: 269203 - RNA, 64 nt, hsa
uuuaagugguaaggauuuucucuuacucuguuuauuuuuaaaugaucaucauaauccuuugcuu

SEQ ID NO: 269204 - RNA, 64 nt, hsa
ggagcacucauuaaaggcagaagacggaaaaguguuuuuaaaauggugaauuuaagugguaagg

SEQ ID NO: 269205 - RNA, 64 nt, hsa
acaacuuaaccaaguauagggcucagaaauuauauuuuuaaaugucugauuauuauuggaugga

SEQ ID NO: 269206 - RNA, 64 nt, hsa
gcuugugaauguguuuuguuguuuugugcuacaauuuuuaaaaagaaaaaaguuuuguuuuguu

SEQ ID NO: 269207 - RNA, 64 nt, hsa
aagcacugaagucuuacccgucaacuuuuuuuuuuuuuuaaauaaacuuuauggcuguuuguuc

SEQ ID NO: 269208 - RNA, 64 nt, hsa
uacagccuuaaagacaaaaauccuuguugaaguuuuuuuaaaaaaagcuaaauuacauagacuu

SEQ ID NO: 269209 - RNA, 64 nt, hsa
uuuggggugguggugugccaagacauuaauuuuuuuuuuaaacaaugaagugaaaaaguuuuac

SEQ ID NO: 269210 - RNA, 64 nt, hsa
agcauugcuuuuguuucuuaagaaaacaaacucuuuuuuaaaaauuacuuuuaaauauuaacuc

SEQ ID NO: 269211 - RNA, 64 nt, hsa
acuggcugugguuuuucauaagauguuuuguggcuuuuuaaagaagugucuuacucccucuucu

SEQ ID NO: 269212 - RNA, 64 nt, hsa
aucagaaaaaaauuuuuggagugcauugcaauuuuuuuuaaagcauaaaacauauuucuagaua

SEQ ID NO: 269213 - RNA, 64 nt, hsa
aaccuaguucaaaaugaaauuauuuagauaccaauuuuuaaaauacuggagagaauuuauaugu

SEQ ID NO: 269214 - RNA, 64 nt, hsa
cuuguuuuuauccccuuggguuguuuuucucugauuuuuaaauaaacuuaagaaauuuagauua

SEQ ID NO: 269215 - RNA, 64 nt, hsa
uauauauuucaagcuuauuucaaaauuggugguuuuuuuaaaaaaagaggcaagaaaauaaaaa

SEQ ID NO: 269216 - RNA, 64 nt, hsa
uagcucaaauaucuguugcacuguucaacugauauuuuuaaaauucuaauaaucuucaucucaa

SEQ ID NO: 269217 - RNA, 64 nt, hsa
uuacuauguuguaauucuuugcauaugaaauguuuuuuuaaacaguucauacuuaccuaaaauu

SEQ ID NO: 269218 - RNA, 64 nt, hsa
aauauuuaugccacuacaguguauuaccuacagauuuuuaaauuuagcuuuauuuaucaaccca

SEQ ID NO: 269219 - RNA, 64 nt, hsa
agcagucucuguaucaauguuuacauguuacuacuuuuuaaauuucaauacuuuuauaacuguu

SEQ ID NO: 269220 - RNA, 64 nt, hsa
guaaagcauauuagaauaauuguggguugacagauuuuuaaaauagaauuuagaguauuugggg

SEQ ID NO: 269221 - RNA, 64 nt, hsa
cuuuuuggaaaauagcacuuuucacuucuguguguuuuuaaaauuaauguuauagaagacucau

SEQ ID NO: 269222 - RNA, 64 nt, hsa
uuaaagucaucacauuaaacauuguaauacuaguuuuuuaaaaguccagcuuuuaguacaggag

SEQ ID NO: 269223 - RNA, 64 nt, hsa
agauugauuguccuggggcuaagaaagaagauaauuuuuaaagaaugggagugggcaacaguga

SEQ ID NO: 269224 - RNA, 64 nt, hsa
agcaaaucucucuccaaaauucuuaaaguugauuuuuuuaaagggggaggggaaggcuuuaaug

SEQ ID NO: 269225 - RNA, 64 nt, hsa
uuauuuuaaagaaaaacacuaguguccaauuucauuuuuaaaagauguagaaagaagaaucaag

SEQ ID NO: 269226 - RNA, 64 nt, hsa
uaccacaaguuacaauuugaaaagaaaacuauuuuuuuuaaauauuccauuguuaacugaaugu

SEQ ID NO: 269227 - RNA, 64 nt, hsa
uguauguauaaaauuucacagggauaugcuuuuuuuuuuaaagacugaauguguucaccauuua

SEQ ID NO: 269228 - RNA, 64 nt, hsa
uuucccuuaugauguccccuuuuugagacacuaauuuuuaaauacuuacuagcucugaaauaua

SEQ ID NO: 269229 - RNA, 64 nt, hsa
aaugcacuuuaguauaaagggcacaguuuguauauuuuuaaaugaauaccaauuuaauuuuuua

SEQ ID NO: 269230 - RNA, 64 nt, hsa
caccauggcaugcgccaccaugcccuauuuuuuuuuuuuaaagacagggucuugcuauauugcc

SEQ ID NO: 269231 - RNA, 64 nt, hsa
gcuggggaugguaggauugcuggggauuuuuuuuuuuuuaaacagggucucacucuguugccca

SEQ ID NO: 269232 - RNA, 64 nt, hsa
aaaaccucaauuuauguucaugacaguggggauuuuuuuaaaugucuacauucuuucuaauaaa

SEQ ID NO: 269233 - RNA, 64 nt, hsa
uugccuacuuuaacccauuuuucaaccuguuuguuuuuuaaaaggcuucacuaaggguugauau

SEQ ID NO: 269234 - RNA, 64 nt, hsa
uguuuggggguuauuuggggggagguugguuuuguuuuuaaauauaaaaaaaaaaaucugucac

SEQ ID NO: 269235 - RNA, 64 nt, hsa
ccacugugccuggcuuccauccucuucuaucauuuuuuuaaaucucuucuccuaucauaaaauu

SEQ ID NO: 269236 - RNA, 64 nt, hsa
uaaagcauuuuaaauaauaccugccuuguaccauuuuuuaaauagaaguuacuucauuauauuu

SEQ ID NO: 269237 - RNA, 64 nt, hsa
uuuauacugggaaugaugcucauauaagaauaccuuuuuaaacuauuuuuuaacuuuguuuuau

SEQ ID NO: 269238 - RNA, 64 nt, hsa
ugaacuuuuauuuaaaagagagagaaucuuauguuuuuuaaauggaguuaugaauuuuaaaagg

SEQ ID NO: 269239 - RNA, 64 nt, hsa
uuugagauuugaaauuauacaucaugcuucucauuuuuuaaacuauguucuuuaaaucaacacu

SEQ ID NO: 269240 - RNA, 64 nt, hsa
cuugaacauuauucacuuagauuucuuccaguauuuuuuaaaaaacuguccuaucucauuuuaa

SEQ ID NO: 269241 - RNA, 64 nt, hsa
aagggauuucauggccucuucuugaaaucaagacuuuuuaaaagucagacaugaacuugcaugu

SEQ ID NO: 269242 - RNA, 64 nt, hsa
agauguuuguuacauuuuuaaaaauugcucuuaauuuuuaaacucucaauacaauauauuuuga

SEQ ID NO: 269243 - RNA, 64 nt, hsa
gauuuuauugucagauauuuagauguuuguuacauuuuuaaaaauugcucuuaauuuuuaaacu

SEQ ID NO: 269244 - RNA, 64 nt, hsa
gggauuuucagaaguuagccugaauuuaacuguauuuuuaaauuuaaccuccauuaacuaagca

SEQ ID NO: 269245 - RNA, 64 nt, hsa
guuuuuguauuuucuugguagacuagguaauuuuuuuuuaaaggacaggaaacugauauuuuaa

SEQ ID NO: 269246 - RNA, 64 nt, hsa
ucuucuaagacuaaauagguaguuguguucuuuauuuuuaaaauuucuuuuuagagcaaauguu

SEQ ID NO: 269247 - RNA, 64 nt, hsa
ugaauacaucgagagagauaaauggcaaauugcuuuuuuaaaaguuuacauaaguuuuuuuuaa

SEQ ID NO: 269248 - RNA, 64 nt, hsa
auuaagugaauucuagguagcuuguuuguuauuauuuuuaaaggacgcucuaggaaaguaauug

SEQ ID NO: 269249 - RNA, 64 nt, hsa
uagugaaaagugacacuucaaaagugugcuuacauuuuuaaaaagacaaauaaaaacaguguuu

SEQ ID NO: 269250 - RNA, 64 nt, hsa
ugcuuuuuaaaaauauuuuuuuauuuuuuacuuauuuuuaaauuuucucuuuuuauuuauuuuu

SEQ ID NO: 269251 - RNA, 64 nt, hsa
uccuaaacccacccacuucucuugcccaggcugcuuuuuaaaaauauuuuuuuauuuuuuacuu

SEQ ID NO: 269252 - RNA, 64 nt, hsa
uuuccaaacuaaauuacucgggaaguaaacgcuuuuuuuaaaaguauuuuuacugguuuuauac

SEQ ID NO: 269253 - RNA, 64 nt, hsa
ucguuucguuuugauaauuguugaaccaauuuuguuuuuaaaaccuuuagacucugaaaguaau

SEQ ID NO: 269254 - RNA, 64 nt, hsa
uuuugcaucccaaauguuuuuaaucuuuguauauuuuuuaaaaauccuuuucuccucaucauug

SEQ ID NO: 269255 - RNA, 64 nt, hsa
augcccuuuuauuaaauaaauucauggcaauguuuuuuuaaaagacauuucagcuucuuuacuc

SEQ ID NO: 269256 - RNA, 64 nt, hsa
uuuacuacuuaaugguuuugaagcaacuguuuaauuuuuaaaauuuuugaaaacuugcuaauaa

SEQ ID NO: 269257 - RNA, 64 nt, hsa
acagaagacacacuuguacgaauguagauuuauuuuuuuaaaaaaaaaaaagcaaagcuuucug

SEQ ID NO: 269258 - RNA, 64 nt, hsa
gugaagucucagcuuugagcuggaggcuagaaacuuuuuaaaaaacuaaaccagaagagacuuu

SEQ ID NO: 269259 - RNA, 64 nt, hsa
uagagcaagaagaccucagacaggaaacuggaauuuuuuaaagugccaaaacauauagaaaugu

SEQ ID NO: 269260 - RNA, 64 nt, hsa
acaguucccacauuagauacuguuuaaaaguucuuuuuuaaacucaauuuuuuuuagaaacaua

SEQ ID NO: 269261 - RNA, 64 nt, hsa
uuaaagggcuaaauuauauaagcaaacacuacuuuuuuuaaaacgucuggacucaaaaaaugcu

SEQ ID NO: 269262 - RNA, 64 nt, hsa
ugaauuugggggugcaggggcaggaguuggaaauuuuuuaaaguuagaaggcuccauuguuuug

SEQ ID NO: 269263 - RNA, 64 nt, hsa
gaaaaaaagaaaaaaaagaaagcauagacauauuuuuuuaaaguauaaaaacaacaauucuaua

SEQ ID NO: 269264 - RNA, 64 nt, hsa
aaacuuuacucuuauucuuagcuguauauacauuuuuuuaaaaguuuguuaaaauaugcuugac

SEQ ID NO: 269265 - RNA, 64 nt, hsa
uaacuguucuuccuggcgcuaaaaagagcuguauuuuuuaaagugcuggggcaaacaaagcaac

SEQ ID NO: 269266 - RNA, 64 nt, hsa
ugauuuaaaauuaugcagggccccuaugugggauuuuuuaaaaagcaaacugguguguauucuc

SEQ ID NO: 269267 - RNA, 64 nt, hsa
uccaagcauguauguagagaaaggacuuugccgcuuuuuaaaacuagugucacagucucucuug

SEQ ID NO: 269268 - RNA, 64 nt, hsa
cuacaaaaagaaacauuuaaugacgguuuaaaacuuuuuaaaagaaaacucaguauuauuuuug

SEQ ID NO: 269269 - RNA, 64 nt, hsa
uguccagcaugcuuguauguauauuucagaaccuuuuuuaaauguaaaagcuguacauuucugg

SEQ ID NO: 269270 - RNA, 64 nt, hsa
uuuuucccggaauucaucagaacuuugaauuuuuuuuuuaaaugggcuguuuuuaaugcagggg

SEQ ID NO: 269271 - RNA, 64 nt, hsa
gagccuuuguggugggacuuuuuaaaaaaaugccuuuuuaaagcauuaauggcuaauugaagua

SEQ ID NO: 269272 - RNA, 64 nt, hsa
auuaguacuugaaguugagccuuuguggugggacuuuuuaaaaaaaugccuuuuuaaagcauua

SEQ ID NO: 269273 - RNA, 64 nt, hsa
gccuguggguuaccugaacuccauaaucugggacuuuuuaaaaauaagaaccagcucaaguaca

SEQ ID NO: 269274 - RNA, 64 nt, hsa
uuuggauccuguacucuaauaaaucauaaguuucuuuuuaaaaauuuuccaaaacuuuucucca

SEQ ID NO: 269275 - RNA, 64 nt, hsa
uuacugacccagcuguacauauguaucuagacuguuuuuaaaugucuuucuucaugaaugcuuc

SEQ ID NO: 269276 - RNA, 64 nt, hsa
ugugaaacacagauuucaaguguuuuaucuuuuuuuuuuaaauuuaaaugggaauauaacacag

SEQ ID NO: 269277 - RNA, 64 nt, hsa
cuuuuuuuuuuuuuuuuuuuuuuuaaagaaaccuuuuuuaaacuauuucuagguuugugaaugu

SEQ ID NO: 269278 - RNA, 64 nt, hsa
uccuuuacccuuucccuuuuuuuuuuuuuuuuuuuuuuuaaagaaaccuuuuuuaaacuauuuc

SEQ ID NO: 269279 - RNA, 64 nt, hsa
agggagcuuugaugcaacuuauuuguaagaaggauuuuuaaauuuuuuauggguagaauuguag

SEQ ID NO: 269280 - RNA, 64 nt, hsa
agacccaaacccacgugcauuuugggacaauugcuuuuuaaaacguuuuuaugccaaaaauccu

SEQ ID NO: 269281 - RNA, 64 nt, hsa
uauagacuuguucuacauuguaaauacaauucaguuuuuaaaaaauaaagcuuaauagcuucca

SEQ ID NO: 269282 - RNA, 64 nt, hsa
aucucuuguauauuuuacuauuuaaaaagcauuauuuuuaaauaguaucugucuccaauuuaua

SEQ ID NO: 269283 - RNA, 64 nt, hsa
acacauuucaucugcugcuucaaaaaguacuuacuuuuuaaaccaucaacauuacuuuucuuuc

SEQ ID NO: 269284 - RNA, 64 nt, hsa
guuacuuauauuuaagaaagugaggauuuuuuuuuuuuuaaagauaaaagcauggucagaugcu

SEQ ID NO: 269285 - RNA, 64 nt, hsa
guaaagugugaugacgauaacacuuaagugugaauuuuuaaauauaguugaguagacugcauca

SEQ ID NO: 269286 - RNA, 64 nt, hsa
uaaauauaaaagauauuucucucuuuuuaaaaucuuuuuaaaagggaauuggcugcuuaaagcc

SEQ ID NO: 269287 - RNA, 64 nt, hsa
gaauauguggguaaauauaaaagauauuucucucuuuuuaaaaucuuuuuaaaagggaauuggc

SEQ ID NO: 269288 - RNA, 64 nt, hsa
ucaagagucacuaagcagaauuuagaaagagaaguuuuuaaaaagcaaacaguguaaaaaaagu

SEQ ID NO: 269289 - RNA, 64 nt, hsa
ugggugcuugccaaagagauagggacgcauaugcuuuuuaaagcaaucuaaaaauaauaauaag

SEQ ID NO: 269290 - RNA, 64 nt, hsa
uauaaacaucguuuuuuacuucuucugguagaauuuuuuaaagcauaauuggaauccuuggaua

SEQ ID NO: 269291 - RNA, 64 nt, hsa
cugaacacaauuauuuguaaaaguuaguaguucuuuuuuaaaucauuaaaagaggcuugcugaa

SEQ ID NO: 269292 - RNA, 64 nt, hsa
ccugagagugacuuugacauuagguccuuuguuguuuuuaaagaggcugcuggccacaggcaaa

SEQ ID NO: 269293 - RNA, 64 nt, hsa
auuuaaauauuagaaauagcacaaagucauggaguuuuuaaaaauuguuauaauuaaguaaaaa

SEQ ID NO: 269294 - RNA, 64 nt, hsa
uguuuuuuccacuuguauaugcacuaauuuuaauuuuuuaaagacuuuuucugaucuuugaacu

SEQ ID NO: 269295 - RNA, 64 nt, hsa
uguauagcucuuuccuucaaauucaacuagagccuuuuuaaaaagacauuugccugcuagucag

SEQ ID NO: 269296 - RNA, 64 nt, hsa
ccugcuagucagauacauuuacauuuaugcaaauuuuuuaaauaggagaaaauuaagaaauugu

SEQ ID NO: 269297 - RNA, 64 nt, hsa
gcuuaucuuuccaaauaacauuuaauuauaauguuuuuuaaaaaauauauuccucuucagucau

SEQ ID NO: 269298 - RNA, 64 nt, hsa
cucaaguuuaacucuacaaaaauuuguuacuuguuuuuuaaacucuauauauaaaguucgacuu

SEQ ID NO: 269299 - RNA, 64 nt, hsa
cuucucuuaggcagcucugcacuucauguucaguuuuuuaaaaauagacuguaguauccuuuca

SEQ ID NO: 269300 - RNA, 64 nt, hsa
aaaagagaaucugugggaaauaggcagauauagcuuuuuaaaauauaaaguacuugggauuuug

SEQ ID NO: 269301 - RNA, 64 nt, hsa
augcugagaguuaaaauauucccagguuaaaauuuuuuuaaaguaccaauaauagagcuaaaua

SEQ ID NO: 269302 - RNA, 64 nt, hsa
cuagucugacaucagaaaauaaaauugaggcugauuuuuaaaaauuucuaguagauuuuuggcc

SEQ ID NO: 269303 - RNA, 64 nt, hsa
uuaaaaauuucuaguagauuuuuggccuuuccuguuuuuaaaaaucaguuucauuuucauauuu

SEQ ID NO: 269304 - RNA, 64 nt, hsa
cagaacuugagauguggcagcacuggacuggguuuuuuuaaauguuaggacuaggaauguuugc

SEQ ID NO: 269305 - RNA, 64 nt, hsa
gaguguuauguauuuccuggauguuuggaaacauuuuuuaaaacaagccaagaaagauguauau

SEQ ID NO: 269306 - RNA, 64 nt, hsa
ggagauguuagacucaugguguguuacacaaugguuuuuaaauuuuguaaugaauuccuagaau

SEQ ID NO: 269307 - RNA, 64 nt, hsa
gaaugaauuaggaagauuguauuuacuuaacuguuuuuuaaauacauguuuaaugaaauaaacu

SEQ ID NO: 269308 - RNA, 64 nt, hsa
uggcuagaaauugcuguuuuuaauaaaugugaauuuuuuaaaaauaaagauuuuugcuuccuac

SEQ ID NO: 269309 - RNA, 64 nt, hsa
uaaccccacccuuuacauuuugugcagugauuauuuuuuaaagucuucuuucauguaaguagca

SEQ ID NO: 269310 - RNA, 64 nt, hsa
aucuuaagagaauccacauaaaagaagaaacuauuuuuuaaaaauucacuucuauauauacaau

SEQ ID NO: 269311 - RNA, 64 nt, hsa
gaacuuacugauuauuuucuucauccaacuuauguuuuuaaaugaggauuauugauaguacucu

SEQ ID NO: 269312 - RNA, 64 nt, hsa
uuuuaggaaaaucacuuugucuaacucagaauuauuuuuaaaaagaaaucuggucuuguuagaa

SEQ ID NO: 269313 - RNA, 64 nt, hsa
auauauauaguuuuacuagguuuucauggauaaguuuuuaaauguaagacaggaaagggaucua

SEQ ID NO: 269314 - RNA, 64 nt, hsa
gauucaacuacuguuuuuccuucagcugacuuuauuuuuaaacacccuuaaagacagauauauc

SEQ ID NO: 269315 - RNA, 64 nt, hsa
aaaacaaaauucagcuuaaucguguacucagcauuuuuuaaauaacaauguuuauuugaacuaa

SEQ ID NO: 269316 - RNA, 64 nt, hsa
uaaaugucauacacaaauacuaagacacuuugcauuuuuaaaaauuaagaaucauuugugaagu

SEQ ID NO: 269317 - RNA, 64 nt, hsa
caauucacaaauagccauugaacaaauguguggguuuuuaaaaauuauauacauauaugaguug

SEQ ID NO: 269318 - RNA, 64 nt, hsa
uucaaccucuuacaauaagcuaaacgcaaugucauuuuuaaaaagaaggacuuagggugucguu

SEQ ID NO: 269319 - RNA, 64 nt, hsa
aaggggucuuaauugaaaugaaaauuuaauuuuguuuuuaaaauauuguuuaucuuuauuuauu

SEQ ID NO: 269320 - RNA, 64 nt, hsa
cuauaaauauguguuguaugucuuuuuugcuuuuuuuuuaaaaaaaagaauaacuuuuuuugcc

SEQ ID NO: 269321 - RNA, 64 nt, hsa
aguuagugguguuuugaagaggguauuuuauuguuuuuuaaaaaaagguucuuaaacauuauuu

SEQ ID NO: 269322 - RNA, 64 nt, hsa
cuuucuguauccuuccuucuaccuauuauucugauuuuuaaaaaugcaguuaauguaccauuua

SEQ ID NO: 269323 - RNA, 64 nt, hsa
cuccccuccccucccuucucauuccuuuucuuuguuuuuaaaggauguguuuguaugcauucug

SEQ ID NO: 269324 - RNA, 64 nt, hsa
guuacagucucauauguaucccagcacauguaauuuuuuaaauaguuucugaauaaacacuuga

SEQ ID NO: 269325 - RNA, 64 nt, hsa
aauggugugcuuuuggggagauacacuagcaauuuuuuuaaaaacuggaacagugugauaggaa

SEQ ID NO: 269326 - RNA, 64 nt, hsa
uuuggaaagaaagcacuuaacauuuuaggaauucuuuuuaaagcugcuugcaaaguguugguga

SEQ ID NO: 269327 - RNA, 64 nt, hsa
cuaguccaguuaugaaaucaguguaauacauugauuuuuaaaacugcugcuuuuuaugcuuuaa

SEQ ID NO: 269328 - RNA, 64 nt, hsa
uauuacucugcuugcauuuaugaaacuaaccaguuuuuuaaacuuuaauucuuaaauuuauggu

SEQ ID NO: 269329 - RNA, 64 nt, hsa
ccuaacauuucuaaacuggccacauaaccuuagauuuuuaaaggaauauuucagaguuuaaucu

SEQ ID NO: 269330 - RNA, 64 nt, hsa
gucuugaaauuuugccaccacagaaagaaagauguuuuuaaaagcuuggcccaaagaauaggaa

SEQ ID NO: 269331 - RNA, 64 nt, hsa
aguaugaggacuccuuguuaugccuuuaagguaauuuuuaaaaaaaaucugaguagagauagua

SEQ ID NO: 269332 - RNA, 64 nt, hsa
aacaaagucuugaagguauuauuuuacaaguauauuuuuaaaguuguuuuauaagagagacuuu

SEQ ID NO: 269333 - RNA, 64 nt, hsa
aauuacuauguaaacaaaaaguagauaguuucacuuuuuaaaaaauccauuacuguuuugcauu

SEQ ID NO: 269334 - RNA, 64 nt, hsa
uauauggaugaaacauauuuuaauguuguuuacuuuuuuaaauacuugguugaucuucaaggua

SEQ ID NO: 269335 - RNA, 64 nt, hsa
uauguugcacauagccuauacaguaccuacauaguuuuuaaauuauuguuuaaaaaacaaaaca

SEQ ID NO: 269336 - RNA, 64 nt, hsa
ucuuucuuuuuuuucuuuuguuucaugauuuugauuuuuaaaauuauuagcacacaacuauuuu

SEQ ID NO: 269337 - RNA, 64 nt, hsa
uuucauguuuuuaauauaagaaugaucuaauauuuuuuuaaaguaauagcuaucaguaauagcu

SEQ ID NO: 269338 - RNA, 64 nt, hsa
guuagaaacuuuggcauaacucaauuuggaguauuuuuuaaaugcuguaucuuuaaagaaaagu

SEQ ID NO: 269339 - RNA, 64 nt, hsa
ggugcaaaugggugacuuagugcauugauucagauuuuuaaaauuucuugaugugguuuguaau

SEQ ID NO: 269340 - RNA, 64 nt, hsa
caacuacccauauuccagacucugagcuguuuccuuuuuaaaaaucauauagacaauuagcugu

SEQ ID NO: 269341 - RNA, 64 nt, hsa
gcaauacaccucaaggaaaagguucagauuuuuauuuuuaaaauauuuucauuuuuuucuugaa

SEQ ID NO: 269342 - RNA, 64 nt, hsa
uuuucuauaaauuacuaauuguaaaaagucuugcuuuuuaaaacaaguugguaaugcauaucau

SEQ ID NO: 269343 - RNA, 64 nt, hsa
gauagaaacaacuagaaaggaaagugugacacaguuuuuaaauuuagauguagaaaauaaugaa

SEQ ID NO: 269344 - RNA, 64 nt, hsa
cccauuuuccuauuauguuugauaauuauauguauuuuuaaaaacugugagaggaaaaauuagu

SEQ ID NO: 269345 - RNA, 64 nt, hsa
guaaagauggaaaugacagagcacagacauuuauuuuuuaaauugauaggguagaaaaugaaau

SEQ ID NO: 269346 - RNA, 64 nt, hsa
ccuuuguugaggugcaaggaguguaaaauguauauuuuuaaagaauguuaguaaaggaaccauu

SEQ ID NO: 269347 - RNA, 64 nt, hsa
auucaguaacaaagguuuaaaguuugaagauuauuuuuuaaaaagguaaaugguuaaauuuuac

SEQ ID NO: 269348 - RNA, 64 nt, hsa
uuuauuuaacauacugucuaauuuuaaaaauagguuuuuaaagcuuucauuuuuaaguuuauga

SEQ ID NO: 269349 - RNA, 64 nt, hsa
aaagucacuaaacuuuuacacacucccaaacgucuuuuuaaaaauugcuugggaaauuauuaaa

SEQ ID NO: 269350 - RNA, 64 nt, hsa
gguaacuauguucugaaaacacugcauuuaagaauuuuuaaaaauugguuuucuaaaauuaaaa

SEQ ID NO: 269351 - RNA, 64 nt, hsa
auuguugauuugaggauauaauaauguuuuaaucuuuuuaaaauauaagugguuauucucugac

SEQ ID NO: 269352 - RNA, 64 nt, hsa
gauuuuuuuucuauuaaaacuguuguuaaaauauuuuuuaaaacaaaaacauuauuugugcccu

SEQ ID NO: 269353 - RNA, 64 nt, hsa
ucuguaauacauuauguaauuuaaaaaauauuccuuuuuaaacagcaacagaaaugcacuauaa

SEQ ID NO: 269354 - RNA, 64 nt, hsa
cugagaaacaaugaauaguacauguauauguauauuuuuaaacugccuuauugcucaaugaguu

SEQ ID NO: 269355 - RNA, 64 nt, hsa
ccccaaauagaauuuuguaaccaacuuugcuauuuuuuuaaaguuuguaagaaugugucauuuc

SEQ ID NO: 269356 - RNA, 64 nt, hsa
augucacugauuauuucaguuaguuuuauaaugauuuuuaaaaaacauaucuauuuggaauaag

SEQ ID NO: 269357 - RNA, 64 nt, hsa
guuuacuauaaaccuuuugcccccauaauuucuuuuuuuaaaggaaauuaauauuaguaaaaua

SEQ ID NO: 269358 - RNA, 64 nt, hsa
uuuuggacauuuaaccaagauacuaagaagguuuuuuuuaaaaaaagagauuugauuauuuuuc

SEQ ID NO: 269359 - RNA, 64 nt, hsa
uuuuuguugauaaaauacgaagaaauuccugcaauuuuuaaaaaacaaguuuggaauuuuuuuc

SEQ ID NO: 269360 - RNA, 64 nt, hsa
ucaacccugaaacuauggucuacauuaauauggauuuuuaaaucacaugucauuacuuuugcaa

SEQ ID NO: 269361 - RNA, 64 nt, hsa
cugaggauaaaaccuccauccccuaaaaugauuuuuuuuaaauaccacugucuuuagcugucca

SEQ ID NO: 269362 - RNA, 64 nt, hsa
aguccucaaaggguuaaggccaauuugcaauuuuuuuuuaaacuuagaagcaaugaauguuuuc

SEQ ID NO: 269363 - RNA, 64 nt, hsa
uguacaaacuuuauacagaagcacaaccuuaucauuuuuaaauaaaaacagggaaaugguuuaa

SEQ ID NO: 269364 - RNA, 64 nt, hsa
caaaauuuugagucuugcauuacuuuuuguuccuuuuuuaaaaacacaagagcacugaaucaaa

SEQ ID NO: 269365 - RNA, 64 nt, hsa
agagauaauaucaauucauauuguaguguagauuuuuuuaaaguucacauacacuuuuuuguaa

SEQ ID NO: 269366 - RNA, 64 nt, hsa
acuaauaggcuucuuggaauuauuuagaaaagcauuuuuaaacuggcaguggaugacugaauag

SEQ ID NO: 269367 - RNA, 64 nt, hsa
ugcagucauuaaaagucaaaauuuuuugacuuucuuuuuaaagccaaagaccauaguuuuaguu

SEQ ID NO: 269368 - RNA, 64 nt, hsa
gagaacaggucuuucaaaaagcauuugauuauuuuuuuuaaauacacucucuuauuuuucuacu

SEQ ID NO: 269369 - RNA, 64 nt, hsa
ugaagacaugcuacaacuacuauuuuuagcaauguuuuuaaauuugugucuauuggggugggaa

SEQ ID NO: 269370 - RNA, 64 nt, hsa
aacuuuaucaucuuucacuuuugguuuuccucuguuuuuaaacaucuuagguauaacagcacaa

SEQ ID NO: 269371 - RNA, 64 nt, hsa
ucaaaacaguguuuaaaaauugcauuguuauuuuuuuuuaaacucaguuuaaaaagacuaaaac

SEQ ID NO: 269372 - RNA, 64 nt, hsa
cccaguuauuaaugaaagaauauggauuuaaaaauuuuuaaacuaaauaauuugugcugucaca

SEQ ID NO: 269373 - RNA, 64 nt, hsa
aacugcaaaagucuaaaauacccauuggugauguuuuuuaaaaaaaucuugcuuucagcuuuca

SEQ ID NO: 269374 - RNA, 64 nt, hsa
uauauacccaucuacucccaacauggauauaaguuuuuuaaaaaaauaguuguauauaacauac

SEQ ID NO: 269375 - RNA, 64 nt, hsa
aacacaggucuuuauucccuuuugaaugagacaguuuuuaaaaguugauuuauaaauacaaaaa

SEQ ID NO: 269376 - RNA, 64 nt, hsa
uauauucaacaaaaaucuucaaagacugguuucuuuuuuaaaagaaaaaacuugaaagaacacu

SEQ ID NO: 269377 - RNA, 64 nt, hsa
aaaagcaguugaguaacagcaacauaaaccacauuuuuuaaaaaaaugagcacuuuucauucac

SEQ ID NO: 269378 - RNA, 64 nt, hsa
ggacaauuuguguuggaugguauucaaaaggaauuuuuuaaaacauuaagcaacaguguaauga

SEQ ID NO: 269379 - RNA, 64 nt, hsa
uugcacauauuaaccucacaauauuacuagcucauuuuuaaaugucuggacauucugaaauaau

SEQ ID NO: 269380 - RNA, 64 nt, hsa
auagucuaaaucacaaauacuuuacucaauuuaguuuuuaaaauaguaaacugaauauuuuugu

SEQ ID NO: 269381 - RNA, 64 nt, hsa
gugaaugacauuggacuuuuaguaacaaacuuaauuuuuaaaaagguguagacaauggugguua

SEQ ID NO: 269382 - RNA, 64 nt, hsa
uuuucaguguuuaaauuagugcuauuuuuccuuguuuuuaaaaaugaaucucguacuguaucuu

SEQ ID NO: 269383 - RNA, 64 nt, hsa
gcugccuaucuguagauagcuguaaaauggaauauuuuuaaaugaaggcaaauaaguacuuaaa

SEQ ID NO: 269384 - RNA, 64 nt, hsa
uugcauuauuuauaauaaaauugcauucaguggcuuuuuaaaaaaauguuugauucaaaacuuu

SEQ ID NO: 269385 - RNA, 64 nt, hsa
cucagaauuucuauucuuucuaaaaagagauuuauuuuuaaaucaaugggacucugauauaaag

SEQ ID NO: 269386 - RNA, 64 nt, hsa
ucaauaucuuaauguauuuaauguagaauauugcuuuuuaaaauaauguuuuuauuuugcugua

SEQ ID NO: 269387 - RNA, 64 nt, hsa
uaauaauggaacaaaauagaagcauaucuaacacuuuuuaaauugauaauuuuguaaaauugau

SEQ ID NO: 269388 - RNA, 64 nt, hsa
auuuaguuucauuuuggcuuuauguaauauaaaguuuuuaaaauuuuaaauaugguuuuaaccu

SEQ ID NO: 269389 - RNA, 64 nt, hsa
gaaaaaaggaaccuucaauuauuagcuuuguuucuuuuuaaauguauauauuuugacuaauguu

SEQ ID NO: 269390 - RNA, 64 nt, hsa
uuugugccuuaagagacuacagagucaaagcucauuuuuaaaggaguaggacaaaguugucaca

SEQ ID NO: 269391 - RNA, 64 nt, hsa
aaugguuuauuuuuauuuaaaugucaauaguuguuuuuuaaaauccaaaucagaggugcaggcc

SEQ ID NO: 269392 - RNA, 64 nt, hsa
cagauaacuugcugcuucaacaaaaagauuuaccuuuuuaaauaaauguuguagaauacuuaaa

SEQ ID NO: 269393 - RNA, 64 nt, hsa
guguauuuuuuucaacuaauuuuuuagugaauuuuuuuuaaacuuacagcauguuuugguuuga

SEQ ID NO: 269394 - RNA, 64 nt, hsa
aaauagcugagcuuucuaaaaugauagcucucuauuuuuaaaugaauuugaaaagucgauuaaa

SEQ ID NO: 269395 - RNA, 64 nt, hsa
guaauauaacaugggcaaauaucugacuucuguauuuuuaaaaaguugccuucuccaguggcag

SEQ ID NO: 269396 - RNA, 64 nt, hsa
uuugaccugccugagaagcuucauaaaguauguuuuuuuaaaauauauuuuaauuacauuuaaa

SEQ ID NO: 269397 - RNA, 64 nt, hsa
cuaagggagaggaucuugucguagagucuaauguuuuuuaaaauuggugccagcaauucacgau

SEQ ID NO: 269398 - RNA, 64 nt, hsa
gcucuuggccaagaaggcugaguaugguucccaauuuuuaaauccauuucauuuuuuaaaaaau

SEQ ID NO: 269399 - RNA, 64 nt, hsa
ugaguaugguucccaauuuuuaaauccauuucauuuuuuaaaaaauaagggaaauaaauguaau

SEQ ID NO: 269400 - RNA, 64 nt, hsa
cacuuauucuagggcacacaaacacuauuuuacuuuuuuaaaaucauaaaacggcagaacagau

SEQ ID NO: 269401 - RNA, 64 nt, hsa
ucucuuuccucucuauucgcuuucuccuguuuuuuuuuuaaaaaaaaagcaugaaaaaggaaga

SEQ ID NO: 269402 - RNA, 64 nt, hsa
auccucaauaucaacuccaguuuaaaaaguguuauuuuuaaaacauuugaaaccaaguacuguu

SEQ ID NO: 269403 - RNA, 64 nt, hsa
ucugcaauagaugacacugaugguuuuacuccuuuuuuuaaaaacacaugcgcgcgcacacaca

SEQ ID NO: 269404 - RNA, 64 nt, hsa
aaaaguucuuaacauuuuuguguaauuuccuuucuuuuuaaaccauaaauuaguuuaaacugaa

SEQ ID NO: 269405 - RNA, 64 nt, hsa
uaagauuuaagaaugauuaaaaauaagcuuuuacuuuuuaaaaccacuugagguuucauaaagc

SEQ ID NO: 269406 - RNA, 64 nt, hsa
cugcaguucuaugguuuuguuucacuucuuuucuuuuuuaaagccauucuguucuuuggaugug

SEQ ID NO: 269407 - RNA, 64 nt, hsa
ccuucugugcgaccaaugagacgacuucagcaucuuuuuaaaauaaucuaagcaucauugaagc

SEQ ID NO: 269408 - RNA, 64 nt, hsa
aguaccuagcucugcucuuuuauauugcuuuaaauuuuuaaagaaauuguauugcauggaugug

SEQ ID NO: 269409 - RNA, 64 nt, hsa
cccaaucuguaugaauaauguaaacuucgauuuuuuuuuaaaaaaauuagauuuuagcuggagc

SEQ ID NO: 269410 - RNA, 64 nt, hsa
guugaaauacaguuuugaguuauuuugauguggcuuuuuaaaaaaguuaauggguagcuaaugu

SEQ ID NO: 269411 - RNA, 64 nt, hsa
ucaaauguaaauguuuugaggauauuuuucuuguuuuuuaaaaucaauuuuuaaccaaauauua

SEQ ID NO: 269412 - RNA, 64 nt, hsa
cacaaaauaacuggugucuuguaaauguucuguuuuuuuaaauaaaacuucucuacuuuagucu

SEQ ID NO: 269413 - RNA, 64 nt, hsa
aauuaaacuguaaauaacuugcccugggggccuuuuuuuaaaaaacaaaaaccacaaaaauucc

SEQ ID NO: 269414 - RNA, 64 nt, hsa
uugauacaaucauuaauggaucauacacaauagguuuuuaaaaauuaauaacuuuuaguaauua

SEQ ID NO: 269415 - RNA, 64 nt, hsa
ugauacaaccauuaaugaaucauacacaauagguuuuuuaaaauuaauauuaauaacuuuuauu

SEQ ID NO: 269416 - RNA, 64 nt, hsa
gguauauaaccacgacucugguggggaaaaccguuuuuuaaaggacacacacacacacagcgau

SEQ ID NO: 269417 - RNA, 64 nt, hsa
ccuuccauuugcucacuucucucuucacccaucuuuuuuaaaaacaaauaaaugaauaaagcug

SEQ ID NO: 269418 - RNA, 64 nt, hsa
caaguuaauuacaaacaguuuuguaacucuuugcuuuuuaaaucuuaaaaaaaaaaaaguugcu

SEQ ID NO: 269419 - RNA, 64 nt, hsa
aggacacaucaaagcuggccaaaauaaugaauuuuuuuuaaaaagcaauaccugguuuccaccu

SEQ ID NO: 269420 - RNA, 64 nt, hsa
uagucuauuagcuagaggguuuuggcuguugcuuuuuuuaaaguuagguccacacagugaaggg

SEQ ID NO: 269421 - RNA, 64 nt, hsa
guacacaaaagcuaaagcaguggcuggggcuuuguuuuuaaauuuuggguuuuuuuuuuuguug

SEQ ID NO: 269422 - RNA, 64 nt, hsa
gcauauaacuauauugauauuagaagauauuuguuuuuuaaaauauauugauguaugauaaaga

SEQ ID NO: 269423 - RNA, 64 nt, hsa
aauuuauuguuuacauuggggaauguaucucaaauuuuuaaauagaagaguaauaaacagacuu

SEQ ID NO: 269424 - RNA, 64 nt, hsa
uacgugguuuugugaauacuggcaaaagcaauuguuuuuaaauuaacaauggagagaaugauaa

SEQ ID NO: 269425 - RNA, 64 nt, hsa
uaaagauugccuuuuuugaauuuuuuaaauuuuguuuuuaaaagcauauaccaccuuaguucau

SEQ ID NO: 269426 - RNA, 64 nt, hsa
uguugaaacaagauaaagauugccuuuuuugaauuuuuuaaauuuuguuuuuaaaagcauauac

SEQ ID NO: 269427 - RNA, 64 nt, hsa
uuuaaauagcgauuuguauaggaagcaaguuauuuuuuuaaaaaauagaguauuuuuccucgua

SEQ ID NO: 269428 - RNA, 64 nt, hsa
gaguuagauuuuaugcuugggccuuauuuguauauuuuuaaauagcgauuuguauaggaagcaa

SEQ ID NO: 269429 - RNA, 64 nt, hsa
ccuucuuuaaaaaaaaaaaagaaucugcgguauuuuuuuaaaaaaaaaguuuaccgcuguagug

SEQ ID NO: 269430 - RNA, 56 nt, hsa
aacauggaaaaaauuuuugagcugauuuuuuaaaaauuuaaguuuuguaagagcuu

SEQ ID NO: 269431 - RNA, 64 nt, hsa
augacaggugcgagccacugcaccuggcccacauuuuuuaaagagacacugucccacuccauca

SEQ ID NO: 269432 - RNA, 64 nt, hsa
aaagugcuacauaaaacacuucuuaaacuuuuuuuuuuuaaaaacugcuccuuguggagcagga

SEQ ID NO: 269433 - RNA, 64 nt, hsa
uuaucagguaaauccugguaauuaaaaacgcauguuuuuaaaaauuagccugguaaggccgggu

SEQ ID NO: 269434 - RNA, 64 nt, hsa
uucuggucauuauccuauuuugauuuuauuuaauuuuuuaaaguugaagaauuaaauauuuuaa

SEQ ID NO: 269435 - RNA, 64 nt, hsa
ccuuauuuugucuugcauguuuuaguuuugcuuauuuuuaaauuuggagguccuccauaauguc

SEQ ID NO: 269436 - RNA, 64 nt, hsa
cugccaguauuccacauuuggugaaauuaauacuuuuuuaaaggguccaaauaaaauaauuuuc

SEQ ID NO: 269437 - RNA, 64 nt, hsa
gaguuuaaguacagugaugguuggcuugaguaccuuuuuaaaucuagcccaguauaaacauuag

SEQ ID NO: 269438 - RNA, 64 nt, hsa
uaagaauaucauuuagaguguagauacuuuugccuuuuuaaaaaagccauuauuuuaugagacu

SEQ ID NO: 269439 - RNA, 64 nt, hsa
gugaguuaaaaaggcacauuucuaccuucuauuguuuuuaaauucaagaauagggaauuaguuc

SEQ ID NO: 269440 - RNA, 64 nt, hsa
uguucaauguauggucauacuuuuuaaauuugauuuuuuaaauauuauaaguggucaugaaauu

SEQ ID NO: 269441 - RNA, 64 nt, hsa
uguuuuucuuaauauguucaauguauggucauacuuuuuaaauuugauuuuuuaaauauuauaa

SEQ ID NO: 269442 - RNA, 64 nt, hsa
uuuuauaaaugauuuuuuauuuaaaaauuugagauuuuuaaaauuuuucacagcacaggucuuc

SEQ ID NO: 269443 - RNA, 64 nt, hsa
agagaagugcuucaaauuauuuuguuuggauuaauuuuuaaaauguaaagcauauacuuguugc

SEQ ID NO: 269444 - RNA, 64 nt, hsa
uauaucucauguauauuuauaguaaugaaaagacuuuuuaaauuguacacguuucagugccuuu

SEQ ID NO: 269445 - RNA, 64 nt, hsa
cauugaaaagguuaagaaacauaaaugguacauauuuuuaaaguuaaguagcaugcauauauau

SEQ ID NO: 269446 - RNA, 64 nt, hsa
cuauaauucuaaggucaaaauggaacuugauaguuuuuuaaauuaaaaaauguauacaccuaac

SEQ ID NO: 269447 - RNA, 64 nt, hsa
aguauuuggcaauaccuaucuguaugagaagacauuuuuaaagaugaaauguguaaaaucuuau

SEQ ID NO: 269448 - RNA, 64 nt, hsa
uauagcaaaacaagaaaaguggacuuuguuguuauuuuuaaaguacaguagggugugaauuauu

SEQ ID NO: 269449 - RNA, 64 nt, hsa
auucccuucagggauucccuguccccaacaggaauuuuuaaaccaaaacaccccaacuuggcag

SEQ ID NO: 269450 - RNA, 64 nt, hsa
aagagacucuuuauuuuucucuuucucccuuuuuuuuuuaaauuuuuauuuuuacguagaagcu

SEQ ID NO: 269451 - RNA, 64 nt, hsa
ccauauguaucaccuauucaaaaaaaauaaaauauuuuuaaauacaguugcuggccaaagauug

SEQ ID NO: 269452 - RNA, 64 nt, hsa
aaaagaaaugcaacuuaaaaccauacugagauccuuuuuaaaacugucagauuggcaaagauca

SEQ ID NO: 269453 - RNA, 64 nt, hsa
gccuuucuuucuuucuguaccuucaaguucuugauuuuuaaaauuccaacucuagagaaaacca

SEQ ID NO: 269454 - RNA, 64 nt, hsa
aagcccuugagauauuccaaaguuuuauuuuacuuuuuuaaagaacagaaaaagaugaaugaaa

SEQ ID NO: 269455 - RNA, 64 nt, hsa
uucccaagcucuaaccguaacacgucccacccccuuuuuaaagcacuuacuguuuucagagcac

SEQ ID NO: 269456 - RNA, 64 nt, hsa
aaggaugauggaaaaaucacccaguugugcuauauuuuuaaagaaggaggucguuuaugugugc

SEQ ID NO: 269457 - RNA, 64 nt, hsa
uaggugugcaagaaccaaacguauuuuauuuuauuuuuuaaaugggagcaacauaucagucgug

SEQ ID NO: 269458 - RNA, 64 nt, hsa
auuuuaaaaaauauauauauaaaauauuuuuuucuuuuuaaaauagacacuauaguuuuaccca

SEQ ID NO: 269459 - RNA, 64 nt, hsa
aaaccaagugauuuccagcugauguaucuaauauuuuuuaaaacgaacauuauagagguguaau

SEQ ID NO: 269460 - RNA, 64 nt, hsa
cccagaauuggaucaucuccuaagauguacuuacuuuuuaaaguccaaauauguuuauauuuaa

SEQ ID NO: 269461 - RNA, 64 nt, hsa
uauaacaucacuauuuggcuuuuguuuugcaugauuuuuaaaagcaguacuccuagggaaaugg

SEQ ID NO: 269462 - RNA, 64 nt, hsa
uugaaucugagacgaauacaacuuuuaaaaauuguuuuuaaaaauagacuuuuuuuuuuagagc

SEQ ID NO: 269463 - RNA, 64 nt, hsa
auucaguauuuuaugauaaucacuucguuuuuaguuuuuaaaauuuagauuauucuauaauuua

SEQ ID NO: 269464 - RNA, 64 nt, hsa
ugcaggucggcugugcaucgcauucgaggcuccuuuuuuaaagagaaaagcauaggccucuguu

SEQ ID NO: 269465 - RNA, 64 nt, hsa
cuuacucuccaauguaaauauaugaguauuugaguuuuuaaaucacuucaacauuauuugagca

SEQ ID NO: 269466 - RNA, 64 nt, hsa
aaagauauguuuaagaccaagacuauuaaaaugauuuuuaaaguuguuggagacgccaauagca

SEQ ID NO: 269467 - RNA, 64 nt, hsa
ugaaacagauuuguuaacugaacucuuaauuauguuuuuaaaauguuuguuauauuucuuuucu

SEQ ID NO: 269468 - RNA, 64 nt, hsa
gcaaguuaguuaacaugaaccuucauuuguaaauuuuuuaaaauuucuuuuauaauaugcuuuc

SEQ ID NO: 269469 - RNA, 64 nt, hsa
aauuccgauuuggaaccuuagaugucuauuugauuuuuuaaaaaaccuuaauguaagauaugac

SEQ ID NO: 269470 - RNA, 64 nt, hsa
uuugcacuguaacuauaauaccucuuaauuuaccuuuuuaaaagcugugggucagucuugcacu

SEQ ID NO: 269471 - RNA, 56 nt, hsa
cucagguucccaauagcugaaaccgcuuuuuaaaauucaaaacaagaaacaaaaca

SEQ ID NO: 269472 - RNA, 64 nt, hsa
aaagugguggucuuuuggaugagggaauaaugcauuuuuaaauaaaauaccaauaucaggaagc

SEQ ID NO: 269473 - RNA, 64 nt, hsa
caaaugcaaaacuuuuuuuuugaaaugaaaagacuuuuuaaaaaaguaaaacaagaaaaguaca

SEQ ID NO: 269474 - RNA, 64 nt, hsa
uuuaggcguuuucuggcuugacggcuucucucuuuuuuuaaaucacccccaccacauaaaucuc

SEQ ID NO: 269475 - RNA, 64 nt, hsa
aaacaugaccaucgucaaagaccugcucaagaaauuuuuaaaaaagaaacaaaguuaugggguu

SEQ ID NO: 269476 - RNA, 64 nt, hsa
auuggugaugggaguaauaacauuuugggggagcuuuuuaaauuucacagaagaggaaaguugc

SEQ ID NO: 269477 - RNA, 64 nt, hsa
ucaccgauuuaaagagugcaauauauaauaaucauuuuuaaaguauuggauuaaaucugauagg

SEQ ID NO: 269478 - RNA, 64 nt, hsa
caaauuacuucuuuguuuuucuuaaugauggcaauuuuuaaacuuuaauuuuauugugaucucu

SEQ ID NO: 269479 - RNA, 64 nt, hsa
uggaaauaauugauaacuuuuaagccauacuauguuuuuaaagauaauuugcacaaacacguuu

SEQ ID NO: 269480 - RNA, 64 nt, hsa
auauagucagauauauguugucugcuuuaaacaauuuuuaaauuuuaaaaaugcauuaacgucu

SEQ ID NO: 269481 - RNA, 64 nt, hsa
aaaauacucuaauagccuugagugaccaacuuuuuuuuuaaagcacagauguaauugucuaaug

SEQ ID NO: 269482 - RNA, 64 nt, hsa
cacacuacuauuugaagcucauuuucuaugcagguuuuuaaacgucauuuauguaucauucuuu

SEQ ID NO: 269483 - RNA, 64 nt, hsa
ucuguuuucuuuguuuguuuugcuuugcuuuuuguuuuuaaaguuucccccagugauuccagug

SEQ ID NO: 269484 - RNA, 64 nt, hsa
uucuuaguguaguuaugauguggauccuacguauuuuuuaaaaaacucuccagauaauuuugau

SEQ ID NO: 269485 - RNA, 64 nt, hsa
uacagaaugugaaauacugauacaguuauucuuuuuuuuaaagaacauuguuuuauaaagaacg

SEQ ID NO: 269486 - RNA, 64 nt, hsa
aacauuaaaucuagucucuauccuguuaauuuaauuuuuaaaugcuuuauccauuugugcaaag

SEQ ID NO: 269487 - RNA, 64 nt, hsa
uuguaggaaauuugcauacccguaaagggagacuuuuuuaaauaacaguugagucuuugcaagu

SEQ ID NO: 269488 - RNA, 64 nt, hsa
uugcaaacugagcuuguuggagggaaggcauuauuuuuuaaaauacuuaguaaauuaaaugaac

SEQ ID NO: 269489 - RNA, 64 nt, hsa
guagaacugggccagagccaguccauugccuguuuuuuuaaauaagguuuuacugagcacagcc

SEQ ID NO: 269490 - RNA, 64 nt, hsa
aagauuuuauucuuucuuguaaacauuacuugauuuuuuaaagaaguuuugggcucacugcuaa

SEQ ID NO: 269491 - RNA, 64 nt, hsa
uguagaauaauuugaacauugugaggaccaaucuuuuuuaaaucaaaagggauguugcugguau

SEQ ID NO: 269492 - RNA, 64 nt, hsa
uuuucuucacuccgugaccuggagaguuuuccauuuuuuaaaauacaugaacuuggcaagggug

SEQ ID NO: 269493 - RNA, 64 nt, hsa
ggugucauuuaguaaggauuuuaugaguucuuguuuuuuaaaauccagacuuucuuuuucuaca

SEQ ID NO: 269494 - RNA, 64 nt, hsa
auuuucuguauuuaauuauaaaaaauuaacuuaguuuuuaaaauuuauuugcaaauauacuuua

SEQ ID NO: 269495 - RNA, 64 nt, hsa
auaaaaugcuccuagaagucuuaauuguguuuauuuuuuaaaaaaacaaauguuagacuugugu

SEQ ID NO: 269496 - RNA, 64 nt, hsa
uguuguaugaauggcauuuguauauuaaaacacuuuuuuaaaggacaguugaaaagggcaagag

SEQ ID NO: 269497 - RNA, 64 nt, hsa
uauuuuuuuuuuuuuauugaccauggugauuauuuuuuuaaaccaucguuaauauacugaagug

SEQ ID NO: 269498 - RNA, 64 nt, hsa
guacuuguagccuggauagcagacuguguucaacuuuuuaaaaagauguuuccuuucuaaagau

SEQ ID NO: 269499 - RNA, 64 nt, hsa
acuuauucugagcuuagagagaauggggaggguauuuuuaaauuuuauuguuuuauuucuuuaa

SEQ ID NO: 269500 - RNA, 64 nt, hsa
aguggagcuccaguuuucuuaccuagcugucacuuuuuuaaaugccucuggggguuauuuuugc

SEQ ID NO: 269501 - RNA, 64 nt, hsa
uuaguccaaaggaaaacaacagcaacaaaaucuguuuuuaaaaugucuuauaugaacauauauc

SEQ ID NO: 269502 - RNA, 64 nt, hsa
caaaggaagcauuucuagaaaaaaggagauaauguuuuuaaauuucauuaucaaacuugggcaa

SEQ ID NO: 269503 - RNA, 64 nt, hsa
aggaauggguuagcccuaauguagaaugucauuguuuuuaaaacuguuuuauaucuuaagagug

SEQ ID NO: 269504 - RNA, 64 nt, hsa
uaaugcaucaaaagccuuagaauaagaaaagcuuuuuuuaaauugcuuuaucuguauaucugaa

SEQ ID NO: 269505 - RNA, 64 nt, hsa
gaccuuguuuuuuguuguauuuuggaagacagguuuuuuaaagaaacauuuuccucagauuaaa

SEQ ID NO: 269506 - RNA, 64 nt, hsa
uucuaaccuaccucuaaugggguuaucagauauguuuuuaaaucucucgcccugaguacucuuc

SEQ ID NO: 269507 - RNA, 64 nt, hsa
ugaaauugucacaaaacguuauuccuugauuugguuuuuaaauuuugcuuucgugugugugucu

SEQ ID NO: 269508 - RNA, 64 nt, hsa; identical to SEQ ID NO: 269476

SEQ ID NO: 269509 - RNA, 64 nt, hsa
aaacaucaccaucgucaaagagcugcugaagaaauuuuuaaaaaagaaacaaaguuaugggguu

SEQ ID NO: 269510 - RNA, 64 nt, hsa
aaaaucucaaauuucuaaaucuccaaaauaaaacuuuuuaaaauaaagugcuggcuuggucugu

SEQ ID NO: 269511 - RNA, 64 nt, hsa
uuauuuuauuaugcaugaaguaauaugcacacauuuuuuaaaugcaccuggaauauauaaccag

SEQ ID NO: 269512 - RNA, 64 nt, hsa
gacugcugaugugaugcuacuguaaugcaauaaauuuuuaaauuguugcaaagugcuguuuuug

SEQ ID NO: 269513 - RNA, 64 nt, hsa
aaacaccaccaucaucaaagagcugcucaagaaauuuuuaaaaacgaaacaaaguuaugggguu

SEQ ID NO: 269514 - RNA, 64 nt, hsa
augauggcuguacaaauaauuuagccucauucauuuuuuaaaggaauuauuccuuaagacaugc

SEQ ID NO: 269515 - RNA, 64 nt, hsa
caaccacuaacaauuguggucucuggugaucuuauuuuuaaagccuguauuauuuaaaaugcau

SEQ ID NO: 269516 - RNA, 64 nt, hsa
ggcgcgagccaccacacccggcuggaaguaaacauuuuuaaagcuacuuuuacucauucuagcc

SEQ ID NO: 269517 - RNA, 64 nt, hsa
uuguuguuagagcaaaagucuuacugaauuuguauuuuuaaauuuuucuuggguuaguauuuaa

SEQ ID NO: 269518 - RNA, 64 nt, hsa
aauuacuguaaguuuuagauucuaagguucaagauuuuuaaaauuugauuuaaaugaagaaaug

SEQ ID NO: 269519 - RNA, 64 nt, hsa
auauacuguaauuuuuguuaaucucaaguuuggguuuuuaaagacagcaagucuggucauucag

SEQ ID NO: 269520 - RNA, 64 nt, hsa
aucuguuuugcugaaucuccuaguaaaagucauuuuuuuaaaguaauauuguaugcuuacaaaa

SEQ ID NO: 269521 - RNA, 64 nt, hsa
auaaugagcuaaugugauaucuauaggucacaauuuuuuaaaaccaaaauuuucaagucuggga

SEQ ID NO: 269522 - RNA, 64 nt, hsa
auagucuaugggcaaauauuuucaacauuuccaauuuuuaaagcuucagaauugaagccaaaca

SEQ ID NO: 269523 - RNA, 64 nt, hsa
aaacacucgcuguuacaaguacagauuuuuuuuuuuuuuaaaucaaccuagauaccaauugacc

SEQ ID NO: 269524 - RNA, 64 nt, hsa
uagaacccaaauuguguaaaaauguuaauuggguuuuuuaaacauuguuuuaucaagucacugu

SEQ ID NO: 269525 - RNA, 64 nt, hsa
uaggcuccauauuuaaagauagagccaguuuuuuuuuuuaaauagaacccaaauuguguaaaaa

SEQ ID NO: 269526 - RNA, 64 nt, hsa
auuuuaaagguaauugauaauuaguauuuauaacuuuuuaaagggcucuuuguauagcagagga

SEQ ID NO: 269527 - RNA, 64 nt, hsa
cuuucgcucucuaaucagcauuucaauguauuuauuuuuaaauuuucucaaaaaguaacuaaaa

SEQ ID NO: 269528 - RNA, 64 nt, hsa
uuuuuuauuuuuuaauaccuuucauacaauaacuuuuuuaaaacaaccucagauugaaaaagca

SEQ ID NO: 269529 - RNA, 64 nt, hsa
gccaucucaaguaaaaggaauaaaugugucaugcuuuuuaaaaaguugaugugcggaaaauguu

SEQ ID NO: 269530 - RNA, 64 nt, hsa
uucuugagugagguggccuuugaacugaacuuaguuuuuaaaguagcuuuuggaagagaaauga

SEQ ID NO: 269531 - RNA, 64 nt, hsa
aaaauuuauugcacacuuuaaaguguaaaaucauuuuuuaaaaucuugaauccacaaauaaagu

SEQ ID NO: 269532 - RNA, 64 nt, hsa
aaacacaauucauuuugauuauaaacuauuugacuuuuuaaaaucuucugacacaguaaauaua

SEQ ID NO: 269533 - RNA, 64 nt, hsa
agaaauaauucauugguaaaguguaauaaugcguuuuuuaaaaaugcuuugagagguaauuacu

SEQ ID NO: 269534 - RNA, 64 nt, hsa
aguaauuucauagcaacuguucuaguguuuuguguuuuuaaaacagaauuaggaauuugagaua

SEQ ID NO: 269535 - RNA, 64 nt, hsa
aagccucauuuuauuuugcugguuugauuuuuuuuuuuuaaagaagaaaaaaaaacugcccuga

SEQ ID NO: 269536 - RNA, 64 nt, hsa
auaaccaguccauuuuuccuuuuuuuuuuuuuuuuuuuuaaaugguggaaugucucucagcaca

SEQ ID NO: 269537 - RNA, 64 nt, hsa
agagguauuaaugagacuaugaaacggcaauacuuuuuuaaaucacagauuuguaauauauguu

SEQ ID NO: 269538 - RNA, 64 nt, hsa
acccacucagccccaaaugcccuggauuauaugauuuuuaaaacauuuuaagauacagcuacuc

SEQ ID NO: 269539 - RNA, 64 nt, hsa
uacuuuuauacaaacugacauugucuacuauacauuuuuaaaagccauuuuacugguuuggcau

SEQ ID NO: 269540 - RNA, 64 nt, hsa
uccccugggccugaaaacuuggagcaauuaauuuuuuuuaaaaaguguucuuuucacuugggag

SEQ ID NO: 269541 - RNA, 64 nt, hsa
ccuuagcaauuaucuuugaacaucccgaaccagauuuuuaaaucccauuuuuguuuaauagggu

SEQ ID NO: 269542 - RNA, 64 nt, hsa
aauuagcauuagagaauugauuuuagauaacagauuuuuaaaguuuuagagaaaaguacaguaa

SEQ ID NO: 269543 - RNA, 64 nt, hsa
aaacaacauaacuuugcccuggauugacuacauauuuuuaaaccuucaagucccuaauaaaaca

SEQ ID NO: 269544 - RNA, 64 nt, hsa
aaauaaaauauauuuuguucuauugguagguuuuuuuuuaaaauuagaugaauauguuagucuu

SEQ ID NO: 269545 - RNA, 64 nt, hsa
agauaguuuucuagcucucgggucccuuuauugcuuuuuaaaauaggguuugaaacaugccaca

SEQ ID NO: 269546 - RNA, 64 nt, hsa
uuguaauucuaaaagagaucuuauuuaaauuuccuuuuuaaaagccgcaugguucugugaucca

SEQ ID NO: 269547 - RNA, 64 nt, hsa
aguggaaagaaucuuuacaaacccugcaauuacuuuuuuaaaggcacuuuuacucuuugguuuu

SEQ ID NO: 269548 - RNA, 64 nt, hsa
ggauucaaccaacugcaaauggaaaauacgauuuuuuuuaaaaaaaggaugguuacauccguau

SEQ ID NO: 269549 - RNA, 64 nt, hsa
cuagauugccucuccuggacauggcaaugaugaguuuuuaaaaaacaguguggaugaugauaug

SEQ ID NO: 269550 - RNA, 64 nt, hsa
aggacuuuucuaggaaagacuuauguauaauugcuuuuuaaaaugcagugcuuuacuuuaaacu

SEQ ID NO: 269551 - RNA, 64 nt, hsa
agccucccagaguacugggauuacaggcucuuucuuuuuaaacauaaaaguuuuaaauugguau

SEQ ID NO: 269552 - RNA, 64 nt, hsa
agucacaggcuggcuucuguuuuauucagggauuuuuuuaaaaagucaaucagaaaagggauac

SEQ ID NO: 269553 - RNA, 64 nt, hsa
uagaaccuuuugagaugaauuaauguaagaauauuuuuuaaauaggcuuacugucaaauugcaa

SEQ ID NO: 269554 - RNA, 64 nt, hsa
gagcuccuugguuuuuuacuucugcacuuaaauuuuuuuaaauaacaugaugaugguacauuuu

SEQ ID NO: 269555 - RNA, 64 nt, hsa
agcuacucuaguucuguuguuuuguguauauaauuuuuuaaaaaaaauuugugugcuucugcuc

SEQ ID NO: 269556 - RNA, 64 nt, hsa
ggaccacaggcaugcaccacuacgcaugacuaauuuuuuaaauauuugagacggggucucccug

SEQ ID NO: 269557 - RNA, 64 nt, hsa
guaaauagccauacccaguuguacuacaaugagcuuuuuaaaaucuugaaugaauugaguauuc

SEQ ID NO: 269558 - RNA, 64 nt, hsa
aauuauuuuaaauaacugucaacuguuucauugcuuuuuaaauuuuucacgugcauaacccccu

SEQ ID NO: 269559 - RNA, 64 nt, hsa
cagcugucggguuagugguaguauuauuguuauuuuuuuaaaggaaacaaacagacaacaaaaa

SEQ ID NO: 269560 - RNA, 64 nt, hsa
guagacuuuauuacccccccacuaugcccucauuuuuuuaaaaaaggaaaaaaaaaagaaacug

SEQ ID NO: 269561 - RNA, 64 nt, hsa
cgagcaaccaauguaggauugcccacaguuuuucuuuuuaaaggugguuuucgcccuuccucuc

SEQ ID NO: 269562 - RNA, 64 nt, hsa
cugcugcuggucaggacauuaaaauauugaaguguuuuuaaaaauuaaagaagaagaaaaguaa

SEQ ID NO: 269563 - RNA, 64 nt, hsa
uuuggucugaaauacuuuugaacagaauuucuuuuuuuuaaaaaaaaacagagauggggucuua

SEQ ID NO: 269564 - RNA, 64 nt, hsa
uagcacacagauucacuuuaauuucuuaauuuuuuuuuuaaauacaaggagggggcuauuaaca

SEQ ID NO: 269565 - RNA, 64 nt, hsa
guguuacaggaagugaaaugcaaaugugcaauuuuuuuuaaaggagcuuuuaaacaaaguaaua

SEQ ID NO: 269566 - RNA, 64 nt, hsa
ucuguaguugacaaaaguggcuucaucacaaauuuuuuuaaacguuucuacuuugggguuccau

SEQ ID NO: 269567 - RNA, 64 nt, hsa
uguucugacgugugaaauuuaaggaaagagccauuuuuuaaaaaugccgagcagggcaaugcaa

SEQ ID NO: 269568 - RNA, 64 nt, hsa
auagaaaguagcuaauccaguguaaucuuuuaccuuuuuaaaaaccaagauagaguaucuauua

SEQ ID NO: 269569 - RNA, 64 nt, hsa
cgccuuaaacucuggacacucuauauguagugcauuuuuaaacuugaaauauauaauauucagc

SEQ ID NO: 269570 - RNA, 64 nt, hsa
ucucaagaaucuagaagauguguaaacagguauuuuuuuaaaucaaggaaaggcucauuuaaaa

SEQ ID NO: 269571 - RNA, 64 nt, hsa
uggaaccaaaggccaaauaauaaacagccuuuaguuuuuaaaguaaaauucauuuuauuugcag

SEQ ID NO: 269572 - RNA, 64 nt, hsa
gagauauacuauuuuuuuccuuuuuuaauucaguuuuuuaaaaaaacaaauguauuguggcuuc

SEQ ID NO: 269573 - RNA, 64 nt, hsa
uugaauuuuguugucuaaauagcuccugcuuuauuuuuuaaauuaaauuuuuuguuuuuacuau

SEQ ID NO: 269574 - RNA, 64 nt, hsa
cagcagcaccacacaugaacccaaagacauguucuuuuuaaagcuguuuucagccauguuucuc

SEQ ID NO: 269575 - RNA, 64 nt, hsa
cuuccuuaaaugaaaaguuauugaccaaauggacuuuuuaaaagacacaggacccuuaacuuug

SEQ ID NO: 269576 - RNA, 64 nt, hsa
gugccuuugagcaacuuuauuuaugguuaccauauuuuuaaaaagauuuuuugucagggugacu

SEQ ID NO: 269577 - RNA, 64 nt, hsa
gaaauugaccauuucacuagaggaguugugcugguuuuuaaaugugcaucaagaaagacuacug

SEQ ID NO: 269578 - RNA, 64 nt, hsa
gagagaauacuuuuuaaggcuuuugaacuaucuuuuuuuaaaaaaaaaaaaaaaagcccacauc

SEQ ID NO: 269579 - RNA, 64 nt, hsa
cgggccuuuccacuacguugaagaagaaaaccuauuuuuaaauguaaauaaaauaucuuguagc

SEQ ID NO: 269580 - RNA, 64 nt, hsa
gguaggguguucuggcuuuuuugugggguuuuuauuuuuaaagaaacacucaaucauccuaccg

SEQ ID NO: 269581 - RNA, 64 nt, hsa
cccuucccuccuuuguuuacuuauauauauauuuuuuuuaaacuuaaauuuugggucaacuuga

SEQ ID NO: 269582 - RNA, 64 nt, hsa
uucuuacggcauggacaaggauuuuucaauuuauuuuuuaaacuguuuccauacccuuucuuuu

SEQ ID NO: 269583 - RNA, 64 nt, hsa
uguccacugguuuuuuuauuuugauauuugucuuuuuuuaaauuuuacaguagucauugaaagu

SEQ ID NO: 269584 - RNA, 64 nt, hsa
uguguguguguguguguguguaugauguuuuguuuuuuuaaauguuuuaaaagcuuaauagguu

SEQ ID NO: 269585 - RNA, 64 nt, hsa
gauuuuuuucucauaaaauagucugauaagcuaauuuuuaaaaagaaaugccauuaacuguguu

SEQ ID NO: 269586 - RNA, 64 nt, hsa
aagaaaaauaauauuugauuuugaaucuuaaauguuuuuaaaaauuagacuugaaugggcacaa

SEQ ID NO: 269587 - RNA, 64 nt, hsa
uccacuuucugcuuuucuuucuuucuuuuuuucuuuuuuaaaguaauuucccccacaguaaaau

SEQ ID NO: 269588 - RNA, 64 nt, hsa
aauuuguuaaccuuacguuuucugucuguauauuuuuuuaaaaaucugguaguuucuggaaaaa

SEQ ID NO: 269589 - RNA, 64 nt, hsa
aaauugcauugccuuuauuuuauguuuaggcuuauuuuuaaauuaacauuuaacagaaacauuu

SEQ ID NO: 269590 - RNA, 64 nt, hsa
acaaaccucaagcuuuacugacuucaauuaucuguuuuuaaagacguagaagauuuauuuaauu

SEQ ID NO: 269591 - RNA, 64 nt, hsa
auagaaguauuucugaacauaucaaauauaaauuuuuuuaaagaucuaacugugaaaacauaca

SEQ ID NO: 269592 - RNA, 64 nt, hsa
uuuucuuauucagguuuaauggagguugaauugauuuuuaaacacauauaacaguaggaaauga

SEQ ID NO: 269593 - RNA, 64 nt, hsa
ggcuggaggccaugccuuuuaagcauguguaaaauuuuuaaagaaaugaacauacacauaguua

SEQ ID NO: 269594 - RNA, 64 nt, hsa
gguuuauuucaugcacugugccuucaaaaugaaauuuuuaaaagggacuuuaaaugaaguugaa

SEQ ID NO: 269595 - RNA, 64 nt, hsa
uuuaaaagggacuuuaaaugaaguugaauaguaguuuuuaaaagucaauuuguaauuuauguga

SEQ ID NO: 269596 - RNA, 64 nt, hsa
ugacauuuuucaaaaagguguugauuuguacagauuuuuaaagucaguuaacuuuacugcuauu

SEQ ID NO: 269597 - RNA, 64 nt, hsa
uuacaguaacugcaaguguguuuuuacaucugcauuuuuaaaacauuuuacuguaauucuguug

SEQ ID NO: 269598 - RNA, 64 nt, hsa
agggcauggguuuuauuauauauauauauuuuuuuuuuuaaaaaaaaaacguauugcauuuaau

SEQ ID NO: 269599 - RNA, 64 nt, hsa
ggcuuuaaaacuuauccuccaugaauaucaguuauuuuuaaacuguaaagcuuugugcagauuc

SEQ ID NO: 269600 - RNA, 64 nt, hsa
cgggguggggccccuacagacuccguauuuuauuuuuuuaaauaaaaaacgaucgaaaccauuu

SEQ ID NO: 269601 - RNA, 64 nt, hsa
aaaaacgaucgaaaccauuucacuuuuagguugcuuuuuaaaagagaacucucugcccaacacc

SEQ ID NO: 269602 - RNA, 64 nt, hsa
cugauucccaucguucucaggcggauuuuauauuuuuuuaaagucuauuuuaaugauuggauau

SEQ ID NO: 269603 - RNA, 64 nt, hsa
uauuuuuaagaaaggaccaucucuuuaggauauauuuuuaaauucuuugaaacacauaaccaaa

SEQ ID NO: 269604 - RNA, 64 nt, hsa
agcaaugaucagauuguuaaucuacagauuuuauuuuuuaaaauuuggauguaaguagagacuu

SEQ ID NO: 269605 - RNA, 64 nt, hsa
aguccaaagugcuuagcgaaguaaaaaaaaaagcuuuuuaaaauuucuauuguugucuauuggu

SEQ ID NO: 269606 - RNA, 64 nt, hsa
cuuugugggaaaaugaucuaaauuauuguuuuaauuuuuaaaccuaauuuauucacucagugaa

SEQ ID NO: 269607 - RNA, 64 nt, hsa
augagguuuuuccaaacuuaggauauaagagggcuuuuuaaauuuggugccgauguugaacuuu

SEQ ID NO: 269608 - RNA, 64 nt, hsa
aagaaucuauuagauuuuagaaaaacauuuaaacuuuuuaaaauacuuauuaaaaaauuuguau

SEQ ID NO: 269609 - RNA, 64 nt, hsa
uuguauaagccacuugucuugaaaacugugcaacuuuuuaaaguaaauuauuaagcagacugga

SEQ ID NO: 269610 - RNA, 64 nt, hsa
auccaaaaugcuugggaccagaaguguuucagauuuuuuaaaauuuuggaauauuugcuuuaua

SEQ ID NO: 269611 - RNA, 64 nt, hsa
cuagaguuaguguuuuaucccuaaauaauuucaauuuuuaaaaacaugcagcuucccucucccc

SEQ ID NO: 269612 - RNA, 64 nt, hsa
cgguugucccuuuuaauuuauuugaagugcuauuuuuuuaaauaaagguucaucuguccaugca

SEQ ID NO: 269613 - RNA, 64 nt, hsa
auuuauuucucuggcaaacuuuucuuucuuuucuuuuuuaaaguaaacuuguguauugagucuu

SEQ ID NO: 269614 - RNA, 64 nt, hsa
uuccaaugauacccaacaguuuauuuuuauuauuuuuuuaaacaaaauuucacaguucuguaau

SEQ ID NO: 269615 - RNA, 64 nt, hsa
aaaaauagacaaguaagacagcauaaauaauacauuuuuaaacaugucaacauugauaauacaa

SEQ ID NO: 269616 - RNA, 64 nt, hsa
uuuuuuuuuuuugaccugggaguaauaaaguuacuuuuuaaaugcacguaugcaaucuuuuauu

SEQ ID NO: 269617 - RNA, 64 nt, hsa
uuuguuuuuucaagaaaauuuugcagaagcuauguuuuuaaaguguacauuuuauaaaguuuau

SEQ ID NO: 269618 - RNA, 64 nt, hsa
uuuugggaggagccauagauuccugguuauccuauuuuuaaacaaaauguagacaaagugaacu

SEQ ID NO: 269619 - RNA, 64 nt, hsa
uaaauggagcagcgaaaucaacgagaaacuggacuuuuuaaacccucuucagagcaagcgugga

SEQ ID NO: 269620 - RNA, 64 nt, hsa
gagaagcauuugguaagcuuuaucauauauauauuuuuuaaagaagagaaaaacaccuugagcc

SEQ ID NO: 269621 - RNA, 64 nt, hsa
aauuacugcuguggcuagagaguuugaggauugcuuuuuaaaaaagacagcaaacuuuuuuuuu

SEQ ID NO: 269622 - RNA, 64 nt, hsa
auggcauccuucaauuucuguauaaaagcagaucuuuuuaaaaagauacuucuguaacuuaaga

SEQ ID NO: 269623 - RNA, 64 nt, hsa
cuccucccucagaaaaaggcaguggccuaaauccuuuuuaaaugacuuggcucgaugcuguggg

SEQ ID NO: 269624 - RNA, 64 nt, hsa
ugucauuucaaacacugcuguggacccuacuggguuuuuaaaauauugucaguuuuucaucguc

SEQ ID NO: 269625 - RNA, 64 nt, hsa
aaagauaauaguuauaaaaauuuuaguucauuuauuuuuaaacuccuuucagauuauuuuacca

SEQ ID NO: 269626 - RNA, 64 nt, hsa
ucuuuggaagaaggcagagagaggagucuuauuauuuuuaaaugcuccuaguuguauagucugu

SEQ ID NO: 269627 - RNA, 64 nt, hsa
auguccacuaauuuuuuuauuuugauauuagucuuuuuuaaaaaauuuuacaguagucauugaa

SEQ ID NO: 269628 - RNA, 64 nt, hsa
uucuuacggcaugggcgaggauuuuucaauuuauuuuuuaaaguuuccauacccuuucuuuguc

SEQ ID NO: 269629 - RNA, 64 nt, hsa
cgccuuagggccagauuccccucucuaguccccuuuuuuaaauguccauuuugcuugccuggaa

SEQ ID NO: 269630 - RNA, 64 nt, hsa
uaacugaagugaaaaaagucuguguuuuuguguuuuuuuaaauaaaaauuuucaaaaaguuaaa

SEQ ID NO: 269631 - RNA, 64 nt, hsa
gccugccucucucucucuccucucucucucucucuuuuuaaaccaccauagacucucacuuauu

SEQ ID NO: 269632 - RNA, 64 nt, hsa
ccuuccccaugcuguuguccccaugcugccuauuuuuuuaaauuucauagauuauauuugaauu

SEQ ID NO: 269633 - RNA, 64 nt, hsa
gcagagcaaaaaaauauagcguaaauacuuauuuuuuuuaaaaacuuacuuaaauuugugugua

SEQ ID NO: 269634 - RNA, 64 nt, hsa
gugugagccacugcaguggaccaauuuuuguauuuuuuuaaaugcuugaccaagugucuaaaau

SEQ ID NO: 269635 - RNA, 64 nt, hsa
gguuauuagaccaggaaaacuuaauguaauauuauuuuuaaaaucaucuuaaaggauccaaguc

SEQ ID NO: 269636 - RNA, 64 nt, hsa
gcauuuugaaugauuaguugggauuaccaaacauuuuuuaaaaagauauuaucaauaaauauuu

SEQ ID NO: 269637 - RNA, 64 nt, hsa
cauuccagcaaaccccguguuaaugcuacugugguuuuuaaauuuuugucuagggguuucuuug

SEQ ID NO: 269638 - RNA, 64 nt, hsa
acuuaaaaugaaaguauacuuuuuauaauuuuucuuuuuaaaacuuggugaaauuauuucagau

SEQ ID NO: 269639 - RNA, 64 nt, hsa
uccucuauaguaaauuauuuauuggaagaugacuuuuuuaaagcugccguuugccuuggcuugg

SEQ ID NO: 269640 - RNA, 64 nt, hsa
acagaaaagggagagcuaccaaauuguuuuuuucuuuuuaaaaggaaguuuaauguccguugua

SEQ ID NO: 269641 - RNA, 64 nt, hsa
aaaguuaguagagcuuguucuuguauugugaccuuuuuuaaaaaaaaggaacugagguucagaa

SEQ ID NO: 269642 - RNA, 64 nt, hsa
uccuuaacagaaacaaaaauauauauauauauuauuuuuaaaaauuagcauugucauacaguac

SEQ ID NO: 269643 - RNA, 64 nt, hsa
auuucauggucaagccuguaguauuaaaaugauuuuuuuaaaagauguaaacugugcuuaguua

SEQ ID NO: 269644 - RNA, 64 nt, hsa
cugauaguuuuauuaagcauggagaaauugccaauuuuuaaaaacugcaguuuuccaaacuuuu

SEQ ID NO: 269645 - RNA, 64 nt, hsa
ucuuuuuuaaauagaaacuuuaguuuuuuguaaauuuuuaaaaaaauauuucauugauaugcau

SEQ ID NO: 269646 - RNA, 64 nt, hsa
uuuaccauguuucaucuuggcauaacaugguucuuuuuuaaauagaaacuuuaguuuuuuguaa

SEQ ID NO: 269647 - RNA, 64 nt, hsa
acaaaagaucagaucccuccuucagcuguacacauuuuuaaauaaaaucauauugaacuaaaca

SEQ ID NO: 269648 - RNA, 64 nt, hsa
uugugaaagugacuauaacccaaacuuuuuuuuuuuuuuaaagaggauuuggaaguuguaugga

SEQ ID NO: 269649 - RNA, 64 nt, hsa
acagauacucuuuacaccaucaugccacgcauuguuuuuaaagcauugcguuaaaaaaaaaauu

SEQ ID NO: 269650 - RNA, 64 nt, hsa
uguaugccccuucagaacaugcagaguguaucuuuuuuuaaauuucuccuuccguuucuuaagu

SEQ ID NO: 269651 - RNA, 64 nt, hsa
auuaaucccgauggaauauagcauuguaguugacuuuuuaaaaaaaaaaaaaauuuaaaaaaaa

SEQ ID NO: 269652 - RNA, 64 nt, hsa
uggcuauugccguuuucuuugaaaaaauaaacauuuuuuaaaaaacuaugcaugguuguccuuu

SEQ ID NO: 269653 - RNA, 64 nt, hsa
gaccugcuguugguguacauguggguacaggguguuuuuaaauccaacaagauagaguauaaua

SEQ ID NO: 269654 - RNA, 64 nt, hsa
uuuauucaguugucuuuagcuacaauugcuuugcuuuuuaaaccuuggcaauuguggcaaaauu

SEQ ID NO: 269655 - RNA, 64 nt, hsa
guccacuaauuuuuuuauuuugauauuugucuuuuuuuuaaauuuuacaguagucaucgaaagu

SEQ ID NO: 269656 - RNA, 64 nt, hsa
uucuuaaggcauggacgaggauuuuucaauuuauuuuuuaaacuguuuccauacccuuucuuug

SEQ ID NO: 269657 - RNA, 64 nt, hsa
aaccugaguuuacuccucaaaucgaauuauuuucuuuuuaaauuuuggaaagaguaaauugacg

SEQ ID NO: 269658 - RNA, 64 nt, hsa
guagaacaaacaacaggaaaucuuuuuuuuguuguuuuuaaaaaauucauuuugcagaaagccu

SEQ ID NO: 269659 - RNA, 64 nt, hsa
aauaagguugccuuuuucaaauucaggguuuuuuuuuuuaaauaaaggaaaauuuguagacucu

SEQ ID NO: 269660 - RNA, 64 nt, hsa
gggucuguccugcgcuucgaauccuuguuugaacuuuuuaaaaauucgaaaacuuuggggaacg

SEQ ID NO: 269661 - RNA, 64 nt, hsa
aaaacuuugacagcuuuuauguagaauaaaaaaauuuuuaaauuuguguauuguuacauauguu

SEQ ID NO: 269662 - RNA, 64 nt, hsa
cuuaauugcuuugcugcuagacuugcaacuaauuuuuuuaaaguauauuccauuauuuugcauu

SEQ ID NO: 269663 - RNA, 64 nt, hsa
acacuaauaacaucaacaucugcuaucacuuaucuuuuuaaaacuaaccaaaaaaggccgggug

SEQ ID NO: 269664 - RNA, 64 nt, hsa
ucaacauuuugugggguagugauuuggcaaguguuuuuuaaauaaaacaaaucucauuguaaag

SEQ ID NO: 269665 - RNA, 64 nt, hsa
aauuggccagucaaaaaaaaaaagacuucaaucauuuuuaaaauuccuaauuuucagaaauaug

SEQ ID NO: 269666 - RNA, 64 nt, hsa
uuuuguuuuguuuuaagcuuuuuuuuuuugcuuguuuuuaaagccaaaacaaaaaacaaccaag

SEQ ID NO: 269667 - RNA, 64 nt, hsa
agguuuuuagccugaacuucaaauguaucagcuauuuuuaaacauuauuuacucggauucuaau

SEQ ID NO: 269668 - RNA, 64 nt, hsa
uuuaauaaacauucaauaaugauuacaguuuucauuuuuaaaaauuuaggaugaaggaaacaag

SEQ ID NO: 269669 - RNA, 64 nt, hsa
aguuauuuacaaugaaaaguuuuuaaaaauaaaauuuuuaaaaaucuaaauauggaccugcuca

SEQ ID NO: 269670 - RNA, 64 nt, hsa
aaccuuuuucaugaaaguuauuuacaaugaaaaguuuuuaaaaauaaaauuuuuaaaaaucuaa

SEQ ID NO: 269671 - RNA, 64 nt, hsa
ucauuuguuaaguuuauaucuggauauaauguucuuuuuaaacaaguauaaucauaucgucgga

SEQ ID NO: 269672 - RNA, 64 nt, hsa
aaaaaauuagguuauuacuuuuuuuauaaccagauuuuuaaagcacuagguuuuaaaucagugg

SEQ ID NO: 269673 - RNA, 64 nt, hsa
cuuaaaauaacuauuuuaacccuugaguggcuucuuuuuaaaccaaaaaccgucuuucuuugcu

SEQ ID NO: 269674 - RNA, 64 nt, hsa
aaaaaagcuuuguuauagaaaucagcauacuauuuuuuuaaaucuggagagaagauauucuggu

SEQ ID NO: 269675 - RNA, 64 nt, hsa
guguaaacucuaauuucuaucaaggugucauggauuuuuaaaauuaguauuucauuacaaaugu

SEQ ID NO: 269676 - RNA, 64 nt, hsa
auuuuuauucuuaaacauagguguguuggcucuuuuuuuaaaagaugcgcucuaccugaaaagg

SEQ ID NO: 269677 - RNA, 64 nt, hsa
guaaauaccaaguuugguaucucauagcuaucuuuuuuuaaagaaauuaaguucuugaaaauuu

SEQ ID NO: 269678 - RNA, 64 nt, hsa
ugggccuugccugcuauggaauauugagagagauuuuuuaaaaaagauuuugcauuuuguccaa

SEQ ID NO: 269679 - RNA, 64 nt, hsa
aacaagauauuuuucuuccauguauacaauaauuuuuuuaaaaagugcaauuugcguugcagca

SEQ ID NO: 269680 - RNA, 64 nt, hsa
augugacuugugguguaaaaugucuugaugauaauuuuuaaaacuuggguaacacuuccaaaua

SEQ ID NO: 269681 - RNA, 64 nt, hsa
ugauacuggcuuuacagaaauuucagagaacuaauuuuuaaaaucuuuagcauuuaaaacuuuu

SEQ ID NO: 269682 - RNA, 64 nt, hsa
cagucacugaacuaguagaugucaauaauuauuauuuuuaaaaauuuuuauuuguuggccgggc

SEQ ID NO: 269683 - RNA, 64 nt, hsa
cacuguguugcccagccugggugucaauaauuauuuuuuaaaaaaaauuuuuaaaaagguuuuu

SEQ ID NO: 269684 - RNA, 64 nt, hsa
agccugggugucaauaauuauuuuuuaaaaaaaauuuuuaaaaagguuuuuugagacagauucu

SEQ ID NO: 269685 - RNA, 64 nt, hsa
ccgcaggcacuugccaccacgccccacuaaaaauuuuuuaaauuguugccuuucuugaaguguu

SEQ ID NO: 269686 - RNA, 64 nt, hsa
cuugaagugcuaaauggaauaauccaaaggaaauuuuuuaaaugcagguucuagcugaaaaauu

SEQ ID NO: 269687 - RNA, 64 nt, hsa
uugucagguuauauauagaauuucuauuaaggauuuuuuaaauggacaagcaauaggggguuga

SEQ ID NO: 269688 - RNA, 64 nt, hsa
aucugauuuguuuaaaauuuuguauaucaccaaauuuuuaaaaagugauagucacagugcuaag

SEQ ID NO: 269689 - RNA, 64 nt, hsa
aaaaaaggcagcauucaaauuauauagaaucuaguuuuuaaaaucagcacagaucuucuuaaaa

SEQ ID NO: 269690 - RNA, 64 nt, hsa
aaaaguaaucuucuacuugcuucaagauuugauuuuuuuaaaaaagccugcgaccuauucaaua

SEQ ID NO: 269691 - RNA, 64 nt, hsa
uuuuggaguggaauaauuucuucauuaaaaaauguuuuuaaaaacacuauaucuugggugguuu

SEQ ID NO: 269692 - RNA, 64 nt, hsa
ugucggugucaugucacuaaguuuaaugcugcuguuuuuaaaaaaaaaaaaaaguuuuuuuaaa

SEQ ID NO: 269693 - RNA, 64 nt, hsa
uuaaugcugcuguuuuuaaaaaaaaaaaaaaguuuuuuuaaaaagccaaucuauguacuaaauu

SEQ ID NO: 269694 - RNA, 64 nt, hsa
auauacuaaauauuugcucacauccuuaauauauuuuuuaaaauuccuaacaauaguacuguug

SEQ ID NO: 269695 - RNA, 64 nt, hsa
caaucuucuuucugucacuauagauuaauuugcauuuuuaaagaaauuuacauacauggaacca

SEQ ID NO: 269696 - RNA, 64 nt, hsa
aaucguuuuaguugcuauucauauucucauucguuuuuuaaaaacugauauauucugaauuuau

SEQ ID NO: 269697 - RNA, 64 nt, hsa
aaggaaguuggcaaaaacagccuucuagcacacuuuuuuaaaugaauaaugguagccuaaacuu

SEQ ID NO: 269698 - RNA, 64 nt, hsa
aacuuaauguguauucauuuuaaauuguucuguauuuuuaaauugccaagaaaaacaacuuugu

SEQ ID NO: 269699 - RNA, 64 nt, hsa
cugugccauggcauauauguucaaauucaaaccauuuuuaaaaugugaagauggacuucaugca

SEQ ID NO: 269700 - RNA, 64 nt, hsa
gcaugcaaaguaagacccagcauuuuaaaagcccuuuuuaaaaacuagacuucguacugugagu

SEQ ID NO: 269701 - RNA, 64 nt, hsa
ggaauaucaugggaccaaauaauuccauuccaguuuuuuaaaguuucuugcauuuauuauucuc

SEQ ID NO: 269702 - RNA, 64 nt, hsa
cuuugaaaugcauauugauuuauuauguauugacuuuuuaaaaauugagguauaauuuucacaa

SEQ ID NO: 269703 - RNA, 64 nt, hsa
ggcuauuucacauuaaaguccagauuucugcuucuuuuuaaacaucagaggcucuggcuacaca

SEQ ID NO: 269704 - RNA, 64 nt, hsa
auauguauauaaauaugcaccuaggagaaugugcuuuuuaaaauaaugacuacuguuuuuauua

SEQ ID NO: 269705 - RNA, 64 nt, hsa
uaaaucuaccccuuuugaugaccccaggcuugaguuuuuaaaaugacuacccagaagggcacaa

SEQ ID NO: 269706 - RNA, 64 nt, hsa
aaccuagaagcaccugcugacacucuucaacugauuuuuaaauguuguugcuuggagauaaaaa

SEQ ID NO: 269707 - RNA, 64 nt, hsa
gugcaauauuaaguguuuuggaauuugaagcuaauuuuuaaaaggccugaacuauacuuugaag

SEQ ID NO: 269708 - RNA, 64 nt, hsa
uuggaaacaaugcaguaauagcuuauuguuuuguuuuuuaaagaagauauuuuauuaucuuuua

SEQ ID NO: 269709 - RNA, 64 nt, hsa
ggaaaaugcuuauugaugagguuuauucuaucuguuuuuaaagcaccgagguugcauucuagau

SEQ ID NO: 269710 - RNA, 64 nt, hsa
gggcacugugauacaguuuugaguaaaaagacauuuuuuaaaagccuuccaguuuuguggauua

SEQ ID NO: 269711 - RNA, 64 nt, hsa
ucauuucuggauauauuguagcuaacccaacacauuuuuaaacuauuuuuguuacugacucacu

SEQ ID NO: 269712 - RNA, 64 nt, hsa
aucuaagcuuuuaaccccuuuaccacuuugcuuauuuuuaaaaaauuuauuggcaaaacugggg

SEQ ID NO: 269713 - RNA, 64 nt, hsa
ccuauugugaauuccaaaucuaaaaaaagaaauauuuuuaaaauguucuuaagcaaauauauac

SEQ ID NO: 269714 - RNA, 64 nt, hsa
aaauuuaugguauuugagugugcaagaaaauauauuuuuaaagcuuucauuuuucccccaguga

SEQ ID NO: 269715 - RNA, 64 nt, hsa
cucaauuuugaauuaugcuacucaccaauuuauauuuuuaaagcaaguuguugcuuaucuuuuc

SEQ ID NO: 269716 - RNA, 64 nt, hsa
cugcagugaaaagcaggaagaagauggccuugacuuuuuaaauaauuuggaacccaaauuuauu

SEQ ID NO: 269717 - RNA, 64 nt, hsa
aguaagaccccuuccuuagauuccuguuauacauuuuuuaaaauguagaguuuguuuuggagac

SEQ ID NO: 269718 - RNA, 64 nt, hsa
uauauuacuagucaugauaaaguaaauuaagcaguuuuuaaaacuuagugugaguuuguucauc

SEQ ID NO: 269719 - RNA, 64 nt, hsa
uaaacaaguacacaaauuuuucaauuuuuacauauuuuuaaauuacuuaucuucuauccaagga

SEQ ID NO: 269720 - RNA, 64 nt, hsa
uuaugacuuuuaaaaaaaauuacaaaccaagaauuuuuuaaagcagaagaugcuauuugugggg

SEQ ID NO: 269721 - RNA, 64 nt, hsa
guguauuaguucauuuucuguuucuauuacauaguuuuuaaagucaaugaaagagauugagaau

SEQ ID NO: 269722 - RNA, 64 nt, hsa
aaguaucuucauuuaaaaagaaaucaagucaguuuuuuuaaaagaaugaucuauggaagaaaac

SEQ ID NO: 269723 - RNA, 64 nt, hsa
uguuuccaagguuguguguuuauacuguguauuuuuuuuaaauucacggugaacagcacuuuua

SEQ ID NO: 269724 - RNA, 64 nt, hsa
guugucaguuaucacuguagaugagcaacucaucuuuuuaaaguauaguuacugaacugauucu

SEQ ID NO: 269725 - RNA, 64 nt, hsa
cugcucuaaauauuuaugauaaaaaugcauuauuuuuuuaaagagcuugaugagauuugugaua

SEQ ID NO: 269726 - RNA, 64 nt, hsa
ugcugagguaggaucagcagauaugggccaucuguuuuuaaaguauguuguauucaguuuauaa

SEQ ID NO: 269727 - RNA, 64 nt, hsa
ggauaugcuagaauuacuuccacauauuuaucccuuuuuaaaaaagcuaaucuauaaauaccgu

SEQ ID NO: 269728 - RNA, 64 nt, hsa
cuucuaaagaauaugcauucuugaacuacuuaacuuuuuaaaaaucacaauaaauuuuugcacu

SEQ ID NO: 269729 - RNA, 64 nt, hsa
acguugaugacagcccucaugaguagcauccacauuuuuaaaauuucaaauugguuuuucuacu

SEQ ID NO: 269730 - RNA, 64 nt, hsa
gagaucuguuuagucucgugcauauaguugcuguuuuuuaaaugaacacaguugaguauuugaa

SEQ ID NO: 269731 - RNA, 64 nt, hsa
caaaagugaaguaacaaauauaaugauaauuggcuuuuuaaauuuucaaacaacauagauuuac

SEQ ID NO: 269732 - RNA, 64 nt, hsa
acucugugacucaaaguagugccacugcagugucuuuuuaaacuggaaacagaauuggaaaacu

SEQ ID NO: 269733 - RNA, 64 nt, hsa
gaauucuuuccaaagcaaugucuaaaaacucuuuuuuuuaaaguaacaguuugguauguuuauu

SEQ ID NO: 269734 - RNA, 64 nt, hsa
uuuauauagcauagugguuuuauuuuguuaguuauuuuuaaaggagaagaaauguuacuuuuua

SEQ ID NO: 269735 - RNA, 64 nt, hsa
auauauguuguauuuuauuaaaauauuaaaauguuuuuuaaacaaaaauauuguccgaagcucu

SEQ ID NO: 269736 - RNA, 64 nt, hsa
uugcuguuugccccagauauguuuuucuguguucuuuuuaaauuucagugaaauuuucuuauac

SEQ ID NO: 269737 - RNA, 64 nt, hsa
uacuuuguuuuuaaagugaagcuuuaaaauuacuuuuuuaaaauagucaaauucauguuuuuaa

SEQ ID NO: 269738 - RNA, 64 nt, hsa
aaaaaugcuuuuuaaaauuuuuacaaauacuuuguuuuuaaagugaagcuuuaaaauuacuuuu

SEQ ID NO: 269739 - RNA, 64 nt, hsa
gauagaaaagaucugaccaagugcaaaaaaaugcuuuuuaaaauuuuuacaaauacuuuguuuu

SEQ ID NO: 269740 - RNA, 64 nt, hsa
gcugaagugaccuuagcagaccagagauuuuauuuuuuuaaagagaaaucaguuuaccuguuuu

SEQ ID NO: 269741 - RNA, 64 nt, hsa
auuuuauuuuuuuaaagagaaaucaguuuaccuguuuuuaaaaaaauuaaaucuaguucaccuu

SEQ ID NO: 269742 - RNA, 64 nt, hsa
uuuuucuuuucuucuuuuuuauuauuuuuuucuuuuuuuaaaaaguucugaccgugguuuccug

SEQ ID NO: 269743 - RNA, 64 nt, hsa
auuuaaauguguguucuguuuuguuuuuuaacgauuuuuaaauaacgucugugccuccacuggu

SEQ ID NO: 269744 - RNA, 64 nt, hsa
aagccugcaauuucucgacaaaacaacacaagauuuuuuaaagauggaaucagaaacuacgugg

SEQ ID NO: 269745 - RNA, 64 nt, hsa
uuuaacucagcaagugagaacuuacaagaggguuuuuuuaaaauuuuuuuuucucuuaaugaac

SEQ ID NO: 269746 - RNA, 64 nt, hsa
aucacauaccugcagacaaacuggagcaauguuauuuuuaaaggguuuuuuucaccuccuuauu

SEQ ID NO: 269747 - RNA, 64 nt, hsa
cauucaaaguacuuuuuuuugaaaauacagauuuuuuuuaaaagugaauaauguguucaacucu

SEQ ID NO: 269748 - RNA, 64 nt, hsa
uuaauuguacuucuaugaaauaauaugcagucuauuuuuaaauuauaaauuaugugugaacuua

SEQ ID NO: 269749 - RNA, 64 nt, hsa
uauuacaagcaauucaauuguacacuuuuaguuauuuuuaaauuuacaauguuauugauuacag

SEQ ID NO: 269750 - RNA, 64 nt, hsa
uaaaaucuauacauuucugaguucugaauaaauauuuuuaaaaauuuuaauauauuuuucuuug

SEQ ID NO: 269751 - RNA, 64 nt, hsa
uauuuaugaaaguuaauccauuucugauacgugguuuuuaaaaauaugaaauggauuuauauau

SEQ ID NO: 269752 - RNA, 64 nt, hsa
augaaaagcauccccaaaauuucaaugaugugaauuuuuaaauuaccuuuauuucuuuaaacua

SEQ ID NO: 269753 - RNA, 64 nt, hsa
uguguuuuuaguuuucauagacacuuauuuaaucuuuuuaaauuguacagcaaggugcucuaag

SEQ ID NO: 269754 - RNA, 64 nt, hsa
uguuacacgaagauaaacugaauaagcauuuagcuuuuuaaaucauuuuaaaaauuaagucuaa

SEQ ID NO: 269755 - RNA, 64 nt, hsa
caaugauaacccuguuuauugugggauaucaauauuuuuaaagugccaacacagucaugauagg

SEQ ID NO: 269756 - RNA, 64 nt, hsa
guggccauuggccaaauauggccucccaacuguuuuuuuaaaauaaaguuuuauuggaacacag

SEQ ID NO: 269757 - RNA, 64 nt, hsa
ucuguaucaucaccaguacuuuguacuuugagucuuuuuaaauaugcucuguuaguuuguaugg

SEQ ID NO: 269758 - RNA, 64 nt, hsa
uuugugaaguguguguugaagccuugcagauuauuuuuuaaauuagagguuuaucacuagguau

SEQ ID NO: 269759 - RNA, 64 nt, hsa
cuuaguuuacagugcaauuuuaucucaggaauuauuuuuaaaaggaggaggggacauagaaaaa

SEQ ID NO: 269760 - RNA, 64 nt, hsa
auuguagccauaugguaaauuuuuauuuguuaaauuuuuaaaaauuacuuagcucaaaauguca

SEQ ID NO: 269761 - RNA, 64 nt, hsa
uaaaaauuacuuagcucaaaaugucagugguaaauuuuuaaauugaguaaagugauucuucuuu

SEQ ID NO: 269762 - RNA, 64 nt, hsa
aacauugucucuugaccuuuuuuuuuuuuuuuuuuuuuuaaagagacagagucucacucuguca

SEQ ID NO: 269763 - RNA, 64 nt, hsa
uuguccaguuuccaauagaagugggagauccagauuuuuaaaugggauaacuuuuuauagguuc

SEQ ID NO: 269764 - RNA, 64 nt, hsa
auuuaucuuaauugaugucuguacuccacccccauuuuuaaauauuaaaaagcugcugcaaaua

SEQ ID NO: 269765 - RNA, 64 nt, hsa
aaaagacaaaaaaaaaaaaaaaaccucaaaaguuuuuuuaaagugggggaaaaacauccaagca

SEQ ID NO: 269766 - RNA, 64 nt, hsa
ggacggugaacggccauguguuaauguuacgauguuuuuaaaagacaaaaaaaaaaaaaaaacc

SEQ ID NO: 269767 - RNA, 64 nt, hsa
gcauugggaugucugguuguuuuuauuucugacuuuuuuaaaauuccaggugugccgcacccac

SEQ ID NO: 269768 - RNA, 64 nt, hsa
aauaacugaaaucccccagcgaugggguaacaauuuuuuaaaacucucgauugccguuucaauu

SEQ ID NO: 269769 - RNA, 64 nt, hsa
uuuuuuuuuaaauaaauguguucuuguucugccauuuuuaaaucaagguuucuguuaacgaggc

SEQ ID NO: 269770 - RNA, 64 nt, hsa
uagcucaauacaaugugaacucacuuuuuuuuuuuuuuuaaauaaauguguucuuguucugcca

SEQ ID NO: 269771 - RNA, 64 nt, hsa
cugguagccaggguucccucgaacuugggggaucuuuuuaaaagcaaaguaaauccugccacca

SEQ ID NO: 269772 - RNA, 64 nt, hsa
uuuuuaaagacugugaaauguuugucuuuucuguuuuuuaaaugaucaugaaaccaaaaagaga

SEQ ID NO: 269773 - RNA, 64 nt, hsa
cccaggacucuggcuucucuccucagacuucuauuuuuuaaagacugugaaauguuugucuuuu

SEQ ID NO: 269774 - RNA, 64 nt, hsa
cuauuuguacuuuuauguaauaaaaugcaguacauuuuuaaauuuucagaugaugugugaacuu

SEQ ID NO: 269775 - RNA, 64 nt, hsa
aaguguucuuuuuuccuugaaaagaaguacagauuuuuuaaaaagcuaauauugcugugauuca

SEQ ID NO: 269776 - RNA, 64 nt, hsa
agaauaauuuuuacaaaauuuagugcauacaaaauuuuuaaauguaauuccacaauuaguguau

SEQ ID NO: 269777 - RNA, 64 nt, hsa
uaaaaucccuacauuucugaggccugaauaaguauuuuuaaaguuuucuaauauuuauuuuuug

SEQ ID NO: 269778 - RNA, 64 nt, hsa
uuuuacuaauacuuuuauauaaaaugcaguauauuuuuuaaauuucagauuauaugugauguua

SEQ ID NO: 269779 - RNA, 64 nt, hsa
uacuaaaacauauuuuugcagauacaggaaaaauuuuuuaaaaauuuuaaucauuaagucugua

SEQ ID NO: 269780 - RNA, 64 nt, hsa
ucccuggcaggcaucagaacuauuuugcacaugauuuuuaaagguauuuauuagaaaucaaaga

SEQ ID NO: 269781 - RNA, 64 nt, hsa
uaaaauaaaauaauaauaauguaugaagcucuguuuuuuaaacuccuuaccagcuuaguuauaa

SEQ ID NO: 269782 - RNA, 64 nt, hsa
agugacaaauuaagucuauauauuaacagaaauauuuuuaaaaaauuagagugaagaaaaauga

SEQ ID NO: 269783 - RNA, 64 nt, hsa
auacuuaauaauauaacaguuuuauaagaagauguuuuuaaaaccuuagggcaggaaagaacuu

SEQ ID NO: 269784 - RNA, 64 nt, hsa
guaaagguaaaagguuugaaauuuuuaagcgcauuuuuuaaaacuuaaaauguauuuggaggag

SEQ ID NO: 269785 - RNA, 64 nt, hsa
uccagucacuagaguucuuucaguagaaaaagaauuuuuaaaaauuaaaauguaauguugcugc

SEQ ID NO: 269786 - RNA, 64 nt, hsa
gcaugcagaaggcggaguuuuuaaauuuaaaacauuuuuaaaauagcaaauguuaauauuccag

SEQ ID NO: 269787 - RNA, 64 nt, hsa
cccacuugggcaaaaacgcaugcagaaggcggaguuuuuaaauuuaaaacauuuuuaaaauagc

SEQ ID NO: 269788 - RNA, 64 nt, hsa
uuuccaccuuucuaaaaccaguuugguacauaucuuuuuaaagaucgcuuuauaaaaacaaaaa

SEQ ID NO: 269789 - RNA, 64 nt, hsa
ccauuuuauuccuaaacaagauaguuacaaagauuuuuuaaaaagcuacauaugccccucccaa

SEQ ID NO: 269790 - RNA, 64 nt, hsa
uucuuuagcaaaugaaaguguuuuuuuaauuuucuuuuuaaauuguuuauuguuaauguaugga

SEQ ID NO: 269791 - RNA, 64 nt, hsa
aaauaccugaugcccuuauuugaagcuccauuauuuuuuaaaaagaaauuauauaaaaauacuu

SEQ ID NO: 269792 - RNA, 64 nt, hsa
ggcaacaugaugagaccccaucucuacaaacaauuuuuuaaaaaugagccaggugugguagugu

SEQ ID NO: 269793 - RNA, 64 nt, hsa
aggggugagccaccacgcccagccccagcuuaguuuuuuaaaaaguuuauuuuagccauucuaa

SEQ ID NO: 269794 - RNA, 64 nt, hsa
guccucucucucuuucuugcuagugguuuaucaauuuuuaaaaccuuuucuuguuuauuuguuu

SEQ ID NO: 269795 - RNA, 64 nt, hsa
cagccagcuuaucccucuuaagugccaaaacuuuuuuuuaaaccauuuuuuaucguuuuugaag

SEQ ID NO: 269796 - RNA, 64 nt, hsa
uuuaaaccauuuuuuaucguuuuugaaggagaucuuuuuaaaaccuacaagagacaucucucua

SEQ ID NO: 269797 - RNA, 64 nt, hsa
cagaugaauuguuuucaucugaagccugcuaucuuuuuuaaaagaugugcuauuuauucuugca

SEQ ID NO: 269798 - RNA, 64 nt, hsa
uaugucuuauuuuuuuccuaaaagauaauguuuauuuuuaaaaaggaaggaaggagcaagugaa

SEQ ID NO: 269799 - RNA, 64 nt, hsa
uugaugaacagaaauaaagugauaacaagaguuauuuuuaaacagaacuccucuuaccccccaa

SEQ ID NO: 269800 - RNA, 64 nt, hsa
cuacauuuaauguaaugagauaccuuuguucauuuuuuuaaauuugaaauauacuuuaccugau

SEQ ID NO: 269801 - RNA, 64 nt, hsa
ucaauuaaaaagcacacuucuacaaaagauuugguuuuuaaauuaugguuacacauuucaguaa

SEQ ID NO: 269802 - RNA, 64 nt, hsa
cucuauaucaugcuuuaaaguguaauaauaugauuuuuuaaaagaaauuuauuacuuguugcaa

SEQ ID NO: 269803 - RNA, 64 nt, hsa
uuuuaaaagaaauuuauuacuuguugcaaaggucuuuuuaaaccaguuuagauuucaagaaaaa

SEQ ID NO: 269804 - RNA, 64 nt, hsa
aaauaaaucucuugcuggauuugagaguauugcauuuuuaaagucucucuucuguaacuggaug

SEQ ID NO: 269805 - RNA, 64 nt, hsa
cuuguucacguuuagugguguuuugcuguuuuguuuuuuaaacaaaugaugcugagaauaagga

SEQ ID NO: 269806 - RNA, 64 nt, hsa
ucagcacauacuguguuguacuuuuguaaaugauuuuuuaaauggaauuuugcacauaauacau

SEQ ID NO: 269807 - RNA, 64 nt, hsa
aacuucugcuaacuugcacggcuuuaucacagcauuuuuaaagcuuucccucaaaaauccugau

SEQ ID NO: 269808 - RNA, 64 nt, hsa
auaaaugucugcuuuguaaaagcaguuuugcaauuuuuuaaagaucuauuucuguuauaauuua

SEQ ID NO: 269809 - RNA, 64 nt, hsa
uccuuuuacauccuggaacaacaauaaaaacauuuuuuuaaacuugucuacuguaagauacugc

SEQ ID NO: 269810 - RNA, 64 nt, hsa
uauaaauaucacccaaaaggcuuucugcccuauauuuuuaaaauacagaauaguuauauuugaa

SEQ ID NO: 269811 - RNA, 64 nt, hsa
aucaguguuuucugcaaggguugugaccugaaacuuuuuaaaaaccacccaccuuuggggaagc

SEQ ID NO: 269812 - RNA, 64 nt, hsa
aauugucuuccucgauucuccaucggguguagaguuuuuaaacuaucaauggcauuucaagucu

SEQ ID NO: 269813 - RNA, 64 nt, hsa
cuggcaggguuuuuuuguuuuauuuguuugcuuauuuuuaaauuaacuguuuugagcuuugaau

SEQ ID NO: 269814 - RNA, 64 nt, hsa
gggaaagaacauaaaagcuuuuugaacuacagccuuuuuaaaagagggaugggaggauauuaca

SEQ ID NO: 269815 - RNA, 64 nt, hsa
ugauuaacauugacaggauuacuguguguuuaauuuuuuaaaaacugaacacugugauuauggg

SEQ ID NO: 269816 - RNA, 64 nt, hsa
cuucagucauaccggaaucugaaucaaaaaaguauuuuuaaauauccaugauuucucccuguau

SEQ ID NO: 269817 - RNA, 64 nt, hsa
guggccagauucuguuauuugcaauuaaagcaaguuuuuaaaaaaugcaagaggcaguuguuag

SEQ ID NO: 269818 - RNA, 64 nt, hsa
caggcaugagccaccgcuccuggccucucuuucuuuuuuaaacaaagaacuuugcacuuggcca

SEQ ID NO: 269819 - RNA, 64 nt, hsa
acacuuacguguuagacaagaacuaugauuuuuuuuuuuaaaguacuggugucacccuuugccu

SEQ ID NO: 269820 - RNA, 64 nt, hsa
gucacccuuugccuauaugguagagcaauaaugcuuuuuaaaaauaaacuucugaaaacccaag

SEQ ID NO: 269821 - RNA, 64 nt, hsa
ugccucgcucuuuucaaucucuuaaucuaaaugcuuuuuaaagagauuauuuguuuagauguag

SEQ ID NO: 269822 - RNA, 64 nt, hsa
aagagauuauuuguuuagauguaggcauuuuaauuuuuuaaaaauuccucuaccagaacuaagc

SEQ ID NO: 269823 - RNA, 52 nt, hsa
uauggaaugcaucuuggugauauuuuuaaauuaauauuuuaaauugcuugaa

SEQ ID NO: 269824 - RNA, 64 nt, hsa
aaagaaauauauauauacuuuuuuucuuuuuucuuuuuuaaagacagggucucacucucauugc

SEQ ID NO: 269825 - RNA, 64 nt, hsa
ccuucuucaaaugacauggaaagcaaaacuuucuuuuuuaaaaauuuucauuuauuuaauggaa

SEQ ID NO: 269826 - RNA, 64 nt, hsa
gcccauuuucacaugucugcuuauuuauuuuauauuuuuaaaagaagacaguauucaccuaugu

SEQ ID NO: 269827 - RNA, 64 nt, hsa
ucaugugugugccaccaaacacguuauuggcaccuuuuuaaauaagcucucaugaucaagaugg

SEQ ID NO: 269828 - RNA, 64 nt, hsa
aacauguuugguuuucuuacgauacagggccauuuuuuuaaaacucucaggacugaacagaaga

SEQ ID NO: 269829 - RNA, 64 nt, hsa
ucaagaguuuuucuaccucuuuaacaguuaauauuuuuuaaaggaagaaauggaauguaccuuc

SEQ ID NO: 269830 - RNA, 64 nt, hsa
guccacaguggcaauaccggacuucuguucaagcuuuuuaaagugcugagccuuacaaaccccu

SEQ ID NO: 269831 - RNA, 64 nt, hsa
gaagcacuucuauccaaaaugacuuuuuuguccuuuuuuaaaaccaauuuacuguuacuggaaa

SEQ ID NO: 269832 - RNA, 64 nt, hsa
gaaauuuuucuguaauuuucuuaccaucggguauuuuuuaaaguauucauugaguuuaccaaaa

SEQ ID NO: 269833 - RNA, 64 nt, hsa
auguagaaguagaaagaaaagaaaaagaaaaucuuuuuuaaaccagaauaaacauuaaaaacua

SEQ ID NO: 269834 - RNA, 64 nt, hsa
aacagggcaagacguuugguuucauuugucaccauuuuuaaaacucuguaugcuagcacaccaa

SEQ ID NO: 269835 - RNA, 64 nt, hsa
cacaguauaccacuccuugggauaaaguuaaauauuuuuaaagaucacauuuuccaugaacgcc

SEQ ID NO: 269836 - RNA, 64 nt, hsa
auucagagcuaucgcucaaaaccaaaagucuugguuuuuaaaugugcuuagacaaaaaaaauca

SEQ ID NO: 269837 - RNA, 64 nt, hsa
gggacaauuuggauuuuguuccaaaagacaaguguuuuuaaaaagaaccuuuccauacuucgug

SEQ ID NO: 269838 - RNA, 64 nt, hsa
auuuuuuguguggaaaaaaaucuccaaauuguaguuuuuaaauuuggggaaugcaaauauauau

SEQ ID NO: 269839 - RNA, 64 nt, hsa
uccccaacagcgccgggcgcagaaagcuuucgauuuuuuaaauaagaauuuuaauaaaaauccu

SEQ ID NO: 269840 - RNA, 64 nt, hsa
agaacacuuuaaaaauacagagaauuucuuccuuuuuuuaaaaaaaaauaagaaaaugcuaaau

SEQ ID NO: 269841 - RNA, 64 nt, hsa
gacaaaaaaaaauugaauuaaaaauaacacagucuuuuuaaaacuaacauaggaaagccuuucc

SEQ ID NO: 269842 - RNA, 64 nt, hsa
guuuugugcggcucgauggggcauuuggaacuucuuuuuaaagucaucucauggucuccaguuu

SEQ ID NO: 269843 - RNA, 64 nt, hsa
auguaagguuuaucuucuggcuuaaaaauagauauuuuuaaaaaauagauuuucuaaaacacag

SEQ ID NO: 269844 - RNA, 64 nt, hsa
ggaaauauauuauuuguuagucuguaucuggagcuuuuuaaaauuauguuauuaaucuuuuagu

SEQ ID NO: 269845 - RNA, 64 nt, hsa
acaguaguuuggauguacaauuauuauuaguggcuuuuuaaaaaaugaaacaguguuaagugaa

SEQ ID NO: 269846 - RNA, 64 nt, hsa
acuguuuaucuuguucugggcauuggaguuucaguuuuuaaaaaauucuugaaaauguauucug

SEQ ID NO: 269847 - RNA, 64 nt, hsa
aggggcccauucauaagaaaguguuauaucuagguuuuuaaaacugaaguugaaauuaucuuug

SEQ ID NO: 269848 - RNA, 64 nt, hsa
caggcaugagccaccaugcccggccuaaacuuuguuuuuaaaaugaacuuuuuuuccccccaau

SEQ ID NO: 269849 - RNA, 64 nt, hsa
uguuuaccaaauauucuccuuuaaacagacucgcuuuuuaaacuuuuuuuuuuuuuuuugagac

SEQ ID NO: 269850 - RNA, 64 nt, hsa
gaaguauaauuguaaauaagccauguaaaaugccuuuuuaaaauuuaauuuucuagcuggcucc

SEQ ID NO: 269851 - RNA, 64 nt, hsa
cuucuagaucucugguguucucuuugguuucauuuuuuuaaaaaauuaccuucuuugggugggg

SEQ ID NO: 269852 - RNA, 64 nt, hsa
auagagcaaggguaauccuagaaaaaauuuuuuuuuuuuaaauuaugcaacguaagauguccuc

SEQ ID NO: 269853 - RNA, 64 nt, hsa
uugugcucuuucauuuaaaauguauguuuuuuuuuuuuuaaacugucaaugauuuuguauuaug

SEQ ID NO: 269854 - RNA, 64 nt, hsa
auaccuucaaauucucugaaaguaaaaauaaaaguuuuuaaauauuugagagacuuccccucuu

SEQ ID NO: 269855 - RNA, 64 nt, hsa
ccuuuauggcauuaggguaaagaugaagcaauaauuuuuaaauuguguaugugcauaugaagca

SEQ ID NO: 269856 - RNA, 64 nt, hsa
cauuauuuuguuagaggaccuuaaaauuguuuauuuuuuaaaugugauuccuuuauggcauuag

SEQ ID NO: 269857 - RNA, 64 nt, hsa
aaaaacauuauugggaaacuagagaacaccucuauuuuuaaaaggacuuuaacgaagucaaaca

SEQ ID NO: 269858 - RNA, 64 nt, hsa
ugucaugaaggguuuuuuuuaugugacugauuuuuuuuuaaaucgauguucaaacuaauaaaua

SEQ ID NO: 269859 - RNA, 64 nt, hsa
ugagaauucucagaacuuuguaccuuuccccugauuuuuaaacccuuuuucuaaacagacugac

SEQ ID NO: 269860 - RNA, 64 nt, hsa
aauaaagguuuguuuugguuuguuauggcuuccuuuuuuaaaaaauuacccuguagugccaguu

SEQ ID NO: 269861 - RNA, 64 nt, hsa
auagacaugucucaauuauauauguguguguauguuuuuaaagcuaaaaacauuacuuuuagau

SEQ ID NO: 269862 - RNA, 64 nt, hsa
uuuuuucucaucuaugcaauucccauaugguuuuuuuuuaaaucauauuuuauucauuuucucc

SEQ ID NO: 269863 - RNA, 64 nt, hsa
augcuaaugauugaauuaucuuuuccaaagauuuuuuuuaaaugugaugucgguaaauugaaau

SEQ ID NO: 269864 - RNA, 64 nt, hsa
uaaaugugaugucgguaaauugaaauaacauaauuuuuuaaaacuuggauggagagaugagaag

SEQ ID NO: 269865 - RNA, 64 nt, hsa
cuuguaaauauacuccuaguaauuuaagauuuuguuuuuaaacuggaaauaaaagauuguauag

SEQ ID NO: 269866 - RNA, 64 nt, hsa
uuaaacuggaaauaaaagauuguauagugcauguuuuuuaaagucuaugugaaguguuuucuuu

SEQ ID NO: 269867 - RNA, 64 nt, hsa
gaaaacaaauuagguuuggguucaauuccuucaauuuuuaaaaaacuggucucugagaguuuuu

SEQ ID NO: 269868 - RNA, 64 nt, hsa
uccuucaauuuuuaaaaaacuggucucugagaguuuuuuaaaucauugagagccuguuuuucuu

SEQ ID NO: 269869 - RNA, 64 nt, hsa
ucugcacaaagaugucuucuguucauccugaacauuuuuaaaaaaugcagaauuuuaugugacu

SEQ ID NO: 269870 - RNA, 64 nt, hsa
guucugcacuuugacacaagguguaacuagaccauuuuuaaaugucaguugaaaauuauggcug

SEQ ID NO: 269871 - RNA, 64 nt, hsa
ccacaucuuagcaagcaccaaaaaacuaaagcaguuuuuaaaccgauauuuacguaaagaaaau

SEQ ID NO: 269872 - RNA, 64 nt, hsa
caccaggaaagcuuuucuuuuucuuuuuuuuuuuuuuuuaaacaccaagagcacguauagcaug

SEQ ID NO: 269873 - RNA, 64 nt, hsa
guagaccguaaggaugaauuccacaauaggauccuuuuuaaaaucgauuuuaaauuguugccua

SEQ ID NO: 269874 - RNA, 64 nt, hsa
ccuaucugaccuuguguguaaauacguacaucuguuuuuaaaguggaugggccccugagaacuc

SEQ ID NO: 269875 - RNA, 64 nt, hsa
uucagaagaagcgacggcaccgucaacccucuguuuuuuaaaggugguuggagacuguuaacac

SEQ ID NO: 269876 - RNA, 64 nt, hsa
uguaaauuuaauuguacauaugguugauuuauuauuuuuaaaaauacagacuaacugauguaau

SEQ ID NO: 269877 - RNA, 64 nt, hsa
uucaacuguguucuuuaaaauaaauccuaccugguuuuuaaauuuuauuuuucaugaaaaugcu

SEQ ID NO: 269878 - RNA, 64 nt, hsa
auauugacuuguuacaugaagauguuaaaaucgguuuuuaaaggugauguaaauagugauuucc

SEQ ID NO: 269879 - RNA, 64 nt, hsa
auuuugcuuuucagaagucagccuacauaacacauuuuuaaagucuaaacuguuaaacaacucu

SEQ ID NO: 269880 - RNA, 64 nt, hsa
agaauaaaauguaccugccauccaguuuuggaucuuuuuaaaacuaaugaguaugaacuugaga

SEQ ID NO: 269881 - RNA, 64 nt, hsa
ugguuugggcucccucuuauuuuuacaaguuucauuuuuaaaaguaggcaacuacuuuggguua

SEQ ID NO: 269882 - RNA, 64 nt, hsa
uugaacuuaugaaucauacucauuacuuuucagcuuuuuaaaaggccaauuuuuguccaguuuu

SEQ ID NO: 269883 - RNA, 64 nt, hsa
cuggaggagaaaaaaugaguuacaaugucagguguuuuuaaaaauuccuuuuagagacagucuu

SEQ ID NO: 269884 - RNA, 64 nt, hsa
aggaccuaaaccuuuaugcuacauuuucgaagauuuuuuaaaaauaauauuguuaaucaguaaa

SEQ ID NO: 269885 - RNA, 64 nt, hsa
ucuaguuuguguuacgagguauucuuucaaauuuuuuuuaaaagccaacuacugucauuaagaa

SEQ ID NO: 269886 - RNA, 64 nt, hsa
ugaauugugaaaugugucauaagaaacaaaauauuuuuuaaacaagaauaauaaagguuggaga

SEQ ID NO: 269887 - RNA, 64 nt, hsa
agcacaacugauuccaacacaaaaccccuuccccuuuuuaaaaugauuucuguucuaaugccau

SEQ ID NO: 269888 - RNA, 64 nt, hsa
aaacagaggcauugagaaaggggaaaggcggguauuuuuaaaagccaaagauugacccaguuac

SEQ ID NO: 269889 - RNA, 64 nt, hsa
agguuuaggucaguguuuuuaaguuuuuguuuuuuuuuuaaagcaaauccuguauauguaucua

SEQ ID NO: 269890 - RNA, 64 nt, hsa
ccuucauauaaaaauucaggcccuuuuuggacaauuuuuaaaauuuguaucuuuacuagaacau

SEQ ID NO: 269891 - RNA, 64 nt, hsa
auuguauuaaauagcauuggggaauagcuaaaccuuuuuaaaaaaauuuauuggauuuuccucc

SEQ ID NO: 269892 - RNA, 64 nt, hsa
gaucuguuccucuguuuuucuuuuugauuuuuguuuuuuaaaccaaaacagacaauagcuuauu

SEQ ID NO: 269893 - RNA, 64 nt, hsa
aaaauaagcucauacccaaauucacaaagccuauuuuuuaaaccaaagcacauuuugaaugagu

SEQ ID NO: 269894 - RNA, 64 nt, hsa
cagcacuaaccagaccuccagccacucacagcucuuuuuaaaaaacagcuucaaaauaugcagc

SEQ ID NO: 269895 - RNA, 64 nt, hsa
aauccagaaaauuucaaaugcaguugaguauucuuuuuuaaaugcagauuuucaaaacauauuu

SEQ ID NO: 269896 - RNA, 64 nt, hsa
gaccccgcagagcugcauugacuaccagauuuauuuuuuaaaccagaaaauguuuuaaauuuau

SEQ ID NO: 269897 - RNA, 64 nt, hsa
uaacaauguucaugguugugauguuuuuuuuuuuuuuuuaaauaaaauuccaaauguuuauaaa

SEQ ID NO: 269898 - RNA, 64 nt, hsa
guuggaaagaagacaguugagcacuucaggaugguuuuuaaauuugguaugagauucucugcca

SEQ ID NO: 269899 - RNA, 64 nt, hsa
uucuugcaguuuuuauaucauuguuuuauuuuguuuuuuaaauaaauucuagugguuugaucca

SEQ ID NO: 269900 - RNA, 64 nt, hsa
gucuggagaaaucucucccuuuuuccuugauuucuuuuuaaagguaccuuaucucuccccacuc

SEQ ID NO: 269901 - RNA, 64 nt, hsa
ccaaaaauagugaaacuaguggauuauauaugacuuuuuaaacaagauucaggauauauauuau

SEQ ID NO: 269902 - RNA, 64 nt, hsa
agcucaugaaauugaguguuauuuuuuucuuucuuuuuuaaaaaaauauguaaagugcagucuu

SEQ ID NO: 269903 - RNA, 64 nt, hsa
aggguuaauuuaaagggggggaaccucaaaaguuuuuuuaaaaaagaaacuugucugccacagu

SEQ ID NO: 269904 - RNA, 64 nt, hsa
cacauaccaguguauaagauuuuuagaaguuuacuuuuuaaaaauaaaagcaaaauguaagauc

SEQ ID NO: 269905 - RNA, 64 nt, hsa
ucuucuugcaaucuccugaggauuaucugccccauuuuuaaaacgagguggaauacccaagguc

SEQ ID NO: 269906 - RNA, 64 nt, hsa
aaugagaaaaagcuauuaugcugauggagcaugcuuuuuaaauccuuuaaaaacacucaccaua

SEQ ID NO: 269907 - RNA, 64 nt, hsa
uggauaugugguuccugaugcauuuugacuugucuuuuuaaaugcuuuaucuuuuucuuuaaag

SEQ ID NO: 269908 - RNA, 64 nt, hsa
uguuuuccuacuaggaauuacaaacuuuaaacacuuuuuaaaucuucaaaauauuuaaaacaaa

SEQ ID NO: 269909 - RNA, 64 nt, hsa
augcgaaauuagaaaaaaauuauaauaucugcuauuuuuaaaagacagcuauagucaagagcuu

SEQ ID NO: 269910 - RNA, 64 nt, hsa
ugguaaauuuuauguaguauauuuuaccacauuuuuuuuaaaggccagucuuauccugaauucc

SEQ ID NO: 269911 - RNA, 64 nt, hsa
uaacauaaugagaccuguccucuaugaaaaaacuuuuuuaaaaauuuagcugggugugguggua

SEQ ID NO: 269912 - RNA, 64 nt, hsa
gagucuauauguuuucguaaucuucaucaagaaguuuuuaaaaggcaagcaaaaacagaagcaa

SEQ ID NO: 269913 - RNA, 64 nt, hsa
uucuuugucucacagaagacuaggagaaagaucuuuuuuaaauaaucuuuuugcuguuuuuaaa

SEQ ID NO: 269914 - RNA, 64 nt, hsa
ggagaaagaucuuuuuuaaauaaucuuuuugcuguuuuuaaaaaauuaaacaaggcuuuguguu

SEQ ID NO: 269915 - RNA, 64 nt, hsa
ugaauaaucaagugcuaaaacaaaaucaggugcuuuuuuaaaacagcuugauugagauauaauc

SEQ ID NO: 269916 - RNA, 64 nt, hsa
uugauugaagauugaaaagggucagcugggaaaauuuuuaaaaagacuguuuuuaaaaaggugc

SEQ ID NO: 269917 - RNA, 64 nt, hsa
aaagggucagcugggaaaauuuuuaaaaagacuguuuuuaaaaaggugcuacaaaauaaagugc

SEQ ID NO: 269918 - RNA, 64 nt, hsa
uuagacauaucagagcaguguauuucuggaucauuuuuuaaaugaccucuucuaaaacauaacu

SEQ ID NO: 269919 - RNA, 64 nt, hsa
uguauagagcuaguuuuaaaauaaugaucucagauuuuuaaaaaggauauaggaaccugcauug

SEQ ID NO: 269920 - RNA, 64 nt, hsa
uuuauuauugacauuaaguaaugguaccauauauuuuuuaaaauacauauugacuugaauugug

SEQ ID NO: 269921 - RNA, 64 nt, hsa
acguaucuauguuguguaggggaaauuuuuucauuuuuuaaaaauucuacuuugguuuuguugu

SEQ ID NO: 269922 - RNA, 64 nt, hsa
auuuuguauuuuuguaauauuuguaaauaugaacuuuuuaaauugcugcaaagaugguuucuuu

SEQ ID NO: 269923 - RNA, 64 nt, hsa
uuuauaugucguuggaauuuguaaauuuacauuuuuuuuaaagaagagacugauguguagauag

SEQ ID NO: 269924 - RNA, 64 nt, hsa
uuuaguuuuagaauggguuuuuauuuuauuuccuuuuuuaaaauuuuacuuugcuuuuaacauu

SEQ ID NO: 269925 - RNA, 64 nt, hsa
agggcaugaaauuggggaagaguguuauuuccguuuuuuaaaugaguugauguacccuuauaua

SEQ ID NO: 269926 - RNA, 64 nt, hsa
agaaugcuauagaaauauuuggugguuuuuuuuuuuuuuaaacauccacaguuaagguugggcc

SEQ ID NO: 269927 - RNA, 64 nt, hsa
uaagaaguuaccuaauccugcuucuuaacaucaauuuuuaaaaauaucuuaaaauuacuuuguu

SEQ ID NO: 269928 - RNA, 64 nt, hsa
aaaugaagcugcaaacuucuuuuuacucuaaucauuuuuaaaauacuaauggaagaacuuucua

SEQ ID NO: 269929 - RNA, 64 nt, hsa
aacuguguauguaugugugggguuuuuuucuuuauuuuuaaaugaaaauuaagacaccuuuugu

SEQ ID NO: 269930 - RNA, 64 nt, hsa
uuuguuugguuugaguuugauuuggcuuuuauauuuuuuaaaaucccuuuugcuaccccaucug

SEQ ID NO: 269931 - RNA, 64 nt, hsa
uuaccugauugauauuacauucaccuuugauuguuuuuuaaaaguuuauuuuuacagaauauau

SEQ ID NO: 269932 - RNA, 64 nt, hsa
uguuucuguguuuuugguaugcuaaauaaagcuauuuuuaaacccaagagauuuuuuuucugcc

SEQ ID NO: 269933 - RNA, 64 nt, hsa
gaaaacauaagccauggugaacugauaauuuuuguuuuuaaauuauuuauauuacugaauuggc

SEQ ID NO: 269934 - RNA, 64 nt, hsa
ggaguuaaaauguguuuuucaguuauaauuucaauuuuuaaauuucuuggugcuuugucuaauu

SEQ ID NO: 269935 - RNA, 64 nt, hsa
acauggaguugacauaauacuuuguaaauugaauuuuuuaaagaaauaggcauuugauaaccag

SEQ ID NO: 269936 - RNA, 64 nt, hsa
aaugcuaaaacuguagaagcccaaucaccagcaguuuuuaaaaaggugauaacuuuuauuagcu

SEQ ID NO: 269937 - RNA, 64 nt, hsa
agcagcuauuaugaaaucagcuuucauaggccuauuuuuaaaaggaaucugaaauuuaauucua

SEQ ID NO: 269938 - RNA, 64 nt, hsa
gcuucucauuuaaauaagagagaaaugaugccguuuuuuaaaugugaagcagacuauaauucuc

SEQ ID NO: 269939 - RNA, 64 nt, hsa
gugggaauauucagacaaaagaggccauuuuccauuuuuaaagcuucuuacuggugaaacagcc

SEQ ID NO: 269940 - RNA, 64 nt, hsa
gaagcaucuuauuuuauaguauaucaaccuuuuguuuuuaaauugaccugccaagguagcugaa

SEQ ID NO: 269941 - RNA, 64 nt, hsa
guagcugaagaccuuuuagacaguuccaucuuuuuuuuuaaauuuuuucugccuauuuaaagac

SEQ ID NO: 269942 - RNA, 64 nt, hsa
ugggagaugcuuucagguugcagccagaagggguuuuuuaaaugacuucucuggauuucagguu

SEQ ID NO: 269943 - RNA, 64 nt, hsa
gauugucugccauguuguugaagcaaaugaauuauuuuuaaauguuaaguaaguaaauaaaccu

SEQ ID NO: 269944 - RNA, 64 nt, hsa
ucuuuugagcuggagcugcaaggaaauacaaaaauuuuuaaaaagaaaagauauuggaugcucc

SEQ ID NO: 269945 - RNA, 64 nt, hsa
uggcacguuaugccuuucaguguuaacuccuuucuuuuuaaauaaauguuuauuggaggaaaaa

SEQ ID NO: 269946 - RNA, 64 nt, hsa
aaaauaacugacaacuguucuaauauuuugcuccuuuuuaaauuuuguagcucaaaagaccuua

SEQ ID NO: 269947 - RNA, 64 nt, hsa
cuugugaacaaguaauuuuauauugugcuuuaauuuuuuaaaaaguauucuuuauucauaugua

SEQ ID NO: 269948 - RNA, 64 nt, hsa
aguuacaauugcuuucauucgugaagccgaaacguuuuuaaacaugaauuacauaugaauuauu

SEQ ID NO: 269949 - RNA, 64 nt, hsa
aagagccuuaaaaguuaaaaacauuuucaguuuuuuuuuaaaaaacguacucuuauuaucugga

SEQ ID NO: 269950 - RNA, 64 nt, hsa
cguuaaguuaaacaaguuuucaaaaacaaaacaauuuuuaaaguaccuuaaaauugaggauguu

SEQ ID NO: 269951 - RNA, 64 nt, hsa
gaucuccauauuucaaaggaaaguuuuaaaaauguuuuuaaaacuucaaauaucucaccacagu

SEQ ID NO: 269952 - RNA, 64 nt, hsa
uacacuaaccgucaugugcuuuuaguaaauaugauuuuuaaaagcaguucaaguugacaacagc

SEQ ID NO: 269953 - RNA, 64 nt, hsa
uuaauggcaauuguuuagugauuguaagugauacuuuuuaaagaguaaacugugugaaauuuau

SEQ ID NO: 269954 - RNA, 64 nt, hsa
uuugaguuuuaucccguaaguucuguuuugauuuuuuuuaaaaaacaaacccuuuuagucacuu

SEQ ID NO: 269955 - RNA, 64 nt, hsa
uaaguuacaaaaagccaauugauguuucuuauucuuuuuaaauuuuaaauauuuuguuauaaau

SEQ ID NO: 269956 - RNA, 64 nt, hsa
uuauuucccuagcuaucaucuccugacuuaauguuuuuuaaacccaccaauauaaauuuaauua

SEQ ID NO: 269957 - RNA, 64 nt, hsa
uuuacaauaauguaaaaauuaaacuguuuacauuuuuuuaaagcauuguaguuuuuaaaaauua

SEQ ID NO: 269958 - RNA, 64 nt, hsa
auuaaacuguuuacauuuuuuuaaagcauuguaguuuuuaaaaauuaagcuguuuuguuuugug

SEQ ID NO: 269959 - RNA, 64 nt, hsa
aaguuucagaauuauuggucuucuggguuuuugcuuuuuaaaagaggugugggagcagaggaau

SEQ ID NO: 269960 - RNA, 64 nt, hsa
uuuugagcuagggaaaguuggagcuccuuuaaucuuuuuaaaggaucagugcugcccuaaguga

SEQ ID NO: 269961 - RNA, 64 nt, hsa
uguguauaaaaugacauugugggagcuguucgauuuuuuaaagguagugucuccugaugacaaa

SEQ ID NO: 269962 - RNA, 64 nt, hsa
guucugggauagagaugaagaccguccuugugacuuuuuaaagagguggggcucacugcaacug

SEQ ID NO: 269963 - RNA, 64 nt, hsa
uuaaaguuauaaacacguacuugugcgaauuauuuuuuuaaagugauuugccauuuuugaaagc

SEQ ID NO: 269964 - RNA, 64 nt, hsa
auuggcaagaaaagaagaauaguuguuuaaauauuuuuuaaaaaacacuugaauaagaaucagu

SEQ ID NO: 269965 - RNA, 64 nt, hsa
uaaaguuuucuacaaggggagaaaaguguuaaaauuuuuaaaauauguuuuccaggacacuuca

SEQ ID NO: 269966 - RNA, 64 nt, hsa
uuaguuggcuuuugaaucgauuauuucaugcuuuuuuuuaaaaaaaaaaaaaaacaaaauaaca

SEQ ID NO: 269967 - RNA, 64 nt, hsa
uuacaauuuuuucaucuaaaaguauuuuaagauauuuuuaaaauccaagagcuucucuauacuu

SEQ ID NO: 269968 - RNA, 64 nt, hsa
auagaaaagcaugaguguucaugcuuuaaaaugauuuuuaaauuuguauuuuauauuguuuuau

SEQ ID NO: 269969 - RNA, 64 nt, hsa
cuuuuguaaauuaucaagcuucaaaaagcuuuuuuuuuuaaaaaaaaacaugcauauucuaaaa

SEQ ID NO: 269970 - RNA, 64 nt, hsa
uucauaauuaucacuaauaagcaucaguuuguuguuuuuaaaaggauauuuaagugagcauuuu

SEQ ID NO: 269971 - RNA, 64 nt, hsa
uaguugaauuauuaagccaccacaauaaagcagauuuuuaaauaagaaauaauaauguuaacuu

SEQ ID NO: 269972 - RNA, 64 nt, hsa
guggaaaauuacacugugcuuaaugacugauuuuuuuuuaaacugcgagucccuuaagaucacg

SEQ ID NO: 269973 - RNA, 64 nt, hsa
agcaaaagaaaaaguguucuagaguguuguugcuuuuuuaaaaaaagcgcugaaguuagaccaa

SEQ ID NO: 269974 - RNA, 64 nt, hsa
caaacccuguuaauuauagaauggaccaaauacauuuuuaaaagaaaacugagaccaaucagau

SEQ ID NO: 269975 - RNA, 64 nt, hsa
augaugcuaugggaaaaaaauugcaaaauauguauuuuuaaaguucaugauuuguaggcaaaga

SEQ ID NO: 269976 - RNA, 64 nt, hsa
acacaguugguaaguggguccauaacuggcaggauuuuuaaauuguauuuugcucaaaucuaug

SEQ ID NO: 269977 - RNA, 64 nt, hsa
cuccaaacucucuaaauaguagcuaacuuuuauuuuuuuaaaaugagucgugggguagugcuuc

SEQ ID NO: 269978 - RNA, 64 nt, hsa
uuccccuaauuuuccagagaagccuauuuuuauauuuuuaaaaaacugacagggcccaguuaaa

SEQ ID NO: 269979 - RNA, 64 nt, hsa
aaacugacagggcccaguuaaauaugauuugcauuuuuuaaauuugccaguuuuauuuucuaaa

SEQ ID NO: 269980 - RNA, 64 nt, hsa
gaaacuguaucaaaguuguacauauuuccaaacauuuuuaaaaugaaaaggcacucucguguuc

SEQ ID NO: 269981 - RNA, 64 nt, hsa
gcaugagaauauuuuuuuuuuuuaagugcgguaguuuuuaaacuguuuguuuuuaaacaaacua

SEQ ID NO: 269982 - RNA, 64 nt, hsa
uuuuuuuuaagugcgguaguuuuuaaacuguuuguuuuuaaacaaacuauagaacucuucauug

SEQ ID NO: 269983 - RNA, 64 nt, hsa
gaaauguuuuugaaguuaaauaaacaguauuacauuuuuaaaacucuucucuauuauaacaguc

SEQ ID NO: 269984 - RNA, 64 nt, hsa
uuuaaguauuuggagcuccauguacugauuacaguuuuuaaauuugaaauaaaugaccagcauc

SEQ ID NO: 269985 - RNA, 64 nt, hsa
aaguuuuacucugcaaugguccuuaaauuucuuuuuuuuaaauugccacugaggcaacccuagu

SEQ ID NO: 269986 - RNA, 64 nt, hsa
ugccaccauuuuuuccuuauauuuuugcuuaauuuuuuuaaauugucauuuaauucuuaaacug

SEQ ID NO: 269987 - RNA, 64 nt, hsa
uuguuuguacuaaaaugcaaaagcaagagugcaauuuuuaaaaucuagaaguuagggguuuugu

SEQ ID NO: 269988 - RNA, 64 nt, hsa
uuuuaaaaaugacaacauucacaaaauuuauuacuuuuuaaaaaauaacaugccuauuaacugg

SEQ ID NO: 269989 - RNA, 64 nt, hsa
auagauucugacaguguugugauucuguauaggauuuuuaaaaaugacaacauucacaaaauuu

SEQ ID NO: 269990 - RNA, 64 nt, hsa
caucuucaguuguguuugugaagguauuuuuugcuuuuuaaauacuggggaccgauaucacugu

SEQ ID NO: 269991 - RNA, 64 nt, hsa
gaaugagguaaaauggcauuagauggcucuauauuuuuuaaagcuauguaauuguucagcguca

SEQ ID NO: 269992 - RNA, 64 nt, hsa
acuuguauuggaaauuacauaccuuuuuuuuuuuuuuuuaaaggacuacagauuauuuuuaaug

SEQ ID NO: 269993 - RNA, 64 nt, hsa
ugcuaagccgcuucauucaugccuacacaauuuuuuuuuaaaagggaacuuuaguuaauuaagu

SEQ ID NO: 269994 - RNA, 64 nt, hsa
uuucaugaaguguucuuaccaguuuuugauaaauuuuuuaaauuauaggauagaauugucauuu

SEQ ID NO: 269995 - RNA, 64 nt, hsa
uauuggcauauucaaauuggcaguucuuuaugucuuuuuaaauuuucauuguacaguuuacaaa

SEQ ID NO: 269996 - RNA, 64 nt, hsa
uuuaacaccaacacuguaacauuuacgaauuauuuuuuuaaacuucaguuuuacugcauuuuca

SEQ ID NO: 269997 - RNA, 64 nt, hsa
uuaugugacgcuggaccuuuucuuuacccaaggauuuuuaaaacucagauuuaaaacaaggggu

SEQ ID NO: 269998 - RNA, 64 nt, hsa
cuuuacucuuucaugccauuuuauuucuuuuugauuuuuaaaucauucauucaauagauaccac

SEQ ID NO: 269999 - RNA, 64 nt, hsa
gcuuuuuuagauuuauugucccaugugggaugaguuuuuaaaugccacaagacauaauuuaaaa

SEQ ID NO: 270000 - RNA, 64 nt, hsa
cacugacaacgaaaguaaaguaaaguauuggauuuuuuuaaagggaacaugugaaugaauacac

SEQ ID NO: 270001 - RNA, 64 nt, hsa
gagauacgaauuucuauagacugacuuuuuccauuuuuuaaauguucaugucacauccuaauag

SEQ ID NO: 270002 - RNA, 64 nt, hsa
ucagccuucaguuuaaaaaaggaaaaggacuuuuuuuuuaaacuuuaagagcuaaauauucuaa

SEQ ID NO: 270003 - RNA, 59 nt, hsa
ccccuggugggcguccauagacacuauuguuuuuaaaccaggaaggcugacagaugaga

SEQ ID NO: 270004 - RNA, 64 nt, hsa
auucuuaguucauacccuuccagaauucucucucuuuuuaaaaccuagaugagauuaaccuguu

SEQ ID NO: 270005 - RNA, 64 nt, hsa
uacauuuuuuaaaaaccacaaaugagcaaagauuuuuuuaaaaccuuaaaugucuggccgggug

SEQ ID NO: 270006 - RNA, 64 nt, hsa
guuccacaaauaguaugugcucauuguaguacauuuuuuaaaaaccacaaaugagcaaagauuu

SEQ ID NO: 270007 - RNA, 64 nt, hsa
caucagaaucguuuguaaagcuuuuucuuuuuccuuuuuaaaaaguaaagcaauauauacacag

SEQ ID NO: 270008 - RNA, 64 nt, hsa
caccaucacacuuuaauuccaaucuguauauugcuuuuuaaaaguuaaguccauucuaauuacc

SEQ ID NO: 270009 - RNA, 64 nt, hsa
aauaauuuugucaaccaauacagaacaugagcccuuuuuaaaugugauuucccgucaucacagc

SEQ ID NO: 270010 - RNA, 64 nt, hsa
uucacuucaaauucuauccucuuugauacuugauuuuuuaaaaauacuguucagaaugcuuuaa

SEQ ID NO: 270011 - RNA, 64 nt, hsa
agaaauauugaauuuuuauuuuugaaguuuuuguuuuuuaaaagguuggggguguucagccacu

SEQ ID NO: 270012 - RNA, 64 nt, hsa
caaucaagaaacaaacaaaagcugaacacauuucuuuuuaaaaaaaggagacuguguuuggucc

SEQ ID NO: 270013 - RNA, 64 nt, hsa
cuguuuuguaauauauauaaggacuggaauuguguuuuuaaagaaaagcauucaaguaugacaa

SEQ ID NO: 270014 - RNA, 64 nt, hsa
ucaucauguucuuuuaccccaguuuccuuacauuuuuuuaaauuguuucagaguuuguuuuuuu

SEQ ID NO: 270015 - RNA, 64 nt, hsa
augccaaucuuccauauuaguuuuacuuuuuuuuuuuuuaaauagggcauaccauuucuuccug

SEQ ID NO: 270016 - RNA, 64 nt, hsa
cgcuuagugauccacugaucucuaaucagaaauauuuuuaaaaaauacaauuuagaucucugaa

SEQ ID NO: 270017 - RNA, 64 nt, hsa
uugcaagugacuauuugauuaacacauuaaaaauuuuuuaaaaauuuccccuuuaaguuaugau

SEQ ID NO: 270018 - RNA, 64 nt, hsa
ccaacucuuuuugcuguaggcuaggaauacacccuuuuuaaauuaacacacuguagauccuuuu

SEQ ID NO: 270019 - RNA, 64 nt, hsa
ugugguguuuuggauuuggagagaaauauuuuaauuuuuaaaugcaguuacaaauuauaaugua

SEQ ID NO: 270020 - RNA, 64 nt, hsa
ccuuuagcuguguuauuauagagcagaaauucuguuuuuaaaaauuagccuaagauauacuugu

SEQ ID NO: 270021 - RNA, 64 nt, hsa
cacauacacacaugcacauaugucaaauauaauuuuuuuaaaaauugaguggcacaucaaagaa

SEQ ID NO: 270022 - RNA, 64 nt, hsa
caugaacccucuacuuauaaacaaggguuugguguuuuuaaaguguguauacauacauacacau

SEQ ID NO: 270023 - RNA, 64 nt, hsa
aaaaaguauugucuauaaaauguuucuucaguacuuuuuaaaugcuguguauuggguguaaggu

SEQ ID NO: 270024 - RNA, 64 nt, hsa
uuagaguagguauuaaucuuauuguuuaaucuuuuuuuuaaaaaaacuggauauuucaaucuuu

SEQ ID NO: 270025 - RNA, 64 nt, hsa
uuuauguggcuguaaugacaaaagauacaaaagcuuuuuaaaauuuagaguagguauuaaucuu

SEQ ID NO: 270026 - RNA, 64 nt, hsa
aggugugagccacugcacccgaccgauacucacauuuuuaaacuuuuuuuuuaauuuuauuuug

SEQ ID NO: 270027 - RNA, 64 nt, hsa
auucuaggaauuuucagcaauacuaauauucucauuuuuaaacauuuuuuacauuuuauuuugu

SEQ ID NO: 270028 - RNA, 64 nt, hsa
uguaaaugagaugccaguaguguucaaaguuguauuuuuaaaagauaaauauuccuuuuuauac

SEQ ID NO: 270029 - RNA, 64 nt, hsa
cagugucuguacuacuguuguagaccuugguauuuuuuuaaacacuguuaacugaaauguuuug

SEQ ID NO: 270030 - RNA, 64 nt, hsa
acugaguagaaauugacuaaacuuugauuuccuuuuuuuaaaucguguugcauuugauuccuga

SEQ ID NO: 270031 - RNA, 64 nt, hsa
acaucgugacaaugagggcuuuuucuagcaaugauuuuuaaauuguguaaguuugacaguauuu

SEQ ID NO: 270032 - RNA, 64 nt, hsa
aucacauguucacacuuggguuuagggguguuuuuuuuuaaaaccaggcagguuagcuagccca

SEQ ID NO: 270033 - RNA, 64 nt, hsa
ccuuaucuggagagacguggaggugauuuucuuuuuuuuaaauuauuauuaagacagaauguga

SEQ ID NO: 270034 - RNA, 64 nt, hsa
aguuaucacuuuucuaccauccuagugacuuugcuuuuuaaaugaauggacaacaauguacagu

SEQ ID NO: 270035 - RNA, 64 nt, hsa
augagaauguagccuuugugaccagauuauauuauuuuuaaaugaagaagcacucauuaaauaa

SEQ ID NO: 270036 - RNA, 64 nt, hsa
gagcauaucagagaggcaaauucuuaaagaaugauuuuuaaaaucagcucuaggaagagcucaa

SEQ ID NO: 270037 - RNA, 64 nt, hsa; identical to SEQ ID NO: 269952

SEQ ID NO: 270038 - RNA, 64 nt, hsa
uuaauggcaauuguuuagugacuguaagugauacuuuuuaaagaguaaacugugugaaauuuau

SEQ ID NO: 270039 - RNA, 64 nt, hsa
uuggggacaacaucugaaggguauguugcaugcauuuuuaaaaaaaucaucucauaugcauugu

SEQ ID NO: 270040 - RNA, 64 nt, hsa
acuguggagaguuucuguuaggaaaagccauacauuuuuaaaaauguagcaaaaugucaaggga

SEQ ID NO: 270041 - RNA, 64 nt, hsa
ggaagauccgcagauucaugcagcauuccauauuuuuuuaaaaaaagguuacacugugcaccga

SEQ ID NO: 270042 - RNA, 64 nt, hsa
agacugaaagaauguuaagauuuaucugcaaggauuuuuaaaaaauugaaacuugcauuuuaag

SEQ ID NO: 270043 - RNA, 64 nt, hsa
aguguuuaaaagcaaauacugacuuucaaaaaaguuuuuaaaaccugauuugaaagcuaacaau

SEQ ID NO: 270044 - RNA, 64 nt, hsa
augauuuaucuagaaauuuaccucaaaagcagaauuuuuaaaacugcauuuuuaaucaguggaa

SEQ ID NO: 270045 - RNA, 64 nt, hsa
uaguaguuaggauaacuaaaauucugggccuaauuuuuuaaagaauccaagacaaacuaaacuu

SEQ ID NO: 270046 - RNA, 64 nt, hsa; identical to SEQ ID NO: 270042

SEQ ID NO: 270047 - RNA, 64 nt, hsa; identical to SEQ ID NO: 270043

SEQ ID NO: 270048 - RNA, 64 nt, hsa; identical to SEQ ID NO: 270044

SEQ ID NO: 270049 - RNA, 64 nt, hsa; identical to SEQ ID NO: 270045

SEQ ID NO: 270050 - RNA, 64 nt, hsa
ugguaucugccagucucuucaacccucuucucacuuuuuaaaaucuuguuccaugccuccaggu

SEQ ID NO: 270051 - RNA, 64 nt, hsa
agaugaagguuuaaauauuguugaaaguugcaguuuuuuaaauguguuccuuuuucuucuguga

SEQ ID NO: 270052 - RNA, 64 nt, hsa
aacuguuccuuggucuauuuauguauaagaaugcuuuuuaaagcacaugucucauuuuaaauga

SEQ ID NO: 270053 - RNA, 64 nt, hsa
uaaccucuuuuagagaacaaauaagugacuuauuuuuuuaaagcuagaugacuuugaaaugcua

SEQ ID NO: 270054 - RNA, 64 nt, hsa
ggugccuauuauaaaguauuacggaaguuugcuguuuuuaaaguaaaugucuuuuagugugauu

SEQ ID NO: 270055 - RNA, 64 nt, hsa
ccaugaugauuacauuugugguuccaaaauaauuuuuuuaaauauuaauagcccauauacaaag

SEQ ID NO: 270056 - RNA, 64 nt, hsa; identical to SEQ ID NO: 226265

SEQ ID NO: 270057 - RNA, 64 nt, hsa; identical to SEQ ID NO: 226266

SEQ ID NO: 270058 - RNA, 64 nt, hsa; identical to SEQ ID NO: 226267

SEQ ID NO: 270059 - RNA, 64 nt, hsa; identical to SEQ ID NO: 226268

SEQ ID NO: 270060 - RNA, 64 nt, hsa; identical to SEQ ID NO: 226269

SEQ ID NO: 270061 - RNA, 64 nt, hsa; identical to SEQ ID NO: 226270

SEQ ID NO: 270062 - RNA, 64 nt, hsa; identical to SEQ ID NO: 226271

SEQ ID NO: 270063 - RNA, 64 nt, hsa; identical to SEQ ID NO: 226272

SEQ ID NO: 270064 - RNA, 64 nt, hsa; identical to SEQ ID NO: 226273

SEQ ID NO: 270065 - RNA, 64 nt, hsa; identical to SEQ ID NO: 226274

SEQ ID NO: 270066 - RNA, 64 nt, hsa; identical to SEQ ID NO: 226275

SEQ ID NO: 270067 - RNA, 64 nt, hsa; identical to SEQ ID NO: 226276

SEQ ID NO: 270068 - RNA, 64 nt, hsa; identical to SEQ ID NO: 226277

SEQ ID NO: 270069 - RNA, 64 nt, hsa; identical to SEQ ID NO: 226278

SEQ ID NO: 270070 - RNA, 64 nt, hsa; identical to SEQ ID NO: 226279

SEQ ID NO: 270071 - RNA, 64 nt, hsa; identical to SEQ ID NO: 226280

SEQ ID NO: 270072 - RNA, 64 nt, hsa; identical to SEQ ID NO: 226281

SEQ ID NO: 270073 - RNA, 64 nt, hsa; identical to SEQ ID NO: 226282

SEQ ID NO: 270074 - RNA, 64 nt, hsa; identical to SEQ ID NO: 226283

SEQ ID NO: 270075 - RNA, 64 nt, hsa; identical to SEQ ID NO: 226284

SEQ ID NO: 270076 - RNA, 64 nt, hsa; identical to SEQ ID NO: 226285

SEQ ID NO: 270077 - RNA, 64 nt, hsa; identical to SEQ ID NO: 226286

SEQ ID NO: 270078 - RNA, 64 nt, hsa; identical to SEQ ID NO: 226287

SEQ ID NO: 270079 - RNA, 64 nt, hsa; identical to SEQ ID NO: 226288

SEQ ID NO: 270080 - RNA, 64 nt, hsa; identical to SEQ ID NO: 226289

SEQ ID NO: 270081 - RNA, 64 nt, hsa; identical to SEQ ID NO: 226290

SEQ ID NO: 270082 - RNA, 64 nt, hsa; identical to SEQ ID NO: 226291

SEQ ID NO: 270083 - RNA, 64 nt, hsa; identical to SEQ ID NO: 226292

SEQ ID NO: 270084 - RNA, 64 nt, hsa; identical to SEQ ID NO: 226293

SEQ ID NO: 270085 - RNA, 64 nt, hsa; identical to SEQ ID NO: 226294

SEQ ID NO: 270086 - RNA, 64 nt, hsa; identical to SEQ ID NO: 226295

SEQ ID NO: 270087 - RNA, 64 nt, hsa; identical to SEQ ID NO: 226296

SEQ ID NO: 270088 - RNA, 64 nt, hsa; identical to SEQ ID NO: 226297

SEQ ID NO: 270089 - RNA, 64 nt, hsa; identical to SEQ ID NO: 226298

SEQ ID NO: 270090 - RNA, 64 nt, hsa; identical to SEQ ID NO: 226299

SEQ ID NO: 270091 - RNA, 64 nt, hsa; identical to SEQ ID NO: 226300

SEQ ID NO: 270092 - RNA, 64 nt, hsa; identical to SEQ ID NO: 226301

SEQ ID NO: 270093 - RNA, 64 nt, hsa; identical to SEQ ID NO: 226302

SEQ ID NO: 270094 - RNA, 64 nt, hsa; identical to SEQ ID NO: 226303

SEQ ID NO: 270095 - RNA, 64 nt, hsa; identical to SEQ ID NO: 226304

SEQ ID NO: 270096 - RNA, 64 nt, hsa; identical to SEQ ID NO: 226305

SEQ ID NO: 270097 - RNA, 64 nt, hsa; identical to SEQ ID NO: 226306

SEQ ID NO: 270098 - RNA, 64 nt, hsa; identical to SEQ ID NO: 226307

SEQ ID NO: 270099 - RNA, 64 nt, hsa; identical to SEQ ID NO: 226308

SEQ ID NO: 270100 - RNA, 64 nt, hsa; identical to SEQ ID NO: 226309

SEQ ID NO: 270101 - RNA, 64 nt, hsa; identical to SEQ ID NO: 226310

SEQ ID NO: 270102 - RNA, 64 nt, hsa; identical to SEQ ID NO: 226311

SEQ ID NO: 270103 - RNA, 64 nt, hsa; identical to SEQ ID NO: 226312

SEQ ID NO: 270104 - RNA, 64 nt, hsa; identical to SEQ ID NO: 226313

SEQ ID NO: 270105 - RNA, 64 nt, hsa
cugccucugaggaaagauacagggaacaaaaaucaauuuguacagucuuaauauuaaaagcagc

SEQ ID NO: 270106 - RNA, 64 nt, hsa
caugauggcgguugugcaauucugguauccucuaaauuuguaagcauucauaaaacaggaaaaa

SEQ ID NO: 270107 - RNA, 64 nt, hsa
agaugugaugaggauuaaaugaaucaaaagacuuaauuuguagauucuuuuagaguuaugagcu

SEQ ID NO: 270108 - RNA, 64 nt, hsa
ugccauaaucuuaaaaaaaauuugaaugcucuugaauuuguauauucaauaaaguuauccuuuu

SEQ ID NO: 270109 - RNA, 64 nt, hsa
cucuacugucucuaacauuuguaaaccugucucuaauuuguaauuuguaaacccugucucucau

SEQ ID NO: 270110 - RNA, 64 nt, hsa
gucucuaacauuuguaaaccugucucuaauuuguaauuuguaaacccugucucucauauuugua

SEQ ID NO: 270111 - RNA, 64 nt, hsa
aguuacuaauucuuuugagaacuccuaagagaccaauuuguaagacuuauuuaguauuucauuu

SEQ ID NO: 270112 - RNA, 64 nt, hsa
ucugaaguuuggagugauaauuuuuaguggaagcaauuuguaauuuaaguugguaguuauauua

SEQ ID NO: 270113 - RNA, 64 nt, hsa
gaauuuucaggagagaucauucugauaucuugcaaauuuguauuaaauguauacagacuuccaa

SEQ ID NO: 270114 - RNA, 64 nt, hsa
cuuccuaaauguuuauacucaucuaguuuuucucaauuuguaguuuuauuaugcaguuaaaucu

SEQ ID NO: 270115 - RNA, 64 nt, hsa
uacugcuuuuauggcaguuuauaauauaggaacaaauuuguacuuggggauugguaaagauugu

SEQ ID NO: 270116 - RNA, 64 nt, hsa
gaaaaaauaaaacuaccuacgaaauacuaagaaaaauuuguauacuaauauuaagaaauuguug

SEQ ID NO: 270117 - RNA, 64 nt, hsa
aaugaagaaggaauaaaagaaauaggaagccacaaauuuguauggauauuucaugauacaccua

SEQ ID NO: 270118 - RNA, 64 nt, hsa
uauaauagaucagcgauuuuuguaaggcaaacagaauuuguaaguuggcagaucuuccuaaguu

SEQ ID NO: 270119 - RNA, 64 nt, hsa
acauugggugagacagaaaaugaaucuguucuaaaauuuguaauuugcuaacuugauuugaguu

SEQ ID NO: 270120 - RNA, 64 nt, hsa
acuuuuauguuccuuucuguuucuacuguagaugaauuuguaauugaaagacauauuauacaaa

SEQ ID NO: 270121 - RNA, 64 nt, hsa
cuugugucugaguucuauuuaguuagcaucuugaaauuuguauucauuuuccagauggcuaguu

SEQ ID NO: 270122 - RNA, 64 nt, hsa
guuuccuauaccuuuacccuuuaccuaacagacuaauuuguacucaguaaaacaaaaauuuaug

SEQ ID NO: 270123 - RNA, 64 nt, hsa
ucuuuauaauuuuguuugucagauaguauuuuggaauuuguauaauaaggauguuuagaagcca

SEQ ID NO: 270124 - RNA, 64 nt, hsa
agaagccauauaaguggcuuuuuuuaacagauagaauuuguauuuuuauuguacuuuaaaaaga

SEQ ID NO: 270125 - RNA, 64 nt, hsa
cuacuaauuucuuugcagcuuauuaauuuugugaaauuuguauauaugaagaauuugcauguau

SEQ ID NO: 270126 - RNA, 64 nt, hsa
aaucacuuucuuccucaaaauaaguccuucuguuaauuuguaaaagcacauuagugcuuuaccu

SEQ ID NO: 270127 - RNA, 64 nt, hsa
ugaacuagaucuugccgugcucuguauugaguauaauuuguauacuuuuuuauaauuaaugacu

SEQ ID NO: 270128 - RNA, 64 nt, hsa
cauauuccaauucacuuuuaaaaaauaccauuugaauuuguauuucauaaagugacucuggggu

SEQ ID NO: 270129 - RNA, 64 nt, hsa
uuuguauuuaugauuaauaaaaguucauuuuuuaaauuuguauuuuuauacaaccuccaaaaaa

SEQ ID NO: 270130 - RNA, 64 nt, hsa
cucuuugaguaaguugaaguuuaauugugcaacaaauuuguauuagaguacaauuuaaaguguu

SEQ ID NO: 270131 - RNA, 64 nt, hsa
uuuacugguuguuccauuccugaauaugcaggcuaauuuguacagauagggauuaaggaauaca

SEQ ID NO: 270132 - RNA, 64 nt, hsa
uuuugcaagcuucuuuuuacuuugaguagcuuuuaauuuguauguuuuuauguggaugaagagc

SEQ ID NO: 270133 - RNA, 64 nt, hsa
uaaguagauuagaaaaucauucaaaugauaccauaauuuguacgggacagggugcgggcaaugg

SEQ ID NO: 270134 - RNA, 64 nt, hsa
agugcuauaucuccuauauuguauuuuuguagaaaauuuguauuuuauguuguuguuaguuuaa

SEQ ID NO: 270135 - RNA, 64 nt, hsa
uuuugaauaucauccauaugucugacauuauuggaauuuguaacauuguuaaugcacuaaguga

SEQ ID NO: 270136 - RNA, 64 nt, hsa
gugauuuccagccuuuacugcuuugaagaaacagaauuuguaaagguaugcauguagaacauaa

SEQ ID NO: 270137 - RNA, 64 nt, hsa
augucuguuggauucuuuuuggauuucuuuaauuaauuuguaaguaaccaagauaauuauuuuc

SEQ ID NO: 270138 - RNA, 64 nt, hsa
cagaaucuccagaacaaccuagagagugaaugcuaauuuguagagcgaacuuccauuuggccca

SEQ ID NO: 270139 - RNA, 64 nt, hsa
uucugauuucuccaauaguauaugccacuauauaaauuuguauuaauaaaugacagucuuguug

SEQ ID NO: 270140 - RNA, 64 nt, hsa
auuuguuuuuauuucaacaauuggaaaaauuaccaauuuguacauuuuaauuauucaauuucua

SEQ ID NO: 270141 - RNA, 64 nt, hsa
agugauaaacuuuguagcugccucuuuaaccaagaauuuguaaacacaacucuaauaaauguga

SEQ ID NO: 270142 - RNA, 64 nt, hsa
gugcagugcacugugaaucuuuuauuuuuaaaaaaauuuguaggugcuuuuauguauaacuuua

SEQ ID NO: 270143 - RNA, 64 nt, hsa
uugaauugguacuuuuccuuauuaaggcuuuaguaauuuguauguaaugucaaauaaaaggaau

SEQ ID NO: 270144 - RNA, 64 nt, hsa
uguuauuuguacaguucaguuccucuuugcauggaauuuguaaguuuaugucuaaagagcuuua

SEQ ID NO: 270145 - RNA, 64 nt, hsa
auucaaguauuagggguaauauauugcugcugguaauuuguaucugaaggagauuuuccuuccu

SEQ ID NO: 270146 - RNA, 64 nt, hsa
accuauaaauaaaauucagcauucuauuuuuaauaauuuguaugccaccaauuuguauuauuug

SEQ ID NO: 270147 - RNA, 64 nt, hsa
ucagcauucuauuuuuaauaauuuguaugccaccaauuuguauuauuugucucaauaaauacuu

SEQ ID NO: 270148 - RNA, 64 nt, hsa
uauuccuuaguauuaauuuaucucauugggaagaaauuuguaguuaaaacuauuuaauguaauu

SEQ ID NO: 270149 - RNA, 64 nt, hsa
gaugcaugcaauggaaagaaaaaaaauuuguuaaaauuuguaaauguucagcuaaaucucagau

SEQ ID NO: 270150 - RNA, 64 nt, hsa
guaaaucaaacaugauugauuuaaaacuucauggaauuuguagaaaauuauggacauuuuuggu

SEQ ID NO: 270151 - RNA, 64 nt, hsa
gccuacugugauuuuuuucauguggaaaaugcaaaauuuguaacaaaaugguuauauggaacau

SEQ ID NO: 270152 - RNA, 64 nt, hsa
uaguuuaaauuaggguauguuucaaguuuguauuaauuuguaauagcucuguuuagaaaaaauc

SEQ ID NO: 270153 - RNA, 64 nt, hsa
uuaacuguagaucaugcaugugauuguaaauguaaauuuguacaauguuguuaugguagagaaa

SEQ ID NO: 270154 - RNA, 64 nt, hsa
aauucauuugcuuauuuuuucuguuuuuggaaauaauuuguaauaaaaaucauggcaacauaau

SEQ ID NO: 270155 - RNA, 64 nt, hsa
aaauuaaaauuuccacaagcauugcuucagaaugaauuuguaccuauaaagcauaaggcauuaa

SEQ ID NO: 270156 - RNA, 64 nt, hsa
uguggaacauaacuguucuuaaaaagucaauuauaauuuguaacucacauccuuugagcuaaac

SEQ ID NO: 270157 - RNA, 64 nt, hsa
uuuaauaauucuuugggcauuuuuaagaggucugaauuuguauuuuucuucauuuuugaaacuu

SEQ ID NO: 270158 - RNA, 64 nt, hsa
ucuacuuuccauuuuucaaguggauuguucucuuaauuuguauauaaccuguugucuaaauuuu

SEQ ID NO: 270159 - RNA, 64 nt, hsa
aaacaagcaaaaagagaauuaucuguaauguuguaauuuguaccuaaguuuuuuaaugagugaa

SEQ ID NO: 270160 - RNA, 64 nt, hsa
agcuuucaagaaaaauuaaaacuuuucauuagaaaauuuguacugaggggaauucuauucaucu

SEQ ID NO: 270161 - RNA, 64 nt, hsa
aaaaggagaucagagaaagccaaagaaugucagaaauuuguagaaaaugacuucuuguuugaau

SEQ ID NO: 270162 - RNA, 64 nt, hsa
aaguauuucauguuucagaaaugaugcauacagcaauuuguaggugggugguuuuuugcaguau

SEQ ID NO: 270163 - RNA, 64 nt, hsa
aaauauuuggaagguguucaauaaaaauucaaauaauuuguacugagggaaacaguuauacuac

SEQ ID NO: 270164 - RNA, 64 nt, hsa
acaaaagauuguucacaacaucucauguaguuuaaauuuguaaauacugcuucuguuuuguuuc

SEQ ID NO: 270165 - RNA, 64 nt, hsa
uucuugcaguugugaguuauuuagaaaugaucaaaauuuguaauuaggcuaauccauuuaguga

SEQ ID NO: 270166 - RNA, 64 nt, hsa
guacaauguggucccucucaauauuuaaaaauauaauuuguaacagugcuuaccauucaccucc

SEQ ID NO: 270167 - RNA, 64 nt, hsa
ggcagaugcuuagcuacuucuuuggcuaccucauaauuuguaugggaaugaacaugaauuaggg

SEQ ID NO: 270168 - RNA, 64 nt, hsa
ucuacgaaaauauuguucauacugaucagaauuaaauuuguauagagcagaguuuuaaaaugaa

SEQ ID NO: 270169 - RNA, 64 nt, hsa
uaucagcaaauugaaauuuuccauaauuaucauuaauuuguaaccacauccagugucaugcuua

SEQ ID NO: 270170 - RNA, 64 nt, hsa
cauuaaaagaaacuuacugcacaagcugcuaauaaauuuguaagcuuugcauaccuuagauuau

SEQ ID NO: 270171 - RNA, 64 nt, hsa
uaauuucuuuaaauguguauuucuuaagaauucaaauuuguaauaaaacuauuuguauaaaaau

SEQ ID NO: 270172 - RNA, 64 nt, hsa
auaaauuauguaucaucauucauguaguaucuauaauuuguaacagugggggggaaagaugaca

SEQ ID NO: 270173 - RNA, 64 nt, hsa
uuugagaaaacacuggauuuaaauaauuuuaaauaauuuguagcuuaauauuaaagauuuaagu

SEQ ID NO: 270174 - RNA, 64 nt, hsa
ugcuuucaauugauggacuacucuauuuuuugcaaauuuguaaacuuugcuucuccaaauacaa

SEQ ID NO: 270175 - RNA, 64 nt, hsa
ucaucauaucauagguacaaucuuucaccaaguaaauuuguauaaauaagcacuauucuuugua

SEQ ID NO: 270176 - RNA, 64 nt, hsa
ccugauccucaaggaacuugcaaaugugucuaugaauuuguaaaacaaucaaaaguaggcguaa

SEQ ID NO: 270177 - RNA, 64 nt, hsa
uguuuaaaauaaccaaagaguuguuauaaugcauaauuuguauuaaauuuauuacuauuucuua

SEQ ID NO: 270178 - RNA, 64 nt, hsa
gcuuacagaaaaugucaguguuucuuacagcucaaauuuguauaguuguuuuaaaaugcggucu

SEQ ID NO: 270179 - RNA, 64 nt, hsa
auuuguaguuaaauuugaccucaauugacuacaaaauuuguaguuaaauuugacuacaauugga

SEQ ID NO: 270180 - RNA, 64 nt, hsa
uuuaagaaucauguguucaauguagacaaugcaaaauuuguaguuaaauuugaccucaauugac

SEQ ID NO: 270181 - RNA, 64 nt, hsa
gcuuauagaaaaugucaguguuucuuacagcucaaauuuguauaguuguuuuaaaaugcggucu

SEQ ID NO: 270182 - RNA, 64 nt, hsa
uuuaagaaucauguguucaauguagacaaugcaaaauuuguaguuaaauuugaccucagugccc

SEQ ID NO: 270183 - RNA, 64 nt, hsa
cuucuucaaagagcuuugggaaauuaaauugcuaaauuuguauucucugugaauuucacuggca

SEQ ID NO: 270184 - RNA, 64 nt, hsa
uuuaaaugaaguugaauaguaguuuuuaaaagucaauuuguaauuuaugugaaaucuaacugua

SEQ ID NO: 270185 - RNA, 64 nt, hsa
auguuaggguauaaguugcuguaaaauuuguguaaauuuguauccacacaaauucagucucuga

SEQ ID NO: 270186 - RNA, 64 nt, hsa
aaaacauuuaaacuuuuuaaaauacuuauuaaaaaauuuguauaagccacuugucuugaaaacu

SEQ ID NO: 270187 - RNA, 64 nt, hsa
cuaauaaaucagugaacuguuccucauguugcugaauuuguaguuguugguuuauuuuaauggu

SEQ ID NO: 270188 - RNA, 64 nt, hsa
uuuaccuucagaucuaaaugguaaucugaacccaaauuuguauaaagacuuuucaggugaaaag

SEQ ID NO: 270189 - RNA, 64 nt, hsa
uccuuaaaauuaaaaaccuacaaaaguugguguaaauuuguauauguuauuuaccuucagaucu

SEQ ID NO: 270190 - RNA, 64 nt, hsa
auacuuacauacuuauauggguaucuguauagauaauuuguauuagaguauuauauagcuucuu

SEQ ID NO: 270191 - RNA, 64 nt, hsa
aggcagcuauuuuaccaucugguauuuauggucuaauuuguauuuaaacauaugcacacauaua

SEQ ID NO: 270192 - RNA, 64 nt, hsa
agggagaaaaguucuuagcacaaauguuuuacauaauuuguaccaaaaaaaaaaaaaaaggaaa

SEQ ID NO: 270193 - RNA, 64 nt, hsa
gcugguugcaaauaaagggaguuuucauaucaccaauuuguagcaaaauugaauuuuuucauaa

SEQ ID NO: 270194 - RNA, 64 nt, hsa
uacgauggccuuuagaaaaugcccuuuagcagagaauuuguaauuuaagaaauuuucuguuugu

SEQ ID NO: 270195 - RNA, 64 nt, hsa
auucaugugagaggaaggcccuguggguguaagaaauuuguaaaaacuguccauuaccuuucac

SEQ ID NO: 270196 - RNA, 64 nt, hsa
ugauuuugaaauuaucaauuauggaauagcaaacaauuuguaagugaagaaaauccagugacug

SEQ ID NO: 270197 - RNA, 64 nt, hsa
uuaccugucccucagcuauacuuuuucauaacagaauuuguacaggugagaagccuaaugaaag

SEQ ID NO: 270198 - RNA, 64 nt, hsa
gagauuuauggugcuugaaauguugcuaaacguaaauuuguaucuauucugaaauuauauaaau

SEQ ID NO: 270199 - RNA, 64 nt, hsa
ggauauggaaaacauuuuucguaaaauaugggagaauuuguagaaaagaaaaacucuugaaagu

SEQ ID NO: 270200 - RNA, 64 nt, hsa
aaaaaaugguuaugaaauaauguuccaauuauuaaauuuguauuaucccagugguauucaauaa

SEQ ID NO: 270201 - RNA, 64 nt, hsa
cugaacacaauucuauauuuuaguauuuuuuaguaauuuguacuguauuuuccuugcaaauauu

SEQ ID NO: 270202 - RNA, 64 nt, hsa
uuucuaccuuauuccaauacuauauuguugauaaaauuuguauauacauuuucaauaaagaaua

SEQ ID NO: 270203 - RNA, 64 nt, hsa
guaguccauuauuacuugggucuuuacuucugggaauuuguauguaacagccuagaaaauuaaa

SEQ ID NO: 270204 - RNA, 64 nt, hsa
auuuuuuuucuuagaaguagucuucauuauuauaaauuuguacaccaaaaggccauggggaacu

SEQ ID NO: 270205 - RNA, 64 nt, hsa
uuguuccaagaaaugugccuacugaaaucaaauuaauuuguauucaauguguacuucaagacug

SEQ ID NO: 270206 - RNA, 64 nt, hsa
uauaugcaauacuacuuggaggaauucuucuacuaauuuguauuuaauguggaaauuguauagu

SEQ ID NO: 270207 - RNA, 64 nt, hsa
cguuuucagaaccuggguuuuaauagcaguauugaauuuguaagcuuaguaguugcagaaauug

SEQ ID NO: 270208 - RNA, 64 nt, hsa; identical to SEQ ID NO: 270202

SEQ ID NO: 270209 - RNA, 64 nt, hsa; identical to SEQ ID NO: 270203

SEQ ID NO: 270210 - RNA, 64 nt, hsa
ugccuuugaccugccucccuucaugcauggaaauucccuucaucuggaaccaucagaaacaccc

SEQ ID NO: 270211 - RNA, 64 nt, hsa
uggcaggugcagcccccacugccuuugaccugccucccuucaugcauggaaauucccuucaucu

SEQ ID NO: 270212 - RNA, 64 nt, hsa
uuuggggauugcucaaccaucaagacugcaggucucccuucagccaccuccuuccugcuaaaag

SEQ ID NO: 270213 - RNA, 64 nt, hsa
gauaauaucuuugaugacuucugaaaguuaugcuucccuucauguuauaugcacauugccaaga

SEQ ID NO: 270214 - RNA, 64 nt, hsa
agacuccugggcccuuggauacucuucucccaucucccuucacaggaugacacccucccauacc

SEQ ID NO: 270215 - RNA, 64 nt, hsa
cugguguagggacccccaagagaccccuguccugucccuucaccaguccuggggaggcugggac

SEQ ID NO: 270216 - RNA, 64 nt, hsa
gccagccccccagaguguucugccuugugcugccucccuucaccuggagugccacaccccucuc

SEQ ID NO: 270217 - RNA, 64 nt, hsa
ccuacggcagcagcuguucauggcacugaagaugucccuucacugucccaaaacuggcacuaga

SEQ ID NO: 270218 - RNA, 64 nt, hsa
caggggcuucucccccucagcucucccucacaccucccuucaucccaggguauccaccugcacc

SEQ ID NO: 270219 - RNA, 64 nt, hsa
cccaccuggagagacauggccccugccaagcuggucccuucaaauggauccuuuguggacuuua

SEQ ID NO: 270220 - RNA, 64 nt, hsa
cagggaggaggggagugaggguaacauuuccauuucccuucauguuuuguuucuuacguucuuu

SEQ ID NO: 270221 - RNA, 64 nt, hsa
gcccucaguguuggcucugcagaagcucugggguucccuucaagugcacgagggguuaggcugc

SEQ ID NO: 270222 - RNA, 64 nt, hsa
ugcauuugccuucuucugccaccuaaauauuacuucccuucaaaucugccuuugaaucaucauu

SEQ ID NO: 270223 - RNA, 64 nt, hsa
guaacuuuauuuuuuagguaauaauuagaacaguucccuucagaggcugcauuugccuucuucu

SEQ ID NO: 270224 - RNA, 64 nt, hsa
uuggcccccugcuuuuccugcucagcagagccccucccuucagagauuacggguacuugcacug

SEQ ID NO: 270225 - RNA, 64 nt, hsa
guuccucccuccuuuucucuucucccaaaucuuuucccuucaaaggaaaaaaaaauguucagag

SEQ ID NO: 270226 - RNA, 64 nt, hsa
uguuuuuccccuccacucagaaaccccugcccuuucccuucagaaaacgauggcaggcauuccu

SEQ ID NO: 270227 - RNA, 64 nt, hsa
agcccauucucugaccccaaggaguggcagaagaucccuucacucagagaagcaaggcugauau

SEQ ID NO: 270228 - RNA, 64 nt, hsa
ggguucuauccuuuggugcagccccauugccuuuucccuucaggcucuguugcucccuccucug

SEQ ID NO: 270229 - RNA, 64 nt, hsa
acagcuggccuugccccguccacccugugcugcuucccuucacagcauuaaccuuccagucugg

SEQ ID NO: 270230 - RNA, 64 nt, hsa
agaccuuuguagcuccuccagccucugcagagacucccuucaccucgcacuuacugccugggaa

SEQ ID NO: 270231 - RNA, 64 nt, hsa
ucaggccacacucaagggcugacuguccaggcgcucccuucagccgccucgucgucagcguucu

SEQ ID NO: 270232 - RNA, 64 nt, hsa
auuguugcaguguucaguuuccuugggggccugcucccuucacaccuugagcccaaguccuuuu

SEQ ID NO: 270233 - RNA, 64 nt, hsa
ccuccuggaaacugggagcuaagggcgaggcccuucccuucagaggcuccugggggauuagggu

SEQ ID NO: 270234 - RNA, 64 nt, hsa
ucaugucacuagauacacaacccccuucccaccaucccuucagucacuaguggaagcuuucaag

SEQ ID NO: 270235 - RNA, 64 nt, hsa
uucucucuuaacgccacuggugauaggaaguaguucccuucaguucaaauccugugcccuuauu

SEQ ID NO: 270236 - RNA, 64 nt, hsa
cuucccuuucccuuucuuccugacuagccccaagucccuucauuugcaucugcuaugcaauagu

SEQ ID NO: 270237 - RNA, 64 nt, hsa
uuuuccgguuguccuuaacaccccuuccugagguucccuucaccccucucucuugccuuccuuc

SEQ ID NO: 270238 - RNA, 64 nt, hsa
auguaaaugugggaaagccuuuagugaucuuuauucccuucaaaaucaugagacaacucauaug

SEQ ID NO: 270239 - RNA, 64 nt, hsa
uaaacaaugugggaaagccuucagugcuuccacuucccuucaaagacgugaaaccacucacagu

SEQ ID NO: 270240 - RNA, 64 nt, hsa
aacaaugaguggagaagucgucacgggucuuucaucccuucauugccacaucagaguugaugcu

SEQ ID NO: 270241 - RNA, 64 nt, hsa
ggaguuugcuucugauagggucagcuuucccauuucccuucaaugcuugggaaccuucucccuu

SEQ ID NO: 270242 - RNA, 64 nt, hsa
auccaagcugagccagagggaacugcugcuguccucccuucauuucuguggaccuuggaggcuu

SEQ ID NO: 270243 - RNA, 64 nt, hsa
aucaccugaauucagucuguuuggugucugcacagacuggaauucaaucugucaaauuuguuuu

SEQ ID NO: 270244 - RNA, 64 nt, hsa
aaagguagaaaagaaaagccaagaucauacuaaggacuggaaauauuuuguucuauggaaucaa

SEQ ID NO: 270245 - RNA, 64 nt, hsa
cuauuuaggacauuuaccaugaacaaguuggcaggacuggaagcuggcucugggugagucagua

SEQ ID NO: 270246 - RNA, 64 nt, hsa
ugguagaaaggcaaaaaguaggauauuuugaccugacuggaaagaugguuguguuuuuauugcc

SEQ ID NO: 270247 - RNA, 64 nt, hsa
agaucugguuuuuuggucaaagggaacauguucggacuggaaacauuucuuuacauuugcauuc

SEQ ID NO: 270248 - RNA, 64 nt, hsa
uccaaaggggcacccacauuuuuuugaaagacuggacuggaaucuuagcaaacaauuguaaguc

SEQ ID NO: 270249 - RNA, 64 nt, hsa; identical to SEQ ID NO: 164139

SEQ ID NO: 270250 - RNA, 64 nt, hsa; identical to SEQ ID NO: 164140

SEQ ID NO: 270251 - RNA, 64 nt, hsa; identical to SEQ ID NO: 164141

SEQ ID NO: 270252 - RNA, 64 nt, hsa; identical to SEQ ID NO: 164142

SEQ ID NO: 270253 - RNA, 64 nt, hsa; identical to SEQ ID NO: 164143

SEQ ID NO: 270254 - RNA, 64 nt, hsa; identical to SEQ ID NO: 164144

SEQ ID NO: 270255 - RNA, 64 nt, hsa; identical to SEQ ID NO: 164145

SEQ ID NO: 270256 - RNA, 64 nt, hsa; identical to SEQ ID NO: 164146

SEQ ID NO: 270257 - RNA, 64 nt, hsa; identical to SEQ ID NO: 164147

SEQ ID NO: 270258 - RNA, 64 nt, hsa; identical to SEQ ID NO: 164148

SEQ ID NO: 270259 - RNA, 62 nt, hsa
auauuaggacugaucagguguugucugccugauccaaucauuaucaaguuccauaauucauu

SEQ ID NO: 270260 - RNA, 62 nt, hsa
uccuuuauagcuguuuauuuuuaaauccaggauccaaucaagaauuauacguuauauguagu

SEQ ID NO: 270261 - RNA, 62 nt, hsa
ugcuuuccuuacccgagagguauuuugccuguuccaaucaaaccaccccauucagguccauc

SEQ ID NO: 270262 - RNA, 62 nt, hsa
agguaaaguugacuucuccucgugggcaguuuuccaaucaccuugugaguagacaccugcca

SEQ ID NO: 270263 - RNA, 62 nt, hsa
cuccaaucaguuuacuucauuucaaaacuauuuccaaucacaaggaaagauuuauuuaaaau

SEQ ID NO: 270264 - RNA, 62 nt, hsa
uggcauaauucacaaaagcagcugugacaaccuccaaucaguuuacuucauuucaaaacuau

SEQ ID NO: 270265 - RNA, 62 nt, hsa
gaucaagccuccugaauccccucauuacaagauccaaucauaucaugccucacuacccucug

SEQ ID NO: 270266 - RNA, 62 nt, hsa
aagaaguggacaccacguggcaugauccuugauccaaucagauugagcccuggcgugaucca

SEQ ID NO: 270267 - RNA, 64 nt, hsa
uugugauaauuaugauuauucugugccauuuacaguuucuaauacuauacuguaugaaauaugu

SEQ ID NO: 270268 - RNA, 64 nt, hsa
aacaaaauaacuaaagaaaugugagcuucccaagguuucuaaacuaucgcuguuguauauucua

SEQ ID NO: 270269 - RNA, 64 nt, hsa
gaaaugcagaguuggauaagaaauacauugcuggguuucuaaaaugcugccuuccugccucuac

SEQ ID NO: 270270 - RNA, 64 nt, hsa
auagacaggggcguauucaugggagcaucagccaguuucuaaaacccacaggccaucagcagcu

SEQ ID NO: 270271 - RNA, 64 nt, hsa
caguaugaguuaugagugcccuaauuugugguuaguuucuaauuuaauguuguuucauagaguu

SEQ ID NO: 270272 - RNA, 64 nt, hsa
agcauauaggaaacuccaaacagaucacaaugagguuucuaaaucuguuggguucugucuucua

SEQ ID NO: 270273 - RNA, 64 nt, hsa
ugucaaacucccucugccccguuaguuucaaaccguuucuaaagagauaaaaaucaaacuucuu

SEQ ID NO: 270274 - RNA, 64 nt, hsa
ggugaucagagggcgcguuuggguuugauggcgaguuucuaaaggcgaggaaaugguuuguaag

SEQ ID NO: 270275 - RNA, 64 nt, hsa
cuaaccucgauucuguguugugaugugcaauacuguuucuaauguuuguauaaaaaaaaacagu

SEQ ID NO: 270276 - RNA, 64 nt, hsa
uggagcugaaaucuuuguaauauuaaagcaacuaguuucuaauucccaguuucuguauagaauc

SEQ ID NO: 270277 - RNA, 64 nt, hsa
uucaagaauguuucacuggaauugaugggaaaugguuucuaaauggcaucgaagcuggucuuua

SEQ ID NO: 270278 - RNA, 64 nt, hsa
uuuuauuagcauaugugauuuuacccuuaucuuuguuucuaauuuaaagaaacaauuucagaaa

SEQ ID NO: 270279 - RNA, 64 nt, hsa
uaucuacugauuugggcugaauguauguaaauagguuucuaaaaagucagauguuugagcagug

SEQ ID NO: 270280 - RNA, 64 nt, hsa
uuuaccacuugcugcacucuugcacauggauucaguuucuaaaauugaguucuuccuguaaucu

SEQ ID NO: 270281 - RNA, 64 nt, hsa
auguuuggaaaugcguggaauuaggauucaugugguuucuaagauuuggacaugucagaauuuu

SEQ ID NO: 270282 - RNA, 64 nt, hsa
caaggauguaaacauucaguccauugcaauacguguuucuaacuuccuaagaaauugucacaca

SEQ ID NO: 270283 - RNA, 64 nt, hsa
auuacauuuuacuuuaaaaacuuuacacauuucaguuucuaaaauuuuaaauuaacaaaaauua

SEQ ID NO: 270284 - RNA, 64 nt, hsa
cucagacuuaacuguugccuugaauuacagccuaguuucuaagcagugaaauguaaugauaaag

SEQ ID NO: 270285 - RNA, 64 nt, hsa
augaaauuaccaagaugacaaugucuuuucuuuuguuucuaaguaucaguuugauaacuuuaua

SEQ ID NO: 270286 - RNA, 64 nt, hsa
uuuuaugauuugaugaguuucuuguaagguuaccguuucuaagaguugugcuuuauggccacug

SEQ ID NO: 270287 - RNA, 64 nt, hsa
aacaucacguucucuauuggcuuuuugguuuaguguuucuaaauuuucuccuucugauuuugcc

SEQ ID NO: 270288 - RNA, 64 nt, hsa
uuuagaguuuuuguauagacuucuuugguagucuguuucuaaaaugaaauguauuucaauaagc

SEQ ID NO: 270289 - RNA, 64 nt, hsa
aaaauaauccagaucugcuuucuaaaaugaaucaguuucuaaagugaaacaugcaauauuuaug

SEQ ID NO: 270290 - RNA, 64 nt, hsa
agaccugugauugcccagaacacauaguccccacguuucuaauuuggagcaaaucuaaaaggug

SEQ ID NO: 270291 - RNA, 64 nt, hsa
cugagagaauucuguguccugcucauugucuugaguuucuaaccaugugcagaugcaagcguuc

SEQ ID NO: 270292 - RNA, 64 nt, hsa
augagaauuauuuuggaucuuagauccaaacacaguuucuaauagaaaacuauuauuuauauug

SEQ ID NO: 270293 - RNA, 64 nt, hsa
ucaauaaacuaaaagguucaauuccuaccaaauaguuucuaaugugggagaaaaacuuggcaca

SEQ ID NO: 270294 - RNA, 64 nt, hsa
caaauauucagaaguaacuugauaagauaugaauguuucuaaagaaguuucuaaagguucggaa

SEQ ID NO: 270295 - RNA, 64 nt, hsa
aguaacuugauaagauaugaauguuucuaaagaaguuucuaaagguucggaaaaugcuccuugu

SEQ ID NO: 270296 - RNA, 64 nt, hsa
ugcaauucaaaaguuccaagagucuaaagauggaguuucuaagguccgguguucuaagauguga

SEQ ID NO: 270297 - RNA, 64 nt, hsa
uaggcacuguaguucuaagacucaaauguucuaaguuucuaagauucuaaagguccacaggucu

SEQ ID NO: 270298 - RNA, 64 nt, hsa
cauuauaccagaucuggucacuuucauugaaaugguuucuaauuuucuucccaagugcuguugg

SEQ ID NO: 270299 - RNA, 64 nt, hsa
gcaguuauuuucugaauuugucaaagaggcaguaguuucuaaccccuguucuauaguaguuaca

SEQ ID NO: 270300 - RNA, 64 nt, hsa
acuuaccuccucuaacacgugguuugucuggagaguuucuaaaaauucagcuauaaccccaguu

SEQ ID NO: 270301 - RNA, 64 nt, hsa
agcaugaaugcaauuuguuaaagcagacugauuuguuucuaagauauuuuugguuuuuuuaaaa

SEQ ID NO: 270302 - RNA, 64 nt, hsa
ggaugccugaaguaaguaaguuuucucaguggggcagucucauaaaaucaccaggacauugacc

SEQ ID NO: 270303 - RNA, 64 nt, hsa
aagcacuauauucuagucauuaacucaacggagccagucucaacucugcugggagcacccacag

SEQ ID NO: 270304 - RNA, 64 nt, hsa
gggccucugugauggacaucucguaggacccagccagucucauccagcagguuggguucuaggg

SEQ ID NO: 270305 - RNA, 64 nt, hsa
uugugaaaagauuuuuucuuuuuuuuuugggacacagucucacucugucgcccaggcuagagug

SEQ ID NO: 270306 - RNA, 64 nt, hsa
uagagagaacuggguaggccucucccaccaugugcagucucauggggagaggcuucuuucguuu

SEQ ID NO: 270307 - RNA, 64 nt, hsa
acuaagaugucaguauucuccucauggauauuuucagucucaauguugccagucuaauaguaua

SEQ ID NO: 270308 - RNA, 64 nt, hsa; identical to SEQ ID NO: 125533

SEQ ID NO: 270309 - RNA, 64 nt, hsa; identical to SEQ ID NO: 125534

SEQ ID NO: 270310 - RNA, 64 nt, hsa; identical to SEQ ID NO: 125535

SEQ ID NO: 270311 - RNA, 64 nt, hsa; identical to SEQ ID NO: 125536

SEQ ID NO: 270312 - RNA, 64 nt, hsa; identical to SEQ ID NO: 125537

SEQ ID NO: 270313 - RNA, 64 nt, hsa; identical to SEQ ID NO: 125538

SEQ ID NO: 270314 - RNA, 64 nt, hsa; identical to SEQ ID NO: 125539

SEQ ID NO: 270315 - RNA, 64 nt, hsa; identical to SEQ ID NO: 125540

SEQ ID NO: 270316 - RNA, 64 nt, hsa; identical to SEQ ID NO: 125541

SEQ ID NO: 270317 - RNA, 64 nt, hsa; identical to SEQ ID NO: 125542

SEQ ID NO: 270318 - RNA, 64 nt, hsa; identical to SEQ ID NO: 125543

SEQ ID NO: 270319 - RNA, 64 nt, hsa; identical to SEQ ID NO: 125544

SEQ ID NO: 270320 - RNA, 64 nt, hsa; identical to SEQ ID NO: 125545

SEQ ID NO: 270321 - RNA, 64 nt, hsa; identical to SEQ ID NO: 125546

SEQ ID NO: 270322 - RNA, 64 nt, hsa; identical to SEQ ID NO: 125547

SEQ ID NO: 270323 - RNA, 64 nt, hsa; identical to SEQ ID NO: 125548

SEQ ID NO: 270324 - RNA, 64 nt, hsa; identical to SEQ ID NO: 125549

SEQ ID NO: 270325 - RNA, 64 nt, hsa; identical to SEQ ID NO: 125550

SEQ ID NO: 270326 - RNA, 64 nt, hsa; identical to SEQ ID NO: 125551

SEQ ID NO: 270327 - RNA, 64 nt, hsa; identical to SEQ ID NO: 125552

SEQ ID NO: 270328 - RNA, 64 nt, hsa; identical to SEQ ID NO: 125553

SEQ ID NO: 270329 - RNA, 64 nt, hsa; identical to SEQ ID NO: 125554

SEQ ID NO: 270330 - RNA, 64 nt, hsa; identical to SEQ ID NO: 125555

SEQ ID NO: 270331 - RNA, 64 nt, hsa; identical to SEQ ID NO: 125556

SEQ ID NO: 270332 - RNA, 64 nt, hsa; identical to SEQ ID NO: 125557

SEQ ID NO: 270333 - RNA, 64 nt, hsa; identical to SEQ ID NO: 125558

SEQ ID NO: 270334 - RNA, 64 nt, hsa; identical to SEQ ID NO: 125559

SEQ ID NO: 270335 - RNA, 64 nt, hsa; identical to SEQ ID NO: 125560

SEQ ID NO: 270336 - RNA, 64 nt, hsa; identical to SEQ ID NO: 125561

SEQ ID NO: 270337 - RNA, 64 nt, hsa; identical to SEQ ID NO: 125562

SEQ ID NO: 270338 - RNA, 64 nt, hsa; identical to SEQ ID NO: 125563

SEQ ID NO: 270339 - RNA, 64 nt, hsa; identical to SEQ ID NO: 125564

SEQ ID NO: 270340 - RNA, 64 nt, hsa; identical to SEQ ID NO: 125565

SEQ ID NO: 270341 - RNA, 64 nt, hsa; identical to SEQ ID NO: 125566

SEQ ID NO: 270342 - RNA, 64 nt, hsa; identical to SEQ ID NO: 125567

SEQ ID NO: 270343 - RNA, 64 nt, hsa; identical to SEQ ID NO: 125568

SEQ ID NO: 270344 - RNA, 65 nt, hsa
auuuuuuuaccaauuccaauuucaaaaugucucaauggugcuauaauaaauaaacuucaacacuc

SEQ ID NO: 270345 - RNA, 65 nt, hsa
acuaauauuugggaaggcuuuaaagacgcauguuauggugcuaauguacuuucacuuuuaaacuc

SEQ ID NO: 270346 - RNA, 65 nt, hsa
uagcugaaaggaaaaaaaguagaagccugacuacuuggugcuaacuacuaaagauuuuggcagaa

SEQ ID NO: 270347 - RNA, 65 nt, hsa
cucagcuucacauaccccucuccauguaugagaucuggugcuagcaaucagauucaacccgaagg

SEQ ID NO: 270348 - RNA, 65 nt, hsa
uugcuacccccgcugcccccuccacaguuccugaauggugcuaaggaucugcagcaguuggcaac

SEQ ID NO: 270349 - RNA, 65 nt, hsa
ccccuugugcagcggaccacuugcccaguuugcuguggugcuagccuuccccaucauccaccggg

SEQ ID NO: 270350 - RNA, 65 nt, hsa
guuacugaauaaggugcuucugcuucuucuagagauggugcuaaagaaaggacuagcauaugaga

SEQ ID NO: 270351 - RNA, 65 nt, hsa
uaccaauggggcuggugggcaugcuguccacuguguggugcuaggacugccaaugccaggcccaa

SEQ ID NO: 270352 - RNA, 65 nt, hsa
aucagguaauaauaggcuugaaaauugauauccuguggugcuaaaguacaguagaaagagaggag

SEQ ID NO: 270353 - RNA, 65 nt, hsa
aguuaguuaauagcauugggauauagucacuguaauggugcuauuaacaaacagucaacaccauu

SEQ ID NO: 270354 - RNA, 65 nt, hsa
cuuucccauuuauuguuuggccagcuaugccaauguggugcuauuguuucuuuaagaaaguacuu

SEQ ID NO: 270355 - RNA, 65 nt, hsa
ucaaacaguauguaaaacucuguuuuuuaguauaauggugcuauuuuguaguuuguuauaugaaa

SEQ ID NO: 270356 - RNA, 65 nt, hsa
ucucagggaggccgggugugaccucaucuuucucauggugcuauccuggugcuauuggggugggg

SEQ ID NO: 270357 - RNA, 65 nt, hsa
ccgggugugaccucaucuuucucauggugcuauccuggugcuauugggguggggagcucccuccc

SEQ ID NO: 270358 - RNA, 64 nt, hsa
uuccacccccugccauccucacuuagaggggccauggcacuagauggcacuagucccccgauaa

SEQ ID NO: 270359 - RNA, 64 nt, hsa
ugccauccucacuuagaggggccauggcacuagauggcacuagucccccgauaauuuaugucuc

SEQ ID NO: 270360 - RNA, 64 nt, hsa
uguauuaaucuaagguuucaaaguauaaaaguauaugggguaggccgggugcaguggcucacgc

SEQ ID NO: 270361 - RNA, 64 nt, hsa
acucugucucagaaaaaaaaaaaaagaaaaauauaugggguaaauacaguaaaacguuuuguua

SEQ ID NO: 270362 - RNA, 64 nt, hsa
agcuuucaguguagugagauuauuccuguagguuaugggguauaauucaggauuuaacuaaugu

SEQ ID NO: 270363 - RNA, 64 nt, hsa
guauuuuaucauuuguaagcagaacucuagcuauaugggguagaaauaaaaucucugagaugaa

SEQ ID NO: 270364 - RNA, 64 nt, hsa
acuucccguucggaauaacugaaaucccccagcgaugggguaacaauuuuuuaaaacucucgau

SEQ ID NO: 270365 - RNA, 64 nt, hsa
ucuccccgccaaaaaaggcguucccaccgcccggaugggguagaauggaccuuguagguggaga

SEQ ID NO: 270366 - RNA, 64 nt, hsa; identical to SEQ ID NO: 160354

SEQ ID NO: 270367 - RNA, 64 nt, hsa; identical to SEQ ID NO: 160355

SEQ ID NO: 270368 - RNA, 64 nt, hsa; identical to SEQ ID NO: 160356

SEQ ID NO: 270369 - RNA, 64 nt, hsa; identical to SEQ ID NO: 160357

SEQ ID NO: 270370 - RNA, 64 nt, hsa; identical to SEQ ID NO: 160358

SEQ ID NO: 270371 - RNA, 64 nt, hsa; identical to SEQ ID NO: 160359

SEQ ID NO: 270372 - RNA, 64 nt, hsa; identical to SEQ ID NO: 160360

SEQ ID NO: 270373 - RNA, 64 nt, hsa; identical to SEQ ID NO: 160361

SEQ ID NO: 270374 - RNA, 64 nt, hsa; identical to SEQ ID NO: 160362

SEQ ID NO: 270375 - RNA, 64 nt, hsa; identical to SEQ ID NO: 160363

SEQ ID NO: 270376 - RNA, 64 nt, hsa; identical to SEQ ID NO: 160364

SEQ ID NO: 270377 - RNA, 64 nt, hsa; identical to SEQ ID NO: 160365

SEQ ID NO: 270378 - RNA, 64 nt, hsa; identical to SEQ ID NO: 160366

SEQ ID NO: 270379 - RNA, 64 nt, hsa; identical to SEQ ID NO: 160367

SEQ ID NO: 270380 - RNA, 64 nt, hsa; identical to SEQ ID NO: 160368

SEQ ID NO: 270381 - RNA, 64 nt, hsa; identical to SEQ ID NO: 160369

SEQ ID NO: 270382 - RNA, 64 nt, hsa; identical to SEQ ID NO: 160370

SEQ ID NO: 270383 - RNA, 64 nt, hsa; identical to SEQ ID NO: 160371

SEQ ID NO: 270384 - RNA, 64 nt, hsa; identical to SEQ ID NO: 160372

SEQ ID NO: 270385 - RNA, 64 nt, hsa; identical to SEQ ID NO: 160373

SEQ ID NO: 270386 - RNA, 64 nt, hsa; identical to SEQ ID NO: 160374

SEQ ID NO: 270387 - RNA, 64 nt, hsa; identical to SEQ ID NO: 160375

SEQ ID NO: 270388 - RNA, 64 nt, hsa; identical to SEQ ID NO: 160376

SEQ ID NO: 270389 - RNA, 64 nt, hsa; identical to SEQ ID NO: 160377

SEQ ID NO: 270390 - RNA, 64 nt, hsa; identical to SEQ ID NO: 206011

SEQ ID NO: 270391 - RNA, 64 nt, hsa; identical to SEQ ID NO: 206012

SEQ ID NO: 270392 - RNA, 64 nt, hsa; identical to SEQ ID NO: 206013

SEQ ID NO: 270393 - RNA, 64 nt, hsa; identical to SEQ ID NO: 206014

SEQ ID NO: 270394 - RNA, 64 nt, hsa; identical to SEQ ID NO: 206015

SEQ ID NO: 270395 - RNA, 64 nt, hsa; identical to SEQ ID NO: 206016

SEQ ID NO: 270396 - RNA, 64 nt, hsa; identical to SEQ ID NO: 206017

SEQ ID NO: 270397 - RNA, 64 nt, hsa; identical to SEQ ID NO: 206018

SEQ ID NO: 270398 - RNA, 64 nt, hsa; identical to SEQ ID NO: 206019

SEQ ID NO: 270399 - RNA, 64 nt, hsa; identical to SEQ ID NO: 206020

SEQ ID NO: 270400 - RNA, 64 nt, hsa; identical to SEQ ID NO: 84026

SEQ ID NO: 270401 - RNA, 64 nt, hsa; identical to SEQ ID NO: 84027

SEQ ID NO: 270402 - RNA, 64 nt, hsa; identical to SEQ ID NO: 84028

SEQ ID NO: 270403 - RNA, 64 nt, hsa; identical to SEQ ID NO: 84029

SEQ ID NO: 270404 - RNA, 64 nt, hsa; identical to SEQ ID NO: 84030

SEQ ID NO: 270405 - RNA, 64 nt, hsa; identical to SEQ ID NO: 84031

SEQ ID NO: 270406 - RNA, 64 nt, hsa; identical to SEQ ID NO: 84032

SEQ ID NO: 270407 - RNA, 64 nt, hsa; identical to SEQ ID NO: 84033

SEQ ID NO: 270408 - RNA, 64 nt, hsa; identical to SEQ ID NO: 84034

SEQ ID NO: 270409 - RNA, 64 nt, hsa; identical to SEQ ID NO: 84035

SEQ ID NO: 270410 - RNA, 64 nt, hsa; identical to SEQ ID NO: 84036

SEQ ID NO: 270411 - RNA, 64 nt, hsa; identical to SEQ ID NO: 84037

SEQ ID NO: 270412 - RNA, 64 nt, hsa; identical to SEQ ID NO: 84038

SEQ ID NO: 270413 - RNA, 64 nt, hsa; identical to SEQ ID NO: 84039

SEQ ID NO: 270414 - RNA, 64 nt, hsa; identical to SEQ ID NO: 84040

SEQ ID NO: 270415 - RNA, 64 nt, hsa; identical to SEQ ID NO: 84041

SEQ ID NO: 270416 - RNA, 64 nt, hsa; identical to SEQ ID NO: 84042

SEQ ID NO: 270417 - RNA, 64 nt, hsa; identical to SEQ ID NO: 84043

SEQ ID NO: 270418 - RNA, 64 nt, hsa; identical to SEQ ID NO: 84044

SEQ ID NO: 270419 - RNA, 64 nt, hsa; identical to SEQ ID NO: 84045

SEQ ID NO: 270420 - RNA, 64 nt, hsa; identical to SEQ ID NO: 84046

SEQ ID NO: 270421 - RNA, 64 nt, hsa; identical to SEQ ID NO: 84047

SEQ ID NO: 270422 - RNA, 64 nt, hsa; identical to SEQ ID NO: 84048

SEQ ID NO: 270423 - RNA, 64 nt, hsa; identical to SEQ ID NO: 84049

SEQ ID NO: 270424 - RNA, 64 nt, hsa; identical to SEQ ID NO: 84050

SEQ ID NO: 270425 - RNA, 64 nt, hsa; identical to SEQ ID NO: 84051

SEQ ID NO: 270426 - RNA, 64 nt, hsa; identical to SEQ ID NO: 84052

SEQ ID NO: 270427 - RNA, 64 nt, hsa; identical to SEQ ID NO: 84053

SEQ ID NO: 270428 - RNA, 64 nt, hsa; identical to SEQ ID NO: 84054

SEQ ID NO: 270429 - RNA, 64 nt, hsa; identical to SEQ ID NO: 84055

SEQ ID NO: 270430 - RNA, 64 nt, hsa; identical to SEQ ID NO: 84056

SEQ ID NO: 270431 - RNA, 64 nt, hsa; identical to SEQ ID NO: 84057

SEQ ID NO: 270432 - RNA, 64 nt, hsa; identical to SEQ ID NO: 84058

SEQ ID NO: 270433 - RNA, 64 nt, hsa; identical to SEQ ID NO: 84059

SEQ ID NO: 270434 - RNA, 64 nt, hsa; identical to SEQ ID NO: 84060

SEQ ID NO: 270435 - RNA, 64 nt, hsa; identical to SEQ ID NO: 84061

SEQ ID NO: 270436 - RNA, 64 nt, hsa; identical to SEQ ID NO: 84062

SEQ ID NO: 270437 - RNA, 64 nt, hsa; identical to SEQ ID NO: 84063

SEQ ID NO: 270438 - RNA, 64 nt, hsa; identical to SEQ ID NO: 84064

SEQ ID NO: 270439 - RNA, 64 nt, hsa; identical to SEQ ID NO: 84065

SEQ ID NO: 270440 - RNA, 64 nt, hsa; identical to SEQ ID NO: 84066

SEQ ID NO: 270441 - RNA, 64 nt, hsa; identical to SEQ ID NO: 84067

SEQ ID NO: 270442 - RNA, 64 nt, hsa; identical to SEQ ID NO: 84068

SEQ ID NO: 270443 - RNA, 64 nt, hsa; identical to SEQ ID NO: 84069

SEQ ID NO: 270444 - RNA, 64 nt, hsa; identical to SEQ ID NO: 84070

SEQ ID NO: 270445 - RNA, 64 nt, hsa; identical to SEQ ID NO: 84071

SEQ ID NO: 270446 - RNA, 64 nt, hsa; identical to SEQ ID NO: 84072

SEQ ID NO: 270447 - RNA, 64 nt, hsa; identical to SEQ ID NO: 84073

SEQ ID NO: 270448 - RNA, 64 nt, hsa; identical to SEQ ID NO: 84074

SEQ ID NO: 270449 - RNA, 64 nt, hsa; identical to SEQ ID NO: 84075

SEQ ID NO: 270450 - RNA, 64 nt, hsa; identical to SEQ ID NO: 84076

SEQ ID NO: 270451 - RNA, 64 nt, hsa; identical to SEQ ID NO: 84077

SEQ ID NO: 270452 - RNA, 57 nt, hsa; identical to SEQ ID NO: 84078

SEQ ID NO: 270453 - RNA, 64 nt, hsa; identical to SEQ ID NO: 84079

SEQ ID NO: 270454 - RNA, 64 nt, hsa; identical to SEQ ID NO: 84080

SEQ ID NO: 270455 - RNA, 64 nt, hsa; identical to SEQ ID NO: 84081

SEQ ID NO: 270456 - RNA, 64 nt, hsa; identical to SEQ ID NO: 84082

SEQ ID NO: 270457 - RNA, 64 nt, hsa; identical to SEQ ID NO: 84083

SEQ ID NO: 270458 - RNA, 64 nt, hsa; identical to SEQ ID NO: 247175

SEQ ID NO: 270459 - RNA, 64 nt, hsa; identical to SEQ ID NO: 247176

SEQ ID NO: 270460 - RNA, 64 nt, hsa; identical to SEQ ID NO: 247177

SEQ ID NO: 270461 - RNA, 64 nt, hsa; identical to SEQ ID NO: 247178

SEQ ID NO: 270462 - RNA, 64 nt, hsa; identical to SEQ ID NO: 247179

SEQ ID NO: 270463 - RNA, 64 nt, hsa; identical to SEQ ID NO: 247180

SEQ ID NO: 270464 - RNA, 64 nt, hsa; identical to SEQ ID NO: 247181

SEQ ID NO: 270465 - RNA, 64 nt, hsa; identical to SEQ ID NO: 247182

SEQ ID NO: 270466 - RNA, 64 nt, hsa; identical to SEQ ID NO: 247183

SEQ ID NO: 270467 - RNA, 64 nt, hsa; identical to SEQ ID NO: 247184

SEQ ID NO: 270468 - RNA, 64 nt, hsa; identical to SEQ ID NO: 247185

SEQ ID NO: 270469 - RNA, 64 nt, hsa; identical to SEQ ID NO: 247186

SEQ ID NO: 270470 - RNA, 64 nt, hsa; identical to SEQ ID NO: 247187

SEQ ID NO: 270471 - RNA, 64 nt, hsa; identical to SEQ ID NO: 247188

SEQ ID NO: 270472 - RNA, 64 nt, hsa; identical to SEQ ID NO: 247189

SEQ ID NO: 270473 - RNA, 64 nt, hsa; identical to SEQ ID NO: 247190

SEQ ID NO: 270474 - RNA, 64 nt, hsa; identical to SEQ ID NO: 247191

SEQ ID NO: 270475 - RNA, 64 nt, hsa; identical to SEQ ID NO: 247192

SEQ ID NO: 270476 - RNA, 64 nt, hsa; identical to SEQ ID NO: 247193

SEQ ID NO: 270477 - RNA, 64 nt, hsa; identical to SEQ ID NO: 247194

SEQ ID NO: 270478 - RNA, 64 nt, hsa; identical to SEQ ID NO: 247195

SEQ ID NO: 270479 - RNA, 64 nt, hsa; identical to SEQ ID NO: 247196

SEQ ID NO: 270480 - RNA, 64 nt, hsa; identical to SEQ ID NO: 247197

SEQ ID NO: 270481 - RNA, 64 nt, hsa; identical to SEQ ID NO: 247198

SEQ ID NO: 270482 - RNA, 64 nt, hsa; identical to SEQ ID NO: 247199

SEQ ID NO: 270483 - RNA, 64 nt, hsa; identical to SEQ ID NO: 247200

SEQ ID NO: 270484 - RNA, 64 nt, hsa; identical to SEQ ID NO: 247201

SEQ ID NO: 270485 - RNA, 61 nt, hsa; identical to SEQ ID NO: 247202

SEQ ID NO: 270486 - RNA, 64 nt, hsa; identical to SEQ ID NO: 247203

SEQ ID NO: 270487 - RNA, 64 nt, hsa; identical to SEQ ID NO: 247204

SEQ ID NO: 270488 - RNA, 64 nt, hsa; identical to SEQ ID NO: 247205

SEQ ID NO: 270489 - RNA, 64 nt, hsa; identical to SEQ ID NO: 247206

SEQ ID NO: 270490 - RNA, 64 nt, hsa; identical to SEQ ID NO: 247207

SEQ ID NO: 270491 - RNA, 64 nt, hsa; identical to SEQ ID NO: 247208

SEQ ID NO: 270492 - RNA, 64 nt, hsa; identical to SEQ ID NO: 247209

SEQ ID NO: 270493 - RNA, 64 nt, hsa; identical to SEQ ID NO: 247210

SEQ ID NO: 270494 - RNA, 64 nt, hsa; identical to SEQ ID NO: 247211

SEQ ID NO: 270495 - RNA, 64 nt, hsa; identical to SEQ ID NO: 247212

SEQ ID NO: 270496 - RNA, 64 nt, hsa; identical to SEQ ID NO: 247213

SEQ ID NO: 270497 - RNA, 64 nt, hsa; identical to SEQ ID NO: 247214

SEQ ID NO: 270498 - RNA, 64 nt, hsa; identical to SEQ ID NO: 247215

SEQ ID NO: 270499 - RNA, 64 nt, hsa; identical to SEQ ID NO: 247216

SEQ ID NO: 270500 - RNA, 64 nt, hsa; identical to SEQ ID NO: 247217

SEQ ID NO: 270501 - RNA, 64 nt, hsa; identical to SEQ ID NO: 247218

SEQ ID NO: 270502 - RNA, 64 nt, hsa; identical to SEQ ID NO: 247219

SEQ ID NO: 270503 - RNA, 64 nt, hsa; identical to SEQ ID NO: 247220

SEQ ID NO: 270504 - RNA, 64 nt, hsa; identical to SEQ ID NO: 247221

SEQ ID NO: 270505 - RNA, 64 nt, hsa; identical to SEQ ID NO: 247222

SEQ ID NO: 270506 - RNA, 64 nt, hsa; identical to SEQ ID NO: 247223

SEQ ID NO: 270507 - RNA, 64 nt, hsa; identical to SEQ ID NO: 247224

SEQ ID NO: 270508 - RNA, 64 nt, hsa; identical to SEQ ID NO: 247225

SEQ ID NO: 270509 - RNA, 64 nt, hsa; identical to SEQ ID NO: 247226

SEQ ID NO: 270510 - RNA, 64 nt, hsa; identical to SEQ ID NO: 247227

SEQ ID NO: 270511 - RNA, 64 nt, hsa; identical to SEQ ID NO: 247228

SEQ ID NO: 270512 - RNA, 64 nt, hsa; identical to SEQ ID NO: 247229

SEQ ID NO: 270513 - RNA, 64 nt, hsa; identical to SEQ ID NO: 247230

SEQ ID NO: 270514 - RNA, 64 nt, hsa; identical to SEQ ID NO: 247231

SEQ ID NO: 270515 - RNA, 64 nt, hsa; identical to SEQ ID NO: 247232

SEQ ID NO: 270516 - RNA, 64 nt, hsa; identical to SEQ ID NO: 247233

SEQ ID NO: 270517 - RNA, 64 nt, hsa; identical to SEQ ID NO: 247234

SEQ ID NO: 270518 - RNA, 64 nt, hsa; identical to SEQ ID NO: 247235

SEQ ID NO: 270519 - RNA, 64 nt, hsa; identical to SEQ ID NO: 247236

SEQ ID NO: 270520 - RNA, 64 nt, hsa; identical to SEQ ID NO: 247237

SEQ ID NO: 270521 - RNA, 64 nt, hsa; identical to SEQ ID NO: 247238

SEQ ID NO: 270522 - RNA, 64 nt, hsa; identical to SEQ ID NO: 247239

SEQ ID NO: 270523 - RNA, 64 nt, hsa; identical to SEQ ID NO: 247240

SEQ ID NO: 270524 - RNA, 64 nt, hsa; identical to SEQ ID NO: 247241

SEQ ID NO: 270525 - RNA, 64 nt, hsa; identical to SEQ ID NO: 247242

SEQ ID NO: 270526 - RNA, 64 nt, hsa; identical to SEQ ID NO: 247243

SEQ ID NO: 270527 - RNA, 64 nt, hsa; identical to SEQ ID NO: 247244

SEQ ID NO: 270528 - RNA, 64 nt, hsa; identical to SEQ ID NO: 247245

SEQ ID NO: 270529 - RNA, 64 nt, hsa; identical to SEQ ID NO: 247246

SEQ ID NO: 270530 - RNA, 64 nt, hsa; identical to SEQ ID NO: 247247

SEQ ID NO: 270531 - RNA, 64 nt, hsa; identical to SEQ ID NO: 247248

SEQ ID NO: 270532 - RNA, 64 nt, hsa; identical to SEQ ID NO: 247249

SEQ ID NO: 270533 - RNA, 64 nt, hsa; identical to SEQ ID NO: 247250

SEQ ID NO: 270534 - RNA, 64 nt, hsa; identical to SEQ ID NO: 247251

SEQ ID NO: 270535 - RNA, 64 nt, hsa; identical to SEQ ID NO: 247252

SEQ ID NO: 270536 - RNA, 64 nt, hsa
ccaaaugggaucuccauaccuguggaccaaaccaacaagagagacuauguuucuaaguauauug

SEQ ID NO: 270537 - RNA, 64 nt, hsa
uggauccuucuguucuuccuuacaccuaaauaauacaagagauuaaugaauagugguuagaagu

SEQ ID NO: 270538 - RNA, 64 nt, hsa
uucccagggauuuuaaugcacaaaccauauugugacaagagaugagccucuguacuguaaauaa

SEQ ID NO: 270539 - RNA, 64 nt, hsa
auacccaugugaaauaauaauuggauuauggauaacaagagagugaaagccaaagcacuuucug

SEQ ID NO: 270540 - RNA, 64 nt, hsa
cuaaucuuacggauaauccacgugagauuuccacacaagagaaaagcacacgcauagugaaaug

SEQ ID NO: 270541 - RNA, 64 nt, hsa
caaaccucaagacuaucagugugaccuccccauaacaagagaaccccauauauaguuugagacu

SEQ ID NO: 270542 - RNA, 64 nt, hsa
cuucucucuuuuaaaucagauaccuuugaaacauacaagagacaugagauuccaguuguuuuug

SEQ ID NO: 270543 - RNA, 64 nt, hsa
cuuaaaguguucuccaugucucgccuuguuaugcacaagagauucuauuaaaagccucuagaag

SEQ ID NO: 270544 - RNA, 64 nt, hsa
uaucaagaguuuguuauuuucaaauacccauccaacaagagagauggggagguuuuuaguuaua

SEQ ID NO: 270545 - RNA, 64 nt, hsa
aaggaaaacacucuaguuuugcaaguauaugcauacaagagacuuuagauugaucugcaugaag

SEQ ID NO: 270546 - RNA, 64 nt, hsa
ucucuucagcuguaaauaacaggauacagaauuaacaagagaaaaugucuaacuuuuuaagaaa

SEQ ID NO: 270547 - RNA, 64 nt, hsa
gcacaaaaugacacucuucuaaaacuaaaugggcacaagagaauuuuccugggaaaguucacau

SEQ ID NO: 270548 - RNA, 64 nt, hsa
ugcauguaagagugagggagggaaggaaggaacuacaagagagucggagaugaugcagcacaca

SEQ ID NO: 270549 - RNA, 64 nt, hsa
uguccugaaacccagaagugauggagagaaaccaacaagagaucucgaacccugucuagaagga

SEQ ID NO: 270550 - RNA, 64 nt, hsa
auuccuuucuaaguguguuuuauggcauccugcccacaaagaacucacagucugauuaggauga

SEQ ID NO: 270551 - RNA, 64 nt, hsa
aggaugauuuuaaaaauaggguauaaucaugacucacaaagauaugaggcugggugugguggcu

SEQ ID NO: 270552 - RNA, 64 nt, hsa
ucaucauaguaaaagaaaugagggcauaucggcucacaaagagauaaacuacauagggguguuu

SEQ ID NO: 270553 - RNA, 64 nt, hsa
aagagauaaacuacauagggguguuuauuugugucacaaagaauuuaaaauaacacuugcccau

SEQ ID NO: 270554 - RNA, 64 nt, hsa
aacacaaagacauggaagauuagagguuugucaacacaaagacacaggaagaaugggcugcaga

SEQ ID NO: 270555 - RNA, 64 nt, hsa
ucaacaaaaagacauggaagguuagguuugucaacacaaagacauggaagauuagagguuuguc

SEQ ID NO: 270556 - RNA, 64 nt, hsa
ggucagaugcaccacccauggagagguuugucaacacaaagacauggaagguuagagguuuguc

SEQ ID NO: 270557 - RNA, 64 nt, hsa
uauauauuucucucacccuauuuugagacagaggcacaaagacucagcaauuuuuuucccuccu

SEQ ID NO: 270558 - RNA, 64 nt, hsa
ugaaacuauuuucuucuucuccaugaagccagggcacaaagaauuugacaguacaagucaaauc

SEQ ID NO: 270559 - RNA, 64 nt, hsa
augaaccaaccaaucaaugacaagaaaacgcuuacacaaagaacaauuugaggcucuaagcuuc

SEQ ID NO: 270560 - RNA, 64 nt, hsa
cgaaaguaggaugagagccuucaaagucuaccagcacaaagaccccugagccccgcaauuguga

SEQ ID NO: 270561 - RNA, 64 nt, hsa
agacgaugcacaaaaaaccacccuguacgaaggccacaaagaacagcucagaugcacaaagauu

SEQ ID NO: 270562 - RNA, 64 nt, hsa
cccuguacgaaggccacaaagaacagcucagaugcacaaagauucacaccauacaggccaaauu

SEQ ID NO: 270563 - RNA, 64 nt, hsa
uguaguccagucucuccagcaucaauuccaucagcacaaagacauaauuuaauuccuucuaccu

SEQ ID NO: 270564 - RNA, 64 nt, hsa
aggaugagacaggaggucagcacaagauacacgucacaaagaccuugcugauaaaacagauugu

SEQ ID NO: 270565 - RNA, 64 nt, hsa
uccaaggacuccuaacuacuuugcaucuguaauccacaaagauucugggcagcugccaccucag

SEQ ID NO: 270566 - RNA, 64 nt, hsa
accaacauccacaggcuaacaccccuucaguccacacaaagaagcuucauauuuuuuuuauaag

SEQ ID NO: 270567 - RNA, 64 nt, hsa
auucaguuaaccaaacaagaaaaaggcagugccucacaaagaaauuaagaaguuguccguccca

SEQ ID NO: 270568 - RNA, 64 nt, hsa
guaacagauuauguauaaucauauaugauauauucacaaagagaaaacaaaaggaacuuuuaaa

SEQ ID NO: 270569 - RNA, 64 nt, hsa
uuuuucuggacaagcuuacaucuuccucagccaucuuugugaguccuucaagagcaguuaucaa

SEQ ID NO: 270570 - RNA, 64 nt, hsa
cacaccccaagauugccuugagccuacuaggcaccuuugugagaaagaaaaaauagaugccucu

SEQ ID NO: 270571 - RNA, 64 nt, hsa
gaggugcuguugugggugucucagcucugagggucuuugugagcucccacuguugugggugucu

SEQ ID NO: 270572 - RNA, 64 nt, hsa
cucccacuguugugggugucucagcucugagggucuuugugagcucccacuguugugggugucu

SEQ ID NO: 270573 - RNA, 64 nt, hsa
cucccacuguugugggugucucagcucugagggucuuugugaguucccaccaacuuuuaauuau

SEQ ID NO: 270574 - RNA, 64 nt, hsa
gcaguacuacagaacaaaggcaaauuaaaagcagcuuugugaacuuuuaugugugcaaaggauc

SEQ ID NO: 270575 - RNA, 64 nt, hsa
agaaaaucaaaaguaaaaagaaacaaagaauuaucuuugugaucaauuguuuacagccuaugaa

SEQ ID NO: 270576 - RNA, 64 nt, hsa
uauuuauuaucuaccuuuucggggaugcugaguucuuugugauggguaguccuucaaaguagaa

SEQ ID NO: 270577 - RNA, 64 nt, hsa
guagccuugcacacaucauuacuucugcauccuucuuugugaccaagugaauaccuaccuaccu

SEQ ID NO: 270578 - RNA, 64 nt, hsa
acagucucuguuucauggcaacacuggauaauggcuuugugaaauuuaaaaaauuuuuguagcg

SEQ ID NO: 270579 - RNA, 64 nt, hsa
aaacaaccauugcauguuugcuuuugauguaucccuuugugaaauuagcacuuuuggggccaau

SEQ ID NO: 270580 - RNA, 55 nt, hsa
uggacacguuugauaguuaacauuucuuugugaaagguaauggacucacaagggg

SEQ ID NO: 270581 - RNA, 64 nt, hsa
aacaugcugagaauggaaagucuaccggcccuuucuuugugaacgucacauuggccgagccgug

SEQ ID NO: 270582 - RNA, 64 nt, hsa
ucucccuuuuuucaaaauugaaguuggguuggcucuuugugaaccucucauccccacagcagaa

SEQ ID NO: 270583 - RNA, 64 nt, hsa
uggggguggauguagcugcagaaagcaugcacaacuuugugaaagaggcccugccuugugcaug

SEQ ID NO: 270584 - RNA, 64 nt, hsa
cuguuaauuuuugugggauguuguucccauucuucuuugugagacagagagaaugugauauaga

SEQ ID NO: 270585 - RNA, 64 nt, hsa
ggaaaaaaaugucaucuccccccaccucaucccucuuugugacagcagaccuggcuguguugcc

SEQ ID NO: 270586 - RNA, 64 nt, hsa
ggcgagagggccuuucccuugagcuacugagcugcuuugugaugcugaaggauacugccggcag

SEQ ID NO: 270587 - RNA, 64 nt, hsa
gaauguccccaggagucagcaggucacagucuggcuuugugaugguugacaaggucuagcuaca

SEQ ID NO: 270588 - RNA, 64 nt, hsa
gccaugucuaguaauugcuauguguugggagaaacuuugugaaugcaccauuuugaugaucaug

SEQ ID NO: 270589 - RNA, 64 nt, hsa
agauaacaucauacauaagucauuuaguaacagccuuugugaaaugaacuuguuuacuauugga

SEQ ID NO: 270590 - RNA, 64 nt, hsa
uauuuuugacuuuauauuuccugagcucuccugacuuugugaaaaaggguggaugaaaaugcau

SEQ ID NO: 270591 - RNA, 64 nt, hsa
ccuguaaacgacuuuaaaaaauaaaugauuauugcuuugugacaauugacagaauaugucugau

SEQ ID NO: 270592 - RNA, 64 nt, hsa
ccauuucauuuuggcuauguagauacaacuuagucuuugugauugugauauauuugcuaaguuu

SEQ ID NO: 270593 - RNA, 64 nt, hsa
cacaucacugacuccuaggucuagcacgacugcucuuugugauucucuugaguacccuuggcuu

SEQ ID NO: 270594 - RNA, 64 nt, hsa
acucacugacaugaucuuagcuucuuuaaucagacuuugugacuuaaaaguuuggggguuuucu

SEQ ID NO: 270595 - RNA, 64 nt, hsa
aaguugaaaaaccuucucuucagaaaagaagaaaaauucagaaaucaguagaucuuggcaauuc

SEQ ID NO: 270596 - RNA, 64 nt, hsa
aagaagaaaaauucagaaaucaguagaucuuggcaauucagauaauauguuuuuuccuacuuca

SEQ ID NO: 270597 - RNA, 64 nt, hsa
ggacgauggauauugcuuccaaugaaagaucugaaauucagaguguagcucugagacuugcuuc

SEQ ID NO: 270598 - RNA, 64 nt, hsa
guugcaagccuacucagacuccaaacacggaacgaauucagacuuccagcacgagcugacugac

SEQ ID NO: 270599 - RNA, 64 nt, hsa
ggugggcugaguggaggugccugggagcugccuaaauucagaagccuccacugccauggagacu

SEQ ID NO: 270600 - RNA, 64 nt, hsa
aaucucccaggugaggauucacaucccaaaauaaaauucagaagccagguggccugugcucccc

SEQ ID NO: 270601 - RNA, 64 nt, hsa
gacaaaagcaaauuggaaaagccagccauuuacuaauucagaggaacagcauagccaaggcuag

SEQ ID NO: 270602 - RNA, 64 nt, hsa
uggguuaguagauauuaucaaaguccauaucaugaauucagaacccuuuaauguaauucuaaua

SEQ ID NO: 270603 - RNA, 64 nt, hsa
gcguccaauugacugcccucuuacuguuuugaggaauucagaaguggagauuucaguucagcgg

SEQ ID NO: 270604 - RNA, 64 nt, hsa
cuugugugugcgugucaguuacuuuuuuaguaacaauucagauccaguguaaacuuccguucau

SEQ ID NO: 270605 - RNA, 64 nt, hsa
cuuaagcuguuagucuuaaagauuauuguuaaaaaauucagaagaaaagagagacaagugcucu

SEQ ID NO: 270606 - RNA, 64 nt, hsa
aaguuugaguuaaguguuuuuaauucagucagugaauucagaauaaguacauucauguauaaca

SEQ ID NO: 270607 - RNA, 64 nt, hsa
auauucuuuuuauauucuguggaaaaauaaaggaaauucagauuguuuaaaugccuaaaaguuu

SEQ ID NO: 270608 - RNA, 64 nt, hsa
uuugguaauuguagaccuguuucauaagcuuuguaauucagaaauccuuguauuuaguaagugc

SEQ ID NO: 270609 - RNA, 64 nt, hsa
cuacuauauuuuuuuauucuugguaucaguuuaaaauucagacaaggcccacagaauaagauuu

SEQ ID NO: 270610 - RNA, 64 nt, hsa
ugguauucuuggguuuuccuacuuaauacacaguaauucagaacuuguauucuauuaugaguuu

SEQ ID NO: 270611 - RNA, 64 nt, hsa
caggcgugagccaccaggcccugccugguuuucaaauucagaaaucuuauuauuuaacccagaa

SEQ ID NO: 270612 - RNA, 64 nt, hsa
uguguaccauccuuuaauagaucucauacaccagaauucagaucaugaaugacugacagaauau

SEQ ID NO: 270613 - RNA, 64 nt, hsa
uuagaaauauucuacuucucuguugucaaacugaaauucagagcaaguuccugagugcguggau

SEQ ID NO: 270614 - RNA, 64 nt, hsa
uuuccuuugaacuugauugccuauggaucaaagaaauucagaacagccugccuguccccccgca

SEQ ID NO: 270615 - RNA, 64 nt, hsa
gcuggauagagguggggucucuucaccuucccugaauucagaacagacccugugccuggcccca

SEQ ID NO: 270616 - RNA, 64 nt, hsa
aaacugaggccagagcugagcuccugggggaguuaauucagaggggagaggccagcaccucccu

SEQ ID NO: 270617 - RNA, 64 nt, hsa
acugcuuuguaauauuucacuuuguuuuacuacaaauucagaucacuuuguuuuacuauaaauu

SEQ ID NO: 270618 - RNA, 64 nt, hsa
uuacuacaaauucagaucacuuuguuuuacuauaaauucagauuauccaaauauuuuccuaaua

SEQ ID NO: 270619 - RNA, 64 nt, hsa
uuuugguuuuucuaaguauauagaaagcuuguauaauucagauuuaucaauuuccugauuuaau

SEQ ID NO: 270620 - RNA, 64 nt, hsa
uggcuaccaaacacauucuccuuugaauuguuaaaauucagaacauucaaaauaacuguuuugc

SEQ ID NO: 270621 - RNA, 64 nt, hsa
cuugucuccuguagacccaguggaacccauaaguaauucagaaccaucaaugaauucagauaug

SEQ ID NO: 270622 - RNA, 64 nt, hsa
aguggaacccauaaguaauucagaaccaucaaugaauucagauaugggaaaagucaguaaaaau

SEQ ID NO: 270623 - RNA, 64 nt, hsa
uuuuuuuuuugacaaaaggaggauacaggaagaaaauucagacucauuugaauauuuguaaacc

SEQ ID NO: 270624 - RNA, 64 nt, hsa
uauucacauugaaauaaagaauuaucuagaugauaauucagauaauucaguuuguucauagaau

SEQ ID NO: 270625 - RNA, 64 nt, hsa
cuccuuuauuuuuauauggauauacuaggauuguaauucagauauuuaauaucuuuuaucagug

SEQ ID NO: 270626 - RNA, 64 nt, hsa
guuucuaagaguugugcuuuauggccacugagagaauucagaauaaauugaaagauggagucua

SEQ ID NO: 270627 - RNA, 64 nt, hsa
guagccuugaagucaccagaauaacuaggacucaaauucagaccaaaccaggacuagcuuuuug

SEQ ID NO: 270628 - RNA, 64 nt, hsa
gcagucauaaaacugagacugagacagaauauugaauucagaaaugugugcaugaauauauggg

SEQ ID NO: 270629 - RNA, 64 nt, hsa
acacacauacuacuuuaagggggugaggaucauuaauucagauaauuuuuaaguuuccuaguga

SEQ ID NO: 270630 - RNA, 64 nt, hsa
auacacauaucauuuuaagaagcugaggaucacuaauucagauaauguauaaguuucccaguga

SEQ ID NO: 270631 - RNA, 64 nt, hsa
uuuguuuugguagauaaugggcucucagaauaaucucucagaugaaauagaagaacaaacacua

SEQ ID NO: 270632 - RNA, 64 nt, hsa
aagaguuucgacuaaaacaaucuaagauaaugggcucucagaauaaucucucagaugaaauaga

SEQ ID NO: 270633 - RNA, 64 nt, hsa
cucaagaaacucuuauuuauaauagguugcuucucucucagaacuuuuaucuauuacuuuuuuc

SEQ ID NO: 270634 - RNA, 64 nt, hsa
aucuauuacuuuuuucuucuuaugaguauguuuacucucagaguaucuaucugauguagacagu

SEQ ID NO: 270635 - RNA, 64 nt, hsa
uggcaucauuguuucaguucuaguuuguauuuuucucucagauauuuuucuucuuuaaaaaucu

SEQ ID NO: 270636 - RNA, 64 nt, hsa
ucugucacuuguguaaguuggcacuaccuugugccucucagauugcugaagugcugcugguaag

SEQ ID NO: 270637 - RNA, 64 nt, hsa
ucucuggcagggaucucagaugaccguggccucccucucagagggggagaacgccagagcccug

SEQ ID NO: 270638 - RNA, 64 nt, hsa
ugugcuggcugggggugaaucccaaugagggucccucucagagcgggagaacgccagagcccug

SEQ ID NO: 270639 - RNA, 64 nt, hsa
ugcgcuggcugggggugaaucccaaugagggucccucucagaaagggagaacgccagagcccug

SEQ ID NO: 270640 - RNA, 64 nt, hsa
gugagcuucggccuggccgaggugggugggugggcucucagauucagcucuguguaaagauucu

SEQ ID NO: 270641 - RNA, 64 nt, hsa
ugggcaccguggcccugugcuccaucacaaacaccucucagaaacaacgugggaugaaaaagca

SEQ ID NO: 270642 - RNA, 64 nt, hsa
aggccugagcauuucccagccccaguguccacaccucucagaaaagagaaaaaagaaugucagu

SEQ ID NO: 270643 - RNA, 64 nt, hsa
aacacagccagcacggugcucuccagggcagccccucucagacgaggaggcagcgggugcagcc

SEQ ID NO: 270644 - RNA, 64 nt, hsa
acuaagggcaccugcagacacuuucugcaauaagcucucagaccaucagcauccuccuggccag

SEQ ID NO: 270645 - RNA, 64 nt, hsa
gcuaagggcacaugcacacauuuucugcaauucacucucagaccaucagcauccuccuggccag

SEQ ID NO: 270646 - RNA, 64 nt, hsa
uacaguaagguggaugguaccuuauggcaaaaaucucucagaaauuuaugugugguuuuaaagu

SEQ ID NO: 270647 - RNA, 64 nt, hsa
uaaaaguaaaauaacagaaauuauuacaaacggucucucagaccacauugcaaucacacuagac

SEQ ID NO: 270648 - RNA, 64 nt, hsa
acuuggcuuuuuacuuagaggacauucugauuugcucucagaaacaucugauuugggguuaaac

SEQ ID NO: 270649 - RNA, 64 nt, hsa
caucuuguggguuucuuuugcccuuacuggaugacucucagaggacaugacuugacauaguaac

SEQ ID NO: 270650 - RNA, 64 nt, hsa
acccauccaggauggagaauaagggcuucucugccucucagaauucuuuuuaauugaagauguc

SEQ ID NO: 270651 - RNA, 64 nt, hsa
gccccggcaugaggccuuuccucaguccuguggccucucagaggacaccugaugcucaccugcc

SEQ ID NO: 270652 - RNA, 64 nt, hsa
ugcauauacaaccaaguggguagaccuagguguucucucagaggggugugugugugugugcgug

SEQ ID NO: 270653 - RNA, 64 nt, hsa
ugugugcgugcgcgugugccuagaauauauauuacucucagaggagauucuguugcuuuugaau

SEQ ID NO: 270654 - RNA, 64 nt, hsa
gucacucuucugccuucgugaaaagccaauagcacucucagauaucaggggauuuuaguuccaa

SEQ ID NO: 270655 - RNA, 64 nt, hsa
auccgaaccauugcccuuguuucccccacguucucucucagaucuuugucucgaagggaaaaca

SEQ ID NO: 270656 - RNA, 64 nt, hsa
cucgugcuuugcuggccccugcccgcuacucccacucucagacacccagggguggugggcccua

SEQ ID NO: 270657 - RNA, 64 nt, hsa
ccaugaggccaagcuuguccuucaaucauguuuccucucagaugcguccgugaugccuccuaau

SEQ ID NO: 270658 - RNA, 62 nt, hsa
caaagcggagcugcugcugaccgaaccucagccucucagacuugaugaugaaguaggugguc

SEQ ID NO: 270659 - RNA, 64 nt, hsa
uucuaaugcuuagcaacaacaacaaaaaauugcucucucagauccauaauccauacucagugaa

SEQ ID NO: 270660 - RNA, 64 nt, hsa
gcccguggccuguaucacagaugugcuacagcaccucucagacagccggcacguggcugucuac

SEQ ID NO: 270661 - RNA, 64 nt, hsa
accucaccccauucccccagggaacaucuugcugcucucagagccagaaaaugcugacagccuc

SEQ ID NO: 270662 - RNA, 64 nt, hsa
accaccaaucccgaucggcucuuauuagcuccccgcuccacaagacaccugugacauccuccag

SEQ ID NO: 270663 - RNA, 64 nt, hsa
accaccaaucccgaucggcucuuauuagcuccccgcuccacaagacaccugugaucuggaaauc

SEQ ID NO: 270664 - RNA, 64 nt, hsa
acgaccaaucccgaucggcucuuauuagcuccccgcuccacaagacaccugugcuuuggaaauc

SEQ ID NO: 270665 - RNA, 64 nt, hsa
gguccugaccaaccugcaucaggggaugcccugagcuccacaggucuucaugggcagggguugu

SEQ ID NO: 270666 - RNA, 64 nt, hsa
cucagaucugcccuugcuugccucauaccucugugcuccacacugcggccaggccagcugaguc

SEQ ID NO: 270667 - RNA, 64 nt, hsa
agcuaaccaccauccauggucaagaccucuccuagcuccacacaagcaguagagucucagcucc

SEQ ID NO: 270668 - RNA, 64 nt, hsa
ccucuccuagcuccacacaagcaguagagucucagcuccacagcuuuacccagaagcccuguaa

SEQ ID NO: 270669 - RNA, 64 nt, hsa
gaaugcagcauuugugggaaauccuuuagaugucgcuccacacuugauacacaucagagaauuc

SEQ ID NO: 270670 - RNA, 64 nt, hsa
aaaugcagcaaaugugggaaauuuuuuauggacagcuccacacucauuagucaugagagaguuc

SEQ ID NO: 270671 - RNA, 64 nt, hsa
auuguucauguaaaaaucauacacguggcauguugcuccacauuccuuacacacagggguagag

SEQ ID NO: 270672 - RNA, 64 nt, hsa
cgagccagaucauucaguuucagcgaguccuugagcuccacaacaucuaccagauauagcagac

SEQ ID NO: 270673 - RNA, 64 nt, hsa
gccauaggguccugaauguuucagaccacaaggggcuccacaccuuugcuguguguucuggggc

SEQ ID NO: 270674 - RNA, 64 nt, hsa
gggaggcccuugggagcaggugcuuguggacaaggcuccacaagcguugagccuuggaaaggua

SEQ ID NO: 270675 - RNA, 64 nt, hsa
cucagggacuggcacacuggccuccagaagggcagcuccacagggcagggccucauuauuuuuc

SEQ ID NO: 270676 - RNA, 64 nt, hsa; identical to SEQ ID NO: 175633

SEQ ID NO: 270677 - RNA, 64 nt, hsa; identical to SEQ ID NO: 175634

SEQ ID NO: 270678 - RNA, 64 nt, hsa; identical to SEQ ID NO: 175635

SEQ ID NO: 270679 - RNA, 64 nt, hsa; identical to SEQ ID NO: 175636

SEQ ID NO: 270680 - RNA, 64 nt, hsa; identical to SEQ ID NO: 175637

SEQ ID NO: 270681 - RNA, 64 nt, hsa; identical to SEQ ID NO: 175638

SEQ ID NO: 270682 - RNA, 64 nt, hsa; identical to SEQ ID NO: 175639

SEQ ID NO: 270683 - RNA, 64 nt, hsa; identical to SEQ ID NO: 175640

SEQ ID NO: 270684 - RNA, 64 nt, hsa; identical to SEQ ID NO: 175641

SEQ ID NO: 270685 - RNA, 64 nt, hsa; identical to SEQ ID NO: 175642

SEQ ID NO: 270686 - RNA, 64 nt, hsa; identical to SEQ ID NO: 175643

SEQ ID NO: 270687 - RNA, 64 nt, hsa; identical to SEQ ID NO: 175644

SEQ ID NO: 270688 - RNA, 64 nt, hsa; identical to SEQ ID NO: 175645

SEQ ID NO: 270689 - RNA, 64 nt, hsa; identical to SEQ ID NO: 175646

SEQ ID NO: 270690 - RNA, 64 nt, hsa; identical to SEQ ID NO: 175647

SEQ ID NO: 270691 - RNA, 64 nt, hsa; identical to SEQ ID NO: 175648

SEQ ID NO: 270692 - RNA, 64 nt, hsa; identical to SEQ ID NO: 175649

SEQ ID NO: 270693 - RNA, 64 nt, hsa; identical to SEQ ID NO: 175650

SEQ ID NO: 270694 - RNA, 64 nt, hsa; identical to SEQ ID NO: 175651

SEQ ID NO: 270695 - RNA, 64 nt, hsa; identical to SEQ ID NO: 175652

SEQ ID NO: 270696 - RNA, 64 nt, hsa; identical to SEQ ID NO: 175653

SEQ ID NO: 270697 - RNA, 64 nt, hsa; identical to SEQ ID NO: 175654

SEQ ID NO: 270698 - RNA, 64 nt, hsa; identical to SEQ ID NO: 175655

SEQ ID NO: 270699 - RNA, 64 nt, hsa; identical to SEQ ID NO: 175656

SEQ ID NO: 270700 - RNA, 64 nt, hsa; identical to SEQ ID NO: 175657

SEQ ID NO: 270701 - RNA, 64 nt, hsa; identical to SEQ ID NO: 175658

SEQ ID NO: 270702 - RNA, 64 nt, hsa; identical to SEQ ID NO: 175659

SEQ ID NO: 270703 - RNA, 64 nt, hsa; identical to SEQ ID NO: 175660

SEQ ID NO: 270704 - RNA, 64 nt, hsa; identical to SEQ ID NO: 175661

SEQ ID NO: 270705 - RNA, 64 nt, hsa; identical to SEQ ID NO: 175662

SEQ ID NO: 270706 - RNA, 64 nt, hsa; identical to SEQ ID NO: 175663

SEQ ID NO: 270707 - RNA, 64 nt, hsa; identical to SEQ ID NO: 175664

SEQ ID NO: 270708 - RNA, 64 nt, hsa; identical to SEQ ID NO: 175665

SEQ ID NO: 270709 - RNA, 64 nt, hsa; identical to SEQ ID NO: 175666

SEQ ID NO: 270710 - RNA, 64 nt, hsa; identical to SEQ ID NO: 175667

SEQ ID NO: 270711 - RNA, 64 nt, hsa; identical to SEQ ID NO: 175668

SEQ ID NO: 270712 - RNA, 64 nt, hsa; identical to SEQ ID NO: 175669

SEQ ID NO: 270713 - RNA, 64 nt, hsa; identical to SEQ ID NO: 175670

SEQ ID NO: 270714 - RNA, 64 nt, hsa; identical to SEQ ID NO: 175671

SEQ ID NO: 270715 - RNA, 64 nt, hsa; identical to SEQ ID NO: 175672

SEQ ID NO: 270716 - RNA, 64 nt, hsa; identical to SEQ ID NO: 175673

SEQ ID NO: 270717 - RNA, 64 nt, hsa; identical to SEQ ID NO: 175674

SEQ ID NO: 270718 - RNA, 64 nt, hsa; identical to SEQ ID NO: 175675

SEQ ID NO: 270719 - RNA, 64 nt, hsa; identical to SEQ ID NO: 175676

SEQ ID NO: 270720 - RNA, 64 nt, hsa; identical to SEQ ID NO: 175677

SEQ ID NO: 270721 - RNA, 64 nt, hsa; identical to SEQ ID NO: 175678

SEQ ID NO: 270722 - RNA, 64 nt, hsa; identical to SEQ ID NO: 175679

SEQ ID NO: 270723 - RNA, 64 nt, hsa; identical to SEQ ID NO: 175680

SEQ ID NO: 270724 - RNA, 64 nt, hsa; identical to SEQ ID NO: 175681

SEQ ID NO: 270725 - RNA, 64 nt, hsa; identical to SEQ ID NO: 175682

SEQ ID NO: 270726 - RNA, 64 nt, hsa; identical to SEQ ID NO: 175683

SEQ ID NO: 270727 - RNA, 64 nt, hsa; identical to SEQ ID NO: 175684

SEQ ID NO: 270728 - RNA, 64 nt, hsa; identical to SEQ ID NO: 175685

SEQ ID NO: 270729 - RNA, 64 nt, hsa; identical to SEQ ID NO: 175686

SEQ ID NO: 270730 - RNA, 64 nt, hsa; identical to SEQ ID NO: 175687

SEQ ID NO: 270731 - RNA, 64 nt, hsa; identical to SEQ ID NO: 175688

SEQ ID NO: 270732 - RNA, 64 nt, hsa; identical to SEQ ID NO: 175689

SEQ ID NO: 270733 - RNA, 64 nt, hsa; identical to SEQ ID NO: 175690

SEQ ID NO: 270734 - RNA, 64 nt, hsa; identical to SEQ ID NO: 175691

SEQ ID NO: 270735 - RNA, 64 nt, hsa; identical to SEQ ID NO: 175692

SEQ ID NO: 270736 - RNA, 64 nt, hsa; identical to SEQ ID NO: 175693

SEQ ID NO: 270737 - RNA, 64 nt, hsa; identical to SEQ ID NO: 175694

SEQ ID NO: 270738 - RNA, 64 nt, hsa; identical to SEQ ID NO: 175695

SEQ ID NO: 270739 - RNA, 64 nt, hsa; identical to SEQ ID NO: 175696

SEQ ID NO: 270740 - RNA, 64 nt, hsa; identical to SEQ ID NO: 175697

SEQ ID NO: 270741 - RNA, 64 nt, hsa; identical to SEQ ID NO: 175698

SEQ ID NO: 270742 - RNA, 64 nt, hsa; identical to SEQ ID NO: 175699

SEQ ID NO: 270743 - RNA, 64 nt, hsa; identical to SEQ ID NO: 175700

SEQ ID NO: 270744 - RNA, 64 nt, hsa; identical to SEQ ID NO: 175701

SEQ ID NO: 270745 - RNA, 64 nt, hsa; identical to SEQ ID NO: 175702

SEQ ID NO: 270746 - RNA, 64 nt, hsa; identical to SEQ ID NO: 175703

SEQ ID NO: 270747 - RNA, 64 nt, hsa; identical to SEQ ID NO: 175704

SEQ ID NO: 270748 - RNA, 64 nt, hsa; identical to SEQ ID NO: 175705

SEQ ID NO: 270749 - RNA, 64 nt, hsa; identical to SEQ ID NO: 175706

SEQ ID NO: 270750 - RNA, 64 nt, hsa; identical to SEQ ID NO: 175707

SEQ ID NO: 270751 - RNA, 64 nt, hsa; identical to SEQ ID NO: 175708

SEQ ID NO: 270752 - RNA, 64 nt, hsa; identical to SEQ ID NO: 175709

SEQ ID NO: 270753 - RNA, 64 nt, hsa; identical to SEQ ID NO: 175710

SEQ ID NO: 270754 - RNA, 64 nt, hsa; identical to SEQ ID NO: 175711

SEQ ID NO: 270755 - RNA, 64 nt, hsa; identical to SEQ ID NO: 175712

SEQ ID NO: 270756 - RNA, 64 nt, hsa; identical to SEQ ID NO: 175713

SEQ ID NO: 270757 - RNA, 64 nt, hsa; identical to SEQ ID NO: 175714

SEQ ID NO: 270758 - RNA, 64 nt, hsa; identical to SEQ ID NO: 175715

SEQ ID NO: 270759 - RNA, 64 nt, hsa; identical to SEQ ID NO: 175716

SEQ ID NO: 270760 - RNA, 64 nt, hsa; identical to SEQ ID NO: 175717

SEQ ID NO: 270761 - RNA, 64 nt, hsa; identical to SEQ ID NO: 175718

SEQ ID NO: 270762 - RNA, 64 nt, hsa; identical to SEQ ID NO: 175719

SEQ ID NO: 270763 - RNA, 64 nt, hsa; identical to SEQ ID NO: 175720

SEQ ID NO: 270764 - RNA, 64 nt, hsa; identical to SEQ ID NO: 175721

SEQ ID NO: 270765 - RNA, 64 nt, hsa; identical to SEQ ID NO: 175722

SEQ ID NO: 270766 - RNA, 64 nt, hsa; identical to SEQ ID NO: 175723

SEQ ID NO: 270767 - RNA, 64 nt, hsa; identical to SEQ ID NO: 175724

SEQ ID NO: 270768 - RNA, 64 nt, hsa; identical to SEQ ID NO: 175725

SEQ ID NO: 270769 - RNA, 64 nt, hsa; identical to SEQ ID NO: 175726

SEQ ID NO: 270770 - RNA, 64 nt, hsa; identical to SEQ ID NO: 175727

SEQ ID NO: 270771 - RNA, 64 nt, hsa
ugacaaggaaggcuaauucuaaaccugaaggcauccuugaaaucaugcuugaauauugcuuuga

SEQ ID NO: 270772 - RNA, 64 nt, hsa
ucagcugaucuuaacaaaauucguagcaguggaaccuugaaaugcauguggcuagauuuaugcu

SEQ ID NO: 270773 - RNA, 64 nt, hsa
augaaguacucacacaugccacaacauggaugagccuugaaaacuugcuaagugaaagaagcca

SEQ ID NO: 270774 - RNA, 64 nt, hsa
aagaaaugcaagggacccagaauauccaaauaagccuugaaaaagaacaaaguugguggauuca

SEQ ID NO: 270775 - RNA, 64 nt, hsa
cacagguggccccugcauucagguggauguccauccuugaaacagccucuucugggaacacagc

SEQ ID NO: 270776 - RNA, 64 nt, hsa
gccugacaguggguuccuuccauggcggauacucccuugaaauuucacauuccaucaaaguuua

SEQ ID NO: 270777 - RNA, 64 nt, hsa
aaauggaaaaaccuauuagguaaauggaaauaauccuugaaaauaguuuuugauguuuugugau

SEQ ID NO: 270778 - RNA, 64 nt, hsa
gagguaaagaaaauaauuuucaaauugcagacuuccuugaaaggcucaagacuguagcauggug

SEQ ID NO: 270779 - RNA, 64 nt, hsa
uaguaccauuuugauuagucugaauguuuucaggccuugaaauaaauuuugacuaagugauauu

SEQ ID NO: 270780 - RNA, 64 nt, hsa
gaaauaguuauaaaauuauuuuuaauauuuaaggccuugaaauuauauuccaaggcaaaucuaa

SEQ ID NO: 270781 - RNA, 64 nt, hsa
uuuaugaaaugccuacugugugcaagucauccauccuugaaaaggccacuucucagugagggag

SEQ ID NO: 270782 - RNA, 64 nt, hsa
auaugggcauacaacugcuacugaaguuauauagccuugaaaacucagugcagguugcccuuaa

SEQ ID NO: 270783 - RNA, 64 nt, hsa
uuacaaaacaagaaaaaaaauacccuuuucuuuuccuugaaaauguugcaguaaaauuuaaaug

SEQ ID NO: 270784 - RNA, 64 nt, hsa
aguuuuucuacugccauucaauuugaugugagugccuugaaaacugaucuuccuauuugagucu

SEQ ID NO: 270785 - RNA, 64 nt, hsa
gagcaccagacucaagaccaugaccuucuuugauccuugaaaaugggaacuuugacagccauga

SEQ ID NO: 270786 - RNA, 64 nt, hsa
ucugcuucucuuggcugggggacucuggugccagccuugaaagucauggucgugggcccuuucc

SEQ ID NO: 270787 - RNA, 64 nt, hsa
uuuggucauaugagaagcaggugcgcagagaauuccuugaaagaucugagguuuuuaacaugaa

SEQ ID NO: 270788 - RNA, 64 nt, hsa
cuuccuuuuaccuagaaugccucauuuaaaagugccuugaaaacauuuagcuccccuucuucau

SEQ ID NO: 270789 - RNA, 64 nt, hsa
ccacauauucggacuuaguaaauuagaacuccuaccuugaaacccagaugaagguucaauuuuc

SEQ ID NO: 270790 - RNA, 64 nt, hsa
acaugcugaucuccaggugcaccacgauuugugcccuugaaaaugcuguuugcucaaucuuucu

SEQ ID NO: 270791 - RNA, 64 nt, hsa
uaauuuaauguuuuuucuuuguaccugaugugaauucuagcaaccuuuguuaggaaaaagcaca

SEQ ID NO: 270792 - RNA, 64 nt, hsa
auuuaugaauccaagggguggcagcaucacucuguucuagcauucuuuguggagauggucuggu

SEQ ID NO: 270793 - RNA, 64 nt, hsa
cuuuagauaaacaagagacauuuucauaauugcuuucuagcaaucagcuuuuauuugccuuaau

SEQ ID NO: 270794 - RNA, 64 nt, hsa
uggccucuguccucuuuuagucuagugucugguuuucuagcaaacaguaaauuuaaacaaguaa

SEQ ID NO: 270795 - RNA, 64 nt, hsa
uaaacaaggcugguggcugucuacccacccucccuucuagcagauuuugauuuuguuucaauuu

SEQ ID NO: 270796 - RNA, 64 nt, hsa
ugugacggggcggguggcgucuacccacccucccuucuagcagauucuuauuuuguuugaauuu

SEQ ID NO: 270797 - RNA, 64 nt, hsa
ccuuuccaaccccuuugcugguugcugggccucauucuagcaccuuguucuuagagcagauucu

SEQ ID NO: 270798 - RNA, 64 nt, hsa
gggccucauucuagcaccuuguucuuagagcagauucuagcacaucauggcagugggaccaagc

SEQ ID NO: 270799 - RNA, 64 nt, hsa
cagaaggaaggauggugcaaauuagcuuuuuaucuucuagcauuuuuuuacuaccuauaugggu

SEQ ID NO: 270800 - RNA, 64 nt, hsa
cucuaugacccuacaaccaucaugaaugcagauauucuagcauauugucagaaggaaggauggu

SEQ ID NO: 270801 - RNA, 64 nt, hsa
gugauuuagcaggaagcugugagagcaguuugguuucuagcaugaagacagagccccacccuca

SEQ ID NO: 270802 - RNA, 63 nt, hsa
ggagcccugucuccucucucuguaauaaacucauuucuagcagacacugcucugccauguuuu

SEQ ID NO: 270803 - RNA, 64 nt, hsa
guauguacaauccugggcauugacucugugacauuucuagcauauccaaggcaccaccagugau

SEQ ID NO: 270804 - RNA, 64 nt, hsa
cauaccacagggaaauaccuuuccugggcuuguuuucuagcauaucacugaccugggaucuuug

SEQ ID NO: 270805 - RNA, 64 nt, hsa
ugagaugcccaggaggaggagcccuagggaagaagucagggacagggaccaggauaccacucug

SEQ ID NO: 270806 - RNA, 64 nt, hsa
gggauaaaugugacaacugugcauugaacccugggucagggacguuccaauggccaagagagug

SEQ ID NO: 270807 - RNA, 64 nt, hsa
gcaaaggcagcacguaauguguaaguucuagaucgucagggaggaagggucaguugggugccug

SEQ ID NO: 270808 - RNA, 64 nt, hsa
guggaggcagcacggaacauguagguuauagaucgucagggaggaggggucaguugggugcuug

SEQ ID NO: 270809 - RNA, 64 nt, hsa
ccuucgcugugcuagaguuguguuguaggaauuagucagggaguuguugugaaaaaaaaaaccc

SEQ ID NO: 270810 - RNA, 64 nt, hsa
gcuccucagagagggcagcggugccaggccucaggucagggagaaugucugugacuuagcugca

SEQ ID NO: 270811 - RNA, 64 nt, hsa
gucacaggcgccccaccauucaaccuuccgggaggucagggaccuucuauaugaggcgaguggg

SEQ ID NO: 270812 - RNA, 64 nt, hsa
uaggaacucccuuuugcaaaaaagaaaccugggugucagggaggugaagugacuugcccuagga

SEQ ID NO: 270813 - RNA, 64 nt, hsa
guggcgauccgguugcacacuggccucuguggaggucagggaggugggaaggugggugggccug

SEQ ID NO: 270814 - RNA, 64 nt, hsa
uggccaggccccaugguccugcucugggucagcugucagggagaccucccuucagccugagcca

SEQ ID NO: 270815 - RNA, 64 nt, hsa
uccccagggccaagcgcuggggggaagacggggagucagggagggggggaaaucucggaagagg

SEQ ID NO: 270816 - RNA, 64 nt, hsa
agcccaauuaggugccugcacccgcccgguggacgucagggacucggggggcaggccccuccca

SEQ ID NO: 270817 - RNA, 64 nt, hsa
cugauguaaaaaucaugcuggcauccaugaacacaccgguaaauaaaacauaguccaaguggaa

SEQ ID NO: 270818 - RNA, 64 nt, hsa
uucugaaaugaaauguuuguuuagacgagaucauaccgguaaagcaggaaugacaaagcuugcu

SEQ ID NO: 270819 - RNA, 64 nt, hsa
agagaacuugagcuuacuuacguacuucaaugccaccgguaacuuagguuuuaccaccaaaugc

SEQ ID NO: 270820 - RNA, 64 nt, hsa
uuuuuugucauuccauaagcuugcugaauaguguaccgguaauauauuguauuuccaccguacu

SEQ ID NO: 270821 - RNA, 64 nt, hsa
cagcauacacacagggaacaaacacauaccacaaaccgguaacuguaccugucacccuccuugu

SEQ ID NO: 270822 - RNA, 64 nt, hsa
aaaauacaaaaauuauccgggcaugggggcacacaccgguaaucccagcuacucaggaggcuga

SEQ ID NO: 270823 - RNA, 64 nt, hsa
cauaaauugcaucacuguaucauuuucuuuuuuaaccgguaagaguuucaguuuguuggaaagu

SEQ ID NO: 270824 - RNA, 64 nt, hsa
aguggaaaaccgaaaaaaaaaaacagaaaaaucuaccgguaauuucccaauagcuuugaauauu

SEQ ID NO: 270825 - RNA, 64 nt, hsa
gagaucuccacaacuccuuggcuuaaacagcuccaccgguaaaaaaaaaaaaaaaaaaaaaaaa

SEQ ID NO: 270826 - RNA, 64 nt, hsa
auaacgagacuuugggucggaugcaggggcucacaccgguaaucccagcacuuugagaggcuga

SEQ ID NO: 270827 - RNA, 64 nt, hsa
aguaaaugcauuaaggccaagugcaguggcucacaccgguaaucccagcacuuugggaggccga

SEQ ID NO: 270828 - RNA, 64 nt, hsa
acccugggcucuggucuguagguuuguaguagccaccgguaauaagccaagggcuaggcucuug

SEQ ID NO: 270829 - RNA, 64 nt, hsa
acuugugccucccaucccuggaguacugacuggcaccgguaagacagaaucucuuugaauccau

SEQ ID NO: 270830 - RNA, 64 nt, hsa
ugucaccaaacagaccaucuucccaggccuggggaccgguaagauccaugucacuaguuaugca

SEQ ID NO: 270831 - RNA, 64 nt, hsa
uuaccacugagauacacuauuugauccauggauaaccgguaaugggaaaaugcuccgacccuca

SEQ ID NO: 270832 - RNA, 64 nt, hsa
auuuaggacucgucguagacaagccagagaacaaaccgguaagauggcagaucaccuugaaggc

SEQ ID NO: 270833 - RNA, 64 nt, hsa
ggagaaugacuccaaagguuugagcuuggcuagaaccgguaagauggugacauuguugaucaag

SEQ ID NO: 270834 - RNA, 64 nt, hsa
gcugcuuucccagaaauucacgcuuaaacaaccaaccgguaaccaccacuuccccacaccgccg

SEQ ID NO: 270835 - RNA, 64 nt, hsa
gagaaauuacaaagcccgagcucuuucuuauaaugccaccuaucccuguaagcuaaacaaacaa

SEQ ID NO: 270836 - RNA, 64 nt, hsa
auacaacuacaaggaaaaaaaugcauuuaaccaugccaccuaugagugccagugacuuauuuua

SEQ ID NO: 270837 - RNA, 64 nt, hsa
accaaagaggaccccacucugaagccagccuggagccaccuaccucuggccucaggcugugggc

SEQ ID NO: 270838 - RNA, 64 nt, hsa
cuggagcaucugaucugucucuaugccaccacuggccaccuagagcccuuggcugugguaaucc

SEQ ID NO: 270839 - RNA, 64 nt, hsa; identical to SEQ ID NO: 98571

SEQ ID NO: 270840 - RNA, 64 nt, hsa; identical to SEQ ID NO: 98572

SEQ ID NO: 270841 - RNA, 64 nt, hsa; identical to SEQ ID NO: 98573

SEQ ID NO: 270842 - RNA, 64 nt, hsa; identical to SEQ ID NO: 98574

SEQ ID NO: 270843 - RNA, 64 nt, hsa; identical to SEQ ID NO: 98575

SEQ ID NO: 270844 - RNA, 64 nt, hsa; identical to SEQ ID NO: 98576

SEQ ID NO: 270845 - RNA, 64 nt, hsa; identical to SEQ ID NO: 189259

SEQ ID NO: 270846 - RNA, 64 nt, hsa; identical to SEQ ID NO: 189260

SEQ ID NO: 270847 - RNA, 64 nt, hsa; identical to SEQ ID NO: 189261

SEQ ID NO: 270848 - RNA, 64 nt, hsa; identical to SEQ ID NO: 189262

SEQ ID NO: 270849 - RNA, 56 nt, hsa; identical to SEQ ID NO: 189263

SEQ ID NO: 270850 - RNA, 64 nt, hsa; identical to SEQ ID NO: 189264

SEQ ID NO: 270851 - RNA, 64 nt, hsa; identical to SEQ ID NO: 189265

SEQ ID NO: 270852 - RNA, 64 nt, hsa; identical to SEQ ID NO: 189266

SEQ ID NO: 270853 - RNA, 64 nt, hsa; identical to SEQ ID NO: 189267

SEQ ID NO: 270854 - RNA, 64 nt, hsa; identical to SEQ ID NO: 189268

SEQ ID NO: 270855 - RNA, 64 nt, hsa; identical to SEQ ID NO: 189269

SEQ ID NO: 270856 - RNA, 64 nt, hsa; identical to SEQ ID NO: 189270

SEQ ID NO: 270857 - RNA, 64 nt, hsa; identical to SEQ ID NO: 189271

SEQ ID NO: 270858 - RNA, 64 nt, hsa; identical to SEQ ID NO: 189272

SEQ ID NO: 270859 - RNA, 64 nt, hsa; identical to SEQ ID NO: 189273

SEQ ID NO: 270860 - RNA, 64 nt, hsa; identical to SEQ ID NO: 189274

SEQ ID NO: 270861 - RNA, 64 nt, hsa; identical to SEQ ID NO: 189275

SEQ ID NO: 270862 - RNA, 64 nt, hsa; identical to SEQ ID NO: 189276

SEQ ID NO: 270863 - RNA, 64 nt, hsa; identical to SEQ ID NO: 189277

SEQ ID NO: 270864 - RNA, 64 nt, hsa; identical to SEQ ID NO: 189278

SEQ ID NO: 270865 - RNA, 64 nt, hsa; identical to SEQ ID NO: 189279

SEQ ID NO: 270866 - RNA, 64 nt, hsa; identical to SEQ ID NO: 189280

SEQ ID NO: 270867 - RNA, 64 nt, hsa
uauuugaaccuuuggaacuugggaguucucauuguaacccuaacaugugagaauaaaaugucuu

SEQ ID NO: 270868 - RNA, 64 nt, hsa
ggagaggucgugaggccagcucccggggccccuguaacccuacucuccucucucccuggaccuc

SEQ ID NO: 270869 - RNA, 64 nt, hsa
aauucugccugccuccucccucccagcugcacuuuaacccuagaagguggggaccuggggggag

SEQ ID NO: 270870 - RNA, 64 nt, hsa
ugcuuuucuguauuguuucacuccguauguaacauaacccuaaauaaauuauuucguauuugag

SEQ ID NO: 270871 - RNA, 64 nt, hsa
gaaaaugaaagguugcaccucauuuaaugaagcuuaacccuauguagaaagucucuuucggggg

SEQ ID NO: 270872 - RNA, 64 nt, hsa
uugccauguguauaaagcuuuauucuuuagcccuuaacccuaaggcucagggaaauacccuaug

SEQ ID NO: 270873 - RNA, 64 nt, hsa
caguauuuaaaaagacauguuugcauugagaaauuaacccuaaaggguuuucaauaggguguag

SEQ ID NO: 270874 - RNA, 64 nt, hsa
gugaugaccaugcaccuuacaauuucugaacaguuaacccuauagaagcaugcuuuauaugagu

SEQ ID NO: 270875 - RNA, 64 nt, hsa
auauuagggguaacgaccgcuugucuuuggucucuaacccuaaucucugggcuugcccuuugcc

SEQ ID NO: 270876 - RNA, 64 nt, hsa
ccuccaggcccaucucaaaucacaaggauuucucuaacccuauccuaauuguccacauacgugg

SEQ ID NO: 270877 - RNA, 64 nt, hsa
uugagauuauuauauacuguauuuucuucuaaauuaacccuaauguuuaaaaacucacuuuccc

SEQ ID NO: 270878 - RNA, 64 nt, hsa
acuaaaacacugaaaaauauuccaagcuucauauuaacccuaccugucaacguaacgauuucau

SEQ ID NO: 270879 - RNA, 64 nt, hsa
ucugaggauuauuuaaccauuguucuauuuggcauaacccuauuuaauggugcuuagagcugaa

SEQ ID NO: 270880 - RNA, 64 nt, hsa
gagacucuuuugcucaacauuaaauugugcuuccuaacccuaaaucuguccagaguaggaacau

SEQ ID NO: 270881 - RNA, 64 nt, hsa
cagaauguguuaaauagauuaagacacaguaaguuaacccuacauguuauaaagauggcgacug

SEQ ID NO: 270882 - RNA, 64 nt, hsa
uuaagagcuaaccaguuaccacacaucuaugauauaacccuaacacacacagaaaagcauacau

SEQ ID NO: 270883 - RNA, 64 nt, hsa
uaucuaaaaguaaguguuuuccggcugauaaggcuaacccuacccaggaaaggauugauaacua

SEQ ID NO: 270884 - RNA, 64 nt, hsa
gaugaaacuuuguacaguauaugaaacaguauauuaacccuaaaaccuagauguuguccaccug

SEQ ID NO: 270885 - RNA, 64 nt, hsa
uuguggcccacucaacucuuggggcaguggcccguaacccuaguuugccugaggcccuuauguc

SEQ ID NO: 270886 - RNA, 64 nt, hsa
ugacucucuuuuucacuguagaauaauguggaaauaacccuagauaaaaauucagucugauaac

SEQ ID NO: 270887 - RNA, 64 nt, hsa
ggcucccaggaugguaccauugcucuuuccuagcuaacccuagauauggcagcucuuuaaugua

SEQ ID NO: 270888 - RNA, 64 nt, hsa
uccuaccguuucauagucuuugucuaacugcuaguaacccuaccgaguuuuauauaugaguggg

SEQ ID NO: 270889 - RNA, 64 nt, hsa
cuuuucaaucccaucuagauaauuuauagaaauauaacccuaauuggacaugugguacaggauc

SEQ ID NO: 270890 - RNA, 64 nt, hsa
augccugcccugcgugcugguuccuucagaccccuaacccuacuaaccagcaggcucaucucac

SEQ ID NO: 270891 - RNA, 64 nt, hsa
aguugaaaaacucugggguguaaacaaaugauuguaacccuacacacuauucaauaaguaguag

SEQ ID NO: 270892 - RNA, 64 nt, hsa
cuuuauuggguuuuuauuguuguuguuugaucccuaacccuacaaagagccuuccuauuccccu

SEQ ID NO: 270893 - RNA, 64 nt, hsa
uuauucauugguggaaccaaaccaccuuagugaguaacccuaagaauugacacaaaucucauau

SEQ ID NO: 270894 - RNA, 64 nt, hsa
gugucggggaaauaguuugcagauaauggaggaguaacccuacaacuauauguccuuaguucuu

SEQ ID NO: 270895 - RNA, 64 nt, hsa
gaacuaagucaggauguuaacagaaaaguccacauaacccuagaauucuuagucaaggaauaau

SEQ ID NO: 270896 - RNA, 64 nt, hsa
cagcugagaaaggacaacuggguuccgcuuuccuuaacccuacacccuuuagcuggaugcuguc

SEQ ID NO: 270897 - RNA, 64 nt, hsa
aggaauuuuagaagagguagagaaaauggaacauuaacccuacacucggaauucccugaagcaa

SEQ ID NO: 270898 - RNA, 64 nt, hsa
ggguaggauuaaguaggugaguuuaauuaaagcuuaacccuagguaagaguaaaugagaaauau

SEQ ID NO: 270899 - RNA, 64 nt, hsa
ugccggucagguauccccccaaagaccccagaaguaacccuaggcucaauggaggggucugggg

SEQ ID NO: 270900 - RNA, 64 nt, hsa
acucuacuuccucuucagucugugguacuccuccuaacccuaaacccucuaugcucaggggcug

SEQ ID NO: 270901 - RNA, 64 nt, hsa
guacuauuauaacuagaguagaucugaaugaggauaacccuaaaaucaugaggaauggaagaau

SEQ ID NO: 270902 - RNA, 64 nt, hsa
cugucaagcuuuggggccacaaaauaauuuaauauaacccuaagcaaaaugcagugacggaguu

SEQ ID NO: 270903 - RNA, 64 nt, hsa
uuccuacacccccacaacccaucacuucugguguuaacccuaaaauacccacauguauugagcu

SEQ ID NO: 270904 - RNA, 64 nt, hsa
auugugauuuccugagaaucgaaccuugguucccuaacccuaauugaugagaggcucgcugcuu

SEQ ID NO: 270905 - RNA, 64 nt, hsa
cauggacgagaugggaaggcacagggagaagggauaacccuacacccagaccccaggcuggaca

SEQ ID NO: 270906 - RNA, 64 nt, hsa
agauccaaccauggauucgagguauuauacuguauaacccuacaaaauacauagaaguauuauu

SEQ ID NO: 270907 - RNA, 64 nt, hsa
ggccgccaccugaggugggcuggggcugcuccccuaacccuacuuugcuuccgccacucagcca

SEQ ID NO: 270908 - RNA, 50 nt, hsa
uccugaggcccuacaaauaguaacccuaggcucagagacccaauuuuuua

SEQ ID NO: 270909 - RNA, 64 nt, hsa
gguaugguggugccuguuggugguguucuugucuuaacccuagauagaaucuaaugaacucaga

SEQ ID NO: 270910 - RNA, 64 nt, hsa
ugccucaucuucaacuuuagugcuccccuuuaccuaacccuacggccucccaugcaucuguacu

SEQ ID NO: 270911 - RNA, 64 nt, hsa
ccucuagaggaauagaaacaaauuuuuaugagcauaacccuauauaaagacaaaaugaauuucu

SEQ ID NO: 270912 - RNA, 64 nt, hsa
uuuuugaagugucucaaaaauauuuuacuaacuguaacccuaaaauugaugucuuuugguuuau

SEQ ID NO: 270913 - RNA, 64 nt, hsa
gaggagugguauuugaugcuuucuguggacaauguaacccuaaacacaucauguauuuuaaaug

SEQ ID NO: 270914 - RNA, 64 nt, hsa
cuuucauuucuaugggccaaacaaaggccauggauaacccuacccgcuuuaugucauuacccau

SEQ ID NO: 270915 - RNA, 64 nt, hsa
guguucccuuuuucauaauuacucuacuucccaguaacccuaaggaaguugcuaacuuaaaaaa

SEQ ID NO: 270916 - RNA, 64 nt, hsa
auacuauaguauucuauaauuucaaacuuugugguaacccuacauuuuauaguugccauaucaa

SEQ ID NO: 270917 - RNA, 64 nt, hsa
uuauagagaauauaaaaguauaaaacauuaaaaauaacccuagauauacuuuaaaauaauguua

SEQ ID NO: 270918 - RNA, 64 nt, hsa
ucuccaaguaagcacaggcuucuguccuacucuguaacccuagagggcaccucugcugagguca

SEQ ID NO: 270919 - RNA, 64 nt, hsa
cacugcucugcgauuuggcaggaaauaaggcgauuaacccuauguguccacaagccucaagccu

SEQ ID NO: 270920 - RNA, 64 nt, hsa
uacuuugacuauucuaauguuuaauuacauaugguaacccuaaggccuggggagaaaagcuuuu

SEQ ID NO: 270921 - RNA, 64 nt, hsa
gucugcuguuaagggauuuuaaauugugcauuuuuaacccuacagugaaauaacuuaagauauc

SEQ ID NO: 270922 - RNA, 64 nt, hsa
guaaagcacuuguugcuuugcugaaaacuaugguuaacccuauauaggugugggaaauuuuugu

SEQ ID NO: 270923 - RNA, 64 nt, hsa
ugguuauuucuaaaaucacugucaacaauaaaucuaacccuaguuguaucccuccuuucaguau

SEQ ID NO: 270924 - RNA, 64 nt, hsa
uaaauguuaaaaauuguccaaucuggugaaugucuaacccuaaaguuuaaaaauuucugccucc

SEQ ID NO: 270925 - RNA, 64 nt, hsa
ggggcauaagcugaucaccgucuaguugggaaaguaacccuacaggguuuguagggacaugauc

SEQ ID NO: 270926 - RNA, 64 nt, hsa
auauaauuguguuguauagucucagaguacauucuaacccuacauuucuaaucauuguuauugg

SEQ ID NO: 270927 - RNA, 64 nt, hsa
gagaauucucuguacuuuuugcucaauuuuucuguaacccuaaagcugcucuaaaaaaugaagu

SEQ ID NO: 270928 - RNA, 64 nt, hsa
gagggggucaguguuuccuggggggaccaugcucuaacccuaguccaggcggaccucacccuuc

SEQ ID NO: 270929 - RNA, 64 nt, hsa
uaguugaccugcacagcuugguuagaccuagauuuaacccuaagguaagaugcugggguauaga

SEQ ID NO: 270930 - RNA, 64 nt, hsa
aguuucagggcuaacgaccacagggucugcacucuaacccuaggcaucacaugcucaaugacuc

SEQ ID NO: 270931 - RNA, 64 nt, hsa
auuauuugauuauuuaagacuaaaaguugcauuuuaacccuauuuuaccuagcuaauuauuuaa

SEQ ID NO: 270932 - RNA, 64 nt, hsa
uuuuuucaauguuugaaauaguucaaacugcagcuaacccuagucaaaacuauuuuuguaaaag

SEQ ID NO: 270933 - RNA, 64 nt, hsa
cugucuauaagagaauuauauauuucuaacuauauaacccuaggaauuuagacaaccugaaauu

SEQ ID NO: 270934 - RNA, 64 nt, hsa
aauauuuucaacugauaguagguuuauugggauguaacccuaugauaaguugagaaacaucucu

SEQ ID NO: 270935 - RNA, 64 nt, hsa
acuuaaaguaaugaaugacguuuuaaggaaucccuaacccuacuaucagaaaagguguuuguua

SEQ ID NO: 270936 - RNA, 64 nt, hsa
auuacuaucuauuuaucuuauaucguagaucugauaacccuaucuaaaagaaagucacacgcua

SEQ ID NO: 270937 - RNA, 64 nt, hsa
aggcccuugacauuuugcguuuuaauauuucucuuaacccuauucucagggaagauggaauuua

SEQ ID NO: 270938 - RNA, 64 nt, hsa
caugagagauucaagaucagauucuaguguucaguaacccuaugugaaucagaugucuccugga

SEQ ID NO: 270939 - RNA, 64 nt, hsa
gaaacccauucauauucccaccaugauguaauuauaacccuacaauuacuucagguagcuacac

SEQ ID NO: 270940 - RNA, 64 nt, hsa
acaggucucuccaaagugaaugaacucuuacccauaacccuaaugaugcaagucauauggggga

SEQ ID NO: 270941 - RNA, 64 nt, hsa
cugccugggugaaugcugcuuguucucucaccccuaacccuaguaguuccuccacuaacuuucu

SEQ ID NO: 270942 - RNA, 64 nt, hsa
guugaccggaagggauuggaggcggcagaaccauuaacccuacacaagaacacuccagcccaaa

SEQ ID NO: 270943 - RNA, 64 nt, hsa
cucauugaucaaagguagggccaauuaaggauucuaacccuaacccagcaccacaaagcccccc

SEQ ID NO: 270944 - RNA, 64 nt, hsa
ucugaaagagaaaucaaugaagcaaguacaauguuaacccuaaauuaauaaaagaguuaacauc

SEQ ID NO: 270945 - RNA, 64 nt, hsa
agggagggcuggggcuggcaccacgcacagugccuaacccuagaaaagccaugucuucagccgc

SEQ ID NO: 270946 - RNA, 64 nt, hsa
uggcccuaaccugucugucuccguggaugcauccuaacccuaaggaaaauuccccaggcuguga

SEQ ID NO: 270947 - RNA, 64 nt, hsa
ggaagucugggcugggcaugguggcucacgccuguaacccuagcacuuuaggaaaucgaggcga

SEQ ID NO: 270948 - RNA, 64 nt, hsa
auuagauguccccuggcccucuguccccucuuaauaacccuagucacagucuccgcagauucuu

SEQ ID NO: 270949 - RNA, 64 nt, hsa
caauccagugcuucaguuugaaaauguaaaauucuaacccuaaaguaggguugguugaaauuuc

SEQ ID NO: 270950 - RNA, 64 nt, hsa
ucuggaaaaaaaagagaaggggguuuguaguacuuaacccuauuuauuuccguauauuuuaguu

SEQ ID NO: 270951 - RNA, 64 nt, hsa
caaaauccuucagaucuggaaaccggcucaguauuaacccuaccuuugguuguccugcccuacc

SEQ ID NO: 270952 - RNA, 64 nt, hsa
uugcugucuuaagaauaagaccugagauuaacacuaacccuagaauagaaauguaauagggaga

SEQ ID NO: 270953 - RNA, 64 nt, hsa
aggagaaaaaggaauggagcagagccuguaccccuaacccuaacagcuaaaucaaggaccucag

SEQ ID NO: 270954 - RNA, 64 nt, hsa
cccccagcccuccccgcagugggaagugaauccuuaacccuaaaauuuuaaggccacggccuug

SEQ ID NO: 270955 - RNA, 64 nt, hsa
aagaaaaugguaaugucugggaauccgagacacauaacccuaauucauaaaugggauuuggggu

SEQ ID NO: 270956 - RNA, 64 nt, hsa
uggguaagaugaaaaacuguggcccaacagggcuuaacccuauggauggugggauuuuuaucca

SEQ ID NO: 270957 - RNA, 64 nt, hsa
caggucuagacuauuaggugcaauuucaagguucuaacccuauacuguaguauucuuuggggug

SEQ ID NO: 270958 - RNA, 64 nt, hsa
uagugaauauggaaaaagguuucagccaaaggccuaacccuauucaacaccagaaaguuuacac

SEQ ID NO: 270959 - RNA, 64 nt, hsa
auuaugaugaucugaaauaacauuaauuugauuguaacccuauugggguuaguucccacccuuu

SEQ ID NO: 270960 - RNA, 64 nt, hsa
aauguuaguggcauauuugcuucuaauguuccccuaacccuacaugcauguuuuaugugcacuc

SEQ ID NO: 270961 - RNA, 64 nt, hsa
aaaaaacagaaagaaagaaaaagaaaacugcagauaacccuauacauuaauacugguaucucga

SEQ ID NO: 270962 - RNA, 64 nt, hsa
gggcuccauucccaauuccugggucaaggugaauuaacccuauguuggagcacuggaaaccguu

SEQ ID NO: 270963 - RNA, 64 nt, hsa
gcuguacccuuuaagauauccaucuuuuucuuuuuaacccuaaucuuucacuugaaagauuuua

SEQ ID NO: 270964 - RNA, 64 nt, hsa
acuucuguucaguaagaaucaugucuuacugaucuaacccuaaauccaacucauuuauacuuuu

SEQ ID NO: 270965 - RNA, 64 nt, hsa
aucacagcuuugugugugggcugagugcuggccuuaacccuaggcguggaagagaaaaugugag

SEQ ID NO: 270966 - RNA, 64 nt, hsa
agaugaacacuacuuuuuuaauuuuuuauuuuuuuaacccuacccuuaacccaugaacacuauu

SEQ ID NO: 270967 - RNA, 64 nt, hsa
aaacuggccuaaauggcuauguagaacauuucauuaacccuauaagucauucaguauucuuuuc

SEQ ID NO: 270968 - RNA, 64 nt, hsa
caagcuuuaggcuggucgcaguggcuuacacuuguaacccuagaacuugggaggcugagguggg

SEQ ID NO: 270969 - RNA, 64 nt, hsa
uuuuggaaaacgauuuaauuuauucuaauuagauuaacccuauuaaucuauggauuggguauca

SEQ ID NO: 270970 - RNA, 64 nt, hsa
ggcaaauuuaaaaaauaacacaauuucuugccuguaacccuagcacuuugggaggccgaggcag

SEQ ID NO: 270971 - RNA, 64 nt, hsa
gaguaacugauuuguaacaagccuccuuuuaaaguaacccuacaaaaccacuggaaaguuuaug

SEQ ID NO: 270972 - RNA, 64 nt, hsa
cgguuaagcccacccccuguuaacugccuauuuauaacccuaggauccuccuuauggagaacua

SEQ ID NO: 270973 - RNA, 64 nt, hsa
aucacccaccucauugauccacugaccaaauccuuaacccuagcgauggcuugggagauggggg

SEQ ID NO: 270974 - RNA, 64 nt, hsa
uuaguucagggcugggcgcgguggcucaugccuguaacccuagcacuuugggaggcugaggcgg

SEQ ID NO: 270975 - RNA, 64 nt, hsa; identical to SEQ ID NO: 184094

SEQ ID NO: 270976 - RNA, 64 nt, hsa; identical to SEQ ID NO: 184095

SEQ ID NO: 270977 - RNA, 64 nt, hsa; identical to SEQ ID NO: 184096

SEQ ID NO: 270978 - RNA, 64 nt, hsa; identical to SEQ ID NO: 184097

SEQ ID NO: 270979 - RNA, 64 nt, hsa; identical to SEQ ID NO: 184098

SEQ ID NO: 270980 - RNA, 64 nt, hsa; identical to SEQ ID NO: 184099

SEQ ID NO: 270981 - RNA, 64 nt, hsa; identical to SEQ ID NO: 184100

SEQ ID NO: 270982 - RNA, 64 nt, hsa; identical to SEQ ID NO: 184101

SEQ ID NO: 270983 - RNA, 64 nt, hsa; identical to SEQ ID NO: 184102

SEQ ID NO: 270984 - RNA, 64 nt, hsa; identical to SEQ ID NO: 184103

SEQ ID NO: 270985 - RNA, 64 nt, hsa; identical to SEQ ID NO: 184104

SEQ ID NO: 270986 - RNA, 64 nt, hsa; identical to SEQ ID NO: 184105

SEQ ID NO: 270987 - RNA, 64 nt, hsa; identical to SEQ ID NO: 184106

SEQ ID NO: 270988 - RNA, 64 nt, hsa; identical to SEQ ID NO: 184107

SEQ ID NO: 270989 - RNA, 64 nt, hsa; identical to SEQ ID NO: 184108

SEQ ID NO: 270990 - RNA, 64 nt, hsa; identical to SEQ ID NO: 184109

SEQ ID NO: 270991 - RNA, 64 nt, hsa; identical to SEQ ID NO: 184110

SEQ ID NO: 270992 - RNA, 64 nt, hsa; identical to SEQ ID NO: 184111

SEQ ID NO: 270993 - RNA, 64 nt, hsa; identical to SEQ ID NO: 184112

SEQ ID NO: 270994 - RNA, 64 nt, hsa; identical to SEQ ID NO: 184113

SEQ ID NO: 270995 - RNA, 64 nt, hsa; identical to SEQ ID NO: 184114

SEQ ID NO: 270996 - RNA, 64 nt, hsa; identical to SEQ ID NO: 184115

SEQ ID NO: 270997 - RNA, 64 nt, hsa; identical to SEQ ID NO: 184116

SEQ ID NO: 270998 - RNA, 64 nt, hsa; identical to SEQ ID NO: 184117

SEQ ID NO: 270999 - RNA, 64 nt, hsa; identical to SEQ ID NO: 184118

SEQ ID NO: 271000 - RNA, 64 nt, hsa; identical to SEQ ID NO: 184119

SEQ ID NO: 271001 - RNA, 64 nt, hsa; identical to SEQ ID NO: 184120

SEQ ID NO: 271002 - RNA, 64 nt, hsa; identical to SEQ ID NO: 184121

SEQ ID NO: 271003 - RNA, 64 nt, hsa
uucucuggaccuaauugggcauugggcuuuagugagaccacagaccaggcccgucucuccugua

SEQ ID NO: 271004 - RNA, 64 nt, hsa
cccacuuacucuuuuuuuuuuuuucagagaccacagaccacagugauuuuucuuuucccuuguu

SEQ ID NO: 271005 - RNA, 64 nt, hsa
cacagaucccacuuacucuuuuuuuuuuuuucagagaccacagaccacagugauuuuucuuuuc

SEQ ID NO: 271006 - RNA, 64 nt, hsa
uuguuuuguuuuuuaaaaacacuguaacucaaugagaccacaguauacuuggcccuugguaaaa

SEQ ID NO: 271007 - RNA, 64 nt, hsa
uuuuguguguguuuuguuguuauuguugaggggaagaccacaugguucuucccccucagccauc

SEQ ID NO: 271008 - RNA, 64 nt, hsa
ggggaagggccagccacugacuacuugaucuuggagaccacauuuagauggaaaugagaggacc

SEQ ID NO: 271009 - RNA, 64 nt, hsa
ugggggguuagggcaagggguuccucuggauugcagaccacaucgcacagaccccuggcucuga

SEQ ID NO: 271010 - RNA, 64 nt, hsa
guauaaaauggucauggggaugaaaggaucucugagaccacagaggcucagacucacuguuaag

SEQ ID NO: 271011 - RNA, 64 nt, hsa
agccuguuucagaaaucuggagcuggcacuguggagaccacacacccuuugggaaagcucuugu

SEQ ID NO: 271012 - RNA, 64 nt, hsa
gcauaggccacacagcacaugcacacaggugcacagaccacacagcacacacaagugcacagag

SEQ ID NO: 271013 - RNA, 64 nt, hsa
agcucacacacaguauacacauacacaagugcacagaccacacacagcacuaacacaugcacac

SEQ ID NO: 271014 - RNA, 64 nt, hsa
aggcguacacaugcacgcuugcacacaugcacacagaccacauagcacacaugugcacugacca

SEQ ID NO: 271015 - RNA, 64 nt, hsa
gcuuuauuaauauagucgcucuucagccaugccuuugcugcagcugaaauggaagucagaagug

SEQ ID NO: 271016 - RNA, 64 nt, hsa
aacauuguaaacucuuugccaaaauccuggggcuuugcugcauucccuaagauaauuacaggaa

SEQ ID NO: 271017 - RNA, 64 nt, hsa
uguuuccuuugagguugaucguuguguuguuguuuugcugcacuuuuuacuuuuuugcgugugg

SEQ ID NO: 271018 - RNA, 57 nt, hsa
uucuuuuuguagauauuuaaacaagauuugcugcauuuccggcaaugcccugugcau

SEQ ID NO: 271019 - RNA, 64 nt, hsa
gagguucuagaauagaagggcugccaaaugagguuugcugcaggaggaaaguuuaaucccccau

SEQ ID NO: 271020 - RNA, 64 nt, hsa
uacauagagaaaaacgaucuuuuaagggucccuuuugcugcauuaucuguccaguuugacuuuu

SEQ ID NO: 271021 - RNA, 64 nt, hsa
ugguggcucugccccuugcugcagugagcccaccuugcugcaacauugguucugaggggcccaa

SEQ ID NO: 271022 - RNA, 64 nt, hsa
ugagcagaaggcaccguggugguggcucugccccuugcugcagugagcccaccuugcugcaaca

SEQ ID NO: 271023 - RNA, 64 nt, hsa
aaugcuguucagugaagauuucagccccaggccuuugcugcaagugacccuguggcaacagugg

SEQ ID NO: 271024 - RNA, 64 nt, hsa
cacacuggagcuacuuggacaagaccagcaugccuugcugcacguguguguauuucacugcuga

SEQ ID NO: 271025 - RNA, 64 nt, hsa
aauuauaaaaauaaaaucuuuaccugucgaauuguugcugcagaugauuguuguggaaaaucug

SEQ ID NO: 271026 - RNA, 64 nt, hsa
ccacaaauaggagcagcaugcaauuccuagugacuugcugcacaguauuguaucauaauuacag

SEQ ID NO: 271027 - RNA, 64 nt, hsa
cauuaugaaaaucuuauuccucagugagguuaucuugcugcacucuguagcaaauuuguuuaau

SEQ ID NO: 271028 - RNA, 64 nt, hsa
caaauuuguuuaaucuacauuauaauaaaauuucuugcugcagugcaacaggaggcuuuuucag

SEQ ID NO: 271029 - RNA, 64 nt, hsa
agcugcugacuaaucuucaucaccacuguagauuuugcugcaugugcagguccucuauuuuuaa

SEQ ID NO: 271030 - RNA, 64 nt, hsa
ugugcagguccucuauuuuuaauugcuguuuucguugcugcaguacuuuacaaacuucuaguuc

SEQ ID NO: 271031 - RNA, 64 nt, hsa
ccuucuugcugcauguacucagccucaggagagcuugcugcacccaggccgcccaggucuucac

SEQ ID NO: 271032 - RNA, 64 nt, hsa
ucagaagacgaugcggggcugugugccggccuucuugcugcauguacucagccucaggagagcu

SEQ ID NO: 271033 - RNA, 64 nt, hsa
uuugcucuugccaaaggucagugagugagugcauuugcugcagugguggcacguagagaacuag

SEQ ID NO: 271034 - RNA, 64 nt, hsa
uuuuuguaauauuuguaaauaugaacuuuuuaaauugcugcaaagaugguuucuuuuguaagau

SEQ ID NO: 271035 - RNA, 64 nt, hsa
uaggguucccacgaagcuccgaaacucuaaguguuugcugcaauuuuauaaggacuuccugauu

SEQ ID NO: 271036 - RNA, 64 nt, hsa
ugcacuuuucuaaacuaggcuccuucaacaaggcuugcugcagauacuacugaccagacaagcu

SEQ ID NO: 271037 - RNA, 64 nt, hsa
aaccaagcuguaucuucgccauugcaucuacucuuugcugcacacacugugcuugcuccuggcu

SEQ ID NO: 271038 - RNA, 64 nt, hsa
uauguuaugaugauuauuaauaauguuaaugauauugcugcaaauggugccauauauaagguua

SEQ ID NO: 271039 - RNA, 64 nt, hsa
cucagcacugccgcucaacagacaugacucagggauggcuuaguacugccccucagcagggaug

SEQ ID NO: 271040 - RNA, 64 nt, hsa
cucagcacugccgcucaacagggaugacucagggauggcuuaguacugccccucaacagggaug

SEQ ID NO: 271041 - RNA, 64 nt, hsa; identical to SEQ ID NO: 271039

SEQ ID NO: 271042 - RNA, 64 nt, hsa; identical to SEQ ID NO: 271039

SEQ ID NO: 271043 - RNA, 64 nt, hsa
cuguccuccuggacccaucugagaugugcaguagcaaggagaggggggaucauuuuagagagug

SEQ ID NO: 271044 - RNA, 64 nt, hsa
gacccagaaagcucuuuugaaaagacagacuccucaaggagagauaaagaggaaagcaccucuu

SEQ ID NO: 271045 - RNA, 64 nt, hsa
aacaaaguauagaaacauguucauugcacacacccaaggagaagagcucaagcgcuuggaagag

SEQ ID NO: 271046 - RNA, 64 nt, hsa
agcugucuccaccuccaggauguccagcaggcugcaaggagaaggaugccagccacccauccuc

SEQ ID NO: 271047 - RNA, 64 nt, hsa
gcaaggagacuuucucucaucuuuccaagcaaggcaaggagacuuuuuaucauuaggaaacaaa

SEQ ID NO: 271048 - RNA, 64 nt, hsa
aggaggaucucaucucucaucuguccaaacaaggcaaggagacuuucucucaucuuuccaagca

SEQ ID NO: 271049 - RNA, 64 nt, hsa
aagauuaggaugugaaagguuguccuaaacagaccaaggagacuguucccuaauuuauucucuu

SEQ ID NO: 271050 - RNA, 64 nt, hsa
uguugaaaaaaaauuuuuuuuuuuuggacagcuucaaggagauguuagcaauuucagauauacu

SEQ ID NO: 271051 - RNA, 64 nt, hsa
gaccuuaggauaugacuaacucaccaaacaaugccaaggagaaaggcggacaggucaccaucac

SEQ ID NO: 271052 - RNA, 64 nt, hsa
gucugaaaguguaggaggaaggaagagauacaaacaaggagaggaaaugaugggagaguguugu

SEQ ID NO: 271053 - RNA, 64 nt, hsa
uccuuucccuucucuccaguucuccuucccuuaccaaggagaggggagcaaaugguuuugggca

SEQ ID NO: 271054 - RNA, 64 nt, hsa
acuucuuuaucuuuuccuuucuucagacuccguccaaggagaugcucuccccggucuucugcug

SEQ ID NO: 271055 - RNA, 64 nt, hsa
aggagugcaucccauauaggccauuuuagaaggccaaggagagccacaccgaaaaaggagacag

SEQ ID NO: 271056 - RNA, 64 nt, hsa
aauauuggcaagaagguccccaggauagaccuagcaaggagauaagaauagaucauuaaaaaau

SEQ ID NO: 271057 - RNA, 64 nt, hsa
guucucuaccaagcuauccuggcucuuuggagaucaaggagaggaggcaacuuuccuuguuccc

SEQ ID NO: 271058 - RNA, 64 nt, hsa
gucucuggccuguuuuagaagguucucuccuccccaaggagacacaacaacuccuagggccacu

SEQ ID NO: 271059 - RNA, 64 nt, hsa
agcugcuuccccacgagcagcaggcaacggcguccaaggagacuaggaugaguucuuggcaagg

SEQ ID NO: 271060 - RNA, 64 nt, hsa
uuccaaaauuagcaucucauugagccagagaagacaaggagaucucccucugggcaucuggcuu

SEQ ID NO: 271061 - RNA, 64 nt, hsa
uucucuauggcucaccuuauuuggagugagaaaucaaggagacagagcugacugcaugaugagu

SEQ ID NO: 271062 - RNA, 64 nt, hsa
cagagggcaacaggaagaugcaggccuucaagggcaaggagaggccacaaggaauauggguggg

SEQ ID NO: 271063 - RNA, 64 nt, hsa
aaaagcucccacccugggacagcaugccacugagcaaggagagaugggugagccugaagauggu

SEQ ID NO: 271064 - RNA, 64 nt, hsa
cucaggagcucugagguggcacccugccugacuccaaggagaagacugguggcccuguguucca

SEQ ID NO: 271065 - RNA, 64 nt, hsa
cugauaaaauuuacaauagccacgcaauagccaucaaggagaauuucuauuaugauuauaaauu

SEQ ID NO: 271066 - RNA, 64 nt, hsa
cuucuuaacaccuccaccagggggaaggcuggcacaaggagaaaaaaaaagcaagcaucagcga

SEQ ID NO: 271067 - RNA, 64 nt, hsa
ccgggagcccagugccagccagagguugugcaggcaaggagaccaaagauugaugagaagaccc

SEQ ID NO: 271068 - RNA, 64 nt, hsa
uguacagggccaccagacuccuggagagaucaagcaaggagaaccuggggcugccauggccaaa

SEQ ID NO: 271069 - RNA, 64 nt, hsa; identical to SEQ ID NO: 147194

SEQ ID NO: 271070 - RNA, 64 nt, hsa; identical to SEQ ID NO: 147195

SEQ ID NO: 271071 - RNA, 64 nt, hsa; identical to SEQ ID NO: 147196

SEQ ID NO: 271072 - RNA, 64 nt, hsa; identical to SEQ ID NO: 147197

SEQ ID NO: 271073 - RNA, 64 nt, hsa; identical to SEQ ID NO: 147198

SEQ ID NO: 271074 - RNA, 64 nt, hsa; identical to SEQ ID NO: 147199

SEQ ID NO: 271075 - RNA, 64 nt, hsa; identical to SEQ ID NO: 147200

SEQ ID NO: 271076 - RNA, 64 nt, hsa; identical to SEQ ID NO: 147201

SEQ ID NO: 271077 - RNA, 64 nt, hsa; identical to SEQ ID NO: 147202

SEQ ID NO: 271078 - RNA, 64 nt, hsa; identical to SEQ ID NO: 147203

SEQ ID NO: 271079 - RNA, 64 nt, hsa; identical to SEQ ID NO: 147204

SEQ ID NO: 271080 - RNA, 64 nt, hsa; identical to SEQ ID NO: 147205

SEQ ID NO: 271081 - RNA, 64 nt, hsa; identical to SEQ ID NO: 147206

SEQ ID NO: 271082 - RNA, 64 nt, hsa; identical to SEQ ID NO: 147207

SEQ ID NO: 271083 - RNA, 64 nt, hsa; identical to SEQ ID NO: 147208

SEQ ID NO: 271084 - RNA, 64 nt, hsa; identical to SEQ ID NO: 147209

SEQ ID NO: 271085 - RNA, 64 nt, hsa; identical to SEQ ID NO: 147210

SEQ ID NO: 271086 - RNA, 64 nt, hsa; identical to SEQ ID NO: 147211

SEQ ID NO: 271087 - RNA, 64 nt, hsa; identical to SEQ ID NO: 147212

SEQ ID NO: 271088 - RNA, 64 nt, hsa; identical to SEQ ID NO: 147213

SEQ ID NO: 271089 - RNA, 64 nt, hsa; identical to SEQ ID NO: 147214

SEQ ID NO: 271090 - RNA, 64 nt, hsa; identical to SEQ ID NO: 147215

SEQ ID NO: 271091 - RNA, 64 nt, hsa; identical to SEQ ID NO: 147216

SEQ ID NO: 271092 - RNA, 64 nt, hsa; identical to SEQ ID NO: 147217

SEQ ID NO: 271093 - RNA, 64 nt, hsa; identical to SEQ ID NO: 147218

SEQ ID NO: 271094 - RNA, 64 nt, hsa; identical to SEQ ID NO: 147219

SEQ ID NO: 271095 - RNA, 64 nt, hsa; identical to SEQ ID NO: 147220

SEQ ID NO: 271096 - RNA, 64 nt, hsa; identical to SEQ ID NO: 147221

SEQ ID NO: 271097 - RNA, 64 nt, hsa; identical to SEQ ID NO: 147222

SEQ ID NO: 271098 - RNA, 64 nt, hsa; identical to SEQ ID NO: 147223

SEQ ID NO: 271099 - RNA, 64 nt, hsa; identical to SEQ ID NO: 147224

SEQ ID NO: 271100 - RNA, 64 nt, hsa; identical to SEQ ID NO: 147225

SEQ ID NO: 271101 - RNA, 64 nt, hsa; identical to SEQ ID NO: 147226

SEQ ID NO: 271102 - RNA, 64 nt, hsa; identical to SEQ ID NO: 147227

SEQ ID NO: 271103 - RNA, 64 nt, hsa; identical to SEQ ID NO: 147228

SEQ ID NO: 271104 - RNA, 64 nt, hsa; identical to SEQ ID NO: 147229

SEQ ID NO: 271105 - RNA, 64 nt, hsa; identical to SEQ ID NO: 147230

SEQ ID NO: 271106 - RNA, 64 nt, hsa; identical to SEQ ID NO: 147231

SEQ ID NO: 271107 - RNA, 64 nt, hsa; identical to SEQ ID NO: 147232

SEQ ID NO: 271108 - RNA, 64 nt, hsa; identical to SEQ ID NO: 147233

SEQ ID NO: 271109 - RNA, 64 nt, hsa; identical to SEQ ID NO: 147234

SEQ ID NO: 271110 - RNA, 64 nt, hsa; identical to SEQ ID NO: 147235

SEQ ID NO: 271111 - RNA, 64 nt, hsa; identical to SEQ ID NO: 147236

SEQ ID NO: 271112 - RNA, 64 nt, hsa; identical to SEQ ID NO: 147237

SEQ ID NO: 271113 - RNA, 64 nt, hsa; identical to SEQ ID NO: 147238

SEQ ID NO: 271114 - RNA, 64 nt, hsa; identical to SEQ ID NO: 147239

SEQ ID NO: 271115 - RNA, 64 nt, hsa; identical to SEQ ID NO: 147240

SEQ ID NO: 271116 - RNA, 64 nt, hsa; identical to SEQ ID NO: 147241

SEQ ID NO: 271117 - RNA, 64 nt, hsa; identical to SEQ ID NO: 147242

SEQ ID NO: 271118 - RNA, 64 nt, hsa; identical to SEQ ID NO: 147243

SEQ ID NO: 271119 - RNA, 64 nt, hsa; identical to SEQ ID NO: 147244

SEQ ID NO: 271120 - RNA, 64 nt, hsa; identical to SEQ ID NO: 147245

SEQ ID NO: 271121 - RNA, 64 nt, hsa; identical to SEQ ID NO: 147246

SEQ ID NO: 271122 - RNA, 64 nt, hsa; identical to SEQ ID NO: 147247

SEQ ID NO: 271123 - RNA, 64 nt, hsa; identical to SEQ ID NO: 147248

SEQ ID NO: 271124 - RNA, 64 nt, hsa; identical to SEQ ID NO: 147249

SEQ ID NO: 271125 - RNA, 64 nt, hsa; identical to SEQ ID NO: 147250

SEQ ID NO: 271126 - RNA, 64 nt, hsa; identical to SEQ ID NO: 147251

SEQ ID NO: 271127 - RNA, 64 nt, hsa; identical to SEQ ID NO: 147252

SEQ ID NO: 271128 - RNA, 64 nt, hsa; identical to SEQ ID NO: 147253

SEQ ID NO: 271129 - RNA, 64 nt, hsa; identical to SEQ ID NO: 147254

SEQ ID NO: 271130 - RNA, 64 nt, hsa; identical to SEQ ID NO: 147255

SEQ ID NO: 271131 - RNA, 64 nt, hsa; identical to SEQ ID NO: 147256

SEQ ID NO: 271132 - RNA, 64 nt, hsa; identical to SEQ ID NO: 147257

SEQ ID NO: 271133 - RNA, 64 nt, hsa; identical to SEQ ID NO: 147258

SEQ ID NO: 271134 - RNA, 64 nt, hsa; identical to SEQ ID NO: 147259

SEQ ID NO: 271135 - RNA, 64 nt, hsa; identical to SEQ ID NO: 147260

SEQ ID NO: 271136 - RNA, 64 nt, hsa; identical to SEQ ID NO: 147261

SEQ ID NO: 271137 - RNA, 64 nt, hsa; identical to SEQ ID NO: 147262

SEQ ID NO: 271138 - RNA, 64 nt, hsa; identical to SEQ ID NO: 147263

SEQ ID NO: 271139 - RNA, 64 nt, hsa; identical to SEQ ID NO: 147264

SEQ ID NO: 271140 - RNA, 64 nt, hsa; identical to SEQ ID NO: 147265

SEQ ID NO: 271141 - RNA, 64 nt, hsa; identical to SEQ ID NO: 147266

SEQ ID NO: 271142 - RNA, 64 nt, hsa
ucuaaaauguauuuuagacuuccuguagggggcgauauacuaaauguauauaguacauuuauac

SEQ ID NO: 271143 - RNA, 64 nt, hsa
uacauuuauacuaaauguauuccuguagggggcgauauacuaaauguauuuuagacuuccugua

SEQ ID NO: 271144 - RNA, 64 nt, hsa
uuucacauaauugcuaaaaacucauuuuuguuuaauauacuaccuauaguuuaauuaucggcac

SEQ ID NO: 271145 - RNA, 64 nt, hsa
uugaaugcaaugagagauuguccagaaauguaauauauacuaaaauauaccacuuaagcauuga

SEQ ID NO: 271146 - RNA, 64 nt, hsa
gcuaauucucuucuucugaaauuauggucacacuauauacuauagcauuucgguuuuauccuuu

SEQ ID NO: 271147 - RNA, 64 nt, hsa
ugugcuuagaaauaauauguugaacuauuuugcaauauacuauuuuaaaucuaaauucugucac

SEQ ID NO: 271148 - RNA, 64 nt, hsa
uucucuuuauauuuagaugaggaugauugaguccauauacuauguauguuuacauauacuauac

SEQ ID NO: 271149 - RNA, 64 nt, hsa
aggaugauugaguccauauacuauguauguuuacauauacuauacaugcacauuagguguuuuc

SEQ ID NO: 271150 - RNA, 64 nt, hsa
aauucaguugugauuuuuaacaugugucagauauauauacuaacacgucuaauauauacuauuu

SEQ ID NO: 271151 - RNA, 64 nt, hsa
acaugugucagauauauauacuaacacgucuaauauauacuauuuuauugguuuauuuugaaaa

SEQ ID NO: 271152 - RNA, 64 nt, hsa
uauaccuaauuuuuaguuuuuaaacuauuuuaaaauauacuaugauuuuauauguauauuuccu

SEQ ID NO: 271153 - RNA, 64 nt, hsa
aacuaugaggaaaacuuauauuagaacuuuugauauauacuaaaauacugauuaucuuaaucac

SEQ ID NO: 271154 - RNA, 64 nt, hsa
uuuuccuauaauuaguugauauacuaaugagaaaauauacuagccuggccaugccaauaaguuu

SEQ ID NO: 271155 - RNA, 64 nt, hsa
acuuuagaaacaguacuuuuccuauaauuaguugauauacuaaugagaaaauauacuagccugg

SEQ ID NO: 271156 - RNA, 64 nt, hsa
aagagauuauuuuccuauguaauuucacauucuaauauacuaaauguuuauauuccuuagagaa

SEQ ID NO: 271157 - RNA, 64 nt, hsa
auauuauuauaaauuuccuuauuauauaaacuuuauauacuauaaaugugauuaagucaaugaa

SEQ ID NO: 271158 - RNA, 64 nt, hsa
aaaaacuaauacagacuccuuuauuuuuauauggauauacuaggauuguaauucagauauuuaa

SEQ ID NO: 271159 - RNA, 64 nt, hsa
gaugcuggaaaccagggauagaacauaauucuauauauacuaugcaugaauuucuuuuuccuuc

SEQ ID NO: 271160 - RNA, 64 nt, hsa
uugaacugauaagcacuuuuugugucaauauaaaauauacuaaaacugaugaaaugcuaagaca

SEQ ID NO: 271161 - RNA, 64 nt, hsa
uagaaauguuucuugugccaguuuuauuguugagauauacuauuuuuuuccuuuuuuaauucag

SEQ ID NO: 271162 - RNA, 64 nt, hsa
auacaaugucuucugucauuucuuaauaaauauuauauacuaggcaaagaaaccauugucuuug

SEQ ID NO: 271163 - RNA, 64 nt, hsa
acaaagccaccugcugaucaucaauuugcuugggauauacuauuucugauauuucugcaggauu

SEQ ID NO: 271164 - RNA, 64 nt, hsa; identical to SEQ ID NO: 250961

SEQ ID NO: 271165 - RNA, 64 nt, hsa; identical to SEQ ID NO: 250962

SEQ ID NO: 271166 - RNA, 64 nt, hsa; identical to SEQ ID NO: 250963

SEQ ID NO: 271167 - RNA, 64 nt, hsa; identical to SEQ ID NO: 250964

SEQ ID NO: 271168 - RNA, 64 nt, hsa; identical to SEQ ID NO: 250965

SEQ ID NO: 271169 - RNA, 64 nt, hsa; identical to SEQ ID NO: 250966

SEQ ID NO: 271170 - RNA, 64 nt, hsa; identical to SEQ ID NO: 250967

SEQ ID NO: 271171 - RNA, 64 nt, hsa; identical to SEQ ID NO: 250968

SEQ ID NO: 271172 - RNA, 64 nt, hsa; identical to SEQ ID NO: 250969

SEQ ID NO: 271173 - RNA, 64 nt, hsa; identical to SEQ ID NO: 250970

SEQ ID NO: 271174 - RNA, 64 nt, hsa; identical to SEQ ID NO: 250971

SEQ ID NO: 271175 - RNA, 64 nt, hsa; identical to SEQ ID NO: 250972

SEQ ID NO: 271176 - RNA, 64 nt, hsa; identical to SEQ ID NO: 250973

SEQ ID NO: 271177 - RNA, 64 nt, hsa; identical to SEQ ID NO: 250974

SEQ ID NO: 271178 - RNA, 64 nt, hsa; identical to SEQ ID NO: 250975

SEQ ID NO: 271179 - RNA, 64 nt, hsa; identical to SEQ ID NO: 250976

SEQ ID NO: 271180 - RNA, 64 nt, hsa; identical to SEQ ID NO: 250977

SEQ ID NO: 271181 - RNA, 64 nt, hsa; identical to SEQ ID NO: 250978

SEQ ID NO: 271182 - RNA, 64 nt, hsa; identical to SEQ ID NO: 250979

SEQ ID NO: 271183 - RNA, 64 nt, hsa; identical to SEQ ID NO: 250980

SEQ ID NO: 271184 - RNA, 64 nt, hsa; identical to SEQ ID NO: 250981

SEQ ID NO: 271185 - RNA, 64 nt, hsa; identical to SEQ ID NO: 250982

SEQ ID NO: 271186 - RNA, 64 nt, hsa; identical to SEQ ID NO: 250983

SEQ ID NO: 271187 - RNA, 64 nt, hsa; identical to SEQ ID NO: 250984

SEQ ID NO: 271188 - RNA, 64 nt, hsa; identical to SEQ ID NO: 250985

SEQ ID NO: 271189 - RNA, 64 nt, hsa; identical to SEQ ID NO: 250986

SEQ ID NO: 271190 - RNA, 64 nt, hsa
cuuuaaugaggaaaaaacaaauaauaaauguucucguuuugaaacucaagcaacgcucaucagg

SEQ ID NO: 271191 - RNA, 64 nt, hsa
agaaacucaucuauauauucuguaucuggaguuccguuuugaauauuaacuguguuauuuuuau

SEQ ID NO: 271192 - RNA, 64 nt, hsa
cugaacaauuuagggacucuuuuaacuugagggucguuuugacuacuagagcuccauuucuacu

SEQ ID NO: 271193 - RNA, 64 nt, hsa
uugguuuuaauuuaucaugguuuuuuguuguuuucguuuugaacuuauccuuccucccacaaaa

SEQ ID NO: 271194 - RNA, 64 nt, hsa
gugggaccugggccccugacgggccuucucagcccguuuugaggacagacagucccccgaggua

SEQ ID NO: 271195 - RNA, 64 nt, hsa
acacacugauguaggaagcacgaggaaaggaagacguuuugauauaguguuacugugagccugu

SEQ ID NO: 271196 - RNA, 64 nt, hsa
gguuuccacgaugaaaaacuuccaugaggccaaacguuuugaacuaauaaaagcauaaaugcaa

SEQ ID NO: 271197 - RNA, 64 nt, hsa
uguaccagggcuuccuccccagaggugcagcuugcguuuugagggugauugcuacauauguugu

SEQ ID NO: 271198 - RNA, 64 nt, hsa
ggggcuauuuggggccugcugucaggcagaaagacguuuugaauugggcuuucugcccuuguug

SEQ ID NO: 271199 - RNA, 64 nt, hsa
auuuuguuccuaguuuuauaacauuaccauccuucguuuugaacuacagauguuguaguggguu

SEQ ID NO: 271200 - RNA, 64 nt, hsa
ugugcuauugguugcagcugccaugcucagaaugcguuuugagagcugaagcaaggugcuugca

SEQ ID NO: 271201 - RNA, 64 nt, hsa
uuguuucccagaagcucuaaaagugaagagaccucguuuugauguaucgcugguuuauuuaacu

SEQ ID NO: 271202 - RNA, 64 nt, hsa
gacugggugaaagaggaguagcuccugccacuggcguuuugaguguuggcaauuugggaugccu

SEQ ID NO: 271203 - RNA, 64 nt, hsa
uacgccacaaaagugcucuugacauccgugacaccguuuugacuuuuuguuuuuuucuuauuua

SEQ ID NO: 271204 - RNA, 64 nt, hsa
cuucccacauccuugaaagaaaaacuguggcuuacguuuugaaguauucugagaaugaaguauu

SEQ ID NO: 271205 - RNA, 64 nt, hsa
uccauuuguuguacagucuggaggauuuucacuacguuuugacaacucugaaauguguuaacuc

SEQ ID NO: 271206 - RNA, 64 nt, hsa
cagacgaccuuuuguuuuccuaccgacguuuccucguuuugaaagcaguuuuguaaagggcaag

SEQ ID NO: 271207 - RNA, 64 nt, hsa
uaaaugaaauuguguuuaagacuaaauuuacuaccguuuugaacagacauucccagaucauucu

SEQ ID NO: 271208 - RNA, 64 nt, hsa
ccgucuugguggacaccuguguggcucucaccugcguuuugagucuguucuuccaggaguaaua

SEQ ID NO: 271209 - RNA, 64 nt, hsa
uuccccaaggaagcagagucaagguauaaacuuucguuuugacucaaaagcagugggucucaac

SEQ ID NO: 271210 - RNA, 64 nt, hsa
aagcuggauuaucuccuguugagagcaagagauucguuuugacauagagugaaugcauuuuccc

SEQ ID NO: 271211 - RNA, 64 nt, hsa
ugguguugcaauuggcucuuucuaaaucaugugacguuuugacuggcuugagauucagaugcau

SEQ ID NO: 271212 - RNA, 53 nt, hsa
caacucguguuggaucauaacuacguuuugagaauugaugcaccauugccacu

SEQ ID NO: 271213 - RNA, 64 nt, hsa
uuaucaaaaucaccuaauuuuuaaaaauagcuuucguuuugaguucuggaaagaaaacugucaa

SEQ ID NO: 271214 - RNA, 64 nt, hsa
uuugcauuguacgguuuuggaccuauauuguucacguuuugauggcggagaggggugguccugg

SEQ ID NO: 271215 - RNA, 64 nt, hsa
uagaauguuaugcuuuggggcuccugaaacaccucguuuugaaggugaaucuuugguuuucucc

SEQ ID NO: 271216 - RNA, 64 nt, hsa
uuaggugcaaaggaugucuaauaaucccugcacacguuuugaacuugcagugaaguacacugcu

SEQ ID NO: 271217 - RNA, 64 nt, hsa
aagacccugggcccucaccgcaggcagcaguuugcguuuugaaagguuauugggucccuuccuc

SEQ ID NO: 271218 - RNA, 64 nt, hsa
gcugcccgccacagggguacccaucacacaccagcguuuugaccagaugcgagacauguuugau

SEQ ID NO: 271219 - RNA, 64 nt, hsa
agacaucaagaauggauucagcagaaucauuucacguuuugaacagcagcaguuugaagggcca

SEQ ID NO: 271220 - RNA, 64 nt, hsa
ccccagaaaacuugaugaagaaaugucuuuugcccguuuugauuacgugcaugcaaacagcgau

SEQ ID NO: 271221 - RNA, 64 nt, hsa
aguuagauucccccuuucuccuuauugccccuuccguuuugacuuccccuuuauuuauuuguug

SEQ ID NO: 271222 - RNA, 64 nt, hsa
ugucacacuuugaggcaacuaaaaaggcuucaaacguuuugaucaguuucuuuucaggaaacau

SEQ ID NO: 271223 - RNA, 64 nt, hsa
cuggaugggugguggccaggugacauuuucugugcguuuugacccugaggcaucugaggagagg

SEQ ID NO: 271224 - RNA, 64 nt, hsa
uccuuugaaauggcuggacucagagaguuggagucguuuugagaugagcauuagccccagcuuu

SEQ ID NO: 271225 - RNA, 64 nt, hsa
uuuaaagaggucuuauaauggaacuaggaaucaccguuuugagagaaccugcauauauaccagu

SEQ ID NO: 271226 - RNA, 56 nt, hsa
caaagucuugugaccuguagcugccacguuuugaagagcuugagcuggguccccag

SEQ ID NO: 271227 - RNA, 64 nt, hsa
ucuaugcuagguuguacagacuuauuuauaucaucguuuugagggacuaauggaggcuuauugu

SEQ ID NO: 271228 - RNA, 64 nt, hsa
uuugauuuguguguauuagucugagucuuggcuccguuuugagguaugagcaaaguuuugcugg

SEQ ID NO: 271229 - RNA, 64 nt, hsa
gaaugauuucuucuagagcucauguagaggaccacguuuugaccaaaacuucuccuaaggcauu

SEQ ID NO: 271230 - RNA, 64 nt, hsa
augcuguauuuuauaucuuaguuguguuugaaaacguuuugauuuuuggaaacacaucaaaaua

SEQ ID NO: 271231 - RNA, 64 nt, hsa
aguauguuugauguggauuaccuauacuuauguucguuuugauacauuuuuagcuucucauuau

SEQ ID NO: 271232 - RNA, 64 nt, hsa
ucuggucuccucggccacuuucagugcgucgguucguuuugauucuuuuucuuuugugcacaua

SEQ ID NO: 271233 - RNA, 64 nt, hsa
uuuuuuuacuuccucuugguucccagcugugacacguuuugaucaaaggagaaacaauaaaggg

SEQ ID NO: 271234 - RNA, 64 nt, hsa
augugugacuggguggccugguagacuccucccacguuuugaauauuucgugccuuuuuuuuuu

SEQ ID NO: 271235 - RNA, 64 nt, hsa
agaauguauaguggcuuagguuauuugagguuuucguuuugaauauauauguuguuauuuugau

SEQ ID NO: 271236 - RNA, 64 nt, hsa
agguaugggcugggggcuauguauagucuguauacguuuugaggagaaauuugauaaugacacu

SEQ ID NO: 271237 - RNA, 64 nt, hsa
cucaaauuaagcauauguguuacuucaaguaauacguuuugacauaagaugguugaccaaggug

SEQ ID NO: 271238 - RNA, 64 nt, hsa
ugagaaacggacucugauaaaagucuucgggauccguuuugacauccugguuuuuggcaccgua

SEQ ID NO: 271239 - RNA, 64 nt, hsa
caaacacauucggcggcuggacacagaccuggcccguuuugaggcugaucucaaggagaaacag

SEQ ID NO: 271240 - RNA, 64 nt, hsa
uaccuauuucacaagguuguucugaggauugauacguuuugaguauguauuuguacacuaucug

SEQ ID NO: 271241 - RNA, 64 nt, hsa
guuaagaaguucuagucaguguucauagucguuucguuuugauaauuguugaaccaauuuuguu

SEQ ID NO: 271242 - RNA, 54 nt, hsa
caaagcaagcaaagaaauagaugucguuuugacacugccuagucgggacuugua

SEQ ID NO: 271243 - RNA, 64 nt, hsa
agaucacgcuguguagcugacaggggcuugcugucguuuugagcaugucgagcaguuuacugug

SEQ ID NO: 271244 - RNA, 64 nt, hsa
cugcugauuucuuuuucagagauaacaaugguuucguuuugaccaaacuuguauuaggacagaa

SEQ ID NO: 271245 - RNA, 64 nt, hsa
aguuggcguuugcuuugcacuucggaaccuguugcguuuugacccacggagguggaggaguaac

SEQ ID NO: 271246 - RNA, 64 nt, hsa
uuuaaaaacuacaguuuccaugauaaaaggaaaacguuuugauuuauaguaccaagugcuuaaa

SEQ ID NO: 271247 - RNA, 64 nt, hsa
acuuugcagccuuuuuucccccuggucccucucccguuuugauuuugugagagcguaggucauc

SEQ ID NO: 271248 - RNA, 64 nt, hsa
uuuuguccaucagauucugugagacaccaggcaucguuuugaggauguggguuauacacaugga

SEQ ID NO: 271249 - RNA, 64 nt, hsa
uucuaaacuaagaagccgcauaggaugugacuugcguuuugaguagaggggaaggcugauaacg

SEQ ID NO: 271250 - RNA, 64 nt, hsa
acuugcaucauuacccuaaaaauaggcuguuaugcguuuugacaauugcgcuauccuacacucu

SEQ ID NO: 271251 - RNA, 64 nt, hsa
auguggcuguccuuuuccacugaagaaggaaagacguuuugaucuagaaauagcguugugauuu

SEQ ID NO: 271252 - RNA, 64 nt, hsa
aaaagaaacacuggauacuuuuuuguuguugauucguuuugaaaaauuguuguuagagcaaaag

SEQ ID NO: 271253 - RNA, 64 nt, hsa
gaugaaggaacaaagguugagagaacauuuaguucguuuugaaaggcugcgacgagcaauggaa

SEQ ID NO: 271254 - RNA, 64 nt, hsa
cuugcucugucucccaggcucacugcagccucaacguuuugagcugaagugauccucucgucuc

SEQ ID NO: 271255 - RNA, 64 nt, hsa
gguuaucaguuuauauuaaauauacugaguugcccguuuugaaaaugcacuuugaauaaucuca

SEQ ID NO: 271256 - RNA, 64 nt, hsa
ugggugcucagggcccugccccaggccacugggccguuuugaugaccucgaaggucacaggcag

SEQ ID NO: 271257 - RNA, 64 nt, hsa
uuuuccagugacuugcaauccaggcuguucucagcguuuugaguuuaaaaccugggauccugac

SEQ ID NO: 271258 - RNA, 64 nt, hsa
guauuuauagagagagacuauccuggagaagccucguuuugaugccauucuuccuugcaagguu

SEQ ID NO: 271259 - RNA, 64 nt, hsa
guauuggcauaggcaugauagauggggauugguacguuuugaaucagcauuugcaaaaaaauug

SEQ ID NO: 271260 - RNA, 64 nt, hsa
gugacuuaacgccuuuuccggcccuagcuccaggcguuuugaggcgucuggugccugaugguag

SEQ ID NO: 271261 - RNA, 64 nt, hsa
uuaaucauuccaaaauuguguccguuuucuugagcguuuugauuuuuuacuuuuagcuuauacc

SEQ ID NO: 271262 - RNA, 64 nt, hsa
guacuuuaaacucauggaaggauaacuaccuucacguuuugaaauaaauguuuccuguugaaau

SEQ ID NO: 271263 - RNA, 64 nt, hsa
uauuccaauccucuaaauuccucauuuuuuaaaucguuuugagccuacagaauauccuucccag

SEQ ID NO: 271264 - RNA, 64 nt, hsa
caagcagggucucccuacuuuuucucacuggccucguuuugacccagagaaagccuauggaagu

SEQ ID NO: 271265 - RNA, 64 nt, hsa
ccagugacucgcucaucugcccugcccaggcccacguuuugaaguuggagcaucaggccuccga

SEQ ID NO: 271266 - RNA, 64 nt, hsa
uguguacuucaucuauuuguguacaaaaugaugucguuuugagggaauuuaaguauuuaaauug

SEQ ID NO: 271267 - RNA, 64 nt, hsa
aacuuacuuucauccuauuuugcaucccucuuaucguuuugagcuaccugccaucuucucuuug

SEQ ID NO: 271268 - RNA, 64 nt, hsa
uuaaaaacaucgacgauacauugaaaugugugaacguuuugaaaagcuacagcuuccagcagcc

SEQ ID NO: 271269 - RNA, 64 nt, hsa
cauugguuggggucguacggggcugggagcccugcguuuugaggcagaccacugcccuuccgac

SEQ ID NO: 271270 - RNA, 64 nt, hsa
uauuuucccugcaagauuagaauggugcucuucacguuuugacggugguuuucaaaauguuguu

SEQ ID NO: 271271 - RNA, 64 nt, hsa
accucgcgaagcgcagcagccccggcccuucccccguuuugaacauguguaaccgacagucugc

SEQ ID NO: 271272 - RNA, 64 nt, hsa
auuugagaacagccuggcuaacauggcgaauccucguuuugaccaaaauauagaaauuagccug

SEQ ID NO: 271273 - RNA, 64 nt, hsa
accugugacggaagcacuucuggaagugaacacucguuuugaaagcuugauuuuguagcuuugg

SEQ ID NO: 271274 - RNA, 64 nt, hsa
ccaucuuuggcucuuuugaugcacaauauccauccguuuugauuucaucuuuauguccccuuua

SEQ ID NO: 271275 - RNA, 64 nt, hsa
uuuccuguuuguuaauauuaggguuguaaggugucguuuugagguaucgacugugauuccuucc

SEQ ID NO: 271276 - RNA, 64 nt, hsa
uaagagcagccccgguaacuggaggaaugggagccguuuugaugagaaaaaugggcuggagaga

SEQ ID NO: 271277 - RNA, 64 nt, hsa
agagaaagcaucggagccauucauucggagaaaacguuuugaucaaaauggagacuuuuguagu

SEQ ID NO: 271278 - RNA, 64 nt, hsa
ccagccaccuccuucugaucagcagcaaagcugacguuuugaucuccaucugucugauucuugu

SEQ ID NO: 271279 - RNA, 64 nt, hsa
guugcgacacccucccccccacauacacacgcagcguuuugauaaauuauugguuuucaacgau

SEQ ID NO: 271280 - RNA, 52 nt, hsa
ggaagccauuaaugaacuaauucguuuugaccacauauauaccaagccccua

SEQ ID NO: 271281 - RNA, 64 nt, hsa
ggugccucugugcacaguggcuucuuuucguuuucguuuugaagacguggacuccucuuggugg

SEQ ID NO: 271282 - RNA, 64 nt, hsa
uccuuccuuauuuccuuuaguuuccuuccuuagccguuuugaguggugggaaucaaugcuguuu

SEQ ID NO: 271283 - RNA, 64 nt, hsa
agguucuuaaauccucauaucuggaaacuugugacguuuugacaccuuuccuauagaugauaua

SEQ ID NO: 271284 - RNA, 64 nt, hsa
acuuugcuuuagucguuccuccugcuaccaguagcguuuugacccaccugccaguguuugcuug

SEQ ID NO: 271285 - RNA, 64 nt, hsa
cuugcccuguuuauaguauccauccugaaccauucguuuugacccauaauaauagugauaguau

SEQ ID NO: 271286 - RNA, 64 nt, hsa
ugguccuggaggcucaaauuuugaguuauucccacguuuugaaauaaaaagaguauauucaaaa

SEQ ID NO: 271287 - RNA, 64 nt, hsa
ccuuuguguggcacccugaugaguauuuaaagcccguuuugaaaugccuauguguggacuccuu

SEQ ID NO: 271288 - RNA, 64 nt, hsa
aacuuacacauuugugguguaccuuugucguaaacguuuugauguuaccuauuucuuguggguc

SEQ ID NO: 271289 - RNA, 64 nt, hsa
cuguuaaauagcaacuuuuagucucagcuuguuucguuuugaugucaauaaauaguaacagcau

SEQ ID NO: 271290 - RNA, 64 nt, hsa
ccauacaagaagucauuuugauuuucaaagaagccguuuugauuuucaaagaagcagguucugg

SEQ ID NO: 271291 - RNA, 64 nt, hsa
uuuacaaaacuacaugagaacaaacagaucgaaccguuuugaagcuacugugugugugaaugaa

SEQ ID NO: 271292 - RNA, 64 nt, hsa
uuuguuauacucuuugcaccuuaaacccccaccacuccccgacacuauugccuucccagcaugg

SEQ ID NO: 271293 - RNA, 64 nt, hsa
gcuccugcuguccugggggagagaagguucgccccuccccgaggaagaaggcuucuggucagga

SEQ ID NO: 271294 - RNA, 64 nt, hsa
agugucggcauggcucacugugcugggugaaggccuccccgagcauuagguccuccacggggcu

SEQ ID NO: 271295 - RNA, 64 nt, hsa
ccacagccacacgcauggacguuucauccaacagcuccccgagcugccagccagcccgagccag

SEQ ID NO: 271296 - RNA, 64 nt, hsa
ggcagcagugauccucugaaccugcagaggcccccuccccgagccuggccuggcucuggcccgg

SEQ ID NO: 271297 - RNA, 64 nt, hsa
gcccccaugggcuuuacccuucccugcgggcucucuccccgacacauuuguuaaaaucaaaccu

SEQ ID NO: 271298 - RNA, 64 nt, hsa
cucccuccgagugagucagugaugaggccgcggccuccccgagguuguggggaggcugcacugg

SEQ ID NO: 271299 - RNA, 64 nt, hsa
cugaauugacaugacccucuguccccaggccuggcuccccgagggcucagaagagcagcuucgg

SEQ ID NO: 271300 - RNA, 64 nt, hsa
cugcuccgugucuguccuaggacguccccucccgcuccccgaugguggcguggacaugguuauu

SEQ ID NO: 271301 - RNA, 64 nt, hsa
ccuuugcuucgugggggccuggcagggccccugccuccccgacccccgacccacugcaaauccc

SEQ ID NO: 271302 - RNA, 64 nt, hsa
uggccagccaagcccugccgaucagacaugugggcuccccgaagcccagccagagacugccgug

SEQ ID NO: 271303 - RNA, 64 nt, hsa
ugggugccaccaggcccagggacugcagccugagcuccccgaggcccagggcagccgggugagg

SEQ ID NO: 271304 - RNA, 64 nt, hsa
caaggugccugagauggcugugcccgaugugcaccuccccgaggugcagcugccgaaaguguca

SEQ ID NO: 271305 - RNA, 64 nt, hsa
uaaaaugccugagauggcugugccagagguucgacuccccgaggugcagcugccaaaagucuca

SEQ ID NO: 271306 - RNA, 64 nt, hsa
agcaugaugcagcgugaggacagcugagcagggaccgggacagcccucaccgcaugcgugugga

SEQ ID NO: 271307 - RNA, 64 nt, hsa
accacagcugcgcacacagcugcuugcucaggggccgggacagcacugggugcucaggcuggcc

SEQ ID NO: 271308 - RNA, 64 nt, hsa
cuuggcguguaucugguccuagugaagaggaaggccuguguagcagaaaggcuuugggccugag

SEQ ID NO: 271309 - RNA, 64 nt, hsa
uggaaauccuuuugcauuaaaaggacuuuacacaccuguguaaaaggaugugggagaggagggu

SEQ ID NO: 271310 - RNA, 64 nt, hsa
aagcuuuaauguuacauaguaaaugguaguguguccuguguaaauuaguguaccuauuaaaagu

SEQ ID NO: 271311 - RNA, 64 nt, hsa
ucuaguuuguuuaguuaaggugugcaguguuuuuccuguguauuaaaccuuuccauuuuacguu

SEQ ID NO: 271312 - RNA, 64 nt, hsa
aaauacuuggcaaacuccuuugcucugcugucauccuguguacccuugucaauccauggagcug

SEQ ID NO: 271313 - RNA, 64 nt, hsa
cuggugggugcccucucuagacugguaucagcagccuguguaaccccuuuccuguaaaaggggu

SEQ ID NO: 271314 - RNA, 64 nt, hsa
auuuaaguguacaagguuuugaaaaaucuauacaccuguguaaccaccaccaccuguguaacca

SEQ ID NO: 271315 - RNA, 64 nt, hsa
uugaaaaaucuauacaccuguguaaccaccaccaccuguguaaccaccaccgccagaaccaaaa

SEQ ID NO: 271316 - RNA, 64 nt, hsa
guuguguagaucagaccuguguauuuagaucagaccuguguaucacguaagugugugagugcag

SEQ ID NO: 271317 - RNA, 64 nt, hsa
aaagcgguagcaccacaugguuguguagaucagaccuguguauuuagaucagaccuguguauca

SEQ ID NO: 271318 - RNA, 64 nt, hsa
uguuaccuuuuaaaauaguaauuuuuuacauuuuccuguguaaaccuaauugugguagaaauuu

SEQ ID NO: 271319 - RNA, 64 nt, hsa
gguuugaacucacacuuuuuuuuuuuuuuuuguuccuguguauucucauugggguugcaacaau

SEQ ID NO: 271320 - RNA, 64 nt, hsa
gugacagcugauguuaucagaaaaauccuguuauccuguguauuuacuaguccucaugaucuag

SEQ ID NO: 271321 - RNA, 64 nt, hsa
ccuuguccacagccauuuuaaauauccacuuagcccuguguaguugguagguggacaccacuuu

SEQ ID NO: 271322 - RNA, 64 nt, hsa
aauacaguuacuuaaugaccauguuauauugcuuccuguguaacaucugccauuuauuuccuca

SEQ ID NO: 271323 - RNA, 64 nt, hsa
uguugggauuacaggugugaaccacugugcccggccuguguacaacuuuuuaaauagggaauau

SEQ ID NO: 271324 - RNA, 64 nt, hsa
aauuagguuuuuccuuauuugcuucauuguacuaccuguguauauaguuuuuaccuuuuaugua

SEQ ID NO: 271325 - RNA, 64 nt, hsa
aauggauacuacaucuuuaaacaguauuucauugccuguguauggaaaaaccauuugaagugua

SEQ ID NO: 271326 - RNA, 64 nt, hsa
auugccuguguauggaaaaaccauuugaaguguaccuguguacauaacucuguaaaaacacuga

SEQ ID NO: 271327 - RNA, 64 nt, hsa
acugccuaccugaguagaaucuuauuuaugaacuccuguguauugcaaugguaugaaucugcuc

SEQ ID NO: 271328 - RNA, 64 nt, hsa
guugugcaaagcaguuugccuguggauaagaugaccuguguaauaaucuuuguuaguagucuua

SEQ ID NO: 271329 - RNA, 64 nt, hsa
uguuuguuguuuuaauuagcugcaauauauacggccuguguacacagaauuuaaucacuucggc

SEQ ID NO: 271330 - RNA, 64 nt, hsa
ggaaauccuaaaagaggcggcaagaagguaccucccuguguaacucaccuucccccaugacagu

SEQ ID NO: 271331 - RNA, 64 nt, hsa
gugacaccuguaugaaaaugugaugauugaacucccuguguacagcgagugaauuaaaaugucu

SEQ ID NO: 271332 - RNA, 64 nt, hsa
uuccacuuaauagacucuaugugugcugaauguuccuguguacauauguguguuaaauaaaaca

SEQ ID NO: 271333 - RNA, 64 nt, hsa
cccagggaccuggaaacagugcuggggaguucugccuguguauacuuggccgugggcaugagac

SEQ ID NO: 271334 - RNA, 64 nt, hsa
ggacuggugggcggggcuccccagccaucaccauccuguguacaauggcuguagacuuguauau

SEQ ID NO: 271335 - RNA, 64 nt, hsa
cauguuaccccagagagacacauggggaguagacccuguguacacagauugugagugaaguucc

SEQ ID NO: 271336 - RNA, 59 nt, hsa
gacaccagaggacacacugacgggagaaaccuguguaugcaggggucaugaacaagacc

SEQ ID NO: 271337 - RNA, 64 nt, hsa
cuaauuguguuugguuucagacaaaaccuuuucuccuguguaucuuugaaguggcagacaaggc

SEQ ID NO: 271338 - RNA, 64 nt, hsa
uguguuugauuucagacaaaauuaacccuuuucuccuguguaucuuugaaguggcagauaaggu

SEQ ID NO: 271339 - RNA, 64 nt, hsa
caggcugcccccuguuccaggaagcucauccucaccuguguaggccccuguagugacccacgcg

SEQ ID NO: 271340 - RNA, 64 nt, hsa
gcugucccgcgucaugagcaccaccucugcuuucccuguguagaucuaggccaguggcugcuug

SEQ ID NO: 271341 - RNA, 64 nt, hsa
uagagaagcuaccccucaaacugcacaucuacacacaaacaaacaaugcauaggauuccaaggc

SEQ ID NO: 271342 - RNA, 64 nt, hsa
gaagcuaccccucaaacugcacaucuacacacaaacaaacaaugcauaggauuccaaggcuuua

SEQ ID NO: 271343 - RNA, 64 nt, hsa
gcgacacagugagacucugucucaaaaaaacaaaacaaacaaacaaaaauacaaaaaauuagcc

SEQ ID NO: 271344 - RNA, 64 nt, hsa
cacagugagacucugucucaaaaaaacaaaacaaacaaacaaaaauacaaaaaauuagccgggc

SEQ ID NO: 271345 - RNA, 64 nt, hsa
acuccggccuaggcaacgagagcaaaacuccaauacaaacaaacaaacaaacaccugugcuagg

SEQ ID NO: 271346 - RNA, 64 nt, hsa
cggccuaggcaacgagagcaaaacuccaauacaaacaaacaaacaaacaccugugcuaggucag

SEQ ID NO: 271347 - RNA, 64 nt, hsa
cuaggcaacgagagcaaaacuccaauacaaacaaacaaacaaacaccugugcuaggucagucug

SEQ ID NO: 271348 - RNA, 64 nt, hsa
uauuucuucaucugcuggggggaaaaaguaaauuacaaacaaacaaacaaagcagaacuaaaau

SEQ ID NO: 271349 - RNA, 64 nt, hsa
ucuucaucugcuggggggaaaaaguaaauuacaaacaaacaaacaaagcagaacuaaaauauug

SEQ ID NO: 271350 - RNA, 64 nt, hsa
caucugcuggggggaaaaaguaaauuacaaacaaacaaacaaagcagaacuaaaauauugggac

SEQ ID NO: 271351 - RNA, 64 nt, hsa
uguguuaauuuggcuguaauggcauuuaaagcaaacaaacaaacaaaaaaagcugugaaaaugg

SEQ ID NO: 271352 - RNA, 64 nt, hsa
uuaauuuggcuguaauggcauuuaaagcaaacaaacaaacaaaaaaagcugugaaaauggccuu

SEQ ID NO: 271353 - RNA, 64 nt, hsa
acagagcaaacccuguuuccaaacaaacaaacaaacaaacaaauacacagacagaaguaguuaa

SEQ ID NO: 271354 - RNA, 64 nt, hsa
ggcgacagagcaaacccuguuuccaaacaaacaaacaaacaaacaaauacacagacagaaguag

SEQ ID NO: 271355 - RNA, 64 nt, hsa
ccugggcgacagagcaaacccuguuuccaaacaaacaaacaaacaaacaaauacacagacagaa

SEQ ID NO: 271356 - RNA, 64 nt, hsa
ccagccugggcgacagagcaaacccuguuuccaaacaaacaaacaaacaaacaaauacacagac

SEQ ID NO: 271357 - RNA, 64 nt, hsa
caacuaaaauggagagaugaaucauucugccuauacaaacaagcuagcuauuagagggugguug

SEQ ID NO: 271358 - RNA, 52 nt, hsa
gaggcagaagcagauacuagaaacaaacaaaacuuuggaccaaaaucccagu

SEQ ID NO: 271359 - RNA, 64 nt, hsa
ggcaacagaacaagaacccaucucaaacaaacaaacaaacaaaaaaaaaaaacucuugucuccu

SEQ ID NO: 271360 - RNA, 64 nt, hsa
ccugggcaacagaacaagaacccaucucaaacaaacaaacaaacaaaaaaaaaaaacucuuguc

SEQ ID NO: 271361 - RNA, 64 nt, hsa
ccaaccugggcaacagaacaagaacccaucucaaacaaacaaacaaacaaaaaaaaaaaacucu

SEQ ID NO: 271362 - RNA, 64 nt, hsa
gacuuagugaaauaaaauaagaggaaagccaaaaacaaacaaacaaaaagcauauggggagcug

SEQ ID NO: 271363 - RNA, 64 nt, hsa
uagugaaauaaaauaagaggaaagccaaaaacaaacaaacaaaaagcauauggggagcugguau

SEQ ID NO: 271364 - RNA, 64 nt, hsa
cugauuaaugcaaggggaaauuuuuauacugaaaacaaacaaacaaacuagcagcuacuaaaau

SEQ ID NO: 271365 - RNA, 64 nt, hsa
uuaaugcaaggggaaauuuuuauacugaaaacaaacaaacaaacuagcagcuacuaaaauagag

SEQ ID NO: 271366 - RNA, 64 nt, hsa
gagccaccacacauggccuauugcacaagucuugacaaacaacauauauuuucuaaaacuaucc

SEQ ID NO: 271367 - RNA, 64 nt, hsa
uaguaacuagaugcagugugaauuuuuuccauuaacaaacaaacaagucaguggcuuaaaugug

SEQ ID NO: 271368 - RNA, 64 nt, hsa
aacuagaugcagugugaauuuuuuccauuaacaaacaaacaagucaguggcuuaaaugugauua

SEQ ID NO: 271369 - RNA, 64 nt, hsa
gggcaaacugagguagcgacacaaaguuaaacaaacaaacaaaaaacacaaaacauaauaaaac

SEQ ID NO: 271370 - RNA, 64 nt, hsa
augggggcaaacugagguagcgacacaaaguuaaacaaacaaacaaaaaacacaaaacauaaua

SEQ ID NO: 271371 - RNA, 64 nt, hsa
ccgcuuucagaauaguuuugcaaauuguacacaaacaaacaaaaagguggaagcuuuuuaauaa

SEQ ID NO: 271372 - RNA, 64 nt, hsa
uauuccgcuuucagaauaguuuugcaaauuguacacaaacaaacaaaaagguggaagcuuuuua

SEQ ID NO: 271373 - RNA, 64 nt, hsa
uuuuuuucuagucccaugugauuuaaacaaacaaacaaacaaacagaaguaacgaagcuaagaa

SEQ ID NO: 271374 - RNA, 64 nt, hsa
aggauuuuuuucuagucccaugugauuuaaacaaacaaacaaacaaacagaaguaacgaagcua

SEQ ID NO: 271375 - RNA, 64 nt, hsa
cuguaggauuuuuuucuagucccaugugauuuaaacaaacaaacaaacaaacagaaguaacgaa

SEQ ID NO: 271376 - RNA, 64 nt, hsa
ccuagcccccuugaucccuaaagaaaacaaacaaacaaacaaaaacuguugcuauuuccuaacc

SEQ ID NO: 271377 - RNA, 64 nt, hsa
cccuccuagcccccuugaucccuaaagaaaacaaacaaacaaacaaaaacuguugcuauuuccu

SEQ ID NO: 271378 - RNA, 64 nt, hsa
guaacccuccuagcccccuugaucccuaaagaaaacaaacaaacaaacaaaaacuguugcuauu

SEQ ID NO: 271379 - RNA, 64 nt, hsa
ggcuuuuuguucuguuggugugauucaaagcaaaacaaacaaacaaaaacaaauuuuaagaaca

SEQ ID NO: 271380 - RNA, 64 nt, hsa
uuuuguucuguuggugugauucaaagcaaaacaaacaaacaaaaacaaauuuuaagaacacaac

SEQ ID NO: 271381 - RNA, 64 nt, hsa
augaagucucuuuaugguuagagaagaccaaaaaacaaacaaacaaacuuagaaacauaaaagg

SEQ ID NO: 271382 - RNA, 64 nt, hsa
agucucuuuaugguuagagaagaccaaaaaacaaacaaacaaacuuagaaacauaaaaggaaau

SEQ ID NO: 271383 - RNA, 64 nt, hsa
aagaaagggaaaaagcagaaacacugcagaagacacaaacaaacaaagaagagaaggauucuua

SEQ ID NO: 271384 - RNA, 64 nt, hsa
aagggaaaaagcagaaacacugcagaagacacaaacaaacaaagaagagaaggauucuuauacc

SEQ ID NO: 271385 - RNA, 64 nt, hsa
gccgcagggccagccuuguuucucuaacaaacaaacaaacaaacagccuuguuucucuagucac

SEQ ID NO: 271386 - RNA, 64 nt, hsa
cggggccgcagggccagccuuguuucucuaacaaacaaacaaacaaacagccuuguuucucuag

SEQ ID NO: 271387 - RNA, 64 nt, hsa
ggggcggggccgcagggccagccuuguuucucuaacaaacaaacaaacaaacagccuuguuucu

SEQ ID NO: 271388 - RNA, 64 nt, hsa
aaucagaccaucugagcccacuacuaucaaacaaacaaacaaaaacuguuaauauauuagccau

SEQ ID NO: 271389 - RNA, 64 nt, hsa
cccaaaucagaccaucugagcccacuacuaucaaacaaacaaacaaaaacuguuaauauauuag

SEQ ID NO: 271390 - RNA, 64 nt, hsa
uucaaucaucaaaaaguaauuauaaauacguauuacaaacaaguggauguuuuuaaugaccaau

SEQ ID NO: 271391 - RNA, 64 nt, hsa
uggaagaaacuaaaaauauagcaaaugcagaaccacaaacaauucgaaugggguagaaacauug

SEQ ID NO: 271392 - RNA, 64 nt, hsa
ccuaucccuguaagcuaaacaaacaaacaaacaaacaaacaaacaguucuauauauaauaguuu

SEQ ID NO: 271393 - RNA, 64 nt, hsa
gccaccuaucccuguaagcuaaacaaacaaacaaacaaacaaacaaacaguucuauauauaaua

SEQ ID NO: 271394 - RNA, 64 nt, hsa
uaaugccaccuaucccuguaagcuaaacaaacaaacaaacaaacaaacaaacaguucuauauau

SEQ ID NO: 271395 - RNA, 64 nt, hsa
cuuauaaugccaccuaucccuguaagcuaaacaaacaaacaaacaaacaaacaaacaguucuau

SEQ ID NO: 271396 - RNA, 64 nt, hsa
cuuucuuauaaugccaccuaucccuguaagcuaaacaaacaaacaaacaaacaaacaaacaguu

SEQ ID NO: 271397 - RNA, 64 nt, hsa
cuuaugaacaaaacaaaacaacaacaaaaaacaaacaaacaaaaaagcuauggcacuagaauuu

SEQ ID NO: 271398 - RNA, 64 nt, hsa
cuuucuuaugaacaaaacaaaacaacaacaaaaaacaaacaaacaaaaaagcuauggcacuaga

SEQ ID NO: 271399 - RNA, 64 nt, hsa
uguaaucugaaguaugguauuacaaaacaaacaaacaaacaaaaaacccauguguuaaaauacu

SEQ ID NO: 271400 - RNA, 64 nt, hsa
guauuguaaucugaaguaugguauuacaaaacaaacaaacaaacaaaaaacccauguguuaaaa

SEQ ID NO: 271401 - RNA, 64 nt, hsa
uuggguauuguaaucugaaguaugguauuacaaaacaaacaaacaaacaaaaaacccauguguu

SEQ ID NO: 271402 - RNA, 64 nt, hsa
auuagauaaauuucaaucaggguuuuuagauuaaacaaacaaacaauuggguacccaguuaaau

SEQ ID NO: 271403 - RNA, 64 nt, hsa
gauaaauuucaaucaggguuuuuagauuaaacaaacaaacaauuggguacccaguuaaauuuuc

SEQ ID NO: 271404 - RNA, 64 nt, hsa
ccugggugacagagucagacuccgucccaaaaaaacaaacaaacaaaacaaaacaaaaaaaaac

SEQ ID NO: 271405 - RNA, 64 nt, hsa
ggugacagagucagacuccgucccaaaaaaacaaacaaacaaaacaaaacaaaaaaaaacagaa

SEQ ID NO: 271406 - RNA, 64 nt, hsa
ccagccugggugacagagcgagacuccgucucaaacaaacaaacaaaaaacuguuuucauuugc

SEQ ID NO: 271407 - RNA, 64 nt, hsa
ccugggugacagagcgagacuccgucucaaacaaacaaacaaaaaacuguuuucauuugcucuc

SEQ ID NO: 271408 - RNA, 64 nt, hsa
ugauaauaaacaucauuuuaaaagaucaaaacaaacaaacaaaaaaaacaagggugggugggga

SEQ ID NO: 271409 - RNA, 64 nt, hsa
guccugauaauaaacaucauuuuaaaagaucaaaacaaacaaacaaaaaaaacaagggugggug

SEQ ID NO: 271410 - RNA, 64 nt, hsa
uguuuauucaacaacuacuacuugauggucagacacaaacaaacaagcuaggugcuaauuaaua

SEQ ID NO: 271411 - RNA, 64 nt, hsa
uauucaacaacuacuacuugauggucagacacaaacaaacaagcuaggugcuaauuaauaaaga

SEQ ID NO: 271412 - RNA, 64 nt, hsa
gccaacauggugaaaccccaucucuacuaaaaauacaaacaauuaacugagcauaguggugggc

SEQ ID NO: 271413 - RNA, 64 nt, hsa
guuuauuguauguaaggaaaaauuuuaccugaaaacaaacaaacaaacccuaaaacucagcacc

SEQ ID NO: 271414 - RNA, 64 nt, hsa
auuguauguaaggaaaaauuuuaccugaaaacaaacaaacaaacccuaaaacucagcaccacua

SEQ ID NO: 271415 - RNA, 64 nt, hsa
uccagccuggcaacagagcuagaauccgucucaaacaaacaaacaaaaaaucccacagcuauug

SEQ ID NO: 271416 - RNA, 64 nt, hsa
gccuggcaacagagcuagaauccgucucaaacaaacaaacaaaaaaucccacagcuauuggauc

SEQ ID NO: 271417 - RNA, 64 nt, hsa
cugggugacagacucugucuccaaaacaaaacaaacaaacaaaaagauuuuauuaaagauauuu

SEQ ID NO: 271418 - RNA, 64 nt, hsa
caaccugggugacagacucugucuccaaaacaaaacaaacaaacaaaaagauuuuauuaaagau

SEQ ID NO: 271419 - RNA, 64 nt, hsa
ggucuuguuugauaaugugggcauccacaaacaaacaaacaaauaacagaaacaaaaucuguaa

SEQ ID NO: 271420 - RNA, 64 nt, hsa
aauuggucuuguuugauaaugugggcauccacaaacaaacaaacaaauaacagaaacaaaaucu

SEQ ID NO: 271421 - RNA, 64 nt, hsa
ucauaauuggucuuguuugauaaugugggcauccacaaacaaacaaacaaauaacagaaacaaa

SEQ ID NO: 271422 - RNA, 64 nt, hsa
gaaguccugcuauguuaaaaacaaacaacaaaaaacaaacaacaaaaaaaaaauuaaaaaaaaa

SEQ ID NO: 271423 - RNA, 64 nt, hsa
aaaauaucaccaaagaaguccugcuauguuaaaaacaaacaacaaaaaacaaacaacaaaaaaa

SEQ ID NO: 271424 - RNA, 64 nt, hsa
aaucaugauaauuuacucagguagcacuccagucacaaacaaugucacagagaugaaacagauu

SEQ ID NO: 271425 - RNA, 64 nt, hsa
uacuaagaagccuuaauacucuguaaacaaacaaacaaacaaaaaacaaccuuagcauuaagaa

SEQ ID NO: 271426 - RNA, 64 nt, hsa
gcuuuacuaagaagccuuaauacucuguaaacaaacaaacaaacaaaaaacaaccuuagcauua

SEQ ID NO: 271427 - RNA, 64 nt, hsa
ccaagcuuuacuaagaagccuuaauacucuguaaacaaacaaacaaacaaaaaacaaccuuagc

SEQ ID NO: 271428 - RNA, 64 nt, hsa
uucaggaggacuauguccuuugaugcuauaaaauacaaacaacuuugaaggcaacagaagacac

SEQ ID NO: 271429 - RNA, 64 nt, hsa
cuuuuguauaauauuacuucaaagauauguaaucacaaacaaaaaaaacuauuuuuuauaaugu

SEQ ID NO: 271430 - RNA, 64 nt, hsa
uuggaaauguacauauccaauaugaaauacuaaaacaaacaaacaaacaaaaaaccagaaugca

SEQ ID NO: 271431 - RNA, 64 nt, hsa
aaauguacauauccaauaugaaauacuaaaacaaacaaacaaacaaaaaaccagaaugcauugu

SEQ ID NO: 271432 - RNA, 64 nt, hsa
guacauauccaauaugaaauacuaaaacaaacaaacaaacaaaaaaccagaaugcauuguauag

SEQ ID NO: 271433 - RNA, 64 nt, hsa
cgaaagacugcaguugugcuaaaaacaaaacaaaacaaacaaacaaacaaaaaaguaaaaaaag

SEQ ID NO: 271434 - RNA, 64 nt, hsa
agacugcaguugugcuaaaaacaaaacaaaacaaacaaacaaacaaaaaaguaaaaaaagauua

SEQ ID NO: 271435 - RNA, 64 nt, hsa
ugcaguugugcuaaaaacaaaacaaaacaaacaaacaaacaaaaaaguaaaaaaagauuacuuu

SEQ ID NO: 271436 - RNA, 64 nt, hsa
auguaugacacccagcuuuaaaacaaacaaacaaacaaacaaaaaaagggugggggagggaggg

SEQ ID NO: 271437 - RNA, 64 nt, hsa
ugaaauguaugacacccagcuuuaaaacaaacaaacaaacaaacaaaaaaagggugggggaggg

SEQ ID NO: 271438 - RNA, 64 nt, hsa
ucucugaaauguaugacacccagcuuuaaaacaaacaaacaaacaaacaaaaaaaggguggggg

SEQ ID NO: 271439 - RNA, 64 nt, hsa
augcucucugaaauguaugacacccagcuuuaaaacaaacaaacaaacaaacaaaaaaagggug

SEQ ID NO: 271440 - RNA, 64 nt, hsa
guggcgaaauccccgucuuuacaaaaacaaacaaacaaacaaaaaagauauugcaguuguguug

SEQ ID NO: 271441 - RNA, 64 nt, hsa
caacguggcgaaauccccgucuuuacaaaaacaaacaaacaaacaaaaaagauauugcaguugu

SEQ ID NO: 271442 - RNA, 64 nt, hsa
ugggcaacguggcgaaauccccgucuuuacaaaaacaaacaaacaaacaaaaaagauauugcag

SEQ ID NO: 271443 - RNA, 64 nt, hsa
auugaaagaacaaaacaaaacaaaacaaacacaaacaaacaaaaaaccuucaacugccuuaugc

SEQ ID NO: 271444 - RNA, 64 nt, hsa
gcugauugaaagaacaaaacaaaacaaaacaaacacaaacaaacaaaaaaccuucaacugccuu

SEQ ID NO: 271445 - RNA, 64 nt, hsa
guguauuuucucuggcuuuaaaauuuuaaaacaaacaaacaaaaaagccauagagagcagaacu

SEQ ID NO: 271446 - RNA, 64 nt, hsa
guguguguauuuucucuggcuuuaaaauuuuaaaacaaacaaacaaaaaagccauagagagcag

SEQ ID NO: 271447 - RNA, 64 nt, hsa
agccugggugacagagugaaacucguaucuccaaacaaacaaacaaaaaguccuuaaacauaug

SEQ ID NO: 271448 - RNA, 64 nt, hsa
ugggugacagagugaaacucguaucuccaaacaaacaaacaaaaaguccuuaaacauaugugaa

SEQ ID NO: 271449 - RNA, 64 nt, hsa
guguuaagacuaaaauuuugccuauaccuuuaagacaaacaaacaaacacacacacaaacaagc

SEQ ID NO: 271450 - RNA, 64 nt, hsa
uaagacuaaaauuuugccuauaccuuuaagacaaacaaacaaacacacacacaaacaagcucua

SEQ ID NO: 271451 - RNA, 64 nt, hsa
ccuauaccuuuaagacaaacaaacaaacacacacacaaacaagcucuaagcugcuguagccuga

SEQ ID NO: 271452 - RNA, 64 nt, hsa
cuagcuucuugucuuaggccugaaccaaaaaacaacaaacaaacaaaaaacaagaaugaaaaac

SEQ ID NO: 271453 - RNA, 64 nt, hsa
cuucuugucuuaggccugaaccaaaaaacaacaaacaaacaaaaaacaagaaugaaaaacagaa

SEQ ID NO: 271454 - RNA, 64 nt, hsa
uccacugaagcaugcacaugccacugucaccaaaacaaacaacuaccacuuuccaaauuucauu

SEQ ID NO: 271455 - RNA, 64 nt, hsa
aacaucauacuuaaacauuacagaaaauagaaauacaaacaagguugguacaugagagaaaaug

SEQ ID NO: 271456 - RNA, 64 nt, hsa
aacuucaggucuuaagugcaaaucaaagcaaaaaacaaacaaaacuuacauggaaaaacuguaa

SEQ ID NO: 271457 - RNA, 64 nt, hsa
aggucucagaccuacaaagaguuaaaacaaacagacaaacaaaaaaaaacacuacuauuuuaaa

SEQ ID NO: 271458 - RNA, 64 nt, hsa
gcgacggagcgagacucugucucaaaacaaacaaacaaacaaaagacccaaucugagucuuauc

SEQ ID NO: 271459 - RNA, 64 nt, hsa
cugggcgacggagcgagacucugucucaaaacaaacaaacaaacaaaagacccaaucugagucu

SEQ ID NO: 271460 - RNA, 64 nt, hsa
cagccugggcgacggagcgagacucugucucaaaacaaacaaacaaacaaaagacccaaucuga

SEQ ID NO: 271461 - RNA, 64 nt, hsa
aaacauaaaauauaaacaaucaaaauccaaacaaacaaacaaacacucacugcaucgggacuuu

SEQ ID NO: 271462 - RNA, 64 nt, hsa
aacaaaacauaaaauauaaacaaucaaaauccaaacaaacaaacaaacacucacugcaucggga

SEQ ID NO: 271463 - RNA, 64 nt, hsa
cuccuauaucaaaaugccguaggccggguggcuuacaaacaacagaaacguauugcucacaguc

SEQ ID NO: 271464 - RNA, 64 nt, hsa
ggugccuucucgcuguauccucaaugguagaagcacaaacaagcaagcuccuuccugccucuuu

SEQ ID NO: 271465 - RNA, 64 nt, hsa
gcccuuuggcuucugauuuuucucuuuuuuaaaaacaaacaaacaaacuguugcagauuaugag

SEQ ID NO: 271466 - RNA, 64 nt, hsa
uuuggcuucugauuuuucucuuuuuuaaaaacaaacaaacaaacuguugcagauuaugagugaa

SEQ ID NO: 271467 - RNA, 64 nt, hsa
cgugcuuguggucugugcuugcucagaaaaacaaacaaacaaacaguuuuuccaauuauaaaua

SEQ ID NO: 271468 - RNA, 64 nt, hsa
gugacgugcuuguggucugugcuugcucagaaaaacaaacaaacaaacaguuuuuccaauuaua

SEQ ID NO: 271469 - RNA, 64 nt, hsa
cauuccuugagaauguauuuaucugaagaucaaaacaaacaauccagauguauaaguacuaggc

SEQ ID NO: 271470 - RNA, 64 nt, hsa
guucauacaaugguuuuagcaaguucauaguaagacaaacaaguccuaucuuuuuuuuuuuggc

SEQ ID NO: 271471 - RNA, 64 nt, hsa
gacagagagagacuccaucucaaaacaaaaacaaacaaacaaacagaaagcaccgucgagaaau

SEQ ID NO: 271472 - RNA, 64 nt, hsa
gggcgacagagagagacuccaucucaaaacaaaaacaaacaaacaaacagaaagcaccgucgag

SEQ ID NO: 271473 - RNA, 64 nt, hsa
augcuucagcugugacucagcaguuccuuaaaucacaaacaaugguaggucuauuauuuucucc

SEQ ID NO: 271474 - RNA, 64 nt, hsa
auaauaaugacaaaaagcacaugcagaguaauacacaaacaaaaaaagugacaguuacuuuuuu

SEQ ID NO: 271475 - RNA, 64 nt, hsa
aaagcucuaagacacuaauauauguaucuuauaaacaaacaauucaacucagaaguuuaugaga

SEQ ID NO: 271476 - RNA, 64 nt, hsa
gaacaguggucuauucugcuacaugaagaugaauacaaacaaaauuuuuguauaaacuacuauu

SEQ ID NO: 271477 - RNA, 64 nt, hsa
ggcaauuuuaaaacagacuccuuuaaaaaaacaaacaaacaaaaaaaacauagacuucuuuaua

SEQ ID NO: 271478 - RNA, 64 nt, hsa
aauaggcaauuuuaaaacagacuccuuuaaaaaaacaaacaaacaaaaaaaacauagacuucuu

SEQ ID NO: 271479 - RNA, 64 nt, hsa
agacucugucucaaaaaaaaaaaaacaaaaacaaacaaacaaaaaaaacaccucaccaugagug

SEQ ID NO: 271480 - RNA, 64 nt, hsa
aguaagacucugucucaaaaaaaaaaaaacaaaaacaaacaaacaaaaaaaacaccucaccaug

SEQ ID NO: 271481 - RNA, 64 nt, hsa
cacuuccuugaaaauuuuauuaaaaaacaaacaaacaaacaaaaagccuguccacccuugagaa

SEQ ID NO: 271482 - RNA, 64 nt, hsa
aaaucacuuccuugaaaauuuuauuaaaaaacaaacaaacaaacaaaaagccuguccacccuug

SEQ ID NO: 271483 - RNA, 64 nt, hsa
aaagaaaucacuuccuugaaaauuuuauuaaaaaacaaacaaacaaacaaaaagccuguccacc

SEQ ID NO: 271484 - RNA, 64 nt, hsa
uuuagauauucauucaucaaauacaugggacuucacaaacaauuuuccauaacuuuuuagccug

SEQ ID NO: 271485 - RNA, 64 nt, hsa
uaaguauuuuccaguuuugcuugacaguuucuaaacaaacaaaaauaaacucaaugaaaggaaa

SEQ ID NO: 271486 - RNA, 64 nt, hsa
gacauucccuagauucaaaggcaaaacagaagaaacaaacaaacaaacaaaaaaagcuugcaaa

SEQ ID NO: 271487 - RNA, 64 nt, hsa
uucccuagauucaaaggcaaaacagaagaaacaaacaaacaaacaaaaaaagcuugcaaaauau

SEQ ID NO: 271488 - RNA, 64 nt, hsa
cuagauucaaaggcaaaacagaagaaacaaacaaacaaacaaaaaaagcuugcaaaauauuuua

SEQ ID NO: 271489 - RNA, 64 nt, hsa
uguguucuuuugccuucaaucuguugucuucaaaacaaacaaacaaaaaaagcuucuugcgccu

SEQ ID NO: 271490 - RNA, 64 nt, hsa
uucuuuugccuucaaucuguugucuucaaaacaaacaaacaaaaaaagcuucuugcgccuuucc

SEQ ID NO: 271491 - RNA, 64 nt, hsa
aaaaaaaaaaaaaaaaaaaaaauccuaaaaacaaacaaacaaaaaaaacaauucuucauucaga

SEQ ID NO: 271492 - RNA, 64 nt, hsa
aaaaaaaaaaaaaaaaaaaaaaaaaauccuaaaaacaaacaaacaaaaaaaacaauucuucauu

SEQ ID NO: 271493 - RNA, 64 nt, hsa
ccaggauaauuuuuaaaccaaucaaaugaaaaaaacaaacaaacaaaaaaggaaaugucaugug

SEQ ID NO: 271494 - RNA, 64 nt, hsa
gauaauuuuuaaaccaaucaaaugaaaaaaacaaacaaacaaaaaaggaaaugucaugugaggu

SEQ ID NO: 271495 - RNA, 64 nt, hsa
uaugacagagugagacccuguuucuaaaaacaaaacaaacaaacaaacaaacaacguaucuuac

SEQ ID NO: 271496 - RNA, 64 nt, hsa
acagagugagacccuguuucuaaaaacaaaacaaacaaacaaacaaacaacguaucuuacugac

SEQ ID NO: 271497 - RNA, 64 nt, hsa
agugagacccuguuucuaaaaacaaaacaaacaaacaaacaaacaacguaucuuacugacuaaa

SEQ ID NO: 271498 - RNA, 64 nt, hsa
agacccuguuucuaaaaacaaaacaaacaaacaaacaaacaacguaucuuacugacuaaacugg

SEQ ID NO: 271499 - RNA, 64 nt, hsa
aacuccuccuaccccccaagguaagaaacaaaaaacaaacaaacaaacaaaaauagaagacaaa

SEQ ID NO: 271500 - RNA, 64 nt, hsa
ccuccuaccccccaagguaagaaacaaaaaacaaacaaacaaacaaaaauagaagacaaaagaa

SEQ ID NO: 271501 - RNA, 64 nt, hsa
cuaccccccaagguaagaaacaaaaaacaaacaaacaaacaaaaauagaagacaaaagaaagac

SEQ ID NO: 271502 - RNA, 64 nt, hsa
agugacagagcaagaccccaucucaaaaaaaaaaacaaacaaacaaaaaaaaaaccauauauau

SEQ ID NO: 271503 - RNA, 64 nt, hsa
acagagcaagaccccaucucaaaaaaaaaaacaaacaaacaaaaaaaaaaccauauauauacau

SEQ ID NO: 271504 - RNA, 64 nt, hsa
auuaaaacaaagaaacaaacaaacaaaaaacaagacaaacaacuacaaaaaaagacaguauaga

SEQ ID NO: 271505 - RNA, 64 nt, hsa
auauauaucuauauaaauuaaaacaaagaaacaaacaaacaaaaaacaagacaaacaacuacaa

SEQ ID NO: 271506 - RNA, 64 nt, hsa
gaauauauauaucuauauaaauuaaaacaaagaaacaaacaaacaaaaaacaagacaaacaacu

SEQ ID NO: 271507 - RNA, 64 nt, hsa
agguacaacucaaacaagccaugguuccuugaugacaaacaaacaacaucaaggcaaauccaau

SEQ ID NO: 271508 - RNA, 64 nt, hsa
acaacucaaacaagccaugguuccuugaugacaaacaaacaacaucaaggcaaauccaauaauc

SEQ ID NO: 271509 - RNA, 64 nt, hsa
ugucauuuuguuuuaugacagacacacguaucuaacaaacaaacaaacagugaccuucuccaug

SEQ ID NO: 271510 - RNA, 64 nt, hsa
auuuuguuuuaugacagacacacguaucuaacaaacaaacaaacagugaccuucuccauggguc

SEQ ID NO: 271511 - RNA, 64 nt, hsa
cuaagguuuucuggcuuauugaggaaauuuccuaacaaacaaacaaacaaacaaacagaagaga

SEQ ID NO: 271512 - RNA, 64 nt, hsa
gguuuucuggcuuauugaggaaauuuccuaacaaacaaacaaacaaacaaacagaagagaagau

SEQ ID NO: 271513 - RNA, 64 nt, hsa
uucuggcuuauugaggaaauuuccuaacaaacaaacaaacaaacaaacagaagagaagaucauu

SEQ ID NO: 271514 - RNA, 64 nt, hsa
ggcuuauugaggaaauuuccuaacaaacaaacaaacaaacaaacagaagagaagaucauuaacc

SEQ ID NO: 271515 - RNA, 64 nt, hsa
uugggcgacagaucaagacucugucacacacaaaacaaacaaacaaauuuucccguuucucucu

SEQ ID NO: 271516 - RNA, 64 nt, hsa
gcgacagaucaagacucugucacacacaaaacaaacaaacaaauuuucccguuucucucugucc

SEQ ID NO: 271517 - RNA, 64 nt, hsa
ugcaccacggcaagaaaaccaaaaaccaaaacaaacaaacaaaaaaaacccaacaacaacccag

SEQ ID NO: 271518 - RNA, 64 nt, hsa
guuuugcaccacggcaagaaaaccaaaaaccaaaacaaacaaacaaaaaaaacccaacaacaac

SEQ ID NO: 271519 - RNA, 64 nt, hsa
aauauuaaagauuuccuuggagucagaggaaaaaacaaacaauuauaauguugucuagggacga

SEQ ID NO: 271520 - RNA, 64 nt, hsa
uguguguauuugauggcucuaagggcuauaaauuacaaacaaaacacaucccagacauuaggag

SEQ ID NO: 271521 - RNA, 64 nt, hsa; identical to SEQ ID NO: 271520

SEQ ID NO: 271522 - RNA, 64 nt, hsa
aauauuaaagauuuccuuggagucagaguaaaaaacaaacaauuauaauguugucuagggacga

SEQ ID NO: 271523 - RNA, 64 nt, hsa
cauugcauuugcuuuuauuaaaauacaaaauuaaacaaacaaaaaaacucauggagcgauuuua

SEQ ID NO: 271524 - RNA, 64 nt, hsa
ugaacuucagggugaacuugguuuuuggacaaguacaaacaauuucaacugauauucccaaaaa

SEQ ID NO: 271525 - RNA, 64 nt, hsa
ucaauuuaagacuaagacuuugaagguaaaacaaacaaacaaacaucagucuuagucucuugcu

SEQ ID NO: 271526 - RNA, 64 nt, hsa
cuugucaauuuaagacuaagacuuugaagguaaaacaaacaaacaaacaucagucuuagucucu

SEQ ID NO: 271527 - RNA, 64 nt, hsa
ggaaagagacuuugccucacuuuuacauucacaaacaaacaaaggaggggggagcagguuuuau

SEQ ID NO: 271528 - RNA, 64 nt, hsa
acacggaaagagacuuugccucacuuuuacauucacaaacaaacaaaggaggggggagcagguu

SEQ ID NO: 271529 - RNA, 64 nt, hsa
aaggauggaggaagaucuacgaagcaaauggaaaacaaacaaaaaaagaggcagggguugcaau

SEQ ID NO: 271530 - RNA, 64 nt, hsa
agaaucuacaaugaacucaaacaaauuuacaggaacaaacaaccccaucaaaaagucggcaaag

SEQ ID NO: 271531 - RNA, 64 nt, hsa
gccugggcaacagagggagcccccgucucaacaaacaaacaaaaagagccagugggggagggag

SEQ ID NO: 271532 - RNA, 64 nt, hsa
uccagccugggcaacagagggagcccccgucucaacaaacaaacaaaaagagccagugggggag

SEQ ID NO: 271533 - RNA, 64 nt, hsa
gagacuccaacucagaaaaagcaaaacaaaacaaacaaacaagcaaaaaaccacaauuagacug

SEQ ID NO: 271534 - RNA, 64 nt, hsa
gagcgagacuccaacucagaaaaagcaaaacaaaacaaacaaacaagcaaaaaaccacaauuag

SEQ ID NO: 271535 - RNA, 64 nt, hsa
ggaaagccuggcgauaccccaucucuauuuagaaacaaacaaacaaacaaauaaaaaaccuggc

SEQ ID NO: 271536 - RNA, 64 nt, hsa
agccuggcgauaccccaucucuauuuagaaacaaacaaacaaacaaauaaaaaaccuggcaccu

SEQ ID NO: 271537 - RNA, 64 nt, hsa
gccugagugacagagcgagacccugucucaaaaaacaaacaaacaaacaaacaaaaacagaaca

SEQ ID NO: 271538 - RNA, 64 nt, hsa
gagugacagagcgagacccugucucaaaaaacaaacaaacaaacaaacaaaaacagaacauucu

SEQ ID NO: 271539 - RNA, 64 nt, hsa
gacagagcgagacccugucucaaaaaacaaacaaacaaacaaacaaaaacagaacauucugggc

SEQ ID NO: 271540 - RNA, 64 nt, hsa
gagcgagacccugucucaaaaaacaaacaaacaaacaaacaaaaacagaacauucugggcacgg

SEQ ID NO: 271541 - RNA, 64 nt, hsa
ggcuucaauuagaauuauuuuucucaaaaaacaaacaaacaaaaaacacaaaaaaaaccacucu

SEQ ID NO: 271542 - RNA, 64 nt, hsa
augaggcuucaauuagaauuauuuuucucaaaaaacaaacaaacaaaaaacacaaaaaaaacca

SEQ ID NO: 271543 - RNA, 64 nt, hsa
aagacauugcuggaguugacuuucuucuguccaaacaaacaaacaaaaacuaaacacacacaca

SEQ ID NO: 271544 - RNA, 64 nt, hsa
cauugcuggaguugacuuucuucuguccaaacaaacaaacaaaaacuaaacacacacacaaacc

SEQ ID NO: 271545 - RNA, 64 nt, hsa
cagccuggugacagaacgagacucugucuuaaaaacaaacaaacaaaaaaaaaaucuguuagau

SEQ ID NO: 271546 - RNA, 64 nt, hsa
cuggugacagaacgagacucugucuuaaaaacaaacaaacaaaaaaaaaaucuguuagauaagc

SEQ ID NO: 271547 - RNA, 64 nt, hsa
gccagacuccgucucuaaacaaacaaacaaacaaacaaacaaauaaagaaagaacauuggacau

SEQ ID NO: 271548 - RNA, 64 nt, hsa
cagagccagacuccgucucuaaacaaacaaacaaacaaacaaacaaauaaagaaagaacauugg

SEQ ID NO: 271549 - RNA, 64 nt, hsa
gcaacagagccagacuccgucucuaaacaaacaaacaaacaaacaaacaaauaaagaaagaaca

SEQ ID NO: 271550 - RNA, 64 nt, hsa
cugggcaacagagccagacuccgucucuaaacaaacaaacaaacaaacaaacaaauaaagaaag

SEQ ID NO: 271551 - RNA, 64 nt, hsa
cagccugggcaacagagccagacuccgucucuaaacaaacaaacaaacaaacaaacaaauaaag

SEQ ID NO: 271552 - RNA, 64 nt, hsa
acucuauagcaagaugaagaggaaaaacaaacaaacaaacaaaaaaaaacacaaaaaaagaaag

SEQ ID NO: 271553 - RNA, 64 nt, hsa
aggaacucuauagcaagaugaagaggaaaaacaaacaaacaaacaaaaaaaaacacaaaaaaag

SEQ ID NO: 271554 - RNA, 64 nt, hsa
guagaggaacucuauagcaagaugaagaggaaaaacaaacaaacaaacaaaaaaaaacacaaaa

SEQ ID NO: 271555 - RNA, 64 nt, hsa
uuguugauaaugggcuuuguuagcacuuuuuaaaacaaacaaacaaacaaaacaaaaaagcaaa

SEQ ID NO: 271556 - RNA, 64 nt, hsa
ugauaaugggcuuuguuagcacuuuuuaaaacaaacaaacaaacaaaacaaaaaagcaaaccac

SEQ ID NO: 271557 - RNA, 64 nt, hsa
aaugggcuuuguuagcacuuuuuaaaacaaacaaacaaacaaaacaaaaaagcaaaccacauuu

SEQ ID NO: 271558 - RNA, 64 nt, hsa
gauuccaucugaaaaacaaaaacaaaaacagaaaacaaacaaacaaaaaacaaaaaauccccac

SEQ ID NO: 271559 - RNA, 64 nt, hsa
ccaucugaaaaacaaaaacaaaaacagaaaacaaacaaacaaaaaacaaaaaauccccacaacu

SEQ ID NO: 271560 - RNA, 64 nt, hsa
uaaaaaacucagccaacagguaguauugguaaaaacaaacaaacaaaaauccuuugcccucaga

SEQ ID NO: 271561 - RNA, 64 nt, hsa
aaacucagccaacagguaguauugguaaaaacaaacaaacaaaaauccuuugcccucagaagug

SEQ ID NO: 271562 - RNA, 64 nt, hsa
cuugguggauuagacagguuaaauauauaaacaaacaaacaaaaauugcucaaaaaagaggaga

SEQ ID NO: 271563 - RNA, 64 nt, hsa
ccuucuugguggauuagacagguuaaauauauaaacaaacaaacaaaaauugcucaaaaaagag

SEQ ID NO: 271564 - RNA, 64 nt, hsa
uccaucucaaaacaaaacaaaacaaaacaaacaaacaaacaaaacuugcaucuaaccaaaaagu

SEQ ID NO: 271565 - RNA, 64 nt, hsa
aaacuccaucucaaaacaaaacaaaacaaaacaaacaaacaaacaaaacuugcaucuaaccaaa

SEQ ID NO: 271566 - RNA, 64 nt, hsa
aacgaaacuccaucucaaaacaaaacaaaacaaaacaaacaaacaaacaaaacuugcaucuaac

SEQ ID NO: 271567 - RNA, 64 nt, hsa
caucuaaaauggagagaugaaucauucuaccuauacaaacaagcuagcuauuagagggugguug

SEQ ID NO: 271568 - RNA, 52 nt, hsa; identical to SEQ ID NO: 271358

SEQ ID NO: 271569 - RNA, 64 nt, hsa
uuauugucggcaggcggugagggguagaaaaaaaacaaacaaacaaacagaaaaaaaaaccaaa

SEQ ID NO: 271570 - RNA, 64 nt, hsa
ugucggcaggcggugagggguagaaaaaaaacaaacaaacaaacagaaaaaaaaaccaaaaaaa

SEQ ID NO: 271571 - RNA, 64 nt, hsa; identical to SEQ ID NO: 259109

SEQ ID NO: 271572 - RNA, 64 nt, hsa; identical to SEQ ID NO: 259110

SEQ ID NO: 271573 - RNA, 64 nt, hsa; identical to SEQ ID NO: 259111

SEQ ID NO: 271574 - RNA, 64 nt, hsa; identical to SEQ ID NO: 259112

SEQ ID NO: 271575 - RNA, 64 nt, hsa
ccgggcgugguggcgugugccuguagucccagcuacuugcgaggcugaggcaggagaauugcuu

SEQ ID NO: 271576 - RNA, 64 nt, hsa
aagaacaagagauaccuuuaagccagugaaggauacuugcgauagaaucauccgcaacucagug

SEQ ID NO: 271577 - RNA, 64 nt, hsa
ugaucagaaaaauaauuccauaaaucuauugucuacuugcgauuuuuuaaaaaauguauauuuu

SEQ ID NO: 271578 - RNA, 64 nt, hsa
gucaaccauuugaugcuucugaaaaguacuuucaacuugcgaaggaaacucuucuuuaaagacu

SEQ ID NO: 271579 - RNA, 64 nt, hsa
uuguuguauaaagaugggaucgguguaguuaaaaacuugcgaagggacuuuugaguuggcuuuc

SEQ ID NO: 271580 - RNA, 64 nt, hsa
cccugggaaagccagagcugugauuuuuggcacaacuugcgaguguagugacuuuaggacuggc

SEQ ID NO: 271581 - RNA, 64 nt, hsa
cugccugcugagaugaggaggggagcgucugggaacuugcgaguccaaggccaguccccauuuc

SEQ ID NO: 271582 - RNA, 64 nt, hsa
cugcugacuucagccuggucaugcuugcucugccacuugcgauuucaucccuaauuucuuccuc

SEQ ID NO: 271583 - RNA, 64 nt, hsa
ggcaguugacaaaagaaaauguaaugacuacguaacuugcgaaucuguuuacccucacuugcaa

SEQ ID NO: 271584 - RNA, 64 nt, hsa
cuuuggagccacugaagagccgacugugccacccacuugcgagccucagucccuuccaagcugc

SEQ ID NO: 271585 - RNA, 64 nt, hsa
ccugaaagagacacagucacauggccagaugagaacuugcgauacuagccugcacccacuggcu

SEQ ID NO: 271586 - RNA, 64 nt, hsa
ccuauuuagaugauaaagagacagugauauuggaacuugcgagaaauucguguguuuuuuuaug

SEQ ID NO: 271587 - RNA, 64 nt, hsa
gggccgcggggugcugguaggagugguuggagagacuugcgaaggcggcugggguguucggauu

SEQ ID NO: 271588 - RNA, 64 nt, hsa
guguuagcucuaacaucucccacaagcuagaggaacuugcgaguauauuaacaaggacacaucu

SEQ ID NO: 271589 - RNA, 64 nt, hsa
uucugaugcaccgcucugcuucaugcccaagaugacuugcgaggcaaucucaggagcuguggac

SEQ ID NO: 271590 - RNA, 64 nt, hsa
accuucccaaaaugguucuuagaucugcaguaggacuugcgaucaaaaaguaaaacacauucug

SEQ ID NO: 271591 - RNA, 64 nt, hsa
cagaucaaguaguuuggacaucacccuacugaaaacuugcgauucuucuuaguuuucugcauac

SEQ ID NO: 271592 - RNA, 64 nt, hsa
ugaaucaacaaguuauuuucaacucaauuuuaugacuugcgaaaaagcuuuugcccuguugugu

SEQ ID NO: 271593 - RNA, 64 nt, hsa
ugcuuuggacccuacacacuucggcucucuggacacuugcgacaccucaagguguucucuguag

SEQ ID NO: 271594 - RNA, 64 nt, hsa
cuuuuuucccugguggggcuucuucuguaacaugacuugcgaauauuuauauaaaaacgagugu

SEQ ID NO: 271595 - RNA, 64 nt, hsa
ggaggcucagcaggccaggaggcccaaggacaggacuugcgaccuugaagccaaaggaaucuca

SEQ ID NO: 271596 - RNA, 64 nt, hsa
acggucaaagugcuuuuuguaaguucuauuuaauacuugcgacaacccugagauaguaaguauu

SEQ ID NO: 271597 - RNA, 64 nt, hsa
ccaggaguuagggaauauagugcaccgugauuggacuugcgaauagccacugcacugcggccug

SEQ ID NO: 271598 - RNA, 64 nt, hsa
ggauggugaucccuuugaccccugcagacccucuacuugcgaaaagcagcauugaagcagccuu

SEQ ID NO: 271599 - RNA, 64 nt, hsa
cucuggauaacugcuuuuugaauugagaagagagacuugcgauaggacaauaaaaucuagaaga

SEQ ID NO: 271600 - RNA, 64 nt, hsa
ggauugaaaaacagaaacacaaaacuuugacuugacuugcgaagugaagcaggguuuucauuuu

SEQ ID NO: 271601 - RNA, 64 nt, hsa
uucuuccaggggcauguuauuuuagguucugugaacuugcgagucauguagaaaugugaagagu

SEQ ID NO: 271602 - RNA, 64 nt, hsa
ccuuucucaggcccuaaaucccucuccaaaggguacuugcgaugccggauuuaaaacuugcuca

SEQ ID NO: 271603 - RNA, 64 nt, hsa
caaggucuugcucuguugcccaggcugaucuuggacuugcgagccaccaugccuggcuggguuu

SEQ ID NO: 271604 - RNA, 64 nt, hsa
uaguuaagaguaguguagaaaugcaugaacuucauccuaauaaggauaaaacuuaaggaaaacc

SEQ ID NO: 271605 - RNA, 64 nt, hsa
ucaauaauuuaugaauaaguuuccagaacaaauuuccuaauaacacaaucagauugguuuuauu

SEQ ID NO: 271606 - RNA, 64 nt, hsa
aaauccaugaguaacuuuccuaauaggcuuuuuuuccuaauaccaccaccuaacagagaacaca

SEQ ID NO: 271607 - RNA, 64 nt, hsa
uccaccaauuauaaauuaaauccaugaguaacuuuccuaauaggcuuuuuuuccuaauaccacc

SEQ ID NO: 271608 - RNA, 64 nt, hsa
aacauaguaaaacuauugaauuucucuuaagaauuccuaauaggucaauagauuuacccuccag

SEQ ID NO: 271609 - RNA, 64 nt, hsa
augcauucaaugaaguucauauccaugaauucacuccuaauauacccuaauaaagugguugauc

SEQ ID NO: 271610 - RNA, 64 nt, hsa
uacaaucuagaaaugaugaagcucuuucacuaauuccuaauaugaaauguaugauggccaaaga

SEQ ID NO: 271611 - RNA, 64 nt, hsa
ggaagaauccauaaacagacauucuaugucuguuuccuaauaucuuguggcugugugcaauucu

SEQ ID NO: 271612 - RNA, 64 nt, hsa
uuaucaaaacuguugucaccauugcacaauuuuguccuaauauauacauagaaacuuugugggg

SEQ ID NO: 271613 - RNA, 64 nt, hsa
uuccuuuucacauuagauaaauuacuauaaagacuccuaauagcuuuuccuguuaaggcagacc

SEQ ID NO: 271614 - RNA, 64 nt, hsa
cuucuuuuuccagguuuuauuuucaguuuuaaauuccuaauaaauuauuugaaaacguugcugg

SEQ ID NO: 271615 - RNA, 64 nt, hsa
guucguguuuuggguuuuuuuuuuuuuuaauguuuccuaauaaaagagaagcugcauuuuauug

SEQ ID NO: 271616 - RNA, 64 nt, hsa
gcaggaauuacuuuuuguuguuuuugccaccguggagagcaacuauuuggagugcacagccuau

SEQ ID NO: 271617 - RNA, 64 nt, hsa
aggcuaggagaggcugggcccggugaaaaggccagagagcaagccaagauuaggugaggguugu

SEQ ID NO: 271618 - RNA, 64 nt, hsa
gcaggaacaagugggcuuggggaauugaauagcagagagcaaaccaaucagucccucaggaaag

SEQ ID NO: 271619 - RNA, 64 nt, hsa
aggccaggacccuggggccccucaacugcagucagagagcaagccccccaaaaaaaagaaaaag

SEQ ID NO: 271620 - RNA, 64 nt, hsa
aaacaccuuugcccuggcucugcauugucaccuagagagcaagaggucuauagaaacaucaugu

SEQ ID NO: 271621 - RNA, 64 nt, hsa
uauauuaaugcagucaucccuuuucaggugggaagagagcaaaccaguugauuuuuuaauucau

SEQ ID NO: 271622 - RNA, 64 nt, hsa
ugugaccaauauggaauaaagaagaaggcagaaagagagcaaaugaaaaauuucaacuuguaua

SEQ ID NO: 271623 - RNA, 64 nt, hsa
gguccucugggagcugaagcacacggccauguuggagagcaaaacuuaauaauaauucuuuuuu

SEQ ID NO: 271624 - RNA, 64 nt, hsa
ugcaugugcaacaguacacacaaacauacauaaagagagcaauugauaaggcaaauaagguaac

SEQ ID NO: 271625 - RNA, 64 nt, hsa
aaggggcucccacuggccaaacuugagccaaucugagagcaaaauaauugagaaaaauaaauaa

SEQ ID NO: 271626 - RNA, 64 nt, hsa
uacugaugagaguacuaacuggaaaaaggcugaagagagcaaauauauuauuaagauggguugg

SEQ ID NO: 271627 - RNA, 53 nt, hsa
uuggagccuucuuacuauaggaggagagcaaauaucauuauaugaaaguccuc

SEQ ID NO: 271628 - RNA, 64 nt, hsa
acugacucuuccacccuuuuuuuuucugggaaaggagagcaagaggucccgaguccccuccuag

SEQ ID NO: 271629 - RNA, 64 nt, hsa
uucuuuuuuuucuuucguuccuuuuuugaaacaggagagcaaagcaguuagaguucagaggcca

SEQ ID NO: 271630 - RNA, 64 nt, hsa
aguuacuaaggccuucagugaacagaaaggagcagagagcaagauuagaucugagaagaugcuc

SEQ ID NO: 271631 - RNA, 64 nt, hsa
ugaguaaggggcuuuguugaaagaggggguuagagagagcaagacagcacuugagugcacuggc

SEQ ID NO: 271632 - RNA, 64 nt, hsa
ggaaaaugaacguccaggacacaccuguaucccagagagcaaagugaugaggagacugagcguc

SEQ ID NO: 271633 - RNA, 64 nt, hsa
cuccugcggcagaacagcacccgugacccacccagagagcaaggccaggggucuuggugcuccc

SEQ ID NO: 271634 - RNA, 64 nt, hsa; identical to SEQ ID NO: 102083

SEQ ID NO: 271635 - RNA, 64 nt, hsa; identical to SEQ ID NO: 102084

SEQ ID NO: 271636 - RNA, 64 nt, hsa; identical to SEQ ID NO: 138766

SEQ ID NO: 271637 - RNA, 64 nt, hsa; identical to SEQ ID NO: 138767

SEQ ID NO: 271638 - RNA, 64 nt, hsa; identical to SEQ ID NO: 138768

SEQ ID NO: 271639 - RNA, 64 nt, hsa; identical to SEQ ID NO: 138769

SEQ ID NO: 271640 - RNA, 64 nt, hsa; identical to SEQ ID NO: 138770

SEQ ID NO: 271641 - RNA, 64 nt, hsa; identical to SEQ ID NO: 138771

SEQ ID NO: 271642 - RNA, 64 nt, hsa; identical to SEQ ID NO: 138772

SEQ ID NO: 271643 - RNA, 64 nt, hsa; identical to SEQ ID NO: 138773

SEQ ID NO: 271644 - RNA, 64 nt, hsa; identical to SEQ ID NO: 138774

SEQ ID NO: 271645 - RNA, 64 nt, hsa; identical to SEQ ID NO: 138775

SEQ ID NO: 271646 - RNA, 64 nt, hsa; identical to SEQ ID NO: 138776

SEQ ID NO: 271647 - RNA, 64 nt, hsa; identical to SEQ ID NO: 138777

SEQ ID NO: 271648 - RNA, 64 nt, hsa; identical to SEQ ID NO: 138778

SEQ ID NO: 271649 - RNA, 64 nt, hsa; identical to SEQ ID NO: 138779

SEQ ID NO: 271650 - RNA, 64 nt, hsa; identical to SEQ ID NO: 138780

SEQ ID NO: 271651 - RNA, 64 nt, hsa; identical to SEQ ID NO: 138781

SEQ ID NO: 271652 - RNA, 64 nt, hsa; identical to SEQ ID NO: 138782

SEQ ID NO: 271653 - RNA, 64 nt, hsa
aagcagcccuuacuaagcugagagaugucauugcugcaggcaggacguauaggcacauguaggu

SEQ ID NO: 271654 - RNA, 64 nt, hsa
uggguagcuacaaaguuccucagggguuucauuuugcaggcaugucucugagcuucuauaccug

SEQ ID NO: 271655 - RNA, 64 nt, hsa
aguccugaaaggccaaugaguuggauggcaagaaugcaggcagaagcugcuggauaaaauaggc

SEQ ID NO: 271656 - RNA, 64 nt, hsa
auuauccugccucagccucccgaguagcugggacugcaggcacacacugccacgcccagcuaau

SEQ ID NO: 271657 - RNA, 64 nt, hsa
uggguagcuacaaaauuccucagggauuucauuuugcaggcaugucucugagcuucuauaccug

SEQ ID NO: 271658 - RNA, 64 nt, hsa
aagcagcccuuacuaagccgagaggugucauuccugcaggcaggaccuauaggcaccugaagau

SEQ ID NO: 271659 - RNA, 64 nt, hsa
gacaacacuaucuggagccacccacugaaagggcugcaggcaugggcuguacccaagcugauuu

SEQ ID NO: 271660 - RNA, 64 nt, hsa
agcuuagggagucacuauuggaggcagagaggcaugcaggcaggguccuaggagccccugcuuc

SEQ ID NO: 271661 - RNA, 64 nt, hsa
aggcccugggcccagucagcccugcugcucagagugcaggcauugcacauggugugagaagguc

SEQ ID NO: 271662 - RNA, 64 nt, hsa
gugagucccugggcucaguccuagcugcauggggugcaggcauugcacagagcaugaaugggcc

SEQ ID NO: 271663 - RNA, 64 nt, hsa
aguucccaggcccugccagcccugcugcacagggugcaggcauugcacacggugugaagggucu

SEQ ID NO: 271664 - RNA, 64 nt, hsa
ccuguuugguuuuguuucuccuggggcuguguucugcaggcagccagaaaaggaggaggcacgg

SEQ ID NO: 271665 - RNA, 64 nt, hsa
cuggcccaacagaaaaacccugccccaaugcaccugcaggcaagguacccgaagaagcagaggc

SEQ ID NO: 271666 - RNA, 64 nt, hsa
cuuacacccacaguggaaagacagcuucucauccugcaggcagcuuuuucucucccacuagaca

SEQ ID NO: 271667 - RNA, 64 nt, hsa
gggcugaggcauccuuccucacaccaggcuugccugcaggcaugagucagucugaugagaacuc

SEQ ID NO: 271668 - RNA, 64 nt, hsa
uguguuuugcguuuacuuccucuagaaaagaauuugcaggcaaccauguuuaauuugaacuauc

SEQ ID NO: 271669 - RNA, 64 nt, hsa
gugacgcagaauaguuuugcaauguguauauaguugcaggcaaaaaaaaaaccaccucacugca

SEQ ID NO: 271670 - RNA, 64 nt, hsa
aagugcuuauuuuuauagaaguuugaaaauuuaaugcaggcagguguguaauaaauuauuuuug

SEQ ID NO: 271671 - RNA, 64 nt, hsa
auccacccgccucagccucccaaagugcugggauugcaggcaugagccacugcacccaaccccu

SEQ ID NO: 271672 - RNA, 64 nt, hsa
cacuucccaccauugcaggcagacuucccaccauugcaggcagcugggcccacuucauaucaca

SEQ ID NO: 271673 - RNA, 64 nt, hsa
aggagcccucccuccaguggucacuucccaccauugcaggcagacuucccaccauugcaggcag

SEQ ID NO: 271674 - RNA, 64 nt, hsa
uuuuaccuggccuccagggccuguugaugggcuuugcaggcaguccagcagcccacaccugcag

SEQ ID NO: 271675 - RNA, 64 nt, hsa
gaugggcuuugcaggcaguccagcagcccacaccugcaggcaggaugcugucgucaaugagcug

SEQ ID NO: 271676 - RNA, 64 nt, hsa
uucacuaaguagccuguguuuuuaaauccagggcugcaggcagcaacgcaagucaggcugaaca

SEQ ID NO: 271677 - RNA, 64 nt, hsa
gacuccugggacuucugguccugggcacacuuuuugcaggcaacaaaaugugccugggagugau

SEQ ID NO: 271678 - RNA, 64 nt, hsa
cucggucugaacuucauccuggcaaaaacaaaguugcaggcacaacaguuuaagaaugcauucc

SEQ ID NO: 271679 - RNA, 64 nt, hsa
ucccagaaggccuuuguaaaaucaguagccguccugcaggcaggugggagcaacaggggcuuca

SEQ ID NO: 271680 - RNA, 64 nt, hsa
uugagccccuugucccaccacucccgccaucugcugcaggcaggaaggcaugugaguguacguu

SEQ ID NO: 271681 - RNA, 64 nt, hsa
auccucccaccucagccucccaagcagccgggacugcaggcacaagccaccaugccuggcuguu

SEQ ID NO: 271682 - RNA, 64 nt, hsa
uguuccccacagguccuccaucaccccugguggcugcaggcaccgcuggguucugacucuggac

SEQ ID NO: 271683 - RNA, 64 nt, hsa
aaggcagaaggccaggaguaagcccaagcuaagcugcaggcacacacgccuucaugccagugca

SEQ ID NO: 271684 - RNA, 64 nt, hsa
gacacaggaugaaggcaaugccauccucaaacacugcaggcaucacagcuaacaauugugaagu

SEQ ID NO: 271685 - RNA, 64 nt, hsa
caguuuaaccugaugcagucacguggaggagcagugcaggcacaguaugucccauaggcccagu

SEQ ID NO: 271686 - RNA, 64 nt, hsa
ccaagggcuggcgagggugggggcgggcaagggaugcaggcaggacagccaugagguggggcug

SEQ ID NO: 271687 - RNA, 64 nt, hsa
caggagcacgaaggccugucauccauggggccauugcaggcacucugccgcccgaccuugaggg

SEQ ID NO: 271688 - RNA, 64 nt, hsa
gugaguuuaguaaggcuguguacacugacaccuuugcaggcaugcaugugcuugugugugugug

SEQ ID NO: 271689 - RNA, 64 nt, hsa
gucucugucaugguagagaccgagccucugucacugcaggcacucaaugcagccagaccuauuc

SEQ ID NO: 271690 - RNA, 64 nt, hsa
ugcuccagcuccuccaaaguucuggcuuagcagcugcaggcaagcauuaugcugcuauugaaga

SEQ ID NO: 271691 - RNA, 64 nt, hsa
gcuuuccacaucaagaguccuuauguuauugggaugcaggcaaaccucugugguccuaagaccu

SEQ ID NO: 271692 - RNA, 64 nt, hsa
acagacuuuugcagaggcgauggcagagagcagcugcaggcauggucccuggagccgagccuuc

SEQ ID NO: 271693 - RNA, 64 nt, hsa
ucaggaggacuuaaugcuauuuauguugugccucugcaggcaaagcccuuaauaaauauuuuac

SEQ ID NO: 271694 - RNA, 64 nt, hsa
cuggcugccugggagccccacaccaccgggccagugcaggcacuguggugaucccauaaaaggc

SEQ ID NO: 271695 - RNA, 64 nt, hsa
ucgugcuguugcuucccguagauggcgagcaccuugcaggcagccuucugaucaguacugcucu

SEQ ID NO: 271696 - RNA, 64 nt, hsa
uaauuggcuguugccuggggaacaggagagcugcugcaggcagaugaccucaugggggguggag

SEQ ID NO: 271697 - RNA, 64 nt, hsa
acggcugcuaacagacugccacuugagugcgccuugcaggcacucccagagcagccauggaagg

SEQ ID NO: 271698 - RNA, 64 nt, hsa
ccaaggaucucuuggcgacaguaccaagcacgguucucuacacaggugacugaaguugccucug

SEQ ID NO: 271699 - RNA, 64 nt, hsa
uaaagaccagccugggcaacauagugagacuccgucucuacaaaaaauaaauuuagcugggcau

SEQ ID NO: 271700 - RNA, 64 nt, hsa
uacugaggcucaagccuucacagugagcugauggucucuacagggaggggagucuagggaauuu

SEQ ID NO: 271701 - RNA, 64 nt, hsa
uugagacuagacugggcaacauagcaagaccccgucucuacaaagcacaacgaaaaacaacaaa

SEQ ID NO: 271702 - RNA, 64 nt, hsa
uuuccccucuacuaacaagauccucccagcuuucucucuacauguagaaaggauaacauuucuc

SEQ ID NO: 271703 - RNA, 64 nt, hsa
ucaagaccaccuuggcgaacacggugaaaccccgucucuacaaaaaauacaaaaauuagccagg

SEQ ID NO: 271704 - RNA, 64 nt, hsa
uuguaaacagcuuuuccuuuuucucuuacuguuuucucuacaguccuuuauauuucauaccauc

SEQ ID NO: 271705 - RNA, 64 nt, hsa
gugcuuauuucuagugccuugugcucacuccugcucucuacagagccagccuggccugggcauu

SEQ ID NO: 271706 - RNA, 64 nt, hsa
gccaucuuacucugccuuucugcuuuggauguggucucuacacuaaccuucuugauguccaggg

SEQ ID NO: 271707 - RNA, 64 nt, hsa
agagcaccagccagggcaacauagcgugacccugucucuacaaaaaauuaaaaagagaacauac

SEQ ID NO: 271708 - RNA, 64 nt, hsa
agccaccuguuacuaagucaggaguguaguuggaucucuacauuaauguccucuugcugucuac

SEQ ID NO: 271709 - RNA, 64 nt, hsa
gggaugauaguugaagggaggugaagaggcugcuucucuacagaggugaaauuccagaugaguc

SEQ ID NO: 271710 - RNA, 64 nt, hsa
ugcagccuaaugagagugcacugcucccugggguucucuacaggccucuuccuguugugacugc

SEQ ID NO: 271711 - RNA, 64 nt, hsa
uuaaguccagcuuggccaagguggugaaaucccaucucuacaaaaaaugcagaacuuaaucugg

SEQ ID NO: 271712 - RNA, 64 nt, hsa
cugagacaagccuaggcaacaaaacaagacucugucucuacaaaaaguuuaagaaaugagccag

SEQ ID NO: 271713 - RNA, 64 nt, hsa
ggcacucaagccugggcaauguagcaagauccugucucuacaagaaauuuuuuaaaaaugagcc

SEQ ID NO: 271714 - RNA, 64 nt, hsa
ggaaugcgugaccccugagauggguccacgcaucucucuacacuuccuucucuccgugggauac

SEQ ID NO: 271715 - RNA, 64 nt, hsa
uuaaagaccagccugggcaacacagcaagacccaucucuacaagaaauuuaaaaacuagccagg

SEQ ID NO: 271716 - RNA, 64 nt, hsa
ucuucccuaggacugacgaguuacggcugccagaugccugcaugggaagagguggacaucugca

SEQ ID NO: 271717 - RNA, 64 nt, hsa
agggcagagaaauucccccgaagacugagcugguugccugcauccucuaucuucuuugacccuu

SEQ ID NO: 271718 - RNA, 64 nt, hsa
cacccucugaccucagcagagcuccugggccugcugccugcacaccacaucgccuaccuacaau

SEQ ID NO: 271719 - RNA, 64 nt, hsa
aaccaagcuaugggugacagaggcucucuccuggugccugcaccugcacucuagugacccuggg

SEQ ID NO: 271720 - RNA, 64 nt, hsa
caguucugcuaggucugcuuccugcccaggaaggugccugcacaugagaggagagaaauacacg

SEQ ID NO: 271721 - RNA, 64 nt, hsa
ugggcccccacugucccuccuccaggcauccuggugccugcauaccucuggcagcuggcccagg

SEQ ID NO: 271722 - RNA, 64 nt, hsa
auuuaguuuugucuuucucaggguauagucaauaugccugcaggaguuucuauagcgagacaua

SEQ ID NO: 271723 - RNA, 64 nt, hsa
caucagacagaaggguaaugcgugcaguuccugcugccugcaggcagacgaggccuuugcuuua

SEQ ID NO: 271724 - RNA, 64 nt, hsa
cuggccaggauagcuuaacccugacuuugggaucugccugcaucggcguuggccacugucccca

SEQ ID NO: 271725 - RNA, 64 nt, hsa
ccacuguccccauuuacauuuuccccacucugucugccugcaucuccucuguuccggguaggcc

SEQ ID NO: 271726 - RNA, 64 nt, hsa
gcagcaaccugccuuucccccuuaccugcccugcugccugcacacugcaugccugccccuucug

SEQ ID NO: 271727 - RNA, 64 nt, hsa
augaguuuagccaacagaacagguaauuuacuccugccugcagaauacuuuucguuggggaaga

SEQ ID NO: 271728 - RNA, 64 nt, hsa
agaaggaccuugcacugccuaccgagcucccucaugccugcaauuuaaauaccgagguguguuc

SEQ ID NO: 271729 - RNA, 64 nt, hsa
ucccaccuccuuucucuguccucuccugagguucugccugcagcccccaggaggugggccugcc

SEQ ID NO: 271730 - RNA, 64 nt, hsa
gcagucaggggucaggugucaggcccgucggagcugccugcagcacaugcgggcucgcccauac

SEQ ID NO: 271731 - RNA, 64 nt, hsa
aagccugaacugaggccuugugugucaggcccucugccugcacucccuggccuugcccgucgug

SEQ ID NO: 271732 - RNA, 64 nt, hsa
guuugauagaguagucuuggaaaccaucagguacugccugcagacuucuccagcacuaaauaua

SEQ ID NO: 271733 - RNA, 64 nt, hsa
guuuauuuaucuaaaggaaucaaguccacucuucugccugcaacauuuguucaaaaacuaacca

SEQ ID NO: 271734 - RNA, 64 nt, hsa
ggcuuguacccuggucaccaagcaugguagcagcugccugcauuguaucuccaucuggucacug

SEQ ID NO: 271735 - RNA, 64 nt, hsa
gcuccaggcugaccacagaucagccacagccugaugccugcagccccacuuugcucacccuucc

SEQ ID NO: 271736 - RNA, 64 nt, hsa
gugauacuauccaguuacugccgguuugaaaauaugccugcaaucugagccagugcuuuaaugg

SEQ ID NO: 271737 - RNA, 59 nt, hsa
gucgaagagcaucccaguaaugguuguccugccugcaauauuugaauuuuaaaucuaaa

SEQ ID NO: 271738 - RNA, 64 nt, hsa
acuggacucaggaugcccagggccacucugccucugccugcauucugccgugugcccucgggcg

SEQ ID NO: 271739 - RNA, 64 nt, hsa
gucugcuaacuuggagccccagugccaagcacagugccugcauguauuuauccaauaaauguga

SEQ ID NO: 271740 - RNA, 64 nt, hsa
cccuggaccccuagaccccgagccgccugccgacugccugcacagggagagcaguugaggcccg

SEQ ID NO: 271741 - RNA, 64 nt, hsa
cuuuauuuuugucugcugccaaugucgucucgcaugccugcacccucgcaugcacgcugcccgc

SEQ ID NO: 271742 - RNA, 58 nt, hsa
gcuccaugaucuccagguagugccgcgcugccugcaccuagugugcagaggggacggc

SEQ ID NO: 271743 - RNA, 64 nt, hsa
agcccucuugcccggucgggucagcccuaguggcugccugcacacuguagacgucccagggccu

SEQ ID NO: 271744 - RNA, 64 nt, hsa
uugcucuuugccaaaccuaccuugcuuugggagcugccugcaccaccccagagaaggccccacc

SEQ ID NO: 271745 - RNA, 64 nt, hsa
ucucaacugguuucugucuccguggagcuggaacugccugcacuugccuucagagggaggcaca

SEQ ID NO: 271746 - RNA, 64 nt, hsa
ccucauucagagacugcccuucucacgggcucuaugccugcacugggaaggaaacaaaugugua

SEQ ID NO: 271747 - RNA, 60 nt, hsa
uccuccagcugccccagugagggcccacccugccugcaccuccgcgggcugacugggcca

SEQ ID NO: 271748 - RNA, 64 nt, hsa
caaaaguggucggcugcagugccaggaccacccuugccugcagccuuugcgaccagagcccuuu

SEQ ID NO: 271749 - RNA, 64 nt, hsa
agucagguuguguccaggcaugcggagcugugagugccugcaggagagacacccaggaggaguu

SEQ ID NO: 271750 - RNA, 64 nt, hsa
acauaagacagcccguaggcuaccaagggacaccugccugcaaaggcuguugugucgggcagug

SEQ ID NO: 271751 - RNA, 64 nt, hsa
cuuuguaaugaagguuuggcuacuuguauaggucugccugcagggugaaaaugccagugugaau

SEQ ID NO: 271752 - RNA, 64 nt, hsa
ucccauguaggccuaaagucaccccacuccuuagugccugcaccucaccacgauauugaggaag

SEQ ID NO: 271753 - RNA, 64 nt, hsa
ugucauggcaacagaacgugggaugcuggaggcaugccugcagaaggacuguugaugcgaccca

SEQ ID NO: 271754 - RNA, 64 nt, hsa
aggguggaccagcugccuggcauucaggcccagaugccugcagggcuggggcucucgggacaga

SEQ ID NO: 271755 - RNA, 64 nt, hsa
acacuugccuuuaggccuguaggccuuuccugugugccugcaucucagggagggucucucucca

SEQ ID NO: 271756 - RNA, 64 nt, hsa
uuaacaaguaugauacaagcagaggcuugagaagugccugcacaaugaggcuugcccacuuuug

SEQ ID NO: 271757 - RNA, 62 nt, hsa
ggggguggggggugggggugggucagaacccugccauggaacuguuuccuucaucaugaguu

SEQ ID NO: 271758 - RNA, 62 nt, hsa
uccucccucacccccuccuucauaugaaaggugccauggaagaggcuacagggccaaacgcu

SEQ ID NO: 271759 - RNA, 62 nt, hsa
ccacccgcucccuuuuuuccuuagccuucagugccauggaacuaaucaagggaggaaaaggu

SEQ ID NO: 271760 - RNA, 62 nt, hsa
augaaauaacuguccugucacaugugcagcaggccauggaguguagcgggcaucgcugccgc

SEQ ID NO: 271761 - RNA, 62 nt, hsa
cuuuucaguugggaagaaaggagagggguggcgccauggacguggcccuaaacgcuguggga

SEQ ID NO: 271762 - RNA, 62 nt, hsa
gugugguaaagccauuggaugaggaggggacugccauggaaaggagaguuuguuacuuacgg

SEQ ID NO: 271763 - RNA, 62 nt, hsa
guucuccuguugcagguuuccauguugcugaggccauggagauucccagagcuggucacacc

SEQ ID NO: 271764 - RNA, 62 nt, hsa
gaccuuacucaggagcagauaucuccuuggccgccauggagccucauccauccacacgugcc

SEQ ID NO: 271765 - RNA, 62 nt, hsa
ccucaaaaugcaugcccauugucuucagguuugccauggaaagucaaaugauuuccacuuca

SEQ ID NO: 271766 - RNA, 62 nt, hsa
auagcucuagagcauggcuugguaaccuguuugccauggagcacuagaugguccuuuucacu

SEQ ID NO: 271767 - RNA, 62 nt, hsa
gaaaggcgagcagaaaacuccggcggucugaggccauggaggugguugcugcauuugagagg

SEQ ID NO: 271768 - RNA, 62 nt, hsa
ccgcacgcaugcauccacugcggccggaggaggccauggagcccgaguagcugccuggaucg

SEQ ID NO: 271769 - RNA, 62 nt, hsa
gggccugugggccagaggacuccaugacaguagccauggagucccaccugugccaggucaga

SEQ ID NO: 271770 - RNA, 62 nt, hsa
ccagugacuuugacagugugcucacucucagagccauggauuaccuggaacaaagugcagau

SEQ ID NO: 271771 - RNA, 62 nt, hsa
gcacuauccugaggagcgacaugugguugaacgccauggacgggacacaagcggaccaagga

SEQ ID NO: 271772 - RNA, 62 nt, hsa
aaaguugucucuagauacagaugcacgauuuggccauggauccgacuacucucgccaacaga

SEQ ID NO: 271773 - RNA, 62 nt, hsa
aagaaagggcaggugaggccuggguaaccccagccauggaccgucaguggcuggagggagcu

SEQ ID NO: 271774 - RNA, 62 nt, hsa
caaguugauacgauggggugcuugguggaugggccauggagguccgugagcuggaacugggc

SEQ ID NO: 271775 - RNA, 64 nt, hsa
aaagucucuaauucuauuaaagugcuaagguucuaaggccuacuuuuuuuuuuuuuuuuuuuuu

SEQ ID NO: 271776 - RNA, 64 nt, hsa
cuaaagauucuauaguucuagacauggagguucuaaggccuaggauucuaaaaugugauguucu

SEQ ID NO: 271777 - RNA, 64 nt, hsa
cggcaugccuucuguuucuccuucaaugcuccuuaaggccuaugugcugggaaaagggucuucc

SEQ ID NO: 271778 - RNA, 64 nt, hsa
cuccagaugagucagugaguggugaaugaaugugaaggccuagggcauuacuguauacuacugu

SEQ ID NO: 271779 - RNA, 64 nt, hsa
aacuccaucaauccaguccaagaggaggaggacgaaggccuagacucagcugaaggaucuucaa

SEQ ID NO: 271780 - RNA, 64 nt, hsa
ucuucaaagcaggaugaagaccuagacuuaccugaaggccuagacucagcugaaggaucuucaa

SEQ ID NO: 271781 - RNA, 64 nt, hsa
augaaggaguacacaaaccagagaaugacaugaauccagcaaauaggauccaacacaggcaaua

SEQ ID NO: 271782 - RNA, 64 nt, hsa
gugcccuuuuuagggaagcuguuggagaaaauacuccagcaaaaugaaggaguacacaaaccag

SEQ ID NO: 271783 - RNA, 64 nt, hsa
ugaggggugagaagugauguuuguuacuauguucuccagcaaguaaacauuccucugcucaccu

SEQ ID NO: 271784 - RNA, 64 nt, hsa
cacuauuauguagugcauuuuaacuuaaauuuuuuccagcaacauguuacuuauuuaagauaca

SEQ ID NO: 271785 - RNA, 64 nt, hsa
aaauacuaaauucauccucacuuuauguugaucuuccagcaacguuuauauauuuaguaauuuu

SEQ ID NO: 271786 - RNA, 64 nt, hsa
uuucagcagaaaugaaggauaagcaucgcacauguccagcaaugucuuugagaaugcagucauu

SEQ ID NO: 271787 - RNA, 64 nt, hsa
uaaguugucuuuguagaaaaugaagagccuuucuuccagcaaaaaucccugcuguaugcaauag

SEQ ID NO: 271788 - RNA, 64 nt, hsa
gaucuagggcagacacacaaccuccuccuccucuuccagcaaggaacgcaccgaaaagucacau

SEQ ID NO: 271789 - RNA, 64 nt, hsa; identical to SEQ ID NO: 138011

SEQ ID NO: 271790 - RNA, 64 nt, hsa; identical to SEQ ID NO: 138012

SEQ ID NO: 271791 - RNA, 64 nt, hsa; identical to SEQ ID NO: 138013

SEQ ID NO: 271792 - RNA, 64 nt, hsa; identical to SEQ ID NO: 138014

SEQ ID NO: 271793 - RNA, 64 nt, hsa; identical to SEQ ID NO: 138015

SEQ ID NO: 271794 - RNA, 59 nt, hsa; identical to SEQ ID NO: 138016

SEQ ID NO: 271795 - RNA, 64 nt, hsa; identical to SEQ ID NO: 138017

SEQ ID NO: 271796 - RNA, 64 nt, hsa; identical to SEQ ID NO: 138018

SEQ ID NO: 271797 - RNA, 64 nt, hsa; identical to SEQ ID NO: 138019

SEQ ID NO: 271798 - RNA, 64 nt, hsa; identical to SEQ ID NO: 138020

SEQ ID NO: 271799 - RNA, 64 nt, hsa; identical to SEQ ID NO: 138021

SEQ ID NO: 271800 - RNA, 64 nt, hsa; identical to SEQ ID NO: 138022

SEQ ID NO: 271801 - RNA, 64 nt, hsa; identical to SEQ ID NO: 138023

SEQ ID NO: 271802 - RNA, 64 nt, hsa; identical to SEQ ID NO: 138024

SEQ ID NO: 271803 - RNA, 64 nt, hsa; identical to SEQ ID NO: 138025

SEQ ID NO: 271804 - RNA, 64 nt, hsa; identical to SEQ ID NO: 138026

SEQ ID NO: 271805 - RNA, 64 nt, hsa; identical to SEQ ID NO: 138027

SEQ ID NO: 271806 - RNA, 64 nt, hsa; identical to SEQ ID NO: 138028

SEQ ID NO: 271807 - RNA, 64 nt, hsa; identical to SEQ ID NO: 138029

SEQ ID NO: 271808 - RNA, 64 nt, hsa; identical to SEQ ID NO: 138030

SEQ ID NO: 271809 - RNA, 64 nt, hsa; identical to SEQ ID NO: 138031

SEQ ID NO: 271810 - RNA, 64 nt, hsa; identical to SEQ ID NO: 138032

SEQ ID NO: 271811 - RNA, 64 nt, hsa; identical to SEQ ID NO: 138033

SEQ ID NO: 271812 - RNA, 64 nt, hsa; identical to SEQ ID NO: 138034

SEQ ID NO: 271813 - RNA, 64 nt, hsa; identical to SEQ ID NO: 138035

SEQ ID NO: 271814 - RNA, 64 nt, hsa; identical to SEQ ID NO: 138036

SEQ ID NO: 271815 - RNA, 64 nt, hsa; identical to SEQ ID NO: 138037

SEQ ID NO: 271816 - RNA, 64 nt, hsa; identical to SEQ ID NO: 138038

SEQ ID NO: 271817 - RNA, 64 nt, hsa; identical to SEQ ID NO: 138039

SEQ ID NO: 271818 - RNA, 64 nt, hsa; identical to SEQ ID NO: 138040

SEQ ID NO: 271819 - RNA, 64 nt, hsa; identical to SEQ ID NO: 138041

SEQ ID NO: 271820 - RNA, 64 nt, hsa; identical to SEQ ID NO: 138042

SEQ ID NO: 271821 - RNA, 64 nt, hsa; identical to SEQ ID NO: 138043

SEQ ID NO: 271822 - RNA, 64 nt, hsa; identical to SEQ ID NO: 138044

SEQ ID NO: 271823 - RNA, 64 nt, hsa; identical to SEQ ID NO: 138045

SEQ ID NO: 271824 - RNA, 64 nt, hsa; identical to SEQ ID NO: 138046

SEQ ID NO: 271825 - RNA, 64 nt, hsa; identical to SEQ ID NO: 138047

SEQ ID NO: 271826 - RNA, 64 nt, hsa; identical to SEQ ID NO: 138048

SEQ ID NO: 271827 - RNA, 64 nt, hsa; identical to SEQ ID NO: 138049

SEQ ID NO: 271828 - RNA, 64 nt, hsa; identical to SEQ ID NO: 138050

SEQ ID NO: 271829 - RNA, 64 nt, hsa; identical to SEQ ID NO: 138051

SEQ ID NO: 271830 - RNA, 64 nt, hsa; identical to SEQ ID NO: 138052

SEQ ID NO: 271831 - RNA, 64 nt, hsa; identical to SEQ ID NO: 138053

SEQ ID NO: 271832 - RNA, 64 nt, hsa; identical to SEQ ID NO: 138054

SEQ ID NO: 271833 - RNA, 64 nt, hsa; identical to SEQ ID NO: 138055

SEQ ID NO: 271834 - RNA, 64 nt, hsa; identical to SEQ ID NO: 138056

SEQ ID NO: 271835 - RNA, 64 nt, hsa; identical to SEQ ID NO: 138057

SEQ ID NO: 271836 - RNA, 64 nt, hsa; identical to SEQ ID NO: 138058

SEQ ID NO: 271837 - RNA, 64 nt, hsa; identical to SEQ ID NO: 138059

SEQ ID NO: 271838 - RNA, 64 nt, hsa; identical to SEQ ID NO: 138060

SEQ ID NO: 271839 - RNA, 64 nt, hsa; identical to SEQ ID NO: 138061

SEQ ID NO: 271840 - RNA, 64 nt, hsa; identical to SEQ ID NO: 138062

SEQ ID NO: 271841 - RNA, 64 nt, hsa; identical to SEQ ID NO: 138063

SEQ ID NO: 271842 - RNA, 64 nt, hsa; identical to SEQ ID NO: 138064

SEQ ID NO: 271843 - RNA, 64 nt, hsa; identical to SEQ ID NO: 138065

SEQ ID NO: 271844 - RNA, 64 nt, hsa; identical to SEQ ID NO: 138066

SEQ ID NO: 271845 - RNA, 64 nt, hsa; identical to SEQ ID NO: 156991

SEQ ID NO: 271846 - RNA, 64 nt, hsa; identical to SEQ ID NO: 156992

SEQ ID NO: 271847 - RNA, 64 nt, hsa; identical to SEQ ID NO: 156993

SEQ ID NO: 271848 - RNA, 64 nt, hsa; identical to SEQ ID NO: 156994

SEQ ID NO: 271849 - RNA, 64 nt, hsa; identical to SEQ ID NO: 156995

SEQ ID NO: 271850 - RNA, 64 nt, hsa; identical to SEQ ID NO: 156996

SEQ ID NO: 271851 - RNA, 64 nt, hsa; identical to SEQ ID NO: 156997

SEQ ID NO: 271852 - RNA, 64 nt, hsa; identical to SEQ ID NO: 156998

SEQ ID NO: 271853 - RNA, 64 nt, hsa; identical to SEQ ID NO: 156999

SEQ ID NO: 271854 - RNA, 64 nt, hsa; identical to SEQ ID NO: 157000

SEQ ID NO: 271855 - RNA, 64 nt, hsa; identical to SEQ ID NO: 157001

SEQ ID NO: 271856 - RNA, 64 nt, hsa; identical to SEQ ID NO: 157002

SEQ ID NO: 271857 - RNA, 64 nt, hsa; identical to SEQ ID NO: 157003

SEQ ID NO: 271858 - RNA, 64 nt, hsa; identical to SEQ ID NO: 157004

SEQ ID NO: 271859 - RNA, 64 nt, hsa; identical to SEQ ID NO: 157005

SEQ ID NO: 271860 - RNA, 64 nt, hsa; identical to SEQ ID NO: 157006

SEQ ID NO: 271861 - RNA, 64 nt, hsa; identical to SEQ ID NO: 157007

SEQ ID NO: 271862 - RNA, 64 nt, hsa; identical to SEQ ID NO: 157008

SEQ ID NO: 271863 - RNA, 64 nt, hsa; identical to SEQ ID NO: 157009

SEQ ID NO: 271864 - RNA, 64 nt, hsa; identical to SEQ ID NO: 157010

SEQ ID NO: 271865 - RNA, 64 nt, hsa; identical to SEQ ID NO: 157011

SEQ ID NO: 271866 - RNA, 64 nt, hsa; identical to SEQ ID NO: 157012

SEQ ID NO: 271867 - RNA, 64 nt, hsa; identical to SEQ ID NO: 157013

SEQ ID NO: 271868 - RNA, 64 nt, hsa; identical to SEQ ID NO: 157014

SEQ ID NO: 271869 - RNA, 64 nt, hsa; identical to SEQ ID NO: 157015

SEQ ID NO: 271870 - RNA, 64 nt, hsa; identical to SEQ ID NO: 157016

SEQ ID NO: 271871 - RNA, 64 nt, hsa; identical to SEQ ID NO: 157017

SEQ ID NO: 271872 - RNA, 64 nt, hsa; identical to SEQ ID NO: 157018

SEQ ID NO: 271873 - RNA, 64 nt, hsa; identical to SEQ ID NO: 157019

SEQ ID NO: 271874 - RNA, 64 nt, hsa; identical to SEQ ID NO: 157020

SEQ ID NO: 271875 - RNA, 64 nt, hsa; identical to SEQ ID NO: 157021

SEQ ID NO: 271876 - RNA, 64 nt, hsa; identical to SEQ ID NO: 157022

SEQ ID NO: 271877 - RNA, 64 nt, hsa; identical to SEQ ID NO: 157023

SEQ ID NO: 271878 - RNA, 64 nt, hsa; identical to SEQ ID NO: 157024

SEQ ID NO: 271879 - RNA, 64 nt, hsa; identical to SEQ ID NO: 157025

SEQ ID NO: 271880 - RNA, 64 nt, hsa; identical to SEQ ID NO: 157026

SEQ ID NO: 271881 - RNA, 64 nt, hsa; identical to SEQ ID NO: 157027

SEQ ID NO: 271882 - RNA, 64 nt, hsa; identical to SEQ ID NO: 157028

SEQ ID NO: 271883 - RNA, 64 nt, hsa; identical to SEQ ID NO: 157029

SEQ ID NO: 271884 - RNA, 64 nt, hsa; identical to SEQ ID NO: 157030

SEQ ID NO: 271885 - RNA, 64 nt, hsa; identical to SEQ ID NO: 157031

SEQ ID NO: 271886 - RNA, 64 nt, hsa; identical to SEQ ID NO: 157032

SEQ ID NO: 271887 - RNA, 64 nt, hsa; identical to SEQ ID NO: 157033

SEQ ID NO: 271888 - RNA, 64 nt, hsa; identical to SEQ ID NO: 157034

SEQ ID NO: 271889 - RNA, 64 nt, hsa; identical to SEQ ID NO: 157035

SEQ ID NO: 271890 - RNA, 64 nt, hsa; identical to SEQ ID NO: 157036

SEQ ID NO: 271891 - RNA, 64 nt, hsa; identical to SEQ ID NO: 157037

SEQ ID NO: 271892 - RNA, 64 nt, hsa; identical to SEQ ID NO: 157038

SEQ ID NO: 271893 - RNA, 64 nt, hsa; identical to SEQ ID NO: 157039

SEQ ID NO: 271894 - RNA, 64 nt, hsa; identical to SEQ ID NO: 157040

SEQ ID NO: 271895 - RNA, 64 nt, hsa; identical to SEQ ID NO: 157041

SEQ ID NO: 271896 - RNA, 64 nt, hsa; identical to SEQ ID NO: 157042

SEQ ID NO: 271897 - RNA, 64 nt, hsa; identical to SEQ ID NO: 157043

SEQ ID NO: 271898 - RNA, 64 nt, hsa; identical to SEQ ID NO: 157044

SEQ ID NO: 271899 - RNA, 64 nt, hsa; identical to SEQ ID NO: 157045

SEQ ID NO: 271900 - RNA, 64 nt, hsa; identical to SEQ ID NO: 157046

SEQ ID NO: 271901 - RNA, 64 nt, hsa; identical to SEQ ID NO: 157047

SEQ ID NO: 271902 - RNA, 64 nt, hsa; identical to SEQ ID NO: 157048

SEQ ID NO: 271903 - RNA, 64 nt, hsa; identical to SEQ ID NO: 157049

SEQ ID NO: 271904 - RNA, 64 nt, hsa; identical to SEQ ID NO: 157050

SEQ ID NO: 271905 - RNA, 64 nt, hsa; identical to SEQ ID NO: 157051

SEQ ID NO: 271906 - RNA, 64 nt, hsa; identical to SEQ ID NO: 157052

SEQ ID NO: 271907 - RNA, 64 nt, hsa; identical to SEQ ID NO: 157053

SEQ ID NO: 271908 - RNA, 64 nt, hsa; identical to SEQ ID NO: 157054

SEQ ID NO: 271909 - RNA, 64 nt, hsa; identical to SEQ ID NO: 157055

SEQ ID NO: 271910 - RNA, 64 nt, hsa; identical to SEQ ID NO: 157056

SEQ ID NO: 271911 - RNA, 64 nt, hsa; identical to SEQ ID NO: 157057

SEQ ID NO: 271912 - RNA, 64 nt, hsa; identical to SEQ ID NO: 157058

SEQ ID NO: 271913 - RNA, 64 nt, hsa; identical to SEQ ID NO: 157059

SEQ ID NO: 271914 - RNA, 64 nt, hsa; identical to SEQ ID NO: 157060

SEQ ID NO: 271915 - RNA, 64 nt, hsa; identical to SEQ ID NO: 157061

SEQ ID NO: 271916 - RNA, 64 nt, hsa; identical to SEQ ID NO: 157062

SEQ ID NO: 271917 - RNA, 64 nt, hsa; identical to SEQ ID NO: 157063

SEQ ID NO: 271918 - RNA, 64 nt, hsa; identical to SEQ ID NO: 157064

SEQ ID NO: 271919 - RNA, 64 nt, hsa; identical to SEQ ID NO: 157065

SEQ ID NO: 271920 - RNA, 64 nt, hsa; identical to SEQ ID NO: 157066

SEQ ID NO: 271921 - RNA, 64 nt, hsa; identical to SEQ ID NO: 157067

SEQ ID NO: 271922 - RNA, 64 nt, hsa; identical to SEQ ID NO: 157068

SEQ ID NO: 271923 - RNA, 64 nt, hsa; identical to SEQ ID NO: 157069

SEQ ID NO: 271924 - RNA, 64 nt, hsa; identical to SEQ ID NO: 157070

SEQ ID NO: 271925 - RNA, 64 nt, hsa; identical to SEQ ID NO: 157071

SEQ ID NO: 271926 - RNA, 64 nt, hsa; identical to SEQ ID NO: 157072

SEQ ID NO: 271927 - RNA, 64 nt, hsa; identical to SEQ ID NO: 157073

SEQ ID NO: 271928 - RNA, 64 nt, hsa; identical to SEQ ID NO: 157074

SEQ ID NO: 271929 - RNA, 64 nt, hsa; identical to SEQ ID NO: 157075

SEQ ID NO: 271930 - RNA, 64 nt, hsa; identical to SEQ ID NO: 157076

SEQ ID NO: 271931 - RNA, 64 nt, hsa; identical to SEQ ID NO: 157077

SEQ ID NO: 271932 - RNA, 64 nt, hsa; identical to SEQ ID NO: 157078

SEQ ID NO: 271933 - RNA, 64 nt, hsa; identical to SEQ ID NO: 157079

SEQ ID NO: 271934 - RNA, 64 nt, hsa; identical to SEQ ID NO: 157080

SEQ ID NO: 271935 - RNA, 64 nt, hsa; identical to SEQ ID NO: 157081

SEQ ID NO: 271936 - RNA, 64 nt, hsa; identical to SEQ ID NO: 157082

SEQ ID NO: 271937 - RNA, 64 nt, hsa; identical to SEQ ID NO: 157083

SEQ ID NO: 271938 - RNA, 64 nt, hsa; identical to SEQ ID NO: 157084

SEQ ID NO: 271939 - RNA, 64 nt, hsa; identical to SEQ ID NO: 157085

SEQ ID NO: 271940 - RNA, 64 nt, hsa; identical to SEQ ID NO: 157086

SEQ ID NO: 271941 - RNA, 64 nt, hsa; identical to SEQ ID NO: 157087

SEQ ID NO: 271942 - RNA, 64 nt, hsa; identical to SEQ ID NO: 157088

SEQ ID NO: 271943 - RNA, 64 nt, hsa; identical to SEQ ID NO: 157089

SEQ ID NO: 271944 - RNA, 64 nt, hsa; identical to SEQ ID NO: 157090

SEQ ID NO: 271945 - RNA, 64 nt, hsa; identical to SEQ ID NO: 157091

SEQ ID NO: 271946 - RNA, 64 nt, hsa; identical to SEQ ID NO: 157092

SEQ ID NO: 271947 - RNA, 64 nt, hsa; identical to SEQ ID NO: 157093

SEQ ID NO: 271948 - RNA, 64 nt, hsa; identical to SEQ ID NO: 157094

SEQ ID NO: 271949 - RNA, 64 nt, hsa; identical to SEQ ID NO: 157095

SEQ ID NO: 271950 - RNA, 64 nt, hsa; identical to SEQ ID NO: 157096

SEQ ID NO: 271951 - RNA, 64 nt, hsa; identical to SEQ ID NO: 157097

SEQ ID NO: 271952 - RNA, 64 nt, hsa; identical to SEQ ID NO: 157098

SEQ ID NO: 271953 - RNA, 64 nt, hsa; identical to SEQ ID NO: 157099

SEQ ID NO: 271954 - RNA, 64 nt, hsa; identical to SEQ ID NO: 157100

SEQ ID NO: 271955 - RNA, 64 nt, hsa; identical to SEQ ID NO: 157101

SEQ ID NO: 271956 - RNA, 64 nt, hsa; identical to SEQ ID NO: 157102

SEQ ID NO: 271957 - RNA, 64 nt, hsa; identical to SEQ ID NO: 157103

SEQ ID NO: 271958 - RNA, 64 nt, hsa; identical to SEQ ID NO: 157104

SEQ ID NO: 271959 - RNA, 64 nt, hsa; identical to SEQ ID NO: 157105

SEQ ID NO: 271960 - RNA, 64 nt, hsa; identical to SEQ ID NO: 157106

SEQ ID NO: 271961 - RNA, 64 nt, hsa; identical to SEQ ID NO: 157107

SEQ ID NO: 271962 - RNA, 64 nt, hsa; identical to SEQ ID NO: 157108

SEQ ID NO: 271963 - RNA, 64 nt, hsa; identical to SEQ ID NO: 157109

SEQ ID NO: 271964 - RNA, 64 nt, hsa; identical to SEQ ID NO: 157110

SEQ ID NO: 271965 - RNA, 64 nt, hsa; identical to SEQ ID NO: 157111

SEQ ID NO: 271966 - RNA, 64 nt, hsa; identical to SEQ ID NO: 157112

SEQ ID NO: 271967 - RNA, 64 nt, hsa; identical to SEQ ID NO: 157113

SEQ ID NO: 271968 - RNA, 64 nt, hsa; identical to SEQ ID NO: 157114

SEQ ID NO: 271969 - RNA, 64 nt, hsa; identical to SEQ ID NO: 157115

SEQ ID NO: 271970 - RNA, 64 nt, hsa; identical to SEQ ID NO: 157116

SEQ ID NO: 271971 - RNA, 64 nt, hsa; identical to SEQ ID NO: 157117

SEQ ID NO: 271972 - RNA, 64 nt, hsa; identical to SEQ ID NO: 157118

SEQ ID NO: 271973 - RNA, 64 nt, hsa; identical to SEQ ID NO: 157119

SEQ ID NO: 271974 - RNA, 64 nt, hsa; identical to SEQ ID NO: 157120

SEQ ID NO: 271975 - RNA, 50 nt, hsa; identical to SEQ ID NO: 157121

SEQ ID NO: 271976 - RNA, 52 nt, hsa; identical to SEQ ID NO: 157122

SEQ ID NO: 271977 - RNA, 54 nt, hsa; identical to SEQ ID NO: 157123

SEQ ID NO: 271978 - RNA, 56 nt, hsa; identical to SEQ ID NO: 157124

SEQ ID NO: 271979 - RNA, 58 nt, hsa; identical to SEQ ID NO: 157125

SEQ ID NO: 271980 - RNA, 60 nt, hsa; identical to SEQ ID NO: 157126

SEQ ID NO: 271981 - RNA, 62 nt, hsa; identical to SEQ ID NO: 157127

SEQ ID NO: 271982 - RNA, 64 nt, hsa; identical to SEQ ID NO: 157128

SEQ ID NO: 271983 - RNA, 64 nt, hsa; identical to SEQ ID NO: 157129

SEQ ID NO: 271984 - RNA, 64 nt, hsa; identical to SEQ ID NO: 157130

SEQ ID NO: 271985 - RNA, 64 nt, hsa; identical to SEQ ID NO: 157131

SEQ ID NO: 271986 - RNA, 64 nt, hsa; identical to SEQ ID NO: 157132

SEQ ID NO: 271987 - RNA, 64 nt, hsa; identical to SEQ ID NO: 157133

SEQ ID NO: 271988 - RNA, 64 nt, hsa; identical to SEQ ID NO: 157134

SEQ ID NO: 271989 - RNA, 64 nt, hsa; identical to SEQ ID NO: 157135

SEQ ID NO: 271990 - RNA, 64 nt, hsa; identical to SEQ ID NO: 157136

SEQ ID NO: 271991 - RNA, 64 nt, hsa; identical to SEQ ID NO: 157137

SEQ ID NO: 271992 - RNA, 64 nt, hsa; identical to SEQ ID NO: 157138

SEQ ID NO: 271993 - RNA, 64 nt, hsa; identical to SEQ ID NO: 157139

SEQ ID NO: 271994 - RNA, 64 nt, hsa; identical to SEQ ID NO: 157140

SEQ ID NO: 271995 - RNA, 64 nt, hsa; identical to SEQ ID NO: 157141

SEQ ID NO: 271996 - RNA, 64 nt, hsa; identical to SEQ ID NO: 157142

SEQ ID NO: 271997 - RNA, 64 nt, hsa; identical to SEQ ID NO: 157143

SEQ ID NO: 271998 - RNA, 64 nt, hsa; identical to SEQ ID NO: 157144

SEQ ID NO: 271999 - RNA, 64 nt, hsa; identical to SEQ ID NO: 157145

SEQ ID NO: 272000 - RNA, 64 nt, hsa; identical to SEQ ID NO: 157146

SEQ ID NO: 272001 - RNA, 64 nt, hsa; identical to SEQ ID NO: 157147

SEQ ID NO: 272002 - RNA, 64 nt, hsa; identical to SEQ ID NO: 157148

SEQ ID NO: 272003 - RNA, 64 nt, hsa; identical to SEQ ID NO: 157149

SEQ ID NO: 272004 - RNA, 64 nt, hsa; identical to SEQ ID NO: 157150

SEQ ID NO: 272005 - RNA, 64 nt, hsa; identical to SEQ ID NO: 157151

SEQ ID NO: 272006 - RNA, 64 nt, hsa; identical to SEQ ID NO: 157152

SEQ ID NO: 272007 - RNA, 64 nt, hsa; identical to SEQ ID NO: 157153

SEQ ID NO: 272008 - RNA, 64 nt, hsa; identical to SEQ ID NO: 157154

SEQ ID NO: 272009 - RNA, 64 nt, hsa; identical to SEQ ID NO: 157155

SEQ ID NO: 272010 - RNA, 64 nt, hsa; identical to SEQ ID NO: 157156

SEQ ID NO: 272011 - RNA, 64 nt, hsa; identical to SEQ ID NO: 157157

SEQ ID NO: 272012 - RNA, 64 nt, hsa; identical to SEQ ID NO: 157158

SEQ ID NO: 272013 - RNA, 64 nt, hsa; identical to SEQ ID NO: 157159

SEQ ID NO: 272014 - RNA, 64 nt, hsa; identical to SEQ ID NO: 157160

SEQ ID NO: 272015 - RNA, 64 nt, hsa; identical to SEQ ID NO: 157161

SEQ ID NO: 272016 - RNA, 64 nt, hsa; identical to SEQ ID NO: 157162

SEQ ID NO: 272017 - RNA, 64 nt, hsa; identical to SEQ ID NO: 157163

SEQ ID NO: 272018 - RNA, 64 nt, hsa; identical to SEQ ID NO: 157164

SEQ ID NO: 272019 - RNA, 64 nt, hsa; identical to SEQ ID NO: 157165

SEQ ID NO: 272020 - RNA, 64 nt, hsa; identical to SEQ ID NO: 157166

SEQ ID NO: 272021 - RNA, 64 nt, hsa; identical to SEQ ID NO: 157167

SEQ ID NO: 272022 - RNA, 64 nt, hsa; identical to SEQ ID NO: 157168

SEQ ID NO: 272023 - RNA, 64 nt, hsa; identical to SEQ ID NO: 157169

SEQ ID NO: 272024 - RNA, 64 nt, hsa; identical to SEQ ID NO: 157170

SEQ ID NO: 272025 - RNA, 64 nt, hsa; identical to SEQ ID NO: 157171

SEQ ID NO: 272026 - RNA, 64 nt, hsa; identical to SEQ ID NO: 157172

SEQ ID NO: 272027 - RNA, 64 nt, hsa; identical to SEQ ID NO: 157173

SEQ ID NO: 272028 - RNA, 64 nt, hsa; identical to SEQ ID NO: 157174

SEQ ID NO: 272029 - RNA, 64 nt, hsa; identical to SEQ ID NO: 157175

SEQ ID NO: 272030 - RNA, 64 nt, hsa; identical to SEQ ID NO: 157176

SEQ ID NO: 272031 - RNA, 64 nt, hsa; identical to SEQ ID NO: 157177

SEQ ID NO: 272032 - RNA, 64 nt, hsa; identical to SEQ ID NO: 157178

SEQ ID NO: 272033 - RNA, 64 nt, hsa; identical to SEQ ID NO: 157179

SEQ ID NO: 272034 - RNA, 64 nt, hsa; identical to SEQ ID NO: 157180

SEQ ID NO: 272035 - RNA, 64 nt, hsa; identical to SEQ ID NO: 157181

SEQ ID NO: 272036 - RNA, 64 nt, hsa; identical to SEQ ID NO: 157182

SEQ ID NO: 272037 - RNA, 64 nt, hsa; identical to SEQ ID NO: 157183

SEQ ID NO: 272038 - RNA, 64 nt, hsa; identical to SEQ ID NO: 157184

SEQ ID NO: 272039 - RNA, 64 nt, hsa; identical to SEQ ID NO: 157185

SEQ ID NO: 272040 - RNA, 64 nt, hsa; identical to SEQ ID NO: 157186

SEQ ID NO: 272041 - RNA, 64 nt, hsa; identical to SEQ ID NO: 157187

SEQ ID NO: 272042 - RNA, 64 nt, hsa; identical to SEQ ID NO: 157188

SEQ ID NO: 272043 - RNA, 64 nt, hsa; identical to SEQ ID NO: 157189

SEQ ID NO: 272044 - RNA, 64 nt, hsa; identical to SEQ ID NO: 157190

SEQ ID NO: 272045 - RNA, 64 nt, hsa; identical to SEQ ID NO: 157191

SEQ ID NO: 272046 - RNA, 64 nt, hsa; identical to SEQ ID NO: 157192

SEQ ID NO: 272047 - RNA, 64 nt, hsa; identical to SEQ ID NO: 157193

SEQ ID NO: 272048 - RNA, 64 nt, hsa; identical to SEQ ID NO: 157194

SEQ ID NO: 272049 - RNA, 64 nt, hsa; identical to SEQ ID NO: 157195

SEQ ID NO: 272050 - RNA, 64 nt, hsa; identical to SEQ ID NO: 157196

SEQ ID NO: 272051 - RNA, 64 nt, hsa; identical to SEQ ID NO: 157197

SEQ ID NO: 272052 - RNA, 64 nt, hsa; identical to SEQ ID NO: 157198

SEQ ID NO: 272053 - RNA, 64 nt, hsa; identical to SEQ ID NO: 157199

SEQ ID NO: 272054 - RNA, 64 nt, hsa; identical to SEQ ID NO: 157200

SEQ ID NO: 272055 - RNA, 64 nt, hsa; identical to SEQ ID NO: 157201

SEQ ID NO: 272056 - RNA, 64 nt, hsa; identical to SEQ ID NO: 157202

SEQ ID NO: 272057 - RNA, 64 nt, hsa; identical to SEQ ID NO: 157203

SEQ ID NO: 272058 - RNA, 64 nt, hsa; identical to SEQ ID NO: 157204

SEQ ID NO: 272059 - RNA, 64 nt, hsa; identical to SEQ ID NO: 157205

SEQ ID NO: 272060 - RNA, 64 nt, hsa; identical to SEQ ID NO: 157206

SEQ ID NO: 272061 - RNA, 64 nt, hsa; identical to SEQ ID NO: 157207

SEQ ID NO: 272062 - RNA, 64 nt, hsa; identical to SEQ ID NO: 157208

SEQ ID NO: 272063 - RNA, 64 nt, hsa; identical to SEQ ID NO: 157209

SEQ ID NO: 272064 - RNA, 64 nt, hsa; identical to SEQ ID NO: 157210

SEQ ID NO: 272065 - RNA, 64 nt, hsa; identical to SEQ ID NO: 157211

SEQ ID NO: 272066 - RNA, 64 nt, hsa; identical to SEQ ID NO: 157212

SEQ ID NO: 272067 - RNA, 64 nt, hsa; identical to SEQ ID NO: 157213

SEQ ID NO: 272068 - RNA, 64 nt, hsa; identical to SEQ ID NO: 157214

SEQ ID NO: 272069 - RNA, 64 nt, hsa; identical to SEQ ID NO: 157215

SEQ ID NO: 272070 - RNA, 64 nt, hsa; identical to SEQ ID NO: 157216

SEQ ID NO: 272071 - RNA, 64 nt, hsa; identical to SEQ ID NO: 157217

SEQ ID NO: 272072 - RNA, 64 nt, hsa; identical to SEQ ID NO: 157218

SEQ ID NO: 272073 - RNA, 64 nt, hsa; identical to SEQ ID NO: 157219

SEQ ID NO: 272074 - RNA, 64 nt, hsa; identical to SEQ ID NO: 157220

SEQ ID NO: 272075 - RNA, 64 nt, hsa; identical to SEQ ID NO: 157221

SEQ ID NO: 272076 - RNA, 64 nt, hsa; identical to SEQ ID NO: 157222

SEQ ID NO: 272077 - RNA, 64 nt, hsa; identical to SEQ ID NO: 157223

SEQ ID NO: 272078 - RNA, 64 nt, hsa; identical to SEQ ID NO: 157224

SEQ ID NO: 272079 - RNA, 64 nt, hsa; identical to SEQ ID NO: 157225

SEQ ID NO: 272080 - RNA, 64 nt, hsa; identical to SEQ ID NO: 157226

SEQ ID NO: 272081 - RNA, 64 nt, hsa; identical to SEQ ID NO: 157227

SEQ ID NO: 272082 - RNA, 64 nt, hsa; identical to SEQ ID NO: 157228

SEQ ID NO: 272083 - RNA, 64 nt, hsa; identical to SEQ ID NO: 157229

SEQ ID NO: 272084 - RNA, 64 nt, hsa; identical to SEQ ID NO: 157230

SEQ ID NO: 272085 - RNA, 64 nt, hsa; identical to SEQ ID NO: 157231

SEQ ID NO: 272086 - RNA, 63 nt, hsa; identical to SEQ ID NO: 157232

SEQ ID NO: 272087 - RNA, 64 nt, hsa; identical to SEQ ID NO: 157233

SEQ ID NO: 272088 - RNA, 64 nt, hsa; identical to SEQ ID NO: 157234

SEQ ID NO: 272089 - RNA, 64 nt, hsa; identical to SEQ ID NO: 157235

SEQ ID NO: 272090 - RNA, 64 nt, hsa; identical to SEQ ID NO: 157236

SEQ ID NO: 272091 - RNA, 64 nt, hsa; identical to SEQ ID NO: 157237

SEQ ID NO: 272092 - RNA, 64 nt, hsa; identical to SEQ ID NO: 157238

SEQ ID NO: 272093 - RNA, 64 nt, hsa; identical to SEQ ID NO: 157239

SEQ ID NO: 272094 - RNA, 64 nt, hsa; identical to SEQ ID NO: 157240

SEQ ID NO: 272095 - RNA, 64 nt, hsa; identical to SEQ ID NO: 157241

SEQ ID NO: 272096 - RNA, 64 nt, hsa; identical to SEQ ID NO: 157242

SEQ ID NO: 272097 - RNA, 64 nt, hsa; identical to SEQ ID NO: 157243

SEQ ID NO: 272098 - RNA, 64 nt, hsa; identical to SEQ ID NO: 157244

SEQ ID NO: 272099 - RNA, 64 nt, hsa; identical to SEQ ID NO: 157245

SEQ ID NO: 272100 - RNA, 64 nt, hsa; identical to SEQ ID NO: 157246

SEQ ID NO: 272101 - RNA, 64 nt, hsa; identical to SEQ ID NO: 157247

SEQ ID NO: 272102 - RNA, 64 nt, hsa; identical to SEQ ID NO: 157248

SEQ ID NO: 272103 - RNA, 64 nt, hsa; identical to SEQ ID NO: 157249

SEQ ID NO: 272104 - RNA, 64 nt, hsa; identical to SEQ ID NO: 157250

SEQ ID NO: 272105 - RNA, 64 nt, hsa; identical to SEQ ID NO: 157251

SEQ ID NO: 272106 - RNA, 64 nt, hsa; identical to SEQ ID NO: 157252

SEQ ID NO: 272107 - RNA, 64 nt, hsa; identical to SEQ ID NO: 157253

SEQ ID NO: 272108 - RNA, 64 nt, hsa; identical to SEQ ID NO: 157254

SEQ ID NO: 272109 - RNA, 64 nt, hsa; identical to SEQ ID NO: 157255

SEQ ID NO: 272110 - RNA, 64 nt, hsa; identical to SEQ ID NO: 157256

SEQ ID NO: 272111 - RNA, 64 nt, hsa; identical to SEQ ID NO: 157257

SEQ ID NO: 272112 - RNA, 64 nt, hsa; identical to SEQ ID NO: 157258

SEQ ID NO: 272113 - RNA, 64 nt, hsa; identical to SEQ ID NO: 157259

SEQ ID NO: 272114 - RNA, 64 nt, hsa; identical to SEQ ID NO: 157260

SEQ ID NO: 272115 - RNA, 64 nt, hsa; identical to SEQ ID NO: 157261

SEQ ID NO: 272116 - RNA, 64 nt, hsa; identical to SEQ ID NO: 157262

SEQ ID NO: 272117 - RNA, 64 nt, hsa; identical to SEQ ID NO: 157263

SEQ ID NO: 272118 - RNA, 64 nt, hsa; identical to SEQ ID NO: 157264

SEQ ID NO: 272119 - RNA, 64 nt, hsa; identical to SEQ ID NO: 157265

SEQ ID NO: 272120 - RNA, 64 nt, hsa; identical to SEQ ID NO: 157266

SEQ ID NO: 272121 - RNA, 64 nt, hsa; identical to SEQ ID NO: 157267

SEQ ID NO: 272122 - RNA, 64 nt, hsa; identical to SEQ ID NO: 157268

SEQ ID NO: 272123 - RNA, 64 nt, hsa; identical to SEQ ID NO: 157269

SEQ ID NO: 272124 - RNA, 64 nt, hsa; identical to SEQ ID NO: 157270

SEQ ID NO: 272125 - RNA, 64 nt, hsa; identical to SEQ ID NO: 157271

SEQ ID NO: 272126 - RNA, 64 nt, hsa; identical to SEQ ID NO: 157272

SEQ ID NO: 272127 - RNA, 64 nt, hsa; identical to SEQ ID NO: 157273

SEQ ID NO: 272128 - RNA, 64 nt, hsa; identical to SEQ ID NO: 157274

SEQ ID NO: 272129 - RNA, 64 nt, hsa; identical to SEQ ID NO: 157275

SEQ ID NO: 272130 - RNA, 64 nt, hsa; identical to SEQ ID NO: 157276

SEQ ID NO: 272131 - RNA, 64 nt, hsa; identical to SEQ ID NO: 157277

SEQ ID NO: 272132 - RNA, 64 nt, hsa; identical to SEQ ID NO: 157278

SEQ ID NO: 272133 - RNA, 64 nt, hsa; identical to SEQ ID NO: 157279

SEQ ID NO: 272134 - RNA, 64 nt, hsa; identical to SEQ ID NO: 157280

SEQ ID NO: 272135 - RNA, 64 nt, hsa; identical to SEQ ID NO: 157281

SEQ ID NO: 272136 - RNA, 64 nt, hsa; identical to SEQ ID NO: 157282

SEQ ID NO: 272137 - RNA, 64 nt, hsa; identical to SEQ ID NO: 157283

SEQ ID NO: 272138 - RNA, 64 nt, hsa; identical to SEQ ID NO: 157284

SEQ ID NO: 272139 - RNA, 64 nt, hsa; identical to SEQ ID NO: 157285

SEQ ID NO: 272140 - RNA, 64 nt, hsa; identical to SEQ ID NO: 157286

SEQ ID NO: 272141 - RNA, 64 nt, hsa; identical to SEQ ID NO: 157287

SEQ ID NO: 272142 - RNA, 64 nt, hsa; identical to SEQ ID NO: 157288

SEQ ID NO: 272143 - RNA, 64 nt, hsa; identical to SEQ ID NO: 157289

SEQ ID NO: 272144 - RNA, 64 nt, hsa; identical to SEQ ID NO: 157290

SEQ ID NO: 272145 - RNA, 64 nt, hsa; identical to SEQ ID NO: 157291

SEQ ID NO: 272146 - RNA, 64 nt, hsa; identical to SEQ ID NO: 157292

SEQ ID NO: 272147 - RNA, 64 nt, hsa; identical to SEQ ID NO: 157293

SEQ ID NO: 272148 - RNA, 64 nt, hsa; identical to SEQ ID NO: 157294

SEQ ID NO: 272149 - RNA, 64 nt, hsa; identical to SEQ ID NO: 157295

SEQ ID NO: 272150 - RNA, 64 nt, hsa; identical to SEQ ID NO: 157296

SEQ ID NO: 272151 - RNA, 64 nt, hsa; identical to SEQ ID NO: 157297

SEQ ID NO: 272152 - RNA, 64 nt, hsa; identical to SEQ ID NO: 157298

SEQ ID NO: 272153 - RNA, 64 nt, hsa; identical to SEQ ID NO: 157299

SEQ ID NO: 272154 - RNA, 64 nt, hsa; identical to SEQ ID NO: 157300

SEQ ID NO: 272155 - RNA, 64 nt, hsa; identical to SEQ ID NO: 157301

SEQ ID NO: 272156 - RNA, 64 nt, hsa; identical to SEQ ID NO: 157302

SEQ ID NO: 272157 - RNA, 64 nt, hsa; identical to SEQ ID NO: 157303

SEQ ID NO: 272158 - RNA, 64 nt, hsa; identical to SEQ ID NO: 157304

SEQ ID NO: 272159 - RNA, 64 nt, hsa; identical to SEQ ID NO: 157305

SEQ ID NO: 272160 - RNA, 64 nt, hsa; identical to SEQ ID NO: 157306

SEQ ID NO: 272161 - RNA, 64 nt, hsa; identical to SEQ ID NO: 157307

SEQ ID NO: 272162 - RNA, 64 nt, hsa; identical to SEQ ID NO: 157308

SEQ ID NO: 272163 - RNA, 64 nt, hsa; identical to SEQ ID NO: 157309

SEQ ID NO: 272164 - RNA, 64 nt, hsa; identical to SEQ ID NO: 157310

SEQ ID NO: 272165 - RNA, 64 nt, hsa; identical to SEQ ID NO: 157311

SEQ ID NO: 272166 - RNA, 64 nt, hsa; identical to SEQ ID NO: 157312

SEQ ID NO: 272167 - RNA, 64 nt, hsa; identical to SEQ ID NO: 157313

SEQ ID NO: 272168 - RNA, 64 nt, hsa; identical to SEQ ID NO: 157314

SEQ ID NO: 272169 - RNA, 64 nt, hsa; identical to SEQ ID NO: 157315

SEQ ID NO: 272170 - RNA, 64 nt, hsa; identical to SEQ ID NO: 157316

SEQ ID NO: 272171 - RNA, 64 nt, hsa; identical to SEQ ID NO: 157317

SEQ ID NO: 272172 - RNA, 64 nt, hsa; identical to SEQ ID NO: 157318

SEQ ID NO: 272173 - RNA, 64 nt, hsa; identical to SEQ ID NO: 157319

SEQ ID NO: 272174 - RNA, 64 nt, hsa; identical to SEQ ID NO: 157320

SEQ ID NO: 272175 - RNA, 64 nt, hsa; identical to SEQ ID NO: 157321

SEQ ID NO: 272176 - RNA, 64 nt, hsa; identical to SEQ ID NO: 157322

SEQ ID NO: 272177 - RNA, 64 nt, hsa; identical to SEQ ID NO: 157323

SEQ ID NO: 272178 - RNA, 64 nt, hsa; identical to SEQ ID NO: 157324

SEQ ID NO: 272179 - RNA, 64 nt, hsa; identical to SEQ ID NO: 157325

SEQ ID NO: 272180 - RNA, 64 nt, hsa; identical to SEQ ID NO: 157326

SEQ ID NO: 272181 - RNA, 64 nt, hsa; identical to SEQ ID NO: 157327

SEQ ID NO: 272182 - RNA, 64 nt, hsa; identical to SEQ ID NO: 157328

SEQ ID NO: 272183 - RNA, 64 nt, hsa; identical to SEQ ID NO: 157329

SEQ ID NO: 272184 - RNA, 64 nt, hsa; identical to SEQ ID NO: 157330

SEQ ID NO: 272185 - RNA, 64 nt, hsa; identical to SEQ ID NO: 157331

SEQ ID NO: 272186 - RNA, 64 nt, hsa; identical to SEQ ID NO: 157332

SEQ ID NO: 272187 - RNA, 64 nt, hsa; identical to SEQ ID NO: 157333

SEQ ID NO: 272188 - RNA, 64 nt, hsa; identical to SEQ ID NO: 157334

SEQ ID NO: 272189 - RNA, 64 nt, hsa; identical to SEQ ID NO: 157335

SEQ ID NO: 272190 - RNA, 64 nt, hsa; identical to SEQ ID NO: 157336

SEQ ID NO: 272191 - RNA, 64 nt, hsa; identical to SEQ ID NO: 157337

SEQ ID NO: 272192 - RNA, 64 nt, hsa; identical to SEQ ID NO: 157338

SEQ ID NO: 272193 - RNA, 64 nt, hsa; identical to SEQ ID NO: 157339

SEQ ID NO: 272194 - RNA, 64 nt, hsa; identical to SEQ ID NO: 157340

SEQ ID NO: 272195 - RNA, 64 nt, hsa; identical to SEQ ID NO: 157341

SEQ ID NO: 272196 - RNA, 64 nt, hsa; identical to SEQ ID NO: 157342

SEQ ID NO: 272197 - RNA, 64 nt, hsa; identical to SEQ ID NO: 157343

SEQ ID NO: 272198 - RNA, 64 nt, hsa; identical to SEQ ID NO: 157344

SEQ ID NO: 272199 - RNA, 64 nt, hsa; identical to SEQ ID NO: 157345

SEQ ID NO: 272200 - RNA, 64 nt, hsa; identical to SEQ ID NO: 157346

SEQ ID NO: 272201 - RNA, 64 nt, hsa; identical to SEQ ID NO: 157347

SEQ ID NO: 272202 - RNA, 64 nt, hsa; identical to SEQ ID NO: 157348

SEQ ID NO: 272203 - RNA, 64 nt, hsa; identical to SEQ ID NO: 157349

SEQ ID NO: 272204 - RNA, 64 nt, hsa; identical to SEQ ID NO: 157350

SEQ ID NO: 272205 - RNA, 64 nt, hsa; identical to SEQ ID NO: 157351

SEQ ID NO: 272206 - RNA, 64 nt, hsa; identical to SEQ ID NO: 157352

SEQ ID NO: 272207 - RNA, 64 nt, hsa; identical to SEQ ID NO: 157353

SEQ ID NO: 272208 - RNA, 64 nt, hsa; identical to SEQ ID NO: 157354

SEQ ID NO: 272209 - RNA, 64 nt, hsa; identical to SEQ ID NO: 157355

SEQ ID NO: 272210 - RNA, 64 nt, hsa; identical to SEQ ID NO: 157356

SEQ ID NO: 272211 - RNA, 64 nt, hsa; identical to SEQ ID NO: 157357

SEQ ID NO: 272212 - RNA, 64 nt, hsa; identical to SEQ ID NO: 157358

SEQ ID NO: 272213 - RNA, 64 nt, hsa; identical to SEQ ID NO: 157359

SEQ ID NO: 272214 - RNA, 64 nt, hsa; identical to SEQ ID NO: 157360

SEQ ID NO: 272215 - RNA, 64 nt, hsa; identical to SEQ ID NO: 157361

SEQ ID NO: 272216 - RNA, 64 nt, hsa; identical to SEQ ID NO: 157362

SEQ ID NO: 272217 - RNA, 64 nt, hsa; identical to SEQ ID NO: 157363

SEQ ID NO: 272218 - RNA, 64 nt, hsa; identical to SEQ ID NO: 157364

SEQ ID NO: 272219 - RNA, 64 nt, hsa; identical to SEQ ID NO: 157365

SEQ ID NO: 272220 - RNA, 64 nt, hsa; identical to SEQ ID NO: 157366

SEQ ID NO: 272221 - RNA, 64 nt, hsa; identical to SEQ ID NO: 157367

SEQ ID NO: 272222 - RNA, 64 nt, hsa; identical to SEQ ID NO: 157368

SEQ ID NO: 272223 - RNA, 64 nt, hsa; identical to SEQ ID NO: 157369

SEQ ID NO: 272224 - RNA, 64 nt, hsa; identical to SEQ ID NO: 157370

SEQ ID NO: 272225 - RNA, 64 nt, hsa; identical to SEQ ID NO: 157371

SEQ ID NO: 272226 - RNA, 64 nt, hsa; identical to SEQ ID NO: 157372

SEQ ID NO: 272227 - RNA, 64 nt, hsa; identical to SEQ ID NO: 157373

SEQ ID NO: 272228 - RNA, 64 nt, hsa; identical to SEQ ID NO: 157374

SEQ ID NO: 272229 - RNA, 64 nt, hsa; identical to SEQ ID NO: 157375

SEQ ID NO: 272230 - RNA, 64 nt, hsa; identical to SEQ ID NO: 157376

SEQ ID NO: 272231 - RNA, 64 nt, hsa; identical to SEQ ID NO: 157377

SEQ ID NO: 272232 - RNA, 64 nt, hsa; identical to SEQ ID NO: 157378

SEQ ID NO: 272233 - RNA, 64 nt, hsa; identical to SEQ ID NO: 157379

SEQ ID NO: 272234 - RNA, 64 nt, hsa; identical to SEQ ID NO: 157380

SEQ ID NO: 272235 - RNA, 64 nt, hsa; identical to SEQ ID NO: 157381

SEQ ID NO: 272236 - RNA, 64 nt, hsa; identical to SEQ ID NO: 157382

SEQ ID NO: 272237 - RNA, 64 nt, hsa; identical to SEQ ID NO: 157383

SEQ ID NO: 272238 - RNA, 64 nt, hsa; identical to SEQ ID NO: 157384

SEQ ID NO: 272239 - RNA, 64 nt, hsa; identical to SEQ ID NO: 157385

SEQ ID NO: 272240 - RNA, 64 nt, hsa; identical to SEQ ID NO: 157386

SEQ ID NO: 272241 - RNA, 64 nt, hsa; identical to SEQ ID NO: 157387

SEQ ID NO: 272242 - RNA, 64 nt, hsa; identical to SEQ ID NO: 157388

SEQ ID NO: 272243 - RNA, 64 nt, hsa; identical to SEQ ID NO: 157389

SEQ ID NO: 272244 - RNA, 64 nt, hsa; identical to SEQ ID NO: 157390

SEQ ID NO: 272245 - RNA, 64 nt, hsa; identical to SEQ ID NO: 157391

SEQ ID NO: 272246 - RNA, 64 nt, hsa; identical to SEQ ID NO: 157392

SEQ ID NO: 272247 - RNA, 64 nt, hsa; identical to SEQ ID NO: 157393

SEQ ID NO: 272248 - RNA, 64 nt, hsa; identical to SEQ ID NO: 157394

SEQ ID NO: 272249 - RNA, 64 nt, hsa; identical to SEQ ID NO: 157395

SEQ ID NO: 272250 - RNA, 64 nt, hsa; identical to SEQ ID NO: 157396

SEQ ID NO: 272251 - RNA, 64 nt, hsa; identical to SEQ ID NO: 157397

SEQ ID NO: 272252 - RNA, 64 nt, hsa; identical to SEQ ID NO: 157398

SEQ ID NO: 272253 - RNA, 64 nt, hsa; identical to SEQ ID NO: 157399

SEQ ID NO: 272254 - RNA, 64 nt, hsa; identical to SEQ ID NO: 157400

SEQ ID NO: 272255 - RNA, 64 nt, hsa; identical to SEQ ID NO: 157401

SEQ ID NO: 272256 - RNA, 64 nt, hsa; identical to SEQ ID NO: 157402

SEQ ID NO: 272257 - RNA, 64 nt, hsa; identical to SEQ ID NO: 157403

SEQ ID NO: 272258 - RNA, 64 nt, hsa; identical to SEQ ID NO: 157404

SEQ ID NO: 272259 - RNA, 64 nt, hsa; identical to SEQ ID NO: 157405

SEQ ID NO: 272260 - RNA, 64 nt, hsa; identical to SEQ ID NO: 157406

SEQ ID NO: 272261 - RNA, 64 nt, hsa; identical to SEQ ID NO: 157407

SEQ ID NO: 272262 - RNA, 64 nt, hsa; identical to SEQ ID NO: 157408

SEQ ID NO: 272263 - RNA, 64 nt, hsa; identical to SEQ ID NO: 157409

SEQ ID NO: 272264 - RNA, 64 nt, hsa; identical to SEQ ID NO: 157410

SEQ ID NO: 272265 - RNA, 64 nt, hsa; identical to SEQ ID NO: 157411

SEQ ID NO: 272266 - RNA, 64 nt, hsa; identical to SEQ ID NO: 157412

SEQ ID NO: 272267 - RNA, 64 nt, hsa; identical to SEQ ID NO: 157413

SEQ ID NO: 272268 - RNA, 64 nt, hsa; identical to SEQ ID NO: 157414

SEQ ID NO: 272269 - RNA, 64 nt, hsa; identical to SEQ ID NO: 157415

SEQ ID NO: 272270 - RNA, 64 nt, hsa; identical to SEQ ID NO: 157416

SEQ ID NO: 272271 - RNA, 64 nt, hsa; identical to SEQ ID NO: 157417

SEQ ID NO: 272272 - RNA, 64 nt, hsa; identical to SEQ ID NO: 157418

SEQ ID NO: 272273 - RNA, 64 nt, hsa; identical to SEQ ID NO: 157419

SEQ ID NO: 272274 - RNA, 64 nt, hsa; identical to SEQ ID NO: 157420

SEQ ID NO: 272275 - RNA, 64 nt, hsa; identical to SEQ ID NO: 157421

SEQ ID NO: 272276 - RNA, 64 nt, hsa; identical to SEQ ID NO: 157422

SEQ ID NO: 272277 - RNA, 64 nt, hsa; identical to SEQ ID NO: 157423

SEQ ID NO: 272278 - RNA, 64 nt, hsa; identical to SEQ ID NO: 157424

SEQ ID NO: 272279 - RNA, 64 nt, hsa; identical to SEQ ID NO: 157425

SEQ ID NO: 272280 - RNA, 64 nt, hsa; identical to SEQ ID NO: 157426

SEQ ID NO: 272281 - RNA, 64 nt, hsa; identical to SEQ ID NO: 157427

SEQ ID NO: 272282 - RNA, 64 nt, hsa; identical to SEQ ID NO: 157428

SEQ ID NO: 272283 - RNA, 64 nt, hsa; identical to SEQ ID NO: 157429

SEQ ID NO: 272284 - RNA, 64 nt, hsa; identical to SEQ ID NO: 157430

SEQ ID NO: 272285 - RNA, 64 nt, hsa; identical to SEQ ID NO: 157431

SEQ ID NO: 272286 - RNA, 64 nt, hsa; identical to SEQ ID NO: 157432

SEQ ID NO: 272287 - RNA, 64 nt, hsa; identical to SEQ ID NO: 157433

SEQ ID NO: 272288 - RNA, 64 nt, hsa; identical to SEQ ID NO: 157434

SEQ ID NO: 272289 - RNA, 64 nt, hsa; identical to SEQ ID NO: 157435

SEQ ID NO: 272290 - RNA, 64 nt, hsa; identical to SEQ ID NO: 157436

SEQ ID NO: 272291 - RNA, 64 nt, hsa; identical to SEQ ID NO: 157437

SEQ ID NO: 272292 - RNA, 64 nt, hsa; identical to SEQ ID NO: 157438

SEQ ID NO: 272293 - RNA, 64 nt, hsa; identical to SEQ ID NO: 157439

SEQ ID NO: 272294 - RNA, 64 nt, hsa; identical to SEQ ID NO: 157440

SEQ ID NO: 272295 - RNA, 64 nt, hsa; identical to SEQ ID NO: 157441

SEQ ID NO: 272296 - RNA, 64 nt, hsa; identical to SEQ ID NO: 157442

SEQ ID NO: 272297 - RNA, 64 nt, hsa; identical to SEQ ID NO: 157443

SEQ ID NO: 272298 - RNA, 64 nt, hsa; identical to SEQ ID NO: 157444

SEQ ID NO: 272299 - RNA, 64 nt, hsa; identical to SEQ ID NO: 157445

SEQ ID NO: 272300 - RNA, 64 nt, hsa; identical to SEQ ID NO: 157446

SEQ ID NO: 272301 - RNA, 64 nt, hsa; identical to SEQ ID NO: 157447

SEQ ID NO: 272302 - RNA, 64 nt, hsa; identical to SEQ ID NO: 157448

SEQ ID NO: 272303 - RNA, 64 nt, hsa; identical to SEQ ID NO: 157449

SEQ ID NO: 272304 - RNA, 64 nt, hsa; identical to SEQ ID NO: 157450

SEQ ID NO: 272305 - RNA, 64 nt, hsa; identical to SEQ ID NO: 157451

SEQ ID NO: 272306 - RNA, 64 nt, hsa; identical to SEQ ID NO: 157452

SEQ ID NO: 272307 - RNA, 64 nt, hsa; identical to SEQ ID NO: 157453

SEQ ID NO: 272308 - RNA, 64 nt, hsa; identical to SEQ ID NO: 157454

SEQ ID NO: 272309 - RNA, 64 nt, hsa; identical to SEQ ID NO: 157455

SEQ ID NO: 272310 - RNA, 64 nt, hsa; identical to SEQ ID NO: 157456

SEQ ID NO: 272311 - RNA, 64 nt, hsa; identical to SEQ ID NO: 157457

SEQ ID NO: 272312 - RNA, 64 nt, hsa; identical to SEQ ID NO: 157458

SEQ ID NO: 272313 - RNA, 64 nt, hsa; identical to SEQ ID NO: 157459

SEQ ID NO: 272314 - RNA, 64 nt, hsa; identical to SEQ ID NO: 157460

SEQ ID NO: 272315 - RNA, 64 nt, hsa; identical to SEQ ID NO: 157461

SEQ ID NO: 272316 - RNA, 64 nt, hsa; identical to SEQ ID NO: 157462

SEQ ID NO: 272317 - RNA, 64 nt, hsa; identical to SEQ ID NO: 157463

SEQ ID NO: 272318 - RNA, 64 nt, hsa; identical to SEQ ID NO: 157464

SEQ ID NO: 272319 - RNA, 64 nt, hsa; identical to SEQ ID NO: 157465

SEQ ID NO: 272320 - RNA, 64 nt, hsa; identical to SEQ ID NO: 157466

SEQ ID NO: 272321 - RNA, 64 nt, hsa; identical to SEQ ID NO: 157467

SEQ ID NO: 272322 - RNA, 64 nt, hsa; identical to SEQ ID NO: 157468

SEQ ID NO: 272323 - RNA, 64 nt, hsa; identical to SEQ ID NO: 157469

SEQ ID NO: 272324 - RNA, 64 nt, hsa; identical to SEQ ID NO: 157470

SEQ ID NO: 272325 - RNA, 64 nt, hsa; identical to SEQ ID NO: 157471

SEQ ID NO: 272326 - RNA, 64 nt, hsa; identical to SEQ ID NO: 157472

SEQ ID NO: 272327 - RNA, 64 nt, hsa; identical to SEQ ID NO: 157473

SEQ ID NO: 272328 - RNA, 64 nt, hsa; identical to SEQ ID NO: 157474

SEQ ID NO: 272329 - RNA, 64 nt, hsa; identical to SEQ ID NO: 157475

SEQ ID NO: 272330 - RNA, 64 nt, hsa; identical to SEQ ID NO: 157476

SEQ ID NO: 272331 - RNA, 64 nt, hsa; identical to SEQ ID NO: 157477

SEQ ID NO: 272332 - RNA, 64 nt, hsa; identical to SEQ ID NO: 157478

SEQ ID NO: 272333 - RNA, 64 nt, hsa; identical to SEQ ID NO: 157479

SEQ ID NO: 272334 - RNA, 64 nt, hsa; identical to SEQ ID NO: 157480

SEQ ID NO: 272335 - RNA, 64 nt, hsa; identical to SEQ ID NO: 157481

SEQ ID NO: 272336 - RNA, 64 nt, hsa; identical to SEQ ID NO: 157482

SEQ ID NO: 272337 - RNA, 64 nt, hsa; identical to SEQ ID NO: 157483

SEQ ID NO: 272338 - RNA, 64 nt, hsa; identical to SEQ ID NO: 157484

SEQ ID NO: 272339 - RNA, 64 nt, hsa; identical to SEQ ID NO: 157485

SEQ ID NO: 272340 - RNA, 64 nt, hsa; identical to SEQ ID NO: 157486

SEQ ID NO: 272341 - RNA, 64 nt, hsa; identical to SEQ ID NO: 157487

SEQ ID NO: 272342 - RNA, 64 nt, hsa; identical to SEQ ID NO: 157488

SEQ ID NO: 272343 - RNA, 64 nt, hsa; identical to SEQ ID NO: 157489

SEQ ID NO: 272344 - RNA, 64 nt, hsa; identical to SEQ ID NO: 157490

SEQ ID NO: 272345 - RNA, 64 nt, hsa; identical to SEQ ID NO: 157491

SEQ ID NO: 272346 - RNA, 64 nt, hsa; identical to SEQ ID NO: 157492

SEQ ID NO: 272347 - RNA, 64 nt, hsa; identical to SEQ ID NO: 157493

SEQ ID NO: 272348 - RNA, 64 nt, hsa; identical to SEQ ID NO: 157494

SEQ ID NO: 272349 - RNA, 64 nt, hsa; identical to SEQ ID NO: 157495

SEQ ID NO: 272350 - RNA, 64 nt, hsa; identical to SEQ ID NO: 157496

SEQ ID NO: 272351 - RNA, 64 nt, hsa; identical to SEQ ID NO: 157497

SEQ ID NO: 272352 - RNA, 64 nt, hsa; identical to SEQ ID NO: 157498

SEQ ID NO: 272353 - RNA, 64 nt, hsa; identical to SEQ ID NO: 157499

SEQ ID NO: 272354 - RNA, 64 nt, hsa; identical to SEQ ID NO: 157500

SEQ ID NO: 272355 - RNA, 64 nt, hsa; identical to SEQ ID NO: 157501

SEQ ID NO: 272356 - RNA, 64 nt, hsa; identical to SEQ ID NO: 157502

SEQ ID NO: 272357 - RNA, 64 nt, hsa; identical to SEQ ID NO: 157503

SEQ ID NO: 272358 - RNA, 64 nt, hsa; identical to SEQ ID NO: 157504

SEQ ID NO: 272359 - RNA, 64 nt, hsa; identical to SEQ ID NO: 157505

SEQ ID NO: 272360 - RNA, 64 nt, hsa; identical to SEQ ID NO: 157506

SEQ ID NO: 272361 - RNA, 64 nt, hsa; identical to SEQ ID NO: 157507

SEQ ID NO: 272362 - RNA, 64 nt, hsa; identical to SEQ ID NO: 157508

SEQ ID NO: 272363 - RNA, 64 nt, hsa; identical to SEQ ID NO: 157509

SEQ ID NO: 272364 - RNA, 64 nt, hsa; identical to SEQ ID NO: 157510

SEQ ID NO: 272365 - RNA, 64 nt, hsa; identical to SEQ ID NO: 157511

SEQ ID NO: 272366 - RNA, 64 nt, hsa; identical to SEQ ID NO: 157512

SEQ ID NO: 272367 - RNA, 64 nt, hsa; identical to SEQ ID NO: 157513

SEQ ID NO: 272368 - RNA, 64 nt, hsa; identical to SEQ ID NO: 157514

SEQ ID NO: 272369 - RNA, 64 nt, hsa; identical to SEQ ID NO: 157515

SEQ ID NO: 272370 - RNA, 64 nt, hsa; identical to SEQ ID NO: 157516

SEQ ID NO: 272371 - RNA, 64 nt, hsa; identical to SEQ ID NO: 157517

SEQ ID NO: 272372 - RNA, 64 nt, hsa; identical to SEQ ID NO: 157518

SEQ ID NO: 272373 - RNA, 64 nt, hsa; identical to SEQ ID NO: 157519

SEQ ID NO: 272374 - RNA, 64 nt, hsa; identical to SEQ ID NO: 157520

SEQ ID NO: 272375 - RNA, 64 nt, hsa; identical to SEQ ID NO: 157521

SEQ ID NO: 272376 - RNA, 64 nt, hsa; identical to SEQ ID NO: 157522

SEQ ID NO: 272377 - RNA, 64 nt, hsa; identical to SEQ ID NO: 157523

SEQ ID NO: 272378 - RNA, 64 nt, hsa; identical to SEQ ID NO: 157524

SEQ ID NO: 272379 - RNA, 64 nt, hsa; identical to SEQ ID NO: 157525

SEQ ID NO: 272380 - RNA, 64 nt, hsa; identical to SEQ ID NO: 157526

SEQ ID NO: 272381 - RNA, 64 nt, hsa; identical to SEQ ID NO: 157527

SEQ ID NO: 272382 - RNA, 64 nt, hsa; identical to SEQ ID NO: 157528

SEQ ID NO: 272383 - RNA, 64 nt, hsa; identical to SEQ ID NO: 157529

SEQ ID NO: 272384 - RNA, 64 nt, hsa; identical to SEQ ID NO: 157530

SEQ ID NO: 272385 - RNA, 64 nt, hsa; identical to SEQ ID NO: 157531

SEQ ID NO: 272386 - RNA, 64 nt, hsa; identical to SEQ ID NO: 157532

SEQ ID NO: 272387 - RNA, 64 nt, hsa; identical to SEQ ID NO: 157533

SEQ ID NO: 272388 - RNA, 64 nt, hsa; identical to SEQ ID NO: 157534

SEQ ID NO: 272389 - RNA, 64 nt, hsa; identical to SEQ ID NO: 157535

SEQ ID NO: 272390 - RNA, 64 nt, hsa; identical to SEQ ID NO: 157536

SEQ ID NO: 272391 - RNA, 64 nt, hsa; identical to SEQ ID NO: 157537

SEQ ID NO: 272392 - RNA, 64 nt, hsa; identical to SEQ ID NO: 157538

SEQ ID NO: 272393 - RNA, 64 nt, hsa; identical to SEQ ID NO: 157539

SEQ ID NO: 272394 - RNA, 64 nt, hsa; identical to SEQ ID NO: 157540

SEQ ID NO: 272395 - RNA, 64 nt, hsa; identical to SEQ ID NO: 157541

SEQ ID NO: 272396 - RNA, 64 nt, hsa; identical to SEQ ID NO: 157542

SEQ ID NO: 272397 - RNA, 64 nt, hsa; identical to SEQ ID NO: 157543

SEQ ID NO: 272398 - RNA, 64 nt, hsa; identical to SEQ ID NO: 157544

SEQ ID NO: 272399 - RNA, 64 nt, hsa; identical to SEQ ID NO: 157545

SEQ ID NO: 272400 - RNA, 64 nt, hsa; identical to SEQ ID NO: 157546

SEQ ID NO: 272401 - RNA, 64 nt, hsa; identical to SEQ ID NO: 157547

SEQ ID NO: 272402 - RNA, 64 nt, hsa; identical to SEQ ID NO: 157548

SEQ ID NO: 272403 - RNA, 64 nt, hsa; identical to SEQ ID NO: 157549

SEQ ID NO: 272404 - RNA, 64 nt, hsa; identical to SEQ ID NO: 157550

SEQ ID NO: 272405 - RNA, 64 nt, hsa; identical to SEQ ID NO: 157551

SEQ ID NO: 272406 - RNA, 64 nt, hsa; identical to SEQ ID NO: 157552

SEQ ID NO: 272407 - RNA, 64 nt, hsa; identical to SEQ ID NO: 157553

SEQ ID NO: 272408 - RNA, 64 nt, hsa; identical to SEQ ID NO: 157554

SEQ ID NO: 272409 - RNA, 64 nt, hsa; identical to SEQ ID NO: 157555

SEQ ID NO: 272410 - RNA, 64 nt, hsa; identical to SEQ ID NO: 157556

SEQ ID NO: 272411 - RNA, 64 nt, hsa; identical to SEQ ID NO: 157557

SEQ ID NO: 272412 - RNA, 64 nt, hsa; identical to SEQ ID NO: 157558

SEQ ID NO: 272413 - RNA, 64 nt, hsa; identical to SEQ ID NO: 157559

SEQ ID NO: 272414 - RNA, 64 nt, hsa; identical to SEQ ID NO: 157560

SEQ ID NO: 272415 - RNA, 64 nt, hsa; identical to SEQ ID NO: 157561

SEQ ID NO: 272416 - RNA, 64 nt, hsa; identical to SEQ ID NO: 157562

SEQ ID NO: 272417 - RNA, 64 nt, hsa; identical to SEQ ID NO: 157563

SEQ ID NO: 272418 - RNA, 64 nt, hsa; identical to SEQ ID NO: 157564

SEQ ID NO: 272419 - RNA, 64 nt, hsa; identical to SEQ ID NO: 157565

SEQ ID NO: 272420 - RNA, 64 nt, hsa; identical to SEQ ID NO: 157566

SEQ ID NO: 272421 - RNA, 64 nt, hsa; identical to SEQ ID NO: 157567

SEQ ID NO: 272422 - RNA, 64 nt, hsa; identical to SEQ ID NO: 157568

SEQ ID NO: 272423 - RNA, 64 nt, hsa; identical to SEQ ID NO: 157569

SEQ ID NO: 272424 - RNA, 64 nt, hsa; identical to SEQ ID NO: 157570

SEQ ID NO: 272425 - RNA, 64 nt, hsa; identical to SEQ ID NO: 157571

SEQ ID NO: 272426 - RNA, 64 nt, hsa; identical to SEQ ID NO: 157572

SEQ ID NO: 272427 - RNA, 64 nt, hsa; identical to SEQ ID NO: 157573

SEQ ID NO: 272428 - RNA, 64 nt, hsa; identical to SEQ ID NO: 157574

SEQ ID NO: 272429 - RNA, 64 nt, hsa; identical to SEQ ID NO: 157575

SEQ ID NO: 272430 - RNA, 64 nt, hsa; identical to SEQ ID NO: 157576

SEQ ID NO: 272431 - RNA, 64 nt, hsa; identical to SEQ ID NO: 157577

SEQ ID NO: 272432 - RNA, 64 nt, hsa; identical to SEQ ID NO: 157578

SEQ ID NO: 272433 - RNA, 64 nt, hsa; identical to SEQ ID NO: 157579

SEQ ID NO: 272434 - RNA, 64 nt, hsa; identical to SEQ ID NO: 157580

SEQ ID NO: 272435 - RNA, 64 nt, hsa; identical to SEQ ID NO: 157581

SEQ ID NO: 272436 - RNA, 64 nt, hsa; identical to SEQ ID NO: 157582

SEQ ID NO: 272437 - RNA, 64 nt, hsa; identical to SEQ ID NO: 157583

SEQ ID NO: 272438 - RNA, 64 nt, hsa; identical to SEQ ID NO: 157584

SEQ ID NO: 272439 - RNA, 64 nt, hsa; identical to SEQ ID NO: 157585

SEQ ID NO: 272440 - RNA, 64 nt, hsa; identical to SEQ ID NO: 157586

SEQ ID NO: 272441 - RNA, 64 nt, hsa; identical to SEQ ID NO: 157587

SEQ ID NO: 272442 - RNA, 64 nt, hsa; identical to SEQ ID NO: 157588

SEQ ID NO: 272443 - RNA, 64 nt, hsa; identical to SEQ ID NO: 157589

SEQ ID NO: 272444 - RNA, 64 nt, hsa; identical to SEQ ID NO: 157590

SEQ ID NO: 272445 - RNA, 64 nt, hsa; identical to SEQ ID NO: 157591

SEQ ID NO: 272446 - RNA, 64 nt, hsa; identical to SEQ ID NO: 157592

SEQ ID NO: 272447 - RNA, 64 nt, hsa; identical to SEQ ID NO: 157593

SEQ ID NO: 272448 - RNA, 64 nt, hsa; identical to SEQ ID NO: 157594

SEQ ID NO: 272449 - RNA, 64 nt, hsa; identical to SEQ ID NO: 157595

SEQ ID NO: 272450 - RNA, 64 nt, hsa; identical to SEQ ID NO: 157596

SEQ ID NO: 272451 - RNA, 64 nt, hsa; identical to SEQ ID NO: 157597

SEQ ID NO: 272452 - RNA, 64 nt, hsa; identical to SEQ ID NO: 157598

SEQ ID NO: 272453 - RNA, 64 nt, hsa; identical to SEQ ID NO: 157599

SEQ ID NO: 272454 - RNA, 64 nt, hsa; identical to SEQ ID NO: 157600

SEQ ID NO: 272455 - RNA, 64 nt, hsa; identical to SEQ ID NO: 157601

SEQ ID NO: 272456 - RNA, 64 nt, hsa; identical to SEQ ID NO: 157602

SEQ ID NO: 272457 - RNA, 64 nt, hsa; identical to SEQ ID NO: 157603

SEQ ID NO: 272458 - RNA, 64 nt, hsa; identical to SEQ ID NO: 157604

SEQ ID NO: 272459 - RNA, 64 nt, hsa; identical to SEQ ID NO: 157605

SEQ ID NO: 272460 - RNA, 64 nt, hsa; identical to SEQ ID NO: 157606

SEQ ID NO: 272461 - RNA, 64 nt, hsa
caucuucaguugaaugcccucacuccaagacuggaugcuggaucucauagaaaauucacagcca

SEQ ID NO: 272462 - RNA, 64 nt, hsa
cucacauaacuugauuauucacuccucugaaaagaugcuggauaggcuaccaaaguucccaagu

SEQ ID NO: 272463 - RNA, 64 nt, hsa
ggugcuugaugaugaccaggagugugcucugggaaugcuggaggucccccugugccagauccuc

SEQ ID NO: 272464 - RNA, 64 nt, hsa
uuauggcucuagcugcguacugacuauaaaauagaugcuggacucugguugguaaggucccuuc

SEQ ID NO: 272465 - RNA, 64 nt, hsa
uuuuaguccacuauauauugcuguauuugcuuaaaugcuggaaaguaacuguuaaaaugugaaa

SEQ ID NO: 272466 - RNA, 64 nt, hsa
aggcugcgucaggcucuuaaagucauguguuugcaugcuggaugcuauacuguccagccaggac

SEQ ID NO: 272467 - RNA, 64 nt, hsa
ucuccagagcagacuucugacaggaaagguuuagaugcuggagaguugaagagguguaagaaga

SEQ ID NO: 272468 - RNA, 64 nt, hsa
uguuuagcauucccuugucaaagugcuugacugcaugcuggaaacuuuguauuuuugaagcggc

SEQ ID NO: 272469 - RNA, 64 nt, hsa
cagcccucaccggugaauaaacauaagaaaaaucaugcuggagggaagcccuacacauguggca

SEQ ID NO: 272470 - RNA, 64 nt, hsa
uuaauugguccucaaugcuuaauaaauauaauucaugcuggagagaaacuucacaugugaaccg

SEQ ID NO: 272471 - RNA, 64 nt, hsa
ugguccucaacccuuaaugaacguaagugaauucaugcuggagcaaaaugcuucacaugcgaag

SEQ ID NO: 272472 - RNA, 64 nt, hsa
uguaccugccagcaggagcaugauggggacuuccaugcuggaauugcucccugauuaaaaugag

SEQ ID NO: 272473 - RNA, 64 nt, hsa
cucugcacacgcuagcucuccuucgccuucugccaugcuggaaguagccugaggcccucaccag

SEQ ID NO: 272474 - RNA, 64 nt, hsa
uuauucuuccaaacaguaucgcuaguaaaauagcaugcuggacuucagaccucagggauccuuu

SEQ ID NO: 272475 - RNA, 64 nt, hsa
uggcagcuaaacauuaaauucgcaugaaccacagaugcuggagaucaccagaccggggagagaa

SEQ ID NO: 272476 - RNA, 64 nt, hsa
uaggguuccugugauuaauuuugugaugacuaaaaugcuggaaagcgagugaguugcccauuaa

SEQ ID NO: 272477 - RNA, 64 nt, hsa
aauugaauuagcauaauugggccauggaacacauaugcuggaaaucuuugaaccauuucaaguc

SEQ ID NO: 272478 - RNA, 64 nt, hsa
gcgucacaccuguugaggagugggguggcuuugaaugcuggaaauggcuucauagugaagugcc

SEQ ID NO: 272479 - RNA, 64 nt, hsa
uucugcccuucucgguguccaggcuccuugggugaugcuggaguugucauggccgcaguucagu

SEQ ID NO: 272480 - RNA, 64 nt, hsa
acucccaagaaaccaggcaggcagaagcuccugaaugcuggacuagacaaacuacaugcuggcu

SEQ ID NO: 272481 - RNA, 64 nt, hsa
aaacaaguagugaucaguuuauacuuugauauuuaugcuggaaauggauagaaguucaaucaga

SEQ ID NO: 272482 - RNA, 64 nt, hsa
gacucacauuggggcgaaugaaccaaguuucgccaugcuggaugaugaaauggauucccauccc

SEQ ID NO: 272483 - RNA, 64 nt, hsa
ccucucacccuggaaaggaguugagggacaucagaugcuggaacccucacugaaaguccagaau

SEQ ID NO: 272484 - RNA, 64 nt, hsa
ccaccccuuggugcuggcaguguuuggggacauuaugcuggaaagagcuccuagcaucagagga

SEQ ID NO: 272485 - RNA, 64 nt, hsa
uaugucaccaauauaugauuuaaaccgagcacugaugcuggacuucaugauuuuuacccucccu

SEQ ID NO: 272486 - RNA, 64 nt, hsa
uauaugagggagaacgccucacccagauuuuaucaugcuggaaagaguguauguaugugaagau

SEQ ID NO: 272487 - RNA, 64 nt, hsa
auagagaacacaguggcuauuaaugaagaggcccaugcuggagacuggaaggguucccuugucc

SEQ ID NO: 272488 - RNA, 64 nt, hsa
uggucucucagcaaacacuccugagugguugaagaugcuggacauuggauucuagcacuggguu

SEQ ID NO: 272489 - RNA, 64 nt, hsa
auuacaauuaaaaauagugauguagcuguaacauaugcuggaauuggauauuuaauuuauguuu

SEQ ID NO: 272490 - RNA, 64 nt, hsa
ccuagcucugggggcaaaggggcuuaguaaaggaaugcuggauguguagaggguuuagucccga

SEQ ID NO: 272491 - RNA, 64 nt, hsa
gaggaggcugugaaugcugagaccagaguuuaucaugcuggacaagccuggaaggaggcaauaa

SEQ ID NO: 272492 - RNA, 64 nt, hsa
ccagaggcacagccggggccugccuagcacucacaugcuggacaggucugggagaggcagagug

SEQ ID NO: 272493 - RNA, 64 nt, hsa
acacaagacuuuccccauacucugucucccuauaaugcuggagcggcuacuaaaaaggauaaaa

SEQ ID NO: 272494 - RNA, 64 nt, hsa
gccgccccuccccgauguggugcgcucaauaaaaaugcuggaauucacagggggcuuugcugag

SEQ ID NO: 272495 - RNA, 64 nt, hsa
ccacuaucucuugggagcccccaaaagcugggaaaugcuggaggaaccaggccuuucccgcuuu

SEQ ID NO: 272496 - RNA, 64 nt, hsa
caguacuuuacccuuaauacacauaagauaauuaaugcuggagagaaacccuacaaaugugaag

SEQ ID NO: 272497 - RNA, 64 nt, hsa
caauccucaacccuuacuacacauuagauaauucaugcuggagagaaacccuacaaaugugaaa

SEQ ID NO: 272498 - RNA, 64 nt, hsa
ucacauucacaccucaauagacaucagagaauccaugcuggacagaaaucuuacaaaugucauc

SEQ ID NO: 272499 - RNA, 64 nt, hsa
uaucguucauauauugcuauucaucaucgaacucaugcuggagagaaaccuuauaaaugucaug

SEQ ID NO: 272500 - RNA, 64 nt, hsa
ucacauucacaccucauuagacaucagagaauccaugcuggacagaaaucuuacaaaugucauc

SEQ ID NO: 272501 - RNA, 64 nt, hsa
caucguucaugccuugcauuucacuggugaacucaugcuggagagaaaccuuauaaaugucaug

SEQ ID NO: 272502 - RNA, 64 nt, hsa
accagguugucacuugcuuguccuauaaagagccaugcuggaauuugacccaccuugggauuuu

SEQ ID NO: 272503 - RNA, 64 nt, hsa
auguggaaggcauuccaucaacaucagagaacucaugcuggagaaagacauuccaaauauaacu

SEQ ID NO: 272504 - RNA, 64 nt, hsa
ugucauuuuaaacauugguaggccuugguacaugaugcuggauuaccucucuuaaaaugacacc

SEQ ID NO: 272505 - RNA, 64 nt, hsa
agagucuggucauguggaggugggguuuauugggaugcuggagaagagcugccaggaaguguuu

SEQ ID NO: 272506 - RNA, 64 nt, hsa
ggguaaauacccuaccucuuagaaagggcaaaaaugcaaagaagcuuucuuuaaaacuaaaagg

SEQ ID NO: 272507 - RNA, 64 nt, hsa
uauucauccccuuugaaagaugagaagguugagaugcaaagagucuaccuuuccaaguucucac

SEQ ID NO: 272508 - RNA, 64 nt, hsa
aaagaaaacuucuuguagccucacauuccccuugugcaaagagcucuuuuggaccuacauacau

SEQ ID NO: 272509 - RNA, 64 nt, hsa
guguguauuuuucuuuuucuauaauaccuuuaacugcaaagaaaaggcaguuucaaauauaaga

SEQ ID NO: 272510 - RNA, 64 nt, hsa
uuuuuuaaagcuuuucuuuuaaauuuuucuccguugcaaagaauguuuccuaaauuguauggga

SEQ ID NO: 272511 - RNA, 64 nt, hsa
aaagcagucaaguuccaaggaacugacagcaaccugcaaagaggaaaacagcaucuccucaccu

SEQ ID NO: 272512 - RNA, 64 nt, hsa
gcccguuuugauuacgugcaugcaaacagcgauuugcaaagaccguaugaugaugaucaugauc

SEQ ID NO: 272513 - RNA, 64 nt, hsa
cuuuuugaucaaacaagaaaaggcauuugggaaaugcaaagaggacugagaauacuuuggcuua

SEQ ID NO: 272514 - RNA, 64 nt, hsa
uccagaguucugugacacaugccccccagauugcugcaaagaucccaaggcauugauugcacuu

SEQ ID NO: 272515 - RNA, 64 nt, hsa
aaggugcccaaccuaaaaauguaggcuuucauguugcaaagaacuccagagucaguaguuaggu

SEQ ID NO: 272516 - RNA, 64 nt, hsa
acacuuguggggacuuaggcaugacacagguucuugcaaagaaacuagaggcuggcuucacuag

SEQ ID NO: 272517 - RNA, 64 nt, hsa
cuugacauccaauucaaacugcauuugcaaaaugugcaaagaccucuuaugagggaccaauuca

SEQ ID NO: 272518 - RNA, 64 nt, hsa
uaucuaauugcaaauggugcugugguuggcaccaugcaaagauaacuugcauaggacuuucugu

SEQ ID NO: 272519 - RNA, 64 nt, hsa
cuacacaauggacccucaauaaauggccuauaugugcaaagaaagaauguguagcaaaugaaaa

SEQ ID NO: 272520 - RNA, 64 nt, hsa
auaaauuccuuaagcuauuguaaccauguuuuauugcaaagauguaaaauaugccagaugugug

SEQ ID NO: 272521 - RNA, 64 nt, hsa
gugaguuggaaaucaaaaaaagaaaaauaaaauaugcaaagaauucaccgacuguuucagauuu

SEQ ID NO: 272522 - RNA, 64 nt, hsa
cguuuucauuaugguucagauuuggaauagcuuaugcaaagauuguguucauuuuuauacaauu

SEQ ID NO: 272523 - RNA, 64 nt, hsa
gaaacgaagaagcagauggagaggucccauuaccugcaaagaaagggcacucaggcagcccuuu

SEQ ID NO: 272524 - RNA, 64 nt, hsa
ugcuugacagacucacucggccucacuucauccuugcaaagagaauccuguacuucauccuugc

SEQ ID NO: 272525 - RNA, 64 nt, hsa
ucauccuugcaaagagaauccuguacuucauccuugcaaagagaauccuguacuucacucagaa

SEQ ID NO: 272526 - RNA, 64 nt, hsa
gagaaucacuugaccccaggugguggagguugcagugagccaagauugcaccauugcacuccag

SEQ ID NO: 272527 - RNA, 64 nt, hsa
gagaaucgcuugaacccgggaggcacagguuccagugagccaagguugugccacugcacuccag

SEQ ID NO: 272528 - RNA, 64 nt, hsa
caccucagccucccaaagugcugggauuacaggugugagccaccacgcccggcuauguuuuuuu

SEQ ID NO: 272529 - RNA, 64 nt, hsa
ugccucggccucccaaagugcugagacuacaggugugagccaccgugcucagccacuagcuuug

SEQ ID NO: 272530 - RNA, 64 nt, hsa
gaggaucgcuugugccuuggaggucaaaacugcagugagccaugguugcaccacugcucuccag

SEQ ID NO: 272531 - RNA, 64 nt, hsa
gagaauugcuugaaccugggagguggagguugcagugagccaagaucgugccacugcacuccag

SEQ ID NO: 272532 - RNA, 64 nt, hsa
ucuaggaauauuaguuagagacugauuaucucaugugagccaggacauucuuccagcaagguug

SEQ ID NO: 272533 - RNA, 64 nt, hsa
caccucggccucccaaagugcuaggauuacaggagugagccacugcgccuggcccacuuuucuu

SEQ ID NO: 272534 - RNA, 64 nt, hsa
uccuaaaggagacgagcgaauuaacggugucgaggugagccagggccagggggaccccgguaaa

SEQ ID NO: 272535 - RNA, 64 nt, hsa
cagaagagugggaggugagaagcccgucuccucagugagccagcauuucagggggagcuggcgg

SEQ ID NO: 272536 - RNA, 64 nt, hsa
ugccucggccucccaaagugcugggauuacaggugugagccaccacgcccgguacauauuuuuu

SEQ ID NO: 272537 - RNA, 64 nt, hsa
cgccuucaucucccaaagugcugggauuacaggcgugagccaccgugccuggccacgcccaacu

SEQ ID NO: 272538 - RNA, 64 nt, hsa
cuccucagccucccaaagugcugggauuacaagugugagccaccacaccuggcuccagaaauuu

SEQ ID NO: 272539 - RNA, 64 nt, hsa
cuaaguuccuagagagccauuuaauaauuaguuggugagccagaggcuugacagagcuguuacu

SEQ ID NO: 272540 - RNA, 64 nt, hsa
aagaaucaccuggaguuaggagguggugguugcagugagccaaucucaccauugcacuucagcc

SEQ ID NO: 272541 - RNA, 64 nt, hsa
ggagaauugccucaaccgggaggcggagguugcagugagccaagaucgcaccacugcacuccag

SEQ ID NO: 272542 - RNA, 64 nt, hsa
caccucggccuccgaaagugcuaggauuacaggugugagccacugugccuggccuccggugagu

SEQ ID NO: 272543 - RNA, 64 nt, hsa
gaggauugcuugaacccaagaggucgaggcugcagugagccaagauugugccacugcacuccag

SEQ ID NO: 272544 - RNA, 64 nt, hsa
ugggagaaucuccugagccuggaagguccaggcagugagccaagauugugccaccacacuccag

SEQ ID NO: 272545 - RNA, 64 nt, hsa
caccucggccucccaaagugcugggauuacaggcgugagccaccgcgccuggccgaugguacua

SEQ ID NO: 272546 - RNA, 64 nt, hsa
gaggauugcuugaacccaagaggucaaggcugcagugagccauguucacaccgcugcacucaag

SEQ ID NO: 272547 - RNA, 64 nt, hsa
auuaaagaaauucacuguaaaaucuuuuuagaaagugagccauuuuguaaugaugaagauguua

SEQ ID NO: 272548 - RNA, 64 nt, hsa
uacaugguuguuaaagcugaugauaauggcaucugugagccagaaaacucuccuuggauacguu

SEQ ID NO: 272549 - RNA, 64 nt, hsa
ugccuuggccccccaaagugcugggauuacaggagugagccacugugcccagccuccaaccuaa

SEQ ID NO: 272550 - RNA, 64 nt, hsa
caccucggucucccaaaguguugggauuacaggcgugagccacugcaccuggccuguaacauga

SEQ ID NO: 272551 - RNA, 64 nt, hsa
cgccuuggccucccaaagugcugggauuacaggugugagccaccaugccuggcccuaauuuuug

SEQ ID NO: 272552 - RNA, 64 nt, hsa
ugccucagccucccaaagugcugggauuacaggcgugagccacugcacagggccagauucauca

SEQ ID NO: 272553 - RNA, 64 nt, hsa
gagauuugcuugaaccugggaggcagagguugcagugagccaagauugcgccguuguacuccag

SEQ ID NO: 272554 - RNA, 64 nt, hsa
acacccacauaccuggcccaaccagacuucucccgugagccaggcaaaggaaauugucaucugc

SEQ ID NO: 272555 - RNA, 64 nt, hsa
gaggaucacuugagccccggaggucgaggcuacagugagccaagagugcacuacuguacuccag

SEQ ID NO: 272556 - RNA, 64 nt, hsa
guccauuuucuaugcuuguaacugucuucuagcagugagccaaauguaaaauagugaauaaagu

SEQ ID NO: 272557 - RNA, 64 nt, hsa
cgccucggccucccaaaaugcugggauuacaggugugagccacugugcccggccaaaagaacag

SEQ ID NO: 272558 - RNA, 64 nt, hsa
caccucugccucccaaagugcugggauuacaggcgugagccacugugccugaccugucauuuuu

SEQ ID NO: 272559 - RNA, 64 nt, hsa
cgucucggccucccaaagugcugggauuacaggugugagccaccacgccuggcccaugaaccaa

SEQ ID NO: 272560 - RNA, 64 nt, hsa
uuuuguauuuuuaguagagacaggguuucaccaugugagccaggauggucucaaucuccugacc

SEQ ID NO: 272561 - RNA, 64 nt, hsa
caccucggccucccaaagugcugggauuaaagcugugagccacugugccaaggcuuuuuuauuu

SEQ ID NO: 272562 - RNA, 64 nt, hsa
cgccucagccucccaaaaugcugggauuacaggcgugagccaccgcgccuggccuaaaaugugu

SEQ ID NO: 272563 - RNA, 64 nt, hsa
gggauaaaugguccacaaucuuaaacagaauacugugagccaaugccuuuuggaaguaauggug

SEQ ID NO: 272564 - RNA, 64 nt, hsa
ugccucggccucccaaagugcugggauuacaggcgugagccacugcgcccggccaaaaagaaca

SEQ ID NO: 272565 - RNA, 64 nt, hsa
caccucagccucccaaagugcugggauuacaggugugagccaccgcagccggaccauuuuuagu

SEQ ID NO: 272566 - RNA, 64 nt, hsa
cgccuuggccucccaaagugcugggauuacaggcgugagccaccgugccuggccgacauuuuua

SEQ ID NO: 272567 - RNA, 64 nt, hsa
ugccucggccucccaaagugcugagauuacaagugugagccaccacgcccagccucuccccuuu

SEQ ID NO: 272568 - RNA, 64 nt, hsa
caccccggccucccaaaaugcugggaucacaggcgugagccaccucgccuggccagaucucuuu

SEQ ID NO: 272569 - RNA, 64 nt, hsa
cgccucggccucccaaagugcugggauuacaggcgugagccaccgcgcccggcggcgaaacacg

SEQ ID NO: 272570 - RNA, 64 nt, hsa
cgccucggccucccaaaguauugggauuacccgcgugagccaccgcgcccggcugcaaauaauc

SEQ ID NO: 272571 - RNA, 64 nt, hsa
caccucagccucccaaagugcugggauuacaggcgugagccaccacaccaggcccgagaaaugc

SEQ ID NO: 272572 - RNA, 64 nt, hsa
cgccucggccucccaaagugcugggauuacaggcgugagccacuuaguauuuguaaccauaaga

SEQ ID NO: 272573 - RNA, 64 nt, hsa
cgccucgaccucccaaagugcugugauuacaggugugagccacugcacccggccugaaauuuuu

SEQ ID NO: 272574 - RNA, 64 nt, hsa
ugccuuggccucccaaagugcugggauuacaggcgugagccacugcgcccggccgaaguguuug

SEQ ID NO: 272575 - RNA, 64 nt, hsa
cgccucagccucccaaagugcugggauuacaggagugagccaccgcucccggcccagaacuuuu

SEQ ID NO: 272576 - RNA, 64 nt, hsa
uauagcccagguccucugauacccagagcauuacgugagccagguaaugagggacuggaaccag

SEQ ID NO: 272577 - RNA, 64 nt, hsa
gagaaucgcuuaaaccugggaggcggagaguacagugagccaagaucgcgccacugcacuccgg

SEQ ID NO: 272578 - RNA, 64 nt, hsa
aagaaucacuugaacuugggagguggagguugcagugagccaagauugugccacugcacucaag

SEQ ID NO: 272579 - RNA, 64 nt, hsa
ugccucggccucccaaagugcugggauuacaggcgugagccaccacgccuggccaauuauguaa

SEQ ID NO: 272580 - RNA, 64 nt, hsa
caccuuggccucccaaaguucuaggauuacaggugugagccaccacguccggccaauuuuucuc

SEQ ID NO: 272581 - RNA, 64 nt, hsa
ugccuuggcuccccaaagugcugggauuacaggcgugagccaccaggcccugccugguuuucaa

SEQ ID NO: 272582 - RNA, 64 nt, hsa
cuugcuucaguggugguucuguugcucagcugcagugagccaguucaauuuugcaaaggugcag

SEQ ID NO: 272583 - RNA, 64 nt, hsa
gcuuugguaugaaugagagccagaucuccacugugugagccagugaauuauggcuaauucggcu

SEQ ID NO: 272584 - RNA, 64 nt, hsa
aucaccgaagcucccuagaggggcaaaagauggagugagccacaggaaguuuggggcgugguga

SEQ ID NO: 272585 - RNA, 64 nt, hsa
ugacucugccucccaaagugcugccauuacaggcgugagccacuaggccugaccuccccuuccc

SEQ ID NO: 272586 - RNA, 64 nt, hsa
uuuuauuuuuucgugcacucugcuaaucaugugggugagccaguggaacagcgggagaccugug

SEQ ID NO: 272587 - RNA, 64 nt, hsa
aucccagccugugguuacagugcagacaggccaugugagccaccgcugccagcacagagcgucc

SEQ ID NO: 272588 - RNA, 64 nt, hsa
gagaaucacuugaacucgggagguggagguugcagugagccaagaucgcgccacugcacuccag

SEQ ID NO: 272589 - RNA, 64 nt, hsa
aaggauugcuugagcgagggaggucgaggcugcagugagccacgaucacaccacugcacuccag

SEQ ID NO: 272590 - RNA, 64 nt, hsa
gagaaucacuugaaccuaggaggcggagguugcagugagccaagauggcgccauugcacuccag

SEQ ID NO: 272591 - RNA, 64 nt, hsa
gagaaucgcuugaacccaggaggcggagguugcagugagccaagauggcgccauugcacuccag

SEQ ID NO: 272592 - RNA, 64 nt, hsa
aagacuggugaaaacacauacaucagacuauguugugagccagguugauuuuuuauuuuauuau

SEQ ID NO: 272593 - RNA, 64 nt, hsa
acgggcaggaaaaagccaagcccgggacccucgugugagccagcccggccuaaucugaccgccu

SEQ ID NO: 272594 - RNA, 64 nt, hsa
caccucggccucccaaagugcuaggauuacuggcgugagccaccacuccuagccuuaaugcaua

SEQ ID NO: 272595 - RNA, 64 nt, hsa
gccuuggccucccaaaagugcugggauuauaggcgugagccaccgcccgggcaaauuuuuguau

SEQ ID NO: 272596 - RNA, 64 nt, hsa
cgccucggccucccaaagugcuggaauuacuggcgugagccaccaugcccagccucaaauaugu

SEQ ID NO: 272597 - RNA, 64 nt, hsa
caccucagccucccaaagcauuaggauuauaggcgugagccacugcaccuggccaaguaauuuc

SEQ ID NO: 272598 - RNA, 64 nt, hsa
ugccuuggccuuccaaaguguuggaauuacaggcgugagccaccgcgccuggucuauaugugau

SEQ ID NO: 272599 - RNA, 64 nt, hsa
gccugccccuguccuagugcaaagugaauuuagagugagccagauuauggaggauucugugacu

SEQ ID NO: 272600 - RNA, 64 nt, hsa
caccucagccuuucaaagugcuggaauuacaggugugagccacucugccuggccuaccacuaac

SEQ ID NO: 272601 - RNA, 64 nt, hsa
ccccucggucucccaaagugcugggauuacaggcgugagccaccaugcccggcccaaauauuuu

SEQ ID NO: 272602 - RNA, 64 nt, hsa
cugccucggccucccaagugcugggauuacaggcgugagccacugcacccagccuagaaucuug

SEQ ID NO: 272603 - RNA, 64 nt, hsa
cgccuuggccucccaaagugcugggauuacagaugugagccaccacaccuggccccaagcuuga

SEQ ID NO: 272604 - RNA, 64 nt, hsa
acagguguauggagucaccuguaaauugauucaagugagccaggaaagcagcaaaggaaagaga

SEQ ID NO: 272605 - RNA, 64 nt, hsa
uaccucggccucccaaagugcugggauuacaggcgugagccaccacgcccggucaccuuugucc

SEQ ID NO: 272606 - RNA, 64 nt, hsa
ugccuuggcuucccaaaguccugggauuacaggugugagccaccacauccagccuaacuuacau

SEQ ID NO: 272607 - RNA, 64 nt, hsa
ccucgaccucucucaaagugcuggcauuacaggugugagccacggugcccggcccacaauuaau

SEQ ID NO: 272608 - RNA, 64 nt, hsa
guuacaaguuauagcuacauaugggagagacucagugagccagcaaaggccauagaaacaacaa

SEQ ID NO: 272609 - RNA, 64 nt, hsa
aaauguauuuauggcagaaggaccuaaauaaacugugagccaccuuuucuucuuuauauuguua

SEQ ID NO: 272610 - RNA, 64 nt, hsa
ugccuuggccucccagagugcugggauuacaggcgugagccaccgcacccggccucuguguagc

SEQ ID NO: 272611 - RNA, 64 nt, hsa
ugccucagccucucgaguagcugggacuacaggcgugagccagcacgcccagcuaauuuuugua

SEQ ID NO: 272612 - RNA, 64 nt, hsa
gagaauugcuugaaccugggaggcagaggcugcagugagccaagacaaugccacuacacuccag

SEQ ID NO: 272613 - RNA, 64 nt, hsa
gagaauuguuugaaccuggaaggcggagguugcagugagccaagaucacagcacugcacugcug

SEQ ID NO: 272614 - RNA, 64 nt, hsa
cgccuuggccucccuaaguguugggauuauaggugugagccagcagccauaccccucuucucaa

SEQ ID NO: 272615 - RNA, 64 nt, hsa
cgccugggucuccuaaaguacugggauuacaggcgugagccaccucgcccagcggcaucaggcu

SEQ ID NO: 272616 - RNA, 64 nt, hsa
ugccucaaccucccaagcaguugggacuacaggcgugagccaccaugcccggcuaauuuuugua

SEQ ID NO: 272617 - RNA, 64 nt, hsa
ugccucggccucccaaagugcuaggauuacaggcgugagccaccaugcccagcugggagcguuc

SEQ ID NO: 272618 - RNA, 64 nt, hsa
caccuuggccucccaaagugcugggauuacacgcgugagccaccaugcccggccaauacuacac

SEQ ID NO: 272619 - RNA, 64 nt, hsa
gagaaucccuugagcccgggaggcggagguugcagugagccaagaucaugccacugcacuccag

SEQ ID NO: 272620 - RNA, 64 nt, hsa
uuauggaucccccacuauauuugaugggaacccagugagccaggggccaguuuugacaggucag

SEQ ID NO: 272621 - RNA, 64 nt, hsa
ccugccucagccucccagugcugggauuauaggugugagccacugcgccuggcuaaguuauuau

SEQ ID NO: 272622 - RNA, 64 nt, hsa
ugccuugaccucccaaagugcuaggauaacaggugugagccaccgcacccugccaaguuauuuu

SEQ ID NO: 272623 - RNA, 64 nt, hsa
agccucagccucccaaagugcugggauuacaggcgugagccacugugcccggccaagaauuuuu

SEQ ID NO: 272624 - RNA, 64 nt, hsa
auccucggccucccaaagugcuggaaucacaggggugagccaccgcacccagcccucucucuuc

SEQ ID NO: 272625 - RNA, 64 nt, hsa
gauaaucacuugaauccgggaggcggagguugcggugagccaagaucgcgccacugcacuccag

SEQ ID NO: 272626 - RNA, 64 nt, hsa
gaagaucucuugagcccaagggguggggguugcagugagccaagaugcacugcaccccagccug

SEQ ID NO: 272627 - RNA, 64 nt, hsa
accucggucuccccaaagugcugggauuacaggcgugagccacucugccuggcugguuauuuug

SEQ ID NO: 272628 - RNA, 64 nt, hsa
cuccucggccucccaaagugcugggauuauaggcgugagccaccgcgcccggccuccaguucau

SEQ ID NO: 272629 - RNA, 64 nt, hsa
ugccuuggccucccaaagugcugggauuacaggcgugagccaccacacccggcccccaguucuu

SEQ ID NO: 272630 - RNA, 64 nt, hsa
ugccucggccucccaaagugcugggauuacaggugugagccacagcacccaaccuuuuuuuccc

SEQ ID NO: 272631 - RNA, 64 nt, hsa
caucuccaccucccaaagugcuaggauuacaggcgugagccaccguacccagccuggucccaua

SEQ ID NO: 272632 - RNA, 64 nt, hsa
caccucagccucucaaagugcugggauuacaggugugagccacuguggccgaccuacuauuuuu

SEQ ID NO: 272633 - RNA, 64 nt, hsa
ugccuuggccucccaaaguguugggauuauaggcgugagccaccaugcccagccuaauuuuugu

SEQ ID NO: 272634 - RNA, 64 nt, hsa
caccuuggccucccgaagugcugggauuacaggcgugagccaccgugcccggccugauguuuuu

SEQ ID NO: 272635 - RNA, 64 nt, hsa
ugcuucggccucccaaagugcuaggauuacaggugugagccaccacgccuggcuaauuuuguau

SEQ ID NO: 272636 - RNA, 64 nt, hsa
caccuuggccucccagaaugcuggguuuauagaugugagccagcacaccgggccaagugaagaa

SEQ ID NO: 272637 - RNA, 64 nt, hsa
caccucggccucccacagugcugggauuaccggcgugagccaccaugccuggcccggauaauuu

SEQ ID NO: 272638 - RNA, 64 nt, hsa
cgccucugccucccaaagugcugggauuacagacgugagccaccacagcuggcugaagauuaua

SEQ ID NO: 272639 - RNA, 64 nt, hsa
cauuucagccucccaaguagcugggacuacaauugugagccaccaugccaggcucauuguuaua

SEQ ID NO: 272640 - RNA, 64 nt, hsa
cgccucagccucccaaagugcugggauuacaggggugagccaccacgcccagccccagcuuagu

SEQ ID NO: 272641 - RNA, 64 nt, hsa
cgccucagccucccaaaguguugggauuacaggugugagccacagcaccuggccaaccaacacu

SEQ ID NO: 272642 - RNA, 64 nt, hsa
cagaagcucccagcaccuccuacuugggagaaaagugagccaucugcuggucaggaaguccucc

SEQ ID NO: 272643 - RNA, 64 nt, hsa
ucuuggccaggcuggucuuggaacuccugaccucgugagccaccacgcccagccucuuuugcug

SEQ ID NO: 272644 - RNA, 64 nt, hsa
cgccucggccucccaaagugcugggauuacaggcgugagccaccuugccuggccaaaaaucuca

SEQ ID NO: 272645 - RNA, 64 nt, hsa
aggaucaccugagcccagggaggucaaggaugcagugagccauggucucaccacugcacucuag

SEQ ID NO: 272646 - RNA, 64 nt, hsa
gaggaucacuugaaccuaggaggucgaggcugcagugagccaagaucaugcuacugcacuccag

SEQ ID NO: 272647 - RNA, 64 nt, hsa
caccuuggccucccaaagugcugagauuacaggcgugagccacugugccuggccuuauguaaag

SEQ ID NO: 272648 - RNA, 64 nt, hsa
ugucuuggccucccaaagugcugagauuacaggugugagccacugugcccagcaguuucccaga

SEQ ID NO: 272649 - RNA, 64 nt, hsa
cgccuuggccucccaaagugcugggauuacaggugugagccaccacacccagccucuguaguuc

SEQ ID NO: 272650 - RNA, 64 nt, hsa
gagaauugcuugaacccaggaggcagagauugcggugagccaagauggcaccacugcacuccag

SEQ ID NO: 272651 - RNA, 64 nt, hsa
ggaguacgugauucccucccuuucacuuuucaaagugagccacuaaacagaaagucuaagaguu

SEQ ID NO: 272652 - RNA, 64 nt, hsa
ugccucagccucccaaagugcugggauuacaggugugagccaccgugcccggcccagauagguu

SEQ ID NO: 272653 - RNA, 64 nt, hsa
cacccaccucaggaagugcugggauuacaggcgugugagccaccacgcccggccaugaaauauu

SEQ ID NO: 272654 - RNA, 64 nt, hsa
cgccuuggccucccaaaguacugggauuacaggcgugagccaccgugcccaaccaugaaauauu

SEQ ID NO: 272655 - RNA, 64 nt, hsa
agagucggguuuugggguugaaagugugaguuugacggugcaucagcaugccgcguuaggcucg

SEQ ID NO: 272656 - RNA, 64 nt, hsa
aaagggcccgcgcacaaagcaguguuucuucgccacggugcaucuucaugguaaguuaggauuu

SEQ ID NO: 272657 - RNA, 64 nt, hsa
augggaggguugaugugagcuugcuuggagacacacggugcagcaucagggaccuucccaggcc

SEQ ID NO: 272658 - RNA, 64 nt, hsa
uggugucagagaaggcagagcccacaguaggugcacggugcaaggcccugggagggcacuggcc

SEQ ID NO: 272659 - RNA, 64 nt, hsa
aaagagaagguuucuuccagagucaucuaccugaguccugaagcucccuguccugaaagccaca

SEQ ID NO: 272660 - RNA, 64 nt, hsa
uccagagucaucuaccugaguccugaagcucccuguccugaaagccacagacaauaugguccca

SEQ ID NO: 272661 - RNA, 64 nt, hsa
agccgcugaccauagccagcaaaagaccuggcagguccugaaucaaaacaacagaguggcugaa

SEQ ID NO: 272662 - RNA, 64 nt, hsa
cuaugccaguuacccuggagaggacuccugccguguccugaaaaggcagaaaaggaagaggggc

SEQ ID NO: 272663 - RNA, 64 nt, hsa
uccuuccagggaugucucuccagcucuacuuuauguccugaagcugacccgaggucuuccuauc

SEQ ID NO: 272664 - RNA, 64 nt, hsa
cccaccaggcuugggaggaagugccugcagccagguccugaaccauaaccaccccugggaaaca

SEQ ID NO: 272665 - RNA, 64 nt, hsa
uuucaaauagcauuuuagugaaugcaauucaguaguccugaagccugacuuaauaaaacaaaau

SEQ ID NO: 272666 - RNA, 64 nt, hsa
uaauuuuuuuaaaauagcauuacagacugaggcgguccugaagcaaugguuuuucacucucuua

SEQ ID NO: 272667 - RNA, 64 nt, hsa
agcccagcugcuuuaccaggaguauagugauguuguccugaauaaggagauccagagccagcag

SEQ ID NO: 272668 - RNA, 64 nt, hsa
gaacaauaucuucuccuuccaaguaugugacguaguccugaaccacgccccagacuuccgccgg

SEQ ID NO: 272669 - RNA, 64 nt, hsa
caaauguuucuucucuuccuuuccccaagacagaguccugaaccuguuaaauuaagucauugga

SEQ ID NO: 272670 - RNA, 64 nt, hsa
gcauuuguuacugaaaugauuaaugcacugauggguccugaauucaccuugagaaagacccaaa

SEQ ID NO: 272671 - RNA, 64 nt, hsa; identical to SEQ ID NO: 73516

SEQ ID NO: 272672 - RNA, 64 nt, hsa; identical to SEQ ID NO: 73517

SEQ ID NO: 272673 - RNA, 64 nt, hsa; identical to SEQ ID NO: 91418

SEQ ID NO: 272674 - RNA, 64 nt, hsa; identical to SEQ ID NO: 91419

SEQ ID NO: 272675 - RNA, 56 nt, hsa; identical to SEQ ID NO: 91420

SEQ ID NO: 272676 - RNA, 64 nt, hsa; identical to SEQ ID NO: 91421

SEQ ID NO: 272677 - RNA, 64 nt, hsa; identical to SEQ ID NO: 91422

SEQ ID NO: 272678 - RNA, 64 nt, hsa; identical to SEQ ID NO: 91423

SEQ ID NO: 272679 - RNA, 64 nt, hsa; identical to SEQ ID NO: 91424

SEQ ID NO: 272680 - RNA, 64 nt, hsa; identical to SEQ ID NO: 91425

SEQ ID NO: 272681 - RNA, 64 nt, hsa; identical to SEQ ID NO: 91426

SEQ ID NO: 272682 - RNA, 64 nt, hsa; identical to SEQ ID NO: 91427

SEQ ID NO: 272683 - RNA, 64 nt, hsa; identical to SEQ ID NO: 91428

SEQ ID NO: 272684 - RNA, 64 nt, hsa; identical to SEQ ID NO: 91429

SEQ ID NO: 272685 - RNA, 64 nt, hsa; identical to SEQ ID NO: 91430

SEQ ID NO: 272686 - RNA, 64 nt, hsa; identical to SEQ ID NO: 91431

SEQ ID NO: 272687 - RNA, 64 nt, hsa; identical to SEQ ID NO: 91432

SEQ ID NO: 272688 - RNA, 64 nt, hsa; identical to SEQ ID NO: 91433

SEQ ID NO: 272689 - RNA, 64 nt, hsa; identical to SEQ ID NO: 91434

SEQ ID NO: 272690 - RNA, 64 nt, hsa; identical to SEQ ID NO: 91435

SEQ ID NO: 272691 - RNA, 64 nt, hsa; identical to SEQ ID NO: 91436

SEQ ID NO: 272692 - RNA, 64 nt, hsa
uuagguacugcauggaaauaggucauuaacuugaaacucuuaucaaaauauauuuuaccaguuu

SEQ ID NO: 272693 - RNA, 64 nt, hsa
guaguacgacccucuggauuuggaaggcaaauaaaacucuuacagugauuauuuagauauuaaa

SEQ ID NO: 272694 - RNA, 64 nt, hsa
aauauaaaaagaguaccugagauguauuuuuuuaaacucuuagagauaucuguaacucaaauuu

SEQ ID NO: 272695 - RNA, 64 nt, hsa
guauaucaguaauauagaagacaucuuuauagucaacucuuaauuaaugcuuauuguaccaaau

SEQ ID NO: 272696 - RNA, 57 nt, hsa
aaaaaaacacaacugauugacacucagaacucuuagcuguggaagaacaucaugccu

SEQ ID NO: 272697 - RNA, 64 nt, hsa
uaucagaacaucugagcaccauuuuagaagagucaacucuuaagauuaucauuagaaaacaaau

SEQ ID NO: 272698 - RNA, 64 nt, hsa
uacagucauuuuccucaguuccuuuucucgccugaacucuuaagcugcaucuggaagauggcuu

SEQ ID NO: 272699 - RNA, 64 nt, hsa
gcaugauaaauguuuaaauguagucaacaucuguaacucuuacaugaguguccagaggcacuca

SEQ ID NO: 272700 - RNA, 64 nt, hsa
guggagaaugcggaaaagccuuuaacugguccucaacucuuauuacacauaagauaauucacag

SEQ ID NO: 272701 - RNA, 64 nt, hsa
gugaacaguguggcaaggucuuuaagaaguccucaacucuuacugcacauaagaucauucauac

SEQ ID NO: 272702 - RNA, 64 nt, hsa
gaaugugacgaaugaagaaaagguauuaguguuaaacucuuaaucgacuccugcaaaucuauac

SEQ ID NO: 272703 - RNA, 64 nt, hsa
ucugcuguucuuggcccaaguucuuuccaaaaccaacucuuaggccugcucuuuacuagggauc

SEQ ID NO: 272704 - RNA, 64 nt, hsa
uacccuggaaagaaaauauuggaauguuauuauaaacucuuagauauuuauauaauucaaaaga

SEQ ID NO: 272705 - RNA, 64 nt, hsa
acucuccagaauguacuauccaucuugaugagaaaacucuuaaauaguaccaaacauuuugaac

SEQ ID NO: 272706 - RNA, 64 nt, hsa
gaucuugaaauaucucaggauagcacuuuuggcaaacucuuagccaaggcuucuucauuggugc

SEQ ID NO: 272707 - RNA, 64 nt, hsa
aacuguaaaauauaucauauggggggaguuuuuuaacucuuauuuuuugaaaauuuacuguagc

SEQ ID NO: 272708 - RNA, 64 nt, hsa
ucuugaaaauguuuuggaacugcgauaacugagaaacucuuaccaguccacaugcaauuagaca

SEQ ID NO: 272709 - RNA, 64 nt, hsa
uuagaaucugaugccuuuauuuucagggauaaguaacucuuaccuaaacugagcugaauguuug

SEQ ID NO: 272710 - RNA, 64 nt, hsa
uagauuuuuugaaaagugaguaauaauguaauucaacucuuaaauuauuuccugccuuuucuuc

SEQ ID NO: 272711 - RNA, 64 nt, hsa
gugaaaaauguggcaaagccuuuuaccaguccucaacucuuacuaaacauaaaaaaauucauac

SEQ ID NO: 272712 - RNA, 64 nt, hsa
guaaaaaauguagaaaauccuuuauugauuguucaacucuuaacaccagagaauucacacuggu

SEQ ID NO: 272713 - RNA, 64 nt, hsa
guaaagaaugugggaagguuuuuaauaauuauccaacucuuacucaacaucaaagaauucauac

SEQ ID NO: 272714 - RNA, 64 nt, hsa; identical to SEQ ID NO: 96836

SEQ ID NO: 272715 - RNA, 64 nt, hsa; identical to SEQ ID NO: 96837

SEQ ID NO: 272716 - RNA, 64 nt, hsa; identical to SEQ ID NO: 96838

SEQ ID NO: 272717 - RNA, 64 nt, hsa; identical to SEQ ID NO: 96839

SEQ ID NO: 272718 - RNA, 64 nt, hsa; identical to SEQ ID NO: 96840

SEQ ID NO: 272719 - RNA, 64 nt, hsa; identical to SEQ ID NO: 96841

SEQ ID NO: 272720 - RNA, 64 nt, hsa; identical to SEQ ID NO: 96842

SEQ ID NO: 272721 - RNA, 64 nt, hsa; identical to SEQ ID NO: 96843

SEQ ID NO: 272722 - RNA, 64 nt, hsa; identical to SEQ ID NO: 96844

SEQ ID NO: 272723 - RNA, 64 nt, hsa; identical to SEQ ID NO: 96845

SEQ ID NO: 272724 - RNA, 64 nt, hsa; identical to SEQ ID NO: 96846

SEQ ID NO: 272725 - RNA, 64 nt, hsa; identical to SEQ ID NO: 96847

SEQ ID NO: 272726 - RNA, 64 nt, hsa; identical to SEQ ID NO: 96848

SEQ ID NO: 272727 - RNA, 64 nt, hsa; identical to SEQ ID NO: 96849

SEQ ID NO: 272728 - RNA, 64 nt, hsa; identical to SEQ ID NO: 96850

SEQ ID NO: 272729 - RNA, 64 nt, hsa; identical to SEQ ID NO: 96851

SEQ ID NO: 272730 - RNA, 64 nt, hsa; identical to SEQ ID NO: 96852

SEQ ID NO: 272731 - RNA, 64 nt, hsa; identical to SEQ ID NO: 96853

SEQ ID NO: 272732 - RNA, 64 nt, hsa; identical to SEQ ID NO: 96854

SEQ ID NO: 272733 - RNA, 64 nt, hsa; identical to SEQ ID NO: 96855

SEQ ID NO: 272734 - RNA, 64 nt, hsa; identical to SEQ ID NO: 96856

SEQ ID NO: 272735 - RNA, 64 nt, hsa; identical to SEQ ID NO: 96857

SEQ ID NO: 272736 - RNA, 64 nt, hsa; identical to SEQ ID NO: 96858

SEQ ID NO: 272737 - RNA, 64 nt, hsa; identical to SEQ ID NO: 96859

SEQ ID NO: 272738 - RNA, 64 nt, hsa; identical to SEQ ID NO: 96860

SEQ ID NO: 272739 - RNA, 64 nt, hsa; identical to SEQ ID NO: 96861

SEQ ID NO: 272740 - RNA, 64 nt, hsa; identical to SEQ ID NO: 96862

SEQ ID NO: 272741 - RNA, 64 nt, hsa; identical to SEQ ID NO: 96863

SEQ ID NO: 272742 - RNA, 64 nt, hsa; identical to SEQ ID NO: 96864

SEQ ID NO: 272743 - RNA, 64 nt, hsa; identical to SEQ ID NO: 96865

SEQ ID NO: 272744 - RNA, 64 nt, hsa; identical to SEQ ID NO: 96866

SEQ ID NO: 272745 - RNA, 64 nt, hsa; identical to SEQ ID NO: 96867

SEQ ID NO: 272746 - RNA, 64 nt, hsa; identical to SEQ ID NO: 96868

SEQ ID NO: 272747 - RNA, 64 nt, hsa; identical to SEQ ID NO: 96869

SEQ ID NO: 272748 - RNA, 64 nt, hsa; identical to SEQ ID NO: 96870

SEQ ID NO: 272749 - RNA, 64 nt, hsa; identical to SEQ ID NO: 96871

SEQ ID NO: 272750 - RNA, 64 nt, hsa; identical to SEQ ID NO: 96872

SEQ ID NO: 272751 - RNA, 64 nt, hsa; identical to SEQ ID NO: 96873

SEQ ID NO: 272752 - RNA, 64 nt, hsa; identical to SEQ ID NO: 96874

SEQ ID NO: 272753 - RNA, 64 nt, hsa; identical to SEQ ID NO: 96875

SEQ ID NO: 272754 - RNA, 64 nt, hsa
caguuuauaaauuuggcgcucuuuuaauuacacucuguagaagguuaauagagcuugagcccug

SEQ ID NO: 272755 - RNA, 64 nt, hsa
ugagcccugcuuuaauauguagugaaagauaauucuguagaaaaacgucagccaguaggguaaa

SEQ ID NO: 272756 - RNA, 64 nt, hsa
ggaacguuuuuccuguucuuaagacgugauuuugcuguagaagauggcacuuauaaccaaagcc

SEQ ID NO: 272757 - RNA, 64 nt, hsa
caaguucuuaguugcuguaugucucgugguaggacuguagaaaagggaacugaacauuccagag

SEQ ID NO: 272758 - RNA, 64 nt, hsa
uauuuugaguuauuccaacagagaugauggauuccuguagaacuagaggugggugaccuauggu

SEQ ID NO: 272759 - RNA, 64 nt, hsa
cuuggagggagguggaaguugacucucuuuuucacuguagaauaauguggaaauaacccuagau

SEQ ID NO: 272760 - RNA, 64 nt, hsa
agaguuuaccaugauucagagaaguucuucaggccuguagaaagaggaguauggaacaaccuua

SEQ ID NO: 272761 - RNA, 64 nt, hsa
auaauuuccugguaaggcuaacuccugaucguuucuguagaaagaugacaaauaaagaaaaagu

SEQ ID NO: 272762 - RNA, 64 nt, hsa
caggcuguugaagcauuuucucagaggaguggaucuguagaagucugucuuucuauagaaauau

SEQ ID NO: 272763 - RNA, 64 nt, hsa
uuguuuucaauguguuggaaacuguaaaaugauacuguagaaccugucuccuacuuugaaaacu

SEQ ID NO: 272764 - RNA, 64 nt, hsa
uuccuguuugaaggcuuacuguagaaguggcuuacuguagaagcagcuugcugagccccuccga

SEQ ID NO: 272765 - RNA, 64 nt, hsa
ucauuuuaugcuuuauuuccuguuugaaggcuuacuguagaaguggcuuacuguagaagcagcu

SEQ ID NO: 272766 - RNA, 64 nt, hsa
ucuacugcauuaugagcacuuaaaguacugcuagcuguagaacuccagcuucggccugucgccc

SEQ ID NO: 272767 - RNA, 64 nt, hsa
aauccaugcaaaacugacugugguagugaaaagucuguagaaaaguaagggaaacucaaacccc

SEQ ID NO: 272768 - RNA, 64 nt, hsa
gucggggccgggcccgccaguucuuuuccggauucuguagaaaauacauacuuccugugccaua

SEQ ID NO: 272769 - RNA, 64 nt, hsa
aagucugugguacuccaggauuccaggaguaagccuguagaagagauuuauuuuaaaagagauu

SEQ ID NO: 272770 - RNA, 64 nt, hsa
cuacgaccccagagugacugacggcuguguauuucuguagaaugcuguagaauccgguuuuagu

SEQ ID NO: 272771 - RNA, 64 nt, hsa
agagugacugacggcuguguauuucuguagaaugcuguagaauccgguuuuaguugagucuuca

SEQ ID NO: 272772 - RNA, 64 nt, hsa
agaugguacgucaugcucaguguccaguuuaauucuguagaaguuacgucuggcucuagguuaa

SEQ ID NO: 272773 - RNA, 64 nt, hsa
cauuucuaguucacguugaaugacaggccuggagcuguagaaucaggaaacccggaugccuaac

SEQ ID NO: 272774 - RNA, 64 nt, hsa
uccaaagugcugucaugcugccugcuuucuggagcuguagaaaguugaaacaccuggcgcagau

SEQ ID NO: 272775 - RNA, 64 nt, hsa
ugcuaaaacaggugccaugaaucagguacaauuacuguagaaacuaacauuagcuauuauacac

SEQ ID NO: 272776 - RNA, 64 nt, hsa
cuuauuuacaaggcugcguuaaaguuguacuaggcaaacacacugauguaggaagcacgaggaa

SEQ ID NO: 272777 - RNA, 64 nt, hsa
ugauuuuagaaaaagaagcuuaaucuaacguuuucaaacacaaggucucuuacagguauaguuc

SEQ ID NO: 272778 - RNA, 64 nt, hsa
uuugggagggauggggaaaacuacaaacguuugacaaacacaauucuaggaugaacaauguaua

SEQ ID NO: 272779 - RNA, 64 nt, hsa
ucuaaaugcaauaagauuuaguugaguuauuccacaaacacauuauaaaguucagauguuucau

SEQ ID NO: 272780 - RNA, 64 nt, hsa
aacaggcccaauuaaaaacuguuccauuacuacgcaaacacauauuagaggccuuugcugauga

SEQ ID NO: 272781 - RNA, 64 nt, hsa
gaacucuagcaaaacuuguuuagcuuagcaaaaacaaacacacaaaaaacugagaacucugcug

SEQ ID NO: 272782 - RNA, 64 nt, hsa
ucuguugcauacuuaguuuuuaguccuguaaaugcaaacacagcauuuuuuacaacuuucuuug

SEQ ID NO: 272783 - RNA, 64 nt, hsa
caaaagcguaagaugaagagagaggaaaugaagccaaacacauccuuucaucagaagcccauuc

SEQ ID NO: 272784 - RNA, 64 nt, hsa
uaaagcuuaugcucagaaaugccauacacacacacaaacacacacauuuaucauuuaaugcaua

SEQ ID NO: 272785 - RNA, 64 nt, hsa
uaaacauauacauacacaaacacaaucccacaugcaaacacacacagccacauauauacaugug

SEQ ID NO: 272786 - RNA, 64 nt, hsa
auucaacucacacacacauaaacauauacauacacaaacacaaucccacaugcaaacacacaca

SEQ ID NO: 272787 - RNA, 64 nt, hsa
caccugaagacaugcucucacauauagagguacacaaacacaccgucaugcacauuucagcuug

SEQ ID NO: 272788 - RNA, 64 nt, hsa
aaugugucuuuagagcucaguauucuuuauuuuacaaacacaacaaaauguaguaacuuuuuuc

SEQ ID NO: 272789 - RNA, 64 nt, hsa
gcuguaugagcagggauauccaugcuuauguauccaaacacagagacccaugggaacaaaugag

SEQ ID NO: 272790 - RNA, 64 nt, hsa
gggccuggugaggcaacagcuguggagugggggccaaacacauggaugguggaguacggccggg

SEQ ID NO: 272791 - RNA, 64 nt, hsa
ccuggcccaggcuggggguacagaucugcugaagcaaacacaggagcgcuacuuggccaagaag

SEQ ID NO: 272792 - RNA, 64 nt, hsa
gugacagacaacaggccuucugcagccaggccuccaaacacaccacaaaggaagccucugcuuc

SEQ ID NO: 272793 - RNA, 64 nt, hsa
gggauuacgggugugagccaccgugcccggccugcaaacacauuuuaauugacaacacuagggc

SEQ ID NO: 272794 - RNA, 64 nt, hsa
cauucagauaaauggcaguacuuuaggacacacacaaacacacagacacaccuuuugauaugua

SEQ ID NO: 272795 - RNA, 64 nt, hsa
augagcucaagaagguccuuaacacagucgugaacaaacacaaggaccugaagacacacggguu

SEQ ID NO: 272796 - RNA, 64 nt, hsa
agcucuaugacaucauuaccaugcgguacgcagacaaacacaugaacaucgacuuugacaguuu

SEQ ID NO: 272797 - RNA, 64 nt, hsa
cacaaacacacacacaagcacuugcacauacauacaaacacaugcaaacauaccuacacacaca

SEQ ID NO: 272798 - RNA, 64 nt, hsa
cauggcagaggaauacaucucucacacauacucacaaacacacacacaagcacuugcacauaca

SEQ ID NO: 272799 - RNA, 64 nt, hsa
cuguaacgugguucaucccugguuaaaaagcaaacaaacacaggcugaaaacccaugcugcugu

SEQ ID NO: 272800 - RNA, 64 nt, hsa
uugacuccaagucucugugagcagugacuugaaccaaacacaccaggaauaauccauucuuugg

SEQ ID NO: 272801 - RNA, 64 nt, hsa
aucugccucacaccuucaaauucaugaaaggacacaaacacacauaagaauacacucuggagaa

SEQ ID NO: 272802 - RNA, 64 nt, hsa
aucugccaagaaccuucgaauucaugaaaggacacaaacacacguaagaaugcacucuguagaa

SEQ ID NO: 272803 - RNA, 64 nt, hsa
ggccuuccacagcagaaaccagggcaaaaggguccaaacacaugguuuuccuugcugcaaggcu

SEQ ID NO: 272804 - RNA, 64 nt, hsa
gaaaaaaaaaacucauuggcagauccaagaaugacaaacacaagugccccuuuucucuggaucu

SEQ ID NO: 272805 - RNA, 64 nt, hsa
ggaaaaacauguuggcuuuucucuugacgugggagaaauugaaaagaaggggaaggggaagaaa

SEQ ID NO: 272806 - RNA, 64 nt, hsa
gcaacagcguauuggcuuggcuguugacauggaugaaauugaaaaguaccaagaaguggaagaa

SEQ ID NO: 272807 - RNA, 64 nt, hsa
aauacuccaacaggaaugguagucacacugucuugaaauugaaucuguccaucuguuuauaauc

SEQ ID NO: 272808 - RNA, 64 nt, hsa
uugguugcagcacaacuguauauauuguauaaccgaaauugauuauuuucauuguccuuaaugc

SEQ ID NO: 272809 - RNA, 64 nt, hsa
uauucagugcagcccucauaguaucauacuugaagaaauugauuacaguuccacuaaauuguug

SEQ ID NO: 272810 - RNA, 64 nt, hsa
aauggguucuauagaaaaguccguuuaguguagagaaauugaaaacagaucuauuagguuggug

SEQ ID NO: 272811 - RNA, 64 nt, hsa
caagaaggaaaagucacgauaaaccuggucaccugaaauugaaauugagccacuuccuugaaga

SEQ ID NO: 272812 - RNA, 64 nt, hsa
ggaaaagucacgauaaaccuggucaccugaaauugaaauugagccacuuccuugaagaaucaaa

SEQ ID NO: 272813 - RNA, 64 nt, hsa
agaaguagagaaugaaggaaaaggugaaugcuaugaaauugauauuuuuucuggaacugaauuc

SEQ ID NO: 272814 - RNA, 64 nt, hsa
aacacugacuuuguuuuuauaaguuauuaaaugugaaauugaucugcaucagcuuauuuauaaa

SEQ ID NO: 272815 - RNA, 64 nt, hsa
uaagcuuaccuguagggcaguuaccacagaaacagaaauugaccuccgguauauauaaauauuu

SEQ ID NO: 272816 - RNA, 53 nt, hsa
aacaagaaugccucgacuagagugaaauugaacuccaucaggcaaaauuuaaa

SEQ ID NO: 272817 - RNA, 64 nt, hsa
aagacuccgucucaaaaaaaaaaaaaaaaaaaaagaaauugaauugggggagucauggucaggg

SEQ ID NO: 272818 - RNA, 64 nt, hsa
uggcauggguggguggggagucagucaugucacugaaauugaaugggggaggcccaaugaggug

SEQ ID NO: 272819 - RNA, 64 nt, hsa
caccuuuauuagauaaaucaugaagugucccugugaaauugaagugaaacuaucucuguaggac

SEQ ID NO: 272820 - RNA, 64 nt, hsa
ggccuuggaauuuucauuuugaugcagaaauuuugaaauugaaaaugugcauguuuuggugcac

SEQ ID NO: 272821 - RNA, 64 nt, hsa
uggggagggaaaauuggaaugguucccuuuuuuagaaauugaaguggucuucauaugucaacua

SEQ ID NO: 272822 - RNA, 64 nt, hsa
cuucauaugucaacuacagaaaaggaaaaaaauagaaauugaaggauuuuuaugaaauuauauu

SEQ ID NO: 272823 - RNA, 64 nt, hsa
gacuuacccaguccggcaucggacuugaaaaaucgaaauugacaucacucagcuguuacauuuc

SEQ ID NO: 272824 - RNA, 64 nt, hsa
uuauaccuauuuauguauuuauuuauugaagugugaaauugagcaauaggcaggcaccaccguc

SEQ ID NO: 272825 - RNA, 64 nt, hsa
uuuaaauccugaagaaauugagaaguauguugcugaaauugaaaaagaaaaagaagaaaacgaa

SEQ ID NO: 272826 - RNA, 64 nt, hsa
augaaguuuuuuucuauagauuuuaaauccugaagaaauugagaaguauguugcugaaauugaa

SEQ ID NO: 272827 - RNA, 64 nt, hsa
aacaccaaaaaauaucuaguaauauauuuaaagggaaauugagcugcuuuuuuugaaacuuuga

SEQ ID NO: 272828 - RNA, 64 nt, hsa
cuuuaacuuaguuuugcauaguucuagugcagcugaaauugaaaaguuauuucccuuuagcugu

SEQ ID NO: 272829 - RNA, 64 nt, hsa
uuuaugggucagcaugaccauuaauuacugaguagaaauugacuaaacuuugauuuccuuuuuu

SEQ ID NO: 272830 - RNA, 64 nt, hsa
aauuaacauguucugaagguuacaauugauauuugaaauugacuguagagcauuuaguugaaga

SEQ ID NO: 272831 - RNA, 64 nt, hsa
cagugaauaaaacaccaaaaacccaaaaaugcuuuaaccacaguauaaauaauagauuauacac

SEQ ID NO: 272832 - RNA, 64 nt, hsa
cucauuccucagguguuuugagaaacaugacuaauaaccacacaauuaaguagagucauuccaa

SEQ ID NO: 272833 - RNA, 64 nt, hsa
gauuacugaaaccugauuuauugcuuugucacuuuaaccacaucucucaacucucugcaauguu

SEQ ID NO: 272834 - RNA, 64 nt, hsa
ugcaaggcuuuuaucccugaaaaucauuuacagauaaccacaauuugcugugguauauaaacua

SEQ ID NO: 272835 - RNA, 64 nt, hsa
gguuuguaucuuccauauaauaaccacacacagauaaccacacaaaaaauccuuuguaaaauuu

SEQ ID NO: 272836 - RNA, 64 nt, hsa
uuaaauagaauuucgguuuguaucuuccauauaauaaccacacacagauaaccacacaaaaaau

SEQ ID NO: 272837 - RNA, 64 nt, hsa
guuuccgauguuuacacauguugccugagcugguuaaccacaucggcagccucagcuaccacaa

SEQ ID NO: 272838 - RNA, 64 nt, hsa
uuccagaaaagaaaauacaauuagucacucaacauaaccacaggccaauuuguuggccaccaga

SEQ ID NO: 272839 - RNA, 64 nt, hsa
acuugaacaacuuugcaggaauaaagcaacccccuaaccacaaaauaucccucuaaauuaguuc

SEQ ID NO: 272840 - RNA, 64 nt, hsa
uuccuuuucagaaguaccuguguguaucuguuaauaaccacagggguuaauaugauguaggauc

SEQ ID NO: 272841 - RNA, 64 nt, hsa
ugcuuccucuccugucaauuccaggcucuuuccauaaccacaagccugaggcugcagccuuuua

SEQ ID NO: 272842 - RNA, 64 nt, hsa
ccuaacuuugucgcuaguccuaaggagaaaccuuuaaccacaaaguuuuuaucauugaagacaa

SEQ ID NO: 272843 - RNA, 64 nt, hsa
cgugggcagggcaggccccaucgcuuuccucugauaaccacauggacacauccugaagucagcc

SEQ ID NO: 272844 - RNA, 64 nt, hsa
ggggucuggugggggacacccaagaauaaaagaauaaccacaaagugugcaagggaccaacagc

SEQ ID NO: 272845 - RNA, 64 nt, hsa
cauauauuuauagauuguguucacagcaaucauuuaaccacaaauaaaauaucccuugaugaua

SEQ ID NO: 272846 - RNA, 64 nt, hsa
gucagcuuagaagaguacuccaagcuucagaugauaaccacagccugggcugacaccuggauuu

SEQ ID NO: 272847 - RNA, 64 nt, hsa
aaauuuuucagugauuuuuaacguguuacauuuaguaaaccauagauuuuuuaaaaacuacauu

SEQ ID NO: 272848 - RNA, 64 nt, hsa
gguuuuuuuauauacaugcucuccccagaauacaguaaaccacaguuuuagaacuaaacacauc

SEQ ID NO: 272849 - RNA, 64 nt, hsa
ggccuuuucaagccuaagaagucucucuuacugaguaaaccagaggcuugcaucgcuauucuuu

SEQ ID NO: 272850 - RNA, 64 nt, hsa
gcuugaauacugcauaugccaaauagcuuuuauaguaaaccauguaaugaacucaaauuuaaau

SEQ ID NO: 272851 - RNA, 64 nt, hsa
ugcuauuaaaucauacaaaagcaaauuuugcacaguaaaccaauaguuugagauuuaaaacuau

SEQ ID NO: 272852 - RNA, 64 nt, hsa
uucauauuaauuccaggugauuuguuuuuucacaguaaaccauguaaguggaagcuuuacugcc

SEQ ID NO: 272853 - RNA, 64 nt, hsa
aaaaaaaccuaaaagcaguaucuguuauuuagcuguaaaccaaguuggaagcuauucggauaau

SEQ ID NO: 272854 - RNA, 64 nt, hsa
gaggcaugcuuuaauaucacaauaauuuugauuuguaaaccaagaaauuaauccuguguuuauc

SEQ ID NO: 272855 - RNA, 64 nt, hsa
cagcucagauacugaucucuuucuaaugggcuuuguaaaccacuugacuuugcuaauggcuauu

SEQ ID NO: 272856 - RNA, 64 nt, hsa
ccaaucaggcaaauagcccauacauuugaucguuguaaaccaugaagucuuuucuugcaagacg

SEQ ID NO: 272857 - RNA, 64 nt, hsa
cuuuaaaauuggaaagugggauaagaaaucuaaaguaaaccagcuuaucuuugaaacaauauua

SEQ ID NO: 272858 - RNA, 64 nt, hsa
cuucauaaaucauggaaaacucacugcugagauaguaaaccaugaaaucgccuuuucaguuggu

SEQ ID NO: 272859 - RNA, 64 nt, hsa
agugauaugggucugauuucgaucucuuccugauguaaaccaugcucacccauaucccacuaua

SEQ ID NO: 272860 - RNA, 64 nt, hsa; identical to SEQ ID NO: 75247

SEQ ID NO: 272861 - RNA, 64 nt, hsa; identical to SEQ ID NO: 75248

SEQ ID NO: 272862 - RNA, 64 nt, hsa; identical to SEQ ID NO: 75249

SEQ ID NO: 272863 - RNA, 64 nt, hsa; identical to SEQ ID NO: 75250

SEQ ID NO: 272864 - RNA, 64 nt, hsa; identical to SEQ ID NO: 75251

SEQ ID NO: 272865 - RNA, 64 nt, hsa; identical to SEQ ID NO: 75252

SEQ ID NO: 272866 - RNA, 64 nt, hsa; identical to SEQ ID NO: 75253

SEQ ID NO: 272867 - RNA, 64 nt, hsa; identical to SEQ ID NO: 75254

SEQ ID NO: 272868 - RNA, 64 nt, hsa; identical to SEQ ID NO: 75255

SEQ ID NO: 272869 - RNA, 64 nt, hsa; identical to SEQ ID NO: 75256

SEQ ID NO: 272870 - RNA, 64 nt, hsa; identical to SEQ ID NO: 75257

SEQ ID NO: 272871 - RNA, 64 nt, hsa; identical to SEQ ID NO: 75258

SEQ ID NO: 272872 - RNA, 64 nt, hsa; identical to SEQ ID NO: 75259

SEQ ID NO: 272873 - RNA, 64 nt, hsa; identical to SEQ ID NO: 75260

SEQ ID NO: 272874 - RNA, 64 nt, hsa; identical to SEQ ID NO: 75261

SEQ ID NO: 272875 - RNA, 64 nt, hsa; identical to SEQ ID NO: 75262

SEQ ID NO: 272876 - RNA, 64 nt, hsa; identical to SEQ ID NO: 75263

SEQ ID NO: 272877 - RNA, 64 nt, hsa; identical to SEQ ID NO: 75264

SEQ ID NO: 272878 - RNA, 64 nt, hsa; identical to SEQ ID NO: 75265

SEQ ID NO: 272879 - RNA, 64 nt, hsa; identical to SEQ ID NO: 75266

SEQ ID NO: 272880 - RNA, 64 nt, hsa; identical to SEQ ID NO: 75267

SEQ ID NO: 272881 - RNA, 64 nt, hsa; identical to SEQ ID NO: 75268

SEQ ID NO: 272882 - RNA, 64 nt, hsa; identical to SEQ ID NO: 75269

SEQ ID NO: 272883 - RNA, 64 nt, hsa; identical to SEQ ID NO: 75270

SEQ ID NO: 272884 - RNA, 64 nt, hsa; identical to SEQ ID NO: 75271

SEQ ID NO: 272885 - RNA, 64 nt, hsa; identical to SEQ ID NO: 75272

SEQ ID NO: 272886 - RNA, 64 nt, hsa; identical to SEQ ID NO: 75273

SEQ ID NO: 272887 - RNA, 64 nt, hsa; identical to SEQ ID NO: 75274

SEQ ID NO: 272888 - RNA, 64 nt, hsa; identical to SEQ ID NO: 75275

SEQ ID NO: 272889 - RNA, 64 nt, hsa; identical to SEQ ID NO: 75276

SEQ ID NO: 272890 - RNA, 64 nt, hsa; identical to SEQ ID NO: 75277

SEQ ID NO: 272891 - RNA, 64 nt, hsa; identical to SEQ ID NO: 75278

SEQ ID NO: 272892 - RNA, 64 nt, hsa; identical to SEQ ID NO: 75279

SEQ ID NO: 272893 - RNA, 64 nt, hsa; identical to SEQ ID NO: 75280

SEQ ID NO: 272894 - RNA, 64 nt, hsa; identical to SEQ ID NO: 75281

SEQ ID NO: 272895 - RNA, 64 nt, hsa; identical to SEQ ID NO: 75282

SEQ ID NO: 272896 - RNA, 64 nt, hsa; identical to SEQ ID NO: 75283

SEQ ID NO: 272897 - RNA, 64 nt, hsa; identical to SEQ ID NO: 75284

SEQ ID NO: 272898 - RNA, 64 nt, hsa; identical to SEQ ID NO: 75285

SEQ ID NO: 272899 - RNA, 64 nt, hsa; identical to SEQ ID NO: 75286

SEQ ID NO: 272900 - RNA, 64 nt, hsa; identical to SEQ ID NO: 75287

SEQ ID NO: 272901 - RNA, 64 nt, hsa; identical to SEQ ID NO: 75288

SEQ ID NO: 272902 - RNA, 64 nt, hsa; identical to SEQ ID NO: 75289

SEQ ID NO: 272903 - RNA, 64 nt, hsa; identical to SEQ ID NO: 75290

SEQ ID NO: 272904 - RNA, 64 nt, hsa; identical to SEQ ID NO: 75291

SEQ ID NO: 272905 - RNA, 64 nt, hsa; identical to SEQ ID NO: 75292

SEQ ID NO: 272906 - RNA, 64 nt, hsa; identical to SEQ ID NO: 75293

SEQ ID NO: 272907 - RNA, 64 nt, hsa; identical to SEQ ID NO: 75294

SEQ ID NO: 272908 - RNA, 64 nt, hsa; identical to SEQ ID NO: 75295

SEQ ID NO: 272909 - RNA, 64 nt, hsa; identical to SEQ ID NO: 75296

SEQ ID NO: 272910 - RNA, 64 nt, hsa; identical to SEQ ID NO: 75297

SEQ ID NO: 272911 - RNA, 64 nt, hsa; identical to SEQ ID NO: 75298

SEQ ID NO: 272912 - RNA, 64 nt, hsa; identical to SEQ ID NO: 75299

SEQ ID NO: 272913 - RNA, 64 nt, hsa; identical to SEQ ID NO: 75300

SEQ ID NO: 272914 - RNA, 64 nt, hsa; identical to SEQ ID NO: 75301

SEQ ID NO: 272915 - RNA, 64 nt, hsa; identical to SEQ ID NO: 75302

SEQ ID NO: 272916 - RNA, 64 nt, hsa; identical to SEQ ID NO: 75303

SEQ ID NO: 272917 - RNA, 64 nt, hsa; identical to SEQ ID NO: 75304

SEQ ID NO: 272918 - RNA, 64 nt, hsa; identical to SEQ ID NO: 75305

SEQ ID NO: 272919 - RNA, 64 nt, hsa; identical to SEQ ID NO: 75306

SEQ ID NO: 272920 - RNA, 64 nt, hsa; identical to SEQ ID NO: 75307

SEQ ID NO: 272921 - RNA, 64 nt, hsa; identical to SEQ ID NO: 75308

SEQ ID NO: 272922 - RNA, 64 nt, hsa; identical to SEQ ID NO: 75309

SEQ ID NO: 272923 - RNA, 64 nt, hsa; identical to SEQ ID NO: 75310

SEQ ID NO: 272924 - RNA, 64 nt, hsa; identical to SEQ ID NO: 75311

SEQ ID NO: 272925 - RNA, 64 nt, hsa; identical to SEQ ID NO: 75312

SEQ ID NO: 272926 - RNA, 64 nt, hsa; identical to SEQ ID NO: 75313

SEQ ID NO: 272927 - RNA, 64 nt, hsa; identical to SEQ ID NO: 75314

SEQ ID NO: 272928 - RNA, 64 nt, hsa
uagccguuccccuucugccccagucugagccagugagggguagcuuuuuaaaaccauuauucua

SEQ ID NO: 272929 - RNA, 64 nt, hsa
agcaccuccagguugguucuggguguccugcugugagggguagaacgggaggcugcugaaguga

SEQ ID NO: 272930 - RNA, 64 nt, hsa
gccacauagcagcagaggacugguguaagggagggagggguagggacagaagcuagacccaauc

SEQ ID NO: 272931 - RNA, 64 nt, hsa
agugcagccccuuccccugcccaggguggcaggggagggguaggguaaaaggcaugugcugcaa

SEQ ID NO: 272932 - RNA, 64 nt, hsa
ugcaucucucauuacuguagugcugagguuauugaaguuauacaaaacacaucucagucucugu

SEQ ID NO: 272933 - RNA, 64 nt, hsa
ccaucaauuuugacuuuuacuaaguuguuaaauaaaguuauaauacagcugugaagggcuaaag

SEQ ID NO: 272934 - RNA, 64 nt, hsa
aaucaguucucaaaaaaugaccggugcuuauaaaaaguuauaaauaucgaguagcucuaaaaca

SEQ ID NO: 272935 - RNA, 64 nt, hsa
uuuuuggaauaaguggugggugaauaccacugcuaaguuauagcuuuguuuuugcuugccuccu

SEQ ID NO: 272936 - RNA, 64 nt, hsa
guuugguuauuaauauauaugagacuuuuaaagaaaguuauauaacuacauagagauaaauuaa

SEQ ID NO: 272937 - RNA, 64 nt, hsa
uauauuucuuaauacaaaauaagugggaaaugagaaguuauaccaauaaaaagcauuuaaaaau

SEQ ID NO: 272938 - RNA, 64 nt, hsa
aaaguuauauauacuggguauuaaaauuaaaagcaaguuauaucagugaaguaagauccuuuug

SEQ ID NO: 272939 - RNA, 64 nt, hsa
ugaauucagauugccuagcuauuugaacaucucaaaguuauauauacuggguauuaaaauuaaa

SEQ ID NO: 272940 - RNA, 64 nt, hsa
caacuucuuuucugaacuucaaaucuuaauuuccaaguuauacuuguucuagguccaucuaaau

SEQ ID NO: 272941 - RNA, 64 nt, hsa
cauaagcuauucuaauuuuugagagaaacacaaaaaguuauagauugauagucuguauaauauu

SEQ ID NO: 272942 - RNA, 64 nt, hsa
ugguuugaucguaucuaaaucacauucaaaauuaaaguuauaucuaauaucuuugacauuuuuu

SEQ ID NO: 272943 - RNA, 64 nt, hsa
acuuuccagaggaaauaauccaaauauuuguuuuaaguuauauauacacaucuuauugaaccau

SEQ ID NO: 272944 - RNA, 64 nt, hsa
gaaaaaaaugcaguuuccuuuaauccuugacuauaaguuauacuauguugcguacauggcaaau

SEQ ID NO: 272945 - RNA, 64 nt, hsa
uguuuccuucuauaaacuguucuuuggaaaaauuaaguuauacauaaaauucauauuaaacuuu

SEQ ID NO: 272946 - RNA, 64 nt, hsa
cuuccuccucuauucucuaaauaaugauggggcuaaguuauacccaaagcucacuuuacaaaau

SEQ ID NO: 272947 - RNA, 64 nt, hsa
agguggccaauauggggauguggaauuuuuauacaaguuauaaguguuuggcauaguacuuuug

SEQ ID NO: 272948 - RNA, 64 nt, hsa
cacuucauucgcuuugaggcccugcuuuaaccuuaaguuauagcccuguccaccgaggaagguc

SEQ ID NO: 272949 - RNA, 64 nt, hsa
uuuuaagcaaauggaucauggcaccccaaaaugaaaguuauagaaagcugucuacaacugugga

SEQ ID NO: 272950 - RNA, 64 nt, hsa
acaaaugucuggggauaauuuaaauuugaaaccuaaguuauauauaguuuggcaaugcucuucu

SEQ ID NO: 272951 - RNA, 64 nt, hsa
aaaaauacuuucuuuuucuauuggaaaugguuacaaguuauacuccaaaagauauuugaauuau

SEQ ID NO: 272952 - RNA, 64 nt, hsa
ggauucuucaguuuugcuugcuuuagguuuccaaaaguuauacauugguguuuugauuggaaua

SEQ ID NO: 272953 - RNA, 64 nt, hsa
cuaggcuuuuuggacuaaggagcuuuccuuuuugaaguuauaugauaauguacaggucacagau

SEQ ID NO: 272954 - RNA, 64 nt, hsa
cucuucugccauugugcuggucccaucccaagaauuguaggacagagaccacacugggucggcg

SEQ ID NO: 272955 - RNA, 64 nt, hsa
auuuuuaaaaaaaaaaaucuuuuauuuuaauacauuguaggaaaucuucauaauuggagaaagu

SEQ ID NO: 272956 - RNA, 64 nt, hsa
auguccguccuaaugcuuuaaauauaugauuuaauuguaggaauugguuuacacagaacuuuuu

SEQ ID NO: 272957 - RNA, 64 nt, hsa
cagaaagcuuaacuaauguaagauuagcuauuauuuguaggacugaaauaauaauccagauaau

SEQ ID NO: 272958 - RNA, 64 nt, hsa
ggcuuuccucacuguucucucccuugaaucucauuuguaggaaucaagagauuccuauacaugg

SEQ ID NO: 272959 - RNA, 64 nt, hsa
auguaagguguuaauguguguguaugugcuuugguuguaggaaaacuugaaaauuccaaaaucc

SEQ ID NO: 272960 - RNA, 64 nt, hsa
uguauuaacaaacacugcaauuuauagauuacauuuguaggaaguuaugcuuuuuucugguuuu

SEQ ID NO: 272961 - RNA, 64 nt, hsa
uaaccaggcuuauggcaugaucucuggaacaaauuuguaggaaaaaauuacuccaauugaauga

SEQ ID NO: 272962 - RNA, 64 nt, hsa
caaaaaaacaaaaacaaaaaaacaaaaccagaaucagguaaaacagcuaugugauuaaaauauu

SEQ ID NO: 272963 - RNA, 64 nt, hsa
aagaucuuugcaccuuaauauuaauggacuguuucagguaaaagagaaugaauguaugauugug

SEQ ID NO: 272964 - RNA, 64 nt, hsa
aagaucacaucacugcacuucaaccugggugacagagcaagacccugucucaaaaacaaaaaac

SEQ ID NO: 272965 - RNA, 64 nt, hsa
gagaucgugccacugcacuccagccugagcaacagagcaagacucuaucucaaaaauaaaauaa

SEQ ID NO: 272966 - RNA, 64 nt, hsa
ugagagaguuuuccauaaagacauuuauauaugugagcaagauuuuuuuuaaacaauuacuuua

SEQ ID NO: 272967 - RNA, 64 nt, hsa
uguaacuacauuucagcucugcagaauugcugaagagcaagauauugaaaguuucaaugugguu

SEQ ID NO: 272968 - RNA, 64 nt, hsa
augauugcaccacugcacuccagccugggugauagagcaagaccccaacucaaaaaaaaaaaaa

SEQ ID NO: 272969 - RNA, 64 nt, hsa
gagaucgcgccacugcacuccagccugggcgacagagcaagacuccaucucaaaaaaaaaguua

SEQ ID NO: 272970 - RNA, 64 nt, hsa
agaucgugccacugcacuccagccuggguggacagagcaagacuccgucucaaagaaacaaaca

SEQ ID NO: 272971 - RNA, 64 nt, hsa
gagaucgugccacugcacuccagccugggugauagagcaagacugucucaaaaaagaaaaaaaa

SEQ ID NO: 272972 - RNA, 64 nt, hsa
accccccgccgccccccuggaaagcacaagugaugagcaagaaggcauuuuccuugggagagaa

SEQ ID NO: 272973 - RNA, 64 nt, hsa
gaauuccagcagccauccagguauaauggugagagagcaagagagaggcaugaacacacaguca

SEQ ID NO: 272974 - RNA, 64 nt, hsa
aggaucacaccauugcuguccagccugggugacagagcaagacugcguuucaaaaaaaaaaaaa

SEQ ID NO: 272975 - RNA, 64 nt, hsa
gaaauggcgccacuguacuccaaccugggcgacagagcaagacuccaucucauaaauuaaaagg

SEQ ID NO: 272976 - RNA, 64 nt, hsa
gagauccugccacugcacuccagucugggugacagagcaagacuccaucucaaaaaauaaauaa

SEQ ID NO: 272977 - RNA, 64 nt, hsa
cugcccaccuggggaucccccaaagucagacacagagcaagaguccccuuggguacaccccucu

SEQ ID NO: 272978 - RNA, 64 nt, hsa
cccuguccgucuucacccauccccaagccuacuagagcaagaaaccaguuguaauauaaaaugc

SEQ ID NO: 272979 - RNA, 64 nt, hsa
caaaccucagagggauaaggcaguugaaccugaugagcaagaauuauaacagcaaggaaacauu

SEQ ID NO: 272980 - RNA, 64 nt, hsa
gagaucacgccauuguacuccagccugggcgacagagcaagacuccauuucaaaaaaaaaaaaa

SEQ ID NO: 272981 - RNA, 64 nt, hsa
agcagguuuuuccucccuguugagcaagacaggugagcaagauaggacuuggcuuucuuacaug

SEQ ID NO: 272982 - RNA, 64 nt, hsa
agcagcugcagcaagcagguuuuuccucccuguugagcaagacaggugagcaagauaggacuug

SEQ ID NO: 272983 - RNA, 64 nt, hsa
gcgugugucaguggcugugugcaggagugugagugagcaagagcaagagcgcauggcuccugcu

SEQ ID NO: 272984 - RNA, 64 nt, hsa
gucaguggcugugugcaggagugugagugagcaagagcaagagcgcauggcuccugcuguaccu

SEQ ID NO: 272985 - RNA, 64 nt, hsa
cgggaaauaacagcacuuuagguguaguucaggugagcaagaugccagauaguuucuacuaacc

SEQ ID NO: 272986 - RNA, 64 nt, hsa
aagaucgugccacugcacuccagccuuggugacagagcaagacuccgucuccaaaaaaaagaaa

SEQ ID NO: 272987 - RNA, 64 nt, hsa
accccugcauccccauuuuuuacugagcucaggagagcaagaugaagguaacaaucaucuaaaa

SEQ ID NO: 272988 - RNA, 64 nt, hsa
gaagagguugcuggagcaagaggagaggaugcuggagcaagaggagaggcugcuggagcuugag

SEQ ID NO: 272989 - RNA, 64 nt, hsa
agucgccugaaccaagagcaggaagagguugcuggagcaagaggagaggaugcuggagcaagag

SEQ ID NO: 272990 - RNA, 64 nt, hsa
cgagagguuguuggagcaagaggagagguugcuggagcaagaggagagguugcuggagcugcag

SEQ ID NO: 272991 - RNA, 64 nt, hsa
gcugagauuguuggaacaagacgagagguuguuggagcaagaggagagguugcuggagcaagag

SEQ ID NO: 272992 - RNA, 64 nt, hsa
ggagagguugcuggagcaagaggagagguugcuggagcaagaggagaggcuacuggagcugcag

SEQ ID NO: 272993 - RNA, 64 nt, hsa
ggagaaguugcuggagcaagaggagagguugcuggagcaagaggagagguugcuggagcaagag

SEQ ID NO: 272994 - RNA, 64 nt, hsa
gcucagguuguuggagcaagaggagaaguugcuggagcaagaggagagguugcuggagcaagag

SEQ ID NO: 272995 - RNA, 64 nt, hsa
aaccaagagcaggaagagguugcucagguuguuggagcaagaggagaaguugcuggagcaagag

SEQ ID NO: 272996 - RNA, 64 nt, hsa
uuacuaaggccuucagugaacagaaaggagcagagagcaagauuagaucugagaagaugcucug

SEQ ID NO: 272997 - RNA, 64 nt, hsa
aguaaggggcuuuguugaaagaggggguuagagagagcaagacagcacuugagugcacuggcag

SEQ ID NO: 272998 - RNA, 64 nt, hsa
gagucgcuugaaugcaggagguggagguugcaaugagcaagauugugccacugcacuccagccu

SEQ ID NO: 272999 - RNA, 64 nt, hsa
aagauugugccacugcacuccagccugggcaacagagcaagacucugucucaaaaaaaaaaaag

SEQ ID NO: 273000 - RNA, 64 nt, hsa
aagauuguaccacuguauuccagcccgggugacagagcaagacugugucucaaaaaaaaaaaaa

SEQ ID NO: 273001 - RNA, 64 nt, hsa
aagauggcaccauugcacccuagccugggcaacagagcaagacaccgucuuaaaaccaaaaguu

SEQ ID NO: 273002 - RNA, 64 nt, hsa; identical to SEQ ID NO: 247878

SEQ ID NO: 273003 - RNA, 64 nt, hsa; identical to SEQ ID NO: 247879

SEQ ID NO: 273004 - RNA, 64 nt, hsa; identical to SEQ ID NO: 247880

SEQ ID NO: 273005 - RNA, 64 nt, hsa; identical to SEQ ID NO: 247881

SEQ ID NO: 273006 - RNA, 64 nt, hsa
caggaaaaacuaaugauauggaucaucacccagauucucucacuugguaccagcauuucuguag

SEQ ID NO: 273007 - RNA, 64 nt, hsa
auauuuucagauauuucauaauuucuaaccucuguucucucaguaaacagaaugucugaucgau

SEQ ID NO: 273008 - RNA, 64 nt, hsa
guugaaaauguuucuaguuuuuuuucuuucauuuuucucucauuccauuucugccuuaacuuua

SEQ ID NO: 273009 - RNA, 64 nt, hsa
gcuuccugccaggacguggccucuuccgauccuuuucucucagacacuggaggucucuucugcc

SEQ ID NO: 273010 - RNA, 64 nt, hsa
ugauuaucuguacuguggguuuaaguaugcuacuuucucucagcauccaauaaucauggccccu

SEQ ID NO: 273011 - RNA, 64 nt, hsa
caaaugccaccgcugcccuguggguagcaucuguuucucucagcuuugccuucuugcuuuuuca

SEQ ID NO: 273012 - RNA, 64 nt, hsa
cuaaugaagugccagagugaguguacacuuucuuuucucucaucucucauaaaucucuucuguc

SEQ ID NO: 273013 - RNA, 64 nt, hsa
cugacuuuccuguacccucuguuuaaacuuuccguucucucaaccugaagauugagaccuuggu

SEQ ID NO: 273014 - RNA, 64 nt, hsa
ucaaucaguauguauucuuuugugccuggcuucuuucucucagccuuacauuugugagauuccu

SEQ ID NO: 273015 - RNA, 64 nt, hsa
cuuggguauuugcaauauuccuuugggccucugcuucucucaccuaaaaaaagagaauuagauu

SEQ ID NO: 273016 - RNA, 64 nt, hsa
gauguacuuguuuuagguacaucuacuauacuuauucucucaaaccuggguaauaguuucucag

SEQ ID NO: 273017 - RNA, 64 nt, hsa
gugcaugugugcauuaaaaacauuucacuaccuauucucucauggacuucucauccuuucuuuu

SEQ ID NO: 273018 - RNA, 64 nt, hsa
cgaguguuaagugucaaggugagaaagccucacauucucucaagacaguugcucuaggagcuga

SEQ ID NO: 273019 - RNA, 64 nt, hsa
gcugguuuggaaguguggagauugcauuucuggcuucucucaauggcuuguguugaggacucug

SEQ ID NO: 273020 - RNA, 64 nt, hsa
agucuucaguuuucucucauaguggauuuucauuuucucucagauggugagagggcuucuguuu

SEQ ID NO: 273021 - RNA, 64 nt, hsa
cauuuuacuuaaaucuguauuaaagucuucaguuuucucucauaguggauuuucauuuucucuc

SEQ ID NO: 273022 - RNA, 64 nt, hsa
uagcuagugccucuugcccucuccucaccuccuuuucucucagugacucuggaaccugaaugca

SEQ ID NO: 273023 - RNA, 64 nt, hsa
ccauuuuuucaaagucuguuuaauugccuauuacuucucucaaagagaaccugaagucagaaca

SEQ ID NO: 273024 - RNA, 64 nt, hsa
gcucaugcguucucauucuuccuuuucucacucuuucucucaucacucaccucuguauucauuc

SEQ ID NO: 273025 - RNA, 64 nt, hsa
aaugaaagaaaaauggcgcccucucaauuuagucuucucucauuggccauguuucagauuuuga

SEQ ID NO: 273026 - RNA, 64 nt, hsa
agaagcauaaaacugacuucugguuguucugcaguucucucauccuuaugaaucuguuguguug

SEQ ID NO: 273027 - RNA, 64 nt, hsa
acuguauguaugauuuuggcuaaaggauuugacuuucucucaacugcaguuuucuuaaucuuug

SEQ ID NO: 273028 - RNA, 64 nt, hsa
augauaaguuacaauuguaagugaugcuuguagauucucucacaggcuguuuucuguaguaugc

SEQ ID NO: 273029 - RNA, 64 nt, hsa
gcugcagcggggagugguggugcuggccaagagcuucucucaggagagaaucaaagagaacuuc

SEQ ID NO: 273030 - RNA, 64 nt, hsa
uccacgccauuuccuuuuccuucaagccuagcccuucucucauuauuucucucugacccucucc

SEQ ID NO: 273031 - RNA, 64 nt, hsa
agggaaaucaggguuacaaaucuucuugauccacuucucucaggauccccucucuuccuacccu

SEQ ID NO: 273032 - RNA, 64 nt, hsa
uuuauuaaugcacacagucauugccaugguaucuuucucucagaccccuuuuguuguagugcuu

SEQ ID NO: 273033 - RNA, 64 nt, hsa
guuuuaccagucaaagguccucaggguucuccucuucucucacgggcggcucgcccgccucugg

SEQ ID NO: 273034 - RNA, 64 nt, hsa
aauccaaauauuuuaaaaaucugucucucuuuucuucucucauaaagugaauuauuccuuuuuu

SEQ ID NO: 273035 - RNA, 64 nt, hsa
uuuuuaaagcagaagaugcuauuuguggggguuuuucucucauuauuuggauggaaucucuuug

SEQ ID NO: 273036 - RNA, 64 nt, hsa
gcacaccuucgcuucucucaccaggaacauucgcuucucucaccaggaacauuuaugguaguau

SEQ ID NO: 273037 - RNA, 64 nt, hsa
ccugguggcugagccaggagaugcacaccuucgcuucucucaccaggaacauucgcuucucuca

SEQ ID NO: 273038 - RNA, 64 nt, hsa
auuuguuuagauccuuuuguauuuucagaucuccuuggagcaguagaguaccugguagaccaua

SEQ ID NO: 273039 - RNA, 64 nt, hsa
cagcuagagggagauaaagagggcuaguuaguucuuggagcagcugcuuuugaggagaaaauau

SEQ ID NO: 273040 - RNA, 64 nt, hsa
gaaaaacaauggaacaaggguggguuugcacagauuggagcacauuccugcacaaacuaccaag

SEQ ID NO: 273041 - RNA, 64 nt, hsa
uguaccucauugcuuuagcuggucacuuggaacuuuggagcagaauccugcacauuaaaggaug

SEQ ID NO: 273042 - RNA, 64 nt, hsa
agguauagaggugucauaggcauuaguguaguaauuggagcacuaacucucgagccaacugccu

SEQ ID NO: 273043 - RNA, 64 nt, hsa
uugguccugacggguuugacccgugccuggacccuuggagcaguguugugugaacuugccuaga

SEQ ID NO: 273044 - RNA, 64 nt, hsa
uucaucacaugaguucaggcauggaaauuuucauuuggagcaucaugucagcacucaaaaaguu

SEQ ID NO: 273045 - RNA, 64 nt, hsa
gagcaucaugucagcacucaaaaaguucuggaucuuggagcaguucagauuuucagauuaggga

SEQ ID NO: 273046 - RNA, 64 nt, hsa
cagacucacugaugcagcacuguagcccaucaccuuggagcacugacuguacauagugugguga

SEQ ID NO: 273047 - RNA, 58 nt, hsa
gacagcgaacacucgccugaacuuccuuuuggagcaccgcauggucuugccagcuacc

SEQ ID NO: 273048 - RNA, 64 nt, hsa
guugcugagauuguuggaacaagacgagagguuguuggagcaagaggagagguugcuggagcaa

SEQ ID NO: 273049 - RNA, 64 nt, hsa
cugaaccaagagcaggaagagguugcucagguuguuggagcaagaggagaaguugcuggagcaa

SEQ ID NO: 273050 - RNA, 64 nt, hsa
gggcacgagucccucucccuuggguuccauuuucuuggagcagccuauuaguucuggugggguu

SEQ ID NO: 273051 - RNA, 64 nt, hsa
uaugauuagaauucuguuugggggucuaguugucuuggagcaaguauguacuuaacuagccgag

SEQ ID NO: 273052 - RNA, 64 nt, hsa
ccagaaugauggccgguugccagauauaacugcuuuggagcaaaucucuucuguuuagagagau

SEQ ID NO: 273053 - RNA, 64 nt, hsa
uuuugucuuguuggugcucaaaaaguuuuggauuuuggagcauuucggauuuuggauuuuugga

SEQ ID NO: 273054 - RNA, 64 nt, hsa
cgagaucaggccccaccugccagcucuacugggcuuggagcacguccgggcaguggagggaggg

SEQ ID NO: 273055 - RNA, 64 nt, hsa
gagggacacagccugggacaggaagccucuuggguuggagcaggagacccucauuugccaccca

SEQ ID NO: 273056 - RNA, 64 nt, hsa; identical to SEQ ID NO: 195697

SEQ ID NO: 273057 - RNA, 64 nt, hsa; identical to SEQ ID NO: 195698

SEQ ID NO: 273058 - RNA, 64 nt, hsa; identical to SEQ ID NO: 195699

SEQ ID NO: 273059 - RNA, 64 nt, hsa; identical to SEQ ID NO: 195700

SEQ ID NO: 273060 - RNA, 64 nt, hsa; identical to SEQ ID NO: 195701

SEQ ID NO: 273061 - RNA, 64 nt, hsa; identical to SEQ ID NO: 195702

SEQ ID NO: 273062 - RNA, 64 nt, hsa; identical to SEQ ID NO: 195703

SEQ ID NO: 273063 - RNA, 64 nt, hsa; identical to SEQ ID NO: 195704

SEQ ID NO: 273064 - RNA, 64 nt, hsa; identical to SEQ ID NO: 195705

SEQ ID NO: 273065 - RNA, 64 nt, hsa; identical to SEQ ID NO: 195706

SEQ ID NO: 273066 - RNA, 64 nt, hsa; identical to SEQ ID NO: 195707

SEQ ID NO: 273067 - RNA, 64 nt, hsa; identical to SEQ ID NO: 195708

SEQ ID NO: 273068 - RNA, 64 nt, hsa; identical to SEQ ID NO: 195709

SEQ ID NO: 273069 - RNA, 64 nt, hsa; identical to SEQ ID NO: 195710

SEQ ID NO: 273070 - RNA, 64 nt, hsa
ucaaauuaguggaacuuaguucagggacauagaagagucuuaaugaauuaaaaucauucacuug

SEQ ID NO: 273071 - RNA, 64 nt, hsa
cuuccucugguuuucaaguaaacucaacaagguggagucuuaccugguuuuccuuuccaagcau

SEQ ID NO: 273072 - RNA, 64 nt, hsa
ccugccccuuagagucuaggugcagcagcuccaagcaugggaccaaggaggccagaaccugucg

SEQ ID NO: 273073 - RNA, 64 nt, hsa
cuccagaggaauuugucuucucugccuucacucagcaugggaaccaguguucauccugaccuug

SEQ ID NO: 273074 - RNA, 64 nt, hsa
ggcauuuaagccuaaagacacucaccccugcagugcaugggacagccuggcacaaugaagaauu

SEQ ID NO: 273075 - RNA, 64 nt, hsa
cugacaguugccuuuuuuuucaucucaaauggcagcaugggacugaaacaugagaaugccaccu

SEQ ID NO: 273076 - RNA, 64 nt, hsa
agcugaccccuuuccucacagggaccaagacaaagcaugggacaugaaauuaagagugaacuuc

SEQ ID NO: 273077 - RNA, 64 nt, hsa
ccacugcuguugaaaugagugcccuuggggccuugcaugggacacauucaagaccucgaaguca

SEQ ID NO: 273078 - RNA, 64 nt, hsa
ccucaaacaccgucagaugcauuagcagcccacugcaugggacaaucgcaggcagauacgagga

SEQ ID NO: 273079 - RNA, 64 nt, hsa
auagcaguuuugcucaugacuuaccauuccagcugcaugggaaagcaaagcagaaaacagugcc

SEQ ID NO: 273080 - RNA, 64 nt, hsa
ucgcuggacugugaagucaacaauaauggcaguaacagggcaguucauuccaaauccagcacug

SEQ ID NO: 273081 - RNA, 64 nt, hsa
ccacaaauaagcuuucuuguaagcucucuuccuaacagggcacauauucuuccauaauauaaac

SEQ ID NO: 273082 - RNA, 64 nt, hsa
ccccacucagccuggccuggacaccgccaugagcacagggcagggcuggggcagagaaaggaag

SEQ ID NO: 273083 - RNA, 64 nt, hsa
gggcuaggaaaaaccauuuccagccuuagccuaaacagggcacauagaucucucccacuagagc

SEQ ID NO: 273084 - RNA, 64 nt, hsa
ucucaagagggcacugguggcccgacagccuggcacagggcagugggacagggcauggccaggu

SEQ ID NO: 273085 - RNA, 64 nt, hsa
cugguggcccgacagccuggcacagggcagugggacagggcauggccagguggccacuccagac

SEQ ID NO: 273086 - RNA, 64 nt, hsa
agugaagguacuuuggaaccacuaacaccucugcacagggcaguuagccagcucaaguucuuuu

SEQ ID NO: 273087 - RNA, 64 nt, hsa
gccuacccaugggcccaaguuucuguggcucauuacagggcaucugaccccugccacccagcau

SEQ ID NO: 273088 - RNA, 64 nt, hsa
ggacuggcacacuggccuccagaagggcagcuccacagggcagggccucauuauuuuucacugc

SEQ ID NO: 273089 - RNA, 64 nt, hsa
gccccagccuccuccuucccuccccuccccguccacagggcagccugagcgugcuuuccaaaac

SEQ ID NO: 273090 - RNA, 64 nt, hsa; identical to SEQ ID NO: 99247

SEQ ID NO: 273091 - RNA, 64 nt, hsa; identical to SEQ ID NO: 99248

SEQ ID NO: 273092 - RNA, 64 nt, hsa; identical to SEQ ID NO: 99249

SEQ ID NO: 273093 - RNA, 64 nt, hsa; identical to SEQ ID NO: 99250

SEQ ID NO: 273094 - RNA, 64 nt, hsa; identical to SEQ ID NO: 99251

SEQ ID NO: 273095 - RNA, 64 nt, hsa; identical to SEQ ID NO: 99252

SEQ ID NO: 273096 - RNA, 64 nt, hsa; identical to SEQ ID NO: 99253

SEQ ID NO: 273097 - RNA, 64 nt, hsa; identical to SEQ ID NO: 99254

SEQ ID NO: 273098 - RNA, 64 nt, hsa; identical to SEQ ID NO: 99255

SEQ ID NO: 273099 - RNA, 64 nt, hsa; identical to SEQ ID NO: 99256

SEQ ID NO: 273100 - RNA, 64 nt, hsa; identical to SEQ ID NO: 99257

SEQ ID NO: 273101 - RNA, 64 nt, hsa; identical to SEQ ID NO: 99258

SEQ ID NO: 273102 - RNA, 64 nt, hsa; identical to SEQ ID NO: 99259

SEQ ID NO: 273103 - RNA, 64 nt, hsa; identical to SEQ ID NO: 99260

SEQ ID NO: 273104 - RNA, 64 nt, hsa; identical to SEQ ID NO: 99261

SEQ ID NO: 273105 - RNA, 64 nt, hsa; identical to SEQ ID NO: 99262

SEQ ID NO: 273106 - RNA, 64 nt, hsa; identical to SEQ ID NO: 99263

SEQ ID NO: 273107 - RNA, 64 nt, hsa; identical to SEQ ID NO: 99264

SEQ ID NO: 273108 - RNA, 64 nt, hsa; identical to SEQ ID NO: 99265

SEQ ID NO: 273109 - RNA, 64 nt, hsa; identical to SEQ ID NO: 99266

SEQ ID NO: 273110 - RNA, 64 nt, hsa; identical to SEQ ID NO: 99267

SEQ ID NO: 273111 - RNA, 64 nt, hsa; identical to SEQ ID NO: 99268

SEQ ID NO: 273112 - RNA, 64 nt, hsa; identical to SEQ ID NO: 99269

SEQ ID NO: 273113 - RNA, 64 nt, hsa; identical to SEQ ID NO: 99270

SEQ ID NO: 273114 - RNA, 64 nt, hsa; identical to SEQ ID NO: 99271

SEQ ID NO: 273115 - RNA, 62 nt, hsa
uuuaauguguuuauucaaauguggucucuucugugucaaauguuaaaugaaauauaaacauu

SEQ ID NO: 273116 - RNA, 62 nt, hsa
guauaucagauggucagaacaaauaaaguucagugucaaaugacuuuuggcucuauauguau

SEQ ID NO: 273117 - RNA, 62 nt, hsa
uuguaaaaaugaaacucaaaaauaaaauaaaugugucaaauuuugaaaaaaaaagaaaacug

SEQ ID NO: 273118 - RNA, 62 nt, hsa
guauacuguaauugauuacaugggcugggggggugucaaagaacuugacagguuguguugau

SEQ ID NO: 273119 - RNA, 62 nt, hsa
gcagggggccccgccagggcuggggacagagggugucaaacauucgugagcuggggacucag

SEQ ID NO: 273120 - RNA, 62 nt, hsa
uugguuaaacugauggcagcaauccaugaggugugucaaagaguguacauauguaugugugu

SEQ ID NO: 273121 - RNA, 62 nt, hsa
cccaagaaacaacaugaaugagcaacuucagagugucaaacaacugccauuaaacuuaacuc

SEQ ID NO: 273122 - RNA, 62 nt, hsa
aacuauuguuuuauccugucuuugggggcaaugugucaaaaguccccucaggaauuuucaga

SEQ ID NO: 273123 - RNA, 62 nt, hsa
cuauuuuguaugcaacuagucacugcugaggggugucaaaguuucuauuuuuauuuguucug

SEQ ID NO: 273124 - RNA, 60 nt, hsa
gucaauauucuuuauuaauaaaauguuuuucagugucaaaauuuauuauucauuucuuca

SEQ ID NO: 273125 - RNA, 62 nt, hsa
guacacuaauaauuuucuaucaaccuuaaaaagugucaaagcaucuuuguagggugacucua

SEQ ID NO: 273126 - RNA, 62 nt, hsa
accaacuccuagacaaaguuugccaaccauaagugucaaaagcacaggccaguauuaagcag

SEQ ID NO: 273127 - RNA, 62 nt, hsa
gccugccgauaugccuacagaaucaucuguaagugucaaaaugaacccacguuguuagccau

SEQ ID NO: 273128 - RNA, 62 nt, hsa
uaugaacccgaagccauuuagaaaaucccugugugucaaaauuacauucaaaaagcucuccu

SEQ ID NO: 273129 - RNA, 62 nt, hsa
aacuacaaaaugucaaacuaacugcaagacaagugucaaaaugggauguuuaagcaguuuug

SEQ ID NO: 273130 - RNA, 62 nt, hsa
ugcucaagacccuggagcuguacuuggccagggugucaaagggacaggccuccuuguuggga

SEQ ID NO: 273131 - RNA, 62 nt, hsa
ucaucaaaaguguacggcuuccugugcugcuugugucaaauggaaccugcccucuaaagcac

SEQ ID NO: 273132 - RNA, 62 nt, hsa
uaccuugagucagccaggagcccucuuuuccugugucaaagccugcccucgggcucugcuca

SEQ ID NO: 273133 - RNA, 62 nt, hsa
guuugucagguuugaagccccuaugauggugugugucaaaucaguuguagcuaaucugucca

SEQ ID NO: 273134 - RNA, 62 nt, hsa
uuuaaauuuaguuuaaaaauuuuuuaacuuuugugucaaauaggaguugaggaauugagcag

SEQ ID NO: 273135 - RNA, 62 nt, hsa
aauuguacuuguggagcuucacucaaaccaaugugucaaauaacguauugaauauuuaugaa

SEQ ID NO: 273136 - RNA, 62 nt, hsa
cauaauaauugcauuuucuuagaacuauuuuggugucaaaugcuauuuuuuauauuacauua

SEQ ID NO: 273137 - RNA, 62 nt, hsa
uaauagcacagcaguuuggagaagaaaugaaggugucaaagaguccauucaccugagaaaug

SEQ ID NO: 273138 - RNA, 62 nt, hsa
aacuuuaucauacaggaaacuuaaaacaagaggugucaaaagacccaaauuaggugcauuuu

SEQ ID NO: 273139 - RNA, 62 nt, hsa
aggcuguaccuccuugacuaagcugguuccuugugucaaagcaccucaugccuuccauuaaa

SEQ ID NO: 273140 - RNA, 62 nt, hsa
uuacaaaguuauauucacaguuuuuuaaaaaugugucaaaauaaaggauaacucuguauuac

SEQ ID NO: 273141 - RNA, 62 nt, hsa
aauuuguauggaggguacgaucuaaguuaagugugucaaaagcaaggcuuaggauuuguuau

SEQ ID NO: 273142 - RNA, 62 nt, hsa
auguucuuugaaagaaagaaaaaucucuugcugugucaaaccucaaaauguugcuauugggg

SEQ ID NO: 273143 - RNA, 62 nt, hsa
caagaauucguauaguacgagccuggaucugcgugucaaacuguuccauuuguuuauguaaa

SEQ ID NO: 273144 - RNA, 62 nt, hsa
auuuagaauuuuuaacuaaugucaaaacuacagugucaaacauucuagguuguaguuacuuu

SEQ ID NO: 273145 - RNA, 62 nt, hsa
cucuccugggcuuccauauuuugggggcuggggugucaaaagugagaugaaguucuuagcuc

SEQ ID NO: 273146 - RNA, 62 nt, hsa
auauacugagauccacaucuagugaaaugucagugucaaaauauuauagauuauagcuaaaa

SEQ ID NO: 273147 - RNA, 62 nt, hsa
ggaacaaaaaaagggaucucagggagaggccagugucaaacuugaccucccuuguuuggccu

SEQ ID NO: 273148 - RNA, 62 nt, hsa
uugugauuuugggaguggaagcuuccauuuuugugucaaaaaugaauccugauucuuaugga

SEQ ID NO: 273149 - RNA, 62 nt, hsa
uuuaucagugaaguagugauuaacaauggggagugucaaaacuauugaacuuuuguauaaaa

SEQ ID NO: 273150 - RNA, 62 nt, hsa
gugcauuuuacuauugauauauauguuaaauugugucaaauauauaugucaaauucccucca

SEQ ID NO: 273151 - RNA, 62 nt, hsa
uuuguuccucucucaucccauacuuuuagccugugucaaauguaagucccaaguauuuccag

SEQ ID NO: 273152 - RNA, 62 nt, hsa
gugauccucaagcaauauuuuugauacagcaagugucaaacuugcuauagcauaaaagccgg

SEQ ID NO: 273153 - RNA, 62 nt, hsa
uggauuaccaauuuaaaaauauauguaguucugugucaaaaaacuucuucacugaaguuaua

SEQ ID NO: 273154 - RNA, 62 nt, hsa
auaauagauuuuaaaaaagcaaaugaggcaaugugucaaaauuuaauguuucauaauaaaaa

SEQ ID NO: 273155 - RNA, 62 nt, hsa
guaucaaaaauaucuuugcuuacuaucaagaagugucaaauagguucagcuugcugccaaaa

SEQ ID NO: 273156 - RNA, 62 nt, hsa
aaugcgggagguucaaugugaagcuguguguggugucaaaguuucaggaaggauuuuacccu

SEQ ID NO: 273157 - RNA, 62 nt, hsa
acuggugacaacuggcuggauguggagaauaagugucaaaaccuggcuucaaugucuauuuc

SEQ ID NO: 273158 - RNA, 62 nt, hsa
uaaauuggcagauuuaccucucauguuuuaaugugucaaauuagagagcaaaguauaacagg

SEQ ID NO: 273159 - RNA, 62 nt, hsa
aguguuguauaugacccacauuuaccuaguuugugucaaauuauaguuacagugaguuguuu

SEQ ID NO: 273160 - RNA, 62 nt, hsa
gaaggcauaaguuggucuuagguuguauacaggugucaaacuccacuugacauuuacuguau

SEQ ID NO: 273161 - RNA, 62 nt, hsa
uuaucaauagccaacuuuggguauuuuuuuaagugucaaauaucaucaugguuugaaaaaag

SEQ ID NO: 273162 - RNA, 62 nt, hsa
acaauucagucuucucuuugggguuuuaguaugugucaaacauaggacuggaaguuugcccc

SEQ ID NO: 273163 - RNA, 62 nt, hsa
auaacgucuuugaugcuuuuagaauaagaacagugucaaaucaucugucuucuggaaaauca

SEQ ID NO: 273164 - RNA, 62 nt, hsa
cccuggggcucagauagaggugcugagccccugugucaaaguuguuaaauguuuuuguuuug

SEQ ID NO: 273165 - RNA, 62 nt, hsa
aggagugucaccaucagaggcuucucuucauugugucaaagaagccccuagcugcucucgug

SEQ ID NO: 273166 - RNA, 62 nt, hsa
gauguauuugcagagaagacgaaggcagaguggugucaaaucuuugacggcacagaugccug

SEQ ID NO: 273167 - RNA, 62 nt, hsa
aaagucaguacaugaaaggcaauugggcaaaagugucaaaguacugauaguuuuugagcugg

SEQ ID NO: 273168 - RNA, 62 nt, hsa
uaauguggaacaguccauauuagcuccagagagugucaaacccagagaaaugugugcaaaaa

SEQ ID NO: 273169 - RNA, 62 nt, hsa
caacuaaaauauucguggugucaguuuaauuagugucaaacuggcaagucagaguuuuacaa

SEQ ID NO: 273170 - RNA, 62 nt, hsa
cauaacugugguguuacucugucauuuauauggugucaaaagcacuugaugaguaaacccag

SEQ ID NO: 273171 - RNA, 62 nt, hsa
aggcaucacugccucagcuguuaaggagaccugugucaaaacuuacauccacauuccuacac

SEQ ID NO: 273172 - RNA, 62 nt, hsa
ugcgaagcauggaccccaguguuguugugggugugucaaauccccuuucauccucaagagcu

SEQ ID NO: 273173 - RNA, 62 nt, hsa
uuuggggcuuuuuuucaggguccugaaacuuugugucaaacagacaaugcaggggcagggug

SEQ ID NO: 273174 - RNA, 62 nt, hsa
uguuagauugaggaugggggcaugacacuccagugucaaaauaagucuuaguagauuuccuu

SEQ ID NO: 273175 - RNA, 62 nt, hsa
uuucuuuccagugcccaguaugcuguuuugaggugucaaauacaaauaaaucugggcuuagg

SEQ ID NO: 273176 - RNA, 62 nt, hsa
uuauuauauuucacuuauagaccugauuuucugugucaaaguauaauucucaugcugaagcu

SEQ ID NO: 273177 - RNA, 62 nt, hsa
cagcagaccucggaguacugcuaaguguaccugugucaaauccgcacaggacucaauauagc

SEQ ID NO: 273178 - RNA, 62 nt, hsa
uugacuucugcacuaauccagugaaggaggcugugucaaaagaagggcucagaagcccucuu

SEQ ID NO: 273179 - RNA, 62 nt, hsa
ugaaaugugucggcaguuuuuuuucuuuuaaugugucaaaucuugaaauauuaaauguauac

SEQ ID NO: 273180 - RNA, 62 nt, hsa
aaauggauuuacuuugcuaagauuuauggcaagugucaaaaauaguaucugaagauacugaa

SEQ ID NO: 273181 - RNA, 62 nt, hsa
aagagugccaggaaagcagaugcuuagauuuugugucaaagcuuguuauuuuuuucauacua

SEQ ID NO: 273182 - RNA, 62 nt, hsa
ccugaugcaggccccaggcccuccuuucuugggugucaaaugacuguguccuggacaucuga

SEQ ID NO: 273183 - RNA, 62 nt, hsa
ccugugugcuccucuuuuggauuuacagaaaugugucaaauguaaaucuuucaaagccauuu

SEQ ID NO: 273184 - RNA, 62 nt, hsa
gugaacuuuauaaaagacacuugcaauauacugugucaaaaugauaauuuuguuauguuagc

SEQ ID NO: 273185 - RNA, 62 nt, hsa
uuuguguucaauauauaggcagaaaaaaauuugugucaaaauguugaauggaauaauaauga

SEQ ID NO: 273186 - RNA, 62 nt, hsa
gaauuccaaacuacagaaaauguuuguuuuuagugucaaauuuuuagcuguauuuguagcaa

SEQ ID NO: 273187 - RNA, 62 nt, hsa
ggguggggugguaugccccaggacccuuguuugugucaaaaaugacuuucccugcccuugcc

SEQ ID NO: 273188 - RNA, 62 nt, hsa
uuacaaacguguuucuguacacccuuucuaucgugucaaauguuaaugaaucugugaucaau

SEQ ID NO: 273189 - RNA, 60 nt, hsa
auaagugcuugaaauaaaaugcuaauacuuaagugucaaaacuauggcuuaaggcucuug

SEQ ID NO: 273190 - RNA, 62 nt, hsa
gcuccccauaagacguccucuuugggugcacggugucaaagugugggcaggaguggagagcu

SEQ ID NO: 273191 - RNA, 62 nt, hsa
uuaugauaauuugccauugcuauacuguaccagugucaaaugcugcagccugccaagcugug

SEQ ID NO: 273192 - RNA, 62 nt, hsa
cuuuuagggaauauuuuauuuuuuaguuauuugugucaaauuauaauuauaaaagguacagc

SEQ ID NO: 273193 - RNA, 62 nt, hsa
cugucuuugcccccaaagguauuuugugucuagugucaaauuggagcuauucuucacugguc

SEQ ID NO: 273194 - RNA, 62 nt, hsa
agagacgaggucccaccauguugcccaggcuggugucaaacuccugggcucagucagucccc

SEQ ID NO: 273195 - RNA, 62 nt, hsa
aaaaaaaaaaguucaagucauguuauacaggugugucaaaagguaucuuggucauuaaguau

SEQ ID NO: 273196 - RNA, 62 nt, hsa
acauccccacucucuaggggauuagcuugugcgugucaaaagaaggaacagcucguucugcu

SEQ ID NO: 273197 - RNA, 62 nt, hsa
ugaugucaucaagguaaccaucucauauacuagugucaaaagguuuauguaaacuugaauuu

SEQ ID NO: 273198 - RNA, 62 nt, hsa
uugugacuugaaugucaggauucaagggcucagugucaaagauaauuggcuuugacuuuuug

SEQ ID NO: 273199 - RNA, 62 nt, hsa
uuucuaaauuccuccauugugagauaaggacagugucaaagugauaaagcuuaacacuugac

SEQ ID NO: 273200 - RNA, 62 nt, hsa
ugaaaauaccuguguacugaggguuaugauuugugucaaaaauugacauaagugcuuuuaca

SEQ ID NO: 273201 - RNA, 62 nt, hsa
cugguaccugggcuagcuugguuccuuuccaagugucaaauaggacacccaucuuaccggcc

SEQ ID NO: 273202 - RNA, 62 nt, hsa
cacuaugaauggguuguuaaaggcaaugguuugugucaaaacugguuuaggauuacuuagau

SEQ ID NO: 273203 - RNA, 62 nt, hsa
cauauccuggguguacugagccacauaauaaggugucaaaaugugcuugagauuccaaaaac

SEQ ID NO: 273204 - RNA, 62 nt, hsa
gguccuuggaggaggggcuaggacagccgugggugucaaagguggcauuugaggcucguuug

SEQ ID NO: 273205 - RNA, 62 nt, hsa
guuguguagcugugucauguauauaccuuuuugugucaaaaggacauuuaaaauucaauuag

SEQ ID NO: 273206 - RNA, 62 nt, hsa
auuugacaaaagugaauacaauaauaacacuugugucaaaaugauauagcuuaguauaaaaa

SEQ ID NO: 273207 - RNA, 62 nt, hsa
cucccaaggugauuuucuuuuucuaagugacugugucaaauguugcaguagaugggcagcuu

SEQ ID NO: 273208 - RNA, 62 nt, hsa
gagauuucauuuuacaacacaaaaauaagccugugucaaagauuuuaaaaucauggaaaguu

SEQ ID NO: 273209 - RNA, 62 nt, hsa
gcuuucacauagcacaggcauuacccguagucgugucaaauagcaguuggugucuucauuuu

SEQ ID NO: 273210 - RNA, 62 nt, hsa
uuaaaacuaacuauauaaggauggucccagcugugucaaaaggaagcuuguuuguaauacgu

SEQ ID NO: 273211 - RNA, 62 nt, hsa
uuuuuuaaauaaucuuuugaaacuaagaaaaugugucaaauugugugcauucauucuguagg

SEQ ID NO: 273212 - RNA, 62 nt, hsa
uauguauucauucacuuucaagauuuguuuuggugucaaaauaacaugaaaagguagaugga

SEQ ID NO: 273213 - RNA, 62 nt, hsa
gccuccccgagcauuagguccuccacggggcugugucaaaugcccucccacauugugucaag

SEQ ID NO: 273214 - RNA, 62 nt, hsa
ggcugucuauucuagucuauuuguugaugcuugugucaaacaguacacuaucuuaauuauug

SEQ ID NO: 273215 - RNA, 62 nt, hsa
uuaaaaaaaaaaucuaaaaauaguuaagcacugugucaaagaguguuucaaaagaauuguuu

SEQ ID NO: 273216 - RNA, 62 nt, hsa
aauaauauauaguaaaacuaagauuuaagguugugucaaaaagguacagugauucagccauu

SEQ ID NO: 273217 - RNA, 62 nt, hsa
gagaaacagguuaauggacuuuguguuuaagagugucaaacagucugagagaauaaaugggg

SEQ ID NO: 273218 - RNA, 62 nt, hsa
gcuucuugacuuuaacaucagcauuauaaaaagugucaaauaaaaaauuaccaucauuauca

SEQ ID NO: 273219 - RNA, 62 nt, hsa
aacuuaaguguuggaggaggcaggggcugaaggugucaaaaccuccucaguaggauaacccc

SEQ ID NO: 273220 - RNA, 62 nt, hsa
cugguugggagacaggauuccuagcaccuccggugucaaaaggcugucaugggguugugcca

SEQ ID NO: 273221 - RNA, 62 nt, hsa
ucuuucuggacuguuuguauugaaacaaaguggugucaaaauaaagccccugcagggccugg

SEQ ID NO: 273222 - RNA, 62 nt, hsa
uuuggcagugugcuauaauaaaaaaaaguguugugucaaagcuuucuagugacggucagucc

SEQ ID NO: 273223 - RNA, 62 nt, hsa
guuuauauaaauaaauguuucuagucuuccgugugucaaaauccucaccuccuucauaacca

SEQ ID NO: 273224 - RNA, 62 nt, hsa
cucaugaccauuagaauagucauaccuggaaugugucaaauuauaagagacagacacuuggu

SEQ ID NO: 273225 - RNA, 62 nt, hsa
ugauauagcaucaaaaauuauucaguucucuagugucaaaguuuagccguuuguuuuuuuuu

SEQ ID NO: 273226 - RNA, 62 nt, hsa
uuuuagcauguuuuuaaauaaaaacggauaaagugucaaaagcacagcaggcugucucucag

SEQ ID NO: 273227 - RNA, 62 nt, hsa
uucuucaaaaaaguaauauccucacuuggagagugucaaauacauacuuugaggauugacuu

SEQ ID NO: 273228 - RNA, 62 nt, hsa
guuuuguuuacuuucugucaagauauuuacccgugucaaauucaaacuacaguacuguguaa

SEQ ID NO: 273229 - RNA, 62 nt, hsa
uuacuucaugacugccacgcauuuacagauuggugucaaagacauucacuauguuuuuaugg

SEQ ID NO: 273230 - RNA, 62 nt, hsa
uugaaauaagauccuggaaacgaauuuaaauggugucaaacugcagagcaacagggcuucag

SEQ ID NO: 273231 - RNA, 62 nt, hsa
auagaaaaguguauuuauuugugugugugugugugucaaaaauguaacugcuuuauaauauu

SEQ ID NO: 273232 - RNA, 62 nt, hsa
aaggauucugggagaugguccaaggguguucugugucaaaagauggccuauuggcccucagu

SEQ ID NO: 273233 - RNA, 62 nt, hsa
acuguguguguccuacacaauggugcuauucugugucaaacaccucuguauuuuuuaaaaca

SEQ ID NO: 273234 - RNA, 62 nt, hsa
agcugggcugcuuucuuuguguguggccccaggugucaaaaugacaccagcugucuguacua

SEQ ID NO: 273235 - RNA, 62 nt, hsa
uuaaauggccuuaauuuuuuuuuaaggaauuugugucaaaaccagaaugaagaguauucgug

SEQ ID NO: 273236 - RNA, 62 nt, hsa
aaaauauugaauauuggcaggugugaaaacaagugucaaaauuccucauauagagaaaauaa

SEQ ID NO: 273237 - RNA, 62 nt, hsa
uuuuccucuaauuaaaaugugcaguauuuucagugucaaauauauuuaacuauuuagagaau

SEQ ID NO: 273238 - RNA, 62 nt, hsa
auucuauuuuuuucugaaugauagcaugaaaagugucaaagugguuuguccgcuagcgucug

SEQ ID NO: 273239 - RNA, 62 nt, hsa
aaucccaaaccaaaucaacuccagauauaucagugucaaaagcccaagaaaagacaaaaaag

SEQ ID NO: 273240 - RNA, 62 nt, hsa
aacaagaggguaaaguucauacauggcgaccugugucaaauccguccauugaucugcccucc

SEQ ID NO: 273241 - RNA, 62 nt, hsa
uaugauuuguacuucugcugugagauucccuagugucaaaauuaaaucaauaaaacugagca

SEQ ID NO: 273242 - RNA, 62 nt, hsa
uagaaguuacuuaauugccagcaaauaaauacgugucaaaaaagaaucuguauucagacccu

SEQ ID NO: 273243 - RNA, 62 nt, hsa
aaagagaaguuccuuuaaaaggucuuguucuugugucaaaaagcugcaaguuugguuuguuc

SEQ ID NO: 273244 - RNA, 62 nt, hsa
guauguugacuuuuaacaucaaaauuggauuugugucaaacauucauuguuaagagaagaau

SEQ ID NO: 273245 - RNA, 62 nt, hsa
guauauucugugaauuaaaaguuaugugauuggugucaaacuuaaggagauucaagaccugg

SEQ ID NO: 273246 - RNA, 62 nt, hsa
auucuuuaucccccuucaaagaaauuaccuuugugucaaaugccgcuuuguugagcccuuaa

SEQ ID NO: 273247 - RNA, 62 nt, hsa
gcaaaagauccaccuguauucccugugugugugugucaaaaugaccauuugccaaccuggcu

SEQ ID NO: 273248 - RNA, 62 nt, hsa
gaacauccugggcaccagucaugagucuuacugugucaaaaaucugaaaacacuugcugaga

SEQ ID NO: 273249 - RNA, 62 nt, hsa
aagugugaauuuuaguuuugucacaguuaacugugucaaagagaauuaaaaaaaaaaacuuc

SEQ ID NO: 273250 - RNA, 62 nt, hsa
gugugugguuuuuaaaacuguuaaggcaagaagugucaaaugcuuuagaguuaaauaacaga

SEQ ID NO: 273251 - RNA, 62 nt, hsa
uguccuaaucuuugugguguucgcuaucucuugugucaaaucuggugaacgcuacgcuuaca

SEQ ID NO: 273252 - RNA, 62 nt, hsa
auuaauaauuucuugauaauuauaaaaaugaagugucaaaaaaucucaaguguaggccugcc

SEQ ID NO: 273253 - RNA, 62 nt, hsa
ugugauuacagcauaggguccacuuugguaaugugucaaagagaugaggaaauaagacuuuu

SEQ ID NO: 273254 - RNA, 62 nt, hsa
aguccacgaaaaaacaauuuuuuucaccucaggugucaaaguaaauuuguuaaaaaaacaaa

SEQ ID NO: 273255 - RNA, 62 nt, hsa
uccauuguugguuuauugcagauuuguauccugugucaaauucaagguauuauugauaaacc

SEQ ID NO: 273256 - RNA, 62 nt, hsa
ugcuuucuauuguacagaagcucuucguuucagugucaaauaaacacuguguaagcuauuuc

SEQ ID NO: 273257 - RNA, 62 nt, hsa
uugcucaggcaauaauugguuuaaugcugguagugucaaauuuugaaguguuaauuuugucu

SEQ ID NO: 273258 - RNA, 62 nt, hsa
uugaauuuacagugggaaaauuucauauaaacgugucaaagucgugcuuuguuuuuggaaga

SEQ ID NO: 273259 - RNA, 62 nt, hsa
uucugaugcucauucugauacaacuauuuuucgugucaaauaucuacugugcccaaauguac

SEQ ID NO: 273260 - RNA, 62 nt, hsa
uacaucuuggcuaaauaauaccauacaaucuagugucaaaaacauaaauggccacaaaaaag

SEQ ID NO: 273261 - RNA, 62 nt, hsa
ccuccgccaccuaggaaaggagggagaugugcgugucaaauauucaucuaguccccuggggg

SEQ ID NO: 273262 - RNA, 62 nt, hsa
caagaggcaucccaagaccucaucugccugcagugucaaaucgauggccuggccuuggcuuc

SEQ ID NO: 273263 - RNA, 62 nt, hsa
gcacuccagccugggcaacagagcuagacucugugucaaaaauaaaugacuagauaaaaaaa

SEQ ID NO: 273264 - RNA, 62 nt, hsa
acauacuucaguauaggcauuuguucuugagugugucaaaauacagcuaguuacugugccaa

SEQ ID NO: 273265 - RNA, 62 nt, hsa
gggucacccucaggaucucuccaagaaaucuugugucaaauuaguaacucagucuuauacuu

SEQ ID NO: 273266 - RNA, 62 nt, hsa
gugucugugcgugugcgcgcgugugugcaugugugucaaaauugccaguguuguuuaggcaa

SEQ ID NO: 273267 - RNA, 62 nt, hsa
aucauuaggcuuacguacuacuuguuucaaaugugucaaauacaaaaaugguaacuagguug

SEQ ID NO: 273268 - RNA, 62 nt, hsa
uugguacagagacugagaaguuuuucauucuggugucaaaguuuuguuacauuaugggugug

SEQ ID NO: 273269 - RNA, 62 nt, hsa
uuggcgauucuccacuggagcggaagggcugugugucaaaagaaggaagccaggcugugaag

SEQ ID NO: 273270 - RNA, 62 nt, hsa
augggggcugcacuucccuuuuacauuuugaugugucaaaggcuuuuggagugaccaaaagc

SEQ ID NO: 273271 - RNA, 62 nt, hsa
ggcaucugugcucuccgagagaaaaccaaggugugucaaaugacgucaagucucuauuuaaa

SEQ ID NO: 273272 - RNA, 62 nt, hsa
ucucggccuucgagcacuuucuuucacuuacugugucaaagcccuggguccucuuuuugaug

SEQ ID NO: 273273 - RNA, 62 nt, hsa
uaaaguauauuccauuauuuugcauuuuugaugugucaaaacuuugacagcuuuuauguaga

SEQ ID NO: 273274 - RNA, 62 nt, hsa
uugggggaaaacuuuuaaaagauacccucauugugucaaagagugugccaaucuauuuuugu

SEQ ID NO: 273275 - RNA, 62 nt, hsa
ugccaugacaauaaaggucauagaaccugguagugucaaauuuaacccuuugaggacuguaa

SEQ ID NO: 273276 - RNA, 62 nt, hsa
gguauaauuuucacaaaauucuccaauuuucagugucaaauucagugaauuuugaaaacaua

SEQ ID NO: 273277 - RNA, 62 nt, hsa
uuggaacuuuggguugacucgguuugaguuuugugucaaagaagauuucccgcggcugaaga

SEQ ID NO: 273278 - RNA, 62 nt, hsa
uaauggagaaaaacccuacaaaugugaagaaugugucaaagcuuuuaacuguuccucaaucc

SEQ ID NO: 273279 - RNA, 62 nt, hsa
guaaguuauaauaauuguagcuuucugaauaagugucaaacuauaucuuuaagugugcugua

SEQ ID NO: 273280 - RNA, 62 nt, hsa
ucacaccugcugcccauucuccauuucugugugugucaaaggggacuaacagcagaaucuac

SEQ ID NO: 273281 - RNA, 62 nt, hsa
uaaaaaaaucauacagcagaaaaaccuuaugagugucaaacauguagaaaagccuucaguca

SEQ ID NO: 273282 - RNA, 62 nt, hsa
gcacuucagccugggugacagaaugagacucugugucaaaaaaauaaaaaauaaaaaaucua

SEQ ID NO: 273283 - RNA, 62 nt, hsa
ccccgcccaccagaccuguucugaccucaugagugucaaacgugccccccaguuccuuagga

SEQ ID NO: 273284 - RNA, 51 nt, hsa
aacccuacaaauguaaauaaugugucaaauccuuuaguguauuuucaacuu

SEQ ID NO: 273285 - RNA, 62 nt, hsa
aaagucuuuacucagaaauaugaccucagugagugucaaaguuuacacuggaaaauaacuuu

SEQ ID NO: 273286 - RNA, 62 nt, hsa
uuguggaaaaaucuauauaaaacaguaucagugugucaaagcauuauggcugucacaagcuu

SEQ ID NO: 273287 - RNA, 62 nt, hsa
agagccuucagacugcaacgcuggccugauacgugucaaaggagagagggauagaggaggau

SEQ ID NO: 273288 - RNA, 62 nt, hsa
ugaugcuggugacucaaacgugccuacucauggugucaaauuggcauaauccucuugggaag

SEQ ID NO: 273289 - RNA, 62 nt, hsa
uaguuuauuccuuuaacaacaauauuuuaugugugucaaaagucucacuugggaguaguguu

SEQ ID NO: 273290 - RNA, 62 nt, hsa
ucaaccaaaucauguuuuccucuuggauggaagugucaaaggcagaagggugugggaggggg

SEQ ID NO: 273291 - RNA, 62 nt, hsa
uuucuggaaguacuugcuucauguauggaugagugucaaagugaauuugauuuguacuuaga

SEQ ID NO: 273292 - RNA, 62 nt, hsa
acaucacuaguguagacucaaaagauaugcaagugucaaauaugcaaaagaaauaguuuauu

SEQ ID NO: 273293 - RNA, 62 nt, hsa
cuccccacccccuggcuuccccaccucuccaggugucaaaggugaaccgaguccaguauuag

SEQ ID NO: 273294 - RNA, 62 nt, hsa
guguuguacaauaccagaucacucaaaaaggugugucaaagauuuuaccugggauaugacaa

SEQ ID NO: 273295 - RNA, 62 nt, hsa
gaauuguauugaaaaaaugcugaggaaugaaugugucaaaauggguuaacuguguauauuga

SEQ ID NO: 273296 - RNA, 62 nt, hsa
ucuccuauuaaauaaaauuauuuuaaguuuuagugucaaaagugagaugcugagaguaggug

SEQ ID NO: 273297 - RNA, 62 nt, hsa
aguuugcuguuucuguagccauauuguauucugugucaaauaaaguccaguuggauucugga

SEQ ID NO: 273298 - RNA, 62 nt, hsa
gugccaccaggcugggcagggacaaccaccaggugucaaaugagaaaagcugccuggagucu

SEQ ID NO: 273299 - RNA, 62 nt, hsa
ugaacccaacuacuugucauagauguuugacugugucaaaagcugugagcagcaaaauauaa

SEQ ID NO: 273300 - RNA, 62 nt, hsa
cuucggauaauuuucauuuuuaauuccucuuggugucaaauuuuuaaguaauuucaugcaca

SEQ ID NO: 273301 - RNA, 62 nt, hsa
uuguaucaugugcuagauuggaguggggaagugugucaaaucaauaaaugaauaaauucaau

SEQ ID NO: 273302 - RNA, 62 nt, hsa
auauuuuuagccuaacauuauuaauaagaaaugugucaaauuuuuaacauugguaaaauaug

SEQ ID NO: 273303 - RNA, 62 nt, hsa
aucuaauugcaauaauaucuuaacagaagggggugucaaacagaggcaucagccugcuguug

SEQ ID NO: 273304 - RNA, 62 nt, hsa
uguuguauauaagcuaaauucuagugacccaugugucaaaaaucuuacuucuacauuuuuuu

SEQ ID NO: 273305 - RNA, 62 nt, hsa
guuucuuuuaucugacugacucugucaaacaagugucaaaguuguguguuaaaaaauguuua

SEQ ID NO: 273306 - RNA, 62 nt, hsa
gugugaguuuuccaaaauacuuaaaaauaauagugucaaaaauucaggggcaguuaaggagu

SEQ ID NO: 273307 - RNA, 62 nt, hsa
uauuuuuaucagaaaaauggcauauugcugaagugucaaaauaugagaaaagagcaucuuca

SEQ ID NO: 273308 - RNA, 62 nt, hsa
cuggugggguacacugcagaggaguaagucuugugucaaagcaggaaucugaucagagguuc

SEQ ID NO: 273309 - RNA, 62 nt, hsa
cuaccagaauuucauaugggcagaauaauauugugucaaacucuacuucagauugucuccuu

SEQ ID NO: 273310 - RNA, 64 nt, hsa
uauuccaagucuaaaauacaccuggaucugucuagucaaucaacauagcagagacagucuuaaa

SEQ ID NO: 273311 - RNA, 64 nt, hsa
aacuuuuaaaaaauucuuuuacuuuuaacuucuugucaaucaaaguauccugaaaaaugauaua

SEQ ID NO: 273312 - RNA, 64 nt, hsa
acuucugaaguaauuuguaaaaaagauuuguagagucaaucauguguuuaaauuauuuuaucac

SEQ ID NO: 273313 - RNA, 64 nt, hsa
gaaaugucaauugcaggaugcugauguugugcacgucaaucaccgggcacuugcauacucuuag

SEQ ID NO: 273314 - RNA, 64 nt, hsa
uaaaaguuuguuuaaaaauuugcaagcaucaagugucaaucaaaacugaagaugaaacacuaau

SEQ ID NO: 273315 - RNA, 64 nt, hsa
uugguuauguguaauguucacgugaccuuuuuuugucaaucauuuuuggaauuuuucuuucuuu

SEQ ID NO: 273316 - RNA, 64 nt, hsa
acauuuuaguuccuaugugauuuggccuuucgaugucaaucaucacucccagccauugauuuug

SEQ ID NO: 273317 - RNA, 64 nt, hsa
uccaugugcauaauuuaccucaugauuucuuuuggucaaucaggaucuuuaauacaauauagaa

SEQ ID NO: 273318 - RNA, 64 nt, hsa
cguucuuuucgauagcucacgaugguguaugagugucaaucaucugacccuucuuggagucuca

SEQ ID NO: 273319 - RNA, 64 nt, hsa
aagcgcacugggcuguuuuaccuuucuuuuuuaggucaaucaagacuccaaaauagugauuccu

SEQ ID NO: 273320 - RNA, 64 nt, hsa; identical to SEQ ID NO: 189841

SEQ ID NO: 273321 - RNA, 64 nt, hsa; identical to SEQ ID NO: 189842

SEQ ID NO: 273322 - RNA, 64 nt, hsa
ccauagccccuuggagugccccagcugcccugaggucaaucaaggaaaauuucuuaaugaaaua

SEQ ID NO: 273323 - RNA, 64 nt, hsa
guaguauuuucccagucagcuuugccauacugacgucaaucauuugagagaaauuauucagauu

SEQ ID NO: 273324 - RNA, 64 nt, hsa
aaugcauuucaugucugauucugcugcuaauuaagucaaucauuuaauuuuugggaccucaguu

SEQ ID NO: 273325 - RNA, 64 nt, hsa
augcggaaugugcacguuuccaggggcgaguauugucaaucaaaagguuugcaaugauuuccuu

SEQ ID NO: 273326 - RNA, 64 nt, hsa
caccaucuucaugaguggacccuguuuggcuugugucaaucaguuuaucccauccccuuggcca

SEQ ID NO: 273327 - RNA, 64 nt, hsa
acaggugccugaugaaaacgguucagaaagaucugucaaucaagcaguagugugaaaaaagcac

SEQ ID NO: 273328 - RNA, 64 nt, hsa
uuugcuuaugacacuaacacuauuaaugacaggagucaaucagccuuuacagcuaucaaaauau

SEQ ID NO: 273329 - RNA, 64 nt, hsa
uguggagggaggaagggggucuaaggucuaucaagucaaucauuucucacuguguacauaaugc

SEQ ID NO: 273330 - RNA, 64 nt, hsa
uaaaaaugauuagugucaguauuuuuucacuugggucaaucaaaucuguaacacugaauccaag

SEQ ID NO: 273331 - RNA, 64 nt, hsa
uuugagaaguugcuucuuuuacaucagaaaaccagucaaucauauggagacuucuuuugugaug

SEQ ID NO: 273332 - RNA, 64 nt, hsa
cagaccccgagguugucugguucaaagaugaccagucaaucagggagucccgccacuuccagau

SEQ ID NO: 273333 - RNA, 64 nt, hsa
gacuucaaaccauuuaacugguuucuuaagagccgucaaucagccugguuuuggggaugcuaug

SEQ ID NO: 273334 - RNA, 64 nt, hsa
cacaggucuuuccaccucugugaguccaagucaggucaaucagcaaggacccaucucugcccug

SEQ ID NO: 273335 - RNA, 64 nt, hsa
auaguuacaucuugugaaaauauaugauuuuuaugucaaucaagacaaaugaaauauauaugua

SEQ ID NO: 273336 - RNA, 64 nt, hsa
uaaauuucuuucauguccucccuacuuccucagugucaaucagauuaaaguguguaauccuauu

SEQ ID NO: 273337 - RNA, 64 nt, hsa
aagaaugcugacgaaaagcaauauccaaagucuugucaaucaggaugcaguuucuccaucggua

SEQ ID NO: 273338 - RNA, 64 nt, hsa
uuuuuuuuuuuuuuuuuugccaaccauugccaaugucaaucaaucacaguauuagccucuguua

SEQ ID NO: 273339 - RNA, 64 nt, hsa
cccacugccccucccccuguuccugccccaagccgucaaucagauuguggagcaguacacaguc

SEQ ID NO: 273340 - RNA, 64 nt, hsa
uaacccucuuuuuaagaggagauuuaaggaagacgucaaucaaaaugucaaauaugugugucag

SEQ ID NO: 273341 - RNA, 64 nt, hsa
ucagccaacaugcaucaguacugcaagaaaagaagucaaucagcagaggagagcauuugauaac

SEQ ID NO: 273342 - RNA, 64 nt, hsa
ugagaguaugaaugaagaacaacuagauauuaaugucaaucauuuaagauuaaugggcaugcaa

SEQ ID NO: 273343 - RNA, 64 nt, hsa
cuuuaaccaaaagauuucaacccacaaugaucaggucaaucaaaaucccuaagagcagaacucc

SEQ ID NO: 273344 - RNA, 64 nt, hsa
gacauugccaucucuauuuaacucauccauaugggucaaucaacugauuagaaaaucaaaaaac

SEQ ID NO: 273345 - RNA, 64 nt, hsa
cgacaacaacgcccucuuaagggaccacccuuuggucaaucauaacaugcuguuuaaagcagcu

SEQ ID NO: 273346 - RNA, 64 nt, hsa
aauacauuccaguguauuuucuguguuguucauagucaaucaaacagggacacuacaaacaugg

SEQ ID NO: 273347 - RNA, 64 nt, hsa
uuuuauuuuuuuucuguaacugugcuuguugaaugucaaucauauuuaaagggaaugacuuuga

SEQ ID NO: 273348 - RNA, 64 nt, hsa
auggcugaucaauuuucauacauugagaaaccaagucaaucaagcaggaaucauuuaaaaacca

SEQ ID NO: 273349 - RNA, 64 nt, hsa
aggcuccugugaggacaacagccugggccucggcgucaaucaucgauaagaagccucuacagca

SEQ ID NO: 273350 - RNA, 64 nt, hsa
gcacuuuagcaggcuccgagcuuuccuggcauaggucaaucaggucccaggaugaauaauccag

SEQ ID NO: 273351 - RNA, 64 nt, hsa
ggggaggggaggguguugagaaagcugaacuggagucaaucacccuucccacaaaucaccaaac

SEQ ID NO: 273352 - RNA, 64 nt, hsa
ugcugcuaaaggacuggacucaaacaaaaacgaggucaaucaugccauugaccgagugaccacu

SEQ ID NO: 273353 - RNA, 64 nt, hsa
aaaaauagaugcaugcauauguuaacauugaauagucaaucacuagaugaagaugcucucuacc

SEQ ID NO: 273354 - RNA, 64 nt, hsa
uuaagcaucaaaugcaaucaucuaaaauauaaaggucaaucauuuauaauagaaacaccuugac

SEQ ID NO: 273355 - RNA, 64 nt, hsa
ccuaacauucuucuuccuguguggaugcuuauuugucaaucaguaaauuuguucguaaagaaaa

SEQ ID NO: 273356 - RNA, 64 nt, hsa
gcuucaaaaggcucucaacaugaagguuaacacagucaaucaaacuuacauuccugccaagaug

SEQ ID NO: 273357 - RNA, 64 nt, hsa
aaaaaagaauaaagaaagaaaagugcgaugcccagucaaucacaaauaagaucauccugguuua

SEQ ID NO: 273358 - RNA, 64 nt, hsa
cugugaugcagcgaguggcacacagcauuauugugucaaucaugugucuugaugugaugcacug

SEQ ID NO: 273359 - RNA, 64 nt, hsa
ugaccauauagauuuuauuauguuaguuuaaaaggucaaucagccucaugacuuuauaguuaug

SEQ ID NO: 273360 - RNA, 64 nt, hsa
ccaugugcuaguaauuggaaaggcagcucuaaaugucaaucagccuaguugaucagcuuauugu

SEQ ID NO: 273361 - RNA, 64 nt, hsa
gaguguguagccccuuuguccaggaauuugacuagucaaucagugacaccugguacuggcaguu

SEQ ID NO: 273362 - RNA, 64 nt, hsa
uuuccaagaccugcccaggauuuaguaagggaaagucaaucaggaagagaauggaaaacuuaua

SEQ ID NO: 273363 - RNA, 64 nt, hsa
uggauguguaaagaaugauauauauauuaaauaggucaaucagacuaugacagcuauguacgac

SEQ ID NO: 273364 - RNA, 64 nt, hsa
gugggagacuuuccauuaaaucaaucaggaaugagucaaucagccuuuaggucuuuaguccggg

SEQ ID NO: 273365 - RNA, 64 nt, hsa
guauuugacaaacauuauuucauuaaacgagacugucaaucauuacucaaagaaugaugaaggu

SEQ ID NO: 273366 - RNA, 64 nt, hsa
auguuaggucaacuggcaaauuggaauauagacagucaaucagauaagaaguauacuuugauua

SEQ ID NO: 273367 - RNA, 64 nt, hsa
uguaucuaaauuuuuuuugcugaaauacauuauggucaaucaagccaagccugcauguacagaa

SEQ ID NO: 273368 - RNA, 64 nt, hsa
auguuuccuuucugcucuuacacagcauuguuuugucaaucaacacagccugcacugaaaggac

SEQ ID NO: 273369 - RNA, 64 nt, hsa
gaaggcagaaagcuucuguguaagccaggcuuaagucaaucagagggcacaaaccuuauuagga

SEQ ID NO: 273370 - RNA, 64 nt, hsa
ggugucuuucuugugcagucagggucugcgcacagucaaucaggguagaggggguauuucugag

SEQ ID NO: 273371 - RNA, 59 nt, hsa
cucaucaugaacacagcuaaggaaugauggucaaucaguguuaacuugcauauuguugg

SEQ ID NO: 273372 - RNA, 64 nt, hsa
agauauaagaaucaaauauucccaaggaggauuugucaaucaaggaaaacaugacagaugguga

SEQ ID NO: 273373 - RNA, 64 nt, hsa
ugcuaccgccccaaaguaaaagaaaccacuucuggucaaucaacacuaccagcguauauauaag

SEQ ID NO: 273374 - RNA, 64 nt, hsa
accacuaaaauuuuaguuuuagccuaucacucaugucaaucauaucuaugagacaaaugucucc

SEQ ID NO: 273375 - RNA, 64 nt, hsa
uuaauuuucauccaucuuuuggucguagguaaaggucaaucagguuuuucaaaaagacucccug

SEQ ID NO: 273376 - RNA, 64 nt, hsa
agaaagcugaacgugcacucugacaaggggagcugucaaucaaacaccaaaccggggagacaag

SEQ ID NO: 273377 - RNA, 64 nt, hsa
ugaugugguguaauugaagggugugaaaugcuuugucaaucauuugucacauuuauccaguuug

SEQ ID NO: 273378 - RNA, 64 nt, hsa
uaaguuauguaagaaucaucgccuuguggaacaagucaaucagugacuagcuuccuguagccaa

SEQ ID NO: 273379 - RNA, 64 nt, hsa
acuauuuucagaugugaaccauuaaccagaucuagucaaucaagucuguuuacugcaagguuca

SEQ ID NO: 273380 - RNA, 64 nt, hsa
uaugcaauuuuuauuuugguuauauuacaaaaaugucaaucaaauauuaaaaaauaguuaaugu

SEQ ID NO: 273381 - RNA, 64 nt, hsa
uuauuccaguuuucaaugauuuuucaaaauaaaagucaaucagcauuguuauuuaucauuaagg

SEQ ID NO: 273382 - RNA, 64 nt, hsa
auguuuuuaauucccuuuuaacccaguguacuaggucaaucaggaggcaucuggaaaggggggg

SEQ ID NO: 273383 - RNA, 64 nt, hsa
aaaugaauacuauugucagaaccauaucuauauagucaaucauuuccucuuuuaacgucugucu

SEQ ID NO: 273384 - RNA, 52 nt, hsa
cuccugauguuaaggccugagcgucaaucauaugugcaguuaguauacaacu

SEQ ID NO: 273385 - RNA, 64 nt, hsa
ccugacaaaacuguugcugcacacaucuguacucgucaaucaacaaaaccugaugcaaaaaaca

SEQ ID NO: 273386 - RNA, 64 nt, hsa
gagugggcgggugagaaaaaccgaauuggguuuagucaaucacugcacugcaugcaaacaagaa

SEQ ID NO: 273387 - RNA, 64 nt, hsa
auuuucugaccaggcacaugccauccaauuuucugucaaucacacuguuguauaaagcagcaga

SEQ ID NO: 273388 - RNA, 64 nt, hsa
ugauuucauacguacccagggagcaugcuguuuugucaaucaauauaaaauauuuaugaggucu

SEQ ID NO: 273389 - RNA, 64 nt, hsa
ggagccucucccuccgagauacccacccagcuuugucaaucacccaagcacuuuaugcauauag

SEQ ID NO: 273390 - RNA, 64 nt, hsa
ucguggucuucgcagaggggaaggccugucuaaagucaaucauccgagauggguuuuccauucc

SEQ ID NO: 273391 - RNA, 64 nt, hsa
guacauuucugccauguacuccagaacucauccugucaaucacucugucccauugucuacuggg

SEQ ID NO: 273392 - RNA, 64 nt, hsa
cauuccuuaucucagaaaacagaaaccgggcucagucaaucaaugcuuuauuucaggccgaaug

SEQ ID NO: 273393 - RNA, 64 nt, hsa
uugugcuguuaacaacguuaguggacacuuguaagucaaucaguguuaaaguauuuguaaauag

SEQ ID NO: 273394 - RNA, 64 nt, hsa
gaacaucuugcacacaauuugaauuauguagaaugucaaucaaguuuuuguauauuuaaaaguu

SEQ ID NO: 273395 - RNA, 64 nt, hsa
cuguuccugucucagcaaccaagggauuguuccugucaaucaaugguuuauuggaagguggccc

SEQ ID NO: 273396 - RNA, 64 nt, hsa
aucagaacaaagggcccacucuaguucucuacaugucaaucaaucaagcauguugaauaaggga

SEQ ID NO: 273397 - RNA, 64 nt, hsa
ugaaaaugaggcugcaacaacaguaagucucuaagucaaucauuuguuagccaagcaaagccau

SEQ ID NO: 273398 - RNA, 64 nt, hsa
gaauuagggggccucuuggccuugguccaaaauugucaaucagaaaugaacauaaaggacucca

SEQ ID NO: 273399 - RNA, 64 nt, hsa
gugcucuccucuuuuuuguuuuguuuugcacuuugucaaucauuuggggaaauagccuggaggu

SEQ ID NO: 273400 - RNA, 64 nt, hsa
uggcuucuguuuuauucagggauuuuuuuaaaaagucaaucagaaaagggauacuggagcuucu

SEQ ID NO: 273401 - RNA, 64 nt, hsa
uugaagcugaugggugccagcccugcauugcugagucaaucaauaaagagcuuucuuuugaccc

SEQ ID NO: 273402 - RNA, 64 nt, hsa; identical to SEQ ID NO: 273401

SEQ ID NO: 273403 - RNA, 64 nt, hsa
gcagagaauaaaacguuaguuaaucccuuugucugucaaucacagucucaguucucuugcuuuc

SEQ ID NO: 273404 - RNA, 64 nt, hsa
ucuggugccuuccaugcgucgcauaagcacucuugucaaucauggaauuggaaaaaaagaugua

SEQ ID NO: 273405 - RNA, 64 nt, hsa
guggcucacguagguggcaccugccaauagcuuugucaaucacagccccauaggaacgucugga

SEQ ID NO: 273406 - RNA, 64 nt, hsa
cuuggagaagcuguugcugagaccccccccccaagucaaucagaaccacaacagguuggucauc

SEQ ID NO: 273407 - RNA, 64 nt, hsa
acugacaggacugcaagagggagaaaggaauuuugucaaucaaaauuauucuguauugcaacuu

SEQ ID NO: 273408 - RNA, 64 nt, hsa
guuuuguuuugccuuuaacaguuggauggauuuugucaaucagcuggauaugcuguuuaguuuu

SEQ ID NO: 273409 - RNA, 64 nt, hsa
cugauucuagcccauuuuccugauucucuggcuugucaaucaagaguauccuccaaaucucuug

SEQ ID NO: 273410 - RNA, 64 nt, hsa
auuguacuccaucaauauaauacaauuauuauuugucaaucaaauauuaauaaaaucaaagaug

SEQ ID NO: 273411 - RNA, 64 nt, hsa
ggcggaagccaucuuauugcuaccagcugugugugucaaucacuccauuuugcucagggaaggc

SEQ ID NO: 273412 - RNA, 64 nt, hsa
cagcaggaugcugaggaaccauguugccuuuccugucaaucacagccaccuuccuguuaucucc

SEQ ID NO: 273413 - RNA, 64 nt, hsa
ucagagaugaccuuaaauaugauggaguaaaauugucaaucauacauugaauugcuauggaaga

SEQ ID NO: 273414 - RNA, 64 nt, hsa
gugcaaccugaaacccaggaaagcagucuccauagucaaucagaaaaacaaugaucauucugug

SEQ ID NO: 273415 - RNA, 64 nt, hsa
ggcuuucucuagccuugucacugucucccugccugucaaucaccaccuuuccuccagaggagga

SEQ ID NO: 273416 - RNA, 64 nt, hsa
guauuucugacuuauacuauaaaauuauuaaaaagucaaucaguauucaacaucuuuuacacua

SEQ ID NO: 273417 - RNA, 64 nt, hsa
guguauccugacagcgccaugugugucagcccaugucaaucaagaugggugauuaugaaaugcc

SEQ ID NO: 273418 - RNA, 64 nt, hsa
cuggggcacagagaggugaugucaucugccuggugucaaucagcuagcaagugauggagcccag

SEQ ID NO: 273419 - RNA, 64 nt, hsa
aagguacuauagaagggcgaagaaucguucaacugucaaucagccucuugauucuuuguaaauu

SEQ ID NO: 273420 - RNA, 64 nt, hsa
auaaugaaaaaaucacacaauuuugaagaaaacugucaaucagcuuauaacgacaauguggcac

SEQ ID NO: 273421 - RNA, 64 nt, hsa
uguuuuuagcauucuaaauuuaaaugcuuaaaacgucaaucaacaaaacuuuguuuuaaauauu

SEQ ID NO: 273422 - RNA, 64 nt, hsa
ucuccuaugugacuuuagugcaggaagaacuucugucaaucauggacgcaucuggagacaagug

SEQ ID NO: 273423 - RNA, 64 nt, hsa
cuucguuguuguuguuuuuaauuguaaauuguuaucaaucaaacuauuguagcagcuacaaagu

SEQ ID NO: 273424 - RNA, 64 nt, hsa
auuccaagucuaaaauacaccuggaucugucuagucaaucaacauagcagagacagucuuaaac

SEQ ID NO: 273425 - RNA, 64 nt, hsa
gaagauggucuguuuugacagaaacugacaggaaucaaucaaaacaaucgaauuuugaauugag

SEQ ID NO: 273426 - RNA, 64 nt, hsa
aucacauaaccuuaaagaauaccguuuacauuucucaaucaaaauucuuauaauacuauuuguu

SEQ ID NO: 273427 - RNA, 64 nt, hsa
aacagaauacauacauguguauauguaaagaauuucaaucaaaugaaacguuauccuauuggau

SEQ ID NO: 273428 - RNA, 64 nt, hsa
cuuuguauauuuaaguguuguaaggaaacguguuucaaucaaaacugaccaugagauaaaggaa

SEQ ID NO: 273429 - RNA, 64 nt, hsa
acuuuuaaaaaauucuuuuacuuuuaacuucuugucaaucaaaguauccugaaaaaugauauaa

SEQ ID NO: 273430 - RNA, 64 nt, hsa
aaacacagugcuggcucggcugcccugagggugcucaaucaagcacagguuucaagucuggguu

SEQ ID NO: 273431 - RNA, 64 nt, hsa
cuccguguugcuggauaaagcuuuuuuauuuaccucaaucaaaaaaagaaaacaaaaaugaacu

SEQ ID NO: 273432 - RNA, 64 nt, hsa
uaucacuaucaccaccaccccucacccuaugcaaucaaucaaucaaucaucuuaaguuaaagau

SEQ ID NO: 273433 - RNA, 64 nt, hsa
acuaucaccaccaccccucacccuaugcaaucaaucaaucaaucaucuuaaguuaaagauauuu

SEQ ID NO: 273434 - RNA, 64 nt, hsa
aacuuuauuuuuauaaagggagaggaugacuuucucaaucaagugccaccagauaaaaacaacu

SEQ ID NO: 273435 - RNA, 64 nt, hsa
uccauuuggugcaguuguacuuggucuguuauauucaaucaagguuuaauagauagggcugggc

SEQ ID NO: 273436 - RNA, 64 nt, hsa
acuuggauuaauucaugguaucuugagucuugguucaaucaacagaauuguucuuuuuccuguu

SEQ ID NO: 273437 - RNA, 64 nt, hsa
aauccaagaauagaagaaugaagcaaguucacuuucaaucaagaaacuucauaauacuuucagg

SEQ ID NO: 273438 - RNA, 64 nt, hsa
ccauggaaugaaugcacugcagacucucaagagaucaaucaaauugccagaaacaguuugguuu

SEQ ID NO: 273439 - RNA, 64 nt, hsa
aaaaguuuguuuaaaaauuugcaagcaucaagugucaaucaaaacugaagaugaaacacuaaug

SEQ ID NO: 273440 - RNA, 64 nt, hsa
cuguauuugguuuaauguuuuuguccuaaucucuucaaucaauaaaauugugcguauuuaacua

SEQ ID NO: 273441 - RNA, 64 nt, hsa
uguuuugcacuuucaaagauuguaaauaguucauucaaucaaugguauggaguuauuuauuugc

SEQ ID NO: 273442 - RNA, 64 nt, hsa
aagauauuacaggguagacacguuuuaacugaaaucaaucaagauaacuuuauucaaagagcag

SEQ ID NO: 273443 - RNA, 64 nt, hsa
cacugugugacauccauaugaauuuugguauauaucaaucaaucaaucaaucacauugcauuca

SEQ ID NO: 273444 - RNA, 64 nt, hsa
gugugacauccauaugaauuuugguauauaucaaucaaucaaucaaucacauugcauucaauca

SEQ ID NO: 273445 - RNA, 64 nt, hsa
gacauccauaugaauuuugguauauaucaaucaaucaaucaaucacauugcauucaaucaauca

SEQ ID NO: 273446 - RNA, 64 nt, hsa
guauauaucaaucaaucaaucaaucacauugcauucaaucaaucagcugugauugauugauuau

SEQ ID NO: 273447 - RNA, 64 nt, hsa
ggaaguguaaagagucaccuucauuuucuguaacucaaucaagacugguggguccauggcccug

SEQ ID NO: 273448 - RNA, 64 nt, hsa
ucggccgcuugcacccgcucucuguuguacacuuucaaucaacacuuuuucagacuaaaggcca

SEQ ID NO: 273449 - RNA, 64 nt, hsa
cacccccaaauuuucuuuuuauacuauuaaugaaucaaucaauucauaucuauuuauuaaauuu

SEQ ID NO: 273450 - RNA, 64 nt, hsa
agcgcacugggcuguuuuaccuuucuuuuuuaggucaaucaagacuccaaaauagugauuccua

SEQ ID NO: 273451 - RNA, 64 nt, hsa
ugaccacauucccaacuagaaaaaucuucuugcgucaaucaagccucaccuggcucauuuggcu

SEQ ID NO: 273452 - RNA, 64 nt, hsa
cauagccccuuggagugccccagcugcccugaggucaaucaaggaaaauuucuuaaugaaauaa

SEQ ID NO: 273453 - RNA, 64 nt, hsa
cucaaugugccagcagggacucaguaccugagccucaaucaagccuuauccaccaaauacacag

SEQ ID NO: 273454 - RNA, 64 nt, hsa
uuguauuuaauguguguagacccuccucuguucaucaaucaaaaagcauuuccuaggcagcucc

SEQ ID NO: 273455 - RNA, 64 nt, hsa
cugccauuuuuuucccuccacaauuuggccuucuucaaucaagccagauaaauuuuugagacaa

SEQ ID NO: 273456 - RNA, 64 nt, hsa
gagcuugaugcccagggaacaacccaaccgucuuucaaucaacaguucuugacugccaaacuuu

SEQ ID NO: 273457 - RNA, 64 nt, hsa
ugagaacauuuuaaaaauauugucuuagcaauuuucaaucaagccugucccauggagacacaag

SEQ ID NO: 273458 - RNA, 64 nt, hsa
ugcggaaugugcacguuuccaggggcgaguauugucaaucaaaagguuugcaaugauuuccuuc

SEQ ID NO: 273459 - RNA, 64 nt, hsa
aaaaaauaaaaaauauauaguggacaguaaccuuucaaucaaaacucaguaucauaaguagaga

SEQ ID NO: 273460 - RNA, 64 nt, hsa
uggauuuuuaaaccuguucagaguccugguuuaaucaaucaagcuaaaagaaucgaagacaucc

SEQ ID NO: 273461 - RNA, 64 nt, hsa
uccauuucaguggcagaagaauuuuuuaaggguuucaaucaauuauuaaugcagagaguauuga

SEQ ID NO: 273462 - RNA, 64 nt, hsa
caggugccugaugaaaacgguucagaaagaucugucaaucaagcaguagugugaaaaaagcacu

SEQ ID NO: 273463 - RNA, 64 nt, hsa
cugguaacucacucaguuuaugcugugcuaaauaucaaucaagccauguauaaaugugauauga

SEQ ID NO: 273464 - RNA, 64 nt, hsa
guagugguaacuauucacuucuuaauuuaugaccucaaucaauuuaauugucuagaauguaaaa

SEQ ID NO: 273465 - RNA, 64 nt, hsa
aauauccaaaugaaauuaagucucacugaacauuucaaucaagaauggcagggaucuauuuuau

SEQ ID NO: 273466 - RNA, 64 nt, hsa
aaaaaugauuagugucaguauuuuuucacuugggucaaucaaaucuguaacacugaauccaagc

SEQ ID NO: 273467 - RNA, 64 nt, hsa
aauguuauuccaaacauuaaauuuuaacagucuaucaaucaauaaauguugaacauuuuuuuuc

SEQ ID NO: 273468 - RNA, 64 nt, hsa
aagaugaauuuuuuucuggaaacacuagauguuaucaaucaaacacuaaaauguaccauacaaa

SEQ ID NO: 273469 - RNA, 64 nt, hsa
aagcacccccugccccggcaagaaacucccaggcucaaucaagguguggcuuccauugaggagc

SEQ ID NO: 273470 - RNA, 64 nt, hsa
gguaauuguagcauuucagaaaaugucuuucauuucaaucaauaaaaagcuuuuguaaaauugc

SEQ ID NO: 273471 - RNA, 64 nt, hsa
ggagguugacuaauaagaaaguuggcauaaacuuucaaucaaaugaagaguuugccuagaggag

SEQ ID NO: 273472 - RNA, 64 nt, hsa
gcuguugucauggcugaguaguuuuuugaugaauucaaucaaugcagagaacgcuuuuagauaa

SEQ ID NO: 273473 - RNA, 64 nt, hsa
gccuuugcuacauccugauuaucucugaaaguaaucaaucaaguggcuccaguagcucuggauu

SEQ ID NO: 273474 - RNA, 64 nt, hsa
uagcaagauguaauccugugaauugaauuucucuucaaucaaagugccccaaaacagaagcaca

SEQ ID NO: 273475 - RNA, 64 nt, hsa
uugguuuugccuaucuacagugugauguauggacucaaucaaaaacauuaaacgcaaacugauu

SEQ ID NO: 273476 - RNA, 64 nt, hsa
uacauuacaagauccagguucuucccccccacacucaaucaagccagcccucuccucuucuguc

SEQ ID NO: 273477 - RNA, 64 nt, hsa
uauuaaccucaguccugucccccaaggucuugacucaaucaacucuaaguuccaagggaggacc

SEQ ID NO: 273478 - RNA, 64 nt, hsa
agauuuuccagaaguaaaaucugaugguucuaaaucaaucaaugugauaguucauuuuuaacuc

SEQ ID NO: 273479 - RNA, 64 nt, hsa
uucuguauguaaauauguuuauauuuauagagcaucaaucaauauaagcauuauugagaaaaau

SEQ ID NO: 273480 - RNA, 64 nt, hsa
ccuuuauauuguauuuauaaaaaaaaaaguacuaucaaucaaucauacuacuuuggauuguugu

SEQ ID NO: 273481 - RNA, 64 nt, hsa
uaguuacaucuugugaaaauauaugauuuuuaugucaaucaagacaaaugaaauauauauguau

SEQ ID NO: 273482 - RNA, 64 nt, hsa
uugacaaauucaguggcagcccagccaccuccuaucaaucaaucagggaagaaaugcaggggag

SEQ ID NO: 273483 - RNA, 64 nt, hsa
auagucaguggcaccauuuccuaaaguaacugaaucaaucaauccagucagguaauuauuuucu

SEQ ID NO: 273484 - RNA, 64 nt, hsa
cucacauaaaaaagaagcacuuugauugaaguauucaaucaaguuuuuuuguuguuuucuguuc

SEQ ID NO: 273485 - RNA, 64 nt, hsa
ugcuauaagcuuggugaaaugaaaauggaacauuucaaucaaacauuuccuauauaacaauuau

SEQ ID NO: 273486 - RNA, 64 nt, hsa
auuaccuuuugauuuguaacacuacuucugcuguucaaucaagagucuugguagauaagaaaaa

SEQ ID NO: 273487 - RNA, 64 nt, hsa
uuuuuuuuuuuuuuuuugccaaccauugccaaugucaaucaaucacaguauuagccucuguuaa

SEQ ID NO: 273488 - RNA, 64 nt, hsa
uccagaaaggacguaacuuagcauggaucaccaaucaaucaaaaaauaaauaaaucacuaagga

SEQ ID NO: 273489 - RNA, 64 nt, hsa
uaagaaaaaaaaaaaaaaaaaaaaagccaugcuaucaaucaagauucuuuuuuuuuaaacuuuc

SEQ ID NO: 273490 - RNA, 64 nt, hsa
aacccucuuuuuaagaggagauuuaaggaagacgucaaucaaaaugucaaauaugugugucaga

SEQ ID NO: 273491 - RNA, 64 nt, hsa
uuuaaccaaaagauuucaacccacaaugaucaggucaaucaaaaucccuaagagcagaacuccu

SEQ ID NO: 273492 - RNA, 64 nt, hsa
ugacagacauuuaaaaacaaccuucagcuccguuucaaucaaucaccucgacuuguuuuuuagc

SEQ ID NO: 273493 - RNA, 64 nt, hsa
ccugaguaauccaccccagcuaaaggcaaacccuucaaucaaguuuauacagcaaacccuccau

SEQ ID NO: 273494 - RNA, 64 nt, hsa
gccucuaaauguaauaagauagagggucaaagguucaaucaauaaaaauauuuuauucaaaaaa

SEQ ID NO: 273495 - RNA, 64 nt, hsa
gauauauuaacaugaaggaauggggaagcuuauuucaaucaaagcuaaaauuuucagaagucug

SEQ ID NO: 273496 - RNA, 64 nt, hsa
ugaacugccacaugccaccaaaugaaccuuuacuucaaucaaaaaggaggguaugauugguuca

SEQ ID NO: 273497 - RNA, 64 nt, hsa
acauugccaucucuauuuaacucauccauaugggucaaucaacugauuagaaaaucaaaaaaca

SEQ ID NO: 273498 - RNA, 64 nt, hsa
uguaggaacucugauggugcucagauuuguguguucaaucaaugggcuuaaaucagcaaaauau

SEQ ID NO: 273499 - RNA, 64 nt, hsa
auacauuccaguguauuuucuguguuguucauagucaaucaaacagggacacuacaaacauggg

SEQ ID NO: 273500 - RNA, 64 nt, hsa
cccucauucauccauccguucauucauucagccuucaaucaacaucucuugagugucuauuaug

SEQ ID NO: 273501 - RNA, 64 nt, hsa
uggcugaucaauuuucauacauugagaaaccaagucaaucaagcaggaaucauuuaaaaaccag

SEQ ID NO: 273502 - RNA, 64 nt, hsa
gauaagugaucaugcagccagagccagccuuccuucaaucaagguuuccaggcagagcaaauac

SEQ ID NO: 273503 - RNA, 64 nt, hsa
gauaagugauugugcagccagagccagccuuccuucaaucaagguuuccaggcagagcaaauac

SEQ ID NO: 273504 - RNA, 64 nt, hsa
ucucacucuaguucccccaaagcuguagucccaaucaaucaaaggcuaccaacugaguccucag

SEQ ID NO: 273505 - RNA, 64 nt, hsa
aaugaaagaaacuucagaaagcuagaauugcuuaucaaucaaaagacuuucucaaucuauuuug

SEQ ID NO: 273506 - RNA, 64 nt, hsa
uauuucuuacauuauccuaaugauugaaaacuccucaaucaagcuuacuuacacacauucuaca

SEQ ID NO: 273507 - RNA, 64 nt, hsa
uuuuuuaaaauugauuuuucucuucauuuuuuuuucaaucaacuuuacuguaauauaaaguauu

SEQ ID NO: 273508 - RNA, 64 nt, hsa
acaucauaaugcacaauuuuauauacugauuuuuucaaucaauguauaucaugaguuuuuaaaa

SEQ ID NO: 273509 - RNA, 64 nt, hsa
gaguaaggacuaggugcaccaccaugacugacuaucaaucaaaauguuuguaacuuaaaauuuu

SEQ ID NO: 273510 - RNA, 64 nt, hsa
cuucaaaaggcucucaacaugaagguuaacacagucaaucaaacuuacauuccugccaagaugc

SEQ ID NO: 273511 - RNA, 64 nt, hsa
auuuguguauauuugggaugauauuuaggagcuaucaaucaaauuuuacaucucacaauguacu

SEQ ID NO: 273512 - RNA, 64 nt, hsa
ugaaagaagcuuugccaauuuuacuuauucgugaucaaucaaggaaaaucuaauaaauuuuagg

SEQ ID NO: 273513 - RNA, 64 nt, hsa
uagacuuuggaggucaaguccaggcauuguguuuucaaucaaguuauugauuccaaagaacucc

SEQ ID NO: 273514 - RNA, 64 nt, hsa
auauuccuuauguugacauggauuggauuucaguucaaucaaacuuucagcuuuuuuuucagcc

SEQ ID NO: 273515 - RNA, 64 nt, hsa
guggugggaagaguuagggccagugucuugaaaaucaaucaaguagugaaugugaucucuuugc

SEQ ID NO: 273516 - RNA, 64 nt, hsa
guccaucucucucccuuacuauucccacuuucauucaaucaaccugcacuucauaucuagauuu

SEQ ID NO: 273517 - RNA, 64 nt, hsa
gccuuccucagccucuggcccucuuggcucagauucaaucaaauguugcuucccucuccugucu

SEQ ID NO: 273518 - RNA, 64 nt, hsa
ugagaacucauaaauaaaauucagccaagauuaaucaaucaaucaaucaaucaguagacgucag

SEQ ID NO: 273519 - RNA, 64 nt, hsa
aaaauucacuccuggagaucuccguagacuacaaucaaucaaaucaauagucagucuuguaagg

SEQ ID NO: 273520 - RNA, 64 nt, hsa
cuuuugacggagacagcaaauaggccucugcaaaucaaucaaaggcugcaacccuauggccucu

SEQ ID NO: 273521 - RNA, 64 nt, hsa
uuaccuaaauguuuuguagaguuuugacuaguaaucaaucaaaauuauauaaagucuucuccag

SEQ ID NO: 273522 - RNA, 64 nt, hsa
uuaacuuaauucaccucagacuucagccuaagauucaaucaaauucauccuucagccugucuug

SEQ ID NO: 273523 - RNA, 64 nt, hsa
uggcuauaauaaagcaggagcaauuauaaaaucuucaaucaauugaacuuuuacaaaaccacuu

SEQ ID NO: 273524 - RNA, 64 nt, hsa
ucuucagguaugggauuucugaacguuucaaauuucaaucaaugagcacugucaacacccacag

SEQ ID NO: 273525 - RNA, 64 nt, hsa
cacuguuuuuaaaucuagcauuauucauuuugcuucaaucaaaagugguuucaauauuuuuuuu

SEQ ID NO: 273526 - RNA, 64 nt, hsa
gaauauaucuggauauguacuaaucaaauaauaaucaaucaaucagcauauacauuucagccaa

SEQ ID NO: 273527 - RNA, 64 nt, hsa
uuucuccaaggaucugcugaaagcucuguacaacucaaucaagaaugagaagcuugaaugggca

SEQ ID NO: 273528 - RNA, 64 nt, hsa
uaccacuccuauucuguuaucuggacuagaauuuucaaucaauguguuugaaaauaauguugcu

SEQ ID NO: 273529 - RNA, 64 nt, hsa
aaacuggcauuauacugaacuauacauugagaaaucaaucaaaauaaaaauuuuuacuuucaca

SEQ ID NO: 273530 - RNA, 64 nt, hsa
gaaagguuugaaauacguaccccaguaaaaccauucaaucaauaauugguaaauaauauuuuaa

SEQ ID NO: 273531 - RNA, 64 nt, hsa
accaucacaguaaauauggcucaggcaagaauuaucaaucaaugcuaaagcuagggggaaauuu

SEQ ID NO: 273532 - RNA, 64 nt, hsa
guaucuaaauuuuuuuugcugaaauacauuauggucaaucaagccaagccugcauguacagaau

SEQ ID NO: 273533 - RNA, 64 nt, hsa
cagcuuugauuuuccagaucucaaucguguugcuucaaucaauauugagauccagcagccuuca

SEQ ID NO: 273534 - RNA, 64 nt, hsa
uaacucuuagaagaaaccccacaaauaaagcaauucaaucaaggcuguucuauuuaaaucagag

SEQ ID NO: 273535 - RNA, 64 nt, hsa
cauuggauuuacuagacgaaaaccauaccucucuucaaucaaaaugaaaacaaagcaaaugaau

SEQ ID NO: 273536 - RNA, 64 nt, hsa
uguuuccuuucugcucuuacacagcauuguuuugucaaucaacacagccugcacugaaaggacc

SEQ ID NO: 273537 - RNA, 64 nt, hsa
uaguaccggguucaguuuaguucuuaguaucuuuucaaucaagcugugugcuuaauuuacucug

SEQ ID NO: 273538 - RNA, 64 nt, hsa
cucuuguguagucacuucugauucugacaaucaaucaaucaauggccuagagcacugacuguua

SEQ ID NO: 273539 - RNA, 64 nt, hsa
aaugcucuuguguagucacuucugauucugacaaucaaucaaucaauggccuagagcacugacu

SEQ ID NO: 273540 - RNA, 64 nt, hsa
cuaauugugguagaaauuuuuaccaacucuauacucaaucaagcaaaauuucuguauauucccu

SEQ ID NO: 273541 - RNA, 64 nt, hsa
ucagaucauuuaggauacucuuaaucucacuucaucaaucaaauauuuuuugaguguaugcugu

SEQ ID NO: 273542 - RNA, 64 nt, hsa
aggucaagggccacauucaccuuuucagagugacucaaucaaauuuguaguuuguaaaaguauu

SEQ ID NO: 273543 - RNA, 64 nt, hsa
gauauaagaaucaaauauucccaaggaggauuugucaaucaaggaaaacaugacagauggugag

SEQ ID NO: 273544 - RNA, 64 nt, hsa
gaggauaauuaauugacacaucugaaauccccaaucaaucaaucaagagaaagguagaacuaaa

SEQ ID NO: 273545 - RNA, 64 nt, hsa
auaauuaauugacacaucugaaauccccaaucaaucaaucaagagaaagguagaacuaaaaacu

SEQ ID NO: 273546 - RNA, 64 nt, hsa
gcuaccgccccaaaguaaaagaaaccacuucuggucaaucaacacuaccagcguauauauaaga

SEQ ID NO: 273547 - RNA, 64 nt, hsa
gaaagcugaacgugcacucugacaaggggagcugucaaucaaacaccaaaccggggagacaaga

SEQ ID NO: 273548 - RNA, 64 nt, hsa
ugaugagguuucuacugggaccacauugagucuaucaaucaacuuaugcagaacuggcaacuua

SEQ ID NO: 273549 - RNA, 64 nt, hsa
ucugaacccagugugggggcauucacuagaaucuucaaucaaccugggcucuccccaccccacc

SEQ ID NO: 273550 - RNA, 64 nt, hsa
ucaguucucauccucuccaucccaauccaguauaucaaucaacucuaacucggagacgucuagc

SEQ ID NO: 273551 - RNA, 64 nt, hsa
agcuuuauucauacaugagugauuugguuauaacucaaucaaaauuuuuaucuuuaaaucugag

SEQ ID NO: 273552 - RNA, 64 nt, hsa
aauaaugagcaucuaagugguuggguuuuagagaucaaucaagaauaauuuuaauuuucuuuug

SEQ ID NO: 273553 - RNA, 64 nt, hsa
cuauuuucagaugugaaccauuaaccagaucuagucaaucaagucuguuuacugcaagguucaa

SEQ ID NO: 273554 - RNA, 64 nt, hsa
ucucuaugccagauaaacacuuucuccuuacucaucaaucaagaauaaaauuuucuacaucaaa

SEQ ID NO: 273555 - RNA, 64 nt, hsa
gaacgaaaaagagguagcacuacaaacacaauauucaaucaaaauuucagcauuauugaaauug

SEQ ID NO: 273556 - RNA, 64 nt, hsa
augcaauuuuuauuuugguuauauuacaaaaaugucaaucaaauauuaaaaaauaguuaaugug

SEQ ID NO: 273557 - RNA, 64 nt, hsa
agcuuucuucccgaaccccaaggagggagauggaucaaucaaacccggcgguccccuccgccag

SEQ ID NO: 273558 - RNA, 64 nt, hsa
ucaucuuuucaccccaccuucaaucaacaaguccucaaucaacaaguccuacugacugcacauc

SEQ ID NO: 273559 - RNA, 64 nt, hsa
agccagaaaccugugucaucuuuucaccccaccuucaaucaacaaguccucaaucaacaagucc

SEQ ID NO: 273560 - RNA, 64 nt, hsa
gcaguguaucuuuuuguaaaguuugcaacaauccucaaucaagucuauggaaaaauuauuuaua

SEQ ID NO: 273561 - RNA, 64 nt, hsa
gauugcccagguggaaagaaaccuuagccagcguucaaucaagcucaccaugcagggcagucac

SEQ ID NO: 273562 - RNA, 64 nt, hsa
acuuuguggcugaggggucaguuaccagugaccuucaaucaacuccaucacuucuuaaaucggu

SEQ ID NO: 273563 - RNA, 64 nt, hsa
gcaguuagggauuuggcauuuuauauauguugauucaaucaaguuuggcaagcaggguguucga

SEQ ID NO: 273564 - RNA, 64 nt, hsa
cuugguucuacauauuuuagggaggcaugaggcaucaaucaaauacauuuaaggaguguagggg

SEQ ID NO: 273565 - RNA, 64 nt, hsa
cagauuucgugauccuugauuaacuucugaguacucaaucaaucauaauccuuuugcugcuuau

SEQ ID NO: 273566 - RNA, 64 nt, hsa
cugacaaaacuguugcugcacacaucuguacucgucaaucaacaaaaccugaugcaaaaaacag

SEQ ID NO: 273567 - RNA, 64 nt, hsa
ucuaaaagcauauaagagcuugucaauagagcaaucaaucaaaaagauuuugugauucauaaca

SEQ ID NO: 273568 - RNA, 64 nt, hsa
gauuucauacguacccagggagcaugcuguuuugucaaucaauauaaaauauuuaugaggucuc

SEQ ID NO: 273569 - RNA, 64 nt, hsa
cauuauuuauauggggaauauauuuuuagacucaucaaucaaauaaguauuuauaauagcaacu

SEQ ID NO: 273570 - RNA, 64 nt, hsa
guaacacgaaauugcugucaaaagcuuauuagcaucaaucaagauucuaggucuccaaaaguac

SEQ ID NO: 273571 - RNA, 64 nt, hsa
auuccuuaucucagaaaacagaaaccgggcucagucaaucaaugcuuuauuucaggccgaauga

SEQ ID NO: 273572 - RNA, 64 nt, hsa
guucaauugauguagacuguuagagcaaguauacucaaucaacuugcugauauuuuaguaguua

SEQ ID NO: 273573 - RNA, 64 nt, hsa
aacaucuugcacacaauuugaauuauguagaaugucaaucaaguuuuuguauauuuaaaaguug

SEQ ID NO: 273574 - RNA, 64 nt, hsa
uguuccugucucagcaaccaagggauuguuccugucaaucaaugguuuauuggaagguggccca

SEQ ID NO: 273575 - RNA, 64 nt, hsa
uacuguguuuuuauuccucuaacuuccuuaaugaucaaucaaaaaaaguaacacccucccuuuu

SEQ ID NO: 273576 - RNA, 64 nt, hsa
agucuauuguuuaaagagaaggugcauuuguuccucaaucaagcaagagcaccuguguuguacu

SEQ ID NO: 273577 - RNA, 64 nt, hsa
aacaaagggcccacucuaguucucuacaugucaaucaaucaagcauguugaauaagggacauag

SEQ ID NO: 273578 - RNA, 64 nt, hsa
ucagaacaaagggcccacucuaguucucuacaugucaaucaaucaagcauguugaauaagggac

SEQ ID NO: 273579 - RNA, 64 nt, hsa
gcccuggcaauuaacugaaagggcaaagucuuaaucaaucaaacaauggaggaaucaccgacuu

SEQ ID NO: 273580 - RNA, 64 nt, hsa
cccccaaagaguuuucugugcaaaaucuugagaaucaaucaauaaagaaagauggaaggaaggg

SEQ ID NO: 273581 - RNA, 64 nt, hsa
ccgaggucuccuugguggguggcaggauuuaaauucaaucaaauccuguccuagugugugcagu

SEQ ID NO: 273582 - RNA, 64 nt, hsa
auuacaaguauucaguuccaauacuucauuaauuucaaucaaccaaaguuaguucaguagcuua

SEQ ID NO: 273583 - RNA, 64 nt, hsa
acugauguguugaaccuuauucuuguacauucauucaaucaaggcaaacuuuuauaauuuuucu

SEQ ID NO: 273584 - RNA, 64 nt, hsa
uugcacauaaaaaauaccgaagaaaacccaaaauucaaucaacaauucugucuuauugaagagu

SEQ ID NO: 273585 - RNA, 64 nt, hsa
ugaagcugaugggugccagcccugcauugcugagucaaucaauaaagagcuuucuuuugaccca

SEQ ID NO: 273586 - RNA, 64 nt, hsa; identical to SEQ ID NO: 273585

SEQ ID NO: 273587 - RNA, 64 nt, hsa
cagagugagacucugucucaaaccaaucaaucaaucaaucaaucacuguccuggccaguugcag

SEQ ID NO: 273588 - RNA, 64 nt, hsa
acgacagagugagacucugucucaaaccaaucaaucaaucaaucaaucacuguccuggccaguu

SEQ ID NO: 273589 - RNA, 64 nt, hsa
cuggacgacagagugagacucugucucaaaccaaucaaucaaucaaucaaucacuguccuggcc

SEQ ID NO: 273590 - RNA, 64 nt, hsa
acucauccaacucccucuucacugguacucccaaucaaucaaagaaccucaaaauuuaaacuga

SEQ ID NO: 273591 - RNA, 64 nt, hsa
gaggguuuggcaccauucucauucuuuaucccacucaaucaaaggaacucugggaaggagguug

SEQ ID NO: 273592 - RNA, 64 nt, hsa
ugguuuagagguucacugcugcuuugucacuuucucaaucaaauuggccacuuaagaaauaaag

SEQ ID NO: 273593 - RNA, 64 nt, hsa
uauguuuuggcgaguagccagucuuucuuuaacaucaaucaaccguagcaauguggucaucacg

SEQ ID NO: 273594 - RNA, 64 nt, hsa
agacacaggaaaaauaaacguggauuuuaaaaaaucaaucaauggugcaaaaaaaaacuuaaag

SEQ ID NO: 273595 - RNA, 64 nt, hsa
ggguucuaauuccuuguccuagaauccccaugacucaaucaaggacugugcuaaaugagauugu

SEQ ID NO: 273596 - RNA, 64 nt, hsa
gccucauaccauaugucuaaauauuuaaaaguuaucaaucaagcuaacaacuguuaaauaaaau

SEQ ID NO: 273597 - RNA, 64 nt, hsa
ucuuagaaauauuuuuuguuugcugaaauaaagcucaaucaacacacuaccuuaaaaaaaaagu

SEQ ID NO: 273598 - RNA, 64 nt, hsa
cugacaggacugcaagagggagaaaggaauuuugucaaucaaaauuauucuguauugcaacuuu

SEQ ID NO: 273599 - RNA, 64 nt, hsa
agcugugccgccgcggguccaccgaggacgccaaucaaucaacccaacaccacaagcuugguug

SEQ ID NO: 273600 - RNA, 64 nt, hsa
ugauucuagcccauuuuccugauucucuggcuugucaaucaagaguauccuccaaaucucuuga

SEQ ID NO: 273601 - RNA, 64 nt, hsa
gguucaaaccagagaauucaugcugcagggaaacucaaucaauguuauugugaaaacugggaau

SEQ ID NO: 273602 - RNA, 64 nt, hsa
aaaguaaccuuccuugaaguguaucuauccguaaucaaucaaguugcugcagccuaugcacugg

SEQ ID NO: 273603 - RNA, 64 nt, hsa
uuguacuccaucaauauaauacaauuauuauuugucaaucaaauauuaauaaaaucaaagauga

SEQ ID NO: 273604 - RNA, 64 nt, hsa
uaugaaaagcaaggauagcuuaauuuucaaaaacucaaucaauguaauucaguauuuuaacaaa

SEQ ID NO: 273605 - RNA, 64 nt, hsa
gaaauggugaauuucgugguaugugaauucuaccucaaucaaaaaaauuugcuauuuuaucuca

SEQ ID NO: 273606 - RNA, 64 nt, hsa
uggucauauaagagugcagcaguuugacacacuuucaaucaagagguggaaucuacaucccucu

SEQ ID NO: 273607 - RNA, 64 nt, hsa
gaaggugaguuagaauaauauauuggagcagcaaucaaucaaugccuacaguucuucuaugauu

SEQ ID NO: 273608 - RNA, 64 nt, hsa
ccaucuagaaauaaaccauaguauuuauguugaaucaaucaauauuauauuuuguuuuuuuccu

SEQ ID NO: 273609 - RNA, 64 nt, hsa
cucagauggguaagacaugaguuugaaaagagacucaaucaaggcaauguaaauucugcuaaaa

SEQ ID NO: 273610 - RNA, 64 nt, hsa
ucauaccuauuaaagcuguucauuguaacaaaauucaaucaaaaaggcagcuaggucagaagga

SEQ ID NO: 273611 - RNA, 64 nt, hsa
gaauugacuuauacucuugagaaugaauucaguuucaaucaaguuuacauuauguugcuuaaaa

SEQ ID NO: 273612 - RNA, 64 nt, hsa
aaucaauauaauuuauuuauguaagaaaaauaacucaaucaauauauuuuugaaccuuuuaagu

SEQ ID NO: 273613 - RNA, 64 nt, hsa
ggucuaaggauuagaaaacucuaaaguucugacuucaaucaacgguuagugugauacugccaaa

SEQ ID NO: 273614 - RNA, 64 nt, hsa
caucucauccacguaguaaagugaacuuaaaaauucaaucaaaugaacaauuaaauaaacaccu

SEQ ID NO: 273615 - RNA, 64 nt, hsa
ucuuagcaaugaaauugcuguuaaaacacaaauuucaaucaaauacuuuuguguauagaaaaua

SEQ ID NO: 273616 - RNA, 64 nt, hsa
acuggacagcgguuguaaauacaauucaaacaauucaaucaaagcuaccuuuuuuuuacggaau

SEQ ID NO: 273617 - RNA, 64 nt, hsa
uguauccugacagcgccaugugugucagcccaugucaaucaagaugggugauuaugaaaugcca

SEQ ID NO: 273618 - RNA, 64 nt, hsa
ccucucuucuacccagugcccugugugcugacccucaaucaagauggcaccgugugggugacag

SEQ ID NO: 273619 - RNA, 64 nt, hsa
uuguagguugaaacugaaaaauaaguuaaaaugaucaaucaagauaaaaggugaucuauccauc

SEQ ID NO: 273620 - RNA, 64 nt, hsa
aaccuacucaacacagcacucuaggcagccacuaucaaucaauugaaguugacacucugcauua

SEQ ID NO: 273621 - RNA, 64 nt, hsa
uucaagcugaaugacuuauaugagaauaauacguucaaucaaaguaguuauucuauuuuguguc

SEQ ID NO: 273622 - RNA, 64 nt, hsa
guuuuuagcauucuaaauuuaaaugcuuaaaacgucaaucaacaaaacuuuguuuuaaauauug

SEQ ID NO: 273623 - RNA, 64 nt, hsa
cuauccagccacucugaccagccgaaccaggaacucaaucaaaaugcgccacagcaggaccaca

SEQ ID NO: 273624 - RNA, 64 nt, hsa
cuauccagccacucugaccagccgaacgaggaacucaaucaaaaugagccauagcgggaccaca

SEQ ID NO: 273625 - RNA, 64 nt, hsa
auuccauacugagagccuaucuacacauuuauuuucaaucaauaaaugcugcuuuuaaaaccuu

SEQ ID NO: 273626 - RNA, 64 nt, hsa
auucaaucaagauccgugcucgcagugggcugauucaaucaagauguauguuugcuauguucua

SEQ ID NO: 273627 - RNA, 64 nt, hsa
guauguagaccuaaaacuacaccaauaggcugauucaaucaagauccgugcucgcagugggcug

SEQ ID NO: 273628 - RNA, 64 nt, hsa
cugauagaccaaaaaacuacaccaguagguugauucaaucaagauguauguagaccuaaaacua

SEQ ID NO: 273629 - RNA, 64 nt, hsa
guuauacccggggcacucuaaccaucacaaucaaucaaucaaauucccuuaaauuuguauggca

SEQ ID NO: 273630 - RNA, 64 nt, hsa
cacuguuauacccggggcacucuaaccaucacaaucaaucaaucaaauucccuuaaauuuguau

SEQ ID NO: 273631 - RNA, 64 nt, hsa
uucaaacugaaugacuuauaugagaauaauauguucaaucaaaguaguuauucuauuuuguguc

SEQ ID NO: 273632 - RNA, 62 nt, hsa; identical to SEQ ID NO: 273115

SEQ ID NO: 273633 - RNA, 62 nt, hsa; identical to SEQ ID NO: 273116

SEQ ID NO: 273634 - RNA, 62 nt, hsa; identical to SEQ ID NO: 273117

SEQ ID NO: 273635 - RNA, 62 nt, hsa; identical to SEQ ID NO: 273118

SEQ ID NO: 273636 - RNA, 62 nt, hsa; identical to SEQ ID NO: 273119

SEQ ID NO: 273637 - RNA, 62 nt, hsa; identical to SEQ ID NO: 273120

SEQ ID NO: 273638 - RNA, 62 nt, hsa; identical to SEQ ID NO: 273121

SEQ ID NO: 273639 - RNA, 62 nt, hsa; identical to SEQ ID NO: 273122

SEQ ID NO: 273640 - RNA, 62 nt, hsa; identical to SEQ ID NO: 273123

SEQ ID NO: 273641 - RNA, 60 nt, hsa; identical to SEQ ID NO: 273124

SEQ ID NO: 273642 - RNA, 62 nt, hsa; identical to SEQ ID NO: 273125

SEQ ID NO: 273643 - RNA, 62 nt, hsa; identical to SEQ ID NO: 273126

SEQ ID NO: 273644 - RNA, 62 nt, hsa; identical to SEQ ID NO: 273127

SEQ ID NO: 273645 - RNA, 62 nt, hsa; identical to SEQ ID NO: 273128

SEQ ID NO: 273646 - RNA, 62 nt, hsa; identical to SEQ ID NO: 273129

SEQ ID NO: 273647 - RNA, 62 nt, hsa; identical to SEQ ID NO: 273130

SEQ ID NO: 273648 - RNA, 62 nt, hsa; identical to SEQ ID NO: 273131

SEQ ID NO: 273649 - RNA, 62 nt, hsa; identical to SEQ ID NO: 273132

SEQ ID NO: 273650 - RNA, 62 nt, hsa; identical to SEQ ID NO: 273133

SEQ ID NO: 273651 - RNA, 62 nt, hsa; identical to SEQ ID NO: 273134

SEQ ID NO: 273652 - RNA, 62 nt, hsa; identical to SEQ ID NO: 273135

SEQ ID NO: 273653 - RNA, 62 nt, hsa; identical to SEQ ID NO: 273136

SEQ ID NO: 273654 - RNA, 62 nt, hsa; identical to SEQ ID NO: 273137

SEQ ID NO: 273655 - RNA, 62 nt, hsa; identical to SEQ ID NO: 273138

SEQ ID NO: 273656 - RNA, 62 nt, hsa; identical to SEQ ID NO: 273139

SEQ ID NO: 273657 - RNA, 62 nt, hsa; identical to SEQ ID NO: 273140

SEQ ID NO: 273658 - RNA, 62 nt, hsa; identical to SEQ ID NO: 273141

SEQ ID NO: 273659 - RNA, 62 nt, hsa; identical to SEQ ID NO: 273142

SEQ ID NO: 273660 - RNA, 62 nt, hsa; identical to SEQ ID NO: 273143

SEQ ID NO: 273661 - RNA, 62 nt, hsa; identical to SEQ ID NO: 273144

SEQ ID NO: 273662 - RNA, 62 nt, hsa; identical to SEQ ID NO: 273145

SEQ ID NO: 273663 - RNA, 62 nt, hsa; identical to SEQ ID NO: 273146

SEQ ID NO: 273664 - RNA, 62 nt, hsa; identical to SEQ ID NO: 273147

SEQ ID NO: 273665 - RNA, 62 nt, hsa; identical to SEQ ID NO: 273148

SEQ ID NO: 273666 - RNA, 62 nt, hsa; identical to SEQ ID NO: 273149

SEQ ID NO: 273667 - RNA, 62 nt, hsa; identical to SEQ ID NO: 273150

SEQ ID NO: 273668 - RNA, 62 nt, hsa; identical to SEQ ID NO: 273151

SEQ ID NO: 273669 - RNA, 62 nt, hsa; identical to SEQ ID NO: 273152

SEQ ID NO: 273670 - RNA, 62 nt, hsa; identical to SEQ ID NO: 273153

SEQ ID NO: 273671 - RNA, 62 nt, hsa; identical to SEQ ID NO: 273154

SEQ ID NO: 273672 - RNA, 62 nt, hsa; identical to SEQ ID NO: 273155

SEQ ID NO: 273673 - RNA, 62 nt, hsa; identical to SEQ ID NO: 273156

SEQ ID NO: 273674 - RNA, 62 nt, hsa; identical to SEQ ID NO: 273157

SEQ ID NO: 273675 - RNA, 62 nt, hsa; identical to SEQ ID NO: 273158

SEQ ID NO: 273676 - RNA, 62 nt, hsa; identical to SEQ ID NO: 273159

SEQ ID NO: 273677 - RNA, 62 nt, hsa; identical to SEQ ID NO: 273160

SEQ ID NO: 273678 - RNA, 62 nt, hsa; identical to SEQ ID NO: 273161

SEQ ID NO: 273679 - RNA, 62 nt, hsa; identical to SEQ ID NO: 273162

SEQ ID NO: 273680 - RNA, 62 nt, hsa; identical to SEQ ID NO: 273163

SEQ ID NO: 273681 - RNA, 62 nt, hsa; identical to SEQ ID NO: 273164

SEQ ID NO: 273682 - RNA, 62 nt, hsa; identical to SEQ ID NO: 273165

SEQ ID NO: 273683 - RNA, 62 nt, hsa; identical to SEQ ID NO: 273166

SEQ ID NO: 273684 - RNA, 62 nt, hsa; identical to SEQ ID NO: 273167

SEQ ID NO: 273685 - RNA, 62 nt, hsa; identical to SEQ ID NO: 273168

SEQ ID NO: 273686 - RNA, 62 nt, hsa; identical to SEQ ID NO: 273169

SEQ ID NO: 273687 - RNA, 62 nt, hsa; identical to SEQ ID NO: 273170

SEQ ID NO: 273688 - RNA, 62 nt, hsa; identical to SEQ ID NO: 273171

SEQ ID NO: 273689 - RNA, 62 nt, hsa; identical to SEQ ID NO: 273172

SEQ ID NO: 273690 - RNA, 62 nt, hsa; identical to SEQ ID NO: 273173

SEQ ID NO: 273691 - RNA, 62 nt, hsa; identical to SEQ ID NO: 273174

SEQ ID NO: 273692 - RNA, 62 nt, hsa; identical to SEQ ID NO: 273175

SEQ ID NO: 273693 - RNA, 62 nt, hsa; identical to SEQ ID NO: 273176

SEQ ID NO: 273694 - RNA, 62 nt, hsa; identical to SEQ ID NO: 273177

SEQ ID NO: 273695 - RNA, 62 nt, hsa; identical to SEQ ID NO: 273178

SEQ ID NO: 273696 - RNA, 62 nt, hsa; identical to SEQ ID NO: 273179

SEQ ID NO: 273697 - RNA, 62 nt, hsa; identical to SEQ ID NO: 273180

SEQ ID NO: 273698 - RNA, 62 nt, hsa; identical to SEQ ID NO: 273181

SEQ ID NO: 273699 - RNA, 62 nt, hsa; identical to SEQ ID NO: 273182

SEQ ID NO: 273700 - RNA, 62 nt, hsa; identical to SEQ ID NO: 273183

SEQ ID NO: 273701 - RNA, 62 nt, hsa; identical to SEQ ID NO: 273184

SEQ ID NO: 273702 - RNA, 62 nt, hsa; identical to SEQ ID NO: 273185

SEQ ID NO: 273703 - RNA, 62 nt, hsa; identical to SEQ ID NO: 273186

SEQ ID NO: 273704 - RNA, 62 nt, hsa; identical to SEQ ID NO: 273187

SEQ ID NO: 273705 - RNA, 62 nt, hsa; identical to SEQ ID NO: 273188

SEQ ID NO: 273706 - RNA, 60 nt, hsa; identical to SEQ ID NO: 273189

SEQ ID NO: 273707 - RNA, 62 nt, hsa; identical to SEQ ID NO: 273190

SEQ ID NO: 273708 - RNA, 62 nt, hsa; identical to SEQ ID NO: 273191

SEQ ID NO: 273709 - RNA, 62 nt, hsa; identical to SEQ ID NO: 273192

SEQ ID NO: 273710 - RNA, 62 nt, hsa; identical to SEQ ID NO: 273193

SEQ ID NO: 273711 - RNA, 62 nt, hsa; identical to SEQ ID NO: 273194

SEQ ID NO: 273712 - RNA, 62 nt, hsa; identical to SEQ ID NO: 273195

SEQ ID NO: 273713 - RNA, 62 nt, hsa; identical to SEQ ID NO: 273196

SEQ ID NO: 273714 - RNA, 62 nt, hsa; identical to SEQ ID NO: 273197

SEQ ID NO: 273715 - RNA, 62 nt, hsa; identical to SEQ ID NO: 273198

SEQ ID NO: 273716 - RNA, 62 nt, hsa; identical to SEQ ID NO: 273199

SEQ ID NO: 273717 - RNA, 62 nt, hsa; identical to SEQ ID NO: 273200

SEQ ID NO: 273718 - RNA, 62 nt, hsa; identical to SEQ ID NO: 273201

SEQ ID NO: 273719 - RNA, 62 nt, hsa; identical to SEQ ID NO: 273202

SEQ ID NO: 273720 - RNA, 62 nt, hsa; identical to SEQ ID NO: 273203

SEQ ID NO: 273721 - RNA, 62 nt, hsa; identical to SEQ ID NO: 273204

SEQ ID NO: 273722 - RNA, 62 nt, hsa; identical to SEQ ID NO: 273205

SEQ ID NO: 273723 - RNA, 62 nt, hsa; identical to SEQ ID NO: 273206

SEQ ID NO: 273724 - RNA, 62 nt, hsa; identical to SEQ ID NO: 273207

SEQ ID NO: 273725 - RNA, 62 nt, hsa; identical to SEQ ID NO: 273208

SEQ ID NO: 273726 - RNA, 62 nt, hsa; identical to SEQ ID NO: 273209

SEQ ID NO: 273727 - RNA, 62 nt, hsa; identical to SEQ ID NO: 273210

SEQ ID NO: 273728 - RNA, 62 nt, hsa; identical to SEQ ID NO: 273211

SEQ ID NO: 273729 - RNA, 62 nt, hsa; identical to SEQ ID NO: 273212

SEQ ID NO: 273730 - RNA, 62 nt, hsa; identical to SEQ ID NO: 273213

SEQ ID NO: 273731 - RNA, 62 nt, hsa; identical to SEQ ID NO: 273214

SEQ ID NO: 273732 - RNA, 62 nt, hsa; identical to SEQ ID NO: 273215

SEQ ID NO: 273733 - RNA, 62 nt, hsa; identical to SEQ ID NO: 273216

SEQ ID NO: 273734 - RNA, 62 nt, hsa; identical to SEQ ID NO: 273217

SEQ ID NO: 273735 - RNA, 62 nt, hsa; identical to SEQ ID NO: 273218

SEQ ID NO: 273736 - RNA, 62 nt, hsa; identical to SEQ ID NO: 273219

SEQ ID NO: 273737 - RNA, 62 nt, hsa; identical to SEQ ID NO: 273220

SEQ ID NO: 273738 - RNA, 62 nt, hsa; identical to SEQ ID NO: 273221

SEQ ID NO: 273739 - RNA, 62 nt, hsa; identical to SEQ ID NO: 273222

SEQ ID NO: 273740 - RNA, 62 nt, hsa; identical to SEQ ID NO: 273223

SEQ ID NO: 273741 - RNA, 62 nt, hsa; identical to SEQ ID NO: 273224

SEQ ID NO: 273742 - RNA, 62 nt, hsa; identical to SEQ ID NO: 273225

SEQ ID NO: 273743 - RNA, 62 nt, hsa; identical to SEQ ID NO: 273226

SEQ ID NO: 273744 - RNA, 62 nt, hsa; identical to SEQ ID NO: 273227

SEQ ID NO: 273745 - RNA, 62 nt, hsa; identical to SEQ ID NO: 273228

SEQ ID NO: 273746 - RNA, 62 nt, hsa; identical to SEQ ID NO: 273229

SEQ ID NO: 273747 - RNA, 62 nt, hsa; identical to SEQ ID NO: 273230

SEQ ID NO: 273748 - RNA, 62 nt, hsa; identical to SEQ ID NO: 273231

SEQ ID NO: 273749 - RNA, 62 nt, hsa; identical to SEQ ID NO: 273232

SEQ ID NO: 273750 - RNA, 62 nt, hsa; identical to SEQ ID NO: 273233

SEQ ID NO: 273751 - RNA, 62 nt, hsa; identical to SEQ ID NO: 273234

SEQ ID NO: 273752 - RNA, 62 nt, hsa; identical to SEQ ID NO: 273235

SEQ ID NO: 273753 - RNA, 62 nt, hsa; identical to SEQ ID NO: 273236

SEQ ID NO: 273754 - RNA, 62 nt, hsa; identical to SEQ ID NO: 273237

SEQ ID NO: 273755 - RNA, 62 nt, hsa; identical to SEQ ID NO: 273238

SEQ ID NO: 273756 - RNA, 62 nt, hsa; identical to SEQ ID NO: 273239

SEQ ID NO: 273757 - RNA, 62 nt, hsa; identical to SEQ ID NO: 273240

SEQ ID NO: 273758 - RNA, 62 nt, hsa; identical to SEQ ID NO: 273241

SEQ ID NO: 273759 - RNA, 62 nt, hsa; identical to SEQ ID NO: 273242

SEQ ID NO: 273760 - RNA, 62 nt, hsa; identical to SEQ ID NO: 273243

SEQ ID NO: 273761 - RNA, 62 nt, hsa; identical to SEQ ID NO: 273244

SEQ ID NO: 273762 - RNA, 62 nt, hsa; identical to SEQ ID NO: 273245

SEQ ID NO: 273763 - RNA, 62 nt, hsa; identical to SEQ ID NO: 273246

SEQ ID NO: 273764 - RNA, 62 nt, hsa; identical to SEQ ID NO: 273247

SEQ ID NO: 273765 - RNA, 62 nt, hsa; identical to SEQ ID NO: 273248

SEQ ID NO: 273766 - RNA, 62 nt, hsa; identical to SEQ ID NO: 273249

SEQ ID NO: 273767 - RNA, 62 nt, hsa; identical to SEQ ID NO: 273250

SEQ ID NO: 273768 - RNA, 62 nt, hsa; identical to SEQ ID NO: 273251

SEQ ID NO: 273769 - RNA, 62 nt, hsa; identical to SEQ ID NO: 273252

SEQ ID NO: 273770 - RNA, 62 nt, hsa; identical to SEQ ID NO: 273253

SEQ ID NO: 273771 - RNA, 62 nt, hsa; identical to SEQ ID NO: 273254

SEQ ID NO: 273772 - RNA, 62 nt, hsa; identical to SEQ ID NO: 273255

SEQ ID NO: 273773 - RNA, 62 nt, hsa; identical to SEQ ID NO: 273256

SEQ ID NO: 273774 - RNA, 62 nt, hsa; identical to SEQ ID NO: 273257

SEQ ID NO: 273775 - RNA, 62 nt, hsa; identical to SEQ ID NO: 273258

SEQ ID NO: 273776 - RNA, 62 nt, hsa; identical to SEQ ID NO: 273259

SEQ ID NO: 273777 - RNA, 62 nt, hsa; identical to SEQ ID NO: 273260

SEQ ID NO: 273778 - RNA, 62 nt, hsa; identical to SEQ ID NO: 273261

SEQ ID NO: 273779 - RNA, 62 nt, hsa; identical to SEQ ID NO: 273262

SEQ ID NO: 273780 - RNA, 62 nt, hsa; identical to SEQ ID NO: 273263

SEQ ID NO: 273781 - RNA, 62 nt, hsa; identical to SEQ ID NO: 273264

SEQ ID NO: 273782 - RNA, 62 nt, hsa; identical to SEQ ID NO: 273265

SEQ ID NO: 273783 - RNA, 62 nt, hsa; identical to SEQ ID NO: 273266

SEQ ID NO: 273784 - RNA, 62 nt, hsa; identical to SEQ ID NO: 273267

SEQ ID NO: 273785 - RNA, 62 nt, hsa; identical to SEQ ID NO: 273268

SEQ ID NO: 273786 - RNA, 62 nt, hsa; identical to SEQ ID NO: 273269

SEQ ID NO: 273787 - RNA, 62 nt, hsa; identical to SEQ ID NO: 273270

SEQ ID NO: 273788 - RNA, 62 nt, hsa; identical to SEQ ID NO: 273271

SEQ ID NO: 273789 - RNA, 62 nt, hsa; identical to SEQ ID NO: 273272

SEQ ID NO: 273790 - RNA, 62 nt, hsa; identical to SEQ ID NO: 273273

SEQ ID NO: 273791 - RNA, 62 nt, hsa; identical to SEQ ID NO: 273274

SEQ ID NO: 273792 - RNA, 62 nt, hsa; identical to SEQ ID NO: 273275

SEQ ID NO: 273793 - RNA, 62 nt, hsa; identical to SEQ ID NO: 273276

SEQ ID NO: 273794 - RNA, 62 nt, hsa; identical to SEQ ID NO: 273277

SEQ ID NO: 273795 - RNA, 62 nt, hsa; identical to SEQ ID NO: 273278

SEQ ID NO: 273796 - RNA, 62 nt, hsa; identical to SEQ ID NO: 273279

SEQ ID NO: 273797 - RNA, 62 nt, hsa; identical to SEQ ID NO: 273280

SEQ ID NO: 273798 - RNA, 62 nt, hsa; identical to SEQ ID NO: 273281

SEQ ID NO: 273799 - RNA, 62 nt, hsa; identical to SEQ ID NO: 273282

SEQ ID NO: 273800 - RNA, 62 nt, hsa; identical to SEQ ID NO: 273283

SEQ ID NO: 273801 - RNA, 51 nt, hsa; identical to SEQ ID NO: 273284

SEQ ID NO: 273802 - RNA, 62 nt, hsa; identical to SEQ ID NO: 273285

SEQ ID NO: 273803 - RNA, 62 nt, hsa; identical to SEQ ID NO: 273286

SEQ ID NO: 273804 - RNA, 62 nt, hsa; identical to SEQ ID NO: 273287

SEQ ID NO: 273805 - RNA, 62 nt, hsa; identical to SEQ ID NO: 273288

SEQ ID NO: 273806 - RNA, 62 nt, hsa; identical to SEQ ID NO: 273289

SEQ ID NO: 273807 - RNA, 62 nt, hsa; identical to SEQ ID NO: 273290

SEQ ID NO: 273808 - RNA, 62 nt, hsa; identical to SEQ ID NO: 273291

SEQ ID NO: 273809 - RNA, 62 nt, hsa; identical to SEQ ID NO: 273292

SEQ ID NO: 273810 - RNA, 62 nt, hsa; identical to SEQ ID NO: 273293

SEQ ID NO: 273811 - RNA, 62 nt, hsa; identical to SEQ ID NO: 273294

SEQ ID NO: 273812 - RNA, 62 nt, hsa; identical to SEQ ID NO: 273295

SEQ ID NO: 273813 - RNA, 62 nt, hsa; identical to SEQ ID NO: 273296

SEQ ID NO: 273814 - RNA, 62 nt, hsa; identical to SEQ ID NO: 273297

SEQ ID NO: 273815 - RNA, 62 nt, hsa; identical to SEQ ID NO: 273298

SEQ ID NO: 273816 - RNA, 62 nt, hsa; identical to SEQ ID NO: 273299

SEQ ID NO: 273817 - RNA, 62 nt, hsa; identical to SEQ ID NO: 273300

SEQ ID NO: 273818 - RNA, 62 nt, hsa; identical to SEQ ID NO: 273301

SEQ ID NO: 273819 - RNA, 62 nt, hsa; identical to SEQ ID NO: 273302

SEQ ID NO: 273820 - RNA, 62 nt, hsa; identical to SEQ ID NO: 273303

SEQ ID NO: 273821 - RNA, 62 nt, hsa; identical to SEQ ID NO: 273304

SEQ ID NO: 273822 - RNA, 62 nt, hsa; identical to SEQ ID NO: 273305

SEQ ID NO: 273823 - RNA, 62 nt, hsa; identical to SEQ ID NO: 273306

SEQ ID NO: 273824 - RNA, 62 nt, hsa; identical to SEQ ID NO: 273307

SEQ ID NO: 273825 - RNA, 62 nt, hsa; identical to SEQ ID NO: 273308

SEQ ID NO: 273826 - RNA, 62 nt, hsa; identical to SEQ ID NO: 273309

SEQ ID NO: 273827 - RNA, 64 nt, hsa; identical to SEQ ID NO: 273310

SEQ ID NO: 273828 - RNA, 64 nt, hsa; identical to SEQ ID NO: 273311

SEQ ID NO: 273829 - RNA, 64 nt, hsa; identical to SEQ ID NO: 273312

SEQ ID NO: 273830 - RNA, 64 nt, hsa; identical to SEQ ID NO: 273313

SEQ ID NO: 273831 - RNA, 64 nt, hsa; identical to SEQ ID NO: 273314

SEQ ID NO: 273832 - RNA, 64 nt, hsa; identical to SEQ ID NO: 273315

SEQ ID NO: 273833 - RNA, 64 nt, hsa; identical to SEQ ID NO: 273316

SEQ ID NO: 273834 - RNA, 64 nt, hsa; identical to SEQ ID NO: 273317

SEQ ID NO: 273835 - RNA, 64 nt, hsa; identical to SEQ ID NO: 273318

SEQ ID NO: 273836 - RNA, 64 nt, hsa; identical to SEQ ID NO: 273319

SEQ ID NO: 273837 - RNA, 64 nt, hsa; identical to SEQ ID NO: 189841

SEQ ID NO: 273838 - RNA, 64 nt, hsa; identical to SEQ ID NO: 189842

SEQ ID NO: 273839 - RNA, 64 nt, hsa; identical to SEQ ID NO: 273322

SEQ ID NO: 273840 - RNA, 64 nt, hsa; identical to SEQ ID NO: 273323

SEQ ID NO: 273841 - RNA, 64 nt, hsa; identical to SEQ ID NO: 273324

SEQ ID NO: 273842 - RNA, 64 nt, hsa; identical to SEQ ID NO: 273325

SEQ ID NO: 273843 - RNA, 64 nt, hsa; identical to SEQ ID NO: 273326

SEQ ID NO: 273844 - RNA, 64 nt, hsa; identical to SEQ ID NO: 273327

SEQ ID NO: 273845 - RNA, 64 nt, hsa; identical to SEQ ID NO: 273328

SEQ ID NO: 273846 - RNA, 64 nt, hsa; identical to SEQ ID NO: 273329

SEQ ID NO: 273847 - RNA, 64 nt, hsa; identical to SEQ ID NO: 273330

SEQ ID NO: 273848 - RNA, 64 nt, hsa; identical to SEQ ID NO: 273331

SEQ ID NO: 273849 - RNA, 64 nt, hsa; identical to SEQ ID NO: 273332

SEQ ID NO: 273850 - RNA, 64 nt, hsa; identical to SEQ ID NO: 273333

SEQ ID NO: 273851 - RNA, 64 nt, hsa; identical to SEQ ID NO: 273334

SEQ ID NO: 273852 - RNA, 64 nt, hsa; identical to SEQ ID NO: 273335

SEQ ID NO: 273853 - RNA, 64 nt, hsa; identical to SEQ ID NO: 273336

SEQ ID NO: 273854 - RNA, 64 nt, hsa; identical to SEQ ID NO: 273337

SEQ ID NO: 273855 - RNA, 64 nt, hsa; identical to SEQ ID NO: 273338

SEQ ID NO: 273856 - RNA, 64 nt, hsa; identical to SEQ ID NO: 273339

SEQ ID NO: 273857 - RNA, 64 nt, hsa; identical to SEQ ID NO: 273340

SEQ ID NO: 273858 - RNA, 64 nt, hsa; identical to SEQ ID NO: 273341

SEQ ID NO: 273859 - RNA, 64 nt, hsa; identical to SEQ ID NO: 273342

SEQ ID NO: 273860 - RNA, 64 nt, hsa; identical to SEQ ID NO: 273343

SEQ ID NO: 273861 - RNA, 64 nt, hsa; identical to SEQ ID NO: 273344

SEQ ID NO: 273862 - RNA, 64 nt, hsa; identical to SEQ ID NO: 273345

SEQ ID NO: 273863 - RNA, 64 nt, hsa; identical to SEQ ID NO: 273346

SEQ ID NO: 273864 - RNA, 64 nt, hsa; identical to SEQ ID NO: 273347

SEQ ID NO: 273865 - RNA, 64 nt, hsa; identical to SEQ ID NO: 273348

SEQ ID NO: 273866 - RNA, 64 nt, hsa; identical to SEQ ID NO: 273349

SEQ ID NO: 273867 - RNA, 64 nt, hsa; identical to SEQ ID NO: 273350

SEQ ID NO: 273868 - RNA, 64 nt, hsa; identical to SEQ ID NO: 273351

SEQ ID NO: 273869 - RNA, 64 nt, hsa; identical to SEQ ID NO: 273352

SEQ ID NO: 273870 - RNA, 64 nt, hsa; identical to SEQ ID NO: 273353

SEQ ID NO: 273871 - RNA, 64 nt, hsa; identical to SEQ ID NO: 273354

SEQ ID NO: 273872 - RNA, 64 nt, hsa; identical to SEQ ID NO: 273355

SEQ ID NO: 273873 - RNA, 64 nt, hsa; identical to SEQ ID NO: 273356

SEQ ID NO: 273874 - RNA, 64 nt, hsa; identical to SEQ ID NO: 273357

SEQ ID NO: 273875 - RNA, 64 nt, hsa; identical to SEQ ID NO: 273358

SEQ ID NO: 273876 - RNA, 64 nt, hsa; identical to SEQ ID NO: 273359

SEQ ID NO: 273877 - RNA, 64 nt, hsa; identical to SEQ ID NO: 273360

SEQ ID NO: 273878 - RNA, 64 nt, hsa; identical to SEQ ID NO: 273361

SEQ ID NO: 273879 - RNA, 64 nt, hsa; identical to SEQ ID NO: 273362

SEQ ID NO: 273880 - RNA, 64 nt, hsa; identical to SEQ ID NO: 273363

SEQ ID NO: 273881 - RNA, 64 nt, hsa; identical to SEQ ID NO: 273364

SEQ ID NO: 273882 - RNA, 64 nt, hsa; identical to SEQ ID NO: 273365

SEQ ID NO: 273883 - RNA, 64 nt, hsa; identical to SEQ ID NO: 273366

SEQ ID NO: 273884 - RNA, 64 nt, hsa; identical to SEQ ID NO: 273367

SEQ ID NO: 273885 - RNA, 64 nt, hsa; identical to SEQ ID NO: 273368

SEQ ID NO: 273886 - RNA, 64 nt, hsa; identical to SEQ ID NO: 273369

SEQ ID NO: 273887 - RNA, 64 nt, hsa; identical to SEQ ID NO: 273370

SEQ ID NO: 273888 - RNA, 59 nt, hsa; identical to SEQ ID NO: 273371

SEQ ID NO: 273889 - RNA, 64 nt, hsa; identical to SEQ ID NO: 273372

SEQ ID NO: 273890 - RNA, 64 nt, hsa; identical to SEQ ID NO: 273373

SEQ ID NO: 273891 - RNA, 64 nt, hsa; identical to SEQ ID NO: 273374

SEQ ID NO: 273892 - RNA, 64 nt, hsa; identical to SEQ ID NO: 273375

SEQ ID NO: 273893 - RNA, 64 nt, hsa; identical to SEQ ID NO: 273376

SEQ ID NO: 273894 - RNA, 64 nt, hsa; identical to SEQ ID NO: 273377

SEQ ID NO: 273895 - RNA, 64 nt, hsa; identical to SEQ ID NO: 273378

SEQ ID NO: 273896 - RNA, 64 nt, hsa; identical to SEQ ID NO: 273379

SEQ ID NO: 273897 - RNA, 64 nt, hsa; identical to SEQ ID NO: 273380

SEQ ID NO: 273898 - RNA, 64 nt, hsa; identical to SEQ ID NO: 273381

SEQ ID NO: 273899 - RNA, 64 nt, hsa; identical to SEQ ID NO: 273382

SEQ ID NO: 273900 - RNA, 64 nt, hsa; identical to SEQ ID NO: 273383

SEQ ID NO: 273901 - RNA, 52 nt, hsa; identical to SEQ ID NO: 273384

SEQ ID NO: 273902 - RNA, 64 nt, hsa; identical to SEQ ID NO: 273385

SEQ ID NO: 273903 - RNA, 64 nt, hsa; identical to SEQ ID NO: 273386

SEQ ID NO: 273904 - RNA, 64 nt, hsa; identical to SEQ ID NO: 273387

SEQ ID NO: 273905 - RNA, 64 nt, hsa; identical to SEQ ID NO: 273388

SEQ ID NO: 273906 - RNA, 64 nt, hsa; identical to SEQ ID NO: 273389

SEQ ID NO: 273907 - RNA, 64 nt, hsa; identical to SEQ ID NO: 273390

SEQ ID NO: 273908 - RNA, 64 nt, hsa; identical to SEQ ID NO: 273391

SEQ ID NO: 273909 - RNA, 64 nt, hsa; identical to SEQ ID NO: 273392

SEQ ID NO: 273910 - RNA, 64 nt, hsa; identical to SEQ ID NO: 273393

SEQ ID NO: 273911 - RNA, 64 nt, hsa; identical to SEQ ID NO: 273394

SEQ ID NO: 273912 - RNA, 64 nt, hsa; identical to SEQ ID NO: 273395

SEQ ID NO: 273913 - RNA, 64 nt, hsa; identical to SEQ ID NO: 273396

SEQ ID NO: 273914 - RNA, 64 nt, hsa; identical to SEQ ID NO: 273397

SEQ ID NO: 273915 - RNA, 64 nt, hsa; identical to SEQ ID NO: 273398

SEQ ID NO: 273916 - RNA, 64 nt, hsa; identical to SEQ ID NO: 273399

SEQ ID NO: 273917 - RNA, 64 nt, hsa; identical to SEQ ID NO: 273400

SEQ ID NO: 273918 - RNA, 64 nt, hsa; identical to SEQ ID NO: 273401

SEQ ID NO: 273919 - RNA, 64 nt, hsa; identical to SEQ ID NO: 273401

SEQ ID NO: 273920 - RNA, 64 nt, hsa; identical to SEQ ID NO: 273403

SEQ ID NO: 273921 - RNA, 64 nt, hsa; identical to SEQ ID NO: 273404

SEQ ID NO: 273922 - RNA, 64 nt, hsa; identical to SEQ ID NO: 273405

SEQ ID NO: 273923 - RNA, 64 nt, hsa; identical to SEQ ID NO: 273406

SEQ ID NO: 273924 - RNA, 64 nt, hsa; identical to SEQ ID NO: 273407

SEQ ID NO: 273925 - RNA, 64 nt, hsa; identical to SEQ ID NO: 273408

SEQ ID NO: 273926 - RNA, 64 nt, hsa; identical to SEQ ID NO: 273409

SEQ ID NO: 273927 - RNA, 64 nt, hsa; identical to SEQ ID NO: 273410

SEQ ID NO: 273928 - RNA, 64 nt, hsa; identical to SEQ ID NO: 273411

SEQ ID NO: 273929 - RNA, 64 nt, hsa; identical to SEQ ID NO: 273412

SEQ ID NO: 273930 - RNA, 64 nt, hsa; identical to SEQ ID NO: 273413

SEQ ID NO: 273931 - RNA, 64 nt, hsa; identical to SEQ ID NO: 273414

SEQ ID NO: 273932 - RNA, 64 nt, hsa; identical to SEQ ID NO: 273415

SEQ ID NO: 273933 - RNA, 64 nt, hsa; identical to SEQ ID NO: 273416

SEQ ID NO: 273934 - RNA, 64 nt, hsa; identical to SEQ ID NO: 273417

SEQ ID NO: 273935 - RNA, 64 nt, hsa; identical to SEQ ID NO: 273418

SEQ ID NO: 273936 - RNA, 64 nt, hsa; identical to SEQ ID NO: 273419

SEQ ID NO: 273937 - RNA, 64 nt, hsa; identical to SEQ ID NO: 273420

SEQ ID NO: 273938 - RNA, 64 nt, hsa; identical to SEQ ID NO: 273421

SEQ ID NO: 273939 - RNA, 64 nt, hsa; identical to SEQ ID NO: 273422

SEQ ID NO: 273940 - RNA, 64 nt, hsa; identical to SEQ ID NO: 273423

SEQ ID NO: 273941 - RNA, 64 nt, hsa; identical to SEQ ID NO: 273424

SEQ ID NO: 273942 - RNA, 64 nt, hsa; identical to SEQ ID NO: 273425

SEQ ID NO: 273943 - RNA, 64 nt, hsa; identical to SEQ ID NO: 273426

SEQ ID NO: 273944 - RNA, 64 nt, hsa; identical to SEQ ID NO: 273427

SEQ ID NO: 273945 - RNA, 64 nt, hsa; identical to SEQ ID NO: 273428

SEQ ID NO: 273946 - RNA, 64 nt, hsa; identical to SEQ ID NO: 273429

SEQ ID NO: 273947 - RNA, 64 nt, hsa; identical to SEQ ID NO: 273430

SEQ ID NO: 273948 - RNA, 64 nt, hsa; identical to SEQ ID NO: 273431

SEQ ID NO: 273949 - RNA, 64 nt, hsa; identical to SEQ ID NO: 273432

SEQ ID NO: 273950 - RNA, 64 nt, hsa; identical to SEQ ID NO: 273433

SEQ ID NO: 273951 - RNA, 64 nt, hsa; identical to SEQ ID NO: 273434

SEQ ID NO: 273952 - RNA, 64 nt, hsa; identical to SEQ ID NO: 273435

SEQ ID NO: 273953 - RNA, 64 nt, hsa; identical to SEQ ID NO: 273436

SEQ ID NO: 273954 - RNA, 64 nt, hsa; identical to SEQ ID NO: 273437

SEQ ID NO: 273955 - RNA, 64 nt, hsa; identical to SEQ ID NO: 273438

SEQ ID NO: 273956 - RNA, 64 nt, hsa; identical to SEQ ID NO: 273439

SEQ ID NO: 273957 - RNA, 64 nt, hsa; identical to SEQ ID NO: 273440

SEQ ID NO: 273958 - RNA, 64 nt, hsa; identical to SEQ ID NO: 273441

SEQ ID NO: 273959 - RNA, 64 nt, hsa; identical to SEQ ID NO: 273442

SEQ ID NO: 273960 - RNA, 64 nt, hsa; identical to SEQ ID NO: 273443

SEQ ID NO: 273961 - RNA, 64 nt, hsa; identical to SEQ ID NO: 273444

SEQ ID NO: 273962 - RNA, 64 nt, hsa; identical to SEQ ID NO: 273445

SEQ ID NO: 273963 - RNA, 64 nt, hsa; identical to SEQ ID NO: 273446

SEQ ID NO: 273964 - RNA, 64 nt, hsa; identical to SEQ ID NO: 273447

SEQ ID NO: 273965 - RNA, 64 nt, hsa; identical to SEQ ID NO: 273448

SEQ ID NO: 273966 - RNA, 64 nt, hsa; identical to SEQ ID NO: 273449

SEQ ID NO: 273967 - RNA, 64 nt, hsa; identical to SEQ ID NO: 273450

SEQ ID NO: 273968 - RNA, 64 nt, hsa; identical to SEQ ID NO: 273451

SEQ ID NO: 273969 - RNA, 64 nt, hsa; identical to SEQ ID NO: 273452

SEQ ID NO: 273970 - RNA, 64 nt, hsa; identical to SEQ ID NO: 273453

SEQ ID NO: 273971 - RNA, 64 nt, hsa; identical to SEQ ID NO: 273454

SEQ ID NO: 273972 - RNA, 64 nt, hsa; identical to SEQ ID NO: 273455

SEQ ID NO: 273973 - RNA, 64 nt, hsa; identical to SEQ ID NO: 273456

SEQ ID NO: 273974 - RNA, 64 nt, hsa; identical to SEQ ID NO: 273457

SEQ ID NO: 273975 - RNA, 64 nt, hsa; identical to SEQ ID NO: 273458

SEQ ID NO: 273976 - RNA, 64 nt, hsa; identical to SEQ ID NO: 273459

SEQ ID NO: 273977 - RNA, 64 nt, hsa; identical to SEQ ID NO: 273460

SEQ ID NO: 273978 - RNA, 64 nt, hsa; identical to SEQ ID NO: 273461

SEQ ID NO: 273979 - RNA, 64 nt, hsa; identical to SEQ ID NO: 273462

SEQ ID NO: 273980 - RNA, 64 nt, hsa; identical to SEQ ID NO: 273463

SEQ ID NO: 273981 - RNA, 64 nt, hsa; identical to SEQ ID NO: 273464

SEQ ID NO: 273982 - RNA, 64 nt, hsa; identical to SEQ ID NO: 273465

SEQ ID NO: 273983 - RNA, 64 nt, hsa; identical to SEQ ID NO: 273466

SEQ ID NO: 273984 - RNA, 64 nt, hsa; identical to SEQ ID NO: 273467

SEQ ID NO: 273985 - RNA, 64 nt, hsa; identical to SEQ ID NO: 273468

SEQ ID NO: 273986 - RNA, 64 nt, hsa; identical to SEQ ID NO: 273469

SEQ ID NO: 273987 - RNA, 64 nt, hsa; identical to SEQ ID NO: 273470

SEQ ID NO: 273988 - RNA, 64 nt, hsa; identical to SEQ ID NO: 273471

SEQ ID NO: 273989 - RNA, 64 nt, hsa; identical to SEQ ID NO: 273472

SEQ ID NO: 273990 - RNA, 64 nt, hsa; identical to SEQ ID NO: 273473

SEQ ID NO: 273991 - RNA, 64 nt, hsa; identical to SEQ ID NO: 273474

SEQ ID NO: 273992 - RNA, 64 nt, hsa; identical to SEQ ID NO: 273475

SEQ ID NO: 273993 - RNA, 64 nt, hsa; identical to SEQ ID NO: 273476

SEQ ID NO: 273994 - RNA, 64 nt, hsa; identical to SEQ ID NO: 273477

SEQ ID NO: 273995 - RNA, 64 nt, hsa; identical to SEQ ID NO: 273478

SEQ ID NO: 273996 - RNA, 64 nt, hsa; identical to SEQ ID NO: 273479

SEQ ID NO: 273997 - RNA, 64 nt, hsa; identical to SEQ ID NO: 273480

SEQ ID NO: 273998 - RNA, 64 nt, hsa; identical to SEQ ID NO: 273481

SEQ ID NO: 273999 - RNA, 64 nt, hsa; identical to SEQ ID NO: 273482

SEQ ID NO: 274000 - RNA, 64 nt, hsa; identical to SEQ ID NO: 273483

SEQ ID NO: 274001 - RNA, 64 nt, hsa; identical to SEQ ID NO: 273484

SEQ ID NO: 274002 - RNA, 64 nt, hsa; identical to SEQ ID NO: 273485

SEQ ID NO: 274003 - RNA, 64 nt, hsa; identical to SEQ ID NO: 273486

SEQ ID NO: 274004 - RNA, 64 nt, hsa; identical to SEQ ID NO: 273487

SEQ ID NO: 274005 - RNA, 64 nt, hsa; identical to SEQ ID NO: 273488

SEQ ID NO: 274006 - RNA, 64 nt, hsa; identical to SEQ ID NO: 273489

SEQ ID NO: 274007 - RNA, 64 nt, hsa; identical to SEQ ID NO: 273490

SEQ ID NO: 274008 - RNA, 64 nt, hsa; identical to SEQ ID NO: 273491

SEQ ID NO: 274009 - RNA, 64 nt, hsa; identical to SEQ ID NO: 273492

SEQ ID NO: 274010 - RNA, 64 nt, hsa; identical to SEQ ID NO: 273493

SEQ ID NO: 274011 - RNA, 64 nt, hsa; identical to SEQ ID NO: 273494

SEQ ID NO: 274012 - RNA, 64 nt, hsa; identical to SEQ ID NO: 273495

SEQ ID NO: 274013 - RNA, 64 nt, hsa; identical to SEQ ID NO: 273496

SEQ ID NO: 274014 - RNA, 64 nt, hsa; identical to SEQ ID NO: 273497

SEQ ID NO: 274015 - RNA, 64 nt, hsa; identical to SEQ ID NO: 273498

SEQ ID NO: 274016 - RNA, 64 nt, hsa; identical to SEQ ID NO: 273499

SEQ ID NO: 274017 - RNA, 64 nt, hsa; identical to SEQ ID NO: 273500

SEQ ID NO: 274018 - RNA, 64 nt, hsa; identical to SEQ ID NO: 273501

SEQ ID NO: 274019 - RNA, 64 nt, hsa; identical to SEQ ID NO: 273502

SEQ ID NO: 274020 - RNA, 64 nt, hsa; identical to SEQ ID NO: 273503

SEQ ID NO: 274021 - RNA, 64 nt, hsa; identical to SEQ ID NO: 273504

SEQ ID NO: 274022 - RNA, 64 nt, hsa; identical to SEQ ID NO: 273505

SEQ ID NO: 274023 - RNA, 64 nt, hsa; identical to SEQ ID NO: 273506

SEQ ID NO: 274024 - RNA, 64 nt, hsa; identical to SEQ ID NO: 273507

SEQ ID NO: 274025 - RNA, 64 nt, hsa; identical to SEQ ID NO: 273508

SEQ ID NO: 274026 - RNA, 64 nt, hsa; identical to SEQ ID NO: 273509

SEQ ID NO: 274027 - RNA, 64 nt, hsa; identical to SEQ ID NO: 273510

SEQ ID NO: 274028 - RNA, 64 nt, hsa; identical to SEQ ID NO: 273511

SEQ ID NO: 274029 - RNA, 64 nt, hsa; identical to SEQ ID NO: 273512

SEQ ID NO: 274030 - RNA, 64 nt, hsa; identical to SEQ ID NO: 273513

SEQ ID NO: 274031 - RNA, 64 nt, hsa; identical to SEQ ID NO: 273514

SEQ ID NO: 274032 - RNA, 64 nt, hsa; identical to SEQ ID NO: 273515

SEQ ID NO: 274033 - RNA, 64 nt, hsa; identical to SEQ ID NO: 273516

SEQ ID NO: 274034 - RNA, 64 nt, hsa; identical to SEQ ID NO: 273517

SEQ ID NO: 274035 - RNA, 64 nt, hsa; identical to SEQ ID NO: 273518

SEQ ID NO: 274036 - RNA, 64 nt, hsa; identical to SEQ ID NO: 273519

SEQ ID NO: 274037 - RNA, 64 nt, hsa; identical to SEQ ID NO: 273520

SEQ ID NO: 274038 - RNA, 64 nt, hsa; identical to SEQ ID NO: 273521

SEQ ID NO: 274039 - RNA, 64 nt, hsa; identical to SEQ ID NO: 273522

SEQ ID NO: 274040 - RNA, 64 nt, hsa; identical to SEQ ID NO: 273523

SEQ ID NO: 274041 - RNA, 64 nt, hsa; identical to SEQ ID NO: 273524

SEQ ID NO: 274042 - RNA, 64 nt, hsa; identical to SEQ ID NO: 273525

SEQ ID NO: 274043 - RNA, 64 nt, hsa; identical to SEQ ID NO: 273526

SEQ ID NO: 274044 - RNA, 64 nt, hsa; identical to SEQ ID NO: 273527

SEQ ID NO: 274045 - RNA, 64 nt, hsa; identical to SEQ ID NO: 273528

SEQ ID NO: 274046 - RNA, 64 nt, hsa; identical to SEQ ID NO: 273529

SEQ ID NO: 274047 - RNA, 64 nt, hsa; identical to SEQ ID NO: 273530

SEQ ID NO: 274048 - RNA, 64 nt, hsa; identical to SEQ ID NO: 273531

SEQ ID NO: 274049 - RNA, 64 nt, hsa; identical to SEQ ID NO: 273532

SEQ ID NO: 274050 - RNA, 64 nt, hsa; identical to SEQ ID NO: 273533

SEQ ID NO: 274051 - RNA, 64 nt, hsa; identical to SEQ ID NO: 273534

SEQ ID NO: 274052 - RNA, 64 nt, hsa; identical to SEQ ID NO: 273535

SEQ ID NO: 274053 - RNA, 64 nt, hsa; identical to SEQ ID NO: 273536

SEQ ID NO: 274054 - RNA, 64 nt, hsa; identical to SEQ ID NO: 273537

SEQ ID NO: 274055 - RNA, 64 nt, hsa; identical to SEQ ID NO: 273538

SEQ ID NO: 274056 - RNA, 64 nt, hsa; identical to SEQ ID NO: 273539

SEQ ID NO: 274057 - RNA, 64 nt, hsa; identical to SEQ ID NO: 273540

SEQ ID NO: 274058 - RNA, 64 nt, hsa; identical to SEQ ID NO: 273541

SEQ ID NO: 274059 - RNA, 64 nt, hsa; identical to SEQ ID NO: 273542

SEQ ID NO: 274060 - RNA, 64 nt, hsa; identical to SEQ ID NO: 273543

SEQ ID NO: 274061 - RNA, 64 nt, hsa; identical to SEQ ID NO: 273544

SEQ ID NO: 274062 - RNA, 64 nt, hsa; identical to SEQ ID NO: 273545

SEQ ID NO: 274063 - RNA, 64 nt, hsa; identical to SEQ ID NO: 273546

SEQ ID NO: 274064 - RNA, 64 nt, hsa; identical to SEQ ID NO: 273547

SEQ ID NO: 274065 - RNA, 64 nt, hsa; identical to SEQ ID NO: 273548

SEQ ID NO: 274066 - RNA, 64 nt, hsa; identical to SEQ ID NO: 273549

SEQ ID NO: 274067 - RNA, 64 nt, hsa; identical to SEQ ID NO: 273550

SEQ ID NO: 274068 - RNA, 64 nt, hsa; identical to SEQ ID NO: 273551

SEQ ID NO: 274069 - RNA, 64 nt, hsa; identical to SEQ ID NO: 273552

SEQ ID NO: 274070 - RNA, 64 nt, hsa; identical to SEQ ID NO: 273553

SEQ ID NO: 274071 - RNA, 64 nt, hsa; identical to SEQ ID NO: 273554

SEQ ID NO: 274072 - RNA, 64 nt, hsa; identical to SEQ ID NO: 273555

SEQ ID NO: 274073 - RNA, 64 nt, hsa; identical to SEQ ID NO: 273556

SEQ ID NO: 274074 - RNA, 64 nt, hsa; identical to SEQ ID NO: 273557

SEQ ID NO: 274075 - RNA, 64 nt, hsa; identical to SEQ ID NO: 273558

SEQ ID NO: 274076 - RNA, 64 nt, hsa; identical to SEQ ID NO: 273559

SEQ ID NO: 274077 - RNA, 64 nt, hsa; identical to SEQ ID NO: 273560

SEQ ID NO: 274078 - RNA, 64 nt, hsa; identical to SEQ ID NO: 273561

SEQ ID NO: 274079 - RNA, 64 nt, hsa; identical to SEQ ID NO: 273562

SEQ ID NO: 274080 - RNA, 64 nt, hsa; identical to SEQ ID NO: 273563

SEQ ID NO: 274081 - RNA, 64 nt, hsa; identical to SEQ ID NO: 273564

SEQ ID NO: 274082 - RNA, 64 nt, hsa; identical to SEQ ID NO: 273565

SEQ ID NO: 274083 - RNA, 64 nt, hsa; identical to SEQ ID NO: 273566

SEQ ID NO: 274084 - RNA, 64 nt, hsa; identical to SEQ ID NO: 273567

SEQ ID NO: 274085 - RNA, 64 nt, hsa; identical to SEQ ID NO: 273568

SEQ ID NO: 274086 - RNA, 64 nt, hsa; identical to SEQ ID NO: 273569

SEQ ID NO: 274087 - RNA, 64 nt, hsa; identical to SEQ ID NO: 273570

SEQ ID NO: 274088 - RNA, 64 nt, hsa; identical to SEQ ID NO: 273571

SEQ ID NO: 274089 - RNA, 64 nt, hsa; identical to SEQ ID NO: 273572

SEQ ID NO: 274090 - RNA, 64 nt, hsa; identical to SEQ ID NO: 273573

SEQ ID NO: 274091 - RNA, 64 nt, hsa; identical to SEQ ID NO: 273574

SEQ ID NO: 274092 - RNA, 64 nt, hsa; identical to SEQ ID NO: 273575

SEQ ID NO: 274093 - RNA, 64 nt, hsa; identical to SEQ ID NO: 273576

SEQ ID NO: 274094 - RNA, 64 nt, hsa; identical to SEQ ID NO: 273577

SEQ ID NO: 274095 - RNA, 64 nt, hsa; identical to SEQ ID NO: 273578

SEQ ID NO: 274096 - RNA, 64 nt, hsa; identical to SEQ ID NO: 273579

SEQ ID NO: 274097 - RNA, 64 nt, hsa; identical to SEQ ID NO: 273580

SEQ ID NO: 274098 - RNA, 64 nt, hsa; identical to SEQ ID NO: 273581

SEQ ID NO: 274099 - RNA, 64 nt, hsa; identical to SEQ ID NO: 273582

SEQ ID NO: 274100 - RNA, 64 nt, hsa; identical to SEQ ID NO: 273583

SEQ ID NO: 274101 - RNA, 64 nt, hsa; identical to SEQ ID NO: 273584

SEQ ID NO: 274102 - RNA, 64 nt, hsa; identical to SEQ ID NO: 273585

SEQ ID NO: 274103 - RNA, 64 nt, hsa; identical to SEQ ID NO: 273585

SEQ ID NO: 274104 - RNA, 64 nt, hsa; identical to SEQ ID NO: 273587

SEQ ID NO: 274105 - RNA, 64 nt, hsa; identical to SEQ ID NO: 273588

SEQ ID NO: 274106 - RNA, 64 nt, hsa; identical to SEQ ID NO: 273589

SEQ ID NO: 274107 - RNA, 64 nt, hsa; identical to SEQ ID NO: 273590

SEQ ID NO: 274108 - RNA, 64 nt, hsa; identical to SEQ ID NO: 273591

SEQ ID NO: 274109 - RNA, 64 nt, hsa; identical to SEQ ID NO: 273592

SEQ ID NO: 274110 - RNA, 64 nt, hsa; identical to SEQ ID NO: 273593

SEQ ID NO: 274111 - RNA, 64 nt, hsa; identical to SEQ ID NO: 273594

SEQ ID NO: 274112 - RNA, 64 nt, hsa; identical to SEQ ID NO: 273595

SEQ ID NO: 274113 - RNA, 64 nt, hsa; identical to SEQ ID NO: 273596

SEQ ID NO: 274114 - RNA, 64 nt, hsa; identical to SEQ ID NO: 273597

SEQ ID NO: 274115 - RNA, 64 nt, hsa; identical to SEQ ID NO: 273598

SEQ ID NO: 274116 - RNA, 64 nt, hsa; identical to SEQ ID NO: 273599

SEQ ID NO: 274117 - RNA, 64 nt, hsa; identical to SEQ ID NO: 273600

SEQ ID NO: 274118 - RNA, 64 nt, hsa; identical to SEQ ID NO: 273601

SEQ ID NO: 274119 - RNA, 64 nt, hsa; identical to SEQ ID NO: 273602

SEQ ID NO: 274120 - RNA, 64 nt, hsa; identical to SEQ ID NO: 273603

SEQ ID NO: 274121 - RNA, 64 nt, hsa; identical to SEQ ID NO: 273604

SEQ ID NO: 274122 - RNA, 64 nt, hsa; identical to SEQ ID NO: 273605

SEQ ID NO: 274123 - RNA, 64 nt, hsa; identical to SEQ ID NO: 273606

SEQ ID NO: 274124 - RNA, 64 nt, hsa; identical to SEQ ID NO: 273607

SEQ ID NO: 274125 - RNA, 64 nt, hsa; identical to SEQ ID NO: 273608

SEQ ID NO: 274126 - RNA, 64 nt, hsa; identical to SEQ ID NO: 273609

SEQ ID NO: 274127 - RNA, 64 nt, hsa; identical to SEQ ID NO: 273610

SEQ ID NO: 274128 - RNA, 64 nt, hsa; identical to SEQ ID NO: 273611

SEQ ID NO: 274129 - RNA, 64 nt, hsa; identical to SEQ ID NO: 273612

SEQ ID NO: 274130 - RNA, 64 nt, hsa; identical to SEQ ID NO: 273613

SEQ ID NO: 274131 - RNA, 64 nt, hsa; identical to SEQ ID NO: 273614

SEQ ID NO: 274132 - RNA, 64 nt, hsa; identical to SEQ ID NO: 273615

SEQ ID NO: 274133 - RNA, 64 nt, hsa; identical to SEQ ID NO: 273616

SEQ ID NO: 274134 - RNA, 64 nt, hsa; identical to SEQ ID NO: 273617

SEQ ID NO: 274135 - RNA, 64 nt, hsa; identical to SEQ ID NO: 273618

SEQ ID NO: 274136 - RNA, 64 nt, hsa; identical to SEQ ID NO: 273619

SEQ ID NO: 274137 - RNA, 64 nt, hsa; identical to SEQ ID NO: 273620

SEQ ID NO: 274138 - RNA, 64 nt, hsa; identical to SEQ ID NO: 273621

SEQ ID NO: 274139 - RNA, 64 nt, hsa; identical to SEQ ID NO: 273622

SEQ ID NO: 274140 - RNA, 64 nt, hsa; identical to SEQ ID NO: 273623

SEQ ID NO: 274141 - RNA, 64 nt, hsa; identical to SEQ ID NO: 273624

SEQ ID NO: 274142 - RNA, 64 nt, hsa; identical to SEQ ID NO: 273625

SEQ ID NO: 274143 - RNA, 64 nt, hsa; identical to SEQ ID NO: 273626

SEQ ID NO: 274144 - RNA, 64 nt, hsa; identical to SEQ ID NO: 273627

SEQ ID NO: 274145 - RNA, 64 nt, hsa; identical to SEQ ID NO: 273628

SEQ ID NO: 274146 - RNA, 64 nt, hsa; identical to SEQ ID NO: 273629

SEQ ID NO: 274147 - RNA, 64 nt, hsa; identical to SEQ ID NO: 273630

SEQ ID NO: 274148 - RNA, 64 nt, hsa; identical to SEQ ID NO: 273631

SEQ ID NO: 274149 - RNA, 62 nt, hsa; identical to SEQ ID NO: 273115

SEQ ID NO: 274150 - RNA, 62 nt, hsa; identical to SEQ ID NO: 273116

SEQ ID NO: 274151 - RNA, 62 nt, hsa; identical to SEQ ID NO: 273117

SEQ ID NO: 274152 - RNA, 62 nt, hsa; identical to SEQ ID NO: 273118

SEQ ID NO: 274153 - RNA, 62 nt, hsa; identical to SEQ ID NO: 273119

SEQ ID NO: 274154 - RNA, 62 nt, hsa; identical to SEQ ID NO: 273120

SEQ ID NO: 274155 - RNA, 62 nt, hsa; identical to SEQ ID NO: 273121

SEQ ID NO: 274156 - RNA, 62 nt, hsa; identical to SEQ ID NO: 273122

SEQ ID NO: 274157 - RNA, 62 nt, hsa; identical to SEQ ID NO: 273123

SEQ ID NO: 274158 - RNA, 60 nt, hsa; identical to SEQ ID NO: 273124

SEQ ID NO: 274159 - RNA, 62 nt, hsa; identical to SEQ ID NO: 273125

SEQ ID NO: 274160 - RNA, 62 nt, hsa; identical to SEQ ID NO: 273126

SEQ ID NO: 274161 - RNA, 62 nt, hsa; identical to SEQ ID NO: 273127

SEQ ID NO: 274162 - RNA, 62 nt, hsa; identical to SEQ ID NO: 273128

SEQ ID NO: 274163 - RNA, 62 nt, hsa; identical to SEQ ID NO: 273129

SEQ ID NO: 274164 - RNA, 62 nt, hsa; identical to SEQ ID NO: 273130

SEQ ID NO: 274165 - RNA, 62 nt, hsa; identical to SEQ ID NO: 273131

SEQ ID NO: 274166 - RNA, 62 nt, hsa; identical to SEQ ID NO: 273132

SEQ ID NO: 274167 - RNA, 62 nt, hsa; identical to SEQ ID NO: 273133

SEQ ID NO: 274168 - RNA, 62 nt, hsa; identical to SEQ ID NO: 273134

SEQ ID NO: 274169 - RNA, 62 nt, hsa; identical to SEQ ID NO: 273135

SEQ ID NO: 274170 - RNA, 62 nt, hsa; identical to SEQ ID NO: 273136

SEQ ID NO: 274171 - RNA, 62 nt, hsa; identical to SEQ ID NO: 273137

SEQ ID NO: 274172 - RNA, 62 nt, hsa; identical to SEQ ID NO: 273138

SEQ ID NO: 274173 - RNA, 62 nt, hsa; identical to SEQ ID NO: 273139

SEQ ID NO: 274174 - RNA, 62 nt, hsa; identical to SEQ ID NO: 273140

SEQ ID NO: 274175 - RNA, 62 nt, hsa; identical to SEQ ID NO: 273141

SEQ ID NO: 274176 - RNA, 62 nt, hsa; identical to SEQ ID NO: 273142

SEQ ID NO: 274177 - RNA, 62 nt, hsa; identical to SEQ ID NO: 273143

SEQ ID NO: 274178 - RNA, 62 nt, hsa; identical to SEQ ID NO: 273144

SEQ ID NO: 274179 - RNA, 62 nt, hsa; identical to SEQ ID NO: 273145

SEQ ID NO: 274180 - RNA, 62 nt, hsa; identical to SEQ ID NO: 273146

SEQ ID NO: 274181 - RNA, 62 nt, hsa; identical to SEQ ID NO: 273147

SEQ ID NO: 274182 - RNA, 62 nt, hsa; identical to SEQ ID NO: 273148

SEQ ID NO: 274183 - RNA, 62 nt, hsa; identical to SEQ ID NO: 273149

SEQ ID NO: 274184 - RNA, 62 nt, hsa; identical to SEQ ID NO: 273150

SEQ ID NO: 274185 - RNA, 62 nt, hsa; identical to SEQ ID NO: 273151

SEQ ID NO: 274186 - RNA, 62 nt, hsa; identical to SEQ ID NO: 273152

SEQ ID NO: 274187 - RNA, 62 nt, hsa; identical to SEQ ID NO: 273153

SEQ ID NO: 274188 - RNA, 62 nt, hsa; identical to SEQ ID NO: 273154

SEQ ID NO: 274189 - RNA, 62 nt, hsa; identical to SEQ ID NO: 273155

SEQ ID NO: 274190 - RNA, 62 nt, hsa; identical to SEQ ID NO: 273156

SEQ ID NO: 274191 - RNA, 62 nt, hsa; identical to SEQ ID NO: 273157

SEQ ID NO: 274192 - RNA, 62 nt, hsa; identical to SEQ ID NO: 273158

SEQ ID NO: 274193 - RNA, 62 nt, hsa; identical to SEQ ID NO: 273159

SEQ ID NO: 274194 - RNA, 62 nt, hsa; identical to SEQ ID NO: 273160

SEQ ID NO: 274195 - RNA, 62 nt, hsa; identical to SEQ ID NO: 273161

SEQ ID NO: 274196 - RNA, 62 nt, hsa; identical to SEQ ID NO: 273162

SEQ ID NO: 274197 - RNA, 62 nt, hsa; identical to SEQ ID NO: 273163

SEQ ID NO: 274198 - RNA, 62 nt, hsa; identical to SEQ ID NO: 273164

SEQ ID NO: 274199 - RNA, 62 nt, hsa; identical to SEQ ID NO: 273165

SEQ ID NO: 274200 - RNA, 62 nt, hsa; identical to SEQ ID NO: 273166

SEQ ID NO: 274201 - RNA, 62 nt, hsa; identical to SEQ ID NO: 273167

SEQ ID NO: 274202 - RNA, 62 nt, hsa; identical to SEQ ID NO: 273168

SEQ ID NO: 274203 - RNA, 62 nt, hsa; identical to SEQ ID NO: 273169

SEQ ID NO: 274204 - RNA, 62 nt, hsa; identical to SEQ ID NO: 273170

SEQ ID NO: 274205 - RNA, 62 nt, hsa; identical to SEQ ID NO: 273171

SEQ ID NO: 274206 - RNA, 62 nt, hsa; identical to SEQ ID NO: 273172

SEQ ID NO: 274207 - RNA, 62 nt, hsa; identical to SEQ ID NO: 273173

SEQ ID NO: 274208 - RNA, 62 nt, hsa; identical to SEQ ID NO: 273174

SEQ ID NO: 274209 - RNA, 62 nt, hsa; identical to SEQ ID NO: 273175

SEQ ID NO: 274210 - RNA, 62 nt, hsa; identical to SEQ ID NO: 273176

SEQ ID NO: 274211 - RNA, 62 nt, hsa; identical to SEQ ID NO: 273177

SEQ ID NO: 274212 - RNA, 62 nt, hsa; identical to SEQ ID NO: 273178

SEQ ID NO: 274213 - RNA, 62 nt, hsa; identical to SEQ ID NO: 273179

SEQ ID NO: 274214 - RNA, 62 nt, hsa; identical to SEQ ID NO: 273180

SEQ ID NO: 274215 - RNA, 62 nt, hsa; identical to SEQ ID NO: 273181

SEQ ID NO: 274216 - RNA, 62 nt, hsa; identical to SEQ ID NO: 273182

SEQ ID NO: 274217 - RNA, 62 nt, hsa; identical to SEQ ID NO: 273183

SEQ ID NO: 274218 - RNA, 62 nt, hsa; identical to SEQ ID NO: 273184

SEQ ID NO: 274219 - RNA, 62 nt, hsa; identical to SEQ ID NO: 273185

SEQ ID NO: 274220 - RNA, 62 nt, hsa; identical to SEQ ID NO: 273186

SEQ ID NO: 274221 - RNA, 62 nt, hsa; identical to SEQ ID NO: 273187

SEQ ID NO: 274222 - RNA, 62 nt, hsa; identical to SEQ ID NO: 273188

SEQ ID NO: 274223 - RNA, 60 nt, hsa; identical to SEQ ID NO: 273189

SEQ ID NO: 274224 - RNA, 62 nt, hsa; identical to SEQ ID NO: 273190

SEQ ID NO: 274225 - RNA, 62 nt, hsa; identical to SEQ ID NO: 273191

SEQ ID NO: 274226 - RNA, 62 nt, hsa; identical to SEQ ID NO: 273192

SEQ ID NO: 274227 - RNA, 62 nt, hsa; identical to SEQ ID NO: 273193

SEQ ID NO: 274228 - RNA, 62 nt, hsa; identical to SEQ ID NO: 273194

SEQ ID NO: 274229 - RNA, 62 nt, hsa; identical to SEQ ID NO: 273195

SEQ ID NO: 274230 - RNA, 62 nt, hsa; identical to SEQ ID NO: 273196

SEQ ID NO: 274231 - RNA, 62 nt, hsa; identical to SEQ ID NO: 273197

SEQ ID NO: 274232 - RNA, 62 nt, hsa; identical to SEQ ID NO: 273198

SEQ ID NO: 274233 - RNA, 62 nt, hsa; identical to SEQ ID NO: 273199

SEQ ID NO: 274234 - RNA, 62 nt, hsa; identical to SEQ ID NO: 273200

SEQ ID NO: 274235 - RNA, 62 nt, hsa; identical to SEQ ID NO: 273201

SEQ ID NO: 274236 - RNA, 62 nt, hsa; identical to SEQ ID NO: 273202

SEQ ID NO: 274237 - RNA, 62 nt, hsa; identical to SEQ ID NO: 273203

SEQ ID NO: 274238 - RNA, 62 nt, hsa; identical to SEQ ID NO: 273204

SEQ ID NO: 274239 - RNA, 62 nt, hsa; identical to SEQ ID NO: 273205

SEQ ID NO: 274240 - RNA, 62 nt, hsa; identical to SEQ ID NO: 273206

SEQ ID NO: 274241 - RNA, 62 nt, hsa; identical to SEQ ID NO: 273207

SEQ ID NO: 274242 - RNA, 62 nt, hsa; identical to SEQ ID NO: 273208

SEQ ID NO: 274243 - RNA, 62 nt, hsa; identical to SEQ ID NO: 273209

SEQ ID NO: 274244 - RNA, 62 nt, hsa; identical to SEQ ID NO: 273210

SEQ ID NO: 274245 - RNA, 62 nt, hsa; identical to SEQ ID NO: 273211

SEQ ID NO: 274246 - RNA, 62 nt, hsa; identical to SEQ ID NO: 273212

SEQ ID NO: 274247 - RNA, 62 nt, hsa; identical to SEQ ID NO: 273213

SEQ ID NO: 274248 - RNA, 62 nt, hsa; identical to SEQ ID NO: 273214

SEQ ID NO: 274249 - RNA, 62 nt, hsa; identical to SEQ ID NO: 273215

SEQ ID NO: 274250 - RNA, 62 nt, hsa; identical to SEQ ID NO: 273216

SEQ ID NO: 274251 - RNA, 62 nt, hsa; identical to SEQ ID NO: 273217

SEQ ID NO: 274252 - RNA, 62 nt, hsa; identical to SEQ ID NO: 273218

SEQ ID NO: 274253 - RNA, 62 nt, hsa; identical to SEQ ID NO: 273219

SEQ ID NO: 274254 - RNA, 62 nt, hsa; identical to SEQ ID NO: 273220

SEQ ID NO: 274255 - RNA, 62 nt, hsa; identical to SEQ ID NO: 273221

SEQ ID NO: 274256 - RNA, 62 nt, hsa; identical to SEQ ID NO: 273222

SEQ ID NO: 274257 - RNA, 62 nt, hsa; identical to SEQ ID NO: 273223

SEQ ID NO: 274258 - RNA, 62 nt, hsa; identical to SEQ ID NO: 273224

SEQ ID NO: 274259 - RNA, 62 nt, hsa; identical to SEQ ID NO: 273225

SEQ ID NO: 274260 - RNA, 62 nt, hsa; identical to SEQ ID NO: 273226

SEQ ID NO: 274261 - RNA, 62 nt, hsa; identical to SEQ ID NO: 273227

SEQ ID NO: 274262 - RNA, 62 nt, hsa; identical to SEQ ID NO: 273228

SEQ ID NO: 274263 - RNA, 62 nt, hsa; identical to SEQ ID NO: 273229

SEQ ID NO: 274264 - RNA, 62 nt, hsa; identical to SEQ ID NO: 273230

SEQ ID NO: 274265 - RNA, 62 nt, hsa; identical to SEQ ID NO: 273231

SEQ ID NO: 274266 - RNA, 62 nt, hsa; identical to SEQ ID NO: 273232

SEQ ID NO: 274267 - RNA, 62 nt, hsa; identical to SEQ ID NO: 273233

SEQ ID NO: 274268 - RNA, 62 nt, hsa; identical to SEQ ID NO: 273234

SEQ ID NO: 274269 - RNA, 62 nt, hsa; identical to SEQ ID NO: 273235

SEQ ID NO: 274270 - RNA, 62 nt, hsa; identical to SEQ ID NO: 273236

SEQ ID NO: 274271 - RNA, 62 nt, hsa; identical to SEQ ID NO: 273237

SEQ ID NO: 274272 - RNA, 62 nt, hsa; identical to SEQ ID NO: 273238

SEQ ID NO: 274273 - RNA, 62 nt, hsa; identical to SEQ ID NO: 273239

SEQ ID NO: 274274 - RNA, 62 nt, hsa; identical to SEQ ID NO: 273240

SEQ ID NO: 274275 - RNA, 62 nt, hsa; identical to SEQ ID NO: 273241

SEQ ID NO: 274276 - RNA, 62 nt, hsa; identical to SEQ ID NO: 273242

SEQ ID NO: 274277 - RNA, 62 nt, hsa; identical to SEQ ID NO: 273243

SEQ ID NO: 274278 - RNA, 62 nt, hsa; identical to SEQ ID NO: 273244

SEQ ID NO: 274279 - RNA, 62 nt, hsa; identical to SEQ ID NO: 273245

SEQ ID NO: 274280 - RNA, 62 nt, hsa; identical to SEQ ID NO: 273246

SEQ ID NO: 274281 - RNA, 62 nt, hsa; identical to SEQ ID NO: 273247

SEQ ID NO: 274282 - RNA, 62 nt, hsa; identical to SEQ ID NO: 273248

SEQ ID NO: 274283 - RNA, 62 nt, hsa; identical to SEQ ID NO: 273249

SEQ ID NO: 274284 - RNA, 62 nt, hsa; identical to SEQ ID NO: 273250

SEQ ID NO: 274285 - RNA, 62 nt, hsa; identical to SEQ ID NO: 273251

SEQ ID NO: 274286 - RNA, 62 nt, hsa; identical to SEQ ID NO: 273252

SEQ ID NO: 274287 - RNA, 62 nt, hsa; identical to SEQ ID NO: 273253

SEQ ID NO: 274288 - RNA, 62 nt, hsa; identical to SEQ ID NO: 273254

SEQ ID NO: 274289 - RNA, 62 nt, hsa; identical to SEQ ID NO: 273255

SEQ ID NO: 274290 - RNA, 62 nt, hsa; identical to SEQ ID NO: 273256

SEQ ID NO: 274291 - RNA, 62 nt, hsa; identical to SEQ ID NO: 273257

SEQ ID NO: 274292 - RNA, 62 nt, hsa; identical to SEQ ID NO: 273258

SEQ ID NO: 274293 - RNA, 62 nt, hsa; identical to SEQ ID NO: 273259

SEQ ID NO: 274294 - RNA, 62 nt, hsa; identical to SEQ ID NO: 273260

SEQ ID NO: 274295 - RNA, 62 nt, hsa; identical to SEQ ID NO: 273261

SEQ ID NO: 274296 - RNA, 62 nt, hsa; identical to SEQ ID NO: 273262

SEQ ID NO: 274297 - RNA, 62 nt, hsa; identical to SEQ ID NO: 273263

SEQ ID NO: 274298 - RNA, 62 nt, hsa; identical to SEQ ID NO: 273264

SEQ ID NO: 274299 - RNA, 62 nt, hsa; identical to SEQ ID NO: 273265

SEQ ID NO: 274300 - RNA, 62 nt, hsa; identical to SEQ ID NO: 273266

SEQ ID NO: 274301 - RNA, 62 nt, hsa; identical to SEQ ID NO: 273267

SEQ ID NO: 274302 - RNA, 62 nt, hsa; identical to SEQ ID NO: 273268

SEQ ID NO: 274303 - RNA, 62 nt, hsa; identical to SEQ ID NO: 273269

SEQ ID NO: 274304 - RNA, 62 nt, hsa; identical to SEQ ID NO: 273270

SEQ ID NO: 274305 - RNA, 62 nt, hsa; identical to SEQ ID NO: 273271

SEQ ID NO: 274306 - RNA, 62 nt, hsa; identical to SEQ ID NO: 273272

SEQ ID NO: 274307 - RNA, 62 nt, hsa; identical to SEQ ID NO: 273273

SEQ ID NO: 274308 - RNA, 62 nt, hsa; identical to SEQ ID NO: 273274

SEQ ID NO: 274309 - RNA, 62 nt, hsa; identical to SEQ ID NO: 273275

SEQ ID NO: 274310 - RNA, 62 nt, hsa; identical to SEQ ID NO: 273276

SEQ ID NO: 274311 - RNA, 62 nt, hsa; identical to SEQ ID NO: 273277

SEQ ID NO: 274312 - RNA, 62 nt, hsa; identical to SEQ ID NO: 273278

SEQ ID NO: 274313 - RNA, 62 nt, hsa; identical to SEQ ID NO: 273279

SEQ ID NO: 274314 - RNA, 62 nt, hsa; identical to SEQ ID NO: 273280

SEQ ID NO: 274315 - RNA, 62 nt, hsa; identical to SEQ ID NO: 273281

SEQ ID NO: 274316 - RNA, 62 nt, hsa; identical to SEQ ID NO: 273282

SEQ ID NO: 274317 - RNA, 62 nt, hsa; identical to SEQ ID NO: 273283

SEQ ID NO: 274318 - RNA, 51 nt, hsa; identical to SEQ ID NO: 273284

SEQ ID NO: 274319 - RNA, 62 nt, hsa; identical to SEQ ID NO: 273285

SEQ ID NO: 274320 - RNA, 62 nt, hsa; identical to SEQ ID NO: 273286

SEQ ID NO: 274321 - RNA, 62 nt, hsa; identical to SEQ ID NO: 273287

SEQ ID NO: 274322 - RNA, 62 nt, hsa; identical to SEQ ID NO: 273288

SEQ ID NO: 274323 - RNA, 62 nt, hsa; identical to SEQ ID NO: 273289

SEQ ID NO: 274324 - RNA, 62 nt, hsa; identical to SEQ ID NO: 273290

SEQ ID NO: 274325 - RNA, 62 nt, hsa; identical to SEQ ID NO: 273291

SEQ ID NO: 274326 - RNA, 62 nt, hsa; identical to SEQ ID NO: 273292

SEQ ID NO: 274327 - RNA, 62 nt, hsa; identical to SEQ ID NO: 273293

SEQ ID NO: 274328 - RNA, 62 nt, hsa; identical to SEQ ID NO: 273294

SEQ ID NO: 274329 - RNA, 62 nt, hsa; identical to SEQ ID NO: 273295

SEQ ID NO: 274330 - RNA, 62 nt, hsa; identical to SEQ ID NO: 273296

SEQ ID NO: 274331 - RNA, 62 nt, hsa; identical to SEQ ID NO: 273297

SEQ ID NO: 274332 - RNA, 62 nt, hsa; identical to SEQ ID NO: 273298

SEQ ID NO: 274333 - RNA, 62 nt, hsa; identical to SEQ ID NO: 273299

SEQ ID NO: 274334 - RNA, 62 nt, hsa; identical to SEQ ID NO: 273300

SEQ ID NO: 274335 - RNA, 62 nt, hsa; identical to SEQ ID NO: 273301

SEQ ID NO: 274336 - RNA, 62 nt, hsa; identical to SEQ ID NO: 273302

SEQ ID NO: 274337 - RNA, 62 nt, hsa; identical to SEQ ID NO: 273303

SEQ ID NO: 274338 - RNA, 62 nt, hsa; identical to SEQ ID NO: 273304

SEQ ID NO: 274339 - RNA, 62 nt, hsa; identical to SEQ ID NO: 273305

SEQ ID NO: 274340 - RNA, 62 nt, hsa; identical to SEQ ID NO: 273306

SEQ ID NO: 274341 - RNA, 62 nt, hsa; identical to SEQ ID NO: 273307

SEQ ID NO: 274342 - RNA, 62 nt, hsa; identical to SEQ ID NO: 273308

SEQ ID NO: 274343 - RNA, 62 nt, hsa; identical to SEQ ID NO: 273309

SEQ ID NO: 274344 - RNA, 64 nt, hsa; identical to SEQ ID NO: 273310

SEQ ID NO: 274345 - RNA, 64 nt, hsa; identical to SEQ ID NO: 273311

SEQ ID NO: 274346 - RNA, 64 nt, hsa; identical to SEQ ID NO: 273312

SEQ ID NO: 274347 - RNA, 64 nt, hsa; identical to SEQ ID NO: 273313

SEQ ID NO: 274348 - RNA, 64 nt, hsa; identical to SEQ ID NO: 273314

SEQ ID NO: 274349 - RNA, 64 nt, hsa; identical to SEQ ID NO: 273315

SEQ ID NO: 274350 - RNA, 64 nt, hsa; identical to SEQ ID NO: 273316

SEQ ID NO: 274351 - RNA, 64 nt, hsa; identical to SEQ ID NO: 273317

SEQ ID NO: 274352 - RNA, 64 nt, hsa; identical to SEQ ID NO: 273318

SEQ ID NO: 274353 - RNA, 64 nt, hsa; identical to SEQ ID NO: 273319

SEQ ID NO: 274354 - RNA, 64 nt, hsa; identical to SEQ ID NO: 189841

SEQ ID NO: 274355 - RNA, 64 nt, hsa; identical to SEQ ID NO: 189842

SEQ ID NO: 274356 - RNA, 64 nt, hsa; identical to SEQ ID NO: 273322

SEQ ID NO: 274357 - RNA, 64 nt, hsa; identical to SEQ ID NO: 273323

SEQ ID NO: 274358 - RNA, 64 nt, hsa; identical to SEQ ID NO: 273324

SEQ ID NO: 274359 - RNA, 64 nt, hsa; identical to SEQ ID NO: 273325

SEQ ID NO: 274360 - RNA, 64 nt, hsa; identical to SEQ ID NO: 273326

SEQ ID NO: 274361 - RNA, 64 nt, hsa; identical to SEQ ID NO: 273327

SEQ ID NO: 274362 - RNA, 64 nt, hsa; identical to SEQ ID NO: 273328

SEQ ID NO: 274363 - RNA, 64 nt, hsa; identical to SEQ ID NO: 273329

SEQ ID NO: 274364 - RNA, 64 nt, hsa; identical to SEQ ID NO: 273330

SEQ ID NO: 274365 - RNA, 64 nt, hsa; identical to SEQ ID NO: 273331

SEQ ID NO: 274366 - RNA, 64 nt, hsa; identical to SEQ ID NO: 273332

SEQ ID NO: 274367 - RNA, 64 nt, hsa; identical to SEQ ID NO: 273333

SEQ ID NO: 274368 - RNA, 64 nt, hsa; identical to SEQ ID NO: 273334

SEQ ID NO: 274369 - RNA, 64 nt, hsa; identical to SEQ ID NO: 273335

SEQ ID NO: 274370 - RNA, 64 nt, hsa; identical to SEQ ID NO: 273336

SEQ ID NO: 274371 - RNA, 64 nt, hsa; identical to SEQ ID NO: 273337

SEQ ID NO: 274372 - RNA, 64 nt, hsa; identical to SEQ ID NO: 273338

SEQ ID NO: 274373 - RNA, 64 nt, hsa; identical to SEQ ID NO: 273339

SEQ ID NO: 274374 - RNA, 64 nt, hsa; identical to SEQ ID NO: 273340

SEQ ID NO: 274375 - RNA, 64 nt, hsa; identical to SEQ ID NO: 273341

SEQ ID NO: 274376 - RNA, 64 nt, hsa; identical to SEQ ID NO: 273342

SEQ ID NO: 274377 - RNA, 64 nt, hsa; identical to SEQ ID NO: 273343

SEQ ID NO: 274378 - RNA, 64 nt, hsa; identical to SEQ ID NO: 273344

SEQ ID NO: 274379 - RNA, 64 nt, hsa; identical to SEQ ID NO: 273345

SEQ ID NO: 274380 - RNA, 64 nt, hsa; identical to SEQ ID NO: 273346

SEQ ID NO: 274381 - RNA, 64 nt, hsa; identical to SEQ ID NO: 273347

SEQ ID NO: 274382 - RNA, 64 nt, hsa; identical to SEQ ID NO: 273348

SEQ ID NO: 274383 - RNA, 64 nt, hsa; identical to SEQ ID NO: 273349

SEQ ID NO: 274384 - RNA, 64 nt, hsa; identical to SEQ ID NO: 273350

SEQ ID NO: 274385 - RNA, 64 nt, hsa; identical to SEQ ID NO: 273351

SEQ ID NO: 274386 - RNA, 64 nt, hsa; identical to SEQ ID NO: 273352

SEQ ID NO: 274387 - RNA, 64 nt, hsa; identical to SEQ ID NO: 273353

SEQ ID NO: 274388 - RNA, 64 nt, hsa; identical to SEQ ID NO: 273354

SEQ ID NO: 274389 - RNA, 64 nt, hsa; identical to SEQ ID NO: 273355

SEQ ID NO: 274390 - RNA, 64 nt, hsa; identical to SEQ ID NO: 273356

SEQ ID NO: 274391 - RNA, 64 nt, hsa; identical to SEQ ID NO: 273357

SEQ ID NO: 274392 - RNA, 64 nt, hsa; identical to SEQ ID NO: 273358

SEQ ID NO: 274393 - RNA, 64 nt, hsa; identical to SEQ ID NO: 273359

SEQ ID NO: 274394 - RNA, 64 nt, hsa; identical to SEQ ID NO: 273360

SEQ ID NO: 274395 - RNA, 64 nt, hsa; identical to SEQ ID NO: 273361

SEQ ID NO: 274396 - RNA, 64 nt, hsa; identical to SEQ ID NO: 273362

SEQ ID NO: 274397 - RNA, 64 nt, hsa; identical to SEQ ID NO: 273363

SEQ ID NO: 274398 - RNA, 64 nt, hsa; identical to SEQ ID NO: 273364

SEQ ID NO: 274399 - RNA, 64 nt, hsa; identical to SEQ ID NO: 273365

SEQ ID NO: 274400 - RNA, 64 nt, hsa; identical to SEQ ID NO: 273366

SEQ ID NO: 274401 - RNA, 64 nt, hsa; identical to SEQ ID NO: 273367

SEQ ID NO: 274402 - RNA, 64 nt, hsa; identical to SEQ ID NO: 273368

SEQ ID NO: 274403 - RNA, 64 nt, hsa; identical to SEQ ID NO: 273369

SEQ ID NO: 274404 - RNA, 64 nt, hsa; identical to SEQ ID NO: 273370

SEQ ID NO: 274405 - RNA, 59 nt, hsa; identical to SEQ ID NO: 273371

SEQ ID NO: 274406 - RNA, 64 nt, hsa; identical to SEQ ID NO: 273372

SEQ ID NO: 274407 - RNA, 64 nt, hsa; identical to SEQ ID NO: 273373

SEQ ID NO: 274408 - RNA, 64 nt, hsa; identical to SEQ ID NO: 273374

SEQ ID NO: 274409 - RNA, 64 nt, hsa; identical to SEQ ID NO: 273375

SEQ ID NO: 274410 - RNA, 64 nt, hsa; identical to SEQ ID NO: 273376

SEQ ID NO: 274411 - RNA, 64 nt, hsa; identical to SEQ ID NO: 273377

SEQ ID NO: 274412 - RNA, 64 nt, hsa; identical to SEQ ID NO: 273378

SEQ ID NO: 274413 - RNA, 64 nt, hsa; identical to SEQ ID NO: 273379

SEQ ID NO: 274414 - RNA, 64 nt, hsa; identical to SEQ ID NO: 273380

SEQ ID NO: 274415 - RNA, 64 nt, hsa; identical to SEQ ID NO: 273381

SEQ ID NO: 274416 - RNA, 64 nt, hsa; identical to SEQ ID NO: 273382

SEQ ID NO: 274417 - RNA, 64 nt, hsa; identical to SEQ ID NO: 273383

SEQ ID NO: 274418 - RNA, 52 nt, hsa; identical to SEQ ID NO: 273384

SEQ ID NO: 274419 - RNA, 64 nt, hsa; identical to SEQ ID NO: 273385

SEQ ID NO: 274420 - RNA, 64 nt, hsa; identical to SEQ ID NO: 273386

SEQ ID NO: 274421 - RNA, 64 nt, hsa; identical to SEQ ID NO: 273387

SEQ ID NO: 274422 - RNA, 64 nt, hsa; identical to SEQ ID NO: 273388

SEQ ID NO: 274423 - RNA, 64 nt, hsa; identical to SEQ ID NO: 273389

SEQ ID NO: 274424 - RNA, 64 nt, hsa; identical to SEQ ID NO: 273390

SEQ ID NO: 274425 - RNA, 64 nt, hsa; identical to SEQ ID NO: 273391

SEQ ID NO: 274426 - RNA, 64 nt, hsa; identical to SEQ ID NO: 273392

SEQ ID NO: 274427 - RNA, 64 nt, hsa; identical to SEQ ID NO: 273393

SEQ ID NO: 274428 - RNA, 64 nt, hsa; identical to SEQ ID NO: 273394

SEQ ID NO: 274429 - RNA, 64 nt, hsa; identical to SEQ ID NO: 273395

SEQ ID NO: 274430 - RNA, 64 nt, hsa; identical to SEQ ID NO: 273396

SEQ ID NO: 274431 - RNA, 64 nt, hsa; identical to SEQ ID NO: 273397

SEQ ID NO: 274432 - RNA, 64 nt, hsa; identical to SEQ ID NO: 273398

SEQ ID NO: 274433 - RNA, 64 nt, hsa; identical to SEQ ID NO: 273399

SEQ ID NO: 274434 - RNA, 64 nt, hsa; identical to SEQ ID NO: 273400

SEQ ID NO: 274435 - RNA, 64 nt, hsa; identical to SEQ ID NO: 273401

SEQ ID NO: 274436 - RNA, 64 nt, hsa; identical to SEQ ID NO: 273401

SEQ ID NO: 274437 - RNA, 64 nt, hsa; identical to SEQ ID NO: 273403

SEQ ID NO: 274438 - RNA, 64 nt, hsa; identical to SEQ ID NO: 273404

SEQ ID NO: 274439 - RNA, 64 nt, hsa; identical to SEQ ID NO: 273405

SEQ ID NO: 274440 - RNA, 64 nt, hsa; identical to SEQ ID NO: 273406

SEQ ID NO: 274441 - RNA, 64 nt, hsa; identical to SEQ ID NO: 273407

SEQ ID NO: 274442 - RNA, 64 nt, hsa; identical to SEQ ID NO: 273408

SEQ ID NO: 274443 - RNA, 64 nt, hsa; identical to SEQ ID NO: 273409

SEQ ID NO: 274444 - RNA, 64 nt, hsa; identical to SEQ ID NO: 273410

SEQ ID NO: 274445 - RNA, 64 nt, hsa; identical to SEQ ID NO: 273411

SEQ ID NO: 274446 - RNA, 64 nt, hsa; identical to SEQ ID NO: 273412

SEQ ID NO: 274447 - RNA, 64 nt, hsa; identical to SEQ ID NO: 273413

SEQ ID NO: 274448 - RNA, 64 nt, hsa; identical to SEQ ID NO: 273414

SEQ ID NO: 274449 - RNA, 64 nt, hsa; identical to SEQ ID NO: 273415

SEQ ID NO: 274450 - RNA, 64 nt, hsa; identical to SEQ ID NO: 273416

SEQ ID NO: 274451 - RNA, 64 nt, hsa; identical to SEQ ID NO: 273417

SEQ ID NO: 274452 - RNA, 64 nt, hsa; identical to SEQ ID NO: 273418

SEQ ID NO: 274453 - RNA, 64 nt, hsa; identical to SEQ ID NO: 273419

SEQ ID NO: 274454 - RNA, 64 nt, hsa; identical to SEQ ID NO: 273420

SEQ ID NO: 274455 - RNA, 64 nt, hsa; identical to SEQ ID NO: 273421

SEQ ID NO: 274456 - RNA, 64 nt, hsa; identical to SEQ ID NO: 273422

SEQ ID NO: 274457 - RNA, 64 nt, hsa; identical to SEQ ID NO: 273423

SEQ ID NO: 274458 - RNA, 64 nt, hsa; identical to SEQ ID NO: 273424

SEQ ID NO: 274459 - RNA, 64 nt, hsa; identical to SEQ ID NO: 273425

SEQ ID NO: 274460 - RNA, 64 nt, hsa; identical to SEQ ID NO: 273426

SEQ ID NO: 274461 - RNA, 64 nt, hsa; identical to SEQ ID NO: 273427

SEQ ID NO: 274462 - RNA, 64 nt, hsa; identical to SEQ ID NO: 273428

SEQ ID NO: 274463 - RNA, 64 nt, hsa; identical to SEQ ID NO: 273429

SEQ ID NO: 274464 - RNA, 64 nt, hsa; identical to SEQ ID NO: 273430

SEQ ID NO: 274465 - RNA, 64 nt, hsa; identical to SEQ ID NO: 273431

SEQ ID NO: 274466 - RNA, 64 nt, hsa; identical to SEQ ID NO: 273432

SEQ ID NO: 274467 - RNA, 64 nt, hsa; identical to SEQ ID NO: 273433

SEQ ID NO: 274468 - RNA, 64 nt, hsa; identical to SEQ ID NO: 273434

SEQ ID NO: 274469 - RNA, 64 nt, hsa; identical to SEQ ID NO: 273435

SEQ ID NO: 274470 - RNA, 64 nt, hsa; identical to SEQ ID NO: 273436

SEQ ID NO: 274471 - RNA, 64 nt, hsa; identical to SEQ ID NO: 273437

SEQ ID NO: 274472 - RNA, 64 nt, hsa; identical to SEQ ID NO: 273438

SEQ ID NO: 274473 - RNA, 64 nt, hsa; identical to SEQ ID NO: 273439

SEQ ID NO: 274474 - RNA, 64 nt, hsa; identical to SEQ ID NO: 273440

SEQ ID NO: 274475 - RNA, 64 nt, hsa; identical to SEQ ID NO: 273441

SEQ ID NO: 274476 - RNA, 64 nt, hsa; identical to SEQ ID NO: 273442

SEQ ID NO: 274477 - RNA, 64 nt, hsa; identical to SEQ ID NO: 273443

SEQ ID NO: 274478 - RNA, 64 nt, hsa; identical to SEQ ID NO: 273444

SEQ ID NO: 274479 - RNA, 64 nt, hsa; identical to SEQ ID NO: 273445

SEQ ID NO: 274480 - RNA, 64 nt, hsa; identical to SEQ ID NO: 273446

SEQ ID NO: 274481 - RNA, 64 nt, hsa; identical to SEQ ID NO: 273447

SEQ ID NO: 274482 - RNA, 64 nt, hsa; identical to SEQ ID NO: 273448

SEQ ID NO: 274483 - RNA, 64 nt, hsa; identical to SEQ ID NO: 273449

SEQ ID NO: 274484 - RNA, 64 nt, hsa; identical to SEQ ID NO: 273450

SEQ ID NO: 274485 - RNA, 64 nt, hsa; identical to SEQ ID NO: 273451

SEQ ID NO: 274486 - RNA, 64 nt, hsa; identical to SEQ ID NO: 273452

SEQ ID NO: 274487 - RNA, 64 nt, hsa; identical to SEQ ID NO: 273453

SEQ ID NO: 274488 - RNA, 64 nt, hsa; identical to SEQ ID NO: 273454

SEQ ID NO: 274489 - RNA, 64 nt, hsa; identical to SEQ ID NO: 273455

SEQ ID NO: 274490 - RNA, 64 nt, hsa; identical to SEQ ID NO: 273456

SEQ ID NO: 274491 - RNA, 64 nt, hsa; identical to SEQ ID NO: 273457

SEQ ID NO: 274492 - RNA, 64 nt, hsa; identical to SEQ ID NO: 273458

SEQ ID NO: 274493 - RNA, 64 nt, hsa; identical to SEQ ID NO: 273459

SEQ ID NO: 274494 - RNA, 64 nt, hsa; identical to SEQ ID NO: 273460

SEQ ID NO: 274495 - RNA, 64 nt, hsa; identical to SEQ ID NO: 273461

SEQ ID NO: 274496 - RNA, 64 nt, hsa; identical to SEQ ID NO: 273462

SEQ ID NO: 274497 - RNA, 64 nt, hsa; identical to SEQ ID NO: 273463

SEQ ID NO: 274498 - RNA, 64 nt, hsa; identical to SEQ ID NO: 273464

SEQ ID NO: 274499 - RNA, 64 nt, hsa; identical to SEQ ID NO: 273465

SEQ ID NO: 274500 - RNA, 64 nt, hsa; identical to SEQ ID NO: 273466

SEQ ID NO: 274501 - RNA, 64 nt, hsa; identical to SEQ ID NO: 273467

SEQ ID NO: 274502 - RNA, 64 nt, hsa; identical to SEQ ID NO: 273468

SEQ ID NO: 274503 - RNA, 64 nt, hsa; identical to SEQ ID NO: 273469

SEQ ID NO: 274504 - RNA, 64 nt, hsa; identical to SEQ ID NO: 273470

SEQ ID NO: 274505 - RNA, 64 nt, hsa; identical to SEQ ID NO: 273471

SEQ ID NO: 274506 - RNA, 64 nt, hsa; identical to SEQ ID NO: 273472

SEQ ID NO: 274507 - RNA, 64 nt, hsa; identical to SEQ ID NO: 273473

SEQ ID NO: 274508 - RNA, 64 nt, hsa; identical to SEQ ID NO: 273474

SEQ ID NO: 274509 - RNA, 64 nt, hsa; identical to SEQ ID NO: 273475

SEQ ID NO: 274510 - RNA, 64 nt, hsa; identical to SEQ ID NO: 273476

SEQ ID NO: 274511 - RNA, 64 nt, hsa; identical to SEQ ID NO: 273477

SEQ ID NO: 274512 - RNA, 64 nt, hsa; identical to SEQ ID NO: 273478

SEQ ID NO: 274513 - RNA, 64 nt, hsa; identical to SEQ ID NO: 273479

SEQ ID NO: 274514 - RNA, 64 nt, hsa; identical to SEQ ID NO: 273480

SEQ ID NO: 274515 - RNA, 64 nt, hsa; identical to SEQ ID NO: 273481

SEQ ID NO: 274516 - RNA, 64 nt, hsa; identical to SEQ ID NO: 273482

SEQ ID NO: 274517 - RNA, 64 nt, hsa; identical to SEQ ID NO: 273483

SEQ ID NO: 274518 - RNA, 64 nt, hsa; identical to SEQ ID NO: 273484

SEQ ID NO: 274519 - RNA, 64 nt, hsa; identical to SEQ ID NO: 273485

SEQ ID NO: 274520 - RNA, 64 nt, hsa; identical to SEQ ID NO: 273486

SEQ ID NO: 274521 - RNA, 64 nt, hsa; identical to SEQ ID NO: 273487

SEQ ID NO: 274522 - RNA, 64 nt, hsa; identical to SEQ ID NO: 273488

SEQ ID NO: 274523 - RNA, 64 nt, hsa; identical to SEQ ID NO: 273489

SEQ ID NO: 274524 - RNA, 64 nt, hsa; identical to SEQ ID NO: 273490

SEQ ID NO: 274525 - RNA, 64 nt, hsa; identical to SEQ ID NO: 273491

SEQ ID NO: 274526 - RNA, 64 nt, hsa; identical to SEQ ID NO: 273492

SEQ ID NO: 274527 - RNA, 64 nt, hsa; identical to SEQ ID NO: 273493

SEQ ID NO: 274528 - RNA, 64 nt, hsa; identical to SEQ ID NO: 273494

SEQ ID NO: 274529 - RNA, 64 nt, hsa; identical to SEQ ID NO: 273495

SEQ ID NO: 274530 - RNA, 64 nt, hsa; identical to SEQ ID NO: 273496

SEQ ID NO: 274531 - RNA, 64 nt, hsa; identical to SEQ ID NO: 273497

SEQ ID NO: 274532 - RNA, 64 nt, hsa; identical to SEQ ID NO: 273498

SEQ ID NO: 274533 - RNA, 64 nt, hsa; identical to SEQ ID NO: 273499

SEQ ID NO: 274534 - RNA, 64 nt, hsa; identical to SEQ ID NO: 273500

SEQ ID NO: 274535 - RNA, 64 nt, hsa; identical to SEQ ID NO: 273501

SEQ ID NO: 274536 - RNA, 64 nt, hsa; identical to SEQ ID NO: 273502

SEQ ID NO: 274537 - RNA, 64 nt, hsa; identical to SEQ ID NO: 273503

SEQ ID NO: 274538 - RNA, 64 nt, hsa; identical to SEQ ID NO: 273504

SEQ ID NO: 274539 - RNA, 64 nt, hsa; identical to SEQ ID NO: 273505

SEQ ID NO: 274540 - RNA, 64 nt, hsa; identical to SEQ ID NO: 273506

SEQ ID NO: 274541 - RNA, 64 nt, hsa; identical to SEQ ID NO: 273507

SEQ ID NO: 274542 - RNA, 64 nt, hsa; identical to SEQ ID NO: 273508

SEQ ID NO: 274543 - RNA, 64 nt, hsa; identical to SEQ ID NO: 273509

SEQ ID NO: 274544 - RNA, 64 nt, hsa; identical to SEQ ID NO: 273510

SEQ ID NO: 274545 - RNA, 64 nt, hsa; identical to SEQ ID NO: 273511

SEQ ID NO: 274546 - RNA, 64 nt, hsa; identical to SEQ ID NO: 273512

SEQ ID NO: 274547 - RNA, 64 nt, hsa; identical to SEQ ID NO: 273513

SEQ ID NO: 274548 - RNA, 64 nt, hsa; identical to SEQ ID NO: 273514

SEQ ID NO: 274549 - RNA, 64 nt, hsa; identical to SEQ ID NO: 273515

SEQ ID NO: 274550 - RNA, 64 nt, hsa; identical to SEQ ID NO: 273516

SEQ ID NO: 274551 - RNA, 64 nt, hsa; identical to SEQ ID NO: 273517

SEQ ID NO: 274552 - RNA, 64 nt, hsa; identical to SEQ ID NO: 273518

SEQ ID NO: 274553 - RNA, 64 nt, hsa; identical to SEQ ID NO: 273519

SEQ ID NO: 274554 - RNA, 64 nt, hsa; identical to SEQ ID NO: 273520

SEQ ID NO: 274555 - RNA, 64 nt, hsa; identical to SEQ ID NO: 273521

SEQ ID NO: 274556 - RNA, 64 nt, hsa; identical to SEQ ID NO: 273522

SEQ ID NO: 274557 - RNA, 64 nt, hsa; identical to SEQ ID NO: 273523

SEQ ID NO: 274558 - RNA, 64 nt, hsa; identical to SEQ ID NO: 273524

SEQ ID NO: 274559 - RNA, 64 nt, hsa; identical to SEQ ID NO: 273525

SEQ ID NO: 274560 - RNA, 64 nt, hsa; identical to SEQ ID NO: 273526

SEQ ID NO: 274561 - RNA, 64 nt, hsa; identical to SEQ ID NO: 273527

SEQ ID NO: 274562 - RNA, 64 nt, hsa; identical to SEQ ID NO: 273528

SEQ ID NO: 274563 - RNA, 64 nt, hsa; identical to SEQ ID NO: 273529

SEQ ID NO: 274564 - RNA, 64 nt, hsa; identical to SEQ ID NO: 273530

SEQ ID NO: 274565 - RNA, 64 nt, hsa; identical to SEQ ID NO: 273531

SEQ ID NO: 274566 - RNA, 64 nt, hsa; identical to SEQ ID NO: 273532

SEQ ID NO: 274567 - RNA, 64 nt, hsa; identical to SEQ ID NO: 273533

SEQ ID NO: 274568 - RNA, 64 nt, hsa; identical to SEQ ID NO: 273534

SEQ ID NO: 274569 - RNA, 64 nt, hsa; identical to SEQ ID NO: 273535

SEQ ID NO: 274570 - RNA, 64 nt, hsa; identical to SEQ ID NO: 273536

SEQ ID NO: 274571 - RNA, 64 nt, hsa; identical to SEQ ID NO: 273537

SEQ ID NO: 274572 - RNA, 64 nt, hsa; identical to SEQ ID NO: 273538

SEQ ID NO: 274573 - RNA, 64 nt, hsa; identical to SEQ ID NO: 273539

SEQ ID NO: 274574 - RNA, 64 nt, hsa; identical to SEQ ID NO: 273540

SEQ ID NO: 274575 - RNA, 64 nt, hsa; identical to SEQ ID NO: 273541

SEQ ID NO: 274576 - RNA, 64 nt, hsa; identical to SEQ ID NO: 273542

SEQ ID NO: 274577 - RNA, 64 nt, hsa; identical to SEQ ID NO: 273543

SEQ ID NO: 274578 - RNA, 64 nt, hsa; identical to SEQ ID NO: 273544

SEQ ID NO: 274579 - RNA, 64 nt, hsa; identical to SEQ ID NO: 273545

SEQ ID NO: 274580 - RNA, 64 nt, hsa; identical to SEQ ID NO: 273546

SEQ ID NO: 274581 - RNA, 64 nt, hsa; identical to SEQ ID NO: 273547

SEQ ID NO: 274582 - RNA, 64 nt, hsa; identical to SEQ ID NO: 273548

SEQ ID NO: 274583 - RNA, 64 nt, hsa; identical to SEQ ID NO: 273549

SEQ ID NO: 274584 - RNA, 64 nt, hsa; identical to SEQ ID NO: 273550

SEQ ID NO: 274585 - RNA, 64 nt, hsa; identical to SEQ ID NO: 273551

SEQ ID NO: 274586 - RNA, 64 nt, hsa; identical to SEQ ID NO: 273552

SEQ ID NO: 274587 - RNA, 64 nt, hsa; identical to SEQ ID NO: 273553

SEQ ID NO: 274588 - RNA, 64 nt, hsa; identical to SEQ ID NO: 273554

SEQ ID NO: 274589 - RNA, 64 nt, hsa; identical to SEQ ID NO: 273555

SEQ ID NO: 274590 - RNA, 64 nt, hsa; identical to SEQ ID NO: 273556

SEQ ID NO: 274591 - RNA, 64 nt, hsa; identical to SEQ ID NO: 273557

SEQ ID NO: 274592 - RNA, 64 nt, hsa; identical to SEQ ID NO: 273558

SEQ ID NO: 274593 - RNA, 64 nt, hsa; identical to SEQ ID NO: 273559

SEQ ID NO: 274594 - RNA, 64 nt, hsa; identical to SEQ ID NO: 273560

SEQ ID NO: 274595 - RNA, 64 nt, hsa; identical to SEQ ID NO: 273561

SEQ ID NO: 274596 - RNA, 64 nt, hsa; identical to SEQ ID NO: 273562

SEQ ID NO: 274597 - RNA, 64 nt, hsa; identical to SEQ ID NO: 273563

SEQ ID NO: 274598 - RNA, 64 nt, hsa; identical to SEQ ID NO: 273564

SEQ ID NO: 274599 - RNA, 64 nt, hsa; identical to SEQ ID NO: 273565

SEQ ID NO: 274600 - RNA, 64 nt, hsa; identical to SEQ ID NO: 273566

SEQ ID NO: 274601 - RNA, 64 nt, hsa; identical to SEQ ID NO: 273567

SEQ ID NO: 274602 - RNA, 64 nt, hsa; identical to SEQ ID NO: 273568

SEQ ID NO: 274603 - RNA, 64 nt, hsa; identical to SEQ ID NO: 273569

SEQ ID NO: 274604 - RNA, 64 nt, hsa; identical to SEQ ID NO: 273570

SEQ ID NO: 274605 - RNA, 64 nt, hsa; identical to SEQ ID NO: 273571

SEQ ID NO: 274606 - RNA, 64 nt, hsa; identical to SEQ ID NO: 273572

SEQ ID NO: 274607 - RNA, 64 nt, hsa; identical to SEQ ID NO: 273573

SEQ ID NO: 274608 - RNA, 64 nt, hsa; identical to SEQ ID NO: 273574

SEQ ID NO: 274609 - RNA, 64 nt, hsa; identical to SEQ ID NO: 273575

SEQ ID NO: 274610 - RNA, 64 nt, hsa; identical to SEQ ID NO: 273576

SEQ ID NO: 274611 - RNA, 64 nt, hsa; identical to SEQ ID NO: 273577

SEQ ID NO: 274612 - RNA, 64 nt, hsa; identical to SEQ ID NO: 273578

SEQ ID NO: 274613 - RNA, 64 nt, hsa; identical to SEQ ID NO: 273579

SEQ ID NO: 274614 - RNA, 64 nt, hsa; identical to SEQ ID NO: 273580

SEQ ID NO: 274615 - RNA, 64 nt, hsa; identical to SEQ ID NO: 273581

SEQ ID NO: 274616 - RNA, 64 nt, hsa; identical to SEQ ID NO: 273582

SEQ ID NO: 274617 - RNA, 64 nt, hsa; identical to SEQ ID NO: 273583

SEQ ID NO: 274618 - RNA, 64 nt, hsa; identical to SEQ ID NO: 273584

SEQ ID NO: 274619 - RNA, 64 nt, hsa; identical to SEQ ID NO: 273585

SEQ ID NO: 274620 - RNA, 64 nt, hsa; identical to SEQ ID NO: 273585

SEQ ID NO: 274621 - RNA, 64 nt, hsa; identical to SEQ ID NO: 273587

SEQ ID NO: 274622 - RNA, 64 nt, hsa; identical to SEQ ID NO: 273588

SEQ ID NO: 274623 - RNA, 64 nt, hsa; identical to SEQ ID NO: 273589

SEQ ID NO: 274624 - RNA, 64 nt, hsa; identical to SEQ ID NO: 273590

SEQ ID NO: 274625 - RNA, 64 nt, hsa; identical to SEQ ID NO: 273591

SEQ ID NO: 274626 - RNA, 64 nt, hsa; identical to SEQ ID NO: 273592

SEQ ID NO: 274627 - RNA, 64 nt, hsa; identical to SEQ ID NO: 273593

SEQ ID NO: 274628 - RNA, 64 nt, hsa; identical to SEQ ID NO: 273594

SEQ ID NO: 274629 - RNA, 64 nt, hsa; identical to SEQ ID NO: 273595

SEQ ID NO: 274630 - RNA, 64 nt, hsa; identical to SEQ ID NO: 273596

SEQ ID NO: 274631 - RNA, 64 nt, hsa; identical to SEQ ID NO: 273597

SEQ ID NO: 274632 - RNA, 64 nt, hsa; identical to SEQ ID NO: 273598

SEQ ID NO: 274633 - RNA, 64 nt, hsa; identical to SEQ ID NO: 273599

SEQ ID NO: 274634 - RNA, 64 nt, hsa; identical to SEQ ID NO: 273600

SEQ ID NO: 274635 - RNA, 64 nt, hsa; identical to SEQ ID NO: 273601

SEQ ID NO: 274636 - RNA, 64 nt, hsa; identical to SEQ ID NO: 273602

SEQ ID NO: 274637 - RNA, 64 nt, hsa; identical to SEQ ID NO: 273603

SEQ ID NO: 274638 - RNA, 64 nt, hsa; identical to SEQ ID NO: 273604

SEQ ID NO: 274639 - RNA, 64 nt, hsa; identical to SEQ ID NO: 273605

SEQ ID NO: 274640 - RNA, 64 nt, hsa; identical to SEQ ID NO: 273606

SEQ ID NO: 274641 - RNA, 64 nt, hsa; identical to SEQ ID NO: 273607

SEQ ID NO: 274642 - RNA, 64 nt, hsa; identical to SEQ ID NO: 273608

SEQ ID NO: 274643 - RNA, 64 nt, hsa; identical to SEQ ID NO: 273609

SEQ ID NO: 274644 - RNA, 64 nt, hsa; identical to SEQ ID NO: 273610

SEQ ID NO: 274645 - RNA, 64 nt, hsa; identical to SEQ ID NO: 273611

SEQ ID NO: 274646 - RNA, 64 nt, hsa; identical to SEQ ID NO: 273612

SEQ ID NO: 274647 - RNA, 64 nt, hsa; identical to SEQ ID NO: 273613

SEQ ID NO: 274648 - RNA, 64 nt, hsa; identical to SEQ ID NO: 273614

SEQ ID NO: 274649 - RNA, 64 nt, hsa; identical to SEQ ID NO: 273615

SEQ ID NO: 274650 - RNA, 64 nt, hsa; identical to SEQ ID NO: 273616

SEQ ID NO: 274651 - RNA, 64 nt, hsa; identical to SEQ ID NO: 273617

SEQ ID NO: 274652 - RNA, 64 nt, hsa; identical to SEQ ID NO: 273618

SEQ ID NO: 274653 - RNA, 64 nt, hsa; identical to SEQ ID NO: 273619

SEQ ID NO: 274654 - RNA, 64 nt, hsa; identical to SEQ ID NO: 273620

SEQ ID NO: 274655 - RNA, 64 nt, hsa; identical to SEQ ID NO: 273621

SEQ ID NO: 274656 - RNA, 64 nt, hsa; identical to SEQ ID NO: 273622

SEQ ID NO: 274657 - RNA, 64 nt, hsa; identical to SEQ ID NO: 273623

SEQ ID NO: 274658 - RNA, 64 nt, hsa; identical to SEQ ID NO: 273624

SEQ ID NO: 274659 - RNA, 64 nt, hsa; identical to SEQ ID NO: 273625

SEQ ID NO: 274660 - RNA, 64 nt, hsa; identical to SEQ ID NO: 273626

SEQ ID NO: 274661 - RNA, 64 nt, hsa; identical to SEQ ID NO: 273627

SEQ ID NO: 274662 - RNA, 64 nt, hsa; identical to SEQ ID NO: 273628

SEQ ID NO: 274663 - RNA, 64 nt, hsa; identical to SEQ ID NO: 273629

SEQ ID NO: 274664 - RNA, 64 nt, hsa; identical to SEQ ID NO: 273630

SEQ ID NO: 274665 - RNA, 64 nt, hsa; identical to SEQ ID NO: 273631

SEQ ID NO: 274666 - RNA, 64 nt, hsa
uacagcgcucucucugcuucucucuugcauagacacaaucaagacaauagugcaccguuccuua

SEQ ID NO: 274667 - RNA, 64 nt, hsa
gagcaugaagcccaguggcaccaaauggcuggguacaaucaagugauauuuuguagcaccucac

SEQ ID NO: 274668 - RNA, 61 nt, hsa
aacaugcgaacacugcucacacgcgaguuuucacaguuauuucuauccacgccuaugaauc

SEQ ID NO: 274669 - RNA, 61 nt, hsa
aaugugaagaaagugugaauuuuaguuuugucacaguuaacugugucaaagagaauuaaaa

SEQ ID NO: 274670 - RNA, 61 nt, hsa
uucagaaauacagauaaaugauucaaaaagucacaguuaaggagaaucauguuucuuugau

SEQ ID NO: 274671 - RNA, 61 nt, hsa
aucucacauuuuuauaccuguuuaaauugcucacaguuauuacauacacaucagccaucaa

SEQ ID NO: 274672 - RNA, 64 nt, hsa; identical to SEQ ID NO: 76027

SEQ ID NO: 274673 - RNA, 64 nt, hsa; identical to SEQ ID NO: 76028

SEQ ID NO: 274674 - RNA, 64 nt, hsa; identical to SEQ ID NO: 76029

SEQ ID NO: 274675 - RNA, 64 nt, hsa; identical to SEQ ID NO: 76030

SEQ ID NO: 274676 - RNA, 64 nt, hsa; identical to SEQ ID NO: 76031

SEQ ID NO: 274677 - RNA, 64 nt, hsa; identical to SEQ ID NO: 76032

SEQ ID NO: 274678 - RNA, 64 nt, hsa; identical to SEQ ID NO: 76033

SEQ ID NO: 274679 - RNA, 64 nt, hsa; identical to SEQ ID NO: 76034

SEQ ID NO: 274680 - RNA, 64 nt, hsa; identical to SEQ ID NO: 76035

SEQ ID NO: 274681 - RNA, 64 nt, hsa; identical to SEQ ID NO: 76036

SEQ ID NO: 274682 - RNA, 64 nt, hsa; identical to SEQ ID NO: 76037

SEQ ID NO: 274683 - RNA, 64 nt, hsa; identical to SEQ ID NO: 76038

SEQ ID NO: 274684 - RNA, 64 nt, hsa; identical to SEQ ID NO: 76039

SEQ ID NO: 274685 - RNA, 64 nt, hsa; identical to SEQ ID NO: 76040

SEQ ID NO: 274686 - RNA, 64 nt, hsa; identical to SEQ ID NO: 76041

SEQ ID NO: 274687 - RNA, 64 nt, hsa; identical to SEQ ID NO: 76042

SEQ ID NO: 274688 - RNA, 64 nt, hsa; identical to SEQ ID NO: 76043

SEQ ID NO: 274689 - RNA, 64 nt, hsa; identical to SEQ ID NO: 76044

SEQ ID NO: 274690 - RNA, 64 nt, hsa; identical to SEQ ID NO: 76045

SEQ ID NO: 274691 - RNA, 64 nt, hsa; identical to SEQ ID NO: 76046

SEQ ID NO: 274692 - RNA, 64 nt, hsa; identical to SEQ ID NO: 76047

SEQ ID NO: 274693 - RNA, 64 nt, hsa; identical to SEQ ID NO: 76048

SEQ ID NO: 274694 - RNA, 64 nt, hsa; identical to SEQ ID NO: 76049

SEQ ID NO: 274695 - RNA, 64 nt, hsa; identical to SEQ ID NO: 76050

SEQ ID NO: 274696 - RNA, 64 nt, hsa; identical to SEQ ID NO: 76051

SEQ ID NO: 274697 - RNA, 64 nt, hsa; identical to SEQ ID NO: 76052

SEQ ID NO: 274698 - RNA, 64 nt, hsa; identical to SEQ ID NO: 76053

SEQ ID NO: 274699 - RNA, 64 nt, hsa; identical to SEQ ID NO: 76054

SEQ ID NO: 274700 - RNA, 64 nt, hsa; identical to SEQ ID NO: 76055

SEQ ID NO: 274701 - RNA, 64 nt, hsa; identical to SEQ ID NO: 76056

SEQ ID NO: 274702 - RNA, 64 nt, hsa; identical to SEQ ID NO: 76057

SEQ ID NO: 274703 - RNA, 64 nt, hsa; identical to SEQ ID NO: 76058

SEQ ID NO: 274704 - RNA, 52 nt, hsa; identical to SEQ ID NO: 76059

SEQ ID NO: 274705 - RNA, 64 nt, hsa; identical to SEQ ID NO: 76060

SEQ ID NO: 274706 - RNA, 64 nt, hsa; identical to SEQ ID NO: 76061

SEQ ID NO: 274707 - RNA, 64 nt, hsa; identical to SEQ ID NO: 76062

SEQ ID NO: 274708 - RNA, 64 nt, hsa; identical to SEQ ID NO: 76062

SEQ ID NO: 274709 - RNA, 64 nt, hsa; identical to SEQ ID NO: 76064

SEQ ID NO: 274710 - RNA, 64 nt, hsa; identical to SEQ ID NO: 76065

SEQ ID NO: 274711 - RNA, 64 nt, hsa; identical to SEQ ID NO: 76066

SEQ ID NO: 274712 - RNA, 64 nt, hsa; identical to SEQ ID NO: 76067

SEQ ID NO: 274713 - RNA, 64 nt, hsa; identical to SEQ ID NO: 76068

SEQ ID NO: 274714 - RNA, 64 nt, hsa; identical to SEQ ID NO: 76069

SEQ ID NO: 274715 - RNA, 64 nt, hsa; identical to SEQ ID NO: 76070

SEQ ID NO: 274716 - RNA, 64 nt, hsa; identical to SEQ ID NO: 76071

SEQ ID NO: 274717 - RNA, 64 nt, hsa; identical to SEQ ID NO: 76072

SEQ ID NO: 274718 - RNA, 64 nt, hsa; identical to SEQ ID NO: 76073

SEQ ID NO: 274719 - RNA, 64 nt, hsa; identical to SEQ ID NO: 76074

SEQ ID NO: 274720 - RNA, 64 nt, hsa; identical to SEQ ID NO: 76075

SEQ ID NO: 274721 - RNA, 64 nt, hsa; identical to SEQ ID NO: 76076

SEQ ID NO: 274722 - RNA, 64 nt, hsa; identical to SEQ ID NO: 76077

SEQ ID NO: 274723 - RNA, 64 nt, hsa; identical to SEQ ID NO: 76078

SEQ ID NO: 274724 - RNA, 64 nt, hsa; identical to SEQ ID NO: 76079

SEQ ID NO: 274725 - RNA, 64 nt, hsa; identical to SEQ ID NO: 76080

SEQ ID NO: 274726 - RNA, 64 nt, hsa; identical to SEQ ID NO: 76081

SEQ ID NO: 274727 - RNA, 64 nt, hsa; identical to SEQ ID NO: 76082

SEQ ID NO: 274728 - RNA, 64 nt, hsa; identical to SEQ ID NO: 76083

SEQ ID NO: 274729 - RNA, 64 nt, hsa; identical to SEQ ID NO: 76084

SEQ ID NO: 274730 - RNA, 64 nt, hsa; identical to SEQ ID NO: 76085

SEQ ID NO: 274731 - RNA, 64 nt, hsa; identical to SEQ ID NO: 76086

SEQ ID NO: 274732 - RNA, 64 nt, hsa; identical to SEQ ID NO: 76087

SEQ ID NO: 274733 - RNA, 64 nt, hsa; identical to SEQ ID NO: 76088

SEQ ID NO: 274734 - RNA, 64 nt, hsa; identical to SEQ ID NO: 76089

SEQ ID NO: 274735 - RNA, 64 nt, hsa; identical to SEQ ID NO: 76090

SEQ ID NO: 274736 - RNA, 64 nt, hsa; identical to SEQ ID NO: 76090

SEQ ID NO: 274737 - RNA, 64 nt, hsa
accaaucccgaucggcucuuauuagcuccccgcuccacaagacaccugugacauccuccagggc

SEQ ID NO: 274738 - RNA, 64 nt, hsa
accaaucccgaucggcucuuauuagcuccccgcuccacaagacaccugugaucuggaaaucuac

SEQ ID NO: 274739 - RNA, 64 nt, hsa
accaaucccgaucggcucuuauuagcuccccgcuccacaagacaccugugcuuuggaaauccac

SEQ ID NO: 274740 - RNA, 64 nt, hsa
ucuuuaccaacaucuugaauauauauucuaguguccacaagauuuagcaaaaagauaaagcuug

SEQ ID NO: 274741 - RNA, 64 nt, hsa
agaaaauguauugugauugaaauuauuuuguccuccacaagauggcucuaugaguauucuucca

SEQ ID NO: 274742 - RNA, 64 nt, hsa
cucucucccuguccucagacccuggaaaagugaaccacaagacucccuccagugaggagcuggg

SEQ ID NO: 274743 - RNA, 64 nt, hsa
uguguuuauuaauugacaaugacccaaaucucuuccacaagacuuaaaaccaaauucagggaca

SEQ ID NO: 274744 - RNA, 64 nt, hsa; identical to SEQ ID NO: 76027

SEQ ID NO: 274745 - RNA, 64 nt, hsa; identical to SEQ ID NO: 76028

SEQ ID NO: 274746 - RNA, 64 nt, hsa; identical to SEQ ID NO: 76029

SEQ ID NO: 274747 - RNA, 64 nt, hsa; identical to SEQ ID NO: 76030

SEQ ID NO: 274748 - RNA, 64 nt, hsa; identical to SEQ ID NO: 76031

SEQ ID NO: 274749 - RNA, 64 nt, hsa; identical to SEQ ID NO: 76032

SEQ ID NO: 274750 - RNA, 64 nt, hsa; identical to SEQ ID NO: 76033

SEQ ID NO: 274751 - RNA, 64 nt, hsa; identical to SEQ ID NO: 76034

SEQ ID NO: 274752 - RNA, 64 nt, hsa; identical to SEQ ID NO: 76035

SEQ ID NO: 274753 - RNA, 64 nt, hsa; identical to SEQ ID NO: 76036

SEQ ID NO: 274754 - RNA, 64 nt, hsa; identical to SEQ ID NO: 76037

SEQ ID NO: 274755 - RNA, 64 nt, hsa; identical to SEQ ID NO: 76038

SEQ ID NO: 274756 - RNA, 64 nt, hsa; identical to SEQ ID NO: 76039

SEQ ID NO: 274757 - RNA, 64 nt, hsa; identical to SEQ ID NO: 76040

SEQ ID NO: 274758 - RNA, 64 nt, hsa; identical to SEQ ID NO: 76041

SEQ ID NO: 274759 - RNA, 64 nt, hsa; identical to SEQ ID NO: 76042

SEQ ID NO: 274760 - RNA, 64 nt, hsa; identical to SEQ ID NO: 76043

SEQ ID NO: 274761 - RNA, 64 nt, hsa; identical to SEQ ID NO: 76044

SEQ ID NO: 274762 - RNA, 64 nt, hsa; identical to SEQ ID NO: 76045

SEQ ID NO: 274763 - RNA, 64 nt, hsa; identical to SEQ ID NO: 76046

SEQ ID NO: 274764 - RNA, 64 nt, hsa; identical to SEQ ID NO: 76047

SEQ ID NO: 274765 - RNA, 64 nt, hsa; identical to SEQ ID NO: 76048

SEQ ID NO: 274766 - RNA, 64 nt, hsa; identical to SEQ ID NO: 76049

SEQ ID NO: 274767 - RNA, 64 nt, hsa; identical to SEQ ID NO: 76050

SEQ ID NO: 274768 - RNA, 64 nt, hsa; identical to SEQ ID NO: 76051

SEQ ID NO: 274769 - RNA, 64 nt, hsa; identical to SEQ ID NO: 76052

SEQ ID NO: 274770 - RNA, 64 nt, hsa; identical to SEQ ID NO: 76053

SEQ ID NO: 274771 - RNA, 64 nt, hsa; identical to SEQ ID NO: 76054

SEQ ID NO: 274772 - RNA, 64 nt, hsa; identical to SEQ ID NO: 76055

SEQ ID NO: 274773 - RNA, 64 nt, hsa; identical to SEQ ID NO: 76056

SEQ ID NO: 274774 - RNA, 64 nt, hsa; identical to SEQ ID NO: 76057

SEQ ID NO: 274775 - RNA, 64 nt, hsa; identical to SEQ ID NO: 76058

SEQ ID NO: 274776 - RNA, 52 nt, hsa; identical to SEQ ID NO: 76059

SEQ ID NO: 274777 - RNA, 64 nt, hsa; identical to SEQ ID NO: 76060

SEQ ID NO: 274778 - RNA, 64 nt, hsa; identical to SEQ ID NO: 76061

SEQ ID NO: 274779 - RNA, 64 nt, hsa; identical to SEQ ID NO: 76062

SEQ ID NO: 274780 - RNA, 64 nt, hsa; identical to SEQ ID NO: 76062

SEQ ID NO: 274781 - RNA, 64 nt, hsa; identical to SEQ ID NO: 76064

SEQ ID NO: 274782 - RNA, 64 nt, hsa; identical to SEQ ID NO: 76065

SEQ ID NO: 274783 - RNA, 64 nt, hsa; identical to SEQ ID NO: 76066

SEQ ID NO: 274784 - RNA, 64 nt, hsa; identical to SEQ ID NO: 76067

SEQ ID NO: 274785 - RNA, 64 nt, hsa; identical to SEQ ID NO: 76068

SEQ ID NO: 274786 - RNA, 64 nt, hsa; identical to SEQ ID NO: 76069

SEQ ID NO: 274787 - RNA, 64 nt, hsa; identical to SEQ ID NO: 76070

SEQ ID NO: 274788 - RNA, 64 nt, hsa; identical to SEQ ID NO: 76071

SEQ ID NO: 274789 - RNA, 64 nt, hsa; identical to SEQ ID NO: 76072

SEQ ID NO: 274790 - RNA, 64 nt, hsa; identical to SEQ ID NO: 76073

SEQ ID NO: 274791 - RNA, 64 nt, hsa; identical to SEQ ID NO: 76074

SEQ ID NO: 274792 - RNA, 64 nt, hsa; identical to SEQ ID NO: 76075

SEQ ID NO: 274793 - RNA, 64 nt, hsa; identical to SEQ ID NO: 76076

SEQ ID NO: 274794 - RNA, 64 nt, hsa; identical to SEQ ID NO: 76077

SEQ ID NO: 274795 - RNA, 64 nt, hsa; identical to SEQ ID NO: 76078

SEQ ID NO: 274796 - RNA, 64 nt, hsa; identical to SEQ ID NO: 76079

SEQ ID NO: 274797 - RNA, 64 nt, hsa; identical to SEQ ID NO: 76080

SEQ ID NO: 274798 - RNA, 64 nt, hsa; identical to SEQ ID NO: 76081

SEQ ID NO: 274799 - RNA, 64 nt, hsa; identical to SEQ ID NO: 76082

SEQ ID NO: 274800 - RNA, 64 nt, hsa; identical to SEQ ID NO: 76083

SEQ ID NO: 274801 - RNA, 64 nt, hsa; identical to SEQ ID NO: 76084

SEQ ID NO: 274802 - RNA, 64 nt, hsa; identical to SEQ ID NO: 76085

SEQ ID NO: 274803 - RNA, 64 nt, hsa; identical to SEQ ID NO: 76086

SEQ ID NO: 274804 - RNA, 64 nt, hsa; identical to SEQ ID NO: 76087

SEQ ID NO: 274805 - RNA, 64 nt, hsa; identical to SEQ ID NO: 76088

SEQ ID NO: 274806 - RNA, 64 nt, hsa; identical to SEQ ID NO: 76089

SEQ ID NO: 274807 - RNA, 64 nt, hsa; identical to SEQ ID NO: 76090

SEQ ID NO: 274808 - RNA, 64 nt, hsa; identical to SEQ ID NO: 76090

SEQ ID NO: 274809 - RNA, 64 nt, hsa; identical to SEQ ID NO: 274737

SEQ ID NO: 274810 - RNA, 64 nt, hsa; identical to SEQ ID NO: 274738

SEQ ID NO: 274811 - RNA, 64 nt, hsa; identical to SEQ ID NO: 274739

SEQ ID NO: 274812 - RNA, 64 nt, hsa; identical to SEQ ID NO: 274740

SEQ ID NO: 274813 - RNA, 64 nt, hsa; identical to SEQ ID NO: 274741

SEQ ID NO: 274814 - RNA, 64 nt, hsa; identical to SEQ ID NO: 274742

SEQ ID NO: 274815 - RNA, 64 nt, hsa; identical to SEQ ID NO: 274743

SEQ ID NO: 274816 - RNA, 64 nt, hsa
cuagccaggugcaguccccgccccgccuaguccucggcgucacgcaaugcucaccucgccucuu

SEQ ID NO: 274817 - RNA, 64 nt, hsa
aaaaugagcugagaaggaguguuauggccaggugcggcgucaugcaccuauagucccagcugcu

SEQ ID NO: 274818 - RNA, 64 nt, hsa
aaccaggcuccugugaggacaacagccugggccucggcgucaaucaucgauaagaagccucuac

SEQ ID NO: 274819 - RNA, 64 nt, hsa
gagauugacccacaauaaagcacaggccuuaccgcggcgucacccucucccacuccuuuguucu

SEQ ID NO: 274820 - RNA, 64 nt, hsa
accccccacacucacuccugagaccccuggccuccggcgucagccuccagccucuguuccccua

SEQ ID NO: 274821 - RNA, 64 nt, hsa
auuccugguuaucucaccaacgaaggcuaggaggcggcgucagaggugcugggugacagagcca

SEQ ID NO: 274822 - RNA, 64 nt, hsa
ccugccucgugccaccucaugcuuauaauaaagccggcgucagagaccgcugcuucccucaccu

SEQ ID NO: 274823 - RNA, 64 nt, hsa
aguuuaccaagugcaaauccaagaagacccagaacggcgucacuucucagacacugaagaacuc

SEQ ID NO: 274824 - RNA, 64 nt, hsa
uauuacggugacuugaaugucagauucaagggcccggcgucaaaggaaauugguuuugacuuuu

SEQ ID NO: 274825 - RNA, 64 nt, hsa
aaucuguguauauuauuuggcaguuugguauuugcggcgucagucuuuuucuguuguaacuuau

SEQ ID NO: 274826 - RNA, 64 nt, hsa
gguuaguuuucuuuguuccagaacaucaugaaagcggcgucauguacuguguauucuuaugaau

SEQ ID NO: 274827 - RNA, 64 nt, hsa
ucacacaaggggaaagggcgccaagccaaggagccggcgucauccgacguaacuuccgcccuuu

SEQ ID NO: 274828 - RNA, 64 nt, hsa
uuguuuuguccaugccuuccucccugcacgcacacggcgucaaaaccaagcugccggccacugu

SEQ ID NO: 274829 - RNA, 64 nt, hsa
acacauacacacucacugaucuacagccccuguucggcgucagaguccccacuagacccagugg

SEQ ID NO: 274830 - RNA, 64 nt, hsa
uguuucugugcuccaaguugagacucggccgcagcggcgucagacuuuucuuugcgauguccuc

SEQ ID NO: 274831 - RNA, 64 nt, hsa
gaagagaggcggggccgcguccuccuggcgucaccggcgucacugucauuccuuggugucugug

SEQ ID NO: 274832 - RNA, 64 nt, hsa
ugaguuggccucgcccggaccauuaggcggacugcggcgucagggggauagcggguggugaggg

SEQ ID NO: 274833 - RNA, 64 nt, hsa; identical to SEQ ID NO: 71880

SEQ ID NO: 274834 - RNA, 64 nt, hsa; identical to SEQ ID NO: 71881

SEQ ID NO: 274835 - RNA, 64 nt, hsa; identical to SEQ ID NO: 71882

SEQ ID NO: 274836 - RNA, 64 nt, hsa; identical to SEQ ID NO: 71883

SEQ ID NO: 274837 - RNA, 64 nt, hsa; identical to SEQ ID NO: 71884

SEQ ID NO: 274838 - RNA, 64 nt, hsa; identical to SEQ ID NO: 71885

SEQ ID NO: 274839 - RNA, 64 nt, hsa; identical to SEQ ID NO: 71886

SEQ ID NO: 274840 - RNA, 64 nt, hsa; identical to SEQ ID NO: 71887

SEQ ID NO: 274841 - RNA, 64 nt, hsa; identical to SEQ ID NO: 71888

SEQ ID NO: 274842 - RNA, 64 nt, hsa; identical to SEQ ID NO: 71889

SEQ ID NO: 274843 - RNA, 64 nt, hsa; identical to SEQ ID NO: 71890

SEQ ID NO: 274844 - RNA, 64 nt, hsa; identical to SEQ ID NO: 71891

SEQ ID NO: 274845 - RNA, 64 nt, hsa; identical to SEQ ID NO: 71892

SEQ ID NO: 274846 - RNA, 64 nt, hsa; identical to SEQ ID NO: 71893

SEQ ID NO: 274847 - RNA, 64 nt, hsa; identical to SEQ ID NO: 71894

SEQ ID NO: 274848 - RNA, 64 nt, hsa; identical to SEQ ID NO: 71895

SEQ ID NO: 274849 - RNA, 64 nt, hsa; identical to SEQ ID NO: 71896

SEQ ID NO: 274850 - RNA, 64 nt, hsa; identical to SEQ ID NO: 71897

SEQ ID NO: 274851 - RNA, 64 nt, hsa; identical to SEQ ID NO: 71898

SEQ ID NO: 274852 - RNA, 64 nt, hsa; identical to SEQ ID NO: 71899

SEQ ID NO: 274853 - RNA, 64 nt, hsa; identical to SEQ ID NO: 71900

SEQ ID NO: 274854 - RNA, 64 nt, hsa; identical to SEQ ID NO: 147936

SEQ ID NO: 274855 - RNA, 64 nt, hsa; identical to SEQ ID NO: 147937

SEQ ID NO: 274856 - RNA, 64 nt, hsa; identical to SEQ ID NO: 147938

SEQ ID NO: 274857 - RNA, 64 nt, hsa; identical to SEQ ID NO: 147939

SEQ ID NO: 274858 - RNA, 64 nt, hsa; identical to SEQ ID NO: 147940

SEQ ID NO: 274859 - RNA, 64 nt, hsa; identical to SEQ ID NO: 147941

SEQ ID NO: 274860 - RNA, 64 nt, hsa; identical to SEQ ID NO: 94750

SEQ ID NO: 274861 - RNA, 64 nt, hsa; identical to SEQ ID NO: 94751

SEQ ID NO: 274862 - RNA, 64 nt, hsa; identical to SEQ ID NO: 94752

SEQ ID NO: 274863 - RNA, 64 nt, hsa; identical to SEQ ID NO: 94753

SEQ ID NO: 274864 - RNA, 64 nt, hsa; identical to SEQ ID NO: 94754

SEQ ID NO: 274865 - RNA, 64 nt, hsa; identical to SEQ ID NO: 94755

SEQ ID NO: 274866 - RNA, 64 nt, hsa; identical to SEQ ID NO: 94756

SEQ ID NO: 274867 - RNA, 64 nt, hsa; identical to SEQ ID NO: 94757

SEQ ID NO: 274868 - RNA, 64 nt, hsa; identical to SEQ ID NO: 94758

SEQ ID NO: 274869 - RNA, 64 nt, hsa; identical to SEQ ID NO: 94759

SEQ ID NO: 274870 - RNA, 64 nt, hsa; identical to SEQ ID NO: 94760

SEQ ID NO: 274871 - RNA, 64 nt, hsa; identical to SEQ ID NO: 94761

SEQ ID NO: 274872 - RNA, 64 nt, hsa; identical to SEQ ID NO: 94762

SEQ ID NO: 274873 - RNA, 64 nt, hsa; identical to SEQ ID NO: 94763

SEQ ID NO: 274874 - RNA, 64 nt, hsa; identical to SEQ ID NO: 94764

SEQ ID NO: 274875 - RNA, 64 nt, hsa; identical to SEQ ID NO: 94765

SEQ ID NO: 274876 - RNA, 64 nt, hsa; identical to SEQ ID NO: 94766

SEQ ID NO: 274877 - RNA, 64 nt, hsa; identical to SEQ ID NO: 94767

SEQ ID NO: 274878 - RNA, 64 nt, hsa; identical to SEQ ID NO: 94768

SEQ ID NO: 274879 - RNA, 64 nt, hsa; identical to SEQ ID NO: 94769

SEQ ID NO: 274880 - RNA, 64 nt, hsa; identical to SEQ ID NO: 94770

SEQ ID NO: 274881 - RNA, 64 nt, hsa; identical to SEQ ID NO: 94771

SEQ ID NO: 274882 - RNA, 64 nt, hsa; identical to SEQ ID NO: 94772

SEQ ID NO: 274883 - RNA, 64 nt, hsa; identical to SEQ ID NO: 94773

SEQ ID NO: 274884 - RNA, 64 nt, hsa; identical to SEQ ID NO: 94774

SEQ ID NO: 274885 - RNA, 64 nt, hsa; identical to SEQ ID NO: 94775

SEQ ID NO: 274886 - RNA, 64 nt, hsa; identical to SEQ ID NO: 94776

SEQ ID NO: 274887 - RNA, 64 nt, hsa; identical to SEQ ID NO: 94777

SEQ ID NO: 274888 - RNA, 64 nt, hsa; identical to SEQ ID NO: 94778

SEQ ID NO: 274889 - RNA, 64 nt, hsa; identical to SEQ ID NO: 94779

SEQ ID NO: 274890 - RNA, 64 nt, hsa; identical to SEQ ID NO: 94780

SEQ ID NO: 274891 - RNA, 64 nt, hsa; identical to SEQ ID NO: 94781

SEQ ID NO: 274892 - RNA, 64 nt, hsa; identical to SEQ ID NO: 94782

SEQ ID NO: 274893 - RNA, 64 nt, hsa; identical to SEQ ID NO: 94783

SEQ ID NO: 274894 - RNA, 64 nt, hsa; identical to SEQ ID NO: 94784

SEQ ID NO: 274895 - RNA, 64 nt, hsa; identical to SEQ ID NO: 94785

SEQ ID NO: 274896 - RNA, 64 nt, hsa; identical to SEQ ID NO: 94786

SEQ ID NO: 274897 - RNA, 64 nt, hsa; identical to SEQ ID NO: 94787

SEQ ID NO: 274898 - RNA, 64 nt, hsa; identical to SEQ ID NO: 94788

SEQ ID NO: 274899 - RNA, 64 nt, hsa; identical to SEQ ID NO: 94789

SEQ ID NO: 274900 - RNA, 64 nt, hsa; identical to SEQ ID NO: 94790

SEQ ID NO: 274901 - RNA, 64 nt, hsa; identical to SEQ ID NO: 94791

SEQ ID NO: 274902 - RNA, 64 nt, hsa; identical to SEQ ID NO: 94792

SEQ ID NO: 274903 - RNA, 64 nt, hsa; identical to SEQ ID NO: 94793

SEQ ID NO: 274904 - RNA, 64 nt, hsa; identical to SEQ ID NO: 94794

SEQ ID NO: 274905 - RNA, 64 nt, hsa; identical to SEQ ID NO: 94795

SEQ ID NO: 274906 - RNA, 64 nt, hsa; identical to SEQ ID NO: 94796

SEQ ID NO: 274907 - RNA, 64 nt, hsa; identical to SEQ ID NO: 94797

SEQ ID NO: 274908 - RNA, 64 nt, hsa; identical to SEQ ID NO: 94798

SEQ ID NO: 274909 - RNA, 64 nt, hsa; identical to SEQ ID NO: 94799

SEQ ID NO: 274910 - RNA, 64 nt, hsa; identical to SEQ ID NO: 94800

SEQ ID NO: 274911 - RNA, 64 nt, hsa; identical to SEQ ID NO: 94801

SEQ ID NO: 274912 - RNA, 64 nt, hsa; identical to SEQ ID NO: 94802

SEQ ID NO: 274913 - RNA, 64 nt, hsa; identical to SEQ ID NO: 94803

SEQ ID NO: 274914 - RNA, 64 nt, hsa; identical to SEQ ID NO: 94804

SEQ ID NO: 274915 - RNA, 64 nt, hsa; identical to SEQ ID NO: 94805

SEQ ID NO: 274916 - RNA, 64 nt, hsa; identical to SEQ ID NO: 94806

SEQ ID NO: 274917 - RNA, 64 nt, hsa; identical to SEQ ID NO: 94807

SEQ ID NO: 274918 - RNA, 64 nt, hsa; identical to SEQ ID NO: 94808

SEQ ID NO: 274919 - RNA, 64 nt, hsa; identical to SEQ ID NO: 94809

SEQ ID NO: 274920 - RNA, 64 nt, hsa; identical to SEQ ID NO: 94810

SEQ ID NO: 274921 - RNA, 64 nt, hsa; identical to SEQ ID NO: 94811

SEQ ID NO: 274922 - RNA, 64 nt, hsa; identical to SEQ ID NO: 94812

SEQ ID NO: 274923 - RNA, 64 nt, hsa; identical to SEQ ID NO: 94813

SEQ ID NO: 274924 - RNA, 64 nt, hsa; identical to SEQ ID NO: 94814

SEQ ID NO: 274925 - RNA, 64 nt, hsa; identical to SEQ ID NO: 94815

SEQ ID NO: 274926 - RNA, 64 nt, hsa; identical to SEQ ID NO: 94816

SEQ ID NO: 274927 - RNA, 64 nt, hsa; identical to SEQ ID NO: 94817

SEQ ID NO: 274928 - RNA, 64 nt, hsa; identical to SEQ ID NO: 94818

SEQ ID NO: 274929 - RNA, 64 nt, hsa; identical to SEQ ID NO: 94819

SEQ ID NO: 274930 - RNA, 64 nt, hsa; identical to SEQ ID NO: 94820

SEQ ID NO: 274931 - RNA, 64 nt, hsa; identical to SEQ ID NO: 94821

SEQ ID NO: 274932 - RNA, 64 nt, hsa; identical to SEQ ID NO: 94822

SEQ ID NO: 274933 - RNA, 64 nt, hsa; identical to SEQ ID NO: 94823

SEQ ID NO: 274934 - RNA, 64 nt, hsa; identical to SEQ ID NO: 94824

SEQ ID NO: 274935 - RNA, 64 nt, hsa; identical to SEQ ID NO: 94825

SEQ ID NO: 274936 - RNA, 64 nt, hsa; identical to SEQ ID NO: 94826

SEQ ID NO: 274937 - RNA, 64 nt, hsa; identical to SEQ ID NO: 94827

SEQ ID NO: 274938 - RNA, 64 nt, hsa; identical to SEQ ID NO: 94828

SEQ ID NO: 274939 - RNA, 64 nt, hsa; identical to SEQ ID NO: 94829

SEQ ID NO: 274940 - RNA, 64 nt, hsa; identical to SEQ ID NO: 94830

SEQ ID NO: 274941 - RNA, 64 nt, hsa; identical to SEQ ID NO: 94831

SEQ ID NO: 274942 - RNA, 64 nt, hsa; identical to SEQ ID NO: 94832

SEQ ID NO: 274943 - RNA, 64 nt, hsa; identical to SEQ ID NO: 94833

SEQ ID NO: 274944 - RNA, 64 nt, hsa; identical to SEQ ID NO: 94834

SEQ ID NO: 274945 - RNA, 64 nt, hsa; identical to SEQ ID NO: 94835

SEQ ID NO: 274946 - RNA, 64 nt, hsa
auuauauucccacauccugagaaaggucauuucucccacacacgacaaagucacagacauccug

SEQ ID NO: 274947 - RNA, 64 nt, hsa
guuuuaaauuuuucucaguuccagugauagaaaacccacacaauacauccucugccagucuuaa

SEQ ID NO: 274948 - RNA, 64 nt, hsa
aagaagccuuacucccugcacauucccucaugcucccacacaaguccagcaauggaaaugcuug

SEQ ID NO: 274949 - RNA, 64 nt, hsa
uggaagcugaaauugaugaucccugaagguugaacccacacacaccccugcagccuccccagau

SEQ ID NO: 274950 - RNA, 64 nt, hsa
ucccaguauuucaucaaggacagggaauaucccucccacacacaggccagcugcucacccugcc

SEQ ID NO: 274951 - RNA, 64 nt, hsa
uccuuggacagcagauccacacaccacuuccccacccacacacaguacccugggcugguuggac

SEQ ID NO: 274952 - RNA, 64 nt, hsa
agcuuggaggagcccagagaccguuugcuuuauacccacacagcaacugguccacugcuuuacu

SEQ ID NO: 274953 - RNA, 64 nt, hsa
uaggaaacagacuaugauuaauccauuuauucuucccacacacuuaccuuacuaagucuuugcu

SEQ ID NO: 274954 - RNA, 64 nt, hsa
aguaggggcagugccacuuucuacaaccugccaacccacacacuggaguaauucugaaaaaaau

SEQ ID NO: 274955 - RNA, 64 nt, hsa
gucucuccuucucucucuccccccaccacccacccccacacacgucaucugcauuguuauugga

SEQ ID NO: 274956 - RNA, 64 nt, hsa
cuugucgcuuuuaggaccucccacaaccugguuccccacacauccauaguucugccuccccagc

SEQ ID NO: 274957 - RNA, 64 nt, hsa
ccgcggggccugugagcggagaggggcccugcuucccacacaaauccgccccggugcacccccg

SEQ ID NO: 274958 - RNA, 64 nt, hsa
cccaggaucacaccucgacacccaaccccugaaccccacacacucugccaugcacacaggagga

SEQ ID NO: 274959 - RNA, 64 nt, hsa
uggaguugaggcuguugucagcaaagccccuggucccacacagcucugcccuagagccaccucu

SEQ ID NO: 274960 - RNA, 64 nt, hsa
ugggagagcagccauccccugcuggcaccauagacccacacaaggagccugcacagcaagccag

SEQ ID NO: 274961 - RNA, 64 nt, hsa
ugcuuccacuugcagagcaccgugccaagcacuucccacacacuuacccguuugauucuccuag

SEQ ID NO: 274962 - RNA, 64 nt, hsa
cccggggccacugguggcuccccagagccucagacccacacagcccagaggacgaggccuucaa

SEQ ID NO: 274963 - RNA, 64 nt, hsa
aggcugccaccgcggccugaucaugcccucugugcccacacaggucucugagcggccccugaug

SEQ ID NO: 274964 - RNA, 64 nt, hsa
ucuuugcuggcuggcugccucugcugccccauaccccacacacucaucagccugaaguuagccc

SEQ ID NO: 274965 - RNA, 64 nt, hsa
cagucuccacagccauccuggcccacacaggcaccccacacaaaccuauuuauugaaucugcug

SEQ ID NO: 274966 - RNA, 64 nt, hsa
aguccaccagcuccagucuccacagccauccuggcccacacaggcaccccacacaaaccuauuu

SEQ ID NO: 274967 - RNA, 64 nt, hsa
gaggccccuggcccagcggccccucccacacacacccacacacucgcccgcccacuguccuggg

SEQ ID NO: 274968 - RNA, 64 nt, hsa
cccagagcaggaggccccuggcccagcggccccucccacacacacccacacacucgcccgccca

SEQ ID NO: 274969 - RNA, 64 nt, hsa
cugguggggaauggcuggggcugggcaggacccucccacacaccugcacccuagcuucgugcuu

SEQ ID NO: 274970 - RNA, 64 nt, hsa
agagaccugugcaaaucugagcuccggcuccgaccccacacacccugagggagcccuacccuag

SEQ ID NO: 274971 - RNA, 64 nt, hsa
gcugcccugcccgucucagggccaccaagucugacccacacagcgucacucacucccacacaca

SEQ ID NO: 274972 - RNA, 64 nt, hsa
gccaccaagucugacccacacagcgucacucacucccacacacacccccuggcucugcugaggu

SEQ ID NO: 274973 - RNA, 64 nt, hsa
gggcagggaggggacuggggaagugcgcacacagcccacacagacaacacgcacccacacagac

SEQ ID NO: 274974 - RNA, 64 nt, hsa
gaagugcgcacacagcccacacagacaacacgcacccacacagacacagagggaagggguuggg

SEQ ID NO: 274975 - RNA, 64 nt, hsa
aagucuagauccuggcagcccagucacagaguaucccacacacacuggugcccagagccggcuu

SEQ ID NO: 274976 - RNA, 64 nt, hsa
uggauccuggaccucuacgucuuaaccacuggaucccacacaaaucagugaauggaucccaaca

SEQ ID NO: 274977 - RNA, 64 nt, hsa
uucccgcuucugaaacucccccuggagucucacucccacacaugcccauagcuagcauucaaca

SEQ ID NO: 274978 - RNA, 64 nt, hsa
ccgaguuucuguccacacauugcaugcacagcgccccacacauuggauacuguuguucacgaua

SEQ ID NO: 274979 - RNA, 64 nt, hsa
uggggggggccaggcuccagagagggggcaccuccccacacaccccccccccaccgaggccuag

SEQ ID NO: 274980 - RNA, 64 nt, hsa
cggggcucagccucccccugggccgaggccuuggcccacacagcugagggagaggcccagcccu

SEQ ID NO: 274981 - RNA, 64 nt, hsa
cagccugggcuguguaugccugcggaugcagugucccacacaaggacacuuccucuaggaugcc

SEQ ID NO: 274982 - RNA, 59 nt, hsa
auucuggggagaagcuauagaaagaggagcccacacaaagcuugaaagccugugccaga

SEQ ID NO: 274983 - RNA, 64 nt, hsa
uuaguuuugcuuaagaaguuauguuacaacugaucagcccuauaugaauuaacugaucagcccu

SEQ ID NO: 274984 - RNA, 64 nt, hsa
uuacaacugaucagcccuauaugaauuaacugaucagcccuauaugaaacauaaguuguguuau

SEQ ID NO: 274985 - RNA, 64 nt, hsa
cuucucccuguuggccugaagggagcuuagaaugcagcccuaccuggagauagugcgggcaccu

SEQ ID NO: 274986 - RNA, 64 nt, hsa
ugggaccgagccacccagccccacuauccccaagcagcccuacagccgggaugggaggcacgug

SEQ ID NO: 274987 - RNA, 64 nt, hsa
uccuuccaguugucuugaacagccugacuccugccagcccuacggaaguuccuuuuaugcauug

SEQ ID NO: 274988 - RNA, 64 nt, hsa
uccuucagguuaucuugaacugccugacuuaggccagcccuacagaagugcuguuuacucauug

SEQ ID NO: 274989 - RNA, 64 nt, hsa
uccuucaguuuaucuuggacugacugacucaugccagcccuacagaagugccuuuuacguauug

SEQ ID NO: 274990 - RNA, 64 nt, hsa
caugccucccucucauuggaggagcugaccaaagcagcccuaacgggccauaacacuugaccaa

SEQ ID NO: 274991 - RNA, 64 nt, hsa
uccaggagaccauaagauagaucccccauccucucagcccuauucccaugccucccucucauug

SEQ ID NO: 274992 - RNA, 64 nt, hsa
ugcccaucacacagacguccagcccuacauuguccagcccuaccuagaguacccauccaggccc

SEQ ID NO: 274993 - RNA, 64 nt, hsa
uuggcaguuccuuucugcccaucacacagacguccagcccuacauuguccagcccuaccuagag

SEQ ID NO: 274994 - RNA, 64 nt, hsa
gcaucggcauaauuuucuuuccucuggcugaucccagcccuaaaggaaggguagacccgugucu

SEQ ID NO: 274995 - RNA, 64 nt, hsa
ccagcccuaaaggaaggguagacccgugucuuuccagcccuaaaggaaggguagacccgugucu

SEQ ID NO: 274996 - RNA, 64 nt, hsa
ccagcccuaaaggaaggguagacccgugucuuuccagcccuaaaggaagggcagacccgugucu

SEQ ID NO: 274997 - RNA, 64 nt, hsa
guuuaucugcuguaauugaacauucagcuacccuauaacccaguuaauccaauacuggggauaa

SEQ ID NO: 274998 - RNA, 64 nt, hsa
uagcaacccuauucacaaaagcaaaagccuagaaauaacccagaugcccaugagcaagagagug

SEQ ID NO: 274999 - RNA, 64 nt, hsa
aaauauccaaguauaaagcccaggaacuucuagaauaacccagaugcgcuuuaauuuuuuuuaa

SEQ ID NO: 275000 - RNA, 64 nt, hsa
uuuuuuaauauguuuugaucacagaacuucuagaauaacccagaugcucuuucauauucuuuua

SEQ ID NO: 275001 - RNA, 64 nt, hsa; identical to SEQ ID NO: 209051

SEQ ID NO: 275002 - RNA, 64 nt, hsa; identical to SEQ ID NO: 209052

SEQ ID NO: 275003 - RNA, 64 nt, hsa; identical to SEQ ID NO: 209053

SEQ ID NO: 275004 - RNA, 64 nt, hsa; identical to SEQ ID NO: 209054

SEQ ID NO: 275005 - RNA, 64 nt, hsa
uggggucagauggugguggugagaggccuuggggcuggggaaggagaguggacuuuggcucacu

SEQ ID NO: 275006 - RNA, 64 nt, hsa
gaguucacaggcuuauccccaggaagccucacuccuggggaaagacagauaauuucacugcccc

SEQ ID NO: 275007 - RNA, 64 nt, hsa
guaucuucuuuguuuagcaagucaaacuucacagcuggggaaguugaaaaccuuuggaaaauga

SEQ ID NO: 275008 - RNA, 64 nt, hsa
uguguguguugggggagcuuccacaggagccacacuggggaaaagcuguaguaucuucuuuguu

SEQ ID NO: 275009 - RNA, 64 nt, hsa
ggguuucuuauccucaaaaaaggcgauggaagggcuggggaagugauuaaauaaaagcaacgca

SEQ ID NO: 275010 - RNA, 64 nt, hsa
ggagaugggagaggagccuguuuugggguggggucuggggaaggcaaucugauucugaagcuaa

SEQ ID NO: 275011 - RNA, 64 nt, hsa
caggccuuuuuaaaaaauucauuacagcaaacagcuggggaaggacaugcaguccucccccagc

SEQ ID NO: 275012 - RNA, 64 nt, hsa
ucucccuuggggugggaaucuaugauggagguuacuggggaaacagcucagcagauuuuuggag

SEQ ID NO: 275013 - RNA, 64 nt, hsa
cuucguggcuccuuuaggaugucaccucaccggccuggggaaggcggggggugcccaagcccag

SEQ ID NO: 275014 - RNA, 64 nt, hsa
cuggagucuaccugcggaugagccugcggcaguccuggggaaacuuuuccagagccuguuagcc

SEQ ID NO: 275015 - RNA, 64 nt, hsa
acaccuauguaacucaucuuuuaguuuacacuuccuggggaaauugucuuugguguuuagagga

SEQ ID NO: 275016 - RNA, 64 nt, hsa
uacacuagcauuaguuuauacaccacuuuugccgcuggggaauucaaguugaaaugucccucaa

SEQ ID NO: 275017 - RNA, 51 nt, hsa
uaaaccggcuaaauuauugaccuggggaacuagccacacaggaggccggga

SEQ ID NO: 275018 - RNA, 64 nt, hsa
cagccucucccuacucccaucccauuuccaccaacuggggaacugugacuaucuaucucccccg

SEQ ID NO: 275019 - RNA, 64 nt, hsa
uggguguuggguccucugcuuccugugcuguccccuggggaaggucccgaggaugcugucagga

SEQ ID NO: 275020 - RNA, 64 nt, hsa
guuugccaggcuaagcagcaaugccagggcacagcuggggaagaucuugcugaccuugucccca

SEQ ID NO: 275021 - RNA, 64 nt, hsa
cgaggcagcucuggaaucugugcccaccuggggccuggggaacaaggcccuccuuucuccaggc

SEQ ID NO: 275022 - RNA, 64 nt, hsa
ggagugugccccucggggcaggagggaagggcaucuggggaagggcaggagggaagagcugucc

SEQ ID NO: 275023 - RNA, 64 nt, hsa
auuuauucuccaaauuaagugggaauuagauccucuggggaacccuggagcuuggugagaguga

SEQ ID NO: 275024 - RNA, 64 nt, hsa
cguagagcgcgugcugaagaguguggcugugaagcuggggaagacgcagaaggugaaggugcuc

SEQ ID NO: 275025 - RNA, 64 nt, hsa
cucccacacaagcucgguggugacucuucggccccuggggaaaaacaaaaagauauugcugaga

SEQ ID NO: 275026 - RNA, 64 nt, hsa
acgaggccagugagggacggcguggcugugcuuccuggggaaaugaacccccuccccacagaca

SEQ ID NO: 275027 - RNA, 64 nt, hsa
gcgaccgucacacacuguccucagcccacugcaccuggggaagccccucgugcagccccuccuu

SEQ ID NO: 275028 - RNA, 64 nt, hsa
gguccacagcacaggauguggggcgagggcacagcuggggaacggcaagaaaggaauggacccu

SEQ ID NO: 275029 - RNA, 64 nt, hsa
cugccccucaccuucuccuucuugauuccaaagccuggggaacgguuagggagcucugccuguu

SEQ ID NO: 275030 - RNA, 64 nt, hsa
cugcaucuguuuuggaggagaugagaucagaacucuggggaaaggagaaccggcuaggugggcu

SEQ ID NO: 275031 - RNA, 64 nt, hsa
uucccgggcacaccuauggcuccuucgguaucaccuggggaagccccggaaucuuaguucuucc

SEQ ID NO: 275032 - RNA, 64 nt, hsa
ucacagccauuugagaaauggcuucuuugcagagcuggggaagccgggcagaagaugccgcagc

SEQ ID NO: 275033 - RNA, 64 nt, hsa
ucuuuccugugcucugaagaugccagcuacaucacuggggaaacaguggugguggguggaggaa

SEQ ID NO: 275034 - RNA, 64 nt, hsa
cuuggcaaagaccaagauauuuuuuccugggccacuggggaaucugaggggugaugggagagaa

SEQ ID NO: 275035 - RNA, 64 nt, hsa
uuuugaaugaauucaugucaaaaauguuauucagcuggggaaauuucucuaaauguacacugau

SEQ ID NO: 275036 - RNA, 64 nt, hsa
ugauuucguuaguuuuauuaucuguuuacuuccucuggggaaggcagacugauaaaauuauaug

SEQ ID NO: 275037 - RNA, 64 nt, hsa
cuucuccggguauuuaguacuguggugaggagcacuggggaaagccucagcccaauucgggccc

SEQ ID NO: 275038 - RNA, 64 nt, hsa
ugaauucacaucuaggaccucagccauguggccucuggggaaucaguggaugaagacgucccuc

SEQ ID NO: 275039 - RNA, 64 nt, hsa; identical to SEQ ID NO: 275038

SEQ ID NO: 275040 - RNA, 64 nt, hsa
cuguuuguagguggcuacagugucaauggaggaucuggggaaaauacuuauggucggaagucgu

SEQ ID NO: 275041 - RNA, 64 nt, hsa
uagaccuagcaaaacccuggaaggauauugaggucuggggaaaagggaggacuuugcauuuucc

SEQ ID NO: 275042 - RNA, 64 nt, hsa
cugaggcaaccauggaccuguugcuaggagauagcuggggaaggcccaaggccgcccagggcag

SEQ ID NO: 275043 - RNA, 64 nt, hsa
uucccuucugcauacugcaaucugaucugucagacuggggaauguuggguucuggggucugguc

SEQ ID NO: 275044 - RNA, 64 nt, hsa
ugccugccucagaucucagacuauccugauuaaucuggggaagaacagagccagggaaagaaug

SEQ ID NO: 275045 - RNA, 64 nt, hsa
cuugcugggcugaguccagcccuggggaagauuccuggggaauuuauuugcugcuucucccagc

SEQ ID NO: 275046 - RNA, 64 nt, hsa
gcaccccagucuacuugcugggcugaguccagcccuggggaagauuccuggggaauuuauuugc

SEQ ID NO: 275047 - RNA, 64 nt, hsa
ggugccacuuaccguggcuuaggagccuuuuguacuggggaagauuuuauuucuuggguggggu

SEQ ID NO: 275048 - RNA, 64 nt, hsa
accaucuucacuacaaacacgccugagaguggcacuggggaaacauaacuccaucuacaccuug

SEQ ID NO: 275049 - RNA, 64 nt, hsa
uugccuuuguggcccaugaaagucuuacugggcccuggggaagguauccuacccuggugaagca

SEQ ID NO: 275050 - RNA, 64 nt, hsa
caucccacaucagguauauuagagcuuauccgaacuggggaaagacggauugagauuaacugcu

SEQ ID NO: 275051 - RNA, 64 nt, hsa
uuugaggauguugugugaggguguuugacugugacuggggaagcucagacuacuuuguauguga

SEQ ID NO: 275052 - RNA, 63 nt, hsa
uaauuuuuaauaucuuuacuucuaucaucccaaaucaaagaacucuucucuauuauguuuaau

SEQ ID NO: 275053 - RNA, 63 nt, hsa
guauugccuguggcuuguuguuuaagauuaagaaucaaagagauuaagaaguaucacuucaaa

SEQ ID NO: 275054 - RNA, 63 nt, hsa
auaaggcaaaugccagaauuaaaaaaaaaaaucaucaaagacagaaaaugccugaccaaauuc

SEQ ID NO: 275055 - RNA, 63 nt, hsa
auugugaaccauacuguccccaaugacuaaggaaucaaagagagagaaccaacguuccuaaaa

SEQ ID NO: 275056 - RNA, 63 nt, hsa
uagaaauuuaaauaguaaauaaaacacaacauaaucaaagacaacucacucaggcaucuucuu

SEQ ID NO: 275057 - RNA, 63 nt, hsa
auucaaauauaaguuuccaugcuuuuuuguaacaucaaagaaaacauacccaucaguaauuuc

SEQ ID NO: 275058 - RNA, 63 nt, hsa
aagacuucagauugaauucacaucuuauucagcaucaaagaauucacacaggagagaaagcac

SEQ ID NO: 275059 - RNA, 63 nt, hsa
ggagauucagucauaacccaacgcucauucaacaucaaagaauuuauaccuaagagaacuuau

SEQ ID NO: 275060 - RNA, 63 nt, hsa
cauggaguggccguaaugagaauauguuugaagaucaaagaguuagaccaaugcuugaauaag

SEQ ID NO: 275061 - RNA, 63 nt, hsa
uuuuguauagccaggaguuuauugugauuaaacaucaaagaaacagguagaaagccuggguuu

SEQ ID NO: 275062 - RNA, 63 nt, hsa
acuucuucaguguccuucacggcacuggaucccaucaaagaaccuugaagaaguggcugcccc

SEQ ID NO: 275063 - RNA, 63 nt, hsa
uucccucucuaucggggucacuugcaauuguuaaucaaagauugaacacugcguaggagaggg

SEQ ID NO: 275064 - RNA, 63 nt, hsa
uauggguuaaaucaaagauaagguuauaguaacaucaaagauuaggugagguuuauagaaaga

SEQ ID NO: 275065 - RNA, 63 nt, hsa
caagauuaugaugaguaaauguguauggguuaaaucaaagauaagguuauaguaacaucaaag

SEQ ID NO: 275066 - RNA, 63 nt, hsa
cauaggcagguuuuucuuaaaaaugaaaaaaaaaucaaagauuuuuuuaacaguucucagacu

SEQ ID NO: 275067 - RNA, 63 nt, hsa
auugcuauccauaaugggauucaccuccaaauuaucaaagaaauaacucagaguaauuugaca

SEQ ID NO: 275068 - RNA, 63 nt, hsa
uuugauuagcagucaauggcaaagaaaaaguaaaucaaagaugacuucuuuucaaaauguauu

SEQ ID NO: 275069 - RNA, 63 nt, hsa
agugacuacuauuauaauacuaaaacucagagaaucaaagauggauuaaacucagugguugau

SEQ ID NO: 275070 - RNA, 63 nt, hsa
aggccuuuaggcagagggcgcaucuuacucaacaucaaagaauuccuacuggugagaaacccu

SEQ ID NO: 275071 - RNA, 63 nt, hsa
agguuuuuaauaauuauccaacucuuacucaacaucaaagaauucauaccagugugaaacccu

SEQ ID NO: 275072 - RNA, 64 nt, hsa
ggcauggcagcaaaugccaacauuuuguggaauagcagcaaaucuacaagagacccugguuggu

SEQ ID NO: 275073 - RNA, 64 nt, hsa
aaauccuauuucaguggaccaacauuguggcauggcagcaaaugccaacauuuuguggaauagc

SEQ ID NO: 275074 - RNA, 64 nt, hsa
cagccugggaugcugccguaccaagaggaaagaagcagcaaaaugccuuuacguuguucuaaac

SEQ ID NO: 275075 - RNA, 64 nt, hsa
uuuaaucugugaccauugggcaaaaaauuuuccugcagcaaaagucugaggcuguugggaccau

SEQ ID NO: 275076 - RNA, 64 nt, hsa
gucucuguauggcagcaaauguggcccauggccugcagcaaaacguccuauauguagauuccaa

SEQ ID NO: 275077 - RNA, 64 nt, hsa
ccaaugcccccacccccagguaugucucuguauggcagcaaauguggcccauggccugcagcaa

SEQ ID NO: 275078 - RNA, 64 nt, hsa
aacaguaguaugaaacuccaaaaugcaaacugaagcagcaaacccacaaagcaucaaaagacuc

SEQ ID NO: 275079 - RNA, 64 nt, hsa
ucuccuuugugaugccuuaggacauguuugaacugcagcaaaaaacaaaaacaaaaaacagugc

SEQ ID NO: 275080 - RNA, 64 nt, hsa
agaaacagguugacaacucagcccugcucaugaggcagcaaacccugcaaagggcugggacugg

SEQ ID NO: 275081 - RNA, 64 nt, hsa
aaaaacacugaagugcuuuucaugaagcacagcugcagcaaagccuugcaaucccaggcugggg

SEQ ID NO: 275082 - RNA, 64 nt, hsa
gaacuauuguagaacagcgcuggcuuuugggggagcagcaaaaaugagaggagugcuagguggg

SEQ ID NO: 275083 - RNA, 62 nt, hsa
auacauauguguauauaagagguuauugauaaacuucugaggcagacauuugucucgcuuuu

SEQ ID NO: 275084 - RNA, 62 nt, hsa
cccuuguacuugccuacuguaauauggauuucacuucugaacaguuuacagcacaauauuua

SEQ ID NO: 275085 - RNA, 62 nt, hsa
uccuagaguucuuuccugaccucuagcuccauacuucugauugccuaauaaauaugacaugg

SEQ ID NO: 275086 - RNA, 62 nt, hsa
cuugauuuuggggacacacauugcaacuucccacuucugacgaaaggucuccaugcuuuugc

SEQ ID NO: 275087 - RNA, 62 nt, hsa
gacaaaagugguagggaaauuguucccucuccacuucugaaaguaugaugauguauuaagga

SEQ ID NO: 275088 - RNA, 62 nt, hsa
auuuuuuuaauuacuggcuucugauuucuuucacuucugauccuuuuccuuuuucucagaug

SEQ ID NO: 275089 - RNA, 62 nt, hsa
cacauuuggaggagacguaauccagcauuggaacuucugaucuucaagcagggauucucaac

SEQ ID NO: 275090 - RNA, 62 nt, hsa
gcucaucgacgccugugacagggagaaaggauacuucugaacaaggagccuccaagcaaauc

SEQ ID NO: 275091 - RNA, 62 nt, hsa
ucacuagcuuggccauagcaccucucuucuccacuucugaucugcugcuucuaaccuucuau

SEQ ID NO: 275092 - RNA, 62 nt, hsa
ggguuucaccacguuagccaugauggucucaaacuucugaccucauaauccacccaccuugg

SEQ ID NO: 275093 - RNA, 62 nt, hsa
ugggucauauucuuuauuuggaagaaguugugacuucugacaugggugugauugucuuccua

SEQ ID NO: 275094 - RNA, 62 nt, hsa
acauuuguaaauacauuguuugcaggacgaaaacuucugaguuacagcucaggaaaagccug

SEQ ID NO: 275095 - RNA, 62 nt, hsa
gacagaggaggauagcucuuuccagaauccacacuucugaccucagccucggucucaugaac

SEQ ID NO: 275096 - RNA, 62 nt, hsa
gaagaccuacuugaacagggcauauuuuuuagacuucugaacaucaguauguucgaggguac

SEQ ID NO: 275097 - RNA, 62 nt, hsa
aaauuuagaguaguugaaaucuuuaggaaugaacuucugagggccaaaaaaugugacugacg

SEQ ID NO: 275098 - RNA, 62 nt, hsa
cugacuucgugaauauagagaccaaguuuaccacuucugaugaagagaccaauuaagauuca

SEQ ID NO: 275099 - RNA, 62 nt, hsa
uuucauauacuuccgucucgaugcuguuaacaacuucugauaacauggaaaauucaaggauu

SEQ ID NO: 275100 - RNA, 62 nt, hsa
uauguaacagauacacuacaguagaagaacuuacuucugaaaugaagggaaaaaaaccaccc

SEQ ID NO: 275101 - RNA, 62 nt, hsa
ucuguaucgugccaaaguuguaucacuguuaaacuucugaagacauaaccaguugagucuua

SEQ ID NO: 275102 - RNA, 62 nt, hsa
ucaacccauauuauuggcuguacauccuggucacuucugacuucuguuuuuacuaauggaag

SEQ ID NO: 275103 - RNA, 62 nt, hsa
cggguguuuccaacgucauggaagcagcugacacuucugaaacucagccaaggacacuugau

SEQ ID NO: 275104 - RNA, 62 nt, hsa
uaucguugguguuuuccaguauuacaagaucaacuucugacccugugaaaugugagaaguac

SEQ ID NO: 275105 - RNA, 64 nt, hsa
gaccggccggucacugcaggggucugguggucucugcuugcauccccaacuuagcuguccccug

SEQ ID NO: 275106 - RNA, 64 nt, hsa
gggaaaugaagaagcaucuuccuuaggucugcccugcuugcaaauccacuagcaccgaccccac

SEQ ID NO: 275107 - RNA, 64 nt, hsa
accuggccagauccgcucccagacggccuuggacugcuugcauuuccccggagaaaaagggguu

SEQ ID NO: 275108 - RNA, 64 nt, hsa
acagccuccugcuagagugacuuguacaugagcuugcuugcagaagacuagauuagauguuucu

SEQ ID NO: 275109 - RNA, 64 nt, hsa
guggaaguucccauugucaaaaaaaauaaagaccugcuugcaguauucauguugacaacagagu

SEQ ID NO: 275110 - RNA, 64 nt, hsa
uauuuuaaauggugcuauagccaauguauuugaaugcuugcacugcugguuguguaucaucaau

SEQ ID NO: 275111 - RNA, 64 nt, hsa
uuagcguuggucuucucuugucaggaaugaaggaugcuugcacacaugcacccccucacucuca

SEQ ID NO: 275112 - RNA, 64 nt, hsa
uuuauccaauccacuggucugugaguuuuugaaaugcuugcacagcauggucucaguuguauag

SEQ ID NO: 275113 - RNA, 64 nt, hsa
cuugaugguggcguuuuugaaauguagaacagagugcuugcaaaauguaauaaauacacuugug

SEQ ID NO: 275114 - RNA, 64 nt, hsa
auauuugaaaaggcuuccauuaauauaauagcuuugcuugcagccuuccaaucuauguugguuu

SEQ ID NO: 275115 - RNA, 64 nt, hsa
aaauaauuucaucaacuuuuagaauauuuuauguugcuugcacuauaggagucauaaaaggaac

SEQ ID NO: 275116 - RNA, 64 nt, hsa
caagugcucucuagauuuguugauaaacauuuuaugcuugcauuuaaacuugaaauguaugagc

SEQ ID NO: 275117 - RNA, 64 nt, hsa
cugggcucccgugagguccuagggcagaaggaggugcuugcagggccucucgcugcuacuggga

SEQ ID NO: 275118 - RNA, 64 nt, hsa
guagaguagaacacagccccggaaugcuuccaguugcuugcaagggaccaugccggcccgggug

SEQ ID NO: 275119 - RNA, 64 nt, hsa
aucauguguauuacagugggcagguauuugcuuuugcuugcacugaaaauuaaauugcuaucaa

SEQ ID NO: 275120 - RNA, 64 nt, hsa
ugcguauggcagugagcagguauguguuugcuuuugcuugcacugaaaauuaaauugcuaucaa

SEQ ID NO: 275121 - RNA, 64 nt, hsa
cgaagcugaagucauugaagugugugaagcucugugcuugcaugagggcaagcaaggaauggcu

SEQ ID NO: 275122 - RNA, 64 nt, hsa
cugcucucugcuugcuguuguuuugacgcuauucugcuugcaugucuucugguugggaugugga

SEQ ID NO: 275123 - RNA, 64 nt, hsa
aauucacugauuugacuagaaacaucaaggaagaaugaagaacguugacuuuuuuccaggauaa

SEQ ID NO: 275124 - RNA, 64 nt, hsa
gauccacaggacuugaaggucaaaguucacaaagaugaagaaucaggguagcugaccauguuug

SEQ ID NO: 275125 - RNA, 64 nt, hsa
aaaaagaagugugggcaaccaaauguagguaaggaugaagaagaacaggaacucucacuggugg

SEQ ID NO: 275126 - RNA, 64 nt, hsa
uauaugacauucuggaaaaggcaaaacuauagggaugaagaacagaucaguuguugucagguuu

SEQ ID NO: 275127 - RNA, 64 nt, hsa
auuuuauuccccucaauucucaauauauucaguaaugaagaauggugccaccacucaagcaaca

SEQ ID NO: 275128 - RNA, 64 nt, hsa
gaaggaugaagacgaagaagcaagggaggaacaaaugaagaaccaucuuuguucaugaauagga

SEQ ID NO: 275129 - RNA, 64 nt, hsa
auaggcucaagauuguacagugagugaugcugucaugaagaaaauucagaugaaaaaggcaaga

SEQ ID NO: 275130 - RNA, 64 nt, hsa
cuagagcaauucaguccuguuggaaauuuagaacaugaagaaacuuugaaugucuugacccuuu

SEQ ID NO: 275131 - RNA, 64 nt, hsa
agggaggaagaaagggagagagaagaaaagaaaaaugaagaaaaguaauuagaauauuuucaac

SEQ ID NO: 275132 - RNA, 64 nt, hsa
uaauuaguuuauaugagaauaauucuugcaauaaaugaagaaggaauaaaagaaauaggaagcc

SEQ ID NO: 275133 - RNA, 64 nt, hsa
aaaucucacucuuauugacaauaaauaucaaacuaugaagaaacagaagucccauuaccagaaa

SEQ ID NO: 275134 - RNA, 64 nt, hsa
gugugggaaaagaaggcucuuuggggacccugacaugaagaaguccacuaagugggagaucuuc

SEQ ID NO: 275135 - RNA, 64 nt, hsa
agacuuauuuuaaugacaauguagcuugaaagcgaugaagaaugucucuagaagagaaugaagg

SEQ ID NO: 275136 - RNA, 64 nt, hsa
cuuggccugaaacuuccacacagaauuuuagucaaugaagaauuaaucucuguuaagaagaagu

SEQ ID NO: 275137 - RNA, 64 nt, hsa
aaagcuauaaaguauauauuaggaucugcaaacaaugaagaauuauguaauauauuguacaaau

SEQ ID NO: 275138 - RNA, 64 nt, hsa
gacaagcugacuuggcacuuaagugcacuuuuuuaugaagaaaaaguacaaugaacugcuuuuc

SEQ ID NO: 275139 - RNA, 64 nt, hsa
aaauaaggauggugauagagagguugaagaagaaaugaagaagcaugaaaguaauaauguggga

SEQ ID NO: 275140 - RNA, 64 nt, hsa
uuuccagcuagaaaauuuuauggcuaucgaagaaaugaagaagcacggaaguacucaugucgga

SEQ ID NO: 275141 - RNA, 64 nt, hsa
aacacuggaauauuacacgaugagauucugauucaugaagaaaagcagauagaagugguugaaa

SEQ ID NO: 275142 - RNA, 64 nt, hsa
auauacuuucgaaagaauaaaauaguucuccuacaugaagaaagaauaugucaggaaauaaggu

SEQ ID NO: 275143 - RNA, 64 nt, hsa
gagcaaugcuuucauaguuucagauaugguaguuaugaagaaaacaaugucauuugcugcuauu

SEQ ID NO: 275144 - RNA, 64 nt, hsa
uucuucuuccaugccaugucaggaguuaauacaaaugaagaaauuccguggguuccccugggau

SEQ ID NO: 275145 - RNA, 64 nt, hsa
uccucccugcugauuuguuucuaaaucaaaagaaaugaagaaaaaaguacugugaccugagaga

SEQ ID NO: 275146 - RNA, 64 nt, hsa
cccagcuugaauguaaauuuuguauaguguaaguaugaagaacauagugcaacuguacagguag

SEQ ID NO: 275147 - RNA, 64 nt, hsa
uuauugugauaugauaaauaauugggcuauuuugaugaagaaaacuuuguucauuuguuucuac

SEQ ID NO: 275148 - RNA, 64 nt, hsa
ugguucagauuaacuucacuauuaaguguucaauaugaagaauucaaguauucugacugaguga

SEQ ID NO: 275149 - RNA, 64 nt, hsa
auaguuguuuuaucaauaaaagccccuuaauauuaugaagaaacuuuucauauuuuuucuucuu

SEQ ID NO: 275150 - RNA, 64 nt, hsa
acaucucucauacaguuuggggugaauuguaaaaaugaagaacuauaauuuauguagugaaaua

SEQ ID NO: 275151 - RNA, 64 nt, hsa
cccauuagaagaggauuuuuugggggacuucaauaugaagaaaaccaagaauguuuuguugggc

SEQ ID NO: 275152 - RNA, 64 nt, hsa
uagcagacagcuguuccacgcgggccagggcggcaugaagaagucccgccgcuacgugcccggc

SEQ ID NO: 275153 - RNA, 64 nt, hsa
uugacaggauaguuaauaauaaaccuuaaaacccaugaagaaaucugagguaaaguguuagcac

SEQ ID NO: 275154 - RNA, 64 nt, hsa
aauaaaauuggagcagacagaaaagauauagcaaaugaagaaauauuuuaaggaaaccuauuug

SEQ ID NO: 275155 - RNA, 64 nt, hsa
ugcuagcugguaccuucuaguaaucaaaauuaauaugaagaaacuagguugugacagacuagau

SEQ ID NO: 275156 - RNA, 64 nt, hsa
ugugcaaaaauaccaaauuuguguccugugcaguaugaagaauucagugaauauucauuaaugu

SEQ ID NO: 275157 - RNA, 64 nt, hsa
ucagcuucugcauuuccuucccugcuccuaacaaaugaagaagcaggcugcagccugcauugug

SEQ ID NO: 275158 - RNA, 64 nt, hsa
ugaacauauuguugaaagguaauuugagagaaauaugaagaacugaggaggaaaaaaaaaaaaa

SEQ ID NO: 275159 - RNA, 64 nt, hsa
uacuuuuuaaauguaaagauauuuuuaucuuuauaugaagaaaaucacuuaggaaauggcuuug

SEQ ID NO: 275160 - RNA, 64 nt, hsa
ugaaggagauacaggugugugugcacaugccgguaugaagaagacacaggcaugugcuucucag

SEQ ID NO: 275161 - RNA, 64 nt, hsa
aaggggcagagacaggguccaccaacuccccaagaugaagaagccccuucaggccagucguggu

SEQ ID NO: 275162 - RNA, 64 nt, hsa
uaggaaaaggaauguagcucaacuugugauaaaaaugaagaaaagagucuauacaaaggcuugc

SEQ ID NO: 275163 - RNA, 64 nt, hsa
auauuaggcucuuugucaucuuauaggaaaauauaugaagaacccaucauuuuaucgagagaac

SEQ ID NO: 275164 - RNA, 64 nt, hsa
uauuuauaauagcaauaaaccuaacuggauuuggaugaagaagucuuaauacugacauacugga

SEQ ID NO: 275165 - RNA, 64 nt, hsa
gccugagccuaguuagaguuagaccugucuuuggaugaagaagucuuaauacugaaauacugaa

SEQ ID NO: 275166 - RNA, 64 nt, hsa
ccagaggcucgagagcaggccauuucccaagaagaugaagaauggugacuguguuuuuauugaa

SEQ ID NO: 275167 - RNA, 64 nt, hsa
aauggugacuguguuuuuauugaaggaauuucaaaugaagaauaauguuuaaaauguguauaua

SEQ ID NO: 275168 - RNA, 64 nt, hsa
auauugcagguuaaauuacuuuaugucagguccuaugaagaaagauacgguuucagacugaaaa

SEQ ID NO: 275169 - RNA, 64 nt, hsa
cuuuuuuuuuuuuuuuuuaaacgagaacaagaauaugaagaacuggaaaucauuaagaaagggu

SEQ ID NO: 275170 - RNA, 64 nt, hsa
uaaagucgcugaucauccucuuccucaucuguaaaugaagaaaguaggcccugucuaccucaca

SEQ ID NO: 275171 - RNA, 64 nt, hsa
gagaaccagagcuccaagucuuuaauuugccaagaugaagaaaaugaguucucaaggagggaau

SEQ ID NO: 275172 - RNA, 64 nt, hsa
caaaagacaaacaauaugucuuuuuuuuuuuugcaugaagaaaaaugucuaucauuuacaguuu

SEQ ID NO: 275173 - RNA, 64 nt, hsa
aauuccugggagggggauuauuuagugaaauaauaugaagaacuuuaugacuuauguuugccuu

SEQ ID NO: 275174 - RNA, 64 nt, hsa
aaaagcacuucguacauggugguggcaagagaaaaugaagaagaagcaaaaguggaaaccccug

SEQ ID NO: 275175 - RNA, 64 nt, hsa
uugauauuuucugaaagaggaacauguguuagagaugaagaaucuuccaaggcucaugcaguug

SEQ ID NO: 275176 - RNA, 64 nt, hsa
gcaaguggccaaccuagagauucacuccuuaucuaugaagaacaucugagccccuagcccaucc

SEQ ID NO: 275177 - RNA, 64 nt, hsa
ggggugggguggucagcuggccaagggaguaaaaaugaagaaauaguccccuaccccccaucau

SEQ ID NO: 275178 - RNA, 64 nt, hsa
ucaggagucagcucugacaaugaagaugaugaugaugaagaagaugggaauuaccuucaucccu

SEQ ID NO: 275179 - RNA, 64 nt, hsa
aaucguguuaagcuagaugaugacagugaugaugaugaagaaagcaaagaaggccaagaaaguu

SEQ ID NO: 275180 - RNA, 64 nt, hsa
aacacuggaauauuacaagaugagauucugauucaugaagaaaagcagauagaaguggcugaaa

SEQ ID NO: 275181 - RNA, 64 nt, hsa
aaauaaggguggugauagaaagguugaagaagaaaugaagaagcacggaaguacucauauggga

SEQ ID NO: 275182 - RNA, 64 nt, hsa
cuuguucuaucacagguaugagcugcuaugauacaugaagaacauuccaugaaguauguuuuaa

SEQ ID NO: 275183 - RNA, 64 nt, hsa
cagcacgcgugucagcugccaaagaauagacuuaaugaagaagugcccacaugcuggcaggggc

SEQ ID NO: 275184 - RNA, 64 nt, hsa
ccacuugaacacccaaacuacgucaucuguuccaaugaagaaaccaaaccaccaucuuuuauaa

SEQ ID NO: 275185 - RNA, 64 nt, hsa
ggcagaggcuauaaaagauucaccaggcacuggcaugaagaaagagucuuuguaaauggacauu

SEQ ID NO: 275186 - RNA, 64 nt, hsa
guuggucugagugacaaggaauugguuucagaugaugaagaaagaggaacgggcuuggaagaaa

SEQ ID NO: 275187 - RNA, 64 nt, hsa
aauuguaagcauccugaaauaaaaaagcaagaauaugaagaaguaguucagacuguuaauacag

SEQ ID NO: 275188 - RNA, 64 nt, hsa
gaaaauggacuuuagacaaaagcaagaggaucagaugaagaaaaggagagguagauacagucag

SEQ ID NO: 275189 - RNA, 64 nt, hsa
acagucaauauggauuuagaaaaaggaacaccugaugaagaaaaggagagguagauacagucag

SEQ ID NO: 275190 - RNA, 64 nt, hsa
auuagucaaaccacuguuauuaacagauguagcaacaugagaaacgcuuauguuacagguuaca

SEQ ID NO: 275191 - RNA, 64 nt, hsa
uguagcaacaugagaaacgcuuauguuacagguuacaugagagcaaucauguaagucuauauga

SEQ ID NO: 275192 - RNA, 64 nt, hsa
aauucaagauucaaaaagaauuuuaaauacaccaacaugagacaucaguagucaguugguuuuc

SEQ ID NO: 275193 - RNA, 64 nt, hsa
auacacaguauaacugaugcucuucuggaauaccacaugagacauggucagaaacagugcuugg

SEQ ID NO: 275194 - RNA, 64 nt, hsa
cguccaagguggaugcugucaaugcccgagugacacaugagagcuguaugaauugagagaaaag

SEQ ID NO: 275195 - RNA, 64 nt, hsa
uucauguguuuggcauaccagugaaugaugaagaacaugagauuaauuuaauuuaucuucggua

SEQ ID NO: 275196 - RNA, 64 nt, hsa
ugauaguagauuaugucucuagguagagacagauacaugagaagagccuccaaaacuggaagcc

SEQ ID NO: 275197 - RNA, 64 nt, hsa
aaaccaugcaauuuaacacuucaguuaaagaaauacaugagaacugcuugucaugaccagacaa

SEQ ID NO: 275198 - RNA, 64 nt, hsa
gagaagggugccuuaaaaauguuguggccaagccacaugagaucaaagacacacuuuucaugac

SEQ ID NO: 275199 - RNA, 64 nt, hsa
uuggcuccuuagcauggccacuuacaauuuuuuaacaugagauaacacaucaggugucagaacu

SEQ ID NO: 275200 - RNA, 64 nt, hsa
cuguucacaccuuucuucacugagauuccaguguacaugagaacauauauuuauugcaugauuu

SEQ ID NO: 275201 - RNA, 64 nt, hsa
uauuguagcuuaagauauauguguuaagauauauacaugagaaacuuuaaaagguaacuacugu

SEQ ID NO: 275202 - RNA, 64 nt, hsa
uggagcagaggagccucucaccuccuguccucugacaugagaaugaaaccaggaauggacuugg

SEQ ID NO: 275203 - RNA, 64 nt, hsa
cucuucuuuuuacugucucuucugcuuacuuuccacaugagaugcuuuguaccggggagcugug

SEQ ID NO: 275204 - RNA, 64 nt, hsa
aagaugugagaagguacuaaaacuuaauacuaaaacaugagagggaaaauauguguaaaccucu

SEQ ID NO: 275205 - RNA, 64 nt, hsa
gacauaucacuguauccaucuauacuuggcagcaacaugagaagugugauacaugugaacccaa

SEQ ID NO: 275206 - RNA, 64 nt, hsa
aaacccuucaguuuccuuacaggcuuucgagugcacaugagaaugcacacuggagagaaaccuu

SEQ ID NO: 275207 - RNA, 64 nt, hsa
ggaaagccuucaguuaccacuguacugcucaaaaacaugagaggaaucacacugcacagaaaca

SEQ ID NO: 275208 - RNA, 64 nt, hsa
aucaguauuauguucuaaauaaacuuauggccauacaugagaaauguaccuugcagcugaaugg

SEQ ID NO: 275209 - RNA, 64 nt, hsa
agggaaggaacuuacugucuaauauaggaaaaacacaugagaacaggugcaauauauugacuua

SEQ ID NO: 275210 - RNA, 64 nt, hsa
gaccaaaguccuuuuuuuccaucuuuacaaaacuacaugagaacaaacagaucgaaccguuuug

SEQ ID NO: 275211 - RNA, 64 nt, hsa
aauauaaaaagcuuccaugauucuauuuauauguacaugagaaggaacuuccagguguuacugu

SEQ ID NO: 275212 - RNA, 64 nt, hsa; identical to SEQ ID NO: 124726

SEQ ID NO: 275213 - RNA, 64 nt, hsa; identical to SEQ ID NO: 124727

SEQ ID NO: 275214 - RNA, 64 nt, hsa; identical to SEQ ID NO: 124728

SEQ ID NO: 275215 - RNA, 64 nt, hsa; identical to SEQ ID NO: 124729

SEQ ID NO: 275216 - RNA, 64 nt, hsa; identical to SEQ ID NO: 124730

SEQ ID NO: 275217 - RNA, 64 nt, hsa; identical to SEQ ID NO: 124731

SEQ ID NO: 275218 - RNA, 64 nt, hsa; identical to SEQ ID NO: 124732

SEQ ID NO: 275219 - RNA, 64 nt, hsa; identical to SEQ ID NO: 124733

SEQ ID NO: 275220 - RNA, 64 nt, hsa; identical to SEQ ID NO: 124734

SEQ ID NO: 275221 - RNA, 64 nt, hsa; identical to SEQ ID NO: 124735

SEQ ID NO: 275222 - RNA, 64 nt, hsa; identical to SEQ ID NO: 124736

SEQ ID NO: 275223 - RNA, 64 nt, hsa; identical to SEQ ID NO: 124737

SEQ ID NO: 275224 - RNA, 64 nt, hsa; identical to SEQ ID NO: 124738

SEQ ID NO: 275225 - RNA, 64 nt, hsa; identical to SEQ ID NO: 124739

SEQ ID NO: 275226 - RNA, 64 nt, hsa; identical to SEQ ID NO: 124740

SEQ ID NO: 275227 - RNA, 64 nt, hsa; identical to SEQ ID NO: 124741

SEQ ID NO: 275228 - RNA, 64 nt, hsa; identical to SEQ ID NO: 124742

SEQ ID NO: 275229 - RNA, 64 nt, hsa; identical to SEQ ID NO: 124743

SEQ ID NO: 275230 - RNA, 64 nt, hsa; identical to SEQ ID NO: 124744

SEQ ID NO: 275231 - RNA, 64 nt, hsa; identical to SEQ ID NO: 124745

SEQ ID NO: 275232 - RNA, 64 nt, hsa; identical to SEQ ID NO: 124746

SEQ ID NO: 275233 - RNA, 64 nt, hsa; identical to SEQ ID NO: 124747

SEQ ID NO: 275234 - RNA, 64 nt, hsa; identical to SEQ ID NO: 124748

SEQ ID NO: 275235 - RNA, 64 nt, hsa; identical to SEQ ID NO: 124749

SEQ ID NO: 275236 - RNA, 64 nt, hsa; identical to SEQ ID NO: 124750

SEQ ID NO: 275237 - RNA, 64 nt, hsa; identical to SEQ ID NO: 124751

SEQ ID NO: 275238 - RNA, 60 nt, hsa; identical to SEQ ID NO: 124752

SEQ ID NO: 275239 - RNA, 64 nt, hsa; identical to SEQ ID NO: 124753

SEQ ID NO: 275240 - RNA, 64 nt, hsa; identical to SEQ ID NO: 124754

SEQ ID NO: 275241 - RNA, 64 nt, hsa; identical to SEQ ID NO: 124755

SEQ ID NO: 275242 - RNA, 64 nt, hsa; identical to SEQ ID NO: 124756

SEQ ID NO: 275243 - RNA, 64 nt, hsa; identical to SEQ ID NO: 124757

SEQ ID NO: 275244 - RNA, 64 nt, hsa; identical to SEQ ID NO: 124758

SEQ ID NO: 275245 - RNA, 64 nt, hsa; identical to SEQ ID NO: 124759

SEQ ID NO: 275246 - RNA, 64 nt, hsa; identical to SEQ ID NO: 124760

SEQ ID NO: 275247 - RNA, 64 nt, hsa; identical to SEQ ID NO: 124761

SEQ ID NO: 275248 - RNA, 64 nt, hsa; identical to SEQ ID NO: 124762

SEQ ID NO: 275249 - RNA, 64 nt, hsa; identical to SEQ ID NO: 124763

SEQ ID NO: 275250 - RNA, 64 nt, hsa; identical to SEQ ID NO: 124764

SEQ ID NO: 275251 - RNA, 64 nt, hsa; identical to SEQ ID NO: 124765

SEQ ID NO: 275252 - RNA, 64 nt, hsa; identical to SEQ ID NO: 124766

SEQ ID NO: 275253 - RNA, 64 nt, hsa; identical to SEQ ID NO: 124767

SEQ ID NO: 275254 - RNA, 64 nt, hsa; identical to SEQ ID NO: 124768

SEQ ID NO: 275255 - RNA, 64 nt, hsa; identical to SEQ ID NO: 124769

SEQ ID NO: 275256 - RNA, 64 nt, hsa; identical to SEQ ID NO: 124770

SEQ ID NO: 275257 - RNA, 64 nt, hsa; identical to SEQ ID NO: 124771

SEQ ID NO: 275258 - RNA, 64 nt, hsa; identical to SEQ ID NO: 124772

SEQ ID NO: 275259 - RNA, 64 nt, hsa; identical to SEQ ID NO: 124773

SEQ ID NO: 275260 - RNA, 64 nt, hsa; identical to SEQ ID NO: 124774

SEQ ID NO: 275261 - RNA, 64 nt, hsa; identical to SEQ ID NO: 124775

SEQ ID NO: 275262 - RNA, 64 nt, hsa; identical to SEQ ID NO: 124776

SEQ ID NO: 275263 - RNA, 64 nt, hsa; identical to SEQ ID NO: 124777

SEQ ID NO: 275264 - RNA, 64 nt, hsa; identical to SEQ ID NO: 124778

SEQ ID NO: 275265 - RNA, 64 nt, hsa; identical to SEQ ID NO: 124779

SEQ ID NO: 275266 - RNA, 64 nt, hsa; identical to SEQ ID NO: 124780

SEQ ID NO: 275267 - RNA, 64 nt, hsa; identical to SEQ ID NO: 124781

SEQ ID NO: 275268 - RNA, 64 nt, hsa; identical to SEQ ID NO: 124782

SEQ ID NO: 275269 - RNA, 64 nt, hsa; identical to SEQ ID NO: 124783

SEQ ID NO: 275270 - RNA, 64 nt, hsa; identical to SEQ ID NO: 124784

SEQ ID NO: 275271 - RNA, 64 nt, hsa; identical to SEQ ID NO: 124785

SEQ ID NO: 275272 - RNA, 64 nt, hsa; identical to SEQ ID NO: 124786

SEQ ID NO: 275273 - RNA, 64 nt, hsa; identical to SEQ ID NO: 124787

SEQ ID NO: 275274 - RNA, 64 nt, hsa; identical to SEQ ID NO: 124788

SEQ ID NO: 275275 - RNA, 64 nt, hsa; identical to SEQ ID NO: 124789

SEQ ID NO: 275276 - RNA, 64 nt, hsa; identical to SEQ ID NO: 124790

SEQ ID NO: 275277 - RNA, 64 nt, hsa; identical to SEQ ID NO: 124791

SEQ ID NO: 275278 - RNA, 64 nt, hsa; identical to SEQ ID NO: 124792

SEQ ID NO: 275279 - RNA, 64 nt, hsa; identical to SEQ ID NO: 124793

SEQ ID NO: 275280 - RNA, 64 nt, hsa; identical to SEQ ID NO: 124794

SEQ ID NO: 275281 - RNA, 64 nt, hsa; identical to SEQ ID NO: 124795

SEQ ID NO: 275282 - RNA, 64 nt, hsa; identical to SEQ ID NO: 124796

SEQ ID NO: 275283 - RNA, 64 nt, hsa; identical to SEQ ID NO: 124797

SEQ ID NO: 275284 - RNA, 64 nt, hsa; identical to SEQ ID NO: 124798

SEQ ID NO: 275285 - RNA, 64 nt, hsa; identical to SEQ ID NO: 124799

SEQ ID NO: 275286 - RNA, 64 nt, hsa; identical to SEQ ID NO: 124800

SEQ ID NO: 275287 - RNA, 64 nt, hsa; identical to SEQ ID NO: 124801

SEQ ID NO: 275288 - RNA, 64 nt, hsa; identical to SEQ ID NO: 124802

SEQ ID NO: 275289 - RNA, 64 nt, hsa; identical to SEQ ID NO: 124803

SEQ ID NO: 275290 - RNA, 64 nt, hsa; identical to SEQ ID NO: 124804

SEQ ID NO: 275291 - RNA, 64 nt, hsa; identical to SEQ ID NO: 124805

SEQ ID NO: 275292 - RNA, 64 nt, hsa; identical to SEQ ID NO: 124806

SEQ ID NO: 275293 - RNA, 64 nt, hsa; identical to SEQ ID NO: 124807

SEQ ID NO: 275294 - RNA, 64 nt, hsa; identical to SEQ ID NO: 124808

SEQ ID NO: 275295 - RNA, 64 nt, hsa; identical to SEQ ID NO: 124809

SEQ ID NO: 275296 - RNA, 64 nt, hsa; identical to SEQ ID NO: 124810

SEQ ID NO: 275297 - RNA, 64 nt, hsa; identical to SEQ ID NO: 124811

SEQ ID NO: 275298 - RNA, 64 nt, hsa; identical to SEQ ID NO: 124812

SEQ ID NO: 275299 - RNA, 64 nt, hsa; identical to SEQ ID NO: 103795

SEQ ID NO: 275300 - RNA, 64 nt, hsa; identical to SEQ ID NO: 103796

SEQ ID NO: 275301 - RNA, 64 nt, hsa; identical to SEQ ID NO: 103797

SEQ ID NO: 275302 - RNA, 64 nt, hsa; identical to SEQ ID NO: 103798

SEQ ID NO: 275303 - RNA, 64 nt, hsa; identical to SEQ ID NO: 103799

SEQ ID NO: 275304 - RNA, 64 nt, hsa; identical to SEQ ID NO: 103800

SEQ ID NO: 275305 - RNA, 64 nt, hsa; identical to SEQ ID NO: 103801

SEQ ID NO: 275306 - RNA, 64 nt, hsa; identical to SEQ ID NO: 103802

SEQ ID NO: 275307 - RNA, 64 nt, hsa; identical to SEQ ID NO: 103803

SEQ ID NO: 275308 - RNA, 64 nt, hsa; identical to SEQ ID NO: 103804

SEQ ID NO: 275309 - RNA, 64 nt, hsa; identical to SEQ ID NO: 103805

SEQ ID NO: 275310 - RNA, 64 nt, hsa; identical to SEQ ID NO: 103806

SEQ ID NO: 275311 - RNA, 64 nt, hsa; identical to SEQ ID NO: 103807

SEQ ID NO: 275312 - RNA, 64 nt, hsa; identical to SEQ ID NO: 103808

SEQ ID NO: 275313 - RNA, 64 nt, hsa; identical to SEQ ID NO: 103809

SEQ ID NO: 275314 - RNA, 64 nt, hsa; identical to SEQ ID NO: 103810

SEQ ID NO: 275315 - RNA, 64 nt, hsa; identical to SEQ ID NO: 103811

SEQ ID NO: 275316 - RNA, 64 nt, hsa; identical to SEQ ID NO: 103812

SEQ ID NO: 275317 - RNA, 64 nt, hsa; identical to SEQ ID NO: 103813

SEQ ID NO: 275318 - RNA, 64 nt, hsa; identical to SEQ ID NO: 103814

SEQ ID NO: 275319 - RNA, 64 nt, hsa; identical to SEQ ID NO: 103815

SEQ ID NO: 275320 - RNA, 64 nt, hsa; identical to SEQ ID NO: 103816

SEQ ID NO: 275321 - RNA, 64 nt, hsa; identical to SEQ ID NO: 103817

SEQ ID NO: 275322 - RNA, 64 nt, hsa; identical to SEQ ID NO: 103818

SEQ ID NO: 275323 - RNA, 64 nt, hsa; identical to SEQ ID NO: 103819

SEQ ID NO: 275324 - RNA, 64 nt, hsa; identical to SEQ ID NO: 103820

SEQ ID NO: 275325 - RNA, 64 nt, hsa; identical to SEQ ID NO: 103821

SEQ ID NO: 275326 - RNA, 64 nt, hsa; identical to SEQ ID NO: 103822

SEQ ID NO: 275327 - RNA, 64 nt, hsa; identical to SEQ ID NO: 103823

SEQ ID NO: 275328 - RNA, 64 nt, hsa; identical to SEQ ID NO: 103824

SEQ ID NO: 275329 - RNA, 64 nt, hsa; identical to SEQ ID NO: 103825

SEQ ID NO: 275330 - RNA, 64 nt, hsa; identical to SEQ ID NO: 103826

SEQ ID NO: 275331 - RNA, 64 nt, hsa; identical to SEQ ID NO: 103827

SEQ ID NO: 275332 - RNA, 64 nt, hsa; identical to SEQ ID NO: 103828

SEQ ID NO: 275333 - RNA, 64 nt, hsa; identical to SEQ ID NO: 103829

SEQ ID NO: 275334 - RNA, 64 nt, hsa; identical to SEQ ID NO: 103830

SEQ ID NO: 275335 - RNA, 64 nt, hsa; identical to SEQ ID NO: 103831

SEQ ID NO: 275336 - RNA, 64 nt, hsa; identical to SEQ ID NO: 103832

SEQ ID NO: 275337 - RNA, 64 nt, hsa; identical to SEQ ID NO: 103833

SEQ ID NO: 275338 - RNA, 64 nt, hsa; identical to SEQ ID NO: 103834

SEQ ID NO: 275339 - RNA, 64 nt, hsa; identical to SEQ ID NO: 103835

SEQ ID NO: 275340 - RNA, 64 nt, hsa; identical to SEQ ID NO: 103836

SEQ ID NO: 275341 - RNA, 64 nt, hsa; identical to SEQ ID NO: 103837

SEQ ID NO: 275342 - RNA, 64 nt, hsa; identical to SEQ ID NO: 103838

SEQ ID NO: 275343 - RNA, 64 nt, hsa; identical to SEQ ID NO: 103839

SEQ ID NO: 275344 - RNA, 64 nt, hsa; identical to SEQ ID NO: 103840

SEQ ID NO: 275345 - RNA, 64 nt, hsa
cuuccuuucccacuggcucuguauaaaaaacuucuggaccaaaagccaucauuggaagauuuaa

SEQ ID NO: 275346 - RNA, 64 nt, hsa
guugacuuaauuccaaaugggaucuccauaccuguggaccaaaccaacaaguaaguuuugacag

SEQ ID NO: 275347 - RNA, 64 nt, hsa
aucacuuuauaaaacauacauuaagccuaauaaauggaccaauaagccaaacuaucaguauuuu

SEQ ID NO: 275348 - RNA, 64 nt, hsa
aaaaaaaaggagaguauagaaugauggagaaaaauggaccaaaggcuaaaaauauugcagggca

SEQ ID NO: 275349 - RNA, 64 nt, hsa
uucagcucuaacauggaggucagagaaagggacuuggaccaauaaaaugacauggaggccuaac

SEQ ID NO: 275350 - RNA, 64 nt, hsa
cacaucuucuaugagccagaugcuuaugaugaccuggaccaagaagacccagaugacgaccugg

SEQ ID NO: 275351 - RNA, 64 nt, hsa
cuccaucucucagggagacaaagaaccuccuuccuggaccaaggaggugcugccaaguuuucua

SEQ ID NO: 275352 - RNA, 64 nt, hsa
uaaggauuuggaauaaggauuugguccuguuuucuggaccaaauccuuacucuggcucugcuua

SEQ ID NO: 275353 - RNA, 64 nt, hsa
cucuguaagauggaccaaucagcgcucuguaaaauggaccaaucagcaggacaugggcggggac

SEQ ID NO: 275354 - RNA, 64 nt, hsa
gauuguaaaauggaccaaucagcacucuguaagauggaccaaucagcgcucuguaaaauggacc

SEQ ID NO: 275355 - RNA, 64 nt, hsa
gagaacuuuucugucuuacaagaggauuguaaaauggaccaaucagcacucuguaagauggacc

SEQ ID NO: 275356 - RNA, 64 nt, hsa
cucugcuugagccucguggucucuugucucuuuuuggaccaauauccucagauuggugcagcuu

SEQ ID NO: 275357 - RNA, 64 nt, hsa
uuucucuuggcugagugacagguggcuguucagguggaccaaagcaccuugacacaaggacucc

SEQ ID NO: 275358 - RNA, 64 nt, hsa
aggucuagggaaccacaacccuuauuguccuggguggaccaauccaaaggcuaagugauaguga

SEQ ID NO: 275359 - RNA, 64 nt, hsa
guaauagugacccuuucacguccuggagcccgaguggaccaaucggaagccuaagugacgauga

SEQ ID NO: 275360 - RNA, 64 nt, hsa
guaguggacccaguucuauuguuggcuucagcgguggaccaagcacugguguuggcuucugcag

SEQ ID NO: 275361 - RNA, 64 nt, hsa
gcgguggaccaagcacugguguuggcuucugcaguggaccaagcaccaguggcuucagcggugg

SEQ ID NO: 275362 - RNA, 64 nt, hsa
gcgguggaccgagcacaggagcuggcuucggcgguggaccaaacacuggugcuggcuuuggugg

SEQ ID NO: 275363 - RNA, 64 nt, hsa
ggcaacaguacuucaaacagaacugcagucagcaugaauccaguccagauauuucacauuuuga

SEQ ID NO: 275364 - RNA, 64 nt, hsa
uuacuccaguauaugcugauggaccaggaagcccugaauccauaaaggcauaccuuaaacaagc

SEQ ID NO: 275365 - RNA, 64 nt, hsa
uacaguauaguaccauuauuuuauguugugccagugaauccaguugccagaaauaagucugaau

SEQ ID NO: 275366 - RNA, 64 nt, hsa
aguauuggcaaucaugacaccuguaauaaaaacuugaauccaaagucaaaacuuaagcaagaua

SEQ ID NO: 275367 - RNA, 64 nt, hsa
guuugaauauagaaacuuuuuuuaccccaacuacugaauccaggaguaccaaauaauauauagu

SEQ ID NO: 275368 - RNA, 64 nt, hsa
uuacuguuggucaaaaaucaugaggaggaacaguugaauccagccugaacgugggugcuugugu

SEQ ID NO: 275369 - RNA, 64 nt, hsa
uuuccuuucagaacauuuuccagauggcgaggucacagcagagagauguggccaccuagccuuu

SEQ ID NO: 275370 - RNA, 64 nt, hsa
gaauuucaugucucuggaauugaggugguagugaacagcagaucggucagcaccagaagucaac

SEQ ID NO: 275371 - RNA, 64 nt, hsa
agcuggaugggacuaccuuucuguucaucaccacacagcagaauuucuaauggaaguuuguugu

SEQ ID NO: 275372 - RNA, 64 nt, hsa
cagcaucaggucccagagggccaccguguccauuacagcagaguccagcugcagcauccagcuc

SEQ ID NO: 275373 - RNA, 64 nt, hsa
guauuugaaggaaaaauacccugauuugaaaccaacagcagauguugcaaacuuucauaccacu

SEQ ID NO: 275374 - RNA, 64 nt, hsa
acucuaccaccaagaaccuaaaaggaauuagaauacagcagaauuggccucagugaagagcuua

SEQ ID NO: 275375 - RNA, 64 nt, hsa
accucauucagccguauugcacagaugagcaauuacagcagagaaaauucauuagugcucccac

SEQ ID NO: 275376 - RNA, 64 nt, hsa
aucaugcugaaagcacucagacaugucuguccucacagcagaauguagaagucauaugaaugag

SEQ ID NO: 275377 - RNA, 64 nt, hsa
cacucugccccucacuuccuuuagggcaaauaacacagcagaaccacguggguauuuuaguacu

SEQ ID NO: 275378 - RNA, 64 nt, hsa
ugggguuuccugcugcaggaauugggggcugggaacagcagaggggauagaagucugguggagg

SEQ ID NO: 275379 - RNA, 64 nt, hsa
uucauuuggaugcagugaaaagggcagaaauaccacagcagagaauaaaauugauaauguuggc

SEQ ID NO: 275380 - RNA, 64 nt, hsa
uagaaggugggaggggaaugcuauacagcugggaacagcagacuuucucugaagggccagaugg

SEQ ID NO: 275381 - RNA, 64 nt, hsa
cugcaauucaacacauccacagguucgagcccaaacagcagaacuuuuugccaaaaugacagca

SEQ ID NO: 275382 - RNA, 64 nt, hsa
ucgagcccaaacagcagaacuuuuugccaaaaugacagcagauaaacugauagguccaaaggua

SEQ ID NO: 275383 - RNA, 64 nt, hsa
uuucaguguagcuucaagauuaauguuaauuaugacagcagaucuacaaagcuguaguucacaa

SEQ ID NO: 275384 - RNA, 64 nt, hsa
gcagucagcagcaucuauggaugcaaauccagccacagcagacaaucauggauauacggcacuu

SEQ ID NO: 275385 - RNA, 64 nt, hsa
acuauguuucuauucuaaguaauuccuguauucuacagcagauacuuugucagcaauacuaagg

SEQ ID NO: 275386 - RNA, 64 nt, hsa
ucucuauugcugcucucucacucccccaugagguacagcagaaaggagaacuauccaaaacuaa

SEQ ID NO: 275387 - RNA, 64 nt, hsa
gcuuucuccuacagggcuuuuccugaguccccagacagcagaguaugaacugcugacacccaga

SEQ ID NO: 275388 - RNA, 64 nt, hsa
cagauacaugcugguucuccuugcugugugugacacagcagacagaggcacuauuccuggugca

SEQ ID NO: 275389 - RNA, 64 nt, hsa
aagugcaauguguuuuaaaauaagcuugcaaaugacagcagagacauuuacuucugcaguuagu

SEQ ID NO: 275390 - RNA, 64 nt, hsa
cuagacauuuauguaacaucuugcuguacuaaauacagcagaaaaucuacucuuuagcaauaua

SEQ ID NO: 275391 - RNA, 64 nt, hsa
gaauaauaaaauugcaaccaguuugguaaugcaaacagcagaauagaaugaaaucucaguaaug

SEQ ID NO: 275392 - RNA, 64 nt, hsa
agagaauguuuauacaaaaaaugaaauucuuccaacagcagagaaacucuaaaaaguuugauag

SEQ ID NO: 275393 - RNA, 64 nt, hsa
cuaugggaaggagcaggcgguuggaaauccugugacagcagagaucuucuggauuuuugccugg

SEQ ID NO: 275394 - RNA, 64 nt, hsa
ugcgccuccacugucaccuguaccaagugccaaaacagcagaggggccaguuagagcaagagcu

SEQ ID NO: 275395 - RNA, 64 nt, hsa
guugcuuccacauuaacaaaacaaucacugaaaaacagcagauguuuaaauagauuauuuuaua

SEQ ID NO: 275396 - RNA, 64 nt, hsa
uuuucuuuuuguaguagcucagucaaaacagguaacagcagauuaaucauagaaaauguugcuu

SEQ ID NO: 275397 - RNA, 64 nt, hsa
ggaugaggagggggaaagggucuuaauucuauguacagcagagacauuaaacuugcuguguccg

SEQ ID NO: 275398 - RNA, 64 nt, hsa
ccuuggcuuaacuccuaagccccugcccagcaccacagcagagaucacacacugacccuccgcc

SEQ ID NO: 275399 - RNA, 64 nt, hsa
cucccccugccacccucccuggcacguuuauuucacagcagagccaagucuguggcagguugac

SEQ ID NO: 275400 - RNA, 64 nt, hsa
agaaacguugguaaaagggcaguuugguuucaacacagcagaccugauaugggaucccuuagcc

SEQ ID NO: 275401 - RNA, 64 nt, hsa
cucccucuccuucccugacacuucucugggcugcacagcagaaacguugguaaaagggcaguuu

SEQ ID NO: 275402 - RNA, 64 nt, hsa
agcuccugaaucccuuucaguuuguccacacaagacagcagagccaucugcgacaccaccaaca

SEQ ID NO: 275403 - RNA, 64 nt, hsa
aacuccuggaucccuuucacuauguccaugaaaaacagcagaguaaaauuacagaagaagcucc

SEQ ID NO: 275404 - RNA, 64 nt, hsa
cagaccgaccaccagcacaguagggcagaucuggacagcagaauguuauaacgcaaguucaugu

SEQ ID NO: 275405 - RNA, 64 nt, hsa
cucagagacacaaaaauacuguaagucucaauuaacagcagaaucucagagaaaagcuguuugc

SEQ ID NO: 275406 - RNA, 64 nt, hsa
cauccccugcacccgcuaccacaccagcucagccacagcagagccaaucacagacccaccacac

SEQ ID NO: 275407 - RNA, 64 nt, hsa
cgaguuugggccaguuuaccaccaccccaaguacacagcagaauaguacaagucacccuacaac

SEQ ID NO: 275408 - RNA, 64 nt, hsa
ccacuucccauauaagaugcuuaaggcucucaaaacagcagaacaaugaaacauacucucccua

SEQ ID NO: 275409 - RNA, 64 nt, hsa
gcucacagaugcagagacugacaauugugucuccacagcagagguggaugcuagcuacaccagc

SEQ ID NO: 275410 - RNA, 64 nt, hsa
ucagugaccugccugcaagcauccccagaagcaaacagcagagguagaagauaucacugcagcc

SEQ ID NO: 275411 - RNA, 64 nt, hsa
aauugcagugggggcuaaggcauccauuaugaauacagcagaacauuugcuggcgagaguccug

SEQ ID NO: 275412 - RNA, 64 nt, hsa
guggaguuuguucagugguacgguguccaagcaaacagcagaaugcaacuuucuaaacagcccc

SEQ ID NO: 275413 - RNA, 64 nt, hsa
agcagaaugcaacuuucuaaacagccccaagcaaacagcagaauucaacuuuuuaaacaauaaa

SEQ ID NO: 275414 - RNA, 64 nt, hsa
cauagacugcuccuccaaggggaagcaguguggaacagcagagaaagucccgucccuaucucug

SEQ ID NO: 275415 - RNA, 64 nt, hsa
uuaguccccaaccuuguggucacaucagaggucaacagcagaacagaggcaggucaggguuguc

SEQ ID NO: 275416 - RNA, 64 nt, hsa
gggggaagcuguguggaaggagaagcugguggccacagcagaguccugcucuggggacgccugc

SEQ ID NO: 275417 - RNA, 64 nt, hsa
gccugagcuugcugcccaacgggaggauggcuucacagcagagccagcaugagggguggggccu

SEQ ID NO: 275418 - RNA, 64 nt, hsa
ccacaacggccagcaggugccccauccucugcccacagcagacucugucccauggcucuccggg

SEQ ID NO: 275419 - RNA, 64 nt, hsa
ggccugguguggaaccagggagcugugggaagccacagcagaaauggaagaaaaacaggucuca

SEQ ID NO: 275420 - RNA, 64 nt, hsa
auauuuugaaauggacugugaaggaaaaggggacaggaacaaaggaccaaaaauaagcuacaug

SEQ ID NO: 275421 - RNA, 64 nt, hsa
uaaauguggaacauuauuaacuuacuuugugucuaggaacaauggauuuuguaucugauuuaaa

SEQ ID NO: 275422 - RNA, 64 nt, hsa
ugcuuucacuuaagugucuggcccgcaauacuguaggaacaagcaugaucuuguuacugugaua

SEQ ID NO: 275423 - RNA, 64 nt, hsa
agauucccgagaguaaaucaucuuuccaauccagaggaacaagcaugucucucugccaagaucc

SEQ ID NO: 275424 - RNA, 64 nt, hsa
aagcuuucagugaaacacuacauacacgaagaaaaggaacaagguuuaacuauuuaagaaccau

SEQ ID NO: 275425 - RNA, 64 nt, hsa
gcacgaucaugucccuuuuuaagccuuaccugagaggaacaaugccuuaaaauaaaaaagcauu

SEQ ID NO: 275426 - RNA, 64 nt, hsa
ucaguuguguauuuguucaucuucauaugcuggcaggaacaacuauuaauacagauacucagaa

SEQ ID NO: 275427 - RNA, 64 nt, hsa
uggcucaucucaggacagaaggcaauugcagcuaaggaacaauggaaagagcugaaggccaccu

SEQ ID NO: 275428 - RNA, 64 nt, hsa
aaucuauagaaagaauuuagcugcaaguggacaaaggaacaagcccccagaaaagaaagggaag

SEQ ID NO: 275429 - RNA, 64 nt, hsa
aagcacccauuaaacaaguccuggcaggacucacaggaacaaacgaggucccuguuaggguucu

SEQ ID NO: 275430 - RNA, 64 nt, hsa
aauuuucuugcauuuagaugucaaccucagaaacaggaacaaucgucuuuugaacuuccaguag

SEQ ID NO: 275431 - RNA, 64 nt, hsa
ugcacuguuccaguaguuauaauccacuugcccuaggaacaaguuagcacugaauuuugggugg

SEQ ID NO: 275432 - RNA, 64 nt, hsa
aaaagagcuccugaaggaagcacuaaacauggaaaggaacaacugauaccagccgcugcaaaau

SEQ ID NO: 275433 - RNA, 64 nt, hsa
uaguuggaaguaaagcacuccucagcaaauguaaaggaacaaaaauuauaacaaacugucucuc

SEQ ID NO: 275434 - RNA, 64 nt, hsa
auccagaaucuacaaugaacucaaacaaauuuacaggaacaaacaaccccaucaaaaagucggc

SEQ ID NO: 275435 - RNA, 64 nt, hsa
aaaaugaaaaaagagcaggcauccauuuccauacaggaacaaaauaggaggcagcacuacagac

SEQ ID NO: 275436 - RNA, 64 nt, hsa
uguauauauuuacacaaauacauuugaucagacuaggaacaaguugauaccaaaaccugaaaag

SEQ ID NO: 275437 - RNA, 64 nt, hsa
uaaauuauguaucaaggccaucaguaucccuggguuacacuaauugaugauuuagaaauuaaag

SEQ ID NO: 275438 - RNA, 64 nt, hsa
gcaaaggaaggguagaaaggaauugaaaauuaauuuacacuaguugcuacuugggaauaaaggg

SEQ ID NO: 275439 - RNA, 64 nt, hsa
guaugcucguuucucucaauuugaaacacaagaauuacacuaauaguaacaggccuugagcaca

SEQ ID NO: 275440 - RNA, 64 nt, hsa
gcuggaacacaauaauguguccuucuacauuuuauuacacuaaaugauauucauauucaagcaa

SEQ ID NO: 275441 - RNA, 64 nt, hsa
aaaaaaaaaaaaaaaaaaguaucaaccaacaaauguuaccaagauaacgugacuucaugaggga

SEQ ID NO: 275442 - RNA, 64 nt, hsa
ccagaaaauuagaagauggucaaaaaaaguccaaguuaccaauuuuuuaaaauuuauaggcaaa

SEQ ID NO: 275443 - RNA, 64 nt, hsa
aucacgagguguaauuuuuaauuugaucagaacuguuaccaaaaaacaacugucaguuuuauug

SEQ ID NO: 275444 - RNA, 64 nt, hsa
cagagggacaaagccacagccacacucuucaacgguuaccaaacuguuuuuggaaauucacacc

SEQ ID NO: 275445 - RNA, 64 nt, hsa; identical to SEQ ID NO: 53771

SEQ ID NO: 275446 - RNA, 64 nt, hsa; identical to SEQ ID NO: 53772

SEQ ID NO: 275447 - RNA, 64 nt, hsa; identical to SEQ ID NO: 53773

SEQ ID NO: 275448 - RNA, 64 nt, hsa; identical to SEQ ID NO: 53774

SEQ ID NO: 275449 - RNA, 64 nt, hsa; identical to SEQ ID NO: 53775

SEQ ID NO: 275450 - RNA, 64 nt, hsa; identical to SEQ ID NO: 53776

SEQ ID NO: 275451 - RNA, 64 nt, hsa; identical to SEQ ID NO: 53777

SEQ ID NO: 275452 - RNA, 64 nt, hsa; identical to SEQ ID NO: 53778

SEQ ID NO: 275453 - RNA, 64 nt, hsa; identical to SEQ ID NO: 53779

SEQ ID NO: 275454 - RNA, 64 nt, hsa; identical to SEQ ID NO: 53780

SEQ ID NO: 275455 - RNA, 64 nt, hsa; identical to SEQ ID NO: 53781

SEQ ID NO: 275456 - RNA, 64 nt, hsa; identical to SEQ ID NO: 53782

SEQ ID NO: 275457 - RNA, 64 nt, hsa; identical to SEQ ID NO: 53783

SEQ ID NO: 275458 - RNA, 64 nt, hsa; identical to SEQ ID NO: 53784

SEQ ID NO: 275459 - RNA, 64 nt, hsa; identical to SEQ ID NO: 53785

SEQ ID NO: 275460 - RNA, 64 nt, hsa; identical to SEQ ID NO: 53786

SEQ ID NO: 275461 - RNA, 64 nt, hsa; identical to SEQ ID NO: 53787

SEQ ID NO: 275462 - RNA, 64 nt, hsa; identical to SEQ ID NO: 53788

SEQ ID NO: 275463 - RNA, 64 nt, hsa; identical to SEQ ID NO: 53789

SEQ ID NO: 275464 - RNA, 64 nt, hsa; identical to SEQ ID NO: 53790

SEQ ID NO: 275465 - RNA, 64 nt, hsa; identical to SEQ ID NO: 53791

SEQ ID NO: 275466 - RNA, 64 nt, hsa; identical to SEQ ID NO: 53792

SEQ ID NO: 275467 - RNA, 64 nt, hsa; identical to SEQ ID NO: 53793

SEQ ID NO: 275468 - RNA, 64 nt, hsa; identical to SEQ ID NO: 53794

SEQ ID NO: 275469 - RNA, 64 nt, hsa; identical to SEQ ID NO: 53795

SEQ ID NO: 275470 - RNA, 64 nt, hsa; identical to SEQ ID NO: 53796

SEQ ID NO: 275471 - RNA, 64 nt, hsa; identical to SEQ ID NO: 53797

SEQ ID NO: 275472 - RNA, 64 nt, hsa; identical to SEQ ID NO: 53798

SEQ ID NO: 275473 - RNA, 64 nt, hsa; identical to SEQ ID NO: 53799

SEQ ID NO: 275474 - RNA, 64 nt, hsa; identical to SEQ ID NO: 53800

SEQ ID NO: 275475 - RNA, 64 nt, hsa; identical to SEQ ID NO: 53801

SEQ ID NO: 275476 - RNA, 64 nt, hsa; identical to SEQ ID NO: 53802

SEQ ID NO: 275477 - RNA, 64 nt, hsa; identical to SEQ ID NO: 53803

SEQ ID NO: 275478 - RNA, 64 nt, hsa; identical to SEQ ID NO: 53804

SEQ ID NO: 275479 - RNA, 64 nt, hsa; identical to SEQ ID NO: 53805

SEQ ID NO: 275480 - RNA, 64 nt, hsa; identical to SEQ ID NO: 53806

SEQ ID NO: 275481 - RNA, 64 nt, hsa; identical to SEQ ID NO: 53807

SEQ ID NO: 275482 - RNA, 64 nt, hsa; identical to SEQ ID NO: 53808

SEQ ID NO: 275483 - RNA, 64 nt, hsa; identical to SEQ ID NO: 53809

SEQ ID NO: 275484 - RNA, 64 nt, hsa; identical to SEQ ID NO: 53810

SEQ ID NO: 275485 - RNA, 64 nt, hsa; identical to SEQ ID NO: 53811

SEQ ID NO: 275486 - RNA, 64 nt, hsa; identical to SEQ ID NO: 53812

SEQ ID NO: 275487 - RNA, 64 nt, hsa; identical to SEQ ID NO: 53813

SEQ ID NO: 275488 - RNA, 64 nt, hsa; identical to SEQ ID NO: 53814

SEQ ID NO: 275489 - RNA, 64 nt, hsa; identical to SEQ ID NO: 53815

SEQ ID NO: 275490 - RNA, 64 nt, hsa
guugacaaggccuaugggaaaugccugaugggauuaucuucagcuuguugagcuucuaaguuuc

SEQ ID NO: 275491 - RNA, 64 nt, hsa
aaagcagaaggcuccaauaugaacaagauaaaucuaucuucaaagacauauuagaaguugggaa

SEQ ID NO: 275492 - RNA, 64 nt, hsa
gauagcauuuagaaagggcuuuguuguggugggguaucuucaguuaguuuuuaaaugggaauaa

SEQ ID NO: 275493 - RNA, 64 nt, hsa
gaucucaacaguguggggugaaacaagaagacuguaucuucagccuuuuuccuauaaucaugga

SEQ ID NO: 275494 - RNA, 64 nt, hsa
uccuaugaugcuauuaucauagacuaaugacauuuaucuucaaaacaccaaauugucuuuagaa

SEQ ID NO: 275495 - RNA, 64 nt, hsa
cacucaauucuuccugcccuguuauuaauuaagauaucuucagcuuguagucagacacaaucag

SEQ ID NO: 275496 - RNA, 64 nt, hsa
acuggcuuugcuguaaugcuugaaaaggcguugguaucuucauuuuacaguucauuaacccaag

SEQ ID NO: 275497 - RNA, 64 nt, hsa
aucugcuuguaaaaaugcuuguugccuuuugcuuuaucuucaguguaccuccuuaauccugcuu

SEQ ID NO: 275498 - RNA, 64 nt, hsa
gguauccagggacuaugaugagaggccagcacauuaucuucauaugucaccuuugcuacgcaag

SEQ ID NO: 275499 - RNA, 64 nt, hsa
gaaagggaggcuaauauuuuucaugcuaucaaauuaucuucacccucauccuuuacauuuuuca

SEQ ID NO: 275500 - RNA, 64 nt, hsa
acccauaaucugcuuggcaauaguuaagucaaucuaucuucaguuuuucucuggccuuuaaggu

SEQ ID NO: 275501 - RNA, 64 nt, hsa
gucaagaugcuacaauggaaaccauuucugguuuuaucuucaaagcggagaaacauguugauuu

SEQ ID NO: 275502 - RNA, 64 nt, hsa
cuggccacagguccuuauugccauuauuuuuaaguaucuucauuggagaugaacacugacuuuu

SEQ ID NO: 275503 - RNA, 64 nt, hsa
uuuuuaucacauuaucacguuugucuuuauauuuuaucuucauccuaaauuuucucccuaucaa

SEQ ID NO: 275504 - RNA, 64 nt, hsa
agaagaauugauccuauuuugaaccccucuccaguaucuucacacucuugucaacucuccaggc

SEQ ID NO: 275505 - RNA, 64 nt, hsa
ccagcuucccucaaaucaguccuuauccucuuucuaucuucacucccaucaucaucuauuuuca

SEQ ID NO: 275506 - RNA, 64 nt, hsa
uccagcuaagcaaagauuccuggaggcugacuuguaucuucagacucacagagugaauucagcu

SEQ ID NO: 275507 - RNA, 64 nt, hsa
ugaacuuugaugggguuuuuuuguuuuuacuuucuaucuucauaaccauuuaaagcgauuuagc

SEQ ID NO: 275508 - RNA, 64 nt, hsa
uuacaauuucugagcaugauuuuucauaauucauuaucuucagaucauuacuauaauaagauac

SEQ ID NO: 275509 - RNA, 64 nt, hsa
aagcaccaguacuccaaccuuccagaaagccgauuaucuucauugcuuuuaauguucuauucug

SEQ ID NO: 275510 - RNA, 64 nt, hsa
cagcucaaaugaucacauuagauggaauagaugguaucuucagguguacuuugggaugcuuuac

SEQ ID NO: 275511 - RNA, 64 nt, hsa
uaauaugggcacauucuugccaauuucacacuuguaucuucagcagggacauuacaaucaaaca

SEQ ID NO: 275512 - RNA, 64 nt, hsa
gcuguuagugugacauagcuuccagcuccucuguuaucuucacagcugacuucacacucacugg

SEQ ID NO: 275513 - RNA, 64 nt, hsa
auguuucugugagagugacagagcugugcccguuuaucuucauuguauuaauuauuacauaaag

SEQ ID NO: 275514 - RNA, 64 nt, hsa
acauguuugcaugagugucagggcuuuguccaguuaucuucauaugacuguucucugaaaaaag

SEQ ID NO: 275515 - RNA, 64 nt, hsa
uuauuauuuccaguucagaagagccaaaaaaaaguaucuucauuuaaaaagaaaucaagucagu

SEQ ID NO: 275516 - RNA, 64 nt, hsa
uaagucaguauacuuuuggaugcucaaaaugccauaucuucaaccaguaggaguuguuucaagu

SEQ ID NO: 275517 - RNA, 64 nt, hsa
uuuaaaagccuuccaacaccauuuaaacaugguuuaucuucagcaaauuccuaugagagaauaa

SEQ ID NO: 275518 - RNA, 64 nt, hsa
ccuggaaagagaacucucccagggcccaucuccugcaucccaugaauacucuguacacauggug

SEQ ID NO: 275519 - RNA, 64 nt, hsa
ggggagaugccuucucccccaccucccaggaccugcaucccagcucagaaggcugagaggguuu

SEQ ID NO: 275520 - RNA, 64 nt, hsa
gcaugccagagccuggggcaucccagagcccagggcaucccaugggggugcugcagccaggagg

SEQ ID NO: 275521 - RNA, 64 nt, hsa
cacgccugcccagccucgcaugccagagccuggggcaucccagagcccagggcaucccaugggg

SEQ ID NO: 275522 - RNA, 64 nt, hsa
cagccucugccccagcccacuggcaugccacccagcaucccaccugugccugucccuguuugca

SEQ ID NO: 275523 - RNA, 64 nt, hsa
gaucccacccacccaccguagggugcacagcaaggcaucccagcuucuggcccgcuccucacug

SEQ ID NO: 275524 - RNA, 64 nt, hsa
agauguacugcaauggaacaaaacucaucuggcugcaucccagguguguagcaaaguccacaug

SEQ ID NO: 275525 - RNA, 64 nt, hsa
guaaaagcuguugauuucgaguuguaagagcucagcaucccaggggcaucuucuugacuguggc

SEQ ID NO: 275526 - RNA, 64 nt, hsa
ccccuaacuuucuugcuucaaaaauuaaaauccagcaucccaagaucauucuacaaguaauuuu

SEQ ID NO: 275527 - RNA, 64 nt, hsa
accaguccuaguuuuagaccucaucuccaagauagcaucccaucucagaagauggguguuguuu

SEQ ID NO: 275528 - RNA, 64 nt, hsa
aacggaaugaccuuggcgcuggcuucaggaauaugcaucccacagccaguuuagagaaauacau

SEQ ID NO: 275529 - RNA, 64 nt, hsa
aaaggaagaccucaagaaaaauucacaguugagugcaucccagcauucuguuccgggcaggcau

SEQ ID NO: 275530 - RNA, 64 nt, hsa
ugaggugacaucucauccccucacugaagcaacagcaucccaaggugcucagccggacucccug

SEQ ID NO: 275531 - RNA, 64 nt, hsa
gguccaggacgaucccagugggcucgcuuccaaagcaucccacucaagggagacuugaaacuuc

SEQ ID NO: 275532 - RNA, 64 nt, hsa
auccaccaaauacacagggaagggugaugcagggaagggugacaucaggagucagggcauggac

SEQ ID NO: 275533 - RNA, 64 nt, hsa
ccucaaucaagccuuauccaccaaauacacagggaagggugaugcagggaagggugacaucagg

SEQ ID NO: 275534 - RNA, 64 nt, hsa
uccaaaaggagaaagcuauguagaaagauacauuaagggugaaaauagcaauacaguagauuug

SEQ ID NO: 275535 - RNA, 64 nt, hsa
gucauucuggagguccuauuagagaauauuauaaaagggugaccuuguaggaaggaucugaguc

SEQ ID NO: 275536 - RNA, 64 nt, hsa
uuuacuuucaaccauaagcgguaauagcagaggaaagggugaagggagucugggcaagcaaagc

SEQ ID NO: 275537 - RNA, 64 nt, hsa
ggucuaguagguggaucccauccaguugguuuccaagggugauccugaaacaguguaaaaggag

SEQ ID NO: 275538 - RNA, 64 nt, hsa
gcuaggacagcuggcugagaaguggguucaggcgaagggugaagccauguguagcaguuccugc

SEQ ID NO: 275539 - RNA, 64 nt, hsa
uauuguauuuguguguuuguguuuguuuuuuuuuaagggugagccaggucuagcccaacagucu

SEQ ID NO: 275540 - RNA, 64 nt, hsa
acuaaucaguugaacuuaacauuuaauaaaaagaaagggugaaauaaacugaagaccauuuuag

SEQ ID NO: 275541 - RNA, 64 nt, hsa
ccaggacugcacgguuuaacacagcagaguacagaagggugaagaagugagcagaggcuuauga

SEQ ID NO: 275542 - RNA, 64 nt, hsa
guguauaucuggcaugugucccagucacuugcagaagggugacuucuugccagccgcaucgaga

SEQ ID NO: 275543 - RNA, 64 nt, hsa
uguggaaggaggucgguuccgaggggguggguguaagggugaggugggggugugugugccgugu

SEQ ID NO: 275544 - RNA, 64 nt, hsa
gugagucaucccuacucccaacaucuggaggggaaagggugauucuggggguccacuugucugu

SEQ ID NO: 275545 - RNA, 64 nt, hsa
caaggaaucaaaugucaucucccaggaguuauucaagggugagcccuuuacuugggauguacag

SEQ ID NO: 275546 - RNA, 64 nt, hsa
uuuuaguuaacuacacuucuugauauucaaauguucuauuaaaaaaacugaguaugaagaaaaa

SEQ ID NO: 275547 - RNA, 64 nt, hsa
ugcucaagagcucugccgugcuccccaugaaaagucuauuaaguaggcacccugugcucacuca

SEQ ID NO: 275548 - RNA, 64 nt, hsa
aaauaauggacuuuuuucuaaacagaaauuauuuucuauuaauuugcaaacugaugauuucacu

SEQ ID NO: 275549 - RNA, 64 nt, hsa
ucuggcacguaauuuuuuucacaguuauuauucuucuauuaacaaauuauuuuuaucuuuccua

SEQ ID NO: 275550 - RNA, 64 nt, hsa
aacaccagccuggccaagauggugaaaccccgucucuauuaaaaauauuuuuuaaaaauuaacu

SEQ ID NO: 275551 - RNA, 64 nt, hsa
caaugagaggaaguguaaugauuauuuuaauauuucuauuaaaacuguauauuuuuauggcugc

SEQ ID NO: 275552 - RNA, 64 nt, hsa
guuuggacuucgauagguugauggaaggaauacuucuauuaaccaaauagaaucuguuuacaaa

SEQ ID NO: 275553 - RNA, 64 nt, hsa
acccucuuuguccuagguguacccuuuccucaucucuauuaaauuguaaacaggacuacugcau

SEQ ID NO: 275554 - RNA, 64 nt, hsa
uuauuuaauuuuuuagguaaugccuaucucuuggucuauuaaggaaagaagcaaucaguagaga

SEQ ID NO: 275555 - RNA, 64 nt, hsa
acugauguguugauuuuacugauuguacuguacaucuauuaaagccuuagauuauuacauuacg

SEQ ID NO: 275556 - RNA, 64 nt, hsa
uuuuucauuuccuacauuuauuagauuuucauuuucuauuaacaauugaauaccauuucaguuu

SEQ ID NO: 275557 - RNA, 64 nt, hsa
aacacagaaaaguugaaaccacaacaaaaugaauucuauuaaagaauagccccagauauaaauu

SEQ ID NO: 275558 - RNA, 64 nt, hsa
auuuaagcaaauuaaagacaauguuaacaaauuuucuauuaaaugcccugagugauaaaaccag

SEQ ID NO: 275559 - RNA, 64 nt, hsa
ggcauguaauuuuaaaacugcaguagguuaaaauucuauuaaacaaauauagaaaauauuuugu

SEQ ID NO: 275560 - RNA, 64 nt, hsa
aagaccagccuggccaacauggugaauccccgucucuauuaaaaauacaaaaauuagcugggug

SEQ ID NO: 275561 - RNA, 64 nt, hsa
uuguaauuuaggaaaaauguauaauaagauaaaaucuauuaaauuuuucuccucuaaaaacuga

SEQ ID NO: 275562 - RNA, 64 nt, hsa
uucucccaguagagauugaguuugagccuguauaucuauuaaaaauuucaacuucccacauaua

SEQ ID NO: 275563 - RNA, 64 nt, hsa
uguuuuaugucaaacaauuaugcuuaauauacagucuauuaaauguaagucuuguuugagauau

SEQ ID NO: 275564 - RNA, 64 nt, hsa
uuuuccugauuugaaaguuuguuuuuaaaaguuuucuauuaauuauagugcacuauugaaucag

SEQ ID NO: 275565 - RNA, 64 nt, hsa
ugggaaugaaaauacuuaaauacuguaaagcauaucuauuaauaauucccccaauuuuuuaaac

SEQ ID NO: 275566 - RNA, 64 nt, hsa
uucuaaaacuauugaaaaauuaauauuucuauaaucuauuaaaaaaaauggagaauguuuucuc

SEQ ID NO: 275567 - RNA, 64 nt, hsa
uuaagaauguuuauuuaucaaagucuuuccuucuucuauuaaauauuuagcaauuaccuuucua

SEQ ID NO: 275568 - RNA, 64 nt, hsa
caagucaaaaaugaagauuuugcagcacugaaaaucuauuaaagcuccaaauuuuaaguuucua

SEQ ID NO: 275569 - RNA, 64 nt, hsa
cuguaguggucacuaaacccuuuuugagagaauuucuauuaaagaugaggcagacucgcuuauu

SEQ ID NO: 275570 - RNA, 64 nt, hsa
aagggucaguugggacauuaaccuaagaaacauaucuauuaagcacuuguuaacaccuuauuuu

SEQ ID NO: 275571 - RNA, 64 nt, hsa
uagcucagucaucaaagcagaagucuggcuuugcucuauuaagauuggaaauguacacuaccaa

SEQ ID NO: 275572 - RNA, 64 nt, hsa
aguuacuugugacaagaauaauuuuggaauaauuucuauuaauaucaacucugaagcuaauugu

SEQ ID NO: 275573 - RNA, 64 nt, hsa
auauugguacaacaugacuuaaaacuuuuuuuuuucuauuaaaacuuaaaggggaacaaaacuu

SEQ ID NO: 275574 - RNA, 64 nt, hsa
auaugcacaguaaauccaugucuuuguuuguuuuucuauuaaaaagcaaucaagaaagauaaug

SEQ ID NO: 275575 - RNA, 64 nt, hsa
ugaggguuucauuguguguuagcagcagugagcuucuauuaaauguauaugucauuuauuuugu

SEQ ID NO: 275576 - RNA, 64 nt, hsa
auucuuaugcaggguauugcgaaacaacuuguguucuauuaaucgugucuucaauuaaaagacc

SEQ ID NO: 275577 - RNA, 64 nt, hsa
uguugacucaacaagggcccgaggccuuagguuuucuauuaaggucucugccccaggcauggug

SEQ ID NO: 275578 - RNA, 64 nt, hsa
acguuuuuaaauuuaacaucuggcuggacaguguucuauuaacucauugaauguguuuccuuug

SEQ ID NO: 275579 - RNA, 64 nt, hsa
aagcauggaauuuaggguugggguacaauuuguuucuauuaagcaaguaccaguuuaccaauac

SEQ ID NO: 275580 - RNA, 64 nt, hsa
cuuuagaaugugaggcaaauuuuacauucuugguucuauuaagauuuucuuaggcaugcuaaca

SEQ ID NO: 275581 - RNA, 64 nt, hsa
aacacuggcuuaauucaagucaguugauuuuuuuucuauuaaaacuguuguuaaaauauuuuuu

SEQ ID NO: 275582 - RNA, 64 nt, hsa
ugaaacucugcuuccaccauguuccugacaccuaucuauuaaaccauucugcaaauacgguuuu

SEQ ID NO: 275583 - RNA, 64 nt, hsa
uuaguguguuaccccaaaugaacgguucuagcccucuauuaagaaauaaagggaccauaagcau

SEQ ID NO: 275584 - RNA, 64 nt, hsa
gagaccagccuggccaacauagugaaaccccgucucuauuaaaaauacaaaaauuagcugggug

SEQ ID NO: 275585 - RNA, 64 nt, hsa
aaccacuuuggggaauuaguaucaacuuacaauccaaguccaaguaucaucuuauaaucacuuu

SEQ ID NO: 275586 - RNA, 64 nt, hsa
uggucagagaaggcagguggucacugacauuucccaaguccaugcuuuaaaggguuugcaagaa

SEQ ID NO: 275587 - RNA, 64 nt, hsa
uguuuuaaacuuucuuagugcuggaguaaaaggucaaguccaacaccugccuuaaauuuaaauc

SEQ ID NO: 275588 - RNA, 64 nt, hsa
caucuacuaugaugaauacuucgacugugacauacaaguccauuaucugggaugcaaccacuca

SEQ ID NO: 275589 - RNA, 64 nt, hsa
cccaccagguccauccaggaggcucuccugaccucaaguccaacaacaguguccacacuaguca

SEQ ID NO: 275590 - RNA, 64 nt, hsa
uuucuugcagccagaaggcagagaaagugaagaccaaguccagaacugaauccuaagaaaugca

SEQ ID NO: 275591 - RNA, 64 nt, hsa
caagaucacguucucccaaguaccauucgucauccaaguccaggucuagaucacacucaaaagc

SEQ ID NO: 275592 - RNA, 64 nt, hsa
agaagaagaagaagaggcggucccggucgcggaccaaguccaaggccaggucucagucgguguc

SEQ ID NO: 275593 - RNA, 64 nt, hsa
ggcugagugggaugaccgcuugagcccaggauuucaaguccagccugggcuacauagugagacc

SEQ ID NO: 275594 - RNA, 64 nt, hsa
gcugugguuuauggcaucacucccuucuaaucagcaaguccaguggccacuuagagcccagcuc

SEQ ID NO: 275595 - RNA, 64 nt, hsa; identical to SEQ ID NO: 152055

SEQ ID NO: 275596 - RNA, 64 nt, hsa; identical to SEQ ID NO: 152056

SEQ ID NO: 275597 - RNA, 64 nt, hsa; identical to SEQ ID NO: 152057

SEQ ID NO: 275598 - RNA, 64 nt, hsa; identical to SEQ ID NO: 152058

SEQ ID NO: 275599 - RNA, 64 nt, hsa; identical to SEQ ID NO: 152059

SEQ ID NO: 275600 - RNA, 64 nt, hsa; identical to SEQ ID NO: 152060

SEQ ID NO: 275601 - RNA, 64 nt, hsa; identical to SEQ ID NO: 152061

SEQ ID NO: 275602 - RNA, 64 nt, hsa; identical to SEQ ID NO: 152062

SEQ ID NO: 275603 - RNA, 64 nt, hsa; identical to SEQ ID NO: 152063

SEQ ID NO: 275604 - RNA, 64 nt, hsa; identical to SEQ ID NO: 152064

SEQ ID NO: 275605 - RNA, 64 nt, hsa; identical to SEQ ID NO: 152065

SEQ ID NO: 275606 - RNA, 64 nt, hsa; identical to SEQ ID NO: 152066

SEQ ID NO: 275607 - RNA, 64 nt, hsa; identical to SEQ ID NO: 152067

SEQ ID NO: 275608 - RNA, 64 nt, hsa; identical to SEQ ID NO: 152068

SEQ ID NO: 275609 - RNA, 64 nt, hsa; identical to SEQ ID NO: 152069

SEQ ID NO: 275610 - RNA, 64 nt, hsa; identical to SEQ ID NO: 152070

SEQ ID NO: 275611 - RNA, 64 nt, hsa; identical to SEQ ID NO: 152071

SEQ ID NO: 275612 - RNA, 64 nt, hsa; identical to SEQ ID NO: 152072

SEQ ID NO: 275613 - RNA, 64 nt, hsa; identical to SEQ ID NO: 152073

SEQ ID NO: 275614 - RNA, 64 nt, hsa; identical to SEQ ID NO: 152074

SEQ ID NO: 275615 - RNA, 64 nt, hsa; identical to SEQ ID NO: 152075

SEQ ID NO: 275616 - RNA, 64 nt, hsa; identical to SEQ ID NO: 152076

SEQ ID NO: 275617 - RNA, 64 nt, hsa; identical to SEQ ID NO: 152077

SEQ ID NO: 275618 - RNA, 64 nt, hsa; identical to SEQ ID NO: 152078

SEQ ID NO: 275619 - RNA, 64 nt, hsa; identical to SEQ ID NO: 152079

SEQ ID NO: 275620 - RNA, 64 nt, hsa; identical to SEQ ID NO: 152080

SEQ ID NO: 275621 - RNA, 64 nt, hsa; identical to SEQ ID NO: 112922

SEQ ID NO: 275622 - RNA, 64 nt, hsa; identical to SEQ ID NO: 112923

SEQ ID NO: 275623 - RNA, 64 nt, hsa; identical to SEQ ID NO: 112924

SEQ ID NO: 275624 - RNA, 64 nt, hsa; identical to SEQ ID NO: 112925

SEQ ID NO: 275625 - RNA, 64 nt, hsa; identical to SEQ ID NO: 112926

SEQ ID NO: 275626 - RNA, 64 nt, hsa; identical to SEQ ID NO: 112927

SEQ ID NO: 275627 - RNA, 64 nt, hsa; identical to SEQ ID NO: 112928

SEQ ID NO: 275628 - RNA, 64 nt, hsa; identical to SEQ ID NO: 112929

SEQ ID NO: 275629 - RNA, 64 nt, hsa; identical to SEQ ID NO: 112930

SEQ ID NO: 275630 - RNA, 64 nt, hsa; identical to SEQ ID NO: 112931

SEQ ID NO: 275631 - RNA, 64 nt, hsa; identical to SEQ ID NO: 112932

SEQ ID NO: 275632 - RNA, 64 nt, hsa; identical to SEQ ID NO: 112933

SEQ ID NO: 275633 - RNA, 64 nt, hsa; identical to SEQ ID NO: 112934

SEQ ID NO: 275634 - RNA, 64 nt, hsa; identical to SEQ ID NO: 112935

SEQ ID NO: 275635 - RNA, 64 nt, hsa; identical to SEQ ID NO: 112936

SEQ ID NO: 275636 - RNA, 64 nt, hsa; identical to SEQ ID NO: 112937

SEQ ID NO: 275637 - RNA, 64 nt, hsa; identical to SEQ ID NO: 112938

SEQ ID NO: 275638 - RNA, 64 nt, hsa; identical to SEQ ID NO: 112939

SEQ ID NO: 275639 - RNA, 64 nt, hsa; identical to SEQ ID NO: 112940

SEQ ID NO: 275640 - RNA, 64 nt, hsa; identical to SEQ ID NO: 112941

SEQ ID NO: 275641 - RNA, 64 nt, hsa; identical to SEQ ID NO: 112942

SEQ ID NO: 275642 - RNA, 64 nt, hsa; identical to SEQ ID NO: 112943

SEQ ID NO: 275643 - RNA, 64 nt, hsa; identical to SEQ ID NO: 112944

SEQ ID NO: 275644 - RNA, 64 nt, hsa; identical to SEQ ID NO: 112945

SEQ ID NO: 275645 - RNA, 64 nt, hsa; identical to SEQ ID NO: 112946

SEQ ID NO: 275646 - RNA, 64 nt, hsa; identical to SEQ ID NO: 112947

SEQ ID NO: 275647 - RNA, 64 nt, hsa; identical to SEQ ID NO: 112948

SEQ ID NO: 275648 - RNA, 64 nt, hsa; identical to SEQ ID NO: 112949

SEQ ID NO: 275649 - RNA, 64 nt, hsa; identical to SEQ ID NO: 112950

SEQ ID NO: 275650 - RNA, 64 nt, hsa; identical to SEQ ID NO: 112951

SEQ ID NO: 275651 - RNA, 64 nt, hsa; identical to SEQ ID NO: 112952

SEQ ID NO: 275652 - RNA, 64 nt, hsa; identical to SEQ ID NO: 112953

SEQ ID NO: 275653 - RNA, 64 nt, hsa; identical to SEQ ID NO: 112954

SEQ ID NO: 275654 - RNA, 50 nt, hsa; identical to SEQ ID NO: 112955

SEQ ID NO: 275655 - RNA, 64 nt, hsa; identical to SEQ ID NO: 112956

SEQ ID NO: 275656 - RNA, 64 nt, hsa; identical to SEQ ID NO: 112957

SEQ ID NO: 275657 - RNA, 64 nt, hsa; identical to SEQ ID NO: 112958

SEQ ID NO: 275658 - RNA, 64 nt, hsa; identical to SEQ ID NO: 112959

SEQ ID NO: 275659 - RNA, 64 nt, hsa; identical to SEQ ID NO: 112960

SEQ ID NO: 275660 - RNA, 64 nt, hsa; identical to SEQ ID NO: 112961

SEQ ID NO: 275661 - RNA, 64 nt, hsa
ccaaagaagcauauugacccugcccaauggaagaaccaggaagauguggucauucauucaauag

SEQ ID NO: 275662 - RNA, 64 nt, hsa
cuccccauccccacaaaggcuguugaaccacagcaccaggaagccugagaaugaauccugaggg

SEQ ID NO: 275663 - RNA, 64 nt, hsa
cugccauaguucugccucuuugcuggggaaagaaaccaggaacguggaggguuauuacugcggg

SEQ ID NO: 275664 - RNA, 64 nt, hsa
gugaaugggugcccuacggggcccuccuucccccaccaggaacagauggaaccugccacccagg

SEQ ID NO: 275665 - RNA, 64 nt, hsa
uuuugagauacccugcuaucgauggucgcuacaaaccaggaaauacucaaguuauuauguguau

SEQ ID NO: 275666 - RNA, 64 nt, hsa
uucuguuguuuuaauuaguauuuguguaguucaaaccaggaaggauuugacuaucauuagauuu

SEQ ID NO: 275667 - RNA, 64 nt, hsa
caugauugacaacagucaagcuguggaugaaaugaccaggaacggagaaugaaguauguaaauc

SEQ ID NO: 275668 - RNA, 64 nt, hsa
uuaucuagugauuuccuaguaccggacuacuuaaaccaggaacaagaagagacccuuguucaau

SEQ ID NO: 275669 - RNA, 64 nt, hsa
gucacaacgacgaagugcugagaagguuauggguaccaggaagaaacaaacagaagucuuaaga

SEQ ID NO: 275670 - RNA, 64 nt, hsa
gaauauaaguagguguuggaugccuuuuuccuagaccaggaauggggaauauauaacaccugug

SEQ ID NO: 275671 - RNA, 64 nt, hsa
ccauuggagguagagacaggucucaacaguuggaaccaggaacucugcugucagguugagaguu

SEQ ID NO: 275672 - RNA, 64 nt, hsa
uacccagcuuaaucaacagaaugguuuaaguaguaccaggaaguaggacaaguaauuucaaaaa

SEQ ID NO: 275673 - RNA, 64 nt, hsa
uucgcuucucucaccaggaacauucgcuucucucaccaggaacauuuaugguaguaugaggggu

SEQ ID NO: 275674 - RNA, 64 nt, hsa
gcugagccaggagaugcacaccuucgcuucucucaccaggaacauucgcuucucucaccaggaa

SEQ ID NO: 275675 - RNA, 64 nt, hsa
agugcuuuuaagugaaaauggucgagaaagaggcaccaggaagccguccuggcgccuggcaguc

SEQ ID NO: 275676 - RNA, 64 nt, hsa
cagacuauuuuuagauuuucuuuugccuuuugcaaccaggaacagcaaaugcaaaaacucuuug

SEQ ID NO: 275677 - RNA, 64 nt, hsa; identical to SEQ ID NO: 82354

SEQ ID NO: 275678 - RNA, 64 nt, hsa; identical to SEQ ID NO: 82355

SEQ ID NO: 275679 - RNA, 64 nt, hsa; identical to SEQ ID NO: 82356

SEQ ID NO: 275680 - RNA, 64 nt, hsa; identical to SEQ ID NO: 82357

SEQ ID NO: 275681 - RNA, 64 nt, hsa; identical to SEQ ID NO: 82358

SEQ ID NO: 275682 - RNA, 64 nt, hsa; identical to SEQ ID NO: 82359

SEQ ID NO: 275683 - RNA, 64 nt, hsa; identical to SEQ ID NO: 82360

SEQ ID NO: 275684 - RNA, 64 nt, hsa; identical to SEQ ID NO: 82361

SEQ ID NO: 275685 - RNA, 64 nt, hsa; identical to SEQ ID NO: 82362

SEQ ID NO: 275686 - RNA, 64 nt, hsa; identical to SEQ ID NO: 82363

SEQ ID NO: 275687 - RNA, 64 nt, hsa; identical to SEQ ID NO: 82364

SEQ ID NO: 275688 - RNA, 64 nt, hsa; identical to SEQ ID NO: 82365

SEQ ID NO: 275689 - RNA, 64 nt, hsa; identical to SEQ ID NO: 82366

SEQ ID NO: 275690 - RNA, 64 nt, hsa; identical to SEQ ID NO: 82367

SEQ ID NO: 275691 - RNA, 64 nt, hsa; identical to SEQ ID NO: 82368

SEQ ID NO: 275692 - RNA, 64 nt, hsa; identical to SEQ ID NO: 82369

SEQ ID NO: 275693 - RNA, 64 nt, hsa; identical to SEQ ID NO: 82370

SEQ ID NO: 275694 - RNA, 64 nt, hsa; identical to SEQ ID NO: 82371

SEQ ID NO: 275695 - RNA, 64 nt, hsa; identical to SEQ ID NO: 82372

SEQ ID NO: 275696 - RNA, 64 nt, hsa; identical to SEQ ID NO: 82373

SEQ ID NO: 275697 - RNA, 64 nt, hsa; identical to SEQ ID NO: 82374

SEQ ID NO: 275698 - RNA, 64 nt, hsa; identical to SEQ ID NO: 82375

SEQ ID NO: 275699 - RNA, 64 nt, hsa; identical to SEQ ID NO: 82376

SEQ ID NO: 275700 - RNA, 64 nt, hsa; identical to SEQ ID NO: 82377

SEQ ID NO: 275701 - RNA, 64 nt, hsa; identical to SEQ ID NO: 82378

SEQ ID NO: 275702 - RNA, 64 nt, hsa; identical to SEQ ID NO: 82379

SEQ ID NO: 275703 - RNA, 64 nt, hsa; identical to SEQ ID NO: 82380

SEQ ID NO: 275704 - RNA, 64 nt, hsa; identical to SEQ ID NO: 82381

SEQ ID NO: 275705 - RNA, 64 nt, hsa; identical to SEQ ID NO: 82382

SEQ ID NO: 275706 - RNA, 64 nt, hsa; identical to SEQ ID NO: 82383

SEQ ID NO: 275707 - RNA, 64 nt, hsa; identical to SEQ ID NO: 82384

SEQ ID NO: 275708 - RNA, 64 nt, hsa; identical to SEQ ID NO: 82385

SEQ ID NO: 275709 - RNA, 64 nt, hsa; identical to SEQ ID NO: 82386

SEQ ID NO: 275710 - RNA, 64 nt, hsa; identical to SEQ ID NO: 82387

SEQ ID NO: 275711 - RNA, 64 nt, hsa; identical to SEQ ID NO: 82388

SEQ ID NO: 275712 - RNA, 64 nt, hsa; identical to SEQ ID NO: 161670

SEQ ID NO: 275713 - RNA, 64 nt, hsa; identical to SEQ ID NO: 161671

SEQ ID NO: 275714 - RNA, 64 nt, hsa; identical to SEQ ID NO: 161672

SEQ ID NO: 275715 - RNA, 64 nt, hsa; identical to SEQ ID NO: 161673

SEQ ID NO: 275716 - RNA, 64 nt, hsa; identical to SEQ ID NO: 161674

SEQ ID NO: 275717 - RNA, 64 nt, hsa; identical to SEQ ID NO: 161675

SEQ ID NO: 275718 - RNA, 64 nt, hsa; identical to SEQ ID NO: 161676

SEQ ID NO: 275719 - RNA, 64 nt, hsa; identical to SEQ ID NO: 161677

SEQ ID NO: 275720 - RNA, 64 nt, hsa; identical to SEQ ID NO: 161678

SEQ ID NO: 275721 - RNA, 64 nt, hsa; identical to SEQ ID NO: 161679

SEQ ID NO: 275722 - RNA, 64 nt, hsa; identical to SEQ ID NO: 161680

SEQ ID NO: 275723 - RNA, 64 nt, hsa; identical to SEQ ID NO: 161681

SEQ ID NO: 275724 - RNA, 64 nt, hsa; identical to SEQ ID NO: 161682

SEQ ID NO: 275725 - RNA, 64 nt, hsa; identical to SEQ ID NO: 161683

SEQ ID NO: 275726 - RNA, 64 nt, hsa; identical to SEQ ID NO: 161684

SEQ ID NO: 275727 - RNA, 64 nt, hsa; identical to SEQ ID NO: 161685

SEQ ID NO: 275728 - RNA, 64 nt, hsa; identical to SEQ ID NO: 161686

SEQ ID NO: 275729 - RNA, 64 nt, hsa; identical to SEQ ID NO: 161687

SEQ ID NO: 275730 - RNA, 64 nt, hsa; identical to SEQ ID NO: 161688

SEQ ID NO: 275731 - RNA, 64 nt, hsa; identical to SEQ ID NO: 161689

SEQ ID NO: 275732 - RNA, 64 nt, hsa; identical to SEQ ID NO: 161690

SEQ ID NO: 275733 - RNA, 64 nt, hsa; identical to SEQ ID NO: 161691

SEQ ID NO: 275734 - RNA, 64 nt, hsa; identical to SEQ ID NO: 161692

SEQ ID NO: 275735 - RNA, 64 nt, hsa; identical to SEQ ID NO: 161693

SEQ ID NO: 275736 - RNA, 64 nt, hsa; identical to SEQ ID NO: 161694

SEQ ID NO: 275737 - RNA, 64 nt, hsa; identical to SEQ ID NO: 161695

SEQ ID NO: 275738 - RNA, 64 nt, hsa; identical to SEQ ID NO: 161696

SEQ ID NO: 275739 - RNA, 64 nt, hsa; identical to SEQ ID NO: 161697

SEQ ID NO: 275740 - RNA, 64 nt, hsa; identical to SEQ ID NO: 161698

SEQ ID NO: 275741 - RNA, 64 nt, hsa; identical to SEQ ID NO: 161699

SEQ ID NO: 275742 - RNA, 64 nt, hsa; identical to SEQ ID NO: 161700

SEQ ID NO: 275743 - RNA, 64 nt, hsa; identical to SEQ ID NO: 161701

SEQ ID NO: 275744 - RNA, 64 nt, hsa; identical to SEQ ID NO: 161702

SEQ ID NO: 275745 - RNA, 64 nt, hsa; identical to SEQ ID NO: 161703

SEQ ID NO: 275746 - RNA, 64 nt, hsa; identical to SEQ ID NO: 161704

SEQ ID NO: 275747 - RNA, 64 nt, hsa; identical to SEQ ID NO: 161705

SEQ ID NO: 275748 - RNA, 64 nt, hsa; identical to SEQ ID NO: 161706

SEQ ID NO: 275749 - RNA, 64 nt, hsa; identical to SEQ ID NO: 161707

SEQ ID NO: 275750 - RNA, 64 nt, hsa; identical to SEQ ID NO: 161708

SEQ ID NO: 275751 - RNA, 64 nt, hsa; identical to SEQ ID NO: 161709

SEQ ID NO: 275752 - RNA, 64 nt, hsa; identical to SEQ ID NO: 52870

SEQ ID NO: 275753 - RNA, 64 nt, hsa; identical to SEQ ID NO: 52871

SEQ ID NO: 275754 - RNA, 64 nt, hsa; identical to SEQ ID NO: 52872

SEQ ID NO: 275755 - RNA, 64 nt, hsa; identical to SEQ ID NO: 52873

SEQ ID NO: 275756 - RNA, 64 nt, hsa; identical to SEQ ID NO: 52874

SEQ ID NO: 275757 - RNA, 64 nt, hsa
uauuauuuuugggggacucuucuucaaagagcuugccaaugaagauuuaaagacagagcaggag

SEQ ID NO: 275758 - RNA, 64 nt, hsa
ggagagacugugguauauauuuuaaaccuguugggccaaugagaaaagaaccacacuggagauc

SEQ ID NO: 275759 - RNA, 64 nt, hsa
ggcaaccauagagaucgagcuucaggacagagcagccaaugaaaacggccgccugaacccacag

SEQ ID NO: 275760 - RNA, 64 nt, hsa
gcagccaauggguacugagcuggcugagccuauggccaaugaguauuccugcuaugcucagggc

SEQ ID NO: 275761 - RNA, 60 nt, hsa
caagauuaauauuugauucucuaucucuuaacuguagauuuuauuggccuguuuuuuuuu

SEQ ID NO: 275762 - RNA, 60 nt, hsa
ugggcggugaggguauugauuuacauaaaaacuguagacaaacacaguacgagucucagc

SEQ ID NO: 275763 - RNA, 60 nt, hsa
aaucauugagauagaaaaagauucccauugacuguagacuucuucccauuuugucuuccc

SEQ ID NO: 275764 - RNA, 60 nt, hsa
uguuacagagaagcagccgauagcaaaucgacuguagagacuuggcggcgguggcauugc

SEQ ID NO: 275765 - RNA, 60 nt, hsa
cuguuugaaggcuuacuguagaaguggcuuacuguagaagcagcuugcugagccccuccg

SEQ ID NO: 275766 - RNA, 60 nt, hsa
uuuuaugcuuuauuuccuguuugaaggcuuacuguagaaguggcuuacuguagaagcagc

SEQ ID NO: 275767 - RNA, 60 nt, hsa
uauggcauguacuuuacacuauuuauaaugacuguagauacuugaauguucuacuugcua

SEQ ID NO: 275768 - RNA, 60 nt, hsa
cucauuuucccauguuuauacucuucccacacuguagauauggcauguacuuuacacuau

SEQ ID NO: 275769 - RNA, 60 nt, hsa
gaguuucggguguuuuucuccagucuuguuacuguagacuguagaaagcacgggccccag

SEQ ID NO: 275770 - RNA, 60 nt, hsa
ggguguuuuucuccagucuuguuacuguagacuguagaaagcacgggccccaggcucuga

SEQ ID NO: 275771 - RNA, 60 nt, hsa
cgccugcaggcgguguagauacauguagauacuguagauacuguagauaccgccccggcg

SEQ ID NO: 275772 - RNA, 60 nt, hsa
gcgguguagauacauguagauacuguagauacuguagauaccgccccggcgccgacuuga

SEQ ID NO: 275773 - RNA, 64 nt, hsa
uggcauuuggucucaggcagcaccacacugggugcgucuccagucaucuguaagagcuugcucc

SEQ ID NO: 275774 - RNA, 64 nt, hsa
gaagagcacacaugagggcaaggcugcuggcagacgucuccauuguccuuauguugucuguguu

SEQ ID NO: 275775 - RNA, 64 nt, hsa
cucugacaagauugcuuuggaaagagcugcuuuuagggauuauuuuuugaauaccccgaguggg

SEQ ID NO: 275776 - RNA, 64 nt, hsa
uccgugggccuguuucccaaucugcaaagugugaagggauuagaugggauggucucugaggcuc

SEQ ID NO: 275777 - RNA, 64 nt, hsa
cacuaauuaaaucugaauuuuggggauguuguauagggauuaguauuuuuuuuaaucuagguga

SEQ ID NO: 275778 - RNA, 64 nt, hsa
uuauuuacuugaauuuugaaaacugagcuguguuagggauuaaacuauaauucuguucuuaaaa

SEQ ID NO: 275779 - RNA, 64 nt, hsa
gcugucugugaccauuuccauggcagcaggaugcagggauuaauaaggacacauacacauuauu

SEQ ID NO: 275780 - RNA, 64 nt, hsa
uuaaccuaagcccuuaugaaaauaaacaaaaugaagggauuaugacagguauuaccaaaaacac

SEQ ID NO: 275781 - RNA, 64 nt, hsa
aaaaacguauaaaauaaugcccugaaagaauaauagggauuauaccugucuguucuuaaagauu

SEQ ID NO: 275782 - RNA, 64 nt, hsa
aauaucugauauuuuccugguacucguacugauaagggauuauuggaagucagucacagaauuu

SEQ ID NO: 275783 - RNA, 64 nt, hsa
aaauaguuaauggaugugugcacauuuucuguucagggauuaagaccagaauaucaguggauuu

SEQ ID NO: 275784 - RNA, 64 nt, hsa
cgucaucugcauuguuauuggagccuguacuuagagggauuaagcccacacccuggcuuccauu

SEQ ID NO: 275785 - RNA, 64 nt, hsa; identical to SEQ ID NO: 236284

SEQ ID NO: 275786 - RNA, 64 nt, hsa; identical to SEQ ID NO: 236285

SEQ ID NO: 275787 - RNA, 64 nt, hsa; identical to SEQ ID NO: 236286

SEQ ID NO: 275788 - RNA, 64 nt, hsa; identical to SEQ ID NO: 236287

SEQ ID NO: 275789 - RNA, 64 nt, hsa; identical to SEQ ID NO: 236288

SEQ ID NO: 275790 - RNA, 64 nt, hsa; identical to SEQ ID NO: 236289

SEQ ID NO: 275791 - RNA, 64 nt, hsa
acccaggcacagccaccacuuugcaagugggaggaggggagaaggggagacaaaaccacugcag

SEQ ID NO: 275792 - RNA, 64 nt, hsa
acagccaccacuuugcaagugggaggaggggagaaggggagacaaaaccacugcagaccuacca

SEQ ID NO: 275793 - RNA, 64 nt, hsa
aaaaggggagauuucgguaggcacagguguaaaaaggggagauuucagaagacgggcgaaacaa

SEQ ID NO: 275794 - RNA, 64 nt, hsa
gaauaucagcagaguaguaggcacaguuguaaaaaggggagauuucgguaggcacagguguaaa

SEQ ID NO: 275795 - RNA, 64 nt, hsa
gccccaggccucccucccccggggucuccaccucaggggagacuuaggccagaggugaacauuc

SEQ ID NO: 275796 - RNA, 64 nt, hsa
gccagcccagauggcucccugggcuggcauggggaggggagagaagguggucugcaccccacag

SEQ ID NO: 275797 - RNA, 64 nt, hsa
cuggguaaggcucaucuuuaaaaacuggcuucagaggggagaggggagaacaaugaauuggcuc

SEQ ID NO: 275798 - RNA, 64 nt, hsa
aggcucaucuuuaaaaacuggcuucagaggggagaggggagaacaaugaauuggcucuauuuuc

SEQ ID NO: 275799 - RNA, 64 nt, hsa
ucacuggacacgucuccucgcagcugcccuagcaaggggagacauugugguagcuaucagacau

SEQ ID NO: 275800 - RNA, 64 nt, hsa
ucacacguggccuugucuagacccaguccugagcaggggagaggcucuugagaccugaugcccu

SEQ ID NO: 275801 - RNA, 64 nt, hsa
cuuacuaaugcugcccucacugccucuuugcaguaggggagagagcagagaaguacaggucauc

SEQ ID NO: 275802 - RNA, 64 nt, hsa
ggcaaacugaggcagcaugcacggaggcggggucaggggagacgaggccaagcugaggaggugc

SEQ ID NO: 275803 - RNA, 64 nt, hsa
uguguugauggguggcccaugagugacccccgccaggggagaccaggcuggcuggauccagcac

SEQ ID NO: 275804 - RNA, 64 nt, hsa
aauccauuugccccgcaacccuggcugcuccgacaggggagacuugucucccuuguuccccuca

SEQ ID NO: 275805 - RNA, 64 nt, hsa
cccuggccacagccuucccucugcauugaccuggaggggagaggucagccuugaccuaaugagg

SEQ ID NO: 275806 - RNA, 64 nt, hsa
ggccaggggccaggaguggggagaguugugauggaggggagaggggucacacccacccccugcc

SEQ ID NO: 275807 - RNA, 64 nt, hsa
cauuuucauucuguuaucucaggugagcugguagaggggagacauuagaaaaaaaugaaacaac

SEQ ID NO: 275808 - RNA, 64 nt, hsa
aggucauuuuuuuugcuucuggcuaccuguuugaaggggagagagggaaaaucaagugguauuu

SEQ ID NO: 275809 - RNA, 64 nt, hsa
gcugcccucaaguccaggccuugaggcccaccugaggggagauacugcccuucucucugccugc

SEQ ID NO: 275810 - RNA, 64 nt, hsa
accccagccuccucagaacaggggugaccacugcaggggagacugccccuaaccugugucuuug

SEQ ID NO: 275811 - RNA, 64 nt, hsa
ggucgucgagaggcugcgggcuggcggcagucccaggggagagacaccacagaaggagacccag

SEQ ID NO: 275812 - RNA, 64 nt, hsa
uuccgcacucugagaccaugaucuuccuccugccaggggagagccacccacaggccauguccag

SEQ ID NO: 275813 - RNA, 64 nt, hsa
uuugucacagccuugcccacaaacccugccucugaggggagacugaggaagggcagagccagaa

SEQ ID NO: 275814 - RNA, 64 nt, hsa
cgccugccuguccugugcccaccacgcagcagucaggggagaaaaugguggcuaucccuucugc

SEQ ID NO: 275815 - RNA, 64 nt, hsa
uuacucuucccauuccucagaccagcaggaaaagaggggagacgucagucuuuuuccugugguu

SEQ ID NO: 275816 - RNA, 64 nt, hsa
gguagaggggauaccuggguucuaaccucuaaauaggggagaucccagccuccacaaagaggcc

SEQ ID NO: 275817 - RNA, 64 nt, hsa
ggggccaggcagcugggggccuuuggggaccagaaggggagaugugcucccagagccucucugc

SEQ ID NO: 275818 - RNA, 64 nt, hsa
agagucaggccacccacugggcucggcaggagauaggggagagcaauuacuuuguucacuguau

SEQ ID NO: 275819 - RNA, 64 nt, hsa
auucagcaaguuauuaaaucugacaugguaggagaggggagauguguccugcuuauuaaaugug

SEQ ID NO: 275820 - RNA, 64 nt, hsa
gcaagggagccaguacugaauuaugccuuggcagaggggagacuccaaaagagucaucgcagga

SEQ ID NO: 275821 - RNA, 64 nt, hsa
gcgaggagcauagacaguguggagacauugggcaaggggagaauucacauccugggugggacag

SEQ ID NO: 275822 - RNA, 64 nt, hsa
aucaaacacacacaggauaccagcaauggauggcaggggagaguguuccuuuuguucuuaacua

SEQ ID NO: 275823 - RNA, 64 nt, hsa
gaagucaguccuccucauucaccagaggacacacaggggagacgccccagucugcaggaaggau

SEQ ID NO: 275824 - RNA, 64 nt, hsa
agucagaccuccucagucaccagaggacacacacaggggagaagccuuaugucugcagagagug

SEQ ID NO: 275825 - RNA, 64 nt, hsa
agaacgcauuugagauuuuaagaugucacuuauaaggggagaaguguucuuaaaaagucaacca

SEQ ID NO: 275826 - RNA, 64 nt, hsa
acauauguaaaaaaaaaaaaaaaaagauuauuuuaggggagauguagguguagaauuauugcuu

SEQ ID NO: 275827 - RNA, 64 nt, hsa
ggagaggaggggagagagaaagagagguggggagaggggagagagauaugaggagagagagaca

SEQ ID NO: 275828 - RNA, 64 nt, hsa
gggagggaaaggaggagggagagagauggagaggaggggagagagaaagagagguggggagagg

SEQ ID NO: 275829 - RNA, 64 nt, hsa
ggcuaauauuagggacuggggaggggaccaccagaggggagagggaagcugcuuacuuuggggg

SEQ ID NO: 275830 - RNA, 64 nt, hsa
caggccucagcaucucacauccaccaccuccaggaggggagaccacugguaaguccuccuccug

SEQ ID NO: 275831 - RNA, 64 nt, hsa
ugucagacaggcugggggccucacucuguuuuccaggggagaaaccugagucucagagcagggg

SEQ ID NO: 275832 - RNA, 64 nt, hsa
augcucagacauggaggucagagccacaagggaaaggggagagggggagaaaacuguacucugu

SEQ ID NO: 275833 - RNA, 64 nt, hsa
cuauuuuguguuuagggaagggaaaauggaggaaaggggagaagagcaaagggcgcuuuuaaag

SEQ ID NO: 275834 - RNA, 64 nt, hsa
ccuaauaacaaagggguucugacacuaagacauuaggggagaauguuggguaggcagccagcac

SEQ ID NO: 275835 - RNA, 64 nt, hsa
ugaggagugacuucucccucucuuccaguccuguaggggagacaaaaccagauuggggggccca

SEQ ID NO: 275836 - RNA, 64 nt, hsa
aauuauuuuauuuaaaaaaauaccgagcagcaaaaggggagaagaucccacuacucucccacca

SEQ ID NO: 275837 - RNA, 64 nt, hsa
uggggacgauauggggagggagaugggaggggaaaggggagaggguuuuucucacugugccaau

SEQ ID NO: 275838 - RNA, 64 nt, hsa
cuggaauuagcuuggggccagggaagggacugggaggggagagaagagaaggagggaaggauuu

SEQ ID NO: 275839 - RNA, 64 nt, hsa
ccaugaccugcagccaagcccagccccguggggaaggggagaaagugggggauggcuaagaaag

SEQ ID NO: 275840 - RNA, 64 nt, hsa
uccuuccagggcuuuuccuuugggggaggcggagaggggagaagaaggaagggaagggcagaag

SEQ ID NO: 275841 - RNA, 63 nt, hsa
guauuaccucugugcucagugccaggcaaaacacuagcucaaaggagagucaaggaaaccgcu

SEQ ID NO: 275842 - RNA, 63 nt, hsa
ugucagguuuuugguuuuauuauuauuucagaacuagcucagcccaucucuaauuauaaaaca

SEQ ID NO: 275843 - RNA, 63 nt, hsa
gggauuguaaauacaccgaugggcacucuguaucuagcucaagguuuguaaacacaccaauca

SEQ ID NO: 275844 - RNA, 63 nt, hsa
agguuuguaaacacaccaaucagcacccugugucuagcucaguguuugugaaugcaccaaucc

SEQ ID NO: 275845 - RNA, 63 nt, hsa
cuaaucuaguggggauguggagaaccuuugugucuagcucagggaucguaaacgcaccaauca

SEQ ID NO: 275846 - RNA, 64 nt, hsa; identical to SEQ ID NO: 58312

SEQ ID NO: 275847 - RNA, 64 nt, hsa; identical to SEQ ID NO: 58313

SEQ ID NO: 275848 - RNA, 64 nt, hsa; identical to SEQ ID NO: 58314

SEQ ID NO: 275849 - RNA, 64 nt, hsa; identical to SEQ ID NO: 58315

SEQ ID NO: 275850 - RNA, 64 nt, hsa; identical to SEQ ID NO: 58316

SEQ ID NO: 275851 - RNA, 64 nt, hsa; identical to SEQ ID NO: 58317

SEQ ID NO: 275852 - RNA, 64 nt, hsa; identical to SEQ ID NO: 58318

SEQ ID NO: 275853 - RNA, 64 nt, hsa; identical to SEQ ID NO: 58319

SEQ ID NO: 275854 - RNA, 64 nt, hsa; identical to SEQ ID NO: 58320

SEQ ID NO: 275855 - RNA, 64 nt, hsa; identical to SEQ ID NO: 58321

SEQ ID NO: 275856 - RNA, 64 nt, hsa; identical to SEQ ID NO: 58322

SEQ ID NO: 275857 - RNA, 64 nt, hsa; identical to SEQ ID NO: 58323

SEQ ID NO: 275858 - RNA, 64 nt, hsa; identical to SEQ ID NO: 58324

SEQ ID NO: 275859 - RNA, 64 nt, hsa; identical to SEQ ID NO: 58325

SEQ ID NO: 275860 - RNA, 64 nt, hsa; identical to SEQ ID NO: 58326

SEQ ID NO: 275861 - RNA, 64 nt, hsa; identical to SEQ ID NO: 58327

SEQ ID NO: 275862 - RNA, 64 nt, hsa; identical to SEQ ID NO: 58328

SEQ ID NO: 275863 - RNA, 64 nt, hsa; identical to SEQ ID NO: 58329

SEQ ID NO: 275864 - RNA, 64 nt, hsa; identical to SEQ ID NO: 58330

SEQ ID NO: 275865 - RNA, 64 nt, hsa; identical to SEQ ID NO: 58331

SEQ ID NO: 275866 - RNA, 64 nt, hsa; identical to SEQ ID NO: 58332

SEQ ID NO: 275867 - RNA, 64 nt, hsa; identical to SEQ ID NO: 58333

SEQ ID NO: 275868 - RNA, 64 nt, hsa; identical to SEQ ID NO: 58334

SEQ ID NO: 275869 - RNA, 64 nt, hsa; identical to SEQ ID NO: 58335

SEQ ID NO: 275870 - RNA, 64 nt, hsa; identical to SEQ ID NO: 58336

SEQ ID NO: 275871 - RNA, 64 nt, hsa; identical to SEQ ID NO: 58337

SEQ ID NO: 275872 - RNA, 64 nt, hsa; identical to SEQ ID NO: 58338

SEQ ID NO: 275873 - RNA, 64 nt, hsa; identical to SEQ ID NO: 58339

SEQ ID NO: 275874 - RNA, 64 nt, hsa; identical to SEQ ID NO: 58340

SEQ ID NO: 275875 - RNA, 64 nt, hsa; identical to SEQ ID NO: 58341

SEQ ID NO: 275876 - RNA, 64 nt, hsa; identical to SEQ ID NO: 58342

SEQ ID NO: 275877 - RNA, 64 nt, hsa; identical to SEQ ID NO: 58343

SEQ ID NO: 275878 - RNA, 64 nt, hsa; identical to SEQ ID NO: 58344

SEQ ID NO: 275879 - RNA, 64 nt, hsa; identical to SEQ ID NO: 58345

SEQ ID NO: 275880 - RNA, 64 nt, hsa; identical to SEQ ID NO: 58346

SEQ ID NO: 275881 - RNA, 64 nt, hsa; identical to SEQ ID NO: 58347

SEQ ID NO: 275882 - RNA, 64 nt, hsa; identical to SEQ ID NO: 58348

SEQ ID NO: 275883 - RNA, 64 nt, hsa; identical to SEQ ID NO: 58349

SEQ ID NO: 275884 - RNA, 64 nt, hsa; identical to SEQ ID NO: 58350

SEQ ID NO: 275885 - RNA, 64 nt, hsa; identical to SEQ ID NO: 58351

SEQ ID NO: 275886 - RNA, 64 nt, hsa; identical to SEQ ID NO: 58352

SEQ ID NO: 275887 - RNA, 64 nt, hsa; identical to SEQ ID NO: 58353

SEQ ID NO: 275888 - RNA, 64 nt, hsa; identical to SEQ ID NO: 58354

SEQ ID NO: 275889 - RNA, 64 nt, hsa; identical to SEQ ID NO: 58355

SEQ ID NO: 275890 - RNA, 64 nt, hsa; identical to SEQ ID NO: 58356

SEQ ID NO: 275891 - RNA, 64 nt, hsa; identical to SEQ ID NO: 58357

SEQ ID NO: 275892 - RNA, 64 nt, hsa; identical to SEQ ID NO: 58358

SEQ ID NO: 275893 - RNA, 64 nt, hsa; identical to SEQ ID NO: 58359

SEQ ID NO: 275894 - RNA, 64 nt, hsa; identical to SEQ ID NO: 58360

SEQ ID NO: 275895 - RNA, 64 nt, hsa; identical to SEQ ID NO: 58361

SEQ ID NO: 275896 - RNA, 64 nt, hsa; identical to SEQ ID NO: 58362

SEQ ID NO: 275897 - RNA, 64 nt, hsa; identical to SEQ ID NO: 58363

SEQ ID NO: 275898 - RNA, 64 nt, hsa; identical to SEQ ID NO: 58364

SEQ ID NO: 275899 - RNA, 64 nt, hsa; identical to SEQ ID NO: 58365

SEQ ID NO: 275900 - RNA, 64 nt, hsa; identical to SEQ ID NO: 58366

SEQ ID NO: 275901 - RNA, 64 nt, hsa; identical to SEQ ID NO: 58367

SEQ ID NO: 275902 - RNA, 64 nt, hsa; identical to SEQ ID NO: 58368

SEQ ID NO: 275903 - RNA, 64 nt, hsa; identical to SEQ ID NO: 58369

SEQ ID NO: 275904 - RNA, 64 nt, hsa; identical to SEQ ID NO: 58370

SEQ ID NO: 275905 - RNA, 64 nt, hsa; identical to SEQ ID NO: 58371

SEQ ID NO: 275906 - RNA, 64 nt, hsa; identical to SEQ ID NO: 58372

SEQ ID NO: 275907 - RNA, 64 nt, hsa; identical to SEQ ID NO: 58373

SEQ ID NO: 275908 - RNA, 64 nt, hsa; identical to SEQ ID NO: 58374

SEQ ID NO: 275909 - RNA, 64 nt, hsa; identical to SEQ ID NO: 58375

SEQ ID NO: 275910 - RNA, 64 nt, hsa; identical to SEQ ID NO: 58376

SEQ ID NO: 275911 - RNA, 64 nt, hsa; identical to SEQ ID NO: 58377

SEQ ID NO: 275912 - RNA, 64 nt, hsa; identical to SEQ ID NO: 58378

SEQ ID NO: 275913 - RNA, 64 nt, hsa; identical to SEQ ID NO: 58379

SEQ ID NO: 275914 - RNA, 64 nt, hsa; identical to SEQ ID NO: 58380

SEQ ID NO: 275915 - RNA, 64 nt, hsa; identical to SEQ ID NO: 58381

SEQ ID NO: 275916 - RNA, 64 nt, hsa; identical to SEQ ID NO: 58382

SEQ ID NO: 275917 - RNA, 64 nt, hsa; identical to SEQ ID NO: 58383

SEQ ID NO: 275918 - RNA, 64 nt, hsa; identical to SEQ ID NO: 58384

SEQ ID NO: 275919 - RNA, 64 nt, hsa; identical to SEQ ID NO: 58385

SEQ ID NO: 275920 - RNA, 64 nt, hsa; identical to SEQ ID NO: 58386

SEQ ID NO: 275921 - RNA, 64 nt, hsa; identical to SEQ ID NO: 58387

SEQ ID NO: 275922 - RNA, 64 nt, hsa; identical to SEQ ID NO: 58388

SEQ ID NO: 275923 - RNA, 64 nt, hsa; identical to SEQ ID NO: 58389

SEQ ID NO: 275924 - RNA, 64 nt, hsa; identical to SEQ ID NO: 58390

SEQ ID NO: 275925 - RNA, 64 nt, hsa; identical to SEQ ID NO: 58391

SEQ ID NO: 275926 - RNA, 64 nt, hsa; identical to SEQ ID NO: 58392

SEQ ID NO: 275927 - RNA, 64 nt, hsa; identical to SEQ ID NO: 58393

SEQ ID NO: 275928 - RNA, 64 nt, hsa; identical to SEQ ID NO: 58394

SEQ ID NO: 275929 - RNA, 64 nt, hsa; identical to SEQ ID NO: 58395

SEQ ID NO: 275930 - RNA, 64 nt, hsa; identical to SEQ ID NO: 58396

SEQ ID NO: 275931 - RNA, 64 nt, hsa; identical to SEQ ID NO: 58397

SEQ ID NO: 275932 - RNA, 64 nt, hsa; identical to SEQ ID NO: 58398

SEQ ID NO: 275933 - RNA, 64 nt, hsa; identical to SEQ ID NO: 58399

SEQ ID NO: 275934 - RNA, 64 nt, hsa; identical to SEQ ID NO: 58400

SEQ ID NO: 275935 - RNA, 64 nt, hsa; identical to SEQ ID NO: 58401

SEQ ID NO: 275936 - RNA, 64 nt, hsa; identical to SEQ ID NO: 58402

SEQ ID NO: 275937 - RNA, 64 nt, hsa; identical to SEQ ID NO: 58403

SEQ ID NO: 275938 - RNA, 64 nt, hsa; identical to SEQ ID NO: 58404

SEQ ID NO: 275939 - RNA, 64 nt, hsa; identical to SEQ ID NO: 58405

SEQ ID NO: 275940 - RNA, 64 nt, hsa; identical to SEQ ID NO: 58406

SEQ ID NO: 275941 - RNA, 64 nt, hsa; identical to SEQ ID NO: 58407

SEQ ID NO: 275942 - RNA, 64 nt, hsa; identical to SEQ ID NO: 58408

SEQ ID NO: 275943 - RNA, 64 nt, hsa; identical to SEQ ID NO: 58409

SEQ ID NO: 275944 - RNA, 64 nt, hsa; identical to SEQ ID NO: 58410

SEQ ID NO: 275945 - RNA, 64 nt, hsa; identical to SEQ ID NO: 58411

SEQ ID NO: 275946 - RNA, 64 nt, hsa; identical to SEQ ID NO: 58412

SEQ ID NO: 275947 - RNA, 64 nt, hsa; identical to SEQ ID NO: 58413

SEQ ID NO: 275948 - RNA, 64 nt, hsa; identical to SEQ ID NO: 58414

SEQ ID NO: 275949 - RNA, 64 nt, hsa; identical to SEQ ID NO: 58415

SEQ ID NO: 275950 - RNA, 64 nt, hsa; identical to SEQ ID NO: 58416

SEQ ID NO: 275951 - RNA, 64 nt, hsa; identical to SEQ ID NO: 58417

SEQ ID NO: 275952 - RNA, 64 nt, hsa; identical to SEQ ID NO: 58418

SEQ ID NO: 275953 - RNA, 64 nt, hsa; identical to SEQ ID NO: 58419

SEQ ID NO: 275954 - RNA, 64 nt, hsa; identical to SEQ ID NO: 58420

SEQ ID NO: 275955 - RNA, 64 nt, hsa; identical to SEQ ID NO: 58421

SEQ ID NO: 275956 - RNA, 64 nt, hsa; identical to SEQ ID NO: 58422

SEQ ID NO: 275957 - RNA, 64 nt, hsa; identical to SEQ ID NO: 58423

SEQ ID NO: 275958 - RNA, 64 nt, hsa; identical to SEQ ID NO: 58424

SEQ ID NO: 275959 - RNA, 64 nt, hsa; identical to SEQ ID NO: 58425

SEQ ID NO: 275960 - RNA, 64 nt, hsa; identical to SEQ ID NO: 58426

SEQ ID NO: 275961 - RNA, 64 nt, hsa; identical to SEQ ID NO: 58427

SEQ ID NO: 275962 - RNA, 64 nt, hsa; identical to SEQ ID NO: 58428

SEQ ID NO: 275963 - RNA, 64 nt, hsa; identical to SEQ ID NO: 58429

SEQ ID NO: 275964 - RNA, 64 nt, hsa; identical to SEQ ID NO: 58430

SEQ ID NO: 275965 - RNA, 64 nt, hsa; identical to SEQ ID NO: 58431

SEQ ID NO: 275966 - RNA, 64 nt, hsa; identical to SEQ ID NO: 58432

SEQ ID NO: 275967 - RNA, 64 nt, hsa; identical to SEQ ID NO: 58433

SEQ ID NO: 275968 - RNA, 64 nt, hsa; identical to SEQ ID NO: 58434

SEQ ID NO: 275969 - RNA, 64 nt, hsa; identical to SEQ ID NO: 58435

SEQ ID NO: 275970 - RNA, 50 nt, hsa; identical to SEQ ID NO: 58436

SEQ ID NO: 275971 - RNA, 64 nt, hsa; identical to SEQ ID NO: 58437

SEQ ID NO: 275972 - RNA, 64 nt, hsa; identical to SEQ ID NO: 58438

SEQ ID NO: 275973 - RNA, 64 nt, hsa; identical to SEQ ID NO: 58439

SEQ ID NO: 275974 - RNA, 64 nt, hsa; identical to SEQ ID NO: 58440

SEQ ID NO: 275975 - RNA, 64 nt, hsa; identical to SEQ ID NO: 58441

SEQ ID NO: 275976 - RNA, 64 nt, hsa; identical to SEQ ID NO: 58442

SEQ ID NO: 275977 - RNA, 64 nt, hsa; identical to SEQ ID NO: 58443

SEQ ID NO: 275978 - RNA, 64 nt, hsa; identical to SEQ ID NO: 58444

SEQ ID NO: 275979 - RNA, 64 nt, hsa; identical to SEQ ID NO: 58445

SEQ ID NO: 275980 - RNA, 64 nt, hsa; identical to SEQ ID NO: 58446

SEQ ID NO: 275981 - RNA, 64 nt, hsa; identical to SEQ ID NO: 58447

SEQ ID NO: 275982 - RNA, 64 nt, hsa; identical to SEQ ID NO: 58448

SEQ ID NO: 275983 - RNA, 64 nt, hsa; identical to SEQ ID NO: 58449

SEQ ID NO: 275984 - RNA, 64 nt, hsa; identical to SEQ ID NO: 58450

SEQ ID NO: 275985 - RNA, 64 nt, hsa; identical to SEQ ID NO: 58451

SEQ ID NO: 275986 - RNA, 64 nt, hsa; identical to SEQ ID NO: 58452

SEQ ID NO: 275987 - RNA, 64 nt, hsa; identical to SEQ ID NO: 58453

SEQ ID NO: 275988 - RNA, 64 nt, hsa; identical to SEQ ID NO: 58454

SEQ ID NO: 275989 - RNA, 64 nt, hsa; identical to SEQ ID NO: 58455

SEQ ID NO: 275990 - RNA, 64 nt, hsa; identical to SEQ ID NO: 58456

SEQ ID NO: 275991 - RNA, 64 nt, hsa; identical to SEQ ID NO: 58457

SEQ ID NO: 275992 - RNA, 64 nt, hsa; identical to SEQ ID NO: 58458

SEQ ID NO: 275993 - RNA, 64 nt, hsa; identical to SEQ ID NO: 58459

SEQ ID NO: 275994 - RNA, 64 nt, hsa; identical to SEQ ID NO: 58460

SEQ ID NO: 275995 - RNA, 64 nt, hsa; identical to SEQ ID NO: 58461

SEQ ID NO: 275996 - RNA, 64 nt, hsa; identical to SEQ ID NO: 58462

SEQ ID NO: 275997 - RNA, 64 nt, hsa; identical to SEQ ID NO: 58463

SEQ ID NO: 275998 - RNA, 64 nt, hsa; identical to SEQ ID NO: 58464

SEQ ID NO: 275999 - RNA, 64 nt, hsa; identical to SEQ ID NO: 58465

SEQ ID NO: 276000 - RNA, 64 nt, hsa; identical to SEQ ID NO: 58466

SEQ ID NO: 276001 - RNA, 64 nt, hsa; identical to SEQ ID NO: 58467

SEQ ID NO: 276002 - RNA, 62 nt, hsa
gacggcaggcucacugccaggccagccuccgagagggagagagagagagagaggacagcuug

SEQ ID NO: 276003 - RNA, 62 nt, hsa
cuggagguugaagccaaguggggugcugggaggagggagagggaggucacuggaaaggggag

SEQ ID NO: 276004 - RNA, 62 nt, hsa
cucacaagcaacccugagagagacagucuugugagggagaucugggggaggcaggaagcucc

SEQ ID NO: 276005 - RNA, 62 nt, hsa
uauaugagacaugaagcauuggcucagaaguagagggagaagaggaacccaguucccuugac

SEQ ID NO: 276006 - RNA, 62 nt, hsa
cauuugaggggccaggggcaggcagggcugcagagggagacggcccugcuggggcuuaggaa

SEQ ID NO: 276007 - RNA, 62 nt, hsa
ugugccauggccccccacucccccuucccuuggagggagagguggcaggaauacuucaccuu

SEQ ID NO: 276008 - RNA, 62 nt, hsa
uuggauucugaggguggggagggagagagagggagggagagggagugaagagccugcccucc

SEQ ID NO: 276009 - RNA, 62 nt, hsa
gcaaacgacugcuguuggauucugaggguggggagggagagagagggagggagagggaguga

SEQ ID NO: 276010 - RNA, 62 nt, hsa
guugccuguuucacuuguuacuguuacugggagagggagacaaaaccucauggcaaucuugu

SEQ ID NO: 276011 - RNA, 62 nt, hsa
caucucagugaucauuuacguugcguguacuugagggagauucugagagaugcuccuuuggg

SEQ ID NO: 276012 - RNA, 62 nt, hsa
cuccucccacacuagacacuggguuucaggaggagggagacugcccugcuuuggucccagag

SEQ ID NO: 276013 - RNA, 62 nt, hsa
ugccaugauaaguccuuccaugaaggacugaggagggagaguggggguccagggcuggugcu

SEQ ID NO: 276014 - RNA, 62 nt, hsa
aaggaggaggagggagaagagaaaauguaaaggagggagaucuuucccaggccgcaccauuu

SEQ ID NO: 276015 - RNA, 62 nt, hsa
uguuggaggcacaguuuuagaauaaggaggaggagggagaagagaaaauguaaaggagggag

SEQ ID NO: 276016 - RNA, 62 nt, hsa
caaaguuuugaagucaucuuagcuuuccacaggagggagagaacuuaaaaaagcaacaguag

SEQ ID NO: 276017 - RNA, 62 nt, hsa
uggucucccuccagcuggaauugcugcucucugagggagaggcugugguggcugucucuguc

SEQ ID NO: 276018 - RNA, 62 nt, hsa
ucaggggugguaaggacucugguaccagggaagagggagaauuaauuuauugugcaaaugcu

SEQ ID NO: 276019 - RNA, 62 nt, hsa
cuagguguuaccauucacugaaucuucucucagagggagaugagcaauugucagucaggaua

SEQ ID NO: 276020 - RNA, 62 nt, hsa
gagcaggagggagacugaaguaagagauggcagagggagaugguggcaaaaagguuuagaug

SEQ ID NO: 276021 - RNA, 62 nt, hsa
agccucccucacucuccaugcuggcagagcaggagggagacugaaguaagagauggcagagg

SEQ ID NO: 276022 - RNA, 62 nt, hsa
ggcucucccaggggcugauggggggguucugugagggagaaucagggcucgggaagccacgc

SEQ ID NO: 276023 - RNA, 62 nt, hsa
ggcauggaggguggugugaguuccucuggugggagggagaacgcacaucucuucugggcggc

SEQ ID NO: 276024 - RNA, 62 nt, hsa
cugagaaguggcccaugugcuucaaggcccaggagggagaucugucagcucauucuugccuu

SEQ ID NO: 276025 - RNA, 62 nt, hsa
ucuugguaaaaggagggagccugcugagccaggagggagaaaagaagauugaccagcuugcu

SEQ ID NO: 276026 - RNA, 62 nt, hsa
guggaagugggguaggggaagaggaggggcaggagggagaguuccugugagcaugugggggg

SEQ ID NO: 276027 - RNA, 62 nt, hsa
uccuguccccucugggaacauuucaugcuucagagggagagguuuuuauugagcuuguuuca

SEQ ID NO: 276028 - RNA, 62 nt, hsa
guuaccuuccuggugcacacaccgaagugcucgagggagaggcugccgcccccucuccccuu

SEQ ID NO: 276029 - RNA, 62 nt, hsa
auggggcccugagcuucugcugccucuggugagagggagagcccuucccauccuuacccacc

SEQ ID NO: 276030 - RNA, 62 nt, hsa
uuugaggcugggcugggagggggagggagauagagggagagaugcaguuugaccccauuugg

SEQ ID NO: 276031 - RNA, 62 nt, hsa
uccugggggguuugaggcugggcugggagggggagggagauagagggagagaugcaguuuga

SEQ ID NO: 276032 - RNA, 62 nt, hsa
augcgugugacaggugcagagacgggggacuggagggagacuuuuauacguuuuguaccuuu

SEQ ID NO: 276033 - RNA, 62 nt, hsa
ucaccagccccaaggucccgaagggcaggucagagggagagaggcuggagaccugggcuggg

SEQ ID NO: 276034 - RNA, 62 nt, hsa
ccugcccugauagggcuuaccugugggugggggagggagaccacacaugucagagguaguga

SEQ ID NO: 276035 - RNA, 62 nt, hsa
ucgugucucagcaucaggaaaggagaaaggcagagggagagcgcugagaagacuguucacgc

SEQ ID NO: 276036 - RNA, 62 nt, hsa
cccguccuggccuggagcacccugggauccuggagggagaggccccacgcccccacucuccc

SEQ ID NO: 276037 - RNA, 62 nt, hsa
ggaaaagacugccugccuuggaggggucacaugagggagaccugugccugauuucauuagga

SEQ ID NO: 276038 - RNA, 62 nt, hsa
uuuauuagcgcugcucugcaccccucccuugggagggagacuucaugugguuuauugcgagu

SEQ ID NO: 276039 - RNA, 62 nt, hsa
agcgguuuuugcaaauucauauuacuuaagcagagggagagaaccucuacugaucagagcau

SEQ ID NO: 276040 - RNA, 62 nt, hsa
ggugugguccuagaugaagcauuggggugggggagggagagggagcuuuguguuaagugccu

SEQ ID NO: 276041 - RNA, 62 nt, hsa
uggccagagcagggcuggagggaaggagccaggagggagagagccucccaccuuuccccugc

SEQ ID NO: 276042 - RNA, 62 nt, hsa
cacaugggguaagggggguugggggugggggagagggagagagcgaacacccacgcugguuu

SEQ ID NO: 276043 - RNA, 62 nt, hsa
ggagagagaggaaagggaaggaagaaaggaaggagggagaagggaagaaagaaacaaugucu

SEQ ID NO: 276044 - RNA, 62 nt, hsa
ggauagcugcaacaaugaaacaggaaagaagagagggagagagaggaaagggaaggaagaaa

SEQ ID NO: 276045 - RNA, 62 nt, hsa
aaggggcuaggacuagggugagagggaguggggagggagagggcaggaaggaggcagagcug

SEQ ID NO: 276046 - RNA, 62 nt, hsa
cauucuucaaaaccauuccugauagaguagccgagggagagucuuggggccaagaagggccc

SEQ ID NO: 276047 - RNA, 62 nt, hsa
acuagugccugagcucagugcugcuggaugaugagggagaucaagaaaaagccacguaaggg

SEQ ID NO: 276048 - RNA, 62 nt, hsa
gugccguuuggauggggaagggaaagacuggggagggagagugaacuccgaggggugucccc

SEQ ID NO: 276049 - RNA, 62 nt, hsa
gagggagggagggagagaauggcccgagggaggagggagagaaggagggaggcgcuccuggg

SEQ ID NO: 276050 - RNA, 62 nt, hsa
uauaaacacuggaggggagggagggagggagggagggagagaauggcccgagggaggaggga

SEQ ID NO: 276051 - RNA, 62 nt, hsa
uauuuuuauauagcuugaaacauagagggagagagggagagagccuauaccccuuacuuagc

SEQ ID NO: 276052 - RNA, 62 nt, hsa
cauuuguuuauuuuuauauagcuugaaacauagagggagagagggagagagccuauaccccu

SEQ ID NO: 276053 - RNA, 62 nt, hsa
ugagggcggccgggagggcgagcgagggagaggagggagagggggaggggaggaguccaggg

SEQ ID NO: 276054 - RNA, 62 nt, hsa
ggguaucagugagggcggccgggagggcgagcgagggagaggagggagagggggaggggagg

SEQ ID NO: 276055 - RNA, 62 nt, hsa
auuuuucuccacugcuuggauaugaaacuguagagggagaggcccuguugcccaguguucuc

SEQ ID NO: 276056 - RNA, 62 nt, hsa
cauugacuucucuacccuaaaacuguuugagagagggagagugggcccuggcuuucucaagc

SEQ ID NO: 276057 - RNA, 62 nt, hsa
gcaacagcagcaggacagggcacggagggagcgagggagagaggaccggucccagcuuuugg

SEQ ID NO: 276058 - RNA, 62 nt, hsa
ggauuuaucucaaaaaccaacauccaaaaugggagggagauguggcuugaggucaagcgcca

SEQ ID NO: 276059 - RNA, 62 nt, hsa
cacaggagugggauggggugugguagcaaaaggagggagaggaguccuuuuugugccaaauc

SEQ ID NO: 276060 - RNA, 62 nt, hsa
agccaggugucccuccuaugcacagagcagaggagggagaagcucuggggagccagcuuugg

SEQ ID NO: 276061 - RNA, 62 nt, hsa
gaugccgacuggaagggagggagagggagggggagggagaaaauggggcuaugccuggcuua

SEQ ID NO: 276062 - RNA, 62 nt, hsa
gcugugggcagcagacgaugccgacuggaagggagggagagggagggggagggagaaaaugg

SEQ ID NO: 276063 - RNA, 62 nt, hsa
gcaguuaaugggguagaggagggcaugggagggagggagagguggggagggagacagagaca

SEQ ID NO: 276064 - RNA, 62 nt, hsa
agaggagggcaugggagggagggagagguggggagggagacagagacagaaacagagagaga

SEQ ID NO: 276065 - RNA, 62 nt, hsa
gaaacagagagagacagagacagagagagacugagggagagacucugaggacauggagagag

SEQ ID NO: 276066 - RNA, 62 nt, hsa
uggucaugaaagcgugguucuguaagaaaucagagggagaaagggagagaagggggagggag

SEQ ID NO: 276067 - RNA, 62 nt, hsa
aagaaaucagagggagaaagggagagaagggggagggagacaacccaaacguuggaggguau

SEQ ID NO: 276068 - RNA, 62 nt, hsa
aaugccuccccaggucugucucuggaggcucugagggagaugggcuugggggcuguaggagg

SEQ ID NO: 276069 - RNA, 62 nt, hsa
ccaaccaagagagcgggagggagggaaggagggagggagagagauagagagagagagagaga

SEQ ID NO: 276070 - RNA, 62 nt, hsa
agagaauggcuacugcugaguccuuugggguugagggagaugggagcuagggggaggggagg

SEQ ID NO: 276071 - RNA, 62 nt, hsa
gggguugagggagaugggagcuagggggaggggagggagaugucuuguuguggggacuuggg

SEQ ID NO: 276072 - RNA, 62 nt, hsa
augggucucagagagcaaccuccucccucguagagggagauuauauccccaacuccagggac

SEQ ID NO: 276073 - RNA, 62 nt, hsa
gcugccaaaggggcagagggugguggagaggagagggagaaagggaagucccagggcccggg

SEQ ID NO: 276074 - RNA, 62 nt, hsa
ucgugguucuuccccgagggugcauguugcaggagggagagggcagggaagacucacagcag

SEQ ID NO: 276075 - RNA, 62 nt, hsa
aaugggcuuccuuuuugguucaguauuagugagagggagagggagauggauggugggguagg

SEQ ID NO: 276076 - RNA, 62 nt, hsa
cuuccuuuuugguucaguauuagugagagggagagggagauggauggugggguagguuuucu

SEQ ID NO: 276077 - RNA, 62 nt, hsa
aucgccugaacccaggaggcggagguugcagggagggagacugcaccacugcacuucagccu

SEQ ID NO: 276078 - RNA, 62 nt, hsa
gacugcaccacugcacuucagccugggugacagagggagacucugucuuaaaaaaaaaaaaa

SEQ ID NO: 276079 - RNA, 62 nt, hsa
gcggcccaggcacagaagggcagggccauagggagggagauucgcuacggauccaggccauu

SEQ ID NO: 276080 - RNA, 62 nt, hsa
uccucuguccccacagugaccugacugggggugagggagaaggaggagagagcccaugugug

SEQ ID NO: 276081 - RNA, 62 nt, hsa
gccuccugcagagccagcgaaggaaagcucuagagggagacgacuccaccgccucucugcuc

SEQ ID NO: 276082 - RNA, 62 nt, hsa
uggagggcgcaucaaagaagaguccuacccaggagggagagcgcagcugcugcaggauucuc

SEQ ID NO: 276083 - RNA, 62 nt, hsa
cuaccacucuggcugcuagacagcuugguggcgagggagaugacuccuuguagcugauacuu

SEQ ID NO: 276084 - RNA, 62 nt, hsa
ggcucucuuaagagcuaugugccuuccaaccagagggagacccaguagaaagaaaaacaucc

SEQ ID NO: 276085 - RNA, 62 nt, hsa
gcuuuuaaugaauuuaaggcaaaaaagguggagagggagaugugugagcauccugcaaggug

SEQ ID NO: 276086 - RNA, 62 nt, hsa
ggauaaaaaauacauacuguggucggcaaggugagggagauagggauauccaggggaagagg

SEQ ID NO: 276087 - RNA, 62 nt, hsa
gaggcagagagggagagaggcagagagacagagagggagagagggacagagagagauagagc

SEQ ID NO: 276088 - RNA, 62 nt, hsa
gaaggagagaggcagagagggagagaggcagagagggagagaggcagagagacagagaggga

SEQ ID NO: 276089 - RNA, 62 nt, hsa
gaaagagacaggcagagaaggagagaggcagagagggagagaggcagagagggagagaggca

SEQ ID NO: 276090 - RNA, 62 nt, hsa
aaacagaggagacagagagggagagagagacagagggagagagagacagaggggaagagagg

SEQ ID NO: 276091 - RNA, 62 nt, hsa
aggcagagagggagagaaacagaggagacagagagggagagagagacagagggagagagaga

SEQ ID NO: 276092 - RNA, 62 nt, hsa
agauaugaggagagagagacagaggaggcagagagggagagaaacagaggagacagagaggg

SEQ ID NO: 276093 - RNA, 62 nt, hsa
gugcauaaaugggggucagggagggaaaggaggagggagagagauggagaggaggggagaga

SEQ ID NO: 276094 - RNA, 62 nt, hsa
ggcucucuuaagagcuaugugccuuccacccagagggagacccaguagaaagaaaaacaucc

SEQ ID NO: 276095 - RNA, 62 nt, hsa
cuaccacucuggcugcuagauagcuugguggggagggagaugacuccuuguagcugauacuu

SEQ ID NO: 276096 - RNA, 62 nt, hsa
acugcugugaacucacuuugaggggguaggaggagggagaaacagccuguguuuuuuaugca

SEQ ID NO: 276097 - RNA, 62 nt, hsa
cacuuaaagugcuucugccccuaggguuuccggagggagagccgagaugggaugggggagcc

SEQ ID NO: 276098 - RNA, 62 nt, hsa
gcucuggccacugcuucccaugagcugagggagagggagaggggacccgaggcugaggcaua

SEQ ID NO: 276099 - RNA, 62 nt, hsa
uggggagcucuggccacugcuucccaugagcugagggagagggagaggggacccgaggcuga

SEQ ID NO: 276100 - RNA, 62 nt, hsa
uuguggaaagaggaguuggugguaucggugucgagggagaggaggggguuggggaggaccca

SEQ ID NO: 276101 - RNA, 62 nt, hsa
acagugcacggaguguggaagggggucuaggagagggagagcuggaaaaggagcugaugggg

SEQ ID NO: 276102 - RNA, 62 nt, hsa
ggggugucuccuggcugggaaggagggaaagggagggagaguuuugcggggguuggcagugg

SEQ ID NO: 276103 - RNA, 62 nt, hsa
ucugcucaucagcacugucccaggauccuggagagggagaacuccuggccccaggggaaaga

SEQ ID NO: 276104 - RNA, 62 nt, hsa
aggaggagcccagaggaccccaggggagugaggagggagaacuuggaagggugcagcccacu

SEQ ID NO: 276105 - RNA, 62 nt, hsa
gggagggaacccugggcagggcucuggugggagagggagacagauggaggcaguggcuggug

SEQ ID NO: 276106 - RNA, 62 nt, hsa
cucuuuaaaaaaaauagaagcuauaaagaaaagagggagagaugaguggguuagcuaccugc

SEQ ID NO: 276107 - RNA, 62 nt, hsa
gacacauaaugaggucccucuagcuuuagcuggagggagauaaaagaaccccagaccucuga

SEQ ID NO: 276108 - RNA, 64 nt, hsa
ucuuuucaacaaauggcaccgagacaaugauaugcaagugcaaaagaaugagguuggaccuuua

SEQ ID NO: 276109 - RNA, 64 nt, hsa
cagaaagaauaaaauaggaaucaacuuaacaaaacaagugcaagacugaaaacuacaaaauugg

SEQ ID NO: 276110 - RNA, 64 nt, hsa
agguggguauggacaguggaggcagcuggaauggcaagugcagaaaauaggaacaguucuauac

SEQ ID NO: 276111 - RNA, 64 nt, hsa
cuugaaacacgagaagcagcaaagacagagcacacaagugcauaaggcuguugucuucggcuug

SEQ ID NO: 276112 - RNA, 64 nt, hsa
uaugcugcuauggacgaccuccagcucucaguuacaagugcaggcgacuggaggcaggacuccu

SEQ ID NO: 276113 - RNA, 64 nt, hsa
ugccacuccugacccagcccugaacaaagcaccucaagugcaaggaccaaagggggcccuggcu

SEQ ID NO: 276114 - RNA, 64 nt, hsa
caugcacacaggugcacagaccacacagcacacacaagugcacagagcacacugcacacaugca

SEQ ID NO: 276115 - RNA, 64 nt, hsa
cacacguguagcucacacacaguauacacauacacaagugcacagaccacacacagcacuaaca

SEQ ID NO: 276116 - RNA, 64 nt, hsa
agccuagccugauaauccuauuacauaguuugaaaaauaguauuuuauuucucagaacaaggua

SEQ ID NO: 276117 - RNA, 64 nt, hsa
agacaagagggaauaguauagacaauaaggaaggaaauaguacuuacaaaugacuccuaaggga

SEQ ID NO: 276118 - RNA, 64 nt, hsa
agcagaacagccauuaaaucagcaucaaaagaacaaauaguaaaauccaaaguauuaauuacag

SEQ ID NO: 276119 - RNA, 64 nt, hsa
acagaacaacugaaauacuugaaauagaccuauaaaauaguaauuaaaaugagaaauacauaag

SEQ ID NO: 276120 - RNA, 64 nt, hsa
gaguaugaugaucccugugacaguuuuugcucugaaauaguauuuaucauguguuugguaccua

SEQ ID NO: 276121 - RNA, 64 nt, hsa
aauaucaauuuuacaguacggaaauaguauuuuaaaauaguauuggcuaauaaauuaugaauuc

SEQ ID NO: 276122 - RNA, 64 nt, hsa
cuuuuuuuccucuaauaucaauuuuacaguacggaaauaguauuuuaaaauaguauuggcuaau

SEQ ID NO: 276123 - RNA, 64 nt, hsa
uguacauauaaaccauuuuuauuucaugcauuaaaaauaguaugauaaagauuucagaguacag

SEQ ID NO: 276124 - RNA, 64 nt, hsa
ugggagacugauaaacugguaauuagacugugauaaauaguaugauggaaauuagcuuaagcug

SEQ ID NO: 276125 - RNA, 64 nt, hsa
auuaaaucgcacuuuuaaagugagucauugaaauaaauaguacugaaaugauucucuauguugu

SEQ ID NO: 276126 - RNA, 64 nt, hsa
gguuaaacauuucuaaaaauaaacuaccaauacuaaauaguaagaaaccuaacuuuaguagcaa

SEQ ID NO: 276127 - RNA, 64 nt, hsa
agaaugagaaaauauacaauuagaauuauuuuagaaauaguaggaaguauugcagaagucaaua

SEQ ID NO: 276128 - RNA, 64 nt, hsa
uauaauuugaauugauuaaaauuggucguuacuaaaauaguauaguaaccacaagugauuggcu

SEQ ID NO: 276129 - RNA, 64 nt, hsa
aaaccacuaaaaacuaccuaaacacugacuuaguaaauaguaaaaagguaauguugggacuuuu

SEQ ID NO: 276130 - RNA, 64 nt, hsa
gucugcagugcacauuauaaggaauggaacaugaaaauaguauauaauccuagaccuggaguug

SEQ ID NO: 276131 - RNA, 64 nt, hsa
uuuggugaguuauacccauuuuauuuauuuagaaaaauaguaucuuuguuaacgacuuacaugg

SEQ ID NO: 276132 - RNA, 64 nt, hsa
auacaaaggagacuuuuuuuuugagauaacacucaaauaguauucucuucuuuugaaaauuuua

SEQ ID NO: 276133 - RNA, 64 nt, hsa
aauuaagaauuuuaguuuacaguuuagcauaaacaaauaguaguagaaaugaaugcauuuauuc

SEQ ID NO: 276134 - RNA, 64 nt, hsa
gauuuacuuugcuaagauuuauggcaagugucaaaaauaguaucugaagauacugaaucaucau

SEQ ID NO: 276135 - RNA, 64 nt, hsa
cuauauugauagcucuuaaaggagugaaaaucuaaaauaguaaauuucaauguuaagugucugc

SEQ ID NO: 276136 - RNA, 64 nt, hsa
agaaauuuuguuuuaagucuucaaauaucuugagaaauaguagacuguauguugaaaauuguac

SEQ ID NO: 276137 - RNA, 64 nt, hsa
agacaauuuuggagagcaagcaaaucuuuuuaaaaaauaguaugaaugugaauacuagaaaaga

SEQ ID NO: 276138 - RNA, 64 nt, hsa
auaguaugaaugugaauacuagaaaagauuuaaaaaauaguaugagugugaguacuaggaagga

SEQ ID NO: 276139 - RNA, 64 nt, hsa
gucuugggaaaacuauaacuugccaaaguagaagaaauaguaguaccauaugccaaagugauag

SEQ ID NO: 276140 - RNA, 64 nt, hsa
aacaagguuauaauuuagcaucuucccuggaucuaaauaguauauuauauccugaaauaaauga

SEQ ID NO: 276141 - RNA, 64 nt, hsa
cugauuguuuucauagaugaugcuucuuggggaaaaauaguauaggaugugaaaguuuugaauu

SEQ ID NO: 276142 - RNA, 64 nt, hsa
gguagagacacgcuccagaagggauaacaaaaucaaauaguagauggguucauugggccucaga

SEQ ID NO: 276143 - RNA, 64 nt, hsa
acugcuuuccaucuacuggguaaaaugacuauugaaauaguaugaauguggucagaggauuaua

SEQ ID NO: 276144 - RNA, 64 nt, hsa
cugagcgagucucuagagggugagaauuugagagaaauaguaauuugauuauuucauucaugaa

SEQ ID NO: 276145 - RNA, 64 nt, hsa
acagcuuguaaauuacaacagaaagguuccuuucaaauaguagagcugcaccuaaagaggaaau

SEQ ID NO: 276146 - RNA, 64 nt, hsa
uuuauaauccauuuaaagugaaaguuuaucacacaaauaguacacuuauuuucuaaccaaauac

SEQ ID NO: 276147 - RNA, 64 nt, hsa
ugucucuuuguuccuauaaguagaucuuaauguaaaauaguaaauguccauugaaaagcaagua

SEQ ID NO: 276148 - RNA, 64 nt, hsa
uaucuaaaccuaaugaaauuccuuuuauauuuaaaaauaguacauucugucucaugucacguau

SEQ ID NO: 276149 - RNA, 64 nt, hsa; identical to SEQ ID NO: 46130

SEQ ID NO: 276150 - RNA, 64 nt, hsa; identical to SEQ ID NO: 46131

SEQ ID NO: 276151 - RNA, 64 nt, hsa; identical to SEQ ID NO: 46132

SEQ ID NO: 276152 - RNA, 64 nt, hsa; identical to SEQ ID NO: 46133

SEQ ID NO: 276153 - RNA, 64 nt, hsa; identical to SEQ ID NO: 46134

SEQ ID NO: 276154 - RNA, 64 nt, hsa; identical to SEQ ID NO: 46135

SEQ ID NO: 276155 - RNA, 64 nt, hsa; identical to SEQ ID NO: 46136

SEQ ID NO: 276156 - RNA, 64 nt, hsa; identical to SEQ ID NO: 46137

SEQ ID NO: 276157 - RNA, 64 nt, hsa; identical to SEQ ID NO: 46138

SEQ ID NO: 276158 - RNA, 64 nt, hsa; identical to SEQ ID NO: 46139

SEQ ID NO: 276159 - RNA, 64 nt, hsa; identical to SEQ ID NO: 46140

SEQ ID NO: 276160 - RNA, 64 nt, hsa; identical to SEQ ID NO: 46141

SEQ ID NO: 276161 - RNA, 64 nt, hsa; identical to SEQ ID NO: 46142

SEQ ID NO: 276162 - RNA, 64 nt, hsa; identical to SEQ ID NO: 46143

SEQ ID NO: 276163 - RNA, 64 nt, hsa; identical to SEQ ID NO: 46144

SEQ ID NO: 276164 - RNA, 64 nt, hsa; identical to SEQ ID NO: 46145

SEQ ID NO: 276165 - RNA, 64 nt, hsa; identical to SEQ ID NO: 46146

SEQ ID NO: 276166 - RNA, 64 nt, hsa; identical to SEQ ID NO: 46147

SEQ ID NO: 276167 - RNA, 64 nt, hsa; identical to SEQ ID NO: 46148

SEQ ID NO: 276168 - RNA, 64 nt, hsa; identical to SEQ ID NO: 46149

SEQ ID NO: 276169 - RNA, 64 nt, hsa; identical to SEQ ID NO: 46150

SEQ ID NO: 276170 - RNA, 64 nt, hsa; identical to SEQ ID NO: 46151

SEQ ID NO: 276171 - RNA, 64 nt, hsa
aagagacuugaaaacagaaaacugguuaaugacuacuauaaaugcacugaaacuauguuuaugg

SEQ ID NO: 276172 - RNA, 64 nt, hsa
gagaaaguuuuuagaaagugauuuuuaugcucgcacuauaaauauggcaggucaguucauucuu

SEQ ID NO: 276173 - RNA, 64 nt, hsa
gcagaauaaaugagguuuuuuucaauuaaaaauuacuauaaauccaggaggcaaacuauuuuag

SEQ ID NO: 276174 - RNA, 64 nt, hsa
uaaauuuucuguauaauuagcccaggcugauguaacuauaaaaauuaguugaaaaaaaaaauau

SEQ ID NO: 276175 - RNA, 64 nt, hsa
gauguggaaccugugcauauggagggucaacuguacuauaaauaauacgaauaugccaacauua

SEQ ID NO: 276176 - RNA, 64 nt, hsa
accagccuggccaacauggcgaaaccccgucucuacuauaaaauacaaaaaauuaguugggugu

SEQ ID NO: 276177 - RNA, 64 nt, hsa
cagucuccccagucuguuggugucuuuauaggaaacuauaaagcagagcaguggugucuuuaga

SEQ ID NO: 276178 - RNA, 64 nt, hsa
auguauagagugugauguccaauugguauucagcacuauaaauguguuuuuaaccucccgcauu

SEQ ID NO: 276179 - RNA, 64 nt, hsa
uggugucucacaaauuacccaauuguugaauaaaacuauaaauauguuaauaccagcuuuuucc

SEQ ID NO: 276180 - RNA, 64 nt, hsa
aucaacgugaaugaagaauguuuguuuauauaucacuauaaaauccaguugaccuggacaguau

SEQ ID NO: 276181 - RNA, 64 nt, hsa
uacuauaaauuaauguaauacugugugaauucagacuauaaaaaacaucauucagaaaacuuua

SEQ ID NO: 276182 - RNA, 64 nt, hsa
uauuucauuucuucaaauuaccaagcacuguaauacuauaaauuaauguaauacugugugaauu

SEQ ID NO: 276183 - RNA, 64 nt, hsa
uuuuauauacaauuaggauaauuagcauugucagacuauaaaccuuugcuuuuuaaaguuuauu

SEQ ID NO: 276184 - RNA, 64 nt, hsa
aaucuauuguauuauuacacuuguuauaauuuuaacuauaaagguccaauuguuucacagagcc

SEQ ID NO: 276185 - RNA, 64 nt, hsa
uuuaugugcaaguguuuucagugcccugaaucaaacuauaaauguggggagaaaucaccuccau

SEQ ID NO: 276186 - RNA, 64 nt, hsa
ugaauaguuugccaucgagauuauuuucauuuauacuauaaaacaaaagcaaacuaguccaguu

SEQ ID NO: 276187 - RNA, 64 nt, hsa
uuuuuuuuuuuuuuuuacuuuggaaaggacaauaacuauaaaccuauauccagauuuucuuucu

SEQ ID NO: 276188 - RNA, 64 nt, hsa
cagaaucuuccuuuggacaaaacaucacuagcugacuauaaaaacaaaagugucaucauugaag

SEQ ID NO: 276189 - RNA, 64 nt, hsa
ugaaguucuucacuacuauaaacaugucuucuguacuauaaaauccauuuaacugguguucuua

SEQ ID NO: 276190 - RNA, 64 nt, hsa
uuuaaacuauuuuuuauagcugaaguucuucacuacuauaaacaugucuucuguacuauaaaau

SEQ ID NO: 276191 - RNA, 64 nt, hsa
gagggugauccuuauucaaaaauaacaucugacuacuauaaaaauauuugcauauauaaguuug

SEQ ID NO: 276192 - RNA, 64 nt, hsa
aucacuccugaauacagaggcauauucuuuuuaaacuauaaauaccauuuugagugagaaagua

SEQ ID NO: 276193 - RNA, 64 nt, hsa
uauaaaauaggucucuuaaccuggcaccaguauaacuauaaagcacuagcugagaaggaacuga

SEQ ID NO: 276194 - RNA, 64 nt, hsa
ugugcuuuucuuguaguugacuuucaugucacucacuauaaaauaggucucuuaaccuggcacc

SEQ ID NO: 276195 - RNA, 64 nt, hsa
augauuugagugguuauucauugaguaauuuuccacuauaaagaauuuuauugaacauuuauua

SEQ ID NO: 276196 - RNA, 59 nt, hsa
uagaaaagaagaaagauugagacuugaugacuauaaaauauuuguuaggacuucaaauu

SEQ ID NO: 276197 - RNA, 64 nt, hsa
cuuggaggacucauuuuaccugacuucaagacuuacuauaaagcuauaguaaucaagauagaug

SEQ ID NO: 276198 - RNA, 64 nt, hsa
ggauagggacuggagggggugugggguauguaugacuauaaagggaugacgcaaggaguuccuu

SEQ ID NO: 276199 - RNA, 64 nt, hsa
auggaucuugaacagaaccaguaucugucauggaacugaacauucaucgauggucuccauguau

SEQ ID NO: 276200 - RNA, 64 nt, hsa
acagcucuguuccauguaaguugccaacaguuucacugaacagugggguaugugaugguuuugg

SEQ ID NO: 276201 - RNA, 64 nt, hsa
uucagugccuuccucucucuaccagucuauuuccacugaacaaaaccuacgcacauaccuucau

SEQ ID NO: 276202 - RNA, 64 nt, hsa
uucacugccuuccucucucuaccagucuauuuccacugaacaaaaccuacacacauaccuucau

SEQ ID NO: 276203 - RNA, 64 nt, hsa
uauuugcucagcuggcugagacacugaagaagucacugaacaaaaccuacacacguaccuucau

SEQ ID NO: 276204 - RNA, 64 nt, hsa
uucauuaagggccaccugcugucuguugaacuagacugaacaaaauauauuuucucacaagcuc

SEQ ID NO: 276205 - RNA, 64 nt, hsa
guacauaugcauuuuucuggagagagccugugaaacugaacagauuuucagugggaucugagac

SEQ ID NO: 276206 - RNA, 64 nt, hsa
caggugaucagauaaaauauauuuugggaaauuaacugaacaaauaaaaaguuuuugauauaac

SEQ ID NO: 276207 - RNA, 64 nt, hsa
uuucauuucagucaaaucacugcagucaugaaauacugaacaauugccuuaagucuuugcuuga

SEQ ID NO: 276208 - RNA, 64 nt, hsa
ugcuaaacuuuguaaugcacauucuuagcauauaacugaacacaguugaaaaauugugccugau

SEQ ID NO: 276209 - RNA, 64 nt, hsa
uguuacccaauuaggcuugucagguuaguaauaaacugaacaguaauaaaacuguggaaguaau

SEQ ID NO: 276210 - RNA, 56 nt, hsa
aagcuuuuaaccuaucuuaacaacuuacugaacauaagaaaauuuacacuagagag

SEQ ID NO: 276211 - RNA, 64 nt, hsa
auguggcagagcuuuuaaccaguccgcaaagcucacugaacauaaguuaauucauacuggagaa

SEQ ID NO: 276212 - RNA, 64 nt, hsa
aacuguagaacaguuuuauuuuuauuaaaacuugacugaacaaaaggggaccaucaacauugua

SEQ ID NO: 276213 - RNA, 64 nt, hsa
ucguuuaaccugcucuuggucauuggaaauuuacacugaacaaagugcaauuaacuguagaaca

SEQ ID NO: 276214 - RNA, 64 nt, hsa
ccacgugauuucccuuucagcauuuauacccaggacugaacaugcagaacuguuuuuuuuuuuu

SEQ ID NO: 276215 - RNA, 64 nt, hsa
auacacaccuccaguuuuugcucuuuuguguuguacugaacacaauauuuguguuuuuauuauu

SEQ ID NO: 276216 - RNA, 64 nt, hsa
ucagaacaggaauccacauugccagugacaugagacugaacagccaaauggaggcuauguggag

SEQ ID NO: 276217 - RNA, 64 nt, hsa
ucagaugacuagaaagugaauaaaaauuaaggcaacugaacaaaaaaaugcucacacuccacau

SEQ ID NO: 276218 - RNA, 64 nt, hsa
gguuuuuccauaauuuacuuaaccaauccuugucacugaacauuaaggcugcuuucacacuguc

SEQ ID NO: 276219 - RNA, 64 nt, hsa
guuuuuccuacauucugaaaagcaaacaugaaaaacugaacacaguuuuuacagauauacaaua

SEQ ID NO: 276220 - RNA, 64 nt, hsa
cauuugcauuuguuuauguaauuucaggaggaauacugaacaucugaguccuggaugauacuaa

SEQ ID NO: 276221 - RNA, 64 nt, hsa
ggguaaaguuaaguugagauaguuuucauccauaacugaacauccaaaaucuugaucaguuaag

SEQ ID NO: 276222 - RNA, 64 nt, hsa
uuaauaccaaguauucauuucaugauguaaagaaacugaacagugaaguggcuugauugcuuaa

SEQ ID NO: 276223 - RNA, 64 nt, hsa; identical to SEQ ID NO: 276222

SEQ ID NO: 276224 - RNA, 64 nt, hsa
augugucaaguuacucaaaguuauugcuguuggaacugaacaauaauauuucccagauagcugg

SEQ ID NO: 276225 - RNA, 64 nt, hsa
cacauaauuaaagcaguugaacuauagggaaagcacugaacaaaccacuuuggaguaaauagcu

SEQ ID NO: 276226 - RNA, 64 nt, hsa
ucaaacuaaauuguauuuucagagcuauccugaaacugaacagcugaaacuuuaaaaaauaauu

SEQ ID NO: 276227 - RNA, 64 nt, hsa
uacgauacagggccauuuuuuuaaaacucucaggacugaacagaagagaaaaauuauuaauuag

SEQ ID NO: 276228 - RNA, 64 nt, hsa
cacugcuggacaugagauggagaggcugagggacaggaucuauaggcagcuucuaagagcgaac

SEQ ID NO: 276229 - RNA, 64 nt, hsa
uccuugucuuuugagcuauucaccucaguagaaaaggaucuaagggaagaucacuguaguuuag

SEQ ID NO: 276230 - RNA, 64 nt, hsa
uugagauguguaacuggcaugauucugcuuuugaaggaucuauaguaucauuuuaguuaagugg

SEQ ID NO: 276231 - RNA, 64 nt, hsa
aauaguuuaaaauagguuaauucgaacacaggaaaggaucuauuuguuguuucuuuugucuggu

SEQ ID NO: 276232 - RNA, 64 nt, hsa
auuguagguggcuuggggaauguggguggcuuagaggaucuaaaccgauucacuuccugguuga

SEQ ID NO: 276233 - RNA, 64 nt, hsa
acgagggcuugcucuaaaucguuuagaggauaacaggaucuagagaugcucucugcuugacaac

SEQ ID NO: 276234 - RNA, 64 nt, hsa; identical to SEQ ID NO: 83098

SEQ ID NO: 276235 - RNA, 64 nt, hsa; identical to SEQ ID NO: 83099

SEQ ID NO: 276236 - RNA, 64 nt, hsa; identical to SEQ ID NO: 83100

SEQ ID NO: 276237 - RNA, 64 nt, hsa; identical to SEQ ID NO: 83101

SEQ ID NO: 276238 - RNA, 64 nt, hsa; identical to SEQ ID NO: 83102

SEQ ID NO: 276239 - RNA, 64 nt, hsa; identical to SEQ ID NO: 83103

SEQ ID NO: 276240 - RNA, 64 nt, hsa; identical to SEQ ID NO: 83104

SEQ ID NO: 276241 - RNA, 64 nt, hsa; identical to SEQ ID NO: 83105

SEQ ID NO: 276242 - RNA, 64 nt, hsa; identical to SEQ ID NO: 83106

SEQ ID NO: 276243 - RNA, 64 nt, hsa; identical to SEQ ID NO: 83107

SEQ ID NO: 276244 - RNA, 64 nt, hsa; identical to SEQ ID NO: 83108

SEQ ID NO: 276245 - RNA, 64 nt, hsa; identical to SEQ ID NO: 83109

SEQ ID NO: 276246 - RNA, 64 nt, hsa; identical to SEQ ID NO: 83110

SEQ ID NO: 276247 - RNA, 64 nt, hsa; identical to SEQ ID NO: 83111

SEQ ID NO: 276248 - RNA, 64 nt, hsa; identical to SEQ ID NO: 83112

SEQ ID NO: 276249 - RNA, 64 nt, hsa; identical to SEQ ID NO: 83113

SEQ ID NO: 276250 - RNA, 64 nt, hsa; identical to SEQ ID NO: 83114

SEQ ID NO: 276251 - RNA, 64 nt, hsa; identical to SEQ ID NO: 83115

SEQ ID NO: 276252 - RNA, 64 nt, hsa; identical to SEQ ID NO: 83116

SEQ ID NO: 276253 - RNA, 64 nt, hsa; identical to SEQ ID NO: 83117

SEQ ID NO: 276254 - RNA, 64 nt, hsa; identical to SEQ ID NO: 83118

SEQ ID NO: 276255 - RNA, 64 nt, hsa; identical to SEQ ID NO: 83119

SEQ ID NO: 276256 - RNA, 64 nt, hsa; identical to SEQ ID NO: 83120

SEQ ID NO: 276257 - RNA, 64 nt, hsa; identical to SEQ ID NO: 83121

SEQ ID NO: 276258 - RNA, 64 nt, hsa
aacaugguuguuauugugcuguugacaugaauagaccauggaaacauuuucaucauuauuauuc

SEQ ID NO: 276259 - RNA, 64 nt, hsa
aaaagcaugaaguacguguguguguguguguguuaccauggaaaaggauauucacaguaguaca

SEQ ID NO: 276260 - RNA, 64 nt, hsa
ccaucagacagguaaaugggcagugccuccugggaccauggacacauuuucuccuaggagaagc

SEQ ID NO: 276261 - RNA, 64 nt, hsa
gacucucuuagggaaaccaauaguccccaucagcaccauggaggcaggcucccccugccuuuga

SEQ ID NO: 276262 - RNA, 64 nt, hsa
gagggcuccacaagcgugucuggcauucccacccaccauggaagacuggauacgcaccuggaaa

SEQ ID NO: 276263 - RNA, 64 nt, hsa
ugccacuguagccagaucuccaacagugccuuggaccauggacucauacucaacugaguaagaa

SEQ ID NO: 276264 - RNA, 64 nt, hsa
gauagacuggauuaagaaaauguggcacauauacaccauggaauacuaugcagccauaaagaag

SEQ ID NO: 276265 - RNA, 64 nt, hsa
uuacugauaguuucugugccagguucugggcuaaaccauggagauaaaaagaagaguaaaauac

SEQ ID NO: 276266 - RNA, 64 nt, hsa
ccagggugacccaacauccaguucuccggcucucaccauggaaacaaacugucccuguccccag

SEQ ID NO: 276267 - RNA, 64 nt, hsa
cccaugaagacagugccucccuccuccagcuguaaccauggauaccacacauuucucaucucau

SEQ ID NO: 276268 - RNA, 64 nt, hsa
agcuccaggaaggcuuugugggaaaugaguugagaccauggacuugggaguugggggccagagu

SEQ ID NO: 276269 - RNA, 64 nt, hsa
augugacaggcugugguggcaccacugagccuagaccauggagccuuggcaugcccagggcaag

SEQ ID NO: 276270 - RNA, 64 nt, hsa
ccagacaagguugaagcggaagcagccugugcggaaacgccagugacacguacacaccacgucc

SEQ ID NO: 276271 - RNA, 64 nt, hsa
agugaagcccaagccaggccugguugagggugauaaacgccacugucucuaaggguucugacuc

SEQ ID NO: 276272 - RNA, 64 nt, hsa
aaacugugcauaugaaaugggagaggagaugccaaaacgccagaugaaagcaaucaaguuucuu

SEQ ID NO: 276273 - RNA, 64 nt, hsa
acucagauuguaucuuuguacagaagaggauucaaaacgccacguguaguggcucaugccugua

SEQ ID NO: 276274 - RNA, 64 nt, hsa
gcuuguccaacaacuccaggaaaacuguuuuucaaaacgccauguccuaggggccgagggaaau

SEQ ID NO: 276275 - RNA, 64 nt, hsa
guguguguuuuuuaauagguuauuucugacagacaaacgccaaaaaaagaugaaagucuuguau

SEQ ID NO: 276276 - RNA, 64 nt, hsa
uucauuuuaauuuguagaaguacuuuacaguaggaaacgccaguaaacaacuuuuauacuguua

SEQ ID NO: 276277 - RNA, 64 nt, hsa
cagaguugccauggcaucggcuagugucuaaaggaaacgccaugaggcagggggcuggacuuca

SEQ ID NO: 276278 - RNA, 64 nt, hsa
uguaaugaauguuccaaaaugguagagugguagaaaacgccagaguaguuuagagcagaggaaa

SEQ ID NO: 276279 - RNA, 64 nt, hsa
aaagcauauaauauucucacguacuucuuucagcaaacgccaaacaguaguaauucuuguaacu

SEQ ID NO: 276280 - RNA, 64 nt, hsa
ccagcccucagaugugcuuauuggauuccaguacaaacgccaccaaagccagcccacugcucuc

SEQ ID NO: 276281 - RNA, 64 nt, hsa
acaaccaggaggagcuugagaggcugaacacccaaaacgccauugccuuccgcagagaccagag

SEQ ID NO: 276282 - RNA, 64 nt, hsa
cagaggaaguaaauguucacuuaaaugaaauugaaaacgccauguggcaccacaaaagagcucu

SEQ ID NO: 276283 - RNA, 64 nt, hsa
uaucauaguacuuuacauggauucacaugaacugaaacgccaccacuuggcccaggauguugaa

SEQ ID NO: 276284 - RNA, 64 nt, hsa
uggugucagcgcagcagccuacaacuaaguuccuaaacgccacuuuggacuaauuuaaaaaaga

SEQ ID NO: 276285 - RNA, 64 nt, hsa
cccaacccuuuccggaacucagucuuuagaaaagaaacgccagguucaagaauugcaaaccagc

SEQ ID NO: 276286 - RNA, 64 nt, hsa
uuuaaaguguggaaagcaaaauaacaaaaaagagaaacgccaacaaaaaucagcagauguugaa

SEQ ID NO: 276287 - RNA, 64 nt, hsa
ccuccucuccguccauaccuacaaggccaaggacaaacgccaucuucauccuucuuagaaagag

SEQ ID NO: 276288 - RNA, 64 nt, hsa
ucccaagucauguaauguauagugaauuuauccaaaacgccauuguaacguuuuuuacuagagu

SEQ ID NO: 276289 - RNA, 64 nt, hsa
cgugccacuucacuccagccugggcaaaagagcaaaacgccaucucaaaaaauauacauauaua

SEQ ID NO: 276290 - RNA, 64 nt, hsa
uggggaacccagcaggaaauuagaauagaaccaaaaacgccagucaugggaggcagagcugggg

SEQ ID NO: 276291 - RNA, 64 nt, hsa
cuccauguagcaaccaggacgaaguugagaaggaaaacgccaaaugcuuugguuauuagaguuu

SEQ ID NO: 276292 - RNA, 64 nt, hsa
caccaaaauuauuaauccucuugagagaaacgugaaacgccacaaaaauagagaaaauucaggu

SEQ ID NO: 276293 - RNA, 64 nt, hsa
ugcuuaggggaaugaaauugccauuuuucgggugaaacgccacaccuccagggucuuaagaguc

SEQ ID NO: 276294 - RNA, 64 nt, hsa
caaacccaccaaaccaacaggauaauugacaaauaaacgccauaggcuaggcugaacuguaugu

SEQ ID NO: 276295 - RNA, 64 nt, hsa
gccaccagauccucuugcaagauugccccaacuuaaacgccacauaaaacagcuccuaauugac

SEQ ID NO: 276296 - RNA, 64 nt, hsa
guuccccagcaacucuggccuccaaaaugggagaaaacgccaguguguuuaaauugauagcaga

SEQ ID NO: 276297 - RNA, 64 nt, hsa
uuauuuguguuaaucuauucaggaugcucuaagaaaacgccauagacuggguugcugacaaaca

SEQ ID NO: 276298 - RNA, 64 nt, hsa
aacuguucucuuggaugguuaccuuauuucuaagaaacgccacugaggaacaggauccacuuug

SEQ ID NO: 276299 - RNA, 64 nt, hsa
ucaggaguucgagaccagccugaccaacauggugaaacgccaucucuacuaaaaauacaaaaau

SEQ ID NO: 276300 - RNA, 64 nt, hsa
gcuucuagagauugaggugaaagcuucguccgagaaacgccaggacagacgauggcagaggaga

SEQ ID NO: 276301 - RNA, 64 nt, hsa
cuugaaucacguuaacuuuugagauuaaaaaaaaaaacgccauagcacagcugucuuuaugcaa

SEQ ID NO: 276302 - RNA, 64 nt, hsa
gcuggcucagaggggcccaccuugcguggaaugaaaacgccaaaggcucaugagcaacauuagg

SEQ ID NO: 276303 - RNA, 64 nt, hsa
cuucuggguuagccugcugacucuuaggcauggcaaacgccagugauauuugugaaggccuuua

SEQ ID NO: 276304 - RNA, 64 nt, hsa
ucaugcucuagagaaaauaauuuuauuuuuaaauaaacgccaaaaaaugucaaaaucucaagau

SEQ ID NO: 276305 - RNA, 64 nt, hsa
ugccucagucuccugagcagcugggauuacaggcaaacgccaccacacccagcuaaauuuuuuu

SEQ ID NO: 276306 - RNA, 64 nt, hsa
gaagcgccggagcaagaggcuguacgugaauuaaaaacgccaccuugggcucgagcagcgaccc

SEQ ID NO: 276307 - RNA, 64 nt, hsa
gaggcuuuuccaguguguauaaauccaugaaaauaaacgccaccugcaccccacccacucaccc

SEQ ID NO: 276308 - RNA, 64 nt, hsa
agaaaaaugggaagaaccaguuuuauccaucuuaaaacgccaggcaccucuucacaggugguaa

SEQ ID NO: 276309 - RNA, 52 nt, hsa
gggcagggagcagacagugagcaaacgccagcagggcugcugugaauuugug

SEQ ID NO: 276310 - RNA, 64 nt, hsa
uuugugucuuauuuuauuuuaccuucaaaaacaaaaacgccauccaaaaccaaggaaguccuug

SEQ ID NO: 276311 - RNA, 64 nt, hsa
gccaugucccccagccauggcauggcugcacuguaaacgccaaucggggggucaccaggaucaa

SEQ ID NO: 276312 - RNA, 64 nt, hsa
acgcaagggcgcugucccgcccaaccccgccuuuaaacgccacaaauaaagagcauuguuaccg

SEQ ID NO: 276313 - RNA, 64 nt, hsa
ccucugcccagcucaccacaucuucaucaccagcaaacgccaggacuuggcucccccauccuca

SEQ ID NO: 276314 - RNA, 64 nt, hsa
gguucuuucagcaggacaggcauuuacacugaugaaacgccacugggagugaggaagccagacu

SEQ ID NO: 276315 - RNA, 64 nt, hsa
gauaugaaaacucucaugaauaaacaucuccgugaaacgccaaggcccucgucaaacccugagu

SEQ ID NO: 276316 - RNA, 64 nt, hsa
agggugggcugugcccagcaggagucaggcuaagaaacgccaggucugccuguucuugcugggc

SEQ ID NO: 276317 - RNA, 64 nt, hsa
uucuaaaacuaauuugacaaaucaugacacuagaaaacgccaauguuuuaugucuuugcccauc

SEQ ID NO: 276318 - RNA, 64 nt, hsa
cacucucugcuucaucuaagaaaaccaauaccaaaaacgccacuuuaaugcucagcccugcguu

SEQ ID NO: 276319 - RNA, 64 nt, hsa
aacaggccuccauaccaggcauguguuucucucuaaacgccauuggguucucuagugcucauuu

SEQ ID NO: 276320 - RNA, 64 nt, hsa
aauauuuauaucauccagaaaagaaaaacacgagaaacgccaucgcgggauggugcagacgcgg

SEQ ID NO: 276321 - RNA, 64 nt, hsa
aggaagccccagaacacccacaggucuugguaacaaacgccaccuuacacucugcaggcugcag

SEQ ID NO: 276322 - RNA, 64 nt, hsa
ggcucaugugucugcugcgacucgagauggccugaaacgccacucauucucccacuucaguucg

SEQ ID NO: 276323 - RNA, 64 nt, hsa
acccaaccccaaacucccuguacagaagggaaacaaacgccaggcacgguggcucaugccugua

SEQ ID NO: 276324 - RNA, 64 nt, hsa
uccccaggaccauuccccugauccaacaguugcuaaacgccacggagcucacgcaggacccggc

SEQ ID NO: 276325 - RNA, 64 nt, hsa
auccaaagggugggagcacaucugcccugaaagaaaacgccacuggccauguggaauccauggc

SEQ ID NO: 276326 - RNA, 64 nt, hsa
gugcucacuaaaacaacuuuuuccauuuuuaauaaaacgccaaaaauaucacaacccaccaaaa

SEQ ID NO: 276327 - RNA, 64 nt, hsa
uauucccauaucaaaagacacaggggacacccagaaacgccacaucccccaauccaucagugcc

SEQ ID NO: 276328 - RNA, 64 nt, hsa
ucucuuccugaagaaacugaaguguccaacuuccucuaaguauugcuaugcaaaagcugcugua

SEQ ID NO: 276329 - RNA, 64 nt, hsa
uuguauuccuuuaaucaaaaaggaaacacaauauucuaaguaucuuuagcccaaauaccaugac

SEQ ID NO: 276330 - RNA, 64 nt, hsa
gugcaaaaaaaaagauucuguuauaaagugauuuucuaaguauuuccuaacuuuauuuuucaaa

SEQ ID NO: 276331 - RNA, 64 nt, hsa
aagccauuuucuagcaaaugucucuaugaagguuucuaaguaccugaaugggguuugauucuga

SEQ ID NO: 276332 - RNA, 64 nt, hsa
agaacccugucccuccggcccccaguuccuaccccagaaccaguuaacugugcuucagggguag

SEQ ID NO: 276333 - RNA, 64 nt, hsa
aggcccuggaucucaccagcagccaagguugagccagaaccagaacccugucccuccggccccc

SEQ ID NO: 276334 - RNA, 64 nt, hsa
gcuuauuaagaucacccagcaaguuaggagugaucagaaccagugaaguuuccauuuuucaucc

SEQ ID NO: 276335 - RNA, 64 nt, hsa
auggggaggcggggggggggggggguguugucugcagaaccaccaccuugaaagauccauguuc

SEQ ID NO: 276336 - RNA, 64 nt, hsa
aaggaccauucaagguucacuguuguuuuguccucagaaccaggagcuucagauccuaagucaa

SEQ ID NO: 276337 - RNA, 64 nt, hsa
aauuuuguuuguccaguauagcauuuaacugcaucagaaccaguaugaaaagaccaggaaucca

SEQ ID NO: 276338 - RNA, 64 nt, hsa
uggcagcuucaacaggcaggcaauaaucucuucccagaaccacugcagucaggaauaaacuguu

SEQ ID NO: 276339 - RNA, 64 nt, hsa
ggugggaggccugggcccggggccucccccgugacagaaccacacugggcagaggggucugcug

SEQ ID NO: 276340 - RNA, 64 nt, hsa
augcggucacccugcaaaagacuugcacuuuccucagaaccaacaugacgcagcucaauaaggg

SEQ ID NO: 276341 - RNA, 64 nt, hsa
ccuuucccacagacuucccuccuggguccagguucagaaccaagacuucuguaccuagugcugc

SEQ ID NO: 276342 - RNA, 64 nt, hsa
auaacugauaauguugguucagggaacacacuuucagaaccacugcuuuaauauuuuaaauaag

SEQ ID NO: 276343 - RNA, 64 nt, hsa
ucuccuguagacccaguggaacccauaaguaauucagaaccaucaaugaauucagauaugggaa

SEQ ID NO: 276344 - RNA, 64 nt, hsa
caggcaacaacugccccuucuuuaugcagaggugcagaaccagggacuccugggcccauccagg

SEQ ID NO: 276345 - RNA, 64 nt, hsa
gaagugggcaagcuggccaaaauauuggaacacacagaaccaaaccagguguguucuacaccug

SEQ ID NO: 276346 - RNA, 64 nt, hsa
accuugggugugagggaccaauccugugaccucccagaaccauggaagccaggacgucaggcug

SEQ ID NO: 276347 - RNA, 64 nt, hsa
acuaaggcagccuucuucacaggcugaggggguucagaaccagccuggccaaaaauuacaccag

SEQ ID NO: 276348 - RNA, 64 nt, hsa
cuccccguccccugcuccgaugcauaccucagugcagaaccacagaaucucugcagcggaaacg

SEQ ID NO: 276349 - RNA, 64 nt, hsa
acccacgggggcuccucccugccgggguccagcucagaaccacgggggucugugccggcagcac

SEQ ID NO: 276350 - RNA, 64 nt, hsa
gacauauuucaguuuccaccucacguuuuuagagcagaaccacacugucucccuggaggggcuc

SEQ ID NO: 276351 - RNA, 64 nt, hsa
cuccuagccaccagugauccccaagcauccaguacagaaccaggcaucgagcuagcucccugca

SEQ ID NO: 276352 - RNA, 64 nt, hsa
ugucugccugggcuccaagugggcaggaccaggacagaaccacaggcacacacugagggggcag

SEQ ID NO: 276353 - RNA, 64 nt, hsa
gcagcugugccacgggucagcugagccacagucccagaaccaagcucucggugucucgggccac

SEQ ID NO: 276354 - RNA, 64 nt, hsa
cccuagggcuucaguccuggggcagaggcauaaacagaaccagucacuauggaggucgaggauu

SEQ ID NO: 276355 - RNA, 64 nt, hsa
agggcuggcucgggcaggugggucacguggucugcagaaccaaagagaggaaucgccaaaacaa

SEQ ID NO: 276356 - RNA, 64 nt, hsa
uugucauguacucuuagaggaggccaguaaugaucagaaccauuuuacuuuaaaauuaauaaua

SEQ ID NO: 276357 - RNA, 64 nt, hsa
gggcucagaggggugagaccauuucccaaggucacagaaccagcucucuagucaccacccugcc

SEQ ID NO: 276358 - RNA, 64 nt, hsa
auuguuuuugacuaugggagucaacucaacauggcagaaccauuuuugagaugaugauacaaca

SEQ ID NO: 276359 - RNA, 64 nt, hsa
uucacacccuguuuuauaaacaacaucaaaauggcagaaccauugcugacuuuagguucacaug

SEQ ID NO: 276360 - RNA, 64 nt, hsa
gagagaagcugggcccagccgggccgugccugcuggcacagacgccuuaacgcuguguguauga

SEQ ID NO: 276361 - RNA, 64 nt, hsa
cuuucauuucugugggaggggcagagagguagguggcacagaagauggggcuuuaugcuuguaa

SEQ ID NO: 276362 - RNA, 64 nt, hsa
cugggaaggagacaggacauuccuguacuaagguggcacagagcuguccuuugcaacauucuca

SEQ ID NO: 276363 - RNA, 64 nt, hsa
cagagcuguccuuugcaacauucucauaaaauugggcacagaguucgcauuggcgcaauauuua

SEQ ID NO: 276364 - RNA, 64 nt, hsa
auuggcaagaggagcugguccauuccccauucauggcacagagcaguggcagggcccagcuagc

SEQ ID NO: 276365 - RNA, 64 nt, hsa
caggcggccgagcugccgaauucaguugacacgaggcacagaaaacaaauaucaaagaucuaau

SEQ ID NO: 276366 - RNA, 64 nt, hsa
uucuccccucucucagauuggccuggcagccccuggcacagagcagacccggccacugguagcu

SEQ ID NO: 276367 - RNA, 64 nt, hsa
ggccugcuccacuugucugggaaccugggcaggaggcacagaggaagccaaggccuggagcugc

SEQ ID NO: 276368 - RNA, 64 nt, hsa
ccaugaugugaaaccaaugacccugugaccacauggcacagaacacuaaauuuuggucccaugg

SEQ ID NO: 276369 - RNA, 64 nt, hsa
uuuguguagcuucagaguuagauugaaauuaccaggcacagauuuagucuugucauuuuguuua

SEQ ID NO: 276370 - RNA, 64 nt, hsa
ucugagggagcaagagcuggcaggcggcagggcuggcacagacagacggaagcagaaaggacag

SEQ ID NO: 276371 - RNA, 64 nt, hsa
ggugggggccagguucacugggaccagggcuacaggcacagagucuccuggaaaagggagaggg

SEQ ID NO: 276372 - RNA, 64 nt, hsa
cacaagaaagggaggguacgccaggcgagcccagggcacagaugcugagacagccucuccuucu

SEQ ID NO: 276373 - RNA, 64 nt, hsa
gugcagggacgucaccccugccaggcaagcccagggcacagaugccaggauggcuucucccucu

SEQ ID NO: 276374 - RNA, 64 nt, hsa
gugcagggacgucaccccugccaggcaagcccagggcacagaggccgggacggccucucccucu

SEQ ID NO: 276375 - RNA, 64 nt, hsa
agugugaggcuucacccaugcuaggcaagcccagggcacagaugccgggauggccccucccucu

SEQ ID NO: 276376 - RNA, 64 nt, hsa
gugcgggaacgucaccccugccaggcaagcccagggcacagaugcugcgauggccucuuccucu

SEQ ID NO: 276377 - RNA, 64 nt, hsa
gaaggagcagggcucuggagggauucgcauucaaggcacagaauuggccccuugccuguuuguu

SEQ ID NO: 276378 - RNA, 64 nt, hsa
gggaccaaaggaaaggaggaggugccgggggccuggcacagaccccuaggugccucgcuccaug

SEQ ID NO: 276379 - RNA, 64 nt, hsa; identical to SEQ ID NO: 70892

SEQ ID NO: 276380 - RNA, 64 nt, hsa; identical to SEQ ID NO: 70893

SEQ ID NO: 276381 - RNA, 64 nt, hsa; identical to SEQ ID NO: 70894

SEQ ID NO: 276382 - RNA, 64 nt, hsa; identical to SEQ ID NO: 70895

SEQ ID NO: 276383 - RNA, 64 nt, hsa; identical to SEQ ID NO: 70896

SEQ ID NO: 276384 - RNA, 64 nt, hsa; identical to SEQ ID NO: 70897

SEQ ID NO: 276385 - RNA, 64 nt, hsa; identical to SEQ ID NO: 70898

SEQ ID NO: 276386 - RNA, 64 nt, hsa; identical to SEQ ID NO: 70899

SEQ ID NO: 276387 - RNA, 64 nt, hsa; identical to SEQ ID NO: 70900

SEQ ID NO: 276388 - RNA, 64 nt, hsa; identical to SEQ ID NO: 70901

SEQ ID NO: 276389 - RNA, 64 nt, hsa; identical to SEQ ID NO: 70902

SEQ ID NO: 276390 - RNA, 64 nt, hsa; identical to SEQ ID NO: 70903

SEQ ID NO: 276391 - RNA, 64 nt, hsa; identical to SEQ ID NO: 70904

SEQ ID NO: 276392 - RNA, 64 nt, hsa; identical to SEQ ID NO: 70905

SEQ ID NO: 276393 - RNA, 64 nt, hsa; identical to SEQ ID NO: 70906

SEQ ID NO: 276394 - RNA, 64 nt, hsa; identical to SEQ ID NO: 70907

SEQ ID NO: 276395 - RNA, 64 nt, hsa
ugggggguggugaugauugucucagcacucacgcacugcacaagauggcagcaggauacagcac

SEQ ID NO: 276396 - RNA, 64 nt, hsa
ucacgcacugcacaagauggcagcaggauacagcacugcacaagauggcagcuccucugcagcu

SEQ ID NO: 276397 - RNA, 64 nt, hsa
ugcacagacagcugcgaccaggacgucagccagcacugcacagacagcugcgaccagagacugg

SEQ ID NO: 276398 - RNA, 64 nt, hsa
ugugaggccgugguuagcguggacaucagccagcacugcacagacagcugcgaccaggacguca

SEQ ID NO: 276399 - RNA, 64 nt, hsa
aaacuuuaguucacuugcaguaugcuuauccuugacugcacaugagaaugccuugugcagaguu

SEQ ID NO: 276400 - RNA, 64 nt, hsa
ggaggcagagcuugcagugagccgagauugugccacugcacacuccaaucugggugaaagaccg

SEQ ID NO: 276401 - RNA, 64 nt, hsa
cuugaaggaguuuaaaaggaggcuggaaaucaauacugcacacugcacauuugcucagaauugc

SEQ ID NO: 276402 - RNA, 64 nt, hsa
gaguuuaaaaggaggcuggaaaucaauacugcacacugcacauuugcucagaauugcacaucua

SEQ ID NO: 276403 - RNA, 64 nt, hsa
caacagaaaauaaauguguauuugugaauaacaaacugcacaaccugcaaaccaggagagaggg

SEQ ID NO: 276404 - RNA, 64 nt, hsa
uccgaacacagaacauuguuuggacggcagccccacugcacauaacagacccgugcaucuuccu

SEQ ID NO: 276405 - RNA, 64 nt, hsa
auuaguuuuauugaugcuugcugcagcaagagagacugcacaccacuggggucuaugggugcuu

SEQ ID NO: 276406 - RNA, 64 nt, hsa
auguauuugcaguuuucucuuuugauucaauuauacugcacauguuuuaaggaaaaguaacuua

SEQ ID NO: 276407 - RNA, 64 nt, hsa
aauuuugcaaaugugguuuuuuuacuuggaaauaacugcacauuuauauauaggauauuggacu

SEQ ID NO: 276408 - RNA, 64 nt, hsa
gaugguaagaauaguacaaacaccuuagcacaucacugcacacacaguauucugaaaggagauu

SEQ ID NO: 276409 - RNA, 64 nt, hsa
gcacaggcacacacauguacgcacacacacaugcacugcacacauauccaugcacacaaacaca

SEQ ID NO: 276410 - RNA, 64 nt, hsa
ccuccugacuguccuggaugugcaacugguuugcacugcacaccccacggccauguaacucucc

SEQ ID NO: 276411 - RNA, 64 nt, hsa
gacucucuauggaaaacgaggagcuucuguggaaacugcacaauggggaccuguguagccccaa

SEQ ID NO: 276412 - RNA, 64 nt, hsa
uuuuaaaccccaaggaaagccuacauccuugaaaacugcacagucgucaugggugaauuugccu

SEQ ID NO: 276413 - RNA, 64 nt, hsa
cuuggcuggagguccaauugccagagccucccacacugcacauacaaaggucugagcccagggc

SEQ ID NO: 276414 - RNA, 64 nt, hsa
acaaaggucugagcccagggcagcuucuggggccacugcacaggccaccugcuuggguuccucg

SEQ ID NO: 276415 - RNA, 64 nt, hsa
cucuugugagggccauuugggaccucccuggggcacugcacaauugauaguguaccaauagagg

SEQ ID NO: 276416 - RNA, 64 nt, hsa
agaagacuuuuauuuauuuuuuuuuaagauaaaaacugcacaaaaggggagugagagagacuag

SEQ ID NO: 276417 - RNA, 64 nt, hsa
uaacuuuuauggacuagaaggaaucacgagggcuacugcacaauacauggccuaaguucccucu

SEQ ID NO: 276418 - RNA, 64 nt, hsa
cagaucugaggaugggauuagcgaagcuguggagacugcacauccggaccugcccaugucucaa

SEQ ID NO: 276419 - RNA, 64 nt, hsa
ucaacccccacaccagguggugguaggcggugugacugcacagcgaggugccggaucugugagc

SEQ ID NO: 276420 - RNA, 64 nt, hsa
cuggccaugaucuggagagcaucaggcccgcaggacugcacaacucugccaggggugagguucu

SEQ ID NO: 276421 - RNA, 64 nt, hsa; identical to SEQ ID NO: 58312

SEQ ID NO: 276422 - RNA, 64 nt, hsa; identical to SEQ ID NO: 58313

SEQ ID NO: 276423 - RNA, 64 nt, hsa; identical to SEQ ID NO: 58314

SEQ ID NO: 276424 - RNA, 64 nt, hsa; identical to SEQ ID NO: 58315

SEQ ID NO: 276425 - RNA, 64 nt, hsa; identical to SEQ ID NO: 58316

SEQ ID NO: 276426 - RNA, 64 nt, hsa; identical to SEQ ID NO: 58317

SEQ ID NO: 276427 - RNA, 64 nt, hsa; identical to SEQ ID NO: 58318

SEQ ID NO: 276428 - RNA, 64 nt, hsa; identical to SEQ ID NO: 58319

SEQ ID NO: 276429 - RNA, 64 nt, hsa; identical to SEQ ID NO: 58320

SEQ ID NO: 276430 - RNA, 64 nt, hsa; identical to SEQ ID NO: 58321

SEQ ID NO: 276431 - RNA, 64 nt, hsa; identical to SEQ ID NO: 58322

SEQ ID NO: 276432 - RNA, 64 nt, hsa; identical to SEQ ID NO: 58323

SEQ ID NO: 276433 - RNA, 64 nt, hsa; identical to SEQ ID NO: 58324

SEQ ID NO: 276434 - RNA, 64 nt, hsa; identical to SEQ ID NO: 58325

SEQ ID NO: 276435 - RNA, 64 nt, hsa; identical to SEQ ID NO: 58326

SEQ ID NO: 276436 - RNA, 64 nt, hsa; identical to SEQ ID NO: 58327

SEQ ID NO: 276437 - RNA, 64 nt, hsa; identical to SEQ ID NO: 58328

SEQ ID NO: 276438 - RNA, 64 nt, hsa; identical to SEQ ID NO: 58329

SEQ ID NO: 276439 - RNA, 64 nt, hsa; identical to SEQ ID NO: 58330

SEQ ID NO: 276440 - RNA, 64 nt, hsa; identical to SEQ ID NO: 58331

SEQ ID NO: 276441 - RNA, 64 nt, hsa; identical to SEQ ID NO: 58332

SEQ ID NO: 276442 - RNA, 64 nt, hsa; identical to SEQ ID NO: 58333

SEQ ID NO: 276443 - RNA, 64 nt, hsa; identical to SEQ ID NO: 58334

SEQ ID NO: 276444 - RNA, 64 nt, hsa; identical to SEQ ID NO: 58335

SEQ ID NO: 276445 - RNA, 64 nt, hsa; identical to SEQ ID NO: 58336

SEQ ID NO: 276446 - RNA, 64 nt, hsa; identical to SEQ ID NO: 58337

SEQ ID NO: 276447 - RNA, 64 nt, hsa; identical to SEQ ID NO: 58338

SEQ ID NO: 276448 - RNA, 64 nt, hsa; identical to SEQ ID NO: 58339

SEQ ID NO: 276449 - RNA, 64 nt, hsa; identical to SEQ ID NO: 58340

SEQ ID NO: 276450 - RNA, 64 nt, hsa; identical to SEQ ID NO: 58341

SEQ ID NO: 276451 - RNA, 64 nt, hsa; identical to SEQ ID NO: 58342

SEQ ID NO: 276452 - RNA, 64 nt, hsa; identical to SEQ ID NO: 58343

SEQ ID NO: 276453 - RNA, 64 nt, hsa; identical to SEQ ID NO: 58344

SEQ ID NO: 276454 - RNA, 64 nt, hsa; identical to SEQ ID NO: 58345

SEQ ID NO: 276455 - RNA, 64 nt, hsa; identical to SEQ ID NO: 58346

SEQ ID NO: 276456 - RNA, 64 nt, hsa; identical to SEQ ID NO: 58347

SEQ ID NO: 276457 - RNA, 64 nt, hsa; identical to SEQ ID NO: 58348

SEQ ID NO: 276458 - RNA, 64 nt, hsa; identical to SEQ ID NO: 58349

SEQ ID NO: 276459 - RNA, 64 nt, hsa; identical to SEQ ID NO: 58350

SEQ ID NO: 276460 - RNA, 64 nt, hsa; identical to SEQ ID NO: 58351

SEQ ID NO: 276461 - RNA, 64 nt, hsa; identical to SEQ ID NO: 58352

SEQ ID NO: 276462 - RNA, 64 nt, hsa; identical to SEQ ID NO: 58353

SEQ ID NO: 276463 - RNA, 64 nt, hsa; identical to SEQ ID NO: 58354

SEQ ID NO: 276464 - RNA, 64 nt, hsa; identical to SEQ ID NO: 58355

SEQ ID NO: 276465 - RNA, 64 nt, hsa; identical to SEQ ID NO: 58356

SEQ ID NO: 276466 - RNA, 64 nt, hsa; identical to SEQ ID NO: 58357

SEQ ID NO: 276467 - RNA, 64 nt, hsa; identical to SEQ ID NO: 58358

SEQ ID NO: 276468 - RNA, 64 nt, hsa; identical to SEQ ID NO: 58359

SEQ ID NO: 276469 - RNA, 64 nt, hsa; identical to SEQ ID NO: 58360

SEQ ID NO: 276470 - RNA, 64 nt, hsa; identical to SEQ ID NO: 58361

SEQ ID NO: 276471 - RNA, 64 nt, hsa; identical to SEQ ID NO: 58362

SEQ ID NO: 276472 - RNA, 64 nt, hsa; identical to SEQ ID NO: 58363

SEQ ID NO: 276473 - RNA, 64 nt, hsa; identical to SEQ ID NO: 58364

SEQ ID NO: 276474 - RNA, 64 nt, hsa; identical to SEQ ID NO: 58365

SEQ ID NO: 276475 - RNA, 64 nt, hsa; identical to SEQ ID NO: 58366

SEQ ID NO: 276476 - RNA, 64 nt, hsa; identical to SEQ ID NO: 58367

SEQ ID NO: 276477 - RNA, 64 nt, hsa; identical to SEQ ID NO: 58368

SEQ ID NO: 276478 - RNA, 64 nt, hsa; identical to SEQ ID NO: 58369

SEQ ID NO: 276479 - RNA, 64 nt, hsa; identical to SEQ ID NO: 58370

SEQ ID NO: 276480 - RNA, 64 nt, hsa; identical to SEQ ID NO: 58371

SEQ ID NO: 276481 - RNA, 64 nt, hsa; identical to SEQ ID NO: 58372

SEQ ID NO: 276482 - RNA, 64 nt, hsa; identical to SEQ ID NO: 58373

SEQ ID NO: 276483 - RNA, 64 nt, hsa; identical to SEQ ID NO: 58374

SEQ ID NO: 276484 - RNA, 64 nt, hsa; identical to SEQ ID NO: 58375

SEQ ID NO: 276485 - RNA, 64 nt, hsa; identical to SEQ ID NO: 58376

SEQ ID NO: 276486 - RNA, 64 nt, hsa; identical to SEQ ID NO: 58377

SEQ ID NO: 276487 - RNA, 64 nt, hsa; identical to SEQ ID NO: 58378

SEQ ID NO: 276488 - RNA, 64 nt, hsa; identical to SEQ ID NO: 58379

SEQ ID NO: 276489 - RNA, 64 nt, hsa; identical to SEQ ID NO: 58380

SEQ ID NO: 276490 - RNA, 64 nt, hsa; identical to SEQ ID NO: 58381

SEQ ID NO: 276491 - RNA, 64 nt, hsa; identical to SEQ ID NO: 58382

SEQ ID NO: 276492 - RNA, 64 nt, hsa; identical to SEQ ID NO: 58383

SEQ ID NO: 276493 - RNA, 64 nt, hsa; identical to SEQ ID NO: 58384

SEQ ID NO: 276494 - RNA, 64 nt, hsa; identical to SEQ ID NO: 58385

SEQ ID NO: 276495 - RNA, 64 nt, hsa; identical to SEQ ID NO: 58386

SEQ ID NO: 276496 - RNA, 64 nt, hsa; identical to SEQ ID NO: 58387

SEQ ID NO: 276497 - RNA, 64 nt, hsa; identical to SEQ ID NO: 58388

SEQ ID NO: 276498 - RNA, 64 nt, hsa; identical to SEQ ID NO: 58389

SEQ ID NO: 276499 - RNA, 64 nt, hsa; identical to SEQ ID NO: 58390

SEQ ID NO: 276500 - RNA, 64 nt, hsa; identical to SEQ ID NO: 58391

SEQ ID NO: 276501 - RNA, 64 nt, hsa; identical to SEQ ID NO: 58392

SEQ ID NO: 276502 - RNA, 64 nt, hsa; identical to SEQ ID NO: 58393

SEQ ID NO: 276503 - RNA, 64 nt, hsa; identical to SEQ ID NO: 58394

SEQ ID NO: 276504 - RNA, 64 nt, hsa; identical to SEQ ID NO: 58395

SEQ ID NO: 276505 - RNA, 64 nt, hsa; identical to SEQ ID NO: 58396

SEQ ID NO: 276506 - RNA, 64 nt, hsa; identical to SEQ ID NO: 58397

SEQ ID NO: 276507 - RNA, 64 nt, hsa; identical to SEQ ID NO: 58398

SEQ ID NO: 276508 - RNA, 64 nt, hsa; identical to SEQ ID NO: 58399

SEQ ID NO: 276509 - RNA, 64 nt, hsa; identical to SEQ ID NO: 58400

SEQ ID NO: 276510 - RNA, 64 nt, hsa; identical to SEQ ID NO: 58401

SEQ ID NO: 276511 - RNA, 64 nt, hsa; identical to SEQ ID NO: 58402

SEQ ID NO: 276512 - RNA, 64 nt, hsa; identical to SEQ ID NO: 58403

SEQ ID NO: 276513 - RNA, 64 nt, hsa; identical to SEQ ID NO: 58404

SEQ ID NO: 276514 - RNA, 64 nt, hsa; identical to SEQ ID NO: 58405

SEQ ID NO: 276515 - RNA, 64 nt, hsa; identical to SEQ ID NO: 58406

SEQ ID NO: 276516 - RNA, 64 nt, hsa; identical to SEQ ID NO: 58407

SEQ ID NO: 276517 - RNA, 64 nt, hsa; identical to SEQ ID NO: 58408

SEQ ID NO: 276518 - RNA, 64 nt, hsa; identical to SEQ ID NO: 58409

SEQ ID NO: 276519 - RNA, 64 nt, hsa; identical to SEQ ID NO: 58410

SEQ ID NO: 276520 - RNA, 64 nt, hsa; identical to SEQ ID NO: 58411

SEQ ID NO: 276521 - RNA, 64 nt, hsa; identical to SEQ ID NO: 58412

SEQ ID NO: 276522 - RNA, 64 nt, hsa; identical to SEQ ID NO: 58413

SEQ ID NO: 276523 - RNA, 64 nt, hsa; identical to SEQ ID NO: 58414

SEQ ID NO: 276524 - RNA, 64 nt, hsa; identical to SEQ ID NO: 58415

SEQ ID NO: 276525 - RNA, 64 nt, hsa; identical to SEQ ID NO: 58416

SEQ ID NO: 276526 - RNA, 64 nt, hsa; identical to SEQ ID NO: 58417

SEQ ID NO: 276527 - RNA, 64 nt, hsa; identical to SEQ ID NO: 58418

SEQ ID NO: 276528 - RNA, 64 nt, hsa; identical to SEQ ID NO: 58419

SEQ ID NO: 276529 - RNA, 64 nt, hsa; identical to SEQ ID NO: 58420

SEQ ID NO: 276530 - RNA, 64 nt, hsa; identical to SEQ ID NO: 58421

SEQ ID NO: 276531 - RNA, 64 nt, hsa; identical to SEQ ID NO: 58422

SEQ ID NO: 276532 - RNA, 64 nt, hsa; identical to SEQ ID NO: 58423

SEQ ID NO: 276533 - RNA, 64 nt, hsa; identical to SEQ ID NO: 58424

SEQ ID NO: 276534 - RNA, 64 nt, hsa; identical to SEQ ID NO: 58425

SEQ ID NO: 276535 - RNA, 64 nt, hsa; identical to SEQ ID NO: 58426

SEQ ID NO: 276536 - RNA, 64 nt, hsa; identical to SEQ ID NO: 58427

SEQ ID NO: 276537 - RNA, 64 nt, hsa; identical to SEQ ID NO: 58428

SEQ ID NO: 276538 - RNA, 64 nt, hsa; identical to SEQ ID NO: 58429

SEQ ID NO: 276539 - RNA, 64 nt, hsa; identical to SEQ ID NO: 58430

SEQ ID NO: 276540 - RNA, 64 nt, hsa; identical to SEQ ID NO: 58431

SEQ ID NO: 276541 - RNA, 64 nt, hsa; identical to SEQ ID NO: 58432

SEQ ID NO: 276542 - RNA, 64 nt, hsa; identical to SEQ ID NO: 58433

SEQ ID NO: 276543 - RNA, 64 nt, hsa; identical to SEQ ID NO: 58434

SEQ ID NO: 276544 - RNA, 64 nt, hsa; identical to SEQ ID NO: 58435

SEQ ID NO: 276545 - RNA, 50 nt, hsa; identical to SEQ ID NO: 58436

SEQ ID NO: 276546 - RNA, 64 nt, hsa; identical to SEQ ID NO: 58437

SEQ ID NO: 276547 - RNA, 64 nt, hsa; identical to SEQ ID NO: 58438

SEQ ID NO: 276548 - RNA, 64 nt, hsa; identical to SEQ ID NO: 58439

SEQ ID NO: 276549 - RNA, 64 nt, hsa; identical to SEQ ID NO: 58440

SEQ ID NO: 276550 - RNA, 64 nt, hsa; identical to SEQ ID NO: 58441

SEQ ID NO: 276551 - RNA, 64 nt, hsa; identical to SEQ ID NO: 58442

SEQ ID NO: 276552 - RNA, 64 nt, hsa; identical to SEQ ID NO: 58443

SEQ ID NO: 276553 - RNA, 64 nt, hsa; identical to SEQ ID NO: 58444

SEQ ID NO: 276554 - RNA, 64 nt, hsa; identical to SEQ ID NO: 58445

SEQ ID NO: 276555 - RNA, 64 nt, hsa; identical to SEQ ID NO: 58446

SEQ ID NO: 276556 - RNA, 64 nt, hsa; identical to SEQ ID NO: 58447

SEQ ID NO: 276557 - RNA, 64 nt, hsa; identical to SEQ ID NO: 58448

SEQ ID NO: 276558 - RNA, 64 nt, hsa; identical to SEQ ID NO: 58449

SEQ ID NO: 276559 - RNA, 64 nt, hsa; identical to SEQ ID NO: 58450

SEQ ID NO: 276560 - RNA, 64 nt, hsa; identical to SEQ ID NO: 58451

SEQ ID NO: 276561 - RNA, 64 nt, hsa; identical to SEQ ID NO: 58452

SEQ ID NO: 276562 - RNA, 64 nt, hsa; identical to SEQ ID NO: 58453

SEQ ID NO: 276563 - RNA, 64 nt, hsa; identical to SEQ ID NO: 58454

SEQ ID NO: 276564 - RNA, 64 nt, hsa; identical to SEQ ID NO: 58455

SEQ ID NO: 276565 - RNA, 64 nt, hsa; identical to SEQ ID NO: 58456

SEQ ID NO: 276566 - RNA, 64 nt, hsa; identical to SEQ ID NO: 58457

SEQ ID NO: 276567 - RNA, 64 nt, hsa; identical to SEQ ID NO: 58458

SEQ ID NO: 276568 - RNA, 64 nt, hsa; identical to SEQ ID NO: 58459

SEQ ID NO: 276569 - RNA, 64 nt, hsa; identical to SEQ ID NO: 58460

SEQ ID NO: 276570 - RNA, 64 nt, hsa; identical to SEQ ID NO: 58461

SEQ ID NO: 276571 - RNA, 64 nt, hsa; identical to SEQ ID NO: 58462

SEQ ID NO: 276572 - RNA, 64 nt, hsa; identical to SEQ ID NO: 58463

SEQ ID NO: 276573 - RNA, 64 nt, hsa; identical to SEQ ID NO: 58464

SEQ ID NO: 276574 - RNA, 64 nt, hsa; identical to SEQ ID NO: 58465

SEQ ID NO: 276575 - RNA, 64 nt, hsa; identical to SEQ ID NO: 58466

SEQ ID NO: 276576 - RNA, 64 nt, hsa; identical to SEQ ID NO: 58467

SEQ ID NO: 276577 - RNA, 64 nt, hsa
gggaucuggggaaggaccaacccaugcccugccaagccuggagccccuguguuggggggcaagg

SEQ ID NO: 276578 - RNA, 64 nt, hsa
ccuggagccccuguguuggggggcaaggugggggagccuggagccccugugugggagggcgagg

SEQ ID NO: 276579 - RNA, 64 nt, hsa
ccuggagccccugugugggagggcgaggcgggggagccuggagccccugugugggagggcgagg

SEQ ID NO: 276580 - RNA, 64 nt, hsa
aggaggaucgucuugagcccaggaguucaagaccagccuggacaacauagugagaccuugucuc

SEQ ID NO: 276581 - RNA, 64 nt, hsa
gcuauguugagcugagaucacaccacuguacuccagccuggaugacagaguggagacucuguuu

SEQ ID NO: 276582 - RNA, 64 nt, hsa
ggauccucauugccaugguacucaaagguagaagagccuggaguuuguugcuucucuuugcuau

SEQ ID NO: 276583 - RNA, 64 nt, hsa
gagcagaaaaggaauugaggugggcaggcagaagagccuggauugcucacuguuuugggaaacu

SEQ ID NO: 276584 - RNA, 64 nt, hsa
gugaaauggaaucucccagaaccccugcccuggcagccuggaagaccgugccugcccagcccuc

SEQ ID NO: 276585 - RNA, 64 nt, hsa
gagcccugccucugggagcccccuaggaagcaccagccuggaccuaccaccugcggaggccugc

SEQ ID NO: 276586 - RNA, 64 nt, hsa
ccucugggcuugacaggucaaaaugguccccaucagccuggagcagcccuccagaccugggugg

SEQ ID NO: 276587 - RNA, 64 nt, hsa
gucagggcacaauucccucucauaaaaaccacacagccuggaaauuggcccuggcccuucaaga

SEQ ID NO: 276588 - RNA, 64 nt, hsa
cagcacccgaacacaucuuccuccuccccacccgagccuggagcacucuaacccucggagaccc

SEQ ID NO: 276589 - RNA, 64 nt, hsa
cuccggaaggggugaguggggaggggcuuuccugagccuggagcugggcuuuggggcagccugc

SEQ ID NO: 276590 - RNA, 64 nt, hsa
uguccuuaucuagaaacaugugaagaugcccaagagccuggaggcacugcuguccuuccugcag

SEQ ID NO: 276591 - RNA, 64 nt, hsa
uuuccuuuagcuucccugcuuccugggaaucaggagccuggacacugccaucucuagagcagag

SEQ ID NO: 276592 - RNA, 64 nt, hsa
ggggcagauugguucaugccugggguggaggcuaagccuggacacagucagggcggggcuggcc

SEQ ID NO: 276593 - RNA, 64 nt, hsa
ugcugcccgugaggagggggagaaggguuagacaagccuggaggacaaaacagcgggagugugg

SEQ ID NO: 276594 - RNA, 64 nt, hsa
aguuuggcuaaagguugguguaaaaaucaagagaagccuggaagacaucauggaugccauggau

SEQ ID NO: 276595 - RNA, 64 nt, hsa
gguauggaaggagcaggcacuggccugagcaugcagccuggagaguguucuugucucuagcagc

SEQ ID NO: 276596 - RNA, 64 nt, hsa
uguugccauuuaaugcauggauaaacuugcugcaagccuggauacaauuaaccauuuuauauuu

SEQ ID NO: 276597 - RNA, 64 nt, hsa
auaagcauguggucagaucauuuugugcauaugcagccuggauuggauguuaaguaaaugcuug

SEQ ID NO: 276598 - RNA, 64 nt, hsa
aauugucaaccagaaaauguuuaaauuuaccuacagccuggaagcacucacccccgcugcuucg

SEQ ID NO: 276599 - RNA, 64 nt, hsa
augcuuugcaaagcacccucaaaagcugcaccacagccuggagaauaaaauauccucagcccug

SEQ ID NO: 276600 - RNA, 64 nt, hsa
gguugcaugagccgagauggcgccacugcucuccagccuggacgacagagcaagacuccgucuc

SEQ ID NO: 276601 - RNA, 64 nt, hsa
gaaaaaagccugcucuccaguagccuggccugucagccuggaggaaucaggaaagaccccuucc

SEQ ID NO: 276602 - RNA, 64 nt, hsa
agagugucauguuuccacaaagggcugacaccugagccuggauuuucacucaucccugagaagc

SEQ ID NO: 276603 - RNA, 64 nt, hsa
ggacgcagguuauuuggggugaguggguggugggagccuggagcaagguggagggugcagaggg

SEQ ID NO: 276604 - RNA, 64 nt, hsa
gucuguguccuugagacuuggagcccugccucugagccuggacgggaaguguggccuguugugu

SEQ ID NO: 276605 - RNA, 64 nt, hsa
agauucauuucuaagacgcacucuggagccauguagccuggagucaacccauuuuccacggucu

SEQ ID NO: 276606 - RNA, 64 nt, hsa
gacuggcugcccccuagagccugccaggagcagaagccuggagggguggcagggcagagcagcc

SEQ ID NO: 276607 - RNA, 64 nt, hsa
caccgaggaacacugggcugagcacaugacagggagccuggagccccggggccuccagcgaggc

SEQ ID NO: 276608 - RNA, 64 nt, hsa
ccuggagcccaggaccuaaguccaccucaccuagagccuggaauuaggaucccagaguucagcc

SEQ ID NO: 276609 - RNA, 63 nt, hsa
gcuaccugcugcagcccugaaggccccuggccuagccuggagcccaggaccuaaguccaccuc

SEQ ID NO: 276610 - RNA, 64 nt, hsa
aaacacccggcccacgcgugcugcagauguggggagccuggaaacacccggcccacgcgugcug

SEQ ID NO: 276611 - RNA, 64 nt, hsa; identical to SEQ ID NO: 276610

SEQ ID NO: 276612 - RNA, 64 nt, hsa
ccugcgaggcagaguuaagaccugugacguggggagccuggaaacacccggcccacgcgugcug

SEQ ID NO: 276613 - RNA, 64 nt, hsa
accaacaggcuacagugucccugauucuuggaaaagccuggagaagcuggggagaugcgguuca

SEQ ID NO: 276614 - RNA, 64 nt, hsa
agcugcagaggcccagggagagcagcaggaagauagccuggagaaggugauuaaagauacggag

SEQ ID NO: 276615 - RNA, 64 nt, hsa
ucaggagcagccucagaacaaagugagacaguccagccuggagaugaaaucuuacagcugggug

SEQ ID NO: 276616 - RNA, 64 nt, hsa
guggcacugccaugcagggccucacacgguuugaagccuggaacaucaucaaggcacugccuga

SEQ ID NO: 276617 - RNA, 64 nt, hsa
aacacagcugggcaaguauuaauguauauggaacagccuggauuucugcauauggauaagccac

SEQ ID NO: 276618 - RNA, 64 nt, hsa
uggauaagccaccuuggaauaggaagagguguugagccuggacugugggaggaaagagcugcgu

SEQ ID NO: 276619 - RNA, 64 nt, hsa
uagggcaggcagcugggggcacuugguuccauggagccuggauaaacagugcuuuggaggcucu

SEQ ID NO: 276620 - RNA, 64 nt, hsa
agucaagagcuggaaccucccucagcucacuccgagccuggagaacugcaggggccaaggugga

SEQ ID NO: 276621 - RNA, 64 nt, hsa
ggcagucucugagugacggugacuguggccuugaagccuggaggacuguugggcauguagacug

SEQ ID NO: 276622 - RNA, 64 nt, hsa
aucuggggacacacuuuggaaagugggacccuccagccuggagaccccauggacugaugccucc

SEQ ID NO: 276623 - RNA, 64 nt, hsa
cgaccccaccucuguuccuaacaaagcgguugugagccuggauccgacucccggcagugcugac

SEQ ID NO: 276624 - RNA, 64 nt, hsa
aucugggaguagccccacugccaccugcagccgcagccuggacugcugcccacgagugaaccug

SEQ ID NO: 276625 - RNA, 64 nt, hsa
uugggaggccgaggcagguggauugcuugagcucagccuggacaacauggcaaaaccccaucua

SEQ ID NO: 276626 - RNA, 64 nt, hsa
caggaagauugcuugagcucaggaguuugaaaccagccuggacaacauauagcaagacucugcc

SEQ ID NO: 276627 - RNA, 64 nt, hsa
gcagcaggucagagcaggcgagcugacauucugcagccuggacggccauggcaggaagcuuuua

SEQ ID NO: 276628 - RNA, 64 nt, hsa
uuaauaguguaucauguuuucccuguugguauguagccuggauaaaugcucuuaauuauaaaaa

SEQ ID NO: 276629 - RNA, 64 nt, hsa
cauucuugcacaagucaugaaaauggagccagagagccuggacaucagggacuuuugcccacag

SEQ ID NO: 276630 - RNA, 64 nt, hsa
cauggcaauggucuccccacagaccgcaggacugagccuggagagagaaguugcuugacggaug

SEQ ID NO: 276631 - RNA, 64 nt, hsa
uucucccuagggaugggaagggggcauugaggcaagccuggagaggagcccggggagcaggguc

SEQ ID NO: 276632 - RNA, 64 nt, hsa
uuuuagaguuagugucugugcgggggcagcccugagccuggaguugagacuuuggggucucuua

SEQ ID NO: 276633 - RNA, 64 nt, hsa
gagaugaauguuacagaauuggacaacccgaacugcuuuucaaaaccagaggaaggagguucuu

SEQ ID NO: 276634 - RNA, 64 nt, hsa
cacagcagaggcucccugaccgggaggccugccugcuuuucagguuguuucccauguucagcgu

SEQ ID NO: 276635 - RNA, 64 nt, hsa
uuguaauccuaacaaacaaaagaaauguaguucagcuuuucaauguuucauguuugcugugcuu

SEQ ID NO: 276636 - RNA, 64 nt, hsa
ugcaguuuuuaccaagagcuaagccaauauaugugcuuuucaaccaguauugucacagcaugaa

SEQ ID NO: 276637 - RNA, 64 nt, hsa
acagguuugaauuaggcuaaaaggucuugcaguggcuuuucauggcccuucaaauuggaaugga

SEQ ID NO: 276638 - RNA, 64 nt, hsa
guaacuggaaggccuuccacuguggcaaauggaggcuuuucacugccuguagagacaauacagu

SEQ ID NO: 276639 - RNA, 64 nt, hsa
guuuagaccuaaaaccgaacaaucuguauuuuuugcuuuucauguguuuuuguccuagggguuc

SEQ ID NO: 276640 - RNA, 64 nt, hsa
uuaugauggucuguaucaaucagcagauuuuauugcuuuucauuauuuuacuguaaaggcaaag

SEQ ID NO: 276641 - RNA, 64 nt, hsa
ucacgugauuaagacccuacuccaaauuguagaagcuuuucaggaaccauauuacucucaugau

SEQ ID NO: 276642 - RNA, 64 nt, hsa
augaaaugcagguucacuaaaugugaacagcuuugcuuuucacgugauuaagacccuacuccaa

SEQ ID NO: 276643 - RNA, 64 nt, hsa
uaaaguucaguuguuuuuaaaagauucaauauuagcuuuucauaacaugauaguuuccuaaccu

SEQ ID NO: 276644 - RNA, 64 nt, hsa
uuugauuguuuuaucuccaacguguguaucuacagcuuuucaaaaaaucucuagcaaugguaaa

SEQ ID NO: 276645 - RNA, 64 nt, hsa
aguaaaagucaaaccaaacuuccucaagcugcaugcuuuucacaaaauccagaaagcauuuaag

SEQ ID NO: 276646 - RNA, 64 nt, hsa
uaguuuuuacaguaacaugaauaaagccaaaccugcuuuucauuuagcagcaaauuaaaguaac

SEQ ID NO: 276647 - RNA, 64 nt, hsa
auuagccuuaaaauucacaauuuugauuuuccuggcuuuucaggaauugacuaacuguaaaaga

SEQ ID NO: 276648 - RNA, 64 nt, hsa
acgucauuguuuauuuuuguuccuuugucuucuggcuuuucagcuguucuuuguagucccuuuu

SEQ ID NO: 276649 - RNA, 64 nt, hsa
ggugugagauguaacccaccuugaccauaaauuggcuuuucauagugcucagauguuucauaau

SEQ ID NO: 276650 - RNA, 64 nt, hsa
cuguggaucacgacaggaaaaagguuggagcagugcuuuucacuacuuuguaucaauccaggcu

SEQ ID NO: 276651 - RNA, 64 nt, hsa
uguauauuugauuuguugcaaauuugacauuauagcuuuucauaggcuuaauucuugcguauaa

SEQ ID NO: 276652 - RNA, 64 nt, hsa
auucauguguaauggugaauauuggaccacuacugcuuuucacauuuguaaauugguuuuaugu

SEQ ID NO: 276653 - RNA, 64 nt, hsa
uauagaaauguuuuauagugaaagauucaaauuugcuuuucaagaaaaaugccaaaagcuauuu

SEQ ID NO: 276654 - RNA, 64 nt, hsa
aggaauuguauaaccagaauuguuccugccuuuagcuuuucagaacuugagauguggcagcacu

SEQ ID NO: 276655 - RNA, 64 nt, hsa
aagaucuuguacuguguaacaguaacucuuuuuugcuuuucaguaauuuaauauguucacuuaa

SEQ ID NO: 276656 - RNA, 64 nt, hsa
gaggcagcucagcucuuaggagcaaguugugggggcuuuucaagaggggccaggcuuccuggag

SEQ ID NO: 276657 - RNA, 64 nt, hsa
uaucagugaggcaucucugacuguuucuucuacugcuuuucaguucccuucccugcuguucuau

SEQ ID NO: 276658 - RNA, 64 nt, hsa
uugcagugugggcuaagacaaaguauauuaauaagcuuuucagcccccccacucccguuccgua

SEQ ID NO: 276659 - RNA, 64 nt, hsa
ucaucuuaacuaacauucugaacuaguuagugcagcuuuucauuguguugugugguuggucuca

SEQ ID NO: 276660 - RNA, 64 nt, hsa
cuucagaugcagugagaccuggccuuccuguugugcuuuucagacuuuguuuucagaaugcuuu

SEQ ID NO: 276661 - RNA, 64 nt, hsa
cuccagccaucaccgcugugguuguucagggguagcuuuucaaaaacagggcagagccuggcug

SEQ ID NO: 276662 - RNA, 64 nt, hsa
gaguuuacaagaugucuggggguaaaagcacugugcuuuucagugguggcugcgugaaagggag

SEQ ID NO: 276663 - RNA, 64 nt, hsa
ccuuucuuagcuuauaucuucuucuuguaaaagugcuuuucaaccuuucucucccgaacaucuu

SEQ ID NO: 276664 - RNA, 64 nt, hsa; identical to SEQ ID NO: 45025

SEQ ID NO: 276665 - RNA, 64 nt, hsa; identical to SEQ ID NO: 45026

SEQ ID NO: 276666 - RNA, 64 nt, hsa; identical to SEQ ID NO: 45027

SEQ ID NO: 276667 - RNA, 64 nt, hsa; identical to SEQ ID NO: 45028

SEQ ID NO: 276668 - RNA, 64 nt, hsa; identical to SEQ ID NO: 45029

SEQ ID NO: 276669 - RNA, 64 nt, hsa; identical to SEQ ID NO: 45030

SEQ ID NO: 276670 - RNA, 64 nt, hsa; identical to SEQ ID NO: 45031

SEQ ID NO: 276671 - RNA, 64 nt, hsa; identical to SEQ ID NO: 45032

SEQ ID NO: 276672 - RNA, 64 nt, hsa; identical to SEQ ID NO: 45033

SEQ ID NO: 276673 - RNA, 64 nt, hsa; identical to SEQ ID NO: 45034

SEQ ID NO: 276674 - RNA, 64 nt, hsa; identical to SEQ ID NO: 45035

SEQ ID NO: 276675 - RNA, 64 nt, hsa; identical to SEQ ID NO: 45036

SEQ ID NO: 276676 - RNA, 64 nt, hsa; identical to SEQ ID NO: 45037

SEQ ID NO: 276677 - RNA, 64 nt, hsa; identical to SEQ ID NO: 45038

SEQ ID NO: 276678 - RNA, 64 nt, hsa; identical to SEQ ID NO: 45039

SEQ ID NO: 276679 - RNA, 64 nt, hsa; identical to SEQ ID NO: 45040

SEQ ID NO: 276680 - RNA, 64 nt, hsa; identical to SEQ ID NO: 45041

SEQ ID NO: 276681 - RNA, 64 nt, hsa; identical to SEQ ID NO: 45042

SEQ ID NO: 276682 - RNA, 64 nt, hsa; identical to SEQ ID NO: 45043

SEQ ID NO: 276683 - RNA, 64 nt, hsa; identical to SEQ ID NO: 45044

SEQ ID NO: 276684 - RNA, 64 nt, hsa; identical to SEQ ID NO: 45045

SEQ ID NO: 276685 - RNA, 64 nt, hsa; identical to SEQ ID NO: 45046

SEQ ID NO: 276686 - RNA, 64 nt, hsa; identical to SEQ ID NO: 45047

SEQ ID NO: 276687 - RNA, 64 nt, hsa; identical to SEQ ID NO: 45048

SEQ ID NO: 276688 - RNA, 64 nt, hsa; identical to SEQ ID NO: 45049

SEQ ID NO: 276689 - RNA, 64 nt, hsa; identical to SEQ ID NO: 45050

SEQ ID NO: 276690 - RNA, 64 nt, hsa; identical to SEQ ID NO: 45051

SEQ ID NO: 276691 - RNA, 64 nt, hsa; identical to SEQ ID NO: 45052

SEQ ID NO: 276692 - RNA, 64 nt, hsa; identical to SEQ ID NO: 45053

SEQ ID NO: 276693 - RNA, 64 nt, hsa; identical to SEQ ID NO: 45054

SEQ ID NO: 276694 - RNA, 64 nt, hsa; identical to SEQ ID NO: 45055

SEQ ID NO: 276695 - RNA, 64 nt, hsa; identical to SEQ ID NO: 45056

SEQ ID NO: 276696 - RNA, 64 nt, hsa; identical to SEQ ID NO: 45057

SEQ ID NO: 276697 - RNA, 64 nt, hsa; identical to SEQ ID NO: 45058

SEQ ID NO: 276698 - RNA, 64 nt, hsa; identical to SEQ ID NO: 45059

SEQ ID NO: 276699 - RNA, 64 nt, hsa; identical to SEQ ID NO: 45060

SEQ ID NO: 276700 - RNA, 64 nt, hsa; identical to SEQ ID NO: 45061

SEQ ID NO: 276701 - RNA, 64 nt, hsa; identical to SEQ ID NO: 45062

SEQ ID NO: 276702 - RNA, 64 nt, hsa; identical to SEQ ID NO: 45063

SEQ ID NO: 276703 - RNA, 64 nt, hsa; identical to SEQ ID NO: 45064

SEQ ID NO: 276704 - RNA, 64 nt, hsa; identical to SEQ ID NO: 45065

SEQ ID NO: 276705 - RNA, 64 nt, hsa; identical to SEQ ID NO: 45066

SEQ ID NO: 276706 - RNA, 64 nt, hsa
cuggcuccaucuuugagagcucuggugggcagggcagaaacaggccacagugcucaacccggac

SEQ ID NO: 276707 - RNA, 64 nt, hsa
uggugacucauugccuucacaccacuggguuugccagaaacagggaaggagggcguuaagggaa

SEQ ID NO: 276708 - RNA, 64 nt, hsa
gcaaugggaaggagccagaaaugccaucuucacccagaaacaaagaauacugaagccacucaag

SEQ ID NO: 276709 - RNA, 64 nt, hsa
uauuauaaauaacccagucucagauauucuguuacagaaacacaaaauggacuaagacaccacc

SEQ ID NO: 276710 - RNA, 64 nt, hsa
gaacuuuguuauggagggagcagccucacacaagcagaaacacuccuguggaugguauuguagc

SEQ ID NO: 276711 - RNA, 64 nt, hsa
guugccaauaaccugaagaagcuggcauuguuuacagaaacagaucaagggcuauaauuuaugu

SEQ ID NO: 276712 - RNA, 64 nt, hsa
cuaacucucccuugcucgcuguaaaaucuuggcacagaaacacaauauuuuguggcuuucuuuc

SEQ ID NO: 276713 - RNA, 62 nt, hsa
agccuucuuacauccuuuaaguucaaaagaaucagaaacaggugcaucuggggaacuagagg

SEQ ID NO: 276714 - RNA, 64 nt, hsa
gaaggauucaccaccuccaggaaaagugucuucucagaaacaaccagcugagaagguaauuaaa

SEQ ID NO: 276715 - RNA, 64 nt, hsa
aaaggagggaccaauaucugggacagugucuucucagaaacaaccagcugagaagguaauuaaa

SEQ ID NO: 276716 - RNA, 64 nt, hsa
aaagaagggacaacaaucugggacagugucuccucagaaacaaucggccuggaagguaguuacu

SEQ ID NO: 276717 - RNA, 64 nt, hsa
aauggguggugggaaaucuggaacagugucuucucagaaacaaccagccucaaagguaauuaaa

SEQ ID NO: 276718 - RNA, 64 nt, hsa
aaaggauggacuacagugugggacagugucuucucagaaacaaccagccuugaagguaauuaaa

SEQ ID NO: 276719 - RNA, 64 nt, hsa
aaaggauggagaaaaaucugggacagugucuucucagaaacaaccagccuugaagguaauuaaa

SEQ ID NO: 276720 - RNA, 64 nt, hsa
ugcaaaugcaguuccuuucauaauaucucagcaccagaaacaaaaauuaagauuaucaaagcau

SEQ ID NO: 276721 - RNA, 64 nt, hsa
ugugaagacaacagcagaaaugcuaacaagcgugcagaaacaccagagagugcguauccugcuc

SEQ ID NO: 276722 - RNA, 64 nt, hsa
aguggucagguuuccccugaccuucccucacccccagaaacacuugcuuacagaccgaaacugg

SEQ ID NO: 276723 - RNA, 64 nt, hsa
ucuuuugaucuuuuucuagaagguacuaagaagacagaaacaagcaaagccgccaccacagagc

SEQ ID NO: 276724 - RNA, 64 nt, hsa
uacaguauaggcuggaaagaccuuaucugaaggucagaaacauugacucagaaaaaagguauga

SEQ ID NO: 276725 - RNA, 64 nt, hsa
agcaggauaauuaauuugcuaagcccauccucugcagaaacagaaaaaucuaucuucccaucuc

SEQ ID NO: 276726 - RNA, 64 nt, hsa
uuacaaguugcuaguuuauaaugucuuacuaaugcagaaacaaggaaaaaagcaaaauuggccu

SEQ ID NO: 276727 - RNA, 64 nt, hsa
guuugcaaaagugcuuuuauacauuuucuaauuucagaaacaggauaauuuguuaaguggguuu

SEQ ID NO: 276728 - RNA, 64 nt, hsa
guggccaugccuaccuguuuuguuuuuuuaagaacagaaacaacuauuuuaaaagaacucuuuu

SEQ ID NO: 276729 - RNA, 64 nt, hsa
augcucacugcuaagcuacaaacucggacagggucagaaacagaggugucccaucccauugcag

SEQ ID NO: 276730 - RNA, 64 nt, hsa
ugguggcagaaacaugcauuugccauaaauaauucagaaacacuuguaugguccuguaaaacuu

SEQ ID NO: 276731 - RNA, 64 nt, hsa
cugcccguguccacacaggaauguacacugguggcagaaacaugcauuugccauaaauaauuca

SEQ ID NO: 276732 - RNA, 64 nt, hsa
gaauaauuuuuaaaucuguaaaugucuauaugagcagaaacaaaacauuguguaacauguuuua

SEQ ID NO: 276733 - RNA, 64 nt, hsa
ucuaaaacuauuuucucuuugcccuuaccacucccagaaacauaagugaccaauuuaaaaugcu

SEQ ID NO: 276734 - RNA, 64 nt, hsa
gacauuaugggagcuucaaaauuguaucaugauacagaaacacuccuuagcacuuuaagaaagu

SEQ ID NO: 276735 - RNA, 64 nt, hsa
aggaagauaguaucucagaaugaccagagcagcacagaaacaagcuacucugacauuaugggag

SEQ ID NO: 276736 - RNA, 64 nt, hsa
cacacaguuggcagcacauagcguuuccuucuuucagaaacauuccucuucuggggcuucagaa

SEQ ID NO: 276737 - RNA, 64 nt, hsa
guguauguguguacacacgcucugucuuuaaugacagaaacacaaaaaccagcuggccuugcag

SEQ ID NO: 276738 - RNA, 64 nt, hsa
agguucuauagauuuuuaacuaguccaacacagucagaaacauuguuuugaauccucuguaaac

SEQ ID NO: 276739 - RNA, 64 nt, hsa
acccaugccuuaaagaggggcaguuucucaaaagcagaaacaugccgccaguucucaaguuuuc

SEQ ID NO: 276740 - RNA, 64 nt, hsa
uucaguccugcuugggaggacgcagcccacugcccagaaacaagaaacacgauaccauucuggc

SEQ ID NO: 276741 - RNA, 64 nt, hsa
aggugguguucuauaccuaaaggaugaccugcuccagaaacagcaccagcacagcauguauuuu

SEQ ID NO: 276742 - RNA, 64 nt, hsa
guauugagacugaggagaaugauagagagugaagcagaaacaggagcacagaccucugcuguag

SEQ ID NO: 276743 - RNA, 64 nt, hsa
uuccaguaagaacucaauuugucucccaaauuugcagaaacaaaacgugauuuaaaagcugagc

SEQ ID NO: 276744 - RNA, 64 nt, hsa
ccaaauuaaaacaaacaaaaccgcaacuccuccacagaaacacaaacacaguuauuccaugaag

SEQ ID NO: 276745 - RNA, 64 nt, hsa
uuuuaaucuuauaagauauuuuucuaaguauuuccagaaacauuugagagugcccaucauuuuc

SEQ ID NO: 276746 - RNA, 64 nt, hsa
gaaagacauaugaaaggaauuguaauuggcuuaacagaaacagucuguaaaaaccuaacagugg

SEQ ID NO: 276747 - RNA, 64 nt, hsa
accagcaccuaaaaagacucuuuucaaaaaaucacagaaacaaccuaggacaauuauuuguuac

SEQ ID NO: 276748 - RNA, 64 nt, hsa
uuaugguugaguuuccauauaaguggaccagacacagaaacaaacagaaugagcuaguaagcga

SEQ ID NO: 276749 - RNA, 64 nt, hsa
uuuuucaauuuuauuuuaguucuaaauuauguuucagaaacaaaagacaaugcuguacaguuuu

SEQ ID NO: 276750 - RNA, 64 nt, hsa
caugggcagccuggugcaauuccauucauuuguacagaaacauuuuugaaaaauucuuuucaau

SEQ ID NO: 276751 - RNA, 64 nt, hsa
agcccagugccaugacugcccgcggauugaaaaacagaaacacaaaacuuugacuugacuugcg

SEQ ID NO: 276752 - RNA, 64 nt, hsa
cuucagccaggagcuccugggugcauuuccgugucagaaacaguaccgagucccacccccucug

SEQ ID NO: 276753 - RNA, 64 nt, hsa
uguagcccaucugagagguugggaaacugaggcccagaaacaggaagugacucacacaagaccc

SEQ ID NO: 276754 - RNA, 64 nt, hsa
uacucagucuacugauucaaaugcuaaucucuuccagaaacagccucacagacacacccagaca

SEQ ID NO: 276755 - RNA, 64 nt, hsa
auagacaguauuauuacauucaguauuacaauggcagaaacagacagaaaggguggaguaauuu

SEQ ID NO: 276756 - RNA, 64 nt, hsa
cugaaauucacaaaguuaaacgugaugugcucaucagaaacaauuucuguguccuguuuuuauu

SEQ ID NO: 276757 - RNA, 64 nt, hsa
uuuauucccuucaaugcaaaauacaugaugauuucagaaacaaagcauuugacuuucugucugu

SEQ ID NO: 276758 - RNA, 64 nt, hsa
ccauuaucuuguaugugcacauuuuauaaauguacagaaacaucaccaacuuaauuuucuucca

SEQ ID NO: 276759 - RNA, 64 nt, hsa
uaugauuuuuaaaagcaguucaaguugacaacagcagaaacaguaacaaaaaaaucugcucaga

SEQ ID NO: 276760 - RNA, 64 nt, hsa
ccauuaucuuguaugugcacauuuuauaaauguacagaaacaucaccaacuugauuuucuucca

SEQ ID NO: 276761 - RNA, 64 nt, hsa; identical to SEQ ID NO: 276759

SEQ ID NO: 276762 - RNA, 64 nt, hsa; identical to SEQ ID NO: 247795

SEQ ID NO: 276763 - RNA, 64 nt, hsa; identical to SEQ ID NO: 247796

SEQ ID NO: 276764 - RNA, 64 nt, hsa
gauccaugguacaggcuacugcuaaacuuggcacaguaucaaguauaguaccuccaaggaccag

SEQ ID NO: 276765 - RNA, 64 nt, hsa
aggcccugugcaggaccagaaguaauuauacuaaaguaucaagaaagggaguuagggcuuaaac

SEQ ID NO: 276766 - RNA, 64 nt, hsa
cauuaauugaauauacuuuaaauauauauauuaaaguaucaaaauauagagagacauuugaacu

SEQ ID NO: 276767 - RNA, 64 nt, hsa
uuuuugagaagucugccccuauuuauuuuuaguaaguaucaagagguagccugagccuaguuag

SEQ ID NO: 276768 - RNA, 64 nt, hsa
ucuuccguauucacugaaaaauaaaugcuuguuuaguaucaaauuuuauuucacgaaaguuuuu

SEQ ID NO: 276769 - RNA, 64 nt, hsa
ugguuguagugcaugucuuggaguuaaacucuuaaguaucaagaaguaaaauaauuucauuguu

SEQ ID NO: 276770 - RNA, 64 nt, hsa
ugauaggcaaggaugaaagacaaagaaggaaaagaguaucaaaggcagaaaggagaucauuuag

SEQ ID NO: 276771 - RNA, 64 nt, hsa
uacagugcuuuauggcucuaacauuacugccuucaguaucaaggcugccuggagaaaggauggc

SEQ ID NO: 276772 - RNA, 64 nt, hsa
aucuuuuugcauuuauuauguaaaacuguuuuacaguaucaaaauuuuucacuuaaagaaaaaa

SEQ ID NO: 276773 - RNA, 64 nt, hsa
uguaaaacguguaauaaguugaguaucuacgaagaguaucaaguucugaaguuuaauuuuuuua

SEQ ID NO: 276774 - RNA, 64 nt, hsa
uacugaacugaacuuucugaaaacguaauguagcaguaucaauauacuuuugggcauaaaaaua

SEQ ID NO: 276775 - RNA, 64 nt, hsa
uuuauuuguauucgaucuguguuaccugggauccaguaucaaauauauccacauucuuuaucag

SEQ ID NO: 276776 - RNA, 64 nt, hsa
uuuaagauuuuucaucacuaacauauccauuaaaaguaucaacuggccaggcaggguggcucac

SEQ ID NO: 276777 - RNA, 64 nt, hsa
gcaagacacugucucaaaaaaaaaaaaaaaaaaaaguaucaaccaacaaauguuaccaagauaa

SEQ ID NO: 276778 - RNA, 64 nt, hsa
uccaaguuaccaauuuuuuaaaauuuauaggcaaaguaucaaauugucuucuuaauaugauaaa

SEQ ID NO: 276779 - RNA, 64 nt, hsa
aagauguguguucacaauagaccauaacuccucuaguaucaaaauuggggcucuucaguuaaaa

SEQ ID NO: 276780 - RNA, 64 nt, hsa
uuaaaucauaaauucuugaaguuaaauuuggcagaguaucaaaagggggaaaaugacaaaguga

SEQ ID NO: 276781 - RNA, 64 nt, hsa
ugguuagauguuguagcaacaucauaaaaucaagaguaucaagaaaauaaaugagcauagcaau

SEQ ID NO: 276782 - RNA, 64 nt, hsa
gagaaaaauguguggcaagaugauacagcuacacaguaucaaaugaaugggucaauucagcacc

SEQ ID NO: 276783 - RNA, 64 nt, hsa
ccucacgccaggccccguccugccgugacacccuucauccuacccuuggaaccccaaggccaag

SEQ ID NO: 276784 - RNA, 64 nt, hsa
gagauaaagcaacagccugcccagaucccucuguucauccuaucccuuccaagguugguccaug

SEQ ID NO: 276785 - RNA, 64 nt, hsa
uauguaggaaaaacaaucuugccaaauaaugaauucauccuaggauguguagacaauaaucugc

SEQ ID NO: 276786 - RNA, 64 nt, hsa
uccauaugcaaaaguccugcaugccucaacuuucucauccuaaaacuggaaacuuauuucucau

SEQ ID NO: 276787 - RNA, 64 nt, hsa
ucccuccacccagaaaacugcccuuuucuuucucucauccuacauagcugccuggcaaaucccu

SEQ ID NO: 276788 - RNA, 64 nt, hsa
aaccucccccaauccauacacauacauaccuaggucauccuaucacccaaaagagggacaaaca

SEQ ID NO: 276789 - RNA, 64 nt, hsa
aaaggcaucuuucugaauuucauucucuugaaggugcugccaccccuuggcacuguggaacugc

SEQ ID NO: 276790 - RNA, 64 nt, hsa
ccacuuccugccccaacugcaggaaugcugacaaugcugccaugcccaccaucggguguaggug

SEQ ID NO: 276791 - RNA, 64 nt, hsa
caguuucuguugcugccaaaguaauguggcucucugcugccacccugugcugcugaggugcgua

SEQ ID NO: 276792 - RNA, 64 nt, hsa
ccauggggcugccgggcuggccgccaguuucuguugcugccaaaguaauguggcucucugcugc

SEQ ID NO: 276793 - RNA, 64 nt, hsa
acucccagcggggcucccugagcucucaaggagaugcugccaucacugggaggcucagaggacc

SEQ ID NO: 276794 - RNA, 64 nt, hsa
gauuuaaugagcgugggccuggaccuuccccagaugcugccaggcagccccuccccaagccuca

SEQ ID NO: 276795 - RNA, 64 nt, hsa
ccugccugcugcucccuuuuucugucucuguccaugcugccauguuucucugcugccaaauugg

SEQ ID NO: 276796 - RNA, 64 nt, hsa
uuuuucugucucuguccaugcugccauguuucucugcugccaaauugggccccuuggccccuuc

SEQ ID NO: 276797 - RNA, 64 nt, hsa
cuggaccccagggacuugccuuccccacccacucugcugccagcaggcccagggaucccugacc

SEQ ID NO: 276798 - RNA, 64 nt, hsa
ggccacaguucugggagccuucaacccuggcucaugcugccauagucuccacggugcccuucac

SEQ ID NO: 276799 - RNA, 64 nt, hsa
gucuguggcauguuugaccuguggcaggacucgcugcugccaggugagucaccgccuguccugc

SEQ ID NO: 276800 - RNA, 64 nt, hsa
augccaucucugucucccugggugccagcagcccugcugccaugugcacugggguggcacugga

SEQ ID NO: 276801 - RNA, 64 nt, hsa
ggccugugggcagccgcgccagcugccgggacacugcugccagaccugcccccaggguaagucu

SEQ ID NO: 276802 - RNA, 64 nt, hsa
caggcaggccagggcugcgcaucaguggacacauugcugccaggaagagcugcgacggugaggc

SEQ ID NO: 276803 - RNA, 64 nt, hsa
uucucccaaguuccagagccucuccgggccucagugcugccaucuguacaaugguggagugagu

SEQ ID NO: 276804 - RNA, 64 nt, hsa
uugggccgggaguacaagcugcccauggacgaccugcugccacuucucaucuacguggugucgc

SEQ ID NO: 276805 - RNA, 64 nt, hsa
cccacagaccuaauauauguccggacagcuuggaugcugccacguaaggucacugcuguggcga

SEQ ID NO: 276806 - RNA, 64 nt, hsa
gaagaccuggagggcagccacacagcuggacggaugcugccacaucugggcauacagugucugg

SEQ ID NO: 276807 - RNA, 64 nt, hsa
gucaugacuugggggugcuacuagaagccaggaaugcugccaaacauucuaccaugcacagcac

SEQ ID NO: 276808 - RNA, 64 nt, hsa
cugaaaaugaacuuuuguuucuaaaguuggaccuugcugccaugacuguuuaguuuacagaaac

SEQ ID NO: 276809 - RNA, 64 nt, hsa
gggaauacuuuuacuacucagaaaugaauuuaugugcugccauuugcuauaaaguugaacuuug

SEQ ID NO: 276810 - RNA, 64 nt, hsa
aucagaaaaccuaccaaacaaaaacaucagaagcugcugccauaaugacuauuuucuacuguag

SEQ ID NO: 276811 - RNA, 64 nt, hsa
guuggcucugauuugaaaucgggagaaacagagcugcugccaaugggaucuuuuagguaacucc

SEQ ID NO: 276812 - RNA, 64 nt, hsa
cuagcuuccgugugucugugcagugcccaugagcugcugccaaugggaucuuucagguaccccc

SEQ ID NO: 276813 - RNA, 64 nt, hsa
gggaucgcccugcuggcugccggcaccgcccuccugcugccagagacgaggcaggcacagcugc

SEQ ID NO: 276814 - RNA, 64 nt, hsa
ugggaguaucgaacccucugccuagggccggaguugcugccaguacccgcucccucugcucauc

SEQ ID NO: 276815 - RNA, 64 nt, hsa
gcccguaccgccaacucgggucacaccugaacgcugcugccagccgaugccccagcccugcacg

SEQ ID NO: 276816 - RNA, 64 nt, hsa
cucgccacaccuacuggggcaucuggcuggugccugcugccauggccagcccccacucucaccc

SEQ ID NO: 276817 - RNA, 64 nt, hsa
ucucccuucuuuaccuucauuucauccuguuggcugcugccaccaaaucugucuagaauccugc

SEQ ID NO: 276818 - RNA, 64 nt, hsa
ucaauaaauauuuguuugggugguuugugagccuugcugccaaguccugccuuugggucgacau

SEQ ID NO: 276819 - RNA, 64 nt, hsa
aauugugcugccauuugauuuuucuaaccuugaaugcugccaguguggaguggguaauccaggc

SEQ ID NO: 276820 - RNA, 64 nt, hsa
aaauuccagaagaagagaagcugcugaccaauugugcugccauuugauuuuucuaaccuugaau

SEQ ID NO: 276821 - RNA, 64 nt, hsa
cugccauccucccacuugcagugcaggaucccacugcugccaaagagaugggacaaggaaccuc

SEQ ID NO: 276822 - RNA, 64 nt, hsa
cccagaccuggacuccaaggccggccugcgcacuugcugccaccagaaacuggaggacaugauc

SEQ ID NO: 276823 - RNA, 64 nt, hsa
gacagagaaaggggcuguggugcuuguugguugaugcugccauguaagcuggacuccugggacu

SEQ ID NO: 276824 - RNA, 64 nt, hsa
uucaacagcgcucaugucucuuggcccagucaggugcugccagguuuagauaggaaaguacaug

SEQ ID NO: 276825 - RNA, 64 nt, hsa
uaaugccugaccuuugagaugcucaguucucuggugcugccaaaagaugcuuccaugguccgug

SEQ ID NO: 276826 - RNA, 64 nt, hsa
uggucaacccacgcagaagaaacagaagaacucaugcugccagauagauagaaaaagaagcaug

SEQ ID NO: 276827 - RNA, 64 nt, hsa
uguucaaagucuacuagcucgcauuaguuucuguugcugccaacagaucugaacuaaugcuaac

SEQ ID NO: 276828 - RNA, 64 nt, hsa
aagcucuucacuaugacaguaaaggcucucugccugcugccaaggccugugacuuucuaaccug

SEQ ID NO: 276829 - RNA, 64 nt, hsa
caaacuccccguuccugcguaguccgcuuucucuugcugccacauucuaaaggcuugauauuuu

SEQ ID NO: 276830 - RNA, 64 nt, hsa
gcaagcuggcgugugccagggcucgagucccacgugcugccaacucaaacauagccuccuuccc

SEQ ID NO: 276831 - RNA, 64 nt, hsa
cccggcuccccuaaagguagaagauacucgagcaugcugccaggggagcuggauggugaaacac

SEQ ID NO: 276832 - RNA, 64 nt, hsa
cugugccuguuaugaaugaaaaauccauccacucugcugccauucacagccuaauuuucuggag

SEQ ID NO: 276833 - RNA, 64 nt, hsa
ugccuuuucagcugcacuauuuaauuaugguaccugcugccacucaucacagagcccuucuugg

SEQ ID NO: 276834 - RNA, 64 nt, hsa
ugaugggccaagggaaggcuaucagagacccuggugcugccaccugccccuacucaagugucua

SEQ ID NO: 276835 - RNA, 64 nt, hsa
uaagggagggccuggggagccccacccuagcccuugcugccacaccacauugccucaacaaccg

SEQ ID NO: 276836 - RNA, 64 nt, hsa
gaaacguggugucaucugaugcauuuggaccauaugcugccagacugcagaacgggggagccgg

SEQ ID NO: 276837 - RNA, 64 nt, hsa
cagccuagcgaugccgcuggccagaccgugaccaugcugccagugugcucgccaugagcugggu

SEQ ID NO: 276838 - RNA, 64 nt, hsa
ucagucuccuuggugauuaagguccugcuugaacugcugccaacuccaugucagggaagucgcu

SEQ ID NO: 276839 - RNA, 64 nt, hsa
aaaggucuauggcucaugucugaaaaaugccugcugcugccaaguuagcuauugggagcaaucu

SEQ ID NO: 276840 - RNA, 64 nt, hsa
accacaaccugucucccaguccugcucucaccccugcugccacacacaugcccugagcagccag

SEQ ID NO: 276841 - RNA, 64 nt, hsa
uucugcacuagggcucugugcuggaacccaggcaugcugccagccuuuucucuggaucugucag

SEQ ID NO: 276842 - RNA, 64 nt, hsa
cuccugcugcaucuccaguugcugccgccccaacugcugccagaccaugugcugccgcccaacc

SEQ ID NO: 276843 - RNA, 64 nt, hsa
caccugcugccaccccagcuauugcauuuccagcugcugccagccuuccugcaguaucucuagc

SEQ ID NO: 276844 - RNA, 64 nt, hsa
caucugcuggcaaaccaccugcuacaggaccaccugcugccaccccagcuauugcauuuccagc

SEQ ID NO: 276845 - RNA, 64 nt, hsa
gccacugugcugaggcccugcagugucugcucacugcugccaucuucgcugcuagucaggguuc

SEQ ID NO: 276846 - RNA, 64 nt, hsa
ugauuccuguguggggagaagcucaguggccguuugcugccacugacaaggauuucacaugcag

SEQ ID NO: 276847 - RNA, 64 nt, hsa
gacggaaaacagaccucggggcuggcguaaacccugcugccaggcccucuccccacugccccaa

SEQ ID NO: 276848 - RNA, 64 nt, hsa
acaguaaccaaacacauacauggauuuugccaagugcugccaguagccaaaacaaagucuuuuu

SEQ ID NO: 276849 - RNA, 64 nt, hsa
agagccuacugcugcucuccacucaacuggccucugcugccaggccacugccugucucugcuuc

SEQ ID NO: 276850 - RNA, 64 nt, hsa
ucugagccucccuggagaagguauuuuauaugucugcugccagcugcuggucuccacacccuca

SEQ ID NO: 276851 - RNA, 64 nt, hsa
cuggggagaugcugccagcacacaggggcccuccugcugccagcagguuggggugguuaagucu

SEQ ID NO: 276852 - RNA, 64 nt, hsa
gugggugcaggugagccggcguguccuggggagaugcugccagcacacaggggcccuccugcug

SEQ ID NO: 276853 - RNA, 64 nt, hsa
ccugcugccaggcuuacaucuucccagagaacuaugcugccacuucacauccacucaccacauc

SEQ ID NO: 276854 - RNA, 64 nt, hsa
agaccacccauagcccugcugcugccaccugcccugcugccaggcuuacaucuucccagagaac

SEQ ID NO: 276855 - RNA, 64 nt, hsa
uguuacaaacugcgcagaccacccauagcccugcugcugccaccugcccugcugccaggcuuac

SEQ ID NO: 276856 - RNA, 64 nt, hsa
uccagaaacacccacaggcaugucccaugugagcugcugccaugaacugucaaguguguguugu

SEQ ID NO: 276857 - RNA, 64 nt, hsa
caguccccagaacucugccugcccuuuguccuccugcugccaguaccagccccacccuguuuug

SEQ ID NO: 276858 - RNA, 63 nt, hsa
gaguagaggauacaagugaugugaauaaaauggaaauugcauugaguuaaugaaacagacacu

SEQ ID NO: 276859 - RNA, 63 nt, hsa
uauuuugugucacaugaaaauuauaugaaauucaaauugcaguguccauaaguaaaguuuuau

SEQ ID NO: 276860 - RNA, 63 nt, hsa
ggucugaggaugauguagauuacugaaaaaugcaaauugcaaucauauaaauaaguguuuuug

SEQ ID NO: 276861 - RNA, 63 nt, hsa
gccucccucaaaggaccugcaggcagagacugaaaauugcagacagaggggcacgucugggca

SEQ ID NO: 276862 - RNA, 63 nt, hsa
uuaucagcucaguagagcagugagaaacugaucaaauugcacuuguucuccuacaagcaaccu

SEQ ID NO: 276863 - RNA, 63 nt, hsa
agugaagcacaaggauuaaguuggaaaagcuguaaauugcaugugcauauuugucuauuuuuu

SEQ ID NO: 276864 - RNA, 63 nt, hsa
ugcaauuuuacuuugucuagcuucuaaugugguaaauugcacauugugcaacagaaccauuaa

SEQ ID NO: 276865 - RNA, 63 nt, hsa
ucaaauaucuugcuuuugggucuucuccaaaguaaauugcauggacuucuuaaagaaguuuga

SEQ ID NO: 276866 - RNA, 63 nt, hsa
cugucacauguuucuguuucuauaguaauuuagaaauugcaaauaguuaacuuuucaucaugu

SEQ ID NO: 276867 - RNA, 63 nt, hsa
aagucauugccaaggucugauuuuucacacaaaaaauugcaacccccagcauaaauggguuag

SEQ ID NO: 276868 - RNA, 63 nt, hsa
cugcaguucuggaccauguggagcuacauggagaaauugcacagacagaaucacuuugccaca

SEQ ID NO: 276869 - RNA, 63 nt, hsa
gcccucccuccaggguagagaugcaccgaauggaaauugcacuaaggaccucuuccuuugcug

SEQ ID NO: 276870 - RNA, 63 nt, hsa
aagcgaucaagaauccagauucuauaacaaaucaaauugcacuuuuggaagcccggugucaug

SEQ ID NO: 276871 - RNA, 63 nt, hsa
acauaacaaaaaguguugcuguaaauccaaaagaaauugcaucuaagggacuuuguugaacuu

SEQ ID NO: 276872 - RNA, 63 nt, hsa
uauaaaauuaugagauugguuuuccuguggcauaaauugcaucacuguaucauuuucuuuuuu

SEQ ID NO: 276873 - RNA, 63 nt, hsa
uugccucugaaaaguguguauauauuuugugugaaauugcauacuuuguauuuugauuauuuu

SEQ ID NO: 276874 - RNA, 63 nt, hsa
cuuuaaggacauucaaaguuuaaaauaguguucaaauugcaaaauuuggcaaucuucauauaa

SEQ ID NO: 276875 - RNA, 63 nt, hsa
ucauaucuagguauccauugugacagacaaguaaaauugcaggugauuugauaauuaagcacc

SEQ ID NO: 276876 - RNA, 63 nt, hsa
ccguguuguaaagauacccacuaauggacaaucaaauugcagaaaaggcucaauauccaagag

SEQ ID NO: 276877 - RNA, 63 nt, hsa
aucuguuaccaguaggaggaggaugagccacagaaauugcauaauuuucuaauuucaagucuu

SEQ ID NO: 276878 - RNA, 63 nt, hsa
aauuuugucuauugucuuagaauugauugccagaaauugcaagauguaauauaucaaagucag

SEQ ID NO: 276879 - RNA, 63 nt, hsa
aauuguaagcuauuuuuuuuuguccugaugucuaaauugcagugauaagaauagguugauaca

SEQ ID NO: 276880 - RNA, 63 nt, hsa
uaagucaacaaaaugcaauaucagucaucagguaaauugcaagcugaggauaaauaauaaaac

SEQ ID NO: 276881 - RNA, 63 nt, hsa
uuuaaacucacgauaccaguuaucuguuaaucaaaauugcauuuuacaauuuaauaaugugau

SEQ ID NO: 276882 - RNA, 63 nt, hsa
auuggccaauuaucuuuaauaauuuaccuuuugaaauugcauguuuaucauauauccuuaagu

SEQ ID NO: 276883 - RNA, 63 nt, hsa
uuuuuuuuuuuaaacaguaacauccagagugacaaauugcaggagauuuaauguauaaaauuu

SEQ ID NO: 276884 - RNA, 63 nt, hsa
uccauuccauuauuacaagugaugaaaaacaaaaaauugcaaguaguaugcaaauuauaaaua

SEQ ID NO: 276885 - RNA, 63 nt, hsa
gucaacucuugacaguugccucaagauggagugaaauugcaucgaggguaagacuguguccac

SEQ ID NO: 276886 - RNA, 63 nt, hsa
cuuugggauaauuccuauccuuuucagggaggcaaauugcacgugaguuuaaguaugaaggca

SEQ ID NO: 276887 - RNA, 63 nt, hsa
auuaauagucaugguucguauuuuaggugacugaaauugcaucagugaucauaaugagguuug

SEQ ID NO: 276888 - RNA, 63 nt, hsa
caugaccucucagaauaaggugucaccucccugaaauugcauauauguauauagacaugcaca

SEQ ID NO: 276889 - RNA, 63 nt, hsa
ccuuuugguuugggcuguauugaaauccuuucuaaauugcaugaauaggcucugcuaacguga

SEQ ID NO: 276890 - RNA, 63 nt, hsa
aaaccaguuucucauugcauaagauacagauguaaauugcauggagagguugauaugcaccug

SEQ ID NO: 276891 - RNA, 63 nt, hsa
accuaugacacuucuuauuccacacugaaugugaaauugcauguucagauguuuacuacgagg

SEQ ID NO: 276892 - RNA, 63 nt, hsa
auacuaaaccucacaaaguagaggaauccauguaaauugcaaauaaaccacuuucuaauuuuu

SEQ ID NO: 276893 - RNA, 63 nt, hsa
caccuaauaucaauuuguagguaauguuccugaaaauugcaauacauuucaauuauacuaaac

SEQ ID NO: 276894 - RNA, 63 nt, hsa
guaaucccagcuacucaggaggcugaggcaggaaaauugcaugaaccuaaguggcagagguug

SEQ ID NO: 276895 - RNA, 63 nt, hsa
auauuuacauauuuugcuguaguauuugaguauaaauugcagauacuauaacacaucacaucu

SEQ ID NO: 276896 - RNA, 63 nt, hsa
auuagcaaaauuauuaauuuaaaaccccaaaguaaauugcaaauuuuaaaauuuauuuuugac

SEQ ID NO: 276897 - RNA, 63 nt, hsa
cagcccuuaaaauuuuagcuuaaggacauuuuaaaauugcaugagauuagcaaaauuauuaau

SEQ ID NO: 276898 - RNA, 63 nt, hsa
guuucauggauuuuucaucuucuaccguaugugaaauugcaaguguuugaagauuuauaagua

SEQ ID NO: 276899 - RNA, 63 nt, hsa
aggugccacucaguuuuagccaugucuucacugaaauugcaaaaguacuuuuagggagcagga

SEQ ID NO: 276900 - RNA, 63 nt, hsa
cuaaaucaccuggaaggagagcauuacucaccaaaauugcaaaacaaggguaucaagaauuug

SEQ ID NO: 276901 - RNA, 63 nt, hsa
uauuggauauaaugcugcuuuuuagagacaccuaaauugcaguaucagaaugaauguugaugu

SEQ ID NO: 276902 - RNA, 64 nt, hsa
accugguauuccaucaccauucaccccaggggacagccucgaccgagacaaggaggcccuuaaa

SEQ ID NO: 276903 - RNA, 64 nt, hsa
gccccagaaagagccuaagcuauguucagauagaagccucgaaauuccuguaaauuguuuacuu

SEQ ID NO: 276904 - RNA, 64 nt, hsa
uguucuaugucaauuugcucuugccgaaaagaugagccucgauuuuaaaaucuauccacaucca

SEQ ID NO: 276905 - RNA, 64 nt, hsa
agagucaaggccaagucugcagggaccuguugaaagccucgagaaugucuuggcugcccaagac

SEQ ID NO: 276906 - RNA, 64 nt, hsa
ggggccucaguguccucugaagccauccccagugagccucgacucugucccugcugaaaauagc

SEQ ID NO: 276907 - RNA, 64 nt, hsa
aguccuugcaagaaggaucagcccuuucugugccagccucgaucgccuugugcuuuggucucuu

SEQ ID NO: 276908 - RNA, 64 nt, hsa
auccauccagcuugccagaugcugcagagucacaagccucgaggugccuucuucagggccuggu

SEQ ID NO: 276909 - RNA, 64 nt, hsa
aaucccuugagcccaggaagcagagguugcagugagccucgauuguaccacugcacuccagccu

SEQ ID NO: 276910 - RNA, 64 nt, hsa
ccccaucuugcuuuucuguggaaccucagaggccagccucgacuuccuggagacccccaggugg

SEQ ID NO: 276911 - RNA, 64 nt, hsa
ugcaggcuucuagacggaguuucaaaaacugaugagccucgauccagggcuugaaagaagccag

SEQ ID NO: 276912 - RNA, 64 nt, hsa
uguggguccccugagacgaaggcugagcagggugagccucgaaaaccccauagcacuggcccag

SEQ ID NO: 276913 - RNA, 64 nt, hsa
agauggggcuuuguggcccugggggugcuucugcagccucgaaaaaguugcccuuaccuccuag

SEQ ID NO: 276914 - RNA, 64 nt, hsa
ucuguguagcaccauucaccacagcaggauagggagccucgacucuuucucgguaaccacggca

SEQ ID NO: 276915 - RNA, 64 nt, hsa
gcuggagugcaguggugccaucauagcucacuguagccucgaccuuccgggaucaagcaauccc

SEQ ID NO: 276916 - RNA, 64 nt, hsa
gcuggaauacaguggcaugauuucaguucacugcagccucgaccucccaggcucaagugauccu

SEQ ID NO: 276917 - RNA, 64 nt, hsa
guggcuauucgcaguuguaaucauagcacacugcagccucgaauuucugggcuugagcaguccu

SEQ ID NO: 276918 - RNA, 64 nt, hsa
acucaggaggggaagggucaggaugagaggcugcagccucgacacuuggcgcggccugauacug

SEQ ID NO: 276919 - RNA, 64 nt, hsa
aaguacuucuugauaccugggauacugugcccagagccucgaggagguaaugaauuaaagaaga

SEQ ID NO: 276920 - RNA, 64 nt, hsa
gauggagugcaguggugagaucacggcucauugcagccucgaccucccaggugauccucccacc

SEQ ID NO: 276921 - RNA, 64 nt, hsa
uucuugcuuuugacucacagcuggaaguuagaaaagccucgauuucaucuuuggagaggccaaa

SEQ ID NO: 276922 - RNA, 64 nt, hsa
uucuuuguaaaauuuauuuuuuacaugcugaauuagccucgaucuuuuugauuaagagcacaaa

SEQ ID NO: 276923 - RNA, 64 nt, hsa
uuccaauccuggcuggccucuaaaucaccuggagagccucgaaaaaaacagcaguggccagucc

SEQ ID NO: 276924 - RNA, 64 nt, hsa
aggcccuguccuccccacguaccccugcauccccagccucgacccagggacaugcagggcucac

SEQ ID NO: 276925 - RNA, 64 nt, hsa
cccgccaaccgcugccuuucucgggaguacuuagagccucgaacccgcgucccugggggcuggg

SEQ ID NO: 276926 - RNA, 64 nt, hsa
gauucuccagccauggucagacaggucacccaggagccucgaggaaagcccuggagggaaucac

SEQ ID NO: 276927 - RNA, 64 nt, hsa
gcccuuguauaguguccccaugggcucccacugcagccucgagugccccugucccaccuggcuc

SEQ ID NO: 276928 - RNA, 64 nt, hsa
gcuggagugcagugaugcaaucacggcucacugcagccucgaccuccccagcucaagcaauccu

SEQ ID NO: 276929 - RNA, 64 nt, hsa
ggcugugaaaccaggacaagcuacuuaacuugguagccucgauguccuccucugugaaacuggg

SEQ ID NO: 276930 - RNA, 64 nt, hsa
ggagagaugggugaagacaaaagaguucuuuaugagccucgauguucccugguaaacuuuuaaa

SEQ ID NO: 276931 - RNA, 64 nt, hsa
ugugaaguugguuacgggggaggccuguguauggagccucgagaugcgccaccucccagaaagc

SEQ ID NO: 276932 - RNA, 64 nt, hsa
agggucuugguuccagccugccacucaggcccaaagccucgacacagaguggacuguucccuga

SEQ ID NO: 276933 - RNA, 64 nt, hsa
aagacugccaaggacaugaccagcagcuggcuacagccucgauuuauauuucuguuugugguga

SEQ ID NO: 276934 - RNA, 64 nt, hsa
cagugcaauccugcaauucucaaucuugcacugcagccucgaccucccaggcuccagugacucu

SEQ ID NO: 276935 - RNA, 64 nt, hsa
ugcugcucaagccagucuggcaagcacucagcccagccucgagguccuucuggggagaguguaa

SEQ ID NO: 276936 - RNA, 64 nt, hsa
gcuacagugcaguggugugaucacagcucacugcagccucgacuucccaggcucaagugauccu

SEQ ID NO: 276937 - RNA, 64 nt, hsa
agagcagaagcuagggcagagccaaugcugagggagccucgacuuccggcgccgccgcccucuc

SEQ ID NO: 276938 - RNA, 64 nt, hsa
gcuggagugaaguggugugaucccagcucacugcagccucgaccucccuggcuugagugauccu

SEQ ID NO: 276939 - RNA, 64 nt, hsa
gagccaaggcgaggcggcugucugcgaccacagcagccucgaaacaccaggcagcagccuugcu

SEQ ID NO: 276940 - RNA, 64 nt, hsa
ggcuguagccgaggccgcagccggugagaggcggagccucgagcgggccccuccuccuccguuc

SEQ ID NO: 276941 - RNA, 64 nt, hsa
ccgcugucuccagugggggcagcagcugucccccagccucgauggagacacuggggcagucugc

SEQ ID NO: 276942 - RNA, 56 nt, hsa
aggggccuagggcgaaaugaacacaaagccucgaaaucagugcgcuccagcugauc

SEQ ID NO: 276943 - RNA, 64 nt, hsa
cuccaucucccaucagugcugugggcuggcugcaagccucgaaacaguucuccuggaagggagg

SEQ ID NO: 276944 - RNA, 64 nt, hsa
gcuggagugcaguggcacgauuauggcucauugcagccucgacuucucggggccaagcgauccu

SEQ ID NO: 276945 - RNA, 64 nt, hsa
cugcaacggucuucuugugcuagaacucaggcucagccucgaauuccacagacgaaguacuuuc

SEQ ID NO: 276946 - RNA, 64 nt, hsa
agagcugcgggaacaccgagaccccccguccuucagccucgaccugggugcaggcaucccgggc

SEQ ID NO: 276947 - RNA, 64 nt, hsa
uguguaagguauauguuuuauaauucauaaccauagccucgaucaucaagaaauacuuucgaaa

SEQ ID NO: 276948 - RNA, 64 nt, hsa
gcuugagugcaguggugcgaucacagcccagugcagccucgaccaccugugcucaagcaauccu

SEQ ID NO: 276949 - RNA, 64 nt, hsa
uacucuaagacuggcuaaacaaccuugaucauugagccucgagccaugggagagaugcugacca

SEQ ID NO: 276950 - RNA, 64 nt, hsa
cgcgcugugcaaagcgcucucggggucuuuccucagccucgaaaagugggcucuggaaucccuu

SEQ ID NO: 276951 - RNA, 64 nt, hsa
cagcauguccuacggaaacccagcacguguguagagccucgaucgucaucucugguuauuuguu

SEQ ID NO: 276952 - RNA, 64 nt, hsa
gacuuggaggccaaaccuuaaauccagagauagcagccucgauagggaccuuaaaaggauucac

SEQ ID NO: 276953 - RNA, 64 nt, hsa
ccugccaggcucucccucucugcaccugucucauagccucgaauaucuuaauuccuuaggcuua

SEQ ID NO: 276954 - RNA, 64 nt, hsa
accaacagccaccuuccagggauggggggccugaagccucgaugcuugucuccugauccuuauu

SEQ ID NO: 276955 - RNA, 64 nt, hsa
agggcgggacugggccgcccagccccuugacuccagccucgaccgccaggccccaggccagagc

SEQ ID NO: 276956 - RNA, 64 nt, hsa
gccgcauuuucacgcuggcuggcagugugcugagagccucgaaugcucugcggcguagugcccu

SEQ ID NO: 276957 - RNA, 64 nt, hsa
guuugugugugugugugcacucaagaccucuaacagccucgaagccugggguggcaucccggcc

SEQ ID NO: 276958 - RNA, 64 nt, hsa
ggccucaacccagggguggcgcaggcaccuugcaagccucgagcuguagccacccucaggccug

SEQ ID NO: 276959 - RNA, 64 nt, hsa
uguguaccacuucugugggcauggccgcuucuagagccucgacacccccccaacccccgcacca

SEQ ID NO: 276960 - RNA, 64 nt, hsa
gcgggaauacagugccaugaucauagcucacugcagccucgaaucccugggcucaaguguuccu

SEQ ID NO: 276961 - RNA, 57 nt, hsa
cagcugcccggaccuccuaaguccagaagccucgaggucuccuguuucucuuccuga

SEQ ID NO: 276962 - RNA, 64 nt, hsa
guuggagugcaguugcaggaucauaguuugcugcagccucgaccuccugggcuuaagcgauccu

SEQ ID NO: 276963 - RNA, 64 nt, hsa
accuccugacaacgucucuucaagcauccucagaagccucgacugagcuuuagacagcagagca

SEQ ID NO: 276964 - RNA, 64 nt, hsa
cauaucgcuguaggguccugcccuccggaggagcagccucgaggcuggugguuuucagagcagg

SEQ ID NO: 276965 - RNA, 64 nt, hsa
ccacugcucagaaagcuuccauucugcuguccucagccucgacccucuucugugcuggacuucc

SEQ ID NO: 276966 - RNA, 64 nt, hsa
gcuggagugcgguggugcgaucauagcucacugcagccucgaacucuugggcuucaagcaaucc

SEQ ID NO: 276967 - RNA, 64 nt, hsa
ccccucccugccagagucugucuuggccagugccagccucgaugcuuugguuuugaccccaccu

SEQ ID NO: 276968 - RNA, 64 nt, hsa
gcuggagugcaguggugcgaucauggcucacugcagccucgaacuccugggcucaagcaauccu

SEQ ID NO: 276969 - RNA, 64 nt, hsa
cccacuacuccuucuccuucuagaugguaaccacagccucgaccaugccugcucccucugaccc

SEQ ID NO: 276970 - RNA, 64 nt, hsa
gcagcacacacacccuaccuuccacgcgcugcgcagccucgaccagcagauguaccucuguuac

SEQ ID NO: 276971 - RNA, 64 nt, hsa
cccuggaguuguucaggcuguugggagguggcucagccucgaaggacagacugcacaccuguug

SEQ ID NO: 276972 - RNA, 64 nt, hsa
gcuagagugcaguggugcagucuuggcucacuacagccucgaacuccuggucucaagcaguccu

SEQ ID NO: 276973 - RNA, 64 nt, hsa
gcuggaguacaguggcacaaucauggcucacugcagccucgagcuccugagcucaaaggauccu

SEQ ID NO: 276974 - RNA, 64 nt, hsa
ugcagcggugcaaucaugagucaaugcagccuccagccucgaccucccgaggcucaggugaucc

SEQ ID NO: 276975 - RNA, 64 nt, hsa
gccccgagguguuugugcuucacccccagacgucagccucgaaggcaggacugugggguguucg

SEQ ID NO: 276976 - RNA, 64 nt, hsa
gcuggaguacaauggcacaaacacugcucacugcagccucgaccucccaaggccuaagcaaucc

SEQ ID NO: 276977 - RNA, 64 nt, hsa
ggaagggggcauuuggcuagggggugccccugugagccucgaccuugcccccucgucccucucc

SEQ ID NO: 276978 - RNA, 64 nt, hsa
agagaccuccccacugauggcuaggacuccagggagccucgacccuagggcugauccucaagua

SEQ ID NO: 276979 - RNA, 64 nt, hsa
uggccugcgccccgccagcugcccgcagaggugcagccucgaggaaucugagggcgucggggca

SEQ ID NO: 276980 - RNA, 64 nt, hsa
guccuguugcugugagggagugcuggccgcaggcagccucgagucaccgccaggcucacaggcu

SEQ ID NO: 276981 - RNA, 64 nt, hsa
gcuugagggcaguggugcaaucauaacucauugcagccucgaacuccugggcuuaagggauccu

SEQ ID NO: 276982 - RNA, 64 nt, hsa
uggaggugcugggcccuccugggauggguggcucagccucgaaucccaggccccagcccaggca

SEQ ID NO: 276983 - RNA, 64 nt, hsa
ggugagugggugaggccgagccugcugcguguggagccucgagugggcccuggcugccacuacc

SEQ ID NO: 276984 - RNA, 64 nt, hsa
agccccaggggccaccgcggcucuccccuuccccagccucgaagccaugggggcccccucgcca

SEQ ID NO: 276985 - RNA, 64 nt, hsa
ggucagcugccugcaugacuuuucuggaaggcagagccucgaaaauaggcagaccguuugagcc

SEQ ID NO: 276986 - RNA, 64 nt, hsa
cuggcccucucucugaucaugccagguuugcaccagccucgagucucccauguuguaguacauu

SEQ ID NO: 276987 - RNA, 64 nt, hsa
aggaauuuugaacauuuccuucuucaguaucugcagccucgaccuggucacuuuauuuccauag

SEQ ID NO: 276988 - RNA, 64 nt, hsa
cagaaaaugauugaugggcuggggaacccuggagagccucgacuccggaagucucaaggugccu

SEQ ID NO: 276989 - RNA, 63 nt, hsa
ggcuauuuguucuuuggaaugacugcuccacuccacacucacaccucuauucacagaccagca

SEQ ID NO: 276990 - RNA, 63 nt, hsa
cuaaagagaaagaauacuugacagcucuaugcccacacucacauuacagcugaugugaaagag

SEQ ID NO: 276991 - RNA, 63 nt, hsa
agcuuaaccaagagugagaggauaugucauguucacacucaaugcaauucguagugguuuucu

SEQ ID NO: 276992 - RNA, 63 nt, hsa
aaugcaccuagggaaaaaauuuaaggagguauucacacucagggucaugcacuugcacaaugu

SEQ ID NO: 276993 - RNA, 63 nt, hsa
aacuauaaugcacacucacacacaauuuaugugcacacucacacaugcacacacacacacaca

SEQ ID NO: 276994 - RNA, 63 nt, hsa
cuaaaccaagagagaaagcaagaaacuauaaugcacacucacacacaauuuaugugcacacuc

SEQ ID NO: 276995 - RNA, 63 nt, hsa
agaauauuuauaacuuuuguaugagagagaauucacacucaacaagacacuaccagcaccacg

SEQ ID NO: 276996 - RNA, 63 nt, hsa
uuugcuggugguggcuucgggcucaugcccagacacacucacugccccgucuguccaaggccu

SEQ ID NO: 276997 - RNA, 63 nt, hsa
aaauuacauuacaagauccagguucuucccccccacacucaaucaagccagcccucuccucuu

SEQ ID NO: 276998 - RNA, 63 nt, hsa
ccucuccucuucugucacguaaaggauauuuggcacacucaugcgucauucauucacaaaaca

SEQ ID NO: 276999 - RNA, 63 nt, hsa
ugcucacauggacgcggacggacacacucauuacacacucacacgccccgacugcacccggug

SEQ ID NO: 277000 - RNA, 63 nt, hsa
ccccgucugcaugcucacauggacgcggacggacacacucauuacacacucacacgccccgac

SEQ ID NO: 277001 - RNA, 63 nt, hsa
gcccccgccugugucagguguggaugaggucgucacacucagaaggacaggcuugucugccag

SEQ ID NO: 277002 - RNA, 63 nt, hsa
auuaacaacucuaacccaggacagaccacaagccacacucagaggccucacugugcugggggc

SEQ ID NO: 277003 - RNA, 63 nt, hsa
ucuaugagaauguggauuuauggcauugaguaucacacucagcucugcuguguuaacuuugug

SEQ ID NO: 277004 - RNA, 63 nt, hsa
uaucuguacaguugugcaagauaugaaugguuucacacucaaauaaaaaauauugaaacgacc

SEQ ID NO: 277005 - RNA, 63 nt, hsa
gcuucugauacacagccacugcacacacacacucacacucacacucccuugucugaugcccca

SEQ ID NO: 277006 - RNA, 63 nt, hsa
cugguugcuucugauacacagccacugcacacacacacucacacucacacucccuugucugau

SEQ ID NO: 277007 - RNA, 63 nt, hsa
ucguacaugcacaaauacacacucaugcacacacacacucacacacaugcauacacuuagguu

SEQ ID NO: 277008 - RNA, 63 nt, hsa
gagugaucuuacucccucguacaugcacaaauacacacucaugcacacacacacucacacaca

SEQ ID NO: 277009 - RNA, 63 nt, hsa
gcccuaacuuuuaauguacaucacacacacacucacacucacauacacacacacacacacacu

SEQ ID NO: 277010 - RNA, 63 nt, hsa
ugcccagcccuaacuuuuaauguacaucacacacacacucacacucacauacacacacacaca

SEQ ID NO: 277011 - RNA, 63 nt, hsa
guuucaaauuggaaccuugaggcuaguuaguaucacacucaggccacacucagcacuugccca

SEQ ID NO: 277012 - RNA, 63 nt, hsa
gaaccuugaggcuaguuaguaucacacucaggccacacucagcacuugcccacucuuguuuac

SEQ ID NO: 277013 - RNA, 63 nt, hsa
ugugggcacuaacacgugugcguuccuggcgggcacacucaggaccgugccucacagggccca

SEQ ID NO: 277014 - RNA, 63 nt, hsa
uggagucuguucucacaccugugcgcagguuugcacacucaaguucucaugggcaggcucagg

SEQ ID NO: 277015 - RNA, 64 nt, hsa; identical to SEQ ID NO: 189281

SEQ ID NO: 277016 - RNA, 64 nt, hsa; identical to SEQ ID NO: 189282

SEQ ID NO: 277017 - RNA, 64 nt, hsa; identical to SEQ ID NO: 189283

SEQ ID NO: 277018 - RNA, 64 nt, hsa; identical to SEQ ID NO: 189284

SEQ ID NO: 277019 - RNA, 64 nt, hsa; identical to SEQ ID NO: 189285

SEQ ID NO: 277020 - RNA, 64 nt, hsa; identical to SEQ ID NO: 189286

SEQ ID NO: 277021 - RNA, 64 nt, hsa; identical to SEQ ID NO: 189287

SEQ ID NO: 277022 - RNA, 64 nt, hsa; identical to SEQ ID NO: 189288

SEQ ID NO: 277023 - RNA, 64 nt, hsa; identical to SEQ ID NO: 189289

SEQ ID NO: 277024 - RNA, 64 nt, hsa; identical to SEQ ID NO: 189290

SEQ ID NO: 277025 - RNA, 64 nt, hsa; identical to SEQ ID NO: 189291

SEQ ID NO: 277026 - RNA, 64 nt, hsa; identical to SEQ ID NO: 189292

SEQ ID NO: 277027 - RNA, 64 nt, hsa; identical to SEQ ID NO: 189293

SEQ ID NO: 277028 - RNA, 64 nt, hsa; identical to SEQ ID NO: 189294

SEQ ID NO: 277029 - RNA, 64 nt, hsa; identical to SEQ ID NO: 189295

SEQ ID NO: 277030 - RNA, 64 nt, hsa; identical to SEQ ID NO: 189296

SEQ ID NO: 277031 - RNA, 64 nt, hsa; identical to SEQ ID NO: 189297

SEQ ID NO: 277032 - RNA, 64 nt, hsa; identical to SEQ ID NO: 189298

SEQ ID NO: 277033 - RNA, 64 nt, hsa; identical to SEQ ID NO: 189299

SEQ ID NO: 277034 - RNA, 64 nt, hsa; identical to SEQ ID NO: 189300

SEQ ID NO: 277035 - RNA, 64 nt, hsa; identical to SEQ ID NO: 189301

SEQ ID NO: 277036 - RNA, 64 nt, hsa; identical to SEQ ID NO: 189302

SEQ ID NO: 277037 - RNA, 64 nt, hsa; identical to SEQ ID NO: 189303

SEQ ID NO: 277038 - RNA, 64 nt, hsa; identical to SEQ ID NO: 189304

SEQ ID NO: 277039 - RNA, 64 nt, hsa; identical to SEQ ID NO: 189305

SEQ ID NO: 277040 - RNA, 64 nt, hsa; identical to SEQ ID NO: 189306

SEQ ID NO: 277041 - RNA, 64 nt, hsa; identical to SEQ ID NO: 189307

SEQ ID NO: 277042 - RNA, 64 nt, hsa; identical to SEQ ID NO: 189308

SEQ ID NO: 277043 - RNA, 64 nt, hsa; identical to SEQ ID NO: 189309

SEQ ID NO: 277044 - RNA, 64 nt, hsa; identical to SEQ ID NO: 189310

SEQ ID NO: 277045 - RNA, 64 nt, hsa; identical to SEQ ID NO: 189311

SEQ ID NO: 277046 - RNA, 64 nt, hsa; identical to SEQ ID NO: 189312

SEQ ID NO: 277047 - RNA, 64 nt, hsa; identical to SEQ ID NO: 189313

SEQ ID NO: 277048 - RNA, 64 nt, hsa; identical to SEQ ID NO: 189314

SEQ ID NO: 277049 - RNA, 64 nt, hsa; identical to SEQ ID NO: 189315

SEQ ID NO: 277050 - RNA, 64 nt, hsa; identical to SEQ ID NO: 189316

SEQ ID NO: 277051 - RNA, 64 nt, hsa; identical to SEQ ID NO: 189317

SEQ ID NO: 277052 - RNA, 64 nt, hsa; identical to SEQ ID NO: 189318

SEQ ID NO: 277053 - RNA, 64 nt, hsa; identical to SEQ ID NO: 189319

SEQ ID NO: 277054 - RNA, 50 nt, hsa; identical to SEQ ID NO: 189320

SEQ ID NO: 277055 - RNA, 64 nt, hsa; identical to SEQ ID NO: 189321

SEQ ID NO: 277056 - RNA, 64 nt, hsa; identical to SEQ ID NO: 189322

SEQ ID NO: 277057 - RNA, 64 nt, hsa; identical to SEQ ID NO: 189323

SEQ ID NO: 277058 - RNA, 61 nt, hsa; identical to SEQ ID NO: 260215

SEQ ID NO: 277059 - RNA, 64 nt, hsa; identical to SEQ ID NO: 260216

SEQ ID NO: 277060 - RNA, 57 nt, hsa; identical to SEQ ID NO: 260217

SEQ ID NO: 277061 - RNA, 64 nt, hsa; identical to SEQ ID NO: 260218

SEQ ID NO: 277062 - RNA, 64 nt, hsa; identical to SEQ ID NO: 260219

SEQ ID NO: 277063 - RNA, 64 nt, hsa; identical to SEQ ID NO: 260220

SEQ ID NO: 277064 - RNA, 64 nt, hsa; identical to SEQ ID NO: 260221

SEQ ID NO: 277065 - RNA, 64 nt, hsa; identical to SEQ ID NO: 260222

SEQ ID NO: 277066 - RNA, 64 nt, hsa; identical to SEQ ID NO: 260223

SEQ ID NO: 277067 - RNA, 64 nt, hsa; identical to SEQ ID NO: 260224

SEQ ID NO: 277068 - RNA, 64 nt, hsa; identical to SEQ ID NO: 260225

SEQ ID NO: 277069 - RNA, 64 nt, hsa; identical to SEQ ID NO: 260226

SEQ ID NO: 277070 - RNA, 64 nt, hsa; identical to SEQ ID NO: 260227

SEQ ID NO: 277071 - RNA, 64 nt, hsa; identical to SEQ ID NO: 260228

SEQ ID NO: 277072 - RNA, 64 nt, hsa; identical to SEQ ID NO: 260229

SEQ ID NO: 277073 - RNA, 64 nt, hsa; identical to SEQ ID NO: 260230

SEQ ID NO: 277074 - RNA, 64 nt, hsa; identical to SEQ ID NO: 260231

SEQ ID NO: 277075 - RNA, 64 nt, hsa; identical to SEQ ID NO: 260232

SEQ ID NO: 277076 - RNA, 64 nt, hsa; identical to SEQ ID NO: 260233

SEQ ID NO: 277077 - RNA, 64 nt, hsa; identical to SEQ ID NO: 260234

SEQ ID NO: 277078 - RNA, 64 nt, hsa; identical to SEQ ID NO: 260235

SEQ ID NO: 277079 - RNA, 64 nt, hsa; identical to SEQ ID NO: 260236

SEQ ID NO: 277080 - RNA, 64 nt, hsa; identical to SEQ ID NO: 260237

SEQ ID NO: 277081 - RNA, 64 nt, hsa; identical to SEQ ID NO: 260238

SEQ ID NO: 277082 - RNA, 64 nt, hsa; identical to SEQ ID NO: 260239

SEQ ID NO: 277083 - RNA, 64 nt, hsa; identical to SEQ ID NO: 260240

SEQ ID NO: 277084 - RNA, 64 nt, hsa; identical to SEQ ID NO: 260241

SEQ ID NO: 277085 - RNA, 64 nt, hsa; identical to SEQ ID NO: 260242

SEQ ID NO: 277086 - RNA, 64 nt, hsa; identical to SEQ ID NO: 260243

SEQ ID NO: 277087 - RNA, 64 nt, hsa; identical to SEQ ID NO: 260244

SEQ ID NO: 277088 - RNA, 64 nt, hsa; identical to SEQ ID NO: 260245

SEQ ID NO: 277089 - RNA, 64 nt, hsa; identical to SEQ ID NO: 260246

SEQ ID NO: 277090 - RNA, 64 nt, hsa; identical to SEQ ID NO: 260247

SEQ ID NO: 277091 - RNA, 64 nt, hsa; identical to SEQ ID NO: 260248

SEQ ID NO: 277092 - RNA, 64 nt, hsa; identical to SEQ ID NO: 260249

SEQ ID NO: 277093 - RNA, 64 nt, hsa; identical to SEQ ID NO: 260250

SEQ ID NO: 277094 - RNA, 64 nt, hsa; identical to SEQ ID NO: 260251

SEQ ID NO: 277095 - RNA, 64 nt, hsa; identical to SEQ ID NO: 260252

SEQ ID NO: 277096 - RNA, 64 nt, hsa; identical to SEQ ID NO: 260253

SEQ ID NO: 277097 - RNA, 64 nt, hsa; identical to SEQ ID NO: 260254

SEQ ID NO: 277098 - RNA, 64 nt, hsa; identical to SEQ ID NO: 260255

SEQ ID NO: 277099 - RNA, 64 nt, hsa; identical to SEQ ID NO: 260256

SEQ ID NO: 277100 - RNA, 64 nt, hsa; identical to SEQ ID NO: 260257

SEQ ID NO: 277101 - RNA, 64 nt, hsa; identical to SEQ ID NO: 260258

SEQ ID NO: 277102 - RNA, 64 nt, hsa; identical to SEQ ID NO: 260259

SEQ ID NO: 277103 - RNA, 64 nt, hsa; identical to SEQ ID NO: 260260

SEQ ID NO: 277104 - RNA, 64 nt, hsa; identical to SEQ ID NO: 260261

SEQ ID NO: 277105 - RNA, 64 nt, hsa; identical to SEQ ID NO: 260262

SEQ ID NO: 277106 - RNA, 64 nt, hsa; identical to SEQ ID NO: 260263

SEQ ID NO: 277107 - RNA, 64 nt, hsa
cuagagcauauuuuggaaauguucuaaaccuuucuaagcucagaugcauuuuugcaugacuaug

SEQ ID NO: 277108 - RNA, 64 nt, hsa
cacaguuccuacauacguuucaguucuuucaugguaagcucaauggacuuugaauuguuuacag

SEQ ID NO: 277109 - RNA, 64 nt, hsa
gaaguacucaguaauacaguacaguauucaguaaggcagugaaguacucaguaauacaauacag

SEQ ID NO: 277110 - RNA, 64 nt, hsa
gcagugcucaauaaggcagugcagugcucaguaaggcagugaauugcuuaguaacacaguguag

SEQ ID NO: 277111 - RNA, 64 nt, hsa
cuccgucucaaaaaaaaaaaaaaaaaaaguaauuggcagugacuaugggcgcacugccuaacau

SEQ ID NO: 277112 - RNA, 64 nt, hsa
aauuacauaugauguucucuguucaaaaguaauuggcagugauuggccaggcgcaguggcucac

SEQ ID NO: 277113 - RNA, 64 nt, hsa
uaaacaaaagcaucugaaauaauugugcacaucuggcagugacuguagaaaauacgaaauauau

SEQ ID NO: 277114 - RNA, 64 nt, hsa
caaagaaguauguaauugucacuugguucuguuuggcagugaugcuccugguuaacugaauaau

SEQ ID NO: 277115 - RNA, 64 nt, hsa
ccaaccccagguucccuacacccugcucucagcaggcagugagugucacacaccuguuaaucca

SEQ ID NO: 277116 - RNA, 64 nt, hsa
gaggugggagaaucuccugagccuggaagguccaggcagugagccaagauugugccaccacacu

SEQ ID NO: 277117 - RNA, 64 nt, hsa
uuugaauauuccagauguguuuggucgugcguauggcagugagcagguauguguuugcuuuugc

SEQ ID NO: 277118 - RNA, 64 nt, hsa
uacccaaauaucguuuacacagagagaugacuauggcagugauguuuaauauuauuaaauccag

SEQ ID NO: 277119 - RNA, 64 nt, hsa
ccucacuauucucaccaggccaugggacuuugggggcagugagagagagcuggaaaggggcaac

SEQ ID NO: 277120 - RNA, 64 nt, hsa
gaaugcugccaucuggugacagcauguagauuugggcagugaacagggauugccaugccccagu

SEQ ID NO: 277121 - RNA, 64 nt, hsa
aauuugccagggaacaguggcaggcugcuagcaaggcagugagaagcucuuggcagccaaaugg

SEQ ID NO: 277122 - RNA, 64 nt, hsa
uauuuauuguauauccuaaauauauuucuccuuuggcagugacuagauuuccacuaaugugucu

SEQ ID NO: 277123 - RNA, 64 nt, hsa
aguaaaaagaucagugauuuccaggagcugcaagggcagugagaggaagggagggaugaggagg

SEQ ID NO: 277124 - RNA, 64 nt, hsa
gagggaugaggagguggagugcaggggauguuagggcagugaaagguucuguaugacacuguga

SEQ ID NO: 277125 - RNA, 64 nt, hsa
uuugaucucacacaccagggcauucccccuaagaggcagugagauguagccuggcccuggaacu

SEQ ID NO: 277126 - RNA, 64 nt, hsa
uuaugacucuuaacauuagagagggcuaaacaagggcagugagaagacuggcaggcagcagaaa

SEQ ID NO: 277127 - RNA, 64 nt, hsa
ggaauuugaagaaaggaacugaggcccagaaagaggcagugauuugccaaagugacacagagca

SEQ ID NO: 277128 - RNA, 64 nt, hsa; identical to SEQ ID NO: 277107

SEQ ID NO: 277129 - RNA, 64 nt, hsa; identical to SEQ ID NO: 277108

SEQ ID NO: 277130 - RNA, 64 nt, hsa; identical to SEQ ID NO: 277109

SEQ ID NO: 277131 - RNA, 64 nt, hsa; identical to SEQ ID NO: 277110

SEQ ID NO: 277132 - RNA, 64 nt, hsa; identical to SEQ ID NO: 277111

SEQ ID NO: 277133 - RNA, 64 nt, hsa; identical to SEQ ID NO: 277112

SEQ ID NO: 277134 - RNA, 64 nt, hsa; identical to SEQ ID NO: 277113

SEQ ID NO: 277135 - RNA, 64 nt, hsa; identical to SEQ ID NO: 277114

SEQ ID NO: 277136 - RNA, 64 nt, hsa; identical to SEQ ID NO: 277115

SEQ ID NO: 277137 - RNA, 64 nt, hsa; identical to SEQ ID NO: 277116

SEQ ID NO: 277138 - RNA, 64 nt, hsa; identical to SEQ ID NO: 277117

SEQ ID NO: 277139 - RNA, 64 nt, hsa; identical to SEQ ID NO: 277118

SEQ ID NO: 277140 - RNA, 64 nt, hsa; identical to SEQ ID NO: 277119

SEQ ID NO: 277141 - RNA, 64 nt, hsa; identical to SEQ ID NO: 277120

SEQ ID NO: 277142 - RNA, 64 nt, hsa; identical to SEQ ID NO: 277121

SEQ ID NO: 277143 - RNA, 64 nt, hsa; identical to SEQ ID NO: 277122

SEQ ID NO: 277144 - RNA, 64 nt, hsa; identical to SEQ ID NO: 277123

SEQ ID NO: 277145 - RNA, 64 nt, hsa; identical to SEQ ID NO: 277124

SEQ ID NO: 277146 - RNA, 64 nt, hsa; identical to SEQ ID NO: 277125

SEQ ID NO: 277147 - RNA, 64 nt, hsa; identical to SEQ ID NO: 277126

SEQ ID NO: 277148 - RNA, 64 nt, hsa; identical to SEQ ID NO: 277127

SEQ ID NO: 277149 - RNA, 64 nt, hsa; identical to SEQ ID NO: 277107

SEQ ID NO: 277150 - RNA, 64 nt, hsa; identical to SEQ ID NO: 277108

SEQ ID NO: 277151 - RNA, 64 nt, hsa; identical to SEQ ID NO: 277109

SEQ ID NO: 277152 - RNA, 64 nt, hsa; identical to SEQ ID NO: 277110

SEQ ID NO: 277153 - RNA, 64 nt, hsa; identical to SEQ ID NO: 277111

SEQ ID NO: 277154 - RNA, 64 nt, hsa; identical to SEQ ID NO: 277112

SEQ ID NO: 277155 - RNA, 64 nt, hsa; identical to SEQ ID NO: 277113

SEQ ID NO: 277156 - RNA, 64 nt, hsa; identical to SEQ ID NO: 277114

SEQ ID NO: 277157 - RNA, 64 nt, hsa; identical to SEQ ID NO: 277115

SEQ ID NO: 277158 - RNA, 64 nt, hsa; identical to SEQ ID NO: 277116

SEQ ID NO: 277159 - RNA, 64 nt, hsa; identical to SEQ ID NO: 277117

SEQ ID NO: 277160 - RNA, 64 nt, hsa; identical to SEQ ID NO: 277118

SEQ ID NO: 277161 - RNA, 64 nt, hsa; identical to SEQ ID NO: 277119

SEQ ID NO: 277162 - RNA, 64 nt, hsa; identical to SEQ ID NO: 277120

SEQ ID NO: 277163 - RNA, 64 nt, hsa; identical to SEQ ID NO: 277121

SEQ ID NO: 277164 - RNA, 64 nt, hsa; identical to SEQ ID NO: 277122

SEQ ID NO: 277165 - RNA, 64 nt, hsa; identical to SEQ ID NO: 277123

SEQ ID NO: 277166 - RNA, 64 nt, hsa; identical to SEQ ID NO: 277124

SEQ ID NO: 277167 - RNA, 64 nt, hsa; identical to SEQ ID NO: 277125

SEQ ID NO: 277168 - RNA, 64 nt, hsa; identical to SEQ ID NO: 277126

SEQ ID NO: 277169 - RNA, 64 nt, hsa; identical to SEQ ID NO: 277127

SEQ ID NO: 277170 - RNA, 64 nt, hsa
gugugugugccuaguguaaaagaacugaaauuuugaugcuuacagcacuuggcucgugcauuug

SEQ ID NO: 277171 - RNA, 64 nt, hsa
uuuacuuaaauuaucaggaauacaauguugcaaugaugcuuaaaaaacacuuguuaguuuuccc

SEQ ID NO: 277172 - RNA, 64 nt, hsa
uuguuguaucuuggggacuuuuacuuuguuguuugaugcuuaaacuucaaaauucucuguauuc

SEQ ID NO: 277173 - RNA, 64 nt, hsa
accagucuuaaauuauucaugauucaauaaaauugaugcuuauuuauucagauuagugguuugg

SEQ ID NO: 277174 - RNA, 64 nt, hsa
uuuuuaggcugucacccuugacccaaacuuucuggaugcuuauaucaauuuaggaaaugucuug

SEQ ID NO: 277175 - RNA, 64 nt, hsa
ccgcacggcucugaaacuuaagccugauuuuccugaugcuuauuguaacuuggcucauugccug

SEQ ID NO: 277176 - RNA, 64 nt, hsa
uuucuggagcagaagauuccacuucuuugguccucaucuuuacuuaaaaagcucuuauagaaag

SEQ ID NO: 277177 - RNA, 64 nt, hsa
guccauugaggccucauguaaaauucccauuuuucaucuuuacacuccuuuucuccccucauuu

SEQ ID NO: 277178 - RNA, 64 nt, hsa
guucuaacauggucucaguuaaucugguaaauggcaucuuuaccaucuuaguucugacuucuca

SEQ ID NO: 277179 - RNA, 64 nt, hsa
uucaugaagcacagaagauaaagaagaagucuuucaucuuuacugcugagauccuugggaacac

SEQ ID NO: 277180 - RNA, 64 nt, hsa
uucuugcuuauguaagaaguacauauuagucugccaucuuuaaaaaaaaauacaguauuuucau

SEQ ID NO: 277181 - RNA, 64 nt, hsa
gaugagccccaguguucuugccuccuacuauucacaucuuuaugugguccccuccaaugcugaa

SEQ ID NO: 277182 - RNA, 64 nt, hsa
uagauaauuuggaaccaggauacuaaugauuucucaucuuuacuuuuuuuuaauccuaauauaa

SEQ ID NO: 277183 - RNA, 64 nt, hsa
aaaacugauauugucuauugguuauugaucuugccaucuuuauuuaaaaccaugucccuucuau

SEQ ID NO: 277184 - RNA, 64 nt, hsa
uuaaccucuugaagcuaguccucuccccacuuuccaucuuuaaaugggcauauauacaauaaag

SEQ ID NO: 277185 - RNA, 64 nt, hsa
uugauccaaaaacuaccuuuccauaauguucucacaucuuuacucuguccuaccucucauuuuc

SEQ ID NO: 277186 - RNA, 52 nt, hsa
cuuuacugaaacaacaguaaaccaucuuuauuauggucauauuucacagcac

SEQ ID NO: 277187 - RNA, 64 nt, hsa
uauuauggucauauuucacagcaccaaaauaaaucaucuuuauuaaguagaugaaacauuaacu

SEQ ID NO: 277188 - RNA, 64 nt, hsa
auguguuuguguguguguaguuuauccucucucucaucuuuaucuagagauugacugauaccuc

SEQ ID NO: 277189 - RNA, 64 nt, hsa
agcagaaacuuuacauaaagcuguauuucuuaaucaucuuuaauuugaaacuuaagaaaaugaa

SEQ ID NO: 277190 - RNA, 64 nt, hsa
ggcuagaauccggaauguuuucuugauuuaaagacaucuuuagaccgggcacaguggcucacgc

SEQ ID NO: 277191 - RNA, 64 nt, hsa
agcgagaccuugucuuuaaaaauaaaaauaaaaacaucuuuacaacauuccuguuuguauuuua

SEQ ID NO: 277192 - RNA, 64 nt, hsa
uacuaucccagaaacagggcaacguuuuuagaaacaucuuuagcccaaaguaacuaguaaaaau

SEQ ID NO: 277193 - RNA, 64 nt, hsa
ccuuuuacaagguuagaaaagucucauacuaccucaucuuuauuguggcgcuuuuguagaucac

SEQ ID NO: 277194 - RNA, 64 nt, hsa
gauuaggagagagacagcaguguuugaacuacagcaucuuuacacuagcuuguguuuugugcua

SEQ ID NO: 277195 - RNA, 64 nt, hsa
ucauuucugguggauaaccuuuuuaguuuaauagcaucuuuaauuagaucacagcauugaauuc

SEQ ID NO: 277196 - RNA, 64 nt, hsa
cuuuguauggcuugccagcuaacaauagugguuccaucuuuaaggaagaagaauguuugaugga

SEQ ID NO: 277197 - RNA, 64 nt, hsa
caucaugaaaacagagccccguucauaaauuuuucaucuuuauuuuuaagguuauacuccucua

SEQ ID NO: 277198 - RNA, 64 nt, hsa
gaggaggcacugccccccuuuccugcccccuccucaucuuuaauaaagaccuggcuucucaucu

SEQ ID NO: 277199 - RNA, 64 nt, hsa
cccccuccucaucuuuaauaaagaccuggcuucucaucuuuaauaaagaccuguuuguaacaga

SEQ ID NO: 277200 - RNA, 64 nt, hsa; identical to SEQ ID NO: 87818

SEQ ID NO: 277201 - RNA, 64 nt, hsa; identical to SEQ ID NO: 87819

SEQ ID NO: 277202 - RNA, 64 nt, hsa; identical to SEQ ID NO: 87820

SEQ ID NO: 277203 - RNA, 64 nt, hsa; identical to SEQ ID NO: 87821

SEQ ID NO: 277204 - RNA, 64 nt, hsa; identical to SEQ ID NO: 87822

SEQ ID NO: 277205 - RNA, 64 nt, hsa; identical to SEQ ID NO: 87823

SEQ ID NO: 277206 - RNA, 64 nt, hsa; identical to SEQ ID NO: 87824

SEQ ID NO: 277207 - RNA, 64 nt, hsa; identical to SEQ ID NO: 87825

SEQ ID NO: 277208 - RNA, 64 nt, hsa; identical to SEQ ID NO: 87826

SEQ ID NO: 277209 - RNA, 64 nt, hsa; identical to SEQ ID NO: 87827

SEQ ID NO: 277210 - RNA, 64 nt, hsa; identical to SEQ ID NO: 87828

SEQ ID NO: 277211 - RNA, 64 nt, hsa; identical to SEQ ID NO: 87829

SEQ ID NO: 277212 - RNA, 64 nt, hsa; identical to SEQ ID NO: 87830

SEQ ID NO: 277213 - RNA, 64 nt, hsa; identical to SEQ ID NO: 87831

SEQ ID NO: 277214 - RNA, 64 nt, hsa; identical to SEQ ID NO: 87832

SEQ ID NO: 277215 - RNA, 64 nt, hsa; identical to SEQ ID NO: 87833

SEQ ID NO: 277216 - RNA, 64 nt, hsa; identical to SEQ ID NO: 87834

SEQ ID NO: 277217 - RNA, 64 nt, hsa; identical to SEQ ID NO: 87835

SEQ ID NO: 277218 - RNA, 64 nt, hsa; identical to SEQ ID NO: 87836

SEQ ID NO: 277219 - RNA, 64 nt, hsa; identical to SEQ ID NO: 87837

SEQ ID NO: 277220 - RNA, 64 nt, hsa; identical to SEQ ID NO: 87838

SEQ ID NO: 277221 - RNA, 64 nt, hsa; identical to SEQ ID NO: 87839

SEQ ID NO: 277222 - RNA, 64 nt, hsa; identical to SEQ ID NO: 87840

SEQ ID NO: 277223 - RNA, 64 nt, hsa; identical to SEQ ID NO: 87841

SEQ ID NO: 277224 - RNA, 64 nt, hsa; identical to SEQ ID NO: 87842

SEQ ID NO: 277225 - RNA, 64 nt, hsa; identical to SEQ ID NO: 87843

SEQ ID NO: 277226 - RNA, 64 nt, hsa; identical to SEQ ID NO: 87844

SEQ ID NO: 277227 - RNA, 64 nt, hsa; identical to SEQ ID NO: 87845

SEQ ID NO: 277228 - RNA, 64 nt, hsa; identical to SEQ ID NO: 87846

SEQ ID NO: 277229 - RNA, 64 nt, hsa; identical to SEQ ID NO: 87847

SEQ ID NO: 277230 - RNA, 64 nt, hsa; identical to SEQ ID NO: 87848

SEQ ID NO: 277231 - RNA, 64 nt, hsa; identical to SEQ ID NO: 87849

SEQ ID NO: 277232 - RNA, 64 nt, hsa; identical to SEQ ID NO: 87850

SEQ ID NO: 277233 - RNA, 64 nt, hsa; identical to SEQ ID NO: 87851

SEQ ID NO: 277234 - RNA, 64 nt, hsa; identical to SEQ ID NO: 179628

SEQ ID NO: 277235 - RNA, 64 nt, hsa; identical to SEQ ID NO: 179629

SEQ ID NO: 277236 - RNA, 64 nt, hsa; identical to SEQ ID NO: 179630

SEQ ID NO: 277237 - RNA, 64 nt, hsa; identical to SEQ ID NO: 179631

SEQ ID NO: 277238 - RNA, 64 nt, hsa; identical to SEQ ID NO: 179632

SEQ ID NO: 277239 - RNA, 64 nt, hsa; identical to SEQ ID NO: 179633

SEQ ID NO: 277240 - RNA, 64 nt, hsa; identical to SEQ ID NO: 179634

SEQ ID NO: 277241 - RNA, 64 nt, hsa; identical to SEQ ID NO: 179635

SEQ ID NO: 277242 - RNA, 64 nt, hsa; identical to SEQ ID NO: 179636

SEQ ID NO: 277243 - RNA, 64 nt, hsa; identical to SEQ ID NO: 179637

SEQ ID NO: 277244 - RNA, 64 nt, hsa; identical to SEQ ID NO: 179638

SEQ ID NO: 277245 - RNA, 64 nt, hsa; identical to SEQ ID NO: 179639

SEQ ID NO: 277246 - RNA, 64 nt, hsa; identical to SEQ ID NO: 179640

SEQ ID NO: 277247 - RNA, 64 nt, hsa; identical to SEQ ID NO: 179641

SEQ ID NO: 277248 - RNA, 64 nt, hsa; identical to SEQ ID NO: 179642

SEQ ID NO: 277249 - RNA, 64 nt, hsa; identical to SEQ ID NO: 179643

SEQ ID NO: 277250 - RNA, 64 nt, hsa; identical to SEQ ID NO: 179644

SEQ ID NO: 277251 - RNA, 64 nt, hsa; identical to SEQ ID NO: 179645

SEQ ID NO: 277252 - RNA, 64 nt, hsa; identical to SEQ ID NO: 259559

SEQ ID NO: 277253 - RNA, 64 nt, hsa; identical to SEQ ID NO: 259560

SEQ ID NO: 277254 - RNA, 64 nt, hsa; identical to SEQ ID NO: 259561

SEQ ID NO: 277255 - RNA, 64 nt, hsa; identical to SEQ ID NO: 259562

SEQ ID NO: 277256 - RNA, 64 nt, hsa; identical to SEQ ID NO: 259563

SEQ ID NO: 277257 - RNA, 64 nt, hsa; identical to SEQ ID NO: 259564

SEQ ID NO: 277258 - RNA, 64 nt, hsa; identical to SEQ ID NO: 259565

SEQ ID NO: 277259 - RNA, 64 nt, hsa; identical to SEQ ID NO: 259566

SEQ ID NO: 277260 - RNA, 64 nt, hsa; identical to SEQ ID NO: 259567

SEQ ID NO: 277261 - RNA, 64 nt, hsa; identical to SEQ ID NO: 259568

SEQ ID NO: 277262 - RNA, 64 nt, hsa; identical to SEQ ID NO: 259569

SEQ ID NO: 277263 - RNA, 64 nt, hsa; identical to SEQ ID NO: 259570

SEQ ID NO: 277264 - RNA, 64 nt, hsa; identical to SEQ ID NO: 259571

SEQ ID NO: 277265 - RNA, 64 nt, hsa; identical to SEQ ID NO: 259572

SEQ ID NO: 277266 - RNA, 64 nt, hsa; identical to SEQ ID NO: 259573

SEQ ID NO: 277267 - RNA, 64 nt, hsa; identical to SEQ ID NO: 259574

SEQ ID NO: 277268 - RNA, 64 nt, hsa; identical to SEQ ID NO: 259575

SEQ ID NO: 277269 - RNA, 64 nt, hsa; identical to SEQ ID NO: 259576

SEQ ID NO: 277270 - RNA, 64 nt, hsa; identical to SEQ ID NO: 259577

SEQ ID NO: 277271 - RNA, 64 nt, hsa; identical to SEQ ID NO: 259578

SEQ ID NO: 277272 - RNA, 64 nt, hsa; identical to SEQ ID NO: 259579

SEQ ID NO: 277273 - RNA, 64 nt, hsa; identical to SEQ ID NO: 259580

SEQ ID NO: 277274 - RNA, 64 nt, hsa; identical to SEQ ID NO: 128887

SEQ ID NO: 277275 - RNA, 64 nt, hsa; identical to SEQ ID NO: 128888

SEQ ID NO: 277276 - RNA, 54 nt, hsa; identical to SEQ ID NO: 128889

SEQ ID NO: 277277 - RNA, 64 nt, hsa; identical to SEQ ID NO: 128890

SEQ ID NO: 277278 - RNA, 64 nt, hsa; identical to SEQ ID NO: 128891

SEQ ID NO: 277279 - RNA, 64 nt, hsa; identical to SEQ ID NO: 128892

SEQ ID NO: 277280 - RNA, 64 nt, hsa; identical to SEQ ID NO: 128893

SEQ ID NO: 277281 - RNA, 64 nt, hsa; identical to SEQ ID NO: 128894

SEQ ID NO: 277282 - RNA, 64 nt, hsa; identical to SEQ ID NO: 128895

SEQ ID NO: 277283 - RNA, 64 nt, hsa; identical to SEQ ID NO: 128896

SEQ ID NO: 277284 - RNA, 64 nt, hsa; identical to SEQ ID NO: 128897

SEQ ID NO: 277285 - RNA, 64 nt, hsa; identical to SEQ ID NO: 128898

SEQ ID NO: 277286 - RNA, 64 nt, hsa; identical to SEQ ID NO: 128899

SEQ ID NO: 277287 - RNA, 64 nt, hsa; identical to SEQ ID NO: 128900

SEQ ID NO: 277288 - RNA, 64 nt, hsa; identical to SEQ ID NO: 128901

SEQ ID NO: 277289 - RNA, 64 nt, hsa; identical to SEQ ID NO: 128902

SEQ ID NO: 277290 - RNA, 64 nt, hsa; identical to SEQ ID NO: 128903

SEQ ID NO: 277291 - RNA, 64 nt, hsa; identical to SEQ ID NO: 128904

SEQ ID NO: 277292 - RNA, 64 nt, hsa; identical to SEQ ID NO: 128905

SEQ ID NO: 277293 - RNA, 64 nt, hsa; identical to SEQ ID NO: 128906

SEQ ID NO: 277294 - RNA, 64 nt, hsa; identical to SEQ ID NO: 128907

SEQ ID NO: 277295 - RNA, 64 nt, hsa; identical to SEQ ID NO: 128908

SEQ ID NO: 277296 - RNA, 64 nt, hsa; identical to SEQ ID NO: 128909

SEQ ID NO: 277297 - RNA, 64 nt, hsa
ucgguuuugaaucucaugaaccuugagugcuggagcaucugaucugucucuaugccaccacugg

SEQ ID NO: 277298 - RNA, 64 nt, hsa
cuuggcugugguaauccaggguaauugcgcagaggcaucugauguguaggaaaguaauucuggg

SEQ ID NO: 277299 - RNA, 64 nt, hsa
agugggaauaacaaauguucugguugugaagagugcaucugaagugcuuacacggcgucuggca

SEQ ID NO: 277300 - RNA, 64 nt, hsa
aucaguaggguuugucccugaugccuuuacaacagcaucugagcaccucucaaguuuuuccagg

SEQ ID NO: 277301 - RNA, 64 nt, hsa
aauacacacuagagaaaaaccuuacaaaugugaagcaucugauaaauccugugaagcgucugau

SEQ ID NO: 277302 - RNA, 64 nt, hsa
ugggaagauauuuaucaaauucaggcuucauucagcaucugagaguucacaccagggagaaauc

SEQ ID NO: 277303 - RNA, 64 nt, hsa
cggagggaggcagaggggagacugugguagaaggaagacagaacucacacaugcucccaggauu

SEQ ID NO: 277304 - RNA, 64 nt, hsa
gagaucauugagugacccagaaagcucuuuugaaaagacagacuccucaaggagagauaaagag

SEQ ID NO: 277305 - RNA, 64 nt, hsa
aggguaucuccucuggaaggaucuaagagaagguaagacagauuaggacaucgaaaaggaggau

SEQ ID NO: 277306 - RNA, 64 nt, hsa
auaauuuguuugcuguguaaggaagaauguagacaagacagauaaaucugaaggucauguggca

SEQ ID NO: 277307 - RNA, 64 nt, hsa
acccuucaauugccaaauuugauauguugcacugaagacagacccugucauauauuuaauggcu

SEQ ID NO: 277308 - RNA, 64 nt, hsa
agacuuuuucauagagaagaggcuuucuuuuguaaagacagaauaaaaauaauuguuauguuuc

SEQ ID NO: 277309 - RNA, 64 nt, hsa
agauuccuccaugucagcucccaucacggccccaaagacagagucacuugguugcugagucacu

SEQ ID NO: 277310 - RNA, 64 nt, hsa
cccauauagacuugaucucaaagaagcagauaagaagacagaaaaguguuuuaaguguaagauc

SEQ ID NO: 277311 - RNA, 64 nt, hsa
uaguucagccauuguggaagacaguguggggauaaagacagagauaccauucaacccagcaauc

SEQ ID NO: 277312 - RNA, 64 nt, hsa
ugcaggguacuacgcaagccuuaaaauuuuucuuaagacagagucuugcucugucucccaggcu

SEQ ID NO: 277313 - RNA, 64 nt, hsa
aaccucuuagacucuuagaaauaaaaguagaagaaagacagaaaaaauaacugauuagacccaa

SEQ ID NO: 277314 - RNA, 64 nt, hsa
ugccuuggugccgcaguggcccaucuuuuaugggaagacagagugaugcaccuucccgcugcug

SEQ ID NO: 277315 - RNA, 64 nt, hsa
agaucccacuggauggguagcugaaauaaaggaaaagacagagaaaggggcuguggugcuuguu

SEQ ID NO: 277316 - RNA, 64 nt, hsa
cagggguguguggaguaaauagcucgaagagcugaagacagaaaaccaguuucacgccaggugc

SEQ ID NO: 277317 - RNA, 64 nt, hsa
aggcaagccuggccaucuguauuuuuuuuuuuccaagacagagucuugcucuguugcccaagcu

SEQ ID NO: 277318 - RNA, 64 nt, hsa
auuccugcacgaaguggcugaugggaaccauuucaagacagauugugaagauugauagaaaauc

SEQ ID NO: 277319 - RNA, 64 nt, hsa
agucagcucuaauuguucaccacagaacucauauaagacagaaacccuauggguguaaugaaug

SEQ ID NO: 277320 - RNA, 64 nt, hsa
ugagcugugaucgugccacuguacucuagccuggaagacagagugagaccccaucucaggaaaa

SEQ ID NO: 277321 - RNA, 64 nt, hsa
ugggccuucagaugucacccuaauccacuucccuaagacagaauuucuggacaagauggguaag

SEQ ID NO: 277322 - RNA, 64 nt, hsa
ucucucaucauacucuuguuucuuagaaauaagcaagacagagcaggaaauggaauaugcgggu

SEQ ID NO: 277323 - RNA, 62 nt, hsa
agaugcuggaugagcucugaggcaggguugagaagacagaucuagucaggaccaccagccau

SEQ ID NO: 277324 - RNA, 64 nt, hsa
gagcauggugggccaugcucugggcagcuguuccaagacagagcugacccuuccauuaccaaug

SEQ ID NO: 277325 - RNA, 64 nt, hsa
gggucgggggucuucuguuucacuaacaggaacaaagacagaaaccaugacagggcugccccgc

SEQ ID NO: 277326 - RNA, 64 nt, hsa
uuucaaagaagagcucauagacugacugguccagaagacagaggguacaacaguggcaucacag

SEQ ID NO: 277327 - RNA, 64 nt, hsa
ugaccagccggagcagccggagcugaagcggaucaagacagaagacggcgagggcaucgucauu

SEQ ID NO: 277328 - RNA, 64 nt, hsa
aaacccaaaacccagcuggccuuaacacuccuuaaagacagaagucacacuugaacaaaaccca

SEQ ID NO: 277329 - RNA, 64 nt, hsa
agggaggacagugugagaaggcgaugauccaaagaagacagagaggucagccccacccgauccc

SEQ ID NO: 277330 - RNA, 64 nt, hsa
aaagcagcuuuugggggaaacugaggcaguggggaagacagagcagaaugagcccucacccugg

SEQ ID NO: 277331 - RNA, 64 nt, hsa
aguguguucaaugggaccugcuguggggaguccuaagacagacaucuaauuauucucucuuuuu

SEQ ID NO: 277332 - RNA, 64 nt, hsa
uuugggcagcauugauagaaguauggagggguucaagacagagcccaccugaucaagaucauca

SEQ ID NO: 277333 - RNA, 64 nt, hsa
cuggcgggcgggcugcgcggaggcucgggagcuggccggggaggggcggauggaggggccuggg

SEQ ID NO: 277334 - RNA, 64 nt, hsa
cggagacaccagcgcuggcuucccgggcccgcgggccggggagggaagccucggggcugcgggg

SEQ ID NO: 277335 - RNA, 59 nt, hsa
ucccguuccugggggcguagaggggccgggccggggacgaggccuccugcggacaccag

SEQ ID NO: 277336 - RNA, 64 nt, hsa
gacaccagcuccucucuccgccgucaccggggaggccggggauccuugcagggcuucuggggcg

SEQ ID NO: 277337 - RNA, 64 nt, hsa
ccagguggaccggcccgcgcuccgcccccagcgagccggggacccacccaccaccccccgcacc

SEQ ID NO: 277338 - RNA, 64 nt, hsa
cccggaagccgagcgagcggccggcgcgcucaucgccggggagcccgccagguggaccggcccg

SEQ ID NO: 277339 - RNA, 64 nt, hsa
gguuggggcagaccggacccagguuuccugacuccuggcccaagucucuuccuccuauccugcg

SEQ ID NO: 277340 - RNA, 64 nt, hsa
gcggaagaaagcucgggcccuggaggcugcggcucuggcccacugagccaccgcgcccuccugc

SEQ ID NO: 277341 - RNA, 64 nt, hsa
acccggagcugguguggccauuccccaagugccacuggcccauggaugggggugggugcuggug

SEQ ID NO: 277342 - RNA, 64 nt, hsa
gccugggaguggcucuguguggaccagucccucacuggcccauucuuuuuuugacgcagccaau

SEQ ID NO: 277343 - RNA, 64 nt, hsa
uauuuugugcauuacaggauauuuagcagcaacccuggcccacucuaguuaugacaaccaaaaa

SEQ ID NO: 277344 - RNA, 64 nt, hsa
ggggcaucuuuccugcccucugccaaccucccugcuggcccaggugagaggaggaagagggguc

SEQ ID NO: 277345 - RNA, 64 nt, hsa
guuaccaccaacuggcuggcccuccuccucuucccuggcccauugaucaucccuucucacagag

SEQ ID NO: 277346 - RNA, 64 nt, hsa
accucugguuccugggaugagccauacccuggaacuggcccacccacugugucuuccacguaag

SEQ ID NO: 277347 - RNA, 64 nt, hsa
aggcugguggacagacccaggguggucuucaagccuggcccagugagagugaggcccccgcacg

SEQ ID NO: 277348 - RNA, 64 nt, hsa
cuucccgcccucccccugccagaggccuggugcccuggcccagccuguggccucagcaucucau

SEQ ID NO: 277349 - RNA, 64 nt, hsa
acuauccagauggaggcaccaaacacccacauaccuggcccaaccagacuucucccgugagcca

SEQ ID NO: 277350 - RNA, 64 nt, hsa
gcagcuguacugaggaugauguuauucacagccccuggcccacccacuaauacuacugcacaga

SEQ ID NO: 277351 - RNA, 64 nt, hsa
aggccaaggaccccugaugcagacucuggaaucccuggcccaaaggccugucugggcccaucug

SEQ ID NO: 277352 - RNA, 64 nt, hsa
ccuuagccaaagggaacgugucauuugcucgacccuggcccacccuugccgcccagcuguugug

SEQ ID NO: 277353 - RNA, 64 nt, hsa
uccuaaucagaaucagccacccaagcaagccucucuggcccacauaucuaucucuugccuuccc

SEQ ID NO: 277354 - RNA, 64 nt, hsa
cucuacauuccuuaggauuucucucccuaucaagcuggcccagauacaaguaccaaacaguagu

SEQ ID NO: 277355 - RNA, 64 nt, hsa
uaaccucacccccaaacuccacgggugccccuagcuggcccagagccggcagugugagcccaag

SEQ ID NO: 277356 - RNA, 64 nt, hsa
aggaucggacgugcuaccccucccggucccggcccuggcccagccagcccagcccucgaggcuc

SEQ ID NO: 277357 - RNA, 64 nt, hsa
guugguagugaaugggccugguugggagcagccccuggcccauugcccacccacccaucucacu

SEQ ID NO: 277358 - RNA, 64 nt, hsa
cuccggaguggcccgccaccuccugaagcagggccuggcccacccaaggugccuggggcaggcg

SEQ ID NO: 277359 - RNA, 64 nt, hsa
gcccuggguuucuagcggugccugaggcaucacucuggcccauugacagaugagaggucugaag

SEQ ID NO: 277360 - RNA, 64 nt, hsa
ccaggccgcugcgguacacuggaugguucugaagcuggcccauugaaagagccucuuaaggcag

SEQ ID NO: 277361 - RNA, 64 nt, hsa
agcaugccaggggugugugcgcaccuccccggcccuggcccaccuucuggagcgaacugcaccg

SEQ ID NO: 277362 - RNA, 64 nt, hsa
gcuuuuuuauuuggagaaccguccagcaugcauccuggcccacggccugagcaagcugcagccc

SEQ ID NO: 277363 - RNA, 64 nt, hsa
ucaauuuggugcucacguguccuuaacaccugaucuggcccaagcugggcucccuuuaagccaa

SEQ ID NO: 277364 - RNA, 64 nt, hsa
gggcuuccugggcaguuggggcggcccacgccagcuggcccaguggguagugaauuggcuuccu

SEQ ID NO: 277365 - RNA, 64 nt, hsa
agaaugcagacuuuucagacugaccccagaaauucuggcccagccaaucuagaggcaagccugg

SEQ ID NO: 277366 - RNA, 64 nt, hsa
gcugcgggcacccauccgcuccgugaccuacacccuggcccagcuccccugcgccuccauggcu

SEQ ID NO: 277367 - RNA, 64 nt, hsa
ccucgcccagguaccuguacgugaacagccgcgccuggcccaacggugcggugguggccgaccc

SEQ ID NO: 277368 - RNA, 64 nt, hsa
ggagcgcaugcuagagaccaagguggccgagcugcuggcccagggccacaccaagccacccgag

SEQ ID NO: 277369 - RNA, 64 nt, hsa
gggaccagcaguagaccccccacucuccccaccccuggcccacuguggugugugcugggcaaau

SEQ ID NO: 277370 - RNA, 64 nt, hsa
gcacccucuguccagagucuagggcaguccuccacuggcccagcacuccaguuuccuuucccug

SEQ ID NO: 277371 - RNA, 64 nt, hsa
gucaggcugccacacugaaccauaucgaugaggucuggcccagccucuuccugggagaugcgug

SEQ ID NO: 277372 - RNA, 64 nt, hsa
ccuggcacugauccugcuggugcugcuggaggcucuggcccaggcggacacacagaagauggug

SEQ ID NO: 277373 - RNA, 64 nt, hsa
uuuuguaauuauugugauuucccguggccccagccuggcccagcucccccgggaggggcccgcu

SEQ ID NO: 277374 - RNA, 64 nt, hsa
aggcuggcuggggccuaucagugugccccccauccuggcccaucaguguacccccgcccaggcu

SEQ ID NO: 277375 - RNA, 64 nt, hsa
cgaaacaccacccucugcuccuccuucuccuguccuggcccaggcauccuaggggcugaaaucc

SEQ ID NO: 277376 - RNA, 64 nt, hsa
ucacuacugggugcugcccugcguggcugaccagcuggcccaggauuucacagucgaaaaggaa

SEQ ID NO: 277377 - RNA, 58 nt, hsa
agaaugggaaucuggauuagcccuggggcuggcccaggucuucauugaguccaaagug

SEQ ID NO: 277378 - RNA, 64 nt, hsa
agagggucuguccccuccucuccacgucccagaacuggcccagcugcaggcacuaagaagcucc

SEQ ID NO: 277379 - RNA, 64 nt, hsa
ccuagccuuccccauaucuccugccucagccccccuggcccagugcuggggcgucagcuaaacc

SEQ ID NO: 277380 - RNA, 64 nt, hsa
uguggacuguuccccccacugugguaggacaggacuggcccacuuaguccucaagcucccaacc

SEQ ID NO: 277381 - RNA, 64 nt, hsa
ggacaccaggcuggcugcuuuuuuuagccugccccuggcccaggcccaguccuuggugucaggg

SEQ ID NO: 277382 - RNA, 64 nt, hsa
aguguaagggcccuucacaaaagcagaaggaacacuggcccaaacccccagcaccccggaagca

SEQ ID NO: 277383 - RNA, 64 nt, hsa
ggugacuacggggucgcccuuugcucacgucucucuggcccacucaugauggagaagugugguc

SEQ ID NO: 277384 - RNA, 64 nt, hsa
ccuuucagcugcugcuuaaugcccugcucucucccuggcccaccuuauagagagcccaaagagc

SEQ ID NO: 277385 - RNA, 64 nt, hsa
auggccccugugugguucccuuuaccuuggcuuccuggcccagucccugccucuccaccugcac

SEQ ID NO: 277386 - RNA, 64 nt, hsa
cccagucccugccucuccaccugcacccugcuuccuggcccagucccagguuggagucccucug

SEQ ID NO: 277387 - RNA, 64 nt, hsa
acgucacuagagacugggagccgaggcaguggugcuggcccaagugaaggccagagugaggacu

SEQ ID NO: 277388 - RNA, 64 nt, hsa
aaagguguccuccaugcccucaggcagcagagaacuggcccagagcccuuggaguguuggugga

SEQ ID NO: 277389 - RNA, 64 nt, hsa
cuagacucccaaaggagcccaggcucaggcaggccuggcccagagucacgcuggcaaccacgag

SEQ ID NO: 277390 - RNA, 64 nt, hsa
gcccaggcucuccuuucgcuuggcgugggcuuugcuggcccagugugugcuccuggcucagcag

SEQ ID NO: 277391 - RNA, 64 nt, hsa
agguucugcgaugagaggugcaggaggcaggagccuggcccagggggugcuggugccuccccgg

SEQ ID NO: 277392 - RNA, 64 nt, hsa
uccugggcauuggagaugaugaaaccgagcagaccuggcccauguggagcuggcaugggggaca

SEQ ID NO: 277393 - RNA, 64 nt, hsa
acuucccauuagcaggagcuccccagcggcaagccuggcccagugggcucgguagugcccagcu

SEQ ID NO: 277394 - RNA, 64 nt, hsa
uccuucccggccauauuaaccacacagccugagccuggcccagccucggcugccagaggugccu

SEQ ID NO: 277395 - RNA, 64 nt, hsa
ugcaauaggaggggacccgagccuguccuggcugcuggcccauccugccugggcaucccuggug

SEQ ID NO: 277396 - RNA, 64 nt, hsa
gucugagcagagcuggguccccccaaaacuugggcuggcccagggcccaccagcagcugauguu

SEQ ID NO: 277397 - RNA, 64 nt, hsa
aggcggggcaccugcaugcacugggagggggcggcuggcccagcccucggggcaggagcccccu

SEQ ID NO: 277398 - RNA, 64 nt, hsa
uggccugagaccaccggugugggucacgagggcccuggcccacaguguugaggguccucucuuu

SEQ ID NO: 277399 - RNA, 64 nt, hsa
gggacaggcccugggacugugguggccgguggcccuggcccagcucuggagugcaugugugugu

SEQ ID NO: 277400 - RNA, 64 nt, hsa
acagaacuauuucuugcugcucaauccauuuccucuggcccagcuucccagugcucacagaugg

SEQ ID NO: 277401 - RNA, 64 nt, hsa
uccucuggcccagcuucccagugcucacagauggcuggcccaugugcuggaagaugacacaguu

SEQ ID NO: 277402 - RNA, 64 nt, hsa
uugauguauccugagguuccuagaucucacugaacuggcccagcuaaggagaccuggacucugg

SEQ ID NO: 277403 - RNA, 64 nt, hsa
agccaccugagccagcuuuauauuucaaccauggcuggcccaucugagagcaucuccccacucu

SEQ ID NO: 277404 - RNA, 64 nt, hsa
ccuggaguuaagggaugaaggcaaggcugcaggucuggcccaggggaauuaaaagccagccacu

SEQ ID NO: 277405 - RNA, 64 nt, hsa
ugcccaaccuccaaguggacuucuugcaaagggucuggcccagggcagggcugccccacacaag

SEQ ID NO: 277406 - RNA, 64 nt, hsa
uaacaucucuggucuuuagagccaccagaucucucuggcccauacagauaucagagcagacgga

SEQ ID NO: 277407 - RNA, 64 nt, hsa
ucucugaucagcuggauccccacgugagcaacagcuggcccaggaaaggcugccugcagaggac

SEQ ID NO: 277408 - RNA, 64 nt, hsa
gccucugcuucccucccuucuccucugucuugcccuggcccacgcacgccugucucgucuuccu

SEQ ID NO: 277409 - RNA, 64 nt, hsa
cucuuggacccugcgggaugccggggcggccaggcuggcccaacggacagacaggaccaggauc

SEQ ID NO: 277410 - RNA, 64 nt, hsa
acuguccuccagcccgcccccagccuguggacgccuggcccacccugagugugagucacagaga

SEQ ID NO: 277411 - RNA, 64 nt, hsa
gucauggccauccugcccggagaggcgccuguaccuggcccaggcuggccugagccugaugcug

SEQ ID NO: 277412 - RNA, 64 nt, hsa
gcuaagggggcaaaaagcccagauaccauuuuaacuggcccaguucauuuucuccuuucauuuu

SEQ ID NO: 277413 - RNA, 64 nt, hsa
aaaauaacagugccuuugaccuuaaaacauggcacuggcccaugugaccuuugccauuucccag

SEQ ID NO: 277414 - RNA, 64 nt, hsa
aaaggcccagaucaccgaggaggaggcaaaacuucuggcccagaaggccgcagaggcugagcag

SEQ ID NO: 277415 - RNA, 64 nt, hsa
guaagcccuguggcuccacaggugcugcuucucacuggcccagacucugagcuccaccggccca

SEQ ID NO: 277416 - RNA, 64 nt, hsa
auggucucaagccugaagaggcuccgcccacaagcuggcccaugaaguuagcaaugccuguggc

SEQ ID NO: 277417 - RNA, 64 nt, hsa
uuaucccugcgcuagucucccccgaggguuuaggcuggcccagcacauccuguccuccugagcu

SEQ ID NO: 277418 - RNA, 64 nt, hsa
cuucaccucucagacgaggcagcugacgaggcagcuggcccagucuugggagucugcucaggac

SEQ ID NO: 277419 - RNA, 64 nt, hsa
cauccccaccccagccgggcccgcucaggaugcccuggcccaggcuuggggcugcugggguugg

SEQ ID NO: 277420 - RNA, 64 nt, hsa
guugucagaggcgggggacagcagaggcugcagacuggcccacuucccuccuccccagggaugc

SEQ ID NO: 277421 - RNA, 60 nt, hsa
gccgcaugucuggacacugaucaggcccugcuggcccaggucccugugcgcaugcacaug

SEQ ID NO: 277422 - RNA, 64 nt, hsa
uuuuaauagguucacuggaaguaggagaauuuucaagaaccauacuucgacauuuccucugcca

SEQ ID NO: 277423 - RNA, 64 nt, hsa
aggaaugaaguuggaaccacaggcagaucugaaaaagaaccaaauagagcuccuaaaaaugaga

SEQ ID NO: 277424 - RNA, 64 nt, hsa
gggaagagagccuggaaaagaaccaggccuggaaaagaaccagaaggaggcugggcagaaccag

SEQ ID NO: 277425 - RNA, 64 nt, hsa
ugucauuguucaaaggugggaagagagccuggaaaagaaccaggccuggaaaagaaccagaagg

SEQ ID NO: 277426 - RNA, 64 nt, hsa
ucaucacauaccccucucacagagaaaauuaucaaagaaccagaaauuauaucuguuuuggagc

SEQ ID NO: 277427 - RNA, 64 nt, hsa
auguagaagaucuuaaguccauacgcauuucaugaagaaccauuggaaagaggaaucugcaauc

SEQ ID NO: 277428 - RNA, 64 nt, hsa
cugggguacuuuaaagaaaugcaaauagcaauugaagaaccacugcugcaggugguagcccugg

SEQ ID NO: 277429 - RNA, 64 nt, hsa
gaccuucugaagugucacuggcaccauaugcaacaagaaccaccauucacugaguagcuaaugg

SEQ ID NO: 277430 - RNA, 64 nt, hsa
uuggggccuucuuaacaaaagucuuugauaacuuaagaaccaaaguaacagaguaaacagaggc

SEQ ID NO: 277431 - RNA, 64 nt, hsa
uuucuauuuuuaagauuagaggaaaaugaccauuaagaaccagaaaaauaauuaaucucucugg

SEQ ID NO: 277432 - RNA, 64 nt, hsa
caaaugauaaggaugccacauuuuucaugcagaaaagaaccacagguauucaguuucuuguauu

SEQ ID NO: 277433 - RNA, 64 nt, hsa
uuaguguguauuguacauaaagucggcuucucuaaagaaccauugguuucuucacaucuggguc

SEQ ID NO: 277434 - RNA, 64 nt, hsa
agagcacaggcuccagcaauaugucugcauugaaaagaaccaaaaaaaugcaaacuaugaugcc

SEQ ID NO: 277435 - RNA, 64 nt, hsa
acauuacaaguggccaaaaccccuguucucagugaagaaccacauuggauuuguauucuguuca

SEQ ID NO: 277436 - RNA, 64 nt, hsa
ggguuaugagccuacuggauugagguuaaaauccaagaaccaacauuuagagcuuugugcuuuu

SEQ ID NO: 277437 - RNA, 64 nt, hsa
uauccuccaaugugugcauggaacaaauaaucaaaagaaccagacugugucuuauucucccacu

SEQ ID NO: 277438 - RNA, 64 nt, hsa
ugugagauugcaguucuguauuucgaaugagucuaagaaccacagggauaauacugugcagauu

SEQ ID NO: 277439 - RNA, 64 nt, hsa
gacagagcagcauaucuuugcucauacaaacuagaagaaccagcugauccuugagaaauuuacg

SEQ ID NO: 277440 - RNA, 64 nt, hsa
cuggaaugccaugaacuggagaaggugagcgcugaagaaccaggaugggacggggcuggaacag

SEQ ID NO: 277441 - RNA, 64 nt, hsa
uugguucuagaugaaccaauuaucuggaaaaugaaagaaccagaguuggaaggcacuugacugg

SEQ ID NO: 277442 - RNA, 64 nt, hsa
agaacaaugggaaagaggacugggagaggaaucuaagaaccagauggcuucagcucucuagagg

SEQ ID NO: 277443 - RNA, 64 nt, hsa
cucacuuccuuacuccuccaaaaagaaguggggaaagaaccaucaaaccuuuccuccugacuua

SEQ ID NO: 277444 - RNA, 64 nt, hsa
aaacaaagaacuggguguugaguauucaucaacuaagaaccaaaauccagggcacucauaugug

SEQ ID NO: 277445 - RNA, 64 nt, hsa
ccaaaccaguaucugaacugcuuggggggugggaaagaaccaagccaugcucugucuacuggca

SEQ ID NO: 277446 - RNA, 64 nt, hsa
gucaauguaagaagggaaagggagaagauauuugaagaaccagaauguaaauucauguguuucc

SEQ ID NO: 277447 - RNA, 64 nt, hsa
augucauuccaguauaaaacauucuccucuacccaagaaccauagccaugauuguuauaaauca

SEQ ID NO: 277448 - RNA, 64 nt, hsa
ugacaaagaagagcuacgcucugugcacgaagucaagaaccaaacagcucagggacccucuugc

SEQ ID NO: 277449 - RNA, 64 nt, hsa
guugggaucugccuuuuucauccagagcucugaugccugugaacacugaaagagaaagccuaau

SEQ ID NO: 277450 - RNA, 64 nt, hsa
ccaggaguucaaggcuauagugugcuaugaucaugccugugaauagccacugcacuugagccuc

SEQ ID NO: 277451 - RNA, 64 nt, hsa
ccuggaugcccagcagcccuguccugugucuugggccugugagucaaagaaaagguccuuuuca

SEQ ID NO: 277452 - RNA, 64 nt, hsa
aucccugcccgagcauguaucggcaacaugggcagccugugaccgggucuggggcgaggccagg

SEQ ID NO: 277453 - RNA, 64 nt, hsa
ggcucuaggcuucuccugcugaguccuggucuuggccugugaaugugccucguucaucccuggu

SEQ ID NO: 277454 - RNA, 64 nt, hsa
uuugaaguuuucugcucuacuuuccuuggcagcagccugugaacuacucaaaagaguccccuug

SEQ ID NO: 277455 - RNA, 64 nt, hsa
cuugugugcgccccaugggacccccaguguucuugccugugaccucuuauugcgacaugcaggu

SEQ ID NO: 277456 - RNA, 64 nt, hsa
aauauccacaccucggcaacagucuaagaugagagccugugacagguggcagcgcccccaggug

SEQ ID NO: 277457 - RNA, 64 nt, hsa
caaaugcagggcaugggcucugguucugccaggagccugugacacccccaggaaggggguggaa

SEQ ID NO: 277458 - RNA, 64 nt, hsa
ggguguggcucccccaaacgaaguacugacuucagccugugaggggaggguugagggaggcucu

SEQ ID NO: 277459 - RNA, 64 nt, hsa
uuuccuuaucuguaaagcaaagcgacaccagcaagccugugagcauuguguauauagcagacau

SEQ ID NO: 277460 - RNA, 64 nt, hsa
ggugucuccaggcacaaaggcccgaacacaggaagccugugaccauggcagccuugucuuaugg

SEQ ID NO: 277461 - RNA, 64 nt, hsa
caggagauacaacagaggagauaaucuccaggaugccugugaagaaagaucccuggaucccagg

SEQ ID NO: 277462 - RNA, 64 nt, hsa
ugauugcucacaccaaagccuuggaccccucccagccugugaccuuugggaccaacuccaccua

SEQ ID NO: 277463 - RNA, 64 nt, hsa
accuggugacuugucagugucugugucugugugugccugugagccagcaucucuguaucagugu

SEQ ID NO: 277464 - RNA, 64 nt, hsa
aaacacaggucugugugugcaaucucacauaucugccugugagacuggauugagacccauucgu

SEQ ID NO: 277465 - RNA, 64 nt, hsa
uuaaagcagucacuucagacaggagccacagggagccugugagggaguagugcgguggugguga

SEQ ID NO: 277466 - RNA, 64 nt, hsa
ugaguggagcccaguccagcgacaccuugguuuggccugugagacugagaagagagccagccac

SEQ ID NO: 277467 - RNA, 64 nt, hsa
gugcagguacgugcagcacuacggccugggcagugccugugacaacguagagcgcgugcugaag

SEQ ID NO: 277468 - RNA, 64 nt, hsa
uaaaaucuccaguuaaagggccuguuucuuacuggccugugaggugcaccguagugccuugggc

SEQ ID NO: 277469 - RNA, 64 nt, hsa
aaagaugggaggagaccagcgguccaugggucuggccugugagucuccccuugcagccugguca

SEQ ID NO: 277470 - RNA, 64 nt, hsa
ucacgggccccauuccaccgccuccccaacuugagccugugaccuugggaccaaagggggaguc

SEQ ID NO: 277471 - RNA, 64 nt, hsa
aguagcguagcgugcccgugugcauguccuuugcgccugugaccaccaccccaacaaaccaucc

SEQ ID NO: 277472 - RNA, 64 nt, hsa
agagaccaggcugugucccucuucucuucccugcgccugugaugcugggcacuucaucugaucg

SEQ ID NO: 277473 - RNA, 64 nt, hsa
uaaaugaccacaguaccuuaauuucuaggugggugccugugaugguucauuguagguaaggaca

SEQ ID NO: 277474 - RNA, 64 nt, hsa
cuaugacaguaaaggcucucugccugcugccaaggccugugacuuucuaaccuggccucacgcu

SEQ ID NO: 277475 - RNA, 64 nt, hsa
gauugcuggacccagaggcaagaucugcagagaugccugugagauauuugcuuuccuagagggg

SEQ ID NO: 277476 - RNA, 64 nt, hsa
ccagcagcugaaacucuucaauguuugaauggcugccugugaagguagugagugccccaucacu

SEQ ID NO: 277477 - RNA, 64 nt, hsa
gaaugucugagugaggguccugcuuagcucuuuggccugugagaugcuuugaaaauuuuuauuu

SEQ ID NO: 277478 - RNA, 64 nt, hsa
uugaagcuggggugaccgcaggagacccuguaaggccugugagcggagcccucgaccccgugac

SEQ ID NO: 277479 - RNA, 64 nt, hsa
gucucucuccuccuuacucuuggauaaauaaacagccugugagcacacaggcagcccggcccag

SEQ ID NO: 277480 - RNA, 64 nt, hsa
gcccaggacccagacgcaggacagaguggacucugccugugaugggguggccuuccugcugccc

SEQ ID NO: 277481 - RNA, 64 nt, hsa
ucugaacugcugcuggucacccccacccccgggugccugugaccgggguccugaggcuggggcu

SEQ ID NO: 277482 - RNA, 64 nt, hsa
cccagaggggcggggccaggauggcguguccccugccugugagugacaucgguucaggaggaga

SEQ ID NO: 277483 - RNA, 64 nt, hsa
cuucaguguagcccauucuugauccagagcuguugccugugacagcgguuucucuggaugucaa

SEQ ID NO: 277484 - RNA, 64 nt, hsa
ugacugugacuguugcccuuagccagccagaugcgccugugaaccaaagcuucgugcacaugug

SEQ ID NO: 277485 - RNA, 64 nt, hsa; identical to SEQ ID NO: 182019

SEQ ID NO: 277486 - RNA, 64 nt, hsa; identical to SEQ ID NO: 182020

SEQ ID NO: 277487 - RNA, 64 nt, hsa; identical to SEQ ID NO: 182021

SEQ ID NO: 277488 - RNA, 64 nt, hsa; identical to SEQ ID NO: 182022

SEQ ID NO: 277489 - RNA, 64 nt, hsa; identical to SEQ ID NO: 182023

SEQ ID NO: 277490 - RNA, 64 nt, hsa; identical to SEQ ID NO: 182024

SEQ ID NO: 277491 - RNA, 64 nt, hsa; identical to SEQ ID NO: 182025

SEQ ID NO: 277492 - RNA, 64 nt, hsa; identical to SEQ ID NO: 182026

SEQ ID NO: 277493 - RNA, 64 nt, hsa; identical to SEQ ID NO: 182027

SEQ ID NO: 277494 - RNA, 64 nt, hsa; identical to SEQ ID NO: 182028

SEQ ID NO: 277495 - RNA, 64 nt, hsa; identical to SEQ ID NO: 182029

SEQ ID NO: 277496 - RNA, 64 nt, hsa; identical to SEQ ID NO: 182030

SEQ ID NO: 277497 - RNA, 64 nt, hsa; identical to SEQ ID NO: 182031

SEQ ID NO: 277498 - RNA, 64 nt, hsa; identical to SEQ ID NO: 182032

SEQ ID NO: 277499 - RNA, 64 nt, hsa; identical to SEQ ID NO: 182033

SEQ ID NO: 277500 - RNA, 64 nt, hsa; identical to SEQ ID NO: 182034

SEQ ID NO: 277501 - RNA, 64 nt, hsa; identical to SEQ ID NO: 182035

SEQ ID NO: 277502 - RNA, 64 nt, hsa; identical to SEQ ID NO: 182036

SEQ ID NO: 277503 - RNA, 64 nt, hsa; identical to SEQ ID NO: 182037

SEQ ID NO: 277504 - RNA, 64 nt, hsa; identical to SEQ ID NO: 182038

SEQ ID NO: 277505 - RNA, 64 nt, hsa; identical to SEQ ID NO: 182039

SEQ ID NO: 277506 - RNA, 63 nt, hsa; identical to SEQ ID NO: 182040

SEQ ID NO: 277507 - RNA, 62 nt, hsa
gaagccccgcugcugagaugggcgcucccgacacagcgcagacccaccaggaggaaagaggc

SEQ ID NO: 277508 - RNA, 62 nt, hsa
gugaauggugagggugggagucaggagacaagacagcgcagagagggcugguuagccggaaa

SEQ ID NO: 277509 - RNA, 62 nt, hsa
acaagacaguugacuugauuuugcacaguguaacagcgcaguugcauucuggccacuuugac

SEQ ID NO: 277510 - RNA, 62 nt, hsa
ccagaacuucguacccuuugcacacaggggcuacagcgcauuuucuaccugaaauuggaaga

SEQ ID NO: 277511 - RNA, 62 nt, hsa
ccuuuuuucuuuaaggcucccaacaaugcuauacagcgcaguuguuuccauuccuauuuuua

SEQ ID NO: 277512 - RNA, 62 nt, hsa
ccugaugauaauggugcuuggaaaucaagcaaacagcgcacaucaacuucugacucugaggg

SEQ ID NO: 277513 - RNA, 62 nt, hsa
gugcggaggcaagcaagcuccaugugguggggacagcgcauugcgaccuccaccaccccugc

SEQ ID NO: 277514 - RNA, 62 nt, hsa
agaaaaguugaugauagauugccuucacccucacagcgcacaaauaaagcuacgaugccaac

SEQ ID NO: 277515 - RNA, 62 nt, hsa
ugugcucuggugacccgaggaggucgugcagcacagcgcagaagccccugcccacgggaucc

SEQ ID NO: 277516 - RNA, 62 nt, hsa
agggucacugucauucccuggccauguugcaaacagcgcaauuccaagcucgagagcuucag

SEQ ID NO: 277517 - RNA, 62 nt, hsa
aguuaagugcagauuccuuacagacauauagaacagcgcauucuucuguagacauuugcuca

SEQ ID NO: 277518 - RNA, 62 nt, hsa
uaagagguauuggauuuucacagaggaagaacacagcgcagaaugaagggccaggcuuacug

SEQ ID NO: 277519 - RNA, 62 nt, hsa
auagaaacauuuagcaguacguacagagccugacagcgcagcuccugaggacuucugcggcu

SEQ ID NO: 277520 - RNA, 62 nt, hsa
cuggaguaccuguaacagcgcucggcacuuugacagcgcacagcugcucugugaccagggac

SEQ ID NO: 277521 - RNA, 62 nt, hsa
aaacuccauauauguuagucuuccuuuaucuuacagcgcagcauuuauuuuaugauauaaug

SEQ ID NO: 277522 - RNA, 62 nt, hsa
ucagcugccaugucuuugaggacucggaacccacagcgcaaucccugguccacuggaggaug

SEQ ID NO: 277523 - RNA, 62 nt, hsa
gauuggccccacaucaccacgccaacaggaccacagcgcacuggcuccaccccaucucugcc

SEQ ID NO: 277524 - RNA, 62 nt, hsa
gcauaugagcacacaaauggacaauaaaugccacagcgcaaaagcguguagcgagccugcca

SEQ ID NO: 277525 - RNA, 62 nt, hsa
ccacgauuuuuuuccacaucugucugugagacacagcgcaaugcuacugcccuuccagaaac

SEQ ID NO: 277526 - RNA, 62 nt, hsa
caugagaguacuagccuccuccacuccuccccacagcgcagaggaaacaggccagcccagug

SEQ ID NO: 277527 - RNA, 62 nt, hsa
aggacagcgccucuugggcugcucccucgugcacagcgcaggggaggaugggugccagaggg

SEQ ID NO: 277528 - RNA, 62 nt, hsa
cgugugugcugauuugaguggcuuagcuugccacagcgcagccucuucugucccuuucaguc

SEQ ID NO: 277529 - RNA, 62 nt, hsa
gggagccgcuucuccaagucugcugaugagagacagcgcaugcuggugcagcguaaggacga

SEQ ID NO: 277530 - RNA, 62 nt, hsa
gucgagaaucgucagcuguaaguaggagcuacacagcgcagagaaaauggaaccacccaucc

SEQ ID NO: 277531 - RNA, 62 nt, hsa
cagcucuggguggggagcaguggccgcuaccgacagcgcaugucccgcucuuauccaacucu

SEQ ID NO: 277532 - RNA, 62 nt, hsa
agccacuguugcugccacugaccaccagguagacagcgcaaucuguggagcuuuuacucugu

SEQ ID NO: 277533 - RNA, 62 nt, hsa
ugccugggugaugggcaccucucacugaccucacagcgcaguccgcccaucugagcacaggg

SEQ ID NO: 277534 - RNA, 62 nt, hsa
ugagaggcaucucccagccccucugcugccggacagcgcacuccagggcaggacgccgcccc

SEQ ID NO: 277535 - RNA, 62 nt, hsa
cucaccccugcggagagcaccguggcggggcgacagcgcaugcaggaacgggggucuccucu

SEQ ID NO: 277536 - RNA, 62 nt, hsa
ggguuuucuuggcuccccuguucaaaguggccacagcgcagaccgaagcaaaauucuuguau

SEQ ID NO: 277537 - RNA, 62 nt, hsa
uccuguggaggaguacauggaggacuccagguacagcgcaggagucacggcuuuuguuuuuu

SEQ ID NO: 277538 - RNA, 62 nt, hsa
gaaggccugucaggugaagucuucagccucccacagcgcagggucccagcaucuccacgcgc

SEQ ID NO: 277539 - RNA, 62 nt, hsa
auccgccauggugccacggggaccaggaccccacagcgcacccccccuccccaccaacuucu

SEQ ID NO: 277540 - RNA, 62 nt, hsa
gucccugcuggcugaggagccgcugcugggagacagcgcagccauagaggaaguggugagug

SEQ ID NO: 277541 - RNA, 62 nt, hsa
gggaccugaguuugggugggguggcaguuggcacagcgcagaugcgguagagaugggaggaa

SEQ ID NO: 277542 - RNA, 64 nt, hsa
aaaaugaacuccauugcuuaagaaacacauaaacaccauuuagucacugaacauagcuauaugu

SEQ ID NO: 277543 - RNA, 64 nt, hsa
uuaggaaugaauuuaacuguccuuggguuacacuaccauuuauuggaacaagccccagaggcag

SEQ ID NO: 277544 - RNA, 64 nt, hsa
gguccuacugcaaaccaccccuccauauuuccguaccauuuacaauucaguuucugugacaucu

SEQ ID NO: 277545 - RNA, 64 nt, hsa
uauauucagugaaaagauuuuauuuauggaauuaaccauuuaauaaagaaauauuuaccuaaua

SEQ ID NO: 277546 - RNA, 64 nt, hsa
uagaaaguaaccugucuuugaugaugcuucucuuaccauuuaguuuuuguauauuacccugggg

SEQ ID NO: 277547 - RNA, 64 nt, hsa
uccucaguuuugccgacugcuuuucaucugagucaccauuuacuccaagcauguauuccagacu

SEQ ID NO: 277548 - RNA, 64 nt, hsa
gugaagagacuuguuucaucuccggaaaugcaaaaccauuuauagcaugaagcccuacaugauc

SEQ ID NO: 277549 - RNA, 64 nt, hsa
gugucaguguaucauuuaguauuuguaucacuguaccauuuaguguuguauaucacucagucau

SEQ ID NO: 277550 - RNA, 64 nt, hsa
gcagauuaucagcucggugacuuuucuuucugccaccauuuaggugaugguguuugauucagag

SEQ ID NO: 277551 - RNA, 64 nt, hsa
aauccuuccaaaaauauugauggugauuugugcuaccauuuacucguuuauuuaauaaagacau

SEQ ID NO: 277552 - RNA, 64 nt, hsa
gcauacccaggguggccuuuagcacaguaucaguaccauuuauuugucugccgcuuuuaaaaaa

SEQ ID NO: 277553 - RNA, 64 nt, hsa
aucaugggaauugcaguuagagagaguaaggaauaccauuuagucaucuauccguucuucacuu

SEQ ID NO: 277554 - RNA, 64 nt, hsa
cccaaaucucacuuggcuggaaacaucaaucuuaaccauuuauucagaaccauuaaaccaauga

SEQ ID NO: 277555 - RNA, 64 nt, hsa
cuaaauauugcaugcauauugacuaauuggaauaaccauuuacucaauuauggacagcuuauug

SEQ ID NO: 277556 - RNA, 64 nt, hsa
uggaacauguuucuuuuugaaagggagagaauugaccauuuauuguugugauguuuaaguuaua

SEQ ID NO: 277557 - RNA, 64 nt, hsa
uaaccagggauuuucccauuauguucccuuuuauaccauuuaggugugaguuccuuagcuucug

SEQ ID NO: 277558 - RNA, 64 nt, hsa
ugauaaucuuauucacaguuguuauuguuuacagaccauuuaauuaauauuuccucuguuuauu

SEQ ID NO: 277559 - RNA, 64 nt, hsa
gucauguguuuccccaaagggaagccagucauugaccauuuaaaaagucuccugcuaaguaugg

SEQ ID NO: 277560 - RNA, 64 nt, hsa
aaguaauacaaaaguuuugagcucuuccaaguauaccauuuauauacaaacaaauagguuuauu

SEQ ID NO: 277561 - RNA, 64 nt, hsa
uuuucagggucuaccuaacugagccuagauauggaccauuuauggaugacaacaauuuuuuuuu

SEQ ID NO: 277562 - RNA, 64 nt, hsa
caguggccaggccuugugccguggcuggguggacaccauuuacaaugcccaggugagugcagag

SEQ ID NO: 277563 - RNA, 64 nt, hsa
ucccaguuuaguaucuuuugaauuuuauuucuguaccauuuaaaaaaaauaauuaacacuauuu

SEQ ID NO: 277564 - RNA, 64 nt, hsa
uaguaccugacuaaaaaugaaguaauacccuuaaaccauuuauaauuucuaguauuucucugaa

SEQ ID NO: 277565 - RNA, 64 nt, hsa
gaaauucaauuuaaaaaaucacguuagccuccaaaccauuuaauucaaaugaacccaucaacug

SEQ ID NO: 277566 - RNA, 64 nt, hsa
gaauugcaggacuauccuguaauuguagacacccaccauuuaaauuuauuuaacaguuaucuug

SEQ ID NO: 277567 - RNA, 64 nt, hsa
aaaguuuggauuguaucaaguggcaugugcugugaccauuuauaauguuaguagaaauuuuaca

SEQ ID NO: 277568 - RNA, 64 nt, hsa
auucacuuuaaguucguauuuuuuaauuuauauuaccauuuauagauucauuuuggaaccauuu

SEQ ID NO: 277569 - RNA, 64 nt, hsa
ucccaaaaucaaaaugguacauccauaaucagccaccauuuaacccuuccuuguucuaaaacaa

SEQ ID NO: 277570 - RNA, 64 nt, hsa
ugcaagaaccuccccuuuccccucccacaauaagaccauuuaagugugugcuaaacaacuacgg

SEQ ID NO: 277571 - RNA, 64 nt, hsa
aaucuucugcauauggcuagccaguaaucccagcaccauuuauuaaauggggacuucuuucccc

SEQ ID NO: 277572 - RNA, 64 nt, hsa
cuaccccagauauuuguguggaagaggaggaaucaccauuuacaagguggacaaaugcuaauau

SEQ ID NO: 277573 - RNA, 64 nt, hsa
ggaugguauagaaaacaacgcugcauauacagguaccauuuaggaaauaccgaugccuuugugg

SEQ ID NO: 277574 - RNA, 64 nt, hsa
ugauuguguuuuagaaaaauuauuauuugcuaaaaccauuuaagucuuuguauauguguaaaug

SEQ ID NO: 277575 - RNA, 64 nt, hsa
ggaugaagacaaauagggauacauuucaauguaaaccauuuaugaauuggaagugauguuggcu

SEQ ID NO: 277576 - RNA, 64 nt, hsa
aagcgugaaauugaaaaacugaagcuggacaaggaccauuuagagaagguuuuacaaauuggau

SEQ ID NO: 277577 - RNA, 64 nt, hsa
guauggauucacuuuuuacuuauguuaaaauuauaccauuuaacuggcucuuuugucauugugc

SEQ ID NO: 277578 - RNA, 64 nt, hsa
uauuuuuguucugcaggcuugcagaguucuucucaccauuuaaacugaaggacccuauauuaua

SEQ ID NO: 277579 - RNA, 64 nt, hsa
cugacuuuuuucucacuguugcaucuucuguaggaccauuuaagucugggccacuuaauggcug

SEQ ID NO: 277580 - RNA, 64 nt, hsa
aaaaaccccuggaagagacucuuuaagaccucaaaccauuuagaaugggcaauguauuuuacgc

SEQ ID NO: 277581 - RNA, 64 nt, hsa
agacauuaugagguauacaacuaguauuuaagauaccauuuaauaugccccguaaaugucuuca

SEQ ID NO: 277582 - RNA, 64 nt, hsa
aguucuuuagagcauuugcuucacacacaguucaaccauuuaaccagaaauuaaaauaucaccc

SEQ ID NO: 277583 - RNA, 64 nt, hsa
aaggagcaaugcugggauugcaacuguagggaacaccauuuaugcagugggaggauucgauggc

SEQ ID NO: 277584 - RNA, 64 nt, hsa
gauuagaccaauuacugcacucuuaaacagcaccaccauuuaauuucauguauaucuaacuucg

SEQ ID NO: 277585 - RNA, 64 nt, hsa
ugggcagggcuuuuuaguaucaaaucacuacuagaccauuuaauuuguuaaauuaucucuagga

SEQ ID NO: 277586 - RNA, 64 nt, hsa
cacuagagggaagucuucucaaguuucaagcaagaccauuuacuuaaugugaaguuuuggaaag

SEQ ID NO: 277587 - RNA, 64 nt, hsa
cuggguuuauauuuaacucuugcuucauagguguaccauuuaaagaguguuauuuaaugcuaag

SEQ ID NO: 277588 - RNA, 64 nt, hsa
auugucaauaacgaaaccuaauuguaaaacagucaccauuuacuaccaauaacuuuuaguuaau

SEQ ID NO: 277589 - RNA, 64 nt, hsa
acauaaagucauuauauuaauuaaaagaaaaaacaccauuuaauauguucugaaaacauuacuc

SEQ ID NO: 277590 - RNA, 64 nt, hsa
uuuuguacaaaaacuaauucuuuugguaaaaugaaccauuuacaguucgguuuuggacucugag

SEQ ID NO: 277591 - RNA, 64 nt, hsa
agucaguacuuuuuucucauguaucuuucucuagaccauuuauauacgggugaaaugaaagcuu

SEQ ID NO: 277592 - RNA, 64 nt, hsa
uaaaugaagucuugugaauuuguaauagaucaguaccauuuauugguuuggggaccaucuuaau

SEQ ID NO: 277593 - RNA, 64 nt, hsa
uauauguuauuuggcgagacaucaaauaaaguuaaccauuuaaaaauuauuuucauauacuguu

SEQ ID NO: 277594 - RNA, 64 nt, hsa
ucuucuguggucgcccgcccccccccaaaaaaauaccauuuaugguucucuccgcaaguauaaa

SEQ ID NO: 277595 - RNA, 64 nt, hsa
uaggagcauggauguauaaggcagguuuuauacaaccauuuagauucaacauuaaugguagagu

SEQ ID NO: 277596 - RNA, 64 nt, hsa
gguaaaugagcuugcaauguguuaaagaagauuaaccauuuaaaggcauguguuccauagccaa

SEQ ID NO: 277597 - RNA, 64 nt, hsa
ugcccauuuugaaauugccuauacagucuuagugaccauuuaaaccggacgaacuagguguuua

SEQ ID NO: 277598 - RNA, 64 nt, hsa
cucuuucuacauauggcuagccaguuuucccagcaccauuuauuaaauagggaauccuuucccc

SEQ ID NO: 277599 - RNA, 64 nt, hsa
gcugugaucuuacaaguuagauguuacuauaccuaccauuuauucagcuggauugcugaacaca

SEQ ID NO: 277600 - RNA, 64 nt, hsa
uuuaaaaucauuguuaaauugauugaggaaaacaaccauuuaaaaaaaaucuauguugaauccu

SEQ ID NO: 277601 - RNA, 64 nt, hsa
auggagucuccaccuuuggacacaacacuuacucaccauuuacucuuuaucacucugcaacaaa

SEQ ID NO: 277602 - RNA, 64 nt, hsa
uuauuaaauauuaaaauaucuauuuauuauuaaaaccauuuauaaggcuuuuucauaaauguau

SEQ ID NO: 277603 - RNA, 64 nt, hsa
gcagaguaacauaaaauaaaaguacauuuuauaaaccauuuacuauggcuuuguaacaauugca

SEQ ID NO: 277604 - RNA, 64 nt, hsa
gauuuacuacuaggaaaccuuccucauaugaauaaccauuuauauguguuuugcuuaaaguauu

SEQ ID NO: 277605 - RNA, 64 nt, hsa
aagguuauuccaguaaaaggaaauaguuuucucaaccauuuaaaaauauucuucugaacucauc

SEQ ID NO: 277606 - RNA, 64 nt, hsa
ugacuuuaucacaauaugauucuuacaucuuuauaccauuuacaauuguguuuuagaucuacag

SEQ ID NO: 277607 - RNA, 64 nt, hsa
guauauagccggauuaacgguuauaaaguuuuguaccauuuauuuuaugacauuuuacaaugua

SEQ ID NO: 277608 - RNA, 64 nt, hsa
uagucaauuaguacaguagcuuaaauaaauucaaaccauuuaauucauaauuagaacaauagcu

SEQ ID NO: 277609 - RNA, 64 nt, hsa
ucuaucaauauugauagaagucacacuaguauauaccauuuaauacauuuacacuuucuuauuu

SEQ ID NO: 277610 - RNA, 64 nt, hsa
gaccaguucuuggccuaugauaaguuccaaaaauaccauuuaucuacuauuugaaaaaagaaga

SEQ ID NO: 277611 - RNA, 64 nt, hsa
aagguccacuggacaguugggaaaacaccugaccaccauuuaaggacucuaagccagaauggaa

SEQ ID NO: 277612 - RNA, 64 nt, hsa
guacuugagcuguaggacaaaccuugggcauuuaaccauuuacugucuggcuuugcccuuaaaa

SEQ ID NO: 277613 - RNA, 64 nt, hsa
ucagggaaaaaugaggaaaaaaaauagauucugaaccauuuauuguugaauaaguagagaaaau

SEQ ID NO: 277614 - RNA, 64 nt, hsa
uaagcauuguuuuaugaauuuuacauuuuuccucaccauuuagcaauuuucugaaugguaauaa

SEQ ID NO: 277615 - RNA, 64 nt, hsa
aaguauuuucugaguguugagaagaaugaguuaaaccauuuaaacacauuugaaacauacaaaa

SEQ ID NO: 277616 - RNA, 64 nt, hsa
ucuuccuaaaucaaggaaaggaaaucauccccagaccauuuaugcugagcuuuggaauacuauu

SEQ ID NO: 277617 - RNA, 64 nt, hsa
auauauggugcucacuuuaggaucagcaguguugaccauuuaugcugcauagcuguauuauagc

SEQ ID NO: 277618 - RNA, 64 nt, hsa
uaucuucucuauucuauucuacuuccuccauuucaccauuuauacaaagucauucaaaaaggcu

SEQ ID NO: 277619 - RNA, 64 nt, hsa
guguguggggaggggggcugguuuacaauauuaaaccauuuaaaguauuuuauucuacaaaugg

SEQ ID NO: 277620 - RNA, 64 nt, hsa
uacgcugacaaucaguuaaacacaccggagaagaaccauuuacaugcaccuuauauuucugugu

SEQ ID NO: 277621 - RNA, 64 nt, hsa
cuagaagcagaggcacuuaaaacauguaccaggaaccauuuaacaaagaauauaaaaugucaca

SEQ ID NO: 277622 - RNA, 64 nt, hsa
cugugcccacacuuaaugucaaucuauaauuuuaaccauuuauccaagauucuacuaaguguaa

SEQ ID NO: 277623 - RNA, 64 nt, hsa
uaucaaguuugggucugugcugcuguuacuguuaaccauuuaaguggggcaaaaccuugcuaau

SEQ ID NO: 277624 - RNA, 64 nt, hsa
uuuaaauauaugcuuuucuagaauuugauguuugaccauuuaugacuuaauuaccagagagcca

SEQ ID NO: 277625 - RNA, 64 nt, hsa
ccucauucucucguuuccccuuuagcucccuuucaccauuuauucagcuacaucaucccucuau

SEQ ID NO: 277626 - RNA, 64 nt, hsa
ccuuuuuuuaucguuuuuguauuuucaugaaaauaccauuuaguaagaauaccacaucaaauaa

SEQ ID NO: 277627 - RNA, 64 nt, hsa
auuugauuuguaaauuuacuuauguuaaaaauaaaccauuuauuuucagcuuugaauuuuauuu

SEQ ID NO: 277628 - RNA, 64 nt, hsa
uaucgaaugcaaagcuacuggcuucacagagacaaccauuuaugauuugcuguucuguaagagu

SEQ ID NO: 277629 - RNA, 64 nt, hsa
aaaauugcaggugauuugauaauuaagcacccauaccauuuauaacuucugaauuuaaaaaguu

SEQ ID NO: 277630 - RNA, 64 nt, hsa
gcuagcugaucucauuuccuuccaugguuuccuuaccauuuauaugcaaaugacugucagauuc

SEQ ID NO: 277631 - RNA, 64 nt, hsa
cauaaaauacugaggcugauuuagucagggcaaaaccauuuacuuuacauauucguuuucaaua

SEQ ID NO: 277632 - RNA, 64 nt, hsa
gcaucuaauccuacauaaugaaaaagaaaaacagaccauuuaaaaacucagacaagauuauauu

SEQ ID NO: 277633 - RNA, 64 nt, hsa
cucuuagcacgcaaaagccaaaaucuaaagaucaaccauuuauccugaacaacaccauuugaga

SEQ ID NO: 277634 - RNA, 64 nt, hsa
ggucucucccagcucucgaauccuaacugcagccaccauuuauucagcaccuguuaugcaccag

SEQ ID NO: 277635 - RNA, 64 nt, hsa
uacauuguauucagcuagccccuuaaagguaaugaccauuuauaaauuauuccuucaguuggcu

SEQ ID NO: 277636 - RNA, 64 nt, hsa
acuauguuaauaccuauaaaauauauagccaggaaccauuuaucaucaagaaaaguguaagaaa

SEQ ID NO: 277637 - RNA, 64 nt, hsa
gcagggugaguucucuccucaaagaagacuucaaaccauuuaacugguuucuuaagagccguca

SEQ ID NO: 277638 - RNA, 64 nt, hsa
accccugaauuccaaaauauuauggauaaacauuaccauuuauaugcuacaaauuagucugauu

SEQ ID NO: 277639 - RNA, 64 nt, hsa
ugacacuagauacaguaaauuuuuagaaaaaaauaccauuuacaguauuauugugaaccauuua

SEQ ID NO: 277640 - RNA, 64 nt, hsa
uuagaaaaaaauaccauuuacaguauuauugugaaccauuuaacccuuuugauccaaggccccg

SEQ ID NO: 277641 - RNA, 64 nt, hsa
guucuaguccacauauaaggguaggguugggauuaccauuuacugaccacaucugugaggugcc

SEQ ID NO: 277642 - RNA, 64 nt, hsa
augauacaaccaugauuugcaacuguaacaggagaccauuuauuauaagcguaccuguuuguga

SEQ ID NO: 277643 - RNA, 64 nt, hsa
cuuagauaaagagagaauauuguaugggccaucaaccauuuacuuuucccugaauguuagaaac

SEQ ID NO: 277644 - RNA, 64 nt, hsa
gaucauagaauugcagucauuuggugcucugcuaaccauuuauauaaaacuuaaaaacaagaga

SEQ ID NO: 277645 - RNA, 64 nt, hsa
auaggucagucaaguugguaaugccuguccauuaaccauuuaugcauacuaauaaaauuauaag

SEQ ID NO: 277646 - RNA, 64 nt, hsa
cauuuauuggcuaacugcaugacaugcccauucuaccauuuaaaaaaaaaucuuaaagccugua

SEQ ID NO: 277647 - RNA, 64 nt, hsa
guagguaaaaauauauaccuucgggucgcaguucaccauuuauaugugguauuaaaaauuaaug

SEQ ID NO: 277648 - RNA, 64 nt, hsa
guuaggucuuaggaauugaauuaauaauaaagcuaccauuuaucaagcauuuaccaugugcuaa

SEQ ID NO: 277649 - RNA, 64 nt, hsa
ugaaucaugucagaacugcuuaaaauuaaccuuuaccauuuaaugucaucuaccugaaaacagu

SEQ ID NO: 277650 - RNA, 64 nt, hsa
auuuuuuguuuguuuaguuauaacagaguaacauaccauuuaauuacaauuuuuagccagaaaa

SEQ ID NO: 277651 - RNA, 64 nt, hsa
ucucuuauuaauaaaacuuuggaaauugcuuuaaaccauuuaaaggaaauuucuagauauagaa

SEQ ID NO: 277652 - RNA, 64 nt, hsa
aacuggguuaaucaagucucgguaaguccuuuaaaccauuuaggauuuuuaaaacaucaaaauu

SEQ ID NO: 277653 - RNA, 64 nt, hsa
uugauauacacggaugacuuaacugcauuuuuagaccauuuaucugggauuaugguuuugugau

SEQ ID NO: 277654 - RNA, 64 nt, hsa
aacuuuuaaacuuuuuuaugaauuccuaaacauuaccauuuauguggcagaaguucuguucccu

SEQ ID NO: 277655 - RNA, 64 nt, hsa
ugcauaaaaguuaacauuaggcuguggugcaguaaccauuuaaugucgaggcucuauuucggaa

SEQ ID NO: 277656 - RNA, 56 nt, hsa
aucaaacugcuacugguuaaaggaccaccauuuaauuaacaugauucgaaagccuu

SEQ ID NO: 277657 - RNA, 64 nt, hsa
ugaauaauuuucacucauuuauugucuucuggaaaccauuuaacuuuuacuguuuuuuauuuuu

SEQ ID NO: 277658 - RNA, 64 nt, hsa
aaacaaaaugaacacugcuugucuucuuccauugaccauuuaguguugaguacuguauguguuu

SEQ ID NO: 277659 - RNA, 64 nt, hsa
ccaaaugcuauuuuucaaugcauuuggacugcugaccauuuaaaagcagccuaugauugcuucu

SEQ ID NO: 277660 - RNA, 64 nt, hsa
uaauguauuaaucuguuugugcaaacauaauaccaccauuuaaaaauguuagggagaugaguug

SEQ ID NO: 277661 - RNA, 64 nt, hsa
gcugagaauccccgugcucacaguagcuuccuagaccauuuacuuugcccauauuaaaaagcca

SEQ ID NO: 277662 - RNA, 64 nt, hsa
guggauuaugcuuaacagugagagcugaaaugagaccauuuacuuuguuuaaaaugcuguacug

SEQ ID NO: 277663 - RNA, 64 nt, hsa
ugauacacaaaagugcacacugugugcucccuuuaccauuuacuaucucccuccagccccaacg

SEQ ID NO: 277664 - RNA, 64 nt, hsa
uccucguccauuuuauuaggauuacccaaauauaaccauuuaaagaaagaaugcauuccagaac

SEQ ID NO: 277665 - RNA, 64 nt, hsa
ugccuagcacugcucuuuuugauguuguagugacaccauuuacauugaauuaaugcuugguagc

SEQ ID NO: 277666 - RNA, 64 nt, hsa
auugaaaaacuguuugguaagcacauguauaucuaccauuuagauucagcaguuguuaauguuu

SEQ ID NO: 277667 - RNA, 64 nt, hsa
ugacuauuuuugguucaauacuacuacuguugucaccauuuaugauucugaauuuuaaaguugg

SEQ ID NO: 277668 - RNA, 64 nt, hsa
auuucugaauauguuacugagcuugcuugugguaaccauuuauaauaucagaaaguauauguac

SEQ ID NO: 277669 - RNA, 64 nt, hsa
guaccauauucagcauuugauuuccaugggccccaccauuuauguguagaauuugaaaugguug

SEQ ID NO: 277670 - RNA, 64 nt, hsa
uuuuuauuccccacuacucuugucucuaucagauaccauuuaugagacauucuugcuauaacua

SEQ ID NO: 277671 - RNA, 64 nt, hsa
ucuuuauuguaaaguaugcaaaauauauauucauaccauuuauuaaaucagaauguuuauacaa

SEQ ID NO: 277672 - RNA, 64 nt, hsa
uucucucucaguucuacacugauacacuugaaggaccauuuacuguuuuuuucuguagcaccag

SEQ ID NO: 277673 - RNA, 64 nt, hsa
gagcagcaggaaggcaccgcuguccaccuugggcaccauuuauccuccuuucaucguccccggg

SEQ ID NO: 277674 - RNA, 64 nt, hsa
cgcacacuaaacuuugguauuuugauuccuuuuaaccauuuaagacuacuuuucuuauagguag

SEQ ID NO: 277675 - RNA, 64 nt, hsa
uaguggcagcugaccaaucccccaucccaaauugaccauuuagauguaccaacucaccuuaaau

SEQ ID NO: 277676 - RNA, 64 nt, hsa
aguucauauguacacuagccagugguuguggacaaccauuuacuugguguaaagaacuuaauuu

SEQ ID NO: 277677 - RNA, 64 nt, hsa
auuucuaauuugaaaggcaguuaagaaauagauaaccauuuauuuuagaacacucaacaacuau

SEQ ID NO: 277678 - RNA, 64 nt, hsa
gaaaugcacugugggguuuuuuccuguaugggaaaccauuuaugccaagcuuuuccccauuucc

SEQ ID NO: 277679 - RNA, 64 nt, hsa
gacaucagcaacuuuugaaaacuucacacuuguuaccauuuagaaguuuccuggaaaauauaug

SEQ ID NO: 277680 - RNA, 64 nt, hsa
ugagauaucaggaaugucucaugauaucacguuuaccauuuacaccaucugcaaccauaugcua

SEQ ID NO: 277681 - RNA, 64 nt, hsa
uucccuuacccagaaaugaaaauacucaauauggaccauuuaggaauuauaagcagcaacugug

SEQ ID NO: 277682 - RNA, 64 nt, hsa
uaauagauguccguacaaguagcgcauauauuuaaccauuuaguuuggggcucuauauuacuug

SEQ ID NO: 277683 - RNA, 64 nt, hsa
cagacccauuggauuugcugcugguaacaguuccaccauuuagguuccagcaccaagcaaacua

SEQ ID NO: 277684 - RNA, 64 nt, hsa
cggagacgcgucagauggcagauuuggaaaguuaaccauuuaaaagaacauuuuucucuccaac

SEQ ID NO: 277685 - RNA, 64 nt, hsa
uacaaagcuugggacaguuauuggagauuaaucuaccauuuauugaaugcauacucugugcaag

SEQ ID NO: 277686 - RNA, 64 nt, hsa
uaauguuagaguucauguaaucacauucucuagaaccauuuaguuuguguuaacuaugaaccaa

SEQ ID NO: 277687 - RNA, 64 nt, hsa
auuaacaguauuaauagcgacauugguaacagcuaccauuuauagaguuuuaaugggaguagga

SEQ ID NO: 277688 - RNA, 64 nt, hsa
agaaaauguacauucuaauuaauucacuuauaaaaccauuuacauauuguguauauguuuuuau

SEQ ID NO: 277689 - RNA, 64 nt, hsa
gccuauuuuucaaauuauuuaauagauguaugguaccauuuaaaagugguuguaucugaauuua

SEQ ID NO: 277690 - RNA, 64 nt, hsa
cugaagcaugauaaaggggcaguucacaauuuucaccauuuaaacacaaauuugcugcacagaa

SEQ ID NO: 277691 - RNA, 64 nt, hsa
uuuugaaaagcaaaaaauacuauuaaccuauauaaccauuuaaaauuuaaaaaauuauguucca

SEQ ID NO: 277692 - RNA, 64 nt, hsa
uauuccaagagccaucuccuuaugauguauuugaaccauuuagagaaauucacuucauuguacc

SEQ ID NO: 277693 - RNA, 64 nt, hsa
uguggugguguucuguugguuacaagaaaguuauaccauuuaaagcuggcaccagagacccgau

SEQ ID NO: 277694 - RNA, 64 nt, hsa
aaugcuaggucagaagcugcuuuuucacacugaaaccauuuaaguauguacaaauaaguuaaua

SEQ ID NO: 277695 - RNA, 64 nt, hsa
ccuuaugagcaggaagagggaaggcuguuugagaaccauuuacuuagcagaaccacauauuuua

SEQ ID NO: 277696 - RNA, 64 nt, hsa
ucuucuaaucaucuauguguguaugauggaugugaccauuuauaugucauguguugaaauuaaa

SEQ ID NO: 277697 - RNA, 64 nt, hsa
gaaggaaguaauguuaccuauccuugauaccaugaccauuuauuagauguuuugcuauauaaau

SEQ ID NO: 277698 - RNA, 64 nt, hsa
uugaugccaagugaauauaagagcuuguacugaaaccauuuauuucuuucuauuuugcuauuug

SEQ ID NO: 277699 - RNA, 64 nt, hsa
aaauuuuauucaaaggaauuguaaaccuuaaaccaccauuuauuuccaugugaaaaaguguuau

SEQ ID NO: 277700 - RNA, 64 nt, hsa
aaaagauuaagcaagugaaauucugcugcccuccaccauuuauuuuuacagugcuuuguaauuu

SEQ ID NO: 277701 - RNA, 64 nt, hsa
guaggcugcuaccuaacuuuuagucccuuccaaaaccauuuaguaggguucuauuacauaaaca

SEQ ID NO: 277702 - RNA, 64 nt, hsa
aacagauuacacaaaaauuauuuccagaaaggcuaccauuuaucaucauuauauuucaagccuc

SEQ ID NO: 277703 - RNA, 64 nt, hsa
ggccuuguucuguucucuggaacuaaacagaacaaccauuuaccccuccuuuucaaacuagaga

SEQ ID NO: 277704 - RNA, 64 nt, hsa
acggagcagugccuaguaucuggagagcagcacuaccauuuauucuuucauuuauaguugggaa

SEQ ID NO: 277705 - RNA, 64 nt, hsa
ggaguuagaaaugaauuuuuuagaccuuaguaaaaccauuuaaccauaaaauggacaacugaga

SEQ ID NO: 277706 - RNA, 64 nt, hsa
uucuuuggaacuuuaauaagaucuagucuguuacaccauuuagaacuuuccugagccauuauca

SEQ ID NO: 277707 - RNA, 64 nt, hsa
uagugucauuuuauuuuagucauuauugaauuauaccauuuacucuguuuucuuauagucuuaa

SEQ ID NO: 277708 - RNA, 64 nt, hsa
caggcuggaccugcaagauguggcuugaauuuuaaccauuuauuacauaaucucuagugaucau

SEQ ID NO: 277709 - RNA, 64 nt, hsa
uaaaauacgacacccaguauuuucuuuaaguuucaccauuuacgcuacaugugauuuuuuuaau

SEQ ID NO: 277710 - RNA, 64 nt, hsa
uucaaaagugaacaauccugugauaaguuggaguaccauuuaguaauacagcaacauuguguca

SEQ ID NO: 277711 - RNA, 64 nt, hsa
acaugucacuugugcuuuaaaauuagucuguaucaccauuuauuacaguuauaauuuuggaguu

SEQ ID NO: 277712 - RNA, 64 nt, hsa
aauuuucaugugucaugaaauacuguuuucuccaaccauuuaauaauguaaauacuugcuagcu

SEQ ID NO: 277713 - RNA, 64 nt, hsa
acacuucccuugaucugcuuauuuuuauuccaucaccauuuacccuuuuuuuuuuuuuaaauuu

SEQ ID NO: 277714 - RNA, 64 nt, hsa
aucacguaagugugugagugcagugcagaugagcaccauuuaguuauaugugcuaggcaaaucu

SEQ ID NO: 277715 - RNA, 64 nt, hsa
uggccaagcgaggucucaggugcaaagcaaaaggaccauuuaaaguaaaauagcuuggauucaa

SEQ ID NO: 277716 - RNA, 64 nt, hsa
guacagcuuaaaucauggguccagccuaaaaaccaccauuuaacuuacacugaucaauuucaac

SEQ ID NO: 277717 - RNA, 64 nt, hsa
gaguuucagaacaaaagauauucauugcacauuaaccauuuagaggucauuuaaauaacaaaau

SEQ ID NO: 277718 - RNA, 64 nt, hsa
uaaauuccaccuaucuuaaugugaauuaaaaaccaccauuuauaauaauaauagcgccauauuc

SEQ ID NO: 277719 - RNA, 64 nt, hsa
uguuuaaauucuuaauauuagucauccuaaguauaccauuuauguauccuuuauaaggaaugug

SEQ ID NO: 277720 - RNA, 64 nt, hsa
ccucagaacaaagauuggaaaaagcuggccgagaaccauuuauacauagaggaagggcuuaugg

SEQ ID NO: 277721 - RNA, 64 nt, hsa
uuuaguauuguuguaaaacuucaugaaacaaaagaccauuuaaauagugaauuauuaaaaaucu

SEQ ID NO: 277722 - RNA, 64 nt, hsa
cagaaggaucagacaauaaaaugaguuagugcaaaccauuuaguaaaaauaacuaucagcagag

SEQ ID NO: 277723 - RNA, 64 nt, hsa
uguucucagaacauuuagccugcaguugggcaaaaccauuuaacacaaagccuauuuuauaaug

SEQ ID NO: 277724 - RNA, 64 nt, hsa
gugucugugguagcuuuuaggcugcuccuaacccaccauuuauugccuucugagagguggguga

SEQ ID NO: 277725 - RNA, 64 nt, hsa
aacagcauuacaaaauccuaguuuauacuagacuaccauuuaaaaaucauguuuuuauauaaau

SEQ ID NO: 277726 - RNA, 64 nt, hsa
cucuccuucaacauccucacccccaccccugggcaccauuuaggacaagacuuccuuauuuauc

SEQ ID NO: 277727 - RNA, 64 nt, hsa
gaggccauuuagaugauuaguuaauuuguuuuucaccauuuagcaaaaauguauacuaccuuaa

SEQ ID NO: 277728 - RNA, 64 nt, hsa
gcccuucuguauuuuaaaauguaauauacuuuguaccauuuauaaaaauugugugaugaaugaa

SEQ ID NO: 277729 - RNA, 64 nt, hsa
uucauuuccauaaaccaaguuaaaguauggcccgaccauuuaagaaaacaaccaucugagacac

SEQ ID NO: 277730 - RNA, 64 nt, hsa
aaggguaaacaaaaaacuaaaacuuauacaagauaccauuuacacugaacauagaauucccuag

SEQ ID NO: 277731 - RNA, 64 nt, hsa
cuuccagaucgugaggcuggggagcauucuagguaccauuuauuaucuacugcguuucggucag

SEQ ID NO: 277732 - RNA, 64 nt, hsa
gucccucccacaacacaugggaauucugagagauaccauuuaaguugagauuucaguggggaca

SEQ ID NO: 277733 - RNA, 64 nt, hsa
uguucacaaaaaguagaaacucuaagagaccauuaccauuuauucacagauguauaggggaugu

SEQ ID NO: 277734 - RNA, 64 nt, hsa
ugcuuauuaucaaaagaauaauuaaaaucauguaaccauuuaaaugucacuguuaacacuuuuc

SEQ ID NO: 277735 - RNA, 64 nt, hsa
uuuacccaaaaguauaagauacauuuuuugguaaaccauuuaaaauacaaaauccuauuuugga

SEQ ID NO: 277736 - RNA, 64 nt, hsa
gaauuauugaauaguaauuaaacuuuaacugaugaccauuuauauucuaguagccaucuucacu

SEQ ID NO: 277737 - RNA, 64 nt, hsa
cuuugaaacaggacugaagcccuuuuuaccuagaaccauuuaaaagccugagcaaggaccacca

SEQ ID NO: 277738 - RNA, 64 nt, hsa
uguugaaaggagaaaaagcacaaguucccuaguuaccauuuaauaugagggugcaagagccaca

SEQ ID NO: 277739 - RNA, 64 nt, hsa
aucccagcuuucuuuucuacuagcaaaugacccuaccauuuauuucugccuuuuucuuccguuc

SEQ ID NO: 277740 - RNA, 64 nt, hsa
cccugucagggccucugccaaggaaauaauauggaccauuuaccuggcaggcagucugcucucu

SEQ ID NO: 277741 - RNA, 64 nt, hsa
ugggguuuuuuuguuuuuacuuucuaucuucauaaccauuuaaagcgauuuagcuugaaauuaa

SEQ ID NO: 277742 - RNA, 64 nt, hsa
uuaaccacuuuugacuagguaagucuuucuaaaaaccauuuaaagcuaacugggucuuagcauc

SEQ ID NO: 277743 - RNA, 64 nt, hsa
acauggaaaccagaaaugcaacaguuacuaaaacaccauuuaauaguuauaacgucguuacuug

SEQ ID NO: 277744 - RNA, 64 nt, hsa
uguuguagaauaaauuaaaaggauaaucuaaaucaccauuuagauuaagcuugacuugcaaacu

SEQ ID NO: 277745 - RNA, 64 nt, hsa
agcaauauucaaagaaagaaccacagauguguuaaccauuuaagcagaucaucugccaaacauu

SEQ ID NO: 277746 - RNA, 64 nt, hsa
uaagaaauaacauuuuaaaaucuauuuuauacuuaccauuuauuauucuguuauuuuagucucc

SEQ ID NO: 277747 - RNA, 64 nt, hsa
gccacugaugggaauauacagauuuaggugcuaaaccauuuauuuuccacggaugagucacaau

SEQ ID NO: 277748 - RNA, 64 nt, hsa
cauugacuucagcaaaagcacggggcuguaaauuaccauuuacuagauuagccaaauagucuga

SEQ ID NO: 277749 - RNA, 64 nt, hsa
auauuauuauguggguauuuauaugaccuuuguaaccauuuaaaaauguaaaaacgaccugacu

SEQ ID NO: 277750 - RNA, 64 nt, hsa
aaucugagaagucagccucuuggcuccucaggccaccauuuaggccugacugggguaagaaaug

SEQ ID NO: 277751 - RNA, 64 nt, hsa
uaguggaagcccagucuugaguucuugucuuguuaccauuuaaaauugacauuuaauuuucaaa

SEQ ID NO: 277752 - RNA, 64 nt, hsa
ugcuuuaauccuuucuuuagaaugcuguuuaaacaccauuuacccuacuuaucccucaaugcac

SEQ ID NO: 277753 - RNA, 64 nt, hsa
cuguucucuuuguuuuaaagagagaauuuuguaaaccauuuauugaauguucugaucuuucauu

SEQ ID NO: 277754 - RNA, 64 nt, hsa
aaaaacagucaauagggcuacugcuggcccaaagaccauuuagguccaccuccucuuuuuugcu

SEQ ID NO: 277755 - RNA, 64 nt, hsa
ggggagccucgggaaaagguagaggagucacguuaccauuuacauguuuuaaagaaagaagugu

SEQ ID NO: 277756 - RNA, 64 nt, hsa
ugggagauucagcuuaauuugcuucaauucagcaaccauuuauugagcaucuauuaugugccag

SEQ ID NO: 277757 - RNA, 64 nt, hsa
uaauccacccaugcaaauagcuacuggcccagcuaccauuuaccauuugccuacagaauuucau

SEQ ID NO: 277758 - RNA, 64 nt, hsa
cacuuugucauuaucaagagagauggcaguauugaccauuuaguuuaguuaaaaaaaaaaaaaa

SEQ ID NO: 277759 - RNA, 64 nt, hsa
augaguauggaugucacucaacuaagaucaaaucaccauuuaaggggauggcauucuuuauacc

SEQ ID NO: 277760 - RNA, 64 nt, hsa
aaacuccaaggcagaaauuguaucuuuauagcuaaccauuuaguaaauaaauacauuacauuuu

SEQ ID NO: 277761 - RNA, 64 nt, hsa
gugguugacuaccuuuugauaagcaaaauuugaaaccauuuaaagaccacuguauuuuaacuca

SEQ ID NO: 277762 - RNA, 64 nt, hsa
acugacacaagccaccgccccugagugcucauguaccauuuagcuuguguuuuaaaaaucuacu

SEQ ID NO: 277763 - RNA, 64 nt, hsa
cauuuaggugaggaagcaaaagcaucuaugugagaccauuuagcacacugcuugugaaaggaaa

SEQ ID NO: 277764 - RNA, 64 nt, hsa
augaguuacauuaucagccagcccagccuugcccaccauuuaagaaauaucacagagccacuag

SEQ ID NO: 277765 - RNA, 64 nt, hsa
ugaucuauuuuccuauggaguuguuucuauuaugaccauuuaauuuuguuuuuauuuaauagua

SEQ ID NO: 277766 - RNA, 64 nt, hsa
cccagugacuucagugguauccuuuuuuccuaagaccauuuauaauuauuaguggcaacagagu

SEQ ID NO: 277767 - RNA, 64 nt, hsa
caucaaacaaaaaugcccugguggcaaagcuaucaccauuuaaugucuucucucagucuugcac

SEQ ID NO: 277768 - RNA, 64 nt, hsa
gauaugcuuuuuuuuuuaaagacugaauguguucaccauuuagccuguagauuuauuuccauuu

SEQ ID NO: 277769 - RNA, 64 nt, hsa
gguguuaggagugguuacaacugagcuuuuaguaaccauuuaaccguauguaaacuugguuucu

SEQ ID NO: 277770 - RNA, 64 nt, hsa
ucucagguggcaauguaacucauuuuuuugucccaccauuuaucuucucugcccaagcccuguc

SEQ ID NO: 277771 - RNA, 64 nt, hsa
cuuuuuagcuguuaaauguacuaugccaucauccaccauuuaguaaaauguagcuggcccagga

SEQ ID NO: 277772 - RNA, 64 nt, hsa
ugcuaucuuuuuuuauuauucugaucaugauaugaccauuuaaccucagaauucauaauuccug

SEQ ID NO: 277773 - RNA, 64 nt, hsa
gugaaauucagucuuaaguagggugaauuggaucaccauuuacacaagagauggcuuuuuccuu

SEQ ID NO: 277774 - RNA, 64 nt, hsa
cuauuauucugauuuuuaaaaaugcaguuaauguaccauuuauuugcuugaugaagggagcucu

SEQ ID NO: 277775 - RNA, 64 nt, hsa
guucacaguuaauuguugcgcucuaauacaacugaccauuuaaaauugaacaaguuuauuguuu

SEQ ID NO: 277776 - RNA, 64 nt, hsa
uaaaugucaauguauuuuuggcacugcgauuuuaaccauuuauuaaauaaaaauuuuguuaaag

SEQ ID NO: 277777 - RNA, 64 nt, hsa
uaaagaggucgcuugggaauuuuauugacacaguaccauuuaauggggaggacaaaauggggca

SEQ ID NO: 277778 - RNA, 64 nt, hsa
aguucauauguacaccagcuaguggcugugaacaaccauuuaguugguguaaaaaacuuuauuu

SEQ ID NO: 277779 - RNA, 64 nt, hsa
guuucauuuuacuuuaacuauauaaugucuguuaaccauuuaagaugccaucugaaggggauuc

SEQ ID NO: 277780 - RNA, 64 nt, hsa
aacauuacucauuugauuucccccacccccgccaaccauuuaaaaaaguuugccggcuaggugc

SEQ ID NO: 277781 - RNA, 52 nt, hsa
uagaacccuuuccgguauaaucaccauuuauauagucgagacaguugucaaa

SEQ ID NO: 277782 - RNA, 64 nt, hsa
uuuuuaaaaaagugugccuugcuguauuucuuauaccauuuauuaaaaagcugcuuucacggua

SEQ ID NO: 277783 - RNA, 64 nt, hsa
gucaauuaguagcuuaccacagauacuguuuccuaccauuuauaaaauuuacuuuuuauugaaa

SEQ ID NO: 277784 - RNA, 64 nt, hsa
uucugacuggagaccccagugugggggaggucuuaccauuuaauauagaaaugauaucaauaac

SEQ ID NO: 277785 - RNA, 64 nt, hsa
gaaaauagaagaguguguugggcagguaguuuguaccauuuaugaagguuuguuccuuuguuaa

SEQ ID NO: 277786 - RNA, 64 nt, hsa
gcucaacuuuuuaaaauccagacccaguguuaaaaccauuuauuccuuuuuucauaagaauaau

SEQ ID NO: 277787 - RNA, 64 nt, hsa
cucaaauauauauuuaaaagauuuaugaauacaaaccauuuaugguuuaugauuucuaaaaaga

SEQ ID NO: 277788 - RNA, 64 nt, hsa
uggaggaagaaaacaggugaaagaagaaguaaaaaccauuuaguauuaguauuagaaugaaguc

SEQ ID NO: 277789 - RNA, 64 nt, hsa
gcuaugacaauuugcacagcccaguggcuuaaacaccauuuauaccacagguccagaugaaucc

SEQ ID NO: 277790 - RNA, 64 nt, hsa
acauaacacauaaaauuaguuucuaugaguguauaccauuuaaagaauuuuuuuuucaguaaaa

SEQ ID NO: 277791 - RNA, 64 nt, hsa
aacagauuuuuuuuuauuucaagaaaauuuugcuaccauuuaaguaagagaaggugagaaggau

SEQ ID NO: 277792 - RNA, 64 nt, hsa
ccuaauguaauaaauuuuauuguauaaauauaucaccauuuacaugaggggaaacacuagccag

SEQ ID NO: 277793 - RNA, 64 nt, hsa
auccuccuuucaguucguugguagagcccucagaaccauuuaagagacucuuuauuuuucucuu

SEQ ID NO: 277794 - RNA, 64 nt, hsa
uaugggauuacuuuugcagaaucauaauuuagcaaccauuuaucauggaugaaagagaucugua

SEQ ID NO: 277795 - RNA, 64 nt, hsa
aaauugugcagcaauagauuuuuaacuuuaacugaccauuuaaguuuuuuaauaaguuuuuuac

SEQ ID NO: 277796 - RNA, 64 nt, hsa
uuaacaaguauugcaguaaucaucacuuacagguaccauuuauuucaaaacaacuuuuuuaguc

SEQ ID NO: 277797 - RNA, 64 nt, hsa
gaauuugagaagccaaauggaauuuuuaauggaaaccauuuaucagauuaaucucuugcucucc

SEQ ID NO: 277798 - RNA, 64 nt, hsa
gggaaacgauuuuuuguguccuuaaaauggcaugaccauuuauuugccccuuucuccauccugu

SEQ ID NO: 277799 - RNA, 64 nt, hsa
auugucaauaaugaaacccaauuguaaaacagucaccauuuacuaccaguaacuuuuaguuaau

SEQ ID NO: 277800 - RNA, 64 nt, hsa
guuccugacucugacaagaaagcauaagucucucaccauuuagugugauuuuagcuguggguuu

SEQ ID NO: 277801 - RNA, 64 nt, hsa
cgcccuguuaguuuucagucuccuuuucuuucucaccauuuaucacuucccucacugcccuacc

SEQ ID NO: 277802 - RNA, 64 nt, hsa
ucuuuaagcuauaaauguguuaacauguauauauaccauuuauuauguucuacuuuagugauau

SEQ ID NO: 277803 - RNA, 64 nt, hsa
acaacguauguucauuauuuguacauaaaauaaaaccauuuaaaaaguaaugcugauauuuauu

SEQ ID NO: 277804 - RNA, 64 nt, hsa
uaggggaaacugggagacuuuaggaucuuaaaaaaccauuuaauaaaaaaaaaucuuugaaggg

SEQ ID NO: 277805 - RNA, 64 nt, hsa
uugaaaggaaacaguuuaaugguggaaaugaacuaccauuuauaacuucuguuuuuuuauugag

SEQ ID NO: 277806 - RNA, 64 nt, hsa
acggcuauuaaaugucacaauccuuuaauuagaaaccauuuauuggccggacgcgguggcucac

SEQ ID NO: 277807 - RNA, 64 nt, hsa
agacuccgucucaaaaaaaaaaaaaaaaaaagaaaccauuuauuuuaaaaaugauuagauugcu

SEQ ID NO: 277808 - RNA, 64 nt, hsa
guuggagaauuuagguuuuuauuaguaccauaguaccauuuauacaaauuagaaaauguuauuu

SEQ ID NO: 277809 - RNA, 64 nt, hsa
uuuaaagaaagaaauauuauugauucuauagaaaaccauuuaccaacugaaaggacacgaaguc

SEQ ID NO: 277810 - RNA, 64 nt, hsa
aaggauuuucuuaacucagauuuuaagccaaauaaccauuuaacacuaguauuuguuaaauggg

SEQ ID NO: 277811 - RNA, 64 nt, hsa
guuuaucaugccuaagggagacauuuaugauuaaaccauuuaugcuacauauaacuggggaaaa

SEQ ID NO: 277812 - RNA, 64 nt, hsa
aauuaagugguucucaucucuaauuaacugugaaaccauuuaauccaaacauguaagcacacac

SEQ ID NO: 277813 - RNA, 64 nt, hsa
cucagcuccacucggguggaguggaaguggccagaccauuuagacggacaggguccucacccua

SEQ ID NO: 277814 - RNA, 64 nt, hsa
gaugucagguacaaauacacuauagagucaaaauaccauuuacaaagaaaaucaaaagcauuuc

SEQ ID NO: 277815 - RNA, 64 nt, hsa
ugcuguuagaauagugcuauauaucagguaugugaccauuuauuucagaaggcugaacauaaga

SEQ ID NO: 277816 - RNA, 64 nt, hsa
gauugcaagaaacucuuuuauuaaacuuggaacaaccauuuaaaugaaggauuuugugagauag

SEQ ID NO: 277817 - RNA, 64 nt, hsa
uucuuguccauaucacaccaccaaaggcuuuuggaccauuuagcaucaugagccuaauggcuca

SEQ ID NO: 277818 - RNA, 64 nt, hsa
ccugaagaggaacugggccuguugcccuuucuguaccauuuauuugcucccaauguuuaugaua

SEQ ID NO: 277819 - RNA, 64 nt, hsa
gcgauauaauuuugguugucaaauuccuaaugcaaccauuuagucuaaacuuagucauuuauuu

SEQ ID NO: 277820 - RNA, 64 nt, hsa
auuaaaacgaagggaaaagggaccacugaauugcaccauuuaagaugcugcuugaacaaauggg

SEQ ID NO: 277821 - RNA, 64 nt, hsa
gauggaauaacucuguggcauuauugcauuauauaccauuuaucuguauuaacuuuggaaugua

SEQ ID NO: 277822 - RNA, 64 nt, hsa
cauuccucccuucuuucuuaaaguaauaaaauuuaccauuuaguucaagcuggcaauguggaca

SEQ ID NO: 277823 - RNA, 64 nt, hsa
auuuauccuuuuuuucuuuccugauuauccuaacaccauuuauucaauaaccuuguccauuuuc

SEQ ID NO: 277824 - RNA, 64 nt, hsa
guguguggaagugaccacugggaugucaucauucaccauuuauccaggauggccgcucaccagg

SEQ ID NO: 277825 - RNA, 64 nt, hsa
ccuccacacuccauggagacucaguucuccuaggaccauuuauucaaaaggacugcccucucuu

SEQ ID NO: 277826 - RNA, 64 nt, hsa
caaaaggagagguagaugcauauuuuuguguggaaccauuuaucuuaaaacauugaggugcagu

SEQ ID NO: 277827 - RNA, 64 nt, hsa
ggagggugacauuuuuacucccuuuuuggggcuaaccauuuaugcuuuuguacaucaaccgugc

SEQ ID NO: 277828 - RNA, 64 nt, hsa
gaaauacuaugaauguaaggauaugaguguuguuaccauuuagcccauugguugccaucuuuaa

SEQ ID NO: 277829 - RNA, 64 nt, hsa
gacugucuaugcaugcacacccacaagccuauacaccauuuauauaccuacacgcacgcaagag

SEQ ID NO: 277830 - RNA, 64 nt, hsa
gagaaagaauauguugauuuaaaagccuuccaacaccauuuaaacaugguuuaucuucagcaaa

SEQ ID NO: 277831 - RNA, 64 nt, hsa
uguaccacuuaaaguggaaucuaggcacuuuaucaccauuuagauccuauuaccuuuucucauc

SEQ ID NO: 277832 - RNA, 64 nt, hsa
ucuccagucuuccuucacuauuuuuuuuuccuucaccauuuaucauuucauagucauuuauguu

SEQ ID NO: 277833 - RNA, 64 nt, hsa
acaugaucuguuuuucaccacuucacugaaagacaccauuuaucuacccaagggcagaaaguag

SEQ ID NO: 277834 - RNA, 64 nt, hsa
aaagaauuuuaaaaaagauggauuugacacacucaccauuuaaucauuuccagcaaaauauaug

SEQ ID NO: 277835 - RNA, 64 nt, hsa
cagucaccuucucggcaacuaagcagucccugagaccauuuaacaugcaacccgaagguuaugg

SEQ ID NO: 277836 - RNA, 64 nt, hsa
gcacuggaaaccguuauuugcaaacauugcuguuaccauuuagaaauaugugcacuaucagcug

SEQ ID NO: 277837 - RNA, 64 nt, hsa
uuuauuuagcaccugccagaugccagaaauuuauaccauuuaaaacucaguaagucuuuuaaau

SEQ ID NO: 277838 - RNA, 64 nt, hsa
uggugagaaaucguugcugcacccuucccccagcaccauuuaugagucucaaguuuuauuauug

SEQ ID NO: 277839 - RNA, 64 nt, hsa
cccccauucugugugugucggggggacagagggaaccauuuaagaaaagauaccaaaguagaag

SEQ ID NO: 277840 - RNA, 64 nt, hsa
uacuguauuuuccuugcaaauauuggaguuauaaaccauuuacuuuguguucuacugaguaaga

SEQ ID NO: 277841 - RNA, 64 nt, hsa
cuuccagcauucuaaaggaggguuugugauugucaccauuuacugaugaggaaacuaaggcucc

SEQ ID NO: 277842 - RNA, 64 nt, hsa
auagcaccaugauagguugcacgcugccuguaccaccauuuacuuaauguuuucuuuaaauggc

SEQ ID NO: 277843 - RNA, 64 nt, hsa
uugaaaaauuuccaaguuguuagaguuuuuaauaaccauuuaauucaugaaaauaucauuaauc

SEQ ID NO: 277844 - RNA, 64 nt, hsa
aguucauauauagaauuuacgggagaaacuugagaccauuuacggggagaaacuugauucuggg

SEQ ID NO: 277845 - RNA, 64 nt, hsa
aagaauuagcacagcugauguaaaauucuaaauuaccauuuacuuccagauagagcagaggaga

SEQ ID NO: 277846 - RNA, 64 nt, hsa
guuggaaaugugauuaauuuaaucaugcagauaaaccauuuaaaugucagucucccaguuuuuc

SEQ ID NO: 277847 - RNA, 64 nt, hsa
uucuuguucugugucacucggcccuggguagucuaccauuuacuucaccccaaguccugcugcc

SEQ ID NO: 277848 - RNA, 64 nt, hsa
caaugcacauugcuuuagaucacauucgugauuuaccauuuaauuaacugguaaccucaaaauu

SEQ ID NO: 277849 - RNA, 64 nt, hsa
cuggguggucucauccauuccuuugcuuuuucauaccauuuauuuguuaaugauucccacauuu

SEQ ID NO: 277850 - RNA, 64 nt, hsa
gcucccugccauuuuagugucuugguguaguguaaccauuuagugguugguggcaacaauuuua

SEQ ID NO: 277851 - RNA, 64 nt, hsa
cccucagcaaauaccuaugucaacaguauaaguuaccauuuacucuauaaucugcagugaugca

SEQ ID NO: 277852 - RNA, 64 nt, hsa
gauuugugguaacuguagucaucuuaaauuucaaaccauuuaccaucugaaaguuuugauuuga

SEQ ID NO: 277853 - RNA, 64 nt, hsa
gaacuauguuauaguccagucuacuucuuuaaaaaccauuuaaacugcuagauaguauuagaau

SEQ ID NO: 277854 - RNA, 64 nt, hsa
aguauuauauuuuauuuaucuuuguagccuaaagaccauuuaaucuugaaggaacacaaagauc

SEQ ID NO: 277855 - RNA, 64 nt, hsa
uuuguuggccauauuacugccacacaugagaagcaccauuuaugcagauuuucuucagaauauu

SEQ ID NO: 277856 - RNA, 64 nt, hsa
aaaucauaccuuaauuuuuuuuuuuuuuuuuuuuaccauuuaugauuuauucuccuauguguca

SEQ ID NO: 277857 - RNA, 64 nt, hsa
ugggaacuuauuaaauggaaacugaaacuacugcaccauuuaaaaacaggcagcucauaagagc

SEQ ID NO: 277858 - RNA, 64 nt, hsa
ggcacauguaucauuuuacaaaugagcuuucaagaccauuuaaggaaacagaugcuucauuugc

SEQ ID NO: 277859 - RNA, 64 nt, hsa
aguagagaacauguugcuauaauguuccccagaaaccauuuauuaauugguaugaacaugagac

SEQ ID NO: 277860 - RNA, 64 nt, hsa
aauccauuccagcaaauuccccgugucuguggucaccauuuaggugaucauacaggacaggcug

SEQ ID NO: 277861 - RNA, 64 nt, hsa
aauacuguauuguuacagcugaaagacaguaaagaccauuuaguccucaccuucuguuuuagag

SEQ ID NO: 277862 - RNA, 64 nt, hsa
ccuggccauacucagggguccaggaagaauuuguaccauuuaauggguugggagucuuggccaa

SEQ ID NO: 277863 - RNA, 64 nt, hsa
uagacaacaaugaauaaauaaggagaacuuggaaaccauuuauguagugaugugggauaaccuu

SEQ ID NO: 277864 - RNA, 64 nt, hsa
aagguaagaaauaaacaaugaaagcgaugaggggaccauuuacauaaaacacagagcuuagaca

SEQ ID NO: 277865 - RNA, 64 nt, hsa
caaaagugcugcagggcuuuaaaauucucuuccaaccauuuaucuugaaggaaaaauucaauag

SEQ ID NO: 277866 - RNA, 64 nt, hsa
uaguuauggagacaaagugaaaacauaaaaugugaccauuuaacuuauggcuaagaaauggacu

SEQ ID NO: 277867 - RNA, 64 nt, hsa
ugcaagaaccuccccuuucccuucccccaauaagaccauuuaaguguguguuaaacaacuacag

SEQ ID NO: 277868 - RNA, 64 nt, hsa
agauugcuuguugauuggaaagaguguuuuauucaccauuuaaacguuugcaaaguggcgugcc

SEQ ID NO: 277869 - RNA, 64 nt, hsa
augacauauagaauuaauacaaaacaguuuaacaaccauuuaacugcaguguaagaaaauugga

SEQ ID NO: 277870 - RNA, 65 nt, hsa
caaaaugaacuccauugcuuaagaaacacauaaacaccauuuagucacugaacauagcuauaugu

SEQ ID NO: 277871 - RNA, 65 nt, hsa
uuuaggaaugaauuuaacuguccuuggguuacacuaccauuuauuggaacaagccccagaggcag

SEQ ID NO: 277872 - RNA, 65 nt, hsa
agguccuacugcaaaccaccccuccauauuuccguaccauuuacaauucaguuucugugacaucu

SEQ ID NO: 277873 - RNA, 65 nt, hsa
uuauauucagugaaaagauuuuauuuauggaauuaaccauuuaauaaagaaauauuuaccuaaua

SEQ ID NO: 277874 - RNA, 65 nt, hsa
uuagaaaguaaccugucuuugaugaugcuucucuuaccauuuaguuuuuguauauuacccugggg

SEQ ID NO: 277875 - RNA, 65 nt, hsa
cuccucaguuuugccgacugcuuuucaucugagucaccauuuacuccaagcauguauuccagacu

SEQ ID NO: 277876 - RNA, 65 nt, hsa
ggugaagagacuuguuucaucuccggaaaugcaaaaccauuuauagcaugaagcccuacaugauc

SEQ ID NO: 277877 - RNA, 65 nt, hsa
agugucaguguaucauuuaguauuuguaucacuguaccauuuaguguuguauaucacucagucau

SEQ ID NO: 277878 - RNA, 65 nt, hsa
agcagauuaucagcucggugacuuuucuuucugccaccauuuaggugaugguguuugauucagag

SEQ ID NO: 277879 - RNA, 65 nt, hsa
caauccuuccaaaaauauugauggugauuugugcuaccauuuacucguuuauuuaauaaagacau

SEQ ID NO: 277880 - RNA, 65 nt, hsa
agcauacccaggguggccuuuagcacaguaucaguaccauuuauuugucugccgcuuuuaaaaaa

SEQ ID NO: 277881 - RNA, 65 nt, hsa
uaucaugggaauugcaguuagagagaguaaggaauaccauuuagucaucuauccguucuucacuu

SEQ ID NO: 277882 - RNA, 65 nt, hsa
acccaaaucucacuuggcuggaaacaucaaucuuaaccauuuauucagaaccauuaaaccaauga

SEQ ID NO: 277883 - RNA, 65 nt, hsa
gcuaaauauugcaugcauauugacuaauuggaauaaccauuuacucaauuauggacagcuuauug

SEQ ID NO: 277884 - RNA, 65 nt, hsa
guggaacauguuucuuuuugaaagggagagaauugaccauuuauuguugugauguuuaaguuaua

SEQ ID NO: 277885 - RNA, 65 nt, hsa
guaaccagggauuuucccauuauguucccuuuuauaccauuuaggugugaguuccuuagcuucug

SEQ ID NO: 277886 - RNA, 65 nt, hsa
uugauaaucuuauucacaguuguuauuguuuacagaccauuuaauuaauauuuccucuguuuauu

SEQ ID NO: 277887 - RNA, 65 nt, hsa
cgucauguguuuccccaaagggaagccagucauugaccauuuaaaaagucuccugcuaaguaugg

SEQ ID NO: 277888 - RNA, 65 nt, hsa
uaaguaauacaaaaguuuugagcucuuccaaguauaccauuuauauacaaacaaauagguuuauu

SEQ ID NO: 277889 - RNA, 65 nt, hsa
cuuuucagggucuaccuaacugagccuagauauggaccauuuauggaugacaacaauuuuuuuuu

SEQ ID NO: 277890 - RNA, 65 nt, hsa
ccaguggccaggccuugugccguggcuggguggacaccauuuacaaugcccaggugagugcagag

SEQ ID NO: 277891 - RNA, 65 nt, hsa
cucccaguuuaguaucuuuugaauuuuauuucuguaccauuuaaaaaaaauaauuaacacuauuu

SEQ ID NO: 277892 - RNA, 65 nt, hsa
guaguaccugacuaaaaaugaaguaauacccuuaaaccauuuauaauuucuaguauuucucugaa

SEQ ID NO: 277893 - RNA, 65 nt, hsa
ugaaauucaauuuaaaaaaucacguuagccuccaaaccauuuaauucaaaugaacccaucaacug

SEQ ID NO: 277894 - RNA, 65 nt, hsa
ggaauugcaggacuauccuguaauuguagacacccaccauuuaaauuuauuuaacaguuaucuug

SEQ ID NO: 277895 - RNA, 65 nt, hsa
caaaguuuggauuguaucaaguggcaugugcugugaccauuuauaauguuaguagaaauuuuaca

SEQ ID NO: 277896 - RNA, 65 nt, hsa
uauucacuuuaaguucguauuuuuuaauuuauauuaccauuuauagauucauuuuggaaccauuu

SEQ ID NO: 277897 - RNA, 65 nt, hsa
gucccaaaaucaaaaugguacauccauaaucagccaccauuuaacccuuccuuguucuaaaacaa

SEQ ID NO: 277898 - RNA, 65 nt, hsa
cugcaagaaccuccccuuuccccucccacaauaagaccauuuaagugugugcuaaacaacuacgg

SEQ ID NO: 277899 - RNA, 65 nt, hsa
caaucuucugcauauggcuagccaguaaucccagcaccauuuauuaaauggggacuucuuucccc

SEQ ID NO: 277900 - RNA, 65 nt, hsa
ccuaccccagauauuuguguggaagaggaggaaucaccauuuacaagguggacaaaugcuaauau

SEQ ID NO: 277901 - RNA, 65 nt, hsa
aggaugguauagaaaacaacgcugcauauacagguaccauuuaggaaauaccgaugccuuugugg

SEQ ID NO: 277902 - RNA, 65 nt, hsa
gugauuguguuuuagaaaaauuauuauuugcuaaaaccauuuaagucuuuguauauguguaaaug

SEQ ID NO: 277903 - RNA, 65 nt, hsa
aggaugaagacaaauagggauacauuucaauguaaaccauuuaugaauuggaagugauguuggcu

SEQ ID NO: 277904 - RNA, 65 nt, hsa
uaagcgugaaauugaaaaacugaagcuggacaaggaccauuuagagaagguuuuacaaauuggau

SEQ ID NO: 277905 - RNA, 65 nt, hsa
gguauggauucacuuuuuacuuauguuaaaauuauaccauuuaacuggcucuuuugucauugugc

SEQ ID NO: 277906 - RNA, 65 nt, hsa
uuauuuuuguucugcaggcuugcagaguucuucucaccauuuaaacugaaggacccuauauuaua

SEQ ID NO: 277907 - RNA, 65 nt, hsa
acugacuuuuuucucacuguugcaucuucuguaggaccauuuaagucugggccacuuaauggcug

SEQ ID NO: 277908 - RNA, 65 nt, hsa
caaaaaccccuggaagagacucuuuaagaccucaaaccauuuagaaugggcaauguauuuuacgc

SEQ ID NO: 277909 - RNA, 65 nt, hsa
uagacauuaugagguauacaacuaguauuuaagauaccauuuaauaugccccguaaaugucuuca

SEQ ID NO: 277910 - RNA, 65 nt, hsa
caguucuuuagagcauuugcuucacacacaguucaaccauuuaaccagaaauuaaaauaucaccc

SEQ ID NO: 277911 - RNA, 65 nt, hsa
caaggagcaaugcugggauugcaacuguagggaacaccauuuaugcagugggaggauucgauggc

SEQ ID NO: 277912 - RNA, 65 nt, hsa
ggauuagaccaauuacugcacucuuaaacagcaccaccauuuaauuucauguauaucuaacuucg

SEQ ID NO: 277913 - RNA, 65 nt, hsa
uugggcagggcuuuuuaguaucaaaucacuacuagaccauuuaauuuguuaaauuaucucuagga

SEQ ID NO: 277914 - RNA, 65 nt, hsa
ucacuagagggaagucuucucaaguuucaagcaagaccauuuacuuaaugugaaguuuuggaaag

SEQ ID NO: 277915 - RNA, 65 nt, hsa
acuggguuuauauuuaacucuugcuucauagguguaccauuuaaagaguguuauuuaaugcuaag

SEQ ID NO: 277916 - RNA, 65 nt, hsa
cauugucaauaacgaaaccuaauuguaaaacagucaccauuuacuaccaauaacuuuuaguuaau

SEQ ID NO: 277917 - RNA, 65 nt, hsa
aacauaaagucauuauauuaauuaaaagaaaaaacaccauuuaauauguucugaaaacauuacuc

SEQ ID NO: 277918 - RNA, 65 nt, hsa
auuuuguacaaaaacuaauucuuuugguaaaaugaaccauuuacaguucgguuuuggacucugag

SEQ ID NO: 277919 - RNA, 65 nt, hsa
uagucaguacuuuuuucucauguaucuuucucuagaccauuuauauacgggugaaaugaaagcuu

SEQ ID NO: 277920 - RNA, 65 nt, hsa
uuaaaugaagucuugugaauuuguaauagaucaguaccauuuauugguuuggggaccaucuuaau

SEQ ID NO: 277921 - RNA, 65 nt, hsa
auauauguuauuuggcgagacaucaaauaaaguuaaccauuuaaaaauuauuuucauauacuguu

SEQ ID NO: 277922 - RNA, 65 nt, hsa
aucuucuguggucgcccgcccccccccaaaaaaauaccauuuaugguucucuccgcaaguauaaa

SEQ ID NO: 277923 - RNA, 65 nt, hsa
cuaggagcauggauguauaaggcagguuuuauacaaccauuuagauucaacauuaaugguagagu

SEQ ID NO: 277924 - RNA, 65 nt, hsa
ugguaaaugagcuugcaauguguuaaagaagauuaaccauuuaaaggcauguguuccauagccaa

SEQ ID NO: 277925 - RNA, 65 nt, hsa
gugcccauuuugaaauugccuauacagucuuagugaccauuuaaaccggacgaacuagguguuua

SEQ ID NO: 277926 - RNA, 65 nt, hsa
ucucuuucuacauauggcuagccaguuuucccagcaccauuuauuaaauagggaauccuuucccc

SEQ ID NO: 277927 - RNA, 65 nt, hsa
ugcugugaucuuacaaguuagauguuacuauaccuaccauuuauucagcuggauugcugaacaca

SEQ ID NO: 277928 - RNA, 65 nt, hsa
auuuaaaaucauuguuaaauugauugaggaaaacaaccauuuaaaaaaaaucuauguugaauccu

SEQ ID NO: 277929 - RNA, 65 nt, hsa
uauggagucuccaccuuuggacacaacacuuacucaccauuuacucuuuaucacucugcaacaaa

SEQ ID NO: 277930 - RNA, 65 nt, hsa
auuauuaaauauuaaaauaucuauuuauuauuaaaaccauuuauaaggcuuuuucauaaauguau

SEQ ID NO: 277931 - RNA, 65 nt, hsa
agcagaguaacauaaaauaaaaguacauuuuauaaaccauuuacuauggcuuuguaacaauugca

SEQ ID NO: 277932 - RNA, 65 nt, hsa
agauuuacuacuaggaaaccuuccucauaugaauaaccauuuauauguguuuugcuuaaaguauu

SEQ ID NO: 277933 - RNA, 65 nt, hsa
aaagguuauuccaguaaaaggaaauaguuuucucaaccauuuaaaaauauucuucugaacucauc

SEQ ID NO: 277934 - RNA, 65 nt, hsa
uugacuuuaucacaauaugauucuuacaucuuuauaccauuuacaauuguguuuuagaucuacag

SEQ ID NO: 277935 - RNA, 65 nt, hsa
uguauauagccggauuaacgguuauaaaguuuuguaccauuuauuuuaugacauuuuacaaugua

SEQ ID NO: 277936 - RNA, 65 nt, hsa
guagucaauuaguacaguagcuuaaauaaauucaaaccauuuaauucauaauuagaacaauagcu

SEQ ID NO: 277937 - RNA, 65 nt, hsa
aucuaucaauauugauagaagucacacuaguauauaccauuuaauacauuuacacuuucuuauuu

SEQ ID NO: 277938 - RNA, 65 nt, hsa
agaccaguucuuggccuaugauaaguuccaaaaauaccauuuaucuacuauuugaaaaaagaaga

SEQ ID NO: 277939 - RNA, 65 nt, hsa
uaagguccacuggacaguugggaaaacaccugaccaccauuuaaggacucuaagccagaauggaa

SEQ ID NO: 277940 - RNA, 65 nt, hsa
aguacuugagcuguaggacaaaccuugggcauuuaaccauuuacugucuggcuuugcccuuaaaa

SEQ ID NO: 277941 - RNA, 65 nt, hsa
aucagggaaaaaugaggaaaaaaaauagauucugaaccauuuauuguugaauaaguagagaaaau

SEQ ID NO: 277942 - RNA, 65 nt, hsa
auaagcauuguuuuaugaauuuuacauuuuuccucaccauuuagcaauuuucugaaugguaauaa

SEQ ID NO: 277943 - RNA, 65 nt, hsa
gaaguauuuucugaguguugagaagaaugaguuaaaccauuuaaacacauuugaaacauacaaaa

SEQ ID NO: 277944 - RNA, 65 nt, hsa
aucuuccuaaaucaaggaaaggaaaucauccccagaccauuuaugcugagcuuuggaauacuauu

SEQ ID NO: 277945 - RNA, 65 nt, hsa
uauauauggugcucacuuuaggaucagcaguguugaccauuuaugcugcauagcuguauuauagc

SEQ ID NO: 277946 - RNA, 65 nt, hsa
auaucuucucuauucuauucuacuuccuccauuucaccauuuauacaaagucauucaaaaaggcu

SEQ ID NO: 277947 - RNA, 65 nt, hsa
uguguguggggaggggggcugguuuacaauauuaaaccauuuaaaguauuuuauucuacaaaugg

SEQ ID NO: 277948 - RNA, 65 nt, hsa
cuacgcugacaaucaguuaaacacaccggagaagaaccauuuacaugcaccuuauauuucugugu

SEQ ID NO: 277949 - RNA, 65 nt, hsa
acuagaagcagaggcacuuaaaacauguaccaggaaccauuuaacaaagaauauaaaaugucaca

SEQ ID NO: 277950 - RNA, 65 nt, hsa
ccugugcccacacuuaaugucaaucuauaauuuuaaccauuuauccaagauucuacuaaguguaa

SEQ ID NO: 277951 - RNA, 65 nt, hsa
uuaucaaguuugggucugugcugcuguuacuguuaaccauuuaaguggggcaaaaccuugcuaau

SEQ ID NO: 277952 - RNA, 65 nt, hsa
auuuaaauauaugcuuuucuagaauuugauguuugaccauuuaugacuuaauuaccagagagcca

SEQ ID NO: 277953 - RNA, 65 nt, hsa
cccucauucucucguuuccccuuuagcucccuuucaccauuuauucagcuacaucaucccucuau

SEQ ID NO: 277954 - RNA, 65 nt, hsa
accuuuuuuuaucguuuuuguauuuucaugaaaauaccauuuaguaagaauaccacaucaaauaa

SEQ ID NO: 277955 - RNA, 65 nt, hsa
cauuugauuuguaaauuuacuuauguuaaaaauaaaccauuuauuuucagcuuugaauuuuauuu

SEQ ID NO: 277956 - RNA, 65 nt, hsa
auaucgaaugcaaagcuacuggcuucacagagacaaccauuuaugauuugcuguucuguaagagu

SEQ ID NO: 277957 - RNA, 65 nt, hsa
uaaaauugcaggugauuugauaauuaagcacccauaccauuuauaacuucugaauuuaaaaaguu

SEQ ID NO: 277958 - RNA, 65 nt, hsa
cgcuagcugaucucauuuccuuccaugguuuccuuaccauuuauaugcaaaugacugucagauuc

SEQ ID NO: 277959 - RNA, 65 nt, hsa
gcauaaaauacugaggcugauuuagucagggcaaaaccauuuacuuuacauauucguuuucaaua

SEQ ID NO: 277960 - RNA, 65 nt, hsa
ggcaucuaauccuacauaaugaaaaagaaaaacagaccauuuaaaaacucagacaagauuauauu

SEQ ID NO: 277961 - RNA, 65 nt, hsa
ccucuuagcacgcaaaagccaaaaucuaaagaucaaccauuuauccugaacaacaccauuugaga

SEQ ID NO: 277962 - RNA, 65 nt, hsa
gggucucucccagcucucgaauccuaacugcagccaccauuuauucagcaccuguuaugcaccag

SEQ ID NO: 277963 - RNA, 65 nt, hsa
uuacauuguauucagcuagccccuuaaagguaaugaccauuuauaaauuauuccuucaguuggcu

SEQ ID NO: 277964 - RNA, 65 nt, hsa
aacuauguuaauaccuauaaaauauauagccaggaaccauuuaucaucaagaaaaguguaagaaa

SEQ ID NO: 277965 - RNA, 65 nt, hsa
ggcagggugaguucucuccucaaagaagacuucaaaccauuuaacugguuucuuaagagccguca

SEQ ID NO: 277966 - RNA, 65 nt, hsa
gaccccugaauuccaaaauauuauggauaaacauuaccauuuauaugcuacaaauuagucugauu

SEQ ID NO: 277967 - RNA, 65 nt, hsa
augacacuagauacaguaaauuuuuagaaaaaaauaccauuuacaguauuauugugaaccauuua

SEQ ID NO: 277968 - RNA, 65 nt, hsa
uuuagaaaaaaauaccauuuacaguauuauugugaaccauuuaacccuuuugauccaaggccccg

SEQ ID NO: 277969 - RNA, 65 nt, hsa
uguucuaguccacauauaaggguaggguugggauuaccauuuacugaccacaucugugaggugcc

SEQ ID NO: 277970 - RNA, 65 nt, hsa
gaugauacaaccaugauuugcaacuguaacaggagaccauuuauuauaagcguaccuguuuguga

SEQ ID NO: 277971 - RNA, 65 nt, hsa
ccuuagauaaagagagaauauuguaugggccaucaaccauuuacuuuucccugaauguuagaaac

SEQ ID NO: 277972 - RNA, 65 nt, hsa
ggaucauagaauugcagucauuuggugcucugcuaaccauuuauauaaaacuuaaaaacaagaga

SEQ ID NO: 277973 - RNA, 65 nt, hsa
gauaggucagucaaguugguaaugccuguccauuaaccauuuaugcauacuaauaaaauuauaag

SEQ ID NO: 277974 - RNA, 65 nt, hsa
gcauuuauuggcuaacugcaugacaugcccauucuaccauuuaaaaaaaaaucuuaaagccugua

SEQ ID NO: 277975 - RNA, 65 nt, hsa
uguagguaaaaauauauaccuucgggucgcaguucaccauuuauaugugguauuaaaaauuaaug

SEQ ID NO: 277976 - RNA, 65 nt, hsa
gguuaggucuuaggaauugaauuaauaauaaagcuaccauuuaucaagcauuuaccaugugcuaa

SEQ ID NO: 277977 - RNA, 65 nt, hsa
cugaaucaugucagaacugcuuaaaauuaaccuuuaccauuuaaugucaucuaccugaaaacagu

SEQ ID NO: 277978 - RNA, 65 nt, hsa
gauuuuuuguuuguuuaguuauaacagaguaacauaccauuuaauuacaauuuuuagccagaaaa

SEQ ID NO: 277979 - RNA, 65 nt, hsa
uucucuuauuaauaaaacuuuggaaauugcuuuaaaccauuuaaaggaaauuucuagauauagaa

SEQ ID NO: 277980 - RNA, 65 nt, hsa
aaacuggguuaaucaagucucgguaaguccuuuaaaccauuuaggauuuuuaaaacaucaaaauu

SEQ ID NO: 277981 - RNA, 65 nt, hsa
auugauauacacggaugacuuaacugcauuuuuagaccauuuaucugggauuaugguuuugugau

SEQ ID NO: 277982 - RNA, 65 nt, hsa
gaacuuuuaaacuuuuuuaugaauuccuaaacauuaccauuuauguggcagaaguucuguucccu

SEQ ID NO: 277983 - RNA, 65 nt, hsa
gugcauaaaaguuaacauuaggcuguggugcaguaaccauuuaaugucgaggcucuauuucggaa

SEQ ID NO: 277984 - RNA, 56 nt, hsa; identical to SEQ ID NO: 277656

SEQ ID NO: 277985 - RNA, 65 nt, hsa
augaauaauuuucacucauuuauugucuucuggaaaccauuuaacuuuuacuguuuuuuauuuuu

SEQ ID NO: 277986 - RNA, 65 nt, hsa
aaaacaaaaugaacacugcuugucuucuuccauugaccauuuaguguugaguacuguauguguuu

SEQ ID NO: 277987 - RNA, 65 nt, hsa
accaaaugcuauuuuucaaugcauuuggacugcugaccauuuaaaagcagccuaugauugcuucu

SEQ ID NO: 277988 - RNA, 65 nt, hsa
uuaauguauuaaucuguuugugcaaacauaauaccaccauuuaaaaauguuagggagaugaguug

SEQ ID NO: 277989 - RNA, 65 nt, hsa
ugcugagaauccccgugcucacaguagcuuccuagaccauuuacuuugcccauauuaaaaagcca

SEQ ID NO: 277990 - RNA, 65 nt, hsa
uguggauuaugcuuaacagugagagcugaaaugagaccauuuacuuuguuuaaaaugcuguacug

SEQ ID NO: 277991 - RNA, 65 nt, hsa
augauacacaaaagugcacacugugugcucccuuuaccauuuacuaucucccuccagccccaacg

SEQ ID NO: 277992 - RNA, 65 nt, hsa
cuccucguccauuuuauuaggauuacccaaauauaaccauuuaaagaaagaaugcauuccagaac

SEQ ID NO: 277993 - RNA, 65 nt, hsa
cugccuagcacugcucuuuuugauguuguagugacaccauuuacauugaauuaaugcuugguagc

SEQ ID NO: 277994 - RNA, 65 nt, hsa
aauugaaaaacuguuugguaagcacauguauaucuaccauuuagauucagcaguuguuaauguuu

SEQ ID NO: 277995 - RNA, 65 nt, hsa
uugacuauuuuugguucaauacuacuacuguugucaccauuuaugauucugaauuuuaaaguugg

SEQ ID NO: 277996 - RNA, 65 nt, hsa
aauuucugaauauguuacugagcuugcuugugguaaccauuuauaauaucagaaaguauauguac

SEQ ID NO: 277997 - RNA, 65 nt, hsa
uguaccauauucagcauuugauuuccaugggccccaccauuuauguguagaauuugaaaugguug

SEQ ID NO: 277998 - RNA, 65 nt, hsa
guuuuuauuccccacuacucuugucucuaucagauaccauuuaugagacauucuugcuauaacua

SEQ ID NO: 277999 - RNA, 65 nt, hsa
uucuuuauuguaaaguaugcaaaauauauauucauaccauuuauuaaaucagaauguuuauacaa

SEQ ID NO: 278000 - RNA, 65 nt, hsa
cuucucucucaguucuacacugauacacuugaaggaccauuuacuguuuuuuucuguagcaccag

SEQ ID NO: 278001 - RNA, 65 nt, hsa
agagcagcaggaaggcaccgcuguccaccuugggcaccauuuauccuccuuucaucguccccggg

SEQ ID NO: 278002 - RNA, 65 nt, hsa
ucgcacacuaaacuuugguauuuugauuccuuuuaaccauuuaagacuacuuuucuuauagguag

SEQ ID NO: 278003 - RNA, 65 nt, hsa
auaguggcagcugaccaaucccccaucccaaauugaccauuuagauguaccaacucaccuuaaau

SEQ ID NO: 278004 - RNA, 65 nt, hsa
uaguucauauguacacuagccagugguuguggacaaccauuuacuugguguaaagaacuuaauuu

SEQ ID NO: 278005 - RNA, 65 nt, hsa
aauuucuaauuugaaaggcaguuaagaaauagauaaccauuuauuuuagaacacucaacaacuau

SEQ ID NO: 278006 - RNA, 65 nt, hsa
ggaaaugcacugugggguuuuuuccuguaugggaaaccauuuaugccaagcuuuuccccauuucc

SEQ ID NO: 278007 - RNA, 65 nt, hsa
ugacaucagcaacuuuugaaaacuucacacuuguuaccauuuagaaguuuccuggaaaauauaug

SEQ ID NO: 278008 - RNA, 65 nt, hsa
gugagauaucaggaaugucucaugauaucacguuuaccauuuacaccaucugcaaccauaugcua

SEQ ID NO: 278009 - RNA, 65 nt, hsa
uuucccuuacccagaaaugaaaauacucaauauggaccauuuaggaauuauaagcagcaacugug

SEQ ID NO: 278010 - RNA, 65 nt, hsa
auaauagauguccguacaaguagcgcauauauuuaaccauuuaguuuggggcucuauauuacuug

SEQ ID NO: 278011 - RNA, 65 nt, hsa
gcagacccauuggauuugcugcugguaacaguuccaccauuuagguuccagcaccaagcaaacua

SEQ ID NO: 278012 - RNA, 65 nt, hsa
gcggagacgcgucagauggcagauuuggaaaguuaaccauuuaaaagaacauuuuucucuccaac

SEQ ID NO: 278013 - RNA, 65 nt, hsa
uuacaaagcuugggacaguuauuggagauuaaucuaccauuuauugaaugcauacucugugcaag

SEQ ID NO: 278014 - RNA, 65 nt, hsa
auaauguuagaguucauguaaucacauucucuagaaccauuuaguuuguguuaacuaugaaccaa

SEQ ID NO: 278015 - RNA, 65 nt, hsa
gauuaacaguauuaauagcgacauugguaacagcuaccauuuauagaguuuuaaugggaguagga

SEQ ID NO: 278016 - RNA, 65 nt, hsa
aagaaaauguacauucuaauuaauucacuuauaaaaccauuuacauauuguguauauguuuuuau

SEQ ID NO: 278017 - RNA, 65 nt, hsa
ugccuauuuuucaaauuauuuaauagauguaugguaccauuuaaaagugguuguaucugaauuua

SEQ ID NO: 278018 - RNA, 65 nt, hsa
ucugaagcaugauaaaggggcaguucacaauuuucaccauuuaaacacaaauuugcugcacagaa

SEQ ID NO: 278019 - RNA, 65 nt, hsa
auuuugaaaagcaaaaaauacuauuaaccuauauaaccauuuaaaauuuaaaaaauuauguucca

SEQ ID NO: 278020 - RNA, 65 nt, hsa
guauuccaagagccaucuccuuaugauguauuugaaccauuuagagaaauucacuucauuguacc

SEQ ID NO: 278021 - RNA, 65 nt, hsa
cuguggugguguucuguugguuacaagaaaguuauaccauuuaaagcuggcaccagagacccgau

SEQ ID NO: 278022 - RNA, 65 nt, hsa
gaaugcuaggucagaagcugcuuuuucacacugaaaccauuuaaguauguacaaauaaguuaaua

SEQ ID NO: 278023 - RNA, 65 nt, hsa
accuuaugagcaggaagagggaaggcuguuugagaaccauuuacuuagcagaaccacauauuuua

SEQ ID NO: 278024 - RNA, 65 nt, hsa
gucuucuaaucaucuauguguguaugauggaugugaccauuuauaugucauguguugaaauuaaa

SEQ ID NO: 278025 - RNA, 65 nt, hsa
ggaaggaaguaauguuaccuauccuugauaccaugaccauuuauuagauguuuugcuauauaaau

SEQ ID NO: 278026 - RNA, 65 nt, hsa
uuugaugccaagugaauauaagagcuuguacugaaaccauuuauuucuuucuauuuugcuauuug

SEQ ID NO: 278027 - RNA, 65 nt, hsa
gaaauuuuauucaaaggaauuguaaaccuuaaaccaccauuuauuuccaugugaaaaaguguuau

SEQ ID NO: 278028 - RNA, 65 nt, hsa
aaaaagauuaagcaagugaaauucugcugcccuccaccauuuauuuuuacagugcuuuguaauuu

SEQ ID NO: 278029 - RNA, 65 nt, hsa
aguaggcugcuaccuaacuuuuagucccuuccaaaaccauuuaguaggguucuauuacauaaaca

SEQ ID NO: 278030 - RNA, 65 nt, hsa
aaacagauuacacaaaaauuauuuccagaaaggcuaccauuuaucaucauuauauuucaagccuc

SEQ ID NO: 278031 - RNA, 65 nt, hsa
gggccuuguucuguucucuggaacuaaacagaacaaccauuuaccccuccuuuucaaacuagaga

SEQ ID NO: 278032 - RNA, 65 nt, hsa
uacggagcagugccuaguaucuggagagcagcacuaccauuuauucuuucauuuauaguugggaa

SEQ ID NO: 278033 - RNA, 65 nt, hsa
aggaguuagaaaugaauuuuuuagaccuuaguaaaaccauuuaaccauaaaauggacaacugaga

SEQ ID NO: 278034 - RNA, 65 nt, hsa
auucuuuggaacuuuaauaagaucuagucuguuacaccauuuagaacuuuccugagccauuauca

SEQ ID NO: 278035 - RNA, 65 nt, hsa
auagugucauuuuauuuuagucauuauugaauuauaccauuuacucuguuuucuuauagucuuaa

SEQ ID NO: 278036 - RNA, 65 nt, hsa
acaggcuggaccugcaagauguggcuugaauuuuaaccauuuauuacauaaucucuagugaucau

SEQ ID NO: 278037 - RNA, 65 nt, hsa
uuaaaauacgacacccaguauuuucuuuaaguuucaccauuuacgcuacaugugauuuuuuuaau

SEQ ID NO: 278038 - RNA, 65 nt, hsa
uuucaaaagugaacaauccugugauaaguuggaguaccauuuaguaauacagcaacauuguguca

SEQ ID NO: 278039 - RNA, 65 nt, hsa
aacaugucacuugugcuuuaaaauuagucuguaucaccauuuauuacaguuauaauuuuggaguu

SEQ ID NO: 278040 - RNA, 65 nt, hsa
uaauuuucaugugucaugaaauacuguuuucuccaaccauuuaauaauguaaauacuugcuagcu

SEQ ID NO: 278041 - RNA, 65 nt, hsa
cacacuucccuugaucugcuuauuuuuauuccaucaccauuuacccuuuuuuuuuuuuuaaauuu

SEQ ID NO: 278042 - RNA, 65 nt, hsa
uaucacguaagugugugagugcagugcagaugagcaccauuuaguuauaugugcuaggcaaaucu

SEQ ID NO: 278043 - RNA, 65 nt, hsa
guggccaagcgaggucucaggugcaaagcaaaaggaccauuuaaaguaaaauagcuuggauucaa

SEQ ID NO: 278044 - RNA, 65 nt, hsa
gguacagcuuaaaucauggguccagccuaaaaaccaccauuuaacuuacacugaucaauuucaac

SEQ ID NO: 278045 - RNA, 65 nt, hsa
ugaguuucagaacaaaagauauucauugcacauuaaccauuuagaggucauuuaaauaacaaaau

SEQ ID NO: 278046 - RNA, 65 nt, hsa
uuaaauuccaccuaucuuaaugugaauuaaaaaccaccauuuauaauaauaauagcgccauauuc

SEQ ID NO: 278047 - RNA, 65 nt, hsa
guguuuaaauucuuaauauuagucauccuaaguauaccauuuauguauccuuuauaaggaaugug

SEQ ID NO: 278048 - RNA, 65 nt, hsa
uccucagaacaaagauuggaaaaagcuggccgagaaccauuuauacauagaggaagggcuuaugg

SEQ ID NO: 278049 - RNA, 65 nt, hsa
uuuuaguauuguuguaaaacuucaugaaacaaaagaccauuuaaauagugaauuauuaaaaaucu

SEQ ID NO: 278050 - RNA, 65 nt, hsa
gcagaaggaucagacaauaaaaugaguuagugcaaaccauuuaguaaaaauaacuaucagcagag

SEQ ID NO: 278051 - RNA, 65 nt, hsa
auguucucagaacauuuagccugcaguugggcaaaaccauuuaacacaaagccuauuuuauaaug

SEQ ID NO: 278052 - RNA, 65 nt, hsa
ggugucugugguagcuuuuaggcugcuccuaacccaccauuuauugccuucugagagguggguga

SEQ ID NO: 278053 - RNA, 65 nt, hsa
aaacagcauuacaaaauccuaguuuauacuagacuaccauuuaaaaaucauguuuuuauauaaau

SEQ ID NO: 278054 - RNA, 65 nt, hsa
acucuccuucaacauccucacccccaccccugggcaccauuuaggacaagacuuccuuauuuauc

SEQ ID NO: 278055 - RNA, 65 nt, hsa
ggaggccauuuagaugauuaguuaauuuguuuuucaccauuuagcaaaaauguauacuaccuuaa

SEQ ID NO: 278056 - RNA, 65 nt, hsa
agcccuucuguauuuuaaaauguaauauacuuuguaccauuuauaaaaauugugugaugaaugaa

SEQ ID NO: 278057 - RNA, 65 nt, hsa
auucauuuccauaaaccaaguuaaaguauggcccgaccauuuaagaaaacaaccaucugagacac

SEQ ID NO: 278058 - RNA, 65 nt, hsa
aaaggguaaacaaaaaacuaaaacuuauacaagauaccauuuacacugaacauagaauucccuag

SEQ ID NO: 278059 - RNA, 65 nt, hsa
gcuuccagaucgugaggcuggggagcauucuagguaccauuuauuaucuacugcguuucggucag

SEQ ID NO: 278060 - RNA, 65 nt, hsa
ggucccucccacaacacaugggaauucugagagauaccauuuaaguugagauuucaguggggaca

SEQ ID NO: 278061 - RNA, 65 nt, hsa
auguucacaaaaaguagaaacucuaagagaccauuaccauuuauucacagauguauaggggaugu

SEQ ID NO: 278062 - RNA, 65 nt, hsa
uugcuuauuaucaaaagaauaauuaaaaucauguaaccauuuaaaugucacuguuaacacuuuuc

SEQ ID NO: 278063 - RNA, 65 nt, hsa
guuuacccaaaaguauaagauacauuuuuugguaaaccauuuaaaauacaaaauccuauuuugga

SEQ ID NO: 278064 - RNA, 65 nt, hsa
ugaauuauugaauaguaauuaaacuuuaacugaugaccauuuauauucuaguagccaucuucacu

SEQ ID NO: 278065 - RNA, 65 nt, hsa
acuuugaaacaggacugaagcccuuuuuaccuagaaccauuuaaaagccugagcaaggaccacca

SEQ ID NO: 278066 - RNA, 65 nt, hsa
auguugaaaggagaaaaagcacaaguucccuaguuaccauuuaauaugagggugcaagagccaca

SEQ ID NO: 278067 - RNA, 65 nt, hsa
aaucccagcuuucuuuucuacuagcaaaugacccuaccauuuauuucugccuuuuucuuccguuc

SEQ ID NO: 278068 - RNA, 65 nt, hsa
ccccugucagggccucugccaaggaaauaauauggaccauuuaccuggcaggcagucugcucucu

SEQ ID NO: 278069 - RNA, 65 nt, hsa
augggguuuuuuuguuuuuacuuucuaucuucauaaccauuuaaagcgauuuagcuugaaauuaa

SEQ ID NO: 278070 - RNA, 65 nt, hsa
auuaaccacuuuugacuagguaagucuuucuaaaaaccauuuaaagcuaacugggucuuagcauc

SEQ ID NO: 278071 - RNA, 65 nt, hsa
uacauggaaaccagaaaugcaacaguuacuaaaacaccauuuaauaguuauaacgucguuacuug

SEQ ID NO: 278072 - RNA, 65 nt, hsa
auguuguagaauaaauuaaaaggauaaucuaaaucaccauuuagauuaagcuugacuugcaaacu

SEQ ID NO: 278073 - RNA, 65 nt, hsa
cagcaauauucaaagaaagaaccacagauguguuaaccauuuaagcagaucaucugccaaacauu

SEQ ID NO: 278074 - RNA, 65 nt, hsa
uuaagaaauaacauuuuaaaaucuauuuuauacuuaccauuuauuauucuguuauuuuagucucc

SEQ ID NO: 278075 - RNA, 65 nt, hsa
agccacugaugggaauauacagauuuaggugcuaaaccauuuauuuuccacggaugagucacaau

SEQ ID NO: 278076 - RNA, 65 nt, hsa
acauugacuucagcaaaagcacggggcuguaaauuaccauuuacuagauuagccaaauagucuga

SEQ ID NO: 278077 - RNA, 65 nt, hsa
gauauuauuauguggguauuuauaugaccuuuguaaccauuuaaaaauguaaaaacgaccugacu

SEQ ID NO: 278078 - RNA, 65 nt, hsa
uaaucugagaagucagccucuuggcuccucaggccaccauuuaggccugacugggguaagaaaug

SEQ ID NO: 278079 - RNA, 65 nt, hsa
cuaguggaagcccagucuugaguucuugucuuguuaccauuuaaaauugacauuuaauuuucaaa

SEQ ID NO: 278080 - RNA, 65 nt, hsa
augcuuuaauccuuucuuuagaaugcuguuuaaacaccauuuacccuacuuaucccucaaugcac

SEQ ID NO: 278081 - RNA, 65 nt, hsa
ucuguucucuuuguuuuaaagagagaauuuuguaaaccauuuauugaauguucugaucuuucauu

SEQ ID NO: 278082 - RNA, 65 nt, hsa
caaaaacagucaauagggcuacugcuggcccaaagaccauuuagguccaccuccucuuuuuugcu

SEQ ID NO: 278083 - RNA, 65 nt, hsa
uggggagccucgggaaaagguagaggagucacguuaccauuuacauguuuuaaagaaagaagugu

SEQ ID NO: 278084 - RNA, 65 nt, hsa
cugggagauucagcuuaauuugcuucaauucagcaaccauuuauugagcaucuauuaugugccag

SEQ ID NO: 278085 - RNA, 65 nt, hsa
auaauccacccaugcaaauagcuacuggcccagcuaccauuuaccauuugccuacagaauuucau

SEQ ID NO: 278086 - RNA, 65 nt, hsa
acacuuugucauuaucaagagagauggcaguauugaccauuuaguuuaguuaaaaaaaaaaaaaa

SEQ ID NO: 278087 - RNA, 65 nt, hsa
uaugaguauggaugucacucaacuaagaucaaaucaccauuuaaggggauggcauucuuuauacc

SEQ ID NO: 278088 - RNA, 65 nt, hsa
uaaacuccaaggcagaaauuguaucuuuauagcuaaccauuuaguaaauaaauacauuacauuuu

SEQ ID NO: 278089 - RNA, 65 nt, hsa
ugugguugacuaccuuuugauaagcaaaauuugaaaccauuuaaagaccacuguauuuuaacuca

SEQ ID NO: 278090 - RNA, 65 nt, hsa
uacugacacaagccaccgccccugagugcucauguaccauuuagcuuguguuuuaaaaaucuacu

SEQ ID NO: 278091 - RNA, 65 nt, hsa
ucauuuaggugaggaagcaaaagcaucuaugugagaccauuuagcacacugcuugugaaaggaaa

SEQ ID NO: 278092 - RNA, 65 nt, hsa
aaugaguuacauuaucagccagcccagccuugcccaccauuuaagaaauaucacagagccacuag

SEQ ID NO: 278093 - RNA, 65 nt, hsa
uugaucuauuuuccuauggaguuguuucuauuaugaccauuuaauuuuguuuuuauuuaauagua

SEQ ID NO: 278094 - RNA, 65 nt, hsa
acccagugacuucagugguauccuuuuuuccuaagaccauuuauaauuauuaguggcaacagagu

SEQ ID NO: 278095 - RNA, 65 nt, hsa
acaucaaacaaaaaugcccugguggcaaagcuaucaccauuuaaugucuucucucagucuugcac

SEQ ID NO: 278096 - RNA, 65 nt, hsa
ggauaugcuuuuuuuuuuaaagacugaauguguucaccauuuagccuguagauuuauuuccauuu

SEQ ID NO: 278097 - RNA, 65 nt, hsa
ugguguuaggagugguuacaacugagcuuuuaguaaccauuuaaccguauguaaacuugguuucu

SEQ ID NO: 278098 - RNA, 65 nt, hsa
uucucagguggcaauguaacucauuuuuuugucccaccauuuaucuucucugcccaagcccuguc

SEQ ID NO: 278099 - RNA, 65 nt, hsa
ucuuuuuagcuguuaaauguacuaugccaucauccaccauuuaguaaaauguagcuggcccagga

SEQ ID NO: 278100 - RNA, 65 nt, hsa
uugcuaucuuuuuuuauuauucugaucaugauaugaccauuuaaccucagaauucauaauuccug

SEQ ID NO: 278101 - RNA, 65 nt, hsa
agugaaauucagucuuaaguagggugaauuggaucaccauuuacacaagagauggcuuuuuccuu

SEQ ID NO: 278102 - RNA, 65 nt, hsa
ccuauuauucugauuuuuaaaaaugcaguuaauguaccauuuauuugcuugaugaagggagcucu

SEQ ID NO: 278103 - RNA, 65 nt, hsa
aguucacaguuaauuguugcgcucuaauacaacugaccauuuaaaauugaacaaguuuauuguuu

SEQ ID NO: 278104 - RNA, 65 nt, hsa
cuaaaugucaauguauuuuuggcacugcgauuuuaaccauuuauuaaauaaaaauuuuguuaaag

SEQ ID NO: 278105 - RNA, 65 nt, hsa
uuaaagaggucgcuugggaauuuuauugacacaguaccauuuaauggggaggacaaaauggggca

SEQ ID NO: 278106 - RNA, 65 nt, hsa
uaguucauauguacaccagcuaguggcugugaacaaccauuuaguugguguaaaaaacuuuauuu

SEQ ID NO: 278107 - RNA, 65 nt, hsa
aguuucauuuuacuuuaacuauauaaugucuguuaaccauuuaagaugccaucugaaggggauuc

SEQ ID NO: 278108 - RNA, 65 nt, hsa
aaacauuacucauuugauuucccccacccccgccaaccauuuaaaaaaguuugccggcuaggugc

SEQ ID NO: 278109 - RNA, 52 nt, hsa; identical to SEQ ID NO: 277781

SEQ ID NO: 278110 - RNA, 65 nt, hsa
uuuuuuaaaaaagugugccuugcuguauuucuuauaccauuuauuaaaaagcugcuuucacggua

SEQ ID NO: 278111 - RNA, 65 nt, hsa
ugucaauuaguagcuuaccacagauacuguuuccuaccauuuauaaaauuuacuuuuuauugaaa

SEQ ID NO: 278112 - RNA, 65 nt, hsa
guucugacuggagaccccagugugggggaggucuuaccauuuaauauagaaaugauaucaauaac

SEQ ID NO: 278113 - RNA, 65 nt, hsa
ggaaaauagaagaguguguugggcagguaguuuguaccauuuaugaagguuuguuccuuuguuaa

SEQ ID NO: 278114 - RNA, 65 nt, hsa
ggcucaacuuuuuaaaauccagacccaguguuaaaaccauuuauuccuuuuuucauaagaauaau

SEQ ID NO: 278115 - RNA, 65 nt, hsa
ucucaaauauauauuuaaaagauuuaugaauacaaaccauuuaugguuuaugauuucuaaaaaga

SEQ ID NO: 278116 - RNA, 65 nt, hsa
cuggaggaagaaaacaggugaaagaagaaguaaaaaccauuuaguauuaguauuagaaugaaguc

SEQ ID NO: 278117 - RNA, 65 nt, hsa
ugcuaugacaauuugcacagcccaguggcuuaaacaccauuuauaccacagguccagaugaaucc

SEQ ID NO: 278118 - RNA, 65 nt, hsa
cacauaacacauaaaauuaguuucuaugaguguauaccauuuaaagaauuuuuuuuucaguaaaa

SEQ ID NO: 278119 - RNA, 65 nt, hsa
aaacagauuuuuuuuuauuucaagaaaauuuugcuaccauuuaaguaagagaaggugagaaggau

SEQ ID NO: 278120 - RNA, 65 nt, hsa
accuaauguaauaaauuuuauuguauaaauauaucaccauuuacaugaggggaaacacuagccag

SEQ ID NO: 278121 - RNA, 65 nt, hsa
cauccuccuuucaguucguugguagagcccucagaaccauuuaagagacucuuuauuuuucucuu

SEQ ID NO: 278122 - RNA, 65 nt, hsa
uuaugggauuacuuuugcagaaucauaauuuagcaaccauuuaucauggaugaaagagaucugua

SEQ ID NO: 278123 - RNA, 65 nt, hsa
uaaauugugcagcaauagauuuuuaacuuuaacugaccauuuaaguuuuuuaauaaguuuuuuac

SEQ ID NO: 278124 - RNA, 65 nt, hsa
uuuaacaaguauugcaguaaucaucacuuacagguaccauuuauuucaaaacaacuuuuuuaguc

SEQ ID NO: 278125 - RNA, 65 nt, hsa
ugaauuugagaagccaaauggaauuuuuaauggaaaccauuuaucagauuaaucucuugcucucc

SEQ ID NO: 278126 - RNA, 65 nt, hsa
ggggaaacgauuuuuuguguccuuaaaauggcaugaccauuuauuugccccuuucuccauccugu

SEQ ID NO: 278127 - RNA, 65 nt, hsa
uauugucaauaaugaaacccaauuguaaaacagucaccauuuacuaccaguaacuuuuaguuaau

SEQ ID NO: 278128 - RNA, 65 nt, hsa
uguuccugacucugacaagaaagcauaagucucucaccauuuagugugauuuuagcuguggguuu

SEQ ID NO: 278129 - RNA, 65 nt, hsa
ccgcccuguuaguuuucagucuccuuuucuuucucaccauuuaucacuucccucacugcccuacc

SEQ ID NO: 278130 - RNA, 65 nt, hsa
aucuuuaagcuauaaauguguuaacauguauauauaccauuuauuauguucuacuuuagugauau

SEQ ID NO: 278131 - RNA, 65 nt, hsa
uacaacguauguucauuauuuguacauaaaauaaaaccauuuaaaaaguaaugcugauauuuauu

SEQ ID NO: 278132 - RNA, 65 nt, hsa
auaggggaaacugggagacuuuaggaucuuaaaaaaccauuuaauaaaaaaaaaucuuugaaggg

SEQ ID NO: 278133 - RNA, 65 nt, hsa
cuugaaaggaaacaguuuaaugguggaaaugaacuaccauuuauaacuucuguuuuuuuauugag

SEQ ID NO: 278134 - RNA, 65 nt, hsa
aacggcuauuaaaugucacaauccuuuaauuagaaaccauuuauuggccggacgcgguggcucac

SEQ ID NO: 278135 - RNA, 65 nt, hsa
gagacuccgucucaaaaaaaaaaaaaaaaaaagaaaccauuuauuuuaaaaaugauuagauugcu

SEQ ID NO: 278136 - RNA, 65 nt, hsa
gguuggagaauuuagguuuuuauuaguaccauaguaccauuuauacaaauuagaaaauguuauuu

SEQ ID NO: 278137 - RNA, 65 nt, hsa
auuuaaagaaagaaauauuauugauucuauagaaaaccauuuaccaacugaaaggacacgaaguc

SEQ ID NO: 278138 - RNA, 65 nt, hsa
aaaggauuuucuuaacucagauuuuaagccaaauaaccauuuaacacuaguauuuguuaaauggg

SEQ ID NO: 278139 - RNA, 65 nt, hsa
uguuuaucaugccuaagggagacauuuaugauuaaaccauuuaugcuacauauaacuggggaaaa

SEQ ID NO: 278140 - RNA, 65 nt, hsa
caauuaagugguucucaucucuaauuaacugugaaaccauuuaauccaaacauguaagcacacac

SEQ ID NO: 278141 - RNA, 65 nt, hsa
gcucagcuccacucggguggaguggaaguggccagaccauuuagacggacaggguccucacccua

SEQ ID NO: 278142 - RNA, 65 nt, hsa
ugaugucagguacaaauacacuauagagucaaaauaccauuuacaaagaaaaucaaaagcauuuc

SEQ ID NO: 278143 - RNA, 65 nt, hsa
uugcuguuagaauagugcuauauaucagguaugugaccauuuauuucagaaggcugaacauaaga

SEQ ID NO: 278144 - RNA, 65 nt, hsa
ggauugcaagaaacucuuuuauuaaacuuggaacaaccauuuaaaugaaggauuuugugagauag

SEQ ID NO: 278145 - RNA, 65 nt, hsa
uuucuuguccauaucacaccaccaaaggcuuuuggaccauuuagcaucaugagccuaauggcuca

SEQ ID NO: 278146 - RNA, 65 nt, hsa
uccugaagaggaacugggccuguugcccuuucuguaccauuuauuugcucccaauguuuaugaua

SEQ ID NO: 278147 - RNA, 65 nt, hsa
agcgauauaauuuugguugucaaauuccuaaugcaaccauuuagucuaaacuuagucauuuauuu

SEQ ID NO: 278148 - RNA, 65 nt, hsa
uauuaaaacgaagggaaaagggaccacugaauugcaccauuuaagaugcugcuugaacaaauggg

SEQ ID NO: 278149 - RNA, 65 nt, hsa
ugauggaauaacucuguggcauuauugcauuauauaccauuuaucuguauuaacuuuggaaugua

SEQ ID NO: 278150 - RNA, 65 nt, hsa
ccauuccucccuucuuucuuaaaguaauaaaauuuaccauuuaguucaagcuggcaauguggaca

SEQ ID NO: 278151 - RNA, 65 nt, hsa
aauuuauccuuuuuuucuuuccugauuauccuaacaccauuuauucaauaaccuuguccauuuuc

SEQ ID NO: 278152 - RNA, 65 nt, hsa
gguguguggaagugaccacugggaugucaucauucaccauuuauccaggauggccgcucaccagg

SEQ ID NO: 278153 - RNA, 65 nt, hsa
accuccacacuccauggagacucaguucuccuaggaccauuuauucaaaaggacugcccucucuu

SEQ ID NO: 278154 - RNA, 65 nt, hsa
ccaaaaggagagguagaugcauauuuuuguguggaaccauuuaucuuaaaacauugaggugcagu

SEQ ID NO: 278155 - RNA, 65 nt, hsa
aggagggugacauuuuuacucccuuuuuggggcuaaccauuuaugcuuuuguacaucaaccgugc

SEQ ID NO: 278156 - RNA, 65 nt, hsa
agaaauacuaugaauguaaggauaugaguguuguuaccauuuagcccauugguugccaucuuuaa

SEQ ID NO: 278157 - RNA, 65 nt, hsa
ggacugucuaugcaugcacacccacaagccuauacaccauuuauauaccuacacgcacgcaagag

SEQ ID NO: 278158 - RNA, 65 nt, hsa
agagaaagaauauguugauuuaaaagccuuccaacaccauuuaaacaugguuuaucuucagcaaa

SEQ ID NO: 278159 - RNA, 65 nt, hsa
uuguaccacuuaaaguggaaucuaggcacuuuaucaccauuuagauccuauuaccuuuucucauc

SEQ ID NO: 278160 - RNA, 65 nt, hsa
uucuccagucuuccuucacuauuuuuuuuuccuucaccauuuaucauuucauagucauuuauguu

SEQ ID NO: 278161 - RNA, 65 nt, hsa
cacaugaucuguuuuucaccacuucacugaaagacaccauuuaucuacccaagggcagaaaguag

SEQ ID NO: 278162 - RNA, 65 nt, hsa
aaaagaauuuuaaaaaagauggauuugacacacucaccauuuaaucauuuccagcaaaauauaug

SEQ ID NO: 278163 - RNA, 65 nt, hsa
acagucaccuucucggcaacuaagcagucccugagaccauuuaacaugcaacccgaagguuaugg

SEQ ID NO: 278164 - RNA, 65 nt, hsa
agcacuggaaaccguuauuugcaaacauugcuguuaccauuuagaaauaugugcacuaucagcug

SEQ ID NO: 278165 - RNA, 65 nt, hsa
auuuauuuagcaccugccagaugccagaaauuuauaccauuuaaaacucaguaagucuuuuaaau

SEQ ID NO: 278166 - RNA, 65 nt, hsa
uuggugagaaaucguugcugcacccuucccccagcaccauuuaugagucucaaguuuuauuauug

SEQ ID NO: 278167 - RNA, 65 nt, hsa
ucccccauucugugugugucggggggacagagggaaccauuuaagaaaagauaccaaaguagaag

SEQ ID NO: 278168 - RNA, 65 nt, hsa
guacuguauuuuccuugcaaauauuggaguuauaaaccauuuacuuuguguucuacugaguaaga

SEQ ID NO: 278169 - RNA, 65 nt, hsa
ucuuccagcauucuaaaggaggguuugugauugucaccauuuacugaugaggaaacuaaggcucc

SEQ ID NO: 278170 - RNA, 65 nt, hsa
aauagcaccaugauagguugcacgcugccuguaccaccauuuacuuaauguuuucuuuaaauggc

SEQ ID NO: 278171 - RNA, 65 nt, hsa
auugaaaaauuuccaaguuguuagaguuuuuaauaaccauuuaauucaugaaaauaucauuaauc

SEQ ID NO: 278172 - RNA, 65 nt, hsa
aaguucauauauagaauuuacgggagaaacuugagaccauuuacggggagaaacuugauucuggg

SEQ ID NO: 278173 - RNA, 65 nt, hsa
caagaauuagcacagcugauguaaaauucuaaauuaccauuuacuuccagauagagcagaggaga

SEQ ID NO: 278174 - RNA, 65 nt, hsa
uguuggaaaugugauuaauuuaaucaugcagauaaaccauuuaaaugucagucucccaguuuuuc

SEQ ID NO: 278175 - RNA, 65 nt, hsa
guucuuguucugugucacucggcccuggguagucuaccauuuacuucaccccaaguccugcugcc

SEQ ID NO: 278176 - RNA, 65 nt, hsa
ucaaugcacauugcuuuagaucacauucgugauuuaccauuuaauuaacugguaaccucaaaauu

SEQ ID NO: 278177 - RNA, 65 nt, hsa
ccuggguggucucauccauuccuuugcuuuuucauaccauuuauuuguuaaugauucccacauuu

SEQ ID NO: 278178 - RNA, 65 nt, hsa
ggcucccugccauuuuagugucuugguguaguguaaccauuuagugguugguggcaacaauuuua

SEQ ID NO: 278179 - RNA, 65 nt, hsa
ccccucagcaaauaccuaugucaacaguauaaguuaccauuuacucuauaaucugcagugaugca

SEQ ID NO: 278180 - RNA, 65 nt, hsa
cgauuugugguaacuguagucaucuuaaauuucaaaccauuuaccaucugaaaguuuugauuuga

SEQ ID NO: 278181 - RNA, 65 nt, hsa
agaacuauguuauaguccagucuacuucuuuaaaaaccauuuaaacugcuagauaguauuagaau

SEQ ID NO: 278182 - RNA, 65 nt, hsa
aaguauuauauuuuauuuaucuuuguagccuaaagaccauuuaaucuugaaggaacacaaagauc

SEQ ID NO: 278183 - RNA, 65 nt, hsa
uuuuguuggccauauuacugccacacaugagaagcaccauuuaugcagauuuucuucagaauauu

SEQ ID NO: 278184 - RNA, 65 nt, hsa
gaaaucauaccuuaauuuuuuuuuuuuuuuuuuuuaccauuuaugauuuauucuccuauguguca

SEQ ID NO: 278185 - RNA, 65 nt, hsa
cugggaacuuauuaaauggaaacugaaacuacugcaccauuuaaaaacaggcagcucauaagagc

SEQ ID NO: 278186 - RNA, 65 nt, hsa
gggcacauguaucauuuuacaaaugagcuuucaagaccauuuaaggaaacagaugcuucauuugc

SEQ ID NO: 278187 - RNA, 65 nt, hsa
aaguagagaacauguugcuauaauguuccccagaaaccauuuauuaauugguaugaacaugagac

SEQ ID NO: 278188 - RNA, 65 nt, hsa
caauccauuccagcaaauuccccgugucuguggucaccauuuaggugaucauacaggacaggcug

SEQ ID NO: 278189 - RNA, 65 nt, hsa
gaauacuguauuguuacagcugaaagacaguaaagaccauuuaguccucaccuucuguuuuagag

SEQ ID NO: 278190 - RNA, 65 nt, hsa
uccuggccauacucagggguccaggaagaauuuguaccauuuaauggguugggagucuuggccaa

SEQ ID NO: 278191 - RNA, 65 nt, hsa
guagacaacaaugaauaaauaaggagaacuuggaaaccauuuauguagugaugugggauaaccuu

SEQ ID NO: 278192 - RNA, 65 nt, hsa
aaagguaagaaauaaacaaugaaagcgaugaggggaccauuuacauaaaacacagagcuuagaca

SEQ ID NO: 278193 - RNA, 65 nt, hsa
gcaaaagugcugcagggcuuuaaaauucucuuccaaccauuuaucuugaaggaaaaauucaauag

SEQ ID NO: 278194 - RNA, 65 nt, hsa
uuaguuauggagacaaagugaaaacauaaaaugugaccauuuaacuuauggcuaagaaauggacu

SEQ ID NO: 278195 - RNA, 65 nt, hsa
cugcaagaaccuccccuuucccuucccccaauaagaccauuuaaguguguguuaaacaacuacag

SEQ ID NO: 278196 - RNA, 65 nt, hsa
gagauugcuuguugauuggaaagaguguuuuauucaccauuuaaacguuugcaaaguggcgugcc

SEQ ID NO: 278197 - RNA, 65 nt, hsa
uaugacauauagaauuaauacaaaacaguuuaacaaccauuuaacugcaguguaagaaaauugga

SEQ ID NO: 278198 - RNA, 62 nt, hsa; identical to SEQ ID NO: 253135

SEQ ID NO: 278199 - RNA, 62 nt, hsa; identical to SEQ ID NO: 253136

SEQ ID NO: 278200 - RNA, 62 nt, hsa; identical to SEQ ID NO: 253137

SEQ ID NO: 278201 - RNA, 62 nt, hsa; identical to SEQ ID NO: 253138

SEQ ID NO: 278202 - RNA, 62 nt, hsa; identical to SEQ ID NO: 253139

SEQ ID NO: 278203 - RNA, 62 nt, hsa; identical to SEQ ID NO: 253140

SEQ ID NO: 278204 - RNA, 62 nt, hsa; identical to SEQ ID NO: 253141

SEQ ID NO: 278205 - RNA, 62 nt, hsa; identical to SEQ ID NO: 253142

SEQ ID NO: 278206 - RNA, 62 nt, hsa; identical to SEQ ID NO: 253143

SEQ ID NO: 278207 - RNA, 62 nt, hsa; identical to SEQ ID NO: 253144

SEQ ID NO: 278208 - RNA, 62 nt, hsa; identical to SEQ ID NO: 253145

SEQ ID NO: 278209 - RNA, 58 nt, hsa; identical to SEQ ID NO: 102991

SEQ ID NO: 278210 - RNA, 62 nt, hsa; identical to SEQ ID NO: 253147

SEQ ID NO: 278211 - RNA, 62 nt, hsa; identical to SEQ ID NO: 253148

SEQ ID NO: 278212 - RNA, 62 nt, hsa; identical to SEQ ID NO: 253149

SEQ ID NO: 278213 - RNA, 62 nt, hsa; identical to SEQ ID NO: 253150

SEQ ID NO: 278214 - RNA, 62 nt, hsa; identical to SEQ ID NO: 253151

SEQ ID NO: 278215 - RNA, 62 nt, hsa; identical to SEQ ID NO: 253152

SEQ ID NO: 278216 - RNA, 62 nt, hsa; identical to SEQ ID NO: 253153

SEQ ID NO: 278217 - RNA, 62 nt, hsa; identical to SEQ ID NO: 253154

SEQ ID NO: 278218 - RNA, 62 nt, hsa; identical to SEQ ID NO: 253155

SEQ ID NO: 278219 - RNA, 62 nt, hsa; identical to SEQ ID NO: 253156

SEQ ID NO: 278220 - RNA, 62 nt, hsa; identical to SEQ ID NO: 253157

SEQ ID NO: 278221 - RNA, 62 nt, hsa; identical to SEQ ID NO: 253158

SEQ ID NO: 278222 - RNA, 62 nt, hsa; identical to SEQ ID NO: 253159

SEQ ID NO: 278223 - RNA, 62 nt, hsa; identical to SEQ ID NO: 253160

SEQ ID NO: 278224 - RNA, 62 nt, hsa; identical to SEQ ID NO: 253161

SEQ ID NO: 278225 - RNA, 62 nt, hsa; identical to SEQ ID NO: 253162

SEQ ID NO: 278226 - RNA, 62 nt, hsa; identical to SEQ ID NO: 253163

SEQ ID NO: 278227 - RNA, 62 nt, hsa; identical to SEQ ID NO: 253164

SEQ ID NO: 278228 - RNA, 62 nt, hsa; identical to SEQ ID NO: 253165

SEQ ID NO: 278229 - RNA, 62 nt, hsa; identical to SEQ ID NO: 253166

SEQ ID NO: 278230 - RNA, 62 nt, hsa; identical to SEQ ID NO: 253167

SEQ ID NO: 278231 - RNA, 62 nt, hsa; identical to SEQ ID NO: 253168

SEQ ID NO: 278232 - RNA, 53 nt, hsa; identical to SEQ ID NO: 103014

SEQ ID NO: 278233 - RNA, 62 nt, hsa; identical to SEQ ID NO: 253170

SEQ ID NO: 278234 - RNA, 62 nt, hsa; identical to SEQ ID NO: 253171

SEQ ID NO: 278235 - RNA, 62 nt, hsa; identical to SEQ ID NO: 253172

SEQ ID NO: 278236 - RNA, 62 nt, hsa; identical to SEQ ID NO: 253173

SEQ ID NO: 278237 - RNA, 62 nt, hsa; identical to SEQ ID NO: 253174

SEQ ID NO: 278238 - RNA, 62 nt, hsa; identical to SEQ ID NO: 253175

SEQ ID NO: 278239 - RNA, 62 nt, hsa; identical to SEQ ID NO: 253176

SEQ ID NO: 278240 - RNA, 62 nt, hsa; identical to SEQ ID NO: 253177

SEQ ID NO: 278241 - RNA, 62 nt, hsa; identical to SEQ ID NO: 253178

SEQ ID NO: 278242 - RNA, 62 nt, hsa; identical to SEQ ID NO: 253179

SEQ ID NO: 278243 - RNA, 62 nt, hsa; identical to SEQ ID NO: 253180

SEQ ID NO: 278244 - RNA, 62 nt, hsa; identical to SEQ ID NO: 253181

SEQ ID NO: 278245 - RNA, 62 nt, hsa; identical to SEQ ID NO: 253182

SEQ ID NO: 278246 - RNA, 62 nt, hsa; identical to SEQ ID NO: 253183

SEQ ID NO: 278247 - RNA, 62 nt, hsa; identical to SEQ ID NO: 253184

SEQ ID NO: 278248 - RNA, 62 nt, hsa; identical to SEQ ID NO: 253185

SEQ ID NO: 278249 - RNA, 62 nt, hsa; identical to SEQ ID NO: 253186

SEQ ID NO: 278250 - RNA, 62 nt, hsa; identical to SEQ ID NO: 253187

SEQ ID NO: 278251 - RNA, 62 nt, hsa; identical to SEQ ID NO: 253188

SEQ ID NO: 278252 - RNA, 62 nt, hsa; identical to SEQ ID NO: 253189

SEQ ID NO: 278253 - RNA, 62 nt, hsa; identical to SEQ ID NO: 253190

SEQ ID NO: 278254 - RNA, 62 nt, hsa; identical to SEQ ID NO: 253191

SEQ ID NO: 278255 - RNA, 62 nt, hsa; identical to SEQ ID NO: 253192

SEQ ID NO: 278256 - RNA, 62 nt, hsa; identical to SEQ ID NO: 253193

SEQ ID NO: 278257 - RNA, 62 nt, hsa; identical to SEQ ID NO: 253194

SEQ ID NO: 278258 - RNA, 62 nt, hsa; identical to SEQ ID NO: 253195

SEQ ID NO: 278259 - RNA, 62 nt, hsa; identical to SEQ ID NO: 253196

SEQ ID NO: 278260 - RNA, 62 nt, hsa; identical to SEQ ID NO: 253197

SEQ ID NO: 278261 - RNA, 62 nt, hsa; identical to SEQ ID NO: 253198

SEQ ID NO: 278262 - RNA, 62 nt, hsa; identical to SEQ ID NO: 253199

SEQ ID NO: 278263 - RNA, 62 nt, hsa; identical to SEQ ID NO: 253200

SEQ ID NO: 278264 - RNA, 62 nt, hsa; identical to SEQ ID NO: 253201

SEQ ID NO: 278265 - RNA, 62 nt, hsa; identical to SEQ ID NO: 253202

SEQ ID NO: 278266 - RNA, 62 nt, hsa; identical to SEQ ID NO: 253203

SEQ ID NO: 278267 - RNA, 62 nt, hsa; identical to SEQ ID NO: 253204

SEQ ID NO: 278268 - RNA, 62 nt, hsa; identical to SEQ ID NO: 253205

SEQ ID NO: 278269 - RNA, 62 nt, hsa; identical to SEQ ID NO: 253206

SEQ ID NO: 278270 - RNA, 62 nt, hsa; identical to SEQ ID NO: 253207

SEQ ID NO: 278271 - RNA, 62 nt, hsa; identical to SEQ ID NO: 253208

SEQ ID NO: 278272 - RNA, 62 nt, hsa; identical to SEQ ID NO: 253209

SEQ ID NO: 278273 - RNA, 62 nt, hsa; identical to SEQ ID NO: 253210

SEQ ID NO: 278274 - RNA, 62 nt, hsa; identical to SEQ ID NO: 253211

SEQ ID NO: 278275 - RNA, 62 nt, hsa; identical to SEQ ID NO: 253212

SEQ ID NO: 278276 - RNA, 62 nt, hsa; identical to SEQ ID NO: 253213

SEQ ID NO: 278277 - RNA, 62 nt, hsa; identical to SEQ ID NO: 253214

SEQ ID NO: 278278 - RNA, 62 nt, hsa; identical to SEQ ID NO: 253215

SEQ ID NO: 278279 - RNA, 62 nt, hsa; identical to SEQ ID NO: 253216

SEQ ID NO: 278280 - RNA, 62 nt, hsa; identical to SEQ ID NO: 253217

SEQ ID NO: 278281 - RNA, 62 nt, hsa; identical to SEQ ID NO: 253218

SEQ ID NO: 278282 - RNA, 62 nt, hsa; identical to SEQ ID NO: 253219

SEQ ID NO: 278283 - RNA, 62 nt, hsa; identical to SEQ ID NO: 253220

SEQ ID NO: 278284 - RNA, 62 nt, hsa; identical to SEQ ID NO: 253221

SEQ ID NO: 278285 - RNA, 62 nt, hsa; identical to SEQ ID NO: 253222

SEQ ID NO: 278286 - RNA, 62 nt, hsa; identical to SEQ ID NO: 253223

SEQ ID NO: 278287 - RNA, 62 nt, hsa; identical to SEQ ID NO: 253224

SEQ ID NO: 278288 - RNA, 62 nt, hsa; identical to SEQ ID NO: 253225

SEQ ID NO: 278289 - RNA, 62 nt, hsa; identical to SEQ ID NO: 253226

SEQ ID NO: 278290 - RNA, 62 nt, hsa; identical to SEQ ID NO: 253227

SEQ ID NO: 278291 - RNA, 62 nt, hsa; identical to SEQ ID NO: 253228

SEQ ID NO: 278292 - RNA, 62 nt, hsa; identical to SEQ ID NO: 253229

SEQ ID NO: 278293 - RNA, 62 nt, hsa; identical to SEQ ID NO: 253230

SEQ ID NO: 278294 - RNA, 62 nt, hsa; identical to SEQ ID NO: 253231

SEQ ID NO: 278295 - RNA, 62 nt, hsa; identical to SEQ ID NO: 253232

SEQ ID NO: 278296 - RNA, 62 nt, hsa; identical to SEQ ID NO: 253233

SEQ ID NO: 278297 - RNA, 62 nt, hsa; identical to SEQ ID NO: 253234

SEQ ID NO: 278298 - RNA, 62 nt, hsa; identical to SEQ ID NO: 253235

SEQ ID NO: 278299 - RNA, 62 nt, hsa; identical to SEQ ID NO: 253236

SEQ ID NO: 278300 - RNA, 62 nt, hsa; identical to SEQ ID NO: 253237

SEQ ID NO: 278301 - RNA, 62 nt, hsa; identical to SEQ ID NO: 253238

SEQ ID NO: 278302 - RNA, 62 nt, hsa; identical to SEQ ID NO: 253239

SEQ ID NO: 278303 - RNA, 62 nt, hsa; identical to SEQ ID NO: 253240

SEQ ID NO: 278304 - RNA, 62 nt, hsa; identical to SEQ ID NO: 253241

SEQ ID NO: 278305 - RNA, 62 nt, hsa; identical to SEQ ID NO: 253242

SEQ ID NO: 278306 - RNA, 62 nt, hsa; identical to SEQ ID NO: 253243

SEQ ID NO: 278307 - RNA, 62 nt, hsa; identical to SEQ ID NO: 253244

SEQ ID NO: 278308 - RNA, 62 nt, hsa; identical to SEQ ID NO: 253245

SEQ ID NO: 278309 - RNA, 62 nt, hsa; identical to SEQ ID NO: 253246

SEQ ID NO: 278310 - RNA, 62 nt, hsa; identical to SEQ ID NO: 253247

SEQ ID NO: 278311 - RNA, 62 nt, hsa; identical to SEQ ID NO: 253248

SEQ ID NO: 278312 - RNA, 62 nt, hsa; identical to SEQ ID NO: 253249

SEQ ID NO: 278313 - RNA, 62 nt, hsa; identical to SEQ ID NO: 253250

SEQ ID NO: 278314 - RNA, 62 nt, hsa; identical to SEQ ID NO: 253251

SEQ ID NO: 278315 - RNA, 62 nt, hsa; identical to SEQ ID NO: 253252

SEQ ID NO: 278316 - RNA, 60 nt, hsa; identical to SEQ ID NO: 103098

SEQ ID NO: 278317 - RNA, 62 nt, hsa; identical to SEQ ID NO: 253254

SEQ ID NO: 278318 - RNA, 62 nt, hsa; identical to SEQ ID NO: 253255

SEQ ID NO: 278319 - RNA, 62 nt, hsa; identical to SEQ ID NO: 253256

SEQ ID NO: 278320 - RNA, 62 nt, hsa; identical to SEQ ID NO: 253257

SEQ ID NO: 278321 - RNA, 62 nt, hsa; identical to SEQ ID NO: 253258

SEQ ID NO: 278322 - RNA, 62 nt, hsa; identical to SEQ ID NO: 253259

SEQ ID NO: 278323 - RNA, 62 nt, hsa; identical to SEQ ID NO: 253260

SEQ ID NO: 278324 - RNA, 62 nt, hsa; identical to SEQ ID NO: 253261

SEQ ID NO: 278325 - RNA, 62 nt, hsa; identical to SEQ ID NO: 253262

SEQ ID NO: 278326 - RNA, 62 nt, hsa; identical to SEQ ID NO: 253263

SEQ ID NO: 278327 - RNA, 62 nt, hsa; identical to SEQ ID NO: 253264

SEQ ID NO: 278328 - RNA, 62 nt, hsa; identical to SEQ ID NO: 253265

SEQ ID NO: 278329 - RNA, 62 nt, hsa; identical to SEQ ID NO: 253266

SEQ ID NO: 278330 - RNA, 62 nt, hsa; identical to SEQ ID NO: 253267

SEQ ID NO: 278331 - RNA, 62 nt, hsa; identical to SEQ ID NO: 253268

SEQ ID NO: 278332 - RNA, 62 nt, hsa; identical to SEQ ID NO: 253269

SEQ ID NO: 278333 - RNA, 62 nt, hsa; identical to SEQ ID NO: 253270

SEQ ID NO: 278334 - RNA, 62 nt, hsa; identical to SEQ ID NO: 253271

SEQ ID NO: 278335 - RNA, 62 nt, hsa; identical to SEQ ID NO: 253272

SEQ ID NO: 278336 - RNA, 62 nt, hsa; identical to SEQ ID NO: 253273

SEQ ID NO: 278337 - RNA, 62 nt, hsa; identical to SEQ ID NO: 253274

SEQ ID NO: 278338 - RNA, 62 nt, hsa; identical to SEQ ID NO: 253275

SEQ ID NO: 278339 - RNA, 62 nt, hsa; identical to SEQ ID NO: 253276

SEQ ID NO: 278340 - RNA, 62 nt, hsa; identical to SEQ ID NO: 253277

SEQ ID NO: 278341 - RNA, 62 nt, hsa; identical to SEQ ID NO: 253278

SEQ ID NO: 278342 - RNA, 62 nt, hsa; identical to SEQ ID NO: 253279

SEQ ID NO: 278343 - RNA, 62 nt, hsa; identical to SEQ ID NO: 253280

SEQ ID NO: 278344 - RNA, 62 nt, hsa; identical to SEQ ID NO: 253281

SEQ ID NO: 278345 - RNA, 62 nt, hsa; identical to SEQ ID NO: 253282

SEQ ID NO: 278346 - RNA, 62 nt, hsa; identical to SEQ ID NO: 253283

SEQ ID NO: 278347 - RNA, 62 nt, hsa; identical to SEQ ID NO: 253284

SEQ ID NO: 278348 - RNA, 62 nt, hsa; identical to SEQ ID NO: 253285

SEQ ID NO: 278349 - RNA, 62 nt, hsa; identical to SEQ ID NO: 253286

SEQ ID NO: 278350 - RNA, 62 nt, hsa; identical to SEQ ID NO: 253287

SEQ ID NO: 278351 - RNA, 62 nt, hsa; identical to SEQ ID NO: 253288

SEQ ID NO: 278352 - RNA, 62 nt, hsa; identical to SEQ ID NO: 253289

SEQ ID NO: 278353 - RNA, 62 nt, hsa; identical to SEQ ID NO: 253290

SEQ ID NO: 278354 - RNA, 62 nt, hsa; identical to SEQ ID NO: 253291

SEQ ID NO: 278355 - RNA, 62 nt, hsa; identical to SEQ ID NO: 253292

SEQ ID NO: 278356 - RNA, 62 nt, hsa; identical to SEQ ID NO: 253293

SEQ ID NO: 278357 - RNA, 62 nt, hsa; identical to SEQ ID NO: 253294

SEQ ID NO: 278358 - RNA, 62 nt, hsa; identical to SEQ ID NO: 253295

SEQ ID NO: 278359 - RNA, 62 nt, hsa; identical to SEQ ID NO: 253296

SEQ ID NO: 278360 - RNA, 62 nt, hsa; identical to SEQ ID NO: 253297

SEQ ID NO: 278361 - RNA, 62 nt, hsa; identical to SEQ ID NO: 253298

SEQ ID NO: 278362 - RNA, 62 nt, hsa; identical to SEQ ID NO: 253299

SEQ ID NO: 278363 - RNA, 62 nt, hsa; identical to SEQ ID NO: 253300

SEQ ID NO: 278364 - RNA, 62 nt, hsa; identical to SEQ ID NO: 253301

SEQ ID NO: 278365 - RNA, 62 nt, hsa; identical to SEQ ID NO: 253302

SEQ ID NO: 278366 - RNA, 62 nt, hsa; identical to SEQ ID NO: 253303

SEQ ID NO: 278367 - RNA, 62 nt, hsa; identical to SEQ ID NO: 253304

SEQ ID NO: 278368 - RNA, 62 nt, hsa; identical to SEQ ID NO: 253305

SEQ ID NO: 278369 - RNA, 62 nt, hsa; identical to SEQ ID NO: 253306

SEQ ID NO: 278370 - RNA, 62 nt, hsa; identical to SEQ ID NO: 253307

SEQ ID NO: 278371 - RNA, 62 nt, hsa; identical to SEQ ID NO: 253308

SEQ ID NO: 278372 - RNA, 62 nt, hsa; identical to SEQ ID NO: 253309

SEQ ID NO: 278373 - RNA, 62 nt, hsa; identical to SEQ ID NO: 253310

SEQ ID NO: 278374 - RNA, 62 nt, hsa; identical to SEQ ID NO: 253311

SEQ ID NO: 278375 - RNA, 62 nt, hsa; identical to SEQ ID NO: 253312

SEQ ID NO: 278376 - RNA, 62 nt, hsa; identical to SEQ ID NO: 253313

SEQ ID NO: 278377 - RNA, 62 nt, hsa; identical to SEQ ID NO: 253314

SEQ ID NO: 278378 - RNA, 62 nt, hsa; identical to SEQ ID NO: 253315

SEQ ID NO: 278379 - RNA, 62 nt, hsa; identical to SEQ ID NO: 253316

SEQ ID NO: 278380 - RNA, 62 nt, hsa; identical to SEQ ID NO: 253317

SEQ ID NO: 278381 - RNA, 62 nt, hsa; identical to SEQ ID NO: 253318

SEQ ID NO: 278382 - RNA, 62 nt, hsa; identical to SEQ ID NO: 253319

SEQ ID NO: 278383 - RNA, 62 nt, hsa; identical to SEQ ID NO: 253320

SEQ ID NO: 278384 - RNA, 62 nt, hsa; identical to SEQ ID NO: 253321

SEQ ID NO: 278385 - RNA, 62 nt, hsa; identical to SEQ ID NO: 253322

SEQ ID NO: 278386 - RNA, 62 nt, hsa; identical to SEQ ID NO: 253323

SEQ ID NO: 278387 - RNA, 62 nt, hsa; identical to SEQ ID NO: 253324

SEQ ID NO: 278388 - RNA, 62 nt, hsa; identical to SEQ ID NO: 253325

SEQ ID NO: 278389 - RNA, 62 nt, hsa; identical to SEQ ID NO: 253326

SEQ ID NO: 278390 - RNA, 62 nt, hsa; identical to SEQ ID NO: 253327

SEQ ID NO: 278391 - RNA, 62 nt, hsa; identical to SEQ ID NO: 253328

SEQ ID NO: 278392 - RNA, 62 nt, hsa; identical to SEQ ID NO: 253329

SEQ ID NO: 278393 - RNA, 62 nt, hsa; identical to SEQ ID NO: 253330

SEQ ID NO: 278394 - RNA, 62 nt, hsa; identical to SEQ ID NO: 253331

SEQ ID NO: 278395 - RNA, 62 nt, hsa; identical to SEQ ID NO: 253332

SEQ ID NO: 278396 - RNA, 62 nt, hsa; identical to SEQ ID NO: 253333

SEQ ID NO: 278397 - RNA, 62 nt, hsa; identical to SEQ ID NO: 253334

SEQ ID NO: 278398 - RNA, 62 nt, hsa; identical to SEQ ID NO: 253335

SEQ ID NO: 278399 - RNA, 62 nt, hsa; identical to SEQ ID NO: 253336

SEQ ID NO: 278400 - RNA, 62 nt, hsa; identical to SEQ ID NO: 253337

SEQ ID NO: 278401 - RNA, 62 nt, hsa; identical to SEQ ID NO: 253338

SEQ ID NO: 278402 - RNA, 62 nt, hsa; identical to SEQ ID NO: 253339

SEQ ID NO: 278403 - RNA, 62 nt, hsa; identical to SEQ ID NO: 253340

SEQ ID NO: 278404 - RNA, 62 nt, hsa; identical to SEQ ID NO: 253341

SEQ ID NO: 278405 - RNA, 62 nt, hsa; identical to SEQ ID NO: 253342

SEQ ID NO: 278406 - RNA, 62 nt, hsa; identical to SEQ ID NO: 253343

SEQ ID NO: 278407 - RNA, 62 nt, hsa; identical to SEQ ID NO: 253344

SEQ ID NO: 278408 - RNA, 62 nt, hsa; identical to SEQ ID NO: 253345

SEQ ID NO: 278409 - RNA, 62 nt, hsa; identical to SEQ ID NO: 253346

SEQ ID NO: 278410 - RNA, 62 nt, hsa; identical to SEQ ID NO: 253347

SEQ ID NO: 278411 - RNA, 62 nt, hsa; identical to SEQ ID NO: 253348

SEQ ID NO: 278412 - RNA, 62 nt, hsa; identical to SEQ ID NO: 253349

SEQ ID NO: 278413 - RNA, 62 nt, hsa; identical to SEQ ID NO: 253350

SEQ ID NO: 278414 - RNA, 51 nt, hsa; identical to SEQ ID NO: 103196

SEQ ID NO: 278415 - RNA, 62 nt, hsa; identical to SEQ ID NO: 253352

SEQ ID NO: 278416 - RNA, 62 nt, hsa; identical to SEQ ID NO: 253353

SEQ ID NO: 278417 - RNA, 62 nt, hsa; identical to SEQ ID NO: 253354

SEQ ID NO: 278418 - RNA, 62 nt, hsa; identical to SEQ ID NO: 253355

SEQ ID NO: 278419 - RNA, 62 nt, hsa; identical to SEQ ID NO: 253356

SEQ ID NO: 278420 - RNA, 62 nt, hsa; identical to SEQ ID NO: 253357

SEQ ID NO: 278421 - RNA, 62 nt, hsa; identical to SEQ ID NO: 253358

SEQ ID NO: 278422 - RNA, 62 nt, hsa; identical to SEQ ID NO: 253359

SEQ ID NO: 278423 - RNA, 62 nt, hsa; identical to SEQ ID NO: 253360

SEQ ID NO: 278424 - RNA, 62 nt, hsa; identical to SEQ ID NO: 253361

SEQ ID NO: 278425 - RNA, 62 nt, hsa; identical to SEQ ID NO: 253362

SEQ ID NO: 278426 - RNA, 62 nt, hsa; identical to SEQ ID NO: 253363

SEQ ID NO: 278427 - RNA, 62 nt, hsa; identical to SEQ ID NO: 253364

SEQ ID NO: 278428 - RNA, 62 nt, hsa; identical to SEQ ID NO: 253365

SEQ ID NO: 278429 - RNA, 62 nt, hsa; identical to SEQ ID NO: 253366

SEQ ID NO: 278430 - RNA, 62 nt, hsa; identical to SEQ ID NO: 253367

SEQ ID NO: 278431 - RNA, 62 nt, hsa; identical to SEQ ID NO: 253368

SEQ ID NO: 278432 - RNA, 62 nt, hsa; identical to SEQ ID NO: 253369

SEQ ID NO: 278433 - RNA, 62 nt, hsa; identical to SEQ ID NO: 253370

SEQ ID NO: 278434 - RNA, 62 nt, hsa; identical to SEQ ID NO: 253371

SEQ ID NO: 278435 - RNA, 62 nt, hsa; identical to SEQ ID NO: 253372

SEQ ID NO: 278436 - RNA, 62 nt, hsa; identical to SEQ ID NO: 253373

SEQ ID NO: 278437 - RNA, 62 nt, hsa; identical to SEQ ID NO: 253374

SEQ ID NO: 278438 - RNA, 62 nt, hsa; identical to SEQ ID NO: 253375

SEQ ID NO: 278439 - RNA, 62 nt, hsa; identical to SEQ ID NO: 253376

SEQ ID NO: 278440 - RNA, 62 nt, hsa; identical to SEQ ID NO: 253377

SEQ ID NO: 278441 - RNA, 62 nt, hsa; identical to SEQ ID NO: 253378

SEQ ID NO: 278442 - RNA, 62 nt, hsa; identical to SEQ ID NO: 253379

SEQ ID NO: 278443 - RNA, 62 nt, hsa; identical to SEQ ID NO: 253380

SEQ ID NO: 278444 - RNA, 62 nt, hsa; identical to SEQ ID NO: 253381

SEQ ID NO: 278445 - RNA, 62 nt, hsa; identical to SEQ ID NO: 253382

SEQ ID NO: 278446 - RNA, 62 nt, hsa; identical to SEQ ID NO: 253383

SEQ ID NO: 278447 - RNA, 62 nt, hsa; identical to SEQ ID NO: 253384

SEQ ID NO: 278448 - RNA, 62 nt, hsa; identical to SEQ ID NO: 253385

SEQ ID NO: 278449 - RNA, 62 nt, hsa; identical to SEQ ID NO: 253386

SEQ ID NO: 278450 - RNA, 62 nt, hsa; identical to SEQ ID NO: 253387

SEQ ID NO: 278451 - RNA, 62 nt, hsa; identical to SEQ ID NO: 253388

SEQ ID NO: 278452 - RNA, 62 nt, hsa; identical to SEQ ID NO: 253389

SEQ ID NO: 278453 - RNA, 62 nt, hsa; identical to SEQ ID NO: 253390

SEQ ID NO: 278454 - RNA, 62 nt, hsa; identical to SEQ ID NO: 253391

SEQ ID NO: 278455 - RNA, 62 nt, hsa; identical to SEQ ID NO: 253392

SEQ ID NO: 278456 - RNA, 62 nt, hsa; identical to SEQ ID NO: 253393

SEQ ID NO: 278457 - RNA, 62 nt, hsa; identical to SEQ ID NO: 253394

SEQ ID NO: 278458 - RNA, 62 nt, hsa; identical to SEQ ID NO: 253395

SEQ ID NO: 278459 - RNA, 62 nt, hsa; identical to SEQ ID NO: 253396

SEQ ID NO: 278460 - RNA, 62 nt, hsa; identical to SEQ ID NO: 253397

SEQ ID NO: 278461 - RNA, 62 nt, hsa; identical to SEQ ID NO: 253398

SEQ ID NO: 278462 - RNA, 62 nt, hsa; identical to SEQ ID NO: 253399

SEQ ID NO: 278463 - RNA, 62 nt, hsa; identical to SEQ ID NO: 253400

SEQ ID NO: 278464 - RNA, 62 nt, hsa; identical to SEQ ID NO: 253401

SEQ ID NO: 278465 - RNA, 62 nt, hsa; identical to SEQ ID NO: 253402

SEQ ID NO: 278466 - RNA, 62 nt, hsa; identical to SEQ ID NO: 253403

SEQ ID NO: 278467 - RNA, 62 nt, hsa; identical to SEQ ID NO: 253404

SEQ ID NO: 278468 - RNA, 62 nt, hsa; identical to SEQ ID NO: 253405

SEQ ID NO: 278469 - RNA, 62 nt, hsa; identical to SEQ ID NO: 253406

SEQ ID NO: 278470 - RNA, 62 nt, hsa; identical to SEQ ID NO: 253407

SEQ ID NO: 278471 - RNA, 62 nt, hsa; identical to SEQ ID NO: 253408

SEQ ID NO: 278472 - RNA, 62 nt, hsa; identical to SEQ ID NO: 253409

SEQ ID NO: 278473 - RNA, 62 nt, hsa; identical to SEQ ID NO: 253410

SEQ ID NO: 278474 - RNA, 62 nt, hsa; identical to SEQ ID NO: 253411

SEQ ID NO: 278475 - RNA, 62 nt, hsa; identical to SEQ ID NO: 253412

SEQ ID NO: 278476 - RNA, 62 nt, hsa; identical to SEQ ID NO: 253413

SEQ ID NO: 278477 - RNA, 62 nt, hsa; identical to SEQ ID NO: 253414

SEQ ID NO: 278478 - RNA, 62 nt, hsa; identical to SEQ ID NO: 253415

SEQ ID NO: 278479 - RNA, 62 nt, hsa; identical to SEQ ID NO: 253416

SEQ ID NO: 278480 - RNA, 62 nt, hsa; identical to SEQ ID NO: 253417

SEQ ID NO: 278481 - RNA, 62 nt, hsa; identical to SEQ ID NO: 253418

SEQ ID NO: 278482 - RNA, 62 nt, hsa; identical to SEQ ID NO: 253419

SEQ ID NO: 278483 - RNA, 62 nt, hsa; identical to SEQ ID NO: 253420

SEQ ID NO: 278484 - RNA, 62 nt, hsa; identical to SEQ ID NO: 253421

SEQ ID NO: 278485 - RNA, 62 nt, hsa; identical to SEQ ID NO: 253422

SEQ ID NO: 278486 - RNA, 62 nt, hsa; identical to SEQ ID NO: 253423

SEQ ID NO: 278487 - RNA, 62 nt, hsa; identical to SEQ ID NO: 253424

SEQ ID NO: 278488 - RNA, 62 nt, hsa; identical to SEQ ID NO: 253425

SEQ ID NO: 278489 - RNA, 62 nt, hsa; identical to SEQ ID NO: 253426

SEQ ID NO: 278490 - RNA, 62 nt, hsa; identical to SEQ ID NO: 253427

SEQ ID NO: 278491 - RNA, 62 nt, hsa; identical to SEQ ID NO: 253428

SEQ ID NO: 278492 - RNA, 62 nt, hsa; identical to SEQ ID NO: 253429

SEQ ID NO: 278493 - RNA, 62 nt, hsa; identical to SEQ ID NO: 253430

SEQ ID NO: 278494 - RNA, 62 nt, hsa; identical to SEQ ID NO: 253431

SEQ ID NO: 278495 - RNA, 62 nt, hsa; identical to SEQ ID NO: 253432

SEQ ID NO: 278496 - RNA, 62 nt, hsa; identical to SEQ ID NO: 253433

SEQ ID NO: 278497 - RNA, 62 nt, hsa; identical to SEQ ID NO: 253434

SEQ ID NO: 278498 - RNA, 62 nt, hsa; identical to SEQ ID NO: 253435

SEQ ID NO: 278499 - RNA, 62 nt, hsa; identical to SEQ ID NO: 253436

SEQ ID NO: 278500 - RNA, 62 nt, hsa; identical to SEQ ID NO: 253437

SEQ ID NO: 278501 - RNA, 62 nt, hsa; identical to SEQ ID NO: 253438

SEQ ID NO: 278502 - RNA, 62 nt, hsa; identical to SEQ ID NO: 253439

SEQ ID NO: 278503 - RNA, 62 nt, hsa; identical to SEQ ID NO: 253440

SEQ ID NO: 278504 - RNA, 62 nt, hsa; identical to SEQ ID NO: 253441

SEQ ID NO: 278505 - RNA, 62 nt, hsa; identical to SEQ ID NO: 253442

SEQ ID NO: 278506 - RNA, 62 nt, hsa; identical to SEQ ID NO: 253443

SEQ ID NO: 278507 - RNA, 66 nt, hsa; identical to SEQ ID NO: 253444

SEQ ID NO: 278508 - RNA, 66 nt, hsa; identical to SEQ ID NO: 253445

SEQ ID NO: 278509 - RNA, 66 nt, hsa; identical to SEQ ID NO: 253446

SEQ ID NO: 278510 - RNA, 66 nt, hsa; identical to SEQ ID NO: 253447

SEQ ID NO: 278511 - RNA, 66 nt, hsa; identical to SEQ ID NO: 253448

SEQ ID NO: 278512 - RNA, 66 nt, hsa; identical to SEQ ID NO: 253449

SEQ ID NO: 278513 - RNA, 66 nt, hsa; identical to SEQ ID NO: 253450

SEQ ID NO: 278514 - RNA, 66 nt, hsa; identical to SEQ ID NO: 253451

SEQ ID NO: 278515 - RNA, 66 nt, hsa; identical to SEQ ID NO: 253452

SEQ ID NO: 278516 - RNA, 66 nt, hsa; identical to SEQ ID NO: 253453

SEQ ID NO: 278517 - RNA, 66 nt, hsa; identical to SEQ ID NO: 253454

SEQ ID NO: 278518 - RNA, 58 nt, hsa; identical to SEQ ID NO: 102991

SEQ ID NO: 278519 - RNA, 66 nt, hsa; identical to SEQ ID NO: 253456

SEQ ID NO: 278520 - RNA, 66 nt, hsa; identical to SEQ ID NO: 253457

SEQ ID NO: 278521 - RNA, 66 nt, hsa; identical to SEQ ID NO: 253458

SEQ ID NO: 278522 - RNA, 66 nt, hsa; identical to SEQ ID NO: 253459

SEQ ID NO: 278523 - RNA, 66 nt, hsa; identical to SEQ ID NO: 253460

SEQ ID NO: 278524 - RNA, 66 nt, hsa; identical to SEQ ID NO: 253461

SEQ ID NO: 278525 - RNA, 66 nt, hsa; identical to SEQ ID NO: 253462

SEQ ID NO: 278526 - RNA, 66 nt, hsa; identical to SEQ ID NO: 253463

SEQ ID NO: 278527 - RNA, 66 nt, hsa; identical to SEQ ID NO: 253464

SEQ ID NO: 278528 - RNA, 66 nt, hsa; identical to SEQ ID NO: 253465

SEQ ID NO: 278529 - RNA, 66 nt, hsa; identical to SEQ ID NO: 253466

SEQ ID NO: 278530 - RNA, 66 nt, hsa; identical to SEQ ID NO: 253467

SEQ ID NO: 278531 - RNA, 66 nt, hsa; identical to SEQ ID NO: 253468

SEQ ID NO: 278532 - RNA, 66 nt, hsa; identical to SEQ ID NO: 253469

SEQ ID NO: 278533 - RNA, 66 nt, hsa; identical to SEQ ID NO: 253470

SEQ ID NO: 278534 - RNA, 66 nt, hsa; identical to SEQ ID NO: 253471

SEQ ID NO: 278535 - RNA, 66 nt, hsa; identical to SEQ ID NO: 253472

SEQ ID NO: 278536 - RNA, 66 nt, hsa; identical to SEQ ID NO: 253473

SEQ ID NO: 278537 - RNA, 66 nt, hsa; identical to SEQ ID NO: 253474

SEQ ID NO: 278538 - RNA, 66 nt, hsa; identical to SEQ ID NO: 253475

SEQ ID NO: 278539 - RNA, 66 nt, hsa; identical to SEQ ID NO: 253476

SEQ ID NO: 278540 - RNA, 66 nt, hsa; identical to SEQ ID NO: 253477

SEQ ID NO: 278541 - RNA, 53 nt, hsa; identical to SEQ ID NO: 103014

SEQ ID NO: 278542 - RNA, 66 nt, hsa; identical to SEQ ID NO: 253479

SEQ ID NO: 278543 - RNA, 66 nt, hsa; identical to SEQ ID NO: 253480

SEQ ID NO: 278544 - RNA, 66 nt, hsa; identical to SEQ ID NO: 253481

SEQ ID NO: 278545 - RNA, 66 nt, hsa; identical to SEQ ID NO: 253482

SEQ ID NO: 278546 - RNA, 66 nt, hsa; identical to SEQ ID NO: 253483

SEQ ID NO: 278547 - RNA, 66 nt, hsa; identical to SEQ ID NO: 253484

SEQ ID NO: 278548 - RNA, 66 nt, hsa; identical to SEQ ID NO: 253485

SEQ ID NO: 278549 - RNA, 66 nt, hsa; identical to SEQ ID NO: 253486

SEQ ID NO: 278550 - RNA, 66 nt, hsa; identical to SEQ ID NO: 253487

SEQ ID NO: 278551 - RNA, 66 nt, hsa; identical to SEQ ID NO: 253488

SEQ ID NO: 278552 - RNA, 66 nt, hsa; identical to SEQ ID NO: 253489

SEQ ID NO: 278553 - RNA, 66 nt, hsa; identical to SEQ ID NO: 253490

SEQ ID NO: 278554 - RNA, 66 nt, hsa; identical to SEQ ID NO: 253491

SEQ ID NO: 278555 - RNA, 66 nt, hsa; identical to SEQ ID NO: 253492

SEQ ID NO: 278556 - RNA, 66 nt, hsa; identical to SEQ ID NO: 253493

SEQ ID NO: 278557 - RNA, 66 nt, hsa; identical to SEQ ID NO: 253494

SEQ ID NO: 278558 - RNA, 66 nt, hsa; identical to SEQ ID NO: 253495

SEQ ID NO: 278559 - RNA, 66 nt, hsa; identical to SEQ ID NO: 253496

SEQ ID NO: 278560 - RNA, 66 nt, hsa; identical to SEQ ID NO: 253497

SEQ ID NO: 278561 - RNA, 66 nt, hsa; identical to SEQ ID NO: 253498

SEQ ID NO: 278562 - RNA, 66 nt, hsa; identical to SEQ ID NO: 253499

SEQ ID NO: 278563 - RNA, 66 nt, hsa; identical to SEQ ID NO: 253500

SEQ ID NO: 278564 - RNA, 66 nt, hsa; identical to SEQ ID NO: 253501

SEQ ID NO: 278565 - RNA, 66 nt, hsa; identical to SEQ ID NO: 253502

SEQ ID NO: 278566 - RNA, 66 nt, hsa; identical to SEQ ID NO: 253503

SEQ ID NO: 278567 - RNA, 66 nt, hsa; identical to SEQ ID NO: 253504

SEQ ID NO: 278568 - RNA, 66 nt, hsa; identical to SEQ ID NO: 253505

SEQ ID NO: 278569 - RNA, 66 nt, hsa; identical to SEQ ID NO: 253506

SEQ ID NO: 278570 - RNA, 66 nt, hsa; identical to SEQ ID NO: 253507

SEQ ID NO: 278571 - RNA, 66 nt, hsa; identical to SEQ ID NO: 253508

SEQ ID NO: 278572 - RNA, 66 nt, hsa; identical to SEQ ID NO: 253509

SEQ ID NO: 278573 - RNA, 66 nt, hsa; identical to SEQ ID NO: 253510

SEQ ID NO: 278574 - RNA, 66 nt, hsa; identical to SEQ ID NO: 253511

SEQ ID NO: 278575 - RNA, 66 nt, hsa; identical to SEQ ID NO: 253512

SEQ ID NO: 278576 - RNA, 66 nt, hsa; identical to SEQ ID NO: 253513

SEQ ID NO: 278577 - RNA, 66 nt, hsa; identical to SEQ ID NO: 253514

SEQ ID NO: 278578 - RNA, 66 nt, hsa; identical to SEQ ID NO: 253515

SEQ ID NO: 278579 - RNA, 66 nt, hsa; identical to SEQ ID NO: 253516

SEQ ID NO: 278580 - RNA, 66 nt, hsa; identical to SEQ ID NO: 253517

SEQ ID NO: 278581 - RNA, 66 nt, hsa; identical to SEQ ID NO: 253518

SEQ ID NO: 278582 - RNA, 66 nt, hsa; identical to SEQ ID NO: 253519

SEQ ID NO: 278583 - RNA, 66 nt, hsa; identical to SEQ ID NO: 253520

SEQ ID NO: 278584 - RNA, 66 nt, hsa; identical to SEQ ID NO: 253521

SEQ ID NO: 278585 - RNA, 66 nt, hsa; identical to SEQ ID NO: 253522

SEQ ID NO: 278586 - RNA, 66 nt, hsa; identical to SEQ ID NO: 253523

SEQ ID NO: 278587 - RNA, 66 nt, hsa; identical to SEQ ID NO: 253524

SEQ ID NO: 278588 - RNA, 66 nt, hsa; identical to SEQ ID NO: 253525

SEQ ID NO: 278589 - RNA, 66 nt, hsa; identical to SEQ ID NO: 253526

SEQ ID NO: 278590 - RNA, 66 nt, hsa; identical to SEQ ID NO: 253527

SEQ ID NO: 278591 - RNA, 66 nt, hsa; identical to SEQ ID NO: 253528

SEQ ID NO: 278592 - RNA, 66 nt, hsa; identical to SEQ ID NO: 253529

SEQ ID NO: 278593 - RNA, 66 nt, hsa; identical to SEQ ID NO: 253530

SEQ ID NO: 278594 - RNA, 66 nt, hsa; identical to SEQ ID NO: 253531

SEQ ID NO: 278595 - RNA, 66 nt, hsa; identical to SEQ ID NO: 253532

SEQ ID NO: 278596 - RNA, 66 nt, hsa; identical to SEQ ID NO: 253533

SEQ ID NO: 278597 - RNA, 66 nt, hsa; identical to SEQ ID NO: 253534

SEQ ID NO: 278598 - RNA, 66 nt, hsa; identical to SEQ ID NO: 253535

SEQ ID NO: 278599 - RNA, 66 nt, hsa; identical to SEQ ID NO: 253536

SEQ ID NO: 278600 - RNA, 66 nt, hsa; identical to SEQ ID NO: 253537

SEQ ID NO: 278601 - RNA, 66 nt, hsa; identical to SEQ ID NO: 253538

SEQ ID NO: 278602 - RNA, 66 nt, hsa; identical to SEQ ID NO: 253539

SEQ ID NO: 278603 - RNA, 66 nt, hsa; identical to SEQ ID NO: 253540

SEQ ID NO: 278604 - RNA, 66 nt, hsa; identical to SEQ ID NO: 253541

SEQ ID NO: 278605 - RNA, 66 nt, hsa; identical to SEQ ID NO: 253542

SEQ ID NO: 278606 - RNA, 66 nt, hsa; identical to SEQ ID NO: 253543

SEQ ID NO: 278607 - RNA, 66 nt, hsa; identical to SEQ ID NO: 253544

SEQ ID NO: 278608 - RNA, 66 nt, hsa; identical to SEQ ID NO: 253545

SEQ ID NO: 278609 - RNA, 66 nt, hsa; identical to SEQ ID NO: 253546

SEQ ID NO: 278610 - RNA, 66 nt, hsa; identical to SEQ ID NO: 253547

SEQ ID NO: 278611 - RNA, 66 nt, hsa; identical to SEQ ID NO: 253548

SEQ ID NO: 278612 - RNA, 66 nt, hsa; identical to SEQ ID NO: 253549

SEQ ID NO: 278613 - RNA, 66 nt, hsa; identical to SEQ ID NO: 253550

SEQ ID NO: 278614 - RNA, 66 nt, hsa; identical to SEQ ID NO: 253551

SEQ ID NO: 278615 - RNA, 66 nt, hsa; identical to SEQ ID NO: 253552

SEQ ID NO: 278616 - RNA, 66 nt, hsa; identical to SEQ ID NO: 253553

SEQ ID NO: 278617 - RNA, 66 nt, hsa; identical to SEQ ID NO: 253554

SEQ ID NO: 278618 - RNA, 66 nt, hsa; identical to SEQ ID NO: 253555

SEQ ID NO: 278619 - RNA, 66 nt, hsa; identical to SEQ ID NO: 253556

SEQ ID NO: 278620 - RNA, 66 nt, hsa; identical to SEQ ID NO: 253557

SEQ ID NO: 278621 - RNA, 66 nt, hsa; identical to SEQ ID NO: 253558

SEQ ID NO: 278622 - RNA, 66 nt, hsa; identical to SEQ ID NO: 253559

SEQ ID NO: 278623 - RNA, 66 nt, hsa; identical to SEQ ID NO: 253560

SEQ ID NO: 278624 - RNA, 66 nt, hsa; identical to SEQ ID NO: 253561

SEQ ID NO: 278625 - RNA, 60 nt, hsa; identical to SEQ ID NO: 103098

SEQ ID NO: 278626 - RNA, 66 nt, hsa; identical to SEQ ID NO: 253563

SEQ ID NO: 278627 - RNA, 66 nt, hsa; identical to SEQ ID NO: 253564

SEQ ID NO: 278628 - RNA, 66 nt, hsa; identical to SEQ ID NO: 253565

SEQ ID NO: 278629 - RNA, 66 nt, hsa; identical to SEQ ID NO: 253566

SEQ ID NO: 278630 - RNA, 66 nt, hsa; identical to SEQ ID NO: 253567

SEQ ID NO: 278631 - RNA, 66 nt, hsa; identical to SEQ ID NO: 253568

SEQ ID NO: 278632 - RNA, 66 nt, hsa; identical to SEQ ID NO: 253569

SEQ ID NO: 278633 - RNA, 66 nt, hsa; identical to SEQ ID NO: 253570

SEQ ID NO: 278634 - RNA, 66 nt, hsa; identical to SEQ ID NO: 253571

SEQ ID NO: 278635 - RNA, 66 nt, hsa; identical to SEQ ID NO: 253572

SEQ ID NO: 278636 - RNA, 66 nt, hsa; identical to SEQ ID NO: 253573

SEQ ID NO: 278637 - RNA, 66 nt, hsa; identical to SEQ ID NO: 253574

SEQ ID NO: 278638 - RNA, 66 nt, hsa; identical to SEQ ID NO: 253575

SEQ ID NO: 278639 - RNA, 66 nt, hsa; identical to SEQ ID NO: 253576

SEQ ID NO: 278640 - RNA, 66 nt, hsa; identical to SEQ ID NO: 253577

SEQ ID NO: 278641 - RNA, 66 nt, hsa; identical to SEQ ID NO: 253578

SEQ ID NO: 278642 - RNA, 66 nt, hsa; identical to SEQ ID NO: 253579

SEQ ID NO: 278643 - RNA, 66 nt, hsa; identical to SEQ ID NO: 253580

SEQ ID NO: 278644 - RNA, 66 nt, hsa; identical to SEQ ID NO: 253581

SEQ ID NO: 278645 - RNA, 66 nt, hsa; identical to SEQ ID NO: 253582

SEQ ID NO: 278646 - RNA, 66 nt, hsa; identical to SEQ ID NO: 253583

SEQ ID NO: 278647 - RNA, 66 nt, hsa; identical to SEQ ID NO: 253584

SEQ ID NO: 278648 - RNA, 66 nt, hsa; identical to SEQ ID NO: 253585

SEQ ID NO: 278649 - RNA, 66 nt, hsa; identical to SEQ ID NO: 253586

SEQ ID NO: 278650 - RNA, 66 nt, hsa; identical to SEQ ID NO: 253587

SEQ ID NO: 278651 - RNA, 66 nt, hsa; identical to SEQ ID NO: 253588

SEQ ID NO: 278652 - RNA, 66 nt, hsa; identical to SEQ ID NO: 253589

SEQ ID NO: 278653 - RNA, 66 nt, hsa; identical to SEQ ID NO: 253590

SEQ ID NO: 278654 - RNA, 66 nt, hsa; identical to SEQ ID NO: 253591

SEQ ID NO: 278655 - RNA, 66 nt, hsa; identical to SEQ ID NO: 253592

SEQ ID NO: 278656 - RNA, 66 nt, hsa; identical to SEQ ID NO: 253593

SEQ ID NO: 278657 - RNA, 66 nt, hsa; identical to SEQ ID NO: 253594

SEQ ID NO: 278658 - RNA, 66 nt, hsa; identical to SEQ ID NO: 253595

SEQ ID NO: 278659 - RNA, 66 nt, hsa; identical to SEQ ID NO: 253596

SEQ ID NO: 278660 - RNA, 66 nt, hsa; identical to SEQ ID NO: 253597

SEQ ID NO: 278661 - RNA, 66 nt, hsa; identical to SEQ ID NO: 253598

SEQ ID NO: 278662 - RNA, 66 nt, hsa; identical to SEQ ID NO: 253599

SEQ ID NO: 278663 - RNA, 66 nt, hsa; identical to SEQ ID NO: 253600

SEQ ID NO: 278664 - RNA, 66 nt, hsa; identical to SEQ ID NO: 253601

SEQ ID NO: 278665 - RNA, 66 nt, hsa; identical to SEQ ID NO: 253602

SEQ ID NO: 278666 - RNA, 66 nt, hsa; identical to SEQ ID NO: 253603

SEQ ID NO: 278667 - RNA, 66 nt, hsa; identical to SEQ ID NO: 253604

SEQ ID NO: 278668 - RNA, 66 nt, hsa; identical to SEQ ID NO: 253605

SEQ ID NO: 278669 - RNA, 66 nt, hsa; identical to SEQ ID NO: 253606

SEQ ID NO: 278670 - RNA, 66 nt, hsa; identical to SEQ ID NO: 253607

SEQ ID NO: 278671 - RNA, 66 nt, hsa; identical to SEQ ID NO: 253608

SEQ ID NO: 278672 - RNA, 66 nt, hsa; identical to SEQ ID NO: 253609

SEQ ID NO: 278673 - RNA, 66 nt, hsa; identical to SEQ ID NO: 253610

SEQ ID NO: 278674 - RNA, 66 nt, hsa; identical to SEQ ID NO: 253611

SEQ ID NO: 278675 - RNA, 66 nt, hsa; identical to SEQ ID NO: 253612

SEQ ID NO: 278676 - RNA, 66 nt, hsa; identical to SEQ ID NO: 253613

SEQ ID NO: 278677 - RNA, 66 nt, hsa; identical to SEQ ID NO: 253614

SEQ ID NO: 278678 - RNA, 66 nt, hsa; identical to SEQ ID NO: 253615

SEQ ID NO: 278679 - RNA, 66 nt, hsa; identical to SEQ ID NO: 253616

SEQ ID NO: 278680 - RNA, 66 nt, hsa; identical to SEQ ID NO: 253617

SEQ ID NO: 278681 - RNA, 66 nt, hsa; identical to SEQ ID NO: 253618

SEQ ID NO: 278682 - RNA, 66 nt, hsa; identical to SEQ ID NO: 253619

SEQ ID NO: 278683 - RNA, 66 nt, hsa; identical to SEQ ID NO: 253620

SEQ ID NO: 278684 - RNA, 66 nt, hsa; identical to SEQ ID NO: 253621

SEQ ID NO: 278685 - RNA, 66 nt, hsa; identical to SEQ ID NO: 253622

SEQ ID NO: 278686 - RNA, 66 nt, hsa; identical to SEQ ID NO: 253623

SEQ ID NO: 278687 - RNA, 66 nt, hsa; identical to SEQ ID NO: 253624

SEQ ID NO: 278688 - RNA, 66 nt, hsa; identical to SEQ ID NO: 253625

SEQ ID NO: 278689 - RNA, 66 nt, hsa; identical to SEQ ID NO: 253626

SEQ ID NO: 278690 - RNA, 66 nt, hsa; identical to SEQ ID NO: 253627

SEQ ID NO: 278691 - RNA, 66 nt, hsa; identical to SEQ ID NO: 253628

SEQ ID NO: 278692 - RNA, 66 nt, hsa; identical to SEQ ID NO: 253629

SEQ ID NO: 278693 - RNA, 66 nt, hsa; identical to SEQ ID NO: 253630

SEQ ID NO: 278694 - RNA, 66 nt, hsa; identical to SEQ ID NO: 253631

SEQ ID NO: 278695 - RNA, 66 nt, hsa; identical to SEQ ID NO: 253632

SEQ ID NO: 278696 - RNA, 66 nt, hsa; identical to SEQ ID NO: 253633

SEQ ID NO: 278697 - RNA, 66 nt, hsa; identical to SEQ ID NO: 253634

SEQ ID NO: 278698 - RNA, 66 nt, hsa; identical to SEQ ID NO: 253635

SEQ ID NO: 278699 - RNA, 66 nt, hsa; identical to SEQ ID NO: 253636

SEQ ID NO: 278700 - RNA, 66 nt, hsa; identical to SEQ ID NO: 253637

SEQ ID NO: 278701 - RNA, 66 nt, hsa; identical to SEQ ID NO: 253638

SEQ ID NO: 278702 - RNA, 66 nt, hsa; identical to SEQ ID NO: 253639

SEQ ID NO: 278703 - RNA, 66 nt, hsa; identical to SEQ ID NO: 253640

SEQ ID NO: 278704 - RNA, 66 nt, hsa; identical to SEQ ID NO: 253641

SEQ ID NO: 278705 - RNA, 66 nt, hsa; identical to SEQ ID NO: 253642

SEQ ID NO: 278706 - RNA, 66 nt, hsa; identical to SEQ ID NO: 253643

SEQ ID NO: 278707 - RNA, 66 nt, hsa; identical to SEQ ID NO: 253644

SEQ ID NO: 278708 - RNA, 66 nt, hsa; identical to SEQ ID NO: 253645

SEQ ID NO: 278709 - RNA, 66 nt, hsa; identical to SEQ ID NO: 253646

SEQ ID NO: 278710 - RNA, 66 nt, hsa; identical to SEQ ID NO: 253647

SEQ ID NO: 278711 - RNA, 66 nt, hsa; identical to SEQ ID NO: 253648

SEQ ID NO: 278712 - RNA, 66 nt, hsa; identical to SEQ ID NO: 253649

SEQ ID NO: 278713 - RNA, 66 nt, hsa; identical to SEQ ID NO: 253650

SEQ ID NO: 278714 - RNA, 66 nt, hsa; identical to SEQ ID NO: 253651

SEQ ID NO: 278715 - RNA, 66 nt, hsa; identical to SEQ ID NO: 253652

SEQ ID NO: 278716 - RNA, 66 nt, hsa; identical to SEQ ID NO: 253653

SEQ ID NO: 278717 - RNA, 66 nt, hsa; identical to SEQ ID NO: 253654

SEQ ID NO: 278718 - RNA, 66 nt, hsa; identical to SEQ ID NO: 253655

SEQ ID NO: 278719 - RNA, 66 nt, hsa; identical to SEQ ID NO: 253656

SEQ ID NO: 278720 - RNA, 66 nt, hsa; identical to SEQ ID NO: 253657

SEQ ID NO: 278721 - RNA, 66 nt, hsa; identical to SEQ ID NO: 253658

SEQ ID NO: 278722 - RNA, 63 nt, hsa; identical to SEQ ID NO: 103195

SEQ ID NO: 278723 - RNA, 51 nt, hsa; identical to SEQ ID NO: 103196

SEQ ID NO: 278724 - RNA, 66 nt, hsa; identical to SEQ ID NO: 253661

SEQ ID NO: 278725 - RNA, 66 nt, hsa; identical to SEQ ID NO: 253662

SEQ ID NO: 278726 - RNA, 66 nt, hsa; identical to SEQ ID NO: 253663

SEQ ID NO: 278727 - RNA, 66 nt, hsa; identical to SEQ ID NO: 253664

SEQ ID NO: 278728 - RNA, 66 nt, hsa; identical to SEQ ID NO: 253665

SEQ ID NO: 278729 - RNA, 66 nt, hsa; identical to SEQ ID NO: 253666

SEQ ID NO: 278730 - RNA, 66 nt, hsa; identical to SEQ ID NO: 253667

SEQ ID NO: 278731 - RNA, 66 nt, hsa; identical to SEQ ID NO: 253668

SEQ ID NO: 278732 - RNA, 66 nt, hsa; identical to SEQ ID NO: 253669

SEQ ID NO: 278733 - RNA, 66 nt, hsa; identical to SEQ ID NO: 253670

SEQ ID NO: 278734 - RNA, 66 nt, hsa; identical to SEQ ID NO: 253671

SEQ ID NO: 278735 - RNA, 66 nt, hsa; identical to SEQ ID NO: 253672

SEQ ID NO: 278736 - RNA, 66 nt, hsa; identical to SEQ ID NO: 253673

SEQ ID NO: 278737 - RNA, 66 nt, hsa; identical to SEQ ID NO: 253674

SEQ ID NO: 278738 - RNA, 66 nt, hsa; identical to SEQ ID NO: 253675

SEQ ID NO: 278739 - RNA, 66 nt, hsa; identical to SEQ ID NO: 253676

SEQ ID NO: 278740 - RNA, 66 nt, hsa; identical to SEQ ID NO: 253677

SEQ ID NO: 278741 - RNA, 66 nt, hsa; identical to SEQ ID NO: 253678

SEQ ID NO: 278742 - RNA, 66 nt, hsa; identical to SEQ ID NO: 253679

SEQ ID NO: 278743 - RNA, 66 nt, hsa; identical to SEQ ID NO: 253680

SEQ ID NO: 278744 - RNA, 66 nt, hsa; identical to SEQ ID NO: 253681

SEQ ID NO: 278745 - RNA, 66 nt, hsa; identical to SEQ ID NO: 253682

SEQ ID NO: 278746 - RNA, 66 nt, hsa; identical to SEQ ID NO: 253683

SEQ ID NO: 278747 - RNA, 66 nt, hsa; identical to SEQ ID NO: 253684

SEQ ID NO: 278748 - RNA, 66 nt, hsa; identical to SEQ ID NO: 253685

SEQ ID NO: 278749 - RNA, 66 nt, hsa; identical to SEQ ID NO: 253686

SEQ ID NO: 278750 - RNA, 66 nt, hsa; identical to SEQ ID NO: 253687

SEQ ID NO: 278751 - RNA, 66 nt, hsa; identical to SEQ ID NO: 253688

SEQ ID NO: 278752 - RNA, 66 nt, hsa; identical to SEQ ID NO: 253689

SEQ ID NO: 278753 - RNA, 66 nt, hsa; identical to SEQ ID NO: 253690

SEQ ID NO: 278754 - RNA, 66 nt, hsa; identical to SEQ ID NO: 253691

SEQ ID NO: 278755 - RNA, 66 nt, hsa; identical to SEQ ID NO: 253692

SEQ ID NO: 278756 - RNA, 66 nt, hsa; identical to SEQ ID NO: 253693

SEQ ID NO: 278757 - RNA, 66 nt, hsa; identical to SEQ ID NO: 253694

SEQ ID NO: 278758 - RNA, 66 nt, hsa; identical to SEQ ID NO: 253695

SEQ ID NO: 278759 - RNA, 66 nt, hsa; identical to SEQ ID NO: 253696

SEQ ID NO: 278760 - RNA, 66 nt, hsa; identical to SEQ ID NO: 253697

SEQ ID NO: 278761 - RNA, 66 nt, hsa; identical to SEQ ID NO: 253698

SEQ ID NO: 278762 - RNA, 66 nt, hsa; identical to SEQ ID NO: 253699

SEQ ID NO: 278763 - RNA, 66 nt, hsa; identical to SEQ ID NO: 253700

SEQ ID NO: 278764 - RNA, 66 nt, hsa; identical to SEQ ID NO: 253701

SEQ ID NO: 278765 - RNA, 66 nt, hsa; identical to SEQ ID NO: 253702

SEQ ID NO: 278766 - RNA, 66 nt, hsa; identical to SEQ ID NO: 253703

SEQ ID NO: 278767 - RNA, 66 nt, hsa; identical to SEQ ID NO: 253704

SEQ ID NO: 278768 - RNA, 66 nt, hsa; identical to SEQ ID NO: 253705

SEQ ID NO: 278769 - RNA, 66 nt, hsa; identical to SEQ ID NO: 253706

SEQ ID NO: 278770 - RNA, 66 nt, hsa; identical to SEQ ID NO: 253707

SEQ ID NO: 278771 - RNA, 66 nt, hsa; identical to SEQ ID NO: 253708

SEQ ID NO: 278772 - RNA, 66 nt, hsa; identical to SEQ ID NO: 253709

SEQ ID NO: 278773 - RNA, 66 nt, hsa; identical to SEQ ID NO: 253710

SEQ ID NO: 278774 - RNA, 66 nt, hsa; identical to SEQ ID NO: 253711

SEQ ID NO: 278775 - RNA, 66 nt, hsa; identical to SEQ ID NO: 253712

SEQ ID NO: 278776 - RNA, 66 nt, hsa; identical to SEQ ID NO: 253713

SEQ ID NO: 278777 - RNA, 66 nt, hsa; identical to SEQ ID NO: 253714

SEQ ID NO: 278778 - RNA, 66 nt, hsa; identical to SEQ ID NO: 253715

SEQ ID NO: 278779 - RNA, 66 nt, hsa; identical to SEQ ID NO: 253716

SEQ ID NO: 278780 - RNA, 66 nt, hsa; identical to SEQ ID NO: 253717

SEQ ID NO: 278781 - RNA, 66 nt, hsa; identical to SEQ ID NO: 253718

SEQ ID NO: 278782 - RNA, 66 nt, hsa; identical to SEQ ID NO: 253719

SEQ ID NO: 278783 - RNA, 66 nt, hsa; identical to SEQ ID NO: 253720

SEQ ID NO: 278784 - RNA, 66 nt, hsa; identical to SEQ ID NO: 253721

SEQ ID NO: 278785 - RNA, 66 nt, hsa; identical to SEQ ID NO: 253722

SEQ ID NO: 278786 - RNA, 66 nt, hsa; identical to SEQ ID NO: 253723

SEQ ID NO: 278787 - RNA, 66 nt, hsa; identical to SEQ ID NO: 253724

SEQ ID NO: 278788 - RNA, 66 nt, hsa; identical to SEQ ID NO: 253725

SEQ ID NO: 278789 - RNA, 66 nt, hsa; identical to SEQ ID NO: 253726

SEQ ID NO: 278790 - RNA, 66 nt, hsa; identical to SEQ ID NO: 253727

SEQ ID NO: 278791 - RNA, 66 nt, hsa; identical to SEQ ID NO: 253728

SEQ ID NO: 278792 - RNA, 66 nt, hsa; identical to SEQ ID NO: 253729

SEQ ID NO: 278793 - RNA, 66 nt, hsa; identical to SEQ ID NO: 253730

SEQ ID NO: 278794 - RNA, 66 nt, hsa; identical to SEQ ID NO: 253731

SEQ ID NO: 278795 - RNA, 66 nt, hsa; identical to SEQ ID NO: 253732

SEQ ID NO: 278796 - RNA, 66 nt, hsa; identical to SEQ ID NO: 253733

SEQ ID NO: 278797 - RNA, 66 nt, hsa; identical to SEQ ID NO: 253734

SEQ ID NO: 278798 - RNA, 66 nt, hsa; identical to SEQ ID NO: 253735

SEQ ID NO: 278799 - RNA, 66 nt, hsa; identical to SEQ ID NO: 253736

SEQ ID NO: 278800 - RNA, 66 nt, hsa; identical to SEQ ID NO: 253737

SEQ ID NO: 278801 - RNA, 66 nt, hsa; identical to SEQ ID NO: 253738

SEQ ID NO: 278802 - RNA, 66 nt, hsa; identical to SEQ ID NO: 253739

SEQ ID NO: 278803 - RNA, 66 nt, hsa; identical to SEQ ID NO: 253740

SEQ ID NO: 278804 - RNA, 66 nt, hsa; identical to SEQ ID NO: 253741

SEQ ID NO: 278805 - RNA, 66 nt, hsa; identical to SEQ ID NO: 253742

SEQ ID NO: 278806 - RNA, 66 nt, hsa; identical to SEQ ID NO: 253743

SEQ ID NO: 278807 - RNA, 66 nt, hsa; identical to SEQ ID NO: 253744

SEQ ID NO: 278808 - RNA, 66 nt, hsa; identical to SEQ ID NO: 253745

SEQ ID NO: 278809 - RNA, 66 nt, hsa; identical to SEQ ID NO: 253746

SEQ ID NO: 278810 - RNA, 66 nt, hsa; identical to SEQ ID NO: 253747

SEQ ID NO: 278811 - RNA, 66 nt, hsa; identical to SEQ ID NO: 253748

SEQ ID NO: 278812 - RNA, 66 nt, hsa; identical to SEQ ID NO: 253749

SEQ ID NO: 278813 - RNA, 66 nt, hsa; identical to SEQ ID NO: 253750

SEQ ID NO: 278814 - RNA, 66 nt, hsa; identical to SEQ ID NO: 253751

SEQ ID NO: 278815 - RNA, 66 nt, hsa; identical to SEQ ID NO: 253752

SEQ ID NO: 278816 - RNA, 62 nt, hsa
acucuuaaguguaaauaauauaaaauguuucaagcgcuuaacucccccucauucacaaagua

SEQ ID NO: 278817 - RNA, 62 nt, hsa
gacaguaaauaucagaauuuuaugguuugaccagcgcuuaucacauucccaauucagugaga

SEQ ID NO: 278818 - RNA, 62 nt, hsa
guuuuuauaaaagcaaaaggauauucacuuucagcgcuuauacugaaguauuagauuaaagc

SEQ ID NO: 278819 - RNA, 62 nt, hsa
aauuaaaugggggcucuuacugacuuuaaauuagcgcuuauaaaauaaaaauguuuaguuca

SEQ ID NO: 278820 - RNA, 62 nt, hsa
gaguauaaagcagcugucacacuucaaagagcagcgcuuaaauuccuagcgaagugccguaa

SEQ ID NO: 278821 - RNA, 62 nt, hsa
cagucugaaggauuccccaccuccaaucccccagcgcuuagaaacauguuccuguuccucgg

SEQ ID NO: 278822 - RNA, 50 nt, hsa; identical to SEQ ID NO: 57621

SEQ ID NO: 278823 - RNA, 62 nt, hsa
uaugugaaguacuguguugcagaaguggcaaaagcgcuuauuuuuaaaaaugcaaaauauuu

SEQ ID NO: 278824 - RNA, 62 nt, hsa
caaguucccaucacgucagauuuggagcugguagcgcuuacgaugcccccacgugugaacau

SEQ ID NO: 278825 - RNA, 62 nt, hsa
ggugagggucagaaggggacgguaccaagaguagcgcuuagcccuuacccaggaaauauccu

SEQ ID NO: 278826 - RNA, 62 nt, hsa
ggaggcaagaaagcauuuccuuugggguuuagagcgcuuaaguuguuccucuguuaucaugc

SEQ ID NO: 278827 - RNA, 62 nt, hsa
gaguaaaagucuaccccucugaagcacuauuaagcgcuuaacguauauuuaaauacuaccau

SEQ ID NO: 278828 - RNA, 62 nt, hsa
ucauuuguggcaauuaaguggucccaaugcucagcgcuuaaaaaaacaaauuggacagcuac

SEQ ID NO: 278829 - RNA, 62 nt, hsa
cuaaaaugccagguaaaggguugguuggacacagcgcuuagugcacgcugucaucauggaca

SEQ ID NO: 278830 - RNA, 62 nt, hsa
acuuaagccuagaauuucucuuuagguauaucagcgcuuaaauccaagacuauuuuuuauug

SEQ ID NO: 278831 - RNA, 62 nt, hsa
ugagcauuguauuucucgcaucccuucucgugagcgcuuagaccuuuuucuauuuuagucgg

SEQ ID NO: 278832 - RNA, 62 nt, hsa
gcacugcucgagacacaagugcugcuguaguuagcgcuuagugacacgcgggccuuuggugg

SEQ ID NO: 278833 - RNA, 62 nt, hsa
auguuuuucuugaauagguauugauaaauggaagcgcuuaccagcccagcuuugccagcccu

SEQ ID NO: 278834 - RNA, 62 nt, hsa
cuggcuugcacuuucuuauuuucuuauuuuagagcgcuuaaaaaauccggaaaaaugggguu

SEQ ID NO: 278835 - RNA, 63 nt, hsa; identical to SEQ ID NO: 57615

SEQ ID NO: 278836 - RNA, 63 nt, hsa; identical to SEQ ID NO: 57616

SEQ ID NO: 278837 - RNA, 63 nt, hsa; identical to SEQ ID NO: 57617

SEQ ID NO: 278838 - RNA, 63 nt, hsa; identical to SEQ ID NO: 57618

SEQ ID NO: 278839 - RNA, 63 nt, hsa; identical to SEQ ID NO: 57619

SEQ ID NO: 278840 - RNA, 63 nt, hsa; identical to SEQ ID NO: 57620

SEQ ID NO: 278841 - RNA, 50 nt, hsa; identical to SEQ ID NO: 57621

SEQ ID NO: 278842 - RNA, 63 nt, hsa; identical to SEQ ID NO: 57622

SEQ ID NO: 278843 - RNA, 63 nt, hsa; identical to SEQ ID NO: 57623

SEQ ID NO: 278844 - RNA, 63 nt, hsa; identical to SEQ ID NO: 57624

SEQ ID NO: 278845 - RNA, 63 nt, hsa; identical to SEQ ID NO: 57625

SEQ ID NO: 278846 - RNA, 63 nt, hsa; identical to SEQ ID NO: 57626

SEQ ID NO: 278847 - RNA, 63 nt, hsa; identical to SEQ ID NO: 57627

SEQ ID NO: 278848 - RNA, 63 nt, hsa; identical to SEQ ID NO: 57628

SEQ ID NO: 278849 - RNA, 63 nt, hsa; identical to SEQ ID NO: 57629

SEQ ID NO: 278850 - RNA, 63 nt, hsa; identical to SEQ ID NO: 57630

SEQ ID NO: 278851 - RNA, 63 nt, hsa; identical to SEQ ID NO: 57631

SEQ ID NO: 278852 - RNA, 63 nt, hsa; identical to SEQ ID NO: 57632

SEQ ID NO: 278853 - RNA, 63 nt, hsa; identical to SEQ ID NO: 57633

SEQ ID NO: 278854 - RNA, 64 nt, hsa; identical to SEQ ID NO: 194820

SEQ ID NO: 278855 - RNA, 64 nt, hsa; identical to SEQ ID NO: 194821

SEQ ID NO: 278856 - RNA, 64 nt, hsa; identical to SEQ ID NO: 194822

SEQ ID NO: 278857 - RNA, 64 nt, hsa; identical to SEQ ID NO: 194823

SEQ ID NO: 278858 - RNA, 64 nt, hsa; identical to SEQ ID NO: 194824

SEQ ID NO: 278859 - RNA, 64 nt, hsa; identical to SEQ ID NO: 194825

SEQ ID NO: 278860 - RNA, 50 nt, hsa; identical to SEQ ID NO: 57621

SEQ ID NO: 278861 - RNA, 64 nt, hsa; identical to SEQ ID NO: 194827

SEQ ID NO: 278862 - RNA, 64 nt, hsa; identical to SEQ ID NO: 194828

SEQ ID NO: 278863 - RNA, 64 nt, hsa; identical to SEQ ID NO: 194829

SEQ ID NO: 278864 - RNA, 64 nt, hsa; identical to SEQ ID NO: 194830

SEQ ID NO: 278865 - RNA, 64 nt, hsa; identical to SEQ ID NO: 194831

SEQ ID NO: 278866 - RNA, 64 nt, hsa; identical to SEQ ID NO: 194832

SEQ ID NO: 278867 - RNA, 64 nt, hsa; identical to SEQ ID NO: 194833

SEQ ID NO: 278868 - RNA, 64 nt, hsa; identical to SEQ ID NO: 194834

SEQ ID NO: 278869 - RNA, 64 nt, hsa; identical to SEQ ID NO: 194835

SEQ ID NO: 278870 - RNA, 64 nt, hsa; identical to SEQ ID NO: 194836

SEQ ID NO: 278871 - RNA, 64 nt, hsa; identical to SEQ ID NO: 194837

SEQ ID NO: 278872 - RNA, 64 nt, hsa; identical to SEQ ID NO: 194838

SEQ ID NO: 278873 - RNA, 62 nt, hsa
agauggcaugugaaagcacuuugaaaauuguaaagcgcuauguaaauguaagguauuauaga

SEQ ID NO: 278874 - RNA, 62 nt, hsa
gugcuguguuuugguuguggucugaagcuuugaagcgcuacuuagcaucuccuuucuuccau

SEQ ID NO: 278875 - RNA, 62 nt, hsa
uggacgccgacccuguuguggacagcucucagaagcgcuaccgggccgccagugccuucuuc

SEQ ID NO: 278876 - RNA, 62 nt, hsa
ccccuccacacacaaaacaggaaacauaaucaaagcgcuagucagcuagucuaaccacuagg

SEQ ID NO: 278877 - RNA, 62 nt, hsa
auuaauuuugccuuuuuuuuuuuuuuuuuuuuaagcgcuacuaauguagagaaugaauugaa

SEQ ID NO: 278878 - RNA, 62 nt, hsa
cagaaauuuggguaauguuugaguagauugccaagcgcuacugugauucaugaaugaauuuc

SEQ ID NO: 278879 - RNA, 62 nt, hsa
caaucucuuuguguucagaacucguuaaagcaaagcgcuaaguaaaaauauuaacugacgaa

SEQ ID NO: 278880 - RNA, 62 nt, hsa
cacuuauuacccuucugcagcaaaggcauuaaaagcgcuaagcauauauuaauaaaugcaag

SEQ ID NO: 278881 - RNA, 62 nt, hsa
ucucccaugaagaaagggaacggugaaguacuaagcgcuagaggaagcagccaagucgguua

SEQ ID NO: 278882 - RNA, 62 nt, hsa
uaaaggacucagcaaccagccagggacagauaaagcgcuauggaaaggggcuuccaaguucu

SEQ ID NO: 278883 - RNA, 62 nt, hsa
aaauguuuacaauuuuauaugaaagauggaauaagcgcuagagcuuccaacuguauauuuuu

SEQ ID NO: 278884 - RNA, 62 nt, hsa
accagcuccaaguaaacuaguuaccuggguaaaagcgcuaacgacccaaaggcucuucuaag

SEQ ID NO: 278885 - RNA, 62 nt, hsa
cuaaagaaagcuuguuggaaugcagucuacaaaagcgcuauaagggcuaaaggauuauagua

SEQ ID NO: 278886 - RNA, 62 nt, hsa
agcaucagcaauagauuucaaagauaaguauuaagcgcuacccuaaaguguguaaguuuuuc

SEQ ID NO: 278887 - RNA, 62 nt, hsa
gccugcggagccucaagaagccagaccgcaagaagcgcuacaccguggugggcaaccccuac

SEQ ID NO: 278888 - RNA, 62 nt, hsa
uucugcaaauguaauugauuuauuuguuuaaaaagcgcuaauuucuauuugaucugauauca

SEQ ID NO: 278889 - RNA, 62 nt, hsa
uuugcucuugauuuaaaaaaaaguuuuguugaaagcgcuauugaauauugcaaucuauauag

SEQ ID NO: 278890 - RNA, 62 nt, hsa
acaccgcuucauugaugaggacaggagacuccaagcgcuaguauugcacgcugcacuuaaug

SEQ ID NO: 278891 - RNA, 62 nt, hsa
agaaagaugucaacaaggaaaagaggagagccaagcgcuagcaugccuuuugccucugcaua

SEQ ID NO: 278892 - RNA, 62 nt, hsa
uuuuguuuugucuuucuaccugauguguauucaagcgcuauaacacguauuuccuugacaaa

SEQ ID NO: 278893 - RNA, 62 nt, hsa
caggcuuuuaaaaaaauaccacugugagaauaaagcgcuagcaagauacaucacuuacugau

SEQ ID NO: 278894 - RNA, 62 nt, hsa
acuccgaguucuauaaaaaccucaccuccaucaagcgcuaugauggggacaucacugaccug

SEQ ID NO: 278895 - RNA, 62 nt, hsa
gcuucaagagauccacccaccucagccucccaaagcgcuaggauuacaaguaugagacuuug

SEQ ID NO: 278896 - RNA, 62 nt, hsa
uuauaaagaacgugauuuccagugaucucuggaagcgcuaaagcuaaaauuucuguucuuga

SEQ ID NO: 278897 - RNA, 62 nt, hsa
guaagaacuguuaauaaaaguugucaaguaaaaagcgcuauaucuaaaaagacuuuaugaac

SEQ ID NO: 278898 - RNA, 62 nt, hsa
ugcccaugaccugaaggcuccagguggcuuuaaagcgcuauguuuaccaacuaucccggugu

SEQ ID NO: 278899 - RNA, 62 nt, hsa
aaaacgugcuuuucggcaaagcccugaaccccaagcgcuaccagcagacucuggaggccugu

SEQ ID NO: 278900 - RNA, 62 nt, hsa
ggccucaggaaucaacuuaggcaguucccaacaagcgcuagccuguaauuguagcuuuccac

SEQ ID NO: 278901 - RNA, 62 nt, hsa
cuuuucaauucccuucugguucaugaugcauaaagcgcuaggcccuagaacuccagaaacag

SEQ ID NO: 278902 - RNA, 62 nt, hsa
gucuuaagcaaucuuccugcuuuggccucccaaagcgcuaggauuccaggugugagcuacug

SEQ ID NO: 278903 - RNA, 62 nt, hsa
ggaguggggagggcguggagacagucuacggaaagcgcuagcagacccccgagagggugcag

SEQ ID NO: 278904 - RNA, 62 nt, hsa
auuguguccacauaauccacgcucaucuugcaaagcgcuauuucaggcacaucauuggaaua

SEQ ID NO: 278905 - RNA, 62 nt, hsa
cccagcgcgcagucuccaccucggccccagcaaagcgcuaagcagccggagagacagccagg

SEQ ID NO: 278906 - RNA, 62 nt, hsa
ugacugugcccauuccugcauggaccuuucccaagcgcuagcacaggugcaaaauccaucag

SEQ ID NO: 278907 - RNA, 62 nt, hsa
ggcucaugcaauccuccugccuuggccucccaaagcgcuaggauuagaggugugagccgcug

SEQ ID NO: 278908 - RNA, 62 nt, hsa; identical to SEQ ID NO: 253135

SEQ ID NO: 278909 - RNA, 62 nt, hsa; identical to SEQ ID NO: 253136

SEQ ID NO: 278910 - RNA, 62 nt, hsa; identical to SEQ ID NO: 253137

SEQ ID NO: 278911 - RNA, 62 nt, hsa; identical to SEQ ID NO: 253138

SEQ ID NO: 278912 - RNA, 62 nt, hsa; identical to SEQ ID NO: 253139

SEQ ID NO: 278913 - RNA, 62 nt, hsa; identical to SEQ ID NO: 253140

SEQ ID NO: 278914 - RNA, 62 nt, hsa; identical to SEQ ID NO: 253141

SEQ ID NO: 278915 - RNA, 62 nt, hsa; identical to SEQ ID NO: 253142

SEQ ID NO: 278916 - RNA, 62 nt, hsa; identical to SEQ ID NO: 253143

SEQ ID NO: 278917 - RNA, 62 nt, hsa; identical to SEQ ID NO: 253144

SEQ ID NO: 278918 - RNA, 62 nt, hsa; identical to SEQ ID NO: 253145

SEQ ID NO: 278919 - RNA, 58 nt, hsa; identical to SEQ ID NO: 102991

SEQ ID NO: 278920 - RNA, 62 nt, hsa; identical to SEQ ID NO: 253147

SEQ ID NO: 278921 - RNA, 62 nt, hsa; identical to SEQ ID NO: 253148

SEQ ID NO: 278922 - RNA, 62 nt, hsa; identical to SEQ ID NO: 253149

SEQ ID NO: 278923 - RNA, 62 nt, hsa; identical to SEQ ID NO: 253150

SEQ ID NO: 278924 - RNA, 62 nt, hsa; identical to SEQ ID NO: 253151

SEQ ID NO: 278925 - RNA, 62 nt, hsa; identical to SEQ ID NO: 253152

SEQ ID NO: 278926 - RNA, 62 nt, hsa; identical to SEQ ID NO: 253153

SEQ ID NO: 278927 - RNA, 62 nt, hsa; identical to SEQ ID NO: 253154

SEQ ID NO: 278928 - RNA, 62 nt, hsa; identical to SEQ ID NO: 253155

SEQ ID NO: 278929 - RNA, 62 nt, hsa; identical to SEQ ID NO: 253156

SEQ ID NO: 278930 - RNA, 62 nt, hsa; identical to SEQ ID NO: 253157

SEQ ID NO: 278931 - RNA, 62 nt, hsa; identical to SEQ ID NO: 253158

SEQ ID NO: 278932 - RNA, 62 nt, hsa; identical to SEQ ID NO: 253159

SEQ ID NO: 278933 - RNA, 62 nt, hsa; identical to SEQ ID NO: 253160

SEQ ID NO: 278934 - RNA, 62 nt, hsa; identical to SEQ ID NO: 253161

SEQ ID NO: 278935 - RNA, 62 nt, hsa; identical to SEQ ID NO: 253162

SEQ ID NO: 278936 - RNA, 62 nt, hsa; identical to SEQ ID NO: 253163

SEQ ID NO: 278937 - RNA, 62 nt, hsa; identical to SEQ ID NO: 253164

SEQ ID NO: 278938 - RNA, 62 nt, hsa; identical to SEQ ID NO: 253165

SEQ ID NO: 278939 - RNA, 62 nt, hsa; identical to SEQ ID NO: 253166

SEQ ID NO: 278940 - RNA, 62 nt, hsa; identical to SEQ ID NO: 253167

SEQ ID NO: 278941 - RNA, 62 nt, hsa; identical to SEQ ID NO: 253168

SEQ ID NO: 278942 - RNA, 53 nt, hsa; identical to SEQ ID NO: 103014

SEQ ID NO: 278943 - RNA, 62 nt, hsa; identical to SEQ ID NO: 253170

SEQ ID NO: 278944 - RNA, 62 nt, hsa; identical to SEQ ID NO: 253171

SEQ ID NO: 278945 - RNA, 62 nt, hsa; identical to SEQ ID NO: 253172

SEQ ID NO: 278946 - RNA, 62 nt, hsa; identical to SEQ ID NO: 253173

SEQ ID NO: 278947 - RNA, 62 nt, hsa; identical to SEQ ID NO: 253174

SEQ ID NO: 278948 - RNA, 62 nt, hsa; identical to SEQ ID NO: 253175

SEQ ID NO: 278949 - RNA, 62 nt, hsa; identical to SEQ ID NO: 253176

SEQ ID NO: 278950 - RNA, 62 nt, hsa; identical to SEQ ID NO: 253177

SEQ ID NO: 278951 - RNA, 62 nt, hsa; identical to SEQ ID NO: 253178

SEQ ID NO: 278952 - RNA, 62 nt, hsa; identical to SEQ ID NO: 253179

SEQ ID NO: 278953 - RNA, 62 nt, hsa; identical to SEQ ID NO: 253180

SEQ ID NO: 278954 - RNA, 62 nt, hsa; identical to SEQ ID NO: 253181

SEQ ID NO: 278955 - RNA, 62 nt, hsa; identical to SEQ ID NO: 253182

SEQ ID NO: 278956 - RNA, 62 nt, hsa; identical to SEQ ID NO: 253183

SEQ ID NO: 278957 - RNA, 62 nt, hsa; identical to SEQ ID NO: 253184

SEQ ID NO: 278958 - RNA, 62 nt, hsa; identical to SEQ ID NO: 253185

SEQ ID NO: 278959 - RNA, 62 nt, hsa; identical to SEQ ID NO: 253186

SEQ ID NO: 278960 - RNA, 62 nt, hsa; identical to SEQ ID NO: 253187

SEQ ID NO: 278961 - RNA, 62 nt, hsa; identical to SEQ ID NO: 253188

SEQ ID NO: 278962 - RNA, 62 nt, hsa; identical to SEQ ID NO: 253189

SEQ ID NO: 278963 - RNA, 62 nt, hsa; identical to SEQ ID NO: 253190

SEQ ID NO: 278964 - RNA, 62 nt, hsa; identical to SEQ ID NO: 253191

SEQ ID NO: 278965 - RNA, 62 nt, hsa; identical to SEQ ID NO: 253192

SEQ ID NO: 278966 - RNA, 62 nt, hsa; identical to SEQ ID NO: 253193

SEQ ID NO: 278967 - RNA, 62 nt, hsa; identical to SEQ ID NO: 253194

SEQ ID NO: 278968 - RNA, 62 nt, hsa; identical to SEQ ID NO: 253195

SEQ ID NO: 278969 - RNA, 62 nt, hsa; identical to SEQ ID NO: 253196

SEQ ID NO: 278970 - RNA, 62 nt, hsa; identical to SEQ ID NO: 253197

SEQ ID NO: 278971 - RNA, 62 nt, hsa; identical to SEQ ID NO: 253198

SEQ ID NO: 278972 - RNA, 62 nt, hsa; identical to SEQ ID NO: 253199

SEQ ID NO: 278973 - RNA, 62 nt, hsa; identical to SEQ ID NO: 253200

SEQ ID NO: 278974 - RNA, 62 nt, hsa; identical to SEQ ID NO: 253201

SEQ ID NO: 278975 - RNA, 62 nt, hsa; identical to SEQ ID NO: 253202

SEQ ID NO: 278976 - RNA, 62 nt, hsa; identical to SEQ ID NO: 253203

SEQ ID NO: 278977 - RNA, 62 nt, hsa; identical to SEQ ID NO: 253204

SEQ ID NO: 278978 - RNA, 62 nt, hsa; identical to SEQ ID NO: 253205

SEQ ID NO: 278979 - RNA, 62 nt, hsa; identical to SEQ ID NO: 253206

SEQ ID NO: 278980 - RNA, 62 nt, hsa; identical to SEQ ID NO: 253207

SEQ ID NO: 278981 - RNA, 62 nt, hsa; identical to SEQ ID NO: 253208

SEQ ID NO: 278982 - RNA, 62 nt, hsa; identical to SEQ ID NO: 253209

SEQ ID NO: 278983 - RNA, 62 nt, hsa; identical to SEQ ID NO: 253210

SEQ ID NO: 278984 - RNA, 62 nt, hsa; identical to SEQ ID NO: 253211

SEQ ID NO: 278985 - RNA, 62 nt, hsa; identical to SEQ ID NO: 253212

SEQ ID NO: 278986 - RNA, 62 nt, hsa; identical to SEQ ID NO: 253213

SEQ ID NO: 278987 - RNA, 62 nt, hsa; identical to SEQ ID NO: 253214

SEQ ID NO: 278988 - RNA, 62 nt, hsa; identical to SEQ ID NO: 253215

SEQ ID NO: 278989 - RNA, 62 nt, hsa; identical to SEQ ID NO: 253216

SEQ ID NO: 278990 - RNA, 62 nt, hsa; identical to SEQ ID NO: 253217

SEQ ID NO: 278991 - RNA, 62 nt, hsa; identical to SEQ ID NO: 253218

SEQ ID NO: 278992 - RNA, 62 nt, hsa; identical to SEQ ID NO: 253219

SEQ ID NO: 278993 - RNA, 62 nt, hsa; identical to SEQ ID NO: 253220

SEQ ID NO: 278994 - RNA, 62 nt, hsa; identical to SEQ ID NO: 253221

SEQ ID NO: 278995 - RNA, 62 nt, hsa; identical to SEQ ID NO: 253222

SEQ ID NO: 278996 - RNA, 62 nt, hsa; identical to SEQ ID NO: 253223

SEQ ID NO: 278997 - RNA, 62 nt, hsa; identical to SEQ ID NO: 253224

SEQ ID NO: 278998 - RNA, 62 nt, hsa; identical to SEQ ID NO: 253225

SEQ ID NO: 278999 - RNA, 62 nt, hsa; identical to SEQ ID NO: 253226

SEQ ID NO: 279000 - RNA, 62 nt, hsa; identical to SEQ ID NO: 253227

SEQ ID NO: 279001 - RNA, 62 nt, hsa; identical to SEQ ID NO: 253228

SEQ ID NO: 279002 - RNA, 62 nt, hsa; identical to SEQ ID NO: 253229

SEQ ID NO: 279003 - RNA, 62 nt, hsa; identical to SEQ ID NO: 253230

SEQ ID NO: 279004 - RNA, 62 nt, hsa; identical to SEQ ID NO: 253231

SEQ ID NO: 279005 - RNA, 62 nt, hsa; identical to SEQ ID NO: 253232

SEQ ID NO: 279006 - RNA, 62 nt, hsa; identical to SEQ ID NO: 253233

SEQ ID NO: 279007 - RNA, 62 nt, hsa; identical to SEQ ID NO: 253234

SEQ ID NO: 279008 - RNA, 62 nt, hsa; identical to SEQ ID NO: 253235

SEQ ID NO: 279009 - RNA, 62 nt, hsa; identical to SEQ ID NO: 253236

SEQ ID NO: 279010 - RNA, 62 nt, hsa; identical to SEQ ID NO: 253237

SEQ ID NO: 279011 - RNA, 62 nt, hsa; identical to SEQ ID NO: 253238

SEQ ID NO: 279012 - RNA, 62 nt, hsa; identical to SEQ ID NO: 253239

SEQ ID NO: 279013 - RNA, 62 nt, hsa; identical to SEQ ID NO: 253240

SEQ ID NO: 279014 - RNA, 62 nt, hsa; identical to SEQ ID NO: 253241

SEQ ID NO: 279015 - RNA, 62 nt, hsa; identical to SEQ ID NO: 253242

SEQ ID NO: 279016 - RNA, 62 nt, hsa; identical to SEQ ID NO: 253243

SEQ ID NO: 279017 - RNA, 62 nt, hsa; identical to SEQ ID NO: 253244

SEQ ID NO: 279018 - RNA, 62 nt, hsa; identical to SEQ ID NO: 253245

SEQ ID NO: 279019 - RNA, 62 nt, hsa; identical to SEQ ID NO: 253246

SEQ ID NO: 279020 - RNA, 62 nt, hsa; identical to SEQ ID NO: 253247

SEQ ID NO: 279021 - RNA, 62 nt, hsa; identical to SEQ ID NO: 253248

SEQ ID NO: 279022 - RNA, 62 nt, hsa; identical to SEQ ID NO: 253249

SEQ ID NO: 279023 - RNA, 62 nt, hsa; identical to SEQ ID NO: 253250

SEQ ID NO: 279024 - RNA, 62 nt, hsa; identical to SEQ ID NO: 253251

SEQ ID NO: 279025 - RNA, 62 nt, hsa; identical to SEQ ID NO: 253252

SEQ ID NO: 279026 - RNA, 60 nt, hsa; identical to SEQ ID NO: 103098

SEQ ID NO: 279027 - RNA, 62 nt, hsa; identical to SEQ ID NO: 253254

SEQ ID NO: 279028 - RNA, 62 nt, hsa; identical to SEQ ID NO: 253255

SEQ ID NO: 279029 - RNA, 62 nt, hsa; identical to SEQ ID NO: 253256

SEQ ID NO: 279030 - RNA, 62 nt, hsa; identical to SEQ ID NO: 253257

SEQ ID NO: 279031 - RNA, 62 nt, hsa; identical to SEQ ID NO: 253258

SEQ ID NO: 279032 - RNA, 62 nt, hsa; identical to SEQ ID NO: 253259

SEQ ID NO: 279033 - RNA, 62 nt, hsa; identical to SEQ ID NO: 253260

SEQ ID NO: 279034 - RNA, 62 nt, hsa; identical to SEQ ID NO: 253261

SEQ ID NO: 279035 - RNA, 62 nt, hsa; identical to SEQ ID NO: 253262

SEQ ID NO: 279036 - RNA, 62 nt, hsa; identical to SEQ ID NO: 253263

SEQ ID NO: 279037 - RNA, 62 nt, hsa; identical to SEQ ID NO: 253264

SEQ ID NO: 279038 - RNA, 62 nt, hsa; identical to SEQ ID NO: 253265

SEQ ID NO: 279039 - RNA, 62 nt, hsa; identical to SEQ ID NO: 253266

SEQ ID NO: 279040 - RNA, 62 nt, hsa; identical to SEQ ID NO: 253267

SEQ ID NO: 279041 - RNA, 62 nt, hsa; identical to SEQ ID NO: 253268

SEQ ID NO: 279042 - RNA, 62 nt, hsa; identical to SEQ ID NO: 253269

SEQ ID NO: 279043 - RNA, 62 nt, hsa; identical to SEQ ID NO: 253270

SEQ ID NO: 279044 - RNA, 62 nt, hsa; identical to SEQ ID NO: 253271

SEQ ID NO: 279045 - RNA, 62 nt, hsa; identical to SEQ ID NO: 253272

SEQ ID NO: 279046 - RNA, 62 nt, hsa; identical to SEQ ID NO: 253273

SEQ ID NO: 279047 - RNA, 62 nt, hsa; identical to SEQ ID NO: 253274

SEQ ID NO: 279048 - RNA, 62 nt, hsa; identical to SEQ ID NO: 253275

SEQ ID NO: 279049 - RNA, 62 nt, hsa; identical to SEQ ID NO: 253276

SEQ ID NO: 279050 - RNA, 62 nt, hsa; identical to SEQ ID NO: 253277

SEQ ID NO: 279051 - RNA, 62 nt, hsa; identical to SEQ ID NO: 253278

SEQ ID NO: 279052 - RNA, 62 nt, hsa; identical to SEQ ID NO: 253279

SEQ ID NO: 279053 - RNA, 62 nt, hsa; identical to SEQ ID NO: 253280

SEQ ID NO: 279054 - RNA, 62 nt, hsa; identical to SEQ ID NO: 253281

SEQ ID NO: 279055 - RNA, 62 nt, hsa; identical to SEQ ID NO: 253282

SEQ ID NO: 279056 - RNA, 62 nt, hsa; identical to SEQ ID NO: 253283

SEQ ID NO: 279057 - RNA, 62 nt, hsa; identical to SEQ ID NO: 253284

SEQ ID NO: 279058 - RNA, 62 nt, hsa; identical to SEQ ID NO: 253285

SEQ ID NO: 279059 - RNA, 62 nt, hsa; identical to SEQ ID NO: 253286

SEQ ID NO: 279060 - RNA, 62 nt, hsa; identical to SEQ ID NO: 253287

SEQ ID NO: 279061 - RNA, 62 nt, hsa; identical to SEQ ID NO: 253288

SEQ ID NO: 279062 - RNA, 62 nt, hsa; identical to SEQ ID NO: 253289

SEQ ID NO: 279063 - RNA, 62 nt, hsa; identical to SEQ ID NO: 253290

SEQ ID NO: 279064 - RNA, 62 nt, hsa; identical to SEQ ID NO: 253291

SEQ ID NO: 279065 - RNA, 62 nt, hsa; identical to SEQ ID NO: 253292

SEQ ID NO: 279066 - RNA, 62 nt, hsa; identical to SEQ ID NO: 253293

SEQ ID NO: 279067 - RNA, 62 nt, hsa; identical to SEQ ID NO: 253294

SEQ ID NO: 279068 - RNA, 62 nt, hsa; identical to SEQ ID NO: 253295

SEQ ID NO: 279069 - RNA, 62 nt, hsa; identical to SEQ ID NO: 253296

SEQ ID NO: 279070 - RNA, 62 nt, hsa; identical to SEQ ID NO: 253297

SEQ ID NO: 279071 - RNA, 62 nt, hsa; identical to SEQ ID NO: 253298

SEQ ID NO: 279072 - RNA, 62 nt, hsa; identical to SEQ ID NO: 253299

SEQ ID NO: 279073 - RNA, 62 nt, hsa; identical to SEQ ID NO: 253300

SEQ ID NO: 279074 - RNA, 62 nt, hsa; identical to SEQ ID NO: 253301

SEQ ID NO: 279075 - RNA, 62 nt, hsa; identical to SEQ ID NO: 253302

SEQ ID NO: 279076 - RNA, 62 nt, hsa; identical to SEQ ID NO: 253303

SEQ ID NO: 279077 - RNA, 62 nt, hsa; identical to SEQ ID NO: 253304

SEQ ID NO: 279078 - RNA, 62 nt, hsa; identical to SEQ ID NO: 253305

SEQ ID NO: 279079 - RNA, 62 nt, hsa; identical to SEQ ID NO: 253306

SEQ ID NO: 279080 - RNA, 62 nt, hsa; identical to SEQ ID NO: 253307

SEQ ID NO: 279081 - RNA, 62 nt, hsa; identical to SEQ ID NO: 253308

SEQ ID NO: 279082 - RNA, 62 nt, hsa; identical to SEQ ID NO: 253309

SEQ ID NO: 279083 - RNA, 62 nt, hsa; identical to SEQ ID NO: 253310

SEQ ID NO: 279084 - RNA, 62 nt, hsa; identical to SEQ ID NO: 253311

SEQ ID NO: 279085 - RNA, 62 nt, hsa; identical to SEQ ID NO: 253312

SEQ ID NO: 279086 - RNA, 62 nt, hsa; identical to SEQ ID NO: 253313

SEQ ID NO: 279087 - RNA, 62 nt, hsa; identical to SEQ ID NO: 253314

SEQ ID NO: 279088 - RNA, 62 nt, hsa; identical to SEQ ID NO: 253315

SEQ ID NO: 279089 - RNA, 62 nt, hsa; identical to SEQ ID NO: 253316

SEQ ID NO: 279090 - RNA, 62 nt, hsa; identical to SEQ ID NO: 253317

SEQ ID NO: 279091 - RNA, 62 nt, hsa; identical to SEQ ID NO: 253318

SEQ ID NO: 279092 - RNA, 62 nt, hsa; identical to SEQ ID NO: 253319

SEQ ID NO: 279093 - RNA, 62 nt, hsa; identical to SEQ ID NO: 253320

SEQ ID NO: 279094 - RNA, 62 nt, hsa; identical to SEQ ID NO: 253321

SEQ ID NO: 279095 - RNA, 62 nt, hsa; identical to SEQ ID NO: 253322

SEQ ID NO: 279096 - RNA, 62 nt, hsa; identical to SEQ ID NO: 253323

SEQ ID NO: 279097 - RNA, 62 nt, hsa; identical to SEQ ID NO: 253324

SEQ ID NO: 279098 - RNA, 62 nt, hsa; identical to SEQ ID NO: 253325

SEQ ID NO: 279099 - RNA, 62 nt, hsa; identical to SEQ ID NO: 253326

SEQ ID NO: 279100 - RNA, 62 nt, hsa; identical to SEQ ID NO: 253327

SEQ ID NO: 279101 - RNA, 62 nt, hsa; identical to SEQ ID NO: 253328

SEQ ID NO: 279102 - RNA, 62 nt, hsa; identical to SEQ ID NO: 253329

SEQ ID NO: 279103 - RNA, 62 nt, hsa; identical to SEQ ID NO: 253330

SEQ ID NO: 279104 - RNA, 62 nt, hsa; identical to SEQ ID NO: 253331

SEQ ID NO: 279105 - RNA, 62 nt, hsa; identical to SEQ ID NO: 253332

SEQ ID NO: 279106 - RNA, 62 nt, hsa; identical to SEQ ID NO: 253333

SEQ ID NO: 279107 - RNA, 62 nt, hsa; identical to SEQ ID NO: 253334

SEQ ID NO: 279108 - RNA, 62 nt, hsa; identical to SEQ ID NO: 253335

SEQ ID NO: 279109 - RNA, 62 nt, hsa; identical to SEQ ID NO: 253336

SEQ ID NO: 279110 - RNA, 62 nt, hsa; identical to SEQ ID NO: 253337

SEQ ID NO: 279111 - RNA, 62 nt, hsa; identical to SEQ ID NO: 253338

SEQ ID NO: 279112 - RNA, 62 nt, hsa; identical to SEQ ID NO: 253339

SEQ ID NO: 279113 - RNA, 62 nt, hsa; identical to SEQ ID NO: 253340

SEQ ID NO: 279114 - RNA, 62 nt, hsa; identical to SEQ ID NO: 253341

SEQ ID NO: 279115 - RNA, 62 nt, hsa; identical to SEQ ID NO: 253342

SEQ ID NO: 279116 - RNA, 62 nt, hsa; identical to SEQ ID NO: 253343

SEQ ID NO: 279117 - RNA, 62 nt, hsa; identical to SEQ ID NO: 253344

SEQ ID NO: 279118 - RNA, 62 nt, hsa; identical to SEQ ID NO: 253345

SEQ ID NO: 279119 - RNA, 62 nt, hsa; identical to SEQ ID NO: 253346

SEQ ID NO: 279120 - RNA, 62 nt, hsa; identical to SEQ ID NO: 253347

SEQ ID NO: 279121 - RNA, 62 nt, hsa; identical to SEQ ID NO: 253348

SEQ ID NO: 279122 - RNA, 62 nt, hsa; identical to SEQ ID NO: 253349

SEQ ID NO: 279123 - RNA, 62 nt, hsa; identical to SEQ ID NO: 253350

SEQ ID NO: 279124 - RNA, 51 nt, hsa; identical to SEQ ID NO: 103196

SEQ ID NO: 279125 - RNA, 62 nt, hsa; identical to SEQ ID NO: 253352

SEQ ID NO: 279126 - RNA, 62 nt, hsa; identical to SEQ ID NO: 253353

SEQ ID NO: 279127 - RNA, 62 nt, hsa; identical to SEQ ID NO: 253354

SEQ ID NO: 279128 - RNA, 62 nt, hsa; identical to SEQ ID NO: 253355

SEQ ID NO: 279129 - RNA, 62 nt, hsa; identical to SEQ ID NO: 253356

SEQ ID NO: 279130 - RNA, 62 nt, hsa; identical to SEQ ID NO: 253357

SEQ ID NO: 279131 - RNA, 62 nt, hsa; identical to SEQ ID NO: 253358

SEQ ID NO: 279132 - RNA, 62 nt, hsa; identical to SEQ ID NO: 253359

SEQ ID NO: 279133 - RNA, 62 nt, hsa; identical to SEQ ID NO: 253360

SEQ ID NO: 279134 - RNA, 62 nt, hsa; identical to SEQ ID NO: 253361

SEQ ID NO: 279135 - RNA, 62 nt, hsa; identical to SEQ ID NO: 253362

SEQ ID NO: 279136 - RNA, 62 nt, hsa; identical to SEQ ID NO: 253363

SEQ ID NO: 279137 - RNA, 62 nt, hsa; identical to SEQ ID NO: 253364

SEQ ID NO: 279138 - RNA, 62 nt, hsa; identical to SEQ ID NO: 253365

SEQ ID NO: 279139 - RNA, 62 nt, hsa; identical to SEQ ID NO: 253366

SEQ ID NO: 279140 - RNA, 62 nt, hsa; identical to SEQ ID NO: 253367

SEQ ID NO: 279141 - RNA, 62 nt, hsa; identical to SEQ ID NO: 253368

SEQ ID NO: 279142 - RNA, 62 nt, hsa; identical to SEQ ID NO: 253369

SEQ ID NO: 279143 - RNA, 62 nt, hsa; identical to SEQ ID NO: 253370

SEQ ID NO: 279144 - RNA, 62 nt, hsa; identical to SEQ ID NO: 253371

SEQ ID NO: 279145 - RNA, 62 nt, hsa; identical to SEQ ID NO: 253372

SEQ ID NO: 279146 - RNA, 62 nt, hsa; identical to SEQ ID NO: 253373

SEQ ID NO: 279147 - RNA, 62 nt, hsa; identical to SEQ ID NO: 253374

SEQ ID NO: 279148 - RNA, 62 nt, hsa; identical to SEQ ID NO: 253375

SEQ ID NO: 279149 - RNA, 62 nt, hsa; identical to SEQ ID NO: 253376

SEQ ID NO: 279150 - RNA, 62 nt, hsa; identical to SEQ ID NO: 253377

SEQ ID NO: 279151 - RNA, 62 nt, hsa; identical to SEQ ID NO: 253378

SEQ ID NO: 279152 - RNA, 62 nt, hsa; identical to SEQ ID NO: 253379

SEQ ID NO: 279153 - RNA, 62 nt, hsa; identical to SEQ ID NO: 253380

SEQ ID NO: 279154 - RNA, 62 nt, hsa; identical to SEQ ID NO: 253381

SEQ ID NO: 279155 - RNA, 62 nt, hsa; identical to SEQ ID NO: 253382

SEQ ID NO: 279156 - RNA, 62 nt, hsa; identical to SEQ ID NO: 253383

SEQ ID NO: 279157 - RNA, 62 nt, hsa; identical to SEQ ID NO: 253384

SEQ ID NO: 279158 - RNA, 62 nt, hsa; identical to SEQ ID NO: 253385

SEQ ID NO: 279159 - RNA, 62 nt, hsa; identical to SEQ ID NO: 253386

SEQ ID NO: 279160 - RNA, 62 nt, hsa; identical to SEQ ID NO: 253387

SEQ ID NO: 279161 - RNA, 62 nt, hsa; identical to SEQ ID NO: 253388

SEQ ID NO: 279162 - RNA, 62 nt, hsa; identical to SEQ ID NO: 253389

SEQ ID NO: 279163 - RNA, 62 nt, hsa; identical to SEQ ID NO: 253390

SEQ ID NO: 279164 - RNA, 62 nt, hsa; identical to SEQ ID NO: 253391

SEQ ID NO: 279165 - RNA, 62 nt, hsa; identical to SEQ ID NO: 253392

SEQ ID NO: 279166 - RNA, 62 nt, hsa; identical to SEQ ID NO: 253393

SEQ ID NO: 279167 - RNA, 62 nt, hsa; identical to SEQ ID NO: 253394

SEQ ID NO: 279168 - RNA, 62 nt, hsa; identical to SEQ ID NO: 253395

SEQ ID NO: 279169 - RNA, 62 nt, hsa; identical to SEQ ID NO: 253396

SEQ ID NO: 279170 - RNA, 62 nt, hsa; identical to SEQ ID NO: 253397

SEQ ID NO: 279171 - RNA, 62 nt, hsa; identical to SEQ ID NO: 253398

SEQ ID NO: 279172 - RNA, 62 nt, hsa; identical to SEQ ID NO: 253399

SEQ ID NO: 279173 - RNA, 62 nt, hsa; identical to SEQ ID NO: 253400

SEQ ID NO: 279174 - RNA, 62 nt, hsa; identical to SEQ ID NO: 253401

SEQ ID NO: 279175 - RNA, 62 nt, hsa; identical to SEQ ID NO: 253402

SEQ ID NO: 279176 - RNA, 62 nt, hsa; identical to SEQ ID NO: 253403

SEQ ID NO: 279177 - RNA, 62 nt, hsa; identical to SEQ ID NO: 253404

SEQ ID NO: 279178 - RNA, 62 nt, hsa; identical to SEQ ID NO: 253405

SEQ ID NO: 279179 - RNA, 62 nt, hsa; identical to SEQ ID NO: 253406

SEQ ID NO: 279180 - RNA, 62 nt, hsa; identical to SEQ ID NO: 253407

SEQ ID NO: 279181 - RNA, 62 nt, hsa; identical to SEQ ID NO: 253408

SEQ ID NO: 279182 - RNA, 62 nt, hsa; identical to SEQ ID NO: 253409

SEQ ID NO: 279183 - RNA, 62 nt, hsa; identical to SEQ ID NO: 253410

SEQ ID NO: 279184 - RNA, 62 nt, hsa; identical to SEQ ID NO: 253411

SEQ ID NO: 279185 - RNA, 62 nt, hsa; identical to SEQ ID NO: 253412

SEQ ID NO: 279186 - RNA, 62 nt, hsa; identical to SEQ ID NO: 253413

SEQ ID NO: 279187 - RNA, 62 nt, hsa; identical to SEQ ID NO: 253414

SEQ ID NO: 279188 - RNA, 62 nt, hsa; identical to SEQ ID NO: 253415

SEQ ID NO: 279189 - RNA, 62 nt, hsa; identical to SEQ ID NO: 253416

SEQ ID NO: 279190 - RNA, 62 nt, hsa; identical to SEQ ID NO: 253417

SEQ ID NO: 279191 - RNA, 62 nt, hsa; identical to SEQ ID NO: 253418

SEQ ID NO: 279192 - RNA, 62 nt, hsa; identical to SEQ ID NO: 253419

SEQ ID NO: 279193 - RNA, 62 nt, hsa; identical to SEQ ID NO: 253420

SEQ ID NO: 279194 - RNA, 62 nt, hsa; identical to SEQ ID NO: 253421

SEQ ID NO: 279195 - RNA, 62 nt, hsa; identical to SEQ ID NO: 253422

SEQ ID NO: 279196 - RNA, 62 nt, hsa; identical to SEQ ID NO: 253423

SEQ ID NO: 279197 - RNA, 62 nt, hsa; identical to SEQ ID NO: 253424

SEQ ID NO: 279198 - RNA, 62 nt, hsa; identical to SEQ ID NO: 253425

SEQ ID NO: 279199 - RNA, 62 nt, hsa; identical to SEQ ID NO: 253426

SEQ ID NO: 279200 - RNA, 62 nt, hsa; identical to SEQ ID NO: 253427

SEQ ID NO: 279201 - RNA, 62 nt, hsa; identical to SEQ ID NO: 253428

SEQ ID NO: 279202 - RNA, 62 nt, hsa; identical to SEQ ID NO: 253429

SEQ ID NO: 279203 - RNA, 62 nt, hsa; identical to SEQ ID NO: 253430

SEQ ID NO: 279204 - RNA, 62 nt, hsa; identical to SEQ ID NO: 253431

SEQ ID NO: 279205 - RNA, 62 nt, hsa; identical to SEQ ID NO: 253432

SEQ ID NO: 279206 - RNA, 62 nt, hsa; identical to SEQ ID NO: 253433

SEQ ID NO: 279207 - RNA, 62 nt, hsa; identical to SEQ ID NO: 253434

SEQ ID NO: 279208 - RNA, 62 nt, hsa; identical to SEQ ID NO: 253435

SEQ ID NO: 279209 - RNA, 62 nt, hsa; identical to SEQ ID NO: 253436

SEQ ID NO: 279210 - RNA, 62 nt, hsa; identical to SEQ ID NO: 253437

SEQ ID NO: 279211 - RNA, 62 nt, hsa; identical to SEQ ID NO: 253438

SEQ ID NO: 279212 - RNA, 62 nt, hsa; identical to SEQ ID NO: 253439

SEQ ID NO: 279213 - RNA, 62 nt, hsa; identical to SEQ ID NO: 253440

SEQ ID NO: 279214 - RNA, 62 nt, hsa; identical to SEQ ID NO: 253441

SEQ ID NO: 279215 - RNA, 62 nt, hsa; identical to SEQ ID NO: 253442

SEQ ID NO: 279216 - RNA, 62 nt, hsa; identical to SEQ ID NO: 253443

SEQ ID NO: 279217 - RNA, 66 nt, hsa; identical to SEQ ID NO: 253444

SEQ ID NO: 279218 - RNA, 66 nt, hsa; identical to SEQ ID NO: 253445

SEQ ID NO: 279219 - RNA, 66 nt, hsa; identical to SEQ ID NO: 253446

SEQ ID NO: 279220 - RNA, 66 nt, hsa; identical to SEQ ID NO: 253447

SEQ ID NO: 279221 - RNA, 66 nt, hsa; identical to SEQ ID NO: 253448

SEQ ID NO: 279222 - RNA, 66 nt, hsa; identical to SEQ ID NO: 253449

SEQ ID NO: 279223 - RNA, 66 nt, hsa; identical to SEQ ID NO: 253450

SEQ ID NO: 279224 - RNA, 66 nt, hsa; identical to SEQ ID NO: 253451

SEQ ID NO: 279225 - RNA, 66 nt, hsa; identical to SEQ ID NO: 253452

SEQ ID NO: 279226 - RNA, 66 nt, hsa; identical to SEQ ID NO: 253453

SEQ ID NO: 279227 - RNA, 66 nt, hsa; identical to SEQ ID NO: 253454

SEQ ID NO: 279228 - RNA, 58 nt, hsa; identical to SEQ ID NO: 102991

SEQ ID NO: 279229 - RNA, 66 nt, hsa; identical to SEQ ID NO: 253456

SEQ ID NO: 279230 - RNA, 66 nt, hsa; identical to SEQ ID NO: 253457

SEQ ID NO: 279231 - RNA, 66 nt, hsa; identical to SEQ ID NO: 253458

SEQ ID NO: 279232 - RNA, 66 nt, hsa; identical to SEQ ID NO: 253459

SEQ ID NO: 279233 - RNA, 66 nt, hsa; identical to SEQ ID NO: 253460

SEQ ID NO: 279234 - RNA, 66 nt, hsa; identical to SEQ ID NO: 253461

SEQ ID NO: 279235 - RNA, 66 nt, hsa; identical to SEQ ID NO: 253462

SEQ ID NO: 279236 - RNA, 66 nt, hsa; identical to SEQ ID NO: 253463

SEQ ID NO: 279237 - RNA, 66 nt, hsa; identical to SEQ ID NO: 253464

SEQ ID NO: 279238 - RNA, 66 nt, hsa; identical to SEQ ID NO: 253465

SEQ ID NO: 279239 - RNA, 66 nt, hsa; identical to SEQ ID NO: 253466

SEQ ID NO: 279240 - RNA, 66 nt, hsa; identical to SEQ ID NO: 253467

SEQ ID NO: 279241 - RNA, 66 nt, hsa; identical to SEQ ID NO: 253468

SEQ ID NO: 279242 - RNA, 66 nt, hsa; identical to SEQ ID NO: 253469

SEQ ID NO: 279243 - RNA, 66 nt, hsa; identical to SEQ ID NO: 253470

SEQ ID NO: 279244 - RNA, 66 nt, hsa; identical to SEQ ID NO: 253471

SEQ ID NO: 279245 - RNA, 66 nt, hsa; identical to SEQ ID NO: 253472

SEQ ID NO: 279246 - RNA, 66 nt, hsa; identical to SEQ ID NO: 253473

SEQ ID NO: 279247 - RNA, 66 nt, hsa; identical to SEQ ID NO: 253474

SEQ ID NO: 279248 - RNA, 66 nt, hsa; identical to SEQ ID NO: 253475

SEQ ID NO: 279249 - RNA, 66 nt, hsa; identical to SEQ ID NO: 253476

SEQ ID NO: 279250 - RNA, 66 nt, hsa; identical to SEQ ID NO: 253477

SEQ ID NO: 279251 - RNA, 53 nt, hsa; identical to SEQ ID NO: 103014

SEQ ID NO: 279252 - RNA, 66 nt, hsa; identical to SEQ ID NO: 253479

SEQ ID NO: 279253 - RNA, 66 nt, hsa; identical to SEQ ID NO: 253480

SEQ ID NO: 279254 - RNA, 66 nt, hsa; identical to SEQ ID NO: 253481

SEQ ID NO: 279255 - RNA, 66 nt, hsa; identical to SEQ ID NO: 253482

SEQ ID NO: 279256 - RNA, 66 nt, hsa; identical to SEQ ID NO: 253483

SEQ ID NO: 279257 - RNA, 66 nt, hsa; identical to SEQ ID NO: 253484

SEQ ID NO: 279258 - RNA, 66 nt, hsa; identical to SEQ ID NO: 253485

SEQ ID NO: 279259 - RNA, 66 nt, hsa; identical to SEQ ID NO: 253486

SEQ ID NO: 279260 - RNA, 66 nt, hsa; identical to SEQ ID NO: 253487

SEQ ID NO: 279261 - RNA, 66 nt, hsa; identical to SEQ ID NO: 253488

SEQ ID NO: 279262 - RNA, 66 nt, hsa; identical to SEQ ID NO: 253489

SEQ ID NO: 279263 - RNA, 66 nt, hsa; identical to SEQ ID NO: 253490

SEQ ID NO: 279264 - RNA, 66 nt, hsa; identical to SEQ ID NO: 253491

SEQ ID NO: 279265 - RNA, 66 nt, hsa; identical to SEQ ID NO: 253492

SEQ ID NO: 279266 - RNA, 66 nt, hsa; identical to SEQ ID NO: 253493

SEQ ID NO: 279267 - RNA, 66 nt, hsa; identical to SEQ ID NO: 253494

SEQ ID NO: 279268 - RNA, 66 nt, hsa; identical to SEQ ID NO: 253495

SEQ ID NO: 279269 - RNA, 66 nt, hsa; identical to SEQ ID NO: 253496

SEQ ID NO: 279270 - RNA, 66 nt, hsa; identical to SEQ ID NO: 253497

SEQ ID NO: 279271 - RNA, 66 nt, hsa; identical to SEQ ID NO: 253498

SEQ ID NO: 279272 - RNA, 66 nt, hsa; identical to SEQ ID NO: 253499

SEQ ID NO: 279273 - RNA, 66 nt, hsa; identical to SEQ ID NO: 253500

SEQ ID NO: 279274 - RNA, 66 nt, hsa; identical to SEQ ID NO: 253501

SEQ ID NO: 279275 - RNA, 66 nt, hsa; identical to SEQ ID NO: 253502

SEQ ID NO: 279276 - RNA, 66 nt, hsa; identical to SEQ ID NO: 253503

SEQ ID NO: 279277 - RNA, 66 nt, hsa; identical to SEQ ID NO: 253504

SEQ ID NO: 279278 - RNA, 66 nt, hsa; identical to SEQ ID NO: 253505

SEQ ID NO: 279279 - RNA, 66 nt, hsa; identical to SEQ ID NO: 253506

SEQ ID NO: 279280 - RNA, 66 nt, hsa; identical to SEQ ID NO: 253507

SEQ ID NO: 279281 - RNA, 66 nt, hsa; identical to SEQ ID NO: 253508

SEQ ID NO: 279282 - RNA, 66 nt, hsa; identical to SEQ ID NO: 253509

SEQ ID NO: 279283 - RNA, 66 nt, hsa; identical to SEQ ID NO: 253510

SEQ ID NO: 279284 - RNA, 66 nt, hsa; identical to SEQ ID NO: 253511

SEQ ID NO: 279285 - RNA, 66 nt, hsa; identical to SEQ ID NO: 253512

SEQ ID NO: 279286 - RNA, 66 nt, hsa; identical to SEQ ID NO: 253513

SEQ ID NO: 279287 - RNA, 66 nt, hsa; identical to SEQ ID NO: 253514

SEQ ID NO: 279288 - RNA, 66 nt, hsa; identical to SEQ ID NO: 253515

SEQ ID NO: 279289 - RNA, 66 nt, hsa; identical to SEQ ID NO: 253516

SEQ ID NO: 279290 - RNA, 66 nt, hsa; identical to SEQ ID NO: 253517

SEQ ID NO: 279291 - RNA, 66 nt, hsa; identical to SEQ ID NO: 253518

SEQ ID NO: 279292 - RNA, 66 nt, hsa; identical to SEQ ID NO: 253519

SEQ ID NO: 279293 - RNA, 66 nt, hsa; identical to SEQ ID NO: 253520

SEQ ID NO: 279294 - RNA, 66 nt, hsa; identical to SEQ ID NO: 253521

SEQ ID NO: 279295 - RNA, 66 nt, hsa; identical to SEQ ID NO: 253522

SEQ ID NO: 279296 - RNA, 66 nt, hsa; identical to SEQ ID NO: 253523

SEQ ID NO: 279297 - RNA, 66 nt, hsa; identical to SEQ ID NO: 253524

SEQ ID NO: 279298 - RNA, 66 nt, hsa; identical to SEQ ID NO: 253525

SEQ ID NO: 279299 - RNA, 66 nt, hsa; identical to SEQ ID NO: 253526

SEQ ID NO: 279300 - RNA, 66 nt, hsa; identical to SEQ ID NO: 253527

SEQ ID NO: 279301 - RNA, 66 nt, hsa; identical to SEQ ID NO: 253528

SEQ ID NO: 279302 - RNA, 66 nt, hsa; identical to SEQ ID NO: 253529

SEQ ID NO: 279303 - RNA, 66 nt, hsa; identical to SEQ ID NO: 253530

SEQ ID NO: 279304 - RNA, 66 nt, hsa; identical to SEQ ID NO: 253531

SEQ ID NO: 279305 - RNA, 66 nt, hsa; identical to SEQ ID NO: 253532

SEQ ID NO: 279306 - RNA, 66 nt, hsa; identical to SEQ ID NO: 253533

SEQ ID NO: 279307 - RNA, 66 nt, hsa; identical to SEQ ID NO: 253534

SEQ ID NO: 279308 - RNA, 66 nt, hsa; identical to SEQ ID NO: 253535

SEQ ID NO: 279309 - RNA, 66 nt, hsa; identical to SEQ ID NO: 253536

SEQ ID NO: 279310 - RNA, 66 nt, hsa; identical to SEQ ID NO: 253537

SEQ ID NO: 279311 - RNA, 66 nt, hsa; identical to SEQ ID NO: 253538

SEQ ID NO: 279312 - RNA, 66 nt, hsa; identical to SEQ ID NO: 253539

SEQ ID NO: 279313 - RNA, 66 nt, hsa; identical to SEQ ID NO: 253540

SEQ ID NO: 279314 - RNA, 66 nt, hsa; identical to SEQ ID NO: 253541

SEQ ID NO: 279315 - RNA, 66 nt, hsa; identical to SEQ ID NO: 253542

SEQ ID NO: 279316 - RNA, 66 nt, hsa; identical to SEQ ID NO: 253543

SEQ ID NO: 279317 - RNA, 66 nt, hsa; identical to SEQ ID NO: 253544

SEQ ID NO: 279318 - RNA, 66 nt, hsa; identical to SEQ ID NO: 253545

SEQ ID NO: 279319 - RNA, 66 nt, hsa; identical to SEQ ID NO: 253546

SEQ ID NO: 279320 - RNA, 66 nt, hsa; identical to SEQ ID NO: 253547

SEQ ID NO: 279321 - RNA, 66 nt, hsa; identical to SEQ ID NO: 253548

SEQ ID NO: 279322 - RNA, 66 nt, hsa; identical to SEQ ID NO: 253549

SEQ ID NO: 279323 - RNA, 66 nt, hsa; identical to SEQ ID NO: 253550

SEQ ID NO: 279324 - RNA, 66 nt, hsa; identical to SEQ ID NO: 253551

SEQ ID NO: 279325 - RNA, 66 nt, hsa; identical to SEQ ID NO: 253552

SEQ ID NO: 279326 - RNA, 66 nt, hsa; identical to SEQ ID NO: 253553

SEQ ID NO: 279327 - RNA, 66 nt, hsa; identical to SEQ ID NO: 253554

SEQ ID NO: 279328 - RNA, 66 nt, hsa; identical to SEQ ID NO: 253555

SEQ ID NO: 279329 - RNA, 66 nt, hsa; identical to SEQ ID NO: 253556

SEQ ID NO: 279330 - RNA, 66 nt, hsa; identical to SEQ ID NO: 253557

SEQ ID NO: 279331 - RNA, 66 nt, hsa; identical to SEQ ID NO: 253558

SEQ ID NO: 279332 - RNA, 66 nt, hsa; identical to SEQ ID NO: 253559

SEQ ID NO: 279333 - RNA, 66 nt, hsa; identical to SEQ ID NO: 253560

SEQ ID NO: 279334 - RNA, 66 nt, hsa; identical to SEQ ID NO: 253561

SEQ ID NO: 279335 - RNA, 60 nt, hsa; identical to SEQ ID NO: 103098

SEQ ID NO: 279336 - RNA, 66 nt, hsa; identical to SEQ ID NO: 253563

SEQ ID NO: 279337 - RNA, 66 nt, hsa; identical to SEQ ID NO: 253564

SEQ ID NO: 279338 - RNA, 66 nt, hsa; identical to SEQ ID NO: 253565

SEQ ID NO: 279339 - RNA, 66 nt, hsa; identical to SEQ ID NO: 253566

SEQ ID NO: 279340 - RNA, 66 nt, hsa; identical to SEQ ID NO: 253567

SEQ ID NO: 279341 - RNA, 66 nt, hsa; identical to SEQ ID NO: 253568

SEQ ID NO: 279342 - RNA, 66 nt, hsa; identical to SEQ ID NO: 253569

SEQ ID NO: 279343 - RNA, 66 nt, hsa; identical to SEQ ID NO: 253570

SEQ ID NO: 279344 - RNA, 66 nt, hsa; identical to SEQ ID NO: 253571

SEQ ID NO: 279345 - RNA, 66 nt, hsa; identical to SEQ ID NO: 253572

SEQ ID NO: 279346 - RNA, 66 nt, hsa; identical to SEQ ID NO: 253573

SEQ ID NO: 279347 - RNA, 66 nt, hsa; identical to SEQ ID NO: 253574

SEQ ID NO: 279348 - RNA, 66 nt, hsa; identical to SEQ ID NO: 253575

SEQ ID NO: 279349 - RNA, 66 nt, hsa; identical to SEQ ID NO: 253576

SEQ ID NO: 279350 - RNA, 66 nt, hsa; identical to SEQ ID NO: 253577

SEQ ID NO: 279351 - RNA, 66 nt, hsa; identical to SEQ ID NO: 253578

SEQ ID NO: 279352 - RNA, 66 nt, hsa; identical to SEQ ID NO: 253579

SEQ ID NO: 279353 - RNA, 66 nt, hsa; identical to SEQ ID NO: 253580

SEQ ID NO: 279354 - RNA, 66 nt, hsa; identical to SEQ ID NO: 253581

SEQ ID NO: 279355 - RNA, 66 nt, hsa; identical to SEQ ID NO: 253582

SEQ ID NO: 279356 - RNA, 66 nt, hsa; identical to SEQ ID NO: 253583

SEQ ID NO: 279357 - RNA, 66 nt, hsa; identical to SEQ ID NO: 253584

SEQ ID NO: 279358 - RNA, 66 nt, hsa; identical to SEQ ID NO: 253585

SEQ ID NO: 279359 - RNA, 66 nt, hsa; identical to SEQ ID NO: 253586

SEQ ID NO: 279360 - RNA, 66 nt, hsa; identical to SEQ ID NO: 253587

SEQ ID NO: 279361 - RNA, 66 nt, hsa; identical to SEQ ID NO: 253588

SEQ ID NO: 279362 - RNA, 66 nt, hsa; identical to SEQ ID NO: 253589

SEQ ID NO: 279363 - RNA, 66 nt, hsa; identical to SEQ ID NO: 253590

SEQ ID NO: 279364 - RNA, 66 nt, hsa; identical to SEQ ID NO: 253591

SEQ ID NO: 279365 - RNA, 66 nt, hsa; identical to SEQ ID NO: 253592

SEQ ID NO: 279366 - RNA, 66 nt, hsa; identical to SEQ ID NO: 253593

SEQ ID NO: 279367 - RNA, 66 nt, hsa; identical to SEQ ID NO: 253594

SEQ ID NO: 279368 - RNA, 66 nt, hsa; identical to SEQ ID NO: 253595

SEQ ID NO: 279369 - RNA, 66 nt, hsa; identical to SEQ ID NO: 253596

SEQ ID NO: 279370 - RNA, 66 nt, hsa; identical to SEQ ID NO: 253597

SEQ ID NO: 279371 - RNA, 66 nt, hsa; identical to SEQ ID NO: 253598

SEQ ID NO: 279372 - RNA, 66 nt, hsa; identical to SEQ ID NO: 253599

SEQ ID NO: 279373 - RNA, 66 nt, hsa; identical to SEQ ID NO: 253600

SEQ ID NO: 279374 - RNA, 66 nt, hsa; identical to SEQ ID NO: 253601

SEQ ID NO: 279375 - RNA, 66 nt, hsa; identical to SEQ ID NO: 253602

SEQ ID NO: 279376 - RNA, 66 nt, hsa; identical to SEQ ID NO: 253603

SEQ ID NO: 279377 - RNA, 66 nt, hsa; identical to SEQ ID NO: 253604

SEQ ID NO: 279378 - RNA, 66 nt, hsa; identical to SEQ ID NO: 253605

SEQ ID NO: 279379 - RNA, 66 nt, hsa; identical to SEQ ID NO: 253606

SEQ ID NO: 279380 - RNA, 66 nt, hsa; identical to SEQ ID NO: 253607

SEQ ID NO: 279381 - RNA, 66 nt, hsa; identical to SEQ ID NO: 253608

SEQ ID NO: 279382 - RNA, 66 nt, hsa; identical to SEQ ID NO: 253609

SEQ ID NO: 279383 - RNA, 66 nt, hsa; identical to SEQ ID NO: 253610

SEQ ID NO: 279384 - RNA, 66 nt, hsa; identical to SEQ ID NO: 253611

SEQ ID NO: 279385 - RNA, 66 nt, hsa; identical to SEQ ID NO: 253612

SEQ ID NO: 279386 - RNA, 66 nt, hsa; identical to SEQ ID NO: 253613

SEQ ID NO: 279387 - RNA, 66 nt, hsa; identical to SEQ ID NO: 253614

SEQ ID NO: 279388 - RNA, 66 nt, hsa; identical to SEQ ID NO: 253615

SEQ ID NO: 279389 - RNA, 66 nt, hsa; identical to SEQ ID NO: 253616

SEQ ID NO: 279390 - RNA, 66 nt, hsa; identical to SEQ ID NO: 253617

SEQ ID NO: 279391 - RNA, 66 nt, hsa; identical to SEQ ID NO: 253618

SEQ ID NO: 279392 - RNA, 66 nt, hsa; identical to SEQ ID NO: 253619

SEQ ID NO: 279393 - RNA, 66 nt, hsa; identical to SEQ ID NO: 253620

SEQ ID NO: 279394 - RNA, 66 nt, hsa; identical to SEQ ID NO: 253621

SEQ ID NO: 279395 - RNA, 66 nt, hsa; identical to SEQ ID NO: 253622

SEQ ID NO: 279396 - RNA, 66 nt, hsa; identical to SEQ ID NO: 253623

SEQ ID NO: 279397 - RNA, 66 nt, hsa; identical to SEQ ID NO: 253624

SEQ ID NO: 279398 - RNA, 66 nt, hsa; identical to SEQ ID NO: 253625

SEQ ID NO: 279399 - RNA, 66 nt, hsa; identical to SEQ ID NO: 253626

SEQ ID NO: 279400 - RNA, 66 nt, hsa; identical to SEQ ID NO: 253627

SEQ ID NO: 279401 - RNA, 66 nt, hsa; identical to SEQ ID NO: 253628

SEQ ID NO: 279402 - RNA, 66 nt, hsa; identical to SEQ ID NO: 253629

SEQ ID NO: 279403 - RNA, 66 nt, hsa; identical to SEQ ID NO: 253630

SEQ ID NO: 279404 - RNA, 66 nt, hsa; identical to SEQ ID NO: 253631

SEQ ID NO: 279405 - RNA, 66 nt, hsa; identical to SEQ ID NO: 253632

SEQ ID NO: 279406 - RNA, 66 nt, hsa; identical to SEQ ID NO: 253633

SEQ ID NO: 279407 - RNA, 66 nt, hsa; identical to SEQ ID NO: 253634

SEQ ID NO: 279408 - RNA, 66 nt, hsa; identical to SEQ ID NO: 253635

SEQ ID NO: 279409 - RNA, 66 nt, hsa; identical to SEQ ID NO: 253636

SEQ ID NO: 279410 - RNA, 66 nt, hsa; identical to SEQ ID NO: 253637

SEQ ID NO: 279411 - RNA, 66 nt, hsa; identical to SEQ ID NO: 253638

SEQ ID NO: 279412 - RNA, 66 nt, hsa; identical to SEQ ID NO: 253639

SEQ ID NO: 279413 - RNA, 66 nt, hsa; identical to SEQ ID NO: 253640

SEQ ID NO: 279414 - RNA, 66 nt, hsa; identical to SEQ ID NO: 253641

SEQ ID NO: 279415 - RNA, 66 nt, hsa; identical to SEQ ID NO: 253642

SEQ ID NO: 279416 - RNA, 66 nt, hsa; identical to SEQ ID NO: 253643

SEQ ID NO: 279417 - RNA, 66 nt, hsa; identical to SEQ ID NO: 253644

SEQ ID NO: 279418 - RNA, 66 nt, hsa; identical to SEQ ID NO: 253645

SEQ ID NO: 279419 - RNA, 66 nt, hsa; identical to SEQ ID NO: 253646

SEQ ID NO: 279420 - RNA, 66 nt, hsa; identical to SEQ ID NO: 253647

SEQ ID NO: 279421 - RNA, 66 nt, hsa; identical to SEQ ID NO: 253648

SEQ ID NO: 279422 - RNA, 66 nt, hsa; identical to SEQ ID NO: 253649

SEQ ID NO: 279423 - RNA, 66 nt, hsa; identical to SEQ ID NO: 253650

SEQ ID NO: 279424 - RNA, 66 nt, hsa; identical to SEQ ID NO: 253651

SEQ ID NO: 279425 - RNA, 66 nt, hsa; identical to SEQ ID NO: 253652

SEQ ID NO: 279426 - RNA, 66 nt, hsa; identical to SEQ ID NO: 253653

SEQ ID NO: 279427 - RNA, 66 nt, hsa; identical to SEQ ID NO: 253654

SEQ ID NO: 279428 - RNA, 66 nt, hsa; identical to SEQ ID NO: 253655

SEQ ID NO: 279429 - RNA, 66 nt, hsa; identical to SEQ ID NO: 253656

SEQ ID NO: 279430 - RNA, 66 nt, hsa; identical to SEQ ID NO: 253657

SEQ ID NO: 279431 - RNA, 66 nt, hsa; identical to SEQ ID NO: 253658

SEQ ID NO: 279432 - RNA, 63 nt, hsa; identical to SEQ ID NO: 103195

SEQ ID NO: 279433 - RNA, 51 nt, hsa; identical to SEQ ID NO: 103196

SEQ ID NO: 279434 - RNA, 66 nt, hsa; identical to SEQ ID NO: 253661

SEQ ID NO: 279435 - RNA, 66 nt, hsa; identical to SEQ ID NO: 253662

SEQ ID NO: 279436 - RNA, 66 nt, hsa; identical to SEQ ID NO: 253663

SEQ ID NO: 279437 - RNA, 66 nt, hsa; identical to SEQ ID NO: 253664

SEQ ID NO: 279438 - RNA, 66 nt, hsa; identical to SEQ ID NO: 253665

SEQ ID NO: 279439 - RNA, 66 nt, hsa; identical to SEQ ID NO: 253666

SEQ ID NO: 279440 - RNA, 66 nt, hsa; identical to SEQ ID NO: 253667

SEQ ID NO: 279441 - RNA, 66 nt, hsa; identical to SEQ ID NO: 253668

SEQ ID NO: 279442 - RNA, 66 nt, hsa; identical to SEQ ID NO: 253669

SEQ ID NO: 279443 - RNA, 66 nt, hsa; identical to SEQ ID NO: 253670

SEQ ID NO: 279444 - RNA, 66 nt, hsa; identical to SEQ ID NO: 253671

SEQ ID NO: 279445 - RNA, 66 nt, hsa; identical to SEQ ID NO: 253672

SEQ ID NO: 279446 - RNA, 66 nt, hsa; identical to SEQ ID NO: 253673

SEQ ID NO: 279447 - RNA, 66 nt, hsa; identical to SEQ ID NO: 253674

SEQ ID NO: 279448 - RNA, 66 nt, hsa; identical to SEQ ID NO: 253675

SEQ ID NO: 279449 - RNA, 66 nt, hsa; identical to SEQ ID NO: 253676

SEQ ID NO: 279450 - RNA, 66 nt, hsa; identical to SEQ ID NO: 253677

SEQ ID NO: 279451 - RNA, 66 nt, hsa; identical to SEQ ID NO: 253678

SEQ ID NO: 279452 - RNA, 66 nt, hsa; identical to SEQ ID NO: 253679

SEQ ID NO: 279453 - RNA, 66 nt, hsa; identical to SEQ ID NO: 253680

SEQ ID NO: 279454 - RNA, 66 nt, hsa; identical to SEQ ID NO: 253681

SEQ ID NO: 279455 - RNA, 66 nt, hsa; identical to SEQ ID NO: 253682

SEQ ID NO: 279456 - RNA, 66 nt, hsa; identical to SEQ ID NO: 253683

SEQ ID NO: 279457 - RNA, 66 nt, hsa; identical to SEQ ID NO: 253684

SEQ ID NO: 279458 - RNA, 66 nt, hsa; identical to SEQ ID NO: 253685

SEQ ID NO: 279459 - RNA, 66 nt, hsa; identical to SEQ ID NO: 253686

SEQ ID NO: 279460 - RNA, 66 nt, hsa; identical to SEQ ID NO: 253687

SEQ ID NO: 279461 - RNA, 66 nt, hsa; identical to SEQ ID NO: 253688

SEQ ID NO: 279462 - RNA, 66 nt, hsa; identical to SEQ ID NO: 253689

SEQ ID NO: 279463 - RNA, 66 nt, hsa; identical to SEQ ID NO: 253690

SEQ ID NO: 279464 - RNA, 66 nt, hsa; identical to SEQ ID NO: 253691

SEQ ID NO: 279465 - RNA, 66 nt, hsa; identical to SEQ ID NO: 253692

SEQ ID NO: 279466 - RNA, 66 nt, hsa; identical to SEQ ID NO: 253693

SEQ ID NO: 279467 - RNA, 66 nt, hsa; identical to SEQ ID NO: 253694

SEQ ID NO: 279468 - RNA, 66 nt, hsa; identical to SEQ ID NO: 253695

SEQ ID NO: 279469 - RNA, 66 nt, hsa; identical to SEQ ID NO: 253696

SEQ ID NO: 279470 - RNA, 66 nt, hsa; identical to SEQ ID NO: 253697

SEQ ID NO: 279471 - RNA, 66 nt, hsa; identical to SEQ ID NO: 253698

SEQ ID NO: 279472 - RNA, 66 nt, hsa; identical to SEQ ID NO: 253699

SEQ ID NO: 279473 - RNA, 66 nt, hsa; identical to SEQ ID NO: 253700

SEQ ID NO: 279474 - RNA, 66 nt, hsa; identical to SEQ ID NO: 253701

SEQ ID NO: 279475 - RNA, 66 nt, hsa; identical to SEQ ID NO: 253702

SEQ ID NO: 279476 - RNA, 66 nt, hsa; identical to SEQ ID NO: 253703

SEQ ID NO: 279477 - RNA, 66 nt, hsa; identical to SEQ ID NO: 253704

SEQ ID NO: 279478 - RNA, 66 nt, hsa; identical to SEQ ID NO: 253705

SEQ ID NO: 279479 - RNA, 66 nt, hsa; identical to SEQ ID NO: 253706

SEQ ID NO: 279480 - RNA, 66 nt, hsa; identical to SEQ ID NO: 253707

SEQ ID NO: 279481 - RNA, 66 nt, hsa; identical to SEQ ID NO: 253708

SEQ ID NO: 279482 - RNA, 66 nt, hsa; identical to SEQ ID NO: 253709

SEQ ID NO: 279483 - RNA, 66 nt, hsa; identical to SEQ ID NO: 253710

SEQ ID NO: 279484 - RNA, 66 nt, hsa; identical to SEQ ID NO: 253711

SEQ ID NO: 279485 - RNA, 66 nt, hsa; identical to SEQ ID NO: 253712

SEQ ID NO: 279486 - RNA, 66 nt, hsa; identical to SEQ ID NO: 253713

SEQ ID NO: 279487 - RNA, 66 nt, hsa; identical to SEQ ID NO: 253714

SEQ ID NO: 279488 - RNA, 66 nt, hsa; identical to SEQ ID NO: 253715

SEQ ID NO: 279489 - RNA, 66 nt, hsa; identical to SEQ ID NO: 253716

SEQ ID NO: 279490 - RNA, 66 nt, hsa; identical to SEQ ID NO: 253717

SEQ ID NO: 279491 - RNA, 66 nt, hsa; identical to SEQ ID NO: 253718

SEQ ID NO: 279492 - RNA, 66 nt, hsa; identical to SEQ ID NO: 253719

SEQ ID NO: 279493 - RNA, 66 nt, hsa; identical to SEQ ID NO: 253720

SEQ ID NO: 279494 - RNA, 66 nt, hsa; identical to SEQ ID NO: 253721

SEQ ID NO: 279495 - RNA, 66 nt, hsa; identical to SEQ ID NO: 253722

SEQ ID NO: 279496 - RNA, 66 nt, hsa; identical to SEQ ID NO: 253723

SEQ ID NO: 279497 - RNA, 66 nt, hsa; identical to SEQ ID NO: 253724

SEQ ID NO: 279498 - RNA, 66 nt, hsa; identical to SEQ ID NO: 253725

SEQ ID NO: 279499 - RNA, 66 nt, hsa; identical to SEQ ID NO: 253726

SEQ ID NO: 279500 - RNA, 66 nt, hsa; identical to SEQ ID NO: 253727

SEQ ID NO: 279501 - RNA, 66 nt, hsa; identical to SEQ ID NO: 253728

SEQ ID NO: 279502 - RNA, 66 nt, hsa; identical to SEQ ID NO: 253729

SEQ ID NO: 279503 - RNA, 66 nt, hsa; identical to SEQ ID NO: 253730

SEQ ID NO: 279504 - RNA, 66 nt, hsa; identical to SEQ ID NO: 253731

SEQ ID NO: 279505 - RNA, 66 nt, hsa; identical to SEQ ID NO: 253732

SEQ ID NO: 279506 - RNA, 66 nt, hsa; identical to SEQ ID NO: 253733

SEQ ID NO: 279507 - RNA, 66 nt, hsa; identical to SEQ ID NO: 253734

SEQ ID NO: 279508 - RNA, 66 nt, hsa; identical to SEQ ID NO: 253735

SEQ ID NO: 279509 - RNA, 66 nt, hsa; identical to SEQ ID NO: 253736

SEQ ID NO: 279510 - RNA, 66 nt, hsa; identical to SEQ ID NO: 253737

SEQ ID NO: 279511 - RNA, 66 nt, hsa; identical to SEQ ID NO: 253738

SEQ ID NO: 279512 - RNA, 66 nt, hsa; identical to SEQ ID NO: 253739

SEQ ID NO: 279513 - RNA, 66 nt, hsa; identical to SEQ ID NO: 253740

SEQ ID NO: 279514 - RNA, 66 nt, hsa; identical to SEQ ID NO: 253741

SEQ ID NO: 279515 - RNA, 66 nt, hsa; identical to SEQ ID NO: 253742

SEQ ID NO: 279516 - RNA, 66 nt, hsa; identical to SEQ ID NO: 253743

SEQ ID NO: 279517 - RNA, 66 nt, hsa; identical to SEQ ID NO: 253744

SEQ ID NO: 279518 - RNA, 66 nt, hsa; identical to SEQ ID NO: 253745

SEQ ID NO: 279519 - RNA, 66 nt, hsa; identical to SEQ ID NO: 253746

SEQ ID NO: 279520 - RNA, 66 nt, hsa; identical to SEQ ID NO: 253747

SEQ ID NO: 279521 - RNA, 66 nt, hsa; identical to SEQ ID NO: 253748

SEQ ID NO: 279522 - RNA, 66 nt, hsa; identical to SEQ ID NO: 253749

SEQ ID NO: 279523 - RNA, 66 nt, hsa; identical to SEQ ID NO: 253750

SEQ ID NO: 279524 - RNA, 66 nt, hsa; identical to SEQ ID NO: 253751

SEQ ID NO: 279525 - RNA, 66 nt, hsa; identical to SEQ ID NO: 253752

SEQ ID NO: 279526 - RNA, 64 nt, hsa
auaacugcugccuggcaaacugcaaacaagcagcaucacucaaguuugaaguuucgccgcuuuu

SEQ ID NO: 279527 - RNA, 64 nt, hsa
aaaauaaauaaaugaguacaucuccccuucccacaucacucaaggcauaagcagauuuuacugu

SEQ ID NO: 279528 - RNA, 64 nt, hsa
gcuuaggcauguucaaacgccugcaaaacuacuuaucacucagcuuuaguuuuucuaauccaag

SEQ ID NO: 279529 - RNA, 64 nt, hsa
uuguuuagaaaugcuguugcuucagguucuuaaaaucacucagcacuccaacuucuaaucaaau

SEQ ID NO: 279530 - RNA, 64 nt, hsa
cccgucauacccguaaugcuuucuuuuuuccuuuauugccaaucuuugaacucauucaacucca

SEQ ID NO: 279531 - RNA, 64 nt, hsa
gcuucuguuuauuccagaagcauuaagguaacccauugccaaguaucauucuugcaaauuauuc

SEQ ID NO: 279532 - RNA, 64 nt, hsa
ccaauaauuaaaaauuuaaaauuuuuaaauuagaauugccaauacuucuacauuugagaagggu

SEQ ID NO: 279533 - RNA, 64 nt, hsa
uaaggacuuuugugcaauauggucuuaagaaauaauugccaaaaaaaucggccaugguuugcau

SEQ ID NO: 279534 - RNA, 64 nt, hsa
uuaaguuuggagaaaauaccacacaaaacaaugaauugccaaauuguuuguuuuauucaagacu

SEQ ID NO: 279535 - RNA, 64 nt, hsa
ggaauuuuuauuaugucaccucuaaaacacuuaaauugccaaauuuggcuaguaguuuuguuuc

SEQ ID NO: 279536 - RNA, 64 nt, hsa
uuucucaggaucuuauuagguugaaccauauguaauugccaagauuuuacuauuuuaacuuaga

SEQ ID NO: 279537 - RNA, 64 nt, hsa
cccacaucucuuggaggagccgaucuugaaauccauugccaagaaacacagucgaagcccaggc

SEQ ID NO: 279538 - RNA, 64 nt, hsa
ccugagagaggcagauuugagugaggugcauaggauugccaaaacuuucgugaguaucuuucac

SEQ ID NO: 279539 - RNA, 64 nt, hsa
aauuguuuguaaauaaugaaccuuauuuuuuauuauugccaauccccuaagauauuguauuuua

SEQ ID NO: 279540 - RNA, 64 nt, hsa
ccccugcugcugcccaagccgcugggccuuuuuaauugccaaacugcucucuucaucagcucag

SEQ ID NO: 279541 - RNA, 64 nt, hsa
gaaaccuagauauuuaugugaaaccucccaguguauugccaacuaaaucaaauuuuuaaagaug

SEQ ID NO: 279542 - RNA, 64 nt, hsa
aagccugcuggaagucucccugccgugggcucucauugccaauauggaacagagcccagggcca

SEQ ID NO: 279543 - RNA, 64 nt, hsa
cauauccuacacagaaaaauacuuuuagacuuauauugccaagccaaaguuaccauauuuuggu

SEQ ID NO: 279544 - RNA, 64 nt, hsa
cccuaccauggcuauuccagcaccccaaccuguaauugccaaguccucuaagguacuaauuugu

SEQ ID NO: 279545 - RNA, 64 nt, hsa; identical to SEQ ID NO: 58517

SEQ ID NO: 279546 - RNA, 64 nt, hsa; identical to SEQ ID NO: 58518

SEQ ID NO: 279547 - RNA, 64 nt, hsa; identical to SEQ ID NO: 58519

SEQ ID NO: 279548 - RNA, 64 nt, hsa; identical to SEQ ID NO: 58520

SEQ ID NO: 279549 - RNA, 64 nt, hsa; identical to SEQ ID NO: 58521

SEQ ID NO: 279550 - RNA, 64 nt, hsa; identical to SEQ ID NO: 58522

SEQ ID NO: 279551 - RNA, 64 nt, hsa; identical to SEQ ID NO: 58523

SEQ ID NO: 279552 - RNA, 64 nt, hsa; identical to SEQ ID NO: 58524

SEQ ID NO: 279553 - RNA, 64 nt, hsa; identical to SEQ ID NO: 58525

SEQ ID NO: 279554 - RNA, 64 nt, hsa; identical to SEQ ID NO: 58526

SEQ ID NO: 279555 - RNA, 64 nt, hsa; identical to SEQ ID NO: 58527

SEQ ID NO: 279556 - RNA, 64 nt, hsa; identical to SEQ ID NO: 58528

SEQ ID NO: 279557 - RNA, 64 nt, hsa; identical to SEQ ID NO: 58529

SEQ ID NO: 279558 - RNA, 64 nt, hsa; identical to SEQ ID NO: 58530

SEQ ID NO: 279559 - RNA, 64 nt, hsa; identical to SEQ ID NO: 58531

SEQ ID NO: 279560 - RNA, 64 nt, hsa; identical to SEQ ID NO: 58532

SEQ ID NO: 279561 - RNA, 64 nt, hsa
acagaucuuggauauguuguucaauuuucuuucugagccagacuaguuuacgcuauucaaaucu

SEQ ID NO: 279562 - RNA, 64 nt, hsa
auuuuuauauugaggaacaauauuggguguuugggagccagaaagcuuuguugacagaucagaa

SEQ ID NO: 279563 - RNA, 64 nt, hsa
gucugaaaagcaagucccccagccccaccccagggagccagagaggcuugcacucaggagagaa

SEQ ID NO: 279564 - RNA, 64 nt, hsa
aucucccgcccucugggguuugaguggagguauggagccagagaggcuauccuagcuaccuucc

SEQ ID NO: 279565 - RNA, 64 nt, hsa
uacaggcggcuccagcccugggcagcggcuucaagagccagagugggaagucaggccucucugg

SEQ ID NO: 279566 - RNA, 64 nt, hsa
uggcugcuggcuuucaagcgugguuuuuugcuaagagccagaggcaggucuucuggaguucuca

SEQ ID NO: 279567 - RNA, 64 nt, hsa
acauagauccgagggcagcagugcuggguggagagagccagaaaacagaucuggaggcagcagu

SEQ ID NO: 279568 - RNA, 64 nt, hsa
ugggggcuaaauuaauuggaguggggcgaggagagagccagaaaacauagauccgagggcagca

SEQ ID NO: 279569 - RNA, 64 nt, hsa
cuggaucuccucuuuuaccugcuaggacuggaaagagccagaagugggguggccugaagcccuc

SEQ ID NO: 279570 - RNA, 64 nt, hsa
gauccaguagcccuggagguuccccagguagggagagccagaggugccagccuuccugaagggc

SEQ ID NO: 279571 - RNA, 64 nt, hsa
guccuccugcaggaaaguacgucacaucauaccagagccagaggucagugcugaagacguggac

SEQ ID NO: 279572 - RNA, 64 nt, hsa
gcgccugucuuacccgguggccuuggcccagaaggagccagaggcagcagccucagccccaggg

SEQ ID NO: 279573 - RNA, 64 nt, hsa
guuaguuccagccugcuauaccucagaugggagagagccagagagaggagugaggguggcucaa

SEQ ID NO: 279574 - RNA, 61 nt, hsa
ugcgacacugcugcacguaggugccucaccagagccagauuaucuggucuuccaagacuuu

SEQ ID NO: 279575 - RNA, 64 nt, hsa
uccaguuguccccagagcacccugggccugggcugagccagaccagacccuugggagguggccc

SEQ ID NO: 279576 - RNA, 64 nt, hsa
uaggccagggcaggcuaccagccacaucuucuaugagccagaugcuuaugaugaccuggaccaa

SEQ ID NO: 279577 - RNA, 64 nt, hsa
ccgccucugucuccggccaccggguggcgcugccgagccagagccgccgcgucccggcgcuuuc

SEQ ID NO: 279578 - RNA, 64 nt, hsa
ucugggccgaagcacgucccaccacacagugccagagccagagaaggggccccaccaccaaggc

SEQ ID NO: 279579 - RNA, 64 nt, hsa
cuccaagccuggggaaggacguggcauccaagcugagccagagggaacugcugcuguccucccu

SEQ ID NO: 279580 - RNA, 63 nt, hsa
uuguucaccuccugaccugaccgucgcuuaccagagccagaaguuccugcugaggacaugagg

SEQ ID NO: 279581 - RNA, 64 nt, hsa
agcugucgguccccagcccugcccggcgggcccggagccagagccgcgaggagcaggcugugcu

SEQ ID NO: 279582 - RNA, 64 nt, hsa
auggcaugcccugcacucagucaccccgagggcugagccagauuccuggaugugauggaccagc

SEQ ID NO: 279583 - RNA, 64 nt, hsa
acuguguugcauucuugcacaagucaugaaaauggagccagagagccuggacaucagggacuuu

SEQ ID NO: 279584 - RNA, 64 nt, hsa
gaaguccagucccgacagugcccuuguugccuuugagccagauccauggcaauggucuccccac

SEQ ID NO: 279585 - RNA, 64 nt, hsa
guaaaagucucguugcucauauauaguagacaaagagccagaaaauuaacugaaaagcaguuua

SEQ ID NO: 279586 - RNA, 64 nt, hsa
augaccccagagcagugcagccaccagggaaggugagccagacacaggccgggacaaaacgcag

SEQ ID NO: 279587 - RNA, 64 nt, hsa
ccccauucccccagggaacaucuugcugcucucagagccagaaaaugcugacagccucaugcug

SEQ ID NO: 279588 - RNA, 64 nt, hsa
agaaggcaucugagucuccuaacccaagauggaagagccagagggcucuggagugagcagaacc

SEQ ID NO: 279589 - RNA, 64 nt, hsa
aggcagagauugaagccaucagagcugggguugggagccagaaugccugaguccuucuguccgu

SEQ ID NO: 279590 - RNA, 64 nt, hsa
cuccgcccccacccccgccgccagaggaguacaagagccagaggcccgucuccaacuccucauc

SEQ ID NO: 279591 - RNA, 64 nt, hsa; identical to SEQ ID NO: 126039

SEQ ID NO: 279592 - RNA, 64 nt, hsa; identical to SEQ ID NO: 126040

SEQ ID NO: 279593 - RNA, 64 nt, hsa; identical to SEQ ID NO: 126041

SEQ ID NO: 279594 - RNA, 64 nt, hsa; identical to SEQ ID NO: 126042

SEQ ID NO: 279595 - RNA, 64 nt, hsa; identical to SEQ ID NO: 209225

SEQ ID NO: 279596 - RNA, 64 nt, hsa; identical to SEQ ID NO: 209226

SEQ ID NO: 279597 - RNA, 64 nt, hsa; identical to SEQ ID NO: 209227

SEQ ID NO: 279598 - RNA, 64 nt, hsa; identical to SEQ ID NO: 209228

SEQ ID NO: 279599 - RNA, 64 nt, hsa; identical to SEQ ID NO: 209229

SEQ ID NO: 279600 - RNA, 64 nt, hsa; identical to SEQ ID NO: 209230

SEQ ID NO: 279601 - RNA, 64 nt, hsa; identical to SEQ ID NO: 209231

SEQ ID NO: 279602 - RNA, 64 nt, hsa; identical to SEQ ID NO: 209232

SEQ ID NO: 279603 - RNA, 64 nt, hsa; identical to SEQ ID NO: 209233

SEQ ID NO: 279604 - RNA, 64 nt, hsa; identical to SEQ ID NO: 209234

SEQ ID NO: 279605 - RNA, 64 nt, hsa; identical to SEQ ID NO: 209235

SEQ ID NO: 279606 - RNA, 64 nt, hsa; identical to SEQ ID NO: 209236

SEQ ID NO: 279607 - RNA, 64 nt, hsa; identical to SEQ ID NO: 209237

SEQ ID NO: 279608 - RNA, 64 nt, hsa; identical to SEQ ID NO: 209238

SEQ ID NO: 279609 - RNA, 64 nt, hsa; identical to SEQ ID NO: 209239

SEQ ID NO: 279610 - RNA, 64 nt, hsa; identical to SEQ ID NO: 209240

SEQ ID NO: 279611 - RNA, 64 nt, hsa; identical to SEQ ID NO: 209241

SEQ ID NO: 279612 - RNA, 64 nt, hsa; identical to SEQ ID NO: 209242

SEQ ID NO: 279613 - RNA, 64 nt, hsa; identical to SEQ ID NO: 209243

SEQ ID NO: 279614 - RNA, 64 nt, hsa; identical to SEQ ID NO: 209244

SEQ ID NO: 279615 - RNA, 64 nt, hsa; identical to SEQ ID NO: 209245

SEQ ID NO: 279616 - RNA, 64 nt, hsa; identical to SEQ ID NO: 209246

SEQ ID NO: 279617 - RNA, 64 nt, hsa; identical to SEQ ID NO: 209247

SEQ ID NO: 279618 - RNA, 64 nt, hsa; identical to SEQ ID NO: 209248

SEQ ID NO: 279619 - RNA, 64 nt, hsa; identical to SEQ ID NO: 209249

SEQ ID NO: 279620 - RNA, 64 nt, hsa; identical to SEQ ID NO: 209250

SEQ ID NO: 279621 - RNA, 64 nt, hsa; identical to SEQ ID NO: 209251

SEQ ID NO: 279622 - RNA, 64 nt, hsa; identical to SEQ ID NO: 209252

SEQ ID NO: 279623 - RNA, 64 nt, hsa; identical to SEQ ID NO: 209253

SEQ ID NO: 279624 - RNA, 64 nt, hsa; identical to SEQ ID NO: 209254

SEQ ID NO: 279625 - RNA, 64 nt, hsa; identical to SEQ ID NO: 209255

SEQ ID NO: 279626 - RNA, 64 nt, hsa; identical to SEQ ID NO: 209256

SEQ ID NO: 279627 - RNA, 64 nt, hsa; identical to SEQ ID NO: 209257

SEQ ID NO: 279628 - RNA, 64 nt, hsa; identical to SEQ ID NO: 209258

SEQ ID NO: 279629 - RNA, 64 nt, hsa; identical to SEQ ID NO: 209259

SEQ ID NO: 279630 - RNA, 64 nt, hsa; identical to SEQ ID NO: 209260

SEQ ID NO: 279631 - RNA, 64 nt, hsa; identical to SEQ ID NO: 209261

SEQ ID NO: 279632 - RNA, 64 nt, hsa; identical to SEQ ID NO: 209262

SEQ ID NO: 279633 - RNA, 64 nt, hsa; identical to SEQ ID NO: 209263

SEQ ID NO: 279634 - RNA, 64 nt, hsa; identical to SEQ ID NO: 209264

SEQ ID NO: 279635 - RNA, 64 nt, hsa; identical to SEQ ID NO: 209263

SEQ ID NO: 279636 - RNA, 64 nt, hsa; identical to SEQ ID NO: 209266

SEQ ID NO: 279637 - RNA, 64 nt, hsa; identical to SEQ ID NO: 209267

SEQ ID NO: 279638 - RNA, 64 nt, hsa; identical to SEQ ID NO: 209268

SEQ ID NO: 279639 - RNA, 64 nt, hsa; identical to SEQ ID NO: 209269

SEQ ID NO: 279640 - RNA, 64 nt, hsa; identical to SEQ ID NO: 209270

SEQ ID NO: 279641 - RNA, 64 nt, hsa; identical to SEQ ID NO: 209271

SEQ ID NO: 279642 - RNA, 64 nt, hsa; identical to SEQ ID NO: 209272

SEQ ID NO: 279643 - RNA, 64 nt, hsa; identical to SEQ ID NO: 209273

SEQ ID NO: 279644 - RNA, 64 nt, hsa; identical to SEQ ID NO: 209274

SEQ ID NO: 279645 - RNA, 64 nt, hsa; identical to SEQ ID NO: 209275

SEQ ID NO: 279646 - RNA, 64 nt, hsa; identical to SEQ ID NO: 102053

SEQ ID NO: 279647 - RNA, 64 nt, hsa; identical to SEQ ID NO: 102054

SEQ ID NO: 279648 - RNA, 64 nt, hsa; identical to SEQ ID NO: 102055

SEQ ID NO: 279649 - RNA, 64 nt, hsa; identical to SEQ ID NO: 102056

SEQ ID NO: 279650 - RNA, 64 nt, hsa; identical to SEQ ID NO: 102057

SEQ ID NO: 279651 - RNA, 64 nt, hsa; identical to SEQ ID NO: 102058

SEQ ID NO: 279652 - RNA, 64 nt, hsa; identical to SEQ ID NO: 102059

SEQ ID NO: 279653 - RNA, 64 nt, hsa; identical to SEQ ID NO: 102060

SEQ ID NO: 279654 - RNA, 64 nt, hsa; identical to SEQ ID NO: 102061

SEQ ID NO: 279655 - RNA, 64 nt, hsa; identical to SEQ ID NO: 102062

SEQ ID NO: 279656 - RNA, 64 nt, hsa; identical to SEQ ID NO: 102063

SEQ ID NO: 279657 - RNA, 64 nt, hsa; identical to SEQ ID NO: 102064

SEQ ID NO: 279658 - RNA, 52 nt, hsa; identical to SEQ ID NO: 102065

SEQ ID NO: 279659 - RNA, 63 nt, hsa; identical to SEQ ID NO: 102066

SEQ ID NO: 279660 - RNA, 64 nt, hsa; identical to SEQ ID NO: 102067

SEQ ID NO: 279661 - RNA, 64 nt, hsa; identical to SEQ ID NO: 102068

SEQ ID NO: 279662 - RNA, 64 nt, hsa; identical to SEQ ID NO: 102069

SEQ ID NO: 279663 - RNA, 62 nt, hsa
gcacauguauauuacuaaaguagauaauuccaaugagaaauacuaccagauuauuguuauaa

SEQ ID NO: 279664 - RNA, 62 nt, hsa
gaagcaguguaguucuaccucucauuuuacagaugagaaaaccgaagcccagaaaaacucuc

SEQ ID NO: 279665 - RNA, 62 nt, hsa
ggaugugcuuugaucguuaaugagguggucacaugagaaaugauaccuguuacuacuguauu

SEQ ID NO: 279666 - RNA, 62 nt, hsa
aucuuuuacuacuugaacauuuaaauuucuaaaugagaaagguauauauauuacuguaacug

SEQ ID NO: 279667 - RNA, 62 nt, hsa
uaaguggccuggugaguggagguagaaaaaugaugagaaaugaacugagagcauuaagcaga

SEQ ID NO: 279668 - RNA, 62 nt, hsa
auuuagggacaaagaagguauaaaguccagagaugagaaaacugggucagcccucagaaacu

SEQ ID NO: 279669 - RNA, 62 nt, hsa
caaauguuguggaaaacuggaauauuaagaaaaugagaaauuauauuuauuagaauaaaaug

SEQ ID NO: 279670 - RNA, 62 nt, hsa
uuugucacuugagcuuauguacagaaugcuauaugagaaacacuuuuagaauggauuuauuu

SEQ ID NO: 279671 - RNA, 62 nt, hsa
gauguuauuauauaugcuuaugaaacagauuuaugagaaaaguuuuuuuuaaauaaauuauu

SEQ ID NO: 279672 - RNA, 62 nt, hsa
uuauauuuguuuuccuguauuuagguggagaaaugagaaaaagcuuuaguuccaauugacag

SEQ ID NO: 279673 - RNA, 62 nt, hsa
ggcaguguaacaaccuauagugccauugauccaugagaaaaagauuuucugguacuacucca

SEQ ID NO: 279674 - RNA, 62 nt, hsa
acuuuuaauuuuuauuuuggcaaaacugucaaaugagaaaaaugauuuuaaaaacuuuuuuu

SEQ ID NO: 279675 - RNA, 62 nt, hsa
aguuuauuuuuaccaaagagaugcaauucauuaugagaaaguauugcauaauaaauuuuguu

SEQ ID NO: 279676 - RNA, 62 nt, hsa
ggggccagaccuuugccugauuccugauucccaugagaaaucagaacugcuuucugcagcaa

SEQ ID NO: 279677 - RNA, 62 nt, hsa
aaaaccuaccucaggguugcuucaaggauuaaaugagaaaauaugucaacaauaaagaccug

SEQ ID NO: 279678 - RNA, 62 nt, hsa
ucagaaacaaccagccuugaaggcuacaacugaugagaaagauucuguuucgaacauagcca

SEQ ID NO: 279679 - RNA, 62 nt, hsa
ugagaaaccaccaggcuugaaggcuacaagugaugagaaagauucuguuuugaauauagcca

SEQ ID NO: 279680 - RNA, 62 nt, hsa
uguccuauuucugauuauuaagacuaguauaaaugagaaaauccaagcuauuaaguaccauu

SEQ ID NO: 279681 - RNA, 62 nt, hsa
ucagagaaauuugauagacucaaacagauaguaugagaaauaucuuugaaagaaauauggag

SEQ ID NO: 279682 - RNA, 62 nt, hsa
ugaaauugcauuacaguucauaaaaauugaaaaugagaaauuaaaccugcaagugaaacauu

SEQ ID NO: 279683 - RNA, 62 nt, hsa
ucaguaaaaauagugaagacaugcaucauggaaugagaaaaugagaaaggaaugaguugucu

SEQ ID NO: 279684 - RNA, 62 nt, hsa
aauagugaagacaugcaucauggaaugagaaaaugagaaaggaaugaguugucuaacaucac

SEQ ID NO: 279685 - RNA, 62 nt, hsa
aaauccuaaucaggaaaaagacucaucuaguaaugagaaacaaacuauuagucugccaguuu

SEQ ID NO: 279686 - RNA, 62 nt, hsa
uuaauagcagcagcauguucaguuucgcuuauaugagaaacauguuuaggcaacuagucaga

SEQ ID NO: 279687 - RNA, 62 nt, hsa
ucuuacaagaaugaagccauauucaaccccagaugagaaaacccaacagauccaucccuuga

SEQ ID NO: 279688 - RNA, 62 nt, hsa
ucauaauaaauagcaaaauaauugaagcuuccaugagaaagaaaacacuauuuugauaaauu

SEQ ID NO: 279689 - RNA, 62 nt, hsa
uaauuuccuucuuuaaagcaaguauauauaguaugagaaacuuggaggcauuucauacacac

SEQ ID NO: 279690 - RNA, 62 nt, hsa
auuuaggcaauguuucucauuuggaaaaugaaaugagaaauaauuuccuucuuuaaagcaag

SEQ ID NO: 279691 - RNA, 62 nt, hsa
augcacacacacaaaaaauaccuaaauuuuggaugagaaaaugauaaaauaugcuaaguucu

SEQ ID NO: 279692 - RNA, 62 nt, hsa
ggugggaugguaauggggauuagagaacugacaugagaaaagaggagcuguuuugguauuaa

SEQ ID NO: 279693 - RNA, 62 nt, hsa
cuucaauccuggccaaguuggaguagacugguaugagaaaacuaugauuaguucacauuuac

SEQ ID NO: 279694 - RNA, 62 nt, hsa
acuuguacuucuaauaacauuuuucaugaaucaugagaaaauuuccacagauacuucccuua

SEQ ID NO: 279695 - RNA, 62 nt, hsa
cccuugauucuggcaaggcaaauaaagccagaaugagaaauuaccaucuucuacuagagaaa

SEQ ID NO: 279696 - RNA, 62 nt, hsa
aacuacauguauguguggcauuuuuguuagagaugagaaaaggauugagaaggauaaacugg

SEQ ID NO: 279697 - RNA, 62 nt, hsa
ucgcuguuuaaguagaacaaugccaacgauguaugagaaacagggaauaaaucaggauuugu

SEQ ID NO: 279698 - RNA, 62 nt, hsa
accuugaucuuggacuuccagccuccaaaacuaugagaaauaaauuucuauuguuuaaguca

SEQ ID NO: 279699 - RNA, 62 nt, hsa
uuuuuuauuugggauaauuuaaaaaaugauggaugagaaaagaaagauugguccggguuaau

SEQ ID NO: 279700 - RNA, 62 nt, hsa
caaguagcuuacaaggggacaauucuggacuaaugagaaagaccugaagugaaggcuagaga

SEQ ID NO: 279701 - RNA, 62 nt, hsa
gauggugagcacaagguaagucauaaagaauaaugagaaaauaaaucuaugcuggugcagcu

SEQ ID NO: 279702 - RNA, 62 nt, hsa
uaucaguuaggcaauguuuuuaaaacuuaguaaugagaaacugugaaaagagccaaguguua

SEQ ID NO: 279703 - RNA, 62 nt, hsa
gaauuaguccaaauggaaccccuugaaggauaaugagaaaccacaaggccugccucugacug

SEQ ID NO: 279704 - RNA, 62 nt, hsa
gauugagagagacacuacaugacuccaaguauaugagaaaaggacagagcucuaauugauaa

SEQ ID NO: 279705 - RNA, 62 nt, hsa
uuaccaagauuaaaaagugagauaaauggucaaugagaaagaauggaagaugguaaacaauc

SEQ ID NO: 279706 - RNA, 62 nt, hsa
cuuaucagaacuccuuucuaaggagcacuagaaugagaaaucauguuguucgaucguuucac

SEQ ID NO: 279707 - RNA, 62 nt, hsa
ccaacuuaaaccugugcuuucauguuuaagaaaugagaaauugugccaaagauagcagaaga

SEQ ID NO: 279708 - RNA, 62 nt, hsa
guauucaauaauugggugcccuaaauuucuggaugagaaaauuuucaauucuggccaugaga

SEQ ID NO: 279709 - RNA, 62 nt, hsa
auuucuggaugagaaaauuuucaauucuggccaugagaaagaaaaaaaaauaaacagccuuc

SEQ ID NO: 279710 - RNA, 62 nt, hsa
uuuuacugccuuuccuuuuaauuuuuguuugaaugagaaaaguuuaauacaacaggugucca

SEQ ID NO: 279711 - RNA, 62 nt, hsa
auacuccauccccuucccucccagugaauggaaugagaaaagccuucuuccuuugcuucagg

SEQ ID NO: 279712 - RNA, 62 nt, hsa
aagcacuucuuacauggcggcagcaagagaaaaugagaaagaagcaaaaguggaaaccccua

SEQ ID NO: 279713 - RNA, 62 nt, hsa
augcaguugcuuagaauaaucauuacuguuauaugagaaacauuuuaguaauuuaauaaaag

SEQ ID NO: 279714 - RNA, 62 nt, hsa
auaguacauauugcuuuguuuaugucuuugagaugagaaaggcuuaaaacuugagaauauau

SEQ ID NO: 279715 - RNA, 62 nt, hsa
acugguugggguccauuuuguauauaacuuuuaugagaaaaaaaugguaauuauuucacgca

SEQ ID NO: 279716 - RNA, 62 nt, hsa
acaacaguuacauaauucacucugaguguuuuaugagaaagccuucuuuugggggucaacag

SEQ ID NO: 279717 - RNA, 62 nt, hsa
uguuucacaaggucuuuaaagugacuaauggcaugagaaauacaaaaauacucagauaaggu

SEQ ID NO: 279718 - RNA, 62 nt, hsa
ugauguuuuguauauuuuaauagacugauaggaugagaaagauuuauauuauuagauuucag

SEQ ID NO: 279719 - RNA, 62 nt, hsa
auuugaaaaauauugucauaucuggcccuuugaugagaaaaggaaauuacaauaauaaaguu

SEQ ID NO: 279720 - RNA, 62 nt, hsa
gccuucuaaaaagcagguuaaaaugcucuaaaaugagaaagccugugguuucacuuauuuau

SEQ ID NO: 279721 - RNA, 62 nt, hsa
uuuguaaaaugaagaguagaauuccaagaaaaaugagaaauaauuuuguaaaacuuaacaaa

SEQ ID NO: 279722 - RNA, 62 nt, hsa
acuucccugugauucccccgaauacccccaaaaugagaaacaaaauuuuuuuucuuacucca

SEQ ID NO: 279723 - RNA, 62 nt, hsa
guaccagcaagucaugagauuuuuuaguaaagaugagaaagaugguugaagaaaauuagugc

SEQ ID NO: 279724 - RNA, 62 nt, hsa
uuaauaaugcacuauuacccagggcagauauuaugagaaacuguuucuucucuaaggguuua

SEQ ID NO: 279725 - RNA, 62 nt, hsa
aucccacuuaugagauugggaaaaagaucaauaugagaaauaccauacagauaccuuaaaug

SEQ ID NO: 279726 - RNA, 62 nt, hsa
auuuaaauauuauguuugugaacuaucuaagcaugagaaaauacaaagcuuucuuuguaucu

SEQ ID NO: 279727 - RNA, 62 nt, hsa
ugucaugccagauugucagaaguuccagacagaugagaaagcaaaaaguacuuuguaaagug

SEQ ID NO: 279728 - RNA, 62 nt, hsa
auaaaaaauacagacuuaaugagcaacucaagaugagaaaacugcucuuuuuccaaaaauua

SEQ ID NO: 279729 - RNA, 62 nt, hsa
cuguacuugccccccuccccaaaaaaccauggaugagaaagaaaggagucaggggccugaua

SEQ ID NO: 279730 - RNA, 62 nt, hsa
ucaguaacccagcugcaauaccugucuguaauaugagaaaaaaaaaaugaaucuauuuaauc

SEQ ID NO: 279731 - RNA, 62 nt, hsa
agcuuacaagggcuagaucuaagauuauucccaugagaaauguugaauuuaugaagaauaga

SEQ ID NO: 279732 - RNA, 62 nt, hsa
aguuacucugcuacucuuaggcugcauaguuuaugagaaaaugaacacaugcauuuauggau

SEQ ID NO: 279733 - RNA, 62 nt, hsa
aucucuuucaccuuuauuucaucuucauaagaaugagaaaggcucaaaaggaagcacuuuua

SEQ ID NO: 279734 - RNA, 62 nt, hsa
ccccgguaacuggaggaaugggagccguuuugaugagaaaaaugggcuggagagaaggagaa

SEQ ID NO: 279735 - RNA, 62 nt, hsa
aaaauuggcaaccagccacuauuuuguugacuaugagaaaguuaaaaguuuauguuaauuuu

SEQ ID NO: 279736 - RNA, 62 nt, hsa
uaauuucaaauagaauauggacuuaaauguuaaugagaaaauggcuuuaaucaauucuagca

SEQ ID NO: 279737 - RNA, 62 nt, hsa
auuggaagauaaacuugucaaacuugucaagaaugagaaaagccaaauuagaaaauccuaug

SEQ ID NO: 279738 - RNA, 62 nt, hsa
acuccauuuguugagggucuuuguguucuucaaugagaaaucaaauuugagacguugaaauu

SEQ ID NO: 279739 - RNA, 62 nt, hsa
cugccuguuauaaagaugaacaaaaaaacuuaaugagaaagaucacagauacguaauaauuu

SEQ ID NO: 279740 - RNA, 62 nt, hsa
gcuaucuauaaaaaagagaaaaaagaaaaaaaaugagaaaaaaguaagaaaaaaaaaaaucc

SEQ ID NO: 279741 - RNA, 62 nt, hsa
ggaaagaaguuauagaaucuucauagaguucuaugagaaaaaauauacuugcuaucuauaaa

SEQ ID NO: 279742 - RNA, 64 nt, hsa
gcaaugggggccccugaugccaagagcucuggagguucuugaaagaggggacacgaaggaggag

SEQ ID NO: 279743 - RNA, 64 nt, hsa
auuaaauuucauuuaucuggaaaauuuuguaugaguucuugaauaaaacuugggaaccaaaaug

SEQ ID NO: 279744 - RNA, 64 nt, hsa
cagcuaugaacacauccuaaccaggauauacucuguucuugaacaacauacaaaguuuaaagua

SEQ ID NO: 279745 - RNA, 64 nt, hsa
ucuuuuuaagcuguuuuaugaaaaagaccuagaaguucuugauucauuuuuaccauucuuucca

SEQ ID NO: 279746 - RNA, 64 nt, hsa
uucaugccuuaacucggguuacugcacaacuuuaguucuugacuuagucugcaccgucaucuag

SEQ ID NO: 279747 - RNA, 64 nt, hsa
cgaacauuuccugauaaaugccuuuuagagauagguucuugauauucagacaucugcagaaaug

SEQ ID NO: 279748 - RNA, 64 nt, hsa
gcugccuuuuacguuuucuuguccuuucaaaaguguucuugaaagaaacaaagcgaauaggcag

SEQ ID NO: 279749 - RNA, 64 nt, hsa
ucagauguuuaccagaguguguauuuuacauaauguucuugauuaaaaagacuuguuuguaaau

SEQ ID NO: 279750 - RNA, 64 nt, hsa
ugauccaccaauggaauuagauggguagaguuggguucuugaguuuuaccaccacuuaguuccc

SEQ ID NO: 279751 - RNA, 64 nt, hsa
guucucacuguauucuuuuuauccuggggccacaguucuugauuauuccucuugugguuaaaga

SEQ ID NO: 279752 - RNA, 64 nt, hsa
ugguacaaggugacccuuaauuacccguaucaugguucuugaccagcacauucaauccuccaac

SEQ ID NO: 279753 - RNA, 64 nt, hsa
ccaauggccccauucagauggcaagggaggagguguucuugaagacaggaggaggcucccgcug

SEQ ID NO: 279754 - RNA, 64 nt, hsa
guauuuuguaaacugauguuugugauggucucugguucuugaacagccauaucugaaugccgug

SEQ ID NO: 279755 - RNA, 64 nt, hsa
uguaaagaaaacuuacagaagaggcaacaauuugguucuugacagugagaggauauugagggcu

SEQ ID NO: 279756 - RNA, 64 nt, hsa
uauaaugcugucagcucaaaaucauagccagguaguucuugaacucagaacuuaaauccugcac

SEQ ID NO: 279757 - RNA, 64 nt, hsa
cagagggaguugugcuggagauugugaaaaauggguucuugaaugaucuacuauaaggcaggga

SEQ ID NO: 279758 - RNA, 64 nt, hsa
ugguauagacugccucuggggaagcaaguuggcaguucuugaacagcaucagauaucaagaguu

SEQ ID NO: 279759 - RNA, 64 nt, hsa
guggguuuagaaagacugaagugacagauuaagaguucuugauauuagauaacuccaacuucug

SEQ ID NO: 279760 - RNA, 64 nt, hsa
agcacugcugugcagaccuagagguccuuagaacauagucuaagaaccauucauuguagccauu

SEQ ID NO: 279761 - RNA, 64 nt, hsa
gcuaaaugguacugauucucaaaacaaggagcucauagucuaaaaccauuuuucuuucuuuuuu

SEQ ID NO: 279762 - RNA, 64 nt, hsa
ucugcuccugccccuggccauuggugacuaguggggccaagagaagcuggagcagagagcuggc

SEQ ID NO: 279763 - RNA, 64 nt, hsa
aaucgcuugaacccaggagauggagauugcaguaggccaagaugaugccacugcacuccagccu

SEQ ID NO: 279764 - RNA, 64 nt, hsa
acagcccugagcauggggcuuaaugggacaauggggccaagagugaagcgggcagggccccugg

SEQ ID NO: 279765 - RNA, 64 nt, hsa
cccugccaaccaacugccucucugaggaggagguggccaagaagcggaaaaaccuggccacuua

SEQ ID NO: 279766 - RNA, 64 nt, hsa
ugaagcgggagauggcgcaggggcugcucccugaggccaagaagccucggcuccugcacggcac

SEQ ID NO: 279767 - RNA, 64 nt, hsa
cagagccggagagcgugcugcuggugcauggcgaggccaagaagauggaguuccugaagcagaa

SEQ ID NO: 279768 - RNA, 64 nt, hsa
ccuuccauuuccagccaggccucaucugggguagggccaagaggaaaguacagagugcccgugg

SEQ ID NO: 279769 - RNA, 64 nt, hsa
uggacaguagacuuuaucccuccuucuuacucugggccaagaccucccacuccgcccucugagg

SEQ ID NO: 279770 - RNA, 64 nt, hsa
cggacagaguagguggccgcuuugcgccauccggggccaagaggggguggacccgcgugucugg

SEQ ID NO: 279771 - RNA, 64 nt, hsa
gugguucuggccaggaaggcacaagguagcugugggccaagacaccagcccuguccuagcccuu

SEQ ID NO: 279772 - RNA, 64 nt, hsa
cuccuacgggucccuggggcagcuguccccaucaggccaagagcgagcgagaggcgcugcccca

SEQ ID NO: 279773 - RNA, 64 nt, hsa
cggcucuccugcgguguggcugguggccugccguggccaagagcaucuucuggguggauggaac

SEQ ID NO: 279774 - RNA, 64 nt, hsa
uggagcuuuagagagaugcacucagcuucguguuggccaagacuccuucugggccaauggggcu

SEQ ID NO: 279775 - RNA, 64 nt, hsa
cauuguggagcccauuauacuuugauuuaaaauaggccaagagaaucaggccuggagaucuagg

SEQ ID NO: 279776 - RNA, 62 nt, hsa
guccuccuggacccaucugagaugugcaguagcaaggagaggggggaucauuuuagagagug

SEQ ID NO: 279777 - RNA, 62 nt, hsa
cccagaaagcucuuuugaaaagacagacuccucaaggagagauaaagaggaaagcaccucuu

SEQ ID NO: 279778 - RNA, 62 nt, hsa
caaaguauagaaacauguucauugcacacacccaaggagaagagcucaagcgcuuggaagag

SEQ ID NO: 279779 - RNA, 62 nt, hsa
cugucuccaccuccaggauguccagcaggcugcaaggagaaggaugccagccacccauccuc

SEQ ID NO: 279780 - RNA, 62 nt, hsa
aaggagacuuucucucaucuuuccaagcaaggcaaggagacuuuuuaucauuaggaaacaaa

SEQ ID NO: 279781 - RNA, 62 nt, hsa
gaggaucucaucucucaucuguccaaacaaggcaaggagacuuucucucaucuuuccaagca

SEQ ID NO: 279782 - RNA, 62 nt, hsa
gauuaggaugugaaagguuguccuaaacagaccaaggagacuguucccuaauuuauucucuu

SEQ ID NO: 279783 - RNA, 62 nt, hsa
uugaaaaaaaauuuuuuuuuuuuggacagcuucaaggagauguuagcaauuucagauauacu

SEQ ID NO: 279784 - RNA, 62 nt, hsa
ccuuaggauaugacuaacucaccaaacaaugccaaggagaaaggcggacaggucaccaucac

SEQ ID NO: 279785 - RNA, 62 nt, hsa
cugaaaguguaggaggaaggaagagauacaaacaaggagaggaaaugaugggagaguguugu

SEQ ID NO: 279786 - RNA, 62 nt, hsa
cuuucccuucucuccaguucuccuucccuuaccaaggagaggggagcaaaugguuuugggca

SEQ ID NO: 279787 - RNA, 62 nt, hsa
uucuuuaucuuuuccuuucuucagacuccguccaaggagaugcucuccccggucuucugcug

SEQ ID NO: 279788 - RNA, 62 nt, hsa
gagugcaucccauauaggccauuuuagaaggccaaggagagccacaccgaaaaaggagacag

SEQ ID NO: 279789 - RNA, 62 nt, hsa
uauuggcaagaagguccccaggauagaccuagcaaggagauaagaauagaucauuaaaaaau

SEQ ID NO: 279790 - RNA, 62 nt, hsa
ucucuaccaagcuauccuggcucuuuggagaucaaggagaggaggcaacuuuccuuguuccc

SEQ ID NO: 279791 - RNA, 62 nt, hsa
cucuggccuguuuuagaagguucucuccuccccaaggagacacaacaacuccuagggccacu

SEQ ID NO: 279792 - RNA, 62 nt, hsa
cugcuuccccacgagcagcaggcaacggcguccaaggagacuaggaugaguucuuggcaagg

SEQ ID NO: 279793 - RNA, 62 nt, hsa
ccaaaauuagcaucucauugagccagagaagacaaggagaucucccucugggcaucuggcuu

SEQ ID NO: 279794 - RNA, 62 nt, hsa
cucuauggcucaccuuauuuggagugagaaaucaaggagacagagcugacugcaugaugagu

SEQ ID NO: 279795 - RNA, 62 nt, hsa
gagggcaacaggaagaugcaggccuucaagggcaaggagaggccacaaggaauauggguggg

SEQ ID NO: 279796 - RNA, 62 nt, hsa
aagcucccacccugggacagcaugccacugagcaaggagagaugggugagccugaagauggu

SEQ ID NO: 279797 - RNA, 62 nt, hsa
caggagcucugagguggcacccugccugacuccaaggagaagacugguggcccuguguucca

SEQ ID NO: 279798 - RNA, 62 nt, hsa
gauaaaauuuacaauagccacgcaauagccaucaaggagaauuucuauuaugauuauaaauu

SEQ ID NO: 279799 - RNA, 62 nt, hsa
ucuuaacaccuccaccagggggaaggcuggcacaaggagaaaaaaaaagcaagcaucagcga

SEQ ID NO: 279800 - RNA, 62 nt, hsa
gggagcccagugccagccagagguugugcaggcaaggagaccaaagauugaugagaagaccc

SEQ ID NO: 279801 - RNA, 62 nt, hsa
uacagggccaccagacuccuggagagaucaagcaaggagaaccuggggcugccauggccaaa

SEQ ID NO: 279802 - RNA, 64 nt, hsa
accaaucucaauuuagagguauggaugaugacagaaagcccaauagaagcuuaaugaugcuucu

SEQ ID NO: 279803 - RNA, 64 nt, hsa
caguuaugugggaaagguaaagcaacaccaaauaaaagcccacagcagcuucaucuuuacgaua

SEQ ID NO: 279804 - RNA, 64 nt, hsa
cuuaccugaaccagccugguccacugggaacucaaaagcccacgucaggaccacagacccccca

SEQ ID NO: 279805 - RNA, 64 nt, hsa
ggaagaaaugaaauguacaucugcagaaauugccaaagcccaaauuaacgaguauuauaaaagg

SEQ ID NO: 279806 - RNA, 64 nt, hsa
gaaggaaagcuuaaagcccaagcagauaaaaauaaaagcccagccuauuugucuugccugcugu

SEQ ID NO: 279807 - RNA, 64 nt, hsa
aggcagaaucugucacuugaaugaaggaaagcuuaaagcccaagcagauaaaaauaaaagccca

SEQ ID NO: 279808 - RNA, 64 nt, hsa
gggcccagccugaggaacccuggcucuuuucuuuaaagcccaggccccacuuacguaaaacauu

SEQ ID NO: 279809 - RNA, 64 nt, hsa
gacacuggcccucccacuucccucuuugacuuacaaagcccaccaggaagauccaggauaaucu

SEQ ID NO: 279810 - RNA, 64 nt, hsa
caacauaugaugaaaaccccaugaaggccucgaaaaagcccaagacagcagaagcagacaccuc

SEQ ID NO: 279811 - RNA, 64 nt, hsa
ucuaggcagacucagugggauccuccuacuugggaaagcccaggagaugaugccagccuugagc

SEQ ID NO: 279812 - RNA, 64 nt, hsa
gggccugggucugggcauggggaggccgugccucaaagcccacccuaccccaugccuuggugcu

SEQ ID NO: 279813 - RNA, 64 nt, hsa
caggcagacugggagcaggaaaacagagggccccaaagcccaaggcaccagaagguuuguuuca

SEQ ID NO: 279814 - RNA, 64 nt, hsa
ugacagagcaagacucugucucauaaauaaauacaaagcccauucuuccagagucuugugccuu

SEQ ID NO: 279815 - RNA, 64 nt, hsa
aaugccugaucacucuggccaaaugucagauacuaaagcccauucuuggccgggcauguuggcu

SEQ ID NO: 279816 - RNA, 64 nt, hsa
acagagcgagauuccgucucaaaaaaaaaaaaaaaaagcccaccugaaagccugucucuuucca

SEQ ID NO: 279817 - RNA, 64 nt, hsa
ggaaagcaugucucugcuuccauggcuuccugagaaagcccaccugggcugggcgcgguggcuc

SEQ ID NO: 279818 - RNA, 64 nt, hsa
gccccucgcuggcuuccccaccucucucaggaugaaagcccaagucaucaggguggcacgucag

SEQ ID NO: 279819 - RNA, 64 nt, hsa
cggccaucgccauugggaaggggcgacuccacggaaagcccagacgggcuucugcauccauucc

SEQ ID NO: 279820 - RNA, 64 nt, hsa
uaaacaguugccccagaaagacaugucuuguuuuaaagcccagaaccugaaauuauuauagauu

SEQ ID NO: 279821 - RNA, 64 nt, hsa
gucuccaggcuucacucaggguagagaaacaagcaaagcccagcagcgcacagggugcuuguua

SEQ ID NO: 279822 - RNA, 64 nt, hsa
cccaucaugcgccgcccuccuccaucgagggagaggccugaagggacugccuacugcagcucgu

SEQ ID NO: 279823 - RNA, 64 nt, hsa
cuuccuuaguauaaucaauguauacucccuuacuggccugaaacguuguauagcuacuuauuca

SEQ ID NO: 279824 - RNA, 64 nt, hsa
cauuagugugaaagaggugggagugagguuuucuggccugaagcagucugcacugaaagguacc

SEQ ID NO: 279825 - RNA, 64 nt, hsa
gccugaagcagucugcacugaaagguacccaaguggccugaaacaguguagggaaagaccuggg

SEQ ID NO: 279826 - RNA, 64 nt, hsa
ggugcuguaaucauggaccguaggccaugugaugggccugaaguggaggcugcucagcacagag

SEQ ID NO: 279827 - RNA, 64 nt, hsa
agugaaccccaugaagcugauggguuugcaggaaggccugaacaugugcacccucccagggaca

SEQ ID NO: 279828 - RNA, 64 nt, hsa
uuguauucaaguaacccuuguuuuacuaaauaauggccugaaauugcaagagcauuucuggcau

SEQ ID NO: 279829 - RNA, 64 nt, hsa
cagacaggcuucuguuuucagaguacuauggauaggccugaaugaagucauacccuauuagaua

SEQ ID NO: 279830 - RNA, 64 nt, hsa
cagcaaacacaccguccauuucugaagaggcuucggccugaaggcauuuuccaaugauguuagu

SEQ ID NO: 279831 - RNA, 64 nt, hsa
cauuccuagacagguucauucuuugcucaagaaaggccugaaugacaauguccaggaugucugc

SEQ ID NO: 279832 - RNA, 64 nt, hsa
ucagcaguuugagcaguauuuccgagacgagaguggccugaaccgaaagaacauccaagacaac

SEQ ID NO: 279833 - RNA, 62 nt, hsa
gucuggcacugcuuuuuuaaggcuggggcaaaggccugaaagggagagaagauuggcgcugg

SEQ ID NO: 279834 - RNA, 64 nt, hsa
ccgauggcgccuuacccugcugcccugggcuuuuggccugaagcaaauuccugaguggggggua

SEQ ID NO: 279835 - RNA, 64 nt, hsa
gucgguguuuccugggccuuuggaguggcugcgaggccugaacgccuuguggauccgcuguguc

SEQ ID NO: 279836 - RNA, 64 nt, hsa
gccaccgugaagaggaagcggaagagccggugggggccugaagaggauaagguagagcucccac

SEQ ID NO: 279837 - RNA, 64 nt, hsa
cagcuccacaggcagcuucacagcaccugaucccggccugaagcgcaaguccccuccugaggcc

SEQ ID NO: 279838 - RNA, 64 nt, hsa
cugcgccaguccugcuaccucccuugccuuucgaggccugaagccagcugcccuaugggccugc

SEQ ID NO: 279839 - RNA, 64 nt, hsa
uauuauccuugggggcucccagggcaaggguuaaggccugaaucaugagccugcuggaagccca

SEQ ID NO: 279840 - RNA, 64 nt, hsa; identical to SEQ ID NO: 276199

SEQ ID NO: 279841 - RNA, 64 nt, hsa; identical to SEQ ID NO: 276200

SEQ ID NO: 279842 - RNA, 64 nt, hsa; identical to SEQ ID NO: 276201

SEQ ID NO: 279843 - RNA, 64 nt, hsa; identical to SEQ ID NO: 276202

SEQ ID NO: 279844 - RNA, 64 nt, hsa; identical to SEQ ID NO: 276203

SEQ ID NO: 279845 - RNA, 64 nt, hsa; identical to SEQ ID NO: 276204

SEQ ID NO: 279846 - RNA, 64 nt, hsa; identical to SEQ ID NO: 276205

SEQ ID NO: 279847 - RNA, 64 nt, hsa; identical to SEQ ID NO: 276206

SEQ ID NO: 279848 - RNA, 64 nt, hsa; identical to SEQ ID NO: 276207

SEQ ID NO: 279849 - RNA, 64 nt, hsa; identical to SEQ ID NO: 276208

SEQ ID NO: 279850 - RNA, 64 nt, hsa; identical to SEQ ID NO: 276209

SEQ ID NO: 279851 - RNA, 56 nt, hsa; identical to SEQ ID NO: 276210

SEQ ID NO: 279852 - RNA, 64 nt, hsa; identical to SEQ ID NO: 276211

SEQ ID NO: 279853 - RNA, 64 nt, hsa; identical to SEQ ID NO: 276212

SEQ ID NO: 279854 - RNA, 64 nt, hsa; identical to SEQ ID NO: 276213

SEQ ID NO: 279855 - RNA, 64 nt, hsa; identical to SEQ ID NO: 276214

SEQ ID NO: 279856 - RNA, 64 nt, hsa; identical to SEQ ID NO: 276215

SEQ ID NO: 279857 - RNA, 64 nt, hsa; identical to SEQ ID NO: 276216

SEQ ID NO: 279858 - RNA, 64 nt, hsa; identical to SEQ ID NO: 276217

SEQ ID NO: 279859 - RNA, 64 nt, hsa; identical to SEQ ID NO: 276218

SEQ ID NO: 279860 - RNA, 64 nt, hsa; identical to SEQ ID NO: 276219

SEQ ID NO: 279861 - RNA, 64 nt, hsa; identical to SEQ ID NO: 276220

SEQ ID NO: 279862 - RNA, 64 nt, hsa; identical to SEQ ID NO: 276221

SEQ ID NO: 279863 - RNA, 64 nt, hsa; identical to SEQ ID NO: 276222

SEQ ID NO: 279864 - RNA, 64 nt, hsa; identical to SEQ ID NO: 276222

SEQ ID NO: 279865 - RNA, 64 nt, hsa; identical to SEQ ID NO: 276224

SEQ ID NO: 279866 - RNA, 64 nt, hsa; identical to SEQ ID NO: 276225

SEQ ID NO: 279867 - RNA, 64 nt, hsa; identical to SEQ ID NO: 276226

SEQ ID NO: 279868 - RNA, 64 nt, hsa; identical to SEQ ID NO: 276227

SEQ ID NO: 279869 - RNA, 64 nt, hsa
caguuagguagagcugucuguucacccucccaucccagcugaucccagucacugcuugcugggg

SEQ ID NO: 279870 - RNA, 64 nt, hsa
uggggccaugccauggaagcuucccaucagucucccagcugaauccucccugcucucugagcug

SEQ ID NO: 279871 - RNA, 64 nt, hsa
ucccuuuugcuuuucagugucuucucagaaacaaccagcugagaagguaauuaaagucucauuu

SEQ ID NO: 279872 - RNA, 64 nt, hsa; identical to SEQ ID NO: 279871

SEQ ID NO: 279873 - RNA, 64 nt, hsa
gcaucaggaaggccuuugcuucuugcacccaggcccagcugagacaggccccugaguccuggcu

SEQ ID NO: 279874 - RNA, 64 nt, hsa
acucucccuggagcugcucuccuaucagaagcucccagcugaccagacacugccugggguggac

SEQ ID NO: 279875 - RNA, 64 nt, hsa
agugacagagcccagcaucccuucugcccccguuccagcugacaucuugcacggugaccccuuu

SEQ ID NO: 279876 - RNA, 64 nt, hsa
cuuucccaaaaugugccucccuuccgcugcgggcccagcugagucuauguaggugauguuucca

SEQ ID NO: 279877 - RNA, 64 nt, hsa
ccagcccagcaggguccucuguaugagugugcacccagcugaagagaagaaauggagagcagca

SEQ ID NO: 279878 - RNA, 64 nt, hsa
gacaagcugguacagccaacccccuagguguggaccagcugaggcaggugggcagauaugcaga

SEQ ID NO: 279879 - RNA, 64 nt, hsa
caggaggcaggaaccaggauaaggguggcuucucccagcugaguaauguggccaccauguccaa

SEQ ID NO: 279880 - RNA, 64 nt, hsa
uuuuaagaaaacauggauacuacuggaacuucccccagcugaguuacauggucacuuuuucagu

SEQ ID NO: 279881 - RNA, 64 nt, hsa
gcgaggaggccugcaccccaguauaagggccuccccagcugaguaagaagcugcuuccccuccu

SEQ ID NO: 279882 - RNA, 64 nt, hsa
cuggggccucagaccucugagugggccccagagcccagcugaggaagccacacagccuccagga

SEQ ID NO: 279883 - RNA, 64 nt, hsa
auguggcaggcuuguuugaaggacccagaggggcccagcugaccugucucacugcuccuggcag

SEQ ID NO: 279884 - RNA, 64 nt, hsa
ggagggagagucugaccuggauccugaccuguaaccagcugaagacgguggaggcuuuguggcu

SEQ ID NO: 279885 - RNA, 64 nt, hsa
uugguuuucagcugauaggaucuaugccucuggaccagcugaacuuacuggugcagcuuuuugu

SEQ ID NO: 279886 - RNA, 64 nt, hsa
agcuagguuugguuuccuguuuuuugucuaugucccagcugacauucagucaaauguugggaua

SEQ ID NO: 279887 - RNA, 64 nt, hsa
ugagaagaguagcuauaaagacauaugagcgaggccagcugagcccagcacugcggccaagucg

SEQ ID NO: 279888 - RNA, 64 nt, hsa
ggucccaaaccaggccauccuagaccagccagcuccagcugauccgcacgcagccacuucggcu

SEQ ID NO: 279889 - RNA, 64 nt, hsa
aauucugggacggaccaccucgcugaccagcugaccagcugaccaggucuguguguugcaggug

SEQ ID NO: 279890 - RNA, 64 nt, hsa
ugucccaaaauucugggacggaccaccucgcugaccagcugaccagcugaccaggucugugugu

SEQ ID NO: 279891 - RNA, 64 nt, hsa
cccacgugggcccaccccgggcagcagagaaggcccagcugacagggggugaggugugggucug

SEQ ID NO: 279892 - RNA, 64 nt, hsa
ggugcccggcccccuguccacuaggccgcuucuaccagcugacugccccggcccggccucccgc

SEQ ID NO: 279893 - RNA, 64 nt, hsa
cccgugugagccagaaaccagggcuucccuacccccagcugacacuggaccccaacauguaugc

SEQ ID NO: 279894 - RNA, 64 nt, hsa
uauuaggcugaggaccuuguggaguguagcugauccagcugauagaggaacuagccaggugggg

SEQ ID NO: 279895 - RNA, 64 nt, hsa
cauuaggcugagaaccuuguggaaugcagcugacccagcugauagaggaaguagccagguggga

SEQ ID NO: 279896 - RNA, 64 nt, hsa
agaucaacgcagaaggugggugcuuucuguauuuccagcugagguaccuggcucaucucauugg

SEQ ID NO: 279897 - RNA, 64 nt, hsa
ccccucacagcguaaacaaagccauggggaaguuccagcugagcagagcccuccacagcucagc

SEQ ID NO: 279898 - RNA, 64 nt, hsa
cccaaguaacugggacuauagcaugccaccacacccagcugauuaucauauuuuuuuuuguaga

SEQ ID NO: 279899 - RNA, 64 nt, hsa; identical to SEQ ID NO: 279898

SEQ ID NO: 279900 - RNA, 64 nt, hsa
ccccacccaucagugaaaucccugagggcaggggcugucucauucaucuguggauauggagcgg

SEQ ID NO: 279901 - RNA, 64 nt, hsa
uuucucucacaugccugggucggcauuucucucgcugucucaugauuaguuauguuugccuguc

SEQ ID NO: 279902 - RNA, 64 nt, hsa
cacugcacuccagccuggacaacagagcaagacucugucucaaaaaaaaaauaaaaaauaaaaa

SEQ ID NO: 279903 - RNA, 64 nt, hsa
gccacugcacuccagcuugagcaacacagugauacugucucaauaaauaaauaaauagaagaaa

SEQ ID NO: 279904 - RNA, 64 nt, hsa
cacugcccuccagccugggugacagagugagacccugucucaaaagcaaaacaaacagcaauaa

SEQ ID NO: 279905 - RNA, 64 nt, hsa
gacugcacuccagccugggugacagagccagacucugucucaaaaaaaaaaaaaaagaaaagaa

SEQ ID NO: 279906 - RNA, 64 nt, hsa
agaagagcuucuguauaguaaccauuuucuuaggcugucucacuugugugaaucuucugacaca

SEQ ID NO: 279907 - RNA, 64 nt, hsa
cacuguacuccagccugggugacagagcgagacucugucucaaaaaaacaaaacaaaaaaacac

SEQ ID NO: 279908 - RNA, 64 nt, hsa
cagaaugaaacaugggguuggaguggaggaggagcugucucagcaagaggagaccuggggcugu

SEQ ID NO: 279909 - RNA, 64 nt, hsa
uuccccaccacuagccccacuuaaacuacuacuacugucucagagaacaguguuuccuaaugua

SEQ ID NO: 279910 - RNA, 64 nt, hsa
caacuuuucauaaaguagaaaaauucaaaggaagcugucucaauuugagaauaccagcugggca

SEQ ID NO: 279911 - RNA, 64 nt, hsa
ccgcuacacuccagccugaugacagaccgagacacugucucaaaaaaauaaaaaaauucagauu

SEQ ID NO: 279912 - RNA, 64 nt, hsa
cacugcauuccagccuggaugacagagcaaaacccugucucaaaaaaaugcagacuggccaggc

SEQ ID NO: 279913 - RNA, 64 nt, hsa
aagagaaggucuuuacuuacuugucuguaucuuucugucucacucgaaaggcacagucucaaug

SEQ ID NO: 279914 - RNA, 64 nt, hsa
cauugcacucuagccugggcaaccaagagugaaacugucucaaaaaacaacuuuuaucaauguc

SEQ ID NO: 279915 - RNA, 64 nt, hsa
cauugcacucuagucugggugacagagcgagacucugucucaaaaaaaaaaaaauaaagccggg

SEQ ID NO: 279916 - RNA, 64 nt, hsa
ccugugugcuccagccugagcaacaagagcgaaacugucucaaaaaaaagaagaaaauaaauaa

SEQ ID NO: 279917 - RNA, 64 nt, hsa
uaaccccaaucugccugugcugcucuuucauacccugucucaguaacuauuuggccaugugcuc

SEQ ID NO: 279918 - RNA, 64 nt, hsa
ggcagacugcuccggacucuucuaggaaauuccucugucucauuuguccucaucuccuucuugc

SEQ ID NO: 279919 - RNA, 64 nt, hsa
cacugcacuccagccggggugacagagcgaaccucugucucaaaaaaaaaaaaagaaaaaagaa

SEQ ID NO: 279920 - RNA, 64 nt, hsa
cauuguacuccagcuugggcaacagaguaagacucugucucaaaaaaaaaaaaacaaaaacaaa

SEQ ID NO: 279921 - RNA, 64 nt, hsa
acugcauuccagccugggcaacaaaagcgaaacucugucucaaaaaagaaaaaaaagaaaaaaa

SEQ ID NO: 279922 - RNA, 64 nt, hsa
auugcacuccagccugggcaacaagagcgaaacucugucucaaaaaaaaaaaaaagaggugggu

SEQ ID NO: 279923 - RNA, 57 nt, hsa; identical to SEQ ID NO: 244788

SEQ ID NO: 279924 - RNA, 64 nt, hsa
gagguccugucuaaacccugugucccugagggaucugucucacuggcaucuuguugagggccuu

SEQ ID NO: 279925 - RNA, 64 nt, hsa
cacugcacuccagucugggcaacagagugagacccugucucaauaauaauaauaauaauaauga

SEQ ID NO: 279926 - RNA, 64 nt, hsa
uucugaagauacagaugacagugacgaaugccuucugucucaugauugacagggaaaaggaagg

SEQ ID NO: 279927 - RNA, 64 nt, hsa
gguagggguuguuugguuuugguuuucacugucucugucucaucuaguaccuaccuuaguuuau

SEQ ID NO: 279928 - RNA, 64 nt, hsa
caccacacuccaaccuaggugacagagcaagacccugucucaaaaaaaaaaaaacaaauuaacc

SEQ ID NO: 279929 - RNA, 64 nt, hsa
auuacacucaagcuugggcaacgagagcaaaacucugucucaaaaaaaaaauuagccagaugug

SEQ ID NO: 279930 - RNA, 64 nt, hsa
caauguacuccagccuaggugacagagugagacccugucucaaaaauaaauaauaaauaaauaa

SEQ ID NO: 279931 - RNA, 64 nt, hsa
ggaagaagagagggugggagauucuccuccaguccugucucaucuccugggagaggcagacgag

SEQ ID NO: 279932 - RNA, 64 nt, hsa
agugaggccucugccauguccagagggcacaaaacugucucaaugagaggggagacagaggcag

SEQ ID NO: 279933 - RNA, 64 nt, hsa
cacugcacuccagccugggcaacagagcaaaacucugucucaaaaaaaaaaaaaaaaaggcaaa

SEQ ID NO: 279934 - RNA, 64 nt, hsa
accccggacagggccacauuugcaugagacauggcugucucacaggucacagagccauuacaac

SEQ ID NO: 279935 - RNA, 64 nt, hsa
caccagagucugcccuuuggcccaaaauuuaugucugucucauguguaaaagacauucauccca

SEQ ID NO: 279936 - RNA, 64 nt, hsa
gggaacaggcauaggauaacaguuacagacauuucugucucaaaaaggagagaauggaaauugg

SEQ ID NO: 279937 - RNA, 64 nt, hsa
gccagagcagcaucuucucuguguaccaccucugcugucucagaugcccccagcaaauaaacac

SEQ ID NO: 279938 - RNA, 64 nt, hsa
gugagggccacucaccgaccugagucaguguccucugucucacagggccccucucccuucuguu

SEQ ID NO: 279939 - RNA, 62 nt, hsa
ggucaauaguuucccaauuucaggauauuucgaugucagaaauaacgcaucuuaggaaugac

SEQ ID NO: 279940 - RNA, 62 nt, hsa
cacuauaccaagcacuaggcuuagaggaaaagaugucagauuguacugucacuggcuaugua

SEQ ID NO: 279941 - RNA, 62 nt, hsa
augacuaugucagaagacauuugggcucuccaaugucagauguggucaguagggagcuccau

SEQ ID NO: 279942 - RNA, 62 nt, hsa
ccgaguugaacugaagaaacgaguggaugacuaugucagaagacauuugguaugaagcuucu

SEQ ID NO: 279943 - RNA, 62 nt, hsa
auuaggauucaugugguuucuaagauuuggacaugucagaauuuugugagucauggaugggg

SEQ ID NO: 279944 - RNA, 62 nt, hsa
gugauuacugcuauuacuauauuuacuugcauaugucagaaugaugugauagacuaucucug

SEQ ID NO: 279945 - RNA, 62 nt, hsa
gcaaaauacaggaaaagaacuauccaguauaaaugucagaagacagauuuccuaaacaagua

SEQ ID NO: 279946 - RNA, 62 nt, hsa
acuuguggaucuuuuguacuucucauaaccuaaugucagacuaagaaaaauaaaauaucuga

SEQ ID NO: 279947 - RNA, 62 nt, hsa
uugcuuauuuuuaaauuuggagguccuccauaaugucagauaauauugaccugccauacguu

SEQ ID NO: 279948 - RNA, 62 nt, hsa
cacuucaauagcaaucacaucuuauauccuaaaugucagaagauauucugaacuggaugccu

SEQ ID NO: 279949 - RNA, 62 nt, hsa
cugcauugcaccuuuugcccugcccagggcccaugucagauuuaugucucugcugauacuau

SEQ ID NO: 279950 - RNA, 62 nt, hsa
cacccuggagaaaguccuugaguacacagugaaugucagaaagcuucagcugaaggccauau

SEQ ID NO: 279951 - RNA, 62 nt, hsa
ugguuucagugaaacaaucuagcagagaauuaaugucagaaccuuuuuaaauaauagucuga

SEQ ID NO: 279952 - RNA, 62 nt, hsa
cguaaagagguaccaacugucgcugaugugauaugucagaacugaagaguaaaucuacuugu

SEQ ID NO: 279953 - RNA, 64 nt, hsa
uagcccagcacagagccaccggaacaucaagauccuagaggacgaaccccacaguaaggaugag

SEQ ID NO: 279954 - RNA, 64 nt, hsa
gcagaagggcaguaucggcaaccuccugggcuuccuagaggacagccuugccgccacacaguuc

SEQ ID NO: 279955 - RNA, 64 nt, hsa
ucaucucugggugccaccaucggucuggcugcagcuagaggacaggcaagccagcucuggggga

SEQ ID NO: 279956 - RNA, 64 nt, hsa
gaaaccacagcucuuaguaguaauggcauacagucuagaggaccauucaugcaaugacuauuuc

SEQ ID NO: 279957 - RNA, 64 nt, hsa
gggaacuggcacugugaccuuagcauuuaguuuucuagaggaugugaucuaauuucuuucuagc

SEQ ID NO: 279958 - RNA, 64 nt, hsa
aaaaauaugccaaaaaaugagagauacaaaugagcuagaggaagaugaggggggaugcgaguac

SEQ ID NO: 279959 - RNA, 64 nt, hsa
caguugaaaagggcaagaggaaaccagggcaguucuagaggagugcuggugacuggauagcagu

SEQ ID NO: 279960 - RNA, 64 nt, hsa
uggcaggcuguagaccugacauuuugagacaagccuagaggagucaggagcagggacuuugacu

SEQ ID NO: 279961 - RNA, 64 nt, hsa
auuuggagcuuauguaauaauggcauaaagccaacuagaggauguuguauuuugcacaucagau

SEQ ID NO: 279962 - RNA, 64 nt, hsa
gugacaagcuuugcuuuguuaucauuggucuucacuagaggauaccuuuuacauguacuucucu

SEQ ID NO: 279963 - RNA, 64 nt, hsa
gcugcuuggcugccugucuuucuaggcagucccccuagaggaaaaauguaggaauuuauuuuuu

SEQ ID NO: 279964 - RNA, 64 nt, hsa
gacacccguaccgcggcuggcuggcggggacaggcuagaggagacagcaagucccaguccccgg

SEQ ID NO: 279965 - RNA, 64 nt, hsa
uguucauguaucgugcuggaagucugaacugacucuagaggaugaauuagcaagaggguauuuu

SEQ ID NO: 279966 - RNA, 64 nt, hsa
uagccauuguaucaguugaaguaauacuuguuuacuagaggaguuugaacaaagccuuuccuac

SEQ ID NO: 279967 - RNA, 64 nt, hsa
guguaggcaauuauguccugcuuugauaaaacugcuagaggauggcuaugcaaaagcauaacga

SEQ ID NO: 279968 - RNA, 64 nt, hsa
guugaugccacuuugaagaaaagaacacugagaacuagaggagggaacacuuugcccaagauua

SEQ ID NO: 279969 - RNA, 64 nt, hsa
auaaauguuuaucaugcauguauucuagagcucauucauuuauucaacaaacauuuggugagca

SEQ ID NO: 279970 - RNA, 64 nt, hsa
aacauuuggugagcaccuauuucguucgagaaacuucauuuaucuccuauaauuggcaaacuua

SEQ ID NO: 279971 - RNA, 64 nt, hsa
uugugugauauuuuuuucuucgcuuguuuauuuauucauuuauuuaauuguauuuauucauuua

SEQ ID NO: 279972 - RNA, 64 nt, hsa
cuuguuuauuuauucauuuauuuaauuguauuuauucauuuacuaacuuuauguguuaccaauu

SEQ ID NO: 279973 - RNA, 64 nt, hsa
agacauugugcuaugugcauaucauauguauuauuucauuuaauucucacaacaauucugugaa

SEQ ID NO: 279974 - RNA, 64 nt, hsa
aauaaaauuuuauaauaguacacagccacacucauucauuuauuuucugugguugcuuucaagc

SEQ ID NO: 279975 - RNA, 64 nt, hsa
cuagccauuucuccaaggcgcaaauggcccuggcuucauuuauuccuuuccuuucuauccuuuu

SEQ ID NO: 279976 - RNA, 64 nt, hsa
ccuaguucccaccccaaguuuaagaagacuuagauucauuuauugcuaucugaggccacuagug

SEQ ID NO: 279977 - RNA, 64 nt, hsa
uuuuacacuaaaacuuuacaagauaaaauuggacuucauuuaguaucuuuuuaacagaauuacu

SEQ ID NO: 279978 - RNA, 64 nt, hsa
guaagagcaaaagaacguuuuuguacaauuuuuuuucauuuaauuggaaugaucuucagguuuc

SEQ ID NO: 279979 - RNA, 64 nt, hsa
gagccuaaaaaguaggcuuuauucaucccuucuguucauuuaccaaccugggggauugauacga

SEQ ID NO: 279980 - RNA, 64 nt, hsa
cuucuuaucagcgguaaaaaugcauuuacaaccuuucauuuaaccgaaaaacacagaccgcuuu

SEQ ID NO: 279981 - RNA, 64 nt, hsa
gaccaaauucuaaaaccuaauccauauaaguuuauucauuuaggaauguucguuuaaauuaauc

SEQ ID NO: 279982 - RNA, 64 nt, hsa
cagaccuugccucagaaggagcugugagccaguauucauuuaagaggcaauaaggcaaaugcca

SEQ ID NO: 279983 - RNA, 64 nt, hsa
guggaaagaauauuuguaguaguaacaagaauuuuucauuuaggaaagauuucuuagguuuuga

SEQ ID NO: 279984 - RNA, 64 nt, hsa
gacauuucaguuaagcucauaaaauuucauuguuuucauuuaaaagauuaacguuauugauacu

SEQ ID NO: 279985 - RNA, 64 nt, hsa
guagcuuucuguuuacauccuaugccacauggucuucauuuaugccagguaaacuguauuugaa

SEQ ID NO: 279986 - RNA, 64 nt, hsa
gagccaaacucuuuuccauuccaucuaaaauguuuucauuuaguacucuucuuuccuccuacuc

SEQ ID NO: 279987 - RNA, 64 nt, hsa
uacaaauugacaugauuuuccauauuaaaaaauuuucauuuauuuuguaccucauucacaugaa

SEQ ID NO: 279988 - RNA, 64 nt, hsa
ccagauacuauucugaauauuuuauguauauucauucauuuaguugucauauuggcuuuaugug

SEQ ID NO: 279989 - RNA, 64 nt, hsa
gcuaauaguggauuguauagggugguguuuuuauuucauuuauuguagacaaaaauaaugaauu

SEQ ID NO: 279990 - RNA, 64 nt, hsa
uuagucugccaucuuuaaaaaaaaauacaguauuuucauuuaaauucucugauggagggacaac

SEQ ID NO: 279991 - RNA, 64 nt, hsa
caguuauucucuuuuucaucuggggauuuaccuguucauuuaaucugccuguuuugaucuguuu

SEQ ID NO: 279992 - RNA, 64 nt, hsa
aauuccauuuuuauuuugcauuuuagaauugcccuucauuuacuaaaucagccaguuaauguga

SEQ ID NO: 279993 - RNA, 64 nt, hsa
ucucaaaaucuagaaaagugcauauaaauuuuuguucauuuagaacugaguauucuggagaaaa

SEQ ID NO: 279994 - RNA, 64 nt, hsa
uauuauuuaguuggaggccuuuagauauuauucauucauuuacucauucauuuauucauucauu

SEQ ID NO: 279995 - RNA, 64 nt, hsa
ggaggccuuuagauauuauucauucauuuacucauucauuuauucauucauucaucgaguaacu

SEQ ID NO: 279996 - RNA, 64 nt, hsa
caaaguaaacauuuaaauuguagaacugauauuuuucauuuauaugaaguauaagccucuacug

SEQ ID NO: 279997 - RNA, 64 nt, hsa
cuacguuuaaauaaauaaaaauugaauuuuauuguucauuuauauaaaaucugauaccuugaug

SEQ ID NO: 279998 - RNA, 64 nt, hsa
aguaaauuguuaauguaaauaguuggugcuuacuuucauuuauguuuauuaucuuaaagcaauu

SEQ ID NO: 279999 - RNA, 64 nt, hsa
uaguuuagccaaaaguuuaugugugguuuggggcuucauuuauuuaucucaugaguaaaaugga

SEQ ID NO: 280000 - RNA, 64 nt, hsa
uacuuugguccauaauuugauuugauaugauuguuucauuuauaauuugcccaaauacauggag

SEQ ID NO: 280001 - RNA, 64 nt, hsa
uuuucaaauauuuuccuuggcuguaauuuauguauucauuuauauccuauccgucuuuugagcu

SEQ ID NO: 280002 - RNA, 64 nt, hsa
uaaguuguaugcauaaacauaagauuuguaauguuucauuuauaaacugccuucuucaacacau

SEQ ID NO: 280003 - RNA, 64 nt, hsa
gacuuggaguuaucuuugacuuuuaccacaaaucuucauuuauaaaagaaaaagccaaagugaa

SEQ ID NO: 280004 - RNA, 64 nt, hsa
auguguugauugugugguucauuuuuguauuuauuucauuuaaaaucaugugacgcagaauagu

SEQ ID NO: 280005 - RNA, 64 nt, hsa
ucgugcccucauuuuucacuuauuuuuuugguuauucauuuauaauaaaagguuggcauugaua

SEQ ID NO: 280006 - RNA, 64 nt, hsa
ucuugcugcguucuguuugcugagguugggcuuauucauuuaacacauaccaaccauuauccag

SEQ ID NO: 280007 - RNA, 64 nt, hsa
aaagagcucugacaccacuuuucauguuaagaucuucauuuagcuccuuuacugggauuuauug

SEQ ID NO: 280008 - RNA, 64 nt, hsa
uuuccagguagacguggacuuuauugacugugaauucauuuacauguaacuucugacauuucac

SEQ ID NO: 280009 - RNA, 64 nt, hsa
ugacuuuucaauaaaucagcugcaauccauuuauuucauuuacaaaagauuuauuguaagcauc

SEQ ID NO: 280010 - RNA, 64 nt, hsa
ugguguauauuuuaauguuuuuaaaaagaguaauuucauuuaaauaucuguuauucaaauuuga

SEQ ID NO: 280011 - RNA, 64 nt, hsa
cccacuuagacucaaacacauuuuagugugauauuucauuuauuauagguaguauauuuuaauu

SEQ ID NO: 280012 - RNA, 64 nt, hsa
cuaggaaaugaaaguagcgucuuuuaaauugcuauucauuuaauauaccuguuuucccaucuuu

SEQ ID NO: 280013 - RNA, 64 nt, hsa
uuacaguuuuucuuuugaucgugcacuuauagucuucauuuaauuccucauagaaucccaguca

SEQ ID NO: 280014 - RNA, 64 nt, hsa
caauacaucuacccacuccauuauuuuuuaaaacuucauuuaauaguuuaaacaagauugguuu

SEQ ID NO: 280015 - RNA, 64 nt, hsa
cauugaguacugauggauguuuugaaagugagcauucauuuaaggauaaauaaaaaauaaagua

SEQ ID NO: 280016 - RNA, 64 nt, hsa
ugaacagccaaacuaaacuuuggccaucuauauauucauuuacagauuauucauacauucauuu

SEQ ID NO: 280017 - RNA, 64 nt, hsa
aguaccuauugggaacagacauaacauucaauuuuucauuuaugcuaagugaccacaguauaca

SEQ ID NO: 280018 - RNA, 64 nt, hsa
uaguuaaaguuuuauugucacauagccacauacauucauuuacauguuuucugauuuuacacua

SEQ ID NO: 280019 - RNA, 64 nt, hsa
cuuaaagaauuugaaaguuuccuuauuuucauaauucauuuaagaacaagagaccccugucugg

SEQ ID NO: 280020 - RNA, 64 nt, hsa
uacagaaaauagcuuuuauugaguaauauuacauuucauuuauacuguagcaauauauuuguag

SEQ ID NO: 280021 - RNA, 64 nt, hsa
aaaaaauuaauauauaaauaauucagagggguuuuucauuuacuuuugaaaagaaauuucuuua

SEQ ID NO: 280022 - RNA, 64 nt, hsa
guggacugaaaagcaaauuuauucuuucgaagauuucauuuaaaucucuguacuaugcauuuuu

SEQ ID NO: 280023 - RNA, 64 nt, hsa
auaguuccuagugacauagaaacgaugcguaguuuucauuuacuaauuacaaauguugaggccu

SEQ ID NO: 280024 - RNA, 64 nt, hsa
ucuguccuauaaaagauuuauuaaaaaacaauccuucauuuauuuuuugucuaauuuuuuaguu

SEQ ID NO: 280025 - RNA, 64 nt, hsa
acgucaaauuggaccaauugucuugguuucuugauucauuuauuugagaaaaaaacaauacaaa

SEQ ID NO: 280026 - RNA, 64 nt, hsa
aaaacaguauuguccauucagaaaugugugacccuucauuuauggauauugacuauauguaaug

SEQ ID NO: 280027 - RNA, 64 nt, hsa
uauuuaauaaagaagauugaguacucugacacauuucauuuaaauuaggaaauuuuuaauauua

SEQ ID NO: 280028 - RNA, 64 nt, hsa
guuuuuuuuuuuuacaucguuuuaguaaguuaauuucauuuauuuacuuuggagcuauauuucc

SEQ ID NO: 280029 - RNA, 64 nt, hsa
uugagagaggaggcugaguuuccagagcuuugcuuucauuuauuuuuauacacauugucucucu

SEQ ID NO: 280030 - RNA, 64 nt, hsa
uaacucuuaucaaggccaucuuuuagaccugauuuucauuuauaugaaaacagaccuguccaug

SEQ ID NO: 280031 - RNA, 64 nt, hsa
caauuuaaauaucacaacaauuugacacccuucauucauuuauaaaaauaaaugagcuaguucu

SEQ ID NO: 280032 - RNA, 64 nt, hsa
guuuuuuuauuagaauguucuuuauccuaauuaguucauuuauccaagaauacaugaaugugau

SEQ ID NO: 280033 - RNA, 64 nt, hsa
gcuuucugcccaguggcguugggggaauucagccuucauuuauaaucagugagauuccccuguu

SEQ ID NO: 280034 - RNA, 64 nt, hsa
aaaggaagcuugcucuauggauuuaaaugcaaacuucauuuaccagugcaggaagucucauaaa

SEQ ID NO: 280035 - RNA, 64 nt, hsa
caguagauuugaauaccuugauguuuugcauuacuucauuuauguuuacaucauguuuagaaau

SEQ ID NO: 280036 - RNA, 64 nt, hsa
cuucauuuauguuuacaucauguuuagaaauguuuucauuuacuguggucuuuggucacuucag

SEQ ID NO: 280037 - RNA, 64 nt, hsa
ucaaagaccuagugauggauauuucuuugaggcuuucauuuauauaauuuuauuuuguacaaug

SEQ ID NO: 280038 - RNA, 64 nt, hsa
uaugauuaaaggaagguuaugauaaaaugauuaguucauuuacauucacuuguagcaauuacau

SEQ ID NO: 280039 - RNA, 64 nt, hsa
auauguacauauucucauauguaaagucacaagguucauuuaucuuucugaaucaguuaucaaa

SEQ ID NO: 280040 - RNA, 64 nt, hsa
auaccacauauccuccucuagccuguaaaggaguuucauuuaaaaaaauaacauuugauuacuu

SEQ ID NO: 280041 - RNA, 64 nt, hsa
ugauuaugcaucacucugugugcaacuuuuuuauuucauuuaguguuucuuucaagcuguguau

SEQ ID NO: 280042 - RNA, 64 nt, hsa
uugucguguuucauccuucuuaacaugcuaucuuuucauuuaauaauaguaauaguguauggca

SEQ ID NO: 280043 - RNA, 64 nt, hsa
guaagccucuccuucuaaaaacuucucaacuguuuucauuuaagggaaagaaaaugaguauuuu

SEQ ID NO: 280044 - RNA, 64 nt, hsa
uguggugaaaacuuaccacccccauacuaugguuuucauuuacucuaaaaacugauugaaugau

SEQ ID NO: 280045 - RNA, 64 nt, hsa
gacagaaaaaugaaaaguguuugaguucagccucuucauuuacuccauuuacauauaaaagauc

SEQ ID NO: 280046 - RNA, 64 nt, hsa
uuuaaaguucagguaugacaaaguauagaauuuauucauuuaacauauucacauuuaguuuaug

SEQ ID NO: 280047 - RNA, 64 nt, hsa
auuuaaaaagguguagcuauuaguguuguauuuuuucauuuacauuaauguaauuuccauucac

SEQ ID NO: 280048 - RNA, 64 nt, hsa
aagcauuuuuaaaaacgaauuguaguuguuuuucuucauuuaaaauggaucuguuggagguuau

SEQ ID NO: 280049 - RNA, 64 nt, hsa
aucauauauauuuucuguauuaagcucauuuggcuucauuuaagcuguauacuuagucauauau

SEQ ID NO: 280050 - RNA, 64 nt, hsa
gccaagucccugucucuuucagacacagacaagcuucauuuaaauuauuucaucugaucauuau

SEQ ID NO: 280051 - RNA, 64 nt, hsa
cuaggaaauuuaaagcugcauggucugucuuguuuucauuuaauuauugugaauaccuagaauc

SEQ ID NO: 280052 - RNA, 64 nt, hsa
cuuacuaacaaccccucuagaauacauuggugauuucauuuaaagagauuguaugcauuugugg

SEQ ID NO: 280053 - RNA, 64 nt, hsa
acccaaaggccaugcugauccccugcucccugcuuucauuuauguuugcugaccuguggagacc

SEQ ID NO: 280054 - RNA, 64 nt, hsa
gagagcauguccuaugcagacauagauuuuucuguucauuuauuuuucuucauugcaguggauu

SEQ ID NO: 280055 - RNA, 64 nt, hsa
auucucauagaacaccaaaaaugauguucagugauucauuuaacauacaccaauguacucuggc

SEQ ID NO: 280056 - RNA, 64 nt, hsa
cauuaaucugacgauaauuucccuguauauuauguucauuuagcuguuuguaauuuuuguuaau

SEQ ID NO: 280057 - RNA, 64 nt, hsa
ugaaacgugaagaaauugcauuugauaacugcuauucauuuaacuuuucucauuaucaguacca

SEQ ID NO: 280058 - RNA, 64 nt, hsa
auuuuacagggcuguugaugauggguuaaaaauguucauuuaagggcuacccccguguuuaaua

SEQ ID NO: 280059 - RNA, 64 nt, hsa
ccagcuucagacuuguagauauaacucguucaucuucauuuacuuuccacuuugcccccugucc

SEQ ID NO: 280060 - RNA, 64 nt, hsa
uucacuuuuacuuaaacauaauauauaauggauauucauuuauacugauuuaugaaaguaaguu

SEQ ID NO: 280061 - RNA, 64 nt, hsa
auucuuaaucuuuuuuuagaaaggaaaaguuuucuucauuuagcugcugauuuaaaaguaaagu

SEQ ID NO: 280062 - RNA, 64 nt, hsa
accccgcccggcccuuuuuuuucauuuauacuuuuucauuuagauuguaaugauuaacagaaac

SEQ ID NO: 280063 - RNA, 64 nt, hsa
uacaggcgugagccaccccgcccggcccuuuuuuuucauuuauacuuuuucauuuagauuguaa

SEQ ID NO: 280064 - RNA, 64 nt, hsa
aaaccuuucaaauuauuugaauaaucuucauauuuucauuuaaccuauaugacucuaauuuuuu

SEQ ID NO: 280065 - RNA, 64 nt, hsa
uggguaauaagugugaaaauuuuaauuugugguuuucauuuauuaaugucugcccaucuguauu

SEQ ID NO: 280066 - RNA, 64 nt, hsa
ucacagauaaacuucugccaucaaauggcuacaguucauuuaaauuuaaaaaaaagaaaaaaga

SEQ ID NO: 280067 - RNA, 64 nt, hsa
gucuauacaaauaauuucucugaggugaauuuaauucauuuauuuucaaauaagcauaauuugc

SEQ ID NO: 280068 - RNA, 64 nt, hsa
cucccccaggcccuacccugcaaugggauucgcuuucauuuaauggaaacuucugggacugaug

SEQ ID NO: 280069 - RNA, 64 nt, hsa
uaacuucuagaugcuaccguugaccugaguuaaauucauuuagucguguacguaaaaacucucc

SEQ ID NO: 280070 - RNA, 64 nt, hsa
cacuuaugauauaauccauucacacauucauuuauucauuuauucauuuauucauucauaaaau

SEQ ID NO: 280071 - RNA, 64 nt, hsa
accuauuacacuuaugauauaauccauucacacauucauuuauucauuuauucauuuauucauu

SEQ ID NO: 280072 - RNA, 64 nt, hsa
ugaaguugaauaucagucuauagcuaaugcuacuuucauuuauauuuuuaaauguucuuaguuu

SEQ ID NO: 280073 - RNA, 64 nt, hsa
uauguuaaaagaaacauuaauuacauuggcaguuuucauuuauacauuguugacauaauuuuac

SEQ ID NO: 280074 - RNA, 64 nt, hsa
agguuuguauuguugaucuaaaccugauacaugcuucauuuaaucaggaauaauccuuuuuuuu

SEQ ID NO: 280075 - RNA, 64 nt, hsa
aaccauauguguauuagggugacugaguggugacuucauuuauaauaauacagagaauagcuau

SEQ ID NO: 280076 - RNA, 64 nt, hsa
cacuuggucugguuugguuuugaacacgcacuaauucauuuaauuacaacaacuuugcgaugua

SEQ ID NO: 280077 - RNA, 64 nt, hsa
caagccuaagauggcccaugugccacuuuguucauucauuuauuuauucagcagauauuuauug

SEQ ID NO: 280078 - RNA, 64 nt, hsa
ucccacucucugcaagguuuuccucauuuuuauauucauuuauucaucauucauucauucaccu

SEQ ID NO: 280079 - RNA, 64 nt, hsa
uuaacaagcaagcaaaaugcaaaccaaaccauuauucauuuauuggcuuaaguaugcuuucucc

SEQ ID NO: 280080 - RNA, 64 nt, hsa
uagauaacuuucuggcauuuagaauuuuguuccauucauuuaauuuguucaucugagaauuuuu

SEQ ID NO: 280081 - RNA, 64 nt, hsa
ucuguuguguuuauguagaaaauucacaaaucuguucauuuaauuuuuuaauuugagaauuuuu

SEQ ID NO: 280082 - RNA, 64 nt, hsa
uuugaccaagccaggauauaucuguuaggccacauucauuuagggaucauguuuuccaaagcag

SEQ ID NO: 280083 - RNA, 64 nt, hsa
augacuccugucacucaguacaauuauuuugagauucauuuauguuauuguauguaucaauagu

SEQ ID NO: 280084 - RNA, 64 nt, hsa
guuggcuugguucaguaauaaauaugugagacuuuucauuuaaaaaaagucaaaugacuuaauu

SEQ ID NO: 280085 - RNA, 64 nt, hsa
uuguagauuugaagguagaaacuucucaacuuuuuucauuuauuccuaaguauuucuuacuuua

SEQ ID NO: 280086 - RNA, 64 nt, hsa
uuugguuguguauguccaaaguccuaugguuuuauucauuuaugguuuuacaggcuuugaagua

SEQ ID NO: 280087 - RNA, 64 nt, hsa
augguugcaccuuaugaccuugagggaaagccaguucauuuaagaggaaauggacuggcauuua

SEQ ID NO: 280088 - RNA, 64 nt, hsa
guguuucugugagggaggcugcuuucugugaaauuucauuuauauuuuucuauuuuuaguacug

SEQ ID NO: 280089 - RNA, 64 nt, hsa
ccagacagucuacuagccaaaaguccuguaugcauucauuuauuccuugcuggacaaacucugg

SEQ ID NO: 280090 - RNA, 64 nt, hsa
auuugggaacugacaaugugucagaaaauauauguucauuuaucauuuuaaaaucuuguauaau

SEQ ID NO: 280091 - RNA, 64 nt, hsa
aucauuuuaaaaucuuguauaauuugccacuguauucauuuaugccuaaaucucuauaacagau

SEQ ID NO: 280092 - RNA, 64 nt, hsa
cuuuuggcaugaauguuucauagguuauguuguguucauuuaguagguggcgcauaaucugugg

SEQ ID NO: 280093 - RNA, 64 nt, hsa
agccacacccacauauauauuaaaagugguuguauucauuuagugaaaaacaaaaaguagaugu

SEQ ID NO: 280094 - RNA, 64 nt, hsa
aagaugggcuucucugagguccacaucauggcaguucauuuacucuugugccaaauggcaacac

SEQ ID NO: 280095 - RNA, 64 nt, hsa
uuaauauaacauuuuaaaauucuaaguguauaguuucauuuauuugaagugauuucaaauauuu

SEQ ID NO: 280096 - RNA, 64 nt, hsa
accucaggccaggugagcuccccaaauuucuuuuuucauuuacuccagugaguuucugcugucu

SEQ ID NO: 280097 - RNA, 64 nt, hsa
gucuuugguauuucauauaggaauuauuuuuuuuuucauuuaaaacaaauccacaucuuuugua

SEQ ID NO: 280098 - RNA, 64 nt, hsa
ucuuuccacacaggauuccguuggugaaccuguaaaaacaaaacaaacaaaacaaaacaaaaaa

SEQ ID NO: 280099 - RNA, 64 nt, hsa
ccacacaggauuccguuggugaaccuguaaaaacaaaacaaacaaaacaaaacaaaaaagacaa

SEQ ID NO: 280100 - RNA, 64 nt, hsa
auuccguuggugaaccuguaaaaacaaaacaaacaaaacaaaacaaaaaagacaaaaccuaaaa

SEQ ID NO: 280101 - RNA, 64 nt, hsa
guuggugaaccuguaaaaacaaaacaaacaaaacaaaacaaaaaagacaaaaccuaaaacugag

SEQ ID NO: 280102 - RNA, 64 nt, hsa
ugauagaugaaauucacaccccugcagaucagaaaaaacaaauagaagaaaaugaggguuacag

SEQ ID NO: 280103 - RNA, 64 nt, hsa
uguguuuucuuuggucagaggucaaaauuuaugaaaaacaaaaugcuguaugaauggaaaucau

SEQ ID NO: 280104 - RNA, 64 nt, hsa
ccugauaaccccuugucaguugucagcucuucccaaaacaaagcucuggaguuucugcuggaag

SEQ ID NO: 280105 - RNA, 64 nt, hsa
gggaguugcagugaaugucauuaaaauuucuuccaaaacaaaacuagaaauaauugcugagggc

SEQ ID NO: 280106 - RNA, 64 nt, hsa
gcugagggcuuauagggaagugauuuaaaaagaaaaaacaaacaacaacaaaaaaaacucuucg

SEQ ID NO: 280107 - RNA, 64 nt, hsa
cagccugguuacagagcaagacucugucucaaacaaaacaaaacaaaacaaaaacacacuacug

SEQ ID NO: 280108 - RNA, 64 nt, hsa
ugguuacagagcaagacucugucucaaacaaaacaaaacaaaacaaaaacacacuacuguauuu

SEQ ID NO: 280109 - RNA, 64 nt, hsa
acagagcaagacucugucucaaacaaaacaaaacaaaacaaaaacacacuacuguauuuuggau

SEQ ID NO: 280110 - RNA, 64 nt, hsa
cuccagccugggugacaaagccagacucucuccaaaaacaaaccagaaacagaaaagaaaugac

SEQ ID NO: 280111 - RNA, 64 nt, hsa
agcauacuucuuuugcguauuauguuuaacucacaaaacaaagcucaucaugcguuugauucug

SEQ ID NO: 280112 - RNA, 64 nt, hsa
ggcauuccucaucaccaucguguuugcaaagguuaaaacaaaaacaaaaaaccacaaaaauaaa

SEQ ID NO: 280113 - RNA, 64 nt, hsa
ccucaucaccaucguguuugcaaagguuaaaacaaaaacaaaaaaccacaaaaauaaaaaacaa

SEQ ID NO: 280114 - RNA, 64 nt, hsa
agguuaaaacaaaaacaaaaaaccacaaaaauaaaaaacaaaaaaaacaaaaaacccaagaaaa

SEQ ID NO: 280115 - RNA, 64 nt, hsa
caaaaacaaaaaaccacaaaaauaaaaaacaaaaaaaacaaaaaacccaagaaaaaaaaaaaga

SEQ ID NO: 280116 - RNA, 64 nt, hsa
cuacaucucaauuaguggcuggaaaguacaugguaaaacaaaguaaauuuuuuuauguucuuuu

SEQ ID NO: 280117 - RNA, 64 nt, hsa
uuaaugauaaauuuuucaacauacuugccauuagaaaacaaaguauugcuaaguacuauaacau

SEQ ID NO: 280118 - RNA, 64 nt, hsa
gcaucuuuucuaguugaaauggugaacugauaggaaaacaaaugaguagaaagaguucaugaag

SEQ ID NO: 280119 - RNA, 64 nt, hsa
ccuggacugaguauaacagcuuuaugauuaugagaaaacaaauucuuuauuuuuuuuuucuguu

SEQ ID NO: 280120 - RNA, 64 nt, hsa
uguguuuucauuguuuuaaguuuuucuucugaguaaaacaaaauuauagaaaacaaaugcaaca

SEQ ID NO: 280121 - RNA, 64 nt, hsa
uuaaguuuuucuucugaguaaaacaaaauuauagaaaacaaaugcaacaaugugcacaucugac

SEQ ID NO: 280122 - RNA, 64 nt, hsa
aaagcaaaccaauaccauugauaagaagaagauaaaaacaaaauauuuuggaguguuuuccaac

SEQ ID NO: 280123 - RNA, 64 nt, hsa
ccucugcauguauauuugauaacaugucuuuuguaaaacaaaaauuacaaaaaaauuuguuuac

SEQ ID NO: 280124 - RNA, 64 nt, hsa
auaauugauggucagagccagcacuggaauuuugaaaacaaauaaggugauuaucuauuuuagg

SEQ ID NO: 280125 - RNA, 64 nt, hsa
ucugaauaauuauggaaguugggacauguuaaggaaaacaaauauguucaucaccaacaaucag

SEQ ID NO: 280126 - RNA, 64 nt, hsa
ccagccuggcgacacagugagacucugucucaaaaaaacaaaacaaacaaacaaaaauacaaaa

SEQ ID NO: 280127 - RNA, 64 nt, hsa
cuggcgacacagugagacucugucucaaaaaaacaaaacaaacaaacaaaaauacaaaaaauua

SEQ ID NO: 280128 - RNA, 64 nt, hsa
uggagaggcaggagcccuggggugagaaaagcaaaaaacaaacaaaaaacaaaacccuggagug

SEQ ID NO: 280129 - RNA, 64 nt, hsa
gagcccuggggugagaaaagcaaaaaacaaacaaaaaacaaaacccuggaguguuaggaggaga

SEQ ID NO: 280130 - RNA, 64 nt, hsa
uguaggaaauguucuuuuuuaaaaaaaaauaacaaaaacaaaacaaaacuauuuauuuugugau

SEQ ID NO: 280131 - RNA, 64 nt, hsa
gaaauguucuuuuuuaaaaaaaaauaacaaaaacaaaacaaaacuauuuauuuugugauuguuu

SEQ ID NO: 280132 - RNA, 64 nt, hsa
uguuucuuaaugaacuugcaaaggaauauugcuaaaaacaaacaaaaaaaacuguuaucgaacu

SEQ ID NO: 280133 - RNA, 64 nt, hsa
guacuuuauuuuuuugugccuucugaaaggaucuaaaacaaaaauauuuugccuuuuuuucccc

SEQ ID NO: 280134 - RNA, 64 nt, hsa
agcauaaguuacaaccccuaggagcucugcuuucaaaacaaaaagagauugggggaguggggag

SEQ ID NO: 280135 - RNA, 64 nt, hsa
uauaacuauuuggagggucuuuaacauugccaaaaaaacaaauauguugauuuuuauuuuauuu

SEQ ID NO: 280136 - RNA, 64 nt, hsa
guauauguucagcaauguugaucucauaaaaggaaaaacaaaagauuuaaguauucuauauacc

SEQ ID NO: 280137 - RNA, 64 nt, hsa
guuaacuaaaaaugcugagaccccuuuuuauagaaaaacaaaaagacaucaagucuucuuaauu

SEQ ID NO: 280138 - RNA, 64 nt, hsa
gggccccuauaacaaaagacagauugacaagagaaaaacaaacauaaauuuauuagcggguaua

SEQ ID NO: 280139 - RNA, 64 nt, hsa
ucgacaaagaacaguaaauuuuuagagaaacaacaaaacaaagaaaaagagcuuugagucugua

SEQ ID NO: 280140 - RNA, 64 nt, hsa
cugagaucgcgguauuaaaucugugaaagaaaacaaaacaaaacaaaaacggcuucuuggcguu

SEQ ID NO: 280141 - RNA, 64 nt, hsa
uuuggcugagaucgcgguauuaaaucugugaaagaaaacaaaacaaaacaaaaacggcuucuug

SEQ ID NO: 280142 - RNA, 64 nt, hsa
agcaaaaaaaaaaaaaaaacaaaaaaacaaaaaaaaaacaaaacaguuuuuaaaacugauuuua

SEQ ID NO: 280143 - RNA, 64 nt, hsa
aaauaguccugagcaaaaaaaaaaaaaaaacaaaaaaacaaaaaaaaaacaaaacaguuuuuaa

SEQ ID NO: 280144 - RNA, 64 nt, hsa
cugaaagcaaauaguccugagcaaaaaaaaaaaaaaaacaaaaaaacaaaaaaaaaacaaaaca

SEQ ID NO: 280145 - RNA, 64 nt, hsa
uuccccaccuccucauuuuaguaaaaaacaaacaaaaacaaaaaaaccugagaaguuugaauug

SEQ ID NO: 280146 - RNA, 64 nt, hsa
caaauagcucuuccccaccuccucauuuuaguaaaaaacaaacaaaaacaaaaaaaccugagaa

SEQ ID NO: 280147 - RNA, 64 nt, hsa
ucuguagauucucuccucucccaucccagaaaacaaaacaaaauaaugcuuuucgaaauuguuu

SEQ ID NO: 280148 - RNA, 64 nt, hsa
gcaaaucuguagauucucuccucucccaucccagaaaacaaaacaaaauaaugcuuuucgaaau

SEQ ID NO: 280149 - RNA, 64 nt, hsa
gcccaccugggcacuuuuagauaaaaaaaaaaaaaaaacaaaaaacaacaccaaaaaaacagca

SEQ ID NO: 280150 - RNA, 64 nt, hsa
ccauuuuaaggaacuauucuuuggaaaaaaacaaaaaacaaaaaaaacaacaaaaaaagcuaag

SEQ ID NO: 280151 - RNA, 64 nt, hsa
ggagcauccauuuuaaggaacuauucuuuggaaaaaaacaaaaaacaaaaaaaacaacaaaaaa

SEQ ID NO: 280152 - RNA, 64 nt, hsa
gagcgacacucggucucaaaaaacaaaacaaaacaaaacaaaauuagagauugggucuuuccca

SEQ ID NO: 280153 - RNA, 64 nt, hsa
ugacagagcgacacucggucucaaaaaacaaaacaaaacaaaacaaaauuagagauugggucuu

SEQ ID NO: 280154 - RNA, 64 nt, hsa
cugggugacagagcgacacucggucucaaaaaacaaaacaaaacaaaacaaaauuagagauugg

SEQ ID NO: 280155 - RNA, 64 nt, hsa
ccagccugggugacagagcgacacucggucucaaaaaacaaaacaaaacaaaacaaaauuagag

SEQ ID NO: 280156 - RNA, 64 nt, hsa
acaagaugguacaaccuuuauucuuuuccaaaauaaaacaaagggcacagcaucuguagucagc

SEQ ID NO: 280157 - RNA, 64 nt, hsa
ucuguacaaaggggaaagaacauaaagguaaaacaaaacaaaacaacauuuugagaacaaagau

SEQ ID NO: 280158 - RNA, 64 nt, hsa
uagcaucuguacaaaggggaaagaacauaaagguaaaacaaaacaaaacaacauuuugagaaca

SEQ ID NO: 280159 - RNA, 64 nt, hsa
cuccagccugggcgacagagcaagacucugucucaaaacaaacacaaauacaguauccaaacau

SEQ ID NO: 280160 - RNA, 64 nt, hsa
gccuggccaacauggugaaaccccgucuccacuaaaaacaaaaacaauuagcugggcauggugg

SEQ ID NO: 280161 - RNA, 64 nt, hsa
gggcgacagagcaagacgccaucucaaaaacaaaaaaacaaaauucauguuacuaaaagacagg

SEQ ID NO: 280162 - RNA, 64 nt, hsa
uccagccugggcgacagagcaagacgccaucucaaaaacaaaaaaacaaaauucauguuacuaa

SEQ ID NO: 280163 - RNA, 64 nt, hsa
uaugugucuuaaugcagucagauuguaaaaaacaaaaacaaagaaacuaagaaucuuacuaaaa

SEQ ID NO: 280164 - RNA, 64 nt, hsa
agaguauaugugucuuaaugcagucagauuguaaaaaacaaaaacaaagaaacuaagaaucuua

SEQ ID NO: 280165 - RNA, 64 nt, hsa
acuacaaaagaaaaauauaaaaguaaaacaaacaaaaacaaaccugaaaacugcuuggcauuug

SEQ ID NO: 280166 - RNA, 54 nt, hsa
acuacaaaagaaaaauauaaaaguaaaacaaacaaaaacaaaccugaaaacugc

SEQ ID NO: 280167 - RNA, 64 nt, hsa
uacaauuuaaaaaguauauucuauaauaaauaauaaaacaaauuguuuuaaauguuuaguuuca

SEQ ID NO: 280168 - RNA, 64 nt, hsa
uuugugguuucaaaaguguaaauaaccaauucagaaaacaaaauggaaaaacgaccccuuguua

SEQ ID NO: 280169 - RNA, 64 nt, hsa
ucuaggacccgguuucuuuuacugauuuaaaaacaaaacaaaaaaaaauaaaaaaguugugccu

SEQ ID NO: 280170 - RNA, 64 nt, hsa
cagcuucuaggacccgguuucuuuuacugauuuaaaaacaaaacaaaaaaaaauaaaaaaguug

SEQ ID NO: 280171 - RNA, 64 nt, hsa
gccagcagugugauaauuuaaacauauuuaaacaaaaacaaaaaaaaugaaugcacaaacuugc

SEQ ID NO: 280172 - RNA, 64 nt, hsa
gcuucacuugccuagucuugaagaaaaaaaacaaaaaacaaaaaaaaaccuuguuccuuuauag

SEQ ID NO: 280173 - RNA, 64 nt, hsa
ucccacugcuucacuugccuagucuugaagaaaaaaaacaaaaaacaaaaaaaaaccuuguucc

SEQ ID NO: 280174 - RNA, 64 nt, hsa
cacaucgugcagucgugucauaaaaaaacaaaacaaaacaaaaaaacacuaggaguccacucaa

SEQ ID NO: 280175 - RNA, 64 nt, hsa
agauccacaucgugcagucgugucauaaaaaaacaaaacaaaacaaaaaaacacuaggagucca

SEQ ID NO: 280176 - RNA, 64 nt, hsa
ggaccagauccacaucgugcagucgugucauaaaaaaacaaaacaaaacaaaaaaacacuagga

SEQ ID NO: 280177 - RNA, 64 nt, hsa
uaguuucaguggaugauugaaaacaacaacaacaaaaacaaaaugaaacuaaucugcugccucu

SEQ ID NO: 280178 - RNA, 64 nt, hsa
acuuuacagcaacauucgccauacuagcggagguaaaacaaaagaaauauugaaaacugaggca

SEQ ID NO: 280179 - RNA, 64 nt, hsa
auguugguuucaguggcuggaauuaaaacaaaacaaaacaaacuuccaaacaguguguuggugc

SEQ ID NO: 280180 - RNA, 64 nt, hsa
cuucuauguugguuucaguggcuggaauuaaaacaaaacaaaacaaacuuccaaacaguguguu

SEQ ID NO: 280181 - RNA, 64 nt, hsa
aauaacuucuauguugguuucaguggcuggaauuaaaacaaaacaaaacaaacuuccaaacagu

SEQ ID NO: 280182 - RNA, 64 nt, hsa
acucuaucucaaaaaaaaacaaaaaaaaaaacaaaaaacaaagaugagucgcacaucugcugcu

SEQ ID NO: 280183 - RNA, 64 nt, hsa
gagcgagacucuaucucaaaaaaaaacaaaaaaaaaaacaaaaaacaaagaugagucgcacauc

SEQ ID NO: 280184 - RNA, 64 nt, hsa
gccugggcaacagagcgagacucuaucucaaaaaaaaacaaaaaaaaaaacaaaaaacaaagau

SEQ ID NO: 280185 - RNA, 64 nt, hsa
uuaguagauuuuucacacaccucauuauuaaaaaaaaacaaacaugcuggugucuugguuaccc

SEQ ID NO: 280186 - RNA, 64 nt, hsa
ucucucggucuuauaaaacucguuggugucuuauaaaacaaacagugauaaucucaaguuagaa

SEQ ID NO: 280187 - RNA, 64 nt, hsa
acuaaucacacaacaauuuugagaaguaggcuauaaaacaaaaaaagguugcuguuuucuauuu

SEQ ID NO: 280188 - RNA, 64 nt, hsa
uugacauuggcacuaaaugcauuuggggaugguuaaaacaaauuacuauagaacauuuaaauga

SEQ ID NO: 280189 - RNA, 64 nt, hsa
ugcagauauagcaaaggauuaguaauauagccugaaaacaaaugggagcauagcagugugugag

SEQ ID NO: 280190 - RNA, 64 nt, hsa
acaugaauauaaugcuuacuucaaauuguuuaguaaaacaaaauaacuaaagaaaugugagcuu

SEQ ID NO: 280191 - RNA, 64 nt, hsa
guaacaaagugaaaacaggugagacaaugugcccaaaacaaagggaagaagagaaccuucugug

SEQ ID NO: 280192 - RNA, 64 nt, hsa
cuguugugucccuuucucuucaaagauccugagcaaaacaaagauacgcuuuccauuugaugau

SEQ ID NO: 280193 - RNA, 64 nt, hsa
gcuaugaugaccuucauauaaucagcauaaacauaaaacaaauuuuuuacuuaacaugagugca

SEQ ID NO: 280194 - RNA, 64 nt, hsa
augucauuugcuaaugaauuuuaaaagcauauauaaaacaaaacaaacaaccugccacaaugug

SEQ ID NO: 280195 - RNA, 64 nt, hsa
auuugcuaaugaauuuuaaaagcauauauaaaacaaaacaaacaaccugccacaaugugauaug

SEQ ID NO: 280196 - RNA, 64 nt, hsa
augugcaaagcaagcaaggaacauuugggguaagaaaacaaacaugaggcaaaagaaaaaauac

SEQ ID NO: 280197 - RNA, 64 nt, hsa
cagcagacauucacucuggcugcugggacaucagaaaacaaagucuucaucucucucuccaguu

SEQ ID NO: 280198 - RNA, 64 nt, hsa
ucagcugaaagaaacagauauuuuaaauugccagaaaacaaaugaugaggcaacuacagucaga

SEQ ID NO: 280199 - RNA, 64 nt, hsa
ugaacccuacuugcuaucucuaucuuagaaagcaaaaacaaacaggaguuuccagggagaaugg

SEQ ID NO: 280200 - RNA, 64 nt, hsa
auguaaccaguagcugaucuuaaggcuuuuuuaaaaaacaaaacaaaacaacaaaaaaaaaucu

SEQ ID NO: 280201 - RNA, 64 nt, hsa
accaguagcugaucuuaaggcuuuuuuaaaaaacaaaacaaaacaacaaaaaaaaaucuuuaua

SEQ ID NO: 280202 - RNA, 64 nt, hsa
ccccgugaacuuccuuugacuuauuguccccacuaaaacaaaacaaaaaacuuuuaaugccuuc

SEQ ID NO: 280203 - RNA, 64 nt, hsa
ugaacuuccuuugacuuauuguccccacuaaaacaaaacaaaaaacuuuuaaugccuuccacau

SEQ ID NO: 280204 - RNA, 64 nt, hsa
cuccaguuuggacuacagagugagacuccaucucaaaacaaaacaaaacaacaacagcaaaaaa

SEQ ID NO: 280205 - RNA, 64 nt, hsa
guuuggacuacagagugagacuccaucucaaaacaaaacaaaacaacaacagcaaaaaacaaca

SEQ ID NO: 280206 - RNA, 64 nt, hsa
aaaacaaaacaaaacaacaacagcaaaaaacaacaaaacaaaacacaaauacucucacagggca

SEQ ID NO: 280207 - RNA, 64 nt, hsa
ccgccgaccuucagcuuugugggacuaucaggaaaaaacaaaacaaaaacaaaauguagaaaaa

SEQ ID NO: 280208 - RNA, 64 nt, hsa
gaccuucagcuuugugggacuaucaggaaaaaacaaaacaaaaacaaaauguagaaaaagcaaa

SEQ ID NO: 280209 - RNA, 64 nt, hsa
cagcuuugugggacuaucaggaaaaaacaaaacaaaaacaaaauguagaaaaagcaaaagcucu

SEQ ID NO: 280210 - RNA, 64 nt, hsa
cacuuuauagaauguuguaaaacagacaaacaagaaaacaaaccacauacuuuugaaguguauu

SEQ ID NO: 280211 - RNA, 64 nt, hsa
aguuuuguuuaagguuuuggauaaggagcacuuuaaaacaaacugguguguuguuuuuaaguua

SEQ ID NO: 280212 - RNA, 64 nt, hsa
uaguacucuucuuuccuccuacucuaugaacuucaaaacaaaaacaaaacuuugagagcagcac

SEQ ID NO: 280213 - RNA, 64 nt, hsa
ucuucuuuccuccuacucuaugaacuucaaaacaaaaacaaaacuuugagagcagcacaugcau

SEQ ID NO: 280214 - RNA, 64 nt, hsa
uuaacagacugccuugguacugccgaguccucucaaaacaaacacccucuugcaaccagcuuug

SEQ ID NO: 280215 - RNA, 64 nt, hsa
cuccacaucugcuccuagcagugcaucagccaguaaaacaaacacauuuacaagaaaaauguuu

SEQ ID NO: 280216 - RNA, 64 nt, hsa
uguaggcaucaaaaggcaaaaaucaaaaaaaaaaaaaacaaaaacaaaaaaaaagaugaaccua

SEQ ID NO: 280217 - RNA, 64 nt, hsa
caucaaaaggcaaaaaucaaaaaaaaaaaaaacaaaaacaaaaaaaaagaugaaccuaggucug

SEQ ID NO: 280218 - RNA, 64 nt, hsa
cugauuuuucaauguuauucuucaguccuauuuaaaaacaaaaccaagcucccuucccuuccuc

SEQ ID NO: 280219 - RNA, 64 nt, hsa
gaaguaucagcacccagaagagaaaaaggaauuuaaaacaaaaaccacagaggcggaaauaccg

SEQ ID NO: 280220 - RNA, 64 nt, hsa
gcuaagugcaggaggcccuuuauuauugcugcagaaaacaaaagccuggcugaguugauguuuu

SEQ ID NO: 280221 - RNA, 64 nt, hsa
aaguauagcaauucaaacugaccugcauccauccaaaacaaauuccuccuucaaccuuauuuuu

SEQ ID NO: 280222 - RNA, 64 nt, hsa
aagcuuugacucuauaagcaaauugcuuuuuuccaaaacaaaaagaugucucagguuuguuuug

SEQ ID NO: 280223 - RNA, 64 nt, hsa
aauaugcuuauaaccuaguuaaagaaaggaaaagaaaacaaaaaacgaaugaaaauaacugaau

SEQ ID NO: 280224 - RNA, 64 nt, hsa
acuauguuuuaaguacacuuuagaaagucucuucaaaacaaacaguccuguauuugaacucugu

SEQ ID NO: 280225 - RNA, 64 nt, hsa
uuuuaaugagacuuccuaggaagggaugcacuguaaaacaaaaguauucuuguaacucaguuuu

SEQ ID NO: 280226 - RNA, 64 nt, hsa
gugaaauauaaggcacguuuucacacaaaauuucaaaacaaaaacaagagggcauagaugcaau

SEQ ID NO: 280227 - RNA, 64 nt, hsa
ucucaugcucuuguuucucaaaaaagaaaaacaaaaaacaaaaaacaggggccaauaaauuccc

SEQ ID NO: 280228 - RNA, 64 nt, hsa
acaaguaucucaugcucuuguuucucaaaaaagaaaaacaaaaaacaaaaaacaggggccaaua

SEQ ID NO: 280229 - RNA, 64 nt, hsa
uagaauaggcugcaucuuuuuaacaacucauuaaaaaacaaaacaacucuggcuuuugagauga

SEQ ID NO: 280230 - RNA, 64 nt, hsa
agucuauuucagccuagaagaaaagauaaugaguaaaacaaauugcguuguuuaaaggauuaua

SEQ ID NO: 280231 - RNA, 64 nt, hsa
cucuuauguauuuguaaggcugggcuucaaaaucaaaacaaaaaccccaaaaacagcaggcaaa

SEQ ID NO: 280232 - RNA, 64 nt, hsa
uacagauucugcaguuuaugauauuguuuuucuaaaaacaaaugcuguuuauacauaugagaua

SEQ ID NO: 280233 - RNA, 64 nt, hsa
uagcgaacucuagcaaaacuuguuuagcuuagcaaaaacaaacacacaaaaaacugagaacucu

SEQ ID NO: 280234 - RNA, 64 nt, hsa
gcugccagagguucugauauguaagaaaacugcaaaaacaaauauagacaaauauuuugauucu

SEQ ID NO: 280235 - RNA, 64 nt, hsa
guuuauuuuaguaaaaaaaaaaaaacaaaaaacaaaaacaaaagauuuuuaucaaauguuauga

SEQ ID NO: 280236 - RNA, 64 nt, hsa
gaacagguuuauuuuaguaaaaaaaaaaaaacaaaaaacaaaaacaaaagauuuuuaucaaaug

SEQ ID NO: 280237 - RNA, 64 nt, hsa
uucccccgaacagguuuauuuuaguaaaaaaaaaaaaacaaaaaacaaaaacaaaagauuuuua

SEQ ID NO: 280238 - RNA, 64 nt, hsa
ccuauugaucuuaagguauuuacauguauguggaaaaacaaaacacuuaacuagaauucucuaa

SEQ ID NO: 280239 - RNA, 64 nt, hsa
gcuaauuuauuuuuuugcaucuuaguuauuuuuaaaaacaaauucuucaaguaugaagacuaaa

SEQ ID NO: 280240 - RNA, 64 nt, hsa
ggguccccuuuccauguauguuuucuugucacugaaaacaaacaacgcugaguuuaucaagaaa

SEQ ID NO: 280241 - RNA, 64 nt, hsa
uacacauccugugccccaauauggugcauuaugaaaaacaaaaucauuuucuaaaaugcauuuu

SEQ ID NO: 280242 - RNA, 64 nt, hsa
guauucauggcacaaagcuuucccaagcugaauaaaaacaaacauuaacaaauuuuuaccuugu

SEQ ID NO: 280243 - RNA, 64 nt, hsa
uaguuuuacuguacauuuauuuuuaaagaaaaagaaaacaaaagccagacaaacccaaguuguc

SEQ ID NO: 280244 - RNA, 64 nt, hsa
gugagacugcaucucaaaaaaaacccaaaaaacaaaaacaaacaacaacaacaaaauuauaaag

SEQ ID NO: 280245 - RNA, 64 nt, hsa
uacagagugagacugcaucucaaaaaaaacccaaaaaacaaaaacaaacaacaacaacaaaauu

SEQ ID NO: 280246 - RNA, 64 nt, hsa
caugguaaaacccugucucuacugaaaaacaacaaaaacaaaaacacaaauuagucgggugugg

SEQ ID NO: 280247 - RNA, 64 nt, hsa
gugagacuccaucucauuaaaaaaaacgaaaacaaaaacaaaaaaaacacaaaccaucaucaca

SEQ ID NO: 280248 - RNA, 64 nt, hsa
gacagagugagacuccaucucauuaaaaaaaacgaaaacaaaaacaaaaaaaacacaaaccauc

SEQ ID NO: 280249 - RNA, 64 nt, hsa
auauggaccccugagaaugagcaauugagaaaacaaaacaaaaggaacaauccaugaacuuaga

SEQ ID NO: 280250 - RNA, 64 nt, hsa
cuuguauauggaccccugagaaugagcaauugagaaaacaaaacaaaaggaacaauccaugaac

SEQ ID NO: 280251 - RNA, 64 nt, hsa
uuucaauaaaaaaaagagaaacuguccuuaaaacaaaacaaaaaccaaaaaagucacccuauca

SEQ ID NO: 280252 - RNA, 64 nt, hsa
uuucauuucaauaaaaaaaagagaaacuguccuuaaaacaaaacaaaaaccaaaaaagucaccc

SEQ ID NO: 280253 - RNA, 64 nt, hsa
cauuugcagauacaaaagauggaaauuuuucuguaaaacaaaaccuugaaggagaggagggcgg

SEQ ID NO: 280254 - RNA, 64 nt, hsa
guuuucugaagucugaggaacaaugccuuaagaaaaaacaaacagcaggaaucggugggacagu

SEQ ID NO: 280255 - RNA, 64 nt, hsa
ugcacccgggugggggacagagggaccuuuaaagaaaacaaaacuggacagaaacaggaaugug

SEQ ID NO: 280256 - RNA, 64 nt, hsa
gcacagaaaacaaauaucaaagaucuaauaauacaaaacaaacuugauuaaaacuggugcuuaa

SEQ ID NO: 280257 - RNA, 64 nt, hsa
ccgagcugccgaauucaguugacacgaggcacagaaaacaaauaucaaagaucuaauaauacaa

SEQ ID NO: 280258 - RNA, 64 nt, hsa
uauauuguuuucaggugcucaaaaugcaaaacacaaaacaaauccugcauuuagauacaccuca

SEQ ID NO: 280259 - RNA, 64 nt, hsa
auuuaggaauuuaauaaccuuuaagucagaaacuaaaacaaauacugaaauauuagcucuuccu

SEQ ID NO: 280260 - RNA, 64 nt, hsa
uuuuccugugaacacauaaauauauuuuuauagaaaaacaaaucuacauaaaauaaaucuacug

SEQ ID NO: 280261 - RNA, 64 nt, hsa
uugguuuucuccuucccaaggcagcuggauugaaaaaacaaaacaaaacaaaaaaacccagggg

SEQ ID NO: 280262 - RNA, 64 nt, hsa
uuucuccuucccaaggcagcuggauugaaaaaacaaaacaaaacaaaaaaacccaggggcguca

SEQ ID NO: 280263 - RNA, 64 nt, hsa
ccuucccaaggcagcuggauugaaaaaacaaaacaaaacaaaaaaacccaggggcgucagucga

SEQ ID NO: 280264 - RNA, 64 nt, hsa
caaacacccaaacuguuuggauugauugcuuuaaaaaacaaaccuggcucuuaccuuugaucuu

SEQ ID NO: 280265 - RNA, 64 nt, hsa
accaucagauaacuguauuuugucaggugcaauaaaaacaaaauuaaaacccaaaucaucaaga

SEQ ID NO: 280266 - RNA, 64 nt, hsa
uaccccaagaggaaguuuucugaaauaagauuuaaaaacaaaacaaaaaaaacacuuaauauuu

SEQ ID NO: 280267 - RNA, 64 nt, hsa
caagaggaaguuuucugaaauaagauuuaaaaacaaaacaaaaaaaacacuuaauauuucagac

SEQ ID NO: 280268 - RNA, 64 nt, hsa
aaaaaauuuccagaagaggaaaaaaaaacuacaaaaaacaaaacauugaagguugauauuuuau

SEQ ID NO: 280269 - RNA, 64 nt, hsa
aaggcucucgaggcaagcugucaacgucuuguugaaaacaaaaaucaagaaagaauugaaauac

SEQ ID NO: 280270 - RNA, 64 nt, hsa
agauaggagcuuauggucaaaaagugcaaaaaaaaaaacaaaaaaaaagcaauagauagagaaa

SEQ ID NO: 280271 - RNA, 64 nt, hsa
uucuauuucaaaggaaaccaaaccuuaaaaaaaaaaaacaaaaacugggcugggucuuccaaac

SEQ ID NO: 280272 - RNA, 64 nt, hsa
auugguucagccucaagucuggcccgucuucgaaaaaacaaacacauuuguaagcuuuguggga

SEQ ID NO: 280273 - RNA, 64 nt, hsa
guauauuuauaaauaaaaauauuaaauagaagguaaaacaaaucagacauacacacauuagaua

SEQ ID NO: 280274 - RNA, 64 nt, hsa
agccuggggguauauucaagguuauaugucuuagaaaacaaaaauacuuguuuggguucaguuu

SEQ ID NO: 280275 - RNA, 64 nt, hsa
uuuggcuuuuuguucuguuggugugauucaaagcaaaacaaacaaacaaaaacaaauuuuaaga

SEQ ID NO: 280276 - RNA, 64 nt, hsa
cuguuggugugauucaaagcaaaacaaacaaacaaaaacaaauuuuaagaacacaacaaaaaag

SEQ ID NO: 280277 - RNA, 64 nt, hsa
aacaugaagucucuuuaugguuagagaagaccaaaaaacaaacaaacaaacuuagaaacauaaa

SEQ ID NO: 280278 - RNA, 64 nt, hsa
aaaaaaugagacccuaaaaaguuucuagagagagaaaacaaaagaucagaaaugaaagcggggc

SEQ ID NO: 280279 - RNA, 64 nt, hsa
gaagacacaagaaaagcauuucagaggcuaauuuaaaacaaaaaguaagcaccuaaaggcaagg

SEQ ID NO: 280280 - RNA, 64 nt, hsa
uuccauuuccuagguaauuuuuuaaaagccagucaaaacaaaaacuuuacugaaaauggacaga

SEQ ID NO: 280281 - RNA, 57 nt, hsa
auuuauuguaucccauguaaaaacaaaaaaacaaaaaacaaagaaaagaaagagauu

SEQ ID NO: 280282 - RNA, 64 nt, hsa
auuuauuguaucccauguaaaaacaaaaaaacaaaaaacaaagaaaagaaagagauuuuauaga

SEQ ID NO: 280283 - RNA, 64 nt, hsa
aaacuaguuucauauauuaccuaguuauucuuucaaaacaaaacaaaaaaaaaacaaaaacuga

SEQ ID NO: 280284 - RNA, 64 nt, hsa
aguuucauauauuaccuaguuauucuuucaaaacaaaacaaaaaaaaaacaaaaacugacgcac

SEQ ID NO: 280285 - RNA, 64 nt, hsa
aaaaaaugaauuguauauauacaaaucaacuuuaaaaacaaauuucaauugcuugaagcaauug

SEQ ID NO: 280286 - RNA, 64 nt, hsa
gccuuagcaaaggcucaugcugaaauuugccaguaaaacaaagaaguuuaaagacuggcaggua

SEQ ID NO: 280287 - RNA, 64 nt, hsa
uuuguauauguaaucagauguacauuuauauugaaaaacaaaugagauggacuuaaagagcaca

SEQ ID NO: 280288 - RNA, 64 nt, hsa
guaaacuuugaagauuguuuguaucuuuuuuuaaaaaacaaaacaaaacaaaaauccccaaaau

SEQ ID NO: 280289 - RNA, 64 nt, hsa
cuuugaagauuguuuguaucuuuuuuuaaaaaacaaaacaaaacaaaaauccccaaaauauaua

SEQ ID NO: 280290 - RNA, 64 nt, hsa
aagauuguuuguaucuuuuuuuaaaaaacaaaacaaaacaaaaauccccaaaauauauagaaau

SEQ ID NO: 280291 - RNA, 64 nt, hsa
aauuuguauuuagaaaagguuuauauuauuagugaaaacaaaacuaaagggaaguucaaguucu

SEQ ID NO: 280292 - RNA, 64 nt, hsa
ugucucauauaauaaggugaugucggaaacacgcaaaacaaaacgaaaaaagauuucucaguau

SEQ ID NO: 280293 - RNA, 64 nt, hsa
aguaauuguacugcaauaauuuuucaaaaaacaaaaaacaaaacaaacaaaagagaacuaugca

SEQ ID NO: 280294 - RNA, 64 nt, hsa
aaauaggaguaauuguacugcaauaauuuuucaaaaaacaaaaaacaaaacaaacaaaagagaa

SEQ ID NO: 280295 - RNA, 64 nt, hsa
ugauauauaauuauuucauguuacauaauaacccaaaacaaauaauuacuugaauauguuugua

SEQ ID NO: 280296 - RNA, 64 nt, hsa
uaacaauauuauuauuguuauaacuaaaaaaaaaaaaacaaaaacaagcagcuuuugugacuaa

SEQ ID NO: 280297 - RNA, 64 nt, hsa
ccugggugacagagugagacccugucucaaaagcaaaacaaacagcaauaacaauauuauuauu

SEQ ID NO: 280298 - RNA, 64 nt, hsa
ugucuugcgugauuuguauauuucacugguuuaaaaaacaaacaucgaaaggcuuaugccaaau

SEQ ID NO: 280299 - RNA, 64 nt, hsa
caagauaaaaggucuugggaaaacaaaacaaaacaaaacaaaccucccuuccccagcagggcug

SEQ ID NO: 280300 - RNA, 64 nt, hsa
uggugcaagauaaaaggucuugggaaaacaaaacaaaacaaaacaaaccucccuuccccagcag

SEQ ID NO: 280301 - RNA, 64 nt, hsa
uucucuggugcaagauaaaaggucuugggaaaacaaaacaaaacaaaacaaaccucccuucccc

SEQ ID NO: 280302 - RNA, 64 nt, hsa
guaaauucucuggugcaagauaaaaggucuugggaaaacaaaacaaaacaaaacaaaccucccu

SEQ ID NO: 280303 - RNA, 64 nt, hsa
guuguaaaaaauauccaucagaaaaaugacacacaaaacaaaauaucuggaccuuuacagaaga

SEQ ID NO: 280304 - RNA, 64 nt, hsa
gagaauuuuucccugugaaaaguaagaccaagaaaaaacaaacuaaagacaugugacuuauuca

SEQ ID NO: 280305 - RNA, 64 nt, hsa
ucucuuucuuaugaacaaaacaaaacaacaacaaaaaacaaacaaacaaaaaagcuauggcacu

SEQ ID NO: 280306 - RNA, 64 nt, hsa
ggauaaguaguaucuuucucucuuucuuaugaacaaaacaaaacaacaacaaaaaacaaacaaa

SEQ ID NO: 280307 - RNA, 64 nt, hsa
guaagaacuauuuuuaaaauauucaaacaaaacuaaaacaaaaauccagugucacaugggccug

SEQ ID NO: 280308 - RNA, 64 nt, hsa
auuugaauaguuccugcuuucugcaccucccaccaaaacaaacuuuucaaugaucaaaaaaugc

SEQ ID NO: 280309 - RNA, 64 nt, hsa
uauuuuguuguguaaaauugaucggauugauuaaaaaacaaauucucuggaauuugugcguuca

SEQ ID NO: 280310 - RNA, 64 nt, hsa
gacaaacuuguuucaaugauagucuucauuuuuaaaaacaaaaaggcaggcagacagaaauaau

SEQ ID NO: 280311 - RNA, 64 nt, hsa
uuggcaugccaaauuaacuugcauguuuguuaaaaaaacaaacacauguuuugaagagaaacca

SEQ ID NO: 280312 - RNA, 64 nt, hsa
gauuuauuaaauuuccuucaaacuguuuaucuuuaaaacaaauauaagguuuuaauuauacugc

SEQ ID NO: 280313 - RNA, 64 nt, hsa
aaaaaucugaccaaaacaaacaaacagaaaacagaaaacaaaaaaaccucuaugcaaucugagu

SEQ ID NO: 280314 - RNA, 64 nt, hsa
gauacacuaugaagauguuucaaaaaaucugaccaaaacaaacaaacagaaaacagaaaacaaa

SEQ ID NO: 280315 - RNA, 64 nt, hsa
guauuuaaagcaaaaaaacgaaaaacaaaaaacaaaaacaaaccuuuugguaacugugcacugu

SEQ ID NO: 280316 - RNA, 64 nt, hsa
guuuugguauuuaaagcaaaaaaacgaaaaacaaaaaacaaaaacaaaccuuuugguaacugug

SEQ ID NO: 280317 - RNA, 64 nt, hsa
uuuuguaguuuugguauuuaaagcaaaaaaacgaaaaacaaaaaacaaaaacaaaccuuuuggu

SEQ ID NO: 280318 - RNA, 64 nt, hsa
ugcauacguuuugguguugcuuuucaaauguuugaaaacaaaaaaaauguuaagaaauggguuu

SEQ ID NO: 280319 - RNA, 64 nt, hsa
auuuuggguauuguaaucugaaguaugguauuacaaaacaaacaaacaaacaaaaaacccaugu

SEQ ID NO: 280320 - RNA, 64 nt, hsa
uuccaucugagugauugucaguguaaggccuuuuaaaacaaaagcaaguucuuuguuaggaauu

SEQ ID NO: 280321 - RNA, 64 nt, hsa
cugugaagaaguuuucacaacuauuuaugcugguaaaacaaaugcuguuaaaucaccuuaugcg

SEQ ID NO: 280322 - RNA, 64 nt, hsa
acagauaacaaaauacacuuuacugguaaaauuuaaaacaaaaaaggcaaaacaaaacaaacuc

SEQ ID NO: 280323 - RNA, 64 nt, hsa
acacuuuacugguaaaauuuaaaacaaaaaaggcaaaacaaaacaaacucauuuuccccuuagu

SEQ ID NO: 280324 - RNA, 64 nt, hsa
uuacugguaaaauuuaaaacaaaaaaggcaaaacaaaacaaacucauuuuccccuuaguuccca

SEQ ID NO: 280325 - RNA, 64 nt, hsa
agccuggauauuauucuuguaguuuaccucuuuaaaaacaaaacaaaacaaaacaaaaaacucc

SEQ ID NO: 280326 - RNA, 64 nt, hsa
ggauauuauucuuguaguuuaccucuuuaaaaacaaaacaaaacaaaacaaaaaacuccccuuc

SEQ ID NO: 280327 - RNA, 64 nt, hsa
uuauucuuguaguuuaccucuuuaaaaacaaaacaaaacaaaacaaaaaacuccccuuccucac

SEQ ID NO: 280328 - RNA, 64 nt, hsa
cuuguaguuuaccucuuuaaaaacaaaacaaaacaaaacaaaaaacuccccuuccucacugccc

SEQ ID NO: 280329 - RNA, 64 nt, hsa
caaccugaauucaccacagcuggaauagcuguggaaaacaaaauaaaacaacaaaauuaauaau

SEQ ID NO: 280330 - RNA, 64 nt, hsa
uuucuaguaaugcaaacaaauuauuuuuuacaaaaaaacaaaauaaauaaaauuagacuuccuu

SEQ ID NO: 280331 - RNA, 64 nt, hsa
cuggggagaggacuuaacugacuuaagaaguaggaaaacaaaaaccucucuccucagccuucca

SEQ ID NO: 280332 - RNA, 64 nt, hsa
uacuugaaauguauugacugcugacuauauuuuaaaaacaaaaugaaauaauuugaguuguauu

SEQ ID NO: 280333 - RNA, 64 nt, hsa
uacugucuguuggauaauggcuguaaaauguuuaaaaacaaaacaaaacaaaaaagaggcacua

SEQ ID NO: 280334 - RNA, 64 nt, hsa
ucuguuggauaauggcuguaaaauguuuaaaaacaaaacaaaacaaaaaagaggcacuagucua

SEQ ID NO: 280335 - RNA, 64 nt, hsa
uggauaauggcuguaaaauguuuaaaaacaaaacaaaacaaaaaagaggcacuagucuaucugc

SEQ ID NO: 280336 - RNA, 64 nt, hsa
aagcagcaucuuauguccugauuucauauaguagaaaacaaacauuggguccgacuucaaaaug

SEQ ID NO: 280337 - RNA, 64 nt, hsa
uaguuauucucuaagaggaaacuaguguuuguuaaaaacaaaaauaaaaacaaaaccacacaag

SEQ ID NO: 280338 - RNA, 64 nt, hsa
aagaggaaacuaguguuuguuaaaaacaaaaauaaaaacaaaaccacacaaggagaacccaauu

SEQ ID NO: 280339 - RNA, 64 nt, hsa
cuucaaaugaaaaccgacuaaggauuuucuuucaaaaacaaaucagaagcagaugcugauuggg

SEQ ID NO: 280340 - RNA, 64 nt, hsa
uagccugggugacagagucagacuccgucccaaaaaaacaaacaaacaaaacaaaacaaaaaaa

SEQ ID NO: 280341 - RNA, 64 nt, hsa
agagucagacuccgucccaaaaaaacaaacaaacaaaacaaaacaaaaaaaaacagaaguuaca

SEQ ID NO: 280342 - RNA, 64 nt, hsa
cagacuccgucccaaaaaaacaaacaaacaaaacaaaacaaaaaaaaacagaaguuacaaauga

SEQ ID NO: 280343 - RNA, 64 nt, hsa
cagaagcauagauuuaauugcaucuuuauuuugaaaaacaaaugaaaauugaugggguuuaaag

SEQ ID NO: 280344 - RNA, 64 nt, hsa
uuucuaguuauuguauugcuacaauuuaaauauuaaaacaaauaagagcuuucucaacaaauua

SEQ ID NO: 280345 - RNA, 64 nt, hsa
ugcauuugcaagaucugagcaaauaagauuaaguaaaacaaaucaauuguauauauaauugacc

SEQ ID NO: 280346 - RNA, 64 nt, hsa
gcccugucucaggaacaucuuaacagauggcaaaaaaacaaaaacuuuuuuucaacuccuauga

SEQ ID NO: 280347 - RNA, 64 nt, hsa
agccuggaugacagagugagaccuugucucaaacaaaacaaaacaaaaaugaaauguucuaguu

SEQ ID NO: 280348 - RNA, 64 nt, hsa
ggaugacagagugagaccuugucucaaacaaaacaaaacaaaaaugaaauguucuaguuuuggu

SEQ ID NO: 280349 - RNA, 64 nt, hsa
ugaaugguagcuuuugcacagaacuuccaaaagcaaaacaaaaacaaaaucuauuguaguuaua

SEQ ID NO: 280350 - RNA, 64 nt, hsa
guagcuuuugcacagaacuuccaaaagcaaaacaaaaacaaaaucuauuguaguuauauacuuc

SEQ ID NO: 280351 - RNA, 64 nt, hsa
agucagaaaauggccuucugugcuuucaaaaaaaaaaacaaaaaaaaaaccacacacacacaua

SEQ ID NO: 280352 - RNA, 64 nt, hsa
agccugggcaacaaagagcgaaacucugucucaaaaaacaaaccaacaaaaaccacaauugauu

SEQ ID NO: 280353 - RNA, 64 nt, hsa
uaugucaaucuguauauauuguaccuuaauaugaaaaacaaauuuuuuaauucauaaaaguauu

SEQ ID NO: 280354 - RNA, 64 nt, hsa
ugcuugucuuauuuuuagaauaauuuagaaaaacaaaacaaaggcuguuuuuccuaauuuuggc

SEQ ID NO: 280355 - RNA, 64 nt, hsa
cuaccugcuugucuuauuuuuagaauaauuuagaaaaacaaaacaaaggcuguuuuuccuaauu

SEQ ID NO: 280356 - RNA, 64 nt, hsa
agcugaacuuacugcuuauauauauuugauuguaaaaacaaaaagacagugugugugucuguug

SEQ ID NO: 280357 - RNA, 64 nt, hsa
aauuucuccuacuuuacacucucuguacaaaaacaaaacaaaacaacaacaauacaacaagaac

SEQ ID NO: 280358 - RNA, 64 nt, hsa
uuaggaauuucuccuacuuuacacucucuguacaaaaacaaaacaaaacaacaacaauacaaca

SEQ ID NO: 280359 - RNA, 64 nt, hsa
caagaguguaccauuaacuugauuguugauaauaaaaacaaaaagcaagucuagcaauugaacu

SEQ ID NO: 280360 - RNA, 64 nt, hsa
aaaaacaaaaaaguuggaaggcagaaaccauuaaaaaacaaaaagccaacaacccagaaagguu

SEQ ID NO: 280361 - RNA, 64 nt, hsa
uuguuuagaaaaaaaagacaaaaaaguaaaaauaaaaacaaaaaaguuggaaggcagaaaccau

SEQ ID NO: 280362 - RNA, 64 nt, hsa
accccacuccuacccccuuccucaacccccaaacaaaacaaacaaacuucccuggcuucgcacc

SEQ ID NO: 280363 - RNA, 64 nt, hsa
uaaauccauauuucauaaauaacugagaauaauuaaaacaaaauuaagcaaaugcacaagcaaa

SEQ ID NO: 280364 - RNA, 64 nt, hsa
aaauaccuucagccuaaggcacaaggaugccaaaaaaacaaaggugagaaaccacaacacaggu

SEQ ID NO: 280365 - RNA, 64 nt, hsa
cagaauaggauucugugauaauauuuaaauggcaaaaacaaaacauaauuuugugcaauuaaca

SEQ ID NO: 280366 - RNA, 64 nt, hsa
gaccagagagagcuuggaauguuaaaaacaaaacaaaacaaaaaaaaacaaggagaaguugucc

SEQ ID NO: 280367 - RNA, 64 nt, hsa
uaggggaccagagagagcuuggaauguuaaaaacaaaacaaaacaaaaaaaaacaaggagaagu

SEQ ID NO: 280368 - RNA, 64 nt, hsa
uuggauaggggaccagagagagcuuggaauguuaaaaacaaaacaaaacaaaaaaaaacaagga

SEQ ID NO: 280369 - RNA, 64 nt, hsa
auagaaacacauuuucuggcuagcagaaaaaaacaaaacaaaacuguuguuucucuuucuugcu

SEQ ID NO: 280370 - RNA, 64 nt, hsa
aaugaauagaaacacauuuucuggcuagcagaaaaaaacaaaacaaaacuguuguuucucuuuc

SEQ ID NO: 280371 - RNA, 64 nt, hsa
uggcacaaggaaucacacguggugcagcuaaaacaaaacaaaacaugagcaaacacaaaaccca

SEQ ID NO: 280372 - RNA, 64 nt, hsa
gaaaauggcacaaggaaucacacguggugcagcuaaaacaaaacaaaacaugagcaaacacaaa

SEQ ID NO: 280373 - RNA, 64 nt, hsa
cagaagccuauuuuuaaagcagaagcaaaaaagaaaaacaaaauaacaaaaacaacccuuccuc

SEQ ID NO: 280374 - RNA, 64 nt, hsa
ugucuuccuccaaggaguuagaauuucccaguuuaaaacaaaaagggaaauguccuagguuuuc

SEQ ID NO: 280375 - RNA, 64 nt, hsa
gcgccacugacuccuccuucagucggcuuugcccaaaacaaauuuuaguauuacugguauuaag

SEQ ID NO: 280376 - RNA, 64 nt, hsa
uuuuaaaaccagauaccacauuuucuuccuauugaaaacaaaaugccaguugcauugguuuccc

SEQ ID NO: 280377 - RNA, 64 nt, hsa
cucauuuguaguaaaacuuaaaaagcaaaaacaaaaaacaaaaaagaccuuccugugauacuuu

SEQ ID NO: 280378 - RNA, 64 nt, hsa
gcugucacucauuuguaguaaaacuuaaaaagcaaaaacaaaaaacaaaaaagaccuuccugug

SEQ ID NO: 280379 - RNA, 64 nt, hsa
caccaacacaccacucauuggaaaauggaaaaaaaaaacaaaaaaaaaacaaaaaaauguacaa

SEQ ID NO: 280380 - RNA, 64 nt, hsa
cacucauuggaaaauggaaaaaaaaaacaaaaaaaaaacaaaaaaauguacaauggaugcauug

SEQ ID NO: 280381 - RNA, 64 nt, hsa
cauagaaagugccagaaaguguuuaacuugucaaaaaacaaaaacccagcaacagaaaaaugga

SEQ ID NO: 280382 - RNA, 64 nt, hsa
uauaugcacauauauauauguauuuaaaaaaaucaaaacaaaaaaaaacucauuuauaccugug

SEQ ID NO: 280383 - RNA, 64 nt, hsa
auaaucccacagaauuuacuuuaaaugucacguaaaaacaaauucaccuaagauagucuugcuu

SEQ ID NO: 280384 - RNA, 64 nt, hsa
uuguauaaguuaaggcagccauaaaugaaaauacaaaacaaacguuugcuuuuguauuugauuc

SEQ ID NO: 280385 - RNA, 64 nt, hsa
gcucuucuaaggaaauggagaagcucuguuuauaaaaacaaaaacaaaaccagcugcuacucau

SEQ ID NO: 280386 - RNA, 64 nt, hsa
cuaaggaaauggagaagcucuguuuauaaaaacaaaaacaaaaccagcugcuacucauaaguug

SEQ ID NO: 280387 - RNA, 64 nt, hsa
ccagccugggcgacagagcgagacucugccucaaaaaacaaaacaaaacaaaacacucacccau

SEQ ID NO: 280388 - RNA, 64 nt, hsa
cugggcgacagagcgagacucugccucaaaaaacaaaacaaaacaaaacacucacccaucaacg

SEQ ID NO: 280389 - RNA, 64 nt, hsa
cgacagagcgagacucugccucaaaaaacaaaacaaaacaaaacacucacccaucaacgaauau

SEQ ID NO: 280390 - RNA, 64 nt, hsa
ggcugagcugagcuucgguucuccagaauguaagaaaacaaaaucuaaaacaaaaucugaacuc

SEQ ID NO: 280391 - RNA, 64 nt, hsa
cuucgguucuccagaauguaagaaaacaaaaucuaaaacaaaaucugaacucucaaaagucuau

SEQ ID NO: 280392 - RNA, 64 nt, hsa
uggaagaaccuguuugaugcaaaaaagaaaaugaaaaacaaaacaaaaaauccccaaaaccuua

SEQ ID NO: 280393 - RNA, 64 nt, hsa
gaaccuguuugaugcaaaaaagaaaaugaaaaacaaaacaaaaaauccccaaaaccuuauuaug

SEQ ID NO: 280394 - RNA, 64 nt, hsa
caaacccauguugaaacuaguacuuuucccuuuaaaaacaaaccaaaaaaaaaaacaaaaaaaa

SEQ ID NO: 280395 - RNA, 64 nt, hsa
uaguacuuuucccuuuaaaaacaaaccaaaaaaaaaaacaaaaaaaaacuuuuuaauuaaagaa

SEQ ID NO: 280396 - RNA, 64 nt, hsa
uggugaaacccugccucuacuaaaaauacaaaaaaaaacaaaauuagccgggcgugguugcggg

SEQ ID NO: 280397 - RNA, 64 nt, hsa
cuccagucugggcgacagagugagacuccaucucaaaacaaacaaaaaaaggauggggcugggc

SEQ ID NO: 280398 - RNA, 64 nt, hsa
guuuucagaaggaacaacaccagggaaugccaaaaaaacaaagggcaagucaaccaaggcauuu

SEQ ID NO: 280399 - RNA, 64 nt, hsa
ucagaaaagaaaaagaaugaugcuucuugcaacaaaaacaaaagugauuaugucacgagaggag

SEQ ID NO: 280400 - RNA, 64 nt, hsa
uuuggagucuuucaugucuaaaagauuuaaguuaaaaacaaaguguuacuuggaagguuagcuu

SEQ ID NO: 280401 - RNA, 64 nt, hsa
ggccuaggcuggcuccagugugccaugcccagccaaaacaaacacagagcugcccaggcuuucu

SEQ ID NO: 280402 - RNA, 64 nt, hsa
auuucacaaguccugugaggcaaaaaaacaaaacaaaacaaaacaaccaaacaaauacaaucua

SEQ ID NO: 280403 - RNA, 64 nt, hsa
agacuauuucacaaguccugugaggcaaaaaaacaaaacaaaacaaaacaaccaaacaaauaca

SEQ ID NO: 280404 - RNA, 64 nt, hsa
ucuuaagacuauuucacaaguccugugaggcaaaaaaacaaaacaaaacaaaacaaccaaacaa

SEQ ID NO: 280405 - RNA, 64 nt, hsa
aacuuuguccuauuugucaacuggguucuggaaaaaaacaaacaugaugaagcuuuugaauaau

SEQ ID NO: 280406 - RNA, 64 nt, hsa
guuuuacuuucgugccugcauuauuuuucuauuuaaaacaaaaauaaaucuaguuuagcacuaa

SEQ ID NO: 280407 - RNA, 64 nt, hsa
gcaacagagcaagacccugucugucucaaaacaaaaaacaaaaccacuuauauugcuagcuaca

SEQ ID NO: 280408 - RNA, 64 nt, hsa
agccugggcaacagagcaagacccugucugucucaaaacaaaaaacaaaaccacuuauauugcu

SEQ ID NO: 280409 - RNA, 64 nt, hsa
aagaaaauguguaaggcuugcuaaaaaacaaaacaaaacaaaacacaguccugcauacucacca

SEQ ID NO: 280410 - RNA, 64 nt, hsa
uacaaaagaaaauguguaaggcuugcuaaaaaacaaaacaaaacaaaacacaguccugcauacu

SEQ ID NO: 280411 - RNA, 64 nt, hsa
uugcauacaaaagaaaauguguaaggcuugcuaaaaaacaaaacaaaacaaaacacaguccugc

SEQ ID NO: 280412 - RNA, 64 nt, hsa
uucaauuaggaaaaguaaaauccaaaauguuagcaaaacaaagugcaauauuaaauguuugcuu

SEQ ID NO: 280413 - RNA, 64 nt, hsa
uugaccugguuaaauacugucuuaaagcucauacaaaacaaauaggcuuuuccauaaguggccu

SEQ ID NO: 280414 - RNA, 64 nt, hsa
uuaaaacuuguuuguggucagcacaacaaggaacaaaacaaagcuuugaaaaaacuuuaacaug

SEQ ID NO: 280415 - RNA, 64 nt, hsa
gaaaaacaaaacaaaacaaaacaaaaacaggaaaaaaacaaaaaaccaaagugguaaggauuca

SEQ ID NO: 280416 - RNA, 64 nt, hsa
aagccucggguaacacugaaaaacaaaacaaaacaaaacaaaaacaggaaaaaaacaaaaaacc

SEQ ID NO: 280417 - RNA, 64 nt, hsa
cagagaagccucggguaacacugaaaaacaaaacaaaacaaaacaaaaacaggaaaaaaacaaa

SEQ ID NO: 280418 - RNA, 64 nt, hsa
cucuucagagaagccucggguaacacugaaaaacaaaacaaaacaaaacaaaaacaggaaaaaa

SEQ ID NO: 280419 - RNA, 64 nt, hsa
acuagcucuucagagaagccucggguaacacugaaaaacaaaacaaaacaaaacaaaaacagga

SEQ ID NO: 280420 - RNA, 64 nt, hsa
agaauuuuuuuuuaagggccuuggagccaucucuaaaacaaaccucaagggauuuagugcccug

SEQ ID NO: 280421 - RNA, 64 nt, hsa
guaaaggugaaaacauccccuuucaccccucugcaaaacaaacaagcaacauccucaaaaccca

SEQ ID NO: 280422 - RNA, 64 nt, hsa
ugggugacagagcgagacucugucucaaaaaaacaaaacaaaaaaacaccaaaaaaacccccaa

SEQ ID NO: 280423 - RNA, 64 nt, hsa
cagccugggugacagagcgagacucugucucaaaaaaacaaaacaaaaaaacaccaaaaaaacc

SEQ ID NO: 280424 - RNA, 64 nt, hsa
uguguggguaugcguggguguauguuugggaagaaaaacaaaggugcagacuaucuuccuuuuu

SEQ ID NO: 280425 - RNA, 64 nt, hsa
uuuaaaaaagaaaauauguaauauaauguaaaaaaaaacaaaaaaaagcuuuuaugauggauuu

SEQ ID NO: 280426 - RNA, 64 nt, hsa
uuuauauuuaaauguagacuuuugacacuuuuaaaaaacaaaaaaagacaagagagaugaaaac

SEQ ID NO: 280427 - RNA, 64 nt, hsa
aggagaauuagccaaacacuguaagcuuuuaagaaaaacaaaguuuuaaacgaaauacugcucu

SEQ ID NO: 280428 - RNA, 64 nt, hsa
gaaagaaagcugcaauuauccgccaacugcauuuaaaacaaaacaaaacagaaaaaucaaaaua

SEQ ID NO: 280429 - RNA, 64 nt, hsa
aaagcugcaauuauccgccaacugcauuuaaaacaaaacaaaacagaaaaaucaaaauaacauu

SEQ ID NO: 280430 - RNA, 64 nt, hsa
aaucuaagaauacgcggucuccugagaacuucaaaaaacaaaaacaaaaaaacccaaaggcccu

SEQ ID NO: 280431 - RNA, 64 nt, hsa
agaauacgcggucuccugagaacuucaaaaaacaaaaacaaaaaaacccaaaggcccuuuucag

SEQ ID NO: 280432 - RNA, 64 nt, hsa
cccgggcaacaagagcgaaaccccaucucgaaaaaaaacaaaacaaaacuagacaagugagugc

SEQ ID NO: 280433 - RNA, 64 nt, hsa
gcaacaagagcgaaaccccaucucgaaaaaaaacaaaacaaaacuagacaagugagugccuacg

SEQ ID NO: 280434 - RNA, 64 nt, hsa
guuucuccuucugacuuuuaauaaugguaauaggaaaacaaaacccaaagcuuuucagaacuuc

SEQ ID NO: 280435 - RNA, 64 nt, hsa
aaaucuuacuuucuuuuaaugaccaaccuuagguaaaacaaaaauauuguaauccuagaaauua

SEQ ID NO: 280436 - RNA, 64 nt, hsa
uuuucugcacuauaugcaaacaggguaacuaacuaaaacaaagccacuuucaaucuucaauccu

SEQ ID NO: 280437 - RNA, 64 nt, hsa
caucagaugacaagaaaggcugcuguacugaaguaaaacaaacaauaccugaaugcucuguagc

SEQ ID NO: 280438 - RNA, 64 nt, hsa
uaguucugcaaauucaaagauacaguaucccuucaaaacaaauaggaguucagggaagagaaac

SEQ ID NO: 280439 - RNA, 64 nt, hsa
caaccuguaaacaugugccuguaacuuacuuccaaaaacaaaaucauacuuauuagaagaaaau

SEQ ID NO: 280440 - RNA, 64 nt, hsa
agccugggcaacagagcgagaaccugucucaaaaaaaacaaaaacaaaguuacuaaaaugucac

SEQ ID NO: 280441 - RNA, 64 nt, hsa
ggcaacagagcgagaaccugucucaaaaaaaacaaaaacaaaguuacuaaaaugucaccuucac

SEQ ID NO: 280442 - RNA, 64 nt, hsa
gccauaucuccaaaaaaagaaagaaaaaauacaaaaaacaaaaacaaaaaaaaaagaggguaau

SEQ ID NO: 280443 - RNA, 64 nt, hsa
ucuccaaaaaaagaaagaaaaaauacaaaaaacaaaaacaaaaaaaaaagaggguaauguacaa

SEQ ID NO: 280444 - RNA, 64 nt, hsa
uaaauugguuuggcuacagaacagaaagaaaacaaaaacaaaccucguaagggaaguaucacac

SEQ ID NO: 280445 - RNA, 64 nt, hsa
ggcugguaaauugguuuggcuacagaacagaaagaaaacaaaaacaaaccucguaagggaagua

SEQ ID NO: 280446 - RNA, 64 nt, hsa
uguaucucacuuuaaacucuuuggggaaaaaacaaaaacaaaaaaaacuaaguugcuuucuuuu

SEQ ID NO: 280447 - RNA, 64 nt, hsa
aaguacuguaucucacuuuaaacucuuuggggaaaaaacaaaaacaaaaaaaacuaaguugcuu

SEQ ID NO: 280448 - RNA, 64 nt, hsa
gaaggaaacuaaggacuuggcuccaaaacaaaacaaaacaaaaucuggagaugcugaauuuugu

SEQ ID NO: 280449 - RNA, 64 nt, hsa
acugagaaggaaacuaaggacuuggcuccaaaacaaaacaaaacaaaaucuggagaugcugaau

SEQ ID NO: 280450 - RNA, 64 nt, hsa
guguuacugagaaggaaacuaaggacuuggcuccaaaacaaaacaaaacaaaaucuggagaugc

SEQ ID NO: 280451 - RNA, 64 nt, hsa
cuccaaccugggugacagacucugucuccaaaacaaaacaaacaaacaaaaagauuuuauuaaa

SEQ ID NO: 280452 - RNA, 64 nt, hsa
cugcacuccaaccugggugacagacucugucuccaaaacaaaacaaacaaacaaaaagauuuua

SEQ ID NO: 280453 - RNA, 64 nt, hsa
ugcuaaggguuuauuuuauguaaaaaaaaaaaaaaaaacaaaaaaaaacccugagaccaugagu

SEQ ID NO: 280454 - RNA, 64 nt, hsa
cagccuggacaacaagagcgaaauucugucuaaaaaaacaaaagucccaauuaagaaccuccga

SEQ ID NO: 280455 - RNA, 64 nt, hsa
uuauugugaggaccuucucauggaagccauuaggaaaacaaacuagagguaaauaucacauuaa

SEQ ID NO: 280456 - RNA, 64 nt, hsa
ugacugagaaccugcagccauuucuuguuacaugaaaacaaaaugcuacuuguuaccucuauuu

SEQ ID NO: 280457 - RNA, 64 nt, hsa
gcugaugugcaguugagaaaacuagaggacugaaaaaacaaauuuuaacuagcaaaugcuguga

SEQ ID NO: 280458 - RNA, 64 nt, hsa
uuuuuagagguacauguuuuaaguaaauguauuuaaaacaaauuuucauggucugaauuguaua

SEQ ID NO: 280459 - RNA, 64 nt, hsa
uggauuuccuacauuucugagaucccuguauucaaaaacaaaugacaggguuguuaaguuguac

SEQ ID NO: 280460 - RNA, 64 nt, hsa
cacagaauaucaccauugcaguucaaaacaaaacaaaacaaaaagucuuuuguuugugaacacu

SEQ ID NO: 280461 - RNA, 64 nt, hsa
ugcugcacagaauaucaccauugcaguucaaaacaaaacaaaacaaaaagucuuuuguuuguga

SEQ ID NO: 280462 - RNA, 64 nt, hsa
aaauuugcugcacagaauaucaccauugcaguucaaaacaaaacaaaacaaaaagucuuuuguu

SEQ ID NO: 280463 - RNA, 64 nt, hsa
aaagaaguccugcuauguuaaaaacaaacaacaaaaaacaaacaacaaaaaaaaaauuaaaaaa

SEQ ID NO: 280464 - RNA, 64 nt, hsa
uaaaaaauaucaccaaagaaguccugcuauguuaaaaacaaacaacaaaaaacaaacaacaaaa

SEQ ID NO: 280465 - RNA, 64 nt, hsa
gacugggacuccagaaccauuaauaaaacaaaacaaaacaaagcaaaauauugaugaucaggca

SEQ ID NO: 280466 - RNA, 64 nt, hsa
guagggacugggacuccagaaccauuaauaaaacaaaacaaaacaaagcaaaauauugaugauc

SEQ ID NO: 280467 - RNA, 64 nt, hsa
cagggguagggacugggacuccagaaccauuaauaaaacaaaacaaaacaaagcaaaauauuga

SEQ ID NO: 280468 - RNA, 64 nt, hsa
aacaaacaaaaaacaaccuuagcauuaagaaauaaaaacaaaaaacaagaagcaaguuguacug

SEQ ID NO: 280469 - RNA, 64 nt, hsa
gaauuguuuuaauaucuuuacucaaaaaaacaaaaaaacaaaaacccauggaagcaacaaaaga

SEQ ID NO: 280470 - RNA, 64 nt, hsa
uggcaucugaauuguuuuaauaucuuuacucaaaaaaacaaaaaaacaaaaacccauggaagca

SEQ ID NO: 280471 - RNA, 64 nt, hsa
gucccuuggaaccuuuguacgcuuugcucaaaaaaaaacaaaaaaaaaaaacaaaaaaaaaaaa

SEQ ID NO: 280472 - RNA, 64 nt, hsa
uuuguacgcuuugcucaaaaaaaaacaaaaaaaaaaaacaaaaaaaaaaaacaacgguggagcc

SEQ ID NO: 280473 - RNA, 64 nt, hsa
cagccaaagcaacaagagcaaaaacuucgucucaaaaacaaaacaaaaaaagaguauucauugu

SEQ ID NO: 280474 - RNA, 64 nt, hsa
aaagcaacaagagcaaaaacuucgucucaaaaacaaaacaaaaaaagaguauucauugugagga

SEQ ID NO: 280475 - RNA, 64 nt, hsa
uuggugacagggucugacauggucagucuacuaaaaaacaaaaaaaaaaaacaaaaaaaaaaaa

SEQ ID NO: 280476 - RNA, 64 nt, hsa
cugacauggucagucuacuaaaaaacaaaaaaaaaaaacaaaaaaaaaaaaacaaaagaaaaaa

SEQ ID NO: 280477 - RNA, 64 nt, hsa
cuacuaaaaaacaaaaaaaaaaaacaaaaaaaaaaaaacaaaagaaaaaaauaaaaauacggug

SEQ ID NO: 280478 - RNA, 64 nt, hsa
cuguuacagauaaauggggccuuuaaaaauaugaaaaacaaacuugugaaaauguauaaaagau

SEQ ID NO: 280479 - RNA, 64 nt, hsa
gagacacccuaccuucaauuguucaucaguggguaaaacaaauucugauguacauucaggacaa

SEQ ID NO: 280480 - RNA, 64 nt, hsa
gacagagcaggacucucucucaaaaaaacacaaaaaaacaaaaacaaaaaaccauacacacaca

SEQ ID NO: 280481 - RNA, 64 nt, hsa
gcaggacucucucucaaaaaaacacaaaaaaacaaaaacaaaaaaccauacacacacacacaca

SEQ ID NO: 280482 - RNA, 64 nt, hsa
ggagggaaaaagaaauacagccucaacagauuaaaaaacaaaagucacacuuaaggauccuucu

SEQ ID NO: 280483 - RNA, 64 nt, hsa
cauccugcuuauuucucaaaaaagagggacagugaaaacaaaaacgacauugggacaugcugcu

SEQ ID NO: 280484 - RNA, 54 nt, hsa
gccaauauucucuagaaugagcacaaaacaaaucgaauaacagcuaaacaaauc

SEQ ID NO: 280485 - RNA, 64 nt, hsa
gagguuuguaaacuguccuuuuuaaaucaaacugaaaacaaaaagcuuuaaccuuucaacagaa

SEQ ID NO: 280486 - RNA, 64 nt, hsa
aaaaaaaaaaaagcgaaagacugcaguugugcuaaaaacaaaacaaaacaaacaaacaaacaaa

SEQ ID NO: 280487 - RNA, 64 nt, hsa
aaaaaaagcgaaagacugcaguugugcuaaaaacaaaacaaaacaaacaaacaaacaaaaaagu

SEQ ID NO: 280488 - RNA, 64 nt, hsa
aagcgaaagacugcaguugugcuaaaaacaaaacaaaacaaacaaacaaacaaaaaaguaaaaa

SEQ ID NO: 280489 - RNA, 64 nt, hsa
ggugcaaagcgaaacugguugcucaaguugauagaaaacaaaauucugaauaucuucaaauuaa

SEQ ID NO: 280490 - RNA, 64 nt, hsa
agagucugauaggacauauucuuguaccacagacaaaacaaaucuuauguugcauuuacuauca

SEQ ID NO: 280491 - RNA, 64 nt, hsa
uccagagacuggcucaaaaaagaaagaagcaacgaaaacaaaaugcacagccugaauggacgua

SEQ ID NO: 280492 - RNA, 64 nt, hsa
gaagcaggcuguagauuuaagggcacucaaggggaaaacaaauguaguuuccacagugugagga

SEQ ID NO: 280493 - RNA, 64 nt, hsa
agaaauuuuguuuucuggcaagaugugagauggaaaaacaaauucuggggcaaauccauggaaa

SEQ ID NO: 280494 - RNA, 64 nt, hsa
uaagauucauguguuuucuaagcuuuucauuaagaaaacaaaaguccucuggauugagauacuu

SEQ ID NO: 280495 - RNA, 64 nt, hsa
uccaccccuccccaucuggaccauaauagacaccaaaacaaacccaaauuggugaaaagaauaa

SEQ ID NO: 280496 - RNA, 64 nt, hsa
ggaaaaauaaaagaaaauguaaaaaacaaaaacaaaaacaaaaaagcaacccaguccccaaccu

SEQ ID NO: 280497 - RNA, 64 nt, hsa
aaaaugggaaaaauaaaagaaaauguaaaaaacaaaaacaaaaacaaaaaagcaacccaguccc

SEQ ID NO: 280498 - RNA, 64 nt, hsa
cuuacaaaaaugggaaaaauaaaagaaaauguaaaaaacaaaaacaaaaacaaaaaagcaaccc

SEQ ID NO: 280499 - RNA, 64 nt, hsa
aauaaaaaaugcuuugagauagcuaacugcccauaaaacaaacucaaauugcuuauaaaguuuc

SEQ ID NO: 280500 - RNA, 64 nt, hsa
ugcauucucauuggaaaugucuguuuagcuuuauaaaacaaacacuuugcugaaauaggaaaau

SEQ ID NO: 280501 - RNA, 64 nt, hsa
aaaaaagcucuagguucuucagcacauuucccccaaaacaaaauaaaauugagggcauguugca

SEQ ID NO: 280502 - RNA, 64 nt, hsa
aaaaaaaaaaacaaaaaaaaacaaaaguaaauuaaaaacaaaaccugaugaaacagaugaagga

SEQ ID NO: 280503 - RNA, 64 nt, hsa
gaaauuaaaaacaaaacaaaaaaaaaaacaaaaaaaaacaaaaguaaauuaaaaacaaaaccug

SEQ ID NO: 280504 - RNA, 64 nt, hsa
cagaaaaauagaaauuaaaaacaaaacaaaaaaaaaaacaaaaaaaaacaaaaguaaauuaaaa

SEQ ID NO: 280505 - RNA, 64 nt, hsa
uucugaguuaaccagaaaaauagaaauuaaaaacaaaacaaaaaaaaaaacaaaaaaaaacaaa

SEQ ID NO: 280506 - RNA, 64 nt, hsa
aagguuucugaguuaaccagaaaaauagaaauuaaaaacaaaacaaaaaaaaaaacaaaaaaaa

SEQ ID NO: 280507 - RNA, 64 nt, hsa
aggucuuuuaagagauuuaagcuucaguuuucucaaaacaaaacaauuauccugucuuaucuga

SEQ ID NO: 280508 - RNA, 64 nt, hsa
aguggagagggagcaagggaggccgcagagggaaaaaacaaaacguaacacaguuaagagaaau

SEQ ID NO: 280509 - RNA, 64 nt, hsa
ccccccaaaaaauaaaaaaaccacaaaaaacaaaaaaacaaaacuaaggcacuucacuuagaga

SEQ ID NO: 280510 - RNA, 64 nt, hsa
ccucccacccccccaaaaaauaaaaaaaccacaaaaaacaaaaaaacaaaacuaaggcacuuca

SEQ ID NO: 280511 - RNA, 64 nt, hsa
aggcaacagagcaagacucugucucaaaaaaaacaaaacaaaaaggaggcacaaaaccccaggc

SEQ ID NO: 280512 - RNA, 64 nt, hsa
agccuaggcaacagagcaagacucugucucaaaaaaaacaaaacaaaaaggaggcacaaaaccc

SEQ ID NO: 280513 - RNA, 64 nt, hsa
agccugagugacagagcgagacuccaucucuuuaaaaacaaacaaaaaauuaucugaaugaucc

SEQ ID NO: 280514 - RNA, 64 nt, hsa
caucauagcaagaccucaucucuacuaaaauucaaaaacaaaauuagccgggcaugauggugca

SEQ ID NO: 280515 - RNA, 64 nt, hsa
uugaaauuuucucuuguaaaacauuuagaaaacaaaaacaaaaaaaaugugauuuguuucuguc

SEQ ID NO: 280516 - RNA, 64 nt, hsa
augcuuuugaaauuuucucuuguaaaacauuuagaaaacaaaaacaaaaaaaaugugauuuguu

SEQ ID NO: 280517 - RNA, 64 nt, hsa
ggcugccaaaaccauuaaguggaaagcugauuaaaaaacaaaaauuucuaauggauuuaucaaa

SEQ ID NO: 280518 - RNA, 64 nt, hsa
gccugggcaacguggcgaaauccccgucuuuacaaaaacaaacaaacaaacaaaaaagauauug

SEQ ID NO: 280519 - RNA, 64 nt, hsa
gauauuuaggugacuuacagcaaccaauugcaacaaaacaaaauguuaagaaaugaucuuuuua

SEQ ID NO: 280520 - RNA, 64 nt, hsa
caguuuuagaaucuacugcugcuaaagcacauuaaaaacaaauccugguuuuuaauguaugcau

SEQ ID NO: 280521 - RNA, 64 nt, hsa
uuaucuacauuuugaaggguuuaugugcaaagugaaaacaaauuuugaaaaauaagacaaaucc

SEQ ID NO: 280522 - RNA, 64 nt, hsa
cacgcacaagcgccagugcgcacguguacacagaaaaacaaaaggacaagcuuucugugaaaca

SEQ ID NO: 280523 - RNA, 64 nt, hsa
ucaggaaugucuuuuuuaauuagaagacaggaagaaaacaaaaaccagacugugucccacaauc

SEQ ID NO: 280524 - RNA, 64 nt, hsa
aagguucuuguacccagagugauucuacaugggaaaaacaaaccagcuuuuuucagagagugac

SEQ ID NO: 280525 - RNA, 64 nt, hsa
uggguauuuuagacccaacacagguucuaaauuuaaaacaaauaauaauuggaacaaauaaagg

SEQ ID NO: 280526 - RNA, 64 nt, hsa
uuuucaggguauccuuaaaaaaaaacacacacgaaaaacaaaaguuugcuuguuuaaaaugaca

SEQ ID NO: 280527 - RNA, 64 nt, hsa
uuuuuuaaagcugaguaguuaagaauucccuguaaaaacaaaacccuguaaauugagccucaug

SEQ ID NO: 280528 - RNA, 64 nt, hsa
ugacgcuucuuccuauauccacucuuauuauguuaaaacaaauguauuugcgaguauuggcauu

SEQ ID NO: 280529 - RNA, 64 nt, hsa
uuucccuaaguuugaguugauaguuauuaaaaagaaaacaaaacaaaaaaaaaaggcaaggcac

SEQ ID NO: 280530 - RNA, 64 nt, hsa
cuaaguuugaguugauaguuauuaaaaagaaaacaaaacaaaaaaaaaaggcaaggcacaacaa

SEQ ID NO: 280531 - RNA, 64 nt, hsa
caugugacuaguuacaaaagcaauaaauugaaacaaaacaaaacaaaacaaaacuuguuucuua

SEQ ID NO: 280532 - RNA, 64 nt, hsa
gacuaguuacaaaagcaauaaauugaaacaaaacaaaacaaaacaaaacuuguuucuuaaaaau

SEQ ID NO: 280533 - RNA, 64 nt, hsa
guuacaaaagcaauaaauugaaacaaaacaaaacaaaacaaaacuuguuucuuaaaaaugcggu

SEQ ID NO: 280534 - RNA, 64 nt, hsa
uaaaagauucaccggauggauucugaugaaaacgaaaacaaaguaaaaugacuggcuuagcaga

SEQ ID NO: 280535 - RNA, 64 nt, hsa
cucucugauaucacuuaaagcuggaguuuauuuuaaaacaaaugaagcaugggccaccucauga

SEQ ID NO: 280536 - RNA, 64 nt, hsa
ugaacucccccaaacauggcuguggagagacaacaaaacaaaacaaagcacaaaagucucugcc

SEQ ID NO: 280537 - RNA, 64 nt, hsa
ucccccaaacauggcuguggagagacaacaaaacaaaacaaagcacaaaagucucugccaacaa

SEQ ID NO: 280538 - RNA, 64 nt, hsa
aaggauaugaugagauuuugcucacagucaugugaaaacaaaaucucagcucuuuauccauugc

SEQ ID NO: 280539 - RNA, 64 nt, hsa
ucuuuauccauugcuuucacuuaguuuuaguaccaaaacaaagagaaugcaaaguuaagcagac

SEQ ID NO: 280540 - RNA, 64 nt, hsa
ugaagaacaacuuuaucaaggaagcuaguauuuaaaaacaaauucaugagcaagcugcaaauga

SEQ ID NO: 280541 - RNA, 64 nt, hsa
gaaagaucuauguuuauaaaccagcacuuggccaaaaacaaaauuguaaaggaaauuuaaauuc

SEQ ID NO: 280542 - RNA, 64 nt, hsa
uguggaauucuuacuucauuaugaauguauuuaaaaaacaaacaccaaauaauuggaauauauu

SEQ ID NO: 280543 - RNA, 64 nt, hsa
uaauuggaauauauugcaggcauuaagcucauuaaaaacaaacuggcuugcagaaggguccgau

SEQ ID NO: 280544 - RNA, 64 nt, hsa
cacauucguuucccagugaaaagcaaaccagaacaaaacaaaaagccaccgcaauaauucggua

SEQ ID NO: 280545 - RNA, 64 nt, hsa
aauuauucuuccuaucugauuauuuguauugaagaaaacaaauuuaccaaaagcaaaagcauaa

SEQ ID NO: 280546 - RNA, 64 nt, hsa
gggauuggugcugauugaaagaacaaaacaaaacaaaacaaacacaaacaaacaaaaaaccuuc

SEQ ID NO: 280547 - RNA, 64 nt, hsa
uuuaugggauuggugcugauugaaagaacaaaacaaaacaaaacaaacacaaacaaacaaaaaa

SEQ ID NO: 280548 - RNA, 64 nt, hsa
gaucauuuaugggauuggugcugauugaaagaacaaaacaaaacaaaacaaacacaaacaaaca

SEQ ID NO: 280549 - RNA, 64 nt, hsa
uguauacaaagauauucucuauguuuuguaaguaaaaacaaaaagaaaaccuuucuuuuguuuu

SEQ ID NO: 280550 - RNA, 64 nt, hsa
auguguaaauguagaacccuaauuuuucuauaaaaaaacaaacuaacuaacuaacuguguaaag

SEQ ID NO: 280551 - RNA, 64 nt, hsa
gcccccugagaaaacacuugaauugacgcaauauaaaacaaaaugugaaaaccaaaguggauuu

SEQ ID NO: 280552 - RNA, 64 nt, hsa
uaaguugaguuuguagaggguaacaaaguaaaguaaaacaaaccuaucuugguuaacaugaaaa

SEQ ID NO: 280553 - RNA, 64 nt, hsa
auauguuuuucuuucccuuaagaaucaaaagcagaaaacaaaaacaacaguccuacuccgaugu

SEQ ID NO: 280554 - RNA, 64 nt, hsa
aaauauuugccaucuuuauuaugagccuuuaaggaaaacaaacccuaaacacaaagcaucagua

SEQ ID NO: 280555 - RNA, 64 nt, hsa
uagagaguguugaaauucaauaccaaauacaguaaaaacaaauguaaauaaaagaaaacacauc

SEQ ID NO: 280556 - RNA, 64 nt, hsa
aaaauaaaaaguauucccaagugauuuuaauuuaaaaacaaauuggcuuugucucauugaucag

SEQ ID NO: 280557 - RNA, 64 nt, hsa
uaaauccagauacauauuaauguugauaugaguaaaaacaaauaggaagaaauugaaauuucuu

SEQ ID NO: 280558 - RNA, 64 nt, hsa
augguaguaaagaaacugacaaacugaaaauaagaaaacaaaaaucaaaugccuauaauaccau

SEQ ID NO: 280559 - RNA, 64 nt, hsa
aaggcuuucagguaugaauuaaaagcaaaaacaaaaaacaaaacaauucauuagccucagauuc

SEQ ID NO: 280560 - RNA, 60 nt, hsa
uucaaggcuuucagguaugaauuaaaagcaaaaacaaaaaacaaaacaauucauuagccu

SEQ ID NO: 280561 - RNA, 64 nt, hsa
accaacaauaagcuagaaaagacaaaaaaaacaaaaaacaaaaaaacguguaauaaaguuagug

SEQ ID NO: 280562 - RNA, 64 nt, hsa
uuuuucuaccaacaauaagcuagaaaagacaaaaaaaacaaaaaacaaaaaaacguguaauaaa

SEQ ID NO: 280563 - RNA, 64 nt, hsa
aaaacaaaaaaacacaaaaaaauaguaaaauauaaaaacaaauuaauguuuuauagacccuggg

SEQ ID NO: 280564 - RNA, 64 nt, hsa
acauaaugcuaguccuagauuacuuauugauuuaaaaacaaaaaaacacaaaaaaauaguaaaa

SEQ ID NO: 280565 - RNA, 64 nt, hsa
uguagauuucugacaucaaaacuuggacccuuggaaaacaaaaguuuuaauuaaaaaaaauccu

SEQ ID NO: 280566 - RNA, 64 nt, hsa
auucuguuauauaguggaugauauacacaguggcaaaacaaaaguacauugcuuaaaauauaua

SEQ ID NO: 280567 - RNA, 64 nt, hsa
uaaacugguuuuuuucaaaaaaaaaaaaaaaacaaaaacaaaaaaaaaacacaaaagcugcaug

SEQ ID NO: 280568 - RNA, 64 nt, hsa
ucaaaauaaacugguuuuuuucaaaaaaaaaaaaaaaacaaaaacaaaaaaaaaacacaaaagc

SEQ ID NO: 280569 - RNA, 64 nt, hsa
acuggguagcaaaagaaaauggaaaaaaacccacaaaacaaacuuuaaaaaaaaaaaaaaacaa

SEQ ID NO: 280570 - RNA, 64 nt, hsa
aaaaaacccacaaaacaaacuuuaaaaaaaaaaaaaaacaaauuugccaagguuuagcugcuca

SEQ ID NO: 280571 - RNA, 64 nt, hsa
cuggaaaggaacucuccaccccucccauccugauaaaacaaacaagguuuacauuuacaacuaa

SEQ ID NO: 280572 - RNA, 64 nt, hsa
aaugauuucaaguacccuguauucuggaugcuaaaaaacaaaaacaaacaaaaaaacaaaaaca

SEQ ID NO: 280573 - RNA, 64 nt, hsa
uucaaguacccuguauucuggaugcuaaaaaacaaaaacaaacaaaaaaacaaaaacaaaaaaa

SEQ ID NO: 280574 - RNA, 64 nt, hsa
guauucuggaugcuaaaaaacaaaaacaaacaaaaaaacaaaaacaaaaaaacaaaaccagaau

SEQ ID NO: 280575 - RNA, 64 nt, hsa
uggaugcuaaaaaacaaaaacaaacaaaaaaacaaaaacaaaaaaacaaaaccagaaucaggua

SEQ ID NO: 280576 - RNA, 64 nt, hsa
aaaaaacaaaaacaaacaaaaaaacaaaaacaaaaaaacaaaaccagaaucagguaaaacagcu

SEQ ID NO: 280577 - RNA, 64 nt, hsa
auguuaaggauugucuuaaaguuccuuagccagcaaaacaaaacaaaacaaaacaaacaaauga

SEQ ID NO: 280578 - RNA, 64 nt, hsa
aaggauugucuuaaaguuccuuagccagcaaaacaaaacaaaacaaaacaaacaaaugaaaaac

SEQ ID NO: 280579 - RNA, 64 nt, hsa
uugucuuaaaguuccuuagccagcaaaacaaaacaaaacaaaacaaacaaaugaaaaacguuua

SEQ ID NO: 280580 - RNA, 64 nt, hsa
uuaaaguuccuuagccagcaaaacaaaacaaaacaaaacaaacaaaugaaaaacguuuaaaaag

SEQ ID NO: 280581 - RNA, 64 nt, hsa
ucugaggcuaagaaagguucaucucacaacaggaaaaacaaaucucaacacacauuagagauaa

SEQ ID NO: 280582 - RNA, 64 nt, hsa
uaguuuuaaccaguuguagucaaaaugcuacaauaaaacaaaaaagagaaagaaaaugaagagc

SEQ ID NO: 280583 - RNA, 64 nt, hsa
aaaagccuuuaguuguguuucuugaacuauaaagaaaacaaauuuuggcagucuuuaaguauau

SEQ ID NO: 280584 - RNA, 64 nt, hsa
uuucuuccauucuuaacaguaugugcccauuugcaaaacaaaaaugcuaauaaucaguaauagu

SEQ ID NO: 280585 - RNA, 64 nt, hsa
uuucaagaccuaacugcagccgcuuugggaaaaaaaaacaaaaaacaaaaaacagaaaacaaaa

SEQ ID NO: 280586 - RNA, 64 nt, hsa
accuaacugcagccgcuuugggaaaaaaaaacaaaaaacaaaaaacagaaaacaaaaaaaaaaa

SEQ ID NO: 280587 - RNA, 64 nt, hsa
agggaccacauuuuucaaguauuucuaaguauaaaaaacaaaacaaaaaucucuuaggaaaugu

SEQ ID NO: 280588 - RNA, 64 nt, hsa
ccacauuuuucaaguauuucuaaguauaaaaaacaaaacaaaaaucucuuaggaaaugucuaga

SEQ ID NO: 280589 - RNA, 64 nt, hsa
uccuugacaaaauuuaagcugagcuuaaaagcaaaaaacaaaaaguacacagaaauauuuauua

SEQ ID NO: 280590 - RNA, 64 nt, hsa
uacuuagugggacuauuacacacaaaacaaauuaaaaacaaauuauuccagguggaccaagaau

SEQ ID NO: 280591 - RNA, 64 nt, hsa
uagcuaacaacuacuuagugggacuauuacacacaaaacaaauuaaaaacaaauuauuccaggu

SEQ ID NO: 280592 - RNA, 64 nt, hsa
ccucaauuaucaguggcuuuaugaaguaaaguuaaaaacaaacauaggaaaugugaaaauauuu

SEQ ID NO: 280593 - RNA, 64 nt, hsa
cauuuuucuuugguucuuuuuuccuuuuuuaggaaaaacaaaacaacagacuucauccuuaggu

SEQ ID NO: 280594 - RNA, 64 nt, hsa
cagaucugugccuacuuuauuacuggaguaaaagaaaacaaaguucauugaugucgaaggauau

SEQ ID NO: 280595 - RNA, 64 nt, hsa
ccaagaaaagcaagaagcagauuagguuuuugacaaaacaaacaggccaaaagggggcugaccu

SEQ ID NO: 280596 - RNA, 64 nt, hsa
aauaccuguagaaauauuauuccagcauagcaggaaaacaaacaaaaguauuggacugucggag

SEQ ID NO: 280597 - RNA, 64 nt, hsa
auaucaaacuugcaaaaaaaaaaaaaaaaaaaaaaaaacaaaaaaacuagacaaggagagaggc

SEQ ID NO: 280598 - RNA, 64 nt, hsa
uguacacacacaacagaacaaaaugaagcaaaacaaaacaaaaaaacccacaaaaauuuguaaa

SEQ ID NO: 280599 - RNA, 64 nt, hsa
guuguuguacacacacaacagaacaaaaugaagcaaaacaaaacaaaaaaacccacaaaaauuu

SEQ ID NO: 280600 - RNA, 64 nt, hsa
ugaccugcugguguguguguauauuuacaaaaacaaaacaaacaaaccacccauugggauauaa

SEQ ID NO: 280601 - RNA, 64 nt, hsa
gaccaugaccugcugguguguguguauauuuacaaaaacaaaacaaacaaaccacccauuggga

SEQ ID NO: 280602 - RNA, 64 nt, hsa
uguguuuuguauaaaucccuaauauuuaaaaaaaaaaacaaaacaaaaaaagguuacaaaguuu

SEQ ID NO: 280603 - RNA, 64 nt, hsa
uuuguauaaaucccuaauauuuaaaaaaaaaaacaaaacaaaaaaagguuacaaaguuuguuaa

SEQ ID NO: 280604 - RNA, 64 nt, hsa
ugggauggaaaggacuagccucuacugaugcaaaaaaacaaaaagcaacacaaacguuuccuuc

SEQ ID NO: 280605 - RNA, 64 nt, hsa
caaaaugaggaagauguguucauuguggacucuaaaaacaaaacaaaacacaaaauccccuguu

SEQ ID NO: 280606 - RNA, 64 nt, hsa
ugaggaagauguguucauuguggacucuaaaaacaaaacaaaacacaaaauccccuguucaaau

SEQ ID NO: 280607 - RNA, 64 nt, hsa
auuagaaaaaaaaaauucuuguugaaauauuuugaaaacaaauucccuacuaucaucacaugcc

SEQ ID NO: 280608 - RNA, 64 nt, hsa
uucuuccuauuacuuuauugacucauuuuauugcaaaacaaaaaggauuacccaaacaacaugu

SEQ ID NO: 280609 - RNA, 64 nt, hsa
cuaauccaaguaaaggaauaugaagggauuguaaaaaacaaaauguccauugauagaccaucgu

SEQ ID NO: 280610 - RNA, 64 nt, hsa
augacaaagaccgagucuucuuuuuuuuuaaacaaaaacaaaaaaagcaaccagggcuauuugu

SEQ ID NO: 280611 - RNA, 64 nt, hsa
ucuuggaauguguauuguuuuuauuuugcgaaacaaaacaaaacaaaaaaaaaagcuuggaacu

SEQ ID NO: 280612 - RNA, 64 nt, hsa
gaauguguauuguuuuuauuuugcgaaacaaaacaaaacaaaaaaaaaagcuuggaacuccauc

SEQ ID NO: 280613 - RNA, 64 nt, hsa
aaaauagugagucucaaauuguucucuuuuaacuaaaacaaaucugcaaugaaucuagaugcaa

SEQ ID NO: 280614 - RNA, 64 nt, hsa
aacuuggcuacguauuggaaucaccuaaaaaguuaaaacaaaacauggaugucugggucccgcc

SEQ ID NO: 280615 - RNA, 64 nt, hsa
uucauugugaucagauuaaaauuacuauuugugcaaaacaaauuccacaccacauguacuguau

SEQ ID NO: 280616 - RNA, 64 nt, hsa
gaaagguggucaggcccuucuaaaugcuuaaccaaaaacaaacauuauuggaguuucaguguaa

SEQ ID NO: 280617 - RNA, 64 nt, hsa
ucuauuauuuguuuugguuagaaagugaauuuaaaaaacaaaccaaacucuaaacuuucucaga

SEQ ID NO: 280618 - RNA, 64 nt, hsa
ucuauugcaauucccuauuauauucugcaucagaaaaacaaacaaaacaaaaacaacuuuaaau

SEQ ID NO: 280619 - RNA, 64 nt, hsa
auucccuauuauauucugcaucagaaaaacaaacaaaacaaaaacaacuuuaaaugcuuguagc

SEQ ID NO: 280620 - RNA, 64 nt, hsa
uggaacuucaggucuuaagugcaaaucaaagcaaaaaacaaacaaaacuuacauggaaaaacug

SEQ ID NO: 280621 - RNA, 64 nt, hsa
aagguucucaaaggucucagaccuacaaagaguuaaaacaaacagacaaacaaaaaaaaacacu

SEQ ID NO: 280622 - RNA, 64 nt, hsa
cugccuuuucuuuguuuguuuguuuuuuucucuaaaaacaaacagcaaaagacagcugaaaaca

SEQ ID NO: 280623 - RNA, 64 nt, hsa
gauaggaaaaucugaauggaggcagcaaacagccaaaacaaacauuccccacccggcccugugc

SEQ ID NO: 280624 - RNA, 64 nt, hsa
ucuuaaauuggguucaugaugcagucuccucuuuaaaacaaaacaaaacaaaacaaaacuauac

SEQ ID NO: 280625 - RNA, 64 nt, hsa
aauuggguucaugaugcagucuccucuuuaaaacaaaacaaaacaaaacaaaacuauacuugaa

SEQ ID NO: 280626 - RNA, 64 nt, hsa
gguucaugaugcagucuccucuuuaaaacaaaacaaaacaaaacaaaacuauacuugaacaaaa

SEQ ID NO: 280627 - RNA, 64 nt, hsa
augaugcagucuccucuuuaaaacaaaacaaaacaaaacaaaacuauacuugaacaaaaggguc

SEQ ID NO: 280628 - RNA, 64 nt, hsa
agacagggagagguggagaaggaaaaaacccuacaaaacaaaaacaaaccgcauacacguucac

SEQ ID NO: 280629 - RNA, 64 nt, hsa
ggagagguggagaaggaaaaaacccuacaaaacaaaaacaaaccgcauacacguucaccgagaa

SEQ ID NO: 280630 - RNA, 64 nt, hsa
uuucccccccaucuuuaaaaauaauuaguaauaaaaaacaaaaauuccauaucuagccccaucc

SEQ ID NO: 280631 - RNA, 64 nt, hsa
gacagagccaaacuccgucaaaaaaaaacaaaacaaaacaaaaaaaagacaugggagagauggu

SEQ ID NO: 280632 - RNA, 64 nt, hsa
ggagugacagagccaaacuccgucaaaaaaaaacaaaacaaaacaaaaaaaagacaugggagag

SEQ ID NO: 280633 - RNA, 64 nt, hsa
cagcuggagugacagagccaaacuccgucaaaaaaaaacaaaacaaaacaaaaaaaagacaugg

SEQ ID NO: 280634 - RNA, 64 nt, hsa
ccauguuucaguuucugcauguagauuuaaauaaaaaacaaaacuuguaaaguuguaacauuuc

SEQ ID NO: 280635 - RNA, 64 nt, hsa
agggaucuaggugagcccauuguaaguaucauugaaaacaaaacaugcccgucaacaugucaca

SEQ ID NO: 280636 - RNA, 64 nt, hsa
caagcacuugcaaacucuuuaucccuauuucuuuaaaacaaaauaaggugaaauacgaaguccu

SEQ ID NO: 280637 - RNA, 64 nt, hsa
gugggaaagcagaacugaaguuagcuuaagcauaaaaacaaagaaaaaucuucgcuuuucaugu

SEQ ID NO: 280638 - RNA, 64 nt, hsa
ggcgucuucaaaaacaaauugcacugauaaaacaaaaacaaaaguauguuuuaaaugcuuugaa

SEQ ID NO: 280639 - RNA, 64 nt, hsa
uuuuccggcgucuucaaaaacaaauugcacugauaaaacaaaaacaaaaguauguuuuaaaugc

SEQ ID NO: 280640 - RNA, 64 nt, hsa
ucagguuaaaugaaauaguuuuccggcgucuucaaaaacaaauugcacugauaaaacaaaaaca

SEQ ID NO: 280641 - RNA, 64 nt, hsa
acauugacaugcgaucaguuugggaaaugugaugaaaacaaagacuagauggguauguguguuu

SEQ ID NO: 280642 - RNA, 64 nt, hsa
uuguaaacaagauucuaaauuuaaaaaggaaaacaaaacaaacuuguucuuugcagcuuaucac

SEQ ID NO: 280643 - RNA, 64 nt, hsa
auguguuguaaacaagauucuaaauuuaaaaaggaaaacaaaacaaacuuguucuuugcagcuu

SEQ ID NO: 280644 - RNA, 64 nt, hsa
ccugaaaaaggcagaguuugaaagcucccauuuaaaaacaaaauacuuuuuaaagcccucuugc

SEQ ID NO: 280645 - RNA, 64 nt, hsa
cagaguugcuguggacagaccuguaaggacuugcaaaacaaaagaaagugagggguuuuuuuaa

SEQ ID NO: 280646 - RNA, 64 nt, hsa
uggaggacgccaguaaaaaaacaaaaacaaaaacaaaacaaaacauaaaauauaaacaaucaaa

SEQ ID NO: 280647 - RNA, 64 nt, hsa
uugaauggaggacgccaguaaaaaaacaaaaacaaaaacaaaacaaaacauaaaauauaaacaa

SEQ ID NO: 280648 - RNA, 64 nt, hsa
aaauguuugaauggaggacgccaguaaaaaaacaaaaacaaaaacaaaacaaaacauaaaauau

SEQ ID NO: 280649 - RNA, 64 nt, hsa
cuauguaaauguuugaauggaggacgccaguaaaaaaacaaaaacaaaaacaaaacaaaacaua

SEQ ID NO: 280650 - RNA, 64 nt, hsa
gaggagggaaguugugcacucugaaaaugcaugaaaaacaaaggcaaaaacuagugggaaaugu

SEQ ID NO: 280651 - RNA, 64 nt, hsa
aacucauucuucagugccucaugacugaaaacaaaaaacaaaaaaacgaaagcaucuucacaau

SEQ ID NO: 280652 - RNA, 64 nt, hsa
ucagcacaacucauucuucagugccucaugacugaaaacaaaaaacaaaaaaacgaaagcaucu

SEQ ID NO: 280653 - RNA, 64 nt, hsa
ccagccuaggcaacagagcaagacccugucucuuaaaacaaaaaaccucacacauaccuaaaau

SEQ ID NO: 280654 - RNA, 64 nt, hsa
aguaauacgcuauuucuccaacaucaagacaacuaaaacaaaugauaaaaauguuuauuuuuac

SEQ ID NO: 280655 - RNA, 64 nt, hsa
gugcuuauucuuuaacaaagagaaucuaaaaaaaaaaacaaaaaacuguugucuaauauaucua

SEQ ID NO: 280656 - RNA, 64 nt, hsa
cauauuuucauaaucagucaaaauaauaaaacuaaaaacaaaaaguaaaaauuaguucccaagu

SEQ ID NO: 280657 - RNA, 64 nt, hsa
uaaauaaaggggaaguccacauuaaaaagaaaacaaaacaaacccuaacuaacuuccaaauggg

SEQ ID NO: 280658 - RNA, 64 nt, hsa
aaauuuaaauaaaggggaaguccacauuaaaaagaaaacaaaacaaacccuaacuaacuuccaa

SEQ ID NO: 280659 - RNA, 64 nt, hsa
aaacauuuugcaaacugcagcagaaaucgaauuuaaaacaaaaaggagggacuuuaaaauaccu

SEQ ID NO: 280660 - RNA, 64 nt, hsa
aaauacuuuugaaaaaaaaguuuguuguauagucaaaacaaaucggugccacccggccgugaca

SEQ ID NO: 280661 - RNA, 64 nt, hsa
auauuuucacauuucucaguccugaagaauaaggaaaacaaagcgacgccuauuuuguauaaag

SEQ ID NO: 280662 - RNA, 64 nt, hsa
cuccagcuugggcaacagagugagacuccaucucaaaacaaaacaaaacaaaacaaaacaaaaa

SEQ ID NO: 280663 - RNA, 64 nt, hsa
gcuugggcaacagagugagacuccaucucaaaacaaaacaaaacaaaacaaaacaaaaaaaccc

SEQ ID NO: 280664 - RNA, 64 nt, hsa
ggcaacagagugagacuccaucucaaaacaaaacaaaacaaaacaaaacaaaaaaacccggcuu

SEQ ID NO: 280665 - RNA, 64 nt, hsa
cagagugagacuccaucucaaaacaaaacaaaacaaaacaaaacaaaaaaacccggcuuugcug

SEQ ID NO: 280666 - RNA, 64 nt, hsa
ugagacuccaucucaaaacaaaacaaaacaaaacaaaacaaaaaaacccggcuuugcugcuuuu

SEQ ID NO: 280667 - RNA, 64 nt, hsa
gcauaucaaccaggcaagucuugcuguaaaaaugaaaacaaaacaaacccaugagguuaccauc

SEQ ID NO: 280668 - RNA, 64 nt, hsa
ucaaccaggcaagucuugcuguaaaaaugaaaacaaaacaaacccaugagguuaccaucaagug

SEQ ID NO: 280669 - RNA, 64 nt, hsa
cacggacaguaguuucaguucugaugguauaagcaaaacaaauaaaacguuuauaaaaguugua

SEQ ID NO: 280670 - RNA, 64 nt, hsa
ccaggaauucuuccaguaggugcucagcuauuuaaaaacaaaacuauucucaaacauucaucau

SEQ ID NO: 280671 - RNA, 64 nt, hsa
aaaaguuuuuuuucaaucauuguaccuugauauuaaaacaaauauccuuuaaguauuucuaauc

SEQ ID NO: 280672 - RNA, 64 nt, hsa
gcuucuggcuuuuaauuuugccagcuaaggacauaaaacaaaaauaaacaaacaaaaacaaaua

SEQ ID NO: 280673 - RNA, 64 nt, hsa
ccagcuaaggacauaaaacaaaaauaaacaaacaaaaacaaauagccaucugcuaucagcauca

SEQ ID NO: 280674 - RNA, 64 nt, hsa
aggcccccaucagggaccagacuguuccaaaaaaaaaacaaaaaacaaaaacaaacaaaaaaac

SEQ ID NO: 280675 - RNA, 64 nt, hsa
caucagggaccagacuguuccaaaaaaaaaacaaaaaacaaaaacaaacaaaaaaacacuuaaa

SEQ ID NO: 280676 - RNA, 64 nt, hsa
ggaccagacuguuccaaaaaaaaaacaaaaaacaaaaacaaacaaaaaaacacuuaaaagccca

SEQ ID NO: 280677 - RNA, 64 nt, hsa
ccauccugggcagcauacugagacccugccuuuaaaaacaaacagaacaaaaacaaaacaccag

SEQ ID NO: 280678 - RNA, 64 nt, hsa
uacugagacccugccuuuaaaaacaaacagaacaaaaacaaaacaccagggacacauuucucug

SEQ ID NO: 280679 - RNA, 64 nt, hsa
caggauucauacaugggacuaaagguucaagaauaaaacaaagcaugacccacuuuguuccuuc

SEQ ID NO: 280680 - RNA, 64 nt, hsa
uaacaugcaaaaaaagcugaaugcacuaacucacaaaacaaacacuugcacugaauucccaaug

SEQ ID NO: 280681 - RNA, 64 nt, hsa
guucucucuaugguaaagauauuauucaccauguaaaacaaaaaacaauauuuauuguauuuua

SEQ ID NO: 280682 - RNA, 64 nt, hsa
aacuuuaugcagcuuccuuuugagggacaaauuuaaaacaaacaaccccccaucacaaacuuaa

SEQ ID NO: 280683 - RNA, 64 nt, hsa
uaaaucuacuguuucaaaaaagugucuuuacaaaaaaacaaaaaagaaaagaaauuuauuuauu

SEQ ID NO: 280684 - RNA, 64 nt, hsa
gagacucaaaucuaaaacauuuacagaguuacaaaaaacaaacaaucaaaaaaaaagacaguuu

SEQ ID NO: 280685 - RNA, 64 nt, hsa
cugguuucuucucuuugguugguguggguaaaagaaaacaaaacauuuccuauaagcugaaagc

SEQ ID NO: 280686 - RNA, 64 nt, hsa
auaguguucaaaaccuguaggcacucucuggcuaaaaacaaacucugaggccaccagcagauca

SEQ ID NO: 280687 - RNA, 64 nt, hsa
uugagaauaaguuuauauucuugcuagguaaaacaaaacaaaaacgacaguaauaccaaggaau

SEQ ID NO: 280688 - RNA, 64 nt, hsa
ggauuuugagaauaaguuuauauucuugcuagguaaaacaaaacaaaaacgacaguaauaccaa

SEQ ID NO: 280689 - RNA, 64 nt, hsa
uacaauucauaaugcagcaguuucuccaaaaacaaaaacaaaacacacaccacacacacgcgcu

SEQ ID NO: 280690 - RNA, 64 nt, hsa
agugguuacaauucauaaugcagcaguuucuccaaaaacaaaaacaaaacacacaccacacaca

SEQ ID NO: 280691 - RNA, 64 nt, hsa
uagaaguagaagaacauaagauguauuucugacuaaaacaaauggcucuuucacaugugcuuua

SEQ ID NO: 280692 - RNA, 64 nt, hsa
acccuauucuuaccuagccucccccgacuuccucaaaacaaacaagagauggcaaagcagcagu

SEQ ID NO: 280693 - RNA, 64 nt, hsa
gagcaaggcucugucucaaaaaaaaacaaaaacaaaaacaaaaaagacugauaucgcaccuaaa

SEQ ID NO: 280694 - RNA, 64 nt, hsa
gugacagagcaaggcucugucucaaaaaaaaacaaaaacaaaaacaaaaaagacugauaucgca

SEQ ID NO: 280695 - RNA, 64 nt, hsa
gccugggugacagagcaaggcucugucucaaaaaaaaacaaaaacaaaaacaaaaaagacugau

SEQ ID NO: 280696 - RNA, 64 nt, hsa
ggauuguuuaaucacaaccucaaguguuaaaacaaaaacaaacaaacacguuuguagguucuua

SEQ ID NO: 280697 - RNA, 64 nt, hsa
aguuggggauuguuuaaucacaaccucaaguguuaaaacaaaaacaaacaaacacguuuguagg

SEQ ID NO: 280698 - RNA, 64 nt, hsa
uugcauuccuugagaauguauuuaucugaagaucaaaacaaacaauccagauguauaaguacua

SEQ ID NO: 280699 - RNA, 64 nt, hsa
uuacucagauuuggggaaaugacauuuuuauacuaaaacaaacaccaaaauauuuuagaauaaa

SEQ ID NO: 280700 - RNA, 64 nt, hsa
caagggagaagauauucucgugaaagaaaaaaacaaaacaaaacaacagugcuuuuuucaaacc

SEQ ID NO: 280701 - RNA, 64 nt, hsa
ucuuccaagggagaagauauucucgugaaagaaaaaaacaaaacaaaacaacagugcuuuuuuc

SEQ ID NO: 280702 - RNA, 64 nt, hsa
aacaacaacaacaacacacaaaccugacaagagaaaaacaaaccugaagcugccgagcaggagu

SEQ ID NO: 280703 - RNA, 64 nt, hsa
gguggccccgcucccuaaauuuuuuaaaaagacaaaaacaaaacaacaacaacaacacacaaac

SEQ ID NO: 280704 - RNA, 64 nt, hsa
gagaguucucccuccacgauugugaaaacaaaugaaaacaaaauuagagcaaagcugaccugga

SEQ ID NO: 280705 - RNA, 64 nt, hsa
caagccuccagagaguucucccuccacgauugugaaaacaaaugaaaacaaaauuagagcaaag

SEQ ID NO: 280706 - RNA, 64 nt, hsa
ccugggcgacagagagagacuccaucucaaaacaaaaacaaacaaacaaacagaaagcaccguc

SEQ ID NO: 280707 - RNA, 64 nt, hsa
cuccagccugggcgacagagagagacuccaucucaaaacaaaaacaaacaaacaaacagaaagc

SEQ ID NO: 280708 - RNA, 64 nt, hsa
aguaucauuuuaguuaagugggucaaacagaaucaaaacaaaacccaaagaaauaaauaaaaaa

SEQ ID NO: 280709 - RNA, 64 nt, hsa
acagaaucaaaacaaaacccaaagaaauaaauaaaaaacaaaauggcuaaauaguuuaaaauag

SEQ ID NO: 280710 - RNA, 64 nt, hsa
gguggaaguauaaauaagccuaugaacuuauaauaaaacaaacuguagguagaaaaaaugagag

SEQ ID NO: 280711 - RNA, 64 nt, hsa
aaaaauacuuguucagguaauucuaauucuuaauaaaacaaaugaguaucauacagguagaggu

SEQ ID NO: 280712 - RNA, 64 nt, hsa
ugauauauucauauuacucguuuauaaaaaaucaaaaacaaaaggaaagaaaacaaaaaaaacu

SEQ ID NO: 280713 - RNA, 64 nt, hsa
acucguuuauaaaaaaucaaaaacaaaaggaaagaaaacaaaaaaaacuugcacaaaaauacug

SEQ ID NO: 280714 - RNA, 64 nt, hsa
accaucuccugaagaccuuucuuaccuuuuuuuaaaaacaaaaaaugaaauuauuuugcaugcu

SEQ ID NO: 280715 - RNA, 64 nt, hsa
auugaaaggguuuuucuuucuuuuuuaaaaaagaaaaacaaacuauugauuguagauaaugaaa

SEQ ID NO: 280716 - RNA, 64 nt, hsa
agacaguauuguaaucccaucaaaagaugaaagaaaaacaaaaacaaaaaccaacaacaauuag

SEQ ID NO: 280717 - RNA, 64 nt, hsa
uauuguaaucccaucaaaagaugaaagaaaaacaaaaacaaaaaccaacaacaauuagccauag

SEQ ID NO: 280718 - RNA, 64 nt, hsa
ugcucugaaaugaaaguuugucuucacaaauaucaaaacaaaauggaggaaaacuaagcauugg

SEQ ID NO: 280719 - RNA, 64 nt, hsa
agcugccucuacugcucccacguguuccuguugaaaaacaaaggacuuuccacuggucugcaga

SEQ ID NO: 280720 - RNA, 64 nt, hsa
ggggugggaacuuuuuuaaauguucauuuaaaaaaaaacaaaaacagggcagucuuguaguuua

SEQ ID NO: 280721 - RNA, 64 nt, hsa
cuggguggcaaagugagacucuggcucaaaaaaaaaaacaaaaaacaaaaccaucugcccuccu

SEQ ID NO: 280722 - RNA, 64 nt, hsa
gcaaagugagacucuggcucaaaaaaaaaaacaaaaaacaaaaccaucugcccuccuccccuag

SEQ ID NO: 280723 - RNA, 64 nt, hsa
uguaagaaaaaauguaagacaaaaaaaaaaaaaaaaaacaaacagaggcagaggcaggcaguag

SEQ ID NO: 280724 - RNA, 64 nt, hsa
gcagaaauaaaucuuuuuuuuuuuuuuuugguagaaaacaaagaggcauacucugauuuuuaua

SEQ ID NO: 280725 - RNA, 64 nt, hsa
uuacuguaaaaaaaagugcacugaacuucaaaacaaaacaaaaaacaacaacaacaaaaaacaa

SEQ ID NO: 280726 - RNA, 64 nt, hsa
uaaucuuacuguaaaaaaaagugcacugaacuucaaaacaaaacaaaaaacaacaacaacaaaa

SEQ ID NO: 280727 - RNA, 64 nt, hsa
ucaaacuucccuccaagggagauauuguaaggggaaaacaaaguguuuauuuccccaaaacaac

SEQ ID NO: 280728 - RNA, 64 nt, hsa
ggccauguuauaaauauuguuauuuaaaaaacaaaaaacaaaacacacguacauuagguccugg

SEQ ID NO: 280729 - RNA, 64 nt, hsa
agucacuggccauguuauaaauauuguuauuuaaaaaacaaaaaacaaaacacacguacauuag

SEQ ID NO: 280730 - RNA, 64 nt, hsa
cuuuggaaaagaauuccuucuuaaaaucaaaaacaaaacaaaaaaacacaaaaaacacauucua

SEQ ID NO: 280731 - RNA, 64 nt, hsa
aguaacuuuggaaaagaauuccuucuuaaaaucaaaaacaaaacaaaaaaacacaaaaaacaca

SEQ ID NO: 280732 - RNA, 64 nt, hsa
uuauauuugggguccuuuuuuauacaggaaaaacaaaacaaagaaauaauggucuuuuuuuuuu

SEQ ID NO: 280733 - RNA, 64 nt, hsa
uaccuuuauauuugggguccuuuuuuauacaggaaaaacaaaacaaagaaauaauggucuuuuu

SEQ ID NO: 280734 - RNA, 64 nt, hsa
cagaguaagacucugucucaaaaaaaaaaaaacaaaaacaaacaaacaaaaaaaacaccucacc

SEQ ID NO: 280735 - RNA, 64 nt, hsa
gggcaacagaguaagacucugucucaaaaaaaaaaaaacaaaaacaaacaaacaaaaaaaacac

SEQ ID NO: 280736 - RNA, 64 nt, hsa
uuccacaucgugagucauuuuacuuuaaaagggaaaaacaaauuuguagcaacucugaaguauc

SEQ ID NO: 280737 - RNA, 64 nt, hsa
aauggauuuuuaacagagaagucuuuguuuuugaaaaacaaaaaucaaaaacaguaacuauuuu

SEQ ID NO: 280738 - RNA, 64 nt, hsa
uuaacuuucugaagaauaucugucaaaauuuaagaaaacaaauguauaaaauuccauuuuuucc

SEQ ID NO: 280739 - RNA, 64 nt, hsa
ugguuuggucuuuauuaaaaaucacaauauuccgaaaacaaaaaaaccuaggagauaaauguag

SEQ ID NO: 280740 - RNA, 64 nt, hsa
aaugcuuuguuuaaaaaaacgaaaaaaacaaaacaaaacaaaaaaacaugagcagugguguucu

SEQ ID NO: 280741 - RNA, 64 nt, hsa
acacuaaugcuuuguuuaaaaaaacgaaaaaaacaaaacaaaacaaaaaaacaugagcaguggu

SEQ ID NO: 280742 - RNA, 64 nt, hsa
agauaacacuaaugcuuuguuuaaaaaaacgaaaaaaacaaaacaaaacaaaaaaacaugagca

SEQ ID NO: 280743 - RNA, 64 nt, hsa
ugaaaagaaaucacuuccuugaaaauuuuauuaaaaaacaaacaaacaaacaaaaagccugucc

SEQ ID NO: 280744 - RNA, 64 nt, hsa
uucacuauuuuauuuuuuaaugaauuaaaacuagaaaacaaauugaugcaaacccuggaaguca

SEQ ID NO: 280745 - RNA, 64 nt, hsa
uucuauauuuuacauucuuggaaagucuauaugaaaaacaaaaauaacaucuucaguuuuucuc

SEQ ID NO: 280746 - RNA, 64 nt, hsa
aagugaaaagagagaaaggaaaagaaaaaggagaaaaacaaagagauuucuaccagugaaaggg

SEQ ID NO: 280747 - RNA, 64 nt, hsa
cuuaucuuaaaaaguaaacaaaacaaaacaaaacaaaacaaaaaacuagauauguaauuucuaa

SEQ ID NO: 280748 - RNA, 64 nt, hsa
ggacucuuaucuuaaaaaguaaacaaaacaaaacaaaacaaaacaaaaaacuagauauguaauu

SEQ ID NO: 280749 - RNA, 64 nt, hsa
cggcaggacucuuaucuuaaaaaguaaacaaaacaaaacaaaacaaaacaaaaaacuagauaug

SEQ ID NO: 280750 - RNA, 64 nt, hsa
aggugcggcaggacucuuaucuuaaaaaguaaacaaaacaaaacaaaacaaaacaaaaaacuag

SEQ ID NO: 280751 - RNA, 64 nt, hsa
aaggcuuuacuucuuuugcaugcacuuuaaaaacaaaacaaaacauuuuucagguuccaaggaa

SEQ ID NO: 280752 - RNA, 64 nt, hsa
aaaaaaaggcuuuacuucuuuugcaugcacuuuaaaaacaaaacaaaacauuuuucagguucca

SEQ ID NO: 280753 - RNA, 64 nt, hsa
uuauuuuuuugguauuuauucaucaggaauaaaaaaaacaaaguuuuauuaaagauugaaaauu

SEQ ID NO: 280754 - RNA, 64 nt, hsa
auauaaugcuaguccuagauuacuuauugauuuaaaaacaaaaaaaagauuacuuaauuuugau

SEQ ID NO: 280755 - RNA, 64 nt, hsa
aaaaacaaaaaaaagauuacuuaauuuugauuuaaaaacaaaaaaucguaaaauacaaaaacca

SEQ ID NO: 280756 - RNA, 64 nt, hsa
ugcagaagguguauguuggggagaacugaaagggaaaacaaaauacuugacauagucuuaagua

SEQ ID NO: 280757 - RNA, 64 nt, hsa
ugacauagucuuaaguagaagaaggcaguuagagaaaacaaaguaucuacuggccuugucaaca

SEQ ID NO: 280758 - RNA, 64 nt, hsa
uauaaacacaaggaacauuccauaucauuagucgaaaacaaaaacaaaaaaaaaaccuuugguc

SEQ ID NO: 280759 - RNA, 64 nt, hsa
cacaaggaacauuccauaucauuagucgaaaacaaaaacaaaaaaaaaaccuuuggucauuugu

SEQ ID NO: 280760 - RNA, 64 nt, hsa
acaguaccuacauaguuuuuaaauuauuguuuaaaaaacaaaacagcuguuauaaaugaauauu

SEQ ID NO: 280761 - RNA, 64 nt, hsa
ugaugaauaaaucuuaaaugcuuuguuuaauuaaaaaacaaaaaucaccaauauccaagacaug

SEQ ID NO: 280762 - RNA, 64 nt, hsa
cucuuuccuuuccaguuaaaaaaaaacaaaaacaaaaacaaaacccuuugcuguaucacugugu

SEQ ID NO: 280763 - RNA, 64 nt, hsa
ucuuuccucuuuccuuuccaguuaaaaaaaaacaaaaacaaaaacaaaacccuuugcuguauca

SEQ ID NO: 280764 - RNA, 64 nt, hsa
uucccuucuuuccucuuuccuuuccaguuaaaaaaaaacaaaaacaaaaacaaaacccuuugcu

SEQ ID NO: 280765 - RNA, 64 nt, hsa
uucacauuuuacuuugaauguuuuucuucuggauaaaacaaauggaaucaaguuguaguuguuu

SEQ ID NO: 280766 - RNA, 64 nt, hsa
aaauaaccuuccuuaaguacaauuuaacuucaagaaaacaaaauuugacaacauaguuucuuaa

SEQ ID NO: 280767 - RNA, 64 nt, hsa
augcauugaagaucuguuucuaccaauaaacauuaaaacaaagacuguaugugaacuauguuuu

SEQ ID NO: 280768 - RNA, 64 nt, hsa
guuaaguucacuuggaggcuaaaaaucuccagugaaaacaaaacgaaaaccuuuaagagaaugu

SEQ ID NO: 280769 - RNA, 64 nt, hsa
uugggcaauuaaacaauuuauggcucuauuuuguaaaacaaacuacugguaauuauuuuuaaua

SEQ ID NO: 280770 - RNA, 64 nt, hsa
acugagugugacuauuuucacugcaacaaaugaaaaaacaaaaugugccuguuuaaagcacuca

SEQ ID NO: 280771 - RNA, 64 nt, hsa
ucaccaucaauuuaaaaguaaaaaaaacaaaaaaaaaacaaaaaauuuaaaaaaaagguuugcu

SEQ ID NO: 280772 - RNA, 64 nt, hsa
aaugccacgguucaccaucaauuuaaaaguaaaaaaaacaaaaaaaaaacaaaaaauuuaaaaa

SEQ ID NO: 280773 - RNA, 64 nt, hsa
uacauuauuuuaagccacauguuuguaauuguuuaaaacaaaguggaaacauuacacaaugucc

SEQ ID NO: 280774 - RNA, 64 nt, hsa
gagaaacagauucaugcuuguaucuugcauucagaaaacaaacuguccuacuaaucaaagcugc

SEQ ID NO: 280775 - RNA, 64 nt, hsa
agucauuaaaacaaaaugaaacauuugccaaaacaaaacaaaaaacuauguauuugcacagcac

SEQ ID NO: 280776 - RNA, 64 nt, hsa
accgaagucauuaaaacaaaaugaaacauuugccaaaacaaaacaaaaaacuauguauuugcac

SEQ ID NO: 280777 - RNA, 64 nt, hsa
uauuucauuuucuuuauauuggaccgaagucauuaaaacaaaaugaaacauuugccaaaacaaa

SEQ ID NO: 280778 - RNA, 64 nt, hsa
caaccaccaaaaacuagacaaauaaagacaaacuaaaacaaaacagaacaaaagcaaaggaaaa

SEQ ID NO: 280779 - RNA, 64 nt, hsa
ccuaaauauccuggggaccaaggaacuauguacaaaaacaaaccuaccaaccaccaaaaacuag

SEQ ID NO: 280780 - RNA, 64 nt, hsa
gugcacauauuccaggaaagugucuuuaaaaacaaaaacaaacccugaaauguauauuugggau

SEQ ID NO: 280781 - RNA, 64 nt, hsa
accauagugcacauauuccaggaaagugucuuuaaaaacaaaaacaaacccugaaauguauauu

SEQ ID NO: 280782 - RNA, 64 nt, hsa
aacauggugcaaccucgucuuuacuaaaaauacaaaaacaaaaauuagccagggguggugguau

SEQ ID NO: 280783 - RNA, 64 nt, hsa
uccagccugggagacagagcaagacuccaucucaaaaacaaaaacaaaacaaaacaacaacaaa

SEQ ID NO: 280784 - RNA, 64 nt, hsa
cugggagacagagcaagacuccaucucaaaaacaaaaacaaaacaaaacaacaacaaaaaaaga

SEQ ID NO: 280785 - RNA, 64 nt, hsa
agacagagcaagacuccaucucaaaaacaaaaacaaaacaaaacaacaacaaaaaaagaaguua

SEQ ID NO: 280786 - RNA, 64 nt, hsa
ucaucagagauacuuuccuaaaaaggaaaaauaaaaaacaaaauggugccacuuuggguugaag

SEQ ID NO: 280787 - RNA, 64 nt, hsa
cuugaauucauuuauaugucuuuugauucuuaaaaaaacaaaaaacauuccauuagaagcacca

SEQ ID NO: 280788 - RNA, 64 nt, hsa
aucauaccaaaaaguguaagugaaaacccccuuuaaaacaaaacaaaaaaaugaaauaaaauua

SEQ ID NO: 280789 - RNA, 64 nt, hsa
accaaaaaguguaagugaaaacccccuuuaaaacaaaacaaaaaaaugaaauaaaauuaggcaa

SEQ ID NO: 280790 - RNA, 64 nt, hsa
acuguaaccauguuuuuucuguuuaauuauguaaaaaacaaaacuacaacaacaaaaaaagaaa

SEQ ID NO: 280791 - RNA, 64 nt, hsa
aaaagaaaaaaguuaaaaaagaaaaaaacaccaaaaaacaaaaacaaacaaaaaaaaaaaccca

SEQ ID NO: 280792 - RNA, 64 nt, hsa
aaaaaguuaaaaaagaaaaaaacaccaaaaaacaaaaacaaacaaaaaaaaaaacccacaaccc

SEQ ID NO: 280793 - RNA, 64 nt, hsa
auaaugacuggacaucagaagaggaaaaaaacucaaaacaaaagcgagagagacuauugccaua

SEQ ID NO: 280794 - RNA, 64 nt, hsa
auuugcucacuucucucuucacccaucuuuuuuaaaaacaaauaaaugaauaaagcugcuguga

SEQ ID NO: 280795 - RNA, 64 nt, hsa
guugaaaauauauuagacauucucccugagguuaaaaacaaaaaguacgugaccagucugguaa

SEQ ID NO: 280796 - RNA, 64 nt, hsa
gaguuuuguauaugucugauaccguuguuauaacaaaacaaauuuuuuuacuauaguuuuuugu

SEQ ID NO: 280797 - RNA, 64 nt, hsa
uuacuuaccucuugcaaaaaaaaugaaaaaugaaaaaacaaauucaaaaccuauucaaaugggu

SEQ ID NO: 280798 - RNA, 64 nt, hsa
uuguuuaguauaaauugucauagcugguuuacugaaaacaaacacauuuaaaauugguuuaccu

SEQ ID NO: 280799 - RNA, 64 nt, hsa
ugagaauuauuuagaaaagacaugcuccaaaaaaaaaacaaaacugauaaaacaguuuuucgaa

SEQ ID NO: 280800 - RNA, 64 nt, hsa
ccuguguuaaacuguuuagugcucuguuuuuaagaaaacaaauguugaaccucacacuuuuaug

SEQ ID NO: 280801 - RNA, 64 nt, hsa
ggcucagucagcaaccucagaacucugaaaaaacaaaacaaaaaaaaaaaaaaaagaaaaaaaa

SEQ ID NO: 280802 - RNA, 64 nt, hsa
gcuguggcucagucagcaaccucagaacucugaaaaaacaaaacaaaaaaaaaaaaaaaagaaa

SEQ ID NO: 280803 - RNA, 64 nt, hsa
uauuuuaccaagauuauaaaaacacuuuuacaaaaaaacaaaaaccuguaaaaauaauuuugag

SEQ ID NO: 280804 - RNA, 64 nt, hsa
cuccacugacuacugacucaaaaauaaaauaauaaaaacaaauuuuuuuaagcacuggggauaa

SEQ ID NO: 280805 - RNA, 64 nt, hsa
agccuggcgacagagagagacuccaucucaaaacaaaacaaaaaaaauuagccuacuuaaaggc

SEQ ID NO: 280806 - RNA, 64 nt, hsa
acuccagccuggcgacagagagagacuccaucucaaaacaaaacaaaaaaaauuagccuacuua

SEQ ID NO: 280807 - RNA, 64 nt, hsa
ucgugaccaaauuguuuaagaaaaaaaaacaaaaaaaacaaaaucuagggcuguauuuuauaua

SEQ ID NO: 280808 - RNA, 64 nt, hsa
aaaggugcaucgugaccaaauuguuuaagaaaaaaaaacaaaaaaaacaaaaucuagggcugua

SEQ ID NO: 280809 - RNA, 64 nt, hsa
guauuccagcaaaagaggauguagccucugggaaaaaacaaacauguuacaguguuuuuuguag

SEQ ID NO: 280810 - RNA, 64 nt, hsa
cagcacuguauauaccugucucuaaguaaaggaaaaaacaaaauaaggacuucaauccaaaguu

SEQ ID NO: 280811 - RNA, 64 nt, hsa
uguguuuaacuuuguauuuugauuguugagaacaaaaacaaaaaguaucaauguguauguggcu

SEQ ID NO: 280812 - RNA, 64 nt, hsa
aauaugaucuuccauccaaguggagggaaacuuuaaaacaaaaacacccaguacuguggcucag

SEQ ID NO: 280813 - RNA, 64 nt, hsa
ugaagaaaaaaaagaaaaagagaaaaaaaucacaaaaacaaacuuuuuuuauucaaaaguaaca

SEQ ID NO: 280814 - RNA, 64 nt, hsa
uuuuaaaaaaccuuaauguaagauaugaccaguuaaaacaaagcaauucuugaauuauauaacu

SEQ ID NO: 280815 - RNA, 64 nt, hsa
cugaaaccgcuuuuuaaaauucaaaacaagaaacaaaacaaaaaaaauuaaggggaaaauuauu

SEQ ID NO: 280816 - RNA, 64 nt, hsa
uagugaauuuggaaauaaaaagaaaaaaaaaacaaaaacaaacaggcugccauaauauauuuuu

SEQ ID NO: 280817 - RNA, 64 nt, hsa
uuuuguuagugaauuuggaaauaaaaagaaaaaaaaaacaaaaacaaacaggcugccauaauau

SEQ ID NO: 280818 - RNA, 64 nt, hsa
acaaguuacaaguugauaucguugaaugaaaagcaaaacaaaaacaauucaggaacaacggcua

SEQ ID NO: 280819 - RNA, 64 nt, hsa
acuaaauccuuuccaauaauugacugguggaaggaaaacaaaaaacaaaaacuaaaaaccucuu

SEQ ID NO: 280820 - RNA, 64 nt, hsa
ccuuuccaauaauugacugguggaaggaaaacaaaaaacaaaaacuaaaaaccucuuagcuuuu

SEQ ID NO: 280821 - RNA, 64 nt, hsa
aauuuguguuuauauuuccuguaagugaauaaauaaaacaaaacaaaacaaaaaaaacuugugc

SEQ ID NO: 280822 - RNA, 64 nt, hsa
guguuuauauuuccuguaagugaauaaauaaaacaaaacaaaacaaaaaaaacuugugccugau

SEQ ID NO: 280823 - RNA, 64 nt, hsa
uauauuuccuguaagugaauaaauaaaacaaaacaaaacaaaaaaaacuugugccugauaagcu

SEQ ID NO: 280824 - RNA, 64 nt, hsa
cugguuagcuaauugaacuuuugugaccuguuuaaaaacaaaucaaauuuauugaacaaaugac

SEQ ID NO: 280825 - RNA, 64 nt, hsa
ccagcccguaugacagagugagacccuguuucuaaaaacaaaacaaacaaacaaacaaacaacg

SEQ ID NO: 280826 - RNA, 64 nt, hsa
ccguaugacagagugagacccuguuucuaaaaacaaaacaaacaaacaaacaaacaacguaucu

SEQ ID NO: 280827 - RNA, 64 nt, hsa
agcuacugcagcaaggcuucuguguacuugccugaaaacaaaggaaggugcuggucauuccauu

SEQ ID NO: 280828 - RNA, 64 nt, hsa
uuuaacuccuccuaccccccaagguaagaaacaaaaaacaaacaaacaaacaaaaauagaagac

SEQ ID NO: 280829 - RNA, 64 nt, hsa
ugaaaacuuuaccaucuagagugcucaugcaauuaaaacaaaacaaacacaaacaaggaggcac

SEQ ID NO: 280830 - RNA, 64 nt, hsa
acuuuaccaucuagagugcucaugcaauuaaaacaaaacaaacacaaacaaggaggcacuaagc

SEQ ID NO: 280831 - RNA, 64 nt, hsa
guguucagggagauaauucugccuuuaauugucuaaaacaaaaacaaaaccagccaaccuaugu

SEQ ID NO: 280832 - RNA, 64 nt, hsa
agggagauaauucugccuuuaauugucuaaaacaaaaacaaaaccagccaaccuauguuacacg

SEQ ID NO: 280833 - RNA, 64 nt, hsa
agccugggugacagagcgagacuaucucagaaacaaaacaaaacaaaacaacaaaaaaagaaaa

SEQ ID NO: 280834 - RNA, 64 nt, hsa
gggugacagagcgagacuaucucagaaacaaaacaaaacaaaacaacaaaaaaagaaaaggcag

SEQ ID NO: 280835 - RNA, 64 nt, hsa
caaaggggugcaugggaaagggcuguugauauuaaaaacaaacaaaacaaaaaagccccacaca

SEQ ID NO: 280836 - RNA, 64 nt, hsa
gcaugggaaagggcuguugauauuaaaaacaaacaaaacaaaaaagccccacacauaacuguuu

SEQ ID NO: 280837 - RNA, 64 nt, hsa
uugguuuaacucuuuaguuuuauuuuaagaggggaaaacaaaaauaucuugcaagcagaaccuu

SEQ ID NO: 280838 - RNA, 64 nt, hsa
cuugggaaacugaaaguguucccauauagcuucaaaaacaaaaacaaauguguuauccgacgga

SEQ ID NO: 280839 - RNA, 64 nt, hsa
aaacugaaaguguucccauauagcuucaaaaacaaaaacaaauguguuauccgacggauacuuu

SEQ ID NO: 280840 - RNA, 64 nt, hsa
gcccucagaacuuuaguaacagcacaacaaauuaaaaacaaaaacaacucaugccacaguaugu

SEQ ID NO: 280841 - RNA, 64 nt, hsa
auuuggcaugcuguaaaacaaaacaaaacaaaauaaaacaaaaaaaaggaaggaaaaaaaaaga

SEQ ID NO: 280842 - RNA, 58 nt, hsa
aaggauuuggcaugcuguaaaacaaaacaaaacaaaauaaaacaaaaaaaaggaagga

SEQ ID NO: 280843 - RNA, 53 nt, hsa
aaggauuuggcaugcuguaaaacaaaacaaaacaaaauaaaacaaaaaaaagg

SEQ ID NO: 280844 - RNA, 64 nt, hsa; identical to SEQ ID NO: 280820

SEQ ID NO: 280845 - RNA, 64 nt, hsa; identical to SEQ ID NO: 280819

SEQ ID NO: 280846 - RNA, 64 nt, hsa
ugcagccugaguaacaaaaugagacccuaucucaaaaacaaaaaggaaaagaaaauauacauga

SEQ ID NO: 280847 - RNA, 64 nt, hsa
uuagucuuaaacucaaauuacuauaugaugauuuaaaacaaaauaaaagagcgaggaugggggu

SEQ ID NO: 280848 - RNA, 64 nt, hsa
uuccugcuaaaaagacaaaaaacaaaaaacaaaaaaaacaaaaaaaaccucaugagugcaugga

SEQ ID NO: 280849 - RNA, 64 nt, hsa
cucccccucuuccugcuaaaaagacaaaaaacaaaaaacaaaaaaaacaaaaaaaaccucauga

SEQ ID NO: 280850 - RNA, 64 nt, hsa
uuauauucucccccucuuccugcuaaaaagacaaaaaacaaaaaacaaaaaaaacaaaaaaaac

SEQ ID NO: 280851 - RNA, 64 nt, hsa
ccacagaaaugaugaaagugaccagaaaaaaacaaaaacaaaaccccuuuacucuguaggucau

SEQ ID NO: 280852 - RNA, 64 nt, hsa
uuucucccacagaaaugaugaaagugaccagaaaaaaacaaaaacaaaaccccuuuacucugua

SEQ ID NO: 280853 - RNA, 64 nt, hsa
ucuuuaaaguauuuacaauaucacuccagaaaagaaaacaaaucaaauaaauauugacucaaaa

SEQ ID NO: 280854 - RNA, 64 nt, hsa
gaaaacauuccuucauaguucaguuaguuaaaaaaaaacaaacauuuuuuccuauuacaaaaaa

SEQ ID NO: 280855 - RNA, 64 nt, hsa
gugaucggggucaggcaaaggaggggaaacaaugaaaacaaauaaaaguugaacuuguuuuucu

SEQ ID NO: 280856 - RNA, 64 nt, hsa
aagcacuucuagaaugucugaaguacaaacaugaaaaacaaacaaaaaaauuaaccgagacacu

SEQ ID NO: 280857 - RNA, 64 nt, hsa
cuuuguugcacuuuuaguuuuuuuaaaaaaaacaaaaacaaaaacauggcagaugcauauugug

SEQ ID NO: 280858 - RNA, 64 nt, hsa
aacugacuuuguugcacuuuuaguuuuuuuaaaaaaaacaaaaacaaaaacauggcagaugcau

SEQ ID NO: 280859 - RNA, 64 nt, hsa
ggcgacacagcgagacuccaucucaaaacaaaacaaaacaaaauuagcugagcaugguggugug

SEQ ID NO: 280860 - RNA, 64 nt, hsa
gccugggcgacacagcgagacuccaucucaaaacaaaacaaaacaaaauuagcugagcauggug

SEQ ID NO: 280861 - RNA, 64 nt, hsa
cuugagccugggcgacacagcgagacuccaucucaaaacaaaacaaaacaaaauuagcugagca

SEQ ID NO: 280862 - RNA, 64 nt, hsa
ucacugugcagagggauuguaccuuguacaaaauaaaacaaauuucucaaacuaauuuaacaag

SEQ ID NO: 280863 - RNA, 64 nt, hsa
ccaagcccuaaagagaaccuucucacaagaauuaaaaacaaaaagggcaaaccuaggaagcuaa

SEQ ID NO: 280864 - RNA, 64 nt, hsa
cugucuuauuucuaaauuuccuucuuccaagaugaaaacaaaagaaaaacuuaaaacagaaggu

SEQ ID NO: 280865 - RNA, 64 nt, hsa
caagagauucccaccauuauuuagguucaccugcaaaacaaaaaucuuacuccagccccucaau

SEQ ID NO: 280866 - RNA, 64 nt, hsa
uuuuucaaggguuucccugugcuagcugagaugcaaaacaaaucauggaagauugcauaccugu

SEQ ID NO: 280867 - RNA, 64 nt, hsa
aguagugauaaacaccuuaaucauaaaaugaauaaaaacaaaaaaaccauggggcuugucugca

SEQ ID NO: 280868 - RNA, 64 nt, hsa
aacucaccauuucauccauauuucuuuuucuugcaaaacaaacauacccaucugcaccgacgcc

SEQ ID NO: 280869 - RNA, 64 nt, hsa
aaaaaaauuuuuaaauaccacaagauggaaaaaaaaaacaaaaaaauuuaaaaagauggaaugu

SEQ ID NO: 280870 - RNA, 64 nt, hsa
gauuuaauuugcuaaauagacuaacaggaggaaaaaaacaaacagccuagcuuuaaaaaacagu

SEQ ID NO: 280871 - RNA, 64 nt, hsa
ucaucuuaccccuuuaugccaccuacugaaaagaaaaacaaauagcuagguuugguuuccuguu

SEQ ID NO: 280872 - RNA, 64 nt, hsa
gagaucuugugguuccaugagaauuauuacuuuaaaaacaaaacaaaauauaaaaaacuguguu

SEQ ID NO: 280873 - RNA, 64 nt, hsa
cuugugguuccaugagaauuauuacuuuaaaaacaaaacaaaauauaaaaaacuguguuugagu

SEQ ID NO: 280874 - RNA, 64 nt, hsa
guaucauguuauuuagccaaugcaaaucuguuuuaaaacaaauaguuuaaaaaaagaacaaguu

SEQ ID NO: 280875 - RNA, 64 nt, hsa
cuaauaaaugcagaaucugaagguaaauagguuuaaaacaaaacaaaaacccaccccuuuaagg

SEQ ID NO: 280876 - RNA, 64 nt, hsa
aaaugcagaaucugaagguaaauagguuuaaaacaaaacaaaaacccaccccuuuaaggaguug

SEQ ID NO: 280877 - RNA, 64 nt, hsa
aggcuucagagguaccuggcaccuuacucaagcaaaaacaaaaaacagcuuuacuucaaaagca

SEQ ID NO: 280878 - RNA, 64 nt, hsa
auuccaccugacccuguguguacaauccaggaaaaaaacaaaccccacucagaaacagagaaaa

SEQ ID NO: 280879 - RNA, 64 nt, hsa
ucucuccucauccuaguucuuuaaaaaaaacaaaaaaacaaaaaaaacuuuuuuuaaucguugu

SEQ ID NO: 280880 - RNA, 60 nt, hsa
cggcucucuccucauccuaguucuuuaaaaaaaacaaaaaaacaaaaaaaacuuuuuuua

SEQ ID NO: 280881 - RNA, 64 nt, hsa
cuccaucucuucagaccccuuugccuuuaaaaaaaaaacaaaaacaaaaacaaaaaaacccaua

SEQ ID NO: 280882 - RNA, 64 nt, hsa
cucuucagaccccuuugccuuuaaaaaaaaaacaaaaacaaaaacaaaaaaacccauaaugccc

SEQ ID NO: 280883 - RNA, 64 nt, hsa
agaccccuuugccuuuaaaaaaaaaacaaaaacaaaaacaaaaaaacccauaaugcccacagaa

SEQ ID NO: 280884 - RNA, 64 nt, hsa
cauuggaauucuacuggaaaaaaauacaaaaagcaaaacaaaacccucagcacuguuacaagag

SEQ ID NO: 280885 - RNA, 64 nt, hsa
aagggcaaggaguuuauuacaauguaucuuuauuaaaacaaaaggguguauaguguucacaaac

SEQ ID NO: 280886 - RNA, 64 nt, hsa
cugggcaaaaagagugagacucugucucaaaaaaaaaacaaaacaaaaaaaaccucuuugcugg

SEQ ID NO: 280887 - RNA, 64 nt, hsa
caaaaagagugagacucugucucaaaaaaaaaacaaaacaaaaaaaaccucuuugcugguauau

SEQ ID NO: 280888 - RNA, 64 nt, hsa
ggacuuggaggguugguccucuugccuccuggaaaaaacaaaaacaaaaaacugcagugaaaga

SEQ ID NO: 280889 - RNA, 64 nt, hsa
ggaggguugguccucuugccuccuggaaaaaacaaaaacaaaaaacugcagugaaagacaagcu

SEQ ID NO: 280890 - RNA, 64 nt, hsa
uucccuucugugugaccgaccccuuggccaaaaaaaaacaaaaagcaaaaaacaaaaaccuacc

SEQ ID NO: 280891 - RNA, 64 nt, hsa
accgaccccuuggccaaaaaaaaacaaaaagcaaaaaacaaaaaccuacccuguucugguuuuu

SEQ ID NO: 280892 - RNA, 64 nt, hsa
gcagggcuuaauacauuagugguaacugguuuaaaaaacaaagacuguaagccugugugugcca

SEQ ID NO: 280893 - RNA, 64 nt, hsa
gucaguuucaaaucaaauuaucuaagaaaacaagaaaacaaaggcagcagacuauugguacaca

SEQ ID NO: 280894 - RNA, 64 nt, hsa
auucugaucugcaaauagcuuaaaugucucuugcaaaacaaaguaagauaccaccaguauuaca

SEQ ID NO: 280895 - RNA, 64 nt, hsa
aaaauuauuuauuuuguaaggagagguuuuaauuaaaacaaaaaaaaauucuuuuuuuuuuuuu

SEQ ID NO: 280896 - RNA, 64 nt, hsa
uuguccaucccuuuuuucuuuguuguuuuuguugaaaacaaacuggaaacuuguuucuuuuuuu

SEQ ID NO: 280897 - RNA, 64 nt, hsa
guauuccuaacagucuuuuguugucguuguuuuuaaaacaaagguacggaccaugugcuauaua

SEQ ID NO: 280898 - RNA, 64 nt, hsa
ugcacauuuaaagagaagcaucuaccacggcuuuaaaacaaaacaacucugagaugaacaauau

SEQ ID NO: 280899 - RNA, 64 nt, hsa
aacaagaguaaaacuucaucucaaaaaacaaaacaaaacaaaaacaacaacaaaaaacaaaaga

SEQ ID NO: 280900 - RNA, 64 nt, hsa
uggucaacaagaguaaaacuucaucucaaaaaacaaaacaaaacaaaaacaacaacaaaaaaca

SEQ ID NO: 280901 - RNA, 64 nt, hsa
cagccuggucaacaagaguaaaacuucaucucaaaaaacaaaacaaaacaaaaacaacaacaaa

SEQ ID NO: 280902 - RNA, 64 nt, hsa
cuccccuuauucccgaggcccagaaaagaaaacaaaaacaaaaacccagcacauacaagaaaca

SEQ ID NO: 280903 - RNA, 64 nt, hsa
acucuccuccccuuauucccgaggcccagaaaagaaaacaaaaacaaaaacccagcacauacaa

SEQ ID NO: 280904 - RNA, 64 nt, hsa
uccccauucugugcccuacuauuuucaacaaaacaaaacaaacaagcaaaaaacacaaaaaccu

SEQ ID NO: 280905 - RNA, 64 nt, hsa
uccucuccccauucugugcccuacuauuuucaacaaaacaaaacaaacaagcaaaaaacacaaa

SEQ ID NO: 280906 - RNA, 64 nt, hsa
ucuuuggcauuaaucuaauuuuaauguacugauaaaaacaaacaugguuuuccuuuacuuugac

SEQ ID NO: 280907 - RNA, 64 nt, hsa
aucaagagauacucuugauaauuugaauagggccaaaacaaaguuggugaccuaaaggcuuguu

SEQ ID NO: 280908 - RNA, 64 nt, hsa
ugaauugaguauauauuugaaaaggaaaaaacaaaaaacaaacccagaccccaccugaauuggg

SEQ ID NO: 280909 - RNA, 64 nt, hsa
cagagguugaauugaguauauauuugaaaaggaaaaaacaaaaaacaaacccagaccccaccug

SEQ ID NO: 280910 - RNA, 64 nt, hsa
aaguuugcuggggaguuugauaaaaguauaaaacaaaacaaaaaaagccucgguauaauuuugu

SEQ ID NO: 280911 - RNA, 64 nt, hsa
ucagcaaguuugcuggggaguuugauaaaaguauaaaacaaaacaaaaaaagccucgguauaau

SEQ ID NO: 280912 - RNA, 64 nt, hsa
cugaauaacccuuuuagcauugaaaaaaaaaacaaaaacaaaaaauggaaaaaaaaaaccuugu

SEQ ID NO: 280913 - RNA, 64 nt, hsa
aaaauucugaauaacccuuuuagcauugaaaaaaaaaacaaaaacaaaaaauggaaaaaaaaaa

SEQ ID NO: 280914 - RNA, 64 nt, hsa
auagggaaguaaaaaaacaaaacaaaaaacaaaaaaaacaaaaaaaaaacccuauuuaaaugaa

SEQ ID NO: 280915 - RNA, 64 nt, hsa
ucaaaucgaauagggaaguaaaaaaacaaaacaaaaaacaaaaaaaacaaaaaaaaaacccuau

SEQ ID NO: 280916 - RNA, 64 nt, hsa
aggaaacucaaaucgaauagggaaguaaaaaaacaaaacaaaaaacaaaaaaaacaaaaaaaaa

SEQ ID NO: 280917 - RNA, 64 nt, hsa
gaaucaggaaacucaaaucgaauagggaaguaaaaaaacaaaacaaaaaacaaaaaaaacaaaa

SEQ ID NO: 280918 - RNA, 64 nt, hsa
uuuuucuaaaaaacaaacaaaaaaaaaaacacacaaaacaaaaacagaacaaaagaagagagaa

SEQ ID NO: 280919 - RNA, 64 nt, hsa
gauuuuauuucuucucccccaccccuuuuucuaaaaaacaaacaaaaaaaaaaacacacaaaac

SEQ ID NO: 280920 - RNA, 64 nt, hsa
gcccauagaugcauuggcuccauccaacaccugaaaaacaaacuuggcaaggauuacauucuag

SEQ ID NO: 280921 - RNA, 64 nt, hsa
acucaucacauccccgaugcuaaauuaaaaacagaaaacaaagaaaagcuuguauauacuuugc

SEQ ID NO: 280922 - RNA, 64 nt, hsa
cauuugguuuauuuagaaaaaggaagaaaaacaaaaaacaaaaaacuaaagggugagaauuugc

SEQ ID NO: 280923 - RNA, 64 nt, hsa
caccaagcauuugguuuauuuagaaaaaggaagaaaaacaaaaaacaaaaaacuaaagggugag

SEQ ID NO: 280924 - RNA, 64 nt, hsa
cuccuccuucaccccuccucucacugccugccagaaaacaaaaacaccaagaaaccaagucaac

SEQ ID NO: 280925 - RNA, 64 nt, hsa
gaguuguuuuuuuuuuaacaacugggaaaaaacaaaaacaaaaaacuauaguuagaaaaaugga

SEQ ID NO: 280926 - RNA, 64 nt, hsa
aacugugaguuguuuuuuuuuuaacaacugggaaaaaacaaaaacaaaaaacuauaguuagaaa

SEQ ID NO: 280927 - RNA, 64 nt, hsa
cuccaaguagcuccaaaugcaauuuuuaaaauggaaaacaaaaaucugaaagaaacgucuuuag

SEQ ID NO: 280928 - RNA, 64 nt, hsa
aaaaaguuccaugacucgaauaucugaaaugaagaaaacaaaccgacucacaaaccuccaagua

SEQ ID NO: 280929 - RNA, 64 nt, hsa
uagagcaaaugcuagagcgauuucagcugauagaaaaacaaaaaugaaaaaaaaaacacaaaaa

SEQ ID NO: 280930 - RNA, 64 nt, hsa
ugauagaaaaacaaaaaugaaaaaaaaaacacaaaaaacaaaaaacauggcacguugcuaguuu

SEQ ID NO: 280931 - RNA, 64 nt, hsa
uuugucuuucuuuuuccuuuuuuuuuaaaaaaacaaaacaaacaaaacaccuugaaucaaguuu

SEQ ID NO: 280932 - RNA, 64 nt, hsa
uuuccuuugucuuucuuuuuccuuuuuuuuuaaaaaaacaaaacaaacaaaacaccuugaauca

SEQ ID NO: 280933 - RNA, 64 nt, hsa
aauucuuugauuuauuuuauugcaucaaugaauuaaaacaaaaaucuugggggaagaaauuggc

SEQ ID NO: 280934 - RNA, 64 nt, hsa
aaagauuaugaaaggaacaggcucuuuaaaaaagaaaacaaaaagccagaaucuuccuuuuuuu

SEQ ID NO: 280935 - RNA, 64 nt, hsa
uaugcauauaaaagugauggaauuaaugugaaauaaaacaaaaauauaauggcuagaauacaaa

SEQ ID NO: 280936 - RNA, 64 nt, hsa
uugcuaaggcuuuuaauacauuuugaauggcaccaaaacaaaauaagucaaaauggacagucau

SEQ ID NO: 280937 - RNA, 64 nt, hsa
uacauauuguuuaaaaaaaagcaagaaaaaaaggaaaacaaaggaaaauauccccaaaguuguu

SEQ ID NO: 280938 - RNA, 64 nt, hsa
cccaaaguuguuuucuagauuuguggcuuuaagaaaaacaaaacaaaacaaacacauuguuuuu

SEQ ID NO: 280939 - RNA, 64 nt, hsa
aguuguuuucuagauuuguggcuuuaagaaaaacaaaacaaaacaaacacauuguuuuucucag

SEQ ID NO: 280940 - RNA, 64 nt, hsa
uuuucuagauuuguggcuuuaagaaaaacaaaacaaaacaaacacauuguuuuucucagaacca

SEQ ID NO: 280941 - RNA, 64 nt, hsa
agggagggauggaggagauaauuugcuuauauuaaaaacaaaaaauggcugaggcaggaguuug

SEQ ID NO: 280942 - RNA, 64 nt, hsa
uugcaugcaaaucaaguggacaagaaaaaauaacaaaacaaaaaacaagaaaaaaaaaacacaa

SEQ ID NO: 280943 - RNA, 64 nt, hsa
uccucaggccgccagugucgcccugccccuuuuuaaaacaaaaugcccucguuuguaaacccuu

SEQ ID NO: 280944 - RNA, 64 nt, hsa
cugggggagggggacauagcgagacucggucucaaaaacaaaacaaaacaaaacaaaacaaaac

SEQ ID NO: 280945 - RNA, 64 nt, hsa
ggagggggacauagcgagacucggucucaaaaacaaaacaaaacaaaacaaaacaaaacaaaaa

SEQ ID NO: 280946 - RNA, 64 nt, hsa
gggacauagcgagacucggucucaaaaacaaaacaaaacaaaacaaaacaaaacaaaaacaaaa

SEQ ID NO: 280947 - RNA, 64 nt, hsa
auagcgagacucggucucaaaaacaaaacaaaacaaaacaaaacaaaacaaaaacaaaacaaaa

SEQ ID NO: 280948 - RNA, 64 nt, hsa
gagacucggucucaaaaacaaaacaaaacaaaacaaaacaaaacaaaacaaaacaaaacaaaac

SEQ ID NO: 280949 - RNA, 64 nt, hsa
ucggucucaaaaacaaaacaaaacaaaacaaaacaaaacaaaacaaaacaaaacaaaacacugc

SEQ ID NO: 280950 - RNA, 64 nt, hsa
cucaaaaacaaaacaaaacaaaacaaaacaaaacaaaacaaaacaaaacaaaacacugccaaac

SEQ ID NO: 280951 - RNA, 64 nt, hsa
aaacaaaacaaaacaaaacaaaacaaaacaaaacaaaacaaaacaaaacacugccaaacuguuu

SEQ ID NO: 280952 - RNA, 64 nt, hsa
aacaaaacaaaacaaaacaaaaacaaaacaaaacaaaacaaaacacugccaaacuguuuccaaa

SEQ ID NO: 280953 - RNA, 64 nt, hsa
ccacacacaccaucuuuccaucccaggcuuuugaaaaacaaacagaaacccguguaucugggau

SEQ ID NO: 280954 - RNA, 64 nt, hsa
ugaccgagggaggcucugucucaaaagcaaagcaaaaacaaaaacaaaaacaccuaaaaaaccu

SEQ ID NO: 280955 - RNA, 64 nt, hsa
agggaggcucugucucaaaagcaaagcaaaaacaaaaacaaaaacaccuaaaaaaccugcaguu

SEQ ID NO: 280956 - RNA, 64 nt, hsa
ugauuccccaaaucugcauccuuuucaaaaccuaaaaacaaaaagaaaaacaaauaaaacaaaa

SEQ ID NO: 280957 - RNA, 64 nt, hsa
ucugcauccuuuucaaaaccuaaaaacaaaaagaaaaacaaauaaaacaaaaccaacucagacc

SEQ ID NO: 280958 - RNA, 64 nt, hsa
uuuucaaaaccuaaaaacaaaaagaaaaacaaauaaaacaaaaccaacucagaccagaacuguu

SEQ ID NO: 280959 - RNA, 64 nt, hsa
ucaauaaaugugauuuaucacauacacagaacuaaaaacaaaaaccacaugaccaugaucaucu

SEQ ID NO: 280960 - RNA, 64 nt, hsa
acuuaaugaugaacaccccaaagcaauugcaacaaaaacaaaaauugacaagugggaccuaauu

SEQ ID NO: 280961 - RNA, 64 nt, hsa
gaaaauccacaaauuccaaugucacaaaagcaauaaaacaaacuagaaaaaaaaaagguuuuac

SEQ ID NO: 280962 - RNA, 64 nt, hsa
cacuuuuuagauuuuuuuuucucuuuccuccuuaaaaacaaaauuuauauauagauauauauau

SEQ ID NO: 280963 - RNA, 64 nt, hsa
cccuaaacccaagcacccaaugaugcaaaaaacaaaaacaaaaaaaaaccaccaaauccccaaa

SEQ ID NO: 280964 - RNA, 64 nt, hsa
acccuucccuaaacccaagcacccaaugaugcaaaaaacaaaaacaaaaaaaaaccaccaaauc

SEQ ID NO: 280965 - RNA, 64 nt, hsa
auagauagaugguguuugcauguaaauugcagagaaaacaaaaccaaagcugauuggaaacaau

SEQ ID NO: 280966 - RNA, 64 nt, hsa
gcuugcuuugauuuuuagugaagggaauguacguaaaacaaaauagggcuuggcuggucaaagg

SEQ ID NO: 280967 - RNA, 64 nt, hsa
caaaaggcucauaacaacaagaacguuucagaaaaaaacaaaaaguuuuaaaaaaauuguugag

SEQ ID NO: 280968 - RNA, 64 nt, hsa
aaccaauuuugggucgagugcauuuaacgagaacaaaacaaaaggcucauaacaacaagaacgu

SEQ ID NO: 280969 - RNA, 64 nt, hsa
gccgccagagcagcuuuuuacaauccagagacagaaaacaaaaucuagaugcaacagcgaaaca

SEQ ID NO: 280970 - RNA, 64 nt, hsa
acccuggccaacauggugaaaccccaucucuacuaaaacaaaaauuagccaggcaugguggcac

SEQ ID NO: 280971 - RNA, 64 nt, hsa
uaacagagcgagacuccaucucaaaaaaaaaaacaaaacaaaaccaaguucccacuggugaugc

SEQ ID NO: 280972 - RNA, 64 nt, hsa
cuggguaacagagcgagacuccaucucaaaaaaaaaaacaaaacaaaaccaaguucccacuggu

SEQ ID NO: 280973 - RNA, 64 nt, hsa
augcaucgaaaaucuuuuuguuuguaaacguuuaaaaacaaaguuccccggccaggcacagugg

SEQ ID NO: 280974 - RNA, 64 nt, hsa
ggcccuucgcuuccucucuuguguuauggaaauaaaaacaaauaaaacuacacacugcacaucc

SEQ ID NO: 280975 - RNA, 64 nt, hsa
ggguuuccuugggcgcggccccaaaauugccuucaaaacaaacccgggacgguugaaagccuuc

SEQ ID NO: 280976 - RNA, 64 nt, hsa
gaaccagaggugaaaaacaaacaaaaaaaaaccaaaaacaaaccaaaaaaaaaaaaaacccaca

SEQ ID NO: 280977 - RNA, 64 nt, hsa
cagaaaccagcugccccaaaggaaccagaggugaaaaacaaacaaaaaaaaaccaaaaacaaac

SEQ ID NO: 280978 - RNA, 64 nt, hsa
ugcccccuuuuucuuguuaaaaaacaaaaaacaaaaaacaaaaaaccacacacacauuuuguac

SEQ ID NO: 280979 - RNA, 64 nt, hsa
uggcuuuugcccccuuuuucuuguuaaaaaacaaaaaacaaaaaacaaaaaaccacacacacau

SEQ ID NO: 280980 - RNA, 64 nt, hsa
ccauuccuggcuuuugcccccuuuuucuuguuaaaaaacaaaaaacaaaaaacaaaaaaccaca

SEQ ID NO: 280981 - RNA, 64 nt, hsa
aacaguuguuagauguucucagugauucaacuuuaaaacaaauuucucgugaugauucauuuca

SEQ ID NO: 280982 - RNA, 64 nt, hsa
cagccugggcagcagagugagacucucucucaaaaaaacaaaacuuggcuguuaaugucugccc

SEQ ID NO: 280983 - RNA, 64 nt, hsa
acagagcgagacuccaacucagaaaaagcaaaacaaaacaaacaaacaagcaaaaaaccacaau

SEQ ID NO: 280984 - RNA, 64 nt, hsa
gggcaacagagcgagacuccaacucagaaaaagcaaaacaaaacaaacaaacaagcaaaaaacc

SEQ ID NO: 280985 - RNA, 64 nt, hsa
acagcaaguucuuguuuccaaacaacaacaaaacaaaacaaaaaaaaaaccggauagaauaaug

SEQ ID NO: 280986 - RNA, 64 nt, hsa
gcgacacagcaaguucuuguuuccaaacaacaacaaaacaaaacaaaaaaaaaaccggauagaa

SEQ ID NO: 280987 - RNA, 64 nt, hsa
acaacauauagcaagacucugccucuauuauaaaaaaacaaaauaaaugaaaaggacuguagga

SEQ ID NO: 280988 - RNA, 64 nt, hsa
gaaaacuguucuugggacugucucaacugugcaaaaaacaaaagauggaguguuuacaaguaga

SEQ ID NO: 280989 - RNA, 64 nt, hsa
uagugacugagauguaaaaauagauuuuagaauuaaaacaaaauccaaguccucacaccccugu

SEQ ID NO: 280990 - RNA, 64 nt, hsa
ugugaugccuuaggacauguuugaacugcagcaaaaaacaaaaacaaaaaacagugcauuagca

SEQ ID NO: 280991 - RNA, 64 nt, hsa
gccuuaggacauguuugaacugcagcaaaaaacaaaaacaaaaaacagugcauuagcaauuuca

SEQ ID NO: 280992 - RNA, 64 nt, hsa
uuuuuuuuuuuuuacugcauguuacauugaaauaaaaacaaaguaaaaugagcaauugccuuau

SEQ ID NO: 280993 - RNA, 64 nt, hsa
gccugggcaacauagcaagacccugucucuuaaaaaaacaaaaagacauauucagguacugauu

SEQ ID NO: 280994 - RNA, 64 nt, hsa
ugggcaacauagcgagaccucaucuccaaaaaagaaaacaaaaaacaaaaaaaggaaugauguu

SEQ ID NO: 280995 - RNA, 64 nt, hsa
cauagcgagaccucaucuccaaaaaagaaaacaaaaaacaaaaaaaggaaugauguucuguaga

SEQ ID NO: 280996 - RNA, 64 nt, hsa
ugaaaugagaaaagaaaaauuuaugcacugauuuaaaacaaaccaaaaaaaaagaaaaaaacaa

SEQ ID NO: 280997 - RNA, 64 nt, hsa
ugcacugauuuaaaacaaaccaaaaaaaaagaaaaaaacaaaaaaaaaaaucccuccuuucuag

SEQ ID NO: 280998 - RNA, 64 nt, hsa
ggcuggucugucuuuucuccauuuguuuaaaaaaaaaacaaaaacaaaaaacaacacuuuggug

SEQ ID NO: 280999 - RNA, 64 nt, hsa
ucugucuuuucuccauuuguuuaaaaaaaaaacaaaaacaaaaaacaacacuuugguguggugg

SEQ ID NO: 281000 - RNA, 64 nt, hsa
ccaaagaaauaaacaagugugacaaaaaaaaaaaaaaacaaaccuaaaugcuacuguuccaaag

SEQ ID NO: 281001 - RNA, 64 nt, hsa
ccuuagcuuuucauaguugucugacauuuccaugaaaacaaaggaaccaacuuuguuuuaacca

SEQ ID NO: 281002 - RNA, 64 nt, hsa
gucuaauuuuuuuuccuguugaauggguaaaaacaaaacaaaacuuuuuuuagaagaugaauuu

SEQ ID NO: 281003 - RNA, 64 nt, hsa
ugugugucuaauuuuuuuuccuguugaauggguaaaaacaaaacaaaacuuuuuuuagaagaug

SEQ ID NO: 281004 - RNA, 64 nt, hsa
cagacugaucuaaugugaaauguaaguauccuuaaaaacaaagcaucuauuuuggcagaaauug

SEQ ID NO: 281005 - RNA, 64 nt, hsa
ugacagagcgagacccugucuuaaaaaaaaaaacaaaacaaaaccagcaucuguuacuggaaca

SEQ ID NO: 281006 - RNA, 64 nt, hsa
cugggugacagagcgagacccugucuuaaaaaaaaaaacaaaacaaaaccagcaucuguuacug

SEQ ID NO: 281007 - RNA, 64 nt, hsa
ggagaauggguuccuguggagaaaaauggugaagaaaacaaagaugaugauaauguuuucagca

SEQ ID NO: 281008 - RNA, 64 nt, hsa
aaaaugggcuggagagaaggagaaggauuaggaaaaaacaaagaaggcaauaaggaacccaucc

SEQ ID NO: 281009 - RNA, 64 nt, hsa
ccagucuggucggcaagagugagacuccgucucaaaaacaaaacaaaacaaaaaaaccacauaa

SEQ ID NO: 281010 - RNA, 64 nt, hsa
cuggucggcaagagugagacuccgucucaaaaacaaaacaaaacaaaaaaaccacauaacauaa

SEQ ID NO: 281011 - RNA, 64 nt, hsa
cggcaagagugagacuccgucucaaaaacaaaacaaaacaaaaaaaccacauaacauaaauuua

SEQ ID NO: 281012 - RNA, 64 nt, hsa
uaugacuuuccucagaacaugagacuguaaaacaaaaacaaaaaacuaugugaugccucuauuu

SEQ ID NO: 281013 - RNA, 64 nt, hsa
augacuuaugacuuuccucagaacaugagacuguaaaacaaaaacaaaaaacuaugugaugccu

SEQ ID NO: 281014 - RNA, 64 nt, hsa
gaaaugaggcuucaauuagaauuauuuuucucaaaaaacaaacaaacaaaaaacacaaaaaaaa

SEQ ID NO: 281015 - RNA, 64 nt, hsa
uuaguagugcagaccuuuaccccuagucuaugaaaaaacaaaccaaaauaugcucuugcgccca

SEQ ID NO: 281016 - RNA, 64 nt, hsa
ucaaaacagaagggcaaauggaaaaggggaauauaaaacaaaccaauaaaaauaccaucugagg

SEQ ID NO: 281017 - RNA, 64 nt, hsa
cugcacuugaaguucaacuuaaugguguaugugaaaaacaaaaacuacuuugguuguguauguc

SEQ ID NO: 281018 - RNA, 64 nt, hsa
cauacauggauuuugccaagugcugccaguagccaaaacaaagucuuuuuagggcaauagagga

SEQ ID NO: 281019 - RNA, 64 nt, hsa
uggguuucuuccaaccaucucgucauuuaaagggaaaacaaaaucugagucuccagccaggagg

SEQ ID NO: 281020 - RNA, 64 nt, hsa
uucuucgugauaauauaaucucuauuuuuuuaggaaaacaaaaaugaaaaacuacuccauuuga

SEQ ID NO: 281021 - RNA, 64 nt, hsa
gagacaaacauuauaaaaaucugauggcaaaagcaaaacaaaauggaaaguaggggagguggau

SEQ ID NO: 281022 - RNA, 64 nt, hsa
caguguucugcauuccacauguaagugaauugcaaaaacaaaacaaaacucacucucuuguagg

SEQ ID NO: 281023 - RNA, 64 nt, hsa
uucugcauuccacauguaagugaauugcaaaaacaaaacaaaacucacucucuuguagguuuau

SEQ ID NO: 281024 - RNA, 64 nt, hsa
uccuuaaaggaaauguuaaaaaaaaaaaaacaaaaaaacaaaaaaacaacuguucuuugccuaa

SEQ ID NO: 281025 - RNA, 64 nt, hsa
agccaccuuccuuaaaggaaauguuaaaaaaaaaaaaacaaaaaaacaaaaaaacaacuguucu

SEQ ID NO: 281026 - RNA, 64 nt, hsa
cugcuggagaaaagccuggaacugccaaaacaaaaaaacaaauacaaacaaaccucgucaccac

SEQ ID NO: 281027 - RNA, 64 nt, hsa
agucccuccugcuggagaaaagccuggaacugccaaaacaaaaaaacaaauacaaacaaaccuc

SEQ ID NO: 281028 - RNA, 64 nt, hsa
aacaggaaaugugggaaaauauaaacgagggaagaaaacaaacuuuaaaaaaaagcgagaggga

SEQ ID NO: 281029 - RNA, 64 nt, hsa
gcaaaaacaaaaaacaaaaaaaacaaaaaaacaaaaaacaaaaaaacacacacacacaaaaaaa

SEQ ID NO: 281030 - RNA, 64 nt, hsa
uccaaaagcaaaaacaaaaaacaaaaaaaacaaaaaaacaaaaaacaaaaaaacacacacacac

SEQ ID NO: 281031 - RNA, 64 nt, hsa
ggagaccuuccaaaagcaaaaacaaaaaacaaaaaaaacaaaaaaacaaaaaacaaaaaaacac

SEQ ID NO: 281032 - RNA, 64 nt, hsa
ccuccgcugggagaccuuccaaaagcaaaaacaaaaaacaaaaaaaacaaaaaaacaaaaaaca

SEQ ID NO: 281033 - RNA, 64 nt, hsa
cccagacccuccgcugggagaccuuccaaaagcaaaaacaaaaaacaaaaaaaacaaaaaaaca

SEQ ID NO: 281034 - RNA, 64 nt, hsa
acauugguguguuuagagauuuuaguuuaaaaacaaaacaaaaagauugaucaaaucuguacag

SEQ ID NO: 281035 - RNA, 64 nt, hsa
augggacauugguguguuuagagauuuuaguuuaaaaacaaaacaaaaagauugaucaaaucug

SEQ ID NO: 281036 - RNA, 64 nt, hsa
cuuaaaaagaugagagaaacauauuuuuucaggaaaaacaaacuuuaaaaaaaaaagaggagaa

SEQ ID NO: 281037 - RNA, 64 nt, hsa
gcuguuucacaaacaguuuuauuuaaaaaaacaaaaaacaaaaaaaaucaaaaaaucaaaaaaa

SEQ ID NO: 281038 - RNA, 64 nt, hsa
uaaaauagcuguuucacaaacaguuuuauuuaaaaaaacaaaaaacaaaaaaaaucaaaaaauc

SEQ ID NO: 281039 - RNA, 64 nt, hsa
guuucaaucuguccaucuaccaggccucgcgauaaaaacaaaacaaaaaaacgcugccagguuu

SEQ ID NO: 281040 - RNA, 64 nt, hsa
aaucuguccaucuaccaggccucgcgauaaaaacaaaacaaaaaaacgcugccagguuuuagaa

SEQ ID NO: 281041 - RNA, 64 nt, hsa
uuuggaaaggcggggaagaaggaugaaaccuuuaaaaacaaaaacaaaaacaucaaugaguagg

SEQ ID NO: 281042 - RNA, 64 nt, hsa
aaggcggggaagaaggaugaaaccuuuaaaaacaaaaacaaaaacaucaaugaguaggcauuuu

SEQ ID NO: 281043 - RNA, 64 nt, hsa
uauauauauaaauauaaauauauauaaaaacaacaaaacaaaacaaaaaaagaaaaaaaaacaa

SEQ ID NO: 281044 - RNA, 64 nt, hsa
auauaaauauaaauauauauaaaaacaacaaaacaaaacaaaaaaagaaaaaaaaacaaaaaac

SEQ ID NO: 281045 - RNA, 64 nt, hsa
cuuuggcuaaaucugacaauuuuauauauagcuuaaaacaaagaauauacauucuuuucacccc

SEQ ID NO: 281046 - RNA, 64 nt, hsa
auauauauuaaaagugguuguauucauuuagugaaaaacaaaaaguagauguacuucuguaaau

SEQ ID NO: 281047 - RNA, 64 nt, hsa
uccugaugccaaagaauaugaaaauauuuaaguaaaaacaaaaugaugcauuuugagaagaaca

SEQ ID NO: 281048 - RNA, 64 nt, hsa
uuuaaaaucuuaaauguguaagucacccccaccaaaaacaaaagagaagaaaaagaauagaaag

SEQ ID NO: 281049 - RNA, 64 nt, hsa
uuguuguugauaaugggcuuuguuagcacuuuuuaaaacaaacaaacaaacaaaacaaaaaagc

SEQ ID NO: 281050 - RNA, 64 nt, hsa
cuuuguuagcacuuuuuaaaacaaacaaacaaacaaaacaaaaaagcaaaccacauuuguuauc

SEQ ID NO: 281051 - RNA, 64 nt, hsa
uccaaccugggugacagagugagauuccaucugaaaaacaaaaacaaaaacagaaaacaaacaa

SEQ ID NO: 281052 - RNA, 64 nt, hsa
cugggugacagagugagauuccaucugaaaaacaaaaacaaaaacagaaaacaaacaaacaaaa

SEQ ID NO: 281053 - RNA, 64 nt, hsa
ugagauuccaucugaaaaacaaaaacaaaaacagaaaacaaacaaacaaaaaacaaaaaauccc

SEQ ID NO: 281054 - RNA, 64 nt, hsa
aaaacaaaaacaaaaacagaaaacaaacaaacaaaaaacaaaaaauccccacaacuuugucaaa

SEQ ID NO: 281055 - RNA, 64 nt, hsa
gcaaucaugacugagccaaucacuguuucucagaaaaacaaaacaaaacaaaacaaaugacagu

SEQ ID NO: 281056 - RNA, 64 nt, hsa
caugacugagccaaucacuguuucucagaaaaacaaaacaaaacaaaacaaaugacaguaaccc

SEQ ID NO: 281057 - RNA, 64 nt, hsa
cugagccaaucacuguuucucagaaaaacaaaacaaaacaaaacaaaugacaguaacccuuccc

SEQ ID NO: 281058 - RNA, 64 nt, hsa
ccaaucacuguuucucagaaaaacaaaacaaaacaaaacaaaugacaguaacccuuccccggaa

SEQ ID NO: 281059 - RNA, 64 nt, hsa
cuaaugucaaacuugagucacaaagaacauguagaaaacaaaauggauaaaaucugauauguau

SEQ ID NO: 281060 - RNA, 64 nt, hsa
ucuagccugggugacagagcaagacucugucuaaaaaacaaaacaaaacaaaacaaaacaaaaa

SEQ ID NO: 281061 - RNA, 64 nt, hsa
ccugggugacagagcaagacucugucuaaaaaacaaaacaaaacaaaacaaaacaaaaaaaccu

SEQ ID NO: 281062 - RNA, 64 nt, hsa
gugacagagcaagacucugucuaaaaaacaaaacaaaacaaaacaaaacaaaaaaaccucuuaa

SEQ ID NO: 281063 - RNA, 64 nt, hsa
agagcaagacucugucuaaaaaacaaaacaaaacaaaacaaaacaaaaaaaccucuuaauauuc

SEQ ID NO: 281064 - RNA, 64 nt, hsa
aagacucugucuaaaaaacaaaacaaaacaaaacaaaacaaaaaaaccucuuaauauucuggag

SEQ ID NO: 281065 - RNA, 64 nt, hsa
ucgauuauuucaugcuuuuuuuuaaaaaaaaaaaaaaacaaaauaacaaucugaagaggcauuu

SEQ ID NO: 281066 - RNA, 64 nt, hsa
cauuuugcgaggcuuaggcagcuagacaucguuuaaaacaaaauauuaacuuauauuacaugug

SEQ ID NO: 281067 - RNA, 64 nt, hsa
ccuuaaaaaacucagccaacagguaguauugguaaaaacaaacaaacaaaaauccuuugcccuc

SEQ ID NO: 281068 - RNA, 64 nt, hsa
auugaugaagcagaugaguuuguagcagggccacaaaacaaagugaaacguccaggggaaccca

SEQ ID NO: 281069 - RNA, 64 nt, hsa
gauguugauuuugaccuguucaugauucagaagaaaaacaaacuuuuuuggauuuuuuuucccu

SEQ ID NO: 281070 - RNA, 64 nt, hsa
cuaaucuguguacacaucuccaagcaaggaagaaaaaacaaacucugcucagacgccuaugaaa

SEQ ID NO: 281071 - RNA, 64 nt, hsa
uaccuguuccaccaaaaccuauggaaauuuaaaaaaaacaaaaauaaaaagcaaaacaaaaauc

SEQ ID NO: 281072 - RNA, 64 nt, hsa
cuauggaaauuuaaaaaaaacaaaaauaaaaagcaaaacaaaaaucccaaaaugaauuccauuc

SEQ ID NO: 281073 - RNA, 64 nt, hsa
cauuuuuuaaauccccucuguuuaaaagguuuguaaaacaaaaacaaaaaacuaagucugcuca

SEQ ID NO: 281074 - RNA, 64 nt, hsa
uuaaauccccucuguuuaaaagguuuguaaaacaaaaacaaaaaacuaagucugcucagugaaa

SEQ ID NO: 281075 - RNA, 64 nt, hsa
uauguauaaucauauaugauauauucacaaagagaaaacaaaaggaacuuuuaaaaaaaaaauc

SEQ ID NO: 281076 - RNA, 64 nt, hsa
agaauaagguuccauugcguagccagccuuaggaaaaacaaacagaacccaaaccagauggcaa

SEQ ID NO: 281077 - RNA, 64 nt, hsa
uaaaaaaaaguuguuuauaaaaaccccuaaaaacaaaacaaacacacacacacacacauacaca

SEQ ID NO: 281078 - RNA, 64 nt, hsa
cuuuauaaaaaaaaguuguuuauaaaaaccccuaaaaacaaaacaaacacacacacacacacau

SEQ ID NO: 281079 - RNA, 64 nt, hsa
aggaagcaauauuuaauaaaacuaggucaaaaacaaaacaaaacagugacacucacuugugugu

SEQ ID NO: 281080 - RNA, 64 nt, hsa
ccccaaggaagcaauauuuaauaaaacuaggucaaaaacaaaacaaaacagugacacucacuug

SEQ ID NO: 281081 - RNA, 64 nt, hsa
ugguaaaacuccgacucuauuuaaaaaaaaaacaaaaacaaaaaaaccuuaaaugucaaaaaaa

SEQ ID NO: 281082 - RNA, 64 nt, hsa
gaaaugugguaaaacuccgacucuauuuaaaaaaaaaacaaaaacaaaaaaaccuuaaauguca

SEQ ID NO: 281083 - RNA, 64 nt, hsa
caguaugcaugaagacaugaaggcaagaaacagcaaaacaaauacugaagcaugaagauuccug

SEQ ID NO: 281084 - RNA, 64 nt, hsa
auucuucuaauacauauuaaaagacauaacuaucaaaacaaaauaaauuugucuguuuucaacc

SEQ ID NO: 281085 - RNA, 64 nt, hsa
uuagcugacuuuucccuguagcccuaucauauuaaaaacaaaaagugguccacuugaagcagca

SEQ ID NO: 281086 - RNA, 64 nt, hsa
ucuuuuucuuaaaaaaauaauaaaacuacagacaaaaacaaagugcaaacaacugagacagcaa

SEQ ID NO: 281087 - RNA, 64 nt, hsa
uaagaauguaggccuuaacuauuucacaugagucaaaacaaagcagcuuuaaaaaaauaauugg

SEQ ID NO: 281088 - RNA, 64 nt, hsa
aaaaacgaaacuccaucucaaaacaaaacaaaacaaaacaaacaaacaaacaaaacuugcaucu

SEQ ID NO: 281089 - RNA, 64 nt, hsa
gcgacaaaaacgaaacuccaucucaaaacaaaacaaaacaaaacaaacaaacaaacaaaacuug

SEQ ID NO: 281090 - RNA, 64 nt, hsa
ccugggcgacaaaaacgaaacuccaucucaaaacaaaacaaaacaaaacaaacaaacaaacaaa

SEQ ID NO: 281091 - RNA, 64 nt, hsa
uccagccugggcgacaaaaacgaaacuccaucucaaaacaaaacaaaacaaaacaaacaaacaa

SEQ ID NO: 281092 - RNA, 64 nt, hsa
auggauugcuaguguuggugaguaaaaacaaaaaaaaacaaaugacaaagaaugugauagcuca

SEQ ID NO: 281093 - RNA, 64 nt, hsa
ggaaaacagaauggauugcuaguguuggugaguaaaaacaaaaaaaaacaaaugacaaagaaug

SEQ ID NO: 281094 - RNA, 64 nt, hsa
cacaauuguucuucaaaaacaaacaaaacaaaacaaaacaaaauuaacugcuuaaauguuuugu

SEQ ID NO: 281095 - RNA, 64 nt, hsa
aagaccacaauuguucuucaaaaacaaacaaaacaaaacaaaacaaaauuaacugcuuaaaugu

SEQ ID NO: 281096 - RNA, 64 nt, hsa
uguaaaagaccacaauuguucuucaaaaacaaacaaaacaaaacaaaacaaaauuaacugcuua

SEQ ID NO: 281097 - RNA, 64 nt, hsa
ccaagaaaauguaaaagaccacaauuguucuucaaaaacaaacaaaacaaaacaaaacaaaauu

SEQ ID NO: 281098 - RNA, 64 nt, hsa
gaugugugcauuuggacaaauaguacuuaaaaacaaaacaaacaagcacucagcccagcuccuc

SEQ ID NO: 281099 - RNA, 64 nt, hsa
ccacagaugugugcauuuggacaaauaguacuuaaaaacaaaacaaacaagcacucagcccagc

SEQ ID NO: 281100 - RNA, 64 nt, hsa
caucuacagauauuuucagggauugcuucagaugaaaacaaaucacacaccguuucccaaacca

SEQ ID NO: 281101 - RNA, 64 nt, hsa
cuguuauugucggcaggcggugagggguagaaaaaaaacaaacaaacaaacagaaaaaaaaacc

SEQ ID NO: 281102 - RNA, 64 nt, hsa
gccuggaggccagagugagacuccgucucaaaacaaaacaaaaguggguggcucacggguccgg

SEQ ID NO: 281103 - RNA, 64 nt, hsa
cuccagccuggaggccagagugagacuccgucucaaaacaaaacaaaaguggguggcucacggg

SEQ ID NO: 281104 - RNA, 64 nt, hsa
gaaaguauuaaagcucacuuuaccauuccauauacuuacuaaaagccuguguaaacaugucuua

SEQ ID NO: 281105 - RNA, 64 nt, hsa
uaacauauguuuuaugcaccuucuuuaccugaaacuuacuaagaaucuaccaguaaacaaacau

SEQ ID NO: 281106 - RNA, 64 nt, hsa
ggaauguggcaaagguuuuagccaacucucaaaccuuacuaaacacaagaagauucauacuaga

SEQ ID NO: 281107 - RNA, 64 nt, hsa
agaaugugguaaugcuuuuaaccaauucucaaaucuuacuaaacaaaauuaauacugaaaaugu

SEQ ID NO: 281108 - RNA, 64 nt, hsa
uuuuauuuucuuucacucuguauuaaaaguaaaacuuacuaaaagaaaagagguuuguguucac

SEQ ID NO: 281109 - RNA, 64 nt, hsa
ccccacucccacaaacucugaagccagugucuagcuuacuaaaaaaagaguuguauauaauauu

SEQ ID NO: 281110 - RNA, 64 nt, hsa
aggcaccugcuuuuucuuuucucucauuguccaccuuacuaaaagucaguagaaucuucuaccu

SEQ ID NO: 281111 - RNA, 64 nt, hsa
ccuuccaaaggcagcucagaagauuagaaccagacuuacuaaccaauuccaccccccaccaacc

SEQ ID NO: 281112 - RNA, 64 nt, hsa
agaauguggcaaaggccuuuacugcuccuauucccuuacuaaagaauguggcaaagcuuuucac

SEQ ID NO: 281113 - RNA, 64 nt, hsa
agaauguggcaaagauuucuauugauucucauaccuuacuaaauauaagauaauucauauugga

SEQ ID NO: 281114 - RNA, 64 nt, hsa
agaauguggcaaaggcuuuaauuaguucucaucccuuacuaaacauaagagaauucauaccaua

SEQ ID NO: 281115 - RNA, 64 nt, hsa
ggaaugucucaaagcuuuuuacugauucuuauaccuuacuaaacauaaaauaauucauaaagga

SEQ ID NO: 281116 - RNA, 64 nt, hsa
aaaauguggcaaagcuuuuaaccaauuuucaaaccuuacuaaacauaagauaacucauacugga

SEQ ID NO: 281117 - RNA, 64 nt, hsa
agacugugaaaaagacgucaauaucugcucacaucuuacuaaacaccagagaguucaugcuuaa

SEQ ID NO: 281118 - RNA, 64 nt, hsa
agaaugugucaaagcuuuuaacuguuccucaauccuuacuaaacauaagggaauucauaauaga

SEQ ID NO: 281119 - RNA, 64 nt, hsa
ugaauguggcauagccucuucccaguucucaacucuuacuaaacaugagaacacauguggaaga

SEQ ID NO: 281120 - RNA, 64 nt, hsa
uucaauuaagguacuucucccucagggacguagaacaauggaaugucagucagucucuguaguu

SEQ ID NO: 281121 - RNA, 64 nt, hsa; identical to SEQ ID NO: 281120

SEQ ID NO: 281122 - RNA, 64 nt, hsa
uacaggguuauaggccucuccuuucacauuccagacaauggagaguguuuaugguuucaggaaa

SEQ ID NO: 281123 - RNA, 64 nt, hsa
cauaagaauguuaucagaaucuggucuacuuaggacaauggagacuuuuucaguuuuauaaagg

SEQ ID NO: 281124 - RNA, 64 nt, hsa
agcccuggccccuccacugcuucucuccccauccacaauggagaaggugaaaagaggagggaaa

SEQ ID NO: 281125 - RNA, 64 nt, hsa
auuaagggaaaauggugucauuuguugcagaaaaacaauggauacauuuucuucuggccuaaau

SEQ ID NO: 281126 - RNA, 64 nt, hsa
agcuauuagauuuuucucaaaauaugaguuuuguacaauggaaugaaaaagugacuucauauac

SEQ ID NO: 281127 - RNA, 64 nt, hsa
cacccagcucuguaggugacuuuuaaaugauuauacaauggaaauaacauucauugacauuucu

SEQ ID NO: 281128 - RNA, 64 nt, hsa
acaauggaaguuuaaacauuucuuucugugccacacaauggauggcucuccuuaagugaagaaa

SEQ ID NO: 281129 - RNA, 64 nt, hsa
aaacucagccaaggacacuugauauuuuuuaauuacaauggaaguuuaaacauuucuuucugug

SEQ ID NO: 281130 - RNA, 64 nt, hsa
aagcucagccagggacacuuaauauuuuuuaauuacaauggaaauuuaaacauuuuuauguggg

SEQ ID NO: 281131 - RNA, 64 nt, hsa
acaauggaaauuuaaacauuuuuaugugggcuacacaauggauggcucuucuuaagugaagaaa

SEQ ID NO: 281132 - RNA, 64 nt, hsa
gugcugcuucauaacaaaaaugaaaagcugcaugcaucuacagcaggcauggauuguuuauguc

SEQ ID NO: 281133 - RNA, 64 nt, hsa
gggaauuuuuuuccugaaguaauaauuuauuccacaucuacaucagugaaagcuaucuaccuau

SEQ ID NO: 281134 - RNA, 64 nt, hsa
aauuuuaacuuuuaagugcuauuauguacucuuucaucuacauaaugcacguguucuggaugua

SEQ ID NO: 281135 - RNA, 64 nt, hsa
caaaacacacgaagcauaauauguaaaaaagaugcaucuacaaagaaggcuaaugucauucuuc

SEQ ID NO: 281136 - RNA, 64 nt, hsa
gcuggaaggucuuugacggcaccaucuggaaggacaucuacaaucaggagugguggaaccucag

SEQ ID NO: 281137 - RNA, 64 nt, hsa
ccucgggccacauggguccacugcaccagugugacaucuacaacuccaagauugccgggaagcu

SEQ ID NO: 281138 - RNA, 64 nt, hsa
cagcuugggcccugcaaacacaaccaucuacacacaucuacacccccaagcacacacacauggu

SEQ ID NO: 281139 - RNA, 64 nt, hsa
uguaugugaacagcuugggcccugcaaacacaaccaucuacacacaucuacacccccaagcaca

SEQ ID NO: 281140 - RNA, 64 nt, hsa
ccuacagguuguguacuuuucauaaugguuuccaugaauguaguacguucauacaggcuucauu

SEQ ID NO: 281141 - RNA, 64 nt, hsa
cuuacaaaaauggaguauuuuaguaugaauuugcugaauguaagaccguggacuguuuuuuaua

SEQ ID NO: 281142 - RNA, 64 nt, hsa
agaaaguggggucaggaggccaagaaagggaauaugaauguauauccaagucacucaggaacuu

SEQ ID NO: 281143 - RNA, 64 nt, hsa
cauccucugggaucuucugagguggacagcacuuugaauguagcauuucacuggaacagagucu

SEQ ID NO: 281144 - RNA, 64 nt, hsa
ugauucuuggucuauaauugcagauguuauuguaugaauguaccauaauauauuugagcagucc

SEQ ID NO: 281145 - RNA, 64 nt, hsa
cguuguuuaggguagaauaggcuguguauuuacaugaauguauaauaucuaugucagcaguauu

SEQ ID NO: 281146 - RNA, 64 nt, hsa
accuaccucaaacacacuguuuccacccucuucuugaauguauucaguagccuuuacugaaugu

SEQ ID NO: 281147 - RNA, 64 nt, hsa
guuuuaauaugucaguuauugcccuuuuauauugugaauguaaugugcauaagcuauauccgua

SEQ ID NO: 281148 - RNA, 64 nt, hsa
uuuguaucucacaauucuggucuagauucaguuaugaauguaggcauuaguuaaaauuaacaag

SEQ ID NO: 281149 - RNA, 64 nt, hsa
ugagaaaaacaaugagcugagaggcagacuucccugaauguauugaacuuggaaagaaaugccc

SEQ ID NO: 281150 - RNA, 64 nt, hsa
auuuuguuguguuaaaaguacuuuucuugauuuuugaauguauuuguuucagcagaagucauuu

SEQ ID NO: 281151 - RNA, 54 nt, hsa; identical to SEQ ID NO: 227074

SEQ ID NO: 281152 - RNA, 64 nt, hsa
cuccuaagagaguuguaaaaauagaggcuuggcuugaauguacauagaugguaccuggcaugga

SEQ ID NO: 281153 - RNA, 64 nt, hsa
ggugacuuucauuccaguugcugggacggaaggcugaauguagggucauuuuguaugggauaug

SEQ ID NO: 281154 - RNA, 64 nt, hsa
uauagauauaggacaguacuguaucauaccucugugaauguaaaauaucuuguaccugcuuuau

SEQ ID NO: 281155 - RNA, 64 nt, hsa
aaguaaucuagaagaauguggauacucuuaggcgugaauguaaaugccuuaauauugaaggucc

SEQ ID NO: 281156 - RNA, 64 nt, hsa
aagauuucuuuauuuacaaaugauuacauuuaaaugaauguacauucuucucacugacuuuggu

SEQ ID NO: 281157 - RNA, 64 nt, hsa
cccccgucuuauuaaggagcuuuuaaaguuuuucugaauguauagacauuucucggguuccuac

SEQ ID NO: 281158 - RNA, 64 nt, hsa
gcaacuguggcuuagcuaauauugcaauguggcuugaauguagguagcauccuuugaugcuucu

SEQ ID NO: 281159 - RNA, 64 nt, hsa
cugcuucaugaguagaaauuucaacaacucuuuuugaauguaugaagaguagcaguccccuuug

SEQ ID NO: 281160 - RNA, 64 nt, hsa
guuaaagguuuuggcugcuguaagaaugugaauuugaauguauuuugaauuguaagagcaaaag

SEQ ID NO: 281161 - RNA, 64 nt, hsa; identical to SEQ ID NO: 117710

SEQ ID NO: 281162 - RNA, 64 nt, hsa; identical to SEQ ID NO: 117711

SEQ ID NO: 281163 - RNA, 64 nt, hsa
cuaguggaagauaguguucugcuuauaauuaaacugaauguagaguaucucuguauguuaauug

SEQ ID NO: 281164 - RNA, 64 nt, hsa
augaacuguauuuugcauuuugucuacuuguaagugaauguaacauacugucaauuuuccuugu

SEQ ID NO: 281165 - RNA, 64 nt, hsa
agcaacaacccucacauaugcacugagugaaggaugaauguauggacacaucugggaguauuuu

SEQ ID NO: 281166 - RNA, 64 nt, hsa
ucauaggguuguugugaggauuaaaaugaggaaaugaauguaaagcacuuaguacaguauauga

SEQ ID NO: 281167 - RNA, 64 nt, hsa
ccaauguuugaugggaaaacguggcacucauaguugaauguauacuucuguaccaaaacuugaa

SEQ ID NO: 281168 - RNA, 64 nt, hsa
ccuuuucccucucaccuaaaugucaacuugucauugaauguaaagaaugaaaccuucugacaca

SEQ ID NO: 281169 - RNA, 64 nt, hsa
uagcaugauguauuuaaaguaaggccuuuaguaaugaauguaaugagagaaaauguuuugaaaa

SEQ ID NO: 281170 - RNA, 64 nt, hsa
uaacuagcuuauuaaaauuuacaaaaugucuuuuugaauguaucaaggauauauuuaguuugag

SEQ ID NO: 281171 - RNA, 64 nt, hsa
aaauauaguuggcauuggaaguuuagccuuuacuugaauguauacuguagauuuuuaacaaagc

SEQ ID NO: 281172 - RNA, 64 nt, hsa
uaaaggucuacuuuaaucagaaauagcaacgagaugaauguauccaacauuucaauuugcauuc

SEQ ID NO: 281173 - RNA, 64 nt, hsa
uuacucuaugagucuucauuuuucuaaaauaaagugaauguauuuuuauauucucuguauaucu

SEQ ID NO: 281174 - RNA, 64 nt, hsa
auuagaauaaaaugugcaaauaaugacaauuauuugaauguaacaaggaauucaacugaaaucc

SEQ ID NO: 281175 - RNA, 64 nt, hsa
ggugguuuagggauuuuggcccuaaccaauacauugaauguaugaugacuauuugggaggacac

SEQ ID NO: 281176 - RNA, 64 nt, hsa; identical to SEQ ID NO: 117712

SEQ ID NO: 281177 - RNA, 64 nt, hsa; identical to SEQ ID NO: 117713

SEQ ID NO: 281178 - RNA, 64 nt, hsa
agauguauauagauguauauaugcccaaauauauugaauguacagaaaggaaauauucagagac

SEQ ID NO: 281179 - RNA, 64 nt, hsa
cuauaccuuaccagagcauggaagagcccagaucugaauguaaaacgucucuguucugccagag

SEQ ID NO: 281180 - RNA, 64 nt, hsa
gagucaaggaguguaaccuucuccuuuacuauguugaauguauuuuuuucuggacaagcuuaca

SEQ ID NO: 281181 - RNA, 64 nt, hsa
cucccauguccccaagaccucuggaguuuccucuugaauguacaugaaccacuguaauagcauu

SEQ ID NO: 281182 - RNA, 64 nt, hsa
gcagccucuagagccuucuugcuuucauuuuccuugaauguacauaggaacaagggggaaaguc

SEQ ID NO: 281183 - RNA, 64 nt, hsa
uacaauugugaaaaccucauggauuugggcaaacugaauguauauaggcuuuugacaaaaguug

SEQ ID NO: 281184 - RNA, 64 nt, hsa
uagcuacacaguaaguagcuugguagauaguuauugaauguauuuauguaguguauuaagaagc

SEQ ID NO: 281185 - RNA, 64 nt, hsa
auguaaauggcucacaagucaauugcaaacaaacugaauguacaaaucuuagugcuggugcuga

SEQ ID NO: 281186 - RNA, 64 nt, hsa
uuugcauguuuuuuguuaauuuagcuaaagcaauugaauguagauacucagaagaaauaaaaaa

SEQ ID NO: 281187 - RNA, 64 nt, hsa
cagaguuuaaaugaauacauaaauguagaaguacugaauguauauauuuaaaaggagccucuug

SEQ ID NO: 281188 - RNA, 64 nt, hsa
uuuuugcauugccuucgguuuguauuuagugucuugaauguaagaacaugaccuccguguagug

SEQ ID NO: 281189 - RNA, 64 nt, hsa; identical to SEQ ID NO: 117714

SEQ ID NO: 281190 - RNA, 64 nt, hsa; identical to SEQ ID NO: 117715

SEQ ID NO: 281191 - RNA, 64 nt, hsa
aaaacaugaacagucacauacuugagagaaacugugaauguaagguguaggaaaguacuuaauu

SEQ ID NO: 281192 - RNA, 64 nt, hsa
ugggaaaaauauugcuacaauuuuuuuuaaucucugaauguaauuucgauacuguguacauagc

SEQ ID NO: 281193 - RNA, 64 nt, hsa
acaugauuuuauucuaugccaacauuugggccucugaauguaucuguuauuugaauuuaaguau

SEQ ID NO: 281194 - RNA, 64 nt, hsa
uauauuuauacacauacaauuuauguuuuccuguugaauguauuuuuaugagauuuuaaccaga

SEQ ID NO: 281195 - RNA, 64 nt, hsa
uaucugaaagaaguuucuggguuaggagaaguaaugaauguauccauuuguacaugguuuacau

SEQ ID NO: 281196 - RNA, 64 nt, hsa
gaacaaucauuaauucuucgauauuucuguagcuugaauguaacugcuuuaagaaagguucuca

SEQ ID NO: 281197 - RNA, 64 nt, hsa
agaguacuuuuuaaaauuauuucucacaaagaaaugaauguacaauccaaugaaaacauuuguu

SEQ ID NO: 281198 - RNA, 64 nt, hsa
uaaaacaaugaaagagcauuuaucguuugucccuugaauguagaauuuguuuuugauuucauaa

SEQ ID NO: 281199 - RNA, 64 nt, hsa
ccaggggugggaaguuuucauuugcaggggggucugaauguaacucaccauguggugugcaagg

SEQ ID NO: 281200 - RNA, 64 nt, hsa
caauguauuauuaucacugucagaugagcaugcuugaauguagcaugacugccucuuuuugcuu

SEQ ID NO: 281201 - RNA, 64 nt, hsa
agacauccaaucaauaaugaaggaaauuuuuuucugaauguagguuugagugaggggcaccucu

SEQ ID NO: 281202 - RNA, 64 nt, hsa
agucccagccagaagaaucucugaaagcauauugugaauguauacaauguaguacaaacaaucu

SEQ ID NO: 281203 - RNA, 64 nt, hsa
uuuccuccugucuuagaagaacagaccuaacuagugaauguauuaaugaaaaugcaucuauuuc

SEQ ID NO: 281204 - RNA, 64 nt, hsa
accacacagcagaauuucuaauggaaguuuguugugaauguaaaggagggagcauucuuugcuu

SEQ ID NO: 281205 - RNA, 64 nt, hsa
aauuuaauguaguaacucacuuuuccauauauuuugaauguauauuucuauuuaugauaccaau

SEQ ID NO: 281206 - RNA, 64 nt, hsa
aacuugucuuuuuguuaugcaaaugagauuucuuugaauguauuguucuguuuguguuauuuca

SEQ ID NO: 281207 - RNA, 64 nt, hsa
uuauguaauuuagggaggacuggucuguaauuucugaauguauauagaauaauauuuauguuua

SEQ ID NO: 281208 - RNA, 64 nt, hsa
gagucauuucguucccugauuauuuauccuugucugaauguauuuauguguauauuuguagauu

SEQ ID NO: 281209 - RNA, 64 nt, hsa
ucugaacuauaucuugacaaauauuauucaaacuugaauguaaauauauacaguauguauauuu

SEQ ID NO: 281210 - RNA, 64 nt, hsa
auaaagaaaugggugacaggcuuaaccucaccuaugaauguacaguauguggauuugugaaacu

SEQ ID NO: 281211 - RNA, 64 nt, hsa; identical to SEQ ID NO: 117716

SEQ ID NO: 281212 - RNA, 64 nt, hsa; identical to SEQ ID NO: 117717

SEQ ID NO: 281213 - RNA, 64 nt, hsa
cacuguucugauaucucugauugucauguggauuugaauguagcuugacagagggaaugucuaa

SEQ ID NO: 281214 - RNA, 64 nt, hsa
aacagaaaagaacaacagcaacaaaaacauugugugaauguauguuuguauguguguauguaua

SEQ ID NO: 281215 - RNA, 64 nt, hsa
uuaacuauugauuuuuuuuaaaaaaaauugucuuugaauguauuggaaguagacaugcauuaac

SEQ ID NO: 281216 - RNA, 64 nt, hsa
gggcacacacugaaguuggcuuuucagccagcacugaauguauccaucaggacaugcgucuuca

SEQ ID NO: 281217 - RNA, 64 nt, hsa
acuuguccguagggucacacgcgugcccuguugcugaauguauguugcguaucccaaggcacug

SEQ ID NO: 281218 - RNA, 64 nt, hsa
agguauuuacacauacaacuucauauaacugagaugaauguaauuuugaacuguuuaacacuuu

SEQ ID NO: 281219 - RNA, 64 nt, hsa
cuguucccuaaucccacccccugcccugagacagugaauguaguccgugaagggagugccucuc

SEQ ID NO: 281220 - RNA, 64 nt, hsa
uaaauucacagcaguaagauaauauaaauuuuguugaauguauuaacaucauauggucugaaaa

SEQ ID NO: 281221 - RNA, 64 nt, hsa
uggagugaauuaaguucaccugauaacucaaaagugaauguauaauacaauucuguuuuaaucu

SEQ ID NO: 281222 - RNA, 64 nt, hsa
uacaguguaguguuuauucuaaggaagauauguaugaauguauauacaaagacucagcuacuuc

SEQ ID NO: 281223 - RNA, 64 nt, hsa
gaggccucugcaagauucugugggcagcuggcucugaauguagccagcccacauccauuccaga

SEQ ID NO: 281224 - RNA, 64 nt, hsa
agacaucaugagaaaauaccagcaguaucuaucaugaauguagaaauaaaaguccuuaaaauaa

SEQ ID NO: 281225 - RNA, 64 nt, hsa
aacaugggagaauccauacuagugagaaaccacgugaauguaaugaaugugggaacgcuuugau

SEQ ID NO: 281226 - RNA, 64 nt, hsa; identical to SEQ ID NO: 117718

SEQ ID NO: 281227 - RNA, 64 nt, hsa; identical to SEQ ID NO: 117719

SEQ ID NO: 281228 - RNA, 64 nt, hsa
cccuuccagcuuuucuguagaaucuuacugguauugaauguaaaggaagcaaggccuguauugc

SEQ ID NO: 281229 - RNA, 64 nt, hsa
auaagaauaauucagguagcaucugaaauuuuaaugaauguauaauuggcauaucauggaaaau

SEQ ID NO: 281230 - RNA, 64 nt, hsa
ugcccugcaaauaaaaagacaauuccuuauugucugaauguaauacagucuucauuguacuauu

SEQ ID NO: 281231 - RNA, 64 nt, hsa
uuuucauuuuuuuacuuuguaguuuauuuuuuagugaauguauuuaauuuuaugaauuauuuau

SEQ ID NO: 281232 - RNA, 64 nt, hsa
aaaagcaaguuauaucagugaaguaagauccuuuugaauguacaaagacccacacuauugagac

SEQ ID NO: 281233 - RNA, 64 nt, hsa
uaaagguaaaaaaaauuccccaaauauuuugcacugaauguaccaaaggugaagggacauuaca

SEQ ID NO: 281234 - RNA, 64 nt, hsa
agucaaauggcuucaugagaacaguagaaccuuaugaauguauacuagcauacaaggaucucaa

SEQ ID NO: 281235 - RNA, 64 nt, hsa
gcauuugacacaauauuguaauaauccaugauuuugaauguaaaguauauaugaugucauuaau

SEQ ID NO: 281236 - RNA, 64 nt, hsa
uguuuucauauuuuucaaaauagguuuuuauuguugaauguacaucuaccccagccccucaaaa

SEQ ID NO: 281237 - RNA, 64 nt, hsa
aagaucauuuuauuaucuuuaacuguaucuauuuugaauguaaauuuaaaaaaaguaauucucu

SEQ ID NO: 281238 - RNA, 64 nt, hsa
uguauaauuacuugauucacacagugagaaaaaaugaauguauuccuguuuuugaagagaagaa

SEQ ID NO: 281239 - RNA, 64 nt, hsa
guuuaaggcucuucauccugguuagcaaaaggugugaauguaaugugauggaauuuaaaaguuu

SEQ ID NO: 281240 - RNA, 64 nt, hsa
aacuggaauagcuaauuacagucuauuaaaacugugaauguauguagcaauccugcgugugaag

SEQ ID NO: 281241 - RNA, 64 nt, hsa; identical to SEQ ID NO: 117720

SEQ ID NO: 281242 - RNA, 64 nt, hsa; identical to SEQ ID NO: 117721

SEQ ID NO: 281243 - RNA, 64 nt, hsa
gggggaacauuguaaagaaacaaaaagguccagaugaauguaugcuagaaauaaaaguugaaag

SEQ ID NO: 281244 - RNA, 64 nt, hsa
aauaaucuuccauuuggcugucgugaggaguaauugaauguaauccaucucuuacaaaauggag

SEQ ID NO: 281245 - RNA, 64 nt, hsa
gcugcgcgggcuuauuuauuaacaggauaacccuugaauguagcagccccgggagggcggcaca

SEQ ID NO: 281246 - RNA, 64 nt, hsa
cggagggaaauuguaaauccuguguuucauuacuugaauguaguuaucuauugaaaauauauau

SEQ ID NO: 281247 - RNA, 64 nt, hsa
aaggguuucaaucaauuauuaaugcagagaguauugaauguaaaucagagcucucuagucuuca

SEQ ID NO: 281248 - RNA, 64 nt, hsa
acuuguuuaucuuguugcugcaaugagaaauaaaugaauguauguauuuuggugcagacaccug

SEQ ID NO: 281249 - RNA, 64 nt, hsa
cuauacacuaucaaauauauaaagcuuucuauauugaauguacauuauacagaucauucauaug

SEQ ID NO: 281250 - RNA, 64 nt, hsa
accaucgccuuccaaagucagcacucuacacucuugaauguaccaaggaucucuuggcgacagu

SEQ ID NO: 281251 - RNA, 64 nt, hsa
uaugguauuuauuuucaguaguaaagacccagcuugaauguaaauuuuguauaguguaaguaug

SEQ ID NO: 281252 - RNA, 64 nt, hsa
uuccauuuuggcgcuauuacaaauagugcaacuaugaauguacugcauguuaccaucuuacuug

SEQ ID NO: 281253 - RNA, 64 nt, hsa
uauucaauauuggucuguguuuaaguuuguuauuugaauguaauuuacauagaggaauauaaua

SEQ ID NO: 281254 - RNA, 64 nt, hsa; identical to SEQ ID NO: 117722

SEQ ID NO: 281255 - RNA, 64 nt, hsa; identical to SEQ ID NO: 117723

SEQ ID NO: 281256 - RNA, 64 nt, hsa; identical to SEQ ID NO: 117724

SEQ ID NO: 281257 - RNA, 64 nt, hsa; identical to SEQ ID NO: 117725

SEQ ID NO: 281258 - RNA, 64 nt, hsa
gggucucucccucagguguuuuuuaugaagugcgugaauguauguaaugugugguggccucagc

SEQ ID NO: 281259 - RNA, 64 nt, hsa
aaguuuuggcaguaaaauacucuguuuuuaaguaugaauguauuucauucauauuuccucucac

SEQ ID NO: 281260 - RNA, 64 nt, hsa
acagaaggaagggagucccaucucaaaaaaaaaaugaauguaugccacugcaauuagaguaucc

SEQ ID NO: 281261 - RNA, 64 nt, hsa
auucuuaauguaugauuucuuuguucauauauuaugaauguauuauuuuauuugcuucguaaua

SEQ ID NO: 281262 - RNA, 64 nt, hsa
uuacuauguauuuauacguuaagaccucuaugaaugaauguaucagagaaugucuuuguaacug

SEQ ID NO: 281263 - RNA, 64 nt, hsa
uggaaaccaucacuauugagagaugggaaaaaccugaauguauaaagcauuuauuugucaauaa

SEQ ID NO: 281264 - RNA, 64 nt, hsa
aucauggugauuaugaugguuaaagccuuuacacugaauguaauguuuaauaaagaaauuacaa

SEQ ID NO: 281265 - RNA, 64 nt, hsa
uaaccauuucaccuggacuaucuaaucaguccuaugaauguaucccuaaaugugguuauugaaa

SEQ ID NO: 281266 - RNA, 64 nt, hsa
uuucuuauugcuuuuccuucccuaauucauacaaugaauguauuuggaauacuuacauauuaua

SEQ ID NO: 281267 - RNA, 64 nt, hsa
cuuccugauugcgcagacugaaacuagcuaaaccugaauguaccuacuagggcaccauaauacu

SEQ ID NO: 281268 - RNA, 64 nt, hsa
cuagcuuguuuugacagguuuauuucacauccuaugaauguauguaaauaaacuguacauaggu

SEQ ID NO: 281269 - RNA, 64 nt, hsa
ugcauuaccuaauaauuaccucagcguuagaauuugaauguauuaauugauuuaaacaucaugu

SEQ ID NO: 281270 - RNA, 64 nt, hsa
aaagucguuucaacucuuaaagacaucuuaauccugaauguaaacaauuguuauguguuuagaa

SEQ ID NO: 281271 - RNA, 64 nt, hsa
uaggaccaaaacagaauauuguagauggcaguuaugaauguauauuuauauuuugauuaagauu

SEQ ID NO: 281272 - RNA, 64 nt, hsa
gugaggcucccacaggcaccagcaaaacaacggaugaauguagcccuuccaacaccugacagaa

SEQ ID NO: 281273 - RNA, 64 nt, hsa
gagaguuguauguaaccagugauaugauuauuccugaauguacagacagaaguaagccuggaca

SEQ ID NO: 281274 - RNA, 64 nt, hsa
ggcuagauguuuacauuuguaagaaauaacacugugaauguaaaacagagccauucccuuggaa

SEQ ID NO: 281275 - RNA, 64 nt, hsa
cuccagacguagccauuuccugacaucaagauguugaauguaaucuggucugagcugggccugu

SEQ ID NO: 281276 - RNA, 64 nt, hsa
aaaccucaauuuaagucuuuaaaagguuguauuuugaauguaaccaaaaguuuacaguuuuuug

SEQ ID NO: 281277 - RNA, 64 nt, hsa
gguuuuaugcugcuuuguuaggacagauguguuuugaauguaccauuauaagaagaauucuaug

SEQ ID NO: 281278 - RNA, 64 nt, hsa
caauguggaauuaccaaauuaaaagagaauacuaugaauguauucauauuuuuucuauauugaa

SEQ ID NO: 281279 - RNA, 64 nt, hsa
aauggaauauuuucuaaaacauuuaguauacauuugaauguauuuuaaaccaugccaaacuacu

SEQ ID NO: 281280 - RNA, 64 nt, hsa
agguaauauuuuuaauaugauacauuacauauugugaauguauacuaaaaaaacauuuuaaaug

SEQ ID NO: 281281 - RNA, 64 nt, hsa
aagccuuuuuuuucuuuuuuuuuuuuuuggcaaaugaauguaccauuucaacuuugauuuuaau

SEQ ID NO: 281282 - RNA, 64 nt, hsa
gacuuuccucucccaguuuccagacagggcucuuugaauguaugucaaacucaguuacuccaga

SEQ ID NO: 281283 - RNA, 64 nt, hsa
uuaucuuuuuguggugugaauaaaucuuuuaucuugaauguaauaagaauuugguggugucaau

SEQ ID NO: 281284 - RNA, 64 nt, hsa
acuuucuccaauguggacucugugugucagugaaugaauguaguaaaauucacuuuggaagguu

SEQ ID NO: 281285 - RNA, 64 nt, hsa
gugauaauuuugcuuuguguuacuuuuuugcucuugaauguaucguuaugauggucucuuauaa

SEQ ID NO: 281286 - RNA, 64 nt, hsa
auuucauugagggcaaggcugguggcagguacuaugaauguaauucauaauuuaaaaggaaaac

SEQ ID NO: 281287 - RNA, 64 nt, hsa
aauaaguaucuauguaaauuuguuuaaaauaaacugaauguauuuaaugguccauuuauauguu

SEQ ID NO: 281288 - RNA, 64 nt, hsa; identical to SEQ ID NO: 117726

SEQ ID NO: 281289 - RNA, 64 nt, hsa; identical to SEQ ID NO: 117727

SEQ ID NO: 281290 - RNA, 64 nt, hsa
uacuaguguguucauuauagaguaucuguagaggugaauguaaaaguaaguccaaucuauuuuc

SEQ ID NO: 281291 - RNA, 64 nt, hsa
caugaacauuacugcagguuuuugaugaauauaaugaauguauggaauucaauugaauuugcau

SEQ ID NO: 281292 - RNA, 64 nt, hsa
ucugcuuuaaaggcauguguguuuuuaaaauuaaugaauguagaugugugauugucugagugag

SEQ ID NO: 281293 - RNA, 64 nt, hsa
uuuaagacacuuuuuggacucaacguuacauuuuugaauguaguaaguaaauuaaccaaaaaag

SEQ ID NO: 281294 - RNA, 64 nt, hsa
ucagagcuagggugggggugcccgauucgggugcugaauguaaggaggggagccuccaagugug

SEQ ID NO: 281295 - RNA, 64 nt, hsa
uuaaggagcauuuaaaaauauguauauaugugacugaauguaagauuaacuuuauuuuggucug

SEQ ID NO: 281296 - RNA, 64 nt, hsa
ggucugugcuaccucugugagguauauacuaaaaugaauguaaaauaaggaucguauucccugc

SEQ ID NO: 281297 - RNA, 64 nt, hsa
auaaauuauaaaugcaauuaacuaagaacagcucugaauguauuugcaugggauugguccuuga

SEQ ID NO: 281298 - RNA, 64 nt, hsa
guucauuucacugggauuuugaagcauuucugucugaauguaaagccuguucuaguccuggugg

SEQ ID NO: 281299 - RNA, 64 nt, hsa
gugugagaaaagaauagaagugaaauuugcauaaugaauguaaaagggaaauaaaagucuuuug

SEQ ID NO: 281300 - RNA, 64 nt, hsa; identical to SEQ ID NO: 117728

SEQ ID NO: 281301 - RNA, 64 nt, hsa; identical to SEQ ID NO: 117729

SEQ ID NO: 281302 - RNA, 64 nt, hsa
auuuauuuaaauauuuaaauuuuauauuuauuguugaauguaugguuugcuaccuauuguaacu

SEQ ID NO: 281303 - RNA, 64 nt, hsa
guuuuguagccuuaagaaguguuucaaacauaucugaauguauaaaauaagaguaaaugcccua

SEQ ID NO: 281304 - RNA, 64 nt, hsa
aaguaccuggagcaucauucucuucuaccacaucugaauguaacuuaaauuugcucaaagaagc

SEQ ID NO: 281305 - RNA, 64 nt, hsa
ucaggcuugacaacuucacauugccucucuuccuugaauguauuuuaucuggucuuuucuauau

SEQ ID NO: 281306 - RNA, 64 nt, hsa
guuacucagcucccuggaaagcaggcaagcauguugaauguaucuaguggucugauuuuaauuu

SEQ ID NO: 281307 - RNA, 64 nt, hsa
acuggauuugauuucuuuuuaugaaaguuucauaugaauguaacuugauuuuuuacuauuauaa

SEQ ID NO: 281308 - RNA, 64 nt, hsa
acauaugguagacaauuugccuuaggaagugacuugaauguacaaagauacuugaugcacuuau

SEQ ID NO: 281309 - RNA, 64 nt, hsa
acacauaagccaaaacugagcauaaguccucuagugaauguaggcuggcuuucagaguaggcua

SEQ ID NO: 281310 - RNA, 64 nt, hsa
gaaauuaacacuggaacugacccuuuucuggcagugaauguaagcucuagcucccccaucuacu

SEQ ID NO: 281311 - RNA, 64 nt, hsa
augguuacacuguuagaacacuauuuucagaaucugaauguaauuuguguaauaaaguguuuuc

SEQ ID NO: 281312 - RNA, 64 nt, hsa
gauggguuuguugguauuuaaaaugaauacaacuugaauguaauuaaagugcuguuuuuuggaa

SEQ ID NO: 281313 - RNA, 64 nt, hsa
agucuugaacacagaauaacgauugugaccauuaugaauguaacuaauuucaguuguacuguga

SEQ ID NO: 281314 - RNA, 64 nt, hsa
uucuaaauagcgauuauaaucuccaacuuuauuuugaauguaccucuauuaguuucaauugagu

SEQ ID NO: 281315 - RNA, 64 nt, hsa
ucaggcagauuaaaagaaucauuuguugaacaacugaauguauaaaaaaauuauaaacuggugu

SEQ ID NO: 281316 - RNA, 64 nt, hsa
acuauuaccuagagugaacuuuaagcuuuauuguugaauguaauuccauuauauuuccuuuugu

SEQ ID NO: 281317 - RNA, 64 nt, hsa
aggggcaaaaauauuuugcaagcucuggaauuguugaauguauucuuuuauauaacuacauuaa

SEQ ID NO: 281318 - RNA, 64 nt, hsa
uuuuauuuuguguccuugggcuauaaaagauuccugaauguaauuauaaggauuuggguuugga

SEQ ID NO: 281319 - RNA, 64 nt, hsa
ugaaguaguguuuaggauccuccauggcaguuagugaauguaagaaguacaguguuaaaguguu

SEQ ID NO: 281320 - RNA, 64 nt, hsa
aacucgaucuaaaguuuagcauuuccaucugcgaugaauguaggccacaaaccacaguaguauu

SEQ ID NO: 281321 - RNA, 64 nt, hsa
cggccgccggggcacauagggguuuuaucgggcgugaauguaaauaaauuauauauauauauug

SEQ ID NO: 281322 - RNA, 64 nt, hsa
gcugaacagugaugaucuguagacauuuauggacugaauguaaugguugauauauguacauucu

SEQ ID NO: 281323 - RNA, 64 nt, hsa
guggcgacuuagaguuggcggauauucggaacugugaauguacauagcguugaguuaaaccccu

SEQ ID NO: 281324 - RNA, 64 nt, hsa
uggcagcaguuuuauaaaguccgucauuugcauuugaauguaaggcucaguaaaugacagaacu

SEQ ID NO: 281325 - RNA, 64 nt, hsa
ugucuuaaaacaaggcuuacuuacuagacauaacugaauguaaaaagugcuuuuucaaaucugu

SEQ ID NO: 281326 - RNA, 64 nt, hsa
gaaaacuuacuuuucauggagugccaccuaacagugaauguauuagaguauaaaauguuugcca

SEQ ID NO: 281327 - RNA, 64 nt, hsa
ccaacagaguugugaaugugugugggaaggccuuugaauguaaagcugcauaagcuguuagguu

SEQ ID NO: 281328 - RNA, 64 nt, hsa
uaauuuucuaguuccuuuuuaaugaugauuauucugaauguauuugccacuacauuuacaauaa

SEQ ID NO: 281329 - RNA, 64 nt, hsa
auucauuaauuuaguguaagaagaaaguuaagucugaauguaaauucaguguaagaugaaaauu

SEQ ID NO: 281330 - RNA, 64 nt, hsa; identical to SEQ ID NO: 117730

SEQ ID NO: 281331 - RNA, 64 nt, hsa; identical to SEQ ID NO: 117731

SEQ ID NO: 281332 - RNA, 64 nt, hsa; identical to SEQ ID NO: 117732

SEQ ID NO: 281333 - RNA, 64 nt, hsa; identical to SEQ ID NO: 117733

SEQ ID NO: 281334 - RNA, 64 nt, hsa
augauuuauuaauuaccaggauccuuuucuaaauugaauguacuuuugaauuacuagguuucuu

SEQ ID NO: 281335 - RNA, 64 nt, hsa
gacuugguucuaguccaauuucugccacugaggaugaauguaacugugggcaaacuauuuaccc

SEQ ID NO: 281336 - RNA, 64 nt, hsa
aauuuuguuccaccaugguuaguuauuugccauaugaauguauucuuguuucuaccaauauucu

SEQ ID NO: 281337 - RNA, 64 nt, hsa; identical to SEQ ID NO: 117734

SEQ ID NO: 281338 - RNA, 64 nt, hsa; identical to SEQ ID NO: 117735

SEQ ID NO: 281339 - RNA, 64 nt, hsa
cggaagucagggcggcuggauuccaggacaggagugaauguaaaaauaaauaucgcuuagaaug

SEQ ID NO: 281340 - RNA, 64 nt, hsa
agucucuccgaacucaaauggaagaaauaccuuaugaauguaagaauguagggggucauggcuu

SEQ ID NO: 281341 - RNA, 64 nt, hsa
auuauuaguuaggcuucugagcuugcaaucauauugaauguaugaagagcgaaaucaaauucuu

SEQ ID NO: 281342 - RNA, 64 nt, hsa
uacuuauccagguuugcaaauguacauguucauuugaauguaaaucaccauuucuuggaacccc

SEQ ID NO: 281343 - RNA, 64 nt, hsa
uuuauuauuuauuuauuauuuauuuauuuacagaugaauguauuuauuugggagaccgggguau

SEQ ID NO: 281344 - RNA, 64 nt, hsa
gcuggggagggaagcacugucauguggacguggaugaauguaggaccagcaucacccucugcuc

SEQ ID NO: 281345 - RNA, 64 nt, hsa
ucugucauuauugcccugaucacaaacaaaagccugaauguacuauguuuaaaagacaaaccaa

SEQ ID NO: 281346 - RNA, 64 nt, hsa
cuacucuaaugcauuugguauguaacuuuaaauuugaauguauucuuguaaaacauccaguauu

SEQ ID NO: 281347 - RNA, 64 nt, hsa
gcccugggccugcuccuugccaccaaccgaaccgugaauguagggcccccagccucaccucugc

SEQ ID NO: 281348 - RNA, 64 nt, hsa
ugaacagcauggaaucucauugccaaauuauuagugaauguauaguucagguauucuuugagac

SEQ ID NO: 281349 - RNA, 64 nt, hsa
aaauuuuauucuuagcacacuguuauguccuaacugaauguauucaguauucaaauaaaagaca

SEQ ID NO: 281350 - RNA, 64 nt, hsa
auuuuggauguaaagauuccugugucucauaauaugaauguauuuuuugauauacaagaaacug

SEQ ID NO: 281351 - RNA, 64 nt, hsa
ucuaauaaggagauuuaagauaagacccaauaaaugaauguauucuguaaugcuuuuaggaugu

SEQ ID NO: 281352 - RNA, 64 nt, hsa
caccaugaaauuaaaaucaucucauuccugaagaugaauguaggaccagacauuuuagcuucac

SEQ ID NO: 281353 - RNA, 64 nt, hsa
cuccaccucaaaaaauaaaaucaagauaaccucuugaauguaauagcucauagcacuuuaauuu

SEQ ID NO: 281354 - RNA, 64 nt, hsa
caaguuagugauugcauuugaucccaaaacaagaugaauguaugcaaugggauguacauaaguu

SEQ ID NO: 281355 - RNA, 64 nt, hsa
ucuuccuugggccuuuggaaaaauaugugacaagugaauguaagucugugccuggagagcuaau

SEQ ID NO: 281356 - RNA, 64 nt, hsa
ucucagacuauucugaguaaugcuugcuugcuaaugaauguauaggagaccacauuguaauugu

SEQ ID NO: 281357 - RNA, 64 nt, hsa
uuuuugaaauuacauugcuuguuuaucagacaauugaauguaguaauucuguucuggauuuaau

SEQ ID NO: 281358 - RNA, 64 nt, hsa
accaaaggcacagauuuguguacaauauacccauugaauguauauccugagaaaaauuggggcc

SEQ ID NO: 281359 - RNA, 64 nt, hsa
guucugaaaauauggugaugguugcacaccauugugaauguacugaaugccauucagugguacc

SEQ ID NO: 281360 - RNA, 64 nt, hsa
uucguaaagaaaauuacuucugguauuuaggcugugaauguaccuugaaggggagaguucaugg

SEQ ID NO: 281361 - RNA, 64 nt, hsa
augaaggguugugaguuuaguuucucuccuaaaaugaauguaugcccaccagagcagacaucuu

SEQ ID NO: 281362 - RNA, 64 nt, hsa
ccuugauauacacagagauggucuuggagaauugugaauguauguacuguauugucaucaagga

SEQ ID NO: 281363 - RNA, 64 nt, hsa
gagacuaacuuuguauguuaagguuugaacuaagugaauguaucugcagaggaaguauuacaaa

SEQ ID NO: 281364 - RNA, 64 nt, hsa
cuuacgcagggagaugcaggucucucuaaacgcaugaauguauguaguguguaggcacuguagu

SEQ ID NO: 281365 - RNA, 64 nt, hsa
uauagaaaaaaacauucuaucuacugauuugggcugaauguauguaaauagguuucuaaaaagu

SEQ ID NO: 281366 - RNA, 64 nt, hsa
cuguuuauuuuuuauucuaaguacacugauucugugaauguaccuuuuuuauuaacagggaaag

SEQ ID NO: 281367 - RNA, 64 nt, hsa
auuauaauuugagaaaaauauuacccaguaacauugaauguagauggcuaaacgauucuuacuc

SEQ ID NO: 281368 - RNA, 64 nt, hsa
auaaaguguucuaugaaauucagaacuuuauuucugaauguaacaucccuaauaacaaccuuca

SEQ ID NO: 281369 - RNA, 64 nt, hsa
gaguuucugacaaauuuguuuuaaaaaucaaauuugaauguacuauucuauaaauugccuuucu

SEQ ID NO: 281370 - RNA, 64 nt, hsa
aaacgugugucuggauauuaacucuuguuuaaacugaauguaugauauuuuguuagaauggaaa

SEQ ID NO: 281371 - RNA, 64 nt, hsa
ccaggagagguagagugaaaaucccagccauggaugaauguacuaauuugaaagccaaguguua

SEQ ID NO: 281372 - RNA, 64 nt, hsa
aaaccaagaaauguaaucaagcaguaaaaacaucugaauguagaccaugaucucaaguucuucc

SEQ ID NO: 281373 - RNA, 64 nt, hsa
guuccuaagacccuugucccagauacucuaaaugugaauguaugagcugggggagucaacccag

SEQ ID NO: 281374 - RNA, 64 nt, hsa
cuuauuucauaauugccuacauuuaucaugguccugaauguagcguguaagcuuguguuucuug

SEQ ID NO: 281375 - RNA, 64 nt, hsa
cuucuauuccugagggcucagagcugaccaugcaugaauguauggcaguguccacuuuucugua

SEQ ID NO: 281376 - RNA, 64 nt, hsa
agaaaaauugacauugcugccuuuaagaauaccaugaauguaagaaauugaaagaaauuguaaa

SEQ ID NO: 281377 - RNA, 64 nt, hsa
gagugaguccuuuuuuuaugguguccucccucugugaauguacaggcggaacuguacgaacagc

SEQ ID NO: 281378 - RNA, 64 nt, hsa; identical to SEQ ID NO: 117736

SEQ ID NO: 281379 - RNA, 64 nt, hsa; identical to SEQ ID NO: 117737

SEQ ID NO: 281380 - RNA, 64 nt, hsa; identical to SEQ ID NO: 117738

SEQ ID NO: 281381 - RNA, 64 nt, hsa; identical to SEQ ID NO: 117739

SEQ ID NO: 281382 - RNA, 64 nt, hsa
ccaauuuaugggagaauugcacacagaugugaaaugaauguaaucuaauagaagccuaaucagc

SEQ ID NO: 281383 - RNA, 64 nt, hsa; identical to SEQ ID NO: 117740

SEQ ID NO: 281384 - RNA, 64 nt, hsa; identical to SEQ ID NO: 117741

SEQ ID NO: 281385 - RNA, 64 nt, hsa
uuuaaacuaaaacuaguauaauuuagucuuuucaugaauguacauacauaaaauuauacauaaa

SEQ ID NO: 281386 - RNA, 64 nt, hsa
gggaagggauuguuguguagucaagucaccaugcugaauguacacugauuccuuuaugaugacu

SEQ ID NO: 281387 - RNA, 64 nt, hsa
ggccagccggccucucgagagccagagcagcaguugaauguaaugcuggggacaggcaugcugc

SEQ ID NO: 281388 - RNA, 64 nt, hsa; identical to SEQ ID NO: 117742

SEQ ID NO: 281389 - RNA, 64 nt, hsa; identical to SEQ ID NO: 117743

SEQ ID NO: 281390 - RNA, 64 nt, hsa
uucagcucaauuguuaaugugauggauggcacaaugaauguauauuuuguguuauucgugaaua

SEQ ID NO: 281391 - RNA, 64 nt, hsa
cuggacugccggaaucccagcauuagcuuccugcugaauguaguauuuggcauucucugaauuu

SEQ ID NO: 281392 - RNA, 64 nt, hsa
uccgugguuaaacucgcucacugcuaagaauauuugaauguaugcuucauacagggaugguguu

SEQ ID NO: 281393 - RNA, 64 nt, hsa
uaaggaugggaauauuuuguuauacuguguauagugaauguauuguacugugucugugaaaacu

SEQ ID NO: 281394 - RNA, 64 nt, hsa
aaauacuuagaacuggaaggcucuuuguuauuauugaauguaccccucagccuucucagcauuu

SEQ ID NO: 281395 - RNA, 64 nt, hsa
gacauuugacuuuuauuuuuguauuuaauugacaugaauguaaaggggacagcucaggguuguu

SEQ ID NO: 281396 - RNA, 64 nt, hsa
aaaauguagaaauucuucaugaacauaacucugcugaauguaaaagaaaauuuuuuuucaaaaa

SEQ ID NO: 281397 - RNA, 64 nt, hsa
gugucaugaguguuuaaaucaagaggaagcugcaugaauguaaucaacauuccaacuggagcuc

SEQ ID NO: 281398 - RNA, 64 nt, hsa
uuucuucacugugacagcaaagauuuaaauaagaugaauguaaaagagaaagcuuauuggacuc

SEQ ID NO: 281399 - RNA, 64 nt, hsa; identical to SEQ ID NO: 117744

SEQ ID NO: 281400 - RNA, 64 nt, hsa; identical to SEQ ID NO: 117745

SEQ ID NO: 281401 - RNA, 64 nt, hsa
uuuugaacuaaauaguggugauggcuacacauugugaauguaauuaacaccacugaguuaaaca

SEQ ID NO: 281402 - RNA, 64 nt, hsa
gaugaacuuuggaguacuguuucuuccuucaaacugaauguaauuaauucaugaauaaaugcac

SEQ ID NO: 281403 - RNA, 64 nt, hsa
auaaaaaugcuuguauuucuuuaaaaaguaagccugaauguagaguaaaaggggaaaugccaag

SEQ ID NO: 281404 - RNA, 64 nt, hsa
aaagacuguaacuauugcuggaaauguucuauauugaauguacaugcucuuguuggaaaaaugu

SEQ ID NO: 281405 - RNA, 64 nt, hsa
ugcuaaaaauauuaagaccaagucaugcaauaauugaauguaccucaaauuuuuaggggagggu

SEQ ID NO: 281406 - RNA, 64 nt, hsa
cuaaagauuucaaauaguggcagacagugucuucugaauguaaguuuugagaaauacgagucug

SEQ ID NO: 281407 - RNA, 56 nt, hsa; identical to SEQ ID NO: 227330

SEQ ID NO: 281408 - RNA, 64 nt, hsa
ucagaaguauauagauacuuccggugacuacauaugaauguacuuucaauauuauuuuuuuauu

SEQ ID NO: 281409 - RNA, 64 nt, hsa
auauacugcacauacugaaauagagggaaaucacugaauguaaagagguuucaucuaugccccc

SEQ ID NO: 281410 - RNA, 64 nt, hsa
ccaggacaugagagacauagaaaaacagaagucaugaauguaaauugaaugagaggcuuaacau

SEQ ID NO: 281411 - RNA, 64 nt, hsa
uaaacuauaucuuggcuaguggcuacugugucugugaauguaaccaguacuucuuuaagcucua

SEQ ID NO: 281412 - RNA, 64 nt, hsa
uuuagucaugaguuguuuucaguuuucagacgaaugaauguaauaggaaacuauggaguuacca

SEQ ID NO: 281413 - RNA, 64 nt, hsa
uuagacuucuuaauaaccuaaauauuuaaaauaaugaauguaacaccuuuuuuaguucacugau

SEQ ID NO: 281414 - RNA, 64 nt, hsa
cuggaauuacaguugugagccaccacaccuggcuugaauguagauuuuaauaauugaauuuauu

SEQ ID NO: 281415 - RNA, 64 nt, hsa
accagauucacuucugaauuggccagaggaaaucugaauguauuauccugugugugucuaggua

SEQ ID NO: 281416 - RNA, 64 nt, hsa
uggggaaaacaguuguggaauucuuacuucauuaugaauguauuuaaaaaacaaacaccaaaua

SEQ ID NO: 281417 - RNA, 64 nt, hsa
caagaaaaaaaaaaaaaaaagaauaugcacagucugaauguauaccaggagugugagagacaca

SEQ ID NO: 281418 - RNA, 64 nt, hsa
ggcagcauaauuuugugguuaagagaaugaauucugaauguacacuuucugucucaaacccugg

SEQ ID NO: 281419 - RNA, 64 nt, hsa
ugcucucugccacagcuugcagcauggucuugacugaauguacuguuccuguuagcguuacuuc

SEQ ID NO: 281420 - RNA, 64 nt, hsa
cuacugugugcaaaguguuucauguauaucucauugaauguauacagccacccuguugugguau

SEQ ID NO: 281421 - RNA, 64 nt, hsa
uucagugaaagaggaaggaaaggaguagggcuagugaauguaucugccaggucuuagaagucag

SEQ ID NO: 281422 - RNA, 64 nt, hsa
cuuuagguauuacuacauaguugaaggauuuaacugaauguauggaucaaauuuauuuauuuga

SEQ ID NO: 281423 - RNA, 64 nt, hsa
auguugacaggcaaauuucauacccaugucagauugaauguauuuaaauguauguauuuaagga

SEQ ID NO: 281424 - RNA, 64 nt, hsa
acuaguaaauugucugccuccuauagcagaaaggugaauguacaaacuguugguggcccugaau

SEQ ID NO: 281425 - RNA, 64 nt, hsa
aagcugauuugcaacauuugcuaaauggauuagaugaauguacuucuuuuugugagcuuacuug

SEQ ID NO: 281426 - RNA, 64 nt, hsa
ggagaaaaacauuuuagauauguauuacuauacaugaauguauuauacacacacacuuuagaga

SEQ ID NO: 281427 - RNA, 64 nt, hsa
auaaauuaucugaauauuagaugcucugagaaauugaauguaccuuauuuaaaagauuuuaugg

SEQ ID NO: 281428 - RNA, 64 nt, hsa; identical to SEQ ID NO: 117746

SEQ ID NO: 281429 - RNA, 64 nt, hsa; identical to SEQ ID NO: 117747

SEQ ID NO: 281430 - RNA, 64 nt, hsa
gcuauuucaaaggaaccagccaacguaugagaaaugaauguaacacuguggacauugacuuccc

SEQ ID NO: 281431 - RNA, 64 nt, hsa
agcugcuaauuguuccuguuggggugacagauacugaauguauacguauugugccugagcucac

SEQ ID NO: 281432 - RNA, 64 nt, hsa
gucuuuuauuuguacccaugugucugucacaccaugaauguaccuggggaaaucaacugaccuc

SEQ ID NO: 281433 - RNA, 64 nt, hsa
uaauuguugacuuucuuagauucacuuccauaugugaauguaagcucuuaacuaugucucuuug

SEQ ID NO: 281434 - RNA, 64 nt, hsa
aaaaugagaugcacucauuuaaaucugcauucagugaauguauugggagaaaaauaggucuugc

SEQ ID NO: 281435 - RNA, 64 nt, hsa
uuaauauuaauggacuguuucagguaaaagagaaugaauguaugauugugaacugugaagagaa

SEQ ID NO: 281436 - RNA, 64 nt, hsa
ccgccaguucucaaguuuuccuccuaacuccauuugaauguaagggcagcuggcccccaaugug

SEQ ID NO: 281437 - RNA, 64 nt, hsa
uucugaaccacuagaguuuccuugauucagacuuugaauguacuguucuauaguuuuucaggau

SEQ ID NO: 281438 - RNA, 64 nt, hsa
auuuggcaggugaguggauggauagauggauaggugaauguagguggacaggugacugggugga

SEQ ID NO: 281439 - RNA, 64 nt, hsa
uuuauguaauaucauguguaccuuuacauuguggugaauguaacaauauauguucuucauauuu

SEQ ID NO: 281440 - RNA, 64 nt, hsa
cauucaguggccuaucuccagauugucugauuucugaauguaaaguuguuguguuuuuuuuuaa

SEQ ID NO: 281441 - RNA, 64 nt, hsa
accucccccauuuaaauacucagaagauaaggugugaauguauguauuauuagaguccgaaagu

SEQ ID NO: 281442 - RNA, 64 nt, hsa
uaucagagauacacaaaaaaccaauugaggguagugaauguaagaagacagucccagaaguaaa

SEQ ID NO: 281443 - RNA, 64 nt, hsa
uuaacaauucuccuuaaaagauauuuuggagugaugaauguaguuuacuuuuguauuugaauuu

SEQ ID NO: 281444 - RNA, 64 nt, hsa
cucauuuuucuauauauuuauuucacgacagaguugaauguauggccuucaacaugaugcacau

SEQ ID NO: 281445 - RNA, 64 nt, hsa
ccuuaguaccaaauacacucaauugccuuuuuaaugaauguacuugucuuggauagguugcugg

SEQ ID NO: 281446 - RNA, 64 nt, hsa
agugaguuuaacaaagaaacauuuagaauagaucugaauguaagaacuacagaacuguuucaga

SEQ ID NO: 281447 - RNA, 64 nt, hsa
cuuuuuuuuuuuaacacacuaaucuucaguuggaugaauguaauguauaacuauguuuucagca

SEQ ID NO: 281448 - RNA, 64 nt, hsa
uaaccuauuguuagaaaauauguguuuuuauaaaugaauguaaaauaauuaaaugaauugugaa

SEQ ID NO: 281449 - RNA, 64 nt, hsa
caaaggagcugaauguguuaugcuuccaaacaacugaauguaaaacacuccuagccaguuguug

SEQ ID NO: 281450 - RNA, 64 nt, hsa
cugaccuguuguaggcagcuaucuuacagacgcaugaauguaagaguaggaagggguggguguc

SEQ ID NO: 281451 - RNA, 64 nt, hsa
uucuacccucuuuuuccugcuaauccugucauaaugaauguagcuucucaguucacuguauaug

SEQ ID NO: 281452 - RNA, 64 nt, hsa
acuaacgacuucagggcagggcucugauauuccaugaauguaucaggaaauauauaugugugug

SEQ ID NO: 281453 - RNA, 57 nt, hsa; identical to SEQ ID NO: 227376

SEQ ID NO: 281454 - RNA, 64 nt, hsa
uaugcucuggcaucuaacauaugauucuguaguaugaauguaaucaguguauguuaguacaaau

SEQ ID NO: 281455 - RNA, 64 nt, hsa
aauuuucaguauuuuaacuaccucaauaaugcuaugaauguaagauauugggauagagauccca

SEQ ID NO: 281456 - RNA, 64 nt, hsa; identical to SEQ ID NO: 117748

SEQ ID NO: 281457 - RNA, 64 nt, hsa; identical to SEQ ID NO: 117749

SEQ ID NO: 281458 - RNA, 64 nt, hsa
ccuucacccaaccucucccaccuccaccccacaaugaauguauuuauugugagaauggcuacac

SEQ ID NO: 281459 - RNA, 64 nt, hsa
cuguccagcacagcuucuggcacaggaugcuuggugaauguacccuuucuuucccucccugcag

SEQ ID NO: 281460 - RNA, 64 nt, hsa
cugacggggaaaaaaaaaaaaaaagaauggggugugaauguaccaacacugaaucuuacagcag

SEQ ID NO: 281461 - RNA, 64 nt, hsa
cuauuaccaauuuuucagaacucauagauaaauaugaauguagggaagcuguaagccagcccau

SEQ ID NO: 281462 - RNA, 64 nt, hsa
acaugcuuuaagauuucuauccaucuuucagaguugaauguaauaauguuugguauuuaauucu

SEQ ID NO: 281463 - RNA, 64 nt, hsa
gggcaguuuggugcaauuuauguuaaaugccauuugaauguaaucaccuguguuaccacgaaug

SEQ ID NO: 281464 - RNA, 64 nt, hsa
ucuguggguuugggugggaagagggccaucugccugaauguaaccugcuagcucuccgaaggcc

SEQ ID NO: 281465 - RNA, 64 nt, hsa
ugaugccaguaaucuauaagggaucuuuauaguuugaauguauuugaauaacuucaguauacuu

SEQ ID NO: 281466 - RNA, 64 nt, hsa
agauccauuuugugccacacuccauuguagacuuugaauguaguagucuuuccaagagccuacu

SEQ ID NO: 281467 - RNA, 64 nt, hsa
aggguaaauggagaaaauauuucugggauuacaaugaauguaagcccaaauuguggaauugcca

SEQ ID NO: 281468 - RNA, 64 nt, hsa
guucugcauugagccuaguuuugccauuguccccugaauguaguauuaucuauagauuauacau

SEQ ID NO: 281469 - RNA, 64 nt, hsa
aguaugggaauuauuuuuuauguuaaauagaaacugaauguacuggguugaaugguguccucuc

SEQ ID NO: 281470 - RNA, 64 nt, hsa
gcauggagugaccauagcuccuucucucuuacauugaauguagagaauguagccauuguagcag

SEQ ID NO: 281471 - RNA, 64 nt, hsa
aaaauccuuuuauggaaaccauuuuuuuaaaaagugaauguacacaaauccacagaggacugug

SEQ ID NO: 281472 - RNA, 64 nt, hsa
aucauguucuuauaccuaauuuuagucuuucaaaugaauguacuguaaugcuuguauguauaaa

SEQ ID NO: 281473 - RNA, 64 nt, hsa
ccccuucaggaaggaccccccaaagcugaggggcugaauguagccuuuucaacagagaaggcuc

SEQ ID NO: 281474 - RNA, 64 nt, hsa
ucucaucguaaggcagcuaguucuaauuugcauuugaauguauaacaaauugcaucacuuuuca

SEQ ID NO: 281475 - RNA, 64 nt, hsa
uagaguugucuuucagcauucaaucaggcugagcugaauguagugauguuuacauuguuuacau

SEQ ID NO: 281476 - RNA, 64 nt, hsa
uucaucucuuuagagaaguccaagcaacagccuuugaauguaaccaauccuacuaauaaaccag

SEQ ID NO: 281477 - RNA, 64 nt, hsa
aaaggauggucacucuuccgaggucucccugaaaugaauguauuucucccccaaaagagcugau

SEQ ID NO: 281478 - RNA, 64 nt, hsa
cagaugcagaagguuucucuggauagcacaccucugaauguaaaucaugauaaaauggauauuu

SEQ ID NO: 281479 - RNA, 64 nt, hsa
auuuuuuaaugugcucuguaccugucaaaaauuuugaauguacaccacaugcuauugucugaac

SEQ ID NO: 281480 - RNA, 64 nt, hsa
ugaaagaugcuaaucuauuugccaaacuuggucuugaauguacugggggcuucaagguaugggu

SEQ ID NO: 281481 - RNA, 64 nt, hsa
ccaacuggggcuccuggggguacaggaauccuuaugaauguauagaaugcauacugccuaggcc

SEQ ID NO: 281482 - RNA, 64 nt, hsa
uguuccaaaacaaaauucaccuccuuucuuuaugugaauguauucuccauaaaauuccaguauu

SEQ ID NO: 281483 - RNA, 64 nt, hsa
caggccucgggaccaacucuuuguauaaccuaccugaauguauuaaaaacuaauuuuggagaag

SEQ ID NO: 281484 - RNA, 64 nt, hsa
ucuuuucccagaagagucuuugauucaccaaacaugaauguacauuuucuaacaaacucaaaau

SEQ ID NO: 281485 - RNA, 64 nt, hsa
ugugugacuuugagcaaaaagugacuucuuuuugugaauguaaaauuugugaaacuugaguuuu

SEQ ID NO: 281486 - RNA, 64 nt, hsa
gagcauuuacagaugaauccccacacuuagccauugaauguaaaggggaaaaauaaggugagaa

SEQ ID NO: 281487 - RNA, 64 nt, hsa
uaguauaauuuguuacuuucaaauacccguacuuugaauguagguuuuuuuguuguuguuaucu

SEQ ID NO: 281488 - RNA, 64 nt, hsa
uuguauuguaguaaccaauaugugcaguauacguugaauguauaugaacauacuuuccuauuuc

SEQ ID NO: 281489 - RNA, 64 nt, hsa
ucccaagauccuggggaaaggagagaccauggugugaauguagagaugccaccucccucucucu

SEQ ID NO: 281490 - RNA, 64 nt, hsa
ucauuauuuauuuuuuuguaguaguaaugucauaugaauguaucuuaaaacgugugcccuuuua

SEQ ID NO: 281491 - RNA, 64 nt, hsa
cuuucuaggcuuggagauggcuuugguugguccgugaauguaguuaugagagugcugccauuaa

SEQ ID NO: 281492 - RNA, 64 nt, hsa
uaauguugagcuaagaagcauuaagucuuugaacugaauguauuuugcaucccugguuuuggac

SEQ ID NO: 281493 - RNA, 64 nt, hsa
gugucugccccgcguuuccugccugcggaccagaugaauguagcagauccccagccucuggccu

SEQ ID NO: 281494 - RNA, 64 nt, hsa
ugauacuaguaauucauaagggaucuguguaaucugaauguauuugaauaacuuuagcucuacu

SEQ ID NO: 281495 - RNA, 64 nt, hsa
uuucaggucauuuccugauagucuagucagcuuaugaauguaagcaaaacaggaccaaugaaag

SEQ ID NO: 281496 - RNA, 64 nt, hsa
aaagacugaggcauuuuccagucuacuugccuaaugaauguauaggaacugucuaugaguaugg

SEQ ID NO: 281497 - RNA, 64 nt, hsa
cacagcucaggaaaaagaugaggcauaacgaccuugaauguaauuggaguaagugacaaaauaa

SEQ ID NO: 281498 - RNA, 64 nt, hsa
aagaaaaaaauuugccuuuaagaguuacuuuuguugaauguauuugacuuaguucuuauuuuaa

SEQ ID NO: 281499 - RNA, 64 nt, hsa
ucuucucuucauuaccuuuuaaggacagugucuuugaauguagggcccacccugaucuagggug

SEQ ID NO: 281500 - RNA, 64 nt, hsa; identical to SEQ ID NO: 117750

SEQ ID NO: 281501 - RNA, 64 nt, hsa; identical to SEQ ID NO: 117751

SEQ ID NO: 281502 - RNA, 64 nt, hsa; identical to SEQ ID NO: 117752

SEQ ID NO: 281503 - RNA, 64 nt, hsa; identical to SEQ ID NO: 117753

SEQ ID NO: 281504 - RNA, 64 nt, hsa
uuagugacccccaucuuguaaccuguugcaagagugaauguaaaaaauaguuguggcauuuuaa

SEQ ID NO: 281505 - RNA, 64 nt, hsa
uugaacacacuaugaagaauuccagguguacuagugaauguaauuuauaguugccaaaaaaaaa

SEQ ID NO: 281506 - RNA, 64 nt, hsa
uacccucauauucuuuaaaaaacuuaaagcauuaugaauguagagaaauucaccagagcucacu

SEQ ID NO: 281507 - RNA, 57 nt, hsa; identical to SEQ ID NO: 227430

SEQ ID NO: 281508 - RNA, 64 nt, hsa
gguuuuuuaguugaauuuuuuuuaacauuccucaugaauguaaauuuguacuauuuaacugacu

SEQ ID NO: 281509 - RNA, 64 nt, hsa
gauuugggcugccccaggcccacccagggggcucugaauguauuuuguaccguguuucuuuccc

SEQ ID NO: 281510 - RNA, 64 nt, hsa
ccacugcucugaugggugguuuguccaaggaugcugaauguaaugccuggucaauguggaagcc

SEQ ID NO: 281511 - RNA, 64 nt, hsa
gcccuugaggagcacaggcagaagugugaacuugugaauguaauugaucuuuccuuccuuccag

SEQ ID NO: 281512 - RNA, 64 nt, hsa
aucguuaacggguaccauuaaauauucugagaggugaauguaaaauauaaaagguauagguuuu

SEQ ID NO: 281513 - RNA, 64 nt, hsa
auuagucauguauauuuuaaaugcuaacauuugaugaauguaaguuuccacauuguugcuguuu

SEQ ID NO: 281514 - RNA, 64 nt, hsa
acauauuuuucacuugaauuuuuuuggaaauagcugaauguaaauagcagggaggaagaagcaa

SEQ ID NO: 281515 - RNA, 64 nt, hsa; identical to SEQ ID NO: 117754

SEQ ID NO: 281516 - RNA, 64 nt, hsa; identical to SEQ ID NO: 117755

SEQ ID NO: 281517 - RNA, 64 nt, hsa; identical to SEQ ID NO: 117756

SEQ ID NO: 281518 - RNA, 64 nt, hsa; identical to SEQ ID NO: 117757

SEQ ID NO: 281519 - RNA, 64 nt, hsa
cuauuggaaggaguuagauguugguacuagauacugaauguaaacaaaggaauuauggcuggua

SEQ ID NO: 281520 - RNA, 64 nt, hsa
uuguuaaacauuuagacaaacauauauguauguaugaauguacauaaauauuuuuaacuccuau

SEQ ID NO: 281521 - RNA, 64 nt, hsa
cuaggcaucauguccuauaguuugucaucccugaugaauguaaaguuacacuguucacaaaggu

SEQ ID NO: 281522 - RNA, 64 nt, hsa
ugaccugguuaccuuggaaaugcaggaacuuauaugaauguacuauaaaauaaaaugcggacug

SEQ ID NO: 281523 - RNA, 64 nt, hsa
uauaaauugugauguagccucgcuagucaagcugugaauguauauuguuugcacuuaauccuua

SEQ ID NO: 281524 - RNA, 64 nt, hsa
ccuaaaaugugaaagcauauuuuguauccuaaaaugaauguaugauauucuaaacaucuguuuu

SEQ ID NO: 281525 - RNA, 64 nt, hsa
aguuuuuuuuuaaaugcuuguucuaagacauuucugaauguagaccauuuuccaaaaaggaaac

SEQ ID NO: 281526 - RNA, 64 nt, hsa; identical to SEQ ID NO: 117758

SEQ ID NO: 281527 - RNA, 64 nt, hsa; identical to SEQ ID NO: 117759

SEQ ID NO: 281528 - RNA, 64 nt, hsa
guagggcauuuucugauugcacuuccuuaaguuaugaauguacuagaaagggacucauccagaa

SEQ ID NO: 281529 - RNA, 64 nt, hsa
caguuuucuuuuuuauuuugguuaugcuuaaauaugaauguaauuaccaaaagauuuagaagug

SEQ ID NO: 281530 - RNA, 64 nt, hsa
uacauuugaguaugguaacuuaugucaucuauguugaauguaagcuuauaaagcacaaagcaua

SEQ ID NO: 281531 - RNA, 64 nt, hsa
gugggaagguuuugcugcuaauguauuuauggaaugaauguauuucauucaaaucuguauuccu

SEQ ID NO: 281532 - RNA, 64 nt, hsa
aucucccuucacaaguuuuuuuacuguuuuuagaugaauguacgaugagaaauucaacguuaau

SEQ ID NO: 281533 - RNA, 64 nt, hsa
aauacaaccucagugugucauugggcaguuuaaaugaauguacauuccugaggcaucagaacuu

SEQ ID NO: 281534 - RNA, 64 nt, hsa
guuaggagacuaaaauauaaauuaaguugugauuugaauguagauugguaucaccuccaacucc

SEQ ID NO: 281535 - RNA, 64 nt, hsa
guaagaaacuguccgauaugaaucacaacgugggugaauguaguauuuuccugaagugugaaag

SEQ ID NO: 281536 - RNA, 64 nt, hsa
auauuagugauugaaguauuuugacuuuugagauugaauguaaaauauuuuaaauuugggauca

SEQ ID NO: 281537 - RNA, 64 nt, hsa
gcacacacauacacaccaccaccaacaacgcuugugaauguauuuuucuguuagcuggguuuac

SEQ ID NO: 281538 - RNA, 64 nt, hsa
aguguucauugcacaauauauuuuuacugcuuucugaauguagacggaacaguguggaagcaga

SEQ ID NO: 281539 - RNA, 64 nt, hsa
guuuagagagccugucaccagagcuucucugggcugaauguaugucagugcuauaaaugccaga

SEQ ID NO: 281540 - RNA, 64 nt, hsa
cagaauuaaauuuguauagagcagaguuuuaaaaugaauguaaauagcacuaaacguuuucuuu

SEQ ID NO: 281541 - RNA, 64 nt, hsa
caagucugagucccaguuacuugggaggaucacuugaauguaggaucacuugagucuaggaguu

SEQ ID NO: 281542 - RNA, 64 nt, hsa
gcaucuuuguauauugcaauauacuugaaaaaaaugaauguauuuuuuucuccaaagaacagca

SEQ ID NO: 281543 - RNA, 64 nt, hsa; identical to SEQ ID NO: 117760

SEQ ID NO: 281544 - RNA, 64 nt, hsa; identical to SEQ ID NO: 117761

SEQ ID NO: 281545 - RNA, 64 nt, hsa
uauuaugucuuuauuguuguuaaaaaguuuuuauugaauguaugaaaauuaucaaauuguauuc

SEQ ID NO: 281546 - RNA, 64 nt, hsa
acaauagcccaaagccaagaaagaaaaauuaucuugaauguaguauucaaugauuuuuuaugau

SEQ ID NO: 281547 - RNA, 64 nt, hsa
cuuuagaacagaggauuguauugcaagacaaaguugaauguaaagugaucucccugaacauuuu

SEQ ID NO: 281548 - RNA, 64 nt, hsa
uugacauggaugauucugaggaggaagcuguuauugaauguauagagauuuauccaaauaaaua

SEQ ID NO: 281549 - RNA, 64 nt, hsa
uuguauugaaaugaaaccaccaguguuaucaacuugaauguaaauguacaugugcagauauucc

SEQ ID NO: 281550 - RNA, 64 nt, hsa
uagaccugaccuuguuauuuauuagauaacauuuugaauguauccauuggauuucuaaaaugua

SEQ ID NO: 281551 - RNA, 64 nt, hsa
aucacaguauuguuaggagauuuaaaugaauuagugaauguaagauacuuuagaaagcauguaa

SEQ ID NO: 281552 - RNA, 64 nt, hsa
uggccuaagaaauaaggaucaauaaggaaugauuugaauguaauuuugugaauguguggaaaau

SEQ ID NO: 281553 - RNA, 64 nt, hsa
ccauuccuacuguauuucuguaugaauguguuugugaauguauguguaaaagucuuucuuuucc

SEQ ID NO: 281554 - RNA, 64 nt, hsa
gaugcacuuugaauauugagauauuuugcacggaugaauguaugggaacuacccaugaugaugu

SEQ ID NO: 281555 - RNA, 64 nt, hsa
aaauuccuguacauagagauauauuuuuuaagugugaauguaacaacauacugugaauuccauc

SEQ ID NO: 281556 - RNA, 64 nt, hsa
augacgcgccaggcacaguucugcaaguauauugugaauguauuguucuagugggauacacaaa

SEQ ID NO: 281557 - RNA, 64 nt, hsa; identical to SEQ ID NO: 117762

SEQ ID NO: 281558 - RNA, 64 nt, hsa; identical to SEQ ID NO: 117763

SEQ ID NO: 281559 - RNA, 64 nt, hsa
aaaaaaaaacaugcaccuguuucacugugaauagugaauguaaaggaaagaaaggaaaaacuga

SEQ ID NO: 281560 - RNA, 64 nt, hsa
uaaauuuguauuuauguguauauaaaauguacaaugaauguaaauaugacuuucuggaaaguuu

SEQ ID NO: 281561 - RNA, 64 nt, hsa
uuuuuccccucacauugaauuuuaauuccauucuugaauguagaaauuucagauucucuaaaac

SEQ ID NO: 281562 - RNA, 64 nt, hsa
uaauguaaacagaacuggcacacacacauuaagaugaauguaauuauuauuccucuugcugguc

SEQ ID NO: 281563 - RNA, 64 nt, hsa
ucuacucuucuaagcuuacagagaccagaccaggugaauguaacuggggaaaaucaagauggua

SEQ ID NO: 281564 - RNA, 64 nt, hsa
uucacucagagaagcaaggcugauauuagcuuguugaauguaagagacacaaaugaagaagaac

SEQ ID NO: 281565 - RNA, 64 nt, hsa
augucagguuauacuaaaacuaaaucagaaagucugaauguagcacauaaugguucucuucugu

SEQ ID NO: 281566 - RNA, 64 nt, hsa
gcagugagcaucacuacagucucagucaacagugugaauguaucauguuuuacuuuaaaugugu

SEQ ID NO: 281567 - RNA, 64 nt, hsa
uccuugugacuucaacggacucuuccaaauuguaugaauguaucaauguauuagauaaacccag

SEQ ID NO: 281568 - RNA, 64 nt, hsa; identical to SEQ ID NO: 117764

SEQ ID NO: 281569 - RNA, 64 nt, hsa; identical to SEQ ID NO: 117765

SEQ ID NO: 281570 - RNA, 64 nt, hsa
uuaaaaaguuucaaaucuagacacuaaaugugugugaauguacaaagaaaacaaaccauugcuu

SEQ ID NO: 281571 - RNA, 64 nt, hsa
cggggcagcguggccccaccggacuagcacaugaugaauguaaaguuggcacaaugaaaaugac

SEQ ID NO: 281572 - RNA, 64 nt, hsa
aaugcccuuuagggcacaacuaguuaucaguaacugaauguaucuuaaucauuauggcugcuuc

SEQ ID NO: 281573 - RNA, 58 nt, hsa; identical to SEQ ID NO: 227496

SEQ ID NO: 281574 - RNA, 64 nt, hsa; identical to SEQ ID NO: 281567

SEQ ID NO: 281575 - RNA, 64 nt, hsa
auauauaaaaaucuugagaugguagaaacauguaugaauguacuaaguaguauuccacuguacu

SEQ ID NO: 281576 - RNA, 64 nt, hsa
gguaacaaauuuggggaagacagcacaaucuucuugaauguagcucuugggaaugcauuauuac

SEQ ID NO: 281577 - RNA, 64 nt, hsa
cauccucucccauaagcacccaugucuuugaauaugaauguauuuguaaaauaccacguuucau

SEQ ID NO: 281578 - RNA, 64 nt, hsa
uccuccucuccccaccuuugccauucuuaaguauugaauguacuuuguauaauuuuaguggaau

SEQ ID NO: 281579 - RNA, 64 nt, hsa
cauugacauucauuccuauuuuacugggcaccuaugaauguaugcugugugcuagaaauagacu

SEQ ID NO: 281580 - RNA, 64 nt, hsa
gggguucucaauggaaaaacgaaugcucuuacacugaauguacaggcagugggcuugcagcacu

SEQ ID NO: 281581 - RNA, 64 nt, hsa
uuguuugaauuaauuguauuguaauauuauuuguugaauguaguaauuagguauuuaugaauau

SEQ ID NO: 281582 - RNA, 64 nt, hsa
gguuacuaaccuugaaauguaagagaucugguuuugaauguaaaaguugcaacacacaaacgga

SEQ ID NO: 281583 - RNA, 64 nt, hsa; identical to SEQ ID NO: 117766

SEQ ID NO: 281584 - RNA, 64 nt, hsa; identical to SEQ ID NO: 117767

SEQ ID NO: 281585 - RNA, 64 nt, hsa
acauaaauucuacuuuauuccucaacuucuuugaugaauguaacccaauuuuacuucuuuaaaa

SEQ ID NO: 281586 - RNA, 64 nt, hsa
ggagagagccgcgggguccugcccgugguuacuaugaauguauugcuguuggaggacaucucga

SEQ ID NO: 281587 - RNA, 64 nt, hsa
gccagaggccugaagcugagcguguacguuaaugugaauguauauagucuuugcagagguccaa

SEQ ID NO: 281588 - RNA, 64 nt, hsa
ccgcugugugucuuagcauggaaauaaauaaaccugaauguacgugcucgccucuggccugugu

SEQ ID NO: 281589 - RNA, 64 nt, hsa
uuuauuugcacgucaggggagccggcuccccccuugaauguaccagacccuggggggggucacu

SEQ ID NO: 281590 - RNA, 64 nt, hsa
cuuucuggauuucucuugaagugcuacacugcacugaauguaaggaauuguugcuuguggaagu

SEQ ID NO: 281591 - RNA, 64 nt, hsa
ugucagacuuccaaauccuggaaggacacagugaugaauguacuaugucugaacauagaaacuc

SEQ ID NO: 281592 - RNA, 64 nt, hsa
uuucuaauuaggcauuuuauguuagucacagucuugaauguauaaacagcacuaagacucucag

SEQ ID NO: 281593 - RNA, 64 nt, hsa
acaagacuuucccagcuuguauuaccuagaagcgugaauguauaggauaccugacuacuaagac

SEQ ID NO: 281594 - RNA, 64 nt, hsa
uugauguuuuaacucuaucugucauacauccuagugaauguaaaaugcaaaauccuggugaugu

SEQ ID NO: 281595 - RNA, 64 nt, hsa; identical to SEQ ID NO: 117768

SEQ ID NO: 281596 - RNA, 64 nt, hsa; identical to SEQ ID NO: 117769

SEQ ID NO: 281597 - RNA, 64 nt, hsa
ggagucuucuuucaaaccaguggggguuggacaaugaauguaguuaacugguuccugcucacac

SEQ ID NO: 281598 - RNA, 64 nt, hsa
ucaaggcgccuuuccuaauaauaugguucaacugugaauguagaagugggggggaggggggaga

SEQ ID NO: 281599 - RNA, 64 nt, hsa
agagacccugcaagaccacggagggagcgacacuugaauguagaauaggcagggggcccugccc

SEQ ID NO: 281600 - RNA, 64 nt, hsa; identical to SEQ ID NO: 117770

SEQ ID NO: 281601 - RNA, 64 nt, hsa; identical to SEQ ID NO: 117771

SEQ ID NO: 281602 - RNA, 64 nt, hsa
cguaugugcucuuauaaaguggacuucugaaaaaugaauguaaaagacacugguguaucucaga

SEQ ID NO: 281603 - RNA, 64 nt, hsa
uuuaguugacuguauuauuugauuucggauugaaugaauguaaauagaaauuaaaugcaaauuu

SEQ ID NO: 281604 - RNA, 64 nt, hsa
gguucaucuguccaugcaguccucuuggauucucugaauguaguaacuaugaagcuaugccaaa

SEQ ID NO: 281605 - RNA, 64 nt, hsa
aaagccuucguuguauguugacgaugcacuuuuaugaauguaguuucuaucgcuguuuuuagcc

SEQ ID NO: 281606 - RNA, 64 nt, hsa
gauuucaaauccaggggauuccaugcucaauggaugaauguagacacaaaacagcaacacuugu

SEQ ID NO: 281607 - RNA, 64 nt, hsa
ugucacugaggguuuugguuggcaucguuguuuuugaauguagcacaagcgaugagcaaacucu

SEQ ID NO: 281608 - RNA, 64 nt, hsa
cugacuugccuuauuuauuuguucgacgcgucucugaauguauccgccucgguucccaccacug

SEQ ID NO: 281609 - RNA, 64 nt, hsa
gucuuggccacagccugagugacgaauuuccuacugaauguaccaaguuccaauuuuuaagggg

SEQ ID NO: 281610 - RNA, 64 nt, hsa
auuucaacccaggugccccuggccuggccagcagugaauguaggagaugaauugugcaagugac

SEQ ID NO: 281611 - RNA, 64 nt, hsa
ccuauguagcaacagugguuagaugaucuuugucugaauguaauuaaacuuugaauaguuuuag

SEQ ID NO: 281612 - RNA, 64 nt, hsa
aucaggacucagaccccaggccgagaucuugcccugaauguacccugccucugcuuucuccugc

SEQ ID NO: 281613 - RNA, 64 nt, hsa
cuuccacacagggugcaugugaggaugaaaggagugaauguauaaagacaccuuucccgauaac

SEQ ID NO: 281614 - RNA, 64 nt, hsa
gagaacagcaguuuauuacucacuaaagacagaaugaauguagaaaaggcugaauucuguaaua

SEQ ID NO: 281615 - RNA, 64 nt, hsa
cuuguuuauccaacuaaguguccaaaaccuaaauugaauguacuaaguuuucacaugucccauu

SEQ ID NO: 281616 - RNA, 64 nt, hsa
ugucuaaacuauaagcuuccaacuauuaccugcuugaauguaaauauuaaauggagauguugaa

SEQ ID NO: 281617 - RNA, 64 nt, hsa
auagcauuuuucaacauuuaauggucuguacaguugaauguaaguguucaauauguauugcuga

SEQ ID NO: 281618 - RNA, 64 nt, hsa
ucauuugcauaagauuuaacagcauuuuuuauaaugaauguaaacauuuuaacuuaaugguacu

SEQ ID NO: 281619 - RNA, 64 nt, hsa
uccauuacacgaucaccugcaucacagcccauggugaauguauguuucugcauagcgaaauaaa

SEQ ID NO: 281620 - RNA, 64 nt, hsa
uccugaguggaugacaggucuucauucucuaucuugaauguauuaugguuacuaauaguuuuau

SEQ ID NO: 281621 - RNA, 64 nt, hsa
agaaauuuuaaaauaauagaagaaauagaaauuuugaauguauaaaagaaaaagaucaaguugu

SEQ ID NO: 281622 - RNA, 64 nt, hsa
augcugauaaauguaagauuaguaggaggagaagugaauguaaauuuuauuauagaauuuucug

SEQ ID NO: 281623 - RNA, 64 nt, hsa
auuuuccuuauuguuaaaaacauguuagaagcaaugaauguauauaaaagccucaacuagucau

SEQ ID NO: 281624 - RNA, 64 nt, hsa
ucccucuguaauuucaaaaugaaugaaauucaugugaauguagguugagagggcacugaagacc

SEQ ID NO: 281625 - RNA, 64 nt, hsa
cacaaacaaacaaaggaggggggagcagguuuuaugaauguaacugugcacaggaaaugacugg

SEQ ID NO: 281626 - RNA, 64 nt, hsa
gcgcgggggggaggcuggggucccgccgccgugaugaauguacugacgagccgaggcagcagug

SEQ ID NO: 281627 - RNA, 64 nt, hsa; identical to SEQ ID NO: 117772

SEQ ID NO: 281628 - RNA, 64 nt, hsa; identical to SEQ ID NO: 117773

SEQ ID NO: 281629 - RNA, 64 nt, hsa
ucugggucauucaggcaguacaucugaauuaagcugaauguagacaaauaaagaaaaacaaaac

SEQ ID NO: 281630 - RNA, 64 nt, hsa
ggcccccuccccaccaaaggguucaccucacacuugaauguacaacccaccccacugucgggaa

SEQ ID NO: 281631 - RNA, 64 nt, hsa
uacaugaaagauuucaaacugcagagaaccacuaugaauguaaacaaugugguaaagcauuuag

SEQ ID NO: 281632 - RNA, 64 nt, hsa; identical to SEQ ID NO: 117774

SEQ ID NO: 281633 - RNA, 64 nt, hsa; identical to SEQ ID NO: 117775

SEQ ID NO: 281634 - RNA, 64 nt, hsa; identical to SEQ ID NO: 117776

SEQ ID NO: 281635 - RNA, 64 nt, hsa; identical to SEQ ID NO: 117777

SEQ ID NO: 281636 - RNA, 64 nt, hsa; identical to SEQ ID NO: 117778

SEQ ID NO: 281637 - RNA, 64 nt, hsa; identical to SEQ ID NO: 117779

SEQ ID NO: 281638 - RNA, 64 nt, hsa; identical to SEQ ID NO: 117780

SEQ ID NO: 281639 - RNA, 64 nt, hsa; identical to SEQ ID NO: 117781

SEQ ID NO: 281640 - RNA, 64 nt, hsa; identical to SEQ ID NO: 117782

SEQ ID NO: 281641 - RNA, 64 nt, hsa; identical to SEQ ID NO: 117783

SEQ ID NO: 281642 - RNA, 64 nt, hsa; identical to SEQ ID NO: 117784

SEQ ID NO: 281643 - RNA, 64 nt, hsa
gauacauuaaaauacucacugaagagaagcccuaugaauguaaguaacgugggaaagcaugaaa

SEQ ID NO: 281644 - RNA, 64 nt, hsa
uguucuggggcuuguccuuccuuugcagcuguuuugaauguaguuuuccuuuucuauuuauuug

SEQ ID NO: 281645 - RNA, 64 nt, hsa; identical to SEQ ID NO: 117785

SEQ ID NO: 281646 - RNA, 64 nt, hsa; identical to SEQ ID NO: 117786

SEQ ID NO: 281647 - RNA, 64 nt, hsa
aacucaaucaauguuauugugaaaacugggaaugugaauguaauauauguagaaaaacauuuag

SEQ ID NO: 281648 - RNA, 59 nt, hsa; identical to SEQ ID NO: 58889

SEQ ID NO: 281649 - RNA, 64 nt, hsa; identical to SEQ ID NO: 117788

SEQ ID NO: 281650 - RNA, 64 nt, hsa; identical to SEQ ID NO: 117789

SEQ ID NO: 281651 - RNA, 64 nt, hsa
aaggccugcccaccaccgcccgccugggcagccaugaauguagcgccccaggcccugccccagc

SEQ ID NO: 281652 - RNA, 64 nt, hsa
gcauauaaugagaugcuugaugaauggugcauauugaauguauaaagcccaccgguccugagag

SEQ ID NO: 281653 - RNA, 64 nt, hsa
ucuugcuucuucuaccuuuauuuauucucagcucugaauguaugaaccugcucaaucaccucau

SEQ ID NO: 281654 - RNA, 64 nt, hsa
aaguuaguuuuguggcuuuccaucugacccuaugugaauguaaggugaugugaccuuguuggug

SEQ ID NO: 281655 - RNA, 64 nt, hsa
uaguucacacuggaaaaaggccacguaugugccuugaauguagccaaaaugacgaacaacaccc

SEQ ID NO: 281656 - RNA, 64 nt, hsa
agcaucagagaguucacacuagagaaaggccuuaugaauguagugaaugugggaaauccuuuag

SEQ ID NO: 281657 - RNA, 64 nt, hsa
ggcugguggcauggccccccugccccgugcugaaugaauguacagagccagacaaagcugugaa

SEQ ID NO: 281658 - RNA, 64 nt, hsa; identical to SEQ ID NO: 117790

SEQ ID NO: 281659 - RNA, 64 nt, hsa; identical to SEQ ID NO: 117791

SEQ ID NO: 281660 - RNA, 60 nt, hsa; identical to SEQ ID NO: 227583

SEQ ID NO: 281661 - RNA, 64 nt, hsa
ugcaugaaagaauucacacuggggagaaauacuaugaauguaaggauaugaguguuguuaccau

SEQ ID NO: 281662 - RNA, 64 nt, hsa
cacacgaauccauccaccuguccacgugcacacgugaauguagcgauagauauuuggacaucaa

SEQ ID NO: 281663 - RNA, 64 nt, hsa; identical to SEQ ID NO: 117792

SEQ ID NO: 281664 - RNA, 64 nt, hsa; identical to SEQ ID NO: 117793

SEQ ID NO: 281665 - RNA, 64 nt, hsa; identical to SEQ ID NO: 117794

SEQ ID NO: 281666 - RNA, 64 nt, hsa; identical to SEQ ID NO: 117795

SEQ ID NO: 281667 - RNA, 64 nt, hsa; identical to SEQ ID NO: 117796

SEQ ID NO: 281668 - RNA, 64 nt, hsa; identical to SEQ ID NO: 117797

SEQ ID NO: 281669 - RNA, 64 nt, hsa; identical to SEQ ID NO: 117798

SEQ ID NO: 281670 - RNA, 64 nt, hsa; identical to SEQ ID NO: 117799

SEQ ID NO: 281671 - RNA, 64 nt, hsa; identical to SEQ ID NO: 117800

SEQ ID NO: 281672 - RNA, 64 nt, hsa; identical to SEQ ID NO: 117801

SEQ ID NO: 281673 - RNA, 64 nt, hsa; identical to SEQ ID NO: 117802

SEQ ID NO: 281674 - RNA, 64 nt, hsa; identical to SEQ ID NO: 117803

SEQ ID NO: 281675 - RNA, 64 nt, hsa; identical to SEQ ID NO: 117804

SEQ ID NO: 281676 - RNA, 64 nt, hsa; identical to SEQ ID NO: 117805

SEQ ID NO: 281677 - RNA, 64 nt, hsa; identical to SEQ ID NO: 117806

SEQ ID NO: 281678 - RNA, 64 nt, hsa
auacuuguacgaaacacauuggagauagacccugugaauguaagcacuugguaaagccuuaagu

SEQ ID NO: 281679 - RNA, 64 nt, hsa
ccccacagcaguaucagaaacuucugacaaucagugaauguacaacccagccgaggggacggug

SEQ ID NO: 281680 - RNA, 64 nt, hsa
agcacgaaagaauucccacuggugagaaacaguaugaauguaaacauugugauuaagccuucag

SEQ ID NO: 281681 - RNA, 64 nt, hsa; identical to SEQ ID NO: 117807

SEQ ID NO: 281682 - RNA, 64 nt, hsa; identical to SEQ ID NO: 117808

SEQ ID NO: 281683 - RNA, 64 nt, hsa
agucuuuucaacuucuguguuauagaacauucuaugaauguaguaauuaaucuauuuugcucca

SEQ ID NO: 281684 - RNA, 64 nt, hsa
uuuaagaaaaucuucaucuauuucauaucuauaaugaauguagaacaucuugcuucugcucaga

SEQ ID NO: 281685 - RNA, 64 nt, hsa; identical to SEQ ID NO: 117809

SEQ ID NO: 281686 - RNA, 64 nt, hsa; identical to SEQ ID NO: 117810

SEQ ID NO: 281687 - RNA, 64 nt, hsa; identical to SEQ ID NO: 117811

SEQ ID NO: 281688 - RNA, 64 nt, hsa; identical to SEQ ID NO: 117812

SEQ ID NO: 281689 - RNA, 64 nt, hsa; identical to SEQ ID NO: 117813

SEQ ID NO: 281690 - RNA, 64 nt, hsa
gacauauaacuacuuaucucuaguggugggauucugaauguauaauacauauguuguacuuuua

SEQ ID NO: 281691 - RNA, 64 nt, hsa
uaauuuauacuggagaaaaacuuugcaaguauaaugaauguagcagagccuuuaguuuuuguuc

SEQ ID NO: 281692 - RNA, 64 nt, hsa
gcagucacuuuggagagaagcccugugaauacagugaauguaaggaucccuucagucaccacuc

SEQ ID NO: 281693 - RNA, 64 nt, hsa
gggugcccaggaguagaauaugaagugcuaaaucugaauguaagaaaaauaauaguauugaaug

SEQ ID NO: 281694 - RNA, 64 nt, hsa
gcacacaccacagaaugugugagauuuuccuguuugaauguaugucugcauuauacuccugcaa

SEQ ID NO: 281695 - RNA, 64 nt, hsa
gcuauuuuaaaugucaaggucagcaguguuacuuugaauguaaacugguauaauagguaguuuu

SEQ ID NO: 281696 - RNA, 64 nt, hsa
caguugacugguuuuguguccuguuugaacuugcugaauguaaggcaggcuacuaugcguuaua

SEQ ID NO: 281697 - RNA, 64 nt, hsa
uaugucauucuggauaaauccccaagccccuuuaugaauguagugaaauacauggcaugugggu

SEQ ID NO: 281698 - RNA, 64 nt, hsa
uuuaaacaaaugaugcugagaauaaggagagaaaugaauguagagagagguagagagagaaaua

SEQ ID NO: 281699 - RNA, 64 nt, hsa; identical to SEQ ID NO: 117814

SEQ ID NO: 281700 - RNA, 64 nt, hsa; identical to SEQ ID NO: 117815

SEQ ID NO: 281701 - RNA, 64 nt, hsa
uuuuccugucugacucugacaaguccucccucacugaauguagaaucguugccaaguuucugag

SEQ ID NO: 281702 - RNA, 64 nt, hsa
guagaaauucucccuguaugccuagaaggaucagugaauguaagagccuuggaaauuaacaaaa

SEQ ID NO: 281703 - RNA, 64 nt, hsa
uuggaauggguggcgguaauuggugauacuucuuugaauguagauuuccaaucacaucuuuagu

SEQ ID NO: 281704 - RNA, 64 nt, hsa
gacagcucccaguauacuguggacugugauaaacugaauguauguuuuuuaaugguuuauugcu

SEQ ID NO: 281705 - RNA, 64 nt, hsa
gcucuaugcuaaauaaugaagaguagcacaagaaugaauguauuugcugauacguugcucacau

SEQ ID NO: 281706 - RNA, 64 nt, hsa
gggcuggauagauuaucuaagucaagcuugagaaugaauguauguaauuuuccuguuuauugua

SEQ ID NO: 281707 - RNA, 64 nt, hsa
aauuaaugacaacucaugcuuuaauuuuguauuuugaauguacacgcaugcugaagcuaaguaa

SEQ ID NO: 281708 - RNA, 64 nt, hsa
ugggcuuucagauuucucuuuuuaaccacauuucugaauguauaaaaauaccaauuauuuuccu

SEQ ID NO: 281709 - RNA, 64 nt, hsa; identical to SEQ ID NO: 117816

SEQ ID NO: 281710 - RNA, 64 nt, hsa; identical to SEQ ID NO: 117817

SEQ ID NO: 281711 - RNA, 64 nt, hsa
cucguucaguugcacuucaguauuuucacggauaugaauguaaaauauauaaauauauaaaccu

SEQ ID NO: 281712 - RNA, 64 nt, hsa
auugagcagcugaagcuaacucaugacucuguuuugaauguaaauauuuguaauuaagccugca

SEQ ID NO: 281713 - RNA, 64 nt, hsa
uuuauuguuaguucucacuuguuuccauauuuagugaauguacauuuaauugcaaagcugucau

SEQ ID NO: 281714 - RNA, 64 nt, hsa
caacuugagcucuugaacuccuccugugggccugugaauguauucauucauuccacaacucugg

SEQ ID NO: 281715 - RNA, 64 nt, hsa
uuuuaauuugauuuuagaaucuggacacuuucuaugaauguaauucggcugagaaacauguugc

SEQ ID NO: 281716 - RNA, 64 nt, hsa
auugaacauccccugggcuuacaagaaacacugaugaauguaaaaucaggggacauuugaagau

SEQ ID NO: 281717 - RNA, 64 nt, hsa
gggcacuuggccaguuuucuguucagcuuuucagugaauguaccccuuuaagguucagacuuaa

SEQ ID NO: 281718 - RNA, 64 nt, hsa; identical to SEQ ID NO: 117818

SEQ ID NO: 281719 - RNA, 64 nt, hsa; identical to SEQ ID NO: 117819

SEQ ID NO: 281720 - RNA, 64 nt, hsa
gggguauuggaaauguuuggggacuagguagaggugaauguacuaaaugccacugaauuuguau

SEQ ID NO: 281721 - RNA, 64 nt, hsa
uuuccuccauguuauuuaugaauuuuauauuccgugaauguauauugucuuguaauguugcaua

SEQ ID NO: 281722 - RNA, 64 nt, hsa
uauaugcauuccauuugggagcauagcagcugugugaauguauguaauugugugugggggguuu

SEQ ID NO: 281723 - RNA, 64 nt, hsa
uucuccuuugaaugcuguuuugugaaagaaacugugaauguaauggaaacguaggagcaucugg

SEQ ID NO: 281724 - RNA, 64 nt, hsa
gugaagcuugcaacuuuaugucuugcuuuggacaugaauguauuacagcuugcagcuauucugu

SEQ ID NO: 281725 - RNA, 64 nt, hsa; identical to SEQ ID NO: 117820

SEQ ID NO: 281726 - RNA, 64 nt, hsa; identical to SEQ ID NO: 117821

SEQ ID NO: 281727 - RNA, 64 nt, hsa
agcacauggccuugggugacaaauuccucuuugaugaauguacccuguggggauguuucauacu

SEQ ID NO: 281728 - RNA, 64 nt, hsa; identical to SEQ ID NO: 117822

SEQ ID NO: 281729 - RNA, 64 nt, hsa; identical to SEQ ID NO: 117823

SEQ ID NO: 281730 - RNA, 64 nt, hsa
auuucaaaccauuuaccaucugaaaguuuugauuugaauguaaaacaggaaauuggaauuccuu

SEQ ID NO: 281731 - RNA, 64 nt, hsa
uguuucucccuugggacugugucucauguuugugugaauguagaccaggaaagggggcugcaaa

SEQ ID NO: 281732 - RNA, 64 nt, hsa
agguuucaaaaaucauguaaggauuuaaacuugcugaauguaaagauugaaccucaagucacug

SEQ ID NO: 281733 - RNA, 64 nt, hsa
ucauuuuuacuuuuucuuauuuuuaaaauuaggcugaauguacuucaugugauuugucaaccau

SEQ ID NO: 281734 - RNA, 64 nt, hsa
ccaguagcaauaaacauauaauauaggaggagucugaauguagagaugaaaaauacagaaugua

SEQ ID NO: 281735 - RNA, 64 nt, hsa
augucuugaacuuuuccucaaagcauuacacuugugaauguauuuuugucuaauagggucgaaa

SEQ ID NO: 281736 - RNA, 64 nt, hsa
aauauauaugcauaccuggauuuccuuggcuucgugaauguaagagaaauuaaaucugaauaaa

SEQ ID NO: 281737 - RNA, 64 nt, hsa
cuuaucaggcauuuucauuuggaaauuucauuauugaauguagcaagguuguaguuguuuuuuu

SEQ ID NO: 281738 - RNA, 64 nt, hsa
cucagaagucaagcugauggaguaugugauaaagugaauguacauguauauacacacacaccuc

SEQ ID NO: 281739 - RNA, 64 nt, hsa
caugcauaaaaauagaagacaaucugcuuguuucugaauguauggaaagacauuuugguuauac

SEQ ID NO: 281740 - RNA, 64 nt, hsa
gaucuuaaacccaaaguacgagaaauguuucuguugaauguaaugcuacaugaaugcuugauuu

SEQ ID NO: 281741 - RNA, 64 nt, hsa
aguccuaaaaauggccagauuguggaacagcuguugaauguaauacuuccaaaauguacauauc

SEQ ID NO: 281742 - RNA, 64 nt, hsa
auucucguaaaacugcgcuuugccaguagcacagugaauguaugccaaaugcaaguccauucca

SEQ ID NO: 281743 - RNA, 64 nt, hsa
aaaugaacugcccuucagcaucuaaugggaguugugaauguaacugguuaaugauacacauucc

SEQ ID NO: 281744 - RNA, 64 nt, hsa
acuguauuucccaauacacuugagcaguugccugugaauguaagaggugucaacaaacugggaa

SEQ ID NO: 281745 - RNA, 64 nt, hsa
uugccuuaguacuaucaagacuugugaauauauuugaauguauguuguuugaaaaacuugcaca

SEQ ID NO: 281746 - RNA, 64 nt, hsa
ucugucaaggaauuacaaguagcaagggaaggucugaauguaaggacaggccuagggaccuugc

SEQ ID NO: 281747 - RNA, 64 nt, hsa
aagucugcuuaauuucaaaagaaaaaugccuaauugaauguaacucaucuugguguuauuauac

SEQ ID NO: 281748 - RNA, 64 nt, hsa
gcaacagacuguauuuuugugacgccccguaguaugaauguacaucuuguaaaacugagauaua

SEQ ID NO: 281749 - RNA, 64 nt, hsa
gcaguauucuucaguaaauaaagaauggaauugcugaauguaaucauugaaccucgagucacug

SEQ ID NO: 281750 - RNA, 66 nt, hsa
caccuacagguuguguacuuuucauaaugguuuccaugaauguaguacguucauacaggcuucauu

SEQ ID NO: 281751 - RNA, 66 nt, hsa
aucuuacaaaaauggaguauuuuaguaugaauuugcugaauguaagaccguggacuguuuuuuaua

SEQ ID NO: 281752 - RNA, 66 nt, hsa
guagaaaguggggucaggaggccaagaaagggaauaugaauguauauccaagucacucaggaacuu

SEQ ID NO: 281753 - RNA, 66 nt, hsa
ugcauccucugggaucuucugagguggacagcacuuugaauguagcauuucacuggaacagagucu

SEQ ID NO: 281754 - RNA, 66 nt, hsa
cuugauucuuggucuauaauugcagauguuauuguaugaauguaccauaauauauuugagcagucc

SEQ ID NO: 281755 - RNA, 66 nt, hsa
accguuguuuaggguagaauaggcuguguauuuacaugaauguauaauaucuaugucagcaguauu

SEQ ID NO: 281756 - RNA, 66 nt, hsa
agaccuaccucaaacacacuguuuccacccucuucuugaauguauucaguagccuuuacugaaugu

SEQ ID NO: 281757 - RNA, 66 nt, hsa
auguuuuaauaugucaguuauugcccuuuuauauugugaauguaaugugcauaagcuauauccgua

SEQ ID NO: 281758 - RNA, 66 nt, hsa
cuuuuguaucucacaauucuggucuagauucaguuaugaauguaggcauuaguuaaaauuaacaag

SEQ ID NO: 281759 - RNA, 66 nt, hsa
cuugagaaaaacaaugagcugagaggcagacuucccugaauguauugaacuuggaaagaaaugccc

SEQ ID NO: 281760 - RNA, 66 nt, hsa
guauuuuguuguguuaaaaguacuuuucuugauuuuugaauguauuuguuucagcagaagucauuu

SEQ ID NO: 281761 - RNA, 54 nt, hsa; identical to SEQ ID NO: 227074

SEQ ID NO: 281762 - RNA, 66 nt, hsa
gacuccuaagagaguuguaaaaauagaggcuuggcuugaauguacauagaugguaccuggcaugga

SEQ ID NO: 281763 - RNA, 66 nt, hsa
ugggugacuuucauuccaguugcugggacggaaggcugaauguagggucauuuuguaugggauaug

SEQ ID NO: 281764 - RNA, 66 nt, hsa
auuauagauauaggacaguacuguaucauaccucugugaauguaaaauaucuuguaccugcuuuau

SEQ ID NO: 281765 - RNA, 66 nt, hsa
ucaaguaaucuagaagaauguggauacucuuaggcgugaauguaaaugccuuaauauugaaggucc

SEQ ID NO: 281766 - RNA, 66 nt, hsa
ucaagauuucuuuauuuacaaaugauuacauuuaaaugaauguacauucuucucacugacuuuggu

SEQ ID NO: 281767 - RNA, 66 nt, hsa
cacccccgucuuauuaaggagcuuuuaaaguuuuucugaauguauagacauuucucggguuccuac

SEQ ID NO: 281768 - RNA, 66 nt, hsa
gugcaacuguggcuuagcuaauauugcaauguggcuugaauguagguagcauccuuugaugcuucu

SEQ ID NO: 281769 - RNA, 66 nt, hsa
agcugcuucaugaguagaaauuucaacaacucuuuuugaauguaugaagaguagcaguccccuuug

SEQ ID NO: 281770 - RNA, 66 nt, hsa
ggguuaaagguuuuggcugcuguaagaaugugaauuugaauguauuuugaauuguaagagcaaaag

SEQ ID NO: 281771 - RNA, 66 nt, hsa
ucagggaagauacauacauauaugagguacaguuuuugaauguacugguaaugccuaauguggucu

SEQ ID NO: 281772 - RNA, 66 nt, hsa
cuuaaaaacuuguauaguugucuagauuucugcaccugaauguauguuugaugcuuugauuugaaa

SEQ ID NO: 281773 - RNA, 66 nt, hsa
cacuaguggaagauaguguucugcuuauaauuaaacugaauguagaguaucucuguauguuaauug

SEQ ID NO: 281774 - RNA, 66 nt, hsa
agaugaacuguauuuugcauuuugucuacuuguaagugaauguaacauacugucaauuuuccuugu

SEQ ID NO: 281775 - RNA, 66 nt, hsa
ccagcaacaacccucacauaugcacugagugaaggaugaauguauggacacaucugggaguauuuu

SEQ ID NO: 281776 - RNA, 66 nt, hsa
ccucauaggguuguugugaggauuaaaaugaggaaaugaauguaaagcacuuaguacaguauauga

SEQ ID NO: 281777 - RNA, 66 nt, hsa
gaccaauguuugaugggaaaacguggcacucauaguugaauguauacuucuguaccaaaacuugaa

SEQ ID NO: 281778 - RNA, 66 nt, hsa
cuccuuuucccucucaccuaaaugucaacuugucauugaauguaaagaaugaaaccuucugacaca

SEQ ID NO: 281779 - RNA, 66 nt, hsa
uguagcaugauguauuuaaaguaaggccuuuaguaaugaauguaaugagagaaaauguuuugaaaa

SEQ ID NO: 281780 - RNA, 66 nt, hsa
acuaacuagcuuauuaaaauuuacaaaaugucuuuuugaauguaucaaggauauauuuaguuugag

SEQ ID NO: 281781 - RNA, 66 nt, hsa
ucaaauauaguuggcauuggaaguuuagccuuuacuugaauguauacuguagauuuuuaacaaagc

SEQ ID NO: 281782 - RNA, 66 nt, hsa
guuaaaggucuacuuuaaucagaaauagcaacgagaugaauguauccaacauuucaauuugcauuc

SEQ ID NO: 281783 - RNA, 66 nt, hsa
gcuuacucuaugagucuucauuuuucuaaaauaaagugaauguauuuuuauauucucuguauaucu

SEQ ID NO: 281784 - RNA, 66 nt, hsa
uuauuagaauaaaaugugcaaauaaugacaauuauuugaauguaacaaggaauucaacugaaaucc

SEQ ID NO: 281785 - RNA, 66 nt, hsa
gaggugguuuagggauuuuggcccuaaccaauacauugaauguaugaugacuauuugggaggacac

SEQ ID NO: 281786 - RNA, 66 nt, hsa
uaauguggguggaccccguccagucuguugaaggccugaauguaacaaaagggcuuauucuuccuc

SEQ ID NO: 281787 - RNA, 66 nt, hsa
ccccaccucaggccucacacuuucccaugaaaagggugaauguauauaaccugagcccucuccauu

SEQ ID NO: 281788 - RNA, 66 nt, hsa
aaagauguauauagauguauauaugcccaaauauauugaauguacagaaaggaaauauucagagac

SEQ ID NO: 281789 - RNA, 66 nt, hsa
uccuauaccuuaccagagcauggaagagcccagaucugaauguaaaacgucucuguucugccagag

SEQ ID NO: 281790 - RNA, 66 nt, hsa
augagucaaggaguguaaccuucuccuuuacuauguugaauguauuuuuuucuggacaagcuuaca

SEQ ID NO: 281791 - RNA, 66 nt, hsa
agcucccauguccccaagaccucuggaguuuccucuugaauguacaugaaccacuguaauagcauu

SEQ ID NO: 281792 - RNA, 66 nt, hsa
aggcagccucuagagccuucuugcuuucauuuuccuugaauguacauaggaacaagggggaaaguc

SEQ ID NO: 281793 - RNA, 66 nt, hsa
uuuacaauugugaaaaccucauggauuugggcaaacugaauguauauaggcuuuugacaaaaguug

SEQ ID NO: 281794 - RNA, 66 nt, hsa
uguagcuacacaguaaguagcuugguagauaguuauugaauguauuuauguaguguauuaagaagc

SEQ ID NO: 281795 - RNA, 66 nt, hsa
cuauguaaauggcucacaagucaauugcaaacaaacugaauguacaaaucuuagugcuggugcuga

SEQ ID NO: 281796 - RNA, 66 nt, hsa
uauuugcauguuuuuuguuaauuuagcuaaagcaauugaauguagauacucagaagaaauaaaaaa

SEQ ID NO: 281797 - RNA, 66 nt, hsa
uacagaguuuaaaugaauacauaaauguagaaguacugaauguauauauuuaaaaggagccucuug

SEQ ID NO: 281798 - RNA, 66 nt, hsa
cauuuuugcauugccuucgguuuguauuuagugucuugaauguaagaacaugaccuccguguagug

SEQ ID NO: 281799 - RNA, 66 nt, hsa
ugugaagaugaaugaauguaacuccuggugugaagaugaauguaaacccuggcgacaguugagacc

SEQ ID NO: 281800 - RNA, 66 nt, hsa
aaccacggcagagagcagcgccgaugugaagaugaaugaauguaacuccuggugugaagaugaaug

SEQ ID NO: 281801 - RNA, 66 nt, hsa
caaaaacaugaacagucacauacuugagagaaacugugaauguaagguguaggaaaguacuuaauu

SEQ ID NO: 281802 - RNA, 66 nt, hsa
ugugggaaaaauauugcuacaauuuuuuuuaaucucugaauguaauuucgauacuguguacauagc

SEQ ID NO: 281803 - RNA, 66 nt, hsa
gaacaugauuuuauucuaugccaacauuugggccucugaauguaucuguuauuugaauuuaaguau

SEQ ID NO: 281804 - RNA, 66 nt, hsa
uauauauuuauacacauacaauuuauguuuuccuguugaauguauuuuuaugagauuuuaaccaga

SEQ ID NO: 281805 - RNA, 66 nt, hsa
uuuaucugaaagaaguuucuggguuaggagaaguaaugaauguauccauuuguacaugguuuacau

SEQ ID NO: 281806 - RNA, 66 nt, hsa
gugaacaaucauuaauucuucgauauuucuguagcuugaauguaacugcuuuaagaaagguucuca

SEQ ID NO: 281807 - RNA, 66 nt, hsa
uuagaguacuuuuuaaaauuauuucucacaaagaaaugaauguacaauccaaugaaaacauuuguu

SEQ ID NO: 281808 - RNA, 66 nt, hsa
cuuaaaacaaugaaagagcauuuaucguuugucccuugaauguagaauuuguuuuugauuucauaa

SEQ ID NO: 281809 - RNA, 66 nt, hsa
gcccaggggugggaaguuuucauuugcaggggggucugaauguaacucaccauguggugugcaagg

SEQ ID NO: 281810 - RNA, 66 nt, hsa
cacaauguauuauuaucacugucagaugagcaugcuugaauguagcaugacugccucuuuuugcuu

SEQ ID NO: 281811 - RNA, 66 nt, hsa
uaagacauccaaucaauaaugaaggaaauuuuuuucugaauguagguuugagugaggggcaccucu

SEQ ID NO: 281812 - RNA, 66 nt, hsa
ucagucccagccagaagaaucucugaaagcauauugugaauguauacaauguaguacaaacaaucu

SEQ ID NO: 281813 - RNA, 66 nt, hsa
ucuuuccuccugucuuagaagaacagaccuaacuagugaauguauuaaugaaaaugcaucuauuuc

SEQ ID NO: 281814 - RNA, 66 nt, hsa
ucaccacacagcagaauuucuaauggaaguuuguugugaauguaaaggagggagcauucuuugcuu

SEQ ID NO: 281815 - RNA, 66 nt, hsa
caaauuuaauguaguaacucacuuuuccauauauuuugaauguauauuucuauuuaugauaccaau

SEQ ID NO: 281816 - RNA, 66 nt, hsa
uuaacuugucuuuuuguuaugcaaaugagauuucuuugaauguauuguucuguuuguguuauuuca

SEQ ID NO: 281817 - RNA, 66 nt, hsa
guuuauguaauuuagggaggacuggucuguaauuucugaauguauauagaauaauauuuauguuua

SEQ ID NO: 281818 - RNA, 66 nt, hsa
gcgagucauuucguucccugauuauuuauccuugucugaauguauuuauguguauauuuguagauu

SEQ ID NO: 281819 - RNA, 66 nt, hsa
aaucugaacuauaucuugacaaauauuauucaaacuugaauguaaauauauacaguauguauauuu

SEQ ID NO: 281820 - RNA, 66 nt, hsa
aaauaaagaaaugggugacaggcuuaaccucaccuaugaauguacaguauguggauuugugaaacu

SEQ ID NO: 281821 - RNA, 66 nt, hsa
cuguuuaagauauguuuggugaccaaaacguaugugugaauguaguuauaaugcuuuugaaaaauu

SEQ ID NO: 281822 - RNA, 66 nt, hsa
gucagauuuagauucuuccuggggauuacacagcuaugaauguauuugcuucuaaaaccucccaaa

SEQ ID NO: 281823 - RNA, 66 nt, hsa
aacacuguucugauaucucugauugucauguggauuugaauguagcuugacagagggaaugucuaa

SEQ ID NO: 281824 - RNA, 66 nt, hsa
aaaacagaaaagaacaacagcaacaaaaacauugugugaauguauguuuguauguguguauguaua

SEQ ID NO: 281825 - RNA, 66 nt, hsa
uuuuaacuauugauuuuuuuuaaaaaaaauugucuuugaauguauuggaaguagacaugcauuaac

SEQ ID NO: 281826 - RNA, 66 nt, hsa
uagggcacacacugaaguuggcuuuucagccagcacugaauguauccaucaggacaugcgucuuca

SEQ ID NO: 281827 - RNA, 66 nt, hsa
gcacuuguccguagggucacacgcgugcccuguugcugaauguauguugcguaucccaaggcacug

SEQ ID NO: 281828 - RNA, 66 nt, hsa
caagguauuuacacauacaacuucauauaacugagaugaauguaauuuugaacuguuuaacacuuu

SEQ ID NO: 281829 - RNA, 66 nt, hsa
ugcuguucccuaaucccacccccugcccugagacagugaauguaguccgugaagggagugccucuc

SEQ ID NO: 281830 - RNA, 66 nt, hsa
uguaaauucacagcaguaagauaauauaaauuuuguugaauguauuaacaucauauggucugaaaa

SEQ ID NO: 281831 - RNA, 66 nt, hsa
ucuggagugaauuaaguucaccugauaacucaaaagugaauguauaauacaauucuguuuuaaucu

SEQ ID NO: 281832 - RNA, 66 nt, hsa
auuacaguguaguguuuauucuaaggaagauauguaugaauguauauacaaagacucagcuacuuc

SEQ ID NO: 281833 - RNA, 66 nt, hsa
uggaggccucugcaagauucugugggcagcuggcucugaauguagccagcccacauccauuccaga

SEQ ID NO: 281834 - RNA, 66 nt, hsa
aaagacaucaugagaaaauaccagcaguaucuaucaugaauguagaaauaaaaguccuuaaaauaa

SEQ ID NO: 281835 - RNA, 66 nt, hsa
caaacaugggagaauccauacuagugagaaaccacgugaauguaaugaaugugggaacgcuuugau

SEQ ID NO: 281836 - RNA, 66 nt, hsa
aggcucuaugaauguacauggaaugaccaggcucuaugaauguacauggaaaaccccuaaaaaucc

SEQ ID NO: 281837 - RNA, 66 nt, hsa
acgcaacaaggacuccucgcugcugaccaggcucuaugaauguacauggaaugaccaggcucuaug

SEQ ID NO: 281838 - RNA, 66 nt, hsa
gucccuuccagcuuuucuguagaaucuuacugguauugaauguaaaggaagcaaggccuguauugc

SEQ ID NO: 281839 - RNA, 66 nt, hsa
agauaagaauaauucagguagcaucugaaauuuuaaugaauguauaauuggcauaucauggaaaau

SEQ ID NO: 281840 - RNA, 66 nt, hsa
uuugcccugcaaauaaaaagacaauuccuuauugucugaauguaauacagucuucauuguacuauu

SEQ ID NO: 281841 - RNA, 66 nt, hsa
auuuuucauuuuuuuacuuuguaguuuauuuuuuagugaauguauuuaauuuuaugaauuauuuau

SEQ ID NO: 281842 - RNA, 66 nt, hsa
uuaaaagcaaguuauaucagugaaguaagauccuuuugaauguacaaagacccacacuauugagac

SEQ ID NO: 281843 - RNA, 66 nt, hsa
uauaaagguaaaaaaaauuccccaaauauuuugcacugaauguaccaaaggugaagggacauuaca

SEQ ID NO: 281844 - RNA, 66 nt, hsa
ccagucaaauggcuucaugagaacaguagaaccuuaugaauguauacuagcauacaaggaucucaa

SEQ ID NO: 281845 - RNA, 66 nt, hsa
uugcauuugacacaauauuguaauaauccaugauuuugaauguaaaguauauaugaugucauuaau

SEQ ID NO: 281846 - RNA, 66 nt, hsa
aauguuuucauauuuuucaaaauagguuuuuauuguugaauguacaucuaccccagccccucaaaa

SEQ ID NO: 281847 - RNA, 66 nt, hsa
aaaagaucauuuuauuaucuuuaacuguaucuauuuugaauguaaauuuaaaaaaaguaauucucu

SEQ ID NO: 281848 - RNA, 66 nt, hsa
uuuguauaauuacuugauucacacagugagaaaaaaugaauguauuccuguuuuugaagagaagaa

SEQ ID NO: 281849 - RNA, 66 nt, hsa
cuguuuaaggcucuucauccugguuagcaaaaggugugaauguaaugugauggaauuuaaaaguuu

SEQ ID NO: 281850 - RNA, 66 nt, hsa
acaacuggaauagcuaauuacagucuauuaaaacugugaauguauguagcaauccugcgugugaag

SEQ ID NO: 281851 - RNA, 66 nt, hsa
ccuuacauagcacuugauacguguuaaaugaacauaugaauguaauuuauauauuccuagaauuua

SEQ ID NO: 281852 - RNA, 66 nt, hsa
auuagcagcucaauuuguacuacuucagccaaucugugaauguaaaaacuacacuguugccuugcu

SEQ ID NO: 281853 - RNA, 66 nt, hsa
uagggggaacauuguaaagaaacaaaaagguccagaugaauguaugcuagaaauaaaaguugaaag

SEQ ID NO: 281854 - RNA, 66 nt, hsa
agaauaaucuuccauuuggcugucgugaggaguaauugaauguaauccaucucuuacaaaauggag

SEQ ID NO: 281855 - RNA, 66 nt, hsa
cagcugcgcgggcuuauuuauuaacaggauaacccuugaauguagcagccccgggagggcggcaca

SEQ ID NO: 281856 - RNA, 66 nt, hsa
uucggagggaaauuguaaauccuguguuucauuacuugaauguaguuaucuauugaaaauauauau

SEQ ID NO: 281857 - RNA, 66 nt, hsa
uuaaggguuucaaucaauuauuaaugcagagaguauugaauguaaaucagagcucucuagucuuca

SEQ ID NO: 281858 - RNA, 66 nt, hsa
auacuuguuuaucuuguugcugcaaugagaaauaaaugaauguauguauuuuggugcagacaccug

SEQ ID NO: 281859 - RNA, 66 nt, hsa
uucuauacacuaucaaauauauaaagcuuucuauauugaauguacauuauacagaucauucauaug

SEQ ID NO: 281860 - RNA, 66 nt, hsa
guaccaucgccuuccaaagucagcacucuacacucuugaauguaccaaggaucucuuggcgacagu

SEQ ID NO: 281861 - RNA, 66 nt, hsa
cuuaugguauuuauuuucaguaguaaagacccagcuugaauguaaauuuuguauaguguaaguaug

SEQ ID NO: 281862 - RNA, 66 nt, hsa
cuuuccauuuuggcgcuauuacaaauagugcaacuaugaauguacugcauguuaccaucuuacuug

SEQ ID NO: 281863 - RNA, 66 nt, hsa
aauauucaauauuggucuguguuuaaguuuguuauuugaauguaauuuacauagaggaauauaaua

SEQ ID NO: 281864 - RNA, 66 nt, hsa
agagcgcaucaccugaaugucgugaagaaguaucucugaauguauccaggagaggaacugcauaac

SEQ ID NO: 281865 - RNA, 66 nt, hsa
cagccaugcacccgcccagccaccacgucccccgcaugaauguacuguacacuuucaauccucccc

SEQ ID NO: 281866 - RNA, 66 nt, hsa
aggauaucuuuguccauauacccagguguccugauuugaauguacuauuugauccucauuguguuc

SEQ ID NO: 281867 - RNA, 66 nt, hsa
cuuugcugucuuuuuacacuguaugcgguuuggaaaugaauguagaaacuuacugugggcauuuac

SEQ ID NO: 281868 - RNA, 66 nt, hsa
cagggucucucccucagguguuuuuuaugaagugcgugaauguauguaaugugugguggccucagc

SEQ ID NO: 281869 - RNA, 66 nt, hsa
uaaaguuuuggcaguaaaauacucuguuuuuaaguaugaauguauuucauucauauuuccucucac

SEQ ID NO: 281870 - RNA, 66 nt, hsa
cuacagaaggaagggagucccaucucaaaaaaaaaaugaauguaugccacugcaauuagaguaucc

SEQ ID NO: 281871 - RNA, 66 nt, hsa
ggauucuuaauguaugauuucuuuguucauauauuaugaauguauuauuuuauuugcuucguaaua

SEQ ID NO: 281872 - RNA, 66 nt, hsa
auuuacuauguauuuauacguuaagaccucuaugaaugaauguaucagagaaugucuuuguaacug

SEQ ID NO: 281873 - RNA, 66 nt, hsa
uuuggaaaccaucacuauugagagaugggaaaaaccugaauguauaaagcauuuauuugucaauaa

SEQ ID NO: 281874 - RNA, 66 nt, hsa
auaucauggugauuaugaugguuaaagccuuuacacugaauguaauguuuaauaaagaaauuacaa

SEQ ID NO: 281875 - RNA, 66 nt, hsa
uauaaccauuucaccuggacuaucuaaucaguccuaugaauguaucccuaaaugugguuauugaaa

SEQ ID NO: 281876 - RNA, 66 nt, hsa
uguuucuuauugcuuuuccuucccuaauucauacaaugaauguauuuggaauacuuacauauuaua

SEQ ID NO: 281877 - RNA, 66 nt, hsa
ugcuuccugauugcgcagacugaaacuagcuaaaccugaauguaccuacuagggcaccauaauacu

SEQ ID NO: 281878 - RNA, 66 nt, hsa
aacuagcuuguuuugacagguuuauuucacauccuaugaauguauguaaauaaacuguacauaggu

SEQ ID NO: 281879 - RNA, 66 nt, hsa
ccugcauuaccuaauaauuaccucagcguuagaauuugaauguauuaauugauuuaaacaucaugu

SEQ ID NO: 281880 - RNA, 66 nt, hsa
ccaaagucguuucaacucuuaaagacaucuuaauccugaauguaaacaauuguuauguguuuagaa

SEQ ID NO: 281881 - RNA, 66 nt, hsa
uauaggaccaaaacagaauauuguagauggcaguuaugaauguauauuuauauuuugauuaagauu

SEQ ID NO: 281882 - RNA, 66 nt, hsa
aagugaggcucccacaggcaccagcaaaacaacggaugaauguagcccuuccaacaccugacagaa

SEQ ID NO: 281883 - RNA, 66 nt, hsa
augagaguuguauguaaccagugauaugauuauuccugaauguacagacagaaguaagccuggaca

SEQ ID NO: 281884 - RNA, 66 nt, hsa
cuggcuagauguuuacauuuguaagaaauaacacugugaauguaaaacagagccauucccuuggaa

SEQ ID NO: 281885 - RNA, 66 nt, hsa
gccuccagacguagccauuuccugacaucaagauguugaauguaaucuggucugagcugggccugu

SEQ ID NO: 281886 - RNA, 66 nt, hsa
uaaaaccucaauuuaagucuuuaaaagguuguauuuugaauguaaccaaaaguuuacaguuuuuug

SEQ ID NO: 281887 - RNA, 66 nt, hsa
uugguuuuaugcugcuuuguuaggacagauguguuuugaauguaccauuauaagaagaauucuaug

SEQ ID NO: 281888 - RNA, 66 nt, hsa
gacaauguggaauuaccaaauuaaaagagaauacuaugaauguauucauauuuuuucuauauugaa

SEQ ID NO: 281889 - RNA, 66 nt, hsa
acaauggaauauuuucuaaaacauuuaguauacauuugaauguauuuuaaaccaugccaaacuacu

SEQ ID NO: 281890 - RNA, 66 nt, hsa
aaagguaauauuuuuaauaugauacauuacauauugugaauguauacuaaaaaaacauuuuaaaug

SEQ ID NO: 281891 - RNA, 66 nt, hsa
uuaagccuuuuuuuucuuuuuuuuuuuuuuggcaaaugaauguaccauuucaacuuugauuuuaau

SEQ ID NO: 281892 - RNA, 66 nt, hsa
augacuuuccucucccaguuuccagacagggcucuuugaauguaugucaaacucaguuacuccaga

SEQ ID NO: 281893 - RNA, 66 nt, hsa
gauuaucuuuuuguggugugaauaaaucuuuuaucuugaauguaauaagaauuugguggugucaau

SEQ ID NO: 281894 - RNA, 66 nt, hsa
agacuuucuccaauguggacucugugugucagugaaugaauguaguaaaauucacuuuggaagguu

SEQ ID NO: 281895 - RNA, 66 nt, hsa
aggugauaauuuugcuuuguguuacuuuuuugcucuugaauguaucguuaugauggucucuuauaa

SEQ ID NO: 281896 - RNA, 66 nt, hsa
agauuucauugagggcaaggcugguggcagguacuaugaauguaauucauaauuuaaaaggaaaac

SEQ ID NO: 281897 - RNA, 66 nt, hsa
uaaauaaguaucuauguaaauuuguuuaaaauaaacugaauguauuuaaugguccauuuauauguu

SEQ ID NO: 281898 - RNA, 66 nt, hsa
agaaggaaucauuggugaacuuuccaagguuauuucugaauguaacaauuuccuuaaaaaugacuu

SEQ ID NO: 281899 - RNA, 66 nt, hsa
cuagaauagauuaauaaauuggcuauguuguuccaaugaauguacagcacuuccauuaacuuuuga

SEQ ID NO: 281900 - RNA, 66 nt, hsa
cauacuaguguguucauuauagaguaucuguagaggugaauguaaaaguaaguccaaucuauuuuc

SEQ ID NO: 281901 - RNA, 66 nt, hsa
ggcaugaacauuacugcagguuuuugaugaauauaaugaauguauggaauucaauugaauuugcau

SEQ ID NO: 281902 - RNA, 66 nt, hsa
uuucugcuuuaaaggcauguguguuuuuaaaauuaaugaauguagaugugugauugucugagugag

SEQ ID NO: 281903 - RNA, 66 nt, hsa
gauuuaagacacuuuuuggacucaacguuacauuuuugaauguaguaaguaaauuaaccaaaaaag

SEQ ID NO: 281904 - RNA, 66 nt, hsa
ugucagagcuagggugggggugcccgauucgggugcugaauguaaggaggggagccuccaagugug

SEQ ID NO: 281905 - RNA, 66 nt, hsa
auuuaaggagcauuuaaaaauauguauauaugugacugaauguaagauuaacuuuauuuuggucug

SEQ ID NO: 281906 - RNA, 66 nt, hsa
gaggucugugcuaccucugugagguauauacuaaaaugaauguaaaauaaggaucguauucccugc

SEQ ID NO: 281907 - RNA, 66 nt, hsa
guauaaauuauaaaugcaauuaacuaagaacagcucugaauguauuugcaugggauugguccuuga

SEQ ID NO: 281908 - RNA, 66 nt, hsa
caguucauuucacugggauuuugaagcauuucugucugaauguaaagccuguucuaguccuggugg

SEQ ID NO: 281909 - RNA, 66 nt, hsa
gugugugagaaaagaauagaagugaaauuugcauaaugaauguaaaagggaaauaaaagucuuuug

SEQ ID NO: 281910 - RNA, 66 nt, hsa
gaaaacuuuauaaucgucauuguucaaccaagauuuugaauguaauaagaugaauauauuccuuac

SEQ ID NO: 281911 - RNA, 66 nt, hsa
auggcaaauaagaauguuugagcacacugcccacaaugaauguaacuauuuucuaaacacuuuacu

SEQ ID NO: 281912 - RNA, 66 nt, hsa
cuauuuauuuaaauauuuaaauuuuauauuuauuguugaauguaugguuugcuaccuauuguaacu

SEQ ID NO: 281913 - RNA, 66 nt, hsa
cuguuuuguagccuuaagaaguguuucaaacauaucugaauguauaaaauaagaguaaaugcccua

SEQ ID NO: 281914 - RNA, 66 nt, hsa
agaaguaccuggagcaucauucucuucuaccacaucugaauguaacuuaaauuugcucaaagaagc

SEQ ID NO: 281915 - RNA, 66 nt, hsa
cuucaggcuugacaacuucacauugccucucuuccuugaauguauuuuaucuggucuuuucuauau

SEQ ID NO: 281916 - RNA, 66 nt, hsa
ugguuacucagcucccuggaaagcaggcaagcauguugaauguaucuaguggucugauuuuaauuu

SEQ ID NO: 281917 - RNA, 66 nt, hsa
aaacuggauuugauuucuuuuuaugaaaguuucauaugaauguaacuugauuuuuuacuauuauaa

SEQ ID NO: 281918 - RNA, 66 nt, hsa
guacauaugguagacaauuugccuuaggaagugacuugaauguacaaagauacuugaugcacuuau

SEQ ID NO: 281919 - RNA, 66 nt, hsa
guacacauaagccaaaacugagcauaaguccucuagugaauguaggcuggcuuucagaguaggcua

SEQ ID NO: 281920 - RNA, 66 nt, hsa
gggaaauuaacacuggaacugacccuuuucuggcagugaauguaagcucuagcucccccaucuacu

SEQ ID NO: 281921 - RNA, 66 nt, hsa
agaugguuacacuguuagaacacuauuuucagaaucugaauguaauuuguguaauaaaguguuuuc

SEQ ID NO: 281922 - RNA, 66 nt, hsa
augauggguuuguugguauuuaaaaugaauacaacuugaauguaauuaaagugcuguuuuuuggaa

SEQ ID NO: 281923 - RNA, 66 nt, hsa
agagucuugaacacagaauaacgauugugaccauuaugaauguaacuaauuucaguuguacuguga

SEQ ID NO: 281924 - RNA, 66 nt, hsa
gauucuaaauagcgauuauaaucuccaacuuuauuuugaauguaccucuauuaguuucaauugagu

SEQ ID NO: 281925 - RNA, 66 nt, hsa
cuucaggcagauuaaaagaaucauuuguugaacaacugaauguauaaaaaaauuauaaacuggugu

SEQ ID NO: 281926 - RNA, 66 nt, hsa
caacuauuaccuagagugaacuuuaagcuuuauuguugaauguaauuccauuauauuuccuuuugu

SEQ ID NO: 281927 - RNA, 66 nt, hsa
agaggggcaaaaauauuuugcaagcucuggaauuguugaauguauucuuuuauauaacuacauuaa

SEQ ID NO: 281928 - RNA, 66 nt, hsa
ucuuuuauuuuguguccuugggcuauaaaagauuccugaauguaauuauaaggauuuggguuugga

SEQ ID NO: 281929 - RNA, 66 nt, hsa
gcugaaguaguguuuaggauccuccauggcaguuagugaauguaagaaguacaguguuaaaguguu

SEQ ID NO: 281930 - RNA, 66 nt, hsa
uaaacucgaucuaaaguuuagcauuuccaucugcgaugaauguaggccacaaaccacaguaguauu

SEQ ID NO: 281931 - RNA, 66 nt, hsa
cccggccgccggggcacauagggguuuuaucgggcgugaauguaaauaaauuauauauauauauug

SEQ ID NO: 281932 - RNA, 66 nt, hsa
aagcugaacagugaugaucuguagacauuuauggacugaauguaaugguugauauauguacauucu

SEQ ID NO: 281933 - RNA, 66 nt, hsa
ucguggcgacuuagaguuggcggauauucggaacugugaauguacauagcguugaguuaaaccccu

SEQ ID NO: 281934 - RNA, 66 nt, hsa
auuggcagcaguuuuauaaaguccgucauuugcauuugaauguaaggcucaguaaaugacagaacu

SEQ ID NO: 281935 - RNA, 66 nt, hsa
cgugucuuaaaacaaggcuuacuuacuagacauaacugaauguaaaaagugcuuuuucaaaucugu

SEQ ID NO: 281936 - RNA, 66 nt, hsa
gggaaaacuuacuuuucauggagugccaccuaacagugaauguauuagaguauaaaauguuugcca

SEQ ID NO: 281937 - RNA, 66 nt, hsa
ggccaacagaguugugaaugugugugggaaggccuuugaauguaaagcugcauaagcuguuagguu

SEQ ID NO: 281938 - RNA, 66 nt, hsa
uauaauuuucuaguuccuuuuuaaugaugauuauucugaauguauuugccacuacauuuacaauaa

SEQ ID NO: 281939 - RNA, 66 nt, hsa
uaauucauuaauuuaguguaagaagaaaguuaagucugaauguaaauucaguguaagaugaaaauu

SEQ ID NO: 281940 - RNA, 66 nt, hsa
aucuaucagaaauuguaagagaauagauacauguuuugaauguaaaguugaaaagucugguuuacu

SEQ ID NO: 281941 - RNA, 66 nt, hsa
guccuaguaagugccacuuccacuaagaauacaguuugaauguauaaucaguaguguuuacaagau

SEQ ID NO: 281942 - RNA, 66 nt, hsa
agaugugauagugccgugaauguauucuacuggaaaugaauguaauaauacauuaaauuuuuaaaa

SEQ ID NO: 281943 - RNA, 66 nt, hsa
ggccaguucaaaagaauaguagaugugauagugccgugaauguauucuacuggaaaugaauguaau

SEQ ID NO: 281944 - RNA, 66 nt, hsa
uaaugauuuauuaauuaccaggauccuuuucuaaauugaauguacuuuugaauuacuagguuucuu

SEQ ID NO: 281945 - RNA, 66 nt, hsa
gagacuugguucuaguccaauuucugccacugaggaugaauguaacugugggcaaacuauuuaccc

SEQ ID NO: 281946 - RNA, 66 nt, hsa
agaauuuuguuccaccaugguuaguuauuugccauaugaauguauucuuguuucuaccaauauucu

SEQ ID NO: 281947 - RNA, 66 nt, hsa
uucuucuguuugugaagaaaaaaacaaguuaaaaacugaauguacugauuuagaaaauauauauaa

SEQ ID NO: 281948 - RNA, 66 nt, hsa
aaaaaaacacacauucagccaaccacuuauaugaauugaauguaucagaaguguacugaagggacu

SEQ ID NO: 281949 - RNA, 66 nt, hsa
cgcggaagucagggcggcuggauuccaggacaggagugaauguaaaaauaaauaucgcuuagaaug

SEQ ID NO: 281950 - RNA, 66 nt, hsa
caagucucuccgaacucaaauggaagaaauaccuuaugaauguaagaauguagggggucauggcuu

SEQ ID NO: 281951 - RNA, 66 nt, hsa
cuauuauuaguuaggcuucugagcuugcaaucauauugaauguaugaagagcgaaaucaaauucuu

SEQ ID NO: 281952 - RNA, 66 nt, hsa
ucuacuuauccagguuugcaaauguacauguucauuugaauguaaaucaccauuucuuggaacccc

SEQ ID NO: 281953 - RNA, 66 nt, hsa
uauuuauuauuuauuuauuauuuauuuauuuacagaugaauguauuuauuugggagaccgggguau

SEQ ID NO: 281954 - RNA, 66 nt, hsa
cggcuggggagggaagcacugucauguggacguggaugaauguaggaccagcaucacccucugcuc

SEQ ID NO: 281955 - RNA, 66 nt, hsa
uaucugucauuauugcccugaucacaaacaaaagccugaauguacuauguuuaaaagacaaaccaa

SEQ ID NO: 281956 - RNA, 66 nt, hsa
aacuacucuaaugcauuugguauguaacuuuaaauuugaauguauucuuguaaaacauccaguauu

SEQ ID NO: 281957 - RNA, 66 nt, hsa
aggcccugggccugcuccuugccaccaaccgaaccgugaauguagggcccccagccucaccucugc

SEQ ID NO: 281958 - RNA, 66 nt, hsa
guugaacagcauggaaucucauugccaaauuauuagugaauguauaguucagguauucuuugagac

SEQ ID NO: 281959 - RNA, 66 nt, hsa
aaaaauuuuauucuuagcacacuguuauguccuaacugaauguauucaguauucaaauaaaagaca

SEQ ID NO: 281960 - RNA, 66 nt, hsa
uuauuuuggauguaaagauuccugugucucauaauaugaauguauuuuuugauauacaagaaacug

SEQ ID NO: 281961 - RNA, 66 nt, hsa
uaucuaauaaggagauuuaagauaagacccaauaaaugaauguauucuguaaugcuuuuaggaugu

SEQ ID NO: 281962 - RNA, 66 nt, hsa
ugcaccaugaaauuaaaaucaucucauuccugaagaugaauguaggaccagacauuuuagcuucac

SEQ ID NO: 281963 - RNA, 66 nt, hsa
gacuccaccucaaaaaauaaaaucaagauaaccucuugaauguaauagcucauagcacuuuaauuu

SEQ ID NO: 281964 - RNA, 66 nt, hsa
gucaaguuagugauugcauuugaucccaaaacaagaugaauguaugcaaugggauguacauaaguu

SEQ ID NO: 281965 - RNA, 66 nt, hsa
gaucuuccuugggccuuuggaaaaauaugugacaagugaauguaagucugugccuggagagcuaau

SEQ ID NO: 281966 - RNA, 66 nt, hsa
acucucagacuauucugaguaaugcuugcuugcuaaugaauguauaggagaccacauuguaauugu

SEQ ID NO: 281967 - RNA, 66 nt, hsa
uuuuuuugaaauuacauugcuuguuuaucagacaauugaauguaguaauucuguucuggauuuaau

SEQ ID NO: 281968 - RNA, 66 nt, hsa
aaaccaaaggcacagauuuguguacaauauacccauugaauguauauccugagaaaaauuggggcc

SEQ ID NO: 281969 - RNA, 66 nt, hsa
auguucugaaaauauggugaugguugcacaccauugugaauguacugaaugccauucagugguacc

SEQ ID NO: 281970 - RNA, 66 nt, hsa
uguucguaaagaaaauuacuucugguauuuaggcugugaauguaccuugaaggggagaguucaugg

SEQ ID NO: 281971 - RNA, 66 nt, hsa
aaaugaaggguugugaguuuaguuucucuccuaaaaugaauguaugcccaccagagcagacaucuu

SEQ ID NO: 281972 - RNA, 66 nt, hsa
aaccuugauauacacagagauggucuuggagaauugugaauguauguacuguauugucaucaagga

SEQ ID NO: 281973 - RNA, 66 nt, hsa
cugagacuaacuuuguauguuaagguuugaacuaagugaauguaucugcagaggaaguauuacaaa

SEQ ID NO: 281974 - RNA, 66 nt, hsa
uacuuacgcagggagaugcaggucucucuaaacgcaugaauguauguaguguguaggcacuguagu

SEQ ID NO: 281975 - RNA, 66 nt, hsa
aauauagaaaaaaacauucuaucuacugauuugggcugaauguauguaaauagguuucuaaaaagu

SEQ ID NO: 281976 - RNA, 66 nt, hsa
cucuguuuauuuuuuauucuaaguacacugauucugugaauguaccuuuuuuauuaacagggaaag

SEQ ID NO: 281977 - RNA, 66 nt, hsa
gaauuauaauuugagaaaaauauuacccaguaacauugaauguagauggcuaaacgauucuuacuc

SEQ ID NO: 281978 - RNA, 66 nt, hsa
gaauaaaguguucuaugaaauucagaacuuuauuucugaauguaacaucccuaauaacaaccuuca

SEQ ID NO: 281979 - RNA, 66 nt, hsa
uugaguuucugacaaauuuguuuuaaaaaucaaauuugaauguacuauucuauaaauugccuuucu

SEQ ID NO: 281980 - RNA, 66 nt, hsa
gaaaacgugugucuggauauuaacucuuguuuaaacugaauguaugauauuuuguuagaauggaaa

SEQ ID NO: 281981 - RNA, 66 nt, hsa
agccaggagagguagagugaaaaucccagccauggaugaauguacuaauuugaaagccaaguguua

SEQ ID NO: 281982 - RNA, 66 nt, hsa
ugaaaccaagaaauguaaucaagcaguaaaaacaucugaauguagaccaugaucucaaguucuucc

SEQ ID NO: 281983 - RNA, 66 nt, hsa
auguuccuaagacccuugucccagauacucuaaaugugaauguaugagcugggggagucaacccag

SEQ ID NO: 281984 - RNA, 66 nt, hsa
aacuuauuucauaauugccuacauuuaucaugguccugaauguagcguguaagcuuguguuucuug

SEQ ID NO: 281985 - RNA, 66 nt, hsa
cccuucuauuccugagggcucagagcugaccaugcaugaauguauggcaguguccacuuuucugua

SEQ ID NO: 281986 - RNA, 66 nt, hsa
gcagaaaaauugacauugcugccuuuaagaauaccaugaauguaagaaauugaaagaaauuguaaa

SEQ ID NO: 281987 - RNA, 66 nt, hsa
cugagugaguccuuuuuuuaugguguccucccucugugaauguacaggcggaacuguacgaacagc

SEQ ID NO: 281988 - RNA, 66 nt, hsa
ugaacacuuaaaucuaacagaggauuuucagaguagugaauguaaggaaagcuuaauggaucucuc

SEQ ID NO: 281989 - RNA, 66 nt, hsa
ucagcaucaaagaauucacacaggagagaaagcacaugaauguaaugaauguggaaaagcuuucag

SEQ ID NO: 281990 - RNA, 66 nt, hsa
ucagcaucacaaaaugcauaggaaagagaaaucguaugaauguaaugaguaugagggcaguuucag

SEQ ID NO: 281991 - RNA, 66 nt, hsa
guucaacaucagagcauucauaccaaagagaacucaugaauguaaugaagaugggaagauauuuau

SEQ ID NO: 281992 - RNA, 66 nt, hsa
gaccaauuuaugggagaauugcacacagaugugaaaugaauguaaucuaauagaagccuaaucagc

SEQ ID NO: 281993 - RNA, 66 nt, hsa
uugcuuauauugacaacaaaucaucucgcuaaagagugaauguaggccaggcgcgguggcucaugc

SEQ ID NO: 281994 - RNA, 66 nt, hsa
uccgucucaaaaaaaaaaaaaaaaaaaaaaaaagagugaauguaauagucuugcagaaaaugaaug

SEQ ID NO: 281995 - RNA, 66 nt, hsa
cauuuaaacuaaaacuaguauaauuuagucuuuucaugaauguacauacauaaaauuauacauaaa

SEQ ID NO: 281996 - RNA, 66 nt, hsa
aggggaagggauuguuguguagucaagucaccaugcugaauguacacugauuccuuuaugaugacu

SEQ ID NO: 281997 - RNA, 66 nt, hsa
gaggccagccggccucucgagagccagagcagcaguugaauguaaugcuggggacaggcaugcugc

SEQ ID NO: 281998 - RNA, 66 nt, hsa
ucuuuacaauuucaaauguuacccugauuguuuauaugaauguagaacaccuugacauuucuuuuu

SEQ ID NO: 281999 - RNA, 66 nt, hsa
aagcaagccauuuaauccgguucuuggagaaacauaugaauguauucgggaggacaagggcuucca

SEQ ID NO: 282000 - RNA, 66 nt, hsa
uuuucagcucaauuguuaaugugauggauggcacaaugaauguauauuuuguguuauucgugaaua

SEQ ID NO: 282001 - RNA, 66 nt, hsa
cccuggacugccggaaucccagcauuagcuuccugcugaauguaguauuuggcauucucugaauuu

SEQ ID NO: 282002 - RNA, 66 nt, hsa
guuccgugguuaaacucgcucacugcuaagaauauuugaauguaugcuucauacagggaugguguu

SEQ ID NO: 282003 - RNA, 66 nt, hsa
gguaaggaugggaauauuuuguuauacuguguauagugaauguauuguacugugucugugaaaacu

SEQ ID NO: 282004 - RNA, 66 nt, hsa
acaaauacuuagaacuggaaggcucuuuguuauuauugaauguaccccucagccuucucagcauuu

SEQ ID NO: 282005 - RNA, 66 nt, hsa
aggacauuugacuuuuauuuuuguauuuaauugacaugaauguaaaggggacagcucaggguuguu

SEQ ID NO: 282006 - RNA, 66 nt, hsa
uaaaaauguagaaauucuucaugaacauaacucugcugaauguaaaagaaaauuuuuuuucaaaaa

SEQ ID NO: 282007 - RNA, 66 nt, hsa
augugucaugaguguuuaaaucaagaggaagcugcaugaauguaaucaacauuccaacuggagcuc

SEQ ID NO: 282008 - RNA, 66 nt, hsa
uauuucuucacugugacagcaaagauuuaaauaagaugaauguaaaagagaaagcuuauuggacuc

SEQ ID NO: 282009 - RNA, 66 nt, hsa
aauuugggauacuaaaguaguuuaagucuccuuuacugaauguaagggggggaucgaaaagaaggu

SEQ ID NO: 282010 - RNA, 66 nt, hsa
caggaccuagcuguuguaaagaauuggucuuaauguugaauguauuuugguugcugauguuuauaa

SEQ ID NO: 282011 - RNA, 66 nt, hsa
auuuuugaacuaaauaguggugauggcuacacauugugaauguaauuaacaccacugaguuaaaca

SEQ ID NO: 282012 - RNA, 66 nt, hsa
uugaugaacuuuggaguacuguuucuuccuucaaacugaauguaauuaauucaugaauaaaugcac

SEQ ID NO: 282013 - RNA, 66 nt, hsa
aaauaaaaaugcuuguauuucuuuaaaaaguaagccugaauguagaguaaaaggggaaaugccaag

SEQ ID NO: 282014 - RNA, 66 nt, hsa
agaaagacuguaacuauugcuggaaauguucuauauugaauguacaugcucuuguuggaaaaaugu

SEQ ID NO: 282015 - RNA, 66 nt, hsa
cuugcuaaaaauauuaagaccaagucaugcaauaauugaauguaccucaaauuuuuaggggagggu

SEQ ID NO: 282016 - RNA, 66 nt, hsa
cucuaaagauuucaaauaguggcagacagugucuucugaauguaaguuuugagaaauacgagucug

SEQ ID NO: 282017 - RNA, 56 nt, hsa; identical to SEQ ID NO: 227330

SEQ ID NO: 282018 - RNA, 66 nt, hsa
cuucagaaguauauagauacuuccggugacuacauaugaauguacuuucaauauuauuuuuuuauu

SEQ ID NO: 282019 - RNA, 66 nt, hsa
gcauauacugcacauacugaaauagagggaaaucacugaauguaaagagguuucaucuaugccccc

SEQ ID NO: 282020 - RNA, 66 nt, hsa
aaccaggacaugagagacauagaaaaacagaagucaugaauguaaauugaaugagaggcuuaacau

SEQ ID NO: 282021 - RNA, 66 nt, hsa
gauaaacuauaucuuggcuaguggcuacugugucugugaauguaaccaguacuucuuuaagcucua

SEQ ID NO: 282022 - RNA, 66 nt, hsa
auuuuagucaugaguuguuuucaguuuucagacgaaugaauguaauaggaaacuauggaguuacca

SEQ ID NO: 282023 - RNA, 66 nt, hsa
uuuuagacuucuuaauaaccuaaauauuuaaaauaaugaauguaacaccuuuuuuaguucacugau

SEQ ID NO: 282024 - RNA, 66 nt, hsa
ugcuggaauuacaguugugagccaccacaccuggcuugaauguagauuuuaauaauugaauuuauu

SEQ ID NO: 282025 - RNA, 66 nt, hsa
uuaccagauucacuucugaauuggccagaggaaaucugaauguauuauccugugugugucuaggua

SEQ ID NO: 282026 - RNA, 66 nt, hsa
ucuggggaaaacaguuguggaauucuuacuucauuaugaauguauuuaaaaaacaaacaccaaaua

SEQ ID NO: 282027 - RNA, 66 nt, hsa
uucaagaaaaaaaaaaaaaaaagaauaugcacagucugaauguauaccaggagugugagagacaca

SEQ ID NO: 282028 - RNA, 66 nt, hsa
cuggcagcauaauuuugugguuaagagaaugaauucugaauguacacuuucugucucaaacccugg

SEQ ID NO: 282029 - RNA, 66 nt, hsa
guugcucucugccacagcuugcagcauggucuugacugaauguacuguuccuguuagcguuacuuc

SEQ ID NO: 282030 - RNA, 66 nt, hsa
gccuacugugugcaaaguguuucauguauaucucauugaauguauacagccacccuguugugguau

SEQ ID NO: 282031 - RNA, 66 nt, hsa
cuuucagugaaagaggaaggaaaggaguagggcuagugaauguaucugccaggucuuagaagucag

SEQ ID NO: 282032 - RNA, 66 nt, hsa
cacuuuagguauuacuacauaguugaaggauuuaacugaauguauggaucaaauuuauuuauuuga

SEQ ID NO: 282033 - RNA, 66 nt, hsa
aaauguugacaggcaaauuucauacccaugucagauugaauguauuuaaauguauguauuuaagga

SEQ ID NO: 282034 - RNA, 66 nt, hsa
agacuaguaaauugucugccuccuauagcagaaaggugaauguacaaacuguugguggcccugaau

SEQ ID NO: 282035 - RNA, 66 nt, hsa
ggaagcugauuugcaacauuugcuaaauggauuagaugaauguacuucuuuuugugagcuuacuug

SEQ ID NO: 282036 - RNA, 66 nt, hsa
ugggagaaaaacauuuuagauauguauuacuauacaugaauguauuauacacacacacuuuagaga

SEQ ID NO: 282037 - RNA, 66 nt, hsa
auauaaauuaucugaauauuagaugcucugagaaauugaauguaccuuauuuaaaagauuuuaugg

SEQ ID NO: 282038 - RNA, 66 nt, hsa
aaucauuuggguuugaggguguguuauuuugagucaugaauguacaagcucugugaaucagaccag

SEQ ID NO: 282039 - RNA, 66 nt, hsa
ugcguucuggcuaacacuguuggaccugacccacacugaauguagucuuucaguacgagacaaagu

SEQ ID NO: 282040 - RNA, 66 nt, hsa
aggcuauuucaaaggaaccagccaacguaugagaaaugaauguaacacuguggacauugacuuccc

SEQ ID NO: 282041 - RNA, 66 nt, hsa
uaagcugcuaauuguuccuguuggggugacagauacugaauguauacguauugugccugagcucac

SEQ ID NO: 282042 - RNA, 66 nt, hsa
gggucuuuuauuuguacccaugugucugucacaccaugaauguaccuggggaaaucaacugaccuc

SEQ ID NO: 282043 - RNA, 66 nt, hsa
aauaauuguugacuuucuuagauucacuuccauaugugaauguaagcucuuaacuaugucucuuug

SEQ ID NO: 282044 - RNA, 66 nt, hsa
ucaaaaugagaugcacucauuuaaaucugcauucagugaauguauugggagaaaaauaggucuugc

SEQ ID NO: 282045 - RNA, 66 nt, hsa
ccuuaauauuaauggacuguuucagguaaaagagaaugaauguaugauugugaacugugaagagaa

SEQ ID NO: 282046 - RNA, 66 nt, hsa
ugccgccaguucucaaguuuuccuccuaacuccauuugaauguaagggcagcuggcccccaaugug

SEQ ID NO: 282047 - RNA, 66 nt, hsa
gauucugaaccacuagaguuuccuugauucagacuuugaauguacuguucuauaguuuuucaggau

SEQ ID NO: 282048 - RNA, 66 nt, hsa
auauuuggcaggugaguggauggauagauggauaggugaauguagguggacaggugacugggugga

SEQ ID NO: 282049 - RNA, 66 nt, hsa
uuuuuauguaauaucauguguaccuuuacauuguggugaauguaacaauauauguucuucauauuu

SEQ ID NO: 282050 - RNA, 66 nt, hsa
cgcauucaguggccuaucuccagauugucugauuucugaauguaaaguuguuguguuuuuuuuuaa

SEQ ID NO: 282051 - RNA, 66 nt, hsa
gaaccucccccauuuaaauacucagaagauaaggugugaauguauguauuauuagaguccgaaagu

SEQ ID NO: 282052 - RNA, 66 nt, hsa
gauaucagagauacacaaaaaaccaauugaggguagugaauguaagaagacagucccagaaguaaa

SEQ ID NO: 282053 - RNA, 66 nt, hsa
uuuuaacaauucuccuuaaaagauauuuuggagugaugaauguaguuuacuuuuguauuugaauuu

SEQ ID NO: 282054 - RNA, 66 nt, hsa
accucauuuuucuauauauuuauuucacgacagaguugaauguauggccuucaacaugaugcacau

SEQ ID NO: 282055 - RNA, 66 nt, hsa
acccuuaguaccaaauacacucaauugccuuuuuaaugaauguacuugucuuggauagguugcugg

SEQ ID NO: 282056 - RNA, 66 nt, hsa
caagugaguuuaacaaagaaacauuuagaauagaucugaauguaagaacuacagaacuguuucaga

SEQ ID NO: 282057 - RNA, 66 nt, hsa
aacuuuuuuuuuuuaacacacuaaucuucaguuggaugaauguaauguauaacuauguuuucagca

SEQ ID NO: 282058 - RNA, 66 nt, hsa
aauaaccuauuguuagaaaauauguguuuuuauaaaugaauguaaaauaauuaaaugaauugugaa

SEQ ID NO: 282059 - RNA, 66 nt, hsa
uucaaaggagcugaauguguuaugcuuccaaacaacugaauguaaaacacuccuagccaguuguug

SEQ ID NO: 282060 - RNA, 66 nt, hsa
uacugaccuguuguaggcagcuaucuuacagacgcaugaauguaagaguaggaagggguggguguc

SEQ ID NO: 282061 - RNA, 66 nt, hsa
cauucuacccucuuuuuccugcuaauccugucauaaugaauguagcuucucaguucacuguauaug

SEQ ID NO: 282062 - RNA, 66 nt, hsa
acacuaacgacuucagggcagggcucugauauuccaugaauguaucaggaaauauauaugugugug

SEQ ID NO: 282063 - RNA, 57 nt, hsa; identical to SEQ ID NO: 227376

SEQ ID NO: 282064 - RNA, 66 nt, hsa
auuaugcucuggcaucuaacauaugauucuguaguaugaauguaaucaguguauguuaguacaaau

SEQ ID NO: 282065 - RNA, 66 nt, hsa
ccaauuuucaguauuuuaacuaccucaauaaugcuaugaauguaagauauugggauagagauccca

SEQ ID NO: 282066 - RNA, 66 nt, hsa
agcagguaaauugucgggggagagaguuagcauguaugaauguaaggaugagggaagcgaagcaag

SEQ ID NO: 282067 - RNA, 66 nt, hsa
uuaagugcccacauuugauggaggguggaaauaauuugaauguauuugauuuauaaguuuuuuuuu

SEQ ID NO: 282068 - RNA, 66 nt, hsa
gcccuucacccaaccucucccaccuccaccccacaaugaauguauuuauugugagaauggcuacac

SEQ ID NO: 282069 - RNA, 66 nt, hsa
cccuguccagcacagcuucuggcacaggaugcuuggugaauguacccuuucuuucccucccugcag

SEQ ID NO: 282070 - RNA, 66 nt, hsa
gacugacggggaaaaaaaaaaaaaaagaauggggugugaauguaccaacacugaaucuuacagcag

SEQ ID NO: 282071 - RNA, 66 nt, hsa
cucuauuaccaauuuuucagaacucauagauaaauaugaauguagggaagcuguaagccagcccau

SEQ ID NO: 282072 - RNA, 66 nt, hsa
gcacaugcuuuaagauuucuauccaucuuucagaguugaauguaauaauguuugguauuuaauucu

SEQ ID NO: 282073 - RNA, 66 nt, hsa
uagggcaguuuggugcaauuuauguuaaaugccauuugaauguaaucaccuguguuaccacgaaug

SEQ ID NO: 282074 - RNA, 66 nt, hsa
guucuguggguuugggugggaagagggccaucugccugaauguaaccugcuagcucuccgaaggcc

SEQ ID NO: 282075 - RNA, 66 nt, hsa
cuugaugccaguaaucuauaagggaucuuuauaguuugaauguauuugaauaacuucaguauacuu

SEQ ID NO: 282076 - RNA, 66 nt, hsa
auagauccauuuugugccacacuccauuguagacuuugaauguaguagucuuuccaagagccuacu

SEQ ID NO: 282077 - RNA, 66 nt, hsa
ugaggguaaauggagaaaauauuucugggauuacaaugaauguaagcccaaauuguggaauugcca

SEQ ID NO: 282078 - RNA, 66 nt, hsa
auguucugcauugagccuaguuuugccauuguccccugaauguaguauuaucuauagauuauacau

SEQ ID NO: 282079 - RNA, 66 nt, hsa
auaguaugggaauuauuuuuuauguuaaauagaaacugaauguacuggguugaaugguguccucuc

SEQ ID NO: 282080 - RNA, 66 nt, hsa
uugcauggagugaccauagcuccuucucucuuacauugaauguagagaauguagccauuguagcag

SEQ ID NO: 282081 - RNA, 66 nt, hsa
caaaaauccuuuuauggaaaccauuuuuuuaaaaagugaauguacacaaauccacagaggacugug

SEQ ID NO: 282082 - RNA, 66 nt, hsa
aaaucauguucuuauaccuaauuuuagucuuucaaaugaauguacuguaaugcuuguauguauaaa

SEQ ID NO: 282083 - RNA, 66 nt, hsa
agccccuucaggaaggaccccccaaagcugaggggcugaauguagccuuuucaacagagaaggcuc

SEQ ID NO: 282084 - RNA, 66 nt, hsa
aaucucaucguaaggcagcuaguucuaauuugcauuugaauguauaacaaauugcaucacuuuuca

SEQ ID NO: 282085 - RNA, 66 nt, hsa
uuuagaguugucuuucagcauucaaucaggcugagcugaauguagugauguuuacauuguuuacau

SEQ ID NO: 282086 - RNA, 66 nt, hsa
gcuucaucucuuuagagaaguccaagcaacagccuuugaauguaaccaauccuacuaauaaaccag

SEQ ID NO: 282087 - RNA, 66 nt, hsa
caaaaggauggucacucuuccgaggucucccugaaaugaauguauuucucccccaaaagagcugau

SEQ ID NO: 282088 - RNA, 66 nt, hsa
uacagaugcagaagguuucucuggauagcacaccucugaauguaaaucaugauaaaauggauauuu

SEQ ID NO: 282089 - RNA, 66 nt, hsa
ucauuuuuuaaugugcucuguaccugucaaaaauuuugaauguacaccacaugcuauugucugaac

SEQ ID NO: 282090 - RNA, 66 nt, hsa
ccugaaagaugcuaaucuauuugccaaacuuggucuugaauguacugggggcuucaagguaugggu

SEQ ID NO: 282091 - RNA, 66 nt, hsa
ucccaacuggggcuccuggggguacaggaauccuuaugaauguauagaaugcauacugccuaggcc

SEQ ID NO: 282092 - RNA, 66 nt, hsa
ccuguuccaaaacaaaauucaccuccuuucuuuaugugaauguauucuccauaaaauuccaguauu

SEQ ID NO: 282093 - RNA, 66 nt, hsa
cccaggccucgggaccaacucuuuguauaaccuaccugaauguauuaaaaacuaauuuuggagaag

SEQ ID NO: 282094 - RNA, 66 nt, hsa
auucuuuucccagaagagucuuugauucaccaaacaugaauguacauuuucuaacaaacucaaaau

SEQ ID NO: 282095 - RNA, 66 nt, hsa
cgugugugacuuugagcaaaaagugacuucuuuuugugaauguaaaauuugugaaacuugaguuuu

SEQ ID NO: 282096 - RNA, 66 nt, hsa
gggagcauuuacagaugaauccccacacuuagccauugaauguaaaggggaaaaauaaggugagaa

SEQ ID NO: 282097 - RNA, 66 nt, hsa
aguaguauaauuuguuacuuucaaauacccguacuuugaauguagguuuuuuuguuguuguuaucu

SEQ ID NO: 282098 - RNA, 66 nt, hsa
cuuuguauuguaguaaccaauaugugcaguauacguugaauguauaugaacauacuuuccuauuuc

SEQ ID NO: 282099 - RNA, 66 nt, hsa
uaucccaagauccuggggaaaggagagaccauggugugaauguagagaugccaccucccucucucu

SEQ ID NO: 282100 - RNA, 66 nt, hsa
aaucauuauuuauuuuuuuguaguaguaaugucauaugaauguaucuuaaaacgugugcccuuuua

SEQ ID NO: 282101 - RNA, 66 nt, hsa
uccuuucuaggcuuggagauggcuuugguugguccgugaauguaguuaugagagugcugccauuaa

SEQ ID NO: 282102 - RNA, 66 nt, hsa
cuuaauguugagcuaagaagcauuaagucuuugaacugaauguauuuugcaucccugguuuuggac

SEQ ID NO: 282103 - RNA, 66 nt, hsa
aggugucugccccgcguuuccugccugcggaccagaugaauguagcagauccccagccucuggccu

SEQ ID NO: 282104 - RNA, 66 nt, hsa
uaugauacuaguaauucauaagggaucuguguaaucugaauguauuugaauaacuuuagcucuacu

SEQ ID NO: 282105 - RNA, 66 nt, hsa
auuuucaggucauuuccugauagucuagucagcuuaugaauguaagcaaaacaggaccaaugaaag

SEQ ID NO: 282106 - RNA, 66 nt, hsa
cgaaagacugaggcauuuuccagucuacuugccuaaugaauguauaggaacugucuaugaguaugg

SEQ ID NO: 282107 - RNA, 66 nt, hsa
gccacagcucaggaaaaagaugaggcauaacgaccuugaauguaauuggaguaagugacaaaauaa

SEQ ID NO: 282108 - RNA, 66 nt, hsa
auaagaaaaaaauuugccuuuaagaguuacuuuuguugaauguauuugacuuaguucuuauuuuaa

SEQ ID NO: 282109 - RNA, 66 nt, hsa
ugucuucucuucauuaccuuuuaaggacagugucuuugaauguagggcccacccugaucuagggug

SEQ ID NO: 282110 - RNA, 66 nt, hsa
caaaucuguugucauguuaguaaaugauuugaaaacugaauguaauacuugaguagauuuuuuuuu

SEQ ID NO: 282111 - RNA, 66 nt, hsa
gugacauagaguaaacaucuuaguaauauauuaaagugaauguaaauggugguuaaaauuacauua

SEQ ID NO: 282112 - RNA, 66 nt, hsa
ugcuucuaaccccaguagaguagaacuaaauugcacugaauguauaguuaacucugucuugaauuc

SEQ ID NO: 282113 - RNA, 66 nt, hsa
uaauaauuuuuugucauuugucuuuauguccagcuaugaauguagauuuugugucccgacagcccu

SEQ ID NO: 282114 - RNA, 66 nt, hsa
gcuuagugacccccaucuuguaaccuguugcaagagugaauguaaaaaauaguuguggcauuuuaa

SEQ ID NO: 282115 - RNA, 66 nt, hsa
aguugaacacacuaugaagaauuccagguguacuagugaauguaauuuauaguugccaaaaaaaaa

SEQ ID NO: 282116 - RNA, 66 nt, hsa
uuuacccucauauucuuuaaaaaacuuaaagcauuaugaauguagagaaauucaccagagcucacu

SEQ ID NO: 282117 - RNA, 57 nt, hsa; identical to SEQ ID NO: 227430

SEQ ID NO: 282118 - RNA, 66 nt, hsa
uggguuuuuuaguugaauuuuuuuuaacauuccucaugaauguaaauuuguacuauuuaacugacu

SEQ ID NO: 282119 - RNA, 66 nt, hsa
aggauuugggcugccccaggcccacccagggggcucugaauguauuuuguaccguguuucuuuccc

SEQ ID NO: 282120 - RNA, 66 nt, hsa
acccacugcucugaugggugguuuguccaaggaugcugaauguaaugccuggucaauguggaagcc

SEQ ID NO: 282121 - RNA, 66 nt, hsa
cugcccuugaggagcacaggcagaagugugaacuugugaauguaauugaucuuuccuuccuuccag

SEQ ID NO: 282122 - RNA, 66 nt, hsa
acaucguuaacggguaccauuaaauauucugagaggugaauguaaaauauaaaagguauagguuuu

SEQ ID NO: 282123 - RNA, 66 nt, hsa
uuauuagucauguauauuuuaaaugcuaacauuugaugaauguaaguuuccacauuguugcuguuu

SEQ ID NO: 282124 - RNA, 66 nt, hsa
ucacauauuuuucacuugaauuuuuuuggaaauagcugaauguaaauagcagggaggaagaagcaa

SEQ ID NO: 282125 - RNA, 66 nt, hsa
ugaacaccagugaauuuacacugcaaagaaaaacuaugaauguauggaauuuuuuaaaaagaagua

SEQ ID NO: 282126 - RNA, 66 nt, hsa
uuaauacucuuguaggagaaaaagcaacuguauaaaugaauguagagugacuuucugcaauauuuc

SEQ ID NO: 282127 - RNA, 66 nt, hsa
uuguuacucugguucuuuguuuuaaaauaaaaauucugaauguacacgacauuaugggcuuauuua

SEQ ID NO: 282128 - RNA, 66 nt, hsa
ugagucaaugugcaguguagcccacacuugagaggaugaauguaugugcacugucacuuugcucug

SEQ ID NO: 282129 - RNA, 66 nt, hsa
cacuauuggaaggaguuagauguugguacuagauacugaauguaaacaaaggaauuauggcuggua

SEQ ID NO: 282130 - RNA, 66 nt, hsa
aauuguuaaacauuuagacaaacauauauguauguaugaauguacauaaauauuuuuaacuccuau

SEQ ID NO: 282131 - RNA, 66 nt, hsa
uucuaggcaucauguccuauaguuugucaucccugaugaauguaaaguuacacuguucacaaaggu

SEQ ID NO: 282132 - RNA, 66 nt, hsa
ugugaccugguuaccuuggaaaugcaggaacuuauaugaauguacuauaaaauaaaaugcggacug

SEQ ID NO: 282133 - RNA, 66 nt, hsa
uuuauaaauugugauguagccucgcuagucaagcugugaauguauauuguuugcacuuaauccuua

SEQ ID NO: 282134 - RNA, 66 nt, hsa
ugccuaaaaugugaaagcauauuuuguauccuaaaaugaauguaugauauucuaaacaucuguuuu

SEQ ID NO: 282135 - RNA, 66 nt, hsa
uuaguuuuuuuuuaaaugcuuguucuaagacauuucugaauguagaccauuuuccaaaaaggaaac

SEQ ID NO: 282136 - RNA, 66 nt, hsa
augguuuauuuugaugaaaguucuuuuaacaugucuugaauguacacauaaaggaauccaaagcuu

SEQ ID NO: 282137 - RNA, 66 nt, hsa
uuacagagcuauguaaagggacuuaggagaaaaugcugaauguaagauggucccauuucaauuucc

SEQ ID NO: 282138 - RNA, 66 nt, hsa
guguagggcauuuucugauugcacuuccuuaaguuaugaauguacuagaaagggacucauccagaa

SEQ ID NO: 282139 - RNA, 66 nt, hsa
uucaguuuucuuuuuuauuuugguuaugcuuaaauaugaauguaauuaccaaaagauuuagaagug

SEQ ID NO: 282140 - RNA, 66 nt, hsa
cuuacauuugaguaugguaacuuaugucaucuauguugaauguaagcuuauaaagcacaaagcaua

SEQ ID NO: 282141 - RNA, 66 nt, hsa
uggugggaagguuuugcugcuaauguauuuauggaaugaauguauuucauucaaaucuguauuccu

SEQ ID NO: 282142 - RNA, 66 nt, hsa
caaucucccuucacaaguuuuuuuacuguuuuuagaugaauguacgaugagaaauucaacguuaau

SEQ ID NO: 282143 - RNA, 66 nt, hsa
guaauacaaccucagugugucauugggcaguuuaaaugaauguacauuccugaggcaucagaacuu

SEQ ID NO: 282144 - RNA, 66 nt, hsa
agguuaggagacuaaaauauaaauuaaguugugauuugaauguagauugguaucaccuccaacucc

SEQ ID NO: 282145 - RNA, 66 nt, hsa
gaguaagaaacuguccgauaugaaucacaacgugggugaauguaguauuuuccugaagugugaaag

SEQ ID NO: 282146 - RNA, 66 nt, hsa
acauauuagugauugaaguauuuugacuuuugagauugaauguaaaauauuuuaaauuugggauca

SEQ ID NO: 282147 - RNA, 66 nt, hsa
uagcacacacauacacaccaccaccaacaacgcuugugaauguauuuuucuguuagcuggguuuac

SEQ ID NO: 282148 - RNA, 66 nt, hsa
aaaguguucauugcacaauauauuuuuacugcuuucugaauguagacggaacaguguggaagcaga

SEQ ID NO: 282149 - RNA, 66 nt, hsa
uuguuuagagagccugucaccagagcuucucugggcugaauguaugucagugcuauaaaugccaga

SEQ ID NO: 282150 - RNA, 66 nt, hsa
aucagaauuaaauuuguauagagcagaguuuuaaaaugaauguaaauagcacuaaacguuuucuuu

SEQ ID NO: 282151 - RNA, 66 nt, hsa
cccaagucugagucccaguuacuugggaggaucacuugaauguaggaucacuugagucuaggaguu

SEQ ID NO: 282152 - RNA, 66 nt, hsa
gagcaucuuuguauauugcaauauacuugaaaaaaaugaauguauuuuuuucuccaaagaacagca

SEQ ID NO: 282153 - RNA, 66 nt, hsa
cuuuuuuuuaauacauauccaauaaugccuuccaucugaauguaaaauaaguacccaugauuucua

SEQ ID NO: 282154 - RNA, 66 nt, hsa
guuggcuacgcagggaugggcaguugcacgaaggcaugaauguauuguaaauaaguaacuuugacu

SEQ ID NO: 282155 - RNA, 66 nt, hsa
aguauuaugucuuuauuguuguuaaaaaguuuuuauugaauguaugaaaauuaucaaauuguauuc

SEQ ID NO: 282156 - RNA, 66 nt, hsa
agacaauagcccaaagccaagaaagaaaaauuaucuugaauguaguauucaaugauuuuuuaugau

SEQ ID NO: 282157 - RNA, 66 nt, hsa
aacuuuagaacagaggauuguauugcaagacaaaguugaauguaaagugaucucccugaacauuuu

SEQ ID NO: 282158 - RNA, 66 nt, hsa
uuuugacauggaugauucugaggaggaagcuguuauugaauguauagagauuuauccaaauaaaua

SEQ ID NO: 282159 - RNA, 66 nt, hsa
auuuguauugaaaugaaaccaccaguguuaucaacuugaauguaaauguacaugugcagauauucc

SEQ ID NO: 282160 - RNA, 66 nt, hsa
aguagaccugaccuuguuauuuauuagauaacauuuugaauguauccauuggauuucuaaaaugua

SEQ ID NO: 282161 - RNA, 66 nt, hsa
ucaucacaguauuguuaggagauuuaaaugaauuagugaauguaagauacuuuagaaagcauguaa

SEQ ID NO: 282162 - RNA, 66 nt, hsa
cauggccuaagaaauaaggaucaauaaggaaugauuugaauguaauuuugugaauguguggaaaau

SEQ ID NO: 282163 - RNA, 66 nt, hsa
auccauuccuacuguauuucuguaugaauguguuugugaauguauguguaaaagucuuucuuuucc

SEQ ID NO: 282164 - RNA, 66 nt, hsa
uugaugcacuuugaauauugagauauuuugcacggaugaauguaugggaacuacccaugaugaugu

SEQ ID NO: 282165 - RNA, 66 nt, hsa
gcaaauuccuguacauagagauauauuuuuuaagugugaauguaacaacauacugugaauuccauc

SEQ ID NO: 282166 - RNA, 66 nt, hsa
ccaugacgcgccaggcacaguucugcaaguauauugugaauguauuguucuagugggauacacaaa

SEQ ID NO: 282167 - RNA, 66 nt, hsa
guauaauuuguuaacacuagaaaccuauuaguauugugaauguagauuuuacugugaagcuaucug

SEQ ID NO: 282168 - RNA, 66 nt, hsa
ccugccauuuuaccagcauuauuguaguuuaaugauugaauguagacagggauaugcguauaguuu

SEQ ID NO: 282169 - RNA, 66 nt, hsa
gaaaaaaaaaacaugcaccuguuucacugugaauagugaauguaaaggaaagaaaggaaaaacuga

SEQ ID NO: 282170 - RNA, 66 nt, hsa
uauaaauuuguauuuauguguauauaaaauguacaaugaauguaaauaugacuuucuggaaaguuu

SEQ ID NO: 282171 - RNA, 66 nt, hsa
cuuuuuuccccucacauugaauuuuaauuccauucuugaauguagaaauuucagauucucuaaaac

SEQ ID NO: 282172 - RNA, 66 nt, hsa
guuaauguaaacagaacuggcacacacacauuaagaugaauguaauuauuauuccucuugcugguc

SEQ ID NO: 282173 - RNA, 66 nt, hsa
auucuacucuucuaagcuuacagagaccagaccaggugaauguaacuggggaaaaucaagauggua

SEQ ID NO: 282174 - RNA, 66 nt, hsa
ccuucacucagagaagcaaggcugauauuagcuuguugaauguaagagacacaaaugaagaagaac

SEQ ID NO: 282175 - RNA, 66 nt, hsa
caaugucagguuauacuaaaacuaaaucagaaagucugaauguagcacauaaugguucucuucugu

SEQ ID NO: 282176 - RNA, 66 nt, hsa
uugcagugagcaucacuacagucucagucaacagugugaauguaucauguuuuacuuuaaaugugu

SEQ ID NO: 282177 - RNA, 66 nt, hsa
gguccuugugacuucaacggacucuuccaaauuguaugaauguaucaauguauuagauaaacccag

SEQ ID NO: 282178 - RNA, 66 nt, hsa
uucauuagggcuugcagacaaugucaccuaaauugcugaauguacucauuauaauaugauaucuga

SEQ ID NO: 282179 - RNA, 66 nt, hsa
uacuuugcaguaaguaucauguaaauaugcaaauguugaauguaauauagauuguguccucauuga

SEQ ID NO: 282180 - RNA, 66 nt, hsa
aauuaaaaaguuucaaaucuagacacuaaaugugugugaauguacaaagaaaacaaaccauugcuu

SEQ ID NO: 282181 - RNA, 66 nt, hsa
ugcggggcagcguggccccaccggacuagcacaugaugaauguaaaguuggcacaaugaaaaugac

SEQ ID NO: 282182 - RNA, 66 nt, hsa
auaaugcccuuuagggcacaacuaguuaucaguaacugaauguaucuuaaucauuauggcugcuuc

SEQ ID NO: 282183 - RNA, 58 nt, hsa; identical to SEQ ID NO: 227496

SEQ ID NO: 282184 - RNA, 66 nt, hsa; identical to SEQ ID NO: 282177

SEQ ID NO: 282185 - RNA, 66 nt, hsa
guauauauaaaaaucuugagaugguagaaacauguaugaauguacuaaguaguauuccacuguacu

SEQ ID NO: 282186 - RNA, 66 nt, hsa
cagguaacaaauuuggggaagacagcacaaucuucuugaauguagcucuugggaaugcauuauuac

SEQ ID NO: 282187 - RNA, 66 nt, hsa
accauccucucccauaagcacccaugucuuugaauaugaauguauuuguaaaauaccacguuucau

SEQ ID NO: 282188 - RNA, 66 nt, hsa
ucuccuccucuccccaccuuugccauucuuaaguauugaauguacuuuguauaauuuuaguggaau

SEQ ID NO: 282189 - RNA, 66 nt, hsa
uacauugacauucauuccuauuuuacugggcaccuaugaauguaugcugugugcuagaaauagacu

SEQ ID NO: 282190 - RNA, 66 nt, hsa
cagggguucucaauggaaaaacgaaugcucuuacacugaauguacaggcagugggcuugcagcacu

SEQ ID NO: 282191 - RNA, 66 nt, hsa
acuuguuugaauuaauuguauuguaauauuauuuguugaauguaguaauuagguauuuaugaauau

SEQ ID NO: 282192 - RNA, 66 nt, hsa
uggguuacuaaccuugaaauguaagagaucugguuuugaauguaaaaguugcaacacacaaacgga

SEQ ID NO: 282193 - RNA, 66 nt, hsa
ggggaaaggaguuugaaugugucuauuuuuuucuagugaauguauuuuaaccacaguguccuaaac

SEQ ID NO: 282194 - RNA, 66 nt, hsa
gaaugaaguagaggugacucucucugugguacacauugaauguacuauguauguucaaguauucag

SEQ ID NO: 282195 - RNA, 66 nt, hsa
uuacauaaauucuacuuuauuccucaacuucuuugaugaauguaacccaauuuuacuucuuuaaaa

SEQ ID NO: 282196 - RNA, 66 nt, hsa
ggggagagagccgcgggguccugcccgugguuacuaugaauguauugcuguuggaggacaucucga

SEQ ID NO: 282197 - RNA, 66 nt, hsa
ccgccagaggccugaagcugagcguguacguuaaugugaauguauauagucuuugcagagguccaa

SEQ ID NO: 282198 - RNA, 66 nt, hsa
cgccgcugugugucuuagcauggaaauaaauaaaccugaauguacgugcucgccucuggccugugu

SEQ ID NO: 282199 - RNA, 66 nt, hsa
ccuuuauuugcacgucaggggagccggcuccccccuugaauguaccagacccuggggggggucacu

SEQ ID NO: 282200 - RNA, 66 nt, hsa
aacuuucuggauuucucuugaagugcuacacugcacugaauguaaggaauuguugcuuguggaagu

SEQ ID NO: 282201 - RNA, 66 nt, hsa
uuugucagacuuccaaauccuggaaggacacagugaugaauguacuaugucugaacauagaaacuc

SEQ ID NO: 282202 - RNA, 66 nt, hsa
acuuucuaauuaggcauuuuauguuagucacagucuugaauguauaaacagcacuaagacucucag

SEQ ID NO: 282203 - RNA, 66 nt, hsa
aaacaagacuuucccagcuuguauuaccuagaagcgugaauguauaggauaccugacuacuaagac

SEQ ID NO: 282204 - RNA, 66 nt, hsa
uguugauguuuuaacucuaucugucauacauccuagugaauguaaaaugcaaaauccuggugaugu

SEQ ID NO: 282205 - RNA, 66 nt, hsa
uccugcggcucagccuugcacacccacugccccgugugaauguagcuuccaccucauggauugcca

SEQ ID NO: 282206 - RNA, 66 nt, hsa
ugacaucuacauuuuuuaaaacugaaucuuaaucgaugaauguaaacucgggggugcuggggccag

SEQ ID NO: 282207 - RNA, 66 nt, hsa
uuggagucuucuuucaaaccaguggggguuggacaaugaauguaguuaacugguuccugcucacac

SEQ ID NO: 282208 - RNA, 66 nt, hsa
caucaaggcgccuuuccuaauaauaugguucaacugugaauguagaagugggggggaggggggaga

SEQ ID NO: 282209 - RNA, 66 nt, hsa
agagagacccugcaagaccacggagggagcgacacuugaauguagaauaggcagggggcccugccc

SEQ ID NO: 282210 - RNA, 66 nt, hsa
aauucugaauagaugaaagcauaaaaugugagaaacugaauguauuauucaggaagaauacugagu

SEQ ID NO: 282211 - RNA, 66 nt, hsa
caggaagaauacugagugccuucauuuaacuaaaguugaauguaaaagucaauuugcacuucuuua

SEQ ID NO: 282212 - RNA, 66 nt, hsa
aacguaugugcucuuauaaaguggacuucugaaaaaugaauguaaaagacacugguguaucucaga

SEQ ID NO: 282213 - RNA, 66 nt, hsa
uauuuaguugacuguauuauuugauuucggauugaaugaauguaaauagaaauuaaaugcaaauuu

SEQ ID NO: 282214 - RNA, 66 nt, hsa
aagguucaucuguccaugcaguccucuuggauucucugaauguaguaacuaugaagcuaugccaaa

SEQ ID NO: 282215 - RNA, 66 nt, hsa
ccaaagccuucguuguauguugacgaugcacuuuuaugaauguaguuucuaucgcuguuuuuagcc

SEQ ID NO: 282216 - RNA, 66 nt, hsa
aagauuucaaauccaggggauuccaugcucaauggaugaauguagacacaaaacagcaacacuugu

SEQ ID NO: 282217 - RNA, 66 nt, hsa
ccugucacugaggguuuugguuggcaucguuguuuuugaauguagcacaagcgaugagcaaacucu

SEQ ID NO: 282218 - RNA, 66 nt, hsa
uccugacuugccuuauuuauuuguucgacgcgucucugaauguauccgccucgguucccaccacug

SEQ ID NO: 282219 - RNA, 66 nt, hsa
uggucuuggccacagccugagugacgaauuuccuacugaauguaccaaguuccaauuuuuaagggg

SEQ ID NO: 282220 - RNA, 66 nt, hsa
ugauuucaacccaggugccccuggccuggccagcagugaauguaggagaugaauugugcaagugac

SEQ ID NO: 282221 - RNA, 66 nt, hsa
ucccuauguagcaacagugguuagaugaucuuugucugaauguaauuaaacuuugaauaguuuuag

SEQ ID NO: 282222 - RNA, 66 nt, hsa
ccaucaggacucagaccccaggccgagaucuugcccugaauguacccugccucugcuuucuccugc

SEQ ID NO: 282223 - RNA, 66 nt, hsa
accuuccacacagggugcaugugaggaugaaaggagugaauguauaaagacaccuuucccgauaac

SEQ ID NO: 282224 - RNA, 66 nt, hsa
augagaacagcaguuuauuacucacuaaagacagaaugaauguagaaaaggcugaauucuguaaua

SEQ ID NO: 282225 - RNA, 66 nt, hsa
aacuuguuuauccaacuaaguguccaaaaccuaaauugaauguacuaaguuuucacaugucccauu

SEQ ID NO: 282226 - RNA, 66 nt, hsa
aaugucuaaacuauaagcuuccaacuauuaccugcuugaauguaaauauuaaauggagauguugaa

SEQ ID NO: 282227 - RNA, 66 nt, hsa
auauagcauuuuucaacauuuaauggucuguacaguugaauguaaguguucaauauguauugcuga

SEQ ID NO: 282228 - RNA, 66 nt, hsa
aaucauuugcauaagauuuaacagcauuuuuuauaaugaauguaaacauuuuaacuuaaugguacu

SEQ ID NO: 282229 - RNA, 66 nt, hsa
ucuccauuacacgaucaccugcaucacagcccauggugaauguauguuucugcauagcgaaauaaa

SEQ ID NO: 282230 - RNA, 66 nt, hsa
ucuccugaguggaugacaggucuucauucucuaucuugaauguauuaugguuacuaauaguuuuau

SEQ ID NO: 282231 - RNA, 66 nt, hsa
agagaaauuuuaaaauaauagaagaaauagaaauuuugaauguauaaaagaaaaagaucaaguugu

SEQ ID NO: 282232 - RNA, 66 nt, hsa
guaugcugauaaauguaagauuaguaggaggagaagugaauguaaauuuuauuauagaauuuucug

SEQ ID NO: 282233 - RNA, 66 nt, hsa
gcauuuuccuuauuguuaaaaacauguuagaagcaaugaauguauauaaaagccucaacuagucau

SEQ ID NO: 282234 - RNA, 66 nt, hsa
ugucccucuguaauuucaaaaugaaugaaauucaugugaauguagguugagagggcacugaagacc

SEQ ID NO: 282235 - RNA, 66 nt, hsa
uucacaaacaaacaaaggaggggggagcagguuuuaugaauguaacugugcacaggaaaugacugg

SEQ ID NO: 282236 - RNA, 66 nt, hsa
gggcgcgggggggaggcuggggucccgccgccgugaugaauguacugacgagccgaggcagcagug

SEQ ID NO: 282237 - RNA, 66 nt, hsa
ucagaucuuaacaauuccaauagaagagaagacauaugaauguaaggaaugugggaaaaucuuggc

SEQ ID NO: 282238 - RNA, 66 nt, hsa
uauucagcugugaucucacaagugugaaaaaucuuaugaauguaaaauguguggagauucuucuuu

SEQ ID NO: 282239 - RNA, 66 nt, hsa
ugucugggucauucaggcaguacaucugaauuaagcugaauguagacaaauaaagaaaaacaaaac

SEQ ID NO: 282240 - RNA, 66 nt, hsa
ggggcccccuccccaccaaaggguucaccucacacuugaauguacaacccaccccacugucgggaa

SEQ ID NO: 282241 - RNA, 66 nt, hsa
guuacaugaaagauuucaaacugcagagaaccacuaugaauguaaacaaugugguaaagcauuuag

SEQ ID NO: 282242 - RNA, 66 nt, hsa
auuucauaaaaggacacacacuggagagaaacccugugaauguaagaaauguagaaaagcauucca

SEQ ID NO: 282243 - RNA, 66 nt, hsa
aauacaugaaaggaugcacagaggagagaagcucugugaauguaagcauugugggaaagcauucau

SEQ ID NO: 282244 - RNA, 66 nt, hsa
aauacaugcaagaacacacaauggagagaaacccuaugaauguaaagaaugcagaaaagcauucag

SEQ ID NO: 282245 - RNA, 66 nt, hsa
aaugcauggaaggacucacacuggagaaaaacccuaugaauguaagcaguaugggaaagcguucag

SEQ ID NO: 282246 - RNA, 66 nt, hsa
cguucagaccugacaagauucuuugaauacagauaaugaauguaaacaauuaacuguuuauaauaa

SEQ ID NO: 282247 - RNA, 66 nt, hsa
aauuuaugaaaggacacacacuggagagaaacccuaugaauguaagaaauguggaaaagcguucca

SEQ ID NO: 282248 - RNA, 66 nt, hsa
ugaauacaugcaaaacacacacuggagagaaaccuaugaauguaaggaaugcaaacaagcauucaa

SEQ ID NO: 282249 - RNA, 66 nt, hsa
uauacaugaaaggacucauacgagagagaauccguaugaauguaaggauugugggaaagcauucag

SEQ ID NO: 282250 - RNA, 66 nt, hsa
cauagacauguaaagacacaccagaaggaaacccuaugaauguaagcaauguggcaaaagcuuuca

SEQ ID NO: 282251 - RNA, 66 nt, hsa
aaugcauggaagcacucacacuuggcagaaacucuaugaauguaagcaguaugggaaagccuucag

SEQ ID NO: 282252 - RNA, 66 nt, hsa
ccuucagaucggcuaggauucuuugaauacaaauaaugaauguaaacaauuaacuguuuauaauaa

SEQ ID NO: 282253 - RNA, 66 nt, hsa
cagauacauuaaaauacucacugaagagaagcccuaugaauguaaguaacgugggaaagcaugaaa

SEQ ID NO: 282254 - RNA, 66 nt, hsa
ucuguucuggggcuuguccuuccuuugcagcuguuuugaauguaguuuuccuuuucuauuuauuug

SEQ ID NO: 282255 - RNA, 66 nt, hsa
ucagcaaagccauucuuaagagucgugagguccuucugaauguaaaacuggagcccaggagaagcu

SEQ ID NO: 282256 - RNA, 66 nt, hsa
acauaauuaacuuaauuggagaugcauuaggucacuugaauguauaagcaagcaccuaugguaggc

SEQ ID NO: 282257 - RNA, 66 nt, hsa
gaaacucaaucaauguuauugugaaaacugggaaugugaauguaauauauguagaaaaacauuuag

SEQ ID NO: 282258 - RNA, 59 nt, hsa; identical to SEQ ID NO: 58889

SEQ ID NO: 282259 - RNA, 66 nt, hsa
ucuucaugugagaagucacacaggggagaaacccuaugaauguaauaaaugugggaaagccuuuuc

SEQ ID NO: 282260 - RNA, 66 nt, hsa
uauacauaugagaagucauacuggugagaaacccuuugaauguaaugaaugugggaaagcauucuc

SEQ ID NO: 282261 - RNA, 66 nt, hsa
cuaaggccugcccaccaccgcccgccugggcagccaugaauguagcgccccaggcccugccccagc

SEQ ID NO: 282262 - RNA, 66 nt, hsa
cagcauauaaugagaugcuugaugaauggugcauauugaauguauaaagcccaccgguccugagag

SEQ ID NO: 282263 - RNA, 66 nt, hsa
cuucuugcuucuucuaccuuuauuuauucucagcucugaauguaugaaccugcucaaucaccucau

SEQ ID NO: 282264 - RNA, 66 nt, hsa
ccaaguuaguuuuguggcuuuccaucugacccuaugugaauguaaggugaugugaccuuguuggug

SEQ ID NO: 282265 - RNA, 66 nt, hsa
uguaguucacacuggaaaaaggccacguaugugccuugaauguagccaaaaugacgaacaacaccc

SEQ ID NO: 282266 - RNA, 66 nt, hsa
gcagcaucagagaguucacacuagagaaaggccuuaugaauguagugaaugugggaaauccuuuag

SEQ ID NO: 282267 - RNA, 66 nt, hsa
caggcugguggcauggccccccugccccgugcugaaugaauguacagagccagacaaagcugugaa

SEQ ID NO: 282268 - RNA, 66 nt, hsa
caaacacaucagaaaucucacuggagagaaacuguaugaauguagagaaucugggaauaccuuucu

SEQ ID NO: 282269 - RNA, 66 nt, hsa
ucugaagacaugaaaacucacuggggagaaacccuaugaauguaaaaauguggaagcaacuuugua

SEQ ID NO: 282270 - RNA, 60 nt, hsa; identical to SEQ ID NO: 227583

SEQ ID NO: 282271 - RNA, 66 nt, hsa
uaugcaugaaagaauucacacuggggagaaauacuaugaauguaaggauaugaguguuguuaccau

SEQ ID NO: 282272 - RNA, 66 nt, hsa
ggcacacgaauccauccaccuguccacgugcacacgugaauguagcgauagauauuuggacaucaa

SEQ ID NO: 282273 - RNA, 66 nt, hsa
uauacaugaacgaauucauacuggagagaaacccuaugaauguaaagaauguggaaaacccuucag

SEQ ID NO: 282274 - RNA, 66 nt, hsa
gauacaugaaagaacccacacuggagagaaaccuuaugaauguaaacagugugguaaagccuucag

SEQ ID NO: 282275 - RNA, 66 nt, hsa
aagacaugaaaggaugcacacugcaaagaaacaguaugaauguaaaaaaugugggaaaacauacau

SEQ ID NO: 282276 - RNA, 66 nt, hsa
aaaacaugagaggaaucacacugcacagaaacacuaugaauguaaacugugugggaaaacuuacuu

SEQ ID NO: 282277 - RNA, 66 nt, hsa
agcacaugaaagaacucacacuggagaaaaacccuaugaauguaaaaaaugugggaaaguguucgu

SEQ ID NO: 282278 - RNA, 66 nt, hsa
agcacaugaaaggaaucacacuguacagaaacgcuaugaauguaaacaauguggaaaaaccuacau

SEQ ID NO: 282279 - RNA, 66 nt, hsa
ucagauagaaauaauucucauuggagauaaacccuaugaauguaaacacauaguaaagccuuaauu

SEQ ID NO: 282280 - RNA, 66 nt, hsa
aguacaugaaaggauucacucuggagagaagucauaugaauguaagaaauguagaaaagcauugag

SEQ ID NO: 282281 - RNA, 66 nt, hsa
aaaaaaauaaaaaaaaagaaaaagaaauaaacucuaugaauguaaaccauguggugaaggcuuaag

SEQ ID NO: 282282 - RNA, 66 nt, hsa
aggacaugaaagaacucauaccgcaaagaagcuaugugaauguaaggaauguggaaaagcauugag

SEQ ID NO: 282283 - RNA, 66 nt, hsa
gcaacaugaaaggauucacacuggagagaagccguaugaauguaaggaaugcaggaaagcauucuc

SEQ ID NO: 282284 - RNA, 66 nt, hsa
aaaucaugagacaacucauaugggagagaagccauaugaauguaaauaaugugggaaagcauuugg

SEQ ID NO: 282285 - RNA, 66 nt, hsa
aagacgugaaaccacucacagugcagagaaaccccaugaauguaagcaaugugggaaagcauuuga

SEQ ID NO: 282286 - RNA, 66 nt, hsa
aagacaugaaagaacacguacuggggagaaacuguaugaauguaagcaguguucuaaagccuuccc

SEQ ID NO: 282287 - RNA, 66 nt, hsa
uaugcaugaaagaacucacucuggagagaaacuauaugaauguaagcaguguucuaaagccuuuca

SEQ ID NO: 282288 - RNA, 66 nt, hsa
agauacuuguacgaaacacauuggagauagacccugugaauguaagcacuugguaaagccuuaagu

SEQ ID NO: 282289 - RNA, 66 nt, hsa
gcccccacagcaguaucagaaacuucugacaaucagugaauguacaacccagccgaggggacggug

SEQ ID NO: 282290 - RNA, 66 nt, hsa
ugagcacgaaagaauucccacuggugagaaacaguaugaauguaaacauugugauuaagccuucag

SEQ ID NO: 282291 - RNA, 66 nt, hsa
aaacauaauuuauucuagguaaaauuuagauuguagugaauguaggaaguucuucagcacuugagc

SEQ ID NO: 282292 - RNA, 66 nt, hsa
uuaucuucagcaaauuccuaugagagaauaauguaaugaauguaggaaaaucuuuagccuuaucug

SEQ ID NO: 282293 - RNA, 66 nt, hsa
aaagucuuuucaacuucuguguuauagaacauucuaugaauguaguaauuaaucuauuuugcucca

SEQ ID NO: 282294 - RNA, 66 nt, hsa
aauuuaagaaaaucuucaucuauuucauaucuauaaugaauguagaacaucuugcuucugcucaga

SEQ ID NO: 282295 - RNA, 66 nt, hsa
gagaauagcauauagagaauaaucauguugacuuugugaauguagaaaagcuuuuaucuauuacac

SEQ ID NO: 282296 - RNA, 66 nt, hsa
ucaacaucaaagaauuccuacuggugagaaacccuaugaauguaaugaaugugagaaggccucuuc

SEQ ID NO: 282297 - RNA, 66 nt, hsa
uaaacaucagacaauucacacuggugacaaacccuaugaauguaaagauuguaaaaaagcuuuucu

SEQ ID NO: 282298 - RNA, 66 nt, hsa
ucaacaucaaagaauucauaccagugugaaacccuaugaauguaaggaauguguaaagaccuuuac

SEQ ID NO: 282299 - RNA, 66 nt, hsa
gagacaucagagaauucacaguggggagaaacccuaugaauguaaugaaugugggaaugccuucau

SEQ ID NO: 282300 - RNA, 66 nt, hsa
aggacauauaacuacuuaucucuaguggugggauucugaauguauaauacauauguuguacuuuua

SEQ ID NO: 282301 - RNA, 66 nt, hsa
aauaauuuauacuggagaaaaacuuugcaaguauaaugaauguagcagagccuuuaguuuuuguuc

SEQ ID NO: 282302 - RNA, 66 nt, hsa
gagcagucacuuuggagagaagcccugugaauacagugaauguaaggaucccuucagucaccacuc

SEQ ID NO: 282303 - RNA, 66 nt, hsa
cugggugcccaggaguagaauaugaagugcuaaaucugaauguaagaaaaauaauaguauugaaug

SEQ ID NO: 282304 - RNA, 66 nt, hsa
cugcacacaccacagaaugugugagauuuuccuguuugaauguaugucugcauuauacuccugcaa

SEQ ID NO: 282305 - RNA, 66 nt, hsa
gggcuauuuuaaaugucaaggucagcaguguuacuuugaauguaaacugguauaauagguaguuuu

SEQ ID NO: 282306 - RNA, 66 nt, hsa
uucaguugacugguuuuguguccuguuugaacuugcugaauguaaggcaggcuacuaugcguuaua

SEQ ID NO: 282307 - RNA, 66 nt, hsa
gguaugucauucuggauaaauccccaagccccuuuaugaauguagugaaauacauggcaugugggu

SEQ ID NO: 282308 - RNA, 66 nt, hsa
uuuuuaaacaaaugaugcugagaauaaggagagaaaugaauguagagagagguagagagagaaaua

SEQ ID NO: 282309 - RNA, 66 nt, hsa
ucugagcccccuuuucuggacaccaacuguguccugugaauguaucgcuacugugagcuguucccg

SEQ ID NO: 282310 - RNA, 66 nt, hsa
gucagugucggggcugagccccuugagcugcuucagugaauguacagugcccggcacgagcugaac

SEQ ID NO: 282311 - RNA, 66 nt, hsa
gcuuuuccugucugacucugacaaguccucccucacugaauguagaaucguugccaaguuucugag

SEQ ID NO: 282312 - RNA, 66 nt, hsa
ugguagaaauucucccuguaugccuagaaggaucagugaauguaagagccuuggaaauuaacaaaa

SEQ ID NO: 282313 - RNA, 66 nt, hsa
aauuggaauggguggcgguaauuggugauacuucuuugaauguagauuuccaaucacaucuuuagu

SEQ ID NO: 282314 - RNA, 66 nt, hsa
uggacagcucccaguauacuguggacugugauaaacugaauguauguuuuuuaaugguuuauugcu

SEQ ID NO: 282315 - RNA, 66 nt, hsa
uagcucuaugcuaaauaaugaagaguagcacaagaaugaauguauuugcugauacguugcucacau

SEQ ID NO: 282316 - RNA, 66 nt, hsa
cagggcuggauagauuaucuaagucaagcuugagaaugaauguauguaauuuuccuguuuauugua

SEQ ID NO: 282317 - RNA, 66 nt, hsa
caaauuaaugacaacucaugcuuuaauuuuguauuuugaauguacacgcaugcugaagcuaaguaa

SEQ ID NO: 282318 - RNA, 66 nt, hsa
uuugggcuuucagauuucucuuuuuaaccacauuucugaauguauaaaaauaccaauuauuuuccu

SEQ ID NO: 282319 - RNA, 66 nt, hsa
ugccagagucguaauugaaaucuaggaagucucgcuugaauguaugcgauacauauuuucacuacg

SEQ ID NO: 282320 - RNA, 66 nt, hsa
uuuuaaagguagaguuaacagaauauacugguggacugaauguagguugagagaggaagcgagaag

SEQ ID NO: 282321 - RNA, 66 nt, hsa
uccucguucaguugcacuucaguauuuucacggauaugaauguaaaauauauaaauauauaaaccu

SEQ ID NO: 282322 - RNA, 66 nt, hsa
gcauugagcagcugaagcuaacucaugacucuguuuugaauguaaauauuuguaauuaagccugca

SEQ ID NO: 282323 - RNA, 66 nt, hsa
uuuuuauuguuaguucucacuuguuuccauauuuagugaauguacauuuaauugcaaagcugucau

SEQ ID NO: 282324 - RNA, 66 nt, hsa
cucaacuugagcucuugaacuccuccugugggccugugaauguauucauucauuccacaacucugg

SEQ ID NO: 282325 - RNA, 66 nt, hsa
gcuuuuaauuugauuuuagaaucuggacacuuucuaugaauguaauucggcugagaaacauguugc

SEQ ID NO: 282326 - RNA, 66 nt, hsa
uuauugaacauccccugggcuuacaagaaacacugaugaauguaaaaucaggggacauuugaagau

SEQ ID NO: 282327 - RNA, 66 nt, hsa
gagggcacuuggccaguuuucuguucagcuuuucagugaauguaccccuuuaagguucagacuuaa

SEQ ID NO: 282328 - RNA, 66 nt, hsa
uccgcccccuccggggcugagccugggucugaagacugaauguaacaggggccgcuggcacuccug

SEQ ID NO: 282329 - RNA, 66 nt, hsa
caguguuguuuuuguaucaauauguuugugcagugaugaauguauuuauuucucagacuuggggcg

SEQ ID NO: 282330 - RNA, 66 nt, hsa
cugggguauuggaaauguuuggggacuagguagaggugaauguacuaaaugccacugaauuuguau

SEQ ID NO: 282331 - RNA, 66 nt, hsa
guuuuccuccauguuauuuaugaauuuuauauuccgugaauguauauugucuuguaauguugcaua

SEQ ID NO: 282332 - RNA, 66 nt, hsa
aauauaugcauuccauuugggagcauagcagcugugugaauguauguaauugugugugggggguuu

SEQ ID NO: 282333 - RNA, 66 nt, hsa
ccuucuccuuugaaugcuguuuugugaaagaaacugugaauguaauggaaacguaggagcaucugg

SEQ ID NO: 282334 - RNA, 66 nt, hsa
augugaagcuugcaacuuuaugucuugcuuuggacaugaauguauuacagcuugcagcuauucugu

SEQ ID NO: 282335 - RNA, 66 nt, hsa
uuucuaacaacuguggagauuugagggaauguguggugaauguaaaauaccuaguuuacuugccag

SEQ ID NO: 282336 - RNA, 66 nt, hsa
uuuuuugguguuccaaugaaucugggauguaaacucugaauguauuuauaacuauuuauuucugga

SEQ ID NO: 282337 - RNA, 66 nt, hsa
aaagcacauggccuugggugacaaauuccucuuugaugaauguacccuguggggauguuucauacu

SEQ ID NO: 282338 - RNA, 66 nt, hsa
ugcacagaaugagcuucgagcuuuguucagacuaaaugaauguaucugggaggggucgggggcacg

SEQ ID NO: 282339 - RNA, 66 nt, hsa
ccaucugccuuucuuucccccagcccccacccgcuuugaauguagagacccgugggcacuuuuccu

SEQ ID NO: 282340 - RNA, 66 nt, hsa
aaauuucaaaccauuuaccaucugaaaguuuugauuugaauguaaaacaggaaauuggaauuccuu

SEQ ID NO: 282341 - RNA, 66 nt, hsa
ucuguuucucccuugggacugugucucauguuugugugaauguagaccaggaaagggggcugcaaa

SEQ ID NO: 282342 - RNA, 66 nt, hsa
uaagguuucaaaaaucauguaaggauuuaaacuugcugaauguaaagauugaaccucaagucacug

SEQ ID NO: 282343 - RNA, 66 nt, hsa
auucauuuuuacuuuuucuuauuuuuaaaauuaggcugaauguacuucaugugauuugucaaccau

SEQ ID NO: 282344 - RNA, 66 nt, hsa
ucccaguagcaauaaacauauaauauaggaggagucugaauguagagaugaaaaauacagaaugua

SEQ ID NO: 282345 - RNA, 66 nt, hsa
uuaugucuugaacuuuuccucaaagcauuacacuugugaauguauuuuugucuaauagggucgaaa

SEQ ID NO: 282346 - RNA, 66 nt, hsa
aaaauauauaugcauaccuggauuuccuuggcuucgugaauguaagagaaauuaaaucugaauaaa

SEQ ID NO: 282347 - RNA, 66 nt, hsa
cucuuaucaggcauuuucauuuggaaauuucauuauugaauguagcaagguuguaguuguuuuuuu

SEQ ID NO: 282348 - RNA, 66 nt, hsa
aucucagaagucaagcugauggaguaugugauaaagugaauguacauguauauacacacacaccuc

SEQ ID NO: 282349 - RNA, 66 nt, hsa
cacaugcauaaaaauagaagacaaucugcuuguuucugaauguauggaaagacauuuugguuauac

SEQ ID NO: 282350 - RNA, 66 nt, hsa
aggaucuuaaacccaaaguacgagaaauguuucuguugaauguaaugcuacaugaaugcuugauuu

SEQ ID NO: 282351 - RNA, 66 nt, hsa
acaguccuaaaaauggccagauuguggaacagcuguugaauguaauacuuccaaaauguacauauc

SEQ ID NO: 282352 - RNA, 66 nt, hsa
auauucucguaaaacugcgcuuugccaguagcacagugaauguaugccaaaugcaaguccauucca

SEQ ID NO: 282353 - RNA, 66 nt, hsa
aaaaaugaacugcccuucagcaucuaaugggaguugugaauguaacugguuaaugauacacauucc

SEQ ID NO: 282354 - RNA, 66 nt, hsa
caacuguauuucccaauacacuugagcaguugccugugaauguaagaggugucaacaaacugggaa

SEQ ID NO: 282355 - RNA, 66 nt, hsa
uguugccuuaguacuaucaagacuugugaauauauuugaauguauguuguuugaaaaacuugcaca

SEQ ID NO: 282356 - RNA, 66 nt, hsa
cuucugucaaggaauuacaaguagcaagggaaggucugaauguaaggacaggccuagggaccuugc

SEQ ID NO: 282357 - RNA, 66 nt, hsa
aaaagucugcuuaauuucaaaagaaaaaugccuaauugaauguaacucaucuugguguuauuauac

SEQ ID NO: 282358 - RNA, 66 nt, hsa
cagcaacagacuguauuuuugugacgccccguaguaugaauguacaucuuguaaaacugagauaua

SEQ ID NO: 282359 - RNA, 66 nt, hsa
cagcaguauucuucaguaaauaaagaauggaauugcugaauguaaucauugaaccucgagucacug

SEQ ID NO: 282360 - RNA, 64 nt, hsa; identical to SEQ ID NO: 210303

SEQ ID NO: 282361 - RNA, 64 nt, hsa; identical to SEQ ID NO: 210304

SEQ ID NO: 282362 - RNA, 64 nt, hsa; identical to SEQ ID NO: 210305

SEQ ID NO: 282363 - RNA, 64 nt, hsa; identical to SEQ ID NO: 210306

SEQ ID NO: 282364 - RNA, 64 nt, hsa; identical to SEQ ID NO: 210307

SEQ ID NO: 282365 - RNA, 64 nt, hsa; identical to SEQ ID NO: 210308

SEQ ID NO: 282366 - RNA, 64 nt, hsa; identical to SEQ ID NO: 210309

SEQ ID NO: 282367 - RNA, 64 nt, hsa; identical to SEQ ID NO: 210310

SEQ ID NO: 282368 - RNA, 64 nt, hsa; identical to SEQ ID NO: 210311

SEQ ID NO: 282369 - RNA, 64 nt, hsa; identical to SEQ ID NO: 210312

SEQ ID NO: 282370 - RNA, 64 nt, hsa; identical to SEQ ID NO: 210313

SEQ ID NO: 282371 - RNA, 64 nt, hsa; identical to SEQ ID NO: 210314

SEQ ID NO: 282372 - RNA, 64 nt, hsa; identical to SEQ ID NO: 210315

SEQ ID NO: 282373 - RNA, 64 nt, hsa; identical to SEQ ID NO: 210316

SEQ ID NO: 282374 - RNA, 64 nt, hsa; identical to SEQ ID NO: 210317

SEQ ID NO: 282375 - RNA, 64 nt, hsa; identical to SEQ ID NO: 210318

SEQ ID NO: 282376 - RNA, 64 nt, hsa; identical to SEQ ID NO: 210319

SEQ ID NO: 282377 - RNA, 64 nt, hsa
ccgccacacauacacacacacacuuuuuguuucuuucagguagacaccuuuuaaaaugcagaac

SEQ ID NO: 282378 - RNA, 64 nt, hsa
auauugaaagugaagcaacuaugugacuguauucuucagguaaacacugacugcgcuuguugga

SEQ ID NO: 282379 - RNA, 64 nt, hsa
aauccauaaaguuauaaauuagccugaaaaauauuucagguaaugguguggauuggccugcuuu

SEQ ID NO: 282380 - RNA, 64 nt, hsa
auucagguguucagagccuccugguaugauguuauucagguaguguccagcuauauguguaugu

SEQ ID NO: 282381 - RNA, 64 nt, hsa
guuucccuuuuuuuugcuucauuuuguuuaaauuuucagguauuuagcuccccuuucauauuau

SEQ ID NO: 282382 - RNA, 64 nt, hsa
ugggaauccuagaaugccugaucuauuuuaucuguucagguaguuuuguuauuguacccucuuu

SEQ ID NO: 282383 - RNA, 64 nt, hsa
auuuccacuuaucauuaaugauuuaauguuggauuucagguaccuuguaugucuuaauuuauuu

SEQ ID NO: 282384 - RNA, 64 nt, hsa
aaaaguacagaaaauuugacuauuauuuauagauuucagguauauuuauauguguaaaagaaau

SEQ ID NO: 282385 - RNA, 64 nt, hsa
ucaagacugggacaaaaguauaaauauuauuuauuucagguagaauuuuuuugguguaguuuuu

SEQ ID NO: 282386 - RNA, 64 nt, hsa
cccucccaguggaggcaucuuacauuuaggauacuucagguauccucagaaauguauucugcac

SEQ ID NO: 282387 - RNA, 64 nt, hsa
ugacauaaguaaauuuauuuauugagucaauuuguucagguaaguacuagggaagcuuuauaag

SEQ ID NO: 282388 - RNA, 64 nt, hsa
gaauuuacaguagaaauauguaaggcacugaugcuucagguauuuuacuaaaucagagugcuga

SEQ ID NO: 282389 - RNA, 64 nt, hsa
cauuucauaagacuuacaauaacucuauuuaaaauucagguauuguacucgggaggcugaggug

SEQ ID NO: 282390 - RNA, 64 nt, hsa
aagacccugucucuuaaaaaaacaaaaagacauauucagguacugauuuuucaucaagagauug

SEQ ID NO: 282391 - RNA, 64 nt, hsa
uguauccccuguuguggcauuuuuuuuagauaaucuaagcuagaaaaaugacauugaauucugg

SEQ ID NO: 282392 - RNA, 64 nt, hsa
ugaagggacucuuuuaaauaaaugagcaaguguccuaagcuaugucauccaaagauuguccuuu

SEQ ID NO: 282393 - RNA, 64 nt, hsa; identical to SEQ ID NO: 195961

SEQ ID NO: 282394 - RNA, 64 nt, hsa; identical to SEQ ID NO: 195962

SEQ ID NO: 282395 - RNA, 64 nt, hsa; identical to SEQ ID NO: 195963

SEQ ID NO: 282396 - RNA, 64 nt, hsa; identical to SEQ ID NO: 195964

SEQ ID NO: 282397 - RNA, 64 nt, hsa; identical to SEQ ID NO: 195965

SEQ ID NO: 282398 - RNA, 64 nt, hsa; identical to SEQ ID NO: 195966

SEQ ID NO: 282399 - RNA, 64 nt, hsa; identical to SEQ ID NO: 195967

SEQ ID NO: 282400 - RNA, 64 nt, hsa; identical to SEQ ID NO: 195968

SEQ ID NO: 282401 - RNA, 64 nt, hsa; identical to SEQ ID NO: 195969

SEQ ID NO: 282402 - RNA, 64 nt, hsa; identical to SEQ ID NO: 195970

SEQ ID NO: 282403 - RNA, 64 nt, hsa; identical to SEQ ID NO: 195971

SEQ ID NO: 282404 - RNA, 64 nt, hsa; identical to SEQ ID NO: 195972

SEQ ID NO: 282405 - RNA, 64 nt, hsa; identical to SEQ ID NO: 195973

SEQ ID NO: 282406 - RNA, 64 nt, hsa; identical to SEQ ID NO: 195974

SEQ ID NO: 282407 - RNA, 64 nt, hsa; identical to SEQ ID NO: 195975

SEQ ID NO: 282408 - RNA, 64 nt, hsa; identical to SEQ ID NO: 195976

SEQ ID NO: 282409 - RNA, 64 nt, hsa; identical to SEQ ID NO: 195977

SEQ ID NO: 282410 - RNA, 64 nt, hsa; identical to SEQ ID NO: 195978

SEQ ID NO: 282411 - RNA, 64 nt, hsa; identical to SEQ ID NO: 195979

SEQ ID NO: 282412 - RNA, 64 nt, hsa; identical to SEQ ID NO: 195980

SEQ ID NO: 282413 - RNA, 64 nt, hsa; identical to SEQ ID NO: 195981

SEQ ID NO: 282414 - RNA, 64 nt, hsa; identical to SEQ ID NO: 195982

SEQ ID NO: 282415 - RNA, 64 nt, hsa; identical to SEQ ID NO: 195983

SEQ ID NO: 282416 - RNA, 64 nt, hsa; identical to SEQ ID NO: 195984

SEQ ID NO: 282417 - RNA, 64 nt, hsa; identical to SEQ ID NO: 195985

SEQ ID NO: 282418 - RNA, 64 nt, hsa; identical to SEQ ID NO: 195986

SEQ ID NO: 282419 - RNA, 64 nt, hsa; identical to SEQ ID NO: 195987

SEQ ID NO: 282420 - RNA, 64 nt, hsa; identical to SEQ ID NO: 60048

SEQ ID NO: 282421 - RNA, 64 nt, hsa; identical to SEQ ID NO: 60049

SEQ ID NO: 282422 - RNA, 64 nt, hsa; identical to SEQ ID NO: 60050

SEQ ID NO: 282423 - RNA, 64 nt, hsa; identical to SEQ ID NO: 60051

SEQ ID NO: 282424 - RNA, 64 nt, hsa; identical to SEQ ID NO: 60052

SEQ ID NO: 282425 - RNA, 64 nt, hsa; identical to SEQ ID NO: 60053

SEQ ID NO: 282426 - RNA, 64 nt, hsa
uuuucuuuagccauaguaacuuuuugucacaauaacuaaguauucaauuauauauaaagaguga

SEQ ID NO: 282427 - RNA, 64 nt, hsa
auauaaacaaaagaaaaauccaacugaaaauaacacuaaguauuuuugaguuccuagaaugucc

SEQ ID NO: 282428 - RNA, 64 nt, hsa
guacagcugacgguuucuccccggacacucgccuacuaaguacccuugggguggugcuggguca

SEQ ID NO: 282429 - RNA, 64 nt, hsa
auuugaggacugaagcuggggcuuggggauugccacuaaguacagcugacgguuucuccccgga

SEQ ID NO: 282430 - RNA, 64 nt, hsa
gauauuugacuuuucauaaguaguggaagguuucacuaaguaaaacucucaguuucuugguauc

SEQ ID NO: 282431 - RNA, 64 nt, hsa
gguauuugacuuuucauaaguaguggaagguuucacuaaguaaagaucugaguuucuugguauc

SEQ ID NO: 282432 - RNA, 64 nt, hsa
uguacacagcuuuuacaaaucaauaaagaugauuguacaagaguauuuucagacuaauuggauu

SEQ ID NO: 282433 - RNA, 64 nt, hsa
gaauauaacugcuuuuauaaaucuuuugaaucauguacaagacuuauaucuacauuuuuugauc

SEQ ID NO: 282434 - RNA, 64 nt, hsa; identical to SEQ ID NO: 199794

SEQ ID NO: 282435 - RNA, 64 nt, hsa; identical to SEQ ID NO: 199795

SEQ ID NO: 282436 - RNA, 64 nt, hsa; identical to SEQ ID NO: 199796

SEQ ID NO: 282437 - RNA, 64 nt, hsa; identical to SEQ ID NO: 199797

SEQ ID NO: 282438 - RNA, 64 nt, hsa; identical to SEQ ID NO: 199798

SEQ ID NO: 282439 - RNA, 64 nt, hsa; identical to SEQ ID NO: 199799

SEQ ID NO: 282440 - RNA, 64 nt, hsa; identical to SEQ ID NO: 199800

SEQ ID NO: 282441 - RNA, 64 nt, hsa; identical to SEQ ID NO: 199801

SEQ ID NO: 282442 - RNA, 64 nt, hsa; identical to SEQ ID NO: 199802

SEQ ID NO: 282443 - RNA, 64 nt, hsa; identical to SEQ ID NO: 199803

SEQ ID NO: 282444 - RNA, 64 nt, hsa; identical to SEQ ID NO: 199804

SEQ ID NO: 282445 - RNA, 55 nt, hsa; identical to SEQ ID NO: 199805

SEQ ID NO: 282446 - RNA, 64 nt, hsa; identical to SEQ ID NO: 199806

SEQ ID NO: 282447 - RNA, 64 nt, hsa; identical to SEQ ID NO: 199807

SEQ ID NO: 282448 - RNA, 64 nt, hsa; identical to SEQ ID NO: 199808

SEQ ID NO: 282449 - RNA, 64 nt, hsa; identical to SEQ ID NO: 199809

SEQ ID NO: 282450 - RNA, 64 nt, hsa; identical to SEQ ID NO: 199810

SEQ ID NO: 282451 - RNA, 51 nt, hsa; identical to SEQ ID NO: 199811

SEQ ID NO: 282452 - RNA, 64 nt, hsa; identical to SEQ ID NO: 199812

SEQ ID NO: 282453 - RNA, 64 nt, hsa; identical to SEQ ID NO: 199813

SEQ ID NO: 282454 - RNA, 64 nt, hsa; identical to SEQ ID NO: 199814

SEQ ID NO: 282455 - RNA, 64 nt, hsa; identical to SEQ ID NO: 199815

SEQ ID NO: 282456 - RNA, 64 nt, hsa; identical to SEQ ID NO: 199816

SEQ ID NO: 282457 - RNA, 64 nt, hsa; identical to SEQ ID NO: 199817

SEQ ID NO: 282458 - RNA, 64 nt, hsa; identical to SEQ ID NO: 199818

SEQ ID NO: 282459 - RNA, 64 nt, hsa; identical to SEQ ID NO: 199819

SEQ ID NO: 282460 - RNA, 64 nt, hsa; identical to SEQ ID NO: 199820

SEQ ID NO: 282461 - RNA, 64 nt, hsa; identical to SEQ ID NO: 199821

SEQ ID NO: 282462 - RNA, 64 nt, hsa; identical to SEQ ID NO: 199822

SEQ ID NO: 282463 - RNA, 64 nt, hsa; identical to SEQ ID NO: 199823

SEQ ID NO: 282464 - RNA, 64 nt, hsa; identical to SEQ ID NO: 199824

SEQ ID NO: 282465 - RNA, 64 nt, hsa; identical to SEQ ID NO: 282432

SEQ ID NO: 282466 - RNA, 64 nt, hsa; identical to SEQ ID NO: 282433

SEQ ID NO: 282467 - RNA, 64 nt, hsa; identical to SEQ ID NO: 199794

SEQ ID NO: 282468 - RNA, 64 nt, hsa; identical to SEQ ID NO: 199795

SEQ ID NO: 282469 - RNA, 64 nt, hsa; identical to SEQ ID NO: 199796

SEQ ID NO: 282470 - RNA, 64 nt, hsa; identical to SEQ ID NO: 199797

SEQ ID NO: 282471 - RNA, 64 nt, hsa; identical to SEQ ID NO: 199798

SEQ ID NO: 282472 - RNA, 64 nt, hsa; identical to SEQ ID NO: 199799

SEQ ID NO: 282473 - RNA, 64 nt, hsa; identical to SEQ ID NO: 199800

SEQ ID NO: 282474 - RNA, 64 nt, hsa; identical to SEQ ID NO: 199801

SEQ ID NO: 282475 - RNA, 64 nt, hsa; identical to SEQ ID NO: 199802

SEQ ID NO: 282476 - RNA, 64 nt, hsa; identical to SEQ ID NO: 199803

SEQ ID NO: 282477 - RNA, 64 nt, hsa; identical to SEQ ID NO: 199804

SEQ ID NO: 282478 - RNA, 55 nt, hsa; identical to SEQ ID NO: 199805

SEQ ID NO: 282479 - RNA, 64 nt, hsa; identical to SEQ ID NO: 199806

SEQ ID NO: 282480 - RNA, 64 nt, hsa; identical to SEQ ID NO: 199807

SEQ ID NO: 282481 - RNA, 64 nt, hsa; identical to SEQ ID NO: 199808

SEQ ID NO: 282482 - RNA, 64 nt, hsa; identical to SEQ ID NO: 199809

SEQ ID NO: 282483 - RNA, 64 nt, hsa; identical to SEQ ID NO: 199810

SEQ ID NO: 282484 - RNA, 51 nt, hsa; identical to SEQ ID NO: 199811

SEQ ID NO: 282485 - RNA, 64 nt, hsa; identical to SEQ ID NO: 199812

SEQ ID NO: 282486 - RNA, 64 nt, hsa; identical to SEQ ID NO: 199813

SEQ ID NO: 282487 - RNA, 64 nt, hsa; identical to SEQ ID NO: 199814

SEQ ID NO: 282488 - RNA, 64 nt, hsa; identical to SEQ ID NO: 199815

SEQ ID NO: 282489 - RNA, 64 nt, hsa; identical to SEQ ID NO: 199816

SEQ ID NO: 282490 - RNA, 64 nt, hsa; identical to SEQ ID NO: 199817

SEQ ID NO: 282491 - RNA, 64 nt, hsa; identical to SEQ ID NO: 199818

SEQ ID NO: 282492 - RNA, 64 nt, hsa; identical to SEQ ID NO: 199819

SEQ ID NO: 282493 - RNA, 64 nt, hsa; identical to SEQ ID NO: 199820

SEQ ID NO: 282494 - RNA, 64 nt, hsa; identical to SEQ ID NO: 199821

SEQ ID NO: 282495 - RNA, 64 nt, hsa; identical to SEQ ID NO: 199822

SEQ ID NO: 282496 - RNA, 64 nt, hsa; identical to SEQ ID NO: 199823

SEQ ID NO: 282497 - RNA, 64 nt, hsa; identical to SEQ ID NO: 199824

SEQ ID NO: 282498 - RNA, 64 nt, hsa
uacgaaagcccuacauugagcuccaaucugcucggggugggacgggugcuucccacaccucugg

SEQ ID NO: 282499 - RNA, 64 nt, hsa
gagugggucuccauuccccgagaagccgggggcagggugggauggggaagaccaggagcagagu

SEQ ID NO: 282500 - RNA, 64 nt, hsa
uccuugcugauuugauauuuuuggucauggagaagggugggauugggugggaaugggguggaag

SEQ ID NO: 282501 - RNA, 64 nt, hsa
uuugauauuuuuggucauggagaagggugggauugggugggaaugggguggaagggugaugggg

SEQ ID NO: 282502 - RNA, 64 nt, hsa
acuuuagaugggaaagugaggggcuugagaaagugggugggaggagggaaggauuuuuuaggag

SEQ ID NO: 282503 - RNA, 64 nt, hsa
aaccuuuuguaccuuucuuuggggaauggggugggggugggagaggagguagauggggaagaaa

SEQ ID NO: 282504 - RNA, 64 nt, hsa
gcuuuuguuaacacuauuaaugggguggggaauagggugggaguggggguuugggagacgggug

SEQ ID NO: 282505 - RNA, 64 nt, hsa
uggggaauagggugggaguggggguuugggagacgggugggaaagggugguuggggggaccgau

SEQ ID NO: 282506 - RNA, 64 nt, hsa
ucagaaaugcucaaauggguacaaccaucaccaagggugggaugggagggcagaggggaaauaa

SEQ ID NO: 282507 - RNA, 64 nt, hsa
ugaauguuccuaaagaacugcugccccacagugagggugggagcagcggaacagggaaugccag

SEQ ID NO: 282508 - RNA, 64 nt, hsa
augccagacacaggcucgcugcugcuggaaggcggggugggacuuccuuccucuguccggagag

SEQ ID NO: 282509 - RNA, 64 nt, hsa
gaggcggggcuacagauugggcggggcuucucuugggugggacagggcuucuccugcgggggcg

SEQ ID NO: 282510 - RNA, 64 nt, hsa
gaccaggcuccaauggggcggggcuucucuccgcgggugggacucuucccugggaaccgcccuc

SEQ ID NO: 282511 - RNA, 64 nt, hsa
uccccucuucugcgucuguuccgugacuucgccugggugggauguaccgcaggugcaucgcguc

SEQ ID NO: 282512 - RNA, 64 nt, hsa
cuggcgcguuucucggagcucccggcuccucagcgggugggaaccucggggcccagggguggag

SEQ ID NO: 282513 - RNA, 64 nt, hsa
guuucuccaagccugcuuugugcuucucaccuuugggugggaugccuugccagugugucuuacu

SEQ ID NO: 282514 - RNA, 64 nt, hsa
ugccagcgcagcguucugggcuccucagucgcaggggugggaugugagucaugcggauuaucca

SEQ ID NO: 282515 - RNA, 64 nt, hsa
accccagcucuugaagggcugaguggccugcugggggugggagggugucuuuacuauguccuag

SEQ ID NO: 282516 - RNA, 64 nt, hsa
cacugcccccugcuugaauugauuccgaaggguagggugggaaggugagcaaagggagcagaaa

SEQ ID NO: 282517 - RNA, 64 nt, hsa
ucaucucucucuccuuccugggguggacucagaugggugggacacaugccuuccucccccuauu

SEQ ID NO: 282518 - RNA, 64 nt, hsa
cccugggccaagcugacaccagccccugaggguggggugggacggguggugcuuaaaagaggaa

SEQ ID NO: 282519 - RNA, 64 nt, hsa
cuggcccagacaguauuugcaguucuugugcuaugggugggagucuucuuccucaaguuucggc

SEQ ID NO: 282520 - RNA, 64 nt, hsa
cugagaggcccuggcucuggccaggcugggaucugggugggaggcuggggcucuucuucuucca

SEQ ID NO: 282521 - RNA, 64 nt, hsa
uggggagaaaacgggaggugcucgugcuggcccugggugggagcggggaguccuggugagaccc

SEQ ID NO: 282522 - RNA, 64 nt, hsa
cugggcuggggccuuccuccagggaaggaggcuggggugggaacacuggccucccccagaauaa

SEQ ID NO: 282523 - RNA, 64 nt, hsa
ggagcugggcuggccaguacagccaguggggagugggugggaggcaccaaaacuuggcagcugu

SEQ ID NO: 282524 - RNA, 64 nt, hsa
gguuguaauauaaaaacuguguuucuguacgugugggugggaauucucugacggugcucguuca

SEQ ID NO: 282525 - RNA, 64 nt, hsa
agguuuacagaccagggaccgaacacgcagccaggggugggaaagcugccucagccaagcugag

SEQ ID NO: 282526 - RNA, 64 nt, hsa
auuuugcaacuggguaucuuaauuuuuauguugugggugggaggaaaggaaagaagcaacaguc

SEQ ID NO: 282527 - RNA, 64 nt, hsa
cacaugccuguagucccagcuucucaggaggcuggggugggaagaucacuugagcccaggaggu

SEQ ID NO: 282528 - RNA, 64 nt, hsa
ccaggcuuacugagcuguccaguggagggcucaugggugggacauggaaaagaaggcagccuag

SEQ ID NO: 282529 - RNA, 64 nt, hsa
augcucagcacauauuugcaugggagggggagaugggugggaggagaugaaaauaucagcuuuu

SEQ ID NO: 282530 - RNA, 64 nt, hsa
guugccaaggcucaucuugagaagcaggcggguugggugggaggaggaagaaagggaagaauua

SEQ ID NO: 282531 - RNA, 64 nt, hsa
cuugaguuuguugccacugagaagcaggcggguugggugggaggaggaagaaagggaagaauua

SEQ ID NO: 282532 - RNA, 64 nt, hsa
gccgguggugcuuucugggcagccagggguuccugggugggaggacugucccucuggggacgug

SEQ ID NO: 282533 - RNA, 64 nt, hsa
accgucagcuugauaauuacuaaagcaaaggccugggugggagaacagguuucuaguuuuuacc

SEQ ID NO: 282534 - RNA, 64 nt, hsa
cugagggccccaauguauguguggcugugggugugggugggagugugucugcugaguaaggaac

SEQ ID NO: 282535 - RNA, 64 nt, hsa
acggaaacauacagaggaugccuuuucugugauugggugggauuuuuucccuuuuuauguggga

SEQ ID NO: 282536 - RNA, 64 nt, hsa
ugaagaguuuagaaugaggcagcggugagaagaagggugggagggcgugggggccccugggugg

SEQ ID NO: 282537 - RNA, 64 nt, hsa
auuuuucaauccuccacucuaagugauuccuccagggugggaagcacggggagcaauggaauca

SEQ ID NO: 282538 - RNA, 64 nt, hsa
ccauugucgucuuuucuauugaggguugggauuugggugggagaggaaagcaaauuuuauuuuc

SEQ ID NO: 282539 - RNA, 64 nt, hsa
cggauaguggcagggguggggguugcuaaggaaagggugggaugggaguggguaaagaguuugg

SEQ ID NO: 282540 - RNA, 64 nt, hsa
uugauggggaagcugcuggaggagcagggguggggggugggagggaggggaaaggcaaaugcag

SEQ ID NO: 282541 - RNA, 64 nt, hsa
uuuuuuaaggggguaguuuuauuuuggugggguugggugggaaggaaggcuggggguuuuguaa

SEQ ID NO: 282542 - RNA, 64 nt, hsa
ucuguuuuuaggucugggagggcaaaaaagaggugggugggaugaaacauguuuugggggggga

SEQ ID NO: 282543 - RNA, 64 nt, hsa
gcaguugggaaaggaaagccaggacuuguggggugggugggaccagaaauucuugagcaaauuu

SEQ ID NO: 282544 - RNA, 64 nt, hsa
uuuuuauuuuccagaacucauuuuuuaccuucaggggugggagcuaagucaguugcagcuguaa

SEQ ID NO: 282545 - RNA, 64 nt, hsa
augguuugacuuuuuuucccugagggugagggaugggugggaagagaggacaucuguccagucu

SEQ ID NO: 282546 - RNA, 64 nt, hsa
aaccguuggcauuaucaggauucguguuuugugggggugggaguggagaguaggguggucuugu

SEQ ID NO: 282547 - RNA, 64 nt, hsa
aaaagaggcuuuugggccaaaaugugaggguggugggugggaugggcagggaaggaauccuggu

SEQ ID NO: 282548 - RNA, 64 nt, hsa
gggaagggcgggcaaggaguggggagggagucuggggugggagggaggcaucugcaugggucuu

SEQ ID NO: 282549 - RNA, 64 nt, hsa
aaagucuuuuguauugggucaggaguugaauuuggggugggaggauggaugcaacugaagcaga

SEQ ID NO: 282550 - RNA, 64 nt, hsa
ucugauuccucugcugucccugccaggagcugaagggugggaacaacaaaggcaauggugaaaa

SEQ ID NO: 282551 - RNA, 64 nt, hsa
ucuuuugauguuccuauuguggggguucuggauagggugggacagggauggggguguguuuuau

SEQ ID NO: 282552 - RNA, 64 nt, hsa
auauuccccuaaaaugucuauaaauuaucagucugggugggaaagcccccaccuccauccauuu

SEQ ID NO: 282553 - RNA, 64 nt, hsa
cuccucccucagagcuggggcagcugccucccaggggugggacucugggcucagagagaggccc

SEQ ID NO: 282554 - RNA, 64 nt, hsa
gcugacaugcucgggaaagggcagaggucacugggggugggaaggucauccaguccagacucag

SEQ ID NO: 282555 - RNA, 64 nt, hsa
ggaaaagagagguaguuuagaacucucugcauaggggugggaauuaaucaaaaaccucagaggc

SEQ ID NO: 282556 - RNA, 64 nt, hsa
aauuaagcacacaaaugcuaaggcagaauuuugagggugggagagaagaaaagggaaagaagcu

SEQ ID NO: 282557 - RNA, 64 nt, hsa
cugggaaguaacaguacuuagcacucuugguggugggugggaggguggguacaggccagggaua

SEQ ID NO: 282558 - RNA, 64 nt, hsa
gcacaauagccugaaugggauuucagguuaggcagggugggaggggaggcucucuggcuuuagu

SEQ ID NO: 282559 - RNA, 64 nt, hsa
ugucugcugggcugccaggcggcaccacugcaaggggugggagccuggcuuggguguggcugag

SEQ ID NO: 282560 - RNA, 64 nt, hsa
agggcgcagguggaggggacaggucugccgaugggggugggagccugucugcugggcugccagg

SEQ ID NO: 282561 - RNA, 64 nt, hsa
gccauguuuucauuuccuuuugcccaaaugagcggggugggaagaggguuagucuuaugugagc

SEQ ID NO: 282562 - RNA, 64 nt, hsa
ucuguccugccuucuuucccucugcgaggcaguggggugggauucagagugcuuagucugcuca

SEQ ID NO: 282563 - RNA, 64 nt, hsa
ucaggucuguagucuuugggucuuugggaggccagggugggaggaucacuugagcucaggaguu

SEQ ID NO: 282564 - RNA, 64 nt, hsa
uggcucagguggggucacucuggcagcucagagagggugggagugggcccaaugcacuuuguuc

SEQ ID NO: 282565 - RNA, 64 nt, hsa
guucuggcucuuccaggcugggagagccuuccaggggugggacacccugugauggggcccugcc

SEQ ID NO: 282566 - RNA, 64 nt, hsa
auugcauaagaccagggggaagagugucagcguggggugggaauucccgcggccuccaccugcu

SEQ ID NO: 282567 - RNA, 64 nt, hsa
caggggagggccagauggcauccuggcuuggggcgggugggaccuacccaggcucugagacuuu

SEQ ID NO: 282568 - RNA, 64 nt, hsa
cuggggagcuggucugccucagagacagaguagggggugggagcagagccucggugagggucuu

SEQ ID NO: 282569 - RNA, 64 nt, hsa
ucucuucccuuugagaagauauuuucccacaaaggggugggaagccaggagugagaaggaauuc

SEQ ID NO: 282570 - RNA, 64 nt, hsa
cuugaccaucguccuuccucucaagcuagccagagggugggagccuaaggaagcgugggguagc

SEQ ID NO: 282571 - RNA, 64 nt, hsa
cuagggaggugggguacauuucucugagcagucagggugggaagaaagaaugcaagaguggacu

SEQ ID NO: 282572 - RNA, 64 nt, hsa
ucuauuguuaucugacaucucuugacaugcccgugggugggaugggaguggaggguucauauga

SEQ ID NO: 282573 - RNA, 64 nt, hsa
aguucucucccauggggaaagauucucacugcuggggugggaagauucucgcugcuggggugug

SEQ ID NO: 282574 - RNA, 64 nt, hsa
uuuuguuuguuuguuuuuuaagacguucggggcagggugggaguggguauggagaugcaauuug

SEQ ID NO: 282575 - RNA, 64 nt, hsa
cccggcucuguccugugugcgcugcagcguugcggggugggagaauguggggugaggguucuua

SEQ ID NO: 282576 - RNA, 64 nt, hsa
cugggagcuauaugggaagugggggcugggaucugggugggaauauguguuuguauacaaaggg

SEQ ID NO: 282577 - RNA, 64 nt, hsa
ucacaguuucccucgccccugggcugggggguuggggugggacacccguaccgcggcuggcugg

SEQ ID NO: 282578 - RNA, 64 nt, hsa
cacgugggccuggaacucuaacuccaucgcugaggggugggaaugagaacuaugaaccaggaag

SEQ ID NO: 282579 - RNA, 64 nt, hsa
ucaccgucaccuggaagcagggcaccagcugcuggggugggacuugggucuucagaucauaaac

SEQ ID NO: 282580 - RNA, 64 nt, hsa
agcccaagcgcuccggcggagcccaaaagggugggggugggaggggcagaggccaacggauccc

SEQ ID NO: 282581 - RNA, 64 nt, hsa
ggcgggggaggcugggagcugggccuccugcguggggugggacucgcaggggccgggucuccgu

SEQ ID NO: 282582 - RNA, 64 nt, hsa
ccaagcccccaggggagcccucccuggcguccgagggugggagucgggguguggcaggccgcgg

SEQ ID NO: 282583 - RNA, 64 nt, hsa
uuuugugugugugcacgcauggcugagcaugugugggugggagucagcacauucacgauacugu

SEQ ID NO: 282584 - RNA, 64 nt, hsa
gucucuggguugucauucacuuugagagcccgaggggugggagggagugaugcaggcagacgcu

SEQ ID NO: 282585 - RNA, 64 nt, hsa
gguugaggugagucauggccucuugcuggcaauggggugggaggaguacccccaaguccucuca

SEQ ID NO: 282586 - RNA, 64 nt, hsa
gcgaggccggagagcuggugacuuuggggacagggggugggaaggggauggacacccccagcug

SEQ ID NO: 282587 - RNA, 64 nt, hsa
cuucgggcaguccugugugaggauuaagggacgggggugggagguaggcuguggggugggcugg

SEQ ID NO: 282588 - RNA, 64 nt, hsa
cguuuuucucuguggcuguauguggguugcuugggggugggaugggaagaggcucuuugcaaac

SEQ ID NO: 282589 - RNA, 64 nt, hsa
ggugugggguugggggaugaggucagggggucuugggugggaguugggggccccuucauuuccc

SEQ ID NO: 282590 - RNA, 64 nt, hsa
ggcuggaagcagaaacaaaaugaaaaaaaaaggggggugggaggggaagaaaaacucuauuuuu

SEQ ID NO: 282591 - RNA, 64 nt, hsa
acgucccugcggaagccacagggugagcacucuggggugggagggucugcagggaauugggggg

SEQ ID NO: 282592 - RNA, 64 nt, hsa
aacucugccaaauggaaaaugaccaaauuuaagagggugggacaguccccugcuccucucccag

SEQ ID NO: 282593 - RNA, 64 nt, hsa
uuuccuggaaucaguuuauuauacugaaaacugggggugggaguagggagcuaguuuguugaua

SEQ ID NO: 282594 - RNA, 64 nt, hsa
cugcccgggaagugcagcaggcagcuuuucuuuggggugggacuugcccugagcuuggagcugc

SEQ ID NO: 282595 - RNA, 64 nt, hsa
aggccucguuuuccuggucuugacugcucuguuugggugggagaagauucucugggggucccca

SEQ ID NO: 282596 - RNA, 64 nt, hsa
uccagugcuccuacugguucccaagcuacagguggggugggaaaggcuuuaucagguaucauca

SEQ ID NO: 282597 - RNA, 64 nt, hsa
gcuaagggaucagggagaggaagaaagagggauggggugggaggcacccccuccagugcuccua

SEQ ID NO: 282598 - RNA, 64 nt, hsa
accccagaggcaaggcugugcacucagggagggagggugggacacagaggugcaucuagggucc

SEQ ID NO: 282599 - RNA, 64 nt, hsa
cccccuuuuuuuuuguuuuguucuguuuuguuuugggugggagggugggaaauuuggguuuuua

SEQ ID NO: 282600 - RNA, 64 nt, hsa
uuuuuuguuuuguucuguuuuguuuugggugggagggugggaaauuuggguuuuuaaguccucu

SEQ ID NO: 282601 - RNA, 64 nt, hsa
cuuccuccacccuaagcccuggggcccugaaauggggugggagggcaggggugggagcccuccu

SEQ ID NO: 282602 - RNA, 64 nt, hsa
agcccuggggcccugaaauggggugggagggcaggggugggagcccuccuaguggguuuggggg

SEQ ID NO: 282603 - RNA, 60 nt, hsa
ccgggaggcggagguugcagugagccaagaucgcaccacugcacuccagccuggcaacag

SEQ ID NO: 282604 - RNA, 60 nt, hsa
ccuggagauggagguugcagugagcagagaucgcaccacugcacuccagccugggcaaga

SEQ ID NO: 282605 - RNA, 64 nt, hsa
ucguaauaaccuuuuggaauuauauuuuuccacuuuuaggcaaagugcuuagacauuuucaauu

SEQ ID NO: 282606 - RNA, 64 nt, hsa
ccaaccaacaaacuuaaaaguuuaucuaccucguuuuaggcaaucaagauucuggagagucuug

SEQ ID NO: 282607 - RNA, 64 nt, hsa
cugagccaucaaugagcugagagaucaaugacuuuuuaggcagcuguguuuuuuaagccauaua

SEQ ID NO: 282608 - RNA, 64 nt, hsa
gauacacacuuaucuauucugucuccuucuagcuuuuaggcagccuacucuuggaaacuggagg

SEQ ID NO: 282609 - RNA, 64 nt, hsa
uuuuuguaaaugagguuuacguugaagaaacaguauacaagaacccugucucucaaaugaucag

SEQ ID NO: 282610 - RNA, 64 nt, hsa
ugacuguuuuaacaaauacucauagucagugccuauacaagacagugaagugaccucucuguca

SEQ ID NO: 282611 - RNA, 64 nt, hsa
aauuucuuuguguucccagugucuugcccaguagauacaagauaaauauugccagaaucagaua

SEQ ID NO: 282612 - RNA, 64 nt, hsa
accaggccccucccacaacauggaauaaugggagauacaagauauuuggguggagacacagagc

SEQ ID NO: 282613 - RNA, 64 nt, hsa
uugugucuacaccagguuugaaauaaguaaacaaauacaagagguucauauaaaagggcaaaug

SEQ ID NO: 282614 - RNA, 64 nt, hsa
ugaggccaaugcugcuuucugguguauauucuccauacaagauuauuauuaacugcucuuuuuc

SEQ ID NO: 282615 - RNA, 64 nt, hsa
cuucucauccuggagcguauucaagaucuucccaauacaagaaaauuaauaaaaaauuuauaua

SEQ ID NO: 282616 - RNA, 64 nt, hsa
aaaaauauuuauuuuguggaucuuugaaaagguaauacaagacuucuuuugauaguauagaaug

SEQ ID NO: 282617 - RNA, 64 nt, hsa
uagcaauccugacauuaaaaggaaauguauuucuauacaagauuauuagcuguaauacaagaua

SEQ ID NO: 282618 - RNA, 64 nt, hsa
ggaaauguauuucuauacaagauuauuagcuguaauacaagauauuuauuuaaccaaugaccuu

SEQ ID NO: 282619 - RNA, 64 nt, hsa
aaugcuggauggaugcaggaaggaauggaggaaugaaugggaagggagaacauaucuauccucu

SEQ ID NO: 282620 - RNA, 64 nt, hsa
ccccuggggcuagagguggaggaggcaguccugggaaugggaaaaaccccaacuuuggggucau

SEQ ID NO: 282621 - RNA, 64 nt, hsa
aaaguggaaacaacccaaaugucuaccaacugaugaaugggaaauaaaauguggucuguccacg

SEQ ID NO: 282622 - RNA, 64 nt, hsa
agacccuaucaagaaggugaaaagauaaccugcagaaugggagaaaauauuugcgagucauaua

SEQ ID NO: 282623 - RNA, 64 nt, hsa
uguccuggggcuaagaaagaagauaauuuuuaaagaaugggagugggcaacagugaaaaauauu

SEQ ID NO: 282624 - RNA, 64 nt, hsa
uucugaaacucuaccacauacugaaggaauacaggaaugggauuaagaugacuagcauagcagu

SEQ ID NO: 282625 - RNA, 64 nt, hsa
cuuuguuagcaguuauguggucagaaaacaacuagaaugggagcacaccuggugcccagauuuu

SEQ ID NO: 282626 - RNA, 64 nt, hsa
aaauauuuacaagcccaaacuaauauaaaugauugaaugggaacaaaucucuugugcagaagaa

SEQ ID NO: 282627 - RNA, 64 nt, hsa
ggguuuuguauucagaauguugugcaauauuuuggaaugggacauugguguguuuagagauuuu

SEQ ID NO: 282628 - RNA, 64 nt, hsa
cuuacuucuagaaaaaagauccagcccaggcacggaaugggagggcccugcaaagcacccaagu

SEQ ID NO: 282629 - RNA, 64 nt, hsa
cccagaguuugcucaauuccaagacagugcccaugaaugggacaccuguaauguaacccacaca

SEQ ID NO: 282630 - RNA, 64 nt, hsa
cuaaagccuuguugccuucucuuuaaugccuagagaaugggaugugugaugcaaaugcucaaaa

SEQ ID NO: 282631 - RNA, 64 nt, hsa; identical to SEQ ID NO: 154250

SEQ ID NO: 282632 - RNA, 64 nt, hsa; identical to SEQ ID NO: 154251

SEQ ID NO: 282633 - RNA, 64 nt, hsa; identical to SEQ ID NO: 154252

SEQ ID NO: 282634 - RNA, 64 nt, hsa; identical to SEQ ID NO: 154253

SEQ ID NO: 282635 - RNA, 64 nt, hsa; identical to SEQ ID NO: 154254

SEQ ID NO: 282636 - RNA, 64 nt, hsa; identical to SEQ ID NO: 154255

SEQ ID NO: 282637 - RNA, 64 nt, hsa; identical to SEQ ID NO: 154256

SEQ ID NO: 282638 - RNA, 64 nt, hsa; identical to SEQ ID NO: 154257

SEQ ID NO: 282639 - RNA, 64 nt, hsa; identical to SEQ ID NO: 154258

SEQ ID NO: 282640 - RNA, 64 nt, hsa; identical to SEQ ID NO: 154259

SEQ ID NO: 282641 - RNA, 64 nt, hsa; identical to SEQ ID NO: 154260

SEQ ID NO: 282642 - RNA, 64 nt, hsa; identical to SEQ ID NO: 154261

SEQ ID NO: 282643 - RNA, 64 nt, hsa; identical to SEQ ID NO: 154262

SEQ ID NO: 282644 - RNA, 64 nt, hsa; identical to SEQ ID NO: 154263

SEQ ID NO: 282645 - RNA, 64 nt, hsa; identical to SEQ ID NO: 154264

SEQ ID NO: 282646 - RNA, 64 nt, hsa; identical to SEQ ID NO: 154265

SEQ ID NO: 282647 - RNA, 64 nt, hsa; identical to SEQ ID NO: 154266

SEQ ID NO: 282648 - RNA, 64 nt, hsa; identical to SEQ ID NO: 154267

SEQ ID NO: 282649 - RNA, 64 nt, hsa; identical to SEQ ID NO: 154268

SEQ ID NO: 282650 - RNA, 64 nt, hsa; identical to SEQ ID NO: 154269

SEQ ID NO: 282651 - RNA, 64 nt, hsa; identical to SEQ ID NO: 154270

SEQ ID NO: 282652 - RNA, 64 nt, hsa; identical to SEQ ID NO: 154271

SEQ ID NO: 282653 - RNA, 64 nt, hsa; identical to SEQ ID NO: 154272

SEQ ID NO: 282654 - RNA, 64 nt, hsa; identical to SEQ ID NO: 154273

SEQ ID NO: 282655 - RNA, 64 nt, hsa; identical to SEQ ID NO: 154274

SEQ ID NO: 282656 - RNA, 64 nt, hsa; identical to SEQ ID NO: 154275

SEQ ID NO: 282657 - RNA, 64 nt, hsa; identical to SEQ ID NO: 154276

SEQ ID NO: 282658 - RNA, 64 nt, hsa; identical to SEQ ID NO: 154277

SEQ ID NO: 282659 - RNA, 64 nt, hsa; identical to SEQ ID NO: 154278

SEQ ID NO: 282660 - RNA, 64 nt, hsa
gaaaaaggacagcuucugagugugguaauugugccucuagcacccagccuuucaaagcccaccu

SEQ ID NO: 282661 - RNA, 64 nt, hsa
caguguuguugauucugauugugaauccccucaacucuagcagacacauacacaccccugaaau

SEQ ID NO: 282662 - RNA, 64 nt, hsa
uucucaaaaccugggugagaagacuauuccuggacucuagcaacuucaaaacugaggcuggguu

SEQ ID NO: 282663 - RNA, 64 nt, hsa
cucaccauccaauuaucuacccaccugucuuccucucuagcaaucuauuuacuguuuaucaauc

SEQ ID NO: 282664 - RNA, 64 nt, hsa
caauacacuauuugguaagauaauguacugacaucucuagcaaucuuuuuugccaguggcuuua

SEQ ID NO: 282665 - RNA, 64 nt, hsa
auaaucacauuagaggaaaugagauauccauuaccucuagcauuuauucuuuuuauuacaagca

SEQ ID NO: 282666 - RNA, 64 nt, hsa
guuuagccauuuuggcugcuguucuuuaaucuuccucuagcaggcaugcaguccaaggaauauc

SEQ ID NO: 282667 - RNA, 64 nt, hsa
guuuaaccauuuuggcugcugcucuuuaauuuuccucuagcaggcaugcaguccaaggaauauc

SEQ ID NO: 282668 - RNA, 64 nt, hsa
cuaaauucuuagcaucucacuggauguaaaaucuaucaguuaauaguuuuaaaaaugucucuuu

SEQ ID NO: 282669 - RNA, 64 nt, hsa
uauucccaagaagaaauugauuuauuuuuaaacuaucaguuacugaagacuuaugaaaagguca

SEQ ID NO: 282670 - RNA, 64 nt, hsa
ugcugagucauuuucucaaaucauauuccauuguaucaguuaacauauaguuuuaaauguaugu

SEQ ID NO: 282671 - RNA, 64 nt, hsa
cuguuuccaaaaagaaggugcaauaucauauaucaucaguuagcaauauuagcauuucaaucag

SEQ ID NO: 282672 - RNA, 64 nt, hsa
agugguuuauuccacuggagaaaggggauugaaaaucaguuagaaccaauguauuucuugcccc

SEQ ID NO: 282673 - RNA, 64 nt, hsa
ugagaacaucucucgugucacauacugcaggugcaucaguuacuuuugcacagauucuaggggg

SEQ ID NO: 282674 - RNA, 64 nt, hsa
uuagguuaaauaucuguggacaagaaacaagauaaucaguuacugagugaagaaagacgggaau

SEQ ID NO: 282675 - RNA, 64 nt, hsa
uguuaaaugaugagcauuuaauaaaauugugauaaucaguuaucaguacaagugccgcauagug

SEQ ID NO: 282676 - RNA, 64 nt, hsa
ggcuaaauauuuguccuuuuauuaugguuucuaaaucaguuauuuucuucagcuuuaauuucau

SEQ ID NO: 282677 - RNA, 64 nt, hsa
cuauuuuuaaggugaauuuuaauuucuaucugaaaucaguuaagauaccuugagaaaaacugca

SEQ ID NO: 282678 - RNA, 64 nt, hsa
uauccuuauucugagccuucuccuccuaacccucaucaguuaagguuaggaagaacaagaugcc

SEQ ID NO: 282679 - RNA, 64 nt, hsa
gcacguuuuugucccuucaguugccuuauguugaaucaguuauauuuaucuguaccuucuuugc

SEQ ID NO: 282680 - RNA, 64 nt, hsa
aauauaaucaaagaauuuucuguacauauuucacuaaagacaaguuuuugggcuggauguggua

SEQ ID NO: 282681 - RNA, 64 nt, hsa
gggcacaaaaugaaugaauaaauaaauaaaugaauaaagacaaaagccaagguguaugcucuca

SEQ ID NO: 282682 - RNA, 64 nt, hsa
uggguguggguugaagguguuuaacucagaaaaguaaagacaggaaauaacucucugcuagguc

SEQ ID NO: 282683 - RNA, 64 nt, hsa
uucuucuaaaucauaaaugcagacaauguuuagguaaagacauacucauuaaguguuauuuauu

SEQ ID NO: 282684 - RNA, 64 nt, hsa
gugccacccacccaacuaauuuuuguguuuuuaauaaagacaggguuucaccauguuggccagg

SEQ ID NO: 282685 - RNA, 64 nt, hsa
uuccuggcucaucucuuuauucuuuuuuuuuuuuuaaagacagagucucgcucuguugcccagg

SEQ ID NO: 282686 - RNA, 64 nt, hsa
aaauuuuuuauaauauauguaauuugucuagucuuaaagacauuuggagcauggccaacaggaa

SEQ ID NO: 282687 - RNA, 64 nt, hsa
uuucaucaagcagucaacauguaaauuucuguuguaaagacaccuuauuuaauauaaucgauuc

SEQ ID NO: 282688 - RNA, 64 nt, hsa
uccaaagagacucccacucagauucuaaagcauuuaaagacaauucuagcagaauuuaucaaaa

SEQ ID NO: 282689 - RNA, 64 nt, hsa
cuugaaagcaauguucauaaauauuuaagcaaauuaaagacaauguuaacaaauuuucuauuaa

SEQ ID NO: 282690 - RNA, 64 nt, hsa
gguccccucuaguaugugucacugagaaauuuuuuaaagacaugguagaucguguuuagaggcu

SEQ ID NO: 282691 - RNA, 64 nt, hsa
auuuaaguggauuaauauucuacaugugugccccuaaagacacauuuacucaauauuggagaag

SEQ ID NO: 282692 - RNA, 64 nt, hsa
gucuuaagugagaauauuugccugggaguagagauaaagacacaaaccgaaugugaaauaccag

SEQ ID NO: 282693 - RNA, 64 nt, hsa
aguuuuuauacagguugcaaaacauaguauucauuaaagacaugaauuuagaauugauuucuuu

SEQ ID NO: 282694 - RNA, 64 nt, hsa
agaagaaaaagagaaagaugaaaauaggaacaaauaaagacaaacaacauuaagggccauauug

SEQ ID NO: 282695 - RNA, 64 nt, hsa
aaagacuuuuucauagagaagaggcuuucuuuuguaaagacagaauaaaaauaauuguuauguu

SEQ ID NO: 282696 - RNA, 64 nt, hsa
ggguauauacccaaaggaauagaaaucauuguuauaaagacacaugcacgcguauguucguugc

SEQ ID NO: 282697 - RNA, 64 nt, hsa
auuaguucagccauuguggaagacaguguggggauaaagacagagauaccauucaacccagcaa

SEQ ID NO: 282698 - RNA, 64 nt, hsa
aucugguuguauuagucuguuuucacgcugcugauaaagacauaccugagaccaggaagaaaaa

SEQ ID NO: 282699 - RNA, 64 nt, hsa
aguuuacuguauuagucuguuuucacacugcugauaaagacauuccucaagauugugaagaaaa

SEQ ID NO: 282700 - RNA, 64 nt, hsa
gcuggauucucuucacuauaacugagugguaauuuaaagacaacaauuuaaugucacuaauuuu

SEQ ID NO: 282701 - RNA, 64 nt, hsa
cuuaggauuccugaaaagaauuucaaaaaaaaaauaaagacacuguugccaaugugacccaaaa

SEQ ID NO: 282702 - RNA, 64 nt, hsa
gguaaauuuauauugaguuuaacaccugugugauuaaagacaacuuuccaauguaguaucugua

SEQ ID NO: 282703 - RNA, 64 nt, hsa
guuauaucaguguauauacacgaggggaacuguauaaagacauacuaaagggaacagauuaaaa

SEQ ID NO: 282704 - RNA, 64 nt, hsa
cagugacuuggccccagacgcauagacugagguauaaagacaaguaugaauauuacucucaaaa

SEQ ID NO: 282705 - RNA, 64 nt, hsa
auguuauacaaggcaagcauuuuuuuuuuuuuuuuaaagacagguuacgaagacaaagucccag

SEQ ID NO: 282706 - RNA, 64 nt, hsa
aauugaccccuuuaacaugugauuauuguccaauuaaagacaguugauuuaaguagcaugaggu

SEQ ID NO: 282707 - RNA, 64 nt, hsa
caugacuguauauucacuggaagauagucaagacuaaagacacauuagagcaaauugaccccuu

SEQ ID NO: 282708 - RNA, 64 nt, hsa
gcaguuucaaguuaguuagaagcauguugucaacuaaagacaacaaacuaucagauucauucau

SEQ ID NO: 282709 - RNA, 64 nt, hsa
aggcccauaacagaggacuaaaaucucugaauuuuaaagacacagaugacuggcauauuuugga

SEQ ID NO: 282710 - RNA, 64 nt, hsa
ugaaaucuuuacaauuuauguuuagagauugcaguaaagacaggcauaagaaauuauaaaagua

SEQ ID NO: 282711 - RNA, 64 nt, hsa
auccuccucagcugacaggauugagagauuaaaguaaagacaggcauaggaaaucacaagggua

SEQ ID NO: 282712 - RNA, 64 nt, hsa
cacuuuuucucuuuccaugacaucaagacuuugcuaaagacaugaagccacgggugccagaagc

SEQ ID NO: 282713 - RNA, 64 nt, hsa
aagacaggcuggaagauagcugugacuucuauuuuaaagacaauguuaaacuuauaacccacuu

SEQ ID NO: 282714 - RNA, 64 nt, hsa
ucacucuccuuauuacacaagcacagccgcccagugugcacaucaugugcagacaccuuggaaa

SEQ ID NO: 282715 - RNA, 64 nt, hsa
gcucggggugugugugugcgugcuguguguauggugugcacauacgugagugugggugugugua

SEQ ID NO: 282716 - RNA, 64 nt, hsa
ugagugagcacacccgugugcacacucauacacaugugcacacacacgcacucuccccgcucag

SEQ ID NO: 282717 - RNA, 64 nt, hsa
augugugcaugugcugugugagugagcacacccgugugcacacucauacacaugugcacacaca

SEQ ID NO: 282718 - RNA, 64 nt, hsa
acggacucaagugggcuggugacccagucagaguugugcacauggcuuaguuuucauacacagc

SEQ ID NO: 282719 - RNA, 64 nt, hsa
gagagagguuuuuuucuguucugucucauaugauugugcacauacuugagacuguuuugaauuu

SEQ ID NO: 282720 - RNA, 64 nt, hsa
uaugaugugugcacaugcuuaaugagcgugcaagugugcacacguuuguggagaggaggguguu

SEQ ID NO: 282721 - RNA, 64 nt, hsa
aucaagagcauggcuugagugugugaauaugaugugugcacaugcuuaaugagcgugcaagugu

SEQ ID NO: 282722 - RNA, 64 nt, hsa
gcacggauauugccuggacacacacacacacacgugugcacagauaugcugucuggacacgcac

SEQ ID NO: 282723 - RNA, 64 nt, hsa
ucacacacgugcagauauugccuggacacacacaugugcacagauaugcugucuggacaugcac

SEQ ID NO: 282724 - RNA, 64 nt, hsa
guugcccauggugggagcguggucacugugcaguugugcacagaugucuuuccuuuaccguugg

SEQ ID NO: 282725 - RNA, 64 nt, hsa
uuucgggagucaggggaggagaugacuuugcuucugugcacagccccgucuuccaggagccaca

SEQ ID NO: 282726 - RNA, 64 nt, hsa
caccuugucucccuucccaagaacaaaccauuucugugcacauccuuggaggcgagaugagcuc

SEQ ID NO: 282727 - RNA, 64 nt, hsa
cuucacuagagcuuacucuggagcaccuauuuucugugcacaugggagugcuccacucccuagc

SEQ ID NO: 282728 - RNA, 64 nt, hsa
agugccucugugcugguuauauguaugcaccacaugugcacacacggguguuggugcaacucac

SEQ ID NO: 282729 - RNA, 64 nt, hsa
gcaugcuucguagagggccaggagcagcaggucaugugcacaugccguugcagcacaagcuuau

SEQ ID NO: 282730 - RNA, 64 nt, hsa
aguagcgguuucuuucagguuaacaagaggcauuugugcacacacacagggcucuugugugugu

SEQ ID NO: 282731 - RNA, 64 nt, hsa
acauugcacaggguuggugacucgacguggugaaugugcacacgcccugccugguccgccaugu

SEQ ID NO: 282732 - RNA, 64 nt, hsa
uuuauuauuagaagacacaguggcagagcacacaugugcacagguucugauuauuucucuugga

SEQ ID NO: 282733 - RNA, 64 nt, hsa
gucuuccagcgugccgcucaguuccccgaauccgugugcacacgugugaucucgucuucagugu

SEQ ID NO: 282734 - RNA, 64 nt, hsa
cgucuucagugugccgcucaguucccugaauccgugugcacacugcguauguguacgcgcagca

SEQ ID NO: 282735 - RNA, 64 nt, hsa
gugaugugcacauguugucuguuuggugucuuuuugugcacagauuaugaugaagauuagauug

SEQ ID NO: 282736 - RNA, 64 nt, hsa
uuuucacuggaccugugaugucauuucacugugaugugcacauguugucuguuuggugucuuuu

SEQ ID NO: 282737 - RNA, 64 nt, hsa
ucccacagugccuuuuaagggggaccucaccuccugugcacagcccacccacuuuccucugcuu

SEQ ID NO: 282738 - RNA, 64 nt, hsa
ucgccccuuucuggguguguucgcacauccugugugugcacagcugucccuccacuggaucccc

SEQ ID NO: 282739 - RNA, 64 nt, hsa
uauauauagauaucuguauauacacacacacauaugugcacacacacacucucucuccauuauc

SEQ ID NO: 282740 - RNA, 64 nt, hsa
ccaaagaaauauguuuuuguaagugguaggaacaugugcacacaauagaacaugaaauaaguuu

SEQ ID NO: 282741 - RNA, 64 nt, hsa
ugacgcacugccuccugcaccuucagcacaucccugugcacagcuggaagggugcauggcccgc

SEQ ID NO: 282742 - RNA, 64 nt, hsa
acucccauuagggccugcuuugcuuaugcaugugugugcacaugcauguaaaccagggaccuuc

SEQ ID NO: 282743 - RNA, 64 nt, hsa
cccugugcaugucuggacucacggagcucacccaugugcacaagugugcacaguaaacguguuu

SEQ ID NO: 282744 - RNA, 64 nt, hsa
gucuggacucacggagcucacccaugugcacaagugugcacaguaaacguguuuguggucaaca

SEQ ID NO: 282745 - RNA, 64 nt, hsa
uaugugcgugugugcaagugucugugugcaagugugugcacaugugugcgugugcgugcaugug

SEQ ID NO: 282746 - RNA, 64 nt, hsa
gacagauuccaggcgaugugcaaguguaugcacgugugcacacacaccacacauacacacacac

SEQ ID NO: 282747 - RNA, 64 nt, hsa
cuuuagaagcacccaugaaguaguguguucagacugugcacacagaaaacaggcucugccuuca

SEQ ID NO: 282748 - RNA, 64 nt, hsa
uccuucucuuugagaccugacugaaaaaauuaggugugcacaccuguaaucccagcuaccuggg

SEQ ID NO: 282749 - RNA, 64 nt, hsa
uguccauggacgugaaacugcauaguaaugagacugugcacacugauguuuacaagauugaaag

SEQ ID NO: 282750 - RNA, 64 nt, hsa
guugcucuugggucaacuggcuuacagauuuacaugugcacacacacacaaauuucuuaucaca

SEQ ID NO: 282751 - RNA, 64 nt, hsa
uguuacucgugguaguuagguucugugaauuuucugugcacacugaauuagugaaugcugaaug

SEQ ID NO: 282752 - RNA, 64 nt, hsa
auauaaaggcuugagucaugaaauacuuaacacaugugcacauguacacauguacauuuauaug

SEQ ID NO: 282753 - RNA, 64 nt, hsa
uucuuguauccucuuaacuggccauuaucuuguaugugcacauuuuauaaauguacagaaacau

SEQ ID NO: 282754 - RNA, 64 nt, hsa
aacaguaacaaaaaaaucugcucagaaaaauguaugugcacaaauaaaaaaaauuaauggcaau

SEQ ID NO: 282755 - RNA, 64 nt, hsa
uucuuuuauccucuuaacuggccauuaucuuguaugugcacauuuuauaaauguacagaaacau

SEQ ID NO: 282756 - RNA, 64 nt, hsa; identical to SEQ ID NO: 282754

SEQ ID NO: 282757 - RNA, 64 nt, hsa
auaccuuccaucucaaccuaccucgaguggcgaguccagacaccaucaccacgcagagagggga

SEQ ID NO: 282758 - RNA, 64 nt, hsa
gccauucugauuggaccuggcccagugcaaucuguccagacaagcccugcuugcuggaaaacug

SEQ ID NO: 282759 - RNA, 64 nt, hsa
gaucaugggaauugagugucuaugaaaaccauauuccagacaagaauauagucuaagguaaaug

SEQ ID NO: 282760 - RNA, 64 nt, hsa
cuuuuuuaauacacaugacuuuccucucccaguuuccagacagggcucuuugaauguaugucaa

SEQ ID NO: 282761 - RNA, 64 nt, hsa
ggagaaccaugcucuuguucuguuccuguucgguuccagacacugguuucuugcuuuguuuucc

SEQ ID NO: 282762 - RNA, 64 nt, hsa
agcugccucuucucuugacagucugaagcucgcauccagacagucgcucagucuguucacugca

SEQ ID NO: 282763 - RNA, 64 nt, hsa
ugaaacccggugucuaccaaaaauacaaaauguauccagacauggugguguguaccuguagucc

SEQ ID NO: 282764 - RNA, 64 nt, hsa
agacccugacucagaaagaaccacuugcccacaguccagacagauggauuguagguggguuuuc

SEQ ID NO: 282765 - RNA, 64 nt, hsa
uaaaaacuuaaacucaccaaaugguguuuuguuauccagacagccuaguaugaaccguggagga

SEQ ID NO: 282766 - RNA, 64 nt, hsa
aacaccagugaguguucaucugcagccuucccucuccagacagagcagcuacaccaguaauggc

SEQ ID NO: 282767 - RNA, 64 nt, hsa
uacacaaaaauauuuuccuuguagaaaauaguuuuccagacacuuagccuucugaagugcucau

SEQ ID NO: 282768 - RNA, 64 nt, hsa
cuguguacagcgagugaauuaaaaugucugccucuccagacauuucuuaaugauuccacuuaau

SEQ ID NO: 282769 - RNA, 64 nt, hsa
ggaucagugcucucuauugauguucuugcuggucuccagacacauuccuguugcauuaagacuu

SEQ ID NO: 282770 - RNA, 64 nt, hsa
uuaacuggggaccaucugugaaauuaauuuuccauccagacagcugcugugagcaaaugaacau

SEQ ID NO: 282771 - RNA, 64 nt, hsa
agaagugggauucaggaaugggccaagccaggguuccagacaggguggggcuuagaauggggcu

SEQ ID NO: 282772 - RNA, 64 nt, hsa
guguggaguggaggggucagcagggggguuggguuccagacagaguggaucuggagucugaagg

SEQ ID NO: 282773 - RNA, 64 nt, hsa
aggaggaaagaggcccagcucucagcugacgauggaggcagaaccggagucggguuuggggaag

SEQ ID NO: 282774 - RNA, 64 nt, hsa
cacaaccaagcacuuugacauuugcaccuuaggagaggcagauguuaaaauggaauccaaagac

SEQ ID NO: 282775 - RNA, 64 nt, hsa
aacaguuguagcagcagcagacgaagccauugcagaggcagaauaugcugagugucuggaguca

SEQ ID NO: 282776 - RNA, 64 nt, hsa
ucccacccuugagaauguggagaacucccauggagaggcagaauggcaggagguuucauguccc

SEQ ID NO: 282777 - RNA, 64 nt, hsa
gggaggcugaggcaggagaauugcuugaacccuggaggcagaaguugcagugagccgagaucgc

SEQ ID NO: 282778 - RNA, 64 nt, hsa
uaaauugucgaaggucucccaggagcucuguacugaggcagacacagaaagacacaaaacgguc

SEQ ID NO: 282779 - RNA, 64 nt, hsa
gggaggcugaggcaggagaauugcuugaaccggggaggcagaaguugcagugagccgagauuau

SEQ ID NO: 282780 - RNA, 64 nt, hsa
gggaggcugaggcaggagaauggcaugaaccugggaggcagagcuugcagugagcugagauugc

SEQ ID NO: 282781 - RNA, 64 nt, hsa
aagucccaggcaaugccagcauuucaugggggcugaggcagaacccaggagcuccaagaaaggc

SEQ ID NO: 282782 - RNA, 64 nt, hsa
caugcccaccuagcucccuggccagggcccuggggaggcagaggguacccaggggacugagggc

SEQ ID NO: 282783 - RNA, 64 nt, hsa
aggaggcugaggcaggagaauugcuugaaccugggaggcagagguugcagugagccgagaucac

SEQ ID NO: 282784 - RNA, 54 nt, hsa
gcaacaagccuguaugcugagcaggaggcagacuugcagagcuuguuuuguuuc

SEQ ID NO: 282785 - RNA, 64 nt, hsa
gcccccaugccccucugagucacacaggacagaggaggcagagcuucugcccacuguuaucuuc

SEQ ID NO: 282786 - RNA, 64 nt, hsa
ucuggccaggccccccuuuuuucccccaagugaagaggcagaaaccuaagaaguuaucuuuucu

SEQ ID NO: 282787 - RNA, 64 nt, hsa
cuagaaaaacuugggucucuuaccgcgagacugagaggcagaagucagcccgaaugccugucag

SEQ ID NO: 282788 - RNA, 64 nt, hsa
guaacugggaucgcaccuuuuauaccagagaccugaggcagaugaaauuuauuuccaucuagga

SEQ ID NO: 282789 - RNA, 64 nt, hsa
aguuccaaagacucagagaacuagaguuuaagcugaggcagagugccgccacccuggcaugccc

SEQ ID NO: 282790 - RNA, 64 nt, hsa
ucuugagcaaauuaggaaaauguacccuucgcuugaggcagaugcagcccuucccccgagugca

SEQ ID NO: 282791 - RNA, 64 nt, hsa
acugggaggugaaauggggaaauggaaggguuuggaggcagagcugaaaacaggguuggaagga

SEQ ID NO: 282792 - RNA, 64 nt, hsa
agaaugaacugcaaguucagcauaguggaggggagaggcagaacuggaggagaggugcagugaa

SEQ ID NO: 282793 - RNA, 64 nt, hsa
gggaggcugaggcaggagaaucacuugaacccgggaggcagaggucauggugagccgagaucac

SEQ ID NO: 282794 - RNA, 64 nt, hsa
aggaaugugguguucuggcuucacaaaugaaaaggaggcagauguuaccauugucuuuucacug

SEQ ID NO: 282795 - RNA, 64 nt, hsa
acuuguuuaucucagucuguacaaaaacaguaaggaggcagaaagccaagcacugcauuuuuag

SEQ ID NO: 282796 - RNA, 64 nt, hsa
gggaggcugaggcaggagaaucacuugaacccgggaggcagagguugcagugagcugagauugc

SEQ ID NO: 282797 - RNA, 64 nt, hsa
agggggcugaggcaggggaauggcuugaacccaggaggcagagguugcagugagccaaggucau

SEQ ID NO: 282798 - RNA, 64 nt, hsa
gggaggcugaggcaggagaaucgcuugaaccugggaggcagaaguugcagugagcugagauugu

SEQ ID NO: 282799 - RNA, 64 nt, hsa
acaguggcucaugccuauaauuccagcacuuugggaggcagaggugggcggaucacaaggucaa

SEQ ID NO: 282800 - RNA, 64 nt, hsa
gcgguggcucaugccuguaauuccagcacuuugggaggcagaguugggaggaucaccugauguc

SEQ ID NO: 282801 - RNA, 64 nt, hsa
gggaggcugaggcaagagaaucgcuugaacccaggaggcagagguugcagugagcugagaucau

SEQ ID NO: 282802 - RNA, 64 nt, hsa
accaaacuuguaaaagcauuccauguauucaguggaggcagaauguauaauauuuuuuccuuau

SEQ ID NO: 282803 - RNA, 64 nt, hsa
auaacacauguaauacauaguagaauacauuucagaggcagaguuccucggauuauuuuuuaug

SEQ ID NO: 282804 - RNA, 64 nt, hsa
auucuugguuuuaaugagaggaggcagagagagggaggcagauggaagaagaaaaacaguuaaa

SEQ ID NO: 282805 - RNA, 64 nt, hsa
ccaaacuaagcuagauucuugguuuuaaugagaggaggcagagagagggaggcagauggaagaa

SEQ ID NO: 282806 - RNA, 64 nt, hsa
gggaggcugaggcaugagaaucauuugaacccgcgaggcagagucugcagugagccgagauugc

SEQ ID NO: 282807 - RNA, 64 nt, hsa
aagcacaggaucaaggaauuaggguggucuacuugaggcagaugggauaguagcugggaacugu

SEQ ID NO: 282808 - RNA, 64 nt, hsa
uggaggcugaggcaggagaauggcaugaacccaggaggcagagauugcagugagccaagaucac

SEQ ID NO: 282809 - RNA, 64 nt, hsa
ggaggcugaggcaggagaauuugcuugauccugggaggcagagguuguagugagccgagaucgc

SEQ ID NO: 282810 - RNA, 64 nt, hsa
aauuaaguugcauagcugcuuugcagugguuucagaggcagaucugagaagauuaaaaaaaaau

SEQ ID NO: 282811 - RNA, 64 nt, hsa
agcucgccucuuuaggguccaugguggcagcagagaggcagaagugggaguccagagccaggaa

SEQ ID NO: 282812 - RNA, 64 nt, hsa
cuccaguccaugcucuucuggacguggacucucugaggcagaacugagcuuuuccaggccucuu

SEQ ID NO: 282813 - RNA, 64 nt, hsa
gcucacgccuguaauccuaacacuuugggaggccgaggcagacagaucaccugaggucaggagu

SEQ ID NO: 282814 - RNA, 64 nt, hsa
uccaggcaccugugaucccagcuacuuagaggcugaggcagaagaauugcuuuaaccuuggagg

SEQ ID NO: 282815 - RNA, 64 nt, hsa
aggaggcuaaggcaggagaaucacuugaacccaggaggcagagguuggagugagcugagaucgc

SEQ ID NO: 282816 - RNA, 64 nt, hsa
gcaauggcucacaccuguaauuccaacacuuugggaggcagaggcgggaggauugcuugaggcc

SEQ ID NO: 282817 - RNA, 64 nt, hsa
aagaggcugaggcaggagaaucgcuugaaccugggaggcagagguugcagugagccaagauuau

SEQ ID NO: 282818 - RNA, 64 nt, hsa
auucagaaauguauugggggguggaggagaauaagaggcagagcaagagcuagagaauugguuu

SEQ ID NO: 282819 - RNA, 64 nt, hsa
cgacauuccccccgaaaaauugaaauguaaagaugaggcagagaauaaaguguucuaugaaauu

SEQ ID NO: 282820 - RNA, 64 nt, hsa
gggaggcugaggcaggagaauugcucaaacccgggaggcagagguugcagugacccaagaucgu

SEQ ID NO: 282821 - RNA, 64 nt, hsa
uagcuguguucaauuuuuuuuuuuuuuuuuuuuugaggcagagucuugcucugcuggagugcgg

SEQ ID NO: 282822 - RNA, 64 nt, hsa
gaaauuagaauagaaccaaaaacgccagucaugggaggcagagcugggggagcgaggcugacaa

SEQ ID NO: 282823 - RNA, 64 nt, hsa
gugcacgucuguagucccagcuacucaggaggcugaggcagaagaaucgcuugaacccuggagg

SEQ ID NO: 282824 - RNA, 64 nt, hsa
uacuccagaagaguauaucuaaguaacuaaaauggaggcagaaaauguuuuaaggauuuucuuc

SEQ ID NO: 282825 - RNA, 64 nt, hsa
gggaggcugaggcaggagaaucacuugaacccaggaggcagagguugcagugagccaagauugc

SEQ ID NO: 282826 - RNA, 64 nt, hsa
gggcaugccuguagucccagcuacucagaagggugaggcagaauugccugaacccgcgaggcgg

SEQ ID NO: 282827 - RNA, 64 nt, hsa
agguggcugaggcauaagaauugcuugagccugggaggcagagauugcacugagccgagaucgc

SEQ ID NO: 282828 - RNA, 64 nt, hsa
ccccagugccggagcagaaaggacccuggacccagaggcagauacugcggggugguagaaaagg

SEQ ID NO: 282829 - RNA, 64 nt, hsa
gcuuugaaggccugaggucugcggaaggugggaggaggcagacgcccugcguggcccauggucg

SEQ ID NO: 282830 - RNA, 64 nt, hsa
auaauaaucaaaugccuucaauuucugagaaaaugaggcagagcauggaaaaggaauaggaagg

SEQ ID NO: 282831 - RNA, 64 nt, hsa
cucagcucccaccguguuugucuggugucagcacgaggcagagcugugugcuccauagcgugua

SEQ ID NO: 282832 - RNA, 64 nt, hsa
aggaggccgaggcagaagaauugcuugaacuggggaggcagagguugcggugagcccagaucgc

SEQ ID NO: 282833 - RNA, 64 nt, hsa
gcgcauggcuguaauccuggcuacucaggaggccgaggcagaagaauugcuugaacuggggagg

SEQ ID NO: 282834 - RNA, 53 nt, hsa
ggucacacgagccagugugaguggaggcagaggagugaggcccacgggcagcg

SEQ ID NO: 282835 - RNA, 64 nt, hsa
gaccccccgacauagcaaaagguggcaacccauggaggcagaaagaaggacgccagccugaccc

SEQ ID NO: 282836 - RNA, 64 nt, hsa
ucaaaccgcaaguaugggagauuuaggcccugcagaggcagaccauuccuuaguaucucacaaa

SEQ ID NO: 282837 - RNA, 64 nt, hsa
auuccuuaguaucucacaaagcagaguaauacuggaggcagaguagggggugguuggagagcag

SEQ ID NO: 282838 - RNA, 64 nt, hsa
gaguagggggugguuggagagcaguuaguacaaagaggcagaacagugucugguuuacuuggca

SEQ ID NO: 282839 - RNA, 64 nt, hsa
uguuguccagaaaaucuucccagauagggaaacugaggcagagagugccguggagugguuuuug

SEQ ID NO: 282840 - RNA, 64 nt, hsa
ggugaucaauuacaugugcacagugcuaggacgggaggcagagccggcucagagcagguccacc

SEQ ID NO: 282841 - RNA, 64 nt, hsa
gccucgguggcccugacugucagggagggccagggaggcagagcgggagggagucucaggagga

SEQ ID NO: 282842 - RNA, 64 nt, hsa
gccccccagcuacuguaugcccccgacccccgcagaggcagaaugaacccauagggagcugauc

SEQ ID NO: 282843 - RNA, 64 nt, hsa
cacacaaagguuguucagggagaagggggugcaggaggcagagggugccccgcagggagcuggu

SEQ ID NO: 282844 - RNA, 64 nt, hsa
gaggcguuucuggggcuccagagaagugccacgggaggcagaaguccagaacugcccauauaga

SEQ ID NO: 282845 - RNA, 64 nt, hsa
cacugcucccucuagaaagauuccuucaggucuggaggcagaggaaugggcauagcugagccag

SEQ ID NO: 282846 - RNA, 64 nt, hsa
uugccacaaugguaugauggcuugguagccccucgaggcagaugcaccugacuugcugcuauua

SEQ ID NO: 282847 - RNA, 53 nt, hsa
cccuaccccacggaggaugagaagaggcagaucgcagcccagaccaaccucac

SEQ ID NO: 282848 - RNA, 64 nt, hsa
cggaaggacuugaguuguuuacaagcccugcacugaggcagauuggugcuguucgcagaguagg

SEQ ID NO: 282849 - RNA, 64 nt, hsa
gcacuggaggucucgcucccccagccuccgacccgaggcagaauaaagcaaggcucccgaaacc

SEQ ID NO: 282850 - RNA, 64 nt, hsa
caaggcugucugguuuggcgaggacaucgggacggaggcagacguggucguucucaacgcgccc

SEQ ID NO: 282851 - RNA, 64 nt, hsa
gccucuacggccccgacggacgcuugugaggcccgaggcagaagggcccaccccgucccuccuc

SEQ ID NO: 282852 - RNA, 64 nt, hsa
caggaccagagaagggaaaugacuucuccaggcagaggcagaucugagucuagaacccaggcuu

SEQ ID NO: 282853 - RNA, 64 nt, hsa
gaacaaaaagagcagcagugagaaggcaaagagagaggcagaagagacagacgaggcagagaca

SEQ ID NO: 282854 - RNA, 64 nt, hsa
ugagaaggcaaagagagaggcagaagagacagacgaggcagagacaaaacacugagaaagagac

SEQ ID NO: 282855 - RNA, 64 nt, hsa
gaacuggcuccggggggaguggggcccugcgcuagaggcagaggcaguucuuuguucaagcguu

SEQ ID NO: 282856 - RNA, 64 nt, hsa
uugguuuugggagggcgaggacugggccagguuagaggcagauggcacaggggcguguggcggg

SEQ ID NO: 282857 - RNA, 64 nt, hsa
cucuguugaacuggucuaaugaguucaagggccugaggcagauccagaggacaagccugccuca

SEQ ID NO: 282858 - RNA, 64 nt, hsa
cuuugguguggaggugcuggcauucagucugcuagaggcagaggaagaagggugaggacagcac

SEQ ID NO: 282859 - RNA, 64 nt, hsa
ggguggcccaggagccauggccucacacagacccgaggcagagaacagcucauugggucacugg

SEQ ID NO: 282860 - RNA, 64 nt, hsa
aaaguggacacagaccagacuaaggaagaagucugaggcagacggugaggguggcccaggagcc

SEQ ID NO: 282861 - RNA, 64 nt, hsa
ccucgggcuccaggcccccacugagacccucucggaggcagaagcacuucaccccucagagucc

SEQ ID NO: 282862 - RNA, 64 nt, hsa
uaauagagacacagagauggaauagaaaagaugagaggcagaggcagacaggcgcuggacagag

SEQ ID NO: 282863 - RNA, 64 nt, hsa
agacacagagauggaauagaaaagaugagaggcagaggcagacaggcgcuggacagaggggcag

SEQ ID NO: 282864 - RNA, 64 nt, hsa
gacagaggggcaggggagugccaagguuguccuggaggcagacagcccagcugagccuccuuac

SEQ ID NO: 282865 - RNA, 64 nt, hsa
aggaggcugaggcaggagaaucgcuugaaccugggaggcagagguugcagugagccaagaucgc

SEQ ID NO: 282866 - RNA, 64 nt, hsa
aguuuccuauuacugaggaaaaccuccauacacugaggcagaaacuugugucaguuggaggaaa

SEQ ID NO: 282867 - RNA, 64 nt, hsa
ucauacagcuauuaaaauguaacugaccuccuuagaggcagauuaguaacuguuccuacuuugu

SEQ ID NO: 282868 - RNA, 64 nt, hsa
aaaaaagaaaugaaauugacaagcuaggaaagaggaggcagaaagauuuggaaaauucacagag

SEQ ID NO: 282869 - RNA, 64 nt, hsa
gcuucacccuguguccuuaggaggggguggccuugaggcagagccgugccucacugacccccag

SEQ ID NO: 282870 - RNA, 64 nt, hsa
gcuguggcccugcauccagauaccugccucguccgaggcagacacccccaccccugccuccucc

SEQ ID NO: 282871 - RNA, 64 nt, hsa
acuucaaguccucuguaacaucugaggugaccaagaggcagaagagcagagcagucgggggccg

SEQ ID NO: 282872 - RNA, 64 nt, hsa
caacugcagcucugcugugggggcccgugggagggaggcagaccccugggcuuuccugcuggcc

SEQ ID NO: 282873 - RNA, 64 nt, hsa
cgggagagacacaggauaaaagguuaaaagugcagaggcagagucuggggcucagguugggucu

SEQ ID NO: 282874 - RNA, 64 nt, hsa
gcccccucuguccuuuucagaacacauggacuuggaggcagauuugaaauaaacuuuuaguaaa

SEQ ID NO: 282875 - RNA, 64 nt, hsa
acuggggagugcuggaauggggaccugggguggggaggcagagggucacuuuacauaggauuaa

SEQ ID NO: 282876 - RNA, 64 nt, hsa
agcugugaaauugaagucccaauuuaagaguccugaggcagaaccugguggcuggaggcauucc

SEQ ID NO: 282877 - RNA, 64 nt, hsa
uggcuccgcuguguggauggggagaucggggccagaggcagaacccuggugaggaagcuccagu

SEQ ID NO: 282878 - RNA, 64 nt, hsa
gguugggcagcugaacaguguuggcuuucaugaggaggcagaaagcagaggcuggccucagacu

SEQ ID NO: 282879 - RNA, 64 nt, hsa
cugccuagcacucacaugcuggacaggucugggagaggcagagugccccaccugccacuaggcu

SEQ ID NO: 282880 - RNA, 64 nt, hsa
ugggccugcagccuuccucuucugggacugcugugaggcagaggaaugauggagaaucuagugu

SEQ ID NO: 282881 - RNA, 64 nt, hsa
agcuucgcacaggcuccuggagggcugccugggggaggcagacaugggagugccaagguggcca

SEQ ID NO: 282882 - RNA, 64 nt, hsa
gagaggcagagagggagagaggcagagagggagagaggcagagagacagagagggagagaggga

SEQ ID NO: 282883 - RNA, 64 nt, hsa
gacaggcagagaaggagagaggcagagagggagagaggcagagagggagagaggcagagagaca

SEQ ID NO: 282884 - RNA, 64 nt, hsa
ggcagagaaggaaagagacaggcagagaaggagagaggcagagagggagagaggcagagaggga

SEQ ID NO: 282885 - RNA, 64 nt, hsa
gagagacagaggggaagagaggcagagagggaaagaggcagagaaggaaagagacaggcagaga

SEQ ID NO: 282886 - RNA, 64 nt, hsa
gagagacagagggagagagagacagaggggaagagaggcagagagggaaagaggcagagaagga

SEQ ID NO: 282887 - RNA, 64 nt, hsa
gaggggagagagauaugaggagagagagacagaggaggcagagagggagagaaacagaggagac

SEQ ID NO: 282888 - RNA, 64 nt, hsa
guucuguuuuuuuuuuuuuuuuuuuuuuuuuuuugaggcagagucuuguucuguugccugggcu

SEQ ID NO: 282889 - RNA, 64 nt, hsa
gucuuauauaaugagcauaggaaaauuuuggaaugaggcagaaaaguauaucaagacauacuuc

SEQ ID NO: 282890 - RNA, 64 nt, hsa
gcgggcaucuguaauaccagcuacuugggaggcugaggcagaagaaucacuugaacccgggagg

SEQ ID NO: 282891 - RNA, 64 nt, hsa
gggaggcugaggcagaagaaucacuugaacccgggaggcagagguuacagugagcugagaucgc

SEQ ID NO: 282892 - RNA, 64 nt, hsa
gggaggcugaggcaugagaaucacuuaaaccugagaggcagagguuacagugagccaagaucgu

SEQ ID NO: 282893 - RNA, 64 nt, hsa
gggaggcugaggcaggagaacugcuugaacccaggaggcagagguugcagugauccaagaucau

SEQ ID NO: 282894 - RNA, 64 nt, hsa
gccagagcuuuguuuuauauauuuauucaucugggaggcagaacaggcuucggacagugcccau

SEQ ID NO: 282895 - RNA, 64 nt, hsa
accaaacucauucaccaaaugaugccacuucccagaggcagagccugagucacuggucacccuu

SEQ ID NO: 282896 - RNA, 64 nt, hsa
gcuggcgccuguaaucccagcuacucaggagacugaggcagaaggaucgcuugaaccugggagg

SEQ ID NO: 282897 - RNA, 64 nt, hsa
aggagacugaggcagaaggaucgcuugaaccugggaggcagagguugcagugagccgagauugc

SEQ ID NO: 282898 - RNA, 64 nt, hsa
agagacacacagagaagaaagccauguggcggcagaggcagagaugggagugaugcggacggac

SEQ ID NO: 282899 - RNA, 64 nt, hsa
uggagaaucugggggacugggagugggggucagagaggcagauuccuuccccucccguccccuc

SEQ ID NO: 282900 - RNA, 64 nt, hsa
acacugcccucauagagcucacaguccaauggaggaggcagauguguccucaggcagcgacugg

SEQ ID NO: 282901 - RNA, 64 nt, hsa
aggaggcugaggcagaugaauugcuugaauccaggaggcagagguugcaaugagccgagauugu

SEQ ID NO: 282902 - RNA, 64 nt, hsa
gcgcgcgccuguaaucccagcuacucaggaggcugaggcagaugaauugcuugaauccaggagg

SEQ ID NO: 282903 - RNA, 64 nt, hsa
cagagggugcuguuucaacgccaccaccaggagagaggcagaggggcugugccgugcuagaguc

SEQ ID NO: 282904 - RNA, 64 nt, hsa
gcugggagaccagguccucugugcaugggcccgggaggcagaccugccccaagggugaugcaga

SEQ ID NO: 282905 - RNA, 64 nt, hsa
caagauuguuugaaaaaaaaaaaaggggagcagggaggcagaaaguccuggaaaaguaaauugu

SEQ ID NO: 282906 - RNA, 64 nt, hsa
gcgggcgccuguaaucccagcuacuugggaggcugaggcagaagaaucauuugaacccaggagg

SEQ ID NO: 282907 - RNA, 64 nt, hsa
gggaggcugaggcagaagaaucauuugaacccaggaggcagagguuacagugagccgagaucgu

SEQ ID NO: 282908 - RNA, 64 nt, hsa
agggaguguggagaagguggaagagcugagcucagaggcagagaagcuccuugcagggagcacu

SEQ ID NO: 282909 - RNA, 64 nt, hsa
uggcagagccugggccaagcugcagccuacugaggaggcagaggccaccuccuccagaaagccc

SEQ ID NO: 282910 - RNA, 64 nt, hsa
acacagacacagagcaggaggacacguggagacagaggcagacuggagugaugcggccacaagc

SEQ ID NO: 282911 - RNA, 64 nt, hsa
acacagacacaaagcaggaggccacauaaagacagaggcagagacugaagugaugcugccccaa

SEQ ID NO: 282912 - RNA, 64 nt, hsa; identical to SEQ ID NO: 229025

SEQ ID NO: 282913 - RNA, 64 nt, hsa; identical to SEQ ID NO: 229026

SEQ ID NO: 282914 - RNA, 64 nt, hsa; identical to SEQ ID NO: 229027

SEQ ID NO: 282915 - RNA, 64 nt, hsa; identical to SEQ ID NO: 229028

SEQ ID NO: 282916 - RNA, 64 nt, hsa; identical to SEQ ID NO: 229029

SEQ ID NO: 282917 - RNA, 64 nt, hsa; identical to SEQ ID NO: 229030

SEQ ID NO: 282918 - RNA, 64 nt, hsa; identical to SEQ ID NO: 229031

SEQ ID NO: 282919 - RNA, 64 nt, hsa; identical to SEQ ID NO: 229032

SEQ ID NO: 282920 - RNA, 64 nt, hsa; identical to SEQ ID NO: 229033

SEQ ID NO: 282921 - RNA, 64 nt, hsa; identical to SEQ ID NO: 229034

SEQ ID NO: 282922 - RNA, 64 nt, hsa; identical to SEQ ID NO: 229035

SEQ ID NO: 282923 - RNA, 64 nt, hsa; identical to SEQ ID NO: 229036

SEQ ID NO: 282924 - RNA, 64 nt, hsa; identical to SEQ ID NO: 229037

SEQ ID NO: 282925 - RNA, 64 nt, hsa; identical to SEQ ID NO: 229038

SEQ ID NO: 282926 - RNA, 64 nt, hsa; identical to SEQ ID NO: 229039

SEQ ID NO: 282927 - RNA, 64 nt, hsa; identical to SEQ ID NO: 229040

SEQ ID NO: 282928 - RNA, 64 nt, hsa; identical to SEQ ID NO: 229041

SEQ ID NO: 282929 - RNA, 64 nt, hsa; identical to SEQ ID NO: 229042

SEQ ID NO: 282930 - RNA, 64 nt, hsa; identical to SEQ ID NO: 229043

SEQ ID NO: 282931 - RNA, 64 nt, hsa; identical to SEQ ID NO: 229044

SEQ ID NO: 282932 - RNA, 64 nt, hsa; identical to SEQ ID NO: 229045

SEQ ID NO: 282933 - RNA, 64 nt, hsa; identical to SEQ ID NO: 229046

SEQ ID NO: 282934 - RNA, 64 nt, hsa; identical to SEQ ID NO: 229047

SEQ ID NO: 282935 - RNA, 64 nt, hsa; identical to SEQ ID NO: 229048

SEQ ID NO: 282936 - RNA, 64 nt, hsa; identical to SEQ ID NO: 229049

SEQ ID NO: 282937 - RNA, 64 nt, hsa; identical to SEQ ID NO: 229050

SEQ ID NO: 282938 - RNA, 64 nt, hsa; identical to SEQ ID NO: 229051

SEQ ID NO: 282939 - RNA, 64 nt, hsa; identical to SEQ ID NO: 229052

SEQ ID NO: 282940 - RNA, 64 nt, hsa; identical to SEQ ID NO: 229053

SEQ ID NO: 282941 - RNA, 64 nt, hsa; identical to SEQ ID NO: 229054

SEQ ID NO: 282942 - RNA, 64 nt, hsa
uugccggugccuaggauugugccuguaugcaacaggcacucaauaaauauuuuugcuguagacu

SEQ ID NO: 282943 - RNA, 64 nt, hsa
agcaccucgaguuagaacccggcccacguagggcggcacucacacgcgaaaguaucaccagggu

SEQ ID NO: 282944 - RNA, 64 nt, hsa
ccuccccugcuuucucaaacacuugcccaccucaggcacucagcgggcuccgccguggugagag

SEQ ID NO: 282945 - RNA, 64 nt, hsa
uguagccagguccgcaucuccccaccaccaccagggcacucacucgcagcuauagcccaggaca

SEQ ID NO: 282946 - RNA, 64 nt, hsa
cucagggagaggccaugcggccagcccaggucugcaugcugagccccauccuccacagcuugcc

SEQ ID NO: 282947 - RNA, 64 nt, hsa
gcugggaggggacccuccauuucucccccucacccaugcugaguguagagccggggccugggug

SEQ ID NO: 282948 - RNA, 64 nt, hsa
uguccaccugccugcugaccacuggacgcugcuccaugcugaagaaaagugacagucuccaggg

SEQ ID NO: 282949 - RNA, 64 nt, hsa
aagaaaagugacagucuccaggggacauuucagccaugcugaaagggaggcuggcaguggucau

SEQ ID NO: 282950 - RNA, 64 nt, hsa
gcuguguuuauuguagagacacuguuuuaguaaacaugcugagcauucauuuugcguccucugg

SEQ ID NO: 282951 - RNA, 64 nt, hsa
agggacguggucuugcccacuguccuuuugccuccaugcugaggucggugcuguauuucagagg

SEQ ID NO: 282952 - RNA, 64 nt, hsa
ccugagaucaggaguucaagaccagccugacuaacaugcugaaaccccaugucuacuaaagaua

SEQ ID NO: 282953 - RNA, 64 nt, hsa
augggagucaaacccaggcacgcggccuggccugcaugcugagccacauggugcuguccggaca

SEQ ID NO: 282954 - RNA, 64 nt, hsa
augagccauaggaaggcacuacaugaaauaaugcacugaguaugcaaugcuaucacugucuuug

SEQ ID NO: 282955 - RNA, 64 nt, hsa
gacuuuauguauuauuugcacagggagaauugaaacugaguauaaucaauaagcuagauacgaa

SEQ ID NO: 282956 - RNA, 64 nt, hsa
cuccugggcucaagugguccuccugccucagcuuacugaguaaggauauguauuucuuaaaagu

SEQ ID NO: 282957 - RNA, 64 nt, hsa
agcauuguuuacuugaagugggcagggaagcagcacugaguaaaguucaauugagugguuacag

SEQ ID NO: 282958 - RNA, 64 nt, hsa; identical to SEQ ID NO: 21812

SEQ ID NO: 282959 - RNA, 64 nt, hsa; identical to SEQ ID NO: 21813

SEQ ID NO: 282960 - RNA, 64 nt, hsa; identical to SEQ ID NO: 21814

SEQ ID NO: 282961 - RNA, 64 nt, hsa; identical to SEQ ID NO: 21815

SEQ ID NO: 282962 - RNA, 64 nt, hsa; identical to SEQ ID NO: 21816

SEQ ID NO: 282963 - RNA, 64 nt, hsa; identical to SEQ ID NO: 21817

SEQ ID NO: 282964 - RNA, 64 nt, hsa; identical to SEQ ID NO: 21818

SEQ ID NO: 282965 - RNA, 64 nt, hsa; identical to SEQ ID NO: 21819

SEQ ID NO: 282966 - RNA, 64 nt, hsa; identical to SEQ ID NO: 21820

SEQ ID NO: 282967 - RNA, 64 nt, hsa; identical to SEQ ID NO: 21821

SEQ ID NO: 282968 - RNA, 64 nt, hsa; identical to SEQ ID NO: 21822

SEQ ID NO: 282969 - RNA, 64 nt, hsa; identical to SEQ ID NO: 21823

SEQ ID NO: 282970 - RNA, 64 nt, hsa; identical to SEQ ID NO: 21824

SEQ ID NO: 282971 - RNA, 64 nt, hsa; identical to SEQ ID NO: 21825

SEQ ID NO: 282972 - RNA, 64 nt, hsa; identical to SEQ ID NO: 21826

SEQ ID NO: 282973 - RNA, 64 nt, hsa; identical to SEQ ID NO: 21827

SEQ ID NO: 282974 - RNA, 64 nt, hsa; identical to SEQ ID NO: 21828

SEQ ID NO: 282975 - RNA, 64 nt, hsa; identical to SEQ ID NO: 21829

SEQ ID NO: 282976 - RNA, 64 nt, hsa; identical to SEQ ID NO: 21830

SEQ ID NO: 282977 - RNA, 64 nt, hsa; identical to SEQ ID NO: 21831

SEQ ID NO: 282978 - RNA, 50 nt, hsa; identical to SEQ ID NO: 21832

SEQ ID NO: 282979 - RNA, 64 nt, hsa; identical to SEQ ID NO: 21833

SEQ ID NO: 282980 - RNA, 64 nt, hsa; identical to SEQ ID NO: 21834

SEQ ID NO: 282981 - RNA, 64 nt, hsa; identical to SEQ ID NO: 21835

SEQ ID NO: 282982 - RNA, 64 nt, hsa; identical to SEQ ID NO: 21836

SEQ ID NO: 282983 - RNA, 64 nt, hsa; identical to SEQ ID NO: 21837

SEQ ID NO: 282984 - RNA, 64 nt, hsa; identical to SEQ ID NO: 21838

SEQ ID NO: 282985 - RNA, 64 nt, hsa; identical to SEQ ID NO: 21839

SEQ ID NO: 282986 - RNA, 64 nt, hsa; identical to SEQ ID NO: 21840

SEQ ID NO: 282987 - RNA, 64 nt, hsa; identical to SEQ ID NO: 21841

SEQ ID NO: 282988 - RNA, 64 nt, hsa; identical to SEQ ID NO: 21842

SEQ ID NO: 282989 - RNA, 64 nt, hsa; identical to SEQ ID NO: 21843

SEQ ID NO: 282990 - RNA, 64 nt, hsa; identical to SEQ ID NO: 21844

SEQ ID NO: 282991 - RNA, 64 nt, hsa; identical to SEQ ID NO: 21845

SEQ ID NO: 282992 - RNA, 64 nt, hsa; identical to SEQ ID NO: 21846

SEQ ID NO: 282993 - RNA, 64 nt, hsa; identical to SEQ ID NO: 21847

SEQ ID NO: 282994 - RNA, 64 nt, hsa; identical to SEQ ID NO: 21848

SEQ ID NO: 282995 - RNA, 64 nt, hsa; identical to SEQ ID NO: 21849

SEQ ID NO: 282996 - RNA, 64 nt, hsa; identical to SEQ ID NO: 21850

SEQ ID NO: 282997 - RNA, 64 nt, hsa; identical to SEQ ID NO: 21851

SEQ ID NO: 282998 - RNA, 64 nt, hsa; identical to SEQ ID NO: 21852

SEQ ID NO: 282999 - RNA, 64 nt, hsa; identical to SEQ ID NO: 21853

SEQ ID NO: 283000 - RNA, 64 nt, hsa; identical to SEQ ID NO: 21854

SEQ ID NO: 283001 - RNA, 64 nt, hsa; identical to SEQ ID NO: 21855

SEQ ID NO: 283002 - RNA, 64 nt, hsa; identical to SEQ ID NO: 21856

SEQ ID NO: 283003 - RNA, 64 nt, hsa; identical to SEQ ID NO: 21857

SEQ ID NO: 283004 - RNA, 64 nt, hsa; identical to SEQ ID NO: 21858

SEQ ID NO: 283005 - RNA, 64 nt, hsa; identical to SEQ ID NO: 21859

SEQ ID NO: 283006 - RNA, 64 nt, hsa; identical to SEQ ID NO: 21860

SEQ ID NO: 283007 - RNA, 64 nt, hsa; identical to SEQ ID NO: 21861

SEQ ID NO: 283008 - RNA, 64 nt, hsa; identical to SEQ ID NO: 21862

SEQ ID NO: 283009 - RNA, 64 nt, hsa; identical to SEQ ID NO: 21863

SEQ ID NO: 283010 - RNA, 64 nt, hsa; identical to SEQ ID NO: 21864

SEQ ID NO: 283011 - RNA, 64 nt, hsa; identical to SEQ ID NO: 21865

SEQ ID NO: 283012 - RNA, 64 nt, hsa; identical to SEQ ID NO: 21866

SEQ ID NO: 283013 - RNA, 64 nt, hsa; identical to SEQ ID NO: 21867

SEQ ID NO: 283014 - RNA, 64 nt, hsa; identical to SEQ ID NO: 21868

SEQ ID NO: 283015 - RNA, 64 nt, hsa; identical to SEQ ID NO: 21869

SEQ ID NO: 283016 - RNA, 64 nt, hsa; identical to SEQ ID NO: 21870

SEQ ID NO: 283017 - RNA, 64 nt, hsa; identical to SEQ ID NO: 21871

SEQ ID NO: 283018 - RNA, 64 nt, hsa; identical to SEQ ID NO: 21872

SEQ ID NO: 283019 - RNA, 64 nt, hsa; identical to SEQ ID NO: 21873

SEQ ID NO: 283020 - RNA, 64 nt, hsa; identical to SEQ ID NO: 21874

SEQ ID NO: 283021 - RNA, 64 nt, hsa
cacaucuguucguuggacuaaacccacagguuaguucagucaaagcaggcaacccccuuguggg

SEQ ID NO: 283022 - RNA, 64 nt, hsa
aggccaggcugucgcuggccauccauucagucgauucagucauaggcgaaucuguucugcccga

SEQ ID NO: 283023 - RNA, 64 nt, hsa
uuaaauuuuguuucagucauuuaaaauuuaaauuuucagucauuuaaaauuuuaaaaauuuaaa

SEQ ID NO: 283024 - RNA, 64 nt, hsa
uugugaauuuugaauaauaauguuuaaauuuuguuucagucauuuaaaauuuaaauuuucaguc

SEQ ID NO: 283025 - RNA, 64 nt, hsa
gaagcccuacaaauguaaagaaugugaaaagucuuucagucagagcucaagucuuagucgacau

SEQ ID NO: 283026 - RNA, 64 nt, hsa
gaaagcacaugaauguaaugaauguggaaaagcuuucagucaaaccucaugccuuauucagcau

SEQ ID NO: 283027 - RNA, 64 nt, hsa
gaaaucguaugaauguaaugaguaugagggcaguuucagucauagcucagaucuuauccugcaa

SEQ ID NO: 283028 - RNA, 64 nt, hsa
gagaaaucauguauguacugcaugugguaaagccuucagucauagcucagccauugcucagcau

SEQ ID NO: 283029 - RNA, 64 nt, hsa
auaaauguaauaagcauguaugugugugaggagauucagucauaacccaacgcucauucaacau

SEQ ID NO: 283030 - RNA, 64 nt, hsa
accgugcugccauuaaaggcagcuguucuagaguuucagucaccuaaguacacccacaaaacaa

SEQ ID NO: 283031 - RNA, 64 nt, hsa
uuuaaauuuaucaacuuuuuacauuuguguuauuuucagucagggcuucuuagaucuacuuaug

SEQ ID NO: 283032 - RNA, 64 nt, hsa
aaccaaacccuaaauugaaagacaaaacuaugguuucagucaacauauucaugaauuagggagc

SEQ ID NO: 283033 - RNA, 64 nt, hsa
gcaccaggggaugcucuacaucaagggaugcaccuucagucaaacugucaaaaagcccagaauu

SEQ ID NO: 283034 - RNA, 64 nt, hsa
gucacuagauacacaacccccuucccaccaucccuucagucacuaguggaagcuuucaaguuag

SEQ ID NO: 283035 - RNA, 64 nt, hsa
uucagucacuaguggaagcuuucaaguuaguuauuucagucaggauauacaguguugaaaucuc

SEQ ID NO: 283036 - RNA, 64 nt, hsa
gagccacuuguuacccucuauucuuucuagugcuuucagucaguggcaacacauaggccccuug

SEQ ID NO: 283037 - RNA, 64 nt, hsa
agggcagaauucaacaagcacaacucacuggucuuucagucaacgugcuagaaaccgaugacuu

SEQ ID NO: 283038 - RNA, 64 nt, hsa
uacaguaacuugauguguauauuaauaaaaguaauucagucauuuuaguuuuugauugaaaaua

SEQ ID NO: 283039 - RNA, 64 nt, hsa
uuaauuuuggaagugcaguuuuguaaaaaccuuuuucagucaaacaguaaagacuuuauuuaug

SEQ ID NO: 283040 - RNA, 64 nt, hsa
gaaaccuuacaaaugugaagcaugugacaaaguuuucagucacagaucacgccuuaaaagacau

SEQ ID NO: 283041 - RNA, 64 nt, hsa
gaaaccuuacaaaugucaugacuguggcaaggucuucagucaagcuucauccuaugcaaaacau

SEQ ID NO: 283042 - RNA, 64 nt, hsa
gaaaccuuauaaaugucaugauuguggcaaggucuucagucaaguuucauccuaugcaaaacau

SEQ ID NO: 283043 - RNA, 64 nt, hsa
gaaaccuugaaaguguaaugaguguggcaagaccuucagucagaugucaaaccuuguauaccau

SEQ ID NO: 283044 - RNA, 64 nt, hsa
gaaaccauacaaguauaauaaauguggcaagguuuucagucacaauucacuccuacacagcauc

SEQ ID NO: 283045 - RNA, 62 nt, hsa
aaccuuauaaaagaaauuaauauggcaaggucuucagucaaaguuuaaauccugugagucau

SEQ ID NO: 283046 - RNA, 64 nt, hsa; identical to SEQ ID NO: 108245

SEQ ID NO: 283047 - RNA, 64 nt, hsa; identical to SEQ ID NO: 108246

SEQ ID NO: 283048 - RNA, 64 nt, hsa; identical to SEQ ID NO: 108247

SEQ ID NO: 283049 - RNA, 64 nt, hsa; identical to SEQ ID NO: 108248

SEQ ID NO: 283050 - RNA, 64 nt, hsa; identical to SEQ ID NO: 108249

SEQ ID NO: 283051 - RNA, 64 nt, hsa; identical to SEQ ID NO: 108250

SEQ ID NO: 283052 - RNA, 64 nt, hsa; identical to SEQ ID NO: 108251

SEQ ID NO: 283053 - RNA, 64 nt, hsa; identical to SEQ ID NO: 108252

SEQ ID NO: 283054 - RNA, 64 nt, hsa; identical to SEQ ID NO: 108253

SEQ ID NO: 283055 - RNA, 64 nt, hsa; identical to SEQ ID NO: 108254

SEQ ID NO: 283056 - RNA, 64 nt, hsa; identical to SEQ ID NO: 108255

SEQ ID NO: 283057 - RNA, 64 nt, hsa; identical to SEQ ID NO: 108256

SEQ ID NO: 283058 - RNA, 64 nt, hsa; identical to SEQ ID NO: 108257

SEQ ID NO: 283059 - RNA, 64 nt, hsa; identical to SEQ ID NO: 108258

SEQ ID NO: 283060 - RNA, 64 nt, hsa; identical to SEQ ID NO: 108259

SEQ ID NO: 283061 - RNA, 64 nt, hsa; identical to SEQ ID NO: 108260

SEQ ID NO: 283062 - RNA, 64 nt, hsa; identical to SEQ ID NO: 108261

SEQ ID NO: 283063 - RNA, 64 nt, hsa; identical to SEQ ID NO: 108262

SEQ ID NO: 283064 - RNA, 64 nt, hsa; identical to SEQ ID NO: 108263

SEQ ID NO: 283065 - RNA, 64 nt, hsa; identical to SEQ ID NO: 108264

SEQ ID NO: 283066 - RNA, 64 nt, hsa; identical to SEQ ID NO: 108265

SEQ ID NO: 283067 - RNA, 64 nt, hsa; identical to SEQ ID NO: 108266

SEQ ID NO: 283068 - RNA, 64 nt, hsa; identical to SEQ ID NO: 108267

SEQ ID NO: 283069 - RNA, 64 nt, hsa; identical to SEQ ID NO: 108268

SEQ ID NO: 283070 - RNA, 64 nt, hsa; identical to SEQ ID NO: 108269

SEQ ID NO: 283071 - RNA, 64 nt, hsa; identical to SEQ ID NO: 108270

SEQ ID NO: 283072 - RNA, 64 nt, hsa; identical to SEQ ID NO: 108271

SEQ ID NO: 283073 - RNA, 64 nt, hsa; identical to SEQ ID NO: 108272

SEQ ID NO: 283074 - RNA, 64 nt, hsa; identical to SEQ ID NO: 108273

SEQ ID NO: 283075 - RNA, 64 nt, hsa; identical to SEQ ID NO: 108274

SEQ ID NO: 283076 - RNA, 64 nt, hsa; identical to SEQ ID NO: 108275

SEQ ID NO: 283077 - RNA, 64 nt, hsa; identical to SEQ ID NO: 108276

SEQ ID NO: 283078 - RNA, 64 nt, hsa; identical to SEQ ID NO: 108277

SEQ ID NO: 283079 - RNA, 64 nt, hsa; identical to SEQ ID NO: 108278

SEQ ID NO: 283080 - RNA, 64 nt, hsa; identical to SEQ ID NO: 108279

SEQ ID NO: 283081 - RNA, 64 nt, hsa; identical to SEQ ID NO: 108280

SEQ ID NO: 283082 - RNA, 64 nt, hsa; identical to SEQ ID NO: 108281

SEQ ID NO: 283083 - RNA, 64 nt, hsa; identical to SEQ ID NO: 108282

SEQ ID NO: 283084 - RNA, 64 nt, hsa; identical to SEQ ID NO: 108283

SEQ ID NO: 283085 - RNA, 64 nt, hsa; identical to SEQ ID NO: 108284

SEQ ID NO: 283086 - RNA, 64 nt, hsa; identical to SEQ ID NO: 262900

SEQ ID NO: 283087 - RNA, 64 nt, hsa; identical to SEQ ID NO: 262901

SEQ ID NO: 283088 - RNA, 64 nt, hsa; identical to SEQ ID NO: 262902

SEQ ID NO: 283089 - RNA, 64 nt, hsa; identical to SEQ ID NO: 262903

SEQ ID NO: 283090 - RNA, 64 nt, hsa; identical to SEQ ID NO: 262904

SEQ ID NO: 283091 - RNA, 64 nt, hsa; identical to SEQ ID NO: 262905

SEQ ID NO: 283092 - RNA, 64 nt, hsa; identical to SEQ ID NO: 262906

SEQ ID NO: 283093 - RNA, 64 nt, hsa; identical to SEQ ID NO: 262907

SEQ ID NO: 283094 - RNA, 64 nt, hsa; identical to SEQ ID NO: 262908

SEQ ID NO: 283095 - RNA, 64 nt, hsa; identical to SEQ ID NO: 262909

SEQ ID NO: 283096 - RNA, 64 nt, hsa; identical to SEQ ID NO: 262910

SEQ ID NO: 283097 - RNA, 64 nt, hsa; identical to SEQ ID NO: 262911

SEQ ID NO: 283098 - RNA, 64 nt, hsa; identical to SEQ ID NO: 262912

SEQ ID NO: 283099 - RNA, 64 nt, hsa; identical to SEQ ID NO: 80484

SEQ ID NO: 283100 - RNA, 64 nt, hsa; identical to SEQ ID NO: 80485

SEQ ID NO: 283101 - RNA, 64 nt, hsa; identical to SEQ ID NO: 80486

SEQ ID NO: 283102 - RNA, 64 nt, hsa; identical to SEQ ID NO: 80487

SEQ ID NO: 283103 - RNA, 64 nt, hsa; identical to SEQ ID NO: 80488

SEQ ID NO: 283104 - RNA, 64 nt, hsa; identical to SEQ ID NO: 80489

SEQ ID NO: 283105 - RNA, 64 nt, hsa; identical to SEQ ID NO: 80490

SEQ ID NO: 283106 - RNA, 64 nt, hsa; identical to SEQ ID NO: 80491

SEQ ID NO: 283107 - RNA, 64 nt, hsa; identical to SEQ ID NO: 80492

SEQ ID NO: 283108 - RNA, 64 nt, hsa; identical to SEQ ID NO: 80493

SEQ ID NO: 283109 - RNA, 64 nt, hsa; identical to SEQ ID NO: 80494

SEQ ID NO: 283110 - RNA, 64 nt, hsa; identical to SEQ ID NO: 80495

SEQ ID NO: 283111 - RNA, 64 nt, hsa; identical to SEQ ID NO: 80496

SEQ ID NO: 283112 - RNA, 64 nt, hsa; identical to SEQ ID NO: 80497

SEQ ID NO: 283113 - RNA, 64 nt, hsa; identical to SEQ ID NO: 80498

SEQ ID NO: 283114 - RNA, 64 nt, hsa; identical to SEQ ID NO: 80499

SEQ ID NO: 283115 - RNA, 64 nt, hsa; identical to SEQ ID NO: 80500

SEQ ID NO: 283116 - RNA, 64 nt, hsa; identical to SEQ ID NO: 80501

SEQ ID NO: 283117 - RNA, 64 nt, hsa; identical to SEQ ID NO: 80502

SEQ ID NO: 283118 - RNA, 64 nt, hsa; identical to SEQ ID NO: 80503

SEQ ID NO: 283119 - RNA, 64 nt, hsa; identical to SEQ ID NO: 80504

SEQ ID NO: 283120 - RNA, 64 nt, hsa; identical to SEQ ID NO: 80505

SEQ ID NO: 283121 - RNA, 64 nt, hsa; identical to SEQ ID NO: 80506

SEQ ID NO: 283122 - RNA, 64 nt, hsa; identical to SEQ ID NO: 80507

SEQ ID NO: 283123 - RNA, 64 nt, hsa; identical to SEQ ID NO: 80508

SEQ ID NO: 283124 - RNA, 64 nt, hsa; identical to SEQ ID NO: 80509

SEQ ID NO: 283125 - RNA, 64 nt, hsa; identical to SEQ ID NO: 80510

SEQ ID NO: 283126 - RNA, 64 nt, hsa; identical to SEQ ID NO: 80511

SEQ ID NO: 283127 - RNA, 64 nt, hsa; identical to SEQ ID NO: 80512

SEQ ID NO: 283128 - RNA, 64 nt, hsa; identical to SEQ ID NO: 80513

SEQ ID NO: 283129 - RNA, 64 nt, hsa; identical to SEQ ID NO: 80514

SEQ ID NO: 283130 - RNA, 64 nt, hsa; identical to SEQ ID NO: 80515

SEQ ID NO: 283131 - RNA, 64 nt, hsa; identical to SEQ ID NO: 80516

SEQ ID NO: 283132 - RNA, 64 nt, hsa; identical to SEQ ID NO: 80517

SEQ ID NO: 283133 - RNA, 64 nt, hsa; identical to SEQ ID NO: 80518

SEQ ID NO: 283134 - RNA, 64 nt, hsa; identical to SEQ ID NO: 80519

SEQ ID NO: 283135 - RNA, 64 nt, hsa
cccucugggucauauggugcagacugugaccagcaccaggcaggcaguccugucugcgugugga

SEQ ID NO: 283136 - RNA, 64 nt, hsa
caaagguuggagucugcuggugcgguguuuacacaccaggcagggcugucugccaccuugugug

SEQ ID NO: 283137 - RNA, 64 nt, hsa
ugucuuuggguuuagaagaccaaguauggggaaaaccaggcaccagccucugcagcaauggguc

SEQ ID NO: 283138 - RNA, 64 nt, hsa
gggcagcauggaacaugcagcugggcuuccugugaccaggcacccucuggcacuguugcuugcc

SEQ ID NO: 283139 - RNA, 64 nt, hsa
ugaggcugaggauggccugaaccuggagcagcggaccaggcagacgggcugaagugggguccca

SEQ ID NO: 283140 - RNA, 64 nt, hsa
ucauggcuaaauauuuauggagggccuacuguggaccaggcacugggcuaaauacuuacauuua

SEQ ID NO: 283141 - RNA, 64 nt, hsa
uguguccuuugaggggcugauggcaauaucuaaaaccaggcaccagcaugaacaccaagcuggg

SEQ ID NO: 283142 - RNA, 64 nt, hsa
ugugauucacagugugaaucuuggugucuacguuaccaggcaggaaggcugagaggagagagac

SEQ ID NO: 283143 - RNA, 64 nt, hsa
aucugaugcaagcaagaaacacugggcuucuagaaccaggcaacuugggaacuagacucccaag

SEQ ID NO: 283144 - RNA, 64 nt, hsa
uuucauuucauccuggucagucuagagucugugcaccaggcaguccauccacugaaggcugugu

SEQ ID NO: 283145 - RNA, 64 nt, hsa
auucauuccucaggcacuugagugacaguuguuuaccaggcacuguguguagccccaggguuug

SEQ ID NO: 283146 - RNA, 64 nt, hsa
auauucaucccuucaguucuggagaaagccugauaccaggcacagccuacugaccccaaggagc

SEQ ID NO: 283147 - RNA, 64 nt, hsa
gauaggaaccuucuuggagaccccuuugaagaaaaccaggcagccaagggagccaaacacacua

SEQ ID NO: 283148 - RNA, 64 nt, hsa
gcugggcaaggcgcucaggcaugcaaccaugggcaccaggcaauacccauccaucacccaucuc

SEQ ID NO: 283149 - RNA, 64 nt, hsa
aucuaucucacacugcaccaagcacccacugugcaccaggcacuaagucucuagccucuuucuc

SEQ ID NO: 283150 - RNA, 64 nt, hsa
cgucauggcacuuuuuaacgcuucagcaacaaacaccaggcagcuguugccacuggccuccuac

SEQ ID NO: 283151 - RNA, 64 nt, hsa
guagaggugagaauggggaggcaagaucucaggcaccaggcaggaggugccuuguaagcuaacu

SEQ ID NO: 283152 - RNA, 64 nt, hsa
ggccaucucuggaugccugauugccaagcucaggaccaggcaaugugacuuugcaucagcaaca

SEQ ID NO: 283153 - RNA, 64 nt, hsa
cgugggccugggguaccaagagacuccuugagagaccaggcaaagcaagugauugggacagagg

SEQ ID NO: 283154 - RNA, 64 nt, hsa
cagccauccagggcuacccacugcuuacucagggaccaggcagcccccauggcaguaaaagcag

SEQ ID NO: 283155 - RNA, 64 nt, hsa
agaagcccuggcuggccccacuugguaccaauccaccaggcagcucagggcuccugcccagccc

SEQ ID NO: 283156 - RNA, 64 nt, hsa
cuaccuacgagugaaacucuguccucccgcgaggaccaggcaucgcugugugaggacggcacgg

SEQ ID NO: 283157 - RNA, 64 nt, hsa
ggggggagccauccccgccgcccucacaggacccaccaggcagcggagacauguggaauuagag

SEQ ID NO: 283158 - RNA, 64 nt, hsa
cagccggcaggcgccccuguacgucugcucaugcaccaggcagcacagccgcaguuccucaguu

SEQ ID NO: 283159 - RNA, 64 nt, hsa
uagccaccagugauccccaagcauccaguacagaaccaggcaucgagcuagcucccugcacggc

SEQ ID NO: 283160 - RNA, 64 nt, hsa
uuuggugccaaaccccaaaucuccaaagagacauaccaggcaagacaaacccccaaacaccucc

SEQ ID NO: 283161 - RNA, 64 nt, hsa
caucuggccugcacccuugacaaaggaccccaggaccaggcagaaggcgccuccguccuagcca

SEQ ID NO: 283162 - RNA, 64 nt, hsa
cagcugugugaccauccagggguggagggggaaaaccaggcaauuucguuccuggaaucaacca

SEQ ID NO: 283163 - RNA, 64 nt, hsa
uccauggcagggguggauucgggagcugggaguaaccaggcaaagucaaccagaugccuagcuc

SEQ ID NO: 283164 - RNA, 64 nt, hsa
ucauucugggaacauguuguaagcacugacugggaccaggcaccaggcagggucuagaaggcug

SEQ ID NO: 283165 - RNA, 64 nt, hsa
gggaacauguuguaagcacugacugggaccaggcaccaggcagggucuagaaggcuguggugag

SEQ ID NO: 283166 - RNA, 64 nt, hsa
aaaggcuggacucagcaggaacaccaaaucccggaccaggcagaaaccacccaagacugagggg

SEQ ID NO: 283167 - RNA, 64 nt, hsa
ucagacuaacggcuaaagagacugaugcaucaacaccaggcagagaauaaagcagauuuuuuug

SEQ ID NO: 283168 - RNA, 64 nt, hsa; identical to SEQ ID NO: 172311

SEQ ID NO: 283169 - RNA, 64 nt, hsa; identical to SEQ ID NO: 172312

SEQ ID NO: 283170 - RNA, 64 nt, hsa; identical to SEQ ID NO: 172313

SEQ ID NO: 283171 - RNA, 64 nt, hsa; identical to SEQ ID NO: 172314

SEQ ID NO: 283172 - RNA, 64 nt, hsa; identical to SEQ ID NO: 172315

SEQ ID NO: 283173 - RNA, 64 nt, hsa; identical to SEQ ID NO: 172316

SEQ ID NO: 283174 - RNA, 64 nt, hsa; identical to SEQ ID NO: 172317

SEQ ID NO: 283175 - RNA, 64 nt, hsa; identical to SEQ ID NO: 172318

SEQ ID NO: 283176 - RNA, 63 nt, hsa
ccacccacccccuaccauugagccaccaugcccagccccaaagccucuuaauugcucuaacaa

SEQ ID NO: 283177 - RNA, 63 nt, hsa
gugcugggauuacacacgugagucaccaugcccagccccaaagccauuucuugaagaauuucu

SEQ ID NO: 283178 - RNA, 63 nt, hsa
ccggggcaagauccuuccagacucaucugucagagccccaagcccuuuagacccagagcccaa

SEQ ID NO: 283179 - RNA, 63 nt, hsa
gagcccuucccauccuuacccaccaggaacuagagccccaaccacagcagaugcuuccugggc

SEQ ID NO: 283180 - RNA, 63 nt, hsa
cccacgguccccaggaggacgcuuccuggccaaagccccaagccuuuggugagaagccaauuc

SEQ ID NO: 283181 - RNA, 63 nt, hsa
cuuguggcuagaguacagugggguagacccuccagccccaauagcccuaguacccagcuggca

SEQ ID NO: 283182 - RNA, 63 nt, hsa
cuuaaaacucccuugcuaccgaucuggaacucaagccccaagacauccccuuagaugaucuga

SEQ ID NO: 283183 - RNA, 63 nt, hsa
aucacaagaagcuggggcuuccuugagaaggccagccccaaagguaccuguguuuaaaagaug

SEQ ID NO: 283184 - RNA, 63 nt, hsa
cccugccuaguggggugguaguggcuaccucucagccccaauagucccugcuccucuuagaau

SEQ ID NO: 283185 - RNA, 63 nt, hsa
aguggcggcugaucuguagagguaugaaaauacagccccaaagggggaauuugucauggggaa

SEQ ID NO: 283186 - RNA, 63 nt, hsa
ugcuacaaaugaaguccuucuccaaaugcauugagccccaagaaaaaucgcugauucugagga

SEQ ID NO: 283187 - RNA, 63 nt, hsa
cgcgcagaaugugcucgcugccccgcggcuucgagccccaagcucccgaggacuuggcgcagc

SEQ ID NO: 283188 - RNA, 63 nt, hsa
agggacagaggggguggccucccaacucaccccagccccaaaacucuccucugcugcuggcug

SEQ ID NO: 283189 - RNA, 63 nt, hsa
uggcugguuagagguucccuuugacgccaucccagccccaaugaacaauuauuuauuaaaugc

SEQ ID NO: 283190 - RNA, 63 nt, hsa
ugccucuggcucugucggccagagccccaacucagccccaaaagcugggcuuccuggggccac

SEQ ID NO: 283191 - RNA, 63 nt, hsa
agcccuggccuugccucuggcucugucggccagagccccaacucagccccaaaagcugggcuu

SEQ ID NO: 283192 - RNA, 63 nt, hsa
aggucaggauggaacuaccucauucggcaaauuagccccaaauugagcgcugaaucguguccc

SEQ ID NO: 283193 - RNA, 63 nt, hsa
guaggggucacugucacaugcuugugcccuggaagccccaaggcucuuccuccagcuggcucc

SEQ ID NO: 283194 - RNA, 63 nt, hsa
cuccauccccaacccauccucauccccaacuacagccccaaacccagccccagacuaauccac

SEQ ID NO: 283195 - RNA, 63 nt, hsa
agccauccccaacucauccucauccccaacugcagccccaaacccaacccagggccaucccca

SEQ ID NO: 283196 - RNA, 63 nt, hsa
cccuggccacauccccauccucccccaaccuccagccccaacacccaucaucccccugagcuc

SEQ ID NO: 283197 - RNA, 63 nt, hsa
uguuggaagggcagcggguaagguucccaagccagccccaacacccuucccacuuggcaccca

SEQ ID NO: 283198 - RNA, 63 nt, hsa
gguggaagcggcagccacaaguccuccucagggagccccaagggggauuuugugggaccgcug

SEQ ID NO: 283199 - RNA, 63 nt, hsa
ccuugaaccuaggaccaagagccaccuacauccagccccaaaacuggggcuucaggccagagc

SEQ ID NO: 283200 - RNA, 63 nt, hsa
acaggacaucugugaccgcccuacccccacgccagccccaaacuaagauaucccucacaccca

SEQ ID NO: 283201 - RNA, 63 nt, hsa
cgaagcaugaacagugcaccugggacagggagcagccccaaauugucaccugcuucucugccc

SEQ ID NO: 283202 - RNA, 63 nt, hsa
ccacccgugguggcucaagucuggccccacaccagccccaauccaaaacuggcaaggacgcuu

SEQ ID NO: 283203 - RNA, 64 nt, hsa
ucaguauccuucagcuuuuuacauuaacccaguguccucugauauaggugagucuugugguagc

SEQ ID NO: 283204 - RNA, 64 nt, hsa
uaaaaaaucccaauuacagaacaggagauauguuuccucugacaaaaccccauuuuuagagugu

SEQ ID NO: 283205 - RNA, 64 nt, hsa
aauccucuuccucugaggcuggauccuagccuuauccucugaucuccauggcuuccuccucccu

SEQ ID NO: 283206 - RNA, 64 nt, hsa
agccucucaccuguacucuuccgaaaaauccucuuccucugaggcuggauccuagccuuauccu

SEQ ID NO: 283207 - RNA, 64 nt, hsa
uggcucuccggacaggagcuggccugacucucacuccucugaggcuuuccuggggccuccuccc

SEQ ID NO: 283208 - RNA, 64 nt, hsa
guguagacagcaggaggagcaccgggcuugggcuuccucugagccgugaugccaaagguugcga

SEQ ID NO: 283209 - RNA, 64 nt, hsa
auugggaagucuccccgcuggagaaggguggggcuccucugagccugcccugccuccuccauca

SEQ ID NO: 283210 - RNA, 64 nt, hsa
cccucucugggggcugagggacccaccuggccccuccucugacacagggcuggcccgccaggug

SEQ ID NO: 283211 - RNA, 64 nt, hsa
caagccccccgcccaaucauguguucaguagccguccucugagcagggcccaaggcagccaggg

SEQ ID NO: 283212 - RNA, 64 nt, hsa
gcccuggguggaaggaaggcacugagagcccccuuccucugagggccccaccucaccccuuggu

SEQ ID NO: 283213 - RNA, 64 nt, hsa
caaacagaagggagaaagugucagugacacaguuuccucugaugcagcugcuucuccaauggcu

SEQ ID NO: 283214 - RNA, 64 nt, hsa
acuucuucaucaaguuuugauaagaaauccuagguccucugagcaacgccugcuucuccauauc

SEQ ID NO: 283215 - RNA, 64 nt, hsa
acuuucuuaauuuaaucugcccuguccuaccugcuccucugauuguuagccaucacauaacuua

SEQ ID NO: 283216 - RNA, 64 nt, hsa
cugcccuuucccuucagaaaacgauggcaggcauuccucugaguuuacaagcagagacucacuc

SEQ ID NO: 283217 - RNA, 64 nt, hsa
aucuccuuucggaaugaauguucauggaagaggcuccucugagggcaagagaccuguuuuagug

SEQ ID NO: 283218 - RNA, 64 nt, hsa
auuguaacuauucaguauuuacugguaggcacuguccucugauuaaacuuggccuacuggcaau

SEQ ID NO: 283219 - RNA, 64 nt, hsa
uuucucuccucuucuugggcaaugccuuguuuucuccucugaauauuugcauuugaaaggauug

SEQ ID NO: 283220 - RNA, 64 nt, hsa
caaauaagaggcauauacauugaauuguuuuuaauccucugacaaguugacucuucgaccccca

SEQ ID NO: 283221 - RNA, 64 nt, hsa
uuucugaacaucccacagcagucucaguccugguuccucugauaagaucgacaaaagaaacaac

SEQ ID NO: 283222 - RNA, 64 nt, hsa
uuaauuguaugaaaacacaaagcacaggucaggauccucugagagaaaaucaacauugcaccac

SEQ ID NO: 283223 - RNA, 64 nt, hsa
uguugagauaugcaagcacugagcuccucuuuuguccucugagaccccaucuccauucucaccc

SEQ ID NO: 283224 - RNA, 64 nt, hsa
gauauuucuuugaagggagagcaaacccacccuguccucugacgucccuuucccaacugucacc

SEQ ID NO: 283225 - RNA, 64 nt, hsa
guucugauagguacagauucucuuauuuuuugcuuccucugaggacaucuuuuucucaccuuca

SEQ ID NO: 283226 - RNA, 64 nt, hsa
uuauuuuccaaauuucguucugcaaauuuccacuuccucugauagacguuuuuuaguucuuuua

SEQ ID NO: 283227 - RNA, 64 nt, hsa
ggcugcagcuuuccuuaaugugguugcacagggguccucugagaccaccuggcgugagguggac

SEQ ID NO: 283228 - RNA, 64 nt, hsa
ggcugucuggucagcacgugcaggucagggcagguccucugagccggcgccccuggccagcagg

SEQ ID NO: 283229 - RNA, 64 nt, hsa; identical to SEQ ID NO: 45461

SEQ ID NO: 283230 - RNA, 64 nt, hsa; identical to SEQ ID NO: 45462

SEQ ID NO: 283231 - RNA, 64 nt, hsa; identical to SEQ ID NO: 175237

SEQ ID NO: 283232 - RNA, 64 nt, hsa; identical to SEQ ID NO: 175238

SEQ ID NO: 283233 - RNA, 64 nt, hsa; identical to SEQ ID NO: 175239

SEQ ID NO: 283234 - RNA, 64 nt, hsa; identical to SEQ ID NO: 175240

SEQ ID NO: 283235 - RNA, 64 nt, hsa; identical to SEQ ID NO: 175241

SEQ ID NO: 283236 - RNA, 64 nt, hsa; identical to SEQ ID NO: 175242

SEQ ID NO: 283237 - RNA, 64 nt, hsa; identical to SEQ ID NO: 175243

SEQ ID NO: 283238 - RNA, 64 nt, hsa; identical to SEQ ID NO: 175244

SEQ ID NO: 283239 - RNA, 64 nt, hsa; identical to SEQ ID NO: 175245

SEQ ID NO: 283240 - RNA, 64 nt, hsa; identical to SEQ ID NO: 175246

SEQ ID NO: 283241 - RNA, 64 nt, hsa; identical to SEQ ID NO: 175247

SEQ ID NO: 283242 - RNA, 64 nt, hsa; identical to SEQ ID NO: 175248

SEQ ID NO: 283243 - RNA, 64 nt, hsa; identical to SEQ ID NO: 175249

SEQ ID NO: 283244 - RNA, 64 nt, hsa; identical to SEQ ID NO: 175250

SEQ ID NO: 283245 - RNA, 64 nt, hsa; identical to SEQ ID NO: 175251

SEQ ID NO: 283246 - RNA, 64 nt, hsa; identical to SEQ ID NO: 175252

SEQ ID NO: 283247 - RNA, 64 nt, hsa; identical to SEQ ID NO: 175253

SEQ ID NO: 283248 - RNA, 64 nt, hsa; identical to SEQ ID NO: 175254

SEQ ID NO: 283249 - RNA, 64 nt, hsa; identical to SEQ ID NO: 175255

SEQ ID NO: 283250 - RNA, 64 nt, hsa; identical to SEQ ID NO: 175256

SEQ ID NO: 283251 - RNA, 64 nt, hsa; identical to SEQ ID NO: 175257

SEQ ID NO: 283252 - RNA, 64 nt, hsa; identical to SEQ ID NO: 175258

SEQ ID NO: 283253 - RNA, 64 nt, hsa; identical to SEQ ID NO: 175259

SEQ ID NO: 283254 - RNA, 64 nt, hsa; identical to SEQ ID NO: 175260

SEQ ID NO: 283255 - RNA, 64 nt, hsa; identical to SEQ ID NO: 175261

SEQ ID NO: 283256 - RNA, 64 nt, hsa; identical to SEQ ID NO: 175262

SEQ ID NO: 283257 - RNA, 64 nt, hsa; identical to SEQ ID NO: 175263

SEQ ID NO: 283258 - RNA, 64 nt, hsa; identical to SEQ ID NO: 175264

SEQ ID NO: 283259 - RNA, 64 nt, hsa; identical to SEQ ID NO: 175265

SEQ ID NO: 283260 - RNA, 64 nt, hsa; identical to SEQ ID NO: 175266

SEQ ID NO: 283261 - RNA, 64 nt, hsa; identical to SEQ ID NO: 175267

SEQ ID NO: 283262 - RNA, 64 nt, hsa; identical to SEQ ID NO: 175268

SEQ ID NO: 283263 - RNA, 64 nt, hsa; identical to SEQ ID NO: 175269

SEQ ID NO: 283264 - RNA, 64 nt, hsa; identical to SEQ ID NO: 175270

SEQ ID NO: 283265 - RNA, 64 nt, hsa; identical to SEQ ID NO: 175271

SEQ ID NO: 283266 - RNA, 64 nt, hsa; identical to SEQ ID NO: 175272

SEQ ID NO: 283267 - RNA, 64 nt, hsa; identical to SEQ ID NO: 175273

SEQ ID NO: 283268 - RNA, 64 nt, hsa; identical to SEQ ID NO: 175274

SEQ ID NO: 283269 - RNA, 64 nt, hsa; identical to SEQ ID NO: 175275

SEQ ID NO: 283270 - RNA, 64 nt, hsa; identical to SEQ ID NO: 175276

SEQ ID NO: 283271 - RNA, 64 nt, hsa; identical to SEQ ID NO: 175277

SEQ ID NO: 283272 - RNA, 64 nt, hsa; identical to SEQ ID NO: 175278

SEQ ID NO: 283273 - RNA, 64 nt, hsa; identical to SEQ ID NO: 237354

SEQ ID NO: 283274 - RNA, 64 nt, hsa; identical to SEQ ID NO: 237355

SEQ ID NO: 283275 - RNA, 64 nt, hsa; identical to SEQ ID NO: 237356

SEQ ID NO: 283276 - RNA, 64 nt, hsa; identical to SEQ ID NO: 237357

SEQ ID NO: 283277 - RNA, 64 nt, hsa; identical to SEQ ID NO: 237358

SEQ ID NO: 283278 - RNA, 64 nt, hsa; identical to SEQ ID NO: 237359

SEQ ID NO: 283279 - RNA, 64 nt, hsa; identical to SEQ ID NO: 237360

SEQ ID NO: 283280 - RNA, 64 nt, hsa; identical to SEQ ID NO: 237361

SEQ ID NO: 283281 - RNA, 64 nt, hsa; identical to SEQ ID NO: 237362

SEQ ID NO: 283282 - RNA, 64 nt, hsa; identical to SEQ ID NO: 237363

SEQ ID NO: 283283 - RNA, 64 nt, hsa; identical to SEQ ID NO: 237364

SEQ ID NO: 283284 - RNA, 64 nt, hsa; identical to SEQ ID NO: 237365

SEQ ID NO: 283285 - RNA, 64 nt, hsa; identical to SEQ ID NO: 237366

SEQ ID NO: 283286 - RNA, 64 nt, hsa; identical to SEQ ID NO: 237367

SEQ ID NO: 283287 - RNA, 64 nt, hsa; identical to SEQ ID NO: 237368

SEQ ID NO: 283288 - RNA, 64 nt, hsa; identical to SEQ ID NO: 237369

SEQ ID NO: 283289 - RNA, 64 nt, hsa; identical to SEQ ID NO: 237370

SEQ ID NO: 283290 - RNA, 64 nt, hsa; identical to SEQ ID NO: 237371

SEQ ID NO: 283291 - RNA, 64 nt, hsa; identical to SEQ ID NO: 237372

SEQ ID NO: 283292 - RNA, 64 nt, hsa; identical to SEQ ID NO: 237373

SEQ ID NO: 283293 - RNA, 64 nt, hsa; identical to SEQ ID NO: 237374

SEQ ID NO: 283294 - RNA, 64 nt, hsa; identical to SEQ ID NO: 237375

SEQ ID NO: 283295 - RNA, 64 nt, hsa; identical to SEQ ID NO: 237376

SEQ ID NO: 283296 - RNA, 64 nt, hsa; identical to SEQ ID NO: 237377

SEQ ID NO: 283297 - RNA, 64 nt, hsa; identical to SEQ ID NO: 237378

SEQ ID NO: 283298 - RNA, 64 nt, hsa; identical to SEQ ID NO: 237379

SEQ ID NO: 283299 - RNA, 64 nt, hsa; identical to SEQ ID NO: 237380

SEQ ID NO: 283300 - RNA, 64 nt, hsa; identical to SEQ ID NO: 237381

SEQ ID NO: 283301 - RNA, 64 nt, hsa; identical to SEQ ID NO: 237382

SEQ ID NO: 283302 - RNA, 64 nt, hsa; identical to SEQ ID NO: 237383

SEQ ID NO: 283303 - RNA, 64 nt, hsa; identical to SEQ ID NO: 237384

SEQ ID NO: 283304 - RNA, 64 nt, hsa; identical to SEQ ID NO: 237385

SEQ ID NO: 283305 - RNA, 64 nt, hsa; identical to SEQ ID NO: 237386

SEQ ID NO: 283306 - RNA, 64 nt, hsa; identical to SEQ ID NO: 237387

SEQ ID NO: 283307 - RNA, 64 nt, hsa; identical to SEQ ID NO: 237388

SEQ ID NO: 283308 - RNA, 64 nt, hsa; identical to SEQ ID NO: 237389

SEQ ID NO: 283309 - RNA, 64 nt, hsa; identical to SEQ ID NO: 237390

SEQ ID NO: 283310 - RNA, 64 nt, hsa; identical to SEQ ID NO: 237391

SEQ ID NO: 283311 - RNA, 64 nt, hsa; identical to SEQ ID NO: 237392

SEQ ID NO: 283312 - RNA, 64 nt, hsa; identical to SEQ ID NO: 237393

SEQ ID NO: 283313 - RNA, 64 nt, hsa; identical to SEQ ID NO: 237394

SEQ ID NO: 283314 - RNA, 64 nt, hsa; identical to SEQ ID NO: 237395

SEQ ID NO: 283315 - RNA, 64 nt, hsa; identical to SEQ ID NO: 237396

SEQ ID NO: 283316 - RNA, 64 nt, hsa; identical to SEQ ID NO: 237397

SEQ ID NO: 283317 - RNA, 64 nt, hsa; identical to SEQ ID NO: 237398

SEQ ID NO: 283318 - RNA, 64 nt, hsa; identical to SEQ ID NO: 237399

SEQ ID NO: 283319 - RNA, 64 nt, hsa; identical to SEQ ID NO: 237400

SEQ ID NO: 283320 - RNA, 64 nt, hsa; identical to SEQ ID NO: 237401

SEQ ID NO: 283321 - RNA, 64 nt, hsa; identical to SEQ ID NO: 237402

SEQ ID NO: 283322 - RNA, 64 nt, hsa; identical to SEQ ID NO: 237403

SEQ ID NO: 283323 - RNA, 64 nt, hsa; identical to SEQ ID NO: 237404

SEQ ID NO: 283324 - RNA, 64 nt, hsa; identical to SEQ ID NO: 237405

SEQ ID NO: 283325 - RNA, 64 nt, hsa; identical to SEQ ID NO: 237406

SEQ ID NO: 283326 - RNA, 64 nt, hsa; identical to SEQ ID NO: 237407

SEQ ID NO: 283327 - RNA, 64 nt, hsa; identical to SEQ ID NO: 237408

SEQ ID NO: 283328 - RNA, 64 nt, hsa; identical to SEQ ID NO: 237409

SEQ ID NO: 283329 - RNA, 64 nt, hsa
cagugguuauucagggucugagcagcaguaaaagucacccuaaaucaaggggcuuuucagaagg

SEQ ID NO: 283330 - RNA, 64 nt, hsa
uccuuuuuaaagccauggaacaaaaccugauacaucacccuaacagagcauuaaguuguaacug

SEQ ID NO: 283331 - RNA, 64 nt, hsa
caguucucccugaguugauugauaggcuuaauggucacccuaaaaacacccacauaugcuuuuc

SEQ ID NO: 283332 - RNA, 64 nt, hsa
gaugcauucaucauaauaauuccagacauuuucaucacccuaaaaggaaacccugaaacccauu

SEQ ID NO: 283333 - RNA, 64 nt, hsa; identical to SEQ ID NO: 62936

SEQ ID NO: 283334 - RNA, 64 nt, hsa; identical to SEQ ID NO: 62937

SEQ ID NO: 283335 - RNA, 64 nt, hsa; identical to SEQ ID NO: 62938

SEQ ID NO: 283336 - RNA, 64 nt, hsa; identical to SEQ ID NO: 62939

SEQ ID NO: 283337 - RNA, 64 nt, hsa; identical to SEQ ID NO: 62940

SEQ ID NO: 283338 - RNA, 64 nt, hsa; identical to SEQ ID NO: 62941

SEQ ID NO: 283339 - RNA, 64 nt, hsa; identical to SEQ ID NO: 62942

SEQ ID NO: 283340 - RNA, 64 nt, hsa; identical to SEQ ID NO: 62943

SEQ ID NO: 283341 - RNA, 64 nt, hsa; identical to SEQ ID NO: 62944

SEQ ID NO: 283342 - RNA, 64 nt, hsa; identical to SEQ ID NO: 62945

SEQ ID NO: 283343 - RNA, 64 nt, hsa; identical to SEQ ID NO: 62946

SEQ ID NO: 283344 - RNA, 64 nt, hsa; identical to SEQ ID NO: 62947

SEQ ID NO: 283345 - RNA, 64 nt, hsa; identical to SEQ ID NO: 62948

SEQ ID NO: 283346 - RNA, 64 nt, hsa; identical to SEQ ID NO: 62949

SEQ ID NO: 283347 - RNA, 64 nt, hsa; identical to SEQ ID NO: 62950

SEQ ID NO: 283348 - RNA, 64 nt, hsa; identical to SEQ ID NO: 62951

SEQ ID NO: 283349 - RNA, 64 nt, hsa; identical to SEQ ID NO: 62952

SEQ ID NO: 283350 - RNA, 64 nt, hsa; identical to SEQ ID NO: 62953

SEQ ID NO: 283351 - RNA, 64 nt, hsa; identical to SEQ ID NO: 62954

SEQ ID NO: 283352 - RNA, 64 nt, hsa; identical to SEQ ID NO: 62955

SEQ ID NO: 283353 - RNA, 64 nt, hsa; identical to SEQ ID NO: 62956

SEQ ID NO: 283354 - RNA, 64 nt, hsa; identical to SEQ ID NO: 62957

SEQ ID NO: 283355 - RNA, 64 nt, hsa; identical to SEQ ID NO: 62958

SEQ ID NO: 283356 - RNA, 64 nt, hsa; identical to SEQ ID NO: 62959

SEQ ID NO: 283357 - RNA, 64 nt, hsa; identical to SEQ ID NO: 62960

SEQ ID NO: 283358 - RNA, 64 nt, hsa; identical to SEQ ID NO: 62961

SEQ ID NO: 283359 - RNA, 64 nt, hsa; identical to SEQ ID NO: 62962

SEQ ID NO: 283360 - RNA, 64 nt, hsa; identical to SEQ ID NO: 62963

SEQ ID NO: 283361 - RNA, 64 nt, hsa; identical to SEQ ID NO: 62964

SEQ ID NO: 283362 - RNA, 64 nt, hsa; identical to SEQ ID NO: 62965

SEQ ID NO: 283363 - RNA, 64 nt, hsa; identical to SEQ ID NO: 62966

SEQ ID NO: 283364 - RNA, 64 nt, hsa; identical to SEQ ID NO: 62967

SEQ ID NO: 283365 - RNA, 64 nt, hsa; identical to SEQ ID NO: 62968

SEQ ID NO: 283366 - RNA, 64 nt, hsa; identical to SEQ ID NO: 62969

SEQ ID NO: 283367 - RNA, 64 nt, hsa; identical to SEQ ID NO: 62970

SEQ ID NO: 283368 - RNA, 64 nt, hsa; identical to SEQ ID NO: 62971

SEQ ID NO: 283369 - RNA, 64 nt, hsa; identical to SEQ ID NO: 62972

SEQ ID NO: 283370 - RNA, 64 nt, hsa; identical to SEQ ID NO: 62973

SEQ ID NO: 283371 - RNA, 64 nt, hsa; identical to SEQ ID NO: 62974

SEQ ID NO: 283372 - RNA, 64 nt, hsa; identical to SEQ ID NO: 62975

SEQ ID NO: 283373 - RNA, 64 nt, hsa; identical to SEQ ID NO: 62976

SEQ ID NO: 283374 - RNA, 64 nt, hsa; identical to SEQ ID NO: 62977

SEQ ID NO: 283375 - RNA, 64 nt, hsa; identical to SEQ ID NO: 62978

SEQ ID NO: 283376 - RNA, 64 nt, hsa; identical to SEQ ID NO: 62979

SEQ ID NO: 283377 - RNA, 64 nt, hsa; identical to SEQ ID NO: 62980

SEQ ID NO: 283378 - RNA, 64 nt, hsa; identical to SEQ ID NO: 62981

SEQ ID NO: 283379 - RNA, 64 nt, hsa; identical to SEQ ID NO: 62982

SEQ ID NO: 283380 - RNA, 64 nt, hsa; identical to SEQ ID NO: 62983

SEQ ID NO: 283381 - RNA, 64 nt, hsa; identical to SEQ ID NO: 62984

SEQ ID NO: 283382 - RNA, 64 nt, hsa; identical to SEQ ID NO: 62985

SEQ ID NO: 283383 - RNA, 64 nt, hsa; identical to SEQ ID NO: 62986

SEQ ID NO: 283384 - RNA, 64 nt, hsa; identical to SEQ ID NO: 62987

SEQ ID NO: 283385 - RNA, 64 nt, hsa; identical to SEQ ID NO: 62988

SEQ ID NO: 283386 - RNA, 64 nt, hsa; identical to SEQ ID NO: 62989

SEQ ID NO: 283387 - RNA, 64 nt, hsa; identical to SEQ ID NO: 62990

SEQ ID NO: 283388 - RNA, 64 nt, hsa; identical to SEQ ID NO: 62991

SEQ ID NO: 283389 - RNA, 64 nt, hsa; identical to SEQ ID NO: 62992

SEQ ID NO: 283390 - RNA, 64 nt, hsa; identical to SEQ ID NO: 62993

SEQ ID NO: 283391 - RNA, 64 nt, hsa; identical to SEQ ID NO: 62994

SEQ ID NO: 283392 - RNA, 64 nt, hsa; identical to SEQ ID NO: 62995

SEQ ID NO: 283393 - RNA, 64 nt, hsa; identical to SEQ ID NO: 62996

SEQ ID NO: 283394 - RNA, 64 nt, hsa; identical to SEQ ID NO: 62997

SEQ ID NO: 283395 - RNA, 64 nt, hsa; identical to SEQ ID NO: 62998

SEQ ID NO: 283396 - RNA, 64 nt, hsa; identical to SEQ ID NO: 62999

SEQ ID NO: 283397 - RNA, 64 nt, hsa; identical to SEQ ID NO: 63000

SEQ ID NO: 283398 - RNA, 64 nt, hsa; identical to SEQ ID NO: 63001

SEQ ID NO: 283399 - RNA, 64 nt, hsa; identical to SEQ ID NO: 63002

SEQ ID NO: 283400 - RNA, 64 nt, hsa; identical to SEQ ID NO: 63003

SEQ ID NO: 283401 - RNA, 64 nt, hsa; identical to SEQ ID NO: 63004

SEQ ID NO: 283402 - RNA, 64 nt, hsa; identical to SEQ ID NO: 63005

SEQ ID NO: 283403 - RNA, 64 nt, hsa; identical to SEQ ID NO: 63006

SEQ ID NO: 283404 - RNA, 64 nt, hsa; identical to SEQ ID NO: 63007

SEQ ID NO: 283405 - RNA, 64 nt, hsa; identical to SEQ ID NO: 63008

SEQ ID NO: 283406 - RNA, 64 nt, hsa; identical to SEQ ID NO: 63009

SEQ ID NO: 283407 - RNA, 64 nt, hsa; identical to SEQ ID NO: 63010

SEQ ID NO: 283408 - RNA, 64 nt, hsa; identical to SEQ ID NO: 63011

SEQ ID NO: 283409 - RNA, 64 nt, hsa; identical to SEQ ID NO: 63012

SEQ ID NO: 283410 - RNA, 64 nt, hsa; identical to SEQ ID NO: 63013

SEQ ID NO: 283411 - RNA, 64 nt, hsa; identical to SEQ ID NO: 63014

SEQ ID NO: 283412 - RNA, 64 nt, hsa; identical to SEQ ID NO: 63015

SEQ ID NO: 283413 - RNA, 64 nt, hsa
ggaacauuuucuuaaagaacacuccaauucagccugagugcaaccugacucucugcaucuguau

SEQ ID NO: 283414 - RNA, 64 nt, hsa
ggacgauggaaccguucaguaaagaacccaagguugagugcaacugggguugcacuucagcuuc

SEQ ID NO: 283415 - RNA, 64 nt, hsa
cgaaggcagaagacugaugcaauuuucgaguaauugagugcaguucugggaaaauaccacauuc

SEQ ID NO: 283416 - RNA, 64 nt, hsa
uugcagagccagccccgcgugagaacgugcauaaugagugcacaccaucaugucaaggugcaua

SEQ ID NO: 283417 - RNA, 64 nt, hsa
cagacuuggggcugugaugcccuucagugcguggugagugcagcgugugugcgugugccugugu

SEQ ID NO: 283418 - RNA, 64 nt, hsa
uguguggcacagauggcugggacgggugacagugugagugcaugugugcaugcauguguguaug

SEQ ID NO: 283419 - RNA, 64 nt, hsa
gacaucggagaaaucacuuuggagaaaggucuuuugagugcacugagugugggagaguuuuuag

SEQ ID NO: 283420 - RNA, 64 nt, hsa
gucaugagagaguucauacuggagaaaagccuuaugagugcagugaaugugggaaagucuuuag

SEQ ID NO: 283421 - RNA, 64 nt, hsa
uacaucugagaguucacacuggagaaaggccuuaugagugcagugacugugggaaauccuuugc

SEQ ID NO: 283422 - RNA, 64 nt, hsa
cauaaaagagugcucccacugaagaagugccuuuugagugcaaugaaugugagaaagccuucag

SEQ ID NO: 283423 - RNA, 64 nt, hsa; identical to SEQ ID NO: 164705

SEQ ID NO: 283424 - RNA, 64 nt, hsa; identical to SEQ ID NO: 164706

SEQ ID NO: 283425 - RNA, 64 nt, hsa; identical to SEQ ID NO: 133550

SEQ ID NO: 283426 - RNA, 64 nt, hsa; identical to SEQ ID NO: 133551

SEQ ID NO: 283427 - RNA, 64 nt, hsa; identical to SEQ ID NO: 133552

SEQ ID NO: 283428 - RNA, 64 nt, hsa; identical to SEQ ID NO: 133553

SEQ ID NO: 283429 - RNA, 64 nt, hsa; identical to SEQ ID NO: 133554

SEQ ID NO: 283430 - RNA, 64 nt, hsa; identical to SEQ ID NO: 133555

SEQ ID NO: 283431 - RNA, 64 nt, hsa; identical to SEQ ID NO: 133556

SEQ ID NO: 283432 - RNA, 64 nt, hsa; identical to SEQ ID NO: 133557

SEQ ID NO: 283433 - RNA, 64 nt, hsa; identical to SEQ ID NO: 133558

SEQ ID NO: 283434 - RNA, 64 nt, hsa; identical to SEQ ID NO: 133559

SEQ ID NO: 283435 - RNA, 64 nt, hsa; identical to SEQ ID NO: 133560

SEQ ID NO: 283436 - RNA, 64 nt, hsa; identical to SEQ ID NO: 133561

SEQ ID NO: 283437 - RNA, 64 nt, hsa; identical to SEQ ID NO: 133562

SEQ ID NO: 283438 - RNA, 64 nt, hsa; identical to SEQ ID NO: 133563

SEQ ID NO: 283439 - RNA, 64 nt, hsa; identical to SEQ ID NO: 133564

SEQ ID NO: 283440 - RNA, 64 nt, hsa; identical to SEQ ID NO: 133565

SEQ ID NO: 283441 - RNA, 64 nt, hsa; identical to SEQ ID NO: 133566

SEQ ID NO: 283442 - RNA, 64 nt, hsa; identical to SEQ ID NO: 133567

SEQ ID NO: 283443 - RNA, 64 nt, hsa; identical to SEQ ID NO: 133568

SEQ ID NO: 283444 - RNA, 64 nt, hsa; identical to SEQ ID NO: 133569

SEQ ID NO: 283445 - RNA, 64 nt, hsa; identical to SEQ ID NO: 133570

SEQ ID NO: 283446 - RNA, 64 nt, hsa; identical to SEQ ID NO: 133571

SEQ ID NO: 283447 - RNA, 64 nt, hsa; identical to SEQ ID NO: 133572

SEQ ID NO: 283448 - RNA, 64 nt, hsa; identical to SEQ ID NO: 133573

SEQ ID NO: 283449 - RNA, 64 nt, hsa; identical to SEQ ID NO: 133574

SEQ ID NO: 283450 - RNA, 64 nt, hsa; identical to SEQ ID NO: 133575

SEQ ID NO: 283451 - RNA, 64 nt, hsa; identical to SEQ ID NO: 133576

SEQ ID NO: 283452 - RNA, 64 nt, hsa; identical to SEQ ID NO: 133577

SEQ ID NO: 283453 - RNA, 64 nt, hsa; identical to SEQ ID NO: 133578

SEQ ID NO: 283454 - RNA, 64 nt, hsa; identical to SEQ ID NO: 133579

SEQ ID NO: 283455 - RNA, 64 nt, hsa; identical to SEQ ID NO: 133580

SEQ ID NO: 283456 - RNA, 64 nt, hsa; identical to SEQ ID NO: 133581

SEQ ID NO: 283457 - RNA, 64 nt, hsa; identical to SEQ ID NO: 133582

SEQ ID NO: 283458 - RNA, 64 nt, hsa; identical to SEQ ID NO: 133583

SEQ ID NO: 283459 - RNA, 64 nt, hsa; identical to SEQ ID NO: 133584

SEQ ID NO: 283460 - RNA, 64 nt, hsa; identical to SEQ ID NO: 133585

SEQ ID NO: 283461 - RNA, 64 nt, hsa; identical to SEQ ID NO: 133586

SEQ ID NO: 283462 - RNA, 64 nt, hsa; identical to SEQ ID NO: 133587

SEQ ID NO: 283463 - RNA, 64 nt, hsa; identical to SEQ ID NO: 133588

SEQ ID NO: 283464 - RNA, 64 nt, hsa; identical to SEQ ID NO: 133589

SEQ ID NO: 283465 - RNA, 64 nt, hsa; identical to SEQ ID NO: 133590

SEQ ID NO: 283466 - RNA, 64 nt, hsa; identical to SEQ ID NO: 133591

SEQ ID NO: 283467 - RNA, 64 nt, hsa; identical to SEQ ID NO: 133592

SEQ ID NO: 283468 - RNA, 64 nt, hsa; identical to SEQ ID NO: 133593

SEQ ID NO: 283469 - RNA, 64 nt, hsa; identical to SEQ ID NO: 133594

SEQ ID NO: 283470 - RNA, 64 nt, hsa; identical to SEQ ID NO: 133595

SEQ ID NO: 283471 - RNA, 64 nt, hsa; identical to SEQ ID NO: 133596

SEQ ID NO: 283472 - RNA, 64 nt, hsa; identical to SEQ ID NO: 133597

SEQ ID NO: 283473 - RNA, 64 nt, hsa; identical to SEQ ID NO: 133598

SEQ ID NO: 283474 - RNA, 64 nt, hsa; identical to SEQ ID NO: 133599

SEQ ID NO: 283475 - RNA, 64 nt, hsa; identical to SEQ ID NO: 133600

SEQ ID NO: 283476 - RNA, 64 nt, hsa; identical to SEQ ID NO: 133601

SEQ ID NO: 283477 - RNA, 64 nt, hsa; identical to SEQ ID NO: 133602

SEQ ID NO: 283478 - RNA, 64 nt, hsa; identical to SEQ ID NO: 133603

SEQ ID NO: 283479 - RNA, 64 nt, hsa; identical to SEQ ID NO: 133604

SEQ ID NO: 283480 - RNA, 64 nt, hsa; identical to SEQ ID NO: 133605

SEQ ID NO: 283481 - RNA, 64 nt, hsa; identical to SEQ ID NO: 133606

SEQ ID NO: 283482 - RNA, 64 nt, hsa; identical to SEQ ID NO: 133607

SEQ ID NO: 283483 - RNA, 64 nt, hsa; identical to SEQ ID NO: 133608

SEQ ID NO: 283484 - RNA, 64 nt, hsa; identical to SEQ ID NO: 133609

SEQ ID NO: 283485 - RNA, 64 nt, hsa; identical to SEQ ID NO: 133610

SEQ ID NO: 283486 - RNA, 52 nt, hsa; identical to SEQ ID NO: 133611

SEQ ID NO: 283487 - RNA, 55 nt, hsa; identical to SEQ ID NO: 133612

SEQ ID NO: 283488 - RNA, 64 nt, hsa; identical to SEQ ID NO: 133613

SEQ ID NO: 283489 - RNA, 64 nt, hsa; identical to SEQ ID NO: 133614

SEQ ID NO: 283490 - RNA, 64 nt, hsa; identical to SEQ ID NO: 133615

SEQ ID NO: 283491 - RNA, 64 nt, hsa; identical to SEQ ID NO: 133616

SEQ ID NO: 283492 - RNA, 64 nt, hsa; identical to SEQ ID NO: 133617

SEQ ID NO: 283493 - RNA, 64 nt, hsa; identical to SEQ ID NO: 133618

SEQ ID NO: 283494 - RNA, 64 nt, hsa; identical to SEQ ID NO: 133619

SEQ ID NO: 283495 - RNA, 64 nt, hsa; identical to SEQ ID NO: 133620

SEQ ID NO: 283496 - RNA, 64 nt, hsa; identical to SEQ ID NO: 133621

SEQ ID NO: 283497 - RNA, 64 nt, hsa; identical to SEQ ID NO: 133622

SEQ ID NO: 283498 - RNA, 64 nt, hsa; identical to SEQ ID NO: 133623

SEQ ID NO: 283499 - RNA, 64 nt, hsa; identical to SEQ ID NO: 133624

SEQ ID NO: 283500 - RNA, 64 nt, hsa; identical to SEQ ID NO: 133625

SEQ ID NO: 283501 - RNA, 64 nt, hsa; identical to SEQ ID NO: 133626

SEQ ID NO: 283502 - RNA, 64 nt, hsa; identical to SEQ ID NO: 133627

SEQ ID NO: 283503 - RNA, 64 nt, hsa; identical to SEQ ID NO: 133628

SEQ ID NO: 283504 - RNA, 64 nt, hsa; identical to SEQ ID NO: 133629

SEQ ID NO: 283505 - RNA, 64 nt, hsa; identical to SEQ ID NO: 133630

SEQ ID NO: 283506 - RNA, 64 nt, hsa; identical to SEQ ID NO: 133631

SEQ ID NO: 283507 - RNA, 64 nt, hsa; identical to SEQ ID NO: 133632

SEQ ID NO: 283508 - RNA, 64 nt, hsa; identical to SEQ ID NO: 133633

SEQ ID NO: 283509 - RNA, 64 nt, hsa; identical to SEQ ID NO: 133634

SEQ ID NO: 283510 - RNA, 64 nt, hsa; identical to SEQ ID NO: 133635

SEQ ID NO: 283511 - RNA, 64 nt, hsa; identical to SEQ ID NO: 133636

SEQ ID NO: 283512 - RNA, 64 nt, hsa; identical to SEQ ID NO: 133637

SEQ ID NO: 283513 - RNA, 64 nt, hsa; identical to SEQ ID NO: 133638

SEQ ID NO: 283514 - RNA, 63 nt, hsa; identical to SEQ ID NO: 133639

SEQ ID NO: 283515 - RNA, 51 nt, hsa; identical to SEQ ID NO: 133640

SEQ ID NO: 283516 - RNA, 64 nt, hsa; identical to SEQ ID NO: 133641

SEQ ID NO: 283517 - RNA, 64 nt, hsa; identical to SEQ ID NO: 133642

SEQ ID NO: 283518 - RNA, 64 nt, hsa; identical to SEQ ID NO: 133643

SEQ ID NO: 283519 - RNA, 64 nt, hsa; identical to SEQ ID NO: 133644

SEQ ID NO: 283520 - RNA, 64 nt, hsa; identical to SEQ ID NO: 133645

SEQ ID NO: 283521 - RNA, 64 nt, hsa; identical to SEQ ID NO: 133646

SEQ ID NO: 283522 - RNA, 64 nt, hsa; identical to SEQ ID NO: 133647

SEQ ID NO: 283523 - RNA, 64 nt, hsa; identical to SEQ ID NO: 133648

SEQ ID NO: 283524 - RNA, 64 nt, hsa; identical to SEQ ID NO: 133649

SEQ ID NO: 283525 - RNA, 64 nt, hsa; identical to SEQ ID NO: 133650

SEQ ID NO: 283526 - RNA, 64 nt, hsa; identical to SEQ ID NO: 133651

SEQ ID NO: 283527 - RNA, 64 nt, hsa; identical to SEQ ID NO: 133652

SEQ ID NO: 283528 - RNA, 64 nt, hsa; identical to SEQ ID NO: 133653

SEQ ID NO: 283529 - RNA, 64 nt, hsa; identical to SEQ ID NO: 133654

SEQ ID NO: 283530 - RNA, 64 nt, hsa; identical to SEQ ID NO: 133655

SEQ ID NO: 283531 - RNA, 64 nt, hsa; identical to SEQ ID NO: 133656

SEQ ID NO: 283532 - RNA, 64 nt, hsa; identical to SEQ ID NO: 133657

SEQ ID NO: 283533 - RNA, 64 nt, hsa; identical to SEQ ID NO: 133658

SEQ ID NO: 283534 - RNA, 64 nt, hsa; identical to SEQ ID NO: 133659

SEQ ID NO: 283535 - RNA, 64 nt, hsa; identical to SEQ ID NO: 133660

SEQ ID NO: 283536 - RNA, 64 nt, hsa; identical to SEQ ID NO: 133661

SEQ ID NO: 283537 - RNA, 64 nt, hsa; identical to SEQ ID NO: 133662

SEQ ID NO: 283538 - RNA, 64 nt, hsa; identical to SEQ ID NO: 133663

SEQ ID NO: 283539 - RNA, 64 nt, hsa; identical to SEQ ID NO: 133664

SEQ ID NO: 283540 - RNA, 64 nt, hsa; identical to SEQ ID NO: 133665

SEQ ID NO: 283541 - RNA, 64 nt, hsa; identical to SEQ ID NO: 133666

SEQ ID NO: 283542 - RNA, 64 nt, hsa; identical to SEQ ID NO: 133667

SEQ ID NO: 283543 - RNA, 64 nt, hsa; identical to SEQ ID NO: 133668

SEQ ID NO: 283544 - RNA, 64 nt, hsa; identical to SEQ ID NO: 133669

SEQ ID NO: 283545 - RNA, 64 nt, hsa; identical to SEQ ID NO: 133670

SEQ ID NO: 283546 - RNA, 64 nt, hsa; identical to SEQ ID NO: 133671

SEQ ID NO: 283547 - RNA, 64 nt, hsa; identical to SEQ ID NO: 133672

SEQ ID NO: 283548 - RNA, 64 nt, hsa; identical to SEQ ID NO: 133673

SEQ ID NO: 283549 - RNA, 64 nt, hsa; identical to SEQ ID NO: 133674

SEQ ID NO: 283550 - RNA, 64 nt, hsa; identical to SEQ ID NO: 133675

SEQ ID NO: 283551 - RNA, 64 nt, hsa; identical to SEQ ID NO: 133676

SEQ ID NO: 283552 - RNA, 50 nt, hsa; identical to SEQ ID NO: 133677

SEQ ID NO: 283553 - RNA, 64 nt, hsa; identical to SEQ ID NO: 133678

SEQ ID NO: 283554 - RNA, 64 nt, hsa; identical to SEQ ID NO: 133679

SEQ ID NO: 283555 - RNA, 64 nt, hsa; identical to SEQ ID NO: 133680

SEQ ID NO: 283556 - RNA, 64 nt, hsa; identical to SEQ ID NO: 133681

SEQ ID NO: 283557 - RNA, 64 nt, hsa; identical to SEQ ID NO: 133682

SEQ ID NO: 283558 - RNA, 64 nt, hsa; identical to SEQ ID NO: 133683

SEQ ID NO: 283559 - RNA, 64 nt, hsa; identical to SEQ ID NO: 133684

SEQ ID NO: 283560 - RNA, 64 nt, hsa; identical to SEQ ID NO: 133685

SEQ ID NO: 283561 - RNA, 64 nt, hsa; identical to SEQ ID NO: 133686

SEQ ID NO: 283562 - RNA, 64 nt, hsa; identical to SEQ ID NO: 133687

SEQ ID NO: 283563 - RNA, 64 nt, hsa; identical to SEQ ID NO: 133688

SEQ ID NO: 283564 - RNA, 64 nt, hsa; identical to SEQ ID NO: 133689

SEQ ID NO: 283565 - RNA, 64 nt, hsa; identical to SEQ ID NO: 133690

SEQ ID NO: 283566 - RNA, 64 nt, hsa; identical to SEQ ID NO: 133691

SEQ ID NO: 283567 - RNA, 64 nt, hsa; identical to SEQ ID NO: 133692

SEQ ID NO: 283568 - RNA, 64 nt, hsa; identical to SEQ ID NO: 133693

SEQ ID NO: 283569 - RNA, 64 nt, hsa; identical to SEQ ID NO: 133694

SEQ ID NO: 283570 - RNA, 64 nt, hsa; identical to SEQ ID NO: 133695

SEQ ID NO: 283571 - RNA, 64 nt, hsa; identical to SEQ ID NO: 133696

SEQ ID NO: 283572 - RNA, 64 nt, hsa; identical to SEQ ID NO: 133697

SEQ ID NO: 283573 - RNA, 64 nt, hsa; identical to SEQ ID NO: 133698

SEQ ID NO: 283574 - RNA, 64 nt, hsa; identical to SEQ ID NO: 133699

SEQ ID NO: 283575 - RNA, 64 nt, hsa; identical to SEQ ID NO: 133700

SEQ ID NO: 283576 - RNA, 64 nt, hsa; identical to SEQ ID NO: 133701

SEQ ID NO: 283577 - RNA, 64 nt, hsa; identical to SEQ ID NO: 133702

SEQ ID NO: 283578 - RNA, 64 nt, hsa; identical to SEQ ID NO: 133703

SEQ ID NO: 283579 - RNA, 64 nt, hsa; identical to SEQ ID NO: 133704

SEQ ID NO: 283580 - RNA, 64 nt, hsa; identical to SEQ ID NO: 133705

SEQ ID NO: 283581 - RNA, 64 nt, hsa; identical to SEQ ID NO: 133706

SEQ ID NO: 283582 - RNA, 64 nt, hsa; identical to SEQ ID NO: 133707

SEQ ID NO: 283583 - RNA, 64 nt, hsa; identical to SEQ ID NO: 133708

SEQ ID NO: 283584 - RNA, 64 nt, hsa; identical to SEQ ID NO: 133709

SEQ ID NO: 283585 - RNA, 64 nt, hsa; identical to SEQ ID NO: 133710

SEQ ID NO: 283586 - RNA, 64 nt, hsa; identical to SEQ ID NO: 133711

SEQ ID NO: 283587 - RNA, 64 nt, hsa; identical to SEQ ID NO: 133712

SEQ ID NO: 283588 - RNA, 64 nt, hsa; identical to SEQ ID NO: 133713

SEQ ID NO: 283589 - RNA, 64 nt, hsa; identical to SEQ ID NO: 133714

SEQ ID NO: 283590 - RNA, 64 nt, hsa; identical to SEQ ID NO: 133715

SEQ ID NO: 283591 - RNA, 64 nt, hsa; identical to SEQ ID NO: 133716

SEQ ID NO: 283592 - RNA, 64 nt, hsa; identical to SEQ ID NO: 133717

SEQ ID NO: 283593 - RNA, 64 nt, hsa; identical to SEQ ID NO: 133718

SEQ ID NO: 283594 - RNA, 64 nt, hsa; identical to SEQ ID NO: 133719

SEQ ID NO: 283595 - RNA, 64 nt, hsa; identical to SEQ ID NO: 133720

SEQ ID NO: 283596 - RNA, 64 nt, hsa; identical to SEQ ID NO: 133721

SEQ ID NO: 283597 - RNA, 64 nt, hsa; identical to SEQ ID NO: 133722

SEQ ID NO: 283598 - RNA, 64 nt, hsa; identical to SEQ ID NO: 133723

SEQ ID NO: 283599 - RNA, 64 nt, hsa; identical to SEQ ID NO: 133724

SEQ ID NO: 283600 - RNA, 64 nt, hsa; identical to SEQ ID NO: 133725

SEQ ID NO: 283601 - RNA, 64 nt, hsa; identical to SEQ ID NO: 133726

SEQ ID NO: 283602 - RNA, 64 nt, hsa; identical to SEQ ID NO: 133727

SEQ ID NO: 283603 - RNA, 64 nt, hsa; identical to SEQ ID NO: 133728

SEQ ID NO: 283604 - RNA, 64 nt, hsa; identical to SEQ ID NO: 133729

SEQ ID NO: 283605 - RNA, 64 nt, hsa; identical to SEQ ID NO: 133730

SEQ ID NO: 283606 - RNA, 64 nt, hsa; identical to SEQ ID NO: 133731

SEQ ID NO: 283607 - RNA, 64 nt, hsa; identical to SEQ ID NO: 133732

SEQ ID NO: 283608 - RNA, 64 nt, hsa; identical to SEQ ID NO: 133733

SEQ ID NO: 283609 - RNA, 64 nt, hsa; identical to SEQ ID NO: 133734

SEQ ID NO: 283610 - RNA, 64 nt, hsa; identical to SEQ ID NO: 133735

SEQ ID NO: 283611 - RNA, 64 nt, hsa; identical to SEQ ID NO: 133736

SEQ ID NO: 283612 - RNA, 64 nt, hsa; identical to SEQ ID NO: 133737

SEQ ID NO: 283613 - RNA, 64 nt, hsa; identical to SEQ ID NO: 133738

SEQ ID NO: 283614 - RNA, 64 nt, hsa; identical to SEQ ID NO: 133739

SEQ ID NO: 283615 - RNA, 64 nt, hsa; identical to SEQ ID NO: 133740

SEQ ID NO: 283616 - RNA, 64 nt, hsa; identical to SEQ ID NO: 133741

SEQ ID NO: 283617 - RNA, 64 nt, hsa; identical to SEQ ID NO: 133742

SEQ ID NO: 283618 - RNA, 64 nt, hsa; identical to SEQ ID NO: 133743

SEQ ID NO: 283619 - RNA, 64 nt, hsa; identical to SEQ ID NO: 133744

SEQ ID NO: 283620 - RNA, 64 nt, hsa; identical to SEQ ID NO: 133745

SEQ ID NO: 283621 - RNA, 64 nt, hsa; identical to SEQ ID NO: 133746

SEQ ID NO: 283622 - RNA, 64 nt, hsa; identical to SEQ ID NO: 133747

SEQ ID NO: 283623 - RNA, 64 nt, hsa; identical to SEQ ID NO: 133748

SEQ ID NO: 283624 - RNA, 64 nt, hsa; identical to SEQ ID NO: 133749

SEQ ID NO: 283625 - RNA, 64 nt, hsa; identical to SEQ ID NO: 133750

SEQ ID NO: 283626 - RNA, 64 nt, hsa; identical to SEQ ID NO: 133751

SEQ ID NO: 283627 - RNA, 64 nt, hsa; identical to SEQ ID NO: 133752

SEQ ID NO: 283628 - RNA, 64 nt, hsa; identical to SEQ ID NO: 133753

SEQ ID NO: 283629 - RNA, 64 nt, hsa; identical to SEQ ID NO: 133754

SEQ ID NO: 283630 - RNA, 64 nt, hsa; identical to SEQ ID NO: 133755

SEQ ID NO: 283631 - RNA, 64 nt, hsa; identical to SEQ ID NO: 133756

SEQ ID NO: 283632 - RNA, 64 nt, hsa; identical to SEQ ID NO: 133757

SEQ ID NO: 283633 - RNA, 64 nt, hsa; identical to SEQ ID NO: 133758

SEQ ID NO: 283634 - RNA, 64 nt, hsa; identical to SEQ ID NO: 133759

SEQ ID NO: 283635 - RNA, 64 nt, hsa; identical to SEQ ID NO: 133760

SEQ ID NO: 283636 - RNA, 64 nt, hsa; identical to SEQ ID NO: 133761

SEQ ID NO: 283637 - RNA, 64 nt, hsa; identical to SEQ ID NO: 133762

SEQ ID NO: 283638 - RNA, 64 nt, hsa; identical to SEQ ID NO: 133763

SEQ ID NO: 283639 - RNA, 64 nt, hsa; identical to SEQ ID NO: 133764

SEQ ID NO: 283640 - RNA, 64 nt, hsa; identical to SEQ ID NO: 133765

SEQ ID NO: 283641 - RNA, 60 nt, hsa; identical to SEQ ID NO: 133766

SEQ ID NO: 283642 - RNA, 57 nt, hsa; identical to SEQ ID NO: 133767

SEQ ID NO: 283643 - RNA, 64 nt, hsa; identical to SEQ ID NO: 133768

SEQ ID NO: 283644 - RNA, 64 nt, hsa; identical to SEQ ID NO: 133769

SEQ ID NO: 283645 - RNA, 64 nt, hsa; identical to SEQ ID NO: 133770

SEQ ID NO: 283646 - RNA, 64 nt, hsa; identical to SEQ ID NO: 133771

SEQ ID NO: 283647 - RNA, 64 nt, hsa; identical to SEQ ID NO: 133772

SEQ ID NO: 283648 - RNA, 64 nt, hsa; identical to SEQ ID NO: 133773

SEQ ID NO: 283649 - RNA, 64 nt, hsa; identical to SEQ ID NO: 133774

SEQ ID NO: 283650 - RNA, 64 nt, hsa; identical to SEQ ID NO: 133775

SEQ ID NO: 283651 - RNA, 64 nt, hsa; identical to SEQ ID NO: 133776

SEQ ID NO: 283652 - RNA, 64 nt, hsa; identical to SEQ ID NO: 133777

SEQ ID NO: 283653 - RNA, 64 nt, hsa; identical to SEQ ID NO: 133778

SEQ ID NO: 283654 - RNA, 64 nt, hsa; identical to SEQ ID NO: 133779

SEQ ID NO: 283655 - RNA, 64 nt, hsa; identical to SEQ ID NO: 133780

SEQ ID NO: 283656 - RNA, 64 nt, hsa; identical to SEQ ID NO: 133781

SEQ ID NO: 283657 - RNA, 64 nt, hsa; identical to SEQ ID NO: 133782

SEQ ID NO: 283658 - RNA, 64 nt, hsa; identical to SEQ ID NO: 133783

SEQ ID NO: 283659 - RNA, 64 nt, hsa; identical to SEQ ID NO: 133784

SEQ ID NO: 283660 - RNA, 64 nt, hsa; identical to SEQ ID NO: 133785

SEQ ID NO: 283661 - RNA, 64 nt, hsa; identical to SEQ ID NO: 133786

SEQ ID NO: 283662 - RNA, 64 nt, hsa; identical to SEQ ID NO: 133787

SEQ ID NO: 283663 - RNA, 64 nt, hsa; identical to SEQ ID NO: 133788

SEQ ID NO: 283664 - RNA, 64 nt, hsa; identical to SEQ ID NO: 133789

SEQ ID NO: 283665 - RNA, 64 nt, hsa; identical to SEQ ID NO: 133790

SEQ ID NO: 283666 - RNA, 64 nt, hsa; identical to SEQ ID NO: 133791

SEQ ID NO: 283667 - RNA, 64 nt, hsa; identical to SEQ ID NO: 133792

SEQ ID NO: 283668 - RNA, 64 nt, hsa; identical to SEQ ID NO: 133793

SEQ ID NO: 283669 - RNA, 64 nt, hsa; identical to SEQ ID NO: 133794

SEQ ID NO: 283670 - RNA, 64 nt, hsa; identical to SEQ ID NO: 133795

SEQ ID NO: 283671 - RNA, 64 nt, hsa; identical to SEQ ID NO: 133796

SEQ ID NO: 283672 - RNA, 64 nt, hsa; identical to SEQ ID NO: 133797

SEQ ID NO: 283673 - RNA, 64 nt, hsa; identical to SEQ ID NO: 133798

SEQ ID NO: 283674 - RNA, 64 nt, hsa; identical to SEQ ID NO: 133799

SEQ ID NO: 283675 - RNA, 64 nt, hsa; identical to SEQ ID NO: 133800

SEQ ID NO: 283676 - RNA, 64 nt, hsa; identical to SEQ ID NO: 133801

SEQ ID NO: 283677 - RNA, 64 nt, hsa; identical to SEQ ID NO: 133802

SEQ ID NO: 283678 - RNA, 64 nt, hsa; identical to SEQ ID NO: 133803

SEQ ID NO: 283679 - RNA, 64 nt, hsa; identical to SEQ ID NO: 133804

SEQ ID NO: 283680 - RNA, 64 nt, hsa; identical to SEQ ID NO: 133805

SEQ ID NO: 283681 - RNA, 64 nt, hsa; identical to SEQ ID NO: 133806

SEQ ID NO: 283682 - RNA, 64 nt, hsa; identical to SEQ ID NO: 133807

SEQ ID NO: 283683 - RNA, 64 nt, hsa; identical to SEQ ID NO: 133808

SEQ ID NO: 283684 - RNA, 64 nt, hsa; identical to SEQ ID NO: 133809

SEQ ID NO: 283685 - RNA, 64 nt, hsa; identical to SEQ ID NO: 133810

SEQ ID NO: 283686 - RNA, 64 nt, hsa; identical to SEQ ID NO: 133811

SEQ ID NO: 283687 - RNA, 64 nt, hsa; identical to SEQ ID NO: 133812

SEQ ID NO: 283688 - RNA, 64 nt, hsa; identical to SEQ ID NO: 133813

SEQ ID NO: 283689 - RNA, 64 nt, hsa; identical to SEQ ID NO: 133814

SEQ ID NO: 283690 - RNA, 64 nt, hsa; identical to SEQ ID NO: 133815

SEQ ID NO: 283691 - RNA, 64 nt, hsa; identical to SEQ ID NO: 133816

SEQ ID NO: 283692 - RNA, 64 nt, hsa; identical to SEQ ID NO: 133817

SEQ ID NO: 283693 - RNA, 64 nt, hsa; identical to SEQ ID NO: 133818

SEQ ID NO: 283694 - RNA, 64 nt, hsa; identical to SEQ ID NO: 133819

SEQ ID NO: 283695 - RNA, 64 nt, hsa; identical to SEQ ID NO: 133820

SEQ ID NO: 283696 - RNA, 64 nt, hsa; identical to SEQ ID NO: 133821

SEQ ID NO: 283697 - RNA, 64 nt, hsa; identical to SEQ ID NO: 133822

SEQ ID NO: 283698 - RNA, 64 nt, hsa; identical to SEQ ID NO: 133823

SEQ ID NO: 283699 - RNA, 64 nt, hsa; identical to SEQ ID NO: 133824

SEQ ID NO: 283700 - RNA, 64 nt, hsa; identical to SEQ ID NO: 133825

SEQ ID NO: 283701 - RNA, 64 nt, hsa; identical to SEQ ID NO: 133826

SEQ ID NO: 283702 - RNA, 64 nt, hsa; identical to SEQ ID NO: 133827

SEQ ID NO: 283703 - RNA, 64 nt, hsa; identical to SEQ ID NO: 133828

SEQ ID NO: 283704 - RNA, 64 nt, hsa; identical to SEQ ID NO: 133829

SEQ ID NO: 283705 - RNA, 64 nt, hsa
cuuccauguguagagugcuuagaaaccccaucaacugaucuagugagucagacuguggaaucuc

SEQ ID NO: 283706 - RNA, 64 nt, hsa
cccugcauccaacaucugaucugcugagauaugucugaucuaucucugcucgcuguucucccgu

SEQ ID NO: 283707 - RNA, 64 nt, hsa; identical to SEQ ID NO: 144190

SEQ ID NO: 283708 - RNA, 64 nt, hsa; identical to SEQ ID NO: 144191

SEQ ID NO: 283709 - RNA, 64 nt, hsa; identical to SEQ ID NO: 144192

SEQ ID NO: 283710 - RNA, 64 nt, hsa; identical to SEQ ID NO: 144193

SEQ ID NO: 283711 - RNA, 64 nt, hsa; identical to SEQ ID NO: 144194

SEQ ID NO: 283712 - RNA, 64 nt, hsa; identical to SEQ ID NO: 144195

SEQ ID NO: 283713 - RNA, 64 nt, hsa; identical to SEQ ID NO: 144196

SEQ ID NO: 283714 - RNA, 64 nt, hsa; identical to SEQ ID NO: 144197

SEQ ID NO: 283715 - RNA, 64 nt, hsa; identical to SEQ ID NO: 144198

SEQ ID NO: 283716 - RNA, 64 nt, hsa; identical to SEQ ID NO: 144199

SEQ ID NO: 283717 - RNA, 64 nt, hsa; identical to SEQ ID NO: 144200

SEQ ID NO: 283718 - RNA, 64 nt, hsa; identical to SEQ ID NO: 144201

SEQ ID NO: 283719 - RNA, 64 nt, hsa; identical to SEQ ID NO: 144202

SEQ ID NO: 283720 - RNA, 64 nt, hsa; identical to SEQ ID NO: 144203

SEQ ID NO: 283721 - RNA, 64 nt, hsa; identical to SEQ ID NO: 144204

SEQ ID NO: 283722 - RNA, 64 nt, hsa; identical to SEQ ID NO: 144205

SEQ ID NO: 283723 - RNA, 64 nt, hsa; identical to SEQ ID NO: 144206

SEQ ID NO: 283724 - RNA, 64 nt, hsa; identical to SEQ ID NO: 144207

SEQ ID NO: 283725 - RNA, 64 nt, hsa; identical to SEQ ID NO: 144208

SEQ ID NO: 283726 - RNA, 64 nt, hsa; identical to SEQ ID NO: 144209

SEQ ID NO: 283727 - RNA, 64 nt, hsa; identical to SEQ ID NO: 144210

SEQ ID NO: 283728 - RNA, 64 nt, hsa; identical to SEQ ID NO: 144211

SEQ ID NO: 283729 - RNA, 64 nt, hsa; identical to SEQ ID NO: 144212

SEQ ID NO: 283730 - RNA, 64 nt, hsa; identical to SEQ ID NO: 144213

SEQ ID NO: 283731 - RNA, 64 nt, hsa; identical to SEQ ID NO: 144214

SEQ ID NO: 283732 - RNA, 64 nt, hsa; identical to SEQ ID NO: 144215

SEQ ID NO: 283733 - RNA, 64 nt, hsa; identical to SEQ ID NO: 144216

SEQ ID NO: 283734 - RNA, 64 nt, hsa; identical to SEQ ID NO: 144217

SEQ ID NO: 283735 - RNA, 64 nt, hsa; identical to SEQ ID NO: 144218

SEQ ID NO: 283736 - RNA, 64 nt, hsa; identical to SEQ ID NO: 144219

SEQ ID NO: 283737 - RNA, 64 nt, hsa; identical to SEQ ID NO: 144220

SEQ ID NO: 283738 - RNA, 64 nt, hsa; identical to SEQ ID NO: 144221

SEQ ID NO: 283739 - RNA, 64 nt, hsa; identical to SEQ ID NO: 144222

SEQ ID NO: 283740 - RNA, 64 nt, hsa; identical to SEQ ID NO: 144223

SEQ ID NO: 283741 - RNA, 64 nt, hsa; identical to SEQ ID NO: 144224

SEQ ID NO: 283742 - RNA, 64 nt, hsa; identical to SEQ ID NO: 144225

SEQ ID NO: 283743 - RNA, 64 nt, hsa; identical to SEQ ID NO: 144226

SEQ ID NO: 283744 - RNA, 64 nt, hsa; identical to SEQ ID NO: 144227

SEQ ID NO: 283745 - RNA, 64 nt, hsa; identical to SEQ ID NO: 144228

SEQ ID NO: 283746 - RNA, 64 nt, hsa; identical to SEQ ID NO: 144229

SEQ ID NO: 283747 - RNA, 64 nt, hsa; identical to SEQ ID NO: 144230

SEQ ID NO: 283748 - RNA, 64 nt, hsa; identical to SEQ ID NO: 144231

SEQ ID NO: 283749 - RNA, 64 nt, hsa; identical to SEQ ID NO: 144232

SEQ ID NO: 283750 - RNA, 64 nt, hsa; identical to SEQ ID NO: 144233

SEQ ID NO: 283751 - RNA, 64 nt, hsa; identical to SEQ ID NO: 144234

SEQ ID NO: 283752 - RNA, 64 nt, hsa; identical to SEQ ID NO: 144235

SEQ ID NO: 283753 - RNA, 64 nt, hsa; identical to SEQ ID NO: 144236

SEQ ID NO: 283754 - RNA, 64 nt, hsa; identical to SEQ ID NO: 144237

SEQ ID NO: 283755 - RNA, 64 nt, hsa; identical to SEQ ID NO: 144238

SEQ ID NO: 283756 - RNA, 64 nt, hsa; identical to SEQ ID NO: 144239

SEQ ID NO: 283757 - RNA, 64 nt, hsa; identical to SEQ ID NO: 144240

SEQ ID NO: 283758 - RNA, 64 nt, hsa; identical to SEQ ID NO: 144241

SEQ ID NO: 283759 - RNA, 64 nt, hsa; identical to SEQ ID NO: 144242

SEQ ID NO: 283760 - RNA, 64 nt, hsa; identical to SEQ ID NO: 144243

SEQ ID NO: 283761 - RNA, 64 nt, hsa; identical to SEQ ID NO: 144244

SEQ ID NO: 283762 - RNA, 64 nt, hsa; identical to SEQ ID NO: 144245

SEQ ID NO: 283763 - RNA, 64 nt, hsa; identical to SEQ ID NO: 144246

SEQ ID NO: 283764 - RNA, 64 nt, hsa; identical to SEQ ID NO: 144247

SEQ ID NO: 283765 - RNA, 64 nt, hsa; identical to SEQ ID NO: 144248

SEQ ID NO: 283766 - RNA, 64 nt, hsa; identical to SEQ ID NO: 144249

SEQ ID NO: 283767 - RNA, 64 nt, hsa; identical to SEQ ID NO: 144250

SEQ ID NO: 283768 - RNA, 64 nt, hsa; identical to SEQ ID NO: 144251

SEQ ID NO: 283769 - RNA, 64 nt, hsa; identical to SEQ ID NO: 144252

SEQ ID NO: 283770 - RNA, 64 nt, hsa; identical to SEQ ID NO: 144253

SEQ ID NO: 283771 - RNA, 64 nt, hsa; identical to SEQ ID NO: 144254

SEQ ID NO: 283772 - RNA, 64 nt, hsa; identical to SEQ ID NO: 144255

SEQ ID NO: 283773 - RNA, 64 nt, hsa
guaacaaucccaaaucaaaucugucuccaggcuggagaggcaggagcccuggggugagaaaagc

SEQ ID NO: 283774 - RNA, 64 nt, hsa
guguggcugccccuccuugcuccagcagcagugggagaggcacugcucuggggccugaacugcc

SEQ ID NO: 283775 - RNA, 64 nt, hsa
ucucaucccagauuacuaacccuuccugauccuggagaggcagggauaguaaauaaauugcucu

SEQ ID NO: 283776 - RNA, 64 nt, hsa
ugucuccugggacagaggccaucucucuuccagagagaggcagcauuggcccacaggauaagcc

SEQ ID NO: 283777 - RNA, 64 nt, hsa
uccuguucugcuccccugagaacagugugguggggagaggcagggcugagguggucuacgaaug

SEQ ID NO: 283778 - RNA, 64 nt, hsa
guagggaaggggagaugucugucucuugagaagagagaggcaugugugccggcauccuugaugg

SEQ ID NO: 283779 - RNA, 64 nt, hsa
gguagcugagcggcugcccuugggugacaccuccgagaggcagccagacccagagcccucugag

SEQ ID NO: 283780 - RNA, 64 nt, hsa
ggagagugcacugaccuguaggucaggaccaucagagaggcaagguugcccuuuccuuuuaaaa

SEQ ID NO: 283781 - RNA, 64 nt, hsa
ccccgguugaaaguccgcuuguaaaagcacaagugagaggcagcaucaggccccuggagggcug

SEQ ID NO: 283782 - RNA, 64 nt, hsa
aagagcgaaaugagugugucauuuccacaugaaggagaggcaaggaaaagccccacaaaauucc

SEQ ID NO: 283783 - RNA, 64 nt, hsa
ugcaaccugacucucugcaucuguauccugcugggagaggcaauuacccuuaaagaaucugggu

SEQ ID NO: 283784 - RNA, 64 nt, hsa
gcagccauccagguauaauggugagagagcaagagagaggcaugaacacacagucaccuccacu

SEQ ID NO: 283785 - RNA, 64 nt, hsa
ucaugcuagccaagaggacauuauugucauuaaagagaggcauuauuuauacacccugcaaugu

SEQ ID NO: 283786 - RNA, 64 nt, hsa
gacaaugagacauuuaguuaguuguccuacggaggagaggcaguagagucaggcugcaguggaa

SEQ ID NO: 283787 - RNA, 64 nt, hsa
ucuccugcaaugauugaugaucacuccguggauagagaggcacacugucagaggugaccggaga

SEQ ID NO: 283788 - RNA, 64 nt, hsa
aacacugcuucuccaggcccgggguuguuggggagagaggcagaggcagcuggagcgccguucu

SEQ ID NO: 283789 - RNA, 64 nt, hsa
aagaugcucggauucacucugugaccgcauaugugagaggcagagagggcgaguggcugcgaga

SEQ ID NO: 283790 - RNA, 64 nt, hsa
ggcccuuccuuccccacuucuaagccaaagaaaggagaggcaggugcuccuguaccccagcccc

SEQ ID NO: 283791 - RNA, 64 nt, hsa
uaugagagagagagagagagacaacagagacagagagaggcagagaggcauagagagacagaga

SEQ ID NO: 283792 - RNA, 64 nt, hsa
agagagagagagacaacagagacagagagaggcagagaggcauagagagacagagagagagaca

SEQ ID NO: 283793 - RNA, 64 nt, hsa
guaauuacuuuuauuaauuuaaaauagaacgcuugagaggcacuuuguaaagauuuguuaaacu

SEQ ID NO: 283794 - RNA, 64 nt, hsa
uaaaauagaaugcuuaaaauaaaauagaaugcuugagaggcacugaguaaagauuuguugaacu

SEQ ID NO: 283795 - RNA, 64 nt, hsa
caagaagagugguuugugcucaggcuggggaacagagaggcacgcuaugcugccagaauuccca

SEQ ID NO: 283796 - RNA, 64 nt, hsa
ucuucccuuacccccuuacaaaucucuggcaacagagaggcaaaguaucugaacaagaaucuau

SEQ ID NO: 283797 - RNA, 64 nt, hsa
gagagaggcagagagggagagaggcagagagggagagaggcagagagacagagagggagagagg

SEQ ID NO: 283798 - RNA, 64 nt, hsa
gagacaggcagagaaggagagaggcagagagggagagaggcagagagggagagaggcagagaga

SEQ ID NO: 283799 - RNA, 64 nt, hsa
gaggcagagaaggaaagagacaggcagagaaggagagaggcagagagggagagaggcagagagg

SEQ ID NO: 283800 - RNA, 64 nt, hsa
gagagagacagagggagagagagacagaggggaagagaggcagagagggaaagaggcagagaag

SEQ ID NO: 283801 - RNA, 64 nt, hsa
gcccagggcaaggaugcccaaagacaccagguuggagaggcaccugccaacuacuugcuuuccc

SEQ ID NO: 283802 - RNA, 64 nt, hsa
cauaccuagcagggaacugcagguggauucuguugagaggcaaagcaccugagugguugggaca

SEQ ID NO: 283803 - RNA, 64 nt, hsa
gugccccagcuugagcuggacguggggcuaagccgagaggcacaggcgggcgaggcggccacag

SEQ ID NO: 283804 - RNA, 64 nt, hsa
cuggccuugccgggugcagagguggaggcccggggagaggcaccugagguggcccugaagaugc

SEQ ID NO: 283805 - RNA, 64 nt, hsa
ucuuggucacugcugagacccacaggucuaagaggagaggcagagccagugugccaccaggcug

SEQ ID NO: 283806 - RNA, 64 nt, hsa
gccugcacccuuccacagcuggccugguuuccucgagaggcaccucccacacuccuauggucac

SEQ ID NO: 283807 - RNA, 64 nt, hsa
aagcccagggacaccuggagcccccaggagcugggagaggcaggaaggauccuccccuagagcc

SEQ ID NO: 283808 - RNA, 64 nt, hsa
aagcccagggaugccuggaguccccaggagcugggagaggcaggaaggacccuccccuagaguc

SEQ ID NO: 283809 - RNA, 64 nt, hsa; identical to SEQ ID NO: 223465

SEQ ID NO: 283810 - RNA, 64 nt, hsa; identical to SEQ ID NO: 223466

SEQ ID NO: 283811 - RNA, 64 nt, hsa; identical to SEQ ID NO: 223467

SEQ ID NO: 283812 - RNA, 64 nt, hsa; identical to SEQ ID NO: 223468

SEQ ID NO: 283813 - RNA, 64 nt, hsa; identical to SEQ ID NO: 223469

SEQ ID NO: 283814 - RNA, 64 nt, hsa; identical to SEQ ID NO: 223470

SEQ ID NO: 283815 - RNA, 64 nt, hsa; identical to SEQ ID NO: 223471

SEQ ID NO: 283816 - RNA, 64 nt, hsa; identical to SEQ ID NO: 223472

SEQ ID NO: 283817 - RNA, 64 nt, hsa; identical to SEQ ID NO: 223473

SEQ ID NO: 283818 - RNA, 64 nt, hsa; identical to SEQ ID NO: 223474

SEQ ID NO: 283819 - RNA, 64 nt, hsa; identical to SEQ ID NO: 223475

SEQ ID NO: 283820 - RNA, 64 nt, hsa; identical to SEQ ID NO: 223476

SEQ ID NO: 283821 - RNA, 64 nt, hsa; identical to SEQ ID NO: 223477

SEQ ID NO: 283822 - RNA, 64 nt, hsa; identical to SEQ ID NO: 223478

SEQ ID NO: 283823 - RNA, 64 nt, hsa; identical to SEQ ID NO: 223479

SEQ ID NO: 283824 - RNA, 64 nt, hsa; identical to SEQ ID NO: 223480

SEQ ID NO: 283825 - RNA, 64 nt, hsa; identical to SEQ ID NO: 223481

SEQ ID NO: 283826 - RNA, 64 nt, hsa; identical to SEQ ID NO: 223482

SEQ ID NO: 283827 - RNA, 64 nt, hsa; identical to SEQ ID NO: 223483

SEQ ID NO: 283828 - RNA, 64 nt, hsa; identical to SEQ ID NO: 223484

SEQ ID NO: 283829 - RNA, 64 nt, hsa; identical to SEQ ID NO: 223485

SEQ ID NO: 283830 - RNA, 64 nt, hsa; identical to SEQ ID NO: 223486

SEQ ID NO: 283831 - RNA, 64 nt, hsa; identical to SEQ ID NO: 223487

SEQ ID NO: 283832 - RNA, 64 nt, hsa; identical to SEQ ID NO: 223488

SEQ ID NO: 283833 - RNA, 64 nt, hsa; identical to SEQ ID NO: 223489

SEQ ID NO: 283834 - RNA, 64 nt, hsa; identical to SEQ ID NO: 223490

SEQ ID NO: 283835 - RNA, 64 nt, hsa; identical to SEQ ID NO: 223491

SEQ ID NO: 283836 - RNA, 64 nt, hsa; identical to SEQ ID NO: 223492

SEQ ID NO: 283837 - RNA, 64 nt, hsa; identical to SEQ ID NO: 223493

SEQ ID NO: 283838 - RNA, 64 nt, hsa; identical to SEQ ID NO: 223494

SEQ ID NO: 283839 - RNA, 64 nt, hsa; identical to SEQ ID NO: 223495

SEQ ID NO: 283840 - RNA, 64 nt, hsa; identical to SEQ ID NO: 223496

SEQ ID NO: 283841 - RNA, 64 nt, hsa; identical to SEQ ID NO: 223497

SEQ ID NO: 283842 - RNA, 64 nt, hsa; identical to SEQ ID NO: 223498

SEQ ID NO: 283843 - RNA, 64 nt, hsa; identical to SEQ ID NO: 223499

SEQ ID NO: 283844 - RNA, 64 nt, hsa; identical to SEQ ID NO: 223500

SEQ ID NO: 283845 - RNA, 64 nt, hsa; identical to SEQ ID NO: 223501

SEQ ID NO: 283846 - RNA, 64 nt, hsa; identical to SEQ ID NO: 223502

SEQ ID NO: 283847 - RNA, 64 nt, hsa; identical to SEQ ID NO: 223503

SEQ ID NO: 283848 - RNA, 64 nt, hsa; identical to SEQ ID NO: 223504

SEQ ID NO: 283849 - RNA, 64 nt, hsa; identical to SEQ ID NO: 223505

SEQ ID NO: 283850 - RNA, 64 nt, hsa; identical to SEQ ID NO: 223506

SEQ ID NO: 283851 - RNA, 64 nt, hsa; identical to SEQ ID NO: 223507

SEQ ID NO: 283852 - RNA, 64 nt, hsa; identical to SEQ ID NO: 223508

SEQ ID NO: 283853 - RNA, 64 nt, hsa; identical to SEQ ID NO: 223509

SEQ ID NO: 283854 - RNA, 64 nt, hsa; identical to SEQ ID NO: 223510

SEQ ID NO: 283855 - RNA, 64 nt, hsa; identical to SEQ ID NO: 223511

SEQ ID NO: 283856 - RNA, 64 nt, hsa; identical to SEQ ID NO: 223512

SEQ ID NO: 283857 - RNA, 64 nt, hsa; identical to SEQ ID NO: 223513

SEQ ID NO: 283858 - RNA, 64 nt, hsa; identical to SEQ ID NO: 223514

SEQ ID NO: 283859 - RNA, 64 nt, hsa; identical to SEQ ID NO: 223515

SEQ ID NO: 283860 - RNA, 64 nt, hsa; identical to SEQ ID NO: 223516

SEQ ID NO: 283861 - RNA, 64 nt, hsa; identical to SEQ ID NO: 223517

SEQ ID NO: 283862 - RNA, 64 nt, hsa; identical to SEQ ID NO: 223518

SEQ ID NO: 283863 - RNA, 64 nt, hsa; identical to SEQ ID NO: 223519

SEQ ID NO: 283864 - RNA, 64 nt, hsa; identical to SEQ ID NO: 223520

SEQ ID NO: 283865 - RNA, 64 nt, hsa; identical to SEQ ID NO: 223521

SEQ ID NO: 283866 - RNA, 64 nt, hsa; identical to SEQ ID NO: 223522

SEQ ID NO: 283867 - RNA, 64 nt, hsa; identical to SEQ ID NO: 223523

SEQ ID NO: 283868 - RNA, 64 nt, hsa; identical to SEQ ID NO: 223524

SEQ ID NO: 283869 - RNA, 64 nt, hsa; identical to SEQ ID NO: 223525

SEQ ID NO: 283870 - RNA, 64 nt, hsa; identical to SEQ ID NO: 223526

SEQ ID NO: 283871 - RNA, 64 nt, hsa; identical to SEQ ID NO: 223527

SEQ ID NO: 283872 - RNA, 64 nt, hsa; identical to SEQ ID NO: 223528

SEQ ID NO: 283873 - RNA, 64 nt, hsa; identical to SEQ ID NO: 223529

SEQ ID NO: 283874 - RNA, 64 nt, hsa; identical to SEQ ID NO: 223530

SEQ ID NO: 283875 - RNA, 64 nt, hsa; identical to SEQ ID NO: 223531

SEQ ID NO: 283876 - RNA, 64 nt, hsa; identical to SEQ ID NO: 223532

SEQ ID NO: 283877 - RNA, 64 nt, hsa; identical to SEQ ID NO: 223533

SEQ ID NO: 283878 - RNA, 64 nt, hsa; identical to SEQ ID NO: 223534

SEQ ID NO: 283879 - RNA, 64 nt, hsa; identical to SEQ ID NO: 223535

SEQ ID NO: 283880 - RNA, 64 nt, hsa; identical to SEQ ID NO: 223536

SEQ ID NO: 283881 - RNA, 64 nt, hsa; identical to SEQ ID NO: 223537

SEQ ID NO: 283882 - RNA, 64 nt, hsa; identical to SEQ ID NO: 223538

SEQ ID NO: 283883 - RNA, 64 nt, hsa; identical to SEQ ID NO: 223539

SEQ ID NO: 283884 - RNA, 64 nt, hsa; identical to SEQ ID NO: 223540

SEQ ID NO: 283885 - RNA, 64 nt, hsa; identical to SEQ ID NO: 223541

SEQ ID NO: 283886 - RNA, 64 nt, hsa; identical to SEQ ID NO: 223542

SEQ ID NO: 283887 - RNA, 64 nt, hsa; identical to SEQ ID NO: 223543

SEQ ID NO: 283888 - RNA, 64 nt, hsa; identical to SEQ ID NO: 223544

SEQ ID NO: 283889 - RNA, 64 nt, hsa; identical to SEQ ID NO: 223545

SEQ ID NO: 283890 - RNA, 64 nt, hsa; identical to SEQ ID NO: 223546

SEQ ID NO: 283891 - RNA, 64 nt, hsa; identical to SEQ ID NO: 223547

SEQ ID NO: 283892 - RNA, 64 nt, hsa; identical to SEQ ID NO: 223548

SEQ ID NO: 283893 - RNA, 64 nt, hsa; identical to SEQ ID NO: 223549

SEQ ID NO: 283894 - RNA, 64 nt, hsa; identical to SEQ ID NO: 223550

SEQ ID NO: 283895 - RNA, 64 nt, hsa; identical to SEQ ID NO: 223551

SEQ ID NO: 283896 - RNA, 64 nt, hsa; identical to SEQ ID NO: 223552

SEQ ID NO: 283897 - RNA, 64 nt, hsa; identical to SEQ ID NO: 223553

SEQ ID NO: 283898 - RNA, 64 nt, hsa; identical to SEQ ID NO: 223554

SEQ ID NO: 283899 - RNA, 64 nt, hsa; identical to SEQ ID NO: 223555

SEQ ID NO: 283900 - RNA, 64 nt, hsa; identical to SEQ ID NO: 223556

SEQ ID NO: 283901 - RNA, 64 nt, hsa; identical to SEQ ID NO: 223557

SEQ ID NO: 283902 - RNA, 64 nt, hsa; identical to SEQ ID NO: 223558

SEQ ID NO: 283903 - RNA, 64 nt, hsa; identical to SEQ ID NO: 223559

SEQ ID NO: 283904 - RNA, 64 nt, hsa; identical to SEQ ID NO: 223560

SEQ ID NO: 283905 - RNA, 64 nt, hsa; identical to SEQ ID NO: 223561

SEQ ID NO: 283906 - RNA, 64 nt, hsa; identical to SEQ ID NO: 223562

SEQ ID NO: 283907 - RNA, 64 nt, hsa; identical to SEQ ID NO: 223563

SEQ ID NO: 283908 - RNA, 64 nt, hsa; identical to SEQ ID NO: 223564

SEQ ID NO: 283909 - RNA, 64 nt, hsa; identical to SEQ ID NO: 223565

SEQ ID NO: 283910 - RNA, 64 nt, hsa; identical to SEQ ID NO: 223566

SEQ ID NO: 283911 - RNA, 64 nt, hsa; identical to SEQ ID NO: 223567

SEQ ID NO: 283912 - RNA, 64 nt, hsa; identical to SEQ ID NO: 223568

SEQ ID NO: 283913 - RNA, 64 nt, hsa; identical to SEQ ID NO: 223569

SEQ ID NO: 283914 - RNA, 64 nt, hsa; identical to SEQ ID NO: 223570

SEQ ID NO: 283915 - RNA, 64 nt, hsa; identical to SEQ ID NO: 223571

SEQ ID NO: 283916 - RNA, 64 nt, hsa
gcggccauaagaggugaucucugggaguuauaggucaugggaagagcguagacagguguuacuu

SEQ ID NO: 283917 - RNA, 64 nt, hsa
uucuagaaucucguuucuccucuuuccuccugcuucaugggaaaacagaccugugugugccucc

SEQ ID NO: 283918 - RNA, 64 nt, hsa
caggaugguaaauuggauugguggauccaccauaucaugggauuuaaauuuaucauaaccaugu

SEQ ID NO: 283919 - RNA, 64 nt, hsa
uuuugauaaaacuuuauucacaaaaacagccgggucaugggauuuggcuugugagucuguaaca

SEQ ID NO: 283920 - RNA, 64 nt, hsa
cacuaaaccguuccgccgcccacccucugcuagacacagccaaggccaacgaggcaagcagaag

SEQ ID NO: 283921 - RNA, 64 nt, hsa
aguaugucugccgguuucaacacacacagacaaacacagccacacgcgcacacaaguauaagac

SEQ ID NO: 283922 - RNA, 64 nt, hsa
cucugcgccgcagcuggacgccaccuccgacggacacagccagccccuuccugcugccaaggug

SEQ ID NO: 283923 - RNA, 64 nt, hsa
uuuaaaaauauaagcucacaugccuuuucccugccacagccaaacccccacugcacccuaccca

SEQ ID NO: 283924 - RNA, 64 nt, hsa
ugucaucuaggacacguccaaaggagugcauggccacagccaccuccacccccaagaaaccucc

SEQ ID NO: 283925 - RNA, 64 nt, hsa
uacacacacacacacacacacacacacacacacacacagccauucaucugggcuggcagagggg

SEQ ID NO: 283926 - RNA, 64 nt, hsa
cccuccaggaacauucccacauaauacauuccaucacagccagcccagcuccacucagggcugg

SEQ ID NO: 283927 - RNA, 64 nt, hsa
ggcucuucccuugggggccuccuuucaucuggggcacagccacaagucucaucucuaacguucu

SEQ ID NO: 283928 - RNA, 64 nt, hsa
agggcaccacgcaagggcagagcugggcggcauccacagccagagaggcagaggcaagagcaga

SEQ ID NO: 283929 - RNA, 64 nt, hsa
uggagagaagcuuccagaccagcccuucacacaccacagccaggaggggccuuucccaccugga

SEQ ID NO: 283930 - RNA, 64 nt, hsa
ccuggagagaaacuuccagaccagccccucauaccacagccaagaggggccuuucucaccugga

SEQ ID NO: 283931 - RNA, 64 nt, hsa
ccuggagagaaauuuccagaccauccccucucaccacagccaggagaggccuuucccaccggua

SEQ ID NO: 283932 - RNA, 64 nt, hsa
ccgguagagaaacuuccagaccagccccucacaccacagccaagagaagccuuuccagccugga

SEQ ID NO: 283933 - RNA, 64 nt, hsa
cgccuggaaacuuccggacaagccucucacacaccacagccaggagaggccuuucccaccugga

SEQ ID NO: 283934 - RNA, 64 nt, hsa
ccuggacagaaacuuccagaccagccccucucaccacagccaggagaggccuuuaccaccugga

SEQ ID NO: 283935 - RNA, 64 nt, hsa
ccuggagagaagcuuccagaccagccccucacaccacagccaggagaggccuuucccaccugga

SEQ ID NO: 283936 - RNA, 64 nt, hsa; identical to SEQ ID NO: 283930

SEQ ID NO: 283937 - RNA, 64 nt, hsa
ccgggagagaaacuuccagaccagccccucacaccacagccaggagaggccuuucccaccggga

SEQ ID NO: 283938 - RNA, 64 nt, hsa
ccgggagaggaacuuccagaccagccccucacaccacagccaggagaggccuuucccgccugga

SEQ ID NO: 283939 - RNA, 64 nt, hsa
gccuggagagaagcuucaggccagcuccucacaccacagccaggagagaccuuuucugccugga

SEQ ID NO: 283940 - RNA, 64 nt, hsa
ccuggagagaaacuuucagaccagccccacacaccacagccaggagaggccguuccugccugga

SEQ ID NO: 283941 - RNA, 64 nt, hsa
ccuggagagaagcuuccagaccagcccuucacaccacagccaggagaggccuuucccaccugga

SEQ ID NO: 283942 - RNA, 64 nt, hsa
ccuggagagaaacuuccagaccagccccucucaccacagccaggagaggccguucccaccugga

SEQ ID NO: 283943 - RNA, 64 nt, hsa
cggggccccugcguguguucucuccggauggaaucacagccaauaaacaccagugauuucacac

SEQ ID NO: 283944 - RNA, 64 nt, hsa
ggcggugggcgccugucgggcccgcacucaggagcacagccauagcagacggggggcugcgggc

SEQ ID NO: 283945 - RNA, 60 nt, hsa
accuccagaacaccagguagccguggccaccacagccagacugaacguuugugaaagcug

SEQ ID NO: 283946 - RNA, 64 nt, hsa
aguuagggcauuguccuacacauuggcccaguaucacagccaagacgagaagucauuucccagc

SEQ ID NO: 283947 - RNA, 64 nt, hsa
gcacacugccacugucccuuggcacgcacacagccacagccacacgugugaccugcugggccgu

SEQ ID NO: 283948 - RNA, 64 nt, hsa
acaauggcacacugccacugucccuuggcacgcacacagccacagccacacgugugaccugcug

SEQ ID NO: 283949 - RNA, 64 nt, hsa
gccccagagaagccucagucccucccuccuggcucacagccaccaccuggauggaucugcucca

SEQ ID NO: 283950 - RNA, 64 nt, hsa
cagauugcggugugagauggugcccccuggggggcacagccagaaacugaacuggccgcuggga

SEQ ID NO: 283951 - RNA, 64 nt, hsa
uugacaucacccuacccaggcggugggucuccaccacagccacuuugagucuguggucccugga

SEQ ID NO: 283952 - RNA, 64 nt, hsa
uaucccccaauguugucagcagaugccuggacagcacagccacccaucucccauucacauggcc

SEQ ID NO: 283953 - RNA, 64 nt, hsa
guaagccccgcccaccccacggaggccacagccacacagccacgcccccugauucuggaacucg

SEQ ID NO: 283954 - RNA, 64 nt, hsa
cccggcauguaagccccgcccaccccacggaggccacagccacacagccacgcccccugauucu

SEQ ID NO: 283955 - RNA, 64 nt, hsa
agagauacacuuugguaggcugaggccccuguuccacagccacuauuugcauugcugucccugc

SEQ ID NO: 283956 - RNA, 64 nt, hsa
ccuuccacaucuacagggucacugucauccucaccacagccaggggugauucucaccucugccu

SEQ ID NO: 283957 - RNA, 64 nt, hsa
agccaagggagaaugcugcugguuuggcccauggcacagccagcuucucugaccaguaauccgg

SEQ ID NO: 283958 - RNA, 64 nt, hsa
ugagcucccuuccaaaggaucguuccucucauugcacagccauauuacaaaggguuuccugcuc

SEQ ID NO: 283959 - RNA, 64 nt, hsa
agcccaggcugcccugcacuccugccucccagcccacagccaggugcuuucaucacagcuaaac

SEQ ID NO: 283960 - RNA, 64 nt, hsa
gaaagcagccagcucaucccagugacucacaggacacagccauccagcggcaucuuuccuuguc

SEQ ID NO: 283961 - RNA, 64 nt, hsa
cccagugugcacgccguccggccaugcccacagccacagccacagcugaggaguggccgggcag

SEQ ID NO: 283962 - RNA, 64 nt, hsa
ggacggcccagugugcacgccguccggccaugcccacagccacagccacagcugaggaguggcc

SEQ ID NO: 283963 - RNA, 64 nt, hsa
ccuccaggcuuuccugcccugggcagccccaccucacagccagagucaaugccuucaugggaag

SEQ ID NO: 283964 - RNA, 64 nt, hsa
cacacgcuuguucacacucagaacccaggacagccacagccaccgcuuaggggaagccacugca

SEQ ID NO: 283965 - RNA, 64 nt, hsa
gaagccacugcagaugccccuggaaugggcacagcacagccagggcgcucuuccaggcaggcga

SEQ ID NO: 283966 - RNA, 64 nt, hsa
gagagagagagggagucaaggugugaccgucgaccacagccagugucaggccucugccucuggg

SEQ ID NO: 283967 - RNA, 64 nt, hsa
agaaggaaagaagccuggagcagccucuccuguccacagccagggguuaggucugcaggcccgu

SEQ ID NO: 283968 - RNA, 64 nt, hsa
aguccuaugccuugaaauaucaugcaccaugacccacagccaucugguuaugucuuauuuuuuu

SEQ ID NO: 283969 - RNA, 64 nt, hsa
uggugguuucugugagaauuggccauccugaggacacagccaggacggcagaggccuccuggcc

SEQ ID NO: 283970 - RNA, 64 nt, hsa
ccuccccucaccccaacucuagguuuccaggccucacagccaagcugaagcuuggagaaaacuc

SEQ ID NO: 283971 - RNA, 64 nt, hsa
ugcuuuuauucuuccagcuaccacuugggcacuucacagccagccuagggucuucggcaccucc

SEQ ID NO: 283972 - RNA, 64 nt, hsa
gcagccacgaggugcaacaagguccucugucagucacagccaccccugagauccggcaacauca

SEQ ID NO: 283973 - RNA, 64 nt, hsa
aaguggacucagggcagcgccaggcugaccacagcacagccaacacgcaccugccucaggacug

SEQ ID NO: 283974 - RNA, 64 nt, hsa
agacuggcuggaaaugcucugacuccugugaaggcacagccagcguuguggccugagggaggcc

SEQ ID NO: 283975 - RNA, 64 nt, hsa
caguagcuguguguccgaggucagugugcggaaucacagccaaggacgugaagagauguacggg

SEQ ID NO: 283976 - RNA, 64 nt, hsa
ccugugccuugagacagcagccuaucuggggccacacagccaacccagcccuggucccugaggu

SEQ ID NO: 283977 - RNA, 64 nt, hsa
uugggccuagagccacuucuuaccaggcaacgggcacagccacccuggcacacccucugccugg

SEQ ID NO: 283978 - RNA, 64 nt, hsa
gagaacagagcucagagcacccaguguagggaaacacagccagaccacuguggugacagacuuu

SEQ ID NO: 283979 - RNA, 64 nt, hsa
guaauuuuuuuguucuauuuuuuuccacguacuccacagccaacaucacgagguguaauuuuua

SEQ ID NO: 283980 - RNA, 64 nt, hsa
gcuucaaauggccaauugugcagagggacaaagccacagccacacucuucaacgguuaccaaac

SEQ ID NO: 283981 - RNA, 64 nt, hsa
ccaccgcggggccucagugggggucucuggggaacacagccagacauccugauggggaggcaga

SEQ ID NO: 283982 - RNA, 64 nt, hsa
ucccuuggccucagagcugccccugcucucccaccacagccacccagaggcaccccaugaagcu

SEQ ID NO: 283983 - RNA, 64 nt, hsa
cccuaagccccacagccagcucugcaucaccacacacagccagagccugugaggagcugccuuc

SEQ ID NO: 283984 - RNA, 64 nt, hsa
agagcaaggagagggcuccccacucccuaagccccacagccagcucugcaucaccacacacagc

SEQ ID NO: 283985 - RNA, 64 nt, hsa
aaaagccaucuauucuucugcagccucaggagcgagacuucaaggacucaguuugguuccaccc

SEQ ID NO: 283986 - RNA, 64 nt, hsa
cgcaccacugcacuccagccuaggagacaaaacgagacuucauuuaaaaaaaauaaaaauaaaa

SEQ ID NO: 283987 - RNA, 64 nt, hsa
uauauauuguaacuuaaagaaaauacuuauaaaaagacuucauuuuuagugauugacaagcaaa

SEQ ID NO: 283988 - RNA, 64 nt, hsa
gggcuucugcuugccucgcugauguugcaugggcagacuucaaaaaggauaguuagaaagguuu

SEQ ID NO: 283989 - RNA, 64 nt, hsa
ggccauaagaacaguggaagaggagcauggacucagacuucaaggaagaagccauuuccccagg

SEQ ID NO: 283990 - RNA, 64 nt, hsa
ucauuuccauuuuguuugugauauuuagacgcgcagacuucaggaaguucaccuuuaacuucag

SEQ ID NO: 283991 - RNA, 64 nt, hsa
gcccaguaguacugcggccaaggggacaguuaggagacuucaucuaaagcaugaaaccuagcuc

SEQ ID NO: 283992 - RNA, 64 nt, hsa
uuaacuugaaaauuugaaaauauuuaauguugaaagacuucaauuagggcuauuagaguuauau

SEQ ID NO: 283993 - RNA, 64 nt, hsa
uagagaaguguauaagucugaggacagauuagaaagacuucaggaaauucuaaggaaauuucug

SEQ ID NO: 283994 - RNA, 64 nt, hsa
gagaaaagcccuauacguguagugaauguggaaaagacuucagauugaauucacaucuuauuca

SEQ ID NO: 283995 - RNA, 64 nt, hsa
uucuggacucucaugcccccaucuccgaccugggagacuucaggaaugacaaccuacccagccu

SEQ ID NO: 283996 - RNA, 64 nt, hsa
cuggcaggaugguggagguuucucaaggagcuggagacuucagggagccccucucauggggagg

SEQ ID NO: 283997 - RNA, 64 nt, hsa
aaaaaaaaauucuccacuuuuuuuuuucuugaguagacuucagugaccacacuguggaaaauac

SEQ ID NO: 283998 - RNA, 64 nt, hsa
gcaauaguuccgggagaauuggccauugguaaaaagacuucauagggucacuggaaugcuuugu

SEQ ID NO: 283999 - RNA, 64 nt, hsa
uuuuaaucaacaaucacaccuugcaagucaucauagacuucauacugcauagaaaucuuacaaa

SEQ ID NO: 284000 - RNA, 64 nt, hsa
uuuuaaucaaaaagcaaccuuugcacaucaccauagacuucauacuggagagaaaccuuacaaa

SEQ ID NO: 284001 - RNA, 64 nt, hsa
cuccugccguccugcgccugcuggggccuccaggcaaggccaagugggguuggggguggggcug

SEQ ID NO: 284002 - RNA, 64 nt, hsa
cuaucuaaguggaacuaauugcccgagggcucagcaaggccaagaggagacagccgugacggua

SEQ ID NO: 284003 - RNA, 64 nt, hsa
aagucggaacaauuccuagcaccugucggaaggucaaggccaaaggcaaauucaaggccagacu

SEQ ID NO: 284004 - RNA, 64 nt, hsa
gcaccugucggaaggucaaggccaaaggcaaauucaaggccagacugugacaaacccagggcug

SEQ ID NO: 284005 - RNA, 64 nt, hsa
accaagaccuacugaucuggagucccacguuccccaaggccagcgggaugugugccccuccucc

SEQ ID NO: 284006 - RNA, 64 nt, hsa
ccuuggggcagguuuuuaaaaauuagcuaggcaucaaggccagaccagggcuggggguugggcu

SEQ ID NO: 284007 - RNA, 64 nt, hsa
agcuauuguucuuccacuucguuuucugcugucccaaggccagaugaguggaaucaccaucuga

SEQ ID NO: 284008 - RNA, 64 nt, hsa
ucaauugagcaguugugaaaauugcuaauggugccaaggccaagcaaagaguuucagaaaauga

SEQ ID NO: 284009 - RNA, 64 nt, hsa
acgaggcacuguauauggggacacugccagucaccaaggccaugggugaggacugagggggcug

SEQ ID NO: 284010 - RNA, 64 nt, hsa
ucaagugccauguguuuugcugugaugucccugccaaggccauugccagugcccuacaugggcu

SEQ ID NO: 284011 - RNA, 64 nt, hsa
aagcacuucggcucuggaguuacagaucuggguucaaggccaaauuccaccacuuacuagguuu

SEQ ID NO: 284012 - RNA, 64 nt, hsa
ccaccccacgugggacuuccauggcuucugaguacaaggccagccccccggcccaccagcuuuc

SEQ ID NO: 284013 - RNA, 64 nt, hsa
gccgacgcaggaggauugcuugaggccaggaguucaaggccagccuggacaacauaguaagacc

SEQ ID NO: 284014 - RNA, 64 nt, hsa
gaagcagaggaucagagaugggaaaggacuagcccaaggccaacauuaacaagcccucuaacaa

SEQ ID NO: 284015 - RNA, 64 nt, hsa
ugcccuugacuccaccuauguuggagccuuagcccaaggccauuccuucugugaugauaaagcc

SEQ ID NO: 284016 - RNA, 64 nt, hsa
guuuuuuucucuucauaggucccaacuccaucuccaaggccaaggguuuucaccccucagucau

SEQ ID NO: 284017 - RNA, 64 nt, hsa
cagaccaagcucaacgccuccaagaccagcaggccaaggccaagcccugccccagauccucaua

SEQ ID NO: 284018 - RNA, 64 nt, hsa
cagccacgcuccaucgccgcccaaagggaggugccaaggccaggaacccaagccaccccggcuc

SEQ ID NO: 284019 - RNA, 64 nt, hsa
caauagcuuccuuugcuccaauaagcuuugcaaucaaggccaaagaaaaugaucugcuuccccu

SEQ ID NO: 284020 - RNA, 64 nt, hsa
agaagaagaggcggucccggucgcggaccaaguccaaggccaggucucagucggugucacccag

SEQ ID NO: 284021 - RNA, 64 nt, hsa
uccaugcccaaacuggcagaugcuucucugggagcaaggccacaugggcugaugcagcuuugag

SEQ ID NO: 284022 - RNA, 64 nt, hsa
gaugaagaaaacccugugguagaaccaaaccacccaaggccagcccuuaagccugccuccaccu

SEQ ID NO: 284023 - RNA, 64 nt, hsa
uaauguaccaacuagauacagacagggccaguggcaaggccaucagaaaacuucuucccaaggc

SEQ ID NO: 284024 - RNA, 64 nt, hsa
gggccaguggcaaggccaucagaaaacuucuucccaaggccacaccacaccugcaaaaugccua

SEQ ID NO: 284025 - RNA, 64 nt, hsa
cucuugucuucagggaauucagaggauugcucuccaaggccauaaugaccccuugccuucccca

SEQ ID NO: 284026 - RNA, 64 nt, hsa
gggcccacgaccaagacccuggguguucagaccccaaggccagggccuuucccgcugcaucaag

SEQ ID NO: 284027 - RNA, 64 nt, hsa
caggcccauccucaacagcuaccccagccaacaccaaggccacaaggggaccccggccuaggag

SEQ ID NO: 284028 - RNA, 64 nt, hsa
gcuguagccacagaccccuugcucgggccucacccaaggccaaacuccaaacacaaucagaacc

SEQ ID NO: 284029 - RNA, 64 nt, hsa
uggaaauuggaagagcacaagaggagauccagggcaaggccauugggauauucugaaacuugaa

SEQ ID NO: 284030 - RNA, 54 nt, hsa
gcucccuugauggaacuuagacagcaaggccagaugcacaucccuggaaggaca

SEQ ID NO: 284031 - RNA, 64 nt, hsa
auuuucucgcugaaaccauguuucucagacaggccaaggccaccugacuccuaucacgacgcac

SEQ ID NO: 284032 - RNA, 64 nt, hsa
ggggaguuuucccgcaguucaguuccugacugugcaaggccaacagggcaggggaggggaagac

SEQ ID NO: 284033 - RNA, 64 nt, hsa
gacugcugcccaccuugggacucaggagcucagucaaggccacaggcuggaggagagacggggc

SEQ ID NO: 284034 - RNA, 64 nt, hsa
agguaggcgcccugcagccucccugcucccagcccaaggccagucggccugggaaguucacugc

SEQ ID NO: 284035 - RNA, 64 nt, hsa
gucuguucacggaggugcgguguggaugcaccuacaaggccaacucucugaucagggugaggga

SEQ ID NO: 284036 - RNA, 64 nt, hsa
aauuuguugggggucugaugguuaaaaucaugggcaaggccauucucuacaucauugcuuaaua

SEQ ID NO: 284037 - RNA, 64 nt, hsa
aguugaguggggcagagggacagggcagccagaccaaggccaagccuucucacccuuggccagc

SEQ ID NO: 284038 - RNA, 64 nt, hsa
gccaaagcaacucaacagaugccaaugccaauuccaaggccagccacaacccugccaccuuggg

SEQ ID NO: 284039 - RNA, 64 nt, hsa
uccacauaucauugacuguauccuguaauaugcaacggcacagcuaguuuucccgauuuggaua

SEQ ID NO: 284040 - RNA, 64 nt, hsa
agcauccagggagguuucucgccccaauagccucacggcacaguacucuugggcaguaacugga

SEQ ID NO: 284041 - RNA, 64 nt, hsa
aagaauauauuucuugcucaguuguuucaggcaagcccaagacuuuguaauuuuuaaagggccc

SEQ ID NO: 284042 - RNA, 64 nt, hsa
ucaggcaagcccaagacuuuguaauuuuuaaagggcccaagauuuuuuuuuuuuuuuuuuuuuu

SEQ ID NO: 284043 - RNA, 64 nt, hsa
acugucccuagacaaagguggagucccccacacugcccaagaccaaaucccucacucaaccugc

SEQ ID NO: 284044 - RNA, 64 nt, hsa
cucccaucucaaucauugagccugaaggcuucaagcccaagaaugcaacaagacccccagccua

SEQ ID NO: 284045 - RNA, 64 nt, hsa
uuucagagugauagagcuccuaacagguguacaggcccaagaguugaaggugauugguuuucuu

SEQ ID NO: 284046 - RNA, 64 nt, hsa
gugcugggauuacaggcgugagccacugcuccuggcccaagaucugaugguuuuguaagggaau

SEQ ID NO: 284047 - RNA, 64 nt, hsa
ccagagccugggguguucucuuugguguuacacagcccaagaggacugagacuggcacuuagcc

SEQ ID NO: 284048 - RNA, 64 nt, hsa
uuacacagcccaagaggacugagacuggcacuuagcccaagaggucugagcccugguguguuuc

SEQ ID NO: 284049 - RNA, 64 nt, hsa
ggcaccuggcacccaccuucccugcugccaggaugcccaagaaaaaggucagcuccaccgaagg

SEQ ID NO: 284050 - RNA, 64 nt, hsa
aggucagcuccaccgaaggggcugccauggaagagcccaagaggagaucagcgcaauugucagc

SEQ ID NO: 284051 - RNA, 64 nt, hsa
cagccucuccuccuacaccggccuacccaucugggcccaagagcugcacucacacuccuacaac

SEQ ID NO: 284052 - RNA, 64 nt, hsa
gagcuuuccuacaucuuccgugguucccagcacagcccaagauuauuuggcagccaaguggaug

SEQ ID NO: 284053 - RNA, 64 nt, hsa
cggcugaccucauacaucaagccaauaccguguggcccaagacccccaccauaaaucacaucau

SEQ ID NO: 284054 - RNA, 64 nt, hsa
uaaaucacaucauuagcaugaaccacccagaguggcccaagacucccagaucagcuaccaggca

SEQ ID NO: 284055 - RNA, 64 nt, hsa
gugaggcacuggggaggcaggcacacguccuccagcccaagacugccuaauuuaacagggauuu

SEQ ID NO: 284056 - RNA, 64 nt, hsa
cuuauccaacuagcccuagccuauacccucugcugcccaagaaaaugagcccaaccaguacacc

SEQ ID NO: 284057 - RNA, 64 nt, hsa
cuaauuaauuuauguagaguccuuuuuuccaaagagcucaaaacacuacauccacauuauugac

SEQ ID NO: 284058 - RNA, 64 nt, hsa
uugcuuggacaaaauauuccaggaacucauagcgagcucaaagcaauuaagugggaacauuuuu

SEQ ID NO: 284059 - RNA, 64 nt, hsa
cacuccaccugagaaaaaagaaaaaaaaauugauagcucaaaugcauguaauucauaaacacug

SEQ ID NO: 284060 - RNA, 64 nt, hsa
ccucaccuaguguccccuuggugacguaugcagcagcucaaauuaaaccuuugugcauuggguu

SEQ ID NO: 284061 - RNA, 64 nt, hsa
auugaucauaaaaccuuuaggaaauguauuugaaagcucaaaauagaaauuagguuaaaaugcc

SEQ ID NO: 284062 - RNA, 64 nt, hsa
guuuuuaccaagaaagguggcaagguaaacuaacagcucaaauucccaauauaaguggaccagu

SEQ ID NO: 284063 - RNA, 64 nt, hsa
agcuguagacguacgcucaggcgcuccugcuguccugggggagagaagguucgccccuccccga

SEQ ID NO: 284064 - RNA, 64 nt, hsa
gaggcgacuagggcaccauacucacuuuccagggcugggggaagggggacgcaggaucaucccc

SEQ ID NO: 284065 - RNA, 64 nt, hsa
caaccugacaguccaggagauggacuggcuggugcugggggagcugcagauggcccuggagugg

SEQ ID NO: 284066 - RNA, 64 nt, hsa
ccucucaacaguggggucgggggcccacccccagcugggggaccccaugcaggcugaugggccc

SEQ ID NO: 284067 - RNA, 64 nt, hsa
gaacgggucacccugcugaagaucacucugugcccugggggaggagccaagcccucaccccaca

SEQ ID NO: 284068 - RNA, 64 nt, hsa
cccugaaugcauuggccggugcccggcucauggucugggggaugcaggcaggggaagggcagag

SEQ ID NO: 284069 - RNA, 64 nt, hsa
gucacugcuacaccuuagcagcucuuccccuuuccugggggaugugcacggcagcuugagccug

SEQ ID NO: 284070 - RNA, 64 nt, hsa
cugucacguggucaaggcccggccccaucagaggcugggggaggcggcacauuggcaguguguc

SEQ ID NO: 284071 - RNA, 64 nt, hsa
auccccauccucugccucaucguuccccugagcacugggggacagacccucacccccacccugg

SEQ ID NO: 284072 - RNA, 64 nt, hsa
gguguuggggggcccccuuccaugacucuguccccugggggagguaggacagggcugggcuucc

SEQ ID NO: 284073 - RNA, 57 nt, hsa
ugcagacgcccguccagugaacucgagcugggggaggggcagagcgcggggcucccc

SEQ ID NO: 284074 - RNA, 64 nt, hsa
gccacaaaguaaacuucauuuucaggcaguguuucugggggagguuauggagggaagaaaaaag

SEQ ID NO: 284075 - RNA, 64 nt, hsa
gcacagcagugaucaagugucaucccuuacgugacugggggaugucuguccuaaaagcugacug

SEQ ID NO: 284076 - RNA, 64 nt, hsa
ugaccguaaguaaaaacacacagaauuguguugacugggggaggugaaucacaaaaaaguuacg

SEQ ID NO: 284077 - RNA, 64 nt, hsa
auccuguuguauacuaggagagaacuuaacccaccugggggaaaauagcuccccaagagcuggc

SEQ ID NO: 284078 - RNA, 64 nt, hsa
gauguggggagaguggaagaggcagggaguaauccugggggacagcagggaggaggcacuucuu

SEQ ID NO: 284079 - RNA, 64 nt, hsa
ccugggugaugagcagcuuuuccccccuggcuuucugggggaggagugggccuccuuagggaga

SEQ ID NO: 284080 - RNA, 64 nt, hsa
agaggccugguggcccugcugggcagcccaacugcugggggagacguuucugccacccugggug

SEQ ID NO: 284081 - RNA, 64 nt, hsa
gucugcagugaauguucaacaguuugcccaggaacugggggaucauauaugucuuaguggacag

SEQ ID NO: 284082 - RNA, 64 nt, hsa
aagcgcagugcaugcugggugcaugaagggcagccugggggacagacuguugugggaacguccc

SEQ ID NO: 284083 - RNA, 64 nt, hsa
cagcggccuccuguagcaccaucuugggaaaguccugggggacgugugugucgugcuuuuuacc

SEQ ID NO: 284084 - RNA, 64 nt, hsa
ucccacccuggucccaguuucccgcaaagugccucugggggaccccccagccucccacccuggu

SEQ ID NO: 284085 - RNA, 64 nt, hsa
cagguggauggaagguucugggugcccgcaggggcugggggaugcuaggacugagacccugggu

SEQ ID NO: 284086 - RNA, 64 nt, hsa
uuuuuaaaaguuaaggggcaagcagcauugcauucugggggaacgauccuggccacagccgcca

SEQ ID NO: 284087 - RNA, 64 nt, hsa
agcucccgccuugcgggcagugcuaaagguggagcugggggauuuuccugggaaugauuugagg

SEQ ID NO: 284088 - RNA, 64 nt, hsa
gugaccugucuggcucaggaaugggcucuggcugcugggggagccgugucacuccugggccaug

SEQ ID NO: 284089 - RNA, 64 nt, hsa
ugugaagggucagacacagucuacccaggggugucugggggacaagggggucucuggagauguc

SEQ ID NO: 284090 - RNA, 64 nt, hsa
cacuggugacugcuggugggcaggcuggcccugccugggggaguccguggcgaugggcgcuggg

SEQ ID NO: 284091 - RNA, 55 nt, hsa
caaacuuugaggucaucuagcccagcugggggacagugggcuguuguggcugggu

SEQ ID NO: 284092 - RNA, 64 nt, hsa
cuuggcugccccaggccuccuuggcccaugggugcugggggagguggaugucagaucugguagg

SEQ ID NO: 284093 - RNA, 64 nt, hsa
ucggcucagcaggaggaggcuguggcugcagagccugggggagcuuuuagguguugagaugggg

SEQ ID NO: 284094 - RNA, 64 nt, hsa
uacagaaucagggaaagaaccauuaggaguggaacugggggaaucugaguugugucacuucagu

SEQ ID NO: 284095 - RNA, 64 nt, hsa
caggaggggcgaccagauaaggagccccucucugcugggggagaagggaagacgaggaacccca

SEQ ID NO: 284096 - RNA, 64 nt, hsa
uucuuccagguggcucccgcugaggcagcggucucugggggaucccccagcugaaggaggcugg

SEQ ID NO: 284097 - RNA, 64 nt, hsa
cugcccuguccaggugggaagcugagucccagugcugggggacuguggccugggcugaucuuga

SEQ ID NO: 284098 - RNA, 64 nt, hsa
cucaggagugggcagcagucagggagagacagaacugggggaaagggaugguugugggucuuuc

SEQ ID NO: 284099 - RNA, 64 nt, hsa
agcagucuauaccagcaugaguacugccccaccccugggggaaaccuggcuccaaccaaccccu

SEQ ID NO: 284100 - RNA, 64 nt, hsa
ggggcgccuguggggagggaaccaggaggccacacugggggagcgugcagccagcaugugcagu

SEQ ID NO: 284101 - RNA, 64 nt, hsa
agugaggugugauugggcccuccggcuggauguucugggggaggaggcaaucgcuguagcugcc

SEQ ID NO: 284102 - RNA, 64 nt, hsa
agccagucucacugugaaccacacgaaaccucaacugggggagugaggggcuggccaggucugg

SEQ ID NO: 284103 - RNA, 64 nt, hsa
cugagccaggagugaauggcccuuccuuaguagccugggggauguccagagacuaggccucucc

SEQ ID NO: 284104 - RNA, 64 nt, hsa
uucuugauuucacuucugauggaugcauggggcucugggggaaugcugggaaaaugggcaagca

SEQ ID NO: 284105 - RNA, 64 nt, hsa
ugucuggccagggagauccaugugcucaauguugcugggggaccuacaaaagucaaacauugcu

SEQ ID NO: 284106 - RNA, 64 nt, hsa
uccugccccugcuaccugcuucauuguccauccccugggggagugggucagagguacuggaggg

SEQ ID NO: 284107 - RNA, 64 nt, hsa
ggaaaggacacacacaggauaugggagccaggggcugggggagguggaaggggcggggggcggg

SEQ ID NO: 284108 - RNA, 64 nt, hsa
cugaaguguuacuugaaccgggggaaucucggaccugggggagccggggugugaggggacugga

SEQ ID NO: 284109 - RNA, 64 nt, hsa
ccugcccuuugguucauuuuucugcuucucuuggcugggggacucuggugccagccuugaaagu

SEQ ID NO: 284110 - RNA, 64 nt, hsa
agggguuguggggccugaaccccggccucccacccugggggaggcccucugugaaugggucucu

SEQ ID NO: 284111 - RNA, 64 nt, hsa
ucaccuuccagagaggacagacacagauuuccugcugggggagggaggaguccacgcauccuga

SEQ ID NO: 284112 - RNA, 64 nt, hsa
cagaugcccucagaauuggggcaugggaggggggcugggggaccccaugauucagccacggacu

SEQ ID NO: 284113 - RNA, 64 nt, hsa
acugaacuugcuauggaaaggacagugugggaggcugggggagcuguguccugcaguucccagg

SEQ ID NO: 284114 - RNA, 64 nt, hsa
gccaccuugaccguaggggaaggaggaaugugggcugggggaagaugcccucaacucacccccu

SEQ ID NO: 284115 - RNA, 64 nt, hsa
caccugcccucccgggcaguacuggggaccuucccugggggacggggagggaggaggcagcgac

SEQ ID NO: 284116 - RNA, 64 nt, hsa
acaggggggucuccccucaccccugcacccccagcugggggagcuggcucugccccgaccuccu

SEQ ID NO: 284117 - RNA, 64 nt, hsa
uuuuugauggaauugauuuucccugaguggagugcugggggaaggaggagguccaggccgguag

SEQ ID NO: 284118 - RNA, 64 nt, hsa
gcuggcugagauuggggcagcggcucagcagucccugggggaagccauugacguguaccaggcg

SEQ ID NO: 284119 - RNA, 64 nt, hsa
gcugcucugggcagggugugcgggccgggcccggcugggggagggcagcucugggcacgccgca

SEQ ID NO: 284120 - RNA, 64 nt, hsa
gcagcucugggcacgccgcacccacgccccccaccugggggaaacaggcgguuccugcccgguu

SEQ ID NO: 284121 - RNA, 64 nt, hsa
auggagcuaccguguccaggaugaagcugcaggucugggggacacugaccagcuugggcuccac

SEQ ID NO: 284122 - RNA, 64 nt, hsa
caugcggccccaggggccucccuccuguugaagacugggggagagcaguggguucugggggggc

SEQ ID NO: 284123 - RNA, 64 nt, hsa
aagagcagcagcagcaggauggugaaguaguaaacugggggaggcagggcacagggagaugcuc

SEQ ID NO: 284124 - RNA, 64 nt, hsa
ugggaccuuucccucccaggaguccccuagguggcugggggaggcaggcucacuggccauuuuc

SEQ ID NO: 284125 - RNA, 64 nt, hsa
cagggagagcugcugagccuaaagacuggagaaucugggggacugggagugggggucagagagg

SEQ ID NO: 284126 - RNA, 64 nt, hsa
uauggacaggggccugggcuuucuuccaagggcacugggggagccauggcaagguuguagguag

SEQ ID NO: 284127 - RNA, 64 nt, hsa
cccuuuccuuuugguuuugggauuacuuuugauccugggggaccaaugaggugagggggguucu

SEQ ID NO: 284128 - RNA, 64 nt, hsa
ggauacuugccaaaaugagacucuccgucggcagcugggggaagggucugagacucccuuuccu

SEQ ID NO: 284129 - RNA, 64 nt, hsa
ccugcugcagccaccuggugccuuaguccuugggcugggggagggggcccacccuuaaaggcgg

SEQ ID NO: 284130 - RNA, 64 nt, hsa
gcgccuuccacgccccccaggacgggcccagaggcugggggagccccgcggcggccugaacccu

SEQ ID NO: 284131 - RNA, 64 nt, hsa; identical to SEQ ID NO: 82929

SEQ ID NO: 284132 - RNA, 64 nt, hsa; identical to SEQ ID NO: 82930

SEQ ID NO: 284133 - RNA, 64 nt, hsa; identical to SEQ ID NO: 82931

SEQ ID NO: 284134 - RNA, 64 nt, hsa; identical to SEQ ID NO: 82932

SEQ ID NO: 284135 - RNA, 64 nt, hsa; identical to SEQ ID NO: 82933

SEQ ID NO: 284136 - RNA, 64 nt, hsa; identical to SEQ ID NO: 82934

SEQ ID NO: 284137 - RNA, 64 nt, hsa; identical to SEQ ID NO: 82935

SEQ ID NO: 284138 - RNA, 64 nt, hsa; identical to SEQ ID NO: 82936

SEQ ID NO: 284139 - RNA, 64 nt, hsa; identical to SEQ ID NO: 82937

SEQ ID NO: 284140 - RNA, 64 nt, hsa; identical to SEQ ID NO: 82938

SEQ ID NO: 284141 - RNA, 64 nt, hsa; identical to SEQ ID NO: 82939

SEQ ID NO: 284142 - RNA, 64 nt, hsa; identical to SEQ ID NO: 82940

SEQ ID NO: 284143 - RNA, 64 nt, hsa; identical to SEQ ID NO: 82941

SEQ ID NO: 284144 - RNA, 64 nt, hsa; identical to SEQ ID NO: 82942

SEQ ID NO: 284145 - RNA, 64 nt, hsa; identical to SEQ ID NO: 82943

SEQ ID NO: 284146 - RNA, 64 nt, hsa; identical to SEQ ID NO: 82944

SEQ ID NO: 284147 - RNA, 64 nt, hsa; identical to SEQ ID NO: 82945

SEQ ID NO: 284148 - RNA, 64 nt, hsa; identical to SEQ ID NO: 82946

SEQ ID NO: 284149 - RNA, 64 nt, hsa; identical to SEQ ID NO: 82947

SEQ ID NO: 284150 - RNA, 64 nt, hsa; identical to SEQ ID NO: 82948

SEQ ID NO: 284151 - RNA, 64 nt, hsa; identical to SEQ ID NO: 82949

SEQ ID NO: 284152 - RNA, 64 nt, hsa; identical to SEQ ID NO: 82950

SEQ ID NO: 284153 - RNA, 64 nt, hsa; identical to SEQ ID NO: 82951

SEQ ID NO: 284154 - RNA, 64 nt, hsa; identical to SEQ ID NO: 82952

SEQ ID NO: 284155 - RNA, 64 nt, hsa; identical to SEQ ID NO: 82953

SEQ ID NO: 284156 - RNA, 64 nt, hsa; identical to SEQ ID NO: 82954

SEQ ID NO: 284157 - RNA, 64 nt, hsa; identical to SEQ ID NO: 82955

SEQ ID NO: 284158 - RNA, 64 nt, hsa; identical to SEQ ID NO: 82956

SEQ ID NO: 284159 - RNA, 64 nt, hsa; identical to SEQ ID NO: 82957

SEQ ID NO: 284160 - RNA, 64 nt, hsa; identical to SEQ ID NO: 82958

SEQ ID NO: 284161 - RNA, 64 nt, hsa; identical to SEQ ID NO: 82959

SEQ ID NO: 284162 - RNA, 64 nt, hsa; identical to SEQ ID NO: 82960

SEQ ID NO: 284163 - RNA, 64 nt, hsa; identical to SEQ ID NO: 82961

SEQ ID NO: 284164 - RNA, 64 nt, hsa; identical to SEQ ID NO: 82962

SEQ ID NO: 284165 - RNA, 64 nt, hsa; identical to SEQ ID NO: 82963

SEQ ID NO: 284166 - RNA, 64 nt, hsa; identical to SEQ ID NO: 82964

SEQ ID NO: 284167 - RNA, 64 nt, hsa; identical to SEQ ID NO: 82965

SEQ ID NO: 284168 - RNA, 64 nt, hsa; identical to SEQ ID NO: 82966

SEQ ID NO: 284169 - RNA, 64 nt, hsa; identical to SEQ ID NO: 82967

SEQ ID NO: 284170 - RNA, 64 nt, hsa; identical to SEQ ID NO: 82968

SEQ ID NO: 284171 - RNA, 64 nt, hsa; identical to SEQ ID NO: 82969

SEQ ID NO: 284172 - RNA, 64 nt, hsa; identical to SEQ ID NO: 82970

SEQ ID NO: 284173 - RNA, 64 nt, hsa; identical to SEQ ID NO: 82971

SEQ ID NO: 284174 - RNA, 64 nt, hsa; identical to SEQ ID NO: 82972

SEQ ID NO: 284175 - RNA, 64 nt, hsa; identical to SEQ ID NO: 82973

SEQ ID NO: 284176 - RNA, 64 nt, hsa; identical to SEQ ID NO: 82974

SEQ ID NO: 284177 - RNA, 64 nt, hsa; identical to SEQ ID NO: 82975

SEQ ID NO: 284178 - RNA, 64 nt, hsa; identical to SEQ ID NO: 82976

SEQ ID NO: 284179 - RNA, 64 nt, hsa; identical to SEQ ID NO: 82977

SEQ ID NO: 284180 - RNA, 64 nt, hsa; identical to SEQ ID NO: 82978

SEQ ID NO: 284181 - RNA, 64 nt, hsa; identical to SEQ ID NO: 82979

SEQ ID NO: 284182 - RNA, 64 nt, hsa; identical to SEQ ID NO: 82980

SEQ ID NO: 284183 - RNA, 64 nt, hsa; identical to SEQ ID NO: 82981

SEQ ID NO: 284184 - RNA, 64 nt, hsa; identical to SEQ ID NO: 82982

SEQ ID NO: 284185 - RNA, 64 nt, hsa
guuucugccaaacggggaccuccauccagagaaaaggaagaaggugcagggugggccaagaggc

SEQ ID NO: 284186 - RNA, 64 nt, hsa
cccugggccaucacugcaguggcccugggaggugaggaagaagcuggcuagaggagggggcucc

SEQ ID NO: 284187 - RNA, 64 nt, hsa
auucaggauuuuauuggcacaggcccuucuuaguaggaagaaagggugcuuagcuuuggaccug

SEQ ID NO: 284188 - RNA, 64 nt, hsa
gaaaacuuuuuuuuagcuucaccgaugacaacagaggaagaagggaacugggauuuggguaagu

SEQ ID NO: 284189 - RNA, 64 nt, hsa
cugaacucugucugagugggaugguaugaguuagaggaagaauucucuugcaaauuaauaaucg

SEQ ID NO: 284190 - RNA, 64 nt, hsa
ucugcugauggaacagccagccaugaacaaggugaggaagaagaaagaggaagcgcugaauuau

SEQ ID NO: 284191 - RNA, 64 nt, hsa
cuguuucuacuaaccuauaccaucugagaauucuaggaagaauaauaaaaucucguguauucca

SEQ ID NO: 284192 - RNA, 64 nt, hsa
acacagccuaaauaaggcauuugaucuaaucugcaggaagaauuuucuuccccaaaacagaauu

SEQ ID NO: 284193 - RNA, 64 nt, hsa
gcuccgccuccgccgcuuagucccaacccugcccaggaagaagggcccguggggcuuugccugu

SEQ ID NO: 284194 - RNA, 64 nt, hsa
gaacaguggaagaggagcauggacucagacuucaaggaagaagccauuuccccagguccuuccu

SEQ ID NO: 284195 - RNA, 64 nt, hsa
aaagacacuucuuacauuguggcaagaaaaaaugaggaagaagcaaaagcagaaaccccugaua

SEQ ID NO: 284196 - RNA, 64 nt, hsa
aaaggcacuucuuacauggcagcaagagaaaaugaggaagaagcaaaaguggaaaccccugaua

SEQ ID NO: 284197 - RNA, 64 nt, hsa
acuuuaggagggugcuagacuuuagaagccagauaggaagaaucagucuaaacuggccaugcuu

SEQ ID NO: 284198 - RNA, 64 nt, hsa
uugaggcaaguuggaugaacagagaagggaagagaggaagaacgagaggaagagaagggaagga

SEQ ID NO: 284199 - RNA, 64 nt, hsa
uuauuaauguuucuuaaaaguuuuugagaaaaaaaggaagaaaccaacucauucagaaggcucg

SEQ ID NO: 284200 - RNA, 64 nt, hsa
uucugaucaccuuagaaauggcaguaagcccaaaaggaagaauuaugcugguaguaaaugggac

SEQ ID NO: 284201 - RNA, 64 nt, hsa
aacaguaaaaaugacucccauccauccucugacaaggaagaaggugaggccacauccgauucug

SEQ ID NO: 284202 - RNA, 64 nt, hsa
aguccgggagaaccauaugaaggagcaggaggagaggaagaaacuuuuuuuccuucuuuuccag

SEQ ID NO: 284203 - RNA, 64 nt, hsa
uugcccaagaggcaucucaguacuccagcaauggaggaagaauagagaauuuugccuggcaaug

SEQ ID NO: 284204 - RNA, 64 nt, hsa
aaccguuccaagguggggccaguugcgauucuaaaggaagaagcacuaaauggcagggugauca

SEQ ID NO: 284205 - RNA, 64 nt, hsa
cuauauauaaaucuuuguuaugaucaugucauauaggaagaauggcuugugcuuaaggacaaag

SEQ ID NO: 284206 - RNA, 64 nt, hsa
cuggucugccuuguacaagaaaaggcaauauuagaggaagaaaauuuaaagaaaagcuagagga

SEQ ID NO: 284207 - RNA, 64 nt, hsa
ccuacgucugacuccucuccaaucccacaccaucaggaagaaggugccugucggggcucacuug

SEQ ID NO: 284208 - RNA, 64 nt, hsa
augacaguugcccuuucaaagcaggaggaagaaaaggaagaaagaaaaacuguuucaucauuuc

SEQ ID NO: 284209 - RNA, 64 nt, hsa
auaucccucaugacaguugcccuuucaaagcaggaggaagaaaaggaagaaagaaaaacuguuu

SEQ ID NO: 284210 - RNA, 64 nt, hsa
auucaggaagaaaugaccugucuaaaaaaaccuaaggaagaauaauaauauaagaaaggaaauu

SEQ ID NO: 284211 - RNA, 64 nt, hsa
aaaaauaaaaauaaaagaaaaaggaaaaucauucaggaagaaaugaccugucuaaaaaaaccua

SEQ ID NO: 284212 - RNA, 64 nt, hsa
aacaaauauauuagucuagggccacuuaauuuagaggaagaaaaaaaaucaacccauccauaga

SEQ ID NO: 284213 - RNA, 64 nt, hsa
aggaacucacugauggagaugugaaauggcaguaaggaagaaaacagaauaacugaacaaauau

SEQ ID NO: 284214 - RNA, 64 nt, hsa
gucacagagagcaagccaagacauccagggaaagaggaagaaaggccuuagugugccccagcag

SEQ ID NO: 284215 - RNA, 64 nt, hsa
cccaggaccaacaacacccugguuuggagcugggaggaagaagggggccugagagagccccagg

SEQ ID NO: 284216 - RNA, 64 nt, hsa
aaagaagagaaaaaauuaagaaaaaaaucaaaaaaggaagaaaacuaaaaaaaaaaaaaaucaa

SEQ ID NO: 284217 - RNA, 64 nt, hsa
aacaaaucaaccccagcaccaaacccacccaggcaggaagaagccgccccuccucuggggccau

SEQ ID NO: 284218 - RNA, 64 nt, hsa
aacuggcuguuuucuguucuuguuuauccagcguaggaagaaggaaaagaaaaucuuugcuccu

SEQ ID NO: 284219 - RNA, 64 nt, hsa
ucaaaaaagagaaaaugaaaaaaauacaacuaaaaggaagaaacacaacuucaaagauuuuuca

SEQ ID NO: 284220 - RNA, 64 nt, hsa
cuauugauuuuuacuucaaugggcucuuccaacaaggaagaagcuugcugguagcacuugcuac

SEQ ID NO: 284221 - RNA, 64 nt, hsa
cuccuagucaauauccaccccauccaauuuaucaaggaagaaaugguucagaaaauauuuucag

SEQ ID NO: 284222 - RNA, 64 nt, hsa
uccccuacucccuuauguguuguguauuccacuuaggaagaaaugcccaaaagagguccuggcc

SEQ ID NO: 284223 - RNA, 64 nt, hsa
aaguccacuuuacucaaauuggugaacaguguauaggaagaagccagcaggagcucugacuaag

SEQ ID NO: 284224 - RNA, 64 nt, hsa
aguagugaaucucucagccaaggagggaaagaaaaggaagaacucuugacuauuuagauucuag

SEQ ID NO: 284225 - RNA, 64 nt, hsa
uacaggugucuucuggggggcagaaccaauuggaaggaagaaagggaccccucuccaguccugg

SEQ ID NO: 284226 - RNA, 64 nt, hsa
gagcagcaguucauuuaauugucacagcgucgccaggaagaagaucugauaaaccuagguuuac

SEQ ID NO: 284227 - RNA, 64 nt, hsa
aacaaaugcaguuaagaauucuggcacccuuguaaggaagaaaagagaguucaacaccuucgag

SEQ ID NO: 284228 - RNA, 64 nt, hsa
auucagaaauaugauguaguagaacaugcccugcaggaagaaaauguuuucucuccugcguaug

SEQ ID NO: 284229 - RNA, 64 nt, hsa
aaacaaaccagcuuuuuucagagagugaccgaauaggaagaagggauucagaaauaugauguag

SEQ ID NO: 284230 - RNA, 64 nt, hsa
uugagaaguuaacuuuuguggaauaugaaaccaaaggaagaauuuccauguagauaaauuaaga

SEQ ID NO: 284231 - RNA, 64 nt, hsa
guaagaccacaagucugcaggaaacucuggaaucaggaagaaaagcuauguucauacucuaaau

SEQ ID NO: 284232 - RNA, 64 nt, hsa
uucccuuuguuuacucagauuucucuuagccauaaggaagaaaaagaacucuugcaugaaaaua

SEQ ID NO: 284233 - RNA, 64 nt, hsa
gaaaaagaacucuugcaugaaaauagcaugaugcaggaagaaauugccaugcuaagaauagaac

SEQ ID NO: 284234 - RNA, 64 nt, hsa
cucaucuugagaagcaggcggguugggugggaggaggaagaaagggaagaauuagguuugaauu

SEQ ID NO: 284235 - RNA, 64 nt, hsa
uugccacugagaagcaggcggguugggugggaggaggaagaaagggaagaauuagguuugaauu

SEQ ID NO: 284236 - RNA, 64 nt, hsa
gugcuggacaguuuuguugaaaaauuaaaagaagaggaagaaagagaaauaaucaaacugacca

SEQ ID NO: 284237 - RNA, 64 nt, hsa
gaugacuuucaaugacuuucaauacuuccccugaaggaagaaugauaaggagaaaugucuguuu

SEQ ID NO: 284238 - RNA, 64 nt, hsa
uuuucacgcugcugauaaagacauaccugagaccaggaagaaaaagagguuuaauuggacuuac

SEQ ID NO: 284239 - RNA, 64 nt, hsa
aauacaauugacauaggaauuacauuaaaauauuaggaagaaacaaggacaaauuuagaccuug

SEQ ID NO: 284240 - RNA, 64 nt, hsa
cagcuaguuugacuugguuucucuuccuguucaaaggaagaauggguagaauaaagauuugaug

SEQ ID NO: 284241 - RNA, 64 nt, hsa
guaacacuguauaugaugaaaggcuucuauuuggaggaagaaaaauuaagaagacaacuuacaa

SEQ ID NO: 284242 - RNA, 64 nt, hsa
uuauuuugcuacugagucacacaagggaaguggaaggaagaacaguuaauuuaagaaugaaacu

SEQ ID NO: 284243 - RNA, 64 nt, hsa
aaauaauacaaauuggcuuucaagugagacccaaaggaagaacuggauaaaaucuuccaaaucc

SEQ ID NO: 284244 - RNA, 64 nt, hsa
ucaggagaagccagaggcccuggccaaagauaggaggaagaaagagaacucuccauagaaugua

SEQ ID NO: 284245 - RNA, 64 nt, hsa
gagagccccauaugcacacugccugccugauaccaggaagaaccaugugggaauaggugggcca

SEQ ID NO: 284246 - RNA, 64 nt, hsa
aaggguccacuaccagagacagaugaaaaaucacaggaagaagaauuugaugaguauuuucagg

SEQ ID NO: 284247 - RNA, 64 nt, hsa
ugucugcuaauguaacuacuuugaaacucugaugaggaagaaagugcuucagaaucugaacuuu

SEQ ID NO: 284248 - RNA, 64 nt, hsa
gccucugcuuugucaugccauuaagcucacaauaaggaagaaauaacagauaaguccauuggug

SEQ ID NO: 284249 - RNA, 64 nt, hsa
ugcugauagcucauauuauaaauuucuaaauccuaggaagaaacgcuuggagugcuucugaaua

SEQ ID NO: 284250 - RNA, 64 nt, hsa
auauaaaaaagugggcauuuuguaacauuccuucaggaagaauagaauuguaugcuuuuuucug

SEQ ID NO: 284251 - RNA, 64 nt, hsa
cuuacuagcucaauuuaaauaauugauuuuaaauaggaagaaaagaggauauauuuaagauaca

SEQ ID NO: 284252 - RNA, 64 nt, hsa
gcggaacaaugacugccccgauaggugaggcuggaggaagaaucaguccuguccuuggcaagcu

SEQ ID NO: 284253 - RNA, 64 nt, hsa
agaccaguccuguuugcagggaagccccacuugaaggaagaagucuaagagugaaguaggugug

SEQ ID NO: 284254 - RNA, 64 nt, hsa
accaccaugcaggaacagacuuuugguggugaggaggaagaacaaauaauagaagaaaauaaaa

SEQ ID NO: 284255 - RNA, 64 nt, hsa
guuuacuauauauaaagcuaagauguggauuuacaggaagaacccugguuugaauaacugaucu

SEQ ID NO: 284256 - RNA, 64 nt, hsa
uuucaccaccuguguuguuaaccuuauuuccuggaggaagaaacagaugaaacaagugccuaac

SEQ ID NO: 284257 - RNA, 64 nt, hsa
auguuggggguuggggggaagaguggugcuagccaggaagaagccaguaaacauguaaauauag

SEQ ID NO: 284258 - RNA, 64 nt, hsa
uauuuuuacugugaagguguuuucaguuguucuuaggaagaacagcugauagaaauucaagauu

SEQ ID NO: 284259 - RNA, 64 nt, hsa
uccauagcucucugcccugaugugugggggaacuaggaagaaguccuuugaccucaccaggccu

SEQ ID NO: 284260 - RNA, 64 nt, hsa
guggaggugcuggcauucagucugcuagaggcagaggaagaagggugaggacagcaccagacuu

SEQ ID NO: 284261 - RNA, 64 nt, hsa
guuacuuuagaaaaaguggacacagaccagacuaaggaagaagucugaggcagacggugagggu

SEQ ID NO: 284262 - RNA, 64 nt, hsa
aaaacaaaacacacguacauuagguccuggguggaggaagaagugguggagccucagggccagg

SEQ ID NO: 284263 - RNA, 64 nt, hsa
auaggugggaggacuaacuuccagggugccaagaaggaagaaaagccccagguucucuuuucuu

SEQ ID NO: 284264 - RNA, 64 nt, hsa
uagcccccacccuccugccaagcugccucugggaaggaagaaacaggagcuaggcagaagccuu

SEQ ID NO: 284265 - RNA, 64 nt, hsa
uuguuugaauuucaauaaucagggguuugggucaaggaagaaaaaucaugggacuugccauuua

SEQ ID NO: 284266 - RNA, 64 nt, hsa
auugagagcuauuauuaagaaaaacaguugagagaggaagaauuugaagagggcucaagauuuu

SEQ ID NO: 284267 - RNA, 64 nt, hsa
ccagaaaaaagucaauuguucagguacaccaaagaggaagaagagcuguggaggccacccucua

SEQ ID NO: 284268 - RNA, 64 nt, hsa
agaaaaugauucacgaauuccaaaucagauugccaggaagaaauaggacgugacgguacugggc

SEQ ID NO: 284269 - RNA, 64 nt, hsa
caucuguguguccucuugacuaccuucuauuuagaggaagaaugagagcuuuguguguuuaacu

SEQ ID NO: 284270 - RNA, 64 nt, hsa
ugagcuggggccuccuuccauugcaucauuuuaaaggaagaaaaaagcagcuaaaaaagagugg

SEQ ID NO: 284271 - RNA, 64 nt, hsa
aaaaucaugccaaaauguaaagaccaucgagacuaggaagaaacugcaugaacuaacgagcaaa

SEQ ID NO: 284272 - RNA, 64 nt, hsa
uuccucaacacguacacccucccaagacuaaaccaggaagaaguugaaucucugaauagaccaa

SEQ ID NO: 284273 - RNA, 64 nt, hsa
caaagaaauggaagagcauuccaugcucauggguaggaagaaucaauaucaugaaaauggccca

SEQ ID NO: 284274 - RNA, 64 nt, hsa
ccauccccgcucagccuggguugcacuggaggggaggaagaaaguuguuuucagcauaguaaag

SEQ ID NO: 284275 - RNA, 64 nt, hsa
gcacgauaagaauagcagggaauuccucuacuacaggaagaagguggcugagauaagaaaggaa

SEQ ID NO: 284276 - RNA, 64 nt, hsa
gcagauguacagagggaagacgaugugaagacacaggaagaacaucuucaagccaaggaacaca

SEQ ID NO: 284277 - RNA, 64 nt, hsa
guuauuuuaucauucauaaugggacccacacuguaggaagaaguccuucgaaugcaaagaaugu

SEQ ID NO: 284278 - RNA, 64 nt, hsa
cauauguucuaaaaugacuagcaaugguuuaaaaaggaagaagaguggaagugaagaagguggu

SEQ ID NO: 284279 - RNA, 62 nt, hsa
uuuuucuaccucuuuaacaguuaauauuuuuuaaaggaagaaauggaauguaccuucagggg

SEQ ID NO: 284280 - RNA, 64 nt, hsa
ucccuaggaaaaaggucgcuggcuuuggugcaagaggaagaagaauguuccacuggaagccuga

SEQ ID NO: 284281 - RNA, 64 nt, hsa
acaaaucauugaacugagggggaaaaauguaacuaggaagaaaaacccaauuuaagaaauuaca

SEQ ID NO: 284282 - RNA, 64 nt, hsa
gagguuuuauacuucagguuaguuaguuuuuggaaggaagaacauuuuuagguuugcaagccuc

SEQ ID NO: 284283 - RNA, 64 nt, hsa
guuucuucaauuagucucaguucucuuaauuuucaggaagaaagggaaauugcagccccucagc

SEQ ID NO: 284284 - RNA, 64 nt, hsa
ggauuaguuuuccaggacucugcggaggaacggcaggaagaaccucagagagggcagaggugac

SEQ ID NO: 284285 - RNA, 64 nt, hsa
gugaccucaacuuugaguagggacuggaaacuuuaggaagaaagauaauugaggggcgugucug

SEQ ID NO: 284286 - RNA, 64 nt, hsa
gguguccauaugucuuuaccuaccuaaguaaaacaggaagaaaaucaguaacauuauccuuagg

SEQ ID NO: 284287 - RNA, 64 nt, hsa
cagaggcccggacucuccuaugugacuuuagugcaggaagaacuucugucaaucauggacgcau

SEQ ID NO: 284288 - RNA, 64 nt, hsa
uuuguaccauuuaauggguugggagucuuggccaaggaagaaucacacccuuggaauagaaauu

SEQ ID NO: 284289 - RNA, 64 nt, hsa
uuguuuuauuauuccuggccauacucagggguccaggaagaauuuguaccauuuaauggguugg

SEQ ID NO: 284290 - RNA, 64 nt, hsa
ccaagcugcacaauuuaauauauucaagaguggggggaggaagcagaggucuucagggcucuuu

SEQ ID NO: 284291 - RNA, 64 nt, hsa
ccugucuggcuucuagagaugugccugugggagggggaggaaguuggcugagccauugagugcu

SEQ ID NO: 284292 - RNA, 64 nt, hsa
uuccacaguaaugggaucggcuggugugccuucagggaggaagagggagguggucaagcuugaa

SEQ ID NO: 284293 - RNA, 64 nt, hsa
cccauguggcacuggcaucauucucugcuucccugggaggaauuuuuucaccauguuauugaag

SEQ ID NO: 284294 - RNA, 64 nt, hsa
gugggguggagggaggaagggcugggagggaguggggaggaauugcuagcuguagugugacaca

SEQ ID NO: 284295 - RNA, 64 nt, hsa
uuugccucaaauggcuauaggguugugggguggagggaggaagggcugggagggaguggggagg

SEQ ID NO: 284296 - RNA, 64 nt, hsa
aacauuuuguagaguauaggggagugggaggaaggggaggaauaauuuuuuauuuaaaguugau

SEQ ID NO: 284297 - RNA, 64 nt, hsa
cccagggaaaacauuuuguagaguauaggggagugggaggaaggggaggaauaauuuuuuauuu

SEQ ID NO: 284298 - RNA, 64 nt, hsa
agacagacaggccuggggacacuggccccaugaggggaggaaggcaggcgcacgagguccaggg

SEQ ID NO: 284299 - RNA, 64 nt, hsa
cugcccugacccaccuggcaaagcagggcacauggggaggaagagacuggaaccuuucuuugac

SEQ ID NO: 284300 - RNA, 64 nt, hsa
aguaagauggaugguuccggccagagucgauguggggaggaacagagggcugaagggagagggg

SEQ ID NO: 284301 - RNA, 64 nt, hsa
cagugcuagagcuugaagccacucaagccaguuggggaggaaagggaugcggagguacccucua

SEQ ID NO: 284302 - RNA, 64 nt, hsa
uaaguaaggaagguacugcggacagugugggccagggaggaaaaccagagcacacaguuuuguc

SEQ ID NO: 284303 - RNA, 64 nt, hsa
uaaucugcagcaugcuauagaaaguggggaggaagggaggaaaaauaauuacagucaaaauauu

SEQ ID NO: 284304 - RNA, 64 nt, hsa
uuacuguauaaucugcagcaugcuauagaaaguggggaggaagggaggaaaaauaauuacaguc

SEQ ID NO: 284305 - RNA, 64 nt, hsa
cacguugcagaaagagccagccaaggagacccgggggaggaaccgcaguguccccugucaccac

SEQ ID NO: 284306 - RNA, 64 nt, hsa
ugcuuuuuccacgagugucugucagugagcgggcgggaggaagggcacagcaggagcggucagg

SEQ ID NO: 284307 - RNA, 64 nt, hsa
cagaaagaacaucugcuaguugguuauaggcggugggaggaauaauauaccuaauugguuauag

SEQ ID NO: 284308 - RNA, 64 nt, hsa
aagaacauaauguaaaauugucagcagccucauggggaggaaaaaggaagagucaacucacuug

SEQ ID NO: 284309 - RNA, 64 nt, hsa
gugaggaaggagacagggguggaauucgucuucugggaggaagcuggagagagcacagugaaau

SEQ ID NO: 284310 - RNA, 64 nt, hsa
ugaaaaaauaacaguuuaaaaagggaaacaaugugggaggaagaaucaccguugacgcaucuug

SEQ ID NO: 284311 - RNA, 64 nt, hsa
cccaaaaacgcaacacgucucaaggcaaacccgagggaggaacuuggucugggaggaagagaga

SEQ ID NO: 284312 - RNA, 64 nt, hsa
gucucaaggcaaacccgagggaggaacuuggucugggaggaagagagaacucgcuccucaacca

SEQ ID NO: 284313 - RNA, 64 nt, hsa
ucugcaggaucucacagcagcccugagaagacaugggaggaagaagccaguggcccuggggugg

SEQ ID NO: 284314 - RNA, 64 nt, hsa
gcccacaguagugcuagcugaggcccagaggaacgggaggaaagggaggcagcgccggacggcg

SEQ ID NO: 284315 - RNA, 64 nt, hsa
auucugguuuagauacagauauuuacagaaaguagggaggaaggggaccaagccagagagggac

SEQ ID NO: 284316 - RNA, 64 nt, hsa
uauggaaucuauuucugucugcacuagagaggucgggaggaaguuaauucucacuguacuugaa

SEQ ID NO: 284317 - RNA, 64 nt, hsa
cagacgcggagccugggugcgcgagccgcccuccgggaggaaggcgcccggcugcgucugcaga

SEQ ID NO: 284318 - RNA, 64 nt, hsa
uuuuaaauguuuuauuuugcuuucccagcgggaggggaggaagaagaguguuuacaaaguccug

SEQ ID NO: 284319 - RNA, 64 nt, hsa
aaaugaauaagguguugaaagagugcaggggguugggaggaagcauguaagagagggaacauuu

SEQ ID NO: 284320 - RNA, 64 nt, hsa
auuccagggcgcccaggggcgggcggggguacgagggaggaaggggagcaagacuugggcucac

SEQ ID NO: 284321 - RNA, 64 nt, hsa
uaggugccccuaguucuuuguccugccucccagagggaggaaaagccccugggggcuucuggcu

SEQ ID NO: 284322 - RNA, 64 nt, hsa
acuguccaaaccugugaccccaggccagggaacggggaggaaaccaaagaaaaccauuuucagg

SEQ ID NO: 284323 - RNA, 64 nt, hsa
ggggcugagaacugcagcccugggucuucccuuagggaggaagggcagaugaacccagcaggcu

SEQ ID NO: 284324 - RNA, 64 nt, hsa
cugguuucccagaucuguauuucaguguuuacaagggaggaaggaccuuuccucaccucccuuu

SEQ ID NO: 284325 - RNA, 64 nt, hsa
ccaaguauacacaacuucccaguaaaugguuguggggaggaaagagguggagccuccccagccg

SEQ ID NO: 284326 - RNA, 64 nt, hsa
ggacuuuagagagggaugaaaaugagcccugggagggaggaagggacgaggagggguggcugca

SEQ ID NO: 284327 - RNA, 64 nt, hsa
accucuccccacguggaggguggagcaguuaugagggaggaagucaacugcuguucagccucag

SEQ ID NO: 284328 - RNA, 64 nt, hsa
gagaaucuccaagagaaaaauauuuggggaaggagggaggaaauaugucccuugcacaccaccc

SEQ ID NO: 284329 - RNA, 64 nt, hsa
aagccaccucccaucacaccccugagcagaguuagggaggaauucuacuucccauaaaaggacc

SEQ ID NO: 284330 - RNA, 64 nt, hsa
cuagggggaagugacaaggccccagagacucagagggaggaaucgaggaaccagagccauggac

SEQ ID NO: 284331 - RNA, 64 nt, hsa
aaauggcaauucuuugaccucaaccugugaugaggggaggaaacucaccugcuggccccucacc

SEQ ID NO: 284332 - RNA, 64 nt, hsa
uaguuaaaaagcauuauacuguggguaaugaaaagggaggaaaaaaaaagaaggaaaaggaauu

SEQ ID NO: 284333 - RNA, 64 nt, hsa
uuaugcucaggagcauuggaauccucuucuuccagggaggaauuagccugcaagguuaggacuu

SEQ ID NO: 284334 - RNA, 50 nt, hsa
aacugggagccgacagcugagggaggaauuagccaguggacaccccauuu

SEQ ID NO: 284335 - RNA, 64 nt, hsa
gcacuaagggcugaggucaauaccgcagaccuuggggaggaagcugagcaucccccgggauguc

SEQ ID NO: 284336 - RNA, 64 nt, hsa
uacacucaaguguggggagucaugggguguggaggggaggaaaggaaagguauuuuguuucuuu

SEQ ID NO: 284337 - RNA, 64 nt, hsa
aaaccaagggcagaauguuucacccugaucuuaugggaggaaucaaacucccaaaauagugugu

SEQ ID NO: 284338 - RNA, 64 nt, hsa
aacaucaggaaguuacccgauaugucccaaaagggggaggaaugaauaauccaccccuuguuua

SEQ ID NO: 284339 - RNA, 64 nt, hsa
ggucucuuaggcuuuaggacugggacuucggcuagggaggaagguagaguaagagguugaagau

SEQ ID NO: 284340 - RNA, 64 nt, hsa
aagaugaguccuggagggaaggaggaugaguccugggaggaaguaccauagcauuguacuugcc

SEQ ID NO: 284341 - RNA, 64 nt, hsa
cuccaagccauucaugaagcaggcaugagccagagggaggaaguugaaaggauacuaaugauuc

SEQ ID NO: 284342 - RNA, 64 nt, hsa
guauuuauugcaauguaaauguauccugaagguggggaggaauguuuaaucuaccauguccgug

SEQ ID NO: 284343 - RNA, 64 nt, hsa
aggcccagagaccugcuguccuuuuucuccuugagggaggaaauaaaacugcggaauacaaugu

SEQ ID NO: 284344 - RNA, 64 nt, hsa
ccggcagguuuuuuacgagccggguggaggguuggggaggaaagaaagggcgguggcucgggag

SEQ ID NO: 284345 - RNA, 64 nt, hsa
uuucagacaaaaauuaaccagacagaggagaggagggaggaagagcugggcgagaggccuagag

SEQ ID NO: 284346 - RNA, 64 nt, hsa
auuucuccuggagccuccagggcaggaccuuggagggaggaacaacgagcagaaggcccuggcg

SEQ ID NO: 284347 - RNA, 64 nt, hsa
uccaggcaauuggaucagaagucgcagcucuggugggaggaaggcgagcccucauguguguccc

SEQ ID NO: 284348 - RNA, 64 nt, hsa
acaaaggacccuuucaaugucccuggaguugggagggaggaaugggggacauaaagccuguccu

SEQ ID NO: 284349 - RNA, 64 nt, hsa
gacagcuuauccuuuucaaccaacuuuuuggccagggaggaaugucccuuuuguucuucccccu

SEQ ID NO: 284350 - RNA, 64 nt, hsa
uggggauggaugggagggaaggggagggaaaggugggaggaaugggaagcagcuguucuggugg

SEQ ID NO: 284351 - RNA, 64 nt, hsa
cuccccucuccacugauggcugggaagggaguuggggaggaagagugggagggagggcugggga

SEQ ID NO: 284352 - RNA, 64 nt, hsa
guuccugagggccaggucgggggcaggcauggaggggaggaaaggcgucccucuuggcccuccc

SEQ ID NO: 284353 - RNA, 64 nt, hsa
uaaucuaaagaaagcacauuuuaccauugcuguugggaggaagcagaggcagaugggaaagcag

SEQ ID NO: 284354 - RNA, 64 nt, hsa
ugcucugggcaaguggauauuuauuaggcuauuucaaagccacagcauaagaaugucagccuag

SEQ ID NO: 284355 - RNA, 64 nt, hsa
acuuuguuguccauauugcuaucagcauuuggggcaaagccauucaacaagucuguaggaaguu

SEQ ID NO: 284356 - RNA, 64 nt, hsa
uugaaaauuagccaggaucaaaugcuauugcagacaaagccaauaaaaaguuggacuucuuuug

SEQ ID NO: 284357 - RNA, 64 nt, hsa
cccuggcaccaacacccgccaguacugugacuuccaaagccagagccacaugugcucaucaaac

SEQ ID NO: 284358 - RNA, 64 nt, hsa
augcccaggccucggccggggcgcagcgaucccccaaagccagcgccguggaguucgugccaau

SEQ ID NO: 284359 - RNA, 64 nt, hsa
uggauuuacagaaaugugucaaauguaaaucuuucaaagccauuuaaaaauauucacuuuaguu

SEQ ID NO: 284360 - RNA, 64 nt, hsa
ucaauugggagauaccuuuggucugcuccugcaccaaagccauauggguggaagucaguuggcc

SEQ ID NO: 284361 - RNA, 64 nt, hsa
uguauguaugcacacauugugugugugggaaggacaaagccacucucacaagaaagggcaccag

SEQ ID NO: 284362 - RNA, 64 nt, hsa
aauaccaaccuuuauuugcacuuggguuccaguucaaagccaccuuagacaguguggcaaagug

SEQ ID NO: 284363 - RNA, 64 nt, hsa
gccgcaguuaggcaaaaugacagugugacagcuucaaagccacugacucaugacacagcccuga

SEQ ID NO: 284364 - RNA, 64 nt, hsa
aaagaugcugccaguguucgcccuagaguuauuacaaagccagugccaaaacccagccaugggc

SEQ ID NO: 284365 - RNA, 64 nt, hsa
ugagggucuuucaguguuccuguuuacaacaugucaaagccauugguucaagggcguaauaaau

SEQ ID NO: 284366 - RNA, 64 nt, hsa
aggguccacggauggccccaaaggcugagggccccaaagccacuugucuccuaggauccaggcc

SEQ ID NO: 284367 - RNA, 64 nt, hsa
aggggcucccuccucuucacauuccccccgaccccaaagccagagaaagccagauggcaccagc

SEQ ID NO: 284368 - RNA, 64 nt, hsa
gaugggcuggugggccauuccagcuugccgaaaucaaagccaucugaagccugucucuggugaa

SEQ ID NO: 284369 - RNA, 64 nt, hsa
aagaaaaagggccuucaaggcaggaaugagaaagcaaagccaaucucucauuuagaccuggcuu

SEQ ID NO: 284370 - RNA, 64 nt, hsa
agaucugcgagguugucugcuaaaccugcuccuccaaagccagagcccaagccuaaaaaggccc

SEQ ID NO: 284371 - RNA, 64 nt, hsa
aguaagucucuaagucaaucauuuguuagccaagcaaagccauuuauugauggugugaauuaau

SEQ ID NO: 284372 - RNA, 64 nt, hsa
ucaccauguaugccugaaccaggcuggccucauccaaagccaugcaggaucacucaggauuuca

SEQ ID NO: 284373 - RNA, 64 nt, hsa
gaucacucaggauuucaguuucacccucuauuuccaaagccauuuaccucaaaggacccagcag

SEQ ID NO: 284374 - RNA, 64 nt, hsa
ugugacccggggcccaaagccaccaccguccuuccaaagccagaucuuauuuauuuauuuauuu

SEQ ID NO: 284375 - RNA, 59 nt, hsa
ugcugaagacucggcugugacccggggcccaaagccaccaccguccuuccaaagccaga

SEQ ID NO: 284376 - RNA, 64 nt, hsa
cauuuugcuucaaauggccaauugugcagagggacaaagccacagccacacucuucaacgguua

SEQ ID NO: 284377 - RNA, 64 nt, hsa
cugggccagcaccgcugaguccuaagacugcagucaaagccagaacugagaggggaccccagac

SEQ ID NO: 284378 - RNA, 64 nt, hsa
gguagcaagagugaccgaugucaagaacgagcaucaaagccagaauccugcuuguuugcuuaaa

SEQ ID NO: 284379 - RNA, 64 nt, hsa
caccagccucgggagcugcugagccaccaacucccaaagccagccugccuccagcuuuacugag

SEQ ID NO: 284380 - RNA, 64 nt, hsa; identical to SEQ ID NO: 72274

SEQ ID NO: 284381 - RNA, 64 nt, hsa; identical to SEQ ID NO: 72275

SEQ ID NO: 284382 - RNA, 64 nt, hsa; identical to SEQ ID NO: 72276

SEQ ID NO: 284383 - RNA, 64 nt, hsa; identical to SEQ ID NO: 72277

SEQ ID NO: 284384 - RNA, 64 nt, hsa; identical to SEQ ID NO: 72278

SEQ ID NO: 284385 - RNA, 64 nt, hsa; identical to SEQ ID NO: 72279

SEQ ID NO: 284386 - RNA, 64 nt, hsa; identical to SEQ ID NO: 72280

SEQ ID NO: 284387 - RNA, 64 nt, hsa; identical to SEQ ID NO: 72281

SEQ ID NO: 284388 - RNA, 64 nt, hsa; identical to SEQ ID NO: 72282

SEQ ID NO: 284389 - RNA, 64 nt, hsa; identical to SEQ ID NO: 72283

SEQ ID NO: 284390 - RNA, 64 nt, hsa; identical to SEQ ID NO: 72284

SEQ ID NO: 284391 - RNA, 64 nt, hsa; identical to SEQ ID NO: 72285

SEQ ID NO: 284392 - RNA, 64 nt, hsa; identical to SEQ ID NO: 72286

SEQ ID NO: 284393 - RNA, 64 nt, hsa; identical to SEQ ID NO: 72287

SEQ ID NO: 284394 - RNA, 64 nt, hsa; identical to SEQ ID NO: 72288

SEQ ID NO: 284395 - RNA, 64 nt, hsa; identical to SEQ ID NO: 72289

SEQ ID NO: 284396 - RNA, 64 nt, hsa; identical to SEQ ID NO: 72290

SEQ ID NO: 284397 - RNA, 64 nt, hsa; identical to SEQ ID NO: 72291

SEQ ID NO: 284398 - RNA, 64 nt, hsa; identical to SEQ ID NO: 72292

SEQ ID NO: 284399 - RNA, 64 nt, hsa; identical to SEQ ID NO: 72293

SEQ ID NO: 284400 - RNA, 64 nt, hsa; identical to SEQ ID NO: 72294

SEQ ID NO: 284401 - RNA, 64 nt, hsa; identical to SEQ ID NO: 72295

SEQ ID NO: 284402 - RNA, 64 nt, hsa; identical to SEQ ID NO: 72296

SEQ ID NO: 284403 - RNA, 64 nt, hsa; identical to SEQ ID NO: 72297

SEQ ID NO: 284404 - RNA, 64 nt, hsa; identical to SEQ ID NO: 72298

SEQ ID NO: 284405 - RNA, 64 nt, hsa; identical to SEQ ID NO: 72299

SEQ ID NO: 284406 - RNA, 64 nt, hsa; identical to SEQ ID NO: 72300

SEQ ID NO: 284407 - RNA, 64 nt, hsa; identical to SEQ ID NO: 72301

SEQ ID NO: 284408 - RNA, 64 nt, hsa; identical to SEQ ID NO: 72302

SEQ ID NO: 284409 - RNA, 64 nt, hsa; identical to SEQ ID NO: 72303

SEQ ID NO: 284410 - RNA, 64 nt, hsa; identical to SEQ ID NO: 72304

SEQ ID NO: 284411 - RNA, 64 nt, hsa; identical to SEQ ID NO: 72305

SEQ ID NO: 284412 - RNA, 64 nt, hsa; identical to SEQ ID NO: 72306

SEQ ID NO: 284413 - RNA, 64 nt, hsa; identical to SEQ ID NO: 72307

SEQ ID NO: 284414 - RNA, 64 nt, hsa; identical to SEQ ID NO: 72308

SEQ ID NO: 284415 - RNA, 64 nt, hsa; identical to SEQ ID NO: 72309

SEQ ID NO: 284416 - RNA, 64 nt, hsa; identical to SEQ ID NO: 72310

SEQ ID NO: 284417 - RNA, 64 nt, hsa; identical to SEQ ID NO: 72311

SEQ ID NO: 284418 - RNA, 64 nt, hsa; identical to SEQ ID NO: 72312

SEQ ID NO: 284419 - RNA, 64 nt, hsa; identical to SEQ ID NO: 72313

SEQ ID NO: 284420 - RNA, 64 nt, hsa; identical to SEQ ID NO: 72314

SEQ ID NO: 284421 - RNA, 64 nt, hsa; identical to SEQ ID NO: 72315

SEQ ID NO: 284422 - RNA, 64 nt, hsa; identical to SEQ ID NO: 72316

SEQ ID NO: 284423 - RNA, 64 nt, hsa; identical to SEQ ID NO: 72317

SEQ ID NO: 284424 - RNA, 64 nt, hsa; identical to SEQ ID NO: 72318

SEQ ID NO: 284425 - RNA, 64 nt, hsa; identical to SEQ ID NO: 72319

SEQ ID NO: 284426 - RNA, 64 nt, hsa; identical to SEQ ID NO: 72320

SEQ ID NO: 284427 - RNA, 64 nt, hsa; identical to SEQ ID NO: 72321

SEQ ID NO: 284428 - RNA, 64 nt, hsa; identical to SEQ ID NO: 72322

SEQ ID NO: 284429 - RNA, 64 nt, hsa; identical to SEQ ID NO: 72323

SEQ ID NO: 284430 - RNA, 64 nt, hsa; identical to SEQ ID NO: 72324

SEQ ID NO: 284431 - RNA, 64 nt, hsa; identical to SEQ ID NO: 72325

SEQ ID NO: 284432 - RNA, 64 nt, hsa; identical to SEQ ID NO: 72326

SEQ ID NO: 284433 - RNA, 64 nt, hsa; identical to SEQ ID NO: 72327

SEQ ID NO: 284434 - RNA, 64 nt, hsa; identical to SEQ ID NO: 72328

SEQ ID NO: 284435 - RNA, 64 nt, hsa; identical to SEQ ID NO: 72329

SEQ ID NO: 284436 - RNA, 64 nt, hsa; identical to SEQ ID NO: 72330

SEQ ID NO: 284437 - RNA, 64 nt, hsa; identical to SEQ ID NO: 72331

SEQ ID NO: 284438 - RNA, 64 nt, hsa; identical to SEQ ID NO: 72332

SEQ ID NO: 284439 - RNA, 64 nt, hsa; identical to SEQ ID NO: 72333

SEQ ID NO: 284440 - RNA, 64 nt, hsa; identical to SEQ ID NO: 72334

SEQ ID NO: 284441 - RNA, 64 nt, hsa; identical to SEQ ID NO: 72335

SEQ ID NO: 284442 - RNA, 64 nt, hsa; identical to SEQ ID NO: 72336

SEQ ID NO: 284443 - RNA, 64 nt, hsa; identical to SEQ ID NO: 72337

SEQ ID NO: 284444 - RNA, 64 nt, hsa; identical to SEQ ID NO: 72338

SEQ ID NO: 284445 - RNA, 64 nt, hsa; identical to SEQ ID NO: 72339

SEQ ID NO: 284446 - RNA, 64 nt, hsa; identical to SEQ ID NO: 72340

SEQ ID NO: 284447 - RNA, 64 nt, hsa; identical to SEQ ID NO: 72341

SEQ ID NO: 284448 - RNA, 64 nt, hsa; identical to SEQ ID NO: 72342

SEQ ID NO: 284449 - RNA, 64 nt, hsa; identical to SEQ ID NO: 72343

SEQ ID NO: 284450 - RNA, 64 nt, hsa; identical to SEQ ID NO: 72344

SEQ ID NO: 284451 - RNA, 64 nt, hsa; identical to SEQ ID NO: 72345

SEQ ID NO: 284452 - RNA, 64 nt, hsa; identical to SEQ ID NO: 72346

SEQ ID NO: 284453 - RNA, 64 nt, hsa; identical to SEQ ID NO: 72347

SEQ ID NO: 284454 - RNA, 64 nt, hsa; identical to SEQ ID NO: 72348

SEQ ID NO: 284455 - RNA, 64 nt, hsa; identical to SEQ ID NO: 72349

SEQ ID NO: 284456 - RNA, 64 nt, hsa; identical to SEQ ID NO: 72350

SEQ ID NO: 284457 - RNA, 64 nt, hsa; identical to SEQ ID NO: 72351

SEQ ID NO: 284458 - RNA, 64 nt, hsa; identical to SEQ ID NO: 72352

SEQ ID NO: 284459 - RNA, 64 nt, hsa; identical to SEQ ID NO: 72353

SEQ ID NO: 284460 - RNA, 64 nt, hsa; identical to SEQ ID NO: 72354

SEQ ID NO: 284461 - RNA, 64 nt, hsa; identical to SEQ ID NO: 72355

SEQ ID NO: 284462 - RNA, 64 nt, hsa; identical to SEQ ID NO: 72356

SEQ ID NO: 284463 - RNA, 64 nt, hsa; identical to SEQ ID NO: 72357

SEQ ID NO: 284464 - RNA, 64 nt, hsa; identical to SEQ ID NO: 72358

SEQ ID NO: 284465 - RNA, 64 nt, hsa; identical to SEQ ID NO: 72359

SEQ ID NO: 284466 - RNA, 64 nt, hsa; identical to SEQ ID NO: 72360

SEQ ID NO: 284467 - RNA, 64 nt, hsa; identical to SEQ ID NO: 72361

SEQ ID NO: 284468 - RNA, 64 nt, hsa; identical to SEQ ID NO: 72362

SEQ ID NO: 284469 - RNA, 64 nt, hsa; identical to SEQ ID NO: 72363

SEQ ID NO: 284470 - RNA, 64 nt, hsa; identical to SEQ ID NO: 72364

SEQ ID NO: 284471 - RNA, 64 nt, hsa; identical to SEQ ID NO: 72365

SEQ ID NO: 284472 - RNA, 64 nt, hsa; identical to SEQ ID NO: 72366

SEQ ID NO: 284473 - RNA, 64 nt, hsa; identical to SEQ ID NO: 72367

SEQ ID NO: 284474 - RNA, 64 nt, hsa; identical to SEQ ID NO: 72368

SEQ ID NO: 284475 - RNA, 64 nt, hsa; identical to SEQ ID NO: 72369

SEQ ID NO: 284476 - RNA, 64 nt, hsa; identical to SEQ ID NO: 72370

SEQ ID NO: 284477 - RNA, 64 nt, hsa; identical to SEQ ID NO: 72371

SEQ ID NO: 284478 - RNA, 64 nt, hsa; identical to SEQ ID NO: 72372

SEQ ID NO: 284479 - RNA, 64 nt, hsa; identical to SEQ ID NO: 72373

SEQ ID NO: 284480 - RNA, 64 nt, hsa; identical to SEQ ID NO: 72374

SEQ ID NO: 284481 - RNA, 64 nt, hsa; identical to SEQ ID NO: 72375

SEQ ID NO: 284482 - RNA, 64 nt, hsa; identical to SEQ ID NO: 72376

SEQ ID NO: 284483 - RNA, 64 nt, hsa; identical to SEQ ID NO: 72377

SEQ ID NO: 284484 - RNA, 64 nt, hsa; identical to SEQ ID NO: 72378

SEQ ID NO: 284485 - RNA, 64 nt, hsa; identical to SEQ ID NO: 72379

SEQ ID NO: 284486 - RNA, 64 nt, hsa; identical to SEQ ID NO: 72380

SEQ ID NO: 284487 - RNA, 64 nt, hsa; identical to SEQ ID NO: 72381

SEQ ID NO: 284488 - RNA, 64 nt, hsa; identical to SEQ ID NO: 72382

SEQ ID NO: 284489 - RNA, 64 nt, hsa; identical to SEQ ID NO: 72383

SEQ ID NO: 284490 - RNA, 64 nt, hsa; identical to SEQ ID NO: 72384

SEQ ID NO: 284491 - RNA, 64 nt, hsa; identical to SEQ ID NO: 72385

SEQ ID NO: 284492 - RNA, 64 nt, hsa; identical to SEQ ID NO: 72386

SEQ ID NO: 284493 - RNA, 64 nt, hsa; identical to SEQ ID NO: 72387

SEQ ID NO: 284494 - RNA, 64 nt, hsa; identical to SEQ ID NO: 72388

SEQ ID NO: 284495 - RNA, 64 nt, hsa; identical to SEQ ID NO: 72389

SEQ ID NO: 284496 - RNA, 64 nt, hsa; identical to SEQ ID NO: 72390

SEQ ID NO: 284497 - RNA, 64 nt, hsa; identical to SEQ ID NO: 72391

SEQ ID NO: 284498 - RNA, 64 nt, hsa; identical to SEQ ID NO: 72392

SEQ ID NO: 284499 - RNA, 64 nt, hsa; identical to SEQ ID NO: 72393

SEQ ID NO: 284500 - RNA, 64 nt, hsa; identical to SEQ ID NO: 72394

SEQ ID NO: 284501 - RNA, 64 nt, hsa; identical to SEQ ID NO: 72395

SEQ ID NO: 284502 - RNA, 64 nt, hsa; identical to SEQ ID NO: 72396

SEQ ID NO: 284503 - RNA, 64 nt, hsa; identical to SEQ ID NO: 72397

SEQ ID NO: 284504 - RNA, 64 nt, hsa; identical to SEQ ID NO: 72398

SEQ ID NO: 284505 - RNA, 64 nt, hsa; identical to SEQ ID NO: 72399

SEQ ID NO: 284506 - RNA, 64 nt, hsa; identical to SEQ ID NO: 72400

SEQ ID NO: 284507 - RNA, 64 nt, hsa; identical to SEQ ID NO: 72401

SEQ ID NO: 284508 - RNA, 64 nt, hsa; identical to SEQ ID NO: 72402

SEQ ID NO: 284509 - RNA, 64 nt, hsa; identical to SEQ ID NO: 72403

SEQ ID NO: 284510 - RNA, 64 nt, hsa; identical to SEQ ID NO: 72404

SEQ ID NO: 284511 - RNA, 64 nt, hsa; identical to SEQ ID NO: 72405

SEQ ID NO: 284512 - RNA, 64 nt, hsa; identical to SEQ ID NO: 72406

SEQ ID NO: 284513 - RNA, 64 nt, hsa; identical to SEQ ID NO: 72407

SEQ ID NO: 284514 - RNA, 64 nt, hsa; identical to SEQ ID NO: 72408

SEQ ID NO: 284515 - RNA, 64 nt, hsa; identical to SEQ ID NO: 72409

SEQ ID NO: 284516 - RNA, 64 nt, hsa; identical to SEQ ID NO: 72410

SEQ ID NO: 284517 - RNA, 64 nt, hsa; identical to SEQ ID NO: 72411

SEQ ID NO: 284518 - RNA, 64 nt, hsa; identical to SEQ ID NO: 72412

SEQ ID NO: 284519 - RNA, 64 nt, hsa; identical to SEQ ID NO: 72413

SEQ ID NO: 284520 - RNA, 64 nt, hsa; identical to SEQ ID NO: 72414

SEQ ID NO: 284521 - RNA, 64 nt, hsa; identical to SEQ ID NO: 72415

SEQ ID NO: 284522 - RNA, 64 nt, hsa; identical to SEQ ID NO: 72416

SEQ ID NO: 284523 - RNA, 64 nt, hsa; identical to SEQ ID NO: 72417

SEQ ID NO: 284524 - RNA, 64 nt, hsa; identical to SEQ ID NO: 72418

SEQ ID NO: 284525 - RNA, 64 nt, hsa; identical to SEQ ID NO: 72419

SEQ ID NO: 284526 - RNA, 64 nt, hsa; identical to SEQ ID NO: 72420

SEQ ID NO: 284527 - RNA, 64 nt, hsa; identical to SEQ ID NO: 72421

SEQ ID NO: 284528 - RNA, 64 nt, hsa; identical to SEQ ID NO: 72422

SEQ ID NO: 284529 - RNA, 64 nt, hsa; identical to SEQ ID NO: 72423

SEQ ID NO: 284530 - RNA, 64 nt, hsa; identical to SEQ ID NO: 72424

SEQ ID NO: 284531 - RNA, 64 nt, hsa; identical to SEQ ID NO: 72425

SEQ ID NO: 284532 - RNA, 64 nt, hsa; identical to SEQ ID NO: 72426

SEQ ID NO: 284533 - RNA, 64 nt, hsa; identical to SEQ ID NO: 72427

SEQ ID NO: 284534 - RNA, 64 nt, hsa; identical to SEQ ID NO: 72428

SEQ ID NO: 284535 - RNA, 64 nt, hsa; identical to SEQ ID NO: 72429

SEQ ID NO: 284536 - RNA, 64 nt, hsa; identical to SEQ ID NO: 72430

SEQ ID NO: 284537 - RNA, 64 nt, hsa; identical to SEQ ID NO: 72431

SEQ ID NO: 284538 - RNA, 64 nt, hsa; identical to SEQ ID NO: 72432

SEQ ID NO: 284539 - RNA, 64 nt, hsa; identical to SEQ ID NO: 72433

SEQ ID NO: 284540 - RNA, 64 nt, hsa; identical to SEQ ID NO: 72434

SEQ ID NO: 284541 - RNA, 64 nt, hsa
cuaacagguaagaaaugaaauugaacuauugacugggccccagaaauccauaaaauggcugcag

SEQ ID NO: 284542 - RNA, 64 nt, hsa
guggccccagcuggguuucccaggucaggaaugugggccccaggcaaggugcagccuuugcuca

SEQ ID NO: 284543 - RNA, 64 nt, hsa
gccgcugcuugaguggacagcagcuggacugggugggccccacaguggucagcgauuccugcca

SEQ ID NO: 284544 - RNA, 64 nt, hsa
guggucagcgauuccugccaaguaggguuuagccgggccccauggucacagaccccugggggag

SEQ ID NO: 284545 - RNA, 64 nt, hsa
uuuuauucuaugagaacaagucacagcugcagcugggccccaugcucugccccaagcccccaac

SEQ ID NO: 284546 - RNA, 64 nt, hsa
cugucagaggcuaagaugagauuugccagcacaggggccccagaucugccugggccugugcagc

SEQ ID NO: 284547 - RNA, 64 nt, hsa
gcuguacccuuccaccuccuagaggugggcagcugggccccaccuacuugugacugaaggggca

SEQ ID NO: 284548 - RNA, 64 nt, hsa
acuguggggcaagccugaguggugaggggccacugggccccauucucccuccauggcaggaagg

SEQ ID NO: 284549 - RNA, 64 nt, hsa
gccuugggggucugcucugugccugggaucaguggggccccaaagcccagcccggcugaccaac

SEQ ID NO: 284550 - RNA, 64 nt, hsa
ggacacgcuggucugagaugagggggagccccacgggccccaggcaggcuagaggaggcacagg

SEQ ID NO: 284551 - RNA, 64 nt, hsa
ggcaccuuggggcuagcacacggguguaucgccugggccccaggcuucuccauggccacauggg

SEQ ID NO: 284552 - RNA, 64 nt, hsa
gugagauugggccuggggucucaccccuaguguggggccccaggucccgugccuccccuuccca

SEQ ID NO: 284553 - RNA, 64 nt, hsa
uuccacugggccuaccuuccuuggggauguucaugggccccaguuuccaguuucccuugccaga

SEQ ID NO: 284554 - RNA, 64 nt, hsa
ccucuccccaccccguccuguccaugcgcuuccagggccccacgguccccaggaggacgcuucc

SEQ ID NO: 284555 - RNA, 64 nt, hsa
guccugggccagagacaggcagggcccaguccaggggccccaggccuccccagucccagugugc

SEQ ID NO: 284556 - RNA, 64 nt, hsa
gggggaggaggaagccacugcaucuguuggcucagggccccagccugugcgagcagggcgccug

SEQ ID NO: 284557 - RNA, 64 nt, hsa
ccugggggccaggucgaccuucaaguggcuuuuggggccccagguugagcucuggauguuucaa

SEQ ID NO: 284558 - RNA, 64 nt, hsa
gguggggguccgggucaccauuuccuccaguccugggccccauccuugagggccuucccagcca

SEQ ID NO: 284559 - RNA, 64 nt, hsa
agaccgacuggucgcacucgcagcugcuggacuugggccccaucgacgcgcucaacuucuucug

SEQ ID NO: 284560 - RNA, 64 nt, hsa
cgcagagguccgcgagguccgcgaugagacugaggggccccaugcggucccggcucugugcggg

SEQ ID NO: 284561 - RNA, 64 nt, hsa
acuggccugcacggugggccuugcuggggacggggggccccagucagccucucucccagucuac

SEQ ID NO: 284562 - RNA, 64 nt, hsa
ucacacagccaggugccuuggagggucccaagcugggccccagcccacccuccugucuucccag

SEQ ID NO: 284563 - RNA, 64 nt, hsa
caccccacggggcuugggcgacuacagggucuucgggccccagcccuggagcugcaggaguugg

SEQ ID NO: 284564 - RNA, 64 nt, hsa
ugguggaaauggcaggagggugcagguacucuuggggccccagcggugggagugcaaaagaccc

SEQ ID NO: 284565 - RNA, 64 nt, hsa
acuucccuugcugcaggcuguuguaacacuuuaagggccccaggucuccacugccaagcaggac

SEQ ID NO: 284566 - RNA, 64 nt, hsa
uguuucuggugggcucugcgggagaagacacuaagggccccacaggcuuguuucaugguguugc

SEQ ID NO: 284567 - RNA, 64 nt, hsa
uggaaggaaggcacugagagcccccuuccucugagggccccaccucaccccuuggugucacccc

SEQ ID NO: 284568 - RNA, 64 nt, hsa
gggcgacuccauaugcaaucaguagcgagcagccgggccccacagacccucaugcacucucuua

SEQ ID NO: 284569 - RNA, 64 nt, hsa
gguuaaguacccgaggccucucuuaagauguccagggccccaggcccgcgggcacagccagccc

SEQ ID NO: 284570 - RNA, 64 nt, hsa
ccaucacuagagugcucugacccugggcuuucacgggccccauuccaccgccuccccaacuuga

SEQ ID NO: 284571 - RNA, 59 nt, hsa
cagaggauucccgagugugagcugucuuggggccccaccuggccaagaguagcagccac

SEQ ID NO: 284572 - RNA, 64 nt, hsa
gugagccauagugggccaggcugcccuccaugcugggccccagcccaggucugcacucgccugg

SEQ ID NO: 284573 - RNA, 64 nt, hsa
cagacuuggcagggccuucaagaggccugugugggggccccaggaauccuuagcugaagcgggg

SEQ ID NO: 284574 - RNA, 64 nt, hsa
gagaaggaaaagugacgaagagagaggaggaggggggccccagauggcccuuccuuuggugcau

SEQ ID NO: 284575 - RNA, 64 nt, hsa
caaaguugacccucggguaggguuguccugccuggggccccacuugaaggaggcaggacagagg

SEQ ID NO: 284576 - RNA, 64 nt, hsa
ggauggaggagggucugcagccaguucauucccagggccccaucuugaugggccaagggcuaaa

SEQ ID NO: 284577 - RNA, 64 nt, hsa
cugaucgggccagggacaggcuugcccaugucccgggccccauugcuuccaugccuggugcugu

SEQ ID NO: 284578 - RNA, 64 nt, hsa
gugagcuggggugagcugggccgcaccuacccuggggccccagggagcaggacgcuccggggcc

SEQ ID NO: 284579 - RNA, 64 nt, hsa
acaagagugcauuugucucccccuuccacccguggggccccaccuucaggucuuagugguucac

SEQ ID NO: 284580 - RNA, 64 nt, hsa
ggagcugacgccaccacccugcuuagcccucacagggccccaagguguccgaguguguuggguc

SEQ ID NO: 284581 - RNA, 64 nt, hsa
gccuuggucccccaacccccagagcuuggagucugggccccacacccagcccugccuugguccc

SEQ ID NO: 284582 - RNA, 64 nt, hsa
uagguuaggaaagcggaggcucaugguggggcuggggccccagaggugggcuagguguaaggca

SEQ ID NO: 284583 - RNA, 64 nt, hsa
cgcagccuagcuccucacagcugccuugcaccaagggccccacccagcucgguguucugagacc

SEQ ID NO: 284584 - RNA, 56 nt, hsa
aauaccuauuucccuguuaagggggagggccccaggacaccccucaccuacuuuca

SEQ ID NO: 284585 - RNA, 64 nt, hsa
accccaccccugggcuggggccaaggcuacauaggggccccauucaccuggaggcaucucaggc

SEQ ID NO: 284586 - RNA, 64 nt, hsa
uccuugaccgcauggcggcagcccaccuugguaagggccccagggcccaugcgagagcugccug

SEQ ID NO: 284587 - RNA, 64 nt, hsa
cuccagucuuguuacuguagacuguagaaagcacgggccccaggcucugagcuuaguaauaacc

SEQ ID NO: 284588 - RNA, 64 nt, hsa
gccucccucugaggcuggugacuccucccugcuggggccccacaggugaggcagaacagcuaga

SEQ ID NO: 284589 - RNA, 64 nt, hsa
agagaguuacagguuggacaugaugcacacuauggggccccagcgacgugucugguugagcuca

SEQ ID NO: 284590 - RNA, 64 nt, hsa
ccgggccccauaguggugcgggcacuggacccccgggccccacggaggccgcggucugaacugc

SEQ ID NO: 284591 - RNA, 64 nt, hsa
cuggguuggaggucuggacagggagcccagucccgggccccauaguggugcgggcacuggaccc

SEQ ID NO: 284592 - RNA, 64 nt, hsa
cagcccuucucuccuccagcccggggacccccgcgggccccagaagcagcccaguucucagaga

SEQ ID NO: 284593 - RNA, 64 nt, hsa
gagggccuccuuccugccacgagggaggggagucgggccccaggucgcccccgcccccagcccu

SEQ ID NO: 284594 - RNA, 64 nt, hsa
acccugugccccagagcuccccugccgcagaauggggccccagccggccccgaccggguccagg

SEQ ID NO: 284595 - RNA, 64 nt, hsa
cguuccuuuuguuccuguccguuuaucaggacacgggccccaccugucacgugcccgaggccac

SEQ ID NO: 284596 - RNA, 64 nt, hsa
ccauuucuucccaagcccgagcagagggucaugcgggccccacaggagaagcggccagggcccg

SEQ ID NO: 284597 - RNA, 64 nt, hsa
cggggaaccaggcgggagggacugaguggcccgcgggccccagugaggcacuuugucccgccca

SEQ ID NO: 284598 - RNA, 64 nt, hsa
cagcacccagugcucccuccucuacucugaccuggggccccagcauccuggagcacacgcucca

SEQ ID NO: 284599 - RNA, 64 nt, hsa
gcuguggcggaagagcauguggggcuugguggaggggccccaggauuuguugggggcaaagggg

SEQ ID NO: 284600 - RNA, 64 nt, hsa
gcccagagccuccaaagagagcugaggggauguggggccccaaacucauuaauucacugaagac

SEQ ID NO: 284601 - RNA, 64 nt, hsa
cuguggaaggagggcugcccucuugcccuagugagggccccauguggauccacucuagugcugg

SEQ ID NO: 284602 - RNA, 64 nt, hsa
cgagccucuugucccuucccugcucugcugcauggggccccauggcuuuggcuggccacugagg

SEQ ID NO: 284603 - RNA, 64 nt, hsa
ccccaggcugcaggugaggcuucaggggaugcuggggccccacugccccuccgcugccuugccc

SEQ ID NO: 284604 - RNA, 64 nt, hsa
uuuuaaaugcaauaucucuguauacagacuggcugggccccacccccugcguguggcccuccca

SEQ ID NO: 284605 - RNA, 64 nt, hsa
acuaccagagacucugggaaauggacaagguggggggccccacucuuucucuccugcagucccg

SEQ ID NO: 284606 - RNA, 64 nt, hsa
cucuacuguaugaauuaugcuuuaaguagaauucagugccaaggagaacuuggugaaauaaauu

SEQ ID NO: 284607 - RNA, 64 nt, hsa
ucaacauaugucuacauugcccccaaguuaauaaagugccaacccuuuacucucucauacagcc

SEQ ID NO: 284608 - RNA, 64 nt, hsa
uuuuugacugaaaguacuaaaagucagcuuuacuagugccaaaccuuuaaauuuucaaaagaaa

SEQ ID NO: 284609 - RNA, 64 nt, hsa
gagacugacugaguagcucauucuugugacuuacagugccaacauuuaaaaaaguaugaaaaug

SEQ ID NO: 284610 - RNA, 64 nt, hsa
auauaauacuaaucuaaacaguacuagaaauuacagugccaagagccaccaggaggcccagcca

SEQ ID NO: 284611 - RNA, 64 nt, hsa
gagguagagcaaugaucagaugggugcacagaccagugccaaucugaacauuguuaauggccug

SEQ ID NO: 284612 - RNA, 64 nt, hsa
uuaucuauugcacaccacacuacaucuuugagcaagugccaaauuuguacugaaguguugacca

SEQ ID NO: 284613 - RNA, 64 nt, hsa
cuacaauguucuagaaauucucacucagguacacagugccaacaaguggcuugugaauguguuu

SEQ ID NO: 284614 - RNA, 64 nt, hsa
cucauggggcaggaaauggggggaucacuuuccaagugccaaagagcccagagggacucuaaga

SEQ ID NO: 284615 - RNA, 64 nt, hsa
gaggccugguggagccauaaccucucccacagccagugccaaguccucccccugcccauucuca

SEQ ID NO: 284616 - RNA, 64 nt, hsa
ccaacaacugucacccucuucuguaccucuccugagugccaacuguccaggccauuugacacac

SEQ ID NO: 284617 - RNA, 64 nt, hsa
acaguguauuggaaauuuuauaaacaaaagugaaagugccaacaaauuauugauagcugauaau

SEQ ID NO: 284618 - RNA, 64 nt, hsa
aacccuguuuauugugggauaucaauauuuuuaaagugccaacacagucaugauaggacaauau

SEQ ID NO: 284619 - RNA, 64 nt, hsa
aucuccaccaucuauagugagccucuccauaauuagugccaaccauuagucucguucauauuuu

SEQ ID NO: 284620 - RNA, 64 nt, hsa; identical to SEQ ID NO: 218492

SEQ ID NO: 284621 - RNA, 64 nt, hsa; identical to SEQ ID NO: 218493

SEQ ID NO: 284622 - RNA, 64 nt, hsa; identical to SEQ ID NO: 218494

SEQ ID NO: 284623 - RNA, 64 nt, hsa; identical to SEQ ID NO: 218495

SEQ ID NO: 284624 - RNA, 64 nt, hsa; identical to SEQ ID NO: 218496

SEQ ID NO: 284625 - RNA, 64 nt, hsa; identical to SEQ ID NO: 218497

SEQ ID NO: 284626 - RNA, 64 nt, hsa; identical to SEQ ID NO: 218498

SEQ ID NO: 284627 - RNA, 64 nt, hsa; identical to SEQ ID NO: 218499

SEQ ID NO: 284628 - RNA, 64 nt, hsa; identical to SEQ ID NO: 218500

SEQ ID NO: 284629 - RNA, 64 nt, hsa; identical to SEQ ID NO: 218501

SEQ ID NO: 284630 - RNA, 64 nt, hsa; identical to SEQ ID NO: 218502

SEQ ID NO: 284631 - RNA, 64 nt, hsa; identical to SEQ ID NO: 218503

SEQ ID NO: 284632 - RNA, 64 nt, hsa
uguuguaccucuuuugcuugccaaaguacagaauuugaauuaucagcaaagaaaaaaaaaaaag

SEQ ID NO: 284633 - RNA, 64 nt, hsa
ucauaaagucaguugcucaaaaagaaaucaauaguugaauuagugaguauagugggguuccaug

SEQ ID NO: 284634 - RNA, 64 nt, hsa
aaacaaauauauuucuuacuagcaaaauagaaaauugaauuauuuuucuccaaauugagacucu

SEQ ID NO: 284635 - RNA, 64 nt, hsa
uuuucuccaaauugagacucucagaaaaggaagauugaauuagcguguuuuuuguuuguuuguu

SEQ ID NO: 284636 - RNA, 64 nt, hsa
acauauuuguuauguaaacuuauacuauguaaacuugaauuaguuuuuugcuuccuugaauuaa

SEQ ID NO: 284637 - RNA, 64 nt, hsa
auacuauguaaacuugaauuaguuuuuugcuuccuugaauuaauaaagcccauuaaugcaaauc

SEQ ID NO: 284638 - RNA, 64 nt, hsa
acuugauuauacuauuuauaauuggcacaguacuuugaauuaugccaguacuacauuguaaaac

SEQ ID NO: 284639 - RNA, 64 nt, hsa
aucucacuuuaaaaaugaccaaaacaugucuuucuugaauuaacuuugaauaaaaguuuguaua

SEQ ID NO: 284640 - RNA, 64 nt, hsa
gugcuuaaugcaugguaggcccuuaguaauguuuuugaauuaaugaggcaugauucuaaaugcc

SEQ ID NO: 284641 - RNA, 64 nt, hsa
uugauaaaguuucuuucuuacagaaguucugauauugaauuaaggaaugggucacuacuuaaga

SEQ ID NO: 284642 - RNA, 64 nt, hsa
uuaugcucuguuuccaacugcauuuccuuuccaauugaauuaaaguguggccucguuuuuaguc

SEQ ID NO: 284643 - RNA, 64 nt, hsa
uugcauucacagagaggucauugguuauagagacuugaauuaauaagugacauuaugccaguuu

SEQ ID NO: 284644 - RNA, 64 nt, hsa
ucuuugguaaaucaagauccagucaggguuucucuugaauuauuuuggaacaaugccaggaucc

SEQ ID NO: 284645 - RNA, 64 nt, hsa
acaguauaccucucaacaguuuauaaauaauauguugaauuaugucagugugggcagcaguaga

SEQ ID NO: 284646 - RNA, 64 nt, hsa
uuugcauacuuuaaaaucaccuaacuuggacugcuugaauuacauuggcuuuuagaaccgaaau

SEQ ID NO: 284647 - RNA, 64 nt, hsa
uggaagcuuucuucucugaagucgauauaugguuuugaauuacuagagcuuuggucaguauuuc

SEQ ID NO: 284648 - RNA, 64 nt, hsa
cagcaucacuauguagcauucuguuuuagcaucuuugaauuaugaucauuugauuuggcuaauu

SEQ ID NO: 284649 - RNA, 64 nt, hsa
cauuacauauuuaguuuuaaaaggaggagucaccuugaauuauuuucugagucaccuugaguua

SEQ ID NO: 284650 - RNA, 64 nt, hsa
gaaaauacugaaaguuugauuuuucuuuccauauuugaauuaauuuuuucuguuugacuggaag

SEQ ID NO: 284651 - RNA, 64 nt, hsa
ccagcuaguccuagaguucuauauuucuacauaguugaauuauuuuaucaugcuguugcugggg

SEQ ID NO: 284652 - RNA, 64 nt, hsa
uacuagaaucaauuuguuccuuguuaaaggccuuuugaauuauacugcagggcaucuugugaau

SEQ ID NO: 284653 - RNA, 64 nt, hsa
augggaaguuagggaaaaugugugauuuuguguuuugaauuacugucagaauuacauacacaau

SEQ ID NO: 284654 - RNA, 64 nt, hsa
uucuuuccucuuccagcugagcagaguuggauaauugaauuagucauucugacauucuuuggac

SEQ ID NO: 284655 - RNA, 64 nt, hsa
uagccauagauggagaaacaaagcucaggguuuguugaauuagcaugagagaaaauuauguacc

SEQ ID NO: 284656 - RNA, 64 nt, hsa
uucuuagagaaguaugaguggaacuugaguacaguugaauuauuaaauaugcaaguuagaaauu

SEQ ID NO: 284657 - RNA, 64 nt, hsa
gccugagaaaucccuauguaccuuugugaaauuguugaauuaguuagugaauaaagaaauaaac

SEQ ID NO: 284658 - RNA, 64 nt, hsa
ccuuuuuguuguuguuguuguugcuagaaauggauugaauuaguagaccagaaaguaacuucaa

SEQ ID NO: 284659 - RNA, 64 nt, hsa
ugcgcaccuuugcuaauaaggaaauggucucccuuugaauuaugggaaguuucuugucugugau

SEQ ID NO: 284660 - RNA, 64 nt, hsa
cagcaaagagcuuugugauuggguuugaaagauuuugaauuauagacagugcucuuaauaguuu

SEQ ID NO: 284661 - RNA, 64 nt, hsa
uaggagaacagagaugagauuugacaaaaaaaaauugaauuaaaaauaacacagucuuuuuaaa

SEQ ID NO: 284662 - RNA, 64 nt, hsa
gggcgagagaggccagggauuuguucacagauacuugaauuaauucauccaaauguacugaggu

SEQ ID NO: 284663 - RNA, 64 nt, hsa
uguaguauucaucuuuguauucugaagauaagguuugaauuaaauugauacacacagaggggaa

SEQ ID NO: 284664 - RNA, 64 nt, hsa
auuuuucuuuacuaaucauuuuggauuuuuuucuuugaauuauuggcagggaauauacuuaugu

SEQ ID NO: 284665 - RNA, 64 nt, hsa
accaguuguaacaucuuaccauuucccuaacaaauugaauuaguuuaauaaaaucuuuugacac

SEQ ID NO: 284666 - RNA, 64 nt, hsa
gagacagaaacgaagcccagaacaaagaugaaacuugaauuaccaucucagaagucaagcugau

SEQ ID NO: 284667 - RNA, 64 nt, hsa
auguuuuuauggcuauuaucuauuucaucaguuauugaauuaagaaugauuuucauuacuugag

SEQ ID NO: 284668 - RNA, 64 nt, hsa
cuugugaaaguuggugucacaguucaggcgcuccuugaauuaccaacaaccaaggcaucucagc

SEQ ID NO: 284669 - RNA, 64 nt, hsa
ccugugcuaguuuucauguucacacugacccuauuugaauuaauauccuuuguuagaguggucg

SEQ ID NO: 284670 - RNA, 64 nt, hsa
uuggaagagacugcagacuacugcuuugaaugaguugaauuacauaagcuaagaucacuauagg

SEQ ID NO: 284671 - RNA, 64 nt, hsa
cuuauaaaaaacuagugucauguaccugccaugaacaugacaaaagguuagucuucaauagacu

SEQ ID NO: 284672 - RNA, 64 nt, hsa
aaucccaaacucugcccucuuagcaucuuauucuacaugacaacucucaagguacucacagauc

SEQ ID NO: 284673 - RNA, 64 nt, hsa
gggugcagaaaggugaauuaacuuuacaaaguagacaugacaagugaacagcagagcugggauc

SEQ ID NO: 284674 - RNA, 64 nt, hsa
gugucuugguugagagaauaaccucauaguaccaacaugacaugugacuuggaaagagacuaga

SEQ ID NO: 284675 - RNA, 64 nt, hsa
auguacuauucuauaaauugccuuucugaauagaacaugacaugccauuuucuagcagcugcca

SEQ ID NO: 284676 - RNA, 64 nt, hsa
aauaaugugauggcaaucuuaauuuuuggguacaacaugacaagcugugaguuuguguguuugu

SEQ ID NO: 284677 - RNA, 64 nt, hsa
guucaaaaggaaaagaguaugcccaauucucucuacaugacauauugagauuuuuuuuaaucaa

SEQ ID NO: 284678 - RNA, 64 nt, hsa
gcugugguuaggcuugguuagagugcagcaagcaacaugacagaugguggcacgcuguuuuuac

SEQ ID NO: 284679 - RNA, 64 nt, hsa
auuuuccaagcguguaauaaugauguuuuuccuaacaugacagaugaguaguaaauguugauau

SEQ ID NO: 284680 - RNA, 64 nt, hsa
ugacagaugaguaguaaauguugauauauccuauacaugacagugugagacuuuuucauuaaau

SEQ ID NO: 284681 - RNA, 64 nt, hsa
uaugauacaugcauaacuugagcuacacuaaaccacaugacaguguuuaguuaauucuuguaua

SEQ ID NO: 284682 - RNA, 64 nt, hsa
acuuucaaaauuauuagugacuaguaaugguuuuacaugacaauuuguaaucauaagagauggu

SEQ ID NO: 284683 - RNA, 64 nt, hsa
gauuaacuaauagaugcauagcacuuaacagagugcauagcauacacuguuuucaauaaaugca

SEQ ID NO: 284684 - RNA, 64 nt, hsa
aaaagucugaugaggaaaagauuaacuaauagaugcauagcacuuaacagagugcauagcauac

SEQ ID NO: 284685 - RNA, 64 nt, hsa
aagaauuguaguggucauggacagcuaagacugagcauagcaguucacauggucuggguaaaca

SEQ ID NO: 284686 - RNA, 64 nt, hsa
gccaggccacauggcuggagaggaauuucagggagcauagcaucgggaggaugcuacauaucca

SEQ ID NO: 284687 - RNA, 64 nt, hsa
ugcauguauacgcccauacagacaugcacacacagacuccuacuccauuagcuaacauacccuc

SEQ ID NO: 284688 - RNA, 64 nt, hsa
uucuuccugaauaaugucuucaguuucuugaggagacuccuaguuuugguuuucaaauuacuug

SEQ ID NO: 284689 - RNA, 64 nt, hsa
ucaugggaucccagcauccagauccuggauccuagacuccuaugccccaaccacugggucaugc

SEQ ID NO: 284690 - RNA, 64 nt, hsa
ccacgagaucccaguacccagauccuggauccuagacuccuaugccccaaccauugggucaugg

SEQ ID NO: 284691 - RNA, 64 nt, hsa
uaucugauuuuaaaaauuccuuuagucuguaaaacuccuagagggagggagguaacugaauuca

SEQ ID NO: 284692 - RNA, 64 nt, hsa
cugcaucuucguccagcgacccuuugcuuuucggcuccuagaauccuuagagucugaauuccuu

SEQ ID NO: 284693 - RNA, 64 nt, hsa
ucccauccugagcucucucaccuaccugcucucucuccuagagcaggauacugggguacuuuua

SEQ ID NO: 284694 - RNA, 64 nt, hsa; identical to SEQ ID NO: 154522

SEQ ID NO: 284695 - RNA, 64 nt, hsa; identical to SEQ ID NO: 154523

SEQ ID NO: 284696 - RNA, 64 nt, hsa; identical to SEQ ID NO: 154524

SEQ ID NO: 284697 - RNA, 64 nt, hsa; identical to SEQ ID NO: 154525

SEQ ID NO: 284698 - RNA, 64 nt, hsa; identical to SEQ ID NO: 154526

SEQ ID NO: 284699 - RNA, 64 nt, hsa; identical to SEQ ID NO: 154527

SEQ ID NO: 284700 - RNA, 64 nt, hsa; identical to SEQ ID NO: 154528

SEQ ID NO: 284701 - RNA, 64 nt, hsa; identical to SEQ ID NO: 154529

SEQ ID NO: 284702 - RNA, 64 nt, hsa; identical to SEQ ID NO: 154530

SEQ ID NO: 284703 - RNA, 64 nt, hsa; identical to SEQ ID NO: 154531

SEQ ID NO: 284704 - RNA, 64 nt, hsa; identical to SEQ ID NO: 154532

SEQ ID NO: 284705 - RNA, 64 nt, hsa; identical to SEQ ID NO: 154533

SEQ ID NO: 284706 - RNA, 64 nt, hsa; identical to SEQ ID NO: 154534

SEQ ID NO: 284707 - RNA, 64 nt, hsa; identical to SEQ ID NO: 154535

SEQ ID NO: 284708 - RNA, 64 nt, hsa; identical to SEQ ID NO: 154536

SEQ ID NO: 284709 - RNA, 64 nt, hsa; identical to SEQ ID NO: 154537

SEQ ID NO: 284710 - RNA, 64 nt, hsa; identical to SEQ ID NO: 154538

SEQ ID NO: 284711 - RNA, 64 nt, hsa; identical to SEQ ID NO: 154539

SEQ ID NO: 284712 - RNA, 64 nt, hsa; identical to SEQ ID NO: 154540

SEQ ID NO: 284713 - RNA, 64 nt, hsa; identical to SEQ ID NO: 154541

SEQ ID NO: 284714 - RNA, 64 nt, hsa; identical to SEQ ID NO: 154542

SEQ ID NO: 284715 - RNA, 64 nt, hsa; identical to SEQ ID NO: 154543

SEQ ID NO: 284716 - RNA, 64 nt, hsa; identical to SEQ ID NO: 154544

SEQ ID NO: 284717 - RNA, 64 nt, hsa; identical to SEQ ID NO: 154545

SEQ ID NO: 284718 - RNA, 64 nt, hsa; identical to SEQ ID NO: 154546

SEQ ID NO: 284719 - RNA, 64 nt, hsa; identical to SEQ ID NO: 154547

SEQ ID NO: 284720 - RNA, 64 nt, hsa; identical to SEQ ID NO: 154548

SEQ ID NO: 284721 - RNA, 64 nt, hsa; identical to SEQ ID NO: 154549

SEQ ID NO: 284722 - RNA, 64 nt, hsa; identical to SEQ ID NO: 154550

SEQ ID NO: 284723 - RNA, 64 nt, hsa; identical to SEQ ID NO: 154551

SEQ ID NO: 284724 - RNA, 64 nt, hsa
aggguugauggguuaccuuaaaaaguugauuuccuugaagcaguuugaaaauuugaauugaguc

SEQ ID NO: 284725 - RNA, 64 nt, hsa
uguuuugcauuugcuauaauuuucaaaauuauuuuugaagcaagacaaaaguuuaaugucagcu

SEQ ID NO: 284726 - RNA, 64 nt, hsa
gaauccaaccaguuucuuuguuaaaaggguccuuuugaagcaauuaagugcugguaagaauauu

SEQ ID NO: 284727 - RNA, 64 nt, hsa
ccuuccuuucuuuccugcuuccuuugccuuacaauugaagcagcccgugguaccaucacaguau

SEQ ID NO: 284728 - RNA, 64 nt, hsa
gaauggugaaaaagaacagaaagucuucaguuucuugaagcacuccuguccucaucccucugag

SEQ ID NO: 284729 - RNA, 64 nt, hsa
ggucagcucagucaagacagacauccuggcguacuugaagcaauucaaaaccaaauaggaaggu

SEQ ID NO: 284730 - RNA, 64 nt, hsa
cugucuugauuugaagcauaugauugagagccauuugaagcaaucuucauuaaugcagauaaaa

SEQ ID NO: 284731 - RNA, 64 nt, hsa
uguuuaugcugcuggaacuuagcacugucuugauuugaagcauaugauugagagccauuugaag

SEQ ID NO: 284732 - RNA, 64 nt, hsa
cccuagucuccaccugagacccugggagagaaguuugaagcacaacucccuuaaggucuccaaa

SEQ ID NO: 284733 - RNA, 64 nt, hsa
gguuauuuuggaguguaggugacuuguuuacucauugaagcagauuucugcuuccuuuuauuuu

SEQ ID NO: 284734 - RNA, 64 nt, hsa
gaucaaauaaaaaucuugugagauuguuuauguuuugaagcaggaggauuucuugagauuugau

SEQ ID NO: 284735 - RNA, 64 nt, hsa
ugaaauauuuucuuauugaauuaauauuuuugucuugaagcauuuucuagugauagaauguauu

SEQ ID NO: 284736 - RNA, 64 nt, hsa
ccugccuauuaacaaaaacccaauuuuguucauauugaagcaugaaauaaaugagagcaaggua

SEQ ID NO: 284737 - RNA, 64 nt, hsa
auguaaaacugcaaacuuaaaaaccugcaucuucuugaagcaucaguuuuacuuaccaaauggu

SEQ ID NO: 284738 - RNA, 64 nt, hsa
ugcagguuuguuuugcaugcuggacuagagcauauugaagcaugacugacuguuaaguuauaag

SEQ ID NO: 284739 - RNA, 64 nt, hsa
accaugaugaaguucgccugcuuugaacguacuguugaagcacuguacaaguuugugguuccua

SEQ ID NO: 284740 - RNA, 64 nt, hsa
aauuaacacucaaaacuauuuuuaaaauaugcauuugaagcaucuguugauuguauggauguaa

SEQ ID NO: 284741 - RNA, 64 nt, hsa
cuacaacauuuauuuaaaaagguaaaucuuuuuguugaagcagcaaguuaucugguagaacuua

SEQ ID NO: 284742 - RNA, 64 nt, hsa
aaggagaucuuccaccuaaacaguguucucuuauuugaagcaaaucuuuuugagaauuuguuua

SEQ ID NO: 284743 - RNA, 64 nt, hsa
auuguaaaacuagaaucaucaaaauuauuuguuguugaagcagucauaaaacugagacugagac

SEQ ID NO: 284744 - RNA, 64 nt, hsa
uaacauauucuuuaguagaacucacauuaucugcuugaagcacauuuugcuaauguuuuauuca

SEQ ID NO: 284745 - RNA, 64 nt, hsa
acaaauguagugacaguggccaaucccucaugaguugaagcauuaauagauaugagaggccaua

SEQ ID NO: 284746 - RNA, 64 nt, hsa
augacaagcucaaagugacagaauauguuauagguugaagcacacauauuugcaguuuacugaa

SEQ ID NO: 284747 - RNA, 64 nt, hsa
gaaauucuccagaaagauaguauuauagagucuuuugaagcaauuuuuugagaaauaguaaaau

SEQ ID NO: 284748 - RNA, 64 nt, hsa
uggugaccuagcauuuucaccaagaaguggacguggagaggaccagagugaucaaggguguaug

SEQ ID NO: 284749 - RNA, 64 nt, hsa
caacauggagauuagauuagagcaaggauguaagggagaggaagggacauagcaguauuucagg

SEQ ID NO: 284750 - RNA, 64 nt, hsa
gauguugguggugcagccccaggaccaagcuuaaggagaggagagcaucugcucugagacggau

SEQ ID NO: 284751 - RNA, 64 nt, hsa
aggugaccccaucucugcugcuucugggccugauggagaggagaacacuagacaugccaacucg

SEQ ID NO: 284752 - RNA, 64 nt, hsa
cuccucaagcagcgauuggagcccaagcaccccuggagaggaagggaggguccccacuggcccg

SEQ ID NO: 284753 - RNA, 64 nt, hsa
uagagucagagcggguuuggggcugaccaguuugggagaggagaaaagaucugagaauguccuu

SEQ ID NO: 284754 - RNA, 64 nt, hsa
uggcugagcccaggaaagcgacaagggugaacugggagaggacuuacucagagaccccaacagg

SEQ ID NO: 284755 - RNA, 64 nt, hsa
ggcacaggagucucuauagaacaguuccuagucuggagaggauauggaaauuuguucuuguucu

SEQ ID NO: 284756 - RNA, 64 nt, hsa
cgggagggcuggagaccaggccaugggcccucacggagaggaagggaaggaaggagagggaggg

SEQ ID NO: 284757 - RNA, 64 nt, hsa
ccccucuccaggcccagcuccccucuuggcagggggagaggauggcccagcaggccuggcccag

SEQ ID NO: 284758 - RNA, 64 nt, hsa
guccugcugaagccaggagggucuucccaagauaggagaggaaccgcagguggugagcggcugg

SEQ ID NO: 284759 - RNA, 64 nt, hsa
aauugauucuucaaauuaaaaguucuugagagaaggagaggaagauacagcagacauaggacug

SEQ ID NO: 284760 - RNA, 64 nt, hsa
cgcucggaaauccucucccgugccuuuagaggaaggagaggauugcugaggaaugcagggacgc

SEQ ID NO: 284761 - RNA, 64 nt, hsa
guaucuuuuccuccuguguuuaauguuucacuagggagaggaaauaaagcagaaggaacgugug

SEQ ID NO: 284762 - RNA, 64 nt, hsa
ucuaugugagcaagugagagaagguuagguaaggggagaggauggaaugcuugccuccaaugaa

SEQ ID NO: 284763 - RNA, 64 nt, hsa
ucuucuuccacacuaggcugggcccagcaauacaggagaggaugaagggaggagcuccaggagg

SEQ ID NO: 284764 - RNA, 64 nt, hsa
gaaugucgugaagaaguaucucugaauguauccaggagaggaacugcauaaccaaaggggugac

SEQ ID NO: 284765 - RNA, 64 nt, hsa
cugagggguuuaacaacaugcuccguagacgaagggagaggaggagagaaggcuuccuggguuu

SEQ ID NO: 284766 - RNA, 64 nt, hsa
ggcuauaaaacaaucuuguugggaaaaaugugggggagaggacuucuuccuacacgcgcauuga

SEQ ID NO: 284767 - RNA, 64 nt, hsa
cggggccuuaucgggcuccagccaucucaugaggggagaggagacggaggggaguagagaaguu

SEQ ID NO: 284768 - RNA, 64 nt, hsa
gcauaagugucuucauucccaccuggaggguuugggagaggagcaaagcaguugaaaacuaguu

SEQ ID NO: 284769 - RNA, 64 nt, hsa
ucuggucccaggagcucaggaggaggaccccaggggagaggagagcugugagagcaccggcacc

SEQ ID NO: 284770 - RNA, 64 nt, hsa
cuucccuccugcagugcugagaggcagcgaggacggagaggacagcggcaucucuaggcucuuc

SEQ ID NO: 284771 - RNA, 64 nt, hsa
cucucacuacagccagaagaggccuuucccaccgggagaggaacuuccagaccagccccucaca

SEQ ID NO: 284772 - RNA, 64 nt, hsa
cugcagaggccagcccggggcuggggaggcgcaaggagaggagggauccaguggggccgugggc

SEQ ID NO: 284773 - RNA, 64 nt, hsa
gcucugccucauucccuguucguaggaaggugcaggagaggaggugggcaagcuuauggguuuc

SEQ ID NO: 284774 - RNA, 64 nt, hsa
auuuuccagauccuaauuggaaauuuagcaauaaggagaggaguccaaggggacaaauaaaggc

SEQ ID NO: 284775 - RNA, 64 nt, hsa
aaaauaaauaucgcuuagaaugcaggagaaggguggagaggaggcaggggccgagggggugcuu

SEQ ID NO: 284776 - RNA, 64 nt, hsa
ggcgcgcaggcagggagaagggccgggggggguaggagaggagaaaaaaaaagugaaaaaaaga

SEQ ID NO: 284777 - RNA, 64 nt, hsa
ugaggugagacuucccagaccccggaggcguggaggagaggagacuguuugaugugguacaggg

SEQ ID NO: 284778 - RNA, 64 nt, hsa
aguccugagaagcuuugaccuugaagggcuucugggagaggaggaauuucugcauggggcguga

SEQ ID NO: 284779 - RNA, 64 nt, hsa
guggcugacacugagugaagguguuugaaaugcaggagaggauaucccagcaaauugggaucac

SEQ ID NO: 284780 - RNA, 64 nt, hsa
agggugagaggugaggcaagguucauccugaaugggagaggaagucgaaccacugcuguguguc

SEQ ID NO: 284781 - RNA, 64 nt, hsa
aauacuaaguuagaguuaguggauuucuaguuuaggagaggagcucaaaacuauaaucuuuaac

SEQ ID NO: 284782 - RNA, 64 nt, hsa
ugcaucaucuguacuugaagaggccagugggagaggagaggagggggaggucauuuaucugagu

SEQ ID NO: 284783 - RNA, 64 nt, hsa
auacaugcaucaucuguacuugaagaggccagugggagaggagaggagggggaggucauuuauc

SEQ ID NO: 284784 - RNA, 64 nt, hsa
gguuuucucaggaugaugucuugggugaggguagggagaggacaaggggucaccgagcccuucc

SEQ ID NO: 284785 - RNA, 64 nt, hsa
uucacugggcuccacccccaccuccaggaggggaggagaggaccugacaucuguagguggcccc

SEQ ID NO: 284786 - RNA, 64 nt, hsa
auccccacgugaacaaaaugggaaggagccgugaggagaggagugaggcaacaggcacccgaag

SEQ ID NO: 284787 - RNA, 64 nt, hsa
cccccaucucuaagucacucugaaagggaguuguggagaggagacgccuccagacucucagaag

SEQ ID NO: 284788 - RNA, 64 nt, hsa
cugagcaaauaaguacuuuccagccuguguuucaggagaggacugugcuggaucaugcuugccc

SEQ ID NO: 284789 - RNA, 64 nt, hsa
cucccaaacaggacaagcccaggcagggcugcauggagaggaauggaaccuggagcuagaauua

SEQ ID NO: 284790 - RNA, 64 nt, hsa
gggcagaggcaaaucaccgggcagagggaggggaggagaggaggccgcacucucccugucucuc

SEQ ID NO: 284791 - RNA, 64 nt, hsa
cccccagccagggaucccagaggcugaggguuggggagaggaagccaucaucucauuaccucug

SEQ ID NO: 284792 - RNA, 64 nt, hsa
cggcagguggccuaaggcugcuguaaaguugaggggagaggaaaucuuaagauuacaagauaaa

SEQ ID NO: 284793 - RNA, 64 nt, hsa
accaagcuuguuucccugcuggccaaagucaguaggagaggaugcacaguuugcuauuugcuuu

SEQ ID NO: 284794 - RNA, 64 nt, hsa
uauagcaaacuuggaauuuguaaccucagcucugggagaggauuuuuuucugagcgauuauuau

SEQ ID NO: 284795 - RNA, 64 nt, hsa
cuuggguucugauauugccgcacuaggggauauaggagaggaaaaguaaggugcaguuccccca

SEQ ID NO: 284796 - RNA, 64 nt, hsa
gggccacuugcuuaauugcauuucuggcagggaaggagaggagggauggagaagcucugcucgc

SEQ ID NO: 284797 - RNA, 64 nt, hsa
cgggagagagccgcagcuccguccacagcaccacggagaggacagcgccucuugggcugcuccc

SEQ ID NO: 284798 - RNA, 64 nt, hsa
auuccugugaggugucucaaaccaaaguuaacagggagaggaugggggaggggacaaauuagaa

SEQ ID NO: 284799 - RNA, 64 nt, hsa
agugaaaugaaaacgggcugaaaauaccaccccaggagaggaccucgccccaagcaagccagug

SEQ ID NO: 284800 - RNA, 64 nt, hsa
agugguugaggucugggggccaggccacauggcuggagaggaauuucagggagcauagcaucgg

SEQ ID NO: 284801 - RNA, 64 nt, hsa
ccacaggucagaauaugggacaggacauggucagggagaggacccugugaguuggugacauaua

SEQ ID NO: 284802 - RNA, 64 nt, hsa
cucuaccaagcuauccuggcucuuuggagaucaaggagaggaggcaacuuuccuuguuccccau

SEQ ID NO: 284803 - RNA, 64 nt, hsa
guuagagcugacacaaaccugccuggguuuaaggggagaggaaauauugcuggggucauuuaug

SEQ ID NO: 284804 - RNA, 64 nt, hsa
caaaucugaacaagcccaagucuuccaguucugaggagaggaggucuucaguacuauugaagga

SEQ ID NO: 284805 - RNA, 64 nt, hsa
acgucuucccuucucucccugcugcggcacuuauggagaggaucuaaagcagccgguguggcag

SEQ ID NO: 284806 - RNA, 64 nt, hsa
ggccaaccagugaacaccagcugugaaggccuugggagaggaggaacaggcccuugggcagaug

SEQ ID NO: 284807 - RNA, 64 nt, hsa
ucccccucugagcaacagacugcuugucuugcuaggagaggaggauggggggcugagcacucag

SEQ ID NO: 284808 - RNA, 64 nt, hsa
ugauguccggguccuuuaucauccuauucauccuggagaggaaaagugucgggcaaagggggau

SEQ ID NO: 284809 - RNA, 64 nt, hsa
gugugugggaaugauugaguccuguuugcaagcuggagaggagcucucccuuugcuaguacuuu

SEQ ID NO: 284810 - RNA, 64 nt, hsa
uugugaucaggccccuggggcggucaauaauuguggagaggagagaaugagagaguguggaaaa

SEQ ID NO: 284811 - RNA, 64 nt, hsa
cacgggggaggccgaggcaggggcugggcagaggggagaggaagcacaagaagugggaguggga

SEQ ID NO: 284812 - RNA, 64 nt, hsa
gcagaggggagaggaagcacaagaagugggagugggagaggaagccacgugcuggagaguagac

SEQ ID NO: 284813 - RNA, 64 nt, hsa
ccuguucugcccacucuggggaauagggaggggaggagaggagaggagagggaggauccuggag

SEQ ID NO: 284814 - RNA, 64 nt, hsa
ucugcccacucuggggaauagggaggggaggagaggagaggagagggaggauccuggaggacug

SEQ ID NO: 284815 - RNA, 64 nt, hsa
ccuagacuuauauacuaguuaguggugcagccagggagaggacucagauuuccuggaggcaaag

SEQ ID NO: 284816 - RNA, 64 nt, hsa
ggcugagauucgggaggaagugugacaccaagcaggagaggaagaaugauuuucuuuguacuua

SEQ ID NO: 284817 - RNA, 64 nt, hsa
ccgcugcucugugucguguuugcuguggccgcagggagaggagcaggacacgcaccuuuccagg

SEQ ID NO: 284818 - RNA, 64 nt, hsa
ucccccaggcccuccccagccgacgacagccaccggagaggagaucggaacacgauugucucag

SEQ ID NO: 284819 - RNA, 64 nt, hsa
agaacugaacccggaccugcucacugcccuggcuggagaggagcacaacagaugccacgucuuc

SEQ ID NO: 284820 - RNA, 64 nt, hsa
ggacggcaccugguaugcgggaggaacagagugaggagaggagggcagggcgugcagggccuug

SEQ ID NO: 284821 - RNA, 64 nt, hsa
guccuacccccuuuccccaccgagagcugggccgggagaggaccgcagggcagguggcgugagg

SEQ ID NO: 284822 - RNA, 64 nt, hsa
cccccaagugagauugcacauuuaacuacuguaaggagaggagcggcguuggcaaaugugaacc

SEQ ID NO: 284823 - RNA, 64 nt, hsa
ucuucuccuacaucccccaggccuuuugcaagaaggagaggaaugggggagaggacgugaggga

SEQ ID NO: 284824 - RNA, 64 nt, hsa
cccccaggccuuuugcaagaaggagaggaaugggggagaggacgugagggaccacccccaccca

SEQ ID NO: 284825 - RNA, 57 nt, hsa
ccccggaggagaagaaguagggggagaggagaggacucagcgggccccgucucuaua

SEQ ID NO: 284826 - RNA, 52 nt, hsa
ccccggaggagaagaaguagggggagaggagaggacucagcgggccccgucu

SEQ ID NO: 284827 - RNA, 64 nt, hsa
acccagguuggcgacugcaacaggaacuuggaguggagaggaaaagcaucagaaagaggcagac

SEQ ID NO: 284828 - RNA, 64 nt, hsa
uauaaugcgggugagaguaaugaggcuuggggcuggagaggacaagauggguaaacccucacau

SEQ ID NO: 284829 - RNA, 64 nt, hsa
cugccugcucaccccugggcugagggaagggagaggagaggaacaagggccuccgaaaccccaa

SEQ ID NO: 284830 - RNA, 64 nt, hsa
accgacugccugcucaccccugggcugagggaagggagaggagaggaacaagggccuccgaaac

SEQ ID NO: 284831 - RNA, 64 nt, hsa
auaucacaccccaaguggauaaaggcaacuugcaggagaggagagccagccaagaagaaaauuu

SEQ ID NO: 284832 - RNA, 64 nt, hsa
agcccugcaugcacuggcugaagaguuggucuguggagaggauuuucuugguuacuuguauuca

SEQ ID NO: 284833 - RNA, 64 nt, hsa
gaggguugaggcaggugccaauaauuacaucuuuggagaggauuugauuucugcccagggauuu

SEQ ID NO: 284834 - RNA, 64 nt, hsa
uuccaaagaguguggaauuuugguugggguggggggagaggagggaugcaacucgcccuguuug

SEQ ID NO: 284835 - RNA, 64 nt, hsa
ccuguguacccacuggguauccguuagagguaagggagaggagaggauugauagaguguugcaa

SEQ ID NO: 284836 - RNA, 64 nt, hsa
guacccacuggguauccguuagagguaagggagaggagaggauugauagaguguugcaaaagua

SEQ ID NO: 284837 - RNA, 64 nt, hsa
augaauggugaaagagaguggagauacggaagggggagaggagaggagaaauguggacagaggg

SEQ ID NO: 284838 - RNA, 64 nt, hsa
uggugaaagagaguggagauacggaagggggagaggagaggagaaauguggacagagggcuuga

SEQ ID NO: 284839 - RNA, 64 nt, hsa
uuggguuccagacagaguggaucuggagucugaaggagaggagugcgcuagagcauucuggggu

SEQ ID NO: 284840 - RNA, 64 nt, hsa
guagagaggacaguuuaggacccaagguggucuuggagaggagguguggaguggaggggucagc

SEQ ID NO: 284841 - RNA, 64 nt, hsa
uuguuuguucauuuucaguauuuuuauauugcuucccugcuauuucccuccuugggcucuuccc

SEQ ID NO: 284842 - RNA, 64 nt, hsa
cucuucugccucgucauggccagcugccaguacucccugcuaaaggcaagaccacaucuaauuc

SEQ ID NO: 284843 - RNA, 64 nt, hsa
ugguccagcacauccacgcuguauacgccacccacccugcuagugacuuaguagccgucuuggu

SEQ ID NO: 284844 - RNA, 64 nt, hsa
auucugucuuuacuccguggcaucuguggaauaacccugcuaauguaacacgugagaaagccuu

SEQ ID NO: 284845 - RNA, 64 nt, hsa
cgcuucggcagaauggagagcugaggugucccuccccugcuagucaccuaccaggugucugagc

SEQ ID NO: 284846 - RNA, 64 nt, hsa
gggugagagggagaagaccuugguuccuagccagcccugcuaaugugcuguguggccuucugua

SEQ ID NO: 284847 - RNA, 64 nt, hsa
ucauuuaaucauuucaaaguuaaucucugccaucucgcuaaaucaucagucucggcucuucuga

SEQ ID NO: 284848 - RNA, 64 nt, hsa
ugcuacaucaaacggaauggaagcauagcugacuucgcuaaaguuacuucaucuccaucuagca

SEQ ID NO: 284849 - RNA, 64 nt, hsa; identical to SEQ ID NO: 277339

SEQ ID NO: 284850 - RNA, 64 nt, hsa; identical to SEQ ID NO: 277340

SEQ ID NO: 284851 - RNA, 64 nt, hsa; identical to SEQ ID NO: 277341

SEQ ID NO: 284852 - RNA, 64 nt, hsa; identical to SEQ ID NO: 277342

SEQ ID NO: 284853 - RNA, 64 nt, hsa; identical to SEQ ID NO: 277343

SEQ ID NO: 284854 - RNA, 64 nt, hsa; identical to SEQ ID NO: 277344

SEQ ID NO: 284855 - RNA, 64 nt, hsa; identical to SEQ ID NO: 277345

SEQ ID NO: 284856 - RNA, 64 nt, hsa; identical to SEQ ID NO: 277346

SEQ ID NO: 284857 - RNA, 64 nt, hsa; identical to SEQ ID NO: 277347

SEQ ID NO: 284858 - RNA, 64 nt, hsa; identical to SEQ ID NO: 277348

SEQ ID NO: 284859 - RNA, 64 nt, hsa; identical to SEQ ID NO: 277349

SEQ ID NO: 284860 - RNA, 64 nt, hsa; identical to SEQ ID NO: 277350

SEQ ID NO: 284861 - RNA, 64 nt, hsa; identical to SEQ ID NO: 277351

SEQ ID NO: 284862 - RNA, 64 nt, hsa; identical to SEQ ID NO: 277352

SEQ ID NO: 284863 - RNA, 64 nt, hsa; identical to SEQ ID NO: 277353

SEQ ID NO: 284864 - RNA, 64 nt, hsa; identical to SEQ ID NO: 277354

SEQ ID NO: 284865 - RNA, 64 nt, hsa; identical to SEQ ID NO: 277355

SEQ ID NO: 284866 - RNA, 64 nt, hsa; identical to SEQ ID NO: 277356

SEQ ID NO: 284867 - RNA, 64 nt, hsa; identical to SEQ ID NO: 277357

SEQ ID NO: 284868 - RNA, 64 nt, hsa; identical to SEQ ID NO: 277358

SEQ ID NO: 284869 - RNA, 64 nt, hsa; identical to SEQ ID NO: 277359

SEQ ID NO: 284870 - RNA, 64 nt, hsa; identical to SEQ ID NO: 277360

SEQ ID NO: 284871 - RNA, 64 nt, hsa; identical to SEQ ID NO: 277361

SEQ ID NO: 284872 - RNA, 64 nt, hsa; identical to SEQ ID NO: 277362

SEQ ID NO: 284873 - RNA, 64 nt, hsa; identical to SEQ ID NO: 277363

SEQ ID NO: 284874 - RNA, 64 nt, hsa; identical to SEQ ID NO: 277364

SEQ ID NO: 284875 - RNA, 64 nt, hsa; identical to SEQ ID NO: 277365

SEQ ID NO: 284876 - RNA, 64 nt, hsa; identical to SEQ ID NO: 277366

SEQ ID NO: 284877 - RNA, 64 nt, hsa; identical to SEQ ID NO: 277367

SEQ ID NO: 284878 - RNA, 64 nt, hsa; identical to SEQ ID NO: 277368

SEQ ID NO: 284879 - RNA, 64 nt, hsa; identical to SEQ ID NO: 277369

SEQ ID NO: 284880 - RNA, 64 nt, hsa; identical to SEQ ID NO: 277370

SEQ ID NO: 284881 - RNA, 64 nt, hsa; identical to SEQ ID NO: 277371

SEQ ID NO: 284882 - RNA, 64 nt, hsa; identical to SEQ ID NO: 277372

SEQ ID NO: 284883 - RNA, 64 nt, hsa; identical to SEQ ID NO: 277373

SEQ ID NO: 284884 - RNA, 64 nt, hsa; identical to SEQ ID NO: 277374

SEQ ID NO: 284885 - RNA, 64 nt, hsa; identical to SEQ ID NO: 277375

SEQ ID NO: 284886 - RNA, 64 nt, hsa; identical to SEQ ID NO: 277376

SEQ ID NO: 284887 - RNA, 58 nt, hsa; identical to SEQ ID NO: 277377

SEQ ID NO: 284888 - RNA, 64 nt, hsa; identical to SEQ ID NO: 277378

SEQ ID NO: 284889 - RNA, 64 nt, hsa; identical to SEQ ID NO: 277379

SEQ ID NO: 284890 - RNA, 64 nt, hsa; identical to SEQ ID NO: 277380

SEQ ID NO: 284891 - RNA, 64 nt, hsa; identical to SEQ ID NO: 277381

SEQ ID NO: 284892 - RNA, 64 nt, hsa; identical to SEQ ID NO: 277382

SEQ ID NO: 284893 - RNA, 64 nt, hsa; identical to SEQ ID NO: 277383

SEQ ID NO: 284894 - RNA, 64 nt, hsa; identical to SEQ ID NO: 277384

SEQ ID NO: 284895 - RNA, 64 nt, hsa; identical to SEQ ID NO: 277385

SEQ ID NO: 284896 - RNA, 64 nt, hsa; identical to SEQ ID NO: 277386

SEQ ID NO: 284897 - RNA, 64 nt, hsa; identical to SEQ ID NO: 277387

SEQ ID NO: 284898 - RNA, 64 nt, hsa; identical to SEQ ID NO: 277388

SEQ ID NO: 284899 - RNA, 64 nt, hsa; identical to SEQ ID NO: 277389

SEQ ID NO: 284900 - RNA, 64 nt, hsa; identical to SEQ ID NO: 277390

SEQ ID NO: 284901 - RNA, 64 nt, hsa; identical to SEQ ID NO: 277391

SEQ ID NO: 284902 - RNA, 64 nt, hsa; identical to SEQ ID NO: 277392

SEQ ID NO: 284903 - RNA, 64 nt, hsa; identical to SEQ ID NO: 277393

SEQ ID NO: 284904 - RNA, 64 nt, hsa; identical to SEQ ID NO: 277394

SEQ ID NO: 284905 - RNA, 64 nt, hsa; identical to SEQ ID NO: 277395

SEQ ID NO: 284906 - RNA, 64 nt, hsa; identical to SEQ ID NO: 277396

SEQ ID NO: 284907 - RNA, 64 nt, hsa; identical to SEQ ID NO: 277397

SEQ ID NO: 284908 - RNA, 64 nt, hsa; identical to SEQ ID NO: 277398

SEQ ID NO: 284909 - RNA, 64 nt, hsa; identical to SEQ ID NO: 277399

SEQ ID NO: 284910 - RNA, 64 nt, hsa; identical to SEQ ID NO: 277400

SEQ ID NO: 284911 - RNA, 64 nt, hsa; identical to SEQ ID NO: 277401

SEQ ID NO: 284912 - RNA, 64 nt, hsa; identical to SEQ ID NO: 277402

SEQ ID NO: 284913 - RNA, 64 nt, hsa; identical to SEQ ID NO: 277403

SEQ ID NO: 284914 - RNA, 64 nt, hsa; identical to SEQ ID NO: 277404

SEQ ID NO: 284915 - RNA, 64 nt, hsa; identical to SEQ ID NO: 277405

SEQ ID NO: 284916 - RNA, 64 nt, hsa; identical to SEQ ID NO: 277406

SEQ ID NO: 284917 - RNA, 64 nt, hsa; identical to SEQ ID NO: 277407

SEQ ID NO: 284918 - RNA, 64 nt, hsa; identical to SEQ ID NO: 277408

SEQ ID NO: 284919 - RNA, 64 nt, hsa; identical to SEQ ID NO: 277409

SEQ ID NO: 284920 - RNA, 64 nt, hsa; identical to SEQ ID NO: 277410

SEQ ID NO: 284921 - RNA, 64 nt, hsa; identical to SEQ ID NO: 277411

SEQ ID NO: 284922 - RNA, 64 nt, hsa; identical to SEQ ID NO: 277412

SEQ ID NO: 284923 - RNA, 64 nt, hsa; identical to SEQ ID NO: 277413

SEQ ID NO: 284924 - RNA, 64 nt, hsa; identical to SEQ ID NO: 277414

SEQ ID NO: 284925 - RNA, 64 nt, hsa; identical to SEQ ID NO: 277415

SEQ ID NO: 284926 - RNA, 64 nt, hsa; identical to SEQ ID NO: 277416

SEQ ID NO: 284927 - RNA, 64 nt, hsa; identical to SEQ ID NO: 277417

SEQ ID NO: 284928 - RNA, 64 nt, hsa; identical to SEQ ID NO: 277418

SEQ ID NO: 284929 - RNA, 64 nt, hsa; identical to SEQ ID NO: 277419

SEQ ID NO: 284930 - RNA, 64 nt, hsa; identical to SEQ ID NO: 277420

SEQ ID NO: 284931 - RNA, 60 nt, hsa; identical to SEQ ID NO: 277421

SEQ ID NO: 284932 - RNA, 64 nt, hsa; identical to SEQ ID NO: 155572

SEQ ID NO: 284933 - RNA, 64 nt, hsa; identical to SEQ ID NO: 155573

SEQ ID NO: 284934 - RNA, 64 nt, hsa
caccuggccuccauucucuugggggagucuuggcacuuugcaaacauccuggccaccaugggca

SEQ ID NO: 284935 - RNA, 64 nt, hsa
cauucugaugccucccuggggaacaaggauaaugacuuugcaucugcaccuggaacggggccug

SEQ ID NO: 284936 - RNA, 64 nt, hsa
ccauaauauaaggaaggugagcuccucaacaauaacuuugcaauaauuaaaacuacccuaagua

SEQ ID NO: 284937 - RNA, 64 nt, hsa
uauauaaaugcuagaaauaugguuaauguauuuuacuuugcauuuguguaguacuuuauaguuu

SEQ ID NO: 284938 - RNA, 64 nt, hsa
aagucauaaagagcauauuuuagagcacaguaagacuuugcauggaguaaaacauuuuguaauu

SEQ ID NO: 284939 - RNA, 64 nt, hsa
uguuuuacuuauguggcaaagaacuggauauuaaacuuugcaaaagagaauuuagaugagagau

SEQ ID NO: 284940 - RNA, 64 nt, hsa
uuacagggguguagaauguaaucuacacaaggugacuuugcaucuaucuugcucuugaggugga

SEQ ID NO: 284941 - RNA, 64 nt, hsa
guuaaccuccugcuuccuuuguuaccucuggauuacuuugcaguaaauugcaggucuuuuaaga

SEQ ID NO: 284942 - RNA, 64 nt, hsa
agaccccccaccgugguucuuuucacagcccucgacuuugcacuuaaaaagggauauuguaaau

SEQ ID NO: 284943 - RNA, 64 nt, hsa
uccacauucuuaccuuugguagucagguuuggcuacuuugcagcucgcccaaagagauacaacc

SEQ ID NO: 284944 - RNA, 64 nt, hsa
gccagggccguuggcuuaugccuguaaucccagcacuuugcaggccgagguagacagauggcuu

SEQ ID NO: 284945 - RNA, 64 nt, hsa
agagccuuugugaauuaaaguggaagagaauaacacuuugcaugcuauaaacgugaaaacuaac

SEQ ID NO: 284946 - RNA, 64 nt, hsa
uuggcgggaccagcgggcauuuguuuucuugcugacuuugcaccuccuuuuuuccccaaacacu

SEQ ID NO: 284947 - RNA, 64 nt, hsa
agucagguggagccaccugcugggcucccccagaacuuugcacacaucuugcuauguauuagcc

SEQ ID NO: 284948 - RNA, 64 nt, hsa
ucaugucgucaugcaucugucaugaaugaaugauacuuugcacugggcuguacgacagugagga

SEQ ID NO: 284949 - RNA, 63 nt, hsa
aauuaccaaaaggguccauuauuucauaagaguuacuuugcaaaaaaaaaaauguggguuuuu

SEQ ID NO: 284950 - RNA, 64 nt, hsa; identical to SEQ ID NO: 199527

SEQ ID NO: 284951 - RNA, 64 nt, hsa; identical to SEQ ID NO: 199528

SEQ ID NO: 284952 - RNA, 64 nt, hsa; identical to SEQ ID NO: 199529

SEQ ID NO: 284953 - RNA, 64 nt, hsa; identical to SEQ ID NO: 199530

SEQ ID NO: 284954 - RNA, 64 nt, hsa; identical to SEQ ID NO: 199531

SEQ ID NO: 284955 - RNA, 64 nt, hsa; identical to SEQ ID NO: 199532

SEQ ID NO: 284956 - RNA, 64 nt, hsa; identical to SEQ ID NO: 199533

SEQ ID NO: 284957 - RNA, 64 nt, hsa; identical to SEQ ID NO: 199534

SEQ ID NO: 284958 - RNA, 64 nt, hsa; identical to SEQ ID NO: 199535

SEQ ID NO: 284959 - RNA, 64 nt, hsa; identical to SEQ ID NO: 199536

SEQ ID NO: 284960 - RNA, 64 nt, hsa; identical to SEQ ID NO: 199537

SEQ ID NO: 284961 - RNA, 64 nt, hsa; identical to SEQ ID NO: 199538

SEQ ID NO: 284962 - RNA, 64 nt, hsa; identical to SEQ ID NO: 199539

SEQ ID NO: 284963 - RNA, 64 nt, hsa; identical to SEQ ID NO: 199540

SEQ ID NO: 284964 - RNA, 64 nt, hsa; identical to SEQ ID NO: 199541

SEQ ID NO: 284965 - RNA, 64 nt, hsa; identical to SEQ ID NO: 199542

SEQ ID NO: 284966 - RNA, 64 nt, hsa; identical to SEQ ID NO: 199543

SEQ ID NO: 284967 - RNA, 64 nt, hsa; identical to SEQ ID NO: 199544

SEQ ID NO: 284968 - RNA, 64 nt, hsa; identical to SEQ ID NO: 199545

SEQ ID NO: 284969 - RNA, 64 nt, hsa; identical to SEQ ID NO: 199546

SEQ ID NO: 284970 - RNA, 64 nt, hsa; identical to SEQ ID NO: 199547

SEQ ID NO: 284971 - RNA, 64 nt, hsa; identical to SEQ ID NO: 199548

SEQ ID NO: 284972 - RNA, 64 nt, hsa; identical to SEQ ID NO: 199549

SEQ ID NO: 284973 - RNA, 64 nt, hsa; identical to SEQ ID NO: 199550

SEQ ID NO: 284974 - RNA, 64 nt, hsa; identical to SEQ ID NO: 199551

SEQ ID NO: 284975 - RNA, 64 nt, hsa; identical to SEQ ID NO: 199552

SEQ ID NO: 284976 - RNA, 64 nt, hsa; identical to SEQ ID NO: 199553

SEQ ID NO: 284977 - RNA, 64 nt, hsa; identical to SEQ ID NO: 199554

SEQ ID NO: 284978 - RNA, 64 nt, hsa; identical to SEQ ID NO: 199555

SEQ ID NO: 284979 - RNA, 64 nt, hsa; identical to SEQ ID NO: 199556

SEQ ID NO: 284980 - RNA, 64 nt, hsa; identical to SEQ ID NO: 199557

SEQ ID NO: 284981 - RNA, 64 nt, hsa; identical to SEQ ID NO: 199558

SEQ ID NO: 284982 - RNA, 64 nt, hsa; identical to SEQ ID NO: 199559

SEQ ID NO: 284983 - RNA, 64 nt, hsa; identical to SEQ ID NO: 199560

SEQ ID NO: 284984 - RNA, 64 nt, hsa; identical to SEQ ID NO: 199561

SEQ ID NO: 284985 - RNA, 64 nt, hsa; identical to SEQ ID NO: 199562

SEQ ID NO: 284986 - RNA, 64 nt, hsa; identical to SEQ ID NO: 199563

SEQ ID NO: 284987 - RNA, 64 nt, hsa; identical to SEQ ID NO: 199564

SEQ ID NO: 284988 - RNA, 64 nt, hsa; identical to SEQ ID NO: 199565

SEQ ID NO: 284989 - RNA, 64 nt, hsa; identical to SEQ ID NO: 199566

SEQ ID NO: 284990 - RNA, 64 nt, hsa; identical to SEQ ID NO: 199567

SEQ ID NO: 284991 - RNA, 64 nt, hsa; identical to SEQ ID NO: 199568

SEQ ID NO: 284992 - RNA, 64 nt, hsa; identical to SEQ ID NO: 199569

SEQ ID NO: 284993 - RNA, 64 nt, hsa; identical to SEQ ID NO: 199570

SEQ ID NO: 284994 - RNA, 64 nt, hsa; identical to SEQ ID NO: 199571

SEQ ID NO: 284995 - RNA, 64 nt, hsa; identical to SEQ ID NO: 199572

SEQ ID NO: 284996 - RNA, 64 nt, hsa; identical to SEQ ID NO: 199573

SEQ ID NO: 284997 - RNA, 64 nt, hsa; identical to SEQ ID NO: 199574

SEQ ID NO: 284998 - RNA, 64 nt, hsa; identical to SEQ ID NO: 199575

SEQ ID NO: 284999 - RNA, 64 nt, hsa; identical to SEQ ID NO: 199576

SEQ ID NO: 285000 - RNA, 64 nt, hsa; identical to SEQ ID NO: 199577

SEQ ID NO: 285001 - RNA, 64 nt, hsa; identical to SEQ ID NO: 199578

SEQ ID NO: 285002 - RNA, 64 nt, hsa; identical to SEQ ID NO: 199579

SEQ ID NO: 285003 - RNA, 64 nt, hsa; identical to SEQ ID NO: 199580

SEQ ID NO: 285004 - RNA, 64 nt, hsa; identical to SEQ ID NO: 199581

SEQ ID NO: 285005 - RNA, 64 nt, hsa; identical to SEQ ID NO: 199582

SEQ ID NO: 285006 - RNA, 64 nt, hsa; identical to SEQ ID NO: 199583

SEQ ID NO: 285007 - RNA, 64 nt, hsa; identical to SEQ ID NO: 199584

SEQ ID NO: 285008 - RNA, 64 nt, hsa; identical to SEQ ID NO: 199585

SEQ ID NO: 285009 - RNA, 64 nt, hsa; identical to SEQ ID NO: 199586

SEQ ID NO: 285010 - RNA, 64 nt, hsa; identical to SEQ ID NO: 199587

SEQ ID NO: 285011 - RNA, 64 nt, hsa; identical to SEQ ID NO: 199588

SEQ ID NO: 285012 - RNA, 64 nt, hsa; identical to SEQ ID NO: 199589

SEQ ID NO: 285013 - RNA, 64 nt, hsa; identical to SEQ ID NO: 199590

SEQ ID NO: 285014 - RNA, 64 nt, hsa; identical to SEQ ID NO: 199591

SEQ ID NO: 285015 - RNA, 64 nt, hsa; identical to SEQ ID NO: 199592

SEQ ID NO: 285016 - RNA, 64 nt, hsa; identical to SEQ ID NO: 199593

SEQ ID NO: 285017 - RNA, 64 nt, hsa; identical to SEQ ID NO: 199594

SEQ ID NO: 285018 - RNA, 64 nt, hsa; identical to SEQ ID NO: 199595

SEQ ID NO: 285019 - RNA, 64 nt, hsa; identical to SEQ ID NO: 199596

SEQ ID NO: 285020 - RNA, 64 nt, hsa; identical to SEQ ID NO: 199597

SEQ ID NO: 285021 - RNA, 64 nt, hsa; identical to SEQ ID NO: 199598

SEQ ID NO: 285022 - RNA, 64 nt, hsa; identical to SEQ ID NO: 199599

SEQ ID NO: 285023 - RNA, 64 nt, hsa; identical to SEQ ID NO: 199600

SEQ ID NO: 285024 - RNA, 64 nt, hsa; identical to SEQ ID NO: 199601

SEQ ID NO: 285025 - RNA, 64 nt, hsa; identical to SEQ ID NO: 199602

SEQ ID NO: 285026 - RNA, 64 nt, hsa; identical to SEQ ID NO: 199603

SEQ ID NO: 285027 - RNA, 64 nt, hsa; identical to SEQ ID NO: 199604

SEQ ID NO: 285028 - RNA, 64 nt, hsa
cucuacuuggguagaaaauauuuuaucucuagugauugcauauuauuuccauaucauaguauuu

SEQ ID NO: 285029 - RNA, 64 nt, hsa
aaaaaccaaauuauccaaaauuauuuuauuaaauauugcauacaaaagaaaauguguaaggcuu

SEQ ID NO: 285030 - RNA, 64 nt, hsa
ugcauaguagggugacuagaguuaacaauaaccuauugcauauauuuugaaauagcuagaagag

SEQ ID NO: 285031 - RNA, 64 nt, hsa
uaaaaacuucacauuaaauaagugcuaauguuuuauugcauaguagggugacuagaguuaacaa

SEQ ID NO: 285032 - RNA, 64 nt, hsa
auuauuuguaggaaugucuuccuaauggggaagaauugcauaggagcauuaugcaaaucuacac

SEQ ID NO: 285033 - RNA, 64 nt, hsa
aaaaagaaacugauuuaccuaaguuuacuuuuuaauugcauaauagagcauuuuuuguuuugag

SEQ ID NO: 285034 - RNA, 64 nt, hsa
gucuuuuggccauaagugggaaaguuuucuguauauugcauagcauuacacauuuaugccuauu

SEQ ID NO: 285035 - RNA, 64 nt, hsa
ucaugcagaauuuugaaauguuuucaguuuguauauugcauauucacaugaucauuguucacua

SEQ ID NO: 285036 - RNA, 64 nt, hsa
cccucuguaucacagguaucucgggggagcuuugugccuugauggaucaaguucaucauaugca

SEQ ID NO: 285037 - RNA, 64 nt, hsa
uaaauccucuccucucccuucuguagguacuagcugccuugauuuuuuuuuguggguggggggg

SEQ ID NO: 285038 - RNA, 64 nt, hsa
caugacagaaaguggggaaaaugccgcaguuuguugccuugaaaccuaagagcaauccuugguu

SEQ ID NO: 285039 - RNA, 64 nt, hsa
cuuggcaaaaaucacuauaaggcagcucuaaauuugccuugauaagcuaaauaaauuacuuuua

SEQ ID NO: 285040 - RNA, 64 nt, hsa
ccggacaguuaaaucagaaccucagacagcaauaugccuugagaugccuugaaccaugcuugag

SEQ ID NO: 285041 - RNA, 64 nt, hsa
aaaucagaaccucagacagcaauaugccuugagaugccuugaaccaugcuugagaaggaaggac

SEQ ID NO: 285042 - RNA, 64 nt, hsa
ggugcacucagcugcccagggccucugggacacuugccuugacuugcaacuugccuugaacauc

SEQ ID NO: 285043 - RNA, 64 nt, hsa
agggccucugggacacuugccuugacuugcaacuugccuugaacaucacgaucaaagcagcagg

SEQ ID NO: 285044 - RNA, 64 nt, hsa
aauugauuuuuauuugacucuguggcucuaagacugccuugaaccgccugaggccuaugcaucu

SEQ ID NO: 285045 - RNA, 64 nt, hsa
uaaauuuuaaaagauuaucaggauaacaugaccuugccuugaaaaaccuaaauuucauacagaa

SEQ ID NO: 285046 - RNA, 64 nt, hsa
auuauagauacaguuuugggauauauacaaggauugccuugaucuggcacuuacugauacaagc

SEQ ID NO: 285047 - RNA, 64 nt, hsa
aaacugacucacuugauuggaaaauggacaaaagugccuugacguggagggugggcaccagaug

SEQ ID NO: 285048 - RNA, 64 nt, hsa
ccuccugaggcccaggucuuuguccccaguugugugccuugaccucucucgccccuuucugggu

SEQ ID NO: 285049 - RNA, 64 nt, hsa
accuccccugccagggcucgggcgcuguggcuccugccuugaugaagcccguguccugccuuga

SEQ ID NO: 285050 - RNA, 64 nt, hsa
cgcuguggcuccugccuugaugaagcccguguccugccuugaugaagccugugccaccugcaag

SEQ ID NO: 285051 - RNA, 64 nt, hsa
agccuggagcugcuauugcuuaggaaguuguacgugccuugaaauguccacuaccugaggacgc

SEQ ID NO: 285052 - RNA, 64 nt, hsa
ugcccgaggcccacgcauccauccacuccuuuagugccuugaaucucauucacaagcagccccc

SEQ ID NO: 285053 - RNA, 64 nt, hsa
cuacaucacuuguaucuccagcccaaauguagucugccuugaaaagucuuucagcugugacugc

SEQ ID NO: 285054 - RNA, 64 nt, hsa
cuauguuuuuaauguacagcaucuguacuuuguuugccuugauaaagguaagauaaaugaaacg

SEQ ID NO: 285055 - RNA, 64 nt, hsa
caucucugccuugagacugccuugagacagugcuugccuugagagagugagccaauuaacagcu

SEQ ID NO: 285056 - RNA, 64 nt, hsa
ucuguuuuuugcugugucaucucugccuugagacugccuugagacagugcuugccuugagagag

SEQ ID NO: 285057 - RNA, 64 nt, hsa
uuuucucccccucuguuuuuugcugugucaucucugccuugagacugccuugagacagugcuug

SEQ ID NO: 285058 - RNA, 64 nt, hsa; identical to SEQ ID NO: 105601

SEQ ID NO: 285059 - RNA, 64 nt, hsa; identical to SEQ ID NO: 105602

SEQ ID NO: 285060 - RNA, 64 nt, hsa; identical to SEQ ID NO: 105603

SEQ ID NO: 285061 - RNA, 64 nt, hsa; identical to SEQ ID NO: 105604

SEQ ID NO: 285062 - RNA, 64 nt, hsa; identical to SEQ ID NO: 105605

SEQ ID NO: 285063 - RNA, 64 nt, hsa; identical to SEQ ID NO: 105606

SEQ ID NO: 285064 - RNA, 64 nt, hsa; identical to SEQ ID NO: 105607

SEQ ID NO: 285065 - RNA, 64 nt, hsa; identical to SEQ ID NO: 105608

SEQ ID NO: 285066 - RNA, 64 nt, hsa; identical to SEQ ID NO: 105609

SEQ ID NO: 285067 - RNA, 64 nt, hsa; identical to SEQ ID NO: 105610

SEQ ID NO: 285068 - RNA, 64 nt, hsa; identical to SEQ ID NO: 105611

SEQ ID NO: 285069 - RNA, 64 nt, hsa; identical to SEQ ID NO: 105612

SEQ ID NO: 285070 - RNA, 64 nt, hsa; identical to SEQ ID NO: 105613

SEQ ID NO: 285071 - RNA, 64 nt, hsa; identical to SEQ ID NO: 105614

SEQ ID NO: 285072 - RNA, 64 nt, hsa
acucguugagcagcaacgcaaucaccaucaucccacugcccaaucuagaauaugucugcucucc

SEQ ID NO: 285073 - RNA, 64 nt, hsa
acccucaugaaaaauuaauccucaguuccacgagacugcccacccacagacaaaaaaauauaua

SEQ ID NO: 285074 - RNA, 64 nt, hsa
uugcaguuaacaucuagaguguuguuuccaucccacugcccaagcauuggcauggucaugaaug

SEQ ID NO: 285075 - RNA, 64 nt, hsa
ugaugaccauaagcaggaggauuccaccauggucacugcccauccagucacagggauucugugu

SEQ ID NO: 285076 - RNA, 64 nt, hsa
caagcauacuuaccaguacugcccaccaccacccacugcccaccucuaagaagcccggcucucc

SEQ ID NO: 285077 - RNA, 64 nt, hsa
ggcaagucccagccacccaagcauacuuaccaguacugcccaccaccacccacugcccaccucu

SEQ ID NO: 285078 - RNA, 64 nt, hsa
ccaugccagccccacggugguccaugacugcggaacugcccagacauaagcaggagccuccgag

SEQ ID NO: 285079 - RNA, 64 nt, hsa
agugguguguaccccuaaauccucccaccccagcacugcccaucuguaaaaucuuguaaagccc

SEQ ID NO: 285080 - RNA, 64 nt, hsa
ccaugggucugacccuuggacucugccaggaucaacugcccagagugccagaguuuuagccaaa

SEQ ID NO: 285081 - RNA, 64 nt, hsa
uaaauccccaguuccucaaggccugugccccaugacugcccauguuucugaggcuucagagucg

SEQ ID NO: 285082 - RNA, 64 nt, hsa
agggacucaucuugcauggcaccgccggccagacacugcccaaggaccaguauuugucacuacc

SEQ ID NO: 285083 - RNA, 64 nt, hsa
agaaacuagcucugauccuaacaggccacguuaaacugcccaucuggagaaucgccugcaggug

SEQ ID NO: 285084 - RNA, 64 nt, hsa
cuccaagagguuuuucagcucuuugacaacgccaacugcccaagccuacagaacaaaccaaaaa

SEQ ID NO: 285085 - RNA, 64 nt, hsa
gugaugccgguaaagaaaaguugccgaagaugagacugcccacgcgcucagacaugauaugcgg

SEQ ID NO: 285086 - RNA, 64 nt, hsa
ggauuccucagggccuacuggaaugugacugcccacugcccagcugccucggguacaaguccug

SEQ ID NO: 285087 - RNA, 64 nt, hsa
uauuuggggauuccucagggccuacuggaaugugacugcccacugcccagcugccucggguaca

SEQ ID NO: 285088 - RNA, 64 nt, hsa
ucuugcagcccagaaccaagucagccucccugcgacugcccaggcacacugcccaccaccccac

SEQ ID NO: 285089 - RNA, 64 nt, hsa
aaccaagucagccucccugcgacugcccaggcacacugcccaccaccccacccccgaaacaaug

SEQ ID NO: 285090 - RNA, 64 nt, hsa
ccuucagccucccuuuguaaugcugcuccucuccacugcccagcaccaugaguugggugcagac

SEQ ID NO: 285091 - RNA, 64 nt, hsa
cguggaacugaccuaggggggccaaauuggggagacugcccacuccccccuccaugcugggguu

SEQ ID NO: 285092 - RNA, 62 nt, hsa
gccacagugcucacaacuagccgggaggcaagacugcccaacugucagguaaauucagaugu

SEQ ID NO: 285093 - RNA, 64 nt, hsa
ucugggguggaaguuuuguagccacacacaggauacugcccaagauccagcggguguuuucuuc

SEQ ID NO: 285094 - RNA, 64 nt, hsa
auugugggaggaaaugcuagguuuuuguguguggacugcccagaccucagccaggucuucugga

SEQ ID NO: 285095 - RNA, 64 nt, hsa
cucuccacaucuuucccugacucuuggauaugaaacugcccagcauuccugggagucuuaggau

SEQ ID NO: 285096 - RNA, 64 nt, hsa
cggccugcagaacaucuguccccaagccagcuccacugcccaggcccccaagagggcagcucca

SEQ ID NO: 285097 - RNA, 64 nt, hsa
gccugagucccaggaggccuccuggaagcccaggacugcccacccaccacgcuggugcccaccg

SEQ ID NO: 285098 - RNA, 64 nt, hsa
caggacccccuuuggagaugcccauggcaugggcacugcccacaggcucagccagaaccucuug

SEQ ID NO: 285099 - RNA, 64 nt, hsa
cuuuuugcucaggggccaaacacugaaggcacguacugcccaacccacugagcgccugaggcca

SEQ ID NO: 285100 - RNA, 64 nt, hsa
ucucugagcugggugggaggccauccuggcgaccacugcccauuccauucaccccucacuguac

SEQ ID NO: 285101 - RNA, 64 nt, hsa
cuuccaauagaaaauuccgcuugaccuuuggugcacugcccacuucccagcuccacuggcccaa

SEQ ID NO: 285102 - RNA, 64 nt, hsa
uuuuuauuaacccuggcuuuggugguaagggaaacuuccagaaaugcuuguggguauauuggau

SEQ ID NO: 285103 - RNA, 64 nt, hsa
gaacugugggugacuuuauccucacaucguguuucuuccagaaauucagacgcaacagagguua

SEQ ID NO: 285104 - RNA, 64 nt, hsa
auaagucugggcacuggaugcaugaauuccacuccuuccagaaccaacugcauugguuuuccau

SEQ ID NO: 285105 - RNA, 64 nt, hsa
gggcaccuuaaaacuuaacuauccuuccagggcucuuccagaugaggcccaaaacauauauagg

SEQ ID NO: 285106 - RNA, 64 nt, hsa
uccuucgauuccauuuuaccuccucuucugaucacuuccagagaugagcuguuucuggauaaug

SEQ ID NO: 285107 - RNA, 64 nt, hsa
aaaacagacucccacugucuccagaagucguggccuuccagaacagucugccccucaaggaagg

SEQ ID NO: 285108 - RNA, 64 nt, hsa
gcucucccugauagaugcugagagcauccagaaacuuccagaccagcccucucaccacacccag

SEQ ID NO: 285109 - RNA, 64 nt, hsa
cacccagaagaggccuuucccaucuggagagaagcuuccagaccagcccuucacacaccacagc

SEQ ID NO: 285110 - RNA, 64 nt, hsa
cagccaggaggggccuuucccaccuggagagaaacuuccagaccagccccucauaccacagcca

SEQ ID NO: 285111 - RNA, 64 nt, hsa
cagccaggagaggccuuucccaccgguagagaaacuuccagaccagccccucacaccacagcca

SEQ ID NO: 285112 - RNA, 64 nt, hsa
cagccaagagaagccuuuccagccuggagagaaacuuccagaccagcccucucacuacagccag

SEQ ID NO: 285113 - RNA, 64 nt, hsa
cagccaggagaggccuuucccaccuggacagaaacuuccagaccagccccucucaccacagcca

SEQ ID NO: 285114 - RNA, 64 nt, hsa
cagccaggagaggccuuuaccaccuggagagaagcuuccagaccagccccucacaccacagcca

SEQ ID NO: 285115 - RNA, 64 nt, hsa
cagccaggagaggccuuucccaccuggagagaaacuuccagaccagccccucauaccacagcca

SEQ ID NO: 285116 - RNA, 64 nt, hsa
cagccaagaggggccuuucucaccuggagagaaacuuccagaccagccccucacaccaccgcca

SEQ ID NO: 285117 - RNA, 64 nt, hsa
ccgccaggagaggccuuucccaccgggagagaaacuuccagaccagccccucacaccacagcca

SEQ ID NO: 285118 - RNA, 64 nt, hsa
cagccaggagaggccuuucccaccgggagagaaacuuccagaccagcccucucacuacagccag

SEQ ID NO: 285119 - RNA, 64 nt, hsa
cagccagaagaggccuuucccaccgggagaggaacuuccagaccagccccucacaccacagcca

SEQ ID NO: 285120 - RNA, 64 nt, hsa
cagccaggagaggccguuccugccuggagagaagcuuccagaccagcccuucacaccacagcca

SEQ ID NO: 285121 - RNA, 64 nt, hsa
cagccaggagaggccuuucccaccuggagagaaacuuccagaccagccccucucaccacagcca

SEQ ID NO: 285122 - RNA, 64 nt, hsa
cagugaagaguaaguuuucccuccuacucucgaucuuccagaagcuguacuuuuaccaguuucu

SEQ ID NO: 285123 - RNA, 64 nt, hsa
uaaauguaaguauuacaugacaugcauucuguuucuuccagaguucugucugccacacgaaaga

SEQ ID NO: 285124 - RNA, 64 nt, hsa
guagugaccggcagggcuggggugagaccccucccuuccagaauccaggccccaucucccccaa

SEQ ID NO: 285125 - RNA, 64 nt, hsa
gcuuaaacaggguucucugucauuuuccuguuuucuuccagagucccaauccuuugcccuaguu

SEQ ID NO: 285126 - RNA, 64 nt, hsa
uggcacccugaggucaggggauccuaaggguguccuuccagagacgguguuuccagggggagga

SEQ ID NO: 285127 - RNA, 64 nt, hsa
agagacgguguuuccagggggaggaccgcccccgcuuccagauccccggccccggcugugacug

SEQ ID NO: 285128 - RNA, 64 nt, hsa
cucuagggugcuucuuccagagucugucuucuugcuuccagauguggucaacuucuggaacacu

SEQ ID NO: 285129 - RNA, 64 nt, hsa
agugaaggggguuccuggagucucuagggugcuucuuccagagucugucuucuugcuuccagau

SEQ ID NO: 285130 - RNA, 64 nt, hsa
agugucacacugggagcugggcacagccgaucuccuuccagaaggguucugucuguauccuuua

SEQ ID NO: 285131 - RNA, 64 nt, hsa
cccacccccggccaacuaaccacugcaggcuccucuuccagacucaccagggggccucgaggcc

SEQ ID NO: 285132 - RNA, 64 nt, hsa
accaggaacccagacaccaccuccaacucugagccuuccagagcuucagccucucuucgucguc

SEQ ID NO: 285133 - RNA, 64 nt, hsa
gcccuggacagagagccuccagagagugaacagucuuccagaucugggccaaucauccuggaca

SEQ ID NO: 285134 - RNA, 64 nt, hsa
auugggaaguuugguugagguucaagugugacuccuuccagagccacagguaggggagugugaa

SEQ ID NO: 285135 - RNA, 64 nt, hsa
uguggcuccuagugcaaaccggaaaccauggcaccuuccagagccguggucucaaggagucaga

SEQ ID NO: 285136 - RNA, 64 nt, hsa
uaaccauccuugagcccagauggggcucagggcccuuccagagccugucauguccuugugcagu

SEQ ID NO: 285137 - RNA, 64 nt, hsa
uguaugggcucccaaggacccagcagccuggauccuuccagagcaucccuccuggaggccuggg

SEQ ID NO: 285138 - RNA, 64 nt, hsa
cuggccgucaugacagcugcuuggagacccgugccuuccagauggcugggagaugccucugugg

SEQ ID NO: 285139 - RNA, 64 nt, hsa
uuuauagaacuucuggaucuaacucacaaacaagcuuccagaagagacuagagaccuuaggcca

SEQ ID NO: 285140 - RNA, 64 nt, hsa
caccagcgggaacagggcaccccuucugcacugacuuccagaucaugguucucccuuccucccu

SEQ ID NO: 285141 - RNA, 64 nt, hsa
ggccccuggcuccgcagucacccuccaucagaugcuuccagaagcaccuacucugugcaagggc

SEQ ID NO: 285142 - RNA, 64 nt, hsa
gaugcuuccugugcccucucaagccaguucuucucuuccagaagaauucagaguaugugucuca

SEQ ID NO: 285143 - RNA, 64 nt, hsa
ggguguggcugcccaaccccauccagagcaucugcuuccagaugagccagugccucgcaugaua

SEQ ID NO: 285144 - RNA, 64 nt, hsa
auguuaauauugcuuuaugaauuaacagucuguucuuccagaguccagagacauuguuaauaaa

SEQ ID NO: 285145 - RNA, 64 nt, hsa
ugaaugcaguugcauugauucagugccaaggucacuuccagaauucagaguugugaugcucucu

SEQ ID NO: 285146 - RNA, 64 nt, hsa
augagcacaaggugauucaggccagcuggagaagcuuccagaagggcccugcacugcuacccuc

SEQ ID NO: 285147 - RNA, 64 nt, hsa
cucuccgggagcagacuucagcuugcccucucugcuuccagagcaccuccuagauaccucucuu

SEQ ID NO: 285148 - RNA, 64 nt, hsa
ccaugcuccaacucccacacaaacgcuucuaccccuuccagaacuuacccaucauccccccaug

SEQ ID NO: 285149 - RNA, 64 nt, hsa
ugccuaugcucucaccuucccugguugcuccuggcuuccagacugggccuugguguuugcugga

SEQ ID NO: 285150 - RNA, 64 nt, hsa
agaggugucagagguggcugugccagaggugcggcuuccagaggugcagcugccgaaagugcca

SEQ ID NO: 285151 - RNA, 64 nt, hsa
aaaggugccagagauggcugugccggaggugcggcuuccagagguacagcugccgaaaguguca

SEQ ID NO: 285152 - RNA, 64 nt, hsa
aaaggugccagagauggcugugccggaggugcggcuuccagagguacagcugcugaaagugucg

SEQ ID NO: 285153 - RNA, 64 nt, hsa
aaaggugccagagauggcugugccggaggugcggcuuccagagguagagcugcccaaaguguca

SEQ ID NO: 285154 - RNA, 64 nt, hsa
ugaggucaagcuuccaaaagugcccgaggcagcccuuccagagguucgacucccagagguggag

SEQ ID NO: 285155 - RNA, 64 nt, hsa
cuucugccccgcagaaagcagaccugcgagaucucuuccagaaggcugcuaagaagcaccagaa

SEQ ID NO: 285156 - RNA, 64 nt, hsa
gccuucuauccagccggcacccuaugcucuacagcuuccagacaucucugcccaagcuuccugu

SEQ ID NO: 285157 - RNA, 64 nt, hsa
ucagggugcuccagcgcuggggaguggugagggccuuccagagauccucguacucuuucucccg

SEQ ID NO: 285158 - RNA, 64 nt, hsa
guccucucacccccagcaguugccaugggguuuccuuccagauucgaggauccuugccacuuga

SEQ ID NO: 285159 - RNA, 64 nt, hsa
gcucccuauuuggaagcaagcggggcaaggggcccuuccagaugccaccaccgccaacaggcca

SEQ ID NO: 285160 - RNA, 64 nt, hsa; identical to SEQ ID NO: 144070

SEQ ID NO: 285161 - RNA, 64 nt, hsa; identical to SEQ ID NO: 144071

SEQ ID NO: 285162 - RNA, 64 nt, hsa; identical to SEQ ID NO: 144072

SEQ ID NO: 285163 - RNA, 64 nt, hsa; identical to SEQ ID NO: 144073

SEQ ID NO: 285164 - RNA, 64 nt, hsa; identical to SEQ ID NO: 144074

SEQ ID NO: 285165 - RNA, 64 nt, hsa; identical to SEQ ID NO: 144075

SEQ ID NO: 285166 - RNA, 64 nt, hsa; identical to SEQ ID NO: 144076

SEQ ID NO: 285167 - RNA, 64 nt, hsa; identical to SEQ ID NO: 144077

SEQ ID NO: 285168 - RNA, 64 nt, hsa; identical to SEQ ID NO: 144078

SEQ ID NO: 285169 - RNA, 64 nt, hsa; identical to SEQ ID NO: 144079

SEQ ID NO: 285170 - RNA, 64 nt, hsa; identical to SEQ ID NO: 144080

SEQ ID NO: 285171 - RNA, 64 nt, hsa; identical to SEQ ID NO: 144081

SEQ ID NO: 285172 - RNA, 64 nt, hsa; identical to SEQ ID NO: 144082

SEQ ID NO: 285173 - RNA, 64 nt, hsa; identical to SEQ ID NO: 144083

SEQ ID NO: 285174 - RNA, 64 nt, hsa; identical to SEQ ID NO: 144084

SEQ ID NO: 285175 - RNA, 64 nt, hsa; identical to SEQ ID NO: 144085

SEQ ID NO: 285176 - RNA, 64 nt, hsa; identical to SEQ ID NO: 144086

SEQ ID NO: 285177 - RNA, 64 nt, hsa; identical to SEQ ID NO: 144087

SEQ ID NO: 285178 - RNA, 64 nt, hsa; identical to SEQ ID NO: 144088

SEQ ID NO: 285179 - RNA, 64 nt, hsa; identical to SEQ ID NO: 144089

SEQ ID NO: 285180 - RNA, 64 nt, hsa; identical to SEQ ID NO: 144090

SEQ ID NO: 285181 - RNA, 64 nt, hsa; identical to SEQ ID NO: 144091

SEQ ID NO: 285182 - RNA, 64 nt, hsa; identical to SEQ ID NO: 144092

SEQ ID NO: 285183 - RNA, 64 nt, hsa; identical to SEQ ID NO: 144093

SEQ ID NO: 285184 - RNA, 64 nt, hsa; identical to SEQ ID NO: 144094

SEQ ID NO: 285185 - RNA, 64 nt, hsa; identical to SEQ ID NO: 144095

SEQ ID NO: 285186 - RNA, 64 nt, hsa; identical to SEQ ID NO: 144096

SEQ ID NO: 285187 - RNA, 64 nt, hsa; identical to SEQ ID NO: 144097

SEQ ID NO: 285188 - RNA, 64 nt, hsa; identical to SEQ ID NO: 144098

SEQ ID NO: 285189 - RNA, 64 nt, hsa; identical to SEQ ID NO: 144099

SEQ ID NO: 285190 - RNA, 64 nt, hsa; identical to SEQ ID NO: 144100

SEQ ID NO: 285191 - RNA, 64 nt, hsa; identical to SEQ ID NO: 144101

SEQ ID NO: 285192 - RNA, 64 nt, hsa; identical to SEQ ID NO: 144102

SEQ ID NO: 285193 - RNA, 64 nt, hsa; identical to SEQ ID NO: 144103

SEQ ID NO: 285194 - RNA, 64 nt, hsa; identical to SEQ ID NO: 144104

SEQ ID NO: 285195 - RNA, 64 nt, hsa; identical to SEQ ID NO: 144105

SEQ ID NO: 285196 - RNA, 64 nt, hsa; identical to SEQ ID NO: 144106

SEQ ID NO: 285197 - RNA, 64 nt, hsa; identical to SEQ ID NO: 144107

SEQ ID NO: 285198 - RNA, 64 nt, hsa; identical to SEQ ID NO: 144108

SEQ ID NO: 285199 - RNA, 64 nt, hsa; identical to SEQ ID NO: 144109

SEQ ID NO: 285200 - RNA, 64 nt, hsa; identical to SEQ ID NO: 144110

SEQ ID NO: 285201 - RNA, 64 nt, hsa; identical to SEQ ID NO: 144111

SEQ ID NO: 285202 - RNA, 64 nt, hsa; identical to SEQ ID NO: 144112

SEQ ID NO: 285203 - RNA, 64 nt, hsa; identical to SEQ ID NO: 144113

SEQ ID NO: 285204 - RNA, 64 nt, hsa; identical to SEQ ID NO: 144114

SEQ ID NO: 285205 - RNA, 64 nt, hsa; identical to SEQ ID NO: 144115

SEQ ID NO: 285206 - RNA, 64 nt, hsa; identical to SEQ ID NO: 144116

SEQ ID NO: 285207 - RNA, 64 nt, hsa; identical to SEQ ID NO: 144117

SEQ ID NO: 285208 - RNA, 64 nt, hsa; identical to SEQ ID NO: 144118

SEQ ID NO: 285209 - RNA, 64 nt, hsa; identical to SEQ ID NO: 144119

SEQ ID NO: 285210 - RNA, 64 nt, hsa; identical to SEQ ID NO: 144120

SEQ ID NO: 285211 - RNA, 64 nt, hsa; identical to SEQ ID NO: 144121

SEQ ID NO: 285212 - RNA, 64 nt, hsa; identical to SEQ ID NO: 144122

SEQ ID NO: 285213 - RNA, 64 nt, hsa; identical to SEQ ID NO: 144123

SEQ ID NO: 285214 - RNA, 64 nt, hsa; identical to SEQ ID NO: 144124

SEQ ID NO: 285215 - RNA, 64 nt, hsa; identical to SEQ ID NO: 144125

SEQ ID NO: 285216 - RNA, 64 nt, hsa; identical to SEQ ID NO: 144126

SEQ ID NO: 285217 - RNA, 64 nt, hsa; identical to SEQ ID NO: 144127

SEQ ID NO: 285218 - RNA, 64 nt, hsa; identical to SEQ ID NO: 144128

SEQ ID NO: 285219 - RNA, 64 nt, hsa; identical to SEQ ID NO: 144129

SEQ ID NO: 285220 - RNA, 64 nt, hsa; identical to SEQ ID NO: 144130

SEQ ID NO: 285221 - RNA, 64 nt, hsa; identical to SEQ ID NO: 144131

SEQ ID NO: 285222 - RNA, 64 nt, hsa; identical to SEQ ID NO: 144132

SEQ ID NO: 285223 - RNA, 64 nt, hsa; identical to SEQ ID NO: 144133

SEQ ID NO: 285224 - RNA, 64 nt, hsa; identical to SEQ ID NO: 144134

SEQ ID NO: 285225 - RNA, 64 nt, hsa; identical to SEQ ID NO: 144135

SEQ ID NO: 285226 - RNA, 64 nt, hsa; identical to SEQ ID NO: 144136

SEQ ID NO: 285227 - RNA, 64 nt, hsa; identical to SEQ ID NO: 144137

SEQ ID NO: 285228 - RNA, 64 nt, hsa; identical to SEQ ID NO: 144138

SEQ ID NO: 285229 - RNA, 64 nt, hsa; identical to SEQ ID NO: 144139

SEQ ID NO: 285230 - RNA, 64 nt, hsa; identical to SEQ ID NO: 144140

SEQ ID NO: 285231 - RNA, 64 nt, hsa; identical to SEQ ID NO: 144141

SEQ ID NO: 285232 - RNA, 64 nt, hsa; identical to SEQ ID NO: 144142

SEQ ID NO: 285233 - RNA, 64 nt, hsa; identical to SEQ ID NO: 144143

SEQ ID NO: 285234 - RNA, 64 nt, hsa; identical to SEQ ID NO: 144144

SEQ ID NO: 285235 - RNA, 64 nt, hsa; identical to SEQ ID NO: 144145

SEQ ID NO: 285236 - RNA, 64 nt, hsa; identical to SEQ ID NO: 144146

SEQ ID NO: 285237 - RNA, 64 nt, hsa; identical to SEQ ID NO: 144147

SEQ ID NO: 285238 - RNA, 64 nt, hsa; identical to SEQ ID NO: 144148

SEQ ID NO: 285239 - RNA, 64 nt, hsa; identical to SEQ ID NO: 144149

SEQ ID NO: 285240 - RNA, 64 nt, hsa; identical to SEQ ID NO: 144150

SEQ ID NO: 285241 - RNA, 64 nt, hsa; identical to SEQ ID NO: 144151

SEQ ID NO: 285242 - RNA, 64 nt, hsa; identical to SEQ ID NO: 144152

SEQ ID NO: 285243 - RNA, 64 nt, hsa; identical to SEQ ID NO: 144153

SEQ ID NO: 285244 - RNA, 64 nt, hsa; identical to SEQ ID NO: 144154

SEQ ID NO: 285245 - RNA, 64 nt, hsa; identical to SEQ ID NO: 144155

SEQ ID NO: 285246 - RNA, 64 nt, hsa; identical to SEQ ID NO: 193740

SEQ ID NO: 285247 - RNA, 64 nt, hsa; identical to SEQ ID NO: 193741

SEQ ID NO: 285248 - RNA, 64 nt, hsa; identical to SEQ ID NO: 193742

SEQ ID NO: 285249 - RNA, 64 nt, hsa; identical to SEQ ID NO: 193743

SEQ ID NO: 285250 - RNA, 64 nt, hsa; identical to SEQ ID NO: 193744

SEQ ID NO: 285251 - RNA, 64 nt, hsa; identical to SEQ ID NO: 193745

SEQ ID NO: 285252 - RNA, 64 nt, hsa; identical to SEQ ID NO: 134047

SEQ ID NO: 285253 - RNA, 64 nt, hsa; identical to SEQ ID NO: 134048

SEQ ID NO: 285254 - RNA, 64 nt, hsa; identical to SEQ ID NO: 134049

SEQ ID NO: 285255 - RNA, 64 nt, hsa; identical to SEQ ID NO: 134050

SEQ ID NO: 285256 - RNA, 64 nt, hsa; identical to SEQ ID NO: 134051

SEQ ID NO: 285257 - RNA, 64 nt, hsa; identical to SEQ ID NO: 134052

SEQ ID NO: 285258 - RNA, 64 nt, hsa; identical to SEQ ID NO: 134053

SEQ ID NO: 285259 - RNA, 64 nt, hsa; identical to SEQ ID NO: 134054

SEQ ID NO: 285260 - RNA, 64 nt, hsa
uagauguuaaguaucagauuuuaagcuuguuuuaauggucaaaaaauuaggacagaaauaauau

SEQ ID NO: 285261 - RNA, 64 nt, hsa
uugaaagaaaggcguuaaucauaaagaagcaagaauggucaaaaucgaaugcugcauuuuuaua

SEQ ID NO: 285262 - RNA, 64 nt, hsa
auauaauauauaaauauggugucuguguacauauagugaagauaugcaguaagagcuaccuuaa

SEQ ID NO: 285263 - RNA, 64 nt, hsa
uuuuguuaugcuaguaucagucagaugcacuuagagugaagaaacacuguaauuacagcacaca

SEQ ID NO: 285264 - RNA, 64 nt, hsa
aaaguggcuaauguuagcuacuaugaauggugccagugaagacacugaaaaauaagugauuuca

SEQ ID NO: 285265 - RNA, 64 nt, hsa
aaaucuuugcacucacagagcuuacaugccagugagugaagaucgaugauaaauaaagcaaaug

SEQ ID NO: 285266 - RNA, 64 nt, hsa
cuaaaaggaauuagaauacagcagaauuggccucagugaagagcuuaaaauuguucuccucgua

SEQ ID NO: 285267 - RNA, 64 nt, hsa
cucguguucuuuuccagaagaaaauccucagcaaagugaagaauugcuugaaguaagcaacuga

SEQ ID NO: 285268 - RNA, 64 nt, hsa
gaguaaggacauuucugacugaagaagcucuaaaagugaagagaccucguuuugauguaucgcu

SEQ ID NO: 285269 - RNA, 64 nt, hsa
gacucccuacugggaugaugaaggauggcauccuagugaagaagcagcucaaacauuuugauaa

SEQ ID NO: 285270 - RNA, 64 nt, hsa
acucaaaugaaucaaaccccgugggaaugacagaagugaagaaucuggucccugucuuuaagga

SEQ ID NO: 285271 - RNA, 64 nt, hsa
gacuggcuucucagcugaggaaugcauuuccaucagugaagaaucaaccggaccuguugcuagc

SEQ ID NO: 285272 - RNA, 64 nt, hsa
auaauaaaaauauaaaaaggugauguucaacagaagugaagacaaaacaauaugcaucaggaga

SEQ ID NO: 285273 - RNA, 64 nt, hsa
caugguuuuggaccccuucugcucuacuacagagagugaagaagaaaguauuaaagcucacuuu

SEQ ID NO: 285274 - RNA, 64 nt, hsa
ugauuuagaaauggaauggccuuggaugucuaucagugaagaaaaauguucuguuagaagaucu

SEQ ID NO: 285275 - RNA, 64 nt, hsa
gcugaaucagacaguggaugagacacacaacggcagugaagaaccgauacacuuggcauugacg

SEQ ID NO: 285276 - RNA, 64 nt, hsa
uuagguacucaaacuccauucuccagggguuuacagugaagaaagccuguuguuuaagugacug

SEQ ID NO: 285277 - RNA, 64 nt, hsa
gucaagagaucuuucagaaaauauaagccuuuaaagugaagaagaggagccaguugugcuggcu

SEQ ID NO: 285278 - RNA, 64 nt, hsa
gacauuaaaauguaagaugcaugaugaaaaccugagugaagaggcuguuuguguuuaacuuaua

SEQ ID NO: 285279 - RNA, 64 nt, hsa
agagccuugaguuacgguguuuauuuuccaaucaagugaagauaucuccuacuucuccuacugg

SEQ ID NO: 285280 - RNA, 64 nt, hsa
ccuacuucuccuacuggaacaucucagcuucugcagugaagaaaaauuccugugauaguucagu

SEQ ID NO: 285281 - RNA, 64 nt, hsa
acuaugaacgguuuuuuauucaagaugucuccagagugaagaugccgaggaugaacuugcauug

SEQ ID NO: 285282 - RNA, 64 nt, hsa
uuacacaaagugccacuuauuaaagagcuuccacagugaagauggagaaggugaacuugcuuug

SEQ ID NO: 285283 - RNA, 64 nt, hsa
gacugucuggugaugaugucuuucauggcaucugagugaagagugacagguuggcucaacuuuu

SEQ ID NO: 285284 - RNA, 64 nt, hsa
acaguucauuuggaauucagguacauuaagcuuuagugaagagugcaugcaguaauuccaaugu

SEQ ID NO: 285285 - RNA, 64 nt, hsa
caauuuggggcuuaaucuuguuuaaaaaaauguaagugaagauggaaggcuggagagaaugauu

SEQ ID NO: 285286 - RNA, 64 nt, hsa
cgcaagaauaaguucuuugaauuccuuaguauguagugaagaaaauuuaguuguuaguugcuuu

SEQ ID NO: 285287 - RNA, 64 nt, hsa
caagcacuuuaauggccuggagggacuuuuaaucagugaagaugcaaucagacaaguguuuugg

SEQ ID NO: 285288 - RNA, 64 nt, hsa
aaacaggcuaaaugcaccaagaaagcuucuucagagugaagaaucuuaaugcuuguaauuuaaa

SEQ ID NO: 285289 - RNA, 64 nt, hsa
gucaguugcgugaauuuuuuuuaagaaacaacccagugaagaguucuaccauagcaaggccuaa

SEQ ID NO: 285290 - RNA, 64 nt, hsa
uuuauuuuucuagguuuucugucccucccucaguagugaagaguuuucuuuauuccuggcagug

SEQ ID NO: 285291 - RNA, 61 nt, hsa
uuggauaccuguaucucuaaguguugcucagagugaagagugaagagcauuugguacacac

SEQ ID NO: 285292 - RNA, 64 nt, hsa
auaccuguaucucuaaguguugcucagagugaagagugaagagcauuugguacacacuugaccu

SEQ ID NO: 285293 - RNA, 64 nt, hsa
cuuaguagccacuucacaaagcaaaaugaaauccagugaagaaaugaucaaaagugagcuggca

SEQ ID NO: 285294 - RNA, 64 nt, hsa
caugacaucucucuccaaaguaacgaccuuuguaagugaagaugcucuuccagagaccaccuuc

SEQ ID NO: 285295 - RNA, 64 nt, hsa
ugaaaacuggacacucccuaaauguccaccuuucagugaagagauaguuaagccaauuccauuu

SEQ ID NO: 285296 - RNA, 64 nt, hsa
auguugaacaacaugggaaggucgcagcguacuaagugaagaagucagaggacagaggaauuuc

SEQ ID NO: 285297 - RNA, 64 nt, hsa
gacauuaaaauaugagauguaugaugaaaaucuaagugaagagacuuuuaugguuaacuuauaa

SEQ ID NO: 285298 - RNA, 64 nt, hsa
gucaaaauaucuuuaagaaaauauaagcuuuuaaagugaagaguauuuugaagaagaacauugu

SEQ ID NO: 285299 - RNA, 64 nt, hsa
ggaauucgugcaggaagccaugaaaggaaagaucagugaagacagcaaucacgguucugccccu

SEQ ID NO: 285300 - RNA, 64 nt, hsa
ccaugugucauguggaaaccuccacaggucugcuagugaagaaugcauguaugugagauuuuug

SEQ ID NO: 285301 - RNA, 64 nt, hsa; identical to SEQ ID NO: 88546

SEQ ID NO: 285302 - RNA, 64 nt, hsa; identical to SEQ ID NO: 88547

SEQ ID NO: 285303 - RNA, 51 nt, hsa; identical to SEQ ID NO: 88548

SEQ ID NO: 285304 - RNA, 64 nt, hsa; identical to SEQ ID NO: 88549

SEQ ID NO: 285305 - RNA, 64 nt, hsa; identical to SEQ ID NO: 88550

SEQ ID NO: 285306 - RNA, 64 nt, hsa; identical to SEQ ID NO: 88551

SEQ ID NO: 285307 - RNA, 64 nt, hsa; identical to SEQ ID NO: 88552

SEQ ID NO: 285308 - RNA, 64 nt, hsa; identical to SEQ ID NO: 88553

SEQ ID NO: 285309 - RNA, 64 nt, hsa; identical to SEQ ID NO: 88554

SEQ ID NO: 285310 - RNA, 64 nt, hsa; identical to SEQ ID NO: 88555

SEQ ID NO: 285311 - RNA, 64 nt, hsa; identical to SEQ ID NO: 88556

SEQ ID NO: 285312 - RNA, 64 nt, hsa; identical to SEQ ID NO: 88557

SEQ ID NO: 285313 - RNA, 64 nt, hsa; identical to SEQ ID NO: 88558

SEQ ID NO: 285314 - RNA, 64 nt, hsa; identical to SEQ ID NO: 88559

SEQ ID NO: 285315 - RNA, 64 nt, hsa; identical to SEQ ID NO: 88560

SEQ ID NO: 285316 - RNA, 64 nt, hsa; identical to SEQ ID NO: 88561

SEQ ID NO: 285317 - RNA, 64 nt, hsa; identical to SEQ ID NO: 88562

SEQ ID NO: 285318 - RNA, 64 nt, hsa; identical to SEQ ID NO: 88563

SEQ ID NO: 285319 - RNA, 64 nt, hsa; identical to SEQ ID NO: 88564

SEQ ID NO: 285320 - RNA, 64 nt, hsa; identical to SEQ ID NO: 88565

SEQ ID NO: 285321 - RNA, 64 nt, hsa; identical to SEQ ID NO: 88566

SEQ ID NO: 285322 - RNA, 64 nt, hsa; identical to SEQ ID NO: 88567

SEQ ID NO: 285323 - RNA, 64 nt, hsa; identical to SEQ ID NO: 88568

SEQ ID NO: 285324 - RNA, 64 nt, hsa; identical to SEQ ID NO: 88569

SEQ ID NO: 285325 - RNA, 64 nt, hsa; identical to SEQ ID NO: 88570

SEQ ID NO: 285326 - RNA, 64 nt, hsa; identical to SEQ ID NO: 88571

SEQ ID NO: 285327 - RNA, 64 nt, hsa; identical to SEQ ID NO: 88572

SEQ ID NO: 285328 - RNA, 64 nt, hsa; identical to SEQ ID NO: 88573

SEQ ID NO: 285329 - RNA, 64 nt, hsa; identical to SEQ ID NO: 88574

SEQ ID NO: 285330 - RNA, 64 nt, hsa; identical to SEQ ID NO: 88575

SEQ ID NO: 285331 - RNA, 64 nt, hsa; identical to SEQ ID NO: 88576

SEQ ID NO: 285332 - RNA, 64 nt, hsa; identical to SEQ ID NO: 88577

SEQ ID NO: 285333 - RNA, 64 nt, hsa; identical to SEQ ID NO: 88578

SEQ ID NO: 285334 - RNA, 64 nt, hsa; identical to SEQ ID NO: 88579

SEQ ID NO: 285335 - RNA, 64 nt, hsa; identical to SEQ ID NO: 88580

SEQ ID NO: 285336 - RNA, 64 nt, hsa; identical to SEQ ID NO: 88581

SEQ ID NO: 285337 - RNA, 64 nt, hsa; identical to SEQ ID NO: 88582

SEQ ID NO: 285338 - RNA, 64 nt, hsa; identical to SEQ ID NO: 88583

SEQ ID NO: 285339 - RNA, 64 nt, hsa; identical to SEQ ID NO: 88584

SEQ ID NO: 285340 - RNA, 64 nt, hsa; identical to SEQ ID NO: 88585

SEQ ID NO: 285341 - RNA, 64 nt, hsa; identical to SEQ ID NO: 88586

SEQ ID NO: 285342 - RNA, 64 nt, hsa; identical to SEQ ID NO: 88587

SEQ ID NO: 285343 - RNA, 64 nt, hsa; identical to SEQ ID NO: 88588

SEQ ID NO: 285344 - RNA, 64 nt, hsa; identical to SEQ ID NO: 88589

SEQ ID NO: 285345 - RNA, 64 nt, hsa; identical to SEQ ID NO: 88590

SEQ ID NO: 285346 - RNA, 64 nt, hsa; identical to SEQ ID NO: 88591

SEQ ID NO: 285347 - RNA, 64 nt, hsa; identical to SEQ ID NO: 88592

SEQ ID NO: 285348 - RNA, 64 nt, hsa; identical to SEQ ID NO: 88593

SEQ ID NO: 285349 - RNA, 64 nt, hsa
gguuuggcccauggggcccccccaggccccugccccaacugauucugcccagauaaucgugucu

SEQ ID NO: 285350 - RNA, 64 nt, hsa
acacaacaggacugagcagaaccaaacacuucuuccaacugacucugcucccugcccucaccau

SEQ ID NO: 285351 - RNA, 64 nt, hsa
uucuauugcuaggguaaaauaaauacauuuguguccaacugaaauauaauugucauuaaaauaa

SEQ ID NO: 285352 - RNA, 64 nt, hsa
ugagagguuaguuuuuuuccuacacuuuuuuuugccaacugacuuaacaacauugcugucaggu

SEQ ID NO: 285353 - RNA, 63 nt, hsa
uacacaccaaccugcuggcuuuagaauaaaagcaccaacugaacugagaugugugguguggua

SEQ ID NO: 285354 - RNA, 64 nt, hsa
auggacuuuccacuguaggaguggacauuucaagccaacugagccuuuuccucaagugccgaca

SEQ ID NO: 285355 - RNA, 64 nt, hsa
uauuucauauucuacagaaguaaaucagguuucaccaacugaaaugucucccuuugaaaguagc

SEQ ID NO: 285356 - RNA, 64 nt, hsa
augaaaauacaucuaucccucauuuugagagccuccaacugauccaagugucauccggaggagg

SEQ ID NO: 285357 - RNA, 64 nt, hsa
aaagaugagccucgauuuuaaaaucuauccacauccaacugauggcaccauugaugugcaaaua

SEQ ID NO: 285358 - RNA, 64 nt, hsa
ugguauacuguuuuagucuugaauugccaacuuuccaacugaucuauccauauuccuuaaguac

SEQ ID NO: 285359 - RNA, 64 nt, hsa
gaaacccuaucuuucacuuuacauuccuuucaauccaacugaucaaaacugguacccacacuug

SEQ ID NO: 285360 - RNA, 64 nt, hsa
ucagaagguuuggguacauuacagcuuggguuuuccaacugacuuaggauuucugacuuuuuau

SEQ ID NO: 285361 - RNA, 64 nt, hsa
aauccacauuugguguugcagaugaguuguaaagccaacugaaagaguuccuucaagaaguucc

SEQ ID NO: 285362 - RNA, 64 nt, hsa
gcucaccccacuccagggccuuccccagcggccaccaacugaccuggggcgcugcuccccacag

SEQ ID NO: 285363 - RNA, 64 nt, hsa
uugaaucgcugcgauacuggcauuucccuacuccccaacugaguucaagggcuguagguucaug

SEQ ID NO: 285364 - RNA, 64 nt, hsa
auuccuuccauaucuuuagcaggugccaguuuuuccaacugauucauugaauuuaaaauagagc

SEQ ID NO: 285365 - RNA, 64 nt, hsa
ucuuuuuugcccuuucauggagucauaaauuuucccaacugaagucuuguauauucuguuagau

SEQ ID NO: 285366 - RNA, 64 nt, hsa
uuucccaucccaggagcucauuauccagucugugccaacugaaguaggagacugacugugagug

SEQ ID NO: 285367 - RNA, 64 nt, hsa
auuaaaguacuugggcuucagaaguaagagccaaccaacugaaaaccugagauggagauauguu

SEQ ID NO: 285368 - RNA, 64 nt, hsa
uugcaauauucaguaucaaauuagagcauuuugaccaacugaaacauauaacguuuucaucucc

SEQ ID NO: 285369 - RNA, 64 nt, hsa
uuuaguaaaauccuuuuuagaagguauuuuuuuuccaacugaguagugaaaaucaacaaggugc

SEQ ID NO: 285370 - RNA, 64 nt, hsa
uuaguauuugaaaaucagugugauuccuuaauggccaacugaagauugaauugccgcuaacaac

SEQ ID NO: 285371 - RNA, 64 nt, hsa
auucuucauagggaccuuuaaaaagcaggaaauaccaacugaagucaauuugggggacaugcua

SEQ ID NO: 285372 - RNA, 64 nt, hsa
augucgaaagagcuggcugggggccuugcccaaaccaacugaggucuuaaaguccagggaaaaa

SEQ ID NO: 285373 - RNA, 64 nt, hsa
aagauggaaauuucuuuuuaggcuaauuugaaauccaacugaagcuuuuuaaccaauauuuuaa

SEQ ID NO: 285374 - RNA, 64 nt, hsa
gacucaaaauugcaaauauaaacaaaagaaaaauccaacugaaaauaacacuaaguauuuuuga

SEQ ID NO: 285375 - RNA, 64 nt, hsa
uguucaacauuuuugaauacauuaaaagaaguaaccaacugaacgacaaagcaugguauuugaa

SEQ ID NO: 285376 - RNA, 64 nt, hsa
gacguuccauacccccacaugccaauuucagcacccaacugagauccgaggagcuccugggaag

SEQ ID NO: 285377 - RNA, 64 nt, hsa
agaaugagacaauuccuugggcuguaguuuggacccaacugaauccugagugcucuguggcuga

SEQ ID NO: 285378 - RNA, 64 nt, hsa
acuccuacccuuccagggaccccuauccugauccccaacugaagcuucaaaaagccacuuuucc

SEQ ID NO: 285379 - RNA, 64 nt, hsa
uucucaauuaaaaagaaguguauccuuaaucuggccaacugaaagugaacuuguucauucaccu

SEQ ID NO: 285380 - RNA, 64 nt, hsa
ggggcagcugaagcucacggugacucagcagugcccaacugaccaaucucccgcagcucuccug

SEQ ID NO: 285381 - RNA, 64 nt, hsa
cugcuucucccauguaccagggcaccaggcccacccaacugaaggcauggcggcggggugcagg

SEQ ID NO: 285382 - RNA, 64 nt, hsa
acaauucauuuuucucuucuaaagguagucuuucccaacugacuguaggguugugucuuuuccc

SEQ ID NO: 285383 - RNA, 64 nt, hsa
cuggucagccuuuuuggguaacacaguuaauuuaccaacugauacagauaauagaauauauuca

SEQ ID NO: 285384 - RNA, 64 nt, hsa
aauagccaaaaaguggaaacaacccaaaugucuaccaacugaugaaugggaaauaaaauguggu

SEQ ID NO: 285385 - RNA, 64 nt, hsa
agcccucccaugucugcugguuucaguuccccacccaacugacugaagucuugaccuugauacc

SEQ ID NO: 285386 - RNA, 64 nt, hsa
agcuacccuggaaugguggcguguccugcuguacccaacugacuugcuuagguaccuggcagcu

SEQ ID NO: 285387 - RNA, 64 nt, hsa
uguguugucauucaaggacuuccucuccugcaggccaacugaaauaccagaaaaugacauucug

SEQ ID NO: 285388 - RNA, 64 nt, hsa
auaucuuugcagguaucacagccuugcagaagaaccaacugaaaaaaaaauucucaggcuuuac

SEQ ID NO: 285389 - RNA, 64 nt, hsa
acucaugagcacuauaauaaccaucaggaagcucccaacugaagcaauguaacaguguaaucua

SEQ ID NO: 285390 - RNA, 64 nt, hsa
uaguucagcugcugucacagucucauuuguucuuccaacugaaagccguaaaaccuuuguugcu

SEQ ID NO: 285391 - RNA, 64 nt, hsa
uggguccacuuucugagaugcuuucuaaaaccaaccaacugauaaaaaguagaugagacuucuc

SEQ ID NO: 285392 - RNA, 64 nt, hsa
ccacauucaauauuuugauucuugcacaauaaagccaacugauugcaacugauucuuugagagg

SEQ ID NO: 285393 - RNA, 64 nt, hsa
uccaccuggaccuccauuuuucccuguaaauucuccaacugauccuacccucccuacuccugca

SEQ ID NO: 285394 - RNA, 64 nt, hsa
ugaacccugaaacaaagauaaugauuuggaccacccaacugaaguggcauguuauguuuuuggc

SEQ ID NO: 285395 - RNA, 64 nt, hsa
ugaguuuugaucucuuuuuaaggagaggcacuuuccaacugaaggugauugauguagggaaaug

SEQ ID NO: 285396 - RNA, 64 nt, hsa
cugguauauaguaggugcucaauaaauguugaaaccaacugaacugccaacaaaauaaaaauaa

SEQ ID NO: 285397 - RNA, 64 nt, hsa
uuuuuuucaccuuaagggaggauuuaauuugcucccaacugauugucacuuaaaugaaaauuua

SEQ ID NO: 285398 - RNA, 64 nt, hsa
agaauggcuaugaagcgucauuucacauuuuaccccaacugaccugcaugcccaggacacaagu

SEQ ID NO: 285399 - RNA, 64 nt, hsa
uaauggauguaaaaaagccuauuucuacauuauaccaacugagaaaaaaauggucgguaaagug

SEQ ID NO: 285400 - RNA, 64 nt, hsa
augcaauuagccucauaguuauuauccagaggacccaacugaacugaacuaauccuucuggcag

SEQ ID NO: 285401 - RNA, 64 nt, hsa
cugcugaacauuuggaaaccaugcacuagccaacccaacugacuucugcuagguagaggcauuu

SEQ ID NO: 285402 - RNA, 64 nt, hsa
uguuagggcuucaaggcccucagagaugaucaguccaacugaacgaccuuacaaaugaggaaac

SEQ ID NO: 285403 - RNA, 64 nt, hsa
guuuuuuauccagaaauauuuucagcaaaacuuuccaacugaguggagucugauuaaggauuua

SEQ ID NO: 285404 - RNA, 64 nt, hsa
cggauuagcuagcaccuuuaagcccugcauuucuccaacugacaagugggugggggugauggca

SEQ ID NO: 285405 - RNA, 64 nt, hsa
gaaggacagaacuugacuggcuccauuucauggaccaacugaucaauugccaguacuaagccac

SEQ ID NO: 285406 - RNA, 64 nt, hsa
acuacaagccauacugaggcggcagcaggagcgaccaacugaucgcacacaugcuuuguuugga

SEQ ID NO: 285407 - RNA, 64 nt, hsa
acaagcauugcuaccaaccgccucaucugagggcccaacugauaugauuugauuuauccuugua

SEQ ID NO: 285408 - RNA, 64 nt, hsa
cauucuugcuauaacuaagugcuucuccaagaccccaacugaguccccagcaccugcuacagug

SEQ ID NO: 285409 - RNA, 64 nt, hsa
ccauagggacagcuuguauaauuaccuucagaggccaacugacagaauccuggcaggaacagac

SEQ ID NO: 285410 - RNA, 64 nt, hsa
aggggccgugaccagcccucugccuccagggaggccaacugacucugagccaggguucccccag

SEQ ID NO: 285411 - RNA, 64 nt, hsa
agccuucacuugucaguaucauaaagaguauugcccaacugaacuuugcucccacugguuuaau

SEQ ID NO: 285412 - RNA, 64 nt, hsa
ccccaaagcuguagucccaaucaaucaaaggcuaccaacugaguccucagguucauuucuuuuu

SEQ ID NO: 285413 - RNA, 64 nt, hsa
cauugccccuccgaugcugaggccacccacugacccaacugauccugcuccagcagcacaccuc

SEQ ID NO: 285414 - RNA, 64 nt, hsa
gucucaccucacauugucccuacaaggacaggccccaacugauaaccguugcuuuuuuuuuuuu

SEQ ID NO: 285415 - RNA, 64 nt, hsa
ucugcccuugggauuccaaaccucccuagggcucccaacugaccucaggccucugagucacuga

SEQ ID NO: 285416 - RNA, 64 nt, hsa
gauggcugguguuauuggccaguuuuuagccaauccaacugaccuagugaagguucagaugcaa

SEQ ID NO: 285417 - RNA, 64 nt, hsa
ugaaucccuuaggacuggaacacuucaagcucaaccaacugacucaguugucauucuucacaaa

SEQ ID NO: 285418 - RNA, 64 nt, hsa
ugauguuccacuccacuuuguauagacaucugccccaacugaauguguucugucacucagcuuu

SEQ ID NO: 285419 - RNA, 64 nt, hsa
gaagaauaauucauggauuuguucauuguucuuuccaacugaaggcaguaaccauuacuucuaa

SEQ ID NO: 285420 - RNA, 64 nt, hsa
auaugcccuaggaaaguacaaccagaauugaaaaccaacugaucuauaccaguucuuucaauua

SEQ ID NO: 285421 - RNA, 64 nt, hsa
acuuuaacaaugaaggggaaggggaagauuuccaccaacugaaucauuugugcacguguauagc

SEQ ID NO: 285422 - RNA, 64 nt, hsa
uauauucuucuacugauucagucagacacgaaauccaacugaauuacccgguagacugaauauc

SEQ ID NO: 285423 - RNA, 64 nt, hsa
cagugaaacaacaucauuuaagccaaaauaucucccaacugacugauagacucugagcacuaau

SEQ ID NO: 285424 - RNA, 64 nt, hsa
aguuccaagcauggaggcucauucugaagcagcaccaacugagcaaaccccugugguccggcag

SEQ ID NO: 285425 - RNA, 64 nt, hsa
ccuuuccucuccuggguacugaggugcuaugaagccaacugacaaagaugcaucacgugucuua

SEQ ID NO: 285426 - RNA, 64 nt, hsa
aaaaacaaccucaaggguccaugaacaauaucugccaacugaaccuguugucuucaaauacuaa

SEQ ID NO: 285427 - RNA, 64 nt, hsa
cuuuuacaguuaauccaggagagggaguccuuugccaacugaugaccaacaguuccaagccaga

SEQ ID NO: 285428 - RNA, 64 nt, hsa
uuuccucauaagcauaaaaagaaaaucuuuguugccaacugaagcacaugaugauuuugugguc

SEQ ID NO: 285429 - RNA, 64 nt, hsa
gggcuuugacuaugucauuagguggguacaaaacccaacugauguggagaaaaauugauguuug

SEQ ID NO: 285430 - RNA, 64 nt, hsa
aggggggaugucuugagauguauuaugcaaaguaccaacugagccaaaaacaauaaacgaaaca

SEQ ID NO: 285431 - RNA, 64 nt, hsa
aucaaucaugggaauuacauaaggauaaugaggcccaacugaaaccaaguuucagucugccuua

SEQ ID NO: 285432 - RNA, 64 nt, hsa
cagcaguauuuuaaguggggaaugcaacgugaggccaacugaacaauuccccccguggcugccc

SEQ ID NO: 285433 - RNA, 64 nt, hsa
ugaaugaaauuaucacagguugucucaagcacaaccaacugaaugucucuuaacuguggggacc

SEQ ID NO: 285434 - RNA, 64 nt, hsa
aguguucugcccuagauugguucaaggaggucauccaacugacuuuaucaaguggaauugggau

SEQ ID NO: 285435 - RNA, 64 nt, hsa
auuuuaaugauuguguguucuaauucaugugcugccaacugaguuaucuagugauaugaccuca

SEQ ID NO: 285436 - RNA, 64 nt, hsa
aacaggagaaaggacaaccaggaugaggaugucaccaacugaauuaaacuuaaguccagaagcc

SEQ ID NO: 285437 - RNA, 64 nt, hsa
acugugugagcuacuuaacugacgcccucuuccuccaacugaaggaucgcccaacguuuuugga

SEQ ID NO: 285438 - RNA, 64 nt, hsa
uccagucuggagagcugugucuauuuguuucaacccaacugaccugccagccgguucugcuaga

SEQ ID NO: 285439 - RNA, 64 nt, hsa
acaaagacuucaacaauugcacaucuucauucucccaacugaguguaguauguggagcauaaaa

SEQ ID NO: 285440 - RNA, 64 nt, hsa
auuaugucuuaguuauaauuagauugugaaucagccaacugaaaauccuuuuugcauauuucaa

SEQ ID NO: 285441 - RNA, 64 nt, hsa
ucucucucucuaguauucuaaacugaccccaugaccaacugagaauuuauuuuuguuucauugg

SEQ ID NO: 285442 - RNA, 64 nt, hsa
caggacauacuaguucccuggcaggcaagggcuuccaacugaggcagugcauguguggcagaga

SEQ ID NO: 285443 - RNA, 55 nt, hsa; identical to SEQ ID NO: 221797

SEQ ID NO: 285444 - RNA, 64 nt, hsa
uacuguaauugggccuggcucacugaugcuuucgccaacugaaacuacuaggauccugugugug

SEQ ID NO: 285445 - RNA, 64 nt, hsa
caucccauaaauaaaaaauacuuuaguuugcuaaccaacugaauauaugaggacugcauguaau

SEQ ID NO: 285446 - RNA, 64 nt, hsa
ccagccagaaagcacuacaaucauggucaaguucccaacugagucaucuugugaguggauaauc

SEQ ID NO: 285447 - RNA, 64 nt, hsa
auuucauucauaccagauaauagcugcauuacugccaacugaccuuauaacccucugcaccuuc

SEQ ID NO: 285448 - RNA, 64 nt, hsa
cucaagcuguaacagaaaggucaauggacuugacccaacugagaaggaaaaacuucuguaugga

SEQ ID NO: 285449 - RNA, 64 nt, hsa
uucucaggcugcaccaaagauuccaucaucagggccaacugagagugagggagucucacccacc

SEQ ID NO: 285450 - RNA, 64 nt, hsa
uggcugaggccagaggcccaucgccugccccuguccaacugagauggccuucaggagccuaggu

SEQ ID NO: 285451 - RNA, 64 nt, hsa
uucacaagccaaguagggcauauaucagauuuggccaacugaauggcgucuguccugucaucca

SEQ ID NO: 285452 - RNA, 64 nt, hsa
auacguaggaauuuuuuccuuuuguguucugucaccaacugaaguggcuaaagagcuuugugau

SEQ ID NO: 285453 - RNA, 64 nt, hsa
ugcccacacaacaggcuuauuuucugugaaggaaccaacugaucucccccacccuuggauuaga

SEQ ID NO: 285454 - RNA, 64 nt, hsa
uuguuaagaggaaauaaucaagaucacucauaucccaacugaaucugagguuuuauaaaucccu

SEQ ID NO: 285455 - RNA, 64 nt, hsa
guugccagaugccccuaggggacagagucaacccccaacugaggaccacuguccuacagaguca

SEQ ID NO: 285456 - RNA, 64 nt, hsa
ugguuuuuuuuuuuuuaaccaaaguguugucaggccaacugaaugaugaugugguugcuaugga

SEQ ID NO: 285457 - RNA, 64 nt, hsa
agaagagguguccuuacagaggccucuuuacugaccaacugaaguauagacuuacugcuggaca

SEQ ID NO: 285458 - RNA, 64 nt, hsa
aggguauuuaagugcuagggcuggucacacacaaccaacugaaaaagacuagagggauuaguac

SEQ ID NO: 285459 - RNA, 64 nt, hsa
ggugcuuggcagcuguucuguguuuuccaggaauccaacugagcauugaaaucucucauuugcc

SEQ ID NO: 285460 - RNA, 64 nt, hsa
gcccaccuggcuaccaggccgacagcuacauccuccaacugacccugaucaacgaagagggauu

SEQ ID NO: 285461 - RNA, 52 nt, hsa; identical to SEQ ID NO: 221815

SEQ ID NO: 285462 - RNA, 64 nt, hsa
ucuuguccccuuggucuuuuaauuaaaagaaauuccaacugacuuuuaaacuuuguucuugucc

SEQ ID NO: 285463 - RNA, 64 nt, hsa
caagucacucacuuaaaauggggaaacugagguuccaacugacagaaacugaggguccugcccu

SEQ ID NO: 285464 - RNA, 64 nt, hsa
uccccaacccacucccuuccaacaacaaccagcuccaacugacucuggucuugggaggugaggc

SEQ ID NO: 285465 - RNA, 64 nt, hsa
augacgucugaccucuaccaucgccauuuuugcuccaacugaggaaacuacaggggaagugggg

SEQ ID NO: 285466 - RNA, 64 nt, hsa
auaguaguuagaggcuuacaacuuaggagcagcaccaacugaaggugcuaauugcuuggaucuc

SEQ ID NO: 285467 - RNA, 64 nt, hsa
gaacagagaagagauuacaccagcgguaacacugccaacugagacuaaaggaaacaaacaaaaa

SEQ ID NO: 285468 - RNA, 64 nt, hsa
gaacuuacgauaucugccccaaaccucuguaaccccaacugaaaugaggagcuuccucucuucc

SEQ ID NO: 285469 - RNA, 64 nt, hsa
uugcucuuugaaaauuucuuuuuacacguguaagccaacugagauaccgugaugguguugauuu

SEQ ID NO: 285470 - RNA, 64 nt, hsa
acugggauuuaagacaccccugauggaaugaaagccaacugaaccacguaaagcucgaaccacg

SEQ ID NO: 285471 - RNA, 64 nt, hsa
aaguccagaaagaaaggguucaucuuuuugacuuccaacugauauugggaaguuugguugaggu

SEQ ID NO: 285472 - RNA, 64 nt, hsa
uugaaccucuuagccacauuuccagcagggcaaaccaacugaugcccuggaagagucuuccgca

SEQ ID NO: 285473 - RNA, 64 nt, hsa
cauuggaaagcuaauccuaccuugucaguuucaaccaacugaguuuuuucuuuaagaaagguaa

SEQ ID NO: 285474 - RNA, 64 nt, hsa
gcaggucucauagguugagcaauuucccccuaaaccaacugaaggcuaaaaagcaacaggccau

SEQ ID NO: 285475 - RNA, 64 nt, hsa
uuccaaauauaagaguacucauguuuauuuauuuccaacugagcagcaaccuccuuuguuucac

SEQ ID NO: 285476 - RNA, 64 nt, hsa
uuugccagacaagucuccaggggaucccuguuucccaacugaaaggugugaacggacacacaca

SEQ ID NO: 285477 - RNA, 64 nt, hsa
cacucaaaauaaauggucuuuagcaucucaaauuccaacugaaaucauuuuaguauuaacucuu

SEQ ID NO: 285478 - RNA, 64 nt, hsa
ucuuucuucccguguguauuucuaagaaauagagccaacugauuuuguauguaaauaccaagag

SEQ ID NO: 285479 - RNA, 64 nt, hsa
aaaaagccuaacaaacagauaagguaggacucaaccaacugaaaccugacuuucccccuguacc

SEQ ID NO: 285480 - RNA, 64 nt, hsa
uuauuccauuaccaggcacuccgccacccacaugccaacugacuugaugcuuaauaaaacugcu

SEQ ID NO: 285481 - RNA, 64 nt, hsa
uuaaacccuuaccaaggaaaaaaaagggauguuaccaacugagaucgaucaguucauccaauca

SEQ ID NO: 285482 - RNA, 64 nt, hsa
aagaaauauuauugauucuauagaaaaccauuuaccaacugaaaggacacgaagucuagcuccg

SEQ ID NO: 285483 - RNA, 64 nt, hsa
uaaggagguugugggugggauuccaaggugaggcccaacugaaucguggggugagcuuuauagc

SEQ ID NO: 285484 - RNA, 64 nt, hsa
cugugacugacagguaauccuaauauauccaaauccaacugaauaccaaauugagauggcaaau

SEQ ID NO: 285485 - RNA, 64 nt, hsa
uggaaaauuaaaggccacuuguggcuuuuuccuaccaacugauacguuuaaauuugcccuagga

SEQ ID NO: 285486 - RNA, 64 nt, hsa
uuuuuguauuuuaaaggaaaaaugacuuucauucccaacugauuaugaccuuucaggaugucgu

SEQ ID NO: 285487 - RNA, 64 nt, hsa
uuguuuuuuuuuuaugaggcuccugagaaucaacccaacugaagcauuucaauucacuugaaug

SEQ ID NO: 285488 - RNA, 64 nt, hsa
cuugugauuccuaccccucuuccagcuucuuuugccaacugaagccuucuucugccacuucugc

SEQ ID NO: 285489 - RNA, 64 nt, hsa
uuugcuccaccccacucacagagacacagggcauccaacugagaaaacgaaacugcucuaagca

SEQ ID NO: 285490 - RNA, 64 nt, hsa
ccccuuggccugcucccuguaggaagucauccugccaacugauuuaaaagggcucuuuagccag

SEQ ID NO: 285491 - RNA, 64 nt, hsa
aaagaggugacugucaguggaggggucucugcagccaacugagacuaucuugcugugcccugag

SEQ ID NO: 285492 - RNA, 64 nt, hsa
aacccccuugggguggggcagaaggugaagcaucccaacugacuagagacucaggcccugcagg

SEQ ID NO: 285493 - RNA, 64 nt, hsa
gagccaguuagacuaguccccggucucccgauucccaacugaguguuauuugcacacugcacug

SEQ ID NO: 285494 - RNA, 64 nt, hsa
uguaauauugguuagggaaacaaacuucaggucaccaacugaagucauuacaaacuccuuguac

SEQ ID NO: 285495 - RNA, 64 nt, hsa
gaugccagccaggcccaggagugcccagcaucccccaacugaugacacaguagcacugauucug

SEQ ID NO: 285496 - RNA, 64 nt, hsa
ucgcuugcugcccaacaccauggcccucacaggcccaacugaccugcgcuggagcugcucuuau

SEQ ID NO: 285497 - RNA, 64 nt, hsa
ccuuaccccaauaccaagaccaacuggcauagagccaacugagauaaaugcuauuuaaauaaag

SEQ ID NO: 285498 - RNA, 64 nt, hsa
ucccugccagaaaaaugugcucugcaguguccucccaacugaaaacaacagugacauguuugaa

SEQ ID NO: 285499 - RNA, 64 nt, hsa
aggaaacccaagagcugccuggacacacggaaacccaacugagaacaaaauccuggcccgugcu

SEQ ID NO: 285500 - RNA, 64 nt, hsa
auggagggcugagcccugugacaaccugcuguuaccaacugaagagccccaagcucuccauggc

SEQ ID NO: 285501 - RNA, 64 nt, hsa
agggcagccagggagagcccaggagcuccccuccccaacugaccaccuuuguuucucccccaug

SEQ ID NO: 285502 - RNA, 64 nt, hsa
ggucucagguuggauuauuuguuggccuuaagucccaacugauguccauuagccggacucgaaa

SEQ ID NO: 285503 - RNA, 64 nt, hsa
uuccacuaucaugaaggacucugaauagacuuggccaacugauguuuacaaaccagacuuuuau

SEQ ID NO: 285504 - RNA, 64 nt, hsa
aaacugaacucacaccugguaccacucagaaccuccaacugacugaaugccaggagcugaacau

SEQ ID NO: 285505 - RNA, 64 nt, hsa
aaaccagagccuauauggaguucccucuucuaacccaacugacuuguaucuguccguggaaaau

SEQ ID NO: 285506 - RNA, 64 nt, hsa
cauaucuuuuuguucaucaguaauaacuaguuggccaacugacugugguccauggacuacacag

SEQ ID NO: 285507 - RNA, 64 nt, hsa
ccuggacagggggcagccguggaggccaccguuaccaacugaagcugggggccuggguccuacc

SEQ ID NO: 285508 - RNA, 64 nt, hsa
cgcauugagccaguggugcuaaaugcuacauacuccaacugaaauguuaaggaagaagauagau

SEQ ID NO: 285509 - RNA, 64 nt, hsa
cuaagauucaagggaguguugcuucucaacucagccaacugaguagcaaaucauuuguucuaga

SEQ ID NO: 285510 - RNA, 64 nt, hsa
ugcaaggauguaugauaauauguacaaaguaauuccaacugaggaagcucaccugauccuuagu

SEQ ID NO: 285511 - RNA, 64 nt, hsa
cuccugacauaagugcacagagcuucaguguccaccaacugaccaugaaauagaguaugcugua

SEQ ID NO: 285512 - RNA, 64 nt, hsa
auuagaaaugcaaauucuugggucacucucuagaccaacugaugcagaaacaggaggugugagc

SEQ ID NO: 285513 - RNA, 64 nt, hsa
caccucccacccuccuccucuucuccuucaagacccaacugagcacccgcucugauuccccaca

SEQ ID NO: 285514 - RNA, 64 nt, hsa
aagcuggagcacuacgacuugcaggccacccauuccaacugaguguagucggcucaacacccuc

SEQ ID NO: 285515 - RNA, 64 nt, hsa
ggugcgaaccagcauuaacggauggggcacgugcccaacugaggaacaggagaagaaaucacca

SEQ ID NO: 285516 - RNA, 64 nt, hsa
gggaaaguuucagcucacugugaagccagacuccccaacugaaacaccagaagguuuggaguga

SEQ ID NO: 285517 - RNA, 64 nt, hsa
auaaguuucuuuuagcuuguacagcauccucagaccaacugaggagcuuuccuuguuaacaauu

SEQ ID NO: 285518 - RNA, 64 nt, hsa
ggccuggaguugccgaggaagucacagaaaaugaccaacugauggggccuggagugcaggaggg

SEQ ID NO: 285519 - RNA, 64 nt, hsa
guaaaggacuuuuuuaacugcuggauuuguuuuuccaacugaguccaaacuuuucuaaugucug

SEQ ID NO: 285520 - RNA, 64 nt, hsa
aaguagcugagauuacaggcgcacaccaccacgcccaacugauuuuuguauuuuuaguagagac

SEQ ID NO: 285521 - RNA, 64 nt, hsa
uauuuucuguuaguacaaguugaacuugauugugccaacugaaaccccagagguuuguauauca

SEQ ID NO: 285522 - RNA, 64 nt, hsa
gguggccagguggggcgggaccccagcaccucccccaacugacccuggacguccaggugggccc

SEQ ID NO: 285523 - RNA, 64 nt, hsa
gcucacuuuuuguauuuaaauauuaaaaaugauuccaacugaaagugucauccuaaguaccuug

SEQ ID NO: 285524 - RNA, 64 nt, hsa
uuucuaacuucucaaguucuagagaaagaauuaaccaacugaugacuuaccugccuaguuaaua

SEQ ID NO: 285525 - RNA, 64 nt, hsa
aagugccugaugcccgcgucagagaccagaggagccaacugagaugauggggugggggugcucc

SEQ ID NO: 285526 - RNA, 64 nt, hsa
caaaauuauauugagcaaucgccaaggccuaaagccaacugacuuaaagguaaucauuucagcu

SEQ ID NO: 285527 - RNA, 64 nt, hsa
ccccugccaugcucuggucuguucugaaacugugccaacugaaagaugauaguccacacagcac

SEQ ID NO: 285528 - RNA, 64 nt, hsa
uaauuacaucccauaacuugucaggauaguugcuccaacugaauugcuaucauuuggcuggaug

SEQ ID NO: 285529 - RNA, 64 nt, hsa
uuauuaugagaaaguggacuuaaccgaaauggaaccaacugacauucuaucguguuguacauag

SEQ ID NO: 285530 - RNA, 64 nt, hsa
cagaagggugcuaagucaccuacugaagagagaaccaacugacuuuccuauugacucaucagga

SEQ ID NO: 285531 - RNA, 64 nt, hsa
uccuucuaucuugaaucuucuagagaguugcugaccaacugacguauguuucccuuugugaauu

SEQ ID NO: 285532 - RNA, 64 nt, hsa
aaucuuugugugaaggauuggaaaaggcuauuuuccaacugaagucagggacauugccagcucc

SEQ ID NO: 285533 - RNA, 64 nt, hsa
aaucugcccccaacucccaaaagcuagaacacugccaacugaucuguuauagguccuuuagaaa

SEQ ID NO: 285534 - RNA, 64 nt, hsa
gggguaugcuacucauaagauuucagggugucuuccaacugaaaucucaauguucucaguacga

SEQ ID NO: 285535 - RNA, 64 nt, hsa
uguuuacagagaugucucuuauaucuaaaucuguccaacugagaaguaccuuaucaaaguagca

SEQ ID NO: 285536 - RNA, 64 nt, hsa; identical to SEQ ID NO: 21758

SEQ ID NO: 285537 - RNA, 64 nt, hsa; identical to SEQ ID NO: 21759

SEQ ID NO: 285538 - RNA, 64 nt, hsa; identical to SEQ ID NO: 21760

SEQ ID NO: 285539 - RNA, 64 nt, hsa; identical to SEQ ID NO: 21761

SEQ ID NO: 285540 - RNA, 64 nt, hsa; identical to SEQ ID NO: 21762

SEQ ID NO: 285541 - RNA, 64 nt, hsa; identical to SEQ ID NO: 21763

SEQ ID NO: 285542 - RNA, 64 nt, hsa; identical to SEQ ID NO: 21764

SEQ ID NO: 285543 - RNA, 64 nt, hsa; identical to SEQ ID NO: 21765

SEQ ID NO: 285544 - RNA, 64 nt, hsa; identical to SEQ ID NO: 21766

SEQ ID NO: 285545 - RNA, 64 nt, hsa; identical to SEQ ID NO: 21767

SEQ ID NO: 285546 - RNA, 64 nt, hsa; identical to SEQ ID NO: 21768

SEQ ID NO: 285547 - RNA, 64 nt, hsa; identical to SEQ ID NO: 21769

SEQ ID NO: 285548 - RNA, 64 nt, hsa; identical to SEQ ID NO: 21770

SEQ ID NO: 285549 - RNA, 64 nt, hsa; identical to SEQ ID NO: 21771

SEQ ID NO: 285550 - RNA, 64 nt, hsa; identical to SEQ ID NO: 21772

SEQ ID NO: 285551 - RNA, 64 nt, hsa; identical to SEQ ID NO: 21773

SEQ ID NO: 285552 - RNA, 64 nt, hsa; identical to SEQ ID NO: 21774

SEQ ID NO: 285553 - RNA, 64 nt, hsa; identical to SEQ ID NO: 21775

SEQ ID NO: 285554 - RNA, 64 nt, hsa; identical to SEQ ID NO: 21775

SEQ ID NO: 285555 - RNA, 64 nt, hsa; identical to SEQ ID NO: 21777

SEQ ID NO: 285556 - RNA, 64 nt, hsa; identical to SEQ ID NO: 21778

SEQ ID NO: 285557 - RNA, 64 nt, hsa; identical to SEQ ID NO: 21779

SEQ ID NO: 285558 - RNA, 64 nt, hsa; identical to SEQ ID NO: 21780

SEQ ID NO: 285559 - RNA, 64 nt, hsa; identical to SEQ ID NO: 21781

SEQ ID NO: 285560 - RNA, 64 nt, hsa; identical to SEQ ID NO: 262484

SEQ ID NO: 285561 - RNA, 64 nt, hsa; identical to SEQ ID NO: 262485

SEQ ID NO: 285562 - RNA, 64 nt, hsa; identical to SEQ ID NO: 262486

SEQ ID NO: 285563 - RNA, 64 nt, hsa; identical to SEQ ID NO: 262487

SEQ ID NO: 285564 - RNA, 64 nt, hsa; identical to SEQ ID NO: 262488

SEQ ID NO: 285565 - RNA, 64 nt, hsa; identical to SEQ ID NO: 262489

SEQ ID NO: 285566 - RNA, 64 nt, hsa; identical to SEQ ID NO: 262490

SEQ ID NO: 285567 - RNA, 64 nt, hsa; identical to SEQ ID NO: 262491

SEQ ID NO: 285568 - RNA, 64 nt, hsa; identical to SEQ ID NO: 262492

SEQ ID NO: 285569 - RNA, 64 nt, hsa; identical to SEQ ID NO: 262493

SEQ ID NO: 285570 - RNA, 64 nt, hsa; identical to SEQ ID NO: 262494

SEQ ID NO: 285571 - RNA, 64 nt, hsa; identical to SEQ ID NO: 262495

SEQ ID NO: 285572 - RNA, 64 nt, hsa; identical to SEQ ID NO: 262496

SEQ ID NO: 285573 - RNA, 64 nt, hsa; identical to SEQ ID NO: 262497

SEQ ID NO: 285574 - RNA, 64 nt, hsa; identical to SEQ ID NO: 262498

SEQ ID NO: 285575 - RNA, 64 nt, hsa; identical to SEQ ID NO: 262499

SEQ ID NO: 285576 - RNA, 64 nt, hsa; identical to SEQ ID NO: 262500

SEQ ID NO: 285577 - RNA, 64 nt, hsa; identical to SEQ ID NO: 262501

SEQ ID NO: 285578 - RNA, 64 nt, hsa; identical to SEQ ID NO: 262502

SEQ ID NO: 285579 - RNA, 64 nt, hsa; identical to SEQ ID NO: 262503

SEQ ID NO: 285580 - RNA, 64 nt, hsa; identical to SEQ ID NO: 262504

SEQ ID NO: 285581 - RNA, 64 nt, hsa; identical to SEQ ID NO: 262505

SEQ ID NO: 285582 - RNA, 64 nt, hsa; identical to SEQ ID NO: 262506

SEQ ID NO: 285583 - RNA, 64 nt, hsa; identical to SEQ ID NO: 262507

SEQ ID NO: 285584 - RNA, 64 nt, hsa; identical to SEQ ID NO: 262508

SEQ ID NO: 285585 - RNA, 64 nt, hsa; identical to SEQ ID NO: 262509

SEQ ID NO: 285586 - RNA, 64 nt, hsa; identical to SEQ ID NO: 262510

SEQ ID NO: 285587 - RNA, 64 nt, hsa; identical to SEQ ID NO: 262511

SEQ ID NO: 285588 - RNA, 64 nt, hsa; identical to SEQ ID NO: 262512

SEQ ID NO: 285589 - RNA, 64 nt, hsa; identical to SEQ ID NO: 262513

SEQ ID NO: 285590 - RNA, 64 nt, hsa; identical to SEQ ID NO: 262514

SEQ ID NO: 285591 - RNA, 64 nt, hsa; identical to SEQ ID NO: 262515

SEQ ID NO: 285592 - RNA, 64 nt, hsa; identical to SEQ ID NO: 262516

SEQ ID NO: 285593 - RNA, 64 nt, hsa; identical to SEQ ID NO: 262517

SEQ ID NO: 285594 - RNA, 64 nt, hsa; identical to SEQ ID NO: 262518

SEQ ID NO: 285595 - RNA, 64 nt, hsa; identical to SEQ ID NO: 262519

SEQ ID NO: 285596 - RNA, 64 nt, hsa; identical to SEQ ID NO: 262520

SEQ ID NO: 285597 - RNA, 64 nt, hsa; identical to SEQ ID NO: 262521

SEQ ID NO: 285598 - RNA, 64 nt, hsa; identical to SEQ ID NO: 262522

SEQ ID NO: 285599 - RNA, 64 nt, hsa; identical to SEQ ID NO: 262523

SEQ ID NO: 285600 - RNA, 64 nt, hsa; identical to SEQ ID NO: 262524

SEQ ID NO: 285601 - RNA, 64 nt, hsa; identical to SEQ ID NO: 262525

SEQ ID NO: 285602 - RNA, 64 nt, hsa; identical to SEQ ID NO: 262526

SEQ ID NO: 285603 - RNA, 64 nt, hsa; identical to SEQ ID NO: 262527

SEQ ID NO: 285604 - RNA, 64 nt, hsa; identical to SEQ ID NO: 262528

SEQ ID NO: 285605 - RNA, 64 nt, hsa; identical to SEQ ID NO: 262529

SEQ ID NO: 285606 - RNA, 64 nt, hsa; identical to SEQ ID NO: 262530

SEQ ID NO: 285607 - RNA, 64 nt, hsa; identical to SEQ ID NO: 262531

SEQ ID NO: 285608 - RNA, 64 nt, hsa; identical to SEQ ID NO: 262532

SEQ ID NO: 285609 - RNA, 64 nt, hsa; identical to SEQ ID NO: 262533

SEQ ID NO: 285610 - RNA, 64 nt, hsa; identical to SEQ ID NO: 262534

SEQ ID NO: 285611 - RNA, 64 nt, hsa; identical to SEQ ID NO: 262535

SEQ ID NO: 285612 - RNA, 64 nt, hsa; identical to SEQ ID NO: 262536

SEQ ID NO: 285613 - RNA, 64 nt, hsa; identical to SEQ ID NO: 262537

SEQ ID NO: 285614 - RNA, 64 nt, hsa; identical to SEQ ID NO: 262538

SEQ ID NO: 285615 - RNA, 64 nt, hsa; identical to SEQ ID NO: 262539

SEQ ID NO: 285616 - RNA, 64 nt, hsa; identical to SEQ ID NO: 262540

SEQ ID NO: 285617 - RNA, 64 nt, hsa; identical to SEQ ID NO: 262541

SEQ ID NO: 285618 - RNA, 64 nt, hsa; identical to SEQ ID NO: 262542

SEQ ID NO: 285619 - RNA, 64 nt, hsa; identical to SEQ ID NO: 262543

SEQ ID NO: 285620 - RNA, 64 nt, hsa; identical to SEQ ID NO: 262544

SEQ ID NO: 285621 - RNA, 64 nt, hsa; identical to SEQ ID NO: 262545

SEQ ID NO: 285622 - RNA, 64 nt, hsa; identical to SEQ ID NO: 262546

SEQ ID NO: 285623 - RNA, 64 nt, hsa; identical to SEQ ID NO: 262547

SEQ ID NO: 285624 - RNA, 64 nt, hsa; identical to SEQ ID NO: 262548

SEQ ID NO: 285625 - RNA, 64 nt, hsa; identical to SEQ ID NO: 262549

SEQ ID NO: 285626 - RNA, 64 nt, hsa; identical to SEQ ID NO: 262550

SEQ ID NO: 285627 - RNA, 64 nt, hsa; identical to SEQ ID NO: 262551

SEQ ID NO: 285628 - RNA, 64 nt, hsa; identical to SEQ ID NO: 262552

SEQ ID NO: 285629 - RNA, 64 nt, hsa; identical to SEQ ID NO: 262553

SEQ ID NO: 285630 - RNA, 64 nt, hsa; identical to SEQ ID NO: 262554

SEQ ID NO: 285631 - RNA, 64 nt, hsa; identical to SEQ ID NO: 262555

SEQ ID NO: 285632 - RNA, 64 nt, hsa; identical to SEQ ID NO: 262556

SEQ ID NO: 285633 - RNA, 64 nt, hsa; identical to SEQ ID NO: 262557

SEQ ID NO: 285634 - RNA, 64 nt, hsa; identical to SEQ ID NO: 262558

SEQ ID NO: 285635 - RNA, 64 nt, hsa; identical to SEQ ID NO: 262559

SEQ ID NO: 285636 - RNA, 64 nt, hsa; identical to SEQ ID NO: 262560

SEQ ID NO: 285637 - RNA, 64 nt, hsa; identical to SEQ ID NO: 262561

SEQ ID NO: 285638 - RNA, 64 nt, hsa; identical to SEQ ID NO: 262562

SEQ ID NO: 285639 - RNA, 64 nt, hsa
acauauauauaaauauaccugaugccagauuuuuuucauaaauauucugccuacuguaaauaug

SEQ ID NO: 285640 - RNA, 64 nt, hsa
uacaguuuaauuaauuauucuuagugcuuaaggcuucauaaaguaauuuuuccaaccuuuuuuu

SEQ ID NO: 285641 - RNA, 64 nt, hsa
auugcuuucugauucguguagucucucccacagauucauaaacuuuuaugacuuauauuguuuc

SEQ ID NO: 285642 - RNA, 64 nt, hsa
caggugcuucuccuuuaugauuugaguuggccucuucauaaauuagugcuguuuacuuucagag

SEQ ID NO: 285643 - RNA, 64 nt, hsa
agacuggauaacuucuaaccaauaguuuauuuguuucauaaaucuaaaagcugagaaguccaag

SEQ ID NO: 285644 - RNA, 64 nt, hsa
uguuccugggcaaaucacaacauggggaauuuuauucauaaauguccacagaaacaguaaaugu

SEQ ID NO: 285645 - RNA, 64 nt, hsa
cuguugcugaaauguggcuuuggcauuguuggauuucauaaaaaauuucuggcaggaagucuug

SEQ ID NO: 285646 - RNA, 64 nt, hsa
aaaaaauaaaaguaucuccuagucccuuaauuuuuucauaaauauuucuggcuuuugaguagug

SEQ ID NO: 285647 - RNA, 64 nt, hsa
auguuagaaauccaaaaucuuggugcauuauuuuuucauaaacgcuaaaacauuugaagaaaca

SEQ ID NO: 285648 - RNA, 64 nt, hsa
auauuauguuuauacaaaaucaaucugaacacaauucauaaagauuucucuuuuauaccuuccu

SEQ ID NO: 285649 - RNA, 64 nt, hsa
uugaugugcugugauaugagggaaucugaaauguuucauaaaaauaaagcuuaaaaauugucuu

SEQ ID NO: 285650 - RNA, 64 nt, hsa
auacucugauccuuacagaauccaagaggaagcuuucauaaaaacaauucagcaaauauuucca

SEQ ID NO: 285651 - RNA, 64 nt, hsa
uuauauacacugccucuucaauuuggaaauaaauuucauaaaaauagauguaaacaccucuucu

SEQ ID NO: 285652 - RNA, 64 nt, hsa
acagguaucuuggauuucagacacauucuguuucuucauaaaaauuuuacuuaaaaucuguaac

SEQ ID NO: 285653 - RNA, 64 nt, hsa
ccaucugcaucccaaguccuauuuuauaaggauauucauaaaaauuccauggugaauccuuguc

SEQ ID NO: 285654 - RNA, 64 nt, hsa
cacccuucuccuuggauuguuuuggaaguuauucuucauaaaaaauguuaacgugggcugggca

SEQ ID NO: 285655 - RNA, 64 nt, hsa
cuuuuaguaagaggaaaaagggauuauaaaacccuucauaaaucaagaaggccaucacuuagaa

SEQ ID NO: 285656 - RNA, 64 nt, hsa
aaaauaucacugacucaucccuacccauauucuuuucauaaaacccacucaccagguacaauag

SEQ ID NO: 285657 - RNA, 64 nt, hsa
ucagugaguaaaagcuuugacauuuuauguuuuauucauaaaggggguuaauuauuugcuacaa

SEQ ID NO: 285658 - RNA, 64 nt, hsa
acauacuagcuucuuucucuauaagagugccucuuucauaaaaccaaaugcuugucugcuagca

SEQ ID NO: 285659 - RNA, 64 nt, hsa
gugucuaguagaacaauguacaagguauguacaguucauaaauuuguugucauguguaugagaa

SEQ ID NO: 285660 - RNA, 64 nt, hsa
cugaauauuaagaaacaauuuaaauuguuauaacuucauaaaacucaugacugagucuggcaaa

SEQ ID NO: 285661 - RNA, 64 nt, hsa
ugcuuucuuaugacuguuuuuauaaauaaacuguuucauaaauaauguauacuggaaaauuguc

SEQ ID NO: 285662 - RNA, 64 nt, hsa
caaaaucuccaaaccucugaaaacugaaauauuuuucauaaauuaggcguaaauucuaugcccu

SEQ ID NO: 285663 - RNA, 64 nt, hsa
ggcagaaaaauggucaaggaauaggaacuacaacuucauaaaugaggaaccagaaaagguaaaa

SEQ ID NO: 285664 - RNA, 64 nt, hsa
uacggcuuuauugaaaacauugauauauugaauauucauaaauuuuaauuuaacuuucuuuuau

SEQ ID NO: 285665 - RNA, 64 nt, hsa
uaacacaaauaauuauucuauaugaauauuaugguucauaaauuauaauguauaaucuauacau

SEQ ID NO: 285666 - RNA, 64 nt, hsa
uuuugucucucuccugaucuuacuaaauccauauuucauaaauaacugagaauaauuaaaacaa

SEQ ID NO: 285667 - RNA, 64 nt, hsa
cacagugugaucucucaccugucuuggaaacuccuucauaaagccgcucuuccuuaggccuggg

SEQ ID NO: 285668 - RNA, 64 nt, hsa
cuccuuccacaagaagugcauagguccauaauauuucauaaaaugaagaaaaagaauguggcca

SEQ ID NO: 285669 - RNA, 64 nt, hsa
uggauuauagacuuaaaaauagucauuuuucuuauucauaaaucugacaggcauaaacccaaau

SEQ ID NO: 285670 - RNA, 64 nt, hsa
gucccugauuuuauuuucuuuuagggaaaauuguuucauaaaugugacacugauaaagccuuug

SEQ ID NO: 285671 - RNA, 64 nt, hsa
uagcacuguuaaagcacgaauugguaacaguuguuucauaaaugagcacuguugugauaacacc

SEQ ID NO: 285672 - RNA, 64 nt, hsa
ucaaaccuauccccggaugugugagaauaauguguucauaaagcauggaucucgcuuugguugu

SEQ ID NO: 285673 - RNA, 64 nt, hsa
agugcuugagacuggaaccaaaauuaaauuguacuucauaaaauccucuuauagaguuacucuu

SEQ ID NO: 285674 - RNA, 64 nt, hsa
guccauuugaguucuuuccaauauuuccauaucguucauaaaugugucugggggcuuccuuguu

SEQ ID NO: 285675 - RNA, 64 nt, hsa
guauuuccaauuuggucuucaauucaagagaugcuucauaaaacacuuauagccuuaaaccauu

SEQ ID NO: 285676 - RNA, 64 nt, hsa
uuacauguuuuaggauaaacuaauuucuuuugaguucauaaaucauuuguacccagaauguauu

SEQ ID NO: 285677 - RNA, 64 nt, hsa
ugcaaaagccacaacaguaguggaagaauuaaaauucauaaagucucaucauucuguuggcuaa

SEQ ID NO: 285678 - RNA, 64 nt, hsa
cauugccuucuguuuuguauaucccuuauaguaauucauaaaugcuucccauggaguuuugcua

SEQ ID NO: 285679 - RNA, 64 nt, hsa
uaaagauguaugauuucuaaggcuuuaaaaauuauucauaaaacagugggcaauagauaaagga

SEQ ID NO: 285680 - RNA, 64 nt, hsa
augcaccaccuguuugcuugcuuucaaugaaccuuucauaaauucgcagucucagcuuaugguu

SEQ ID NO: 285681 - RNA, 64 nt, hsa
auaacugaguaauauauuaagagaauugucaugguucauaaaucacauuaugcuaaucugaaau

SEQ ID NO: 285682 - RNA, 64 nt, hsa
aaagaugaaauaaaguauucaaaauauuaacauuuucauaaauauaaggauguauuauugagaa

SEQ ID NO: 285683 - RNA, 64 nt, hsa
ugccagaggcagaaauggucuggguauaagcuauuucauaaaagcagcuuuaaauugucaguau

SEQ ID NO: 285684 - RNA, 64 nt, hsa
gucuuaauuucuaacauuaucuuugcuuuuauguuucauaaaaauuugucauuauuuaugcugg

SEQ ID NO: 285685 - RNA, 64 nt, hsa
cuaguaccucaaugcgauucugagauauuugaauuucauaaaauuguaacugaaauuuaaaauu

SEQ ID NO: 285686 - RNA, 64 nt, hsa
aauaauugcuuguuuucuagccuggcaagauauuuucauaaaagagggauaacaaugcugauua

SEQ ID NO: 285687 - RNA, 64 nt, hsa
aagccacgguguucugugauauaaguguguguuuuucauaaagcaggcagaacucaucuaggua

SEQ ID NO: 285688 - RNA, 64 nt, hsa
uaugauacuugaaaauuaacaugaauauuuaguguucauaaauaaaguuuguugaaacacaacc

SEQ ID NO: 285689 - RNA, 64 nt, hsa
uaagaacauacauuuugaaauuaugaacauuuuuuucauaaaaauuaaaugcuuuaagaaaugg

SEQ ID NO: 285690 - RNA, 64 nt, hsa
agaaguacgugaguuguuccucaggaauagauuuuucauaaagcagaauugauccuguggcugg

SEQ ID NO: 285691 - RNA, 64 nt, hsa
cccugucucuaggucgcugagagaggugcuuuucuucauaaaaccuuugggguuuggauuuccc

SEQ ID NO: 285692 - RNA, 64 nt, hsa
uguaaaagaugcauggagucaggagaaaaccaccuucauaaacugcucugugcaaagaggaaua

SEQ ID NO: 285693 - RNA, 64 nt, hsa
auuugaagugaaguuauaaaagggcaaauccagauucauaaacuaucaccucggauuucuugua

SEQ ID NO: 285694 - RNA, 64 nt, hsa
aaauacaugcuuaacaaaaggaaugagccugaaguucauaaagaauacauaucaauauucuuau

SEQ ID NO: 285695 - RNA, 64 nt, hsa
ggguuaaaauucuucaccauauuaguuuuguugcuucauaaaauuuaccuaagcaaguggucuu

SEQ ID NO: 285696 - RNA, 64 nt, hsa
gaaaguuagagaacauuauguuuguaucauuucuuucauaaaaccucaagagcauuuuuaagcc

SEQ ID NO: 285697 - RNA, 64 nt, hsa
uacaucugaguuuaaauguucuguuuaauggccauucauaaauucaagcacuaccacuggucag

SEQ ID NO: 285698 - RNA, 64 nt, hsa
cuaucaaucuuauaaauauauguaaucuauuuucuucauaaaacaggcacaaaaguuuuaucag

SEQ ID NO: 285699 - RNA, 64 nt, hsa
uuauuuuaucccagauguguucugaauauccuucuucauaaaucauggaaaacucacugcugag

SEQ ID NO: 285700 - RNA, 64 nt, hsa
cuuccuuucuaggcugguaacaguucauguuugcuucauaaaugaagcagcuuuaaacaaauuc

SEQ ID NO: 285701 - RNA, 64 nt, hsa
aagucuuuguacccacuccuuauguuucuuuucauucauaaacagguguauaaggaacaauguc

SEQ ID NO: 285702 - RNA, 64 nt, hsa
uuccacuggcaccauuagugaauauuuaguuguuuucauaaacgaugcugugaugaagacucau

SEQ ID NO: 285703 - RNA, 64 nt, hsa
uccuccaugggcuaaauccagauguccaccuguuuucauaaauaacguuuuauuggagcauagc

SEQ ID NO: 285704 - RNA, 64 nt, hsa
auuuuuuaaauguauucauuccuacaaauuaacuuucauaaauuuuauggcaugucuucuauuu

SEQ ID NO: 285705 - RNA, 64 nt, hsa
aaauaagcuuuuacuuuuuaaaaccacuugagguuucauaaagcuugggguuuuuuuuuuuccu

SEQ ID NO: 285706 - RNA, 64 nt, hsa
uacuguauugggaaacuugaggagaacucuuuaguucauaaagcuucaaugucuuuuuuuuuuu

SEQ ID NO: 285707 - RNA, 64 nt, hsa
gagucugcuguugaacuauuagauuaagucauaauucauaaaauuuuaguuuaaugugcucuuu

SEQ ID NO: 285708 - RNA, 64 nt, hsa
cacaauacuuaauguauuguacuagauugccaaauucauaaaauguuaauggaagcuuuuugau

SEQ ID NO: 285709 - RNA, 64 nt, hsa
acugaaccaguuggccacucucucagauucccucuucauaaagcuuccgugacuucuaaaccau

SEQ ID NO: 285710 - RNA, 64 nt, hsa
acucuugugcuaguaugucuauagugugaauacauucauaaauuucuugaucaaagcuagguca

SEQ ID NO: 285711 - RNA, 64 nt, hsa
cuuaucaagaguuguuuuuuaaaaauuuaauaaauucauaaaaaagacucauaucuuugcaaac

SEQ ID NO: 285712 - RNA, 64 nt, hsa
ucccuucuuccuagcgagcauauuucaacuguucuucauaaauguuuaugugccuuaaaagacu

SEQ ID NO: 285713 - RNA, 64 nt, hsa
caaugaaugcucaaguugggguugggcguuagaauucauaaaagucuuuauaugcucagauucu

SEQ ID NO: 285714 - RNA, 64 nt, hsa
uuccuuguuuuauucccuuuggaauuugcuccaauucauaaauuugcaguuuuaugucuuuuac

SEQ ID NO: 285715 - RNA, 64 nt, hsa
gcuggcugagaaauaaaagaaaacaagacaguuguucauaaaguuucauuuuguaugcacugau

SEQ ID NO: 285716 - RNA, 64 nt, hsa
aucucuuuuuuuguuuuugaaaauauggccauuuuucauaaaauguuauuuguguuagcaugua

SEQ ID NO: 285717 - RNA, 64 nt, hsa
gucccuguaccagaguauguauccugaacuuugguucauaaauauggcucuugaacccauagac

SEQ ID NO: 285718 - RNA, 64 nt, hsa
acuuccuguuuauggguuugccuauucuggaucuuucauaaaaauggaauuacacaauuguggc

SEQ ID NO: 285719 - RNA, 64 nt, hsa
uccggaaagcgcgguaggguucguagguagggcuaguagguaggguuaguagguagggcuagua

SEQ ID NO: 285720 - RNA, 64 nt, hsa
guaggguucguagguagggcuaguagguaggguuaguagguagggcuaguagguagggcuagua

SEQ ID NO: 285721 - RNA, 64 nt, hsa
guagggcuaguagguaggguuaguagguagggcuaguagguagggcuaguagguaggguucgua

SEQ ID NO: 285722 - RNA, 64 nt, hsa
guaggguuaguagguagggcuaguagguagggcuaguagguaggguucguagguaggguucgua

SEQ ID NO: 285723 - RNA, 64 nt, hsa
guaggguucguagguagggcugguagguaggguuaguagguagggcuaguagguaggguuagua

SEQ ID NO: 285724 - RNA, 64 nt, hsa
guagggcugguagguaggguuaguagguagggcuaguagguaggguuaguagguaggguucgua

SEQ ID NO: 285725 - RNA, 64 nt, hsa
guaggguuaguagguagggcuaguagguaggguuaguagguaggguucguagguaggguucgua

SEQ ID NO: 285726 - RNA, 64 nt, hsa
guaggguucguagguaggguucguagguagggcuaguagguaggguuaguagguaggguucgua

SEQ ID NO: 285727 - RNA, 64 nt, hsa
guaggguucguagguagggcuaguagguaggguuaguagguaggguucguagguagggcuagua

SEQ ID NO: 285728 - RNA, 64 nt, hsa
guaggguucguagguaggguucguagguagggcuaguagguaggguuaguagguagggcuagua

SEQ ID NO: 285729 - RNA, 64 nt, hsa; identical to SEQ ID NO: 285720

SEQ ID NO: 285730 - RNA, 64 nt, hsa
guagggcuaguagguaggguuaguagguagggcuaguagguagggcuaguagguaggguuagua

SEQ ID NO: 285731 - RNA, 64 nt, hsa
guaggguuaguagguagggcuaguagguagggcuaguagguaggguuaguagguagggcuagua

SEQ ID NO: 285732 - RNA, 64 nt, hsa
guagggcuaguagguagggcuaguagguaggguuaguagguagggcuaguagguaggguucgua

SEQ ID NO: 285733 - RNA, 64 nt, hsa
guagggcuaguagguaggguuaguagguagggcuaguagguaggguucguagguaggguuagua

SEQ ID NO: 285734 - RNA, 64 nt, hsa
guagggcuaguagguaggguucguagguaggguuaguagguagggcuaguagguaggguucgua

SEQ ID NO: 285735 - RNA, 64 nt, hsa
guaggguucguagguaggguuaguagguagggcuaguagguaggguucguagguaggguucgua

SEQ ID NO: 285736 - RNA, 64 nt, hsa; identical to SEQ ID NO: 285728

SEQ ID NO: 285737 - RNA, 64 nt, hsa; identical to SEQ ID NO: 285720

SEQ ID NO: 285738 - RNA, 64 nt, hsa; identical to SEQ ID NO: 285721

SEQ ID NO: 285739 - RNA, 64 nt, hsa; identical to SEQ ID NO: 285722

SEQ ID NO: 285740 - RNA, 64 nt, hsa
guaggguucguagguaggguucguagguaggguuaguagguaggguucguagguagggcuagua

SEQ ID NO: 285741 - RNA, 64 nt, hsa
guaggguuaguagguaggguucguagguagggcuaguagguagggcuaguagguagggcuagua

SEQ ID NO: 285742 - RNA, 64 nt, hsa
guaggguucguagguagggcuaguagguagggcuaguagguagggcuaguagguaggguuagua

SEQ ID NO: 285743 - RNA, 64 nt, hsa
guagggcuaguagguagggcuaguagguagggcuaguagguaggguuaguagguagggcuagua

SEQ ID NO: 285744 - RNA, 64 nt, hsa
guagggcuaguagguagggcuaguagguaggguuaguagguagggcuaguagguagggcuagua

SEQ ID NO: 285745 - RNA, 64 nt, hsa
guagggcuaguagguaggguuaguagguagggcuaguagguagggcuaguagguagggcuagua

SEQ ID NO: 285746 - RNA, 64 nt, hsa
guaggguuaguagguagggcuaguagguagggcuaguagguagggcuaguagguagggcuagua

SEQ ID NO: 285747 - RNA, 64 nt, hsa
guagggcuaguagguagggcuaguagguagggcuaguagguagggcuaguagguaggguucgua

SEQ ID NO: 285748 - RNA, 64 nt, hsa
guagggcuaguagguagggcuaguagguagggcuaguagguaggguucguagguaggguucgua

SEQ ID NO: 285749 - RNA, 64 nt, hsa
acugauugugcauuguaucuggauagcaugccuaauugugcauuucugaaaguuaccaauucaa

SEQ ID NO: 285750 - RNA, 64 nt, hsa
uauuuaaaaauagguguucaauaagggaauacugauugugcauuguaucuggauagcaugccua

SEQ ID NO: 285751 - RNA, 64 nt, hsa
gaacugauucuguggauggaugugauuucaggagauugugcagugccagcaucagugcauaaag

SEQ ID NO: 285752 - RNA, 64 nt, hsa
ugaagccuauugggguuaaguuuguaaguguuuaauugugcaaauugccacccuguguaccucc

SEQ ID NO: 285753 - RNA, 64 nt, hsa
agguaugauaauuuuuguaauuaauuuucuuagaauugugcaggcuggaugagauaaugacaua

SEQ ID NO: 285754 - RNA, 64 nt, hsa
gaggcacaucucacuguuuugcagcagaauuugaauugugcaacuccuguguaaaguaaggauu

SEQ ID NO: 285755 - RNA, 64 nt, hsa
cagccacaguugugaugguuguuaaaugcucacaauugugcauucuuaggguuuuuccaucccu

SEQ ID NO: 285756 - RNA, 64 nt, hsa
acuaaaugguugacacacaaaaauugguggagaaauugugcauaugccaauuuuuuguuaaaac

SEQ ID NO: 285757 - RNA, 58 nt, hsa
gagccaugaaauguaguuaguguggcaaauugugcagaguaguuuauuccuucugacc

SEQ ID NO: 285758 - RNA, 64 nt, hsa
uaagcccaggaguuugagucuguaaugcacuaugauugugcaugugaauagccacugcacucca

SEQ ID NO: 285759 - RNA, 64 nt, hsa
uguauauauagaagucauuauggcagaugcacaaauugugcagugauguaaauauacauacuuc

SEQ ID NO: 285760 - RNA, 64 nt, hsa
aauuuacacaaauuauaaaaauuagucgggugucauugugcauaccuguagucccagcuauuca

SEQ ID NO: 285761 - RNA, 64 nt, hsa
uccauguugcccaagcuggucuugaacuacugagcucaagcaaucugccugcuucagccuccca

SEQ ID NO: 285762 - RNA, 64 nt, hsa
caaacaugggucauuguagccucaaccucccaggcucaagcaguccuuucaccucaacccccca

SEQ ID NO: 285763 - RNA, 64 nt, hsa
accguuuugcccaggcuggucucaaacuccugggcucaagcaauguauugaauuuuaaaauaac

SEQ ID NO: 285764 - RNA, 64 nt, hsa
caaucuugccucacugcaacgccugccucucaggcucaagcaaaccucucaccucagccugcug

SEQ ID NO: 285765 - RNA, 64 nt, hsa
gugacauugcccaggcuggucucgaacucuugagcucaagcagucuacccaccuugaccuccca

SEQ ID NO: 285766 - RNA, 64 nt, hsa
caaucucggcucacugcaaccucugccuucugggcucaagcaauccucccacuucaaccuccca

SEQ ID NO: 285767 - RNA, 64 nt, hsa
accauguugcccaggcuggucucaaccuccugggcucaagcaauccuccugccucggccuccca

SEQ ID NO: 285768 - RNA, 64 nt, hsa
caaucucggcucacugcaaccucugccuccugggcucaagcaauucucccaccucagccuccca

SEQ ID NO: 285769 - RNA, 64 nt, hsa
ugaucuuggcucacggcagccuugcccucccuggcucaagcagucuucaucucagccuccagag

SEQ ID NO: 285770 - RNA, 64 nt, hsa
gccauauuugccaggcugguuugaacuccuacaacucaagcauuccucccaccuuggucuccca

SEQ ID NO: 285771 - RNA, 64 nt, hsa
guuuuguugccaaagcuggucucaaacuuguggccucaagcaauccaccugccuuggccuccca

SEQ ID NO: 285772 - RNA, 64 nt, hsa
ugaucauagcucacugcagccucauacuccugggcucaagcaauccuccugccucagccuucca

SEQ ID NO: 285773 - RNA, 64 nt, hsa
uaaaauggaggcaguagggagcaaaacuauucuucucaagcauccuuuacaccauacuuuacuu

SEQ ID NO: 285774 - RNA, 64 nt, hsa
aaagaacuaggaucucacaggaaaagcuggguaacucaagcagcuauucuuucuguagggacca

SEQ ID NO: 285775 - RNA, 64 nt, hsa
caucucaagcaaguuucgacguuugacuagccaucucaagcaaguuuaaucaaugaucaucuca

SEQ ID NO: 285776 - RNA, 64 nt, hsa
cuuuuucuuugauuuucgacguuugacuagccaucucaagcaaguuucgacguuugacuagcca

SEQ ID NO: 285777 - RNA, 64 nt, hsa
ugaucauagcucacuguaaccucaaacucuggggcucaagcaguucucccaccagccuccuuuu

SEQ ID NO: 285778 - RNA, 64 nt, hsa
gcuauguugcccaagcuggucuuaaacuccuggccucaagcaauccuucugccuuggcccccca

SEQ ID NO: 285779 - RNA, 64 nt, hsa
uaccauuugccccagcuggucucaaaccccugggcucaagcaagccuccugccuuggccuccca

SEQ ID NO: 285780 - RNA, 64 nt, hsa
gugauuacagcucauguagccuggaccucccaagcucaagcaauccuccugccucugccuccca

SEQ ID NO: 285781 - RNA, 64 nt, hsa
aucugagaguuuuccuuuaaccuggacuguguuucucaagcacauuuuuucuuuguucacugcc

SEQ ID NO: 285782 - RNA, 64 nt, hsa
gaaugaauguauuugcugauacguugcucacauucucaagcaaaaauucaacugcauuaaccga

SEQ ID NO: 285783 - RNA, 61 nt, hsa
cucaauaguacaugaaaucaagaugcuuaugagcauggaaauguauuuaaaguuuuugcuu

SEQ ID NO: 285784 - RNA, 61 nt, hsa
uacgugugaguauaaaagacaaaaguugaacagcauggaaucucauugccaaauuauuagu

SEQ ID NO: 285785 - RNA, 61 nt, hsa
gcuuucagguaugugugucuaucauugaaagagcauggacucaaacaucagcccugaguuc

SEQ ID NO: 285786 - RNA, 61 nt, hsa
uacccccacccaggaaaaccugcauugugcuagcauggaagaaucaugggcuuuggaauua

SEQ ID NO: 285787 - RNA, 61 nt, hsa
gccccgaggagcccgaagucugcugcugugcagcauggaauuccuuuaaaaaggugcacua

SEQ ID NO: 285788 - RNA, 61 nt, hsa
agcuuauaaaaauaaagggaagaaaggaggcagcauggagagaggccugugcuagaagcuc

SEQ ID NO: 285789 - RNA, 61 nt, hsa
aggcauacagaagguuuguccugcucugggaagcauggaggauguuguacuucacuccucu

SEQ ID NO: 285790 - RNA, 61 nt, hsa
ucuucuagcaccagauaaacucugaaaucaaagcauggauaugagcucaguaggaaacuaa

SEQ ID NO: 285791 - RNA, 61 nt, hsa
caaaggcagcaaggcagugagcuaugagcccagcauggaugugucucaggcaccucauccc

SEQ ID NO: 285792 - RNA, 61 nt, hsa
ucacacacaccaaaccagacagaggcagggcagcauggagacagguagacagaccuccagg

SEQ ID NO: 285793 - RNA, 61 nt, hsa
aguauccuugacugcuuaagucagccaguucagcauggauaccaacauuagcuuuucuucu

SEQ ID NO: 285794 - RNA, 61 nt, hsa
aaguuaggaggcaacuuugggauggugcuagagcauggaaagcacagagaauuggacaaac

SEQ ID NO: 285795 - RNA, 61 nt, hsa
uucucaagggacacaguggccugcaugggccagcauggacccugggcugaucaugugcauu

SEQ ID NO: 285796 - RNA, 61 nt, hsa
ucucuggggacacagugggcccacaugggccagcauggacccugggcuagagcaagcacau

SEQ ID NO: 285797 - RNA, 61 nt, hsa
acuuaaccuguuucuggcuggcuagccaaccagcauggaaaacagauuagguuagauguuc

SEQ ID NO: 285798 - RNA, 61 nt, hsa
cuggucccaccucuggaaaucugauucagccagcauggauaauaacccagauaacuaaccc

SEQ ID NO: 285799 - RNA, 64 nt, hsa; identical to SEQ ID NO: 218191

SEQ ID NO: 285800 - RNA, 64 nt, hsa; identical to SEQ ID NO: 218192

SEQ ID NO: 285801 - RNA, 64 nt, hsa; identical to SEQ ID NO: 218193

SEQ ID NO: 285802 - RNA, 64 nt, hsa; identical to SEQ ID NO: 218194

SEQ ID NO: 285803 - RNA, 64 nt, hsa; identical to SEQ ID NO: 218195

SEQ ID NO: 285804 - RNA, 64 nt, hsa; identical to SEQ ID NO: 218196

SEQ ID NO: 285805 - RNA, 64 nt, hsa; identical to SEQ ID NO: 218197

SEQ ID NO: 285806 - RNA, 64 nt, hsa; identical to SEQ ID NO: 218198

SEQ ID NO: 285807 - RNA, 64 nt, hsa; identical to SEQ ID NO: 218199

SEQ ID NO: 285808 - RNA, 64 nt, hsa; identical to SEQ ID NO: 218200

SEQ ID NO: 285809 - RNA, 64 nt, hsa; identical to SEQ ID NO: 218201

SEQ ID NO: 285810 - RNA, 64 nt, hsa; identical to SEQ ID NO: 218202

SEQ ID NO: 285811 - RNA, 64 nt, hsa; identical to SEQ ID NO: 218203

SEQ ID NO: 285812 - RNA, 64 nt, hsa; identical to SEQ ID NO: 218204

SEQ ID NO: 285813 - RNA, 64 nt, hsa; identical to SEQ ID NO: 218205

SEQ ID NO: 285814 - RNA, 64 nt, hsa; identical to SEQ ID NO: 218206

SEQ ID NO: 285815 - RNA, 64 nt, hsa; identical to SEQ ID NO: 218207

SEQ ID NO: 285816 - RNA, 64 nt, hsa; identical to SEQ ID NO: 218208

SEQ ID NO: 285817 - RNA, 64 nt, hsa; identical to SEQ ID NO: 218209

SEQ ID NO: 285818 - RNA, 64 nt, hsa; identical to SEQ ID NO: 218210

SEQ ID NO: 285819 - RNA, 64 nt, hsa; identical to SEQ ID NO: 218211

SEQ ID NO: 285820 - RNA, 64 nt, hsa; identical to SEQ ID NO: 218212

SEQ ID NO: 285821 - RNA, 64 nt, hsa; identical to SEQ ID NO: 218213

SEQ ID NO: 285822 - RNA, 64 nt, hsa; identical to SEQ ID NO: 218214

SEQ ID NO: 285823 - RNA, 64 nt, hsa; identical to SEQ ID NO: 218215

SEQ ID NO: 285824 - RNA, 64 nt, hsa; identical to SEQ ID NO: 218216

SEQ ID NO: 285825 - RNA, 64 nt, hsa; identical to SEQ ID NO: 218217

SEQ ID NO: 285826 - RNA, 64 nt, hsa; identical to SEQ ID NO: 218218

SEQ ID NO: 285827 - RNA, 64 nt, hsa; identical to SEQ ID NO: 218219

SEQ ID NO: 285828 - RNA, 64 nt, hsa; identical to SEQ ID NO: 218220

SEQ ID NO: 285829 - RNA, 64 nt, hsa; identical to SEQ ID NO: 218221

SEQ ID NO: 285830 - RNA, 64 nt, hsa; identical to SEQ ID NO: 218222

SEQ ID NO: 285831 - RNA, 64 nt, hsa; identical to SEQ ID NO: 218223

SEQ ID NO: 285832 - RNA, 64 nt, hsa; identical to SEQ ID NO: 218224

SEQ ID NO: 285833 - RNA, 64 nt, hsa; identical to SEQ ID NO: 218225

SEQ ID NO: 285834 - RNA, 64 nt, hsa; identical to SEQ ID NO: 218226

SEQ ID NO: 285835 - RNA, 64 nt, hsa; identical to SEQ ID NO: 218227

SEQ ID NO: 285836 - RNA, 64 nt, hsa; identical to SEQ ID NO: 218228

SEQ ID NO: 285837 - RNA, 64 nt, hsa; identical to SEQ ID NO: 218229

SEQ ID NO: 285838 - RNA, 64 nt, hsa; identical to SEQ ID NO: 218230

SEQ ID NO: 285839 - RNA, 64 nt, hsa; identical to SEQ ID NO: 218231

SEQ ID NO: 285840 - RNA, 64 nt, hsa; identical to SEQ ID NO: 218232

SEQ ID NO: 285841 - RNA, 64 nt, hsa; identical to SEQ ID NO: 218233

SEQ ID NO: 285842 - RNA, 64 nt, hsa; identical to SEQ ID NO: 218234

SEQ ID NO: 285843 - RNA, 64 nt, hsa; identical to SEQ ID NO: 218235

SEQ ID NO: 285844 - RNA, 64 nt, hsa; identical to SEQ ID NO: 218236

SEQ ID NO: 285845 - RNA, 64 nt, hsa; identical to SEQ ID NO: 218237

SEQ ID NO: 285846 - RNA, 64 nt, hsa; identical to SEQ ID NO: 218238

SEQ ID NO: 285847 - RNA, 64 nt, hsa; identical to SEQ ID NO: 218239

SEQ ID NO: 285848 - RNA, 64 nt, hsa; identical to SEQ ID NO: 218240

SEQ ID NO: 285849 - RNA, 64 nt, hsa; identical to SEQ ID NO: 218241

SEQ ID NO: 285850 - RNA, 64 nt, hsa; identical to SEQ ID NO: 218242

SEQ ID NO: 285851 - RNA, 64 nt, hsa; identical to SEQ ID NO: 218243

SEQ ID NO: 285852 - RNA, 64 nt, hsa; identical to SEQ ID NO: 218244

SEQ ID NO: 285853 - RNA, 64 nt, hsa; identical to SEQ ID NO: 218245

SEQ ID NO: 285854 - RNA, 64 nt, hsa; identical to SEQ ID NO: 218246

SEQ ID NO: 285855 - RNA, 64 nt, hsa; identical to SEQ ID NO: 218247

SEQ ID NO: 285856 - RNA, 64 nt, hsa; identical to SEQ ID NO: 218248

SEQ ID NO: 285857 - RNA, 64 nt, hsa; identical to SEQ ID NO: 218249

SEQ ID NO: 285858 - RNA, 64 nt, hsa; identical to SEQ ID NO: 218250

SEQ ID NO: 285859 - RNA, 64 nt, hsa; identical to SEQ ID NO: 218251

SEQ ID NO: 285860 - RNA, 64 nt, hsa; identical to SEQ ID NO: 218252

SEQ ID NO: 285861 - RNA, 64 nt, hsa; identical to SEQ ID NO: 218253

SEQ ID NO: 285862 - RNA, 64 nt, hsa; identical to SEQ ID NO: 218254

SEQ ID NO: 285863 - RNA, 64 nt, hsa; identical to SEQ ID NO: 218255

SEQ ID NO: 285864 - RNA, 64 nt, hsa; identical to SEQ ID NO: 218256

SEQ ID NO: 285865 - RNA, 64 nt, hsa; identical to SEQ ID NO: 218257

SEQ ID NO: 285866 - RNA, 64 nt, hsa; identical to SEQ ID NO: 218258

SEQ ID NO: 285867 - RNA, 64 nt, hsa; identical to SEQ ID NO: 218259

SEQ ID NO: 285868 - RNA, 64 nt, hsa; identical to SEQ ID NO: 218260

SEQ ID NO: 285869 - RNA, 64 nt, hsa; identical to SEQ ID NO: 218261

SEQ ID NO: 285870 - RNA, 64 nt, hsa; identical to SEQ ID NO: 218262

SEQ ID NO: 285871 - RNA, 64 nt, hsa; identical to SEQ ID NO: 218263

SEQ ID NO: 285872 - RNA, 64 nt, hsa; identical to SEQ ID NO: 218264

SEQ ID NO: 285873 - RNA, 64 nt, hsa; identical to SEQ ID NO: 218265

SEQ ID NO: 285874 - RNA, 64 nt, hsa; identical to SEQ ID NO: 218266

SEQ ID NO: 285875 - RNA, 64 nt, hsa; identical to SEQ ID NO: 218267

SEQ ID NO: 285876 - RNA, 64 nt, hsa; identical to SEQ ID NO: 218268

SEQ ID NO: 285877 - RNA, 64 nt, hsa; identical to SEQ ID NO: 218269

SEQ ID NO: 285878 - RNA, 64 nt, hsa; identical to SEQ ID NO: 218270

SEQ ID NO: 285879 - RNA, 64 nt, hsa; identical to SEQ ID NO: 218271

SEQ ID NO: 285880 - RNA, 64 nt, hsa; identical to SEQ ID NO: 218272

SEQ ID NO: 285881 - RNA, 64 nt, hsa; identical to SEQ ID NO: 218273

SEQ ID NO: 285882 - RNA, 64 nt, hsa; identical to SEQ ID NO: 218274

SEQ ID NO: 285883 - RNA, 64 nt, hsa; identical to SEQ ID NO: 218275

SEQ ID NO: 285884 - RNA, 64 nt, hsa; identical to SEQ ID NO: 218276

SEQ ID NO: 285885 - RNA, 64 nt, hsa; identical to SEQ ID NO: 218277

SEQ ID NO: 285886 - RNA, 64 nt, hsa; identical to SEQ ID NO: 218278

SEQ ID NO: 285887 - RNA, 64 nt, hsa; identical to SEQ ID NO: 218279

SEQ ID NO: 285888 - RNA, 64 nt, hsa; identical to SEQ ID NO: 218280

SEQ ID NO: 285889 - RNA, 64 nt, hsa; identical to SEQ ID NO: 218281

SEQ ID NO: 285890 - RNA, 64 nt, hsa; identical to SEQ ID NO: 218282

SEQ ID NO: 285891 - RNA, 64 nt, hsa; identical to SEQ ID NO: 218283

SEQ ID NO: 285892 - RNA, 64 nt, hsa; identical to SEQ ID NO: 218284

SEQ ID NO: 285893 - RNA, 64 nt, hsa; identical to SEQ ID NO: 218285

SEQ ID NO: 285894 - RNA, 64 nt, hsa; identical to SEQ ID NO: 218286

SEQ ID NO: 285895 - RNA, 64 nt, hsa; identical to SEQ ID NO: 218287

SEQ ID NO: 285896 - RNA, 64 nt, hsa; identical to SEQ ID NO: 218288

SEQ ID NO: 285897 - RNA, 64 nt, hsa; identical to SEQ ID NO: 218289

SEQ ID NO: 285898 - RNA, 64 nt, hsa; identical to SEQ ID NO: 218290

SEQ ID NO: 285899 - RNA, 64 nt, hsa; identical to SEQ ID NO: 218291

SEQ ID NO: 285900 - RNA, 64 nt, hsa; identical to SEQ ID NO: 218292

SEQ ID NO: 285901 - RNA, 64 nt, hsa; identical to SEQ ID NO: 218293

SEQ ID NO: 285902 - RNA, 64 nt, hsa; identical to SEQ ID NO: 218294

SEQ ID NO: 285903 - RNA, 64 nt, hsa; identical to SEQ ID NO: 218295

SEQ ID NO: 285904 - RNA, 64 nt, hsa; identical to SEQ ID NO: 218296

SEQ ID NO: 285905 - RNA, 64 nt, hsa; identical to SEQ ID NO: 218297

SEQ ID NO: 285906 - RNA, 64 nt, hsa; identical to SEQ ID NO: 218298

SEQ ID NO: 285907 - RNA, 64 nt, hsa; identical to SEQ ID NO: 218299

SEQ ID NO: 285908 - RNA, 64 nt, hsa; identical to SEQ ID NO: 218300

SEQ ID NO: 285909 - RNA, 64 nt, hsa; identical to SEQ ID NO: 218301

SEQ ID NO: 285910 - RNA, 64 nt, hsa; identical to SEQ ID NO: 218302

SEQ ID NO: 285911 - RNA, 64 nt, hsa; identical to SEQ ID NO: 218303

SEQ ID NO: 285912 - RNA, 64 nt, hsa; identical to SEQ ID NO: 218304

SEQ ID NO: 285913 - RNA, 64 nt, hsa; identical to SEQ ID NO: 218305

SEQ ID NO: 285914 - RNA, 64 nt, hsa; identical to SEQ ID NO: 218306

SEQ ID NO: 285915 - RNA, 64 nt, hsa; identical to SEQ ID NO: 218307

SEQ ID NO: 285916 - RNA, 64 nt, hsa; identical to SEQ ID NO: 218308

SEQ ID NO: 285917 - RNA, 64 nt, hsa; identical to SEQ ID NO: 218309

SEQ ID NO: 285918 - RNA, 64 nt, hsa; identical to SEQ ID NO: 218310

SEQ ID NO: 285919 - RNA, 64 nt, hsa; identical to SEQ ID NO: 218311

SEQ ID NO: 285920 - RNA, 64 nt, hsa; identical to SEQ ID NO: 218312

SEQ ID NO: 285921 - RNA, 64 nt, hsa; identical to SEQ ID NO: 218313

SEQ ID NO: 285922 - RNA, 64 nt, hsa; identical to SEQ ID NO: 218314

SEQ ID NO: 285923 - RNA, 64 nt, hsa; identical to SEQ ID NO: 218315

SEQ ID NO: 285924 - RNA, 64 nt, hsa; identical to SEQ ID NO: 218316

SEQ ID NO: 285925 - RNA, 64 nt, hsa; identical to SEQ ID NO: 218317

SEQ ID NO: 285926 - RNA, 64 nt, hsa; identical to SEQ ID NO: 218318

SEQ ID NO: 285927 - RNA, 64 nt, hsa; identical to SEQ ID NO: 218319

SEQ ID NO: 285928 - RNA, 64 nt, hsa; identical to SEQ ID NO: 218320

SEQ ID NO: 285929 - RNA, 64 nt, hsa; identical to SEQ ID NO: 218321

SEQ ID NO: 285930 - RNA, 64 nt, hsa; identical to SEQ ID NO: 218322

SEQ ID NO: 285931 - RNA, 64 nt, hsa; identical to SEQ ID NO: 218323

SEQ ID NO: 285932 - RNA, 64 nt, hsa; identical to SEQ ID NO: 218324

SEQ ID NO: 285933 - RNA, 64 nt, hsa; identical to SEQ ID NO: 218325

SEQ ID NO: 285934 - RNA, 64 nt, hsa; identical to SEQ ID NO: 218326

SEQ ID NO: 285935 - RNA, 64 nt, hsa; identical to SEQ ID NO: 218327

SEQ ID NO: 285936 - RNA, 64 nt, hsa; identical to SEQ ID NO: 218328

SEQ ID NO: 285937 - RNA, 64 nt, hsa; identical to SEQ ID NO: 218329

SEQ ID NO: 285938 - RNA, 64 nt, hsa; identical to SEQ ID NO: 218330

SEQ ID NO: 285939 - RNA, 64 nt, hsa; identical to SEQ ID NO: 218331

SEQ ID NO: 285940 - RNA, 64 nt, hsa; identical to SEQ ID NO: 218332

SEQ ID NO: 285941 - RNA, 64 nt, hsa; identical to SEQ ID NO: 218333

SEQ ID NO: 285942 - RNA, 64 nt, hsa; identical to SEQ ID NO: 218334

SEQ ID NO: 285943 - RNA, 64 nt, hsa; identical to SEQ ID NO: 218335

SEQ ID NO: 285944 - RNA, 64 nt, hsa; identical to SEQ ID NO: 218336

SEQ ID NO: 285945 - RNA, 64 nt, hsa; identical to SEQ ID NO: 218337

SEQ ID NO: 285946 - RNA, 64 nt, hsa; identical to SEQ ID NO: 218338

SEQ ID NO: 285947 - RNA, 64 nt, hsa; identical to SEQ ID NO: 218339

SEQ ID NO: 285948 - RNA, 64 nt, hsa; identical to SEQ ID NO: 218340

SEQ ID NO: 285949 - RNA, 64 nt, hsa; identical to SEQ ID NO: 218341

SEQ ID NO: 285950 - RNA, 64 nt, hsa; identical to SEQ ID NO: 218342

SEQ ID NO: 285951 - RNA, 64 nt, hsa; identical to SEQ ID NO: 218343

SEQ ID NO: 285952 - RNA, 64 nt, hsa; identical to SEQ ID NO: 218344

SEQ ID NO: 285953 - RNA, 64 nt, hsa; identical to SEQ ID NO: 125759

SEQ ID NO: 285954 - RNA, 64 nt, hsa; identical to SEQ ID NO: 125760

SEQ ID NO: 285955 - RNA, 64 nt, hsa
cuguccaucuuuaagaccuucauccauggaaucuacuauacaggaggaugcagugggcuggagg

SEQ ID NO: 285956 - RNA, 64 nt, hsa
uucuugccucccucccuucuaaacauguguaauaacuauacagagacugcuacaaaauuguaua

SEQ ID NO: 285957 - RNA, 64 nt, hsa
ugaaagaaacauguugggaucguggauuuaagaaacuauacacuguuucucauaaucucuugaa

SEQ ID NO: 285958 - RNA, 64 nt, hsa
guaaacauggagacuuaaacauaaagaaauaggcacuauacaauggggacauaaaaaaagaaaa

SEQ ID NO: 285959 - RNA, 64 nt, hsa
uuuucagugguugccgauuuccauuugaugaagaacuauacagcuuaaaaaaauacguuaguua

SEQ ID NO: 285960 - RNA, 64 nt, hsa
agugaaaugggacagugccuugcagucuuugcccacuauacauaggcuaaggcuaagcucuuug

SEQ ID NO: 285961 - RNA, 64 nt, hsa; identical to SEQ ID NO: 264323

SEQ ID NO: 285962 - RNA, 64 nt, hsa; identical to SEQ ID NO: 264324

SEQ ID NO: 285963 - RNA, 64 nt, hsa; identical to SEQ ID NO: 264325

SEQ ID NO: 285964 - RNA, 64 nt, hsa; identical to SEQ ID NO: 264326

SEQ ID NO: 285965 - RNA, 64 nt, hsa; identical to SEQ ID NO: 264327

SEQ ID NO: 285966 - RNA, 64 nt, hsa; identical to SEQ ID NO: 264328

SEQ ID NO: 285967 - RNA, 64 nt, hsa; identical to SEQ ID NO: 264329

SEQ ID NO: 285968 - RNA, 64 nt, hsa; identical to SEQ ID NO: 264330

SEQ ID NO: 285969 - RNA, 64 nt, hsa; identical to SEQ ID NO: 264331

SEQ ID NO: 285970 - RNA, 64 nt, hsa; identical to SEQ ID NO: 264332

SEQ ID NO: 285971 - RNA, 64 nt, hsa; identical to SEQ ID NO: 264333

SEQ ID NO: 285972 - RNA, 64 nt, hsa; identical to SEQ ID NO: 264334

SEQ ID NO: 285973 - RNA, 64 nt, hsa; identical to SEQ ID NO: 264335

SEQ ID NO: 285974 - RNA, 64 nt, hsa; identical to SEQ ID NO: 264336

SEQ ID NO: 285975 - RNA, 64 nt, hsa; identical to SEQ ID NO: 264337

SEQ ID NO: 285976 - RNA, 64 nt, hsa; identical to SEQ ID NO: 264338

SEQ ID NO: 285977 - RNA, 64 nt, hsa; identical to SEQ ID NO: 264339

SEQ ID NO: 285978 - RNA, 64 nt, hsa; identical to SEQ ID NO: 264340

SEQ ID NO: 285979 - RNA, 64 nt, hsa; identical to SEQ ID NO: 264341

SEQ ID NO: 285980 - RNA, 64 nt, hsa; identical to SEQ ID NO: 264342

SEQ ID NO: 285981 - RNA, 64 nt, hsa; identical to SEQ ID NO: 264343

SEQ ID NO: 285982 - RNA, 64 nt, hsa; identical to SEQ ID NO: 264344

SEQ ID NO: 285983 - RNA, 64 nt, hsa; identical to SEQ ID NO: 264345

SEQ ID NO: 285984 - RNA, 64 nt, hsa; identical to SEQ ID NO: 264346

SEQ ID NO: 285985 - RNA, 64 nt, hsa; identical to SEQ ID NO: 264347

SEQ ID NO: 285986 - RNA, 64 nt, hsa; identical to SEQ ID NO: 264348

SEQ ID NO: 285987 - RNA, 64 nt, hsa; identical to SEQ ID NO: 264349

SEQ ID NO: 285988 - RNA, 64 nt, hsa; identical to SEQ ID NO: 264350

SEQ ID NO: 285989 - RNA, 64 nt, hsa; identical to SEQ ID NO: 264351

SEQ ID NO: 285990 - RNA, 64 nt, hsa; identical to SEQ ID NO: 264352

SEQ ID NO: 285991 - RNA, 64 nt, hsa; identical to SEQ ID NO: 264353

SEQ ID NO: 285992 - RNA, 64 nt, hsa; identical to SEQ ID NO: 264354

SEQ ID NO: 285993 - RNA, 64 nt, hsa; identical to SEQ ID NO: 264355

SEQ ID NO: 285994 - RNA, 64 nt, hsa; identical to SEQ ID NO: 264356

SEQ ID NO: 285995 - RNA, 64 nt, hsa; identical to SEQ ID NO: 264357

SEQ ID NO: 285996 - RNA, 64 nt, hsa; identical to SEQ ID NO: 264358

SEQ ID NO: 285997 - RNA, 64 nt, hsa; identical to SEQ ID NO: 264359

SEQ ID NO: 285998 - RNA, 64 nt, hsa; identical to SEQ ID NO: 264360

SEQ ID NO: 285999 - RNA, 64 nt, hsa; identical to SEQ ID NO: 264361

SEQ ID NO: 286000 - RNA, 64 nt, hsa; identical to SEQ ID NO: 264362

SEQ ID NO: 286001 - RNA, 64 nt, hsa; identical to SEQ ID NO: 264363

SEQ ID NO: 286002 - RNA, 64 nt, hsa; identical to SEQ ID NO: 264364

SEQ ID NO: 286003 - RNA, 64 nt, hsa
accugacuugaaaugccauuucuuuuaaccuuccaaauccuaaauguuuccuucaaggcaucuu

SEQ ID NO: 286004 - RNA, 64 nt, hsa
uaauagguaaagucuaauauuaguucccuuaacaaaauccuaacuguauaccagaauuagguca

SEQ ID NO: 286005 - RNA, 64 nt, hsa
uuuacaaaauauagcagaugcaagauuaugggggaaauccuauauucagaguacucuauaaauu

SEQ ID NO: 286006 - RNA, 64 nt, hsa
accagagaacuacuaaaaaaaccaacugcuuuuuaaauccuauuguguaguuaaagugucaugc

SEQ ID NO: 286007 - RNA, 64 nt, hsa
gguacuuuuaggugccauuagguauugaucagugaaauccuagggugcucuaugagauuguacu

SEQ ID NO: 286008 - RNA, 64 nt, hsa
gguuuaaaucgacuguuuuuaaaaugacacuuauaaauccuaauaaacuguuaaacccaccuuc

SEQ ID NO: 286009 - RNA, 64 nt, hsa
gaaaacaauuccacgaggccaaucuaaagggaaaaaauccuacacuacuuuuacuacuuuugau

SEQ ID NO: 286010 - RNA, 64 nt, hsa
gacuuucuacgaacagguaccuugcugucuugacaaauccuaaugucacgccuacagccccaac

SEQ ID NO: 286011 - RNA, 64 nt, hsa
ccugccaaauuuugauccuuccccucuuuuggccaaauccuagggggaagaaauccuaguaugc

SEQ ID NO: 286012 - RNA, 64 nt, hsa
ccuuccccucuuuuggccaaauccuagggggaagaaauccuaguaugccaaaaauauaugcuaa

SEQ ID NO: 286013 - RNA, 64 nt, hsa
auucuaaagacugcuaagguuuuguuuucauuuuaaauccuagcugauuguuguggucaaugaa

SEQ ID NO: 286014 - RNA, 64 nt, hsa
aaucucuuugucaaauuacgaaaacuucagggugaaauccuaugcuuccauguacauuacaugg

SEQ ID NO: 286015 - RNA, 64 nt, hsa
ccuuacuaaacauaagagaauucauaccauagagaaauccuacaaauaugaagaaugugacaaa

SEQ ID NO: 286016 - RNA, 64 nt, hsa
cuuuucuaaucauaaaagaaaucauauuggugagaaauccuagaaauguggagaauguaacaaa

SEQ ID NO: 286017 - RNA, 64 nt, hsa
aauaggaaaaacaguauguuuucaguccauuaaaaaauccuaaccaaauuuaauuugaauucaa

SEQ ID NO: 286018 - RNA, 64 nt, hsa
uaagcaucaucuccauuucaccauauccuaacugaaauccuauauauuucuuguguguucuuuu

SEQ ID NO: 286019 - RNA, 64 nt, hsa
uuuuguucccgguuuuucuuacuguuacaaauaaaaauccuaugaacauuuguacacacaggcu

SEQ ID NO: 286020 - RNA, 64 nt, hsa
uaggacauuaugucuaaaaauuguauacugagaaaaauccuaugaauguggcagacuauaaaag

SEQ ID NO: 286021 - RNA, 64 nt, hsa
gauacuuuccugaauguguucuugguguuugugaaaauccuauaagauuuaaagaaauauauau

SEQ ID NO: 286022 - RNA, 64 nt, hsa
cauuucauaguuucaaaucuguaaucagcaauaaaaauccuaaaauauguaccuaagaacaucu

SEQ ID NO: 286023 - RNA, 64 nt, hsa
uccaguggaagcagaaaggguuuuuucagcuguuaaauccuaaaaaucaauauaauuuauuuau

SEQ ID NO: 286024 - RNA, 64 nt, hsa
aacugaucauagaagaagaauccaguaauugaacaaauccuauuuaaugacauccuuguagcau

SEQ ID NO: 286025 - RNA, 64 nt, hsa; identical to SEQ ID NO: 114439

SEQ ID NO: 286026 - RNA, 64 nt, hsa; identical to SEQ ID NO: 114440

SEQ ID NO: 286027 - RNA, 64 nt, hsa; identical to SEQ ID NO: 114441

SEQ ID NO: 286028 - RNA, 64 nt, hsa; identical to SEQ ID NO: 114442

SEQ ID NO: 286029 - RNA, 64 nt, hsa; identical to SEQ ID NO: 114443

SEQ ID NO: 286030 - RNA, 64 nt, hsa; identical to SEQ ID NO: 114444

SEQ ID NO: 286031 - RNA, 64 nt, hsa; identical to SEQ ID NO: 114445

SEQ ID NO: 286032 - RNA, 64 nt, hsa; identical to SEQ ID NO: 114446

SEQ ID NO: 286033 - RNA, 64 nt, hsa; identical to SEQ ID NO: 114447

SEQ ID NO: 286034 - RNA, 64 nt, hsa; identical to SEQ ID NO: 114448

SEQ ID NO: 286035 - RNA, 64 nt, hsa; identical to SEQ ID NO: 114449

SEQ ID NO: 286036 - RNA, 64 nt, hsa; identical to SEQ ID NO: 114450

SEQ ID NO: 286037 - RNA, 64 nt, hsa; identical to SEQ ID NO: 114451

SEQ ID NO: 286038 - RNA, 64 nt, hsa; identical to SEQ ID NO: 114452

SEQ ID NO: 286039 - RNA, 64 nt, hsa; identical to SEQ ID NO: 114453

SEQ ID NO: 286040 - RNA, 64 nt, hsa; identical to SEQ ID NO: 114454

SEQ ID NO: 286041 - RNA, 64 nt, hsa; identical to SEQ ID NO: 114455

SEQ ID NO: 286042 - RNA, 64 nt, hsa; identical to SEQ ID NO: 114456

SEQ ID NO: 286043 - RNA, 64 nt, hsa; identical to SEQ ID NO: 114457

SEQ ID NO: 286044 - RNA, 64 nt, hsa; identical to SEQ ID NO: 114458

SEQ ID NO: 286045 - RNA, 64 nt, hsa; identical to SEQ ID NO: 114459

SEQ ID NO: 286046 - RNA, 64 nt, hsa; identical to SEQ ID NO: 114460

SEQ ID NO: 286047 - RNA, 64 nt, hsa; identical to SEQ ID NO: 114461

SEQ ID NO: 286048 - RNA, 64 nt, hsa; identical to SEQ ID NO: 114462

SEQ ID NO: 286049 - RNA, 64 nt, hsa; identical to SEQ ID NO: 114463

SEQ ID NO: 286050 - RNA, 64 nt, hsa; identical to SEQ ID NO: 114464

SEQ ID NO: 286051 - RNA, 64 nt, hsa; identical to SEQ ID NO: 114465

SEQ ID NO: 286052 - RNA, 64 nt, hsa; identical to SEQ ID NO: 114466

SEQ ID NO: 286053 - RNA, 64 nt, hsa; identical to SEQ ID NO: 114467

SEQ ID NO: 286054 - RNA, 64 nt, hsa; identical to SEQ ID NO: 114468

SEQ ID NO: 286055 - RNA, 64 nt, hsa; identical to SEQ ID NO: 114469

SEQ ID NO: 286056 - RNA, 64 nt, hsa; identical to SEQ ID NO: 114470

SEQ ID NO: 286057 - RNA, 64 nt, hsa; identical to SEQ ID NO: 114471

SEQ ID NO: 286058 - RNA, 64 nt, hsa; identical to SEQ ID NO: 114472

SEQ ID NO: 286059 - RNA, 64 nt, hsa; identical to SEQ ID NO: 114473

SEQ ID NO: 286060 - RNA, 64 nt, hsa; identical to SEQ ID NO: 114474

SEQ ID NO: 286061 - RNA, 64 nt, hsa; identical to SEQ ID NO: 114475

SEQ ID NO: 286062 - RNA, 64 nt, hsa; identical to SEQ ID NO: 114476

SEQ ID NO: 286063 - RNA, 64 nt, hsa; identical to SEQ ID NO: 114477

SEQ ID NO: 286064 - RNA, 64 nt, hsa; identical to SEQ ID NO: 114478

SEQ ID NO: 286065 - RNA, 64 nt, hsa; identical to SEQ ID NO: 114479

SEQ ID NO: 286066 - RNA, 64 nt, hsa; identical to SEQ ID NO: 114480

SEQ ID NO: 286067 - RNA, 64 nt, hsa; identical to SEQ ID NO: 114481

SEQ ID NO: 286068 - RNA, 64 nt, hsa; identical to SEQ ID NO: 114482

SEQ ID NO: 286069 - RNA, 64 nt, hsa; identical to SEQ ID NO: 114483

SEQ ID NO: 286070 - RNA, 64 nt, hsa; identical to SEQ ID NO: 114484

SEQ ID NO: 286071 - RNA, 64 nt, hsa; identical to SEQ ID NO: 114485

SEQ ID NO: 286072 - RNA, 64 nt, hsa; identical to SEQ ID NO: 114486

SEQ ID NO: 286073 - RNA, 64 nt, hsa; identical to SEQ ID NO: 114487

SEQ ID NO: 286074 - RNA, 64 nt, hsa; identical to SEQ ID NO: 114488

SEQ ID NO: 286075 - RNA, 64 nt, hsa; identical to SEQ ID NO: 114489

SEQ ID NO: 286076 - RNA, 64 nt, hsa; identical to SEQ ID NO: 114490

SEQ ID NO: 286077 - RNA, 64 nt, hsa; identical to SEQ ID NO: 114491

SEQ ID NO: 286078 - RNA, 64 nt, hsa; identical to SEQ ID NO: 114492

SEQ ID NO: 286079 - RNA, 64 nt, hsa; identical to SEQ ID NO: 114493

SEQ ID NO: 286080 - RNA, 64 nt, hsa; identical to SEQ ID NO: 114494

SEQ ID NO: 286081 - RNA, 64 nt, hsa; identical to SEQ ID NO: 114495

SEQ ID NO: 286082 - RNA, 64 nt, hsa; identical to SEQ ID NO: 114496

SEQ ID NO: 286083 - RNA, 64 nt, hsa; identical to SEQ ID NO: 114497

SEQ ID NO: 286084 - RNA, 64 nt, hsa; identical to SEQ ID NO: 114498

SEQ ID NO: 286085 - RNA, 64 nt, hsa; identical to SEQ ID NO: 114499

SEQ ID NO: 286086 - RNA, 64 nt, hsa; identical to SEQ ID NO: 114500

SEQ ID NO: 286087 - RNA, 64 nt, hsa; identical to SEQ ID NO: 114501

SEQ ID NO: 286088 - RNA, 64 nt, hsa; identical to SEQ ID NO: 114502

SEQ ID NO: 286089 - RNA, 64 nt, hsa; identical to SEQ ID NO: 114503

SEQ ID NO: 286090 - RNA, 64 nt, hsa; identical to SEQ ID NO: 114504

SEQ ID NO: 286091 - RNA, 64 nt, hsa; identical to SEQ ID NO: 114505

SEQ ID NO: 286092 - RNA, 64 nt, hsa; identical to SEQ ID NO: 114506

SEQ ID NO: 286093 - RNA, 64 nt, hsa; identical to SEQ ID NO: 114507

SEQ ID NO: 286094 - RNA, 64 nt, hsa; identical to SEQ ID NO: 114508

SEQ ID NO: 286095 - RNA, 64 nt, hsa; identical to SEQ ID NO: 114509

SEQ ID NO: 286096 - RNA, 64 nt, hsa; identical to SEQ ID NO: 114510

SEQ ID NO: 286097 - RNA, 64 nt, hsa; identical to SEQ ID NO: 114511

SEQ ID NO: 286098 - RNA, 64 nt, hsa; identical to SEQ ID NO: 114512

SEQ ID NO: 286099 - RNA, 64 nt, hsa; identical to SEQ ID NO: 114513

SEQ ID NO: 286100 - RNA, 64 nt, hsa; identical to SEQ ID NO: 114514

SEQ ID NO: 286101 - RNA, 64 nt, hsa; identical to SEQ ID NO: 114515

SEQ ID NO: 286102 - RNA, 64 nt, hsa; identical to SEQ ID NO: 114516

SEQ ID NO: 286103 - RNA, 64 nt, hsa
ccacagcccuccucucccaagaaauccaggcuccucucccaagaaauccaggugcuuuccagac

SEQ ID NO: 286104 - RNA, 64 nt, hsa
gaagaagaacugauuggggcuuccacagcccuccucucccaagaaauccaggcuccucucccaa

SEQ ID NO: 286105 - RNA, 64 nt, hsa
gaaucuuuuuaagauuaaaaaugaauaccuuaaaucucccaaaagagauaaccaguaucugaag

SEQ ID NO: 286106 - RNA, 64 nt, hsa
gaacuccugaccgcaagugauccacacgccuuggucucccaaagugcugggauuacgguguuag

SEQ ID NO: 286107 - RNA, 64 nt, hsa
gagaaacugcagccccacuucuguuucccuggagucucccaauggaucauucaggaguguccua

SEQ ID NO: 286108 - RNA, 64 nt, hsa
aucugaaggggaagagggugaccucagcggcuuuucucccaaaaaucggcugaaggcugguugu

SEQ ID NO: 286109 - RNA, 64 nt, hsa
auguacuacccucagucuacacucacaaucaucuucucccaagacugcucccuuuuguuuugug

SEQ ID NO: 286110 - RNA, 64 nt, hsa
ucugccuuugugcucuguuccuguccagcaggggucucccaacaagugcucuuuccaccccaaa

SEQ ID NO: 286111 - RNA, 64 nt, hsa
ccuggcagccccccaugugggagaaauaccugauucucccaaucugcagugggagagcuuugcu

SEQ ID NO: 286112 - RNA, 64 nt, hsa
ccucacugcgccagccuccccgcccgcucucuuuucucccaagcgaaaccaaaugcgccccuuc

SEQ ID NO: 286113 - RNA, 64 nt, hsa
gggugagacaguccacccagagcucucccaagucucucccaaauaccuuagaguagggacacug

SEQ ID NO: 286114 - RNA, 64 nt, hsa
gcauuugaacagggugagacaguccacccagagcucucccaagucucucccaaauaccuuagag

SEQ ID NO: 286115 - RNA, 64 nt, hsa
agccgaacguggaacaguaucacaaaagauuccaucucccaacgauuucagaacucugagcuca

SEQ ID NO: 286116 - RNA, 64 nt, hsa
uaagagaagaaagauaaggaggcucccacccaccucucccaagagcagacauuaaacaucuuug

SEQ ID NO: 286117 - RNA, 64 nt, hsa
uaaaggggaaagaaacuacuuuagagccucuuuuucucccaacucauauuuuugauaggaaaaa

SEQ ID NO: 286118 - RNA, 64 nt, hsa
guguguaugcuuccagguggaggagaaaggggaaucucccaaaauuuaaaaacaaauuggaaga

SEQ ID NO: 286119 - RNA, 64 nt, hsa
ugacucaaucugccaaaugugcugcagcucguuuucucccaauuacagcaagacugucagccuc

SEQ ID NO: 286120 - RNA, 64 nt, hsa
uccacuaggagauuuuuauaaacccucuccagccucucccaaaggaagcguuggcagcaaaggg

SEQ ID NO: 286121 - RNA, 64 nt, hsa
ggcugcccugggccauaugugcuauggagaggacucucccaaacccccaauagcuagugacagc

SEQ ID NO: 286122 - RNA, 64 nt, hsa
uuccaaagcuuccccuuaucguccccugugauuaucucccaaccccgugacaaagguagagcaa

SEQ ID NO: 286123 - RNA, 64 nt, hsa
aucacguuugucacugccguuuauuacauugacuucucccaagaugaaucuuccuuccaaaugu

SEQ ID NO: 286124 - RNA, 64 nt, hsa
aacccugaagauaaucaaggccaguuacucaucaucucccaaccacuguuuccucaacugcccu

SEQ ID NO: 286125 - RNA, 64 nt, hsa; identical to SEQ ID NO: 61562

SEQ ID NO: 286126 - RNA, 64 nt, hsa; identical to SEQ ID NO: 61563

SEQ ID NO: 286127 - RNA, 64 nt, hsa; identical to SEQ ID NO: 61564

SEQ ID NO: 286128 - RNA, 64 nt, hsa; identical to SEQ ID NO: 61565

SEQ ID NO: 286129 - RNA, 64 nt, hsa; identical to SEQ ID NO: 61566

SEQ ID NO: 286130 - RNA, 64 nt, hsa; identical to SEQ ID NO: 61567

SEQ ID NO: 286131 - RNA, 64 nt, hsa; identical to SEQ ID NO: 61568

SEQ ID NO: 286132 - RNA, 64 nt, hsa; identical to SEQ ID NO: 61569

SEQ ID NO: 286133 - RNA, 64 nt, hsa; identical to SEQ ID NO: 61570

SEQ ID NO: 286134 - RNA, 64 nt, hsa; identical to SEQ ID NO: 61571

SEQ ID NO: 286135 - RNA, 64 nt, hsa; identical to SEQ ID NO: 61572

SEQ ID NO: 286136 - RNA, 64 nt, hsa; identical to SEQ ID NO: 61573

SEQ ID NO: 286137 - RNA, 64 nt, hsa; identical to SEQ ID NO: 61574

SEQ ID NO: 286138 - RNA, 64 nt, hsa; identical to SEQ ID NO: 61575

SEQ ID NO: 286139 - RNA, 64 nt, hsa; identical to SEQ ID NO: 61576

SEQ ID NO: 286140 - RNA, 64 nt, hsa; identical to SEQ ID NO: 61577

SEQ ID NO: 286141 - RNA, 64 nt, hsa; identical to SEQ ID NO: 61578

SEQ ID NO: 286142 - RNA, 64 nt, hsa; identical to SEQ ID NO: 61579

SEQ ID NO: 286143 - RNA, 64 nt, hsa; identical to SEQ ID NO: 61580

SEQ ID NO: 286144 - RNA, 64 nt, hsa; identical to SEQ ID NO: 61581

SEQ ID NO: 286145 - RNA, 64 nt, hsa; identical to SEQ ID NO: 61582

SEQ ID NO: 286146 - RNA, 64 nt, hsa; identical to SEQ ID NO: 61583

SEQ ID NO: 286147 - RNA, 64 nt, hsa; identical to SEQ ID NO: 61584

SEQ ID NO: 286148 - RNA, 64 nt, hsa; identical to SEQ ID NO: 61585

SEQ ID NO: 286149 - RNA, 64 nt, hsa; identical to SEQ ID NO: 61586

SEQ ID NO: 286150 - RNA, 64 nt, hsa; identical to SEQ ID NO: 61587

SEQ ID NO: 286151 - RNA, 64 nt, hsa; identical to SEQ ID NO: 61588

SEQ ID NO: 286152 - RNA, 64 nt, hsa; identical to SEQ ID NO: 61589

SEQ ID NO: 286153 - RNA, 64 nt, hsa; identical to SEQ ID NO: 61590

SEQ ID NO: 286154 - RNA, 64 nt, hsa; identical to SEQ ID NO: 61591

SEQ ID NO: 286155 - RNA, 64 nt, hsa; identical to SEQ ID NO: 61592

SEQ ID NO: 286156 - RNA, 64 nt, hsa; identical to SEQ ID NO: 61593

SEQ ID NO: 286157 - RNA, 64 nt, hsa; identical to SEQ ID NO: 61594

SEQ ID NO: 286158 - RNA, 64 nt, hsa; identical to SEQ ID NO: 61595

SEQ ID NO: 286159 - RNA, 64 nt, hsa; identical to SEQ ID NO: 61596

SEQ ID NO: 286160 - RNA, 64 nt, hsa; identical to SEQ ID NO: 61597

SEQ ID NO: 286161 - RNA, 64 nt, hsa; identical to SEQ ID NO: 61598

SEQ ID NO: 286162 - RNA, 64 nt, hsa; identical to SEQ ID NO: 61599

SEQ ID NO: 286163 - RNA, 64 nt, hsa; identical to SEQ ID NO: 61600

SEQ ID NO: 286164 - RNA, 64 nt, hsa; identical to SEQ ID NO: 61601

SEQ ID NO: 286165 - RNA, 64 nt, hsa; identical to SEQ ID NO: 61602

SEQ ID NO: 286166 - RNA, 64 nt, hsa; identical to SEQ ID NO: 61603

SEQ ID NO: 286167 - RNA, 64 nt, hsa; identical to SEQ ID NO: 61604

SEQ ID NO: 286168 - RNA, 64 nt, hsa; identical to SEQ ID NO: 61605

SEQ ID NO: 286169 - RNA, 64 nt, hsa; identical to SEQ ID NO: 61606

SEQ ID NO: 286170 - RNA, 64 nt, hsa; identical to SEQ ID NO: 61607

SEQ ID NO: 286171 - RNA, 64 nt, hsa; identical to SEQ ID NO: 61608

SEQ ID NO: 286172 - RNA, 64 nt, hsa; identical to SEQ ID NO: 61609

SEQ ID NO: 286173 - RNA, 64 nt, hsa; identical to SEQ ID NO: 61610

SEQ ID NO: 286174 - RNA, 64 nt, hsa; identical to SEQ ID NO: 61611

SEQ ID NO: 286175 - RNA, 64 nt, hsa; identical to SEQ ID NO: 61612

SEQ ID NO: 286176 - RNA, 64 nt, hsa; identical to SEQ ID NO: 61613

SEQ ID NO: 286177 - RNA, 64 nt, hsa; identical to SEQ ID NO: 61614

SEQ ID NO: 286178 - RNA, 64 nt, hsa; identical to SEQ ID NO: 61615

SEQ ID NO: 286179 - RNA, 64 nt, hsa; identical to SEQ ID NO: 61616

SEQ ID NO: 286180 - RNA, 64 nt, hsa; identical to SEQ ID NO: 61617

SEQ ID NO: 286181 - RNA, 64 nt, hsa; identical to SEQ ID NO: 61618

SEQ ID NO: 286182 - RNA, 64 nt, hsa; identical to SEQ ID NO: 61619

SEQ ID NO: 286183 - RNA, 64 nt, hsa; identical to SEQ ID NO: 61620

SEQ ID NO: 286184 - RNA, 64 nt, hsa; identical to SEQ ID NO: 61621

SEQ ID NO: 286185 - RNA, 64 nt, hsa; identical to SEQ ID NO: 61622

SEQ ID NO: 286186 - RNA, 64 nt, hsa
uaacuucuuuugacuuaaaugaauuuaaaaugagccaaaggacccugaaaagaagacauguuga

SEQ ID NO: 286187 - RNA, 64 nt, hsa
cagcugcagcaaggagguggggaaggagggcaccccaaaggacagcgccuucuucucuuccacc

SEQ ID NO: 286188 - RNA, 64 nt, hsa
cucauuaaacuuggcuuagugaagaagagagaugccaaaggaaugaaccaacccuucacauaaa

SEQ ID NO: 286189 - RNA, 64 nt, hsa
gagggacuaggggagugguggggaggugaguggaccaaaggauauaggccccaggcaugcagau

SEQ ID NO: 286190 - RNA, 64 nt, hsa
uaaaaauauugcagugacuuuuuaggcaggagugccaaaggacacuaugaacuuuuugaacuga

SEQ ID NO: 286191 - RNA, 64 nt, hsa
cuugacgaggauacaaaagugaaagcaucaucccccaaaggaucacugcacaguccuacuacag

SEQ ID NO: 286192 - RNA, 64 nt, hsa
acaaacaaaaaacuguuuucauuugcucucuugaccaaaggauaggacuuuaguucuuuaagca

SEQ ID NO: 286193 - RNA, 64 nt, hsa
acugacaagaugucuaauuuuuuuuuaaguaggaccaaaggaaaacaagauuuagauagucuga

SEQ ID NO: 286194 - RNA, 64 nt, hsa
guuuucaauaacuuuuauuucuguuuuguaaugaccaaaggaaugaggcugacauagguauaua

SEQ ID NO: 286195 - RNA, 64 nt, hsa
gagucuguaccagguggugguuauggggucugaaccaaaggauagcagcucuucauuccucuuc

SEQ ID NO: 286196 - RNA, 64 nt, hsa
ugggcuuuccugaauugccaagccuggugccuuuccaaaggacuagcagggccugugguggagc

SEQ ID NO: 286197 - RNA, 64 nt, hsa
uuuguuuugccuagagaggggcaauaaaaaugaaccaaaggauauuuccagaaaggauuaagaa

SEQ ID NO: 286198 - RNA, 64 nt, hsa
cuaaaauugucuauuaaagcagaggaaauaccugccaaaggaaguauguauugcauuaaucagg

SEQ ID NO: 286199 - RNA, 64 nt, hsa
cauaguugaugcauccaauccuaaaacuuacauuccaaaggaauuauaucauuauguuccuaag

SEQ ID NO: 286200 - RNA, 64 nt, hsa
ucacccuggagauauuuuuucuuauuugaguccaccaaaggauaaugccaacuuauauaaguuc

SEQ ID NO: 286201 - RNA, 64 nt, hsa
aaggauuuucuuuuuaacuuuaccaaaugaaaugccaaaggaaguuuuaaaggccguuggcugu

SEQ ID NO: 286202 - RNA, 64 nt, hsa
gggcuguacaguauuguggcaucagauaaugccaccaaaggagacauaucacugcugcugggac

SEQ ID NO: 286203 - RNA, 64 nt, hsa
uuuuuaaaggaacuucgugacacuaaacauuagcccaaaggacuucuuagccuucaauugggag

SEQ ID NO: 286204 - RNA, 64 nt, hsa
acucaaauucgcaucuucucuauccacaucaugaccaaaggaaccccucccuggugucugauca

SEQ ID NO: 286205 - RNA, 64 nt, hsa
ccaguucuuaaaugcuacaugcaacucccagauuccaaaggauucaaguucuaauuauaaccuu

SEQ ID NO: 286206 - RNA, 64 nt, hsa
cccauaggaggccuauguggagcauuaacuguggccaaaggaggcagcgggaacaggcugcuug

SEQ ID NO: 286207 - RNA, 64 nt, hsa
aagguuucagugauaagucagauguuauuacacaccaaaggacacacacaggggggaagcccua

SEQ ID NO: 286208 - RNA, 64 nt, hsa
cagagggagauuucaagggccuuuucuagcccacccaaaggacaaauggggagcucuagagugg

SEQ ID NO: 286209 - RNA, 64 nt, hsa
uggagaagaacaugagguuauuguuucauuuacuccaaaggauccugaagccugcgaggaaagg

SEQ ID NO: 286210 - RNA, 64 nt, hsa
gcgauugaccaguaacugugagaucagaauucacccaaaggaagacauuuucaucucuguauua

SEQ ID NO: 286211 - RNA, 64 nt, hsa; identical to SEQ ID NO: 43717

SEQ ID NO: 286212 - RNA, 64 nt, hsa; identical to SEQ ID NO: 43718

SEQ ID NO: 286213 - RNA, 64 nt, hsa; identical to SEQ ID NO: 43719

SEQ ID NO: 286214 - RNA, 64 nt, hsa; identical to SEQ ID NO: 43720

SEQ ID NO: 286215 - RNA, 64 nt, hsa; identical to SEQ ID NO: 43721

SEQ ID NO: 286216 - RNA, 64 nt, hsa; identical to SEQ ID NO: 43722

SEQ ID NO: 286217 - RNA, 64 nt, hsa; identical to SEQ ID NO: 43723

SEQ ID NO: 286218 - RNA, 64 nt, hsa; identical to SEQ ID NO: 43724

SEQ ID NO: 286219 - RNA, 64 nt, hsa; identical to SEQ ID NO: 43725

SEQ ID NO: 286220 - RNA, 64 nt, hsa; identical to SEQ ID NO: 43726

SEQ ID NO: 286221 - RNA, 64 nt, hsa; identical to SEQ ID NO: 43727

SEQ ID NO: 286222 - RNA, 64 nt, hsa; identical to SEQ ID NO: 43728

SEQ ID NO: 286223 - RNA, 64 nt, hsa; identical to SEQ ID NO: 43729

SEQ ID NO: 286224 - RNA, 64 nt, hsa; identical to SEQ ID NO: 43730

SEQ ID NO: 286225 - RNA, 64 nt, hsa; identical to SEQ ID NO: 43731

SEQ ID NO: 286226 - RNA, 64 nt, hsa; identical to SEQ ID NO: 43732

SEQ ID NO: 286227 - RNA, 64 nt, hsa; identical to SEQ ID NO: 43733

SEQ ID NO: 286228 - RNA, 64 nt, hsa; identical to SEQ ID NO: 43734

SEQ ID NO: 286229 - RNA, 64 nt, hsa; identical to SEQ ID NO: 43735

SEQ ID NO: 286230 - RNA, 64 nt, hsa; identical to SEQ ID NO: 43736

SEQ ID NO: 286231 - RNA, 64 nt, hsa; identical to SEQ ID NO: 43737

SEQ ID NO: 286232 - RNA, 64 nt, hsa; identical to SEQ ID NO: 43738

SEQ ID NO: 286233 - RNA, 64 nt, hsa; identical to SEQ ID NO: 43739

SEQ ID NO: 286234 - RNA, 64 nt, hsa; identical to SEQ ID NO: 43740

SEQ ID NO: 286235 - RNA, 64 nt, hsa; identical to SEQ ID NO: 43741

SEQ ID NO: 286236 - RNA, 64 nt, hsa; identical to SEQ ID NO: 43742

SEQ ID NO: 286237 - RNA, 64 nt, hsa; identical to SEQ ID NO: 43743

SEQ ID NO: 286238 - RNA, 64 nt, hsa; identical to SEQ ID NO: 43744

SEQ ID NO: 286239 - RNA, 64 nt, hsa; identical to SEQ ID NO: 43745

SEQ ID NO: 286240 - RNA, 64 nt, hsa; identical to SEQ ID NO: 43746

SEQ ID NO: 286241 - RNA, 64 nt, hsa; identical to SEQ ID NO: 100592

SEQ ID NO: 286242 - RNA, 64 nt, hsa; identical to SEQ ID NO: 100593

SEQ ID NO: 286243 - RNA, 64 nt, hsa; identical to SEQ ID NO: 100594

SEQ ID NO: 286244 - RNA, 64 nt, hsa; identical to SEQ ID NO: 100595

SEQ ID NO: 286245 - RNA, 64 nt, hsa; identical to SEQ ID NO: 100596

SEQ ID NO: 286246 - RNA, 64 nt, hsa; identical to SEQ ID NO: 100597

SEQ ID NO: 286247 - RNA, 64 nt, hsa; identical to SEQ ID NO: 100598

SEQ ID NO: 286248 - RNA, 64 nt, hsa; identical to SEQ ID NO: 100599

SEQ ID NO: 286249 - RNA, 64 nt, hsa; identical to SEQ ID NO: 100600

SEQ ID NO: 286250 - RNA, 64 nt, hsa; identical to SEQ ID NO: 100601

SEQ ID NO: 286251 - RNA, 64 nt, hsa; identical to SEQ ID NO: 100602

SEQ ID NO: 286252 - RNA, 64 nt, hsa; identical to SEQ ID NO: 100603

SEQ ID NO: 286253 - RNA, 64 nt, hsa; identical to SEQ ID NO: 100604

SEQ ID NO: 286254 - RNA, 64 nt, hsa; identical to SEQ ID NO: 100605

SEQ ID NO: 286255 - RNA, 64 nt, hsa; identical to SEQ ID NO: 100606

SEQ ID NO: 286256 - RNA, 64 nt, hsa; identical to SEQ ID NO: 100607

SEQ ID NO: 286257 - RNA, 64 nt, hsa; identical to SEQ ID NO: 100608

SEQ ID NO: 286258 - RNA, 64 nt, hsa; identical to SEQ ID NO: 100609

SEQ ID NO: 286259 - RNA, 64 nt, hsa; identical to SEQ ID NO: 100610

SEQ ID NO: 286260 - RNA, 64 nt, hsa; identical to SEQ ID NO: 100611

SEQ ID NO: 286261 - RNA, 64 nt, hsa; identical to SEQ ID NO: 100612

SEQ ID NO: 286262 - RNA, 64 nt, hsa; identical to SEQ ID NO: 100613

SEQ ID NO: 286263 - RNA, 64 nt, hsa; identical to SEQ ID NO: 100614

SEQ ID NO: 286264 - RNA, 64 nt, hsa; identical to SEQ ID NO: 100615

SEQ ID NO: 286265 - RNA, 64 nt, hsa; identical to SEQ ID NO: 100616

SEQ ID NO: 286266 - RNA, 64 nt, hsa; identical to SEQ ID NO: 100617

SEQ ID NO: 286267 - RNA, 64 nt, hsa; identical to SEQ ID NO: 100618

SEQ ID NO: 286268 - RNA, 64 nt, hsa; identical to SEQ ID NO: 100619

SEQ ID NO: 286269 - RNA, 64 nt, hsa; identical to SEQ ID NO: 100620

SEQ ID NO: 286270 - RNA, 64 nt, hsa; identical to SEQ ID NO: 100621

SEQ ID NO: 286271 - RNA, 64 nt, hsa; identical to SEQ ID NO: 100622

SEQ ID NO: 286272 - RNA, 64 nt, hsa; identical to SEQ ID NO: 100623

SEQ ID NO: 286273 - RNA, 64 nt, hsa; identical to SEQ ID NO: 100624

SEQ ID NO: 286274 - RNA, 64 nt, hsa; identical to SEQ ID NO: 100625

SEQ ID NO: 286275 - RNA, 64 nt, hsa; identical to SEQ ID NO: 100626

SEQ ID NO: 286276 - RNA, 64 nt, hsa; identical to SEQ ID NO: 100627

SEQ ID NO: 286277 - RNA, 64 nt, hsa; identical to SEQ ID NO: 100628

SEQ ID NO: 286278 - RNA, 64 nt, hsa; identical to SEQ ID NO: 100629

SEQ ID NO: 286279 - RNA, 64 nt, hsa; identical to SEQ ID NO: 100630

SEQ ID NO: 286280 - RNA, 64 nt, hsa; identical to SEQ ID NO: 100631

SEQ ID NO: 286281 - RNA, 64 nt, hsa; identical to SEQ ID NO: 100632

SEQ ID NO: 286282 - RNA, 64 nt, hsa; identical to SEQ ID NO: 100633

SEQ ID NO: 286283 - RNA, 64 nt, hsa; identical to SEQ ID NO: 100634

SEQ ID NO: 286284 - RNA, 64 nt, hsa; identical to SEQ ID NO: 100635

SEQ ID NO: 286285 - RNA, 64 nt, hsa; identical to SEQ ID NO: 100636

SEQ ID NO: 286286 - RNA, 64 nt, hsa; identical to SEQ ID NO: 100637

SEQ ID NO: 286287 - RNA, 64 nt, hsa; identical to SEQ ID NO: 100638

SEQ ID NO: 286288 - RNA, 64 nt, hsa; identical to SEQ ID NO: 100639

SEQ ID NO: 286289 - RNA, 64 nt, hsa; identical to SEQ ID NO: 100640

SEQ ID NO: 286290 - RNA, 64 nt, hsa; identical to SEQ ID NO: 100641

SEQ ID NO: 286291 - RNA, 64 nt, hsa; identical to SEQ ID NO: 100642

SEQ ID NO: 286292 - RNA, 64 nt, hsa; identical to SEQ ID NO: 100643

SEQ ID NO: 286293 - RNA, 64 nt, hsa; identical to SEQ ID NO: 100644

SEQ ID NO: 286294 - RNA, 64 nt, hsa; identical to SEQ ID NO: 100645

SEQ ID NO: 286295 - RNA, 64 nt, hsa; identical to SEQ ID NO: 100646

SEQ ID NO: 286296 - RNA, 64 nt, hsa; identical to SEQ ID NO: 100647

SEQ ID NO: 286297 - RNA, 64 nt, hsa; identical to SEQ ID NO: 100648

SEQ ID NO: 286298 - RNA, 64 nt, hsa; identical to SEQ ID NO: 100649

SEQ ID NO: 286299 - RNA, 64 nt, hsa; identical to SEQ ID NO: 100650

SEQ ID NO: 286300 - RNA, 64 nt, hsa; identical to SEQ ID NO: 100651

SEQ ID NO: 286301 - RNA, 64 nt, hsa; identical to SEQ ID NO: 100652

SEQ ID NO: 286302 - RNA, 64 nt, hsa; identical to SEQ ID NO: 100653

SEQ ID NO: 286303 - RNA, 64 nt, hsa; identical to SEQ ID NO: 100654

SEQ ID NO: 286304 - RNA, 64 nt, hsa; identical to SEQ ID NO: 100655

SEQ ID NO: 286305 - RNA, 64 nt, hsa; identical to SEQ ID NO: 100656

SEQ ID NO: 286306 - RNA, 64 nt, hsa; identical to SEQ ID NO: 100657

SEQ ID NO: 286307 - RNA, 64 nt, hsa; identical to SEQ ID NO: 100658

SEQ ID NO: 286308 - RNA, 63 nt, hsa; identical to SEQ ID NO: 100659

SEQ ID NO: 286309 - RNA, 64 nt, hsa; identical to SEQ ID NO: 100660

SEQ ID NO: 286310 - RNA, 64 nt, hsa; identical to SEQ ID NO: 100661

SEQ ID NO: 286311 - RNA, 64 nt, hsa; identical to SEQ ID NO: 100662

SEQ ID NO: 286312 - RNA, 64 nt, hsa; identical to SEQ ID NO: 100663

SEQ ID NO: 286313 - RNA, 64 nt, hsa; identical to SEQ ID NO: 100664

SEQ ID NO: 286314 - RNA, 64 nt, hsa; identical to SEQ ID NO: 100665

SEQ ID NO: 286315 - RNA, 64 nt, hsa; identical to SEQ ID NO: 100666

SEQ ID NO: 286316 - RNA, 64 nt, hsa; identical to SEQ ID NO: 100667

SEQ ID NO: 286317 - RNA, 64 nt, hsa; identical to SEQ ID NO: 100668

SEQ ID NO: 286318 - RNA, 64 nt, hsa; identical to SEQ ID NO: 100669

SEQ ID NO: 286319 - RNA, 54 nt, hsa; identical to SEQ ID NO: 100670

SEQ ID NO: 286320 - RNA, 64 nt, hsa; identical to SEQ ID NO: 100671

SEQ ID NO: 286321 - RNA, 64 nt, hsa; identical to SEQ ID NO: 100672

SEQ ID NO: 286322 - RNA, 64 nt, hsa; identical to SEQ ID NO: 100673

SEQ ID NO: 286323 - RNA, 64 nt, hsa; identical to SEQ ID NO: 100674

SEQ ID NO: 286324 - RNA, 64 nt, hsa; identical to SEQ ID NO: 100675

SEQ ID NO: 286325 - RNA, 64 nt, hsa; identical to SEQ ID NO: 100676

SEQ ID NO: 286326 - RNA, 64 nt, hsa; identical to SEQ ID NO: 100677

SEQ ID NO: 286327 - RNA, 64 nt, hsa; identical to SEQ ID NO: 100678

SEQ ID NO: 286328 - RNA, 57 nt, hsa; identical to SEQ ID NO: 100679

SEQ ID NO: 286329 - RNA, 64 nt, hsa; identical to SEQ ID NO: 100680

SEQ ID NO: 286330 - RNA, 64 nt, hsa; identical to SEQ ID NO: 100681

SEQ ID NO: 286331 - RNA, 64 nt, hsa; identical to SEQ ID NO: 100682

SEQ ID NO: 286332 - RNA, 64 nt, hsa; identical to SEQ ID NO: 100683

SEQ ID NO: 286333 - RNA, 64 nt, hsa
uucugccacgagccagcugugugaauuuggucaagggaccuaacucucugaguuccagguuccu

SEQ ID NO: 286334 - RNA, 64 nt, hsa
caauuauauuuuaagagguguucccaggacuuuugggaccuacuaaaacaaugaugguuauuuu

SEQ ID NO: 286335 - RNA, 64 nt, hsa
gaaaagguaccguggcugcugcagggcacauggagggaccuacccucugggaaagcccuugugu

SEQ ID NO: 286336 - RNA, 64 nt, hsa
uggccagggagauccaugugcucaauguugcugggggaccuacaaaagucaaacauugcucagu

SEQ ID NO: 286337 - RNA, 63 nt, hsa
agaccaagucccuauaaacaaggaccuuccaguccaggggaaugacugugcaagguaguaucu

SEQ ID NO: 286338 - RNA, 63 nt, hsa
uugagcccaggaguucaagaccagccugagcaaccaggggagaccuuguuucuacaaaagaau

SEQ ID NO: 286339 - RNA, 63 nt, hsa
aaguaggauguuguugccuuuaacuuuucuuauccaggggaaaauugccauuuuagggucagc

SEQ ID NO: 286340 - RNA, 63 nt, hsa
gaaagaaagacgcugggcccaauuuugacuuggccaggggacaccuugguguguuuguuaucu

SEQ ID NO: 286341 - RNA, 63 nt, hsa
gugaagcaucugcuggacaagucggaccacuggccaggggaccuuugauugucuuuccagaga

SEQ ID NO: 286342 - RNA, 63 nt, hsa
ggagaccaaggcaauaguccuuuccacuacaggccaggggaugggacaagaaguagggaacag

SEQ ID NO: 286343 - RNA, 63 nt, hsa
ccaugggaacgccaacuggaaagguccccuuccccaggggagccugcgaaggagagguucugu

SEQ ID NO: 286344 - RNA, 63 nt, hsa
ccagccuuuuuuuuuuuuuuuuuuuuuuugucuccaggggaggggcuguuugcuggcucaggc

SEQ ID NO: 286345 - RNA, 63 nt, hsa
uauacgugauuuaaucugcaauagguggaauaaccaggggaacugguuaugaauaugugaaug

SEQ ID NO: 286346 - RNA, 63 nt, hsa
ugaugcuuuuucucugaaguggugugggaaguaccaggggacuggcagaagcccaggcccucu

SEQ ID NO: 286347 - RNA, 63 nt, hsa
gggucgucgagaggcugcgggcuggcggcagucccaggggagagacaccacagaaggagaccc

SEQ ID NO: 286348 - RNA, 63 nt, hsa
uuuccgcacucugagaccaugaucuuccuccugccaggggagagccacccacaggccaugucc

SEQ ID NO: 286349 - RNA, 63 nt, hsa
ccucccgugccccuccccgcuguccucuuggccccaggggagaagaugaggccaucagagaug

SEQ ID NO: 286350 - RNA, 63 nt, hsa
agaugaggccaucagagauggccaggagaagggccaggggaauagagcuauuuuuuuaacaaa

SEQ ID NO: 286351 - RNA, 63 nt, hsa
gcccaccugucaaacaaagccagaagcugagcaccaggggaugaguggagguuaaggcugagg

SEQ ID NO: 286352 - RNA, 63 nt, hsa
gggugggguggagaacuccuaggguggcuggguccaggggaugggagguugugggcauugaug

SEQ ID NO: 286353 - RNA, 63 nt, hsa
cugggcugacaguaaaagcacagaauacaaaacccaggggauggggcugggaggggcugugag

SEQ ID NO: 286354 - RNA, 63 nt, hsa
uccccuaaagguagaagauacucgagcaugcugccaggggagcuggauggugaaacaccugaa

SEQ ID NO: 286355 - RNA, 63 nt, hsa
gggcaccaggggacgcucuggcgagggcagaccccaggggaaagcaaagggcgucucagggaa

SEQ ID NO: 286356 - RNA, 63 nt, hsa
cccuucccccucgacccccgcaaugagugggcaccaggggacgcucuggcgagggcagacccc

SEQ ID NO: 286357 - RNA, 63 nt, hsa
ccucugacccuggcccagggaccccucacggggccaggggaggcauagcagaaagacuggccc

SEQ ID NO: 286358 - RNA, 63 nt, hsa
ugggggugcagagcccaccuggguaccugacccccaggggaugaaaaugcaaggaugagucug

SEQ ID NO: 286359 - RNA, 63 nt, hsa
gcagagaccugggaugggagaaguccuggggcgccaggggauccagccuagagcagaccuuag

SEQ ID NO: 286360 - RNA, 63 nt, hsa
ccaagagcacccaccaagacacagcaggacaggccaggggagggcaucuggaccagggcaucc

SEQ ID NO: 286361 - RNA, 63 nt, hsa
cagcgccaauaacaauacagugucugaguaucuccaggggaugauuucuggcucuuugucucc

SEQ ID NO: 286362 - RNA, 63 nt, hsa
ugaagcugauuuguaaugauuggcacucuucagccaggggaguggguaggccauagccaagga

SEQ ID NO: 286363 - RNA, 63 nt, hsa
aaaaaacugcuccuucacccucacccugaggccccaggggagaggacccgugggauggugccc

SEQ ID NO: 286364 - RNA, 63 nt, hsa
aggggccacacggcgggaggaagggcucugagcccaggggaggggagggagcgaggggcucac

SEQ ID NO: 286365 - RNA, 63 nt, hsa
uauccuaugggggccugagcaggauugagggagccaggggaggggcaggagucccagcaccau

SEQ ID NO: 286366 - RNA, 63 nt, hsa
agcccugccaggggcugugggccuacaaggcuuccaggggaugccauccagccuguaggaaac

SEQ ID NO: 286367 - RNA, 63 nt, hsa
caccucccuucuucuaacuaaauauaaaaagauccaggggacauaaauguggagauuaaauaa

SEQ ID NO: 286368 - RNA, 63 nt, hsa
caguucuguuccuucugacuagccccucuuccuccaggggagaacuuccaaauguuaauuuuu

SEQ ID NO: 286369 - RNA, 63 nt, hsa
cagggagcagggccaggcgggcucgggggccggccaggggagcaccccacucaacuacucaga

SEQ ID NO: 286370 - RNA, 63 nt, hsa
caggcucucugguggccgccccugugcaccuggccaggggaagcccgggggucuggggccucc

SEQ ID NO: 286371 - RNA, 63 nt, hsa
cccuagccgucaucuccacacucaccaggcccaccaggggagggggcuggccugggggucuug

SEQ ID NO: 286372 - RNA, 63 nt, hsa
agauacaagaggcaguaggaccuggguuggaacccaggggagcagacuggggggcuguugccc

SEQ ID NO: 286373 - RNA, 63 nt, hsa
aacaccccggccucggggcuccugguggcagcaccaggggacacaccugccaaacccaccaga

SEQ ID NO: 286374 - RNA, 63 nt, hsa
augcugucacucagccagaucaguauugacccaccaggggaggugggguuuggugagagacgc

SEQ ID NO: 286375 - RNA, 63 nt, hsa
cugcuaaaaggccuugugagguggccccacccuccaggggagcuggugaagaugggccacaga

SEQ ID NO: 286376 - RNA, 63 nt, hsa
gacagccuuuguuuucugagauaccaaagagagccaggggagggccccggguucggcggccag

SEQ ID NO: 286377 - RNA, 64 nt, hsa
gugccccauccuggaggauuggccccaagaucuccuagaacaggauaauugccuguguuuaggc

SEQ ID NO: 286378 - RNA, 64 nt, hsa
aucaaaaacaaagaagcccuauaagaccauuucucuagaacagauguucuuaauauuuuucuua

SEQ ID NO: 286379 - RNA, 64 nt, hsa
aggccaaggcgagcggaucaugaggucagaagaucuagaacagccuggucaacauggugaaacc

SEQ ID NO: 286380 - RNA, 64 nt, hsa
gauaaggcuucaucacuggauuucugugucuucacuagaacaccauugucaucucauauugauc

SEQ ID NO: 286381 - RNA, 64 nt, hsa
auaguggauugggcagacuggccuggaggaaaugcuagaacagagggaaaggaggcuggagagg

SEQ ID NO: 286382 - RNA, 64 nt, hsa
gaugguggagaucuggcaugccaggcuuaggugucuagaacagcaacuguaugugaaggggagc

SEQ ID NO: 286383 - RNA, 64 nt, hsa
aauguuauuuuuuuuacugcuguaacuccaguuccuagaacaauuuccagcacauagcaagugu

SEQ ID NO: 286384 - RNA, 64 nt, hsa
gccucagggccuucgcaugugcuguucccucugccuagaacacucucucccaaguauaugucug

SEQ ID NO: 286385 - RNA, 64 nt, hsa
ggcccauuuccuuuucucuaaaaugagggucaucauaccuaaggauguugugaggcgugaguga

SEQ ID NO: 286386 - RNA, 64 nt, hsa
auugugacuauaauacauuuuugguaauuuuuuuauaccuaauuuguauaggaagugcuauuuc

SEQ ID NO: 286387 - RNA, 64 nt, hsa
agaacauuauacaauugucaaaugaacuauaaugauaccuaaccauauggaugaaucugagcaa

SEQ ID NO: 286388 - RNA, 63 nt, hsa
gcuuugaggacagcagcugacagcauucggcguauaccuaaggagaguuuuuuccccgaacug

SEQ ID NO: 286389 - RNA, 64 nt, hsa
ugauaaagcugcuuuaauaaauacuucuggucugauaccuaaggagccugguucaguagaaagu

SEQ ID NO: 286390 - RNA, 64 nt, hsa
cuuucauugcuauauaauauucaguggcucauuuauaccuaauaaaauaaugguauuuuaaaau

SEQ ID NO: 286391 - RNA, 64 nt, hsa
ccguuaaguaaaauggacuuuguaauuguacagcauaccuaagaaacucagaaggugcauuuaa

SEQ ID NO: 286392 - RNA, 64 nt, hsa
gcugcucagcagauauggauggaucugcaaucacauaccuaauguggagcugggcuuuucugga

SEQ ID NO: 286393 - RNA, 64 nt, hsa
aggaauaugaaagaaaggcacauguuuaagaggaauaccuaaagguuuuucuaaauuccaacau

SEQ ID NO: 286394 - RNA, 64 nt, hsa
caaaaaugggcagacauuugguuaauugugccagauaccuaaaauguauguucagaaaagcauu

SEQ ID NO: 286395 - RNA, 64 nt, hsa
guuuguaucuaaauagcacuuacuguaauguauuauaccuaaauguuuauuaaaaguuagaaga

SEQ ID NO: 286396 - RNA, 64 nt, hsa
gauuuaaccauucuaggcaacaccccugaagggcauaccuaaccucaauaguguuggcuuuuaa

SEQ ID NO: 286397 - RNA, 64 nt, hsa
guggcuuuugcggccaguauuagacuggaaguucauaccuaaguacuguaauaauaccucaaug

SEQ ID NO: 286398 - RNA, 64 nt, hsa
ugcugcaguauaaaagagcaaagagcuuugggaaauaccuaagaagcaccuuaagauuagggug

SEQ ID NO: 286399 - RNA, 64 nt, hsa
aucuaagaagguuauaacaaaaugcucuucagaaauaccuaagugcugagaauuuuuaguacua

SEQ ID NO: 286400 - RNA, 64 nt, hsa
auuuuuggcucaggucauugggaacccauuacuaauaccuaacaggaaauagcuaaacacaaca

SEQ ID NO: 286401 - RNA, 64 nt, hsa
cuguuugcucauguucugugccccacacccaccaauaccuaaaucuguuaaggaagacagaaaa

SEQ ID NO: 286402 - RNA, 64 nt, hsa
ugauuuuguaauuugcaaaaggguauaggaaaauauaccuaaaagcgaauuuguggcugagagg

SEQ ID NO: 286403 - RNA, 64 nt, hsa
auuuauuugguugccuuguguguuaauugaaugcauaccuaauuguaaaauuuuuuuauuuaca

SEQ ID NO: 286404 - RNA, 64 nt, hsa
ccucaguuuuaucauuuucaaaauggagggaauaauaccuaagccuuccugccgcaacaguuuu

SEQ ID NO: 286405 - RNA, 64 nt, hsa
agucacucuuuuuaguacaaacaaaucauuuggaauaccuaaagauuguagagucauucccucu

SEQ ID NO: 286406 - RNA, 64 nt, hsa
aucuucugagagaaccugcuuccuuccaucagccauaccuaagaccugcaccuaaguggccaug

SEQ ID NO: 286407 - RNA, 64 nt, hsa
ggacugagugcuuccguugcaggcaguuugcacaauaccuaauuaaccuuccuauugaaaauac

SEQ ID NO: 286408 - RNA, 64 nt, hsa
guuccagaaucaggugccuuuuagggagagaacaauaccuaagauugucugagcuuccaucuuu

SEQ ID NO: 286409 - RNA, 64 nt, hsa
aauauuaacaugaaggauaaaccaacuuauuuguauaccuaaggcaggcauuuggaucaguaac

SEQ ID NO: 286410 - RNA, 64 nt, hsa
aaauugagccugauaacaagauuacaaauucacaauaccuaauacuuagggaaauauaaaaauu

SEQ ID NO: 286411 - RNA, 64 nt, hsa
auguauagauuuugcaaauauuaugcuauauguaauaccuaacuguaucuguaguguauaugua

SEQ ID NO: 286412 - RNA, 64 nt, hsa
aaagcaauuguauuaguaagaacuuuguaaauaaauaccuaaaacccaaguguauuuuaugucu

SEQ ID NO: 286413 - RNA, 64 nt, hsa
uagucuauuaaaagauacguggagauauuaaauuauaccuaaagcagacguccaacaaauucug

SEQ ID NO: 286414 - RNA, 64 nt, hsa
aaaagguauaaauaauaauauaaugaauuccuauauaccuaauacccaguuuaagacaccaaau

SEQ ID NO: 286415 - RNA, 64 nt, hsa
gccucugauacauaccuaaguaaacauaacauuaauaccuaaguaaacauaacauuacuuggag

SEQ ID NO: 286416 - RNA, 64 nt, hsa
uaagaucugcuuuggaaauuauugccucugauacauaccuaaguaaacauaacauuaauaccua

SEQ ID NO: 286417 - RNA, 64 nt, hsa
uuugcaccuaguagauagaucaauguaaaaacaaauaccuaacuguacagugagugugggggaa

SEQ ID NO: 286418 - RNA, 64 nt, hsa
uguuuuuaaauaauguuuuuauaauuucauucguauaccuaaguuuguauuuuuugugacuuug

SEQ ID NO: 286419 - RNA, 64 nt, hsa
cuucauuuauuuaucucaugaguaaaauggaauaauaccuaacaggcaggcucuggaaguugga

SEQ ID NO: 286420 - RNA, 64 nt, hsa
cugacuggcaauaacgcacgguacuguucuugaaauaccuaauggcuugaaauucuagucuguu

SEQ ID NO: 286421 - RNA, 64 nt, hsa
ugaagcagguguuuucucuuggacauacuaaaaaauaccuaaaaggaagcuuagaugggcugug

SEQ ID NO: 286422 - RNA, 64 nt, hsa
aaauguaggacccaaguuucuggacuacuucagaauaccuaaaugaaucauggaaacacucuuu

SEQ ID NO: 286423 - RNA, 64 nt, hsa
guggggggcugggagagggauaguguuaggagaaauaccuaauguaaaugacgaguuaaugggu

SEQ ID NO: 286424 - RNA, 64 nt, hsa
uuuacuaacacguuuuucaaaagaugucaguguuauaccuaaagcuaaaaaaaagcaaggguuu

SEQ ID NO: 286425 - RNA, 64 nt, hsa
accagaaaggaaauggcaugcacacacacaaaaaauaccuaaauuuuggaugagaaaaugauaa

SEQ ID NO: 286426 - RNA, 64 nt, hsa
uuaaaaguaauaaagagaaauauauuugucacuuauaccuaaaauaugaguggcucauuuuugc

SEQ ID NO: 286427 - RNA, 62 nt, hsa
acagcaauaugaagaaaaauaaauuaagucccuuauaccuaagaccucuauuucucuguuga

SEQ ID NO: 286428 - RNA, 64 nt, hsa
uauauauggggacaucaaaacuucaauaaucaagauaccuaauauuuaagugaauauuuuuaaa

SEQ ID NO: 286429 - RNA, 64 nt, hsa
aaauacaauggggggaaggauagcauuuggagauauaccuaauguuaaaugacgaguuacugga

SEQ ID NO: 286430 - RNA, 64 nt, hsa
gauccuguaaucacaacucagcauuggccuuaauauaccuaaaucuccaaaaacagugauuaaa

SEQ ID NO: 286431 - RNA, 64 nt, hsa
ucucuccccuauggauuuugcuaaugguugagugauaccuaaaggccuuguugcauuuuuuaca

SEQ ID NO: 286432 - RNA, 64 nt, hsa
uuuuuuuucuuaguauuucuaaguaucucauuaaauaccuaaaaugguauaagauuuaucaauu

SEQ ID NO: 286433 - RNA, 64 nt, hsa
caagaauacauuuagcaucuuuguguuggguucuauaccuaaaaauuuucccucccugcccaag

SEQ ID NO: 286434 - RNA, 64 nt, hsa
ugaaaauaauagugucuucuauggcauguaauggauaccuaauaccgaugaguuaaaucuugca

SEQ ID NO: 286435 - RNA, 64 nt, hsa
aagcaguacaguaucuuaagugucaaccaguuauauaccuaaucugguuuuuuauaacuucugu

SEQ ID NO: 286436 - RNA, 64 nt, hsa
ggaaccugagguauuuuucaugcuaucuaaucauauaccuaagauaaaccaacccaguuacuua

SEQ ID NO: 286437 - RNA, 64 nt, hsa
ggagacccuaaagucuguuggcugugacgucauuauaccuaaaaucugcaucauaccugcaagc

SEQ ID NO: 286438 - RNA, 64 nt, hsa
uuguacaacugaaauauaaauaauuuugucaauuauaccuaaauaaaacuggaaaaaaauuucu

SEQ ID NO: 286439 - RNA, 64 nt, hsa
aaaauuaauuaacauaucuacuuauauguuacuuauaccuaaagcuguuauuaagacaaaccaa

SEQ ID NO: 286440 - RNA, 51 nt, hsa
uugcacaaauacuccuuuaauauaccuaaaaauuguuagaaauugguggga

SEQ ID NO: 286441 - RNA, 64 nt, hsa
ucuguuuaaccuguucgugugguauaugaaaaagauaccuaagcacuagaauauccagcuaaau

SEQ ID NO: 286442 - RNA, 64 nt, hsa
aaaauuuaaaaguaggucaguuuauaacgaguaaauaccuaacacaccaagaaugugcagugaa

SEQ ID NO: 286443 - RNA, 64 nt, hsa
cuguauacuuuaaaucaucucuagauuacuuauaauaccuaauacaauguaaaugcuauguaaa

SEQ ID NO: 286444 - RNA, 64 nt, hsa
caaucauuccauucgguuuuaaauuauccuguauauaccuaauuaugugcacuggagaguaauu

SEQ ID NO: 286445 - RNA, 64 nt, hsa
uugauuccuuuugccaacaauuuuaccagcaguuauaccuaacauauuaugcaauuuucucuug

SEQ ID NO: 286446 - RNA, 64 nt, hsa
aagcuauaugauuucuucaaaaagcaaaagcaauauaccuaauucauuuggaucaaacuuacau

SEQ ID NO: 286447 - RNA, 64 nt, hsa
uuggguuuaaaaagugcuuugugccaaaaauaucauaccuaauuuuuauagugcuuuacuauca

SEQ ID NO: 286448 - RNA, 64 nt, hsa
gguauggcaaguugugaagacagcacauuaaaacauaccuaauuucacaguauuccugucacga

SEQ ID NO: 286449 - RNA, 64 nt, hsa
ucaugccuucaaucagauguuacuuaggguggguauaccuaaauuauaaaccuuauguacaagu

SEQ ID NO: 286450 - RNA, 64 nt, hsa
auuuggaccaauagcccacagcugagaauguggaauaccuaaggauagcaccgcuuuuguucuc

SEQ ID NO: 286451 - RNA, 64 nt, hsa
uaacuaccucugauccucuuugaccuuccauuacauaccuaauccuagcugucuccucaucuca

SEQ ID NO: 286452 - RNA, 64 nt, hsa
cauaacccaacgcucauucaacaucaaagaauuuauaccuaagagaacuuauuuggguguagua

SEQ ID NO: 286453 - RNA, 64 nt, hsa
acagauguuggcucaaguucagggccaccaucauauaccuaacaagaguucaugauucuuuagg

SEQ ID NO: 286454 - RNA, 64 nt, hsa
cugcuaguugguuauaggcggugggaggaauaauauaccuaauugguuauagguggggggagca

SEQ ID NO: 286455 - RNA, 64 nt, hsa
gggggaagacagccaauagcacccauuaaaagaaauaccuaaauaaaaccucucucccacucag

SEQ ID NO: 286456 - RNA, 64 nt, hsa
augcauaauaaaugcuuugugcuucugacuaucaauaccuaaagaaagugcaucagugaagaga

SEQ ID NO: 286457 - RNA, 64 nt, hsa
agcaaacuaggaggagaaugugcaauuuugagggauaccuaauuugcauucgguuaggggauau

SEQ ID NO: 286458 - RNA, 64 nt, hsa
aaugugagguuuaccugauucucuaaugaaauaaauaccuaaguuauuguuugaugauuuguuu

SEQ ID NO: 286459 - RNA, 64 nt, hsa
ccagaguguucaaggcauuuuucuaccuaaaugaauaccuaaaucuugaguaguguacgguaau

SEQ ID NO: 286460 - RNA, 64 nt, hsa
uucauuuuagagcacguuuuggucauuuuuaaaaauaccuaaagugccagaccggaaccuauag

SEQ ID NO: 286461 - RNA, 64 nt, hsa
gaaaaauugauguuugauguugauagauaugcuuauaccuaauuuuuaguuuuuaaacuauuuu

SEQ ID NO: 286462 - RNA, 64 nt, hsa
cagcuugggcuaccuaaacuaaaacacauuuuugauaccuaaauuaaugagcuauagauaaaau

SEQ ID NO: 286463 - RNA, 64 nt, hsa
agacaaugaaacaacagagacagugaaaguuuuaauaccuaagucauuccuccagugcauacug

SEQ ID NO: 286464 - RNA, 64 nt, hsa
auacucacuuaaaccaacugggauggaauucagaauaccuaagcugcuucuuuaacauagagau

SEQ ID NO: 286465 - RNA, 64 nt, hsa
accuuaaguaagcaacagcauaacaagguccaagauaccuaaaagagauuucaagagauuuaau

SEQ ID NO: 286466 - RNA, 64 nt, hsa
aauauuuuuaucugaagaaagcagaauuuguuugauaccuaacaagauuucaauaaaaauccaa

SEQ ID NO: 286467 - RNA, 64 nt, hsa
ucaguauagagaacuuaagaggcuggcuuauguuauaccuaaauuuuuacuuucuuguauacaa

SEQ ID NO: 286468 - RNA, 64 nt, hsa
cggaaucacacauguuaucuuaaacccagccaucauaccuaagucuuuugccaaaaccucucau

SEQ ID NO: 286469 - RNA, 64 nt, hsa
uggacuuaacucacguaguaaauacugcugaucaauaccuaaucauuccacauuuauugagcuc

SEQ ID NO: 286470 - RNA, 64 nt, hsa
ugguggggagggggcaaucucugugugucucaguauaccuaaagguugggguggggcggaguug

SEQ ID NO: 286471 - RNA, 64 nt, hsa
aguacaccccaccucuuccuuguaaauaugauuuauaccuaacugaauaaaaagcuguucuguc

SEQ ID NO: 286472 - RNA, 64 nt, hsa
aacaguaagccagguucaccagaggaaauguggaauaccuaaguauaaagcagcaaagaaaugu

SEQ ID NO: 286473 - RNA, 64 nt, hsa
cugauucacuaacacacagaugaacaaccaaaauauaccuaaaagguauagucucuaggaguuu

SEQ ID NO: 286474 - RNA, 64 nt, hsa
gcauauggauggcauuuaaaacuuugaaugaauuauaccuaaaucugggacagggaggugacag

SEQ ID NO: 286475 - RNA, 64 nt, hsa
gaaaauaugaucauaagucaaaaauguauuuaauauaccuaaccuaccaaacaucauagcuuag

SEQ ID NO: 286476 - RNA, 64 nt, hsa
gauauaucuagauccauauauagguuugccuuagauaccuaaauacacauauauucaguucuca

SEQ ID NO: 286477 - RNA, 64 nt, hsa
uuaucagcacuuuaugcacguauuauugacauuaauaccuaaucggcgagugcccaucugcccc

SEQ ID NO: 286478 - RNA, 64 nt, hsa
gugguccccucuccccucugacuaccuaaaaucaauaccuaaauacagaagccuuggucuaaca

SEQ ID NO: 286479 - RNA, 64 nt, hsa
aagugucccuuaauaguguccuucccugaaauaaauaccuaagggaguguaacagucucuggag

SEQ ID NO: 286480 - RNA, 64 nt, hsa
guagcuugagaagcaaauuggcagguaauauuucauaccuaaauuaagacucugacuuggauug

SEQ ID NO: 286481 - RNA, 64 nt, hsa
cugcaaaaucagaugucagcauaagcgauggauaauaccuaauaaacugcccucaguaaaucca

SEQ ID NO: 286482 - RNA, 64 nt, hsa
ccagccauuacccagcuaaauaaucuuacucuagauaccuaaaacauaagaucacugccagaga

SEQ ID NO: 286483 - RNA, 64 nt, hsa
uugauauuaccacaugaaauauugccagaccaagauaccuaaacucaugaugucuguggugcug

SEQ ID NO: 286484 - RNA, 64 nt, hsa
cgcguuccuauuauugaagcaaaaagggugacugauaccuaaaagcccuuucuuccucuagucg

SEQ ID NO: 286485 - RNA, 64 nt, hsa
ugauauuuuggacaaggaguucuggugacaagcuauaccuaauuauaagcuauaaaacaauaga

SEQ ID NO: 286486 - RNA, 64 nt, hsa
gaaaacucuuuaucuuaugaggcuguauuccucaauaccuaauuuguguccaaagaauuuauag

SEQ ID NO: 286487 - RNA, 64 nt, hsa
aagacccugucucuuaaaacaaaaaaccucacacauaccuaaaauaaguauauaucuguaacca

SEQ ID NO: 286488 - RNA, 64 nt, hsa
ugguucugaugucaucggguggaggugguguucuauaccuaaaggaugaccugcuccagaaaca

SEQ ID NO: 286489 - RNA, 64 nt, hsa
ugccuuuacuacuucuuuauguaauagaaguuauauaccuaagcuuauauaauacauggggagg

SEQ ID NO: 286490 - RNA, 64 nt, hsa
uaccuacugugucuuggaaucuagccgauggaaaauaccuaauuguggaugaugauugcgcagg

SEQ ID NO: 286491 - RNA, 64 nt, hsa
ccaggcuauaaauauccuuucaaaucauguucuuauaccuaauuuuagucuuucaaaugaaugu

SEQ ID NO: 286492 - RNA, 64 nt, hsa
agccuagcucuacagcaaucauccugaaauaagcauaccuaauuucaagcaauuguuguauuuu

SEQ ID NO: 286493 - RNA, 64 nt, hsa
auauugccuguuuugugaauacugacacauguccauaccuaaaacacuccugagucaaguccca

SEQ ID NO: 286494 - RNA, 64 nt, hsa
auauuguguguuuacuaacacacuuaauguuuauauaccuaauauuuauuaugccauaucugaa

SEQ ID NO: 286495 - RNA, 64 nt, hsa
auggcaaccauuauaaccuuaauuuauuauuaacauaccuaagaaguacauuguuaccucuaua

SEQ ID NO: 286496 - RNA, 64 nt, hsa
gccaaacucacaaauuggagugaugaaccugcuuauaccuaagggcaggagcaagccccucaca

SEQ ID NO: 286497 - RNA, 64 nt, hsa
aaaaggaaaaauaugguuuccagagaaaaggccaauaccuaagcauuuuuuccaugagaagcac

SEQ ID NO: 286498 - RNA, 64 nt, hsa
ccauggcaaguagaaagguauaucaucaacuucuauaccuaagaauauaggauugcauuuaaua

SEQ ID NO: 286499 - RNA, 64 nt, hsa
caaguauuaaauaagagcaagcuguccugagcccauaccuaaugaauuugugucuuaaauauug

SEQ ID NO: 286500 - RNA, 64 nt, hsa
uaauaguuauuaggcauuuagguaaaauuuucuaauaccuaaaaauugucaaaaacagucaaua

SEQ ID NO: 286501 - RNA, 64 nt, hsa
uguggugagaagguuggggaaaggugaggugaauauaccuaaaacuuuuaaugugggauauuuu

SEQ ID NO: 286502 - RNA, 64 nt, hsa
cauggacuguaucuuaucuaccacuauaucccaaauaccuaagauagugcuuacguucagugac

SEQ ID NO: 286503 - RNA, 64 nt, hsa
gaucaaaucaccauuuaaggggauggcauucuuuauaccuaaacaccuaagagcugaagucagg

SEQ ID NO: 286504 - RNA, 64 nt, hsa
auuuuaucauauaagcaaguaauaccuauuagucauaccuaaauuuuucagcacuucauucaau

SEQ ID NO: 286505 - RNA, 64 nt, hsa
auuaguuaggaaugacuuauacguuuuguuuugaauaccuaagagauacuuuuuggauauuuau

SEQ ID NO: 286506 - RNA, 64 nt, hsa
acugcauaaaccuagauauaccauuaucccuuuuauaccuaagaagggcaugcuaauaauuacc

SEQ ID NO: 286507 - RNA, 64 nt, hsa
auccugugaaagauuccacauagagaaaagaaagauaccuaaccuucaacaaauguuauuuuug

SEQ ID NO: 286508 - RNA, 64 nt, hsa
uuugaacuagcaaugccugugaaaaagaaacugaauaccuaagauuucugucuuggggcuuuug

SEQ ID NO: 286509 - RNA, 64 nt, hsa
cugaauaauguaauuaugcaauuaauugauaaucauaccuaaagcacauugaacuucuaagaga

SEQ ID NO: 286510 - RNA, 64 nt, hsa
gggccuccuccugggccucagcuugcccagauacauaccuaaauauauauauauauauauauga

SEQ ID NO: 286511 - RNA, 64 nt, hsa
auuuuuucucauccuugcauuccuugcuuguuauauaccuaaaauguuaaccauauaguuuuug

SEQ ID NO: 286512 - RNA, 64 nt, hsa
aaguaugugaaaagaaaauuaugaaaaaauaugcauaccuaaugaaguauugguuuuaguaaga

SEQ ID NO: 286513 - RNA, 64 nt, hsa
aagggugagcaacagaacaaaaggcagaaaaggcauaccuaaggacuaauuuaaacacauauca

SEQ ID NO: 286514 - RNA, 64 nt, hsa
ggaaguccuagggugguuucaguuucucccagacauaccuaaauuuuuacaucaauccuuuuaa

SEQ ID NO: 286515 - RNA, 64 nt, hsa
uuaaauaaugcagcaauaucaccucuuauugacaauaccuaaauuaugaguuuuauuaauauuu

SEQ ID NO: 286516 - RNA, 64 nt, hsa
ugguucauagaccaccugugucaccaacagccagauaccuaaucccugagccuccuuugggaag

SEQ ID NO: 286517 - RNA, 64 nt, hsa
uuuuagucaaaagucaguuuauuaaauguuuagaauaccuaaacaggaagaaaauucuauuguu

SEQ ID NO: 286518 - RNA, 64 nt, hsa
auaugaccuauuuaucugaaguuuauaauuguuuauaccuaauacaguucuuuuuggaguaaga

SEQ ID NO: 286519 - RNA, 64 nt, hsa
auucuaaacaauacaguggaugacccuuuugaauauaccuaaugauuuccuuaaaaaagaaauu

SEQ ID NO: 286520 - RNA, 64 nt, hsa
aauuuguaguaaauuagcagaggucuggauuuuuauaccuaaguuguuguuuaggcuaacagug

SEQ ID NO: 286521 - RNA, 64 nt, hsa
ugguucacuaguagagaaagaauuacgucgcuuaauaccuaauaucauaguuguacaauaugaa

SEQ ID NO: 286522 - RNA, 64 nt, hsa
auguguagaauauauuuaauaaaagacuuauaaaauaccuaacuacaggacuuaaaauauagau

SEQ ID NO: 286523 - RNA, 64 nt, hsa
ccuaauuugcuauuuaaaggcuucuaagaagcguauaccuaacuguaaauaaauguauguauag

SEQ ID NO: 286524 - RNA, 64 nt, hsa
uuuacuuacauaggcuaaaaaacuauguaacuaaauaccuaaugguauuuaauuuuuguuuauu

SEQ ID NO: 286525 - RNA, 64 nt, hsa
aacuuuagauauggauauuaaugcuuuugccauuauaccuaauuuuugagaacagcaagcccua

SEQ ID NO: 286526 - RNA, 64 nt, hsa
ccaguauguacuucaaaaauguguauugucaaacauaccuaacuuucuugcaauaaaugcaaaa

SEQ ID NO: 286527 - RNA, 64 nt, hsa
aagaaaaugccuuaauauaaacugacucaguugaauaccuaauuugcugagaccucagcguuuc

SEQ ID NO: 286528 - RNA, 64 nt, hsa
ucacacaaauuccaauugagaagcauucuuuaaaauaccuaaccaguacuucucaaaacuauca

SEQ ID NO: 286529 - RNA, 64 nt, hsa
uuuucugugaauuaugacuauucauuuguuaaaaauaccuaagagcaauuauagugggacaucu

SEQ ID NO: 286530 - RNA, 64 nt, hsa
uuauauaucugauauauauuauauauaaaauaauauaccuaaguguuuuuuuaaacuaugggag

SEQ ID NO: 286531 - RNA, 64 nt, hsa
agcucaaaguagcuagcuaaaggaguagccuuaaauaccuaaaagaugacagaagcauagcccu

SEQ ID NO: 286532 - RNA, 64 nt, hsa
cccaccuguggcaucacugaaaauaaauuugaucauaccuaagagguuaggaaauggugccauu

SEQ ID NO: 286533 - RNA, 64 nt, hsa
gaggaggcaguaaaugaaguuacaggcuagcacaauaccuaacucauguuucccaguacaccug

SEQ ID NO: 286534 - RNA, 64 nt, hsa
aguaaguuagcguuaaauggaaguaaauauauguauaccuaagagaaugucaaaauaaacacca

SEQ ID NO: 286535 - RNA, 64 nt, hsa
aaaaaaacaaauguacagauuguaaaguuuuuugauaccuaauguaaguuuucuuuguguaaua

SEQ ID NO: 286536 - RNA, 64 nt, hsa
uacaauuucuccugaguuaacuuuugugaaaauaauaccuaagguuuucuggcuuauugaggaa

SEQ ID NO: 286537 - RNA, 64 nt, hsa
ccaaacuggugcaugacaaguacuguauuuuuuuauaccuaaauaaagaaaaaucuuuagccug

SEQ ID NO: 286538 - RNA, 64 nt, hsa
aagauuuaaacuaauaugcuggcuuuuauguaugauaccuaaucagagcauugaccagaaaaau

SEQ ID NO: 286539 - RNA, 64 nt, hsa
uauaguuacaacuuguaagcauguccguguauaaauaccuaaaagcaaaacuaaacaaagaaag

SEQ ID NO: 286540 - RNA, 64 nt, hsa
ucuccagccccgccguggguggcaagcuguguucauaccuaaauuuucuggaaggggacaguga

SEQ ID NO: 286541 - RNA, 64 nt, hsa
uuuucauacuucaguugguuuuggaaucugccuuauaccuaauauuuauuuauucacacucaua

SEQ ID NO: 286542 - RNA, 64 nt, hsa
ggcucaaaggaacguauucuugaaggugacggaaauaccuaaaaacuccuaaaggugcagagca

SEQ ID NO: 286543 - RNA, 64 nt, hsa
ggugggcuccuuauuuggggacuggucaccaaaaauaccuaacuaugguuggaagcuuagugcu

SEQ ID NO: 286544 - RNA, 63 nt, hsa
ugugaacuuuuuuuuuuuaagaguaaaaagaaauauaccuaaaccuucuguuaguugucuggu

SEQ ID NO: 286545 - RNA, 64 nt, hsa
uuaaaguagaaagucagcauuuuccuugagcuaaauaccuaauaaccaaaacugugaggaaggu

SEQ ID NO: 286546 - RNA, 64 nt, hsa
cacucuaacuuaagaguuuuuacuuuauguagugauaccuaauacaauuuugaaaauacaauag

SEQ ID NO: 286547 - RNA, 64 nt, hsa
cagaauuaaaggagggaauuguauugauacuccaauaccuaaauuucacaauaccacuuaggaa

SEQ ID NO: 286548 - RNA, 64 nt, hsa
uuucugaagaugcuuuuuggaaagcucugaaucuauaccuaaugcucuuaauuauuggcuuguu

SEQ ID NO: 286549 - RNA, 64 nt, hsa
uguugggaaucuauuuccuauucuauaaguaaguauaccuaacaugcuguggaaucuugaguuu

SEQ ID NO: 286550 - RNA, 64 nt, hsa
uuaugguugcuguugccauauuuacugaagguuuauaccuaaauguaacuuuagcuuuauggaa

SEQ ID NO: 286551 - RNA, 64 nt, hsa
aagcacuauagaauuugcaaauucagaacauuuuauaccuaaaaguaauucugucuuuccuaaa

SEQ ID NO: 286552 - RNA, 64 nt, hsa
uuuuugcuggauggguuuuacagcaguauuugauauaccuaacuuguuauggagguugauugau

SEQ ID NO: 286553 - RNA, 64 nt, hsa
caacaaaggaauugaaacaggcagggagaucuuaauaccuaauuucaucauuucugaaaaugua

SEQ ID NO: 286554 - RNA, 64 nt, hsa
aaccuagaaacacacauuucuuugaauuuaggugauaccuaaauccuucuuauguuucuaaauu

SEQ ID NO: 286555 - RNA, 64 nt, hsa; identical to SEQ ID NO: 286554

SEQ ID NO: 286556 - RNA, 64 nt, hsa
agaaugcaguauaacaccacuuccaaagguaaggauaccuaacauucuuuuuuuuuuuuuuuuu

SEQ ID NO: 286557 - RNA, 64 nt, hsa
augacaucaccaacagucaaagcaauuagagaccauaccuaauauuguuuaaauucuagaugua

SEQ ID NO: 286558 - RNA, 64 nt, hsa
acauaauuagagggcuuugaaaugaucuacugaaauaccuaaauugauagaaauuaaucauacu

SEQ ID NO: 286559 - RNA, 64 nt, hsa
uccaacaagccucaaagucccuugagacuccccaauaccuaauaaggcaugcgaaauguucuca

SEQ ID NO: 286560 - RNA, 64 nt, hsa
auagcauucaacccagcaucccauuacuggguguauaccuaaaggaauauaaucauuccaccau

SEQ ID NO: 286561 - RNA, 64 nt, hsa
ccuuccaugguccucacugauuguuuucuuugucauaccuaaucuguugaguuugugcagugag

SEQ ID NO: 286562 - RNA, 64 nt, hsa
auauauauauacauauauauacacauauguauguauaccuaacuccuaaaguggaacaguaaga

SEQ ID NO: 286563 - RNA, 64 nt, hsa
cauaugcaggggauugguuccagacccccuaagcauaccuaaauccacagaugcuguguuccuu

SEQ ID NO: 286564 - RNA, 64 nt, hsa
auaugcaggggauuaauuccagcagucccugaucauaccuaaauccacacaugccaaguuucuu

SEQ ID NO: 286565 - RNA, 64 nt, hsa
uucugcaagagauggacucuaagacccccaguggauaccuaaaacccagauaggaccaaacucu

SEQ ID NO: 286566 - RNA, 64 nt, hsa
cuccugcccccgggggccuguggcuaaguaaaccauaccuaaccuaccccaguguggguguggg

SEQ ID NO: 286567 - RNA, 64 nt, hsa
uuauaaaaaauggccuggagugacacauuuuauuauaccuaauauucacugcaucaguaucaca

SEQ ID NO: 286568 - RNA, 64 nt, hsa
aauagugauaacuuguuaauaauaguaaaccuuuauaccuaaaguaaaugucuucccucccaca

SEQ ID NO: 286569 - RNA, 64 nt, hsa
aggguugguuuguagauucaaauaauccagaaauauaccuaauaagauugagugaaaaauuuga

SEQ ID NO: 286570 - RNA, 64 nt, hsa
aaguuugcugcagaaauacaauuuccuacacuucauaccuaaaggagauucagagcuaucgcuc

SEQ ID NO: 286571 - RNA, 64 nt, hsa
uauuaauauuuuuuacuuugcccuuuuaaaaaauauaccuaauacaauauauuuaauuuuuaau

SEQ ID NO: 286572 - RNA, 64 nt, hsa
agaaaucauguuuauuuaaauauugaagggaaaaauaccuaaaaauguacaaagguuuuauauu

SEQ ID NO: 286573 - RNA, 64 nt, hsa
gaaaaauauuauaucuaauuaugucuaugugguaauaccuaaaaagagguagagagacucuaug

SEQ ID NO: 286574 - RNA, 64 nt, hsa
acuuuaauuucuaggcuauaacucagaccaaauuauaccuaaaaguuccaacaaagucccuuuu

SEQ ID NO: 286575 - RNA, 64 nt, hsa
caguagugaaugcagaaaauaaaaauacacagguauaccuaaaggcacuuuuauugagaaugag

SEQ ID NO: 286576 - RNA, 64 nt, hsa
aagagcgacugcagugggucuccgugucuaucaaauaccuaaggaguccccaggagcuggcugg

SEQ ID NO: 286577 - RNA, 64 nt, hsa
uauugaggggauaagaggaugucaaaaaaguuaaauaccuaaguagaaaaaaauauagaaauaa

SEQ ID NO: 286578 - RNA, 64 nt, hsa
auauaccaguucaaguccuuuuaggaagaagaaaauaccuaauuuauguaaaauuuaaauaauu

SEQ ID NO: 286579 - RNA, 64 nt, hsa
cuuucugcugugucuucacaucacccuccucuguauaccuaaucugccucugccucuguuuaau

SEQ ID NO: 286580 - RNA, 64 nt, hsa
uuuuaggucuagccuauguggauuuuuuccuaacauaccuaagcaaacccagugucaggauggu

SEQ ID NO: 286581 - RNA, 64 nt, hsa
accacucgguccaaccuagacaaccaagaccgcuauaccuaaagaccucuauauccuggugccu

SEQ ID NO: 286582 - RNA, 64 nt, hsa
guaugaaaguagauucuauuuuguaaugcugauaauaccuaaagaugcauugaaugcuuggaag

SEQ ID NO: 286583 - RNA, 64 nt, hsa
uauuuucauugccacaaagugcuuugaugauguaauaccuaauaaaggguaggaugaauauuuc

SEQ ID NO: 286584 - RNA, 64 nt, hsa
gaaggcuuugauucaucagucucgggcucuuggaauaccuaauuuuaauaauaucuaugaaauc

SEQ ID NO: 286585 - RNA, 64 nt, hsa
aaaagggauauuguauccaugguaaauuaauuguauaccuaaacagagauagcucaucuuugcc

SEQ ID NO: 286586 - RNA, 64 nt, hsa
gguaaaaucaauagauuucaggcaagagggccagauaccuaacagguuuuucuccgugaaucuu

SEQ ID NO: 286587 - RNA, 64 nt, hsa
uauaaucguuugcuucuccaagugaagcucagaaauaccuaaaaauagcuguaacguucgcguu

SEQ ID NO: 286588 - RNA, 64 nt, hsa; identical to SEQ ID NO: 170380

SEQ ID NO: 286589 - RNA, 64 nt, hsa; identical to SEQ ID NO: 170381

SEQ ID NO: 286590 - RNA, 64 nt, hsa; identical to SEQ ID NO: 170382

SEQ ID NO: 286591 - RNA, 64 nt, hsa; identical to SEQ ID NO: 170383

SEQ ID NO: 286592 - RNA, 64 nt, hsa; identical to SEQ ID NO: 170384

SEQ ID NO: 286593 - RNA, 64 nt, hsa; identical to SEQ ID NO: 170385

SEQ ID NO: 286594 - RNA, 64 nt, hsa; identical to SEQ ID NO: 170386

SEQ ID NO: 286595 - RNA, 64 nt, hsa; identical to SEQ ID NO: 170387

SEQ ID NO: 286596 - RNA, 64 nt, hsa; identical to SEQ ID NO: 170388

SEQ ID NO: 286597 - RNA, 64 nt, hsa; identical to SEQ ID NO: 170389

SEQ ID NO: 286598 - RNA, 64 nt, hsa; identical to SEQ ID NO: 170390

SEQ ID NO: 286599 - RNA, 64 nt, hsa; identical to SEQ ID NO: 170391

SEQ ID NO: 286600 - RNA, 64 nt, hsa; identical to SEQ ID NO: 170392

SEQ ID NO: 286601 - RNA, 64 nt, hsa; identical to SEQ ID NO: 170393

SEQ ID NO: 286602 - RNA, 64 nt, hsa; identical to SEQ ID NO: 170394

SEQ ID NO: 286603 - RNA, 64 nt, hsa; identical to SEQ ID NO: 170395

SEQ ID NO: 286604 - RNA, 64 nt, hsa; identical to SEQ ID NO: 170396

SEQ ID NO: 286605 - RNA, 64 nt, hsa; identical to SEQ ID NO: 170397

SEQ ID NO: 286606 - RNA, 64 nt, hsa; identical to SEQ ID NO: 170398

SEQ ID NO: 286607 - RNA, 64 nt, hsa; identical to SEQ ID NO: 170399

SEQ ID NO: 286608 - RNA, 64 nt, hsa; identical to SEQ ID NO: 170400

SEQ ID NO: 286609 - RNA, 64 nt, hsa; identical to SEQ ID NO: 170401

SEQ ID NO: 286610 - RNA, 64 nt, hsa; identical to SEQ ID NO: 170402

SEQ ID NO: 286611 - RNA, 64 nt, hsa; identical to SEQ ID NO: 170403

SEQ ID NO: 286612 - RNA, 64 nt, hsa; identical to SEQ ID NO: 170404

SEQ ID NO: 286613 - RNA, 64 nt, hsa; identical to SEQ ID NO: 170405

SEQ ID NO: 286614 - RNA, 64 nt, hsa; identical to SEQ ID NO: 170406

SEQ ID NO: 286615 - RNA, 64 nt, hsa; identical to SEQ ID NO: 170407

SEQ ID NO: 286616 - RNA, 64 nt, hsa; identical to SEQ ID NO: 170408

SEQ ID NO: 286617 - RNA, 64 nt, hsa; identical to SEQ ID NO: 170409

SEQ ID NO: 286618 - RNA, 64 nt, hsa; identical to SEQ ID NO: 170410

SEQ ID NO: 286619 - RNA, 64 nt, hsa; identical to SEQ ID NO: 170411

SEQ ID NO: 286620 - RNA, 64 nt, hsa; identical to SEQ ID NO: 170412

SEQ ID NO: 286621 - RNA, 64 nt, hsa; identical to SEQ ID NO: 170413

SEQ ID NO: 286622 - RNA, 64 nt, hsa; identical to SEQ ID NO: 170414

SEQ ID NO: 286623 - RNA, 64 nt, hsa
gaaugaucaaaguucagaaaauggucugcaaaaguuacuccauauacaaccccaaaucuacuac

SEQ ID NO: 286624 - RNA, 64 nt, hsa
ugacugguuuuauuuuucucccaggccagaaguauuacuccacuagaucaccuuacuuaauugg

SEQ ID NO: 286625 - RNA, 64 nt, hsa
cuuacuaguguguaugagcaagaucugcuaaaacuuacuccacuggguaaaugguugacugagu

SEQ ID NO: 286626 - RNA, 64 nt, hsa
uuaggaagagugaguauuggagucaucuuaucuauuacuccaaaccucccuuuuuauuucuuga

SEQ ID NO: 286627 - RNA, 64 nt, hsa
ucaucucuuccuuuguugauaaauugccaaagagugggaacagguggggucaggggccagagug

SEQ ID NO: 286628 - RNA, 64 nt, hsa
guuuuugggggaacagggagcauucacagggucuugggaacaaaggccugggccuccccguuug

SEQ ID NO: 286629 - RNA, 64 nt, hsa
uaagagcaaucaaccauauaaaucaaguaccuauugggaacagacauaacauucaauuuuucau

SEQ ID NO: 286630 - RNA, 64 nt, hsa
caccugccagagaaacacaggcucagaggaugccugggaacagggaggaugggauuaguggaag

SEQ ID NO: 286631 - RNA, 64 nt, hsa
ggcuggggccuuccuccagggaaggaggcuggggugggaacacuggccucccccagaauaaaac

SEQ ID NO: 286632 - RNA, 64 nt, hsa
uuucuugguaaagagccuuuaccacagcaaggaaugggaacauuuccccaucagcaacggggcu

SEQ ID NO: 286633 - RNA, 64 nt, hsa
ccccaaggguacaggaggggcaucccucagccuaugggaacacccaaacuaggagggguuauug

SEQ ID NO: 286634 - RNA, 64 nt, hsa
gcugggauuauaggugugagccaccgcacccaguugggaacaaagccuuuuuaacacacguaag

SEQ ID NO: 286635 - RNA, 64 nt, hsa
uagaugugggugugucucaguggggcccccaggcugggaacacacucggaagaucccgugugug

SEQ ID NO: 286636 - RNA, 64 nt, hsa
aaggcuugggaaccauuugcauccaggaguuagaugggaacaagugucacuccuggucaccugg

SEQ ID NO: 286637 - RNA, 64 nt, hsa
uugccugaccucguuaucacaugagcuuauauuuugggaacacauagaacugauggaggcuuuu

SEQ ID NO: 286638 - RNA, 64 nt, hsa
uauugagacuguauuguuaugagccuaggaaauuugggaacaugauuguauuguauuaaaauuc

SEQ ID NO: 286639 - RNA, 64 nt, hsa
caggccuuacaucuggcuggaaagcagagccuccugggaacacaucuggcugcacaggcugaaa

SEQ ID NO: 286640 - RNA, 64 nt, hsa
gcagggcuggcacgugacaggcucgucagccaccugggaacacaguucugggcaaagaggaucc

SEQ ID NO: 286641 - RNA, 64 nt, hsa
ugcccuguguccauggugggugugccgggcuggcugggaacaaggagcaguauguugaguagaa

SEQ ID NO: 286642 - RNA, 64 nt, hsa
ucuggagauagauggagaaguguuuucagauuccugggaacagacaccagugcuccagcuccuc

SEQ ID NO: 286643 - RNA, 64 nt, hsa
uccacucuagugcugggagccagcgcucccuuacugggaacaggauuccaggaccccuuucuug

SEQ ID NO: 286644 - RNA, 64 nt, hsa
ugcaggcuaggaaguggccuagugcaagaugagcugggaacaagggaggagagagcaggagcug

SEQ ID NO: 286645 - RNA, 64 nt, hsa
uuuguacuucuuguaagaccaucuuuaauuuuucugggaacacaccugccuuuuguguaaugcg

SEQ ID NO: 286646 - RNA, 64 nt, hsa
gucuuguucucccaucuguuuauucuuugggcucugggaacaggggacuacuuuggggcuuucu

SEQ ID NO: 286647 - RNA, 64 nt, hsa
ccuccccaguuuaccacuuuguucuaauaggagaugggaacacgagaaguuugauggcuuugcc

SEQ ID NO: 286648 - RNA, 64 nt, hsa; identical to SEQ ID NO: 90763

SEQ ID NO: 286649 - RNA, 64 nt, hsa; identical to SEQ ID NO: 90764

SEQ ID NO: 286650 - RNA, 64 nt, hsa; identical to SEQ ID NO: 90765

SEQ ID NO: 286651 - RNA, 64 nt, hsa; identical to SEQ ID NO: 90766

SEQ ID NO: 286652 - RNA, 64 nt, hsa; identical to SEQ ID NO: 90767

SEQ ID NO: 286653 - RNA, 64 nt, hsa; identical to SEQ ID NO: 90768

SEQ ID NO: 286654 - RNA, 64 nt, hsa; identical to SEQ ID NO: 90769

SEQ ID NO: 286655 - RNA, 64 nt, hsa; identical to SEQ ID NO: 90770

SEQ ID NO: 286656 - RNA, 64 nt, hsa; identical to SEQ ID NO: 90771

SEQ ID NO: 286657 - RNA, 64 nt, hsa; identical to SEQ ID NO: 90772

SEQ ID NO: 286658 - RNA, 64 nt, hsa; identical to SEQ ID NO: 90773

SEQ ID NO: 286659 - RNA, 64 nt, hsa; identical to SEQ ID NO: 90774

SEQ ID NO: 286660 - RNA, 64 nt, hsa; identical to SEQ ID NO: 90775

SEQ ID NO: 286661 - RNA, 64 nt, hsa; identical to SEQ ID NO: 90776

SEQ ID NO: 286662 - RNA, 64 nt, hsa; identical to SEQ ID NO: 90777

SEQ ID NO: 286663 - RNA, 64 nt, hsa; identical to SEQ ID NO: 90778

SEQ ID NO: 286664 - RNA, 64 nt, hsa; identical to SEQ ID NO: 90779

SEQ ID NO: 286665 - RNA, 64 nt, hsa; identical to SEQ ID NO: 90780

SEQ ID NO: 286666 - RNA, 64 nt, hsa; identical to SEQ ID NO: 90781

SEQ ID NO: 286667 - RNA, 64 nt, hsa; identical to SEQ ID NO: 90782

SEQ ID NO: 286668 - RNA, 64 nt, hsa; identical to SEQ ID NO: 90783

SEQ ID NO: 286669 - RNA, 64 nt, hsa; identical to SEQ ID NO: 90784

SEQ ID NO: 286670 - RNA, 64 nt, hsa; identical to SEQ ID NO: 90785

SEQ ID NO: 286671 - RNA, 64 nt, hsa; identical to SEQ ID NO: 90786

SEQ ID NO: 286672 - RNA, 64 nt, hsa; identical to SEQ ID NO: 90787

SEQ ID NO: 286673 - RNA, 64 nt, hsa; identical to SEQ ID NO: 90788

SEQ ID NO: 286674 - RNA, 64 nt, hsa; identical to SEQ ID NO: 90789

SEQ ID NO: 286675 - RNA, 64 nt, hsa; identical to SEQ ID NO: 90790

SEQ ID NO: 286676 - RNA, 64 nt, hsa; identical to SEQ ID NO: 90791

SEQ ID NO: 286677 - RNA, 64 nt, hsa; identical to SEQ ID NO: 90792

SEQ ID NO: 286678 - RNA, 64 nt, hsa; identical to SEQ ID NO: 90793

SEQ ID NO: 286679 - RNA, 64 nt, hsa; identical to SEQ ID NO: 90794

SEQ ID NO: 286680 - RNA, 64 nt, hsa; identical to SEQ ID NO: 90795

SEQ ID NO: 286681 - RNA, 64 nt, hsa; identical to SEQ ID NO: 90796

SEQ ID NO: 286682 - RNA, 64 nt, hsa; identical to SEQ ID NO: 90797

SEQ ID NO: 286683 - RNA, 64 nt, hsa; identical to SEQ ID NO: 90798

SEQ ID NO: 286684 - RNA, 64 nt, hsa; identical to SEQ ID NO: 90799

SEQ ID NO: 286685 - RNA, 64 nt, hsa; identical to SEQ ID NO: 90800

SEQ ID NO: 286686 - RNA, 64 nt, hsa; identical to SEQ ID NO: 90801

SEQ ID NO: 286687 - RNA, 64 nt, hsa; identical to SEQ ID NO: 90802

SEQ ID NO: 286688 - RNA, 64 nt, hsa; identical to SEQ ID NO: 90803

SEQ ID NO: 286689 - RNA, 64 nt, hsa; identical to SEQ ID NO: 90804

SEQ ID NO: 286690 - RNA, 64 nt, hsa; identical to SEQ ID NO: 90805

SEQ ID NO: 286691 - RNA, 64 nt, hsa; identical to SEQ ID NO: 90806

SEQ ID NO: 286692 - RNA, 64 nt, hsa; identical to SEQ ID NO: 90807

SEQ ID NO: 286693 - RNA, 64 nt, hsa; identical to SEQ ID NO: 90808

SEQ ID NO: 286694 - RNA, 64 nt, hsa; identical to SEQ ID NO: 90809

SEQ ID NO: 286695 - RNA, 64 nt, hsa; identical to SEQ ID NO: 90810

SEQ ID NO: 286696 - RNA, 64 nt, hsa; identical to SEQ ID NO: 90811

SEQ ID NO: 286697 - RNA, 64 nt, hsa; identical to SEQ ID NO: 90812

SEQ ID NO: 286698 - RNA, 64 nt, hsa; identical to SEQ ID NO: 90813

SEQ ID NO: 286699 - RNA, 64 nt, hsa; identical to SEQ ID NO: 90814

SEQ ID NO: 286700 - RNA, 64 nt, hsa; identical to SEQ ID NO: 90815

SEQ ID NO: 286701 - RNA, 64 nt, hsa; identical to SEQ ID NO: 90816

SEQ ID NO: 286702 - RNA, 64 nt, hsa; identical to SEQ ID NO: 90817

SEQ ID NO: 286703 - RNA, 64 nt, hsa; identical to SEQ ID NO: 90818

SEQ ID NO: 286704 - RNA, 64 nt, hsa; identical to SEQ ID NO: 90819

SEQ ID NO: 286705 - RNA, 64 nt, hsa; identical to SEQ ID NO: 90820

SEQ ID NO: 286706 - RNA, 64 nt, hsa; identical to SEQ ID NO: 90821

SEQ ID NO: 286707 - RNA, 64 nt, hsa; identical to SEQ ID NO: 90822

SEQ ID NO: 286708 - RNA, 64 nt, hsa; identical to SEQ ID NO: 90823

SEQ ID NO: 286709 - RNA, 64 nt, hsa; identical to SEQ ID NO: 90824

SEQ ID NO: 286710 - RNA, 64 nt, hsa; identical to SEQ ID NO: 90825

SEQ ID NO: 286711 - RNA, 64 nt, hsa; identical to SEQ ID NO: 90826

SEQ ID NO: 286712 - RNA, 64 nt, hsa; identical to SEQ ID NO: 90827

SEQ ID NO: 286713 - RNA, 64 nt, hsa; identical to SEQ ID NO: 90828

SEQ ID NO: 286714 - RNA, 64 nt, hsa; identical to SEQ ID NO: 90829

SEQ ID NO: 286715 - RNA, 64 nt, hsa; identical to SEQ ID NO: 90830

SEQ ID NO: 286716 - RNA, 64 nt, hsa; identical to SEQ ID NO: 90831

SEQ ID NO: 286717 - RNA, 64 nt, hsa; identical to SEQ ID NO: 90832

SEQ ID NO: 286718 - RNA, 64 nt, hsa; identical to SEQ ID NO: 90833

SEQ ID NO: 286719 - RNA, 64 nt, hsa; identical to SEQ ID NO: 90834

SEQ ID NO: 286720 - RNA, 64 nt, hsa; identical to SEQ ID NO: 90835

SEQ ID NO: 286721 - RNA, 64 nt, hsa; identical to SEQ ID NO: 90836

SEQ ID NO: 286722 - RNA, 64 nt, hsa; identical to SEQ ID NO: 90837

SEQ ID NO: 286723 - RNA, 64 nt, hsa; identical to SEQ ID NO: 90838

SEQ ID NO: 286724 - RNA, 64 nt, hsa; identical to SEQ ID NO: 90839

SEQ ID NO: 286725 - RNA, 64 nt, hsa; identical to SEQ ID NO: 90840

SEQ ID NO: 286726 - RNA, 64 nt, hsa; identical to SEQ ID NO: 90841

SEQ ID NO: 286727 - RNA, 64 nt, hsa; identical to SEQ ID NO: 90842

SEQ ID NO: 286728 - RNA, 64 nt, hsa; identical to SEQ ID NO: 90843

SEQ ID NO: 286729 - RNA, 64 nt, hsa; identical to SEQ ID NO: 90844

SEQ ID NO: 286730 - RNA, 64 nt, hsa; identical to SEQ ID NO: 90845

SEQ ID NO: 286731 - RNA, 64 nt, hsa; identical to SEQ ID NO: 90846

SEQ ID NO: 286732 - RNA, 64 nt, hsa; identical to SEQ ID NO: 90847

SEQ ID NO: 286733 - RNA, 64 nt, hsa; identical to SEQ ID NO: 90848

SEQ ID NO: 286734 - RNA, 64 nt, hsa; identical to SEQ ID NO: 90849

SEQ ID NO: 286735 - RNA, 64 nt, hsa; identical to SEQ ID NO: 90850

SEQ ID NO: 286736 - RNA, 64 nt, hsa; identical to SEQ ID NO: 90851

SEQ ID NO: 286737 - RNA, 64 nt, hsa; identical to SEQ ID NO: 90852

SEQ ID NO: 286738 - RNA, 64 nt, hsa; identical to SEQ ID NO: 90853

SEQ ID NO: 286739 - RNA, 64 nt, hsa; identical to SEQ ID NO: 90854

SEQ ID NO: 286740 - RNA, 64 nt, hsa; identical to SEQ ID NO: 90855

SEQ ID NO: 286741 - RNA, 64 nt, hsa; identical to SEQ ID NO: 90856

SEQ ID NO: 286742 - RNA, 64 nt, hsa; identical to SEQ ID NO: 90857

SEQ ID NO: 286743 - RNA, 64 nt, hsa; identical to SEQ ID NO: 90858

SEQ ID NO: 286744 - RNA, 64 nt, hsa; identical to SEQ ID NO: 90859

SEQ ID NO: 286745 - RNA, 64 nt, hsa; identical to SEQ ID NO: 90860

SEQ ID NO: 286746 - RNA, 64 nt, hsa; identical to SEQ ID NO: 90861

SEQ ID NO: 286747 - RNA, 64 nt, hsa; identical to SEQ ID NO: 90862

SEQ ID NO: 286748 - RNA, 64 nt, hsa; identical to SEQ ID NO: 90863

SEQ ID NO: 286749 - RNA, 64 nt, hsa; identical to SEQ ID NO: 90864

SEQ ID NO: 286750 - RNA, 64 nt, hsa; identical to SEQ ID NO: 90865

SEQ ID NO: 286751 - RNA, 64 nt, hsa; identical to SEQ ID NO: 90866

SEQ ID NO: 286752 - RNA, 64 nt, hsa; identical to SEQ ID NO: 90867

SEQ ID NO: 286753 - RNA, 64 nt, hsa; identical to SEQ ID NO: 90868

SEQ ID NO: 286754 - RNA, 64 nt, hsa; identical to SEQ ID NO: 90869

SEQ ID NO: 286755 - RNA, 64 nt, hsa; identical to SEQ ID NO: 90870

SEQ ID NO: 286756 - RNA, 64 nt, hsa; identical to SEQ ID NO: 90871

SEQ ID NO: 286757 - RNA, 64 nt, hsa; identical to SEQ ID NO: 90872

SEQ ID NO: 286758 - RNA, 64 nt, hsa; identical to SEQ ID NO: 90873

SEQ ID NO: 286759 - RNA, 64 nt, hsa; identical to SEQ ID NO: 90874

SEQ ID NO: 286760 - RNA, 64 nt, hsa; identical to SEQ ID NO: 90875

SEQ ID NO: 286761 - RNA, 64 nt, hsa; identical to SEQ ID NO: 90876

SEQ ID NO: 286762 - RNA, 64 nt, hsa; identical to SEQ ID NO: 90877

SEQ ID NO: 286763 - RNA, 64 nt, hsa; identical to SEQ ID NO: 90878

SEQ ID NO: 286764 - RNA, 64 nt, hsa; identical to SEQ ID NO: 90879

SEQ ID NO: 286765 - RNA, 64 nt, hsa; identical to SEQ ID NO: 90880

SEQ ID NO: 286766 - RNA, 64 nt, hsa; identical to SEQ ID NO: 90881

SEQ ID NO: 286767 - RNA, 64 nt, hsa; identical to SEQ ID NO: 90882

SEQ ID NO: 286768 - RNA, 64 nt, hsa; identical to SEQ ID NO: 90883

SEQ ID NO: 286769 - RNA, 64 nt, hsa; identical to SEQ ID NO: 90884

SEQ ID NO: 286770 - RNA, 64 nt, hsa; identical to SEQ ID NO: 90885

SEQ ID NO: 286771 - RNA, 64 nt, hsa; identical to SEQ ID NO: 90886

SEQ ID NO: 286772 - RNA, 64 nt, hsa; identical to SEQ ID NO: 90887

SEQ ID NO: 286773 - RNA, 64 nt, hsa; identical to SEQ ID NO: 90888

SEQ ID NO: 286774 - RNA, 64 nt, hsa; identical to SEQ ID NO: 90889

SEQ ID NO: 286775 - RNA, 64 nt, hsa; identical to SEQ ID NO: 90890

SEQ ID NO: 286776 - RNA, 64 nt, hsa; identical to SEQ ID NO: 90891

SEQ ID NO: 286777 - RNA, 64 nt, hsa; identical to SEQ ID NO: 90892

SEQ ID NO: 286778 - RNA, 64 nt, hsa; identical to SEQ ID NO: 90893

SEQ ID NO: 286779 - RNA, 64 nt, hsa; identical to SEQ ID NO: 90894

SEQ ID NO: 286780 - RNA, 64 nt, hsa; identical to SEQ ID NO: 90895

SEQ ID NO: 286781 - RNA, 64 nt, hsa; identical to SEQ ID NO: 90896

SEQ ID NO: 286782 - RNA, 64 nt, hsa; identical to SEQ ID NO: 90897

SEQ ID NO: 286783 - RNA, 64 nt, hsa; identical to SEQ ID NO: 90898

SEQ ID NO: 286784 - RNA, 64 nt, hsa; identical to SEQ ID NO: 90899

SEQ ID NO: 286785 - RNA, 54 nt, hsa; identical to SEQ ID NO: 90900

SEQ ID NO: 286786 - RNA, 64 nt, hsa; identical to SEQ ID NO: 90901

SEQ ID NO: 286787 - RNA, 64 nt, hsa; identical to SEQ ID NO: 90902

SEQ ID NO: 286788 - RNA, 64 nt, hsa; identical to SEQ ID NO: 90903

SEQ ID NO: 286789 - RNA, 64 nt, hsa; identical to SEQ ID NO: 90904

SEQ ID NO: 286790 - RNA, 64 nt, hsa; identical to SEQ ID NO: 90905

SEQ ID NO: 286791 - RNA, 64 nt, hsa; identical to SEQ ID NO: 90906

SEQ ID NO: 286792 - RNA, 64 nt, hsa; identical to SEQ ID NO: 90907

SEQ ID NO: 286793 - RNA, 64 nt, hsa; identical to SEQ ID NO: 90908

SEQ ID NO: 286794 - RNA, 64 nt, hsa; identical to SEQ ID NO: 90909

SEQ ID NO: 286795 - RNA, 64 nt, hsa; identical to SEQ ID NO: 90910

SEQ ID NO: 286796 - RNA, 64 nt, hsa; identical to SEQ ID NO: 90911

SEQ ID NO: 286797 - RNA, 64 nt, hsa; identical to SEQ ID NO: 90912

SEQ ID NO: 286798 - RNA, 64 nt, hsa; identical to SEQ ID NO: 90913

SEQ ID NO: 286799 - RNA, 64 nt, hsa; identical to SEQ ID NO: 90914

SEQ ID NO: 286800 - RNA, 64 nt, hsa; identical to SEQ ID NO: 90915

SEQ ID NO: 286801 - RNA, 64 nt, hsa; identical to SEQ ID NO: 90916

SEQ ID NO: 286802 - RNA, 64 nt, hsa; identical to SEQ ID NO: 90917

SEQ ID NO: 286803 - RNA, 64 nt, hsa; identical to SEQ ID NO: 90918

SEQ ID NO: 286804 - RNA, 64 nt, hsa; identical to SEQ ID NO: 90919

SEQ ID NO: 286805 - RNA, 64 nt, hsa; identical to SEQ ID NO: 90920

SEQ ID NO: 286806 - RNA, 64 nt, hsa; identical to SEQ ID NO: 90921

SEQ ID NO: 286807 - RNA, 64 nt, hsa; identical to SEQ ID NO: 90922

SEQ ID NO: 286808 - RNA, 64 nt, hsa; identical to SEQ ID NO: 90923

SEQ ID NO: 286809 - RNA, 64 nt, hsa; identical to SEQ ID NO: 90924

SEQ ID NO: 286810 - RNA, 64 nt, hsa; identical to SEQ ID NO: 90925

SEQ ID NO: 286811 - RNA, 64 nt, hsa; identical to SEQ ID NO: 90926

SEQ ID NO: 286812 - RNA, 64 nt, hsa; identical to SEQ ID NO: 90927

SEQ ID NO: 286813 - RNA, 64 nt, hsa; identical to SEQ ID NO: 90928

SEQ ID NO: 286814 - RNA, 64 nt, hsa; identical to SEQ ID NO: 90929

SEQ ID NO: 286815 - RNA, 64 nt, hsa; identical to SEQ ID NO: 90811

SEQ ID NO: 286816 - RNA, 64 nt, hsa; identical to SEQ ID NO: 90931

SEQ ID NO: 286817 - RNA, 64 nt, hsa; identical to SEQ ID NO: 90932

SEQ ID NO: 286818 - RNA, 64 nt, hsa; identical to SEQ ID NO: 90933

SEQ ID NO: 286819 - RNA, 64 nt, hsa; identical to SEQ ID NO: 90934

SEQ ID NO: 286820 - RNA, 64 nt, hsa; identical to SEQ ID NO: 90935

SEQ ID NO: 286821 - RNA, 64 nt, hsa; identical to SEQ ID NO: 90936

SEQ ID NO: 286822 - RNA, 64 nt, hsa; identical to SEQ ID NO: 90937

SEQ ID NO: 286823 - RNA, 64 nt, hsa; identical to SEQ ID NO: 90938

SEQ ID NO: 286824 - RNA, 64 nt, hsa; identical to SEQ ID NO: 90939

SEQ ID NO: 286825 - RNA, 64 nt, hsa; identical to SEQ ID NO: 90940

SEQ ID NO: 286826 - RNA, 64 nt, hsa; identical to SEQ ID NO: 90941

SEQ ID NO: 286827 - RNA, 64 nt, hsa; identical to SEQ ID NO: 90942

SEQ ID NO: 286828 - RNA, 64 nt, hsa; identical to SEQ ID NO: 90943

SEQ ID NO: 286829 - RNA, 64 nt, hsa; identical to SEQ ID NO: 90944

SEQ ID NO: 286830 - RNA, 64 nt, hsa; identical to SEQ ID NO: 90945

SEQ ID NO: 286831 - RNA, 64 nt, hsa; identical to SEQ ID NO: 90946

SEQ ID NO: 286832 - RNA, 64 nt, hsa; identical to SEQ ID NO: 90947

SEQ ID NO: 286833 - RNA, 64 nt, hsa; identical to SEQ ID NO: 90948

SEQ ID NO: 286834 - RNA, 64 nt, hsa; identical to SEQ ID NO: 90949

SEQ ID NO: 286835 - RNA, 64 nt, hsa; identical to SEQ ID NO: 90950

SEQ ID NO: 286836 - RNA, 64 nt, hsa; identical to SEQ ID NO: 90951

SEQ ID NO: 286837 - RNA, 64 nt, hsa; identical to SEQ ID NO: 90952

SEQ ID NO: 286838 - RNA, 64 nt, hsa; identical to SEQ ID NO: 90953

SEQ ID NO: 286839 - RNA, 64 nt, hsa; identical to SEQ ID NO: 90954

SEQ ID NO: 286840 - RNA, 64 nt, hsa; identical to SEQ ID NO: 90955

SEQ ID NO: 286841 - RNA, 64 nt, hsa; identical to SEQ ID NO: 90956

SEQ ID NO: 286842 - RNA, 64 nt, hsa; identical to SEQ ID NO: 90957

SEQ ID NO: 286843 - RNA, 64 nt, hsa; identical to SEQ ID NO: 90958

SEQ ID NO: 286844 - RNA, 64 nt, hsa; identical to SEQ ID NO: 90959

SEQ ID NO: 286845 - RNA, 64 nt, hsa; identical to SEQ ID NO: 90960

SEQ ID NO: 286846 - RNA, 64 nt, hsa; identical to SEQ ID NO: 90961

SEQ ID NO: 286847 - RNA, 64 nt, hsa; identical to SEQ ID NO: 90962

SEQ ID NO: 286848 - RNA, 64 nt, hsa; identical to SEQ ID NO: 90963

SEQ ID NO: 286849 - RNA, 64 nt, hsa; identical to SEQ ID NO: 90964

SEQ ID NO: 286850 - RNA, 64 nt, hsa; identical to SEQ ID NO: 90965

SEQ ID NO: 286851 - RNA, 64 nt, hsa; identical to SEQ ID NO: 90966

SEQ ID NO: 286852 - RNA, 64 nt, hsa; identical to SEQ ID NO: 90967

SEQ ID NO: 286853 - RNA, 64 nt, hsa; identical to SEQ ID NO: 90968

SEQ ID NO: 286854 - RNA, 64 nt, hsa; identical to SEQ ID NO: 90969

SEQ ID NO: 286855 - RNA, 64 nt, hsa; identical to SEQ ID NO: 90970

SEQ ID NO: 286856 - RNA, 64 nt, hsa; identical to SEQ ID NO: 90971

SEQ ID NO: 286857 - RNA, 64 nt, hsa; identical to SEQ ID NO: 90972

SEQ ID NO: 286858 - RNA, 64 nt, hsa; identical to SEQ ID NO: 90973

SEQ ID NO: 286859 - RNA, 64 nt, hsa; identical to SEQ ID NO: 90974

SEQ ID NO: 286860 - RNA, 64 nt, hsa; identical to SEQ ID NO: 90975

SEQ ID NO: 286861 - RNA, 64 nt, hsa; identical to SEQ ID NO: 90976

SEQ ID NO: 286862 - RNA, 64 nt, hsa; identical to SEQ ID NO: 90977

SEQ ID NO: 286863 - RNA, 64 nt, hsa; identical to SEQ ID NO: 90978

SEQ ID NO: 286864 - RNA, 64 nt, hsa; identical to SEQ ID NO: 90979

SEQ ID NO: 286865 - RNA, 64 nt, hsa; identical to SEQ ID NO: 90980

SEQ ID NO: 286866 - RNA, 64 nt, hsa; identical to SEQ ID NO: 90981

SEQ ID NO: 286867 - RNA, 64 nt, hsa; identical to SEQ ID NO: 90982

SEQ ID NO: 286868 - RNA, 64 nt, hsa; identical to SEQ ID NO: 90983

SEQ ID NO: 286869 - RNA, 64 nt, hsa; identical to SEQ ID NO: 90984

SEQ ID NO: 286870 - RNA, 64 nt, hsa; identical to SEQ ID NO: 90985

SEQ ID NO: 286871 - RNA, 64 nt, hsa; identical to SEQ ID NO: 90986

SEQ ID NO: 286872 - RNA, 64 nt, hsa; identical to SEQ ID NO: 90987

SEQ ID NO: 286873 - RNA, 64 nt, hsa; identical to SEQ ID NO: 90988

SEQ ID NO: 286874 - RNA, 64 nt, hsa; identical to SEQ ID NO: 90989

SEQ ID NO: 286875 - RNA, 64 nt, hsa; identical to SEQ ID NO: 90990

SEQ ID NO: 286876 - RNA, 64 nt, hsa; identical to SEQ ID NO: 90991

SEQ ID NO: 286877 - RNA, 64 nt, hsa; identical to SEQ ID NO: 90992

SEQ ID NO: 286878 - RNA, 64 nt, hsa; identical to SEQ ID NO: 90993

SEQ ID NO: 286879 - RNA, 64 nt, hsa; identical to SEQ ID NO: 90994

SEQ ID NO: 286880 - RNA, 64 nt, hsa; identical to SEQ ID NO: 90995

SEQ ID NO: 286881 - RNA, 64 nt, hsa; identical to SEQ ID NO: 90996

SEQ ID NO: 286882 - RNA, 64 nt, hsa; identical to SEQ ID NO: 90997

SEQ ID NO: 286883 - RNA, 64 nt, hsa; identical to SEQ ID NO: 90998

SEQ ID NO: 286884 - RNA, 64 nt, hsa; identical to SEQ ID NO: 90999

SEQ ID NO: 286885 - RNA, 64 nt, hsa; identical to SEQ ID NO: 91000

SEQ ID NO: 286886 - RNA, 64 nt, hsa; identical to SEQ ID NO: 91001

SEQ ID NO: 286887 - RNA, 64 nt, hsa; identical to SEQ ID NO: 91002

SEQ ID NO: 286888 - RNA, 64 nt, hsa; identical to SEQ ID NO: 91003

SEQ ID NO: 286889 - RNA, 64 nt, hsa; identical to SEQ ID NO: 91004

SEQ ID NO: 286890 - RNA, 64 nt, hsa; identical to SEQ ID NO: 91005

SEQ ID NO: 286891 - RNA, 64 nt, hsa; identical to SEQ ID NO: 91006

SEQ ID NO: 286892 - RNA, 64 nt, hsa; identical to SEQ ID NO: 91007

SEQ ID NO: 286893 - RNA, 64 nt, hsa; identical to SEQ ID NO: 91008

SEQ ID NO: 286894 - RNA, 64 nt, hsa; identical to SEQ ID NO: 91009

SEQ ID NO: 286895 - RNA, 64 nt, hsa; identical to SEQ ID NO: 91010

SEQ ID NO: 286896 - RNA, 64 nt, hsa; identical to SEQ ID NO: 91011

SEQ ID NO: 286897 - RNA, 64 nt, hsa; identical to SEQ ID NO: 91012

SEQ ID NO: 286898 - RNA, 64 nt, hsa; identical to SEQ ID NO: 91013

SEQ ID NO: 286899 - RNA, 64 nt, hsa; identical to SEQ ID NO: 91014

SEQ ID NO: 286900 - RNA, 64 nt, hsa; identical to SEQ ID NO: 91015

SEQ ID NO: 286901 - RNA, 64 nt, hsa; identical to SEQ ID NO: 91016

SEQ ID NO: 286902 - RNA, 64 nt, hsa; identical to SEQ ID NO: 91017

SEQ ID NO: 286903 - RNA, 64 nt, hsa; identical to SEQ ID NO: 91018

SEQ ID NO: 286904 - RNA, 64 nt, hsa; identical to SEQ ID NO: 91019

SEQ ID NO: 286905 - RNA, 64 nt, hsa; identical to SEQ ID NO: 91020

SEQ ID NO: 286906 - RNA, 64 nt, hsa; identical to SEQ ID NO: 91021

SEQ ID NO: 286907 - RNA, 64 nt, hsa; identical to SEQ ID NO: 91022

SEQ ID NO: 286908 - RNA, 64 nt, hsa; identical to SEQ ID NO: 91023

SEQ ID NO: 286909 - RNA, 64 nt, hsa; identical to SEQ ID NO: 91024

SEQ ID NO: 286910 - RNA, 64 nt, hsa; identical to SEQ ID NO: 91025

SEQ ID NO: 286911 - RNA, 64 nt, hsa; identical to SEQ ID NO: 91026

SEQ ID NO: 286912 - RNA, 64 nt, hsa; identical to SEQ ID NO: 91027

SEQ ID NO: 286913 - RNA, 64 nt, hsa; identical to SEQ ID NO: 91028

SEQ ID NO: 286914 - RNA, 64 nt, hsa; identical to SEQ ID NO: 91029

SEQ ID NO: 286915 - RNA, 64 nt, hsa
cagcgagggucuccuucgccuucaaccuccuagugucuguuagcaucuuccuuuucaugggggg

SEQ ID NO: 286916 - RNA, 64 nt, hsa
uguaagcauguuuaccuguuggcuugcuuugugugucuguuaaaugaaugucauauguaaaugc

SEQ ID NO: 286917 - RNA, 61 nt, hsa
aaacagaaccaccuggcuagacccuaggaagccaggagaggaucagguuccaaaggggaau

SEQ ID NO: 286918 - RNA, 64 nt, hsa
acucgggaggcugagacaggagaaucgcuugaacccaggagauggagauugcaguaggccaaga

SEQ ID NO: 286919 - RNA, 64 nt, hsa
cccaagcagaauuagcaacaggaaaagcagagccccaggagagacacucuacuauauauacucu

SEQ ID NO: 286920 - RNA, 64 nt, hsa
caauacaugugcagggguugcugcuuucccagugccaggagaacccccgcuccgagucagccug

SEQ ID NO: 286921 - RNA, 64 nt, hsa
ccgagucagccugugugggucaugaggcuggggcccaggagacacggucccaggcacugcacag

SEQ ID NO: 286922 - RNA, 64 nt, hsa
gucccuggaaaagaaagaauaaguggauucucccccaggagaauccuuuuugcaaagauaggca

SEQ ID NO: 286923 - RNA, 64 nt, hsa
cugcaagccuugaagccuccagcaacgucuaucuccaggagagcagggcagccuaugcaagugu

SEQ ID NO: 286924 - RNA, 64 nt, hsa
ucuccuuuaucgucauuaagucauucacaaaaagccaggagaagcauuuggaaagggcaugaua

SEQ ID NO: 286925 - RNA, 64 nt, hsa
uucccugcagugaggcuuguccagaugauugagcccaggagaggaagaacaaacaaacuacgga

SEQ ID NO: 286926 - RNA, 64 nt, hsa
ugguggccgguagaauucuccaucuauccaggcuccaggagaccccugggcaucucccaccugu

SEQ ID NO: 286927 - RNA, 64 nt, hsa
aaucaacacuguucucucuguaccaugagcuccuccaggagauuauuuaaguguauuguaucau

SEQ ID NO: 286928 - RNA, 64 nt, hsa
cucugaguucugugcugucucuuggaggcagggcccaggagaacaaaguguggaggccucgggg

SEQ ID NO: 286929 - RNA, 64 nt, hsa
agaguaucgcccugggaugugguggggagcugggccaggagagggacugacugugacccucugc

SEQ ID NO: 286930 - RNA, 64 nt, hsa
gaggugguucaaauccucuggaacauagccaagaccaggagaagagagagcacuuucuucccag

SEQ ID NO: 286931 - RNA, 64 nt, hsa
cuuugcugcccuugccaucuuuuaggaugggcccccaggagacugaggucuuccugggcccuca

SEQ ID NO: 286932 - RNA, 64 nt, hsa
caagggaggugccaacacugggcuugccacagccccaggagaggaauuuggggccuaggaaccg

SEQ ID NO: 286933 - RNA, 64 nt, hsa
caggcuuugcugaggugcugcccaaccugacaguccaggagauggacuggcuggugcuggggga

SEQ ID NO: 286934 - RNA, 64 nt, hsa
cagagacuugccagggcugccaaggagccgggacccaggagagggugagcuggaagggugcgug

SEQ ID NO: 286935 - RNA, 64 nt, hsa
gaggaccgguugcagcuuacccagaaccacuccuccaggagagcuggauguuuugcgugcaaca

SEQ ID NO: 286936 - RNA, 64 nt, hsa
gcccacuucccacugcucagcccacaccagaccuccaggagacauccccccuugaggcagagag

SEQ ID NO: 286937 - RNA, 64 nt, hsa
acccaaagggaugcucugccaaagguuuaaacacccaggagaccaucagccucuccugggagca

SEQ ID NO: 286938 - RNA, 64 nt, hsa
agagaaauuuccagaccauccccucucaccacagccaggagaggccuuucccaccgguagagaa

SEQ ID NO: 286939 - RNA, 64 nt, hsa
gagagaaacuuccagaccagcccucucacuacagccaggagaggccuuucccgccuggaaacuu

SEQ ID NO: 286940 - RNA, 64 nt, hsa
ggaaacuuccggacaagccucucacacaccacagccaggagaggccuuucccaccuggacagaa

SEQ ID NO: 286941 - RNA, 64 nt, hsa
acagaaacuuccagaccagccccucucaccacagccaggagaggccuuuaccaccuggagagaa

SEQ ID NO: 286942 - RNA, 64 nt, hsa
agagaagcuuccagaccagccccucacaccacagccaggagaggccuuucccaccuggagagaa

SEQ ID NO: 286943 - RNA, 64 nt, hsa
agagaaacuuccagaccagccccucacaccaccgccaggagaggccuuucccaccgggagagaa

SEQ ID NO: 286944 - RNA, 64 nt, hsa
agagaaacuuccagaccagccccucacaccacagccaggagaggccuuucccaccgggagagaa

SEQ ID NO: 286945 - RNA, 64 nt, hsa
agaggaacuuccagaccagccccucacaccacagccaggagaggccuuucccgccuggagagaa

SEQ ID NO: 286946 - RNA, 64 nt, hsa
gagagaagcuucaggccagcuccucacaccacagccaggagagaccuuuucugccuggagagaa

SEQ ID NO: 286947 - RNA, 64 nt, hsa
agagaaacuuucagaccagccccacacaccacagccaggagaggccguuccugccuggagagaa

SEQ ID NO: 286948 - RNA, 64 nt, hsa
agagaagcuuccagaccagcccuucacaccacagccaggagaggccuuucccaccuggagagaa

SEQ ID NO: 286949 - RNA, 64 nt, hsa
agagaaacuuccagaccagccccucucaccacagccaggagaggccguucccaccuggagggaa

SEQ ID NO: 286950 - RNA, 64 nt, hsa
caggagagagggacagguucugucaggggugacaccaggagagagggacagguucuguuggggg

SEQ ID NO: 286951 - RNA, 64 nt, hsa
gaggagacagggacagguucugucgggggugacaccaggagagagggacagguucugucagggg

SEQ ID NO: 286952 - RNA, 64 nt, hsa
gaggacacagggacagguucuaucaugggugacaccaggagagagggacagguucuguuggggg

SEQ ID NO: 286953 - RNA, 64 nt, hsa
guauuugugaauaacaaacugcacaaccugcaaaccaggagagagggacagguucugucagggg

SEQ ID NO: 286954 - RNA, 64 nt, hsa
agcggcccucaggcuuuucucagacaugcgggagccaggagagcacccuucuccacucagcucc

SEQ ID NO: 286955 - RNA, 64 nt, hsa
guucauucaacucuugcuuuucacaaaauaguaaccaggagauguuuaaugugccugauuuaau

SEQ ID NO: 286956 - RNA, 64 nt, hsa
uguuucuccuugacacauuucucaauccacgaagccaggagagguagagugaaaaucccagcca

SEQ ID NO: 286957 - RNA, 64 nt, hsa
acuuuucugucuucacagcuuuggggaauuuuggccaggagacccugaaacaugaaaccaaaca

SEQ ID NO: 286958 - RNA, 64 nt, hsa
ugccuuaccuuuacccguccuugagaacagcgguccaggagaaucaggcagucuguggccuccu

SEQ ID NO: 286959 - RNA, 64 nt, hsa
gcacuccugaagaagggagugugaccugcagucaccaggagaugaggguuaggugugcccagcc

SEQ ID NO: 286960 - RNA, 64 nt, hsa
caguacccagcaaguggggaugguugguccccuaccaggagagggccuggggcucuugcuuccc

SEQ ID NO: 286961 - RNA, 64 nt, hsa
uccugacagggaugcucaugcccagaaagcaagcccaggagaggaaggcagagugugacagagc

SEQ ID NO: 286962 - RNA, 64 nt, hsa
agagugugacagagcagagccagggccaggcgcaccaggagaggcguuucuggggcuccagaga

SEQ ID NO: 286963 - RNA, 64 nt, hsa
ggaaggccaggguggaagggcggcuugagggacgccaggagaagacugaaugccaggcuaggaa

SEQ ID NO: 286964 - RNA, 64 nt, hsa
uacccuauggccacagcaggaggucagcccagggccaggagacacauggcuggacaaggcuuug

SEQ ID NO: 286965 - RNA, 64 nt, hsa
cacaacaaccucgucaucauccccacuuuaaaccccaggagacugaaacucaaacaacccuggg

SEQ ID NO: 286966 - RNA, 64 nt, hsa
gagcucugaccuuucucuuggccccuuguacaccccaggagagaaguucucaaucccagcaguu

SEQ ID NO: 286967 - RNA, 64 nt, hsa
gcaccccacagcccucacauccccuggccuggacccaggagacccaggagaaagcacccucccu

SEQ ID NO: 286968 - RNA, 64 nt, hsa
agcccucacauccccuggccuggacccaggagacccaggagaaagcacccucccuuaggaauga

SEQ ID NO: 286969 - RNA, 64 nt, hsa
uucagugccugggugcucaggcuuugcccaggugccaggagaaggugugagcaugagccuauug

SEQ ID NO: 286970 - RNA, 64 nt, hsa
aguccugcagagccucugggcugggcuggugcccccaggagauggagggccugguggaugcccu

SEQ ID NO: 286971 - RNA, 64 nt, hsa
gcacccuucuggaccaaagcgccaaggacugcagccaggagagagggggcucaccucuuauccu

SEQ ID NO: 286972 - RNA, 64 nt, hsa
cgcaggccgggaagcagugcccgccaggccugggccaggagagcuccaggaagggcacugagcg

SEQ ID NO: 286973 - RNA, 64 nt, hsa
aauagugugauuagaacacugaucgugugcgaggccaggagaucaagaccauccugacuaacaa

SEQ ID NO: 286974 - RNA, 64 nt, hsa
guguaaaguauguugguggugaaagcaagguuccccaggagaggggagggacuggccccuggga

SEQ ID NO: 286975 - RNA, 64 nt, hsa
agucgugagguccuucugaauguaaaacuggagcccaggagaagcugucccaggagggcuguua

SEQ ID NO: 286976 - RNA, 64 nt, hsa
gcugucccaggagggcuguuaacucccuauagagccaggagacaggauagggguuucuaggguc

SEQ ID NO: 286977 - RNA, 64 nt, hsa
caugguacugucuccacagcccucaguccccaccccaggagaggcgccugccaccuccuccuca

SEQ ID NO: 286978 - RNA, 64 nt, hsa
cacacacuccacgagagcagccccuccacucugcccaggagaggggccgacccuccucgggaac

SEQ ID NO: 286979 - RNA, 64 nt, hsa
acaacacggggagcagcaagagaugagccaggguccaggagacagaugcccaucgcgaguacag

SEQ ID NO: 286980 - RNA, 64 nt, hsa
uuccauaggacauuucacacaguccuuagaacccccaggagagagcuacugacuuguuaucauc

SEQ ID NO: 286981 - RNA, 64 nt, hsa
guucguuuauuacuuaccauuggaauauuuugagccaggagagcgccuucucucuccagccauc

SEQ ID NO: 286982 - RNA, 64 nt, hsa
aggaccggggguggagaggagccucaaguacauuccaggagaccacugucuccucgcuggccug

SEQ ID NO: 286983 - RNA, 64 nt, hsa
gaaacgacgguacccaggagaagggauuuugggcccaggagaaacacuuacauucuggugccuu

SEQ ID NO: 286984 - RNA, 64 nt, hsa
cuauggcugagccuggagccagaaacgacgguacccaggagaagggauuuugggcccaggagaa

SEQ ID NO: 286985 - RNA, 64 nt, hsa
ccuccacggcuguguacgccuguugcaaccccauccaggagacauauuuccagcagcuggcacc

SEQ ID NO: 286986 - RNA, 64 nt, hsa
uuaacuucauauugugagacugcucggucaagugccaggagauugugauugggagaggguaagg

SEQ ID NO: 286987 - RNA, 64 nt, hsa
agagugacagcugcucaggcccuaacccuuggcuccaggagacacagggcccagcacccagguu

SEQ ID NO: 286988 - RNA, 64 nt, hsa
ccacccgccccauccaggcuccagcagcaaagccccaggagaacaggcuggacagaggagaagg

SEQ ID NO: 286989 - RNA, 64 nt, hsa
uggccagagggccucagggagcugcaaaacucauccaggagaaaaaggcaggagcagcaaguga

SEQ ID NO: 286990 - RNA, 64 nt, hsa
agacucccauccucucuucccccucaccaagugcccaggagaccccuggcucagaccagcccaa

SEQ ID NO: 286991 - RNA, 64 nt, hsa
aaaugccuuaaacugcaacgucccgucccuuccccacccccaucccauccccacccccagcccc

SEQ ID NO: 286992 - RNA, 64 nt, hsa
acgucccgucccuuccccacccccaucccauccccacccccagccccagcccaguccuccuagg

SEQ ID NO: 286993 - RNA, 64 nt, hsa
ccuaccaagcucgagcuggcccuugacccccacccacccccacccuugcuggcaggggcaggga

SEQ ID NO: 286994 - RNA, 64 nt, hsa
uuugggguuuucugugcccaugacuugggggcugcacccccacagcacccccacaauguaggaa

SEQ ID NO: 286995 - RNA, 64 nt, hsa
cugugcccaugacuugggggcugcacccccacagcacccccacaauguaggaaaagaccucagg

SEQ ID NO: 286996 - RNA, 64 nt, hsa
uugcagaccacgcggggcagggcuccacugaagccacccccaccccucgccagcuagcuccaua

SEQ ID NO: 286997 - RNA, 64 nt, hsa
ugccucauggaagccuuugaggguaucacacagacacccccaccuuccuccagccugugcgcac

SEQ ID NO: 286998 - RNA, 64 nt, hsa
ccuguugugcccuuuaagagacauguuuccaccccacccccaaccuugucccaagugcccugga

SEQ ID NO: 286999 - RNA, 64 nt, hsa
aggagaggggcuugggagcccacuuuuaauuucucacccccauuuuacaaagagugcuuagauu

SEQ ID NO: 287000 - RNA, 64 nt, hsa
uccucugcagcuuccuccucagccucccuccuugcacccccacagguuuggcuugugguuuuug

SEQ ID NO: 287001 - RNA, 64 nt, hsa
cggcccagccuguccaggauacaguggggcugagcacccccaggccuuccacuccucuacccuc

SEQ ID NO: 287002 - RNA, 64 nt, hsa
ucugggcaccagaaggcuccuggaccaugagcuucacccccagaauucccugcugacccugccc

SEQ ID NO: 287003 - RNA, 64 nt, hsa
aucacacugcaugggagauuuuguuaacgucugccacccccacucucacccccaagcucuaagc

SEQ ID NO: 287004 - RNA, 64 nt, hsa
gggagauuuuguuaacgucugccacccccacucucacccccaagcucuaagcccccgggaggcc

SEQ ID NO: 287005 - RNA, 64 nt, hsa
aggaccagguccccaagucccuucacaggguccccacccccacuggcuuuggugcuguccacac

SEQ ID NO: 287006 - RNA, 64 nt, hsa
uaccaggcggaggggcugcuuuucugcccuuccucacccccacgccccaccccacucccccaga

SEQ ID NO: 287007 - RNA, 64 nt, hsa
uuaucccucuccauaaccccacccuugcccaccccacccccacccccaccaagggcgcaagagu

SEQ ID NO: 287008 - RNA, 64 nt, hsa
cucuccauaaccccacccuugcccaccccacccccacccccaccaagggcgcaagaguagcggu

SEQ ID NO: 287009 - RNA, 64 nt, hsa
acacagauuugagucagaacuggaaagugucccccacccccaccacccucgagcgggguucccc

SEQ ID NO: 287010 - RNA, 64 nt, hsa
ugcagccacauccuuguacagaggcauagguuaccacccccaccccggcccgggauacugcccc

SEQ ID NO: 287011 - RNA, 64 nt, hsa
gaagggaggggcaggaugggccauggaggugccccacccccacaccugacaaucacccacacuc

SEQ ID NO: 287012 - RNA, 64 nt, hsa
cgugccacaccugcgcugauucuugugugugcugcacccccaaggugugugggugcuggcugag

SEQ ID NO: 287013 - RNA, 64 nt, hsa
ggugccgagcccugcauguggagcccucccaccccacccccagauagagggaaauaaccaaaaa

SEQ ID NO: 287014 - RNA, 64 nt, hsa
uucucuuucccucucaacaguggggucgggggcccacccccagcugggggaccccaugcaggcu

SEQ ID NO: 287015 - RNA, 64 nt, hsa
cagugccuuugcuccucuguccugccucuacucccacccccacuaccucugggaaccacagcuc

SEQ ID NO: 287016 - RNA, 64 nt, hsa
cccuccaucucugaccacccccacccuaaccccccacccccaccauccuauuaaacauuuuuaa

SEQ ID NO: 287017 - RNA, 64 nt, hsa
cucauuuucuucccucucucccuccaucucugaccacccccacccuaaccccccacccccacca

SEQ ID NO: 287018 - RNA, 64 nt, hsa
aauucuugacacucuuucuauaauuagcguucuucacccccacccccacccccaccccccuuau

SEQ ID NO: 287019 - RNA, 64 nt, hsa
ugacacucuuucuauaauuagcguucuucacccccacccccacccccaccccccuuauuuuccu

SEQ ID NO: 287020 - RNA, 64 nt, hsa
ucuuucuauaauuagcguucuucacccccacccccacccccaccccccuuauuuuccuuuuguc

SEQ ID NO: 287021 - RNA, 64 nt, hsa
gagaccugugucaaaacuuacauccacauuccuacacccccacaacccaucacuucugguguua

SEQ ID NO: 287022 - RNA, 64 nt, hsa
acaugagccaaaagcacauaccuaccccaucccccacccccacacacacacacacacacacaug

SEQ ID NO: 287023 - RNA, 64 nt, hsa
cccgaaugccucccugggaggcacacugauugcccacccccaccacugcaccauuuccaggagg

SEQ ID NO: 287024 - RNA, 64 nt, hsa
ucaucguuccccugagcacugggggacagacccucacccccacccuggggguguggcaccucca

SEQ ID NO: 287025 - RNA, 64 nt, hsa
cucucagcuccagguggcucugaggugccugucccacccccacccccagcucaauggacuggaa

SEQ ID NO: 287026 - RNA, 64 nt, hsa
gcuccagguggcucugaggugccugucccacccccacccccagcucaauggacuggaaggggaa

SEQ ID NO: 287027 - RNA, 64 nt, hsa
ccugacaaaaacacguaggggcagggacgguccccacccccagggacacaaccccuggucuugg

SEQ ID NO: 287028 - RNA, 64 nt, hsa
caaccugagacagaaccaggcugagccaggccuccacccccacccccguuugcugggggcuccu

SEQ ID NO: 287029 - RNA, 64 nt, hsa
acugcucugggagggcccugaggacucccacccucacccccacccccacagggucagcaacugc

SEQ ID NO: 287030 - RNA, 64 nt, hsa
cugggagggcccugaggacucccacccucacccccacccccacagggucagcaacugcuuccgg

SEQ ID NO: 287031 - RNA, 64 nt, hsa
acucagcugccccuguccccaccucuggagaauccacccccaccagauuccuccgcgggaggug

SEQ ID NO: 287032 - RNA, 64 nt, hsa
cgugggaccaugacuuagggaggugggacccacccacccccauccaggaaccgugacguccaag

SEQ ID NO: 287033 - RNA, 64 nt, hsa
ugaauuugagcacaguccagaaauggagacaucccacccccaguugaauaauggcccauucaug

SEQ ID NO: 287034 - RNA, 64 nt, hsa
cucugucucuccuucucucucuccccccaccacccacccccacacacgucaucugcauuguuau

SEQ ID NO: 287035 - RNA, 64 nt, hsa
uccuagaggccccggaggagcugggccagccgcccacccccacccccagugcagggcuggucuu

SEQ ID NO: 287036 - RNA, 64 nt, hsa
aggccccggaggagcugggccagccgcccacccccacccccagugcagggcuggucuuggggag

SEQ ID NO: 287037 - RNA, 64 nt, hsa
uaaguuagacucuuccccucccucccacacuucccacccccaggcaaggcugacuucucugaau

SEQ ID NO: 287038 - RNA, 64 nt, hsa
ccucugccauguuuuuccccugcuccccugagaccacccccaaacacaaaacauucauguaacu

SEQ ID NO: 287039 - RNA, 64 nt, hsa
aaacaaaggugccaugaugggcuguucuaacccccacccccacugccagguaagggugucaggg

SEQ ID NO: 287040 - RNA, 64 nt, hsa
aguccuuaucaccagccucacaaucccacaggcccacccccagugggccuguggcauucauauu

SEQ ID NO: 287041 - RNA, 64 nt, hsa
gaaaagacuagaaaggacauugcuuucucagccccacccccagguccacaguguccaagguaau

SEQ ID NO: 287042 - RNA, 64 nt, hsa
guuuuuccccacaccucugaacucagggccuagccacccccaaacuuccaaaucccacuuuugu

SEQ ID NO: 287043 - RNA, 64 nt, hsa
uuuccagcccuuuuaugccugugugaucccaccccacccccauaguuguauaaaggucauagug

SEQ ID NO: 287044 - RNA, 64 nt, hsa
cauucaagccccuucuccacuguagcaaaauaagcacccccaccccaucugccuucaggucuuc

SEQ ID NO: 287045 - RNA, 64 nt, hsa
gggccccuggccucgggagcggccccuggcuaugcacccccaccauuccuacacaucuugccag

SEQ ID NO: 287046 - RNA, 64 nt, hsa
agcagggccgcgcccuuggugaccucaggcaaagcacccccaaacuuaccucagggggugccuc

SEQ ID NO: 287047 - RNA, 64 nt, hsa
cuucugaccaacacacacacgaccccucccccaacacccccaaauucaagaguggauguggccc

SEQ ID NO: 287048 - RNA, 64 nt, hsa
ucugaagcaaagaggccaaagauuggaaaccccccacccccaccucuuuccagaacugcuugaa

SEQ ID NO: 287049 - RNA, 64 nt, hsa
auuacuugauuuaucuucucaggacucauuguuccacccccaaccaauuugaaugccuacaaua

SEQ ID NO: 287050 - RNA, 64 nt, hsa
uagcacacaucugcugacucuccuucaacauccucacccccaccccugggcaccauuuaggaca

SEQ ID NO: 287051 - RNA, 64 nt, hsa
cuagaggugagcucagaaaccuacuguuaaccaacacccccaagugacugacacagguggucua

SEQ ID NO: 287052 - RNA, 64 nt, hsa
ccccuggggaccccaaggccccagcuucccucugcacccccagccuaucccagaggccuugcag

SEQ ID NO: 287053 - RNA, 64 nt, hsa
ugccacaaauaagcaucgagcaccuccccauucacacccccauuccuccuggcuccuuaucccc

SEQ ID NO: 287054 - RNA, 64 nt, hsa
auaagcugcaguaauuugcucuuugaaugaccgucacccccaguauaggauaugcuuguauccc

SEQ ID NO: 287055 - RNA, 64 nt, hsa
ggccaccucgugggggacaagucucgccagcgcccacccccauggcucgggucaguccucaucg

SEQ ID NO: 287056 - RNA, 64 nt, hsa
ccgcuucagugggccuugcccuuuguacagccuccacccccauuaaaacugcucuggacuugcu

SEQ ID NO: 287057 - RNA, 64 nt, hsa
gaggccugaugccguuucugcuuucugcugagaccacccccacccugacaccaucagucccccu

SEQ ID NO: 287058 - RNA, 64 nt, hsa
ccauccuaggcugggcuggccccacccucacccccacccccagggugcccugaggccccaggca

SEQ ID NO: 287059 - RNA, 64 nt, hsa
ugcugaccauccuaggcugggcuggccccacccucacccccacccccagggugcccugaggccc

SEQ ID NO: 287060 - RNA, 64 nt, hsa
cuuccucugagggccccaccucaccccuuggugucacccccaccacgccuaggcagcucugggc

SEQ ID NO: 287061 - RNA, 64 nt, hsa
gggcacccuccugggagcaggccuuccucccucccacccccaauguccuguugguaggaggugg

SEQ ID NO: 287062 - RNA, 64 nt, hsa
ccaccccaggacgagccaucagggacagaccccccacccccaaggcugcagccacaccauguuu

SEQ ID NO: 287063 - RNA, 64 nt, hsa
agggagcgagcccagaacggaccggacgccugugcacccccagcccugccccuuggccgcagag

SEQ ID NO: 287064 - RNA, 64 nt, hsa
agcuugacccuggaaauucugggccaucccccuccacccccacccugaggcucccccugcaggu

SEQ ID NO: 287065 - RNA, 64 nt, hsa
ugcccugcucuggagggagggccaggagcugccacacccccaaguccucucagggcccacccuc

SEQ ID NO: 287066 - RNA, 64 nt, hsa
gcuagccccugccccaauccugcccuggccugaacacccccagggacagagcuggucucugggc

SEQ ID NO: 287067 - RNA, 64 nt, hsa
accuguuauccucuucuuucacccuaucucuucccacccccagcuucccuuugccccacaaagu

SEQ ID NO: 287068 - RNA, 64 nt, hsa
gcuuccccacccccuccucaggcuccugcgagcacacccccacccccaaaucccucccuguucu

SEQ ID NO: 287069 - RNA, 64 nt, hsa
ccacccccuccucaggcuccugcgagcacacccccacccccaaaucccucccuguucuacacug

SEQ ID NO: 287070 - RNA, 64 nt, hsa
ccugcacacggggccgcugggcaggugccccucacacccccaggaugucagugcucaccucgag

SEQ ID NO: 287071 - RNA, 64 nt, hsa
agagugacgccacagcccaucccggugacaugcucacccccaacccccguguccgggaccccgg

SEQ ID NO: 287072 - RNA, 64 nt, hsa
uuuuuaucguagcaccaaagaaaugaaaacagaucacccccaaagccaagcaagugauugggua

SEQ ID NO: 287073 - RNA, 64 nt, hsa
aaacuguaccaguucugaagaccguuuucugccacacccccacccccagcugaccagggaggca

SEQ ID NO: 287074 - RNA, 64 nt, hsa
uaccaguucugaagaccguuuucugccacacccccacccccagcugaccagggaggcagaggac

SEQ ID NO: 287075 - RNA, 64 nt, hsa
caacugcgucuucucucagcccuccacacacacucacccccacucccacacacauacacacaca

SEQ ID NO: 287076 - RNA, 55 nt, hsa
auuccaauucugugaauuagcaccccacccccauaccccuucuuccacccccaga

SEQ ID NO: 287077 - RNA, 64 nt, hsa
gugaauuagcaccccacccccauaccccuucuuccacccccagacuaaaggaagauacuuacuc

SEQ ID NO: 287078 - RNA, 64 nt, hsa
uguguuucagaccuacaagaugggguacuaacaccacccccaccgcccccaccaccacccccag

SEQ ID NO: 287079 - RNA, 64 nt, hsa
gggguacuaacaccacccccaccgcccccaccaccacccccagcuccugaggugcuggccagug

SEQ ID NO: 287080 - RNA, 64 nt, hsa
ccaccacccccagcuccugaggugcuggccagugcacccccacucccacccucaaccgcggccc

SEQ ID NO: 287081 - RNA, 64 nt, hsa
ccccccgaccuccacccccucagacuccaucccccacccccaggagccuggcugucucuagcga

SEQ ID NO: 287082 - RNA, 64 nt, hsa
uucuuucaaaagaccccaccgacagaccgcauuccacccccaacaucggcacugagggacaucg

SEQ ID NO: 287083 - RNA, 64 nt, hsa
ccccaaguguccuggacccuggccuaaagaaucccacccccacuucaugcccacugccgaugcc

SEQ ID NO: 287084 - RNA, 64 nt, hsa
cuugacuggcucaagaauuagggccccaacuacacacccccaagccacagggaagcauguacug

SEQ ID NO: 287085 - RNA, 64 nt, hsa
gugugaugugugugaugcaccagagcacccccuccacccccaccuugggugugugugcgugguc

SEQ ID NO: 287086 - RNA, 64 nt, hsa
ccaggcucacucccaaaacagacccaggcagccccacccccacggcagacccuggugucccugg

SEQ ID NO: 287087 - RNA, 64 nt, hsa
aggaguucucuuccgcagccccuuuccccacgcccacccccagucuccagggacccuugccugc

SEQ ID NO: 287088 - RNA, 64 nt, hsa
uuccuguccuaaaaauaggggccguuuucuuacacacccccagagagaggagggacugucacac

SEQ ID NO: 287089 - RNA, 64 nt, hsa
ccgagcugcccccacccccggccucagccaccagcacccccauagggcccccagacaccacaca

SEQ ID NO: 287090 - RNA, 64 nt, hsa
ggcccgaguuccuccauuucccuggccugccccccacccccaaccugucccacccccgugcccc

SEQ ID NO: 287091 - RNA, 64 nt, hsa
gacgggccuacaggggggucuccccucaccccugcacccccagcugggggagcuggcucugccc

SEQ ID NO: 287092 - RNA, 64 nt, hsa
acucaccucuugguuagcgggagugugcugcccccacccccacccccgcacccccauucuacac

SEQ ID NO: 287093 - RNA, 64 nt, hsa
uagcgggagugugcugcccccacccccacccccgcacccccauucuacacaaggcagaagaggc

SEQ ID NO: 287094 - RNA, 64 nt, hsa
augccacuacucaccaguguuguucaccaacacccacccccacacacaccaacauuuugcugcc

SEQ ID NO: 287095 - RNA, 64 nt, hsa
ccagucuugggaggagcgcgcugcuuuggugagacacccccaugcaagguccucagaguagccg

SEQ ID NO: 287096 - RNA, 64 nt, hsa
agaaacagcugcuucuccccccaucccagggucccacccccaacccccagagguggcccuuguu

SEQ ID NO: 287097 - RNA, 64 nt, hsa
acauuccagccaggcccaggccagcccccccacccacccccaggccuccuaggggaagggggug

SEQ ID NO: 287098 - RNA, 64 nt, hsa
gggcccugcaaacacaaccaucuacacacaucuacacccccaagcacacacacaugguccgugc

SEQ ID NO: 287099 - RNA, 64 nt, hsa
uggggaacuuaucgacaaugcaagcuccugggcccacccccagaccuccugaaccaaaagcucc

SEQ ID NO: 287100 - RNA, 64 nt, hsa
gaucacaaagccaaccaugcccagccccucccagcacccccagccccacgaccaucguucugaa

SEQ ID NO: 287101 - RNA, 64 nt, hsa
augaagaaacuaacaagaaagcagggggaccugccacccccagccaaacccgagcaagggucgu

SEQ ID NO: 287102 - RNA, 64 nt, hsa
gcacaagaagacagaaaccuguaagcucugaccccacccccaccccuugagaggucagcggacc

SEQ ID NO: 287103 - RNA, 64 nt, hsa
uugccagaggcaaacagccuuccaauugccccuccacccccagcugaggcccggucaccugguc

SEQ ID NO: 287104 - RNA, 64 nt, hsa
aggagggcuaaggcuuuagcauugugaagcgcugcacccccaccaaccuuacccucaccgggga

SEQ ID NO: 287105 - RNA, 64 nt, hsa
guuagggcgccggagcccgggccuggaacgcccucacccccaaccuccagucuccgcguuuugc

SEQ ID NO: 287106 - RNA, 64 nt, hsa
cgccccccuguccccagcccccagagcgcagggacacccccauccuaccccggcgccgggcgcg

SEQ ID NO: 287107 - RNA, 64 nt, hsa
ggagcugggcucuaucccacacccacccccaccccacccccacccagccuccagaagcuggaac

SEQ ID NO: 287108 - RNA, 64 nt, hsa
agaggcuuggaggagcugggcucuaucccacacccacccccaccccacccccacccagccucca

SEQ ID NO: 287109 - RNA, 64 nt, hsa
guggagagccgcaugucacugucagagaugagcccacccccacccuucccugggggcgauuagc

SEQ ID NO: 287110 - RNA, 64 nt, hsa
ccuacgugagucacccaugaaauccagacauucucacccccagcggaugcacaggagccacuca

SEQ ID NO: 287111 - RNA, 64 nt, hsa
cgcccccggccguccccccucaucgccccgcgcccacccccaucgccccugcccccggcggcgg

SEQ ID NO: 287112 - RNA, 64 nt, hsa
cccaccguggccccccacgccccauuaacccccacacccccauuccgcgcaauaaacgacagca

SEQ ID NO: 287113 - RNA, 64 nt, hsa
cagggccgcugugagcaaagcugaccccagcccccacccccaguuaacacugcugcuucucuga

SEQ ID NO: 287114 - RNA, 64 nt, hsa
caaggugcgcaacauggcugccagccccgccucccacccccaccccgaguccugagcucacuuu

SEQ ID NO: 287115 - RNA, 64 nt, hsa
uuagcccccagccggccugagugggggauauugacacccccagcuaaagcacaagcaccuuagu

SEQ ID NO: 287116 - RNA, 64 nt, hsa
gugggggggccagcuccugggccuggggucuucucacccccacccccuuguccuggguaggccc

SEQ ID NO: 287117 - RNA, 64 nt, hsa
uuuucucucccuccagagcucccacgagcugaugcacccccaggcuucaaaccaccuggaaugc

SEQ ID NO: 287118 - RNA, 64 nt, hsa
augugcuuugccgggaggagcggcggccgcagcccacccccacugcuguucgaaucaagcagga

SEQ ID NO: 287119 - RNA, 52 nt, hsa
augaggaccagcuuagcugacacacccccagcuggcccuccacccccaccuc

SEQ ID NO: 287120 - RNA, 64 nt, hsa
accagcuuagcugacacacccccagcuggcccuccacccccaccucaagugccuuauucucaca

SEQ ID NO: 287121 - RNA, 64 nt, hsa
caggcucucuccccugcucucccaccucuaccuccacccccaccggccugacgcuguggccccg

SEQ ID NO: 287122 - RNA, 64 nt, hsa
aaugggggugcaugcugggccuggcccccuggcccacccccacuuuccagggcaaaaagggccc

SEQ ID NO: 287123 - RNA, 55 nt, hsa
ccagcgggcgcaggaagugacuucccacccccaggaccugacacaucucgucucc

SEQ ID NO: 287124 - RNA, 64 nt, hsa
cccuauagccauaucucggccccuucccacucaccacccccaccccaggugcugggggucccuu

SEQ ID NO: 287125 - RNA, 64 nt, hsa
gaaggagaggaaugggggagaggacgugagggaccacccccacccacacagcugccgcagcauc

SEQ ID NO: 287126 - RNA, 64 nt, hsa
gccaucucaguauugccugugggggccaccccuccacccccacccccaagugccuucgcucugu

SEQ ID NO: 287127 - RNA, 64 nt, hsa
ucaguauugccugugggggccaccccuccacccccacccccaagugccuucgcucuguuuuuau

SEQ ID NO: 287128 - RNA, 64 nt, hsa
cauagcucugacccuggaaugggguugguuuggacacccccagggaucugagcccugacccuuu

SEQ ID NO: 287129 - RNA, 64 nt, hsa
agcccugacccuuugugacugcugaccccugagccacccccacucccacagggagccccggcca

SEQ ID NO: 287130 - RNA, 64 nt, hsa
agcugcucacuuuugccggguuugguggccacuucacccccaacccugucucacccccauuauc

SEQ ID NO: 287131 - RNA, 64 nt, hsa
ggguuugguggccacuucacccccaacccugucucacccccauuaucccuccucaauuggaggc

SEQ ID NO: 287132 - RNA, 64 nt, hsa
cccauuccucaucccucacucccacccccacccccacccccaggaguugagugcauggaucugu

SEQ ID NO: 287133 - RNA, 64 nt, hsa
uucccacccauuccucaucccucacucccacccccacccccacccccaggaguugagugcaugg

SEQ ID NO: 287134 - RNA, 64 nt, hsa
ccuugcuucccacccauuccucaucccucacucccacccccacccccacccccaggaguugagu

SEQ ID NO: 287135 - RNA, 64 nt, hsa
cacaccccccccccaccgaggccuaggccccugccacccccaagacugggaggggacuucuuuu

SEQ ID NO: 287136 - RNA, 64 nt, hsa
uuuuucggcuaaaaagaaugcagagaugugcccccacccccacccucgaccacccccgauggga

SEQ ID NO: 287137 - RNA, 64 nt, hsa
agaggggcucacgcuuaacuccagcccccacccacacccccaucccacccaaccacaggcccca

SEQ ID NO: 287138 - RNA, 64 nt, hsa
gccagagggccccagaguuccuugcaucuaauuucacccccaccccacccuccaggguuagggg

SEQ ID NO: 287139 - RNA, 64 nt, hsa
gccaggagugucucuaagagauccaggagggagccacccccaaggacccugccagccacagacc

SEQ ID NO: 287140 - RNA, 64 nt, hsa
caccaggagggcagacccagccacauaccacaaccacccccaagccucacacucccuugucuuu

SEQ ID NO: 287141 - RNA, 64 nt, hsa
ugcauccccucugggggcaggagcccacccccagcacccccaucuguuaauaaauaucucaacu

SEQ ID NO: 287142 - RNA, 64 nt, hsa
gcauccaccugcauccccucugggggcaggagcccacccccagcacccccaucuguuaauaaau

SEQ ID NO: 287143 - RNA, 64 nt, hsa
ggcccacuccaguuccagaccacccuccaugcuccacccccaggcgguuuggaccccaccacug

SEQ ID NO: 287144 - RNA, 64 nt, hsa
uaacagggcacaccccucuaguuucaugggcgagcacccccaucugccaccucagacugacaca

SEQ ID NO: 287145 - RNA, 64 nt, hsa
gcacagaagucgcaggcagccucucagaaaguuucacccccagaggacgaagaggucaagaacc

SEQ ID NO: 287146 - RNA, 64 nt, hsa
uugaaccccaguacugacagccuccuuaaaguuucacccccagagggagccgagacucggaaag

SEQ ID NO: 287147 - RNA, 64 nt, hsa
ccaggaggcuggugccagggagacaggcccaacccacccccauuugcacugagaagagaaguuu

SEQ ID NO: 287148 - RNA, 64 nt, hsa
cccacgauggcccccauugcccucaucacccugacacccccacauucucuccucuggaccccca

SEQ ID NO: 287149 - RNA, 64 nt, hsa
cuugcccaguagaauggacugaucuaugugcacacacccccaucacauggaaugggcuggucua

SEQ ID NO: 287150 - RNA, 64 nt, hsa
aucuugagagcccuaauacuaaaagaugggcacccacccccaccaagggaagacugccccauuc

SEQ ID NO: 287151 - RNA, 64 nt, hsa
gcgcuuggcgcuccuccuccguccuaucccaacucacccccaaacccccaucccuuccccaccu

SEQ ID NO: 287152 - RNA, 64 nt, hsa
ucaggccuuaggucuggccauucacacacacacacacccccacaccccacucccacacacaguu

SEQ ID NO: 287153 - RNA, 64 nt, hsa
aagggagaagaaauccauaacacccccaccccaacacccccaagacagcagucuucuucacccg

SEQ ID NO: 287154 - RNA, 64 nt, hsa
uguugcagagacgcaagggagaagaaauccauaacacccccaccccaacacccccaagacagca

SEQ ID NO: 287155 - RNA, 64 nt, hsa
ccuuuacccaggaaaucuccggagccaacaccaccacccccagggggucuccccaccccacccc

SEQ ID NO: 287156 - RNA, 64 nt, hsa
cuccccagguguauuucagcagaccccggggacccacccccacugggccugcuggccucccucg

SEQ ID NO: 287157 - RNA, 64 nt, hsa
gcucaggccacagccggagccuccgcauugcccccacccccauuuuccagggggguuguaauuu

SEQ ID NO: 287158 - RNA, 64 nt, hsa
uguguguguguguguguguguggugcaggagugccacccccagggcccugucaaccucucuuuu

SEQ ID NO: 287159 - RNA, 64 nt, hsa
ggaggccccgcugaaaccugggcugcccuucccccacccccacggcucuccugguugaggaggg

SEQ ID NO: 287160 - RNA, 64 nt, hsa
ccuccccaggcccaacucugcuagcuucccagaccacccccaucgagugcggagagagugggag

SEQ ID NO: 287161 - RNA, 64 nt, hsa
uauuccucuguccuaaaccguccccuccuucccucacccccagcacagggggauucugagcagu

SEQ ID NO: 287162 - RNA, 64 nt, hsa
ugcaggugccagggcccaccccagccucgccugucacccccacucccgccucagggccaggccc

SEQ ID NO: 287163 - RNA, 64 nt, hsa
ugauuuucuguuacacuguauaguaguccuauggcacccccaccccaucccuuucgugccacuc

SEQ ID NO: 287164 - RNA, 64 nt, hsa
ccccaccccaucccuuucgugccacucccguccccacccccaccccaguguguauaagcuggca

SEQ ID NO: 287165 - RNA, 64 nt, hsa
agagcugcuggggauucuggccuagucccuuccacacccccaccccuugcucucaacccaggag

SEQ ID NO: 287166 - RNA, 64 nt, hsa
uuggggcaggaugauuuuggccucauuacuuuaccacccccacaccuggaaagcauauacuaua

SEQ ID NO: 287167 - RNA, 64 nt, hsa
uagccgagcugguccuaggccccgccuagugccccacccccacccacagugcugcacuccuccu

SEQ ID NO: 287168 - RNA, 64 nt, hsa
uggccugcucaggcuucccacccugugcggggcacacccccaggaagggacccuggacacggcu

SEQ ID NO: 287169 - RNA, 64 nt, hsa
ccccauguccucccugccuugggacccguccucucacccccagcaguugccaugggguuuccuu

SEQ ID NO: 287170 - RNA, 64 nt, hsa
ccggccaccagggggcuccuacucccacccccaccacccccagucaccauugucaccacacuca

SEQ ID NO: 287171 - RNA, 64 nt, hsa
cccuggaucccggccaccagggggcuccuacucccacccccaccacccccagucaccauuguca

SEQ ID NO: 287172 - RNA, 64 nt, hsa
cuuguuccccacccccacccccacucccgccccgcacccccaaguugggacgccuuguuuagcu

SEQ ID NO: 287173 - RNA, 64 nt, hsa
cggccugcgcucguccacccuuguuccccacccccacccccacucccgccccgcacccccaagu

SEQ ID NO: 287174 - RNA, 64 nt, hsa
gagcaccggccugcgcucguccacccuuguuccccacccccacccccacucccgccccgcaccc

SEQ ID NO: 287175 - RNA, 64 nt, hsa
ggguguggcgcauggcgcugggguuggaauggggcacccccaagucuguccccaggcucugccc

SEQ ID NO: 287176 - RNA, 64 nt, hsa
ccaggcugagugccugggucagccaaaccccuggcacccccagggugacggguggcgagcuguu

SEQ ID NO: 287177 - RNA, 64 nt, hsa
uccuuggauugucaacccccaucccccaaauggaaauuccgaaggaggccuccucgcaccugcc

SEQ ID NO: 287178 - RNA, 64 nt, hsa
cgcaaggacaaugaauccacucacauugcagaacaauuccgaaaauggcaaacuacuacuacua

SEQ ID NO: 287179 - RNA, 64 nt, hsa
uuaguauuaaaccuuuuuuaugccauuucauaagaauuccgauauauacuugaugauugccaag

SEQ ID NO: 287180 - RNA, 64 nt, hsa
gcuccacaugcuguaccuggaucauucugaagcaaauuccgagcauuacaucauuuuguccaua

SEQ ID NO: 287181 - RNA, 64 nt, hsa
cuuauucauuuugcaugguuuuaaaauuaaaaauaauuccgaagauacaccagcucacaaauga

SEQ ID NO: 287182 - RNA, 64 nt, hsa
aauggucuugucaccuuucaacuucgaggacuggaauuccgaggaaccuacugccagcagaggg

SEQ ID NO: 287183 - RNA, 64 nt, hsa
ugaggaccccuggggcccccaucggagcccugcaaauuccgagaaaugugaaacuugguggggu

SEQ ID NO: 287184 - RNA, 64 nt, hsa
caagcacuggccuccccuggcuccugccuggaagaauuccgagccagcccauuucuagaauguc

SEQ ID NO: 287185 - RNA, 64 nt, hsa
acaggaguauuaguacauaaauuuucuacucaacaauuccgagauaggauuaugccuaguuugu

SEQ ID NO: 287186 - RNA, 64 nt, hsa
ucaccuuccaagucucccucaaagaagaaaaagaaauuccgaacccccuccuuccugaaaaaga

SEQ ID NO: 287187 - RNA, 64 nt, hsa
ucugaugccugaagagaggccuaguuuaaaucacaauuccgaaucuggggcaauggaaucacug

SEQ ID NO: 287188 - RNA, 64 nt, hsa
gcaaggggacucugggaggaguuuuccagaaugcaauuccgagugagcaaaucgcauagcugua

SEQ ID NO: 287189 - RNA, 64 nt, hsa
uggcugccuucucuggaaacaaggaaaacccaauaauuccgaggaacauuggggguuaaauacc

SEQ ID NO: 287190 - RNA, 64 nt, hsa
aggagaaucaucuucaugccugaaaauuuagcaaaauuccgacuauggccuccaggggcaauuc

SEQ ID NO: 287191 - RNA, 64 nt, hsa
guuccauaaaauuggagaacugcugaaggucaguaauuccgacuuucucagcaguggugucucu

SEQ ID NO: 287192 - RNA, 64 nt, hsa
acugugccuguuuccucauuugcaacaagaggauaauuccgaccuaccucugaaaaauguguag

SEQ ID NO: 287193 - RNA, 64 nt, hsa
cugcagcccccucggggacgcccccaccagcucaaauuccgagugcagaaaagaaaccggaccc

SEQ ID NO: 287194 - RNA, 64 nt, hsa
cucugccccagauagguggugccaguggcuuauuaauuccgauacuaguuugcuuugcugacca

SEQ ID NO: 287195 - RNA, 64 nt, hsa
cguagaauucucuacacaccaguaacgggauuucaauuccgauggacucugccgcccuggcggc

SEQ ID NO: 287196 - RNA, 64 nt, hsa
gugcucucuuucaggugggaugugugugggcugaaauuccgagcugcgguugugcaugagaaua

SEQ ID NO: 287197 - RNA, 64 nt, hsa
gccuuuugguacaguguuuucaucucuuggucauaauuccgagauccccagagaccacuguuuc

SEQ ID NO: 287198 - RNA, 64 nt, hsa
aucacgcucuguuccuugcuuuugccuucaagggaauuccgaguguccagcacugccguauugc

SEQ ID NO: 287199 - RNA, 64 nt, hsa
ccucucuucuugcacuguccccaaacuugcugucaauuccgagaucuaaucucccccuacgcuc

SEQ ID NO: 287200 - RNA, 64 nt, hsa
aauugugaaccgcuaacauugaagaaauuuugacaauuccgauuugaugcugcaauuacuugcu

SEQ ID NO: 287201 - RNA, 64 nt, hsa
augaacucuucucaacucuguuuugcuaugcuauaauuccgaaacauacaagacaaaaaaaaug

SEQ ID NO: 287202 - RNA, 64 nt, hsa
gaauggcucagaagccgcgucccuuacuuaacacaauuccgaaucucccucauccaugaugcgu

SEQ ID NO: 287203 - RNA, 64 nt, hsa
uaggccucauauuuacacuauauguucgcuuuauaauuccgaaguuguuauuugcuaaaucucc

SEQ ID NO: 287204 - RNA, 64 nt, hsa
ugagcaaauuaggugacuuguuuuaaaaauauuuaauuccgauuuggaaccuuagaugucuauu

SEQ ID NO: 287205 - RNA, 64 nt, hsa
aaaaguaggauguagguauuuauuguguucuagaaauuccgacucuuuucauuagauauaugcu

SEQ ID NO: 287206 - RNA, 64 nt, hsa
ccuguggugugguuuaaaaaucuauaggccugggaauuccgauccuagcugcagaucgcauccc

SEQ ID NO: 287207 - RNA, 64 nt, hsa
cagagcucaagaagggggcuuccaaugcugugagaauuccgagcuguucccugggcucuguuaa

SEQ ID NO: 287208 - RNA, 64 nt, hsa
uuuaaagucaauacgauggaaaucaauaaaucugaauuccgaacauguuguguggaauacucuu

SEQ ID NO: 287209 - RNA, 64 nt, hsa
agcugccuuucugacuuggccgccguguccaacaaauuccgagaccucuugcagguaagcccca

SEQ ID NO: 287210 - RNA, 64 nt, hsa
aaaagugcuaaaguuuucuucccagagagagcauaauuccgaaacaaaacugugacaaucuuuu

SEQ ID NO: 287211 - RNA, 64 nt, hsa
ugaucgugacaagaaauaccuuaggccuucagucaauuccgaagcuccuucaguuguuuuuaua

SEQ ID NO: 287212 - RNA, 64 nt, hsa
agugugguccagcagcagggaggaguucugcccaaauuccgauaucaccccuucccccauccaa

SEQ ID NO: 287213 - RNA, 64 nt, hsa
gguuaguauuuaacuacaucugccucggcucacaaauuccgauuagaccuuuauccagcuagug

SEQ ID NO: 287214 - RNA, 64 nt, hsa
augacacuuggaagaaaaauguaugaaauucagaaauuccgaucaaagaaaaguaauucuuucu

SEQ ID NO: 287215 - RNA, 64 nt, hsa
uauauucuacuccuguaaggaaaaugguauuuggaauuccgaauugacagguuaucuggaacaa

SEQ ID NO: 287216 - RNA, 64 nt, hsa
aacagcauuaacugucuuaaagagagagagagagaauuccgaauuggggaacacacgauaccug

SEQ ID NO: 287217 - RNA, 64 nt, hsa
uuguugguguguuuguuuuuuuccagggaggucuaauuccgaagcaguauuccagguuuucucu

SEQ ID NO: 287218 - RNA, 64 nt, hsa
uuucuuuuuuccccuuucuuguaauaaaugauaaaauuccgagucuuucucacugccuuuguuu

SEQ ID NO: 287219 - RNA, 64 nt, hsa
gugcacaccaacacugagacgccuucccaugaaaaauuccgaagaugcucaagagggagguuuc

SEQ ID NO: 287220 - RNA, 64 nt, hsa
uaaaucuagaggguuguuuugucuuagccacaagaauuccgaggucuugacccugaugaucaac

SEQ ID NO: 287221 - RNA, 64 nt, hsa; identical to SEQ ID NO: 130118

SEQ ID NO: 287222 - RNA, 64 nt, hsa; identical to SEQ ID NO: 130119

SEQ ID NO: 287223 - RNA, 64 nt, hsa; identical to SEQ ID NO: 130120

SEQ ID NO: 287224 - RNA, 64 nt, hsa; identical to SEQ ID NO: 130121

SEQ ID NO: 287225 - RNA, 64 nt, hsa; identical to SEQ ID NO: 130122

SEQ ID NO: 287226 - RNA, 64 nt, hsa; identical to SEQ ID NO: 130123

SEQ ID NO: 287227 - RNA, 64 nt, hsa; identical to SEQ ID NO: 130124

SEQ ID NO: 287228 - RNA, 64 nt, hsa; identical to SEQ ID NO: 130125

SEQ ID NO: 287229 - RNA, 64 nt, hsa; identical to SEQ ID NO: 130126

SEQ ID NO: 287230 - RNA, 64 nt, hsa; identical to SEQ ID NO: 130127

SEQ ID NO: 287231 - RNA, 64 nt, hsa; identical to SEQ ID NO: 130128

SEQ ID NO: 287232 - RNA, 64 nt, hsa; identical to SEQ ID NO: 130129

SEQ ID NO: 287233 - RNA, 64 nt, hsa; identical to SEQ ID NO: 130130

SEQ ID NO: 287234 - RNA, 64 nt, hsa; identical to SEQ ID NO: 130131

SEQ ID NO: 287235 - RNA, 64 nt, hsa; identical to SEQ ID NO: 130132

SEQ ID NO: 287236 - RNA, 64 nt, hsa; identical to SEQ ID NO: 130133

SEQ ID NO: 287237 - RNA, 64 nt, hsa; identical to SEQ ID NO: 130134

SEQ ID NO: 287238 - RNA, 64 nt, hsa; identical to SEQ ID NO: 130135

SEQ ID NO: 287239 - RNA, 64 nt, hsa; identical to SEQ ID NO: 130136

SEQ ID NO: 287240 - RNA, 64 nt, hsa; identical to SEQ ID NO: 130137

SEQ ID NO: 287241 - RNA, 64 nt, hsa; identical to SEQ ID NO: 130138

SEQ ID NO: 287242 - RNA, 64 nt, hsa; identical to SEQ ID NO: 130139

SEQ ID NO: 287243 - RNA, 64 nt, hsa; identical to SEQ ID NO: 130140

SEQ ID NO: 287244 - RNA, 64 nt, hsa; identical to SEQ ID NO: 130141

SEQ ID NO: 287245 - RNA, 64 nt, hsa; identical to SEQ ID NO: 130142

SEQ ID NO: 287246 - RNA, 64 nt, hsa; identical to SEQ ID NO: 130143

SEQ ID NO: 287247 - RNA, 64 nt, hsa; identical to SEQ ID NO: 130144

SEQ ID NO: 287248 - RNA, 64 nt, hsa; identical to SEQ ID NO: 130145

SEQ ID NO: 287249 - RNA, 64 nt, hsa; identical to SEQ ID NO: 130146

SEQ ID NO: 287250 - RNA, 64 nt, hsa; identical to SEQ ID NO: 130147

SEQ ID NO: 287251 - RNA, 64 nt, hsa; identical to SEQ ID NO: 130148

SEQ ID NO: 287252 - RNA, 64 nt, hsa; identical to SEQ ID NO: 130149

SEQ ID NO: 287253 - RNA, 64 nt, hsa; identical to SEQ ID NO: 130150

SEQ ID NO: 287254 - RNA, 64 nt, hsa; identical to SEQ ID NO: 130151

SEQ ID NO: 287255 - RNA, 64 nt, hsa; identical to SEQ ID NO: 130152

SEQ ID NO: 287256 - RNA, 64 nt, hsa; identical to SEQ ID NO: 130153

SEQ ID NO: 287257 - RNA, 64 nt, hsa; identical to SEQ ID NO: 130154

SEQ ID NO: 287258 - RNA, 64 nt, hsa; identical to SEQ ID NO: 130155

SEQ ID NO: 287259 - RNA, 64 nt, hsa; identical to SEQ ID NO: 130156

SEQ ID NO: 287260 - RNA, 64 nt, hsa; identical to SEQ ID NO: 130157

SEQ ID NO: 287261 - RNA, 64 nt, hsa; identical to SEQ ID NO: 130158

SEQ ID NO: 287262 - RNA, 64 nt, hsa; identical to SEQ ID NO: 130159

SEQ ID NO: 287263 - RNA, 64 nt, hsa; identical to SEQ ID NO: 130160

SEQ ID NO: 287264 - RNA, 64 nt, hsa; identical to SEQ ID NO: 130161

SEQ ID NO: 287265 - RNA, 64 nt, hsa; identical to SEQ ID NO: 130162

SEQ ID NO: 287266 - RNA, 64 nt, hsa; identical to SEQ ID NO: 130163

SEQ ID NO: 287267 - RNA, 64 nt, hsa; identical to SEQ ID NO: 130164

SEQ ID NO: 287268 - RNA, 64 nt, hsa; identical to SEQ ID NO: 130165

SEQ ID NO: 287269 - RNA, 64 nt, hsa; identical to SEQ ID NO: 130166

SEQ ID NO: 287270 - RNA, 64 nt, hsa; identical to SEQ ID NO: 130167

SEQ ID NO: 287271 - RNA, 64 nt, hsa; identical to SEQ ID NO: 130168

SEQ ID NO: 287272 - RNA, 64 nt, hsa; identical to SEQ ID NO: 130169

SEQ ID NO: 287273 - RNA, 64 nt, hsa; identical to SEQ ID NO: 130170

SEQ ID NO: 287274 - RNA, 64 nt, hsa; identical to SEQ ID NO: 130171

SEQ ID NO: 287275 - RNA, 64 nt, hsa; identical to SEQ ID NO: 130172

SEQ ID NO: 287276 - RNA, 64 nt, hsa; identical to SEQ ID NO: 130173

SEQ ID NO: 287277 - RNA, 64 nt, hsa; identical to SEQ ID NO: 130174

SEQ ID NO: 287278 - RNA, 64 nt, hsa; identical to SEQ ID NO: 130175

SEQ ID NO: 287279 - RNA, 64 nt, hsa; identical to SEQ ID NO: 130176

SEQ ID NO: 287280 - RNA, 64 nt, hsa; identical to SEQ ID NO: 130177

SEQ ID NO: 287281 - RNA, 64 nt, hsa; identical to SEQ ID NO: 130178

SEQ ID NO: 287282 - RNA, 64 nt, hsa; identical to SEQ ID NO: 130179

SEQ ID NO: 287283 - RNA, 64 nt, hsa; identical to SEQ ID NO: 130180

SEQ ID NO: 287284 - RNA, 64 nt, hsa; identical to SEQ ID NO: 130181

SEQ ID NO: 287285 - RNA, 64 nt, hsa; identical to SEQ ID NO: 130182

SEQ ID NO: 287286 - RNA, 64 nt, hsa; identical to SEQ ID NO: 130183

SEQ ID NO: 287287 - RNA, 64 nt, hsa; identical to SEQ ID NO: 130184

SEQ ID NO: 287288 - RNA, 64 nt, hsa; identical to SEQ ID NO: 130185

SEQ ID NO: 287289 - RNA, 64 nt, hsa; identical to SEQ ID NO: 130186

SEQ ID NO: 287290 - RNA, 64 nt, hsa; identical to SEQ ID NO: 130187

SEQ ID NO: 287291 - RNA, 64 nt, hsa; identical to SEQ ID NO: 130188

SEQ ID NO: 287292 - RNA, 64 nt, hsa; identical to SEQ ID NO: 130189

SEQ ID NO: 287293 - RNA, 64 nt, hsa; identical to SEQ ID NO: 130190

SEQ ID NO: 287294 - RNA, 64 nt, hsa; identical to SEQ ID NO: 130191

SEQ ID NO: 287295 - RNA, 64 nt, hsa; identical to SEQ ID NO: 130192

SEQ ID NO: 287296 - RNA, 64 nt, hsa; identical to SEQ ID NO: 130193

SEQ ID NO: 287297 - RNA, 64 nt, hsa; identical to SEQ ID NO: 130194

SEQ ID NO: 287298 - RNA, 64 nt, hsa; identical to SEQ ID NO: 130195

SEQ ID NO: 287299 - RNA, 64 nt, hsa; identical to SEQ ID NO: 130196

SEQ ID NO: 287300 - RNA, 64 nt, hsa
gaaugagugcuaugguguugaaaacugcaguguccguuaugagugccaaaaaucugucuugaag

SEQ ID NO: 287301 - RNA, 64 nt, hsa
acaauuaucccuuacagacuugaacauuugcagacguuaugaucuugcuuccaacucccaccug

SEQ ID NO: 287302 - RNA, 64 nt, hsa
cuuguugcgacagagggacucacuggacucuguucguuaugauuugucuguuuaagagagaaaa

SEQ ID NO: 287303 - RNA, 64 nt, hsa
agcuguugacguuugcucauuuaagaauuugaaacguuaugaugaccuggcaacaaaaaguaau

SEQ ID NO: 287304 - RNA, 64 nt, hsa
auuuuaauuuguauauuuuugugauuuauuuuggcguuaugaguuugacucucggggaguuuug

SEQ ID NO: 287305 - RNA, 64 nt, hsa
cauaaguucagccugucauacuuuuugcauugaucguuaugaauaccagaccauuuguaagugu

SEQ ID NO: 287306 - RNA, 64 nt, hsa
accccaacucaaauuaaauacagauuccuagagacguuaugaugguuacacauguccucggcau

SEQ ID NO: 287307 - RNA, 64 nt, hsa
acuccuauuuacugcuuuuacuaaaccaguacuucguuaugaaaaugccuuccacgcaaauaag

SEQ ID NO: 287308 - RNA, 64 nt, hsa
ggcuucucuucaacucuaauaacagcauuauucacguuaugauuugauaguauuauuauuuaau

SEQ ID NO: 287309 - RNA, 64 nt, hsa
uguucagcccuccuaguuauguuccugaugucuucguuaugaaacuguugauguuugcaucaua

SEQ ID NO: 287310 - RNA, 64 nt, hsa
cuccugucugauagcgguagaugaaaaauaaggucguuaugacuuuggcaacuugcuucauuuc

SEQ ID NO: 287311 - RNA, 64 nt, hsa
uugcuuuguguuacuuuuuugcucuugaauguaucguuaugauggucucuuauaaucaugguau

SEQ ID NO: 287312 - RNA, 64 nt, hsa
gaggcucaguaaaggaauaccgugucuuacccaucguuaugauggaaggcugcuuugaaaaugg

SEQ ID NO: 287313 - RNA, 64 nt, hsa
uggggauaaucaggcacaggucuuuccgccaaugcguuaugaugauuaaagaagguaauuuugu

SEQ ID NO: 287314 - RNA, 64 nt, hsa
aagcaauauagcuuccauucuaaggcuguauucccguuaugaauuacuagcugauuacaguuca

SEQ ID NO: 287315 - RNA, 64 nt, hsa
agauguguuuuuaauguuaaaauauugauuucuacguuaugaaaacagaugcccccgugaaugc

SEQ ID NO: 287316 - RNA, 64 nt, hsa
uaagugauaauuguccuggccucucagccaugaccguuaugaggaaauaucccccauucgaacu

SEQ ID NO: 287317 - RNA, 64 nt, hsa
uucaucugcaggucagagguggagugcaaaauaucguuaugauaaggagugguugaauaauggg

SEQ ID NO: 287318 - RNA, 64 nt, hsa
uguacuugguauuauaaugcauaauugauguuuucguuaugaaaacauuuggugcccagaaguc

SEQ ID NO: 287319 - RNA, 64 nt, hsa
uggagagcagcacauucuuacagaggagauggagcguuaugagcauaguauguggauagguauc

SEQ ID NO: 287320 - RNA, 64 nt, hsa
agagcuaugagauacgcacaauacuugcuguucacguuaugacucucaugcaagcaaaauacac

SEQ ID NO: 287321 - RNA, 64 nt, hsa
cauuuacaacaaauauuaauauuaaaaugcagaccguuaugauuggaaaauaaaucaaugaaca

SEQ ID NO: 287322 - RNA, 64 nt, hsa
uggcagaguggauucuugaacaaacuggaaaguacguuaugauagugucccacggugccuuggg

SEQ ID NO: 287323 - RNA, 64 nt, hsa
ccaaauaugcaaaauuuuaaggcuuuugauacuucguuaugaguguauuuuugagauauuuucc

SEQ ID NO: 287324 - RNA, 64 nt, hsa
cgucugcagugcuuagccuaacuuuuguuuaugucguuaugaagcauucaacugugcucuguga

SEQ ID NO: 287325 - RNA, 64 nt, hsa
augaaucuaugcuggauaagaaaugguggaacugcguuaugaagagcuaauuuacuggacaaag

SEQ ID NO: 287326 - RNA, 64 nt, hsa
aagagaggaacucagaaggcaacaacagcagcuucguuaugaacaagaaaaaaggaauuccuug

SEQ ID NO: 287327 - RNA, 64 nt, hsa
aggacgcuaaauaauaggauugcucauaccagcgcguuaugaacucacccuagcuuguaacgga

SEQ ID NO: 287328 - RNA, 64 nt, hsa
auagcacaaaauuuugaaaacccacuucuguguacguuaugaagcauagaaaauuaaacaguau

SEQ ID NO: 287329 - RNA, 64 nt, hsa
uaaaaugauuuagaccgauuuucagauuuuauuucguuaugauuaaagaugucucauguacuug

SEQ ID NO: 287330 - RNA, 64 nt, hsa
cauccagcaaaucagaaggacucaguacaaacuccguuaugauauauccuagccacaugcaggg

SEQ ID NO: 287331 - RNA, 64 nt, hsa
auggaguccugaguugcucuggggcaggggauuacguuaugaaaacuaaccauguguaacaaua

SEQ ID NO: 287332 - RNA, 64 nt, hsa
gaauuauuggauaaaaaagcuauuuuuauaaauucguuaugaauuggaugaugacuauauugag

SEQ ID NO: 287333 - RNA, 64 nt, hsa
aaagaauaagaugcaucacuaagcccuuugcacucguuaugaccucguaaguaaaaauuaucac

SEQ ID NO: 287334 - RNA, 64 nt, hsa
ggcacccgguuuacagggaggugauugaggacgucguuaugauuugauuugaccuuggcacaca

SEQ ID NO: 287335 - RNA, 64 nt, hsa
auauagggcuguauucaaacaucguguggaacuguacaaauauuuauaccaaaaauauagauaa

SEQ ID NO: 287336 - RNA, 64 nt, hsa
cugaauuuagauaucuuuauuccauuuauuaugguacaaauaacugauguuuuaaccagaguaa

SEQ ID NO: 287337 - RNA, 64 nt, hsa
cucauuuacuugaaauguaaaaacuuucacugaauacaaauagaaaaagugauguguuuuauau

SEQ ID NO: 287338 - RNA, 64 nt, hsa
caguguguuugcuaauuaauaaaaaucaguuucuuacaaauaaaguuuguaagaaaauguucau

SEQ ID NO: 287339 - RNA, 64 nt, hsa
uaagugcucagaccuaugaacguaaucccuuugcuacaaauauuuaagagcagcucagcuuggu

SEQ ID NO: 287340 - RNA, 64 nt, hsa
cuucuaauaaaugaaguaaaaaaauuaaaaagaauacaaauauuccagccccaaaugagaaauc

SEQ ID NO: 287341 - RNA, 64 nt, hsa
uugaaguaaccuuauagguuacucauaaggcauauacaaauaaacuuguuuguuuucuuuuuuc

SEQ ID NO: 287342 - RNA, 64 nt, hsa
aacaagacacccaaguccaggcccaaggaguaaguacaaauauuccuguuucugaaccauuacu

SEQ ID NO: 287343 - RNA, 64 nt, hsa
aaugugaaauuuaaauaauagacauacagagauauacaaauauauuauauauuuuucugagauu

SEQ ID NO: 287344 - RNA, 64 nt, hsa
cagguccuuccuucugcaucucaccaccccuaguuacaaauaacuccauugaacagcaucuauu

SEQ ID NO: 287345 - RNA, 64 nt, hsa
ucuuugauuaacccccauaaggcauguguguguauacaaauauacuucucuuuggcuuuucgac

SEQ ID NO: 287346 - RNA, 64 nt, hsa
gguuuuucccaugacuguauugcuuuuauaaauguacaaauaguuacugaaaugacgagacccu

SEQ ID NO: 287347 - RNA, 64 nt, hsa
augggcacuugagaacuuuccauuuuggcgcuauuacaaauagugcaacuaugaauguacugca

SEQ ID NO: 287348 - RNA, 64 nt, hsa
ggaacaacucuccagugccuggauccccucugucuacaaauauaagauuuucugggccuaaagg

SEQ ID NO: 287349 - RNA, 64 nt, hsa
auaaggauuuuccuagauauugcacgggagaauauacaaauagcaaaauugaggccaagggcca

SEQ ID NO: 287350 - RNA, 64 nt, hsa
guaauuucuugcugguugaaacuuguuuauuauguacaaauagauucuuauaauauuauuuaaa

SEQ ID NO: 287351 - RNA, 64 nt, hsa
aacaacuaccuaauacaaauauuucugauaagacuacaaauaucugacugagcuggggauuaaa

SEQ ID NO: 287352 - RNA, 64 nt, hsa
aagcaauagaauaggaaauaaaacaacuaccuaauacaaauauuucugauaagacuacaaauau

SEQ ID NO: 287353 - RNA, 64 nt, hsa
uugaugaauuucuagguguuugggucacaguuccuacaaauacggaaaaggggguuaaaaagca

SEQ ID NO: 287354 - RNA, 64 nt, hsa
acauauuauugcuauuaccugaacaaaauagaauuacaaauagcacuugauaauuuuaaaguau

SEQ ID NO: 287355 - RNA, 64 nt, hsa
uuacuuugguacaaauaaaaacuguauaucuauauacaaauaauauauagauauauauguccac

SEQ ID NO: 287356 - RNA, 64 nt, hsa
uagaauuaggcaguuggugauaguuuuacuuugguacaaauaaaaacuguauaucuauauacaa

SEQ ID NO: 287357 - RNA, 64 nt, hsa
ugcacaggaaagcauuuauacuucagaaagauuguacaaauacaaggaauguggaaaagccauu

SEQ ID NO: 287358 - RNA, 64 nt, hsa
acaaaaaaagaguauucauugugaggacaaacaauacaaauacgaagaggguuguaguaccuuu

SEQ ID NO: 287359 - RNA, 64 nt, hsa
gggagucaggauguucacuauggaaaaacaaauauacaaauaugaaaugagggaaggcaagaaa

SEQ ID NO: 287360 - RNA, 64 nt, hsa
auuucuaauuuucggcugcuaugaauaaagcugcuacaaauauuuuuguacaagacuuuuugua

SEQ ID NO: 287361 - RNA, 64 nt, hsa
ugaagauuguacacuacauuacaugaucagaucauacaaauaaucuaagauuuuacagucuggu

SEQ ID NO: 287362 - RNA, 64 nt, hsa
auuuuuuugaauuugugaaaguuuuuggcaaaacuacaaauaggauuauguuagcauuuacacu

SEQ ID NO: 287363 - RNA, 64 nt, hsa
gcaaugcuuacaauagaugucucacacagaacaauacaaauauguaaaaaaucuuucaccacau

SEQ ID NO: 287364 - RNA, 64 nt, hsa
uugccaauuaauuggaucauauaaguaaaaucauuacaaauauaaguauuuacaggauuuuaaa

SEQ ID NO: 287365 - RNA, 64 nt, hsa
gauaaaguauacaggcggaugugcguugguuauauacaaauaugucauuuuauguaagggacuu

SEQ ID NO: 287366 - RNA, 64 nt, hsa
ugcagaucaaaaauauuagaaaaaauaaaaauaauacaaauaaaaauacaguauaacaguuauu

SEQ ID NO: 287367 - RNA, 64 nt, hsa
ggcuguauugaaaaauauaaauccaugauggcuguacaaauaauuuagccucauucauuuuuua

SEQ ID NO: 287368 - RNA, 64 nt, hsa
ccuccugcgcacaguguuguucaguuucacaugguacaaauaaguaaaaccaaaugagcaaaca

SEQ ID NO: 287369 - RNA, 64 nt, hsa
uuuaaauauuguuaguuuuaauauuccugauauuuacaaauauucauucuuauauacaaugaaa

SEQ ID NO: 287370 - RNA, 64 nt, hsa
uaaacauaagagaauucauaccauagagaaauccuacaaauaugaagaaugugacaaagcuuuu

SEQ ID NO: 287371 - RNA, 64 nt, hsa
uacacguaagauaauucauacuggaaggaaacccuacaaauaugaggaaugucucaaagcuuuu

SEQ ID NO: 287372 - RNA, 64 nt, hsa
uaauuuagucauguugggagaaaaauagauggguuacaaauacaucagauaucgagcaaauggu

SEQ ID NO: 287373 - RNA, 64 nt, hsa
uuucuauuuuuguuuagaguuuguacacaaaaucuacaaauacauuacucuaaaauagcaccua

SEQ ID NO: 287374 - RNA, 64 nt, hsa
gaauucuuucauaaagcagaaaaccauuuuauaauacaaauaaccauucucugauuuaucucuu

SEQ ID NO: 287375 - RNA, 64 nt, hsa
auuuuuuagcaguacuuuagcuugaaaguacucguacaaauacuguuagauuuaguugcaaaua

SEQ ID NO: 287376 - RNA, 64 nt, hsa
aaccgggugaguauagucaauaauagcuuaauuguacaaauaacuaagaguauaauuggauugu

SEQ ID NO: 287377 - RNA, 64 nt, hsa
acuguaacaaaaguguacuauguuaugcacacauuacaaauaauauaaggggaaguuuuauuag

SEQ ID NO: 287378 - RNA, 64 nt, hsa
uggggauuacaggugcgagcuacugcucccagcaagagccaagauuuuaaccuagaucucccua

SEQ ID NO: 287379 - RNA, 64 nt, hsa
auaacuuaucugugguuacaagcuaguaaguagcagagccaagauuuuuuuuaauauagagaca

SEQ ID NO: 287380 - RNA, 64 nt, hsa
gucuucuuagaguuaaaggagggggugcuggccaagagccaacacauucuuggcccaggagcau

SEQ ID NO: 287381 - RNA, 64 nt, hsa
ugguaaaucugccuuauccuucuuuaccuggcaaagagccaaucauguuaacucuuccuuauca

SEQ ID NO: 287382 - RNA, 64 nt, hsa
gcugaugagagcaaugaacaggagaaggagggagagagccaaaugucugaguaaacagauaucc

SEQ ID NO: 287383 - RNA, 64 nt, hsa
caaagauagaauuccaaguuauaaagcauaaaaaagagccaacagaaguaacuaauccgggaaa

SEQ ID NO: 287384 - RNA, 64 nt, hsa
ggaaagaguaacagcaauugaaaaaagagauucaagagccaaguacucagcccuggcaggggau

SEQ ID NO: 287385 - RNA, 64 nt, hsa
gugccucugaacagacugcugagauacccaaucaagagccaauccuugcuucccuagacucucc

SEQ ID NO: 287386 - RNA, 64 nt, hsa
cuuggccuuaaggaaaucuuuacuccuguaagcaagagccaaccucacaggauuaggagcuggg

SEQ ID NO: 287387 - RNA, 64 nt, hsa
guacauaaaaguuucuuuccuaaaccauucaccaagagccaauaucuaggcauuuucuugguag

SEQ ID NO: 287388 - RNA, 64 nt, hsa
cuuauucaauucuucugaccucagaacuggcagaaggucagaugugacuacagaacucuaggug

SEQ ID NO: 287389 - RNA, 64 nt, hsa
cagcucuuugggaggcugaagcggguggaucaugaggucagaagaucaagaccauacuggcuaa

SEQ ID NO: 287390 - RNA, 64 nt, hsa
cagaaggucagacuccaugucugccuugaccucaaggucagaagguucccaaaccccuggggcu

SEQ ID NO: 287391 - RNA, 64 nt, hsa
auaaaauucaaaaaagugugaugugcugcucagaaggucagacuccaugucugccuugaccuca

SEQ ID NO: 287392 - RNA, 64 nt, hsa
cacaggccaggcccagucacagcugggcuuccacaggucagaauaugggacaggacauggucag

SEQ ID NO: 287393 - RNA, 64 nt, hsa
uccaugacaguagccauggagucccaccugugccaggucagagcccacccggcagguuucagag

SEQ ID NO: 287394 - RNA, 64 nt, hsa
ucuagcacccagaggcaugacaggcccugcucagaggucagagggucugggcagaggagggacc

SEQ ID NO: 287395 - RNA, 64 nt, hsa
gcagcccagggguaaguaaacaaaguauggaugaaggucagauuuucuugucaguuucugagaa

SEQ ID NO: 287396 - RNA, 64 nt, hsa
auaggagcucagcaggcagacgaaugaggaauaaaggucagagaaggucagagcugagugacgu

SEQ ID NO: 287397 - RNA, 64 nt, hsa
agcaggcagacgaaugaggaauaaaggucagagaaggucagagcugagugacguuuggaaucca

SEQ ID NO: 287398 - RNA, 64 nt, hsa
acacuuugguagacugaugugaguggaucaccuaaggucagaaguucaagagcacccuggcuaa

SEQ ID NO: 287399 - RNA, 64 nt, hsa
gcacgguuggaggccaaggcacauaggucacuugaggucagaaguuugaaaccagcauggccaa

SEQ ID NO: 287400 - RNA, 64 nt, hsa
aucccucccuuuggggagccuauauugcuggagucauacccagccuaaguguugcccugcacua

SEQ ID NO: 287401 - RNA, 64 nt, hsa
ucccccucaucucuggggcccccuguggaucuggcauacccaaguucaguaaaugucuaucagu

SEQ ID NO: 287402 - RNA, 64 nt, hsa
cgcagcuccuagcccguugcgguggcccaucccgcauacccaucuucucgggcuucagcccagu

SEQ ID NO: 287403 - RNA, 64 nt, hsa
ugcaguaucuuccccugacuccagccacaaagcucauacccagcccuaccaaucaugaacugga

SEQ ID NO: 287404 - RNA, 64 nt, hsa
cagcuucucccugagggcccaccagccugugcugcauacccaccgcccagcuucucccugaggg

SEQ ID NO: 287405 - RNA, 64 nt, hsa
ugcccugccucugagggcccaccagccugugcugcauacccaccgcccagcuucucccugaggg

SEQ ID NO: 287406 - RNA, 64 nt, hsa
accagacucaauuuaaaucugcuccaaaugaguccauacccaucuucaucauuggcauuugaac

SEQ ID NO: 287407 - RNA, 64 nt, hsa
auaugguuuucuguuacuuucguugucaaaaugccauacccaaauacacagcaaugaauggcac

SEQ ID NO: 287408 - RNA, 64 nt, hsa
acauaauguauguguuguuuaagaaauguauaaaaaaccugaaaaaaaugaguaagaacuggca

SEQ ID NO: 287409 - RNA, 64 nt, hsa
ugcuuuuucacuaaaggucaguuguuuuaauuugaaaccugaaaugccucuuuagcaaaagccu

SEQ ID NO: 287410 - RNA, 64 nt, hsa
aaaagaaaaauauaaaaguaaaacaaacaaaaacaaaccugaaaacugcuuggcauuugaguag

SEQ ID NO: 287411 - RNA, 64 nt, hsa
uauacagaacugaagggaauauugaggcucaaugaaaccugacaaagagacuguaauauuguag

SEQ ID NO: 287412 - RNA, 64 nt, hsa
gacuugcaguaguaaguaacugagagcauaaaauaaaccugacuguaugaagucaauuuaagug

SEQ ID NO: 287413 - RNA, 64 nt, hsa
agaagcaugaaaguaauaaugugggauuacuagaaaaccugacuaauggugucacugcuggcaa

SEQ ID NO: 287414 - RNA, 64 nt, hsa
agaagcacggaaguacucaugucggauucccagaaaaccugacuaauggugccacugcuggcaa

SEQ ID NO: 287415 - RNA, 64 nt, hsa
aaagcauauggucaguuauuuaauuaaaaaggcaaaaccugaaccaccuucugcacuuaaagaa

SEQ ID NO: 287416 - RNA, 64 nt, hsa
gcaucugaagcuucuuuggccuagauuuuagcacaaaccugaguauaucucuucuacuuucauc

SEQ ID NO: 287417 - RNA, 64 nt, hsa
agaccacucaauccauccauguacuucccucuugaaaccugaugucagcugcuguugaacuuuu

SEQ ID NO: 287418 - RNA, 64 nt, hsa
cgaagacugagccagauuggccaauuaaaaacgaaaaccugacuagguucuguagagccaauua

SEQ ID NO: 287419 - RNA, 64 nt, hsa
cucacuaaacauaagauaauacugaaaacuuuacaaaccugaaugaugugacaauaauuuugac

SEQ ID NO: 287420 - RNA, 64 nt, hsa
gaauaaggacauuaaaauguaagaugcaugaugaaaaccugagugaagaggcuguuuguguuua

SEQ ID NO: 287421 - RNA, 64 nt, hsa
ggaggccauugugugagccuaucagaguugcugcaaaccugaccccugcucaguaaagcacuug

SEQ ID NO: 287422 - RNA, 64 nt, hsa
uucuucugaacucaaacugaggaauuucaccuguaaaccugagucguacagaaagcugccuggu

SEQ ID NO: 287423 - RNA, 64 nt, hsa
ugacaccagagaacaauaguagucucaagaauggaaaccugaaugucugagggaaugggcuggu

SEQ ID NO: 287424 - RNA, 64 nt, hsa
ugggacagcugauuucuuugauucccuagcugcaaaaccugaaauugaccacuaggugacagaa

SEQ ID NO: 287425 - RNA, 64 nt, hsa
uaugcauuaaaauauauuuguuaauuuaauauuuaaaccugagagauagguauuguuucccaga

SEQ ID NO: 287426 - RNA, 64 nt, hsa
gaacccacaacuuaggcccuagcggcagaaaggaaaaccugaagacugaggacaaaguggagga

SEQ ID NO: 287427 - RNA, 64 nt, hsa
uuacugaaacauuuugccagacuuucuccaaaugaaaccugaaucaauuuuucuaaaucuaggu

SEQ ID NO: 287428 - RNA, 64 nt, hsa
ggacuucagaagugcaauguauuuuucuccugugaaaccugaaucuacaaguuuuccugccaag

SEQ ID NO: 287429 - RNA, 64 nt, hsa
caacaacaacacacaaaccugacaagagaaaaacaaaccugaagcugccgagcaggaguggaug

SEQ ID NO: 287430 - RNA, 64 nt, hsa
aaaagacaaaaacaaaacaacaacaacaacacacaaaccugacaagagaaaaacaaaccugaag

SEQ ID NO: 287431 - RNA, 64 nt, hsa
gaccgguagcagcgcucgcugacagcuugggaggaaaccugagaucuguguuuuuuaaauugau

SEQ ID NO: 287432 - RNA, 64 nt, hsa
auugugcuguuugcuuguaguugaauaaaaauagaaaccugaaugaaggaacugaguccccgga

SEQ ID NO: 287433 - RNA, 64 nt, hsa
agcccagcaaacguugacuucugggcaaaccugaaaaccugaaaaugccacuuucaugcaguuu

SEQ ID NO: 287434 - RNA, 64 nt, hsa
uuucuccaagcccagcaaacguugacuucugggcaaaccugaaaaccugaaaaugccacuuuca

SEQ ID NO: 287435 - RNA, 64 nt, hsa
gaugauuaaacguuguauuaaaaagaccccguguaaaccugagcccccccgucccccccccccc

SEQ ID NO: 287436 - RNA, 64 nt, hsa
cugacaggagcauuuuuuuuuuuuccaguaaacaaaaccugaaagcaagcaacaaaacauacac

SEQ ID NO: 287437 - RNA, 64 nt, hsa
acucuggguaucccacagaugcaaaagggagaauaaaccugaauauuauuaccagccuagaguc

SEQ ID NO: 287438 - RNA, 64 nt, hsa
gcgcccucuccucucuuccugccaagguuuauagaaaccugagaaucugagggugaugucuggc

SEQ ID NO: 287439 - RNA, 64 nt, hsa
guauucuugugccauauucugucuuuuuauuacuuauaaagacaaaccaaaguaaaucugaaag

SEQ ID NO: 287440 - RNA, 64 nt, hsa
uuccuuaaacuauuguuuucuaauugaaauugucuauaaagaaaauacuugcaauauauuuuuc

SEQ ID NO: 287441 - RNA, 64 nt, hsa
acaagugagacaaaaagcacuaguauaaagauuauauaaagaccuauaaaucauuaagacaacu

SEQ ID NO: 287442 - RNA, 64 nt, hsa
acaaauaaaugacaagugagacaaaaagcacuaguauaaagauuauauaaagaccuauaaauca

SEQ ID NO: 287443 - RNA, 64 nt, hsa
caauuaggauggcuggcuaguggcagggacuucauauaaagaaaucuuucccagaauuguuuuu

SEQ ID NO: 287444 - RNA, 64 nt, hsa
guuucuaaaagaaauguacaaacuagaauuuuaauauaaagaaauguggccaugcuuuaaaccu

SEQ ID NO: 287445 - RNA, 64 nt, hsa
agugucaucuccuggguaaauuuugaugucgcauuauaaagacaugcauaauugaugguuucua

SEQ ID NO: 287446 - RNA, 64 nt, hsa
aguagcuaagaaguauuaaaacuauauacauccauauaaagaugaaauaugaacuaucucauua

SEQ ID NO: 287447 - RNA, 64 nt, hsa
guguacaaaguacuguucuaaauacaaaagggaauauaaagaugacuuucaaggaacauauaau

SEQ ID NO: 287448 - RNA, 64 nt, hsa
uguuuuuaaugcuaacauagaccccaaaauuagauauaaagaauugggaaggauaccuggagca

SEQ ID NO: 287449 - RNA, 64 nt, hsa
ugcugcagauauauaacucaaaacagauauagcguauaaagauauaguaaaugcaucuccuaga

SEQ ID NO: 287450 - RNA, 64 nt, hsa
auaaguagaagauuuguugaagacauagaacccuuauaaagaauuauuaaccuuuauaaacauu

SEQ ID NO: 287451 - RNA, 64 nt, hsa
uauuuucuucuccuuuauauguaaugaaagcacuuauaaagaaacaggaaucauuagaccaggu

SEQ ID NO: 287452 - RNA, 64 nt, hsa
uuuaaaaguaaaauacuucugacuguuaaaacuauauaaagaaaaucucauuugucuaauugca

SEQ ID NO: 287453 - RNA, 64 nt, hsa
agcuucacuuuuuguguucuaauuguuuuugagauauaaagacccugaaaaagcccauuuuaga

SEQ ID NO: 287454 - RNA, 64 nt, hsa
uaaauuuaaaagcaguccaguaaaagguuaacuguauaaagaaucuaugacuuuuugagggaag

SEQ ID NO: 287455 - RNA, 64 nt, hsa
uucagcuacaucaugccgcgcuguuguaauacuguauaaagaccucaaucuauccagaguauuu

SEQ ID NO: 287456 - RNA, 64 nt, hsa
uugcagcuuugaaaacauucaucucagaguuagguauaaagacauaaaaaugugugucaagccc

SEQ ID NO: 287457 - RNA, 64 nt, hsa
auuaucuuuauggaacuuuucaauaucuuugcuuuauaaagauucuaaacauguaucugagcug

SEQ ID NO: 287458 - RNA, 64 nt, hsa
ccuaagaaauaccacccuaccacuaacaaaaugguauaaagaaucucccagccaggccaacaug

SEQ ID NO: 287459 - RNA, 64 nt, hsa
uuggaauuucaaauaaaccucauguacuuguguuuauaaagaagaaaccacucugguggcuguu

SEQ ID NO: 287460 - RNA, 64 nt, hsa
uuauuaaaaguugcuuguuucagcagugauauuguauaaagaacaucuuguaagauacuccuga

SEQ ID NO: 287461 - RNA, 64 nt, hsa
ccuauggacguuaauugaaaagaaagauuguuguuauaaagaauugguuucuuggaaagcaggc

SEQ ID NO: 287462 - RNA, 64 nt, hsa
aggaaacaguauuguaugauauauuuauaaaugcuauaaagaaauauuguguuucaugcauuca

SEQ ID NO: 287463 - RNA, 64 nt, hsa
gugccuacuucaugaucaugaauuccaguuaauuuauaaagaggcgauuuuugugugccauuca

SEQ ID NO: 287464 - RNA, 64 nt, hsa
agaaguugccugcaugccgguccaaauuguucuguauaaagaugcucuuaaaagacacaagagu

SEQ ID NO: 287465 - RNA, 64 nt, hsa
uucuuuuuuauuugaaauuuuaagucaaguccuuuauaaagaccauagcaguggaaaacagugu

SEQ ID NO: 287466 - RNA, 64 nt, hsa
uuuuugacaaguaagauugcaaaauagaaauaucuauaaagauuccacaguuugacauuauggc

SEQ ID NO: 287467 - RNA, 64 nt, hsa
uucugugguaauacuacugauauuugcuuuucuauauaaagaaauguugccuaaggcugucugg

SEQ ID NO: 287468 - RNA, 64 nt, hsa
acuagcuuacaaauauucuguuaagggguaguuuuauaaagaaaaaugauauauaguuauguug

SEQ ID NO: 287469 - RNA, 64 nt, hsa
uucaguuaaaguuuugacuucuuauuauaaauaauauaaagaaugucucaguaauuagaaaucc

SEQ ID NO: 287470 - RNA, 64 nt, hsa
agagauguguagcucacaggggcuaccuuaccaguauaaagagcugauaacaguacucagaaga

SEQ ID NO: 287471 - RNA, 64 nt, hsa
auacaguuauucuuuuuuuuaaagaacauuguuuuauaaagaacgugauuuccagugaucucug

SEQ ID NO: 287472 - RNA, 64 nt, hsa
gaucuguugccguauuaguccguuuucacacagcuauaaagaaugccugagacugggugaugua

SEQ ID NO: 287473 - RNA, 64 nt, hsa
cacagcuauaaagaaugccugagacugggugauguauaaagaaaagaaguuuaacugacucaca

SEQ ID NO: 287474 - RNA, 64 nt, hsa
ugacuuaaaaugaagaauuaacuuguguuacaucuauaaagagcaaaauaacacacuccagaac

SEQ ID NO: 287475 - RNA, 64 nt, hsa
auuaauuggcuuucuguauucuaugccuuuuauuuauaaagacacuaagaaaacccauguuugu

SEQ ID NO: 287476 - RNA, 64 nt, hsa
uuuguuuaaaagaaguuuugucaaaauacaaaaauauaaagaaaugacugaaaguuguugacag

SEQ ID NO: 287477 - RNA, 64 nt, hsa
gagaaaaagguggaaaggaagagaagccacauacuauaaagaucuauuuuuuuuuuuuuaagag

SEQ ID NO: 287478 - RNA, 64 nt, hsa
uaaaagccuuccaguuuuguggauuaaaccuuuuuauaaagaucauuuauaauacuguuuuaaa

SEQ ID NO: 287479 - RNA, 64 nt, hsa
gaugcuugauuguuuuggucucaaaauggugugcuauaaagauaaaggugaggggaagacaaag

SEQ ID NO: 287480 - RNA, 64 nt, hsa
agccgaacaguauucuuuuuugaaaauuagcaauuauaaagauuguuuaaaauaucuugauauu

SEQ ID NO: 287481 - RNA, 64 nt, hsa
uauacuauuagauaagaauuaaauauucuauuuuuauaaagauaaauacuuaguagauaaaaac

SEQ ID NO: 287482 - RNA, 64 nt, hsa
aauguuaguuucauuccgugaaacauuacuuccauauaaagacagaucucuuaauaagugaauc

SEQ ID NO: 287483 - RNA, 64 nt, hsa
gauuugagugguuauucauugaguaauuuuccacuauaaagaauuuuauugaacauuuauuaaa

SEQ ID NO: 287484 - RNA, 64 nt, hsa
accagacagauuuauaguugaagccuacgagauguauaaagaaaagcuguuaccaaucuuacug

SEQ ID NO: 287485 - RNA, 64 nt, hsa
caaacugcaucugacaaagaucuaauccagaaucuauaaagaacucaaacaaaucaacaaugag

SEQ ID NO: 287486 - RNA, 64 nt, hsa
aaaaaugaaucauuguguuaggauucuaauucuuuauaaagaacuucaugggcuucaauaaugu

SEQ ID NO: 287487 - RNA, 64 nt, hsa
uucuagugguuugauccaaaucccauuacaguuguauaaagaaauaaaauuuuguacuuauauu

SEQ ID NO: 287488 - RNA, 64 nt, hsa
ucuauuuaagcaugugguuuuaaaaauagacaguauuuuuuaaaaaucaaaaaaugacuugcaa

SEQ ID NO: 287489 - RNA, 64 nt, hsa
gugauaagguugugugucgugugggaguggggcgauuuuuuaugugccaaauacccccgucccc

SEQ ID NO: 287490 - RNA, 64 nt, hsa
acaggcaugcgccaccaugccuggcuaauuucauauuuuuuaguagagacaggauuucuccaug

SEQ ID NO: 287491 - RNA, 64 nt, hsa
agucuaauauugcaguuggaauucuugcuguauuauuuuuuaagcaaguguuaggugcauuuaa

SEQ ID NO: 287492 - RNA, 64 nt, hsa
aggggcuugagaaagugggugggaggagggaaggauuuuuuaggagccuuaaucagaaaaggac

SEQ ID NO: 287493 - RNA, 64 nt, hsa
guuuuaauggguucagaauccaguuuguaggaagauuuuuuaaugguuuugguugcuccucccc

SEQ ID NO: 287494 - RNA, 64 nt, hsa
agguuagucaucaguaaccuucucuauuauuauuauuuuuuagaaacuuggaauacugucguca

SEQ ID NO: 287495 - RNA, 64 nt, hsa
ugcagauaaggauccauuucugggauagaauuguauuuuuuaagucauuuuuuuuucuugaaau

SEQ ID NO: 287496 - RNA, 64 nt, hsa
guuggauuugcccauauuuauguaggugguuuuaauuuuuuaaauggugauuaguguuaaaaau

SEQ ID NO: 287497 - RNA, 64 nt, hsa
agaaacaucuuuaacauauaguuucauaccauucauuuuuuaacaaagaaagggaaaagucugc

SEQ ID NO: 287498 - RNA, 64 nt, hsa
uuuaaaugaagcaccaugaauucuuuuuuaaauuauuuuuuaaaagucuuucucucucugauuc

SEQ ID NO: 287499 - RNA, 64 nt, hsa
guacagccuaccaggaacauguuguguuuucuuuauuuuuuaaaaucauuauauugaguugugu

SEQ ID NO: 287500 - RNA, 64 nt, hsa
cuuccuuuuuauuucauaagacugcuaggaagugauuuuuuaaaauuaggacuccuuaagaaua

SEQ ID NO: 287501 - RNA, 64 nt, hsa
guauacauguacuuaguaugugugguaucaggauauuuuuuaaacugugauaauacaacagaua

SEQ ID NO: 287502 - RNA, 64 nt, hsa
cuauuguuugugugcuuguuuugcgcuauggaacauuuuuuaauuuauuuuaagauaaauuauu

SEQ ID NO: 287503 - RNA, 64 nt, hsa
uccuuacgauacugaaacuuuacagcugcuguaaauuuuuuauaaaugaauuucaaaauguuau

SEQ ID NO: 287504 - RNA, 64 nt, hsa
uguuauuugcuuuucuccuccaccugugugguauauuuuuuaagcagaauuuuauuuuuuaaaa

SEQ ID NO: 287505 - RNA, 64 nt, hsa
ccaccugugugguauauuuuuuaagcagaauuuuauuuuuuaaaauaaaagguucuuuacaaga

SEQ ID NO: 287506 - RNA, 64 nt, hsa
uucuuaaguuaaggauguuuggcuuuuuucuuuaauuuuuuaaaaaccauuuuccuauguuagg

SEQ ID NO: 287507 - RNA, 64 nt, hsa
aggggacaguuaaauaucuuaaaauaucuaaaacauuuuuuaaagcacuuagauugucuuacgu

SEQ ID NO: 287508 - RNA, 64 nt, hsa
caacagaaaccuuuuauuuuuauuucugacucuuauuuuuuaaaaaauuugcgccucgguaucu

SEQ ID NO: 287509 - RNA, 64 nt, hsa
ggacuugugauuggcugcaggaagaaacuuuuuuauuuuuuaaaucuugaccaacagaaaccuu

SEQ ID NO: 287510 - RNA, 64 nt, hsa
guuguaaauauugucuugguuauguaaaaaugaaauuuuuuagacacaguaauugaacuguauu

SEQ ID NO: 287511 - RNA, 64 nt, hsa
gugucuacagcuaaauuuuguuuacaauuaggcuauuuuuuaauauaggauuuagaaaccaagg

SEQ ID NO: 287512 - RNA, 64 nt, hsa
aucggguuuucauuuacucuggacuggugaaaauauuuuuuaaagccagugcucuaagaccuca

SEQ ID NO: 287513 - RNA, 64 nt, hsa
aggugagaguuuuuaaaguguaagggaaaaauuaauuuuuuaaaaaacaccaugcuuggagggu

SEQ ID NO: 287514 - RNA, 64 nt, hsa
acuagggcuuuguauugucaauaauuuuuuaauaauuuuuuaaugagguauuuaccacugaaga

SEQ ID NO: 287515 - RNA, 64 nt, hsa
ucuguauacuaacuagggcuuuguauugucaauaauuuuuuaauaauuuuuuaaugagguauuu

SEQ ID NO: 287516 - RNA, 64 nt, hsa
acuuaaagcuucuaugguugacauuguauauauaauuuuuuaaaaagguuuucuauauggggau

SEQ ID NO: 287517 - RNA, 64 nt, hsa
caggugcgcacuaccacgccaagcuaauuuuuguauuuuuuaguagagaugggguuucaccauc

SEQ ID NO: 287518 - RNA, 64 nt, hsa
ugcuauuguaucucuucacuucugugaaaguaauauuuuuuauaaaauacacugaaauuuaacc

SEQ ID NO: 287519 - RNA, 64 nt, hsa
uaaaugcacgaaugucuuuuuuuuuaaaacugucauuuuuuacugucuuuugcuccauaucagg

SEQ ID NO: 287520 - RNA, 64 nt, hsa
ccauaaauauuauggccuuccauuuucuucauacauuuuuuaggauccacuugugcauguaguu

SEQ ID NO: 287521 - RNA, 64 nt, hsa
aguacuuagaauuuguuuaacugguacuuuuauuauuuuuuagugaaagacuuuugaaaagugc

SEQ ID NO: 287522 - RNA, 64 nt, hsa
accacuucugugugauauguacauauucaaacacauuuuuuaacuuuuuuaaauuuugauguga

SEQ ID NO: 287523 - RNA, 64 nt, hsa
uguucuccccuacauuaguaaaaauaaaaauggaauuuuuuacccauacaaauucauaaauucc

SEQ ID NO: 287524 - RNA, 64 nt, hsa
guagaugcaucuaagcaggcagcaggaacuuuaaauuuuuuaaguucaugucuaugacaugaac

SEQ ID NO: 287525 - RNA, 64 nt, hsa
aaguuuccccacuuuuauuuuuuaaaauuaaguaauuuuuuaaagaaggcacuuuuaaaauuaa

SEQ ID NO: 287526 - RNA, 64 nt, hsa
cuugaaagucaccugaggaaguuuccccacuuuuauuuuuuaaaauuaaguaauuuuuuaaaga

SEQ ID NO: 287527 - RNA, 64 nt, hsa
ucuccuucaggguuuauuuagguuauuauuuuuuauuuuuuaauccauucuuuguuuguuuacc

SEQ ID NO: 287528 - RNA, 64 nt, hsa
aucagacucuccuucaggguuuauuuagguuauuauuuuuuauuuuuuaauccauucuuuguuu

SEQ ID NO: 287529 - RNA, 64 nt, hsa
gcaaucguuuuccauggaguuugguccguucauuauuuuuuaguuaacuacacuucuugauauu

SEQ ID NO: 287530 - RNA, 64 nt, hsa
gggauccaucuggguuggucuguggauuuuuaauauuuuuuaauggaacaugaaaaccuccaca

SEQ ID NO: 287531 - RNA, 64 nt, hsa
ugguaaauuuaaauacauacuguucuaauuuuguauuuuuuaauuuuugaauuugacauugagu

SEQ ID NO: 287532 - RNA, 64 nt, hsa
auauaaauugaccauugaugauauccaguuuuucauuuuuuaccuguauugcauuuucccccua

SEQ ID NO: 287533 - RNA, 64 nt, hsa
uuuuagagaacacuacuaaaugcuaaauaagccuauuuuuuacacuacacuaucaaaauaauuu

SEQ ID NO: 287534 - RNA, 64 nt, hsa
uuauuuugugagcauaauuuauuguuuuaaauuaauuuuuuagcagauagcaguuagcacuuaa

SEQ ID NO: 287535 - RNA, 64 nt, hsa
aacaaacaucccugaaaaccucugugaaaauuuaauuuuuuauauccugauuaauauauuguga

SEQ ID NO: 287536 - RNA, 64 nt, hsa
uuaauuucucauuuugggggguuuuuauuuuuuuauuuuuuagauggugucucacgcuaucgcc

SEQ ID NO: 287537 - RNA, 64 nt, hsa
gggauuacaggcgggagccacugcacauggcagcauuuuuuaaaaauucaguuuuaagaucucu

SEQ ID NO: 287538 - RNA, 64 nt, hsa
agucccccuucaacccaguugauguaaccaccucauuuuuuacaaauacagaaucuauucuacu

SEQ ID NO: 287539 - RNA, 64 nt, hsa
gaaaugccaaaaacuuggagugaaggaugaugcuauuuuuuauuuuuaaauauaucuucagguu

SEQ ID NO: 287540 - RNA, 64 nt, hsa
cuuuuaugauuuuguuuauauugcaguaguauuuauuuuuuagugaugagaauuguaugucaug

SEQ ID NO: 287541 - RNA, 64 nt, hsa
cuacaccaagguaaacagguguuugccuuauuuaauuuuuuacuuucaguucuacgugaauuag

SEQ ID NO: 287542 - RNA, 64 nt, hsa
ugaaggcuaaaugagauacacugauucuagguacauuuuuuaacuuucuagaagagaaaaacua

SEQ ID NO: 287543 - RNA, 64 nt, hsa
gauaucugugggggcaaaauuuaauuuggauuugauuuuuuaaaacaauguuuacugcgauuuc

SEQ ID NO: 287544 - RNA, 64 nt, hsa
ugaccuucauauaaucagcauaaacauaaaacaaauuuuuuacuuaacaugagugcacuuuacu

SEQ ID NO: 287545 - RNA, 64 nt, hsa
gaaauuuuggaccuacuaacucuaagccuauuuuauuuuuuauaaaacuaugugacauuuuggu

SEQ ID NO: 287546 - RNA, 64 nt, hsa
gugauucaugcaggguuaaagaugcuuuguuuuuauuuuuuaaguaccaaaauugguuucagaa

SEQ ID NO: 287547 - RNA, 64 nt, hsa
gcaggcaugagccaccgugcccagccucaaaaauauuuuuuaaaagaaaagagaaaauaauucu

SEQ ID NO: 287548 - RNA, 64 nt, hsa
aauauuuuacuuuauugauaaugacaaaaagaauauuuuuuaaaccccaucaaaauagauuuca

SEQ ID NO: 287549 - RNA, 64 nt, hsa
uacuaaugaugacauucaguucucuuuuguuuuuauuuuuuaaaaacucagguguaauuauuau

SEQ ID NO: 287550 - RNA, 64 nt, hsa
aagcacagaaacaucuuuacgguggcaucaucucauuuuuuaggaagacaugauaauacugccc

SEQ ID NO: 287551 - RNA, 64 nt, hsa
gauuugcuuucagcuguuucugugauuauaaagcauuuuuuaagagacaaauuuuaacuuuuaa

SEQ ID NO: 287552 - RNA, 64 nt, hsa
uugcaucuaacugccagugccauugucaaaacuuauuuuuuaaaucguuguacauuucuuauua

SEQ ID NO: 287553 - RNA, 64 nt, hsa
uccuauuucaugccauucuuguuaguugacugguauuuuuuacugaggagcaacucauuccagc

SEQ ID NO: 287554 - RNA, 64 nt, hsa
uuuuuacgcugcuuuuuucaaugcauuucuuaauauuuuuuaaguuucaugaaugcaugcucag

SEQ ID NO: 287555 - RNA, 64 nt, hsa
acguuuaaaaccuuuauugucucuccuuagucuaauuuuuuaaauauggauuaugcuugaauua

SEQ ID NO: 287556 - RNA, 64 nt, hsa
caggguuugaaaucaguuuuugugggugauugcaauuuuuuaaugaaaugcauuagaacaucua

SEQ ID NO: 287557 - RNA, 64 nt, hsa
auauaugcauuaaguguagcaaaucgugauguaaauuuuuuacugcuggucauggucaaaaagu

SEQ ID NO: 287558 - RNA, 64 nt, hsa
auuauucuaauuuuauauauagagaaagugaccuauuuuuuaaaaaaaucacacucuaaguucu

SEQ ID NO: 287559 - RNA, 64 nt, hsa
ugccuuucuuauuugcaauaaaagguauugagccauuuuuuaaaugacauuuuugauaaauuau

SEQ ID NO: 287560 - RNA, 64 nt, hsa
uuucaauucuucuggugagaauuagaaaugaaauauuuuuuauucauuggccaaaaaguucaca

SEQ ID NO: 287561 - RNA, 64 nt, hsa
uccauuuuaggucuuuuucaagaauagugaacacauuuuuuaacaaaauaaguuguaauuuuaa

SEQ ID NO: 287562 - RNA, 64 nt, hsa
aaaguguugauuaauagaugaaauuuuuaaauuaauuuuuuaaaacaugccauacauuguauca

SEQ ID NO: 287563 - RNA, 64 nt, hsa
agauaauguuauucauuuagaacaaauaagguauauuuuuuagaaucaacuuuguaagcacuau

SEQ ID NO: 287564 - RNA, 64 nt, hsa
aaauaaaacugaauauuaugcagauuuaugccuuauuuuuuagcauuuuuuaagguugggucuu

SEQ ID NO: 287565 - RNA, 64 nt, hsa
gaauauuaugcagauuuaugccuuauuuuuuagcauuuuuuaagguugggucuuucaggcuggu

SEQ ID NO: 287566 - RNA, 64 nt, hsa
ugggaggaagaaauuuucucagagcaaacuuucuauuuuuuaccugugaaauaacagugacuuu

SEQ ID NO: 287567 - RNA, 64 nt, hsa
uuuguaugcguauauaagcaaauauguaaucuuuauuuuuuaaauaaaugggaucauauuauau

SEQ ID NO: 287568 - RNA, 64 nt, hsa
cagggagacuugucuaugacucgaucuucaauuuauuuuuuacauauauaugagaagaguguca

SEQ ID NO: 287569 - RNA, 64 nt, hsa
caaaagacccaaaucaaaaaguuaguuugaaagcauuuuuuaauaauuguauuuaugcauuucc

SEQ ID NO: 287570 - RNA, 64 nt, hsa
auaacuguaaagauguuuauuucaggcauuggauauuuuuuacuuuagaagccugcauaauguu

SEQ ID NO: 287571 - RNA, 64 nt, hsa
uaccuguggauauuuguauaaaagugugaaauaaauuuuuuauaaaaguguucauuguuucgua

SEQ ID NO: 287572 - RNA, 64 nt, hsa
cuguuuucuacuucaguauucuaccagagaacauauuuuuuaggggagaaggguuaugguuuug

SEQ ID NO: 287573 - RNA, 64 nt, hsa
uuugccucuuuguuuuucaauagauuauucugccauuuuuuaaaggaaagggaaaaugaaaaca

SEQ ID NO: 287574 - RNA, 64 nt, hsa
ugggacuacaggggcccgccaccacaccuggcuaauuuuuuaaaaauauuuuuaguagagacag

SEQ ID NO: 287575 - RNA, 64 nt, hsa
uaucuuuaaaauuuaaguaucuuuuuucaaaaacauuuuuuaauagaauaaaauauaauuugau

SEQ ID NO: 287576 - RNA, 64 nt, hsa
uguauuugggccaguugauuguagguuguccaacauuuuuuaauauugggaaaauuaugauaaa

SEQ ID NO: 287577 - RNA, 64 nt, hsa
gccaagauggugaaaccccgucucuauuaaaaauauuuuuuaaaaauuaacugagcgugguggu

SEQ ID NO: 287578 - RNA, 64 nt, hsa
cugggcugaugcuccguuucucugggaauuggugauuuuuuacugugaagaugaaauuacccua

SEQ ID NO: 287579 - RNA, 64 nt, hsa
ugggacuacaggcgcccgccaccacgccuggcuaauuuuuuauauuuuuaguagagacaggguu

SEQ ID NO: 287580 - RNA, 64 nt, hsa
agaaguggccucaaaggcacuuaauuugauuuuuauuuuuuaaaugcugucaaaguuacaguuu

SEQ ID NO: 287581 - RNA, 64 nt, hsa
auacugcaagaagguuuuuuaaacuucccacuuuauuuuuuauacacauuaaucagauaucauu

SEQ ID NO: 287582 - RNA, 64 nt, hsa
uuuauuucuccaaaucgagagugauuuuuuaaaaauuuuuuaucuuuauaugguuucagaagua

SEQ ID NO: 287583 - RNA, 64 nt, hsa
uauaauguaaauuuauuucuccaaaucgagagugauuuuuuaaaaauuuuuuaucuuuauaugg

SEQ ID NO: 287584 - RNA, 64 nt, hsa
aaacuauuuauugacuuuauucauccauuuguaaauuuuuuaagguucuuguguauauuugggg

SEQ ID NO: 287585 - RNA, 64 nt, hsa
auaaaagccuuccccuucagugaagaaaacauuuauuuuuuauuugauuccuaggauuuaguaa

SEQ ID NO: 287586 - RNA, 64 nt, hsa
aucuaaauuauuaggaguguguguaucagaaguaauuuuuuaaugucuucuaaggauggucuuc

SEQ ID NO: 287587 - RNA, 64 nt, hsa
ccuugaccagagcacagauuacuuaugcuucuuaauuuuuuaaaaucuuaaauccucuguccaa

SEQ ID NO: 287588 - RNA, 64 nt, hsa
uguauugguugcuccugacacuauacauuucaaaauuuuuuauaacuugaaaaacacuucugug

SEQ ID NO: 287589 - RNA, 64 nt, hsa
aauacucugcaaaguagccuuuaaaaaaauguaaauuuuuuaaaaaguccacagaggagaauuu

SEQ ID NO: 287590 - RNA, 64 nt, hsa
gccagcaucucacggcaccuuauuuuuuauuuuuauuuuuuaaaucacaugcauguuaggaaac

SEQ ID NO: 287591 - RNA, 64 nt, hsa
aaauguuaaaacugccagcaucucacggcaccuuauuuuuuauuuuuauuuuuuaaaucacaug

SEQ ID NO: 287592 - RNA, 64 nt, hsa
gacucuggggugcuuacuuuagucaauucuuaaaauuuuuuauuuguucccuaagaaaguaauu

SEQ ID NO: 287593 - RNA, 64 nt, hsa
ucaauuauuuuguauuuaugauuaauaaaaguucauuuuuuaaauuuguauuuuuauacaaccu

SEQ ID NO: 287594 - RNA, 64 nt, hsa
aguagcuucaccuuguguaugcaggccccaaguuauuuuuuagcaaucuuacgagugaaauguu

SEQ ID NO: 287595 - RNA, 64 nt, hsa
aaguugauucaccccuuuuuggggaccuuaauauauuuuuuaagggaugugccuaugcauugau

SEQ ID NO: 287596 - RNA, 64 nt, hsa
gucuuucacuggaaugaagaccaugccuaggaacauuuuuuaaggacucagcuguggcuuuuag

SEQ ID NO: 287597 - RNA, 64 nt, hsa
aaaauuauacaugagcagcucaaaguaaacguguauuuuuuaguaacaaugaaauugucaaauu

SEQ ID NO: 287598 - RNA, 64 nt, hsa
ccugucuacuguaacuuaagacuuucauagaauaauuuuuuauagaguauaugguauauugugu

SEQ ID NO: 287599 - RNA, 64 nt, hsa
uaccaaagcaguuuacauauguccuuauaugcauauuuuuuauuauauauuuaguguuuuauag

SEQ ID NO: 287600 - RNA, 64 nt, hsa
cauauuuuuuauuauauauuuaguguuuuauagaauuuuuuaaaguuaacauauaauguagaua

SEQ ID NO: 287601 - RNA, 64 nt, hsa
acaagcuaacaggcaauagaaauauguauaucagauuuuuuaauguaacaaacuacauguuaau

SEQ ID NO: 287602 - RNA, 64 nt, hsa
gaagacagaacuauaauaaauuaguuuuguucugauuuuuuagaacacuugcaauaauguauca

SEQ ID NO: 287603 - RNA, 64 nt, hsa
aaaugucuuaaagggaaucauuuuuguaggaagcauuuuuuauaauuuucuaagucgugcacuu

SEQ ID NO: 287604 - RNA, 64 nt, hsa
aggugugugggccaccgugccuggcugauucagcauuuuuuaucaggcaggaccagguggcacu

SEQ ID NO: 287605 - RNA, 64 nt, hsa
aaaaaaacccccagacuguaauaguauuauuauuauuuuuuaagauggaaucuugcucuguugc

SEQ ID NO: 287606 - RNA, 64 nt, hsa
ccuccugaguagugugugccaccacgcccagcuaauuuuuuaauuuuuaguagagacaggguuu

SEQ ID NO: 287607 - RNA, 64 nt, hsa
ugcaguuuguuuuauugugucuugcggauauugcauuuuuuacaaacugaagguuuguggcagg

SEQ ID NO: 287608 - RNA, 64 nt, hsa
gguguuucaaacuuagagaagaccaagggacaguauuuuuuaucaaaggaauacuauuuuuuca

SEQ ID NO: 287609 - RNA, 64 nt, hsa
guucauaauaaaaaucuguuagcucucaaagcuaauuuuuuacuaaaguuuuuauacagccuca

SEQ ID NO: 287610 - RNA, 64 nt, hsa
ugccuaucaguuugaaauauauacacauauauauauuuuuuacauauuuacgccauuuuuacuu

SEQ ID NO: 287611 - RNA, 64 nt, hsa
aauauuguucugaaaugcuuaacuucagaauuacauuuuuuaaaguaaauaauuguuuuaaauc

SEQ ID NO: 287612 - RNA, 64 nt, hsa
cuggaacuacaggugugcacuccucgccuggcuaauuuuuuauuuuuuguacaggcaggaucuu

SEQ ID NO: 287613 - RNA, 64 nt, hsa
ugauguuuuauauauaucauucagaaaaaguuuuauuuuuuaauaacauucuauuaacauuauu

SEQ ID NO: 287614 - RNA, 64 nt, hsa
gagggaaauacauuuuaggaggaguuuugccuuaauuuuuuaaguacugcaccaaaaccaaaga

SEQ ID NO: 287615 - RNA, 64 nt, hsa
acuuaauauucucuauaauguauuauuuuauuuuauuuuuuacaauuagccuuuuuuuuaguua

SEQ ID NO: 287616 - RNA, 64 nt, hsa
agaaaccauugggaacuauacucuuuuuauuuuuauuuuuuauuuuuuuuauuauuuuuuuuuu

SEQ ID NO: 287617 - RNA, 64 nt, hsa
guauuuauuuuaugccucaguauauuauuauuuaauuuuuuagguaaugccuaucucuuggucu

SEQ ID NO: 287618 - RNA, 64 nt, hsa
ugaaaaauauuaucuuggguucuuuguaaaauuuauuuuuuacaugcugaauuagccucgaucu

SEQ ID NO: 287619 - RNA, 64 nt, hsa
cauuuuuagguuagccagugugacuaugcaccuaauuuuuuaugagauuaaauucauaagacuu

SEQ ID NO: 287620 - RNA, 64 nt, hsa
auaguuuuugaaaaauacagucaguagauguuuuauuuuuuagcuauucaguuauguuuauaag

SEQ ID NO: 287621 - RNA, 64 nt, hsa
acuauuguuuguuucaucuugcuuuugcauuuuuauuuuuuaauuuccaaauuuuaaguguucc

SEQ ID NO: 287622 - RNA, 64 nt, hsa
uuuaagacauaagaauuccucaaagaagccauacauuuuuuaagguggggauugacuuuuauuc

SEQ ID NO: 287623 - RNA, 64 nt, hsa
acucaaauuugugucauucuauuuuauuuauuuuauuuuuuauuuccuucccucauaccuugcc

SEQ ID NO: 287624 - RNA, 64 nt, hsa
cagguauuuagcuccccuuucauauuauuuuuaaauuuuuuaauuaccuguuguaggguguucc

SEQ ID NO: 287625 - RNA, 64 nt, hsa
uccuuuuaacaguaggaggcagugugagcuuuuuauuuuuuauuuuucuuaagguggucuuagu

SEQ ID NO: 287626 - RNA, 64 nt, hsa
uuuccuuauaauuuagcauacaggaaaaguauuuauuuuuuaaguaggguaucuuaauuaugcu

SEQ ID NO: 287627 - RNA, 64 nt, hsa
uagaauacauuucagaggcagaguuccucggauuauuuuuuauggauauuaguguucagcagcu

SEQ ID NO: 287628 - RNA, 64 nt, hsa
uaaaaaguaaacaugauuaucuaaauuacuuaaaauuuuuuaaucuuaguaaaaauuuuaggaa

SEQ ID NO: 287629 - RNA, 64 nt, hsa
ugccaauuacagugcaaucuuuauuuauuguaaaauuuuuuaaguguacuuauguacuaauuuu

SEQ ID NO: 287630 - RNA, 64 nt, hsa
uaaaaaauuccaugcagguguuuuggggagagguauuuuuuaagcaaugaaaauucaacugagu

SEQ ID NO: 287631 - RNA, 64 nt, hsa
uaaaugaaagaaaauugaguugcacuuauugaccauuuuuuaauuuacuuguuuuggauggcuu

SEQ ID NO: 287632 - RNA, 64 nt, hsa
uuaauguuuucaaaagguauuauacaugugauacauuuuuuaagcuucaguugcuugucuucug

SEQ ID NO: 287633 - RNA, 64 nt, hsa
aaaauaauugauuauacuuuccuaaagaaaagccauuuuuuaaugcaaagucuacuacuuccaa

SEQ ID NO: 287634 - RNA, 64 nt, hsa
uuagauauaaaauucaguuuaaaaagaacaugcuauuuuuuaaaugccaucacauaaacaaagu

SEQ ID NO: 287635 - RNA, 64 nt, hsa
ugggccacagagcaagacugucucaagaaaaaaaauuuuuuaaauaaguuuaauuauaaaguga

SEQ ID NO: 287636 - RNA, 64 nt, hsa
gguaguaauuaggauaacuaaaauucugggccuaauuuuuuaaagaauccaagacaaacuaaac

SEQ ID NO: 287637 - RNA, 64 nt, hsa
ugagacugaaagaaacuaagauuuaucugcaaggauuuuuuaaaaauuggcauuuuaaguguuu

SEQ ID NO: 287638 - RNA, 64 nt, hsa
ugggacuacaagugccugccaccacgccuggguuauuuuuuauauuuuuaguagagacgggguu

SEQ ID NO: 287639 - RNA, 64 nt, hsa
cuggggcuacaggugugugccacccugccagcuaauuuuuuauauuuuuuuguagagacaaaac

SEQ ID NO: 287640 - RNA, 64 nt, hsa
aguaccugcgcaauccuugauuuaaugaaauuaaauuuuuuauuucaaaagauaggcuucuguu

SEQ ID NO: 287641 - RNA, 64 nt, hsa
uucauuuagauaauaaacuauguacauaggacacauuuuuuaucucuaggcuuagucauguaaa

SEQ ID NO: 287642 - RNA, 64 nt, hsa
guuguuugacaccuucuuuccacuuucaccuuuuauuuuuuauuccuuccuuucuacccccaac

SEQ ID NO: 287643 - RNA, 64 nt, hsa
ucucuuuucaguauaguaguuaacauuuucuaguauuuuuuauggagagaaugucaaaaguggc

SEQ ID NO: 287644 - RNA, 64 nt, hsa
auaauggaguaacaaauuacagaauagcuaaauaauuuuuuaaaaauauuuuacaguuguaaaa

SEQ ID NO: 287645 - RNA, 64 nt, hsa
cuugaguagucugauuuagagacuaguuacuucuauuuuuuaaaauaauggaguaacaaauuac

SEQ ID NO: 287646 - RNA, 64 nt, hsa
uauuuaaacuucaauuuuuuauauuuaaacuucaauuuuuuagcaacagcugaauagcuuugcg

SEQ ID NO: 287647 - RNA, 64 nt, hsa
agguccgaauuuucacauuuauauuuaaacuucaauuuuuuauauuuaaacuucaauuuuuuag

SEQ ID NO: 287648 - RNA, 64 nt, hsa
agcuuuuagagaccuaugauccucauggaacuuaauuuuuuauuaaauauucagguaacaguuc

SEQ ID NO: 287649 - RNA, 64 nt, hsa
uuugcagcucaagcaugcaguaugaauacuguguauuuuuuaaaaaaauaauuuaguaucaagg

SEQ ID NO: 287650 - RNA, 64 nt, hsa
ggaaacuggagaaaugauugucgggcaaccguuuauuuuuuauuguauuuuauuugguugaggg

SEQ ID NO: 287651 - RNA, 64 nt, hsa
cuauuagaaaagguaugaaaaucuuuauaguaaaauuuuuuauaaacuaaaguuguaccuuuua

SEQ ID NO: 287652 - RNA, 64 nt, hsa
aaaaaggcagaaaacccaccaugggaaaauaagcauuuuuuaaaaucugaaguugcucuuuucc

SEQ ID NO: 287653 - RNA, 64 nt, hsa
auguuuaggacaacaaaaauaauuuuaaaaaguuauuuuuuacccuaauacuuuucuccacuga

SEQ ID NO: 287654 - RNA, 64 nt, hsa
aaacucucagugcuuccuuaugguuucuaauaggauuuuuuauuauuguuauuauuauuauugg

SEQ ID NO: 287655 - RNA, 64 nt, hsa
uguuuuuuucuucaagagacgcaauugcaauaguauuuuuuagauuuuauccaagaaguuuuuu

SEQ ID NO: 287656 - RNA, 64 nt, hsa
guaagugacucaccuuuaaaguuuuuuuaguguuauuuuuuaucacuacucugggaaaugguuu

SEQ ID NO: 287657 - RNA, 64 nt, hsa
aacugaaaggguuuuuguaaauuuuuuggccaaaauuuuuuaaaacauacuuacuuuggacuag

SEQ ID NO: 287658 - RNA, 64 nt, hsa
acuauaaauagcauucuaaauuugaguaaauacaauuuuuuagguuacucaagaaccagcauua

SEQ ID NO: 287659 - RNA, 64 nt, hsa
acuaugaauuagacaucaguuagcaauaauaagcauuuuuuacacuaucauugaggaauaauua

SEQ ID NO: 287660 - RNA, 64 nt, hsa
ccugucauggaugaacugaagacuuugccuguucauuuuuuaaauauuauuuucagguccuuug

SEQ ID NO: 287661 - RNA, 64 nt, hsa
cugcccuagagcugggauauuguuugugggcaauauuuuuuauugucucuuguuuaaaaaguga

SEQ ID NO: 287662 - RNA, 64 nt, hsa
uuuuaauuuguauguuuuuauguggaugaagagcauuuuuuaugcuuuugugcaauagguucca

SEQ ID NO: 287663 - RNA, 64 nt, hsa
uacauguguuugacuguuuaauuugaaaguuuacauuuuuuaugcuuuguguugguguguaauu

SEQ ID NO: 287664 - RNA, 64 nt, hsa
aagacccauaagaaacccauauuuaaaaaucugaauuuuuuagaagaaugcaaaacuuuaguaa

SEQ ID NO: 287665 - RNA, 64 nt, hsa
cauugcauauuuugcagauuuuauccacagugucauuuuuuacugucagaaaagauaccccuuu

SEQ ID NO: 287666 - RNA, 64 nt, hsa
ugucagaaaagauaccccuuuugucauugcaacuauuuuuuaaauccagaaaucuuuguacuga

SEQ ID NO: 287667 - RNA, 64 nt, hsa
auuaugauguuuuucaaaaugcaagugagguuugauuuuuuacugaaucaaaugcaaauguuac

SEQ ID NO: 287668 - RNA, 64 nt, hsa
agaaaaaaaggagaucuaacaaaaacacuugaauauuuuuuauuuucaaaacuaaacacauaaa

SEQ ID NO: 287669 - RNA, 64 nt, hsa
gagccauauaaguuugaaggaaacaguuaauaccauuuuuuaaggaaacaauauaaccacaaag

SEQ ID NO: 287670 - RNA, 64 nt, hsa
uugaauauucccaagcccaugaguccuugaaaauauuuuuuauauauacaguaacuuuaugugu

SEQ ID NO: 287671 - RNA, 64 nt, hsa
aauuuuuaugcuaggaugccuuuaugaccacuuaauuuuuuaaucuuaguuuaauggucucucc

SEQ ID NO: 287672 - RNA, 64 nt, hsa
uacaaagucuaguuuguauguagguaugaagggaauuuuuuaaauaaauugaaaagcugugaac

SEQ ID NO: 287673 - RNA, 64 nt, hsa
uuuaaaguauuucuggguuaaaugaaacaaugaaauuuuuuaguauguucaacucucauccaaa

SEQ ID NO: 287674 - RNA, 64 nt, hsa
aaauagaaaauguaauaacuuucuuaccauuaacauuuuuuacccuuccauagaagggagggaa

SEQ ID NO: 287675 - RNA, 64 nt, hsa
uucugauaauuuaaaauccauuuuaggugauaaaauuuuuuaaaaguuuugaaggaaaccucug

SEQ ID NO: 287676 - RNA, 64 nt, hsa
uguguauagcucaguuuggauaauuggucaaacaauuuuuuauccaguaguaaaauauguaacc

SEQ ID NO: 287677 - RNA, 64 nt, hsa
uuuuuaaucaagauagugugcuuuauucuguuguauuuuuuauuauuuuaauauacuguaagcc

SEQ ID NO: 287678 - RNA, 64 nt, hsa
ugcagcagauacucuuccugccagugguaauacgauuuuuuaagaaggcaguuugucaauuuua

SEQ ID NO: 287679 - RNA, 64 nt, hsa
aaguaauauccuuuacaguucugugaaaggacuuauuuuuuaacuguaauauuuauuaguuuua

SEQ ID NO: 287680 - RNA, 64 nt, hsa
aauauuuguaucucauuuguaacaauuuguuuuaauuuuuuauauauauguuuuuauuuuuaaa

SEQ ID NO: 287681 - RNA, 64 nt, hsa
ggacuguuugaauauucuauuccaaugggcauuuauuuuuuauccugucauuaaaaaaaaaaga

SEQ ID NO: 287682 - RNA, 64 nt, hsa
cauaaccccuauaugcguuguugcauaacagaugauuuuuuaaaauauauacuuccuuaugcaa

SEQ ID NO: 287683 - RNA, 64 nt, hsa
uuuacacagaaauuccauuguaaauugauaauggauuuuuuauguuacuagaagagauuauuug

SEQ ID NO: 287684 - RNA, 64 nt, hsa
gucacuuuuauuugaaaugucauuuggugccaguauuuuuuaacugcauaauagccuaacauga

SEQ ID NO: 287685 - RNA, 64 nt, hsa
cacauuuggcaguuuaauagauguuacucaaagaauuuuuuaagaacuguauuuuauuuuuuaa

SEQ ID NO: 287686 - RNA, 64 nt, hsa
uguuacucaaagaauuuuuuaagaacuguauuuuauuuuuuaaaugguguuuuauuacaaggga

SEQ ID NO: 287687 - RNA, 64 nt, hsa
guauuauuauuguugauguugucaugguuaaucuauuuuuuaaaauugaaaugaagcagaagua

SEQ ID NO: 287688 - RNA, 64 nt, hsa
uaguagaaucaaucucgaccuauauaaauaguagauuuuuuauggugaaacuuucccacauaaa

SEQ ID NO: 287689 - RNA, 64 nt, hsa
uguuacuuacugcuccaggcauuuuauuaaauuaauuuuuuaaauuauuuuccacccuacauca

SEQ ID NO: 287690 - RNA, 64 nt, hsa
gcaugagccaccaugccuggcccaaaguucuagaauuuuuuaaagguauucauggugacucagg

SEQ ID NO: 287691 - RNA, 64 nt, hsa
uaauuugauaggcaauacaucuacccacuccauuauuuuuuaaaacuucauuuaauaguuuaaa

SEQ ID NO: 287692 - RNA, 64 nt, hsa
uuguuaauacugccaauaaaaucauuuucaacuuauuuuuuaaaguagguuuucuuacuuuggu

SEQ ID NO: 287693 - RNA, 64 nt, hsa
auuuuuauauauguguauguguacacauaaaaauauuuuuuaccauaugaaaauugcaguagcu

SEQ ID NO: 287694 - RNA, 64 nt, hsa
ugcguuuugcuuuauugcacuuugcaaauaaugcauuuuuuacaaauggaagguuuauggcaac

SEQ ID NO: 287695 - RNA, 64 nt, hsa
caccacugucccuaugucaucaaauuugggagagauuuuuuaaaauaccacaaucauuugaaga

SEQ ID NO: 287696 - RNA, 64 nt, hsa
acauuucaugcaaaaaauauauauauuucaauguauuuuuuauuuuaguccuauuuguauuauu

SEQ ID NO: 287697 - RNA, 64 nt, hsa
cauaagagucuuaaaagaaauuaagccauuuaacauuuuuuaaauagguaagauaccauuauau

SEQ ID NO: 287698 - RNA, 64 nt, hsa
gaaacuauuauuuuuuagauuugaauauaaauguauuuuuuaaacacuuguuaugaguuaaguu

SEQ ID NO: 287699 - RNA, 64 nt, hsa
uagaguaauauucacuuaacacauugaaacuauuauuuuuuagauuugaauauaaauguauuuu

SEQ ID NO: 287700 - RNA, 64 nt, hsa
aagucaaaucaguauucuguaauuguuagaauuuauuuuuuaagaacuuacaacucagaaaaga

SEQ ID NO: 287701 - RNA, 64 nt, hsa
gcucuucgguuuuuguuauugaacuguuucauguauuuuuuaaagacauuugaggggaggagga

SEQ ID NO: 287702 - RNA, 64 nt, hsa
augucagccauuuacucucccacuaauugggauuauuuuuuaaaagaggucuuucuccccgaaa

SEQ ID NO: 287703 - RNA, 64 nt, hsa
ccccguaaaaaguagaagauaaguuuguuaaaguauuuuuuauaaacagcuuaauauaaaacau

SEQ ID NO: 287704 - RNA, 64 nt, hsa
aaauacucuaauucuaaccagagcaagcuuuuuuauuuuuuauacaggggaauauuuuauucaa

SEQ ID NO: 287705 - RNA, 64 nt, hsa
cucagaacggacgagauaaugugaacuagcuggaauuuuuuauucuugugaauauguacauagg

SEQ ID NO: 287706 - RNA, 64 nt, hsa
guaaaacauuuauuuugacauaaaguugauaaagauuuuuuaauaauuuagacuucaagcaugg

SEQ ID NO: 287707 - RNA, 64 nt, hsa
auuuauuuaaaauagcaaaagaagaaguuucaucauuuuuuacuuccucucugaguggacuggc

SEQ ID NO: 287708 - RNA, 64 nt, hsa
aagaagaaucucaucucagugaagaauacuucucauuuuuuaaaaaagcuuaaaacuuugaagu

SEQ ID NO: 287709 - RNA, 64 nt, hsa
aagaacagccucauuuuagauguaguccuguuggauuuuuuaugccuccucaguaaccagaaau

SEQ ID NO: 287710 - RNA, 64 nt, hsa
cgcaguuugaauuaaucauaucaaaucaguuuuaauuuuuuaaauuguacuucagagucuauau

SEQ ID NO: 287711 - RNA, 64 nt, hsa
gaaaucacuucaugaaaauaagcaaagaccacacauuuuuuacuacaaaauguaaaggauaaau

SEQ ID NO: 287712 - RNA, 64 nt, hsa
uuacuugccauuuauuguaaggaaacuuuaaagcauuuuuuaggaaauacucaaaagcaagguu

SEQ ID NO: 287713 - RNA, 64 nt, hsa
cacaugggacaaaguuccaaaaugccaaauucuuauuuuuuaaaaagcuaguucuauaaaauac

SEQ ID NO: 287714 - RNA, 64 nt, hsa
aucaaaacaaaaaaaaacucauuuauaccuguguauuuuuuaaagcuacaaucuguucaauguu

SEQ ID NO: 287715 - RNA, 64 nt, hsa
acagaugaaaagccucuguuuugauauggguaguauuuuuuacauuuuacacacuguacacaua

SEQ ID NO: 287716 - RNA, 64 nt, hsa
uaacuuaaugaaaacaaugcaguacaggacauauauuuuuuaaaauaagucugauuuaauuggg

SEQ ID NO: 287717 - RNA, 64 nt, hsa
ccauuuacuuaagacuuaaugagacuuuaaaagcauuuuuuaaccuccuaaguaucaaguauag

SEQ ID NO: 287718 - RNA, 64 nt, hsa
guaaggauugugauauuagaggcuggaaauccuuauuuuuuaaaaaaucagauaggcauaaaua

SEQ ID NO: 287719 - RNA, 64 nt, hsa
uaaagguuugauguauauagaaauuccauguuugauuuuuuaaaauauguguauaagucuguca

SEQ ID NO: 287720 - RNA, 64 nt, hsa
uuauguuaucuuaaaaagugcuggugaauuuuccauuuuuuacauccauuucacauguaagaga

SEQ ID NO: 287721 - RNA, 64 nt, hsa
gucacuuuuuuauuuaacugauaagauuuuuguuauuuuuuacuuugauaaguaaaccaaagaa

SEQ ID NO: 287722 - RNA, 64 nt, hsa
guggguggcuauuuugauuuggcaugacuacuuaauuuuuuaaaaaaauugugguuugugaauu

SEQ ID NO: 287723 - RNA, 64 nt, hsa
uguuuuaaagauaugaaaucuguuuacucaaccaauuuuuuaaaugucauauugugauaaugcu

SEQ ID NO: 287724 - RNA, 64 nt, hsa
gcugucugcaguuuacaauguauuguaaaugaagauuuuuuaaauucuaucuugcugauuuuuu

SEQ ID NO: 287725 - RNA, 64 nt, hsa
uguucuaaaaugaaacauauuacuuuguuaguacauuuuuuagugucacacugacuuuuaaaau

SEQ ID NO: 287726 - RNA, 64 nt, hsa
aacuggaacaugcuuuuacuuuauugcccuaacaauuuuuuauuaaauuuauuugaaaaugcau

SEQ ID NO: 287727 - RNA, 64 nt, hsa
cucuucucucauuuaucgaugauccucuuuuuccauuuuuuaaguacuuauguggaagcuaguc

SEQ ID NO: 287728 - RNA, 64 nt, hsa
guacuuuuauuacugagagaucuucauauacuucauuuuuuaauauaaauaauuuuaauaaauu

SEQ ID NO: 287729 - RNA, 64 nt, hsa
uaagaaucgggacaauauuguauucaacuguuuuauuuuuuauauuuuuaaaauuuaaaguaua

SEQ ID NO: 287730 - RNA, 64 nt, hsa
guauuuauuauagcauuuuaaauaaggguaauucauuuuuuauuaaagucauuuucacguuaag

SEQ ID NO: 287731 - RNA, 64 nt, hsa
accugaagucccucugacaucaccuuguuucaucauuuuuuaugacagaauuagaaacccaucc

SEQ ID NO: 287732 - RNA, 64 nt, hsa
aaacuccauuuagguacuucaggaaacaugcagcauuuuuuaaaaaaugaaaauuguuuuucua

SEQ ID NO: 287733 - RNA, 64 nt, hsa
uaaauacuauauguugaacaaauuaaaugucaaaauuuuuuauuaccauaguccauguuaauag

SEQ ID NO: 287734 - RNA, 64 nt, hsa
uuaagaauuuuguaacagaaagcucuauguuuuaauuuuuuauauacaauuaggauaauuagca

SEQ ID NO: 287735 - RNA, 64 nt, hsa
cucaccaaagguaaauaucuguaucuauuaggacauuuuuuacauagacuucaguugagaugua

SEQ ID NO: 287736 - RNA, 64 nt, hsa
uuuaaaauuuacacuucuaagacuagagacccacauuuuuuaaaaaucauuuuauuuugugaua

SEQ ID NO: 287737 - RNA, 64 nt, hsa
ucuugcugugauagguuuugcaagccuuuucauuauuuuuuagcuuuuaugcuugcuuccauua

SEQ ID NO: 287738 - RNA, 64 nt, hsa
uuacuacuguuggagcuuauaaguaaugaucuacauuuuuuaugaagaugguuuuuaaaacuuu

SEQ ID NO: 287739 - RNA, 64 nt, hsa
guaaaguauugauaaauaugagaaugaugguuuuauuuuuuaauuguuacaguaaguaauccuu

SEQ ID NO: 287740 - RNA, 64 nt, hsa
aauagggauaguuggaacuaauguacagaacuaaauuuuuuaaacuuuauuugcuguuaaauuc

SEQ ID NO: 287741 - RNA, 64 nt, hsa
gaagaaagcagagguacuaaucuccaauuaaaaaauuuuuuaacauguaagaauuuuguacuuu

SEQ ID NO: 287742 - RNA, 64 nt, hsa
uuucaaaaagauuucuuauuaccgacuaaaagcuauuuuuuaccucaccuggaaacuaccauug

SEQ ID NO: 287743 - RNA, 64 nt, hsa
cuuagaaugaaaaaggguacuuguuuauauuaauauuuuuuacuugaacacguguagcuugcag

SEQ ID NO: 287744 - RNA, 64 nt, hsa
auaauuuuaauagucacucaaccaaguauuuuuuauuuuuuauggauacucugaauggcaauua

SEQ ID NO: 287745 - RNA, 64 nt, hsa
auaaagcauaauuuuaauagucacucaaccaaguauuuuuuauuuuuuauggauacucugaaug

SEQ ID NO: 287746 - RNA, 64 nt, hsa
cuacaggcaugcaccaccauacccaacuaauuuuauuuuuuauuuuuugcagagauggagucuc

SEQ ID NO: 287747 - RNA, 64 nt, hsa
gugagugguauugccauccuugacauuugacaucauuuuuuauucuuuggucucuuuugacucu

SEQ ID NO: 287748 - RNA, 64 nt, hsa
gggauuacaggcaugagucaccaugccuggccucauuuuuuaaaacaaaugaauaaauggacaa

SEQ ID NO: 287749 - RNA, 64 nt, hsa
aggcacucauuuuuuaauuuuuauuuuauuuuuaauuuuuuauaucuuuaugagacgaucucac

SEQ ID NO: 287750 - RNA, 64 nt, hsa
ucaccaaugcuuggaacacugccugaaggcacucauuuuuuaauuuuuauuuuauuuuuaauuu

SEQ ID NO: 287751 - RNA, 64 nt, hsa
uuauaaaaagugcaauuuuucaaaacacauuauuauuuuuuaauuucccaauuuuuucaguuuu

SEQ ID NO: 287752 - RNA, 64 nt, hsa
ucuaaaaccaaacugaaaucgcuuuggaaaucagauuuuuuaauguuaggaagauccagcaauu

SEQ ID NO: 287753 - RNA, 64 nt, hsa
ucaggcaaauuugaaaauauacacauugagaauaauuuuuuauuauuauauccuauuuuaauau

SEQ ID NO: 287754 - RNA, 64 nt, hsa
ugacaacuaaaacauuccauuguuaugguccugaauuuuuuaugcuucauuucauguauuuauu

SEQ ID NO: 287755 - RNA, 64 nt, hsa
aaaauauauauucacaauuuuaauauuuuaauuuauuuuuuacuauuuaacccuguacuuggca

SEQ ID NO: 287756 - RNA, 64 nt, hsa
uauuuugcuauuaaugugaaaguugucucuaaauauuuuuuaauuuucaaacucauacuuuauu

SEQ ID NO: 287757 - RNA, 64 nt, hsa
aaaacguugacuggggcaaaggauuuuuuauuuuauuuuuuauuuuguuaauuauguuuuuagg

SEQ ID NO: 287758 - RNA, 64 nt, hsa
auggaugcugcaaaaacguugacuggggcaaaggauuuuuuauuuuauuuuuuauuuuguuaau

SEQ ID NO: 287759 - RNA, 64 nt, hsa
uggguuugcguuccaaccugcaaaacacaaauacauuuuuuaaaaucaagaaaauuuaaaaaga

SEQ ID NO: 287760 - RNA, 64 nt, hsa
uuugaucugucaccuauggaaucugagugguuuuauuuuuuagauuucucagucccgaagaucu

SEQ ID NO: 287761 - RNA, 64 nt, hsa
ccucauaaacaaauacaccuauguacccacaaaaauuuuuuaauuaaaaaaaggaaauuugagu

SEQ ID NO: 287762 - RNA, 64 nt, hsa
uacccacugccagcaucaaaaagcaaagauacuaauuuuuuaagccaaaaaucuguacuaacac

SEQ ID NO: 287763 - RNA, 64 nt, hsa
aauuauagcacuaacuugauuuuagaaaaugagcauuuuuuacaacugccauuuacuguaugua

SEQ ID NO: 287764 - RNA, 64 nt, hsa
gagacuuaguuuuugaaguguugaaguauuuuuaauuuuuuaaaugaaaccauauuuuaagugu

SEQ ID NO: 287765 - RNA, 64 nt, hsa
uagugaacuacgcuugcucauuuuuucuuacauaauuuuuuauucaaguuauuguacagcuguu

SEQ ID NO: 287766 - RNA, 64 nt, hsa
cuaucaguuuguccuguagagguuuuguuguuuuauuuuuuauuguuuucaucuguuguuuugu

SEQ ID NO: 287767 - RNA, 64 nt, hsa
cacgugcagucuucagcccauuaaauuaucgauuauuuuuuaaugaauugaauuuauauugagu

SEQ ID NO: 287768 - RNA, 64 nt, hsa
gaauaauuaauguucaaaggcaagagggcaaggcauuuuuuaacacuuuuuaaaauaaaaauuu

SEQ ID NO: 287769 - RNA, 64 nt, hsa
auuaaaaaacaauccuucauuuauuuuuugucuaauuuuuuaguuuucagcauuaugauuuggg

SEQ ID NO: 287770 - RNA, 64 nt, hsa
uugggagaauaguugagaucuggaaagcauagacauuuuuuacacucuggauagacuuuauucu

SEQ ID NO: 287771 - RNA, 64 nt, hsa
uacaaacuucagaagaaagcugacauuuuaaugaauuuuuuaaaaaauuaauaaacaaauuguc

SEQ ID NO: 287772 - RNA, 64 nt, hsa
aaacacugccagaauacuuucuagcugcuuuguaauuuuuuaagaguguuauuuuguuuuuguu

SEQ ID NO: 287773 - RNA, 64 nt, hsa
aaacuuauguggcuuuuugaccuuugaauagggaauuuuuuaaauuuuuuaaaaauuaaaauaa

SEQ ID NO: 287774 - RNA, 64 nt, hsa
uggcuuuuugaccuuugaauagggaauuuuuuaaauuuuuuaaaaauuaaaauaaaaaaaacac

SEQ ID NO: 287775 - RNA, 64 nt, hsa
gcauagauacuauaugguaucaugggacccaucuauuuuuuaccaguggacuacaggauuacuu

SEQ ID NO: 287776 - RNA, 64 nt, hsa
auugugggcagagaucuuuaguucaaauccacguauuuuuuaaaagagagaaccggagguagag

SEQ ID NO: 287777 - RNA, 64 nt, hsa
ugggacuacaggugugcaccaacaugcccagcuaauuuuuuauauuuuuaguagagacgggguu

SEQ ID NO: 287778 - RNA, 64 nt, hsa
cuaccauuuccagaagcuuuuuuaacaagugaauauuuuuuacauaauggauaauaaaugguau

SEQ ID NO: 287779 - RNA, 64 nt, hsa
cgaagaaaauaaaugacuuuaggaagagguauacauuuuuuaagucgcucugccuccaaaucug

SEQ ID NO: 287780 - RNA, 64 nt, hsa
caaggaaaauuagagaaagucacauuuaggguuuauuuuuuacacuuggccaguaaaauagggu

SEQ ID NO: 287781 - RNA, 64 nt, hsa
acuuggccaguaaaauaggguaaauccuauuagaauuuuuuaaagaacuuuuuuuaaguuuccu

SEQ ID NO: 287782 - RNA, 64 nt, hsa
ugugaaccugaaauggcuuuaaauuaauacucuuauuuuuuauuuaauuuaauuacauaaauua

SEQ ID NO: 287783 - RNA, 64 nt, hsa
uguguuauucaugucuuuaaaucagauaccaaauauuuuuuaggaaagaaaaauguuauuacug

SEQ ID NO: 287784 - RNA, 64 nt, hsa
aaacuaauauuuuacauaaaaacuaauacuuucaauuuuuuauauaguaauauccccauuuugu

SEQ ID NO: 287785 - RNA, 64 nt, hsa
aagacauccauucagaaacaaaaauuagcacuaaauuuuuuauaaaauagaccagaugacaaaa

SEQ ID NO: 287786 - RNA, 64 nt, hsa
cgggggaaagaaaaugaaacuuuuuggugugaauauuuuuuaugcugaugugaauuauuuuguu

SEQ ID NO: 287787 - RNA, 64 nt, hsa
auauuauauauauauauguaugcauauauaucauauuuuuuacaaggaacauuuuaugaugaaa

SEQ ID NO: 287788 - RNA, 64 nt, hsa
caauuagaaauugucuuuugaauauacuauauauauuuuuuauguuccaauaauguuuuguaca

SEQ ID NO: 287789 - RNA, 64 nt, hsa
aagcauaugaucucuuuauuagugaaucaugcuuauuuuuuacucuuaaugccacuaauauaca

SEQ ID NO: 287790 - RNA, 64 nt, hsa
uuccacgugacaguucuucacaauuccuuucaucauuuuuuaaauauuuuuuuuacugccuaug

SEQ ID NO: 287791 - RNA, 64 nt, hsa
ugugguaacuacgaagugaugguagauuuaaauaauuuuuuauuuuuauuuuauauauuuuuuc

SEQ ID NO: 287792 - RNA, 64 nt, hsa
aaacaaauuugagguauggauaaaucuuucacauauuuuuuauugcucuuuaguaaagaaaggc

SEQ ID NO: 287793 - RNA, 64 nt, hsa
aacaaaaaaaaaaucuaacugaagaacuaaguugauuuuuuauuugccauaaaccaagcaaaag

SEQ ID NO: 287794 - RNA, 64 nt, hsa
uaaagcuauaauccccagaauuaaaguuuuuauuauuuuuuauacauuguaaaacauagacguu

SEQ ID NO: 287795 - RNA, 64 nt, hsa
cuuaaaugugguacugagcaugaacuuuuuaaacauuuuuuacuucucuccauauuccugacca

SEQ ID NO: 287796 - RNA, 64 nt, hsa
ggauuuauguaggaagaaacuugauuuucaaauaauuuuuuaaauguaucucuugccuaaagga

SEQ ID NO: 287797 - RNA, 64 nt, hsa
agucucaguaaucuagcuuauauaaggucauuacauuuuuuaacugaaaaaccuaguuaccuga

SEQ ID NO: 287798 - RNA, 64 nt, hsa
aaugacaaauugaaccauauguaaguaaucuuuuauuuuuuauuuuuuuuuugagacagagucu

SEQ ID NO: 287799 - RNA, 64 nt, hsa
ugucagcuagccaccugcuuguuuguguugggauauuuuuuagcaccugaagcaccaucugaaa

SEQ ID NO: 287800 - RNA, 64 nt, hsa
uaauaaauucgcauuuuaaagguguuuacagauuauuuuuuauaucuguagcugaauuuguuaa

SEQ ID NO: 287801 - RNA, 64 nt, hsa
uguuucacaauucauuuucuacuaaauguguaccauuuuuuaaauuguuuuaacagaaauauag

SEQ ID NO: 287802 - RNA, 64 nt, hsa
uguuaaaucaggccugacuagagcaaagauaacaauuuuuuacaaacacuguuaagcccuaagu

SEQ ID NO: 287803 - RNA, 64 nt, hsa
agcauauauaugaugcaucggauaggucauuaugauuuuuuaccauuucgacuuacauaaugaa

SEQ ID NO: 287804 - RNA, 64 nt, hsa
uagucaaaaaugcuaaaauaauuugggagaaaauauuuuuuaaguaguguuauaguuucauguu

SEQ ID NO: 287805 - RNA, 64 nt, hsa
aggaaugucuguucuuuaucaaguguauguaacuauuuuuuagaaaugccaucuacuuucuaga

SEQ ID NO: 287806 - RNA, 64 nt, hsa
gagaugucaaauggaagagacuuaggaucaagacauuuuuuaauguuaggcagaacacauucau

SEQ ID NO: 287807 - RNA, 64 nt, hsa
uuguuaaauagauauugugguuuggggaaguugaauuuuuuauagguuaaaugucauuuuagag

SEQ ID NO: 287808 - RNA, 64 nt, hsa
ugauaaaagcaacuuagcaaggcuucuuuucauuauuuuuuauguuucacuuauaaagucuuag

SEQ ID NO: 287809 - RNA, 64 nt, hsa
uccagauaaucuggagguuagcauuugauaaaugauuuuuuaaaguagauaugaagauuuuguu

SEQ ID NO: 287810 - RNA, 64 nt, hsa
aauuuuucccccuacuuucuugcuucuguuucacauuuuuuaaaagggcaaguacaggagcaac

SEQ ID NO: 287811 - RNA, 64 nt, hsa
ugacauuauaugguaugauaugaaaaaaucaccaauuuuuuacauauaaaagauaccuuuuuaa

SEQ ID NO: 287812 - RNA, 64 nt, hsa
cucuauuuccuaaauaucauucuauacaaaagauauuuuuuaaacgguaaggauuaagacaauc

SEQ ID NO: 287813 - RNA, 64 nt, hsa
cuagaauguaacuaaauugcuuauaaaugucagcauuuuuuaaagguacaguauauggggauug

SEQ ID NO: 287814 - RNA, 64 nt, hsa
auggugucugcugugcauggcauuuuauauguuaauuuuuuaguuuaaaaugaaguauauugaa

SEQ ID NO: 287815 - RNA, 64 nt, hsa
aguuuuuaugagaaguauauuauauuaaaugugaauuuuuuaaauuuugcuucuuauacuggaa

SEQ ID NO: 287816 - RNA, 64 nt, hsa
uaauuuacuacauauuaguacuauauucguaaggauuuuuuauuaaccauuacagauuuuacaa

SEQ ID NO: 287817 - RNA, 64 nt, hsa
cauauuggaguccaaaacuugaauucuggguugaauuuuuuaaaaaucagguaccacuugauuu

SEQ ID NO: 287818 - RNA, 64 nt, hsa
cugguuuugucgacguaaacauuuaaaguguuauauuuuuuauaaaaauguuuauuuuuaauga

SEQ ID NO: 287819 - RNA, 64 nt, hsa
cauauuauggcaucguuuucuagucuacuucaaaauuuuuuacacguuugcagaggugcaauca

SEQ ID NO: 287820 - RNA, 64 nt, hsa
uuuuuaaaaggaagaaagcggauuuuggaauugcauuuuuuaaagcaccacucuugauuuucug

SEQ ID NO: 287821 - RNA, 64 nt, hsa
aagcagugaggcugguguguaugauugucuuaaaauuuuuuaauagauauggccgagcgugaug

SEQ ID NO: 287822 - RNA, 64 nt, hsa
aacuuuaauguauugaaaugcauaaauaaaauuuauuuuuuauauuuuguuuagaguaacagug

SEQ ID NO: 287823 - RNA, 64 nt, hsa
cuauuucauaucuaccuacaauugaccaaaaaaaauuuuuuaggccagcaauuauuauuuagcu

SEQ ID NO: 287824 - RNA, 64 nt, hsa
uuguuaagaccccuauugccucuucuucaugcucauuuuuuacuuuuuuuaaaagguacuuuuc

SEQ ID NO: 287825 - RNA, 64 nt, hsa
uauugacucuuagaugcuauugaucuguagcaccauuuuuuacaaacgacuaaggaaaaaaccu

SEQ ID NO: 287826 - RNA, 64 nt, hsa
cguguguuuuauacaaaaauggaauugauaaaccauuuuuuacaaaauuaauuugucucaaaac

SEQ ID NO: 287827 - RNA, 64 nt, hsa
aaauaguuaaaaugcugacauaacaccaaacuucauuuuuuaaaaaaucuguuguuccaaaugu

SEQ ID NO: 287828 - RNA, 64 nt, hsa
ucaucaaaaagaaaaaucaaaguagaaacuacuaauuuuuuaagaggaauuuauaacaaauaug

SEQ ID NO: 287829 - RNA, 64 nt, hsa
guacagagaaaugugauaauuuuuuauaauaaauauuuuuuaugaugauaaaagacauuguguu

SEQ ID NO: 287830 - RNA, 64 nt, hsa
uuugucuuuaugcuauguacagagaaaugugauaauuuuuuauaauaaauauuuuuuaugauga

SEQ ID NO: 287831 - RNA, 64 nt, hsa
aagacuacaggaguuaacagauggccagcuccuuauuuuuuaauguagaauaacuccugaguuu

SEQ ID NO: 287832 - RNA, 64 nt, hsa
guuugcuguguuuucuucagagcaagaagguuauauuuuuuaaaauuuacuuaguaaugcacau

SEQ ID NO: 287833 - RNA, 64 nt, hsa
cagguaugagccaccaugcccggcuggcaguuguauuuuuuaaagcccuucugaugauuccaau

SEQ ID NO: 287834 - RNA, 64 nt, hsa
aggcacacacugccgcgcccagcuaauuuuuuguauuuuuuaguagagacaggguuucacugug

SEQ ID NO: 287835 - RNA, 64 nt, hsa
caucauuuuuggcuccuuagcauggccacuuacaauuuuuuaacaugagauaacacaucaggug

SEQ ID NO: 287836 - RNA, 64 nt, hsa
uguauguauaccaaacaagauuguuguaaaucauauuuuuuauuacaacacuaaguucugcuuc

SEQ ID NO: 287837 - RNA, 64 nt, hsa
uuugauauaaacgugcaauuaaaauucaaaguuuauuuuuuaucacaagcaccuuugaaaugua

SEQ ID NO: 287838 - RNA, 64 nt, hsa
ugcuggaguugucauggccgcaguucagugugagauuuuuuaccagguauugcgcuuaagggac

SEQ ID NO: 287839 - RNA, 64 nt, hsa
cugcuuuagagcuguguguugagcuaaaaauauaauuuuuuaaaaauugacuagcaaaaucuau

SEQ ID NO: 287840 - RNA, 64 nt, hsa
gcaggaccuuucaauaaauauuuauuuggucaaaauuuuuuauuuugauuuuauuaaaugggaa

SEQ ID NO: 287841 - RNA, 64 nt, hsa
auugcuuuuugagauuuuugcguguguguuugauauuuuuuacgauaauuagcugcaugugaau

SEQ ID NO: 287842 - RNA, 64 nt, hsa
uagcugcaugugaauuuuucaugaccuucuuuacauuuuuuauuuuuuauuucuuuauuuuuuu

SEQ ID NO: 287843 - RNA, 64 nt, hsa
augugaauuuuucaugaccuucuuuacauuuuuuauuuuuuauuucuuuauuuuuuuuucucua

SEQ ID NO: 287844 - RNA, 64 nt, hsa
gauuaucuccuccacuauaauccucuuuagggugauuuuuuaaaucaaaacccagugaaucuca

SEQ ID NO: 287845 - RNA, 64 nt, hsa
caucugugccaauuacaaagcaauuaaaagauuuauuuuuuaugaucugguguagugacugaau

SEQ ID NO: 287846 - RNA, 64 nt, hsa
agugguggggacuuuguuuauuuauuuauuuuuaauuuuuuaauuuuauauuauuauuauuauu

SEQ ID NO: 287847 - RNA, 64 nt, hsa
ucauccaugucccuacaaaggacaugaacucaucauuuuuuauggcugcauaguauuccauggu

SEQ ID NO: 287848 - RNA, 64 nt, hsa
aaaauauaacggguauauuuguuauucuaacucuauuuuuuaaaguuaauaauauaaaguggcc

SEQ ID NO: 287849 - RNA, 64 nt, hsa
aaucacauccaauuauuugaacacaugcaaaauaauuuuuuaaauuauguuauuguuuaaauuu

SEQ ID NO: 287850 - RNA, 64 nt, hsa
caaacuguaaaagauugaaauaaucuuucucaggauuuuuuaaaugucuaagauuaugauguca

SEQ ID NO: 287851 - RNA, 64 nt, hsa
auaaauuuuauuguuggaaaucaaaaauuaguagauuuuuuaccauguuaaauuauagugagau

SEQ ID NO: 287852 - RNA, 64 nt, hsa
uucugaaaauugcauuuuauuaccauuucaaacuauuuuuuaaaaauaaauacaguuaacauag

SEQ ID NO: 287853 - RNA, 64 nt, hsa
uauccaccccaggccagguggaaguaacugaauuauuuuuuaaauuaagcaguucuacucgauc

SEQ ID NO: 287854 - RNA, 64 nt, hsa
uuacaagagagcacaaguuggccuacauuuuuauauuuuuuaagaagauacuuugagaugcauu

SEQ ID NO: 287855 - RNA, 64 nt, hsa
aauaacuuuguugccaaaagguugugcuauccagauuuuuuauaugucugcauguuuaaaaaaa

SEQ ID NO: 287856 - RNA, 64 nt, hsa
agaauuuguaggcguauacagcuuuaaaugauuuauuuuuuaugaaaauguuaacugaugagau

SEQ ID NO: 287857 - RNA, 64 nt, hsa
cuucuuaggacagcuaucuuuagaucacuugcucauuuuuuaauuggguuauuugucuuuuuau

SEQ ID NO: 287858 - RNA, 64 nt, hsa
cugaacacaggguuccagaguacuuaaacacaacauuuuuuaaaucgugauuucggccuauuuc

SEQ ID NO: 287859 - RNA, 64 nt, hsa
gcugucuuccaaguauuauuuuuacuguuaaaaaauuuuuuaaaaaugugaaauguaauguuuu

SEQ ID NO: 287860 - RNA, 64 nt, hsa
uuaaagcaauuuucucccauugugcgaacauuuuauuuuuuaaaaaaaagaaacaaaaauauuu

SEQ ID NO: 287861 - RNA, 64 nt, hsa
auaacaaguuuuuccaaauauuuuuuacuuauauauuuuuuaacauuuagcgauuuuuaauguu

SEQ ID NO: 287862 - RNA, 64 nt, hsa
cuauugaaauaagacauaacaaguuuuuccaaauauuuuuuacuuauauauuuuuuaacauuua

SEQ ID NO: 287863 - RNA, 64 nt, hsa
auaauagcagaguggccuguucuaagaaggccauauuuuuuaaguuaucuuucaggguaacaug

SEQ ID NO: 287864 - RNA, 64 nt, hsa
cacauaucagugauacaauuucuugcugucaccaauuuuuuauaauagcagaguggccuguucu

SEQ ID NO: 287865 - RNA, 64 nt, hsa
acuacauauuacuuguuucugguaaucaagucuuauuuuuuaaaagccuauuguuuuucagaau

SEQ ID NO: 287866 - RNA, 64 nt, hsa
uuagagagaaggauuguuuucaguuuuuaagagaauuuuuuaaaaauacauuuuaugguucucu

SEQ ID NO: 287867 - RNA, 64 nt, hsa
aaugcaggugucaggaaaugucaaauauaauuccauuuuuuauuuuuauuuuuuuaagcuuuug

SEQ ID NO: 287868 - RNA, 64 nt, hsa
aauguuaacugccaagcuuggagugaccuaaagcauuuuuuaaaagcauggcuagauuuacuuc

SEQ ID NO: 287869 - RNA, 64 nt, hsa
gcacaccaaguuauaugacuaauauaacuugaaaauuuuuuauacugagggguuggugauaacu

SEQ ID NO: 287870 - RNA, 64 nt, hsa
ggaggaggaaaugcuagagaacagcaggucuaauauuuuuuaaguuuacugagagaccuuuauu

SEQ ID NO: 287871 - RNA, 64 nt, hsa
aaaaagagugaagauaguacuagcaaguauacuuauuuuuuaaaacaggcuagaaucucauguu

SEQ ID NO: 287872 - RNA, 64 nt, hsa
uuuaaugugcuaaauauaucuuguaugauuuuuuauuuuuuaauaacauuggaaauauauucaa

SEQ ID NO: 287873 - RNA, 64 nt, hsa
cuuaaguuuuaaugugcuaaauauaucuuguaugauuuuuuauuuuuuaauaacauuggaaaua

SEQ ID NO: 287874 - RNA, 64 nt, hsa
aucucucagauguguugaagcauccauugcauccauuuuuuauuauuuucuuaguuuuguucuu

SEQ ID NO: 287875 - RNA, 64 nt, hsa
uauaaaggaauaguauggauaaguggaauuguacauuuuuuaaacuugauugccauuaaagcag

SEQ ID NO: 287876 - RNA, 64 nt, hsa
uuugaauaguuuuauauuaauaaaagaagacaaaauuuuuuaaauguuagaaaaagcagaucug

SEQ ID NO: 287877 - RNA, 64 nt, hsa
aauugcuaguuuauauuuuagauauaaacaucauauuuuuuauuaauaccuacaucaaauggaa

SEQ ID NO: 287878 - RNA, 64 nt, hsa
acugcuuaguccuuucucagauacucuuaaaacaauuuuuuauuguuaaauuugugguaauaca

SEQ ID NO: 287879 - RNA, 64 nt, hsa
ucacagcacagcugcagacacaacaacgugcagcauuuuuuacauaaaaauaugguagaauuaa

SEQ ID NO: 287880 - RNA, 64 nt, hsa
cuggagaccuuuguuauucauucuuuuuaagguuauuuuuuauuaacugugcauaugaaauuuc

SEQ ID NO: 287881 - RNA, 64 nt, hsa
gcugacaaguuaccaguucaccugaucagaauguauuuuuuauaaccaccaucauuccuugucu

SEQ ID NO: 287882 - RNA, 64 nt, hsa
uaucaugagcuaguccuaggccucaaaguacuguauuuuuuauuuuuaccugauuugcagucau

SEQ ID NO: 287883 - RNA, 64 nt, hsa
cauuuaaaaauuuaaaaauugaagugcaaaaaaaauuuuuuagcaauuuuuguaaaacugugua

SEQ ID NO: 287884 - RNA, 64 nt, hsa
uacuuuuguauuugaauuuugauuuucuauuuuuauuuuuuaaauauuguauuugugcacaaug

SEQ ID NO: 287885 - RNA, 64 nt, hsa
uuucuauuuguagaccauaucugaaagaaauaacauuuuuuaaggcucuaccacauagacaaua

SEQ ID NO: 287886 - RNA, 64 nt, hsa
cuucauuaauacuguguuaccuuuuaaaauaguaauuuuuuacauuuuccuguguaaaccuaau

SEQ ID NO: 287887 - RNA, 64 nt, hsa
uguaagacuucagauuucaaauuaaucuuucuauauuuuuuaaauuuacagaauauuauauaac

SEQ ID NO: 287888 - RNA, 64 nt, hsa
agaugggaggagaggguaaaagaauaguacucugauuuuuuaagaauuaguaucuacuaucuug

SEQ ID NO: 287889 - RNA, 64 nt, hsa
cuguucuacuguuuuaaaaguuccucucuauuuuauuuuuuauuuaacaugaaguaaaauugaa

SEQ ID NO: 287890 - RNA, 64 nt, hsa
aucaggaagauuggacuaagugauccugaaauguauuuuuuagcacuggauuucuacaaauaau

SEQ ID NO: 287891 - RNA, 64 nt, hsa
uaaaaucucauauuauuuuuuuuuuaauuuuuuuauuuuuuaugacagggucucacuaugucac

SEQ ID NO: 287892 - RNA, 64 nt, hsa
cuggcucaauuuucuucugucaaauuauaugguuauuuuuuauauuaccacaucagcauuauau

SEQ ID NO: 287893 - RNA, 64 nt, hsa
ugauuaggaaauucauguaagacuuuuuaagaguauuuuuuagguuuucacucaaucuuuccug

SEQ ID NO: 287894 - RNA, 64 nt, hsa
acuguacguaguuaagucguagcuauaacuucaaauuuuuuaaaagagacaaacuguaaaaaau

SEQ ID NO: 287895 - RNA, 64 nt, hsa
uugguuuaauauuaccuaaugaaagugaugacauauuuuuuauaucuggaaugagccuguuggg

SEQ ID NO: 287896 - RNA, 64 nt, hsa
uuaaacucauauugaaacuucaucuagucucuuaauuuuuuaacacuaaauucaagucauuugu

SEQ ID NO: 287897 - RNA, 64 nt, hsa
cuuucacuuaugguucauugguuuuuguaccaauauuuuuuaugcacuucagugcaagucuugu

SEQ ID NO: 287898 - RNA, 64 nt, hsa
uauuaauuuuugaaaagguuuuuuuuauucugcaauuuuuuauuuuuguucuacacaugaauuu

SEQ ID NO: 287899 - RNA, 64 nt, hsa
uuuauauacuaaaauuaaggguggagaagaucuuauuuuuuaaaucauggucauaauuuuucuu

SEQ ID NO: 287900 - RNA, 64 nt, hsa
cucaauaccugcuucacuugauaaucauauuauaauuuuuuaucaugauuauugacuauauuuu

SEQ ID NO: 287901 - RNA, 64 nt, hsa
aagaaucuauagcauuaguauacacuggcacauaauuuuuuaaaaaguuuuaagaaaagauuca

SEQ ID NO: 287902 - RNA, 64 nt, hsa
uauauauaucuaaaugaaugcaaugugcauaaauauuuuuuaaacauaacagugaacuauugca

SEQ ID NO: 287903 - RNA, 64 nt, hsa
ugcuaauuucaaaugaagauuccugccuuaaaauauuuuuuaauuuaauggucaguauauuuug

SEQ ID NO: 287904 - RNA, 64 nt, hsa
uaagaaaagaauccuuaaaaucuagauuuauaccauuuuuuaaagucccaccuuucaauguuua

SEQ ID NO: 287905 - RNA, 64 nt, hsa
acagccuuaagaauugcaguggagcaaauuggucauuuuuuaaaaaaauauauuuuaaccuaca

SEQ ID NO: 287906 - RNA, 64 nt, hsa
gacucugaaugaauuauuuuuuuuuauauauccuauuuuuuauguaguguaugcguagccucua

SEQ ID NO: 287907 - RNA, 64 nt, hsa
uuuuggauuaaaaaguauuauaucauggacauacauuuuuuaaaguaccaaagguauuugguaa

SEQ ID NO: 287908 - RNA, 64 nt, hsa
caugcuuguguaauuggcuuuguuuauaauuuuuauuuuuuaauaugggucagacuuuuggauu

SEQ ID NO: 287909 - RNA, 64 nt, hsa
aucuaaaggauauuauuguuugaauuuuuggguuauuuuuuaaaacuucauugcuguuuuugac

SEQ ID NO: 287910 - RNA, 64 nt, hsa
uagcagaaaaauaccuuaaaggaacaaaaaauccauuuuuuauaauaaugcuuuuuguaaacaa

SEQ ID NO: 287911 - RNA, 64 nt, hsa
guuauauuaaaagagaggguccuucaaaaaaauuauuuuuuaaaacacagagguguucugaccu

SEQ ID NO: 287912 - RNA, 64 nt, hsa
aaauuaagaaucuauauaagcuauaaaaauacucauuuuuuaaaaaaaguuuuuuucauucaaa

SEQ ID NO: 287913 - RNA, 64 nt, hsa
cuuugauucacaccuuugucugcuugguaccuuaauuuuuuauaccugauuugucacucgugac

SEQ ID NO: 287914 - RNA, 64 nt, hsa
aauuguuuaaaguauuauauguaaacauauggguauuuuuuauuuuguguaauuuuacauuuca

SEQ ID NO: 287915 - RNA, 64 nt, hsa
uuaaacaaaguauauguaaaaggugaaagguuauauuuuuuacagaucagaauguggcaccaga

SEQ ID NO: 287916 - RNA, 64 nt, hsa
auuuguguccaaagaauuuauagcuuuucuggacauuuuuuauuauuucuugggugugacauca

SEQ ID NO: 287917 - RNA, 64 nt, hsa
aaaaaaauaugaaaugugugcucaacugccaguaauuuuuuaaaaagcacugucccaguggauu

SEQ ID NO: 287918 - RNA, 64 nt, hsa
accuguuuugccuuauacauuuuagaaacuggaaauuuuuuaaagaaaaugcuuuaguuuucuu

SEQ ID NO: 287919 - RNA, 64 nt, hsa
ucaugguggcaauauccuuuuaauguguuuuaacauuuuuuaaucaacaucguuuaaaaauaau

SEQ ID NO: 287920 - RNA, 64 nt, hsa
uuaauuuuagagccaaauuuuucuaucuuguuggauuuuuuacaguguuuaagauagacacuua

SEQ ID NO: 287921 - RNA, 64 nt, hsa
guggaaguuaugaaagaauguaauucacuaaauuauuuuuuaaaugaaaccuuuuuuuuucuuu

SEQ ID NO: 287922 - RNA, 64 nt, hsa
ugugugugcaguuauauuuuauauggacgaccaaauuuuuuauuaagaugaguaaauauuugaa

SEQ ID NO: 287923 - RNA, 64 nt, hsa
gacucuugaaggcaauccuuccucuggccaggaaauuuuuuaaaaaauaauacuguguuguguu

SEQ ID NO: 287924 - RNA, 64 nt, hsa
uaguaaguaauaaagucucuuauuagaaucuuguauuuuuuaauugagcuaaucaaaauaauuc

SEQ ID NO: 287925 - RNA, 64 nt, hsa
aaauugaggagauugauucauaauucacaugucaauuuuuuauaguaauauguacuucuaauuu

SEQ ID NO: 287926 - RNA, 64 nt, hsa
aagucauuuuuucacccuguauaguaugggaauuauuuuuuauguuaaauagaaacugaaugua

SEQ ID NO: 287927 - RNA, 64 nt, hsa
cuucccucaaggggcuccccucccgugcauggacauuuuuuaaaccaccgauuccaagaggaug

SEQ ID NO: 287928 - RNA, 64 nt, hsa
ggggagaucccagccuccacaaagaggcccuuuuauuuuuuauucugauuagccauuuuaaacc

SEQ ID NO: 287929 - RNA, 64 nt, hsa
uaaacagauuaccaguuuuuuacuugugggugugauuuuuuaaaauaguucuuuauauauaauu

SEQ ID NO: 287930 - RNA, 64 nt, hsa
guuaagugcacuuguauugcuuuuuaaucuguuaauuuuuuaaagacccaagcagucauuuuga

SEQ ID NO: 287931 - RNA, 64 nt, hsa
cugggaaacauagcagaccucguuucuacuaaaaauuuuuuaaaaaagaaaauuagggcaaggu

SEQ ID NO: 287932 - RNA, 64 nt, hsa
gggcaacaugaugugaaaacccaucucuacaaaaauuuuuuaaaaaauaagccagggauugugg

SEQ ID NO: 287933 - RNA, 64 nt, hsa
gcacuucauagggagaagcacuuaugacaaggcuauuuuuuaaaccgcgguauuauccuaauuu

SEQ ID NO: 287934 - RNA, 64 nt, hsa
uuauccuaauuuaaaagaagaucgguuuuuaauaauuuuuuauuuucauaggaugaaguuagag

SEQ ID NO: 287935 - RNA, 64 nt, hsa
uauuugucucuuacaucuccuugaucaugucuucauuuuuuaaugugcucuguaccugucaaaa

SEQ ID NO: 287936 - RNA, 64 nt, hsa
aggaacgugccaccaugacuggcuaauuuucuguauuuuuuaguagagacagaguuucaccaug

SEQ ID NO: 287937 - RNA, 64 nt, hsa
cugccauuuaugugcuuuuauucccccuucaaaaauuuuuuauuggauauauauauuuuucagu

SEQ ID NO: 287938 - RNA, 64 nt, hsa
aggugcccucauaccucuugacauuaaugacuucauuuuuuagcuugaauuuguuagcaaauau

SEQ ID NO: 287939 - RNA, 64 nt, hsa
uuaaauggaaauuuccauacaucuuccccauacuauuuuuuauaaaagagccuauucaauagcu

SEQ ID NO: 287940 - RNA, 64 nt, hsa
uguauuaagcacaagauaaagaacagcuguuaauauuuuuuaaaaaucuauuuuaaaaugugau

SEQ ID NO: 287941 - RNA, 64 nt, hsa
caauauuaugcagauuuaugccuuauuuuuuagcauuuuuuaagguugggucuuucaggcuggu

SEQ ID NO: 287942 - RNA, 64 nt, hsa
aaauaaaacucaauauuaugcagauuuaugccuuauuuuuuagcauuuuuuaagguugggucuu

SEQ ID NO: 287943 - RNA, 64 nt, hsa
uuauuaaagguggcauggagacuguggagggaauauuuuuuaaagcacuacucauauccuuuaa

SEQ ID NO: 287944 - RNA, 64 nt, hsa
aaaugcuuaggaccaggaguguuucaggcuucagauuuuuuaagauuugggaauauuugcaugu

SEQ ID NO: 287945 - RNA, 64 nt, hsa
cuccuuccuaaagagcacuuuuguauuguaauuuauuuuuuauuaugcuuuaaacacuauguaa

SEQ ID NO: 287946 - RNA, 64 nt, hsa
uuaaauguauagaccuugauauuuuuccaauacuauuuuuuaaaaaauuguaugauuuacauau

SEQ ID NO: 287947 - RNA, 64 nt, hsa
acuauuuuccaacuuguauuuucauauaauuuauauuuuuuaaaagcugaaaauuuagaagcaa

SEQ ID NO: 287948 - RNA, 64 nt, hsa
gaauuguuauucuauuuuuuauuuuccagaacucauuuuuuaccuucaggggugggagcuaagu

SEQ ID NO: 287949 - RNA, 64 nt, hsa
guugguuggacucugaauuuugaauuguuauucuauuuuuuauuuuccagaacucauuuuuuac

SEQ ID NO: 287950 - RNA, 64 nt, hsa
cacagauuugaaggaaaaaaauuuugauguaacaauuuuuuaaauaaaauuuuguuuuucugua

SEQ ID NO: 287951 - RNA, 64 nt, hsa
aaagugaugacuucuaaugcuuauaucucaagguauuuuuuaaaaaagcaacggucccuaauag

SEQ ID NO: 287952 - RNA, 64 nt, hsa
gguccuuggacuuuuagcuguuaaaugguaucucauuuuuuaaaacacauuucacauuuaaagu

SEQ ID NO: 287953 - RNA, 64 nt, hsa
agaugccaacguugucuuugauaauauuuaauauauuuuuuaaaaaacaauucuuguaaaauac

SEQ ID NO: 287954 - RNA, 64 nt, hsa
uauuauauuuguagaaguauuagaaaaauauucuauuuuuuauucagugcugcguaauuaccca

SEQ ID NO: 287955 - RNA, 64 nt, hsa
auuacaggcgugagccaccaugcccggcccaaauauuuuuuauucaggaugguauaaccuaacu

SEQ ID NO: 287956 - RNA, 64 nt, hsa
ggaauucacugaaacaguaccagcaagucaugagauuuuuuaguaaagaugagaaagaugguug

SEQ ID NO: 287957 - RNA, 64 nt, hsa
uuauuaacuauaauauaugauggauuuuuuccuaauuuuuuauauuuccuuacaauuuuggugg

SEQ ID NO: 287958 - RNA, 64 nt, hsa
aucugcauaaaugguaaccaguagcucuacuuuuauuuuuuauguugcuuaacuguuuuauuug

SEQ ID NO: 287959 - RNA, 64 nt, hsa
ugauguuuaucagaacuguucacuuucagaaaugauuuuuuaaagcauuuuguugaaaaugcgg

SEQ ID NO: 287960 - RNA, 64 nt, hsa
uaagaaauaugggguuuagaaugggguugacuguauuuuuuaaccuaauucuggagagaagauu

SEQ ID NO: 287961 - RNA, 64 nt, hsa
guauuuuuuaaccuaauucuggagagaagauuguauuuuuuacaguuuuuuggguuuggcuucc

SEQ ID NO: 287962 - RNA, 64 nt, hsa
uuugccugccuuguaauaacaagacucagugcuuauuuuuuaaacugcauuuuaaaaauuggau

SEQ ID NO: 287963 - RNA, 64 nt, hsa
uggguuuauaggugcccgccaccagacccggcuaauuuuuuaguuuuaguagagacgggguuuc

SEQ ID NO: 287964 - RNA, 64 nt, hsa
cuuuguacugcauuuauagagauuuagcuuuaauauuuuuuagagauguaaaacauucugcuuu

SEQ ID NO: 287965 - RNA, 64 nt, hsa
guauuuaccuguuaagagauuauuuagucuuuaaauuuuuuagguuaauuuucuugcugugaua

SEQ ID NO: 287966 - RNA, 64 nt, hsa
acaguuuguauauuuuuaaaugaauaccaauuuaauuuuuuaguauuuaccuguuaagagauua

SEQ ID NO: 287967 - RNA, 64 nt, hsa
gagccugaaaagauuuguauuuaauacacauaacauuuuuuaguucauucugccuuuccuauuu

SEQ ID NO: 287968 - RNA, 64 nt, hsa
cuuuggggaaugggugggaaaggauuguuugaguauuuuuuaaaagggaaacaguaccaaggag

SEQ ID NO: 287969 - RNA, 64 nt, hsa
acuaaagcauuuuaaauaauaccugccuuguaccauuuuuuaaauagaaguuacuucauuauau

SEQ ID NO: 287970 - RNA, 64 nt, hsa
gaaugaugcucauauaagaauaccuuuuuaaacuauuuuuuaacuuuguuuuaugcaaaaaagu

SEQ ID NO: 287971 - RNA, 64 nt, hsa
uguuugagauuugaaauuauacaucaugcuucucauuuuuuaaacuauguucuuuaaaucaaca

SEQ ID NO: 287972 - RNA, 64 nt, hsa
agcuugaacauuauucacuuagauuucuuccaguauuuuuuaaaaaacuguccuaucucauuuu

SEQ ID NO: 287973 - RNA, 64 nt, hsa
ccuuucuguuuuuuuuuaagugagcuuuucuuuaauuuuuuauguuuacuuauucccuucacag

SEQ ID NO: 287974 - RNA, 64 nt, hsa
uacaggauaauauuagccuuauuacccccacaagauuuuuuaaaacuugagguagguagcuaca

SEQ ID NO: 287975 - RNA, 64 nt, hsa
uacugugcccaguuuccuucacuacaugcccugcauuuuuuauuuaaauauuuagcuguagcgc

SEQ ID NO: 287976 - RNA, 64 nt, hsa
ucuugcccaggcugcuuuuuaaaaauauuuuuuuauuuuuuacuuauuuuuaaauuuucucuuu

SEQ ID NO: 287977 - RNA, 64 nt, hsa
ucuuuuuuagccagcacauuaaauuuuagauuuuauuuuuuaaucuaauuuuuuucuaaucaaa

SEQ ID NO: 287978 - RNA, 64 nt, hsa
ugugaauuugggggugcaggggcaggaguuggaaauuuuuuaaaguuagaaggcuccauuguuu

SEQ ID NO: 287979 - RNA, 64 nt, hsa
uugaaaauaacucauuauaccaauucacuauuuuauuuuuuaaugaauuaaaacuagaaaacaa

SEQ ID NO: 287980 - RNA, 64 nt, hsa
cuuaacuguucuuccuggcgcuaaaaagagcuguauuuuuuaaagugcuggggcaaacaaagca

SEQ ID NO: 287981 - RNA, 64 nt, hsa
uuugauuuaaaauuaugcagggccccuaugugggauuuuuuaaaaagcaaacugguguguauuc

SEQ ID NO: 287982 - RNA, 64 nt, hsa
gcauaauuucagcuucuauauauuguauguauauauuuuuuaaaaaucuauauuuugggaaaaa

SEQ ID NO: 287983 - RNA, 64 nt, hsa
cauugugugugcagacuucaggagaacucauguuauuuuuuaaccccgucaacaaaucuaggaa

SEQ ID NO: 287984 - RNA, 64 nt, hsa
uuuguuuuuuccacuuguauaugcacuaauuuuaauuuuuuaaagacuuuuucugaucuuugaa

SEQ ID NO: 287985 - RNA, 64 nt, hsa
ugccugcuagucagauacauuuacauuuaugcaaauuuuuuaaauaggagaaaauuaagaaauu

SEQ ID NO: 287986 - RNA, 64 nt, hsa
ccaaugccaagacaaaauuauuuuucuuauacuuauuuuuuauuaaacaaaaugaaaaagaucc

SEQ ID NO: 287987 - RNA, 64 nt, hsa
gauaacugagaggcucagaaucuuuaccaaggauauuuuuuaggauaagguagcugccuguuca

SEQ ID NO: 287988 - RNA, 64 nt, hsa
cauaaccccacccuuuacauuuugugcagugauuauuuuuuaaagucuucuuucauguaaguag

SEQ ID NO: 287989 - RNA, 64 nt, hsa
aaaucuuaagagaauccacauaaaagaagaaacuauuuuuuaaaaauucacuucuauauauaca

SEQ ID NO: 287990 - RNA, 64 nt, hsa
cuuuuccuuuuuacuucuggcuuauuuuaaaaauauuuuuuaucuauuuacuguguguuuaagc

SEQ ID NO: 287991 - RNA, 64 nt, hsa
uaagcaagcaacagugcacugaucugguaguuaaauuuuuuaauuaaauaguuaaaauaaugua

SEQ ID NO: 287992 - RNA, 64 nt, hsa
uuuuuaugaugaugaaaauuuuaccagcagaaggauuuuuuaaaguuuuuuuuuuuuuuuuaau

SEQ ID NO: 287993 - RNA, 64 nt, hsa
aaauauguacaauugugggcauaaacuguuucagauuuuuuauuugaagguuuuaagugguuug

SEQ ID NO: 287994 - RNA, 64 nt, hsa
guguggagaaauuaaagagugaaggccauauuucauuuuuuauaaauuaucuuucaagcucaga

SEQ ID NO: 287995 - RNA, 64 nt, hsa
agguaaagauggaaaugacagagcacagacauuuauuuuuuaaauugauaggguagaaaaugaa

SEQ ID NO: 287996 - RNA, 64 nt, hsa
uugauuuuuuuucuauuaaaacuguuguuaaaauauuuuuuaaaacaaaaacauuauuugugcc

SEQ ID NO: 287997 - RNA, 64 nt, hsa
uauuagcucacugggguggggagaagccacuaccauuuuuuaggugauggggaugccacugagu

SEQ ID NO: 287998 - RNA, 64 nt, hsa
ucuuuccccaugucauuuuuuauuguuccuugccauuuuuuaaucacacauguauguucuccaa

SEQ ID NO: 287999 - RNA, 64 nt, hsa
guucuuccuauuuucuuaccucuuuccccaugucauuuuuuauuguuccuugccauuuuuuaau

SEQ ID NO: 288000 - RNA, 64 nt, hsa
aggcaaauguggaauuccucacagauuaaccaguauuuuuuaaauguauucauuccuacaaauu

SEQ ID NO: 288001 - RNA, 64 nt, hsa
ucagaauguuugucauaugcuucuugcaaugcauauuuuuuaaucucaaacguuucaauaaaac

SEQ ID NO: 288002 - RNA, 64 nt, hsa
uucuauaugaguggguuuacugguaaauuauguuauuuuuuacaacuaauuuuguacucucaga

SEQ ID NO: 288003 - RNA, 64 nt, hsa
ucaaaagcaguugaguaacagcaacauaaaccacauuuuuuaaaaaaaugagcacuuuucauuc

SEQ ID NO: 288004 - RNA, 64 nt, hsa
aaggacaauuuguguuggaugguauucaaaaggaauuuuuuaaaacauuaagcaacaguguaau

SEQ ID NO: 288005 - RNA, 64 nt, hsa
gagauuuuuuguuguuauuguuguuguugcuagaauuuuuuauagcuuagauauaaaaggucuc

SEQ ID NO: 288006 - RNA, 64 nt, hsa
auuuuuugguugccuaaaguggcuauaguuacugauuuuuuauuauguaagcaaaaccaauaaa

SEQ ID NO: 288007 - RNA, 64 nt, hsa
gggaauuaagaaagccucgucgugaaagcacuuaauuuuuuacaguuagcacuucaacauagcu

SEQ ID NO: 288008 - RNA, 64 nt, hsa
auuucaaggauuaucaagguauggaauuuuuuuuauuuuuuaucuuuuaacaaacuuguucauu

SEQ ID NO: 288009 - RNA, 64 nt, hsa
gguacucuaguguuaaguguauuuuuuucaacuaauuuuuuagugaauuuuuuuuaaacuuaca

SEQ ID NO: 288010 - RNA, 64 nt, hsa
gacauucuacuauugaauuauguacaacauuuucauuuuuuaugcuucuugaggugguaaugag

SEQ ID NO: 288011 - RNA, 64 nt, hsa
ucaguuccccuaaaccaauaaacauuuauacuagauuuuuuauuuccacuuaucauuaaugauu

SEQ ID NO: 288012 - RNA, 64 nt, hsa
uguuaauguguacuuauaaauucacauugucaguauuuuuuaauauugggucugaauaauuauc

SEQ ID NO: 288013 - RNA, 64 nt, hsa
uugucuuuucacauaugauguguuuggaacccaaauuuuuuacugauuuuauuguguuguuggu

SEQ ID NO: 288014 - RNA, 64 nt, hsa
uucucuuguauuuuucuuacuuacuauggguuacauuuuuuauuuuucaaauuggaugauaauu

SEQ ID NO: 288015 - RNA, 64 nt, hsa
uauuuuucaaauuggaugauaauuucuuggaaacauuuuuuauguuuuaguaaacaguauuuuu

SEQ ID NO: 288016 - RNA, 64 nt, hsa
aaugcuugauguuuuaaaauaauaacauuuuuauauuuuuuaaaagacaaacuucauauuaucc

SEQ ID NO: 288017 - RNA, 64 nt, hsa
cagucugguaauacuauucuauuuuauuuaaaauauuuuuuauugaaauauuaauguuuauuac

SEQ ID NO: 288018 - RNA, 64 nt, hsa
aaauaacuauuuuguaucuacagucggauaauggauuuuuuauuuuguauauuuauucuauuuu

SEQ ID NO: 288019 - RNA, 64 nt, hsa
auuguuaagugcaauaaaguuuuugccuugcuuuauuuuuuaauacauaaaacuuacauucuca

SEQ ID NO: 288020 - RNA, 64 nt, hsa
aaguuuuccaguauugaaaacuucaaagcugaauauuuuuuauuucuaaguauuuaaauguucu

SEQ ID NO: 288021 - RNA, 64 nt, hsa
uaaaguauguuuuuaaauuuuaaaaagcagcugcauuuuuuauuuaguuggaauaucacccaau

SEQ ID NO: 288022 - RNA, 64 nt, hsa
agcugcauuuuuuauuuaguuggaauaucacccaauuuuuuauuuuuauugcuauuaaaauauc

SEQ ID NO: 288023 - RNA, 64 nt, hsa
uuuggugaauuuccucaauguuuuauaaauguacauuuuuuaaguccuuaagcugacucuuagc

SEQ ID NO: 288024 - RNA, 64 nt, hsa
cuuuccuuaagacuuuaaaaauguauuuaaaacuauuuuuuauuaaauacuuugugauuuccua

SEQ ID NO: 288025 - RNA, 64 nt, hsa
ggcagacuuugcuuuuuuaacaugugagaaaugaauuuuuuauuuugugauuuaugugauuucu

SEQ ID NO: 288026 - RNA, 64 nt, hsa
uuauuuauuuuucuaaaacucuuacuaaauccagauuuuuuaaacuguuuuaaaugugaauucu

SEQ ID NO: 288027 - RNA, 64 nt, hsa
ggaugacaggugcgagccacugcaccuggcccacauuuuuuaaagagacacugucccacuccau

SEQ ID NO: 288028 - RNA, 64 nt, hsa
uauucuggucauuauccuauuuugauuuuauuuaauuuuuuaaaguugaagaauuaaauauuuu

SEQ ID NO: 288029 - RNA, 64 nt, hsa
uuaaacauacucuuguuuaaguguguguugcuaaauuuuuuacugucauuacuaaauaaucugu

SEQ ID NO: 288030 - RNA, 64 nt, hsa
gcagcaguaagagaaacuagugcugcaagaauguauuuuuuaaugaaguuccuuauuuugucuu

SEQ ID NO: 288031 - RNA, 64 nt, hsa
gugaugauuaaaguuaggaaaacauacauuuuuuauuuuuuaauuaguagcugcuaucagagac

SEQ ID NO: 288032 - RNA, 64 nt, hsa
uuaucuggugaugauuaaaguuaggaaaacauacauuuuuuauuuuuuaauuaguagcugcuau

SEQ ID NO: 288033 - RNA, 64 nt, hsa
agacucgagucuuugggaaacucauuauauauauauuuuuuaaagaguuugaagcaacuguuug

SEQ ID NO: 288034 - RNA, 64 nt, hsa
uauguucaauguauggucauacuuuuuaaauuugauuuuuuaaauauuauaaguggucaugaaa

SEQ ID NO: 288035 - RNA, 64 nt, hsa
gucaugugaggcaauaugcauucuuuguauucugauuuuuuaaguguuuucauauuuauagcca

SEQ ID NO: 288036 - RNA, 64 nt, hsa
auuuuagagccauccauccugaauuuuauaaaugauuuuuuauuuaaaaauuugagauuuuuaa

SEQ ID NO: 288037 - RNA, 64 nt, hsa
ggaaggugcuggagaucccaagugaagugugugcauuuuuuauaacuguacuucuggugacugu

SEQ ID NO: 288038 - RNA, 64 nt, hsa
ugagugccauguauaucacaugaacccacauuuuauuuuuuauuaccagagcauaucuauuaua

SEQ ID NO: 288039 - RNA, 64 nt, hsa
gugcaaguuaguuaacaugaaccuucauuuguaaauuuuuuaaaauuucuuuuauaauaugcuu

SEQ ID NO: 288040 - RNA, 64 nt, hsa
uuaauuccgauuuggaaccuuagaugucuauuugauuuuuuaaaaaaccuuaauguaagauaug

SEQ ID NO: 288041 - RNA, 64 nt, hsa
acauuuuaaaaaccagaauauguagucuacggauauuuuuuaucauaaaaaugaucuuuggcua

SEQ ID NO: 288042 - RNA, 64 nt, hsa
gcauuuuuaaauaaaauaccaauaucaggaagccauuuuuuauuucaggaaauguaagaaacca

SEQ ID NO: 288043 - RNA, 64 nt, hsa
ccuucauccuccauugguccuuuuuuuuucuuucauuuuuuauuuaauuucuuuucuuccuguc

SEQ ID NO: 288044 - RNA, 64 nt, hsa
guaggcacuugcuguauuuuuacuggagcucguaauuuuuuaacuguaagcuuguccuuuuaaa

SEQ ID NO: 288045 - RNA, 64 nt, hsa
aaauaaaaaguggcaugcaguuuuuuuuuuaauuauuuuuuaauuuuuuuuuugguuuuuguuu

SEQ ID NO: 288046 - RNA, 64 nt, hsa
agucaaaacucuaagugguuaaaaauuaguaugaauuuuuuagcuucuuaaugaauauggauuu

SEQ ID NO: 288047 - RNA, 64 nt, hsa
ugaaaugacuugccuuucugguaauacaaugcugauuuuuuaguaauugccuuuucauuacuuu

SEQ ID NO: 288048 - RNA, 64 nt, hsa
gauucuuaguguaguuaugauguggauccuacguauuuuuuaaaaaacucuccagauaauuuug

SEQ ID NO: 288049 - RNA, 64 nt, hsa
uaaacuuacuagcuuuaccuucuaaaaguacugcauuuuuuacuuuuuuuuaugaucaaggaaa

SEQ ID NO: 288050 - RNA, 64 nt, hsa
uauuuugcuuuaauugcuuuaaaucuuaagcaauauuuuuuauucaguaaacaaauucuuucac

SEQ ID NO: 288051 - RNA, 64 nt, hsa
uguuuugucuuuuuuuauuacuaguguuuaagucauuuuuuacuugaaucagauggugucauuu

SEQ ID NO: 288052 - RNA, 64 nt, hsa
uuauaaaaugcuccuagaagucuuaauuguguuuauuuuuuaaaaaaacaaauguuagacuugu

SEQ ID NO: 288053 - RNA, 64 nt, hsa
gcagaggaagacuccuuuuuucaucacuguaugaauuuuuuauaauguuuuuuuaaaauauauu

SEQ ID NO: 288054 - RNA, 64 nt, hsa
augauuaaggaagacuauaucuagaucaugucugauuuuuuauugugacuucuccagcccuggu

SEQ ID NO: 288055 - RNA, 64 nt, hsa
gcacaggggcccugaauuuaugugguuuuuauacauuuuuuaauaagaugcacuuuaugucauu

SEQ ID NO: 288056 - RNA, 64 nt, hsa
uuuauacauuuuuuaauaagaugcacuuuaugucauuuuuuaauaaagucugaagaauuacugu

SEQ ID NO: 288057 - RNA, 64 nt, hsa
caugaaacuuaccuaaucuucaaauguuagcuucauuuuuuaccuuugaaauacuuaaucuuuc

SEQ ID NO: 288058 - RNA, 64 nt, hsa
gcaagucaaauucuaauguguguacuucauaauaauuuuuuauccauuuucaucuuuauauucu

SEQ ID NO: 288059 - RNA, 64 nt, hsa
aacauguguauagugaugcugaaaaaugugcauuauuuuuuauuuauauuuuaggaauaauaaa

SEQ ID NO: 288060 - RNA, 64 nt, hsa
acauccccaugaaguaaacacuauuauuauccucauuuuuuaguugaggaaacugaggcucaua

SEQ ID NO: 288061 - RNA, 64 nt, hsa
uggaggagagauuuuucuaucauguagaguagguauuuuuuauagauugaagguugaucaauuu

SEQ ID NO: 288062 - RNA, 64 nt, hsa
gaguagguauuuuuuauagauugaagguugaucaauuuuuuaauacuuucaagagaaaacugug

SEQ ID NO: 288063 - RNA, 58 nt, hsa
ugaaaucugucacuguguaaaaagacagauuuuuuaaauugacuuaauuacuaaguca

SEQ ID NO: 288064 - RNA, 64 nt, hsa
ggaguuuacuguaaugugaaauuuucacauuugaauuuuuuaauugccuggcaaaagcugauau

SEQ ID NO: 288065 - RNA, 64 nt, hsa
ucuggugaaaagguuaaaucguagaagcuaguauauuuuuuauauuuuuguaacaauugcuuuu

SEQ ID NO: 288066 - RNA, 64 nt, hsa
gggguuaguauuuauaguccuaacaaguccaguaauuuuuuauaaaucuucagauuauaaacag

SEQ ID NO: 288067 - RNA, 64 nt, hsa
guuuugcacuaugauuauaauaccugcauuucuaauuuuuuaagcauguagccaguaauaauuu

SEQ ID NO: 288068 - RNA, 64 nt, hsa
aauagaaccuuuugagaugaauuaauguaagaauauuuuuuaaauaggcuuacugucaaauugc

SEQ ID NO: 288069 - RNA, 64 nt, hsa
ucagcuacucuaguucuguuguuuuguguauauaauuuuuuaaaaaaaauuugugugcuucugc

SEQ ID NO: 288070 - RNA, 64 nt, hsa
ugggaccacaggcaugcaccacuacgcaugacuaauuuuuuaaauauuugagacggggucuccc

SEQ ID NO: 288071 - RNA, 64 nt, hsa
ccacugcaccugcccagcuccccaacucccugccauuuuuuaagagacaguuucgcuccaucgc

SEQ ID NO: 288072 - RNA, 64 nt, hsa
uaaaacuuuggcgguucuugcauaacauugucagauuuuuuaguguauuucugugaagucauuu

SEQ ID NO: 288073 - RNA, 64 nt, hsa
uaguaguugcuguuuggauaaaaguugaugugugauuuuuuauuaaacaaauaguaaacccuuc

SEQ ID NO: 288074 - RNA, 64 nt, hsa
uuacauaaaauuagaguaugaaaaccaguguucaauuuuuuaucuuguugagcuuguaaaaugc

SEQ ID NO: 288075 - RNA, 64 nt, hsa
guuguucugacgugugaaauuuaaggaaagagccauuuuuuaaaaaugccgagcagggcaaugc

SEQ ID NO: 288076 - RNA, 64 nt, hsa
gauugcuuggcuauugucugaauauuuccuuuuaauuuuuuaauuaaagacuaaugcuuugauu

SEQ ID NO: 288077 - RNA, 64 nt, hsa
uaauggcagagauuaaaaguauuccaugcucaguauuuuuuauuguccugcuacagcuagugug

SEQ ID NO: 288078 - RNA, 64 nt, hsa
uuuguuuuuucgccaugugaugaagaccacugugauuuuuuaaaaaaguagauaauacuuaaaa

SEQ ID NO: 288079 - RNA, 64 nt, hsa
cauuuugaaaugggcucuugauuaauagacccauauuuuuuaguggcuucuauguuguauauuu

SEQ ID NO: 288080 - RNA, 64 nt, hsa
uuuaaauuuuaaugcaaaauuuuaauuugucuuuauuuuuuaucauuugaacugauaagcacuu

SEQ ID NO: 288081 - RNA, 64 nt, hsa
cuuugaauuuuguugucuaaauagcuccugcuuuauuuuuuaaauuaaauuuuuuguuuuuacu

SEQ ID NO: 288082 - RNA, 64 nt, hsa
uuccugugcggcccuucguugcccuccugcuuucauuuuuuaaagaaaucuugagugcuugagg

SEQ ID NO: 288083 - RNA, 64 nt, hsa
guaacauuuaccggcuguguacagcaaacaagcuauuuuuuagaaaccgacguuucagggaaga

SEQ ID NO: 288084 - RNA, 64 nt, hsa
ugggacuaccagugcauaccaccaugccugggugauuuuuuaaauuuuuuauacagacaagguc

SEQ ID NO: 288085 - RNA, 64 nt, hsa
cagugcauaccaccaugccugggugauuuuuuaaauuuuuuauacagacaaggucuugcuaugu

SEQ ID NO: 288086 - RNA, 64 nt, hsa
caaaaaaguuauuuauuuuggucccuaugauuuuauuuuuuaagauaaauuaauauacuguauu

SEQ ID NO: 288087 - RNA, 64 nt, hsa
ugauuuuauuuuuuaagauaaauuaauauacuguauuuuuuaaaguauagguuuagguuuacag

SEQ ID NO: 288088 - RNA, 64 nt, hsa
gguuccuccaugucuuuuugugacuugauagcucauuuuuuauugcugaauaauguucauugua

SEQ ID NO: 288089 - RNA, 64 nt, hsa
aagcagcugcugcuccugcuaugaggguguauauauuuuuuacccaaagcucuggaauuguaca

SEQ ID NO: 288090 - RNA, 64 nt, hsa
uauuuuuuacccaaagcucuggaauuguacauuuauuuuuuaaaacucaaagagggaaagagcc

SEQ ID NO: 288091 - RNA, 64 nt, hsa
uggaaauuauuucugcuucuuaaaaaaaccuaagauuuuuuaaaaaauugauuuguuuugauca

SEQ ID NO: 288092 - RNA, 64 nt, hsa
cuugcagaauuuuuuuuucuauauauacauauauauuuuuuaccaaaaugaaucauuacucuau

SEQ ID NO: 288093 - RNA, 64 nt, hsa
aaucugguuggugucuuacaagugagcugacaccauuuuuuauucuguguauuuagaaugaagu

SEQ ID NO: 288094 - RNA, 64 nt, hsa
uuccaaaauuguguccguuuucuugagcguuuugauuuuuuacuuuuagcuuauaccagcugaa

SEQ ID NO: 288095 - RNA, 64 nt, hsa
aauguuucuuagagccaagugucuuuuaaacauuauuuuuuauuucugauuucauaauucagaa

SEQ ID NO: 288096 - RNA, 64 nt, hsa
uuauccaaaaugcuugggaccagaaguguuucagauuuuuuaaaauuuuggaauauuugcuuua

SEQ ID NO: 288097 - RNA, 64 nt, hsa
auccuaaauguguuuuuaagauuuuuaugauuuuauuuuuuacacuuaagucuuuaaucccucu

SEQ ID NO: 288098 - RNA, 64 nt, hsa
uuauaggaaaauauuuguaucauuuccuuuuuagauuuuuuauuuuacucauuuuacuuaaaag

SEQ ID NO: 288099 - RNA, 64 nt, hsa
uauuuguuauuagugauacuuuauuuuauauaauauuuuuuauucacagugaaauuucauucau

SEQ ID NO: 288100 - RNA, 64 nt, hsa
uuucucaguaauguuuuuguuagcuuuugguuccauuuuuuauugugcaugcagaauguacauu

SEQ ID NO: 288101 - RNA, 64 nt, hsa
agaagaggcugugaucuaacauuuauuugcugccauuuuuuacucuggggagaagcagccccaa

SEQ ID NO: 288102 - RNA, 64 nt, hsa
auauugaagagggggccaaaaaacaaccacauggauuuuuuauaggaacaacaaccuaaucuca

SEQ ID NO: 288103 - RNA, 64 nt, hsa
uuuuuuaaguugcaauauguuuuugguuuuuuucauuuuuuaaucauugcaguuaagagaaaug

SEQ ID NO: 288104 - RNA, 64 nt, hsa
uuaaaaaaaaaauuaacuaaaccaagaugcugugauuuuuuaaguugcaauauguuuuugguuu

SEQ ID NO: 288105 - RNA, 64 nt, hsa
auuggcuauugccguuuucuuugaaaaaauaaacauuuuuuaaaaaacuaugcaugguuguccu

SEQ ID NO: 288106 - RNA, 64 nt, hsa
uauacaguuuuccuuuauucaguacaaucuuuucauuuuuuaauucaaacuguuuuguucagaa

SEQ ID NO: 288107 - RNA, 64 nt, hsa
caggcacgggcuuccuuuucugaucaaacauaccauuuuuuauauuucacaacuauagacaguc

SEQ ID NO: 288108 - RNA, 64 nt, hsa
guuuauguagaaaauucacaaaucuguucauuuaauuuuuuaauuugagaauuuuuauuucuuu

SEQ ID NO: 288109 - RNA, 64 nt, hsa
acuuuuauaauuuuaauuugaagauugaauaaauauuuuuuauaaagauuguuuugagugcuga

SEQ ID NO: 288110 - RNA, 64 nt, hsa
aaaauuaauguuuuucuuuguaacauuuauauauauuuuuuaacauuuuaaguuuaacagauug

SEQ ID NO: 288111 - RNA, 64 nt, hsa
ccugggccuugccugcuauggaauauugagagagauuuuuuaaaaaagauuuugcauuuugucc

SEQ ID NO: 288112 - RNA, 64 nt, hsa
ucaguguuaaaucauuugcauaagauuuaacagcauuuuuuauaaugaauguaaacauuuuaac

SEQ ID NO: 288113 - RNA, 64 nt, hsa
cucacuguguugcccagccugggugucaauaauuauuuuuuaaaaaaaauuuuuaaaaagguuu

SEQ ID NO: 288114 - RNA, 64 nt, hsa
gaccgcaggcacuugccaccacgccccacuaaaaauuuuuuaaauuguugccuuucuugaagug

SEQ ID NO: 288115 - RNA, 64 nt, hsa
aacuugaagugcuaaauggaauaauccaaaggaaauuuuuuaaaugcagguucuagcugaaaaa

SEQ ID NO: 288116 - RNA, 64 nt, hsa
guuugucagguuauauauagaauuucuauuaaggauuuuuuaaauggacaagcaauaggggguu

SEQ ID NO: 288117 - RNA, 64 nt, hsa
ucuguauugcaacuuuucucagagauugcaaaggauuuuuuagguagagauuauuuuuccuuau

SEQ ID NO: 288118 - RNA, 64 nt, hsa
uguuaccaaccuccaaagggcucuuuaaaaucauauuuuuuauucauuugaggaugucuuauaa

SEQ ID NO: 288119 - RNA, 64 nt, hsa
auuauuuccucuuaucaacaacuugugacaugagauuuuuuaagggcuuuaugugaacuaugau

SEQ ID NO: 288120 - RNA, 64 nt, hsa
agaaagugaguuaaucuuguaugagguugcauugauuuuuuaaggcaauauauaauugaaacua

SEQ ID NO: 288121 - RNA, 64 nt, hsa
gaaguaagaccccuuccuuagauuccuguuauacauuuuuuaaaauguagaguuuguuuuggag

SEQ ID NO: 288122 - RNA, 64 nt, hsa
cuuuaugacuuuuaaaaaaaauuacaaaccaagaauuuuuuaaagcagaagaugcuauuugugg

SEQ ID NO: 288123 - RNA, 64 nt, hsa
guaaguuuuuacaaauuguuuaauaccuaguuguauuuuuuaccuuaagccacauugaguuuug

SEQ ID NO: 288124 - RNA, 64 nt, hsa
uauauguauguguucauguaaauuugguauaguaauuuuuuauucauucaacaaauauuuauug

SEQ ID NO: 288125 - RNA, 64 nt, hsa
ccuauguguauucaauaguaaauagacaaauuuuauuuuuuauuuccacuugaagaguuacauu

SEQ ID NO: 288126 - RNA, 64 nt, hsa
ccauauuugucuugcacauuauaaauauauuuuuauuuuuuaguaauuuaggggagggaggagg

SEQ ID NO: 288127 - RNA, 64 nt, hsa
aacauagggggaucccaucucuacacacaaaaaaauuuuuuaaugaaccaggcauuguggcaug

SEQ ID NO: 288128 - RNA, 64 nt, hsa
caacuccugcccucaagugauccgccucggucccauuuuuuauucuuuggguccuuccauccca

SEQ ID NO: 288129 - RNA, 64 nt, hsa
cacacacacacacauuuuucucuuguagauuuuaauuuuuuaagugggaaagaacucaccuugc

SEQ ID NO: 288130 - RNA, 64 nt, hsa
uggacauuaauguacuucuuggacauuuuaauaaauuuuuuaacaguucaaccugcccgucacc

SEQ ID NO: 288131 - RNA, 64 nt, hsa
agucaacugcucuuccuacugacucaaauaguuuauuuuuuaaaaauacuuauauaauacaugc

SEQ ID NO: 288132 - RNA, 64 nt, hsa
caugaauuauuuugugucuugcuuauuucacucaauuuuuuaagaucuguacauuauugcaugu

SEQ ID NO: 288133 - RNA, 64 nt, hsa
uauauugcuguuuauccuauugauggauauuuguauuuuuuauacuuuuguguaauaauaaaaa

SEQ ID NO: 288134 - RNA, 64 nt, hsa
uuuuugugaaguguguguugaagccuugcagauuauuuuuuaaauuagagguuuaucacuaggu

SEQ ID NO: 288135 - RNA, 64 nt, hsa
aaagcuuuaaguuugaucacauccaauuaaucacauuuuuuaauaguuaugcuuuuauuuguuu

SEQ ID NO: 288136 - RNA, 64 nt, hsa
uucuauauagaaaugucaucugcaaauacagaccauuuuuuaucuuucaucuuaccuguaauau

SEQ ID NO: 288137 - RNA, 64 nt, hsa
cauccuaagucagggacugucuguauauaucugcauuuuuuagugauuguucuacuauuacagu

SEQ ID NO: 288138 - RNA, 64 nt, hsa
uggguucuuuuguacaccuucuguuucuuugcuuauuuuuuaacgccaaagaaagacucucaga

SEQ ID NO: 288139 - RNA, 64 nt, hsa
uaagaguuaaugguaagugaacaauuuuaaauuuauuuuuuauuauguaacauacuuuuauuaa

SEQ ID NO: 288140 - RNA, 64 nt, hsa
aggcauaagccacugcacccagcugaaaguugguauuuuuuaaugcacugaauaauuguuuuua

SEQ ID NO: 288141 - RNA, 64 nt, hsa
uauuuuacuaauacuuuuauauaaaaugcaguauauuuuuuaaauuucagauuauaugugaugu

SEQ ID NO: 288142 - RNA, 64 nt, hsa
cauacuaaaacauauuuuugcagauacaggaaaaauuuuuuaaaaauuuuaaucauuaagucug

SEQ ID NO: 288143 - RNA, 64 nt, hsa
aaguaucuuucaguuuuauaauaacaguagagcuauuuuuuauaaauuagccugauggaacaau

SEQ ID NO: 288144 - RNA, 64 nt, hsa
caaauguuaauauuccaguuuccauugguaggaaauuuuuuagguaaguucaggcauauguaug

SEQ ID NO: 288145 - RNA, 64 nt, hsa
aaaaauaccugaugcccuuauuugaagcuccauuauuuuuuaaaaagaaauuauauaaaaauac

SEQ ID NO: 288146 - RNA, 64 nt, hsa
ugggcaacaugaugagaccccaucucuacaaacaauuuuuuaaaaaugagccaggugugguagu

SEQ ID NO: 288147 - RNA, 64 nt, hsa
aucccucuuaagugccaaaacuuuuuuuuaaaccauuuuuuaucguuuuugaaggagaucuuuu

SEQ ID NO: 288148 - RNA, 64 nt, hsa
acuucaugacagcucuuuugguggcucagaagccauuuuuuauagaaucauggaaucuagaaua

SEQ ID NO: 288149 - RNA, 64 nt, hsa
augcaaucacccagcaaguccuaccuguuacgcaauuuuuuaucucaaaaugccgaacgagaaa

SEQ ID NO: 288150 - RNA, 64 nt, hsa
acgcgaaucuagcuuuaacggaagcaaauucauuauuuuuuaaaugcaguggacuuuucaaaaa

SEQ ID NO: 288151 - RNA, 64 nt, hsa
aauucgagcgcgugugaacugaacgcugaucaguauuuuuuaucaacaccugagaacuguuaca

SEQ ID NO: 288152 - RNA, 64 nt, hsa
uauuuuuguaauagucaguuggcaaagcaaacugauuuuuuagacuauuuaucuuccuucccuu

SEQ ID NO: 288153 - RNA, 64 nt, hsa
uagcuccacaagagagaugauacugacuuuuuaaauuuuuuacaagagucuguauuccugauau

SEQ ID NO: 288154 - RNA, 64 nt, hsa
aaaucuccucuuugugaaaucccaucugcauuugauuuuuuauuauuuuauguucccccguuag

SEQ ID NO: 288155 - RNA, 64 nt, hsa
ccaggaccuaaaccuuuaugcuacauuuucgaagauuuuuuaaaaauaauauuguuaaucagua

SEQ ID NO: 288156 - RNA, 64 nt, hsa
ccugaauugugaaaugugucauaagaaacaaaauauuuuuuaaacaagaauaauaaagguugga

SEQ ID NO: 288157 - RNA, 64 nt, hsa
caggccugcggaugcaugaaauaauguuggcauuauuuuuuaauuuuuuaaaaaauaaauggua

SEQ ID NO: 288158 - RNA, 64 nt, hsa
cggaugcaugaaauaauguuggcauuauuuuuuaauuuuuuaaaaaauaaaugguaucuuauuu

SEQ ID NO: 288159 - RNA, 64 nt, hsa
ggaaugugguuuggcauuguuuuauacacacaguauuuuuuauaccuuaaugcuuauucuugau

SEQ ID NO: 288160 - RNA, 64 nt, hsa
uuuguacugucuuuugugacggcauugauugaacauuuuuuacuaguagucuuaugacuuuugu

SEQ ID NO: 288161 - RNA, 64 nt, hsa
uuuuuauuauugacauuaaguaaugguaccauauauuuuuuaaaauacauauugacuugaauug

SEQ ID NO: 288162 - RNA, 64 nt, hsa
caacguaucuauguuguguaggggaaauuuuuucauuuuuuaaaaauucuacuuugguuuuguu

SEQ ID NO: 288163 - RNA, 64 nt, hsa
uguuuguuugguuugaguuugauuuggcuuuuauauuuuuuaaaaucccuuuugcuaccccauc

SEQ ID NO: 288164 - RNA, 64 nt, hsa
guuaaaauuaagggguuuguuuggaauaauauauauuuuuuaugcuuuugucuuucuuaccuga

SEQ ID NO: 288165 - RNA, 64 nt, hsa
augguuuuuacuaaugcuaaaacuuuuaaaguuuauuuuuuaauaaauuguugaguauuacauc

SEQ ID NO: 288166 - RNA, 64 nt, hsa
guacauggaguugacauaauacuuuguaaauugaauuuuuuaaagaaauaggcauuugauaacc

SEQ ID NO: 288167 - RNA, 64 nt, hsa
uggauuugcauacauucuucaagaucccauuugaauuuuuuagugacuaaaccauugugcauuc

SEQ ID NO: 288168 - RNA, 64 nt, hsa
uaauaugcuuauauuguucacuucuuuuuuuuuuauuuuuuaaagaaaucuauuucauaccaug

SEQ ID NO: 288169 - RNA, 64 nt, hsa
uuaauuucuaaguguaagugaauuaaucaucuggauuuuuuauucuuuucagauaggcuuaaca

SEQ ID NO: 288170 - RNA, 64 nt, hsa
ucacuuucuacuuuuuucauuuuguucuguucgaauuuuuuauaaguauguauuacuuuuguaa

SEQ ID NO: 288171 - RNA, 64 nt, hsa
auauuggcaagaaaagaagaauaguuguuuaaauauuuuuuaaaaaacacuugaauaagaauca

SEQ ID NO: 288172 - RNA, 64 nt, hsa
agaagguauucugaccuugugaacaucagaagguauuuuuuaacucccaagcaguagcaggacg

SEQ ID NO: 288173 - RNA, 64 nt, hsa
aagagauacgaauuucuauagacugacuuuuuccauuuuuuaaauguucaugucacauccuaau

SEQ ID NO: 288174 - RNA, 64 nt, hsa
uauuauuuuaaauauuugaccucauuaguuguuaauuuuuuaguuggauaaaaaaaaaacucgc

SEQ ID NO: 288175 - RNA, 64 nt, hsa
ugaugacucuuacauagucuuaagcauuuuugcaauuuuuuaaauguauuaauagagucaaugg

SEQ ID NO: 288176 - RNA, 64 nt, hsa
aacuuugcaaaauucguaauaauuuagugauggaauuuuuuaauaacaugcaguauauaaaugu

SEQ ID NO: 288177 - RNA, 64 nt, hsa
cggguauuuuugugggaauagaaaaaaauuguuuauuuuuuauucuucugaauuaaaccccacu

SEQ ID NO: 288178 - RNA, 64 nt, hsa
ggaauuugugcuauuaucuuccucuccagccccccaacuccaucccucaccacaguugucuagg

SEQ ID NO: 288179 - RNA, 64 nt, hsa
uucaauaucuaaugucaaccaauggggagagccacaacuccaggagagguuccugagcugaguc

SEQ ID NO: 288180 - RNA, 64 nt, hsa
guucccuugaugaagaaguugauaugccuuuucccaacuccagaaagugacaagcucacagacc

SEQ ID NO: 288181 - RNA, 64 nt, hsa
ucugacuguuuccaucaaggguacacugccuucucaacuccaaacugacucuuaagaagacugc

SEQ ID NO: 288182 - RNA, 64 nt, hsa
ggaggccaggcugaccccaccagccagucagcuacaacuccacaucaacuccacaugcgcccag

SEQ ID NO: 288183 - RNA, 64 nt, hsa
ugaccccaccagccagucagcuacaacuccacaucaacuccacaugcgcccagcucgagacuga

SEQ ID NO: 288184 - RNA, 64 nt, hsa
ggugggcugggcggggccccgaucccagaauuaucaacuccacccaucaucauuuggucaugaa

SEQ ID NO: 288185 - RNA, 64 nt, hsa
gaugggguuucaccauguuggccaggcuggucuucaacuccagaucucaggugaucuacccucc

SEQ ID NO: 288186 - RNA, 64 nt, hsa
ccuaacucagauccccuaacuuagauuuggcccccaacuccauuuccugucugucuuagacagc

SEQ ID NO: 288187 - RNA, 64 nt, hsa
cgcaagaccguagaucucaggccucuaacacuuccaacuccagccaccacuuuccugugcauuu

SEQ ID NO: 288188 - RNA, 64 nt, hsa
uuggcugaagcccaguuccuuucccauccauccccaacuccaauaaucccccacuccucgcagg

SEQ ID NO: 288189 - RNA, 64 nt, hsa
ugggcaucucucuccuaaugacgaagcugcucagcaacuccaccugcccgccgcaggaaggagc

SEQ ID NO: 288190 - RNA, 64 nt, hsa
aucaccucuccugccccuagcucagccucauccccaacuccaugccugucuccaaucccaaccc

SEQ ID NO: 288191 - RNA, 64 nt, hsa
gucuccaaucccaacccugcccccaaucuccccucaacuccaauccauaacccccuucaaacca

SEQ ID NO: 288192 - RNA, 64 nt, hsa
acuccaaggaauacugagaugaaaugugguaaaucaacuccacagaaccaccaaaaagaaaaug

SEQ ID NO: 288193 - RNA, 64 nt, hsa
gcuacaaggaguuguuggguuaaauguucauggucaacuccaaggaauacugagaugaaaugug

SEQ ID NO: 288194 - RNA, 64 nt, hsa
uucauagaaucguuggacucauuaaugaaucguucaacuccacucacugaagcccagaccuccg

SEQ ID NO: 288195 - RNA, 64 nt, hsa
uaaugcuuucuguggacaccacugagcucugccucaacuccacccucugcgaccggaggacuau

SEQ ID NO: 288196 - RNA, 64 nt, hsa
gagguacugcccccacaccuccugacaccuccauauaccccagcuauaucugcuuuaaggaguu

SEQ ID NO: 288197 - RNA, 64 nt, hsa
auguaauaacuagaaaauccuuuugacaaaaggaauaccccauuugauaucagagauacacaaa

SEQ ID NO: 288198 - RNA, 64 nt, hsa
acuugggcuaguuagagauccagauucuggauccauaccccauaccuacugaauuagaaacucu

SEQ ID NO: 288199 - RNA, 64 nt, hsa
gaaguuugucaggcagagauguuuaugguugaggauaccccauaugaaucugggaaaugggcua

SEQ ID NO: 288200 - RNA, 64 nt, hsa
ucauccagcauccaaguguggcauggccugcuguauaccccaccccaguacuccacagcaccuu

SEQ ID NO: 288201 - RNA, 64 nt, hsa
gcuuuaggggaacauggagaaagaaggagaccacauaccccaaagugaccuaagaacacuuuaa

SEQ ID NO: 288202 - RNA, 64 nt, hsa
uguaugugguauguauauuuucaguggguuaauuauaccccaugauaccuauuaaaggaaaacc

SEQ ID NO: 288203 - RNA, 64 nt, hsa
uccagcuucuagccauguagugcucucagucuucauaccccagaaauuauugguauauuuguag

SEQ ID NO: 288204 - RNA, 60 nt, hsa
ccucucaucucugcccagcccccucaguggcgcugcuaugcaaggcuugugaacccccag

SEQ ID NO: 288205 - RNA, 60 nt, hsa
ucaagacccccgagcaacauuuguaggggccgcugcuaguuagcuacccuugcccaccgc

SEQ ID NO: 288206 - RNA, 60 nt, hsa
uacuggcaucugauagguagaggucagguacgcugcuaaacacugcagcucccaccacau

SEQ ID NO: 288207 - RNA, 60 nt, hsa
aagagguagcaaaggggcaccugagguucacgcugcuagcguggacauagcccugugaua

SEQ ID NO: 288208 - RNA, 60 nt, hsa
uaucugggaccccagaucaggcucuggagacgcugcuaccugaggggaaggccugagguc

SEQ ID NO: 288209 - RNA, 60 nt, hsa
cugugcauccugcccugucccggguuugcgcgcugcuacagagcuucacgcucuccgcuc

SEQ ID NO: 288210 - RNA, 60 nt, hsa
ggaaaaggugcccagcugccagcccagcuccgcugcuaucuuugccucacuuagucaugu

SEQ ID NO: 288211 - RNA, 60 nt, hsa
uauagaaaguuagagaagaccuuguugaaccgcugcuaaacuugccacaggagcgaugug

SEQ ID NO: 288212 - RNA, 60 nt, hsa
agacgggugcugccggcucagccagccucacgcugcuaggaaauggcucccugaucuauc

SEQ ID NO: 288213 - RNA, 60 nt, hsa
ucagagcucuugcuguuagcuggcagcugacgcugcuaggauaguuaguuuggaaauggu

SEQ ID NO: 288214 - RNA, 60 nt, hsa
cuggacgauuuccuugcaucugagggcagacgcugcuaccggagugaccuggacguggcc

SEQ ID NO: 288215 - RNA, 60 nt, hsa
cuccuugcaaguuuccuaguauaagguaugcgcugcuaccaagauugggguuuuuucguu

SEQ ID NO: 288216 - RNA, 60 nt, hsa
ccucaaccacuuccauuccccaaauaccugcgcugcuaccgaugccucuuggagaccaag

SEQ ID NO: 288217 - RNA, 60 nt, hsa
auguauuuaagaauuugcuguuuuauuuaacgcugcuacucuuaaucuucucuaaauuuu

SEQ ID NO: 288218 - RNA, 60 nt, hsa
agggcagaaggaggugcuugcagggccucucgcugcuacugggacauccacaggaccuaa

SEQ ID NO: 288219 - RNA, 60 nt, hsa
cuuuuuguggguggcugcugccaccaccgccgcugcuauauaguuuagguuucugagguu

SEQ ID NO: 288220 - RNA, 60 nt, hsa
uggggcugaccggcuguagggaccaccagccgcugcuacugugggccgccccggggcagg

SEQ ID NO: 288221 - RNA, 60 nt, hsa
uccugaguagcugggauuacaggcacccgccgcugcuaauuuuuguauuuuuaguagaga

SEQ ID NO: 288222 - RNA, 60 nt, hsa
uucaagucaauucauaaccaaguuuuugaacgcugcuaugaauugcacugugaaaagcac

SEQ ID NO: 288223 - RNA, 60 nt, hsa
ugcaaugaacuuguauuuauccuucuucuccgcugcuauauuuuuggugugauuuuuauu

SEQ ID NO: 288224 - RNA, 60 nt, hsa
ccaauaaguguguugaagcauacaucuuuacgcugcuaauaugucuaaauacauauguua

SEQ ID NO: 288225 - RNA, 60 nt, hsa
ucuggcaggcacaccugagucaccauguagcgcugcuacuggagguagagacggcccuuu

SEQ ID NO: 288226 - RNA, 60 nt, hsa
cugcuguccagccaggccugccugaggccacgcugcuauggaggcugccuccuagucucc

SEQ ID NO: 288227 - RNA, 60 nt, hsa
acugggucaggcagagugggcgacaauaaacgcugcuaggagaaucgagccuucugaaua

SEQ ID NO: 288228 - RNA, 60 nt, hsa
uuucuuagccaggaaagacaaauaauccaacgcugcuagucuuaaccccagaccagagag

SEQ ID NO: 288229 - RNA, 60 nt, hsa
gaauucuguguuuaaacgaucacaauaggccgcugcuaucagauuuuagaaauaaaugca

SEQ ID NO: 288230 - RNA, 60 nt, hsa
gcaggcaggaagcagcccugggggacuggacgcugcuauugauucauuaaaaaaagaaaa

SEQ ID NO: 288231 - RNA, 60 nt, hsa
gggacaggccgcagcuccauuuucuuauugcgcugcuaccguugacuuccaggcacgguu

SEQ ID NO: 288232 - RNA, 60 nt, hsa
augcaaaacgucaaaaucugcuucugugaccgcugcuauaggcguggagcugaggcucgg

SEQ ID NO: 288233 - RNA, 60 nt, hsa
uccagagccaugagccaagagcccucuucacgcugcuaacuccaggggacagacgaaggg

SEQ ID NO: 288234 - RNA, 60 nt, hsa
guuuuaagacccccaguuaaugccugaaaccgcugcuaguaccaaacccuaauguuuuuu

SEQ ID NO: 288235 - RNA, 60 nt, hsa
uuuguucaguuugguuuuuuuuuuuuuuugcgcugcuaagaagcuaaagucauccauccu

SEQ ID NO: 288236 - RNA, 60 nt, hsa
caugguuaaaacaggaguuguguucucugucgcugcuaaauuauucuucacuugagugaa

SEQ ID NO: 288237 - RNA, 60 nt, hsa
gaaauccaaggaggacaaagacuccagccacgcugcuaaauagggcuccucucuccucuc

SEQ ID NO: 288238 - RNA, 60 nt, hsa
guggggcugcucugacugagguauggagaccgcugcuaugggaucgucaccugguucggg

SEQ ID NO: 288239 - RNA, 60 nt, hsa
ucugggacauugugcucaggaauuugaaaacgcugcuauacuuacucugguuacuacauu

SEQ ID NO: 288240 - RNA, 60 nt, hsa
uugucccugccaucuacugucugaggccaucgcugcuacacuuuguuuuuauuuguauuu

SEQ ID NO: 288241 - RNA, 60 nt, hsa
ccauccgcaucuuuucuuaaaggcagcgggcgcugcuagugcgcaccgugcugggggaag

SEQ ID NO: 288242 - RNA, 60 nt, hsa
auguaaaacucuaaugauuuggccaugaggcgcugcuauuauaagcagcuggaaaugaau

SEQ ID NO: 288243 - RNA, 60 nt, hsa
cauucacaucgcagauucucccuugcucugcgcugcuagagugacucacuaauucauuaa

SEQ ID NO: 288244 - RNA, 60 nt, hsa
accccuugcaaagggggugugucccacaaacgcugcuaugggugggguggggggcugggg

SEQ ID NO: 288245 - RNA, 60 nt, hsa
uccccagacucagcuccagaauaccuucuucgcugcuagagaagggggauuggagggaag

SEQ ID NO: 288246 - RNA, 53 nt, hsa
cucccauguaugucgauugauaucgcugcuacaucagacucuagaaaaaaggg

SEQ ID NO: 288247 - RNA, 56 nt, hsa
aagacgccuuccugggguagcugagccgcugcuacgccuauccucgccacuaccuc

SEQ ID NO: 288248 - RNA, 60 nt, hsa
ggucuccgccuccucugcuucuccuuucuccgcugcuauagaccaguucauugugugugg

SEQ ID NO: 288249 - RNA, 60 nt, hsa
agguaccccaggcugcacagcauggucguccgcugcuaucuucucauccagcaguacucu

SEQ ID NO: 288250 - RNA, 60 nt, hsa
auggcugggacuccucgcgggaggggacugcgcugcuauagcucuugcugccucucuuga

SEQ ID NO: 288251 - RNA, 60 nt, hsa
agcgggccggcucggcuucugaccuggcaccgcugcuacggcggccuagcaaauuccgcc

SEQ ID NO: 288252 - RNA, 60 nt, hsa
ucuucguccgaaaggaggggaggggggacucgcugcuacaagccucgcccccugugccac

SEQ ID NO: 288253 - RNA, 60 nt, hsa
gaaagggaggcgcugggguuugaaccuccccgcugcuaaucuccccugggccccuccccg

SEQ ID NO: 288254 - RNA, 60 nt, hsa
ccugcagugucugcucacugcugccaucuucgcugcuagucaggguuccauccucuuucc

SEQ ID NO: 288255 - RNA, 60 nt, hsa
guguguguuuuuuuuccuuuaaagaagaaacgcugcuaagaucccacguggcucccacgu

SEQ ID NO: 288256 - RNA, 60 nt, hsa
gguucuugaugcucaccugaagccccuagacgcugcuaggagggggggcccuccugggcc

SEQ ID NO: 288257 - RNA, 60 nt, hsa
cuccugggcccccaauaccccuccgcuugccgcugcuagcgcaccccugcaguccagcgu

SEQ ID NO: 288258 - RNA, 60 nt, hsa
ucacuuuugcugcugcggggcccacacagccgcugcuacuuugggggguggggaaggggc

SEQ ID NO: 288259 - RNA, 62 nt, hsa
agccucucaucucugcccagcccccucaguggcgcugcuaugcaaggcuugugaacccccag

SEQ ID NO: 288260 - RNA, 62 nt, hsa
gcucaagacccccgagcaacauuuguaggggccgcugcuaguuagcuacccuugcccaccgc

SEQ ID NO: 288261 - RNA, 62 nt, hsa
aguacuggcaucugauagguagaggucagguacgcugcuaaacacugcagcucccaccacau

SEQ ID NO: 288262 - RNA, 62 nt, hsa
aaaagagguagcaaaggggcaccugagguucacgcugcuagcguggacauagcccugugaua

SEQ ID NO: 288263 - RNA, 62 nt, hsa
gguaucugggaccccagaucaggcucuggagacgcugcuaccugaggggaaggccugagguc

SEQ ID NO: 288264 - RNA, 62 nt, hsa
ggcugugcauccugcccugucccggguuugcgcgcugcuacagagcuucacgcucuccgcuc

SEQ ID NO: 288265 - RNA, 62 nt, hsa
agggaaaaggugcccagcugccagcccagcuccgcugcuaucuuugccucacuuagucaugu

SEQ ID NO: 288266 - RNA, 62 nt, hsa
cuuauagaaaguuagagaagaccuuguugaaccgcugcuaaacuugccacaggagcgaugug

SEQ ID NO: 288267 - RNA, 62 nt, hsa
ccagacgggugcugccggcucagccagccucacgcugcuaggaaauggcucccugaucuauc

SEQ ID NO: 288268 - RNA, 62 nt, hsa
ccucagagcucuugcuguuagcuggcagcugacgcugcuaggauaguuaguuuggaaauggu

SEQ ID NO: 288269 - RNA, 62 nt, hsa
ggcuggacgauuuccuugcaucugagggcagacgcugcuaccggagugaccuggacguggcc

SEQ ID NO: 288270 - RNA, 62 nt, hsa
gucuccuugcaaguuuccuaguauaagguaugcgcugcuaccaagauugggguuuuuucguu

SEQ ID NO: 288271 - RNA, 62 nt, hsa
ccccucaaccacuuccauuccccaaauaccugcgcugcuaccgaugccucuuggagaccaag

SEQ ID NO: 288272 - RNA, 62 nt, hsa
uaauguauuuaagaauuugcuguuuuauuuaacgcugcuacucuuaaucuucucuaaauuuu

SEQ ID NO: 288273 - RNA, 62 nt, hsa
cuagggcagaaggaggugcuugcagggccucucgcugcuacugggacauccacaggaccuaa

SEQ ID NO: 288274 - RNA, 62 nt, hsa
ugcuuuuuguggguggcugcugccaccaccgccgcugcuauauaguuuagguuucugagguu

SEQ ID NO: 288275 - RNA, 62 nt, hsa
cuuggggcugaccggcuguagggaccaccagccgcugcuacugugggccgccccggggcagg

SEQ ID NO: 288276 - RNA, 62 nt, hsa
ccuccugaguagcugggauuacaggcacccgccgcugcuaauuuuuguauuuuuaguagaga

SEQ ID NO: 288277 - RNA, 62 nt, hsa
ccuucaagucaauucauaaccaaguuuuugaacgcugcuaugaauugcacugugaaaagcac

SEQ ID NO: 288278 - RNA, 62 nt, hsa
ugugcaaugaacuuguauuuauccuucuucuccgcugcuauauuuuuggugugauuuuuauu

SEQ ID NO: 288279 - RNA, 62 nt, hsa
ccccaauaaguguguugaagcauacaucuuuacgcugcuaauaugucuaaauacauauguua

SEQ ID NO: 288280 - RNA, 62 nt, hsa
caucuggcaggcacaccugagucaccauguagcgcugcuacuggagguagagacggcccuuu

SEQ ID NO: 288281 - RNA, 62 nt, hsa
ugcugcuguccagccaggccugccugaggccacgcugcuauggaggcugccuccuagucucc

SEQ ID NO: 288282 - RNA, 62 nt, hsa
acacugggucaggcagagugggcgacaauaaacgcugcuaggagaaucgagccuucugaaua

SEQ ID NO: 288283 - RNA, 62 nt, hsa
uguuucuuagccaggaaagacaaauaauccaacgcugcuagucuuaaccccagaccagagag

SEQ ID NO: 288284 - RNA, 62 nt, hsa
aagaauucuguguuuaaacgaucacaauaggccgcugcuaucagauuuuagaaauaaaugca

SEQ ID NO: 288285 - RNA, 62 nt, hsa
gugcaggcaggaagcagcccugggggacuggacgcugcuauugauucauuaaaaaaagaaaa

SEQ ID NO: 288286 - RNA, 62 nt, hsa
cggggacaggccgcagcuccauuuucuuauugcgcugcuaccguugacuuccaggcacgguu

SEQ ID NO: 288287 - RNA, 62 nt, hsa
uuaugcaaaacgucaaaaucugcuucugugaccgcugcuauaggcguggagcugaggcucgg

SEQ ID NO: 288288 - RNA, 62 nt, hsa
gguccagagccaugagccaagagcccucuucacgcugcuaacuccaggggacagacgaaggg

SEQ ID NO: 288289 - RNA, 62 nt, hsa
auguuuuaagacccccaguuaaugccugaaaccgcugcuaguaccaaacccuaauguuuuuu

SEQ ID NO: 288290 - RNA, 62 nt, hsa
guuuuguucaguuugguuuuuuuuuuuuuuugcgcugcuaagaagcuaaagucauccauccu

SEQ ID NO: 288291 - RNA, 62 nt, hsa
cccaugguuaaaacaggaguuguguucucugucgcugcuaaauuauucuucacuugagugaa

SEQ ID NO: 288292 - RNA, 62 nt, hsa
uggaaauccaaggaggacaaagacuccagccacgcugcuaaauagggcuccucucuccucuc

SEQ ID NO: 288293 - RNA, 62 nt, hsa
gaguggggcugcucugacugagguauggagaccgcugcuaugggaucgucaccugguucggg

SEQ ID NO: 288294 - RNA, 62 nt, hsa
gcucugggacauugugcucaggaauuugaaaacgcugcuauacuuacucugguuacuacauu

SEQ ID NO: 288295 - RNA, 62 nt, hsa
guuugucccugccaucuacugucugaggccaucgcugcuacacuuuguuuuuauuuguauuu

SEQ ID NO: 288296 - RNA, 60 nt, hsa; identical to SEQ ID NO: 288241

SEQ ID NO: 288297 - RNA, 62 nt, hsa
agauguaaaacucuaaugauuuggccaugaggcgcugcuauuauaagcagcuggaaaugaau

SEQ ID NO: 288298 - RNA, 62 nt, hsa
cucauucacaucgcagauucucccuugcucugcgcugcuagagugacucacuaauucauuaa

SEQ ID NO: 288299 - RNA, 62 nt, hsa
ccaccccuugcaaagggggugugucccacaaacgcugcuaugggugggguggggggcugggg

SEQ ID NO: 288300 - RNA, 62 nt, hsa
cuuccccagacucagcuccagaauaccuucuucgcugcuagagaagggggauuggagggaag

SEQ ID NO: 288301 - RNA, 53 nt, hsa; identical to SEQ ID NO: 288246

SEQ ID NO: 288302 - RNA, 56 nt, hsa; identical to SEQ ID NO: 288247

SEQ ID NO: 288303 - RNA, 62 nt, hsa
caggucuccgccuccucugcuucuccuuucuccgcugcuauagaccaguucauugugugugg

SEQ ID NO: 288304 - RNA, 62 nt, hsa
gaagguaccccaggcugcacagcauggucguccgcugcuaucuucucauccagcaguacucu

SEQ ID NO: 288305 - RNA, 62 nt, hsa
ugauggcugggacuccucgcgggaggggacugcgcugcuauagcucuugcugccucucuuga

SEQ ID NO: 288306 - RNA, 62 nt, hsa
aaagcgggccggcucggcuucugaccuggcaccgcugcuacggcggccuagcaaauuccgcc

SEQ ID NO: 288307 - RNA, 62 nt, hsa
cuucuucguccgaaaggaggggaggggggacucgcugcuacaagccucgcccccugugccac

SEQ ID NO: 288308 - RNA, 62 nt, hsa
uggaaagggaggcgcugggguuugaaccuccccgcugcuaaucuccccugggccccuccccg

SEQ ID NO: 288309 - RNA, 62 nt, hsa
gcccugcagugucugcucacugcugccaucuucgcugcuagucaggguuccauccucuuucc

SEQ ID NO: 288310 - RNA, 62 nt, hsa
guguguguguuuuuuuuccuuuaaagaagaaacgcugcuaagaucccacguggcucccacgu

SEQ ID NO: 288311 - RNA, 62 nt, hsa
gugguucuugaugcucaccugaagccccuagacgcugcuaggagggggggcccuccugggcc

SEQ ID NO: 288312 - RNA, 62 nt, hsa
cccuccugggcccccaauaccccuccgcuugccgcugcuagcgcaccccugcaguccagcgu

SEQ ID NO: 288313 - RNA, 62 nt, hsa
ccucacuuuugcugcugcggggcccacacagccgcugcuacuuugggggguggggaaggggc

SEQ ID NO: 288314 - RNA, 65 nt, hsa
ucaagccucucaucucugcccagcccccucaguggcgcugcuaugcaaggcuugugaacccccag

SEQ ID NO: 288315 - RNA, 65 nt, hsa
gcagcucaagacccccgagcaacauuuguaggggccgcugcuaguuagcuacccuugcccaccgc

SEQ ID NO: 288316 - RNA, 65 nt, hsa
aacaguacuggcaucugauagguagaggucagguacgcugcuaaacacugcagcucccaccacau

SEQ ID NO: 288317 - RNA, 65 nt, hsa
ggaaaaagagguagcaaaggggcaccugagguucacgcugcuagcguggacauagcccugugaua

SEQ ID NO: 288318 - RNA, 65 nt, hsa
cuggguaucugggaccccagaucaggcucuggagacgcugcuaccugaggggaaggccugagguc

SEQ ID NO: 288319 - RNA, 65 nt, hsa
acuggcugugcauccugcccugucccggguuugcgcgcugcuacagagcuucacgcucuccgcuc

SEQ ID NO: 288320 - RNA, 65 nt, hsa
aucagggaaaaggugcccagcugccagcccagcuccgcugcuaucuuugccucacuuagucaugu

SEQ ID NO: 288321 - RNA, 65 nt, hsa
ggacuuauagaaaguuagagaagaccuuguugaaccgcugcuaaacuugccacaggagcgaugug

SEQ ID NO: 288322 - RNA, 65 nt, hsa
aguccagacgggugcugccggcucagccagccucacgcugcuaggaaauggcucccugaucuauc

SEQ ID NO: 288323 - RNA, 65 nt, hsa
ugcccucagagcucuugcuguuagcuggcagcugacgcugcuaggauaguuaguuuggaaauggu

SEQ ID NO: 288324 - RNA, 65 nt, hsa
cguggcuggacgauuuccuugcaucugagggcagacgcugcuaccggagugaccuggacguggcc

SEQ ID NO: 288325 - RNA, 65 nt, hsa
cuggucuccuugcaaguuuccuaguauaagguaugcgcugcuaccaagauugggguuuuuucguu

SEQ ID NO: 288326 - RNA, 65 nt, hsa
aacccccucaaccacuuccauuccccaaauaccugcgcugcuaccgaugccucuuggagaccaag

SEQ ID NO: 288327 - RNA, 65 nt, hsa
ucauaauguauuuaagaauuugcuguuuuauuuaacgcugcuacucuuaaucuucucuaaauuuu

SEQ ID NO: 288328 - RNA, 65 nt, hsa
guccuagggcagaaggaggugcuugcagggccucucgcugcuacugggacauccacaggaccuaa

SEQ ID NO: 288329 - RNA, 65 nt, hsa
ucuugcuuuuuguggguggcugcugccaccaccgccgcugcuauauaguuuagguuucugagguu

SEQ ID NO: 288330 - RNA, 65 nt, hsa
gcucuuggggcugaccggcuguagggaccaccagccgcugcuacugugggccgccccggggcagg

SEQ ID NO: 288331 - RNA, 65 nt, hsa
cagccuccugaguagcugggauuacaggcacccgccgcugcuaauuuuuguauuuuuaguagaga

SEQ ID NO: 288332 - RNA, 65 nt, hsa
ccaccuucaagucaauucauaaccaaguuuuugaacgcugcuaugaauugcacugugaaaagcac

SEQ ID NO: 288333 - RNA, 65 nt, hsa
uggugugcaaugaacuuguauuuauccuucuucuccgcugcuauauuuuuggugugauuuuuauu

SEQ ID NO: 288334 - RNA, 65 nt, hsa
uuuccccaauaaguguguugaagcauacaucuuuacgcugcuaauaugucuaaauacauauguua

SEQ ID NO: 288335 - RNA, 65 nt, hsa
cagcaucuggcaggcacaccugagucaccauguagcgcugcuacuggagguagagacggcccuuu

SEQ ID NO: 288336 - RNA, 65 nt, hsa
cccugcugcuguccagccaggccugccugaggccacgcugcuauggaggcugccuccuagucucc

SEQ ID NO: 288337 - RNA, 65 nt, hsa
ccaacacugggucaggcagagugggcgacaauaaacgcugcuaggagaaucgagccuucugaaua

SEQ ID NO: 288338 - RNA, 65 nt, hsa
caauguuucuuagccaggaaagacaaauaauccaacgcugcuagucuuaaccccagaccagagag

SEQ ID NO: 288339 - RNA, 65 nt, hsa
ucaaagaauucuguguuuaaacgaucacaauaggccgcugcuaucagauuuuagaaauaaaugca

SEQ ID NO: 288340 - RNA, 65 nt, hsa
caggugcaggcaggaagcagcccugggggacuggacgcugcuauugauucauuaaaaaaagaaaa

SEQ ID NO: 288341 - RNA, 65 nt, hsa
caccggggacaggccgcagcuccauuuucuuauugcgcugcuaccguugacuuccaggcacgguu

SEQ ID NO: 288342 - RNA, 65 nt, hsa
gaauuaugcaaaacgucaaaaucugcuucugugaccgcugcuauaggcguggagcugaggcucgg

SEQ ID NO: 288343 - RNA, 65 nt, hsa
gccgguccagagccaugagccaagagcccucuucacgcugcuaacuccaggggacagacgaaggg

SEQ ID NO: 288344 - RNA, 65 nt, hsa
gauauguuuuaagacccccaguuaaugccugaaaccgcugcuaguaccaaacccuaauguuuuuu

SEQ ID NO: 288345 - RNA, 65 nt, hsa
uuuguuuuguucaguuugguuuuuuuuuuuuuuugcgcugcuaagaagcuaaagucauccauccu

SEQ ID NO: 288346 - RNA, 65 nt, hsa
uuucccaugguuaaaacaggaguuguguucucugucgcugcuaaauuauucuucacuugagugaa

SEQ ID NO: 288347 - RNA, 65 nt, hsa
auguggaaauccaaggaggacaaagacuccagccacgcugcuaaauagggcuccucucuccucuc

SEQ ID NO: 288348 - RNA, 65 nt, hsa
ggggaguggggcugcucugacugagguauggagaccgcugcuaugggaucgucaccugguucggg

SEQ ID NO: 288349 - RNA, 65 nt, hsa
ccagcucugggacauugugcucaggaauuugaaaacgcugcuauacuuacucugguuacuacauu

SEQ ID NO: 288350 - RNA, 65 nt, hsa
uuaguuugucccugccaucuacugucugaggccaucgcugcuacacuuuguuuuuauuuguauuu

SEQ ID NO: 288351 - RNA, 60 nt, hsa; identical to SEQ ID NO: 288241

SEQ ID NO: 288352 - RNA, 65 nt, hsa
cccagauguaaaacucuaaugauuuggccaugaggcgcugcuauuauaagcagcuggaaaugaau

SEQ ID NO: 288353 - RNA, 65 nt, hsa
cuccucauucacaucgcagauucucccuugcucugcgcugcuagagugacucacuaauucauuaa

SEQ ID NO: 288354 - RNA, 65 nt, hsa
gggccaccccuugcaaagggggugugucccacaaacgcugcuaugggugggguggggggcugggg

SEQ ID NO: 288355 - RNA, 65 nt, hsa
caccuuccccagacucagcuccagaauaccuucuucgcugcuagagaagggggauuggagggaag

SEQ ID NO: 288356 - RNA, 53 nt, hsa; identical to SEQ ID NO: 288246

SEQ ID NO: 288357 - RNA, 56 nt, hsa; identical to SEQ ID NO: 288247

SEQ ID NO: 288358 - RNA, 65 nt, hsa
ggucaggucuccgccuccucugcuucuccuuucuccgcugcuauagaccaguucauugugugugg

SEQ ID NO: 288359 - RNA, 65 nt, hsa
guugaagguaccccaggcugcacagcauggucguccgcugcuaucuucucauccagcaguacucu

SEQ ID NO: 288360 - RNA, 65 nt, hsa
cugugauggcugggacuccucgcgggaggggacugcgcugcuauagcucuugcugccucucuuga

SEQ ID NO: 288361 - RNA, 65 nt, hsa
cgaaaagcgggccggcucggcuucugaccuggcaccgcugcuacggcggccuagcaaauuccgcc

SEQ ID NO: 288362 - RNA, 65 nt, hsa
uuccuucuucguccgaaaggaggggaggggggacucgcugcuacaagccucgcccccugugccac

SEQ ID NO: 288363 - RNA, 65 nt, hsa
cuuuggaaagggaggcgcugggguuugaaccuccccgcugcuaaucuccccugggccccuccccg

SEQ ID NO: 288364 - RNA, 65 nt, hsa
gaggcccugcagugucugcucacugcugccaucuucgcugcuagucaggguuccauccucuuucc

SEQ ID NO: 288365 - RNA, 65 nt, hsa
gguguguguguguuuuuuuuccuuuaaagaagaaacgcugcuaagaucccacguggcucccacgu

SEQ ID NO: 288366 - RNA, 65 nt, hsa
ggagugguucuugaugcucaccugaagccccuagacgcugcuaggagggggggcccuccugggcc

SEQ ID NO: 288367 - RNA, 65 nt, hsa
gggcccuccugggcccccaauaccccuccgcuugccgcugcuagcgcaccccugcaguccagcgu

SEQ ID NO: 288368 - RNA, 65 nt, hsa
aggccucacuuuugcugcugcggggcccacacagccgcugcuacuuugggggguggggaaggggc

SEQ ID NO: 288369 - RNA, 64 nt, hsa; identical to SEQ ID NO: 168843

SEQ ID NO: 288370 - RNA, 64 nt, hsa; identical to SEQ ID NO: 168844

SEQ ID NO: 288371 - RNA, 56 nt, hsa; identical to SEQ ID NO: 168845

SEQ ID NO: 288372 - RNA, 64 nt, hsa; identical to SEQ ID NO: 168846

SEQ ID NO: 288373 - RNA, 64 nt, hsa; identical to SEQ ID NO: 168847

SEQ ID NO: 288374 - RNA, 64 nt, hsa; identical to SEQ ID NO: 168848

SEQ ID NO: 288375 - RNA, 64 nt, hsa; identical to SEQ ID NO: 168849

SEQ ID NO: 288376 - RNA, 64 nt, hsa; identical to SEQ ID NO: 168850

SEQ ID NO: 288377 - RNA, 64 nt, hsa; identical to SEQ ID NO: 168851

SEQ ID NO: 288378 - RNA, 64 nt, hsa; identical to SEQ ID NO: 168852

SEQ ID NO: 288379 - RNA, 64 nt, hsa; identical to SEQ ID NO: 168853

SEQ ID NO: 288380 - RNA, 64 nt, hsa; identical to SEQ ID NO: 168854

SEQ ID NO: 288381 - RNA, 64 nt, hsa; identical to SEQ ID NO: 168855

SEQ ID NO: 288382 - RNA, 64 nt, hsa; identical to SEQ ID NO: 168856

SEQ ID NO: 288383 - RNA, 64 nt, hsa; identical to SEQ ID NO: 168857

SEQ ID NO: 288384 - RNA, 64 nt, hsa; identical to SEQ ID NO: 168858

SEQ ID NO: 288385 - RNA, 64 nt, hsa; identical to SEQ ID NO: 168859

SEQ ID NO: 288386 - RNA, 64 nt, hsa; identical to SEQ ID NO: 168860

SEQ ID NO: 288387 - RNA, 60 nt, hsa
gauuacaggugcgagcuacugcucccagcaagagccaagauuuuaaccuagaucucccua

SEQ ID NO: 288388 - RNA, 60 nt, hsa
cuuaucugugguuacaagcuaguaaguagcagagccaagauuuuuuuuaauauagagaca

SEQ ID NO: 288389 - RNA, 60 nt, hsa
ucuuagaguuaaaggagggggugcuggccaagagccaacacauucuuggcccaggagcau

SEQ ID NO: 288390 - RNA, 60 nt, hsa
aaaucugccuuauccuucuuuaccuggcaaagagccaaucauguuaacucuuccuuauca

SEQ ID NO: 288391 - RNA, 60 nt, hsa
augagagcaaugaacaggagaaggagggagagagccaaaugucugaguaaacagauaucc

SEQ ID NO: 288392 - RNA, 60 nt, hsa
gauagaauuccaaguuauaaagcauaaaaaagagccaacagaaguaacuaauccgggaaa

SEQ ID NO: 288393 - RNA, 60 nt, hsa
agaguaacagcaauugaaaaaagagauucaagagccaaguacucagcccuggcaggggau

SEQ ID NO: 288394 - RNA, 60 nt, hsa
cucugaacagacugcugagauacccaaucaagagccaauccuugcuucccuagacucucc

SEQ ID NO: 288395 - RNA, 60 nt, hsa
gccuuaaggaaaucuuuacuccuguaagcaagagccaaccucacaggauuaggagcuggg

SEQ ID NO: 288396 - RNA, 60 nt, hsa
auaaaaguuucuuuccuaaaccauucaccaagagccaauaucuaggcauuuucuugguag

SEQ ID NO: 288397 - RNA, 64 nt, hsa; identical to SEQ ID NO: 46031

SEQ ID NO: 288398 - RNA, 64 nt, hsa; identical to SEQ ID NO: 46032

SEQ ID NO: 288399 - RNA, 64 nt, hsa; identical to SEQ ID NO: 46033

SEQ ID NO: 288400 - RNA, 64 nt, hsa; identical to SEQ ID NO: 46034

SEQ ID NO: 288401 - RNA, 64 nt, hsa
cauguuguaguccuaugaugauguaaacuugguacuacauaaugacuugcuccacacaugcagu

SEQ ID NO: 288402 - RNA, 64 nt, hsa
acuacauaaugacuugcuccacacaugcaguaaacuacauaaugauguacugguaaacuagaaa

SEQ ID NO: 288403 - RNA, 64 nt, hsa
gcagcggaaucuguucacacccaacuugguuuugcuacauaauuauccaggaagggaauaaggu

SEQ ID NO: 288404 - RNA, 64 nt, hsa
ucugcuacuuugcugcuaugguuuucuccaagagcuacauaauuuaguuucauauaaaguauca

SEQ ID NO: 288405 - RNA, 64 nt, hsa
uacauugaaaacagauauuacagcuuauuuuuuucuacauaauugugaccaauacauuuguauu

SEQ ID NO: 288406 - RNA, 64 nt, hsa
agcaagauauaagagauucauuugcuuaacauuucuacauaauauuuauggucuggucaguauu

SEQ ID NO: 288407 - RNA, 64 nt, hsa
uauuuuauaguuuugaaacuaguuucucauaaaauucugucaauucacugaauaucagagaaua

SEQ ID NO: 288408 - RNA, 64 nt, hsa
aaggaugucacugcuguucauuucuaucugccauuucugucaggguugacacaauccugcaaga

SEQ ID NO: 288409 - RNA, 64 nt, hsa
gggaccuuuaauuuguacagaacacagaacuuauuucugucaguuauuuaauacauugaaaauu

SEQ ID NO: 288410 - RNA, 64 nt, hsa
uuugcacaaauauuuuuacauucugaucauucaguucugucauuguaaucuuuguuguuagaaa

SEQ ID NO: 288411 - RNA, 64 nt, hsa
auacguuuuucaguuucaacaugaauuuuuuuauuucugucaguuaugacauccacaagcauca

SEQ ID NO: 288412 - RNA, 64 nt, hsa
cuuuguggugagaauuuuuuccccgauauucuccuucugucaaagucagaacaaauucagggaa

SEQ ID NO: 288413 - RNA, 64 nt, hsa
cuuaacaucaagcgcgcaguucaaaacuacugucuucugucaaaguuuucuccucuuaaauguu

SEQ ID NO: 288414 - RNA, 64 nt, hsa
guccuuagucuguuaguuaaacccauuaggaauuuucugucaacuaccaugcccaugagauguu

SEQ ID NO: 288415 - RNA, 64 nt, hsa
acuuacaaagcacuccuuuuucccuuaaacuucuuucugucaaauuagauuuaaugagagagua

SEQ ID NO: 288416 - RNA, 64 nt, hsa
cuuauuguugagcuuagcaaauuaauaacacuauuucugucacuaauuauuuugaggccuuuua

SEQ ID NO: 288417 - RNA, 64 nt, hsa
gguggagcaauaguauauuguauguuguaaaguguucugucauuuacaagaugugauucaugag

SEQ ID NO: 288418 - RNA, 64 nt, hsa
agauguuaauuugggauauggaggcauuuuuaucuucugucacuacuacuuaaaacucugauga

SEQ ID NO: 288419 - RNA, 64 nt, hsa
cagcuccuucaugagaucaggucagugguauuguuucugucaagaguguuuuuucugucauuuc

SEQ ID NO: 288420 - RNA, 64 nt, hsa
aggucagugguauuguuucugucaagaguguuuuuucugucauuucuacuuuuuguauaaagga

SEQ ID NO: 288421 - RNA, 64 nt, hsa
ucugucgggggugacaccaggagagagggacagguucugucaggggugacaccaggagagaggg

SEQ ID NO: 288422 - RNA, 64 nt, hsa
ucugucgggggugacaccaggacacagggacagguucugucaugggugacacgaggacacaggg

SEQ ID NO: 288423 - RNA, 64 nt, hsa
cugcacaaccugcaaaccaggagagagggacagguucugucaggggugacaccaggacacaggg

SEQ ID NO: 288424 - RNA, 64 nt, hsa
gucuuuuacuuuauguacaggauaucuaauuuauuucugucagcugguguugcugacacuuucc

SEQ ID NO: 288425 - RNA, 64 nt, hsa
uuaaccuucguaacuaauuacauaucgcugaguguucugucaccccacuuguguuugaguauga

SEQ ID NO: 288426 - RNA, 64 nt, hsa
ucaguauuuaucaaugaaguuugauaauucacuuuucugucauuguuaaagcguacauacugua

SEQ ID NO: 288427 - RNA, 64 nt, hsa
agaugauguuugaauuucaagaaaagaggcugcuuucugucagugcccucucauuagaucugug

SEQ ID NO: 288428 - RNA, 64 nt, hsa
auuuauaucuuuuguauguaaaacuuuaacugauuucugucauucaucaaugaguagaaguaaa

SEQ ID NO: 288429 - RNA, 64 nt, hsa
aaaguucuuuaugaccucauuuauaaacacuaaauucugucaccuccugucauuuuauuuuuua

SEQ ID NO: 288430 - RNA, 64 nt, hsa
uguugcaaagucuacauuuuaugcugaaucugcauucugucaggcacccguagaaagaccucag

SEQ ID NO: 288431 - RNA, 64 nt, hsa
aauaauuuugucccaagucuuauuugcugacuuuuucugucaugagugagauuguugaacaaac

SEQ ID NO: 288432 - RNA, 64 nt, hsa
guuuuucaaauccauugcuuagcuaacuuuuucauucugucacuuggcuucgauuuuuauauuu

SEQ ID NO: 288433 - RNA, 64 nt, hsa
gauuuuucuuucuuucuuuguaaauaguucugaguucugucaaaugccgugaaaguauuugcua

SEQ ID NO: 288434 - RNA, 64 nt, hsa
ggcuaaauggggagcuaucuggaaacucuagauuuucugucauacccacaucugucacaguacc

SEQ ID NO: 288435 - RNA, 64 nt, hsa
uauuguacuuuuggagaauuuuuuguaggcauuuuucugucagauuuguaguaauuugugaggu

SEQ ID NO: 288436 - RNA, 64 nt, hsa
gccuuaugcaccuaauucaaaagguggaauauaguucugucagggcuuuuacguaaaccuccac

SEQ ID NO: 288437 - RNA, 64 nt, hsa
ucaauuuuaauaauaguccauaccauguauguguuucugucagcagaauguacauguuguacaa

SEQ ID NO: 288438 - RNA, 64 nt, hsa
aagauucacgcuucugcauccaccucugcccucauucugucaauuguguguggacucugagaag

SEQ ID NO: 288439 - RNA, 64 nt, hsa
cuaaaaaacuacugccccacuucaaauugcaguguucugucaccuaggcaucaucucuuccugc

SEQ ID NO: 288440 - RNA, 64 nt, hsa
gcacuaaagcaacaaaacaacccauaguaucucauucugucaucagauccagaagaaauauccu

SEQ ID NO: 288441 - RNA, 64 nt, hsa
agaaacucgccaccucugaccuaccuuugccuuuuucugucauggagaauacucacccuucaga

SEQ ID NO: 288442 - RNA, 64 nt, hsa
ggccccuuggaccguggggauggcggcccugagauucugucagugggaccacccugggccuccu

SEQ ID NO: 288443 - RNA, 64 nt, hsa
uggcagggcugggacugcugucccuuguacaguuuucugucacuggugggcacuggacaggcau

SEQ ID NO: 288444 - RNA, 64 nt, hsa
cugugucucaugugcagcugaaauagugaucugcuucugucacugucacauagacagcccugca

SEQ ID NO: 288445 - RNA, 64 nt, hsa
accacugaucugcucaggcaacuaccaaucuucuuucugucacuauagauuaauuugcauuuuu

SEQ ID NO: 288446 - RNA, 64 nt, hsa
guagguuugccaagucuuuguggugaauugacucuucugucauuaugugaugucauuuuuuugc

SEQ ID NO: 288447 - RNA, 64 nt, hsa
ucaaauaaucauucccuauuuuacaaugcaucaguucugucaagcuucauucaaaguguuuuuc

SEQ ID NO: 288448 - RNA, 64 nt, hsa
ucagcuuuggagacagucuggguuuaaaucccaguucugucaauuugagcuguuuacugucucu

SEQ ID NO: 288449 - RNA, 64 nt, hsa
ggggauacauucuuagaaaugugucacuaggcaauucugucauuguguaaacauuauagaaugu

SEQ ID NO: 288450 - RNA, 64 nt, hsa
acgaguuaccagaagauguggauucuaguucugauucugucacucauuggcuuugagugacaua

SEQ ID NO: 288451 - RNA, 64 nt, hsa
ggguugagaguccccaacccccuugucuucuaccuucugucaccuagauuugaucagggucuau

SEQ ID NO: 288452 - RNA, 64 nt, hsa; identical to SEQ ID NO: 187011

SEQ ID NO: 288453 - RNA, 64 nt, hsa; identical to SEQ ID NO: 187012

SEQ ID NO: 288454 - RNA, 64 nt, hsa; identical to SEQ ID NO: 187013

SEQ ID NO: 288455 - RNA, 64 nt, hsa; identical to SEQ ID NO: 187014

SEQ ID NO: 288456 - RNA, 64 nt, hsa; identical to SEQ ID NO: 187015

SEQ ID NO: 288457 - RNA, 64 nt, hsa; identical to SEQ ID NO: 187016

SEQ ID NO: 288458 - RNA, 56 nt, hsa; identical to SEQ ID NO: 187017

SEQ ID NO: 288459 - RNA, 64 nt, hsa; identical to SEQ ID NO: 187018

SEQ ID NO: 288460 - RNA, 64 nt, hsa; identical to SEQ ID NO: 187019

SEQ ID NO: 288461 - RNA, 64 nt, hsa; identical to SEQ ID NO: 187020

SEQ ID NO: 288462 - RNA, 64 nt, hsa; identical to SEQ ID NO: 187021

SEQ ID NO: 288463 - RNA, 64 nt, hsa; identical to SEQ ID NO: 187022

SEQ ID NO: 288464 - RNA, 64 nt, hsa; identical to SEQ ID NO: 187023

SEQ ID NO: 288465 - RNA, 64 nt, hsa; identical to SEQ ID NO: 187024

SEQ ID NO: 288466 - RNA, 64 nt, hsa; identical to SEQ ID NO: 187025

SEQ ID NO: 288467 - RNA, 64 nt, hsa; identical to SEQ ID NO: 187026

SEQ ID NO: 288468 - RNA, 64 nt, hsa; identical to SEQ ID NO: 187027

SEQ ID NO: 288469 - RNA, 64 nt, hsa; identical to SEQ ID NO: 187028

SEQ ID NO: 288470 - RNA, 64 nt, hsa; identical to SEQ ID NO: 187029

SEQ ID NO: 288471 - RNA, 64 nt, hsa; identical to SEQ ID NO: 187030

SEQ ID NO: 288472 - RNA, 64 nt, hsa; identical to SEQ ID NO: 187031

SEQ ID NO: 288473 - RNA, 64 nt, hsa; identical to SEQ ID NO: 187032

SEQ ID NO: 288474 - RNA, 64 nt, hsa; identical to SEQ ID NO: 187033

SEQ ID NO: 288475 - RNA, 64 nt, hsa; identical to SEQ ID NO: 187034

SEQ ID NO: 288476 - RNA, 64 nt, hsa; identical to SEQ ID NO: 187035

SEQ ID NO: 288477 - RNA, 64 nt, hsa; identical to SEQ ID NO: 187036

SEQ ID NO: 288478 - RNA, 64 nt, hsa; identical to SEQ ID NO: 187037

SEQ ID NO: 288479 - RNA, 64 nt, hsa; identical to SEQ ID NO: 187038

SEQ ID NO: 288480 - RNA, 64 nt, hsa; identical to SEQ ID NO: 187039

SEQ ID NO: 288481 - RNA, 64 nt, hsa; identical to SEQ ID NO: 187040

SEQ ID NO: 288482 - RNA, 64 nt, hsa; identical to SEQ ID NO: 187041

SEQ ID NO: 288483 - RNA, 64 nt, hsa; identical to SEQ ID NO: 187042

SEQ ID NO: 288484 - RNA, 64 nt, hsa; identical to SEQ ID NO: 187043

SEQ ID NO: 288485 - RNA, 64 nt, hsa; identical to SEQ ID NO: 187044

SEQ ID NO: 288486 - RNA, 64 nt, hsa; identical to SEQ ID NO: 187045

SEQ ID NO: 288487 - RNA, 64 nt, hsa; identical to SEQ ID NO: 187046

SEQ ID NO: 288488 - RNA, 64 nt, hsa; identical to SEQ ID NO: 187047

SEQ ID NO: 288489 - RNA, 64 nt, hsa; identical to SEQ ID NO: 187048

SEQ ID NO: 288490 - RNA, 64 nt, hsa; identical to SEQ ID NO: 187049

SEQ ID NO: 288491 - RNA, 64 nt, hsa; identical to SEQ ID NO: 187050

SEQ ID NO: 288492 - RNA, 64 nt, hsa; identical to SEQ ID NO: 187051

SEQ ID NO: 288493 - RNA, 64 nt, hsa; identical to SEQ ID NO: 187052

SEQ ID NO: 288494 - RNA, 64 nt, hsa; identical to SEQ ID NO: 187053

SEQ ID NO: 288495 - RNA, 64 nt, hsa; identical to SEQ ID NO: 187054

SEQ ID NO: 288496 - RNA, 64 nt, hsa; identical to SEQ ID NO: 187055

SEQ ID NO: 288497 - RNA, 64 nt, hsa; identical to SEQ ID NO: 187056

SEQ ID NO: 288498 - RNA, 64 nt, hsa; identical to SEQ ID NO: 187057

SEQ ID NO: 288499 - RNA, 64 nt, hsa; identical to SEQ ID NO: 187058

SEQ ID NO: 288500 - RNA, 64 nt, hsa; identical to SEQ ID NO: 187059

SEQ ID NO: 288501 - RNA, 64 nt, hsa; identical to SEQ ID NO: 187060

SEQ ID NO: 288502 - RNA, 64 nt, hsa; identical to SEQ ID NO: 187061

SEQ ID NO: 288503 - RNA, 64 nt, hsa; identical to SEQ ID NO: 187062

SEQ ID NO: 288504 - RNA, 64 nt, hsa; identical to SEQ ID NO: 187063

SEQ ID NO: 288505 - RNA, 64 nt, hsa; identical to SEQ ID NO: 187064

SEQ ID NO: 288506 - RNA, 64 nt, hsa; identical to SEQ ID NO: 187065

SEQ ID NO: 288507 - RNA, 64 nt, hsa; identical to SEQ ID NO: 187066

SEQ ID NO: 288508 - RNA, 64 nt, hsa; identical to SEQ ID NO: 187067

SEQ ID NO: 288509 - RNA, 64 nt, hsa; identical to SEQ ID NO: 187068

SEQ ID NO: 288510 - RNA, 64 nt, hsa; identical to SEQ ID NO: 187069

SEQ ID NO: 288511 - RNA, 64 nt, hsa; identical to SEQ ID NO: 187070

SEQ ID NO: 288512 - RNA, 64 nt, hsa; identical to SEQ ID NO: 187071

SEQ ID NO: 288513 - RNA, 64 nt, hsa; identical to SEQ ID NO: 187072

SEQ ID NO: 288514 - RNA, 64 nt, hsa; identical to SEQ ID NO: 187073

SEQ ID NO: 288515 - RNA, 64 nt, hsa; identical to SEQ ID NO: 187074

SEQ ID NO: 288516 - RNA, 64 nt, hsa; identical to SEQ ID NO: 187075

SEQ ID NO: 288517 - RNA, 64 nt, hsa; identical to SEQ ID NO: 187076

SEQ ID NO: 288518 - RNA, 64 nt, hsa; identical to SEQ ID NO: 187077

SEQ ID NO: 288519 - RNA, 64 nt, hsa; identical to SEQ ID NO: 187078

SEQ ID NO: 288520 - RNA, 64 nt, hsa; identical to SEQ ID NO: 187079

SEQ ID NO: 288521 - RNA, 64 nt, hsa; identical to SEQ ID NO: 187080

SEQ ID NO: 288522 - RNA, 64 nt, hsa; identical to SEQ ID NO: 187081

SEQ ID NO: 288523 - RNA, 64 nt, hsa; identical to SEQ ID NO: 187082

SEQ ID NO: 288524 - RNA, 64 nt, hsa; identical to SEQ ID NO: 187083

SEQ ID NO: 288525 - RNA, 57 nt, hsa; identical to SEQ ID NO: 187084

SEQ ID NO: 288526 - RNA, 64 nt, hsa; identical to SEQ ID NO: 187085

SEQ ID NO: 288527 - RNA, 64 nt, hsa; identical to SEQ ID NO: 187086

SEQ ID NO: 288528 - RNA, 64 nt, hsa; identical to SEQ ID NO: 187087

SEQ ID NO: 288529 - RNA, 64 nt, hsa; identical to SEQ ID NO: 187088

SEQ ID NO: 288530 - RNA, 64 nt, hsa; identical to SEQ ID NO: 187089

SEQ ID NO: 288531 - RNA, 64 nt, hsa; identical to SEQ ID NO: 187090

SEQ ID NO: 288532 - RNA, 64 nt, hsa; identical to SEQ ID NO: 187091

SEQ ID NO: 288533 - RNA, 64 nt, hsa; identical to SEQ ID NO: 187092

SEQ ID NO: 288534 - RNA, 64 nt, hsa; identical to SEQ ID NO: 187093

SEQ ID NO: 288535 - RNA, 64 nt, hsa; identical to SEQ ID NO: 187094

SEQ ID NO: 288536 - RNA, 64 nt, hsa; identical to SEQ ID NO: 187095

SEQ ID NO: 288537 - RNA, 64 nt, hsa; identical to SEQ ID NO: 187096

SEQ ID NO: 288538 - RNA, 64 nt, hsa; identical to SEQ ID NO: 187097

SEQ ID NO: 288539 - RNA, 64 nt, hsa; identical to SEQ ID NO: 187098

SEQ ID NO: 288540 - RNA, 64 nt, hsa; identical to SEQ ID NO: 187099

SEQ ID NO: 288541 - RNA, 64 nt, hsa; identical to SEQ ID NO: 187100

SEQ ID NO: 288542 - RNA, 64 nt, hsa; identical to SEQ ID NO: 187101

SEQ ID NO: 288543 - RNA, 64 nt, hsa; identical to SEQ ID NO: 187102

SEQ ID NO: 288544 - RNA, 64 nt, hsa; identical to SEQ ID NO: 187103

SEQ ID NO: 288545 - RNA, 64 nt, hsa; identical to SEQ ID NO: 187104

SEQ ID NO: 288546 - RNA, 64 nt, hsa; identical to SEQ ID NO: 187105

SEQ ID NO: 288547 - RNA, 64 nt, hsa; identical to SEQ ID NO: 187106

SEQ ID NO: 288548 - RNA, 64 nt, hsa; identical to SEQ ID NO: 187107

SEQ ID NO: 288549 - RNA, 64 nt, hsa; identical to SEQ ID NO: 187108

SEQ ID NO: 288550 - RNA, 64 nt, hsa; identical to SEQ ID NO: 187109

SEQ ID NO: 288551 - RNA, 64 nt, hsa; identical to SEQ ID NO: 187110

SEQ ID NO: 288552 - RNA, 64 nt, hsa; identical to SEQ ID NO: 187111

SEQ ID NO: 288553 - RNA, 64 nt, hsa; identical to SEQ ID NO: 187112

SEQ ID NO: 288554 - RNA, 64 nt, hsa; identical to SEQ ID NO: 187113

SEQ ID NO: 288555 - RNA, 64 nt, hsa; identical to SEQ ID NO: 187114

SEQ ID NO: 288556 - RNA, 64 nt, hsa
acaaauacggaugcagugcugagauaguuuaugagacuuguaccauuucacaaacucugaaauu

SEQ ID NO: 288557 - RNA, 64 nt, hsa
acacuauccagcuaagcaaagauuccuggaggcugacuuguaucuucagacucacagagugaau

SEQ ID NO: 288558 - RNA, 64 nt, hsa
aauuuugcaggugggagauuuggauuugaauguggacuuguaaaugacuugaccuugccaucug

SEQ ID NO: 288559 - RNA, 64 nt, hsa
auaaacugggagaacuauggcagcuacuugcaucgacuuguaccucacuuagcccuugggggcg

SEQ ID NO: 288560 - RNA, 64 nt, hsa
uacuugcugaaugaaugcagaaaucagcgguacugacuuguacuauauuggcugccaugauagg

SEQ ID NO: 288561 - RNA, 64 nt, hsa
uccuuugaagcccagacaucuuucuccagcuucagacuuguagauauaacucguucaucuucau

SEQ ID NO: 288562 - RNA, 64 nt, hsa
ugaaguucuggcucugcagagaccaaaccuuacugacuuguacagacuuguacaaguaaagacu

SEQ ID NO: 288563 - RNA, 64 nt, hsa
gcucugcagagaccaaaccuuacugacuuguacagacuuguacaaguaaagacuuauacagaua

SEQ ID NO: 288564 - RNA, 64 nt, hsa
cuggcuauuacuauauaaugaagcccacuggcuugacuuguaaguucaaccuaaaccacaaucc

SEQ ID NO: 288565 - RNA, 64 nt, hsa
ccagagaaacaagcauauugccucauggaugaaagacuuguaguucuaguuucagugacuuguu

SEQ ID NO: 288566 - RNA, 64 nt, hsa; identical to SEQ ID NO: 210930

SEQ ID NO: 288567 - RNA, 64 nt, hsa; identical to SEQ ID NO: 210931

SEQ ID NO: 288568 - RNA, 64 nt, hsa; identical to SEQ ID NO: 210932

SEQ ID NO: 288569 - RNA, 64 nt, hsa; identical to SEQ ID NO: 210933

SEQ ID NO: 288570 - RNA, 64 nt, hsa; identical to SEQ ID NO: 210934

SEQ ID NO: 288571 - RNA, 64 nt, hsa; identical to SEQ ID NO: 210935

SEQ ID NO: 288572 - RNA, 64 nt, hsa; identical to SEQ ID NO: 210936

SEQ ID NO: 288573 - RNA, 64 nt, hsa; identical to SEQ ID NO: 210937

SEQ ID NO: 288574 - RNA, 64 nt, hsa; identical to SEQ ID NO: 210938

SEQ ID NO: 288575 - RNA, 64 nt, hsa; identical to SEQ ID NO: 210939

SEQ ID NO: 288576 - RNA, 64 nt, hsa; identical to SEQ ID NO: 210940

SEQ ID NO: 288577 - RNA, 64 nt, hsa; identical to SEQ ID NO: 210941

SEQ ID NO: 288578 - RNA, 64 nt, hsa; identical to SEQ ID NO: 210942

SEQ ID NO: 288579 - RNA, 64 nt, hsa; identical to SEQ ID NO: 210943

SEQ ID NO: 288580 - RNA, 64 nt, hsa; identical to SEQ ID NO: 210944

SEQ ID NO: 288581 - RNA, 64 nt, hsa; identical to SEQ ID NO: 210945

SEQ ID NO: 288582 - RNA, 64 nt, hsa; identical to SEQ ID NO: 210946

SEQ ID NO: 288583 - RNA, 64 nt, hsa; identical to SEQ ID NO: 210947

SEQ ID NO: 288584 - RNA, 64 nt, hsa; identical to SEQ ID NO: 261615

SEQ ID NO: 288585 - RNA, 64 nt, hsa; identical to SEQ ID NO: 261616

SEQ ID NO: 288586 - RNA, 64 nt, hsa; identical to SEQ ID NO: 261617

SEQ ID NO: 288587 - RNA, 64 nt, hsa; identical to SEQ ID NO: 261618

SEQ ID NO: 288588 - RNA, 64 nt, hsa; identical to SEQ ID NO: 261619

SEQ ID NO: 288589 - RNA, 64 nt, hsa; identical to SEQ ID NO: 261620

SEQ ID NO: 288590 - RNA, 64 nt, hsa; identical to SEQ ID NO: 261621

SEQ ID NO: 288591 - RNA, 64 nt, hsa; identical to SEQ ID NO: 261622

SEQ ID NO: 288592 - RNA, 64 nt, hsa; identical to SEQ ID NO: 261623

SEQ ID NO: 288593 - RNA, 64 nt, hsa; identical to SEQ ID NO: 261624

SEQ ID NO: 288594 - RNA, 64 nt, hsa; identical to SEQ ID NO: 261625

SEQ ID NO: 288595 - RNA, 64 nt, hsa; identical to SEQ ID NO: 261626

SEQ ID NO: 288596 - RNA, 64 nt, hsa; identical to SEQ ID NO: 261627

SEQ ID NO: 288597 - RNA, 64 nt, hsa; identical to SEQ ID NO: 261628

SEQ ID NO: 288598 - RNA, 64 nt, hsa; identical to SEQ ID NO: 261629

SEQ ID NO: 288599 - RNA, 64 nt, hsa; identical to SEQ ID NO: 261630

SEQ ID NO: 288600 - RNA, 64 nt, hsa; identical to SEQ ID NO: 261631

SEQ ID NO: 288601 - RNA, 64 nt, hsa; identical to SEQ ID NO: 261632

SEQ ID NO: 288602 - RNA, 64 nt, hsa; identical to SEQ ID NO: 261633

SEQ ID NO: 288603 - RNA, 64 nt, hsa; identical to SEQ ID NO: 261634

SEQ ID NO: 288604 - RNA, 64 nt, hsa; identical to SEQ ID NO: 126599

SEQ ID NO: 288605 - RNA, 64 nt, hsa; identical to SEQ ID NO: 126600

SEQ ID NO: 288606 - RNA, 64 nt, hsa; identical to SEQ ID NO: 126601

SEQ ID NO: 288607 - RNA, 64 nt, hsa; identical to SEQ ID NO: 126602

SEQ ID NO: 288608 - RNA, 64 nt, hsa; identical to SEQ ID NO: 126603

SEQ ID NO: 288609 - RNA, 64 nt, hsa; identical to SEQ ID NO: 126604

SEQ ID NO: 288610 - RNA, 64 nt, hsa; identical to SEQ ID NO: 126605

SEQ ID NO: 288611 - RNA, 64 nt, hsa; identical to SEQ ID NO: 126606

SEQ ID NO: 288612 - RNA, 64 nt, hsa; identical to SEQ ID NO: 126607

SEQ ID NO: 288613 - RNA, 64 nt, hsa; identical to SEQ ID NO: 126608

SEQ ID NO: 288614 - RNA, 64 nt, hsa; identical to SEQ ID NO: 126609

SEQ ID NO: 288615 - RNA, 64 nt, hsa; identical to SEQ ID NO: 126610

SEQ ID NO: 288616 - RNA, 64 nt, hsa; identical to SEQ ID NO: 126611

SEQ ID NO: 288617 - RNA, 64 nt, hsa; identical to SEQ ID NO: 126612

SEQ ID NO: 288618 - RNA, 64 nt, hsa; identical to SEQ ID NO: 126613

SEQ ID NO: 288619 - RNA, 64 nt, hsa; identical to SEQ ID NO: 126614

SEQ ID NO: 288620 - RNA, 64 nt, hsa; identical to SEQ ID NO: 126615

SEQ ID NO: 288621 - RNA, 64 nt, hsa
accuuacauguguuaacagcuguuucaacauaaacuccauuauaaucuauauacauuuaaagac

SEQ ID NO: 288622 - RNA, 64 nt, hsa
ucuaugguuaauucuuaaaauaaugccuuacagucuccauuaacucccuugcccuucucuugcu

SEQ ID NO: 288623 - RNA, 64 nt, hsa
uucaagcacuguuuugaaaacagaugacuuauuucuccauuaaaaaugcaauaaaaauaaaugg

SEQ ID NO: 288624 - RNA, 64 nt, hsa
gaagaggagaaacucaauacaaagacaaguacaacuccauuagaaaaauucagacagcaucuuc

SEQ ID NO: 288625 - RNA, 64 nt, hsa
ccauccaagcccugucccacuuuggcccuauccucuccauuagcuccuuccggguuuggaccau

SEQ ID NO: 288626 - RNA, 64 nt, hsa
gacuagcccacuaaagcuccccuguaaaugggggcuccauuaguucugcugccgagacuaauaa

SEQ ID NO: 288627 - RNA, 64 nt, hsa
uccagacugcucgccuccuggggauucucaggggcuccauuauggcuugauuuacuccacgugc

SEQ ID NO: 288628 - RNA, 64 nt, hsa
gagauucuguuccaccugccugccuggcccuuuccuccauuaccauccagacugcucgccuccu

SEQ ID NO: 288629 - RNA, 64 nt, hsa
uggggguugcugagguaggcacaagaaaaagucaggcauaaagcacaaggcagacuguuugagu

SEQ ID NO: 288630 - RNA, 64 nt, hsa
uaacaguugcauuuagguugcaccuggguaaucuggcauaaaagaucucucuaggccucacugu

SEQ ID NO: 288631 - RNA, 64 nt, hsa
uaaaauaaaauccuagauccaguucuuguuuuuuggcauaaauacuuaaucuauuuuaaauuua

SEQ ID NO: 288632 - RNA, 64 nt, hsa
ugcccaaggcagcaacaagcucuuuuguguuuaaggcauaaaagaagaauucugcauagaaaca

SEQ ID NO: 288633 - RNA, 64 nt, hsa
cacauuaguccuaaacgucccauguauuuuucuaggcauaaaaauaaaaguuggcuaaaaauuu

SEQ ID NO: 288634 - RNA, 64 nt, hsa
guuaagcauaucuucugaacugaauacaucagcuggcauaaaaggagcaugaagucuguuaaag

SEQ ID NO: 288635 - RNA, 64 nt, hsa; identical to SEQ ID NO: 266801

SEQ ID NO: 288636 - RNA, 64 nt, hsa; identical to SEQ ID NO: 266802

SEQ ID NO: 288637 - RNA, 64 nt, hsa; identical to SEQ ID NO: 266803

SEQ ID NO: 288638 - RNA, 64 nt, hsa; identical to SEQ ID NO: 266804

SEQ ID NO: 288639 - RNA, 64 nt, hsa; identical to SEQ ID NO: 266805

SEQ ID NO: 288640 - RNA, 64 nt, hsa; identical to SEQ ID NO: 266806

SEQ ID NO: 288641 - RNA, 64 nt, hsa; identical to SEQ ID NO: 219912

SEQ ID NO: 288642 - RNA, 64 nt, hsa; identical to SEQ ID NO: 219913

SEQ ID NO: 288643 - RNA, 64 nt, hsa; identical to SEQ ID NO: 219914

SEQ ID NO: 288644 - RNA, 64 nt, hsa; identical to SEQ ID NO: 219915

SEQ ID NO: 288645 - RNA, 64 nt, hsa; identical to SEQ ID NO: 219916

SEQ ID NO: 288646 - RNA, 64 nt, hsa; identical to SEQ ID NO: 219917

SEQ ID NO: 288647 - RNA, 64 nt, hsa; identical to SEQ ID NO: 219918

SEQ ID NO: 288648 - RNA, 64 nt, hsa; identical to SEQ ID NO: 219919

SEQ ID NO: 288649 - RNA, 64 nt, hsa; identical to SEQ ID NO: 219920

SEQ ID NO: 288650 - RNA, 64 nt, hsa; identical to SEQ ID NO: 219921

SEQ ID NO: 288651 - RNA, 64 nt, hsa; identical to SEQ ID NO: 219922

SEQ ID NO: 288652 - RNA, 64 nt, hsa; identical to SEQ ID NO: 219923

SEQ ID NO: 288653 - RNA, 64 nt, hsa; identical to SEQ ID NO: 219924

SEQ ID NO: 288654 - RNA, 64 nt, hsa; identical to SEQ ID NO: 219925

SEQ ID NO: 288655 - RNA, 64 nt, hsa; identical to SEQ ID NO: 219926

SEQ ID NO: 288656 - RNA, 64 nt, hsa; identical to SEQ ID NO: 219927

SEQ ID NO: 288657 - RNA, 64 nt, hsa; identical to SEQ ID NO: 219928

SEQ ID NO: 288658 - RNA, 64 nt, hsa; identical to SEQ ID NO: 219929

SEQ ID NO: 288659 - RNA, 64 nt, hsa; identical to SEQ ID NO: 219930

SEQ ID NO: 288660 - RNA, 64 nt, hsa; identical to SEQ ID NO: 219931

SEQ ID NO: 288661 - RNA, 64 nt, hsa; identical to SEQ ID NO: 219932

SEQ ID NO: 288662 - RNA, 64 nt, hsa; identical to SEQ ID NO: 219933

SEQ ID NO: 288663 - RNA, 53 nt, hsa; identical to SEQ ID NO: 168469

SEQ ID NO: 288664 - RNA, 64 nt, hsa; identical to SEQ ID NO: 219935

SEQ ID NO: 288665 - RNA, 64 nt, hsa; identical to SEQ ID NO: 219936

SEQ ID NO: 288666 - RNA, 64 nt, hsa; identical to SEQ ID NO: 219937

SEQ ID NO: 288667 - RNA, 64 nt, hsa; identical to SEQ ID NO: 219938

SEQ ID NO: 288668 - RNA, 64 nt, hsa; identical to SEQ ID NO: 219939

SEQ ID NO: 288669 - RNA, 64 nt, hsa; identical to SEQ ID NO: 219940

SEQ ID NO: 288670 - RNA, 64 nt, hsa; identical to SEQ ID NO: 219941

SEQ ID NO: 288671 - RNA, 64 nt, hsa; identical to SEQ ID NO: 219942

SEQ ID NO: 288672 - RNA, 64 nt, hsa; identical to SEQ ID NO: 219943

SEQ ID NO: 288673 - RNA, 64 nt, hsa; identical to SEQ ID NO: 219944

SEQ ID NO: 288674 - RNA, 64 nt, hsa; identical to SEQ ID NO: 219945

SEQ ID NO: 288675 - RNA, 64 nt, hsa; identical to SEQ ID NO: 219946

SEQ ID NO: 288676 - RNA, 64 nt, hsa; identical to SEQ ID NO: 219947

SEQ ID NO: 288677 - RNA, 64 nt, hsa; identical to SEQ ID NO: 219948

SEQ ID NO: 288678 - RNA, 64 nt, hsa; identical to SEQ ID NO: 219949

SEQ ID NO: 288679 - RNA, 64 nt, hsa; identical to SEQ ID NO: 219950

SEQ ID NO: 288680 - RNA, 64 nt, hsa; identical to SEQ ID NO: 219951

SEQ ID NO: 288681 - RNA, 64 nt, hsa; identical to SEQ ID NO: 219952

SEQ ID NO: 288682 - RNA, 64 nt, hsa; identical to SEQ ID NO: 219953

SEQ ID NO: 288683 - RNA, 64 nt, hsa; identical to SEQ ID NO: 219954

SEQ ID NO: 288684 - RNA, 64 nt, hsa; identical to SEQ ID NO: 219955

SEQ ID NO: 288685 - RNA, 64 nt, hsa; identical to SEQ ID NO: 219956

SEQ ID NO: 288686 - RNA, 64 nt, hsa; identical to SEQ ID NO: 219957

SEQ ID NO: 288687 - RNA, 64 nt, hsa; identical to SEQ ID NO: 219958

SEQ ID NO: 288688 - RNA, 64 nt, hsa; identical to SEQ ID NO: 219959

SEQ ID NO: 288689 - RNA, 64 nt, hsa; identical to SEQ ID NO: 219960

SEQ ID NO: 288690 - RNA, 64 nt, hsa; identical to SEQ ID NO: 219961

SEQ ID NO: 288691 - RNA, 64 nt, hsa; identical to SEQ ID NO: 219962

SEQ ID NO: 288692 - RNA, 64 nt, hsa; identical to SEQ ID NO: 219963

SEQ ID NO: 288693 - RNA, 64 nt, hsa; identical to SEQ ID NO: 219964

SEQ ID NO: 288694 - RNA, 64 nt, hsa; identical to SEQ ID NO: 219965

SEQ ID NO: 288695 - RNA, 64 nt, hsa; identical to SEQ ID NO: 219966

SEQ ID NO: 288696 - RNA, 64 nt, hsa; identical to SEQ ID NO: 219967

SEQ ID NO: 288697 - RNA, 64 nt, hsa; identical to SEQ ID NO: 219968

SEQ ID NO: 288698 - RNA, 64 nt, hsa; identical to SEQ ID NO: 219969

SEQ ID NO: 288699 - RNA, 64 nt, hsa; identical to SEQ ID NO: 219970

SEQ ID NO: 288700 - RNA, 64 nt, hsa; identical to SEQ ID NO: 219971

SEQ ID NO: 288701 - RNA, 64 nt, hsa; identical to SEQ ID NO: 59668

SEQ ID NO: 288702 - RNA, 64 nt, hsa; identical to SEQ ID NO: 59669

SEQ ID NO: 288703 - RNA, 64 nt, hsa; identical to SEQ ID NO: 59670

SEQ ID NO: 288704 - RNA, 64 nt, hsa; identical to SEQ ID NO: 59671

SEQ ID NO: 288705 - RNA, 64 nt, hsa; identical to SEQ ID NO: 59672

SEQ ID NO: 288706 - RNA, 64 nt, hsa; identical to SEQ ID NO: 59673

SEQ ID NO: 288707 - RNA, 64 nt, hsa; identical to SEQ ID NO: 59674

SEQ ID NO: 288708 - RNA, 64 nt, hsa; identical to SEQ ID NO: 59675

SEQ ID NO: 288709 - RNA, 64 nt, hsa; identical to SEQ ID NO: 59676

SEQ ID NO: 288710 - RNA, 64 nt, hsa; identical to SEQ ID NO: 59677

SEQ ID NO: 288711 - RNA, 64 nt, hsa; identical to SEQ ID NO: 59678

SEQ ID NO: 288712 - RNA, 64 nt, hsa; identical to SEQ ID NO: 59679

SEQ ID NO: 288713 - RNA, 64 nt, hsa; identical to SEQ ID NO: 59680

SEQ ID NO: 288714 - RNA, 64 nt, hsa; identical to SEQ ID NO: 59681

SEQ ID NO: 288715 - RNA, 64 nt, hsa; identical to SEQ ID NO: 59682

SEQ ID NO: 288716 - RNA, 64 nt, hsa; identical to SEQ ID NO: 59683

SEQ ID NO: 288717 - RNA, 64 nt, hsa; identical to SEQ ID NO: 59684

SEQ ID NO: 288718 - RNA, 64 nt, hsa; identical to SEQ ID NO: 59685

SEQ ID NO: 288719 - RNA, 64 nt, hsa; identical to SEQ ID NO: 59686

SEQ ID NO: 288720 - RNA, 64 nt, hsa; identical to SEQ ID NO: 59687

SEQ ID NO: 288721 - RNA, 64 nt, hsa; identical to SEQ ID NO: 59688

SEQ ID NO: 288722 - RNA, 64 nt, hsa; identical to SEQ ID NO: 59689

SEQ ID NO: 288723 - RNA, 64 nt, hsa; identical to SEQ ID NO: 59690

SEQ ID NO: 288724 - RNA, 64 nt, hsa; identical to SEQ ID NO: 59691

SEQ ID NO: 288725 - RNA, 64 nt, hsa; identical to SEQ ID NO: 59692

SEQ ID NO: 288726 - RNA, 64 nt, hsa; identical to SEQ ID NO: 59693

SEQ ID NO: 288727 - RNA, 64 nt, hsa; identical to SEQ ID NO: 59694

SEQ ID NO: 288728 - RNA, 64 nt, hsa; identical to SEQ ID NO: 59695

SEQ ID NO: 288729 - RNA, 64 nt, hsa; identical to SEQ ID NO: 59696

SEQ ID NO: 288730 - RNA, 64 nt, hsa; identical to SEQ ID NO: 59697

SEQ ID NO: 288731 - RNA, 64 nt, hsa; identical to SEQ ID NO: 59698

SEQ ID NO: 288732 - RNA, 64 nt, hsa; identical to SEQ ID NO: 59699

SEQ ID NO: 288733 - RNA, 64 nt, hsa; identical to SEQ ID NO: 59700

SEQ ID NO: 288734 - RNA, 64 nt, hsa; identical to SEQ ID NO: 59701

SEQ ID NO: 288735 - RNA, 64 nt, hsa; identical to SEQ ID NO: 59702

SEQ ID NO: 288736 - RNA, 64 nt, hsa; identical to SEQ ID NO: 59703

SEQ ID NO: 288737 - RNA, 64 nt, hsa; identical to SEQ ID NO: 59704

SEQ ID NO: 288738 - RNA, 64 nt, hsa; identical to SEQ ID NO: 59705

SEQ ID NO: 288739 - RNA, 64 nt, hsa; identical to SEQ ID NO: 59706

SEQ ID NO: 288740 - RNA, 64 nt, hsa; identical to SEQ ID NO: 59707

SEQ ID NO: 288741 - RNA, 64 nt, hsa; identical to SEQ ID NO: 59708

SEQ ID NO: 288742 - RNA, 64 nt, hsa; identical to SEQ ID NO: 59709

SEQ ID NO: 288743 - RNA, 64 nt, hsa
auacuccaggcuguuuggggugggagccaaaaagaguugagaggccagggcccuugguggaaag

SEQ ID NO: 288744 - RNA, 64 nt, hsa
gauuuucguguucucugcccagaugggcugggggaguugagagugugcuuauuuucacugcgau

SEQ ID NO: 288745 - RNA, 64 nt, hsa
aggugcucagagguacgagaugcccaaguuugucaguugagauuaaaaguaaggaacagagaau

SEQ ID NO: 288746 - RNA, 64 nt, hsa
agacuuagacgaaagaaaggauuucucuuccaacaguugagauucgcauauuugccuauucuuu

SEQ ID NO: 288747 - RNA, 64 nt, hsa
cacaacacgugggaauucugggagauacaauucaaguugagauuuguggggggacacaaccaaa

SEQ ID NO: 288748 - RNA, 64 nt, hsa
acaacacgugggaauucugguagauacaauuucaaguugagauuuggguggggacauagccaaa

SEQ ID NO: 288749 - RNA, 64 nt, hsa
uaagaguuuucuauuucagacaucucuguguggaaguugagacuaagaauaauccuagggaugu

SEQ ID NO: 288750 - RNA, 64 nt, hsa
cguggaauauauuuuauuuucauuaauucagugaaguugagacuucauaguaauuuuagaaugc

SEQ ID NO: 288751 - RNA, 64 nt, hsa
uuuuuuaaaaauuacuuuuaaauauuaacucaaaaguugagauuuuggggugguggugugccaa

SEQ ID NO: 288752 - RNA, 64 nt, hsa
aucuagucacauaaauggauuaauuacuaauuucaguugagaccuucuaauugguuuuuacuga

SEQ ID NO: 288753 - RNA, 64 nt, hsa
augcuccaccuguaagaacagaaaaucgucuuauaguugagaauuuauccucaagagucagcug

SEQ ID NO: 288754 - RNA, 64 nt, hsa
aucccagagcguugauaacgugaucugaucccuaaguugagaccugucuuccuguaacgcuucc

SEQ ID NO: 288755 - RNA, 64 nt, hsa
aaaaaaaaagaccugugguuccagaaagcucauuaguugagauucugugagucuagguugacca

SEQ ID NO: 288756 - RNA, 64 nt, hsa
ucugagauuuugcugguuccaguuugcccaauggaguugagaaucucaaugauucuagaugacu

SEQ ID NO: 288757 - RNA, 64 nt, hsa
guugccuucaguagaaggcauuugugggcugcagaguugagaguugggugagguuagucucucc

SEQ ID NO: 288758 - RNA, 64 nt, hsa
uuugauucucguaaaacgcgcaucuggcgugugcaguugagaaacuugguggcacauggguguu

SEQ ID NO: 288759 - RNA, 64 nt, hsa
ccuugccucuugggacugaccaggagcugcucaugugcgugagagugggaaccaucuccuugcg

SEQ ID NO: 288760 - RNA, 64 nt, hsa
cgaagcauuuagaauggugccuggcacacaguuggugcgugauaugguuaagcuuugugucccc

SEQ ID NO: 288761 - RNA, 64 nt, hsa
ucuaaacacuggaagaauuaacugaagucauaacgugcgugaauuaacagcuucucuauuugau

SEQ ID NO: 288762 - RNA, 64 nt, hsa
gugguggcgugcauauguaaagcacaucagauccgugcgugaaguaggcauauaucacuaagcu

SEQ ID NO: 288763 - RNA, 64 nt, hsa
cucgugaccaaauggccuuggucccgcagcuugugugcgugagugcagugugaguguguguguc

SEQ ID NO: 288764 - RNA, 64 nt, hsa
gugaaccugagacuggccugcaugaauacagggugugcgugaaugaaacugcccacaugaacuu

SEQ ID NO: 288765 - RNA, 64 nt, hsa
uccaaccaucagcaucucaucaugauuuuaaacugugcgugauauaaacucuuaaagauauguu

SEQ ID NO: 288766 - RNA, 64 nt, hsa
gccucucuggcugccacuugguuauguugugugugugcgugaguggugugcaggcgcgguuccu

SEQ ID NO: 288767 - RNA, 64 nt, hsa
agccagggucucucccucagguguuuuuuaugaagugcgugaauguauguaaugugugguggcc

SEQ ID NO: 288768 - RNA, 64 nt, hsa
cggcccacgccguuagcucgugugcguguagucugugcgugagacuccuucgauuguagcucug

SEQ ID NO: 288769 - RNA, 64 nt, hsa
aaguccucuguggccagcugcaucugucugaauggugcgugaaggcucucagaccuuacacacc

SEQ ID NO: 288770 - RNA, 64 nt, hsa
ugguggggugagggaauaugagugcguggugcgagugcgugaauauugggggcccggacgccca

SEQ ID NO: 288771 - RNA, 64 nt, hsa
auauggaguuauguggauuucaucacuaguaugugugcgugagcuggucaguugccaaaggagg

SEQ ID NO: 288772 - RNA, 64 nt, hsa
gccaugcucauugcaggggaggcugggucugggggugcgugacccaauccccuuccuccuggcc

SEQ ID NO: 288773 - RNA, 64 nt, hsa
ucgugagaugggggcuuaacccacacaggucuccgugcgugaaccaggucugcuuaggggaccu

SEQ ID NO: 288774 - RNA, 64 nt, hsa
aacacaaguuagaaauuauaucccauuuaguuaagugcgugauuuauauucagaacaaccuacu

SEQ ID NO: 288775 - RNA, 64 nt, hsa
accguggacagcgcuguauuuacagacacacccagugcgugaagaccaacaaagucacagucgu

SEQ ID NO: 288776 - RNA, 64 nt, hsa
aagaucugaagccugaguguguguacgugcgcgcgugcgugaggcccugccacgauuaaagacu

SEQ ID NO: 288777 - RNA, 64 nt, hsa
gguagucggcuggugucccugucguggagcuggggugcgugaucuggugcucguccacgcaggu

SEQ ID NO: 288778 - RNA, 64 nt, hsa
gagcgccacccgcccgcccccgcccucgcuccgggugcgugaccggcccgccaccuuguacaga

SEQ ID NO: 288779 - RNA, 64 nt, hsa
caccucagucucccaaauagcuaggacuacaggcgugcgugaccaagcccagcuaauuuuugca

SEQ ID NO: 288780 - RNA, 64 nt, hsa
acaaacgcuuucaaaguugggcaaaaguggcccagugcgugaggucagucaacagccaaauucc

SEQ ID NO: 288781 - RNA, 64 nt, hsa
gaggaugcuggggcccugcagugcgcucuaggcugugcgugagccgggacuguacccacagcuu

SEQ ID NO: 288782 - RNA, 64 nt, hsa
cacacaggcuggcgggggccggccccgaggccgcgugcgugagaaccgcgccgguguccccaga

SEQ ID NO: 288783 - RNA, 64 nt, hsa
uucccagggaguggaggaugccuucuacacguuggugcgugagauccggcagcacaagcugcgg

SEQ ID NO: 288784 - RNA, 64 nt, hsa
gacccaauuguguuugccuguugacgugccaucagugcgugaugugguaugacauacacacacc

SEQ ID NO: 288785 - RNA, 64 nt, hsa
uuuugcagcauggguugaguguacaaagccuacugugcgugagauccucuccuuccguuucuga

SEQ ID NO: 288786 - RNA, 64 nt, hsa
cuccucccuguguuaacuggggcuguuggggacagugcgugauuucucagugauuuccuacagu

SEQ ID NO: 288787 - RNA, 64 nt, hsa
cuagacuuccaaguuuguuuucacuuuuuugugugugcgugaaggagucugugucacccaggcu

SEQ ID NO: 288788 - RNA, 64 nt, hsa
ccagcaguucucaaaaugagguccucaggccacagugcgugagaacuugcuuggcuguuuguua

SEQ ID NO: 288789 - RNA, 64 nt, hsa
uuuauugcuuuccauucugugguaugaugugcgugugcgugaguguguggccccuguuuauucc

SEQ ID NO: 288790 - RNA, 64 nt, hsa
gaggguuccuguagaccuagggaggaccuuaucugugcgugaaacacaccaggcugugggccuc

SEQ ID NO: 288791 - RNA, 64 nt, hsa
auauaagcaggaauacuuagccuguauugggaaggugcgugaaacucaaaguugcuaacaucau

SEQ ID NO: 288792 - RNA, 64 nt, hsa
ggacacaaggcuuggcugugagucugguuuuaaagugcgugacagccugaaaagcaugcagggg

SEQ ID NO: 288793 - RNA, 64 nt, hsa
ucucuguugccugaaagagccauuaaagucagucgugcgugaagcaucucucuucuaaaggaug

SEQ ID NO: 288794 - RNA, 64 nt, hsa
cccuggacgagcgggcccugcaggacuuuccugugugcgugagcaccaagccggagcccgagga

SEQ ID NO: 288795 - RNA, 64 nt, hsa
uccuccugccaacauucagucugguaugugaggcgugcgugaagcaagaacuccuggagcuaca

SEQ ID NO: 288796 - RNA, 64 nt, hsa
acuuaaaacugccaaaugauuuuuguucuuuuaugugcgugauaaaaauacaaagaauggugug

SEQ ID NO: 288797 - RNA, 64 nt, hsa
gugcugcccuugcugcugcuggucgggcacccaagugcgugaggggcuucagccugucccgggg

SEQ ID NO: 288798 - RNA, 64 nt, hsa
gcggcagggccggcaccugcgugccugugcccgugugcgugagacagagcccuugccccugcug

SEQ ID NO: 288799 - RNA, 64 nt, hsa
cacauuugaccuuuuggcacagcccagguuccaggugcgugaccugcccuuuuucucauucccu

SEQ ID NO: 288800 - RNA, 64 nt, hsa
cgcccucucuguccucugugaacagugugugugcgugcgugagaccacagaucuguggacacac

SEQ ID NO: 288801 - RNA, 64 nt, hsa
ccaaacaaagacugauaauuccugguaggggugugugcgugacguacugcagccucaaccuccu

SEQ ID NO: 288802 - RNA, 64 nt, hsa
agcagagaccaguaaaggagccuccugguccucagugcgugacccugucagugcuuucaggaga

SEQ ID NO: 288803 - RNA, 64 nt, hsa
auaggccuguguguauagcuguguguguguucaagugcgugacuguaugugugugugugaacca

SEQ ID NO: 288804 - RNA, 64 nt, hsa
uaauugagacaaguguucaaacagaaagacgcuugugcgugaauguucauggcagcccuauuca

SEQ ID NO: 288805 - RNA, 64 nt, hsa
gggaugccacuccauuccuccgccccguggucuggugcgugacaauccaaagcgccgagacgag

SEQ ID NO: 288806 - RNA, 64 nt, hsa
uaauugagacaaguguucaaacagaaagacgcuugugcgugaauguucauggcggcccuauuca

SEQ ID NO: 288807 - RNA, 64 nt, hsa
uauagaauguguuuuauacccgaucguguguggugugcgugaggacaaacuccgcaggggcugu

SEQ ID NO: 288808 - RNA, 64 nt, hsa
caaagacuguuggugacaggguguguguguaucugugcgugagugugagugugugugagagaga

SEQ ID NO: 288809 - RNA, 64 nt, hsa
cuacaguagucuuucuuguuucuaguugagcugcgugcgugaaugcuuauuuucuuuuguuuau

SEQ ID NO: 288810 - RNA, 64 nt, hsa
gagugggagugugugagugugagcaggcgggcgagugcgugagugcacgccagcgcguggccca

SEQ ID NO: 288811 - RNA, 64 nt, hsa
ccaucacagcucaguguugguggcauaguuccaggugcgugaaaguauuugcugauucuuugaa

SEQ ID NO: 288812 - RNA, 64 nt, hsa
acauugacacguauauaaagauccacgcguggcugugcgugauaucucacacucugaauucuua

SEQ ID NO: 288813 - RNA, 64 nt, hsa
uaucaauugugugagcuugggugcgagugcacgcgugcgugaguacggagaguauauauagauc

SEQ ID NO: 288814 - RNA, 64 nt, hsa
uacuuucucccucacauaaaugcaauuaauauccgugcgugauauauauaaagcaaacauaaga

SEQ ID NO: 288815 - RNA, 64 nt, hsa
ucauguguacugagcagcuaccauguucaagguaauaugccaggcgcuguaugucuccacugcc

SEQ ID NO: 288816 - RNA, 64 nt, hsa
uaaaaguuaagggguaguuggcaccuccuuauuaauaugccagccuagaucccccccgguggag

SEQ ID NO: 288817 - RNA, 64 nt, hsa
cuagggugcuccuguuggauggugaggucacuccauaugccaauacaaacaacaaugcggugga

SEQ ID NO: 288818 - RNA, 62 nt, hsa
uggccuuugguucauguuuucuccccauauguauauaugccauaugugaauaugccauauau

SEQ ID NO: 288819 - RNA, 64 nt, hsa
ccuuaauacagauuauuaugcccucuuugguacuauaugccauggaugugaauuucccauagaa

SEQ ID NO: 288820 - RNA, 64 nt, hsa
uuuguuuguuuguuuaguuuugccuucauagguuauaugccaagauaguauuugauaagucaau

SEQ ID NO: 288821 - RNA, 64 nt, hsa
cucuauaccaguggcugacaaggcauauagggauauaugccauccugagaggaguaaaguguuu

SEQ ID NO: 288822 - RNA, 64 nt, hsa
uacacuaaauucacucaacuauuguaugccuaccauaugccagauuuuauccuagacccugagg

SEQ ID NO: 288823 - RNA, 64 nt, hsa; identical to SEQ ID NO: 107704

SEQ ID NO: 288824 - RNA, 64 nt, hsa; identical to SEQ ID NO: 107705

SEQ ID NO: 288825 - RNA, 64 nt, hsa; identical to SEQ ID NO: 107706

SEQ ID NO: 288826 - RNA, 64 nt, hsa; identical to SEQ ID NO: 107707

SEQ ID NO: 288827 - RNA, 64 nt, hsa; identical to SEQ ID NO: 107708

SEQ ID NO: 288828 - RNA, 64 nt, hsa; identical to SEQ ID NO: 107709

SEQ ID NO: 288829 - RNA, 64 nt, hsa; identical to SEQ ID NO: 107710

SEQ ID NO: 288830 - RNA, 64 nt, hsa; identical to SEQ ID NO: 107711

SEQ ID NO: 288831 - RNA, 64 nt, hsa; identical to SEQ ID NO: 107712

SEQ ID NO: 288832 - RNA, 64 nt, hsa; identical to SEQ ID NO: 107713

SEQ ID NO: 288833 - RNA, 64 nt, hsa; identical to SEQ ID NO: 107714

SEQ ID NO: 288834 - RNA, 64 nt, hsa; identical to SEQ ID NO: 107715

SEQ ID NO: 288835 - RNA, 64 nt, hsa; identical to SEQ ID NO: 107716

SEQ ID NO: 288836 - RNA, 64 nt, hsa; identical to SEQ ID NO: 107717

SEQ ID NO: 288837 - RNA, 64 nt, hsa; identical to SEQ ID NO: 107718

SEQ ID NO: 288838 - RNA, 64 nt, hsa; identical to SEQ ID NO: 107719

SEQ ID NO: 288839 - RNA, 64 nt, hsa; identical to SEQ ID NO: 107720

SEQ ID NO: 288840 - RNA, 64 nt, hsa; identical to SEQ ID NO: 107721

SEQ ID NO: 288841 - RNA, 64 nt, hsa; identical to SEQ ID NO: 107722

SEQ ID NO: 288842 - RNA, 64 nt, hsa; identical to SEQ ID NO: 107723

SEQ ID NO: 288843 - RNA, 64 nt, hsa; identical to SEQ ID NO: 107724

SEQ ID NO: 288844 - RNA, 64 nt, hsa; identical to SEQ ID NO: 107725

SEQ ID NO: 288845 - RNA, 64 nt, hsa; identical to SEQ ID NO: 107726

SEQ ID NO: 288846 - RNA, 64 nt, hsa; identical to SEQ ID NO: 107727

SEQ ID NO: 288847 - RNA, 64 nt, hsa; identical to SEQ ID NO: 107728

SEQ ID NO: 288848 - RNA, 64 nt, hsa; identical to SEQ ID NO: 107729

SEQ ID NO: 288849 - RNA, 64 nt, hsa; identical to SEQ ID NO: 107730

SEQ ID NO: 288850 - RNA, 64 nt, hsa; identical to SEQ ID NO: 107731

SEQ ID NO: 288851 - RNA, 64 nt, hsa; identical to SEQ ID NO: 107732

SEQ ID NO: 288852 - RNA, 64 nt, hsa; identical to SEQ ID NO: 107733

SEQ ID NO: 288853 - RNA, 64 nt, hsa; identical to SEQ ID NO: 107734

SEQ ID NO: 288854 - RNA, 64 nt, hsa; identical to SEQ ID NO: 107735

SEQ ID NO: 288855 - RNA, 64 nt, hsa; identical to SEQ ID NO: 107736

SEQ ID NO: 288856 - RNA, 64 nt, hsa; identical to SEQ ID NO: 107737

SEQ ID NO: 288857 - RNA, 64 nt, hsa; identical to SEQ ID NO: 107738

SEQ ID NO: 288858 - RNA, 64 nt, hsa; identical to SEQ ID NO: 107739

SEQ ID NO: 288859 - RNA, 60 nt, hsa; identical to SEQ ID NO: 107740

SEQ ID NO: 288860 - RNA, 64 nt, hsa; identical to SEQ ID NO: 107741

SEQ ID NO: 288861 - RNA, 64 nt, hsa; identical to SEQ ID NO: 107742

SEQ ID NO: 288862 - RNA, 64 nt, hsa; identical to SEQ ID NO: 107743

SEQ ID NO: 288863 - RNA, 64 nt, hsa; identical to SEQ ID NO: 107744

SEQ ID NO: 288864 - RNA, 64 nt, hsa; identical to SEQ ID NO: 107745

SEQ ID NO: 288865 - RNA, 64 nt, hsa; identical to SEQ ID NO: 107746

SEQ ID NO: 288866 - RNA, 64 nt, hsa; identical to SEQ ID NO: 107747

SEQ ID NO: 288867 - RNA, 64 nt, hsa; identical to SEQ ID NO: 107748

SEQ ID NO: 288868 - RNA, 64 nt, hsa; identical to SEQ ID NO: 107749

SEQ ID NO: 288869 - RNA, 64 nt, hsa; identical to SEQ ID NO: 107750

SEQ ID NO: 288870 - RNA, 64 nt, hsa; identical to SEQ ID NO: 107751

SEQ ID NO: 288871 - RNA, 64 nt, hsa; identical to SEQ ID NO: 107752

SEQ ID NO: 288872 - RNA, 64 nt, hsa; identical to SEQ ID NO: 107753

SEQ ID NO: 288873 - RNA, 64 nt, hsa; identical to SEQ ID NO: 107754

SEQ ID NO: 288874 - RNA, 64 nt, hsa; identical to SEQ ID NO: 107755

SEQ ID NO: 288875 - RNA, 64 nt, hsa; identical to SEQ ID NO: 107756

SEQ ID NO: 288876 - RNA, 64 nt, hsa; identical to SEQ ID NO: 107757

SEQ ID NO: 288877 - RNA, 64 nt, hsa; identical to SEQ ID NO: 107758

SEQ ID NO: 288878 - RNA, 64 nt, hsa; identical to SEQ ID NO: 107759

SEQ ID NO: 288879 - RNA, 64 nt, hsa; identical to SEQ ID NO: 107760

SEQ ID NO: 288880 - RNA, 64 nt, hsa; identical to SEQ ID NO: 107761

SEQ ID NO: 288881 - RNA, 64 nt, hsa; identical to SEQ ID NO: 107762

SEQ ID NO: 288882 - RNA, 64 nt, hsa; identical to SEQ ID NO: 107763

SEQ ID NO: 288883 - RNA, 64 nt, hsa; identical to SEQ ID NO: 107764

SEQ ID NO: 288884 - RNA, 64 nt, hsa; identical to SEQ ID NO: 107765

SEQ ID NO: 288885 - RNA, 64 nt, hsa; identical to SEQ ID NO: 107766

SEQ ID NO: 288886 - RNA, 64 nt, hsa; identical to SEQ ID NO: 107767

SEQ ID NO: 288887 - RNA, 64 nt, hsa; identical to SEQ ID NO: 107768

SEQ ID NO: 288888 - RNA, 64 nt, hsa
agguucaagauaacggggucaggccuuuaacuuccucaaacaggcccaagcaaaggcuggaaga

SEQ ID NO: 288889 - RNA, 64 nt, hsa
cuucacugagacucagagggaaaaggaaaagagccucaaacauuuuuaggagguuguccaucau

SEQ ID NO: 288890 - RNA, 64 nt, hsa
ucagggccucacuuguauagaauguaauguucuccucaaacauuuauguuaacucuauaaacaa

SEQ ID NO: 288891 - RNA, 64 nt, hsa
ccaucagaauagagaccugcagaggcccagggcacucaaacauaacugugcuugucucagucaa

SEQ ID NO: 288892 - RNA, 64 nt, hsa; identical to SEQ ID NO: 107704

SEQ ID NO: 288893 - RNA, 64 nt, hsa; identical to SEQ ID NO: 107705

SEQ ID NO: 288894 - RNA, 64 nt, hsa; identical to SEQ ID NO: 107706

SEQ ID NO: 288895 - RNA, 64 nt, hsa; identical to SEQ ID NO: 107707

SEQ ID NO: 288896 - RNA, 64 nt, hsa; identical to SEQ ID NO: 107708

SEQ ID NO: 288897 - RNA, 64 nt, hsa; identical to SEQ ID NO: 107709

SEQ ID NO: 288898 - RNA, 64 nt, hsa; identical to SEQ ID NO: 107710

SEQ ID NO: 288899 - RNA, 64 nt, hsa; identical to SEQ ID NO: 107711

SEQ ID NO: 288900 - RNA, 64 nt, hsa; identical to SEQ ID NO: 107712

SEQ ID NO: 288901 - RNA, 64 nt, hsa; identical to SEQ ID NO: 107713

SEQ ID NO: 288902 - RNA, 64 nt, hsa; identical to SEQ ID NO: 107714

SEQ ID NO: 288903 - RNA, 64 nt, hsa; identical to SEQ ID NO: 107715

SEQ ID NO: 288904 - RNA, 64 nt, hsa; identical to SEQ ID NO: 107716

SEQ ID NO: 288905 - RNA, 64 nt, hsa; identical to SEQ ID NO: 107717

SEQ ID NO: 288906 - RNA, 64 nt, hsa; identical to SEQ ID NO: 107718

SEQ ID NO: 288907 - RNA, 64 nt, hsa; identical to SEQ ID NO: 107719

SEQ ID NO: 288908 - RNA, 64 nt, hsa; identical to SEQ ID NO: 107720

SEQ ID NO: 288909 - RNA, 64 nt, hsa; identical to SEQ ID NO: 107721

SEQ ID NO: 288910 - RNA, 64 nt, hsa; identical to SEQ ID NO: 107722

SEQ ID NO: 288911 - RNA, 64 nt, hsa; identical to SEQ ID NO: 107723

SEQ ID NO: 288912 - RNA, 64 nt, hsa; identical to SEQ ID NO: 107724

SEQ ID NO: 288913 - RNA, 64 nt, hsa; identical to SEQ ID NO: 107725

SEQ ID NO: 288914 - RNA, 64 nt, hsa; identical to SEQ ID NO: 107726

SEQ ID NO: 288915 - RNA, 64 nt, hsa; identical to SEQ ID NO: 107727

SEQ ID NO: 288916 - RNA, 64 nt, hsa; identical to SEQ ID NO: 107728

SEQ ID NO: 288917 - RNA, 64 nt, hsa; identical to SEQ ID NO: 107729

SEQ ID NO: 288918 - RNA, 64 nt, hsa; identical to SEQ ID NO: 107730

SEQ ID NO: 288919 - RNA, 64 nt, hsa; identical to SEQ ID NO: 107731

SEQ ID NO: 288920 - RNA, 64 nt, hsa; identical to SEQ ID NO: 107732

SEQ ID NO: 288921 - RNA, 64 nt, hsa; identical to SEQ ID NO: 107733

SEQ ID NO: 288922 - RNA, 64 nt, hsa; identical to SEQ ID NO: 107734

SEQ ID NO: 288923 - RNA, 64 nt, hsa; identical to SEQ ID NO: 107735

SEQ ID NO: 288924 - RNA, 64 nt, hsa; identical to SEQ ID NO: 107736

SEQ ID NO: 288925 - RNA, 64 nt, hsa; identical to SEQ ID NO: 107737

SEQ ID NO: 288926 - RNA, 64 nt, hsa; identical to SEQ ID NO: 107738

SEQ ID NO: 288927 - RNA, 64 nt, hsa; identical to SEQ ID NO: 107739

SEQ ID NO: 288928 - RNA, 60 nt, hsa; identical to SEQ ID NO: 107740

SEQ ID NO: 288929 - RNA, 64 nt, hsa; identical to SEQ ID NO: 107741

SEQ ID NO: 288930 - RNA, 64 nt, hsa; identical to SEQ ID NO: 107742

SEQ ID NO: 288931 - RNA, 64 nt, hsa; identical to SEQ ID NO: 107743

SEQ ID NO: 288932 - RNA, 64 nt, hsa; identical to SEQ ID NO: 107744

SEQ ID NO: 288933 - RNA, 64 nt, hsa; identical to SEQ ID NO: 107745

SEQ ID NO: 288934 - RNA, 64 nt, hsa; identical to SEQ ID NO: 107746

SEQ ID NO: 288935 - RNA, 64 nt, hsa; identical to SEQ ID NO: 107747

SEQ ID NO: 288936 - RNA, 64 nt, hsa; identical to SEQ ID NO: 107748

SEQ ID NO: 288937 - RNA, 64 nt, hsa; identical to SEQ ID NO: 107749

SEQ ID NO: 288938 - RNA, 64 nt, hsa; identical to SEQ ID NO: 107750

SEQ ID NO: 288939 - RNA, 64 nt, hsa; identical to SEQ ID NO: 107751

SEQ ID NO: 288940 - RNA, 64 nt, hsa; identical to SEQ ID NO: 107752

SEQ ID NO: 288941 - RNA, 64 nt, hsa; identical to SEQ ID NO: 107753

SEQ ID NO: 288942 - RNA, 64 nt, hsa; identical to SEQ ID NO: 107754

SEQ ID NO: 288943 - RNA, 64 nt, hsa; identical to SEQ ID NO: 107755

SEQ ID NO: 288944 - RNA, 64 nt, hsa; identical to SEQ ID NO: 107756

SEQ ID NO: 288945 - RNA, 64 nt, hsa; identical to SEQ ID NO: 107757

SEQ ID NO: 288946 - RNA, 64 nt, hsa; identical to SEQ ID NO: 107758

SEQ ID NO: 288947 - RNA, 64 nt, hsa; identical to SEQ ID NO: 107759

SEQ ID NO: 288948 - RNA, 64 nt, hsa; identical to SEQ ID NO: 107760

SEQ ID NO: 288949 - RNA, 64 nt, hsa; identical to SEQ ID NO: 107761

SEQ ID NO: 288950 - RNA, 64 nt, hsa; identical to SEQ ID NO: 107762

SEQ ID NO: 288951 - RNA, 64 nt, hsa; identical to SEQ ID NO: 107763

SEQ ID NO: 288952 - RNA, 64 nt, hsa; identical to SEQ ID NO: 107764

SEQ ID NO: 288953 - RNA, 64 nt, hsa; identical to SEQ ID NO: 107765

SEQ ID NO: 288954 - RNA, 64 nt, hsa; identical to SEQ ID NO: 107766

SEQ ID NO: 288955 - RNA, 64 nt, hsa; identical to SEQ ID NO: 107767

SEQ ID NO: 288956 - RNA, 64 nt, hsa; identical to SEQ ID NO: 107768

SEQ ID NO: 288957 - RNA, 64 nt, hsa; identical to SEQ ID NO: 288888

SEQ ID NO: 288958 - RNA, 64 nt, hsa; identical to SEQ ID NO: 288889

SEQ ID NO: 288959 - RNA, 64 nt, hsa; identical to SEQ ID NO: 288890

SEQ ID NO: 288960 - RNA, 64 nt, hsa; identical to SEQ ID NO: 288891

SEQ ID NO: 288961 - RNA, 64 nt, hsa
gauccuggaccugggaggccccugugagggccagcucuggaaaaaccugggaguugaugccgga

SEQ ID NO: 288962 - RNA, 64 nt, hsa
uggcaacugucacgugugcuagaagguucgaugccucuggaaugcaugugauacucaucuccau

SEQ ID NO: 288963 - RNA, 64 nt, hsa
caagaaaccaaagucugccgcccaccucgcuccccucuggaaucuuccccaagggccaaaccca

SEQ ID NO: 288964 - RNA, 64 nt, hsa
ucaucuccugacccucccacucccaucuccuuaccucuggaaccccccaggcccuacaaugcuc

SEQ ID NO: 288965 - RNA, 64 nt, hsa
ugacauuccuccauguccucacggcuggauuucucucuggaaaggauuuucauucaucauggug

SEQ ID NO: 288966 - RNA, 64 nt, hsa
acccucuguaggccaguaguucucaaaguguggucucuggaagagcaguaucagcaucaucugg

SEQ ID NO: 288967 - RNA, 64 nt, hsa
uccccgguugcuggucagguccccauggcuuguucucuggaaccugacuuuagauguuuuggga

SEQ ID NO: 288968 - RNA, 64 nt, hsa
uagggguggcgcucagaccccacccuacgcucaucucuggaaggggcagcccugaguggucacu

SEQ ID NO: 288969 - RNA, 64 nt, hsa
ggaagacccccuccagaagcauacuggaagccaccucuggaaaagccucauauggugauaugcc

SEQ ID NO: 288970 - RNA, 64 nt, hsa
ggcccuuugccagacagcucugucuccccauguccucuggaacagcugggcaugggucauggcc

SEQ ID NO: 288971 - RNA, 64 nt, hsa
cuugcccucuccucaccuccuuuucucucagugacucuggaaccugaaugcagcuuacaagaca

SEQ ID NO: 288972 - RNA, 64 nt, hsa
caggagcuagcagaaaauaacucaaaguugaagacucuggaagauuuugcuuuaaccuaacucg

SEQ ID NO: 288973 - RNA, 64 nt, hsa
ccucacuauucuuggaccaugccagauucugccucucuggaaagaggcucuggacagcagaagc

SEQ ID NO: 288974 - RNA, 64 nt, hsa
gagucccuaccugcuucacguuggccggcggcuacucuggaauguuuuucccuccccagaauca

SEQ ID NO: 288975 - RNA, 64 nt, hsa
agccugcacugcccagugggccacuaggggcagucucuggaagggcugguucaaggcuguuugg

SEQ ID NO: 288976 - RNA, 64 nt, hsa
gcagaugucacaggauuaaaugugcaguuuggggcucuggaauuugggucagaaccuucucucu

SEQ ID NO: 288977 - RNA, 64 nt, hsa
cucucggggucuuuccucagccucgaaaagugggcucuggaaucccuuuguaaauagguguguu

SEQ ID NO: 288978 - RNA, 64 nt, hsa
aauucuggugagggacauuguaguucgcaugguucucuggaaacgcgccaggaaaagcuuccgu

SEQ ID NO: 288979 - RNA, 64 nt, hsa
agggguagucccucucaccugcuuccucagacgacucuggaagcuucccucuaccacugggcac

SEQ ID NO: 288980 - RNA, 52 nt, hsa; identical to SEQ ID NO: 69449

SEQ ID NO: 288981 - RNA, 64 nt, hsa
gccguagcaugauugcgcucauggauacagauggcucuggaaagcucaaccugcaggaguucca

SEQ ID NO: 288982 - RNA, 64 nt, hsa
cucuggaaagcucaaccugcaggaguuccaccaccucuggaacaagauuaaggccuggcaggug

SEQ ID NO: 288983 - RNA, 64 nt, hsa
gauguccccaccacuccuggagucccaaugacuucucuggaaagacaaagagguuaucacaaaa

SEQ ID NO: 288984 - RNA, 64 nt, hsa
acauuguuuuauaaagaacgugauuuccagugaucucuggaagcgcuaaagcuaaaauuucugu

SEQ ID NO: 288985 - RNA, 64 nt, hsa
uuucucgaugugcacugugaugccuggaaccuuccucuggaagugcugauuuuauggacugagg

SEQ ID NO: 288986 - RNA, 64 nt, hsa
uaagcgucuccaauaugacuauuaaaacugucaccucuggaaauacacuagugugagccuucag

SEQ ID NO: 288987 - RNA, 64 nt, hsa
ggccuacauucuucccgaggcuccaggccgcugucucuggaaguaaaagagccuugucugaccu

SEQ ID NO: 288988 - RNA, 64 nt, hsa
cccacagucaggggccuccacaugccuggccuggcucuggaagucacgucuuagcuucugaaca

SEQ ID NO: 288989 - RNA, 64 nt, hsa
uacccaucagcccuugcaagucccccacucaggccucuggaagguccagggaugggcucugaug

SEQ ID NO: 288990 - RNA, 64 nt, hsa
cugcuaugaggguguauauauuuuuuacccaaagcucuggaauuguacauuuauuuuuuaaaac

SEQ ID NO: 288991 - RNA, 64 nt, hsa
gagaacugggaacauugcauccauggguugaugucucuggaagugcaaccacccaaugucucug

SEQ ID NO: 288992 - RNA, 64 nt, hsa
gguugaugucucuggaagugcaaccacccaaugucucuggaagugccaccuggaagugccaccu

SEQ ID NO: 288993 - RNA, 64 nt, hsa
ggaagugccaccuggaagugccaccuggaagugucucuggaagagcacccaccacuguucagcc

SEQ ID NO: 288994 - RNA, 64 nt, hsa
ccccgcaaguccauuuuauuuccuucuugugcugcucuggaagagaggcaguagcaaagagaug

SEQ ID NO: 288995 - RNA, 64 nt, hsa
gcucaccuugagcagccucagaucaucucugucacucuggaagggacaccccagccagggacgg

SEQ ID NO: 288996 - RNA, 64 nt, hsa
auugagcuccaagcacagcaaagccugacagaaucucuggaaugcaccguggcagaaaccgagg

SEQ ID NO: 288997 - RNA, 64 nt, hsa
auggagaucuuggaacugaaacgcacagccagugcucuggaaauugagcuccaagcacagcaaa

SEQ ID NO: 288998 - RNA, 64 nt, hsa
ccuauucaauacauuaugcuuaaauuagcaguuucucuggaauuccugucucuccuuuaaaaga

SEQ ID NO: 288999 - RNA, 64 nt, hsa
uuguugauaucgucauauaaagccauugcaaggacucuggaaacugccgccaaugaccaauuuc

SEQ ID NO: 289000 - RNA, 64 nt, hsa
acucuggaaccucugugacgccaguucucccugacucuggaaccucugugauccuuugcagguu

SEQ ID NO: 289001 - RNA, 64 nt, hsa
auuucacucagcugcuccucucaguucucccugacucuggaaccucugugacgccaguucuccc

SEQ ID NO: 289002 - RNA, 64 nt, hsa
ggcucuguguacagcgcugugcauguuacauuugcucuggaaacaucucugggguuugcuuguu

SEQ ID NO: 289003 - RNA, 64 nt, hsa
gguggaauacccaaggucauguagccagugagugcucuggaaagccaaagcagcucaucccuuc

SEQ ID NO: 289004 - RNA, 64 nt, hsa
cauugguaagaguagcuggguuuucuaagccacucucuggaaucucuuuguguuagggucucga

SEQ ID NO: 289005 - RNA, 64 nt, hsa
gugucacgccaggaggcuguggcugcugugggcccucuggaauugugcuccucacaaaguuucc

SEQ ID NO: 289006 - RNA, 64 nt, hsa
ccuuggcgucuguucugggagcacggaugauaagcucuggaagcuggcaguguguaaagcacug

SEQ ID NO: 289007 - RNA, 64 nt, hsa
cacaacaguaucuuaaguuuaacugggcacuucccucuggaaaucacaguguugugcaccagga

SEQ ID NO: 289008 - RNA, 64 nt, hsa
ggagcucuuuaaaaauaaauugcucuggucccaccucuggaaaucugauucagccagcauggau

SEQ ID NO: 289009 - RNA, 64 nt, hsa
guacauuccuguuauuuucuggguuuuaucauuuugccuaaaauaggauauaaaagggacaaaa

SEQ ID NO: 289010 - RNA, 64 nt, hsa
gcuuauuuauaaaaggaauguuucugaaugcaagugccuaaaaagaucuuuguugguaugcaua

SEQ ID NO: 289011 - RNA, 64 nt, hsa
uacuguaccauccauaaugcaggacauuucuuacugccuaaauuucacaccauugcucuuuuaa

SEQ ID NO: 289012 - RNA, 64 nt, hsa
auucuauaauuuauuugcuucauaaagauucaccugccuaaacaauauugaaguauccauaggg

SEQ ID NO: 289013 - RNA, 64 nt, hsa
uggguggauuuguguaagucacuuaaccucugugugccuaaacaaguugugcuuuuuuaaaagg

SEQ ID NO: 289014 - RNA, 64 nt, hsa
uguuuuccaucuaugucccgauuccccuaaauuuugccuaaaauucaguauguuccuuaaguuu

SEQ ID NO: 289015 - RNA, 64 nt, hsa
uaauaaauucuucuuaccugacguaacuucucaaugccuaaauucuguaguugaagcucugcug

SEQ ID NO: 289016 - RNA, 64 nt, hsa
cuaauaauugagggugcuaauuuucuuaagauagugccuaaaacacuaaauuucagucaagucg

SEQ ID NO: 289017 - RNA, 64 nt, hsa
acccugaugaaaccuugaaguucugaaauuuaacugccuaaaauguucuccuuagaugugagag

SEQ ID NO: 289018 - RNA, 64 nt, hsa
ggagagaaaaaauuaacuagguugcuacuuuauuugccuaaauacuuuuuucuauuuuguuaga

SEQ ID NO: 289019 - RNA, 64 nt, hsa
augcaugaugaaugaaugaauuucaguuguacauugccuaaaucauaacuugaugaugcuuggg

SEQ ID NO: 289020 - RNA, 64 nt, hsa
agcggaauguaaaacggaaauacugaaagacuuuugccuaaaguggcauuauugacugcuggug

SEQ ID NO: 289021 - RNA, 64 nt, hsa; identical to SEQ ID NO: 289020

SEQ ID NO: 289022 - RNA, 64 nt, hsa; identical to SEQ ID NO: 289019

SEQ ID NO: 289023 - RNA, 64 nt, hsa
uagcuuauucuaggaaugccugauucuuuaauauugccuaaaucggaaccuuuuucuauguugc

SEQ ID NO: 289024 - RNA, 64 nt, hsa
uggcggcaaguaaguaucauaguauuaagaaauuugccuaaaucugaguugugccuuucuuuac

SEQ ID NO: 289025 - RNA, 64 nt, hsa
uacuggaaggaaauauuuucuggacuuaaguaguugccuaaauuuaagauuccuacacuuuauu

SEQ ID NO: 289026 - RNA, 64 nt, hsa
guuaugccugggagugccacuggcauaccgcaggugccuaaaucccaggccccuuucucagggg

SEQ ID NO: 289027 - RNA, 64 nt, hsa
uguuacucauacucgggugggcuccuuagucagaugccuaaaacauuuugccuaaagcucgaug

SEQ ID NO: 289028 - RNA, 64 nt, hsa
gggugggcuccuuagucagaugccuaaaacauuuugccuaaagcucgauggguucuggaggaca

SEQ ID NO: 289029 - RNA, 64 nt, hsa; identical to SEQ ID NO: 119409

SEQ ID NO: 289030 - RNA, 64 nt, hsa; identical to SEQ ID NO: 119410

SEQ ID NO: 289031 - RNA, 64 nt, hsa; identical to SEQ ID NO: 119411

SEQ ID NO: 289032 - RNA, 64 nt, hsa; identical to SEQ ID NO: 119412

SEQ ID NO: 289033 - RNA, 64 nt, hsa; identical to SEQ ID NO: 119413

SEQ ID NO: 289034 - RNA, 64 nt, hsa; identical to SEQ ID NO: 119414

SEQ ID NO: 289035 - RNA, 64 nt, hsa; identical to SEQ ID NO: 119415

SEQ ID NO: 289036 - RNA, 64 nt, hsa; identical to SEQ ID NO: 119415

SEQ ID NO: 289037 - RNA, 64 nt, hsa; identical to SEQ ID NO: 119417

SEQ ID NO: 289038 - RNA, 64 nt, hsa; identical to SEQ ID NO: 119418

SEQ ID NO: 289039 - RNA, 64 nt, hsa; identical to SEQ ID NO: 119419

SEQ ID NO: 289040 - RNA, 64 nt, hsa; identical to SEQ ID NO: 119420

SEQ ID NO: 289041 - RNA, 64 nt, hsa; identical to SEQ ID NO: 119421

SEQ ID NO: 289042 - RNA, 64 nt, hsa; identical to SEQ ID NO: 119422

SEQ ID NO: 289043 - RNA, 64 nt, hsa; identical to SEQ ID NO: 119423

SEQ ID NO: 289044 - RNA, 64 nt, hsa; identical to SEQ ID NO: 119424

SEQ ID NO: 289045 - RNA, 64 nt, hsa; identical to SEQ ID NO: 119425

SEQ ID NO: 289046 - RNA, 64 nt, hsa; identical to SEQ ID NO: 119426

SEQ ID NO: 289047 - RNA, 51 nt, hsa; identical to SEQ ID NO: 119427

SEQ ID NO: 289048 - RNA, 64 nt, hsa; identical to SEQ ID NO: 119428

SEQ ID NO: 289049 - RNA, 64 nt, hsa
augagccaccgcgcccggcccacucugccauugucuaagccaccucugaaagcagguuuuaaca

SEQ ID NO: 289050 - RNA, 64 nt, hsa
uagugucauccacagcaguucauccucauccacacuaagccauccuguuagcuuuuaaaggaag

SEQ ID NO: 289051 - RNA, 64 nt, hsa
caucucucauaggugcaaccugagagugggggagcuaagccaugagguaggggcaggcaagaga

SEQ ID NO: 289052 - RNA, 64 nt, hsa
cuuggugcugggaaccucaggguauugcuugccacuaagccaugaaaccagagacaaaaucucu

SEQ ID NO: 289053 - RNA, 50 nt, hsa
agguguaccagauacgaugacuaagccagggccccuggaucuccucccuu

SEQ ID NO: 289054 - RNA, 64 nt, hsa
cagacaguguacaaacuaagaaggccuaacugaacuaagccauauuuaucacccguggacagca

SEQ ID NO: 289055 - RNA, 64 nt, hsa
uuguauaauacccuaucaugugaguauaccuuaacuaagccauucccauauucaacauuuugug

SEQ ID NO: 289056 - RNA, 64 nt, hsa
uagugugguugguauggaauccuugcuggcuuuacuaagccagccacacuuggagucugccccc

SEQ ID NO: 289057 - RNA, 64 nt, hsa
ggccccuuggucuugaauuuccuagccucuacaacuaagccaaauaaauuucuguuuauuauaa

SEQ ID NO: 289058 - RNA, 64 nt, hsa
ugacagcuuuccuuggugacccaaaccuuguagccuaagccauuugucuuuuucucaguggagg

SEQ ID NO: 289059 - RNA, 64 nt, hsa
guaauucuucagauaugagauagugggcuuagaccuaagccauacauauuucuuuucccacauu

SEQ ID NO: 289060 - RNA, 64 nt, hsa
ucauugcucagccccaaugagaaagcagauacaccuaagccaucaucaaccacuaacaucucaa

SEQ ID NO: 289061 - RNA, 64 nt, hsa
aaaauggggaggcuugggauuucauuuaaauaaucuaagccaagaugauaaaaaaaaccuucaa

SEQ ID NO: 289062 - RNA, 64 nt, hsa
cagugccauuguuuugccagugaagccuccaacccuaagccacugggacgguggccagagaugc

SEQ ID NO: 289063 - RNA, 64 nt, hsa
auaaugauucacagaauuuaguaacagaaucaaacuaagccauguaugaggguaaucgagauga

SEQ ID NO: 289064 - RNA, 64 nt, hsa
accucauuauuuguccuaucucucccuuauaguccuaagccaagacauuugaccuuugacauuu

SEQ ID NO: 289065 - RNA, 64 nt, hsa
caugggaggaggagguggggcccacucaacacaccuaagccaguggcccucuaggaggggcaga

SEQ ID NO: 289066 - RNA, 64 nt, hsa
ccacagaugccacuacuucuguagcaggggccuccuaagccaggcugcccugaugcuaggaagc

SEQ ID NO: 289067 - RNA, 64 nt, hsa
cuuuaccccagcaggcugccacuggggcaccgaacuaagccagcucagccuuccaagcugcuua

SEQ ID NO: 289068 - RNA, 64 nt, hsa
uucguuuaaauuaaucugcaguuuuuaccaagagcuaagccaauauaugugcuuuucaaccagu

SEQ ID NO: 289069 - RNA, 64 nt, hsa
aggcaggagccaguccgugcaggcacacucagcgcuaagccaaaggccgcccaugcugagcuca

SEQ ID NO: 289070 - RNA, 64 nt, hsa
agggaaggaggggaaaagggaggugcagagagcucuaagccagugugcuuacagugaggcgaga

SEQ ID NO: 289071 - RNA, 64 nt, hsa
uucaauaaucaguuuacugcucuuucagggauuucuaagccaccagaaucucacaugagaugug

SEQ ID NO: 289072 - RNA, 64 nt, hsa
uguguaccaagaaccccuagcaucagccucauuccuaagccaauaacgccuguauggaguuggu

SEQ ID NO: 289073 - RNA, 64 nt, hsa
agccagggggaaagcccagcucucuuuaaaccagcuaagccauuccagucuccugugaagccaa

SEQ ID NO: 289074 - RNA, 64 nt, hsa
agaaguggauggacacuucgccauccaggcagaacuaagccaggcauaaccacagccaagcaga

SEQ ID NO: 289075 - RNA, 64 nt, hsa
gcuuaaauaauacguaaugggacuagauggcccacuaagccacuguuauuuuccuuccucucug

SEQ ID NO: 289076 - RNA, 64 nt, hsa
gcagccuccaggugcuuucauuuucacuuccagucuaagccaguggcuccugccacugcccucc

SEQ ID NO: 289077 - RNA, 64 nt, hsa
uuggguaguaaucuggggguucagauggguagcacuaagccagcuggccuaaagaugcaauaag

SEQ ID NO: 289078 - RNA, 64 nt, hsa
ggaaauuacccacugucaggccucugagcccaagcuaagccaucauauccccugugcccugcac

SEQ ID NO: 289079 - RNA, 64 nt, hsa
gccauggaucgaugucaggguggucagcucuggacuaagccacccaccuccaauuuguacaaca

SEQ ID NO: 289080 - RNA, 64 nt, hsa
uacaauuuuagucacuaagacuuuccuccaagaacuaagccaacuugaugugaaaagcacagcu

SEQ ID NO: 289081 - RNA, 64 nt, hsa
auauuucuucacauaucugaaaaauguugaaagccuaagccaggaauaaaagaaaaguagagau

SEQ ID NO: 289082 - RNA, 64 nt, hsa
uuauguuucucaucuaaucaaauagaguuacucucuaagccagaagcuguaaacucaucucuuu

SEQ ID NO: 289083 - RNA, 64 nt, hsa
aguugggaaaacaccugaccaccauuuaaggacucuaagccagaauggaaaauucaccaggacu

SEQ ID NO: 289084 - RNA, 64 nt, hsa
uaaugcccuuucuuuaucugagaugucuauuuuucuaagccaaacguuuuucagacugcagaau

SEQ ID NO: 289085 - RNA, 64 nt, hsa
ucccuccuuccgggccugcucuagugaggagugccuaagccaggacccagaaacucagaguuga

SEQ ID NO: 289086 - RNA, 64 nt, hsa
agugacauuuaaugcccaauauguaugaauagaucuaagccauuuaauuuuuuuuccuuaaaga

SEQ ID NO: 289087 - RNA, 64 nt, hsa
ccuaguaguuccugaaacugugagcaccacugcacuaagccagugcggagcuguuagggacggg

SEQ ID NO: 289088 - RNA, 64 nt, hsa
aagucagcaauuaaguguucccacuagaacugaccuaagccacugauuaauauuuaaugaggga

SEQ ID NO: 289089 - RNA, 64 nt, hsa
auaaacaaggagaguuuuugugugugcgagaucucuaagccagcgugggagggagcgccucagg

SEQ ID NO: 289090 - RNA, 64 nt, hsa
acccaggcucccuuugcacacagagcagcuacuucuaagccauaucgacuguuuugcagaggau

SEQ ID NO: 289091 - RNA, 64 nt, hsa
gccaaauagaguguggauucauuucaggggcuagcuaagccaagaggcagugguuugggcuugu

SEQ ID NO: 289092 - RNA, 64 nt, hsa
ccuucgaaaccucaacacgaggccuaagaauuuccuaagccaugucuuguaccauagugccaca

SEQ ID NO: 289093 - RNA, 64 nt, hsa
gcugagugacuguaggcagggaaccuuaaccucucuaagccacagcuucuucaucuuuaaaaua

SEQ ID NO: 289094 - RNA, 64 nt, hsa
uggugguuugagccuugauuagacuuuugaugugcuaagccagacaggcagucuguacauugau

SEQ ID NO: 289095 - RNA, 64 nt, hsa
aguggugacugugggcuccauucaaagugagcuccuaagccaugggagacacugauguaugagg

SEQ ID NO: 289096 - RNA, 64 nt, hsa
uucuuauuggaaauguacuuuuggauaaguagggcuaagccaguuggaucucugguugucuagu

SEQ ID NO: 289097 - RNA, 64 nt, hsa
caaugccaacuuugugcaaccuggagaucuaguccuaagccacacaccugggcagccacuucau

SEQ ID NO: 289098 - RNA, 64 nt, hsa
aaaaugauuuuauagggaaucuaucuucuaggaucuaagccacuaaauaaaaggauaaaugaau

SEQ ID NO: 289099 - RNA, 64 nt, hsa
gaaccacccacaccucucuccauaguuuauaucacuaagccacuucaggauuuuuuuuuuuuaa

SEQ ID NO: 289100 - RNA, 64 nt, hsa
agacaacauuucucaaaugcacaucucauggcagcuaagccacauggcugggauuuaaagccuu

SEQ ID NO: 289101 - RNA, 64 nt, hsa
agugguggggccagagggcucugugcucuaggagcuaagccagcagcccccgagaggggacuug

SEQ ID NO: 289102 - RNA, 64 nt, hsa
ucccugaacucacugucuuuucuccacacuuguccuaagccaagguagauuuguacguagacag

SEQ ID NO: 289103 - RNA, 64 nt, hsa
uucagaucagaucuggccuauuuucauauuuauccuaagccaucaaaugggguagugccucuua

SEQ ID NO: 289104 - RNA, 64 nt, hsa
caaucauauuuucucuucuaucuuugaaauuauucuaagccaaagaaaacuaugaaugaaagua

SEQ ID NO: 289105 - RNA, 64 nt, hsa
ugcagaauugcuagguaaagaggucaggggaaugcuaagccaguucuuaagacuucucuguccu

SEQ ID NO: 289106 - RNA, 64 nt, hsa
aaacuuucacuuugaaaaaugagaauuuuauauucuaagccaguuuucauuuugguuuuguguu

SEQ ID NO: 289107 - RNA, 64 nt, hsa
agaaacacaguuuugaaagaaaaauaccaugucucuaagccaacuuuaauugcuuaaaagacau

SEQ ID NO: 289108 - RNA, 64 nt, hsa
agaaauuuauagcauuuacuguguuauuuaaaugcuaagccaaaguaucugcacuuagguauac

SEQ ID NO: 289109 - RNA, 64 nt, hsa
aaauaauuuucaagcaaaguauugugaaaguauucuaagccaaguuuuaaauauuaucuaacag

SEQ ID NO: 289110 - RNA, 64 nt, hsa
uccauuucauggaccaacugaucaauugccaguacuaagccacucauuguuauggcuuccuuuu

SEQ ID NO: 289111 - RNA, 64 nt, hsa
uggggggcgggguggagaggaggacccccauuggcuaagccaagcuccaguuacaagacaacac

SEQ ID NO: 289112 - RNA, 64 nt, hsa
accuuggaaacuaucaaauauaaauauacuuuaacuaagccagugaccugguccuaaguuaagg

SEQ ID NO: 289113 - RNA, 64 nt, hsa
accaaaaaggacuuuuuguauagaaagcacuacccuaagccaugaagaacuccaugcuuugcua

SEQ ID NO: 289114 - RNA, 64 nt, hsa
uuacuguucuccaugugucggcaugucucuaccucuaagccaguguuuuucaacuauguuuauc

SEQ ID NO: 289115 - RNA, 64 nt, hsa
caacuuucuguaaacucaaaacuuaacauauuuacuaagccacaagaaauuugauuucuauuca

SEQ ID NO: 289116 - RNA, 64 nt, hsa
uccccggggaagggcagaugacacucccuucccccuaagccaaccgcacugaaggaguggggag

SEQ ID NO: 289117 - RNA, 64 nt, hsa
ccuugcucaagguccccagcuucagccccaggcccuaagccagcgucagaacagucaaucugca

SEQ ID NO: 289118 - RNA, 64 nt, hsa
ccauagaguuuucacagccuauaucgcaaauuuucuaagccacguccuauaggacagaggagac

SEQ ID NO: 289119 - RNA, 64 nt, hsa
aguuuaucaaucaguuaucuuaagucagcauuuucuaagccauuguuugaggaaacagugacaa

SEQ ID NO: 289120 - RNA, 64 nt, hsa
uaggcugcaaggaaagaggccaagggccaagcugcuaagccaaagauggccccugacaccuccc

SEQ ID NO: 289121 - RNA, 64 nt, hsa
ggcucugcuucuccuccugagccucugucgggggcuaagccagccuggcgccccugcagauucc

SEQ ID NO: 289122 - RNA, 64 nt, hsa
accauaacuaaauaucugcauguaccaagagucccuaagccacccccuccaaagauggagugua

SEQ ID NO: 289123 - RNA, 64 nt, hsa
cgauccgggcuugguuuugugagguuccuucaagcuaagccagcucagagaacacggggagcgg

SEQ ID NO: 289124 - RNA, 64 nt, hsa
gucuccucugggaggucuuggccgacucagggaccuaagccacguuaaguccaaggagaagaag

SEQ ID NO: 289125 - RNA, 64 nt, hsa
uccauuauugaucacaguaugaaguaaaacuauucuaagccauuauaugaauuagcaauucuua

SEQ ID NO: 289126 - RNA, 64 nt, hsa
gcauggauaaaggagacagcccuaaaggaacuuacuaagccagcccuuugggauucaguaccaa

SEQ ID NO: 289127 - RNA, 64 nt, hsa
cuuauccaggacucugucaauuucccugacuccucuaagccacucuuccaaaggcauaagaccc

SEQ ID NO: 289128 - RNA, 64 nt, hsa
uuuguaaggaagaucauaaaugcuaaaaauuccacuaagccauucaguucuuccuuuugccuac

SEQ ID NO: 289129 - RNA, 64 nt, hsa
uaaagagcaauugaaucuucuagcuuuagcaaaccuaagccaaaggaaggaaagccaugaagaa

SEQ ID NO: 289130 - RNA, 64 nt, hsa
caagcuguuuuugagugccacuguuugccaucaucuaagccacugaaucaaguguauuucaggc

SEQ ID NO: 289131 - RNA, 64 nt, hsa
aagcuucaaagccauauggacacugugacaaugacuaagccaagcuguguucauccagcuacuu

SEQ ID NO: 289132 - RNA, 64 nt, hsa
ccugccuccaggccacgaaaugggaauuccagcacuaagccaggcaccgggcagaagcugggcc

SEQ ID NO: 289133 - RNA, 64 nt, hsa
uuuuuggucuuuuaccucugaucuuguccccaaccuaagccagcuagcugcgugcucccacucc

SEQ ID NO: 289134 - RNA, 64 nt, hsa
cagagggggacugcugcugccuggccacugcucccuaagccagccugguccaugcagggggcuc

SEQ ID NO: 289135 - RNA, 64 nt, hsa
uaacacaacaaagugggaccaucucuauucccaucuaagccacucaaauugcugagugcuauua

SEQ ID NO: 289136 - RNA, 64 nt, hsa
cugucugucugagucuaaaaccaagcucagguuucuaagccacaugaccuugauuguuaaaugu

SEQ ID NO: 289137 - RNA, 64 nt, hsa
uccgcagagaaauguugcucuccauuauucccuucuaagccagagacccuuauccacugcuccu

SEQ ID NO: 289138 - RNA, 64 nt, hsa
ugggccaucucuuaggugagacaguugcccgaaacuaagccaggccuggcuggaggagcagcag

SEQ ID NO: 289139 - RNA, 64 nt, hsa
aaguuuguguguuguguccauuuugcaaacccaacuaagccaggaccccaaugcgacaaguagu

SEQ ID NO: 289140 - RNA, 64 nt, hsa
ucugccuuccauaccccacgcuuauaaaacauaacuaagccaagaguggacaugacuuuugucc

SEQ ID NO: 289141 - RNA, 64 nt, hsa
caggucugagggguccagcucuggcagggggugucuaagccacguccaaaugguggacaguagc

SEQ ID NO: 289142 - RNA, 64 nt, hsa
gcucagccacaucuuggggucugggaggcccaggcuaagccauguggcagggaccgucuugccc

SEQ ID NO: 289143 - RNA, 64 nt, hsa
agaugcuggaacccucacugaaaguccagaaugucuaagccaguguuagauuuuguaaacaagu

SEQ ID NO: 289144 - RNA, 64 nt, hsa
gguuugccuagggacguguaacuacaggcuuuuacuaagccaaggaaaaagagaauuuuucuuu

SEQ ID NO: 289145 - RNA, 64 nt, hsa
aucaaaaucaaaagguaaugcacauccucauucacuaagccaugccaugcccaggagacugguu

SEQ ID NO: 289146 - RNA, 64 nt, hsa
ucaaguugccacucaguauuaaccaugacaccuucuaagccaucaucuccuccuaauccuccca

SEQ ID NO: 289147 - RNA, 64 nt, hsa
cuuuguuuacuaaggacuuuggggaggaaccaugcuaagccaugaccagugaggagaagcaaca

SEQ ID NO: 289148 - RNA, 64 nt, hsa
uaucugauaaccaaaaaaaaaaaagacauuucaucuaagccacuuaacaccgugucugaugugu

SEQ ID NO: 289149 - RNA, 64 nt, hsa
cacagcaaagggacugaacugaccccuguuugcacuaagccacccccaccccccacucugcuuu

SEQ ID NO: 289150 - RNA, 64 nt, hsa
gugguuguaaggcuggauugaaauaugcaugugacuaagccauguagcuauaaagugagggaug

SEQ ID NO: 289151 - RNA, 64 nt, hsa
ggggaugcuucugccugcagauauugauggacuccuaagccaggcucuccugcuuggggaacug

SEQ ID NO: 289152 - RNA, 64 nt, hsa
cuuaguaugcucagccuccuucuuugcuaugucccuaagccaacaggguauaacacaggcccug

SEQ ID NO: 289153 - RNA, 64 nt, hsa
cuguaccucuuuguagcacguaguguuguggaaacuaagccacuaauugaguuucuggcucccc

SEQ ID NO: 289154 - RNA, 64 nt, hsa
acucaaccaagcacugcucucuagcuccagggcacuaagccacaggaggcagcgcccugcagcc

SEQ ID NO: 289155 - RNA, 64 nt, hsa
aaugcuuuucuguuaguagaaugcaaaaaccuaccuaagccacauaauaauaaaauucuuuuac

SEQ ID NO: 289156 - RNA, 64 nt, hsa
ucuugguuuuguuuuuuuggaaaugagugggccacuaagccacacuuucccuucauccugcuua

SEQ ID NO: 289157 - RNA, 64 nt, hsa
uuggucccuuuuccuggcccuuccuuccccacuucuaagccaaagaaaggagaggcaggugcuc

SEQ ID NO: 289158 - RNA, 64 nt, hsa
acacagcccacugaacaaggucucagggguauugcuaagccaagaaggaacuuucccacacuac

SEQ ID NO: 289159 - RNA, 64 nt, hsa
uccagccugagguggugaaggcaggaugcucucucuaagccagaccagagggacucagacacca

SEQ ID NO: 289160 - RNA, 64 nt, hsa
ccugggcagaaaaguaucuuaauuaaugaaagagcuaagccaucaagcugggacuuaauuggau

SEQ ID NO: 289161 - RNA, 64 nt, hsa
caccaucgucuucuuggccaugggaggccuuucccuaagccagcugcccccagagccacaguuc

SEQ ID NO: 289162 - RNA, 64 nt, hsa
gaaccauacaaaauuuuuccaccacacauacccucuaagccagcaagauuuccucuuugcaaaa

SEQ ID NO: 289163 - RNA, 64 nt, hsa
cacagcaccugugagucugggcgccuuagagccccuaagccagcaugggcccuuucccccuccc

SEQ ID NO: 289164 - RNA, 64 nt, hsa
ccccagggagcucacgccaggcaggccagugggccuaagccagaaacagaaagacagcaguggc

SEQ ID NO: 289165 - RNA, 64 nt, hsa
gagcaagagagaauuugugucuauuggcaaagaacuaagccaggaagacaugggccaucccucc

SEQ ID NO: 289166 - RNA, 64 nt, hsa
aaugaagaacaucauauaaaaucuuucccuaaaucuaagccaguggccauuuuugugggaucuu

SEQ ID NO: 289167 - RNA, 64 nt, hsa
gaccacaauuccuuccaauuucugcggcuccauccuaagccaaauaaauuauacuuuaacaaac

SEQ ID NO: 289168 - RNA, 64 nt, hsa
cccccacccaggggauggaggucuacccuggacacuaagccaagugugucagagacagaaggga

SEQ ID NO: 289169 - RNA, 64 nt, hsa
uacugaugagacuuccugcugccuuuggacauaacuaagccaggaaacuuuaaaagccuucuag

SEQ ID NO: 289170 - RNA, 64 nt, hsa
ucaguaaauguccaaguaauguuuuuauaauaaacuaagccauauuuagacaauaaacauugau

SEQ ID NO: 289171 - RNA, 64 nt, hsa
cagaaaacucccauggcucuaggaagaagugacacuaagccaacaccuuucuuuaugugggagc

SEQ ID NO: 289172 - RNA, 64 nt, hsa
acaaaaaaaaugaagacacucaaucuagaacaaacuaagccagguaugcaaauaucgcugaaua

SEQ ID NO: 289173 - RNA, 64 nt, hsa
gagccuggaguacuggcuauacccauucccaggccuaagccagccucucccuccugacagugcc

SEQ ID NO: 289174 - RNA, 64 nt, hsa
cccauucucccucucaaggcaggggucauagauccuaagccauaaaauaaauuuuauuccaaaa

SEQ ID NO: 289175 - RNA, 64 nt, hsa
ugcaauaauuaaccauaugcuagaaugcccaccucuaagccaauuggauucuuuagcucucuuu

SEQ ID NO: 289176 - RNA, 64 nt, hsa
ggagggcaucugucugccaucgcccgcugccaaucuaagccagucucacugugaaccacacgaa

SEQ ID NO: 289177 - RNA, 64 nt, hsa
ucugagugaaauuugcucauaaagcauuuggauacuaagccauuauuugccauuuuggguacuu

SEQ ID NO: 289178 - RNA, 64 nt, hsa
auaaaaugugcagaugcaauuguuugggugauuccuaagccacuugaaauguuagucauuguua

SEQ ID NO: 289179 - RNA, 64 nt, hsa
auaucaucccugucuuauuagggauuaccguuuccuaagccaagagucaugucaaauugcaauc

SEQ ID NO: 289180 - RNA, 64 nt, hsa
uauccaacauguuugauguuuaagcuagcuuuaccuaagccacuucucagccuccagaauacuc

SEQ ID NO: 289181 - RNA, 64 nt, hsa
guauugucugaauuucuugucuuccaacauucuccuaagccaguuaccuuugcacugaaguaga

SEQ ID NO: 289182 - RNA, 64 nt, hsa
agguggaccucgugcucaucagagcaugccaauccuaagccauuggacauauguagacugguuu

SEQ ID NO: 289183 - RNA, 64 nt, hsa
aaaauuugcuuuaaacuguuucagagcuucuucccuaagccauaaacugucucaccuaaacaag

SEQ ID NO: 289184 - RNA, 64 nt, hsa
gccccugcuggggcagcccguguugccggagccucuaagccaaagagcccguuggccgugguug

SEQ ID NO: 289185 - RNA, 64 nt, hsa
cccaaagcaggaagaagcuccggauggaggccagcuaagccacucggggcaggccagcaauaaa

SEQ ID NO: 289186 - RNA, 64 nt, hsa
ccacacuagaggccuauugcuacaucaagggguucuaagccacacaacagagccuccagcaggg

SEQ ID NO: 289187 - RNA, 64 nt, hsa
guuaauuuuuaccuuacaugugagagucuuaccacuaagccauucugucucuguacuguuggga

SEQ ID NO: 289188 - RNA, 64 nt, hsa
gucccauuuagcccugcacagcggucuccuuccccuaagccagcacugcugcucccuggagccc

SEQ ID NO: 289189 - RNA, 64 nt, hsa
uuugcugaaaaacauuaugagaaggccucccuuccuaagccaccucuggucuugcuaagucuug

SEQ ID NO: 289190 - RNA, 64 nt, hsa
cugagagcuagugaggguucagagaagccccauccuaagccagacacaugaugugggcucagcu

SEQ ID NO: 289191 - RNA, 64 nt, hsa
ggaagaaaacaggucccuccaggggugcugcugccuaagccacccacauaaguacgcuggugcc

SEQ ID NO: 289192 - RNA, 64 nt, hsa
cuaggcuggucucuguccguccucugagcucaagcuaagccaucauaucccagugaccugcaca

SEQ ID NO: 289193 - RNA, 64 nt, hsa
gcugggauuacaggcgugagccacugugcccagccuaagccauuucuuaaaauaaaaaugcuaa

SEQ ID NO: 289194 - RNA, 64 nt, hsa
cucuaggcccugggccugccuccccaagggcucacuaagccagaggccaaagugcccccucccg

SEQ ID NO: 289195 - RNA, 64 nt, hsa
gccgcccagacaccacagacgccaccuggcggcccuaagccacucccgccacacgcucacucca

SEQ ID NO: 289196 - RNA, 64 nt, hsa
agagccucuccagggguggaauacauguccuggacuaagccaaugacaccuuccaucuuuccag

SEQ ID NO: 289197 - RNA, 64 nt, hsa
gagguggagguugcagugagccgucaucgcgccacuaagccaagaucgcgccacugcacuccag

SEQ ID NO: 289198 - RNA, 64 nt, hsa
ugcgaaagaauaacaccuuuucuugcauucugagcuaagccagacagccuuuauacuagauucu

SEQ ID NO: 289199 - RNA, 64 nt, hsa
ccccagcuggaacagcugaagucacaagccuccucuaagccaaggccaguguguucagagguga

SEQ ID NO: 289200 - RNA, 64 nt, hsa
caaggaaggaaaauacuaccuguccccuaugccacuaagccaacgugugugucagcugguagcu

SEQ ID NO: 289201 - RNA, 64 nt, hsa
aauaggccccugccuggcuccugggagauaaccucuaagccauuagaauaucuugccugauaag

SEQ ID NO: 289202 - RNA, 64 nt, hsa
agaccuaagaaaaaaauauuucaugaucauuucccuaagccauuuccagaaugguaaaagguuu

SEQ ID NO: 289203 - RNA, 64 nt, hsa
agagucugugagacugccugagaggugggcucagcuaagccacaauguguacuuugauaguaca

SEQ ID NO: 289204 - RNA, 64 nt, hsa
gcuuuggaggaucaggguagggagggcucugucucuaagccaggugucaggaucagaaucaugg

SEQ ID NO: 289205 - RNA, 64 nt, hsa
ccacaucccugucacacacccagggcauccauuccuaagccagacccggcuccccuacaccuga

SEQ ID NO: 289206 - RNA, 64 nt, hsa
uggggguccuccuccagggacagcaacuaucagacuaagccagcaccggaccagccuggcccac

SEQ ID NO: 289207 - RNA, 64 nt, hsa
cccucuccaccccauagugaccggcugcuuuucccuaagccaagggccucuugcggucccuucu

SEQ ID NO: 289208 - RNA, 64 nt, hsa
auggcacacaccugugcccagacgccaaugccuccuaagccaggagcuggguuaugcaccgcca

SEQ ID NO: 289209 - RNA, 64 nt, hsa
auuauauaaugauacauuuagacaaaaccccaaacuaagccauuugaaacaagauucucuccau

SEQ ID NO: 289210 - RNA, 64 nt, hsa
uaagugccaugucaguguggacagaggcauuugacuaagccaaccuccucucacagccucugua

SEQ ID NO: 289211 - RNA, 64 nt, hsa
gcgaugucagugagggcgaucauagggcauaagccuaagccauaccaugcagccuuugugccag

SEQ ID NO: 289212 - RNA, 64 nt, hsa
uuucuccauagaauuuccccccaaaguagagaugcuaagccaaauccagaagaacccauagaug

SEQ ID NO: 289213 - RNA, 64 nt, hsa
caggaguggaaggugaggcguucuccugcuuguacuaagccaggaggcuuuaagcuccagcuuu

SEQ ID NO: 289214 - RNA, 64 nt, hsa
accucugccuccuggguucaagcgauucuugugccuaagccaccugagcagcugggauuacagg

SEQ ID NO: 289215 - RNA, 64 nt, hsa
cacuaggccacgcaucugaucuguagucacaugacuaagccaagaggaaggagcaagacucaag

SEQ ID NO: 289216 - RNA, 64 nt, hsa
cgggacccccuggcccugccucauccaccaaucucuaagccaaaccccuaaacucaggagucaa

SEQ ID NO: 289217 - RNA, 64 nt, hsa
gagcgaggaggaccaggcagccgccgcugccgcgcuaagccaccaccugcgcuuagguaggcgu

SEQ ID NO: 289218 - RNA, 64 nt, hsa
gaaccaaaaaagagcccacauugccaagucaauccuaagccaaaugaauaaagccggaggcauc

SEQ ID NO: 289219 - RNA, 64 nt, hsa
acucacacucccagccaccauguuacacuggacucuaagccacuucuuacuccaguaguaaauu

SEQ ID NO: 289220 - RNA, 64 nt, hsa
cagccacuucuaagcacaaccagaggcccaacgacuaagccagcccacccugggcugggcccag

SEQ ID NO: 289221 - RNA, 64 nt, hsa
cccuuccccagacagggcuggacuucuggagcugcuaagccacccuccguuugcacguuaacuc

SEQ ID NO: 289222 - RNA, 64 nt, hsa
ugcaccuccccacucgaaaguggguauccgaaaacuaagccagggaagcgguuaacuuaucuuu

SEQ ID NO: 289223 - RNA, 64 nt, hsa
cugucugccuggcugccucccuuaacccugacuucuaagccaucaauuucauguuauuuauuau

SEQ ID NO: 289224 - RNA, 64 nt, hsa
guuugguuccuguucacucuguuaauaagaaacccuaagccaagacccucuacgaacauucuuu

SEQ ID NO: 289225 - RNA, 64 nt, hsa
cugucacaagcuugugaaaggaaaauaaaaauuacuaagccaaagagaaaagucaaucugggaa

SEQ ID NO: 289226 - RNA, 64 nt, hsa
cgggucucgguuauccaccccuaccucccagugucuaagccacgaauaaugguaugcuguugcu

SEQ ID NO: 289227 - RNA, 64 nt, hsa
aggaucccacagugauaaccaggcccuucccuuccuaagccaaaacccauugugacugccuguc

SEQ ID NO: 289228 - RNA, 64 nt, hsa
cagucaccuccucggggaccccucaguguagugacuaagccauccacaggccaacucggccaag

SEQ ID NO: 289229 - RNA, 64 nt, hsa
uuauaaauuugacuucauuggcaguggaugaagccuaagccagcugagucucuaucauagcuga

SEQ ID NO: 289230 - RNA, 64 nt, hsa
cagaggcagaacugaagcccucucggccccuacccuaagccagccaccccucuucacagugggu

SEQ ID NO: 289231 - RNA, 64 nt, hsa
gggugcauaguaagugcucaguaaauuguuuguucuaagccacuuuuaaaaaugguuucauucc

SEQ ID NO: 289232 - RNA, 64 nt, hsa
ugagcagguccaggacucagcuuucugcuucagccuaagccaguacuccuuguuugagguaaaa

SEQ ID NO: 289233 - RNA, 64 nt, hsa
ccaacagcugagcugccgggccuccucgaggccccuaagccacccccagaggucccaucugaag

SEQ ID NO: 289234 - RNA, 64 nt, hsa
gccccagugcuacacucauccuugcuuuccagcccuaagccaucucagccugaugucacaaccc

SEQ ID NO: 289235 - RNA, 64 nt, hsa
augagacuucuccgugcuguuuucuucaucuucucuaagccaagcaauuauuuuauggagggaa

SEQ ID NO: 289236 - RNA, 64 nt, hsa
aggccaaguccacugcccggaagucuugucagcccuaagccagggaagccuggagcguggccug

SEQ ID NO: 289237 - RNA, 64 nt, hsa
ccagaguuggagauauuacagucaacuuuggcuucuaagccaguaauuccauucuuaaauaccu

SEQ ID NO: 289238 - RNA, 64 nt, hsa
aaguuuucccucaucuguaaaugugauuuaaaaucuaagccaugaauaugcuuuauuuauuaaa

SEQ ID NO: 289239 - RNA, 64 nt, hsa
ccuuuccccacauugguaagaguagcuggguuuucuaagccacucucuggaaucucuuuguguu

SEQ ID NO: 289240 - RNA, 64 nt, hsa
cuaugauaaugaauaucucuuuugugucuccuuccuaagccauccucagagaguccuuagcaga

SEQ ID NO: 289241 - RNA, 64 nt, hsa
ccagacauccugauggggaggcagagccaggaagcuaagccagggcccagcugcguccaaccca

SEQ ID NO: 289242 - RNA, 64 nt, hsa
cuauauuuccuagagcaccuguguuuuccucuuucuaagccaggguccugucuggaugacuuau

SEQ ID NO: 289243 - RNA, 64 nt, hsa
gauuuauguggagaugauuuuucaccuuuaaacucuaagccaaguguaagaaacucuugauagc

SEQ ID NO: 289244 - RNA, 64 nt, hsa
uagggagugagugguaguuacuuaaguaauugaccaaauggaaaaggggaaguaauuaaggaaa

SEQ ID NO: 289245 - RNA, 64 nt, hsa
gaaagugcuauucacccaguaaacccaaaaaaagcaaauggauaaugcuggccauuuugccuuu

SEQ ID NO: 289246 - RNA, 64 nt, hsa
gaguuguggcucucagccauguagacacacucuccaaauggaguguuggaaaauguucuuucug

SEQ ID NO: 289247 - RNA, 64 nt, hsa
accuucugcugggcauagcuugugccuaaauggacaaauggaugcauacccuuccugaaaugac

SEQ ID NO: 289248 - RNA, 64 nt, hsa
guuaucaguggggggacuuaauucuaaucucauucaaauggagacgcccucugcaaaggccugg

SEQ ID NO: 289249 - RNA, 64 nt, hsa
uauauaaaaugaaugcagauugcgaaggucccugcaaauggauggcuugugaauuugcucucaa

SEQ ID NO: 289250 - RNA, 64 nt, hsa
accccggaccaguuacauucguuccuggcaaaagcaaauggaaauggucuccugucuccagccu

SEQ ID NO: 289251 - RNA, 64 nt, hsa
ccuaaaggguuuuuaagcccuaacacuugucuagcaaauggagagccuaauuuaccaaaaugaa

SEQ ID NO: 289252 - RNA, 64 nt, hsa
gaggaggcugagaaaggggaagagaaaaacaaaccaaauggaugauguuagcuuuaggaucgug

SEQ ID NO: 289253 - RNA, 64 nt, hsa
uuuguacauagcaccgugcuaggcucugggaucccaaauggacccuuuuaacuuucugaagaug

SEQ ID NO: 289254 - RNA, 64 nt, hsa
accacaugguaauuuuuaaugggacuuuuaucagcaaauggaguuacaggaauucucuguaaug

SEQ ID NO: 289255 - RNA, 64 nt, hsa
aguuucuuucuuccacaaagcagccguuucuauucaaauggaaauucaguaccagagaauaaau

SEQ ID NO: 289256 - RNA, 64 nt, hsa
aauaguauuauugaagauacuaaaugaugcaaaccaaauggauuuuuuccaugucaugauguaa

SEQ ID NO: 289257 - RNA, 64 nt, hsa
uuacgauguaucugugaaaaugggaugauauugacaaauggagacuccuaccucaauaguuaau

SEQ ID NO: 289258 - RNA, 64 nt, hsa
aggaauguauccccugccuauuuuccuuguguaacaaauggaaaacauucuccccugugagaaa

SEQ ID NO: 289259 - RNA, 64 nt, hsa
gcugcaugggaaagcaaagcagaaaacagugccccaaauggaaaaaagauacucacacagaaca

SEQ ID NO: 289260 - RNA, 64 nt, hsa
acacgagccaacugcuguauuuaacaucugccugcaaauggacaaaguacuugauaugguaagu

SEQ ID NO: 289261 - RNA, 64 nt, hsa
ugucaucuucaggcguaaagagaaacaugaaguacaaauggaucacagaccugaaucuguugug

SEQ ID NO: 289262 - RNA, 64 nt, hsa
ucugaauagccccccacugaaugcuugccuugcccaaauggaauggaggaagauugauuuucuc

SEQ ID NO: 289263 - RNA, 64 nt, hsa
ccuugauugcgguauauguacuacuagaaaauaccaaauggauauauuuucuuuaggauaaccu

SEQ ID NO: 289264 - RNA, 64 nt, hsa
guauuuuuuauuuuuuuuuuuuaguagagacaggguuucgcaauguuggccaggccgaucucga

SEQ ID NO: 289265 - RNA, 64 nt, hsa
uuuucuuuucccucaaucucaauccugcagugggguuucgcagccugaguccacgaccuaggca

SEQ ID NO: 289266 - RNA, 64 nt, hsa
ucuguucaaaggggcaccaguuuguagucccucuguuucgcacagaguacuaugacaaggaaac

SEQ ID NO: 289267 - RNA, 64 nt, hsa
cggaagccaggccaacugccccgcgucuucagcuguuucgcauccaccgccaccccacugagag

SEQ ID NO: 289268 - RNA, 64 nt, hsa
ccuauuuacuuucaaaacaauuugcauuuagaguguuucgcaucagaauaacaugaguaagaug

SEQ ID NO: 289269 - RNA, 64 nt, hsa
ccguuuccuuagcgcccaugacacgccaagucccguuucgcacucggcuucucacccgcccagc

SEQ ID NO: 289270 - RNA, 64 nt, hsa
uuuucaucugcaaacucugcaaaaugugucucauguuucgcaacucuuuuuuucccccucgcuc

SEQ ID NO: 289271 - RNA, 64 nt, hsa
aguccccagugugauucaauugauugccuuucacguuucgcaaauuuuccaaucucccacucac

SEQ ID NO: 289272 - RNA, 64 nt, hsa
uuuuuauuuaguuucuuuagccaauaguggcugaguuucgcacuugauuuucaauauuuuauag

SEQ ID NO: 289273 - RNA, 64 nt, hsa
acccaagacugccgugacuccuaguccaaugucuguuucgcaucacaacacaguaucuuuaaca

SEQ ID NO: 289274 - RNA, 64 nt, hsa
uccugggcacuuagguguuucagcauagauuccaguuucgcacccugggcagacccccaggccc

SEQ ID NO: 289275 - RNA, 64 nt, hsa
ugcgggccuggagcgccauagcacagucgauuucguuucgcagcugucuccccuccgcagcaga

SEQ ID NO: 289276 - RNA, 64 nt, hsa
aguucucauaaguucuagaacugguagcucggucguuucgcacacuagguggcauacaggcagc

SEQ ID NO: 289277 - RNA, 64 nt, hsa
uucuccucggccgaccaccuguccaaugcugcugguuucgcagagcgaccgguuggagaugucu

SEQ ID NO: 289278 - RNA, 64 nt, hsa
caaugcauuuuuuuuauuuuuuuuuugagacagaguuucgcacuucuugcccaggcuggaguac

SEQ ID NO: 289279 - RNA, 64 nt, hsa
augcuucacuuugccuugcccaucacccuauacaguuucgcagauagucuagucacucuaugug

SEQ ID NO: 289280 - RNA, 64 nt, hsa
uaaauacuuuuguaccaugaguaaaacuucagguguuucgcaagaaccaccauucucaaugagu

SEQ ID NO: 289281 - RNA, 64 nt, hsa
cucagcacagccagcuccgugcccucugaauuauguuucgcagaaaaguguccccaaggaagug

SEQ ID NO: 289282 - RNA, 64 nt, hsa
agccaaguggauggaacuaacuuuccuggacuguguuucgcauucggcguuaucuggaaagugg

SEQ ID NO: 289283 - RNA, 64 nt, hsa
uuagauguucuuaagaauaaaauguugcucucugguuucgcaggaaauagauuguucuaaucuu

SEQ ID NO: 289284 - RNA, 64 nt, hsa
ccccagcucuggaugaaggcaaaaacuguacuguguuucgcauuaagcacacacaucuggcccu

SEQ ID NO: 289285 - RNA, 64 nt, hsa
ggcucccccaccucagccagugagucagacacggguuucgcagccauguuuccuggcuccgagg

SEQ ID NO: 289286 - RNA, 64 nt, hsa
ugguuuuuuuuuuuuuuuggccaaaucucgugguguuucgcagaaaaaaauccagaaaauuuca

SEQ ID NO: 289287 - RNA, 64 nt, hsa
gcugucccuguuuuaaagagcuguguuuuguuuuguuucgcauuuagagagcagacaaggcacc

SEQ ID NO: 289288 - RNA, 64 nt, hsa
gauaacacguggugaacaacugccuuuagcugguccagauuaaucauuucaaagacauccauuu

SEQ ID NO: 289289 - RNA, 64 nt, hsa
ccagcccuacagggacugggcaaagaugauguuuccagauuacacuccagccugagucagcacc

SEQ ID NO: 289290 - RNA, 64 nt, hsa
acuggaaccucaugauaauugacccucuggaucaccagauuaguuuaauuuaacagauaugucc

SEQ ID NO: 289291 - RNA, 64 nt, hsa
aggacgugcuuuacaucuccagaucuguucuucaccagauuagguuaggccuaccaugugccac

SEQ ID NO: 289292 - RNA, 64 nt, hsa
auuacugcccacucaacacauauuuaauaugugcccagauuauucuaaaaucuuaaaaaaagau

SEQ ID NO: 289293 - RNA, 64 nt, hsa
uuacuaaaguagauaauuccaaugagaaauacuaccagauuauuguuauaaaauuaauuuacaa

SEQ ID NO: 289294 - RNA, 64 nt, hsa
cugcucuaggcccauagucagcagcagcucugagccagauuacaggaaugaagaacuguugccu

SEQ ID NO: 289295 - RNA, 64 nt, hsa
uaaaccgcauuaaucauggcaaucaagcccccuuccagauuacugucucuugaacaguugcaau

SEQ ID NO: 289296 - RNA, 64 nt, hsa
cccugaugcuguauaauguauguugaauguggucccagauuauuucuguaagaagacacuccau

SEQ ID NO: 289297 - RNA, 64 nt, hsa
ggguucccagugcccagcacuuuguagucucaucccagauuacuaacccuuccugauccuggag

SEQ ID NO: 289298 - RNA, 64 nt, hsa
uuuggccugaguuauugagauuguccucauuucuccagauuaucuauuugugugugugugugug

SEQ ID NO: 289299 - RNA, 64 nt, hsa
cucuuguuuuuuuaauugggagagaagagaccugccagauuaucagaccucuucauguuaaaag

SEQ ID NO: 289300 - RNA, 64 nt, hsa
uaaugaagaaaacuucucuuauuguucaguucauccagauuauaacuucaaugggacacuuuag

SEQ ID NO: 289301 - RNA, 64 nt, hsa
caagggacauaccuuacauuuagcauguagaauuccagauuacaaucgccauaauauaaggaag

SEQ ID NO: 289302 - RNA, 64 nt, hsa
uauacuuaaaauaauuuggacaguuuuuaugugaccagauuaagugcuuuugucauuugagcug

SEQ ID NO: 289303 - RNA, 64 nt, hsa
aauacacuuuugcuuuauucucacaugccauucaccagauuauuugaugguacaaagaagcaga

SEQ ID NO: 289304 - RNA, 64 nt, hsa
cuauauuauuaaauguaaugcaaccaaguuccucccagauuaaacuucccagguguucagaauu

SEQ ID NO: 289305 - RNA, 64 nt, hsa
uucuaguuccuaacaauucucauuacauacuaugccagauuacaaaauacuuauuuuuaaaaug

SEQ ID NO: 289306 - RNA, 64 nt, hsa
guaagaaugacugaaccauuacuccagcugccucccagauuaaugcauaaagccaaggaacuac

SEQ ID NO: 289307 - RNA, 64 nt, hsa
cccaggccccauggaaaggucugaaaauaauauuccagauuacacuguaccuggcuucucuucu

SEQ ID NO: 289308 - RNA, 64 nt, hsa
gauuucaccacucaaaggccagaccugcagacgcccagauuaugagacacaggaugaagcauuu

SEQ ID NO: 289309 - RNA, 64 nt, hsa
ucauauuuuuuuguuuauuugcacaacuuuuaaaccagauuacugguuaaaauccaacaguaca

SEQ ID NO: 289310 - RNA, 64 nt, hsa
uucgagaguagcccugucuuguccccuccuacccccagauuagcaccaccccucucacucuugg

SEQ ID NO: 289311 - RNA, 64 nt, hsa
aaaauuaugauaaaaugcuuuaaaaauuaauaugccagauuaaaauaacugaauaguuuacuau

SEQ ID NO: 289312 - RNA, 64 nt, hsa
gcugugcuugccucacaggaauagucaggucuucccagauuaucugaaggcccuggggauucca

SEQ ID NO: 289313 - RNA, 64 nt, hsa
uuguagauuuccauguaaucauugagguuaucacccagauuagaaagacauauuuguuaucagu

SEQ ID NO: 289314 - RNA, 64 nt, hsa
aaugcagaacaguuuaaacuuguuaagucacauuccagauuaggagaaaaugggcaauaaucau

SEQ ID NO: 289315 - RNA, 64 nt, hsa
aaagcaggccugacugaccaggugucucaucaugccagauuaaagacagacugacaguucaucu

SEQ ID NO: 289316 - RNA, 64 nt, hsa
gaccagaaguggcaggaggacagguggaggcgagccagauuaggccuggaguugggcugguuug

SEQ ID NO: 289317 - RNA, 64 nt, hsa
gcauuauuucuugauuagagguuugggcauauaaccagauuaaagugaaggaacuuucuguugu

SEQ ID NO: 289318 - RNA, 64 nt, hsa
ucauguaaaugauuaucuccuuuauagccuguaaccagauuaaggaauacagcucuuaaaaaau

SEQ ID NO: 289319 - RNA, 64 nt, hsa
gcuaauucucagaaaggcaaguagaugauaaaggccagauuacaaauuacauuacugaaaacuu

SEQ ID NO: 289320 - RNA, 64 nt, hsa
ugugcucuuuucacuguagacacuaucacgagacccagauuaauuucugugguuguuacagaau

SEQ ID NO: 289321 - RNA, 64 nt, hsa
aggacuaacagaaagcaccugauuugcacuugaaccagauuauagauuuaaaaguauaugacau

SEQ ID NO: 289322 - RNA, 64 nt, hsa
uccgccucccucagagcagcagccugucaaaacaccagauuacaacaaauuuaguuuaaagguc

SEQ ID NO: 289323 - RNA, 64 nt, hsa
uauuaugguggccuaaaguaggcuucuugguacaccagauuauuuauaacauuaaauuuaugag

SEQ ID NO: 289324 - RNA, 64 nt, hsa
caucaugguauucaggggcuagagugauuuuuuuccagauuaucuaaaguuggaugcccacacu

SEQ ID NO: 289325 - RNA, 64 nt, hsa
cucgaccucccaggugauccucccaccucagcuuccagauuagcuggugcuauaggcaugcacc

SEQ ID NO: 289326 - RNA, 64 nt, hsa
gaagagcaaggcauaaauuuagacuaaaauccauccagauuacacucauucuuuaggcuacucc

SEQ ID NO: 289327 - RNA, 64 nt, hsa
ucagugucaaaauauuauagauuauagcuaaaauccagauuaauacucauuugggguuuuuuau

SEQ ID NO: 289328 - RNA, 64 nt, hsa
auuucauuaacucugauuaauuagaaucagcuagccagauuaguaaccucuuuguccagccuug

SEQ ID NO: 289329 - RNA, 64 nt, hsa
auaaaguucuagucacuucuguuggccugagccaccagauuaugauguugccagaauucacuca

SEQ ID NO: 289330 - RNA, 64 nt, hsa
gcuucuacaguugccacuuucucuuuuuaaucaaccagauuaaauaugaugugagauuauaaua

SEQ ID NO: 289331 - RNA, 64 nt, hsa
aucuguagagaaaucuaugcaauauauaguuuguccagauuagcuuucauuuggggaaugaagu

SEQ ID NO: 289332 - RNA, 64 nt, hsa
aguuuguacugaaaugcuuucaugggcugugcuuccagauuaugaguucuguggaaucaggaag

SEQ ID NO: 289333 - RNA, 64 nt, hsa
guugcaugaacaacaguuugcuauaagaaacauaccagauuagccaccauuagcaucuauaucu

SEQ ID NO: 289334 - RNA, 64 nt, hsa
ugaucaggccgcacugucugaagcaaucgguuccccagauuacuuguauuuaauacacaaugca

SEQ ID NO: 289335 - RNA, 64 nt, hsa
acuugaaaaauuacaggugagauuucuguuuaugccagauuauugaagauaaauauaaauguau

SEQ ID NO: 289336 - RNA, 59 nt, hsa
ccccuagcaguaaauugugauucagucuuccagauuaugccucacaugcuagcaucagg

SEQ ID NO: 289337 - RNA, 64 nt, hsa
cacuauaaacuggaauggauuucucaaugcgggaccagauuaugacuagaguuuuuaugccaga

SEQ ID NO: 289338 - RNA, 64 nt, hsa
agauuuugaaguaggaaauaaaaugaauugcuccccagauuauuuuuuuaauauuguaugcaau

SEQ ID NO: 289339 - RNA, 64 nt, hsa
ucuucuguuaaaauaucucuucagaugaaacuguccagauuaauuaggaaaaggcauauauuaa

SEQ ID NO: 289340 - RNA, 64 nt, hsa
acuugucuuuugcuaauaaacacauggcccuuucccagauuauucucuagccaagccccaccuu

SEQ ID NO: 289341 - RNA, 64 nt, hsa
aaggagcuacgucuuaggugaaaguuaugaccaaccagauuaaacucuacccacauccugcauu

SEQ ID NO: 289342 - RNA, 64 nt, hsa
ugccagccuacccuccaccacuucacaaguccugccagauuaaucuuccuuagauaucaguuag

SEQ ID NO: 289343 - RNA, 64 nt, hsa
gccaagccccggguacccucagugauggcagaggccagauuaacauuaggaaucucagugcaga

SEQ ID NO: 289344 - RNA, 64 nt, hsa
agaaucuaauaaguuagccauucucuauugcauuccagauuaggguuaggguagggaggacugg

SEQ ID NO: 289345 - RNA, 64 nt, hsa
gaccccauagcuggaggccuguggugccagaagcccagauuaggguggcuguccaucccuggau

SEQ ID NO: 289346 - RNA, 64 nt, hsa
gcugggauuacaggcgugagccacuccacccagcccagauuaaauguuuuuauuucuaccugcc

SEQ ID NO: 289347 - RNA, 64 nt, hsa
gugagagaggcccauggcugauuuuaccaugugcccagauuaauguauauaguugauuggaaug

SEQ ID NO: 289348 - RNA, 64 nt, hsa
cucuuuaugugucaguauuaagaguaauauguagccagauuacuuaaaucucagaauuacuaag

SEQ ID NO: 289349 - RNA, 64 nt, hsa
gggugaugaaauaggaguuuccuagcuauauaaaccagauuacucacccaugcauauaguaaga

SEQ ID NO: 289350 - RNA, 64 nt, hsa
augaaaugaaugacugcccagaaugagaauuuguccagauuauucagauaaacaucauaaagca

SEQ ID NO: 289351 - RNA, 64 nt, hsa
caagagucuaugcaaaaaaaaaaauuucuuuaccccagauuaucagauuuuuuucccucagauu

SEQ ID NO: 289352 - RNA, 64 nt, hsa
guuuugccagauguuaaacuuugaauuuaauauaccagauuauuaaaauauuguccauuaacua

SEQ ID NO: 289353 - RNA, 64 nt, hsa
ccuguaagaaacuugccuguucuaacuguugcuaccagauuauaucuggugguaauuguuaaug

SEQ ID NO: 289354 - RNA, 64 nt, hsa
gaaaggaaacguggcucucccuuaucauuuguauccagauuacuguacuguaggcuaaaauaac

SEQ ID NO: 289355 - RNA, 64 nt, hsa
aaaccuagccagcuucacgauuaugacuaaaguaccagauuauaaugccagaauauaaugugca

SEQ ID NO: 289356 - RNA, 64 nt, hsa
ugggaaagacuuggaggguuuggcuuauacaagaccagauuacagagggguauugauuugccuu

SEQ ID NO: 289357 - RNA, 64 nt, hsa
uccuuugccuuugacccuauguauaguuacgaugccagauuagauuuauagcagccucaaguug

SEQ ID NO: 289358 - RNA, 64 nt, hsa
uuaaacuaugaaccuucuuaacaucacugucuugccagauuaccgacacugucacuugaccaau

SEQ ID NO: 289359 - RNA, 64 nt, hsa
cugagggauacagagaugaaauuguaaacuguauccagauuaucaaagcuaauuugacuaguuu

SEQ ID NO: 289360 - RNA, 64 nt, hsa
uuuucuuaugcaaaaauacuccuuuccggugagaccagauuaacuaucuccauguuuguccuuu

SEQ ID NO: 289361 - RNA, 64 nt, hsa
uuuauacaauguuuuuaaaacuguuggauuaucaccagauuaaugcaaaauaacagagcgaguu

SEQ ID NO: 289362 - RNA, 64 nt, hsa
ucugaaagucaacaugaugcuucuugcauauuauccagauuauuguaugaaguugugucuauaa

SEQ ID NO: 289363 - RNA, 64 nt, hsa
auauuucacagggguucuuaugaagguaaauuuaccagauuaauaaaaauuuaugaauauuaaa

SEQ ID NO: 289364 - RNA, 64 nt, hsa
ggcgugugcucggugcugacgggacccacaugcuccagauuagagccuguaaacuuuaucacuu

SEQ ID NO: 289365 - RNA, 64 nt, hsa
gcuuuucaagcuaagagucuugugcuuggauuuuccagauuaauuugaaaagaccucccauuug

SEQ ID NO: 289366 - RNA, 64 nt, hsa
uaugcugaauugaacauuuugaaguuuauagcuuccagauuacaaaggccaaggguaauagaaa

SEQ ID NO: 289367 - RNA, 64 nt, hsa
uaaaaauagcaaucauuuuaaauugucaaaauuuccagauuacugguaaaaauuauuugaaaac

SEQ ID NO: 289368 - RNA, 64 nt, hsa
aaaacuugauguauucuguguguaugguuuuuccccagauuagucauacaguucauuuggaauu

SEQ ID NO: 289369 - RNA, 64 nt, hsa
ggccaaguguacauuugauuugauauacagaccuccagauuauuuucuauauuuggauucacag

SEQ ID NO: 289370 - RNA, 64 nt, hsa
ccauuuaguaaaaauaacuaucagcagaguuguuccagauuaaaaauaguacuacaagcuugua

SEQ ID NO: 289371 - RNA, 64 nt, hsa
ccuuuuuacuccccauacuuuguaaguaaugcuuccagauuaaccugcaaaucuuguggagcca

SEQ ID NO: 289372 - RNA, 64 nt, hsa
aacaauaugacuuagauuuucuguauuucaucugccagauuauuugaaucacacaggaugaugu

SEQ ID NO: 289373 - RNA, 64 nt, hsa
gaggcggggguaguuuauaccuugucgaaucauaccagauuauuaaaugugacaaauuacccaa

SEQ ID NO: 289374 - RNA, 64 nt, hsa
cuuaguuuguccaguccuuccaugcccuucuaucccagauuaccuaaauguucccuucucagga

SEQ ID NO: 289375 - RNA, 64 nt, hsa
auauaaaagggaggguuuuuuuaaaaauauauucccagauuauccuuguaaugacacgaaucug

SEQ ID NO: 289376 - RNA, 64 nt, hsa
aauagccaaaucaaacuuaagaaccagaucucugccagauuaaacauuuuugaagcuuuuaaaa

SEQ ID NO: 289377 - RNA, 64 nt, hsa
cccaguuucuuaggaaacgcaaacgauuuauuauccagauuauuuggauaaguccuuuuuaaga

SEQ ID NO: 289378 - RNA, 64 nt, hsa
caacacccuccagucuguagcagagcaguccaacccagauuagugcagcccggaggcuuagggu

SEQ ID NO: 289379 - RNA, 64 nt, hsa
aauuauuuuagaacacauuguauugguauuacaaccagauuauauucuugacguugacuucauu

SEQ ID NO: 289380 - RNA, 64 nt, hsa
ugcauccuucucccagaugacuuaggugguaaguccagauuagucaaagcuaaucauggaaguu

SEQ ID NO: 289381 - RNA, 64 nt, hsa
ccacugugcugcuaauaggauaaguacucuguugccagauuaccaugccuuuuauacaaaacca

SEQ ID NO: 289382 - RNA, 64 nt, hsa
aaaacuguucuuuuagguucaaaaccuaauucccccagauuaguauacucgagaauucaaaggg

SEQ ID NO: 289383 - RNA, 64 nt, hsa
ugccuuccuuuauuacaaaucaguauuaaaacuuccagauuauauucuugucauuuuuccucau

SEQ ID NO: 289384 - RNA, 64 nt, hsa
ggaguuauuuuugauauguagaaugccagaucuuccagauuaggcuaaauguaaugaaaaccuc

SEQ ID NO: 289385 - RNA, 64 nt, hsa
uccagucaucccagugggcuucucuuugucucucccagauuagaccuuugggugagauuggcau

SEQ ID NO: 289386 - RNA, 59 nt, hsa
auaucaucucacagcucugaggcccugggccagauuacuuccuccaccccucccuaucu

SEQ ID NO: 289387 - RNA, 64 nt, hsa
ggguuaaacugcaggagcaguuugccaccccuguccagauuauuggcugcuuugccucuaccag

SEQ ID NO: 289388 - RNA, 64 nt, hsa
ccccuguccuagugcaaagugaauuuagagugagccagauuauggaggauucugugacucuugc

SEQ ID NO: 289389 - RNA, 64 nt, hsa
gcagggaggaggaaggcugaggaaugacuuggcuccagauuacuugguuauuaagaagaacaau

SEQ ID NO: 289390 - RNA, 64 nt, hsa
gaaccuggagacauagcaucuuugauagcauaagccagauuaucugugugugcgguggugugcg

SEQ ID NO: 289391 - RNA, 64 nt, hsa
gaaauccaauauuuggaguacaauuucuuuuaauccagauuacaccugccuuacaaagcacccc

SEQ ID NO: 289392 - RNA, 64 nt, hsa
aaaacaggguuuccacuagacauuacuugaaaggccagauuacucagcagaucucccauguugg

SEQ ID NO: 289393 - RNA, 64 nt, hsa
cauacugggguuucugucucccuaguguucccauccagauuagcaugagugcuuugguugacuu

SEQ ID NO: 289394 - RNA, 64 nt, hsa
uauugacagcuauucaccuuucacggugcuggggccagauuagggaucacucccgugaggaggg

SEQ ID NO: 289395 - RNA, 64 nt, hsa
aacagauuuauuuauagacuuaacuuguauuaaaccagauuauucacaguaggaauagggguug

SEQ ID NO: 289396 - RNA, 64 nt, hsa
aucaauccacaguccaugaaauugugacacuccaccagauuaaguuagggcauaacauuaacuu

SEQ ID NO: 289397 - RNA, 64 nt, hsa
uucugccauaacaucuugaauuuaaccauauaugccagauuacuuuauaugcaucaacaagauc

SEQ ID NO: 289398 - RNA, 64 nt, hsa
uaccugugaagacauaagaaaaucuuaguaacuaccagauuaucuuuagaauuccacauuaacu

SEQ ID NO: 289399 - RNA, 64 nt, hsa
auuuuugaccucacugcagcaauuuucaguuauuccagauuaucuagcuuauggauucuggugg

SEQ ID NO: 289400 - RNA, 64 nt, hsa
uaccccgcuacccuguucugucuuauggagcagcccagauuaucuuuacucccucuuucucaug

SEQ ID NO: 289401 - RNA, 64 nt, hsa
uacuaccguuauacacauauaguguacagccagaccagauuaaacuucauauguaaucucuagg

SEQ ID NO: 289402 - RNA, 64 nt, hsa
cuuuggcuauuugcauuuugcuuccucuucuuuuccagauuacaguaugaagcuuuauuuucuu

SEQ ID NO: 289403 - RNA, 64 nt, hsa
uauagcacagugguuaugagcacagauuccaaagccagauuaccuagguucggagacccgcuuc

SEQ ID NO: 289404 - RNA, 64 nt, hsa
uuuacauuuuaaauugucuuuauuguguauaaaaccagauuagacuauauucuucaucugagga

SEQ ID NO: 289405 - RNA, 64 nt, hsa
ugaaaauuaugacagucucuggcuaggucuggguccagauuaggauuuaaacugauaaaggaaa

SEQ ID NO: 289406 - RNA, 64 nt, hsa
cuaaaacaccuauggcuuugacuuuguuauugauccagauuauuuuccuugcauuggggaaaau

SEQ ID NO: 289407 - RNA, 64 nt, hsa
ugcaaaccaucugccccugucccaaaaugaugagccagauuagcauuaaaccaguacuugucag

SEQ ID NO: 289408 - RNA, 64 nt, hsa
uugguuuaagaguagcagauugaaauauaagaagccagauuagacucuaaaauuguggccauug

SEQ ID NO: 289409 - RNA, 64 nt, hsa
acucuuccgugucaacaaugugacuacauguucuccagauuagccacacaugcaaacaucagug

SEQ ID NO: 289410 - RNA, 64 nt, hsa
cccaguguguccccaccucucccagccuguauacccagauuacuuuggugaacugagagcugga

SEQ ID NO: 289411 - RNA, 64 nt, hsa
gucacuuggacuauuucagcaacagucucaucucccagauuaccucugugcacacugacacgug

SEQ ID NO: 289412 - RNA, 64 nt, hsa
aaacuacaauuaauuauagaugucaaaacauuaaccagauuaaaguaauauauuuaagaguaaa

SEQ ID NO: 289413 - RNA, 64 nt, hsa
cuuuguuucaagaacacaugaaauucuuuuaacaccagauuaguguguuaccccaaaugaacgg

SEQ ID NO: 289414 - RNA, 64 nt, hsa
ugcgacacugcugcacguaggugccucaccagagccagauuaucuggucuuccaagacuuugcc

SEQ ID NO: 289415 - RNA, 64 nt, hsa
ccuugucugaacuggagccaugggcacaaagggcccagauuaaagucuuuauccucagucugug

SEQ ID NO: 289416 - RNA, 64 nt, hsa
aaucagcacaucguacacuggauugcagugcuucccagauuauugaaaaauguuacagacaacu

SEQ ID NO: 289417 - RNA, 64 nt, hsa
gucagcugccugcacaggcagaggugcccucagcccagauuagcaacacucauaguuuugccaa

SEQ ID NO: 289418 - RNA, 64 nt, hsa
aaccaaauauacauacuuauuuucuauggaccaaccagauuaauuuaaaugccacaggaaacaa

SEQ ID NO: 289419 - RNA, 64 nt, hsa
aggcauggguucagcuuaauuccauaauucccuuccagauuauuaacucuucauacuuacagca

SEQ ID NO: 289420 - RNA, 64 nt, hsa
aacccuggagacacccugaagguucacuggcucuccagauuagccucucuuccucugucaggca

SEQ ID NO: 289421 - RNA, 64 nt, hsa
aaacccaacuuucuuucucccuauguggaagacaccagauuagcuggaauucugccaccuuccu

SEQ ID NO: 289422 - RNA, 64 nt, hsa
gaauacaucaaagugaauuucuguucaaguuuucccagauuaucauucuuugggaugagagaac

SEQ ID NO: 289423 - RNA, 64 nt, hsa
cacagaagaacaaagacccagucaaagaucuuuuccagauuaugugguuuuggcuugugcucug

SEQ ID NO: 289424 - RNA, 64 nt, hsa
ucaauucacaagauuggguuauaacaauuauuugccagauuaacacuagggaauuauuugauaa

SEQ ID NO: 289425 - RNA, 64 nt, hsa
cccaugggcccguucugauugaaggugaagcccaccagauuauuuuucaaagucuuagguuucg

SEQ ID NO: 289426 - RNA, 64 nt, hsa
gguauaagccugcugaaaacaguauggcagauccccagauuaaaauauagaaauaacauaugau

SEQ ID NO: 289427 - RNA, 64 nt, hsa
agcagaguuaagaucuaccaaacugaaggggucuccagauuaucuuggaggggacaggaggaug

SEQ ID NO: 289428 - RNA, 64 nt, hsa
cuagucccuauccccaaccccucagagcagauucccagauuaacagauuuccauaucaccccaa

SEQ ID NO: 289429 - RNA, 64 nt, hsa
uaaaacauauaauucagguauuaggaaagugaucccagauuagauuuuugagauccaaaaaaaa

SEQ ID NO: 289430 - RNA, 64 nt, hsa
aaaguuauaguuuucuuacaaguuaaaaaaacagccagauuaucauuugcuuaacaaagaaauc

SEQ ID NO: 289431 - RNA, 64 nt, hsa
ucuucugcugggauuacagcauaugccaccaugcccagauuauuuuuuuguauuuguaguagag

SEQ ID NO: 289432 - RNA, 64 nt, hsa
gcggucaaggcuuuggagccacucuuuuguaacuccagauuauuuaaagagaaaaguacaagac

SEQ ID NO: 289433 - RNA, 64 nt, hsa
uggagauguuacaucugguagauguaacauucuaccagauuauggauggacugaucugaaaauc

SEQ ID NO: 289434 - RNA, 64 nt, hsa
gggcauuggcaguggguuucccuauggcuuggauccagauuagaauugaucuuuguuuucacuu

SEQ ID NO: 289435 - RNA, 64 nt, hsa
cuagauugaaguuuguuuucugaugcuguucuuaccagauuaaaaaaaaguguaaauuacaugg

SEQ ID NO: 289436 - RNA, 64 nt, hsa
uugcaauuccaggagcggcauugcccccgaauguccagauuaucccuguuuuugugaccaaaga

SEQ ID NO: 289437 - RNA, 64 nt, hsa
gugcauuuaauagucaauaaauucaucuaccauuccagauuauuaaaggcccacugguuguucc

SEQ ID NO: 289438 - RNA, 64 nt, hsa
uuguuacacaguaauagguuaauaauacacuggcccagauuaggaagguucugccauccauccc

SEQ ID NO: 289439 - RNA, 64 nt, hsa
aauaaggauccuuaugaugacuuuuagggacuacccagauuacuccaggauaaucuccucaccu

SEQ ID NO: 289440 - RNA, 64 nt, hsa
uaauaagagagagucuuaccugaauggcaaucgcccagauuaacaguggagacaguaaugcaau

SEQ ID NO: 289441 - RNA, 64 nt, hsa
ggggguagagguuuugggaugucuuaguuagaaaccagauuaauagaagaguaggccugauaua

SEQ ID NO: 289442 - RNA, 64 nt, hsa
uaacuuaacucuuaccuauuuucugcagcugcucccagauuacuccuuccuuccaauauaacua

SEQ ID NO: 289443 - RNA, 64 nt, hsa
cucauggucagagaugagaauguagccuuugugaccagauuauauuauuuuuaaaugaagaagc

SEQ ID NO: 289444 - RNA, 64 nt, hsa
uuccuaacuuaguaaaguagaauaauuucaugguauucauuaaaaagcauaaaagucuuccucu

SEQ ID NO: 289445 - RNA, 64 nt, hsa
aaaaaaaaaaucuaaagaugaauaguccuuggucauucauuauccauggcucauuaaucucuuc

SEQ ID NO: 289446 - RNA, 64 nt, hsa
gaugugaauugguuuuuaggggccccacuucccaauucauuagguaugacuguggaaauacaga

SEQ ID NO: 289447 - RNA, 64 nt, hsa
agccaggcaagucauagaauugauuacccgccgaauucauuaauuuacuguaguguuaagagaa

SEQ ID NO: 289448 - RNA, 64 nt, hsa
auuagaaaaaaacaaacucuacuaauuuuuagauauucauuaauaggaaagauuuaauguuaca

SEQ ID NO: 289449 - RNA, 64 nt, hsa
agguauugauugaaaaaagagaaaggggcaagaaauucauuaaagaaaaaccacagauacugaa

SEQ ID NO: 289450 - RNA, 64 nt, hsa
uauauggaaaggcuuacaaaucaauauuguaagcauucauuauuuaagaauguacaauguauuu

SEQ ID NO: 289451 - RNA, 64 nt, hsa
ggcauauuucuauggaaguuuaauugacagcuauauucauuauuuauuuuacaauuucauuuuu

SEQ ID NO: 289452 - RNA, 64 nt, hsa
ccuaauugguaaccugaguuuauaucuggcaugaauucauuauggugauacacauaugugaauu

SEQ ID NO: 289453 - RNA, 64 nt, hsa
uucugucugcauguaauuuggauuucucaaauacauucauuaguaauuuaucaguaacauuagu

SEQ ID NO: 289454 - RNA, 64 nt, hsa
caauuaaugauucaauuaacauauaucuuauccaauucauuaugucaauucauuaauaaaauac

SEQ ID NO: 289455 - RNA, 64 nt, hsa
aauuaacauauaucuuauccaauucauuaugucaauucauuaauaaaauaccuuuuauguagag

SEQ ID NO: 289456 - RNA, 64 nt, hsa
cuucaaaguuuuaacuagcauuauaaaauggccuauucauuauauguauauuuuuuuauaaaua

SEQ ID NO: 289457 - RNA, 64 nt, hsa
caguggguuuuuccuagaggagagauuaguaccuauucauuaacacaaggauacauaagagacu

SEQ ID NO: 289458 - RNA, 64 nt, hsa
uguugcugguauuuugcauuuuaaagugaucaagauucauuaggcaaacuuugguuuaaguaaa

SEQ ID NO: 289459 - RNA, 64 nt, hsa
cuuuguacagagguuacugcaauaaaggaaguggauucauuaaaccuauuuaauguccauucuu

SEQ ID NO: 289460 - RNA, 64 nt, hsa
auaggugaaagauaacuguagucaggugaaaggcauucauuauuuuuaagcugaaaaggggauc

SEQ ID NO: 289461 - RNA, 64 nt, hsa
uuauuaacauagaugaagguaugcuauaggcaucauucauuaucucuauauugaauaggugaaa

SEQ ID NO: 289462 - RNA, 64 nt, hsa
auuaucuuuuaaguugucagcaaguuaccaagguauucauuaaagaacuuguaauaucaaauua

SEQ ID NO: 289463 - RNA, 64 nt, hsa
uugaugcuaauaauaauuuucuuuaaacucuaccauucauuaugugguaacuguauugaacuua

SEQ ID NO: 289464 - RNA, 64 nt, hsa
aaaagauauuuuagaaucaauuuauaaagggguaauucauuaauuacacuuuaaaauuggaaag

SEQ ID NO: 289465 - RNA, 64 nt, hsa
aaaggauccauuuaguuaaaaucgggcacucuauauucauuaagguuuaugaauuaaaaagaaa

SEQ ID NO: 289466 - RNA, 64 nt, hsa
auuuaccaauuuauuuucuuaguauuacaaaauaauucauuagcauaaaguacaauagugaaau

SEQ ID NO: 289467 - RNA, 64 nt, hsa
acuuguaagucugauuacaucauuauuguuccaaauucauuaucucuguaggaacuuuuaguuc

SEQ ID NO: 289468 - RNA, 64 nt, hsa
uauuauuaaauuuauaucccuaaaauuuuuagaaaucucucaaaaucuuuccaaauguucuggu

SEQ ID NO: 289469 - RNA, 64 nt, hsa
uguguacauuaaaucuagaaaccauuaguuugagaucucucaaaaauaaaaauaaaaauugcuu

SEQ ID NO: 289470 - RNA, 64 nt, hsa
uuccccucuccucuuccaaacaaaacauacauugaucucucacauccagcugccaaaagaaaac

SEQ ID NO: 289471 - RNA, 64 nt, hsa
agaaaaccccaucaaacacaguuacaccccacauaucucucacacacacacacacacgcacaca

SEQ ID NO: 289472 - RNA, 64 nt, hsa
caucugacaggcuuaucauucucuuuaaaauaccaucucucagaguggguucugccgaacccuc

SEQ ID NO: 289473 - RNA, 64 nt, hsa
ccagcugcaaaccuggccagaggaguucuauugcaucucucaccuguucucaccccucugcagc

SEQ ID NO: 289474 - RNA, 64 nt, hsa
accauucuguccugggagagaagaggaggaucucaucucucaucuguccaaacaaggcaaggag

SEQ ID NO: 289475 - RNA, 64 nt, hsa
uuuacaguaagguggaugguaccuuauggcaaaaaucucucagaaauuuaugugugguuuuaaa

SEQ ID NO: 289476 - RNA, 64 nt, hsa
accucaaagaugguugcccauuuuaaauccuuucaucucucaucucucuuucuucucucccuuc

SEQ ID NO: 289477 - RNA, 64 nt, hsa
gcugagccacaaguuggucuccuugggaggugccaucucucaucugucccucccccagccauga

SEQ ID NO: 289478 - RNA, 64 nt, hsa
caagcugacucuaauuuuaaaaaauaaaaauuuuaucucucaccaauuuuaaaauggcucaaac

SEQ ID NO: 289479 - RNA, 64 nt, hsa
uuuuccucagaggggcagguuacaagaacuucacaucucucaggcuacauguugcaaagguuaa

SEQ ID NO: 289480 - RNA, 64 nt, hsa
cuagccugcugcuuggagucagguugagcaucagugagaugaagacaguaccuuuuccucucac

SEQ ID NO: 289481 - RNA, 64 nt, hsa
ggugcaaauucuuguguguguuugcauaggaaggugagaugaccaucuacuaaagaggaaguag

SEQ ID NO: 289482 - RNA, 64 nt, hsa
aucagcccagaaagcuaucaauguccaagugaagugagaugaugcauggccacauuauugcuuu

SEQ ID NO: 289483 - RNA, 64 nt, hsa
uucucuguuuuguuuuguuuuuauuuuuguuuuuugagaugaagucucacugcacucaggcugg

SEQ ID NO: 289484 - RNA, 64 nt, hsa
aaagaauugauaguacaaaauccaacaacaauacugagaugaucuaagaagguuauaacaaaau

SEQ ID NO: 289485 - RNA, 64 nt, hsa
gcuaucaguuucaaauaauauuuucucuguaguaugagaugaaauuaaaaguggauagcuuuca

SEQ ID NO: 289486 - RNA, 64 nt, hsa
uuuucaaacuccauuccuuagaacauucuucuacugagaugauccaagaccaaaaguguucuuu

SEQ ID NO: 289487 - RNA, 64 nt, hsa
aaugaacaggaaaagauguaaaaacauuuuuuucugagaugaaaacauauuaauuaaacaugca

SEQ ID NO: 289488 - RNA, 64 nt, hsa
gcaggaaggagaggcagggcaggacacgcuggucugagaugagggggagccccacgggccccag

SEQ ID NO: 289489 - RNA, 64 nt, hsa
ggaaagggugaggggugacacucggcucuggcucugagaugaggcagacggcacccaggcugug

SEQ ID NO: 289490 - RNA, 64 nt, hsa
cacaauaagcaaaucacaugaaggcugagaugauugagaugaaaguuaacauagugugaaugaa

SEQ ID NO: 289491 - RNA, 64 nt, hsa
cuagagaaacacaauaagcaaaucacaugaaggcugagaugauugagaugaaaguuaacauagu

SEQ ID NO: 289492 - RNA, 64 nt, hsa
uuugauacauacccugauuugauguuuugguauuugagaugaacucugaguaugaagcuguacc

SEQ ID NO: 289493 - RNA, 64 nt, hsa
auauugauaguacauauugcuuuguuuaugucuuugagaugagaaaggcuuaaaacuugagaau

SEQ ID NO: 289494 - RNA, 64 nt, hsa
cacuaacuggguuuaaauuuugacugauguggguugagaugaggaggccucacugguugggguc

SEQ ID NO: 289495 - RNA, 64 nt, hsa
cucaagggcaagaaacgcaaacaagaaauauuugugagaugaaaguugucaauuggauuuucuu

SEQ ID NO: 289496 - RNA, 64 nt, hsa
ugaccagugaccggcucgaaucuggccuuuugugugagaugaucacgguuucuuuuguuuauca

SEQ ID NO: 289497 - RNA, 64 nt, hsa
auaaguuaacccggccugacagaaucaagaaaauugagaugagauuugaaaggacccgaaaaug

SEQ ID NO: 289498 - RNA, 64 nt, hsa
uuugggccucucuugcugucauuaugauguauuuugagaugauuagucaagagucaagguugcg

SEQ ID NO: 289499 - RNA, 64 nt, hsa
agccuaauuuuguguauucugguggcugcugucaugagaugauaaaauguaaaacaaaacucua

SEQ ID NO: 289500 - RNA, 64 nt, hsa
ucuauuuccaguacacgucacauuauuuuaccggugagaugagaaugucacaaacauuaaaagc

SEQ ID NO: 289501 - RNA, 64 nt, hsa
ugaguucauggggagauucuguaaagugaugaacugagaugaaagcagccaacagcccaggagc

SEQ ID NO: 289502 - RNA, 64 nt, hsa
gaagauggagcagagucaaaucugugcuucuaacugagaugagaguguauuaaucacguaucgc

SEQ ID NO: 289503 - RNA, 64 nt, hsa
ucccagugggaaaacgugugcuagaguuggggagugagaugaguggugcuguccauggaaucag

SEQ ID NO: 289504 - RNA, 64 nt, hsa
gacuuuuccuggccucucccagcaugcccugggcugagaugagauggugguuuauggcuccaga

SEQ ID NO: 289505 - RNA, 64 nt, hsa
uaggggaacgugugugcgcgugcuggugggcaugugagaugagugacugccggugaaugugucc

SEQ ID NO: 289506 - RNA, 64 nt, hsa
ccgcccugcuggccucccuucuccccucaacccuugagaugauuuucucuuuucaacuucuuga

SEQ ID NO: 289507 - RNA, 64 nt, hsa
cuggaauuaacugagacuuuugaggccuuugggaugagaugaauauauuuuacaugugaugaca

SEQ ID NO: 289508 - RNA, 64 nt, hsa
auugagucucauccauaucugagugaugugauauugagaugacacuuuggaguuugaguuuaaa

SEQ ID NO: 289509 - RNA, 64 nt, hsa
ugcagcuuccaaaagucccagagaugaagcucccugagaugaaacucccugaggugaaacuccc

SEQ ID NO: 289510 - RNA, 64 nt, hsa
ugaagcuuccaaaggugccugagaugaaacuuccugagaugaaacucccugaagugcaacuccc

SEQ ID NO: 289511 - RNA, 64 nt, hsa
ugaaagucccugagaugaagcuuccaaaggugccugagaugaaacuuccugagaugaaacuccc

SEQ ID NO: 289512 - RNA, 64 nt, hsa
ugcagcugccgaaagugccagagaugaaagucccugagaugaagcuuccaaaggugccugagau

SEQ ID NO: 289513 - RNA, 64 nt, hsa
uggcauggcucagccccugaguuaccacaguccuugagaugagugguucuuuggguuacaaagu

SEQ ID NO: 289514 - RNA, 64 nt, hsa
aauugggaaauagagucuuugcagaugaucuaguugagaugaggucauuggggugggcccucac

SEQ ID NO: 289515 - RNA, 64 nt, hsa
uggcagguccuuuugaggugaugggccgguuuugugagaugaauuguaucccccaaaaagacag

SEQ ID NO: 289516 - RNA, 64 nt, hsa
ggcgggagcaguuugcguguuuggguuuuuuaauugagaugaaauucaaauaaccuaaaaauca

SEQ ID NO: 289517 - RNA, 64 nt, hsa
acauggcuuccuaaauggcccuguuuacggccuaugagaugaaauaugugauuuucucuaaugu

SEQ ID NO: 289518 - RNA, 64 nt, hsa
auagagcuccuaaaaaugagaaauauuuauugaaauaagaaaaaagcccucagacauguugaau

SEQ ID NO: 289519 - RNA, 64 nt, hsa
guuguuuguauaaaacaauuauaaugaaguguuuauaagaaauuguaaacaaauguaaaacuaa

SEQ ID NO: 289520 - RNA, 64 nt, hsa
gccaccgcugccagcccagaguuacccucuaaagauaagaaaaaggcuauuaauaucauacuaa

SEQ ID NO: 289521 - RNA, 64 nt, hsa
augauuaauuaugaagaugaaacacuagagucauauaagaaauaaaaauugggcaauaaaauaa

SEQ ID NO: 289522 - RNA, 64 nt, hsa
auucaggggagaaaagugaaugaaaugacucauaauaagaaagcuugcucccuugggacaguua

SEQ ID NO: 289523 - RNA, 64 nt, hsa
cuuuauugaguaaagguuauaguuugacuuuaagauaagaaauuuucuagaaucauguuugaau

SEQ ID NO: 289524 - RNA, 64 nt, hsa
aggaagagucuaauaguaauuauggauauaaaaaauaagaaauuuuguauagaaaugaagguuu

SEQ ID NO: 289525 - RNA, 64 nt, hsa
uuuuaacuuuuuuggucuucagcuaaaaaauaggauaagaaauuaaggucuauuccauucucca

SEQ ID NO: 289526 - RNA, 64 nt, hsa
ccaaacuuuuagaguaaaaagccaaauuuaaauuauaagaaagaagggaaaaaagagaaaaacu

SEQ ID NO: 289527 - RNA, 64 nt, hsa
cuuuugggaauuuuacagagucaaaguaggcagaauaagaaaauaguucuucaggagggccgac

SEQ ID NO: 289528 - RNA, 64 nt, hsa
guuuuaacuucuaaagaaaauauguuucagcauuauaagaaaggcagaaugcagaacaccuaca

SEQ ID NO: 289529 - RNA, 64 nt, hsa
aagucuccuacauagcaguguuauuuauguacagauaagaaaaccauaugucagccaaagauuu

SEQ ID NO: 289530 - RNA, 64 nt, hsa
auaauaauagcccugagauguuucuaacauuuaaauaagaaaaaaaucaaaucgaagucagccu

SEQ ID NO: 289531 - RNA, 64 nt, hsa
uagugguguuuacugcugcagcauguaucacaagauaagaaaugaaaaaucaaucuuucuuacc

SEQ ID NO: 289532 - RNA, 64 nt, hsa
ugauuguuauuguuggauguuauacugauuauuaauaagaaauuuggauuuuugccuuuuuacc

SEQ ID NO: 289533 - RNA, 64 nt, hsa
agcaaaacacaagcugcauuuuuauuuauuuugcauaagaaagguaaaucuuuuuacaaaaaaa

SEQ ID NO: 289534 - RNA, 64 nt, hsa
caacuguagaugauauuuuauguuuaaucuguaaauaagaaauguauuuaaauuaaaagggauc

SEQ ID NO: 289535 - RNA, 64 nt, hsa
aaauguuuugguuauucaugaucacuugggcaguauaagaaaauguagcuucugaauauuggcc

SEQ ID NO: 289536 - RNA, 64 nt, hsa
aacaauguuuggaugcaacgcagaauaaaagaauauaagaaauagcuuuuuguugcauuaaugu

SEQ ID NO: 289537 - RNA, 64 nt, hsa
uaauugguauggccauuagguucaguccuugaagauaagaaacuuguucucuguuuguugucuu

SEQ ID NO: 289538 - RNA, 64 nt, hsa
aggaauucaauguauguuuguuuuauacuguuugauaagaaaaguagguccagccuuaagcagc

SEQ ID NO: 289539 - RNA, 64 nt, hsa
aaugauaauuugcuuaugucuuauaaaacucagcauaagaaaaauacugcccuaccuugacugu

SEQ ID NO: 289540 - RNA, 64 nt, hsa
caguuugaaaccagugaggaaaaaagguauguugauaagaaaccuauauugcuagguagaauuu

SEQ ID NO: 289541 - RNA, 64 nt, hsa
uuaacaauaagaaauaagaaauaauuuuuuucaaauaagaaaauuguguacucuagaaauggag

SEQ ID NO: 289542 - RNA, 64 nt, hsa
uuacuguaaagucuauucuguuuaacaauaagaaauaagaaauaauuuuuuucaaauaagaaaa

SEQ ID NO: 289543 - RNA, 64 nt, hsa
guuguuguuacuguaaagucuauucuguuuaacaauaagaaauaagaaauaauuuuuuucaaau

SEQ ID NO: 289544 - RNA, 64 nt, hsa
agucagagaugguauuaccuuuuaaaaaaugcuaauaagaaaauuggaagauucuuuuaaaaau

SEQ ID NO: 289545 - RNA, 64 nt, hsa
cauggauagauuuuuggaacgaaaaaggguaaguauaagaaaauauugcaaacacauuaaaaca

SEQ ID NO: 289546 - RNA, 64 nt, hsa
gaugguuggucucuaauauauuuggaacugauucauaagaaaaguuauuaaaauuaucuuugaa

SEQ ID NO: 289547 - RNA, 64 nt, hsa
gugaugguaauuucauuagucccaaaacaccggcauaagaaauuugacauuucacagaugcacu

SEQ ID NO: 289548 - RNA, 64 nt, hsa
uauucaaucagauuuuccaaaguaccuuuccaccauaagaaaugaauuuucuacuucuacaccc

SEQ ID NO: 289549 - RNA, 64 nt, hsa
acuacuucugcuguucaaucaagagucuugguagauaagaaaaaaaucagucaauauuuccaaa

SEQ ID NO: 289550 - RNA, 64 nt, hsa
gaaaauaagguucagaugcagaagaauggcuaaaauaagaaacgugauaagaauauagaugauc

SEQ ID NO: 289551 - RNA, 64 nt, hsa
ugccauagaaauguagguccucagaaaguguauaauaagaaacuuauuucucauaucaacuuag

SEQ ID NO: 289552 - RNA, 64 nt, hsa
aauaagaaacuuauuucucauaucaacuuagucaauaagaaaauauauucuuucaaaggaacau

SEQ ID NO: 289553 - RNA, 64 nt, hsa
ugaugcauaguauuuuagucuacuuguauuguuuauaagaaacccaagcaaaaauauauagcaa

SEQ ID NO: 289554 - RNA, 64 nt, hsa
gauuguucagcaaccuucaguaucuauuauuuuaauaagaaagaaacuuccccuaaacuuuaga

SEQ ID NO: 289555 - RNA, 64 nt, hsa
cuuuuacaaguggcuuuacauuuccuaaaaugccauaagaaaaugcaauaucuggguacuguau

SEQ ID NO: 289556 - RNA, 64 nt, hsa
uuuccucuguaaagaucagaugguaaucuuucaaauaagaaaaaaauaaagacguauguuugac

SEQ ID NO: 289557 - RNA, 64 nt, hsa
aauacaguagcaucauaccuauaguuggucuuagauaagaaaugaacuacuugauauagcaaag

SEQ ID NO: 289558 - RNA, 64 nt, hsa
ucagcuuguccagaccuggaacaaaauuucuggaauaagaaauuuguauuaaaguccuuuuuug

SEQ ID NO: 289559 - RNA, 64 nt, hsa
uaaaucuauucccaugccagaaucuuaucaauacauaagaaauuuaggaagauuaggugccaaa

SEQ ID NO: 289560 - RNA, 64 nt, hsa
auaauguugauguaaguaaugcgguuacugaaucauaagaaaaugccaucucuuuuuaguugaa

SEQ ID NO: 289561 - RNA, 64 nt, hsa
uauuauggaaauguugucuuuuauacuuaguuauauaagaaaaaagggaguuaugcaauuaaua

SEQ ID NO: 289562 - RNA, 64 nt, hsa
uguuuuauuuuuuucccuuuagcauugcaugugaauaagaaaauaauguuuaaagaaaaaaaaa

SEQ ID NO: 289563 - RNA, 63 nt, hsa
aagcuuuuaaccuaucuuaacaacuuacugaacauaagaaaauuuacacuagagagaaagccu

SEQ ID NO: 289564 - RNA, 64 nt, hsa
aaagcuuuucaccgauacucaauccuuaguacacauaagaaaauucauacuggggagaaacccc

SEQ ID NO: 289565 - RNA, 64 nt, hsa
aaagcuuuuaaccaguccucacaccuuaugagacauaagaaaauucauaguaaagagaaacccu

SEQ ID NO: 289566 - RNA, 64 nt, hsa
aguuguuuuaacuaguucucgaacuuuacuaugcauaagaaaauucaaacuggagagaaacucu

SEQ ID NO: 289567 - RNA, 64 nt, hsa
uaaaaauguauguugguuuagcguuguuuuguggauaagaaaaaugcuugacccugaaauauuu

SEQ ID NO: 289568 - RNA, 64 nt, hsa
uguuguaauaucaguuacaguggcaguauugacaauaagaaacaguuuaacagaaaaaugaaau

SEQ ID NO: 289569 - RNA, 64 nt, hsa
auuugauaaagcauauuuaugaacauauuucuuaauaagaaaaauauccauuuuauuaccauuu

SEQ ID NO: 289570 - RNA, 64 nt, hsa
augugacuuugaggccaaugagucauaaacaaauauaagaaagcugucaaugaguuucuucaaa

SEQ ID NO: 289571 - RNA, 64 nt, hsa
aauuuuccccaaagauaauauccucuuagggaacauaagaaaaauguauaauaaaaauguggug

SEQ ID NO: 289572 - RNA, 64 nt, hsa
guuaagaccuucauuuaagaggcagaagauuaagauaagaaauauaagauagaaaagcuuuguu

SEQ ID NO: 289573 - RNA, 64 nt, hsa
ucucauauuuaguauugaauacuuacauucucuaauaagaaaaccaccccuuagauugaaguaa

SEQ ID NO: 289574 - RNA, 64 nt, hsa
ccacuucuggucaaucaacacuaccagcguauauauaagaaagacaucuuucucuuuucuaaaa

SEQ ID NO: 289575 - RNA, 64 nt, hsa
gccugacagacaagcagaugaccucacaggagugauaagaaacaucugcuccacgccaacuccc

SEQ ID NO: 289576 - RNA, 64 nt, hsa
agaagacaucauugguucuguguuuccuacggaaauaagaaacgauaaauauugcacugaaugu

SEQ ID NO: 289577 - RNA, 64 nt, hsa
aguuguaaauuuguaaagauuaccuugccacuuuauaagaaaguguauuuaacuaaaaagucau

SEQ ID NO: 289578 - RNA, 64 nt, hsa
gcacaaaauaguacuuuguggaucauuucaagauauaagaaauuuuggaaauuccaccauaaau

SEQ ID NO: 289579 - RNA, 64 nt, hsa
caggaggcuaugucucuaauucacuuuagagauaauaagaaauuguucugguagauauauccug

SEQ ID NO: 289580 - RNA, 64 nt, hsa
aagcaaacaaaaaaaauuuguauguaaacugaaaauaagaaaauacauuagcaagcuuaauggu

SEQ ID NO: 289581 - RNA, 64 nt, hsa
auucauuaauuacacuuuaaaauuggaaagugggauaagaaaucuaaaguaaaccagcuuaucu

SEQ ID NO: 289582 - RNA, 64 nt, hsa
auuaugugaauaucccuugccaauuuuuuuuauaauaagaaaacaucugacuaaagucaaagaa

SEQ ID NO: 289583 - RNA, 64 nt, hsa
ggugucaggcugucacuguucacacaaauuuuuaauaagaaacauuuaccaagggagcaucuuu

SEQ ID NO: 289584 - RNA, 64 nt, hsa
ugaacuggcauccugcuuuagccugagacuugccauaagaaacugcugaguacuuggcaaaccc

SEQ ID NO: 289585 - RNA, 64 nt, hsa
guaguauuccugagaacuuuauuuuggaaaauuuauaagaaaguaauccaaauaagaaacacga

SEQ ID NO: 289586 - RNA, 64 nt, hsa
uuuauuuuggaaaauuuauaagaaaguaauccaaauaagaaacacgauaguugaaaauaauuuu

SEQ ID NO: 289587 - RNA, 64 nt, hsa
ucuguaagguggaaauuucaucaguuugcaaacgauaagaaaugcagacuugcucuugauagaa

SEQ ID NO: 289588 - RNA, 64 nt, hsa
uacacaaguuuuugccuaucccuuuccuuaaaauauaagaaauaaaggagcucuuacgaaaaac

SEQ ID NO: 289589 - RNA, 64 nt, hsa
aaagcuuuuaaacaguccucaaucuuuauuacacauaagaaaauucaugcuggagagaaacacu

SEQ ID NO: 289590 - RNA, 64 nt, hsa
guaaauccuucagcugauucucagucuaguaaacauaagaaaauucauacuggagagaaaaucu

SEQ ID NO: 289591 - RNA, 64 nt, hsa
gugacagauuuuagagcaaaaauuaguaauaaaaauaagaaauaaaauuacaggagcaauuaag

SEQ ID NO: 289592 - RNA, 64 nt, hsa
accuaaaaggaugucuaaauguuuguuaauaaaaauaagaaauagcuacagugacagauuuuag

SEQ ID NO: 289593 - RNA, 64 nt, hsa
cauuuaacacuugggacaacauuuauuauaaaugauaagaaaaaucuuagagguuugucuaccc

SEQ ID NO: 289594 - RNA, 64 nt, hsa
uuguuggaauugggacuuaggaguuuugauuuugauaagaaacugggauaauuuucugaacuuu

SEQ ID NO: 289595 - RNA, 64 nt, hsa
uaguagagcugcaccuaaagaggaaauuggguuuauaagaaaauggaggcaaagaacuuaaguu

SEQ ID NO: 289596 - RNA, 64 nt, hsa
aaauguaucuuuauuagugacuucuaguccaaauauaagaaacugucauguuuugugggaaaau

SEQ ID NO: 289597 - RNA, 61 nt, hsa
caacucacaaaacguagcacaaacauucauuauggagaaagcaucaggacuguugaguaac

SEQ ID NO: 289598 - RNA, 61 nt, hsa
auuauuccuguuugaaagguggugcaugcagauggagaagugguguuggcagcaagcuuug

SEQ ID NO: 289599 - RNA, 61 nt, hsa
ccuucaucaugucaguuccaaugagguggggauggagaagacaauuguugcuuaugaaaga

SEQ ID NO: 289600 - RNA, 61 nt, hsa
caacaagagacuggaaggaccauaaauuuaaauggagaaaggacccucaagacaaaugacc

SEQ ID NO: 289601 - RNA, 61 nt, hsa
ucuguuucgaauauagccacagaaauaaaggauggagaaaaaucugggacagguaauuuug

SEQ ID NO: 289602 - RNA, 61 nt, hsa
ucuguuucgaacauagccacagaaauaaaggauggagaaaaaucugggacagguaauuuug

SEQ ID NO: 289603 - RNA, 61 nt, hsa
ucuguuuugaguauagccagagaaaacaaggauggagaaaaaucuaggacagguaauuuug

SEQ ID NO: 289604 - RNA, 61 nt, hsa
ucuuuuucgaauauaaccagaggaaaaaaggauggagaaauaucuaggaaagguaauuuug

SEQ ID NO: 289605 - RNA, 61 nt, hsa
ucuuuuucgaauauaaccagagaaaaaaaggauggagaaauaucuaggaaagguaauuuug

SEQ ID NO: 289606 - RNA, 61 nt, hsa
ucuguuuuggguauagccagagaaaacaaggauggagaaaaaucuaggacagguaauuuug

SEQ ID NO: 289607 - RNA, 61 nt, hsa
cacagggcuugguagaggguauaucuagugaauggagaauacauggagaaacuuaacuaag

SEQ ID NO: 289608 - RNA, 61 nt, hsa
guagaggguauaucuagugaauggagaauacauggagaaacuuaacuaaguuacacaagca

SEQ ID NO: 289609 - RNA, 61 nt, hsa
uguccccaggguagaaauguccuaccagcggauggagaauccuggcugccaugugguugau

SEQ ID NO: 289610 - RNA, 61 nt, hsa
ggagagguugcagaggcugcagggccggggcauggagaagaccagggaagaagcagaacuu

SEQ ID NO: 289611 - RNA, 61 nt, hsa
uuaacugagcuccuagagaagaacaauccucauggagaaacucuggaaaccuugacaaugg

SEQ ID NO: 289612 - RNA, 61 nt, hsa
gcucucaaggcaaugacucgaaguuugcaguauggagaacaggugagucugcauagaguca

SEQ ID NO: 289613 - RNA, 61 nt, hsa
caaaggaugugugaggauuucccaguacuggauggagaaugagaagagaaagucagccuuu

SEQ ID NO: 289614 - RNA, 61 nt, hsa
agaagagaacgggcagaaguacagaacagaaauggagaagcugaccacgacuccaucucuu

SEQ ID NO: 289615 - RNA, 61 nt, hsa
agccuaggaguucgagaccagccuaggcaacauggagaaaccccgucucuaucagaaauac

SEQ ID NO: 289616 - RNA, 61 nt, hsa
aguaagcuuggaaaaauaauuuaagaauacaauggagaaauguaaauaaguaucuauguaa

SEQ ID NO: 289617 - RNA, 61 nt, hsa
guucauguuggccauggugaaaggguuugauauggagaaacaaaauccucaggaaauuaga

SEQ ID NO: 289618 - RNA, 61 nt, hsa
aggucgggaguucgagaccagccugaccaacauggagaagccccgucucuacuaaaaaugc

SEQ ID NO: 289619 - RNA, 61 nt, hsa
uaugcucugguuggcaggcaacccuguagucauggagaaagguauuucaagaucuagucca

SEQ ID NO: 289620 - RNA, 61 nt, hsa
cccgaugcucuaguguuuggaggugggcaggauggagaacagugccuguuugggggaaaac

SEQ ID NO: 289621 - RNA, 61 nt, hsa
acuaaugucucuucuaacaucuuagagguccauggagaaggcauauggagaacauguuuua

SEQ ID NO: 289622 - RNA, 61 nt, hsa
cuaacaucuuagagguccauggagaaggcauauggagaacauguuuuauacugcucuauaa

SEQ ID NO: 289623 - RNA, 61 nt, hsa
cauaaauuaucaaauaucaggugaucuuacuauggagaagaaaaaccaauaucuaguuaca

SEQ ID NO: 289624 - RNA, 61 nt, hsa
uuggcuguagucucaaauuuuauucuguagcauggagaaugggugcaaaaagcugacuucu

SEQ ID NO: 289625 - RNA, 61 nt, hsa
aauuugccaugacuuccuggaggacagcagcauggagaaagauccuagaaaaggucagacc

SEQ ID NO: 289626 - RNA, 61 nt, hsa
cucccuugcuuaucuguagaaacaaauggccauggagaaacgcagagcaguccagaaccag

SEQ ID NO: 289627 - RNA, 61 nt, hsa
auaguacuuuucuauguaguaaaccuggaauauggagaauuucauaacaguucauucuacu

SEQ ID NO: 289628 - RNA, 61 nt, hsa
agguauuugcugagaugugggugaacuccaaauggagaaguagucacuguagacuuucuuc

SEQ ID NO: 289629 - RNA, 61 nt, hsa
aauguuuccuggguuugcucuuugacaauaaauggagaaggaaggucacccaacuccauug

SEQ ID NO: 289630 - RNA, 61 nt, hsa
uggccaggauggcagagacuuccuugucaucauggagaagugccagcaggggacugggaaa

SEQ ID NO: 289631 - RNA, 61 nt, hsa
aggucaggaguuugagaccagccuggccaacauggagaaccccccgucucuacaaaaaaua

SEQ ID NO: 289632 - RNA, 61 nt, hsa
uacagaccuuuugcaugggugaguggaugaaauggagaacagagugagugcugugaacggu

SEQ ID NO: 289633 - RNA, 61 nt, hsa
aauuucuggaagaaaggcuguggaagggccaauggagaaaaugaauggacaaagcucagga

SEQ ID NO: 289634 - RNA, 61 nt, hsa
ugugcagacaauucucccugagguuagcccaauggagaaaugaagcagaggaaggaaacau

SEQ ID NO: 289635 - RNA, 61 nt, hsa
uaucuuuuaucaguguucagaucauagauuaauggagaaaacauuuaaaauuguuuuaaau

SEQ ID NO: 289636 - RNA, 61 nt, hsa
auuuuaugcuaaagguuuuguccuguaggacauggagaacuucugaagaauuuucaaggcg

SEQ ID NO: 289637 - RNA, 61 nt, hsa
auauuuggaccuuuaaacagcuuguuuucccauggagaagaugacaaugccaaucauaggc

SEQ ID NO: 289638 - RNA, 61 nt, hsa
ucagagaacuugccagauagaaaagacuuaaauggagaaccagcccaugccucacagacag

SEQ ID NO: 289639 - RNA, 61 nt, hsa
ccaaagcugggcucaguggggaaggucaggaauggagaaauugccuuuucucguuagccuc

SEQ ID NO: 289640 - RNA, 61 nt, hsa
aggucaggaguucgaaaccagccuggccaacauggagaaaccccaucucuacuaaaaauac

SEQ ID NO: 289641 - RNA, 61 nt, hsa
agaucauuauucuaagugaaauaacucaggaauggagaaccaaauauuguacauccucacu

SEQ ID NO: 289642 - RNA, 61 nt, hsa
cacgccgggggugaaaauguacgucuguagcauggagaagccuucaggguacauucagcuc

SEQ ID NO: 289643 - RNA, 61 nt, hsa
ugguuccaucuuuaaggaagaagaauguuugauggagaaaauuuguggccaaugaagucug

SEQ ID NO: 289644 - RNA, 61 nt, hsa
guuugugaaacaguaggauucucuuuuggcaauggagaauugcaucugaugguucaagugu

SEQ ID NO: 289645 - RNA, 61 nt, hsa
gcuuuuguugaguuaaauaagaugcuauauaauggagaagaauuugaaaaugcacaaaaaa

SEQ ID NO: 289646 - RNA, 64 nt, hsa; identical to SEQ ID NO: 250537

SEQ ID NO: 289647 - RNA, 64 nt, hsa; identical to SEQ ID NO: 250538

SEQ ID NO: 289648 - RNA, 64 nt, hsa; identical to SEQ ID NO: 250539

SEQ ID NO: 289649 - RNA, 64 nt, hsa; identical to SEQ ID NO: 250540

SEQ ID NO: 289650 - RNA, 64 nt, hsa; identical to SEQ ID NO: 250541

SEQ ID NO: 289651 - RNA, 64 nt, hsa; identical to SEQ ID NO: 250542

SEQ ID NO: 289652 - RNA, 64 nt, hsa; identical to SEQ ID NO: 250543

SEQ ID NO: 289653 - RNA, 64 nt, hsa; identical to SEQ ID NO: 250544

SEQ ID NO: 289654 - RNA, 64 nt, hsa; identical to SEQ ID NO: 250545

SEQ ID NO: 289655 - RNA, 64 nt, hsa; identical to SEQ ID NO: 250546

SEQ ID NO: 289656 - RNA, 64 nt, hsa; identical to SEQ ID NO: 250547

SEQ ID NO: 289657 - RNA, 64 nt, hsa; identical to SEQ ID NO: 250548

SEQ ID NO: 289658 - RNA, 64 nt, hsa; identical to SEQ ID NO: 250549

SEQ ID NO: 289659 - RNA, 64 nt, hsa; identical to SEQ ID NO: 250550

SEQ ID NO: 289660 - RNA, 64 nt, hsa; identical to SEQ ID NO: 250551

SEQ ID NO: 289661 - RNA, 64 nt, hsa; identical to SEQ ID NO: 250552

SEQ ID NO: 289662 - RNA, 64 nt, hsa; identical to SEQ ID NO: 250553

SEQ ID NO: 289663 - RNA, 64 nt, hsa; identical to SEQ ID NO: 250554

SEQ ID NO: 289664 - RNA, 64 nt, hsa; identical to SEQ ID NO: 250555

SEQ ID NO: 289665 - RNA, 64 nt, hsa; identical to SEQ ID NO: 250556

SEQ ID NO: 289666 - RNA, 64 nt, hsa; identical to SEQ ID NO: 250557

SEQ ID NO: 289667 - RNA, 64 nt, hsa; identical to SEQ ID NO: 250558

SEQ ID NO: 289668 - RNA, 64 nt, hsa; identical to SEQ ID NO: 250559

SEQ ID NO: 289669 - RNA, 64 nt, hsa; identical to SEQ ID NO: 250560

SEQ ID NO: 289670 - RNA, 64 nt, hsa; identical to SEQ ID NO: 250561

SEQ ID NO: 289671 - RNA, 64 nt, hsa; identical to SEQ ID NO: 250562

SEQ ID NO: 289672 - RNA, 64 nt, hsa; identical to SEQ ID NO: 250563

SEQ ID NO: 289673 - RNA, 64 nt, hsa; identical to SEQ ID NO: 250564

SEQ ID NO: 289674 - RNA, 64 nt, hsa; identical to SEQ ID NO: 250565

SEQ ID NO: 289675 - RNA, 64 nt, hsa; identical to SEQ ID NO: 250566

SEQ ID NO: 289676 - RNA, 64 nt, hsa; identical to SEQ ID NO: 250567

SEQ ID NO: 289677 - RNA, 64 nt, hsa; identical to SEQ ID NO: 250568

SEQ ID NO: 289678 - RNA, 64 nt, hsa; identical to SEQ ID NO: 250569

SEQ ID NO: 289679 - RNA, 64 nt, hsa; identical to SEQ ID NO: 250570

SEQ ID NO: 289680 - RNA, 64 nt, hsa; identical to SEQ ID NO: 250571

SEQ ID NO: 289681 - RNA, 64 nt, hsa; identical to SEQ ID NO: 250572

SEQ ID NO: 289682 - RNA, 64 nt, hsa; identical to SEQ ID NO: 250573

SEQ ID NO: 289683 - RNA, 64 nt, hsa; identical to SEQ ID NO: 250574

SEQ ID NO: 289684 - RNA, 64 nt, hsa; identical to SEQ ID NO: 250575

SEQ ID NO: 289685 - RNA, 64 nt, hsa; identical to SEQ ID NO: 250576

SEQ ID NO: 289686 - RNA, 64 nt, hsa; identical to SEQ ID NO: 250577

SEQ ID NO: 289687 - RNA, 64 nt, hsa; identical to SEQ ID NO: 250578

SEQ ID NO: 289688 - RNA, 64 nt, hsa; identical to SEQ ID NO: 250579

SEQ ID NO: 289689 - RNA, 64 nt, hsa; identical to SEQ ID NO: 250580

SEQ ID NO: 289690 - RNA, 62 nt, hsa; identical to SEQ ID NO: 250581

SEQ ID NO: 289691 - RNA, 64 nt, hsa; identical to SEQ ID NO: 250582

SEQ ID NO: 289692 - RNA, 64 nt, hsa; identical to SEQ ID NO: 250583

SEQ ID NO: 289693 - RNA, 64 nt, hsa; identical to SEQ ID NO: 250584

SEQ ID NO: 289694 - RNA, 64 nt, hsa; identical to SEQ ID NO: 250585

SEQ ID NO: 289695 - RNA, 64 nt, hsa; identical to SEQ ID NO: 250586

SEQ ID NO: 289696 - RNA, 64 nt, hsa; identical to SEQ ID NO: 250587

SEQ ID NO: 289697 - RNA, 64 nt, hsa; identical to SEQ ID NO: 120044

SEQ ID NO: 289698 - RNA, 64 nt, hsa; identical to SEQ ID NO: 120045

SEQ ID NO: 289699 - RNA, 64 nt, hsa; identical to SEQ ID NO: 120046

SEQ ID NO: 289700 - RNA, 64 nt, hsa; identical to SEQ ID NO: 120047

SEQ ID NO: 289701 - RNA, 64 nt, hsa; identical to SEQ ID NO: 120048

SEQ ID NO: 289702 - RNA, 64 nt, hsa; identical to SEQ ID NO: 120049

SEQ ID NO: 289703 - RNA, 64 nt, hsa; identical to SEQ ID NO: 120050

SEQ ID NO: 289704 - RNA, 64 nt, hsa; identical to SEQ ID NO: 120051

SEQ ID NO: 289705 - RNA, 64 nt, hsa; identical to SEQ ID NO: 120052

SEQ ID NO: 289706 - RNA, 64 nt, hsa; identical to SEQ ID NO: 120053

SEQ ID NO: 289707 - RNA, 64 nt, hsa; identical to SEQ ID NO: 120054

SEQ ID NO: 289708 - RNA, 64 nt, hsa; identical to SEQ ID NO: 120055

SEQ ID NO: 289709 - RNA, 64 nt, hsa; identical to SEQ ID NO: 120056

SEQ ID NO: 289710 - RNA, 64 nt, hsa; identical to SEQ ID NO: 120057

SEQ ID NO: 289711 - RNA, 64 nt, hsa; identical to SEQ ID NO: 120058

SEQ ID NO: 289712 - RNA, 64 nt, hsa; identical to SEQ ID NO: 120059

SEQ ID NO: 289713 - RNA, 64 nt, hsa; identical to SEQ ID NO: 120060

SEQ ID NO: 289714 - RNA, 64 nt, hsa; identical to SEQ ID NO: 120061

SEQ ID NO: 289715 - RNA, 64 nt, hsa; identical to SEQ ID NO: 120062

SEQ ID NO: 289716 - RNA, 64 nt, hsa; identical to SEQ ID NO: 120063

SEQ ID NO: 289717 - RNA, 64 nt, hsa; identical to SEQ ID NO: 120064

SEQ ID NO: 289718 - RNA, 64 nt, hsa; identical to SEQ ID NO: 120065

SEQ ID NO: 289719 - RNA, 64 nt, hsa; identical to SEQ ID NO: 120066

SEQ ID NO: 289720 - RNA, 54 nt, hsa; identical to SEQ ID NO: 120067

SEQ ID NO: 289721 - RNA, 64 nt, hsa; identical to SEQ ID NO: 120068

SEQ ID NO: 289722 - RNA, 64 nt, hsa; identical to SEQ ID NO: 120069

SEQ ID NO: 289723 - RNA, 64 nt, hsa; identical to SEQ ID NO: 120070

SEQ ID NO: 289724 - RNA, 64 nt, hsa; identical to SEQ ID NO: 120071

SEQ ID NO: 289725 - RNA, 64 nt, hsa
agcuuaaaaguuuaguaaaaaucgucugggcacaguggcucacgccuguaaucccagcacuuug

SEQ ID NO: 289726 - RNA, 64 nt, hsa
aucucaaagagaaaaaaaaaaaagaccgggugugguggcucacaccuguaaucccagcacuuug

SEQ ID NO: 289727 - RNA, 64 nt, hsa
uaugauuaagauaaugccgggcaggccgggcacaguggcucacgccuguaauccaagcacuugg

SEQ ID NO: 289728 - RNA, 64 nt, hsa
uuaaccugccucuugaaagauucaaccgggugugguggcucacgccuguaaucccagcacauug

SEQ ID NO: 289729 - RNA, 64 nt, hsa
ccucuccagcuacccuuuuaccucaucagaagcaguggcucagcuaagugcucccccuagcucc

SEQ ID NO: 289730 - RNA, 64 nt, hsa
cugggccuuucuuucaucccaaaugacaaggaauguggcucagagaaggguuuuucuuuuuuga

SEQ ID NO: 289731 - RNA, 64 nt, hsa
caagauguagaaaauagaaaauaggcuaggcacaguggcucacgccuguaaucucaacacuuug

SEQ ID NO: 289732 - RNA, 64 nt, hsa
gugcuguuuaaagucugaagcucggccaggugcgguggcucacgccuguaaucccaaaacuuug

SEQ ID NO: 289733 - RNA, 64 nt, hsa
ugcuuguguaagaaacugaaauaagcugcgugugguggcucacaccuguaaucccaacacuuug

SEQ ID NO: 289734 - RNA, 64 nt, hsa
aucucaaaggaaaaaggaaacuaggccaggcgugguggcucacgccuguaaucccaacacuuug

SEQ ID NO: 289735 - RNA, 64 nt, hsa
uuccauuuuaaagaguguaggcaggccaggugcaguggcucaugccuguaaucccagcauuuug

SEQ ID NO: 289736 - RNA, 64 nt, hsa
gcaaacacaagaacuauacacauggccaggcgcgguggcucacacccguaaucccagcacuuug

SEQ ID NO: 289737 - RNA, 64 nt, hsa
uucaaaaguaauuggcagugauuggccaggcgcaguggcucacgccuguaaucccagcacuggg

SEQ ID NO: 289738 - RNA, 64 nt, hsa
ccgucuuaaaaaagcccauggcaggcugggcgcgguggcucacgccuguaaucccagcacuuug

SEQ ID NO: 289739 - RNA, 64 nt, hsa
gccagaaccugucgcuggaaaccagggcaaagcaguggcucagggcuccuugggugcaugugua

SEQ ID NO: 289740 - RNA, 64 nt, hsa
agccuuggcuggaaaacugugguagagccgggcuguggcucagguaauuuuugccauuuggcca

SEQ ID NO: 289741 - RNA, 64 nt, hsa
ccuguggucccaguuacuugggaggcugacguggguggcucacuugagcacaggaguuugaggc

SEQ ID NO: 289742 - RNA, 64 nt, hsa
acaggcauuuaaaaaauuaaaaugaccaggcacaguggcucacgccuguaaucucggcacuuug

SEQ ID NO: 289743 - RNA, 64 nt, hsa
caucucaaaaaacauuauuuuuaaaauuagccugguggcucacgccuguaaucccagcacuuug

SEQ ID NO: 289744 - RNA, 64 nt, hsa
aacuggcaagauuaacaaaauuaggccgggcaugguggcucacgccuguaaucccagcacuuug

SEQ ID NO: 289745 - RNA, 64 nt, hsa
uuuguacagaagaggauucaaaacgccacguguaguggcucaugccuguaaucccaacacuuug

SEQ ID NO: 289746 - RNA, 64 nt, hsa
acuaauuagaaaauauaguuugaggccgggcacgguggcucacgccuguaaucccaguacuugg

SEQ ID NO: 289747 - RNA, 64 nt, hsa
uguuuuaagauuuuuggguccugagccagccgugguggcucacaccuguaaucccagcacuuug

SEQ ID NO: 289748 - RNA, 64 nt, hsa
caucaagaauagucaaguuuuuuggccgggcaugguggcucaugccuguaaucccagcacuugg

SEQ ID NO: 289749 - RNA, 64 nt, hsa
uuuuuacuuauaauaccaauuuaggcugggcgcaguggcucacgccuguaaucccagcacuuug

SEQ ID NO: 289750 - RNA, 64 nt, hsa
aaaaaaaaacaaaaaccaguuuaggcuggguaugguggcucaccagcacuuugggaggcugagg

SEQ ID NO: 289751 - RNA, 64 nt, hsa
cagaauuuuggaagagcaaauggggcugagugcaguggcucaugccuguaaucccagcacuuag

SEQ ID NO: 289752 - RNA, 64 nt, hsa
agccuauuaaaaaaugcuguccaggccaggcacaguggcucacaccuguaaucccaggacuucg

SEQ ID NO: 289753 - RNA, 64 nt, hsa
ugguuaacuauuaaauguugaccuagccagcgcaguggcucaugccuguaaucccagcacuuug

SEQ ID NO: 289754 - RNA, 64 nt, hsa
uuaagaaacuaugacuuguaguaagccgggcgcgguggcucacgccuguaaucccaacacuuug

SEQ ID NO: 289755 - RNA, 64 nt, hsa
ucuucauaaaaaauguuaacgugggcugggcaugguggcucaugccuguaaucccagcacucug

SEQ ID NO: 289756 - RNA, 64 nt, hsa
aucauuucaagauaggcuuagcaggaugggcgcaguggcucacgccacuaaucccaacauuuua

SEQ ID NO: 289757 - RNA, 64 nt, hsa
ucucuauuuuauaaauuaaaaaaggcugggugugguggcucacacccauaaucccaacacuuug

SEQ ID NO: 289758 - RNA, 64 nt, hsa
guggacugggccuugucacuggaggucguaggcaguggcucaucacccugguagggcugauagg

SEQ ID NO: 289759 - RNA, 64 nt, hsa
gacgaggccuccccagcccugcccggugcaggagguggcucaguuauugaaccuuuugggaagc

SEQ ID NO: 289760 - RNA, 64 nt, hsa
uaguacucauuuaaaaacuagagggcuaggcuuaguggcucacgccuguaaucucagcacuuug

SEQ ID NO: 289761 - RNA, 64 nt, hsa
agucccuuauauaaaaugguguaggccgggcaugguggcucacgccuguaaucccaguacuuug

SEQ ID NO: 289762 - RNA, 64 nt, hsa
gccucaaaaaaugcuaaaacuuuggcugggcaugguggcucacgccuguaaucccagcacuuug

SEQ ID NO: 289763 - RNA, 64 nt, hsa
uuccauaagaagacauuuugacuggcugggugcgguggcucacgcuuguaaucccagcacuuug

SEQ ID NO: 289764 - RNA, 64 nt, hsa
ugcugagucaagauuuauauuaaggcuggaagcuguggcucacaccuguaaucccagcauuuug

SEQ ID NO: 289765 - RNA, 64 nt, hsa
agacagguguuaaugcaucuaugggccaggugcaguggcucacuccuguaauccgagcaauuug

SEQ ID NO: 289766 - RNA, 64 nt, hsa
aaagcuaaauaaaaauguagacauggcuggcgcaguggcucaugcuuguaauccuagcacuuuu

SEQ ID NO: 289767 - RNA, 64 nt, hsa
uccacaaaaaaaaugaaaaauaaaccugggugcgguggcucacaccuguaaucccagcacuuug

SEQ ID NO: 289768 - RNA, 64 nt, hsa
uagcauauagaagaaaguuaauaggccgggcuugguggcucaugccuguaaucccagcacuuug

SEQ ID NO: 289769 - RNA, 64 nt, hsa
agcaacaauaaaaaguagacaugggcugggugcaguggcucacuccuguagucccaggacuuug

SEQ ID NO: 289770 - RNA, 64 nt, hsa
caccaguaauaaagaaacauaagggcugggggugguggcucaugccuguaaucccagcacuuug

SEQ ID NO: 289771 - RNA, 64 nt, hsa
ggacauagaaaauguuuugaauaggccaggcgcaguggcucacaccuguaaucccagcacguug

SEQ ID NO: 289772 - RNA, 64 nt, hsa
aagccauguaaaaaguaaauaaugucugggcacaguggcucacgccuguaauccuagcacuuug

SEQ ID NO: 289773 - RNA, 64 nt, hsa
agaaagucccuggucaggucucagguagugcgguguggcucagcuggguuuuuaauuagcgcau

SEQ ID NO: 289774 - RNA, 64 nt, hsa
gacaauuaauuccuggucuaguuuccugggccuuguggcucagcugccacuaaagagcuuuuug

SEQ ID NO: 289775 - RNA, 64 nt, hsa
accugcaggaugggccgcgccgccguggcccgcuguggcucaccacggcccaggguggccuugg

SEQ ID NO: 289776 - RNA, 64 nt, hsa
aauaagcuuaaacaaauaacuuuggccgggcacgguggcucacaccuauaaucccagcacuaug

SEQ ID NO: 289777 - RNA, 64 nt, hsa
uuucaggaaucaaaagauaaaggggccgggugugguggcucacaccuguaaucccagcacuuug

SEQ ID NO: 289778 - RNA, 64 nt, hsa
uguaaauuaguaguugaaauucuaggccggugcgguggcucaugccuguaaucccagcacugua

SEQ ID NO: 289779 - RNA, 64 nt, hsa
agaaauuagaaaaucaagcuuugggccaggugcgguggcucaugccuguaaucccagcacuaug

SEQ ID NO: 289780 - RNA, 64 nt, hsa
caguuuuuaaaaaauugcuuguaggcugagcgcgguggcucacgccuguaaucccagcacuuug

SEQ ID NO: 289781 - RNA, 64 nt, hsa
cucuuuaaagagaauaaauagagggccaggugugguggcucacgccugugaucccagcacuuug

SEQ ID NO: 289782 - RNA, 64 nt, hsa
uuaaaagaugaaagagggaaauaggccauggacgguggcucacgccuguaaucccagcacuuua

SEQ ID NO: 289783 - RNA, 64 nt, hsa
ugugacgagacugcacaagacaaagcucaggcaaguggcucaguaguuggccagcccagcaggg

SEQ ID NO: 289784 - RNA, 64 nt, hsa
uuuuaaggauaaaaacuaacauuggccaggcacgguggcucacgccuguaaucccaacacuuua

SEQ ID NO: 289785 - RNA, 64 nt, hsa
gucagguauuuaaaauguuacauaugccggcgcaguggcucauguguguaaucccagcacucug

SEQ ID NO: 289786 - RNA, 64 nt, hsa
aaauacaaaaaauacaaaaaauuagccgggcgcgguggcucacaccuguaaucccagcacuuug

SEQ ID NO: 289787 - RNA, 64 nt, hsa
acccuuagaaggauggcucugguggccgggcgcgguggcucaaaccuguaaucccagcacuuug

SEQ ID NO: 289788 - RNA, 64 nt, hsa
acuguuuuaaaauuacggugauuggccaggugcaguggcucacaccuguaaucccagcacuuug

SEQ ID NO: 289789 - RNA, 64 nt, hsa
aaccaucaaaguuacuaaaacauggccaggcgcaguggcucaugccuguaaucccagcacuuug

SEQ ID NO: 289790 - RNA, 64 nt, hsa
ugagggacucccuccucuucagagaagcccuccuguggcucaggggcagcugcagggccagaug

SEQ ID NO: 289791 - RNA, 64 nt, hsa
cacaaauuaaaacuggguuuccaggccuggugugguggcucacgccuguagccccagcuauugc

SEQ ID NO: 289792 - RNA, 64 nt, hsa
aggcuuuuaaaaacuuucaucuaggccacgugcgguggcucaugccuguaaucccggcacuuug

SEQ ID NO: 289793 - RNA, 64 nt, hsa
uuugcccucuagaaagcaacugaggccaggugcgguggcucacgccuguaaucccagcacuuug

SEQ ID NO: 289794 - RNA, 64 nt, hsa
auugcaagagggagcucaaucuuggccgggcgccguggcucacgccuguaaucgcagcacuuug

SEQ ID NO: 289795 - RNA, 64 nt, hsa
cugucucaucaaaaacugaaguuagcugggugugguggcucaugccuguaaucccagcacuuug

SEQ ID NO: 289796 - RNA, 64 nt, hsa
cugaaguuagaaacaagguuaauagccaggcaugguggcucaugccuguaaucccagcacuuug

SEQ ID NO: 289797 - RNA, 64 nt, hsa
gagacaaaaaauuugaagugccuggcugggcgugguggcucacgccuguaaucccagcacuuug

SEQ ID NO: 289798 - RNA, 64 nt, hsa
aucucaaaaaaaaaagaguucuagcccaggagcgguggcucacacuuguaaucccagcacuuug

SEQ ID NO: 289799 - RNA, 64 nt, hsa
cuucauucucuauaagaguucuaggcggggcgugguggcucacacuuguaaucccagcacuuug

SEQ ID NO: 289800 - RNA, 64 nt, hsa
ccugucucaaaaaaaugcagacuggccaggcacaguggcucacaccuguaauccgacuguaagc

SEQ ID NO: 289801 - RNA, 64 nt, hsa
uugggcugcuuguuaaaaaugcaggccaggugcgguggcucacaccuguaaucccagcgcuuug

SEQ ID NO: 289802 - RNA, 64 nt, hsa
ugcagaucauuuaagaaguaacaggccgggcgcgguggcucacgccuguaaucccagcacuuug

SEQ ID NO: 289803 - RNA, 64 nt, hsa
gggaauuaaaaaguaaaauaauaggccaggcaugguggcucaugccuauaagcacccugggagg

SEQ ID NO: 289804 - RNA, 64 nt, hsa
uauaaaaguaaaggagaauaacuggccgggcacgguggcucaugccuauaaaauuccagcacuu

SEQ ID NO: 289805 - RNA, 64 nt, hsa
cucaagcuuaguuggcagcacucuccacacuucuguggcucagugauuacugcuauuacuauau

SEQ ID NO: 289806 - RNA, 64 nt, hsa
ugaagucaacuucuaucaacuucaggccaggcccguggcucaugccuguauaaucccagcacuu

SEQ ID NO: 289807 - RNA, 64 nt, hsa
gaacucugaaaauguacauguauggcuggacgcgguggcucacgccuguaaucccagcacuuug

SEQ ID NO: 289808 - RNA, 64 nt, hsa
cccaagaugaagaagccccuucaggccagucgugguggcucaugccuguaaucccagcacuuug

SEQ ID NO: 289809 - RNA, 64 nt, hsa
uuaauaucacuguauuaaaagucugccgggcacaguggcucacgccuguaaucccaacacuuug

SEQ ID NO: 289810 - RNA, 64 nt, hsa
cuccacuaaaaguacaaaaaauuagcugggcgugguggcucaugccuguaaucccagcuacuca

SEQ ID NO: 289811 - RNA, 64 nt, hsa
ucgguaagauguaaagaacucuuggccaggugugguggcucaugccuauaaucccagcacuuug

SEQ ID NO: 289812 - RNA, 64 nt, hsa
aaaguauaagcuaauacccaucaggcugggugugguggcucacgccuguaauccuagcacuuug

SEQ ID NO: 289813 - RNA, 64 nt, hsa
caggagugaagacugugaugugugguccccauauguggcucagcaaagacucgagagaucaucc

SEQ ID NO: 289814 - RNA, 64 nt, hsa
ggaagaauaaaguuaaccaagcaggccaggcacgguggcucacgccuauaaucccagcacuuag

SEQ ID NO: 289815 - RNA, 64 nt, hsa
acgggucucacucugucacccaggcuggagugcaguggcucaaugcaaccucugccccccaagu

SEQ ID NO: 289816 - RNA, 64 nt, hsa
aguuugcauuaauaauccuuccaggccgggcacaguggcucacgccuguaaucccagcacuuug

SEQ ID NO: 289817 - RNA, 64 nt, hsa
ggucgggaguuugaaaccagucucaccaggcgcaguggcucacgccuguaauuccagcauguug

SEQ ID NO: 289818 - RNA, 64 nt, hsa
guccagagaauaggggaagacugggccagacgcaguggcucaugccuguaaucccagcacucug

SEQ ID NO: 289819 - RNA, 64 nt, hsa
ggagcuuucaaaaagcacaaauaggcuggacaugguggcucaugccuguaaucccaguacuuug

SEQ ID NO: 289820 - RNA, 64 nt, hsa
accugacaguaagaaaauacucuggcuggucucaguggcucaugucuguaauucuagcauguua

SEQ ID NO: 289821 - RNA, 64 nt, hsa
agacccuguuuaaaaaagaaaaaggccaggcacgguggcucaugccuguaaucccagcuacgca

SEQ ID NO: 289822 - RNA, 64 nt, hsa
acuuaaaaauguucaaauaaccugguugggugugguggcucacacuuguaaucccagcacuuug

SEQ ID NO: 289823 - RNA, 64 nt, hsa
aggaguauguaugagguccauccuggcaugagcaguggcucacccaccggccuugaagagguga

SEQ ID NO: 289824 - RNA, 64 nt, hsa
aagagacccgggucuggcaccgucgggauggcaaguggcucaauguccacuaucacugcucagg

SEQ ID NO: 289825 - RNA, 64 nt, hsa
gaauuuagauauuccaauuugcaucagucuuucuguggcucaaauaaugaugauuauggaauga

SEQ ID NO: 289826 - RNA, 64 nt, hsa
gguguuccuuauaagagaagauagggcgggcaugguggcucacgccuguaaucccagcacugug

SEQ ID NO: 289827 - RNA, 64 nt, hsa
uaagaaauuuguguuauuugauaggccgggcaugguggcucaugccuguaaucccagcacuuug

SEQ ID NO: 289828 - RNA, 64 nt, hsa
accauuaagauuauccaaagucaggcugggcgcaguggcucacgccuguaaucccagcacuuug

SEQ ID NO: 289829 - RNA, 64 nt, hsa
accguuaacaaaaaaguaagucuggccgggcaugguggcucaagccuguaaucccagcacuuug

SEQ ID NO: 289830 - RNA, 64 nt, hsa
uugauuugcgucaacauuauaaaagagcacuucuguggcucauuuaaaagaaaaaaaagguuaa

SEQ ID NO: 289831 - RNA, 64 nt, hsa
guuuaauagagaaaugcuguuuaggcugggcuugguggcucacaucuguaauaccagcgcuuug

SEQ ID NO: 289832 - RNA, 64 nt, hsa
uuuuuuacaaaaagucacuuuugggcugggcgcaguggcucacgccuguaaucccagcacuuug

SEQ ID NO: 289833 - RNA, 64 nt, hsa
uuaucucauuuuacacaaagggaagucgggcaugguggcucaugccuguaaucucagcacuuug

SEQ ID NO: 289834 - RNA, 64 nt, hsa
aaaaaaaaaaaaaaaaacuuuagaacugggugcaguggcucaugccuguaaucccagccagcac

SEQ ID NO: 289835 - RNA, 64 nt, hsa
guggcuucaagaguccuuacugaagccaggcaccguggcucacgucuguaaucccagcgcuuug

SEQ ID NO: 289836 - RNA, 64 nt, hsa
ccauuuaaaagucugccuauccuggccaggugugguggcucacaccuguaaucccagcacuuug

SEQ ID NO: 289837 - RNA, 64 nt, hsa
aguccagugaaaugauauauucuggcugggcacaguggcucacaccuguaauccuagcacuuug

SEQ ID NO: 289838 - RNA, 64 nt, hsa
cugaguucaagaaaaguacuucaggcugggcacaguggcucaugccugaaauccuagcacuuug

SEQ ID NO: 289839 - RNA, 64 nt, hsa
ugaaaugguauuuagaaagcagcagucaggcacgguggcucaugccuguaaucccagcacuuug

SEQ ID NO: 289840 - RNA, 64 nt, hsa
gcaaguaacuaaagguugguguuggccaggcaugguggcucaugccuguaaucccagcauuuug

SEQ ID NO: 289841 - RNA, 64 nt, hsa
cuacauacaagacuucaccauaaggccaggagcaguggcucacaccuuguaaucccagcacuuu

SEQ ID NO: 289842 - RNA, 64 nt, hsa
ggacauuuaagcgaaguaaaagaggccgggugcgguggcucacgccuguaaucccaacacuuua

SEQ ID NO: 289843 - RNA, 64 nt, hsa
acuuugucaaaguuguauggcugaggcccacacgguggcucacuucuguaaucccaucacuuug

SEQ ID NO: 289844 - RNA, 64 nt, hsa
uagucuaucaaacaagaaaugcuggcuuggcccgguggcucaugccuguaaucccagcacugug

SEQ ID NO: 289845 - RNA, 64 nt, hsa
agagguuuuaaaaucaaauuugaggccaggugcaguggcucaugggcggaggagggcagauuac

SEQ ID NO: 289846 - RNA, 64 nt, hsa
uuuuuguauuacaaguugacaguugcuggguguaguggcucaugccuguaauccuagcaacucg

SEQ ID NO: 289847 - RNA, 64 nt, hsa
ucuucuaugaagaaaaaaaugcaggcugggcgcgguggcucacgccuguaauccuagcacuuug

SEQ ID NO: 289848 - RNA, 64 nt, hsa
cucuacuaaaaaauacaaaaauuagccaggugugguggcucacgcuuauguagucccaguuacu

SEQ ID NO: 289849 - RNA, 64 nt, hsa
uucaucaaagagaagaccauguuggccgggcgcgguggcucacgccugcagucccagcacuuug

SEQ ID NO: 289850 - RNA, 64 nt, hsa
ccuguaauccuagcacuuugggaggcugaggcagguggcucacuugaggucaggaauucaagac

SEQ ID NO: 289851 - RNA, 64 nt, hsa
caguguaugaaagucauguuacaggccgagugcgguggcucacaccuguaauccuagcacuuug

SEQ ID NO: 289852 - RNA, 64 nt, hsa
aaaugucaagaauuaaucuaggaggccgggccugguggcucacaccuguaaucccagcucuuug

SEQ ID NO: 289853 - RNA, 64 nt, hsa
uggauccucaaaacucagaacguggccgggcgugguggcucacgccuguaaucccagcacuuug

SEQ ID NO: 289854 - RNA, 64 nt, hsa
cuccacaaaauuuaaaaauuagcggccgggcgcaguggcucacgccuguaaucccagcacuuug

SEQ ID NO: 289855 - RNA, 64 nt, hsa
cugcauaaagagggaguuuugggggcugggcgccguggcucacucuuguaaucccaaaacuuua

SEQ ID NO: 289856 - RNA, 64 nt, hsa
aaaauaaaaauagaagaagaaaaggccgggcaugguggcucaugccuguaaucccaacacuuug

SEQ ID NO: 289857 - RNA, 64 nt, hsa
gugguccucauaaaaaucuugagggccgggcaugguggcucacgccuguaaucucagcacuuug

SEQ ID NO: 289858 - RNA, 64 nt, hsa
aucaaucaaucaaucacuguccuggccaguugcaguggcucacgccuauaaucccaacacuucg

SEQ ID NO: 289859 - RNA, 64 nt, hsa
cuugccauaaaaaggcugaaggcagccgggcgcaguggcucacgccuguaaucccagcacuuug

SEQ ID NO: 289860 - RNA, 64 nt, hsa
agcccaguuagaaaauaagucugggccggcggcgguggcucacaccugcauaggcagugcuuug

SEQ ID NO: 289861 - RNA, 64 nt, hsa
cucuuguuaagaagguucugccaggccgggcgcgguggcucacaccuguaaucccagcacuuug

SEQ ID NO: 289862 - RNA, 64 nt, hsa
uugagccuguauuaaaggaaucaggccaggcacaguggcucacgccuguaaucucagcacauug

SEQ ID NO: 289863 - RNA, 64 nt, hsa
gacuucuuuuacaaguaacucuaggcugggugugguggcucacgccuauaaucccagcacuuug

SEQ ID NO: 289864 - RNA, 64 nt, hsa
ugaucuuaauauucaugaccacuggccaggcgagguggcucacaccuguaaucccagcacuuug

SEQ ID NO: 289865 - RNA, 64 nt, hsa
ccaucucaaaaaaaaaaauaagaggccgggugcgguggcucaagccuguaaucccagcacuuug

SEQ ID NO: 289866 - RNA, 64 nt, hsa
acacaaguuaaagagguuuugcuggccagguaugguggcucacgccuguaaucccagcacuuug

SEQ ID NO: 289867 - RNA, 64 nt, hsa
gagcugagaucacaccaaaaugggguggggcgcaguggcucacgccuguaaucccagcacuuug

SEQ ID NO: 289868 - RNA, 64 nt, hsa
cugcaugucuaaaagaaaauaugggccuggugugguggcucacaccuguaaucccaacacuuug

SEQ ID NO: 289869 - RNA, 64 nt, hsa
gcuuagaaaguccuucacuacauggccaggugcaguggcucacgccuguagucccagguacuug

SEQ ID NO: 289870 - RNA, 64 nt, hsa
ccuagacucacaagcugguccuuggccaggugcaguggcucacgccuguaaucccagcacuuug

SEQ ID NO: 289871 - RNA, 64 nt, hsa
ccaucuuuaaaaaaaaacaagacgggccggcacgguggcucacgccuguaaucccagcacugag

SEQ ID NO: 289872 - RNA, 64 nt, hsa
cuauuuauuaaaaacuuaagaugggccaggugcgguggcucacaccuguaaucccagcauuuug

SEQ ID NO: 289873 - RNA, 64 nt, hsa
uuagggaaagaguauaaauagccagccaggggcgguggcucaugccuguaaucccagcacuuug

SEQ ID NO: 289874 - RNA, 64 nt, hsa
cccuggcccuccugcugcugcugguccaggggguguggcucaguggcuggugguggaccuggag

SEQ ID NO: 289875 - RNA, 64 nt, hsa
ccaacaauaaaagacuuggccuuggcugggcaugguggcucacgccuguaaucccagcacuuug

SEQ ID NO: 289876 - RNA, 64 nt, hsa
cacaaaaaaagacuuggccuuagggccgagugcgguggcucacgccuauaaucccagcacuuug

SEQ ID NO: 289877 - RNA, 64 nt, hsa
auuugaacagauguuuuggcucuggcugggugugguggcucacaccuguaaucccagcacuuug

SEQ ID NO: 289878 - RNA, 64 nt, hsa
aaauguagaagcuauauguauauuuuguuaauuaguggcucauauuuaaaauaguucucugacu

SEQ ID NO: 289879 - RNA, 64 nt, hsa
gguguccucauaagauaaggagaggccaggccugguggcucacgccuguaaucccagcacuuua

SEQ ID NO: 289880 - RNA, 64 nt, hsa
auuuuaaaaagacgaaaagugacggccaggugcaguggcucacgccuauaaucucagcacucug

SEQ ID NO: 289881 - RNA, 64 nt, hsa
aauuaaaaaaagaagacgagagauagugggugugguggcucacaccugcaaucccagcacuuug

SEQ ID NO: 289882 - RNA, 64 nt, hsa
uucucuaaaaugcaauaauaaugggccaggugaaguggcucacaccuguaaucccagcacugug

SEQ ID NO: 289883 - RNA, 64 nt, hsa
ucuaaauaaauaaauaaaaugcgggccaggcacaguggcucacaccuguaaucccagcacuaug

SEQ ID NO: 289884 - RNA, 64 nt, hsa
uuguauagauuuuuaaaacugguggcugggcgugguggcucacgccuguaaucccagcacuuug

SEQ ID NO: 289885 - RNA, 64 nt, hsa
gaaaauaaaaauaaaaauaaacuggccaggugcgguggcucacgcuugcaaucccagugcuuug

SEQ ID NO: 289886 - RNA, 64 nt, hsa
ucaggguucccacuacccccucuuuggggguagaguggcucauggaacucagagaaacauuuau

SEQ ID NO: 289887 - RNA, 64 nt, hsa
uuaaccuuggucacauugagucauuccaggaugaguggcucaaguauuuccucagggaaaauac

SEQ ID NO: 289888 - RNA, 64 nt, hsa
auugcuuagaauaugacaugcugaaccaggcaugguggcucaugcuuguaaaccugaugcuuug

SEQ ID NO: 289889 - RNA, 64 nt, hsa
uagcuuuaagaaguaccugcaagggucaggcgcaguggcucacaccuguaaucccagcacuuug

SEQ ID NO: 289890 - RNA, 64 nt, hsa
ucuacaaaaaaauuaaaaaauuuggccuggugugguggcucaugccugugauccuagcacuuug

SEQ ID NO: 289891 - RNA, 64 nt, hsa
gccgggacuuaaaaagauaaggaggccaggugugguggcucaugccugcaaucccagcacugua

SEQ ID NO: 289892 - RNA, 64 nt, hsa
aaaaaaaagggggggcgggggacgggugggugcaguggcucacaucuguaaccccagcacuuug

SEQ ID NO: 289893 - RNA, 64 nt, hsa
agcuuauaagaucuaacccuuauggccaggugcaguggcucacguauguaaucccagcacuuug

SEQ ID NO: 289894 - RNA, 64 nt, hsa
ucuuuggucaagagucaguuuggggccaggcgugguggcucaugccuguaaucucagcacuuug

SEQ ID NO: 289895 - RNA, 64 nt, hsa
aacguuuaaaaacaaaguuccccggccaggcacaguggcucacaccuguaaucccagcacuuug

SEQ ID NO: 289896 - RNA, 64 nt, hsa
ccgucucaaaaagaaaaaguuuggaucaggcaggguggcucacaccuguaaucccugcacuuug

SEQ ID NO: 289897 - RNA, 64 nt, hsa
cuacguuaaaaaaaaaaaguuugggccaggcacaguggcucaugccuguaaucccagcacuuug

SEQ ID NO: 289898 - RNA, 64 nt, hsa
gaugauguugaaagugaugcacaggacaggugugguggcucacaccuguaaucccagcacuuug

SEQ ID NO: 289899 - RNA, 64 nt, hsa
aagaaacaucaaauuugcgaugagaccagaugcuguggcucaggccuguaaucccauaauuuuc

SEQ ID NO: 289900 - RNA, 64 nt, hsa
aagaaugcgagaaauauaaaucaggccaggcacgguggcucacaccuguaaucccaguacuuug

SEQ ID NO: 289901 - RNA, 64 nt, hsa
cuuguuuugaaauugaagagagaggccaggcgcgguggcucacaccuguaaucccagcacuuug

SEQ ID NO: 289902 - RNA, 64 nt, hsa
gguaugggaagaaauucucuacuggccgggcacaguggcucacgccuguaaugccagcacuuug

SEQ ID NO: 289903 - RNA, 64 nt, hsa
guggauagaaaccuuacaaaggacgccgggcgugguggcucacgccuguaaucccagcacuuug

SEQ ID NO: 289904 - RNA, 64 nt, hsa
cucuauuuaaaaaaagaaguuauggccgggcgcgguggcucaugccuguaauaccagcacuuug

SEQ ID NO: 289905 - RNA, 64 nt, hsa
ccuugugaauauaaaguuacauuggcugggugugguggcucaugccuauaaucccaguacuuua

SEQ ID NO: 289906 - RNA, 64 nt, hsa
gugugcagggggaugggccagggccaggcuaaggguggcucaguuccaucaucuggaggucaga

SEQ ID NO: 289907 - RNA, 64 nt, hsa
gauggggcaggcugggguguggguguggccugggguggcucagggcuggaacugcugccugauu

SEQ ID NO: 289908 - RNA, 64 nt, hsa
uguucuuagaaaagccccagcauggccgggcaugguggcucaugccuauuaucccagcacuuug

SEQ ID NO: 289909 - RNA, 64 nt, hsa
uccgcauaccccccuguccagcagggcacuguggguggcucacccuagauuguggcccagaucu

SEQ ID NO: 289910 - RNA, 64 nt, hsa
aguagcugcauuacaaaaaagaagccugggcacuguggcucacuccuguaaucucagaacuuug

SEQ ID NO: 289911 - RNA, 64 nt, hsa
cccuccaauuaaugcagcccugaggugucuggcuguggcucaagauuuggccccaugcagaccc

SEQ ID NO: 289912 - RNA, 64 nt, hsa
agagagaagagucuauuaugagcugguuacuacuguggcucaauccuauuggggaccuuuuaaa

SEQ ID NO: 289913 - RNA, 64 nt, hsa
uuggauaaggaugcacuggaagaacugccagaauguggcucaugcucugaguacuguuccugua

SEQ ID NO: 289914 - RNA, 64 nt, hsa
acuauuuaaaaaugaaauuacaggcccgggcacgguggcucacaccuguaaucccagcacuuug

SEQ ID NO: 289915 - RNA, 64 nt, hsa
uuacuuuuaaaaauauaaguuagggcuaggcacaguggcucaugccuauaaucucagcacuuuu

SEQ ID NO: 289916 - RNA, 64 nt, hsa
agagcaacaacaaaaaauguuuaagccgggcgcgguggcucacaucuguaaucccagcacuuug

SEQ ID NO: 289917 - RNA, 64 nt, hsa
ucucuacaaaaaauacaaaaauuagccaugcaugguggcucaugccuguagucccagcuacuug

SEQ ID NO: 289918 - RNA, 64 nt, hsa
ggugggccugaggugcccagcucagggcagccagguggcucaugggcuguagugagccagcucc

SEQ ID NO: 289919 - RNA, 64 nt, hsa
cuuacucagcccuuuauggcccauggggaacuccguggcucagggagagcugaacuccaggggu

SEQ ID NO: 289920 - RNA, 64 nt, hsa
accauuauaaauucuuaguucagggcugggcgcgguggcucaugccuguaacccuagcacuuug

SEQ ID NO: 289921 - RNA, 64 nt, hsa
uuuuuuuaaaaccuuaaaugucuggccgggugugguggcucaucccuauaauccuacacuuugg

SEQ ID NO: 289922 - RNA, 64 nt, hsa
ggcuaauucccccuucucuggugccauaaauuauguggcucauaguaggugcaccauccaagga

SEQ ID NO: 289923 - RNA, 64 nt, hsa
agugagacuccgucucaaaacaaaacaaaaguggguggcucacggguccggagguuaugucuuc

SEQ ID NO: 289924 - RNA, 64 nt, hsa
guugguccuuaaaacugggcgguggccgggcgugguggcucacgcugaggucaggaguucgaga

SEQ ID NO: 289925 - RNA, 64 nt, hsa; identical to SEQ ID NO: 59936

SEQ ID NO: 289926 - RNA, 64 nt, hsa; identical to SEQ ID NO: 59937

SEQ ID NO: 289927 - RNA, 64 nt, hsa; identical to SEQ ID NO: 59938

SEQ ID NO: 289928 - RNA, 64 nt, hsa; identical to SEQ ID NO: 59939

SEQ ID NO: 289929 - RNA, 64 nt, hsa; identical to SEQ ID NO: 59940

SEQ ID NO: 289930 - RNA, 64 nt, hsa; identical to SEQ ID NO: 59941

SEQ ID NO: 289931 - RNA, 64 nt, hsa; identical to SEQ ID NO: 59942

SEQ ID NO: 289932 - RNA, 64 nt, hsa; identical to SEQ ID NO: 59943

SEQ ID NO: 289933 - RNA, 64 nt, hsa; identical to SEQ ID NO: 59944

SEQ ID NO: 289934 - RNA, 64 nt, hsa; identical to SEQ ID NO: 59945

SEQ ID NO: 289935 - RNA, 64 nt, hsa; identical to SEQ ID NO: 59946

SEQ ID NO: 289936 - RNA, 64 nt, hsa; identical to SEQ ID NO: 59947

SEQ ID NO: 289937 - RNA, 64 nt, hsa; identical to SEQ ID NO: 59948

SEQ ID NO: 289938 - RNA, 64 nt, hsa; identical to SEQ ID NO: 59949

SEQ ID NO: 289939 - RNA, 64 nt, hsa; identical to SEQ ID NO: 59950

SEQ ID NO: 289940 - RNA, 64 nt, hsa; identical to SEQ ID NO: 59951

SEQ ID NO: 289941 - RNA, 64 nt, hsa; identical to SEQ ID NO: 59952

SEQ ID NO: 289942 - RNA, 64 nt, hsa; identical to SEQ ID NO: 59953

SEQ ID NO: 289943 - RNA, 64 nt, hsa; identical to SEQ ID NO: 59954

SEQ ID NO: 289944 - RNA, 64 nt, hsa; identical to SEQ ID NO: 59955

SEQ ID NO: 289945 - RNA, 64 nt, hsa; identical to SEQ ID NO: 42317

SEQ ID NO: 289946 - RNA, 64 nt, hsa; identical to SEQ ID NO: 42318

SEQ ID NO: 289947 - RNA, 64 nt, hsa; identical to SEQ ID NO: 42319

SEQ ID NO: 289948 - RNA, 64 nt, hsa; identical to SEQ ID NO: 42320

SEQ ID NO: 289949 - RNA, 64 nt, hsa; identical to SEQ ID NO: 42321

SEQ ID NO: 289950 - RNA, 64 nt, hsa; identical to SEQ ID NO: 42322

SEQ ID NO: 289951 - RNA, 64 nt, hsa; identical to SEQ ID NO: 42323

SEQ ID NO: 289952 - RNA, 64 nt, hsa; identical to SEQ ID NO: 42324

SEQ ID NO: 289953 - RNA, 64 nt, hsa; identical to SEQ ID NO: 42325

SEQ ID NO: 289954 - RNA, 64 nt, hsa; identical to SEQ ID NO: 42326

SEQ ID NO: 289955 - RNA, 64 nt, hsa; identical to SEQ ID NO: 42327

SEQ ID NO: 289956 - RNA, 64 nt, hsa; identical to SEQ ID NO: 42328

SEQ ID NO: 289957 - RNA, 64 nt, hsa; identical to SEQ ID NO: 42329

SEQ ID NO: 289958 - RNA, 64 nt, hsa; identical to SEQ ID NO: 42330

SEQ ID NO: 289959 - RNA, 64 nt, hsa; identical to SEQ ID NO: 42331

SEQ ID NO: 289960 - RNA, 64 nt, hsa; identical to SEQ ID NO: 42332

SEQ ID NO: 289961 - RNA, 64 nt, hsa; identical to SEQ ID NO: 79392

SEQ ID NO: 289962 - RNA, 64 nt, hsa; identical to SEQ ID NO: 79393

SEQ ID NO: 289963 - RNA, 64 nt, hsa; identical to SEQ ID NO: 79394

SEQ ID NO: 289964 - RNA, 64 nt, hsa; identical to SEQ ID NO: 79395

SEQ ID NO: 289965 - RNA, 64 nt, hsa; identical to SEQ ID NO: 79396

SEQ ID NO: 289966 - RNA, 64 nt, hsa; identical to SEQ ID NO: 79397

SEQ ID NO: 289967 - RNA, 64 nt, hsa; identical to SEQ ID NO: 79398

SEQ ID NO: 289968 - RNA, 64 nt, hsa; identical to SEQ ID NO: 79399

SEQ ID NO: 289969 - RNA, 64 nt, hsa; identical to SEQ ID NO: 79400

SEQ ID NO: 289970 - RNA, 64 nt, hsa; identical to SEQ ID NO: 79401

SEQ ID NO: 289971 - RNA, 64 nt, hsa
gaaauauuguuauacauuuauuaaauauacuucccccaugaagugaaaagguuaauuuugcuga

SEQ ID NO: 289972 - RNA, 64 nt, hsa
uguuuuaaguugaaguuacuucauggaugucauacccaugaagugcauuuggaugagauagaag

SEQ ID NO: 289973 - RNA, 64 nt, hsa
aauacuauugcucuagaauguauuacuuuguucucccaugaaagaauucaguuuguuaguaccu

SEQ ID NO: 289974 - RNA, 64 nt, hsa
ucccugaagacuggaauuacuucagcaaaacuuccccaugaacagcuaauguguagugaaagaa

SEQ ID NO: 289975 - RNA, 64 nt, hsa
uuggguugcaaagcuaucccgccccccacccugccccaugaaacuugagcauucaaaugaagau

SEQ ID NO: 289976 - RNA, 64 nt, hsa
gcuaaaugaccauccaguagagauuucccacauucccaugaauaucaagaauaguugucagaau

SEQ ID NO: 289977 - RNA, 64 nt, hsa
aggagauacauaucagagaacauuuguacaauuccccaugaaaauugcuccaaaguugauaaca

SEQ ID NO: 289978 - RNA, 64 nt, hsa
uuguggcgccuuccucaucucuauauaggaggaucccaugaaugaugguuuauugggaacugcu

SEQ ID NO: 289979 - RNA, 64 nt, hsa
uggagggcuaaucaaucuuauguuagcaggacaacccaugaaaaacaagucagagagugaaggc

SEQ ID NO: 289980 - RNA, 64 nt, hsa
auauuucuuuuaccauugaccauuauuauagggacccaugaaguaaaugucacaaucaucuuac

SEQ ID NO: 289981 - RNA, 64 nt, hsa
auuugcccagaguuugcucaauuccaagacagugcccaugaaugggacaccuguaauguaaccc

SEQ ID NO: 289982 - RNA, 64 nt, hsa
auuaaaauauauuuaauauguuuugccuuuguggcccaugaaagucuuacugggcccuggggaa

SEQ ID NO: 289983 - RNA, 64 nt, hsa
ucugggcauccuggaucccugaauuauccccccccccaugaaguacuucaagggccaagcugcc

SEQ ID NO: 289984 - RNA, 64 nt, hsa
ucaagggccaagcugccccuuucccuccucuccgcccaugaaaaugccuccaaacugagaugcu

SEQ ID NO: 289985 - RNA, 64 nt, hsa
aauugauuuaaacaucauguagacuaaagucuuaaacaucuaagacucaguuguaguugcagaa

SEQ ID NO: 289986 - RNA, 64 nt, hsa
uugccucauaaacucucucuuuguuuuuaaaggaaacaucuauuaugguaauacaaagaaaagu

SEQ ID NO: 289987 - RNA, 64 nt, hsa
uaguaacacauauguaguauaauuucuagaaacaaacaucuaauaaguauauaauccugugaaa

SEQ ID NO: 289988 - RNA, 64 nt, hsa
uucagaggauaaauaucaauggaacucagagaugaacaucuaacccacuagaggaaaccaguuu

SEQ ID NO: 289989 - RNA, 58 nt, hsa
gccgaguauggucacugugacguguuagaacaucuaauccacaaagguaugugaaaag

SEQ ID NO: 289990 - RNA, 64 nt, hsa
uuucuuuuagugcacugaaauaucuuaucccaguaacaucuaaaaaugcaauucggaaaagugg

SEQ ID NO: 289991 - RNA, 64 nt, hsa
uuaauuuuguuaauccugucugggacacuuaaguaacaucuaaagcauuauugcuuuagaaugu

SEQ ID NO: 289992 - RNA, 64 nt, hsa
uuugugggucucucuuucgucgguggcuuaaaguaacaucuauuuccauugauccuagguucuu

SEQ ID NO: 289993 - RNA, 64 nt, hsa
cuuaaacuauugacuugguaagucuacuguauauaacaucuaauauauauauauuauaggccag

SEQ ID NO: 289994 - RNA, 64 nt, hsa
cuuaaacuauugacuugguaagucuacuguauauaacaucuaauauauauauuacaggccaaau

SEQ ID NO: 289995 - RNA, 64 nt, hsa
aguggaauuuaucccaggaauucaagguugguucaacaucuaaaaaucaaauaagcuaauauac

SEQ ID NO: 289996 - RNA, 64 nt, hsa
gaauaaaaggaaucuuccuagauaugauaaauauaacaucuaugaaaagcccacaccuaacauu

SEQ ID NO: 289997 - RNA, 64 nt, hsa
cacagcaguuagguuaggaauucaagguuuguucaacaucuaaaaaucaaauaagcuaauaaag

SEQ ID NO: 289998 - RNA, 64 nt, hsa
cugcagcauaucagacagcaauuuaacagcuugaaacaucuacagauaguuccuacuaaaagaa

SEQ ID NO: 289999 - RNA, 64 nt, hsa
ggugaauucucaggugaacuuuuuucaguuauaaaacaucuauuuugaaucuguaaauauuuua

SEQ ID NO: 290000 - RNA, 64 nt, hsa
acugaggaaaaaaaauaauuaaacaggccuaagaagaaaucaaaaaccauaagacaccuauccu

SEQ ID NO: 290001 - RNA, 64 nt, hsa
auggcuaagaagauuugaauuauagggagggaacagaaaucauacaugaaaagguuuuacugag

SEQ ID NO: 290002 - RNA, 64 nt, hsa
uagcauuauuucuucagcuauaaugaauugcuauagaaaucaggcagaucuuucuaauguguau

SEQ ID NO: 290003 - RNA, 64 nt, hsa
ugcuucuuucugucuuuccuucucuuuugucuggagaaaucacuuagacucugugugccucuuc

SEQ ID NO: 290004 - RNA, 64 nt, hsa
cuguuagagaaauugcacuuuuccugacuuaccuagaaaucaagaauuuaggaaauuaaugugg

SEQ ID NO: 290005 - RNA, 64 nt, hsa
uuuacaucaagauaaacccugagaagaacuacggagaaaucaaauaaaauccugucauauuuuu

SEQ ID NO: 290006 - RNA, 64 nt, hsa
agaacagccuggcuuauuuggggauuuuucuucuagaaaucaaaugacugauaagcauuggauc

SEQ ID NO: 290007 - RNA, 64 nt, hsa
cgucugcuugggguuauucagugugaccuagagaagaaaucagcggaccacgauuucaagacuu

SEQ ID NO: 290008 - RNA, 64 nt, hsa
uuuaauucuugcauuguaauuggcuguguccauaagaaaucauuuauucuucaggcuuagacau

SEQ ID NO: 290009 - RNA, 64 nt, hsa
uuuucucacauucagacuuacacuuaaugguguuagaaaucaacaaaacuccuuuuuaaaaaga

SEQ ID NO: 290010 - RNA, 64 nt, hsa
gcaguguguucuccaaacaugauggaacgaaauuagaaaucaauaaaauuugggaaauucacaa

SEQ ID NO: 290011 - RNA, 64 nt, hsa
acagugauacugucucaauaaauaaauaaauagaagaaaucaugaguaaaauuggaaaacacuu

SEQ ID NO: 290012 - RNA, 64 nt, hsa
ccuuggugcaauauucuuaaaaccugcuuugcauagaaaucacuuuugcccaggcuggagugca

SEQ ID NO: 290013 - RNA, 64 nt, hsa
ugcugagauuaggcguuagccaccgcgcccggccagaaaucacuuuuauauugucacaugggcc

SEQ ID NO: 290014 - RNA, 64 nt, hsa
aggccuuaucuugaaaguuaaaaaaaaaaaguaaagaaaucacaguaaguucuauuagugauga

SEQ ID NO: 290015 - RNA, 64 nt, hsa
ucucacaaggaaaaaaacauucuauauuuguagcagaaaucagugguuugaaaagucauacuuu

SEQ ID NO: 290016 - RNA, 64 nt, hsa
uugaugccaaaaaaaaauacaugcuaagagaaguagaaaucauagcugguucacacugaccaag

SEQ ID NO: 290017 - RNA, 64 nt, hsa
cauucagaagaaaaagaagcaaccucaguaauuuagaaaucauuuugcaaucccuuaauauccu

SEQ ID NO: 290018 - RNA, 64 nt, hsa
ugguguaagagcuaaauccucaucugucauauccagaaaucacuauauaauauauaauaaugaa

SEQ ID NO: 290019 - RNA, 64 nt, hsa
uucagugaaagcaguguauuugcuaggucauaccagaaaucaucaauugagguacggagaaacu

SEQ ID NO: 290020 - RNA, 64 nt, hsa
acauuaauugaagcaucaaaaauaaauggcaaagagaaaucaggacaaaaaaucuaauugcugu

SEQ ID NO: 290021 - RNA, 64 nt, hsa
cagaaugcauccuuugagauuauguccacuuaagagaaaucaucaguuaagaaaucuacuuuaa

SEQ ID NO: 290022 - RNA, 64 nt, hsa
ggguuuuagagccccugcucuaggaaacaguuuaagaaaucauuggccccuucccagcacauug

SEQ ID NO: 290023 - RNA, 64 nt, hsa
cuuuaggaugacacaaugaauaacaccuagucauagaaaucagucucucugguuuguuuuguau

SEQ ID NO: 290024 - RNA, 64 nt, hsa
ucaugcuuauuucaaacucccugagugauggguaagaaaucaaacauugccucagugguaucaa

SEQ ID NO: 290025 - RNA, 64 nt, hsa
ugagagucacgcuuuuaaauuuacagcucaucacagaaaucaucagcuauacauuaguaaaaau

SEQ ID NO: 290026 - RNA, 64 nt, hsa
auccauccaacuuuaacacaacauuucucaguguagaaaucaugucuucuuaauugcugaaccu

SEQ ID NO: 290027 - RNA, 64 nt, hsa
uucugguguuguguccaucauaagauguaaaaagagaaaucauaguuuuauauuuuaguuucuc

SEQ ID NO: 290028 - RNA, 64 nt, hsa
auaaccaccucaacugauagcaaaauaucuaauuagaaaucaacaguuugaugaguuuuuuucc

SEQ ID NO: 290029 - RNA, 64 nt, hsa
ucuuuaauuuuuuauguuuacuuauucccuucacagaaaucagcagugagcagucaaguuaaug

SEQ ID NO: 290030 - RNA, 56 nt, hsa
cuuuguagguaacccauuaacccaggagaaaucaagugauccucaaggcugaugac

SEQ ID NO: 290031 - RNA, 64 nt, hsa
uacugaacuccagaccaugcauguaguccacuccagaaaucaugcucgcuucccuuggcacacc

SEQ ID NO: 290032 - RNA, 64 nt, hsa
uugauaaguaaaagcuucguuauacauuugacuaagaaaucacccagcuuuaaagcugcuuuua

SEQ ID NO: 290033 - RNA, 64 nt, hsa
cagaagagccaaaaaaaaguaucuucauuuaaaaagaaaucaagucaguuuuuuuaaaagaaug

SEQ ID NO: 290034 - RNA, 64 nt, hsa
uuuuuccuugcuugcaaucucaucugauuuugcuagaaaucacaaccauauuguuuaugcauau

SEQ ID NO: 290035 - RNA, 64 nt, hsa
cuucaaccagcuugaaucacugaauaugcauuugagaaaucacauuagauugaaacccuacgaa

SEQ ID NO: 290036 - RNA, 64 nt, hsa
gaugcagauuuuuuuauuagaguuuauacuguagagaaaucauaugaagucaauaaauguggga

SEQ ID NO: 290037 - RNA, 64 nt, hsa
uuagccaagcauggugaugauauaggaguuaaggagaaaucauuuaggcaaauagcaaggguag

SEQ ID NO: 290038 - RNA, 64 nt, hsa
ugcagcuagaguugacucagaagccgaaauuccuagaaaucagguuucuacugcuaggcaauug

SEQ ID NO: 290039 - RNA, 64 nt, hsa
gagguuuccuuucccaucauauggaaugauguaaagaaaucagauacaaacuacugcaauuaga

SEQ ID NO: 290040 - RNA, 64 nt, hsa
ccuaccacuuccaguaagaaaauggguguuuugaagaaaucauuugccuuguccucacggaauc

SEQ ID NO: 290041 - RNA, 64 nt, hsa; identical to SEQ ID NO: 205933

SEQ ID NO: 290042 - RNA, 64 nt, hsa; identical to SEQ ID NO: 205934

SEQ ID NO: 290043 - RNA, 64 nt, hsa; identical to SEQ ID NO: 205935

SEQ ID NO: 290044 - RNA, 64 nt, hsa; identical to SEQ ID NO: 205936

SEQ ID NO: 290045 - RNA, 64 nt, hsa; identical to SEQ ID NO: 205937

SEQ ID NO: 290046 - RNA, 64 nt, hsa; identical to SEQ ID NO: 205938

SEQ ID NO: 290047 - RNA, 64 nt, hsa; identical to SEQ ID NO: 205939

SEQ ID NO: 290048 - RNA, 64 nt, hsa; identical to SEQ ID NO: 205940

SEQ ID NO: 290049 - RNA, 64 nt, hsa; identical to SEQ ID NO: 205941

SEQ ID NO: 290050 - RNA, 64 nt, hsa; identical to SEQ ID NO: 205942

SEQ ID NO: 290051 - RNA, 64 nt, hsa; identical to SEQ ID NO: 205943

SEQ ID NO: 290052 - RNA, 64 nt, hsa; identical to SEQ ID NO: 205944

SEQ ID NO: 290053 - RNA, 64 nt, hsa; identical to SEQ ID NO: 205945

SEQ ID NO: 290054 - RNA, 64 nt, hsa; identical to SEQ ID NO: 205946

SEQ ID NO: 290055 - RNA, 64 nt, hsa; identical to SEQ ID NO: 205947

SEQ ID NO: 290056 - RNA, 64 nt, hsa; identical to SEQ ID NO: 205948

SEQ ID NO: 290057 - RNA, 64 nt, hsa; identical to SEQ ID NO: 205949

SEQ ID NO: 290058 - RNA, 64 nt, hsa; identical to SEQ ID NO: 205950

SEQ ID NO: 290059 - RNA, 64 nt, hsa; identical to SEQ ID NO: 205951

SEQ ID NO: 290060 - RNA, 64 nt, hsa; identical to SEQ ID NO: 205952

SEQ ID NO: 290061 - RNA, 64 nt, hsa; identical to SEQ ID NO: 205953

SEQ ID NO: 290062 - RNA, 64 nt, hsa; identical to SEQ ID NO: 205954

SEQ ID NO: 290063 - RNA, 64 nt, hsa; identical to SEQ ID NO: 205955

SEQ ID NO: 290064 - RNA, 64 nt, hsa; identical to SEQ ID NO: 205956

SEQ ID NO: 290065 - RNA, 64 nt, hsa; identical to SEQ ID NO: 205957

SEQ ID NO: 290066 - RNA, 64 nt, hsa; identical to SEQ ID NO: 205958

SEQ ID NO: 290067 - RNA, 64 nt, hsa; identical to SEQ ID NO: 205959

SEQ ID NO: 290068 - RNA, 64 nt, hsa; identical to SEQ ID NO: 205960

SEQ ID NO: 290069 - RNA, 64 nt, hsa; identical to SEQ ID NO: 205961

SEQ ID NO: 290070 - RNA, 64 nt, hsa; identical to SEQ ID NO: 205962

SEQ ID NO: 290071 - RNA, 64 nt, hsa; identical to SEQ ID NO: 205963

SEQ ID NO: 290072 - RNA, 64 nt, hsa; identical to SEQ ID NO: 205964

SEQ ID NO: 290073 - RNA, 64 nt, hsa; identical to SEQ ID NO: 205965

SEQ ID NO: 290074 - RNA, 64 nt, hsa; identical to SEQ ID NO: 205966

SEQ ID NO: 290075 - RNA, 64 nt, hsa; identical to SEQ ID NO: 205967

SEQ ID NO: 290076 - RNA, 64 nt, hsa; identical to SEQ ID NO: 205968

SEQ ID NO: 290077 - RNA, 64 nt, hsa; identical to SEQ ID NO: 205969

SEQ ID NO: 290078 - RNA, 64 nt, hsa; identical to SEQ ID NO: 205970

SEQ ID NO: 290079 - RNA, 64 nt, hsa; identical to SEQ ID NO: 205971

SEQ ID NO: 290080 - RNA, 64 nt, hsa; identical to SEQ ID NO: 205972

SEQ ID NO: 290081 - RNA, 64 nt, hsa; identical to SEQ ID NO: 205973

SEQ ID NO: 290082 - RNA, 64 nt, hsa; identical to SEQ ID NO: 205974

SEQ ID NO: 290083 - RNA, 64 nt, hsa; identical to SEQ ID NO: 205975

SEQ ID NO: 290084 - RNA, 64 nt, hsa; identical to SEQ ID NO: 205976

SEQ ID NO: 290085 - RNA, 64 nt, hsa; identical to SEQ ID NO: 205977

SEQ ID NO: 290086 - RNA, 64 nt, hsa; identical to SEQ ID NO: 205978

SEQ ID NO: 290087 - RNA, 64 nt, hsa; identical to SEQ ID NO: 205979

SEQ ID NO: 290088 - RNA, 64 nt, hsa; identical to SEQ ID NO: 205980

SEQ ID NO: 290089 - RNA, 64 nt, hsa; identical to SEQ ID NO: 205981

SEQ ID NO: 290090 - RNA, 64 nt, hsa; identical to SEQ ID NO: 205982

SEQ ID NO: 290091 - RNA, 64 nt, hsa; identical to SEQ ID NO: 205983

SEQ ID NO: 290092 - RNA, 54 nt, hsa; identical to SEQ ID NO: 205984

SEQ ID NO: 290093 - RNA, 64 nt, hsa; identical to SEQ ID NO: 205985

SEQ ID NO: 290094 - RNA, 64 nt, hsa; identical to SEQ ID NO: 205986

SEQ ID NO: 290095 - RNA, 64 nt, hsa; identical to SEQ ID NO: 205987

SEQ ID NO: 290096 - RNA, 64 nt, hsa; identical to SEQ ID NO: 205988

SEQ ID NO: 290097 - RNA, 64 nt, hsa; identical to SEQ ID NO: 205989

SEQ ID NO: 290098 - RNA, 64 nt, hsa; identical to SEQ ID NO: 39060

SEQ ID NO: 290099 - RNA, 64 nt, hsa; identical to SEQ ID NO: 39061

SEQ ID NO: 290100 - RNA, 64 nt, hsa; identical to SEQ ID NO: 39062

SEQ ID NO: 290101 - RNA, 64 nt, hsa; identical to SEQ ID NO: 39063

SEQ ID NO: 290102 - RNA, 57 nt, hsa; identical to SEQ ID NO: 39064

SEQ ID NO: 290103 - RNA, 64 nt, hsa; identical to SEQ ID NO: 39065

SEQ ID NO: 290104 - RNA, 64 nt, hsa; identical to SEQ ID NO: 39066

SEQ ID NO: 290105 - RNA, 64 nt, hsa; identical to SEQ ID NO: 39067

SEQ ID NO: 290106 - RNA, 64 nt, hsa; identical to SEQ ID NO: 39068

SEQ ID NO: 290107 - RNA, 64 nt, hsa; identical to SEQ ID NO: 39069

SEQ ID NO: 290108 - RNA, 64 nt, hsa; identical to SEQ ID NO: 39070

SEQ ID NO: 290109 - RNA, 64 nt, hsa; identical to SEQ ID NO: 39071

SEQ ID NO: 290110 - RNA, 64 nt, hsa; identical to SEQ ID NO: 39072

SEQ ID NO: 290111 - RNA, 64 nt, hsa; identical to SEQ ID NO: 39073

SEQ ID NO: 290112 - RNA, 64 nt, hsa; identical to SEQ ID NO: 39074

SEQ ID NO: 290113 - RNA, 64 nt, hsa; identical to SEQ ID NO: 39075

SEQ ID NO: 290114 - RNA, 64 nt, hsa; identical to SEQ ID NO: 39076

SEQ ID NO: 290115 - RNA, 64 nt, hsa; identical to SEQ ID NO: 39077

SEQ ID NO: 290116 - RNA, 64 nt, hsa; identical to SEQ ID NO: 39078

SEQ ID NO: 290117 - RNA, 64 nt, hsa; identical to SEQ ID NO: 39079

SEQ ID NO: 290118 - RNA, 64 nt, hsa; identical to SEQ ID NO: 39080

SEQ ID NO: 290119 - RNA, 64 nt, hsa; identical to SEQ ID NO: 39081

SEQ ID NO: 290120 - RNA, 64 nt, hsa; identical to SEQ ID NO: 39082

SEQ ID NO: 290121 - RNA, 64 nt, hsa; identical to SEQ ID NO: 39083

SEQ ID NO: 290122 - RNA, 64 nt, hsa; identical to SEQ ID NO: 39084

SEQ ID NO: 290123 - RNA, 64 nt, hsa; identical to SEQ ID NO: 39085

SEQ ID NO: 290124 - RNA, 64 nt, hsa; identical to SEQ ID NO: 39086

SEQ ID NO: 290125 - RNA, 64 nt, hsa; identical to SEQ ID NO: 39087

SEQ ID NO: 290126 - RNA, 64 nt, hsa; identical to SEQ ID NO: 39088

SEQ ID NO: 290127 - RNA, 64 nt, hsa; identical to SEQ ID NO: 39089

SEQ ID NO: 290128 - RNA, 64 nt, hsa; identical to SEQ ID NO: 39090

SEQ ID NO: 290129 - RNA, 64 nt, hsa; identical to SEQ ID NO: 39091

SEQ ID NO: 290130 - RNA, 64 nt, hsa; identical to SEQ ID NO: 39092

SEQ ID NO: 290131 - RNA, 64 nt, hsa; identical to SEQ ID NO: 39093

SEQ ID NO: 290132 - RNA, 64 nt, hsa; identical to SEQ ID NO: 39094

SEQ ID NO: 290133 - RNA, 64 nt, hsa; identical to SEQ ID NO: 39095

SEQ ID NO: 290134 - RNA, 64 nt, hsa; identical to SEQ ID NO: 39096

SEQ ID NO: 290135 - RNA, 64 nt, hsa; identical to SEQ ID NO: 39097

SEQ ID NO: 290136 - RNA, 64 nt, hsa; identical to SEQ ID NO: 39098

SEQ ID NO: 290137 - RNA, 64 nt, hsa; identical to SEQ ID NO: 39099

SEQ ID NO: 290138 - RNA, 64 nt, hsa; identical to SEQ ID NO: 39100

SEQ ID NO: 290139 - RNA, 64 nt, hsa; identical to SEQ ID NO: 39101

SEQ ID NO: 290140 - RNA, 64 nt, hsa; identical to SEQ ID NO: 39102

SEQ ID NO: 290141 - RNA, 64 nt, hsa; identical to SEQ ID NO: 39103

SEQ ID NO: 290142 - RNA, 64 nt, hsa; identical to SEQ ID NO: 39104

SEQ ID NO: 290143 - RNA, 64 nt, hsa; identical to SEQ ID NO: 39105

SEQ ID NO: 290144 - RNA, 64 nt, hsa; identical to SEQ ID NO: 39106

SEQ ID NO: 290145 - RNA, 64 nt, hsa; identical to SEQ ID NO: 39107

SEQ ID NO: 290146 - RNA, 64 nt, hsa; identical to SEQ ID NO: 39108

SEQ ID NO: 290147 - RNA, 64 nt, hsa; identical to SEQ ID NO: 39109

SEQ ID NO: 290148 - RNA, 64 nt, hsa; identical to SEQ ID NO: 39110

SEQ ID NO: 290149 - RNA, 64 nt, hsa; identical to SEQ ID NO: 39111

SEQ ID NO: 290150 - RNA, 64 nt, hsa; identical to SEQ ID NO: 39112

SEQ ID NO: 290151 - RNA, 64 nt, hsa; identical to SEQ ID NO: 39113

SEQ ID NO: 290152 - RNA, 64 nt, hsa; identical to SEQ ID NO: 39114

SEQ ID NO: 290153 - RNA, 64 nt, hsa; identical to SEQ ID NO: 75349

SEQ ID NO: 290154 - RNA, 64 nt, hsa; identical to SEQ ID NO: 75350

SEQ ID NO: 290155 - RNA, 64 nt, hsa; identical to SEQ ID NO: 75351

SEQ ID NO: 290156 - RNA, 64 nt, hsa; identical to SEQ ID NO: 75352

SEQ ID NO: 290157 - RNA, 64 nt, hsa
aucugacucacaagaaagccaacuguaugucuugugaugggacaguucauaauguaguugcuag

SEQ ID NO: 290158 - RNA, 64 nt, hsa
gcccucccaacacuuucacucccucuccaagccuugaugggaccuccacuuauuuaggccucau

SEQ ID NO: 290159 - RNA, 64 nt, hsa
agccaacaaaacaguuuguugccagaccaauguuugaugggaaaacguggcacucauaguugaa

SEQ ID NO: 290160 - RNA, 64 nt, hsa
gaaauguaugauccaacuagaaaugaauggaagaugaugggaaauaugacuucaccaaggagca

SEQ ID NO: 290161 - RNA, 64 nt, hsa
aaaccuuguacuacucagcugaucacaagcugcuugaugggaaccuacuagauggacaggcuga

SEQ ID NO: 290162 - RNA, 64 nt, hsa
uccccaugugucaagggagggaccugaugggaggugaugggaucaugggggugguuuccccuau

SEQ ID NO: 290163 - RNA, 64 nt, hsa
caaauuguaauccccaugugucaagggagggaccugaugggaggugaugggaucaugggggugg

SEQ ID NO: 290164 - RNA, 64 nt, hsa
ggugagcauccgccuuuccuguucuuggaugaauugaugggaguggggcuauucugugccuucu

SEQ ID NO: 290165 - RNA, 64 nt, hsa
cugggaguuggcugcauggccagcacugccgacuugaugggagcaguuugcccucauucuccug

SEQ ID NO: 290166 - RNA, 64 nt, hsa
gcaaggggcugcagagcccaggugcacugugugaugaugggagggggcuccguccugcaggcug

SEQ ID NO: 290167 - RNA, 64 nt, hsa
cagggagccgaaaggcuuaaauaguuuaaguaggugaugggaagaugagauuaccucauuuagg

SEQ ID NO: 290168 - RNA, 64 nt, hsa
gggaagggcccaggccagacccaucccaaacggaugaugggaugaugggacagcagcuccuugc

SEQ ID NO: 290169 - RNA, 64 nt, hsa
cccaggccagacccaucccaaacggaugaugggaugaugggacagcagcuccuugcucagaagc

SEQ ID NO: 290170 - RNA, 64 nt, hsa
guggauggauggaaggcacacagcccgugccggcugaugggacgagggucaggcauccugucug

SEQ ID NO: 290171 - RNA, 64 nt, hsa
ccauuacuccucaggccuggcccucgggccuccgugaugggagccccccaggaggggucagaug

SEQ ID NO: 290172 - RNA, 64 nt, hsa
aauuuuuggcauuuuuguauauuuaugcauuaggugaugggacuuuuaaagguuugaauuuauu

SEQ ID NO: 290173 - RNA, 64 nt, hsa
uuuuuuaaagcacagauguaauugucuaauguucugaugggaacguaacacuuauuuuuauaua

SEQ ID NO: 290174 - RNA, 64 nt, hsa
ucuucccggaaucagauucaaaggauccuggaggugaugggauagacuggggagacgaugcugu

SEQ ID NO: 290175 - RNA, 64 nt, hsa
aucuccaagagguacagcgggcgcccugugaaccugaugggaaccucucugugacacccuccgu

SEQ ID NO: 290176 - RNA, 64 nt, hsa
aaaaauaaaaaauaaauaauggaacacagcaaguccuaggaaguagguuaaaacuaauucuuua

SEQ ID NO: 290177 - RNA, 64 nt, hsa
gaauuccaucccaguaccaaagccagauaggcccccuaggaaacugagguaagagcagucucua

SEQ ID NO: 290178 - RNA, 64 nt, hsa
cuugacuuaaagguugcagcaguacaucucgucaccuaggaauagauuaucaggccuugccaac

SEQ ID NO: 290179 - RNA, 64 nt, hsa
ugcccauuucaguacccuuucaaagguaucucugccuaggaacauucuucagaaaugcaacuuc

SEQ ID NO: 290180 - RNA, 64 nt, hsa
guacugaagaugcuccaguaauuggugacccaacccuaggaaguagggagaaaugaaggaaggg

SEQ ID NO: 290181 - RNA, 64 nt, hsa
ccacuccaagccuggccccaccagugcuguuuggccuaggaacuguggcugggaaggugccucc

SEQ ID NO: 290182 - RNA, 64 nt, hsa
auucgaagauguguugacagucgugaguguguauccuaggaaaggcgagcuggacucugucucc

SEQ ID NO: 290183 - RNA, 64 nt, hsa
gacucugucuccaugguggcucucaccccagggaccuaggaacagccugucaccacacaauuac

SEQ ID NO: 290184 - RNA, 64 nt, hsa
ugccccccuggggggccacagcccagagaaccagccuaggaacacucgggaugacaccccuuau

SEQ ID NO: 290185 - RNA, 64 nt, hsa
ugcccagugggauucuccagggggccgggacuucccuaggaaguggugagccaaugcucccuga

SEQ ID NO: 290186 - RNA, 64 nt, hsa
accucaugccccuuuacauucccuccuugccuucccuaggaaaccguugauuuacauuuuuuac

SEQ ID NO: 290187 - RNA, 64 nt, hsa
agauuugaccucauuugcauugccaccaaggccuccuaggaaaaauuguaggaauuuaugggua

SEQ ID NO: 290188 - RNA, 64 nt, hsa
gcuuaaacauuuucucaauuguaaaauaggugggcacaaguauuacacaucagaaaauccugac

SEQ ID NO: 290189 - RNA, 64 nt, hsa
acacacacacacagagacacaucuuaaggggacccacaaguauugcccuuuaacaagacuucaa

SEQ ID NO: 290190 - RNA, 64 nt, hsa
guaggcaaaucucuuuuuaaaaaacucuuuggugcacaaguaacacauuuggccacaaaacacc

SEQ ID NO: 290191 - RNA, 64 nt, hsa
uggaaaauucuauggaauaguucuguauauagggcacaaguaaaggcauuguccaaaguuuauu

SEQ ID NO: 290192 - RNA, 64 nt, hsa
ucuagccaccaccaccuuucaacuuuuuaucacucacaaguaguguacuguucaccaaauugug

SEQ ID NO: 290193 - RNA, 64 nt, hsa
cauuuaaaagaugggcguuucccccaaugaaauacacaaguaaacauuccaacauugucuuuag

SEQ ID NO: 290194 - RNA, 64 nt, hsa
gugacuuaucuaccauugaaggaaagcuauaucuauuugagagcagaugccauuuuguacaugu

SEQ ID NO: 290195 - RNA, 64 nt, hsa
ccccagcucucaguaguuuaguacaauaaucucuauuugagaaguucucagaauaacuaccucc

SEQ ID NO: 290196 - RNA, 64 nt, hsa
ugaaaguauauuuuccucccaguucuacaagcauauuugagaacccuuccuuucccaaguauug

SEQ ID NO: 290197 - RNA, 64 nt, hsa
guugcuaguacuggggagaaauaauuguugauuaauuugagaauuauuccuuuccuagacuaau

SEQ ID NO: 290198 - RNA, 64 nt, hsa
auagauggaaagugcauauugaacacaucugugcauuugagaaggcaggcuuucauaugcuguc

SEQ ID NO: 290199 - RNA, 64 nt, hsa
gagauggaguuuugcucuuaaugauauuauuauuauuugagacagaguuuugcucuuauugccc

SEQ ID NO: 290200 - RNA, 64 nt, hsa
uuguguucaauauuaacacuucuuaauuugauauauuugagagucagacauuauaauuguuaac

SEQ ID NO: 290201 - RNA, 64 nt, hsa
accuagcuucaccuuauucuuuaaagggcagaaaauuugagacggugaucgccguaacaguaaa

SEQ ID NO: 290202 - RNA, 64 nt, hsa
gugagacgaaugggcucuggacauaugccuguugauuugagaagaaaucuggcugguuugaggg

SEQ ID NO: 290203 - RNA, 64 nt, hsa
guugucauccugggagacaggcaacaguagagauauuugagagccuaaagagagguuuggccug

SEQ ID NO: 290204 - RNA, 64 nt, hsa
cguucaguuuccugggucuuuuucuuauuagcacauuugagaaaaauauuccuuuccuuuauug

SEQ ID NO: 290205 - RNA, 64 nt, hsa
aaagaaucuccauuuucugaaggucuguuaguuaauuugagauaauuuguuaaaggcaaguaug

SEQ ID NO: 290206 - RNA, 64 nt, hsa
uugaguucuaauguuacaucugaggaaguauguaauuugagaauuguaacuucuaagggauuca

SEQ ID NO: 290207 - RNA, 64 nt, hsa
gcuccaucaagaaugugggaugugccgaccaaggauuugagaaaguuguacagaaauguguuca

SEQ ID NO: 290208 - RNA, 64 nt, hsa
uauuugucgaugaaauaaacacaacucuuugaggauuugagacuacauucacccuuuauucaca

SEQ ID NO: 290209 - RNA, 64 nt, hsa
cccguuuaucuugugcuaucucuguaguauuuucauuugagagaggaggcugaguuuccagagc

SEQ ID NO: 290210 - RNA, 64 nt, hsa
cgugaaauccuuagcugguugaauguugcacaguauuugagaauuacgguuugaagugauuucu

SEQ ID NO: 290211 - RNA, 64 nt, hsa
uuguagcugccuccuagaagcacauucugagcacauuugagaccucuguguuagaggggagacu

SEQ ID NO: 290212 - RNA, 64 nt, hsa
guuuuguuuuuaucuugccuguuggcuucaauacauuugagaauacgcugaagagggaaaauuu

SEQ ID NO: 290213 - RNA, 64 nt, hsa
gacucauacaauuugagaaaaaacagucaaccugauuugagaaauuaaccaguauggcuaacua

SEQ ID NO: 290214 - RNA, 64 nt, hsa
aaagugaccacaaaauuucaaagggacucauacaauuugagaaaaaacagucaaccugauuuga

SEQ ID NO: 290215 - RNA, 64 nt, hsa
agggugaacugcaaagcuuuggcugagaccugggauuugagauaccacaaacccugcugaacac

SEQ ID NO: 290216 - RNA, 64 nt, hsa
auaguauagaagucuggaaaaaaacaaaaacagaauuugagaaccuuggaccacuccugucccu

SEQ ID NO: 290217 - RNA, 64 nt, hsa
cauuggagaagcgguggauaacuagccagacaaaauuugagaauacauaaacaacgcauugcca

SEQ ID NO: 290218 - RNA, 64 nt, hsa
uugccuuuaaaacuuacaaaaauacguguuuguuauuugagaaagcauguuuaaaaauugcaga

SEQ ID NO: 290219 - RNA, 64 nt, hsa
agaggcaacuuuuguuuaugauucaaauaugggaauuugagaaauauuucauuuguccacugga

SEQ ID NO: 290220 - RNA, 64 nt, hsa
aaaaagagauaaaauuaauaauaguucacuuguuauuugagauuaauuuggcauuugaaaugau

SEQ ID NO: 290221 - RNA, 64 nt, hsa
guaaaaacagcuauuacuaaucucugcacuggucauuugagaauuuuuuuuguacagcauucau

SEQ ID NO: 290222 - RNA, 64 nt, hsa
agaaaaaguuacacgcaguuccgugguugaauauauuugagaugguaccuuagaaaaaguuuca

SEQ ID NO: 290223 - RNA, 64 nt, hsa
aaaguaaaacaauuucccaaucccaggccuugugauuugagaugguaccuuagaaaaaguuaca

SEQ ID NO: 290224 - RNA, 64 nt, hsa
uguuacacuguuauguccuaaaauucaaaucacuauuugagaaacccucaaauuggugcuuuca

SEQ ID NO: 290225 - RNA, 64 nt, hsa
guauuuuucugucaagacuauucaagaaggcauuauuugagauuccuguucauucuuggugugu

SEQ ID NO: 290226 - RNA, 64 nt, hsa
gaggccaaggugggcagaucaccugagaucaaguauuugagaacagccuggcuaacauggcgaa

SEQ ID NO: 290227 - RNA, 64 nt, hsa
gaggccaagacagguaggucacuugaggucaugaauuugagaccagccuggccaacagacggga

SEQ ID NO: 290228 - RNA, 64 nt, hsa
uuuaucacucugagcgagucucuagagggugagaauuugagagaaauaguaauuugauuauuuc

SEQ ID NO: 290229 - RNA, 64 nt, hsa
uuuggaaacuuucuuuuacaaaagaauauuacauauuugagagaaaauauuucuauuaaugguu

SEQ ID NO: 290230 - RNA, 64 nt, hsa; identical to SEQ ID NO: 174962

SEQ ID NO: 290231 - RNA, 64 nt, hsa; identical to SEQ ID NO: 174963

SEQ ID NO: 290232 - RNA, 64 nt, hsa; identical to SEQ ID NO: 174967

SEQ ID NO: 290233 - RNA, 64 nt, hsa; identical to SEQ ID NO: 174968

SEQ ID NO: 290234 - RNA, 64 nt, hsa
agugcugcgauaaacagcacuauuaugaauagugcugcgauaaacagugcaggugauuuuaaaa

SEQ ID NO: 290235 - RNA, 64 nt, hsa
gguugguuccauaacuuugcuauuacgaauagugcugcgauaaacagcacuauuaugaauagug

SEQ ID NO: 290236 - RNA, 64 nt, hsa
agaagaacagauaacaaagcuguuaauacuuaaacugcgauauuucacuccuaaagaaauagca

SEQ ID NO: 290237 - RNA, 64 nt, hsa
cgugaaccaguaucuuuuaccaccaaagucauugcugcgauaugcucuucuguuagacauuguu

SEQ ID NO: 290238 - RNA, 64 nt, hsa; identical to SEQ ID NO: 108616

SEQ ID NO: 290239 - RNA, 64 nt, hsa; identical to SEQ ID NO: 108617

SEQ ID NO: 290240 - RNA, 64 nt, hsa; identical to SEQ ID NO: 108618

SEQ ID NO: 290241 - RNA, 64 nt, hsa; identical to SEQ ID NO: 108619

SEQ ID NO: 290242 - RNA, 64 nt, hsa; identical to SEQ ID NO: 108620

SEQ ID NO: 290243 - RNA, 64 nt, hsa; identical to SEQ ID NO: 108621

SEQ ID NO: 290244 - RNA, 64 nt, hsa; identical to SEQ ID NO: 108622

SEQ ID NO: 290245 - RNA, 64 nt, hsa; identical to SEQ ID NO: 108623

SEQ ID NO: 290246 - RNA, 61 nt, hsa; identical to SEQ ID NO: 108624

SEQ ID NO: 290247 - RNA, 64 nt, hsa; identical to SEQ ID NO: 108625

SEQ ID NO: 290248 - RNA, 64 nt, hsa; identical to SEQ ID NO: 108626

SEQ ID NO: 290249 - RNA, 64 nt, hsa; identical to SEQ ID NO: 108627

SEQ ID NO: 290250 - RNA, 64 nt, hsa; identical to SEQ ID NO: 108628

SEQ ID NO: 290251 - RNA, 64 nt, hsa; identical to SEQ ID NO: 108629

SEQ ID NO: 290252 - RNA, 64 nt, hsa; identical to SEQ ID NO: 108630

SEQ ID NO: 290253 - RNA, 64 nt, hsa; identical to SEQ ID NO: 108631

SEQ ID NO: 290254 - RNA, 64 nt, hsa; identical to SEQ ID NO: 108632

SEQ ID NO: 290255 - RNA, 64 nt, hsa; identical to SEQ ID NO: 108633

SEQ ID NO: 290256 - RNA, 64 nt, hsa; identical to SEQ ID NO: 108634

SEQ ID NO: 290257 - RNA, 64 nt, hsa; identical to SEQ ID NO: 108635

SEQ ID NO: 290258 - RNA, 64 nt, hsa; identical to SEQ ID NO: 108636

SEQ ID NO: 290259 - RNA, 64 nt, hsa; identical to SEQ ID NO: 108637

SEQ ID NO: 290260 - RNA, 64 nt, hsa; identical to SEQ ID NO: 108638

SEQ ID NO: 290261 - RNA, 64 nt, hsa; identical to SEQ ID NO: 108639

SEQ ID NO: 290262 - RNA, 64 nt, hsa; identical to SEQ ID NO: 108640

SEQ ID NO: 290263 - RNA, 64 nt, hsa; identical to SEQ ID NO: 108641

SEQ ID NO: 290264 - RNA, 64 nt, hsa; identical to SEQ ID NO: 108642

SEQ ID NO: 290265 - RNA, 64 nt, hsa; identical to SEQ ID NO: 108643

SEQ ID NO: 290266 - RNA, 64 nt, hsa; identical to SEQ ID NO: 108644

SEQ ID NO: 290267 - RNA, 64 nt, hsa; identical to SEQ ID NO: 108645

SEQ ID NO: 290268 - RNA, 64 nt, hsa; identical to SEQ ID NO: 108646

SEQ ID NO: 290269 - RNA, 64 nt, hsa; identical to SEQ ID NO: 108647

SEQ ID NO: 290270 - RNA, 64 nt, hsa; identical to SEQ ID NO: 108648

SEQ ID NO: 290271 - RNA, 64 nt, hsa; identical to SEQ ID NO: 108649

SEQ ID NO: 290272 - RNA, 64 nt, hsa; identical to SEQ ID NO: 108650

SEQ ID NO: 290273 - RNA, 64 nt, hsa; identical to SEQ ID NO: 108651

SEQ ID NO: 290274 - RNA, 64 nt, hsa; identical to SEQ ID NO: 108652

SEQ ID NO: 290275 - RNA, 64 nt, hsa; identical to SEQ ID NO: 108653

SEQ ID NO: 290276 - RNA, 64 nt, hsa; identical to SEQ ID NO: 108654

SEQ ID NO: 290277 - RNA, 64 nt, hsa; identical to SEQ ID NO: 108655

SEQ ID NO: 290278 - RNA, 64 nt, hsa; identical to SEQ ID NO: 108656

SEQ ID NO: 290279 - RNA, 64 nt, hsa; identical to SEQ ID NO: 108657

SEQ ID NO: 290280 - RNA, 64 nt, hsa; identical to SEQ ID NO: 108658

SEQ ID NO: 290281 - RNA, 64 nt, hsa; identical to SEQ ID NO: 108659

SEQ ID NO: 290282 - RNA, 64 nt, hsa; identical to SEQ ID NO: 108660

SEQ ID NO: 290283 - RNA, 64 nt, hsa; identical to SEQ ID NO: 108661

SEQ ID NO: 290284 - RNA, 64 nt, hsa; identical to SEQ ID NO: 108662

SEQ ID NO: 290285 - RNA, 64 nt, hsa; identical to SEQ ID NO: 108663

SEQ ID NO: 290286 - RNA, 64 nt, hsa; identical to SEQ ID NO: 108664

SEQ ID NO: 290287 - RNA, 64 nt, hsa; identical to SEQ ID NO: 108665

SEQ ID NO: 290288 - RNA, 64 nt, hsa; identical to SEQ ID NO: 108666

SEQ ID NO: 290289 - RNA, 64 nt, hsa; identical to SEQ ID NO: 108667

SEQ ID NO: 290290 - RNA, 64 nt, hsa; identical to SEQ ID NO: 108668

SEQ ID NO: 290291 - RNA, 64 nt, hsa; identical to SEQ ID NO: 108669

SEQ ID NO: 290292 - RNA, 64 nt, hsa; identical to SEQ ID NO: 108670

SEQ ID NO: 290293 - RNA, 64 nt, hsa; identical to SEQ ID NO: 108671

SEQ ID NO: 290294 - RNA, 64 nt, hsa; identical to SEQ ID NO: 108672

SEQ ID NO: 290295 - RNA, 64 nt, hsa; identical to SEQ ID NO: 108673

SEQ ID NO: 290296 - RNA, 64 nt, hsa; identical to SEQ ID NO: 108674

SEQ ID NO: 290297 - RNA, 64 nt, hsa; identical to SEQ ID NO: 108675

SEQ ID NO: 290298 - RNA, 64 nt, hsa; identical to SEQ ID NO: 108676

SEQ ID NO: 290299 - RNA, 64 nt, hsa; identical to SEQ ID NO: 108677

SEQ ID NO: 290300 - RNA, 64 nt, hsa; identical to SEQ ID NO: 108678

SEQ ID NO: 290301 - RNA, 64 nt, hsa; identical to SEQ ID NO: 108679

SEQ ID NO: 290302 - RNA, 64 nt, hsa; identical to SEQ ID NO: 108680

SEQ ID NO: 290303 - RNA, 64 nt, hsa; identical to SEQ ID NO: 108681

SEQ ID NO: 290304 - RNA, 64 nt, hsa; identical to SEQ ID NO: 108682

SEQ ID NO: 290305 - RNA, 64 nt, hsa; identical to SEQ ID NO: 108683

SEQ ID NO: 290306 - RNA, 64 nt, hsa; identical to SEQ ID NO: 108684

SEQ ID NO: 290307 - RNA, 64 nt, hsa; identical to SEQ ID NO: 108685

SEQ ID NO: 290308 - RNA, 64 nt, hsa; identical to SEQ ID NO: 108686

SEQ ID NO: 290309 - RNA, 64 nt, hsa; identical to SEQ ID NO: 108687

SEQ ID NO: 290310 - RNA, 64 nt, hsa; identical to SEQ ID NO: 108688

SEQ ID NO: 290311 - RNA, 64 nt, hsa; identical to SEQ ID NO: 108689

SEQ ID NO: 290312 - RNA, 64 nt, hsa; identical to SEQ ID NO: 108690

SEQ ID NO: 290313 - RNA, 64 nt, hsa; identical to SEQ ID NO: 108691

SEQ ID NO: 290314 - RNA, 64 nt, hsa; identical to SEQ ID NO: 108692

SEQ ID NO: 290315 - RNA, 64 nt, hsa; identical to SEQ ID NO: 108693

SEQ ID NO: 290316 - RNA, 64 nt, hsa; identical to SEQ ID NO: 108694

SEQ ID NO: 290317 - RNA, 64 nt, hsa; identical to SEQ ID NO: 108695

SEQ ID NO: 290318 - RNA, 64 nt, hsa; identical to SEQ ID NO: 108696

SEQ ID NO: 290319 - RNA, 64 nt, hsa; identical to SEQ ID NO: 108697

SEQ ID NO: 290320 - RNA, 64 nt, hsa; identical to SEQ ID NO: 108698

SEQ ID NO: 290321 - RNA, 64 nt, hsa; identical to SEQ ID NO: 108699

SEQ ID NO: 290322 - RNA, 64 nt, hsa; identical to SEQ ID NO: 108700

SEQ ID NO: 290323 - RNA, 64 nt, hsa; identical to SEQ ID NO: 108701

SEQ ID NO: 290324 - RNA, 64 nt, hsa; identical to SEQ ID NO: 108702

SEQ ID NO: 290325 - RNA, 64 nt, hsa; identical to SEQ ID NO: 108703

SEQ ID NO: 290326 - RNA, 64 nt, hsa; identical to SEQ ID NO: 108704

SEQ ID NO: 290327 - RNA, 64 nt, hsa; identical to SEQ ID NO: 108705

SEQ ID NO: 290328 - RNA, 64 nt, hsa; identical to SEQ ID NO: 108706

SEQ ID NO: 290329 - RNA, 64 nt, hsa; identical to SEQ ID NO: 108707

SEQ ID NO: 290330 - RNA, 64 nt, hsa; identical to SEQ ID NO: 108708

SEQ ID NO: 290331 - RNA, 64 nt, hsa; identical to SEQ ID NO: 108709

SEQ ID NO: 290332 - RNA, 64 nt, hsa; identical to SEQ ID NO: 108710

SEQ ID NO: 290333 - RNA, 64 nt, hsa; identical to SEQ ID NO: 108711

SEQ ID NO: 290334 - RNA, 64 nt, hsa; identical to SEQ ID NO: 108712

SEQ ID NO: 290335 - RNA, 64 nt, hsa; identical to SEQ ID NO: 108713

SEQ ID NO: 290336 - RNA, 64 nt, hsa; identical to SEQ ID NO: 108714

SEQ ID NO: 290337 - RNA, 64 nt, hsa; identical to SEQ ID NO: 108715

SEQ ID NO: 290338 - RNA, 64 nt, hsa; identical to SEQ ID NO: 108716

SEQ ID NO: 290339 - RNA, 64 nt, hsa; identical to SEQ ID NO: 108717

SEQ ID NO: 290340 - RNA, 64 nt, hsa; identical to SEQ ID NO: 108718

SEQ ID NO: 290341 - RNA, 64 nt, hsa; identical to SEQ ID NO: 108719

SEQ ID NO: 290342 - RNA, 64 nt, hsa; identical to SEQ ID NO: 108720

SEQ ID NO: 290343 - RNA, 64 nt, hsa; identical to SEQ ID NO: 108721

SEQ ID NO: 290344 - RNA, 64 nt, hsa; identical to SEQ ID NO: 108722

SEQ ID NO: 290345 - RNA, 64 nt, hsa; identical to SEQ ID NO: 108723

SEQ ID NO: 290346 - RNA, 64 nt, hsa; identical to SEQ ID NO: 108724

SEQ ID NO: 290347 - RNA, 64 nt, hsa; identical to SEQ ID NO: 108725

SEQ ID NO: 290348 - RNA, 64 nt, hsa; identical to SEQ ID NO: 108726

SEQ ID NO: 290349 - RNA, 64 nt, hsa; identical to SEQ ID NO: 108727

SEQ ID NO: 290350 - RNA, 64 nt, hsa; identical to SEQ ID NO: 108728

SEQ ID NO: 290351 - RNA, 64 nt, hsa; identical to SEQ ID NO: 108729

SEQ ID NO: 290352 - RNA, 64 nt, hsa; identical to SEQ ID NO: 108730

SEQ ID NO: 290353 - RNA, 64 nt, hsa; identical to SEQ ID NO: 108731

SEQ ID NO: 290354 - RNA, 64 nt, hsa; identical to SEQ ID NO: 108732

SEQ ID NO: 290355 - RNA, 64 nt, hsa; identical to SEQ ID NO: 108733

SEQ ID NO: 290356 - RNA, 64 nt, hsa; identical to SEQ ID NO: 108734

SEQ ID NO: 290357 - RNA, 64 nt, hsa; identical to SEQ ID NO: 108735

SEQ ID NO: 290358 - RNA, 64 nt, hsa; identical to SEQ ID NO: 108736

SEQ ID NO: 290359 - RNA, 64 nt, hsa; identical to SEQ ID NO: 108737

SEQ ID NO: 290360 - RNA, 64 nt, hsa; identical to SEQ ID NO: 108738

SEQ ID NO: 290361 - RNA, 64 nt, hsa; identical to SEQ ID NO: 108739

SEQ ID NO: 290362 - RNA, 64 nt, hsa; identical to SEQ ID NO: 108740

SEQ ID NO: 290363 - RNA, 64 nt, hsa; identical to SEQ ID NO: 108741

SEQ ID NO: 290364 - RNA, 64 nt, hsa; identical to SEQ ID NO: 108742

SEQ ID NO: 290365 - RNA, 64 nt, hsa; identical to SEQ ID NO: 108743

SEQ ID NO: 290366 - RNA, 64 nt, hsa; identical to SEQ ID NO: 108744

SEQ ID NO: 290367 - RNA, 64 nt, hsa; identical to SEQ ID NO: 108745

SEQ ID NO: 290368 - RNA, 64 nt, hsa; identical to SEQ ID NO: 108746

SEQ ID NO: 290369 - RNA, 64 nt, hsa; identical to SEQ ID NO: 108747

SEQ ID NO: 290370 - RNA, 64 nt, hsa; identical to SEQ ID NO: 108748

SEQ ID NO: 290371 - RNA, 64 nt, hsa; identical to SEQ ID NO: 108749

SEQ ID NO: 290372 - RNA, 64 nt, hsa; identical to SEQ ID NO: 108750

SEQ ID NO: 290373 - RNA, 64 nt, hsa; identical to SEQ ID NO: 108751

SEQ ID NO: 290374 - RNA, 64 nt, hsa; identical to SEQ ID NO: 108752

SEQ ID NO: 290375 - RNA, 64 nt, hsa; identical to SEQ ID NO: 108753

SEQ ID NO: 290376 - RNA, 64 nt, hsa; identical to SEQ ID NO: 108754

SEQ ID NO: 290377 - RNA, 64 nt, hsa; identical to SEQ ID NO: 108755

SEQ ID NO: 290378 - RNA, 64 nt, hsa; identical to SEQ ID NO: 108756

SEQ ID NO: 290379 - RNA, 64 nt, hsa; identical to SEQ ID NO: 108757

SEQ ID NO: 290380 - RNA, 64 nt, hsa; identical to SEQ ID NO: 108758

SEQ ID NO: 290381 - RNA, 64 nt, hsa; identical to SEQ ID NO: 108759

SEQ ID NO: 290382 - RNA, 64 nt, hsa; identical to SEQ ID NO: 108760

SEQ ID NO: 290383 - RNA, 64 nt, hsa; identical to SEQ ID NO: 108761

SEQ ID NO: 290384 - RNA, 64 nt, hsa; identical to SEQ ID NO: 108762

SEQ ID NO: 290385 - RNA, 64 nt, hsa; identical to SEQ ID NO: 108763

SEQ ID NO: 290386 - RNA, 64 nt, hsa; identical to SEQ ID NO: 108764

SEQ ID NO: 290387 - RNA, 64 nt, hsa; identical to SEQ ID NO: 108765

SEQ ID NO: 290388 - RNA, 64 nt, hsa; identical to SEQ ID NO: 164887

SEQ ID NO: 290389 - RNA, 64 nt, hsa; identical to SEQ ID NO: 164888

SEQ ID NO: 290390 - RNA, 64 nt, hsa; identical to SEQ ID NO: 164889

SEQ ID NO: 290391 - RNA, 64 nt, hsa; identical to SEQ ID NO: 164890

SEQ ID NO: 290392 - RNA, 64 nt, hsa; identical to SEQ ID NO: 164891

SEQ ID NO: 290393 - RNA, 64 nt, hsa; identical to SEQ ID NO: 164892

SEQ ID NO: 290394 - RNA, 64 nt, hsa; identical to SEQ ID NO: 164893

SEQ ID NO: 290395 - RNA, 64 nt, hsa; identical to SEQ ID NO: 164894

SEQ ID NO: 290396 - RNA, 64 nt, hsa; identical to SEQ ID NO: 164895

SEQ ID NO: 290397 - RNA, 64 nt, hsa; identical to SEQ ID NO: 164896

SEQ ID NO: 290398 - RNA, 64 nt, hsa; identical to SEQ ID NO: 164897

SEQ ID NO: 290399 - RNA, 64 nt, hsa; identical to SEQ ID NO: 164898

SEQ ID NO: 290400 - RNA, 64 nt, hsa; identical to SEQ ID NO: 164899

SEQ ID NO: 290401 - RNA, 64 nt, hsa; identical to SEQ ID NO: 164900

SEQ ID NO: 290402 - RNA, 64 nt, hsa; identical to SEQ ID NO: 164901

SEQ ID NO: 290403 - RNA, 64 nt, hsa; identical to SEQ ID NO: 164902

SEQ ID NO: 290404 - RNA, 64 nt, hsa; identical to SEQ ID NO: 164903

SEQ ID NO: 290405 - RNA, 64 nt, hsa; identical to SEQ ID NO: 164904

SEQ ID NO: 290406 - RNA, 64 nt, hsa; identical to SEQ ID NO: 164905

SEQ ID NO: 290407 - RNA, 64 nt, hsa; identical to SEQ ID NO: 164906

SEQ ID NO: 290408 - RNA, 64 nt, hsa; identical to SEQ ID NO: 164907

SEQ ID NO: 290409 - RNA, 64 nt, hsa; identical to SEQ ID NO: 164908

SEQ ID NO: 290410 - RNA, 64 nt, hsa; identical to SEQ ID NO: 164909

SEQ ID NO: 290411 - RNA, 64 nt, hsa; identical to SEQ ID NO: 164910

SEQ ID NO: 290412 - RNA, 64 nt, hsa; identical to SEQ ID NO: 164911

SEQ ID NO: 290413 - RNA, 64 nt, hsa; identical to SEQ ID NO: 164912

SEQ ID NO: 290414 - RNA, 64 nt, hsa; identical to SEQ ID NO: 164913

SEQ ID NO: 290415 - RNA, 64 nt, hsa; identical to SEQ ID NO: 164914

SEQ ID NO: 290416 - RNA, 64 nt, hsa; identical to SEQ ID NO: 164915

SEQ ID NO: 290417 - RNA, 64 nt, hsa; identical to SEQ ID NO: 164916

SEQ ID NO: 290418 - RNA, 64 nt, hsa; identical to SEQ ID NO: 164917

SEQ ID NO: 290419 - RNA, 64 nt, hsa; identical to SEQ ID NO: 164918

SEQ ID NO: 290420 - RNA, 64 nt, hsa; identical to SEQ ID NO: 164919

SEQ ID NO: 290421 - RNA, 64 nt, hsa; identical to SEQ ID NO: 164920

SEQ ID NO: 290422 - RNA, 64 nt, hsa; identical to SEQ ID NO: 164921

SEQ ID NO: 290423 - RNA, 64 nt, hsa; identical to SEQ ID NO: 164922

SEQ ID NO: 290424 - RNA, 64 nt, hsa; identical to SEQ ID NO: 164923

SEQ ID NO: 290425 - RNA, 64 nt, hsa; identical to SEQ ID NO: 164924

SEQ ID NO: 290426 - RNA, 64 nt, hsa; identical to SEQ ID NO: 164925

SEQ ID NO: 290427 - RNA, 64 nt, hsa; identical to SEQ ID NO: 164926

SEQ ID NO: 290428 - RNA, 64 nt, hsa; identical to SEQ ID NO: 164927

SEQ ID NO: 290429 - RNA, 64 nt, hsa; identical to SEQ ID NO: 164928

SEQ ID NO: 290430 - RNA, 64 nt, hsa; identical to SEQ ID NO: 164929

SEQ ID NO: 290431 - RNA, 64 nt, hsa; identical to SEQ ID NO: 164930

SEQ ID NO: 290432 - RNA, 64 nt, hsa; identical to SEQ ID NO: 164931

SEQ ID NO: 290433 - RNA, 64 nt, hsa; identical to SEQ ID NO: 164932

SEQ ID NO: 290434 - RNA, 64 nt, hsa; identical to SEQ ID NO: 164933

SEQ ID NO: 290435 - RNA, 64 nt, hsa; identical to SEQ ID NO: 164934

SEQ ID NO: 290436 - RNA, 64 nt, hsa; identical to SEQ ID NO: 164935

SEQ ID NO: 290437 - RNA, 64 nt, hsa; identical to SEQ ID NO: 164936

SEQ ID NO: 290438 - RNA, 64 nt, hsa; identical to SEQ ID NO: 164937

SEQ ID NO: 290439 - RNA, 64 nt, hsa; identical to SEQ ID NO: 164938

SEQ ID NO: 290440 - RNA, 64 nt, hsa; identical to SEQ ID NO: 164939

SEQ ID NO: 290441 - RNA, 64 nt, hsa; identical to SEQ ID NO: 164940

SEQ ID NO: 290442 - RNA, 64 nt, hsa; identical to SEQ ID NO: 164941

SEQ ID NO: 290443 - RNA, 64 nt, hsa; identical to SEQ ID NO: 164942

SEQ ID NO: 290444 - RNA, 64 nt, hsa; identical to SEQ ID NO: 164943

SEQ ID NO: 290445 - RNA, 64 nt, hsa; identical to SEQ ID NO: 164944

SEQ ID NO: 290446 - RNA, 64 nt, hsa; identical to SEQ ID NO: 164945

SEQ ID NO: 290447 - RNA, 64 nt, hsa; identical to SEQ ID NO: 164946

SEQ ID NO: 290448 - RNA, 64 nt, hsa; identical to SEQ ID NO: 164947

SEQ ID NO: 290449 - RNA, 64 nt, hsa; identical to SEQ ID NO: 164948

SEQ ID NO: 290450 - RNA, 64 nt, hsa; identical to SEQ ID NO: 164949

SEQ ID NO: 290451 - RNA, 64 nt, hsa; identical to SEQ ID NO: 164950

SEQ ID NO: 290452 - RNA, 64 nt, hsa; identical to SEQ ID NO: 164951

SEQ ID NO: 290453 - RNA, 64 nt, hsa; identical to SEQ ID NO: 164952

SEQ ID NO: 290454 - RNA, 64 nt, hsa; identical to SEQ ID NO: 164953

SEQ ID NO: 290455 - RNA, 64 nt, hsa; identical to SEQ ID NO: 164954

SEQ ID NO: 290456 - RNA, 64 nt, hsa; identical to SEQ ID NO: 164955

SEQ ID NO: 290457 - RNA, 64 nt, hsa; identical to SEQ ID NO: 164956

SEQ ID NO: 290458 - RNA, 64 nt, hsa; identical to SEQ ID NO: 164957

SEQ ID NO: 290459 - RNA, 64 nt, hsa; identical to SEQ ID NO: 164958

SEQ ID NO: 290460 - RNA, 64 nt, hsa; identical to SEQ ID NO: 164959

SEQ ID NO: 290461 - RNA, 64 nt, hsa; identical to SEQ ID NO: 164960

SEQ ID NO: 290462 - RNA, 64 nt, hsa; identical to SEQ ID NO: 164961

SEQ ID NO: 290463 - RNA, 64 nt, hsa; identical to SEQ ID NO: 164962

SEQ ID NO: 290464 - RNA, 64 nt, hsa; identical to SEQ ID NO: 164963

SEQ ID NO: 290465 - RNA, 64 nt, hsa; identical to SEQ ID NO: 164964

SEQ ID NO: 290466 - RNA, 64 nt, hsa; identical to SEQ ID NO: 164965

SEQ ID NO: 290467 - RNA, 64 nt, hsa; identical to SEQ ID NO: 164966

SEQ ID NO: 290468 - RNA, 64 nt, hsa; identical to SEQ ID NO: 164967

SEQ ID NO: 290469 - RNA, 64 nt, hsa; identical to SEQ ID NO: 164967

SEQ ID NO: 290470 - RNA, 64 nt, hsa; identical to SEQ ID NO: 164969

SEQ ID NO: 290471 - RNA, 64 nt, hsa; identical to SEQ ID NO: 164970

SEQ ID NO: 290472 - RNA, 64 nt, hsa; identical to SEQ ID NO: 164971

SEQ ID NO: 290473 - RNA, 64 nt, hsa; identical to SEQ ID NO: 164972

SEQ ID NO: 290474 - RNA, 64 nt, hsa; identical to SEQ ID NO: 164973

SEQ ID NO: 290475 - RNA, 64 nt, hsa; identical to SEQ ID NO: 164974

SEQ ID NO: 290476 - RNA, 64 nt, hsa; identical to SEQ ID NO: 164975

SEQ ID NO: 290477 - RNA, 64 nt, hsa; identical to SEQ ID NO: 164976

SEQ ID NO: 290478 - RNA, 64 nt, hsa; identical to SEQ ID NO: 164977

SEQ ID NO: 290479 - RNA, 64 nt, hsa; identical to SEQ ID NO: 164978

SEQ ID NO: 290480 - RNA, 64 nt, hsa; identical to SEQ ID NO: 164979

SEQ ID NO: 290481 - RNA, 64 nt, hsa; identical to SEQ ID NO: 164980

SEQ ID NO: 290482 - RNA, 64 nt, hsa; identical to SEQ ID NO: 164981

SEQ ID NO: 290483 - RNA, 64 nt, hsa; identical to SEQ ID NO: 164982

SEQ ID NO: 290484 - RNA, 64 nt, hsa; identical to SEQ ID NO: 164983

SEQ ID NO: 290485 - RNA, 64 nt, hsa; identical to SEQ ID NO: 164984

SEQ ID NO: 290486 - RNA, 64 nt, hsa; identical to SEQ ID NO: 164985

SEQ ID NO: 290487 - RNA, 64 nt, hsa; identical to SEQ ID NO: 164986

SEQ ID NO: 290488 - RNA, 64 nt, hsa; identical to SEQ ID NO: 164987

SEQ ID NO: 290489 - RNA, 64 nt, hsa; identical to SEQ ID NO: 164988

SEQ ID NO: 290490 - RNA, 64 nt, hsa; identical to SEQ ID NO: 164989

SEQ ID NO: 290491 - RNA, 64 nt, hsa; identical to SEQ ID NO: 164990

SEQ ID NO: 290492 - RNA, 64 nt, hsa; identical to SEQ ID NO: 164991

SEQ ID NO: 290493 - RNA, 64 nt, hsa; identical to SEQ ID NO: 164992

SEQ ID NO: 290494 - RNA, 64 nt, hsa; identical to SEQ ID NO: 164993

SEQ ID NO: 290495 - RNA, 64 nt, hsa; identical to SEQ ID NO: 164994

SEQ ID NO: 290496 - RNA, 64 nt, hsa; identical to SEQ ID NO: 164995

SEQ ID NO: 290497 - RNA, 64 nt, hsa; identical to SEQ ID NO: 164996

SEQ ID NO: 290498 - RNA, 64 nt, hsa; identical to SEQ ID NO: 164997

SEQ ID NO: 290499 - RNA, 64 nt, hsa; identical to SEQ ID NO: 164998

SEQ ID NO: 290500 - RNA, 64 nt, hsa; identical to SEQ ID NO: 164999

SEQ ID NO: 290501 - RNA, 64 nt, hsa; identical to SEQ ID NO: 165000

SEQ ID NO: 290502 - RNA, 64 nt, hsa; identical to SEQ ID NO: 165001

SEQ ID NO: 290503 - RNA, 64 nt, hsa; identical to SEQ ID NO: 165002

SEQ ID NO: 290504 - RNA, 64 nt, hsa; identical to SEQ ID NO: 165003

SEQ ID NO: 290505 - RNA, 64 nt, hsa; identical to SEQ ID NO: 165004

SEQ ID NO: 290506 - RNA, 64 nt, hsa; identical to SEQ ID NO: 165005

SEQ ID NO: 290507 - RNA, 64 nt, hsa; identical to SEQ ID NO: 165006

SEQ ID NO: 290508 - RNA, 64 nt, hsa; identical to SEQ ID NO: 165007

SEQ ID NO: 290509 - RNA, 64 nt, hsa; identical to SEQ ID NO: 165008

SEQ ID NO: 290510 - RNA, 64 nt, hsa; identical to SEQ ID NO: 165009

SEQ ID NO: 290511 - RNA, 64 nt, hsa; identical to SEQ ID NO: 165010

SEQ ID NO: 290512 - RNA, 64 nt, hsa; identical to SEQ ID NO: 165011

SEQ ID NO: 290513 - RNA, 64 nt, hsa; identical to SEQ ID NO: 165012

SEQ ID NO: 290514 - RNA, 64 nt, hsa; identical to SEQ ID NO: 165013

SEQ ID NO: 290515 - RNA, 64 nt, hsa; identical to SEQ ID NO: 165014

SEQ ID NO: 290516 - RNA, 64 nt, hsa; identical to SEQ ID NO: 165015

SEQ ID NO: 290517 - RNA, 64 nt, hsa; identical to SEQ ID NO: 165016

SEQ ID NO: 290518 - RNA, 64 nt, hsa; identical to SEQ ID NO: 165017

SEQ ID NO: 290519 - RNA, 64 nt, hsa; identical to SEQ ID NO: 165018

SEQ ID NO: 290520 - RNA, 64 nt, hsa; identical to SEQ ID NO: 165019

SEQ ID NO: 290521 - RNA, 64 nt, hsa; identical to SEQ ID NO: 165020

SEQ ID NO: 290522 - RNA, 64 nt, hsa; identical to SEQ ID NO: 165021

SEQ ID NO: 290523 - RNA, 64 nt, hsa; identical to SEQ ID NO: 165022

SEQ ID NO: 290524 - RNA, 64 nt, hsa; identical to SEQ ID NO: 165023

SEQ ID NO: 290525 - RNA, 64 nt, hsa; identical to SEQ ID NO: 165024

SEQ ID NO: 290526 - RNA, 64 nt, hsa; identical to SEQ ID NO: 165025

SEQ ID NO: 290527 - RNA, 64 nt, hsa; identical to SEQ ID NO: 165026

SEQ ID NO: 290528 - RNA, 64 nt, hsa; identical to SEQ ID NO: 165027

SEQ ID NO: 290529 - RNA, 64 nt, hsa; identical to SEQ ID NO: 165028

SEQ ID NO: 290530 - RNA, 64 nt, hsa; identical to SEQ ID NO: 165029

SEQ ID NO: 290531 - RNA, 64 nt, hsa; identical to SEQ ID NO: 165030

SEQ ID NO: 290532 - RNA, 64 nt, hsa; identical to SEQ ID NO: 165031

SEQ ID NO: 290533 - RNA, 64 nt, hsa; identical to SEQ ID NO: 165032

SEQ ID NO: 290534 - RNA, 64 nt, hsa; identical to SEQ ID NO: 165033

SEQ ID NO: 290535 - RNA, 64 nt, hsa; identical to SEQ ID NO: 165034

SEQ ID NO: 290536 - RNA, 64 nt, hsa; identical to SEQ ID NO: 165035

SEQ ID NO: 290537 - RNA, 64 nt, hsa; identical to SEQ ID NO: 165036

SEQ ID NO: 290538 - RNA, 64 nt, hsa; identical to SEQ ID NO: 165037

SEQ ID NO: 290539 - RNA, 64 nt, hsa; identical to SEQ ID NO: 165038

SEQ ID NO: 290540 - RNA, 64 nt, hsa; identical to SEQ ID NO: 165039

SEQ ID NO: 290541 - RNA, 64 nt, hsa; identical to SEQ ID NO: 165040

SEQ ID NO: 290542 - RNA, 64 nt, hsa; identical to SEQ ID NO: 165041

SEQ ID NO: 290543 - RNA, 64 nt, hsa; identical to SEQ ID NO: 165042

SEQ ID NO: 290544 - RNA, 64 nt, hsa; identical to SEQ ID NO: 165043

SEQ ID NO: 290545 - RNA, 64 nt, hsa; identical to SEQ ID NO: 165044

SEQ ID NO: 290546 - RNA, 64 nt, hsa; identical to SEQ ID NO: 165045

SEQ ID NO: 290547 - RNA, 64 nt, hsa; identical to SEQ ID NO: 165046

SEQ ID NO: 290548 - RNA, 64 nt, hsa
ugguuuuucccaccccagcugccccagcacgcgggacccauagcacaccccuuagcgcuugccu

SEQ ID NO: 290549 - RNA, 64 nt, hsa
caggaaggaagcacaaaagacaagcauugggucagacccauaaaccaccucccaaaggcuguca

SEQ ID NO: 290550 - RNA, 64 nt, hsa
uggggauuguuugcuuuuuaaguaaaacacuucugacccauagcucaguaugucugaauuccag

SEQ ID NO: 290551 - RNA, 64 nt, hsa
uuuacaaagucuacuuuuuguucaaggauaugcugacccauauaguuuacucuuaaaauugugu

SEQ ID NO: 290552 - RNA, 64 nt, hsa
uuuucuuucucucuugccagaauguauucauguugacccauaagacauuaucauuuuuauaagu

SEQ ID NO: 290553 - RNA, 64 nt, hsa
acuacccuagggcacuuucucuuugagguggagagacccauaaagccuugaccacaucacucca

SEQ ID NO: 290554 - RNA, 57 nt, hsa; identical to SEQ ID NO: 50453

SEQ ID NO: 290555 - RNA, 64 nt, hsa
uccaaaaacaucuauuugugaccuuaaacauguggacccauaggugcaguuagaaaaagacaac

SEQ ID NO: 290556 - RNA, 64 nt, hsa
gaauaaauuaugaagcauacuaaugaguaccuaugacccauaacacauauacauuaaaacauuu

SEQ ID NO: 290557 - RNA, 64 nt, hsa
uguugugaagccauuaauauaaaucuuugguaaugacccauaucucuauauguauguguuccca

SEQ ID NO: 290558 - RNA, 64 nt, hsa
aauaauauauccuaugcugauuuucccaaaacaugacccauaguauuaaauacauaucauuuuu

SEQ ID NO: 290559 - RNA, 64 nt, hsa
ccaaguucaaauaaaauuuuuauaaucggauucagacccauaaccaaacuauguugguaguaga

SEQ ID NO: 290560 - RNA, 64 nt, hsa
aaaaauaauuucaucagguuuuuuguauguuacugacccauauggauuuuaguaacaucuugcu

SEQ ID NO: 290561 - RNA, 64 nt, hsa
agccucaauauuugucugaagacacuuaaauucugacccauaaaggaaaguucuagaagcaaua

SEQ ID NO: 290562 - RNA, 64 nt, hsa
gaaaaacucuugcuaccuguauuacuugaucucagacccauaccugaugguucagucuguccuu

SEQ ID NO: 290563 - RNA, 64 nt, hsa
gaaugucauucucaaugcccagauccugagauuggacccauacccugucuccaacccugccuug

SEQ ID NO: 290564 - RNA, 64 nt, hsa
uccaacccugacugcccacuccuccacaaaccgugacccauagccgcccccaccccauaccuug

SEQ ID NO: 290565 - RNA, 64 nt, hsa
ccuagucagggaggggauggcgguccuuugauaagacccauaggcaaacuucgagcccaucagc

SEQ ID NO: 290566 - RNA, 64 nt, hsa
uccuguugaccuucccacacaaucccuguacucugacccauagcacucuuguuugcuuugaaaa

SEQ ID NO: 290567 - RNA, 64 nt, hsa
uuauccacguguggauuauccaccaugccaggaagacccauaacugguuuuaacacuaacuaga

SEQ ID NO: 290568 - RNA, 64 nt, hsa
ggccagcacacugcuaaccagucaccaaauguaagacccauaagaaacccauauuuaaaaaucu

SEQ ID NO: 290569 - RNA, 64 nt, hsa
uuucaaaaacaaaucagaagcagaugcugauugggacccauauaccacguugcugacucacguu

SEQ ID NO: 290570 - RNA, 64 nt, hsa
uacaucuacaaguaaguacagcugaaauucagaggacccauaagaguucacaugaaaaaaauca

SEQ ID NO: 290571 - RNA, 64 nt, hsa
cugugucccagacagauccccuaggccuaucugagacccauacaggcccacaccugagcuccug

SEQ ID NO: 290572 - RNA, 64 nt, hsa
ugauuacguguauguuucuucuuucuuuuaagcagacccauaccuuuccagggucaaaguacag

SEQ ID NO: 290573 - RNA, 64 nt, hsa
uccuaaccauuucuacuacaguuuuuuccuuauggacccauacuagguuguacaaaccuuaagg

SEQ ID NO: 290574 - RNA, 64 nt, hsa
gaucuaccuugguaggagggagucaguacuguuggacccauagguagccucaucccugccacug

SEQ ID NO: 290575 - RNA, 64 nt, hsa
ucaauggugagcagacugcaaaucugccugauaggacccauauucccacagcacuaauucaaca

SEQ ID NO: 290576 - RNA, 64 nt, hsa
caaauaaguugucuuuacugaaaaaugaagugaagacccauauaugcaguuaaaaaaaaguuaa

SEQ ID NO: 290577 - RNA, 64 nt, hsa
cuccuccuccucuuccccucccucuuucauuggugacccauaaccccaagucccagcccagaac

SEQ ID NO: 290578 - RNA, 64 nt, hsa
aauuuaugugauguggauugcugguguccagcaugacccauaaacaggucagaagaaugaugga

SEQ ID NO: 290579 - RNA, 64 nt, hsa
aaggaacagaaacaacuuugcauugcauuggcuugacccauaaacuaaguuauauccgugggca

SEQ ID NO: 290580 - RNA, 64 nt, hsa
ucuuuaaaacaucuacccuaaaccaucugcuauggacccauaauaagaggccuguuguauauga

SEQ ID NO: 290581 - RNA, 64 nt, hsa
aauccccuugucgaaaacuagaaaaaaaggaguugacccauauaaauuaucucuaacgucuuug

SEQ ID NO: 290582 - RNA, 64 nt, hsa
acgucugcucaggaaguggggccagcuccacugggacccauaguuuuacuuccuugucauuuga

SEQ ID NO: 290583 - RNA, 64 nt, hsa
uuagacaaaggcucuacacauacugcaugcucaggacccauagaugaacuauuagacaugaaau

SEQ ID NO: 290584 - RNA, 64 nt, hsa
uucuucauucuccuucuucuccuucuuccacaaagacccauaucuggagaagguguacaacuuu

SEQ ID NO: 290585 - RNA, 64 nt, hsa
aagguucuuucauucaagaucaucauucuugacagacccauaaauauuuccuauaaagacugua

SEQ ID NO: 290586 - RNA, 64 nt, hsa
uugagaaccaggagacacguguggcgggcagugggacccauagaucuucugaaaugaaacaaau

SEQ ID NO: 290587 - RNA, 64 nt, hsa
uugagugucauuaguuacuuuauugaagguuuuagacccauagcagcuuugucucugucacauc

SEQ ID NO: 290588 - RNA, 64 nt, hsa
uaacgcgcggccggggcgggagagacucagcaacgacccauaccucagacccgacggcccggag

SEQ ID NO: 290589 - RNA, 64 nt, hsa
acagaaugauuuccaaaauugcaaaccacgccaugacccauauacgccaaguaagauuuuaaaa

SEQ ID NO: 290590 - RNA, 64 nt, hsa
auuuuuucucccgucuucaaugaccucccauuuggacccauaguuuauuuauagagagcacaca

SEQ ID NO: 290591 - RNA, 64 nt, hsa
auguguaaacauagggugccuaccuauuucaccugacccauacucguuucugauucagaaucag

SEQ ID NO: 290592 - RNA, 64 nt, hsa
aggcuucucaccuguggccaacuucacuuuguaagacccauauuuuuaacucuucccagggaaa

SEQ ID NO: 290593 - RNA, 64 nt, hsa
uggcuugaagacaaauggucuuagaauucauugagacccauagcuucauauggcugcuccagcc

SEQ ID NO: 290594 - RNA, 64 nt, hsa
guacuuuuauuaauauuuaacauaauuaaagauggacccauaagagugacgccuguggagcgcg

SEQ ID NO: 290595 - RNA, 64 nt, hsa
ucucuuacuguacugucuaucugcaguaauugaggacccauaaaauuuagauaacuacaugucu

SEQ ID NO: 290596 - RNA, 64 nt, hsa
aagaaaccccaaacucaggccgaaugaucaaggggacccauaggaaaucuuguccagagacaag

SEQ ID NO: 290597 - RNA, 64 nt, hsa
ccucguucccuacccuaaaauucuaaggggaagggacccauagaggcuugccuguuuccgcuac

SEQ ID NO: 290598 - RNA, 64 nt, hsa
aggugcccuguagaacucuguuacacauauuuuugacccauauuauuuacaaugucuugauaau

SEQ ID NO: 290599 - RNA, 64 nt, hsa
gccucuugcuugaaugugauuucuuucucccugagacccauaagguucaucuuaugggaccuua

SEQ ID NO: 290600 - RNA, 64 nt, hsa
ccuguaauaguuucaguuccuauuuucuuccauugacccauauuuauaccuuucagguacugaa

SEQ ID NO: 290601 - RNA, 64 nt, hsa
ucucuccuacucucaguggucagaggcuguguuggacccauaguagaauuuuccaggucacaga

SEQ ID NO: 290602 - RNA, 64 nt, hsa
cauuaggaaaaugcacauauuccaugaauuuuaagacccauagaaaaguugaagaaugcuuaau

SEQ ID NO: 290603 - RNA, 64 nt, hsa
ugccaaagucucccuucuguuucuucagcacauugacccauagcacacacauacacaccaccac

SEQ ID NO: 290604 - RNA, 64 nt, hsa
gccgugugacgguggccuuggaggacccagcacugacccauagagggcuccucucagaugggca

SEQ ID NO: 290605 - RNA, 64 nt, hsa
aguuggguagagaagccagcagggggcagcgugggacccauaucccagccccaggcggaccaga

SEQ ID NO: 290606 - RNA, 64 nt, hsa
uuuaauaggaaaaugcuaaggaggccucauaaaugacccauaauuaccaacguagaauuuuuca

SEQ ID NO: 290607 - RNA, 64 nt, hsa
caucagagaugggaaaaccauuggggaggacuaggacccauaugggaauuauuaccucucaggg

SEQ ID NO: 290608 - RNA, 64 nt, hsa
ucccugcuaccuuaguucugcaugagaaucagcugacccauacagacuugaaaccagagaacau

SEQ ID NO: 290609 - RNA, 64 nt, hsa
cggcggcccuucucagccccucccuccauggagggacccauagggcuagacacuuugaggcaag

SEQ ID NO: 290610 - RNA, 64 nt, hsa
uuuccgagagcguucaguguuucacugaagacaggacccauagccuucauuucuggcucugugu

SEQ ID NO: 290611 - RNA, 64 nt, hsa
cugaacucuguugauaauaccacaccauguucuggacccauagcucuggcauccucagggguug

SEQ ID NO: 290612 - RNA, 64 nt, hsa
gucugggaguuuuucuguguggggaggagacagagacccauaacuaaauaugcucuguguaaag

SEQ ID NO: 290613 - RNA, 64 nt, hsa
guguucucaggccccccugcuuuugucucaccaggacccauaccuuucaccuuguucccuucca

SEQ ID NO: 290614 - RNA, 64 nt, hsa
cucuuaucauuuugaaaugggcucuugauuaauagacccauauuuuuuaguggcuucuauguug

SEQ ID NO: 290615 - RNA, 64 nt, hsa
agcugcugcuuuuucuugguccuuggggcuggcagacccauagaccauggccuguuaggaggcg

SEQ ID NO: 290616 - RNA, 64 nt, hsa
aaacuagugagagugccaagugcuuuuuagaaaggacccauauguuaucaaacuuugaaauuga

SEQ ID NO: 290617 - RNA, 64 nt, hsa
cuacagaaguuggguauugucugaaaucccagaggacccauaagugccggugacaagcugucug

SEQ ID NO: 290618 - RNA, 64 nt, hsa
cuccacgggaaagaggucgauggauuuaccccuggacccauaagucuguucauccugcugaagu

SEQ ID NO: 290619 - RNA, 64 nt, hsa
gccccaacuucccaaagagcagcaucccucccccgacccauagccauguuuuaaagucaccuuc

SEQ ID NO: 290620 - RNA, 64 nt, hsa
gggggaugggauccuagguagggccaggggaggagacccauaaauguucccuuggggguguuga

SEQ ID NO: 290621 - RNA, 64 nt, hsa
aggucuuaauccuaucuauggauguguuuugugugacccauacaguguuguaaaaaacacuuag

SEQ ID NO: 290622 - RNA, 64 nt, hsa
gaggugcagcgggucacccuguggcccguccugugacccauauuuagccguguuugggacuccg

SEQ ID NO: 290623 - RNA, 64 nt, hsa
ugaggaaguaagucagggcgggcuuugagaaggggacccauauccuacaggcaaaaagcaggcu

SEQ ID NO: 290624 - RNA, 64 nt, hsa
guaaagguugaauuauauuuucccccauauuauugacccauagugacaccaguuuugggagaug

SEQ ID NO: 290625 - RNA, 64 nt, hsa
gcguucccaaagauccacccaaauaucaaacacggacccauagacagcccugggggagccucuu

SEQ ID NO: 290626 - RNA, 64 nt, hsa
cuuaaauaaggaagaggcccagauugugaagacggacccauauaucccuaccucccaccaccua

SEQ ID NO: 290627 - RNA, 64 nt, hsa
agugcugggauuacaggugugagccaccacaccugacccauaggucuucaauaaauauuuaaug

SEQ ID NO: 290628 - RNA, 64 nt, hsa
ggagguaaagcuguugggggaagaagaguuuuuggacccauagauguuuggaugaugucucuaa

SEQ ID NO: 290629 - RNA, 64 nt, hsa
ugguuuuagcaggggaggggaccugcuaagcugagacccauaguccugcucagaguuaucccaa

SEQ ID NO: 290630 - RNA, 64 nt, hsa
ucacacgccugccagaagcuggaggggugcuggagacccauagagcugaugggagcagcuggug

SEQ ID NO: 290631 - RNA, 64 nt, hsa
caacuccagugggaaagaaagagcuuuauuuacagacccauaaaaaucccaucagugucguccc

SEQ ID NO: 290632 - RNA, 64 nt, hsa
agaagcccuaauaucuauaauuugaacuguacuggacccauaguuuuaacugaaaagggccaaa

SEQ ID NO: 290633 - RNA, 64 nt, hsa
agccagaggcaucuuuugagccauacgaauuccugacccauagaaacugcaagacaauaaaugu

SEQ ID NO: 290634 - RNA, 64 nt, hsa
cuguuuauaguauccauccugaaccauucguuuugacccauaauaauagugauaguauaauggc

SEQ ID NO: 290635 - RNA, 64 nt, hsa
cuggaaacugucgacggccauccacuuauuaauggacccauaacuaaggaaacaucaccugucc

SEQ ID NO: 290636 - RNA, 64 nt, hsa
cacugucggaguucuaucacuugcuugaccccuggacccauaaaccaguccacuguuauacccg

SEQ ID NO: 290637 - RNA, 64 nt, hsa; identical to SEQ ID NO: 238083

SEQ ID NO: 290638 - RNA, 64 nt, hsa; identical to SEQ ID NO: 238084

SEQ ID NO: 290639 - RNA, 64 nt, hsa; identical to SEQ ID NO: 238085

SEQ ID NO: 290640 - RNA, 64 nt, hsa; identical to SEQ ID NO: 238086

SEQ ID NO: 290641 - RNA, 64 nt, hsa; identical to SEQ ID NO: 238087

SEQ ID NO: 290642 - RNA, 64 nt, hsa; identical to SEQ ID NO: 238088

SEQ ID NO: 290643 - RNA, 64 nt, hsa; identical to SEQ ID NO: 238089

SEQ ID NO: 290644 - RNA, 64 nt, hsa; identical to SEQ ID NO: 238090

SEQ ID NO: 290645 - RNA, 64 nt, hsa
uacaguccuccuucaccuuacucuguauuuauauuacccauaacuagcaagaaguucuuguucu

SEQ ID NO: 290646 - RNA, 64 nt, hsa
uugucacuucagugcaguacauuuuucugaaagcuacccauaaaaucacuuucaucucaccuac

SEQ ID NO: 290647 - RNA, 64 nt, hsa
gaccaagguguucuucccaaagaccaaaauauucuacccauaugucaggaccaggauuuucuac

SEQ ID NO: 290648 - RNA, 64 nt, hsa
gaccaagguuaucuuccuaaagaccaaaauauucuacccauaugucaggaccgggauuuucuac

SEQ ID NO: 290649 - RNA, 64 nt, hsa
ugaaagggauuccucccacgccagaucugcacaacgaggcaagacaggacccaccugugcgugc

SEQ ID NO: 290650 - RNA, 64 nt, hsa
ccgcccacccucugcuagacacagccaaggccaacgaggcaagcagaagcagcggccgcagcga

SEQ ID NO: 290651 - RNA, 64 nt, hsa
cuucuaaccaaacuaauuuuucacuguugacaagcgaggcaaggguugcacuggaccaaaggcu

SEQ ID NO: 290652 - RNA, 64 nt, hsa
uuuuagauauuacauuuugcuuuuaugacauucacgaggcaaaaaauaaaauaucuuuuuuuga

SEQ ID NO: 290653 - RNA, 64 nt, hsa
gaggccugcuuuucacaccucaguuuauuuaauacgaggcaaguuguaagacaacacucauucu

SEQ ID NO: 290654 - RNA, 64 nt, hsa
gcuuugcucuuucaaaacagaaccuccaggcugacgaggcaagacaaagccucccaccagacuu

SEQ ID NO: 290655 - RNA, 64 nt, hsa
gcuauucuugucuccauuuuaguguugaggaaaacgaggcaaagagagguuauacaacuugccu

SEQ ID NO: 290656 - RNA, 64 nt, hsa
agggcuaagggagggggcgcuggagcuuccaacccgaggcaauaaaagaaauguugcguaacuc

SEQ ID NO: 290657 - RNA, 64 nt, hsa
aggccucaaaaacauacguaacgaaaaggccuagcgaggcaaauucugauugauuugaaucuau

SEQ ID NO: 290658 - RNA, 64 nt, hsa
uaauugccuuaauuuuaaggacgucaaaggcucucgaggcaagcugucaacgucuuguugaaaa

SEQ ID NO: 290659 - RNA, 64 nt, hsa
auuuuuaaucugacuauggcauaacauuacaagacgaggcaaaaauauuuaacccccaaauaua

SEQ ID NO: 290660 - RNA, 64 nt, hsa
acggucauauguguucaacggugacuuuguggaucgaggcaaggauucaguagagauccugaug

SEQ ID NO: 290661 - RNA, 64 nt, hsa
uuauuggcaacuuauggacucgcuagugauuaaacgaggcaaugacugugagcgagccuggcag

SEQ ID NO: 290662 - RNA, 64 nt, hsa
ucaguaccagaagugucuuguggccucugcagcucgaggcaaggccuggggugcccaggcccgu

SEQ ID NO: 290663 - RNA, 64 nt, hsa
gcaggagggcaggauccagcagcacuggggaugccgaggcaaugcuguacuugaagccagagga

SEQ ID NO: 290664 - RNA, 64 nt, hsa
auccucauucccuauguccacuugccuuccucuccgaggcaacuacucuaaugcauuugguaug

SEQ ID NO: 290665 - RNA, 64 nt, hsa
uggugcgcgagagcguauccccaacugggacuuccgaggcaacuugaacucagaacacuacagc

SEQ ID NO: 290666 - RNA, 64 nt, hsa
gcagcacugcagugccaggaggcaggcggggaaccgaggcaaaggcugcccaucucccccugcc

SEQ ID NO: 290667 - RNA, 64 nt, hsa
uuucuaagugugaaaaacccucacagaaagucaucgaggcaaaaagaggcaggcaguggagucu

SEQ ID NO: 290668 - RNA, 64 nt, hsa
cgcucacaccuauaauccuaggaucuugggaggucgaggcaagcugaucgcuugagcccaggag

SEQ ID NO: 290669 - RNA, 50 nt, hsa
cgguuugcacaaugguauaacgaggcaaccuuugccuucuucagaagcuu

SEQ ID NO: 290670 - RNA, 64 nt, hsa
ugucccucucuggucaaacaacauacuaaagaggcgaggcaaugacuguuggccaguucucacc

SEQ ID NO: 290671 - RNA, 64 nt, hsa
cucccucuuuaggucggagauuggccuugccugucgaggcaagaggcugcagaggcggggacac

SEQ ID NO: 290672 - RNA, 64 nt, hsa
uuucugcagcuuagcuuguguccugcccuccgcccgaggcaaaacguauccugaggacuucuuc

SEQ ID NO: 290673 - RNA, 64 nt, hsa
gaacucgaagcccacaauccucgucugaaucauccgaggcaaagagaaaagccacggaccguug

SEQ ID NO: 290674 - RNA, 64 nt, hsa
ugaaaauuugcucggguguguagcaguaauuacacgaggcaaacaguuccaaaacuguucuuuu

SEQ ID NO: 290675 - RNA, 64 nt, hsa
ugcucuaauuugagugaaauaaaaguuauuagugcgaggcaaacauaaaaaaaaaaaguccaug

SEQ ID NO: 290676 - RNA, 64 nt, hsa
cuuccugcugcugcucucccuggacgaccggccucgaggcaacccuggggcccaccagccccug

SEQ ID NO: 290677 - RNA, 64 nt, hsa
ccuaguaguucccugggccuguuuuucuauaaaacgaggcaacuggacuguuagugguuuucaa

SEQ ID NO: 290678 - RNA, 64 nt, hsa
acuccugucugcauucccaaauuuggcucugagucgaggcaaccugcacacaagaccccaccaa

SEQ ID NO: 290679 - RNA, 64 nt, hsa
augcaccgcucugcuucaugcccaagaugacuugcgaggcaaucucaggagcuguggacuuaac

SEQ ID NO: 290680 - RNA, 64 nt, hsa
cuucaugcugugauugaagcauccauucagaacacgaggcaauauugcaguccacagggaaugg

SEQ ID NO: 290681 - RNA, 64 nt, hsa
uuuuguucuccaucuguuugggguagguguugagcgaggcaaauggaucucgauauuucagaug

SEQ ID NO: 290682 - RNA, 64 nt, hsa
aaauuaaaacccuuggcagggcaucgacugugugcgaggcaaugcucuagguccuguaggggcu

SEQ ID NO: 290683 - RNA, 64 nt, hsa
ggggggagaugugggcggcaagccacccaggcaccgaggcaagagacagaggacacgagcuguu

SEQ ID NO: 290684 - RNA, 64 nt, hsa
ucggcuccucccccagccucuagcuacccuguaucgaggcaaggggaggccaguaaaguuugcc

SEQ ID NO: 290685 - RNA, 64 nt, hsa
cucauuauuauuuuaaaaacagacacccagcugccgaggcaaaaaggagccaggcgcucccucu

SEQ ID NO: 290686 - RNA, 64 nt, hsa
uguugaggguccucuuccaucuugcugaacuguucgaggcaaagacaaaacccaacuuugacca

SEQ ID NO: 290687 - RNA, 64 nt, hsa
agaagggaccuccugaaaacucgcucuuuauaaacgaggcaaaagcauuuaauucccacccccc

SEQ ID NO: 290688 - RNA, 64 nt, hsa
ggcucacaccuguaaucccagcacuuugggaggccgaggcaagagcaucacgaggucaggagau

SEQ ID NO: 290689 - RNA, 64 nt, hsa
cagugucucguuuacaucucacacagugacccugcgaggcaaggguuugcccaguuugcagaug

SEQ ID NO: 290690 - RNA, 64 nt, hsa
ucugacguccagacaugaagagaugccagugccacgaggcaaauccaaauugucuuugcuuaga

SEQ ID NO: 290691 - RNA, 64 nt, hsa
auuacugcucugagugaaauaaaaguuauuagugcgaggcaaacauaacucauuugaggauaaa

SEQ ID NO: 290692 - RNA, 64 nt, hsa; identical to SEQ ID NO: 187115

SEQ ID NO: 290693 - RNA, 64 nt, hsa; identical to SEQ ID NO: 187116

SEQ ID NO: 290694 - RNA, 64 nt, hsa; identical to SEQ ID NO: 187117

SEQ ID NO: 290695 - RNA, 64 nt, hsa; identical to SEQ ID NO: 187118

SEQ ID NO: 290696 - RNA, 64 nt, hsa; identical to SEQ ID NO: 187119

SEQ ID NO: 290697 - RNA, 64 nt, hsa; identical to SEQ ID NO: 187120

SEQ ID NO: 290698 - RNA, 64 nt, hsa; identical to SEQ ID NO: 187121

SEQ ID NO: 290699 - RNA, 64 nt, hsa; identical to SEQ ID NO: 187122

SEQ ID NO: 290700 - RNA, 64 nt, hsa; identical to SEQ ID NO: 187123

SEQ ID NO: 290701 - RNA, 64 nt, hsa; identical to SEQ ID NO: 187124

SEQ ID NO: 290702 - RNA, 64 nt, hsa; identical to SEQ ID NO: 187125

SEQ ID NO: 290703 - RNA, 64 nt, hsa; identical to SEQ ID NO: 187126

SEQ ID NO: 290704 - RNA, 64 nt, hsa; identical to SEQ ID NO: 187127

SEQ ID NO: 290705 - RNA, 64 nt, hsa; identical to SEQ ID NO: 187128

SEQ ID NO: 290706 - RNA, 64 nt, hsa; identical to SEQ ID NO: 187129

SEQ ID NO: 290707 - RNA, 64 nt, hsa; identical to SEQ ID NO: 187130

SEQ ID NO: 290708 - RNA, 64 nt, hsa; identical to SEQ ID NO: 187131

SEQ ID NO: 290709 - RNA, 64 nt, hsa; identical to SEQ ID NO: 187132

SEQ ID NO: 290710 - RNA, 64 nt, hsa; identical to SEQ ID NO: 187133

SEQ ID NO: 290711 - RNA, 64 nt, hsa; identical to SEQ ID NO: 187134

SEQ ID NO: 290712 - RNA, 64 nt, hsa; identical to SEQ ID NO: 187135

SEQ ID NO: 290713 - RNA, 64 nt, hsa; identical to SEQ ID NO: 187136

SEQ ID NO: 290714 - RNA, 64 nt, hsa; identical to SEQ ID NO: 187137

SEQ ID NO: 290715 - RNA, 64 nt, hsa; identical to SEQ ID NO: 187138

SEQ ID NO: 290716 - RNA, 64 nt, hsa; identical to SEQ ID NO: 187139

SEQ ID NO: 290717 - RNA, 64 nt, hsa; identical to SEQ ID NO: 187140

SEQ ID NO: 290718 - RNA, 64 nt, hsa; identical to SEQ ID NO: 187141

SEQ ID NO: 290719 - RNA, 64 nt, hsa; identical to SEQ ID NO: 187142

SEQ ID NO: 290720 - RNA, 64 nt, hsa; identical to SEQ ID NO: 187143

SEQ ID NO: 290721 - RNA, 64 nt, hsa; identical to SEQ ID NO: 187144

SEQ ID NO: 290722 - RNA, 64 nt, hsa; identical to SEQ ID NO: 187145

SEQ ID NO: 290723 - RNA, 64 nt, hsa; identical to SEQ ID NO: 187146

SEQ ID NO: 290724 - RNA, 64 nt, hsa; identical to SEQ ID NO: 187147

SEQ ID NO: 290725 - RNA, 64 nt, hsa; identical to SEQ ID NO: 187148

SEQ ID NO: 290726 - RNA, 64 nt, hsa; identical to SEQ ID NO: 187149

SEQ ID NO: 290727 - RNA, 64 nt, hsa; identical to SEQ ID NO: 187150

SEQ ID NO: 290728 - RNA, 64 nt, hsa; identical to SEQ ID NO: 187151

SEQ ID NO: 290729 - RNA, 64 nt, hsa; identical to SEQ ID NO: 187152

SEQ ID NO: 290730 - RNA, 64 nt, hsa; identical to SEQ ID NO: 187153

SEQ ID NO: 290731 - RNA, 64 nt, hsa; identical to SEQ ID NO: 187154

SEQ ID NO: 290732 - RNA, 64 nt, hsa; identical to SEQ ID NO: 187155

SEQ ID NO: 290733 - RNA, 64 nt, hsa; identical to SEQ ID NO: 187156

SEQ ID NO: 290734 - RNA, 64 nt, hsa; identical to SEQ ID NO: 187157

SEQ ID NO: 290735 - RNA, 64 nt, hsa; identical to SEQ ID NO: 187158

SEQ ID NO: 290736 - RNA, 64 nt, hsa; identical to SEQ ID NO: 187159

SEQ ID NO: 290737 - RNA, 64 nt, hsa; identical to SEQ ID NO: 187160

SEQ ID NO: 290738 - RNA, 64 nt, hsa; identical to SEQ ID NO: 187161

SEQ ID NO: 290739 - RNA, 64 nt, hsa; identical to SEQ ID NO: 187162

SEQ ID NO: 290740 - RNA, 64 nt, hsa; identical to SEQ ID NO: 187163

SEQ ID NO: 290741 - RNA, 64 nt, hsa; identical to SEQ ID NO: 187164

SEQ ID NO: 290742 - RNA, 64 nt, hsa; identical to SEQ ID NO: 187165

SEQ ID NO: 290743 - RNA, 64 nt, hsa; identical to SEQ ID NO: 187166

SEQ ID NO: 290744 - RNA, 64 nt, hsa; identical to SEQ ID NO: 187167

SEQ ID NO: 290745 - RNA, 64 nt, hsa; identical to SEQ ID NO: 187168

SEQ ID NO: 290746 - RNA, 64 nt, hsa; identical to SEQ ID NO: 187169

SEQ ID NO: 290747 - RNA, 64 nt, hsa; identical to SEQ ID NO: 187170

SEQ ID NO: 290748 - RNA, 64 nt, hsa; identical to SEQ ID NO: 187171

SEQ ID NO: 290749 - RNA, 64 nt, hsa; identical to SEQ ID NO: 187172

SEQ ID NO: 290750 - RNA, 64 nt, hsa; identical to SEQ ID NO: 187173

SEQ ID NO: 290751 - RNA, 64 nt, hsa; identical to SEQ ID NO: 187174

SEQ ID NO: 290752 - RNA, 64 nt, hsa; identical to SEQ ID NO: 187175

SEQ ID NO: 290753 - RNA, 64 nt, hsa; identical to SEQ ID NO: 187176

SEQ ID NO: 290754 - RNA, 64 nt, hsa; identical to SEQ ID NO: 187177

SEQ ID NO: 290755 - RNA, 64 nt, hsa
uuacuacucuggucagucuccagcuaaccucucaaucaggcaaacauucuucuuggaggaauca

SEQ ID NO: 290756 - RNA, 64 nt, hsa
accucucaaucaggcaaacauucuucuuggaggaaucaggcaaacaucucaaaaauucucuuuc

SEQ ID NO: 290757 - RNA, 64 nt, hsa
ggcaagaaaaaaugaggaagaagcaaaagcagaaaccccugauaaacugaucagaucucaugag

SEQ ID NO: 290758 - RNA, 64 nt, hsa
agcaagagaaaaugaggaagaagcaaaaguggaaaccccugauaagccaucagaucuugugaaa

SEQ ID NO: 290759 - RNA, 64 nt, hsa
ggaccaagccgggaaugagcuugugugcccugauaccccugaggguggcugccuccucuggucc

SEQ ID NO: 290760 - RNA, 64 nt, hsa
ggaagaggcaucgccugcaggacuuugcggugggaccccugaaacuggaccugcauagcuacgu

SEQ ID NO: 290761 - RNA, 64 nt, hsa
agaacuaaaaacuccuuaacuuacuguugcuuacaccccugaaagucuguuuuuaagcaaaugg

SEQ ID NO: 290762 - RNA, 64 nt, hsa
uuuuuaacccuuuuaaaagagaccuauguugaaaaccccugaaaauucacugaagaaaaaucau

SEQ ID NO: 290763 - RNA, 64 nt, hsa
ugaccugcacugcucaucugcuuuguguaacaugaccccugauaagauguugaaacuguuauuc

SEQ ID NO: 290764 - RNA, 64 nt, hsa
uggaggggggugcuuuuguacugggauuuaagacaccccugauggaaugaaagccaacugaacc

SEQ ID NO: 290765 - RNA, 64 nt, hsa
gggaaggagggaggaaauaugucccuugcacaccaccccugaagcacauggcaguaggaaacag

SEQ ID NO: 290766 - RNA, 64 nt, hsa
cucuucacuccuuggggaagccaccucccaucacaccccugagcagaguuagggaggaauucua

SEQ ID NO: 290767 - RNA, 64 nt, hsa
gcucacucccuagagccugacgccggggccccugaccccugagccucagauuccaauaccucac

SEQ ID NO: 290768 - RNA, 64 nt, hsa
ccucacuccccagagccugaugccggggccccugaccccugaucuacggaggccugcucccgga

SEQ ID NO: 290769 - RNA, 64 nt, hsa
ugccgaccccucagaauauaacccucaugccuggaccccugagagcuucugaucccagcuauua

SEQ ID NO: 290770 - RNA, 64 nt, hsa
ugaauuugauuccaagagagcuuaggaugacagcaccccugagcugggcaaagguacucaggac

SEQ ID NO: 290771 - RNA, 64 nt, hsa
cugcgccaccucacugcaguagugcaccaucucacugcaguagcacgcccuccugggccgucug

SEQ ID NO: 290772 - RNA, 64 nt, hsa
uugugcccaagcucaccagcccugcgccaccucacugcaguagugcaccaucucacugcaguag

SEQ ID NO: 290773 - RNA, 64 nt, hsa
ccaucucaguaaauaaauaaauaaauaaaaagcgcugcaguagcuguggccucacccugaaguc

SEQ ID NO: 290774 - RNA, 64 nt, hsa
uaugagaaagaaaaagacaccguccuuuaaagugcugcaguauggccagacgugguggcucaca

SEQ ID NO: 290775 - RNA, 64 nt, hsa
ugcaguuuuagaagcagaaaaggucuuggugccucugcaguacuugauguauuggggucaaauc

SEQ ID NO: 290776 - RNA, 64 nt, hsa
auauggacacuggugccaugucagcgcucuggugcugcaguauguugccaagagcccgucugcu

SEQ ID NO: 290777 - RNA, 64 nt, hsa
ugccucagccuccugaguagcugggaucauaggcacgcgccaccacacccagcuaauuuuuugu

SEQ ID NO: 290778 - RNA, 64 nt, hsa
ucccuguucagcuguuggccggcccugcuaccugacgcgccagaagcacccagcccugcccagc

SEQ ID NO: 290779 - RNA, 64 nt, hsa
uacuaccuggcuguccccagcaccuuccugaaggacgcgccaggggaguuccugcuccgagucu

SEQ ID NO: 290780 - RNA, 64 nt, hsa
agaauauuggagauguccugaauuuuaauaggguacgcgccauuagggcuuuuugcgcuaaagg

SEQ ID NO: 290781 - RNA, 64 nt, hsa
gacaggccaggccugaucccaccucacuuccugcacgcgccacuccgccuaggggcccucgggg

SEQ ID NO: 290782 - RNA, 64 nt, hsa
ugccucagccucccguguagcugggacuacaggcacgcgccaccaugcccggcuaauuuuugua

SEQ ID NO: 290783 - RNA, 64 nt, hsa
aagcucacccaccugugauagugggcuuggggcuacgcgccaggagagucuccccccacccacc

SEQ ID NO: 290784 - RNA, 64 nt, hsa
cgccagggggcgcccgcgggagcccggcgggggcacgcgccacguggccgggagacgcacaggg

SEQ ID NO: 290785 - RNA, 64 nt, hsa
ugagccgugaagggacccugccuuucagggcacuacgcgccaccaguucccgguacccagggag

SEQ ID NO: 290786 - RNA, 64 nt, hsa
uaacucagccucuugaguagcugggauuacaggaacgcgccaccacgcccagcuaauuccugua

SEQ ID NO: 290787 - RNA, 64 nt, hsa
ugagggacauuguaguucgcaugguucucuggaaacgcgccaggaaaagcuuccgugccaguga

SEQ ID NO: 290788 - RNA, 64 nt, hsa
ugccucagccucccaaguagcuggcacuacagacacgcgccaccaugcccggcuaauuuuugua

SEQ ID NO: 290789 - RNA, 64 nt, hsa
gggcacugaaacacacaauugacuggacagguccacgcgccaugacaaaacuauaaucaaguua

SEQ ID NO: 290790 - RNA, 64 nt, hsa
guggaucucugacuucuuauuaccuccgauuggaacgcgccacaaaucauccugcuuucuuuau

SEQ ID NO: 290791 - RNA, 64 nt, hsa
caacuauucacuggacaaguucucugcucccaugacgcgccaggcacaguucugcaaguauauu

SEQ ID NO: 290792 - RNA, 64 nt, hsa
auuaaggugccgaugcagaaggcaaauuggaaacacgcgccagcggcaguggggcucaaagccg

SEQ ID NO: 290793 - RNA, 61 nt, hsa
auguagacuuugcauuauaaauucuggaacaacgcgccagacgugugaauuucaagcuuca

SEQ ID NO: 290794 - RNA, 64 nt, hsa
cgccucagcuuccccagcagcugggacuacaggcacgcgccaccacagccggcuaauuuuuuau

SEQ ID NO: 290795 - RNA, 64 nt, hsa
ggaugcagaggccugcagggccucugucaauuguacgcgccaccgagugccuucaacacagcuu

SEQ ID NO: 290796 - RNA, 64 nt, hsa
ucccucagccuugugaauaccugggacuucaggcacgcgccacuacacccagcuaauuuuuaaa

SEQ ID NO: 290797 - RNA, 64 nt, hsa
gcugccuggugacggcacccggaggcccaccaggacgcgccaccggugaaugugccucuggugg

SEQ ID NO: 290798 - RNA, 64 nt, hsa
ugccucagccuccugaguagcugggacugcaggcacgcgccaccacgcccagcuaauuuuugua

SEQ ID NO: 290799 - RNA, 64 nt, hsa
gugggcuggugacugggucuugggaucccaggccacgcgccagccaggcugugggcagggcggg

SEQ ID NO: 290800 - RNA, 64 nt, hsa
gggggcggcgaggaggccauggccggggccuacgacgcgccaccccccguacgacacgcguccu

SEQ ID NO: 290801 - RNA, 64 nt, hsa
ugccucagccucccaaguagccaggauuacaggcacgcgccaccaagccaggcuaauuuuugua

SEQ ID NO: 290802 - RNA, 64 nt, hsa
ugccucagccucccaaguagcugggauuacaggcacgcgccaccacaccuggcugauuuuguau

SEQ ID NO: 290803 - RNA, 64 nt, hsa
ccugagcgucuuccaggguggcuggagagcacagacgcgccagggagcccccucugugcuccuc

SEQ ID NO: 290804 - RNA, 64 nt, hsa
ugccucagccucccaaguagcugggauuacaggcacgcgccaccacaccuggcuaauucuauuu

SEQ ID NO: 290805 - RNA, 64 nt, hsa
uuuuagacaugguugugggucuggagggagacguggguccaagguccucaucccauccucccuc

SEQ ID NO: 290806 - RNA, 64 nt, hsa
ccuggaaacagcaugaauaaaacacucaucccauggguccaaauuaauaugauucugcuccccc

SEQ ID NO: 290807 - RNA, 64 nt, hsa
gccaagagaaucccuggaccggcucuuccuggauggguccaagaauuggacagcucagauggag

SEQ ID NO: 290808 - RNA, 64 nt, hsa
uggccgugggcaugagaccgagggugaggcuggaggguccaaagcuggcccagcgagcaccagg

SEQ ID NO: 290809 - RNA, 64 nt, hsa
aaaaauaaaucaagaaggcauagcugucugaauccccaauuauugaggcacacuccuuggccug

SEQ ID NO: 290810 - RNA, 64 nt, hsa
uggccguggcagaugcugugauugagaaguuugccccaauuaagcgugaaauugaaaaacugaa

SEQ ID NO: 290811 - RNA, 64 nt, hsa; identical to SEQ ID NO: 155290

SEQ ID NO: 290812 - RNA, 64 nt, hsa; identical to SEQ ID NO: 155291

SEQ ID NO: 290813 - RNA, 64 nt, hsa; identical to SEQ ID NO: 155290

SEQ ID NO: 290814 - RNA, 64 nt, hsa; identical to SEQ ID NO: 155293

SEQ ID NO: 290815 - RNA, 64 nt, hsa
cccugaggacauaauguguaagagaggugagaagugcucccaagcagacacaacagcagcacag

SEQ ID NO: 290816 - RNA, 64 nt, hsa
ccccaaauccuacucccucagccucaggcaguggugcucccaucuuccuccccacaacugugcu

SEQ ID NO: 290817 - RNA, 64 nt, hsa
acugugcucaggcuggugccagccuuucagacccugcucccagggacuuggguggaugcgcuga

SEQ ID NO: 290818 - RNA, 64 nt, hsa
gagacugugguagaaggaagacagaacucacacaugcucccaggauuggggacagggacagagg

SEQ ID NO: 290819 - RNA, 64 nt, hsa
gccaaggccuggagacugggggcccagcagagccugcucccacccuccucccagcagcagacac

SEQ ID NO: 290820 - RNA, 64 nt, hsa
uuuuaugauauccaucacaucuuaucuugaucuuugcucccaguggauuguacagugaugacuu

SEQ ID NO: 290821 - RNA, 64 nt, hsa
ccugacuggcagguuuuuuaauccaguggcaaggugcucccacuccagggcccagcacaucucc

SEQ ID NO: 290822 - RNA, 64 nt, hsa
gguccugcagguccuggugggucagcccagcaccugcucccagugggagcuucccgggauaaac

SEQ ID NO: 290823 - RNA, 64 nt, hsa
gaccagucccacaccgcuggucccugcccuccccugcucccagguugaggugcgcucaccucag

SEQ ID NO: 290824 - RNA, 64 nt, hsa
ggcacggcccuccuucuuuuccuaacaugcaccuugcucccaauggugcuuggagggggaagag

SEQ ID NO: 290825 - RNA, 64 nt, hsa
uggagggggcaagcuuugcuccuucaguucugcuugcucccaagccccugacccgcucggacuu

SEQ ID NO: 290826 - RNA, 64 nt, hsa
aaugcccccuuuauugcugcaccaggguuggcauugcucccacugagcccuacuccacccuguc

SEQ ID NO: 290827 - RNA, 64 nt, hsa
gcaucuccuuccaggucagcucauucacaagaguugcucccaagccuggaugaguugcaccuug

SEQ ID NO: 290828 - RNA, 64 nt, hsa
ccgugcuccaacucgggccuggggcacugcucgcugcucccaggaaggggguggcgugacaggc

SEQ ID NO: 290829 - RNA, 64 nt, hsa
uuggugaggacacacacuaggcccaaggugccugugcucccagcagguccaagugcagcuccag

SEQ ID NO: 290830 - RNA, 64 nt, hsa
ccauccguccugggaaagagcauccucuggcaggugcucccaccaggucagacccaguccugga

SEQ ID NO: 290831 - RNA, 64 nt, hsa
uagccugcacccacuggcugggaagaucucuuccugcucccacgccccugucuggauccccucc

SEQ ID NO: 290832 - RNA, 64 nt, hsa
uugaggagagaaguggaagccccauggaagacagugcucccagcugagguaggaggcggaggug

SEQ ID NO: 290833 - RNA, 64 nt, hsa
cccugguucaguauuuaaugccauuuuauucacaugcucccauguucucccucccucccauugu

SEQ ID NO: 290834 - RNA, 64 nt, hsa
ggggcaggagaggggagaaccccauccucagagcugcucccagccagcgagucaggagcggggg

SEQ ID NO: 290835 - RNA, 64 nt, hsa
ggggagacagggcuccagggaugaggccgcauucugcucccacagcgccuuuuccagaaaguuc

SEQ ID NO: 290836 - RNA, 64 nt, hsa
caguucucucccuuccucucuccuuauagacacuugcucccaacccauucacuacaggugaagg

SEQ ID NO: 290837 - RNA, 64 nt, hsa
agaggggggccaagguccugcucaacucuaccccugcucccauuccucccuccggccauacugc

SEQ ID NO: 290838 - RNA, 64 nt, hsa
cagucauuagugaauuacacucaaggaaaagaugugcucccaccaggcagcuccagcuguuacc

SEQ ID NO: 290839 - RNA, 64 nt, hsa
cugcaaaguuuucuuuccaaaaucaggcuuugucugcucccaauucaccucguuacucucaccu

SEQ ID NO: 290840 - RNA, 64 nt, hsa
auccacggccuccacccgggacgccuuccuccucugcucccaaacaggguuuccguggccuguu

SEQ ID NO: 290841 - RNA, 64 nt, hsa
guggggugggcaggccaggacugcuuuuuuuuaaugcucccauuucacagaggauaccaccgag

SEQ ID NO: 290842 - RNA, 64 nt, hsa
uggcccucccacaguauuuugugcaaugaagcccugcucccagccuuucagagacagggacaca

SEQ ID NO: 290843 - RNA, 64 nt, hsa
cuuccuucucagggucuccccagcccaguccccuugcucccaucccacucggugcuguugggua

SEQ ID NO: 290844 - RNA, 64 nt, hsa
acagaaccauccccacugugaggcugugagagauuuguggcaggaacuguuuaugaggcucuag

SEQ ID NO: 290845 - RNA, 64 nt, hsa
ccaugcgcuagucaggagcacaggcaaggggugcuuguggcaguggccgggcaccugagcccca

SEQ ID NO: 290846 - RNA, 64 nt, hsa
agagccauguaggaaaugcacugauugcauguuauuguggcaagaauauccuaaaugucauuaa

SEQ ID NO: 290847 - RNA, 64 nt, hsa
aaaugagcauuugaaauagauaauccuuuaagccuuguggcaaaauuuuuguggcuuuuguuua

SEQ ID NO: 290848 - RNA, 64 nt, hsa
ccuggacugccuugaauauccccucccagucaccuuguggcaagccccugcccaucugggaaaa

SEQ ID NO: 290849 - RNA, 64 nt, hsa
uuuaguuaaaugaggguggugaauauuguucauauuguggcacaagcaaaagggugucugagcc

SEQ ID NO: 290850 - RNA, 64 nt, hsa
ugggcaggcagaggccaguacagaggaggagccauuguggcagugcccugugcgccuugugaca

SEQ ID NO: 290851 - RNA, 64 nt, hsa
acaugcuuccggaacagugacagggacuucgcuuuuguggcaagugacaaagauagcuguaugc

SEQ ID NO: 290852 - RNA, 64 nt, hsa
ccugaguucuugaguccacccaacucccaucuucuuguggcacaggaaagcugcccucucccuc

SEQ ID NO: 290853 - RNA, 64 nt, hsa
aaaugucccagauauuucuaugcuacuuagauauuuguggcaaagcagaaagcuuuuugacugu

SEQ ID NO: 290854 - RNA, 64 nt, hsa
auguuguacuuuguagggacaaaugugcauuuguuuguggcaaaagccuacaauugacaaacuu

SEQ ID NO: 290855 - RNA, 64 nt, hsa
aagugucaggguggagugauuccaagugggaugguuguggcauuaguuuaagcugaauaaauaa

SEQ ID NO: 290856 - RNA, 64 nt, hsa
cacuggugguuggagaaaaccauggccaaaacgauuguggcaggucucaaucuugggaguuuuu

SEQ ID NO: 290857 - RNA, 64 nt, hsa
ggaaccccucgucccccuaggagcagacccaagcuuguggcaccaggcaucugauggugccagg

SEQ ID NO: 290858 - RNA, 64 nt, hsa
uuugguuucagcaugucaggagauuucuaaugauuuguggcaauaucagcaauuuuuuuucuuu

SEQ ID NO: 290859 - RNA, 64 nt, hsa
accauuaucuugucaagaucagaugguuuuacuauuguggcagaagcgagaaaacuuuguuuau

SEQ ID NO: 290860 - RNA, 64 nt, hsa
ccuguaggcaauagauugcuauguuuuuaacaaauuguggcaaauucuaaacagcaauucuuuu

SEQ ID NO: 290861 - RNA, 64 nt, hsa
aguucauugucauagcuucagcuucagaagcuguuuguggcauuuguaggauucaaacucaugg

SEQ ID NO: 290862 - RNA, 64 nt, hsa
uucagggaauucaggaaaugccagcauuggaauuuuguggcauuaguuacuaccuucuuucuua

SEQ ID NO: 290863 - RNA, 64 nt, hsa
auucauacaggagagaaacucacaagugugaugauuguggcaaagcguuuacuucacauucaca

SEQ ID NO: 290864 - RNA, 64 nt, hsa
cucaugcuggagagaaaccuuauaaaugucaugauuguggcaaggucuucagucaaguuucauc

SEQ ID NO: 290865 - RNA, 64 nt, hsa
ucaguuaauauuucuuagaggaaaguuuugcuuuuuguggcaacauuuuuauagcuugugugag

SEQ ID NO: 290866 - RNA, 63 nt, hsa
gagauggagaccuaaaaugaaauguuuuugucuuuguggcaugcagcuaacuccucuuuaguu

SEQ ID NO: 290867 - RNA, 64 nt, hsa
aacguuuuaucauuuauuaaucaucccugccugugucuauuauuauauucauaucucuacgcug

SEQ ID NO: 290868 - RNA, 64 nt, hsa
auaacugagggaagagaagugacaauuccacucagucuauuagaggucuggauauaagguagcc

SEQ ID NO: 290869 - RNA, 64 nt, hsa
ucuaagguagccaguucuguugcccauucccccagucuauuaaacccuugauaugcccccuagg

SEQ ID NO: 290870 - RNA, 64 nt, hsa
gaaaggaggaagggagaauugagaaaauauauuagucuauuauuuuagaguucuaauacacucu

SEQ ID NO: 290871 - RNA, 64 nt, hsa
acauuuauuuaaaauuuaauuuacuauacuuauugucuauuauaaagcucauuauaauauaaaa

SEQ ID NO: 290872 - RNA, 64 nt, hsa
uuuauaauguauuuauuaggggaggguaccuugagucuauuauauaugcuucaucaaaacaucu

SEQ ID NO: 290873 - RNA, 64 nt, hsa
uuuuuagaaugauguaaauaguuaaccuucaguagucuauuaaggcauuaauacuucucuggac

SEQ ID NO: 290874 - RNA, 64 nt, hsa
uggugguggugguuuuauuauaugcaaaaucucugucuauuaugagauacuggcauugaugagc

SEQ ID NO: 290875 - RNA, 64 nt, hsa
gucacucacacuggccacaaggacgcuggcuacugucuauuaaaauucugauguuucugugaaa

SEQ ID NO: 290876 - RNA, 64 nt, hsa
cgagacuagccuggccaauaugguaaaaccccgugucuauuaaaaauacaaaaauuagcuggcu

SEQ ID NO: 290877 - RNA, 64 nt, hsa
gccuuaaaauuguccaauuauaguuuuauaaccagucuauuaaagguguuuguuuaaaauggau

SEQ ID NO: 290878 - RNA, 64 nt, hsa
aacauuuuaucauuuauuaauccucccugccugugucuauuauuauauucauaucucuacgcug

SEQ ID NO: 290879 - RNA, 64 nt, hsa
uauaagaaagaagggaaaaaagagaaaaacucaagucuauuacuuguagaguccaauucuuagc

SEQ ID NO: 290880 - RNA, 64 nt, hsa
augcucaagagcucugccgugcuccccaugaaaagucuauuaaguaggcacccugugcucacuc

SEQ ID NO: 290881 - RNA, 64 nt, hsa
cuaaugaucauauuuauuuauuuauaugaaccaugucuauuaauuuaauuauuuaauaauauuu

SEQ ID NO: 290882 - RNA, 64 nt, hsa
uaagcuacuuggggugguaguagaggauuagguugucuauuauaaaaccaaaacucauucguuu

SEQ ID NO: 290883 - RNA, 64 nt, hsa
acuguaccuuuauaauaagugcaauucuuucauugucuauuauuaugcuuaagaaaauauucag

SEQ ID NO: 290884 - RNA, 64 nt, hsa
caaauagacaacguuggcauguucuuuucuguuugucuauuaaugggccugcuucuuagcaaua

SEQ ID NO: 290885 - RNA, 64 nt, hsa
guguagacaagguaccaggucagucuucuuccaugucuauuagcuccacaaagccaaucucaau

SEQ ID NO: 290886 - RNA, 64 nt, hsa
ggaugguguuggaacuaauauauccuugaugucugucuauuauucauucaacucuuuuuacaga

SEQ ID NO: 290887 - RNA, 64 nt, hsa
uuaucaugucuauuuuugaugacucaucaauuuugucuauuaaagauauuucuuuaaauuauac

SEQ ID NO: 290888 - RNA, 64 nt, hsa
uaaguuugguuagccuuaguuucucagacuuguugucuauuaucuguagguggaagaaauuuag

SEQ ID NO: 290889 - RNA, 64 nt, hsa
cuaaugauguagaaugcuuugaccaaaugagcuggucuauuaugccuuguaaaacagcagcaua

SEQ ID NO: 290890 - RNA, 64 nt, hsa
uacuuuguccuuuuuguuauuagggugguauuuagucuauuagccacaaaauugggaaaggagu

SEQ ID NO: 290891 - RNA, 64 nt, hsa
aaagccguucugagggguuggugggguaagcucagucuauuacugagacaauagugagauggcu

SEQ ID NO: 290892 - RNA, 64 nt, hsa
ggauuuuaaagcacaacuggaauagcuaauuacagucuauuaaaacugugaauguauguagcaa

SEQ ID NO: 290893 - RNA, 64 nt, hsa
auuguguagagguuguucaacugaaggaauaaaugucuauuaaacuaaaacaaauggaccuucu

SEQ ID NO: 290894 - RNA, 64 nt, hsa
auuauuuaauuuuuuagguaaugccuaucucuuggucuauuaaggaaagaagcaaucaguagag

SEQ ID NO: 290895 - RNA, 64 nt, hsa
uagaaauaccugcaacaugacagucuaaucaguagucuauuaaaacuuguauucauaaugugua

SEQ ID NO: 290896 - RNA, 64 nt, hsa
uuugcagaucccaaucuuucuuuuaagcuucugggucuauuaaacuagguagaucuuuucguau

SEQ ID NO: 290897 - RNA, 64 nt, hsa
caagauucuacuaaguguaaaauuauuuaauaaugucuauuaaauugauauuuauaucuugcau

SEQ ID NO: 290898 - RNA, 64 nt, hsa
ccccaagaauggccuuguacaacuuauccagaaugucuauuaggauucuaauguuauguccacu

SEQ ID NO: 290899 - RNA, 64 nt, hsa
uauaauaauuuguuuugucauauuugcuuucacugucuauuaucuguuuaagucucauaacucu

SEQ ID NO: 290900 - RNA, 64 nt, hsa
uuugaaaacuguaguuaacuaugguuuuuuauuagucuauuaaaagauacguggagauauuaaa

SEQ ID NO: 290901 - RNA, 64 nt, hsa
gccaucuaucuaguucuaacagugaaguuuuacugucuauuaauauucaggguaaauaggaauc

SEQ ID NO: 290902 - RNA, 64 nt, hsa
uggcaaaaauguuuaaaaugcuuaucucuaagaugucuauuauaugcucugucugugcuuucua

SEQ ID NO: 290903 - RNA, 64 nt, hsa
uguuuuuuuccugaugaaggcagaagagaugguggucuauuaaauaugaauugaauggaggguc

SEQ ID NO: 290904 - RNA, 64 nt, hsa
guuaaaggagagauggccaagccagggacaaauugucuauuagaaaacgguccuaagagauucu

SEQ ID NO: 290905 - RNA, 64 nt, hsa
ugcugaagcagaccauucuuccuuucuucccaaugucuauuaagaucacacauagguaaacugu

SEQ ID NO: 290906 - RNA, 64 nt, hsa
aagugugaguaaaguuaguaucauuaaacaaauugucuauuaaaugcaagacgugguaauauac

SEQ ID NO: 290907 - RNA, 64 nt, hsa
ggcucugguugccaacaaacagcauuuguaaauggucuauuagccuucauuuauacugccuaac

SEQ ID NO: 290908 - RNA, 64 nt, hsa
agcucuuaaaugcuauuguaagagaaauuucuuugucuauuaacuccauuuuaguagggauuca

SEQ ID NO: 290909 - RNA, 64 nt, hsa
auguuuuaugucaaacaauuaugcuuaauauacagucuauuaaauguaagucuuguuugagaua

SEQ ID NO: 290910 - RNA, 64 nt, hsa
augguuuaugucaaacaauuaugcuuaauauaaagucuauuaagugguaagucuuguuugagau

SEQ ID NO: 290911 - RNA, 64 nt, hsa
acuauauuguccaggcuagaagaauuuucuaauggucuauuacaccucccguuuuggcaaguaa

SEQ ID NO: 290912 - RNA, 64 nt, hsa
uaugucaauuuuucuuuucaacaaaacugcuaaugucuauuaggaagaaaaauguguuuaaagu

SEQ ID NO: 290913 - RNA, 64 nt, hsa
guagcaguauuguuacuucuuuccaggaugcaaggucuauuaucccaacagaagagaaaauauu

SEQ ID NO: 290914 - RNA, 64 nt, hsa
cauucauucagccuucaaucaacaucucuugagugucuauuauguacaggacauguacugagac

SEQ ID NO: 290915 - RNA, 64 nt, hsa
aacagauauucacauuugauuauagaaacuuaaugucuauuaauaauuuuaguacaaaauuuca

SEQ ID NO: 290916 - RNA, 64 nt, hsa
auuuaauuagccagugaaaaacuauuaacaacuugucuauuaccuguuaguauuauuguugcau

SEQ ID NO: 290917 - RNA, 64 nt, hsa
aucagggaauucccugcucccaugccacacauuugucuauuauggcuauaguaccaaaguacuu

SEQ ID NO: 290918 - RNA, 64 nt, hsa
uuuuuuuuuucuuuuuuggugugaaggugggggggucuauuagacauuuauucaagagcguucu

SEQ ID NO: 290919 - RNA, 64 nt, hsa
ccaucuuuggagagauuauggagauaaucuccuugucuauuagccacuagcauggcuaauugau

SEQ ID NO: 290920 - RNA, 64 nt, hsa
ugauuuucccccguuaacaugucuuucuaaaauugucuauuaaagcagaggaaauaccugccaa

SEQ ID NO: 290921 - RNA, 64 nt, hsa
caaauaauuauuuggaauuuuguguuugucauuugucuauuauaguuuuacaacauacguaugu

SEQ ID NO: 290922 - RNA, 64 nt, hsa
ucaauugauaccaacagaaauaucaacuucuggagucuauuaaauguguugucaccuuucuaaa

SEQ ID NO: 290923 - RNA, 64 nt, hsa
uuuucagguacuguguggugaccgccccacuggugucuauuacaggccacuuugguaguugugu

SEQ ID NO: 290924 - RNA, 64 nt, hsa
agacgggcuguuccugaauaccagguuguuaucugucuauuacagccccuucacuucugggcuc

SEQ ID NO: 290925 - RNA, 64 nt, hsa
uauuuuuauguacaauauugauagugagagguaugucuauuauaauaaagauuauggcacagua

SEQ ID NO: 290926 - RNA, 64 nt, hsa
gauuuucauacgauuguaaaugagcuauauuaaagucuauuaaaggaagcccuucuuguuugag

SEQ ID NO: 290927 - RNA, 64 nt, hsa
aagaaaaaaacuauaaauacaaaucuguauaaaugucuauuauuaugaagaauugccaaucuug

SEQ ID NO: 290928 - RNA, 64 nt, hsa
auguauucucacauguaaauuugaaaguucaggggucuauuaugaaaugauacacauuuuuaaa

SEQ ID NO: 290929 - RNA, 64 nt, hsa
gaagaucagacuccuacuuaacuggaagagaaaugucuauuaaaugucucuccucuuucucugg

SEQ ID NO: 290930 - RNA, 64 nt, hsa
gacuguacuccuaaggaaaauagccacuucugcagucuauuaugcuuuuauaacuguuuaaagg

SEQ ID NO: 290931 - RNA, 64 nt, hsa
uauuucagugagagcuacagugugauauuucagagucuauuaaauaaaaaugugaguuugaauu

SEQ ID NO: 290932 - RNA, 64 nt, hsa
acacuugcaaaaaucucuacuguaauuaauuugggucuauuauuaacucucuguuccaucauag

SEQ ID NO: 290933 - RNA, 64 nt, hsa
aauaucuagaccucucuuccaaugaaacccuccagucuauuauagucacauagauaauggugcc

SEQ ID NO: 290934 - RNA, 64 nt, hsa
aaucaguuuuaaaaaaugagcuaccauaugugcugucuauuauaaaugggacaccaaacaaaau

SEQ ID NO: 290935 - RNA, 64 nt, hsa
uucagguacaccauuaagauacaacauucuagaagucuauuaccuuaggaguuaauuaaacaug

SEQ ID NO: 290936 - RNA, 64 nt, hsa
uauacucaccugcguuuucauuuguuugacauuugucuauuauuggauuucauuaucauaugaa

SEQ ID NO: 290937 - RNA, 64 nt, hsa
uuuguaagagugagcucugguggagacaaaugaggucuauuacgugggugcccucuccaaaggc

SEQ ID NO: 290938 - RNA, 64 nt, hsa
ccuagguccuuggucuaagaagucaaggauguaagucuauuaggacugaguguugaauggucuu

SEQ ID NO: 290939 - RNA, 64 nt, hsa
ugugaugguuccguggcugcaaggaagggaaacagucuauuauacauagcccuguauauaugua

SEQ ID NO: 290940 - RNA, 64 nt, hsa
guugggaaggaggaauuauauuugcaaaggggcugucuauuagcauauuuccuuugagggggca

SEQ ID NO: 290941 - RNA, 64 nt, hsa
uaugucaaacgcauuuuucuuuauugcaaagagagucuauuauagaaggaaagaaguggaggcc

SEQ ID NO: 290942 - RNA, 64 nt, hsa
uauauuauuaaauauucuacaacuuuuuaaaaaugucuauuaauauuccaucguauagauguga

SEQ ID NO: 290943 - RNA, 64 nt, hsa
aaaccaguguuuuuuacuuguacacuguuuuaaagucuauuaaaauugucauuugacuuuuuuc

SEQ ID NO: 290944 - RNA, 64 nt, hsa
cccucccaccuugucacccuucugagucuccaaugucuauuauuccacacuccauguccacgug

SEQ ID NO: 290945 - RNA, 64 nt, hsa
uuacgaauauaugcguuuauauuuauacuuccuugucuauuauaucuauacauuauauauuauu

SEQ ID NO: 290946 - RNA, 64 nt, hsa
guuauacugauaaaauuucaucuuucaaauuauagucuauuauuuuaaagggauuuuucaguau

SEQ ID NO: 290947 - RNA, 64 nt, hsa
agaauguugcuuucugaauuuugcuuuuuaagaugucuauuauauuuacuuauuaguuuuuaaa

SEQ ID NO: 290948 - RNA, 64 nt, hsa
acucagcaguuccuuaaaucacaaacaaugguaggucuauuauuuucucccuggauacacuuua

SEQ ID NO: 290949 - RNA, 64 nt, hsa
ccccuccacacgcucuagucccuucaaccuaccggucuauuaagugguggcuuuucucuccuug

SEQ ID NO: 290950 - RNA, 64 nt, hsa
cuaauccuccauuaagcgagcauaccucaagugggucuauuagcauuuaaugaccuuuugugcc

SEQ ID NO: 290951 - RNA, 64 nt, hsa
agugagugcucccucuguucccucccuggaaugugucuauuaaaugcaugugucaccuguuugg

SEQ ID NO: 290952 - RNA, 64 nt, hsa
caggauagaggcccauauauccuggggagcuuuggucuauuaguuugugacaauauucaaaggc

SEQ ID NO: 290953 - RNA, 64 nt, hsa
gauuuuuacaucuugcuuaaucaauauuuucagagucuauuaguuccccugggauucugaauau

SEQ ID NO: 290954 - RNA, 64 nt, hsa
auuuuggguagugaagaagcaauggcaaucuugagucuauuauuguauaauuuaguaaaagaaa

SEQ ID NO: 290955 - RNA, 64 nt, hsa
agucaaaaauaccauuuuaguaugaagcaaugaagucuauuauuuguugucccauaauugagaa

SEQ ID NO: 290956 - RNA, 64 nt, hsa
uugccaaaaccaaacccagguucaugaauauggugucuauuauagugaaacauguacuuugagc

SEQ ID NO: 290957 - RNA, 64 nt, hsa
aauuaauucuaaagugacucugguuuccauuuuagucuauuagcuagaggguuuuggcuguugc

SEQ ID NO: 290958 - RNA, 64 nt, hsa
aggcaucucaagguaacagauucuuauugaguaggucuauuaggagucagaagguguuggggag

SEQ ID NO: 290959 - RNA, 64 nt, hsa
uuugguaggauuuugacugguuuugcaacaauaggucuauuauuagagucaccuaugacaaaaa

SEQ ID NO: 290960 - RNA, 64 nt, hsa
gcuaucgguuuagccuuuuaagcuucauuagcuugucuauuauugaaauaguuuccaagaaauu

SEQ ID NO: 290961 - RNA, 64 nt, hsa
ggcaugccaaguacuaaagcaccuugcagagcgugucuauuacaagaugucauuuccaccagca

SEQ ID NO: 290962 - RNA, 64 nt, hsa
ucugcugaggcccagugcauaugcaauguauagugucuauuaucacauuaaucucaaagagauu

SEQ ID NO: 290963 - RNA, 64 nt, hsa
agagaauacuguaacaaacuucguacagaguucggucuauuaauuguuucauguuagauauucu

SEQ ID NO: 290964 - RNA, 64 nt, hsa
ucaagcagcaaacuaaauucugagaaauaaacgagucuauuacuguguuggucucagcugauuu

SEQ ID NO: 290965 - RNA, 64 nt, hsa
guguuugugacuuuucagagcccagauuccuguugucuauuaaaacuugaagggaggggugaau

SEQ ID NO: 290966 - RNA, 64 nt, hsa
cucuuccuuuaggagggaguuaucuaaaagaaaugucuauuaaggugauauauuuaaaaauauu

SEQ ID NO: 290967 - RNA, 64 nt, hsa
uaaucuguagaaccuucuccuaggaaauggugaagucuauuaggagccacuugugacuccauga

SEQ ID NO: 290968 - RNA, 64 nt, hsa
guuauuccaguucccugggauuuuaaauucuuuggucuauuaaguauccuuguauuggauacgu

SEQ ID NO: 290969 - RNA, 64 nt, hsa
agaauauuuccaugacccuaagaaguuuccucaugucuauuaauauucccaauccuaggcacca

SEQ ID NO: 290970 - RNA, 64 nt, hsa
cacuaaauaaaaacacagaaauaauuagacaauugucuauuauaacaugacaacccuauuaauc

SEQ ID NO: 290971 - RNA, 64 nt, hsa
cugcuaugguaacacuaaaccuaaguggucucuugucuauuaguuugguuugaauuauuaguac

SEQ ID NO: 290972 - RNA, 64 nt, hsa
auuauuauuuuuuaaccuggacaugcauuaaagggucuauuagcuuucuuuccgucugucucaa

SEQ ID NO: 290973 - RNA, 64 nt, hsa
acuucacuugucccauugguuaacaucugggugggucuauuacuuacugugaugacugcugucu

SEQ ID NO: 290974 - RNA, 64 nt, hsa
gaauuaccauuuccuuuguccuucccuuaguugggucuauuagcucagauugagagguguugcc

SEQ ID NO: 290975 - RNA, 64 nt, hsa
auguaaucaucaccaagaucaauguauacaauaugucuauuaaaccaaaaaguuuucuugugcc

SEQ ID NO: 290976 - RNA, 64 nt, hsa
acauuuauauucagaugaaauuaugguuugcacugucuauuaaauaucucgauuaauuuucaua

SEQ ID NO: 290977 - RNA, 64 nt, hsa
gaguaauucagggaagagaagggaagagagaagagucuauuaugagcugguuacuacuguggcu

SEQ ID NO: 290978 - RNA, 64 nt, hsa
auuauaaaaugauuucccaugccauaauuuuucugucuauuaaaugggacaaguguaaagcaug

SEQ ID NO: 290979 - RNA, 63 nt, hsa
uugcaacaugaauaaaaguuucaccaaaucgggagucuauuauaagcauguuuugaguuauuu

SEQ ID NO: 290980 - RNA, 64 nt, hsa
ccccuugaggcaaauauuaaaguaauuuuuauaugucuauuauuucauuuaaagaauaugcugu

SEQ ID NO: 290981 - RNA, 64 nt, hsa
ggggcguauguguggccagcucuuaaccauuccagucuauuacuugggugaguccuuguggaca

SEQ ID NO: 290982 - RNA, 64 nt, hsa
ggcacuuccuuguaaaaucuaguuuuggcaagaagucuauuaggucaguuuagcaagaacaccu

SEQ ID NO: 290983 - RNA, 64 nt, hsa
aauuuagcuaguuuuuaauaguguucucuguauugucuauuauuuagaaaugaacaaggcagga

SEQ ID NO: 290984 - RNA, 64 nt, hsa
aaauuagggaguaaaaguuauacuuaacuugucugucuauuauuuuaaaauaugcauugaaaua

SEQ ID NO: 290985 - RNA, 64 nt, hsa
ugcauagcaccccaucaaaaguaguucaucaaaugucuauuaaacguuuuaaagaaaaguacau

SEQ ID NO: 290986 - RNA, 64 nt, hsa
aguuugucauaauaaaacuuggcagauucuacaagucuauuaugacaaaccaggaacuaauucu

SEQ ID NO: 290987 - RNA, 64 nt, hsa
uuuaacauuccucuaacucccccauuuaucuuuugucuauuaauauucacuagccaacauagua

SEQ ID NO: 290988 - RNA, 64 nt, hsa
cucaaaagauaguuaauucuugccuuauaccucagucuauuauguaaaauuaaaaauaugugua

SEQ ID NO: 290989 - RNA, 62 nt, hsa
uaguaucauuguuucauuuaguauuugguacaaucuaauaaauacuaauccaguccaauacu

SEQ ID NO: 290990 - RNA, 62 nt, hsa
auacuaauaauacuaacaguaguauugauacaaucuaauaaauaauguguuugacaguguag

SEQ ID NO: 290991 - RNA, 62 nt, hsa
cuuagauuuuaagaacucuugaauugugugguaucuaauaaaagggaagguaagauggauaa

SEQ ID NO: 290992 - RNA, 62 nt, hsa
cuggguaucugcaaggcuuauugauuauucuaaucuaauaagacaaguuuguggaaaugcaa

SEQ ID NO: 290993 - RNA, 62 nt, hsa
gggauuugcauuaugacuugaacugggcuuauaucuaauaauacagagcacuaucucuaacc

SEQ ID NO: 290994 - RNA, 62 nt, hsa
uagaugucaagaagcccuucagacccagacaaaucuaauauccugagguggccuuuacauac

SEQ ID NO: 290995 - RNA, 62 nt, hsa
aggaagguggugcuuacauccuuaaaggcaccaucuaauagcggguuacuuucacauacagc

SEQ ID NO: 290996 - RNA, 62 nt, hsa
ggccaaauuauuuguguaauagaaaacugaaaaucuaauauuaaaaauauggaacuucuaau

SEQ ID NO: 290997 - RNA, 62 nt, hsa
gaaauggguuucugcuaaugaauugagcagacaucuaauauuuuauaugccuuuugagcugu

SEQ ID NO: 290998 - RNA, 62 nt, hsa
ggaaugccuauaauacaucuuagauuccuuauaucuaauaagaguucaaagaguuaugaguu

SEQ ID NO: 290999 - RNA, 62 nt, hsa
cauuaauguaguuccucauugaacaugugauaaucuaauaccugugaaaacugacuaaucag

SEQ ID NO: 291000 - RNA, 62 nt, hsa
cugugaaaacugacuaaucagcugccaauaauaucuaauauuuuucaucaugcacgaauuaa

SEQ ID NO: 291001 - RNA, 62 nt, hsa
uggggaaaaagggcuauugcuaagugagcuuuaucuaauauccuccuaagaguuuuacuagu

SEQ ID NO: 291002 - RNA, 62 nt, hsa
gcuuauuuaauuuuccagaaccaggaaugaguaucuaauagcuuuuguagaaccuuccagaa

SEQ ID NO: 291003 - RNA, 62 nt, hsa
ugcugugauaaaaauaggugagagaucauaugaucuaauauuguauugauggaaguauaggu

SEQ ID NO: 291004 - RNA, 62 nt, hsa
ccagucaagcuaguaggcugauugugaagaaaaucuaauaccuuaucuuuaucucaaaccuc

SEQ ID NO: 291005 - RNA, 62 nt, hsa
acuauugacuugguaagucuacuguauauaacaucuaauauauauauauuauaggccagcua

SEQ ID NO: 291006 - RNA, 62 nt, hsa
acuauugacuugguaagucuacuguauauaacaucuaauauauauauuacaggccaaaugaa

SEQ ID NO: 291007 - RNA, 64 nt, hsa
uacugcacucuuaaacagcaccaccauuuaauuucauguauaucuaacuucgaauauaucugua

SEQ ID NO: 291008 - RNA, 64 nt, hsa
uuucaaaugugcaauuuguaaauauugcuaaaagcauguauaguuagaacugauuacauccgua

SEQ ID NO: 291009 - RNA, 64 nt, hsa
acuacacaguugcuaugauauguaacaagucacacauguauauaucacacaagucuuaccaauu

SEQ ID NO: 291010 - RNA, 64 nt, hsa
cacucagaaggcagccaucccuagauguugguuucauguauauuacacuaucuacuacuaucca

SEQ ID NO: 291011 - RNA, 64 nt, hsa
gguaagagugacuaaccagccuaacuuuaauacacauguauaaagauguucacagagaaagaug

SEQ ID NO: 291012 - RNA, 64 nt, hsa
gaggacagacugauaguuucuuucuuucauaucacauguauagagaaauaauuauaucagaaac

SEQ ID NO: 291013 - RNA, 64 nt, hsa
aauuguugguagguagaaguuaauauuugugguucauguauauuuugaccagaguauauuuaag

SEQ ID NO: 291014 - RNA, 64 nt, hsa
aaaacagaaaaauugaaaaacuguuugguaagcacauguauaucuaccauuuagauucagcagu

SEQ ID NO: 291015 - RNA, 64 nt, hsa
gcaggaaaaaugaauugcuugguauucauuacuucauguauaucaagcacagcaguaaaacaaa

SEQ ID NO: 291016 - RNA, 64 nt, hsa
uagaaucauaccccauggauaccacauauuaaaccauguauaucuguggaauacucaaugugua

SEQ ID NO: 291017 - RNA, 64 nt, hsa
agcaauauugaauuguucauucuaucuaaaauuacauguauauaaaauauauaauuuaucuucc

SEQ ID NO: 291018 - RNA, 64 nt, hsa
accagaagcacauccauuuuuguagugucacaaacauguauaugccacacuuugcaccuuaaug

SEQ ID NO: 291019 - RNA, 64 nt, hsa
ucccccaaaaugacacccaccgucgucaggguagcauguauaaugcccacguguuaaacauugc

SEQ ID NO: 291020 - RNA, 64 nt, hsa
guuccaucuuguuaacugcaguauguauucuaaucauguauaugguuuguguucuuuuacugug

SEQ ID NO: 291021 - RNA, 64 nt, hsa
aguauuuugugugccuuagauuuccguuuuaagacauguauauuuuugugagccuaagguuucu

SEQ ID NO: 291022 - RNA, 64 nt, hsa
ggauuuggagaauaaguguguacagaucacaaaacauguauauacauuauuuagaaaagaucuc

SEQ ID NO: 291023 - RNA, 64 nt, hsa
acuuauuuuguaaacauuuuguggguacauaguacauguauauauuuacgggguaugugagaug

SEQ ID NO: 291024 - RNA, 64 nt, hsa
ugaaaucuaggaggaaggcauacuuggcaaaccacauguauaauaugcuacuuggaaauguauc

SEQ ID NO: 291025 - RNA, 64 nt, hsa
uauagcaucugcauuucuuuuucuuuguuagguacauguauacaccugccugaguauaaauacu

SEQ ID NO: 291026 - RNA, 64 nt, hsa
uauauacacauauauguauguauacacauauacacauguauauauacauguguguauguauaca

SEQ ID NO: 291027 - RNA, 64 nt, hsa
uauacacauguauauauacauguguguauguauacauguauauauauauacauacacauauaug

SEQ ID NO: 291028 - RNA, 64 nt, hsa
agcaagagcaccuguguuguacugcuuuauaucucauguauauuuauaguaaugaaaagacuuu

SEQ ID NO: 291029 - RNA, 64 nt, hsa
uuucaguugaauaagggccaguugguaugcagcccauguauaugugaauggaguaagauaaacc

SEQ ID NO: 291030 - RNA, 64 nt, hsa
aucaagguuuuguuuguuaauucucuuuuauaugcauguauauauugcccuuuucacgacugua

SEQ ID NO: 291031 - RNA, 64 nt, hsa
ugcuaauguuuuuguuuauggagguaaacuuugucauguauagguaaggguacuauaaauauga

SEQ ID NO: 291032 - RNA, 64 nt, hsa
uugugcuuuguugugguugcagcuguuuucgugucauguauaguaguagaaauggaaaucauug

SEQ ID NO: 291033 - RNA, 64 nt, hsa
ugagggucccuguagauauuguguacaccaugcccauguauauacaaguacacacagauguaca

SEQ ID NO: 291034 - RNA, 64 nt, hsa
gcauuacaugcauauguauguagacauaugcaugcauguauauguaaaauauauacuuuuccaa

SEQ ID NO: 291035 - RNA, 64 nt, hsa
ucaagcugauggaguaugugauaaagugaauguacauguauauacacacacaccuccauauaua

SEQ ID NO: 291036 - RNA, 64 nt, hsa
ugucaggucgaugucucagaacacucucccagcuguggaccacguggaccacuuagcagacuca

SEQ ID NO: 291037 - RNA, 64 nt, hsa
gaugucucagaacacucucccagcuguggaccacguggaccacuuagcagacucaggggguagu

SEQ ID NO: 291038 - RNA, 64 nt, hsa
uuuguuggcaugggcagggguugagucagcagaaguggaccaaaggauuccucugaauaaaguu

SEQ ID NO: 291039 - RNA, 64 nt, hsa
uuuccuucauuucccuaagccuguggcccaaaugguggaccagaaugauggugggagggggcaa

SEQ ID NO: 291040 - RNA, 64 nt, hsa
aucagcacuugaggccuugccccacgccuucucuguggaccauucaggaccuccagugggggug

SEQ ID NO: 291041 - RNA, 64 nt, hsa
ggacuuauuccgcuuuccacaccgaacacuaaauguggaccaguaucaagaacccuccuguccc

SEQ ID NO: 291042 - RNA, 64 nt, hsa
uaugaccagagccuugcaacucaaaguguggucuguggaccagcagcggcagugacaccuggga

SEQ ID NO: 291043 - RNA, 64 nt, hsa
gccuugucauggccuccugggggcagaaggcgauguggaccacgggauuuguagccagccagcu

SEQ ID NO: 291044 - RNA, 64 nt, hsa
cuugagaaguuauauugggcaguggcuccaaucuguggaccaguauuucagcuuucccugaaga

SEQ ID NO: 291045 - RNA, 64 nt, hsa
aauuucucuccaccuggcucccaaauuuaaagauguggaccaaggccuguggguacuccagggg

SEQ ID NO: 291046 - RNA, 64 nt, hsa
ugggaggccggcagccaggccacagaauccacacguggaccauugugggucccugggaggccgg

SEQ ID NO: 291047 - RNA, 64 nt, hsa
ugggaggccggcagccaggccacggaauccacacguggaccauugugggucccuugggaggcca

SEQ ID NO: 291048 - RNA, 64 nt, hsa
ugggaggccagcagccagacuacggaauccacauguggaccaugggaagucagucucuugcgug

SEQ ID NO: 291049 - RNA, 64 nt, hsa
gggcccccagcugaccccuacugcagauccgcauguggaccaugagccggcugccagcacuagg

SEQ ID NO: 291050 - RNA, 64 nt, hsa
cccuugccagguggcuuuucaguuacagaguccaguggaccauuuuguagaaccaugcagcucc

SEQ ID NO: 291051 - RNA, 64 nt, hsa
gaggucuagggaaccacaacccuuauuguccuggguggaccaauccaaaggcuaagugauagug

SEQ ID NO: 291052 - RNA, 64 nt, hsa
aguaauagugacccuuucacguccuggagcccgaguggaccaaucggaagccuaagugacgaug

SEQ ID NO: 291053 - RNA, 64 nt, hsa
gagcuggguuucucuucccuuuuuaucugcugguguggaccacaccugggccuggccggaggaa

SEQ ID NO: 291054 - RNA, 64 nt, hsa
cugaccacagggugagacagcagggcccaggggaguggaccagcccccagcaaauuaucaccau

SEQ ID NO: 291055 - RNA, 64 nt, hsa
aguaguggacccaguucuauuguuggcuucagcgguggaccaagcacugguguuggcuucugca

SEQ ID NO: 291056 - RNA, 64 nt, hsa
agcgguggaccaagcacugguguuggcuucugcaguggaccaagcaccaguggcuucagcggug

SEQ ID NO: 291057 - RNA, 64 nt, hsa
agcgguggaccgagcacaggagcuggcuucggcgguggaccaaacacuggugcuggcuuuggug

SEQ ID NO: 291058 - RNA, 64 nt, hsa
cuuguuuccuuuuuuguuuuuaaauccuucucuagugacugaagaaauugugaguacauaauau

SEQ ID NO: 291059 - RNA, 64 nt, hsa
auuacuuugaauucagauuaauguucuacuacuugugacugagaaaaguuuaaugccggcaugg

SEQ ID NO: 291060 - RNA, 64 nt, hsa
gccaauccaaucggccauuucauacccaaugcaugugacugauaaagagauaacacccugucuc

SEQ ID NO: 291061 - RNA, 64 nt, hsa
aaaaaccaggcaaacaucugacucccaggauaaagugacugagagcaguagaagacuuguugag

SEQ ID NO: 291062 - RNA, 64 nt, hsa
cugguguuuuucagccagacagaggcauaauaaagugacugauguuuacagaacccaaaugaug

SEQ ID NO: 291063 - RNA, 64 nt, hsa
uaaguugggaaacagaaugggccagggagguugagugacugaagaccaaggguuggugcagccu

SEQ ID NO: 291064 - RNA, 64 nt, hsa
guccauggcuuuuguuugaugguuuucaauagaggugacugagauuguagggggggcauuuuug

SEQ ID NO: 291065 - RNA, 64 nt, hsa
gucauagagggggccaugaggcuggaauuggccagugacugaaucuuggagaugucggccaggu

SEQ ID NO: 291066 - RNA, 64 nt, hsa
cccaugcacauugggaagacuuggggcucuuucugugacugaggacacaggcacccaggauaag

SEQ ID NO: 291067 - RNA, 64 nt, hsa
uuauagccagguuuguguggcgcucccgacuuuugugacugacuggugucuucccauuuggacu

SEQ ID NO: 291068 - RNA, 64 nt, hsa
gacgacgacgacgccaccaccccagcccccgucugugacugaaggcccggugggaaaagaccac

SEQ ID NO: 291069 - RNA, 64 nt, hsa
acugucugcggcauuuuuuauaauauuguauauagugacugacaaauauuguauuacuguacau

SEQ ID NO: 291070 - RNA, 64 nt, hsa
uccccaccucccuugaucauacagugaggcuacagugacugaggggagaauccccuccuguuca

SEQ ID NO: 291071 - RNA, 64 nt, hsa
uucaucaagauaagcauuucuuuccugaguucaggugacugaggaagagccacaaaacaaaaca

SEQ ID NO: 291072 - RNA, 64 nt, hsa
gguauguguccaucucagcauucaccuuuaucaagugacugauuuuuuuuucuuuucuuuccuu

SEQ ID NO: 291073 - RNA, 64 nt, hsa
cugggauuacaggcgugagccacugcgccuggccgugacugauuuuuuuucauguagaauuguc

SEQ ID NO: 291074 - RNA, 64 nt, hsa
uuucucaauaguacaugaaaucaagaugcuuaugagcauggaaauguauuuaaaguuuuugcuu

SEQ ID NO: 291075 - RNA, 64 nt, hsa
uucuacgugugaguauaaaagacaaaaguugaacagcauggaaucucauugccaaauuauuagu

SEQ ID NO: 291076 - RNA, 64 nt, hsa
gcugcuuucagguaugugugucuaucauugaaagagcauggacucaaacaucagcccugaguuc

SEQ ID NO: 291077 - RNA, 64 nt, hsa
cuuuacccccacccaggaaaaccugcauugugcuagcauggaagaaucaugggcuuuggaauua

SEQ ID NO: 291078 - RNA, 64 nt, hsa
caggccccgaggagcccgaagucugcugcugugcagcauggaauuccuuuaaaaaggugcacua

SEQ ID NO: 291079 - RNA, 64 nt, hsa
gacagcuuauaaaaauaaagggaagaaaggaggcagcauggagagaggccugugcuagaagcuc

SEQ ID NO: 291080 - RNA, 64 nt, hsa
agcaggcauacagaagguuuguccugcucugggaagcauggaggauguuguacuucacuccucu

SEQ ID NO: 291081 - RNA, 64 nt, hsa
uuuucuucuagcaccagauaaacucugaaaucaaagcauggauaugagcucaguaggaaacuaa

SEQ ID NO: 291082 - RNA, 64 nt, hsa
guucaaaggcagcaaggcagugagcuaugagcccagcauggaugugucucaggcaccucauccc

SEQ ID NO: 291083 - RNA, 64 nt, hsa
agaucacacacaccaaaccagacagaggcagggcagcauggagacagguagacagaccuccagg

SEQ ID NO: 291084 - RNA, 64 nt, hsa
gagaguauccuugacugcuuaagucagccaguucagcauggauaccaacauuagcuuuucuucu

SEQ ID NO: 291085 - RNA, 64 nt, hsa
cagaaguuaggaggcaacuuugggauggugcuagagcauggaaagcacagagaauuggacaaac

SEQ ID NO: 291086 - RNA, 64 nt, hsa
ugcuucucaagggacacaguggccugcaugggccagcauggacccugggcugaucaugugcauu

SEQ ID NO: 291087 - RNA, 64 nt, hsa
gcuucucuggggacacagugggcccacaugggccagcauggacccugggcuagagcaagcacau

SEQ ID NO: 291088 - RNA, 64 nt, hsa
ugaacuuaaccuguuucuggcuggcuagccaaccagcauggaaaacagauuagguuagauguuc

SEQ ID NO: 291089 - RNA, 64 nt, hsa
gcucuggucccaccucuggaaaucugauucagccagcauggauaauaacccagauaacuaaccc

SEQ ID NO: 291090 - RNA, 64 nt, hsa; identical to SEQ ID NO: 51723

SEQ ID NO: 291091 - RNA, 64 nt, hsa; identical to SEQ ID NO: 51724

SEQ ID NO: 291092 - RNA, 64 nt, hsa; identical to SEQ ID NO: 51725

SEQ ID NO: 291093 - RNA, 64 nt, hsa; identical to SEQ ID NO: 51726

SEQ ID NO: 291094 - RNA, 64 nt, hsa; identical to SEQ ID NO: 51727

SEQ ID NO: 291095 - RNA, 64 nt, hsa; identical to SEQ ID NO: 51728

SEQ ID NO: 291096 - RNA, 64 nt, hsa; identical to SEQ ID NO: 51729

SEQ ID NO: 291097 - RNA, 64 nt, hsa; identical to SEQ ID NO: 51730

SEQ ID NO: 291098 - RNA, 64 nt, hsa; identical to SEQ ID NO: 51731

SEQ ID NO: 291099 - RNA, 64 nt, hsa; identical to SEQ ID NO: 51732

SEQ ID NO: 291100 - RNA, 64 nt, hsa; identical to SEQ ID NO: 51733

SEQ ID NO: 291101 - RNA, 64 nt, hsa; identical to SEQ ID NO: 51734

SEQ ID NO: 291102 - RNA, 64 nt, hsa; identical to SEQ ID NO: 51735

SEQ ID NO: 291103 - RNA, 64 nt, hsa; identical to SEQ ID NO: 51736

SEQ ID NO: 291104 - RNA, 64 nt, hsa; identical to SEQ ID NO: 51737

SEQ ID NO: 291105 - RNA, 64 nt, hsa; identical to SEQ ID NO: 51738

SEQ ID NO: 291106 - RNA, 64 nt, hsa; identical to SEQ ID NO: 51739

SEQ ID NO: 291107 - RNA, 64 nt, hsa; identical to SEQ ID NO: 51740

SEQ ID NO: 291108 - RNA, 64 nt, hsa; identical to SEQ ID NO: 51741

SEQ ID NO: 291109 - RNA, 64 nt, hsa; identical to SEQ ID NO: 51742

SEQ ID NO: 291110 - RNA, 64 nt, hsa; identical to SEQ ID NO: 51743

SEQ ID NO: 291111 - RNA, 64 nt, hsa; identical to SEQ ID NO: 51744

SEQ ID NO: 291112 - RNA, 64 nt, hsa; identical to SEQ ID NO: 51745

SEQ ID NO: 291113 - RNA, 64 nt, hsa; identical to SEQ ID NO: 51746

SEQ ID NO: 291114 - RNA, 64 nt, hsa; identical to SEQ ID NO: 51747

SEQ ID NO: 291115 - RNA, 64 nt, hsa; identical to SEQ ID NO: 51748

SEQ ID NO: 291116 - RNA, 64 nt, hsa
auauguugucaugcaggguuugggccaagaaagcaugcagaaaaaaaugccaugugauuguaau

SEQ ID NO: 291117 - RNA, 64 nt, hsa
ugauucucucacaggcuugggaaauccuguuagcaugcagaauaaugugguaacuuugucaauu

SEQ ID NO: 291118 - RNA, 64 nt, hsa
cugaaacugagagagugaagaaccauaaaacgcuaugcagaaggaacauuauggagagaaaggg

SEQ ID NO: 291119 - RNA, 64 nt, hsa
cucuagaaucugccacauucauuuucaaaugcaaaugcagaagacuuaccuuaguucaagggga

SEQ ID NO: 291120 - RNA, 62 nt, hsa
aagcagaaagagcucauugaaucaugcauaccaugcagaaaguugagcuuuuagguuuuguc

SEQ ID NO: 291121 - RNA, 64 nt, hsa
aauauagugaggaguagcauaauauuuuuuaauaaugcagaaaacaucacugaaaugagaguca

SEQ ID NO: 291122 - RNA, 64 nt, hsa
uauggagugaaauuauuuuuugcaucauuuaaacaugcagaagauguuuaaaaauaaaaaaaaa

SEQ ID NO: 291123 - RNA, 64 nt, hsa
ugcaacaaagacuugcuuuaaauagauuucagcuaugcagaaaaauuuagcuuaugcuuccaua

SEQ ID NO: 291124 - RNA, 64 nt, hsa
caaauauuuguugacuaaaauuauagcauuuuuaaugcagaaaauuauaaagaauuuggagauu

SEQ ID NO: 291125 - RNA, 64 nt, hsa
ugauagugccaaaaaaaaaaucucagaaaucuuaaugcagaaauuauauagucuccucagauuu

SEQ ID NO: 291126 - RNA, 64 nt, hsa
cauucgggcuugucuuccucuuccauguccccgcaugcagaauccucucuuucuucugccaggg

SEQ ID NO: 291127 - RNA, 64 nt, hsa
uaauuaauuauagcaagugauaugaacugugauaaugcagaagguuuccuuuuaaaauaaaguu

SEQ ID NO: 291128 - RNA, 64 nt, hsa
gaaacacaaaaccaaggaguacauuaagaaguacaugcagaaguuuggggcuguuuacaaaccc

SEQ ID NO: 291129 - RNA, 64 nt, hsa
ggcucaacgggaggcucagaaacaacagcaacagaugcagaaccugggaaugacaucaccacug

SEQ ID NO: 291130 - RNA, 64 nt, hsa
gugcauguggcuuacugugucugaagauacugacaugcagaagaaauaagugcauucuucugcu

SEQ ID NO: 291131 - RNA, 64 nt, hsa
caaagcacccaacaaugguaaauguuuuuuaaaaaugcagaacuaagauuuuugacucuaaaga

SEQ ID NO: 291132 - RNA, 64 nt, hsa
aacaugcuaugcuuauaugucuucuauaaauccaaugcagaauuuaaaauuucaguuuacucua

SEQ ID NO: 291133 - RNA, 64 nt, hsa
agaucuuaaugaguaaaacaacugcuacauacauaugcagaauguguaauaaaacaaaaagcaa

SEQ ID NO: 291134 - RNA, 64 nt, hsa
gaagcaagagaacaccugcaggaagugaaucaagaugcagaacacagaggaauaaucaccugcu

SEQ ID NO: 291135 - RNA, 64 nt, hsa
cuauuuguuccuagguguaaaauuuuaauaguuaaugcagaauucuguaaucauugaaucauua

SEQ ID NO: 291136 - RNA, 64 nt, hsa
auuauaaaagauacauggaaggaaguggaaccagaugcagaagaggaaaugauggaaggacuua

SEQ ID NO: 291137 - RNA, 64 nt, hsa
gacagugagcucugcugccagucaaggccugcauaugcagaaugacgaugccugccuuggugcu

SEQ ID NO: 291138 - RNA, 64 nt, hsa
gugcaaaucaguggaaggagcggcaaacugggacaugcagaauugaauuugcucaaaaaagaug

SEQ ID NO: 291139 - RNA, 64 nt, hsa
gauuaucacagcccucuuuucuccugaauuuuuaaugcagaaguuugaaugaagcaagggaagg

SEQ ID NO: 291140 - RNA, 64 nt, hsa
gcagaugccagcgccaugcuuccuauacaguucuaugcagaacagugagccaaauaaaccucuu

SEQ ID NO: 291141 - RNA, 64 nt, hsa
aagauuccuguccuugagaaguugaagccgucucaugcagaagagggaaugagcuuccauuaug

SEQ ID NO: 291142 - RNA, 64 nt, hsa
aggcagggcccugcuuuucuaggaauugacuccaaugcagaauagugagaaaucaacaaaaagc

SEQ ID NO: 291143 - RNA, 64 nt, hsa
aguggucuaugaggaagagaaaagguaccugaggaugcagaaguaccuaccacaugggaaccgu

SEQ ID NO: 291144 - RNA, 64 nt, hsa
gagagaggcgggccccagacccaugugcugggaaaugcagaaaucacguugcuggugguuuuuc

SEQ ID NO: 291145 - RNA, 64 nt, hsa
auucaguugcuuugcccaagauaggaguucucugaugcagaaauuauugggcucuuuuagggua

SEQ ID NO: 291146 - RNA, 64 nt, hsa
agacucccgaacucaugcucagaacuauuacaacaugcagaaacaacaaauccagucaugugug

SEQ ID NO: 291147 - RNA, 64 nt, hsa
cauuuuagagacgaggaaacugggacccucaauuaugcagaauggaugagugguaccgccaaaa

SEQ ID NO: 291148 - RNA, 64 nt, hsa
cgcaugucacuuagucuaacgcugacagaaaugaaugcagaaggaagauuuucaguccugaacg

SEQ ID NO: 291149 - RNA, 64 nt, hsa
aaaagaaaaaaaaaaagcuuauguuucuugucaaaugcagaaauguuccuuccgccacucacug

SEQ ID NO: 291150 - RNA, 64 nt, hsa; identical to SEQ ID NO: 161534

SEQ ID NO: 291151 - RNA, 64 nt, hsa; identical to SEQ ID NO: 161535

SEQ ID NO: 291152 - RNA, 64 nt, hsa; identical to SEQ ID NO: 161536

SEQ ID NO: 291153 - RNA, 64 nt, hsa; identical to SEQ ID NO: 161537

SEQ ID NO: 291154 - RNA, 64 nt, hsa; identical to SEQ ID NO: 161538

SEQ ID NO: 291155 - RNA, 64 nt, hsa; identical to SEQ ID NO: 161539

SEQ ID NO: 291156 - RNA, 64 nt, hsa; identical to SEQ ID NO: 161540

SEQ ID NO: 291157 - RNA, 64 nt, hsa; identical to SEQ ID NO: 161541

SEQ ID NO: 291158 - RNA, 64 nt, hsa; identical to SEQ ID NO: 161542

SEQ ID NO: 291159 - RNA, 64 nt, hsa; identical to SEQ ID NO: 161543

SEQ ID NO: 291160 - RNA, 64 nt, hsa; identical to SEQ ID NO: 161544

SEQ ID NO: 291161 - RNA, 64 nt, hsa; identical to SEQ ID NO: 161545

SEQ ID NO: 291162 - RNA, 64 nt, hsa; identical to SEQ ID NO: 161546

SEQ ID NO: 291163 - RNA, 64 nt, hsa; identical to SEQ ID NO: 161547

SEQ ID NO: 291164 - RNA, 64 nt, hsa; identical to SEQ ID NO: 161548

SEQ ID NO: 291165 - RNA, 64 nt, hsa; identical to SEQ ID NO: 161549

SEQ ID NO: 291166 - RNA, 64 nt, hsa; identical to SEQ ID NO: 161550

SEQ ID NO: 291167 - RNA, 64 nt, hsa; identical to SEQ ID NO: 161551

SEQ ID NO: 291168 - RNA, 64 nt, hsa; identical to SEQ ID NO: 161552

SEQ ID NO: 291169 - RNA, 64 nt, hsa; identical to SEQ ID NO: 161553

SEQ ID NO: 291170 - RNA, 64 nt, hsa; identical to SEQ ID NO: 161554

SEQ ID NO: 291171 - RNA, 64 nt, hsa; identical to SEQ ID NO: 161555

SEQ ID NO: 291172 - RNA, 64 nt, hsa; identical to SEQ ID NO: 161556

SEQ ID NO: 291173 - RNA, 64 nt, hsa
uuucuagagguacauauuaggccuuuuaugaacacuaaaacaaugaggaaauguuggucauggg

SEQ ID NO: 291174 - RNA, 64 nt, hsa
uggcuucucaauuuucuuccuucucugccccuaccuaaaacauucuccucggaaauuacauggu

SEQ ID NO: 291175 - RNA, 64 nt, hsa
guugccuccccucauaugguuuuuggccaagugacuaaaacaguuuuccacaacuguaaacaaa

SEQ ID NO: 291176 - RNA, 64 nt, hsa
uuguacuuuauuuuuuugugccuucugaaaggaucuaaaacaaaaauauuuugccuuuuuuucc

SEQ ID NO: 291177 - RNA, 64 nt, hsa
uauaaaaauguuuuuaaacuugacaaucauuacacuaaaacagauuugauaaucuuauucacag

SEQ ID NO: 291178 - RNA, 64 nt, hsa
acauggaaauauuaaaauuuuacacuuuuacuagcuaaaacauaaucacaaagcuuuaucgugu

SEQ ID NO: 291179 - RNA, 64 nt, hsa
uucuaaucugagugaguuacugagcuuugguccacuaaaacaagcugagcuuugguccacuaaa

SEQ ID NO: 291180 - RNA, 64 nt, hsa
uuugguccacuaaaacaagcugagcuuugguccacuaaaacaagaugaaaaauacaagagugac

SEQ ID NO: 291181 - RNA, 64 nt, hsa
cauuuuagaauaacaagaacaccaagaauuaccccuaaaacagagacccuguauuuaaucuacu

SEQ ID NO: 291182 - RNA, 64 nt, hsa
gauguucauagcauguuuuauuacauugaagaaacuaaaacauaaaugaaaagaaacacuaggu

SEQ ID NO: 291183 - RNA, 64 nt, hsa
gacuuuaucugaaaaugauuccucuucccaugaccuaaaacacugugaggaaaaaucauucaag

SEQ ID NO: 291184 - RNA, 64 nt, hsa
agcccuuugcuucuuucauuacuuauaaucuccucuaaaacaaccucugcauguuuuuuuuaaa

SEQ ID NO: 291185 - RNA, 64 nt, hsa
aauuguuuuacugacaauuuuuccuuuuucuacacuaaaacaauaugugauauauuuccccucu

SEQ ID NO: 291186 - RNA, 64 nt, hsa
uucauccaauauaucauucaaaugcaucugauuucuaaaacauauuacauuuuaugcugaucuu

SEQ ID NO: 291187 - RNA, 64 nt, hsa
uuccuuacucgauguuuucuuucaacugagaagccuaaaacaaacaaaaaccuuguguguuauc

SEQ ID NO: 291188 - RNA, 64 nt, hsa
augcagacauauaaaguaacauugagaaugacaacuaaaacauuccauuguuaugguccugaau

SEQ ID NO: 291189 - RNA, 64 nt, hsa
uucuaaaaauucauaaucccaaucuaauuaugagcuaaaacauccagcaaacucaaguugaagg

SEQ ID NO: 291190 - RNA, 64 nt, hsa
uggcauccucacaauugaguugaagcuguuccuccuaaaacaauccugacuuuuauuuugccaa

SEQ ID NO: 291191 - RNA, 64 nt, hsa
uuacuuuauacucacuuaaaaucaagaaucccaucuaaaacacauagguaccuuaucugaaacu

SEQ ID NO: 291192 - RNA, 64 nt, hsa
cuaagucaccgccccacccgccgcauuacauuuccuaaaacauacugcugccaaagaccaacug

SEQ ID NO: 291193 - RNA, 64 nt, hsa
guagagaugguuuguuaccauccuuuaaucauaacuaaaacauugaaaacagaacaaaugagaa

SEQ ID NO: 291194 - RNA, 64 nt, hsa
accaaccaccaaaaacuagacaaauaaagacaaacuaaaacaaaacagaacaaaagcaaaggaa

SEQ ID NO: 291195 - RNA, 64 nt, hsa
uuuaucuguauaucugaacucuugaaacuuauagcuaaaacacuaggauuuaucugcaguguuc

SEQ ID NO: 291196 - RNA, 64 nt, hsa
caguguucagggagauaauucugccuuuaauugucuaaaacaaaaacaaaaccagccaaccuau

SEQ ID NO: 291197 - RNA, 64 nt, hsa
acuaaaucuucagcauagaaggaaguguguuugccuaaaacaaucuaaaacaauucccuucuuu

SEQ ID NO: 291198 - RNA, 64 nt, hsa
cagcauagaaggaaguguguuugccuaaaacaaucuaaaacaauucccuucuuuuucaucccag

SEQ ID NO: 291199 - RNA, 64 nt, hsa
auauaugcacagacauggagagaauuaguuuuuacuaaaacauuuaucagaaauuuuaauacuc

SEQ ID NO: 291200 - RNA, 64 nt, hsa
gauguuuuuaaaaccuuagggcaggaaagaacuucuaaaacauuccagaauacccgguaguucc

SEQ ID NO: 291201 - RNA, 64 nt, hsa
cugcuaauuaaucauuuuaaacuuucaaaaacugcuaaaacaggugccaugaaucagguacaau

SEQ ID NO: 291202 - RNA, 64 nt, hsa
uaccuuuaagagaagcccuuugaauaaucaagugcuaaaacaaaaucaggugcuuuuuuaaaac

SEQ ID NO: 291203 - RNA, 64 nt, hsa
guguauuucuggaucauuuuuuaaaugaccucuucuaaaacauaacugucacuuaccugaaaug

SEQ ID NO: 291204 - RNA, 64 nt, hsa
aaaauguaagauuuuaagauccucuaacacuguacuaaaacauuucaauaaaaucauucugacu

SEQ ID NO: 291205 - RNA, 64 nt, hsa
aaguuauaaauaauuauuuuuguuaacaaagacacuaaaacaguauguucugguuuuggcccuc

SEQ ID NO: 291206 - RNA, 64 nt, hsa
gauuacgucugcaucuuuucuaacuuacuauuuucuaaaacacuuguggagcaucaagcaguuu

SEQ ID NO: 291207 - RNA, 59 nt, hsa
gcuccuuuuguccccagggccccucccucugccccaagcagccagccagucuugccuag

SEQ ID NO: 291208 - RNA, 59 nt, hsa
agucacagcugcagcugggccccaugcucugccccaagcccccaaccccgcggugcucu

SEQ ID NO: 291209 - RNA, 59 nt, hsa
ugcagugguugggaggagcuugaccagugugccccaaggaguggaguagagcccaaucu

SEQ ID NO: 291210 - RNA, 59 nt, hsa
aggcugaaccuggcccaacagaaaaacccugccccaaugcaccugcaggcaagguaccc

SEQ ID NO: 291211 - RNA, 59 nt, hsa
acauggccagugccuguuccccacucccuugccccaaaaggaucuggaacacagguguu

SEQ ID NO: 291212 - RNA, 59 nt, hsa
gaacagagcuggauuccuugugccucauaugccccaaugcuggucucaguaaaacacug

SEQ ID NO: 291213 - RNA, 59 nt, hsa
gcaccuccaccugccccagccccugccucugccccaaguggggccagcugcccucacuu

SEQ ID NO: 291214 - RNA, 59 nt, hsa
ggguuucugccacuuccgggucuaggcccugccccaaauccagccaguccugccccagc

SEQ ID NO: 291215 - RNA, 59 nt, hsa
caguugaauuauggagggaaauucccuuuugccccaagcauuucuauauuuaaagcaau

SEQ ID NO: 291216 - RNA, 59 nt, hsa
cccuaaucugaacaguuaaaacccccaaaugccccaaaauccaaaccuuccugaacgcu

SEQ ID NO: 291217 - RNA, 59 nt, hsa
aaugcagagaugaggcuaaggcaagaauaugccccaacuaaagcauagauuccccaaag

SEQ ID NO: 291218 - RNA, 59 nt, hsa
ccugcugccugugugugccugggggcuacugccccaacuccugcggugacaccacccag

SEQ ID NO: 291219 - RNA, 59 nt, hsa
agguauaucauuauaacugaaggagaaggugccccaaaaugcaagauuuuccacaagau

SEQ ID NO: 291220 - RNA, 59 nt, hsa
aggaauguuaaagucagugggaacgugacugccccaacuccuggaagcuguguccuugc

SEQ ID NO: 291221 - RNA, 59 nt, hsa
gcauccagauccuggauccuagacuccuaugccccaaccacugggucaugcgaucccca

SEQ ID NO: 291222 - RNA, 59 nt, hsa
guacccagauccuggauccuagacuccuaugccccaaccauugggucaugggaucccag

SEQ ID NO: 291223 - RNA, 59 nt, hsa
cucccagccugcacuugcaggaguggugaugccccaagucugcgaauccagggugcacg

SEQ ID NO: 291224 - RNA, 59 nt, hsa
aagcaggugcugcauggcucaccaucauaugccccaaacaacugaaaguuggcgguuau

SEQ ID NO: 291225 - RNA, 59 nt, hsa
ggucaaucuucccaccccaccgugugggcugccccaaccccaaaugugcccagggaggg

SEQ ID NO: 291226 - RNA, 59 nt, hsa
uuggccggccccacugcccccccauucuaugccccaaccaccaaggcuuucccaucuug

SEQ ID NO: 291227 - RNA, 64 nt, hsa; identical to SEQ ID NO: 105615

SEQ ID NO: 291228 - RNA, 64 nt, hsa; identical to SEQ ID NO: 105616

SEQ ID NO: 291229 - RNA, 64 nt, hsa; identical to SEQ ID NO: 105617

SEQ ID NO: 291230 - RNA, 64 nt, hsa; identical to SEQ ID NO: 105618

SEQ ID NO: 291231 - RNA, 64 nt, hsa; identical to SEQ ID NO: 105619

SEQ ID NO: 291232 - RNA, 64 nt, hsa; identical to SEQ ID NO: 105620

SEQ ID NO: 291233 - RNA, 64 nt, hsa; identical to SEQ ID NO: 105621

SEQ ID NO: 291234 - RNA, 64 nt, hsa; identical to SEQ ID NO: 105622

SEQ ID NO: 291235 - RNA, 64 nt, hsa; identical to SEQ ID NO: 105623

SEQ ID NO: 291236 - RNA, 64 nt, hsa; identical to SEQ ID NO: 105624

SEQ ID NO: 291237 - RNA, 64 nt, hsa; identical to SEQ ID NO: 96889

SEQ ID NO: 291238 - RNA, 64 nt, hsa; identical to SEQ ID NO: 96890

SEQ ID NO: 291239 - RNA, 64 nt, hsa; identical to SEQ ID NO: 96891

SEQ ID NO: 291240 - RNA, 64 nt, hsa; identical to SEQ ID NO: 96892

SEQ ID NO: 291241 - RNA, 64 nt, hsa; identical to SEQ ID NO: 96893

SEQ ID NO: 291242 - RNA, 64 nt, hsa; identical to SEQ ID NO: 96894

SEQ ID NO: 291243 - RNA, 64 nt, hsa; identical to SEQ ID NO: 96895

SEQ ID NO: 291244 - RNA, 64 nt, hsa; identical to SEQ ID NO: 96896

SEQ ID NO: 291245 - RNA, 64 nt, hsa; identical to SEQ ID NO: 96897

SEQ ID NO: 291246 - RNA, 64 nt, hsa; identical to SEQ ID NO: 96898

SEQ ID NO: 291247 - RNA, 64 nt, hsa; identical to SEQ ID NO: 96899

SEQ ID NO: 291248 - RNA, 64 nt, hsa; identical to SEQ ID NO: 96900

SEQ ID NO: 291249 - RNA, 64 nt, hsa; identical to SEQ ID NO: 96901

SEQ ID NO: 291250 - RNA, 64 nt, hsa; identical to SEQ ID NO: 96902

SEQ ID NO: 291251 - RNA, 64 nt, hsa; identical to SEQ ID NO: 96903

SEQ ID NO: 291252 - RNA, 64 nt, hsa; identical to SEQ ID NO: 96904

SEQ ID NO: 291253 - RNA, 64 nt, hsa; identical to SEQ ID NO: 96905

SEQ ID NO: 291254 - RNA, 64 nt, hsa; identical to SEQ ID NO: 96906

SEQ ID NO: 291255 - RNA, 64 nt, hsa; identical to SEQ ID NO: 96907

SEQ ID NO: 291256 - RNA, 64 nt, hsa; identical to SEQ ID NO: 96908

SEQ ID NO: 291257 - RNA, 64 nt, hsa; identical to SEQ ID NO: 96909

SEQ ID NO: 291258 - RNA, 64 nt, hsa; identical to SEQ ID NO: 96910

SEQ ID NO: 291259 - RNA, 64 nt, hsa; identical to SEQ ID NO: 96911

SEQ ID NO: 291260 - RNA, 64 nt, hsa; identical to SEQ ID NO: 96912

SEQ ID NO: 291261 - RNA, 64 nt, hsa; identical to SEQ ID NO: 96913

SEQ ID NO: 291262 - RNA, 64 nt, hsa; identical to SEQ ID NO: 96914

SEQ ID NO: 291263 - RNA, 64 nt, hsa; identical to SEQ ID NO: 96915

SEQ ID NO: 291264 - RNA, 64 nt, hsa; identical to SEQ ID NO: 96916

SEQ ID NO: 291265 - RNA, 64 nt, hsa; identical to SEQ ID NO: 290809

SEQ ID NO: 291266 - RNA, 64 nt, hsa; identical to SEQ ID NO: 290810

SEQ ID NO: 291267 - RNA, 64 nt, hsa; identical to SEQ ID NO: 45110

SEQ ID NO: 291268 - RNA, 64 nt, hsa; identical to SEQ ID NO: 45111

SEQ ID NO: 291269 - RNA, 64 nt, hsa; identical to SEQ ID NO: 45112

SEQ ID NO: 291270 - RNA, 64 nt, hsa; identical to SEQ ID NO: 45113

SEQ ID NO: 291271 - RNA, 59 nt, hsa; identical to SEQ ID NO: 45114

SEQ ID NO: 291272 - RNA, 64 nt, hsa; identical to SEQ ID NO: 45115

SEQ ID NO: 291273 - RNA, 64 nt, hsa; identical to SEQ ID NO: 45116

SEQ ID NO: 291274 - RNA, 64 nt, hsa; identical to SEQ ID NO: 45117

SEQ ID NO: 291275 - RNA, 64 nt, hsa; identical to SEQ ID NO: 45118

SEQ ID NO: 291276 - RNA, 64 nt, hsa; identical to SEQ ID NO: 45119

SEQ ID NO: 291277 - RNA, 64 nt, hsa; identical to SEQ ID NO: 45120

SEQ ID NO: 291278 - RNA, 64 nt, hsa; identical to SEQ ID NO: 45121

SEQ ID NO: 291279 - RNA, 64 nt, hsa; identical to SEQ ID NO: 45122

SEQ ID NO: 291280 - RNA, 64 nt, hsa; identical to SEQ ID NO: 45123

SEQ ID NO: 291281 - RNA, 64 nt, hsa; identical to SEQ ID NO: 45124

SEQ ID NO: 291282 - RNA, 64 nt, hsa; identical to SEQ ID NO: 45125

SEQ ID NO: 291283 - RNA, 64 nt, hsa; identical to SEQ ID NO: 45126

SEQ ID NO: 291284 - RNA, 64 nt, hsa; identical to SEQ ID NO: 45127

SEQ ID NO: 291285 - RNA, 64 nt, hsa; identical to SEQ ID NO: 45128

SEQ ID NO: 291286 - RNA, 64 nt, hsa; identical to SEQ ID NO: 45129

SEQ ID NO: 291287 - RNA, 64 nt, hsa; identical to SEQ ID NO: 45130

SEQ ID NO: 291288 - RNA, 64 nt, hsa; identical to SEQ ID NO: 45131

SEQ ID NO: 291289 - RNA, 64 nt, hsa; identical to SEQ ID NO: 45132

SEQ ID NO: 291290 - RNA, 64 nt, hsa; identical to SEQ ID NO: 45133

SEQ ID NO: 291291 - RNA, 64 nt, hsa; identical to SEQ ID NO: 45134

SEQ ID NO: 291292 - RNA, 64 nt, hsa; identical to SEQ ID NO: 45135

SEQ ID NO: 291293 - RNA, 64 nt, hsa; identical to SEQ ID NO: 45136

SEQ ID NO: 291294 - RNA, 64 nt, hsa; identical to SEQ ID NO: 45137

SEQ ID NO: 291295 - RNA, 64 nt, hsa; identical to SEQ ID NO: 45138

SEQ ID NO: 291296 - RNA, 64 nt, hsa; identical to SEQ ID NO: 45139

SEQ ID NO: 291297 - RNA, 64 nt, hsa; identical to SEQ ID NO: 45140

SEQ ID NO: 291298 - RNA, 64 nt, hsa; identical to SEQ ID NO: 45141

SEQ ID NO: 291299 - RNA, 64 nt, hsa; identical to SEQ ID NO: 45142

SEQ ID NO: 291300 - RNA, 64 nt, hsa; identical to SEQ ID NO: 45143

SEQ ID NO: 291301 - RNA, 64 nt, hsa; identical to SEQ ID NO: 45144

SEQ ID NO: 291302 - RNA, 64 nt, hsa; identical to SEQ ID NO: 45145

SEQ ID NO: 291303 - RNA, 64 nt, hsa; identical to SEQ ID NO: 45146

SEQ ID NO: 291304 - RNA, 64 nt, hsa; identical to SEQ ID NO: 45147

SEQ ID NO: 291305 - RNA, 64 nt, hsa; identical to SEQ ID NO: 45148

SEQ ID NO: 291306 - RNA, 64 nt, hsa; identical to SEQ ID NO: 45149

SEQ ID NO: 291307 - RNA, 64 nt, hsa; identical to SEQ ID NO: 45150

SEQ ID NO: 291308 - RNA, 64 nt, hsa; identical to SEQ ID NO: 45151

SEQ ID NO: 291309 - RNA, 64 nt, hsa; identical to SEQ ID NO: 45152

SEQ ID NO: 291310 - RNA, 64 nt, hsa; identical to SEQ ID NO: 45153

SEQ ID NO: 291311 - RNA, 64 nt, hsa; identical to SEQ ID NO: 45154

SEQ ID NO: 291312 - RNA, 64 nt, hsa; identical to SEQ ID NO: 45155

SEQ ID NO: 291313 - RNA, 64 nt, hsa; identical to SEQ ID NO: 45156

SEQ ID NO: 291314 - RNA, 64 nt, hsa; identical to SEQ ID NO: 45157

SEQ ID NO: 291315 - RNA, 64 nt, hsa; identical to SEQ ID NO: 45158

SEQ ID NO: 291316 - RNA, 64 nt, hsa; identical to SEQ ID NO: 45159

SEQ ID NO: 291317 - RNA, 64 nt, hsa; identical to SEQ ID NO: 45160

SEQ ID NO: 291318 - RNA, 64 nt, hsa; identical to SEQ ID NO: 45161

SEQ ID NO: 291319 - RNA, 64 nt, hsa; identical to SEQ ID NO: 45162

SEQ ID NO: 291320 - RNA, 64 nt, hsa; identical to SEQ ID NO: 45163

SEQ ID NO: 291321 - RNA, 64 nt, hsa; identical to SEQ ID NO: 45164

SEQ ID NO: 291322 - RNA, 64 nt, hsa; identical to SEQ ID NO: 45165

SEQ ID NO: 291323 - RNA, 64 nt, hsa; identical to SEQ ID NO: 45166

SEQ ID NO: 291324 - RNA, 64 nt, hsa; identical to SEQ ID NO: 45167

SEQ ID NO: 291325 - RNA, 64 nt, hsa; identical to SEQ ID NO: 45168

SEQ ID NO: 291326 - RNA, 64 nt, hsa; identical to SEQ ID NO: 45169

SEQ ID NO: 291327 - RNA, 64 nt, hsa; identical to SEQ ID NO: 45170

SEQ ID NO: 291328 - RNA, 64 nt, hsa; identical to SEQ ID NO: 45171

SEQ ID NO: 291329 - RNA, 64 nt, hsa; identical to SEQ ID NO: 45172

SEQ ID NO: 291330 - RNA, 64 nt, hsa; identical to SEQ ID NO: 45173

SEQ ID NO: 291331 - RNA, 64 nt, hsa; identical to SEQ ID NO: 45174

SEQ ID NO: 291332 - RNA, 64 nt, hsa; identical to SEQ ID NO: 45175

SEQ ID NO: 291333 - RNA, 64 nt, hsa; identical to SEQ ID NO: 45176

SEQ ID NO: 291334 - RNA, 64 nt, hsa; identical to SEQ ID NO: 45177

SEQ ID NO: 291335 - RNA, 64 nt, hsa; identical to SEQ ID NO: 45178

SEQ ID NO: 291336 - RNA, 64 nt, hsa; identical to SEQ ID NO: 45179

SEQ ID NO: 291337 - RNA, 64 nt, hsa; identical to SEQ ID NO: 45180

SEQ ID NO: 291338 - RNA, 64 nt, hsa; identical to SEQ ID NO: 45181

SEQ ID NO: 291339 - RNA, 64 nt, hsa; identical to SEQ ID NO: 45182

SEQ ID NO: 291340 - RNA, 64 nt, hsa; identical to SEQ ID NO: 45183

SEQ ID NO: 291341 - RNA, 64 nt, hsa; identical to SEQ ID NO: 45184

SEQ ID NO: 291342 - RNA, 64 nt, hsa; identical to SEQ ID NO: 45185

SEQ ID NO: 291343 - RNA, 64 nt, hsa; identical to SEQ ID NO: 45186

SEQ ID NO: 291344 - RNA, 64 nt, hsa; identical to SEQ ID NO: 45187

SEQ ID NO: 291345 - RNA, 64 nt, hsa; identical to SEQ ID NO: 45188

SEQ ID NO: 291346 - RNA, 64 nt, hsa; identical to SEQ ID NO: 45189

SEQ ID NO: 291347 - RNA, 64 nt, hsa; identical to SEQ ID NO: 45190

SEQ ID NO: 291348 - RNA, 64 nt, hsa; identical to SEQ ID NO: 45191

SEQ ID NO: 291349 - RNA, 64 nt, hsa; identical to SEQ ID NO: 45192

SEQ ID NO: 291350 - RNA, 64 nt, hsa; identical to SEQ ID NO: 45193

SEQ ID NO: 291351 - RNA, 64 nt, hsa; identical to SEQ ID NO: 45194

SEQ ID NO: 291352 - RNA, 64 nt, hsa; identical to SEQ ID NO: 45195

SEQ ID NO: 291353 - RNA, 64 nt, hsa; identical to SEQ ID NO: 45196

SEQ ID NO: 291354 - RNA, 64 nt, hsa
cagacaguuguuucuguguccuguucuacccccacuccaguacauaacuacuauguacugugua

SEQ ID NO: 291355 - RNA, 64 nt, hsa
ucccucugucuggaguaguccuugccucuuccugcuccaguagggccuuuucccuaccccagcc

SEQ ID NO: 291356 - RNA, 64 nt, hsa
acaacccuuaauugccacgugugcacuuacuacucuccaguaugucuuauuacucuccaguaug

SEQ ID NO: 291357 - RNA, 64 nt, hsa
gugcacuuacuacucuccaguaugucuuauuacucuccaguaugucacgcaucuuuaacuuuuc

SEQ ID NO: 291358 - RNA, 64 nt, hsa
uagagccugugcagccugggcugcugucauugcccuccaguaagggcucaggguuuugcuuuua

SEQ ID NO: 291359 - RNA, 64 nt, hsa
gaaauggguacccuaugaucccccuccccuucuccuccaguaaauaccuggaagagggaaccug

SEQ ID NO: 291360 - RNA, 64 nt, hsa
uuuguggaaggugaaggaagacccacagagugcucaggaugaugcuauugcuggagagcgaaag

SEQ ID NO: 291361 - RNA, 64 nt, hsa
ugggcugggaaaugucucuuucauauuguaaguccaggaugaacuaggagaaagcaauuuguug

SEQ ID NO: 291362 - RNA, 64 nt, hsa
gaaggccaaggagaguccuugcacccgugagcgucaggaugaggaaaugacaggaggaagacgu

SEQ ID NO: 291363 - RNA, 64 nt, hsa
agggauuuccccauuucuguuugcugccugaaagcaggaugaggaaggccaaggagaguccuug

SEQ ID NO: 291364 - RNA, 64 nt, hsa
ccaccgauacacugggaccaccccuuaccccggacaggaugaauggaucaaaggagugagguug

SEQ ID NO: 291365 - RNA, 64 nt, hsa
cuagucuaagacccagauucugccaacauuugggcaggaugagagggcugacccugggcuccaa

SEQ ID NO: 291366 - RNA, 64 nt, hsa
uaauguaaauaaagugaguaauugguaugacuugcaggaugauguacauguuaguuuguagcuc

SEQ ID NO: 291367 - RNA, 64 nt, hsa
acuugcaggaugauguacauguuaguuuguagcucaggaugauuguuaagcaauagauuugcuc

SEQ ID NO: 291368 - RNA, 64 nt, hsa
ccugggccuccucacaacauggugucuggauucccaggaugagcaucccaggaucgcaagagcc

SEQ ID NO: 291369 - RNA, 64 nt, hsa
uagcuuugcucugccaacuucuucagagcugacacaggaugaaggcaaugccauccucaaacac

SEQ ID NO: 291370 - RNA, 64 nt, hsa
uguuuguauacaaaggggcccuccuuaaaagggacaggaugaccuucccgaggaacucauuggc

SEQ ID NO: 291371 - RNA, 64 nt, hsa
gcgcuagggguucuuagucucuggggcuacuaggcaggaugaauuugacugggucgguaggagc

SEQ ID NO: 291372 - RNA, 64 nt, hsa
caaaaguuguggguuaggguuucucccccucccucaggaugacgcuaguuagcugacacagaug

SEQ ID NO: 291373 - RNA, 64 nt, hsa
gacacagauggucaccuccauuaccaaguagagucaggaugaacuaugugugacuguucaacua

SEQ ID NO: 291374 - RNA, 64 nt, hsa
cgaaggccuagacucagcugaaggaucuucaaagcaggaugaagaccuagacuuaccugaaggc

SEQ ID NO: 291375 - RNA, 64 nt, hsa
ugaaggccuagacucagcugaaggaucuucaaagcaggaugaagaccuagacuuaccugaagga

SEQ ID NO: 291376 - RNA, 64 nt, hsa
ugaagaccuaggcuuaccugaaggaucuucaaagcaggaugaagaccuagacuuaccugaagga

SEQ ID NO: 291377 - RNA, 64 nt, hsa
ugggacucauccuugcccaggugagggaaggagacaggaugaggucucgacccuguccccuagg

SEQ ID NO: 291378 - RNA, 64 nt, hsa
cugggacuuucccacccaggaaaggaggaccagucaggaugaggccccgccuuuucccccaccc

SEQ ID NO: 291379 - RNA, 64 nt, hsa; identical to SEQ ID NO: 235935

SEQ ID NO: 291380 - RNA, 64 nt, hsa; identical to SEQ ID NO: 235936

SEQ ID NO: 291381 - RNA, 64 nt, hsa; identical to SEQ ID NO: 235937

SEQ ID NO: 291382 - RNA, 64 nt, hsa; identical to SEQ ID NO: 235938

SEQ ID NO: 291383 - RNA, 64 nt, hsa; identical to SEQ ID NO: 235939

SEQ ID NO: 291384 - RNA, 64 nt, hsa; identical to SEQ ID NO: 235940

SEQ ID NO: 291385 - RNA, 64 nt, hsa; identical to SEQ ID NO: 235941

SEQ ID NO: 291386 - RNA, 64 nt, hsa; identical to SEQ ID NO: 235942

SEQ ID NO: 291387 - RNA, 64 nt, hsa; identical to SEQ ID NO: 235943

SEQ ID NO: 291388 - RNA, 64 nt, hsa; identical to SEQ ID NO: 235944

SEQ ID NO: 291389 - RNA, 64 nt, hsa; identical to SEQ ID NO: 235945

SEQ ID NO: 291390 - RNA, 64 nt, hsa; identical to SEQ ID NO: 235946

SEQ ID NO: 291391 - RNA, 64 nt, hsa; identical to SEQ ID NO: 235947

SEQ ID NO: 291392 - RNA, 64 nt, hsa; identical to SEQ ID NO: 235948

SEQ ID NO: 291393 - RNA, 64 nt, hsa; identical to SEQ ID NO: 235949

SEQ ID NO: 291394 - RNA, 64 nt, hsa; identical to SEQ ID NO: 235950

SEQ ID NO: 291395 - RNA, 64 nt, hsa; identical to SEQ ID NO: 235951

SEQ ID NO: 291396 - RNA, 64 nt, hsa; identical to SEQ ID NO: 235952

SEQ ID NO: 291397 - RNA, 64 nt, hsa; identical to SEQ ID NO: 235953

SEQ ID NO: 291398 - RNA, 64 nt, hsa; identical to SEQ ID NO: 235954

SEQ ID NO: 291399 - RNA, 64 nt, hsa; identical to SEQ ID NO: 235955

SEQ ID NO: 291400 - RNA, 64 nt, hsa; identical to SEQ ID NO: 235956

SEQ ID NO: 291401 - RNA, 64 nt, hsa; identical to SEQ ID NO: 235957

SEQ ID NO: 291402 - RNA, 64 nt, hsa; identical to SEQ ID NO: 235958

SEQ ID NO: 291403 - RNA, 64 nt, hsa; identical to SEQ ID NO: 235959

SEQ ID NO: 291404 - RNA, 64 nt, hsa; identical to SEQ ID NO: 235960

SEQ ID NO: 291405 - RNA, 64 nt, hsa; identical to SEQ ID NO: 235961

SEQ ID NO: 291406 - RNA, 64 nt, hsa; identical to SEQ ID NO: 235962

SEQ ID NO: 291407 - RNA, 64 nt, hsa; identical to SEQ ID NO: 235963

SEQ ID NO: 291408 - RNA, 64 nt, hsa; identical to SEQ ID NO: 235964

SEQ ID NO: 291409 - RNA, 64 nt, hsa; identical to SEQ ID NO: 235965

SEQ ID NO: 291410 - RNA, 64 nt, hsa; identical to SEQ ID NO: 235966

SEQ ID NO: 291411 - RNA, 64 nt, hsa; identical to SEQ ID NO: 235967

SEQ ID NO: 291412 - RNA, 64 nt, hsa; identical to SEQ ID NO: 235968

SEQ ID NO: 291413 - RNA, 64 nt, hsa; identical to SEQ ID NO: 235969

SEQ ID NO: 291414 - RNA, 64 nt, hsa; identical to SEQ ID NO: 235970

SEQ ID NO: 291415 - RNA, 64 nt, hsa; identical to SEQ ID NO: 235971

SEQ ID NO: 291416 - RNA, 64 nt, hsa; identical to SEQ ID NO: 235972

SEQ ID NO: 291417 - RNA, 64 nt, hsa; identical to SEQ ID NO: 235973

SEQ ID NO: 291418 - RNA, 64 nt, hsa; identical to SEQ ID NO: 235974

SEQ ID NO: 291419 - RNA, 58 nt, hsa; identical to SEQ ID NO: 235975

SEQ ID NO: 291420 - RNA, 64 nt, hsa; identical to SEQ ID NO: 235976

SEQ ID NO: 291421 - RNA, 64 nt, hsa; identical to SEQ ID NO: 235977

SEQ ID NO: 291422 - RNA, 64 nt, hsa; identical to SEQ ID NO: 235978

SEQ ID NO: 291423 - RNA, 64 nt, hsa; identical to SEQ ID NO: 235979

SEQ ID NO: 291424 - RNA, 64 nt, hsa; identical to SEQ ID NO: 235980

SEQ ID NO: 291425 - RNA, 64 nt, hsa; identical to SEQ ID NO: 235981

SEQ ID NO: 291426 - RNA, 64 nt, hsa; identical to SEQ ID NO: 235981

SEQ ID NO: 291427 - RNA, 64 nt, hsa; identical to SEQ ID NO: 235983

SEQ ID NO: 291428 - RNA, 64 nt, hsa; identical to SEQ ID NO: 235984

SEQ ID NO: 291429 - RNA, 64 nt, hsa; identical to SEQ ID NO: 235985

SEQ ID NO: 291430 - RNA, 64 nt, hsa; identical to SEQ ID NO: 235986

SEQ ID NO: 291431 - RNA, 64 nt, hsa; identical to SEQ ID NO: 235987

SEQ ID NO: 291432 - RNA, 64 nt, hsa; identical to SEQ ID NO: 235988

SEQ ID NO: 291433 - RNA, 64 nt, hsa; identical to SEQ ID NO: 235989

SEQ ID NO: 291434 - RNA, 64 nt, hsa; identical to SEQ ID NO: 235990

SEQ ID NO: 291435 - RNA, 64 nt, hsa; identical to SEQ ID NO: 235991

SEQ ID NO: 291436 - RNA, 64 nt, hsa; identical to SEQ ID NO: 235992

SEQ ID NO: 291437 - RNA, 64 nt, hsa
gagaucccuggcuucuccccauguuguucccggacaagggcagaagggaggcauggcaagggac

SEQ ID NO: 291438 - RNA, 64 nt, hsa
guccucaucccuccccaccucccacugcuuccugcaagggcaccaguuguaugagaaaguuggc

SEQ ID NO: 291439 - RNA, 64 nt, hsa
ggauauaaaacaggcuuuaaguuucuugguugcccaagggcagagcaaggaauaucugguguuu

SEQ ID NO: 291440 - RNA, 64 nt, hsa
guaagccuuugcacucuguagaguacuuagaagacaagggcaacuuacuuggaguuagagccaa

SEQ ID NO: 291441 - RNA, 64 nt, hsa
ggcaucugacagcccuuucccagagggcaccacgcaagggcagagcugggcggcauccacagcc

SEQ ID NO: 291442 - RNA, 64 nt, hsa
gccuucuccauaccccucuccccagcaucaugagcaagggcauugccuccucucucugcucacu

SEQ ID NO: 291443 - RNA, 64 nt, hsa
aaguggaugggaauuguaggcauagauuucauaucaagggcauuucaagacagaauuuuuauuu

SEQ ID NO: 291444 - RNA, 64 nt, hsa
ugguggccauguucucugaauugggugcagaagacaagggcagaguggcugcggccccuauuac

SEQ ID NO: 291445 - RNA, 64 nt, hsa
aacagaaugcucagccccucguggcaggacuugacaagggcaagcuugaccaggaagcugccau

SEQ ID NO: 291446 - RNA, 64 nt, hsa
aggcgggcucccacccucugcuccuggccuugggcaagggcacucagcgccucgccugccccug

SEQ ID NO: 291447 - RNA, 64 nt, hsa
aggucuccuuggcccaggccaagauugagaagaucaagggcagcaagaaggccaucaagguagu

SEQ ID NO: 291448 - RNA, 64 nt, hsa
ugucggaucucuucaacaagcuggucaugaggcgcaagggcaucucugggaaaggaccuggggc

SEQ ID NO: 291449 - RNA, 64 nt, hsa
uacacgaacucggcuucuuuuguccuagguacgccaagggcagguuucuggagacucccuugug

SEQ ID NO: 291450 - RNA, 64 nt, hsa
cagguuucuggagacucccuugugcccgggauggcaagggcaccgggcuggcguuuccacaucu

SEQ ID NO: 291451 - RNA, 64 nt, hsa
uaggaaugacaaggcuagaaaccuggcuggcugugagucagagagagagaggauggacguggga

SEQ ID NO: 291452 - RNA, 64 nt, hsa
gcagcucggugacuccguccacaucgccacaguugagucagauggcaguggcaguccuuugcca

SEQ ID NO: 291453 - RNA, 64 nt, hsa
guucuauucugcuccaggaaaaucggaaaccugugagucagagucagagaaacuuacccaagca

SEQ ID NO: 291454 - RNA, 64 nt, hsa
uucugcuccaggaaaaucggaaaccugugagucagagucagagaaacuuacccaagcaacguaa

SEQ ID NO: 291455 - RNA, 64 nt, hsa
accuguugugugaaacauaacauuggcagucgaggagucagaacucggauucccagccucacuc

SEQ ID NO: 291456 - RNA, 64 nt, hsa
uagaauuggaacuagaaacuacaccugggcuuuggagucagauuuuaguuaacaauaaugagcc

SEQ ID NO: 291457 - RNA, 64 nt, hsa
ggaagacagagugagccaaugcucaccagccccagagucagagcuggccacaggcuggcagccu

SEQ ID NO: 291458 - RNA, 64 nt, hsa
aguucuucauuaacauuuauacgaguuuuuugcugagucagauggacaguuggguucugaugcu

SEQ ID NO: 291459 - RNA, 64 nt, hsa
gggcugcuguggcccagucguccgcucagccaaggagucagauggcaauggguacuccagcagg

SEQ ID NO: 291460 - RNA, 64 nt, hsa
cugggaagauaccagcuuuuucucucaggguucugagucagaggacaccauccaagaauguugu

SEQ ID NO: 291461 - RNA, 64 nt, hsa
auuuuuuugacuauauuaucaguuaaacaaaaaggagucagauuuaauuuguuuuuugaagcac

SEQ ID NO: 291462 - RNA, 64 nt, hsa
guggccuuuguuaauaucgcaaaccauugguugggagucagauugguuucuuaaaaaaaaaaaa

SEQ ID NO: 291463 - RNA, 64 nt, hsa
acagccacuuggccucacuaccagaagaaggguggagucagaaaccaaagugaccuccagagcu

SEQ ID NO: 291464 - RNA, 64 nt, hsa
ucccuaccauuucuagccucuauugcccagauuggagucagaggucaaaaaaggauuccaagug

SEQ ID NO: 291465 - RNA, 64 nt, hsa; identical to SEQ ID NO: 111876

SEQ ID NO: 291466 - RNA, 64 nt, hsa; identical to SEQ ID NO: 111877

SEQ ID NO: 291467 - RNA, 64 nt, hsa; identical to SEQ ID NO: 111878

SEQ ID NO: 291468 - RNA, 64 nt, hsa; identical to SEQ ID NO: 111879

SEQ ID NO: 291469 - RNA, 64 nt, hsa; identical to SEQ ID NO: 111880

SEQ ID NO: 291470 - RNA, 64 nt, hsa; identical to SEQ ID NO: 111881

SEQ ID NO: 291471 - RNA, 64 nt, hsa; identical to SEQ ID NO: 45477

SEQ ID NO: 291472 - RNA, 64 nt, hsa; identical to SEQ ID NO: 45478

SEQ ID NO: 291473 - RNA, 64 nt, hsa; identical to SEQ ID NO: 45479

SEQ ID NO: 291474 - RNA, 64 nt, hsa; identical to SEQ ID NO: 45480

SEQ ID NO: 291475 - RNA, 64 nt, hsa; identical to SEQ ID NO: 45481

SEQ ID NO: 291476 - RNA, 64 nt, hsa; identical to SEQ ID NO: 45482

SEQ ID NO: 291477 - RNA, 64 nt, hsa; identical to SEQ ID NO: 45483

SEQ ID NO: 291478 - RNA, 64 nt, hsa; identical to SEQ ID NO: 45484

SEQ ID NO: 291479 - RNA, 64 nt, hsa; identical to SEQ ID NO: 45485

SEQ ID NO: 291480 - RNA, 64 nt, hsa; identical to SEQ ID NO: 45486

SEQ ID NO: 291481 - RNA, 64 nt, hsa; identical to SEQ ID NO: 45487

SEQ ID NO: 291482 - RNA, 56 nt, hsa; identical to SEQ ID NO: 45488

SEQ ID NO: 291483 - RNA, 64 nt, hsa; identical to SEQ ID NO: 45489

SEQ ID NO: 291484 - RNA, 64 nt, hsa; identical to SEQ ID NO: 45490

SEQ ID NO: 291485 - RNA, 64 nt, hsa; identical to SEQ ID NO: 45491

SEQ ID NO: 291486 - RNA, 64 nt, hsa; identical to SEQ ID NO: 45492

SEQ ID NO: 291487 - RNA, 64 nt, hsa; identical to SEQ ID NO: 45493

SEQ ID NO: 291488 - RNA, 64 nt, hsa; identical to SEQ ID NO: 45494

SEQ ID NO: 291489 - RNA, 64 nt, hsa; identical to SEQ ID NO: 45495

SEQ ID NO: 291490 - RNA, 64 nt, hsa; identical to SEQ ID NO: 45496

SEQ ID NO: 291491 - RNA, 64 nt, hsa; identical to SEQ ID NO: 45497

SEQ ID NO: 291492 - RNA, 64 nt, hsa; identical to SEQ ID NO: 45498

SEQ ID NO: 291493 - RNA, 64 nt, hsa; identical to SEQ ID NO: 45499

SEQ ID NO: 291494 - RNA, 64 nt, hsa; identical to SEQ ID NO: 45500

SEQ ID NO: 291495 - RNA, 64 nt, hsa; identical to SEQ ID NO: 45501

SEQ ID NO: 291496 - RNA, 64 nt, hsa; identical to SEQ ID NO: 45502

SEQ ID NO: 291497 - RNA, 64 nt, hsa; identical to SEQ ID NO: 45503

SEQ ID NO: 291498 - RNA, 64 nt, hsa; identical to SEQ ID NO: 45504

SEQ ID NO: 291499 - RNA, 64 nt, hsa; identical to SEQ ID NO: 45505

SEQ ID NO: 291500 - RNA, 64 nt, hsa; identical to SEQ ID NO: 45506

SEQ ID NO: 291501 - RNA, 64 nt, hsa; identical to SEQ ID NO: 45507

SEQ ID NO: 291502 - RNA, 64 nt, hsa; identical to SEQ ID NO: 45508

SEQ ID NO: 291503 - RNA, 64 nt, hsa; identical to SEQ ID NO: 45509

SEQ ID NO: 291504 - RNA, 64 nt, hsa; identical to SEQ ID NO: 45510

SEQ ID NO: 291505 - RNA, 64 nt, hsa; identical to SEQ ID NO: 45511

SEQ ID NO: 291506 - RNA, 64 nt, hsa; identical to SEQ ID NO: 45512

SEQ ID NO: 291507 - RNA, 64 nt, hsa; identical to SEQ ID NO: 45513

SEQ ID NO: 291508 - RNA, 64 nt, hsa; identical to SEQ ID NO: 45514

SEQ ID NO: 291509 - RNA, 64 nt, hsa; identical to SEQ ID NO: 45515

SEQ ID NO: 291510 - RNA, 64 nt, hsa; identical to SEQ ID NO: 45516

SEQ ID NO: 291511 - RNA, 64 nt, hsa; identical to SEQ ID NO: 45517

SEQ ID NO: 291512 - RNA, 64 nt, hsa; identical to SEQ ID NO: 45518

SEQ ID NO: 291513 - RNA, 64 nt, hsa; identical to SEQ ID NO: 45519

SEQ ID NO: 291514 - RNA, 64 nt, hsa; identical to SEQ ID NO: 45520

SEQ ID NO: 291515 - RNA, 64 nt, hsa; identical to SEQ ID NO: 45521

SEQ ID NO: 291516 - RNA, 64 nt, hsa; identical to SEQ ID NO: 45522

SEQ ID NO: 291517 - RNA, 64 nt, hsa; identical to SEQ ID NO: 45523

SEQ ID NO: 291518 - RNA, 64 nt, hsa; identical to SEQ ID NO: 45524

SEQ ID NO: 291519 - RNA, 64 nt, hsa; identical to SEQ ID NO: 45525

SEQ ID NO: 291520 - RNA, 64 nt, hsa; identical to SEQ ID NO: 45526

SEQ ID NO: 291521 - RNA, 64 nt, hsa; identical to SEQ ID NO: 45527

SEQ ID NO: 291522 - RNA, 64 nt, hsa; identical to SEQ ID NO: 45528

SEQ ID NO: 291523 - RNA, 64 nt, hsa; identical to SEQ ID NO: 45529

SEQ ID NO: 291524 - RNA, 64 nt, hsa; identical to SEQ ID NO: 45530

SEQ ID NO: 291525 - RNA, 64 nt, hsa; identical to SEQ ID NO: 45531

SEQ ID NO: 291526 - RNA, 64 nt, hsa; identical to SEQ ID NO: 45532

SEQ ID NO: 291527 - RNA, 64 nt, hsa; identical to SEQ ID NO: 45533

SEQ ID NO: 291528 - RNA, 64 nt, hsa; identical to SEQ ID NO: 45534

SEQ ID NO: 291529 - RNA, 64 nt, hsa; identical to SEQ ID NO: 45535

SEQ ID NO: 291530 - RNA, 64 nt, hsa; identical to SEQ ID NO: 45536

SEQ ID NO: 291531 - RNA, 64 nt, hsa; identical to SEQ ID NO: 45537

SEQ ID NO: 291532 - RNA, 64 nt, hsa; identical to SEQ ID NO: 45538

SEQ ID NO: 291533 - RNA, 64 nt, hsa; identical to SEQ ID NO: 45539

SEQ ID NO: 291534 - RNA, 64 nt, hsa; identical to SEQ ID NO: 45540

SEQ ID NO: 291535 - RNA, 64 nt, hsa; identical to SEQ ID NO: 45541

SEQ ID NO: 291536 - RNA, 64 nt, hsa; identical to SEQ ID NO: 45542

SEQ ID NO: 291537 - RNA, 64 nt, hsa; identical to SEQ ID NO: 45543

SEQ ID NO: 291538 - RNA, 64 nt, hsa; identical to SEQ ID NO: 45544

SEQ ID NO: 291539 - RNA, 64 nt, hsa; identical to SEQ ID NO: 45545

SEQ ID NO: 291540 - RNA, 64 nt, hsa; identical to SEQ ID NO: 45546

SEQ ID NO: 291541 - RNA, 64 nt, hsa; identical to SEQ ID NO: 45547

SEQ ID NO: 291542 - RNA, 64 nt, hsa; identical to SEQ ID NO: 45548

SEQ ID NO: 291543 - RNA, 64 nt, hsa; identical to SEQ ID NO: 45549

SEQ ID NO: 291544 - RNA, 64 nt, hsa; identical to SEQ ID NO: 45550

SEQ ID NO: 291545 - RNA, 64 nt, hsa; identical to SEQ ID NO: 45551

SEQ ID NO: 291546 - RNA, 64 nt, hsa; identical to SEQ ID NO: 45552

SEQ ID NO: 291547 - RNA, 64 nt, hsa; identical to SEQ ID NO: 45553

SEQ ID NO: 291548 - RNA, 64 nt, hsa; identical to SEQ ID NO: 45554

SEQ ID NO: 291549 - RNA, 64 nt, hsa; identical to SEQ ID NO: 45555

SEQ ID NO: 291550 - RNA, 64 nt, hsa; identical to SEQ ID NO: 45556

SEQ ID NO: 291551 - RNA, 64 nt, hsa; identical to SEQ ID NO: 45557

SEQ ID NO: 291552 - RNA, 64 nt, hsa; identical to SEQ ID NO: 45558

SEQ ID NO: 291553 - RNA, 64 nt, hsa; identical to SEQ ID NO: 45559

SEQ ID NO: 291554 - RNA, 64 nt, hsa; identical to SEQ ID NO: 45560

SEQ ID NO: 291555 - RNA, 64 nt, hsa; identical to SEQ ID NO: 45561

SEQ ID NO: 291556 - RNA, 64 nt, hsa; identical to SEQ ID NO: 45562

SEQ ID NO: 291557 - RNA, 64 nt, hsa; identical to SEQ ID NO: 45563

SEQ ID NO: 291558 - RNA, 64 nt, hsa; identical to SEQ ID NO: 45564

SEQ ID NO: 291559 - RNA, 64 nt, hsa; identical to SEQ ID NO: 45565

SEQ ID NO: 291560 - RNA, 64 nt, hsa; identical to SEQ ID NO: 45566

SEQ ID NO: 291561 - RNA, 64 nt, hsa; identical to SEQ ID NO: 45567

SEQ ID NO: 291562 - RNA, 64 nt, hsa; identical to SEQ ID NO: 45568

SEQ ID NO: 291563 - RNA, 64 nt, hsa; identical to SEQ ID NO: 45569

SEQ ID NO: 291564 - RNA, 64 nt, hsa; identical to SEQ ID NO: 45570

SEQ ID NO: 291565 - RNA, 64 nt, hsa; identical to SEQ ID NO: 45571

SEQ ID NO: 291566 - RNA, 64 nt, hsa; identical to SEQ ID NO: 45572

SEQ ID NO: 291567 - RNA, 64 nt, hsa; identical to SEQ ID NO: 45573

SEQ ID NO: 291568 - RNA, 64 nt, hsa; identical to SEQ ID NO: 45574

SEQ ID NO: 291569 - RNA, 64 nt, hsa; identical to SEQ ID NO: 45575

SEQ ID NO: 291570 - RNA, 64 nt, hsa; identical to SEQ ID NO: 45576

SEQ ID NO: 291571 - RNA, 64 nt, hsa; identical to SEQ ID NO: 45577

SEQ ID NO: 291572 - RNA, 64 nt, hsa; identical to SEQ ID NO: 45578

SEQ ID NO: 291573 - RNA, 64 nt, hsa; identical to SEQ ID NO: 45579

SEQ ID NO: 291574 - RNA, 64 nt, hsa; identical to SEQ ID NO: 45580

SEQ ID NO: 291575 - RNA, 64 nt, hsa; identical to SEQ ID NO: 45581

SEQ ID NO: 291576 - RNA, 64 nt, hsa; identical to SEQ ID NO: 45582

SEQ ID NO: 291577 - RNA, 64 nt, hsa; identical to SEQ ID NO: 45583

SEQ ID NO: 291578 - RNA, 64 nt, hsa; identical to SEQ ID NO: 45584

SEQ ID NO: 291579 - RNA, 64 nt, hsa; identical to SEQ ID NO: 45585

SEQ ID NO: 291580 - RNA, 64 nt, hsa; identical to SEQ ID NO: 45586

SEQ ID NO: 291581 - RNA, 64 nt, hsa; identical to SEQ ID NO: 45587

SEQ ID NO: 291582 - RNA, 64 nt, hsa; identical to SEQ ID NO: 45588

SEQ ID NO: 291583 - RNA, 64 nt, hsa; identical to SEQ ID NO: 45589

SEQ ID NO: 291584 - RNA, 64 nt, hsa; identical to SEQ ID NO: 45590

SEQ ID NO: 291585 - RNA, 64 nt, hsa; identical to SEQ ID NO: 45591

SEQ ID NO: 291586 - RNA, 64 nt, hsa; identical to SEQ ID NO: 45592

SEQ ID NO: 291587 - RNA, 64 nt, hsa; identical to SEQ ID NO: 45593

SEQ ID NO: 291588 - RNA, 64 nt, hsa; identical to SEQ ID NO: 45594

SEQ ID NO: 291589 - RNA, 64 nt, hsa; identical to SEQ ID NO: 45595

SEQ ID NO: 291590 - RNA, 64 nt, hsa; identical to SEQ ID NO: 45596

SEQ ID NO: 291591 - RNA, 64 nt, hsa; identical to SEQ ID NO: 45597

SEQ ID NO: 291592 - RNA, 64 nt, hsa; identical to SEQ ID NO: 45598

SEQ ID NO: 291593 - RNA, 64 nt, hsa; identical to SEQ ID NO: 45599

SEQ ID NO: 291594 - RNA, 64 nt, hsa; identical to SEQ ID NO: 45600

SEQ ID NO: 291595 - RNA, 64 nt, hsa; identical to SEQ ID NO: 45601

SEQ ID NO: 291596 - RNA, 64 nt, hsa; identical to SEQ ID NO: 45602

SEQ ID NO: 291597 - RNA, 64 nt, hsa; identical to SEQ ID NO: 45603

SEQ ID NO: 291598 - RNA, 64 nt, hsa; identical to SEQ ID NO: 45604

SEQ ID NO: 291599 - RNA, 64 nt, hsa; identical to SEQ ID NO: 45605

SEQ ID NO: 291600 - RNA, 64 nt, hsa; identical to SEQ ID NO: 45606

SEQ ID NO: 291601 - RNA, 64 nt, hsa; identical to SEQ ID NO: 45607

SEQ ID NO: 291602 - RNA, 64 nt, hsa; identical to SEQ ID NO: 45608

SEQ ID NO: 291603 - RNA, 64 nt, hsa; identical to SEQ ID NO: 45609

SEQ ID NO: 291604 - RNA, 64 nt, hsa; identical to SEQ ID NO: 45610

SEQ ID NO: 291605 - RNA, 64 nt, hsa; identical to SEQ ID NO: 45611

SEQ ID NO: 291606 - RNA, 64 nt, hsa; identical to SEQ ID NO: 45612

SEQ ID NO: 291607 - RNA, 64 nt, hsa; identical to SEQ ID NO: 45613

SEQ ID NO: 291608 - RNA, 64 nt, hsa; identical to SEQ ID NO: 45614

SEQ ID NO: 291609 - RNA, 64 nt, hsa; identical to SEQ ID NO: 45615

SEQ ID NO: 291610 - RNA, 64 nt, hsa; identical to SEQ ID NO: 45616

SEQ ID NO: 291611 - RNA, 64 nt, hsa; identical to SEQ ID NO: 45617

SEQ ID NO: 291612 - RNA, 64 nt, hsa; identical to SEQ ID NO: 45618

SEQ ID NO: 291613 - RNA, 64 nt, hsa; identical to SEQ ID NO: 45619

SEQ ID NO: 291614 - RNA, 64 nt, hsa; identical to SEQ ID NO: 45620

SEQ ID NO: 291615 - RNA, 64 nt, hsa; identical to SEQ ID NO: 45621

SEQ ID NO: 291616 - RNA, 64 nt, hsa; identical to SEQ ID NO: 45622

SEQ ID NO: 291617 - RNA, 64 nt, hsa; identical to SEQ ID NO: 45623

SEQ ID NO: 291618 - RNA, 64 nt, hsa; identical to SEQ ID NO: 45624

SEQ ID NO: 291619 - RNA, 64 nt, hsa; identical to SEQ ID NO: 45625

SEQ ID NO: 291620 - RNA, 64 nt, hsa; identical to SEQ ID NO: 45626

SEQ ID NO: 291621 - RNA, 64 nt, hsa; identical to SEQ ID NO: 45627

SEQ ID NO: 291622 - RNA, 64 nt, hsa; identical to SEQ ID NO: 45628

SEQ ID NO: 291623 - RNA, 64 nt, hsa; identical to SEQ ID NO: 45629

SEQ ID NO: 291624 - RNA, 64 nt, hsa; identical to SEQ ID NO: 45630

SEQ ID NO: 291625 - RNA, 64 nt, hsa; identical to SEQ ID NO: 45631

SEQ ID NO: 291626 - RNA, 64 nt, hsa; identical to SEQ ID NO: 45632

SEQ ID NO: 291627 - RNA, 64 nt, hsa; identical to SEQ ID NO: 45633

SEQ ID NO: 291628 - RNA, 64 nt, hsa; identical to SEQ ID NO: 45634

SEQ ID NO: 291629 - RNA, 64 nt, hsa; identical to SEQ ID NO: 45635

SEQ ID NO: 291630 - RNA, 64 nt, hsa; identical to SEQ ID NO: 45636

SEQ ID NO: 291631 - RNA, 64 nt, hsa; identical to SEQ ID NO: 45637

SEQ ID NO: 291632 - RNA, 64 nt, hsa; identical to SEQ ID NO: 45638

SEQ ID NO: 291633 - RNA, 64 nt, hsa; identical to SEQ ID NO: 45639

SEQ ID NO: 291634 - RNA, 64 nt, hsa; identical to SEQ ID NO: 45640

SEQ ID NO: 291635 - RNA, 64 nt, hsa; identical to SEQ ID NO: 45641

SEQ ID NO: 291636 - RNA, 64 nt, hsa; identical to SEQ ID NO: 45642

SEQ ID NO: 291637 - RNA, 64 nt, hsa; identical to SEQ ID NO: 45643

SEQ ID NO: 291638 - RNA, 64 nt, hsa; identical to SEQ ID NO: 45644

SEQ ID NO: 291639 - RNA, 64 nt, hsa; identical to SEQ ID NO: 45645

SEQ ID NO: 291640 - RNA, 64 nt, hsa; identical to SEQ ID NO: 45646

SEQ ID NO: 291641 - RNA, 64 nt, hsa; identical to SEQ ID NO: 45647

SEQ ID NO: 291642 - RNA, 64 nt, hsa; identical to SEQ ID NO: 45648

SEQ ID NO: 291643 - RNA, 64 nt, hsa; identical to SEQ ID NO: 45649

SEQ ID NO: 291644 - RNA, 64 nt, hsa; identical to SEQ ID NO: 45650

SEQ ID NO: 291645 - RNA, 64 nt, hsa; identical to SEQ ID NO: 45651

SEQ ID NO: 291646 - RNA, 64 nt, hsa; identical to SEQ ID NO: 45652

SEQ ID NO: 291647 - RNA, 64 nt, hsa; identical to SEQ ID NO: 45653

SEQ ID NO: 291648 - RNA, 64 nt, hsa; identical to SEQ ID NO: 45654

SEQ ID NO: 291649 - RNA, 64 nt, hsa; identical to SEQ ID NO: 45655

SEQ ID NO: 291650 - RNA, 64 nt, hsa; identical to SEQ ID NO: 97987

SEQ ID NO: 291651 - RNA, 64 nt, hsa; identical to SEQ ID NO: 97988

SEQ ID NO: 291652 - RNA, 64 nt, hsa; identical to SEQ ID NO: 97989

SEQ ID NO: 291653 - RNA, 64 nt, hsa; identical to SEQ ID NO: 97990

SEQ ID NO: 291654 - RNA, 64 nt, hsa; identical to SEQ ID NO: 97991

SEQ ID NO: 291655 - RNA, 64 nt, hsa; identical to SEQ ID NO: 97992

SEQ ID NO: 291656 - RNA, 64 nt, hsa; identical to SEQ ID NO: 97993

SEQ ID NO: 291657 - RNA, 64 nt, hsa; identical to SEQ ID NO: 97994

SEQ ID NO: 291658 - RNA, 64 nt, hsa; identical to SEQ ID NO: 97995

SEQ ID NO: 291659 - RNA, 64 nt, hsa; identical to SEQ ID NO: 97996

SEQ ID NO: 291660 - RNA, 64 nt, hsa; identical to SEQ ID NO: 97997

SEQ ID NO: 291661 - RNA, 64 nt, hsa; identical to SEQ ID NO: 97998

SEQ ID NO: 291662 - RNA, 64 nt, hsa; identical to SEQ ID NO: 97999

SEQ ID NO: 291663 - RNA, 64 nt, hsa; identical to SEQ ID NO: 98000

SEQ ID NO: 291664 - RNA, 64 nt, hsa; identical to SEQ ID NO: 98001

SEQ ID NO: 291665 - RNA, 64 nt, hsa; identical to SEQ ID NO: 98002

SEQ ID NO: 291666 - RNA, 64 nt, hsa; identical to SEQ ID NO: 98003

SEQ ID NO: 291667 - RNA, 64 nt, hsa; identical to SEQ ID NO: 98004

SEQ ID NO: 291668 - RNA, 64 nt, hsa; identical to SEQ ID NO: 98005

SEQ ID NO: 291669 - RNA, 64 nt, hsa; identical to SEQ ID NO: 98006

SEQ ID NO: 291670 - RNA, 64 nt, hsa; identical to SEQ ID NO: 98007

SEQ ID NO: 291671 - RNA, 64 nt, hsa; identical to SEQ ID NO: 98008

SEQ ID NO: 291672 - RNA, 53 nt, hsa; identical to SEQ ID NO: 98009

SEQ ID NO: 291673 - RNA, 64 nt, hsa; identical to SEQ ID NO: 98010

SEQ ID NO: 291674 - RNA, 64 nt, hsa; identical to SEQ ID NO: 125533

SEQ ID NO: 291675 - RNA, 64 nt, hsa; identical to SEQ ID NO: 125534

SEQ ID NO: 291676 - RNA, 64 nt, hsa; identical to SEQ ID NO: 125535

SEQ ID NO: 291677 - RNA, 64 nt, hsa; identical to SEQ ID NO: 125536

SEQ ID NO: 291678 - RNA, 64 nt, hsa; identical to SEQ ID NO: 125537

SEQ ID NO: 291679 - RNA, 64 nt, hsa; identical to SEQ ID NO: 125538

SEQ ID NO: 291680 - RNA, 64 nt, hsa; identical to SEQ ID NO: 125539

SEQ ID NO: 291681 - RNA, 64 nt, hsa; identical to SEQ ID NO: 125540

SEQ ID NO: 291682 - RNA, 64 nt, hsa; identical to SEQ ID NO: 125541

SEQ ID NO: 291683 - RNA, 64 nt, hsa; identical to SEQ ID NO: 125542

SEQ ID NO: 291684 - RNA, 64 nt, hsa; identical to SEQ ID NO: 125543

SEQ ID NO: 291685 - RNA, 64 nt, hsa; identical to SEQ ID NO: 125544

SEQ ID NO: 291686 - RNA, 64 nt, hsa; identical to SEQ ID NO: 125545

SEQ ID NO: 291687 - RNA, 64 nt, hsa; identical to SEQ ID NO: 125546

SEQ ID NO: 291688 - RNA, 64 nt, hsa; identical to SEQ ID NO: 125547

SEQ ID NO: 291689 - RNA, 64 nt, hsa; identical to SEQ ID NO: 125548

SEQ ID NO: 291690 - RNA, 64 nt, hsa; identical to SEQ ID NO: 125549

SEQ ID NO: 291691 - RNA, 64 nt, hsa; identical to SEQ ID NO: 125550

SEQ ID NO: 291692 - RNA, 64 nt, hsa; identical to SEQ ID NO: 125551

SEQ ID NO: 291693 - RNA, 64 nt, hsa; identical to SEQ ID NO: 125552

SEQ ID NO: 291694 - RNA, 64 nt, hsa; identical to SEQ ID NO: 125553

SEQ ID NO: 291695 - RNA, 64 nt, hsa; identical to SEQ ID NO: 125554

SEQ ID NO: 291696 - RNA, 64 nt, hsa; identical to SEQ ID NO: 125555

SEQ ID NO: 291697 - RNA, 64 nt, hsa; identical to SEQ ID NO: 125556

SEQ ID NO: 291698 - RNA, 64 nt, hsa; identical to SEQ ID NO: 125557

SEQ ID NO: 291699 - RNA, 64 nt, hsa; identical to SEQ ID NO: 125558

SEQ ID NO: 291700 - RNA, 64 nt, hsa; identical to SEQ ID NO: 125559

SEQ ID NO: 291701 - RNA, 64 nt, hsa; identical to SEQ ID NO: 125560

SEQ ID NO: 291702 - RNA, 64 nt, hsa; identical to SEQ ID NO: 125561

SEQ ID NO: 291703 - RNA, 64 nt, hsa; identical to SEQ ID NO: 125562

SEQ ID NO: 291704 - RNA, 64 nt, hsa; identical to SEQ ID NO: 125563

SEQ ID NO: 291705 - RNA, 64 nt, hsa; identical to SEQ ID NO: 125564

SEQ ID NO: 291706 - RNA, 64 nt, hsa; identical to SEQ ID NO: 125565

SEQ ID NO: 291707 - RNA, 64 nt, hsa; identical to SEQ ID NO: 125566

SEQ ID NO: 291708 - RNA, 64 nt, hsa; identical to SEQ ID NO: 125567

SEQ ID NO: 291709 - RNA, 64 nt, hsa; identical to SEQ ID NO: 125568

SEQ ID NO: 291710 - RNA, 64 nt, hsa
accugaaaaucagcaauuuccugacaacgaaagugaagaguaucacagguaagccuauggcaac

SEQ ID NO: 291711 - RNA, 64 nt, hsa
accugaaagccagcaauuuccugacacugagaaugaagaguaucacagguaagccuauggcaac

SEQ ID NO: 291712 - RNA, 64 nt, hsa
uugugauuucauugauuuuacuaacuggaaggaagaagaguaaaauuggcauauuuagguuuuu

SEQ ID NO: 291713 - RNA, 64 nt, hsa
auuaggaguggauuggagaaauuggggggaaauagaagaguacggagaaaggaagagauugaaa

SEQ ID NO: 291714 - RNA, 64 nt, hsa
aaaucuuucagaaaauauaagccuuuaauacgaggaagaguauucuuaagaugaacauuacaaa

SEQ ID NO: 291715 - RNA, 64 nt, hsa
uuauaggugggcauuauuuaugccccuuucuguggaagaguaagaaaauuaaaauacaagaugc

SEQ ID NO: 291716 - RNA, 64 nt, hsa
ggguauuugaaagauagaagcauuauuuauaacugaagaguauaacacuuaucuucuuaaguaa

SEQ ID NO: 291717 - RNA, 64 nt, hsa
cuaucagguuucauuacauauucuccuuuauugugaagaguaguuuuaccuguaaauauuagca

SEQ ID NO: 291718 - RNA, 64 nt, hsa
augauucuuuuguuuuucuucuacuucauguccagaagaguaagagggaaaauggacauauguu

SEQ ID NO: 291719 - RNA, 64 nt, hsa
uuggaaccuggaugagaccuuuucguugaauucugaagaguaaugaugugaaaauugauacagg

SEQ ID NO: 291720 - RNA, 64 nt, hsa
agauacagaaaaagaagaaaaaaucaaugaacuugaagaguaagaauaaaaacuaccaaaguga

SEQ ID NO: 291721 - RNA, 64 nt, hsa
acacuugagaauaauaccuacagagguucauacugaagaguagucucaauaauguaaagaauuu

SEQ ID NO: 291722 - RNA, 64 nt, hsa
ugcuaaaauaacauuguacauccaagagagggaagaagaguaugucaguauauuaugcagaaga

SEQ ID NO: 291723 - RNA, 64 nt, hsa
uuuugggaugucuuaguuagaaaccagauuaauagaagaguaggccugauauauuacaucauga

SEQ ID NO: 291724 - RNA, 64 nt, hsa; identical to SEQ ID NO: 77858

SEQ ID NO: 291725 - RNA, 64 nt, hsa; identical to SEQ ID NO: 77859

SEQ ID NO: 291726 - RNA, 64 nt, hsa; identical to SEQ ID NO: 77860

SEQ ID NO: 291727 - RNA, 64 nt, hsa; identical to SEQ ID NO: 77861

SEQ ID NO: 291728 - RNA, 64 nt, hsa; identical to SEQ ID NO: 77862

SEQ ID NO: 291729 - RNA, 64 nt, hsa; identical to SEQ ID NO: 77863

SEQ ID NO: 291730 - RNA, 64 nt, hsa; identical to SEQ ID NO: 77864

SEQ ID NO: 291731 - RNA, 64 nt, hsa; identical to SEQ ID NO: 77865

SEQ ID NO: 291732 - RNA, 64 nt, hsa; identical to SEQ ID NO: 77866

SEQ ID NO: 291733 - RNA, 62 nt, hsa; identical to SEQ ID NO: 77867

SEQ ID NO: 291734 - RNA, 64 nt, hsa; identical to SEQ ID NO: 77868

SEQ ID NO: 291735 - RNA, 64 nt, hsa; identical to SEQ ID NO: 77869

SEQ ID NO: 291736 - RNA, 64 nt, hsa; identical to SEQ ID NO: 77870

SEQ ID NO: 291737 - RNA, 64 nt, hsa; identical to SEQ ID NO: 77871

SEQ ID NO: 291738 - RNA, 64 nt, hsa; identical to SEQ ID NO: 77872

SEQ ID NO: 291739 - RNA, 64 nt, hsa; identical to SEQ ID NO: 77873

SEQ ID NO: 291740 - RNA, 64 nt, hsa; identical to SEQ ID NO: 77874

SEQ ID NO: 291741 - RNA, 64 nt, hsa; identical to SEQ ID NO: 77875

SEQ ID NO: 291742 - RNA, 64 nt, hsa; identical to SEQ ID NO: 77876

SEQ ID NO: 291743 - RNA, 64 nt, hsa; identical to SEQ ID NO: 102479

SEQ ID NO: 291744 - RNA, 64 nt, hsa; identical to SEQ ID NO: 102480

SEQ ID NO: 291745 - RNA, 64 nt, hsa; identical to SEQ ID NO: 102481

SEQ ID NO: 291746 - RNA, 64 nt, hsa; identical to SEQ ID NO: 102482

SEQ ID NO: 291747 - RNA, 64 nt, hsa; identical to SEQ ID NO: 102483

SEQ ID NO: 291748 - RNA, 64 nt, hsa; identical to SEQ ID NO: 102484

SEQ ID NO: 291749 - RNA, 64 nt, hsa; identical to SEQ ID NO: 102485

SEQ ID NO: 291750 - RNA, 64 nt, hsa; identical to SEQ ID NO: 102486

SEQ ID NO: 291751 - RNA, 64 nt, hsa; identical to SEQ ID NO: 102487

SEQ ID NO: 291752 - RNA, 64 nt, hsa; identical to SEQ ID NO: 102488

SEQ ID NO: 291753 - RNA, 64 nt, hsa; identical to SEQ ID NO: 102489

SEQ ID NO: 291754 - RNA, 64 nt, hsa; identical to SEQ ID NO: 102490

SEQ ID NO: 291755 - RNA, 64 nt, hsa; identical to SEQ ID NO: 102491

SEQ ID NO: 291756 - RNA, 64 nt, hsa; identical to SEQ ID NO: 102492

SEQ ID NO: 291757 - RNA, 64 nt, hsa; identical to SEQ ID NO: 102493

SEQ ID NO: 291758 - RNA, 64 nt, hsa; identical to SEQ ID NO: 102494

SEQ ID NO: 291759 - RNA, 64 nt, hsa; identical to SEQ ID NO: 102495

SEQ ID NO: 291760 - RNA, 64 nt, hsa; identical to SEQ ID NO: 102496

SEQ ID NO: 291761 - RNA, 64 nt, hsa; identical to SEQ ID NO: 102497

SEQ ID NO: 291762 - RNA, 64 nt, hsa; identical to SEQ ID NO: 102498

SEQ ID NO: 291763 - RNA, 64 nt, hsa; identical to SEQ ID NO: 102499

SEQ ID NO: 291764 - RNA, 64 nt, hsa; identical to SEQ ID NO: 102500

SEQ ID NO: 291765 - RNA, 64 nt, hsa; identical to SEQ ID NO: 102501

SEQ ID NO: 291766 - RNA, 64 nt, hsa; identical to SEQ ID NO: 102502

SEQ ID NO: 291767 - RNA, 64 nt, hsa; identical to SEQ ID NO: 102503

SEQ ID NO: 291768 - RNA, 64 nt, hsa; identical to SEQ ID NO: 102504

SEQ ID NO: 291769 - RNA, 64 nt, hsa; identical to SEQ ID NO: 102505

SEQ ID NO: 291770 - RNA, 64 nt, hsa; identical to SEQ ID NO: 102506

SEQ ID NO: 291771 - RNA, 64 nt, hsa; identical to SEQ ID NO: 102507

SEQ ID NO: 291772 - RNA, 64 nt, hsa; identical to SEQ ID NO: 102508

SEQ ID NO: 291773 - RNA, 64 nt, hsa; identical to SEQ ID NO: 102509

SEQ ID NO: 291774 - RNA, 64 nt, hsa; identical to SEQ ID NO: 102510

SEQ ID NO: 291775 - RNA, 64 nt, hsa; identical to SEQ ID NO: 102511

SEQ ID NO: 291776 - RNA, 64 nt, hsa; identical to SEQ ID NO: 102512

SEQ ID NO: 291777 - RNA, 64 nt, hsa; identical to SEQ ID NO: 102513

SEQ ID NO: 291778 - RNA, 64 nt, hsa; identical to SEQ ID NO: 102514

SEQ ID NO: 291779 - RNA, 64 nt, hsa; identical to SEQ ID NO: 102515

SEQ ID NO: 291780 - RNA, 64 nt, hsa; identical to SEQ ID NO: 102516

SEQ ID NO: 291781 - RNA, 64 nt, hsa; identical to SEQ ID NO: 102517

SEQ ID NO: 291782 - RNA, 64 nt, hsa; identical to SEQ ID NO: 102518

SEQ ID NO: 291783 - RNA, 64 nt, hsa; identical to SEQ ID NO: 102519

SEQ ID NO: 291784 - RNA, 64 nt, hsa; identical to SEQ ID NO: 102520

SEQ ID NO: 291785 - RNA, 64 nt, hsa; identical to SEQ ID NO: 102521

SEQ ID NO: 291786 - RNA, 64 nt, hsa; identical to SEQ ID NO: 102522

SEQ ID NO: 291787 - RNA, 64 nt, hsa; identical to SEQ ID NO: 102523

SEQ ID NO: 291788 - RNA, 64 nt, hsa; identical to SEQ ID NO: 102524

SEQ ID NO: 291789 - RNA, 64 nt, hsa; identical to SEQ ID NO: 102525

SEQ ID NO: 291790 - RNA, 64 nt, hsa; identical to SEQ ID NO: 102526

SEQ ID NO: 291791 - RNA, 64 nt, hsa; identical to SEQ ID NO: 102527

SEQ ID NO: 291792 - RNA, 64 nt, hsa; identical to SEQ ID NO: 102528

SEQ ID NO: 291793 - RNA, 64 nt, hsa; identical to SEQ ID NO: 102529

SEQ ID NO: 291794 - RNA, 64 nt, hsa; identical to SEQ ID NO: 102530

SEQ ID NO: 291795 - RNA, 64 nt, hsa; identical to SEQ ID NO: 102531

SEQ ID NO: 291796 - RNA, 64 nt, hsa; identical to SEQ ID NO: 102532

SEQ ID NO: 291797 - RNA, 64 nt, hsa; identical to SEQ ID NO: 102533

SEQ ID NO: 291798 - RNA, 64 nt, hsa; identical to SEQ ID NO: 102534

SEQ ID NO: 291799 - RNA, 64 nt, hsa; identical to SEQ ID NO: 102535

SEQ ID NO: 291800 - RNA, 64 nt, hsa; identical to SEQ ID NO: 102536

SEQ ID NO: 291801 - RNA, 64 nt, hsa; identical to SEQ ID NO: 102537

SEQ ID NO: 291802 - RNA, 64 nt, hsa; identical to SEQ ID NO: 102538

SEQ ID NO: 291803 - RNA, 64 nt, hsa; identical to SEQ ID NO: 102539

SEQ ID NO: 291804 - RNA, 64 nt, hsa; identical to SEQ ID NO: 102540

SEQ ID NO: 291805 - RNA, 64 nt, hsa; identical to SEQ ID NO: 102541

SEQ ID NO: 291806 - RNA, 64 nt, hsa; identical to SEQ ID NO: 102542

SEQ ID NO: 291807 - RNA, 64 nt, hsa; identical to SEQ ID NO: 102543

SEQ ID NO: 291808 - RNA, 64 nt, hsa; identical to SEQ ID NO: 102544

SEQ ID NO: 291809 - RNA, 64 nt, hsa; identical to SEQ ID NO: 102545

SEQ ID NO: 291810 - RNA, 64 nt, hsa; identical to SEQ ID NO: 102546

SEQ ID NO: 291811 - RNA, 64 nt, hsa; identical to SEQ ID NO: 102547

SEQ ID NO: 291812 - RNA, 64 nt, hsa; identical to SEQ ID NO: 102548

SEQ ID NO: 291813 - RNA, 64 nt, hsa; identical to SEQ ID NO: 102549

SEQ ID NO: 291814 - RNA, 64 nt, hsa; identical to SEQ ID NO: 102550

SEQ ID NO: 291815 - RNA, 64 nt, hsa; identical to SEQ ID NO: 102551

SEQ ID NO: 291816 - RNA, 64 nt, hsa; identical to SEQ ID NO: 102552

SEQ ID NO: 291817 - RNA, 64 nt, hsa; identical to SEQ ID NO: 102553

SEQ ID NO: 291818 - RNA, 64 nt, hsa; identical to SEQ ID NO: 102554

SEQ ID NO: 291819 - RNA, 64 nt, hsa; identical to SEQ ID NO: 102555

SEQ ID NO: 291820 - RNA, 64 nt, hsa; identical to SEQ ID NO: 102556

SEQ ID NO: 291821 - RNA, 64 nt, hsa; identical to SEQ ID NO: 102557

SEQ ID NO: 291822 - RNA, 64 nt, hsa; identical to SEQ ID NO: 102558

SEQ ID NO: 291823 - RNA, 64 nt, hsa; identical to SEQ ID NO: 102559

SEQ ID NO: 291824 - RNA, 64 nt, hsa; identical to SEQ ID NO: 102560

SEQ ID NO: 291825 - RNA, 64 nt, hsa; identical to SEQ ID NO: 102561

SEQ ID NO: 291826 - RNA, 64 nt, hsa; identical to SEQ ID NO: 102562

SEQ ID NO: 291827 - RNA, 64 nt, hsa; identical to SEQ ID NO: 102563

SEQ ID NO: 291828 - RNA, 64 nt, hsa; identical to SEQ ID NO: 102564

SEQ ID NO: 291829 - RNA, 64 nt, hsa; identical to SEQ ID NO: 102565

SEQ ID NO: 291830 - RNA, 64 nt, hsa; identical to SEQ ID NO: 102566

SEQ ID NO: 291831 - RNA, 64 nt, hsa; identical to SEQ ID NO: 102567

SEQ ID NO: 291832 - RNA, 64 nt, hsa; identical to SEQ ID NO: 102568

SEQ ID NO: 291833 - RNA, 64 nt, hsa; identical to SEQ ID NO: 102569

SEQ ID NO: 291834 - RNA, 64 nt, hsa; identical to SEQ ID NO: 102570

SEQ ID NO: 291835 - RNA, 64 nt, hsa; identical to SEQ ID NO: 102571

SEQ ID NO: 291836 - RNA, 64 nt, hsa; identical to SEQ ID NO: 102572

SEQ ID NO: 291837 - RNA, 64 nt, hsa; identical to SEQ ID NO: 102573

SEQ ID NO: 291838 - RNA, 64 nt, hsa; identical to SEQ ID NO: 102574

SEQ ID NO: 291839 - RNA, 64 nt, hsa; identical to SEQ ID NO: 102575

SEQ ID NO: 291840 - RNA, 64 nt, hsa; identical to SEQ ID NO: 102576

SEQ ID NO: 291841 - RNA, 64 nt, hsa; identical to SEQ ID NO: 102577

SEQ ID NO: 291842 - RNA, 64 nt, hsa; identical to SEQ ID NO: 102578

SEQ ID NO: 291843 - RNA, 64 nt, hsa; identical to SEQ ID NO: 102579

SEQ ID NO: 291844 - RNA, 64 nt, hsa; identical to SEQ ID NO: 102580

SEQ ID NO: 291845 - RNA, 64 nt, hsa; identical to SEQ ID NO: 102581

SEQ ID NO: 291846 - RNA, 64 nt, hsa; identical to SEQ ID NO: 102582

SEQ ID NO: 291847 - RNA, 64 nt, hsa; identical to SEQ ID NO: 102583

SEQ ID NO: 291848 - RNA, 62 nt, hsa; identical to SEQ ID NO: 102584

SEQ ID NO: 291849 - RNA, 64 nt, hsa; identical to SEQ ID NO: 102585

SEQ ID NO: 291850 - RNA, 64 nt, hsa; identical to SEQ ID NO: 102586

SEQ ID NO: 291851 - RNA, 64 nt, hsa; identical to SEQ ID NO: 102587

SEQ ID NO: 291852 - RNA, 64 nt, hsa; identical to SEQ ID NO: 102588

SEQ ID NO: 291853 - RNA, 64 nt, hsa; identical to SEQ ID NO: 102589

SEQ ID NO: 291854 - RNA, 64 nt, hsa; identical to SEQ ID NO: 102590

SEQ ID NO: 291855 - RNA, 64 nt, hsa; identical to SEQ ID NO: 102591

SEQ ID NO: 291856 - RNA, 64 nt, hsa; identical to SEQ ID NO: 102592

SEQ ID NO: 291857 - RNA, 64 nt, hsa; identical to SEQ ID NO: 102593

SEQ ID NO: 291858 - RNA, 64 nt, hsa; identical to SEQ ID NO: 102594

SEQ ID NO: 291859 - RNA, 64 nt, hsa; identical to SEQ ID NO: 102595

SEQ ID NO: 291860 - RNA, 64 nt, hsa; identical to SEQ ID NO: 102596

SEQ ID NO: 291861 - RNA, 64 nt, hsa; identical to SEQ ID NO: 102597

SEQ ID NO: 291862 - RNA, 64 nt, hsa; identical to SEQ ID NO: 102598

SEQ ID NO: 291863 - RNA, 64 nt, hsa; identical to SEQ ID NO: 102599

SEQ ID NO: 291864 - RNA, 64 nt, hsa; identical to SEQ ID NO: 102600

SEQ ID NO: 291865 - RNA, 64 nt, hsa; identical to SEQ ID NO: 102601

SEQ ID NO: 291866 - RNA, 64 nt, hsa; identical to SEQ ID NO: 102602

SEQ ID NO: 291867 - RNA, 64 nt, hsa; identical to SEQ ID NO: 102603

SEQ ID NO: 291868 - RNA, 64 nt, hsa; identical to SEQ ID NO: 102604

SEQ ID NO: 291869 - RNA, 64 nt, hsa; identical to SEQ ID NO: 102605

SEQ ID NO: 291870 - RNA, 64 nt, hsa; identical to SEQ ID NO: 102606

SEQ ID NO: 291871 - RNA, 64 nt, hsa; identical to SEQ ID NO: 102607

SEQ ID NO: 291872 - RNA, 64 nt, hsa; identical to SEQ ID NO: 102608

SEQ ID NO: 291873 - RNA, 64 nt, hsa; identical to SEQ ID NO: 102609

SEQ ID NO: 291874 - RNA, 64 nt, hsa; identical to SEQ ID NO: 102610

SEQ ID NO: 291875 - RNA, 64 nt, hsa; identical to SEQ ID NO: 102611

SEQ ID NO: 291876 - RNA, 64 nt, hsa; identical to SEQ ID NO: 102612

SEQ ID NO: 291877 - RNA, 64 nt, hsa; identical to SEQ ID NO: 102613

SEQ ID NO: 291878 - RNA, 64 nt, hsa; identical to SEQ ID NO: 102614

SEQ ID NO: 291879 - RNA, 64 nt, hsa; identical to SEQ ID NO: 102615

SEQ ID NO: 291880 - RNA, 64 nt, hsa; identical to SEQ ID NO: 102616

SEQ ID NO: 291881 - RNA, 64 nt, hsa; identical to SEQ ID NO: 102617

SEQ ID NO: 291882 - RNA, 64 nt, hsa; identical to SEQ ID NO: 102618

SEQ ID NO: 291883 - RNA, 64 nt, hsa; identical to SEQ ID NO: 102619

SEQ ID NO: 291884 - RNA, 64 nt, hsa; identical to SEQ ID NO: 102620

SEQ ID NO: 291885 - RNA, 64 nt, hsa; identical to SEQ ID NO: 102621

SEQ ID NO: 291886 - RNA, 64 nt, hsa; identical to SEQ ID NO: 102622

SEQ ID NO: 291887 - RNA, 64 nt, hsa; identical to SEQ ID NO: 102623

SEQ ID NO: 291888 - RNA, 64 nt, hsa; identical to SEQ ID NO: 102624

SEQ ID NO: 291889 - RNA, 64 nt, hsa; identical to SEQ ID NO: 102625

SEQ ID NO: 291890 - RNA, 64 nt, hsa; identical to SEQ ID NO: 102626

SEQ ID NO: 291891 - RNA, 64 nt, hsa; identical to SEQ ID NO: 102627

SEQ ID NO: 291892 - RNA, 64 nt, hsa; identical to SEQ ID NO: 102628

SEQ ID NO: 291893 - RNA, 64 nt, hsa
cgcccggcuaauguuuguauuuuuaguagagacgggguuucaccauguuggucaggcuggucuc

SEQ ID NO: 291894 - RNA, 64 nt, hsa
gggccagcuaauuuuuguauguuuaguagaaacgggguuucaccauguuggccaggcuguucuc

SEQ ID NO: 291895 - RNA, 64 nt, hsa
aucuggcuaauuuuuuguauuuuuaguaaagaugggguuucaccauguuggccaggcugaucuc

SEQ ID NO: 291896 - RNA, 64 nt, hsa
cacacccagcuaauuuuugcauuuuuacuugacaggguuucaccauguuggcuaggauaguuuc

SEQ ID NO: 291897 - RNA, 64 nt, hsa
ugcccagcuaauuuuugcauuuuuaguagagaugggguuucaccauguuggccaggauggucuu

SEQ ID NO: 291898 - RNA, 64 nt, hsa
cgcccggcuaauuuuuguguuuuuagcagagacaggguuucaccacguuggccaggguggucuu

SEQ ID NO: 291899 - RNA, 64 nt, hsa
uuguuguuguuguuuuguauuuuugguagagacgggguuucaucauguugccuaggcuguucuu

SEQ ID NO: 291900 - RNA, 64 nt, hsa
cuuccuuccuccgcugggcugggucaccuggcgaggguuucacucaucauggaugccaugggac

SEQ ID NO: 291901 - RNA, 64 nt, hsa
cgcccaacuaauuuuuguauuuuuaguagagacaggguuucaccauguuggccaggcugcucuu

SEQ ID NO: 291902 - RNA, 64 nt, hsa
cgcccggcuaauuuuuguauuuuuaguagagacgggguuucaccauguuggccaggcuggucuc

SEQ ID NO: 291903 - RNA, 64 nt, hsa
uucugugguauaugugggagggccauuaaggaguggguuucacucccugcaugugggcaggugu

SEQ ID NO: 291904 - RNA, 64 nt, hsa
caccaggcuaauuuuuguauuuuuaguagagacgggguuucaccauguuggccaggcuggucuc

SEQ ID NO: 291905 - RNA, 64 nt, hsa
gccuggcuaauuuuuuauauuuuuaguagagacaggguuucaccauguuaaccaggauggucuc

SEQ ID NO: 291906 - RNA, 64 nt, hsa
ccacccagcuaaguuuguauuuuuguuggagacgggguuucaccauauuggccagacuggucuc

SEQ ID NO: 291907 - RNA, 64 nt, hsa
cgcccagcuaauuuuuguauuuuuaguagaaaugggguuucaccauguguggccaggcuggucu

SEQ ID NO: 291908 - RNA, 64 nt, hsa
agaguccuaggaugaggcuugggcagugcugguaggguuucaaggugcuauuaguggggcaggg

SEQ ID NO: 291909 - RNA, 64 nt, hsa
ggggagcuggcaaugaaacccuguccugggacauggguuucauguucuuguacacuuccccucu

SEQ ID NO: 291910 - RNA, 64 nt, hsa
ugccaggcuaauuuuuguauuuuuaguaaagacaggguuucaccauauuggccaggcuggucuc

SEQ ID NO: 291911 - RNA, 64 nt, hsa
cgcccagcuaauuuuuguauuuuucguagagacgggguuucaccacauucgucagguugguuuc

SEQ ID NO: 291912 - RNA, 64 nt, hsa
cgcccagcuaauuuuuguauuuuuaguagagaugggguuucaucauguuggccagguuggucuc

SEQ ID NO: 291913 - RNA, 64 nt, hsa
cccgccuaauuuuuuuguauuuuuaguagagaugggguuucaccguguuagucaggauggucuc

SEQ ID NO: 291914 - RNA, 64 nt, hsa
uauucagagcgcguauggaguggaaacgcuuguaggguuucaccagguaagcgguguugaacuu

SEQ ID NO: 291915 - RNA, 64 nt, hsa; identical to SEQ ID NO: 291914

SEQ ID NO: 291916 - RNA, 64 nt, hsa
cgcccagcuaauuuuuguauuuuuaguagagaugggguuucaccauguugaccaggcugauuuu

SEQ ID NO: 291917 - RNA, 64 nt, hsa
cccagcuaauuuuguuuuuuuuuuagucgagacgggguuucaccauguugcucaggcuggucuu

SEQ ID NO: 291918 - RNA, 64 nt, hsa
gcccggcuaacuuuuuguguuuuuaguagagacgggguuucaccguguuagccaggauggucuc

SEQ ID NO: 291919 - RNA, 64 nt, hsa
ccuggcuaauauuuuguauuuuuuaguagagacgggguuucaccguguuagccaggauggucuc

SEQ ID NO: 291920 - RNA, 64 nt, hsa
cacccagugaauuuuuguauuuuuaguagagacgggguuucaccauguuggccaggcuggucuu

SEQ ID NO: 291921 - RNA, 64 nt, hsa
cgucuggcuaauuuuuguauuuuuaguagagaugggguuucacccuauuggucaggcuggucuu

SEQ ID NO: 291922 - RNA, 64 nt, hsa
uuuaaccuucauguagcuaagucuaccuuaaaaaggguuucaagagcuuuguacagucucgaug

SEQ ID NO: 291923 - RNA, 64 nt, hsa
cgaaucugcuuuguguugggacgcuuuaaugucaggguuucacuaaauaaaugaauuuucauau

SEQ ID NO: 291924 - RNA, 64 nt, hsa
cucccggcugauuuuuguauuaguagagacgacaggguuucaccauguuggccagggcuggucu

SEQ ID NO: 291925 - RNA, 64 nt, hsa
cacccagcuaauuuuuguauuuuuaguagagaugggguuucacuguguuggccaggcuggucuu

SEQ ID NO: 291926 - RNA, 64 nt, hsa
cgcccggcuaauuuuuguauuuuuaguagagacaggguuucaucauguuggccaggugggucuc

SEQ ID NO: 291927 - RNA, 64 nt, hsa
acagagcuugauccagaagugcacaguagagacgggguuucaccauguuagccaggauggucuc

SEQ ID NO: 291928 - RNA, 64 nt, hsa
cugguccccauuuauuggugagaaaacaggcucaggguuucaugacuuguugaaagugcagaaa

SEQ ID NO: 291929 - RNA, 55 nt, hsa
cuuuuuguuuuuuuaaguagagauaggguuucacuauguuggcuaggcugaucuc

SEQ ID NO: 291930 - RNA, 64 nt, hsa
aaaauaagguaaggauuucauaaucagguugucuggguuucagagcuguuuuuaauugacugag

SEQ ID NO: 291931 - RNA, 64 nt, hsa
gccuggcugauuuuuuguauuuuuaguagagacaggguuucaccauguuggccaggcuggucuc

SEQ ID NO: 291932 - RNA, 64 nt, hsa
cacaaggcuaaguuuuguauuuuuuguagagacaggguuucaacauauuauccaggcugguguc

SEQ ID NO: 291933 - RNA, 64 nt, hsa
acucagcuaauuuuuuguauuuuuaguagagccgggguuucaccaucuuggccaggcugaucuu

SEQ ID NO: 291934 - RNA, 64 nt, hsa
augccuggcuaauuuuguauuuuuaguagagaugggguuucaccauguuggccaggcuggucuc

SEQ ID NO: 291935 - RNA, 64 nt, hsa
cacaaacuaccaaguauacuggugaaaucucgauggguuucagauauugucagugaaucauaug

SEQ ID NO: 291936 - RNA, 64 nt, hsa
ugcccggcuacuuuuuguauuuuuaguagagacaggguuucaucauguuggccaggcuagucuc

SEQ ID NO: 291937 - RNA, 64 nt, hsa
gccaaccuaauuuuuguauuauuuaguagagacaggguuucaccacauuggccaggcuggucuc

SEQ ID NO: 291938 - RNA, 64 nt, hsa
gcccgggcaaauuuuuguauuuuuaguagagaugggguuucaccguguuggccaggauggucuc

SEQ ID NO: 291939 - RNA, 64 nt, hsa
cccagcuaauuuuuuuguauuuuuaguagagaugggguuucaccauguuauccaggaugguuuu

SEQ ID NO: 291940 - RNA, 64 nt, hsa
cgcccagcuaauuccuguauuuuuaguagagacaggguuucaccauguuggccaggcuggucuc

SEQ ID NO: 291941 - RNA, 64 nt, hsa
cccgccuaauuuuuuguauuuuuuaguagagacgggguuucaccguguuagucaggauggucuc

SEQ ID NO: 291942 - RNA, 64 nt, hsa
ccuggcuaauuuuuuuugauuuuuaguagagacaggguuucaccguguuagccaggauggucuc

SEQ ID NO: 291943 - RNA, 64 nt, hsa
ugccuggcuaauuuuugcauuuuuaguagagacaggguuucaccauauuggccaggcugggacu

SEQ ID NO: 291944 - RNA, 64 nt, hsa
ggcuaauuuuguuuuuguauuuuuaguagagacgggguuucaccguguuagccaggaaggucuc

SEQ ID NO: 291945 - RNA, 64 nt, hsa
guaaucaccucaguacuuaagcacuucugaacuuggguuucaugccugccccccacaaauuaug

SEQ ID NO: 291946 - RNA, 64 nt, hsa
uggagccaaagguuagcaggugauuugcguggagggguuucaagacuagaaacuguucuuaauu

SEQ ID NO: 291947 - RNA, 64 nt, hsa
cgccuggcugauuuuuguaguuuuaguggagaugggguuucaccauguuggccaggcuugucuc

SEQ ID NO: 291948 - RNA, 64 nt, hsa
acgccuggcuaauuuuuguauuuuuaguagagacggguuucaccauguuggcuagacuagucuc

SEQ ID NO: 291949 - RNA, 64 nt, hsa
cuacacaucgcaugaguagaggggcucugggucgggguuucauaugcagcagagcagcucccuu

SEQ ID NO: 291950 - RNA, 64 nt, hsa
auuugaguuuuguuuugccuguggaggcaauuggggguuucaggucaaagagagggucagugga

SEQ ID NO: 291951 - RNA, 64 nt, hsa
cacccagcuaauuuuuguauuuuuaguagagaugggguuucaccauauuggccaggcuggucuc

SEQ ID NO: 291952 - RNA, 64 nt, hsa
auacaucugucauuuucauuucacaggguucacaggguuucacagucugaugagacugugccug

SEQ ID NO: 291953 - RNA, 64 nt, hsa
cacccaacuaauuuuuguauuuuuaguagagaugggguuucaccauguuggccaggauugucuc

SEQ ID NO: 291954 - RNA, 64 nt, hsa
auuacaggcaugagccaccacacccagcgagacgggguuucauuauguuggccaggcuggucuc

SEQ ID NO: 291955 - RNA, 64 nt, hsa
agcuaauuuuuuguauuuuuuuuuaguagagaugggguuucaccacguuagccaggauggucuc

SEQ ID NO: 291956 - RNA, 64 nt, hsa
acccggcuaauuuuuguauuuuuaguagagacagggguuucaccauauuggccaggcuggucuc

SEQ ID NO: 291957 - RNA, 64 nt, hsa
cgccuggcuaauuuuuguauuuuuaguagagacgggguuucaccaucuuggccagguuggucuu

SEQ ID NO: 291958 - RNA, 64 nt, hsa
acacccagcuaauuuuguauuuuuaguagagacgggguuucaccauguugcucaggcuggucuc

SEQ ID NO: 291959 - RNA, 64 nt, hsa
ccagcuaaauuuuuuuguauuuuuaguagagaugggguuucaccauguugaccaggauggucuc

SEQ ID NO: 291960 - RNA, 64 nt, hsa
gcccggcucauuuuuuguauuuuuaguggagacgggguuucaccguguuagccaggauagucuu

SEQ ID NO: 291961 - RNA, 64 nt, hsa
cgcccaacuaauuuuuauauuuuuaguagagacgggguuucaccauguuggccaggcuggucuu

SEQ ID NO: 291962 - RNA, 64 nt, hsa
ccggcuaauuuuuuuuguauuuuuaguagagacgggguuucaucguguuaaccaggauggucuc

SEQ ID NO: 291963 - RNA, 64 nt, hsa
ugccuggcuaauuuuuguauuuuuaguagagacaggguuucaccauguuggccaggauggucuc

SEQ ID NO: 291964 - RNA, 64 nt, hsa
cccagauuauuuuuuuguauuuguaguagagacgggguuucaccaugucagucaggcuggucuu

SEQ ID NO: 291965 - RNA, 64 nt, hsa
cgcccggcuaauuuuuguauuuuuaguagagacaggguuucaccauauuagccaggugggucuu

SEQ ID NO: 291966 - RNA, 64 nt, hsa
ucucaguaggugccucaugcugacuucuccaguaggguuucaggacaaacuaccaaggaauugc

SEQ ID NO: 291967 - RNA, 64 nt, hsa
uuuggagaauggggaggccucuuggagacacagaggguuucaccuuggaugaccucuagagaaa

SEQ ID NO: 291968 - RNA, 64 nt, hsa
uuuuaaaaaaugccagucuggucagggaaguaggggguuucaaugcuguugggaaccaggaagg

SEQ ID NO: 291969 - RNA, 64 nt, hsa
uccucagcagaacaugucucuccucgaguccuuuggguuucagauuguucagucggcauuugcg

SEQ ID NO: 291970 - RNA, 64 nt, hsa
aagguggcuggacugcugggcgggggacaucucgggguuucagggugggcaggggguuaguuug

SEQ ID NO: 291971 - RNA, 64 nt, hsa
acccuggcuccguggaccuucuggaggaagguggggguuucaaagacugggggaccccuuccuc

SEQ ID NO: 291972 - RNA, 64 nt, hsa
caccuggcuaauuuuuguauuuuuaguagagacaggguuucaccauauuggucaggcuggucuu

SEQ ID NO: 291973 - RNA, 64 nt, hsa
cgcccggcuaauuuuuguauuuuuaguagagacaggguuucaccauauuggucaggcuggucuu

SEQ ID NO: 291974 - RNA, 64 nt, hsa
uguucaaccugggaucagacuuccaugcucuggggaauccaagugguagcaccuguaacccugu

SEQ ID NO: 291975 - RNA, 64 nt, hsa
ccaaaaugguacaccgauauuuaagaaggaaagcgaauccaaacgguugugaucuaaagaauca

SEQ ID NO: 291976 - RNA, 64 nt, hsa
ccaauuggaaauuagaacaguagaguacuuuucugaauccaauccuauuuuuauuuuauacagu

SEQ ID NO: 291977 - RNA, 64 nt, hsa
ucccugaacuacugucuauauuuaaaauuagauggaauccaaagauacacgggauuaauaguau

SEQ ID NO: 291978 - RNA, 64 nt, hsa
cucuauugagcagagccuggaguuugagacuauggaauccaaccuccccauugcacagaugggg

SEQ ID NO: 291979 - RNA, 64 nt, hsa
ucuguuuugcacccagcuuggcagauguggauuugaauccaagccuugugucugccccuaugug

SEQ ID NO: 291980 - RNA, 64 nt, hsa
aaguuucauguaguaggacagagaacagaaggccgaauccaaguuucaugugguaggacagaga

SEQ ID NO: 291981 - RNA, 64 nt, hsa
uauauguauguuucuaaaagcuuuagugaaggcugaauccaaguuucauguaguaggacagaga

SEQ ID NO: 291982 - RNA, 64 nt, hsa
gccuagugccaguuugguagucccccuuucuggccccuuggagcccacacacguuucaucuuuu

SEQ ID NO: 291983 - RNA, 64 nt, hsa
ugccuuaaauuggcaggugguaccguacucacugcccuuggagcugugaccggcuccugccugu

SEQ ID NO: 291984 - RNA, 64 nt, hsa
caaacauuuuaucauucuaaauggugacucucugcccuuggacccauuuauuauucacagaugg

SEQ ID NO: 291985 - RNA, 64 nt, hsa
uuuggucuccuuuccccuccugucuucccgguaucccuuggagucucacaagguuuacuuuggu

SEQ ID NO: 291986 - RNA, 64 nt, hsa
caccuaauccacagaaaguaaugucuuuccccuccccuuggaauuuuuguuuuguuuuuggaaa

SEQ ID NO: 291987 - RNA, 64 nt, hsa
caggccccguccugccgugacacccuucauccuacccuuggaaccccaaggccaaguugguuca

SEQ ID NO: 291988 - RNA, 64 nt, hsa
ggaaccgacugaguaaugaagaagaggaaggaagcccuuggaaggaacguaaaauccauuucag

SEQ ID NO: 291989 - RNA, 64 nt, hsa
uggaaggaacguaaaauccauuucagccugccgccccuuggaauggagggucuucuagggacca

SEQ ID NO: 291990 - RNA, 64 nt, hsa
gcggggccuggccuaccucccccauccccugcuucccuuggaggcagagggcucccuugacuac

SEQ ID NO: 291991 - RNA, 64 nt, hsa
uugacuaccuuuguuccucuucuuugaacacugacccuuggacaacauuuaucauaauuuguca

SEQ ID NO: 291992 - RNA, 64 nt, hsa
ccugcguguccugugcuuaccaccgcccaaggcccccuuggaucucuuggauaggaguugguga

SEQ ID NO: 291993 - RNA, 64 nt, hsa
aggugucuuguugcauggaagggauaguuuggcucccuuggaggcuauguaggcuugucccggg

SEQ ID NO: 291994 - RNA, 64 nt, hsa
gcagguguuggggcacaguccccaagggcucggccccuuggaucaggcugggcacucgcugugc

SEQ ID NO: 291995 - RNA, 64 nt, hsa
ccaagcccaccauggcccagauggacgugcaaagcccuuggaauuuucuggcacuuccucucua

SEQ ID NO: 291996 - RNA, 64 nt, hsa
cuggaacagcuuccucucacugaacggagacgcccccuuggacgaacugccuaaucguuugguu

SEQ ID NO: 291997 - RNA, 64 nt, hsa
accacugagcacauggggucuuucaggauccucucccuuggaagggcaaugugugagcuaagga

SEQ ID NO: 291998 - RNA, 64 nt, hsa
agagucaccagaugaggcucuaaacagaucgcaucccuuggaauuagaaagcaguggagaccgg

SEQ ID NO: 291999 - RNA, 64 nt, hsa
cacaauuagaauauuuugacuuaguguccugucccccuuggacguuccaacuugacuuaguguc

SEQ ID NO: 292000 - RNA, 64 nt, hsa
cuuggacguuccaacuugacuuaguguccagugccccuuggacauuccaaccugguagguaagc

SEQ ID NO: 292001 - RNA, 64 nt, hsa; identical to SEQ ID NO: 73636

SEQ ID NO: 292002 - RNA, 64 nt, hsa; identical to SEQ ID NO: 73637

SEQ ID NO: 292003 - RNA, 64 nt, hsa; identical to SEQ ID NO: 73638

SEQ ID NO: 292004 - RNA, 64 nt, hsa; identical to SEQ ID NO: 73639

SEQ ID NO: 292005 - RNA, 64 nt, hsa; identical to SEQ ID NO: 73640

SEQ ID NO: 292006 - RNA, 64 nt, hsa; identical to SEQ ID NO: 73641

SEQ ID NO: 292007 - RNA, 64 nt, hsa; identical to SEQ ID NO: 73642

SEQ ID NO: 292008 - RNA, 64 nt, hsa; identical to SEQ ID NO: 73643

SEQ ID NO: 292009 - RNA, 64 nt, hsa; identical to SEQ ID NO: 73644

SEQ ID NO: 292010 - RNA, 64 nt, hsa; identical to SEQ ID NO: 73645

SEQ ID NO: 292011 - RNA, 64 nt, hsa; identical to SEQ ID NO: 73646

SEQ ID NO: 292012 - RNA, 64 nt, hsa; identical to SEQ ID NO: 73647

SEQ ID NO: 292013 - RNA, 64 nt, hsa; identical to SEQ ID NO: 73648

SEQ ID NO: 292014 - RNA, 64 nt, hsa; identical to SEQ ID NO: 73649

SEQ ID NO: 292015 - RNA, 64 nt, hsa; identical to SEQ ID NO: 73650

SEQ ID NO: 292016 - RNA, 64 nt, hsa; identical to SEQ ID NO: 73651

SEQ ID NO: 292017 - RNA, 64 nt, hsa; identical to SEQ ID NO: 73652

SEQ ID NO: 292018 - RNA, 64 nt, hsa; identical to SEQ ID NO: 73653

SEQ ID NO: 292019 - RNA, 64 nt, hsa; identical to SEQ ID NO: 73654

SEQ ID NO: 292020 - RNA, 64 nt, hsa; identical to SEQ ID NO: 73655

SEQ ID NO: 292021 - RNA, 64 nt, hsa; identical to SEQ ID NO: 73656

SEQ ID NO: 292022 - RNA, 64 nt, hsa; identical to SEQ ID NO: 73657

SEQ ID NO: 292023 - RNA, 64 nt, hsa; identical to SEQ ID NO: 73658

SEQ ID NO: 292024 - RNA, 64 nt, hsa; identical to SEQ ID NO: 73659

SEQ ID NO: 292025 - RNA, 64 nt, hsa; identical to SEQ ID NO: 73660

SEQ ID NO: 292026 - RNA, 64 nt, hsa; identical to SEQ ID NO: 73661

SEQ ID NO: 292027 - RNA, 64 nt, hsa; identical to SEQ ID NO: 73662

SEQ ID NO: 292028 - RNA, 64 nt, hsa; identical to SEQ ID NO: 73663

SEQ ID NO: 292029 - RNA, 63 nt, hsa; identical to SEQ ID NO: 73664

SEQ ID NO: 292030 - RNA, 64 nt, hsa; identical to SEQ ID NO: 73665

SEQ ID NO: 292031 - RNA, 64 nt, hsa; identical to SEQ ID NO: 73666

SEQ ID NO: 292032 - RNA, 64 nt, hsa; identical to SEQ ID NO: 73667

SEQ ID NO: 292033 - RNA, 64 nt, hsa; identical to SEQ ID NO: 73668

SEQ ID NO: 292034 - RNA, 64 nt, hsa; identical to SEQ ID NO: 73669

SEQ ID NO: 292035 - RNA, 64 nt, hsa; identical to SEQ ID NO: 73670

SEQ ID NO: 292036 - RNA, 64 nt, hsa; identical to SEQ ID NO: 73671

SEQ ID NO: 292037 - RNA, 64 nt, hsa; identical to SEQ ID NO: 73672

SEQ ID NO: 292038 - RNA, 64 nt, hsa; identical to SEQ ID NO: 73673

SEQ ID NO: 292039 - RNA, 64 nt, hsa; identical to SEQ ID NO: 73674

SEQ ID NO: 292040 - RNA, 64 nt, hsa; identical to SEQ ID NO: 73675

SEQ ID NO: 292041 - RNA, 64 nt, hsa; identical to SEQ ID NO: 73676

SEQ ID NO: 292042 - RNA, 64 nt, hsa; identical to SEQ ID NO: 73677

SEQ ID NO: 292043 - RNA, 64 nt, hsa; identical to SEQ ID NO: 73678

SEQ ID NO: 292044 - RNA, 64 nt, hsa; identical to SEQ ID NO: 73679

SEQ ID NO: 292045 - RNA, 64 nt, hsa; identical to SEQ ID NO: 73680

SEQ ID NO: 292046 - RNA, 64 nt, hsa; identical to SEQ ID NO: 73681

SEQ ID NO: 292047 - RNA, 64 nt, hsa; identical to SEQ ID NO: 73682

SEQ ID NO: 292048 - RNA, 64 nt, hsa; identical to SEQ ID NO: 73683

SEQ ID NO: 292049 - RNA, 64 nt, hsa; identical to SEQ ID NO: 73684

SEQ ID NO: 292050 - RNA, 64 nt, hsa; identical to SEQ ID NO: 73685

SEQ ID NO: 292051 - RNA, 64 nt, hsa; identical to SEQ ID NO: 73686

SEQ ID NO: 292052 - RNA, 64 nt, hsa; identical to SEQ ID NO: 73687

SEQ ID NO: 292053 - RNA, 64 nt, hsa; identical to SEQ ID NO: 73688

SEQ ID NO: 292054 - RNA, 64 nt, hsa; identical to SEQ ID NO: 73689

SEQ ID NO: 292055 - RNA, 64 nt, hsa; identical to SEQ ID NO: 73690

SEQ ID NO: 292056 - RNA, 64 nt, hsa; identical to SEQ ID NO: 73691

SEQ ID NO: 292057 - RNA, 64 nt, hsa; identical to SEQ ID NO: 73692

SEQ ID NO: 292058 - RNA, 64 nt, hsa; identical to SEQ ID NO: 73693

SEQ ID NO: 292059 - RNA, 64 nt, hsa; identical to SEQ ID NO: 73694

SEQ ID NO: 292060 - RNA, 64 nt, hsa; identical to SEQ ID NO: 73695

SEQ ID NO: 292061 - RNA, 64 nt, hsa; identical to SEQ ID NO: 73696

SEQ ID NO: 292062 - RNA, 64 nt, hsa; identical to SEQ ID NO: 73697

SEQ ID NO: 292063 - RNA, 64 nt, hsa; identical to SEQ ID NO: 73698

SEQ ID NO: 292064 - RNA, 64 nt, hsa; identical to SEQ ID NO: 73699

SEQ ID NO: 292065 - RNA, 64 nt, hsa; identical to SEQ ID NO: 73700

SEQ ID NO: 292066 - RNA, 64 nt, hsa; identical to SEQ ID NO: 73701

SEQ ID NO: 292067 - RNA, 64 nt, hsa; identical to SEQ ID NO: 73702

SEQ ID NO: 292068 - RNA, 64 nt, hsa; identical to SEQ ID NO: 73703

SEQ ID NO: 292069 - RNA, 64 nt, hsa; identical to SEQ ID NO: 73704

SEQ ID NO: 292070 - RNA, 64 nt, hsa; identical to SEQ ID NO: 73705

SEQ ID NO: 292071 - RNA, 64 nt, hsa; identical to SEQ ID NO: 73706

SEQ ID NO: 292072 - RNA, 64 nt, hsa; identical to SEQ ID NO: 73707

SEQ ID NO: 292073 - RNA, 64 nt, hsa; identical to SEQ ID NO: 91262

SEQ ID NO: 292074 - RNA, 64 nt, hsa; identical to SEQ ID NO: 91263

SEQ ID NO: 292075 - RNA, 64 nt, hsa; identical to SEQ ID NO: 91264

SEQ ID NO: 292076 - RNA, 64 nt, hsa; identical to SEQ ID NO: 91265

SEQ ID NO: 292077 - RNA, 64 nt, hsa; identical to SEQ ID NO: 91266

SEQ ID NO: 292078 - RNA, 64 nt, hsa; identical to SEQ ID NO: 91267

SEQ ID NO: 292079 - RNA, 64 nt, hsa; identical to SEQ ID NO: 91268

SEQ ID NO: 292080 - RNA, 64 nt, hsa; identical to SEQ ID NO: 91269

SEQ ID NO: 292081 - RNA, 64 nt, hsa; identical to SEQ ID NO: 91270

SEQ ID NO: 292082 - RNA, 64 nt, hsa; identical to SEQ ID NO: 91271

SEQ ID NO: 292083 - RNA, 64 nt, hsa; identical to SEQ ID NO: 91272

SEQ ID NO: 292084 - RNA, 64 nt, hsa; identical to SEQ ID NO: 91273

SEQ ID NO: 292085 - RNA, 64 nt, hsa; identical to SEQ ID NO: 91274

SEQ ID NO: 292086 - RNA, 64 nt, hsa; identical to SEQ ID NO: 91275

SEQ ID NO: 292087 - RNA, 64 nt, hsa; identical to SEQ ID NO: 91276

SEQ ID NO: 292088 - RNA, 64 nt, hsa; identical to SEQ ID NO: 91277

SEQ ID NO: 292089 - RNA, 64 nt, hsa; identical to SEQ ID NO: 91278

SEQ ID NO: 292090 - RNA, 64 nt, hsa; identical to SEQ ID NO: 91279

SEQ ID NO: 292091 - RNA, 64 nt, hsa; identical to SEQ ID NO: 91280

SEQ ID NO: 292092 - RNA, 64 nt, hsa; identical to SEQ ID NO: 91281

SEQ ID NO: 292093 - RNA, 64 nt, hsa; identical to SEQ ID NO: 91282

SEQ ID NO: 292094 - RNA, 64 nt, hsa; identical to SEQ ID NO: 91283

SEQ ID NO: 292095 - RNA, 64 nt, hsa; identical to SEQ ID NO: 91284

SEQ ID NO: 292096 - RNA, 64 nt, hsa; identical to SEQ ID NO: 91285

SEQ ID NO: 292097 - RNA, 64 nt, hsa; identical to SEQ ID NO: 91286

SEQ ID NO: 292098 - RNA, 64 nt, hsa; identical to SEQ ID NO: 91287

SEQ ID NO: 292099 - RNA, 64 nt, hsa; identical to SEQ ID NO: 91288

SEQ ID NO: 292100 - RNA, 64 nt, hsa; identical to SEQ ID NO: 91289

SEQ ID NO: 292101 - RNA, 64 nt, hsa; identical to SEQ ID NO: 91290

SEQ ID NO: 292102 - RNA, 64 nt, hsa; identical to SEQ ID NO: 91291

SEQ ID NO: 292103 - RNA, 64 nt, hsa; identical to SEQ ID NO: 91292

SEQ ID NO: 292104 - RNA, 64 nt, hsa; identical to SEQ ID NO: 91293

SEQ ID NO: 292105 - RNA, 64 nt, hsa; identical to SEQ ID NO: 91294

SEQ ID NO: 292106 - RNA, 64 nt, hsa; identical to SEQ ID NO: 91295

SEQ ID NO: 292107 - RNA, 64 nt, hsa; identical to SEQ ID NO: 91296

SEQ ID NO: 292108 - RNA, 64 nt, hsa; identical to SEQ ID NO: 91297

SEQ ID NO: 292109 - RNA, 64 nt, hsa; identical to SEQ ID NO: 91298

SEQ ID NO: 292110 - RNA, 64 nt, hsa; identical to SEQ ID NO: 91299

SEQ ID NO: 292111 - RNA, 64 nt, hsa; identical to SEQ ID NO: 91300

SEQ ID NO: 292112 - RNA, 64 nt, hsa; identical to SEQ ID NO: 91301

SEQ ID NO: 292113 - RNA, 64 nt, hsa; identical to SEQ ID NO: 91302

SEQ ID NO: 292114 - RNA, 64 nt, hsa; identical to SEQ ID NO: 91303

SEQ ID NO: 292115 - RNA, 64 nt, hsa; identical to SEQ ID NO: 91304

SEQ ID NO: 292116 - RNA, 64 nt, hsa; identical to SEQ ID NO: 91305

SEQ ID NO: 292117 - RNA, 64 nt, hsa; identical to SEQ ID NO: 91306

SEQ ID NO: 292118 - RNA, 64 nt, hsa; identical to SEQ ID NO: 91307

SEQ ID NO: 292119 - RNA, 64 nt, hsa; identical to SEQ ID NO: 91308

SEQ ID NO: 292120 - RNA, 64 nt, hsa; identical to SEQ ID NO: 91309

SEQ ID NO: 292121 - RNA, 64 nt, hsa; identical to SEQ ID NO: 91310

SEQ ID NO: 292122 - RNA, 64 nt, hsa; identical to SEQ ID NO: 91311

SEQ ID NO: 292123 - RNA, 64 nt, hsa; identical to SEQ ID NO: 91312

SEQ ID NO: 292124 - RNA, 64 nt, hsa; identical to SEQ ID NO: 91313

SEQ ID NO: 292125 - RNA, 64 nt, hsa; identical to SEQ ID NO: 91314

SEQ ID NO: 292126 - RNA, 64 nt, hsa; identical to SEQ ID NO: 91315

SEQ ID NO: 292127 - RNA, 64 nt, hsa; identical to SEQ ID NO: 91316

SEQ ID NO: 292128 - RNA, 64 nt, hsa; identical to SEQ ID NO: 91317

SEQ ID NO: 292129 - RNA, 64 nt, hsa; identical to SEQ ID NO: 91318

SEQ ID NO: 292130 - RNA, 64 nt, hsa; identical to SEQ ID NO: 91319

SEQ ID NO: 292131 - RNA, 64 nt, hsa; identical to SEQ ID NO: 91320

SEQ ID NO: 292132 - RNA, 64 nt, hsa; identical to SEQ ID NO: 91321

SEQ ID NO: 292133 - RNA, 64 nt, hsa; identical to SEQ ID NO: 91322

SEQ ID NO: 292134 - RNA, 64 nt, hsa; identical to SEQ ID NO: 91323

SEQ ID NO: 292135 - RNA, 64 nt, hsa; identical to SEQ ID NO: 91324

SEQ ID NO: 292136 - RNA, 64 nt, hsa; identical to SEQ ID NO: 91325

SEQ ID NO: 292137 - RNA, 64 nt, hsa; identical to SEQ ID NO: 91326

SEQ ID NO: 292138 - RNA, 64 nt, hsa; identical to SEQ ID NO: 91327

SEQ ID NO: 292139 - RNA, 64 nt, hsa; identical to SEQ ID NO: 91328

SEQ ID NO: 292140 - RNA, 64 nt, hsa; identical to SEQ ID NO: 91329

SEQ ID NO: 292141 - RNA, 64 nt, hsa; identical to SEQ ID NO: 91330

SEQ ID NO: 292142 - RNA, 64 nt, hsa; identical to SEQ ID NO: 91331

SEQ ID NO: 292143 - RNA, 64 nt, hsa; identical to SEQ ID NO: 91332

SEQ ID NO: 292144 - RNA, 64 nt, hsa; identical to SEQ ID NO: 91333

SEQ ID NO: 292145 - RNA, 64 nt, hsa; identical to SEQ ID NO: 91334

SEQ ID NO: 292146 - RNA, 64 nt, hsa; identical to SEQ ID NO: 91335

SEQ ID NO: 292147 - RNA, 64 nt, hsa; identical to SEQ ID NO: 91336

SEQ ID NO: 292148 - RNA, 64 nt, hsa; identical to SEQ ID NO: 91337

SEQ ID NO: 292149 - RNA, 64 nt, hsa; identical to SEQ ID NO: 91338

SEQ ID NO: 292150 - RNA, 64 nt, hsa; identical to SEQ ID NO: 91339

SEQ ID NO: 292151 - RNA, 64 nt, hsa; identical to SEQ ID NO: 91340

SEQ ID NO: 292152 - RNA, 64 nt, hsa; identical to SEQ ID NO: 91341

SEQ ID NO: 292153 - RNA, 64 nt, hsa; identical to SEQ ID NO: 91342

SEQ ID NO: 292154 - RNA, 64 nt, hsa; identical to SEQ ID NO: 91343

SEQ ID NO: 292155 - RNA, 64 nt, hsa; identical to SEQ ID NO: 91344

SEQ ID NO: 292156 - RNA, 64 nt, hsa; identical to SEQ ID NO: 91345

SEQ ID NO: 292157 - RNA, 64 nt, hsa; identical to SEQ ID NO: 91346

SEQ ID NO: 292158 - RNA, 64 nt, hsa; identical to SEQ ID NO: 91347

SEQ ID NO: 292159 - RNA, 64 nt, hsa; identical to SEQ ID NO: 91348

SEQ ID NO: 292160 - RNA, 64 nt, hsa; identical to SEQ ID NO: 91349

SEQ ID NO: 292161 - RNA, 64 nt, hsa; identical to SEQ ID NO: 91350

SEQ ID NO: 292162 - RNA, 64 nt, hsa; identical to SEQ ID NO: 91351

SEQ ID NO: 292163 - RNA, 64 nt, hsa; identical to SEQ ID NO: 91352

SEQ ID NO: 292164 - RNA, 64 nt, hsa; identical to SEQ ID NO: 91353

SEQ ID NO: 292165 - RNA, 54 nt, hsa; identical to SEQ ID NO: 91354

SEQ ID NO: 292166 - RNA, 64 nt, hsa; identical to SEQ ID NO: 91355

SEQ ID NO: 292167 - RNA, 64 nt, hsa; identical to SEQ ID NO: 91356

SEQ ID NO: 292168 - RNA, 64 nt, hsa; identical to SEQ ID NO: 91357

SEQ ID NO: 292169 - RNA, 64 nt, hsa; identical to SEQ ID NO: 91358

SEQ ID NO: 292170 - RNA, 64 nt, hsa; identical to SEQ ID NO: 91359

SEQ ID NO: 292171 - RNA, 64 nt, hsa; identical to SEQ ID NO: 91360

SEQ ID NO: 292172 - RNA, 64 nt, hsa; identical to SEQ ID NO: 91361

SEQ ID NO: 292173 - RNA, 64 nt, hsa; identical to SEQ ID NO: 91362

SEQ ID NO: 292174 - RNA, 64 nt, hsa; identical to SEQ ID NO: 91363

SEQ ID NO: 292175 - RNA, 64 nt, hsa; identical to SEQ ID NO: 91364

SEQ ID NO: 292176 - RNA, 64 nt, hsa; identical to SEQ ID NO: 91365

SEQ ID NO: 292177 - RNA, 64 nt, hsa; identical to SEQ ID NO: 91366

SEQ ID NO: 292178 - RNA, 64 nt, hsa; identical to SEQ ID NO: 91367

SEQ ID NO: 292179 - RNA, 64 nt, hsa; identical to SEQ ID NO: 91368

SEQ ID NO: 292180 - RNA, 64 nt, hsa; identical to SEQ ID NO: 91369

SEQ ID NO: 292181 - RNA, 64 nt, hsa; identical to SEQ ID NO: 91370

SEQ ID NO: 292182 - RNA, 64 nt, hsa; identical to SEQ ID NO: 91371

SEQ ID NO: 292183 - RNA, 64 nt, hsa; identical to SEQ ID NO: 91372

SEQ ID NO: 292184 - RNA, 64 nt, hsa; identical to SEQ ID NO: 91373

SEQ ID NO: 292185 - RNA, 64 nt, hsa; identical to SEQ ID NO: 91374

SEQ ID NO: 292186 - RNA, 64 nt, hsa; identical to SEQ ID NO: 91375

SEQ ID NO: 292187 - RNA, 64 nt, hsa; identical to SEQ ID NO: 91376

SEQ ID NO: 292188 - RNA, 64 nt, hsa; identical to SEQ ID NO: 91377

SEQ ID NO: 292189 - RNA, 64 nt, hsa; identical to SEQ ID NO: 91378

SEQ ID NO: 292190 - RNA, 64 nt, hsa; identical to SEQ ID NO: 91379

SEQ ID NO: 292191 - RNA, 64 nt, hsa; identical to SEQ ID NO: 91380

SEQ ID NO: 292192 - RNA, 62 nt, hsa
ugagaaucucguuaguagcauguggccuaacaaaaggaaaaaauguuuuuaaacacacacac

SEQ ID NO: 292193 - RNA, 62 nt, hsa
ugaagaggaggaaaagugaaucacggagagagaaaggaaaggauagaaucacaggcugcguc

SEQ ID NO: 292194 - RNA, 62 nt, hsa
ccaucauuucacacauaggcucugaaagugggaaaggaaagcugaucaagcaggggccggac

SEQ ID NO: 292195 - RNA, 62 nt, hsa
gcauggaugguuguaaagaaacaaucagaaauaaaggaaaacugagcagaaucugucuggug

SEQ ID NO: 292196 - RNA, 62 nt, hsa
uugcacuguguucauauuaauccucuuuuaaaaaaggaaauauacagaagacaaacauugua

SEQ ID NO: 292197 - RNA, 62 nt, hsa
caggcuugagugacagagcaagacuguaucucaaaggaaaaaggaaacuaggccaggcgugg

SEQ ID NO: 292198 - RNA, 62 nt, hsa
gagugacagagcaagacuguaucucaaaggaaaaaggaaacuaggccaggcgugguggcuca

SEQ ID NO: 292199 - RNA, 62 nt, hsa
auaaacuuuuccagaagcacgagguaguuugcaaaggaaaagucugcacuguuugcucuaaa

SEQ ID NO: 292200 - RNA, 62 nt, hsa
guuuugcuguauuucaaaauuuuccuucuguuaaaggaaaauauugugaauaaccacuggug

SEQ ID NO: 292201 - RNA, 62 nt, hsa
agagggaaagggguacacugagggagaaaggaaaaggaaacuucaaacaauauagaauuaaa

SEQ ID NO: 292202 - RNA, 62 nt, hsa
gcuggcagagggaaagggguacacugagggagaaaggaaaaggaaacuucaaacaauauaga

SEQ ID NO: 292203 - RNA, 62 nt, hsa
aaaaaaaaaaaaaaggaaaaaggaaaaaaaaaaaaggaaaaccagaagcccugcugucuguc

SEQ ID NO: 292204 - RNA, 62 nt, hsa
augcuuucuucuuaaaaaaaaaaaaaaaggaaaaaggaaaaaaaaaaaaggaaaaccagaag

SEQ ID NO: 292205 - RNA, 62 nt, hsa
aaccucuaugcuuucuucuuaaaaaaaaaaaaaaaggaaaaaggaaaaaaaaaaaaggaaaa

SEQ ID NO: 292206 - RNA, 62 nt, hsa
aguucaggaaguuuuguuuuguguuuuaaauaaaaggaaagagcaaguuugcucagucaagu

SEQ ID NO: 292207 - RNA, 62 nt, hsa
uagggaaaaacuuuugcccgacugauuuuuaaaaaggaaaaaaaaaauguuuuacuaugugg

SEQ ID NO: 292208 - RNA, 62 nt, hsa
uuggagacuagagccaauaguguaauguucucaaaggaaacagacuugaguuguuggauuag

SEQ ID NO: 292209 - RNA, 62 nt, hsa
acuauucuaucauaacuacccaaggacuacuaaaaggaaaaauuguguuaccuuuuuuaaau

SEQ ID NO: 292210 - RNA, 62 nt, hsa
guagagagcuguugauuuguuucuguuuuuuuaaaggaaaacuauuuguaagauguugcacu

SEQ ID NO: 292211 - RNA, 62 nt, hsa
cacaaauauguaaagcaauuguaggaaauuugaaaggaaaaaaagaaaccgaagccaguauu

SEQ ID NO: 292212 - RNA, 62 nt, hsa
uauuucuuacaagccucuguuuuuuccccuuuaaaggaaacuuugaaaggauugugaauacu

SEQ ID NO: 292213 - RNA, 62 nt, hsa
uaggauucuuggagcuagccuggaucauggguaaaggaaacauuuugccuuuuguaucuuau

SEQ ID NO: 292214 - RNA, 62 nt, hsa
caaguauaaaauaaaauacauuuauaaaauaaaaaggaaaacagacuuaaauuuucuccuau

SEQ ID NO: 292215 - RNA, 62 nt, hsa
agacucccauuucuuaaaaacggauaaguuugaaaggaaacugcuauugaacuuaagcaucu

SEQ ID NO: 292216 - RNA, 62 nt, hsa
uuaaaauagcuuccaauaaguaacuuagaccaaaaggaaaaaugaagugccccaggagaaga

SEQ ID NO: 292217 - RNA, 62 nt, hsa
guuguaaagcucauuuuggggagguugauugcaaaggaaauuugaaagauaagauuuauucu

SEQ ID NO: 292218 - RNA, 62 nt, hsa
agagugaaaaaguguguuuuaugucaauugugaaaggaaaauguuaggaguaugguuuuuaa

SEQ ID NO: 292219 - RNA, 62 nt, hsa
uugcaugcucaauuucuagguccuuugucuagaaaggaaauuugccucaguugaauuaguga

SEQ ID NO: 292220 - RNA, 62 nt, hsa
caugccacggauaaaugaggcaaauccgaagaaaaggaaaaucgaauaaaaaauagucccac

SEQ ID NO: 292221 - RNA, 62 nt, hsa
uucauccauacagaauuuggaugacuauguauaaaggaaaacuuaaaucuuaauuauuauca

SEQ ID NO: 292222 - RNA, 62 nt, hsa
guuuuaaacgacuuuuguuugcggggcuuuuaaaaggaaaaccgaauuagguccacuucaau

SEQ ID NO: 292223 - RNA, 62 nt, hsa
gaauuagguccacuucaauguccaccugugagaaaggaaaaauuuuuuuguuguuuaacuug

SEQ ID NO: 292224 - RNA, 62 nt, hsa
cacaccguuaagccagagguucugacuucgcuaaaggaaauguaagagguuuuguugucugu

SEQ ID NO: 292225 - RNA, 62 nt, hsa
guaaaaaaacauaaugucuucagccucauaauaaaggaaaguuaauuaaaaaaaaaaagcaa

SEQ ID NO: 292226 - RNA, 62 nt, hsa
aaagucaaaaaaacgaaagagaaggagaagaaaaaggaaaagggcaaauugaaagucaagga

SEQ ID NO: 292227 - RNA, 62 nt, hsa
gaaaaagcgcaaagaggagaaugaagauccagaaaggaaaauaaagaagaagggcuucggcg

SEQ ID NO: 292228 - RNA, 58 nt, hsa
agaccgacgaggaugacuagacagcaaaaaaggaaaaguuaaacuaaaaaaaaaaagg

SEQ ID NO: 292229 - RNA, 62 nt, hsa
aggcccugcuuuuuuucuuaaaaguacuuuaaaaaggaaauuuguuuguauuuuuuauuuac

SEQ ID NO: 292230 - RNA, 62 nt, hsa
guguguaguaauagauguaaguuuacacuuugaaaggaaaucuuguuucaauguuuauuaua

SEQ ID NO: 292231 - RNA, 62 nt, hsa
uuuuaccuuguaaagucacaaaaauaguuuuuaaaggaaaaaguacaguauucuuuuaauaa

SEQ ID NO: 292232 - RNA, 62 nt, hsa
gcuuauuuaauaugcuuauaaccuaguuaaagaaaggaaaagaaaacaaaaaacgaaugaaa

SEQ ID NO: 292233 - RNA, 62 nt, hsa
guaggcccagucgucaucagaugcuugcggcaaaaggaaagcuguguuuauauggaagaaag

SEQ ID NO: 292234 - RNA, 62 nt, hsa
ggacaccuuuguaucucaagcuaaugcucuacaaaggaaaggccgagcaggccguguugcau

SEQ ID NO: 292235 - RNA, 62 nt, hsa
agcccauauaugcgguccaugaaacagauuucaaaggaaaagcuuaaagcaaggcggaacag

SEQ ID NO: 292236 - RNA, 62 nt, hsa
guuaccaucgcaaaggaaagguuauuccaguaaaaggaaauaguuuucucaaccauuuaaaa

SEQ ID NO: 292237 - RNA, 62 nt, hsa
cuauacucccaagacuacaaaguuaccaucgcaaaggaaagguuauuccaguaaaaggaaau

SEQ ID NO: 292238 - RNA, 62 nt, hsa
cugagcugcuuguuuaaaaaaaaaaaaaaggaaaaggaaaaagcaugacauuguguaucgau

SEQ ID NO: 292239 - RNA, 62 nt, hsa
aaaucgcugagcugcuuguuuaaaaaaaaaaaaaaggaaaaggaaaaagcaugacauugugu

SEQ ID NO: 292240 - RNA, 62 nt, hsa
uuuaaggaagaauuggagugacguaucuuagaaaaggaaaggcugauguuuccauauagcuu

SEQ ID NO: 292241 - RNA, 62 nt, hsa
aggugcuauccuagggauuuuaugaauuccugaaaggaaaauagaauaugaucaauuccuug

SEQ ID NO: 292242 - RNA, 62 nt, hsa
aaugucuuaauggcugugugacacacguaaggaaaggaaagggggucacgcacaucauguac

SEQ ID NO: 292243 - RNA, 62 nt, hsa
ucaaagcagaaauuuuaagccaaaaacaaacgaaaggaaagcggggaggggaaaacagaccc

SEQ ID NO: 292244 - RNA, 62 nt, hsa
uuuugugacucuuguacagcuuaaugugcaauaaaggaaaaguuauaucugucuucaguguu

SEQ ID NO: 292245 - RNA, 62 nt, hsa
uaauuaggcuuuauuaucuuccuaaaucaaggaaaggaaaucauccccagaccauuuaugcu

SEQ ID NO: 292246 - RNA, 62 nt, hsa
uauuaguugauucacaguacagaacaagguauaaaggaaaaaacccugcuagguaguguuau

SEQ ID NO: 292247 - RNA, 62 nt, hsa
cagucccccaaccccagccgcucggaggccccaaaggaaaaagcacaagaagcgugagacgc

SEQ ID NO: 292248 - RNA, 62 nt, hsa
ucauucucguagcuuuuuaaaaaaaugaaaguaaaggaaaaaaaaaaaacugcaaaucuaga

SEQ ID NO: 292249 - RNA, 62 nt, hsa
gcaacacaagaauauuucacuuagauaugaagaaaggaaacacuagucuccauucacuugaa

SEQ ID NO: 292250 - RNA, 62 nt, hsa
gauuuuauucuuagaaauccagaaucccuugaaaaggaaauauuuucuguuucuuauaaaua

SEQ ID NO: 292251 - RNA, 62 nt, hsa
ccucguuuuucuuuuguuugcauuuucugcaaaaaggaaaaagaaaccacaaauuggggaaa

SEQ ID NO: 292252 - RNA, 62 nt, hsa
ugggaagagaggagagggagaaaaauaaaaugaaaggaaaaaaaaaaguuugcaaauucaga

SEQ ID NO: 292253 - RNA, 62 nt, hsa
ugcaguugaauggaaaauuacucaguguauagaaaggaaaaaaaccagaaauuuaaaauaga

SEQ ID NO: 292254 - RNA, 62 nt, hsa
aauaacauaagucugaaagcaaugaaaacgucaaaggaaaauguuuauauacauccacaugu

SEQ ID NO: 292255 - RNA, 62 nt, hsa
cauaagugcugucaguauaaaguuguggggauaaaggaaacuggauauuuuuagcacgaugu

SEQ ID NO: 292256 - RNA, 62 nt, hsa
uucuuuuuucuaaaaaaagaaaaaaaagaaaaaaaggaaaagaagaacaaagaaacaugacu

SEQ ID NO: 292257 - RNA, 62 nt, hsa
gcauggagaaaacccgguacgcucaaaaagaaaaaggaaaaaaaaaaaucccaucacccaca

SEQ ID NO: 292258 - RNA, 62 nt, hsa
uuuggacauuuuaauuguuuaaaaauuguacaaaaggaaaaaauuagaauaaguacuggcga

SEQ ID NO: 292259 - RNA, 62 nt, hsa
gccgaugggggcaguggcguuaagugguggaaaaaggaaaguauauauguuagaguuuugaa

SEQ ID NO: 292260 - RNA, 62 nt, hsa
cagcuugggcaacagagcaagauccugucucaaaaggaaaaagaaaacaggaccuagguguu

SEQ ID NO: 292261 - RNA, 62 nt, hsa
aucauucaguuggauuuucccaaugaagaggaaaaggaaaguaguuauuccuagcuccauuu

SEQ ID NO: 292262 - RNA, 62 nt, hsa
gucauucaguaauuuccuacaagcagcaccccaaaggaaauauaguccuaaucuuuacuauc

SEQ ID NO: 292263 - RNA, 62 nt, hsa
aagggaaacucagaguacuaggacguuuauuaaaaggaaaaaaaugucuugcaaugugcugu

SEQ ID NO: 292264 - RNA, 62 nt, hsa
ggggaagaagcaagauacuuuaagagaaauacaaaggaaauuucuaaagcacaagaaauagu

SEQ ID NO: 292265 - RNA, 62 nt, hsa
gaccucuaaaaagcccuuuguuccuaucuucuaaaggaaaguauaucauauaugaugaugua

SEQ ID NO: 292266 - RNA, 62 nt, hsa
uuuugagauguaauuuaagauuguuuuauguaaaaggaaaaucuuguauggcaucgaauagc

SEQ ID NO: 292267 - RNA, 62 nt, hsa
cauuaauaaagaugaaauaaacuuauuacuuuaaaggaaaggauuuggagaauugaacucac

SEQ ID NO: 292268 - RNA, 62 nt, hsa
ucacgugcacaaagauuagcacacuuaaaagcaaaggaaaaaauaaaucagaacuccauaaa

SEQ ID NO: 292269 - RNA, 62 nt, hsa
uuuaggaaauuacauuaaguauuaaugaggggaaaggaaaugagcucuacgaggauuucacc

SEQ ID NO: 292270 - RNA, 62 nt, hsa
ccccacccccaucacagggcuuucaguuuggcaaaggaaaagcagauaaaaacagaacauuc

SEQ ID NO: 292271 - RNA, 62 nt, hsa
accucagggagagcaccuguccaggucugccuaaaggaaauggcuccagugggucuaaacaa

SEQ ID NO: 292272 - RNA, 62 nt, hsa
auuguaaauauguuuuuuagaucaaauacuuuaaaggaaaaaauguuggauuuauaaaugcu

SEQ ID NO: 292273 - RNA, 62 nt, hsa
uaaaugcuauuuuuuauuuuacuuuuauaauaaaaggaaaagcaaauugaugaccucaccuu

SEQ ID NO: 292274 - RNA, 62 nt, hsa
agcaagcaugaauuuuucacccaagagugaaaaaaggaaaaucuaccauggcuugaaguuaa

SEQ ID NO: 292275 - RNA, 62 nt, hsa
uggcagguacuaugaauguaauucauaauuuaaaaggaaaacuaaaaacuauuuugauuugg

SEQ ID NO: 292276 - RNA, 62 nt, hsa
uaucacacugauguguucaacuguuuaugggaaaaggaaacuaggaugguuuuauuugugaa

SEQ ID NO: 292277 - RNA, 62 nt, hsa
cgcagagcagagugcugaguaaagaugucagaaaaggaaagcaauggucugguacaagucuu

SEQ ID NO: 292278 - RNA, 62 nt, hsa
cuuuggguaccaaaccaaaaagaagaaaaaagaaaggaaaagaucuucuuugaagaaaagua

SEQ ID NO: 292279 - RNA, 62 nt, hsa
ccuccuugagccaaugcacugaacugccuuugaaaggaaauugcauguucugaccauuuuag

SEQ ID NO: 292280 - RNA, 62 nt, hsa
guuuggcaguaauugucuguuuaaaaaaauaaaaaggaaaggaagcguucaccgccacaaau

SEQ ID NO: 292281 - RNA, 62 nt, hsa
cuauugggguaugauguuugggucaguugauaaaaggaaaccuuuucaugccuuuagaugug

SEQ ID NO: 292282 - RNA, 62 nt, hsa
uauauauauauauauauauauauauaaauuaaaaaggaaagaaaacuaacaaccaaccaacc

SEQ ID NO: 292283 - RNA, 62 nt, hsa
ccuagaacuucaaaauguucguauucuauucaaaaggaaauauauauauauauauauauaua

SEQ ID NO: 292284 - RNA, 62 nt, hsa
gaaaguuuaaagagggggaagaguugguuugcaaaggaaaaguuuaaauagcuuaauaucaa

SEQ ID NO: 292285 - RNA, 62 nt, hsa
ggaugagaaguaagcaaacuguggaaacaugcaaaggaaaaagugauagaauaauauucaag

SEQ ID NO: 292286 - RNA, 62 nt, hsa
agauauguuuuauauuguuauuuauugugacaaaaggaaauaaaaagccuaaauguucagaa

SEQ ID NO: 292287 - RNA, 62 nt, hsa
cuacugacaaaguaugccaucaugcaagcugcaaaggaaacauuucaagagucuauaucuau

SEQ ID NO: 292288 - RNA, 62 nt, hsa
uaucuguaacaucagagcugucuggccuuuggaaaggaaaaauuauggacucuguuaagaaa

SEQ ID NO: 292289 - RNA, 62 nt, hsa
ccaagauaggccuucacaccuucacaggugcgaaaggaaaggccuucacacccucacagagg

SEQ ID NO: 292290 - RNA, 62 nt, hsa
uacuauagcuuauuuucaaacaagggguaaaaaaaggaaagaaagaaguguacagaauuaac

SEQ ID NO: 292291 - RNA, 62 nt, hsa
gaccuguuaggcugagcucaggaauuguccaaaaaggaaaaagcaaaauaauuaauugagag

SEQ ID NO: 292292 - RNA, 62 nt, hsa
cugaguccagauuucucaucaacuggcaauacaaaggaaaauaugguacaggaguuaguuag

SEQ ID NO: 292293 - RNA, 62 nt, hsa
aaaaugacuguuuucucucucuauggaaauaaaaaggaaaaaaaaaaaggaaacuuuuuuug

SEQ ID NO: 292294 - RNA, 62 nt, hsa
ucucucucuauggaaauaaaaaggaaaaaaaaaaaggaaacuuuuuuuguuugcucuugcau

SEQ ID NO: 292295 - RNA, 62 nt, hsa
auuggcaagacauguauuuaaacaauaaacuaaaaggaaauaaucuccacguacuaccaucu

SEQ ID NO: 292296 - RNA, 62 nt, hsa
uucuucaaaggcuuguuaaaccaaucauguuaaaaggaaauucuugguuuugguuuguuguu

SEQ ID NO: 292297 - RNA, 62 nt, hsa
gugauugguugguuuguagcacuaaggucuaaaaaggaaaaccauaaaagacaucagauuac

SEQ ID NO: 292298 - RNA, 62 nt, hsa
agggaggaugggauuaguggaagcuuaauggaaaaggaaaguuaugauccuccaagacccuu

SEQ ID NO: 292299 - RNA, 62 nt, hsa
uaaaaaaaccuaaggaagaauaauaauauaagaaaggaaauuuaaaaacauuccacaagaag

SEQ ID NO: 292300 - RNA, 62 nt, hsa
uaauccuccuucaaaaaauaaaaauaaaagaaaaaggaaaaucauucaggaagaaaugaccu

SEQ ID NO: 292301 - RNA, 62 nt, hsa
uuuaggaaauauacgaagagucaucaacuuggaaaggaaacaaagagugcuuuugggcaucc

SEQ ID NO: 292302 - RNA, 62 nt, hsa
gauacuuuaaaagccaaggugcccauauggaaaaaggaaauauacgaagagucaucaacuug

SEQ ID NO: 292303 - RNA, 62 nt, hsa
ugcugcuuccuauuggagcccagaaaaaaggaaaaggaaaguuuaggcuuucuuuguccuuu

SEQ ID NO: 292304 - RNA, 62 nt, hsa
uguaaaugcugcuuccuauuggagcccagaaaaaaggaaaaggaaaguuuaggcuuucuuug

SEQ ID NO: 292305 - RNA, 62 nt, hsa
ccuauguacccacaaaaauuuuuuaauuaaaaaaaggaaauuugaguuuaaauagaaacaug

SEQ ID NO: 292306 - RNA, 62 nt, hsa
cauacccuucucuucaagaaauuuguguucacaaaggaaaaaugcaugaagggauggauacc

SEQ ID NO: 292307 - RNA, 62 nt, hsa
aagaaccagaaaaauaauuaaucucucuggaaaaaggaaagcuaaagaagacuaugauacca

SEQ ID NO: 292308 - RNA, 62 nt, hsa
uaacuugaaggcagcacagaggugagggauuaaaaggaaaggcagauuuugaaaucugacuc

SEQ ID NO: 292309 - RNA, 62 nt, hsa
gcauccuuaagauuuaaaaaaaaaaaaaaaaaaaaggaaaaaaaagugauggaagccguaag

SEQ ID NO: 292310 - RNA, 62 nt, hsa
cuugucuauuuuuucucuucauguuguaacaaaaaggaaaaaagaaaaaaaaaucccauccc

SEQ ID NO: 292311 - RNA, 62 nt, hsa
gcaaaauuugaaauaauuucaccaggcuaaauaaaggaaaauggaaaccaguuaagaggcac

SEQ ID NO: 292312 - RNA, 62 nt, hsa
caaaccaaagguaaccagcuagcccaccacugaaaggaaagaucugagacaugggauuccca

SEQ ID NO: 292313 - RNA, 62 nt, hsa
ugcaaguaaaucuuaucguuaguucuucuucaaaaggaaauugcaucuugugacuuaguaga

SEQ ID NO: 292314 - RNA, 62 nt, hsa
uccagaagcugcagcaagagguacagcucaacaaaggaaaaccacaggacuggauaugcaac

SEQ ID NO: 292315 - RNA, 62 nt, hsa
cagaauauucuuuuuauauucuguggaaaaauaaaggaaauucagauuguuuaaaugccuaa

SEQ ID NO: 292316 - RNA, 62 nt, hsa
aaaguuuugagauaaguuuuguuucaauuagaaaaggaaauagguuuuagguggcauagugg

SEQ ID NO: 292317 - RNA, 62 nt, hsa
uucuauuuugugaagggacuauauuuuuugagaaaggaaaaucucaguuagauauauuuugu

SEQ ID NO: 292318 - RNA, 62 nt, hsa
auuuuuauuuccuguaguaggcuugcuggagcaaaggaaaugugcugcuaaaaaucaacuua

SEQ ID NO: 292319 - RNA, 62 nt, hsa
ccgucccuuaaaaagacaaaaaaaauaaggcaaaaggaaagcaacuaagacacuggacuauc

SEQ ID NO: 292320 - RNA, 62 nt, hsa
uaaauaccuggcaaaacuaaauaaauuaccaaaaaggaaaaaaaauccaccaaaccaugaua

SEQ ID NO: 292321 - RNA, 62 nt, hsa
aaagaaaugcauucauaucaaaauuggaauagaaaggaaaaccuauuuuuaagauaucaacc

SEQ ID NO: 292322 - RNA, 62 nt, hsa
ucugucauaaauuauuuccccgguaauuuuugaaaggaaaaauguauaacaaguacuauuua

SEQ ID NO: 292323 - RNA, 62 nt, hsa
gguguuuguuuccauccccaaggcaaacaaggaaaggaaaggaaagaagaaaaggugccuua

SEQ ID NO: 292324 - RNA, 62 nt, hsa
uuguuuccauccccaaggcaaacaaggaaaggaaaggaaagaagaaaaggugccuuaguccu

SEQ ID NO: 292325 - RNA, 62 nt, hsa
caauuccucagaaacaacuuuuuucacaacggaaaggaaagaacacuaguguucuuucagua

SEQ ID NO: 292326 - RNA, 62 nt, hsa
gcugugagaauucuccuuugagauuucagaagaaaggaaacaaugugauucaagauauuuac

SEQ ID NO: 292327 - RNA, 62 nt, hsa
agggguuguuguguaguugcauuggaagagagaaaggaaacacacucuuucauugcugaauu

SEQ ID NO: 292328 - RNA, 62 nt, hsa
aaggacaaagauguaaaaaugccaaauuugggaaaggaaauuuuguaugaccacuguucuau

SEQ ID NO: 292329 - RNA, 62 nt, hsa
uaucuuuaaguguuuuuuugacacauuaaaauaaaggaaauaaggaaauuguaagcuuuauu

SEQ ID NO: 292330 - RNA, 62 nt, hsa
guuuuuggauauaaagcuaauaagcacuuuaaaaaggaaaaggcagccuuuacuauuuuuuc

SEQ ID NO: 292331 - RNA, 62 nt, hsa
aggguaaaaaaaaauugauucaauuuuaugguaaaggaaacccaugcaauuuuaccuagaca

SEQ ID NO: 292332 - RNA, 62 nt, hsa
uacaaaucaaacaauuuaaauauuuuaagaaaaaaggaaaaguagauagugauacugagggu

SEQ ID NO: 292333 - RNA, 62 nt, hsa
auuuaugagugauugcucuacauuauuucuucaaaggaaaggaaaggaauugaagacuuugc

SEQ ID NO: 292334 - RNA, 62 nt, hsa
ugagugauugcucuacauuauuucuucaaaggaaaggaaaggaauugaagacuuugcuacuc

SEQ ID NO: 292335 - RNA, 62 nt, hsa
ugucauugguauaugguggcuguuuaccaauaaaaggaaaaaauucauuaaccgguugcuuc

SEQ ID NO: 292336 - RNA, 62 nt, hsa
uuccuugucucaugaaaaccuaaauauaaaaaaaaggaaaauacuggaguuuuuauuucucu

SEQ ID NO: 292337 - RNA, 62 nt, hsa
gacaguuauuccauaaagcauuuguauaauuaaaaggaaaacagaaaaaggaaaaguaggca

SEQ ID NO: 292338 - RNA, 62 nt, hsa
aaagcauuuguauaauuaaaaggaaaacagaaaaaggaaaaguaggcaaaugugaaaauagu

SEQ ID NO: 292339 - RNA, 62 nt, hsa
gcagagcuauagauagaaacagcuggaaaacuaaaggaaaaauacaaguguuuucggggcau

SEQ ID NO: 292340 - RNA, 62 nt, hsa
cuuucccucuccccgcugccaaaaaaaaaaaaaaaggaaacguuuaucaugaaucaacaggg

SEQ ID NO: 292341 - RNA, 62 nt, hsa
ccauuucuguuaaccucuuaucacuaagaaagaaaggaaagaaggagaugaauagaagaaag

SEQ ID NO: 292342 - RNA, 62 nt, hsa
uaaaccacagucuggagugauagcuacuguagaaaggaaauagacuuuguaugaacucuuua

SEQ ID NO: 292343 - RNA, 62 nt, hsa
gugcugaguuagacuccagguacuuuguggucaaaggaaaucgccuagcuccaggcuguguu

SEQ ID NO: 292344 - RNA, 62 nt, hsa
ucuagaaagccacuguuuuauagcaaaacaggaaaggaaaagcuaccaguuuuuuauucaga

SEQ ID NO: 292345 - RNA, 62 nt, hsa
uuuaaaacuugaauauaggugggagacauaagaaaggaaagaaaagacuuaaaacuggagug

SEQ ID NO: 292346 - RNA, 60 nt, hsa
uggagauguaugauauuugagaguccuggaaaaggaaaauucuucugcuugucugcaaau

SEQ ID NO: 292347 - RNA, 62 nt, hsa
uuuaaaaaucuaccuguuccugacuuaaaacaaaaggaaagaaacuaccuuuuuauaaugca

SEQ ID NO: 292348 - RNA, 62 nt, hsa
agguauuguaagcuuuccauuuucuauaagaaaaaggaaaaguugaggggggggcauuagug

SEQ ID NO: 292349 - RNA, 62 nt, hsa
uaaacagucuucauuuuuaaguaacugauuuaaaaggaaaauaauaaaauauguucguuuau

SEQ ID NO: 292350 - RNA, 62 nt, hsa
aagaaaagaaaagaaaucauagggccaaguucaaaggaaaugcacagaacauaucuucacau

SEQ ID NO: 292351 - RNA, 62 nt, hsa
aguaagugcuauuggcauuccaaaauucagcuaaaggaaaaaugaucaaaaacaaaguaagg

SEQ ID NO: 292352 - RNA, 62 nt, hsa
uaugauuugcacuauuaguacaguauaguuagaaaggaaagcugaacacuauaaaacuauua

SEQ ID NO: 292353 - RNA, 62 nt, hsa
agaggagagucuuacggagggcugggagcuuaaaaggaaaacaauguccuuacuuguaaaca

SEQ ID NO: 292354 - RNA, 62 nt, hsa
cgacuucuguuucacaguucagaccggucuucaaaggaaaagccuguccgauuuuuccaugg

SEQ ID NO: 292355 - RNA, 62 nt, hsa
cagaaaagcaaagucaguguacacucugagugaaaggaaauguaauguggauaaaggcccgc

SEQ ID NO: 292356 - RNA, 62 nt, hsa
uuaugauaccaaaaaaauuacaguuuuguuuaaaaggaaauguugauguuuucaacuccaaa

SEQ ID NO: 292357 - RNA, 62 nt, hsa
gcugaaaucuauucucauucuuguuugucaagaaaggaaaaucuguuauucaagguaaauua

SEQ ID NO: 292358 - RNA, 62 nt, hsa
ccaucuuaguuuuguuaaaaaaaaaaaaaaaaaaaggaaacagccucacuuuuuugugcucc

SEQ ID NO: 292359 - RNA, 62 nt, hsa
augaagauuauaacuguuuauuuaccuaauuaaaaggaaaggcagugccaaauaugagagga

SEQ ID NO: 292360 - RNA, 62 nt, hsa
uuuaauuagucaaacuaaauuaaggcucauuaaaaggaaaggaacuacugggaaauuaugca

SEQ ID NO: 292361 - RNA, 62 nt, hsa
aaaugauuaugauuaguuaugucuuuuaauaaaaaggaaauauuuuucaacuucuucuauau

SEQ ID NO: 292362 - RNA, 62 nt, hsa
cauauagccagggauugaaguuuauuauuuucaaaggaaaacaccuuuauuuuauuuuuuuu

SEQ ID NO: 292363 - RNA, 62 nt, hsa
aauaugaauauauaucauguguuaauauugagaaaggaaaaauacauucccgguguuaguag

SEQ ID NO: 292364 - RNA, 62 nt, hsa
agacaaugguccuauaaugcccuuggauaagaaaaggaaacuuuugagcugcaccuucaguu

SEQ ID NO: 292365 - RNA, 62 nt, hsa
gauagguuaggucucauuuggaguguugguggaaaggaaacugaagguaauugaauagaaua

SEQ ID NO: 292366 - RNA, 62 nt, hsa
caacaucaccuuaaagucgucaguaaaaguaaaaaggaaaaagguacacuuucagauaauuu

SEQ ID NO: 292367 - RNA, 62 nt, hsa
ugcaaucaccccugccuuuuguucaacucuauaaaggaaaaggaauguagcucaacuuguga

SEQ ID NO: 292368 - RNA, 62 nt, hsa
aacccuuucaaaaguguuuguaaaccaaguucaaaggaaaauagacagaaugauuuccaaaa

SEQ ID NO: 292369 - RNA, 62 nt, hsa
aaaagugggaaggugaugcuguucuuauuguaaaaggaaagucauuuauauuaaagaauuug

SEQ ID NO: 292370 - RNA, 62 nt, hsa
acauugcaaaauauaaaauaaauaaaaaaaggaaaggaaacuuugaaccuuauguaccgagc

SEQ ID NO: 292371 - RNA, 62 nt, hsa
aaaaaacauugcaaaauauaaaauaaauaaaaaaaggaaaggaaacuuugaaccuuauguac

SEQ ID NO: 292372 - RNA, 62 nt, hsa
ugucauucaggguuuccugacugcuaaugcagaaaggaaaaucguaaaggaaacagaaagau

SEQ ID NO: 292373 - RNA, 62 nt, hsa
uuccugacugcuaaugcagaaaggaaaaucguaaaggaaacagaaagaugaaauaagccauu

SEQ ID NO: 292374 - RNA, 57 nt, hsa
agaucccacuggauggguagcugaaauaaaggaaaagacagagaaaggggcuguggu

SEQ ID NO: 292375 - RNA, 62 nt, hsa
uuaagaacuauuuuaaaguguuccagacccaaaaaggaaaaauaaaaaaaaaggaauauuug

SEQ ID NO: 292376 - RNA, 62 nt, hsa
agcaauccugcugcuggguauauacccgaaagaaaggaaaaggaagccaguauauugaagag

SEQ ID NO: 292377 - RNA, 62 nt, hsa
uagagaguagaagguugguuaccagaagcuggaaaggaaagugggguugggaggaagguggg

SEQ ID NO: 292378 - RNA, 62 nt, hsa
aaagaaagaaaaagaaagaaagaaagaaagagaaaggaaauuauaaggucaaguuaacaguu

SEQ ID NO: 292379 - RNA, 62 nt, hsa
acagauagagauaauagaagacaaagagauuaaaaggaaauaaaaaugcaugauuaaaaacu

SEQ ID NO: 292380 - RNA, 62 nt, hsa
cuaagaauaaaaaaccuauuuuuauguuuccuaaaggaaauuguuuauucuacagccucagu

SEQ ID NO: 292381 - RNA, 62 nt, hsa
agaaaaaaugaaaaaaaaaggaaaaaaagaaaaaaggaaaaaaacaguuugaacacaaaggc

SEQ ID NO: 292382 - RNA, 62 nt, hsa
uugaaaucuuaaaaaaagaaaaaaugaaaaaaaaaggaaaaaaagaaaaaaggaaaaaaaca

SEQ ID NO: 292383 - RNA, 62 nt, hsa
gaggaagacuggacaaaacaacacaaaggcagaaaggaaagaaacugaagaaagaagauaau

SEQ ID NO: 292384 - RNA, 62 nt, hsa
uaguuuaagaaauuuuuuuuuuaaauaaaaaaaaaggaaaagaggaagacuggacaaaacaa

SEQ ID NO: 292385 - RNA, 62 nt, hsa
ucacaucagcauucacuuccguuaaauuugccaaaggaaacuguuaauauguuucuguuguu

SEQ ID NO: 292386 - RNA, 62 nt, hsa
gcauccuucuugcuuauacguuaaguuacauaaaaggaaaacaaaauuauguggugugaaac

SEQ ID NO: 292387 - RNA, 62 nt, hsa
cucugcuuuucugucaacaucccauuuuggggaaaggaaaagucauauuuauuccugcaccc

SEQ ID NO: 292388 - RNA, 62 nt, hsa
cuaacaacacugauaauaggaaguaaaaacagaaaggaaaagaaauuaccacugggaaaauc

SEQ ID NO: 292389 - RNA, 62 nt, hsa
ccaggggauuucuccuccaaguccuaccacacaaaggaaagucucaagccucuauucacccc

SEQ ID NO: 292390 - RNA, 62 nt, hsa
aaugcaguuuggccucuuuuuuuuuuuuuuuuaaaggaaaucccaaucuuauuauggaaagc

SEQ ID NO: 292391 - RNA, 62 nt, hsa
uaccaggcacuuaaagccuuuuccugaauuggaaaggaaaagaggcccaagugcaaaagaaa

SEQ ID NO: 292392 - RNA, 62 nt, hsa
aauacagucuaguuuccugguuccguuuuagaaaaggaaaacgugaacaaacuuagaaaggg

SEQ ID NO: 292393 - RNA, 62 nt, hsa
agugacaccacacauuuaauucagcuuuguccaaaggaaagcuuaaaacccaauacagucua

SEQ ID NO: 292394 - RNA, 62 nt, hsa
gaagugcuaucuaaugcagugauaccaaaaaaaaaggaaauaaaaugcacauaaauuuggaa

SEQ ID NO: 292395 - RNA, 62 nt, hsa
cuaauaccaaagccaggcaaaaacauuacaagaaaggaaaacuacagaucaauauuuccagu

SEQ ID NO: 292396 - RNA, 62 nt, hsa
aaaaaauaucauuugacuuuuuauagaaaaaaaaaggaaaaaauaauugagaaaguguucau

SEQ ID NO: 292397 - RNA, 62 nt, hsa
gacacccgcgcguggggaggacucgggccacgaaaggaaagaaauguauaccguaucuaucu

SEQ ID NO: 292398 - RNA, 62 nt, hsa
uaaacaggaaauuagaaguguuaggguuagauaaaggaaaagugaaaaagcauaagaaauuu

SEQ ID NO: 292399 - RNA, 62 nt, hsa
cuuguuacaacaauuuaaaaauaauaauaacaaaaggaaagcaacgaaugcacuucauauag

SEQ ID NO: 292400 - RNA, 62 nt, hsa
acaugcagaauugaauuugcucaaaaaagaugaaaggaaaugcaaacuguaaauguauaaau

SEQ ID NO: 292401 - RNA, 62 nt, hsa
gaaugaagcaagggaaggcauguagggacaggaaaggaaacaauggaaggaaagugauucug

SEQ ID NO: 292402 - RNA, 62 nt, hsa
cuaauguguuguaaacaagauucuaaauuuaaaaaggaaaacaaaacaaacuuguucuuugc

SEQ ID NO: 292403 - RNA, 62 nt, hsa
uccugaggcugaugaauugugaaaauuccucaaaaggaaauuaugcuggucaucacaggaac

SEQ ID NO: 292404 - RNA, 62 nt, hsa
acccaucuggaggaaaaccagaucggacuaaaaaaggaaaaagaaaaacaaaaucuccgcag

SEQ ID NO: 292405 - RNA, 62 nt, hsa
ccacuggaugagcggugagacgaacaaaagggaaaggaaaaaaugggggugggggguggggg

SEQ ID NO: 292406 - RNA, 62 nt, hsa
caggagcugucuggagcuccaccuuugcaaagaaaggaaaaacacaaauugcccccagauug

SEQ ID NO: 292407 - RNA, 62 nt, hsa
uguucaaaagcaaaagagaaggaacaggaaugaaaggaaaccuucccuuaacucuuucugcu

SEQ ID NO: 292408 - RNA, 62 nt, hsa
aguuuauuuugcuauugugaaaaacuaaauguaaaggaaaucaccuacuuucaugcaggugu

SEQ ID NO: 292409 - RNA, 62 nt, hsa
ucaccuacuuucaugcagguguauaaucuugaaaaggaaaaaugcuuccauguugaagccag

SEQ ID NO: 292410 - RNA, 62 nt, hsa
ugaaaagaaaaggggaaugugucccacuagugaaaggaaaacuuuucaacacuaucccugcu

SEQ ID NO: 292411 - RNA, 62 nt, hsa
auucaaauuugauuguggcgaaucuacuucaaaaaggaaaaauaauccaacuuuguggauau

SEQ ID NO: 292412 - RNA, 62 nt, hsa
gugagguuuauacuauuucugguuuuuaaccaaaaggaaaucaucuggaagcaggaggcaaa

SEQ ID NO: 292413 - RNA, 62 nt, hsa
aagguugacauauuccaaaacccuucuuuuuaaaaggaaaaaggauggagagaaggauggaa

SEQ ID NO: 292414 - RNA, 62 nt, hsa
cgaagcagaggaaaagaaacguuuucagaccuaaaggaaauguuuggucauguuaagaaaac

SEQ ID NO: 292415 - RNA, 62 nt, hsa
gugggaggguaagaguuuugacaaguuguggcaaaggaaacuauacuuuucauuuuuaaaaa

SEQ ID NO: 292416 - RNA, 62 nt, hsa
uugcaaacacauggcuccaucuucugcacacgaaaggaaagucccucuccuuuucuacaguc

SEQ ID NO: 292417 - RNA, 62 nt, hsa
gaucccagggugaggagaagauugggacauagaaaggaaacugcaucagaaacaugaacaga

SEQ ID NO: 292418 - RNA, 62 nt, hsa
cauggguguggcauucucuaacaaaugaugugaaaggaaaguaguuuucauaaaacucaugg

SEQ ID NO: 292419 - RNA, 62 nt, hsa
agccaaucuuuuauuguuccuuugcuacuuugaaaggaaaaaaaagguugucucuugauuuc

SEQ ID NO: 292420 - RNA, 62 nt, hsa
ggagaaaauagagaacaugauagcaaaaucuaaaaggaaaaucaaaacuaauaaaauugcug

SEQ ID NO: 292421 - RNA, 62 nt, hsa
gagaaaggagugagaaggaagaaacaaugcgcaaaggaaagcagucuuucagaaucugucag

SEQ ID NO: 292422 - RNA, 60 nt, hsa
uuuucacuuugcucucaauuaaagucuauucaaaaggaaaguggcaagauuccaucagcu

SEQ ID NO: 292423 - RNA, 62 nt, hsa
uucaagucugacucuccacuccuccucacuaaaaaggaaacuucaguugaucuucuucaucc

SEQ ID NO: 292424 - RNA, 62 nt, hsa
agugguugggaaacucauuuacuggguccaccaaaggaaacccaauucugccauguuuuugc

SEQ ID NO: 292425 - RNA, 62 nt, hsa
gguaacugaugauauaaacaagcuuucuuuaaaaaggaaaaaaaugcguauauuucuauguu

SEQ ID NO: 292426 - RNA, 62 nt, hsa
gaacuacauuuuucuuauugccuugaaaguuaaaaggaaagcagauuucuucagugacuuug

SEQ ID NO: 292427 - RNA, 62 nt, hsa
uucuuacauauacaucuuaguugauuauuaaaaaaggaaaaauaugguuuccagagaaaagg

SEQ ID NO: 292428 - RNA, 62 nt, hsa
auaguaucacuucuauucuuuuuguuaaaggaaaaggaaauguccccaaaguauuaaagaau

SEQ ID NO: 292429 - RNA, 62 nt, hsa
caguauauaguaucacuucuauucuuuuuguuaaaggaaaaggaaauguccccaaaguauua

SEQ ID NO: 292430 - RNA, 62 nt, hsa
uaaaagcugaaaauuuagaagcaagaugaaaaaaaggaaaagcaggugcuuuuuaaaaauca

SEQ ID NO: 292431 - RNA, 62 nt, hsa
uuaauuccagaagagaggaaugacuugaaggcaaaggaaacuaaggaaggagguucagugag

SEQ ID NO: 292432 - RNA, 62 nt, hsa
guugcagcuguaaucaauugugcgcaguugggaaaggaaagccaggacuuguggggugggug

SEQ ID NO: 292433 - RNA, 62 nt, hsa
guuaaacaaacaaaaaaaaauuuuaaacaaagaaaggaaaaaaauugacaauaaaagucacu

SEQ ID NO: 292434 - RNA, 62 nt, hsa
auacacuuuacuaaucaugaaauucuaaccuaaaaggaaaacauuuuccugcuugucuuaga

SEQ ID NO: 292435 - RNA, 62 nt, hsa
uucaauuucuacacaauauaaauauccaguauaaaggaaagcguuaagucgguaagcuagag

SEQ ID NO: 292436 - RNA, 62 nt, hsa
uaaggcuaguguacuagauguacuuuuucuaaaaaggaaaggacagaaaaaaaugaagaaag

SEQ ID NO: 292437 - RNA, 62 nt, hsa
uucuaaaaaggaaaggacagaaaaaaaugaagaaaggaaaggaagacaaauguaaagaaaua

SEQ ID NO: 292438 - RNA, 62 nt, hsa
cuuguuccagcccggaguuuugggaaagaaagaaaggaaaggucacagugaccuaggauugg

SEQ ID NO: 292439 - RNA, 62 nt, hsa
cugauuuaccgauguauuuaauguaaguaaaaaaaggaaaaaaagaaaagggcauuggagug

SEQ ID NO: 292440 - RNA, 62 nt, hsa
aucuagggucuguaaccguuuugguuugagaaaaaggaaaggccccuugucacauccucuaa

SEQ ID NO: 292441 - RNA, 62 nt, hsa
auauuuuagugggagccagacuauaaggaauaaaaggaaaaacuuucuuccucucucuccaa

SEQ ID NO: 292442 - RNA, 62 nt, hsa
acagagguuacauauucuggguguucuuuuauaaaggaaacauuuuaaaucccacaaauuga

SEQ ID NO: 292443 - RNA, 62 nt, hsa
guaugauccuuacuacuggaauuaccggguuaaaaggaaaugcuuaccacuaagaugucagu

SEQ ID NO: 292444 - RNA, 62 nt, hsa
agcugccaguuuacacauuucucaguauccugaaaggaaaaaaguauagccccacuuauacu

SEQ ID NO: 292445 - RNA, 62 nt, hsa
aaaaaagauaaaguagaaaaagaaaaaagugaaaaggaaacaacuagcaaaaagaauagcca

SEQ ID NO: 292446 - RNA, 62 nt, hsa
uaagugucuaaacuaagguuuagugcuuuuuuaaaggaaaguugucccaggauucauccuaa

SEQ ID NO: 292447 - RNA, 62 nt, hsa
gaacagacaaguggaagggcuguaccagggauaaaggaaagaagugccuguccagcagggag

SEQ ID NO: 292448 - RNA, 62 nt, hsa
uuaugaaaaucuaacacucaagauaguuucuaaaaggaaaucaguaguuaaggauaccugau

SEQ ID NO: 292449 - RNA, 62 nt, hsa
uaagacauuucugaauguagaccauuuuccaaaaaggaaacuuuauuuucaaaaaccuaauc

SEQ ID NO: 292450 - RNA, 62 nt, hsa
aaaauauugcagugcuauuuuuucuuaaucagaaaggaaaauucucaaggccuuuugaagag

SEQ ID NO: 292451 - RNA, 62 nt, hsa
caagagacuuccauguccugguuauuaacaaaaaaggaaaaauguaauaauugauaugauuu

SEQ ID NO: 292452 - RNA, 62 nt, hsa
agaucagucacccaugugaauaagaagccaggaaaggaaagauggggaagcccagaucacca

SEQ ID NO: 292453 - RNA, 62 nt, hsa
gugacaaaugaacagcaggauuaugaauuaucaaaggaaaaaguauuugcugaggugaaaaa

SEQ ID NO: 292454 - RNA, 62 nt, hsa
uaauagaauacuaguaggauagaaacaacuagaaaggaaagugugacacaguuuuuaaauuu

SEQ ID NO: 292455 - RNA, 62 nt, hsa
auguagaaaauaaugaauuaaugagauuggugaaaggaaaucaugcaaaacauuugaaugca

SEQ ID NO: 292456 - RNA, 62 nt, hsa
auaaaccuuuugcccccauaauuucuuuuuuuaaaggaaauuaauauuaguaaaauaaacac

SEQ ID NO: 292457 - RNA, 62 nt, hsa
uuauucaguguugcgguagcagaugcauuaucaaaggaaaaauauuuggcuccuuuaauucc

SEQ ID NO: 292458 - RNA, 62 nt, hsa
uggaauuuuuuucaguggagugguuuucgcuuaaaggaaaaaaaaaucuaaaacugcgaaga

SEQ ID NO: 292459 - RNA, 62 nt, hsa
auuggaauuuauauuaaaagacaaguuauuaaaaaggaaagguucuauucauaaucagggua

SEQ ID NO: 292460 - RNA, 62 nt, hsa
uuucauaaauuuuauggcaugucuucuauuuaaaaggaaaagaauaaguauucuugcaucug

SEQ ID NO: 292461 - RNA, 62 nt, hsa
guuuugaauuggaauugcaccauuucguagauaaaggaaacuaaguauauugcugcacuuuu

SEQ ID NO: 292462 - RNA, 62 nt, hsa
uguuuaaguugaaagcaagagucccugaguauaaaggaaaaacagcaaaacaaaaagcaaac

SEQ ID NO: 292463 - RNA, 62 nt, hsa
aacauuuuugucauauucuuguauucaaagaaaaaggaaaaaagauuauuguaaauauuuua

SEQ ID NO: 292464 - RNA, 62 nt, hsa
aaagacaaacuaaaacaaaacagaacaaaagcaaaggaaaaugcuuuagaaauuuuaacucc

SEQ ID NO: 292465 - RNA, 62 nt, hsa
guuucacugugaauagugaauguaaaggaaagaaaggaaaaacugaaagcuuguucuaucac

SEQ ID NO: 292466 - RNA, 62 nt, hsa
caugcaccuguuucacugugaauagugaauguaaaggaaagaaaggaaaaacugaaagcuug

SEQ ID NO: 292467 - RNA, 62 nt, hsa
gaaagaaacuguauuucagaguaaaaucuccuaaaggaaauaaaaacacagaguuguaaaua

SEQ ID NO: 292468 - RNA, 62 nt, hsa
aaauugauuauacaggcuaugaaaaccauuuuaaaggaaagaaaauauguaaauucuauuga

SEQ ID NO: 292469 - RNA, 62 nt, hsa
aagccccaaggacacaaaacauuuucccauuuaaaggaaaacacucuaguuuugcaaguaua

SEQ ID NO: 292470 - RNA, 62 nt, hsa
uucagcauuuuuagggaccuaggugcaagugcaaaggaaauuucccuguuucaaaaucuauu

SEQ ID NO: 292471 - RNA, 62 nt, hsa
gacauugaaagcgacauaaauagucacuuuaaaaaggaaaugauucuggaugguucuuugac

SEQ ID NO: 292472 - RNA, 62 nt, hsa
auaacuuuaauuaggaucauaugaccauugaaaaaggaaaaauguagacucugacuuccguc

SEQ ID NO: 292473 - RNA, 62 nt, hsa
caguggguuaauuauaccccaugauaccuauuaaaggaaaaccagugggucugguggugcug

SEQ ID NO: 292474 - RNA, 62 nt, hsa
ggagaaggaaaucauaaugaugucaugugaucaaaggaaaccauggaaggguucacgcugau

SEQ ID NO: 292475 - RNA, 62 nt, hsa
aaauguaaugaauuuuaucagauauccaaaguaaaggaaauguuuuaaaacugcaacaagag

SEQ ID NO: 292476 - RNA, 62 nt, hsa
acuaauaguaugcuguuaauuguguaagaaagaaaggaaauuagaaaacauauuugcauaaa

SEQ ID NO: 292477 - RNA, 62 nt, hsa
agucugugaaaaaaaacaaaaguaaaguuauaaaaggaaaagaaaacagaggcuuuaaauua

SEQ ID NO: 292478 - RNA, 62 nt, hsa
acgccuagcaguuucugguuccuuuaacagcaaaaggaaagagagguucugauucuuaccuc

SEQ ID NO: 292479 - RNA, 62 nt, hsa
agcaucuccuugccuguuuucuuuauuaguccaaaggaaaacaacagcaacaaaaucuguuu

SEQ ID NO: 292480 - RNA, 62 nt, hsa
auauuuauggacuuugaguaucuagcaaguagaaaggaaaaaaauauucaucauacucuaau

SEQ ID NO: 292481 - RNA, 62 nt, hsa
aguaacaaaaugagacccuaucucaaaaacaaaaaggaaaagaaaauauacaugaugggauu

SEQ ID NO: 292482 - RNA, 62 nt, hsa
gccacuugauccucaacauauacuauaauugcaaaggaaacaugaggccaucuucccuuguu

SEQ ID NO: 292483 - RNA, 62 nt, hsa
aagugaccuuaacuguauuuauucucaaagggaaaggaaauaucagauguuuauuugguuau

SEQ ID NO: 292484 - RNA, 62 nt, hsa
gguuuuaguugagucuucacauuuagaauuugaaaggaaaaacagaacauuucucaugugcu

SEQ ID NO: 292485 - RNA, 62 nt, hsa
agaacauuucucaugugcuuuguagcuuaaaaaaaggaaaacucaccauuucauccauauuu

SEQ ID NO: 292486 - RNA, 62 nt, hsa
cggguuagugguaguauuauuguuauuuuuuuaaaggaaacaaacagacaacaaaaagaaga

SEQ ID NO: 292487 - RNA, 62 nt, hsa
uuacccccccacuaugcccucauuuuuuuaaaaaaggaaaaaaaaaagaaacuggguuccag

SEQ ID NO: 292488 - RNA, 62 nt, hsa
auaaaaaaauaaauaaaaauaaaaaaaauaaaaaaggaaaaaaaaaaaagaagaaacaagac

SEQ ID NO: 292489 - RNA, 62 nt, hsa
gaccauggccuguuaggaggcguccugucuguaaaggaaauucaucucuugugacagccugg

SEQ ID NO: 292490 - RNA, 62 nt, hsa
aaaaguggucccgcuaccauuggggaaucaggaaaggaaagacugagaugguugccaggacu

SEQ ID NO: 292491 - RNA, 62 nt, hsa
uugaaaagaugaaaaauaaagauuuauuuaaaaaaggaaaaagguaugaguacauuuuuaau

SEQ ID NO: 292492 - RNA, 62 nt, hsa
gaaauuuaagucuucacugagggccacuuuacaaaggaaauuugaauaaauggagagagaga

SEQ ID NO: 292493 - RNA, 62 nt, hsa
gcuggggcuauauauacuggaaguugaagguuaaaggaaaagcacaagaaacuuuggaagca

SEQ ID NO: 292494 - RNA, 62 nt, hsa
ucccuuuauaaagagugcuacaugguuuagauaaaggaaacauauaacuauugaguuacagg

SEQ ID NO: 292495 - RNA, 62 nt, hsa
aaccugggauaauucuuuacuuuuuuugaaauaaaggaaaggaaauucagacucuuacauug

SEQ ID NO: 292496 - RNA, 62 nt, hsa
gggauaauucuuuacuuuuuuugaaauaaaggaaaggaaauucagacucuuacauuguucuc

SEQ ID NO: 292497 - RNA, 62 nt, hsa
agaaggcauuuaauccaguaucucuaguguacaaaggaaacuugaaguuuuaauggauuauu

SEQ ID NO: 292498 - RNA, 62 nt, hsa
uauagcauaguauguuuauccauucgcccauuaaaggaaaucuugauugcuuccaguuuuca

SEQ ID NO: 292499 - RNA, 62 nt, hsa
uucuggcuccugauaggguggagcaaaaguggaaaggaaaggaaagaggccuuuucucacag

SEQ ID NO: 292500 - RNA, 62 nt, hsa
gcuccugauaggguggagcaaaaguggaaaggaaaggaaagaggccuuuucucacagccauu

SEQ ID NO: 292501 - RNA, 62 nt, hsa
cugcucacacuccagaauuaaauucuauugaaaaaggaaaaucagcaauucagcaaaaaaua

SEQ ID NO: 292502 - RNA, 62 nt, hsa
aaugacagauguucuguuuuuauaaccuaccaaaaggaaacuagaggcuucuuggugaagag

SEQ ID NO: 292503 - RNA, 62 nt, hsa
cauccuaggcaacagagugauacgcuguuuaaaaaggaaaaaauccuucccuagagcuagua

SEQ ID NO: 292504 - RNA, 62 nt, hsa
agagugagacuccaucucaacagaaggaaaaaaaaggaaaauaggagaagguggaaaugggu

SEQ ID NO: 292505 - RNA, 62 nt, hsa
aaagaaaggacauugaguuuuaacagaagggaaaaggaaagaagaaaagauuuuugcagaau

SEQ ID NO: 292506 - RNA, 62 nt, hsa
gagcagaacaaaucgucaggugccuggagcaaaaaggaaaaaaaaaaaagaaaggacauuga

SEQ ID NO: 292507 - RNA, 62 nt, hsa
aaaucugcugcugaacuuguuagacauuuuugaaaggaaaauuagguuagcguacaauuuau

SEQ ID NO: 292508 - RNA, 62 nt, hsa
uuacugcaaaguuuguuuauacuuuugccuaaaaaggaaauuggaugggauacuguggcaaa

SEQ ID NO: 292509 - RNA, 62 nt, hsa
ggcucuuuuuuuaaaagaugcgcucuaccugaaaaggaaauuggauuuuagaacuggaugug

SEQ ID NO: 292510 - RNA, 62 nt, hsa
uaaaaccucuugcuugugugcaaaaguuccuaaaaggaaacacaaguaaugccuauccauua

SEQ ID NO: 292511 - RNA, 62 nt, hsa
auagaaacuugaagugcuaaauggaauaauccaaaggaaauuuuuuaaaugcagguucuagc

SEQ ID NO: 292512 - RNA, 62 nt, hsa
guuaaaccauucugggauuugggaacuucuuuaaaggaaaauuguaguagaggucaucuuga

SEQ ID NO: 292513 - RNA, 62 nt, hsa
cauacauuucugccacauucuuaaguagcaaaaaaggaaaagugcuuuccuccucugcagga

SEQ ID NO: 292514 - RNA, 62 nt, hsa
caacaacaaaaaaacuauauuaaacaggguuuaaaggaaauuaaaacagaacuaugagaagu

SEQ ID NO: 292515 - RNA, 62 nt, hsa
aguguggggagucaugggguguggaggggaggaaaggaaagguauuuuguuucuuugucuau

SEQ ID NO: 292516 - RNA, 62 nt, hsa
ugaaagcuuuaauuuagaaagaaaguucaaguaaaggaaauuauuuugauuaaauauauuuu

SEQ ID NO: 292517 - RNA, 62 nt, hsa
uacauaauuuguaccaaaaaaaaaaaaaaaggaaaggaaagaaagggguggccugacacugg

SEQ ID NO: 292518 - RNA, 62 nt, hsa
uguuuuacauaauuuguaccaaaaaaaaaaaaaaaggaaaggaaagaaagggguggccugac

SEQ ID NO: 292519 - RNA, 62 nt, hsa
guucauacagugaauaaagaucuaucaaaggaaaaggaaacugagaccgaaaacuuaggguc

SEQ ID NO: 292520 - RNA, 62 nt, hsa
gacucuguucauacagugaauaaagaucuaucaaaggaaaaggaaacugagaccgaaaacuu

SEQ ID NO: 292521 - RNA, 62 nt, hsa
aaauacauauuguuuaaaaaaaagcaagaaaaaaaggaaaacaaaggaaaauauccccaaag

SEQ ID NO: 292522 - RNA, 62 nt, hsa
uguuuaaaaaaaagcaagaaaaaaaggaaaacaaaggaaaauauccccaaaguuguuuucua

SEQ ID NO: 292523 - RNA, 62 nt, hsa
gggaaccacuucauucugaaaauguguaaaugaaaggaaagucauuuagucugcauuuccug

SEQ ID NO: 292524 - RNA, 62 nt, hsa
augcucacaacuaagcauaggaaguuuuauuuaaaggaaagaauauguuaaugaacauauag

SEQ ID NO: 292525 - RNA, 62 nt, hsa
ucgagauuuuggaauucgugcaggaagccaugaaaggaaagaucagugaagacagcaaucac

SEQ ID NO: 292526 - RNA, 62 nt, hsa
cuuguaauuuuaugugcuuucaucacaaauccaaaggaaagaauaaaaauuucuuaacacaa

SEQ ID NO: 292527 - RNA, 62 nt, hsa
ucucagcaaacacgggacuguguucaguccacaaaggaaaagcguuuuugaagcucucauug

SEQ ID NO: 292528 - RNA, 62 nt, hsa
gcaucacuauagggggucaauauuuacacaaaaaaggaaagucacaagccuguuuaaaauga

SEQ ID NO: 292529 - RNA, 62 nt, hsa
uuaauagguugcuaauuauuuaucacugcuaaaaaggaaaaaaggcauaaaaugaccuucua

SEQ ID NO: 292530 - RNA, 62 nt, hsa
acuuuucuggcaaaaaaaaaaaaaaaagaaagaaaggaaaacaaaaagcacuuuuuucuuaa

SEQ ID NO: 292531 - RNA, 62 nt, hsa
agaugaggacaugagaauaauucaggagaacaaaaggaaacacagaacaugcaaaaggccug

SEQ ID NO: 292532 - RNA, 62 nt, hsa
ucaaauugauacccuuaauaagaaaggaaaggaaaggaaaacagauccuccccucugcuuuu

SEQ ID NO: 292533 - RNA, 62 nt, hsa
uauggucaaauugauacccuuaauaagaaaggaaaggaaaggaaaacagauccuccccucug

SEQ ID NO: 292534 - RNA, 62 nt, hsa
ugucuuauggucaaauugauacccuuaauaagaaaggaaaggaaaggaaaacagauccuccc

SEQ ID NO: 292535 - RNA, 62 nt, hsa
cugcugggucuuaacaagcauaaaaaggaaaaaaaggaaacucaggcaaagggauccauaug

SEQ ID NO: 292536 - RNA, 62 nt, hsa
cguccauuccugcugggucuuaacaagcauaaaaaggaaaaaaaggaaacucaggcaaaggg

SEQ ID NO: 292537 - RNA, 62 nt, hsa
guggcucuaggaauugggguucagcagggaccaaaggaaaggaggaggugccgggggccugg

SEQ ID NO: 292538 - RNA, 62 nt, hsa
cuugaccugguggauguggcugcaguccagagaaaggaaagauugagguggcagagcagacc

SEQ ID NO: 292539 - RNA, 62 nt, hsa
auaaauugggccagggugggagcagggaaagaaaaggaaaauaguagcaagagcugcaaagc

SEQ ID NO: 292540 - RNA, 62 nt, hsa
agacuuuaggaucacgugugugacuaauacagaaaggaaacauggcgucggggagagggaua

SEQ ID NO: 292541 - RNA, 62 nt, hsa
augcugguauuuuaacagauggagagacaaggaaaggaaaggaaaggccuggcaugggcauu

SEQ ID NO: 292542 - RNA, 62 nt, hsa
gguauuuuaacagauggagagacaaggaaaggaaaggaaaggccuggcaugggcauugugag

SEQ ID NO: 292543 - RNA, 62 nt, hsa
guauacuuacaaugugaaguaacuuaugaauaaaaggaaaaguuuaucccauauucaaauaa

SEQ ID NO: 292544 - RNA, 62 nt, hsa
uuucuuggaaagacucacuuuaccaagcauauaaaggaaaaaugauuucaaacauugacaag

SEQ ID NO: 292545 - RNA, 62 nt, hsa
uaccuuuuccauccuccuccucugccuucaaaaaaggaaacuuucccuugguugucuuaauu

SEQ ID NO: 292546 - RNA, 62 nt, hsa
guaaauggcauccccuuaggcgccucuuugggaaaggaaaguggaugcuccuuugaggcagg

SEQ ID NO: 292547 - RNA, 62 nt, hsa
cacaaagaagaaaaagaaacaguuugggaagaaaaggaaaagaaucccgcccacuaagacgc

SEQ ID NO: 292548 - RNA, 62 nt, hsa
ucuguguuugugaggacugacucccauuuccuaaaggaaaugcccccggggaggacauuggg

SEQ ID NO: 292549 - RNA, 62 nt, hsa
uaagcauaugugcuuucgcagcugauaauauaaaaggaaaucccacagucuagauauagccc

SEQ ID NO: 292550 - RNA, 62 nt, hsa
accuaauuuucaagcauggaucuccauauuucaaaggaaaguuuuaaaaauguuuuuaaaac

SEQ ID NO: 292551 - RNA, 62 nt, hsa
ggaauggcuuuguggucgucguugugcucacgaaaggaaaaauggggaggucuuuuuuuucu

SEQ ID NO: 292552 - RNA, 62 nt, hsa
uugaaagugaaacuuugagcacuaccagaagaaaaggaaaccucgggacucuauucauccac

SEQ ID NO: 292553 - RNA, 62 nt, hsa
cuuguauaguguguuuaaaugggacacauuucaaaggaaauaaaucaguguccguuugccag

SEQ ID NO: 292554 - RNA, 62 nt, hsa
aaaaaaaaucugaauucagccuucaguuuaaaaaaggaaaaggacuuuuuuuuuaaacuuua

SEQ ID NO: 292555 - RNA, 62 nt, hsa
uauuuaaugugugaacagcuacugugacaugcaaaggaaaggacagugcagaauuaaaccgu

SEQ ID NO: 292556 - RNA, 62 nt, hsa
cuuuaaauuuucccacaccauaagagaggagcaaaggaaauuaccaguuuagacuaaguuac

SEQ ID NO: 292557 - RNA, 62 nt, hsa
auuguccuuucuccaguuuuuguuccagaauaaaaggaaauauuuuaaaagccacguuauag

SEQ ID NO: 292558 - RNA, 62 nt, hsa
agaacauaagaacucaaggagaacauaagagaaaaggaaaccuguuacagaaaagacaagaa

SEQ ID NO: 292559 - RNA, 62 nt, hsa
uacagauuuagacaaagacaagagcaucagacaaaggaaaagagaggaggauagagucaagg

SEQ ID NO: 292560 - RNA, 62 nt, hsa
agaaaggccagagaaagagcaguccaagcauaaaaggaaaaagaguuaugaagauacagauu

SEQ ID NO: 292561 - RNA, 62 nt, hsa
uguaaaaagggaauaacuguaugcagguuugaaaaggaaaugugcuuuaggcaugagucaua

SEQ ID NO: 292562 - RNA, 62 nt, hsa
uauuucauacuaaacuagugaauaagugaaauaaaggaaacucgucauuaaucuaaagacag

SEQ ID NO: 292563 - RNA, 64 nt, hsa; identical to SEQ ID NO: 161097

SEQ ID NO: 292564 - RNA, 64 nt, hsa; identical to SEQ ID NO: 161098

SEQ ID NO: 292565 - RNA, 64 nt, hsa; identical to SEQ ID NO: 161099

SEQ ID NO: 292566 - RNA, 64 nt, hsa; identical to SEQ ID NO: 161100

SEQ ID NO: 292567 - RNA, 64 nt, hsa; identical to SEQ ID NO: 161101

SEQ ID NO: 292568 - RNA, 64 nt, hsa; identical to SEQ ID NO: 161102

SEQ ID NO: 292569 - RNA, 64 nt, hsa; identical to SEQ ID NO: 161103

SEQ ID NO: 292570 - RNA, 64 nt, hsa; identical to SEQ ID NO: 161104

SEQ ID NO: 292571 - RNA, 64 nt, hsa; identical to SEQ ID NO: 161105

SEQ ID NO: 292572 - RNA, 64 nt, hsa; identical to SEQ ID NO: 161106

SEQ ID NO: 292573 - RNA, 64 nt, hsa; identical to SEQ ID NO: 161107

SEQ ID NO: 292574 - RNA, 64 nt, hsa; identical to SEQ ID NO: 161108

SEQ ID NO: 292575 - RNA, 64 nt, hsa; identical to SEQ ID NO: 161109

SEQ ID NO: 292576 - RNA, 64 nt, hsa; identical to SEQ ID NO: 161110

SEQ ID NO: 292577 - RNA, 64 nt, hsa; identical to SEQ ID NO: 161111

SEQ ID NO: 292578 - RNA, 64 nt, hsa; identical to SEQ ID NO: 161112

SEQ ID NO: 292579 - RNA, 64 nt, hsa; identical to SEQ ID NO: 161113

SEQ ID NO: 292580 - RNA, 64 nt, hsa; identical to SEQ ID NO: 161114

SEQ ID NO: 292581 - RNA, 64 nt, hsa; identical to SEQ ID NO: 161115

SEQ ID NO: 292582 - RNA, 64 nt, hsa; identical to SEQ ID NO: 161116

SEQ ID NO: 292583 - RNA, 64 nt, hsa; identical to SEQ ID NO: 161117

SEQ ID NO: 292584 - RNA, 64 nt, hsa; identical to SEQ ID NO: 161118

SEQ ID NO: 292585 - RNA, 64 nt, hsa; identical to SEQ ID NO: 161119

SEQ ID NO: 292586 - RNA, 64 nt, hsa; identical to SEQ ID NO: 161120

SEQ ID NO: 292587 - RNA, 64 nt, hsa; identical to SEQ ID NO: 161121

SEQ ID NO: 292588 - RNA, 64 nt, hsa; identical to SEQ ID NO: 161122

SEQ ID NO: 292589 - RNA, 64 nt, hsa; identical to SEQ ID NO: 161123

SEQ ID NO: 292590 - RNA, 64 nt, hsa; identical to SEQ ID NO: 161124

SEQ ID NO: 292591 - RNA, 64 nt, hsa; identical to SEQ ID NO: 161125

SEQ ID NO: 292592 - RNA, 64 nt, hsa; identical to SEQ ID NO: 161126

SEQ ID NO: 292593 - RNA, 64 nt, hsa; identical to SEQ ID NO: 161127

SEQ ID NO: 292594 - RNA, 64 nt, hsa; identical to SEQ ID NO: 161128

SEQ ID NO: 292595 - RNA, 64 nt, hsa; identical to SEQ ID NO: 161129

SEQ ID NO: 292596 - RNA, 64 nt, hsa; identical to SEQ ID NO: 161130

SEQ ID NO: 292597 - RNA, 64 nt, hsa; identical to SEQ ID NO: 161131

SEQ ID NO: 292598 - RNA, 64 nt, hsa; identical to SEQ ID NO: 161132

SEQ ID NO: 292599 - RNA, 64 nt, hsa; identical to SEQ ID NO: 161133

SEQ ID NO: 292600 - RNA, 64 nt, hsa; identical to SEQ ID NO: 161134

SEQ ID NO: 292601 - RNA, 64 nt, hsa; identical to SEQ ID NO: 161135

SEQ ID NO: 292602 - RNA, 64 nt, hsa; identical to SEQ ID NO: 161136

SEQ ID NO: 292603 - RNA, 64 nt, hsa; identical to SEQ ID NO: 161137

SEQ ID NO: 292604 - RNA, 64 nt, hsa; identical to SEQ ID NO: 161138

SEQ ID NO: 292605 - RNA, 64 nt, hsa; identical to SEQ ID NO: 161139

SEQ ID NO: 292606 - RNA, 64 nt, hsa; identical to SEQ ID NO: 161140

SEQ ID NO: 292607 - RNA, 64 nt, hsa; identical to SEQ ID NO: 161141

SEQ ID NO: 292608 - RNA, 64 nt, hsa; identical to SEQ ID NO: 161142

SEQ ID NO: 292609 - RNA, 64 nt, hsa; identical to SEQ ID NO: 161143

SEQ ID NO: 292610 - RNA, 64 nt, hsa
guuuaucacuuaacagcucauuuugucuuuuucaauauacaaauuuuaaaaauacuacaauauu

SEQ ID NO: 292611 - RNA, 64 nt, hsa
ccaaguuuuaaacaccuaaaugugaauaacccauauauacaacaaaguuucugccaucuagcuu

SEQ ID NO: 292612 - RNA, 64 nt, hsa
gcuacuauucaacuacacuauauauaaauaaaauauauacaauauauacauuguuuucacugua

SEQ ID NO: 292613 - RNA, 64 nt, hsa
gagagaaccaacguuccuaaaaguacagugcaacauauacaaauugacugagugcaguauuaga

SEQ ID NO: 292614 - RNA, 64 nt, hsa
ucaugaaacaucaucucuacauaaaaaaauacauauauacaaaaauuagcugggcaucauggca

SEQ ID NO: 292615 - RNA, 64 nt, hsa
aauuugguuagaaguucuacaacauuguauguacauauacaaaauuucauuuucucugaaaguc

SEQ ID NO: 292616 - RNA, 64 nt, hsa
uuuaugccacaauuuaaaaauaaaaccagagguuauauacaauuuaaauugggcuaaaaauuaa

SEQ ID NO: 292617 - RNA, 64 nt, hsa
gcccauccaaauuugauaaauggaaccagagguuauauacaacuacaaggaaaaaaaugcauuu

SEQ ID NO: 292618 - RNA, 64 nt, hsa
augcuuuuucguauucuuuauggcuuuuaaauaaauauacaaugguuaauaguaaaacacuguu

SEQ ID NO: 292619 - RNA, 64 nt, hsa
uccugaaaagcugugacucauuaacccaguaaacauauacaaaguaagcuuaaaacacuauaaa

SEQ ID NO: 292620 - RNA, 64 nt, hsa
uaguagauauauauauacacauacauauauacacauauacaaauguauauuuuugcaaaauugu

SEQ ID NO: 292621 - RNA, 64 nt, hsa
uuuuuaugacuuuuauacuauuucuuuauggucgauauacaauugauuuuuuaaaauaauagca

SEQ ID NO: 292622 - RNA, 64 nt, hsa
auuuggguuguguguauacaucuugccauauacaauauacaaacauaugcccauuccugugaua

SEQ ID NO: 292623 - RNA, 64 nt, hsa
uguauacauuuggguuguguguauacaucuugccauauacaauauacaaacauaugcccauucc

SEQ ID NO: 292624 - RNA, 64 nt, hsa
auuuauuuuaacguagacacuaaaaguaugugcaauauacaauuaaaguaggaauuuguuacug

SEQ ID NO: 292625 - RNA, 64 nt, hsa
uacuggugaauugguuuucagguuuugagcauacauauacaauguguuucaaaugcugcuugua

SEQ ID NO: 292626 - RNA, 64 nt, hsa
uuuauuuguuuguuuguuuuugaaaugaccauaaauauacaaauauaggacacuggguguuauc

SEQ ID NO: 292627 - RNA, 64 nt, hsa
gggagacaacuguuuauagaauuuuauuguagauauauacaagaaaagagcgguacuuuacaug

SEQ ID NO: 292628 - RNA, 64 nt, hsa
gucuacaaaggaauaaacauaauguguggccucuauauacaaacucuauuucugucaaugacau

SEQ ID NO: 292629 - RNA, 64 nt, hsa
aaacuuuuaaggacuugagauaacuaauuuguuuauauacaaaaauuaauguuacuguguuacu

SEQ ID NO: 292630 - RNA, 64 nt, hsa
auccugagauacccgauucuauauguaaaagcuaauauacaaaaaagcagauuaaauuacauga

SEQ ID NO: 292631 - RNA, 64 nt, hsa
agcagaugccgcaacuccacacaguguguaaaauauauacaaccaaaaaucagcuuuugcaggu

SEQ ID NO: 292632 - RNA, 64 nt, hsa
gguugggagauguggcuggaaaguacuuuggaaaauauacaaucaagauaucucauggcauauu

SEQ ID NO: 292633 - RNA, 64 nt, hsa
agcaaacaugaaaaacugaacacaguuuuuacagauauacaauauggagugacuuauauacaaa

SEQ ID NO: 292634 - RNA, 64 nt, hsa
acaguuuuuacagauauacaauauggagugacuuauauacaaaaugaccuuaaaaauauauuaa

SEQ ID NO: 292635 - RNA, 64 nt, hsa
uuuaaaagucagccuaaagaauguaaagguaucuauauacaaaaggcuaccuuuucuaaaaucu

SEQ ID NO: 292636 - RNA, 64 nt, hsa
cauaacaggguccauacacaucuucugguuuacuauauacaaaaacuguaguugaaaaaagaug

SEQ ID NO: 292637 - RNA, 64 nt, hsa
uaaagaaaaguugcagaacaagcaauuggcuuagauauacaaucuggaaaaauauuccugugcc

SEQ ID NO: 292638 - RNA, 64 nt, hsa
agcagaggaaccauaaguagaaucacaggauaauauauacaaauauauauauauacauauauau

SEQ ID NO: 292639 - RNA, 64 nt, hsa
aaguuuaaaaauauuauuaacuuguauuuucuuaauauacaaucuaucuuuuccacaaauauga

SEQ ID NO: 292640 - RNA, 64 nt, hsa
ucuagaaaauugaguuuugaguaccucuuuucccauauacaaucuuccuuccuuagguaauuug

SEQ ID NO: 292641 - RNA, 64 nt, hsa
ccgaccagcacuugggaucugaugggacacggccagugccuaggggugccaaguccaaggccuc

SEQ ID NO: 292642 - RNA, 64 nt, hsa
ccgacucccuccuuccgggccugcucuagugaggagugccuaagccaggacccagaaacucaga

SEQ ID NO: 292643 - RNA, 64 nt, hsa
gccggggguucaggguugguagcagggaguacccagugccuacagggcugggccucuucugccu

SEQ ID NO: 292644 - RNA, 64 nt, hsa
accccugggguagccuccuauccaccacugcuuaagugccuaugggaaugugggucugcaccuu

SEQ ID NO: 292645 - RNA, 64 nt, hsa
uaacaacccauaggcacuugggaugucugagaucagugccuauggguuguuaauacuauauugc

SEQ ID NO: 292646 - RNA, 64 nt, hsa
augcguaagugguaugcaugggaugucugaaaucagugccuauggguugucaauaguauuaacu

SEQ ID NO: 292647 - RNA, 64 nt, hsa
guuuaguguucuagaaagagcuauuacuguggauagugccuaggggagugcuccacgcccucug

SEQ ID NO: 292648 - RNA, 64 nt, hsa
uuuaaugugcagaagaucaaagcuacuuggaaggagugccuauaauuugccaguagccacagau

SEQ ID NO: 292649 - RNA, 64 nt, hsa
uaagcaaucacgugcacacaggcagcauuaauggagugccuacugcaugccagcaacagggcuu

SEQ ID NO: 292650 - RNA, 64 nt, hsa
cauucauuuuuaaaauucauucaaggauuuauugagugccuacuguguguugggugccauucca

SEQ ID NO: 292651 - RNA, 64 nt, hsa
cacauacacacacaaacacauacacacaacacuaagugccuagacuuuaaauagaucuagcaau

SEQ ID NO: 292652 - RNA, 64 nt, hsa
agagcuaaaacugcagcauuuuaccuuuaaaugcagugccuagagagagaguauugucucuucc

SEQ ID NO: 292653 - RNA, 64 nt, hsa
auuguugccuuuuaccaaaaugcaaauuuuaugaagugccuaccuuuauauguauaaagcauuu

SEQ ID NO: 292654 - RNA, 64 nt, hsa
guucauucuuucauucaucaauaaauguauuuugagugccuaagaguuuacuaugugccuagca

SEQ ID NO: 292655 - RNA, 64 nt, hsa
uaguggccaucuuacauucucauguccugcuggaagugccuaguugccugcaaagccagcuaag

SEQ ID NO: 292656 - RNA, 64 nt, hsa
gccccggccgggcccagcccucggagugcugccaagugccuaccuguccaccgccaccgggguc

SEQ ID NO: 292657 - RNA, 62 nt, hsa
cccacuccuaggcugccuuggaggguacaagauccacugaggguggccaccacagccuuggc

SEQ ID NO: 292658 - RNA, 62 nt, hsa
ugugccgaguuaccccacuugccuugggcguguccacugagccuuccccagccagucuuguu

SEQ ID NO: 292659 - RNA, 62 nt, hsa
guucagugccuuccucucucuaccagucuauuuccacugaacaaaaccuacgcacauaccuu

SEQ ID NO: 292660 - RNA, 62 nt, hsa
auucacugccuuccucucucuaccagucuauuuccacugaacaaaaccuacacacauaccuu

SEQ ID NO: 292661 - RNA, 62 nt, hsa
uccaaguauucuaaaugugucccaucaugcuuuccacugacccaaaauucaccacagcauuu

SEQ ID NO: 292662 - RNA, 62 nt, hsa
uaaguuccacauagcaauuacaguaugccaguuccacugaagacaugaaaucuuuagagguu

SEQ ID NO: 292663 - RNA, 62 nt, hsa
uccagcugucaccucccccaggagaucaggauuccacugacguccugggcagccagugaauu

SEQ ID NO: 292664 - RNA, 62 nt, hsa
uguuccaccucuccugcgauaguccugggugcuccacugauuggaggauagagccagcuguc

SEQ ID NO: 292665 - RNA, 62 nt, hsa
ggcuagugcgauuucacagucuacugccuguuuccacugaaaacauuuuugucauauucuug

SEQ ID NO: 292666 - RNA, 62 nt, hsa
aguuauuaggagagauacucucuccuguuuucuccacugaacgagacucaucuugcucuucu

SEQ ID NO: 292667 - RNA, 62 nt, hsa
ccgggaguccaaaccaccuuggugcucugaaguccacugacucaucacaccuuucuuagccu

SEQ ID NO: 292668 - RNA, 62 nt, hsa
agaaggggcuggucugcugggcagggcuuacauccacugaguucuaagauuccuuuccugau

SEQ ID NO: 292669 - RNA, 62 nt, hsa
uuccccuccugggucaccucugauggcugcuguccacugagaacgugggcaguguccaaauu

SEQ ID NO: 292670 - RNA, 62 nt, hsa
uuucagagaacuguaaaccgaggcugacgugcuccacugacugugccgaggggcgggggcag

SEQ ID NO: 292671 - RNA, 64 nt, hsa; identical to SEQ ID NO: 72787

SEQ ID NO: 292672 - RNA, 64 nt, hsa; identical to SEQ ID NO: 72788

SEQ ID NO: 292673 - RNA, 64 nt, hsa; identical to SEQ ID NO: 72789

SEQ ID NO: 292674 - RNA, 64 nt, hsa; identical to SEQ ID NO: 72790

SEQ ID NO: 292675 - RNA, 64 nt, hsa; identical to SEQ ID NO: 72791

SEQ ID NO: 292676 - RNA, 64 nt, hsa; identical to SEQ ID NO: 72792

SEQ ID NO: 292677 - RNA, 64 nt, hsa; identical to SEQ ID NO: 72793

SEQ ID NO: 292678 - RNA, 64 nt, hsa; identical to SEQ ID NO: 72794

SEQ ID NO: 292679 - RNA, 64 nt, hsa; identical to SEQ ID NO: 72795

SEQ ID NO: 292680 - RNA, 64 nt, hsa; identical to SEQ ID NO: 72796

SEQ ID NO: 292681 - RNA, 64 nt, hsa; identical to SEQ ID NO: 72797

SEQ ID NO: 292682 - RNA, 64 nt, hsa; identical to SEQ ID NO: 72798

SEQ ID NO: 292683 - RNA, 64 nt, hsa; identical to SEQ ID NO: 72799

SEQ ID NO: 292684 - RNA, 64 nt, hsa; identical to SEQ ID NO: 72800

SEQ ID NO: 292685 - RNA, 64 nt, hsa; identical to SEQ ID NO: 72801

SEQ ID NO: 292686 - RNA, 64 nt, hsa; identical to SEQ ID NO: 72802

SEQ ID NO: 292687 - RNA, 64 nt, hsa; identical to SEQ ID NO: 72803

SEQ ID NO: 292688 - RNA, 64 nt, hsa; identical to SEQ ID NO: 72804

SEQ ID NO: 292689 - RNA, 64 nt, hsa; identical to SEQ ID NO: 72805

SEQ ID NO: 292690 - RNA, 64 nt, hsa; identical to SEQ ID NO: 72806

SEQ ID NO: 292691 - RNA, 64 nt, hsa; identical to SEQ ID NO: 72807

SEQ ID NO: 292692 - RNA, 64 nt, hsa; identical to SEQ ID NO: 72808

SEQ ID NO: 292693 - RNA, 64 nt, hsa; identical to SEQ ID NO: 72809

SEQ ID NO: 292694 - RNA, 64 nt, hsa; identical to SEQ ID NO: 72810

SEQ ID NO: 292695 - RNA, 64 nt, hsa; identical to SEQ ID NO: 72811

SEQ ID NO: 292696 - RNA, 64 nt, hsa; identical to SEQ ID NO: 72812

SEQ ID NO: 292697 - RNA, 64 nt, hsa; identical to SEQ ID NO: 72813

SEQ ID NO: 292698 - RNA, 64 nt, hsa; identical to SEQ ID NO: 72814

SEQ ID NO: 292699 - RNA, 64 nt, hsa; identical to SEQ ID NO: 72815

SEQ ID NO: 292700 - RNA, 64 nt, hsa; identical to SEQ ID NO: 72816

SEQ ID NO: 292701 - RNA, 64 nt, hsa; identical to SEQ ID NO: 72817

SEQ ID NO: 292702 - RNA, 64 nt, hsa; identical to SEQ ID NO: 72818

SEQ ID NO: 292703 - RNA, 64 nt, hsa; identical to SEQ ID NO: 72819

SEQ ID NO: 292704 - RNA, 64 nt, hsa; identical to SEQ ID NO: 72820

SEQ ID NO: 292705 - RNA, 64 nt, hsa; identical to SEQ ID NO: 72821

SEQ ID NO: 292706 - RNA, 64 nt, hsa; identical to SEQ ID NO: 72822

SEQ ID NO: 292707 - RNA, 64 nt, hsa; identical to SEQ ID NO: 72823

SEQ ID NO: 292708 - RNA, 64 nt, hsa; identical to SEQ ID NO: 72824

SEQ ID NO: 292709 - RNA, 64 nt, hsa; identical to SEQ ID NO: 72825

SEQ ID NO: 292710 - RNA, 64 nt, hsa; identical to SEQ ID NO: 72826

SEQ ID NO: 292711 - RNA, 64 nt, hsa; identical to SEQ ID NO: 72827

SEQ ID NO: 292712 - RNA, 64 nt, hsa; identical to SEQ ID NO: 72828

SEQ ID NO: 292713 - RNA, 64 nt, hsa; identical to SEQ ID NO: 72829

SEQ ID NO: 292714 - RNA, 64 nt, hsa; identical to SEQ ID NO: 72830

SEQ ID NO: 292715 - RNA, 64 nt, hsa; identical to SEQ ID NO: 72831

SEQ ID NO: 292716 - RNA, 64 nt, hsa; identical to SEQ ID NO: 72832

SEQ ID NO: 292717 - RNA, 64 nt, hsa; identical to SEQ ID NO: 72833

SEQ ID NO: 292718 - RNA, 64 nt, hsa; identical to SEQ ID NO: 72834

SEQ ID NO: 292719 - RNA, 64 nt, hsa; identical to SEQ ID NO: 72835

SEQ ID NO: 292720 - RNA, 64 nt, hsa; identical to SEQ ID NO: 72836

SEQ ID NO: 292721 - RNA, 64 nt, hsa; identical to SEQ ID NO: 72837

SEQ ID NO: 292722 - RNA, 64 nt, hsa; identical to SEQ ID NO: 72838

SEQ ID NO: 292723 - RNA, 64 nt, hsa; identical to SEQ ID NO: 72839

SEQ ID NO: 292724 - RNA, 64 nt, hsa; identical to SEQ ID NO: 72840

SEQ ID NO: 292725 - RNA, 64 nt, hsa; identical to SEQ ID NO: 72841

SEQ ID NO: 292726 - RNA, 62 nt, hsa
uaauagccaugacuauaauuuaagccuaugagaagauagacuguuucguagggauauauuca

SEQ ID NO: 292727 - RNA, 62 nt, hsa
caucauauaucaucaucauuauuauggugguaaagauagaaucuuuuuucuuuuuugucauu

SEQ ID NO: 292728 - RNA, 62 nt, hsa
acuuuagauuugggauuuaaaaugccuauuguaagauagaauaauugugaggcuggauucac

SEQ ID NO: 292729 - RNA, 62 nt, hsa
auucuaauguaucccaaaccuaaucuuuuuaaaagauagaagauacuuuuaagacaacuugg

SEQ ID NO: 292730 - RNA, 64 nt, hsa; identical to SEQ ID NO: 85812

SEQ ID NO: 292731 - RNA, 64 nt, hsa; identical to SEQ ID NO: 85813

SEQ ID NO: 292732 - RNA, 64 nt, hsa; identical to SEQ ID NO: 85814

SEQ ID NO: 292733 - RNA, 64 nt, hsa; identical to SEQ ID NO: 85815

SEQ ID NO: 292734 - RNA, 64 nt, hsa; identical to SEQ ID NO: 85816

SEQ ID NO: 292735 - RNA, 64 nt, hsa; identical to SEQ ID NO: 85817

SEQ ID NO: 292736 - RNA, 64 nt, hsa; identical to SEQ ID NO: 85818

SEQ ID NO: 292737 - RNA, 64 nt, hsa; identical to SEQ ID NO: 85819

SEQ ID NO: 292738 - RNA, 64 nt, hsa; identical to SEQ ID NO: 85820

SEQ ID NO: 292739 - RNA, 64 nt, hsa; identical to SEQ ID NO: 85821

SEQ ID NO: 292740 - RNA, 64 nt, hsa; identical to SEQ ID NO: 21812

SEQ ID NO: 292741 - RNA, 64 nt, hsa; identical to SEQ ID NO: 21813

SEQ ID NO: 292742 - RNA, 64 nt, hsa; identical to SEQ ID NO: 21814

SEQ ID NO: 292743 - RNA, 64 nt, hsa; identical to SEQ ID NO: 21815

SEQ ID NO: 292744 - RNA, 64 nt, hsa; identical to SEQ ID NO: 21816

SEQ ID NO: 292745 - RNA, 64 nt, hsa; identical to SEQ ID NO: 21817

SEQ ID NO: 292746 - RNA, 64 nt, hsa; identical to SEQ ID NO: 21818

SEQ ID NO: 292747 - RNA, 64 nt, hsa; identical to SEQ ID NO: 21819

SEQ ID NO: 292748 - RNA, 64 nt, hsa; identical to SEQ ID NO: 21820

SEQ ID NO: 292749 - RNA, 64 nt, hsa; identical to SEQ ID NO: 21821

SEQ ID NO: 292750 - RNA, 64 nt, hsa; identical to SEQ ID NO: 21822

SEQ ID NO: 292751 - RNA, 64 nt, hsa; identical to SEQ ID NO: 21823

SEQ ID NO: 292752 - RNA, 64 nt, hsa; identical to SEQ ID NO: 21824

SEQ ID NO: 292753 - RNA, 64 nt, hsa; identical to SEQ ID NO: 21825

SEQ ID NO: 292754 - RNA, 64 nt, hsa; identical to SEQ ID NO: 21826

SEQ ID NO: 292755 - RNA, 64 nt, hsa; identical to SEQ ID NO: 21827

SEQ ID NO: 292756 - RNA, 64 nt, hsa; identical to SEQ ID NO: 21828

SEQ ID NO: 292757 - RNA, 64 nt, hsa; identical to SEQ ID NO: 21829

SEQ ID NO: 292758 - RNA, 64 nt, hsa; identical to SEQ ID NO: 21830

SEQ ID NO: 292759 - RNA, 64 nt, hsa; identical to SEQ ID NO: 21831

SEQ ID NO: 292760 - RNA, 50 nt, hsa; identical to SEQ ID NO: 21832

SEQ ID NO: 292761 - RNA, 64 nt, hsa; identical to SEQ ID NO: 21833

SEQ ID NO: 292762 - RNA, 64 nt, hsa; identical to SEQ ID NO: 21834

SEQ ID NO: 292763 - RNA, 64 nt, hsa; identical to SEQ ID NO: 21835

SEQ ID NO: 292764 - RNA, 64 nt, hsa; identical to SEQ ID NO: 21836

SEQ ID NO: 292765 - RNA, 64 nt, hsa; identical to SEQ ID NO: 21837

SEQ ID NO: 292766 - RNA, 64 nt, hsa; identical to SEQ ID NO: 21838

SEQ ID NO: 292767 - RNA, 64 nt, hsa; identical to SEQ ID NO: 21839

SEQ ID NO: 292768 - RNA, 64 nt, hsa; identical to SEQ ID NO: 21840

SEQ ID NO: 292769 - RNA, 64 nt, hsa; identical to SEQ ID NO: 21841

SEQ ID NO: 292770 - RNA, 64 nt, hsa; identical to SEQ ID NO: 21842

SEQ ID NO: 292771 - RNA, 64 nt, hsa; identical to SEQ ID NO: 21843

SEQ ID NO: 292772 - RNA, 64 nt, hsa; identical to SEQ ID NO: 21844

SEQ ID NO: 292773 - RNA, 64 nt, hsa; identical to SEQ ID NO: 21845

SEQ ID NO: 292774 - RNA, 64 nt, hsa; identical to SEQ ID NO: 21846

SEQ ID NO: 292775 - RNA, 64 nt, hsa; identical to SEQ ID NO: 21847

SEQ ID NO: 292776 - RNA, 64 nt, hsa; identical to SEQ ID NO: 21848

SEQ ID NO: 292777 - RNA, 64 nt, hsa; identical to SEQ ID NO: 21849

SEQ ID NO: 292778 - RNA, 64 nt, hsa; identical to SEQ ID NO: 21850

SEQ ID NO: 292779 - RNA, 64 nt, hsa; identical to SEQ ID NO: 21851

SEQ ID NO: 292780 - RNA, 64 nt, hsa; identical to SEQ ID NO: 21852

SEQ ID NO: 292781 - RNA, 64 nt, hsa; identical to SEQ ID NO: 21853

SEQ ID NO: 292782 - RNA, 64 nt, hsa; identical to SEQ ID NO: 21854

SEQ ID NO: 292783 - RNA, 64 nt, hsa; identical to SEQ ID NO: 21855

SEQ ID NO: 292784 - RNA, 64 nt, hsa; identical to SEQ ID NO: 21856

SEQ ID NO: 292785 - RNA, 64 nt, hsa; identical to SEQ ID NO: 21857

SEQ ID NO: 292786 - RNA, 64 nt, hsa; identical to SEQ ID NO: 21858

SEQ ID NO: 292787 - RNA, 64 nt, hsa; identical to SEQ ID NO: 21859

SEQ ID NO: 292788 - RNA, 64 nt, hsa; identical to SEQ ID NO: 21860

SEQ ID NO: 292789 - RNA, 64 nt, hsa; identical to SEQ ID NO: 21861

SEQ ID NO: 292790 - RNA, 64 nt, hsa; identical to SEQ ID NO: 21862

SEQ ID NO: 292791 - RNA, 64 nt, hsa; identical to SEQ ID NO: 21863

SEQ ID NO: 292792 - RNA, 64 nt, hsa; identical to SEQ ID NO: 21864

SEQ ID NO: 292793 - RNA, 64 nt, hsa; identical to SEQ ID NO: 21865

SEQ ID NO: 292794 - RNA, 64 nt, hsa; identical to SEQ ID NO: 21866

SEQ ID NO: 292795 - RNA, 64 nt, hsa; identical to SEQ ID NO: 21867

SEQ ID NO: 292796 - RNA, 64 nt, hsa; identical to SEQ ID NO: 21868

SEQ ID NO: 292797 - RNA, 64 nt, hsa; identical to SEQ ID NO: 21869

SEQ ID NO: 292798 - RNA, 64 nt, hsa; identical to SEQ ID NO: 21870

SEQ ID NO: 292799 - RNA, 64 nt, hsa; identical to SEQ ID NO: 21871

SEQ ID NO: 292800 - RNA, 64 nt, hsa; identical to SEQ ID NO: 21872

SEQ ID NO: 292801 - RNA, 64 nt, hsa; identical to SEQ ID NO: 21873

SEQ ID NO: 292802 - RNA, 64 nt, hsa; identical to SEQ ID NO: 21874

SEQ ID NO: 292803 - RNA, 61 nt, hsa
ggacccaccagagccuauagaaucaauuccuuggacucacagccaugcagauaagcccugg

SEQ ID NO: 292804 - RNA, 64 nt, hsa
ggccuggaccugggaugaagaugaaugaagaacauggacucauguggaugugguuuggcucaga

SEQ ID NO: 292805 - RNA, 64 nt, hsa
caaaucccccccacuccaaaguccauggauucaauggacucauccauuugugaggaggacuucu

SEQ ID NO: 292806 - RNA, 64 nt, hsa
ggucuucucuaccccucuaccccacauuggccaguggacucauccauucuuuggaacaaauccc

SEQ ID NO: 292807 - RNA, 64 nt, hsa
agcauuguuucugagugugugaggauguuuucaguggacucagugaagaucugcccucagcgug

SEQ ID NO: 292808 - RNA, 64 nt, hsa
ccuuggacaucaggacuccagguucuucggccuuuggacucaggcuugccacagaggccuccca

SEQ ID NO: 292809 - RNA, 64 nt, hsa
aggcuccagacaaugccuuuccuuucuuuuucacuggacucaaguguccaaggcuuuucauccu

SEQ ID NO: 292810 - RNA, 64 nt, hsa
aggcagcaugguagagugggcagaccuugugcucuggacucagguucaaaguucagaugaagcu

SEQ ID NO: 292811 - RNA, 64 nt, hsa
uucucuuuagguuugcaccaguggugugagcaguuggacucaguuuggacaagggggaaagggg

SEQ ID NO: 292812 - RNA, 64 nt, hsa
gaucccuucacuggcccccucgggaggccuggguuggacucagggucuccuccagcugggggcu

SEQ ID NO: 292813 - RNA, 64 nt, hsa
ugagggaacauacuucaauaagaaccaucuaugcuggacucacagccaaauuaauacugaacaa

SEQ ID NO: 292814 - RNA, 64 nt, hsa
cacuuauaagugggagcuaaacauugauuacacauggacucaaagaagggaacaguagacacgg

SEQ ID NO: 292815 - RNA, 64 nt, hsa
ggucuugggcuguguucagccacuuugccuucucuggacucaguuuccccgucugagaaaugag

SEQ ID NO: 292816 - RNA, 64 nt, hsa
uaaggccccucaggcugggcucugaacgaggaccuggacucagagccagacagggcagccucag

SEQ ID NO: 292817 - RNA, 64 nt, hsa
aaucacagcucaccucagugcggccuugaacuccuggacucaaucgauccucccaccucugccu

SEQ ID NO: 292818 - RNA, 64 nt, hsa
aaucacagcucaccucagugcggccuugaacuccuggacucaauugauccucccacuucugccu

SEQ ID NO: 292819 - RNA, 64 nt, hsa
uauguuuuauucauaaaggggguuaauuauuugcuacaaagaagcacgaucuauuuucaucauc

SEQ ID NO: 292820 - RNA, 64 nt, hsa
ccuuggugagaggaucaguguaaauccuaauagguacaaagacuuuuguguuuuggcuuuguca

SEQ ID NO: 292821 - RNA, 64 nt, hsa
auauagggaauauauaaggaacaucgaaauuguauacaaagauuuguacauaaaaaauauacaa

SEQ ID NO: 292822 - RNA, 64 nt, hsa
gaaauuguauacaaagauuuguacauaaaaaauauacaaagacgcuuccuaaaguaccaacuuu

SEQ ID NO: 292823 - RNA, 64 nt, hsa
auaucaucuauauaacuucaaaguaugauguuuauacaaagaauccuuauuucagucuagcagc

SEQ ID NO: 292824 - RNA, 64 nt, hsa
gcuguaaaauguucuaagauaaaaaaacucgagcuacaaagaaagaaugaacuaauucuuuaca

SEQ ID NO: 292825 - RNA, 64 nt, hsa
aaccaucuugggcuacauagagagaccccaucucuacaaagaaagauuuaaaaauuaaccaggc

SEQ ID NO: 292826 - RNA, 64 nt, hsa
uuggucuacuuuucugugaacagaauuuaaaacauacaaagagauaaaucaccauaccacauag

SEQ ID NO: 292827 - RNA, 64 nt, hsa
accaauaucuaguuacagaugaaaaaauguuuaauacaaagagcugaaaauguagaaauugagu

SEQ ID NO: 292828 - RNA, 64 nt, hsa
acucugaacaugauuauauuaugccaaauaagauuacaaagaauaagcagcaauauugaagcau

SEQ ID NO: 292829 - RNA, 64 nt, hsa
acugugaaaauggacuuaauaauuagaccauuucuacaaagaacaacugaauagguggaaaaca

SEQ ID NO: 292830 - RNA, 64 nt, hsa
agggugauugugucuggagacccuuaauuauguuuacaaagacccauguuccaaguaaguuugu

SEQ ID NO: 292831 - RNA, 64 nt, hsa
caaacuguauaaagggauugguagucaaaacauguacaaagaaauaccuguaaaacuguuuugu

SEQ ID NO: 292832 - RNA, 64 nt, hsa
uuacuguguuggacauauuauuuagacuuagucauacaaagaaacuuagcucuuuuuucaucuc

SEQ ID NO: 292833 - RNA, 64 nt, hsa
accugccuuccauuuuauuccuaaacaagauaguuacaaagauuuuuuaaaaagcuacauaugc

SEQ ID NO: 292834 - RNA, 64 nt, hsa
cuuugugauuuucuacacagaagaucaugucaucuacaaagaaauaguuuuacuucuuucuuuc

SEQ ID NO: 292835 - RNA, 64 nt, hsa
auggccacuccagcgucaucggacucucucuuauuacaaagaucacugcccaggaccaucuucc

SEQ ID NO: 292836 - RNA, 64 nt, hsa
uauagagaggaagauugaauauuuaucuagagaauacaaagacccacauguaaaugauagguau

SEQ ID NO: 292837 - RNA, 58 nt, hsa; identical to SEQ ID NO: 144416

SEQ ID NO: 292838 - RNA, 64 nt, hsa; identical to SEQ ID NO: 144417

SEQ ID NO: 292839 - RNA, 64 nt, hsa; identical to SEQ ID NO: 144418

SEQ ID NO: 292840 - RNA, 64 nt, hsa; identical to SEQ ID NO: 144419

SEQ ID NO: 292841 - RNA, 64 nt, hsa; identical to SEQ ID NO: 144420

SEQ ID NO: 292842 - RNA, 64 nt, hsa; identical to SEQ ID NO: 144421

SEQ ID NO: 292843 - RNA, 64 nt, hsa; identical to SEQ ID NO: 144422

SEQ ID NO: 292844 - RNA, 64 nt, hsa; identical to SEQ ID NO: 144423

SEQ ID NO: 292845 - RNA, 64 nt, hsa; identical to SEQ ID NO: 144424

SEQ ID NO: 292846 - RNA, 64 nt, hsa; identical to SEQ ID NO: 144425

SEQ ID NO: 292847 - RNA, 64 nt, hsa; identical to SEQ ID NO: 144426

SEQ ID NO: 292848 - RNA, 64 nt, hsa; identical to SEQ ID NO: 144427

SEQ ID NO: 292849 - RNA, 64 nt, hsa; identical to SEQ ID NO: 144428

SEQ ID NO: 292850 - RNA, 64 nt, hsa; identical to SEQ ID NO: 144429

SEQ ID NO: 292851 - RNA, 64 nt, hsa; identical to SEQ ID NO: 144430

SEQ ID NO: 292852 - RNA, 64 nt, hsa; identical to SEQ ID NO: 144431

SEQ ID NO: 292853 - RNA, 64 nt, hsa; identical to SEQ ID NO: 144432

SEQ ID NO: 292854 - RNA, 64 nt, hsa; identical to SEQ ID NO: 144433

SEQ ID NO: 292855 - RNA, 64 nt, hsa; identical to SEQ ID NO: 144434

SEQ ID NO: 292856 - RNA, 64 nt, hsa; identical to SEQ ID NO: 144435

SEQ ID NO: 292857 - RNA, 64 nt, hsa; identical to SEQ ID NO: 144436

SEQ ID NO: 292858 - RNA, 64 nt, hsa; identical to SEQ ID NO: 144437

SEQ ID NO: 292859 - RNA, 64 nt, hsa; identical to SEQ ID NO: 144438

SEQ ID NO: 292860 - RNA, 64 nt, hsa; identical to SEQ ID NO: 144439

SEQ ID NO: 292861 - RNA, 64 nt, hsa; identical to SEQ ID NO: 144440

SEQ ID NO: 292862 - RNA, 64 nt, hsa; identical to SEQ ID NO: 144441

SEQ ID NO: 292863 - RNA, 64 nt, hsa; identical to SEQ ID NO: 144442

SEQ ID NO: 292864 - RNA, 64 nt, hsa; identical to SEQ ID NO: 144443

SEQ ID NO: 292865 - RNA, 64 nt, hsa; identical to SEQ ID NO: 144444

SEQ ID NO: 292866 - RNA, 64 nt, hsa; identical to SEQ ID NO: 144445

SEQ ID NO: 292867 - RNA, 64 nt, hsa; identical to SEQ ID NO: 144446

SEQ ID NO: 292868 - RNA, 64 nt, hsa; identical to SEQ ID NO: 144447

SEQ ID NO: 292869 - RNA, 64 nt, hsa; identical to SEQ ID NO: 217273

SEQ ID NO: 292870 - RNA, 64 nt, hsa; identical to SEQ ID NO: 217274

SEQ ID NO: 292871 - RNA, 64 nt, hsa; identical to SEQ ID NO: 217275

SEQ ID NO: 292872 - RNA, 64 nt, hsa; identical to SEQ ID NO: 217276

SEQ ID NO: 292873 - RNA, 64 nt, hsa; identical to SEQ ID NO: 217277

SEQ ID NO: 292874 - RNA, 64 nt, hsa; identical to SEQ ID NO: 217278

SEQ ID NO: 292875 - RNA, 64 nt, hsa; identical to SEQ ID NO: 217279

SEQ ID NO: 292876 - RNA, 64 nt, hsa; identical to SEQ ID NO: 217280

SEQ ID NO: 292877 - RNA, 64 nt, hsa; identical to SEQ ID NO: 217281

SEQ ID NO: 292878 - RNA, 64 nt, hsa; identical to SEQ ID NO: 217282

SEQ ID NO: 292879 - RNA, 64 nt, hsa; identical to SEQ ID NO: 217283

SEQ ID NO: 292880 - RNA, 64 nt, hsa; identical to SEQ ID NO: 217284

SEQ ID NO: 292881 - RNA, 64 nt, hsa; identical to SEQ ID NO: 217285

SEQ ID NO: 292882 - RNA, 64 nt, hsa; identical to SEQ ID NO: 217286

SEQ ID NO: 292883 - RNA, 64 nt, hsa; identical to SEQ ID NO: 217287

SEQ ID NO: 292884 - RNA, 64 nt, hsa; identical to SEQ ID NO: 217288

SEQ ID NO: 292885 - RNA, 64 nt, hsa; identical to SEQ ID NO: 217289

SEQ ID NO: 292886 - RNA, 64 nt, hsa; identical to SEQ ID NO: 217290

SEQ ID NO: 292887 - RNA, 64 nt, hsa; identical to SEQ ID NO: 217291

SEQ ID NO: 292888 - RNA, 64 nt, hsa; identical to SEQ ID NO: 217292

SEQ ID NO: 292889 - RNA, 64 nt, hsa; identical to SEQ ID NO: 217293

SEQ ID NO: 292890 - RNA, 64 nt, hsa; identical to SEQ ID NO: 217294

SEQ ID NO: 292891 - RNA, 64 nt, hsa; identical to SEQ ID NO: 217295

SEQ ID NO: 292892 - RNA, 64 nt, hsa
caagggcaggcaaagaugcccucugggguugucugguucccagugagaggcuccugagaaaaau

SEQ ID NO: 292893 - RNA, 63 nt, hsa
uucccagugagaggcuccugagaaaaauaaagcugguucccagagcugcuguccaucccucau

SEQ ID NO: 292894 - RNA, 64 nt, hsa
cagagaugaauagccccaagugcucccucuuugggguucccaaggcacccugugccugcuuccc

SEQ ID NO: 292895 - RNA, 64 nt, hsa
aaccaccagaguccuuuaaaaaguauugcugcuugguucccaccucagagguucugaguuaauu

SEQ ID NO: 292896 - RNA, 64 nt, hsa
augacuccugguucccauuagucuuaagucuucugguucccauaaaagacucaguuuuauugag

SEQ ID NO: 292897 - RNA, 64 nt, hsa
gguguuggggaggagucucuggcuuaugacuccugguucccauuagucuuaagucuucugguuc

SEQ ID NO: 292898 - RNA, 64 nt, hsa
ccugcaggcaggggcaguuuguugcguucuucgugguucccaggcccugggacaucucacucca

SEQ ID NO: 292899 - RNA, 64 nt, hsa
cacaggccgagaaaaggguacagccucuaggugggguucccaaagacgccuucacgcuggacug

SEQ ID NO: 292900 - RNA, 64 nt, hsa
ggagaacugccccacccaguaucuucugugccaugguucccacauucgcacuccauggccuccu

SEQ ID NO: 292901 - RNA, 64 nt, hsa
ucaaaaauuagccaggugugguggugcgugcccagguucccagguacucggaggcugagaggug

SEQ ID NO: 292902 - RNA, 64 nt, hsa
caguauacuguauuuaucggggccccggaggggaggucgcgagagccgcgucuguguauaaaag

SEQ ID NO: 292903 - RNA, 64 nt, hsa
aguagagacgggguuucaccguguugcccaggcuggucgcgaacuccugagcucaggcaauccg

SEQ ID NO: 292904 - RNA, 64 nt, hsa
agcuggucuggcuuacuguuuugccguucaaaaaggucgcgaauccgugggacugagcacgggg

SEQ ID NO: 292905 - RNA, 64 nt, hsa
aaaacaaaccccacucagaaacagagaaaacuggggucgcgaagaaaucacagccaaggaagau

SEQ ID NO: 292906 - RNA, 64 nt, hsa
uugaaccugggagguggagguugcagugagccaaggucgcgacacugcacuccagccuggguga

SEQ ID NO: 292907 - RNA, 64 nt, hsa
gccccuccccgccuccucccugccuggcggcaggggucgcgaugaugggcuggagcaguuuggg

SEQ ID NO: 292908 - RNA, 64 nt, hsa
agcagcccuauacuuuggggaucauuugccuaccauggcauauauuugaaauugcuuuggacaa

SEQ ID NO: 292909 - RNA, 64 nt, hsa
caaacacauuuucuaugcaugugucucuguguauauggcauauaccuaguaaguauguuucugu

SEQ ID NO: 292910 - RNA, 64 nt, hsa
ccacuuuuucagguaaacauuuuucauuuggcaaauggcauaauuauuugaaagugacaggaau

SEQ ID NO: 292911 - RNA, 64 nt, hsa
aauuuaagaugagcuauuuggagcuuauguaauaauggcauaaagccaacuagaggauguugua

SEQ ID NO: 292912 - RNA, 64 nt, hsa
auuauguaaauauguaugauuaugauuuuuauaaauggcauaacaugaguguacuaacuaccuu

SEQ ID NO: 292913 - RNA, 64 nt, hsa
uguauguacaguuuacaugaauguuccucaggacauggcauacaauggccuuggagguccaaau

SEQ ID NO: 292914 - RNA, 64 nt, hsa
ugauuaucacagauuguacuuauacaaaacuuagauggcauagccuacugcauaccuaggcuau

SEQ ID NO: 292915 - RNA, 64 nt, hsa
acauauguaaacagagaaaaaggaaaguaaaaauauggcauaaaagauaagaauuggcucuccu

SEQ ID NO: 292916 - RNA, 64 nt, hsa; identical to SEQ ID NO: 153638

SEQ ID NO: 292917 - RNA, 64 nt, hsa; identical to SEQ ID NO: 153639

SEQ ID NO: 292918 - RNA, 64 nt, hsa; identical to SEQ ID NO: 153640

SEQ ID NO: 292919 - RNA, 64 nt, hsa; identical to SEQ ID NO: 153641

SEQ ID NO: 292920 - RNA, 64 nt, hsa; identical to SEQ ID NO: 153642

SEQ ID NO: 292921 - RNA, 64 nt, hsa; identical to SEQ ID NO: 153643

SEQ ID NO: 292922 - RNA, 64 nt, hsa; identical to SEQ ID NO: 153644

SEQ ID NO: 292923 - RNA, 64 nt, hsa; identical to SEQ ID NO: 153645

SEQ ID NO: 292924 - RNA, 64 nt, hsa; identical to SEQ ID NO: 153646

SEQ ID NO: 292925 - RNA, 64 nt, hsa; identical to SEQ ID NO: 153647

SEQ ID NO: 292926 - RNA, 64 nt, hsa; identical to SEQ ID NO: 153648

SEQ ID NO: 292927 - RNA, 64 nt, hsa; identical to SEQ ID NO: 153649

SEQ ID NO: 292928 - RNA, 64 nt, hsa; identical to SEQ ID NO: 153650

SEQ ID NO: 292929 - RNA, 64 nt, hsa; identical to SEQ ID NO: 153651

SEQ ID NO: 292930 - RNA, 64 nt, hsa; identical to SEQ ID NO: 153652

SEQ ID NO: 292931 - RNA, 64 nt, hsa; identical to SEQ ID NO: 153653

SEQ ID NO: 292932 - RNA, 64 nt, hsa; identical to SEQ ID NO: 153654

SEQ ID NO: 292933 - RNA, 64 nt, hsa; identical to SEQ ID NO: 153655

SEQ ID NO: 292934 - RNA, 64 nt, hsa; identical to SEQ ID NO: 153656

SEQ ID NO: 292935 - RNA, 64 nt, hsa; identical to SEQ ID NO: 153657

SEQ ID NO: 292936 - RNA, 64 nt, hsa; identical to SEQ ID NO: 153658

SEQ ID NO: 292937 - RNA, 64 nt, hsa; identical to SEQ ID NO: 153659

SEQ ID NO: 292938 - RNA, 64 nt, hsa; identical to SEQ ID NO: 153660

SEQ ID NO: 292939 - RNA, 64 nt, hsa; identical to SEQ ID NO: 153661

SEQ ID NO: 292940 - RNA, 64 nt, hsa; identical to SEQ ID NO: 153662

SEQ ID NO: 292941 - RNA, 64 nt, hsa; identical to SEQ ID NO: 153663

SEQ ID NO: 292942 - RNA, 64 nt, hsa; identical to SEQ ID NO: 153664

SEQ ID NO: 292943 - RNA, 64 nt, hsa; identical to SEQ ID NO: 153665

SEQ ID NO: 292944 - RNA, 64 nt, hsa; identical to SEQ ID NO: 153666

SEQ ID NO: 292945 - RNA, 64 nt, hsa; identical to SEQ ID NO: 153667

SEQ ID NO: 292946 - RNA, 64 nt, hsa; identical to SEQ ID NO: 153668

SEQ ID NO: 292947 - RNA, 64 nt, hsa; identical to SEQ ID NO: 153669

SEQ ID NO: 292948 - RNA, 64 nt, hsa; identical to SEQ ID NO: 153670

SEQ ID NO: 292949 - RNA, 64 nt, hsa; identical to SEQ ID NO: 153671

SEQ ID NO: 292950 - RNA, 64 nt, hsa; identical to SEQ ID NO: 153672

SEQ ID NO: 292951 - RNA, 64 nt, hsa; identical to SEQ ID NO: 153673

SEQ ID NO: 292952 - RNA, 64 nt, hsa; identical to SEQ ID NO: 112230

SEQ ID NO: 292953 - RNA, 64 nt, hsa; identical to SEQ ID NO: 112231

SEQ ID NO: 292954 - RNA, 64 nt, hsa; identical to SEQ ID NO: 112232

SEQ ID NO: 292955 - RNA, 64 nt, hsa; identical to SEQ ID NO: 112233

SEQ ID NO: 292956 - RNA, 64 nt, hsa; identical to SEQ ID NO: 112234

SEQ ID NO: 292957 - RNA, 64 nt, hsa; identical to SEQ ID NO: 112235

SEQ ID NO: 292958 - RNA, 64 nt, hsa; identical to SEQ ID NO: 112236

SEQ ID NO: 292959 - RNA, 64 nt, hsa; identical to SEQ ID NO: 112237

SEQ ID NO: 292960 - RNA, 64 nt, hsa; identical to SEQ ID NO: 112238

SEQ ID NO: 292961 - RNA, 64 nt, hsa; identical to SEQ ID NO: 112239

SEQ ID NO: 292962 - RNA, 64 nt, hsa; identical to SEQ ID NO: 112240

SEQ ID NO: 292963 - RNA, 64 nt, hsa; identical to SEQ ID NO: 112241

SEQ ID NO: 292964 - RNA, 64 nt, hsa; identical to SEQ ID NO: 112242

SEQ ID NO: 292965 - RNA, 64 nt, hsa; identical to SEQ ID NO: 112243

SEQ ID NO: 292966 - RNA, 64 nt, hsa; identical to SEQ ID NO: 112244

SEQ ID NO: 292967 - RNA, 64 nt, hsa; identical to SEQ ID NO: 112245

SEQ ID NO: 292968 - RNA, 64 nt, hsa; identical to SEQ ID NO: 112246

SEQ ID NO: 292969 - RNA, 64 nt, hsa; identical to SEQ ID NO: 112247

SEQ ID NO: 292970 - RNA, 64 nt, hsa; identical to SEQ ID NO: 112248

SEQ ID NO: 292971 - RNA, 64 nt, hsa; identical to SEQ ID NO: 112249

SEQ ID NO: 292972 - RNA, 64 nt, hsa; identical to SEQ ID NO: 112250

SEQ ID NO: 292973 - RNA, 64 nt, hsa; identical to SEQ ID NO: 112251

SEQ ID NO: 292974 - RNA, 64 nt, hsa; identical to SEQ ID NO: 112252

SEQ ID NO: 292975 - RNA, 64 nt, hsa; identical to SEQ ID NO: 112253

SEQ ID NO: 292976 - RNA, 64 nt, hsa; identical to SEQ ID NO: 112254

SEQ ID NO: 292977 - RNA, 64 nt, hsa; identical to SEQ ID NO: 112255

SEQ ID NO: 292978 - RNA, 64 nt, hsa; identical to SEQ ID NO: 112256

SEQ ID NO: 292979 - RNA, 64 nt, hsa; identical to SEQ ID NO: 112257

SEQ ID NO: 292980 - RNA, 64 nt, hsa; identical to SEQ ID NO: 112258

SEQ ID NO: 292981 - RNA, 64 nt, hsa
acccccuuccuugccuaaggugucugaguuucuggcucuugaggcauuuccagacuugaaauuc

SEQ ID NO: 292982 - RNA, 64 nt, hsa
gcauuuccagacuugaaauucucaucaguccauugcucuugagucuuugcagagaaccucagau

SEQ ID NO: 292983 - RNA, 64 nt, hsa
cuuggcugaggauuguauuucagaaccaccaacugcucuugacaauuguuaacccgcuaggcuc

SEQ ID NO: 292984 - RNA, 64 nt, hsa
uguuuacucauuggaggaacaguaccuuggcuuggcucuugacguggacagugaguaccuuacu

SEQ ID NO: 292985 - RNA, 64 nt, hsa
aaaucaacugacuagugcaggaggcuguugauuggcucuugacugugaugcccgcaauucucaa

SEQ ID NO: 292986 - RNA, 64 nt, hsa
ugaaaauguccaucuuugggaaauuuucuacccugcucuugagccugauaacccaugccagguc

SEQ ID NO: 292987 - RNA, 64 nt, hsa
aauuuuccucauucuggugaccaugcccagcauggcucuugaagaaaugaagagagguaucauu

SEQ ID NO: 292988 - RNA, 64 nt, hsa
aagagcagagccaggcugugcccgagggaccccagcucuugacugcaccuguuucaugccucuc

SEQ ID NO: 292989 - RNA, 64 nt, hsa
auauuuauuugguuaucaacugcccauggaggaggcucuugaugaucccaggucuccucgaccu

SEQ ID NO: 292990 - RNA, 64 nt, hsa
acaaugaagacuaaaacugaacaagauguugcaugcucuugaggccauaauuugguaguguugg

SEQ ID NO: 292991 - RNA, 64 nt, hsa
agguugucucuuccgagggccuucugaagacagggcucuugaacagacaaguggaagggcugua

SEQ ID NO: 292992 - RNA, 64 nt, hsa
gcaguaagcuugugauaaaggccaauuccagguagcucuugaaggugauagccaucuacuuucc

SEQ ID NO: 292993 - RNA, 64 nt, hsa
cagccugaccaacgaugagcauuucuuaggcucagcucuugauacggaaacgagugucuucacu

SEQ ID NO: 292994 - RNA, 64 nt, hsa
gggacaagugucagcaggauuggcgugugggaaagcucuugagcugggcacuggccccccggac

SEQ ID NO: 292995 - RNA, 64 nt, hsa
cauacuugagagaaauccuacaaauguaaagaauguggcaaaccuuuggaugauccacaaaccu

SEQ ID NO: 292996 - RNA, 64 nt, hsa
uauacuguagagaaacccuggaaaugugaagaacguggcaaaguucuuuaccucauucucaaac

SEQ ID NO: 292997 - RNA, 64 nt, hsa
augcuggagggaagcccuacacauguggcagaauguggcaaagcauuuaauugguccucaaugc

SEQ ID NO: 292998 - RNA, 64 nt, hsa
uucaugcuggagagaaacuucacaugugaaccguguggcaaagccuuuaaaugguccucaaccc

SEQ ID NO: 292999 - RNA, 64 nt, hsa
uauaccagagagaaacccuacacauguaaagaauguggcaaagccuucaauagguucucaaccc

SEQ ID NO: 293000 - RNA, 64 nt, hsa
gauauuggugagaagccacaaaaauaugaaaaauguggcaaagccuucaaaugcuugucacauc

SEQ ID NO: 293001 - RNA, 64 nt, hsa
ucguacuggagagaauccuacaaaugugaaaaauguggcaaauccuuuaacugauccucaacuu

SEQ ID NO: 293002 - RNA, 64 nt, hsa
uauacuggagaggaacucuauaguugugaagaauguggcaaagcuuuuaaccaauccucauacc

SEQ ID NO: 293003 - RNA, 64 nt, hsa
cauacuggagagaaagccuacaauugugaagaauguggcaaagcuuuuaaccuuccuuaacccu

SEQ ID NO: 293004 - RNA, 64 nt, hsa
cauacuggaaagaaacccuacaaaugugaagucuguggcaaagcuuuuaacugauucucaacuc

SEQ ID NO: 293005 - RNA, 64 nt, hsa
uacacuagagagaaagccuacaaaugugaagaauguggcaaagccuuuaaccaguuuucaaccc

SEQ ID NO: 293006 - RNA, 64 nt, hsa
cacaguggagaaaaacccuacaaaugugaagaauguggcaaagcuuuuaaccaguccucacacc

SEQ ID NO: 293007 - RNA, 64 nt, hsa
cauacuggagagaaaccuuacaaaugugaggaauguggcaaagguuuuagccaacucucaaacc

SEQ ID NO: 293008 - RNA, 64 nt, hsa
caaacuggagagaaacucuacaaaugugaagaauguggcaaagcuuuuaaccaagucucaacac

SEQ ID NO: 293009 - RNA, 64 nt, hsa
cauacuggagagaaaccuuacaagugugaagaauguggcaaaacuucuaaccauuucucaaccc

SEQ ID NO: 293010 - RNA, 64 nt, hsa
cauacugaagagaaacaguacaaaugugaugaauguggcaaagcuucuaccugauccucaaaac

SEQ ID NO: 293011 - RNA, 64 nt, hsa
cauacuggagagaaacccuacaaaugugaagaauguggcaaagcuuuuaaccaaucuucaacac

SEQ ID NO: 293012 - RNA, 64 nt, hsa
acaacuacauaaaauauguuucuauuuagaugaaguggcaaacuaaucuguaguguuaaaaauu

SEQ ID NO: 293013 - RNA, 64 nt, hsa
ccaauagaugagaauuuuccguaucuugaucugaguggcaaauuguaaacuuaaaauauauaua

SEQ ID NO: 293014 - RNA, 64 nt, hsa
augcuacugaaacuuaccugagaaccauaggacuguggcaaacaaaaccaauucaugaagugaa

SEQ ID NO: 293015 - RNA, 64 nt, hsa
caucacaauuagggaaugguuaguggucucuacuguggcaaaugccaacuguuggaauucacuu

SEQ ID NO: 293016 - RNA, 55 nt, hsa
gagaaacccuacaaaugugaagauuguggcaaagccucuaacccguccugaauuc

SEQ ID NO: 293017 - RNA, 64 nt, hsa
cauacugaagaaaacuucuacaagugugaacaguguggcaaaacuuuuaaugaaugcucacacc

SEQ ID NO: 293018 - RNA, 55 nt, hsa
aagagacuguacaaaagugaagaauguggcaaaggccuuuacugcuccuauuccc

SEQ ID NO: 293019 - RNA, 64 nt, hsa
ggccuuuacugcuccuauucccuuacuaaagaauguggcaaagcuuuucaccaguacuuuaccc

SEQ ID NO: 293020 - RNA, 64 nt, hsa
aaugcuggagagaaacccuacaaaugugaagaauguggcaaagauuucuauugauucucauacc

SEQ ID NO: 293021 - RNA, 64 nt, hsa
cauauuggagagaaauucuacagaugugaagaauguggcaaaggcuuuaauuaguucucauccc

SEQ ID NO: 293022 - RNA, 64 nt, hsa
cauaaaggagauaaauuauacaaaugugaagaauguggcaaagcuuuuaacaaauccucaucca

SEQ ID NO: 293023 - RNA, 64 nt, hsa
cauacuggagagaaaaccuacaaaugugaggaauguggcaaagccuuuagccugucccuccaau

SEQ ID NO: 293024 - RNA, 64 nt, hsa
uauacuggagagaagcccuacaaaugugaaaaauguggcaaaccuuuuaaccaauccucaaccc

SEQ ID NO: 293025 - RNA, 64 nt, hsa
caugcuggagagaaacccuacaaaugugaaaaauguggcaaagcuuuuaaccaauuuucaaacc

SEQ ID NO: 293026 - RNA, 64 nt, hsa
cauacuggagaaaaaucuuacaaaugugaagaauguggcaaagccuuuauccaguccucaacuc

SEQ ID NO: 293027 - RNA, 64 nt, hsa
aaugauggagagaaaccauacaacugugaagaauguggcaaagcuuuuaaccaguccucaaacu

SEQ ID NO: 293028 - RNA, 64 nt, hsa
cauauuggaaaaauuuccuacaaguaagaacaauguggcaaaguuuuuaacuaauacaccuuau

SEQ ID NO: 293029 - RNA, 52 nt, hsa
guaccuuacagauggaaugaauguggcaaaaucuuuaguuagaauucacacc

SEQ ID NO: 293030 - RNA, 63 nt, hsa
gacucaggagaaaaaccuuacaaauaucauaaauguggcaaagaauuuaguuugcauugaagc

SEQ ID NO: 293031 - RNA, 64 nt, hsa
cauacuggagagaaaccuuacaaguguaaugaguguggcaaagccuuuagugaccagucaacac

SEQ ID NO: 293032 - RNA, 64 nt, hsa
cauaaugaagagagaucuuccgaguguaauaaauguggcaaauuuuucagacaucguucauacc

SEQ ID NO: 293033 - RNA, 64 nt, hsa
ucuuacuagaaaaacucuuacaagugugaagaauguggcaaaauuuuuaaugaauacucacacc

SEQ ID NO: 293034 - RNA, 64 nt, hsa
cauacuagagagaaacccuacaaauguaaagaauguggcaaagcauuuaacuggucccuaaauc

SEQ ID NO: 293035 - RNA, 64 nt, hsa
cauacuggagagaaauccuacaaaugugauaaauguggcaaagccuuuaacuggcucuuaaucc

SEQ ID NO: 293036 - RNA, 64 nt, hsa
uucuuuguuaaaaaaaaaauuagauucuuaaaguguggcaaacauaaaauuugcaagaaaaugu

SEQ ID NO: 293037 - RNA, 55 nt, hsa
gagaaacccuacaaaugugaaaaauguggcaaagccuuuuaccaguccucaacuc

SEQ ID NO: 293038 - RNA, 64 nt, hsa
cauacuggagggaauuccuauaauuguguggaauguggcaaagccuuuaaccaguccuuaaggc

SEQ ID NO: 293039 - RNA, 64 nt, hsa
auacuggaggaaaagcccuacaaaugugaaaaacguggcaaagcuuuucauuaguucucaaccc

SEQ ID NO: 293040 - RNA, 64 nt, hsa
cauacuggagagaaaaucuacaaaggugaagaauguggcaaagcuuuuaaacaguccucaaucu

SEQ ID NO: 293041 - RNA, 64 nt, hsa
uauacaggagagaaaccucacaagugugaugauuguggcaaagccuuugcuucacguucacacg

SEQ ID NO: 293042 - RNA, 64 nt, hsa
cauaaugaagagagaucuuacaaguguaauaaauguggcaaauuuuucagagaucguucacaua

SEQ ID NO: 293043 - RNA, 64 nt, hsa
cacacuggagagaaaccuuacaaguguaaugaguguggcaaagccuuuggcaagcagucaacac

SEQ ID NO: 293044 - RNA, 64 nt, hsa
cauacaggagagaaaccucacaugugugaugauuguggcaaagccuuuacuucauguucacacc

SEQ ID NO: 293045 - RNA, 64 nt, hsa
uauaaugaauaaagaucuaacaaguguaauaaauguggcaaauuuuucagacaucauucauaca

SEQ ID NO: 293046 - RNA, 64 nt, hsa
ucauacaggagagaaacucacaagugugaugauuguggcaaagcguuuacuucacauucacacc

SEQ ID NO: 293047 - RNA, 64 nt, hsa
cacacuggagagaaaccuuacaagugcaaugaguguggcaaagccuuuagugggcagucaccac

SEQ ID NO: 293048 - RNA, 64 nt, hsa
cauacaggagagaaaccucacaagugugaugauuguggcaaagcguuuacuucacauucacacc

SEQ ID NO: 293049 - RNA, 64 nt, hsa
uccacagugaagagaucuuacaaguguaauaaauguggcaaauuuuucagacaucguucaugcc

SEQ ID NO: 293050 - RNA, 64 nt, hsa
cacacuggagagaaaccuuacaagugcaaugaguguggcaaacccuuuagugggcagucaccac

SEQ ID NO: 293051 - RNA, 64 nt, hsa
ugugagaaagagauucuugccuugaggcucugcaguggcaaaugguaggggcaauagcgcuccc

SEQ ID NO: 293052 - RNA, 64 nt, hsa
aaaagacccacugaaucugagaaaguacuuucugguggcaaaugaauuuaucauuuuaguauag

SEQ ID NO: 293053 - RNA, 62 nt, hsa
cugcuggcuccuugcuugauuucccucagcaaacccuugaacuugcuaggccaugaauacac

SEQ ID NO: 293054 - RNA, 62 nt, hsa
gccccccaaaugaaugcauuuucuucccacuaacccuugauuuuucuucauucauggugaaa

SEQ ID NO: 293055 - RNA, 62 nt, hsa
acuuagauccuucucccuuuuggcccaaaagaacccuugauuuaguuccagaauccaaccag

SEQ ID NO: 293056 - RNA, 62 nt, hsa
ucacaaaagguucucauggugccugacagguuacccuugagggcuugugucuacuuuuuaaa

SEQ ID NO: 293057 - RNA, 62 nt, hsa
uaaagcuuccaugcuucacccuugacaugauuacccuugaguaaaacaugggaauuuguagu

SEQ ID NO: 293058 - RNA, 62 nt, hsa
caaaauauuucucaguaaagcuuccaugcuucacccuugacaugauuacccuugaguaaaac

SEQ ID NO: 293059 - RNA, 62 nt, hsa
cgccuucugggcuuucuucagaggucacuucuacccuugaagcugucggcaaaagcgagcag

SEQ ID NO: 293060 - RNA, 62 nt, hsa
cuugacaacaaaagucagggugcagucgguccacccuugacugcucuuggcuuggucucuac

SEQ ID NO: 293061 - RNA, 64 nt, hsa
cauuugaaaaaggaaauauaaaaggaacaaccauauagccaaccuguggucuggcagaaacaac

SEQ ID NO: 293062 - RNA, 64 nt, hsa
gagguucaccuuugugacugauuggugauaaaagauagccaagugucuuacaagcagcuucuga

SEQ ID NO: 293063 - RNA, 64 nt, hsa
auguuuguuguaaaugguuucaaaaauacaaauuauagccaaucaaaacauugcuuugguuggu

SEQ ID NO: 293064 - RNA, 64 nt, hsa
uaaaauagcucuuucucauuuuuagagaagucaaauagccaaccaucaaaauuaagaauaaauu

SEQ ID NO: 293065 - RNA, 64 nt, hsa
aagcaacuuuaaaacauuuagaguuuugcugaguauagccaaaugccuguucugaaacuuauag

SEQ ID NO: 293066 - RNA, 64 nt, hsa
agcaaaguuuuuuauuaaauuuuauaaauuuuuaauagccaauuauguccuaauuguauuuugg

SEQ ID NO: 293067 - RNA, 64 nt, hsa
uacuuuuacuuuguuuguacaaaaacaaagacauauagccaauacaaaucaaaugccggaggug

SEQ ID NO: 293068 - RNA, 64 nt, hsa
uuuuggcuuaugugauuuucuguuuacaaguagaauagccaauuauuuaaauguuuaguugcca

SEQ ID NO: 293069 - RNA, 64 nt, hsa
ggggaaccaggaaucugagaaucagcugugcucaauagccaaccucccuguccagaugcagcua

SEQ ID NO: 293070 - RNA, 64 nt, hsa
aauugcauaugaagaaggcagacauuuauuuuuaauagccaaguaguucugcaaauaguucuuu

SEQ ID NO: 293071 - RNA, 64 nt, hsa
auaaaugaaggcaugagaggaaguaaguagcaaguugaaggacagguaguugagaugaaacacu

SEQ ID NO: 293072 - RNA, 64 nt, hsa
cacauauuguauauaaacaaaacaauaugcuuuguugaaggaaaauuuucuuuauuggaaugug

SEQ ID NO: 293073 - RNA, 64 nt, hsa
aaaggauaaaaugaacgcuauuugaggacucugguugaaggagauuuauuuaaauuugaaguaa

SEQ ID NO: 293074 - RNA, 64 nt, hsa
ugaucaugaggguuaaauauuguaauauggauacuugaaggacuuuauauaaaaggaugacuca

SEQ ID NO: 293075 - RNA, 64 nt, hsa
cuguugaccagccugguuucauaccgaaaagacauugaaggacugcagaaauguaugggugcac

SEQ ID NO: 293076 - RNA, 64 nt, hsa
cuucacugcagauacaguucacucugaaagcugguugaaggagagcagcaaaaauguaucaggg

SEQ ID NO: 293077 - RNA, 64 nt, hsa
aaggcagugaaauggcaguuagaccaacagaggcuugaaggauucaaguacaaguaauauuuug

SEQ ID NO: 293078 - RNA, 64 nt, hsa
gaguaauuuugaucaaaagacguguuacuucccuuugaaggaaaaguuuuuaguguguauugua

SEQ ID NO: 293079 - RNA, 64 nt, hsa
uaaucccagcacuucuguaaccuucagcauuucuuugaaggauuuccuggugcaccuuucucau

SEQ ID NO: 293080 - RNA, 64 nt, hsa
gacaacuacuuuugaaggaaguuaaaagguggcuuugaaggaggaagacaccuugagccaagga

SEQ ID NO: 293081 - RNA, 64 nt, hsa
ucagagugauccuguauaagaaagacaacuacuuuugaaggaaguuaaaagguggcuuugaagg

SEQ ID NO: 293082 - RNA, 64 nt, hsa
gugcucugaaggaggucaccaggaccugaccucuuugaaggaucagaaaauacuucccugaagg

SEQ ID NO: 293083 - RNA, 64 nt, hsa
agaaauaaagcaguuacaaauugugauaagugcuuugaaggaaagaaggggucugagacaacaa

SEQ ID NO: 293084 - RNA, 64 nt, hsa
gcuaacuauauaguaguauacacaagagaaaucuuugaaggaggaaacugaugacagauauaca

SEQ ID NO: 293085 - RNA, 64 nt, hsa
gaaggaggaaacugaugacagauauacagggcacuugaaggagacucugaugcuaguuauauaa

SEQ ID NO: 293086 - RNA, 64 nt, hsa
gaaagccuuuuuuaagaagucuuuuuaagauuucuugaaggauuuuagaaaucauauaucucuu

SEQ ID NO: 293087 - RNA, 64 nt, hsa
agaauauaagucucgccaucgucaaagagaaacuuugaaggagcaggagacugaaaucgauauu

SEQ ID NO: 293088 - RNA, 64 nt, hsa
gccggagaacaagaagcugaagaaaaucucaacauugaaggagccuuggacaaccaccuaaucc

SEQ ID NO: 293089 - RNA, 64 nt, hsa
guuccuaccaagagcccugugcagcccguggugguugaaggaggcuggaccgaacagacucaac

SEQ ID NO: 293090 - RNA, 64 nt, hsa
ucacuuagcagggauuacagaaaugagauacauuuugaaggagaguugucuguuauguucacug

SEQ ID NO: 293091 - RNA, 64 nt, hsa
cacacugaggaaugcauuuugcucaucuguguuauugaaggaggugcuuauuaaauacaguucc

SEQ ID NO: 293092 - RNA, 64 nt, hsa
uacuuuuauuuuuuauguugcuuaacuguuuuauuugaaggaaaccugugugauuuaaaaaguu

SEQ ID NO: 293093 - RNA, 64 nt, hsa
agagagccuuauauuuuccaauugguauaaauuuuugaaggaugugauguucauuaacauucgg

SEQ ID NO: 293094 - RNA, 64 nt, hsa
gcccuggguuucuuuaaucuauucagcuagaacuuugaaggacaauuucuugcauuaauaaagg

SEQ ID NO: 293095 - RNA, 64 nt, hsa
caagagggaagaaagagaaggagccaucuccaucuugaaggaacucaaagacucaagugggaac

SEQ ID NO: 293096 - RNA, 64 nt, hsa
uaggucuguguccaaagcuauguggcaggcuuguuugaaggacccagaggggcccagcugaccu

SEQ ID NO: 293097 - RNA, 64 nt, hsa
uuccaguucugaggagaggaggucuucaguacuauugaaggagacauugaucuucuggauguac

SEQ ID NO: 293098 - RNA, 64 nt, hsa
cuugaccuggaaugggggccuuugucaaacacuguugaaggagaggcugaugugucugugaugg

SEQ ID NO: 293099 - RNA, 64 nt, hsa
auuccugagucagaagucuguuaauauugcuguuuugaaggacaauccuuuauuuuacuugaga

SEQ ID NO: 293100 - RNA, 64 nt, hsa
gaauaaccuuggccauauauuugcucaauaaagauugaaggaagcauggucauaguugcccugg

SEQ ID NO: 293101 - RNA, 64 nt, hsa
uacagagaauagaaacaaauccauguaaacaauuuugaaggaggcaugggagcuaaaaauccug

SEQ ID NO: 293102 - RNA, 64 nt, hsa
uacaacguaguauuuacuggcaagaaggagaaaguugaaggacucagcuaaaggaguacagcaa

SEQ ID NO: 293103 - RNA, 64 nt, hsa
guuggaggcacaguuuuagaauaaggaggaggagggagaagagaaaauguaaaggagggagauc

SEQ ID NO: 293104 - RNA, 64 nt, hsa
ugcaacuucuuucuguugagagaaccucagguacggagaagaauagagguccucaugggucccu

SEQ ID NO: 293105 - RNA, 64 nt, hsa
gguguuuauugaaaauuaaccaaacuuaauacuaggagaagacugaaucauuaaugaugucuca

SEQ ID NO: 293106 - RNA, 64 nt, hsa
gcaagaaauauacugacaugaacaggcaguucuuggagaagaaagagcauuucuuuaaguaccu

SEQ ID NO: 293107 - RNA, 64 nt, hsa
caaaaaaugaacauuuauauaucuacaaaaauauggagaagaguaauuugaaagccuacuuucu

SEQ ID NO: 293108 - RNA, 64 nt, hsa
uuccuaaguugcaaaauguaaugaugagcuugguggagaagaaugagucguucuuggaauaccu

SEQ ID NO: 293109 - RNA, 64 nt, hsa
aaauaaaguuuaaauuaucauuaagacacugcuaggagaagauuaagauuaugaaaguaacagu

SEQ ID NO: 293110 - RNA, 64 nt, hsa
uuccauucagcaauaggacacgaaaggcauagaaggagaagacaaagugucacgcaguugacug

SEQ ID NO: 293111 - RNA, 64 nt, hsa
uggggccccugcaaccucggggagugccacuucgggagaagaaggcaacccaaaugguggccau

SEQ ID NO: 293112 - RNA, 64 nt, hsa
gcuuccaagaaagaggaggagaguugaaaagagaggagaagacucggaauucccugagucccac

SEQ ID NO: 293113 - RNA, 64 nt, hsa
cuuuucugauaucucuaaaaugcuguuaaguucuggagaagaacuucaggagaagaagaucuau

SEQ ID NO: 293114 - RNA, 64 nt, hsa
cuaaaaugcuguuaaguucuggagaagaacuucaggagaagaagaucuaucagcuggcuuuuaa

SEQ ID NO: 293115 - RNA, 64 nt, hsa
agcugguaguccaucagcacaaugaaggagacuuggagaagaggaagaauaacacuguugcuuc

SEQ ID NO: 293116 - RNA, 64 nt, hsa
aggcggggcaggcagccuguugcaggcaggggaaggagaagagacugaggggcugugaccucuc

SEQ ID NO: 293117 - RNA, 64 nt, hsa
ucaaugucaagagaaaaugaccucugcucaaaagggagaagagucucaauuucagcaaguaccu

SEQ ID NO: 293118 - RNA, 64 nt, hsa
gggugggccccaaauccaaugacuggcauccuuaggagaagagagaguuuugguaauagacaca

SEQ ID NO: 293119 - RNA, 64 nt, hsa
uagguaucuggguuuauauacuaaaauuaaggguggagaagaucuuauuuuuuaaaucaugguc

SEQ ID NO: 293120 - RNA, 64 nt, hsa
cugauaaacuguauacauugugcuccuuucugugggagaagaaagauuugguggagggaagcuu

SEQ ID NO: 293121 - RNA, 64 nt, hsa
uucccuggacuaccuucaggaggcacgagagcugggagaagaggcaaagcuacagguuuacuug

SEQ ID NO: 293122 - RNA, 64 nt, hsa
agugccccugugggaugggaggagugaggcagugggagaagaggugguggucguuucuaugcau

SEQ ID NO: 293123 - RNA, 64 nt, hsa
gcguucugccuuccuuguuaauuuuguaauaauuggagaagauuuaugucagcacacacuuaca

SEQ ID NO: 293124 - RNA, 64 nt, hsa
uuauacaguugaaaacuuguaaucuuccccaggaggagaagaagguuucuggagcaguggacug

SEQ ID NO: 293125 - RNA, 64 nt, hsa
gcaguggauacaaggaagggccuuucucggggccggagaagagaccaagagaccaggcccgggc

SEQ ID NO: 293126 - RNA, 64 nt, hsa
aggccaggguggaagggcggcuugagggacgccaggagaagacugaaugccaggcuaggaagga

SEQ ID NO: 293127 - RNA, 64 nt, hsa
ggcuggaguauuaggggccuggggauuggagaacggagaagaaguuguagcagagggaaaugag

SEQ ID NO: 293128 - RNA, 64 nt, hsa
agaaacacgguuaagggaggucgucacuggggugggagaagaggggcugguagaccgaagccuu

SEQ ID NO: 293129 - RNA, 64 nt, hsa
cugucuuaagagaaagccaaggcacguagaguagggagaagaagggcaccauccucucuuuccu

SEQ ID NO: 293130 - RNA, 64 nt, hsa
uuccuuuggaggugggagugggcuggaggccucuggagaagaccuggggugggggcugaugggg

SEQ ID NO: 293131 - RNA, 64 nt, hsa
ggcuccuccuugccuaaugcagggggucaccgcuggagaagaaccaccacuguccucgaugugu

SEQ ID NO: 293132 - RNA, 64 nt, hsa
ggcgaaguacccaugaagcugcccagacuugggaggagaagaguaucggugcccauggugacuu

SEQ ID NO: 293133 - RNA, 64 nt, hsa
gugggaguagaaaaaucucauucccagagucagaggagaagagacauguaccuugaccaucguc

SEQ ID NO: 293134 - RNA, 64 nt, hsa
gaaagaaugcaagaguggacugaaugugccuaauggagaagacccacgugcuaggggaugaggg

SEQ ID NO: 293135 - RNA, 64 nt, hsa
gaacacugaaaugcagguagacaauucaaagucuggagaagagggaucaugccuggauaugauc

SEQ ID NO: 293136 - RNA, 64 nt, hsa
uucaggcaagugaggucaauguaagaagggaaagggagaagauauuugaagaaccagaauguaa

SEQ ID NO: 293137 - RNA, 64 nt, hsa
gcaaucaggagaagaagcacuuuguuuuaaauguggagaagauaacacuugauuccauuucauu

SEQ ID NO: 293138 - RNA, 64 nt, hsa
cuguuuuacauuucagaccuaaagcuggcaaucaggagaagaagcacuuuguuuuaaaugugga

SEQ ID NO: 293139 - RNA, 64 nt, hsa
ucccuauaagggaaacugaaggaaggauacacauggagaagacuguguggauccaccagaagau

SEQ ID NO: 293140 - RNA, 64 nt, hsa
cucaggucuuaaugaacacauaugaauucacaguggagaagacccugcaucagggaauguggaa

SEQ ID NO: 293141 - RNA, 64 nt, hsa
uccugucuuggccuccccuuucaugagauacuggggagaagagaacauuccuccuggcuuaguu

SEQ ID NO: 293142 - RNA, 64 nt, hsa
uucugacaggggaggugagcuggcgcccucuaguggagaagaauccucagagcauccugaagcc

SEQ ID NO: 293143 - RNA, 64 nt, hsa
ugauaaguuccaaauauguuaagggcuuuaauacaaaaagcaaaaauugucaguguuuggauga

SEQ ID NO: 293144 - RNA, 64 nt, hsa
cacaauaagaaugaaucucagaaaauauuaaggaaaaaagcaaguuugaagagaccacaugggg

SEQ ID NO: 293145 - RNA, 64 nt, hsa
acaaaauaagugggaaaugagaaguuauaccaauaaaaagcauuuaaaaauuuaggggauauug

SEQ ID NO: 293146 - RNA, 64 nt, hsa
ugcccacgaaaauuagucuagcauugccggggguaaaaagcacacacugguccugcagcuuauu

SEQ ID NO: 293147 - RNA, 64 nt, hsa
agacacacauuccuuugaaauccacccaguguuuaaaaagcaacuuggaaauuuacacauuagc

SEQ ID NO: 293148 - RNA, 64 nt, hsa
uauccuuucuuaguuauuugcuccuugcaaauuaaaaaagcaacuaagagaaagaaaaacauug

SEQ ID NO: 293149 - RNA, 64 nt, hsa
uugugcucugccuggagcuguuuccauaugauauaaaaagcaaguguaguauuccauuacuaug

SEQ ID NO: 293150 - RNA, 64 nt, hsa
ugagucccucaggaaaaaaaaaaaauucuguuuuaaaaagcaaucugauucuuagcucuugaaa

SEQ ID NO: 293151 - RNA, 64 nt, hsa
aguaccugccauuuuuacuaauuuuugucuuuaaaaaaagcaaaaaagcacauugaccuaaguu

SEQ ID NO: 293152 - RNA, 64 nt, hsa
ccauuuuuacuaauuuuugucuuuaaaaaaagcaaaaaagcacauugaccuaaguugaaaauua

SEQ ID NO: 293153 - RNA, 64 nt, hsa
aaaagaaaaaaagguuaagcauaaaaagaaagggaaaaagcagaaacacugcagaagacacaaa

SEQ ID NO: 293154 - RNA, 64 nt, hsa
uagauccagugggaaaaaaaauagcguuucacauaaaaagcauagcagcagcucugaaaagaca

SEQ ID NO: 293155 - RNA, 64 nt, hsa
aaaagugaaagagaaauugaaagggaaaaaagacaaaaagcauaaggcuccaaaacgaaagcaa

SEQ ID NO: 293156 - RNA, 64 nt, hsa
uccucaaccugcuguccuccagaaagcaccaaggaaaaagcagagaaugacagcaaacagauca

SEQ ID NO: 293157 - RNA, 64 nt, hsa
uaaaaaauaaaauaaauauaaaauauaggcuuuaaaaaagcauagucuuauuaaccaugucugu

SEQ ID NO: 293158 - RNA, 64 nt, hsa
cagguuaagagauccuguuucauaugcuguauuuaaaaagcaacaaugauaacaacauaguaac

SEQ ID NO: 293159 - RNA, 64 nt, hsa
ccauccuccugaagccuucguuuucaagacuuuuaaaaagcacuucuacuugguuuuuugauca

SEQ ID NO: 293160 - RNA, 64 nt, hsa
auacuucauaauaugugaaaaacucggaucuuuuaaaaagcaucauagaucauuuuuccauaug

SEQ ID NO: 293161 - RNA, 64 nt, hsa
ucaaaauguguuacaugggaagaaaaagauuaagaaaaagcaagauaauuuugaagaaggacga

SEQ ID NO: 293162 - RNA, 64 nt, hsa
caucaugaccagcaaauacucauuuuaggaaaaaaaaaagcaugaucugaaaaauacuuuuggu

SEQ ID NO: 293163 - RNA, 64 nt, hsa
acacacacgagagaucauaaccaugugaaaaggcaaaaagcauguguuugcaacaucugauaac

SEQ ID NO: 293164 - RNA, 64 nt, hsa
gacugaauauaucuaaaauuuccagcaauaaaaaaaaaagcauuuaacuugcaccaagcaagaa

SEQ ID NO: 293165 - RNA, 64 nt, hsa
aacaguauucuuuauuuucuggguguuauauuuaaaaaagcaaguuuggauuuuuacaccuaau

SEQ ID NO: 293166 - RNA, 64 nt, hsa
uccacuuuguccuuucugcucuugugaagaaaaaaaaaagcauuuucgaggaaagaauuaugca

SEQ ID NO: 293167 - RNA, 64 nt, hsa
aaugaauuaaagcaacaaaaagauauugauuggcaaaaagcaagauauaagagauucauuugcu

SEQ ID NO: 293168 - RNA, 64 nt, hsa
ucuuucucuccacucuggcuuguuuucagaaccuaaaaagcagacccaaguuuccuuucuccuc

SEQ ID NO: 293169 - RNA, 64 nt, hsa
auuaauauaaaagagguaggagucuguuauuuaaaaaaagcauuaaauuuaaaaaaaaacuguc

SEQ ID NO: 293170 - RNA, 64 nt, hsa
aauccaucugggcacucauuuaaaguauaucuuaaaaaagcagcagcaagguaccuugccauuu

SEQ ID NO: 293171 - RNA, 64 nt, hsa
uuguuucuuagggaaaacagucugagaaaugaauaaaaagcaugaaguacgugugugugugugu

SEQ ID NO: 293172 - RNA, 64 nt, hsa
acacacaacucugagaauacccacugccagcaucaaaaagcaaagauacuaauuuuuuaagcca

SEQ ID NO: 293173 - RNA, 64 nt, hsa
guaccuuaguacccuucaccuaacaucucucgguaaaaagcagacaagaucacaaauuacagua

SEQ ID NO: 293174 - RNA, 64 nt, hsa
augaagaaauauuuuaaggaaaccuauuugaaaaaaaaagcaaagaccauuugauaaaagccug

SEQ ID NO: 293175 - RNA, 64 nt, hsa
agaauaauagaaaaauucuacuuuaauuuccauuaaaaagcaaauagcauugacacauuuaaag

SEQ ID NO: 293176 - RNA, 64 nt, hsa
acagauuuacaaguguaagcuauaugauuucuucaaaaagcaaaagcaauauaccuaauucauu

SEQ ID NO: 293177 - RNA, 64 nt, hsa
ggucaaaacuagauuggaucuugguuugaaugaaaaaaagcauaaaauauucuugcaauaauug

SEQ ID NO: 293178 - RNA, 64 nt, hsa
agggaggcugcagaagccauuucucuuuguagauaaaaagcauuaucuaugauuguuguauaau

SEQ ID NO: 293179 - RNA, 63 nt, hsa
ugaacaagaaagcacaauaaaaaugaguaacagaaaaagcacauauacuagccuaacagauug

SEQ ID NO: 293180 - RNA, 64 nt, hsa
uuaaauuaaaauggcauucuuaaagauuuucuucaaaaagcaauccuaaaugaaaguguguaaa

SEQ ID NO: 293181 - RNA, 64 nt, hsa
aaacuugcauuauguguuaauuuucuugcaucuaaaaaagcauagaauuccuacucacacagcu

SEQ ID NO: 293182 - RNA, 64 nt, hsa
guguguuauaugacaggacaaagcaaaaacaaacaaaaagcaagccugugaauauaauuuaauu

SEQ ID NO: 293183 - RNA, 64 nt, hsa
uuguuguuuucuguggguugcgacccaugcaaucaaaaagcaaaauuuugauugagauuuuuua

SEQ ID NO: 293184 - RNA, 64 nt, hsa
gugaauaagaaaauaauguuuaaagaaaaaaaaaaaaaagcaaaccuccaaaacguggaccuaa

SEQ ID NO: 293185 - RNA, 64 nt, hsa
uauaugguugaagaaucaaaacaaaagcaaaaaaaaaaagcaaaaaaagaaaagagaaaaaaag

SEQ ID NO: 293186 - RNA, 64 nt, hsa
uagaauucuugaaaaguuaacguagaaaauauccaaaaagcaguauuucuagaaaguguccaaa

SEQ ID NO: 293187 - RNA, 64 nt, hsa
aauauccaaaaagcaguauuucuagaaaguguccaaaaagcaguauuucuuucccuugguugug

SEQ ID NO: 293188 - RNA, 64 nt, hsa
acuuugaagagcuugaagauuugaaagauucccaaaaaagcauuuuaaaguuuacauuuaaggg

SEQ ID NO: 293189 - RNA, 64 nt, hsa
gaaaccuacaucuggcuagugcuuacauuugcucaaaaagcauguuguaugaagcugacugcca

SEQ ID NO: 293190 - RNA, 64 nt, hsa
uagugagagauugagaaugaugcuuaauggaucaaaaaagcaauuaggaguauguuccugauuu

SEQ ID NO: 293191 - RNA, 64 nt, hsa
cuacaccuucacagccaccccagaggacuucccuaaaaagcacaaggcgccugucaucgacauu

SEQ ID NO: 293192 - RNA, 64 nt, hsa
auguugacuucucauccccgaguucuuucaggccaaaaagcaaauggauuuccaccugacaaau

SEQ ID NO: 293193 - RNA, 64 nt, hsa
aauauccauggcaagcuuuguauauaaaugaacaaaaaagcaagcaaagcaaaacaauaaacua

SEQ ID NO: 293194 - RNA, 64 nt, hsa
cuucauaaaacauguaacacugaucuucagauagaaaaagcaaucuguuuauuuaccuguaagg

SEQ ID NO: 293195 - RNA, 64 nt, hsa
agugagguuggaagauacccuaucuuuuuuauucaaaaagcacaaucaaucuuuuguuugaaaa

SEQ ID NO: 293196 - RNA, 53 nt, hsa
cccaggauauggaguuguaguagaaaaagcaccugcuuuucagaaagacuauu

SEQ ID NO: 293197 - RNA, 64 nt, hsa
uugucuugucuaagguggaaaucuugugcuguuuaaaaagcagauuuuauucuuugccuuuugc

SEQ ID NO: 293198 - RNA, 64 nt, hsa
agaaaaaugcuggaacaugcuugauguauuauguaaaaagcauauuuaaacaaggguccucaac

SEQ ID NO: 293199 - RNA, 64 nt, hsa
aauugccccuuugcagagaaaaaaaaaaacuuaaaaaaagcacaugccuacugcugccuguccc

SEQ ID NO: 293200 - RNA, 64 nt, hsa
agguuugacuggccuccagauuccaguuauuuuuaaaaagcaacuuaccacuaaauccuugagu

SEQ ID NO: 293201 - RNA, 64 nt, hsa
aaaaccuuuuagugacaaaauccuaauauguggaaaaaagcauaugcauaaaggaauaauauug

SEQ ID NO: 293202 - RNA, 64 nt, hsa
auugcuuugguuggugcauuuaaguauccaacucaaaaagcauaucaaauauuuuggguacuag

SEQ ID NO: 293203 - RNA, 64 nt, hsa
aucagcauauacauuucagccaaagccauagaagaaaaagcaauaguugcuugaauuaugauca

SEQ ID NO: 293204 - RNA, 64 nt, hsa
uugaaaucagaagaacaaaaaagaagagcaagagaaaaagcaaauuugguaaguugugugugcu

SEQ ID NO: 293205 - RNA, 64 nt, hsa
uccagauuuuuuauaugucugcauguuuaaaaaaaaaaagcaacaaaagaaaaugcacucuaac

SEQ ID NO: 293206 - RNA, 64 nt, hsa
uugcugaauacuuuuuauaaugugaugauuauuaaaaaagcaaaaauuuuggucacuuccaagc

SEQ ID NO: 293207 - RNA, 64 nt, hsa
uuaauaaaagaagacaaaauuuuuuaaauguuagaaaaagcagaucugucauugcaaaguaaca

SEQ ID NO: 293208 - RNA, 64 nt, hsa
aauauauugguaguaauuacuguaauuauucaacaaaaagcauauccguucaaaaauuuuucca

SEQ ID NO: 293209 - RNA, 64 nt, hsa
uuuuuuuccuuuguuuuaaaacugugguuuuuuaaaaaagcaauaauuaacucagaccucacua

SEQ ID NO: 293210 - RNA, 64 nt, hsa
uucuuuguuuuucuuuuuuugggggaggaggggaaaaaagcagcaauacuguguuuggaaauua

SEQ ID NO: 293211 - RNA, 64 nt, hsa
cugauaauaucacaacccagaaguaaccaccuuuaaaaagcaacccccauguaugccuauaugu

SEQ ID NO: 293212 - RNA, 64 nt, hsa
aucauagaaaacuugaaaaaugcagaaauguauaaaaaagcaaaaaugauuacugauaauauca

SEQ ID NO: 293213 - RNA, 64 nt, hsa
guauguguagauauaacuuaaauauggagcuuucaaaaagcacaaauaggcuggacaugguggc

SEQ ID NO: 293214 - RNA, 64 nt, hsa
gccugagugacagagagagauucaaaaaacaaaaaaaaagcaaaaauauacuuugcuauugggu

SEQ ID NO: 293215 - RNA, 64 nt, hsa
aggaaugagggagagaagggggcuguagaguuugaaaaagcauauucaauauuaaaauaguuuu

SEQ ID NO: 293216 - RNA, 64 nt, hsa
ugacuggggaggccucagaaucauggugggaggcaaaaagcacuucuuacauggcggcagcaag

SEQ ID NO: 293217 - RNA, 64 nt, hsa
agccuugcuuuuagagaaugcccaauaaggcaagaaaaagcauaguaacuugugcuuugagagc

SEQ ID NO: 293218 - RNA, 64 nt, hsa
caaaaauuaaaacauugccauauguugaauuuuuaaaaagcacuuggagugagcgaacauuucc

SEQ ID NO: 293219 - RNA, 64 nt, hsa
uaagaaauuugggacuuuuucauguugaaaggagaaaaagcacaaguucccuaguuaccauuua

SEQ ID NO: 293220 - RNA, 64 nt, hsa
auuagaaguguuaggguuagauaaaggaaaagugaaaaagcauaagaaauuugggacuuuuuca

SEQ ID NO: 293221 - RNA, 64 nt, hsa
aggauuacaagcugucucucugacaccagugguaaaaaagcaaguagaauaguuucugagucug

SEQ ID NO: 293222 - RNA, 64 nt, hsa
auaggggccauaucauucauggccaaaaaaaaccaaaaagcaaaaaacaaaaacaagucccaug

SEQ ID NO: 293223 - RNA, 64 nt, hsa
acaauugucuaauuuacagcaguugugaucccacaaaaagcaaguuuauaccucagauuggggu

SEQ ID NO: 293224 - RNA, 64 nt, hsa
acaguaaauccaugucuuuguuuguuuuucuauuaaaaagcaaucaagaaagauaaugugaaaa

SEQ ID NO: 293225 - RNA, 64 nt, hsa
aauugacuccaaugcagaauagugagaaaucaacaaaaagcaaaauaagacaauuccagacacu

SEQ ID NO: 293226 - RNA, 64 nt, hsa
cgucuggaccacuggggaaaauauuuuucuuuucaaaaagcagccccuucagucugcguuccca

SEQ ID NO: 293227 - RNA, 64 nt, hsa
uaaaauuaugcagggccccuaugugggauuuuuuaaaaagcaaacugguguguauucucaugug

SEQ ID NO: 293228 - RNA, 64 nt, hsa
gcgaaacucugucucaaaaaagaaaaaaaagaaaaaaaagcacgugaccuuaugaggcucucgc

SEQ ID NO: 293229 - RNA, 64 nt, hsa
cuuuuacuaccucuggguuagccaaacaaccuucaaaaagcauuguuauuuagguuaaauaucu

SEQ ID NO: 293230 - RNA, 64 nt, hsa
aaggaagugguguucuuuauacaucaauuauuacaaaaagcagugaauuguaagugugaggugu

SEQ ID NO: 293231 - RNA, 64 nt, hsa
agucacuaagcagaauuuagaaagagaaguuuuuaaaaagcaaacaguguaaaaaaagucaucu

SEQ ID NO: 293232 - RNA, 59 nt, hsa
cugcaaauggucaguuguaguauuugcuaaaaaagcacgcaggacauggcuaaagaccu

SEQ ID NO: 293233 - RNA, 64 nt, hsa
aaaugauuuucucugccuugagauuugcaucaagaaaaagcaccucucuucaccugaaagcuuu

SEQ ID NO: 293234 - RNA, 64 nt, hsa
uugguucugugauuuggaugucaacaacuucccuaaaaagcaccaguguguuagguucuaaugu

SEQ ID NO: 293235 - RNA, 64 nt, hsa
ccuaagacaugugaggaggaaaaggaaaaaaagcaaaaagcaagggagaaaagagaaaccggga

SEQ ID NO: 293236 - RNA, 64 nt, hsa
uagcaggccuaagacaugugaggaggaaaaggaaaaaaagcaaaaagcaagggagaaaagagaa

SEQ ID NO: 293237 - RNA, 64 nt, hsa
guugagcaauuucccccuaaaccaacugaaggcuaaaaagcaacaggccauugugaaccaaugc

SEQ ID NO: 293238 - RNA, 64 nt, hsa
caaaguucaacuuggugacacucuauaagauuccaaaaagcacauauuagugcagccaaguagc

SEQ ID NO: 293239 - RNA, 64 nt, hsa
gaauauguguggcagugaagagaacaggucuuucaaaaagcauuugauuauuuuuuuuaaauac

SEQ ID NO: 293240 - RNA, 64 nt, hsa
uuacuauugcucuuacuugaaaacuuuuuuucaaaaaaagcacaaauuaaaguaguaaauucau

SEQ ID NO: 293241 - RNA, 64 nt, hsa
aacaucuuagguauaacagcacaauuucaccuugaaaaagcaccaaaauuaugguguuccugaa

SEQ ID NO: 293242 - RNA, 64 nt, hsa
uugaguauugggaaaguuaauucagauccuacucaaaaagcaucuucacauauuaaaagauuca

SEQ ID NO: 293243 - RNA, 64 nt, hsa
agagucccugaguauaaaggaaaaacagcaaaacaaaaagcaaacaaaaaaaaacugcaaaagu

SEQ ID NO: 293244 - RNA, 64 nt, hsa
cuggagauggcagaagugaaagcuggccaucugcaaaaagcagauaagugaguuugaaccuuuu

SEQ ID NO: 293245 - RNA, 64 nt, hsa
caagucuuuaggagaguagaaaacacaauuaacuaaaaagcagggacaucugaaagagacguau

SEQ ID NO: 293246 - RNA, 64 nt, hsa
ugguaaaagggaugcuagaaauucaacugaagaaaaaaagcaagucaaguacguauucagcauu

SEQ ID NO: 293247 - RNA, 64 nt, hsa
aaaagagcucccaucugaucugcagucauuacagaaaaagcaaauauucccucaacaucagaac

SEQ ID NO: 293248 - RNA, 64 nt, hsa
auaccggacacaccucugcuccaaaggaaauccaaaaaagcaaacacaagaaaucaaaauccaa

SEQ ID NO: 293249 - RNA, 64 nt, hsa
uuggcuuuaaguaaaaauccaaaaaguuuuuuuaaaaaagcaaaggaagcauacuugugaacua

SEQ ID NO: 293250 - RNA, 64 nt, hsa
aauuuugucucauuugccaaaaaaaaaaaaaaaaaaaaagcaaacccccuaugguugauauugu

SEQ ID NO: 293251 - RNA, 64 nt, hsa
cucucagguaagccauuuuauaaaacaagaagauaaaaagcacuguugaggcaguguuugcuuu

SEQ ID NO: 293252 - RNA, 64 nt, hsa
uuccuuugguacaaaaggguugaacgucaggcuaaaaaagcagccaugcauuuauuauuaaaca

SEQ ID NO: 293253 - RNA, 64 nt, hsa
uacuaaugaaaauaauguuuucccauauauuauuaaaaagcauacagucuaaauaauaaacagu

SEQ ID NO: 293254 - RNA, 64 nt, hsa
gugaggcucuuucuauaaauacauauuguuuaaaaaaaagcaagaaaaaaaggaaaacaaagga

SEQ ID NO: 293255 - RNA, 64 nt, hsa
ggcaacagagcgagacccugucuccaaaaaaaaaaaaaagcaauguuuauauuauaaaagagug

SEQ ID NO: 293256 - RNA, 64 nt, hsa
uuggcaguguuuugguucagacaccuguucacagaaaaagcaugaugggaaaauauuuccugac

SEQ ID NO: 293257 - RNA, 64 nt, hsa
cuuuuguaauuguguaaaaaauggaaaaaaacauaaaaagcagaauuuuaaugugaagacauuu

SEQ ID NO: 293258 - RNA, 64 nt, hsa
caggucacuuuuaugccacauuauuuuaauugcaaaaaagcaucuauauauggaggaggguggg

SEQ ID NO: 293259 - RNA, 64 nt, hsa
guuuccagcuuuaucaaagacauguuugaaaaauaaaaagcauccaagugagagcuggugagac

SEQ ID NO: 293260 - RNA, 64 nt, hsa
acugcacugcacuuauaaagcaaaucuauuagaaaaaaagcauuuuucuaaaugcucaaauguu

SEQ ID NO: 293261 - RNA, 64 nt, hsa
cacugucaaguggauggauauucuagcgcucccaaaaaagcacuauggccuuauaugcagggaa

SEQ ID NO: 293262 - RNA, 64 nt, hsa
uagcacuuuuuaaaacaaacaaacaaacaaaacaaaaaagcaaaccacauuuguuaucucaaau

SEQ ID NO: 293263 - RNA, 64 nt, hsa
agauaaugggcuuuguuagcacuuucaaaaaaaaaaaaagcaaaccauacuuguccacuguccu

SEQ ID NO: 293264 - RNA, 64 nt, hsa
gcuuauucaaagacuagguuauuuucaacugggaaaaaagcagugcuaacaggauauuguucug

SEQ ID NO: 293265 - RNA, 64 nt, hsa
cuccaccagggggaaggcuggcacaaggagaaaaaaaaagcaagcaucagcgaauaguauagug

SEQ ID NO: 293266 - RNA, 64 nt, hsa
ucucuguauguuguauuugaucauauuuaaaggaaaaaagcaagcuuauaagcuuucaugaagu

SEQ ID NO: 293267 - RNA, 64 nt, hsa
agacacagccgccacucccccagucuacuucuuuaaaaagcauuuaacagguuaguauuggcau

SEQ ID NO: 293268 - RNA, 64 nt, hsa
aucaaagaaaugugaaauuaaaaagaauucuuccaaaaagcagcuuccauuaaaaugggaauuc

SEQ ID NO: 293269 - RNA, 64 nt, hsa
aggagaaguagcuuaaauucacuaauauuaauuuaaaaagcagcaugaacccucuacuuauaaa

SEQ ID NO: 293270 - RNA, 64 nt, hsa; identical to SEQ ID NO: 90410

SEQ ID NO: 293271 - RNA, 64 nt, hsa; identical to SEQ ID NO: 90411

SEQ ID NO: 293272 - RNA, 64 nt, hsa; identical to SEQ ID NO: 90412

SEQ ID NO: 293273 - RNA, 64 nt, hsa; identical to SEQ ID NO: 90413

SEQ ID NO: 293274 - RNA, 64 nt, hsa; identical to SEQ ID NO: 90414

SEQ ID NO: 293275 - RNA, 64 nt, hsa; identical to SEQ ID NO: 90415

SEQ ID NO: 293276 - RNA, 64 nt, hsa; identical to SEQ ID NO: 90416

SEQ ID NO: 293277 - RNA, 64 nt, hsa; identical to SEQ ID NO: 90417

SEQ ID NO: 293278 - RNA, 64 nt, hsa; identical to SEQ ID NO: 90418

SEQ ID NO: 293279 - RNA, 64 nt, hsa; identical to SEQ ID NO: 90419

SEQ ID NO: 293280 - RNA, 64 nt, hsa; identical to SEQ ID NO: 90420

SEQ ID NO: 293281 - RNA, 64 nt, hsa; identical to SEQ ID NO: 90421

SEQ ID NO: 293282 - RNA, 64 nt, hsa; identical to SEQ ID NO: 90422

SEQ ID NO: 293283 - RNA, 64 nt, hsa; identical to SEQ ID NO: 90423

SEQ ID NO: 293284 - RNA, 64 nt, hsa; identical to SEQ ID NO: 90424

SEQ ID NO: 293285 - RNA, 64 nt, hsa; identical to SEQ ID NO: 90425

SEQ ID NO: 293286 - RNA, 64 nt, hsa; identical to SEQ ID NO: 90426

SEQ ID NO: 293287 - RNA, 64 nt, hsa; identical to SEQ ID NO: 90427

SEQ ID NO: 293288 - RNA, 64 nt, hsa; identical to SEQ ID NO: 90428

SEQ ID NO: 293289 - RNA, 64 nt, hsa; identical to SEQ ID NO: 90429

SEQ ID NO: 293290 - RNA, 64 nt, hsa; identical to SEQ ID NO: 90430

SEQ ID NO: 293291 - RNA, 64 nt, hsa; identical to SEQ ID NO: 90431

SEQ ID NO: 293292 - RNA, 64 nt, hsa; identical to SEQ ID NO: 90432

SEQ ID NO: 293293 - RNA, 64 nt, hsa; identical to SEQ ID NO: 90433

SEQ ID NO: 293294 - RNA, 64 nt, hsa; identical to SEQ ID NO: 90434

SEQ ID NO: 293295 - RNA, 64 nt, hsa; identical to SEQ ID NO: 90435

SEQ ID NO: 293296 - RNA, 64 nt, hsa; identical to SEQ ID NO: 90436

SEQ ID NO: 293297 - RNA, 64 nt, hsa; identical to SEQ ID NO: 90437

SEQ ID NO: 293298 - RNA, 64 nt, hsa; identical to SEQ ID NO: 90438

SEQ ID NO: 293299 - RNA, 64 nt, hsa; identical to SEQ ID NO: 90439

SEQ ID NO: 293300 - RNA, 64 nt, hsa
ucuaagacgcacucuggagccauguagccuggagucaacccauuuuccacggucuuuucugcaa

SEQ ID NO: 293301 - RNA, 64 nt, hsa
ucuucguuucacaaauuaaaaaaaaaaucugguaucaacccacauuuuggcugucuaguauuca

SEQ ID NO: 293302 - RNA, 64 nt, hsa
uugugggcaaagcugagaagcugcaacccagauuucaacccaaaaaggucaagcugaaugccuc

SEQ ID NO: 293303 - RNA, 64 nt, hsa
gcccuggggaauggcaccaguuccagccugggaaucaacccaguuccugagugcccaucccacc

SEQ ID NO: 293304 - RNA, 64 nt, hsa
gagaccuagguugccacgguaacagccaaagacaucaacccaagugcugggucaagugucucau

SEQ ID NO: 293305 - RNA, 64 nt, hsa
augcauggauuguaaaaaaccagcucccuuuggaucaacccagccuggcacccuugccugucug

SEQ ID NO: 293306 - RNA, 64 nt, hsa
cuggcuaauuuuuguauuuuuaguagagaugggguuucgcuauguuggccaggcugaucucaaa

SEQ ID NO: 293307 - RNA, 64 nt, hsa
gcuaauuuuuugugucuuuuuaguagagacgggguuucgcuauguuggccagacuggucuugaa

SEQ ID NO: 293308 - RNA, 64 nt, hsa
gguguucaguaagacuacaaaaacauuuugccuauuucgcuaacaguuugguuuuuaauggcug

SEQ ID NO: 293309 - RNA, 64 nt, hsa
gacucuccaccucagcauugcaucguaucaucauuuucgcuacgaauuuauuuuucaacaauaa

SEQ ID NO: 293310 - RNA, 64 nt, hsa
aaggaacuugggagauuugaaacagugcucggguuuucgcuaggaccgguuugggcuuuguaca

SEQ ID NO: 293311 - RNA, 64 nt, hsa
aaugcaucaguauuaugauuccucuguacuuuccuuucgcuauucaucaauuucccauuuuuuu

SEQ ID NO: 293312 - RNA, 64 nt, hsa
ucaagcucuuugagaacauuccaaacuaguaacauuucgcuacuaaaagcuagaaaggaugaac

SEQ ID NO: 293313 - RNA, 64 nt, hsa
aaggucuggaauccauuuggagcagauaccguguuuucgcuauuuaauaagaaguucaguagug

SEQ ID NO: 293314 - RNA, 64 nt, hsa
uccccgugcccggccacucucuguacuuuaaacauuucgcuauacucucuucuuggcucgugua

SEQ ID NO: 293315 - RNA, 64 nt, hsa
cacuucuuuuaaggcuacuuucagaacuuuguauuuucgcuaaacuauaaaugcaguugugucc

SEQ ID NO: 293316 - RNA, 64 nt, hsa
uccaaagagugugugggcuuuccuguuucuaaacuuucgcuacuauaaaaccaaaaaaaggaau

SEQ ID NO: 293317 - RNA, 64 nt, hsa
uaagucccaucaggacguagucaugccuccugcauuucgcuacccgaguuuaguaacagugcag

SEQ ID NO: 293318 - RNA, 64 nt, hsa
gccuggccuuuuuuucuucagagcuuguugucuuuuucgcuauauuagacuuugcaguaugccc

SEQ ID NO: 293319 - RNA, 64 nt, hsa
ugucuguaaaguguagcaucauauauaaaaagaguuucgcuagcagcgcauuuuuuuuaguuca

SEQ ID NO: 293320 - RNA, 64 nt, hsa
uuccaaaaauuuaggaauguuuaguguaauuggauuucgcuaucaguucccauccuuaaguuuu

SEQ ID NO: 293321 - RNA, 64 nt, hsa
gaagcauaguuagcaucagaaaaugucaccauauuuucgcuagcucaagcaguaccccaaguaa

SEQ ID NO: 293322 - RNA, 64 nt, hsa
ggcaccccuuguuucuguuguucccgugaauuuuuuucgcuaugggaggcagccgaggccuggc

SEQ ID NO: 293323 - RNA, 64 nt, hsa
auacuaccgaacuuuuguucccauaccaguuugguuucgcuaccuuauaagcuauggggaguuu

SEQ ID NO: 293324 - RNA, 64 nt, hsa
aacagcagucuaaucuagugacaccucagucauauuucgcuauagauuuuaccucaaaucaguc

SEQ ID NO: 293325 - RNA, 64 nt, hsa
augacugcagugcagcaguaauuauggugcacuuuuucgcuauuuaaguuggauauuucucuac

SEQ ID NO: 293326 - RNA, 64 nt, hsa
uagcuaggacaacaaugcauuugcaguagugagauuucgcuaaaaaauuaaagccauuuacuau

SEQ ID NO: 293327 - RNA, 64 nt, hsa
aaccuggaugaccuucugaggucucuucagcccuuuucgcuaguggucacccaccaccaugguu

SEQ ID NO: 293328 - RNA, 64 nt, hsa
aaaucuuuguuacucuguaaaugaaaaaacccauuuucgcuauaaauaaaagguaacuguacaa

SEQ ID NO: 293329 - RNA, 64 nt, hsa
cuggcuaauuuuuguguuuuuaguagagacgggguuucgcuauuuuggccgggcugguuucaaa

SEQ ID NO: 293330 - RNA, 64 nt, hsa; identical to SEQ ID NO: 223145

SEQ ID NO: 293331 - RNA, 64 nt, hsa; identical to SEQ ID NO: 223146

SEQ ID NO: 293332 - RNA, 64 nt, hsa; identical to SEQ ID NO: 223147

SEQ ID NO: 293333 - RNA, 64 nt, hsa; identical to SEQ ID NO: 223148

SEQ ID NO: 293334 - RNA, 64 nt, hsa; identical to SEQ ID NO: 223149

SEQ ID NO: 293335 - RNA, 64 nt, hsa; identical to SEQ ID NO: 223150

SEQ ID NO: 293336 - RNA, 64 nt, hsa; identical to SEQ ID NO: 223151

SEQ ID NO: 293337 - RNA, 64 nt, hsa; identical to SEQ ID NO: 223152

SEQ ID NO: 293338 - RNA, 64 nt, hsa; identical to SEQ ID NO: 223153

SEQ ID NO: 293339 - RNA, 64 nt, hsa; identical to SEQ ID NO: 223154

SEQ ID NO: 293340 - RNA, 64 nt, hsa; identical to SEQ ID NO: 223155

SEQ ID NO: 293341 - RNA, 64 nt, hsa; identical to SEQ ID NO: 223156

SEQ ID NO: 293342 - RNA, 64 nt, hsa; identical to SEQ ID NO: 223157

SEQ ID NO: 293343 - RNA, 64 nt, hsa; identical to SEQ ID NO: 223158

SEQ ID NO: 293344 - RNA, 64 nt, hsa; identical to SEQ ID NO: 223159

SEQ ID NO: 293345 - RNA, 64 nt, hsa; identical to SEQ ID NO: 223160

SEQ ID NO: 293346 - RNA, 64 nt, hsa; identical to SEQ ID NO: 223161

SEQ ID NO: 293347 - RNA, 64 nt, hsa; identical to SEQ ID NO: 223162

SEQ ID NO: 293348 - RNA, 64 nt, hsa; identical to SEQ ID NO: 223163

SEQ ID NO: 293349 - RNA, 64 nt, hsa; identical to SEQ ID NO: 223164

SEQ ID NO: 293350 - RNA, 64 nt, hsa; identical to SEQ ID NO: 223165

SEQ ID NO: 293351 - RNA, 64 nt, hsa; identical to SEQ ID NO: 223166

SEQ ID NO: 293352 - RNA, 64 nt, hsa; identical to SEQ ID NO: 223167

SEQ ID NO: 293353 - RNA, 64 nt, hsa; identical to SEQ ID NO: 223168

SEQ ID NO: 293354 - RNA, 64 nt, hsa; identical to SEQ ID NO: 223169

SEQ ID NO: 293355 - RNA, 64 nt, hsa; identical to SEQ ID NO: 223170

SEQ ID NO: 293356 - RNA, 64 nt, hsa; identical to SEQ ID NO: 223171

SEQ ID NO: 293357 - RNA, 64 nt, hsa; identical to SEQ ID NO: 223172

SEQ ID NO: 293358 - RNA, 64 nt, hsa; identical to SEQ ID NO: 223173

SEQ ID NO: 293359 - RNA, 64 nt, hsa; identical to SEQ ID NO: 223174

SEQ ID NO: 293360 - RNA, 64 nt, hsa; identical to SEQ ID NO: 223175

SEQ ID NO: 293361 - RNA, 64 nt, hsa; identical to SEQ ID NO: 223176

SEQ ID NO: 293362 - RNA, 64 nt, hsa; identical to SEQ ID NO: 223177

SEQ ID NO: 293363 - RNA, 64 nt, hsa; identical to SEQ ID NO: 223178

SEQ ID NO: 293364 - RNA, 64 nt, hsa; identical to SEQ ID NO: 223179

SEQ ID NO: 293365 - RNA, 64 nt, hsa; identical to SEQ ID NO: 223180

SEQ ID NO: 293366 - RNA, 64 nt, hsa; identical to SEQ ID NO: 223181

SEQ ID NO: 293367 - RNA, 64 nt, hsa; identical to SEQ ID NO: 223182

SEQ ID NO: 293368 - RNA, 64 nt, hsa; identical to SEQ ID NO: 223183

SEQ ID NO: 293369 - RNA, 64 nt, hsa; identical to SEQ ID NO: 223184

SEQ ID NO: 293370 - RNA, 64 nt, hsa; identical to SEQ ID NO: 223185

SEQ ID NO: 293371 - RNA, 64 nt, hsa; identical to SEQ ID NO: 223186

SEQ ID NO: 293372 - RNA, 64 nt, hsa; identical to SEQ ID NO: 223187

SEQ ID NO: 293373 - RNA, 64 nt, hsa; identical to SEQ ID NO: 223188

SEQ ID NO: 293374 - RNA, 64 nt, hsa; identical to SEQ ID NO: 223189

SEQ ID NO: 293375 - RNA, 64 nt, hsa; identical to SEQ ID NO: 223190

SEQ ID NO: 293376 - RNA, 64 nt, hsa; identical to SEQ ID NO: 223191

SEQ ID NO: 293377 - RNA, 64 nt, hsa; identical to SEQ ID NO: 223192

SEQ ID NO: 293378 - RNA, 64 nt, hsa; identical to SEQ ID NO: 223193

SEQ ID NO: 293379 - RNA, 64 nt, hsa; identical to SEQ ID NO: 223194

SEQ ID NO: 293380 - RNA, 64 nt, hsa; identical to SEQ ID NO: 223195

SEQ ID NO: 293381 - RNA, 57 nt, hsa; identical to SEQ ID NO: 223196

SEQ ID NO: 293382 - RNA, 64 nt, hsa; identical to SEQ ID NO: 223197

SEQ ID NO: 293383 - RNA, 54 nt, hsa; identical to SEQ ID NO: 223198

SEQ ID NO: 293384 - RNA, 64 nt, hsa; identical to SEQ ID NO: 161149

SEQ ID NO: 293385 - RNA, 64 nt, hsa; identical to SEQ ID NO: 161150

SEQ ID NO: 293386 - RNA, 64 nt, hsa; identical to SEQ ID NO: 161151

SEQ ID NO: 293387 - RNA, 64 nt, hsa; identical to SEQ ID NO: 161152

SEQ ID NO: 293388 - RNA, 64 nt, hsa; identical to SEQ ID NO: 161153

SEQ ID NO: 293389 - RNA, 64 nt, hsa; identical to SEQ ID NO: 161154

SEQ ID NO: 293390 - RNA, 64 nt, hsa; identical to SEQ ID NO: 161155

SEQ ID NO: 293391 - RNA, 64 nt, hsa; identical to SEQ ID NO: 161156

SEQ ID NO: 293392 - RNA, 64 nt, hsa; identical to SEQ ID NO: 161157

SEQ ID NO: 293393 - RNA, 64 nt, hsa; identical to SEQ ID NO: 161158

SEQ ID NO: 293394 - RNA, 64 nt, hsa; identical to SEQ ID NO: 161159

SEQ ID NO: 293395 - RNA, 64 nt, hsa; identical to SEQ ID NO: 161160

SEQ ID NO: 293396 - RNA, 64 nt, hsa; identical to SEQ ID NO: 161161

SEQ ID NO: 293397 - RNA, 64 nt, hsa; identical to SEQ ID NO: 161162

SEQ ID NO: 293398 - RNA, 64 nt, hsa; identical to SEQ ID NO: 161163

SEQ ID NO: 293399 - RNA, 64 nt, hsa; identical to SEQ ID NO: 161164

SEQ ID NO: 293400 - RNA, 64 nt, hsa; identical to SEQ ID NO: 161165

SEQ ID NO: 293401 - RNA, 64 nt, hsa; identical to SEQ ID NO: 161166

SEQ ID NO: 293402 - RNA, 64 nt, hsa; identical to SEQ ID NO: 161167

SEQ ID NO: 293403 - RNA, 64 nt, hsa; identical to SEQ ID NO: 161168

SEQ ID NO: 293404 - RNA, 64 nt, hsa; identical to SEQ ID NO: 161169

SEQ ID NO: 293405 - RNA, 64 nt, hsa; identical to SEQ ID NO: 161170

SEQ ID NO: 293406 - RNA, 64 nt, hsa; identical to SEQ ID NO: 161171

SEQ ID NO: 293407 - RNA, 64 nt, hsa; identical to SEQ ID NO: 161172

SEQ ID NO: 293408 - RNA, 64 nt, hsa; identical to SEQ ID NO: 161173

SEQ ID NO: 293409 - RNA, 64 nt, hsa; identical to SEQ ID NO: 161174

SEQ ID NO: 293410 - RNA, 64 nt, hsa; identical to SEQ ID NO: 161175

SEQ ID NO: 293411 - RNA, 64 nt, hsa; identical to SEQ ID NO: 161176

SEQ ID NO: 293412 - RNA, 64 nt, hsa; identical to SEQ ID NO: 161177

SEQ ID NO: 293413 - RNA, 64 nt, hsa; identical to SEQ ID NO: 161178

SEQ ID NO: 293414 - RNA, 64 nt, hsa; identical to SEQ ID NO: 161179

SEQ ID NO: 293415 - RNA, 64 nt, hsa; identical to SEQ ID NO: 161180

SEQ ID NO: 293416 - RNA, 64 nt, hsa; identical to SEQ ID NO: 161181

SEQ ID NO: 293417 - RNA, 64 nt, hsa; identical to SEQ ID NO: 161182

SEQ ID NO: 293418 - RNA, 64 nt, hsa; identical to SEQ ID NO: 161183

SEQ ID NO: 293419 - RNA, 64 nt, hsa
ccuggaugcuauccacacccaccuaucccugcagcuaauuuagcugaucucuaauuuaacugag

SEQ ID NO: 293420 - RNA, 64 nt, hsa
acccaccuaucccugcagcuaauuuagcugaucucuaauuuaacugagcucuaauuuagcugau

SEQ ID NO: 293421 - RNA, 64 nt, hsa
agcuaauuuagcugaucucuaauuuaacugagcucuaauuuagcugaucagauuuugcuugggu

SEQ ID NO: 293422 - RNA, 64 nt, hsa
ugaauuauaguucuaauuuauuauuacuuuuuuucuaauuuacugaucuuacuacuacaaagaa

SEQ ID NO: 293423 - RNA, 64 nt, hsa
aauauuuagugugcuacagaucugaauuauaguucuaauuuauuauuacuuuuuuucuaauuua

SEQ ID NO: 293424 - RNA, 64 nt, hsa
caagagaagggaaauacuaggaacuaagacauuucuaauuuauugcuuauuacuuucuuaauuu

SEQ ID NO: 293425 - RNA, 64 nt, hsa
cagaagaauuagaggaaaagcagauacuagaauucuaauuuaauuacauauacagccgucuuug

SEQ ID NO: 293426 - RNA, 64 nt, hsa
uagaauuauaucuaauuuauacaaaauaauuuaacuaauuuaaaccagcagaaaagugcuuaga

SEQ ID NO: 293427 - RNA, 64 nt, hsa
aauuuuuauacauaucagaaaaguagaauuauaucuaauuuauacaaaauaauuuaacuaauuu

SEQ ID NO: 293428 - RNA, 64 nt, hsa
uaaaaguuuguuuacaauuccacaagcaaaagcucuaauuuaaccagauuuucugacauugaag

SEQ ID NO: 293429 - RNA, 64 nt, hsa
uaaaauucuaccuauuaggugucagguuaaaguucuaauuuaucuuuagaaauuuaugugaaaa

SEQ ID NO: 293430 - RNA, 64 nt, hsa
agguuggggcauaugggagcuuaauauaucauaucuaauuuaaaauaauuucacugaaauaaac

SEQ ID NO: 293431 - RNA, 64 nt, hsa
uguaguguaugguaagucauaucagauaucagaccuaauuuaaauuucauuuuagcuuuacaag

SEQ ID NO: 293432 - RNA, 64 nt, hsa
uuucacaauauuuuaacugauuuuuaauccaaaacuaauuuauaagacaguauguauaguaaua

SEQ ID NO: 293433 - RNA, 64 nt, hsa
gccaugaguauucuucccauaacuaaauggguuucuaauuuaauuugaagggaauaaaauuugu

SEQ ID NO: 293434 - RNA, 64 nt, hsa
gguagaguaacaccuuuauacgugugcuugccuccuaauuuaaaauacuguauucgcauguaga

SEQ ID NO: 293435 - RNA, 64 nt, hsa
gaaguaaaucgaccgucaagagaagacuuggccucuaauuuauauugcuuugcacuuugguuug

SEQ ID NO: 293436 - RNA, 64 nt, hsa
aagcugugaacagaguugugucugaggaaugugccuaauuuaaggcaggguuuguuccaaugca

SEQ ID NO: 293437 - RNA, 64 nt, hsa
auauuaauagguuguuuaucuuuuugccuguuugcuaauuuaaaaauauuuauuuuaucauuuu

SEQ ID NO: 293438 - RNA, 64 nt, hsa
ugcaacaaagggcagcaagaaaugcuggguccaccuaauuuaacacaaaaugaaguugagauuc

SEQ ID NO: 293439 - RNA, 64 nt, hsa
gaggggggggggggcaggguagguggggcuuucccuaauuuaucuucauguccagugagcagug

SEQ ID NO: 293440 - RNA, 64 nt, hsa
uucuguagauucaugcaaguggagcugucugucucuaauuuaacuuauugcuagauaauagggu

SEQ ID NO: 293441 - RNA, 64 nt, hsa
augaccagauguaggcuuagccaguuuauuuucucuaauuuaauggauaauaaauauuaagcuc

SEQ ID NO: 293442 - RNA, 64 nt, hsa
aacucuugccguaucaggagacugaaaguucauacuaauuuacaaacuuuguaaagacuggugc

SEQ ID NO: 293443 - RNA, 64 nt, hsa
ucagauuguguuugaaaauuauauacugagcauacuaauuuaaaaagagaacuuguugaaauuu

SEQ ID NO: 293444 - RNA, 64 nt, hsa
uccuguaguauaaauuuuauuuucacauacuuagcuaauuuagcaguaauuggcccaguuuuuu

SEQ ID NO: 293445 - RNA, 64 nt, hsa
aagguuguccuaaacagaccaaggagacuguucccuaauuuauucucuuggcugguucucucau

SEQ ID NO: 293446 - RNA, 64 nt, hsa
auuuaggguggcagccaauaaaggugguuggugucuaauuuaaguguuaaaucaauuucuuuca

SEQ ID NO: 293447 - RNA, 64 nt, hsa
caguaaaagugaaauauuacuguuuuaaggaaaacuaauuuaggguggcagccaauaaaggugg

SEQ ID NO: 293448 - RNA, 64 nt, hsa
aaggacuaauuuaaacacauaucaaugugaaggacuaauuuaaauuacuaucauuuaugauugc

SEQ ID NO: 293449 - RNA, 64 nt, hsa
acagaacaaaaggcagaaaaggcauaccuaaggacuaauuuaaacacauaucaaugugaaggac

SEQ ID NO: 293450 - RNA, 64 nt, hsa
uuuauauuacaaaguuggcauacagggucaauaucuaauuuacuguuguguuuuucuuaauaug

SEQ ID NO: 293451 - RNA, 64 nt, hsa
uuuaaaaaacuaucaaaguagguuaaauuaaaaucuaauuuaaauuagguuaauuuauauuaca

SEQ ID NO: 293452 - RNA, 64 nt, hsa
aaucucaaugcaguugaaaucuggucugaugugccuaauuuaucuguggaaaauuuaaugcuga

SEQ ID NO: 293453 - RNA, 64 nt, hsa
uacauucacugugaguuucaaagggagucagucccuaauuuacagguuuccuuuguucacuuuc

SEQ ID NO: 293454 - RNA, 64 nt, hsa
aaaaugaucuaaauuauuguuuuaauuuuuaaaccuaauuuauucacucagugaacauucuuac

SEQ ID NO: 293455 - RNA, 64 nt, hsa
ggaggcaggcacacguccuccagcccaagacugccuaauuuaacagggauuucugcauucugga

SEQ ID NO: 293456 - RNA, 64 nt, hsa
agcugggacuacaggcaugcaccaccaagcuuggcuaauuuaaaaaaaaaauuauauagauagg

SEQ ID NO: 293457 - RNA, 64 nt, hsa
auuccaucuuucugagaaaaagggaagaucauagcuaauuuauaauagcucaaauuacuaauuu

SEQ ID NO: 293458 - RNA, 64 nt, hsa
gaagaucauagcuaauuuauaauagcucaaauuacuaauuuaauaacugggucaccaguguuuc

SEQ ID NO: 293459 - RNA, 64 nt, hsa
gggcccucccagcacaaaguugcauuccuccccccuaauuuauucuaauuuauuaacuuugacc

SEQ ID NO: 293460 - RNA, 64 nt, hsa
agcacaaaguugcauuccuccccccuaauuuauucuaauuuauuaacuuugacccacccuuucu

SEQ ID NO: 293461 - RNA, 64 nt, hsa; identical to SEQ ID NO: 161149

SEQ ID NO: 293462 - RNA, 64 nt, hsa; identical to SEQ ID NO: 161150

SEQ ID NO: 293463 - RNA, 64 nt, hsa; identical to SEQ ID NO: 161151

SEQ ID NO: 293464 - RNA, 64 nt, hsa; identical to SEQ ID NO: 161152

SEQ ID NO: 293465 - RNA, 64 nt, hsa; identical to SEQ ID NO: 161153

SEQ ID NO: 293466 - RNA, 64 nt, hsa; identical to SEQ ID NO: 161154

SEQ ID NO: 293467 - RNA, 64 nt, hsa; identical to SEQ ID NO: 161155

SEQ ID NO: 293468 - RNA, 64 nt, hsa; identical to SEQ ID NO: 161156

SEQ ID NO: 293469 - RNA, 64 nt, hsa; identical to SEQ ID NO: 161157

SEQ ID NO: 293470 - RNA, 64 nt, hsa; identical to SEQ ID NO: 161158

SEQ ID NO: 293471 - RNA, 64 nt, hsa; identical to SEQ ID NO: 161159

SEQ ID NO: 293472 - RNA, 64 nt, hsa; identical to SEQ ID NO: 161160

SEQ ID NO: 293473 - RNA, 64 nt, hsa; identical to SEQ ID NO: 161161

SEQ ID NO: 293474 - RNA, 64 nt, hsa; identical to SEQ ID NO: 161162

SEQ ID NO: 293475 - RNA, 64 nt, hsa; identical to SEQ ID NO: 161163

SEQ ID NO: 293476 - RNA, 64 nt, hsa; identical to SEQ ID NO: 161164

SEQ ID NO: 293477 - RNA, 64 nt, hsa; identical to SEQ ID NO: 161165

SEQ ID NO: 293478 - RNA, 64 nt, hsa; identical to SEQ ID NO: 161166

SEQ ID NO: 293479 - RNA, 64 nt, hsa; identical to SEQ ID NO: 161167

SEQ ID NO: 293480 - RNA, 64 nt, hsa; identical to SEQ ID NO: 161168

SEQ ID NO: 293481 - RNA, 64 nt, hsa; identical to SEQ ID NO: 161169

SEQ ID NO: 293482 - RNA, 64 nt, hsa; identical to SEQ ID NO: 161170

SEQ ID NO: 293483 - RNA, 64 nt, hsa; identical to SEQ ID NO: 161171

SEQ ID NO: 293484 - RNA, 64 nt, hsa; identical to SEQ ID NO: 161172

SEQ ID NO: 293485 - RNA, 64 nt, hsa; identical to SEQ ID NO: 161173

SEQ ID NO: 293486 - RNA, 64 nt, hsa; identical to SEQ ID NO: 161174

SEQ ID NO: 293487 - RNA, 64 nt, hsa; identical to SEQ ID NO: 161175

SEQ ID NO: 293488 - RNA, 64 nt, hsa; identical to SEQ ID NO: 161176

SEQ ID NO: 293489 - RNA, 64 nt, hsa; identical to SEQ ID NO: 161177

SEQ ID NO: 293490 - RNA, 64 nt, hsa; identical to SEQ ID NO: 161178

SEQ ID NO: 293491 - RNA, 64 nt, hsa; identical to SEQ ID NO: 161179

SEQ ID NO: 293492 - RNA, 64 nt, hsa; identical to SEQ ID NO: 161180

SEQ ID NO: 293493 - RNA, 64 nt, hsa; identical to SEQ ID NO: 161181

SEQ ID NO: 293494 - RNA, 64 nt, hsa; identical to SEQ ID NO: 161182

SEQ ID NO: 293495 - RNA, 64 nt, hsa; identical to SEQ ID NO: 161183

SEQ ID NO: 293496 - RNA, 64 nt, hsa; identical to SEQ ID NO: 293419

SEQ ID NO: 293497 - RNA, 64 nt, hsa; identical to SEQ ID NO: 293420

SEQ ID NO: 293498 - RNA, 64 nt, hsa; identical to SEQ ID NO: 293421

SEQ ID NO: 293499 - RNA, 64 nt, hsa; identical to SEQ ID NO: 293422

SEQ ID NO: 293500 - RNA, 64 nt, hsa; identical to SEQ ID NO: 293423

SEQ ID NO: 293501 - RNA, 64 nt, hsa; identical to SEQ ID NO: 293424

SEQ ID NO: 293502 - RNA, 64 nt, hsa; identical to SEQ ID NO: 293425

SEQ ID NO: 293503 - RNA, 64 nt, hsa; identical to SEQ ID NO: 293426

SEQ ID NO: 293504 - RNA, 64 nt, hsa; identical to SEQ ID NO: 293427

SEQ ID NO: 293505 - RNA, 64 nt, hsa; identical to SEQ ID NO: 293428

SEQ ID NO: 293506 - RNA, 64 nt, hsa; identical to SEQ ID NO: 293429

SEQ ID NO: 293507 - RNA, 64 nt, hsa; identical to SEQ ID NO: 293430

SEQ ID NO: 293508 - RNA, 64 nt, hsa; identical to SEQ ID NO: 293431

SEQ ID NO: 293509 - RNA, 64 nt, hsa; identical to SEQ ID NO: 293432

SEQ ID NO: 293510 - RNA, 64 nt, hsa; identical to SEQ ID NO: 293433

SEQ ID NO: 293511 - RNA, 64 nt, hsa; identical to SEQ ID NO: 293434

SEQ ID NO: 293512 - RNA, 64 nt, hsa; identical to SEQ ID NO: 293435

SEQ ID NO: 293513 - RNA, 64 nt, hsa; identical to SEQ ID NO: 293436

SEQ ID NO: 293514 - RNA, 64 nt, hsa; identical to SEQ ID NO: 293437

SEQ ID NO: 293515 - RNA, 64 nt, hsa; identical to SEQ ID NO: 293438

SEQ ID NO: 293516 - RNA, 64 nt, hsa; identical to SEQ ID NO: 293439

SEQ ID NO: 293517 - RNA, 64 nt, hsa; identical to SEQ ID NO: 293440

SEQ ID NO: 293518 - RNA, 64 nt, hsa; identical to SEQ ID NO: 293441

SEQ ID NO: 293519 - RNA, 64 nt, hsa; identical to SEQ ID NO: 293442

SEQ ID NO: 293520 - RNA, 64 nt, hsa; identical to SEQ ID NO: 293443

SEQ ID NO: 293521 - RNA, 64 nt, hsa; identical to SEQ ID NO: 293444

SEQ ID NO: 293522 - RNA, 64 nt, hsa; identical to SEQ ID NO: 293445

SEQ ID NO: 293523 - RNA, 64 nt, hsa; identical to SEQ ID NO: 293446

SEQ ID NO: 293524 - RNA, 64 nt, hsa; identical to SEQ ID NO: 293447

SEQ ID NO: 293525 - RNA, 64 nt, hsa; identical to SEQ ID NO: 293448

SEQ ID NO: 293526 - RNA, 64 nt, hsa; identical to SEQ ID NO: 293449

SEQ ID NO: 293527 - RNA, 64 nt, hsa; identical to SEQ ID NO: 293450

SEQ ID NO: 293528 - RNA, 64 nt, hsa; identical to SEQ ID NO: 293451

SEQ ID NO: 293529 - RNA, 64 nt, hsa; identical to SEQ ID NO: 293452

SEQ ID NO: 293530 - RNA, 64 nt, hsa; identical to SEQ ID NO: 293453

SEQ ID NO: 293531 - RNA, 64 nt, hsa; identical to SEQ ID NO: 293454

SEQ ID NO: 293532 - RNA, 64 nt, hsa; identical to SEQ ID NO: 293455

SEQ ID NO: 293533 - RNA, 64 nt, hsa; identical to SEQ ID NO: 293456

SEQ ID NO: 293534 - RNA, 64 nt, hsa; identical to SEQ ID NO: 293457

SEQ ID NO: 293535 - RNA, 64 nt, hsa; identical to SEQ ID NO: 293458

SEQ ID NO: 293536 - RNA, 64 nt, hsa; identical to SEQ ID NO: 293459

SEQ ID NO: 293537 - RNA, 64 nt, hsa; identical to SEQ ID NO: 293460

SEQ ID NO: 293538 - RNA, 64 nt, hsa
aaguagaaagugagacucaauaauaacugaacuacagcaaaaggcagagaauuacagggagaaa

SEQ ID NO: 293539 - RNA, 64 nt, hsa
uccagaggggucuggagcuuuguuuccuguucaccagcaaaaaaugucucucccauuuuucuga

SEQ ID NO: 293540 - RNA, 64 nt, hsa
cuuuuugcauuuugguguauaagccaucaauauucagcaaaaugauuccuuucuuuaaaaaaaa

SEQ ID NO: 293541 - RNA, 64 nt, hsa
cucacagcgcagcaagugaggcucccacaggcaccagcaaaacaacggaugaauguagcccuuc

SEQ ID NO: 293542 - RNA, 64 nt, hsa
gguuaucuuuuuuuuuuuccccuccuauuuuaaucagcaaaauccauaccaaaacaacgacaac

SEQ ID NO: 293543 - RNA, 64 nt, hsa
cucagauuuguguguucaaucaaugggcuuaaaucagcaaaauauuaugccuaaaguaaaucug

SEQ ID NO: 293544 - RNA, 64 nt, hsa
auucaaaucugccuuuuaggaccuggcuuugugacagcaaaaaccaucuuuacaggcuccuaga

SEQ ID NO: 293545 - RNA, 64 nt, hsa
uuuaaacuucauaaccuuuuuauaaaaguuguugcagcaaaauaauagccucgguucuaugcau

SEQ ID NO: 293546 - RNA, 64 nt, hsa
cuuaggcagacaucgaaccucucugggauguuuccagcaaaagugagcuuuucuaaucgucuca

SEQ ID NO: 293547 - RNA, 64 nt, hsa
guuccugacauaguaaaguuugcuuucauaacugcagcaaaaaaggucaacuugccaagucacu

SEQ ID NO: 293548 - RNA, 64 nt, hsa
gaggggagcaaguggggaccuggccauggccccucagcaaaaaccuauucacagcgggugggga

SEQ ID NO: 293549 - RNA, 64 nt, hsa
acucccgccucacuucgucucuacagaauguucacagcaaaacacguuuggucuguuuuuagau

SEQ ID NO: 293550 - RNA, 64 nt, hsa
agccugggaugcugccguaccaagaggaaagaagcagcaaaaugccuuuacguuguucuaaacc

SEQ ID NO: 293551 - RNA, 64 nt, hsa
uuaaucugugaccauugggcaaaaaauuuuccugcagcaaaagucugaggcuguugggaccauu

SEQ ID NO: 293552 - RNA, 64 nt, hsa
ccauaaugcagagugggcccccuacuccauuucccagcaaaaggcuccagcuggagggaugggu

SEQ ID NO: 293553 - RNA, 64 nt, hsa
gaacagggcagcucuguuugaauggggugaaaaacagcaaaauuaauucuuagcaagcuccuug

SEQ ID NO: 293554 - RNA, 64 nt, hsa
aagacaagugcucaagcagcaaaauccuuacuuccagcaaaauccaaacugcugucucuuaaau

SEQ ID NO: 293555 - RNA, 64 nt, hsa
aaauggaauuacuccaaaaagacaagugcucaagcagcaaaauccuuacuuccagcaaaaucca

SEQ ID NO: 293556 - RNA, 64 nt, hsa
auuguuucuuuucucuuuguuaacugugucauuacagcaaaauacuagcagucugccuaaacau

SEQ ID NO: 293557 - RNA, 64 nt, hsa
ugggcccaaauauucuuuguaaagaaaaucgcugcagcaaaaacuguuacuguguuuauuauau

SEQ ID NO: 293558 - RNA, 64 nt, hsa
uauuuugauaaguauuagagguuaaccuuaaauccagcaaaacauuaaaacagaaacuuuucaa

SEQ ID NO: 293559 - RNA, 64 nt, hsa
gacauuucaacaaugauacaguccugucauuuaucagcaaaagauugggaauuuucuccuguca

SEQ ID NO: 293560 - RNA, 64 nt, hsa
cuucaucaagaaaaaguggaaccagcugucccuccagcaaaaacagcagcccuaauagcagccc

SEQ ID NO: 293561 - RNA, 64 nt, hsa
ggagcaaagggaggcuccggcugccccagauuggcagcaaaaauaagccgucaaguaguaagaa

SEQ ID NO: 293562 - RNA, 64 nt, hsa
ugguacuccugacgaauauaggugccaaaauccucagcaaaauacuaguaaaccaaauccaucu

SEQ ID NO: 293563 - RNA, 64 nt, hsa
aagugggaccuaauuaaacuaaauaacuucugcacagcaaaagaagcuauuugcagacuacaga

SEQ ID NO: 293564 - RNA, 64 nt, hsa
ucaguauugagacacugucaagauuaaguuauaccagcaaaagugcaguagugucacuuuuuuc

SEQ ID NO: 293565 - RNA, 64 nt, hsa
gauggauuugacacacucaccauuuaaucauuuccagcaaaauauauguuuggcugaaauuaug

SEQ ID NO: 293566 - RNA, 64 nt, hsa
auuuuccuaggguuaacaccucaccaaguucuuccagcaaaaugcuuauuagaguuuuugucug

SEQ ID NO: 293567 - RNA, 64 nt, hsa
acucaacccaaacaaaacuacuucgugaggcuuucagcaaaaaggcugcuuaaaagcaugaacc

SEQ ID NO: 293568 - RNA, 64 nt, hsa
ugaugccucugcaagauacugugaggagaauugacagcaaaaguucaccaccuacucuuauuua

SEQ ID NO: 293569 - RNA, 64 nt, hsa
gacuuuucuucauauuuugcaaagagaaauuucacagcaaaaauucauguuuugucagcuuucu

SEQ ID NO: 293570 - RNA, 64 nt, hsa
aguugucuuuguagaaaaugaagagccuuucuuccagcaaaaaucccugcuguaugcaauagcc

SEQ ID NO: 293571 - RNA, 64 nt, hsa
gaugagaaauaugguaacggguuuguaacugccacagcaaaacaauuugccuccaugccugaau

SEQ ID NO: 293572 - RNA, 64 nt, hsa
uucagcaucuugguugaacuugcuuucauugucccugggauauuguggaaggaaaggugacugu

SEQ ID NO: 293573 - RNA, 64 nt, hsa
aacuccuccuccuccuccuccucuccugcugcuccugggauaccaggucagugauguagucuug

SEQ ID NO: 293574 - RNA, 64 nt, hsa
agaagugauaccucuagacuggguuuauauuaaucugggauauaaaugaagaagacauacuaau

SEQ ID NO: 293575 - RNA, 64 nt, hsa
uaauucuuucuaguaucuuguagaucuaaugggucugggauaaaaacuuugaaaagugucaaua

SEQ ID NO: 293576 - RNA, 64 nt, hsa
aaugucuuagacaauuaccuuuacauuucaagcucugggauauaaauuacguagucagcauuaa

SEQ ID NO: 293577 - RNA, 64 nt, hsa
acucacuaguuuauaggccugaccuuuuaaauuccugggauaaauuuuagaauauuaaauucuu

SEQ ID NO: 293578 - RNA, 64 nt, hsa
ccucacuugggauucucagcaguuacaugaaaguugugcugauaaucucuucucuuguaccaau

SEQ ID NO: 293579 - RNA, 64 nt, hsa
ugaauuuuguuuuauucuuccuaagacugaggauugugcugaguccagagucauugugguaacu

SEQ ID NO: 293580 - RNA, 64 nt, hsa
ugcagggugggccugaucccagaguggugcuuacugugcugacuguguacuuaucuuccccaag

SEQ ID NO: 293581 - RNA, 64 nt, hsa
ucuuuacauauuacuauauggaaaugaauugcucugugcugaaauuugaagaccagauaaugaa

SEQ ID NO: 293582 - RNA, 64 nt, hsa
ugugcuuugucucucugugcugaggccuggacccugugcugagcuggugacucacuguccugac

SEQ ID NO: 293583 - RNA, 64 nt, hsa
cuucaggcagccucucaaaugugcuuugucucucugugcugaggccuggacccugugcugagcu

SEQ ID NO: 293584 - RNA, 64 nt, hsa
uaaguguccuucucucccaggaugagugaggagcugugcugauguugggaacuuaucuuuuucc

SEQ ID NO: 293585 - RNA, 64 nt, hsa
ucagagaggaccugguggggagggagggcuuuccugugcugacagcgcucccucaggagggccu

SEQ ID NO: 293586 - RNA, 64 nt, hsa
ugccuacuaggugaaacauaacaauaaaacuaccugugcugaaauuugggggaaguuuaggucc

SEQ ID NO: 293587 - RNA, 64 nt, hsa
cuuucaaugauaaagguuuguuguaguugucuuaugugcugaauuugcagaugaucagaugcug

SEQ ID NO: 293588 - RNA, 64 nt, hsa
aacaucuacacuucauuuucaaguuaaccauuuuugugcugaagaaauauuuucauguguaaga

SEQ ID NO: 293589 - RNA, 64 nt, hsa
auuuuuuuaagcauugcagauaucaaaguucuauugugcugaauaaaugccccuuuguuaacag

SEQ ID NO: 293590 - RNA, 64 nt, hsa
aggucaccacggggucguugguuuaggcauccugugugcugacaggagacccagagagcuaggg

SEQ ID NO: 293591 - RNA, 64 nt, hsa
acaaaggcccagcagccuucugacaagcaagggcugugcugaggucaccacggggucguugguu

SEQ ID NO: 293592 - RNA, 64 nt, hsa
ggcaccuggugagagccugcugugugccaggcuuugugcugagugcuguacauguauuaguucc

SEQ ID NO: 293593 - RNA, 64 nt, hsa
accugccacugccacaguagcucaaccaagcaguugugcugagaauggcaccuggugagagccu

SEQ ID NO: 293594 - RNA, 64 nt, hsa
uucagucuaagucucguauuugcuuugcugucugugugcugaagcucgucccgugugaguugcu

SEQ ID NO: 293595 - RNA, 64 nt, hsa
uacuauugcuguaguguuaggaaaguauuaaguuugugcugaaaauccauugccauuugguaca

SEQ ID NO: 293596 - RNA, 64 nt, hsa
accugcccgagguguuugcccccaacgccccggaugugcugagcugccuggagcucagguacaa

SEQ ID NO: 293597 - RNA, 64 nt, hsa
ccggagagcugcucaacccgcuggugcugaacucugugcugagcaaggcccugcagugcagccu

SEQ ID NO: 293598 - RNA, 64 nt, hsa
uaugacuauaaagggaugacgcaaggaguuccuuugugcugauggaacaguucuauaugauuau

SEQ ID NO: 293599 - RNA, 64 nt, hsa
uuugauuaugagguuaagcacaugagucuuuaccugugcugaaguuguauggaccuacauacac

SEQ ID NO: 293600 - RNA, 64 nt, hsa
ugaaccacaaguauccagcuuaaucacguaucuuacucacgauaccacugguccagaugaguuu

SEQ ID NO: 293601 - RNA, 64 nt, hsa
gacgcacagagaggucucuuccugacccagacgcacucacgagccagguccuggggguaugggg

SEQ ID NO: 293602 - RNA, 64 nt, hsa
gccuugcccguggggaguaagaguuaauaaacacacucacgaaaaguucugaauagugucugug

SEQ ID NO: 293603 - RNA, 64 nt, hsa
auugaauuggauacaaggaucagaauggaaagaaacucacgaugaaauugaaccugguuuuugu

SEQ ID NO: 293604 - RNA, 64 nt, hsa
uuauaugaggggcaguggacaguucccuaugccaacucacgacuccuacagguacuagucacuc

SEQ ID NO: 293605 - RNA, 64 nt, hsa
uccuauuuucucauuuccagguuauuauaaugaaacucacgaaucuacggacauuuugcuuuca

SEQ ID NO: 293606 - RNA, 64 nt, hsa
auggaaaauaagcuuuauguuucaagaagggcagacucacgaauuuuuuagaaaacagugcuuc

SEQ ID NO: 293607 - RNA, 64 nt, hsa
ggacgcuggguccuccucucugggacacagggguacucacgaaaacugggccgcgugguuuggu

SEQ ID NO: 293608 - RNA, 64 nt, hsa
caaauuguuuaucaugaaugcaggaugugggcaaacucacgacugcuccugccaacagaagguu

SEQ ID NO: 293609 - RNA, 64 nt, hsa
ggaggucagguucauuuuguuacauaugcaauaaacucacgacuuuacauuuuuggcgucuguu

SEQ ID NO: 293610 - RNA, 64 nt, hsa
agccuaggucagccaacccccauccaacccuuagacucacgaacaaauccaccugagaucagca

SEQ ID NO: 293611 - RNA, 64 nt, hsa
cuuuuuuuaagaaccauuuucaucugauuuuuaaacucacgauaccaguuaucuguuaaucaaa

SEQ ID NO: 293612 - RNA, 64 nt, hsa
cuccgccugcuuccuccagaagacacgaaucaugacucacgauugcugaagccugagcaggucu

SEQ ID NO: 293613 - RNA, 64 nt, hsa
ugugacuccugagcgugcgcugucuucuagguuaacucacgaaguacauucucugucuuacuga

SEQ ID NO: 293614 - RNA, 64 nt, hsa
gacggcagacagcuauauuuaguggugccucgacacucacgaaccgccagcguggcgccuggau

SEQ ID NO: 293615 - RNA, 64 nt, hsa
gggcagccuguugaaacugaagcacagucugaccacucacgauaaagcagauuuuucucugccu

SEQ ID NO: 293616 - RNA, 64 nt, hsa
uugagcauggcuugaguugguaaggaaagcuguaacucacgaagcccugagaccugcuaccccu

SEQ ID NO: 293617 - RNA, 64 nt, hsa
guccagcgccuaguggggucucccucuccugccuacucacgauaaauaaucggcccacagcucc

SEQ ID NO: 293618 - RNA, 64 nt, hsa
ggugccugagcugugagaaguguccucagccgacacucacgagggcagugcaagggagaaccug

SEQ ID NO: 293619 - RNA, 64 nt, hsa
uccuaaaugguaaucuggccggccugggagaaagacucacgagaaaagccaguggagaaagcgc

SEQ ID NO: 293620 - RNA, 64 nt, hsa
uuucaucccugccaagaacucugggcacuuuugaacucacgagccuugcgcaaaacccagaaga

SEQ ID NO: 293621 - RNA, 64 nt, hsa
aaauaaauaaaauagcucugucuuucaaugaaacacucacgaugacuacugcgccuucucuuuc

SEQ ID NO: 293622 - RNA, 64 nt, hsa
uaagagagauggaggcuguggcggacuccuuccaacucacgauuuauccucagcucagagugua

SEQ ID NO: 293623 - RNA, 64 nt, hsa
aaagggcccagcucugagccccucacccuuccacacucacgaacucucagccgaggaaggcaag

SEQ ID NO: 293624 - RNA, 64 nt, hsa
cucucuggcccucuaccccugaucugacauccccacucacgaauauuaugcccaguuucugccu

SEQ ID NO: 293625 - RNA, 64 nt, hsa
uggagaacucagagggugccucaggggaaagaaaacucacgaagcagaggcugggcgugguggc

SEQ ID NO: 293626 - RNA, 51 nt, hsa
uaauauacuuucaguauugaaacucacgacggcaccacuaggccagaggcg

SEQ ID NO: 293627 - RNA, 64 nt, hsa
ugggaaccauuuuugugaguggguuuaugauuauacucacgaggaauggccuuucuacaaagca

SEQ ID NO: 293628 - RNA, 64 nt, hsa
gggcgccguccaggccgagcgcagacuguuuaggacucagcagacccagcaagaggcaucugcc

SEQ ID NO: 293629 - RNA, 64 nt, hsa
ugccagcggacgucagcacucacggccugcagggacucagcacagcucuggauucuggaucucu

SEQ ID NO: 293630 - RNA, 64 nt, hsa
cgggcaggacuuggggcagcugaagcucacggugacucagcagugcccaacugaccaaucuccc

SEQ ID NO: 293631 - RNA, 64 nt, hsa
gcacaauuugcacuccccucagcuagacgcacagacucagcaauaaaccuuugcaucaggcucc

SEQ ID NO: 293632 - RNA, 64 nt, hsa
aacuucaucuaaguccuaacuauuacaaugauggacucagcaccuccaaagcaguuaauuuuuc

SEQ ID NO: 293633 - RNA, 64 nt, hsa
agcaaagugcacugaugugugagcucuuaagaccacucagcaugacgacugaguagacuuguuu

SEQ ID NO: 293634 - RNA, 64 nt, hsa
acacaguuggucugcagucggcccaggacggucuacucagcacaacugacugcuucagugcugc

SEQ ID NO: 293635 - RNA, 64 nt, hsa
uccugggcuccaucaauggcugcaucuuuucuggacucagcagucuccuugauuccauguagag

SEQ ID NO: 293636 - RNA, 64 nt, hsa
uugacuuguuccaaauuaaacacuccgccuugugacucagcaaugcuaucuaccuucacacucc

SEQ ID NO: 293637 - RNA, 64 nt, hsa
gccagcugucaaguuuguccccccaggcaucuucacucagcaggauauaaaagaaaaaaauguu

SEQ ID NO: 293638 - RNA, 64 nt, hsa
uccagccacagcaguccacagcagcaggguuaagacucagcacagggccagcagcagcacaacc

SEQ ID NO: 293639 - RNA, 64 nt, hsa
gaaaagggaugagagaaaggaggugguauggaagacucagcaggaacaagguaggcuucaaaga

SEQ ID NO: 293640 - RNA, 64 nt, hsa
gcagugcucaccccaggcuucccugacggggaugacucagcacuaccccucaacagagaugacu

SEQ ID NO: 293641 - RNA, 64 nt, hsa
agggaugacuccgcacugccccucaacagggaugacucagcagagaugacucagcacugucccu

SEQ ID NO: 293642 - RNA, 64 nt, hsa
acugccccucaacagggaugacucagcagagaugacucagcacugucccuuagcagggaugaca

SEQ ID NO: 293643 - RNA, 64 nt, hsa
acugucccuuagcagggaugacacagcaaggaugacucagcacugccccucagcaaggaugacu

SEQ ID NO: 293644 - RNA, 64 nt, hsa
aaggaugacucagcacugccccucagcaaggaugacucagcacugccgcucaacagacaugacu

SEQ ID NO: 293645 - RNA, 64 nt, hsa
agggauggcuuaguacugccccucagcagggaugacucagcaccgccucucaacagggaugacu

SEQ ID NO: 293646 - RNA, 64 nt, hsa
agggaugacucagcaccgccucucaacagggaugacucagcagggaugacucagcaccgccccu

SEQ ID NO: 293647 - RNA, 64 nt, hsa
accgccucucaacagggaugacucagcagggaugacucagcaccgccccucaacaggcaugacu

SEQ ID NO: 293648 - RNA, 64 nt, hsa
accgccccucaacaggcaugacucugcagagaugacucagcacugucccuuagcagggaugaca

SEQ ID NO: 293649 - RNA, 64 nt, hsa; identical to SEQ ID NO: 293643

SEQ ID NO: 293650 - RNA, 64 nt, hsa
aaggaugacucagcacugccccucagcaaggaugacucagcacugccgcucaacagggaugacu

SEQ ID NO: 293651 - RNA, 64 nt, hsa
agggauggcuuaguacugccccucaacagggaugacucagcagggaugacucagcaccgccccu

SEQ ID NO: 293652 - RNA, 64 nt, hsa
acugccccucaacagggaugacucagcagggaugacucagcaccgccccucaacaggcaugacu

SEQ ID NO: 293653 - RNA, 64 nt, hsa
agggaugacucaguacugccccucagcagggaugacucagcacugccccucaacagggaugacu

SEQ ID NO: 293654 - RNA, 64 nt, hsa
agggaugacucagcacugccccucaacagggaugacucagcagggaugacucagcacugucccu

SEQ ID NO: 293655 - RNA, 64 nt, hsa
acugccccucaacagggaugacucagcagggaugacucagcacugucccuuagcagugaugaca

SEQ ID NO: 293656 - RNA, 64 nt, hsa
acugucccuuagcagugaugacacagcaaggaugacucagcacugccccucagcaaggaugacu

SEQ ID NO: 293657 - RNA, 64 nt, hsa; identical to SEQ ID NO: 293644

SEQ ID NO: 293658 - RNA, 64 nt, hsa
agggauggcuuaguacugccccucagcagggaugacucagcaccgccccucaacagggaugacu

SEQ ID NO: 293659 - RNA, 64 nt, hsa
agggaugacucagcaccgccccucaacagggaugacucagcacugccccucaacagggaugacu

SEQ ID NO: 293660 - RNA, 64 nt, hsa
agggaugacucagcacugccccucaacagggaugacucagcagggaugacucagcagugucccu

SEQ ID NO: 293661 - RNA, 64 nt, hsa
acugccccucaacagggaugacucagcagggaugacucagcagugucccuuagcagcgaugaca

SEQ ID NO: 293662 - RNA, 64 nt, hsa
agugucccuuagcagcgaugacacagcaaggaugacucagcacugccccucaccaaggaugacu

SEQ ID NO: 293663 - RNA, 64 nt, hsa
aaggaugacucagcacugccccucaccaaggaugacucagcacugccgcucaacagacaugacu

SEQ ID NO: 293664 - RNA, 64 nt, hsa
agggauggcuuaguacugccccucagcagggaugacucagcagggaugacucagcaccaccccu

SEQ ID NO: 293665 - RNA, 64 nt, hsa
acugccccucagcagggaugacucagcagggaugacucagcaccaccccucaacagggaugacu

SEQ ID NO: 293666 - RNA, 64 nt, hsa
agggaugacucagcaccaccccucaacagggaugacucagcagggaugacucagcacugccccu

SEQ ID NO: 293667 - RNA, 64 nt, hsa
accaccccucaacagggaugacucagcagggaugacucagcacugccccucaacagggaugacu

SEQ ID NO: 293668 - RNA, 64 nt, hsa
gcacugccccucaacagggaugacugcagggaugacucagcacugccccucagcagggaugacu

SEQ ID NO: 293669 - RNA, 64 nt, hsa
agggaugacucagcacugccccucagcagggaugacucagcacugccccucagcagggaugacu

SEQ ID NO: 293670 - RNA, 64 nt, hsa
agggaugacucagcacugccccucagcagggaugacucagcagggaugacucagcaccgccccu

SEQ ID NO: 293671 - RNA, 64 nt, hsa
acugccccucagcagggaugacucagcagggaugacucagcaccgccccucaacaggcaugacu

SEQ ID NO: 293672 - RNA, 64 nt, hsa
accgccccucaacaggcaugacucugcagagaugacucagcacugccccucagcagggauggcu

SEQ ID NO: 293673 - RNA, 64 nt, hsa
acugccccucagcagggauggcucagcagggaugacucagcauugccccucaacagggaugacu

SEQ ID NO: 293674 - RNA, 64 nt, hsa
agggaugacucagcauugccccucaacagggaugacucagcagacucagcagggaugacucagc

SEQ ID NO: 293675 - RNA, 64 nt, hsa
ucagcauugccccucaacagggaugacucagcagacucagcagggaugacucagcacugccccu

SEQ ID NO: 293676 - RNA, 64 nt, hsa
caacagggaugacucagcagacucagcagggaugacucagcacugccccucaacagacaugacu

SEQ ID NO: 293677 - RNA, 64 nt, hsa
agggaugacucagcacugccccucaacagacaugacucagcagggaugacucagcaccgccccu

SEQ ID NO: 293678 - RNA, 64 nt, hsa
acugccccucaacagacaugacucagcagggaugacucagcaccgccccucagcaaggaugacu

SEQ ID NO: 293679 - RNA, 64 nt, hsa
agggaugacucagcaccgccccucagcaaggaugacucagcagggaugauucagcagagauaac

SEQ ID NO: 293680 - RNA, 64 nt, hsa
auuuauuucagaaggcugaacauaagagguuucuacucagcaauacuuagaugucuaacuguuu

SEQ ID NO: 293681 - RNA, 64 nt, hsa
accuugaggcuaguuaguaucacacucaggccacacucagcacuugcccacucuuguuuacugc

SEQ ID NO: 293682 - RNA, 64 nt, hsa
gcuggggacuuguccuucucuuccaacguaggccacucagcaacuggcauggagggcccaggca

SEQ ID NO: 293683 - RNA, 64 nt, hsa
ggggacagcccucgcccugccaagcacugcggccacucagcagcuauguucccgccgcaguggg

SEQ ID NO: 293684 - RNA, 64 nt, hsa
gcugacuggcaaguucgauguuagcucccgggacacucagcagcgauggugagcauuuugguuu

SEQ ID NO: 293685 - RNA, 64 nt, hsa
acauaauggacgugaaguggggcagaaacccagaacucagcauucaaggaugcccaggagagcu

SEQ ID NO: 293686 - RNA, 64 nt, hsa
ugggaguucuagacuagccugggcgagacuucaucucuacaaaaaaagcaacaacgacaaaaaa

SEQ ID NO: 293687 - RNA, 64 nt, hsa
caaguccaaucugggcaacauggggaaaccccagcucuacaaaaaaaauuagccugguguggug

SEQ ID NO: 293688 - RNA, 64 nt, hsa
agucuagaggacaccuuuguaucucaagcuaaugcucuacaaaggaaaggccgagcaggccgug

SEQ ID NO: 293689 - RNA, 64 nt, hsa
ggagugcugcugagaaggcuagaaggagauacagcucuacaaggaguuucccauaucauuguug

SEQ ID NO: 293690 - RNA, 64 nt, hsa
uugucaccucacuuaguucagaugaaaucuguuacucuacaaggaagguguucaucauuaggag

SEQ ID NO: 293691 - RNA, 64 nt, hsa
augauuauuguuuaauuucaaaagaauccucaggcucuacaaucuaggggugguaaauguguuu

SEQ ID NO: 293692 - RNA, 64 nt, hsa
gaugaaggacgugucucaggagcuugauccagaccucuacaagcaaauggagaaguucaggaag

SEQ ID NO: 293693 - RNA, 64 nt, hsa
gagaccagccugggcaacaaagugagacccccaucucuacaaaaaauaaaaacacuuaaaaauu

SEQ ID NO: 293694 - RNA, 64 nt, hsa
uucuguuugucaguucauuccuguguguucuuaccucuacaaaguaaauuacacauuuaguuuu

SEQ ID NO: 293695 - RNA, 64 nt, hsa
caggaguuuugagaccagccugggaaacaucugucucuacaaaaaaauacaaaaauuagcuggg

SEQ ID NO: 293696 - RNA, 64 nt, hsa
cucaggaguucgugaccagccugggcaacccugucucuacaaaaaauacaaaaauuaaccaggc

SEQ ID NO: 293697 - RNA, 64 nt, hsa
cucacuuuaauaccucuuaggaaccaaagaaugccucuacaagcaaaaagauaguugaaaauag

SEQ ID NO: 293698 - RNA, 64 nt, hsa
uguucgagcacagaacggauauaaucagucuggccucuacaacaaguuuugcauuguagaauug

SEQ ID NO: 293699 - RNA, 64 nt, hsa
ccaagucuguccugucuucaucucugugucccaucucuacaacccacauacagacacacacacu

SEQ ID NO: 293700 - RNA, 64 nt, hsa
ugagacaagccuaggcaacaaaacaagacucugucucuacaaaaaguuuaagaaaugagccaga

SEQ ID NO: 293701 - RNA, 64 nt, hsa
gcacucaagccugggcaauguagcaagauccugucucuacaagaaauuuuuuaaaaaugagcca

SEQ ID NO: 293702 - RNA, 64 nt, hsa
ugaauuuuuuuuuccuuuucccauguggcaguccuuccugcacauaguugacauuccuaguaaa

SEQ ID NO: 293703 - RNA, 64 nt, hsa
agaaaugagaugcaggaaagaaaaccaaaucccauuccugcaccccaguccaauaagcagauac

SEQ ID NO: 293704 - RNA, 64 nt, hsa
cuaccccccgacuuugucucugggguccuguuccuuccugcaaagcccaauccaagacuggcau

SEQ ID NO: 293705 - RNA, 64 nt, hsa
uccuuuuuucucuaauuuucuaccuuccucucuguuccugcagacaguuuugccagcuuugcuu

SEQ ID NO: 293706 - RNA, 64 nt, hsa
ugccuaggcugcggcccuucacugcugugcuggguuccugcagccugcuacguuucccuuggca

SEQ ID NO: 293707 - RNA, 64 nt, hsa
cucaucccacucucaguuggauuuucuggcacucuuccugcauugagucuccugauuacugaac

SEQ ID NO: 293708 - RNA, 64 nt, hsa
cacaagcucacucaagaccagauggagaacuuauuuccugcagcugacagauagacucagauuu

SEQ ID NO: 293709 - RNA, 64 nt, hsa
cacaugggagcugccugccugcugcugcugcugcuuccugcagaucauggaggggcuggccuuu

SEQ ID NO: 293710 - RNA, 64 nt, hsa
uuuucuagagauggacagcuugguuaccuccaccuuccugcacucauucucaaacauacugaug

SEQ ID NO: 293711 - RNA, 64 nt, hsa
agaaugauucauuuugcugcgugugaaaucaugguuccugcaugcuguauaaaaguaaaccauc

SEQ ID NO: 293712 - RNA, 64 nt, hsa
uaaaauuacauguauauaaaauauauaauuuaucuuccugcauuuuugaaguauaaagucauaa

SEQ ID NO: 293713 - RNA, 64 nt, hsa
gacuguaguauuaauaagguuuuaaugugagauauuccugcaaaccaucccauuucuacugauu

SEQ ID NO: 293714 - RNA, 64 nt, hsa
ggacacugugagcacguggucucgccuucccuucuuccugcagguucccgccaagccaugugac

SEQ ID NO: 293715 - RNA, 64 nt, hsa
guuugcuucacuuuacccaucccgaugcucuuccuuccugcagcuucaugcuccaaugagggcu

SEQ ID NO: 293716 - RNA, 64 nt, hsa
gcugaguggggcgcccucaccuccagccagccucuuccugcagaggaguagugucagccaccuu

SEQ ID NO: 293717 - RNA, 64 nt, hsa
acauuuucucaguuggguccaucagcaguuuuucuuccugcauuuauuguugaaaacuauuguu

SEQ ID NO: 293718 - RNA, 64 nt, hsa
cucccuccccggcuuugugcugguauuccacguauuccugcauuaauauugcacacccaaacca

SEQ ID NO: 293719 - RNA, 64 nt, hsa
uuucugguauuuuuguugauaaaauacgaagaaauuccugcaauuuuuaaaaaacaaguuugga

SEQ ID NO: 293720 - RNA, 64 nt, hsa
uaaauguccccuuuaguauuuaauggaaaauugguuccugcaaaagacaaagggugagaguuag

SEQ ID NO: 293721 - RNA, 64 nt, hsa
guccgucuacaaccuggaaucagauuugcaaaauuuccugcacugcugucugacacuguccugu

SEQ ID NO: 293722 - RNA, 64 nt, hsa
aacagcucuguuguucugcauugggggagguacauuccugcaucuucucacccccucaaccagg

SEQ ID NO: 293723 - RNA, 64 nt, hsa
ucugcagcccacaggcuuuuuuggaaggaguggcuuccugcagguguuccaccugccuucggag

SEQ ID NO: 293724 - RNA, 64 nt, hsa
uuaaacaacucauuuuaagauucaaauuaacuaauuccugcauauaugacauuccuuacauaag

SEQ ID NO: 293725 - RNA, 64 nt, hsa
uacauguucucaauucauucauauuauuaagcucuuccugcaguugauaucugagcagaguaag

SEQ ID NO: 293726 - RNA, 64 nt, hsa
uuuuaaaaaaauauguaaagugcagucuucuguauuccugcauauuguauauaccuguauaugu

SEQ ID NO: 293727 - RNA, 64 nt, hsa
uguuuugucuguucccuaagaaaauauauuuucauuccugcaaacacagugcucagccuucagu

SEQ ID NO: 293728 - RNA, 61 nt, hsa
ugaacuucccuacccuacccccacaacacaagcaccccagaccucaccuccaucccccucu

SEQ ID NO: 293729 - RNA, 61 nt, hsa
uuuuuucaucuguaaaacagggauaauaacagcaccccauagaguugugacgaggauugag

SEQ ID NO: 293730 - RNA, 61 nt, hsa
uuguaugcacaaaggagacccaugcaggcaugcaccccagaugggcugcuagacuaccccu

SEQ ID NO: 293731 - RNA, 61 nt, hsa
cuuggcuguauuucccaucuucacaguucaagcaccccaaaccugcccuuucuccccugca

SEQ ID NO: 293732 - RNA, 61 nt, hsa
guggggcaggggcagggcggcugcucacagagcaccccaguuccucaccagcuacucuggc

SEQ ID NO: 293733 - RNA, 61 nt, hsa
guugagaccauugacaacugcucguguacaggcaccccacagccccagagcauggggcaca

SEQ ID NO: 293734 - RNA, 61 nt, hsa
agagguugcagugagccgagauugcgccacugcaccccagccuggacaacagagugagacu

SEQ ID NO: 293735 - RNA, 61 nt, hsa
guacacucccccggugacagggugcucacuggcaccccaucuuccugugaauaacucaaau

SEQ ID NO: 293736 - RNA, 61 nt, hsa
ccaacucuugcuguccuuucuuaccaccugugcaccccacuuggagcagugggaggaaauc

SEQ ID NO: 293737 - RNA, 61 nt, hsa
uguugggguaaaucccacauggcagaguaaggcaccccacagaaauuaacuuggagagccu

SEQ ID NO: 293738 - RNA, 61 nt, hsa
ccccugaccucaccuuugcaaaguuacagaugcaccccaacauugagauguguuuuuaaug

SEQ ID NO: 293739 - RNA, 61 nt, hsa
auucaggggcuccccgggggcagacaccugugcaccccaugaguagugcccacuugaggcu

SEQ ID NO: 293740 - RNA, 61 nt, hsa
ggcuucuccagccauugaacuggucccacacgcaccccaggccccacuccucggcaguuuc

SEQ ID NO: 293741 - RNA, 61 nt, hsa
cacagugcugcuaauaucccagcuccagccagcaccccaucugcaccugaauccucuaacu

SEQ ID NO: 293742 - RNA, 61 nt, hsa
ggcagggacaaugccggcagccugagcccaggcaccccagugcccgcugggcccagccugg

SEQ ID NO: 293743 - RNA, 61 nt, hsa
cacagccccgcccguggagggucccuuuuacgcaccccaaggcccacaccuaagcuuccau

SEQ ID NO: 293744 - RNA, 61 nt, hsa
cccgaguaacuuucugcugaugaacaaaucugcaccccacuucagaccucggugggcauuc

SEQ ID NO: 293745 - RNA, 61 nt, hsa
ugacacuccccuugcaaaccaucccagcacugcaccccaggcagccacuccuagccuuggc

SEQ ID NO: 293746 - RNA, 55 nt, hsa; identical to SEQ ID NO: 138573

SEQ ID NO: 293747 - RNA, 61 nt, hsa
gaguuggcccugagcucuauccaccaagccagcaccccaccaucccuuugcaggggaguca

SEQ ID NO: 293748 - RNA, 61 nt, hsa
cucccugaguccccacacagggccucacucugcaccccaccagggucccgcucacaccagg

SEQ ID NO: 293749 - RNA, 61 nt, hsa
cuggccaccuugggcagagcugggucaugcagcaccccauccuuacccggugcccucuccu

SEQ ID NO: 293750 - RNA, 61 nt, hsa
agcugacugugccccgcugcgggaggggacggcaccccagugguggcagagcuugggggcc

SEQ ID NO: 293751 - RNA, 61 nt, hsa
guuucucuuugaugaccaggaagaaaucccagcaccccagccacaggcuguggcugcuccc

SEQ ID NO: 293752 - RNA, 61 nt, hsa
ggagguuucagugagccgagauugcaccauugcaccccagccugggcaacagagcgagacu

SEQ ID NO: 293753 - RNA, 61 nt, hsa
gaagcuacagguagguccacccaacgcccaggcaccccagucuacuugcugggcugagucc

SEQ ID NO: 293754 - RNA, 61 nt, hsa
gaacuaaaccagggagcugucugaaaucauagcaccccauccggguggcggggagaucaac

SEQ ID NO: 293755 - RNA, 61 nt, hsa
uggagaaagggcccaugucaagccuuguucugcaccccaagcauuggugguaggacugggu

SEQ ID NO: 293756 - RNA, 61 nt, hsa
ugacagauggguccccuuuuucucucucagggcaccccagccccacacucacauguacgaa

SEQ ID NO: 293757 - RNA, 61 nt, hsa
cucugcucccuagucccaggguggggguggggcaccccagcugcccugacagauggguccc

SEQ ID NO: 293758 - RNA, 64 nt, hsa
cgaggccaagaagauggaguuccugaagcagaagaucgagcaggagcuccguaggcagccgggc

SEQ ID NO: 293759 - RNA, 64 nt, hsa
caaguaaagaugacaauuuacucaacaaauauuuaucgagcaccuuuuauguaccaggcacugu

SEQ ID NO: 293760 - RNA, 64 nt, hsa
uccagugccuucugagaaggaagaucaaguuuacaucgagcaaagugaccuuggaagacagggc

SEQ ID NO: 293761 - RNA, 64 nt, hsa
cuucuccgcgucauuguuggaagaggagagaugcaucgagcagucccagcugcuuuucauuuau

SEQ ID NO: 293762 - RNA, 64 nt, hsa
gacagacaucaagugccagauguugucugaacuaaucgagcacuucucaccaaacuucauguau

SEQ ID NO: 293763 - RNA, 64 nt, hsa
aauuagagguagcucuagcuuugauuccauuuagaucgagcagcucacacaauguuagcaagga

SEQ ID NO: 293764 - RNA, 64 nt, hsa
aguugaauauguuccugcauuucagcagugcauaaucgagcaggaggcuggaaucuggagaccu

SEQ ID NO: 293765 - RNA, 64 nt, hsa
gcaucuugcaagaccuuuagugccacaaauaagcaucgagcaccuccccauucacacccccauu

SEQ ID NO: 293766 - RNA, 64 nt, hsa
uccuuucaugagaggagcaggccuuggacagcguaucgagcauccugacccacugccccugccu

SEQ ID NO: 293767 - RNA, 64 nt, hsa
guagccuacuuccuuacccccgaauauugguaagaucgagcaauggcuucaggacauggguucu

SEQ ID NO: 293768 - RNA, 64 nt, hsa
augcugaagacuaacgaagaaacuagagacugauaucgagcauucugcccaccucgcucuguau

SEQ ID NO: 293769 - RNA, 64 nt, hsa
guuuguauggucuuguagaagacaguccuguaagaucgagcaaccagucaugaugaaaccaagu

SEQ ID NO: 293770 - RNA, 64 nt, hsa
uaaauauuuucuauguguguuucaguggaugacaaucgagcagcagaagaauggugugccuacc

SEQ ID NO: 293771 - RNA, 64 nt, hsa
caauuauauacuccagggaaauucaccacacugaaucgagcauuuguguguguaugugugaagu

SEQ ID NO: 293772 - RNA, 64 nt, hsa
ugggaacggacugguauguaaaagaaaauccauuaucgagcagcauuuuauuuaccccuccccu

SEQ ID NO: 293773 - RNA, 64 nt, hsa
gagaccugucgcugaugagaugaagaauguggggaucgagcagccuucuucuuugggaccccuc

SEQ ID NO: 293774 - RNA, 64 nt, hsa
agaagaauaguacagcccaugauugaccagucaaaucgagcagugagccaaggagcagcauaua

SEQ ID NO: 293775 - RNA, 64 nt, hsa
guucccugcacaccugucgccagguuaaacaaccaucgagcaugugucaauggcauugcuuggg

SEQ ID NO: 293776 - RNA, 64 nt, hsa
cucuuuccacuuuguuggcccuuccagugggauuaucgagcauguuguuuuuucauagugccuu

SEQ ID NO: 293777 - RNA, 64 nt, hsa
gguugucggccgggcaccacggcucacaccuauaaucgagcacuuugggaggccaagacaggag

SEQ ID NO: 293778 - RNA, 64 nt, hsa
agggguuaggucugcaggcccgucugcgguccccaucgagcaucaaggggacgcugugugugcu

SEQ ID NO: 293779 - RNA, 64 nt, hsa
agaacuuccagaggaaaucgacaucuccacauacaucgagcagagccgguaaccaccacgugcc

SEQ ID NO: 293780 - RNA, 64 nt, hsa
cagaagguucguuagccagguggucccuucuacaaucgagcagcuccuuggacagacuguuucu

SEQ ID NO: 293781 - RNA, 64 nt, hsa
cucacagccaguaggcauaggagcgggaaugaaaaucgagcacugucagaaucuggugggcagc

SEQ ID NO: 293782 - RNA, 64 nt, hsa
uugauuccagauaguaagaugaguggaaguguuuaucgagcaugcaaaagaaacccucacggcu

SEQ ID NO: 293783 - RNA, 64 nt, hsa
gacaguuacagcgucagccccucgcaagacacagaucgagcaagaagcagcauggucuccacag

SEQ ID NO: 293784 - RNA, 64 nt, hsa
ggagaaaaauagauggguuacaaauacaucagauaucgagcaaaugguuugaguuacaucuagc

SEQ ID NO: 293785 - RNA, 64 nt, hsa
acaauguucuggcacauaguaauuaauuaagaaaaucgagcacccuuaauuaccuagaaugcag

SEQ ID NO: 293786 - RNA, 64 nt, hsa
cccagaaucuuggcuguuuacaaaucacguguccaucgagcacgucugaaaccccugguagccc

SEQ ID NO: 293787 - RNA, 63 nt, hsa
aggggcagaguuaaacauuagccacaauggccccccgcgaagugagucauacuccccacaagu

SEQ ID NO: 293788 - RNA, 63 nt, hsa
auggauggauggauggaugagcgagaacccgcgcccgcgaacaaagagcgaaccaaagcgaug

SEQ ID NO: 293789 - RNA, 63 nt, hsa
cauuggaugaaguggugcccucuccucuggucccccgcgaaaagguaaauacacccaaaggga

SEQ ID NO: 293790 - RNA, 63 nt, hsa
ggcagcagagcuggcacaccgauucugggaagccccgcgaaugauggcuuuugaauuaaugag

SEQ ID NO: 293791 - RNA, 63 nt, hsa
ggauccuucugcuccgcucaggacccccggagccccgcgaaaacaucugccucccaggagggu

SEQ ID NO: 293792 - RNA, 63 nt, hsa
uuuugauggcagcaguaaucaugauagugugaacccgcgaaggccucaggauuaugguuaacc

SEQ ID NO: 293793 - RNA, 63 nt, hsa
gugccacaccucgaacugguuguagugggaagucccgcgaaacccggugcaucuggcacgugg

SEQ ID NO: 293794 - RNA, 63 nt, hsa
auccccccaagcccuagagcucccuccacucuucccgcgaacaucacaccguuccccgaccaa

SEQ ID NO: 293795 - RNA, 63 nt, hsa
gagcuggggcccacguggcaucgauccucccugcccgcgaagugacaguuuacaaaauuauuu

SEQ ID NO: 293796 - RNA, 63 nt, hsa
gacaggggcgagggcugcuuccucgcggcagcccccgcgaagaaaucucgagagaacuggcau

SEQ ID NO: 293797 - RNA, 63 nt, hsa
acuccccccgccucgacggcaccacuggccggccccgcgaaagacugcgcgugcguagagcac

SEQ ID NO: 293798 - RNA, 63 nt, hsa
gcgaggccaccccccuccauccugggggaagcgcccgcgaaaaccguggagagaagccgccgc

SEQ ID NO: 293799 - RNA, 63 nt, hsa
gccccccgccagcccgcccccgguuguccaccucccgcgaagcccaaucgcgaggccgcgagc

SEQ ID NO: 293800 - RNA, 63 nt, hsa
gcgccccggacgccgcgauuuugccuuugguuccccgcgaaguccgaggccuggcucuggagc

SEQ ID NO: 293801 - RNA, 64 nt, hsa
ugaaguugguuuuguuggauggcuccugagcugacugacugaugucugaaguuugagacgaggg

SEQ ID NO: 293802 - RNA, 64 nt, hsa
aauaugaaguugguuuuguuggauggcuccugagcugacugacugaugucugaaguuugagacg

SEQ ID NO: 293803 - RNA, 64 nt, hsa
gaacacaggaggugcucaauuacuauuugacugacugacugaaugaaugaaugaaugaggaaga

SEQ ID NO: 293804 - RNA, 64 nt, hsa
acuggaacacaggaggugcucaauuacuauuugacugacugacugaaugaaugaaugaaugagg

SEQ ID NO: 293805 - RNA, 64 nt, hsa
cagaacaaagacuaaauaaugacauaauccucagcugacugacugaaaaugugacuggacgcau

SEQ ID NO: 293806 - RNA, 64 nt, hsa
acaaagacuaaauaaugacauaauccucagcugacugacugaaaaugugacuggacgcauuccc

SEQ ID NO: 293807 - RNA, 52 nt, hsa
ugaugcucuucucaaggugacacugacugagauguucucuuacugacugaga

SEQ ID NO: 293808 - RNA, 64 nt, hsa
uucucaaggugacacugacugagauguucucuuacugacugagauguucucuuggcaugcuaaa

SEQ ID NO: 293809 - RNA, 64 nt, hsa
gcaaaucugcccugcucagcagucaccauagcagcugacugaaaaucagcacugccugaguagu

SEQ ID NO: 293810 - RNA, 64 nt, hsa
gaguaguuuugaucaguuuaacuugaaucacuaacugacugaaaauugaaugggcaaauaagug

SEQ ID NO: 293811 - RNA, 64 nt, hsa
auuaggacuuucugcaguugacauuugcauaaagcugacugacugaaggaacagaaagugagac

SEQ ID NO: 293812 - RNA, 64 nt, hsa
ggacuuucugcaguugacauuugcauaaagcugacugacugaaggaacagaaagugagacagac

SEQ ID NO: 293813 - RNA, 64 nt, hsa; identical to SEQ ID NO: 234346

SEQ ID NO: 293814 - RNA, 64 nt, hsa; identical to SEQ ID NO: 234347

SEQ ID NO: 293815 - RNA, 64 nt, hsa; identical to SEQ ID NO: 234348

SEQ ID NO: 293816 - RNA, 64 nt, hsa; identical to SEQ ID NO: 234349

SEQ ID NO: 293817 - RNA, 64 nt, hsa; identical to SEQ ID NO: 234350

SEQ ID NO: 293818 - RNA, 64 nt, hsa; identical to SEQ ID NO: 234351

SEQ ID NO: 293819 - RNA, 64 nt, hsa; identical to SEQ ID NO: 234352

SEQ ID NO: 293820 - RNA, 64 nt, hsa; identical to SEQ ID NO: 234353

SEQ ID NO: 293821 - RNA, 64 nt, hsa; identical to SEQ ID NO: 234354

SEQ ID NO: 293822 - RNA, 64 nt, hsa; identical to SEQ ID NO: 234355

SEQ ID NO: 293823 - RNA, 64 nt, hsa; identical to SEQ ID NO: 234356

SEQ ID NO: 293824 - RNA, 64 nt, hsa; identical to SEQ ID NO: 234357

SEQ ID NO: 293825 - RNA, 64 nt, hsa; identical to SEQ ID NO: 99247

SEQ ID NO: 293826 - RNA, 64 nt, hsa; identical to SEQ ID NO: 99248

SEQ ID NO: 293827 - RNA, 64 nt, hsa; identical to SEQ ID NO: 99249

SEQ ID NO: 293828 - RNA, 64 nt, hsa; identical to SEQ ID NO: 99250

SEQ ID NO: 293829 - RNA, 64 nt, hsa; identical to SEQ ID NO: 99251

SEQ ID NO: 293830 - RNA, 64 nt, hsa; identical to SEQ ID NO: 99252

SEQ ID NO: 293831 - RNA, 64 nt, hsa; identical to SEQ ID NO: 99253

SEQ ID NO: 293832 - RNA, 64 nt, hsa; identical to SEQ ID NO: 99254

SEQ ID NO: 293833 - RNA, 64 nt, hsa; identical to SEQ ID NO: 99255

SEQ ID NO: 293834 - RNA, 64 nt, hsa; identical to SEQ ID NO: 99256

SEQ ID NO: 293835 - RNA, 64 nt, hsa; identical to SEQ ID NO: 99257

SEQ ID NO: 293836 - RNA, 64 nt, hsa; identical to SEQ ID NO: 99258

SEQ ID NO: 293837 - RNA, 64 nt, hsa; identical to SEQ ID NO: 99259

SEQ ID NO: 293838 - RNA, 64 nt, hsa; identical to SEQ ID NO: 99260

SEQ ID NO: 293839 - RNA, 64 nt, hsa; identical to SEQ ID NO: 99261

SEQ ID NO: 293840 - RNA, 64 nt, hsa; identical to SEQ ID NO: 99262

SEQ ID NO: 293841 - RNA, 64 nt, hsa; identical to SEQ ID NO: 99263

SEQ ID NO: 293842 - RNA, 64 nt, hsa; identical to SEQ ID NO: 99264

SEQ ID NO: 293843 - RNA, 64 nt, hsa; identical to SEQ ID NO: 99265

SEQ ID NO: 293844 - RNA, 64 nt, hsa; identical to SEQ ID NO: 99266

SEQ ID NO: 293845 - RNA, 64 nt, hsa; identical to SEQ ID NO: 99267

SEQ ID NO: 293846 - RNA, 64 nt, hsa; identical to SEQ ID NO: 99268

SEQ ID NO: 293847 - RNA, 64 nt, hsa; identical to SEQ ID NO: 99269

SEQ ID NO: 293848 - RNA, 64 nt, hsa; identical to SEQ ID NO: 99270

SEQ ID NO: 293849 - RNA, 64 nt, hsa; identical to SEQ ID NO: 99271

SEQ ID NO: 293850 - RNA, 64 nt, hsa
ucacggagaaucuaucuaaucccacuguauuaagaggggaaaccgggccaagcgcaguggcuca

SEQ ID NO: 293851 - RNA, 64 nt, hsa
cgaaacuccgucucaaaaaaaaauaaaaaugaagaggggaaaccagaauaaauuaucuuuugga

SEQ ID NO: 293852 - RNA, 64 nt, hsa
uggcuuuucgacauagaaccucagcuguuaaccaaggggaaauacaucagaucugcaacacaga

SEQ ID NO: 293853 - RNA, 64 nt, hsa
aaugggaaagccagggggcauaaaagguacagucaggggaaaauagaucuaggcagagugccuu

SEQ ID NO: 293854 - RNA, 64 nt, hsa
aguaggauguuguugccuuuaacuuuucuuauccaggggaaaauugccauuuuagggucagcau

SEQ ID NO: 293855 - RNA, 64 nt, hsa
ccuggaagcagcauugugugauauucucagaggcaggggaaaauagagggaaaaauagagacua

SEQ ID NO: 293856 - RNA, 64 nt, hsa
cuggcucuggccucagguggggcgcaggagagccaggggaaaagugccucauaguuaggaaagu

SEQ ID NO: 293857 - RNA, 64 nt, hsa
ggcccacccaacugaaggcauggcggcggggugcaggggaaaguuaaaggugaugacgaucauc

SEQ ID NO: 293858 - RNA, 64 nt, hsa
uuugcgucagagaaaugucuguccauuuuuauucaggggaaacuugauuugagauuuuuaugcc

SEQ ID NO: 293859 - RNA, 64 nt, hsa
cuuuuuuggacuagcacugacugaacuguaauguaggggaaaguuucaugaugguaucuauagu

SEQ ID NO: 293860 - RNA, 64 nt, hsa
uuguuguuuauuuuauccaaguaccccagugaauaggggaaaaauaaacacagugaaaaaaaaa

SEQ ID NO: 293861 - RNA, 64 nt, hsa
gcgaguuucuaaaggcgaggaaaugguuuguaagaggggaaagaaaaggagaaaggucuaauca

SEQ ID NO: 293862 - RNA, 64 nt, hsa
uuuccuggaaagcccgcuagaagguuugggaacgaggggaaaguucucagaacuguuggcugcu

SEQ ID NO: 293863 - RNA, 64 nt, hsa
cacccucauuucugccagcgcauguguccuuucaaggggaaaaugugaagcugaacccccucca

SEQ ID NO: 293864 - RNA, 64 nt, hsa
ggaagggccaucagcgugacccucauuuucaagaaggggaaacugaggcccagggaggagagua

SEQ ID NO: 293865 - RNA, 64 nt, hsa
ucauuuccccuggaaaagaaacaugguccauuagaggggaaagcccaggggugaaucuucacgc

SEQ ID NO: 293866 - RNA, 64 nt, hsa
guaauuuauaagaaagaaugccauugaauuuuuuaggggaaaaacuacaaauuucuaauuuagc

SEQ ID NO: 293867 - RNA, 64 nt, hsa
caaccugggcagcagagcaagacucugucucaaaaggggaaaaaaaaaauugcugaugugaccc

SEQ ID NO: 293868 - RNA, 64 nt, hsa
agcaguaaccuuauacacuacuuauaaguuugaaaggggaaagguuaccuuuacaauggagaca

SEQ ID NO: 293869 - RNA, 64 nt, hsa
guucaauaauguauauguaucaguucuguaauaaaggggaaaacacuuuuuuuaaauacucaua

SEQ ID NO: 293870 - RNA, 64 nt, hsa
aauacugaagccucacaguuguaugugaggggaaaggggaaauaaaucuagcauagugugauuu

SEQ ID NO: 293871 - RNA, 64 nt, hsa
caugcaaaauacugaagccucacaguuguaugugaggggaaaggggaaauaaaucuagcauagu

SEQ ID NO: 293872 - RNA, 64 nt, hsa
uuguguuggggaguggcaggggaugauuuguuucaggggaaaaugcccacauuuuaacuuuuaa

SEQ ID NO: 293873 - RNA, 64 nt, hsa
aauaacuugaguuuuccuaaguucaucagaaugaaggggaaaaacagccaucauccaacauuau

SEQ ID NO: 293874 - RNA, 64 nt, hsa
gugaugagcaagaaggcauuuuccuugggagagaaggggaaauggacccugacccccuugaucc

SEQ ID NO: 293875 - RNA, 64 nt, hsa
cucccagugaccuggaagcaagcccacccuccccaggggaaaaucuaggagaaugcauuccucu

SEQ ID NO: 293876 - RNA, 64 nt, hsa
uuccuccacccaguggagacccccccaaggcaugaggggaaagccauuaaguggggugcagccc

SEQ ID NO: 293877 - RNA, 64 nt, hsa
uuguuuguguuuuguuuggcuuguuuguuuuuuaaggggaaaaaaguuuguaauuauuucaucc

SEQ ID NO: 293878 - RNA, 64 nt, hsa
ccugaagucugucucuagcuccucugugacucagaggggaaauaccaaccucccagucuuccac

SEQ ID NO: 293879 - RNA, 64 nt, hsa
augacaaggggacggggucugugagagucaauucaggggaaagauacaagauugauuuguaaaa

SEQ ID NO: 293880 - RNA, 64 nt, hsa
uauaaggaaauggcccaaugaacgugguugugggaggggaaagaggaaacagagcuagucagau

SEQ ID NO: 293881 - RNA, 64 nt, hsa
uauuuuuuaagaaauauaauaaagcacuuagggcaggggaaaucaucucgguaaucauggaacc

SEQ ID NO: 293882 - RNA, 64 nt, hsa
gugagccuuauuaagaacacuacuacaguucugaaggggaaauauaacaucuaugguuauauau

SEQ ID NO: 293883 - RNA, 64 nt, hsa
auauauggaaaaaaaugaccauuuuuucacuuuuaggggaaaaugcaaaaguguaauacauaaa

SEQ ID NO: 293884 - RNA, 64 nt, hsa
agcagaccaaaauuucuaauucugcuaauucugaaggggaaauagacaaaucuuaaaagcugcc

SEQ ID NO: 293885 - RNA, 64 nt, hsa
ccuuguuuucuugcuuuauucugggcaaguuugaaggggaaaauuugugcugcuguuagugcaa

SEQ ID NO: 293886 - RNA, 64 nt, hsa
caguuacuacaucaaucugcaacuaucaaaaaugaggggaaaagguucaggcuguuaacaauuc

SEQ ID NO: 293887 - RNA, 64 nt, hsa
uacuuggagaaaagaaccaaguccuuggauaucuaggggaaagcuguuuggcagaaagaaaaau

SEQ ID NO: 293888 - RNA, 64 nt, hsa
cauuuucaagccucaguuuuugcuuuuuuaaaggaggggaaauauuugccucaugucauaauug

SEQ ID NO: 293889 - RNA, 64 nt, hsa
uuagaccuugguuugguaguucuuguuuuuaauaaggggaaaaagauaaaauaaccccuauuuu

SEQ ID NO: 293890 - RNA, 64 nt, hsa
ccuuuccguuucaagaccuuuuucuuuuauugcaaggggaaaaaaaugucaucuccccccaccu

SEQ ID NO: 293891 - RNA, 64 nt, hsa
ccuccuaaggaaaagggaguagcagauugaucugaggggaaagcacaggcugugcugucgaggc

SEQ ID NO: 293892 - RNA, 64 nt, hsa
cccuugcuggguuuuccuuuucuuugggacugugaggggaaaugguuuuuagaggugaggguug

SEQ ID NO: 293893 - RNA, 64 nt, hsa
ggauuacaggcgugagccaccgugcccggcccaaaggggaaacucuugugggaggagcagaggg

SEQ ID NO: 293894 - RNA, 64 nt, hsa
cucugcugccagccaagucuucauuuggggccaaaggggaaacuuuuuuuuggagaaggcgucu

SEQ ID NO: 293895 - RNA, 64 nt, hsa
auaauugugcugcuacauuauacuggaaauuaacaggggaaaagggaagagcucuuggcucccu

SEQ ID NO: 293896 - RNA, 64 nt, hsa
ucaguggaaguuaagaggggugagaaaacaaagaaggggaaaaacugacaacuaacaaaaccag

SEQ ID NO: 293897 - RNA, 64 nt, hsa
uaccaugguuugaacaaaaaaaggggaaauggggaggggaaaagggugggauuguccagcaugc

SEQ ID NO: 293898 - RNA, 64 nt, hsa
aaaucagaacucuuaccaugguuugaacaaaaaaaggggaaauggggaggggaaaaggguggga

SEQ ID NO: 293899 - RNA, 64 nt, hsa
acuauuuuucuauugguauaacccgcccaccugaaggggaaagggaaaucaaauuaauuuuucu

SEQ ID NO: 293900 - RNA, 64 nt, hsa
auauauauuguuuauaaaugcaagcuauuucuggaggggaaaaauguguguggcucuuacguuu

SEQ ID NO: 293901 - RNA, 64 nt, hsa
cuggugaaucuauggacagucauacacauacaucaggggaaaauguguguguacaacccaaauu

SEQ ID NO: 293902 - RNA, 64 nt, hsa
accacuaccucccacaauaccuagccauuuuggaaggggaaaacaugcgguggucuagcuguau

SEQ ID NO: 293903 - RNA, 64 nt, hsa
gaaagcuuaagugggaaaaaggaagaugauugucaggggaaaaacuuacaaaaugcuacagugu

SEQ ID NO: 293904 - RNA, 64 nt, hsa
ucuuccugccccuaguauuugauuacaaggaaccaggggaaaaaaacuuucuuagacacacugg

SEQ ID NO: 293905 - RNA, 64 nt, hsa
guagcaucauuuugauuaacauuuggggccugauaggggaaauggugaagcaauggaaaagaac

SEQ ID NO: 293906 - RNA, 64 nt, hsa
ucaagcuguauaguuugcacacccaucccaguggaggggaaaggggauaaguguuucaaggcaa

SEQ ID NO: 293907 - RNA, 64 nt, hsa
ccccagcaucuccuggggcccccauggcuggggcaggggaaagagagcccucaaaggccucuuu

SEQ ID NO: 293908 - RNA, 64 nt, hsa
accugugucccagcccucugaugguggugagaccaggggaaaggccagcucagaggguggucac

SEQ ID NO: 293909 - RNA, 64 nt, hsa
agagagacacggcuccugccuucauggagcuuuuaggggaaaaugaaguggcucuugcagcuag

SEQ ID NO: 293910 - RNA, 64 nt, hsa
cguggaaaaucugaacaaucuuugagccaucuagaggggaaagaaaagacuuuguucugugugu

SEQ ID NO: 293911 - RNA, 64 nt, hsa
cuagguacugccuucuaacuccugcauccucagaaggggaaaagggacugggaaguaaagggaa

SEQ ID NO: 293912 - RNA, 64 nt, hsa
uggcucagaccagcccaaggccuugcccaguggcaggggaaaggggcaccucacuccaccucaa

SEQ ID NO: 293913 - RNA, 64 nt, hsa; identical to SEQ ID NO: 236179

SEQ ID NO: 293914 - RNA, 64 nt, hsa; identical to SEQ ID NO: 236180

SEQ ID NO: 293915 - RNA, 64 nt, hsa; identical to SEQ ID NO: 236181

SEQ ID NO: 293916 - RNA, 51 nt, hsa; identical to SEQ ID NO: 110042

SEQ ID NO: 293917 - RNA, 64 nt, hsa; identical to SEQ ID NO: 236183

SEQ ID NO: 293918 - RNA, 64 nt, hsa; identical to SEQ ID NO: 236184

SEQ ID NO: 293919 - RNA, 64 nt, hsa; identical to SEQ ID NO: 236185

SEQ ID NO: 293920 - RNA, 64 nt, hsa; identical to SEQ ID NO: 236186

SEQ ID NO: 293921 - RNA, 64 nt, hsa; identical to SEQ ID NO: 236187

SEQ ID NO: 293922 - RNA, 64 nt, hsa; identical to SEQ ID NO: 236188

SEQ ID NO: 293923 - RNA, 64 nt, hsa; identical to SEQ ID NO: 236189

SEQ ID NO: 293924 - RNA, 64 nt, hsa; identical to SEQ ID NO: 236190

SEQ ID NO: 293925 - RNA, 64 nt, hsa; identical to SEQ ID NO: 236191

SEQ ID NO: 293926 - RNA, 64 nt, hsa; identical to SEQ ID NO: 236192

SEQ ID NO: 293927 - RNA, 64 nt, hsa; identical to SEQ ID NO: 236193

SEQ ID NO: 293928 - RNA, 64 nt, hsa; identical to SEQ ID NO: 236194

SEQ ID NO: 293929 - RNA, 64 nt, hsa; identical to SEQ ID NO: 236195

SEQ ID NO: 293930 - RNA, 64 nt, hsa; identical to SEQ ID NO: 236196

SEQ ID NO: 293931 - RNA, 64 nt, hsa; identical to SEQ ID NO: 236197

SEQ ID NO: 293932 - RNA, 64 nt, hsa; identical to SEQ ID NO: 236198

SEQ ID NO: 293933 - RNA, 64 nt, hsa
aaggaauggcgugggaugggggaaagaaaagaaagagaagaagcuggggucuccaggcagggua

SEQ ID NO: 293934 - RNA, 64 nt, hsa
agagaaaauauuaauuuucaaggggaaaaaaccugagaagaaagggagaaaagaccaugaaauu

SEQ ID NO: 293935 - RNA, 64 nt, hsa
uaaagccaggaaagucaaaaaaacgaaagagaaggagaagaaaaaggaaaagggcaaauugaaa

SEQ ID NO: 293936 - RNA, 64 nt, hsa
gagcagaaagguacucugaaacaugguggccugagagaagaagagcuggagaaaaugaaagaag

SEQ ID NO: 293937 - RNA, 64 nt, hsa
acuaaagugacacaaagagaaugaagcagaaguagagaagaaagacuguaugugacaauuaccu

SEQ ID NO: 293938 - RNA, 64 nt, hsa
uuuauuucccaauuacaggaaauuagaucgacuggagaagaaaaaaaagaaaaaagauagaaaa

SEQ ID NO: 293939 - RNA, 64 nt, hsa
agagagagagagagagagagagagaaagauggaggagaagaacuuggauuccccuggguagaug

SEQ ID NO: 293940 - RNA, 64 nt, hsa
cccagaaggaggacuuugggccaauuucggaggagagaagaaagugcaacguggggagagggaa

SEQ ID NO: 293941 - RNA, 64 nt, hsa
uuagaagguggagaugaugauauugaagagaugggagaagaagauagugaggucauugaaccuc

SEQ ID NO: 293942 - RNA, 64 nt, hsa
cucuguauuugcaaaugcagauaaaggugaugaugagaagaauacagacaacucagaggacagu

SEQ ID NO: 293943 - RNA, 64 nt, hsa
uaaaucuuaaaaguguuguuaucaugacuggugagagaagaaaacauuuuguuuuuauuaaaug

SEQ ID NO: 293944 - RNA, 64 nt, hsa
uuaagcaccauggccuugaugauucacuguuggggagaagaaacaagaaaaguaacugguuguc

SEQ ID NO: 293945 - RNA, 64 nt, hsa
uuuucugauaucucuaaaaugcuguuaaguucuggagaagaacuucaggagaagaagaucuauc

SEQ ID NO: 293946 - RNA, 64 nt, hsa
uaaaaugcuguuaaguucuggagaagaacuucaggagaagaagaucuaucagcuggcuuuuaaa

SEQ ID NO: 293947 - RNA, 64 nt, hsa
uacgauccaucucccuuugugagucaaauguuaagagaagaaacuuguauuugcagcuagaggu

SEQ ID NO: 293948 - RNA, 64 nt, hsa
auaagcgggaacccuuaggauccccucuguccacgagaagaagcugaggcucugagcggaugca

SEQ ID NO: 293949 - RNA, 64 nt, hsa
caggguccucuguaugagugugcacccagcugaagagaagaaauggagagcagcaauuggagcu

SEQ ID NO: 293950 - RNA, 64 nt, hsa
aaaagguuagucuucaauagacugaaauguauaagagaagaaccaagucuuacauagaaaaaaa

SEQ ID NO: 293951 - RNA, 64 nt, hsa
auggaagaguuguaauauauacuuuaagaaagaagagaagaaaacuaguaucucuaagcgguaa

SEQ ID NO: 293952 - RNA, 64 nt, hsa
gcauguaaacaaagauaucuuugcuuuaagaugugagaagaaaugaauuuacuuuguuugcauu

SEQ ID NO: 293953 - RNA, 64 nt, hsa
auuugaugacaauagcugcuuaguuuccuguuaagagaagaaacuuuaucuuuuaauuaugugc

SEQ ID NO: 293954 - RNA, 64 nt, hsa
uaguccuaguuccuuuguuacuccugugagcaccgagaagaacugggcgacucccagucccacc

SEQ ID NO: 293955 - RNA, 64 nt, hsa
aaguaggcucucacuagaguuaccauucauauuugagaagaaaagaacauuuaauaaauguaug

SEQ ID NO: 293956 - RNA, 64 nt, hsa
uugauuuuacagugcacugacaguuuacaggaaggagaagaacagaauuucugcacacuacaca

SEQ ID NO: 293957 - RNA, 64 nt, hsa
gcucaggggugugccugucuguuacacuggaggagagaagaaugagccuacgcugaagauggca

SEQ ID NO: 293958 - RNA, 64 nt, hsa
uugugaacugacaggcagccuggacauagagagggagaagaagucagagagggugacaagauag

SEQ ID NO: 293959 - RNA, 64 nt, hsa
ggcaugugugagcagaagggaggaugaggaaaaagagaagaaaccccgguacugacaagcuguu

SEQ ID NO: 293960 - RNA, 64 nt, hsa
cuggggagagccugugaggaccgagaggagaaaugagaagaaggaacaaaaauauuauuucuau

SEQ ID NO: 293961 - RNA, 64 nt, hsa
ggagcagcugacagggugggucucccuuaccaaagagaagaaccacucucuggcgcugggguga

SEQ ID NO: 293962 - RNA, 64 nt, hsa
ccagcggcuugugcucacucugucugccagguaugagaagaacacguaagaccgccaccacacu

SEQ ID NO: 293963 - RNA, 64 nt, hsa
cuuugagucucagucugaugacccacacuuccaugagaagaagcagauccccuguguggucucc

SEQ ID NO: 293964 - RNA, 64 nt, hsa
aaggaccuuggaagagcaagggacagugaggcaggagaagaacaagaaauggauguaagccugg

SEQ ID NO: 293965 - RNA, 64 nt, hsa
gcuccugcugaagaguuuagaaugaggcagcggugagaagaagggugggagggcgugggggccc

SEQ ID NO: 293966 - RNA, 64 nt, hsa
auuuggacacaugaauuaaaucccaagggaaagugagaagaaaauuaauguauuagcaaccagu

SEQ ID NO: 293967 - RNA, 64 nt, hsa
gagagaaaugcaucacuuccaaacccauguauuagagaagaagggcgugaaauuuaucaccuaa

SEQ ID NO: 293968 - RNA, 64 nt, hsa
aggauauguuuugguaaauguagacugugcacuugagaagaauguauuuugaguuguuggguac

SEQ ID NO: 293969 - RNA, 64 nt, hsa
ugucugaaaccgguuuuaaaaugugacucucccagagaagaagccgcuggcuguaugaaacuug

SEQ ID NO: 293970 - RNA, 64 nt, hsa
ugcuacaauugcugugcaaagaaauuccagaggggagaagaauguaaaaguuugguggugggug

SEQ ID NO: 293971 - RNA, 64 nt, hsa
aauaaaaaaagaaagaaagaaaagaagaagaaaagagaagaaggagaaggagaugaaggaggag

SEQ ID NO: 293972 - RNA, 64 nt, hsa
ggagaaggagaugaaggaggaggaggaggagaaggagaagaagaagaagaagaagaccacaaaa

SEQ ID NO: 293973 - RNA, 64 nt, hsa
ccauggggugucccgugagugugaguguggcagugagaagaagcaucgagggcgaggggaauau

SEQ ID NO: 293974 - RNA, 64 nt, hsa
ugggagcuguuuugucagugucuuggggucacaggagaagaaagcgggacuuuggugggaagga

SEQ ID NO: 293975 - RNA, 64 nt, hsa
aauauguuucucaagcaaccugcaucuuuuaugagagaagaaagagugagagaagaauugccuc

SEQ ID NO: 293976 - RNA, 64 nt, hsa
caaccugcaucuuuuaugagagaagaaagagugagagaagaauugccucuggacuaucaucaau

SEQ ID NO: 293977 - RNA, 64 nt, hsa
auccuccaaaugcucuggagaggcccccacccuugagaagaacugacacagagaagaacauuuu

SEQ ID NO: 293978 - RNA, 64 nt, hsa
ggagaggcccccacccuugagaagaacugacacagagaagaacauuuucucaggcucguagaga

SEQ ID NO: 293979 - RNA, 64 nt, hsa
cccagcaguugccccacccuguguaguuguugaggagaagaagccucaacuuacccaggaggag

SEQ ID NO: 293980 - RNA, 64 nt, hsa
gauaggccuucgagcaaaagcaaagauccaccgagagaagaagagaaagaaaagaaaaagaaaa

SEQ ID NO: 293981 - RNA, 64 nt, hsa
caguaggaagcggacccgcuccagaaguccccacgagaagaagaagaagaggcggucccggucg

SEQ ID NO: 293982 - RNA, 64 nt, hsa
guacauggauccaggcuucugccaaaaaaaaaaagagaagaagaugacgaugaugaccagucgu

SEQ ID NO: 293983 - RNA, 64 nt, hsa
cuagaucagaaaucugacuagauuggauucugaggagaagaaccuacuacaaggcaaggagccg

SEQ ID NO: 293984 - RNA, 64 nt, hsa
ugaaacagucuugagccugggguugacuggguuagagaagaaccgggaugcaaggagcugccug

SEQ ID NO: 293985 - RNA, 64 nt, hsa
caggagacagaggcuuuuuugaauucacugugaagagaagaacccgaaccuuaagacgccagau

SEQ ID NO: 293986 - RNA, 64 nt, hsa
ucauauccauugugguuaguuacucaguuauguugagaagaaucuggagcuaaaagcagagaug

SEQ ID NO: 293987 - RNA, 64 nt, hsa
uuucauuuucaaaaacuauuuaccaaaacaaauggagaagaaacauccaaaagcacauuucauu

SEQ ID NO: 293988 - RNA, 64 nt, hsa
aauuaaugaugcuuaaagagaaaagaaaaaaagagagaagaaaaaggagagaugaaaaaggagg

SEQ ID NO: 293989 - RNA, 64 nt, hsa
agaagaaaaaggagagaugaaaaaggaggaugaggagaagaauuaccuuuugacaaucuguuag

SEQ ID NO: 293990 - RNA, 64 nt, hsa
cuccgacuuuauagcaggaacuuucugguaguaugagaagaaaucauugggugacuaugacuaa

SEQ ID NO: 293991 - RNA, 64 nt, hsa
agcauuggcaggaaaaagcucuagaggcuauacagagaagaaaaaaagagcaaaaaugagaccu

SEQ ID NO: 293992 - RNA, 64 nt, hsa
aaaacugccuacaggccauaguuaaccugcaauagagaagaaagggaaguagggcagugcauga

SEQ ID NO: 293993 - RNA, 64 nt, hsa
gugacagaacaagacugucucaaaaaaaaaaaaagagaagaaaaacugccuacaggccauaguu

SEQ ID NO: 293994 - RNA, 64 nt, hsa
ccauuuggggugguugggucaugacagcuaccaugagaagaagugucccguuuuguccaguggc

SEQ ID NO: 293995 - RNA, 64 nt, hsa
caggaggugggagguggaugguucuuauucuguggagaagaagggcgggaagaacuuccuuuca

SEQ ID NO: 293996 - RNA, 64 nt, hsa
ccucugauaagaucgacaaaagaaacaacaaaaugagaagaagagguuccucgaaaggggggag

SEQ ID NO: 293997 - RNA, 64 nt, hsa
acaaaaugagaagaagagguuccucgaaaggggggagaagaaauuuugagaauggaaaaauccc

SEQ ID NO: 293998 - RNA, 64 nt, hsa
uccagcuggcacuugacagggugcagucauuggugagaagaaucagaaaaagaagacccaucag

SEQ ID NO: 293999 - RNA, 64 nt, hsa
cuccaaaaaaagaaaauagagcuuuauaagcagagagaagaaaauaaucaucuaagaccaucuc

SEQ ID NO: 294000 - RNA, 64 nt, hsa
gcuucucuuucuaaaaaaaaaaaaaaaaaagaaagagaagaaagaagugauuccuacccccuac

SEQ ID NO: 294001 - RNA, 64 nt, hsa
cuuucuuagcucaagagagaggcugagaaaugcagagaagaauaagacauaaaauagcuccgac

SEQ ID NO: 294002 - RNA, 64 nt, hsa
aaaauauuuaaguaaaaacaaaaugaugcauuuugagaagaacaaagugugcacucagcggcug

SEQ ID NO: 294003 - RNA, 64 nt, hsa
uuaaauguguaagucacccccaccaaaaacaaaagagaagaaaaagaauagaaagaauuaucca

SEQ ID NO: 294004 - RNA, 64 nt, hsa
ucuacucauucaaagcacauuguagauauucagagagaagaacaaauggcuggcuuggcaaauc

SEQ ID NO: 294005 - RNA, 64 nt, hsa
caguuuuugugggugauugcaauuuuuuaaugaaaugcauuagaacaucuaagcacgucaccua

SEQ ID NO: 294006 - RNA, 64 nt, hsa
uuuugcauugcaguauagaucugugcauagauauaugcauuaaguguagcaaaucgugauguaa

SEQ ID NO: 294007 - RNA, 64 nt, hsa
aaggcucuucuguuuucaacaucugugcugggucaugcauuagcauuaauuacuacaaugauuc

SEQ ID NO: 294008 - RNA, 64 nt, hsa
uuccuugguaucguguuaucaugugucgucaucuaugcauuagaguugauguguuuuguacuag

SEQ ID NO: 294009 - RNA, 64 nt, hsa
uaucucucuuuauccuaugugauuccugcucugaaugcauuauauuuuccaaacuauacccaua

SEQ ID NO: 294010 - RNA, 64 nt, hsa
aucaucaauugcagacugugaaguuguguauuuaaugcauuauagcaugguggaaaauaagguu

SEQ ID NO: 294011 - RNA, 64 nt, hsa
gguaaguaugcagcacauugcuuauauccuggguaugcauuauuuuaaauguuguaucauuaaa

SEQ ID NO: 294012 - RNA, 64 nt, hsa
gauuugauucauuuuauuuaugccuaagucaucuaugcauuaacaugucauauucuuaacuuug

SEQ ID NO: 294013 - RNA, 64 nt, hsa
cuuagagccugcuauucuuuuagacauagggaggaugcauuauccuguauucuccuccaacauc

SEQ ID NO: 294014 - RNA, 64 nt, hsa
uacucucucugccccuuuuacuuuuuaaucuggaaugcauuacuguaaacaugaucuuucccau

SEQ ID NO: 294015 - RNA, 64 nt, hsa
uuaagauuuuaauuauucaacuuaaaaaguagaaaugcauuauuauacauuuuuuuaagaaagg

SEQ ID NO: 294016 - RNA, 64 nt, hsa
aaccacuaggcucuagagcucccgccgcgccccuaugcauuauguucacaaugccaaucuagau

SEQ ID NO: 294017 - RNA, 64 nt, hsa
ggaagcuaaaaccauguuugcuuucugguacuacaugcauuagcgaaagguuaaguaaguuuug

SEQ ID NO: 294018 - RNA, 64 nt, hsa
ccugcauaauauauuuuuguugcuuuuauaaaucaugcauuacauaaagugugacaacuucaaa

SEQ ID NO: 294019 - RNA, 64 nt, hsa
cgagacuccaucucuauaaauaaaaaaaaaggaaaugcauuaaauagaagguugauaguuuauc

SEQ ID NO: 294020 - RNA, 64 nt, hsa
uguacuucuaaacagagaaggcuuauaaaaguaaaugcauuaaggccaagugcaguggcucaca

SEQ ID NO: 294021 - RNA, 64 nt, hsa
auuuacaguuucaauagcacauaauuuauuuucuaugcauuauaaauggccuugcaguuggcuc

SEQ ID NO: 294022 - RNA, 64 nt, hsa
caaaacuguaaggaaaaagaguguuaauaccaugaugcauuaacauaaaauaucaaacacacaa

SEQ ID NO: 294023 - RNA, 64 nt, hsa
cucggccucugugggauuuagggaagcauuauaaaugcauuaauccuuauagucaauucugugc

SEQ ID NO: 294024 - RNA, 64 nt, hsa
cucuuuugggggaucaaaauuaaaauuccuaauuaugcauuaucuuucuuuucuccaguccuca

SEQ ID NO: 294025 - RNA, 64 nt, hsa
uaauucuucaagauccaaaagaaaaaaauauacuaccucagauuuucaagaaggugaacuaaau

SEQ ID NO: 294026 - RNA, 64 nt, hsa
uauugcaauucaagccauccaugaagccaaugucaccucagagguuucaaacauugcacaagca

SEQ ID NO: 294027 - RNA, 64 nt, hsa
ucaacucuuuuuugugagccuacuugugaauauuaccucagauaccuguugucacucuucacag

SEQ ID NO: 294028 - RNA, 64 nt, hsa
uugaucagcauugaggugaugcucaccuccgaggaccucagaacuggugcagcuucucucuccc

SEQ ID NO: 294029 - RNA, 64 nt, hsa
gaccccaagauaggcugaaguccuaacuugaagcaccucagaaugugaccuuguuuggaaacac

SEQ ID NO: 294030 - RNA, 64 nt, hsa
cagcccgggacugcccagaugacugucuaaccagaccucagaaucagaaacgucuccaaagcca

SEQ ID NO: 294031 - RNA, 64 nt, hsa
acucccguggugguguuugagagccaacaacacuaccucagagacgggucuuugggaaacuuug

SEQ ID NO: 294032 - RNA, 64 nt, hsa
cugacagccccgggcccaagaaaaacccauaaccaccucagauggaucugacguggcuaaggga

SEQ ID NO: 294033 - RNA, 64 nt, hsa
cacagcugcucaccuugucuggcaaacuggagggaccucagaaacuggacuccugcauguccuu

SEQ ID NO: 294034 - RNA, 64 nt, hsa
cuugcaaaacaaaagaaagugagggguuuuuuuaaccucagagcuagcugcucucugcagccuc

SEQ ID NO: 294035 - RNA, 64 nt, hsa
ugccccucguugcaaaacgagcuuguuucccugaaccucagaaauccucagcuucaaacauggg

SEQ ID NO: 294036 - RNA, 64 nt, hsa
guaauagagucauuaaaaugcaggacugaaagagaccucagaggucucuaucccaucccuuccu

SEQ ID NO: 294037 - RNA, 64 nt, hsa
gaagcagagaaacuguucuucugguuccugcacaaccucagaggggcaaaaacccuccccagga

SEQ ID NO: 294038 - RNA, 64 nt, hsa
gugaacuugcuggaaauacaaauccucaggccccaccucagaccuacugaaucagaaucucugg

SEQ ID NO: 294039 - RNA, 64 nt, hsa
cugauccccuuugcgagaugcugugggugcuaacaccucagagcuguccucuucucuagagugg

SEQ ID NO: 294040 - RNA, 64 nt, hsa
uucucucuaggaaaugggggugauaauugugccuaccucagauagacagugccagaauuaagug

SEQ ID NO: 294041 - RNA, 64 nt, hsa
ucugaaucuagacaucgccauuccccgaggugcgaccucagacuaaugacauccuggcugagcc

SEQ ID NO: 294042 - RNA, 64 nt, hsa
uccccacacgugccgaugucagguucauugaaauaccucagauuuguaauuguugauguuugag

SEQ ID NO: 294043 - RNA, 64 nt, hsa
gauagcacauggguagccuaggcagugaguaaauaccucagauguccuccugcagcaagugucu

SEQ ID NO: 294044 - RNA, 64 nt, hsa
agcauggauggggaugaaggcacaggcgucuccaaccucagaggcccuuuguggggucaggaca

SEQ ID NO: 294045 - RNA, 64 nt, hsa
cucggggagcgcccuguucugaaggcaccuccucaccucagaaacugguggugcucucagggca

SEQ ID NO: 294046 - RNA, 64 nt, hsa
gaaucaaacacagaaccucagaaccagauuuaggaccucagaauccugcacucaagguggcagg

SEQ ID NO: 294047 - RNA, 64 nt, hsa
cuugagcugucuguaccccagaaucaaacacagaaccucagaaccagauuuaggaccucagaau

SEQ ID NO: 294048 - RNA, 64 nt, hsa
cccgugccccccgcccgggcgggguacugccugcaccucagaccucugccugggggcucccugu

SEQ ID NO: 294049 - RNA, 64 nt, hsa
auccugucuaaagcuuuguggcacccucagugcaaccucagaacagacaaaucaugaaugagcu

SEQ ID NO: 294050 - RNA, 64 nt, hsa
gaauguucuauuucugccuccccuuaaaggggagaccucagaaguaaaggaauuugauguugug

SEQ ID NO: 294051 - RNA, 64 nt, hsa
uggugcuggccgcccccagcccccuccuggugccaccucagaccccggggugagggggggcucc

SEQ ID NO: 294052 - RNA, 64 nt, hsa
agcauugaacaauguucucgaugaauuuuauuuaauuacugacauuuugugauauuugaauguu

SEQ ID NO: 294053 - RNA, 64 nt, hsa
auaugguuaauguguaaaacaagguucuaacaguauuacugaauauuaauguuucuuguuuaga

SEQ ID NO: 294054 - RNA, 64 nt, hsa
uguguacauuucaacaaauacuuuuacauuugacauuacugaggucauucugaguuuuaggucc

SEQ ID NO: 294055 - RNA, 64 nt, hsa
uacaugaacaaaaaguggugugcucgaaaaagacauuacugaugccuuuuuuuuauagagugga

SEQ ID NO: 294056 - RNA, 64 nt, hsa
aguauuuuuuguuguuuuuaucaucaugugcaauauuacugauuuguuuccaugcugauugugu

SEQ ID NO: 294057 - RNA, 64 nt, hsa
cauuaguuuuuuuuguuuguuucuuuuucaugguauuacugaagguguguauacucccuaauac

SEQ ID NO: 294058 - RNA, 62 nt, hsa
uguuuguaacuuuuuuaauaaaauagacaucuguauuacugagguugguuucuuuaauuauu

SEQ ID NO: 294059 - RNA, 64 nt, hsa
cauucaugugauuuaugggucagcaugaccauuaauuacugaguagaaauugacuaaacuuuga

SEQ ID NO: 294060 - RNA, 64 nt, hsa; identical to SEQ ID NO: 294056

SEQ ID NO: 294061 - RNA, 64 nt, hsa; identical to SEQ ID NO: 294057

SEQ ID NO: 294062 - RNA, 64 nt, hsa
gaagagaaaaugaucugauuuucccuuauacuucauuuuacaauacauauucccuuuuaacuua

SEQ ID NO: 294063 - RNA, 64 nt, hsa
acuuaagaaccauauuuacauugcuuaacacagaauuuuacaucuaagcaaggacuggcuuuag

SEQ ID NO: 294064 - RNA, 64 nt, hsa
gacuggcuuuagaagcaguguaguucuaccucucauuuuacagaugagaaaaccgaagcccaga

SEQ ID NO: 294065 - RNA, 64 nt, hsa
cugauuauagagaaucauauauaguccagucuucauuuuacauacacacacauauuuuacacac

SEQ ID NO: 294066 - RNA, 64 nt, hsa
uauaguccagucuucauuuuacauacacacacauauuuuacacacacacacauuuuacacacac

SEQ ID NO: 294067 - RNA, 64 nt, hsa
uuuacauacacacacauauuuuacacacacacacauuuuacacacacacacacacacacacaca

SEQ ID NO: 294068 - RNA, 64 nt, hsa
aaaacuuguuuuaaguccaccccuuaguuuccuuauuuuacaaggucucucuucagggaccaac

SEQ ID NO: 294069 - RNA, 64 nt, hsa
aggugcuuauucucaaagcaggaauugguggcagauuuuacaaaagauguauccuuccaauuug

SEQ ID NO: 294070 - RNA, 64 nt, hsa
gcaugugcugugaccauuuauaauguuaguagaaauuuuacaauaggugcuuauucucaaagca

SEQ ID NO: 294071 - RNA, 64 nt, hsa
guauagauuauaaaauuauuuuuauuaaauaaauauuuuacaguauauuuucucuuuuuaauca

SEQ ID NO: 294072 - RNA, 64 nt, hsa
aaagggaagugauaucauaaaaguagcaaccuucauuuuacauucugucuguuuuucuuuuuuu

SEQ ID NO: 294073 - RNA, 64 nt, hsa
uuuuuacuucauuauuuuuaggaauaaauguaagauuuuacaaaucuuuuauuuccccacaaga

SEQ ID NO: 294074 - RNA, 64 nt, hsa
uggaggcuaugaaaugucuuuuuuucuuuuugguauuuuacauuauucacauuuuagaauaaca

SEQ ID NO: 294075 - RNA, 64 nt, hsa
guauaccaaauuaaaucuuaauagauuuaaugcaauuuuacagacacaauaccuucaugaauuu

SEQ ID NO: 294076 - RNA, 64 nt, hsa
ugcacugaaagcuaacagggagagguuacacaauauuuuacaguuucuuaaacauaauuuaaug

SEQ ID NO: 294077 - RNA, 64 nt, hsa
aagcacaaaaaaagucagcgucuucauuauuuauauuuuacaaaaagccaaauuauuucagcau

SEQ ID NO: 294078 - RNA, 64 nt, hsa
gcaguccgaccaagcccacuggaauuauccuuuaauuuuacagauaccacuugcuguaggcugu

SEQ ID NO: 294079 - RNA, 64 nt, hsa
uuuaugaugaccugaaauuuuacauccgaacaaaauuuuacauccgaaaagcaaccaacuucuu

SEQ ID NO: 294080 - RNA, 64 nt, hsa
uuccuuuuuggcauaauuuuuaugaugaccugaaauuuuacauccgaacaaaauuuuacauccg

SEQ ID NO: 294081 - RNA, 64 nt, hsa
gcacccuugcuugccuuuuucagagaaaaagaaaauuuuacaacaggaucacacuaguuuuugc

SEQ ID NO: 294082 - RNA, 64 nt, hsa
uuguacuuuauuuuuguauaaaauccauagauuuauuuuacauuuagaguauuuacacuaugau

SEQ ID NO: 294083 - RNA, 64 nt, hsa
guaaagagaaucaacuagguauuuaagacugauaauuuuacaauuuauaugcuucacauagcau

SEQ ID NO: 294084 - RNA, 64 nt, hsa
cuauagaguugggaaaaaauauuuccacuuagauauuuuacaugguuuuguuuaaaauuaccau

SEQ ID NO: 294085 - RNA, 64 nt, hsa
uuuuuugguacugaaucuucaaaauccagaguguauuuuacacuuaccgcacaucuccauucag

SEQ ID NO: 294086 - RNA, 64 nt, hsa
gcaauagaacuuuuauaaaauaauuagaacagagauuuuacaguuaagguuucaaauuguggca

SEQ ID NO: 294087 - RNA, 64 nt, hsa
auuuuucaagagguuagccacuaagacuuuaauaauuuuacaagggaaaaagccuuuuuuuuuc

SEQ ID NO: 294088 - RNA, 64 nt, hsa
ucagauuucacccauaaaaacgcacaauuguauuauuuuacagagauguguccagcgcccccug

SEQ ID NO: 294089 - RNA, 64 nt, hsa
agacacuucaaugccauuuguuagacacuucaauauuuuacaugguuuucaauguacacuguac

SEQ ID NO: 294090 - RNA, 64 nt, hsa
uguauugacuauuuucguucauuacuugauuaagauuuuacaaaagaggagcacuuccaaaauu

SEQ ID NO: 294091 - RNA, 64 nt, hsa
gccucccuaucccucacacauccagacaucaugaauuuuacaugguacucuuguugaguucugu

SEQ ID NO: 294092 - RNA, 64 nt, hsa
uuuguauuuuauguuguuguuaguuuaaaagguaauuuuacacaugcuggaaugacuguaauua

SEQ ID NO: 294093 - RNA, 64 nt, hsa
acuaagugauuuaaauucaauugaugaagaugugauuuuacagaagcagaaguuucauuuucuu

SEQ ID NO: 294094 - RNA, 64 nt, hsa
cuggaaaccaaaucuccuggcaccuugaucuuggauuuuacagccuccagaacugugagaaaau

SEQ ID NO: 294095 - RNA, 64 nt, hsa
agaaaaguuuggggcacucaucccauucauaauuauuuuacauuuaaauuacuguuccuacuua

SEQ ID NO: 294096 - RNA, 64 nt, hsa
uccugaucaguuugaaggacauugauaaacugugauuuuacaauaacauuaucaucugcaguua

SEQ ID NO: 294097 - RNA, 64 nt, hsa
cuuggugauuaucaaccuguugugucuuuauuuaauuuuacaucuuuuugaagcacugccacag

SEQ ID NO: 294098 - RNA, 64 nt, hsa
uaauuuggcucuuucugcucacuaaaaaucauauauuuuacagauuuauuuuguuucuggagaa

SEQ ID NO: 294099 - RNA, 64 nt, hsa
uauuuugcacaucacaaauuacacuauccuggguauuuuacaggugacauguuacuucguucuu

SEQ ID NO: 294100 - RNA, 64 nt, hsa
gcuuuuaauugauuagaauucugccaauagguggauuuuacaaaaccacagacaaccucugaaa

SEQ ID NO: 294101 - RNA, 64 nt, hsa
cauuugaaagguaacaguggagcuagggcugggcauuuuacauccaggcuuuuaauugauuaga

SEQ ID NO: 294102 - RNA, 64 nt, hsa
acagacaaggaaagaaaaaacuugaaugaaauggauuuuacagaaagcuuuaugauaauuuuug

SEQ ID NO: 294103 - RNA, 64 nt, hsa
cuacuuaugcagaaaaauaggcaauaagaacuucauuuuacaauuuaguuuucaaaaaaaaaau

SEQ ID NO: 294104 - RNA, 64 nt, hsa
augucuaaacucuauguugcucaguguacuuaaaauuuuacaguuauauuuguauaacguuuau

SEQ ID NO: 294105 - RNA, 64 nt, hsa
aucaaaauucugauuugauggcaauugaauuuucauuuuacaauagauaaaugcuugugcuacc

SEQ ID NO: 294106 - RNA, 64 nt, hsa
aaguuuagcacuguaucagaaugaagaaacuaauauuuuacauaaaaacuaauacuuucaauuu

SEQ ID NO: 294107 - RNA, 64 nt, hsa
gaagccugcuuaaaaaauguaguugagccccauaauuuuacaaaugggcgaacuuuuaaacuuc

SEQ ID NO: 294108 - RNA, 64 nt, hsa
aacuucuaacucuacuuggaucaaaaccucauacauuuuacaaagggguccugacaagucagcu

SEQ ID NO: 294109 - RNA, 64 nt, hsa
uagcuaccaucugauccccucagacauucucaggauuuuacaagacugucagaguggggaaccc

SEQ ID NO: 294110 - RNA, 64 nt, hsa
cccccuggcuccaggccuguccaucaggaaguaaauuuuacagggcaccaagcuuugcccccua

SEQ ID NO: 294111 - RNA, 64 nt, hsa
ucaauacaauccuuugaauuuuuuaucugcauaaauuuuacaguagaauaugaucaaaccuuca

SEQ ID NO: 294112 - RNA, 64 nt, hsa
gauuucaaauguuuuucuucuggaucugcuuuuuauuuuacaaaaauauuuuucauacaaaugg

SEQ ID NO: 294113 - RNA, 64 nt, hsa
cuuuuucauacuaagcuuucgaaaucugguguguauuuuacacuuucugcacaucuccauuugg

SEQ ID NO: 294114 - RNA, 64 nt, hsa
aauauuucaacauauaaaaauauauuagugagacauuuuacauucucuuuuucauacuaagcuu

SEQ ID NO: 294115 - RNA, 64 nt, hsa
gauuuuuccuacuuuaagaaaauaaaauaauuuaauuuuacauuagauuccacguuagauuugg

SEQ ID NO: 294116 - RNA, 64 nt, hsa
uguuaauaaauccuaauaaauuuaaauuuuuaaaauuuuacaaaccuauuggcuaaguacauuu

SEQ ID NO: 294117 - RNA, 64 nt, hsa
gaacaaccccgugagauaaguaguuauuauccucauuuuacacaugagggaccgaaggauagaa

SEQ ID NO: 294118 - RNA, 64 nt, hsa
ggaaacucaaucuguuuuuaccuuuaaacagugaauuuuacaugaaugaauggguucuucacuu

SEQ ID NO: 294119 - RNA, 64 nt, hsa
agguuuggacaaaauggaauacucuuauaucuauauuuuacauaaauuuaguauuuuguuucag

SEQ ID NO: 294120 - RNA, 64 nt, hsa
uaaauagcuuuuuucucugauacagaaaaguugaauuuuacauggcuggagcuagaauuugaua

SEQ ID NO: 294121 - RNA, 64 nt, hsa
uuuguuacauaaaauauaaggaaaucuuuauacuauuuuacaguaaccacaaucuaaauauuua

SEQ ID NO: 294122 - RNA, 64 nt, hsa
uggagcuauauuuccacuuagaaaaacuaagguaauuuuacaauauaugcugagauuaaaaacc

SEQ ID NO: 294123 - RNA, 64 nt, hsa
aauuuacuuauuauguuugaacuaaaaugauugaauuuuacaguauuucuaagaauggaauugu

SEQ ID NO: 294124 - RNA, 64 nt, hsa
uguaaauaaaacacucuuccauaugauauucaacauuuuacaacugcaguauucaccuaaagua

SEQ ID NO: 294125 - RNA, 64 nt, hsa
agggcccaaguccacaauuuggugagaccacuaaauuuuacauauaauuauacacacacauaug

SEQ ID NO: 294126 - RNA, 64 nt, hsa
uuaaaauaaagugacuauuaaccagaaaagaaacauuuuacauaaaaugcuaaaauuuauuaua

SEQ ID NO: 294127 - RNA, 64 nt, hsa
ucucauauuauauggacuuuauaugaaaaugaauauuuuacaguuugcacaguauuauuuuaca

SEQ ID NO: 294128 - RNA, 64 nt, hsa
augaaaaugaauauuuuacaguuugcacaguauuauuuuacagaaaaggaaucagagaaucuac

SEQ ID NO: 294129 - RNA, 64 nt, hsa
auauacuuauuuuaaagaaaaucuuauauaguacauuuuacaaaaauuauaaaaaaugaauuag

SEQ ID NO: 294130 - RNA, 64 nt, hsa
cuuagauucauaauguuaggagcauuuaaucuguauuuuacaaguuaggaagcagaggaucaga

SEQ ID NO: 294131 - RNA, 64 nt, hsa
caggcaugagccaccacgccuggccaguuucuucauuuuacauauggucacauuggcgccuaga

SEQ ID NO: 294132 - RNA, 64 nt, hsa
acaacagugggaggucuguauccugaauguccucauuuuacagaugaggacauugaggagaaga

SEQ ID NO: 294133 - RNA, 64 nt, hsa
uauuaaauuuaaauguuaaugugaaaugguuuaaauuuuacaugcugaaaagcugcagagcaga

SEQ ID NO: 294134 - RNA, 64 nt, hsa
guaacuaugaacauacacaguuuuccagaaauagauuuuacacuguuuagaauuccaacaccua

SEQ ID NO: 294135 - RNA, 64 nt, hsa
gaagaugaguuuucaaugaguagucauaguugaaauuuuacaaccaaagcucccauuugauugu

SEQ ID NO: 294136 - RNA, 64 nt, hsa
auuuuguugaaaugaaaauacuguguauuacuuuauuuuacaggccacaauugauuaugaaguc

SEQ ID NO: 294137 - RNA, 64 nt, hsa
cuauuucauuuuugaauaauucuucauuuuuauaauuuuacauaucuuggcuugcuauauaaga

SEQ ID NO: 294138 - RNA, 64 nt, hsa
aaagauuuuaaguaagaguagauacauuguacccauuuuacauuuucuuauuuuaacuacagua

SEQ ID NO: 294139 - RNA, 64 nt, hsa
gcaguucuaccaagcccauuggaauuauccuuuaauuuuacagauaccacuugcuguaggcuac

SEQ ID NO: 294140 - RNA, 64 nt, hsa
aagcacaacaaaagucagugucuucauuauuuauauuuuacaaaaagccaaaauauuucagcau

SEQ ID NO: 294141 - RNA, 64 nt, hsa
uucacauuuuauauacuaguaucuggcuauuaguauuuuacaggaaccauaguucuuggugacu

SEQ ID NO: 294142 - RNA, 64 nt, hsa
uguaaugucauauuugcugcuacaguagcucaauauuuuacagggcuaacauaaagcuggcucc

SEQ ID NO: 294143 - RNA, 64 nt, hsa
uuuuagugacuuuuuaacuuguaaauuguagcugauuuuacauuuaucuuccugaaggaaacuc

SEQ ID NO: 294144 - RNA, 64 nt, hsa
ccacucuugagaaguaauuuuuauuuucagaaccauuuuacagauuuaaaauaaacagguuuga

SEQ ID NO: 294145 - RNA, 64 nt, hsa
uuugauuuguuucuggcuuuagaaugugaggcaaauuuuacauucuugguucuauuaagauuuu

SEQ ID NO: 294146 - RNA, 64 nt, hsa
guuggugauuuuacugaaaacuuuugagaucuucauuuuacaggcagaccugucuaacuacaag

SEQ ID NO: 294147 - RNA, 64 nt, hsa
cuauaucauaagcauuuuuaaaguuucuuuucuaauuuuacauuguauuagauuuucugauucu

SEQ ID NO: 294148 - RNA, 64 nt, hsa
aaauguuucagaauucaaucgugaaggaacaggcauuuuacacuaugaagacauucuuuugaga

SEQ ID NO: 294149 - RNA, 64 nt, hsa
uuuuagccuaaaguaaaggcugugaagaaaauucauuuuacauuggguagacaguaaaaaacaa

SEQ ID NO: 294150 - RNA, 64 nt, hsa
caugugauccaagcuguauauaccauauauaaacauuuuacaugaaucauuuaguuuuuuaauu

SEQ ID NO: 294151 - RNA, 64 nt, hsa
uguuguaauuuaaaauuuuggccacuuuuuucagauuuuacaucauucuugcugaacuucaacu

SEQ ID NO: 294152 - RNA, 64 nt, hsa
uccugauuuuugucugaugugaaaaagccuugguauuuuacauuuugaaaauucaaagaagcuu

SEQ ID NO: 294153 - RNA, 64 nt, hsa
auuuuuguccucauauacagaaaguucuuaauugauuuuacagucuguaaugcuugauguuuua

SEQ ID NO: 294154 - RNA, 64 nt, hsa
aaaaggcaaauuucaagggaagaaauguaaaagaauuuuacaaaugcuuuccaagugaugaaua

SEQ ID NO: 294155 - RNA, 64 nt, hsa
ugguuuuuacuauugaacccuuguacuuugccuuauuuuacaaauugaggauuaccaauuaaac

SEQ ID NO: 294156 - RNA, 64 nt, hsa
guauuguguagaaagucaccucccuacuccuuuuauuuuacaugagugcugauguguuuuggca

SEQ ID NO: 294157 - RNA, 64 nt, hsa
auaaaauacuaugugaaucucuuaaaaaucugacauuuuacagucuguauuagacauacuguuu

SEQ ID NO: 294158 - RNA, 64 nt, hsa
gaugaguucuuaaaauuuugucagagccuucuucauuuuacaauauuuuguuauuuuuauuuua

SEQ ID NO: 294159 - RNA, 64 nt, hsa
uacaauauuuuguuauuuuuauuuuaccuuuuucauuuuacaauauuucguuauuuuuauuuua

SEQ ID NO: 294160 - RNA, 64 nt, hsa
uacaauauuucguuauuuuuauuuuaccuuuuucauuuuacaaguugcaauauauuguuucguu

SEQ ID NO: 294161 - RNA, 64 nt, hsa
acaagauguaauuuuuacuuuaucucucacacguauuuuacaaaacgucaugagaaacauuguc

SEQ ID NO: 294162 - RNA, 64 nt, hsa
aagaaaccuacuagcauucaaauaaucauucccuauuuuacaaugcaucaguucugucaagcuu

SEQ ID NO: 294163 - RNA, 64 nt, hsa
uucaauuaaaauaacucaugugucacaagaguaaauuuuacauaaucuguacguaguucuaauc

SEQ ID NO: 294164 - RNA, 64 nt, hsa
cagauuuuacacuuaauaguguauuggaaaauucauuuuacauuaaagugacaugaauguggga

SEQ ID NO: 294165 - RNA, 64 nt, hsa
augaaugccuuggauuuagcaaaacguucagcagauuuuacacuuaauaguguauuggaaaauu

SEQ ID NO: 294166 - RNA, 64 nt, hsa
ugggcaucuccacgcaccuguguaugugaaagucauuuuacauuucaaagcaguguguguuucu

SEQ ID NO: 294167 - RNA, 64 nt, hsa
uguauuguacagagaacaugaacgucucuuccuaauuuuacaucuucagcaucauugcauuaaa

SEQ ID NO: 294168 - RNA, 64 nt, hsa
acgcaccugacuuuuuggaguuugcacagcaaacauuuuacacaguuuuauuucuaauauguuu

SEQ ID NO: 294169 - RNA, 64 nt, hsa
gcaaauuuuuguugauauguaaugcucagauugcauuuuacacuugaucuaaacauauaucgaa

SEQ ID NO: 294170 - RNA, 64 nt, hsa
ucuucuuugaguuguuuauggccucccuuaaggcauuuuacaaacccauaagccuacaauagau

SEQ ID NO: 294171 - RNA, 64 nt, hsa
gaacauuggaaauagaugauuagauuuuugugucauuuuacaauuaaaucuaaaaugcuuaauc

SEQ ID NO: 294172 - RNA, 64 nt, hsa
gcuuuuacuguugcaauaagagagauaucuuuuuauuuuacagauauuugugucgucacugucu

SEQ ID NO: 294173 - RNA, 64 nt, hsa
ugcaaguucugggaccuuuuggggcacauguaucauuuuacaaaugagcuuucaagaccauuua

SEQ ID NO: 294174 - RNA, 64 nt, hsa
acuaacagaugaagucucucauuugcuugaagauauuuuacaaaauaccaacuguucuauauuu

SEQ ID NO: 294175 - RNA, 62 nt, hsa
cuuuucccuuccagaucuaaauugaacucaacauuuuacauuccaucuuuucugaagauugu

SEQ ID NO: 294176 - RNA, 64 nt, hsa
acaaguauuuuuucaaugcaagaugaggaugaaaauuuuacauuucaacccaucuggcuaaagu

SEQ ID NO: 294177 - RNA, 64 nt, hsa
cuccuagauaucaaacuaauuuguugggguagagauuuuacaagucaugccauuagaagauuuu

SEQ ID NO: 294178 - RNA, 64 nt, hsa
uuuuuuugucaguauuuucagauuacaugauaaaauuuuacauuugagcuucuagcauugauua

SEQ ID NO: 294179 - RNA, 64 nt, hsa
cuaauuccaaauuagcaacuucauccugcuuucuauuuuacauugaguaaaguuuuaaaaagac

SEQ ID NO: 294180 - RNA, 64 nt, hsa
ggaaucuuaacuauuaaucuaguucaaugcccuuauuuuacagaugggaaaacugaggccugga

SEQ ID NO: 294181 - RNA, 64 nt, hsa
acaauucuacaacauagguaucauuccaaccucuauuuuacagaugagaaaacugaagcacaga

SEQ ID NO: 294182 - RNA, 64 nt, hsa
acuagguuugguuccuucagcccucuaaaagcauagggcuuagccugcaggcuuccuugggcuu

SEQ ID NO: 294183 - RNA, 64 nt, hsa
guauucccaaggauggcgacaagggcagccaagcagggcuuaggauaucccagccuaccaauau

SEQ ID NO: 294184 - RNA, 64 nt, hsa
aguaaaaauaggucagcagagauuucaguuucccagggcuuaaccagaaccgccaccucaaugc

SEQ ID NO: 294185 - RNA, 64 nt, hsa
aguaaaaauagguuggcagagauuucaguuucccagggcuuaaccagaaccgccaccucaaugc

SEQ ID NO: 294186 - RNA, 64 nt, hsa
aaguaaauauuuugaccacuauuuucaacaacccagggcuuauuuucuucugacuucuuggcua

SEQ ID NO: 294187 - RNA, 64 nt, hsa
aucgcacuguuucuaauucuuuuuacacaaaacaagggcuuagaguauacuguauuugcaagua

SEQ ID NO: 294188 - RNA, 64 nt, hsa
cagaaauguguuugguuacugaugcauaagagcaagcaccaauaaaauggcauaaaaauauuaa

SEQ ID NO: 294189 - RNA, 64 nt, hsa
auuuauagugaaguggcuggacuagcauuuguuuagcaccaacaaauaaaaggugggauggggg

SEQ ID NO: 294190 - RNA, 64 nt, hsa
uuccaguuccaagcauggaggcucauucugaagcagcaccaacugagcaaaccccugugguccg

SEQ ID NO: 294191 - RNA, 64 nt, hsa
ucccgguuccaagccuagaggauccuuccaaaccagcaccaacagagccaaggccuugggagca

SEQ ID NO: 294192 - RNA, 64 nt, hsa
ggauauucuaccagagcucucacuauauugucaagccuaagauugaaaaacuggaggcuuuauu

SEQ ID NO: 294193 - RNA, 64 nt, hsa
aagaauuugugaauuauuucuggguuuguguuuugccuaagagcugaucuuauuucugauuugu

SEQ ID NO: 294194 - RNA, 64 nt, hsa
aguggcugggguggagugggaagggagcauugcagccuaagaagaaggccagagagggaaaagg

SEQ ID NO: 294195 - RNA, 64 nt, hsa
ggaacaaucacagggaauggccacaaaccugcccgccuaagacccugaauccguacuuggguca

SEQ ID NO: 294196 - RNA, 64 nt, hsa; identical to SEQ ID NO: 122412

SEQ ID NO: 294197 - RNA, 64 nt, hsa; identical to SEQ ID NO: 122413

SEQ ID NO: 294198 - RNA, 64 nt, hsa; identical to SEQ ID NO: 122453

SEQ ID NO: 294199 - RNA, 64 nt, hsa; identical to SEQ ID NO: 122454

SEQ ID NO: 294200 - RNA, 64 nt, hsa; identical to SEQ ID NO: 122460

SEQ ID NO: 294201 - RNA, 64 nt, hsa; identical to SEQ ID NO: 122461

SEQ ID NO: 294202 - RNA, 64 nt, hsa; identical to SEQ ID NO: 122467

SEQ ID NO: 294203 - RNA, 64 nt, hsa; identical to SEQ ID NO: 122468

SEQ ID NO: 294204 - RNA, 64 nt, hsa; identical to SEQ ID NO: 122481

SEQ ID NO: 294205 - RNA, 64 nt, hsa; identical to SEQ ID NO: 122482

SEQ ID NO: 294206 - RNA, 64 nt, hsa; identical to SEQ ID NO: 122498

SEQ ID NO: 294207 - RNA, 64 nt, hsa; identical to SEQ ID NO: 122499

SEQ ID NO: 294208 - RNA, 64 nt, hsa; identical to SEQ ID NO: 122513

SEQ ID NO: 294209 - RNA, 64 nt, hsa; identical to SEQ ID NO: 122514

SEQ ID NO: 294210 - RNA, 64 nt, hsa; identical to SEQ ID NO: 122517

SEQ ID NO: 294211 - RNA, 64 nt, hsa; identical to SEQ ID NO: 122518

SEQ ID NO: 294212 - RNA, 64 nt, hsa; identical to SEQ ID NO: 122606

SEQ ID NO: 294213 - RNA, 64 nt, hsa; identical to SEQ ID NO: 122607

SEQ ID NO: 294214 - RNA, 64 nt, hsa; identical to SEQ ID NO: 122654

SEQ ID NO: 294215 - RNA, 64 nt, hsa; identical to SEQ ID NO: 122655

SEQ ID NO: 294216 - RNA, 64 nt, hsa; identical to SEQ ID NO: 122669

SEQ ID NO: 294217 - RNA, 64 nt, hsa; identical to SEQ ID NO: 122670

SEQ ID NO: 294218 - RNA, 64 nt, hsa; identical to SEQ ID NO: 122677

SEQ ID NO: 294219 - RNA, 64 nt, hsa; identical to SEQ ID NO: 122678

SEQ ID NO: 294220 - RNA, 64 nt, hsa; identical to SEQ ID NO: 122684

SEQ ID NO: 294221 - RNA, 64 nt, hsa; identical to SEQ ID NO: 122685

SEQ ID NO: 294222 - RNA, 64 nt, hsa; identical to SEQ ID NO: 122691

SEQ ID NO: 294223 - RNA, 64 nt, hsa; identical to SEQ ID NO: 122692

SEQ ID NO: 294224 - RNA, 64 nt, hsa; identical to SEQ ID NO: 122693

SEQ ID NO: 294225 - RNA, 64 nt, hsa; identical to SEQ ID NO: 122709

SEQ ID NO: 294226 - RNA, 64 nt, hsa; identical to SEQ ID NO: 122710

SEQ ID NO: 294227 - RNA, 64 nt, hsa; identical to SEQ ID NO: 122711

SEQ ID NO: 294228 - RNA, 64 nt, hsa; identical to SEQ ID NO: 122718

SEQ ID NO: 294229 - RNA, 64 nt, hsa; identical to SEQ ID NO: 122719

SEQ ID NO: 294230 - RNA, 64 nt, hsa; identical to SEQ ID NO: 122734

SEQ ID NO: 294231 - RNA, 64 nt, hsa; identical to SEQ ID NO: 122735

SEQ ID NO: 294232 - RNA, 64 nt, hsa; identical to SEQ ID NO: 122742

SEQ ID NO: 294233 - RNA, 64 nt, hsa; identical to SEQ ID NO: 122743

SEQ ID NO: 294234 - RNA, 64 nt, hsa; identical to SEQ ID NO: 122744

SEQ ID NO: 294235 - RNA, 64 nt, hsa; identical to SEQ ID NO: 122746

SEQ ID NO: 294236 - RNA, 64 nt, hsa; identical to SEQ ID NO: 122747

SEQ ID NO: 294237 - RNA, 64 nt, hsa; identical to SEQ ID NO: 122749

SEQ ID NO: 294238 - RNA, 64 nt, hsa; identical to SEQ ID NO: 122750

SEQ ID NO: 294239 - RNA, 64 nt, hsa; identical to SEQ ID NO: 122801

SEQ ID NO: 294240 - RNA, 64 nt, hsa; identical to SEQ ID NO: 122802

SEQ ID NO: 294241 - RNA, 64 nt, hsa; identical to SEQ ID NO: 122837

SEQ ID NO: 294242 - RNA, 64 nt, hsa; identical to SEQ ID NO: 122838

SEQ ID NO: 294243 - RNA, 64 nt, hsa; identical to SEQ ID NO: 122842

SEQ ID NO: 294244 - RNA, 64 nt, hsa; identical to SEQ ID NO: 122843

SEQ ID NO: 294245 - RNA, 64 nt, hsa; identical to SEQ ID NO: 122853

SEQ ID NO: 294246 - RNA, 64 nt, hsa; identical to SEQ ID NO: 122854

SEQ ID NO: 294247 - RNA, 64 nt, hsa; identical to SEQ ID NO: 122861

SEQ ID NO: 294248 - RNA, 64 nt, hsa; identical to SEQ ID NO: 122862

SEQ ID NO: 294249 - RNA, 64 nt, hsa; identical to SEQ ID NO: 122909

SEQ ID NO: 294250 - RNA, 64 nt, hsa; identical to SEQ ID NO: 122910

SEQ ID NO: 294251 - RNA, 64 nt, hsa; identical to SEQ ID NO: 122911

SEQ ID NO: 294252 - RNA, 64 nt, hsa; identical to SEQ ID NO: 122931

SEQ ID NO: 294253 - RNA, 64 nt, hsa; identical to SEQ ID NO: 122932

SEQ ID NO: 294254 - RNA, 64 nt, hsa; identical to SEQ ID NO: 122949

SEQ ID NO: 294255 - RNA, 64 nt, hsa; identical to SEQ ID NO: 122950

SEQ ID NO: 294256 - RNA, 64 nt, hsa; identical to SEQ ID NO: 122967

SEQ ID NO: 294257 - RNA, 64 nt, hsa; identical to SEQ ID NO: 122968

SEQ ID NO: 294258 - RNA, 64 nt, hsa; identical to SEQ ID NO: 122972

SEQ ID NO: 294259 - RNA, 64 nt, hsa; identical to SEQ ID NO: 122973

SEQ ID NO: 294260 - RNA, 64 nt, hsa; identical to SEQ ID NO: 122977

SEQ ID NO: 294261 - RNA, 64 nt, hsa; identical to SEQ ID NO: 122978

SEQ ID NO: 294262 - RNA, 64 nt, hsa
aguaaugcaaaaauaaaacgguagaauaugaaaagcucaggaucucucccaaggcuaccuacug

SEQ ID NO: 294263 - RNA, 64 nt, hsa
ugcuuuguggaaggugaaggaagacccacagagugcucaggaugaugcuauugcuggagagcga

SEQ ID NO: 294264 - RNA, 64 nt, hsa
ugaggcucagggaaaggccagugugaaccgaggggcucaggaaaacgggaccggccaggccacc

SEQ ID NO: 294265 - RNA, 64 nt, hsa
uauuacacggaaaacgguggaggccagggcuauagcucaggaccugggaccuccccugaggcuc

SEQ ID NO: 294266 - RNA, 64 nt, hsa
uuuggccgggauggacuaaugaggcucuaacacugcucaggagaccccugcccucuaguugguu

SEQ ID NO: 294267 - RNA, 64 nt, hsa
caccuggcaguggggagcaucgcuguuuccaauggcucaggagacaaugaaaagcccccauuua

SEQ ID NO: 294268 - RNA, 64 nt, hsa
cuccuuugcugugacaucaccacucuuuccugaugcucaggaaagcauauugcuccaauucaaa

SEQ ID NO: 294269 - RNA, 64 nt, hsa
gacacucauucccauugaccaucuggucccaggagcucaggaggaggaccccaggggagaggag

SEQ ID NO: 294270 - RNA, 64 nt, hsa
ugugagcuguggaaugagagagaaaaccauggcugcucaggaaggaaguggagaaucucucagc

SEQ ID NO: 294271 - RNA, 64 nt, hsa
cugguguuaugauguugcacugugucugaggaaugcucaggaaaucuugugggaaaaaaauggg

SEQ ID NO: 294272 - RNA, 64 nt, hsa
cgcuuugggaggcugaggcagguggaucacuugagcucaggaguucaagaccagcuugggaaac

SEQ ID NO: 294273 - RNA, 64 nt, hsa
aucugggaacuaacagcugcuaaccugaccagccgcucaggacaggacccuggggcuacacucc

SEQ ID NO: 294274 - RNA, 64 nt, hsa
cagguacuggggaggccugaggagcccuccuggagcucaggaggccgaggcugccuuaagcugu

SEQ ID NO: 294275 - RNA, 64 nt, hsa
gcaggggccacugggcagccugagggcugacccugcucaggacacugucugucucaggaacuca

SEQ ID NO: 294276 - RNA, 64 nt, hsa
ccucagagggggcagguggccuggagagagaggggcucaggaacugggagccucgugggugggg

SEQ ID NO: 294277 - RNA, 64 nt, hsa
cucccggcuuugccguucagauggggcuccugaggcucaggagugaagaugccacagagccggg

SEQ ID NO: 294278 - RNA, 64 nt, hsa
ccuucacaaaaaaccuuaagggaaaucugauggugcucaggaaucuaacucucccuaaaccauc

SEQ ID NO: 294279 - RNA, 64 nt, hsa
gccugcuguguuccagaucacagaggcagccaaggcucaggaaaaacuggggcuuugcuuaugg

SEQ ID NO: 294280 - RNA, 64 nt, hsa
ccgggcgucgcagcaugcgccuguagucccagcugcucaggaggcugaggcaggagaauugauu

SEQ ID NO: 294281 - RNA, 64 nt, hsa
cacuuugggaggccaaggugggaagauugccugagcucaggaguuugagaccagccugggcaac

SEQ ID NO: 294282 - RNA, 64 nt, hsa
gcacuuugcaggccgagguagacagauggcuugagcucaggaguucgugaccagccugggcaac

SEQ ID NO: 294283 - RNA, 64 nt, hsa
aacuuugggaggccgaggcagguggaucauuugagcucaggaauucaagaccagccuggguaau

SEQ ID NO: 294284 - RNA, 64 nt, hsa
acauuguuugcaggacgaaaacuucugaguuacagcucaggaaaagccugcugaauuuauguug

SEQ ID NO: 294285 - RNA, 64 nt, hsa
acaaaagaacccucagcagaauaacaaaaacuuugcucaggacauuugaggucaaauugaagac

SEQ ID NO: 294286 - RNA, 64 nt, hsa
caaguccaaccaguggaccuggaauuggccaagggcucaggagagggcuguguugcucucucaa

SEQ ID NO: 294287 - RNA, 64 nt, hsa
gaagcaggaggagguaaugcgggagaagcagcuggcucaggaagccaagaaacuggaugccaag

SEQ ID NO: 294288 - RNA, 64 nt, hsa
gggcagcaaccccugcauccccauuuuuuacugagcucaggagagcaagaugaagguaacaauc

SEQ ID NO: 294289 - RNA, 64 nt, hsa
cguggaccgggagaaugaguacauaagcaggcuggcucaggacaaggaggagaugaagguaggg

SEQ ID NO: 294290 - RNA, 64 nt, hsa
cuguucugggcauggcagggccaggccucugcuggcucaggaggaggggugagagaccugcuca

SEQ ID NO: 294291 - RNA, 64 nt, hsa
uugacucuggggugcagcuucacccaccaggccagcucaggaauucccuggaaaagggaaaugu

SEQ ID NO: 294292 - RNA, 64 nt, hsa
uugccuuaaaacugaguugggugacuugguaccugcucaggaccccccgcacugucccaauccc

SEQ ID NO: 294293 - RNA, 64 nt, hsa
cagcuggccucacuccgcuggugacuucguaccugcucaggagcccccacugucccagucccac

SEQ ID NO: 294294 - RNA, 64 nt, hsa
gagcuauuuaacacaaauccuaagauuuuuuucugcucaggaaggggugaaauagcuggcagau

SEQ ID NO: 294295 - RNA, 64 nt, hsa
ccaagcccccuuuugugugaauggcaguaacugggcucaggagcucugagguggcacccugccu

SEQ ID NO: 294296 - RNA, 64 nt, hsa
cacuuuaagaggcugaggcaggaggaucacuugagcucaggaauucgagaccagccugggucac

SEQ ID NO: 294297 - RNA, 64 nt, hsa
agauuucauccagaaagaguuuaagaaaaucucagcucaggagccagaacagaaaagaucaaua

SEQ ID NO: 294298 - RNA, 64 nt, hsa
gcugacgaggcagcuggcccagucuugggagucugcucaggacagugguggagcugggucuuga

SEQ ID NO: 294299 - RNA, 64 nt, hsa
gcccucggaccccauccccaccccagccgggcccgcucaggaugcccuggcccaggcuuggggc

SEQ ID NO: 294300 - RNA, 64 nt, hsa; identical to SEQ ID NO: 71812

SEQ ID NO: 294301 - RNA, 64 nt, hsa; identical to SEQ ID NO: 71813

SEQ ID NO: 294302 - RNA, 64 nt, hsa; identical to SEQ ID NO: 71814

SEQ ID NO: 294303 - RNA, 64 nt, hsa; identical to SEQ ID NO: 71815

SEQ ID NO: 294304 - RNA, 64 nt, hsa; identical to SEQ ID NO: 71816

SEQ ID NO: 294305 - RNA, 64 nt, hsa; identical to SEQ ID NO: 71817

SEQ ID NO: 294306 - RNA, 64 nt, hsa; identical to SEQ ID NO: 71818

SEQ ID NO: 294307 - RNA, 64 nt, hsa; identical to SEQ ID NO: 71819

SEQ ID NO: 294308 - RNA, 64 nt, hsa; identical to SEQ ID NO: 71820

SEQ ID NO: 294309 - RNA, 64 nt, hsa; identical to SEQ ID NO: 71821

SEQ ID NO: 294310 - RNA, 64 nt, hsa; identical to SEQ ID NO: 71822

SEQ ID NO: 294311 - RNA, 64 nt, hsa; identical to SEQ ID NO: 71823

SEQ ID NO: 294312 - RNA, 64 nt, hsa; identical to SEQ ID NO: 71824

SEQ ID NO: 294313 - RNA, 64 nt, hsa; identical to SEQ ID NO: 71825

SEQ ID NO: 294314 - RNA, 64 nt, hsa; identical to SEQ ID NO: 71826

SEQ ID NO: 294315 - RNA, 64 nt, hsa; identical to SEQ ID NO: 71827

SEQ ID NO: 294316 - RNA, 64 nt, hsa; identical to SEQ ID NO: 71828

SEQ ID NO: 294317 - RNA, 64 nt, hsa; identical to SEQ ID NO: 71829

SEQ ID NO: 294318 - RNA, 64 nt, hsa; identical to SEQ ID NO: 71830

SEQ ID NO: 294319 - RNA, 64 nt, hsa; identical to SEQ ID NO: 71831

SEQ ID NO: 294320 - RNA, 64 nt, hsa; identical to SEQ ID NO: 71832

SEQ ID NO: 294321 - RNA, 64 nt, hsa; identical to SEQ ID NO: 71833

SEQ ID NO: 294322 - RNA, 64 nt, hsa; identical to SEQ ID NO: 71834

SEQ ID NO: 294323 - RNA, 64 nt, hsa; identical to SEQ ID NO: 71835

SEQ ID NO: 294324 - RNA, 64 nt, hsa; identical to SEQ ID NO: 71836

SEQ ID NO: 294325 - RNA, 64 nt, hsa; identical to SEQ ID NO: 71837

SEQ ID NO: 294326 - RNA, 64 nt, hsa; identical to SEQ ID NO: 71838

SEQ ID NO: 294327 - RNA, 64 nt, hsa; identical to SEQ ID NO: 71839

SEQ ID NO: 294328 - RNA, 64 nt, hsa; identical to SEQ ID NO: 71840

SEQ ID NO: 294329 - RNA, 64 nt, hsa; identical to SEQ ID NO: 71841

SEQ ID NO: 294330 - RNA, 64 nt, hsa; identical to SEQ ID NO: 71842

SEQ ID NO: 294331 - RNA, 64 nt, hsa; identical to SEQ ID NO: 71843

SEQ ID NO: 294332 - RNA, 64 nt, hsa; identical to SEQ ID NO: 71844

SEQ ID NO: 294333 - RNA, 64 nt, hsa; identical to SEQ ID NO: 71845

SEQ ID NO: 294334 - RNA, 64 nt, hsa; identical to SEQ ID NO: 71846

SEQ ID NO: 294335 - RNA, 64 nt, hsa; identical to SEQ ID NO: 71847

SEQ ID NO: 294336 - RNA, 64 nt, hsa; identical to SEQ ID NO: 71847

SEQ ID NO: 294337 - RNA, 64 nt, hsa; identical to SEQ ID NO: 71849

SEQ ID NO: 294338 - RNA, 64 nt, hsa; identical to SEQ ID NO: 71850

SEQ ID NO: 294339 - RNA, 64 nt, hsa; identical to SEQ ID NO: 71851

SEQ ID NO: 294340 - RNA, 64 nt, hsa; identical to SEQ ID NO: 71852

SEQ ID NO: 294341 - RNA, 64 nt, hsa; identical to SEQ ID NO: 71853

SEQ ID NO: 294342 - RNA, 64 nt, hsa; identical to SEQ ID NO: 71854

SEQ ID NO: 294343 - RNA, 64 nt, hsa; identical to SEQ ID NO: 71855

SEQ ID NO: 294344 - RNA, 64 nt, hsa; identical to SEQ ID NO: 71856

SEQ ID NO: 294345 - RNA, 57 nt, hsa; identical to SEQ ID NO: 71857

SEQ ID NO: 294346 - RNA, 64 nt, hsa; identical to SEQ ID NO: 71858

SEQ ID NO: 294347 - RNA, 64 nt, hsa
ugauaugcauagcauuggaauacuugucauuauauacucuuacaaauaacacaugaagcaagaa

SEQ ID NO: 294348 - RNA, 64 nt, hsa
uuuuuuuuuuuuucuauuuuugccagacucuugauacucuuaaaacuuguuuguggucagcaca

SEQ ID NO: 294349 - RNA, 64 nt, hsa
uguaauccaugucuauaaucuaccaacaaagauguacucuuaaacucaguaucaccaggcacua

SEQ ID NO: 294350 - RNA, 64 nt, hsa
cccauuuaauaaaccauaugagaaaacccucuauuacucuuacacuuuaguuuuaccauuugag

SEQ ID NO: 294351 - RNA, 64 nt, hsa
agaaacagaaggagaccugguugccuuaugccuuuacucuuacauggaauaaauucccaaugca

SEQ ID NO: 294352 - RNA, 64 nt, hsa
augccaaguauuuuauaaagauuaauaacagaccuacucuuaccuggcaguuuacuuaacuuac

SEQ ID NO: 294353 - RNA, 64 nt, hsa
caaagcgauguauuuuuguacacuugaaauagaguacucuuaauuuacugggcaaaugugcuug

SEQ ID NO: 294354 - RNA, 64 nt, hsa
agcacagccuaggaaggucagauccuguauuaauuacucuuaguggagaugccagauaucccau

SEQ ID NO: 294355 - RNA, 64 nt, hsa
agaacuuagacacaagggaccaucccccaaacucuacucuuauacccagaaaagaacauauuuc

SEQ ID NO: 294356 - RNA, 64 nt, hsa
agaguaucaagaaaauaaaugagcauagcaaugcuacucuuaaaaagaugcuaugccacacaac

SEQ ID NO: 294357 - RNA, 64 nt, hsa
aggucuuggugccucugcaguacuugauguauuggggucaaaucucuacaaauuuuucuguggu

SEQ ID NO: 294358 - RNA, 64 nt, hsa
agacuguguuugguccuguaggaguucuauuuuggggucaaaugcuagaaaaauuguuaaggug

SEQ ID NO: 294359 - RNA, 64 nt, hsa
guuucccucugcuguggguucugggcugucaugucuccaccacuuaaggaugucuuuacacuga

SEQ ID NO: 294360 - RNA, 64 nt, hsa
cucuccugugucuguccuccggaccuacccaggucuccaccaucaggacccugucuuuggguuu

SEQ ID NO: 294361 - RNA, 64 nt, hsa
ggaggauucgagcaucaggcuaagacccuguguccuccaccaugcacucaccccuagcccuggu

SEQ ID NO: 294362 - RNA, 64 nt, hsa
uggagaguacauuugcuuuaaugagugcaccugccuccaccagcaaggggaccccgagaacccu

SEQ ID NO: 294363 - RNA, 64 nt, hsa
aaaaggaaaggcugauguuuccauauagcuugcucuccaccaggccuaucauuuuucuuuuuag

SEQ ID NO: 294364 - RNA, 64 nt, hsa
agagcugggcggcguccacaccuaagaacagcagcuccaccaaaugaagucccucucacgcagc

SEQ ID NO: 294365 - RNA, 64 nt, hsa
agcugcuugugggggcaccugggaggucaaaggucuccaccacaucaaccuauuuuguuuuacc

SEQ ID NO: 294366 - RNA, 64 nt, hsa
aaggccuuccaaacagcuccgucgccccuagcaacuccaccauugggcacugccaugcagagac

SEQ ID NO: 294367 - RNA, 64 nt, hsa
gucuauggugugacaucaccuuauucacagacaacuccaccaauuguacagguaacuaauucug

SEQ ID NO: 294368 - RNA, 64 nt, hsa
uuggugggacauucuacagaaccccuuucugccccuccaccaguaccaguggugccacaugugg

SEQ ID NO: 294369 - RNA, 64 nt, hsa
ccacaauuuagccaugucaucugguggugaccagcuccaccaagccccuuucugagcccuuccu

SEQ ID NO: 294370 - RNA, 64 nt, hsa
uaugguagcuggacuuccccagggcccucuuccccuccaccacacccagguggacuugcagccc

SEQ ID NO: 294371 - RNA, 64 nt, hsa
cuaaaacugagguggggauggggagaggcuuugccuccaccauucccaccccacccuccccuua

SEQ ID NO: 294372 - RNA, 64 nt, hsa
uuucaggaauuuuguaaucucauaacuuuccaagcuccaccacuuccuaaaucuuaagaacuuu

SEQ ID NO: 294373 - RNA, 64 nt, hsa
ugcccuuggcugccagccuacccugccugcacuccuccaccaucacaaucucacccaaacuccu

SEQ ID NO: 294374 - RNA, 64 nt, hsa
gaggcggguuuccuggguccccucuccagcaagccuccaccagcaagcucggcccagagcuucc

SEQ ID NO: 294375 - RNA, 64 nt, hsa
caugaccgagacccccugauccuccguggacucacuccaccagcuuccuauaacuuggacgaug

SEQ ID NO: 294376 - RNA, 64 nt, hsa
ucggccaguuaacaagaagauggugugagguguucuccaccagucucuccuguuugagacuguu

SEQ ID NO: 294377 - RNA, 64 nt, hsa
ucugggacccuuuccuuccuucccuggcuuguaacuccaccaacccaucagaaggagaaggaag

SEQ ID NO: 294378 - RNA, 64 nt, hsa
ccgugauguaggguaaggugccuucuuauucucacuccaccacccaaaagucaaaaggugccug

SEQ ID NO: 294379 - RNA, 64 nt, hsa
cagaguaacugcacgccuuugugcagcucuggagcuccaccaacucucggccugccaguucuca

SEQ ID NO: 294380 - RNA, 64 nt, hsa
ggagcccucgggaccugcugcaccaggaaagccacuccaccaguagugcugguugccuccuacu

SEQ ID NO: 294381 - RNA, 64 nt, hsa
ugcugcuccacgaggaagcucaggccugcacaggcuccaccaggccuuggaugcccucuaguug

SEQ ID NO: 294382 - RNA, 64 nt, hsa
ggggggugggggcuucaaguacagauugggcacacuccaccagaccccagcaaggucagcugcc

SEQ ID NO: 294383 - RNA, 64 nt, hsa
aucuauagacauuaggaagggagugagacggcuccuccaccauccucagccagugcaacccauu

SEQ ID NO: 294384 - RNA, 64 nt, hsa
accccugaacuccugagcgacagaagccccaggccuccaccagccuugaacccuugcaaagggg

SEQ ID NO: 294385 - RNA, 64 nt, hsa
aggguggggaggagaaaaucccaccuccccugaccuccaccaccuccaccaccaccaccaccac

SEQ ID NO: 294386 - RNA, 64 nt, hsa
aggagaaaaucccaccuccccugaccuccaccaccuccaccaccaccaccaccaccaccaccac

SEQ ID NO: 294387 - RNA, 64 nt, hsa; identical to SEQ ID NO: 294372

SEQ ID NO: 294388 - RNA, 64 nt, hsa
cuaaaacugagguggggauggggagagccuuugccuccaccauucccacccacccuccccuuaa

SEQ ID NO: 294389 - RNA, 64 nt, hsa
guaugcacccagaggggacucagcuucaaagcugcuccaccaugcugggucccaggcagcuuuc

SEQ ID NO: 294390 - RNA, 64 nt, hsa
gcagaaaggagaugccaauucugcuaucacagaacuccaccagcaacuccacccgaccccagca

SEQ ID NO: 294391 - RNA, 64 nt, hsa
gccaggugugcacaggggccucccaggcuccuggcuccaccagccaaggaggugggggcaaggg

SEQ ID NO: 294392 - RNA, 64 nt, hsa
gucaucuccuuggucacccucugcuccaggccuucuccaccacaggaccucagcugucccuccu

SEQ ID NO: 294393 - RNA, 63 nt, hsa
gaggaaaaaaaaaauuaaaaaaaaaaugcaagcugucaggaugcuuaagcucuuuucagacau

SEQ ID NO: 294394 - RNA, 63 nt, hsa
uuauauacuuuagaaauacaagggauuccgauaugucaggaccuaaauggccuaagcaccugu

SEQ ID NO: 294395 - RNA, 63 nt, hsa
uauuaaaauguccauucuguagauuagaggugaugucaggacauaaaugagguuaauguaaua

SEQ ID NO: 294396 - RNA, 63 nt, hsa
cagcagcuccgguuucuauuauugugacuugaaugucaggauucaagggcucagugucaaaga

SEQ ID NO: 294397 - RNA, 63 nt, hsa
aauuugguaguguuggcaguuguuaauaaagcuugucaggauguuaagcaucucaggagaaau

SEQ ID NO: 294398 - RNA, 63 nt, hsa
uauggacccaagucuaugcucaguuccacagaaugucaggaccaaauaacuucacagcuacuc

SEQ ID NO: 294399 - RNA, 63 nt, hsa
guucuccccaaagacuggaauauucuacccaaaugucaggaccaggauuuucuacccagagac

SEQ ID NO: 294400 - RNA, 63 nt, hsa
guucuucccaaagaccaaaauauucuacccauaugucaggaccaggauuuucuacccagagac

SEQ ID NO: 294401 - RNA, 63 nt, hsa
uaucuuccuaaagaccaaaauauucuacccauaugucaggaccgggauuuucuacccagagac

SEQ ID NO: 294402 - RNA, 63 nt, hsa
guucucuccaacgaccagaauauucuacccaaaugucaggaccaagauuuucuaccaaaauau

SEQ ID NO: 294403 - RNA, 63 nt, hsa
ugggggcuguaggaggaggcagggauuccagggugucaggaaggcaggggugccaggucccac

SEQ ID NO: 294404 - RNA, 63 nt, hsa
ugggggcucuaggaggaggcagggacuccagggugucaggaaggcaggggugccgggucccac

SEQ ID NO: 294405 - RNA, 63 nt, hsa
cguccaggugugcggcgagccgcugcgcacagaugucaggauuuccguuugggucuaguuuag

SEQ ID NO: 294406 - RNA, 63 nt, hsa
aguuuagaaccuguccuuaaaccuagggguugcugucaggauuugcuuucagacuuuuuuuuu

SEQ ID NO: 294407 - RNA, 63 nt, hsa
cagagaauucacacuggugagaaacccuuugaaugucaggaauguaggaaggccuuuaggcag

SEQ ID NO: 294408 - RNA, 63 nt, hsa
cuauagaacucauacuaaugagaaaccuaugaaugucaggaaugcagcaaggccuuuaagcag

SEQ ID NO: 294409 - RNA, 63 nt, hsa
uaccaucuuacuccugccuccccauuccuugccugucaggaccauuuuagaagaguuaccuug

SEQ ID NO: 294410 - RNA, 63 nt, hsa
ggugcuuugucuaauuaauuacaucccauaacuugucaggauaguugcuccaacugaauugcu

SEQ ID NO: 294411 - RNA, 64 nt, hsa; identical to SEQ ID NO: 21812

SEQ ID NO: 294412 - RNA, 64 nt, hsa; identical to SEQ ID NO: 21813

SEQ ID NO: 294413 - RNA, 64 nt, hsa; identical to SEQ ID NO: 21814

SEQ ID NO: 294414 - RNA, 64 nt, hsa; identical to SEQ ID NO: 21815

SEQ ID NO: 294415 - RNA, 64 nt, hsa; identical to SEQ ID NO: 21816

SEQ ID NO: 294416 - RNA, 64 nt, hsa; identical to SEQ ID NO: 21817

SEQ ID NO: 294417 - RNA, 64 nt, hsa; identical to SEQ ID NO: 21818

SEQ ID NO: 294418 - RNA, 64 nt, hsa; identical to SEQ ID NO: 21819

SEQ ID NO: 294419 - RNA, 64 nt, hsa; identical to SEQ ID NO: 21820

SEQ ID NO: 294420 - RNA, 64 nt, hsa; identical to SEQ ID NO: 21821

SEQ ID NO: 294421 - RNA, 64 nt, hsa; identical to SEQ ID NO: 21822

SEQ ID NO: 294422 - RNA, 64 nt, hsa; identical to SEQ ID NO: 21823

SEQ ID NO: 294423 - RNA, 64 nt, hsa; identical to SEQ ID NO: 21824

SEQ ID NO: 294424 - RNA, 64 nt, hsa; identical to SEQ ID NO: 21825

SEQ ID NO: 294425 - RNA, 64 nt, hsa; identical to SEQ ID NO: 21826

SEQ ID NO: 294426 - RNA, 64 nt, hsa; identical to SEQ ID NO: 21827

SEQ ID NO: 294427 - RNA, 64 nt, hsa; identical to SEQ ID NO: 21828

SEQ ID NO: 294428 - RNA, 64 nt, hsa; identical to SEQ ID NO: 21829

SEQ ID NO: 294429 - RNA, 64 nt, hsa; identical to SEQ ID NO: 21830

SEQ ID NO: 294430 - RNA, 64 nt, hsa; identical to SEQ ID NO: 21831

SEQ ID NO: 294431 - RNA, 50 nt, hsa; identical to SEQ ID NO: 21832

SEQ ID NO: 294432 - RNA, 64 nt, hsa; identical to SEQ ID NO: 21833

SEQ ID NO: 294433 - RNA, 64 nt, hsa; identical to SEQ ID NO: 21834

SEQ ID NO: 294434 - RNA, 64 nt, hsa; identical to SEQ ID NO: 21835

SEQ ID NO: 294435 - RNA, 64 nt, hsa; identical to SEQ ID NO: 21836

SEQ ID NO: 294436 - RNA, 64 nt, hsa; identical to SEQ ID NO: 21837

SEQ ID NO: 294437 - RNA, 64 nt, hsa; identical to SEQ ID NO: 21838

SEQ ID NO: 294438 - RNA, 64 nt, hsa; identical to SEQ ID NO: 21839

SEQ ID NO: 294439 - RNA, 64 nt, hsa; identical to SEQ ID NO: 21840

SEQ ID NO: 294440 - RNA, 64 nt, hsa; identical to SEQ ID NO: 21841

SEQ ID NO: 294441 - RNA, 64 nt, hsa; identical to SEQ ID NO: 21842

SEQ ID NO: 294442 - RNA, 64 nt, hsa; identical to SEQ ID NO: 21843

SEQ ID NO: 294443 - RNA, 64 nt, hsa; identical to SEQ ID NO: 21844

SEQ ID NO: 294444 - RNA, 64 nt, hsa; identical to SEQ ID NO: 21845

SEQ ID NO: 294445 - RNA, 64 nt, hsa; identical to SEQ ID NO: 21846

SEQ ID NO: 294446 - RNA, 64 nt, hsa; identical to SEQ ID NO: 21847

SEQ ID NO: 294447 - RNA, 64 nt, hsa; identical to SEQ ID NO: 21848

SEQ ID NO: 294448 - RNA, 64 nt, hsa; identical to SEQ ID NO: 21849

SEQ ID NO: 294449 - RNA, 64 nt, hsa; identical to SEQ ID NO: 21850

SEQ ID NO: 294450 - RNA, 64 nt, hsa; identical to SEQ ID NO: 21851

SEQ ID NO: 294451 - RNA, 64 nt, hsa; identical to SEQ ID NO: 21852

SEQ ID NO: 294452 - RNA, 64 nt, hsa; identical to SEQ ID NO: 21853

SEQ ID NO: 294453 - RNA, 64 nt, hsa; identical to SEQ ID NO: 21854

SEQ ID NO: 294454 - RNA, 64 nt, hsa; identical to SEQ ID NO: 21855

SEQ ID NO: 294455 - RNA, 64 nt, hsa; identical to SEQ ID NO: 21856

SEQ ID NO: 294456 - RNA, 64 nt, hsa; identical to SEQ ID NO: 21857

SEQ ID NO: 294457 - RNA, 64 nt, hsa; identical to SEQ ID NO: 21858

SEQ ID NO: 294458 - RNA, 64 nt, hsa; identical to SEQ ID NO: 21859

SEQ ID NO: 294459 - RNA, 64 nt, hsa; identical to SEQ ID NO: 21860

SEQ ID NO: 294460 - RNA, 64 nt, hsa; identical to SEQ ID NO: 21861

SEQ ID NO: 294461 - RNA, 64 nt, hsa; identical to SEQ ID NO: 21862

SEQ ID NO: 294462 - RNA, 64 nt, hsa; identical to SEQ ID NO: 21863

SEQ ID NO: 294463 - RNA, 64 nt, hsa; identical to SEQ ID NO: 21864

SEQ ID NO: 294464 - RNA, 64 nt, hsa; identical to SEQ ID NO: 21865

SEQ ID NO: 294465 - RNA, 64 nt, hsa; identical to SEQ ID NO: 21866

SEQ ID NO: 294466 - RNA, 64 nt, hsa; identical to SEQ ID NO: 21867

SEQ ID NO: 294467 - RNA, 64 nt, hsa; identical to SEQ ID NO: 21868

SEQ ID NO: 294468 - RNA, 64 nt, hsa; identical to SEQ ID NO: 21869

SEQ ID NO: 294469 - RNA, 64 nt, hsa; identical to SEQ ID NO: 21870

SEQ ID NO: 294470 - RNA, 64 nt, hsa; identical to SEQ ID NO: 21871

SEQ ID NO: 294471 - RNA, 64 nt, hsa; identical to SEQ ID NO: 21872

SEQ ID NO: 294472 - RNA, 64 nt, hsa; identical to SEQ ID NO: 21873

SEQ ID NO: 294473 - RNA, 64 nt, hsa; identical to SEQ ID NO: 21874

SEQ ID NO: 294474 - RNA, 64 nt, hsa
agcaugaaaguaauaaugugggauuacuagaaaaccugacuaauggugucacugcuggcaaugg

SEQ ID NO: 294475 - RNA, 64 nt, hsa
agcacggaaguacucaugucggauucccagaaaaccugacuaauggugccacugcuggcaaugg

SEQ ID NO: 294476 - RNA, 64 nt, hsa
aauucagauuagcugaaaggaaaaaaaguagaagccugacuacuuggugcuaacuacuaaagau

SEQ ID NO: 294477 - RNA, 64 nt, hsa
gaaaggauaaaauguuuuaauaguagagcaguguccugacuauaggggcccguucauggagcug

SEQ ID NO: 294478 - RNA, 64 nt, hsa
auuuuucagcuacagcaaauaaaacagugaaagcccugacuauuuacaguagugguauccuuac

SEQ ID NO: 294479 - RNA, 64 nt, hsa
ugugaacuuauaacaggaauaagcaaaauucauaccugacuaguguucagaauguagcauucug

SEQ ID NO: 294480 - RNA, 64 nt, hsa; identical to SEQ ID NO: 59819

SEQ ID NO: 294481 - RNA, 64 nt, hsa; identical to SEQ ID NO: 59820

SEQ ID NO: 294482 - RNA, 64 nt, hsa; identical to SEQ ID NO: 59821

SEQ ID NO: 294483 - RNA, 64 nt, hsa; identical to SEQ ID NO: 59822

SEQ ID NO: 294484 - RNA, 64 nt, hsa; identical to SEQ ID NO: 59823

SEQ ID NO: 294485 - RNA, 64 nt, hsa; identical to SEQ ID NO: 59824

SEQ ID NO: 294486 - RNA, 64 nt, hsa; identical to SEQ ID NO: 59825

SEQ ID NO: 294487 - RNA, 64 nt, hsa; identical to SEQ ID NO: 59826

SEQ ID NO: 294488 - RNA, 64 nt, hsa; identical to SEQ ID NO: 59827

SEQ ID NO: 294489 - RNA, 64 nt, hsa; identical to SEQ ID NO: 59828

SEQ ID NO: 294490 - RNA, 64 nt, hsa; identical to SEQ ID NO: 59829

SEQ ID NO: 294491 - RNA, 64 nt, hsa; identical to SEQ ID NO: 59830

SEQ ID NO: 294492 - RNA, 64 nt, hsa; identical to SEQ ID NO: 59831

SEQ ID NO: 294493 - RNA, 64 nt, hsa; identical to SEQ ID NO: 59832

SEQ ID NO: 294494 - RNA, 64 nt, hsa; identical to SEQ ID NO: 59833

SEQ ID NO: 294495 - RNA, 64 nt, hsa; identical to SEQ ID NO: 59834

SEQ ID NO: 294496 - RNA, 64 nt, hsa; identical to SEQ ID NO: 59835

SEQ ID NO: 294497 - RNA, 64 nt, hsa; identical to SEQ ID NO: 59836

SEQ ID NO: 294498 - RNA, 64 nt, hsa; identical to SEQ ID NO: 59837

SEQ ID NO: 294499 - RNA, 64 nt, hsa; identical to SEQ ID NO: 59838

SEQ ID NO: 294500 - RNA, 64 nt, hsa; identical to SEQ ID NO: 59839

SEQ ID NO: 294501 - RNA, 64 nt, hsa; identical to SEQ ID NO: 59840

SEQ ID NO: 294502 - RNA, 64 nt, hsa; identical to SEQ ID NO: 59841

SEQ ID NO: 294503 - RNA, 64 nt, hsa; identical to SEQ ID NO: 59842

SEQ ID NO: 294504 - RNA, 64 nt, hsa; identical to SEQ ID NO: 59843

SEQ ID NO: 294505 - RNA, 64 nt, hsa; identical to SEQ ID NO: 59844

SEQ ID NO: 294506 - RNA, 64 nt, hsa; identical to SEQ ID NO: 59845

SEQ ID NO: 294507 - RNA, 64 nt, hsa; identical to SEQ ID NO: 59846

SEQ ID NO: 294508 - RNA, 64 nt, hsa; identical to SEQ ID NO: 59847

SEQ ID NO: 294509 - RNA, 64 nt, hsa; identical to SEQ ID NO: 59848

SEQ ID NO: 294510 - RNA, 64 nt, hsa; identical to SEQ ID NO: 59849

SEQ ID NO: 294511 - RNA, 64 nt, hsa; identical to SEQ ID NO: 59850

SEQ ID NO: 294512 - RNA, 64 nt, hsa; identical to SEQ ID NO: 59851

SEQ ID NO: 294513 - RNA, 64 nt, hsa; identical to SEQ ID NO: 59852

SEQ ID NO: 294514 - RNA, 64 nt, hsa; identical to SEQ ID NO: 59853

SEQ ID NO: 294515 - RNA, 64 nt, hsa; identical to SEQ ID NO: 59854

SEQ ID NO: 294516 - RNA, 64 nt, hsa; identical to SEQ ID NO: 59855

SEQ ID NO: 294517 - RNA, 64 nt, hsa; identical to SEQ ID NO: 59856

SEQ ID NO: 294518 - RNA, 64 nt, hsa; identical to SEQ ID NO: 59857

SEQ ID NO: 294519 - RNA, 64 nt, hsa; identical to SEQ ID NO: 59858

SEQ ID NO: 294520 - RNA, 64 nt, hsa; identical to SEQ ID NO: 59859

SEQ ID NO: 294521 - RNA, 64 nt, hsa; identical to SEQ ID NO: 59860

SEQ ID NO: 294522 - RNA, 64 nt, hsa; identical to SEQ ID NO: 59861

SEQ ID NO: 294523 - RNA, 64 nt, hsa; identical to SEQ ID NO: 59862

SEQ ID NO: 294524 - RNA, 64 nt, hsa; identical to SEQ ID NO: 59863

SEQ ID NO: 294525 - RNA, 64 nt, hsa; identical to SEQ ID NO: 59864

SEQ ID NO: 294526 - RNA, 64 nt, hsa; identical to SEQ ID NO: 59865

SEQ ID NO: 294527 - RNA, 64 nt, hsa; identical to SEQ ID NO: 59866

SEQ ID NO: 294528 - RNA, 64 nt, hsa; identical to SEQ ID NO: 59867

SEQ ID NO: 294529 - RNA, 64 nt, hsa; identical to SEQ ID NO: 59868

SEQ ID NO: 294530 - RNA, 64 nt, hsa; identical to SEQ ID NO: 59869

SEQ ID NO: 294531 - RNA, 64 nt, hsa; identical to SEQ ID NO: 59870

SEQ ID NO: 294532 - RNA, 64 nt, hsa; identical to SEQ ID NO: 59871

SEQ ID NO: 294533 - RNA, 64 nt, hsa; identical to SEQ ID NO: 59872

SEQ ID NO: 294534 - RNA, 64 nt, hsa; identical to SEQ ID NO: 59873

SEQ ID NO: 294535 - RNA, 64 nt, hsa; identical to SEQ ID NO: 59874

SEQ ID NO: 294536 - RNA, 64 nt, hsa; identical to SEQ ID NO: 59875

SEQ ID NO: 294537 - RNA, 64 nt, hsa
cugcagccuggcuacugcuuuuuacugcagaaugaacugcaaguucagcauaguggaggggaga

SEQ ID NO: 294538 - RNA, 64 nt, hsa
uucugcugcucucuuuccuucucccugagcugguaacugcaaugccaacuuccugggccuuucu

SEQ ID NO: 294539 - RNA, 64 nt, hsa
aucuaucaccucuagaagguuccagagacagugaaacugcaagaugcucucaacaggauuaugu

SEQ ID NO: 294540 - RNA, 64 nt, hsa
uguuguuucggcaaagcauuuugauggaauagggaacugcaaauguaugaugauuuugaaaagg

SEQ ID NO: 294541 - RNA, 64 nt, hsa
uuaugaaacagccaucuuaaaaaaaaaaaaaguaaacugcaaaaguacaaaaucauuuuucaau

SEQ ID NO: 294542 - RNA, 64 nt, hsa
caucccagugaugccuuauuugaaacugggcuuaaacugcaaaaagaaugaaguuggauuuagg

SEQ ID NO: 294543 - RNA, 64 nt, hsa
gagauaacuccaaguuuaauccagcucagcaugaaacugcaaaaacacugaacauauaaccauc

SEQ ID NO: 294544 - RNA, 64 nt, hsa
gguucuugaaacagcaacagucaaaugcccaaccaacugcaaccaugaucugguacaggcaugc

SEQ ID NO: 294545 - RNA, 64 nt, hsa
gaaauuguuguauaucacuaaaagcaugaauuggaacugcaaugaaagucaaauuuacuuuaaa

SEQ ID NO: 294546 - RNA, 64 nt, hsa
auaagauuccagagcucuuugaucgcuuuuaauaaacugcaaguucauuuuaaaugaagggcca

SEQ ID NO: 294547 - RNA, 64 nt, hsa
acuuucugauuacucaugauaaacugacauggcuaacugcaagaauuaaaucuucuaucugaga

SEQ ID NO: 294548 - RNA, 64 nt, hsa
aguucucuauggcaaagucuuucaaauacgagauaacugcaaaauauuuuccuuuuauacuaca

SEQ ID NO: 294549 - RNA, 64 nt, hsa
auuuauuucaugucuuuacuggaccugaaauuuaaacugcaaugccaguccugcaggagugcug

SEQ ID NO: 294550 - RNA, 64 nt, hsa
gcaaaucacaaccucuuugagccucugucaccugaacugcaaaaugaguggguuagacaaaauc

SEQ ID NO: 294551 - RNA, 64 nt, hsa
ucuuguaucuaaaguggauacaagcguauguuuaaacugcaagauuuuuacuugcuagagaauc

SEQ ID NO: 294552 - RNA, 64 nt, hsa
ggaaaaacagcaaaacaaaaagcaaacaaaaaaaaacugcaaaagucuaaaauacccauuggug

SEQ ID NO: 294553 - RNA, 64 nt, hsa
uaucuacuuaccauagauaccuuucauaacugguaacugcaaagccuuuugugcuggacccagg

SEQ ID NO: 294554 - RNA, 64 nt, hsa
uaguuugucauauaaccagguuuauccuuagucuaacugcaagggauggaaccugccccagguc

SEQ ID NO: 294555 - RNA, 64 nt, hsa; identical to SEQ ID NO: 56762

SEQ ID NO: 294556 - RNA, 64 nt, hsa; identical to SEQ ID NO: 56763

SEQ ID NO: 294557 - RNA, 57 nt, hsa; identical to SEQ ID NO: 56764

SEQ ID NO: 294558 - RNA, 64 nt, hsa; identical to SEQ ID NO: 56765

SEQ ID NO: 294559 - RNA, 62 nt, hsa
acagcucugcguugcucccgugcugccugcgccagccccaggcugcugaggagcagaggcca

SEQ ID NO: 294560 - RNA, 62 nt, hsa
ucccuuccccacccccaucccauccccacccccagccccagcccaguccuccuaggagcagg

SEQ ID NO: 294561 - RNA, 62 nt, hsa
gcagccucgcagcuccguggggcccuccgccccagccccagccagccaggcccugguggaaa

SEQ ID NO: 294562 - RNA, 62 nt, hsa
caccccaucccgacccugucuccgccaccucgcagccccauuaaagcgcucucaucugggcu

SEQ ID NO: 294563 - RNA, 62 nt, hsa
ucuguccaccuggccuccucucgccuggccgccagccccagccccagccccagccccaggcc

SEQ ID NO: 294564 - RNA, 62 nt, hsa
caccuggccuccucucgccuggccgccagccccagccccagccccagccccaggcccagcug

SEQ ID NO: 294565 - RNA, 62 nt, hsa
gccuccucucgccuggccgccagccccagccccagccccagccccaggcccagcugccuuug

SEQ ID NO: 294566 - RNA, 62 nt, hsa
ucucgccuggccgccagccccagccccagccccagccccaggcccagcugccuuuggcuuug

SEQ ID NO: 294567 - RNA, 62 nt, hsa
gcccggcccuggacccgucaggugccuguccccagccccaaccccacucaugccccgucguc

SEQ ID NO: 294568 - RNA, 62 nt, hsa
gggaagcaggaaccccaccgugugcccccugccagccccagagggaguggcgagcccagcug

SEQ ID NO: 294569 - RNA, 62 nt, hsa
cccucucccuccugcaauaauucggggagucucagccccauccaggugccgcggccagcucu

SEQ ID NO: 294570 - RNA, 62 nt, hsa
caacccuccuucccgacccccucccccuagcccagccccagucacugucagggucgggccag

SEQ ID NO: 294571 - RNA, 62 nt, hsa
gggcaagcuuuggugcgcccccugcugaggagcagccccaggaggggaccagaggggaugcu

SEQ ID NO: 294572 - RNA, 50 nt, hsa; identical to SEQ ID NO: 245425

SEQ ID NO: 294573 - RNA, 62 nt, hsa
gagagggccaacaacugucccuccuugagcaccagccccacccaagcaagcagacauuuauc

SEQ ID NO: 294574 - RNA, 62 nt, hsa
aggcagguggggucaccugaugagcuaagauccagccccagaauccuggaggagcaggaggu

SEQ ID NO: 294575 - RNA, 62 nt, hsa
aguccccugauccccuaccucugccugcccuccagccccaucaccagcuucuugcucaggga

SEQ ID NO: 294576 - RNA, 62 nt, hsa
gggggccaugggggugaugaaugacccuccaacagccccacauggguuguuucuguuucuuu

SEQ ID NO: 294577 - RNA, 62 nt, hsa
ucgccaguuucuugguugggacacuccucuggcagccccagcaccaccacaaccccuugcag

SEQ ID NO: 294578 - RNA, 62 nt, hsa
ccacccacccccuaccauugagccaccaugcccagccccaaagccucuuaauugcucuaaca

SEQ ID NO: 294579 - RNA, 62 nt, hsa
gugcugggauuacacacgugagucaccaugcccagccccaaagccauuucuugaagaauuuc

SEQ ID NO: 294580 - RNA, 62 nt, hsa
cugccugcagucagcucggccuccccgaccugcagccccagacucugcucucccagcacuga

SEQ ID NO: 294581 - RNA, 62 nt, hsa
ugcucaucccagcguaugcugccucuuuagggcagccccaagggccagccagccuguacucu

SEQ ID NO: 294582 - RNA, 62 nt, hsa
gagaaacaaaaugggucagauagcuuuggccacagccccaggcagccuuuggggccuaugac

SEQ ID NO: 294583 - RNA, 62 nt, hsa
gcggguugcuucagccagugcagugagaacagcagccccacggccccaugggaggcggcgcu

SEQ ID NO: 294584 - RNA, 62 nt, hsa
aagacacuuuauucguuuauauugugagaaaacagccccaucaggcuuguguuaaggcaaug

SEQ ID NO: 294585 - RNA, 62 nt, hsa
cugagguaaauaauuucugccaggaaacuucccagccccaccagcagccccccuaaaaaaau

SEQ ID NO: 294586 - RNA, 62 nt, hsa
ccauuuugcaccaaggacuugguaggcagaggcagccccacuguaaagaagggucagauuaa

SEQ ID NO: 294587 - RNA, 62 nt, hsa
ugcauacuuuaaggaccagaucaugcuccauccagccccacccaauggccuuuugugcuugu

SEQ ID NO: 294588 - RNA, 53 nt, hsa; identical to SEQ ID NO: 245441

SEQ ID NO: 294589 - RNA, 62 nt, hsa
ccaccucccucccagccccagcgccucagccccagccccagcuccagcccugaggacagcuc

SEQ ID NO: 294590 - RNA, 62 nt, hsa
uuaucaccaccucccucccagccccagcgccucagccccagccccagcuccagcccugagga

SEQ ID NO: 294591 - RNA, 62 nt, hsa
uucugcagugguucuuaucaccaccucccucccagccccagcgccucagccccagccccagc

SEQ ID NO: 294592 - RNA, 62 nt, hsa
ucccuugacccaccccagugagugccaaagggcagccccaacaugugcaccccugcauuucc

SEQ ID NO: 294593 - RNA, 62 nt, hsa
gagggcagccugcuguacuggccaugcugggccagccccaccuggagcucaguaaaaacugc

SEQ ID NO: 294594 - RNA, 62 nt, hsa
ugcuccccaccacccccauggcagucccuccgcagccccagucccuggccacgcccaaggga

SEQ ID NO: 294595 - RNA, 62 nt, hsa
gaggccccugggcagcccagccaggggagccacagccccaaggauggucuugcucugggaau

SEQ ID NO: 294596 - RNA, 62 nt, hsa
aggggugggugauuuagggacagccagggucccagccccaaugucagcaggauagggagagc

SEQ ID NO: 294597 - RNA, 62 nt, hsa
aggccuggcccagcucccaguucccccugcaccagccccaccccuagagucccuucuauagg

SEQ ID NO: 294598 - RNA, 62 nt, hsa
gggcagggaagcuucaugcccacggguucugccagccccagcacagacccaaacuggggcug

SEQ ID NO: 294599 - RNA, 62 nt, hsa
aggguguggggaugccuugccaaccagaagcccagccccaaggaugaagcaagacauguggg

SEQ ID NO: 294600 - RNA, 62 nt, hsa
ccugccaguuuccccagccucagccccagccccagccccagugggcaagaccaaaguguggc

SEQ ID NO: 294601 - RNA, 62 nt, hsa
cuaccaccugccaguuuccccagccucagccccagccccagccccagugggcaagaccaaag

SEQ ID NO: 294602 - RNA, 62 nt, hsa
ucccuccuaccaccugccaguuuccccagccucagccccagccccagccccagugggcaaga

SEQ ID NO: 294603 - RNA, 62 nt, hsa
cccugcccucaccccacugccaggccgaggcucagccccagacucucagcaucugcugcccu

SEQ ID NO: 294604 - RNA, 62 nt, hsa
cagaguguggugcuagaaacuggcccccagcccagccccaguacugccaccuuuacaccuac

SEQ ID NO: 294605 - RNA, 62 nt, hsa
ggccaagggaggugccaacacugggcuugccacagccccaggagaggaauuuggggccuagg

SEQ ID NO: 294606 - RNA, 62 nt, hsa
gagggggugcccuccggccaccuguacuguaucagccccaagcagguggugaguugggguau

SEQ ID NO: 294607 - RNA, 62 nt, hsa
ccucaccagcccugaggcuccgccccagcccucagccccaggccccagcuggagaaaaaaca

SEQ ID NO: 294608 - RNA, 62 nt, hsa
cacccugagaccugguagcccuagcugccuugcagccccaaaccccaggacccuaucagccc

SEQ ID NO: 294609 - RNA, 62 nt, hsa
cggcugcacuggccucuaggacucacagcagccagccccagcuaggaacgggcaggacuugg

SEQ ID NO: 294610 - RNA, 62 nt, hsa
gccucccugugcaguccagcccugccuugcugcagccccagcccagauggcacucagcgcuc

SEQ ID NO: 294611 - RNA, 62 nt, hsa
gagagggccuuuccuggcugaucagagcuuaccagccccaccccaccaugguagccuuaggg

SEQ ID NO: 294612 - RNA, 62 nt, hsa
auauauauauauguggcucuagccucaggcuccagccccagugggguacuguacaguuaacu

SEQ ID NO: 294613 - RNA, 62 nt, hsa
gacauuaagggacagcuaacuguggccagacucagccccauguccuuggccaggcccaagga

SEQ ID NO: 294614 - RNA, 62 nt, hsa
cuugauauaccucgagcuuccccugugcuccccagccccaggaccacuggccccuuggccug

SEQ ID NO: 294615 - RNA, 62 nt, hsa
acacacagauggcagacgucuccccacucauccagccccagaucugagccuugacgcaggcc

SEQ ID NO: 294616 - RNA, 62 nt, hsa
aacagacgaccagaggagugcuggagcuccagcagccccaaccacagcauucccuaacaugg

SEQ ID NO: 294617 - RNA, 62 nt, hsa
ccagcagugccucuggagcccaggccccaacacagccccauggccucugccagauggcuuug

SEQ ID NO: 294618 - RNA, 62 nt, hsa
uccaucgugcccugaggccugacacggcagaucagccccauagugcucaggaggcagcaucu

SEQ ID NO: 294619 - RNA, 62 nt, hsa
ccaagucuuccaggcaauaccuggcucaggcccagccccaauccauccccuuacuuucugcc

SEQ ID NO: 294620 - RNA, 62 nt, hsa
ugcggagcuccccugcugguuggggcucagcgcagccccagggaggugcuuccugcaccuca

SEQ ID NO: 294621 - RNA, 62 nt, hsa
cacugaggccccuacugaggccagccccgagccagccccagacccagccccgguggcugaag

SEQ ID NO: 294622 - RNA, 62 nt, hsa
uguagccccgggcugacccagugugugcucagcagccccaccccacccugccccuuguccuc

SEQ ID NO: 294623 - RNA, 62 nt, hsa
gaccuuuucugccuggagagaaacuuucagaccagccccacacaccacagccaggagaggcc

SEQ ID NO: 294624 - RNA, 62 nt, hsa
gggccaggggagagagaagaggaucagcagugcagccccaggaugccucgcagguacccugc

SEQ ID NO: 294625 - RNA, 62 nt, hsa
gacaagauaaacggagcugguggcgggagggacagccccagagcagacccuuccuauggcgg

SEQ ID NO: 294626 - RNA, 62 nt, hsa
agugcugugacuucagcuaaugaucuuuucuucagccccacccccuccccacuagcucgauc

SEQ ID NO: 294627 - RNA, 62 nt, hsa
ccucuguauucccagagugggaucggggcuuucagccccacccugaugccugcccuccagga

SEQ ID NO: 294628 - RNA, 62 nt, hsa
cuuguggcuagaguacagugggguagacccuccagccccaauagcccuaguacccagcuggc

SEQ ID NO: 294629 - RNA, 62 nt, hsa
auguggcccagagaaggaggcugggggaucaccagccccaaggucccgaagggcaggucaga

SEQ ID NO: 294630 - RNA, 62 nt, hsa
uguugggagcagaggaguccuacuccuugccucagccccacacgguuccuuagcugccgugu

SEQ ID NO: 294631 - RNA, 62 nt, hsa
uuggccccacccucuaccccauuccuuccugucagccccagucugucuuggcacuggccagg

SEQ ID NO: 294632 - RNA, 62 nt, hsa
gguuuacagaaugaggcccuggcuccccaccacagccccagcugccucagagcaggcacagc

SEQ ID NO: 294633 - RNA, 62 nt, hsa
ugccucagagcaggcacagcacaaggcaggcccagccccaugggccgucacaaaggcuugau

SEQ ID NO: 294634 - RNA, 62 nt, hsa
gugaggcccuucuucagguuggggugugaggacagccccaucuucaucugcccugcacucac

SEQ ID NO: 294635 - RNA, 62 nt, hsa
ccagcugccucuuucacacccacuacagaccucagccccaguuuucuccuccucacuaggcu

SEQ ID NO: 294636 - RNA, 62 nt, hsa
ggggaccugggagaugauggcucauuuccacccagccccaggauuuccagagcgcacaucca

SEQ ID NO: 294637 - RNA, 62 nt, hsa
caggcccucagcccgggcugugccagcccucccagccccaggcccaucugagggaccaagac

SEQ ID NO: 294638 - RNA, 62 nt, hsa
gccagcggcuucccagcaccugggaggggcugcagccccagcuggacuccagccugucccuc

SEQ ID NO: 294639 - RNA, 62 nt, hsa
cccugccuaguggggugguaguggcuaccucucagccccaauagucccugcuccucuuagaa

SEQ ID NO: 294640 - RNA, 62 nt, hsa
aguggcggcugaucuguagagguaugaaaauacagccccaaagggggaauuugucaugggga

SEQ ID NO: 294641 - RNA, 62 nt, hsa
acagaugucaccacagcccugcccuucaugcccagccccaugggacacccgguggucuuucc

SEQ ID NO: 294642 - RNA, 62 nt, hsa
gcuugcccuggggcacugagacaguuguuuggcagccccagcccagccaggggcucauccuu

SEQ ID NO: 294643 - RNA, 62 nt, hsa
gccuucucugaaagcaucuuugccucccugaacagccccacccuuguagagcaaaacucuuc

SEQ ID NO: 294644 - RNA, 62 nt, hsa
gugaggggacagacucugcucucacuggcuggcagccccaggagccuguucccuugccucuc

SEQ ID NO: 294645 - RNA, 62 nt, hsa
agcgggccucuucccucaguuuuucggugggacagccccagggcccuaacgggggugcggca

SEQ ID NO: 294646 - RNA, 62 nt, hsa
gagcaguggccgcaagcgcagggaggaugccacagccccacagcacccaggcuccaugggga

SEQ ID NO: 294647 - RNA, 62 nt, hsa
aacccggccccuucccccaggagucacugugccagccccaccacauccuggaagaggagggg

SEQ ID NO: 294648 - RNA, 62 nt, hsa
ccugcuccacccgaccccaccugcggugccuucagccccaaccaaagacacuagugcacccc

SEQ ID NO: 294649 - RNA, 62 nt, hsa
acagcuggggaagaucuugcugaccuuguccccagccccaccuggcccuuucuccagcaagc

SEQ ID NO: 294650 - RNA, 62 nt, hsa
gcacagcuuccugagucaccccucugucuaaccagccccagcacaaauggaacucccgaggg

SEQ ID NO: 294651 - RNA, 62 nt, hsa
ugcucauuuacauuagugugugugcauucguucagccccaugguggugaauucuguuucuuu

SEQ ID NO: 294652 - RNA, 62 nt, hsa
uuccccuuugcuaaagcaucucacucccagggcagccccagcacccuggcauugcgggaggu

SEQ ID NO: 294653 - RNA, 62 nt, hsa
gggauaagaacagaggaggcagcagcauugcacagccccaggcacaguggcaguuaggaugg

SEQ ID NO: 294654 - RNA, 62 nt, hsa
agaggcuuacgaaaaacuuugccucugaugcucagccccacccccaaauagcacacaagcuu

SEQ ID NO: 294655 - RNA, 62 nt, hsa
caguugugaucaggcaggcugugcucucaggacagccccauuuuagggaugaggagacuuca

SEQ ID NO: 294656 - RNA, 62 nt, hsa
ggcugggaguuagggagcccuggguuggaauccagccccaccucuuuuaugccacagguuug

SEQ ID NO: 294657 - RNA, 62 nt, hsa
cgcugaccgacugaccucuccucacggaggcccagccccaaagccccagggcuggcccguuu

SEQ ID NO: 294658 - RNA, 62 nt, hsa
ccuccaccaaggcagcuuuccuuacccugacacagccccagaccccacaaagccuucuggac

SEQ ID NO: 294659 - RNA, 62 nt, hsa
cagccugcccucccugccggagccggcucugccagccccagauugggaagucuccccgcugg

SEQ ID NO: 294660 - RNA, 62 nt, hsa
ucuccccagaccacagggggccucucugccuccagccccaccuuccccgggagaagcuuucc

SEQ ID NO: 294661 - RNA, 62 nt, hsa
cuccaauaucacccugugagccucgcacagcucagccccaacacagaggugagaccaggaau

SEQ ID NO: 294662 - RNA, 62 nt, hsa
aaugcccagcagcagcucuggaaggcagugcucagccccaucaccacugucccguggaugcc

SEQ ID NO: 294663 - RNA, 62 nt, hsa
guggcccugucacccgugcugcacgggauucacagccccagccccauggccccucuccacac

SEQ ID NO: 294664 - RNA, 62 nt, hsa
cugucacccgugcugcacgggauucacagccccagccccauggccccucuccacaccucaaa

SEQ ID NO: 294665 - RNA, 62 nt, hsa
gcaggaaugccaagcaccuggccagagcagcccagccccaauaugcuuaggaggagacagag

SEQ ID NO: 294666 - RNA, 62 nt, hsa
uggaagaguuaaaugcuguucagugaagauuucagccccaggccuuugcugcaagugacccu

SEQ ID NO: 294667 - RNA, 62 nt, hsa
ccccgcaagcuggucccaucgaccagcaagcccagccccagggcgcuuagggagaaaugacc

SEQ ID NO: 294668 - RNA, 62 nt, hsa
aaaucagcuuuaaggagcuggcagaaagcccccagccccacagcccugagagaugguguugc

SEQ ID NO: 294669 - RNA, 62 nt, hsa
uauaauggggcuggaggggcccccacaucucucagccccacuaaugcagaaucccacuaccc

SEQ ID NO: 294670 - RNA, 62 nt, hsa
cccagguccugcagcaccuuaguccauacuaccagccccacccaccuuccuuccucuucccu

SEQ ID NO: 294671 - RNA, 62 nt, hsa
caaagaaaggagaggcaggugcuccuguaccccagccccacucagcacugacaguccccagc

SEQ ID NO: 294672 - RNA, 62 nt, hsa
agcugccaaacagcagccugccgggcagggagcagccccaggccagagaggccucccggucc

SEQ ID NO: 294673 - RNA, 62 nt, hsa
ugcugccacagcccucccccggccccagauagcagccccagggaggaugcugccuccaagag

SEQ ID NO: 294674 - RNA, 62 nt, hsa
guuuccuaugguuuacaaagagggccccagcccagccccaccacagaucccagagauagggg

SEQ ID NO: 294675 - RNA, 62 nt, hsa
accucuacuggcaucagucuuugguuaccccccagccccaguaggaggagagcaggcagagc

SEQ ID NO: 294676 - RNA, 62 nt, hsa
gguggcuuucccuaccugacacagccauggcccagccccaaggccaggcugucuacccuaug

SEQ ID NO: 294677 - RNA, 62 nt, hsa
ggcggccucugggcuugggcaccagcucaugccagccccagagggucaggguuggaggccug

SEQ ID NO: 294678 - RNA, 62 nt, hsa
uccauggugucaugccaagacaguaucagacacagccccagaagggggcauuaugggcccug

SEQ ID NO: 294679 - RNA, 62 nt, hsa
ccugaccacaaggccaacugggcgcccguccccagccccacgcacgaccccaagcccgcgga

SEQ ID NO: 294680 - RNA, 62 nt, hsa
ucaagugcugcuguggcaaagcuccggagccccagccccaaggcuuugacaaccaggcguuc

SEQ ID NO: 294681 - RNA, 62 nt, hsa
ucgggcaaccucaccguggccaggaguguccccagccccaugaccuuccuucugcuggugaa

SEQ ID NO: 294682 - RNA, 62 nt, hsa
ccaagcccuggggacagguguagggagaaaagcagccccaggccucagacucgcuucccauc

SEQ ID NO: 294683 - RNA, 62 nt, hsa
ugggagcccccucccugcaaccagccugaguucagccccacggacaaagggacacacagccc

SEQ ID NO: 294684 - RNA, 62 nt, hsa
uccgcccuccuuuguguaucaagugucgcucacagccccauucacuggggagccuuucggau

SEQ ID NO: 294685 - RNA, 62 nt, hsa
gcccguacuguggggauccucacugaccagcccagccccauccgcaagccaggcugggccug

SEQ ID NO: 294686 - RNA, 62 nt, hsa
cuccagggagggcuggacggcgagcugggagccagccccaggcuccagggccacggcggagu

SEQ ID NO: 294687 - RNA, 62 nt, hsa
ugaaaggggccugggggcaucucgggcacagacagccccaccuggggcgcucagccuggccc

SEQ ID NO: 294688 - RNA, 62 nt, hsa
caccgucccugcccagccccacuucuccaucgcagccccaccuuggcugcugagccaggagc

SEQ ID NO: 294689 - RNA, 62 nt, hsa
accccagugcugcucuaagcaccgucccugcccagccccacuucuccaucgcagccccaccu

SEQ ID NO: 294690 - RNA, 62 nt, hsa
agauaguggaagagucaggacagguuggucuccagccccacuucccaaauaugccucagccc

SEQ ID NO: 294691 - RNA, 62 nt, hsa
uuggucuccagccccacuucccaaauaugccucagccccacuagcuggcaccaacuuaauuc

SEQ ID NO: 294692 - RNA, 62 nt, hsa
ugggaagggagacgaggugugcuguuccuucccagccccaucccuccccacccuuccuacuc

SEQ ID NO: 294693 - RNA, 62 nt, hsa
gggggaggaggcaaucgcuguagcugccaggccagccccaucuggaaggagucccugcucug

SEQ ID NO: 294694 - RNA, 62 nt, hsa
cuggcauccaggcagggacacccucacaccaccagccccagggagcuucccugcuauaaaca

SEQ ID NO: 294695 - RNA, 62 nt, hsa
cugagcucccugcuuccuauuucauaauccuccagccccagcagguccacuccugguuccug

SEQ ID NO: 294696 - RNA, 62 nt, hsa
caccugggggggcccagcacgaagucacaucccagccccagagucacuguccagcccccacc

SEQ ID NO: 294697 - RNA, 62 nt, hsa
cccccuguuugagguucugagaaggucaagggcagccccagcagcuggauucucaggcuggg

SEQ ID NO: 294698 - RNA, 62 nt, hsa
auacuccaaacuuucgcagccaucuucccgcucagccccagacacccagcaaucaagccaga

SEQ ID NO: 294699 - RNA, 62 nt, hsa
cacugcagccaaaggugcaauuacuugaccugcagccccagcccacccucggcucugcagcc

SEQ ID NO: 294700 - RNA, 62 nt, hsa
gaaccuuuuguaaaaguugguggcagcagaggcagccccaggccgggcugcaucucucugug

SEQ ID NO: 294701 - RNA, 62 nt, hsa
acgagggcagugcaagggagaaccugccagcccagccccaccacagggagagugcgucagca

SEQ ID NO: 294702 - RNA, 62 nt, hsa
cagagcccccucccucaccuucccuccaccgccagccccagaguuagauuuuaugcuugggc

SEQ ID NO: 294703 - RNA, 62 nt, hsa
aacgccuggaacgcucuccguccgccucccugcagccccaucuccuugggcgccaggguccc

SEQ ID NO: 294704 - RNA, 62 nt, hsa
cuccaggcgugcucaugcccacaacccgcggccagccccacguggugcugcucagccuucuc

SEQ ID NO: 294705 - RNA, 62 nt, hsa
gaccuuggggucuucuggccagagcuugucaccagccccauggccucuccaggcgugcucau

SEQ ID NO: 294706 - RNA, 62 nt, hsa
uucacacuggugaagucuguguacccauacugcagccccaucccauggggccccugaagacc

SEQ ID NO: 294707 - RNA, 62 nt, hsa
aaggaggaagggagacugggcccacugauuuccagccccaccaugugugcuguuuucagaug

SEQ ID NO: 294708 - RNA, 62 nt, hsa
caagaagaggcuggggaggguuuuccccacgacagccccacggcacagcagaucaugcggcu

SEQ ID NO: 294709 - RNA, 62 nt, hsa
cuuggcccagaaggagccagaggcagcagccucagccccagggacugggggcgauucugugu

SEQ ID NO: 294710 - RNA, 62 nt, hsa
agccacggccaggccagagggagugacagaggcagccccauucugccugcccaggccccugc

SEQ ID NO: 294711 - RNA, 62 nt, hsa
cagugggagcugccuguucagcuccagcucaccagccccagugcccacaggaucagucugau

SEQ ID NO: 294712 - RNA, 62 nt, hsa
agggacagaggggguggccucccaacucaccccagccccaaaacucuccucugcugcuggcu

SEQ ID NO: 294713 - RNA, 62 nt, hsa
uggcugguuagagguucccuuugacgccaucccagccccaaugaacaauuauuuauuaaaug

SEQ ID NO: 294714 - RNA, 62 nt, hsa
gucaccccggccaccugcggugcuaucucccccagccccauccucuguacagagcccacgcc

SEQ ID NO: 294715 - RNA, 62 nt, hsa
ccccacucacuccauccugugagccccacucccagccccacucacaccaaccugugagcccc

SEQ ID NO: 294716 - RNA, 62 nt, hsa
ccccacucccaccauccugugagccccacucccagccccacucccaccauccugugagcccc

SEQ ID NO: 294717 - RNA, 62 nt, hsa
ccccacucccaccauccugugagccccacuuccagccccacucccaccauccugugagcccc

SEQ ID NO: 294718 - RNA, 62 nt, hsa
ccccauucacuccauccugugagucccacucccagccccacucccaccauccugugagcccc

SEQ ID NO: 294719 - RNA, 62 nt, hsa
gccccacucacuccaucuuguaagacuaugcccagccccauucacuccauccugugaguccc

SEQ ID NO: 294720 - RNA, 62 nt, hsa
ccccacucacuccauccugugagucccacucccagccccacucccaccauccugugagccca

SEQ ID NO: 294721 - RNA, 62 nt, hsa
gccccacucccaccaucuuguaagacugugcccagccccacucacuccauccugugaguccc

SEQ ID NO: 294722 - RNA, 62 nt, hsa
uuuugaacccugcucuauccccugcccucuuccagccccaccccucccuggucuugaaagaa

SEQ ID NO: 294723 - RNA, 62 nt, hsa
ugugugaaccaaagcgucaggggcuuggggcacagccccagucagcucaacccaguccugcu

SEQ ID NO: 294724 - RNA, 62 nt, hsa
cgaaaacugccaggaugaaugaggaaaaaacccagccccacaaacgagacacacgcuggcgg

SEQ ID NO: 294725 - RNA, 62 nt, hsa
cccuggagaccuccaggcuuuccugcccugggcagccccaccucacagccagagucaaugcc

SEQ ID NO: 294726 - RNA, 50 nt, hsa; identical to SEQ ID NO: 245579

SEQ ID NO: 294727 - RNA, 62 nt, hsa
aggacuaagguggcuuucccacuccuggcccacagccccagagagccugucugugcauccug

SEQ ID NO: 294728 - RNA, 62 nt, hsa
ugaggauaagcccacuuuccugucauuaguggcagccccagauccagaccuaggccuccugg

SEQ ID NO: 294729 - RNA, 62 nt, hsa
gccagguguugacaccuuaaagcuggcgcccccagccccacucuuggcugugcuggccaggu

SEQ ID NO: 294730 - RNA, 62 nt, hsa
cugucucucugagggaaucagaguccagcauccagccccagcuggaacagcugaagucacaa

SEQ ID NO: 294731 - RNA, 62 nt, hsa
acaggaaagggucacguggucccauguugcaacagccccaacaucacgcaugucauucacug

SEQ ID NO: 294732 - RNA, 62 nt, hsa
acacaagcucucagccacaggcagcuucuccacagccccagcuucgcacaggcuccuggagg

SEQ ID NO: 294733 - RNA, 62 nt, hsa
gcaccuucgcgucucagccucagggagccccacagccccaagcucgcugaggcaacgugaga

SEQ ID NO: 294734 - RNA, 62 nt, hsa
cuuuugugccaccuuguacaaagccggcugcccagccccagccucaccaccgcaucccaccu

SEQ ID NO: 294735 - RNA, 62 nt, hsa
gcccugggagaaucgcuccugcagccccagcccagccccacuccucugcugaccugcugacc

SEQ ID NO: 294736 - RNA, 62 nt, hsa
uggcucuccuggcccugggagaaucgcuccugcagccccagcccagccccacuccucugcug

SEQ ID NO: 294737 - RNA, 62 nt, hsa
agccaaccaugcccagccccucccagcacccccagccccacgaccaucguucugaauucuga

SEQ ID NO: 294738 - RNA, 62 nt, hsa
acugaagccccagugugcgcagcucgagccaccagccccagccuggaaggaccagguucuuu

SEQ ID NO: 294739 - RNA, 62 nt, hsa
uacacacaguguuucauugcuccgcgucuucccagccccagaaaccggcuaaaggacccugc

SEQ ID NO: 294740 - RNA, 62 nt, hsa
ggcccaggaccagaaucgcugccuccucuccccagccccaccuuguacacacaguguuucau

SEQ ID NO: 294741 - RNA, 62 nt, hsa
uccaaggcuugccccagaggccacauggccaccagccccagcugccaucagauucaagccca

SEQ ID NO: 294742 - RNA, 62 nt, hsa
ugucccuccccucaugagcgugcaacagggagcagccccagccagccccaccgccgccgucu

SEQ ID NO: 294743 - RNA, 62 nt, hsa
cucaugagcgugcaacagggagcagccccagccagccccaccgccgccgucugcguggaugg

SEQ ID NO: 294744 - RNA, 62 nt, hsa
uuucuuguuuuggugccugaccgaaccaacgacagccccaaucuucccgucuuuaugagaga

SEQ ID NO: 294745 - RNA, 62 nt, hsa
ccuucuccuuugaggggggagagagaacagugcagccccauuuccgguccugcuaccucacc

SEQ ID NO: 294746 - RNA, 62 nt, hsa
cugagacgcaugagugccuucuggggugagagcagccccaggguuuaaguugggcguccuag

SEQ ID NO: 294747 - RNA, 62 nt, hsa
aaugagggcuuugcagggauuguuuucauucucagccccagcugugggagugcggguggggg

SEQ ID NO: 294748 - RNA, 62 nt, hsa
ggguuggguggauggagcucagaaggaaaccccagccccaccacggaugacaccaucccucc

SEQ ID NO: 294749 - RNA, 62 nt, hsa
cuccauccccaacccauccucauccccaacuacagccccaaacccagccccagacuaaucca

SEQ ID NO: 294750 - RNA, 62 nt, hsa
cccauccucauccccaacuacagccccaaacccagccccagacuaauccacagccaucccca

SEQ ID NO: 294751 - RNA, 62 nt, hsa
agccauccccaacucauccucauccccaacugcagccccaaacccaacccagggccaucccc

SEQ ID NO: 294752 - RNA, 62 nt, hsa
cccuggccacauccccauccucccccaaccuccagccccaacacccaucaucccccugagcu

SEQ ID NO: 294753 - RNA, 62 nt, hsa
ugggugguggcuuauaacuguaagggagauggcagccccaggguacagccagcaggcauuga

SEQ ID NO: 294754 - RNA, 62 nt, hsa
ccaggagagggcuggagggagggagauggucucagccccacagaguuuggaguccucagugu

SEQ ID NO: 294755 - RNA, 62 nt, hsa
ggcccagggugggguggaugggcccaaaggcccagccccacacuccuuucccguccacuugu

SEQ ID NO: 294756 - RNA, 62 nt, hsa
agagagaaggggcccaagagagacagcacaggcagccccacggacgacgcgagggccccacg

SEQ ID NO: 294757 - RNA, 62 nt, hsa
cugcagggcugaaguucacucaucgaccgacucagccccaaccgggagccaggcagaaaaac

SEQ ID NO: 294758 - RNA, 62 nt, hsa
augucaggcacuucccucuaacuggcaugcaacagccccaccugccugagagcccugaggug

SEQ ID NO: 294759 - RNA, 62 nt, hsa
ccccagccucugccacccuccaccuccucggucagccccagccccagguugauaaaucuauu

SEQ ID NO: 294760 - RNA, 62 nt, hsa
ccucugccacccuccaccuccucggucagccccagccccagguugauaaaucuauugauuga

SEQ ID NO: 294761 - RNA, 62 nt, hsa
uucccuccugagugccccacuucuggccacaucagccccacaggacuuugaugaagaccauu

SEQ ID NO: 294762 - RNA, 62 nt, hsa
ugacuaacuaugcaauaauccacccccaggugcagccccagggccugcggaggcgguggcag

SEQ ID NO: 294763 - RNA, 62 nt, hsa
cccacugccccaucucccucuccccaccaagacagccccagaaggagcagccagcugggaug

SEQ ID NO: 294764 - RNA, 62 nt, hsa
uguuggaagggcagcggguaagguucccaagccagccccaacacccuucccacuuggcaccc

SEQ ID NO: 294765 - RNA, 62 nt, hsa
cucauccacaggguuuucucacugcuaugaaccagccccacagccccaggccccugucaccu

SEQ ID NO: 294766 - RNA, 62 nt, hsa
caggguuuucucacugcuaugaaccagccccacagccccaggccccugucaccuggcuaugc

SEQ ID NO: 294767 - RNA, 62 nt, hsa
gagggccgggugguggcucugaggaugguccccagccccacccuguccccacccuggccugu

SEQ ID NO: 294768 - RNA, 62 nt, hsa
ccuguacuaccuccugggccaagaaacuggcacagccccacacugucagugccaagaggcug

SEQ ID NO: 294769 - RNA, 62 nt, hsa
accacgugggggucagucgggggcaaggggcucagccccacuggacucugggcugcagaggc

SEQ ID NO: 294770 - RNA, 62 nt, hsa
uugaagugaaggaacagaggcagggggugggccagccccagggccaggguccccuuggugaa

SEQ ID NO: 294771 - RNA, 62 nt, hsa
uagcgguuugaauguugguuccaugccuggcccagccccaccucagucuccaggacauuccu

SEQ ID NO: 294772 - RNA, 62 nt, hsa
ggacagagccucagggagccccgagcaugguccagccccauuugagugcucuccggggaugc

SEQ ID NO: 294773 - RNA, 62 nt, hsa
ggcacccccauugguucgugugagcagcugcccagccccaggccugcccucggccuggucca

SEQ ID NO: 294774 - RNA, 62 nt, hsa
ggaccgacuccaggaguccccuuucccugucccagccccaucuguggguugcacuuacaaac

SEQ ID NO: 294775 - RNA, 62 nt, hsa
uauuaaggagguccaaggggugagucccaacccagccccagaauauauuuguuuuugcaccu

SEQ ID NO: 294776 - RNA, 62 nt, hsa
cucaccucugguagccauagcagccccugcuucagccccaccgcaccccuccagggggccug

SEQ ID NO: 294777 - RNA, 62 nt, hsa
agucuguuguguggaugugcgugugugguccccagccccagacuggauuggaaaagugcaug

SEQ ID NO: 294778 - RNA, 62 nt, hsa
ccuugaaccuaggaccaagagccaccuacauccagccccaaaacuggggcuucaggccagag

SEQ ID NO: 294779 - RNA, 62 nt, hsa
acaggacaucugugaccgcccuacccccacgccagccccaaacuaagauaucccucacaccc

SEQ ID NO: 294780 - RNA, 62 nt, hsa
cgaagcaugaacagugcaccugggacagggagcagccccaaauugucaccugcuucucugcc

SEQ ID NO: 294781 - RNA, 62 nt, hsa
cugccugcccuuuguccuccugcugccaguaccagccccacccuguuuugagcccugaggag

SEQ ID NO: 294782 - RNA, 62 nt, hsa
ccacccgugguggcucaagucuggccccacaccagccccaauccaaaacuggcaaggacgcu

SEQ ID NO: 294783 - RNA, 62 nt, hsa
ucugucuucuucuacacggcaugugccugcaccagccccaacaccugagcugguuuagcgca

SEQ ID NO: 294784 - RNA, 62 nt, hsa
caccuguccauacccgaggguggauauucaaccagccccaccgccuacccgacucgguuucu

SEQ ID NO: 294785 - RNA, 64 nt, hsa
ccauggggaaacccuggagccaucccuucggagccaacaagaccgccccagggcuauagcagaa

SEQ ID NO: 294786 - RNA, 64 nt, hsa
gacucaccaacuugccacauguucuagguuucagcaacaagacugccaggugguuggguucugc

SEQ ID NO: 294787 - RNA, 64 nt, hsa
aaaacaaaaagacagugugugugucuguugagugcaacaagagcaaaaugaugcuuuccgcaca

SEQ ID NO: 294788 - RNA, 64 nt, hsa
cucuguacaaaaacaaaacaaaacaacaacaauacaacaagaacaacaacaacaauaacaacaa

SEQ ID NO: 294789 - RNA, 64 nt, hsa
guggaagauaaacagugacgggggaacaaacagacaacaagaagguuuggaagaaaucugguuu

SEQ ID NO: 294790 - RNA, 64 nt, hsa
aaggaggaucgggucauaagcaaucccaaacuaccaacaagaggaccuugaucuuggcgaaagc

SEQ ID NO: 294791 - RNA, 64 nt, hsa
gggcaguuucagucauagcucagaucuuauccugcaacaagaaguccucaccagacagaaagcc

SEQ ID NO: 294792 - RNA, 64 nt, hsa
cugcgaagaagacaugauaaggacaucagggagccaacaagacuccuaauagccucacuacauu

SEQ ID NO: 294793 - RNA, 64 nt, hsa
agcaagcaaacaaauccauaacaaccacaacaagcaacaagaacaagaacaacaacaagaagaa

SEQ ID NO: 294794 - RNA, 64 nt, hsa
uaacaaccacaacaagcaacaagaacaagaacaacaacaagaagaaguugcaguauggauaucu

SEQ ID NO: 294795 - RNA, 64 nt, hsa
cuuuaacaaagcagaaugauucuucuaaguuuggcaacaagaaggcuuggaucugagucuucua

SEQ ID NO: 294796 - RNA, 64 nt, hsa
auggcuaugaugucagacaguggaugggcuccagcaacaagagacaaaauaacuaaaggccuuu

SEQ ID NO: 294797 - RNA, 64 nt, hsa
cugcuuguaagucacagguuuuccagaugucugccaacaagaaaugacucauacugugaugaua

SEQ ID NO: 294798 - RNA, 64 nt, hsa
acauauuacucuuuuuagcaaccuagcaugaugccaacaagacuauucuugaaagagcaaaggu

SEQ ID NO: 294799 - RNA, 64 nt, hsa
ucuagcucaacuuacugaagaaaaccacuaauaacaacaagaauaucaggaaggaacuuuucaa

SEQ ID NO: 294800 - RNA, 64 nt, hsa
gggagaaauaaggcacaugacugcuucuugcagucaacaagaaauaccaauaacacacacagaa

SEQ ID NO: 294801 - RNA, 64 nt, hsa
uauguguauauuucuaauggaucuauaagaacagcaacaagagaguucuaacaauucuagugug

SEQ ID NO: 294802 - RNA, 64 nt, hsa
ccacuggcaucaccugaugccacuaauuugugaacaacaagaaaucauuuccccauugguugga

SEQ ID NO: 294803 - RNA, 64 nt, hsa
caaaccaaccccaggcccacccagagcgagcaaacgcugagaccugaaaggacauggaugagaa

SEQ ID NO: 294804 - RNA, 64 nt, hsa
ugauacugcagugacugccgucagcuccgacugccgcugagaaggguugauccugcaucugggu

SEQ ID NO: 294805 - RNA, 64 nt, hsa
ucuaauccuuaacuccaggauuagcucccaagugcgcugagacccagccagcacacuucuggcc

SEQ ID NO: 294806 - RNA, 64 nt, hsa
uggcgugucggagccacccaggucccgcagcugccgcugagaaaaugcaaauauuuguugugac

SEQ ID NO: 294807 - RNA, 64 nt, hsa
agcuuugcuuuucuccccauaucccaaggcgaagcgcugagauucuuccaucuaaaaaacccuc

SEQ ID NO: 294808 - RNA, 64 nt, hsa
ugacgaugagugugugauccccccuucuccgagacgcugagagagcaggcauugcaggcgggaa

SEQ ID NO: 294809 - RNA, 64 nt, hsa
uccaggacgcuccguggauaauaaacuuugacgacgcugagagcgcgcggggagaccggagccg

SEQ ID NO: 294810 - RNA, 64 nt, hsa
ugccuguucccagggcugccgaaugcuuaggacacgcugagagacuaguugugauuugcuauuu

SEQ ID NO: 294811 - RNA, 64 nt, hsa
ucugcacugcccuagcagagguucucuccccugccgcugagagggccucuccccugcagcaaac

SEQ ID NO: 294812 - RNA, 64 nt, hsa
agcgaccauuucagauaccguccacagccaggaccgcugagaacugggacaguuuccugggaug

SEQ ID NO: 294813 - RNA, 64 nt, hsa
uugaugggauuuuaaauucaggcaaagccuacaacgcugagacaauccccuaacaacaugguag

SEQ ID NO: 294814 - RNA, 64 nt, hsa
ggugccaaguccaaggccucccacugggagucaucgcugagaagaugccaauguuucauccacc

SEQ ID NO: 294815 - RNA, 64 nt, hsa
ugcccacaacaccaguauuucacaacuuccuggucgcugagaauauuuauucaaaaacagggau

SEQ ID NO: 294816 - RNA, 64 nt, hsa
caagagggaacaaaacuguucuuuugcauuuugccgcugagauauggcauugcacugcuuauau

SEQ ID NO: 294817 - RNA, 64 nt, hsa
cagccugccagcaguuacugugaauguuccccaccgcugagaggcugccuccgcaccugaccgc

SEQ ID NO: 294818 - RNA, 64 nt, hsa
uccacagccugcucacuucgugggaauaguucuccgcugagauagccccucucgccuaaguauu

SEQ ID NO: 294819 - RNA, 64 nt, hsa
uuugagaggcaccucagaguuuccuucuuuaccccgcugagacagugggagagccugaagcaga

SEQ ID NO: 294820 - RNA, 64 nt, hsa
gguggcacaugccuguggccccagccacucugaacgcugagaugggaaggucacuugagcccag

SEQ ID NO: 294821 - RNA, 64 nt, hsa
ugcagcaccggccgucacaggaugcugauaagcgcgcugagagguggaugaaacaccaaagucu

SEQ ID NO: 294822 - RNA, 64 nt, hsa
guaccugaaacugccgccacaugcacuccuccaccgcugagaguugaauagcuuuucuucugca

SEQ ID NO: 294823 - RNA, 64 nt, hsa
agcuaagccugcuggggcugggugaagaaauuggcgcugagauccaggcuggauccauugcuuu

SEQ ID NO: 294824 - RNA, 64 nt, hsa
ucagcaucaggaaaggagaaaggcagagggagagcgcugagaagacuguucacgccagagugcu

SEQ ID NO: 294825 - RNA, 64 nt, hsa
acucuucaguucaagaagagaugucuucuuguugcgcugagaacaccauauguucaugacgaga

SEQ ID NO: 294826 - RNA, 64 nt, hsa
gggggagcgaggcugacaaugacuccuguuuucacgcugagagaccccacuccccugcugagau

SEQ ID NO: 294827 - RNA, 64 nt, hsa
uggucugucucgcuuuaucugucgccccucccagcgcugagagccuccccuggcugucagcagc

SEQ ID NO: 294828 - RNA, 64 nt, hsa
gaugcccaccugucaagaguucagaucaaaguugcgcugagagcaucacaauuuugguucagcc

SEQ ID NO: 294829 - RNA, 64 nt, hsa
gauucucuccaacaaagguccaguuaggaaacgacgcugagaggaugacgacaacgugcaacag

SEQ ID NO: 294830 - RNA, 64 nt, hsa
gcagucaggcugcguccccuuuaaagaacgccaccgcugagaacugacccucacaucucccuuc

SEQ ID NO: 294831 - RNA, 64 nt, hsa
ucugcccgugggcgccccacagcugccccucagccgcugagauccaguguccaagcugcggcca

SEQ ID NO: 294832 - RNA, 64 nt, hsa
gaaacacaacucagggcuuuugugaagguucccccgcugagaucuuuccuccugguuacuguga

SEQ ID NO: 294833 - RNA, 64 nt, hsa
gugcuuggaacauacuguucacucacucuaaaggcgcugagacugugcuguuguucucguuuuu

SEQ ID NO: 294834 - RNA, 64 nt, hsa
gccucccaggaccuggugugggaugggagaacuccgcugagacccugcaggaacacgaaacaga

SEQ ID NO: 294835 - RNA, 64 nt, hsa
caacagccucaugugcacuugaccugacagugcucgcugagaacucucaccagguuggcgccug

SEQ ID NO: 294836 - RNA, 64 nt, hsa
ggcaaggaacuuuccccagaucaaauucuauuaacgcugagauacaagucauccaugcacagcc

SEQ ID NO: 294837 - RNA, 64 nt, hsa
aagcaguaggucugugcucucccugucucuaggucgcugagagaggugcuuuucuucauaaaac

SEQ ID NO: 294838 - RNA, 64 nt, hsa
gucuuuguccggacccuuccauaguacaccuuagcgcugagacugagccagcuugggggucagg

SEQ ID NO: 294839 - RNA, 64 nt, hsa
cgaggaaggagccaggcccggcaugaggaccugacgcugagagagaaccaucauaccccaagcc

SEQ ID NO: 294840 - RNA, 64 nt, hsa
gaagagcgggcugaggaaacccagagggaccaagcgcugagaccaaaguugacccucggguagg

SEQ ID NO: 294841 - RNA, 64 nt, hsa
cuccucuacuuuaacugugcucucaggugguuugcgcugagaauggauguccucaugaacaucc

SEQ ID NO: 294842 - RNA, 64 nt, hsa
ccaguggcuucuccuuucugucaagacuuagccccgcugagaugcccuucugcuccagcuugcu

SEQ ID NO: 294843 - RNA, 64 nt, hsa
ggccagaguggagugcgcagcccugacucccaggcgcugagauuguugccugguuacccaggaa

SEQ ID NO: 294844 - RNA, 64 nt, hsa
gcugcccgcguguccagcccuguugcucuccuggcgcugagagguggguccaagcagaguugau

SEQ ID NO: 294845 - RNA, 64 nt, hsa
ucaggugugauccgcccgccuccgccuccccaagcgcugagauuacaggugugagccaccgugc

SEQ ID NO: 294846 - RNA, 64 nt, hsa
acucucuagggacaccuguaccagccccaccuggcgcugagaucccucagacagcauggcccag

SEQ ID NO: 294847 - RNA, 64 nt, hsa
gaguguauugcuaacccuuccaggucuaguccagcgcugagauuuggugguucugcauguguga

SEQ ID NO: 294848 - RNA, 64 nt, hsa
cuuguuguugaacauggcuaaauacaauggguaucgcugagacuaaguuguagaaauuaacaaa

SEQ ID NO: 294849 - RNA, 64 nt, hsa
caaccucccaggacuguguucuuucuggaguuuucgcugagaacaaaacaguguugucuggacc

SEQ ID NO: 294850 - RNA, 64 nt, hsa
cauacagaaauucucaggaucuucuguuuacuaucgcugagaucauuaucagaaaauagucugg

SEQ ID NO: 294851 - RNA, 64 nt, hsa
ccagcucgcccucccccuacccggggccgcaggacgcugagacgguuugggggugggugggcgg

SEQ ID NO: 294852 - RNA, 64 nt, hsa
caaggcuuuaaagccacauuucagcaagagaaagcgcugagagcucgcagguucauuaaagaag

SEQ ID NO: 294853 - RNA, 64 nt, hsa
cuuccugcuucauccccuuuccagcuccccuucccgcugagagccacuuucaucggcaauaaaa

SEQ ID NO: 294854 - RNA, 64 nt, hsa
uugucccccagccaagcucuaaagcacauguagccgcugagaccugcuguuucugcugggggca

SEQ ID NO: 294855 - RNA, 64 nt, hsa
ugccagcccgucucugugcagucccuggaaggggcgcugagaaaggcaccagcuccuuggaccc

SEQ ID NO: 294856 - RNA, 64 nt, hsa
ccaucaccucaaagccagaggguccccaagucaccgcugagagcacuugagccucaaggaugua

SEQ ID NO: 294857 - RNA, 64 nt, hsa
cugugauccuguuccucaacaagcaagaucugcucgcugagaaaguccuugcugggaaaucgaa

SEQ ID NO: 294858 - RNA, 64 nt, hsa
ccuggccugggggagaaugcuggagggagcacgccgcugagaugcccccaccccagguuucccc

SEQ ID NO: 294859 - RNA, 64 nt, hsa
ccugcccuccccuccccucccuuccccuccacuccgcugagaauccuggaggaauacacaauuc

SEQ ID NO: 294860 - RNA, 64 nt, hsa
ccacgccgccucucacugccaggccagcggcuuccgcugagacucgcuggagaggcggcucccg

SEQ ID NO: 294861 - RNA, 64 nt, hsa
ucgugccagagcgguggccacagggcugaauggucgcugagacagagauggaagccaggacaag

SEQ ID NO: 294862 - RNA, 64 nt, hsa
ucucgauuucucucucucccccucagcaucuucccgcugagagugguggggaagagccuugucu

SEQ ID NO: 294863 - RNA, 64 nt, hsa
agagaggcuucuauccuucccagggaggaggcgccgcugagacccuucugcugagagcucugcc

SEQ ID NO: 294864 - RNA, 64 nt, hsa
gugauauauggguuuuaacaaauucuagucuucacgcugagagagcacuacuugagagagcagu

SEQ ID NO: 294865 - RNA, 64 nt, hsa
aguuuuuuuuaaaaccguggagguugcccacgggccucggcaccuggcccuggcagcacagcuc

SEQ ID NO: 294866 - RNA, 64 nt, hsa
agugggacaaaaagaauuuagaccccaaaaguguccucggcauggaucuugaacagaaccagua

SEQ ID NO: 294867 - RNA, 64 nt, hsa
guugcccuggaucucagaauauauucguccacccccucggcaccccauuaccccgagucccacc

SEQ ID NO: 294868 - RNA, 64 nt, hsa
accccgagcguuccaccacacuguccgcccuuggccucggcacacgcucaccuuuucuguuggu

SEQ ID NO: 294869 - RNA, 64 nt, hsa
ggcgccacugagggcaccgcgcaccagagcgugaccucggcaggcuggacacacugcccagcac

SEQ ID NO: 294870 - RNA, 64 nt, hsa
caucagaacuuggcagccuugaaguuggggucagccucggcaggagucccacuccuccuggggu

SEQ ID NO: 294871 - RNA, 64 nt, hsa
cccccaagucucuucugugcaaggcccgccucggccucggcagcugguuccuguccuguuuucu

SEQ ID NO: 294872 - RNA, 64 nt, hsa
gaggaaaggcaguauggcggaggccaugggggccccucggcauucacacacagccuggccuccc

SEQ ID NO: 294873 - RNA, 64 nt, hsa
aauaacccuuugauuguuuucuaaaaggagacucccucggcaagauggcagaggguacggaguc

SEQ ID NO: 294874 - RNA, 64 nt, hsa
aauugucuccccaagacagcucaaaauauccacaccucggcaacagucuaagaugagagccugu

SEQ ID NO: 294875 - RNA, 64 nt, hsa
ucagagcacuucauccacuugcuccucccucuacccucggcacccugggugggaaaggguugau

SEQ ID NO: 294876 - RNA, 64 nt, hsa
ggacgcccggggucucccacaggccugugaguugccucggcauaugacgcagaaccccaacugu

SEQ ID NO: 294877 - RNA, 64 nt, hsa
agauuccuagagacguuaugaugguuacacauguccucggcaucacauguaggagacuguucaa

SEQ ID NO: 294878 - RNA, 64 nt, hsa
uuuacuacuaaaauguaaaaaauuaaugugcucaccucggcagcacauauacuaaaaauuaaua

SEQ ID NO: 294879 - RNA, 64 nt, hsa
gacacccggguucugaaaaugugcuguguuccuaccucggcaagaucaccagcacugaggggcc

SEQ ID NO: 294880 - RNA, 64 nt, hsa
gucagugauauucucccagaauguacuuaucuuaccucggcauguacuguagucacucaguauu

SEQ ID NO: 294881 - RNA, 64 nt, hsa
cuuaauuuguacacacuuuuaaauauugucuuagccucggcaaaccaauuuggggaagaagcaa

SEQ ID NO: 294882 - RNA, 64 nt, hsa
uacgauuccaacccgucagcauaggucgcuggggccucggcaguaggcagcugugcagcuucac

SEQ ID NO: 294883 - RNA, 64 nt, hsa
aucaccgucauugauggagccugaaccgugugcuccucggcagaugcuguuguuguuacuuccc

SEQ ID NO: 294884 - RNA, 64 nt, hsa
uaaguucugaguccccggccagggucccuuaacaccucggcacagaggcuguuggcaaguguag

SEQ ID NO: 294885 - RNA, 64 nt, hsa
aaccaccucaccagaaccauuggagcaccuguggccucggcacacugcuuaucacuugaaaaau

SEQ ID NO: 294886 - RNA, 64 nt, hsa
ucauuccagaaguauuaaacgucauugcugcaaaccucggcaggugccgugugaggggcuuaau

SEQ ID NO: 294887 - RNA, 64 nt, hsa
acccuggcaucugacacugacagcagccuggaagccucggcaggaccccuggguuguugcaggu

SEQ ID NO: 294888 - RNA, 64 nt, hsa
ugaaaagaagcucgcuccagaugucugcauggguccucggcacucuuggcugaggacucaaagg

SEQ ID NO: 294889 - RNA, 64 nt, hsa
uagcuugggaagcuuccgcuuagagguccuggcgccucggcacagcugccacgggcucuccugg

SEQ ID NO: 294890 - RNA, 64 nt, hsa
cuucaggaccguggggccuggucagucuguccauccucggcaaggacacaacacugccccagag

SEQ ID NO: 294891 - RNA, 64 nt, hsa
gguuuggggcucagagucgagggacgggguguagccucggcauuugcuugaguuucuccacucu

SEQ ID NO: 294892 - RNA, 64 nt, hsa
gaagacacuguccccagcuaccagcuacgccaaaccucggcauuuuuuguguuauuuucugacu

SEQ ID NO: 294893 - RNA, 64 nt, hsa
caaagggcccagggacccuguugcgcugcccuggccucggcauucgaggcuccccuagggccgu

SEQ ID NO: 294894 - RNA, 64 nt, hsa
uuuugauugaaauauuuaguuguuaggcugaaagccucggcaguuaagaacuugccugaguuuu

SEQ ID NO: 294895 - RNA, 64 nt, hsa
gugagccuggcuucagugucuccaagaacuguaaccucggcaagugccagaugucucuaagugg

SEQ ID NO: 294896 - RNA, 64 nt, hsa
uccagcuguacauaaccacguccucgccacugcaccucggcauaugccaccuccaugccacugc

SEQ ID NO: 294897 - RNA, 60 nt, hsa
ggucaguggcuagacuguagcagccgagaaccucggcaucaccaguggcuucgugaagcc

SEQ ID NO: 294898 - RNA, 64 nt, hsa
ccgucccagccaugcaguggggccccuggggugcccucggcagcuucgguccagccugcaucug

SEQ ID NO: 294899 - RNA, 64 nt, hsa
ugcugcugccagccccuggcugggcagaaagugcccucggcaugggcaccuggguguggggugg

SEQ ID NO: 294900 - RNA, 64 nt, hsa
cuucucccuccccucccaccugacuucaucuacgccucggcaccacggggugugggaccccagc

SEQ ID NO: 294901 - RNA, 51 nt, hsa
ccaucuacagcaagugcugagccucggcauuuccacagacaaggccuccag

SEQ ID NO: 294902 - RNA, 64 nt, hsa
uccugagugcccaucccaccccgcgguugccucuccucggcacccuugauuggguuuugcacua

SEQ ID NO: 294903 - RNA, 64 nt, hsa
uugaacuggucccacacgcaccccaggccccacuccucggcaguuucagguguagcuguggggc

SEQ ID NO: 294904 - RNA, 64 nt, hsa
gcguuggaucuacuggaaugagcagcagccgcuuccucggcagccuugggaagcacgggcgacu

SEQ ID NO: 294905 - RNA, 64 nt, hsa
gcuccccccagacuggagagcaagcccagcccagccucggcauagacccccuucugguccgccc

SEQ ID NO: 294906 - RNA, 64 nt, hsa
ugacuucaccucauggagcccgggaagcugcucgccucggcagccauaggagcgaacacugcug

SEQ ID NO: 294907 - RNA, 64 nt, hsa
ccuaacucauguucugacccucugugcacuggauccucggcauagcggacggacacaccucaug

SEQ ID NO: 294908 - RNA, 64 nt, hsa
caauucuuagaggggcaguucuaccuccucugucccucggcagaaagacguuuccacaccucuu

SEQ ID NO: 294909 - RNA, 64 nt, hsa
ccgagaggccggcggcccugaaggugagugaggcccucggcagcugcagccggggugucuggua

SEQ ID NO: 294910 - RNA, 64 nt, hsa
gccuagcacggacauggucuguccugacagcacuccucggcaggcauggcuggugccugaagac

SEQ ID NO: 294911 - RNA, 64 nt, hsa
gaaccccacagcaugccugucucagcucccugucccucggcacuuccccaggcucauuugagca

SEQ ID NO: 294912 - RNA, 64 nt, hsa
uaaggauggaaggcuguccaaguuauuuggaaggccucggcagcuugggauuagcuugggagcg

SEQ ID NO: 294913 - RNA, 64 nt, hsa
cguccagcuuugacagucaguuuugaugucagcuccucggcaggguaggccugaugacagcccu

SEQ ID NO: 294914 - RNA, 64 nt, hsa
ugagugccaaaagcuugggggaggagggacagguccucggcaauaaacagugucacacacgcau

SEQ ID NO: 294915 - RNA, 64 nt, hsa
cagccacccucuggcucagcggggcccagacccaccucggcacggacaccccugucuccaggag

SEQ ID NO: 294916 - RNA, 64 nt, hsa
aguggucacgcuucauccacggcuccuucccaccccucggcaguggcugugcaauguuuuaagu

SEQ ID NO: 294917 - RNA, 64 nt, hsa
gaagccuggcuucucugugagcacauacguggguccucggcagcucccuccaggcugucugggc

SEQ ID NO: 294918 - RNA, 64 nt, hsa
cauaaagucaccuaggugaggauaggcgcgggagccucggcaugacaccauggagaucggggcc

SEQ ID NO: 294919 - RNA, 64 nt, hsa
cccaccucuggguccuuggcucccgggggccccaccucggcacacacugugccccacaaaacuu

SEQ ID NO: 294920 - RNA, 64 nt, hsa
ggaggaucaguugaggucaggaguuugagaccagccucggcaacauggcaaaaucuugucucuu

SEQ ID NO: 294921 - RNA, 64 nt, hsa
cucugcagcgaccccuccuagacgcucccuggccccucggcacccagaaugccacauucuugug

SEQ ID NO: 294922 - RNA, 64 nt, hsa
uguagucuuuucuugaaacaucuugauugcuuuuccucggcagcuuucaaaaaaccaaauaaua

SEQ ID NO: 294923 - RNA, 64 nt, hsa
caggaagacuuuccuucacccaccaucccccuaaccucggcagggcuucuguccuguggaguuc

SEQ ID NO: 294924 - RNA, 64 nt, hsa
uacggcccggcccccacgcgcccugcucucacggccucggcacaggcagcggcugcacguguuc

SEQ ID NO: 294925 - RNA, 64 nt, hsa
ucuccaaaacguucuucccagacugcgaggaccgccucggcagguggcgguaaaagcgccccca

SEQ ID NO: 294926 - RNA, 64 nt, hsa
agggccccgggacagaguuuucccagaccuggcuccucggcagagcugccucccgucagggccc

SEQ ID NO: 294927 - RNA, 64 nt, hsa
ggaaagcggugaggacgcagagugcaggcuguggccucggcaucccgcaggaggucccuagaac

SEQ ID NO: 294928 - RNA, 64 nt, hsa
acaagaaggccagcccacugggcccuggggcugcccucggcaaccguggggaggccauuugcug

SEQ ID NO: 294929 - RNA, 64 nt, hsa
ucuccugcuaccucccaccacugucccagcagucccucggcacacaggcauaucagcuuucaca

SEQ ID NO: 294930 - RNA, 64 nt, hsa
ggaaggcaagauuggaaagacaggaagaccaaggccucggcagaacucucugucuucucuccac

SEQ ID NO: 294931 - RNA, 64 nt, hsa
aguuauuagguuugaagcaaccuccagcuugaggccucggcaucuugagauggaagagcagccu

SEQ ID NO: 294932 - RNA, 64 nt, hsa
ucaggccaccuccugguccagucaccaccugcagccucggcagggcagguacaggggccaccuc

SEQ ID NO: 294933 - RNA, 64 nt, hsa
aacccggcugccugccuuuuuuucugauccagacccucggcaccugcuacuuaccaacuggaaa

SEQ ID NO: 294934 - RNA, 64 nt, hsa
ggaggaucgcuugagcccaggagucugagaccagccucggcaacaugccaagaccccgucucua

SEQ ID NO: 294935 - RNA, 64 nt, hsa
aauuggcacagccauacggcacugaacaaggaagccucggcagauguggcugaaccgagcugga

SEQ ID NO: 294936 - RNA, 64 nt, hsa
gauggcccccaaccccccacccaccccucuccugccucggcagggacugugaucgaggcgugag

SEQ ID NO: 294937 - RNA, 64 nt, hsa
cuuugucuugacccccaagucuucaaccagauauccucggcaacccaccucccacccuccuccu

SEQ ID NO: 294938 - RNA, 64 nt, hsa
ggcugguguccucccuccaggcugaaccccacuuccucggcaggaccccagucucagcagccuc

SEQ ID NO: 294939 - RNA, 64 nt, hsa
uugccggcauagccccgguccucuccaucucucuccucggcagcagcgggaggcagaggaaggc

SEQ ID NO: 294940 - RNA, 64 nt, hsa
gaacccuauguguccauuucugcacacacguauaccucggcauggccgcgucacuucucugauu

SEQ ID NO: 294941 - RNA, 64 nt, hsa
cugccugcuggggaggagggacccacacaagcccccucggcaguuuguccccccagcuucggua

SEQ ID NO: 294942 - RNA, 64 nt, hsa
ggagucccagcagcgagcuggucuggcgagggcaccucggcagcccccacggguuggcuccuac

SEQ ID NO: 294943 - RNA, 64 nt, hsa
acuuccuccgugcaguggcccugccacagcccucccucggcacacuuugacccuuuguaggauu

SEQ ID NO: 294944 - RNA, 64 nt, hsa
agcagacagcgagacccccagcggcagaggccucccucggcacuccaggcuuauaauuucgaac

SEQ ID NO: 294945 - RNA, 64 nt, hsa
caucuuggagaugagggugccuguccuggacagaccucggcaugccuucuguuucuccuucaau

SEQ ID NO: 294946 - RNA, 64 nt, hsa
agugcuggucacaccccugugugauaugugaugcccucggcaaagaaucuacuggaauagauuc

SEQ ID NO: 294947 - RNA, 53 nt, hsa
gcgugacaugaucuucguaacggccucggcacgcuccacaccccuggagucuc

SEQ ID NO: 294948 - RNA, 64 nt, hsa
uccuagaggggacaagccaggcccucucugcaguccucggcagcuccggaaggacacagucagg

SEQ ID NO: 294949 - RNA, 64 nt, hsa
ggagcgagcggggaacgcgacguaccccagugcgccucggcacaccauugcuccccgaaacugg

SEQ ID NO: 294950 - RNA, 64 nt, hsa
uuggcaccaucucaccaccgcauaucccucacccccucggcaagcaccaauccuuggugcugcc

SEQ ID NO: 294951 - RNA, 64 nt, hsa; identical to SEQ ID NO: 213292

SEQ ID NO: 294952 - RNA, 64 nt, hsa; identical to SEQ ID NO: 213293

SEQ ID NO: 294953 - RNA, 64 nt, hsa; identical to SEQ ID NO: 213294

SEQ ID NO: 294954 - RNA, 64 nt, hsa; identical to SEQ ID NO: 213295

SEQ ID NO: 294955 - RNA, 64 nt, hsa
agccccuggcagugguggggaauguugacugaguguucagcagaguuuauuuuuccauacuaua

SEQ ID NO: 294956 - RNA, 64 nt, hsa
ugccuuauguccucugaguuguagaguuguaaaaguucagcagugugugcacagcuuucuuuug

SEQ ID NO: 294957 - RNA, 64 nt, hsa
ucagaauguuagugaauauacuucgcagcucuuuguucagcaauaaggaauauucuuucaauuc

SEQ ID NO: 294958 - RNA, 64 nt, hsa
ccugggacaguuagaaucuuucagguuuaccucuguucagcagauacuucaguaggauacauag

SEQ ID NO: 294959 - RNA, 64 nt, hsa
augagggaauuagacaauggaagucgagcacuggggaaagcaggcauucugcguggggaagagc

SEQ ID NO: 294960 - RNA, 64 nt, hsa
gagguuggaaagagaagagaggcugggagcggauggaaagcaugacugcaucuggagccccugg

SEQ ID NO: 294961 - RNA, 64 nt, hsa
ggaagaacaaccuucucaaccaaaacugcaaucaggaaagcagcagcccacuccuucccaugga

SEQ ID NO: 294962 - RNA, 64 nt, hsa
gaagaagccugagauuugauccuugacaauuucuggaaagcacuggucagucacacuguccugg

SEQ ID NO: 294963 - RNA, 64 nt, hsa
gaggccgccugucuacucaccacugugccuuucuggaaagcaggaguucaagccuuagcaagcc

SEQ ID NO: 294964 - RNA, 64 nt, hsa
ggcugcagagcaaaagaaacagacacuguuggugggaaagcaaacuuguucagccacuauggaa

SEQ ID NO: 294965 - RNA, 64 nt, hsa
uguuggugggaaagcaaacuuguucagccacuauggaaagcaguuuggagauuucuccaagaac

SEQ ID NO: 294966 - RNA, 64 nt, hsa
cauagugggaggagaucagaccuuuacaagugaaggaaagcaacuucagaaaugaauuauuuuc

SEQ ID NO: 294967 - RNA, 64 nt, hsa
uugguuugagaugcauuugaggauuuuaauuuauggaaagcacaacauaugcaauuauauuuau

SEQ ID NO: 294968 - RNA, 64 nt, hsa
gguucaagucccucuuaacaagaacuccaaagcuggaaagcaggagggaacaaaggugaacaug

SEQ ID NO: 294969 - RNA, 64 nt, hsa
cacagcuugcugagggcugcucuucuugggccagggaaagcagggcagccgggaccugcggcug

SEQ ID NO: 294970 - RNA, 64 nt, hsa
agauccaggacugagccagccucaggccagggcgggaaagcaggcuguccaggcugggcuuggu

SEQ ID NO: 294971 - RNA, 64 nt, hsa
cagacuccacacuggggucuuagaggcaccagugggaaagcaggacuggggagagauccaggac

SEQ ID NO: 294972 - RNA, 64 nt, hsa
gucuucccuugguccuucugguccaggccuuggaggaaagcagaggaugaucccugccugugag

SEQ ID NO: 294973 - RNA, 64 nt, hsa
caagccaggcacagugaguggcagagcaagagggggaaagcaggaucagugccuggaaggcagg

SEQ ID NO: 294974 - RNA, 64 nt, hsa
cuggagcugccuucucaucaggugcacucuucauggaaagcaacucuugccccuccuccucugg

SEQ ID NO: 294975 - RNA, 64 nt, hsa
agaggagaggcgcccuaagaauguaagcauugugggaaagcauucauaucugccaagaucguuu

SEQ ID NO: 294976 - RNA, 64 nt, hsa
acgagagagaauccguaugaauguaaggauugugggaaagcauucagcuugcuuaauugcuuuc

SEQ ID NO: 294977 - RNA, 64 nt, hsa
auuggaaagauacucuauaaauguguggaaugugggaaagcauucauuaauuuuauuuuaccug

SEQ ID NO: 294978 - RNA, 64 nt, hsa
acuggagagaagccguaugaauguaaggaaugcaggaaagcauucucuuggcucacuugccuuc

SEQ ID NO: 294979 - RNA, 64 nt, hsa
augggagagaagccauaugaauguaaauaaugugggaaagcauuugguuguuuccaguaccuuu

SEQ ID NO: 294980 - RNA, 64 nt, hsa
agugcagagaaaccccaugaauguaagcaaugugggaaagcauuugaucaucugggaagcuucc

SEQ ID NO: 294981 - RNA, 64 nt, hsa
cauggagauggaccuuauaaauguaaguugugugggaaagcauuuuucuggcccaguuuauuuc

SEQ ID NO: 294982 - RNA, 64 nt, hsa
uuuaaaaugauaauuuuccuucuucaaaugacauggaaagcaaaacuuucuuuuuuaaaaauuu

SEQ ID NO: 294983 - RNA, 64 nt, hsa
uuucugucugauuuuaauugcugucuaaugacggggaaagcacgaugaaaagauguacaauccu

SEQ ID NO: 294984 - RNA, 64 nt, hsa
uguuguucugccuguccuagucuccuuugaagugggaaagcauuuucucucauaggcaagucac

SEQ ID NO: 294985 - RNA, 64 nt, hsa
aguugacucagagugcaagaagucuggccauuuuggaaagcaagguuuccuuucagcccugucu

SEQ ID NO: 294986 - RNA, 64 nt, hsa
aggauggucuuacagcaggcaguauccuguuugaggaaagcaagaaucagagaaggaacauacc

SEQ ID NO: 294987 - RNA, 64 nt, hsa
uccacugugcagguucccacuuaaaaauuaaauuggaaagcagguuucaaggaaguagaaacaa

SEQ ID NO: 294988 - RNA, 64 nt, hsa
aagcagccuccacuuuggaucaggaaauaguaaaggaaagcaguguuggggguagcggcaugca

SEQ ID NO: 294989 - RNA, 64 nt, hsa
uccuugucaguuguaacauucuauuucaacuucaggaaagcagcaguuuucuuuuaauuuuucc

SEQ ID NO: 294990 - RNA, 64 nt, hsa; identical to SEQ ID NO: 113583

SEQ ID NO: 294991 - RNA, 64 nt, hsa; identical to SEQ ID NO: 113584

SEQ ID NO: 294992 - RNA, 64 nt, hsa; identical to SEQ ID NO: 113585

SEQ ID NO: 294993 - RNA, 64 nt, hsa; identical to SEQ ID NO: 113586

SEQ ID NO: 294994 - RNA, 64 nt, hsa; identical to SEQ ID NO: 113587

SEQ ID NO: 294995 - RNA, 64 nt, hsa; identical to SEQ ID NO: 113588

SEQ ID NO: 294996 - RNA, 64 nt, hsa; identical to SEQ ID NO: 113589

SEQ ID NO: 294997 - RNA, 64 nt, hsa; identical to SEQ ID NO: 113590

SEQ ID NO: 294998 - RNA, 64 nt, hsa; identical to SEQ ID NO: 113591

SEQ ID NO: 294999 - RNA, 64 nt, hsa; identical to SEQ ID NO: 113592

SEQ ID NO: 295000 - RNA, 64 nt, hsa; identical to SEQ ID NO: 113593

SEQ ID NO: 295001 - RNA, 64 nt, hsa; identical to SEQ ID NO: 113594

SEQ ID NO: 295002 - RNA, 64 nt, hsa; identical to SEQ ID NO: 113595

SEQ ID NO: 295003 - RNA, 64 nt, hsa; identical to SEQ ID NO: 113596

SEQ ID NO: 295004 - RNA, 64 nt, hsa; identical to SEQ ID NO: 113597

SEQ ID NO: 295005 - RNA, 64 nt, hsa; identical to SEQ ID NO: 113598

SEQ ID NO: 295006 - RNA, 64 nt, hsa; identical to SEQ ID NO: 113599

SEQ ID NO: 295007 - RNA, 64 nt, hsa; identical to SEQ ID NO: 113600

SEQ ID NO: 295008 - RNA, 64 nt, hsa; identical to SEQ ID NO: 113601

SEQ ID NO: 295009 - RNA, 64 nt, hsa; identical to SEQ ID NO: 113602

SEQ ID NO: 295010 - RNA, 64 nt, hsa; identical to SEQ ID NO: 113603

SEQ ID NO: 295011 - RNA, 64 nt, hsa; identical to SEQ ID NO: 113604

SEQ ID NO: 295012 - RNA, 64 nt, hsa; identical to SEQ ID NO: 113605

SEQ ID NO: 295013 - RNA, 64 nt, hsa; identical to SEQ ID NO: 113606

SEQ ID NO: 295014 - RNA, 64 nt, hsa; identical to SEQ ID NO: 113607

SEQ ID NO: 295015 - RNA, 64 nt, hsa; identical to SEQ ID NO: 113608

SEQ ID NO: 295016 - RNA, 64 nt, hsa; identical to SEQ ID NO: 113609

SEQ ID NO: 295017 - RNA, 64 nt, hsa; identical to SEQ ID NO: 113610

SEQ ID NO: 295018 - RNA, 64 nt, hsa; identical to SEQ ID NO: 113611

SEQ ID NO: 295019 - RNA, 64 nt, hsa; identical to SEQ ID NO: 113612

SEQ ID NO: 295020 - RNA, 64 nt, hsa; identical to SEQ ID NO: 113613

SEQ ID NO: 295021 - RNA, 64 nt, hsa; identical to SEQ ID NO: 113614

SEQ ID NO: 295022 - RNA, 64 nt, hsa; identical to SEQ ID NO: 113615

SEQ ID NO: 295023 - RNA, 64 nt, hsa; identical to SEQ ID NO: 113616

SEQ ID NO: 295024 - RNA, 64 nt, hsa; identical to SEQ ID NO: 113617

SEQ ID NO: 295025 - RNA, 64 nt, hsa; identical to SEQ ID NO: 113618

SEQ ID NO: 295026 - RNA, 64 nt, hsa; identical to SEQ ID NO: 113619

SEQ ID NO: 295027 - RNA, 64 nt, hsa; identical to SEQ ID NO: 113620

SEQ ID NO: 295028 - RNA, 64 nt, hsa; identical to SEQ ID NO: 113621

SEQ ID NO: 295029 - RNA, 64 nt, hsa; identical to SEQ ID NO: 113622

SEQ ID NO: 295030 - RNA, 64 nt, hsa; identical to SEQ ID NO: 113623

SEQ ID NO: 295031 - RNA, 64 nt, hsa; identical to SEQ ID NO: 113624

SEQ ID NO: 295032 - RNA, 64 nt, hsa; identical to SEQ ID NO: 113625

SEQ ID NO: 295033 - RNA, 64 nt, hsa; identical to SEQ ID NO: 113626

SEQ ID NO: 295034 - RNA, 64 nt, hsa; identical to SEQ ID NO: 113627

SEQ ID NO: 295035 - RNA, 64 nt, hsa; identical to SEQ ID NO: 113628

SEQ ID NO: 295036 - RNA, 64 nt, hsa; identical to SEQ ID NO: 113629

SEQ ID NO: 295037 - RNA, 64 nt, hsa; identical to SEQ ID NO: 113630

SEQ ID NO: 295038 - RNA, 64 nt, hsa; identical to SEQ ID NO: 113631

SEQ ID NO: 295039 - RNA, 64 nt, hsa; identical to SEQ ID NO: 113632

SEQ ID NO: 295040 - RNA, 64 nt, hsa; identical to SEQ ID NO: 113633

SEQ ID NO: 295041 - RNA, 64 nt, hsa; identical to SEQ ID NO: 113634

SEQ ID NO: 295042 - RNA, 64 nt, hsa; identical to SEQ ID NO: 113635

SEQ ID NO: 295043 - RNA, 64 nt, hsa; identical to SEQ ID NO: 113636

SEQ ID NO: 295044 - RNA, 64 nt, hsa; identical to SEQ ID NO: 113637

SEQ ID NO: 295045 - RNA, 64 nt, hsa; identical to SEQ ID NO: 113638

SEQ ID NO: 295046 - RNA, 64 nt, hsa
uaugucuccacugccaaguagaagugacucaaaacccucugacaaggauauucccuuggcuaug

SEQ ID NO: 295047 - RNA, 64 nt, hsa
ccgcucacugccaccuguggacacucugugucuacccucugagugggaacauacuucuaaguuc

SEQ ID NO: 295048 - RNA, 64 nt, hsa
uugcccucuuugagcuauuuggcuacuucccugucccucugacuccuacugucccaauuuucuc

SEQ ID NO: 295049 - RNA, 64 nt, hsa
cuccccccaacgcaaggaggaugcccaauuguugcccucugaaaaugcacaguucuccuggccc

SEQ ID NO: 295050 - RNA, 64 nt, hsa
uuuuuuuuuuuuugaaauuugccgagcaguggagcccucugacaauuugcaaggcccucugaga

SEQ ID NO: 295051 - RNA, 64 nt, hsa
gccgagcaguggagcccucugacaauuugcaaggcccucugagaaaggaagcugcuuagagcca

SEQ ID NO: 295052 - RNA, 64 nt, hsa
augcuccuguucuggugauaccaaaccugcccaccccucugagucgucuuugcucauggacuug

SEQ ID NO: 295053 - RNA, 64 nt, hsa
cagucccagaggacacaucccucgggaacucugccccucugacaaugagggccacagagaaggu

SEQ ID NO: 295054 - RNA, 64 nt, hsa
guaggcagagccuuuggaugaccagaacaagguucccucugagaauuccaaggaguuccaugaa

SEQ ID NO: 295055 - RNA, 64 nt, hsa
acugcgaucuucagagcagggguccuuggugugacccucugaaugguccaggguugaucacacu

SEQ ID NO: 295056 - RNA, 64 nt, hsa
gggccuuagucucccaaauccaccaugcaucugccccucugagggugucuucacuuugucucug

SEQ ID NO: 295057 - RNA, 64 nt, hsa
uagagcagcugauaaguuucccuaccugauggcccccucugacauaaacugcacaccuggggug

SEQ ID NO: 295058 - RNA, 64 nt, hsa
agccccgugcccugacccggggaccacagggacacccucugagacgugcuggccccaggaggau

SEQ ID NO: 295059 - RNA, 64 nt, hsa
uaucugcugacgggaacaagucauucugaaaggucccucugacccaggucaccaaauuugggcc

SEQ ID NO: 295060 - RNA, 64 nt, hsa
gguggugagggaaggguacgaguacauuccuuuucccucugaccugggcgcuagcaagggcaaa

SEQ ID NO: 295061 - RNA, 64 nt, hsa
uagggagcuguguuguuucccacccaccacccuucccucugaacaaaugccugagugcuggggc

SEQ ID NO: 295062 - RNA, 64 nt, hsa
uugcuauucuauuggaguagccucccuaggcagucccucugaagccuuggagugcagguaaaug

SEQ ID NO: 295063 - RNA, 64 nt, hsa
guccaagaccugggucaguucuuugcuggugguccccucugaccacaagcuucugccugaagau

SEQ ID NO: 295064 - RNA, 64 nt, hsa
auagcuuuuuaaauaucuuuuuccuucuacuccucccucugacucuaagaauucucucuucugg

SEQ ID NO: 295065 - RNA, 64 nt, hsa
aacucaacuucuuuccucuggagacggggcaucucccucugauuuccuucugcuaugacaaaac

SEQ ID NO: 295066 - RNA, 64 nt, hsa
ucugcucaucucuuccgugagauuugcucccagacccucugaucucccuccaacaaacccuggc

SEQ ID NO: 295067 - RNA, 64 nt, hsa
aguggccuuguuaauuccaaguggcauguaucuucccucugagcuucauuucuucaagaugcuc

SEQ ID NO: 295068 - RNA, 64 nt, hsa
ucuugaagagguacccaucauaaugacagcaucucccucugaaggguuuuggucaaaaugggug

SEQ ID NO: 295069 - RNA, 64 nt, hsa
ugcuggaccuccucucagcacagccagcuccgugcccucugaauuauguuucgcagaaaagugu

SEQ ID NO: 295070 - RNA, 64 nt, hsa
ccucugaccccaacuucucuuugaucucugaauccccucugacuccaacuucucuuucacccuc

SEQ ID NO: 295071 - RNA, 64 nt, hsa
uagaccuauaaguucugguuuauguuugaccccucccucugagcugcacuucaccgcugaccuu

SEQ ID NO: 295072 - RNA, 64 nt, hsa
agugugcuggcauuucucacccuuucaucuuuagcccucugaguacuuugaagcacuuuugcau

SEQ ID NO: 295073 - RNA, 64 nt, hsa
cuuugagggaaacuguggaaggcaccuucaggcccccucugacuuguuguucuuggcacauguu

SEQ ID NO: 295074 - RNA, 64 nt, hsa
gguagguuuggaggucugccaguuacaccaaguccccucugagauucgaucaggggacuggaua

SEQ ID NO: 295075 - RNA, 64 nt, hsa
uagacaccagcccccugcauccuucaguagaccucccucugaacaccacagccagguccugccu

SEQ ID NO: 295076 - RNA, 64 nt, hsa
agaccgcaugaagauacuuguaagcacacaugaucccucugaauuguuuuacuuuccuguaacu

SEQ ID NO: 295077 - RNA, 64 nt, hsa
cuuggccgaagcauagauuguaaccccuccacuccccucugagauuggccuucggugaggaauu

SEQ ID NO: 295078 - RNA, 64 nt, hsa
aaagaguguggcugcuggacucuuuucgaaaugccccucugagucaggagccugguggggacaa

SEQ ID NO: 295079 - RNA, 64 nt, hsa
agggcgggaggcaugcaagccagugggggaaaaccccucugaagcugggcagcccucuaccugg

SEQ ID NO: 295080 - RNA, 64 nt, hsa
agcuccaguuugacauuauucaugcaccacgauacccucugauuauuggaauccauuggcuuga

SEQ ID NO: 295081 - RNA, 64 nt, hsa
uucgagagaagcugcccauccgcaguaauaucuucccucugaugcuggaaacugucgacggcca

SEQ ID NO: 295082 - RNA, 64 nt, hsa
uuuccucauuucauugccucucauacaguuuucucccucugauuuauuucauuuugguagugga

SEQ ID NO: 295083 - RNA, 64 nt, hsa
accucaugcaaaauauugguguggcugcaaauuucccucugaagcugacacaauuaaggaugaa

SEQ ID NO: 295084 - RNA, 64 nt, hsa
cuuugcuauugauguagugugauagaaaauucaccccucugaacuggcuccuucccagucaagg

SEQ ID NO: 295085 - RNA, 64 nt, hsa
aucccauucauguuagaucguugaaacccuguaucccucugaaacacuggaagagcuaguaaau

SEQ ID NO: 295086 - RNA, 64 nt, hsa
gugaaaaaugucccuuuuauuuuggcuuugguugugauuucagagcauaaugcuauguuuuuuu

SEQ ID NO: 295087 - RNA, 64 nt, hsa
cuuguacauuauacugauuaagucaggauuaauuugauuucaaagcugagaacagugguaaaaa

SEQ ID NO: 295088 - RNA, 64 nt, hsa
ucucaagucugguaaucuucuaugucagagcuagugauuucaaaagguuucacaauuccccaag

SEQ ID NO: 295089 - RNA, 64 nt, hsa
uuucaccauguuggccaggcuggucucaaacuccugauuucaagcgauccacccaccucgacuu

SEQ ID NO: 295090 - RNA, 64 nt, hsa
aauagcagacaguguuuucugggauaaguaaguuugauuucauuaauacagggcauuuuggucc

SEQ ID NO: 295091 - RNA, 64 nt, hsa
aguugaaacaagaagccacagaccuaggauuucaugauuucauuucaacuguuugccuucuacu

SEQ ID NO: 295092 - RNA, 64 nt, hsa
cugguuaaauaaaaaauuagagaucacucuuggcugauuucagcaccaggaacuguauuacagu

SEQ ID NO: 295093 - RNA, 64 nt, hsa
aaacaccaauacaacuaauccuauuugguuuuaaugauuucaccaugggauuaagaacuauauc

SEQ ID NO: 295094 - RNA, 64 nt, hsa
guuaaguauuugcuacuuuaaauuguuuuacaacugauuucagcacauucuauccuuuuuuuuu

SEQ ID NO: 295095 - RNA, 64 nt, hsa
aaaacaaauaauuucccuuggguuggaggggaagugauuucauaaauuaauuagaaagccaucu

SEQ ID NO: 295096 - RNA, 64 nt, hsa
gaggggugaggaauggauacugucuaacagucucugauuucaacacuaacauuccaucuucuga

SEQ ID NO: 295097 - RNA, 64 nt, hsa
ccaauuucugugguguaaauacucccaccaugguugauuucaagccaccagugguuuaauaacc

SEQ ID NO: 295098 - RNA, 64 nt, hsa
agaauguguuuguguagaugccaagcauuuucugugauuucagguuuuuuccuuuuuuuacauu

SEQ ID NO: 295099 - RNA, 64 nt, hsa
auuaauucuaaccaguuguuugcuuuuaaaugagugauuucauuuugggaaacagguuucaaau

SEQ ID NO: 295100 - RNA, 64 nt, hsa
auucccaacgccaggacccacaucccuuugguauugauuucacagucagcugcucaacggaaug

SEQ ID NO: 295101 - RNA, 64 nt, hsa
cucugaagacccaaagaugacauuacuaaugaugugauuucaggagccacagaagaaccuuacc

SEQ ID NO: 295102 - RNA, 64 nt, hsa
uuuagaaaaguuagcacaugcuuuugaaaaucugugauuucauuuuauuaggcuaaaaggguaa

SEQ ID NO: 295103 - RNA, 64 nt, hsa
cauugaacagcuuugauuaacuuaaugccaccauugauuucaaagugaagaaaauguaacagaa

SEQ ID NO: 295104 - RNA, 64 nt, hsa
auagaacuguuacaaugguagcagaaaauccuauugauuucaucucacccauuucagauaccuu

SEQ ID NO: 295105 - RNA, 64 nt, hsa
agcaccaccuucucuuuuugcccauauugcacuuugauuucaaacuaugcacugugaagagauu

SEQ ID NO: 295106 - RNA, 64 nt, hsa
uauacaaccccacuguauuauuuucuuuagauucugauuucaggaucugugcuuugauuccuug

SEQ ID NO: 295107 - RNA, 64 nt, hsa
cugguugaauaaggguacucuaguuuuauguagaugauuucagaaugugaaggcugguuugccu

SEQ ID NO: 295108 - RNA, 64 nt, hsa
aggcuaagcccuggcuccaugcaacugcauucuuugauuucacuuguuccuucaucuacauguu

SEQ ID NO: 295109 - RNA, 64 nt, hsa
auaagaggucuuagaagaaaauaaccaguuaaccugauuucaauuuugauaccguuuuccugaa

SEQ ID NO: 295110 - RNA, 64 nt, hsa
gaacaggucuuuguggagaucuaaaggcagugauugauuucacagggagcucuaaucucuguga

SEQ ID NO: 295111 - RNA, 64 nt, hsa
aggcacuguccugggaugaugagagauuauaaggugauuucauaaaaggaauccaacccugugc

SEQ ID NO: 295112 - RNA, 64 nt, hsa
agcuaaaauggguuauuuauaggacugauggaaaugauuucaucucugccaucucuaaagcacu

SEQ ID NO: 295113 - RNA, 64 nt, hsa
agcccaauguggguccaucucaucagcccuuugcugauuucaugauuucucacccucccuccca

SEQ ID NO: 295114 - RNA, 64 nt, hsa
auuaacacaguaucauguuuaacaaguauagccuugauuucaguagauguaauggaagccaaau

SEQ ID NO: 295115 - RNA, 64 nt, hsa
uuuguuugcaaauuggucaacaaaauuugcaaagugauuucaggagagagcagcuuugaggaau

SEQ ID NO: 295116 - RNA, 64 nt, hsa
aaagacucacuuuaccaagcauauaaaggaaaaaugauuucaaacauugacaagauagaugagu

SEQ ID NO: 295117 - RNA, 64 nt, hsa
caccuguaaguuauuuauuagcccuaauuguguuugauuucagacaaaauuaacccuuuucucc

SEQ ID NO: 295118 - RNA, 64 nt, hsa
aauaugaugugagcuaguuaagccuuugcuugacugauuucagugauauucagaaguguguacc

SEQ ID NO: 295119 - RNA, 64 nt, hsa
uaagaauaguugaagacuaguugaagaccuuuugugauuucauuaucaugccuaugcagaagaa

SEQ ID NO: 295120 - RNA, 64 nt, hsa
uuuuuuuucaauugacaagacuuuaagucagggauaacaguauuaauguucucuguucuguuuc

SEQ ID NO: 295121 - RNA, 64 nt, hsa
agggaucuucaaaguuauuuugucuugauguauguaacaguaauucuuuacaucuuuugauuuu

SEQ ID NO: 295122 - RNA, 64 nt, hsa
aguuuaaagaaaggacaucaucauagauaugaucuaacaguauuucuaacuauauuugaucauu

SEQ ID NO: 295123 - RNA, 64 nt, hsa
ugcgucuguuugcugaucuucagcgugggaauaauaacaguaccuacuugaaaggaucauugug

SEQ ID NO: 295124 - RNA, 64 nt, hsa
ucagugcauuaucuacuuguguaguccuaugcaauaacaguaguguuacauguaucaagccuag

SEQ ID NO: 295125 - RNA, 64 nt, hsa
uuugaaaaaugcacugggaaaaaguugaugucaauaacaguauaaaacagcccuauuucuugau

SEQ ID NO: 295126 - RNA, 64 nt, hsa
augaaugagaagaaaugauucauaaauuuugaacuaacaguaauaacuucuugaaaauccaaua

SEQ ID NO: 295127 - RNA, 64 nt, hsa
guucuugaaaaaaaauuuuuugauaugacuacucuaacaguaauaacuauaaaucucacuuuaa

SEQ ID NO: 295128 - RNA, 64 nt, hsa
uguucaggaaaucuuguaguuuauuguuguuauuuaacaguauuaaguggauuuuuguauauuu

SEQ ID NO: 295129 - RNA, 64 nt, hsa
cucuuugaacaucauaaacacacuuugguguugguaacaguauuuuaagcauuuuuguucacuu

SEQ ID NO: 295130 - RNA, 64 nt, hsa
cucagggugcccacaacucacucaccaagauguuuaacaguaaguaacaguaaauguaaaagau

SEQ ID NO: 295131 - RNA, 64 nt, hsa
ccacaacucacucaccaagauguuuaacaguaaguaacaguaaauguaaaagauucauuuuggg

SEQ ID NO: 295132 - RNA, 64 nt, hsa
aaauuaacaaauucaguggacauuuguucuggguuaacaguaaauauacacuuuacauucuugc

SEQ ID NO: 295133 - RNA, 64 nt, hsa
cuaugcugugugcagaguauacaaguguuucuaguaacaguauuuccauacgugcccauuucac

SEQ ID NO: 295134 - RNA, 64 nt, hsa
aucaugguuccuuuggugaucuauaagggaucuauuuaagaaguggucagguuuucgcacuucu

SEQ ID NO: 295135 - RNA, 64 nt, hsa
guuaugaauggcauccagggauauuuggguuacuuuuaagaaagcagugugauguaguggagag

SEQ ID NO: 295136 - RNA, 64 nt, hsa
uuaaaugaagagcuauuuauauauauuauuuuuuuuuaagaaaggaggaaaagaaaccaaaagu

SEQ ID NO: 295137 - RNA, 64 nt, hsa
uuuaagaaaggaggaaaagaaaccaaaaguuuuuuuuaagaaaaaaaauccuucaagggagcug

SEQ ID NO: 295138 - RNA, 64 nt, hsa
ugaaaaauacaagagugacucuauaacucuggucuuuaagaaagcugccuuuucauuuuuagac

SEQ ID NO: 295139 - RNA, 64 nt, hsa
gcugcaauguuuuaaaaaaaauaagucaucagauuuuaagaaaaaagugaugauuucuuauuga

SEQ ID NO: 295140 - RNA, 64 nt, hsa
ccaaggaauuauucuuuucucaccaaucaacacuuuuaagaaauauauauauauauauacacac

SEQ ID NO: 295141 - RNA, 64 nt, hsa
aauacugaguaagauauaagaccuaccaggaaccuuuaagaauaugcucugcucaguguuguuu

SEQ ID NO: 295142 - RNA, 64 nt, hsa
ggcgugagccacugcgcccagcuauacuguauauuuuaagaaguuccagcauguugcaucucug

SEQ ID NO: 295143 - RNA, 64 nt, hsa
uguucaaauagagcuguucaacaucacugaaaccuuuaagaaaagcccugagaucaguuauucc

SEQ ID NO: 295144 - RNA, 64 nt, hsa
ggcaagacgacaaaaguaccuuugaauaaaacaauuuaagaaauugguuuaagauauuggauga

SEQ ID NO: 295145 - RNA, 64 nt, hsa
uuuacagauguauuaggaccauugaugcauuacauuuaagaauucucuuuaauacaucugggca

SEQ ID NO: 295146 - RNA, 64 nt, hsa
cucuccacauugaucuuuucauuucuuacuagcuuuuaagaaauuaaauacuugccugagauag

SEQ ID NO: 295147 - RNA, 64 nt, hsa
uuucacaauuaaaaaacuaaaauauguacccauuuuuaagaaaucauacuucucuccacauuga

SEQ ID NO: 295148 - RNA, 64 nt, hsa
guuaaugaaacaaauagcuguugacguuugcucauuuaagaauuugaaacguuaugaugaccug

SEQ ID NO: 295149 - RNA, 64 nt, hsa
gcuguugcugcuacugucuuacuauuauagcaacuuuaagaaguaauuuuccaaccuuuggaag

SEQ ID NO: 295150 - RNA, 64 nt, hsa
gaauauuuaugccuuaauauaucuauggcagacauuuaagaaugcgcuuuaucuagcucauggu

SEQ ID NO: 295151 - RNA, 64 nt, hsa
uucuguugggagcucuccaaagaaacugguugguuuuaagaaaauaguuucaagaaguucaacu

SEQ ID NO: 295152 - RNA, 64 nt, hsa
ugugacgauauguggacaaagaagaagaugcagguuuaagaaguuaauauuuauaaaaugugaa

SEQ ID NO: 295153 - RNA, 64 nt, hsa
ucccuuuucuaaaaaugcaaugcacuaaaacuauuuuaagaauguaguuaauucugcuuauuca

SEQ ID NO: 295154 - RNA, 64 nt, hsa
guaaguauuuuuauuaccaauaaauuuaaaauuuuuuaagaaaaauauuuuuauccuagggcca

SEQ ID NO: 295155 - RNA, 64 nt, hsa
uuugaaauguaaaauuuuuaugaucugauucaguuuuaagaaaacaugaaugaacuagaagaua

SEQ ID NO: 295156 - RNA, 64 nt, hsa
uguguguguaucaaaaguggucucaaaauauuuuuuuaagaaaaaaagcaaaaacaauguauug

SEQ ID NO: 295157 - RNA, 64 nt, hsa
uuuucuauguagguucauguuccauguucauuuauuuaagaaauacauuuuuauugguaagcuu

SEQ ID NO: 295158 - RNA, 64 nt, hsa
aauuuguguguuuucgauuuaagcuaaaagauaauuuaagaacauuuauuuccccuuuucacuu

SEQ ID NO: 295159 - RNA, 64 nt, hsa
aucauuuugccucauguuggaggacuuuauggaauuuaagaaauacauuuugugugcauauugu

SEQ ID NO: 295160 - RNA, 64 nt, hsa
uuauuuguuugauacuaggauucaugcuaaacuuuuuaagaauguauuggauaucaagaagcau

SEQ ID NO: 295161 - RNA, 64 nt, hsa
ccaacuacaaccugcaauuuaagauuacuauuacuuuaagaaaaucaauuucauaguauugguu

SEQ ID NO: 295162 - RNA, 64 nt, hsa
aaagguaugaggaauguuuuaauaccuccaaauuuuuaagaaaagcaucaaaggguugauauuu

SEQ ID NO: 295163 - RNA, 64 nt, hsa
cacaugcacacacccauaaacacacacacagugcuuuaagaaagggccaggugauaucacaccc

SEQ ID NO: 295164 - RNA, 64 nt, hsa
aaaugcuagcugcucaagaguuuucaguagaauauuuaagaacuaauuuucugcagcuuuuagu

SEQ ID NO: 295165 - RNA, 64 nt, hsa
caaaaagaugagauacuacacucauuuaaauauuuuuaagaaaauaaaaagcuuaagaaauuua

SEQ ID NO: 295166 - RNA, 64 nt, hsa
gggugaauguggccaugccuaccuguuuuguuuuuuuaagaacagaaacaacuauuuuaaaaga

SEQ ID NO: 295167 - RNA, 64 nt, hsa
uuaagaacagaaacaacuauuuuaaaagaacucuuuuaagaaauuucauaaagggacaugcauu

SEQ ID NO: 295168 - RNA, 64 nt, hsa
ugauucaaagcaaaacaaacaaacaaaaacaaauuuuaagaacacaacaaaaaagauuugacuu

SEQ ID NO: 295169 - RNA, 64 nt, hsa
agauuaauuuuuauaaaugaaaauauuuuaaugguuuaagaaaaugaggacaacaggauaauau

SEQ ID NO: 295170 - RNA, 64 nt, hsa
cuagccuugcuuguuaaauuuuuuuuuuuuuuuuuuuaagaauaucuguaaugguacugacuuu

SEQ ID NO: 295171 - RNA, 64 nt, hsa
guuauagugaauacugcuacagcaauuucuaauuuuuaagaauugaguaaugguguagaacacu

SEQ ID NO: 295172 - RNA, 64 nt, hsa
cacaaguaacaggauuagggaaggacauaauguauuuaagaauaagugaagguuagagguuuac

SEQ ID NO: 295173 - RNA, 64 nt, hsa
gauuuaaaaaaaucccauuuacaagcauugcaccuuuaagaagaaaacaaauaugacaguaugg

SEQ ID NO: 295174 - RNA, 64 nt, hsa
cugaagucaugucaaguacugucuggaggguuuuuuuaagaaaaggcauuuggcauuuaacugu

SEQ ID NO: 295175 - RNA, 64 nt, hsa
uuaggaacacugcuauuuuuuucuuaaaaauguuuuuaagaauauguucguuucuuugacuauu

SEQ ID NO: 295176 - RNA, 64 nt, hsa
agaacuuggguuaaaaauguuuaagaagcuaauguuuaagaagcauuugggaaagaaaaagaaa

SEQ ID NO: 295177 - RNA, 64 nt, hsa
cgcaguggaccuauuagaacuuggguuaaaaauguuuaagaagcuaauguuuaagaagcauuug

SEQ ID NO: 295178 - RNA, 64 nt, hsa
uuucuuuauucaagauaccugaacuggggugcuuuuuaagaaaaauuugggaaauauauauguu

SEQ ID NO: 295179 - RNA, 64 nt, hsa
auucugaugcacaguaaaauccgagaaacacugguuuaagaaaaaccuuguaaugaucgaauac

SEQ ID NO: 295180 - RNA, 64 nt, hsa
augcugcacauguauuuuauuuaguuauccuugcuuuaagaauauuggaugacauuuccugaca

SEQ ID NO: 295181 - RNA, 64 nt, hsa
aaaagagauauuuuuagauuguaugccacuuuuguuuaagaacugugcugugaucacuguauua

SEQ ID NO: 295182 - RNA, 64 nt, hsa
aaaaaguccacacuugaagccuaaauuugugcuuuuuaagaauauuuuuagacuauuucuuuuu

SEQ ID NO: 295183 - RNA, 64 nt, hsa
uucauaaaaacaagucauuuuuguauuuuucaucuuuaagaaugcuuaaaaaagcuaaucccua

SEQ ID NO: 295184 - RNA, 64 nt, hsa
agaucugugggcuuuuaaaauuguucacagccaauuuaagaagaccccucaugaagucucaguu

SEQ ID NO: 295185 - RNA, 64 nt, hsa
auuaguuaagauauggucacuugaauuuuuuguauuuaagaauuuucuguuuuaaugcauguua

SEQ ID NO: 295186 - RNA, 64 nt, hsa
uggcauaguucaugagcuuaauacauagcuuucuuuuaagaaaggagccuuuuuuuucaacuag

SEQ ID NO: 295187 - RNA, 64 nt, hsa
uuuauccaacaauuauguucauuuuaagcaaaauuuuaagaaaguuuugaaauucauaaagcau

SEQ ID NO: 295188 - RNA, 64 nt, hsa
uuugaaauucauaaagcauuugguuuuaaacuauuuuaagaauauaguacucggucagguauga

SEQ ID NO: 295189 - RNA, 64 nt, hsa
gcagauacucuuccugccagugguaauacgauuuuuuaagaaggcaguuugucaauuuuaaucu

SEQ ID NO: 295190 - RNA, 64 nt, hsa
gaaaaaaagguagugaauuuuuaaucaucuggacuuuaagaaggauucuggaguauacuuaggc

SEQ ID NO: 295191 - RNA, 64 nt, hsa
ugccucacucacagaguuacaaauuaaauaaggauuuaagaauuaugaggaaagcugucuuaug

SEQ ID NO: 295192 - RNA, 64 nt, hsa
gacuuauuaauguggucacuuaagggguaaggaauuuaagaacuggaugagguuauuucuuccu

SEQ ID NO: 295193 - RNA, 64 nt, hsa
aauugggaaacggggaaauucuuggaauuuuuuuuuuaagaaacuuuuuuguguuuuuuuuaau

SEQ ID NO: 295194 - RNA, 64 nt, hsa
uuaccuuuuaucgguaguaagcuuggaaaaauaauuuaagaauacaauggagaaauguaaauaa

SEQ ID NO: 295195 - RNA, 64 nt, hsa
agaguaaaacuuacaggauaagcauuuugcucuuuuuaagaacagcaugaaauuuagaauacca

SEQ ID NO: 295196 - RNA, 64 nt, hsa
cagcaugaaauuuagaauaccaaugauagcuaucuuuaagaaucagaauuaguacuagaaauuu

SEQ ID NO: 295197 - RNA, 64 nt, hsa
auaauaaaaagacuauuaagagcaauaaauuauuuuuaagaaaucgagauuuaguaaauccuau

SEQ ID NO: 295198 - RNA, 64 nt, hsa
ugaugucugggcaucagccuuuguacucuguuuuuuuaagaaagugcagaaucaacuugaagca

SEQ ID NO: 295199 - RNA, 64 nt, hsa
uguuaauuuaagaaauagacuuacuuaagacuauuuuaagaaauagagaugucauagccugaag

SEQ ID NO: 295200 - RNA, 64 nt, hsa
acuuacuggcuuuaacaauaauuuuuguuguuaauuuaagaaauagacuuacuuaagacuauuu

SEQ ID NO: 295201 - RNA, 64 nt, hsa
uacauaauaaacccuuucaucuuuuuuuuuuuccuuuaagaauuaaaacugggaaauagaaaca

SEQ ID NO: 295202 - RNA, 64 nt, hsa
uuucguauaauagauacguucuuuggauuaugauuuuaagaaauuauuaauuuaugaaaugaua

SEQ ID NO: 295203 - RNA, 64 nt, hsa
aauuaauuuaaguacuaaaaagacaaggauuucuuuuaagaaauuuauagcauuuacuguguua

SEQ ID NO: 295204 - RNA, 64 nt, hsa
uucaagaaaaagaaauuauguuaaauagcccuguuuuaagaaaaauauuuaugaagcaucucaa

SEQ ID NO: 295205 - RNA, 64 nt, hsa
ucuuauugaugacuuuuuaaugcagaguaaguuguuuaagaaaggccugaauauaucagaacau

SEQ ID NO: 295206 - RNA, 64 nt, hsa
gcuauucauucugccauuuuuaacuugagacacauuuaagaauaaaguuggauguucuuuuucu

SEQ ID NO: 295207 - RNA, 64 nt, hsa
aagaauuugaaaguuuccuuauuuucauaauucauuuaagaacaagagaccccugucuggcagu

SEQ ID NO: 295208 - RNA, 64 nt, hsa
guuaaaugcuauggaaauacauuuagaaccugcauuuaagaacagaacagcaaguaugaaccac

SEQ ID NO: 295209 - RNA, 64 nt, hsa
uuuucccauugcaacagagcuauauuuuuucuauuuuaagaaucauauuuuaggauuauuuuug

SEQ ID NO: 295210 - RNA, 64 nt, hsa
aauauuguaucauuuauauuugccuuauguuaacuuuaagaaauugauuuuuuuguauuaauca

SEQ ID NO: 295211 - RNA, 64 nt, hsa
caaaguggguaucugacaaguggaaaaucaaacguuuaagaagaauuacaacucugaaaagcau

SEQ ID NO: 295212 - RNA, 64 nt, hsa
uacagagaaaaguuaaacagccaacuaggcaguuuuuaagaauauuaacaauauauuaacaaac

SEQ ID NO: 295213 - RNA, 64 nt, hsa
uauuuggugcugaauauguccuuguaggcucuguuuuaagaaaacaauaugugggaaaugauuu

SEQ ID NO: 295214 - RNA, 64 nt, hsa
cauacaaaacaaauaggcuuuuccauaaguggccuuuaagaaaacauggaagacaauucauguu

SEQ ID NO: 295215 - RNA, 64 nt, hsa
gagacugucaagauuguauaccuucuugguuucuuuuaagaauuuguugccuuucuacuauuac

SEQ ID NO: 295216 - RNA, 64 nt, hsa
aaaccaagauuagaaacauuagaaauuugcagaauuuaagaaauuauguuuugugguaaucuau

SEQ ID NO: 295217 - RNA, 64 nt, hsa
agacuguuuuacaccuggaaaauuuaccucgauuuuuaagaacacacauugccauggcaggauu

SEQ ID NO: 295218 - RNA, 64 nt, hsa
ggaauuggaacuuauuuuaaauuguuggaguucuuuuaagaagaauauaaauugauuauuuuuu

SEQ ID NO: 295219 - RNA, 64 nt, hsa
uauuuaauaagaguccuagauagccagcggagacuuuaagaaucauugccucuagcugggugug

SEQ ID NO: 295220 - RNA, 54 nt, hsa
gccacagcacaaaguuuuaaugucuuuaagaaaaagaaaucaaucugcagaaau

SEQ ID NO: 295221 - RNA, 64 nt, hsa
ugauguuccaucauucuggaccucccaggaguuguuuaagaaugaaucucuuacaccucuacuu

SEQ ID NO: 295222 - RNA, 64 nt, hsa
ggggacaauuuuauguaucuguguuaaggauauguuuaagaacauaauucuuuuguugcuguuu

SEQ ID NO: 295223 - RNA, 64 nt, hsa
auguuuaagaacauaauucuuuuguugcuguuuguuuaagaagcaccuuaguuuguuuaagaag

SEQ ID NO: 295224 - RNA, 64 nt, hsa
uuguugcuguuuguuuaagaagcaccuuaguuuguuuaagaagcaccuuauauaguauaauaua

SEQ ID NO: 295225 - RNA, 64 nt, hsa
uguguuuacugcuggauuuuugaagguuuuuuuuuuuaagaaagugccauuucauuauuugauu

SEQ ID NO: 295226 - RNA, 64 nt, hsa
uaauaaaacuacuaaccagaggagucuaugccauuuuaagaaaaacaauuaaccugguuaaaga

SEQ ID NO: 295227 - RNA, 64 nt, hsa
ugucuuauagacuuuuuaaaauguacauaaagaauuuaagaaagaauauauuugucaaauaaaa

SEQ ID NO: 295228 - RNA, 64 nt, hsa
gauguccuggguccuuccaacagugaagagaagauuuaagaagcaccuauagacuugaacuccu

SEQ ID NO: 295229 - RNA, 64 nt, hsa
cugacuuuaauauugauuauauuuuuaacaggaauuuaagaaaauauuacuggaauuaaaaaua

SEQ ID NO: 295230 - RNA, 64 nt, hsa
uuuuaaaguguauuuuucguauucuggaagauguuuuaagaagcauuuuaaaugucaguuacaa

SEQ ID NO: 295231 - RNA, 64 nt, hsa
uaucauguggaauauccucauauuuuuaccauauuuuaagaacuuuaagacgauuaauuguaaa

SEQ ID NO: 295232 - RNA, 64 nt, hsa
uucugaguuuuuucaaggaauguaauacuggagcuuuaagaacauacuuaguuucucaugugaa

SEQ ID NO: 295233 - RNA, 64 nt, hsa
aaauauuuuugagaaaaguagcugaguauacugguuuaagaaaaugcuuguuuuagauugaggu

SEQ ID NO: 295234 - RNA, 64 nt, hsa
cuauuuucaaagcagaaaaauugacauugcugccuuuaagaauaccaugaauguaagaaauuga

SEQ ID NO: 295235 - RNA, 64 nt, hsa
caggcuacaagagaacccgggucgguaaugucuuuuuaagaauaauuuuuaauugcuuauaaca

SEQ ID NO: 295236 - RNA, 64 nt, hsa
uucucuuuaauggaaucuacaacuguuuuaaaacuuuaagaaagguaaagacugccaguucuuc

SEQ ID NO: 295237 - RNA, 64 nt, hsa
aauuucauuguaaaaugaacaaauacauaaauauuuuaagaaaaauuuaaguuuauucagauaa

SEQ ID NO: 295238 - RNA, 64 nt, hsa
cucucucuuaaauguuauaaaaaacaauuguauuuuuaagaauguuuauuuaucaaagucuuuc

SEQ ID NO: 295239 - RNA, 64 nt, hsa
caagucacuacaguugguucuauugaagccagucuuuaagaaaccuggguuaaagacaccagca

SEQ ID NO: 295240 - RNA, 64 nt, hsa
agggauauuguaaaugaaaggcugcagugccaguuuuaagaaagaauuucugugaagugugagg

SEQ ID NO: 295241 - RNA, 64 nt, hsa
auaaugauaagcauuauucauaaaacuuguuaccuuuaagaagguggaaguggcaaaccauacu

SEQ ID NO: 295242 - RNA, 64 nt, hsa
ugcuuuuauagauuuuacuauauaggaaucaagauuuaagaaauuuugcauuaaaaauagugua

SEQ ID NO: 295243 - RNA, 64 nt, hsa
cccagagcugccuuuuucuuuucuuuuuaaaaauuuuaagaaguuuucuuuguggggcugggga

SEQ ID NO: 295244 - RNA, 64 nt, hsa
cugcagugacuugaugcucuaaaacaguguaggauuuaagaauagaugguuuuuaauccuggaa

SEQ ID NO: 295245 - RNA, 64 nt, hsa
aucacaccaaaacuaugcaauugguacaugguuguuuaagaagaaaccguauuuuuccaugaua

SEQ ID NO: 295246 - RNA, 64 nt, hsa
guuaacaauuggaauaacuuuauucugcagaucauuuaagaaguaacaggccgggcgcgguggc

SEQ ID NO: 295247 - RNA, 64 nt, hsa
agcugccaaaaauuaaagugcaauauuguauauuuuuaagaacaaauuuaaaauagaauuuuga

SEQ ID NO: 295248 - RNA, 64 nt, hsa
caagcugcaugcuuuucacaaaauccagaaagcauuuaagaauugaacuaggggcuggaagaag

SEQ ID NO: 295249 - RNA, 64 nt, hsa
uuucuuugguugaugcaaacaaaaaacuauuauauuuaagaacuuuauuucuucauacgacaua

SEQ ID NO: 295250 - RNA, 64 nt, hsa
uccagauaccggguggaagacugguuuugaucaguuuaagaaguauucuaaacuguucuagaug

SEQ ID NO: 295251 - RNA, 64 nt, hsa
caucaagccauggauucuugguuuggcgcuaucuuuuaagaagagaugauguugaaccugcucc

SEQ ID NO: 295252 - RNA, 64 nt, hsa
auguuagaauuuacacugaggagaaaauugucaauuuaagaaaucuaaagugaaaauuuugcuu

SEQ ID NO: 295253 - RNA, 64 nt, hsa
auaauuuauagauguauauuguggaauguaaagcuuuaagaacuuaaacaaagguaauaauuaa

SEQ ID NO: 295254 - RNA, 64 nt, hsa
gaacagagguguugaguugcaggauaucuagcaauuuaagaaaauguggaaaaaauauuuuuau

SEQ ID NO: 295255 - RNA, 64 nt, hsa
ggaacagauggcuucacugaaguuauuccaaauauuuaagaaauaauaccaggcuuuuauaaac

SEQ ID NO: 295256 - RNA, 64 nt, hsa
uuagcaugcuugucaaccuugagugagugucauuuuuaagaacaguuguagcccuucugauuau

SEQ ID NO: 295257 - RNA, 64 nt, hsa
auguaaaauaauuaaaugaauugugaaauggauguuuaagaaaauauaggcuuaaaaaguaaau

SEQ ID NO: 295258 - RNA, 64 nt, hsa
aaauagcguguuguucaguaugcaaaucaauuauuuuaagaaucgcuuuuguaaauaucuuugu

SEQ ID NO: 295259 - RNA, 64 nt, hsa
uccauguaucauguuccguguagccauuuuauuuuuuaagaaacugcuaauacuuucucccuaa

SEQ ID NO: 295260 - RNA, 58 nt, hsa
aagguauggucgauggauaaauaguuauuuuaagaaacuaauuccacugaaccuaaaa

SEQ ID NO: 295261 - RNA, 64 nt, hsa
gggagccuuuaucugucauuagaaaucuuucucauuuaagaacuuaugaauaugcugaagauuu

SEQ ID NO: 295262 - RNA, 64 nt, hsa
ggaguuguuucugugauguaaauuaugaucauuauuuaagaagucaaauccugaucuugaagug

SEQ ID NO: 295263 - RNA, 64 nt, hsa
gguagaucagauugggggauguagcaaacuggacuuuaagaacuggaaagagguuuuacaaaag

SEQ ID NO: 295264 - RNA, 64 nt, hsa
uuaguauacacuggcacauaauuuuuuaaaaaguuuuaagaaaagauucauuuggaauuuuauu

SEQ ID NO: 295265 - RNA, 64 nt, hsa
guaccguuuuugagguucagucuuaaacauuugcuuuaagaaaacagucuugaauuucacaugc

SEQ ID NO: 295266 - RNA, 64 nt, hsa
cacccgagaaaucuuaaauagacacuuugcaauauuuaagaaccuaaugcuguuuaauuuuggu

SEQ ID NO: 295267 - RNA, 64 nt, hsa
auguacauuguggaauguaaagcuuuaagaauuuuuuaagaaguaauaauuaaaauaaccucac

SEQ ID NO: 295268 - RNA, 64 nt, hsa
auaauuuauagauguacauuguggaauguaaagcuuuaagaauuuuuuaagaaguaauaauuaa

SEQ ID NO: 295269 - RNA, 64 nt, hsa
auguuagcauuuacacugaggagaaaauugucaauuuaagaaaucuaaagugaaaauuuugcuu

SEQ ID NO: 295270 - RNA, 64 nt, hsa
cauccuggcaaaaacaaaguugcaggcacaacaguuuaagaaugcauuccuccagaagaguauc

SEQ ID NO: 295271 - RNA, 64 nt, hsa
aaagucuuguuggauaauaguguuugacuagcguuuuaagaacuugagaguaaaagcaacaaua

SEQ ID NO: 295272 - RNA, 64 nt, hsa
acucuccucuagcuauccuugaugagcuucucacuuuaagaauaaauguguuugauauaaggcc

SEQ ID NO: 295273 - RNA, 64 nt, hsa
ucuacguauccuuguggagaaaagcuaaauaaccuuuaagaaugugggugguauuggagaaaga

SEQ ID NO: 295274 - RNA, 64 nt, hsa
aauuaugaacauuuuuuucauaaaaauuaaaugcuuuaagaaauggagaaggaaaaauagcuuu

SEQ ID NO: 295275 - RNA, 64 nt, hsa
gagcgugacauuaugcauuacuccacauccacccuuuaagaauugauuuauuacaaaauuaugu

SEQ ID NO: 295276 - RNA, 64 nt, hsa
aaaaagugaugaaucaaaauuagaaauuaagaguuuuaagaaaacauguggccuuuuauuaaua

SEQ ID NO: 295277 - RNA, 64 nt, hsa
gaaggaaacauuugugcuuuccuauauuuuuaauuuuaagaauaggauuucggaaggcgacaga

SEQ ID NO: 295278 - RNA, 64 nt, hsa
uagaaauuuuuaauugaguguaaacacaccuaacuuuaagaaaaagaaccgcuuguaugauuuu

SEQ ID NO: 295279 - RNA, 64 nt, hsa
uucauuuaauuuuaauuuuauauuuugugaauauuuuaagaacuguagagcugcuuucaauauc

SEQ ID NO: 295280 - RNA, 64 nt, hsa
gaaauuauacaaucaaacuagaucugaagcauaauuuaagaaaaacaucaacauuuuuugugcu

SEQ ID NO: 295281 - RNA, 64 nt, hsa
ucaggaauacugccucaguuauugaacuuuuuuuuuuaagaauacuuuuuuuuuaagcugagaa

SEQ ID NO: 295282 - RNA, 64 nt, hsa
gaaauuggaaguacuaacuacuuucuagcauaucuuuaagaaaauugauuguuauuuacuccca

SEQ ID NO: 295283 - RNA, 64 nt, hsa
guuaguaucaugguguuuuuguuuuuguuuuuguuuuaagaaccugcaguuugacucuucaucg

SEQ ID NO: 295284 - RNA, 64 nt, hsa
gccaaauaccugauguauugugaaagccacugauuuuaagaauggagagaaagggauuuuuuac

SEQ ID NO: 295285 - RNA, 64 nt, hsa
auaaauagauaaaaauaaaaacccauggaaaugguuuaagaaaaugguucuggguacaccagaa

SEQ ID NO: 295286 - RNA, 64 nt, hsa
ucauguguuagauguguguaaauaugcuaucuucuuuaagaaauuauauuacucuaauaagaug

SEQ ID NO: 295287 - RNA, 64 nt, hsa
aaauacuuaaagaccucagaagcacucuuuuacuuuuaagaaauugcuuuuuugaacuuuauuc

SEQ ID NO: 295288 - RNA, 64 nt, hsa
agaauaagugaacuuuuuuguuuuguuuuguuuuuuuaagaaacuuaucuguauguuagaaaug

SEQ ID NO: 295289 - RNA, 64 nt, hsa
uggcaauuuaauuuauuuacuuccuuuuuuuuuuuuuaagaaaggaaaaaagaaaaaaaaauca

SEQ ID NO: 295290 - RNA, 64 nt, hsa
acaaacuccaccuacugccccccccccucuuuuuuuuaagaauggccugaucauggcuaucuca

SEQ ID NO: 295291 - RNA, 64 nt, hsa
gcaguuuuaacuuucugaagaauaucugucaaaauuuaagaaaacaaauguauaaaauuccauu

SEQ ID NO: 295292 - RNA, 64 nt, hsa
uacaacucucauuuaauauucaugcuuuugugccuuuaagaaaauauuuuuugucauuuuuugu

SEQ ID NO: 295293 - RNA, 64 nt, hsa
auuccacgugcagcaugcuuggcccugcauuuaauuuaagaaggauuaauaauaaugcucugaa

SEQ ID NO: 295294 - RNA, 64 nt, hsa
uggaacucuccuacgaguucugcugaucaggaaauuuaagaauuuaucuuaaaaaugcaaggaa

SEQ ID NO: 295295 - RNA, 64 nt, hsa
ccagaauuuucuggccuuucauggcaaugaaaauuuuaagaagaaagauuuaaaguauuuuaau

SEQ ID NO: 295296 - RNA, 64 nt, hsa
auuuccuuuuguccacuuguaagaaugucaggaauuuaagaauuuguuuaaauuaggcauaucu

SEQ ID NO: 295297 - RNA, 64 nt, hsa
ucugacuugguaacuauguucugaaaacacugcauuuaagaauuuuuaaaaauugguuuucuaa

SEQ ID NO: 295298 - RNA, 64 nt, hsa
auguaaacaaacugcagguuuuuuucaaacuaauuuuaagaauuuagucuuauuucguuguaaa

SEQ ID NO: 295299 - RNA, 64 nt, hsa
auacagucuuuacuauauuagguuuauaaacaguuuuaagaauuucauccuuuugccaaaaugg

SEQ ID NO: 295300 - RNA, 64 nt, hsa
ggagauuuagugcuuuuauauucauuuccuugcauuuaagaaaauaugaaagcuuaaggaauua

SEQ ID NO: 295301 - RNA, 64 nt, hsa
uuggcuagggaguuuaucccuuuuucgaauuauuuuuaagaagaugccaauauaauuuuuguaa

SEQ ID NO: 295302 - RNA, 64 nt, hsa
ucauggaauauauucugcguuuauaaaacuaguuuuuaagaagaaauuuuuuuuggccuaugaa

SEQ ID NO: 295303 - RNA, 64 nt, hsa
uaagggaguggccucauuucacuagagacaaaucuuuaagaauaguucuaaaauugggcuugug

SEQ ID NO: 295304 - RNA, 64 nt, hsa
uuuuuuuuuuuuacauguuuccaucauuucugucuuuaagaacuaauucguacauaauaaguuu

SEQ ID NO: 295305 - RNA, 64 nt, hsa
uugcugcaauuugccccguuaauuaugcuugaaguuuaagaaagcugagcagaggugucucaua

SEQ ID NO: 295306 - RNA, 64 nt, hsa
uaugcugcagauuuuauaauugauugguuacuuauuuaagaagcaaaacacagcaccuuuaccc

SEQ ID NO: 295307 - RNA, 64 nt, hsa
uguuacauuaaaacucuaaccaaggaaaggguucuuuaagaacauucccuuagagggauaaagu

SEQ ID NO: 295308 - RNA, 64 nt, hsa
uguauauaacacuaucugucuguaaaauacuuuuuuuaagaaagcauuuauauuuauaugacag

SEQ ID NO: 295309 - RNA, 64 nt, hsa
ugauugaccaucaacuccauccuaucgagauuuauuuaagaaugaagaacauaauuuucugcug

SEQ ID NO: 295310 - RNA, 64 nt, hsa
uccagcaagggaaauaaugcaguuuccugucuuauuuaagaaaaagagaaggcucucuuuucuc

SEQ ID NO: 295311 - RNA, 64 nt, hsa
uucacacuuaggcaagcauacacaggcacauggcuuuaagaaccacacugaugccuugauaauu

SEQ ID NO: 295312 - RNA, 64 nt, hsa
uagguccuguaucauacuuuuuucuuuaagacuuuuuaagaaauauuacuuaaacauguggcuu

SEQ ID NO: 295313 - RNA, 64 nt, hsa
uguuugguaaaaauguuuuugugagaguucuuuuuuuaagaaagcauuaugcaaaaagucacuu

SEQ ID NO: 295314 - RNA, 64 nt, hsa
uguucauguuguaggguaauuuugauuuauucuuuuuaagaaggaguagaguugcaacuggaaa

SEQ ID NO: 295315 - RNA, 64 nt, hsa
guaauauuaauuuccacuaaaaaauuaaaugucuuuuaagaaacauucuuuuccacuuguuaaa

SEQ ID NO: 295316 - RNA, 64 nt, hsa
acuuguuaaaaaaauuaaauauauuuuaaagcacuuuaagaauaugaaacuuucauauauguua

SEQ ID NO: 295317 - RNA, 64 nt, hsa
acccacgucuucugaugcgaguuggaaguacaccuuuaagaauguuucugaaguuacguuuugu

SEQ ID NO: 295318 - RNA, 64 nt, hsa
ucuuuuccaaacugcuuuguguauuguauauuuuuuuaagaaaaagaaaagccuuauuugacuu

SEQ ID NO: 295319 - RNA, 64 nt, hsa
cuuuugcagcccagacaaaugugguuacacacuuuuuaagaaauacaauucuacauugucaagc

SEQ ID NO: 295320 - RNA, 64 nt, hsa
ucagugauguaccaugaaacaaagcugcaggcuguuuaagaaaaaauaacacacauauaaacau

SEQ ID NO: 295321 - RNA, 64 nt, hsa
acauuuuaaguuguuaagcaaaugugaguuuuuuuuuaagaaaugaggcuuucacugagauuug

SEQ ID NO: 295322 - RNA, 64 nt, hsa
uuuucugaauauuaagugaaaagcaaguucuauuuuuaagaaauagcuuuugcugaggaguugu

SEQ ID NO: 295323 - RNA, 64 nt, hsa
aaagguuuucgaaugggauacgcuguaggcacguuuuaagaaguauucuguuccuaaaguccag

SEQ ID NO: 295324 - RNA, 64 nt, hsa
guuugauauucaugaacaugaauacauguauuuuuuuaagaaauaaguauuguguaacacuaug

SEQ ID NO: 295325 - RNA, 64 nt, hsa
ugcuuuagggcuguuguuuuuuguuguuuuguuuuuuaagaaagugaaagauuauuuuucuaca

SEQ ID NO: 295326 - RNA, 64 nt, hsa
cuucauaauugagaaagccuugaaugugauuaaauuuaagaaaaucuucaucuauuucauaucu

SEQ ID NO: 295327 - RNA, 64 nt, hsa
auuuuuggaaaaauuuucuuuaaaccaucugguuuuuaagaaauuugguaccaaaaauugauga

SEQ ID NO: 295328 - RNA, 64 nt, hsa
uauauuuuccaguugaaaacaaacuaagaaguccuuuaagaauuuauaauccguuccccauuaa

SEQ ID NO: 295329 - RNA, 64 nt, hsa
uggcuuuuccauuguuuuugcuucucuuaaaaaguuuaagaagaauaugaccucauuaaaugug

SEQ ID NO: 295330 - RNA, 64 nt, hsa
gguuuucauuuauggcuuuuugugguuuuagcacuuuaagaaguuuaauuuuuuguaauuuuua

SEQ ID NO: 295331 - RNA, 64 nt, hsa
aaagauauguuaauuacuuuauucaguaaaguuuuuuaagaauguuuaucucagccaguaggca

SEQ ID NO: 295332 - RNA, 64 nt, hsa
uagauguauuaaaaaaacgaaacuacaaaauccuuuuaagaaaguaauaccaauuuagacucua

SEQ ID NO: 295333 - RNA, 64 nt, hsa
cuuguuaauggugggguuuucugcuuuguuuuuauuuaagaaaauaaacacgacauauuuaaag

SEQ ID NO: 295334 - RNA, 64 nt, hsa
gcuggggauuggaugaaagucaaagguugucuacuuuaagaaaauaaaauacccugaauggagc

SEQ ID NO: 295335 - RNA, 64 nt, hsa
acuagcuuaucaugagagcccucaggggaaaggguuuaagaaaaacaacuccucuuucccauag

SEQ ID NO: 295336 - RNA, 64 nt, hsa
acaguauucuuucuacaugauccuuuuuuguacauuuaagaauauuuugauuauauuaaacaag

SEQ ID NO: 295337 - RNA, 64 nt, hsa
agacuuguuuuuuauuauuguuguuuaagcauaauuuaagaaaaaaaauuuuuaccuggugaac

SEQ ID NO: 295338 - RNA, 64 nt, hsa
uugccaaauaacaauaauuaauaauuguucaauguuuaagaauaauauuaacaaaauaaaggag

SEQ ID NO: 295339 - RNA, 64 nt, hsa
aacaacuuaauauaauaaauuguacuaaaagucauuuaagaaauaccaaaaaguaagcuuuugu

SEQ ID NO: 295340 - RNA, 64 nt, hsa
auucucucuuugagugauucauacauucuguuucuuuaagaagaugcagucauggucuuucagu

SEQ ID NO: 295341 - RNA, 63 nt, hsa
uagauggaagcauuuccuauccagugugaauaaaaagaacaguuguaguaaauuauuauaaag

SEQ ID NO: 295342 - RNA, 63 nt, hsa
caaacacuaugucagauggggguaaaauccauuaaagaacaggaaaaaauaauuauaagauga

SEQ ID NO: 295343 - RNA, 63 nt, hsa
agugugcuaacaucgaauauagagaaaacugguaaagaacauuccaguaggaaaagaaaagaa

SEQ ID NO: 295344 - RNA, 63 nt, hsa
aaaacugguaaagaacauuccaguaggaaaagaaaagaacaaucuuccauuucugggcuuggc

SEQ ID NO: 295345 - RNA, 63 nt, hsa
cauccaaauaggagucuucugccucuuaacuuaaaagaacauaggaauuuuguuuuugguuuc

SEQ ID NO: 295346 - RNA, 63 nt, hsa
uaacaccaucuggagucuuccuguaguggcaaaaaagaacaguguugaaauuggaaaggacuu

SEQ ID NO: 295347 - RNA, 63 nt, hsa
uugauauuugugcugaggugauauuccugucuaaaagaacaacauugucuuucuuuucuagca

SEQ ID NO: 295348 - RNA, 63 nt, hsa
cagucauuguuaguucuugucuaguuuucauuaaaagaacaaagaucuuuuauauggauaucu

SEQ ID NO: 295349 - RNA, 63 nt, hsa
gguugucuaaguguuuuuauguaaaaccaacaaaaagaacaaaucagcuuauauuuuuuaucu

SEQ ID NO: 295350 - RNA, 63 nt, hsa
cgcccggccuuaaauguuuuuuuuaaucaucaaaaagaacaacauaucucagguugucuaagu

SEQ ID NO: 295351 - RNA, 63 nt, hsa
gaaaaaaaucucugcucauuaauauuucaagauaaagaacaaauguuuccuugaaugcuugcu

SEQ ID NO: 295352 - RNA, 63 nt, hsa
ucaaugagaaucuguucaccaaaccaaauguggaaagaacacaaagaagacauaagacuucag

SEQ ID NO: 295353 - RNA, 63 nt, hsa
ucucacuagaguuaccauucauauuugagaagaaaagaacauuuaauaaauguaugugugggg

SEQ ID NO: 295354 - RNA, 63 nt, hsa
accuauggcaguugguugaauaauuauugaaaaaaagaacacgacugaaaaaguucaucugau

SEQ ID NO: 295355 - RNA, 63 nt, hsa
uuuuuuuuuuuuaaguaacacuaaagaagcuguaaagaacauugaagguggucauuccuucaa

SEQ ID NO: 295356 - RNA, 63 nt, hsa
ggauuacaggcgugagccacugcgcccggccaaaaagaacauuuugucaaucugaacagagca

SEQ ID NO: 295357 - RNA, 63 nt, hsa
uaaaagcuuucuguaguugcuuccuuuaucagaaaagaacauuugauaccaugguauaucauu

SEQ ID NO: 295358 - RNA, 63 nt, hsa
uuugauaccaugguauaucauuuccucuucauuaaagaacagcuuuucuaaauguugggggaa

SEQ ID NO: 295359 - RNA, 63 nt, hsa
auuuuuacuuuuuuauuauaauuuugauauuaaaaagaacagagauggggucuugcuuuguug

SEQ ID NO: 295360 - RNA, 63 nt, hsa
auuuuuguauuuuaauagucuacaggcuauauaaaagaacauggcuuuuugacugauaaaagu

SEQ ID NO: 295361 - RNA, 63 nt, hsa
ccgcugcuccugccccuuggagcccagugacagaaagaacagccucugucaccccgccgccac

SEQ ID NO: 295362 - RNA, 63 nt, hsa
aaagaaaagcuagaauuuauuuauucagacuuuaaagaacaauuucucauugauguugugaaa

SEQ ID NO: 295363 - RNA, 63 nt, hsa
auucaagccuguugucuuaacauuuuguauaaaaaagaacaacagaaauuaucugucauuuga

SEQ ID NO: 295364 - RNA, 63 nt, hsa
agaaucuaaaagauaacagauuauuugcuuaugaaagaacaauauagucugggaaucccagaa

SEQ ID NO: 295365 - RNA, 63 nt, hsa
ccugggucaacucuuuuaauuuauauacaaagcaaagaacaacauuaauggagaugcacaaug

SEQ ID NO: 295366 - RNA, 63 nt, hsa
aagauuuuuuucuauuuaaaaccccauuuuccuaaagaacaaaguaguaaaauaaaaaaaaau

SEQ ID NO: 295367 - RNA, 63 nt, hsa
augaacauguuuauugcagauucuucuuuuuugaaagaacaacagcaaaacauccacaacucu

SEQ ID NO: 295368 - RNA, 63 nt, hsa
uuaucuauugucaguauuuuauguugaauauguaaagaacauuaaaguccuaaaacaucuaag

SEQ ID NO: 295369 - RNA, 63 nt, hsa
gucccugaugcaguauguuuauuugugauguuuaaagaacauuucuuggcugggcgcugcggc

SEQ ID NO: 295370 - RNA, 63 nt, hsa
uaaauagaaagagagagagaggaaaaaaaaagaaaagaacacuucuuuauuugagggacuuuc

SEQ ID NO: 295371 - RNA, 63 nt, hsa
cgacuuuucauggauauugagagagaacaaguuaaagaacaacaaaggcaaaaagaacaaaag

SEQ ID NO: 295372 - RNA, 63 nt, hsa
gagagagaacaaguuaaagaacaacaaaggcaaaaagaacaaaagaagaaaauugaaaaguaa

SEQ ID NO: 295373 - RNA, 63 nt, hsa
aauuuauaccuauuuguguauuaagcacaagauaaagaacagcuguuaauauuuuuuaaaaau

SEQ ID NO: 295374 - RNA, 63 nt, hsa
gguggcaguuuauuucucaaaccagucauuuucaaagaacaggugccuaaauuauaaauuggu

SEQ ID NO: 295375 - RNA, 63 nt, hsa
uaauguuuuacuaugauuuagggcuuuuuuuucaaagaacaaaaauuauaagcauaaaaacuc

SEQ ID NO: 295376 - RNA, 63 nt, hsa
aaagugcucauugcuucuucaauauccuuuuuuaaagaacagaauuuauguauuguaugacag

SEQ ID NO: 295377 - RNA, 63 nt, hsa
cuuguaaaguuucuuaacuguuuuuuugaggagaaagaacagauuuauuuauagacuuaacuu

SEQ ID NO: 295378 - RNA, 63 nt, hsa
uaaaaacccaaaguuccuuauuuugaaauugucaaagaacaaagcgguguuuuucuuuuaaac

SEQ ID NO: 295379 - RNA, 63 nt, hsa
gaguacacaaguauaguggcccaggauguagugaaagaacaaauccuagagucuuugaaauuu

SEQ ID NO: 295380 - RNA, 63 nt, hsa
aaugucaagucuacaucgacugguaaaacauucaaagaacaaacugacaaugauguucuaccu

SEQ ID NO: 295381 - RNA, 63 nt, hsa
uccugugaucuaugcaggaccucuguacuuucuaaagaacaaaauguuauguagacauuauac

SEQ ID NO: 295382 - RNA, 63 nt, hsa
uugagauauuccaaaguuuuauuuuacuuuuuuaaagaacagaaaaagaugaaugaaagaacc

SEQ ID NO: 295383 - RNA, 63 nt, hsa
gacuucuuucagagagcuuuauacugccugaccaaagaacaaaucugaaaaucaccauuuuaa

SEQ ID NO: 295384 - RNA, 63 nt, hsa
uccagucaggguccugaaguuugcugguucaggaaagaacaggaaagagaaaagccuucugug

SEQ ID NO: 295385 - RNA, 63 nt, hsa
guucuguguuuauuuuuuaauuauagaaauuccaaagaacagcacaucagaaugcuccucucu

SEQ ID NO: 295386 - RNA, 63 nt, hsa
aaagcacagcucucacuggccaguagcugccaaaaagaacacccaucguauaaggaaauccag

SEQ ID NO: 295387 - RNA, 63 nt, hsa
ucucucauguggggauguuugugcugcagacaaaaagaacaaaaaaaaauuuuuaaauaccac

SEQ ID NO: 295388 - RNA, 63 nt, hsa
gugugugugaaacagugaagucucaacagcagaaaagaacaaaauguaaauucaugaauaaug

SEQ ID NO: 295389 - RNA, 63 nt, hsa
caggaaacuguagcuucuuaacuggugacuaccaaagaacaagcagugauuugaaaaaggaaa

SEQ ID NO: 295390 - RNA, 63 nt, hsa
auuaggaagcauuucgaaccugcgcaacagaccaaagaacaguacaaagaacauccguguacc

SEQ ID NO: 295391 - RNA, 63 nt, hsa
uucgaaccugcgcaacagaccaaagaacaguacaaagaacauccguguacccaguacccugac

SEQ ID NO: 295392 - RNA, 63 nt, hsa
uggaaagcacugcagcgauuucucaaagacauaaaagaacauagcauucaacccagcauccca

SEQ ID NO: 295393 - RNA, 63 nt, hsa
cauauacaccauggaauacuaugcagccauaaaaaagaacaagacuguguccuuuacagcaac

SEQ ID NO: 295394 - RNA, 63 nt, hsa
caaaggguuaagucuauuugaaaagguuaaaaaaaagaacaaaaaaaaaaaaagaacuuguac

SEQ ID NO: 295395 - RNA, 63 nt, hsa
gcacaugauuuuuaaagguauuuauuagaaaucaaagaacacucaaaauaaacucagugcuca

SEQ ID NO: 295396 - RNA, 63 nt, hsa
guauaacauuuguauaauuuaauaagaucuugcaaagaacaguacuguguauuggucauggau

SEQ ID NO: 295397 - RNA, 63 nt, hsa
uuuaucaaguuauaaaauauguugaaaggcacaaaagaacaccugaaaaaugauauuuugucu

SEQ ID NO: 295398 - RNA, 63 nt, hsa
cugugcaaagccccaguagucggauuccggggaaaagaacaaguaucuaguuuugaugacaau

SEQ ID NO: 295399 - RNA, 63 nt, hsa
auuugagcuggucuggagcagaguuucucccucaaagaacacagagaaaucagagaguggcug

SEQ ID NO: 295400 - RNA, 63 nt, hsa
gaucaaugacuguagcuuuuuagacuguuggucaaagaacauucuacuucacaguaauagcuc

SEQ ID NO: 295401 - RNA, 63 nt, hsa
acugaauugaaucaaccaguuugcauuuaaauaaaagaacaggcucaguggucuuccuguaga

SEQ ID NO: 295402 - RNA, 64 nt, hsa; identical to SEQ ID NO: 214333

SEQ ID NO: 295403 - RNA, 64 nt, hsa; identical to SEQ ID NO: 214334

SEQ ID NO: 295404 - RNA, 64 nt, hsa; identical to SEQ ID NO: 172152

SEQ ID NO: 295405 - RNA, 64 nt, hsa; identical to SEQ ID NO: 172153

SEQ ID NO: 295406 - RNA, 64 nt, hsa; identical to SEQ ID NO: 172154

SEQ ID NO: 295407 - RNA, 64 nt, hsa; identical to SEQ ID NO: 172155

SEQ ID NO: 295408 - RNA, 64 nt, hsa; identical to SEQ ID NO: 172156

SEQ ID NO: 295409 - RNA, 64 nt, hsa; identical to SEQ ID NO: 172157

SEQ ID NO: 295410 - RNA, 64 nt, hsa; identical to SEQ ID NO: 172158

SEQ ID NO: 295411 - RNA, 64 nt, hsa; identical to SEQ ID NO: 172159

SEQ ID NO: 295412 - RNA, 64 nt, hsa; identical to SEQ ID NO: 172160

SEQ ID NO: 295413 - RNA, 64 nt, hsa; identical to SEQ ID NO: 172161

SEQ ID NO: 295414 - RNA, 64 nt, hsa; identical to SEQ ID NO: 172162

SEQ ID NO: 295415 - RNA, 64 nt, hsa; identical to SEQ ID NO: 172163

SEQ ID NO: 295416 - RNA, 64 nt, hsa; identical to SEQ ID NO: 172164

SEQ ID NO: 295417 - RNA, 64 nt, hsa; identical to SEQ ID NO: 172165

SEQ ID NO: 295418 - RNA, 64 nt, hsa; identical to SEQ ID NO: 214349

SEQ ID NO: 295419 - RNA, 64 nt, hsa; identical to SEQ ID NO: 214350

SEQ ID NO: 295420 - RNA, 64 nt, hsa; identical to SEQ ID NO: 214351

SEQ ID NO: 295421 - RNA, 64 nt, hsa; identical to SEQ ID NO: 214352

SEQ ID NO: 295422 - RNA, 64 nt, hsa; identical to SEQ ID NO: 214353

SEQ ID NO: 295423 - RNA, 64 nt, hsa; identical to SEQ ID NO: 214354

SEQ ID NO: 295424 - RNA, 64 nt, hsa; identical to SEQ ID NO: 214355

SEQ ID NO: 295425 - RNA, 64 nt, hsa; identical to SEQ ID NO: 214356

SEQ ID NO: 295426 - RNA, 64 nt, hsa; identical to SEQ ID NO: 214357

SEQ ID NO: 295427 - RNA, 64 nt, hsa; identical to SEQ ID NO: 214358

SEQ ID NO: 295428 - RNA, 50 nt, hsa; identical to SEQ ID NO: 214359

SEQ ID NO: 295429 - RNA, 64 nt, hsa; identical to SEQ ID NO: 214360

SEQ ID NO: 295430 - RNA, 64 nt, hsa; identical to SEQ ID NO: 214361

SEQ ID NO: 295431 - RNA, 64 nt, hsa; identical to SEQ ID NO: 214362

SEQ ID NO: 295432 - RNA, 64 nt, hsa; identical to SEQ ID NO: 214363

SEQ ID NO: 295433 - RNA, 64 nt, hsa; identical to SEQ ID NO: 214364

SEQ ID NO: 295434 - RNA, 64 nt, hsa; identical to SEQ ID NO: 214365

SEQ ID NO: 295435 - RNA, 64 nt, hsa; identical to SEQ ID NO: 214366

SEQ ID NO: 295436 - RNA, 64 nt, hsa; identical to SEQ ID NO: 214367

SEQ ID NO: 295437 - RNA, 64 nt, hsa; identical to SEQ ID NO: 214368

SEQ ID NO: 295438 - RNA, 64 nt, hsa; identical to SEQ ID NO: 214369

SEQ ID NO: 295439 - RNA, 64 nt, hsa; identical to SEQ ID NO: 214370

SEQ ID NO: 295440 - RNA, 64 nt, hsa; identical to SEQ ID NO: 214371

SEQ ID NO: 295441 - RNA, 64 nt, hsa; identical to SEQ ID NO: 214372

SEQ ID NO: 295442 - RNA, 64 nt, hsa; identical to SEQ ID NO: 214373

SEQ ID NO: 295443 - RNA, 64 nt, hsa; identical to SEQ ID NO: 214374

SEQ ID NO: 295444 - RNA, 64 nt, hsa; identical to SEQ ID NO: 214375

SEQ ID NO: 295445 - RNA, 64 nt, hsa; identical to SEQ ID NO: 214376

SEQ ID NO: 295446 - RNA, 64 nt, hsa; identical to SEQ ID NO: 214377

SEQ ID NO: 295447 - RNA, 64 nt, hsa; identical to SEQ ID NO: 214378

SEQ ID NO: 295448 - RNA, 64 nt, hsa; identical to SEQ ID NO: 214379

SEQ ID NO: 295449 - RNA, 64 nt, hsa; identical to SEQ ID NO: 214380

SEQ ID NO: 295450 - RNA, 64 nt, hsa; identical to SEQ ID NO: 214381

SEQ ID NO: 295451 - RNA, 64 nt, hsa; identical to SEQ ID NO: 214382

SEQ ID NO: 295452 - RNA, 64 nt, hsa; identical to SEQ ID NO: 214383

SEQ ID NO: 295453 - RNA, 64 nt, hsa; identical to SEQ ID NO: 214384

SEQ ID NO: 295454 - RNA, 64 nt, hsa; identical to SEQ ID NO: 214385

SEQ ID NO: 295455 - RNA, 64 nt, hsa; identical to SEQ ID NO: 214386

SEQ ID NO: 295456 - RNA, 64 nt, hsa; identical to SEQ ID NO: 214387

SEQ ID NO: 295457 - RNA, 64 nt, hsa; identical to SEQ ID NO: 214388

SEQ ID NO: 295458 - RNA, 64 nt, hsa; identical to SEQ ID NO: 214389

SEQ ID NO: 295459 - RNA, 64 nt, hsa; identical to SEQ ID NO: 214390

SEQ ID NO: 295460 - RNA, 64 nt, hsa; identical to SEQ ID NO: 214391

SEQ ID NO: 295461 - RNA, 64 nt, hsa; identical to SEQ ID NO: 214392

SEQ ID NO: 295462 - RNA, 64 nt, hsa; identical to SEQ ID NO: 214393

SEQ ID NO: 295463 - RNA, 64 nt, hsa; identical to SEQ ID NO: 214394

SEQ ID NO: 295464 - RNA, 64 nt, hsa; identical to SEQ ID NO: 214395

SEQ ID NO: 295465 - RNA, 64 nt, hsa; identical to SEQ ID NO: 214396

SEQ ID NO: 295466 - RNA, 64 nt, hsa; identical to SEQ ID NO: 214397

SEQ ID NO: 295467 - RNA, 64 nt, hsa; identical to SEQ ID NO: 214398

SEQ ID NO: 295468 - RNA, 64 nt, hsa; identical to SEQ ID NO: 214399

SEQ ID NO: 295469 - RNA, 64 nt, hsa; identical to SEQ ID NO: 214400

SEQ ID NO: 295470 - RNA, 64 nt, hsa; identical to SEQ ID NO: 214401

SEQ ID NO: 295471 - RNA, 64 nt, hsa; identical to SEQ ID NO: 214402

SEQ ID NO: 295472 - RNA, 64 nt, hsa; identical to SEQ ID NO: 214403

SEQ ID NO: 295473 - RNA, 64 nt, hsa; identical to SEQ ID NO: 214404

SEQ ID NO: 295474 - RNA, 64 nt, hsa; identical to SEQ ID NO: 214405

SEQ ID NO: 295475 - RNA, 64 nt, hsa; identical to SEQ ID NO: 214406

SEQ ID NO: 295476 - RNA, 64 nt, hsa; identical to SEQ ID NO: 214407

SEQ ID NO: 295477 - RNA, 64 nt, hsa; identical to SEQ ID NO: 214408

SEQ ID NO: 295478 - RNA, 64 nt, hsa; identical to SEQ ID NO: 214409

SEQ ID NO: 295479 - RNA, 64 nt, hsa; identical to SEQ ID NO: 214410

SEQ ID NO: 295480 - RNA, 64 nt, hsa; identical to SEQ ID NO: 214411

SEQ ID NO: 295481 - RNA, 64 nt, hsa; identical to SEQ ID NO: 214412

SEQ ID NO: 295482 - RNA, 64 nt, hsa; identical to SEQ ID NO: 214413

SEQ ID NO: 295483 - RNA, 64 nt, hsa; identical to SEQ ID NO: 214414

SEQ ID NO: 295484 - RNA, 64 nt, hsa; identical to SEQ ID NO: 214415

SEQ ID NO: 295485 - RNA, 64 nt, hsa; identical to SEQ ID NO: 214416

SEQ ID NO: 295486 - RNA, 64 nt, hsa; identical to SEQ ID NO: 214417

SEQ ID NO: 295487 - RNA, 64 nt, hsa; identical to SEQ ID NO: 214418

SEQ ID NO: 295488 - RNA, 64 nt, hsa; identical to SEQ ID NO: 214419

SEQ ID NO: 295489 - RNA, 64 nt, hsa; identical to SEQ ID NO: 214420

SEQ ID NO: 295490 - RNA, 64 nt, hsa; identical to SEQ ID NO: 214421

SEQ ID NO: 295491 - RNA, 64 nt, hsa; identical to SEQ ID NO: 214422

SEQ ID NO: 295492 - RNA, 64 nt, hsa; identical to SEQ ID NO: 214423

SEQ ID NO: 295493 - RNA, 64 nt, hsa; identical to SEQ ID NO: 214424

SEQ ID NO: 295494 - RNA, 64 nt, hsa; identical to SEQ ID NO: 214425

SEQ ID NO: 295495 - RNA, 64 nt, hsa; identical to SEQ ID NO: 214426

SEQ ID NO: 295496 - RNA, 64 nt, hsa; identical to SEQ ID NO: 214427

SEQ ID NO: 295497 - RNA, 64 nt, hsa; identical to SEQ ID NO: 214428

SEQ ID NO: 295498 - RNA, 64 nt, hsa; identical to SEQ ID NO: 214429

SEQ ID NO: 295499 - RNA, 62 nt, hsa; identical to SEQ ID NO: 214430

SEQ ID NO: 295500 - RNA, 64 nt, hsa; identical to SEQ ID NO: 214431

SEQ ID NO: 295501 - RNA, 64 nt, hsa; identical to SEQ ID NO: 214432

SEQ ID NO: 295502 - RNA, 64 nt, hsa; identical to SEQ ID NO: 214433

SEQ ID NO: 295503 - RNA, 64 nt, hsa; identical to SEQ ID NO: 214434

SEQ ID NO: 295504 - RNA, 64 nt, hsa; identical to SEQ ID NO: 214435

SEQ ID NO: 295505 - RNA, 64 nt, hsa; identical to SEQ ID NO: 214436

SEQ ID NO: 295506 - RNA, 53 nt, hsa; identical to SEQ ID NO: 214437

SEQ ID NO: 295507 - RNA, 64 nt, hsa; identical to SEQ ID NO: 214438

SEQ ID NO: 295508 - RNA, 64 nt, hsa; identical to SEQ ID NO: 214439

SEQ ID NO: 295509 - RNA, 64 nt, hsa; identical to SEQ ID NO: 214440

SEQ ID NO: 295510 - RNA, 64 nt, hsa; identical to SEQ ID NO: 214438

SEQ ID NO: 295511 - RNA, 64 nt, hsa; identical to SEQ ID NO: 214442

SEQ ID NO: 295512 - RNA, 64 nt, hsa; identical to SEQ ID NO: 214443

SEQ ID NO: 295513 - RNA, 64 nt, hsa; identical to SEQ ID NO: 214444

SEQ ID NO: 295514 - RNA, 64 nt, hsa; identical to SEQ ID NO: 214445

SEQ ID NO: 295515 - RNA, 64 nt, hsa; identical to SEQ ID NO: 214446

SEQ ID NO: 295516 - RNA, 64 nt, hsa; identical to SEQ ID NO: 214447

SEQ ID NO: 295517 - RNA, 64 nt, hsa; identical to SEQ ID NO: 214448

SEQ ID NO: 295518 - RNA, 64 nt, hsa; identical to SEQ ID NO: 214449

SEQ ID NO: 295519 - RNA, 64 nt, hsa; identical to SEQ ID NO: 214450

SEQ ID NO: 295520 - RNA, 64 nt, hsa; identical to SEQ ID NO: 214451

SEQ ID NO: 295521 - RNA, 64 nt, hsa; identical to SEQ ID NO: 214452

SEQ ID NO: 295522 - RNA, 64 nt, hsa; identical to SEQ ID NO: 214453

SEQ ID NO: 295523 - RNA, 64 nt, hsa; identical to SEQ ID NO: 214454

SEQ ID NO: 295524 - RNA, 64 nt, hsa; identical to SEQ ID NO: 214455

SEQ ID NO: 295525 - RNA, 64 nt, hsa; identical to SEQ ID NO: 214456

SEQ ID NO: 295526 - RNA, 64 nt, hsa; identical to SEQ ID NO: 214457

SEQ ID NO: 295527 - RNA, 64 nt, hsa; identical to SEQ ID NO: 214458

SEQ ID NO: 295528 - RNA, 64 nt, hsa; identical to SEQ ID NO: 214459

SEQ ID NO: 295529 - RNA, 64 nt, hsa; identical to SEQ ID NO: 214460

SEQ ID NO: 295530 - RNA, 63 nt, hsa; identical to SEQ ID NO: 214461

SEQ ID NO: 295531 - RNA, 64 nt, hsa; identical to SEQ ID NO: 214462

SEQ ID NO: 295532 - RNA, 64 nt, hsa; identical to SEQ ID NO: 214463

SEQ ID NO: 295533 - RNA, 64 nt, hsa; identical to SEQ ID NO: 214464

SEQ ID NO: 295534 - RNA, 64 nt, hsa; identical to SEQ ID NO: 214465

SEQ ID NO: 295535 - RNA, 64 nt, hsa; identical to SEQ ID NO: 214466

SEQ ID NO: 295536 - RNA, 64 nt, hsa; identical to SEQ ID NO: 214467

SEQ ID NO: 295537 - RNA, 64 nt, hsa; identical to SEQ ID NO: 214468

SEQ ID NO: 295538 - RNA, 64 nt, hsa; identical to SEQ ID NO: 214469

SEQ ID NO: 295539 - RNA, 64 nt, hsa; identical to SEQ ID NO: 214470

SEQ ID NO: 295540 - RNA, 64 nt, hsa; identical to SEQ ID NO: 214471

SEQ ID NO: 295541 - RNA, 64 nt, hsa; identical to SEQ ID NO: 214472

SEQ ID NO: 295542 - RNA, 64 nt, hsa; identical to SEQ ID NO: 214473

SEQ ID NO: 295543 - RNA, 64 nt, hsa; identical to SEQ ID NO: 214474

SEQ ID NO: 295544 - RNA, 64 nt, hsa; identical to SEQ ID NO: 214475

SEQ ID NO: 295545 - RNA, 64 nt, hsa; identical to SEQ ID NO: 214476

SEQ ID NO: 295546 - RNA, 64 nt, hsa; identical to SEQ ID NO: 214477

SEQ ID NO: 295547 - RNA, 64 nt, hsa; identical to SEQ ID NO: 214478

SEQ ID NO: 295548 - RNA, 64 nt, hsa; identical to SEQ ID NO: 214479

SEQ ID NO: 295549 - RNA, 64 nt, hsa; identical to SEQ ID NO: 214480

SEQ ID NO: 295550 - RNA, 64 nt, hsa; identical to SEQ ID NO: 214481

SEQ ID NO: 295551 - RNA, 64 nt, hsa; identical to SEQ ID NO: 214482

SEQ ID NO: 295552 - RNA, 64 nt, hsa; identical to SEQ ID NO: 214483

SEQ ID NO: 295553 - RNA, 64 nt, hsa; identical to SEQ ID NO: 214484

SEQ ID NO: 295554 - RNA, 64 nt, hsa; identical to SEQ ID NO: 214485

SEQ ID NO: 295555 - RNA, 64 nt, hsa; identical to SEQ ID NO: 214486

SEQ ID NO: 295556 - RNA, 64 nt, hsa; identical to SEQ ID NO: 214487

SEQ ID NO: 295557 - RNA, 64 nt, hsa; identical to SEQ ID NO: 214488

SEQ ID NO: 295558 - RNA, 64 nt, hsa; identical to SEQ ID NO: 214489

SEQ ID NO: 295559 - RNA, 64 nt, hsa; identical to SEQ ID NO: 214490

SEQ ID NO: 295560 - RNA, 64 nt, hsa; identical to SEQ ID NO: 214491

SEQ ID NO: 295561 - RNA, 64 nt, hsa; identical to SEQ ID NO: 214492

SEQ ID NO: 295562 - RNA, 64 nt, hsa; identical to SEQ ID NO: 214493

SEQ ID NO: 295563 - RNA, 64 nt, hsa; identical to SEQ ID NO: 214494

SEQ ID NO: 295564 - RNA, 64 nt, hsa; identical to SEQ ID NO: 214495

SEQ ID NO: 295565 - RNA, 64 nt, hsa; identical to SEQ ID NO: 214496

SEQ ID NO: 295566 - RNA, 64 nt, hsa; identical to SEQ ID NO: 214497

SEQ ID NO: 295567 - RNA, 64 nt, hsa; identical to SEQ ID NO: 214498

SEQ ID NO: 295568 - RNA, 64 nt, hsa; identical to SEQ ID NO: 214499

SEQ ID NO: 295569 - RNA, 64 nt, hsa; identical to SEQ ID NO: 214500

SEQ ID NO: 295570 - RNA, 64 nt, hsa; identical to SEQ ID NO: 214501

SEQ ID NO: 295571 - RNA, 64 nt, hsa; identical to SEQ ID NO: 214502

SEQ ID NO: 295572 - RNA, 64 nt, hsa; identical to SEQ ID NO: 214503

SEQ ID NO: 295573 - RNA, 64 nt, hsa; identical to SEQ ID NO: 214504

SEQ ID NO: 295574 - RNA, 64 nt, hsa; identical to SEQ ID NO: 214505

SEQ ID NO: 295575 - RNA, 64 nt, hsa; identical to SEQ ID NO: 214506

SEQ ID NO: 295576 - RNA, 64 nt, hsa; identical to SEQ ID NO: 214507

SEQ ID NO: 295577 - RNA, 64 nt, hsa; identical to SEQ ID NO: 214508

SEQ ID NO: 295578 - RNA, 64 nt, hsa; identical to SEQ ID NO: 214509

SEQ ID NO: 295579 - RNA, 64 nt, hsa; identical to SEQ ID NO: 214510

SEQ ID NO: 295580 - RNA, 64 nt, hsa; identical to SEQ ID NO: 214511

SEQ ID NO: 295581 - RNA, 64 nt, hsa; identical to SEQ ID NO: 214512

SEQ ID NO: 295582 - RNA, 64 nt, hsa; identical to SEQ ID NO: 214513

SEQ ID NO: 295583 - RNA, 64 nt, hsa; identical to SEQ ID NO: 214514

SEQ ID NO: 295584 - RNA, 64 nt, hsa; identical to SEQ ID NO: 214515

SEQ ID NO: 295585 - RNA, 64 nt, hsa; identical to SEQ ID NO: 214516

SEQ ID NO: 295586 - RNA, 64 nt, hsa; identical to SEQ ID NO: 214517

SEQ ID NO: 295587 - RNA, 64 nt, hsa; identical to SEQ ID NO: 214518

SEQ ID NO: 295588 - RNA, 64 nt, hsa; identical to SEQ ID NO: 214519

SEQ ID NO: 295589 - RNA, 64 nt, hsa; identical to SEQ ID NO: 214520

SEQ ID NO: 295590 - RNA, 64 nt, hsa; identical to SEQ ID NO: 214521

SEQ ID NO: 295591 - RNA, 64 nt, hsa; identical to SEQ ID NO: 214522

SEQ ID NO: 295592 - RNA, 64 nt, hsa; identical to SEQ ID NO: 214523

SEQ ID NO: 295593 - RNA, 64 nt, hsa; identical to SEQ ID NO: 214524

SEQ ID NO: 295594 - RNA, 64 nt, hsa; identical to SEQ ID NO: 214525

SEQ ID NO: 295595 - RNA, 64 nt, hsa; identical to SEQ ID NO: 214526

SEQ ID NO: 295596 - RNA, 64 nt, hsa; identical to SEQ ID NO: 214527

SEQ ID NO: 295597 - RNA, 64 nt, hsa; identical to SEQ ID NO: 214528

SEQ ID NO: 295598 - RNA, 64 nt, hsa; identical to SEQ ID NO: 214529

SEQ ID NO: 295599 - RNA, 64 nt, hsa; identical to SEQ ID NO: 214530

SEQ ID NO: 295600 - RNA, 64 nt, hsa; identical to SEQ ID NO: 214531

SEQ ID NO: 295601 - RNA, 64 nt, hsa; identical to SEQ ID NO: 214532

SEQ ID NO: 295602 - RNA, 64 nt, hsa; identical to SEQ ID NO: 214533

SEQ ID NO: 295603 - RNA, 64 nt, hsa; identical to SEQ ID NO: 214534

SEQ ID NO: 295604 - RNA, 64 nt, hsa; identical to SEQ ID NO: 214535

SEQ ID NO: 295605 - RNA, 64 nt, hsa; identical to SEQ ID NO: 214536

SEQ ID NO: 295606 - RNA, 64 nt, hsa; identical to SEQ ID NO: 214537

SEQ ID NO: 295607 - RNA, 64 nt, hsa; identical to SEQ ID NO: 214538

SEQ ID NO: 295608 - RNA, 64 nt, hsa; identical to SEQ ID NO: 214539

SEQ ID NO: 295609 - RNA, 64 nt, hsa; identical to SEQ ID NO: 214540

SEQ ID NO: 295610 - RNA, 62 nt, hsa; identical to SEQ ID NO: 214541

SEQ ID NO: 295611 - RNA, 62 nt, hsa; identical to SEQ ID NO: 214542

SEQ ID NO: 295612 - RNA, 62 nt, hsa; identical to SEQ ID NO: 214543

SEQ ID NO: 295613 - RNA, 62 nt, hsa; identical to SEQ ID NO: 214544

SEQ ID NO: 295614 - RNA, 62 nt, hsa; identical to SEQ ID NO: 214545

SEQ ID NO: 295615 - RNA, 62 nt, hsa; identical to SEQ ID NO: 214546

SEQ ID NO: 295616 - RNA, 62 nt, hsa; identical to SEQ ID NO: 214547

SEQ ID NO: 295617 - RNA, 62 nt, hsa; identical to SEQ ID NO: 214548

SEQ ID NO: 295618 - RNA, 62 nt, hsa; identical to SEQ ID NO: 214549

SEQ ID NO: 295619 - RNA, 62 nt, hsa; identical to SEQ ID NO: 214550

SEQ ID NO: 295620 - RNA, 62 nt, hsa; identical to SEQ ID NO: 214551

SEQ ID NO: 295621 - RNA, 62 nt, hsa; identical to SEQ ID NO: 214552

SEQ ID NO: 295622 - RNA, 62 nt, hsa; identical to SEQ ID NO: 214553

SEQ ID NO: 295623 - RNA, 62 nt, hsa; identical to SEQ ID NO: 214554

SEQ ID NO: 295624 - RNA, 62 nt, hsa; identical to SEQ ID NO: 214555

SEQ ID NO: 295625 - RNA, 62 nt, hsa; identical to SEQ ID NO: 214556

SEQ ID NO: 295626 - RNA, 62 nt, hsa; identical to SEQ ID NO: 214557

SEQ ID NO: 295627 - RNA, 62 nt, hsa; identical to SEQ ID NO: 214558

SEQ ID NO: 295628 - RNA, 62 nt, hsa; identical to SEQ ID NO: 214559

SEQ ID NO: 295629 - RNA, 62 nt, hsa; identical to SEQ ID NO: 214560

SEQ ID NO: 295630 - RNA, 62 nt, hsa; identical to SEQ ID NO: 214561

SEQ ID NO: 295631 - RNA, 54 nt, hsa; identical to SEQ ID NO: 214562

SEQ ID NO: 295632 - RNA, 62 nt, hsa; identical to SEQ ID NO: 214563

SEQ ID NO: 295633 - RNA, 62 nt, hsa; identical to SEQ ID NO: 214564

SEQ ID NO: 295634 - RNA, 62 nt, hsa; identical to SEQ ID NO: 214565

SEQ ID NO: 295635 - RNA, 62 nt, hsa; identical to SEQ ID NO: 214566

SEQ ID NO: 295636 - RNA, 62 nt, hsa; identical to SEQ ID NO: 214567

SEQ ID NO: 295637 - RNA, 62 nt, hsa; identical to SEQ ID NO: 214568

SEQ ID NO: 295638 - RNA, 62 nt, hsa; identical to SEQ ID NO: 214569

SEQ ID NO: 295639 - RNA, 62 nt, hsa; identical to SEQ ID NO: 214570

SEQ ID NO: 295640 - RNA, 62 nt, hsa; identical to SEQ ID NO: 214571

SEQ ID NO: 295641 - RNA, 62 nt, hsa; identical to SEQ ID NO: 214572

SEQ ID NO: 295642 - RNA, 62 nt, hsa; identical to SEQ ID NO: 214573

SEQ ID NO: 295643 - RNA, 62 nt, hsa; identical to SEQ ID NO: 214574

SEQ ID NO: 295644 - RNA, 62 nt, hsa; identical to SEQ ID NO: 214575

SEQ ID NO: 295645 - RNA, 62 nt, hsa; identical to SEQ ID NO: 214576

SEQ ID NO: 295646 - RNA, 62 nt, hsa; identical to SEQ ID NO: 214577

SEQ ID NO: 295647 - RNA, 62 nt, hsa; identical to SEQ ID NO: 214578

SEQ ID NO: 295648 - RNA, 62 nt, hsa; identical to SEQ ID NO: 214579

SEQ ID NO: 295649 - RNA, 62 nt, hsa; identical to SEQ ID NO: 214580

SEQ ID NO: 295650 - RNA, 62 nt, hsa; identical to SEQ ID NO: 214581

SEQ ID NO: 295651 - RNA, 62 nt, hsa; identical to SEQ ID NO: 214582

SEQ ID NO: 295652 - RNA, 62 nt, hsa; identical to SEQ ID NO: 214583

SEQ ID NO: 295653 - RNA, 62 nt, hsa; identical to SEQ ID NO: 214584

SEQ ID NO: 295654 - RNA, 62 nt, hsa; identical to SEQ ID NO: 214585

SEQ ID NO: 295655 - RNA, 62 nt, hsa; identical to SEQ ID NO: 214586

SEQ ID NO: 295656 - RNA, 62 nt, hsa; identical to SEQ ID NO: 214587

SEQ ID NO: 295657 - RNA, 62 nt, hsa; identical to SEQ ID NO: 214588

SEQ ID NO: 295658 - RNA, 62 nt, hsa; identical to SEQ ID NO: 214589

SEQ ID NO: 295659 - RNA, 62 nt, hsa; identical to SEQ ID NO: 214590

SEQ ID NO: 295660 - RNA, 62 nt, hsa; identical to SEQ ID NO: 214591

SEQ ID NO: 295661 - RNA, 62 nt, hsa; identical to SEQ ID NO: 214592

SEQ ID NO: 295662 - RNA, 62 nt, hsa; identical to SEQ ID NO: 214593

SEQ ID NO: 295663 - RNA, 62 nt, hsa; identical to SEQ ID NO: 214594

SEQ ID NO: 295664 - RNA, 62 nt, hsa; identical to SEQ ID NO: 214595

SEQ ID NO: 295665 - RNA, 62 nt, hsa; identical to SEQ ID NO: 214596

SEQ ID NO: 295666 - RNA, 62 nt, hsa; identical to SEQ ID NO: 214597

SEQ ID NO: 295667 - RNA, 62 nt, hsa; identical to SEQ ID NO: 214598

SEQ ID NO: 295668 - RNA, 62 nt, hsa; identical to SEQ ID NO: 214599

SEQ ID NO: 295669 - RNA, 62 nt, hsa; identical to SEQ ID NO: 214600

SEQ ID NO: 295670 - RNA, 62 nt, hsa; identical to SEQ ID NO: 214601

SEQ ID NO: 295671 - RNA, 62 nt, hsa; identical to SEQ ID NO: 214602

SEQ ID NO: 295672 - RNA, 62 nt, hsa; identical to SEQ ID NO: 214603

SEQ ID NO: 295673 - RNA, 62 nt, hsa; identical to SEQ ID NO: 214604

SEQ ID NO: 295674 - RNA, 62 nt, hsa; identical to SEQ ID NO: 214605

SEQ ID NO: 295675 - RNA, 62 nt, hsa; identical to SEQ ID NO: 214606

SEQ ID NO: 295676 - RNA, 62 nt, hsa; identical to SEQ ID NO: 214607

SEQ ID NO: 295677 - RNA, 62 nt, hsa; identical to SEQ ID NO: 214608

SEQ ID NO: 295678 - RNA, 62 nt, hsa; identical to SEQ ID NO: 214609

SEQ ID NO: 295679 - RNA, 62 nt, hsa; identical to SEQ ID NO: 214610

SEQ ID NO: 295680 - RNA, 62 nt, hsa; identical to SEQ ID NO: 214611

SEQ ID NO: 295681 - RNA, 62 nt, hsa; identical to SEQ ID NO: 214612

SEQ ID NO: 295682 - RNA, 62 nt, hsa; identical to SEQ ID NO: 214613

SEQ ID NO: 295683 - RNA, 62 nt, hsa; identical to SEQ ID NO: 214614

SEQ ID NO: 295684 - RNA, 62 nt, hsa; identical to SEQ ID NO: 214615

SEQ ID NO: 295685 - RNA, 62 nt, hsa; identical to SEQ ID NO: 214616

SEQ ID NO: 295686 - RNA, 62 nt, hsa; identical to SEQ ID NO: 214617

SEQ ID NO: 295687 - RNA, 62 nt, hsa; identical to SEQ ID NO: 214618

SEQ ID NO: 295688 - RNA, 62 nt, hsa; identical to SEQ ID NO: 214619

SEQ ID NO: 295689 - RNA, 62 nt, hsa; identical to SEQ ID NO: 214620

SEQ ID NO: 295690 - RNA, 62 nt, hsa; identical to SEQ ID NO: 214621

SEQ ID NO: 295691 - RNA, 62 nt, hsa; identical to SEQ ID NO: 214622

SEQ ID NO: 295692 - RNA, 62 nt, hsa; identical to SEQ ID NO: 214623

SEQ ID NO: 295693 - RNA, 62 nt, hsa; identical to SEQ ID NO: 214624

SEQ ID NO: 295694 - RNA, 62 nt, hsa; identical to SEQ ID NO: 214625

SEQ ID NO: 295695 - RNA, 62 nt, hsa; identical to SEQ ID NO: 214626

SEQ ID NO: 295696 - RNA, 62 nt, hsa; identical to SEQ ID NO: 214627

SEQ ID NO: 295697 - RNA, 62 nt, hsa; identical to SEQ ID NO: 214628

SEQ ID NO: 295698 - RNA, 62 nt, hsa; identical to SEQ ID NO: 214629

SEQ ID NO: 295699 - RNA, 62 nt, hsa; identical to SEQ ID NO: 214630

SEQ ID NO: 295700 - RNA, 62 nt, hsa; identical to SEQ ID NO: 214631

SEQ ID NO: 295701 - RNA, 62 nt, hsa; identical to SEQ ID NO: 214632

SEQ ID NO: 295702 - RNA, 62 nt, hsa; identical to SEQ ID NO: 214633

SEQ ID NO: 295703 - RNA, 62 nt, hsa; identical to SEQ ID NO: 214634

SEQ ID NO: 295704 - RNA, 62 nt, hsa; identical to SEQ ID NO: 214635

SEQ ID NO: 295705 - RNA, 62 nt, hsa; identical to SEQ ID NO: 214636

SEQ ID NO: 295706 - RNA, 62 nt, hsa; identical to SEQ ID NO: 214637

SEQ ID NO: 295707 - RNA, 62 nt, hsa; identical to SEQ ID NO: 214638

SEQ ID NO: 295708 - RNA, 62 nt, hsa; identical to SEQ ID NO: 214639

SEQ ID NO: 295709 - RNA, 62 nt, hsa; identical to SEQ ID NO: 214640

SEQ ID NO: 295710 - RNA, 62 nt, hsa; identical to SEQ ID NO: 214641

SEQ ID NO: 295711 - RNA, 62 nt, hsa; identical to SEQ ID NO: 214642

SEQ ID NO: 295712 - RNA, 62 nt, hsa; identical to SEQ ID NO: 214643

SEQ ID NO: 295713 - RNA, 62 nt, hsa; identical to SEQ ID NO: 214644

SEQ ID NO: 295714 - RNA, 62 nt, hsa; identical to SEQ ID NO: 214645

SEQ ID NO: 295715 - RNA, 62 nt, hsa; identical to SEQ ID NO: 214646

SEQ ID NO: 295716 - RNA, 62 nt, hsa; identical to SEQ ID NO: 214647

SEQ ID NO: 295717 - RNA, 62 nt, hsa; identical to SEQ ID NO: 214648

SEQ ID NO: 295718 - RNA, 62 nt, hsa; identical to SEQ ID NO: 214649

SEQ ID NO: 295719 - RNA, 62 nt, hsa; identical to SEQ ID NO: 214650

SEQ ID NO: 295720 - RNA, 62 nt, hsa; identical to SEQ ID NO: 214651

SEQ ID NO: 295721 - RNA, 62 nt, hsa; identical to SEQ ID NO: 214652

SEQ ID NO: 295722 - RNA, 62 nt, hsa; identical to SEQ ID NO: 214653

SEQ ID NO: 295723 - RNA, 62 nt, hsa; identical to SEQ ID NO: 214654

SEQ ID NO: 295724 - RNA, 62 nt, hsa; identical to SEQ ID NO: 214655

SEQ ID NO: 295725 - RNA, 62 nt, hsa; identical to SEQ ID NO: 214656

SEQ ID NO: 295726 - RNA, 62 nt, hsa; identical to SEQ ID NO: 214657

SEQ ID NO: 295727 - RNA, 62 nt, hsa; identical to SEQ ID NO: 214658

SEQ ID NO: 295728 - RNA, 62 nt, hsa; identical to SEQ ID NO: 214659

SEQ ID NO: 295729 - RNA, 62 nt, hsa; identical to SEQ ID NO: 214660

SEQ ID NO: 295730 - RNA, 62 nt, hsa; identical to SEQ ID NO: 214661

SEQ ID NO: 295731 - RNA, 62 nt, hsa; identical to SEQ ID NO: 214662

SEQ ID NO: 295732 - RNA, 62 nt, hsa; identical to SEQ ID NO: 214663

SEQ ID NO: 295733 - RNA, 62 nt, hsa; identical to SEQ ID NO: 214664

SEQ ID NO: 295734 - RNA, 62 nt, hsa; identical to SEQ ID NO: 214665

SEQ ID NO: 295735 - RNA, 62 nt, hsa; identical to SEQ ID NO: 214666

SEQ ID NO: 295736 - RNA, 62 nt, hsa; identical to SEQ ID NO: 214667

SEQ ID NO: 295737 - RNA, 62 nt, hsa; identical to SEQ ID NO: 214668

SEQ ID NO: 295738 - RNA, 62 nt, hsa; identical to SEQ ID NO: 214669

SEQ ID NO: 295739 - RNA, 62 nt, hsa; identical to SEQ ID NO: 214670

SEQ ID NO: 295740 - RNA, 62 nt, hsa; identical to SEQ ID NO: 214671

SEQ ID NO: 295741 - RNA, 61 nt, hsa; identical to SEQ ID NO: 214672

SEQ ID NO: 295742 - RNA, 61 nt, hsa; identical to SEQ ID NO: 214673

SEQ ID NO: 295743 - RNA, 61 nt, hsa; identical to SEQ ID NO: 214674

SEQ ID NO: 295744 - RNA, 61 nt, hsa; identical to SEQ ID NO: 214675

SEQ ID NO: 295745 - RNA, 61 nt, hsa; identical to SEQ ID NO: 214676

SEQ ID NO: 295746 - RNA, 61 nt, hsa; identical to SEQ ID NO: 214677

SEQ ID NO: 295747 - RNA, 61 nt, hsa; identical to SEQ ID NO: 214678

SEQ ID NO: 295748 - RNA, 61 nt, hsa; identical to SEQ ID NO: 214679

SEQ ID NO: 295749 - RNA, 61 nt, hsa; identical to SEQ ID NO: 214680

SEQ ID NO: 295750 - RNA, 61 nt, hsa; identical to SEQ ID NO: 214681

SEQ ID NO: 295751 - RNA, 61 nt, hsa; identical to SEQ ID NO: 214682

SEQ ID NO: 295752 - RNA, 61 nt, hsa; identical to SEQ ID NO: 214683

SEQ ID NO: 295753 - RNA, 61 nt, hsa; identical to SEQ ID NO: 214684

SEQ ID NO: 295754 - RNA, 55 nt, hsa; identical to SEQ ID NO: 214685

SEQ ID NO: 295755 - RNA, 61 nt, hsa; identical to SEQ ID NO: 214686

SEQ ID NO: 295756 - RNA, 61 nt, hsa; identical to SEQ ID NO: 214687

SEQ ID NO: 295757 - RNA, 61 nt, hsa; identical to SEQ ID NO: 214688

SEQ ID NO: 295758 - RNA, 61 nt, hsa; identical to SEQ ID NO: 214689

SEQ ID NO: 295759 - RNA, 61 nt, hsa; identical to SEQ ID NO: 214690

SEQ ID NO: 295760 - RNA, 61 nt, hsa; identical to SEQ ID NO: 214691

SEQ ID NO: 295761 - RNA, 61 nt, hsa; identical to SEQ ID NO: 214692

SEQ ID NO: 295762 - RNA, 61 nt, hsa; identical to SEQ ID NO: 214693

SEQ ID NO: 295763 - RNA, 61 nt, hsa; identical to SEQ ID NO: 214694

SEQ ID NO: 295764 - RNA, 61 nt, hsa; identical to SEQ ID NO: 214695

SEQ ID NO: 295765 - RNA, 61 nt, hsa; identical to SEQ ID NO: 214696

SEQ ID NO: 295766 - RNA, 61 nt, hsa; identical to SEQ ID NO: 214697

SEQ ID NO: 295767 - RNA, 61 nt, hsa; identical to SEQ ID NO: 214698

SEQ ID NO: 295768 - RNA, 61 nt, hsa; identical to SEQ ID NO: 214699

SEQ ID NO: 295769 - RNA, 61 nt, hsa; identical to SEQ ID NO: 214700

SEQ ID NO: 295770 - RNA, 61 nt, hsa; identical to SEQ ID NO: 214701

SEQ ID NO: 295771 - RNA, 61 nt, hsa; identical to SEQ ID NO: 214702

SEQ ID NO: 295772 - RNA, 61 nt, hsa; identical to SEQ ID NO: 214703

SEQ ID NO: 295773 - RNA, 61 nt, hsa; identical to SEQ ID NO: 214704

SEQ ID NO: 295774 - RNA, 61 nt, hsa; identical to SEQ ID NO: 214705

SEQ ID NO: 295775 - RNA, 61 nt, hsa; identical to SEQ ID NO: 214706

SEQ ID NO: 295776 - RNA, 61 nt, hsa; identical to SEQ ID NO: 214707

SEQ ID NO: 295777 - RNA, 61 nt, hsa; identical to SEQ ID NO: 214708

SEQ ID NO: 295778 - RNA, 61 nt, hsa; identical to SEQ ID NO: 214709

SEQ ID NO: 295779 - RNA, 61 nt, hsa; identical to SEQ ID NO: 214710

SEQ ID NO: 295780 - RNA, 61 nt, hsa; identical to SEQ ID NO: 214711

SEQ ID NO: 295781 - RNA, 61 nt, hsa; identical to SEQ ID NO: 214712

SEQ ID NO: 295782 - RNA, 61 nt, hsa; identical to SEQ ID NO: 214713

SEQ ID NO: 295783 - RNA, 61 nt, hsa; identical to SEQ ID NO: 214714

SEQ ID NO: 295784 - RNA, 61 nt, hsa; identical to SEQ ID NO: 214715

SEQ ID NO: 295785 - RNA, 61 nt, hsa; identical to SEQ ID NO: 214716

SEQ ID NO: 295786 - RNA, 61 nt, hsa; identical to SEQ ID NO: 214717

SEQ ID NO: 295787 - RNA, 61 nt, hsa; identical to SEQ ID NO: 214718

SEQ ID NO: 295788 - RNA, 61 nt, hsa; identical to SEQ ID NO: 214719

SEQ ID NO: 295789 - RNA, 61 nt, hsa; identical to SEQ ID NO: 214720

SEQ ID NO: 295790 - RNA, 61 nt, hsa; identical to SEQ ID NO: 214721

SEQ ID NO: 295791 - RNA, 61 nt, hsa; identical to SEQ ID NO: 214722

SEQ ID NO: 295792 - RNA, 61 nt, hsa; identical to SEQ ID NO: 214723

SEQ ID NO: 295793 - RNA, 61 nt, hsa; identical to SEQ ID NO: 214724

SEQ ID NO: 295794 - RNA, 61 nt, hsa; identical to SEQ ID NO: 214725

SEQ ID NO: 295795 - RNA, 61 nt, hsa; identical to SEQ ID NO: 214726

SEQ ID NO: 295796 - RNA, 61 nt, hsa; identical to SEQ ID NO: 214727

SEQ ID NO: 295797 - RNA, 61 nt, hsa; identical to SEQ ID NO: 214728

SEQ ID NO: 295798 - RNA, 61 nt, hsa; identical to SEQ ID NO: 214729

SEQ ID NO: 295799 - RNA, 61 nt, hsa; identical to SEQ ID NO: 214730

SEQ ID NO: 295800 - RNA, 61 nt, hsa; identical to SEQ ID NO: 214731

SEQ ID NO: 295801 - RNA, 61 nt, hsa; identical to SEQ ID NO: 214732

SEQ ID NO: 295802 - RNA, 61 nt, hsa; identical to SEQ ID NO: 214733

SEQ ID NO: 295803 - RNA, 61 nt, hsa; identical to SEQ ID NO: 214734

SEQ ID NO: 295804 - RNA, 61 nt, hsa; identical to SEQ ID NO: 214735

SEQ ID NO: 295805 - RNA, 61 nt, hsa; identical to SEQ ID NO: 214736

SEQ ID NO: 295806 - RNA, 61 nt, hsa; identical to SEQ ID NO: 214737

SEQ ID NO: 295807 - RNA, 61 nt, hsa; identical to SEQ ID NO: 214738

SEQ ID NO: 295808 - RNA, 61 nt, hsa; identical to SEQ ID NO: 214739

SEQ ID NO: 295809 - RNA, 61 nt, hsa; identical to SEQ ID NO: 214740

SEQ ID NO: 295810 - RNA, 61 nt, hsa; identical to SEQ ID NO: 214741

SEQ ID NO: 295811 - RNA, 61 nt, hsa; identical to SEQ ID NO: 214742

SEQ ID NO: 295812 - RNA, 61 nt, hsa; identical to SEQ ID NO: 214743

SEQ ID NO: 295813 - RNA, 61 nt, hsa; identical to SEQ ID NO: 214744

SEQ ID NO: 295814 - RNA, 61 nt, hsa; identical to SEQ ID NO: 214745

SEQ ID NO: 295815 - RNA, 61 nt, hsa; identical to SEQ ID NO: 214746

SEQ ID NO: 295816 - RNA, 61 nt, hsa; identical to SEQ ID NO: 214747

SEQ ID NO: 295817 - RNA, 61 nt, hsa; identical to SEQ ID NO: 214748

SEQ ID NO: 295818 - RNA, 61 nt, hsa; identical to SEQ ID NO: 214749

SEQ ID NO: 295819 - RNA, 61 nt, hsa; identical to SEQ ID NO: 214750

SEQ ID NO: 295820 - RNA, 61 nt, hsa; identical to SEQ ID NO: 214751

SEQ ID NO: 295821 - RNA, 61 nt, hsa; identical to SEQ ID NO: 214752

SEQ ID NO: 295822 - RNA, 61 nt, hsa; identical to SEQ ID NO: 214753

SEQ ID NO: 295823 - RNA, 61 nt, hsa; identical to SEQ ID NO: 214754

SEQ ID NO: 295824 - RNA, 61 nt, hsa; identical to SEQ ID NO: 214755

SEQ ID NO: 295825 - RNA, 61 nt, hsa; identical to SEQ ID NO: 214756

SEQ ID NO: 295826 - RNA, 61 nt, hsa; identical to SEQ ID NO: 214757

SEQ ID NO: 295827 - RNA, 61 nt, hsa; identical to SEQ ID NO: 214758

SEQ ID NO: 295828 - RNA, 61 nt, hsa; identical to SEQ ID NO: 214759

SEQ ID NO: 295829 - RNA, 61 nt, hsa; identical to SEQ ID NO: 214760

SEQ ID NO: 295830 - RNA, 61 nt, hsa; identical to SEQ ID NO: 214761

SEQ ID NO: 295831 - RNA, 61 nt, hsa; identical to SEQ ID NO: 214762

SEQ ID NO: 295832 - RNA, 61 nt, hsa; identical to SEQ ID NO: 214763

SEQ ID NO: 295833 - RNA, 61 nt, hsa; identical to SEQ ID NO: 214764

SEQ ID NO: 295834 - RNA, 61 nt, hsa; identical to SEQ ID NO: 214765

SEQ ID NO: 295835 - RNA, 61 nt, hsa; identical to SEQ ID NO: 214766

SEQ ID NO: 295836 - RNA, 61 nt, hsa; identical to SEQ ID NO: 214767

SEQ ID NO: 295837 - RNA, 61 nt, hsa; identical to SEQ ID NO: 214768

SEQ ID NO: 295838 - RNA, 61 nt, hsa; identical to SEQ ID NO: 214769

SEQ ID NO: 295839 - RNA, 61 nt, hsa; identical to SEQ ID NO: 214770

SEQ ID NO: 295840 - RNA, 61 nt, hsa; identical to SEQ ID NO: 214771

SEQ ID NO: 295841 - RNA, 61 nt, hsa; identical to SEQ ID NO: 214772

SEQ ID NO: 295842 - RNA, 61 nt, hsa; identical to SEQ ID NO: 214773

SEQ ID NO: 295843 - RNA, 61 nt, hsa; identical to SEQ ID NO: 214774

SEQ ID NO: 295844 - RNA, 61 nt, hsa; identical to SEQ ID NO: 214775

SEQ ID NO: 295845 - RNA, 61 nt, hsa; identical to SEQ ID NO: 214776

SEQ ID NO: 295846 - RNA, 61 nt, hsa; identical to SEQ ID NO: 214777

SEQ ID NO: 295847 - RNA, 61 nt, hsa; identical to SEQ ID NO: 214778

SEQ ID NO: 295848 - RNA, 61 nt, hsa; identical to SEQ ID NO: 214779

SEQ ID NO: 295849 - RNA, 61 nt, hsa; identical to SEQ ID NO: 214780

SEQ ID NO: 295850 - RNA, 61 nt, hsa; identical to SEQ ID NO: 214781

SEQ ID NO: 295851 - RNA, 61 nt, hsa; identical to SEQ ID NO: 214782

SEQ ID NO: 295852 - RNA, 61 nt, hsa; identical to SEQ ID NO: 214783

SEQ ID NO: 295853 - RNA, 58 nt, hsa; identical to SEQ ID NO: 214784

SEQ ID NO: 295854 - RNA, 61 nt, hsa; identical to SEQ ID NO: 214785

SEQ ID NO: 295855 - RNA, 61 nt, hsa; identical to SEQ ID NO: 214786

SEQ ID NO: 295856 - RNA, 61 nt, hsa; identical to SEQ ID NO: 214787

SEQ ID NO: 295857 - RNA, 61 nt, hsa; identical to SEQ ID NO: 214788

SEQ ID NO: 295858 - RNA, 61 nt, hsa; identical to SEQ ID NO: 214789

SEQ ID NO: 295859 - RNA, 61 nt, hsa; identical to SEQ ID NO: 214790

SEQ ID NO: 295860 - RNA, 61 nt, hsa; identical to SEQ ID NO: 214791

SEQ ID NO: 295861 - RNA, 61 nt, hsa; identical to SEQ ID NO: 214792

SEQ ID NO: 295862 - RNA, 61 nt, hsa; identical to SEQ ID NO: 214793

SEQ ID NO: 295863 - RNA, 61 nt, hsa; identical to SEQ ID NO: 214794

SEQ ID NO: 295864 - RNA, 61 nt, hsa; identical to SEQ ID NO: 214795

SEQ ID NO: 295865 - RNA, 61 nt, hsa; identical to SEQ ID NO: 214796

SEQ ID NO: 295866 - RNA, 61 nt, hsa; identical to SEQ ID NO: 214797

SEQ ID NO: 295867 - RNA, 61 nt, hsa; identical to SEQ ID NO: 214798

SEQ ID NO: 295868 - RNA, 61 nt, hsa; identical to SEQ ID NO: 214799

SEQ ID NO: 295869 - RNA, 61 nt, hsa; identical to SEQ ID NO: 214800

SEQ ID NO: 295870 - RNA, 61 nt, hsa; identical to SEQ ID NO: 214801

SEQ ID NO: 295871 - RNA, 61 nt, hsa; identical to SEQ ID NO: 214802

SEQ ID NO: 295872 - RNA, 61 nt, hsa; identical to SEQ ID NO: 214803

SEQ ID NO: 295873 - RNA, 61 nt, hsa; identical to SEQ ID NO: 214804

SEQ ID NO: 295874 - RNA, 61 nt, hsa; identical to SEQ ID NO: 214805

SEQ ID NO: 295875 - RNA, 61 nt, hsa; identical to SEQ ID NO: 214806

SEQ ID NO: 295876 - RNA, 61 nt, hsa; identical to SEQ ID NO: 214807

SEQ ID NO: 295877 - RNA, 61 nt, hsa; identical to SEQ ID NO: 214808

SEQ ID NO: 295878 - RNA, 61 nt, hsa; identical to SEQ ID NO: 214809

SEQ ID NO: 295879 - RNA, 61 nt, hsa; identical to SEQ ID NO: 214810

SEQ ID NO: 295880 - RNA, 61 nt, hsa; identical to SEQ ID NO: 214811

SEQ ID NO: 295881 - RNA, 61 nt, hsa; identical to SEQ ID NO: 214812

SEQ ID NO: 295882 - RNA, 61 nt, hsa; identical to SEQ ID NO: 214813

SEQ ID NO: 295883 - RNA, 61 nt, hsa; identical to SEQ ID NO: 214814

SEQ ID NO: 295884 - RNA, 61 nt, hsa; identical to SEQ ID NO: 214815

SEQ ID NO: 295885 - RNA, 61 nt, hsa; identical to SEQ ID NO: 214816

SEQ ID NO: 295886 - RNA, 61 nt, hsa; identical to SEQ ID NO: 214817

SEQ ID NO: 295887 - RNA, 61 nt, hsa; identical to SEQ ID NO: 214818

SEQ ID NO: 295888 - RNA, 61 nt, hsa; identical to SEQ ID NO: 214819

SEQ ID NO: 295889 - RNA, 61 nt, hsa; identical to SEQ ID NO: 214820

SEQ ID NO: 295890 - RNA, 61 nt, hsa; identical to SEQ ID NO: 214821

SEQ ID NO: 295891 - RNA, 61 nt, hsa; identical to SEQ ID NO: 214822

SEQ ID NO: 295892 - RNA, 61 nt, hsa; identical to SEQ ID NO: 214823

SEQ ID NO: 295893 - RNA, 61 nt, hsa; identical to SEQ ID NO: 214824

SEQ ID NO: 295894 - RNA, 61 nt, hsa; identical to SEQ ID NO: 214825

SEQ ID NO: 295895 - RNA, 58 nt, hsa; identical to SEQ ID NO: 214826

SEQ ID NO: 295896 - RNA, 61 nt, hsa; identical to SEQ ID NO: 214827

SEQ ID NO: 295897 - RNA, 61 nt, hsa; identical to SEQ ID NO: 214828

SEQ ID NO: 295898 - RNA, 61 nt, hsa; identical to SEQ ID NO: 214829

SEQ ID NO: 295899 - RNA, 61 nt, hsa; identical to SEQ ID NO: 214830

SEQ ID NO: 295900 - RNA, 61 nt, hsa; identical to SEQ ID NO: 214831

SEQ ID NO: 295901 - RNA, 61 nt, hsa; identical to SEQ ID NO: 214832

SEQ ID NO: 295902 - RNA, 61 nt, hsa; identical to SEQ ID NO: 214833

SEQ ID NO: 295903 - RNA, 61 nt, hsa; identical to SEQ ID NO: 214834

SEQ ID NO: 295904 - RNA, 61 nt, hsa; identical to SEQ ID NO: 214835

SEQ ID NO: 295905 - RNA, 61 nt, hsa; identical to SEQ ID NO: 214836

SEQ ID NO: 295906 - RNA, 61 nt, hsa; identical to SEQ ID NO: 214837

SEQ ID NO: 295907 - RNA, 61 nt, hsa; identical to SEQ ID NO: 214838

SEQ ID NO: 295908 - RNA, 61 nt, hsa; identical to SEQ ID NO: 214839

SEQ ID NO: 295909 - RNA, 64 nt, hsa
aguagauaucuuaaauucaauaaaaucacuggaaguuuuucaugauaacuuauuuuaagaugcc

SEQ ID NO: 295910 - RNA, 64 nt, hsa
aagguauuguauuucaacaauggacuaugccuugguuuuucacuaaucaaaaucaaaauuacuc

SEQ ID NO: 295911 - RNA, 64 nt, hsa
caucuuugugguuuaguuuauuuacucacuucauguuuuucaccuauaaaauugucaagcuagc

SEQ ID NO: 295912 - RNA, 64 nt, hsa
uaaagugcauuuuuaaauuuccucuacuuaauuuguuuuucagagauaaggaaaaauauuuugc

SEQ ID NO: 295913 - RNA, 64 nt, hsa
uuucaccccuuggcuuuauuuuauauaaacuuuuguuuuucagcaguucugaacuuuuuaguau

SEQ ID NO: 295914 - RNA, 64 nt, hsa
uauuuggcuuuagaugguuuuaauacauuugauaguuuuucaccccuuggcuuuauuuuauaua

SEQ ID NO: 295915 - RNA, 64 nt, hsa
uauucuuuguuuuaccuguggucaucuuaaacugguuuuucagucccucuccacuuccuucaga

SEQ ID NO: 295916 - RNA, 64 nt, hsa
auuuggacaacucaaauccaucaacaugaccaauguuuuucaucugccacaucucaaaauaaaa

SEQ ID NO: 295917 - RNA, 64 nt, hsa
cagccaccacgccuggccugauaguuuccacauaguuuuucaugacuuagaagauaucauugcc

SEQ ID NO: 295918 - RNA, 64 nt, hsa
gaggaaaaauaguucaaggaguuuuugccucuuuguuuuucaauagauuauucugccauuuuuu

SEQ ID NO: 295919 - RNA, 64 nt, hsa
ggaacauuacugcuaaucugcuguuaagugaacgguuuuucauuuuacccuuuuguuuuucagu

SEQ ID NO: 295920 - RNA, 64 nt, hsa
cuguuaagugaacgguuuuucauuuuacccuuuuguuuuucaguccagguuggagaucguagcu

SEQ ID NO: 295921 - RNA, 64 nt, hsa
uguuacaguuuucuucaucaaugagugugauccaguuuuucauaagauauuuuauuuugaaaug

SEQ ID NO: 295922 - RNA, 64 nt, hsa
cgacuuguucuugauagccucauuaaagcauuugguuuuucacauagugguggccuauuguguu

SEQ ID NO: 295923 - RNA, 64 nt, hsa
ugugguagcaugugucacgaguuuuuguuuuuauguuuuucauugcugaguacugcuucauuga

SEQ ID NO: 295924 - RNA, 64 nt, hsa
ccccccacagauacggggacaacuuuaugacauuguuuuucaaccaaugaauguuuauaccuuu

SEQ ID NO: 295925 - RNA, 64 nt, hsa
gcucgugugcuccuuggccgcuuacuggaagggcguuuuucagagcugcagggacagggugagc

SEQ ID NO: 295926 - RNA, 64 nt, hsa
uccaaaauauguacauucagcuguuugguuuuucguuuuucauuguuauuauugugagaaugcu

SEQ ID NO: 295927 - RNA, 64 nt, hsa
guguguagccuguggaaagcccauucggaacaauguuuuucacuuggaggauggugaacccuac

SEQ ID NO: 295928 - RNA, 64 nt, hsa
ggaauugugaaucagaagauuauaccccccaauuguuuuucaauccccuuuucucaaauaauaa

SEQ ID NO: 295929 - RNA, 64 nt, hsa
aaaaucuaaauucuuuuguuacuuaaaaaaacauguuuuucauggcuauuacaauccucucucu

SEQ ID NO: 295930 - RNA, 64 nt, hsa
uuuucuacuuguuaaauggagggcauuuuguauuguuuuucaugguuguuaacauuguguaaua

SEQ ID NO: 295931 - RNA, 64 nt, hsa
cucccacuacaucaagacuaaucuuguuuuguguguuuuucacauguauuauagaaugcuuuug

SEQ ID NO: 295932 - RNA, 64 nt, hsa
accugucuuccuguuucucaagaauauuuacguaguuuuucauaggucuguuuuuccuuucaug

SEQ ID NO: 295933 - RNA, 64 nt, hsa
uguugugaguaaauaaaaaugugugcucuuuacuguuuuucauuuuuaaagaauauuauuaugg

SEQ ID NO: 295934 - RNA, 64 nt, hsa
auacauucuuuuaaaaaguauauuuguuauuuaaguuuuucagauaauaugugaccaauauacu

SEQ ID NO: 295935 - RNA, 64 nt, hsa
uaaguuguuuccaauacaauaaauaaaagcaucuguuuuucacuuuauaguguaucuuguucuu

SEQ ID NO: 295936 - RNA, 64 nt, hsa
guucuguuaaguucuuucauuuguuuguaauuuuguuuuucagcaaauuuauauuguuuugcua

SEQ ID NO: 295937 - RNA, 64 nt, hsa
uuuaaaauuucagauguaauuuaacaucacauuuguuuuucagguauugaguuuagaugccuac

SEQ ID NO: 295938 - RNA, 64 nt, hsa
agauaaguauuaagcgcuacccuaaaguguguaaguuuuucauuuugucauauugaaaaaugau

SEQ ID NO: 295939 - RNA, 64 nt, hsa
ccuuuaagcaucauuuaaauuuuaaaggaauggaguuuuucagccuguggcccagcacugguca

SEQ ID NO: 295940 - RNA, 64 nt, hsa
ggaccaaauuaaaacauuuugcugaauauguauaguuuuucacaauuucauuagguaaauaaug

SEQ ID NO: 295941 - RNA, 64 nt, hsa
gucccuaucauuucagcaaguggaacagcagcaaguuuuucagugcauaugcugcacaagaaca

SEQ ID NO: 295942 - RNA, 64 nt, hsa
cauuguacagacaugggaaacaaccaauuuuuuuguuuuucaguuguugcuaugaaugauuuug

SEQ ID NO: 295943 - RNA, 64 nt, hsa
auacuuguacuguauuuuguacuacaaggcagcuguuuuucaauaauguccugcuguauuuacc

SEQ ID NO: 295944 - RNA, 64 nt, hsa
uagaaucucuauccacguaucagguuauagacugguuuuucaaaagugaacaauccugugauaa

SEQ ID NO: 295945 - RNA, 64 nt, hsa
ucauauggucugauuagugacauaaguagcagccguuuuucaacuucaguuucauucacuacca

SEQ ID NO: 295946 - RNA, 64 nt, hsa
aguaguuuaaaucuuuuguuaaugcuccuccgaaguuuuucaggggguaaaaguaacaucagug

SEQ ID NO: 295947 - RNA, 64 nt, hsa
ccugcauauuuuuucuuaaauauuucccaauuguguuuuucauuauuucuuuucaauauauaac

SEQ ID NO: 295948 - RNA, 64 nt, hsa
ugauuucaguguuuaugacuuuaucuaggaguuuguuuuucauuuuguuuuuuuaaaguauuag

SEQ ID NO: 295949 - RNA, 64 nt, hsa
uguggcucauauuuaggaagcuauauaaaauucaguuuuucauuuaacauuugcucuuuugcau

SEQ ID NO: 295950 - RNA, 64 nt, hsa
uuugauggcggacuacauaagcguuaaaaauuguguuuuucagaaucuuuaaaauauaagacag

SEQ ID NO: 295951 - RNA, 64 nt, hsa
accugggcuuuucucuuuccucuucuccuaaccaguuuuucaccaaguccugugccauuucacc

SEQ ID NO: 295952 - RNA, 64 nt, hsa
gcccucaauuuucccccuuucauuugaaggaccaguuuuucaugguacuugucuugaucuuuuu

SEQ ID NO: 295953 - RNA, 64 nt, hsa
augcccguugggcaaacuuagguuuauguguuugguuuuucagcugacguggaagcccugggug

SEQ ID NO: 295954 - RNA, 64 nt, hsa
cuccucaacucuguugauauuuggggaaaauucuguuuuucauagauucuuugagaugcugaug

SEQ ID NO: 295955 - RNA, 64 nt, hsa
ggacuaacaccugguuugguacagagacugagaaguuuuucauucuggugucaaaguuuuguua

SEQ ID NO: 295956 - RNA, 64 nt, hsa
uuucagagaacaccuuuaucaaaggcaaauugcuguuuuucagucagcugccaccugcuucuca

SEQ ID NO: 295957 - RNA, 64 nt, hsa
auuuuacuguuucuggugcaugcaggguuuggguguuuuucaguguguauguguguguauaugu

SEQ ID NO: 295958 - RNA, 64 nt, hsa
ugaguggccuuagugaguuuguugaagugcacauguuuuucaagaguaaaauuuaagauuaaaa

SEQ ID NO: 295959 - RNA, 64 nt, hsa
guauguuugugguauaggaaugucaugguaaauuguuuuucaauaaauauuuugaaacauguuu

SEQ ID NO: 295960 - RNA, 64 nt, hsa
ugaacuugugcagccuuagccaagacaaagcaguguuuuucagcagacggcugaugggacagga

SEQ ID NO: 295961 - RNA, 64 nt, hsa
aaucugcagucuccugcugcaguucaacucugcuguuuuucagucauuuccuacugugagugga

SEQ ID NO: 295962 - RNA, 64 nt, hsa
cuccagcuaacuuccagggucucagcaaacugcuguuuuucacgaguaucaacuuucauacuga

SEQ ID NO: 295963 - RNA, 64 nt, hsa
ugugugugacauucucucaugggacaauguugggguuuuucagacugacaggacugcaagaggg

SEQ ID NO: 295964 - RNA, 64 nt, hsa
aagccaaauucuguuuacggugaaaaaggauuuuguuuuucacccaauuugggaggcgggaggg

SEQ ID NO: 295965 - RNA, 64 nt, hsa
auucuuaacucuuuacgccuaaugaacaagcacaguuuuucaauggugaagaaaaaagcaccag

SEQ ID NO: 295966 - RNA, 64 nt, hsa
gcaucuaaagauugauuagaaaguuugugcgcauguuuuucauuauaacaaugaaaacacaaaa

SEQ ID NO: 295967 - RNA, 64 nt, hsa
ggaaccuguuggcuaaccauuggggccuuacacuguuuuucaaaugguugcaacauuuaacuuc

SEQ ID NO: 295968 - RNA, 64 nt, hsa
ucugguucaacuuuguguaauaaaauggcgaguuguuuuucaguugucguggacccccagguug

SEQ ID NO: 295969 - RNA, 64 nt, hsa
ugccucucucuuccccauagcuuuucuaguuguuguuuuucaauaaaaguguccuccucuuucu

SEQ ID NO: 295970 - RNA, 64 nt, hsa
cuugucaguuuuuuuaaugaggcagggauacucuguuuuucacacuaaacauaugaaugcagca

SEQ ID NO: 295971 - RNA, 64 nt, hsa
aagaaauauuuggauguuaaauuaacucacuaugguuuuucaccugggaaggaaacaaauuacg

SEQ ID NO: 295972 - RNA, 64 nt, hsa
gcccaagagagcauccagaaggcaguaggaccugguuuuucagguacugggagccgggggcuca

SEQ ID NO: 295973 - RNA, 64 nt, hsa
auguuucuucaucucaucgccaagguaggcuuguguuuuucagugugugccuccccgagccuca

SEQ ID NO: 295974 - RNA, 64 nt, hsa
aacauaacuaugaaaaaacuuugcuaauaucuguguuuuucagauuucauuuuuuguaaaauca

SEQ ID NO: 295975 - RNA, 64 nt, hsa
ggauaaaguaugguuuuauuuugguguaauuuagguuuuucaacaaagcccuugucuaaaauaa

SEQ ID NO: 295976 - RNA, 64 nt, hsa
agaaaugucucaaaugucucguaucaguuuuaguguuuuucaguauuagggaaagguaauauaa

SEQ ID NO: 295977 - RNA, 64 nt, hsa
gugauucacuuuaaccugaugguuugcauuugcuguuuuucacucuuaugucagagcaguuggg

SEQ ID NO: 295978 - RNA, 64 nt, hsa
aacuguuagaucucuuuaguaaacauacaaauguguuuuucaguaggcuucaauuacaaacagu

SEQ ID NO: 295979 - RNA, 64 nt, hsa
gugccuaagcaaaaggacaggcuguccaagguagaaacuguacauagccggugaccgaaugcga

SEQ ID NO: 295980 - RNA, 64 nt, hsa
aaguuuauguguauaaagcgaagcuguuucugugaaacuguauauuuuguaaauaaauauauug

SEQ ID NO: 295981 - RNA, 64 nt, hsa
auuuugaaauuuguuucuguuuuguuuuuaaaucaaacuguaaaacuuaaaacugaaaaauuuu

SEQ ID NO: 295982 - RNA, 64 nt, hsa
cuguagagugaggaauaucuauacaaaauguacgaaacuguaugauuaagcaacacaagacacc

SEQ ID NO: 295983 - RNA, 64 nt, hsa
caguuacaguuuccaggaaacaucaggaaguaggaaacuguagggccagagaguaguacaacgu

SEQ ID NO: 295984 - RNA, 64 nt, hsa
uuuucuuuuucucuaagguucuuuuuuuuuauucaaacuguaugaaauggcaaagugaggcucu

SEQ ID NO: 295985 - RNA, 64 nt, hsa
cuauaccguaucuuucuagcacaaggaaauagauaaacuguaaggucuuuuuuacucacuuuuu

SEQ ID NO: 295986 - RNA, 64 nt, hsa
aauaaaauaugaaauauuagucauguuaauuaauaaacuguauuauuuuguauagcuuuuuauu

SEQ ID NO: 295987 - RNA, 64 nt, hsa
aaggaauacuacuguuuuguuuuguuaagaccacaaacuguauugcuaaggacauuuuaagagu

SEQ ID NO: 295988 - RNA, 64 nt, hsa
auguaguugaaacaucugaugugacucaggauaaaaacuguaaacaaagcaaugccuuagcguu

SEQ ID NO: 295989 - RNA, 64 nt, hsa
gugcuguccuuccacauuuaauugcauuuugcucaaacuguagaaugcccuacauuccccccac

SEQ ID NO: 295990 - RNA, 64 nt, hsa
auguacauucaggacaaaugauuagcccuaaaugaaacuguaauaauuucaguggaaacucaau

SEQ ID NO: 295991 - RNA, 64 nt, hsa
cuccaaaaacauuuuuuuaaauguucuguaagauaaacuguauauuucauauguaccuguuaag

SEQ ID NO: 295992 - RNA, 64 nt, hsa
uuuaauguauagaugauuucuaaugucuccugacaaacuguaaauacugcauuucuuuugcgua

SEQ ID NO: 295993 - RNA, 64 nt, hsa
uauuuccacuaagugaaaaaagaacuguguuuuuaaacuguaggagaauuuaauaaaucagcaa

SEQ ID NO: 295994 - RNA, 64 nt, hsa
guuuaucugauaauguuuaaauaauuuacaauauaaacuguaaaacuuauuaggcaugaaauca

SEQ ID NO: 295995 - RNA, 64 nt, hsa
aauuaucaauaauuuuuuuuaaaaagaggaucccaaacuguaaaagauugaaauaaucuuucuc

SEQ ID NO: 295996 - RNA, 64 nt, hsa
uaauaaaauuccuucacgaccugguacccuugugaaacuguaaaauauaucauauggggggagu

SEQ ID NO: 295997 - RNA, 64 nt, hsa
uugaaccuuuuauauguuaugcauugauucuaacaaacuguaaugcccucaacagaacuaauuu

SEQ ID NO: 295998 - RNA, 64 nt, hsa
cacagcauuuacacugaauacaauuucauuuguaaaacuguaaauaagagcuuuuguacuagcc

SEQ ID NO: 295999 - RNA, 64 nt, hsa
cuggaguacuuccuagugcagccagccuaggcggaaacuguacaccauggucuuccagaugggu

SEQ ID NO: 296000 - RNA, 64 nt, hsa
agugacaucagguauuuggaaggaguaagaucauaaacuguauucauuuucuuccuuguacaaa

SEQ ID NO: 296001 - RNA, 64 nt, hsa
cucaagaaaaugccacauuucaauuacauauuuaaaacuguaucuguaagggcuuuucaaaaug

SEQ ID NO: 296002 - RNA, 64 nt, hsa
agugagagcugaaaagagaaaugauaaugcuuccaaacuguagcugucacagggcaauuucuuu

SEQ ID NO: 296003 - RNA, 64 nt, hsa
uauaaaugugaucagauaaaauaacuccugacagaaacuguaaggaaaccagcugaauguuuga

SEQ ID NO: 296004 - RNA, 64 nt, hsa
uuuagcccagauuucaaauagugggggaagaaagaaacuguauuucagaguaaaaucuccuaaa

SEQ ID NO: 296005 - RNA, 64 nt, hsa
uuaucuauacuguauaaaaaagcaauuacccuuaaaacuguacucuggccuacuuuucuauuuu

SEQ ID NO: 296006 - RNA, 64 nt, hsa
ugugcuuuuuugaaaauuuaagaguggggacgugaaacuguauucugugccuuccaucaugauu

SEQ ID NO: 296007 - RNA, 64 nt, hsa
ugaacaacuguuugucuuuuuuuguaucuuuuuuaaacuguaaaguucaauugugaaaaugaau

SEQ ID NO: 296008 - RNA, 64 nt, hsa
gucuccaaguaguccaccuucauuuaacucuuugaaacuguaucaucuuugccaaguaagagug

SEQ ID NO: 296009 - RNA, 64 nt, hsa
auuuguauauacauuuucaauaaagaauauguauaaacuguacagaucuagaucuacaaccuau

SEQ ID NO: 296010 - RNA, 64 nt, hsa
cuuuaauaguuuaguguaaaguacaucagaaauaaaacuguaucugacauuuuaagccuguagu

SEQ ID NO: 296011 - RNA, 64 nt, hsa
uuguaauguauaacuugauauuuaauuuaugauuaaacuguaauuuuguaacauaaacuguggu

SEQ ID NO: 296012 - RNA, 64 nt, hsa; identical to SEQ ID NO: 255810

SEQ ID NO: 296013 - RNA, 64 nt, hsa; identical to SEQ ID NO: 255811

SEQ ID NO: 296014 - RNA, 64 nt, hsa; identical to SEQ ID NO: 255812

SEQ ID NO: 296015 - RNA, 64 nt, hsa; identical to SEQ ID NO: 255813

SEQ ID NO: 296016 - RNA, 64 nt, hsa; identical to SEQ ID NO: 255814

SEQ ID NO: 296017 - RNA, 64 nt, hsa; identical to SEQ ID NO: 255815

SEQ ID NO: 296018 - RNA, 64 nt, hsa; identical to SEQ ID NO: 255816

SEQ ID NO: 296019 - RNA, 64 nt, hsa; identical to SEQ ID NO: 255817

SEQ ID NO: 296020 - RNA, 64 nt, hsa; identical to SEQ ID NO: 255818

SEQ ID NO: 296021 - RNA, 64 nt, hsa; identical to SEQ ID NO: 255819

SEQ ID NO: 296022 - RNA, 64 nt, hsa; identical to SEQ ID NO: 255820

SEQ ID NO: 296023 - RNA, 64 nt, hsa; identical to SEQ ID NO: 255821

SEQ ID NO: 296024 - RNA, 64 nt, hsa; identical to SEQ ID NO: 255822

SEQ ID NO: 296025 - RNA, 64 nt, hsa; identical to SEQ ID NO: 255823

SEQ ID NO: 296026 - RNA, 64 nt, hsa; identical to SEQ ID NO: 255824

SEQ ID NO: 296027 - RNA, 64 nt, hsa; identical to SEQ ID NO: 255825

SEQ ID NO: 296028 - RNA, 64 nt, hsa; identical to SEQ ID NO: 255826

SEQ ID NO: 296029 - RNA, 64 nt, hsa; identical to SEQ ID NO: 255827

SEQ ID NO: 296030 - RNA, 64 nt, hsa; identical to SEQ ID NO: 255828

SEQ ID NO: 296031 - RNA, 64 nt, hsa; identical to SEQ ID NO: 255829

SEQ ID NO: 296032 - RNA, 64 nt, hsa; identical to SEQ ID NO: 255830

SEQ ID NO: 296033 - RNA, 64 nt, hsa; identical to SEQ ID NO: 255831

SEQ ID NO: 296034 - RNA, 64 nt, hsa; identical to SEQ ID NO: 255832

SEQ ID NO: 296035 - RNA, 64 nt, hsa; identical to SEQ ID NO: 255833

SEQ ID NO: 296036 - RNA, 64 nt, hsa; identical to SEQ ID NO: 255834

SEQ ID NO: 296037 - RNA, 64 nt, hsa; identical to SEQ ID NO: 255835

SEQ ID NO: 296038 - RNA, 64 nt, hsa; identical to SEQ ID NO: 255836

SEQ ID NO: 296039 - RNA, 64 nt, hsa; identical to SEQ ID NO: 255837

SEQ ID NO: 296040 - RNA, 64 nt, hsa; identical to SEQ ID NO: 255838

SEQ ID NO: 296041 - RNA, 64 nt, hsa; identical to SEQ ID NO: 255839

SEQ ID NO: 296042 - RNA, 64 nt, hsa; identical to SEQ ID NO: 255840

SEQ ID NO: 296043 - RNA, 64 nt, hsa; identical to SEQ ID NO: 255841

SEQ ID NO: 296044 - RNA, 64 nt, hsa; identical to SEQ ID NO: 255842

SEQ ID NO: 296045 - RNA, 64 nt, hsa
agagagucaggagagcagcaggagaggcgcacagaaggcccaguucucagggguuuuuauucuu

SEQ ID NO: 296046 - RNA, 64 nt, hsa
uuccaaggacuucuuccuguugguguuguaagaaaaggcccaugcuuguccgggcacaguggcu

SEQ ID NO: 296047 - RNA, 64 nt, hsa
acucauaacagucuuacugcaggcaagugggauaaaggcccagacuccaugguggaaguuaaag

SEQ ID NO: 296048 - RNA, 64 nt, hsa
cuugacacuauucacuaaaauuaaucuggaauuuaaggcccaacauuaaacacaaagcuguuga

SEQ ID NO: 296049 - RNA, 64 nt, hsa
gcagugugucaggugcugcagagcguucuuggagaaggcccacugaggcagguucgugcccugc

SEQ ID NO: 296050 - RNA, 64 nt, hsa
agcaacauaaaacaaugaaggaaaaccucacuugaaggcccaggucaacaucuaagccuguuga

SEQ ID NO: 296051 - RNA, 64 nt, hsa
aaaggucacaaaagcaaaauaacugucugaggcuaaggcccacgugggacagucuaauacccau

SEQ ID NO: 296052 - RNA, 64 nt, hsa
cuauaaccaauaccuuuguuuucauguguaagaaaaggcccauuacuuuuaagguaugugcugu

SEQ ID NO: 296053 - RNA, 64 nt, hsa
ccucucucucgaggccacugaaguuuggagucaaaaggcccagagucugagucccagcccugag

SEQ ID NO: 296054 - RNA, 64 nt, hsa
gugggauuugcagggacuuuucugggagaacuuaaaggcccauaguaacugcgaaugaagcaau

SEQ ID NO: 296055 - RNA, 64 nt, hsa
ggccagggaggggacccagagaggccuggcacacaaggcccaagcaccaccgucaacacagccc

SEQ ID NO: 296056 - RNA, 64 nt, hsa
cgagaggggacuuggcugggccuuuccuaugggcaaggcccagugcucuuccugcccaccaggg

SEQ ID NO: 296057 - RNA, 64 nt, hsa
aggcaaggacagagaagguaccugcaggacccacaaggcccauacuggcccccaucugaaccca

SEQ ID NO: 296058 - RNA, 64 nt, hsa
gcugagacugaaaaucaagagggaagaggugaggaaggcccaccccuggggcugggcaguguag

SEQ ID NO: 296059 - RNA, 64 nt, hsa
cucagccuaaccaggaaaggggcucggagggagaaaggcccagggcaguggggacgggucccag

SEQ ID NO: 296060 - RNA, 64 nt, hsa
ucuucugcaacauuugacaaaacuaaccuugaauaaggcccacuguaauacguagcucucuuaa

SEQ ID NO: 296061 - RNA, 64 nt, hsa
aucccaacuacguaauaggaaaauguaggaucaaaaggcccauguauauaaguacugaccacug

SEQ ID NO: 296062 - RNA, 64 nt, hsa
ccugugacugcccugcauguguucaugaccuccgaaggcccaaauucaugaagcagcaaaccca

SEQ ID NO: 296063 - RNA, 64 nt, hsa
uggagcguuccacugagucuacuucaggagacagaaggcccaugcugaugggggaggaggaggg

SEQ ID NO: 296064 - RNA, 64 nt, hsa
ccugucugcauauacacacggggaaugccagaagaaggcccagucugcaccaggcgucugguca

SEQ ID NO: 296065 - RNA, 64 nt, hsa
gcacuguucacucugugucuuuugaagugccuugaaggcccagaugaaauuuuaaagggagggg

SEQ ID NO: 296066 - RNA, 64 nt, hsa
caagcgcaugagagguguuuccuuggccuuccagaaggcccacuguggagccagccucccuaug

SEQ ID NO: 296067 - RNA, 64 nt, hsa
augggcuguaggggagaguguggcaggugacccaaaggcccaaagagggccguggggccugagg

SEQ ID NO: 296068 - RNA, 64 nt, hsa
cucacuguuuucgugguuguaacuaauauguggaaaggcccauuuccagguuugcguagaagag

SEQ ID NO: 296069 - RNA, 64 nt, hsa
acucagcagcgauggugagcauuuugguuuccuuaaggcccagcaagacuuccagggacaucuc

SEQ ID NO: 296070 - RNA, 64 nt, hsa
guuucaaucuaguccuagaguugugucccucugaaaggcccaaugccauguaacuaacuuuaaa

SEQ ID NO: 296071 - RNA, 64 nt, hsa
aaccccaaaaguccaaaaauguaauaauuuugacaaggcccaaaguugagaugcuaugaagcuu

SEQ ID NO: 296072 - RNA, 64 nt, hsa
guuuucauuugaugucguacugguuuuaaaccuugugcucuacuccuuccuguuaaugaauuaa

SEQ ID NO: 296073 - RNA, 64 nt, hsa; identical to SEQ ID NO: 296072

SEQ ID NO: 296074 - RNA, 64 nt, hsa
gccuucccagagccccgucuugcuucucuuccaggugcucuauccccucgagacccucuggugc

SEQ ID NO: 296075 - RNA, 64 nt, hsa
ccuggccucuccugggggaggcugcuguucuuaggugcucuaagcuuaaucccucagaaugugu

SEQ ID NO: 296076 - RNA, 64 nt, hsa
uuauaaugcaaagaccagcuccuuugcgguggcagugcucuagggcugccauuacacggucuug

SEQ ID NO: 296077 - RNA, 64 nt, hsa
uagguuuucuauuaaggucucugccccaggcauggugcucuauaucuuggccaaauaaauuacu

SEQ ID NO: 296078 - RNA, 64 nt, hsa; identical to SEQ ID NO: 245291

SEQ ID NO: 296079 - RNA, 64 nt, hsa; identical to SEQ ID NO: 245292

SEQ ID NO: 296080 - RNA, 64 nt, hsa; identical to SEQ ID NO: 245293

SEQ ID NO: 296081 - RNA, 64 nt, hsa; identical to SEQ ID NO: 245294

SEQ ID NO: 296082 - RNA, 64 nt, hsa; identical to SEQ ID NO: 183694

SEQ ID NO: 296083 - RNA, 64 nt, hsa; identical to SEQ ID NO: 183695

SEQ ID NO: 296084 - RNA, 64 nt, hsa; identical to SEQ ID NO: 183696

SEQ ID NO: 296085 - RNA, 64 nt, hsa; identical to SEQ ID NO: 183697

SEQ ID NO: 296086 - RNA, 64 nt, hsa; identical to SEQ ID NO: 183698

SEQ ID NO: 296087 - RNA, 64 nt, hsa; identical to SEQ ID NO: 183699

SEQ ID NO: 296088 - RNA, 64 nt, hsa; identical to SEQ ID NO: 183700

SEQ ID NO: 296089 - RNA, 64 nt, hsa; identical to SEQ ID NO: 183701

SEQ ID NO: 296090 - RNA, 64 nt, hsa; identical to SEQ ID NO: 183702

SEQ ID NO: 296091 - RNA, 64 nt, hsa; identical to SEQ ID NO: 183703

SEQ ID NO: 296092 - RNA, 64 nt, hsa; identical to SEQ ID NO: 183704

SEQ ID NO: 296093 - RNA, 64 nt, hsa; identical to SEQ ID NO: 183705

SEQ ID NO: 296094 - RNA, 64 nt, hsa; identical to SEQ ID NO: 183706

SEQ ID NO: 296095 - RNA, 64 nt, hsa; identical to SEQ ID NO: 183707

SEQ ID NO: 296096 - RNA, 64 nt, hsa; identical to SEQ ID NO: 183708

SEQ ID NO: 296097 - RNA, 64 nt, hsa; identical to SEQ ID NO: 183709

SEQ ID NO: 296098 - RNA, 64 nt, hsa; identical to SEQ ID NO: 183710

SEQ ID NO: 296099 - RNA, 64 nt, hsa; identical to SEQ ID NO: 183711

SEQ ID NO: 296100 - RNA, 64 nt, hsa; identical to SEQ ID NO: 183712

SEQ ID NO: 296101 - RNA, 64 nt, hsa; identical to SEQ ID NO: 183713

SEQ ID NO: 296102 - RNA, 64 nt, hsa; identical to SEQ ID NO: 183714

SEQ ID NO: 296103 - RNA, 64 nt, hsa; identical to SEQ ID NO: 183715

SEQ ID NO: 296104 - RNA, 64 nt, hsa; identical to SEQ ID NO: 183716

SEQ ID NO: 296105 - RNA, 64 nt, hsa; identical to SEQ ID NO: 183717

SEQ ID NO: 296106 - RNA, 64 nt, hsa; identical to SEQ ID NO: 183718

SEQ ID NO: 296107 - RNA, 64 nt, hsa; identical to SEQ ID NO: 183719

SEQ ID NO: 296108 - RNA, 64 nt, hsa; identical to SEQ ID NO: 183720

SEQ ID NO: 296109 - RNA, 64 nt, hsa; identical to SEQ ID NO: 183721

SEQ ID NO: 296110 - RNA, 64 nt, hsa; identical to SEQ ID NO: 183722

SEQ ID NO: 296111 - RNA, 64 nt, hsa; identical to SEQ ID NO: 183723

SEQ ID NO: 296112 - RNA, 64 nt, hsa; identical to SEQ ID NO: 183724

SEQ ID NO: 296113 - RNA, 64 nt, hsa; identical to SEQ ID NO: 183725

SEQ ID NO: 296114 - RNA, 64 nt, hsa; identical to SEQ ID NO: 183726

SEQ ID NO: 296115 - RNA, 64 nt, hsa; identical to SEQ ID NO: 183727

SEQ ID NO: 296116 - RNA, 64 nt, hsa; identical to SEQ ID NO: 183728

SEQ ID NO: 296117 - RNA, 64 nt, hsa; identical to SEQ ID NO: 183729

SEQ ID NO: 296118 - RNA, 64 nt, hsa; identical to SEQ ID NO: 183730

SEQ ID NO: 296119 - RNA, 64 nt, hsa; identical to SEQ ID NO: 183731

SEQ ID NO: 296120 - RNA, 64 nt, hsa; identical to SEQ ID NO: 183732

SEQ ID NO: 296121 - RNA, 64 nt, hsa; identical to SEQ ID NO: 183733

SEQ ID NO: 296122 - RNA, 64 nt, hsa; identical to SEQ ID NO: 183734

SEQ ID NO: 296123 - RNA, 64 nt, hsa; identical to SEQ ID NO: 183735

SEQ ID NO: 296124 - RNA, 64 nt, hsa
aaauuuaauauauuuguucacuugagucuuaagaguaggucaggccaaggcagguggaucaccu

SEQ ID NO: 296125 - RNA, 64 nt, hsa
aacaaaaaugaaacuccgucucaaaaaaaaaaaaguaggucaauucguaacaguuuauuuugga

SEQ ID NO: 296126 - RNA, 64 nt, hsa
ggaugaacaucagugcccuaacuuuauccaucauguaggucagggaggacugggcacuauuugg

SEQ ID NO: 296127 - RNA, 64 nt, hsa
ucggcauuuguccacagucagacugcaagagaggguaggucaugaacagucacccgugcuggcu

SEQ ID NO: 296128 - RNA, 64 nt, hsa
uaugagaaucaguggaaaauaaggguauaauuuuguaggucauaugauugaagaaaauauuauu

SEQ ID NO: 296129 - RNA, 64 nt, hsa
accuguauaaaagauacauuuuauggugguuucaguaggucauuuuaaaaaccaaugugcauua

SEQ ID NO: 296130 - RNA, 64 nt, hsa
gaucuugcccagaaccucucuuggcuucauaaacagcugugaacccuccccugagggauuaaca

SEQ ID NO: 296131 - RNA, 64 nt, hsa
gacaccagggagcagggccugggccuguuuccccagcugugaucuugcccagaaccucucuugg

SEQ ID NO: 296132 - RNA, 64 nt, hsa
aauucauucagauggucaauaacuugaaauuuauagcugugauaggaguucagaaauuggcaca

SEQ ID NO: 296133 - RNA, 64 nt, hsa
cuguuugcaaagucacagaccuugccucagaaggagcugugagccaguauucauuuaagaggca

SEQ ID NO: 296134 - RNA, 64 nt, hsa
aagcagcacaaggaauuucccuguguggaugcugagcugugauggcgggcacuggguacccaag

SEQ ID NO: 296135 - RNA, 64 nt, hsa
gacaugagucuguaggagcaagggcacaaacugcagcugugagugcgugugugugauuuggugu

SEQ ID NO: 296136 - RNA, 64 nt, hsa
acggccacuccagagccggucccuguccuuggaaagcugugaagccuugcguugaguuccuucu

SEQ ID NO: 296137 - RNA, 64 nt, hsa
gaugcccugggcucagaucuguaauucucccaggagcugugauagagcaggccacacaaagucc

SEQ ID NO: 296138 - RNA, 64 nt, hsa
agugagcaaaaggaucagaaugcagggaacacuaagcugugaugaagaaagugugguaaaaagc

SEQ ID NO: 296139 - RNA, 64 nt, hsa
ccucugcuuuccuccacugccaucauuaaaccucagcugugacaugaaagacuuaccggaccac

SEQ ID NO: 296140 - RNA, 64 nt, hsa
gggccucugauggugagaggugacggggucccucagcugugagaugcaaggggcgccuugcagc

SEQ ID NO: 296141 - RNA, 64 nt, hsa
cauauccauuaggugccaguagcacccccgcuagagcugugaaaaauucucuccagacauaguc

SEQ ID NO: 296142 - RNA, 64 nt, hsa
uaacaaaugccaagauuucuggagcagauuguacagcugugacuuuggaaaacagaaaguaaga

SEQ ID NO: 296143 - RNA, 64 nt, hsa
uuccaugcuuaagacaaaaaugucuuaaauauaaagcugugauuauaucaaaaauccagauaaa

SEQ ID NO: 296144 - RNA, 64 nt, hsa
gaggcuguacuauaugaagccugcauauacugugagcugugauuggggaacaccaaugcagagg

SEQ ID NO: 296145 - RNA, 64 nt, hsa
agaaaucaugacccugaaagagagaugaaauucaagcugugagccaggcaggagcucaguaugg

SEQ ID NO: 296146 - RNA, 64 nt, hsa
ggauuuuguagcuguuuaaaaaaaaaaaaaagguagcugugauacaaaccccaggacacccacc

SEQ ID NO: 296147 - RNA, 64 nt, hsa
gguuuuuguguaagauucuugcuguagcguggauagcugugauuggugagucaaccgucugugg

SEQ ID NO: 296148 - RNA, 64 nt, hsa
cugugaggaaacagccacauguucgucaugauugagcugugaagucuucuuggaccuguugucu

SEQ ID NO: 296149 - RNA, 64 nt, hsa
aguagcugggauuugacuuuucuuccuugccugcagcugugaucgagaugguacaagaggcugg

SEQ ID NO: 296150 - RNA, 64 nt, hsa
agccuggauucgaaucugggcucuuucacauacuagcugugacccuggacaaagagcuuuaacc

SEQ ID NO: 296151 - RNA, 64 nt, hsa
uaaggaguggaaaaguguaggcugcccuuggugaagcugugacaagggagugaccauccauccc

SEQ ID NO: 296152 - RNA, 64 nt, hsa
ggcgauacuguuuuccccugcagggugggauuugagcugugaguugguaacuagcagggagaaa

SEQ ID NO: 296153 - RNA, 64 nt, hsa
auccaaaauggaaaagccaguuagaggcuuucaaagcugugaaaaaucaaaacguugaucacuu

SEQ ID NO: 296154 - RNA, 64 nt, hsa
guagcugaagcaggagguuacagggcaaaagggcagcugugaugauguggaaaugagguugggg

SEQ ID NO: 296155 - RNA, 64 nt, hsa
cauucucccagucucugucguggagccauugaacagcugugagccaugccucccugggccaccu

SEQ ID NO: 296156 - RNA, 64 nt, hsa
uuuuuaagccacuuaauuguggccaaagcuauucagcugugauaauaguaucucacagggaaac

SEQ ID NO: 296157 - RNA, 64 nt, hsa
ugauuuuuuuuuuuccaaucaaacagagcaguauagcugugacuauggaucuggcagauucuuu

SEQ ID NO: 296158 - RNA, 64 nt, hsa
gugaaacuucucuauuggagugucuguuucuuuaagcugugaauacugaaauuaugccuugucu

SEQ ID NO: 296159 - RNA, 64 nt, hsa
cauggucugagacuaaguaaaggaaauuuccuaaagcugugaaauuugaauuuugcuuuaaaua

SEQ ID NO: 296160 - RNA, 64 nt, hsa
cagcaugguaaggggacagagcccagcagaucccagcugugaagaggccacugcauggcugaca

SEQ ID NO: 296161 - RNA, 64 nt, hsa
uucccagagccaccaaaaaccuucuuagcaggacagcugugagaggcaucagaaccucacguuc

SEQ ID NO: 296162 - RNA, 64 nt, hsa
cacccaggaacuaugaguugggggaugugguagaagcugugaggcacagccaggaccgggccuu

SEQ ID NO: 296163 - RNA, 64 nt, hsa
ccucuggcagugggaggagcagcaccgaggucggagcugugaggacuuccagaacuggaaacgc

SEQ ID NO: 296164 - RNA, 64 nt, hsa
ggccugccacuucucacagacccuagguauccacagcugugacaugggggcaagcggcuuuguu

SEQ ID NO: 296165 - RNA, 64 nt, hsa
ugccugggcuccaaugccagcucugccacuugcuagcugugagacuguggacaaaccacucagc

SEQ ID NO: 296166 - RNA, 64 nt, hsa
agcugugaauggccuaggggcugagucccacaccagcugugaauucuccugcagacaggagggc

SEQ ID NO: 296167 - RNA, 64 nt, hsa
gccccgugcugaaugaauguacagagccagacaaagcugugaauggccuaggggcugaguccca

SEQ ID NO: 296168 - RNA, 64 nt, hsa
cuccaaggagacaaccccaggggccaacagccccagcugugacccccaggcuuccacaugaacu

SEQ ID NO: 296169 - RNA, 64 nt, hsa
ugagagagguguggggaaccgcccaaggucacccagcugugaaugaacguggucagaacacaga

SEQ ID NO: 296170 - RNA, 64 nt, hsa
uguaugccugcccaguucccuuuuuauuugcagaagcugugaguuuuguucacaauuagguucc

SEQ ID NO: 296171 - RNA, 64 nt, hsa
ugaaaccacaugaaaugacuuaugggggauggugagcugugacugcuuugcugaccauuuugga

SEQ ID NO: 296172 - RNA, 64 nt, hsa
ggggugguguggagggcccuacuccacacccuagagcugugaugcugagcaaggugccuguggc

SEQ ID NO: 296173 - RNA, 64 nt, hsa
uguuccugugggugacagagaugagaaccagggaagcugugauccacuggccaggacaagucaa

SEQ ID NO: 296174 - RNA, 64 nt, hsa
gacagcugugaaguugggcgugcucugugguaccagcugugacuuuucuauuucuccuaguuuu

SEQ ID NO: 296175 - RNA, 64 nt, hsa
ucucucacccuagccaaagguccuaagaggagacagcugugaaguugggcgugcucugugguac

SEQ ID NO: 296176 - RNA, 64 nt, hsa; identical to SEQ ID NO: 211358

SEQ ID NO: 296177 - RNA, 64 nt, hsa; identical to SEQ ID NO: 211359

SEQ ID NO: 296178 - RNA, 64 nt, hsa; identical to SEQ ID NO: 211360

SEQ ID NO: 296179 - RNA, 64 nt, hsa; identical to SEQ ID NO: 211361

SEQ ID NO: 296180 - RNA, 64 nt, hsa; identical to SEQ ID NO: 211362

SEQ ID NO: 296181 - RNA, 64 nt, hsa; identical to SEQ ID NO: 211363

SEQ ID NO: 296182 - RNA, 64 nt, hsa; identical to SEQ ID NO: 211364

SEQ ID NO: 296183 - RNA, 64 nt, hsa; identical to SEQ ID NO: 211365

SEQ ID NO: 296184 - RNA, 64 nt, hsa; identical to SEQ ID NO: 211366

SEQ ID NO: 296185 - RNA, 64 nt, hsa; identical to SEQ ID NO: 211367

SEQ ID NO: 296186 - RNA, 64 nt, hsa; identical to SEQ ID NO: 211368

SEQ ID NO: 296187 - RNA, 64 nt, hsa; identical to SEQ ID NO: 211369

SEQ ID NO: 296188 - RNA, 64 nt, hsa; identical to SEQ ID NO: 211370

SEQ ID NO: 296189 - RNA, 64 nt, hsa; identical to SEQ ID NO: 211371

SEQ ID NO: 296190 - RNA, 64 nt, hsa; identical to SEQ ID NO: 211372

SEQ ID NO: 296191 - RNA, 64 nt, hsa; identical to SEQ ID NO: 211373

SEQ ID NO: 296192 - RNA, 64 nt, hsa; identical to SEQ ID NO: 211374

SEQ ID NO: 296193 - RNA, 64 nt, hsa; identical to SEQ ID NO: 211375

SEQ ID NO: 296194 - RNA, 50 nt, hsa; identical to SEQ ID NO: 178066

SEQ ID NO: 296195 - RNA, 64 nt, hsa; identical to SEQ ID NO: 211377

SEQ ID NO: 296196 - RNA, 64 nt, hsa; identical to SEQ ID NO: 211378

SEQ ID NO: 296197 - RNA, 64 nt, hsa; identical to SEQ ID NO: 211379

SEQ ID NO: 296198 - RNA, 64 nt, hsa; identical to SEQ ID NO: 211380

SEQ ID NO: 296199 - RNA, 64 nt, hsa; identical to SEQ ID NO: 211381

SEQ ID NO: 296200 - RNA, 64 nt, hsa; identical to SEQ ID NO: 211382

SEQ ID NO: 296201 - RNA, 64 nt, hsa; identical to SEQ ID NO: 211383

SEQ ID NO: 296202 - RNA, 64 nt, hsa; identical to SEQ ID NO: 211384

SEQ ID NO: 296203 - RNA, 64 nt, hsa; identical to SEQ ID NO: 211385

SEQ ID NO: 296204 - RNA, 64 nt, hsa; identical to SEQ ID NO: 211386

SEQ ID NO: 296205 - RNA, 64 nt, hsa; identical to SEQ ID NO: 211387

SEQ ID NO: 296206 - RNA, 64 nt, hsa; identical to SEQ ID NO: 211388

SEQ ID NO: 296207 - RNA, 64 nt, hsa; identical to SEQ ID NO: 211389

SEQ ID NO: 296208 - RNA, 64 nt, hsa; identical to SEQ ID NO: 211390

SEQ ID NO: 296209 - RNA, 64 nt, hsa; identical to SEQ ID NO: 211391

SEQ ID NO: 296210 - RNA, 64 nt, hsa; identical to SEQ ID NO: 211392

SEQ ID NO: 296211 - RNA, 64 nt, hsa; identical to SEQ ID NO: 211393

SEQ ID NO: 296212 - RNA, 64 nt, hsa; identical to SEQ ID NO: 211394

SEQ ID NO: 296213 - RNA, 64 nt, hsa; identical to SEQ ID NO: 211395

SEQ ID NO: 296214 - RNA, 64 nt, hsa; identical to SEQ ID NO: 211396

SEQ ID NO: 296215 - RNA, 64 nt, hsa; identical to SEQ ID NO: 211397

SEQ ID NO: 296216 - RNA, 64 nt, hsa; identical to SEQ ID NO: 211398

SEQ ID NO: 296217 - RNA, 64 nt, hsa; identical to SEQ ID NO: 211399

SEQ ID NO: 296218 - RNA, 64 nt, hsa; identical to SEQ ID NO: 211400

SEQ ID NO: 296219 - RNA, 64 nt, hsa; identical to SEQ ID NO: 211401

SEQ ID NO: 296220 - RNA, 64 nt, hsa; identical to SEQ ID NO: 211402

SEQ ID NO: 296221 - RNA, 64 nt, hsa; identical to SEQ ID NO: 211403

SEQ ID NO: 296222 - RNA, 64 nt, hsa; identical to SEQ ID NO: 211404

SEQ ID NO: 296223 - RNA, 64 nt, hsa; identical to SEQ ID NO: 211405

SEQ ID NO: 296224 - RNA, 64 nt, hsa; identical to SEQ ID NO: 211406

SEQ ID NO: 296225 - RNA, 64 nt, hsa; identical to SEQ ID NO: 211407

SEQ ID NO: 296226 - RNA, 64 nt, hsa; identical to SEQ ID NO: 211408

SEQ ID NO: 296227 - RNA, 64 nt, hsa; identical to SEQ ID NO: 211409

SEQ ID NO: 296228 - RNA, 64 nt, hsa; identical to SEQ ID NO: 211410

SEQ ID NO: 296229 - RNA, 64 nt, hsa; identical to SEQ ID NO: 211411

SEQ ID NO: 296230 - RNA, 64 nt, hsa; identical to SEQ ID NO: 211412

SEQ ID NO: 296231 - RNA, 64 nt, hsa; identical to SEQ ID NO: 211413

SEQ ID NO: 296232 - RNA, 64 nt, hsa; identical to SEQ ID NO: 211414

SEQ ID NO: 296233 - RNA, 64 nt, hsa; identical to SEQ ID NO: 211415

SEQ ID NO: 296234 - RNA, 64 nt, hsa; identical to SEQ ID NO: 211416

SEQ ID NO: 296235 - RNA, 64 nt, hsa; identical to SEQ ID NO: 211417

SEQ ID NO: 296236 - RNA, 64 nt, hsa; identical to SEQ ID NO: 211418

SEQ ID NO: 296237 - RNA, 64 nt, hsa; identical to SEQ ID NO: 211419

SEQ ID NO: 296238 - RNA, 64 nt, hsa; identical to SEQ ID NO: 211420

SEQ ID NO: 296239 - RNA, 64 nt, hsa; identical to SEQ ID NO: 211421

SEQ ID NO: 296240 - RNA, 64 nt, hsa; identical to SEQ ID NO: 211422

SEQ ID NO: 296241 - RNA, 64 nt, hsa; identical to SEQ ID NO: 211423

SEQ ID NO: 296242 - RNA, 64 nt, hsa; identical to SEQ ID NO: 211424

SEQ ID NO: 296243 - RNA, 64 nt, hsa; identical to SEQ ID NO: 211425

SEQ ID NO: 296244 - RNA, 64 nt, hsa; identical to SEQ ID NO: 211426

SEQ ID NO: 296245 - RNA, 64 nt, hsa; identical to SEQ ID NO: 211427

SEQ ID NO: 296246 - RNA, 64 nt, hsa; identical to SEQ ID NO: 211428

SEQ ID NO: 296247 - RNA, 64 nt, hsa; identical to SEQ ID NO: 211429

SEQ ID NO: 296248 - RNA, 64 nt, hsa; identical to SEQ ID NO: 211430

SEQ ID NO: 296249 - RNA, 64 nt, hsa; identical to SEQ ID NO: 211424

SEQ ID NO: 296250 - RNA, 64 nt, hsa; identical to SEQ ID NO: 211423

SEQ ID NO: 296251 - RNA, 64 nt, hsa; identical to SEQ ID NO: 211433

SEQ ID NO: 296252 - RNA, 64 nt, hsa; identical to SEQ ID NO: 211434

SEQ ID NO: 296253 - RNA, 64 nt, hsa; identical to SEQ ID NO: 211435

SEQ ID NO: 296254 - RNA, 64 nt, hsa; identical to SEQ ID NO: 211436

SEQ ID NO: 296255 - RNA, 64 nt, hsa; identical to SEQ ID NO: 211437

SEQ ID NO: 296256 - RNA, 64 nt, hsa; identical to SEQ ID NO: 211438

SEQ ID NO: 296257 - RNA, 64 nt, hsa; identical to SEQ ID NO: 211439

SEQ ID NO: 296258 - RNA, 64 nt, hsa; identical to SEQ ID NO: 211440

SEQ ID NO: 296259 - RNA, 64 nt, hsa; identical to SEQ ID NO: 211441

SEQ ID NO: 296260 - RNA, 64 nt, hsa; identical to SEQ ID NO: 211442

SEQ ID NO: 296261 - RNA, 64 nt, hsa; identical to SEQ ID NO: 211443

SEQ ID NO: 296262 - RNA, 64 nt, hsa; identical to SEQ ID NO: 211444

SEQ ID NO: 296263 - RNA, 64 nt, hsa; identical to SEQ ID NO: 211445

SEQ ID NO: 296264 - RNA, 64 nt, hsa; identical to SEQ ID NO: 211446

SEQ ID NO: 296265 - RNA, 64 nt, hsa; identical to SEQ ID NO: 211447

SEQ ID NO: 296266 - RNA, 64 nt, hsa; identical to SEQ ID NO: 211448

SEQ ID NO: 296267 - RNA, 64 nt, hsa; identical to SEQ ID NO: 211449

SEQ ID NO: 296268 - RNA, 64 nt, hsa; identical to SEQ ID NO: 211450

SEQ ID NO: 296269 - RNA, 64 nt, hsa; identical to SEQ ID NO: 211451

SEQ ID NO: 296270 - RNA, 64 nt, hsa; identical to SEQ ID NO: 211452

SEQ ID NO: 296271 - RNA, 64 nt, hsa; identical to SEQ ID NO: 211453

SEQ ID NO: 296272 - RNA, 64 nt, hsa; identical to SEQ ID NO: 211454

SEQ ID NO: 296273 - RNA, 64 nt, hsa; identical to SEQ ID NO: 211455

SEQ ID NO: 296274 - RNA, 64 nt, hsa; identical to SEQ ID NO: 211456

SEQ ID NO: 296275 - RNA, 64 nt, hsa; identical to SEQ ID NO: 211457

SEQ ID NO: 296276 - RNA, 64 nt, hsa; identical to SEQ ID NO: 211458

SEQ ID NO: 296277 - RNA, 64 nt, hsa; identical to SEQ ID NO: 211459

SEQ ID NO: 296278 - RNA, 64 nt, hsa; identical to SEQ ID NO: 211460

SEQ ID NO: 296279 - RNA, 64 nt, hsa; identical to SEQ ID NO: 211461

SEQ ID NO: 296280 - RNA, 64 nt, hsa; identical to SEQ ID NO: 211462

SEQ ID NO: 296281 - RNA, 64 nt, hsa; identical to SEQ ID NO: 211463

SEQ ID NO: 296282 - RNA, 64 nt, hsa; identical to SEQ ID NO: 211464

SEQ ID NO: 296283 - RNA, 64 nt, hsa; identical to SEQ ID NO: 211465

SEQ ID NO: 296284 - RNA, 64 nt, hsa; identical to SEQ ID NO: 211466

SEQ ID NO: 296285 - RNA, 64 nt, hsa; identical to SEQ ID NO: 211467

SEQ ID NO: 296286 - RNA, 64 nt, hsa; identical to SEQ ID NO: 211468

SEQ ID NO: 296287 - RNA, 64 nt, hsa; identical to SEQ ID NO: 211469

SEQ ID NO: 296288 - RNA, 64 nt, hsa; identical to SEQ ID NO: 211470

SEQ ID NO: 296289 - RNA, 64 nt, hsa; identical to SEQ ID NO: 211471

SEQ ID NO: 296290 - RNA, 64 nt, hsa; identical to SEQ ID NO: 211472

SEQ ID NO: 296291 - RNA, 64 nt, hsa; identical to SEQ ID NO: 211473

SEQ ID NO: 296292 - RNA, 64 nt, hsa; identical to SEQ ID NO: 211474

SEQ ID NO: 296293 - RNA, 64 nt, hsa; identical to SEQ ID NO: 211475

SEQ ID NO: 296294 - RNA, 64 nt, hsa; identical to SEQ ID NO: 211476

SEQ ID NO: 296295 - RNA, 64 nt, hsa; identical to SEQ ID NO: 211477

SEQ ID NO: 296296 - RNA, 64 nt, hsa; identical to SEQ ID NO: 211478

SEQ ID NO: 296297 - RNA, 64 nt, hsa; identical to SEQ ID NO: 211479

SEQ ID NO: 296298 - RNA, 64 nt, hsa; identical to SEQ ID NO: 211480

SEQ ID NO: 296299 - RNA, 64 nt, hsa; identical to SEQ ID NO: 211481

SEQ ID NO: 296300 - RNA, 64 nt, hsa; identical to SEQ ID NO: 211482

SEQ ID NO: 296301 - RNA, 64 nt, hsa; identical to SEQ ID NO: 211483

SEQ ID NO: 296302 - RNA, 64 nt, hsa; identical to SEQ ID NO: 211484

SEQ ID NO: 296303 - RNA, 64 nt, hsa; identical to SEQ ID NO: 211485

SEQ ID NO: 296304 - RNA, 64 nt, hsa; identical to SEQ ID NO: 211486

SEQ ID NO: 296305 - RNA, 64 nt, hsa; identical to SEQ ID NO: 211487

SEQ ID NO: 296306 - RNA, 64 nt, hsa; identical to SEQ ID NO: 211488

SEQ ID NO: 296307 - RNA, 64 nt, hsa; identical to SEQ ID NO: 211489

SEQ ID NO: 296308 - RNA, 64 nt, hsa; identical to SEQ ID NO: 211490

SEQ ID NO: 296309 - RNA, 64 nt, hsa; identical to SEQ ID NO: 211491

SEQ ID NO: 296310 - RNA, 64 nt, hsa; identical to SEQ ID NO: 211492

SEQ ID NO: 296311 - RNA, 64 nt, hsa; identical to SEQ ID NO: 211493

SEQ ID NO: 296312 - RNA, 64 nt, hsa; identical to SEQ ID NO: 211494

SEQ ID NO: 296313 - RNA, 64 nt, hsa; identical to SEQ ID NO: 211495

SEQ ID NO: 296314 - RNA, 64 nt, hsa; identical to SEQ ID NO: 211496

SEQ ID NO: 296315 - RNA, 64 nt, hsa; identical to SEQ ID NO: 211497

SEQ ID NO: 296316 - RNA, 64 nt, hsa; identical to SEQ ID NO: 211498

SEQ ID NO: 296317 - RNA, 64 nt, hsa; identical to SEQ ID NO: 211499

SEQ ID NO: 296318 - RNA, 64 nt, hsa; identical to SEQ ID NO: 211500

SEQ ID NO: 296319 - RNA, 64 nt, hsa; identical to SEQ ID NO: 211501

SEQ ID NO: 296320 - RNA, 64 nt, hsa; identical to SEQ ID NO: 211502

SEQ ID NO: 296321 - RNA, 64 nt, hsa; identical to SEQ ID NO: 211503

SEQ ID NO: 296322 - RNA, 64 nt, hsa; identical to SEQ ID NO: 211504

SEQ ID NO: 296323 - RNA, 64 nt, hsa; identical to SEQ ID NO: 211505

SEQ ID NO: 296324 - RNA, 64 nt, hsa; identical to SEQ ID NO: 211506

SEQ ID NO: 296325 - RNA, 64 nt, hsa; identical to SEQ ID NO: 211507

SEQ ID NO: 296326 - RNA, 64 nt, hsa; identical to SEQ ID NO: 211508

SEQ ID NO: 296327 - RNA, 64 nt, hsa; identical to SEQ ID NO: 211509

SEQ ID NO: 296328 - RNA, 64 nt, hsa; identical to SEQ ID NO: 211510

SEQ ID NO: 296329 - RNA, 64 nt, hsa; identical to SEQ ID NO: 211511

SEQ ID NO: 296330 - RNA, 64 nt, hsa; identical to SEQ ID NO: 211512

SEQ ID NO: 296331 - RNA, 64 nt, hsa; identical to SEQ ID NO: 211513

SEQ ID NO: 296332 - RNA, 64 nt, hsa; identical to SEQ ID NO: 211514

SEQ ID NO: 296333 - RNA, 64 nt, hsa; identical to SEQ ID NO: 211515

SEQ ID NO: 296334 - RNA, 64 nt, hsa; identical to SEQ ID NO: 211516

SEQ ID NO: 296335 - RNA, 64 nt, hsa; identical to SEQ ID NO: 211517

SEQ ID NO: 296336 - RNA, 64 nt, hsa; identical to SEQ ID NO: 211518

SEQ ID NO: 296337 - RNA, 64 nt, hsa; identical to SEQ ID NO: 211519

SEQ ID NO: 296338 - RNA, 64 nt, hsa; identical to SEQ ID NO: 211520

SEQ ID NO: 296339 - RNA, 64 nt, hsa; identical to SEQ ID NO: 211521

SEQ ID NO: 296340 - RNA, 64 nt, hsa; identical to SEQ ID NO: 211522

SEQ ID NO: 296341 - RNA, 64 nt, hsa; identical to SEQ ID NO: 211523

SEQ ID NO: 296342 - RNA, 64 nt, hsa; identical to SEQ ID NO: 211524

SEQ ID NO: 296343 - RNA, 64 nt, hsa; identical to SEQ ID NO: 211525

SEQ ID NO: 296344 - RNA, 64 nt, hsa; identical to SEQ ID NO: 211526

SEQ ID NO: 296345 - RNA, 64 nt, hsa; identical to SEQ ID NO: 211527

SEQ ID NO: 296346 - RNA, 64 nt, hsa; identical to SEQ ID NO: 211528

SEQ ID NO: 296347 - RNA, 64 nt, hsa; identical to SEQ ID NO: 211529

SEQ ID NO: 296348 - RNA, 64 nt, hsa; identical to SEQ ID NO: 211530

SEQ ID NO: 296349 - RNA, 64 nt, hsa; identical to SEQ ID NO: 211531

SEQ ID NO: 296350 - RNA, 64 nt, hsa; identical to SEQ ID NO: 211532

SEQ ID NO: 296351 - RNA, 64 nt, hsa; identical to SEQ ID NO: 211533

SEQ ID NO: 296352 - RNA, 64 nt, hsa; identical to SEQ ID NO: 211534

SEQ ID NO: 296353 - RNA, 64 nt, hsa; identical to SEQ ID NO: 211535

SEQ ID NO: 296354 - RNA, 64 nt, hsa; identical to SEQ ID NO: 211536

SEQ ID NO: 296355 - RNA, 64 nt, hsa; identical to SEQ ID NO: 211537

SEQ ID NO: 296356 - RNA, 64 nt, hsa; identical to SEQ ID NO: 211538

SEQ ID NO: 296357 - RNA, 64 nt, hsa; identical to SEQ ID NO: 211539

SEQ ID NO: 296358 - RNA, 64 nt, hsa; identical to SEQ ID NO: 211540

SEQ ID NO: 296359 - RNA, 64 nt, hsa; identical to SEQ ID NO: 211541

SEQ ID NO: 296360 - RNA, 64 nt, hsa; identical to SEQ ID NO: 211542

SEQ ID NO: 296361 - RNA, 64 nt, hsa; identical to SEQ ID NO: 211543

SEQ ID NO: 296362 - RNA, 64 nt, hsa; identical to SEQ ID NO: 211544

SEQ ID NO: 296363 - RNA, 64 nt, hsa; identical to SEQ ID NO: 211545

SEQ ID NO: 296364 - RNA, 64 nt, hsa; identical to SEQ ID NO: 211546

SEQ ID NO: 296365 - RNA, 64 nt, hsa; identical to SEQ ID NO: 211547

SEQ ID NO: 296366 - RNA, 64 nt, hsa; identical to SEQ ID NO: 211548

SEQ ID NO: 296367 - RNA, 64 nt, hsa; identical to SEQ ID NO: 211549

SEQ ID NO: 296368 - RNA, 64 nt, hsa; identical to SEQ ID NO: 211550

SEQ ID NO: 296369 - RNA, 64 nt, hsa; identical to SEQ ID NO: 211551

SEQ ID NO: 296370 - RNA, 64 nt, hsa; identical to SEQ ID NO: 211552

SEQ ID NO: 296371 - RNA, 64 nt, hsa; identical to SEQ ID NO: 211553

SEQ ID NO: 296372 - RNA, 64 nt, hsa; identical to SEQ ID NO: 211554

SEQ ID NO: 296373 - RNA, 64 nt, hsa; identical to SEQ ID NO: 211555

SEQ ID NO: 296374 - RNA, 64 nt, hsa; identical to SEQ ID NO: 211556

SEQ ID NO: 296375 - RNA, 64 nt, hsa; identical to SEQ ID NO: 211557

SEQ ID NO: 296376 - RNA, 64 nt, hsa; identical to SEQ ID NO: 211558

SEQ ID NO: 296377 - RNA, 64 nt, hsa; identical to SEQ ID NO: 211559

SEQ ID NO: 296378 - RNA, 64 nt, hsa; identical to SEQ ID NO: 211560

SEQ ID NO: 296379 - RNA, 64 nt, hsa
gaacccuucugauugucuuagacacugugguugcaaaacccacggaaagccucauuugugugga

SEQ ID NO: 296380 - RNA, 64 nt, hsa
uuggcucaccaacccugcaggccucaucuuucccaaaacccacuuugucuuggugggagugggu

SEQ ID NO: 296381 - RNA, 64 nt, hsa
ccuaaucucagaaugcuggaaugaugucuguuggaaaacccaggacuccacacacaaaacuccu

SEQ ID NO: 296382 - RNA, 64 nt, hsa
ggcuauuuuaaauucauauuauuaaaaaacaaaaaaaacccaccuauuuguguuguccauucac

SEQ ID NO: 296383 - RNA, 64 nt, hsa
ucuaauuuacugaucuuacuacuacaaagaaaaaaaaacccaaccaaucugcaauucaaaucag

SEQ ID NO: 296384 - RNA, 64 nt, hsa
aguauuaaauacauaucauuuuuaaaaauaaaaaaaaacccaaaaauaaugcaugcauaauuua

SEQ ID NO: 296385 - RNA, 64 nt, hsa
cagaaaaacagaguuauccacacaagucaggagcaaaacccaaguagaugccucuaggggcaca

SEQ ID NO: 296386 - RNA, 64 nt, hsa
gcagauuuuaaccccaucuggcagccauucaaggaaaacccagcccuggcuguuuacucaggcu

SEQ ID NO: 296387 - RNA, 64 nt, hsa
aacuuuucugauaaaauaauauuuuaaauuuucaaaaacccauuccugaggagaacuacuucua

SEQ ID NO: 296388 - RNA, 64 nt, hsa
uuagauguuuauugauaugagacuaugugguuaaaaaacccaaguauguccauguguuucuuau

SEQ ID NO: 296389 - RNA, 64 nt, hsa
ugagcaucagcuuacuuugucacuuagagcaagcaaaacccagugcaagagucucguucagcuc

SEQ ID NO: 296390 - RNA, 64 nt, hsa
aucacugacucaucccuacccauauucuuuucauaaaacccacucaccagguacaauagaaacu

SEQ ID NO: 296391 - RNA, 64 nt, hsa
cgacugagagaagucagaacagagaaggggaaaaaaaacccaaaauuaugugaacaagcaaaau

SEQ ID NO: 296392 - RNA, 64 nt, hsa
ccagcacaauuuggagugucaagggugagagccuaaaacccagcuugccugucuuugucucugu

SEQ ID NO: 296393 - RNA, 64 nt, hsa
ugcgaacuugaucagcuucuccaggauaaaauuaaaaacccaagcauugaucuguguacguguc

SEQ ID NO: 296394 - RNA, 64 nt, hsa
uuuucaucaagaagguagcuugagccugaaaugcaaaacccauggaggaauucugaagccauug

SEQ ID NO: 296395 - RNA, 64 nt, hsa
cagaacucuguguugugaaugucauucacaacagaaaacccaaaauauuaugcaaacuacugua

SEQ ID NO: 296396 - RNA, 64 nt, hsa
caagggugagacuccaucucaaaaaagaaacaaaaaaacccaaaaaguuuucuuuacuguuggu

SEQ ID NO: 296397 - RNA, 64 nt, hsa
gacacaagauguuuuuauagucuagagccuuuaaaaaacccagcagaauguaauucaguauuug

SEQ ID NO: 296398 - RNA, 64 nt, hsa
aaauacaggauuugauaauauuuugaaggcaggaaaaacccaaauuguuucuucuuugagaguc

SEQ ID NO: 296399 - RNA, 64 nt, hsa
uauuuguaaaaaaacaaaaagcaaaaaaauucccaaaacccagauaacaaccagagcaaaacug

SEQ ID NO: 296400 - RNA, 64 nt, hsa
ucacguaugguucacagauaauucuuuuuuuaaaaaaacccaaccuccuagagaagcacaacug

SEQ ID NO: 296401 - RNA, 64 nt, hsa
uguugguccguagcauggagcagauugaaaugcaaaaacccacaccucuggaagauaccuucac

SEQ ID NO: 296402 - RNA, 64 nt, hsa
ucuugugguacaucagggaacucacauaggugaaaaaacccauacuuaccuugagucugagaaa

SEQ ID NO: 296403 - RNA, 64 nt, hsa
uggagagccuuacuuggguuugcacccaaaaaaaaaaacccaaucugaggaaagacugcaagug

SEQ ID NO: 296404 - RNA, 64 nt, hsa
cugcagacaguaugaacaucucauuggaccucagaaaacccacccuggggagaagccccagcaa

SEQ ID NO: 296405 - RNA, 64 nt, hsa
auuuuuguacauaguagcauuagguagaaaagacaaaacccaaacaccuaguuaauugagggau

SEQ ID NO: 296406 - RNA, 64 nt, hsa
uauuucuauaauugagauacucauucuucccuucaaaacccagccucuugcaagaagcuaaaaa

SEQ ID NO: 296407 - RNA, 64 nt, hsa
cacuauaauccucuuuagggugauuuuuuaaaucaaaacccagugaaucucauuacuccuaaga

SEQ ID NO: 296408 - RNA, 64 nt, hsa
uucuggaucauuaauaaaguagcaagauccucaaaaaacccaaaaacaccauucucuaauaguc

SEQ ID NO: 296409 - RNA, 64 nt, hsa
gcuuuaaaacaaagggaaaaaagaguuuaaacaaaaaacccacaauugaacuuccaggaaagug

SEQ ID NO: 296410 - RNA, 64 nt, hsa
ccauuucuggggggagaaaaaaaaagcaaaucagaaaacccacgguuuuucuuuuuuucuuuuu

SEQ ID NO: 296411 - RNA, 64 nt, hsa; identical to SEQ ID NO: 296402

SEQ ID NO: 296412 - RNA, 64 nt, hsa; identical to SEQ ID NO: 296403

SEQ ID NO: 296413 - RNA, 64 nt, hsa; identical to SEQ ID NO: 296404

SEQ ID NO: 296414 - RNA, 64 nt, hsa
guguucgcccuagaguuauuacaaagccagugccaaaacccagccaugggcucuuugcaaccuc

SEQ ID NO: 296415 - RNA, 64 nt, hsa
cugugggugaacaacugcccacuaaccagacuggaaaacccagaaagaugggccuuccaugaau

SEQ ID NO: 296416 - RNA, 64 nt, hsa
uuucuggguagaaggagacuuccugaauuuccuuaaaacccaguaagaguaagaccuguuguuu

SEQ ID NO: 296417 - RNA, 64 nt, hsa
aagcaaaagacagggacagagaaguguuguguuuaaaacccaagccugucuaagguuacugugu

SEQ ID NO: 296418 - RNA, 64 nt, hsa
uuaauuaaugcacuuuaaauaagguagaauggaaaaaacccagagagcaaagugcauuacuuaa

SEQ ID NO: 296419 - RNA, 64 nt, hsa
agggcagcaugggacccagugucucagugccuucaaaacccacccccaccccuacccuacccca

SEQ ID NO: 296420 - RNA, 64 nt, hsa
agacuccaucucaaaaaauaaauagauaaaaauaaaaacccauggaaaugguuuaagaaaaugg

SEQ ID NO: 296421 - RNA, 64 nt, hsa
acuugaggaaaaggagaguugacagcuguauuuaaaaacccauggagccgggugcgguggcuca

SEQ ID NO: 296422 - RNA, 64 nt, hsa
auuuaggguagagcacucuuuacagaagaacucaaaaacccaauuuggauaauuuucauuaucu

SEQ ID NO: 296423 - RNA, 64 nt, hsa
aacuuugagaccagaauuacagagaagaaaaaccaaaacccaacccugcauggucaaguggugc

SEQ ID NO: 296424 - RNA, 64 nt, hsa
aaaaauugaaguuuguaugauguaagagaugagaaaaacccaacaggaaacacagacacauccu

SEQ ID NO: 296425 - RNA, 64 nt, hsa
acaaaaaaaacccaacaacaacccagaacaaagcaaaacccagcagacuguacuuagcauuguc

SEQ ID NO: 296426 - RNA, 64 nt, hsa
caagaaaaccaaaaaccaaaacaaacaaacaaaaaaaacccaacaacaacccagaacaaagcaa

SEQ ID NO: 296427 - RNA, 64 nt, hsa
gggcccugugguuggacuucaccucucagcacugaaaacccaaaacccagcuggccuuaacacu

SEQ ID NO: 296428 - RNA, 64 nt, hsa
gugguuggacuucaccucucagcacugaaaacccaaaacccagcuggccuuaacacuccuuaaa

SEQ ID NO: 296429 - RNA, 64 nt, hsa
uaacacuccuuaaagacagaagucacacuugaacaaaacccacacacaacaaaaccugauuugg

SEQ ID NO: 296430 - RNA, 64 nt, hsa
uuuaaagaaaaaucuuuguuacucuguaaaugaaaaaacccauuuucgcuauaaauaaaaggua

SEQ ID NO: 296431 - RNA, 64 nt, hsa
uccccguccacagggcagccugagcgugcuuuccaaaacccaaauauggccacgcucccccucg

SEQ ID NO: 296432 - RNA, 64 nt, hsa
gaaaagucuaggaccuaucauuucaucagagacaugaucagaaaagaaacugcuucugccccau

SEQ ID NO: 296433 - RNA, 64 nt, hsa
acagacaaagccauugcuagaaaugucauuccaaugaucagaucuggaaacaggcugccauaac

SEQ ID NO: 296434 - RNA, 64 nt, hsa
cuaggaagauuccugauguugcacccauuguaagugaucagaaaccaucuguaucaaagucugg

SEQ ID NO: 296435 - RNA, 64 nt, hsa
cauccuaccauaaaagagaaaaaaauucggaaagugaucagagcacuuauucaaaauacaguga

SEQ ID NO: 296436 - RNA, 64 nt, hsa
gucgcaaauuugaucagagucacagaguagaauuugaucagaaucacagaaucaucagacauag

SEQ ID NO: 296437 - RNA, 64 nt, hsa
aauauaagacuuaauagauuaacugucgcaaauuugaucagagucacagaguagaauuugauca

SEQ ID NO: 296438 - RNA, 64 nt, hsa
agauguuuccagaaaucccuguuguaacaucaagugaucagaacuaaguuacugggaugacaau

SEQ ID NO: 296439 - RNA, 64 nt, hsa
ccuacgcaccagaacagaaggaggguggaggaagugaucagagggaacgagcuguagguuugca

SEQ ID NO: 296440 - RNA, 64 nt, hsa
uuugccacagaaaauggaggcuuucacaaggguuugaucagaauuaaaaccccaaacccgcccu

SEQ ID NO: 296441 - RNA, 64 nt, hsa
aaguugaccuugugucacuauuuauuuuaugcccugaucagacuagcaacuuagauaagugaaa

SEQ ID NO: 296442 - RNA, 64 nt, hsa
uaucaaauagacaaaaacagcuucacuuuagcaaugaucagauuguuaaucuacagauuuuauu

SEQ ID NO: 296443 - RNA, 64 nt, hsa
uaaaauuucuauuguugucuauugguaauguuuuugaucagaauaaagaggguaaagggaaaaa

SEQ ID NO: 296444 - RNA, 64 nt, hsa
ucuguuuucuuuuagcgaccccccaccgccaggcugaucagaagcugaugacucguggacaaau

SEQ ID NO: 296445 - RNA, 64 nt, hsa
cacauuggcuugugggcuuguucuuccugccaaaugaucagagaggaacauuccauuuauuugu

SEQ ID NO: 296446 - RNA, 64 nt, hsa
auuacaaucauuuauuuuauguccuauuauaauaaaaggugaggacuccuuguaaaaaaggaaa

SEQ ID NO: 296447 - RNA, 64 nt, hsa
ccuucagccuaaggcacaaggaugccaaaaaaacaaaggugagaaaccacaacacaggucuaaa

SEQ ID NO: 296448 - RNA, 64 nt, hsa
uuuguuaauucuauaaagguaucuguuagauauuaaaggugagaauuagggcagguuaaucaaa

SEQ ID NO: 296449 - RNA, 64 nt, hsa
aaucagauuaacagauacagguuucauagagaacaaaggugaucauuugaagggcaugcuguaa

SEQ ID NO: 296450 - RNA, 64 nt, hsa
ucaacugaaguaaaugaugucugaguguuacaguaaaggugaccaagucucuuucuuaaaguca

SEQ ID NO: 296451 - RNA, 64 nt, hsa
ugaauuugguauauguguauuagugaaacauuguaaaggugaacuucuaccucuguaucuaaau

SEQ ID NO: 296452 - RNA, 64 nt, hsa
uuauguuucauauacaccuuauauacaauaaccuaaaggugauuuuauaugauauuuugaguaa

SEQ ID NO: 296453 - RNA, 64 nt, hsa
caaaagcacacaaguauuuugggaaaaaauccuaaaaggugacuuaauuugaugccuuaaauuc

SEQ ID NO: 296454 - RNA, 64 nt, hsa
guggaagucauaguuuauauauuucgagguugccaaaggugacuucagauuaaagccuucugug

SEQ ID NO: 296455 - RNA, 64 nt, hsa
uucagaccuugacuauuugguguuuccaguucacaaaggugaugaagacugucuugggagcagc

SEQ ID NO: 296456 - RNA, 64 nt, hsa
ccaggcccucagguugaauccagagcuguagagguuacaguagcaucaccagccuugggggucc

SEQ ID NO: 296457 - RNA, 64 nt, hsa
acuggugccauagacacagguuuauaguuuuaacuuacaguauuguuugaaauuuaccuguuuu

SEQ ID NO: 296458 - RNA, 64 nt, hsa
cuagaaaauacguuugaaagcuuuaucuuauuauuuacaguauuuuuauauuucuuacauuauc

SEQ ID NO: 296459 - RNA, 64 nt, hsa
gggggaaaaggcuucaguaaagcagaggcuagaauuacaguauuuauacauagcaacuuuucau

SEQ ID NO: 296460 - RNA, 64 nt, hsa
uugaauguugacccauuugaguacgcuaaaaggcuuacaguaucagacacgaucaugguuuuag

SEQ ID NO: 296461 - RNA, 64 nt, hsa
auaacuugcaaguaauuuuuuguaaaagauugaauuacaguaaacccaucuuuccuuaacgaaa

SEQ ID NO: 296462 - RNA, 64 nt, hsa
aucuccaucaacugaaguaaaugaugucugaguguuacaguaaaggugaccaagucucuuucuu

SEQ ID NO: 296463 - RNA, 64 nt, hsa
guuuauucacauuguagaacagcaaaugacauuuuuacaguauuuuuuuguaaagcaaacuauu

SEQ ID NO: 296464 - RNA, 64 nt, hsa
ugccugccaccccuucccagucaucccuuuacucuuacaguagcaaauaagaccccugucuaau

SEQ ID NO: 296465 - RNA, 64 nt, hsa
ucccuaccaucccuucucagucaacccuuuacccuuacaguagcaagcauagaccccugucuaa

SEQ ID NO: 296466 - RNA, 64 nt, hsa
ugauuucccuuuggacuucauguauauuguacaguuacaguaaaauucaaccuuuauuuucuaa

SEQ ID NO: 296467 - RNA, 64 nt, hsa
ugaaaaaccaacauagcaucauuaaucaggaauauuacaguaaugaggauuuuuucuuucuuuu

SEQ ID NO: 296468 - RNA, 64 nt, hsa
aaauuuaaauggugggucuauaaauuuguucuuguuacaguaacuguaaagucggaguuuuagu

SEQ ID NO: 296469 - RNA, 64 nt, hsa
guuaaauuuagugcacucugucuuaaaaauacguuuacaguauuggguacauacaaggguaaaa

SEQ ID NO: 296470 - RNA, 64 nt, hsa
agacucugagucugauuacgaaaaguacucuauguuacaguaaagcuaccacucuggcugcuag

SEQ ID NO: 296471 - RNA, 64 nt, hsa
uuuuuuuauuuugauauuugucuuuuuuuaaauuuuacaguagucauugaaaguuauguuucuu

SEQ ID NO: 296472 - RNA, 64 nt, hsa
auguacuuuuacuuuuugcauuguccagacuucuuuauuagauggagauguuucuuuuucuguc

SEQ ID NO: 296473 - RNA, 64 nt, hsa
guguuaaauaaauguguaaaguaaccaccaaauguuauuagaauuuuucuucuagcauuuauaa

SEQ ID NO: 296474 - RNA, 64 nt, hsa
agcagaaucuauucucaguaaaauaacuuaugguuuauuagauauucuguauuggauuuuacca

SEQ ID NO: 296475 - RNA, 64 nt, hsa
ucauccugcugcugagggcagugcaaacaggugcuuauuagagguagugacuugcuuaauuagu

SEQ ID NO: 296476 - RNA, 64 nt, hsa
uuccauccuguuggugcagagaaauuuuggugauuuauuagaagacuuuuaaggaggguggaua

SEQ ID NO: 296477 - RNA, 64 nt, hsa
gacccuucguugacuaucaguacuguugauacauuuauuagaauguaugucucagaagaugguu

SEQ ID NO: 296478 - RNA, 64 nt, hsa
uucuuguuaaaauguaguuuuucauuuccuacauuuauuagauuuucauuuucuauuaacaauu

SEQ ID NO: 296479 - RNA, 64 nt, hsa
acaauugaauaccauuucaguuuauagacuuguuuuauuagauuuuaccaaugaauuuuucaaa

SEQ ID NO: 296480 - RNA, 64 nt, hsa
uacuguguggaacuuuuauuagauaacacacuuuuuauuagauaacgcuuaaaggaagucagua

SEQ ID NO: 296481 - RNA, 64 nt, hsa
augaauuaagacgguuaaauacuguguggaacuuuuauuagauaacacacuuuuuauuagauaa

SEQ ID NO: 296482 - RNA, 64 nt, hsa
aaccgccaccucaaugcauugucaguaggauacauuauuagaaacuguuagggucuuucccagg

SEQ ID NO: 296483 - RNA, 64 nt, hsa
aaccgccaccucaaugcauugucaguagaauacauuauuagaaacuguuaaggucuuucccggg

SEQ ID NO: 296484 - RNA, 64 nt, hsa
uaaaauuaucuuugaaacaccucuugaagcuaauuuauuagaaaaaauauuucaguuggaaggc

SEQ ID NO: 296485 - RNA, 64 nt, hsa
auaguuacuuuuuucacuuuuguuauauauguauuuauuagagcauuugaauauugguaccuuu

SEQ ID NO: 296486 - RNA, 64 nt, hsa
aacaucuuauauugaagauucugaaaaccuaucuuuauuagaggaaaaucucaaucuucaguuu

SEQ ID NO: 296487 - RNA, 64 nt, hsa
uguuuuauuuuuucucuagcuuaucccugcacaauuauuagagugaaugaaaaaccacuuuccu

SEQ ID NO: 296488 - RNA, 64 nt, hsa
uauguauaaaacugccaaaugcuuaccugguauuuuauuagaugcagaaacagauuggaaacag

SEQ ID NO: 296489 - RNA, 64 nt, hsa
ggauugcuuuguacagucaaggcaguucuccauuuuauuagaaaauacaaguugcuaagcacuu

SEQ ID NO: 296490 - RNA, 64 nt, hsa
accagcgaggaggcuccagagggcacucugcuuguuauuagagauuaccuccugagaaaaaagg

SEQ ID NO: 296491 - RNA, 64 nt, hsa
agcagcuuagacuaaggccauuauuguacuugccuuauuagagugucuuuccacggagccacuc

SEQ ID NO: 296492 - RNA, 64 nt, hsa
uaaaaaaaaaguguuuuuuuuccaccguugcugauuauuagacaguaggaaauagcuguuuucu

SEQ ID NO: 296493 - RNA, 64 nt, hsa
gauuccuuuuuucaauaaucuuaauucaaaagcauuauuagacuugaaaggguuugauaaucuc

SEQ ID NO: 296494 - RNA, 64 nt, hsa
guuauauaagguguauugaaaccugcagugcugauuauuagaaaggauuugucagauuuuugaa

SEQ ID NO: 296495 - RNA, 64 nt, hsa
cuauauggaccuuauaaaauugauuucuuauuuauuauuagacauuacuacuaaaagguacauc

SEQ ID NO: 296496 - RNA, 64 nt, hsa
ugauugauauaaccuaacaaaucugagccaguuauuauuagaguugcagaauagaaacuugaag

SEQ ID NO: 296497 - RNA, 64 nt, hsa
agugaaagcuuguuguaaagauauuuucuuuuuguuauuagaaggaaauacaaagagaaaaauu

SEQ ID NO: 296498 - RNA, 64 nt, hsa
uagccaguauuucugauuaacuaaguugaaacucuuauuagaaacuuucaguuggugauauugu

SEQ ID NO: 296499 - RNA, 64 nt, hsa
cuucuuagugucgaguguauuuauuaauaaaagcuuauuagaguguagaaaugccagcaagagu

SEQ ID NO: 296500 - RNA, 64 nt, hsa
auagaauaacauguuauuuauugguauugacuucuuauuagacagagcucauaguauuuguuuu

SEQ ID NO: 296501 - RNA, 64 nt, hsa
gggcaaccagaaguuaaggagguaaaguucuucuuuauuagaaaauuccaggcuaaugaaugca

SEQ ID NO: 296502 - RNA, 53 nt, hsa
gaauucauaauguaacuuaauaauuauuagaacucuuccuuugcgaauuuuau

SEQ ID NO: 296503 - RNA, 64 nt, hsa
guuaacaccucaccaaguucuuccagcaaaaugcuuauuagaguuuuugucugagcacaguagc

SEQ ID NO: 296504 - RNA, 64 nt, hsa
ggccugauuaaagcuuaucgaacuagacauuuguuuauuagaugagcucggcauuauuauuuuc

SEQ ID NO: 296505 - RNA, 62 nt, hsa
caagaaaaaaugaggaagaagcaaaagcagaaaccccugauaaacugaucagaucucaugag

SEQ ID NO: 296506 - RNA, 62 nt, hsa
caagagaaaaugaggaagaagcaaaaguggaaaccccugauaagccaucagaucuugugaaa

SEQ ID NO: 296507 - RNA, 62 nt, hsa
accaagccgggaaugagcuugugugcccugauaccccugaggguggcugccuccucuggucc

SEQ ID NO: 296508 - RNA, 62 nt, hsa
aagaggcaucgccugcaggacuuugcggugggaccccugaaacuggaccugcauagcuacgu

SEQ ID NO: 296509 - RNA, 62 nt, hsa
aacuaaaaacuccuuaacuuacuguugcuuacaccccugaaagucuguuuuuaagcaaaugg

SEQ ID NO: 296510 - RNA, 62 nt, hsa
uuuaacccuuuuaaaagagaccuauguugaaaaccccugaaaauucacugaagaaaaaucau

SEQ ID NO: 296511 - RNA, 62 nt, hsa
accugcacugcucaucugcuuuguguaacaugaccccugauaagauguugaaacuguuauuc

SEQ ID NO: 296512 - RNA, 62 nt, hsa
gaggggggugcuuuuguacugggauuuaagacaccccugauggaaugaaagccaacugaacc

SEQ ID NO: 296513 - RNA, 62 nt, hsa
gaaggagggaggaaauaugucccuugcacaccaccccugaagcacauggcaguaggaaacag

SEQ ID NO: 296514 - RNA, 62 nt, hsa
cuucacuccuuggggaagccaccucccaucacaccccugagcagaguuagggaggaauucua

SEQ ID NO: 296515 - RNA, 62 nt, hsa
ucacucccuagagccugacgccggggccccugaccccugagccucagauuccaauaccucac

SEQ ID NO: 296516 - RNA, 62 nt, hsa
ucacuccccagagccugaugccggggccccugaccccugaucuacggaggccugcucccgga

SEQ ID NO: 296517 - RNA, 62 nt, hsa
ccgaccccucagaauauaacccucaugccuggaccccugagagcuucugaucccagcuauua

SEQ ID NO: 296518 - RNA, 62 nt, hsa
aauuugauuccaagagagcuuaggaugacagcaccccugagcugggcaaagguacucaggac

SEQ ID NO: 296519 - RNA, 64 nt, hsa; identical to SEQ ID NO: 249425

SEQ ID NO: 296520 - RNA, 64 nt, hsa; identical to SEQ ID NO: 249426

SEQ ID NO: 296521 - RNA, 64 nt, hsa; identical to SEQ ID NO: 249427

SEQ ID NO: 296522 - RNA, 64 nt, hsa; identical to SEQ ID NO: 249428

SEQ ID NO: 296523 - RNA, 64 nt, hsa; identical to SEQ ID NO: 249429

SEQ ID NO: 296524 - RNA, 64 nt, hsa; identical to SEQ ID NO: 249430

SEQ ID NO: 296525 - RNA, 64 nt, hsa; identical to SEQ ID NO: 249431

SEQ ID NO: 296526 - RNA, 64 nt, hsa; identical to SEQ ID NO: 249432

SEQ ID NO: 296527 - RNA, 64 nt, hsa; identical to SEQ ID NO: 249433

SEQ ID NO: 296528 - RNA, 64 nt, hsa; identical to SEQ ID NO: 249434

SEQ ID NO: 296529 - RNA, 64 nt, hsa; identical to SEQ ID NO: 249435

SEQ ID NO: 296530 - RNA, 64 nt, hsa; identical to SEQ ID NO: 249436

SEQ ID NO: 296531 - RNA, 64 nt, hsa; identical to SEQ ID NO: 249437

SEQ ID NO: 296532 - RNA, 64 nt, hsa; identical to SEQ ID NO: 249438

SEQ ID NO: 296533 - RNA, 64 nt, hsa; identical to SEQ ID NO: 249439

SEQ ID NO: 296534 - RNA, 64 nt, hsa; identical to SEQ ID NO: 249440

SEQ ID NO: 296535 - RNA, 64 nt, hsa; identical to SEQ ID NO: 249441

SEQ ID NO: 296536 - RNA, 64 nt, hsa; identical to SEQ ID NO: 249442

SEQ ID NO: 296537 - RNA, 64 nt, hsa; identical to SEQ ID NO: 249443

SEQ ID NO: 296538 - RNA, 64 nt, hsa; identical to SEQ ID NO: 249444

SEQ ID NO: 296539 - RNA, 64 nt, hsa; identical to SEQ ID NO: 249445

SEQ ID NO: 296540 - RNA, 64 nt, hsa; identical to SEQ ID NO: 249446

SEQ ID NO: 296541 - RNA, 64 nt, hsa; identical to SEQ ID NO: 249447

SEQ ID NO: 296542 - RNA, 64 nt, hsa; identical to SEQ ID NO: 249448

SEQ ID NO: 296543 - RNA, 64 nt, hsa; identical to SEQ ID NO: 249449

SEQ ID NO: 296544 - RNA, 64 nt, hsa; identical to SEQ ID NO: 249450

SEQ ID NO: 296545 - RNA, 64 nt, hsa; identical to SEQ ID NO: 249451

SEQ ID NO: 296546 - RNA, 64 nt, hsa; identical to SEQ ID NO: 249452

SEQ ID NO: 296547 - RNA, 64 nt, hsa; identical to SEQ ID NO: 249453

SEQ ID NO: 296548 - RNA, 64 nt, hsa; identical to SEQ ID NO: 249454

SEQ ID NO: 296549 - RNA, 64 nt, hsa; identical to SEQ ID NO: 249455

SEQ ID NO: 296550 - RNA, 64 nt, hsa; identical to SEQ ID NO: 249456

SEQ ID NO: 296551 - RNA, 64 nt, hsa; identical to SEQ ID NO: 249457

SEQ ID NO: 296552 - RNA, 64 nt, hsa; identical to SEQ ID NO: 249458

SEQ ID NO: 296553 - RNA, 64 nt, hsa; identical to SEQ ID NO: 249459

SEQ ID NO: 296554 - RNA, 64 nt, hsa; identical to SEQ ID NO: 249460

SEQ ID NO: 296555 - RNA, 64 nt, hsa; identical to SEQ ID NO: 249461

SEQ ID NO: 296556 - RNA, 64 nt, hsa; identical to SEQ ID NO: 249462

SEQ ID NO: 296557 - RNA, 64 nt, hsa; identical to SEQ ID NO: 249463

SEQ ID NO: 296558 - RNA, 64 nt, hsa; identical to SEQ ID NO: 249464

SEQ ID NO: 296559 - RNA, 64 nt, hsa; identical to SEQ ID NO: 249465

SEQ ID NO: 296560 - RNA, 64 nt, hsa; identical to SEQ ID NO: 249466

SEQ ID NO: 296561 - RNA, 64 nt, hsa; identical to SEQ ID NO: 249467

SEQ ID NO: 296562 - RNA, 64 nt, hsa; identical to SEQ ID NO: 249468

SEQ ID NO: 296563 - RNA, 64 nt, hsa; identical to SEQ ID NO: 249469

SEQ ID NO: 296564 - RNA, 64 nt, hsa; identical to SEQ ID NO: 249470

SEQ ID NO: 296565 - RNA, 64 nt, hsa; identical to SEQ ID NO: 249471

SEQ ID NO: 296566 - RNA, 64 nt, hsa; identical to SEQ ID NO: 249472

SEQ ID NO: 296567 - RNA, 64 nt, hsa; identical to SEQ ID NO: 249473

SEQ ID NO: 296568 - RNA, 64 nt, hsa; identical to SEQ ID NO: 249474

SEQ ID NO: 296569 - RNA, 64 nt, hsa; identical to SEQ ID NO: 249475

SEQ ID NO: 296570 - RNA, 64 nt, hsa; identical to SEQ ID NO: 249476

SEQ ID NO: 296571 - RNA, 64 nt, hsa; identical to SEQ ID NO: 249477

SEQ ID NO: 296572 - RNA, 64 nt, hsa; identical to SEQ ID NO: 249478

SEQ ID NO: 296573 - RNA, 64 nt, hsa; identical to SEQ ID NO: 249479

SEQ ID NO: 296574 - RNA, 64 nt, hsa; identical to SEQ ID NO: 249480

SEQ ID NO: 296575 - RNA, 64 nt, hsa; identical to SEQ ID NO: 249481

SEQ ID NO: 296576 - RNA, 64 nt, hsa; identical to SEQ ID NO: 249482

SEQ ID NO: 296577 - RNA, 64 nt, hsa; identical to SEQ ID NO: 249483

SEQ ID NO: 296578 - RNA, 64 nt, hsa; identical to SEQ ID NO: 249484

SEQ ID NO: 296579 - RNA, 64 nt, hsa
gcccagcccucagauggcucuccuacaugauggugcuuuagaaacaaagguaaaauuugccugu

SEQ ID NO: 296580 - RNA, 64 nt, hsa
ugaucccaguguccuuuuccaaaugagugcuguagcuuuagaaguggcccucuauagaaagaag

SEQ ID NO: 296581 - RNA, 64 nt, hsa
caguucacuuuuacacgguagccuugaagugaaggcuuuagaugugggaccccccuaauguaau

SEQ ID NO: 296582 - RNA, 64 nt, hsa
ccauuucgguagagaacacacuacacugaacccugcuuuagagcuguguguugagcuaaaaaua

SEQ ID NO: 296583 - RNA, 64 nt, hsa
gacaaguagaauaaauguugcuguggaaugccaugcuuuagaacaaacccuuuuugaucuuaau

SEQ ID NO: 296584 - RNA, 64 nt, hsa
uggggagcguucgccguagucuuuggaagcuuuggcuuuagauuuaccaagccccgccuccccg

SEQ ID NO: 296585 - RNA, 64 nt, hsa
acuauaaguacaaaguuuuugggguuuuaucuuugcuuuagaaguggauguguacuucaccucu

SEQ ID NO: 296586 - RNA, 64 nt, hsa
agccuaauguagaaggugguuacuuggaccagaggcuuuagauuauuauuuuagauccuacaua

SEQ ID NO: 296587 - RNA, 64 nt, hsa
ugcugcccccaccccucuuuuccaguccuugccuuccaaccaaaagaaauggauguuuuggugg

SEQ ID NO: 296588 - RNA, 64 nt, hsa
cauuuuuagaguguauaaaauucugucuuucauuuccaaccauuuuucaagagaagcugcuacu

SEQ ID NO: 296589 - RNA, 64 nt, hsa
guucaucuucccucgauugguuaacuccuuaguuucagaccacagacucaagauuggcucuucc

SEQ ID NO: 296590 - RNA, 64 nt, hsa
agggagcagggcaggggcugaaaggggcacugauucagaccagggaggcaacuacacaccaacc

SEQ ID NO: 296591 - RNA, 64 nt, hsa
auaaauagauugggaccaucagaccaugggaccaucagaccaugaccacuguaggagugaugac

SEQ ID NO: 296592 - RNA, 64 nt, hsa
aauguuggauggauggauaaauagauugggaccaucagaccaugggaccaucagaccaugacca

SEQ ID NO: 296593 - RNA, 64 nt, hsa
aagggcaccugcagacacuuucugcaauaagcucucagaccaucagcauccuccuggccagcca

SEQ ID NO: 296594 - RNA, 64 nt, hsa
aagggcacaugcacacauuuucugcaauucacucucagaccaucagcauccuccuggccagcug

SEQ ID NO: 296595 - RNA, 64 nt, hsa
aaacucaagcagauucgcaagugcugugcgcuugucagaccaucagaccagggccaaccaauca

SEQ ID NO: 296596 - RNA, 64 nt, hsa
gcagauucgcaagugcugugcgcuugucagaccaucagaccagggccaaccaaucagaaggcaa

SEQ ID NO: 296597 - RNA, 64 nt, hsa
ccuuauuugguuacauggcaccugagaguuucacucagaccagggaucuuccuuaggaggguca

SEQ ID NO: 296598 - RNA, 64 nt, hsa
ccagggaucuuccuuaggagggucaaagugcagaucagaccaugcagguaaggugaaccagcug

SEQ ID NO: 296599 - RNA, 64 nt, hsa
agacucugaucugaggaccccgucgggguccagaucaggucacucugccccagugcucucuugc

SEQ ID NO: 296600 - RNA, 64 nt, hsa
aaaugcucagagagcaagccuguguguggggaugucaggucaggagcuggaaguucaccugcag

SEQ ID NO: 296601 - RNA, 64 nt, hsa
uugccucaccccugcauggucggaaaucuucguuucaggucagaacagccuggggucugugggu

SEQ ID NO: 296602 - RNA, 64 nt, hsa
uuuuaaaaaauuuauuaaacauuauuaaacuugaucaggucaggccaaauaaaguuuuauugga

SEQ ID NO: 296603 - RNA, 64 nt, hsa
gcccuugcugagauuguagagauugagugcucuggaccgcaaaagccaggcuaguccuuguagg

SEQ ID NO: 296604 - RNA, 64 nt, hsa
aaguggacccugagccuagaagagcagaauccaggaccgcaaacugccaaggacaucccccuuc

SEQ ID NO: 296605 - RNA, 64 nt, hsa
guggcugguguuuguaguugacauaaaggauuaagaccgcaaauuguccuucauggguagaguc

SEQ ID NO: 296606 - RNA, 64 nt, hsa
ucaaccauguuggucaggcuggucucgaacuccugaccgcaagugauccacacgccuuggucuc

SEQ ID NO: 296607 - RNA, 64 nt, hsa
acacuguuaguguaacgugccaguggaguggaaagaccgcaacaccugaauccuggguuuugua

SEQ ID NO: 296608 - RNA, 64 nt, hsa
aaaaggggacacagaagcacuggcugcugcuacagaccgcaaaagcagaaaguuucgugaaaau

SEQ ID NO: 296609 - RNA, 64 nt, hsa
uugccacaugauaaucacccuucaucagaaaugggaccgcaagugguaggcagugucccuucug

SEQ ID NO: 296610 - RNA, 64 nt, hsa
uacaccaacuucuaaaaagaaaguacgaauuaaagaccgcaauaaacuuucuacagaggaacgc

SEQ ID NO: 296611 - RNA, 64 nt, hsa
gccucaugcaagucauccccgacaugaccuucacgaccgcaaugcaaggaggggaagaaaguca

SEQ ID NO: 296612 - RNA, 64 nt, hsa
guucacaggggcuagccaccuguacuacggugccgaccgcaaugcgaggaaugugguggccacg

SEQ ID NO: 296613 - RNA, 64 nt, hsa
agucuagagcugguauucuagcccaaaucugucugaccgcaauacacagauucuuuauuccuau

SEQ ID NO: 296614 - RNA, 64 nt, hsa
uucaccauguuggucaggcuagucucgaacucgugaccgcaagcgauucacccaccucagccuc

SEQ ID NO: 296615 - RNA, 64 nt, hsa
ucagccugagggccugcggagccucaagaagccagaccgcaagaagcgcuacaccguggugggc

SEQ ID NO: 296616 - RNA, 64 nt, hsa
agaugugguauaugaucuuaaaugaugaacaugagaccgcaaaaauucacuccuggagaucucc

SEQ ID NO: 296617 - RNA, 64 nt, hsa
ccugugguuugccauccgcuguggcugcagcuuggaccgcaagggcaaauacacccugacccca

SEQ ID NO: 296618 - RNA, 64 nt, hsa
uucaccguguuggccaggcugaucucgaacuccugaccgcaagugauccacccgccucggucuc

SEQ ID NO: 296619 - RNA, 64 nt, hsa
ggcauucucucuggcgauggaguguggcugggcugaccgcaaaaggugccuuacacacugcccc

SEQ ID NO: 296620 - RNA, 64 nt, hsa
uucaccacguuggccaggcuggucucgaacuccugaccgcaagugauccacccgccuccgccuc

SEQ ID NO: 296621 - RNA, 64 nt, hsa
gaaaagccuuacccauuuugguuuucacuauugagaccgcaacugcuugcacugaucauuuugg

SEQ ID NO: 296622 - RNA, 64 nt, hsa
guagccgggcucugcacccacgugcauucacauugaccgcaacucacacauucccccaccagcu

SEQ ID NO: 296623 - RNA, 64 nt, hsa
auuaaaauuaaaagcaaaaccacaagaagggaaagaccgcaacucggacagcccagcgacuucc

SEQ ID NO: 296624 - RNA, 64 nt, hsa
augaacuguacuggcuguugaccaccagacaccugaccgcaaauaucuuuucuuguauucccau

SEQ ID NO: 296625 - RNA, 64 nt, hsa
cuagacugaaaugauacaaacuuccaucuggucugaccgcaaacaguguuuauuuggggacagg

SEQ ID NO: 296626 - RNA, 64 nt, hsa
gagauccgugcgcccgaccagcaccagcaucgcggaccgcaaaggccgcccgucccgucaaaca

SEQ ID NO: 296627 - RNA, 64 nt, hsa
caaagccccuggucauacaggccagggaacauaagaccgcaauucuaaguuucuagauaaacag

SEQ ID NO: 296628 - RNA, 64 nt, hsa
gugcauuuauugccucuaugugcaacugacagaugaccgcaauaaugaaugagcaguuagaaau

SEQ ID NO: 296629 - RNA, 64 nt, hsa
acaaauguuuuuauuaaauguuucauugacccaaguaauuuaaaaguaauauguuaccuauguc

SEQ ID NO: 296630 - RNA, 64 nt, hsa
agcugaucuguaaaugacuuuaaaagcuauuuuaguaauuuaaauaaauuuacuuucuugguuu

SEQ ID NO: 296631 - RNA, 64 nt, hsa
caauacauuuaacacuauuguauuuuuauuauauguaauuuaguaauaugaauauaaaucuugu

SEQ ID NO: 296632 - RNA, 64 nt, hsa
acaaaagcugcaguaaccugucuucaguuacuuuguaauuuauuguggcaugagauaagauggg

SEQ ID NO: 296633 - RNA, 64 nt, hsa
cuugucuucuauaccacccuuguccucaucucagguaauuuaugaaaucuauguaaacuugaaa

SEQ ID NO: 296634 - RNA, 64 nt, hsa
augaaucuugguauccugugaaacagaauaauucguaauuuaagaaagcccuuaucccgguaac

SEQ ID NO: 296635 - RNA, 64 nt, hsa
uauugcuguuagaaguccuaaaagaggauggguuguaauuuagcauaauauucugaauucauuc

SEQ ID NO: 296636 - RNA, 64 nt, hsa
ccacauccaccuucggaauacauuaacuuccuuuguaauuuauuugaaaguaguguuaaacuca

SEQ ID NO: 296637 - RNA, 64 nt, hsa
ucucauagauaauuuucaaauauuuuccuuggcuguaauuuauguauucauuuauauccuaucc

SEQ ID NO: 296638 - RNA, 64 nt, hsa
uuuaaggaaugaggaaacaaaccacccucuggggguaauuuacagacugagugacaguacucag

SEQ ID NO: 296639 - RNA, 64 nt, hsa
ccaggacagagccacaaucuuccucuauuucauuguaauuuauauauuucacuuguauucauuu

SEQ ID NO: 296640 - RNA, 64 nt, hsa
gaguucuucuuucuuucuuuuuuuuuuuuuuuuaguaauuuagcaaaaacauuacuguucuaau

SEQ ID NO: 296641 - RNA, 64 nt, hsa
caucaagaaaaguguaagaaauuauuuuugagauguaauuuaagauuguuuuauguaaaaggaa

SEQ ID NO: 296642 - RNA, 64 nt, hsa
uaaacauggguuuuuaacuucaagaucugccccaguaauuuaccaaagguagcaaaauaauagu

SEQ ID NO: 296643 - RNA, 64 nt, hsa
aggugucuaaaucuccagucugucuguuguacugguaauuuaacucuguaauggaauaguuugc

SEQ ID NO: 296644 - RNA, 64 nt, hsa
uuucauugggcaacagcuaagagggcccagcaagguaauuuaugguugagcugaugucaauugg

SEQ ID NO: 296645 - RNA, 64 nt, hsa
aaaaaagaaaagacaaaaaaaucagcuuuggaaaguaauuuaaauguaccuuauuuuuuuuuuc

SEQ ID NO: 296646 - RNA, 64 nt, hsa
ucaucaacagucaacauaaaaauuucaauuuucaguaauuuaguggaaaauaucuuauuucuuu

SEQ ID NO: 296647 - RNA, 64 nt, hsa
uuaaacuauuaauaagcauaacuuuucuacugguguaauuuaaguauaaaguaaaauaaugggc

SEQ ID NO: 296648 - RNA, 64 nt, hsa
uuuguagcagaauauauuugcagcuauugacuuuguaauuuaggaaaaauguauaauaagauaa

SEQ ID NO: 296649 - RNA, 64 nt, hsa
cuuauguccacccuuuuaaaaauuauuauuugaaguaauuuauuuacaggaaauguuaaugaga

SEQ ID NO: 296650 - RNA, 64 nt, hsa
uuuucugcuacuauaacagaauacgacagacuggguaauuuaaaaagaaaagaaauuuauuuuc

SEQ ID NO: 296651 - RNA, 64 nt, hsa
aacaagagagggugagauuaaccuuuuugcuaaaguaauuuacaagucaaagacaggaagagau

SEQ ID NO: 296652 - RNA, 64 nt, hsa
uucuuuauuauugacggcuguauugaugggauugguaauuuaguccuucauauuaaucucuauu

SEQ ID NO: 296653 - RNA, 64 nt, hsa
uagcccuauuugauacuugacagugcaaguuucuguaauuuaaaaagaugugguggccugacac

SEQ ID NO: 296654 - RNA, 64 nt, hsa
uuggauuuuuaaauacauuuuuaaaauuucagauguaauuuaacaucacauuuguuuuucaggu

SEQ ID NO: 296655 - RNA, 64 nt, hsa
uauuuuacaucuuauuuuugccuuuauuucauaaguaauuuaaaaaucacuggauugcuuuauu

SEQ ID NO: 296656 - RNA, 64 nt, hsa
uuuuuucuaauacauggaauacauuuuguuggagguaauuuaugugauucauauaccacugcua

SEQ ID NO: 296657 - RNA, 64 nt, hsa
auccauguauaaaauagauagaaaacuuugcuugguaauuuaaaauuaauaaugccaguuuucc

SEQ ID NO: 296658 - RNA, 64 nt, hsa
agggcaaaaugugucagaugcccuaguuaaucauguaauuuaauucugguauugugagugguua

SEQ ID NO: 296659 - RNA, 64 nt, hsa
ugaguuaaucuguuguaauuguaguauuguuuuuguaauuuaacaauaaauaagccugcuacau

SEQ ID NO: 296660 - RNA, 64 nt, hsa
aaguuauucaaagaauguuaucuuucuugcaagaguaauuuaagcacaugggaaagauucuaga

SEQ ID NO: 296661 - RNA, 64 nt, hsa
aaauacuauaugugagacugacaaaaaccuuaauguaauuuacuuauaaugccagaaggaaaac

SEQ ID NO: 296662 - RNA, 64 nt, hsa
aguuuauuugcuuuuuaaacauuagccuaugguaguaauuuauguagaauaaaagcauuaaaaa

SEQ ID NO: 296663 - RNA, 64 nt, hsa
ccaucauagcagcauuucuguaucuugaaaaaauguaauuuauuuuugauaacggcucuuaaac

SEQ ID NO: 296664 - RNA, 64 nt, hsa
uucauugaaguauuuuggucuuaagaugacuuuaguaauuuaacuguuuauguuacccacguug

SEQ ID NO: 296665 - RNA, 64 nt, hsa
uauuuuuguuaagaaucauguacagagcuuaaauguaauuuauauguuuuuaauaugccauuuu

SEQ ID NO: 296666 - RNA, 64 nt, hsa
uauagcacaucucauguuuuaucauuuggauggaguaauuuaaaaugaauuaaauuccagagaa

SEQ ID NO: 296667 - RNA, 64 nt, hsa
caaaaugaaaucaauguuuaguucacaaguagauguaauuuacuaaagaaugauacacccauau

SEQ ID NO: 296668 - RNA, 64 nt, hsa
uauacuaucaagaaaaaauucugugaauuaagauguaauuuauaaaauaacauuucaauggggg

SEQ ID NO: 296669 - RNA, 64 nt, hsa
agauauuacauggacuaaauuuugucaauuucauguaauuuacccuuugcaauaaaaaugauuc

SEQ ID NO: 296670 - RNA, 64 nt, hsa
uuagugucuccuuccuaaagagcacuuuuguauuguaauuuauuuuuuauuaugcuuuaaacac

SEQ ID NO: 296671 - RNA, 64 nt, hsa
aagucuaugcucauuugcagacuggaaucauuaaguaauuuaauaaaaaaauugugaaacagca

SEQ ID NO: 296672 - RNA, 64 nt, hsa
gcauuauuuuucuuaauaucuauuuacuaaguauguaauuuaauauacauuaauuauuuuuuga

SEQ ID NO: 296673 - RNA, 64 nt, hsa
ucaaucuguucaguuuaccaagguucagaaauacguaauuuagcaggaaacuauaaauaccagu

SEQ ID NO: 296674 - RNA, 64 nt, hsa
aauguugaaccucacacuuuuauguggugacaguguaauuuaauuaaaagguguaaauguuuuc

SEQ ID NO: 296675 - RNA, 64 nt, hsa
aucccuacguguugugggagggacccagugggcaguaauuuaaucaugguggugguuacccuca

SEQ ID NO: 296676 - RNA, 64 nt, hsa
acaagcuaauugaauuaggcuugugacaauuagaguaauuuacaugacagguaaaacuccuauu

SEQ ID NO: 296677 - RNA, 64 nt, hsa
uuucauuuugauuuuuaugaaaguugcaauucauguaauuuauauaaacuuuuuaaauguagaa

SEQ ID NO: 296678 - RNA, 64 nt, hsa
uguguccaguuuugccugucuauaaaagaugauaguaauuuaccaagugacauuugcagagaaa

SEQ ID NO: 296679 - RNA, 64 nt, hsa
uuaaugaaauauuuuauaauuugcaaauuuuuaaguaauuuaugaaaaaccuagaucaguggau

SEQ ID NO: 296680 - RNA, 64 nt, hsa
gugucucuacaugccuuugauuccuuagaggucgguaauuuaacauaaaacagggaugucacuu

SEQ ID NO: 296681 - RNA, 64 nt, hsa
guugagaaagaaacacuaacaaaaggaacaacgaguaauuuauaaaauuguuuaaaauguuggu

SEQ ID NO: 296682 - RNA, 64 nt, hsa
uacagaaggaagggagggauuauuuuucuacaaaguaauuuaugauuucuaauuuucuaaugug

SEQ ID NO: 296683 - RNA, 64 nt, hsa
uuccuccaccuaggauuaagcuggagagaaguaaguaauuuagguuucaugguacuguagaggc

SEQ ID NO: 296684 - RNA, 64 nt, hsa
gcaaaagguguccacaguguauuagugacauucuuucauugacagcugacauaauucauugagu

SEQ ID NO: 296685 - RNA, 64 nt, hsa
auuagugacauucuuucauugacagcugacauaauucauugagugaaauauuuuaagccaaaaa

SEQ ID NO: 296686 - RNA, 64 nt, hsa
uaugaaacauauaagcuaacuauauaucaaacauuucauugaguuuggauguauuuuccacaua

SEQ ID NO: 296687 - RNA, 64 nt, hsa
acagaggaugacacauaggcaaaugugacauguuuucauugauuuaaacagugugauuugugau

SEQ ID NO: 296688 - RNA, 64 nt, hsa
ucauugcugaguacugcuucauugaauagauuuguucauugaccuaucgauggacaccuggguu

SEQ ID NO: 296689 - RNA, 64 nt, hsa
uuuuguuuuuauguuuuucauugcugaguacugcuucauugaauagauuuguucauugaccuau

SEQ ID NO: 296690 - RNA, 64 nt, hsa
uuagaaaguucuagaaaauaggaaaacgaaaaauuucauugagaugaguagugcauuuaauuau

SEQ ID NO: 296691 - RNA, 61 nt, hsa
ugucauuuauagaucccuaaguuauuuacuuuucauugaauugaaauuuauuuuggaugaa

SEQ ID NO: 296692 - RNA, 64 nt, hsa
gcagaaagaacucagauguacuagauuuucauuguucauugauaugcucaguaugcugccacau

SEQ ID NO: 296693 - RNA, 64 nt, hsa
uucuuuaaaguuuucugacgugcauaaugcauaauucauugaaaagcaugauagcaauguggca

SEQ ID NO: 296694 - RNA, 64 nt, hsa
uguucuuuguauuugguaaauuuauuuuguguuguucauugaacuuuugcuauggaaacuuuug

SEQ ID NO: 296695 - RNA, 64 nt, hsa
aaggaaugaaaacugguucaacauggaaaugauuuucauugauucguaugccagcucaccuuuu

SEQ ID NO: 296696 - RNA, 64 nt, hsa
aguggaauuucuucaaacagagaaagagaggcuguucauugauccacuauucccucuauuuucc

SEQ ID NO: 296697 - RNA, 64 nt, hsa
gacaauauuguggcucguccugauauuuuuuucauucauugacuuugagaagacuccaccugug

SEQ ID NO: 296698 - RNA, 64 nt, hsa
uugggcaauaaugcauaggaguucuugauaccccuucauugauuacuguguaucaguucuuugu

SEQ ID NO: 296699 - RNA, 64 nt, hsa
aaccaauuuuuaacuuucucuucucauuccuguuuucauugauuucccacauguaguccuuuug

SEQ ID NO: 296700 - RNA, 64 nt, hsa
aaccacaaugccucauuguaaugggauauugaaguucauugaagaauuacuagguugccaugug

SEQ ID NO: 296701 - RNA, 64 nt, hsa
guuaaaauggaaccuuacgguuguguuuuaaguauucauugaaaccagcuucagaaaacaagau

SEQ ID NO: 296702 - RNA, 64 nt, hsa
accaaguaucauuugguuaucuuacugggacauuuucauugauauucuauacaccaaaguuuug

SEQ ID NO: 296703 - RNA, 64 nt, hsa
uauuauauauaaaauauaguuccccgucccccuuuucauugaguuugauauucuucaguaaagc

SEQ ID NO: 296704 - RNA, 64 nt, hsa
guaguugaucuaauaaaugagagcagggaggagauucauugacucugaaaugauuuuuauuuuu

SEQ ID NO: 296705 - RNA, 64 nt, hsa
uuccuuuacagugccuagugcuacucauuauguguucauugaauuugacugacauaguuaaaaa

SEQ ID NO: 296706 - RNA, 64 nt, hsa
uggccuuugguugauagauccucugccucggaauuucauugaguuuuuuucuuccuugccuuug

SEQ ID NO: 296707 - RNA, 64 nt, hsa
guggugcugcguucuggccaguaaauuccauguuuuuggcuauaucucauccaaacugagcagu

SEQ ID NO: 296708 - RNA, 64 nt, hsa
uacuuaaaaaaaaaaggauauguuuacauuuaauuuuggcuaccaggaguuuaguuuauuuuau

SEQ ID NO: 296709 - RNA, 64 nt, hsa
gauaguuucucuaaugcugucucaauugcuggccuuuggcuaccuguacuuccccauuauggca

SEQ ID NO: 296710 - RNA, 64 nt, hsa
ucaguuauaggggugauuagcaucaagggcacacuuuggcuacugauuagacaauuauaccuac

SEQ ID NO: 296711 - RNA, 64 nt, hsa
cacuuuuagagauugucuauucaucugauaaucuuuuggcuaaaggguaaugauuagcacuaau

SEQ ID NO: 296712 - RNA, 64 nt, hsa
aguguuguuguuguuguuuuguuguuguucuuuuuuuggcuaagauucuuagaaucaaugaaug

SEQ ID NO: 296713 - RNA, 64 nt, hsa
uuuauacucuggacauaguuuuaacugcaacugcuuuggcuaccaguuuaaaccgaguucuuca

SEQ ID NO: 296714 - RNA, 64 nt, hsa
aaauaaaaguuugauguuugcuagccgugguccuuuuggcuaugguugcgguuccccuguaaag

SEQ ID NO: 296715 - RNA, 64 nt, hsa
gcagaguccuuauucuucucauaaaucuuuuuacuuuggcuacaaauagaugaugguaugauuc

SEQ ID NO: 296716 - RNA, 64 nt, hsa
agcuuauuacagaaaaaccccguuucccugaacuuuuggcuaacagaaauuaauuuaacugaca

SEQ ID NO: 296717 - RNA, 64 nt, hsa
auguucaguuuuaacuaaaacuaaauuuauguuauuuggcuaaauguuaugaugcagucuagua

SEQ ID NO: 296718 - RNA, 64 nt, hsa
ucaacaguuaaagacuauggugguuuuuucagaguuuggcuaagaauguuguuaccaucuucuu

SEQ ID NO: 296719 - RNA, 64 nt, hsa
uagaguauuugcagaaggaaaccauuucugguuauuuggcuauaaaaagucagcauaaaauaug

SEQ ID NO: 296720 - RNA, 64 nt, hsa
ugcgaaugauuugauauuuucauccuuauuucucuuuggcuacaauuuauauugaguuauaucu

SEQ ID NO: 296721 - RNA, 64 nt, hsa
uauuugaguuugcagaauuaucuaauagucuuuuuuuggcuaauauuuuuauaacgugguucuu

SEQ ID NO: 296722 - RNA, 64 nt, hsa
uggugaauuacuaaacugauugacuuucagccuuuuuggcuagauccugagaggcuauuuuucu

SEQ ID NO: 296723 - RNA, 64 nt, hsa
aaaguaaaagugacuuaauuugaaauuacuucuguuuggcuaguuugcuuagcugaucaccacc

SEQ ID NO: 296724 - RNA, 64 nt, hsa
aaaaaaacccacccuuuuucauuucccaacauuuuuuggcuauuaugaucgcuauguguuccuu

SEQ ID NO: 296725 - RNA, 63 nt, hsa
ccccugggcucugccccagcucuggcuuccagaaaaccccagcauccuuuucugcagaggggc

SEQ ID NO: 296726 - RNA, 63 nt, hsa
uaggaguucgagaccagccuggccaacaugguaaaaccccaucucuacuaaaaauacagaaau

SEQ ID NO: 296727 - RNA, 63 nt, hsa
agagggcccuugucugagaaaccccaaaccaggaaaccccaccuacccaaccauccacccaag

SEQ ID NO: 296728 - RNA, 63 nt, hsa
cagggcacccucccuagagggcccuugucugagaaaccccaaaccaggaaaccccaccuaccc

SEQ ID NO: 296729 - RNA, 63 nt, hsa
acaaaggccuagaccagccugggcaacauggugaaaccccaucucuacaaaaaauuuuuaaaa

SEQ ID NO: 296730 - RNA, 63 nt, hsa
caggagaucaagaccauccuggccaacauggugaaaccccaucucuacugaauacacaaaaau

SEQ ID NO: 296731 - RNA, 63 nt, hsa
caagagaucaagaccauccucgccaacaaggugaaaccccaccucuauuaaaaauacaaaaau

SEQ ID NO: 296732 - RNA, 63 nt, hsa
caggaguucgagagcagccuggccaauaugaugaaaccccaucucuacuaaaaauacaaaaau

SEQ ID NO: 296733 - RNA, 63 nt, hsa
cucugaaguaauucccagaauacgguccuuccuaaaccccagaaauugccuuuuucagaguuu

SEQ ID NO: 296734 - RNA, 63 nt, hsa
uaaaccauguguagagcuuuaaaaacagaaaaaaaaccccauauacuuaugaccaucuuaaau

SEQ ID NO: 296735 - RNA, 63 nt, hsa
ccuugaucuaccauccauccucuuccccaauccaaaccccacagucucuucucucccacaccc

SEQ ID NO: 296736 - RNA, 63 nt, hsa
uaauauuuaaaauucaaauauuaaaacucaaauaaaccccaaagaacuuuuggaaaacaaaag

SEQ ID NO: 296737 - RNA, 63 nt, hsa
caggauuuugagaacagcuuggacaucaugacgaaaccccaucuccacaaaaaaauucaaaaa

SEQ ID NO: 296738 - RNA, 63 nt, hsa
ccggaguucgaggcugguuuggccagcauggcgaaaccccaucucuacuaaaaauacaaaaaa

SEQ ID NO: 296739 - RNA, 63 nt, hsa
uaccugcaugcaggcaccagagcagggacugagaaaccccaaggaugggucaucuaagugcug

SEQ ID NO: 296740 - RNA, 63 nt, hsa
ucauuuccuuuuuguauuuuuaaacaagaaagaaaaccccaguccucauuugccuucccuacc

SEQ ID NO: 296741 - RNA, 63 nt, hsa
cuugguacccauucccauuucacaaacuccuccaaaccccaaaccccaaacggaaaucucugg

SEQ ID NO: 296742 - RNA, 63 nt, hsa
cccauucccauuucacaaacuccuccaaaccccaaaccccaaacggaaaucucugggacaaug

SEQ ID NO: 296743 - RNA, 63 nt, hsa
cacaguacugggaaaugggagcauaguacugggaaaccccagaccuggauucugaguuuuuca

SEQ ID NO: 296744 - RNA, 63 nt, hsa
caggugccccugugauccaggucuucuacccugaaaccccacccuccaucaagguccugccug

SEQ ID NO: 296745 - RNA, 63 nt, hsa
caagaugacaugacaucacucccaauucucuccaaaccccagagaaauacugacgaaguuuuc

SEQ ID NO: 296746 - RNA, 63 nt, hsa
auguucaucuuguaaucauagcaaaaagucugcaaaccccagggucaagccugcucugccaca

SEQ ID NO: 296747 - RNA, 63 nt, hsa
caugucccaaggcauaacuucccaacauuuaagaaaccccaauagacaccucugcccuggcca

SEQ ID NO: 296748 - RNA, 63 nt, hsa
uaggaguucaagaccagccuggccaacauggugaaaccccaucucuacuaaaaauacaaaaaa

SEQ ID NO: 296749 - RNA, 63 nt, hsa
cuuauuacacauaagauaauucauagcggagagaaaccccacaaaugugaagaauguggcaga

SEQ ID NO: 296750 - RNA, 63 nt, hsa
cuuaguacacauaagaaaauucauacuggggagaaaccccacaaauguggagaaugcggaaaa

SEQ ID NO: 296751 - RNA, 63 nt, hsa
cuuucugcacauaauauaauucauacuggagagaaaccccacaaauaugaagaaugugguaau

SEQ ID NO: 296752 - RNA, 63 nt, hsa
caggaguucgagaccagccuggucaagauggugaaaccccaucucuacuaaaauuacaaaaau

SEQ ID NO: 296753 - RNA, 63 nt, hsa
caggaguuugaaaccagccuggccaacauggugaaaccccaucucuacuaaaaaaacaaaacu

SEQ ID NO: 296754 - RNA, 63 nt, hsa
ugcuucaaaugcacacaggccuaguugaaguuuaaaccccagcaaaacauuccucccuguaaa

SEQ ID NO: 296755 - RNA, 63 nt, hsa
auugaaugggggugggggcucguguguccugggaaaccccaucagucccuucauuucuugaga

SEQ ID NO: 296756 - RNA, 63 nt, hsa
cgggaguucgagaccagccuuaccaacauggagaaaccccaucucuacuaaaaauacaaaauu

SEQ ID NO: 296757 - RNA, 62 nt, hsa
aggaggaggaggaagaauaaggaggaaaaccaaaaccccaagcacccauuaaacaaguccug

SEQ ID NO: 296758 - RNA, 63 nt, hsa
gauuggcaaaaaagauuggcacaaagcaugaagaaaccccauuuuucccaggguaaucaugaa

SEQ ID NO: 296759 - RNA, 63 nt, hsa
ugaucuguugauaucuuugaaucucuucccuccaaaccccaaguaaguuguccuucaacuguu

SEQ ID NO: 296760 - RNA, 63 nt, hsa
cacgcugucucagaaaacgaaaacggaggaaaaaaaccccaaaccccaaacaaucuuaauaaa

SEQ ID NO: 296761 - RNA, 63 nt, hsa
ucucagaaaacgaaaacggaggaaaaaaaccccaaaccccaaacaaucuuaauaaacacgacu

SEQ ID NO: 296762 - RNA, 63 nt, hsa
gggagaggccggccucaaaucuuuccauuuaacaaaccccagugauggguauggacagcaugc

SEQ ID NO: 296763 - RNA, 63 nt, hsa
ggucccaaggccccgcagcuuccucccccgaccaaaccccaagaccuggaucccaggagacaa

SEQ ID NO: 296764 - RNA, 63 nt, hsa
caggaguugaaguccagccuaagcaacauagugaaaccccaucuccaaaaauauaauaauaau

SEQ ID NO: 296765 - RNA, 63 nt, hsa
caggagauccagcccauccuggccaacauggugaaaccccaucucuacuaaaaauacaaaaau

SEQ ID NO: 296766 - RNA, 63 nt, hsa
caggagcucgagaccagccuggccaacacggugaaaccccaucucuacuaaaaaaaaauacaa

SEQ ID NO: 296767 - RNA, 63 nt, hsa
caggagcucaagaccagccuggccaacauggugaaaccccaucucuacuaaaaaaaaaaaaaa

SEQ ID NO: 296768 - RNA, 63 nt, hsa
caggaguuccagaccagccuggccaacauggcgaaaccccaucucuacuaaaaauacaaaaau

SEQ ID NO: 296769 - RNA, 63 nt, hsa
caggaguucgagaccagccuggccaauauggugaaaccccaucucuacuaaaaauauaaaaau

SEQ ID NO: 296770 - RNA, 63 nt, hsa
aauuggugugugguauagaagaaaaacggguucaaaccccacuucugccaccuaccagcuaua

SEQ ID NO: 296771 - RNA, 63 nt, hsa
uaggaguuugagaccagccuggccaacauggugaaaccccaucucuacuaaaaaaaaaaaaaa

SEQ ID NO: 296772 - RNA, 63 nt, hsa
gcuagcaauaguuggcuucuccccugucaguggaaaccccacuucugcccggcccuugagcuu

SEQ ID NO: 296773 - RNA, 63 nt, hsa
uuguauguacccugugcuuaauucuauaacaguaaaccccauacgcaggugggagggaggaac

SEQ ID NO: 296774 - RNA, 63 nt, hsa
gaucugcuucccuaaauuacuuuuuuagagcccaaaccccagguuuagggugaggguuuguaa

SEQ ID NO: 296775 - RNA, 63 nt, hsa
ccugacccuguguguacaauccaggaaaaaaacaaaccccacucagaaacagagaaaacuggg

SEQ ID NO: 296776 - RNA, 63 nt, hsa
augcagaauggaugagugguaccgccaaaauucaaaccccagacucccgaacucaugcucaga

SEQ ID NO: 296777 - RNA, 63 nt, hsa
caggaguucgagaccagccugaccaauauggugaaaccccaucucuacuaaaaauagaaaaau

SEQ ID NO: 296778 - RNA, 63 nt, hsa
ucuguuugcagacgauaugauucuauaucuagaaaaccccaugaucuuggcccaaaagcuccu

SEQ ID NO: 296779 - RNA, 63 nt, hsa
aucaacucaagauggauuaaagacuuaaauguaaaaccccaaacuauaaaaacucuggaagau

SEQ ID NO: 296780 - RNA, 63 nt, hsa
caggaguucgagaccauccugucuaacacggugaaaccccaucucuacuaaaaauacaaaaaa

SEQ ID NO: 296781 - RNA, 63 nt, hsa
caggaguucaagaccagccuggccaacauggugaaaccccaucucuacuaaaaauacaaaaau

SEQ ID NO: 296782 - RNA, 63 nt, hsa
cgcgagacaggccaggcucguggcucggaagacaaaccccacacacacucaaggggucgaaaa

SEQ ID NO: 296783 - RNA, 63 nt, hsa
acaaaccccacacacacucaaggggucgaaaacaaaccccacacgagggcucucaccuccuuc

SEQ ID NO: 296784 - RNA, 63 nt, hsa
acauccaggugaugugcucugguauggaauuugaaaccccaauggggccuuggcacuaagacu

SEQ ID NO: 296785 - RNA, 63 nt, hsa
gcuggcucgaugauguuaacaguauuaaaaauuaaaccccauaaaccaacuaagccuuaugga

SEQ ID NO: 296786 - RNA, 63 nt, hsa
caggaguucaacaccagccugagcaacaugguaaaaccccaucucuaccaaaaauacaaaaau

SEQ ID NO: 296787 - RNA, 63 nt, hsa
cuaguuacagaacgguuucuuucucccccaaagaaaccccaucgccaucagcacucacucccc

SEQ ID NO: 296788 - RNA, 63 nt, hsa
cuggaguuugagaccacccuggccaacauggugaaaccccaucucuacuaaaacaaaaauuag

SEQ ID NO: 296789 - RNA, 63 nt, hsa
caggaguucgagaccagccuggccaacauagugaaaccccaucucuacuaaaaauacagaaau

SEQ ID NO: 296790 - RNA, 63 nt, hsa
cagaaguucaagagcacccuggcuaacauggugaaaccccaucucuacuaaaaauacaaaagu

SEQ ID NO: 296791 - RNA, 63 nt, hsa
caggagaucgagaccguccuggcuaacacggugaaaccccaucucuacuaaaaauauaaaaua

SEQ ID NO: 296792 - RNA, 63 nt, hsa
aagucaggagagaccagccuggccagcauagugaaaccccaucucuacuaaaaauacaaacuu

SEQ ID NO: 296793 - RNA, 63 nt, hsa
cgggaguucgagaccagccugaccaacauggagaaaccccaauuguacuaaaaauacaaaauu

SEQ ID NO: 296794 - RNA, 63 nt, hsa
uugcuccuugaguuuucaagaugaaauaaggagaaaccccauaacuuuuuagcucucuuuuaa

SEQ ID NO: 296795 - RNA, 63 nt, hsa
caggaguucgagaccagccugaccaacauggagaaaccccaucucuacuaaaaauacaaaauu

SEQ ID NO: 296796 - RNA, 63 nt, hsa
aaauugcaugagauuagcaaaauuauuaauuuaaaaccccaaaguaaauugcaaauuuuaaaa

SEQ ID NO: 296797 - RNA, 63 nt, hsa
uuuccaguauugguacaucuuggcuucuggcccaaaccccaagcagaaaagaaaauggaauaa

SEQ ID NO: 296798 - RNA, 63 nt, hsa
ucugcuguggauaucaaggaaauaauaaagcagaaaccccaagaaauuugcaacuuaacaguu

SEQ ID NO: 296799 - RNA, 63 nt, hsa
guuaguacaaguugaacuugauugugccaacugaaaccccagagguuuguauaucaguagaau

SEQ ID NO: 296800 - RNA, 63 nt, hsa
caggaguucaagaucagccugggcaauauagugaaaccccaucucuuaaagaaaaaguuagcc

SEQ ID NO: 296801 - RNA, 63 nt, hsa
ucaguuucagacauuuucaccacuccaaaaaagaaaccccacaucgacuagcaguuacucauu

SEQ ID NO: 296802 - RNA, 64 nt, hsa
auuccccacaaagccguucgcagcuuccgggagaaggggccagagcccgguggggccaguuucu

SEQ ID NO: 296803 - RNA, 64 nt, hsa
ccggugccaugcuccucccugugucuuguaugaaaggggccacugugugucuuccuccccggcg

SEQ ID NO: 296804 - RNA, 64 nt, hsa
gggguggccucaagagcacacagagaagggaagaaggggccaucacaggaugccagccccugcc

SEQ ID NO: 296805 - RNA, 64 nt, hsa
ugccacuuugacucagaggcugggagcauagcagaggggccaggcccaggcagagcugacggga

SEQ ID NO: 296806 - RNA, 64 nt, hsa
auggagugcagggagccagcuggaagggaaggagaggggccagggaggccacaggcccggccau

SEQ ID NO: 296807 - RNA, 64 nt, hsa
auaucuguggcaucaugggcuauggcugcuggaaaggggccagugggauccuagauuugucuuc

SEQ ID NO: 296808 - RNA, 64 nt, hsa
gauaaauugccaaagagugggaacagguggggucaggggccagagugcaggggagggggcaaug

SEQ ID NO: 296809 - RNA, 64 nt, hsa
aucacagugacaaaagagccagggcuagggcuggaggggccaggugaucuuccuuagccaaucc

SEQ ID NO: 296810 - RNA, 64 nt, hsa
cuggccugaacccgccggugugggccacaguaggaggggccagcaguccucccugucccaugcc

SEQ ID NO: 296811 - RNA, 64 nt, hsa
uggacauuucccuguuucgagccaggcucuuccaaggggccagcuggguccccggagucagucc

SEQ ID NO: 296812 - RNA, 64 nt, hsa
ccacugucaccuguaccaagugccaaaacagcagaggggccaguuagagcaagagcucuggggg

SEQ ID NO: 296813 - RNA, 64 nt, hsa
ucugccccuuccagcuggagccgcccgugccuccaggggccaagaggaugaugucguggccucc

SEQ ID NO: 296814 - RNA, 64 nt, hsa
gaccggugucuugcucuagggcaacccagggcagaggggccaggucugcccagcguuuaccacu

SEQ ID NO: 296815 - RNA, 64 nt, hsa
cuaaguguaaccucaguauuuauguaauuuguacaggggccaugccccaccccccuccuccccc

SEQ ID NO: 296816 - RNA, 64 nt, hsa
auggguggcuuucaaggcuggggcauggcaaaucaggggccagagagcaggggagcuugggacu

SEQ ID NO: 296817 - RNA, 64 nt, hsa
caggucagaagagggagaggaggggcugggggugaggggccaggccauggccaaggggccagcu

SEQ ID NO: 296818 - RNA, 64 nt, hsa
gaggggcugggggugaggggccaggccauggccaaggggccagcugccccucauuuaucacucu

SEQ ID NO: 296819 - RNA, 64 nt, hsa
ggagucuagacuggaccuaggagcuugaguugucaggggccaggacuggccccacugcagugcc

SEQ ID NO: 296820 - RNA, 64 nt, hsa
caaagaaauauaggaugcuuagaaagcauacaggaggggccaggcgugguggcucaugccugua

SEQ ID NO: 296821 - RNA, 64 nt, hsa
gcagcccccucccgggcagcuucaccccacacccaggggccaggcucucccggggucucaugcu

SEQ ID NO: 296822 - RNA, 64 nt, hsa
acuauaaaguacguggcauguguaggugaauuacaggggccauggauguggacaccauggaggg

SEQ ID NO: 296823 - RNA, 64 nt, hsa
cccccucagcacacacacaguccccaggcggccuaggggccaaggcuggggcggcuuugguccc

SEQ ID NO: 296824 - RNA, 64 nt, hsa
ucccgguccagcucagggaugcuccugccagcacaggggccagggacuccuggagcaggcacau

SEQ ID NO: 296825 - RNA, 64 nt, hsa
cugccucccaucacugccugcuggcugcucucccaggggccagguggagagcagugccccccga

SEQ ID NO: 296826 - RNA, 64 nt, hsa
cucugagcagggcccaaggcagccaggggccuggaggggccagaggaggguggggucagggccg

SEQ ID NO: 296827 - RNA, 64 nt, hsa
gaugaaucaaaugacugccggcugggcugguagcaggggccaguccuccccucuugauugcugg

SEQ ID NO: 296828 - RNA, 64 nt, hsa
gguagcccggguuuggacucuuccuccuggcaucaggggccaugaagcccccuggagagagaug

SEQ ID NO: 296829 - RNA, 64 nt, hsa
ucagcgcaggggccagccagggacauagccagggaggggccacaucacuucccacuggaaaucu

SEQ ID NO: 296830 - RNA, 64 nt, hsa
aaaguggcccacuuucuguggcucugaucagcgcaggggccagccagggacauagccagggagg

SEQ ID NO: 296831 - RNA, 64 nt, hsa
acuaauuuuggcucaaacuuaugaggcaggaaauaggggccaacaguaaaugggggaggccucc

SEQ ID NO: 296832 - RNA, 64 nt, hsa
cuuccucucugaaccaacaguucccuucucugacaggggccauccucuaucuuccauccagcgg

SEQ ID NO: 296833 - RNA, 64 nt, hsa
auucagccgcagccucugggccggggcggcccccaggggccaggagagagcccuggagucccgc

SEQ ID NO: 296834 - RNA, 64 nt, hsa
aagccaccuucucuugccccuuggccccuuugucaggggccaggggucugccgggugggggugc

SEQ ID NO: 296835 - RNA, 64 nt, hsa
auauguaugauguguugugcuuuuuuaaccaaggaggggccaguggauucccacagcacaaccg

SEQ ID NO: 296836 - RNA, 64 nt, hsa
augugccuuguccaggaacugccugggccaugcgaggggccagcagagggcgccaccaccaccu

SEQ ID NO: 296837 - RNA, 64 nt, hsa
cccuccuuagacugagcugucagagcaagcaauuaggggccagccugccuccaccucccacccc

SEQ ID NO: 296838 - RNA, 64 nt, hsa
agagagcuguuuagguuuuccgaucuuuuugcucaggggccaaacacugaaggcacguacugcc

SEQ ID NO: 296839 - RNA, 64 nt, hsa
ggagaagggcaggggcaggagagggcugcggaggaggggccacggugcagcaggccguggggac

SEQ ID NO: 296840 - RNA, 64 nt, hsa
cuggcaccaacaagccccccaggugccggggaagaggggccaggccugggggccgcccagcucc

SEQ ID NO: 296841 - RNA, 64 nt, hsa
ugcccuaaagggcucuugagccucugggaaugggaggggccaagagaaggaaaacccugucuuu

SEQ ID NO: 296842 - RNA, 64 nt, hsa
cuuggggauggcacuccacacacgacagagaugcaggggccagggaagcccagcgcucggugcc

SEQ ID NO: 296843 - RNA, 64 nt, hsa
cuagaccuugaugccuggguggagggcccuuguaaggggccauagccucuucaggaccaacugg

SEQ ID NO: 296844 - RNA, 64 nt, hsa
gcacuguuugaagaggagcagagaggcuggcacuaggggccacuggggggcuggggucuccagg

SEQ ID NO: 296845 - RNA, 64 nt, hsa
ggaagggcggcacuggagagaugggcccaucauuaggggccagcaucccaggaacuggaccuuu

SEQ ID NO: 296846 - RNA, 64 nt, hsa
agcugggcggccggggcaggcuuagggcacaguuaggggccaaggagagggaaggccagggccc

SEQ ID NO: 296847 - RNA, 64 nt, hsa
cccucagcccagcagagagggcaucaaccaaggaaggggccaugcuggggugcugcucagcugu

SEQ ID NO: 296848 - RNA, 64 nt, hsa
gaacccugugccccaccaggauuggccugcugcuaggggccaggggcccugaccaggaagacag

SEQ ID NO: 296849 - RNA, 64 nt, hsa
ggacuugucccaagucugacagccagagcguuagaggggccagcggcccucccaggcgaucuug

SEQ ID NO: 296850 - RNA, 64 nt, hsa
aagauguugaggcgagcagggcaggcccccggggaggggccagaguuuucuaugaaucuauuuu

SEQ ID NO: 296851 - RNA, 64 nt, hsa; identical to SEQ ID NO: 128944

SEQ ID NO: 296852 - RNA, 64 nt, hsa; identical to SEQ ID NO: 128945

SEQ ID NO: 296853 - RNA, 64 nt, hsa; identical to SEQ ID NO: 128946

SEQ ID NO: 296854 - RNA, 64 nt, hsa; identical to SEQ ID NO: 128947

SEQ ID NO: 296855 - RNA, 64 nt, hsa
cuccccgccccuuccuggagcuggcagagcuaacgcccugcaggaggaccccggccucucgagg

SEQ ID NO: 296856 - RNA, 64 nt, hsa
aaagccuuucgagaggcccaagguggccucgccagcccugcaguauugaugugcaguauugcac

SEQ ID NO: 296857 - RNA, 64 nt, hsa
agcacccucgcuccucuccuggcuacuagcucuggcccugcaccuacucucacuggccaccucu

SEQ ID NO: 296858 - RNA, 64 nt, hsa
guccugcuucccacccccugccugcccagccugggcccugcaguguggagagacacauaagccu

SEQ ID NO: 296859 - RNA, 64 nt, hsa
ucaucaacaagguggugugauggcuccugcacaggcccugcacauaggaugagggcaucugcuc

SEQ ID NO: 296860 - RNA, 64 nt, hsa
ggaaaggcccagugacagguguggacaggugccagcccugcaagccgccucuucucgguagaag

SEQ ID NO: 296861 - RNA, 64 nt, hsa
ucaggccagggcagugcugcugcagagcuagaaggcccugcagcuacagcugcuucauucccug

SEQ ID NO: 296862 - RNA, 64 nt, hsa
cuugcauacacugagcgggcuacagagcuagaaggcccugcagcuacagcugcuucauucccug

SEQ ID NO: 296863 - RNA, 64 nt, hsa
ccccagggggccauagggugcgguggaacugcaggcccugcagaugacggcagccagcugcuuc

SEQ ID NO: 296864 - RNA, 64 nt, hsa
acaggcugaauuagaugagcuccugccgcagggggcccugcacacugaugucagcucaccaguc

SEQ ID NO: 296865 - RNA, 64 nt, hsa
uguaaguguugagguuucugcaaagagggcgcaggcccugcagugacgguucagauauugauaa

SEQ ID NO: 296866 - RNA, 64 nt, hsa
ucacaccugaacgcugcugccagccgaugccccagcccugcacgccacccacuaucccggcacg

SEQ ID NO: 296867 - RNA, 64 nt, hsa
cagcuggauggccacgugcaggggucaaggcugggcccugcaguggggcgggccgccagcccca

SEQ ID NO: 296868 - RNA, 64 nt, hsa
agaagggauucagaaauaugauguaguagaacaugcccugcaggaagaaaauguuuucucuccu

SEQ ID NO: 296869 - RNA, 64 nt, hsa
uuuauaugucaguugcugcccuucacacuaccaggcccugcagccacaguguucuguuggagaa

SEQ ID NO: 296870 - RNA, 64 nt, hsa
ugcccauggggacacggcccaggacagcccgggggcccugcagcuucaggucccuaugggcgca

SEQ ID NO: 296871 - RNA, 64 nt, hsa
gggcgcagcugcuccgugagcugagucucccacugcccugcacaccaccacauuggaccugugc

SEQ ID NO: 296872 - RNA, 64 nt, hsa
uccccuccugccaguccuucgccugucccuugacgcccugcauccuccucccugacucgcagcc

SEQ ID NO: 296873 - RNA, 64 nt, hsa
cgccccguaguugcucuuucgguaguggcgaugcgcccugcaugucuccucacccguggaucgu

SEQ ID NO: 296874 - RNA, 64 nt, hsa
cccaaccgaggcugucaggugcuacgagcugcuggcccugcaccugucugucauccccacugac

SEQ ID NO: 296875 - RNA, 64 nt, hsa
ugucaacaccagccccgagcggggaggcgaggaggcccugcaugccuuccugcucgugcacucc

SEQ ID NO: 296876 - RNA, 64 nt, hsa
ccugcggccagccagggagguggaccgcaugcuggcccugcagccccgccuucgccugcgccug

SEQ ID NO: 296877 - RNA, 64 nt, hsa
gucuccccgcugagcccaggcacuugcccaggccgcccugcaggaccacugcaauaaacgccuu

SEQ ID NO: 296878 - RNA, 64 nt, hsa
agcaggagcaggggcaggggcaggggcagggagagcccugcauuuccucuacgcccagguuccg

SEQ ID NO: 296879 - RNA, 64 nt, hsa
gggcaacagcacccuaguuucauucucaacucuagcccugcacacucaccuguggcacggaaug

SEQ ID NO: 296880 - RNA, 64 nt, hsa
uuucugcaaguccacuggggcuggccccagccaggcccugcagggcuggucagggugucugggg

SEQ ID NO: 296881 - RNA, 64 nt, hsa
auguggguggcacugaccuguucuguugacuggggcccugcagacucuggcagagcugagaagg

SEQ ID NO: 296882 - RNA, 64 nt, hsa
uuggacguaagccccucaugcugacucagggugggcccugcaugugaugacugggcccuuccag

SEQ ID NO: 296883 - RNA, 64 nt, hsa
gcaugggggcgugccugugugggggacagggagggcccugcauggauuuuccuccuuccuaugc

SEQ ID NO: 296884 - RNA, 64 nt, hsa
acagaggaagcuuuagauagagacuuuagacccugcccugcagagucaagacuugaggccauug

SEQ ID NO: 296885 - RNA, 64 nt, hsa
ccucucucuccucagauuuccuucuuggcccugugcccugcacuuucuucacuguguucaagug

SEQ ID NO: 296886 - RNA, 64 nt, hsa
uccuuggccuagcccacccugcugccuucugacggcccugcaauguaucccuucucacagcaca

SEQ ID NO: 296887 - RNA, 64 nt, hsa
ccuggguggaucggccuccucuucaccccggcaggcccugcaguguucgcuuggcuccaugcuc

SEQ ID NO: 296888 - RNA, 64 nt, hsa
gcauaaggcugucuuggaucccaacaggcacccagcccugcauggggggagccugggccuaaua

SEQ ID NO: 296889 - RNA, 64 nt, hsa
gcugcaggagcaggugcagugggcgcccacacuggcccugcagugaugcagggcgggagggaga

SEQ ID NO: 296890 - RNA, 64 nt, hsa
cuuucuggccuggcugggccccccguccugccgagcccugcagagugggcucugugugcuggcu

SEQ ID NO: 296891 - RNA, 64 nt, hsa
agagaggccugccuuccggauuccaggcgggcaugcccugcaaaccccgccugggccucccuug

SEQ ID NO: 296892 - RNA, 64 nt, hsa
aaaauccuacugugcccaguuuccuucacuacaugcccugcauuuuuuauuuaaauauuuagcu

SEQ ID NO: 296893 - RNA, 64 nt, hsa
cgacuugaauguuuauacuuuuauucuauaauuugcccugcacuuauuuuacaaccuaguaaua

SEQ ID NO: 296894 - RNA, 64 nt, hsa
gggcuucaaaggaaggcuauggaguuugcugugggcccugcaaccuucccagccacuccugcug

SEQ ID NO: 296895 - RNA, 64 nt, hsa
cccagcugcuggaggagaggggagaugccaaggugcccugcaggaccucccuccgggccacacc

SEQ ID NO: 296896 - RNA, 64 nt, hsa
gcagcuccuugaagguccucugccuccagcuguggcccugcauccagauaccugccucguccga

SEQ ID NO: 296897 - RNA, 64 nt, hsa
ggcgccagcagccucugccagaguggaagccagagcccugcagguguccggcgcagccguggga

SEQ ID NO: 296898 - RNA, 64 nt, hsa
ugccucggagagcaucauucucugccuaggcaaggcccugcaucccuugccucaggccgggcug

SEQ ID NO: 296899 - RNA, 64 nt, hsa
ucuguguaguguuuuacgucuccaugguaacugugcccugcaccccucgguagccgcccuguua

SEQ ID NO: 296900 - RNA, 64 nt, hsa
gcucccugcacucugguguucaugccgcccccgugcccugcacaaaaaccaccaccagcagcuc

SEQ ID NO: 296901 - RNA, 64 nt, hsa
agccgccuggacucagccauggcugugugcuuuggcccugcagcucugggccaccugcuggugu

SEQ ID NO: 296902 - RNA, 59 nt, hsa
acuccgcaucucaagaauaggaaggcacggcccugcaauauggacucagcucuggcucu

SEQ ID NO: 296903 - RNA, 64 nt, hsa
ccuggaagagacccccguguucagagugcuggcagcccugcacguguccagggacacugcauuu

SEQ ID NO: 296904 - RNA, 64 nt, hsa
ccacccccacacucccugcucagcuccucgugcugcccugcaugcccaggcuugugagccaagc

SEQ ID NO: 296905 - RNA, 64 nt, hsa
augccugcccagggacccccagcccccucccguugcccugcagcuuuaacagagugaaccaugu

SEQ ID NO: 296906 - RNA, 64 nt, hsa
gcaugcacaaacuucgugagaccaacacagccgugcccugcaggcaccagcacgugcuuuucag

SEQ ID NO: 296907 - RNA, 64 nt, hsa
gacuccaggggguccuggcuccccugucccugcagcccugcaggucagugcaugaucuggguuc

SEQ ID NO: 296908 - RNA, 64 nt, hsa
gugauucaggccagcuggagaagcuuccagaagggcccugcacugcuacccucuauuucccacu

SEQ ID NO: 296909 - RNA, 64 nt, hsa
gacccaccuuguguagugccugacccaaagccuggcccugcacacugucucugacucacagcaa

SEQ ID NO: 296910 - RNA, 64 nt, hsa
ggggaagccgggcuugaguugcccauaggccccugcccugcaccauccuguccagugcccugcg

SEQ ID NO: 296911 - RNA, 64 nt, hsa
uuuccuaggcaggggcguggcagagcagguaggcgcccugcagccucccugcucccagcccaag

SEQ ID NO: 296912 - RNA, 64 nt, hsa
gggccaugccuuccagguggcccagacagcccaagcccugcacuggaucgugaggacgcugcgg

SEQ ID NO: 296913 - RNA, 64 nt, hsa
uccugagccuggccaggacucaggcuguuccugggcccugcacaugaugggguuugguggaccc

SEQ ID NO: 296914 - RNA, 64 nt, hsa
ccugcagaacuggaugcucaaggcccugcccccagcccugcaggacccgccacaugugcccccg

SEQ ID NO: 296915 - RNA, 64 nt, hsa
cuucccuccaggaaaugaggaccggccggacgaugcccugcagacugcucugaagagaaggagg

SEQ ID NO: 296916 - RNA, 64 nt, hsa
ggcaggagcaccccccagacuccccgugcccgcagcccugcagcaccccggcuuucccgggucu

SEQ ID NO: 296917 - RNA, 64 nt, hsa
ccccuccggacccgcagagcuggggacauggcaugcccugcacucagucaccccgagggcugag

SEQ ID NO: 296918 - RNA, 64 nt, hsa
ccuggcccgcucucuaccucugcccaccguuguggcccugcagccggagaucugaggugcucug

SEQ ID NO: 296919 - RNA, 64 nt, hsa
acaccuggauguggacuuggacucggacacuucugcccugcacccuggcccgcucucuaccucu

SEQ ID NO: 296920 - RNA, 64 nt, hsa
cccugcagcuaguccuagugaaccucaccccgaggcccugcaugggccagccccuccaucugua

SEQ ID NO: 296921 - RNA, 64 nt, hsa
ugacugguuaucacaccaucgcuggccccuuugggcccugcauguagugugggaggcuccuguu

SEQ ID NO: 296922 - RNA, 64 nt, hsa
agcccagaccucuucggcuucaggaacuugccucgcccugcaacguucuuauccugaucaaagu

SEQ ID NO: 296923 - RNA, 64 nt, hsa
gggggugcugccugaugggcaguccaagcuccaggcccugcaugcccaguauugccaaggaccg

SEQ ID NO: 296924 - RNA, 64 nt, hsa
uguuuucuucaacuguauuuauugcugcauuucucagcauaaacuuaucccauuguauuuuuua

SEQ ID NO: 296925 - RNA, 64 nt, hsa
aguugccuuuuagugcuguaauaguuaaauccuacagcauaaucaauaacucgcauaugaagua

SEQ ID NO: 296926 - RNA, 64 nt, hsa
uuuaaaugauaauuugcuuaugucuuauaaaacucagcauaagaaaaauacugcccuaccuuga

SEQ ID NO: 296927 - RNA, 64 nt, hsa
agaucauuuaucagaggagguucagcauuuuuugcagcauaacuuuucaugagucuguauuacu

SEQ ID NO: 296928 - RNA, 64 nt, hsa
ccuacugaccuuuucuuuuguuugaagugcuuaucagcauaaugagcuaagugucaugcauauu

SEQ ID NO: 296929 - RNA, 64 nt, hsa
ucucccucacugaacccugcacguugaguaacagcagcauaauuccauccuaggaaaggggaug

SEQ ID NO: 296930 - RNA, 64 nt, hsa
gugaucgacuuagaauccaaauuugaggaguaagcagcauaaccuucuaccuuguaauauguaa

SEQ ID NO: 296931 - RNA, 64 nt, hsa
aaccaaaucacugugacucaaggaaagucacugacagcauaagagaaguuugcuaaaauauuug

SEQ ID NO: 296932 - RNA, 64 nt, hsa
aucuuguuuagagaauccacuuucuggaaguucucagcauaauuaguguugagagugguucagu

SEQ ID NO: 296933 - RNA, 64 nt, hsa
auuagauguuuauaaagaaauggguuuauuuuuccagcauaaaccucagaauuuaaggaaagaa

SEQ ID NO: 296934 - RNA, 64 nt, hsa
acagagcccuccauuccaaguuuaguuuuugucaaaauaugaaucauuuuauuugacuguacua

SEQ ID NO: 296935 - RNA, 64 nt, hsa
ccaguguaauauuugccuuucuguaaaugggauuaaauaugauuuguaaauaaaggacaucuga

SEQ ID NO: 296936 - RNA, 64 nt, hsa
aguagcaaaggacuuaaaauuaccaaaugcuucuaaauaugaaggagagguuggggacacgcac

SEQ ID NO: 296937 - RNA, 64 nt, hsa
uaaauaaauagauguucuguagcauuggucagggaaauaugaauuaggaccacaaugagauucc

SEQ ID NO: 296938 - RNA, 64 nt, hsa
gucguguaagaaggaugcuggucagagcugcagaaaauaugaggcaauuaaaagucuuuagcug

SEQ ID NO: 296939 - RNA, 64 nt, hsa
ugugguuuauuuauggcaugaaccauguaacuugaaauaugaacuuacaaggaggggcacucau

SEQ ID NO: 296940 - RNA, 64 nt, hsa
uuuuugguaaauacuuuaguggcauuucacugucaaauaugaaguucaaggcaaaauaguauuu

SEQ ID NO: 296941 - RNA, 64 nt, hsa
gaaaaauuaugcaucuagcacauuuaaacugugcaaauaugaaaauuuuucgaggauuacauuu

SEQ ID NO: 296942 - RNA, 64 nt, hsa
ucucaaucccucaaaacaaucuugucauacuugaaaauaugacacucuagucaaagccuuggua

SEQ ID NO: 296943 - RNA, 64 nt, hsa
aaagaaagagaaguuuucuugacuuuugaaaacaaaauaugaaaagaaucggcaauguuucaaa

SEQ ID NO: 296944 - RNA, 64 nt, hsa
acuaagacagacuguagaugcauuuuaaauauuuaaauaugauccucagacaugcagcugugug

SEQ ID NO: 296945 - RNA, 64 nt, hsa
aggugaucguauucuuccagugaaaacaagacugaaauaugauggcccaaaauuuauuaaaaag

SEQ ID NO: 296946 - RNA, 64 nt, hsa
cugcauaacaggcaccagauggucaagacgagggaaauaugagaaggcaaaugaugugaggauu

SEQ ID NO: 296947 - RNA, 64 nt, hsa
uaguuuuccacaaccaagccacccuucacagauaaaauaugaugcuggcauggcaaucagacca

SEQ ID NO: 296948 - RNA, 64 nt, hsa
aaguauuaaaacuauauacauccauauaaagaugaaauaugaacuaucucauuagaagucauag

SEQ ID NO: 296949 - RNA, 64 nt, hsa
ucuugucacaugauuucuuuucuugauggaugaaaaauaugaaaggaaacuuuuauaucuguug

SEQ ID NO: 296950 - RNA, 64 nt, hsa
ggcguguuuaaccauuaagaaaugcuguauucuuaaauaugaaacaguuaaucuaaagucuuau

SEQ ID NO: 296951 - RNA, 64 nt, hsa
ccauuuacaagcauugcaccuuuaagaagaaaacaaauaugacaguaugguagcuauacuugug

SEQ ID NO: 296952 - RNA, 64 nt, hsa
ccaacugauccuacccucccuacuccugcaccccaaauaugaacaacugcagcaggugccacca

SEQ ID NO: 296953 - RNA, 64 nt, hsa
ccacuacccuuguaacuacugcuucuacuacccaaaauaugaauuccaacacugcuuccaagag

SEQ ID NO: 296954 - RNA, 64 nt, hsa
auuuaaguauauaauuucagcuuccuugauuuagaaauaugauauaauaaagaaaaacuccauu

SEQ ID NO: 296955 - RNA, 64 nt, hsa
uugaaagcuguacaaaguaauagaaguuccauuuaaauaugaguucaaaacuguauuuacuuuu

SEQ ID NO: 296956 - RNA, 64 nt, hsa
ugcagaauguuuuuaaaauaugagugguuauugaaaauaugauguuucacauaaaaccucauuc

SEQ ID NO: 296957 - RNA, 64 nt, hsa
agguagauuuuguuugguaugcagaauguuuuuaaaauaugagugguuauugaaaauaugaugu

SEQ ID NO: 296958 - RNA, 64 nt, hsa
guccuuuuaggaauauguucaaugcaaaguaaaaaaauaugaauuguccccaaucccggucaug

SEQ ID NO: 296959 - RNA, 64 nt, hsa
auaaggccagaaacuccuuuugcugucuuucucuaaauaugauuacuuuaaaauaaaaaaguaa

SEQ ID NO: 296960 - RNA, 64 nt, hsa
guuacuuaaaaauugugaauucuguuguugugauaaauaugagcaaaugaaguguaauaucuau

SEQ ID NO: 296961 - RNA, 64 nt, hsa
aguuaaaauauguuggauuguuaaacauuuggggaaauaugaacuguauuuuaaauuuguuagg

SEQ ID NO: 296962 - RNA, 64 nt, hsa
ugaaagacaguuuuaguuuuaucuugcuuuaaccaaauaugaaacauacccccuauuuuacaga

SEQ ID NO: 296963 - RNA, 64 nt, hsa
gagguguuuugagguucugagaguaaaauuaugcaaauaugacagagcuauauaugugugcucu

SEQ ID NO: 296964 - RNA, 64 nt, hsa
uguauaucuccacauaccuccauuacuaacaaugaaauaugaaugcaaguuaagcuacacuuga

SEQ ID NO: 296965 - RNA, 64 nt, hsa
cccaucagccggaacuagccuagacauacggugcaaauaugacacuucuaacgauuaacaacag

SEQ ID NO: 296966 - RNA, 64 nt, hsa
aaauaccacuguuacagauaaauggggccuuuaaaaauaugaaaaacaaacuugugaaaaugua

SEQ ID NO: 296967 - RNA, 64 nt, hsa
gucuccucuauuaagaguauuuaaaaucauauuuaaauaugaaucuauucaugcuaacauuauu

SEQ ID NO: 296968 - RNA, 64 nt, hsa
ucagagagugaccgaauaggaagaagggauucagaaauaugauguaguagaacaugcccugcag

SEQ ID NO: 296969 - RNA, 64 nt, hsa
aguuugagaccgcuacccugaacuuaagagcuuuaaauaugaggguuguguuucuggggggguu

SEQ ID NO: 296970 - RNA, 64 nt, hsa
guuucauguagaaugcaaaauguuggcacgucaaaaauaugaauguguagacaacuguaguugu

SEQ ID NO: 296971 - RNA, 64 nt, hsa
cuguuuuauuacagcugguaaugccgcugucaucaaauaugaggagaaaccuccaaaaccagca

SEQ ID NO: 296972 - RNA, 64 nt, hsa
guucugcaucugaaguauuagauuguuagcagcaaaauaugaaagaugagguggacaguccucu

SEQ ID NO: 296973 - RNA, 64 nt, hsa
ucuguuauuuucuguacauugugguagguccaggaaauaugacauuuucccccuugauguguua

SEQ ID NO: 296974 - RNA, 64 nt, hsa
cccaucauaaguugaaaauaugaucauaaguugaaaauaugaucauaagucaaaaauguauuua

SEQ ID NO: 296975 - RNA, 64 nt, hsa
ggguuugcauccugauaaacccaucauaaguugaaaauaugaucauaaguugaaaauaugauca

SEQ ID NO: 296976 - RNA, 64 nt, hsa
gcaauccauugcaugcauuagcaguucaaagauuaaauaugaucauaucaauagguacagaaaa

SEQ ID NO: 296977 - RNA, 64 nt, hsa
aagaaaucuaaagugaaaauuuugcuuagaaauaaaauaugacaaguucuguuuugaguuugau

SEQ ID NO: 296978 - RNA, 64 nt, hsa
uauuaaacucauuauaguaguuaauaucuaaguaaaauaugaugaaauuuaauagagaauucac

SEQ ID NO: 296979 - RNA, 64 nt, hsa
uuguuuuggauaaugaagucagcagaggaaaaaaaaauaugaccaucucaaaagaugccaacgu

SEQ ID NO: 296980 - RNA, 64 nt, hsa
aguaaugaagacugauucccagacucugcacuuaaaauaugaacugauuuuggauuuuuucuuu

SEQ ID NO: 296981 - RNA, 64 nt, hsa
aaacacauccuauauaucaugucaaucuggcaagaaauaugacuugcuuuuugcugagcuuaau

SEQ ID NO: 296982 - RNA, 64 nt, hsa
acauaagagaauucauaccauagagaaauccuacaaauaugaagaaugugacaaagcuuuuaac

SEQ ID NO: 296983 - RNA, 64 nt, hsa
acguaagauaauucauacuggaaggaaacccuacaaauaugaggaaugucucaaagcuuuuuac

SEQ ID NO: 296984 - RNA, 64 nt, hsa
aucucgcaguguuucugugaauagauuuuuuuguaaauaugaccuuuaagauauuguauuaugu

SEQ ID NO: 296985 - RNA, 64 nt, hsa
ucuuccuuucuaauauauggaguuucgaagaauaaaauaugagagcaauauuuaaauucucagg

SEQ ID NO: 296986 - RNA, 64 nt, hsa
uuucaguuuucuuucaaacuggaaaugccuccauaaauaugaucuaugauuuugcuucauaaaa

SEQ ID NO: 296987 - RNA, 64 nt, hsa
agaggcuuuucuuaacuauuucacauacuguaacaaauaugaauuuaaauuugugauagcgcuc

SEQ ID NO: 296988 - RNA, 64 nt, hsa
cuguauauguuuuccugagcaguuaaauaacaauaaauaugacguuaauggugacugugguaua

SEQ ID NO: 296989 - RNA, 64 nt, hsa
ugggaaagaaaacgaaaauguuauugcacauguaaaauaugaaaacuuaacucugcuguguguu

SEQ ID NO: 296990 - RNA, 64 nt, hsa
uguccaccaauaugauuucugagugguaaaccucaaauaugaauuuuaaacuggugaacuaaag

SEQ ID NO: 296991 - RNA, 64 nt, hsa
ggugaacuaaaggaaaucuugaggucauauacugaaauaugaauaaauuaaaauaaugaauuca

SEQ ID NO: 296992 - RNA, 64 nt, hsa
acuugcauccauuuuguauuuuuguaauauuuguaaauaugaacuuuuuaaauugcugcaaaga

SEQ ID NO: 296993 - RNA, 64 nt, hsa
gugagacagucaauuauugccuaggguaguucaaaaauaugaugugagcuaguuaagccuuugc

SEQ ID NO: 296994 - RNA, 64 nt, hsa
ucuacaauauucggucuuuugggacuggcuucccaaauaugauuuucuauauggagugagaaaa

SEQ ID NO: 296995 - RNA, 64 nt, hsa; identical to SEQ ID NO: 193898

SEQ ID NO: 296996 - RNA, 64 nt, hsa; identical to SEQ ID NO: 193899

SEQ ID NO: 296997 - RNA, 64 nt, hsa; identical to SEQ ID NO: 193900

SEQ ID NO: 296998 - RNA, 64 nt, hsa; identical to SEQ ID NO: 193901

SEQ ID NO: 296999 - RNA, 64 nt, hsa; identical to SEQ ID NO: 193902

SEQ ID NO: 297000 - RNA, 64 nt, hsa; identical to SEQ ID NO: 193903

SEQ ID NO: 297001 - RNA, 64 nt, hsa; identical to SEQ ID NO: 193904

SEQ ID NO: 297002 - RNA, 64 nt, hsa; identical to SEQ ID NO: 193905

SEQ ID NO: 297003 - RNA, 64 nt, hsa; identical to SEQ ID NO: 193906

SEQ ID NO: 297004 - RNA, 64 nt, hsa; identical to SEQ ID NO: 193907

SEQ ID NO: 297005 - RNA, 64 nt, hsa; identical to SEQ ID NO: 193908

SEQ ID NO: 297006 - RNA, 64 nt, hsa; identical to SEQ ID NO: 193909

SEQ ID NO: 297007 - RNA, 64 nt, hsa; identical to SEQ ID NO: 193910

SEQ ID NO: 297008 - RNA, 64 nt, hsa; identical to SEQ ID NO: 193911

SEQ ID NO: 297009 - RNA, 64 nt, hsa; identical to SEQ ID NO: 193912

SEQ ID NO: 297010 - RNA, 64 nt, hsa; identical to SEQ ID NO: 193913

SEQ ID NO: 297011 - RNA, 64 nt, hsa; identical to SEQ ID NO: 193914

SEQ ID NO: 297012 - RNA, 64 nt, hsa; identical to SEQ ID NO: 193915

SEQ ID NO: 297013 - RNA, 64 nt, hsa; identical to SEQ ID NO: 193916

SEQ ID NO: 297014 - RNA, 64 nt, hsa; identical to SEQ ID NO: 193917

SEQ ID NO: 297015 - RNA, 64 nt, hsa; identical to SEQ ID NO: 193918

SEQ ID NO: 297016 - RNA, 64 nt, hsa; identical to SEQ ID NO: 193919

SEQ ID NO: 297017 - RNA, 64 nt, hsa
aacaaggcugaagaccuucaaauuuccuggcuuacugguuuagucacaucauuuuuccuguuca

SEQ ID NO: 297018 - RNA, 64 nt, hsa
gucaauuggcaacauggagagggugaccuggcugcugguuuaccacuguaccaacaucucugga

SEQ ID NO: 297019 - RNA, 64 nt, hsa
aaacaagccaacuaguaacaaugcagcaacacuucugguuuagcuaaauuauuuuuccaaugua

SEQ ID NO: 297020 - RNA, 64 nt, hsa
uuaacuauauuuuaaagcugugacauuuaucuaccugguuuauggaauagaauuuauugcugaa

SEQ ID NO: 297021 - RNA, 64 nt, hsa
agaagaacccuggccugagaagguuugguccagccugguuuagccuggauguugcugugcacgg

SEQ ID NO: 297022 - RNA, 64 nt, hsa
guuccuggaacagcgcucaccuuuguuuagaacacugguuuaaagggauaaucaucucugucac

SEQ ID NO: 297023 - RNA, 64 nt, hsa
ugaaucagaagcucugagaguaaggccuaccaaucugguuuaacaagcccgucaggugauucug

SEQ ID NO: 297024 - RNA, 64 nt, hsa
gggcaguauuagaaaacacacugguuuucacuaucugguuuacaaacacuaucauuauuuuacc

SEQ ID NO: 297025 - RNA, 64 nt, hsa
cagaaugcagaagucuuacaucuugggcaggaaacugguuuauuccuauacucuuguuuccucu

SEQ ID NO: 297026 - RNA, 64 nt, hsa
acuagguuuuccauugucaccauuggaugaaccucugguuuagccacaguugugaaaauaaaug

SEQ ID NO: 297027 - RNA, 64 nt, hsa
aaaaauauacacauaggugcugcauuuauaucugcugguuuaaauucugucauauuucacuucu

SEQ ID NO: 297028 - RNA, 64 nt, hsa
acuaacaaaguggucgcaggagauuuuggaacggcugguuuaaauggcuucaggagacuucagu

SEQ ID NO: 297029 - RNA, 64 nt, hsa
ggccgcauucaggauggcucuauacacagcagugcugguuuauguagaguucagcagucacuuc

SEQ ID NO: 297030 - RNA, 64 nt, hsa
ccccuacccguuguggcucccacccugccucggacugguuuacguguccugguucacacccagg

SEQ ID NO: 297031 - RNA, 64 nt, hsa
cagugggaaaaaucucucucccucgccuuuuuuucugguuuagucaaauaacgggugaacauag

SEQ ID NO: 297032 - RNA, 64 nt, hsa
uuugcuuuuauuaucaauuaugaauaugaauugucugguuuacuaauguagucauuuguucauc

SEQ ID NO: 297033 - RNA, 64 nt, hsa
uaugagucccauuuuacuucuacaccugcaaguccugguuuauauuggaccccucccuccgagc

SEQ ID NO: 297034 - RNA, 64 nt, hsa
caugaaucccauuuuaccucuagaccuauaaguucugguuuauguuugaccccucccucugagc

SEQ ID NO: 297035 - RNA, 64 nt, hsa
aaugggggagggcccagggccagcgcauugugcacugguuuacuuuaaaauguacagauucuuc

SEQ ID NO: 297036 - RNA, 64 nt, hsa
uuugcucugacuuuauuuauauggcaugaaaucucugguuuauuuugggauuuuuuguuguugg

SEQ ID NO: 297037 - RNA, 64 nt, hsa
agaagucuuagauuuuaagaguaauacaacccaucuaucuuauuagucuugugccaauaagaga

SEQ ID NO: 297038 - RNA, 64 nt, hsa
ccuccuguuuauucaggaaaaaauaauaaagucacuaucuuauguuuucuuuuggauuggaaag

SEQ ID NO: 297039 - RNA, 64 nt, hsa
ucccacagaaaucaguaaguuuacauuucaauuucuaucuuauuugacuaaguggaaagagauu

SEQ ID NO: 297040 - RNA, 64 nt, hsa
aaaaagagccugcuuuuuucccuaaccaauauagcuaucuuaaguauccuuagguuucugugaa

SEQ ID NO: 297041 - RNA, 64 nt, hsa; identical to SEQ ID NO: 76027

SEQ ID NO: 297042 - RNA, 64 nt, hsa; identical to SEQ ID NO: 76028

SEQ ID NO: 297043 - RNA, 64 nt, hsa; identical to SEQ ID NO: 76029

SEQ ID NO: 297044 - RNA, 64 nt, hsa; identical to SEQ ID NO: 76030

SEQ ID NO: 297045 - RNA, 64 nt, hsa; identical to SEQ ID NO: 76031

SEQ ID NO: 297046 - RNA, 64 nt, hsa; identical to SEQ ID NO: 76032

SEQ ID NO: 297047 - RNA, 64 nt, hsa; identical to SEQ ID NO: 76033

SEQ ID NO: 297048 - RNA, 64 nt, hsa; identical to SEQ ID NO: 76034

SEQ ID NO: 297049 - RNA, 64 nt, hsa; identical to SEQ ID NO: 76035

SEQ ID NO: 297050 - RNA, 64 nt, hsa; identical to SEQ ID NO: 76036

SEQ ID NO: 297051 - RNA, 64 nt, hsa; identical to SEQ ID NO: 76037

SEQ ID NO: 297052 - RNA, 64 nt, hsa; identical to SEQ ID NO: 76038

SEQ ID NO: 297053 - RNA, 64 nt, hsa; identical to SEQ ID NO: 76039

SEQ ID NO: 297054 - RNA, 64 nt, hsa; identical to SEQ ID NO: 76040

SEQ ID NO: 297055 - RNA, 64 nt, hsa; identical to SEQ ID NO: 76041

SEQ ID NO: 297056 - RNA, 64 nt, hsa; identical to SEQ ID NO: 76042

SEQ ID NO: 297057 - RNA, 64 nt, hsa; identical to SEQ ID NO: 76043

SEQ ID NO: 297058 - RNA, 64 nt, hsa; identical to SEQ ID NO: 76044

SEQ ID NO: 297059 - RNA, 64 nt, hsa; identical to SEQ ID NO: 76045

SEQ ID NO: 297060 - RNA, 64 nt, hsa; identical to SEQ ID NO: 76046

SEQ ID NO: 297061 - RNA, 64 nt, hsa; identical to SEQ ID NO: 76047

SEQ ID NO: 297062 - RNA, 64 nt, hsa; identical to SEQ ID NO: 76048

SEQ ID NO: 297063 - RNA, 64 nt, hsa; identical to SEQ ID NO: 76049

SEQ ID NO: 297064 - RNA, 64 nt, hsa; identical to SEQ ID NO: 76050

SEQ ID NO: 297065 - RNA, 64 nt, hsa; identical to SEQ ID NO: 76051

SEQ ID NO: 297066 - RNA, 64 nt, hsa; identical to SEQ ID NO: 76052

SEQ ID NO: 297067 - RNA, 64 nt, hsa; identical to SEQ ID NO: 76053

SEQ ID NO: 297068 - RNA, 64 nt, hsa; identical to SEQ ID NO: 76054

SEQ ID NO: 297069 - RNA, 64 nt, hsa; identical to SEQ ID NO: 76055

SEQ ID NO: 297070 - RNA, 64 nt, hsa; identical to SEQ ID NO: 76056

SEQ ID NO: 297071 - RNA, 64 nt, hsa; identical to SEQ ID NO: 76057

SEQ ID NO: 297072 - RNA, 64 nt, hsa; identical to SEQ ID NO: 76058

SEQ ID NO: 297073 - RNA, 52 nt, hsa; identical to SEQ ID NO: 76059

SEQ ID NO: 297074 - RNA, 64 nt, hsa; identical to SEQ ID NO: 76060

SEQ ID NO: 297075 - RNA, 64 nt, hsa; identical to SEQ ID NO: 76061

SEQ ID NO: 297076 - RNA, 64 nt, hsa; identical to SEQ ID NO: 76062

SEQ ID NO: 297077 - RNA, 64 nt, hsa; identical to SEQ ID NO: 76062

SEQ ID NO: 297078 - RNA, 64 nt, hsa; identical to SEQ ID NO: 76064

SEQ ID NO: 297079 - RNA, 64 nt, hsa; identical to SEQ ID NO: 76065

SEQ ID NO: 297080 - RNA, 64 nt, hsa; identical to SEQ ID NO: 76066

SEQ ID NO: 297081 - RNA, 64 nt, hsa; identical to SEQ ID NO: 76067

SEQ ID NO: 297082 - RNA, 64 nt, hsa; identical to SEQ ID NO: 76068

SEQ ID NO: 297083 - RNA, 64 nt, hsa; identical to SEQ ID NO: 76069

SEQ ID NO: 297084 - RNA, 64 nt, hsa; identical to SEQ ID NO: 76070

SEQ ID NO: 297085 - RNA, 64 nt, hsa; identical to SEQ ID NO: 76071

SEQ ID NO: 297086 - RNA, 64 nt, hsa; identical to SEQ ID NO: 76072

SEQ ID NO: 297087 - RNA, 64 nt, hsa; identical to SEQ ID NO: 76073

SEQ ID NO: 297088 - RNA, 64 nt, hsa; identical to SEQ ID NO: 76074

SEQ ID NO: 297089 - RNA, 64 nt, hsa; identical to SEQ ID NO: 76075

SEQ ID NO: 297090 - RNA, 64 nt, hsa; identical to SEQ ID NO: 76076

SEQ ID NO: 297091 - RNA, 64 nt, hsa; identical to SEQ ID NO: 76077

SEQ ID NO: 297092 - RNA, 64 nt, hsa; identical to SEQ ID NO: 76078

SEQ ID NO: 297093 - RNA, 64 nt, hsa; identical to SEQ ID NO: 76079

SEQ ID NO: 297094 - RNA, 64 nt, hsa; identical to SEQ ID NO: 76080

SEQ ID NO: 297095 - RNA, 64 nt, hsa; identical to SEQ ID NO: 76081

SEQ ID NO: 297096 - RNA, 64 nt, hsa; identical to SEQ ID NO: 76082

SEQ ID NO: 297097 - RNA, 64 nt, hsa; identical to SEQ ID NO: 76083

SEQ ID NO: 297098 - RNA, 64 nt, hsa; identical to SEQ ID NO: 76084

SEQ ID NO: 297099 - RNA, 64 nt, hsa; identical to SEQ ID NO: 76085

SEQ ID NO: 297100 - RNA, 64 nt, hsa; identical to SEQ ID NO: 76086

SEQ ID NO: 297101 - RNA, 64 nt, hsa; identical to SEQ ID NO: 76087

SEQ ID NO: 297102 - RNA, 64 nt, hsa; identical to SEQ ID NO: 76088

SEQ ID NO: 297103 - RNA, 64 nt, hsa; identical to SEQ ID NO: 76089

SEQ ID NO: 297104 - RNA, 64 nt, hsa; identical to SEQ ID NO: 76090

SEQ ID NO: 297105 - RNA, 64 nt, hsa; identical to SEQ ID NO: 76090

SEQ ID NO: 297106 - RNA, 64 nt, hsa; identical to SEQ ID NO: 238399

SEQ ID NO: 297107 - RNA, 64 nt, hsa; identical to SEQ ID NO: 238400

SEQ ID NO: 297108 - RNA, 64 nt, hsa; identical to SEQ ID NO: 238401

SEQ ID NO: 297109 - RNA, 64 nt, hsa; identical to SEQ ID NO: 238402

SEQ ID NO: 297110 - RNA, 64 nt, hsa; identical to SEQ ID NO: 238403

SEQ ID NO: 297111 - RNA, 64 nt, hsa; identical to SEQ ID NO: 238404

SEQ ID NO: 297112 - RNA, 64 nt, hsa; identical to SEQ ID NO: 238405

SEQ ID NO: 297113 - RNA, 64 nt, hsa; identical to SEQ ID NO: 238406

SEQ ID NO: 297114 - RNA, 64 nt, hsa; identical to SEQ ID NO: 238407

SEQ ID NO: 297115 - RNA, 64 nt, hsa; identical to SEQ ID NO: 238408

SEQ ID NO: 297116 - RNA, 64 nt, hsa; identical to SEQ ID NO: 238409

SEQ ID NO: 297117 - RNA, 64 nt, hsa; identical to SEQ ID NO: 238410

SEQ ID NO: 297118 - RNA, 64 nt, hsa; identical to SEQ ID NO: 238411

SEQ ID NO: 297119 - RNA, 64 nt, hsa; identical to SEQ ID NO: 238412

SEQ ID NO: 297120 - RNA, 64 nt, hsa; identical to SEQ ID NO: 238413

SEQ ID NO: 297121 - RNA, 64 nt, hsa; identical to SEQ ID NO: 238414

SEQ ID NO: 297122 - RNA, 64 nt, hsa; identical to SEQ ID NO: 238415

SEQ ID NO: 297123 - RNA, 64 nt, hsa; identical to SEQ ID NO: 238416

SEQ ID NO: 297124 - RNA, 64 nt, hsa; identical to SEQ ID NO: 238417

SEQ ID NO: 297125 - RNA, 64 nt, hsa; identical to SEQ ID NO: 238418

SEQ ID NO: 297126 - RNA, 64 nt, hsa; identical to SEQ ID NO: 238419

SEQ ID NO: 297127 - RNA, 64 nt, hsa; identical to SEQ ID NO: 238420

SEQ ID NO: 297128 - RNA, 64 nt, hsa
cuuccagcagugccuucccuuuaugaaagacaucacauggcauccagggccaggcaggcagcuu

SEQ ID NO: 297129 - RNA, 64 nt, hsa
aagcaagccauaguuaguuuuauuuuuguaaugcacauggcaaagcaaagacguuugugaugaa

SEQ ID NO: 297130 - RNA, 64 nt, hsa
auucaccuuggaaaugcaccgccucaacuuguucacauggcauaaaugaaaggaauuuuauagu

SEQ ID NO: 297131 - RNA, 64 nt, hsa
uucccaggcuccaguggcuggucaagcuuuucucacauggcaucacugugacacuggcccuccc

SEQ ID NO: 297132 - RNA, 64 nt, hsa
gaacacuguaucucuugagagagguggccauaagacauggcacacaauucccaauuucacaaau

SEQ ID NO: 297133 - RNA, 64 nt, hsa
gugagucaucaaaaagucaaagucagccuggccaacauggcaaaacuccgucucugcaaaaaau

SEQ ID NO: 297134 - RNA, 64 nt, hsa
ugacuuaaauuauuagcuaugguuugcauuuaguacauggcagauugccuguaagucuguucau

SEQ ID NO: 297135 - RNA, 64 nt, hsa
acuugaggucaggaguucgagaccagccuggccaacauggcaaaaccccgucucuaugaaaaau

SEQ ID NO: 297136 - RNA, 64 nt, hsa
aacuguuguuuucucaggauucuuucagcugggaacauggcaggugagcagagcuuggugccuc

SEQ ID NO: 297137 - RNA, 64 nt, hsa
cauggaauuuguucuaauaaaucauucuucuaucacauggcagcacgcuggagccugucaccuu

SEQ ID NO: 297138 - RNA, 64 nt, hsa
acuugagcccaggaguuugaaaccagccuggguaacauggcaaaauccugucuuuacaaaaaau

SEQ ID NO: 297139 - RNA, 64 nt, hsa
accugaagucagaaguuugagaccagccuggcaaacauggcaaaacugucucuauuaaaaauac

SEQ ID NO: 297140 - RNA, 64 nt, hsa
cccccgccgccccuccggacccgcagagcuggggacauggcaugcccugcacucagucaccccg

SEQ ID NO: 297141 - RNA, 64 nt, hsa
uaccagaccucaugggaccagaccccuugggaccacauggcacaaugggaccucuguuguacau

SEQ ID NO: 297142 - RNA, 64 nt, hsa
uaaaaaauuuaaaaaaaauugugagugcuauuguacauggcaaaguuucaaagagcucuuggcc

SEQ ID NO: 297143 - RNA, 64 nt, hsa
uggugcccagaagaaagagggcagcacccauugcacauggcaggccuggaauccugcagcccuc

SEQ ID NO: 297144 - RNA, 64 nt, hsa
cuguaaaucauaauguaacugaagcauaaacaucacauggcauguuuugucauuguuuucaggu

SEQ ID NO: 297145 - RNA, 62 nt, hsa
uuuuccaggacacaauguaggaagucuuuuccacauggcagaugauuugggcagagcgaugg

SEQ ID NO: 297146 - RNA, 64 nt, hsa; identical to SEQ ID NO: 248259

SEQ ID NO: 297147 - RNA, 64 nt, hsa; identical to SEQ ID NO: 248260

SEQ ID NO: 297148 - RNA, 64 nt, hsa; identical to SEQ ID NO: 248261

SEQ ID NO: 297149 - RNA, 64 nt, hsa; identical to SEQ ID NO: 248262

SEQ ID NO: 297150 - RNA, 64 nt, hsa; identical to SEQ ID NO: 248263

SEQ ID NO: 297151 - RNA, 64 nt, hsa; identical to SEQ ID NO: 248264

SEQ ID NO: 297152 - RNA, 64 nt, hsa; identical to SEQ ID NO: 248265

SEQ ID NO: 297153 - RNA, 64 nt, hsa; identical to SEQ ID NO: 248266

SEQ ID NO: 297154 - RNA, 64 nt, hsa; identical to SEQ ID NO: 248267

SEQ ID NO: 297155 - RNA, 64 nt, hsa; identical to SEQ ID NO: 248268

SEQ ID NO: 297156 - RNA, 64 nt, hsa; identical to SEQ ID NO: 248269

SEQ ID NO: 297157 - RNA, 64 nt, hsa; identical to SEQ ID NO: 248270

SEQ ID NO: 297158 - RNA, 64 nt, hsa; identical to SEQ ID NO: 248271

SEQ ID NO: 297159 - RNA, 64 nt, hsa; identical to SEQ ID NO: 248272

SEQ ID NO: 297160 - RNA, 64 nt, hsa; identical to SEQ ID NO: 248273

SEQ ID NO: 297161 - RNA, 64 nt, hsa; identical to SEQ ID NO: 248274

SEQ ID NO: 297162 - RNA, 64 nt, hsa; identical to SEQ ID NO: 248275

SEQ ID NO: 297163 - RNA, 64 nt, hsa; identical to SEQ ID NO: 248276

SEQ ID NO: 297164 - RNA, 64 nt, hsa; identical to SEQ ID NO: 248277

SEQ ID NO: 297165 - RNA, 64 nt, hsa; identical to SEQ ID NO: 248278

SEQ ID NO: 297166 - RNA, 64 nt, hsa; identical to SEQ ID NO: 248279

SEQ ID NO: 297167 - RNA, 64 nt, hsa; identical to SEQ ID NO: 248280

SEQ ID NO: 297168 - RNA, 64 nt, hsa; identical to SEQ ID NO: 248281

SEQ ID NO: 297169 - RNA, 64 nt, hsa; identical to SEQ ID NO: 248282

SEQ ID NO: 297170 - RNA, 64 nt, hsa; identical to SEQ ID NO: 248283

SEQ ID NO: 297171 - RNA, 64 nt, hsa; identical to SEQ ID NO: 248284

SEQ ID NO: 297172 - RNA, 64 nt, hsa; identical to SEQ ID NO: 248285

SEQ ID NO: 297173 - RNA, 64 nt, hsa; identical to SEQ ID NO: 248286

SEQ ID NO: 297174 - RNA, 64 nt, hsa; identical to SEQ ID NO: 248287

SEQ ID NO: 297175 - RNA, 64 nt, hsa; identical to SEQ ID NO: 248288

SEQ ID NO: 297176 - RNA, 64 nt, hsa; identical to SEQ ID NO: 248289

SEQ ID NO: 297177 - RNA, 64 nt, hsa; identical to SEQ ID NO: 248290

SEQ ID NO: 297178 - RNA, 54 nt, hsa; identical to SEQ ID NO: 248291

SEQ ID NO: 297179 - RNA, 64 nt, hsa; identical to SEQ ID NO: 248292

SEQ ID NO: 297180 - RNA, 64 nt, hsa; identical to SEQ ID NO: 248293

SEQ ID NO: 297181 - RNA, 64 nt, hsa; identical to SEQ ID NO: 248294

SEQ ID NO: 297182 - RNA, 64 nt, hsa; identical to SEQ ID NO: 248295

SEQ ID NO: 297183 - RNA, 64 nt, hsa; identical to SEQ ID NO: 248296

SEQ ID NO: 297184 - RNA, 64 nt, hsa; identical to SEQ ID NO: 248297

SEQ ID NO: 297185 - RNA, 64 nt, hsa; identical to SEQ ID NO: 248298

SEQ ID NO: 297186 - RNA, 64 nt, hsa; identical to SEQ ID NO: 248299

SEQ ID NO: 297187 - RNA, 64 nt, hsa; identical to SEQ ID NO: 297128

SEQ ID NO: 297188 - RNA, 64 nt, hsa; identical to SEQ ID NO: 297129

SEQ ID NO: 297189 - RNA, 64 nt, hsa; identical to SEQ ID NO: 297130

SEQ ID NO: 297190 - RNA, 64 nt, hsa; identical to SEQ ID NO: 297131

SEQ ID NO: 297191 - RNA, 64 nt, hsa; identical to SEQ ID NO: 297132

SEQ ID NO: 297192 - RNA, 64 nt, hsa; identical to SEQ ID NO: 297133

SEQ ID NO: 297193 - RNA, 64 nt, hsa; identical to SEQ ID NO: 297134

SEQ ID NO: 297194 - RNA, 64 nt, hsa; identical to SEQ ID NO: 297135

SEQ ID NO: 297195 - RNA, 64 nt, hsa; identical to SEQ ID NO: 297136

SEQ ID NO: 297196 - RNA, 64 nt, hsa; identical to SEQ ID NO: 297137

SEQ ID NO: 297197 - RNA, 64 nt, hsa; identical to SEQ ID NO: 297138

SEQ ID NO: 297198 - RNA, 64 nt, hsa; identical to SEQ ID NO: 297139

SEQ ID NO: 297199 - RNA, 64 nt, hsa; identical to SEQ ID NO: 297140

SEQ ID NO: 297200 - RNA, 64 nt, hsa; identical to SEQ ID NO: 297141

SEQ ID NO: 297201 - RNA, 64 nt, hsa; identical to SEQ ID NO: 297142

SEQ ID NO: 297202 - RNA, 64 nt, hsa; identical to SEQ ID NO: 297143

SEQ ID NO: 297203 - RNA, 64 nt, hsa; identical to SEQ ID NO: 297144

SEQ ID NO: 297204 - RNA, 62 nt, hsa; identical to SEQ ID NO: 297145

SEQ ID NO: 297205 - RNA, 64 nt, hsa; identical to SEQ ID NO: 248259

SEQ ID NO: 297206 - RNA, 64 nt, hsa; identical to SEQ ID NO: 248260

SEQ ID NO: 297207 - RNA, 64 nt, hsa; identical to SEQ ID NO: 248261

SEQ ID NO: 297208 - RNA, 64 nt, hsa; identical to SEQ ID NO: 248262

SEQ ID NO: 297209 - RNA, 64 nt, hsa; identical to SEQ ID NO: 248263

SEQ ID NO: 297210 - RNA, 64 nt, hsa; identical to SEQ ID NO: 248264

SEQ ID NO: 297211 - RNA, 64 nt, hsa; identical to SEQ ID NO: 248265

SEQ ID NO: 297212 - RNA, 64 nt, hsa; identical to SEQ ID NO: 248266

SEQ ID NO: 297213 - RNA, 64 nt, hsa; identical to SEQ ID NO: 248267

SEQ ID NO: 297214 - RNA, 64 nt, hsa; identical to SEQ ID NO: 248268

SEQ ID NO: 297215 - RNA, 64 nt, hsa; identical to SEQ ID NO: 248269

SEQ ID NO: 297216 - RNA, 64 nt, hsa; identical to SEQ ID NO: 248270

SEQ ID NO: 297217 - RNA, 64 nt, hsa; identical to SEQ ID NO: 248271

SEQ ID NO: 297218 - RNA, 64 nt, hsa; identical to SEQ ID NO: 248272

SEQ ID NO: 297219 - RNA, 64 nt, hsa; identical to SEQ ID NO: 248273

SEQ ID NO: 297220 - RNA, 64 nt, hsa; identical to SEQ ID NO: 248274

SEQ ID NO: 297221 - RNA, 64 nt, hsa; identical to SEQ ID NO: 248275

SEQ ID NO: 297222 - RNA, 64 nt, hsa; identical to SEQ ID NO: 248276

SEQ ID NO: 297223 - RNA, 64 nt, hsa; identical to SEQ ID NO: 248277

SEQ ID NO: 297224 - RNA, 64 nt, hsa; identical to SEQ ID NO: 248278

SEQ ID NO: 297225 - RNA, 64 nt, hsa; identical to SEQ ID NO: 248279

SEQ ID NO: 297226 - RNA, 64 nt, hsa; identical to SEQ ID NO: 248280

SEQ ID NO: 297227 - RNA, 64 nt, hsa; identical to SEQ ID NO: 248281

SEQ ID NO: 297228 - RNA, 64 nt, hsa; identical to SEQ ID NO: 248282

SEQ ID NO: 297229 - RNA, 64 nt, hsa; identical to SEQ ID NO: 248283

SEQ ID NO: 297230 - RNA, 64 nt, hsa; identical to SEQ ID NO: 248284

SEQ ID NO: 297231 - RNA, 64 nt, hsa; identical to SEQ ID NO: 248285

SEQ ID NO: 297232 - RNA, 64 nt, hsa; identical to SEQ ID NO: 248286

SEQ ID NO: 297233 - RNA, 64 nt, hsa; identical to SEQ ID NO: 248287

SEQ ID NO: 297234 - RNA, 64 nt, hsa; identical to SEQ ID NO: 248288

SEQ ID NO: 297235 - RNA, 64 nt, hsa; identical to SEQ ID NO: 248289

SEQ ID NO: 297236 - RNA, 64 nt, hsa; identical to SEQ ID NO: 248290

SEQ ID NO: 297237 - RNA, 54 nt, hsa; identical to SEQ ID NO: 248291

SEQ ID NO: 297238 - RNA, 64 nt, hsa; identical to SEQ ID NO: 248292

SEQ ID NO: 297239 - RNA, 64 nt, hsa; identical to SEQ ID NO: 248293

SEQ ID NO: 297240 - RNA, 64 nt, hsa; identical to SEQ ID NO: 248294

SEQ ID NO: 297241 - RNA, 64 nt, hsa; identical to SEQ ID NO: 248295

SEQ ID NO: 297242 - RNA, 64 nt, hsa; identical to SEQ ID NO: 248296

SEQ ID NO: 297243 - RNA, 64 nt, hsa; identical to SEQ ID NO: 248297

SEQ ID NO: 297244 - RNA, 64 nt, hsa; identical to SEQ ID NO: 248298

SEQ ID NO: 297245 - RNA, 64 nt, hsa; identical to SEQ ID NO: 248299

SEQ ID NO: 297246 - RNA, 64 nt, hsa; identical to SEQ ID NO: 285102

SEQ ID NO: 297247 - RNA, 64 nt, hsa; identical to SEQ ID NO: 285103

SEQ ID NO: 297248 - RNA, 64 nt, hsa; identical to SEQ ID NO: 285104

SEQ ID NO: 297249 - RNA, 64 nt, hsa; identical to SEQ ID NO: 285105

SEQ ID NO: 297250 - RNA, 64 nt, hsa; identical to SEQ ID NO: 285106

SEQ ID NO: 297251 - RNA, 64 nt, hsa; identical to SEQ ID NO: 285107

SEQ ID NO: 297252 - RNA, 64 nt, hsa; identical to SEQ ID NO: 285108

SEQ ID NO: 297253 - RNA, 64 nt, hsa; identical to SEQ ID NO: 285109

SEQ ID NO: 297254 - RNA, 64 nt, hsa; identical to SEQ ID NO: 285110

SEQ ID NO: 297255 - RNA, 64 nt, hsa; identical to SEQ ID NO: 285111

SEQ ID NO: 297256 - RNA, 64 nt, hsa; identical to SEQ ID NO: 285112

SEQ ID NO: 297257 - RNA, 64 nt, hsa; identical to SEQ ID NO: 285113

SEQ ID NO: 297258 - RNA, 64 nt, hsa; identical to SEQ ID NO: 285114

SEQ ID NO: 297259 - RNA, 64 nt, hsa; identical to SEQ ID NO: 285115

SEQ ID NO: 297260 - RNA, 64 nt, hsa; identical to SEQ ID NO: 285116

SEQ ID NO: 297261 - RNA, 64 nt, hsa; identical to SEQ ID NO: 285117

SEQ ID NO: 297262 - RNA, 64 nt, hsa; identical to SEQ ID NO: 285118

SEQ ID NO: 297263 - RNA, 64 nt, hsa; identical to SEQ ID NO: 285119

SEQ ID NO: 297264 - RNA, 64 nt, hsa; identical to SEQ ID NO: 285120

SEQ ID NO: 297265 - RNA, 64 nt, hsa; identical to SEQ ID NO: 285121

SEQ ID NO: 297266 - RNA, 64 nt, hsa; identical to SEQ ID NO: 285122

SEQ ID NO: 297267 - RNA, 64 nt, hsa; identical to SEQ ID NO: 285123

SEQ ID NO: 297268 - RNA, 64 nt, hsa; identical to SEQ ID NO: 285124

SEQ ID NO: 297269 - RNA, 64 nt, hsa; identical to SEQ ID NO: 285125

SEQ ID NO: 297270 - RNA, 64 nt, hsa; identical to SEQ ID NO: 285126

SEQ ID NO: 297271 - RNA, 64 nt, hsa; identical to SEQ ID NO: 285127

SEQ ID NO: 297272 - RNA, 64 nt, hsa; identical to SEQ ID NO: 285128

SEQ ID NO: 297273 - RNA, 64 nt, hsa; identical to SEQ ID NO: 285129

SEQ ID NO: 297274 - RNA, 64 nt, hsa; identical to SEQ ID NO: 285130

SEQ ID NO: 297275 - RNA, 64 nt, hsa; identical to SEQ ID NO: 285131

SEQ ID NO: 297276 - RNA, 64 nt, hsa; identical to SEQ ID NO: 285132

SEQ ID NO: 297277 - RNA, 64 nt, hsa; identical to SEQ ID NO: 285133

SEQ ID NO: 297278 - RNA, 64 nt, hsa; identical to SEQ ID NO: 285134

SEQ ID NO: 297279 - RNA, 64 nt, hsa; identical to SEQ ID NO: 285135

SEQ ID NO: 297280 - RNA, 64 nt, hsa; identical to SEQ ID NO: 285136

SEQ ID NO: 297281 - RNA, 64 nt, hsa; identical to SEQ ID NO: 285137

SEQ ID NO: 297282 - RNA, 64 nt, hsa; identical to SEQ ID NO: 285138

SEQ ID NO: 297283 - RNA, 64 nt, hsa; identical to SEQ ID NO: 285139

SEQ ID NO: 297284 - RNA, 64 nt, hsa; identical to SEQ ID NO: 285140

SEQ ID NO: 297285 - RNA, 64 nt, hsa; identical to SEQ ID NO: 285141

SEQ ID NO: 297286 - RNA, 64 nt, hsa; identical to SEQ ID NO: 285142

SEQ ID NO: 297287 - RNA, 64 nt, hsa; identical to SEQ ID NO: 285143

SEQ ID NO: 297288 - RNA, 64 nt, hsa; identical to SEQ ID NO: 285144

SEQ ID NO: 297289 - RNA, 64 nt, hsa; identical to SEQ ID NO: 285145

SEQ ID NO: 297290 - RNA, 64 nt, hsa; identical to SEQ ID NO: 285146

SEQ ID NO: 297291 - RNA, 64 nt, hsa; identical to SEQ ID NO: 285147

SEQ ID NO: 297292 - RNA, 64 nt, hsa; identical to SEQ ID NO: 285148

SEQ ID NO: 297293 - RNA, 64 nt, hsa; identical to SEQ ID NO: 285149

SEQ ID NO: 297294 - RNA, 64 nt, hsa; identical to SEQ ID NO: 285150

SEQ ID NO: 297295 - RNA, 64 nt, hsa; identical to SEQ ID NO: 285151

SEQ ID NO: 297296 - RNA, 64 nt, hsa; identical to SEQ ID NO: 285152

SEQ ID NO: 297297 - RNA, 64 nt, hsa; identical to SEQ ID NO: 285153

SEQ ID NO: 297298 - RNA, 64 nt, hsa; identical to SEQ ID NO: 285154

SEQ ID NO: 297299 - RNA, 64 nt, hsa; identical to SEQ ID NO: 285155

SEQ ID NO: 297300 - RNA, 64 nt, hsa; identical to SEQ ID NO: 285156

SEQ ID NO: 297301 - RNA, 64 nt, hsa; identical to SEQ ID NO: 285157

SEQ ID NO: 297302 - RNA, 64 nt, hsa; identical to SEQ ID NO: 285158

SEQ ID NO: 297303 - RNA, 64 nt, hsa; identical to SEQ ID NO: 285159

SEQ ID NO: 297304 - RNA, 64 nt, hsa; identical to SEQ ID NO: 193171

SEQ ID NO: 297305 - RNA, 64 nt, hsa; identical to SEQ ID NO: 193172

SEQ ID NO: 297306 - RNA, 64 nt, hsa; identical to SEQ ID NO: 193173

SEQ ID NO: 297307 - RNA, 64 nt, hsa; identical to SEQ ID NO: 193174

SEQ ID NO: 297308 - RNA, 64 nt, hsa; identical to SEQ ID NO: 193175

SEQ ID NO: 297309 - RNA, 64 nt, hsa; identical to SEQ ID NO: 193176

SEQ ID NO: 297310 - RNA, 64 nt, hsa; identical to SEQ ID NO: 193177

SEQ ID NO: 297311 - RNA, 64 nt, hsa; identical to SEQ ID NO: 193178

SEQ ID NO: 297312 - RNA, 64 nt, hsa; identical to SEQ ID NO: 193179

SEQ ID NO: 297313 - RNA, 64 nt, hsa; identical to SEQ ID NO: 193180

SEQ ID NO: 297314 - RNA, 64 nt, hsa; identical to SEQ ID NO: 193181

SEQ ID NO: 297315 - RNA, 64 nt, hsa; identical to SEQ ID NO: 193182

SEQ ID NO: 297316 - RNA, 64 nt, hsa; identical to SEQ ID NO: 193183

SEQ ID NO: 297317 - RNA, 64 nt, hsa; identical to SEQ ID NO: 193184

SEQ ID NO: 297318 - RNA, 64 nt, hsa; identical to SEQ ID NO: 193185

SEQ ID NO: 297319 - RNA, 64 nt, hsa; identical to SEQ ID NO: 193186

SEQ ID NO: 297320 - RNA, 64 nt, hsa; identical to SEQ ID NO: 193187

SEQ ID NO: 297321 - RNA, 64 nt, hsa; identical to SEQ ID NO: 193188

SEQ ID NO: 297322 - RNA, 64 nt, hsa; identical to SEQ ID NO: 193188

SEQ ID NO: 297323 - RNA, 64 nt, hsa; identical to SEQ ID NO: 193190

SEQ ID NO: 297324 - RNA, 64 nt, hsa; identical to SEQ ID NO: 193191

SEQ ID NO: 297325 - RNA, 64 nt, hsa; identical to SEQ ID NO: 193192

SEQ ID NO: 297326 - RNA, 64 nt, hsa; identical to SEQ ID NO: 193193

SEQ ID NO: 297327 - RNA, 64 nt, hsa; identical to SEQ ID NO: 193194

SEQ ID NO: 297328 - RNA, 64 nt, hsa; identical to SEQ ID NO: 193195

SEQ ID NO: 297329 - RNA, 64 nt, hsa; identical to SEQ ID NO: 193196

SEQ ID NO: 297330 - RNA, 64 nt, hsa; identical to SEQ ID NO: 193197

SEQ ID NO: 297331 - RNA, 64 nt, hsa; identical to SEQ ID NO: 193198

SEQ ID NO: 297332 - RNA, 64 nt, hsa; identical to SEQ ID NO: 193199

SEQ ID NO: 297333 - RNA, 64 nt, hsa; identical to SEQ ID NO: 193200

SEQ ID NO: 297334 - RNA, 64 nt, hsa; identical to SEQ ID NO: 97744

SEQ ID NO: 297335 - RNA, 64 nt, hsa; identical to SEQ ID NO: 97745

SEQ ID NO: 297336 - RNA, 64 nt, hsa; identical to SEQ ID NO: 97746

SEQ ID NO: 297337 - RNA, 64 nt, hsa; identical to SEQ ID NO: 97747

SEQ ID NO: 297338 - RNA, 64 nt, hsa; identical to SEQ ID NO: 97748

SEQ ID NO: 297339 - RNA, 64 nt, hsa; identical to SEQ ID NO: 97749

SEQ ID NO: 297340 - RNA, 64 nt, hsa; identical to SEQ ID NO: 97750

SEQ ID NO: 297341 - RNA, 64 nt, hsa; identical to SEQ ID NO: 97751

SEQ ID NO: 297342 - RNA, 64 nt, hsa; identical to SEQ ID NO: 97752

SEQ ID NO: 297343 - RNA, 64 nt, hsa; identical to SEQ ID NO: 97753

SEQ ID NO: 297344 - RNA, 64 nt, hsa; identical to SEQ ID NO: 97754

SEQ ID NO: 297345 - RNA, 64 nt, hsa; identical to SEQ ID NO: 97755

SEQ ID NO: 297346 - RNA, 64 nt, hsa; identical to SEQ ID NO: 97756

SEQ ID NO: 297347 - RNA, 64 nt, hsa; identical to SEQ ID NO: 97757

SEQ ID NO: 297348 - RNA, 64 nt, hsa; identical to SEQ ID NO: 97758

SEQ ID NO: 297349 - RNA, 64 nt, hsa; identical to SEQ ID NO: 97759

SEQ ID NO: 297350 - RNA, 64 nt, hsa; identical to SEQ ID NO: 97760

SEQ ID NO: 297351 - RNA, 64 nt, hsa; identical to SEQ ID NO: 97761

SEQ ID NO: 297352 - RNA, 64 nt, hsa; identical to SEQ ID NO: 97762

SEQ ID NO: 297353 - RNA, 64 nt, hsa; identical to SEQ ID NO: 97763

SEQ ID NO: 297354 - RNA, 64 nt, hsa; identical to SEQ ID NO: 97764

SEQ ID NO: 297355 - RNA, 64 nt, hsa; identical to SEQ ID NO: 97765

SEQ ID NO: 297356 - RNA, 64 nt, hsa; identical to SEQ ID NO: 97766

SEQ ID NO: 297357 - RNA, 64 nt, hsa; identical to SEQ ID NO: 97767

SEQ ID NO: 297358 - RNA, 64 nt, hsa; identical to SEQ ID NO: 97768

SEQ ID NO: 297359 - RNA, 64 nt, hsa; identical to SEQ ID NO: 97769

SEQ ID NO: 297360 - RNA, 64 nt, hsa; identical to SEQ ID NO: 97770

SEQ ID NO: 297361 - RNA, 64 nt, hsa; identical to SEQ ID NO: 97771

SEQ ID NO: 297362 - RNA, 64 nt, hsa; identical to SEQ ID NO: 97772

SEQ ID NO: 297363 - RNA, 64 nt, hsa; identical to SEQ ID NO: 97773

SEQ ID NO: 297364 - RNA, 64 nt, hsa; identical to SEQ ID NO: 97774

SEQ ID NO: 297365 - RNA, 64 nt, hsa; identical to SEQ ID NO: 97775

SEQ ID NO: 297366 - RNA, 64 nt, hsa; identical to SEQ ID NO: 97776

SEQ ID NO: 297367 - RNA, 64 nt, hsa; identical to SEQ ID NO: 97777

SEQ ID NO: 297368 - RNA, 64 nt, hsa; identical to SEQ ID NO: 97778

SEQ ID NO: 297369 - RNA, 64 nt, hsa; identical to SEQ ID NO: 97779

SEQ ID NO: 297370 - RNA, 64 nt, hsa; identical to SEQ ID NO: 97780

SEQ ID NO: 297371 - RNA, 64 nt, hsa; identical to SEQ ID NO: 97781

SEQ ID NO: 297372 - RNA, 64 nt, hsa; identical to SEQ ID NO: 97782

SEQ ID NO: 297373 - RNA, 64 nt, hsa; identical to SEQ ID NO: 97783

SEQ ID NO: 297374 - RNA, 64 nt, hsa; identical to SEQ ID NO: 97784

SEQ ID NO: 297375 - RNA, 64 nt, hsa; identical to SEQ ID NO: 97785

SEQ ID NO: 297376 - RNA, 64 nt, hsa; identical to SEQ ID NO: 265947

SEQ ID NO: 297377 - RNA, 64 nt, hsa; identical to SEQ ID NO: 265948

SEQ ID NO: 297378 - RNA, 64 nt, hsa; identical to SEQ ID NO: 265949

SEQ ID NO: 297379 - RNA, 64 nt, hsa; identical to SEQ ID NO: 265950

SEQ ID NO: 297380 - RNA, 64 nt, hsa; identical to SEQ ID NO: 265951

SEQ ID NO: 297381 - RNA, 64 nt, hsa; identical to SEQ ID NO: 265952

SEQ ID NO: 297382 - RNA, 64 nt, hsa; identical to SEQ ID NO: 265953

SEQ ID NO: 297383 - RNA, 64 nt, hsa; identical to SEQ ID NO: 265954

SEQ ID NO: 297384 - RNA, 64 nt, hsa; identical to SEQ ID NO: 265955

SEQ ID NO: 297385 - RNA, 64 nt, hsa; identical to SEQ ID NO: 265956

SEQ ID NO: 297386 - RNA, 64 nt, hsa; identical to SEQ ID NO: 265957

SEQ ID NO: 297387 - RNA, 64 nt, hsa; identical to SEQ ID NO: 265958

SEQ ID NO: 297388 - RNA, 64 nt, hsa; identical to SEQ ID NO: 265959

SEQ ID NO: 297389 - RNA, 64 nt, hsa; identical to SEQ ID NO: 265960

SEQ ID NO: 297390 - RNA, 64 nt, hsa; identical to SEQ ID NO: 265961

SEQ ID NO: 297391 - RNA, 64 nt, hsa; identical to SEQ ID NO: 265962

SEQ ID NO: 297392 - RNA, 64 nt, hsa; identical to SEQ ID NO: 265963

SEQ ID NO: 297393 - RNA, 64 nt, hsa; identical to SEQ ID NO: 265964

SEQ ID NO: 297394 - RNA, 64 nt, hsa; identical to SEQ ID NO: 265965

SEQ ID NO: 297395 - RNA, 64 nt, hsa; identical to SEQ ID NO: 265966

SEQ ID NO: 297396 - RNA, 64 nt, hsa; identical to SEQ ID NO: 265967

SEQ ID NO: 297397 - RNA, 64 nt, hsa; identical to SEQ ID NO: 265968

SEQ ID NO: 297398 - RNA, 64 nt, hsa; identical to SEQ ID NO: 265969

SEQ ID NO: 297399 - RNA, 64 nt, hsa; identical to SEQ ID NO: 265970

SEQ ID NO: 297400 - RNA, 64 nt, hsa; identical to SEQ ID NO: 265971

SEQ ID NO: 297401 - RNA, 64 nt, hsa; identical to SEQ ID NO: 265972

SEQ ID NO: 297402 - RNA, 64 nt, hsa; identical to SEQ ID NO: 265973

SEQ ID NO: 297403 - RNA, 64 nt, hsa; identical to SEQ ID NO: 265974

SEQ ID NO: 297404 - RNA, 64 nt, hsa; identical to SEQ ID NO: 265975

SEQ ID NO: 297405 - RNA, 64 nt, hsa; identical to SEQ ID NO: 265976

SEQ ID NO: 297406 - RNA, 64 nt, hsa; identical to SEQ ID NO: 265977

SEQ ID NO: 297407 - RNA, 64 nt, hsa; identical to SEQ ID NO: 265978

SEQ ID NO: 297408 - RNA, 64 nt, hsa; identical to SEQ ID NO: 265979

SEQ ID NO: 297409 - RNA, 64 nt, hsa; identical to SEQ ID NO: 265980

SEQ ID NO: 297410 - RNA, 64 nt, hsa; identical to SEQ ID NO: 265981

SEQ ID NO: 297411 - RNA, 64 nt, hsa; identical to SEQ ID NO: 265982

SEQ ID NO: 297412 - RNA, 64 nt, hsa; identical to SEQ ID NO: 265983

SEQ ID NO: 297413 - RNA, 64 nt, hsa; identical to SEQ ID NO: 265984

SEQ ID NO: 297414 - RNA, 64 nt, hsa; identical to SEQ ID NO: 265985

SEQ ID NO: 297415 - RNA, 64 nt, hsa; identical to SEQ ID NO: 265986

SEQ ID NO: 297416 - RNA, 64 nt, hsa; identical to SEQ ID NO: 265987

SEQ ID NO: 297417 - RNA, 64 nt, hsa; identical to SEQ ID NO: 265988

SEQ ID NO: 297418 - RNA, 64 nt, hsa; identical to SEQ ID NO: 265989

SEQ ID NO: 297419 - RNA, 64 nt, hsa; identical to SEQ ID NO: 265990

SEQ ID NO: 297420 - RNA, 64 nt, hsa; identical to SEQ ID NO: 265991

SEQ ID NO: 297421 - RNA, 64 nt, hsa; identical to SEQ ID NO: 265992

SEQ ID NO: 297422 - RNA, 64 nt, hsa; identical to SEQ ID NO: 265993

SEQ ID NO: 297423 - RNA, 64 nt, hsa; identical to SEQ ID NO: 265994

SEQ ID NO: 297424 - RNA, 64 nt, hsa; identical to SEQ ID NO: 265995

SEQ ID NO: 297425 - RNA, 64 nt, hsa; identical to SEQ ID NO: 265996

SEQ ID NO: 297426 - RNA, 64 nt, hsa; identical to SEQ ID NO: 265997

SEQ ID NO: 297427 - RNA, 64 nt, hsa; identical to SEQ ID NO: 265998

SEQ ID NO: 297428 - RNA, 64 nt, hsa; identical to SEQ ID NO: 265999

SEQ ID NO: 297429 - RNA, 64 nt, hsa; identical to SEQ ID NO: 266000

SEQ ID NO: 297430 - RNA, 64 nt, hsa; identical to SEQ ID NO: 266001

SEQ ID NO: 297431 - RNA, 64 nt, hsa; identical to SEQ ID NO: 266002

SEQ ID NO: 297432 - RNA, 64 nt, hsa; identical to SEQ ID NO: 266003

SEQ ID NO: 297433 - RNA, 64 nt, hsa; identical to SEQ ID NO: 266004

SEQ ID NO: 297434 - RNA, 64 nt, hsa; identical to SEQ ID NO: 266005

SEQ ID NO: 297435 - RNA, 64 nt, hsa; identical to SEQ ID NO: 266006

SEQ ID NO: 297436 - RNA, 64 nt, hsa; identical to SEQ ID NO: 266007

SEQ ID NO: 297437 - RNA, 64 nt, hsa; identical to SEQ ID NO: 266008

SEQ ID NO: 297438 - RNA, 64 nt, hsa; identical to SEQ ID NO: 266009

SEQ ID NO: 297439 - RNA, 64 nt, hsa; identical to SEQ ID NO: 266010

SEQ ID NO: 297440 - RNA, 64 nt, hsa; identical to SEQ ID NO: 266011

SEQ ID NO: 297441 - RNA, 64 nt, hsa; identical to SEQ ID NO: 266012

SEQ ID NO: 297442 - RNA, 64 nt, hsa; identical to SEQ ID NO: 266013

SEQ ID NO: 297443 - RNA, 64 nt, hsa; identical to SEQ ID NO: 266014

SEQ ID NO: 297444 - RNA, 64 nt, hsa; identical to SEQ ID NO: 266015

SEQ ID NO: 297445 - RNA, 64 nt, hsa; identical to SEQ ID NO: 266016

SEQ ID NO: 297446 - RNA, 64 nt, hsa; identical to SEQ ID NO: 266017

SEQ ID NO: 297447 - RNA, 64 nt, hsa; identical to SEQ ID NO: 266018

SEQ ID NO: 297448 - RNA, 64 nt, hsa; identical to SEQ ID NO: 266019

SEQ ID NO: 297449 - RNA, 64 nt, hsa; identical to SEQ ID NO: 266020

SEQ ID NO: 297450 - RNA, 64 nt, hsa; identical to SEQ ID NO: 266021

SEQ ID NO: 297451 - RNA, 64 nt, hsa; identical to SEQ ID NO: 266022

SEQ ID NO: 297452 - RNA, 64 nt, hsa; identical to SEQ ID NO: 266023

SEQ ID NO: 297453 - RNA, 64 nt, hsa; identical to SEQ ID NO: 266024

SEQ ID NO: 297454 - RNA, 64 nt, hsa; identical to SEQ ID NO: 266025

SEQ ID NO: 297455 - RNA, 64 nt, hsa; identical to SEQ ID NO: 266026

SEQ ID NO: 297456 - RNA, 64 nt, hsa; identical to SEQ ID NO: 266027

SEQ ID NO: 297457 - RNA, 64 nt, hsa; identical to SEQ ID NO: 266028

SEQ ID NO: 297458 - RNA, 64 nt, hsa; identical to SEQ ID NO: 266029

SEQ ID NO: 297459 - RNA, 64 nt, hsa; identical to SEQ ID NO: 266030

SEQ ID NO: 297460 - RNA, 64 nt, hsa; identical to SEQ ID NO: 266031

SEQ ID NO: 297461 - RNA, 64 nt, hsa; identical to SEQ ID NO: 266032

SEQ ID NO: 297462 - RNA, 64 nt, hsa; identical to SEQ ID NO: 266033

SEQ ID NO: 297463 - RNA, 64 nt, hsa; identical to SEQ ID NO: 266034

SEQ ID NO: 297464 - RNA, 64 nt, hsa; identical to SEQ ID NO: 266035

SEQ ID NO: 297465 - RNA, 64 nt, hsa; identical to SEQ ID NO: 266036

SEQ ID NO: 297466 - RNA, 64 nt, hsa; identical to SEQ ID NO: 266037

SEQ ID NO: 297467 - RNA, 64 nt, hsa; identical to SEQ ID NO: 266038

SEQ ID NO: 297468 - RNA, 64 nt, hsa; identical to SEQ ID NO: 266039

SEQ ID NO: 297469 - RNA, 64 nt, hsa; identical to SEQ ID NO: 266040

SEQ ID NO: 297470 - RNA, 64 nt, hsa; identical to SEQ ID NO: 266041

SEQ ID NO: 297471 - RNA, 64 nt, hsa; identical to SEQ ID NO: 266042

SEQ ID NO: 297472 - RNA, 64 nt, hsa; identical to SEQ ID NO: 266043

SEQ ID NO: 297473 - RNA, 64 nt, hsa; identical to SEQ ID NO: 266044

SEQ ID NO: 297474 - RNA, 64 nt, hsa; identical to SEQ ID NO: 266045

SEQ ID NO: 297475 - RNA, 64 nt, hsa; identical to SEQ ID NO: 266046

SEQ ID NO: 297476 - RNA, 64 nt, hsa; identical to SEQ ID NO: 266047

SEQ ID NO: 297477 - RNA, 64 nt, hsa; identical to SEQ ID NO: 266048

SEQ ID NO: 297478 - RNA, 64 nt, hsa; identical to SEQ ID NO: 266049

SEQ ID NO: 297479 - RNA, 64 nt, hsa; identical to SEQ ID NO: 266050

SEQ ID NO: 297480 - RNA, 64 nt, hsa; identical to SEQ ID NO: 266051

SEQ ID NO: 297481 - RNA, 64 nt, hsa; identical to SEQ ID NO: 266052

SEQ ID NO: 297482 - RNA, 64 nt, hsa; identical to SEQ ID NO: 266053

SEQ ID NO: 297483 - RNA, 64 nt, hsa; identical to SEQ ID NO: 266054

SEQ ID NO: 297484 - RNA, 64 nt, hsa; identical to SEQ ID NO: 266055

SEQ ID NO: 297485 - RNA, 64 nt, hsa; identical to SEQ ID NO: 266056

SEQ ID NO: 297486 - RNA, 64 nt, hsa; identical to SEQ ID NO: 266057

SEQ ID NO: 297487 - RNA, 64 nt, hsa; identical to SEQ ID NO: 266058

SEQ ID NO: 297488 - RNA, 64 nt, hsa; identical to SEQ ID NO: 266059

SEQ ID NO: 297489 - RNA, 64 nt, hsa; identical to SEQ ID NO: 266060

SEQ ID NO: 297490 - RNA, 64 nt, hsa; identical to SEQ ID NO: 266061

SEQ ID NO: 297491 - RNA, 64 nt, hsa; identical to SEQ ID NO: 266062

SEQ ID NO: 297492 - RNA, 64 nt, hsa; identical to SEQ ID NO: 266063

SEQ ID NO: 297493 - RNA, 64 nt, hsa; identical to SEQ ID NO: 266064

SEQ ID NO: 297494 - RNA, 64 nt, hsa; identical to SEQ ID NO: 266065

SEQ ID NO: 297495 - RNA, 64 nt, hsa; identical to SEQ ID NO: 266066

SEQ ID NO: 297496 - RNA, 64 nt, hsa; identical to SEQ ID NO: 266067

SEQ ID NO: 297497 - RNA, 64 nt, hsa; identical to SEQ ID NO: 266068

SEQ ID NO: 297498 - RNA, 64 nt, hsa; identical to SEQ ID NO: 266069

SEQ ID NO: 297499 - RNA, 64 nt, hsa; identical to SEQ ID NO: 266070

SEQ ID NO: 297500 - RNA, 64 nt, hsa; identical to SEQ ID NO: 266071

SEQ ID NO: 297501 - RNA, 64 nt, hsa; identical to SEQ ID NO: 266072

SEQ ID NO: 297502 - RNA, 64 nt, hsa; identical to SEQ ID NO: 266073

SEQ ID NO: 297503 - RNA, 64 nt, hsa; identical to SEQ ID NO: 266074

SEQ ID NO: 297504 - RNA, 64 nt, hsa; identical to SEQ ID NO: 266075

SEQ ID NO: 297505 - RNA, 64 nt, hsa; identical to SEQ ID NO: 266076

SEQ ID NO: 297506 - RNA, 64 nt, hsa; identical to SEQ ID NO: 266077

SEQ ID NO: 297507 - RNA, 64 nt, hsa; identical to SEQ ID NO: 266078

SEQ ID NO: 297508 - RNA, 64 nt, hsa; identical to SEQ ID NO: 266079

SEQ ID NO: 297509 - RNA, 64 nt, hsa; identical to SEQ ID NO: 266080

SEQ ID NO: 297510 - RNA, 64 nt, hsa; identical to SEQ ID NO: 266081

SEQ ID NO: 297511 - RNA, 64 nt, hsa; identical to SEQ ID NO: 266082

SEQ ID NO: 297512 - RNA, 64 nt, hsa; identical to SEQ ID NO: 266083

SEQ ID NO: 297513 - RNA, 64 nt, hsa; identical to SEQ ID NO: 266084

SEQ ID NO: 297514 - RNA, 64 nt, hsa; identical to SEQ ID NO: 266085

SEQ ID NO: 297515 - RNA, 64 nt, hsa; identical to SEQ ID NO: 266086

SEQ ID NO: 297516 - RNA, 64 nt, hsa; identical to SEQ ID NO: 266087

SEQ ID NO: 297517 - RNA, 64 nt, hsa; identical to SEQ ID NO: 266088

SEQ ID NO: 297518 - RNA, 64 nt, hsa; identical to SEQ ID NO: 266089

SEQ ID NO: 297519 - RNA, 64 nt, hsa; identical to SEQ ID NO: 266090

SEQ ID NO: 297520 - RNA, 64 nt, hsa; identical to SEQ ID NO: 266091

SEQ ID NO: 297521 - RNA, 64 nt, hsa; identical to SEQ ID NO: 266092

SEQ ID NO: 297522 - RNA, 64 nt, hsa; identical to SEQ ID NO: 266093

SEQ ID NO: 297523 - RNA, 64 nt, hsa; identical to SEQ ID NO: 266094

SEQ ID NO: 297524 - RNA, 64 nt, hsa; identical to SEQ ID NO: 266095

SEQ ID NO: 297525 - RNA, 64 nt, hsa; identical to SEQ ID NO: 266096

SEQ ID NO: 297526 - RNA, 64 nt, hsa; identical to SEQ ID NO: 266097

SEQ ID NO: 297527 - RNA, 64 nt, hsa; identical to SEQ ID NO: 266098

SEQ ID NO: 297528 - RNA, 64 nt, hsa; identical to SEQ ID NO: 266099

SEQ ID NO: 297529 - RNA, 64 nt, hsa; identical to SEQ ID NO: 266100

SEQ ID NO: 297530 - RNA, 64 nt, hsa; identical to SEQ ID NO: 266101

SEQ ID NO: 297531 - RNA, 64 nt, hsa; identical to SEQ ID NO: 266102

SEQ ID NO: 297532 - RNA, 64 nt, hsa; identical to SEQ ID NO: 266103

SEQ ID NO: 297533 - RNA, 64 nt, hsa; identical to SEQ ID NO: 266104

SEQ ID NO: 297534 - RNA, 64 nt, hsa; identical to SEQ ID NO: 266105

SEQ ID NO: 297535 - RNA, 64 nt, hsa; identical to SEQ ID NO: 266106

SEQ ID NO: 297536 - RNA, 64 nt, hsa; identical to SEQ ID NO: 266107

SEQ ID NO: 297537 - RNA, 64 nt, hsa; identical to SEQ ID NO: 266108

SEQ ID NO: 297538 - RNA, 64 nt, hsa; identical to SEQ ID NO: 266109

SEQ ID NO: 297539 - RNA, 64 nt, hsa; identical to SEQ ID NO: 266110

SEQ ID NO: 297540 - RNA, 64 nt, hsa; identical to SEQ ID NO: 266111

SEQ ID NO: 297541 - RNA, 64 nt, hsa; identical to SEQ ID NO: 266112

SEQ ID NO: 297542 - RNA, 64 nt, hsa; identical to SEQ ID NO: 266113

SEQ ID NO: 297543 - RNA, 64 nt, hsa; identical to SEQ ID NO: 266114

SEQ ID NO: 297544 - RNA, 64 nt, hsa; identical to SEQ ID NO: 266115

SEQ ID NO: 297545 - RNA, 64 nt, hsa
ccagaacuaagaaugccaagguuuuauauauguguguauauauauauauauauauauauauaua

SEQ ID NO: 297546 - RNA, 64 nt, hsa
uauauauauauauauauauauauauguuuguguguguauauauauauauauauauauauguuug

SEQ ID NO: 297547 - RNA, 64 nt, hsa
uguauauauauauauauauauauauguuuguguguguauauauauguuuguguauauauauaca

SEQ ID NO: 297548 - RNA, 64 nt, hsa
uauauauauguuuguguguguauauauauguuuguguauauauauacacauaugcauacauaug

SEQ ID NO: 297549 - RNA, 64 nt, hsa
uuggcuauaucucauccaaacugagcaguuucuguguauauauagaagguagaaaugaaaagug

SEQ ID NO: 297550 - RNA, 64 nt, hsa
ucugaaugagcgagaaaaauguggauguacuguuuguauauauuguauauauuaaaacagagau

SEQ ID NO: 297551 - RNA, 64 nt, hsa
gcgagaaaaauguggauguacuguuuguauauauuguauauauuaaaacagagauaugugcaug

SEQ ID NO: 297552 - RNA, 64 nt, hsa
uauaagaaauuauagagugaguguauuuuccuuguguauauauuaaacacacccauacaaacau

SEQ ID NO: 297553 - RNA, 64 nt, hsa
auuuguaucuguuuaacucauauucugcacgaucuguauauaguacaucaaacuuagaggugug

SEQ ID NO: 297554 - RNA, 64 nt, hsa
ugagcuaugauaugugcuuguguguaugucuauguguauauauuauauauacauuagacacaca

SEQ ID NO: 297555 - RNA, 64 nt, hsa
uauauauacauuagacacacauauacauuauuucuguauauagaugucuguguauacauaugua

SEQ ID NO: 297556 - RNA, 64 nt, hsa
auggaccaaagguuaugcacaggugggagucuuuuguauauaguuguaaauauugucuugguua

SEQ ID NO: 297557 - RNA, 64 nt, hsa
uaucuuagacuauacuuuuugggaagucuagagauguauauaaugugcuaaauucaaaguagca

SEQ ID NO: 297558 - RNA, 64 nt, hsa
gauuuucuauuuauguagguaauauuguucuauuuguauauauugagauaauuuauuuaauaua

SEQ ID NO: 297559 - RNA, 64 nt, hsa
gauuuaagguacuuaaagcuucuaugguugacauuguauauauaauuuuuuaaaaagguuuucu

SEQ ID NO: 297560 - RNA, 64 nt, hsa
ugaauauauacauguauguauauacagauguguguguauauauauauauacauacacauauaca

SEQ ID NO: 297561 - RNA, 64 nt, hsa
cuuuauauguauauaauuugaauauauacauguauguauauacagauguguguguauauauaua

SEQ ID NO: 297562 - RNA, 64 nt, hsa
cccuauauaucuugaaucuacaaauaucuuuauauguauauaauuugaauauauacauguaugu

SEQ ID NO: 297563 - RNA, 64 nt, hsa
agagauaauauauauauagaaagauguauauagauguauauaugcccaaauauauugaauguac

SEQ ID NO: 297564 - RNA, 64 nt, hsa
agaaagaaacagagauaauauauauauagaaagauguauauagauguauauaugcccaaauaua

SEQ ID NO: 297565 - RNA, 64 nt, hsa
guuugugaaagucuaaauaaugguuguauagauauguauauaugguucacauaucuggaucugu

SEQ ID NO: 297566 - RNA, 64 nt, hsa
uuuuggguccacauuucaaggcugaaguguauaguguauauauaaccuuuccuauggaaaugug

SEQ ID NO: 297567 - RNA, 64 nt, hsa
gcaucauugcacacauugacucuguauuuacaucuguauauacacuaugauuagaaaauaugca

SEQ ID NO: 297568 - RNA, 64 nt, hsa
aaaagauugcugcauaauuuaaaugaaaccuauguguauauaacuuucaaaacuucuuuuucaa

SEQ ID NO: 297569 - RNA, 64 nt, hsa
aaauagaauguguaugcauauauuuguguguauauguauauaugugugugugucuauaucucua

SEQ ID NO: 297570 - RNA, 64 nt, hsa
gaaaaggaggcagauguuaccauugucuuuucacuguauauacuucuaagacagcaagcgggac

SEQ ID NO: 297571 - RNA, 64 nt, hsa
aagacuauaccuauguguauauauauguauaucauguauauauuacucugcacuauaucccuuc

SEQ ID NO: 297572 - RNA, 64 nt, hsa
cauauauacauguagagacaagacuauaccuauguguauauauauguauaucauguauauauua

SEQ ID NO: 297573 - RNA, 64 nt, hsa
aauguccauuuguguaaauguauuuauuuuauauuguauauauuguuaaaugcaaaaaggagau

SEQ ID NO: 297574 - RNA, 64 nt, hsa
uucaagaauauagauaagucuaauuuuuaaaugcuguauauauggcuuucacucaaucaucucu

SEQ ID NO: 297575 - RNA, 64 nt, hsa
guggcaguuccuguuuuugauuuuauuauauauauguauauaauaugaaaguagucauuaaagu

SEQ ID NO: 297576 - RNA, 64 nt, hsa
ucuauccauuguuuugugugcauuuuauuacuucuguauauagagguaacaacgcuaagcuuuu

SEQ ID NO: 297577 - RNA, 64 nt, hsa
uacacaguugcuaugauauguaacaagucacacauguauauaucacacaagucuuaccaauucu

SEQ ID NO: 297578 - RNA, 64 nt, hsa
cagacgugcacuggucugcauuugggggcuaaaguguauauauuccauuuaaaauggaauuugu

SEQ ID NO: 297579 - RNA, 64 nt, hsa
aacauuuuuaucuucauaauuuaaaaaauauauauguauauauugcauauucacuuuuuccuuu

SEQ ID NO: 297580 - RNA, 64 nt, hsa
uggaauacaauugucugccguuuccccuucuuaauguauauauugugaguauuuauuagauucg

SEQ ID NO: 297581 - RNA, 64 nt, hsa
gagauauauauauauacacacacacacacauauguguauauauguauauauauaugugaguaua

SEQ ID NO: 297582 - RNA, 64 nt, hsa
uauauauacacacacacacacauauguguauauauguauauauauaugugaguauauauacaca

SEQ ID NO: 297583 - RNA, 64 nt, hsa
caguguuuauuaaaggaacaugcacagauguaucuguauauagguauugauauagccacaguua

SEQ ID NO: 297584 - RNA, 64 nt, hsa
aauaguccaaauguuucugaagaauuuucaauguuguauauagaaaauacagaauuucauggug

SEQ ID NO: 297585 - RNA, 64 nt, hsa
caacuuuauuaagguauaguggauaauuuaaaacuguauauauugacgguacagauggucccca

SEQ ID NO: 297586 - RNA, 64 nt, hsa
auaagacaaggagaaucauauacaacuugauauguguauauacaguaaaguguucaccacaagc

SEQ ID NO: 297587 - RNA, 64 nt, hsa
aauaauaaaauuucaagggauaguuuuuauucaauguauauaagacagguagugccugauuuac

SEQ ID NO: 297588 - RNA, 64 nt, hsa
gacccuaagggagagauuugugugauaaaaguauuguauauaauagaucagcgauuuuuguaag

SEQ ID NO: 297589 - RNA, 64 nt, hsa
aguguaaagaagccucauaagaucauaaggaaaauguauauaugcuuuucacagcuuucuagaa

SEQ ID NO: 297590 - RNA, 64 nt, hsa
gcauuucauuucaacacugcuucaagguuucuuuuguauauaauucuuagaaugcucauuucuu

SEQ ID NO: 297591 - RNA, 64 nt, hsa
agugacacuuuucacccuuguacagccaaaauaauguauauauggaaagugacagacaaauucu

SEQ ID NO: 297592 - RNA, 64 nt, hsa
auagauguacacacgaauuuaaaugugaugucuuuguauauaucuguauaauguugagauuacu

SEQ ID NO: 297593 - RNA, 64 nt, hsa
ccuaauuuugugugcgugugugugugcgcgcauauguauauagacaggcacaucuuuuuuacuu

SEQ ID NO: 297594 - RNA, 63 nt, hsa
gccauaguccagugggauaaaggaaugauaaacuguauauaacuguaaaauauauguagcaua

SEQ ID NO: 297595 - RNA, 64 nt, hsa
gcccuaaaaugucucuggcaauguacagaaauauuguauauacuuacauauguaauuguuguaa

SEQ ID NO: 297596 - RNA, 64 nt, hsa
ucuacaaccccauagcacaacagguuuauagagauguauauagaauuauaguccuuauuuuuuu

SEQ ID NO: 297597 - RNA, 64 nt, hsa
uuuauauuaagucuuguuuuaaauauguauuauguguauauauuguuugcagacauuauuguuc

SEQ ID NO: 297598 - RNA, 64 nt, hsa
uaaauuguauuucaaaacagugaaaaaauugacauguauauacuguucauucuuguuuauauua

SEQ ID NO: 297599 - RNA, 64 nt, hsa
auucuuauucugugccaggcaacaugcuaacugcuguauauauauuauuauauuuguacuuugg

SEQ ID NO: 297600 - RNA, 64 nt, hsa
uguuuuuugcaucaacuuuucuauauuguauguauguauauaaauacauagauuaaggaaauag

SEQ ID NO: 297601 - RNA, 64 nt, hsa
ucuuuuauuuuacaacugggccaaaggcacauuauguauauaauuaguuuauauuuacacacua

SEQ ID NO: 297602 - RNA, 64 nt, hsa
uguguauauauguauacauauauguauguguauguguauauagagagagagcugagaguuauuc

SEQ ID NO: 297603 - RNA, 64 nt, hsa
guacacgugcauguacacacagcuguacaguguguguauauauguauacauauauguaugugua

SEQ ID NO: 297604 - RNA, 64 nt, hsa
ggcaacagcuggaucuccaaguacauauggauuuuguauauauaggagauuuuuagaaaaauca

SEQ ID NO: 297605 - RNA, 64 nt, hsa
uguugaugggguuuguuguuguuuuugagcuggcuguauauauuuuaaaauuauaaauagauaa

SEQ ID NO: 297606 - RNA, 64 nt, hsa
gaaucuggugcuugucaggguguuugguaagaacuguauauagucagaauuaccuaaaucaccu

SEQ ID NO: 297607 - RNA, 64 nt, hsa
uaaaucaccuagagguaccguuuacaugguuuuguguauauagaguuggcuugcauuuuagggg

SEQ ID NO: 297608 - RNA, 64 nt, hsa
auguguuugguuucaaugguuuuuuauauucagauguauauauggugcucacuuuaggaucagc

SEQ ID NO: 297609 - RNA, 64 nt, hsa
uguggaaaaacagucuuguauuuuucuguauguguguauauauauauaauuauguacuucuggc

SEQ ID NO: 297610 - RNA, 64 nt, hsa
augagaauucuuaucacucaccuuuauauuaaaauguauauauauguauauauuuuuuccuuug

SEQ ID NO: 297611 - RNA, 64 nt, hsa
uuaucacucaccuuuauauuaaaauguauauauauguauauauuuuuuccuuuggaucacuuac

SEQ ID NO: 297612 - RNA, 64 nt, hsa
ugguuagaguaaaggacgaggucauuagccauauuguauauaucgucaagcaacacacacaaaa

SEQ ID NO: 297613 - RNA, 64 nt, hsa
aacgucuagggagaagguugacuuuuugcacuucuguauauagucaaaagagagaaaccuguau

SEQ ID NO: 297614 - RNA, 64 nt, hsa
aguauuucuuuuagggcucacuuaaauacauguuuguauauacuguauucuagccagaauaauu

SEQ ID NO: 297615 - RNA, 64 nt, hsa
uugaaacugguaaaaucaguuuuuugauaguguguguauauaagaaaaaauagauacacacauu

SEQ ID NO: 297616 - RNA, 64 nt, hsa
uacauauacuagaucuggacacacgcauacuaaguguauauaguaucuccuuuuucuuuuuaug

SEQ ID NO: 297617 - RNA, 64 nt, hsa
cacauguauacguauguacgugucuguagguguguguauauauauauauauuuaugcaucuaua

SEQ ID NO: 297618 - RNA, 64 nt, hsa
ucugcacauguggauguacauaugucuguauauauguauauauuuugaacuuucuaaaaaaaaa

SEQ ID NO: 297619 - RNA, 64 nt, hsa
ugccugugucugcacauguggauguacauaugucuguauauauguauauauuuugaacuuucua

SEQ ID NO: 297620 - RNA, 64 nt, hsa
aguauauacaccacauuauccagucaucuggauauguauauaaguauauacaccacauuuucuu

SEQ ID NO: 297621 - RNA, 64 nt, hsa
uguguguguguguaugcauauauguguauguguauguauauaaguauauacaccacauuaucca

SEQ ID NO: 297622 - RNA, 64 nt, hsa
uuuuugcuguucccaaucuaaacuuuucugguauuguauauaugcacuuuaauaucuuauuuau

SEQ ID NO: 297623 - RNA, 64 nt, hsa
ccagucucuguucagauccaaaagcacaaaauguuguauauagagucaaagucaggcucaaaag

SEQ ID NO: 297624 - RNA, 64 nt, hsa
ucaucagccaccauccuauugcaaagguuccaacuguauauauucccaauagcaacguagcuuc

SEQ ID NO: 297625 - RNA, 64 nt, hsa
uugaauuggagagaaggccucccuagccagcacuuguauauacgcaucuauaaauuguccgugu

SEQ ID NO: 297626 - RNA, 64 nt, hsa
uuucuuuaaucacagucacugggaaguaaggagauguauauauguguauauaugguaacaaagc

SEQ ID NO: 297627 - RNA, 64 nt, hsa
cacagucacugggaaguaaggagauguauauauguguauauaugguaacaaagcauagcaguuc

SEQ ID NO: 297628 - RNA, 64 nt, hsa
uuuguagcugccaggcuuucuguaaaaauuguauuguauauaaugugauuuuuacacauacaua

SEQ ID NO: 297629 - RNA, 64 nt, hsa
guguguuuguguaugugcucugugccauggcugguguauauaugugcaauguuagaaggcaaaa

SEQ ID NO: 297630 - RNA, 64 nt, hsa
ugucauuuaacucugccugagacuuucagugcacuguauauagaagucuaaaacacaccuaaga

SEQ ID NO: 297631 - RNA, 64 nt, hsa
uuucauucagguauuuguaauagugacauauauauguauauacauaucaccuccuauucucuua

SEQ ID NO: 297632 - RNA, 64 nt, hsa
gaguacagcagaaaaucuuuuacuaguguguguguguauauauauaaacaauuguaaauuucuu

SEQ ID NO: 297633 - RNA, 64 nt, hsa
auagaauuauaaaugucauuugacuaugucaaucuguauauauuguaccuuaauaugaaaaaca

SEQ ID NO: 297634 - RNA, 64 nt, hsa
augucaaucaagacaaaugaaauauauauguauguguauauauauacauguauguaugaaauau

SEQ ID NO: 297635 - RNA, 64 nt, hsa
guauguaugaaauauauauaugugcguguguguguguauauauauauauauauauauauauuuc

SEQ ID NO: 297636 - RNA, 64 nt, hsa
cuaguaaaauuagguccaguaacaccuguauauauguauauauuuaauaaagaguacuuguaca

SEQ ID NO: 297637 - RNA, 64 nt, hsa
aauugauucuaguaaaauuagguccaguaacaccuguauauauguauauauuuaauaaagagua

SEQ ID NO: 297638 - RNA, 64 nt, hsa
agcgauuaggauuuuucgcuugcgagcaagggaguguauauacuaaaugccacacuguauguuu

SEQ ID NO: 297639 - RNA, 64 nt, hsa
uuuagcauuguuaacauuuaaaugacugaaaggauguauauauaucgaaaugucaaauuaauuu

SEQ ID NO: 297640 - RNA, 64 nt, hsa
ugcaacaucugauaacuucauggccuuugauaaauguauauauguauaugugcauggacugugu

SEQ ID NO: 297641 - RNA, 64 nt, hsa
uauauauauauguguguguguguguguguguguguguauauauauauauauauauauauauaua

SEQ ID NO: 297642 - RNA, 64 nt, hsa
uauauauauauauauauauauauauauauguguguguauauauauauauauguguauauauaua

SEQ ID NO: 297643 - RNA, 64 nt, hsa
uauauauauauguguguguauauauauauauauguguauauauauauguauauacauauaugua

SEQ ID NO: 297644 - RNA, 64 nt, hsa
uguguguauauauauauauauguguauauauauauguauauacauauauguauauauaugcaca

SEQ ID NO: 297645 - RNA, 64 nt, hsa
uauauauguguauauauauauguauauacauauauguauauauaugcacauauauauauguauu

SEQ ID NO: 297646 - RNA, 64 nt, hsa
uauuagucuaaaugugguucuggugcuggugcccuguauauauguaacaauauaggaccccucc

SEQ ID NO: 297647 - RNA, 64 nt, hsa
cucacgugucugucaugaauagcaaaugagaaaauguauauaaaagcacuuuguaaauuguaaa

SEQ ID NO: 297648 - RNA, 64 nt, hsa
aagggauuuaugucuacauauuuguguguguguguguauauauauguaauaugcauacacagau

SEQ ID NO: 297649 - RNA, 64 nt, hsa
auauauauguaauaugcauacacagaugcauauguguauauauaaugaaauuuauguugcuggu

SEQ ID NO: 297650 - RNA, 64 nt, hsa
uauauauauaguacauguauauauauaguacauguguauauauauauuacacacuacuguuguu

SEQ ID NO: 297651 - RNA, 64 nt, hsa
uguguguaauauauauauguauauauauaguacauguauauauauaguacauguguauauauau

SEQ ID NO: 297652 - RNA, 64 nt, hsa
auauauguguguguguguguguguaauauauauauguauauauauaguacauguauauauauag

SEQ ID NO: 297653 - RNA, 64 nt, hsa
ugcauauauaugcauauauguguuuguuuguguauguauauaugcuuuuuucccccugaaccau

SEQ ID NO: 297654 - RNA, 64 nt, hsa
gaauuaagaucauuuuguuguucauugugcaguauguauauagcauaauauacacagugaauua

SEQ ID NO: 297655 - RNA, 64 nt, hsa
aggcaugggguugccaguaccacaaaaacuguguuguauauaauguaaagauuaaaauggggaa

SEQ ID NO: 297656 - RNA, 64 nt, hsa
acuucuguuuuauauauauauacguauacauaucuguauauauacauauauauauauauaaaua

SEQ ID NO: 297657 - RNA, 64 nt, hsa
uuuuauacaguauuuguuuuguuuugguuuugaguguauauaaugcagcauuagcaauaugguu

SEQ ID NO: 297658 - RNA, 64 nt, hsa
uaugugauuauggcuaaaucaaagguaacuggaauguauauacuuuugcuaauguuccagcaac

SEQ ID NO: 297659 - RNA, 64 nt, hsa
caaagacugaagaaauuucacagcaguuuauuaauguauauaaacuuauaaauauuucuccagc

SEQ ID NO: 297660 - RNA, 64 nt, hsa
gucauuauggcauccuuaauuuuucuucuccuucuguauauaggguaagggacuguucugaaga

SEQ ID NO: 297661 - RNA, 64 nt, hsa
aguuugaaaagaaauuaauuugcaguguuuggauuguauauauggugcuaaaaauaaauuaauu

SEQ ID NO: 297662 - RNA, 64 nt, hsa
uacauucuugcuuccuuaaauuaauauguuuguguguauauaugugccucacaccugaauugaa

SEQ ID NO: 297663 - RNA, 64 nt, hsa
gauguuauuuuuguauuuuuaaaaaacaauugguuguauauaaaguuuuuuuauuucuuuugug

SEQ ID NO: 297664 - RNA, 64 nt, hsa
ccagaucacugaauuggaacuuuucuccugcauguguauauaugucaaauugucagcaugacaa

SEQ ID NO: 297665 - RNA, 64 nt, hsa
uauuuguuuauauacauauaugcacguaucuauauguauauauaaaugcauuauuacacauaca

SEQ ID NO: 297666 - RNA, 64 nt, hsa
uacauaauauauacauacguguguacuuauuauauguauauauacacguauguauagaugugug

SEQ ID NO: 297667 - RNA, 64 nt, hsa
ggcugugacuucucucuaaauuguauauaaguuguguauauagagaccauaauuauaugguccu

SEQ ID NO: 297668 - RNA, 64 nt, hsa
ccagggcacugggggcugugacuucucucuaaauuguauauaaguuguguauauagagaccaua

SEQ ID NO: 297669 - RNA, 64 nt, hsa
gauacacacucauguauguaaacguauacauauguguauauaugauacauacacauacacacac

SEQ ID NO: 297670 - RNA, 64 nt, hsa
gauggauguaauauauguagaacacacacauagauguauauaggauacacacucauguauguaa

SEQ ID NO: 297671 - RNA, 64 nt, hsa
ucaguguuuaaggauucuaccuaaugcagauauauguauauaucuauauagaggucuuucuaua

SEQ ID NO: 297672 - RNA, 64 nt, hsa
auuagaaaagauagguuuaacaaaaaaauuuacuuguauauaaugcaccuucaggaggacuaug

SEQ ID NO: 297673 - RNA, 64 nt, hsa
uguuuaaaauugcuuugagugauucauacagagauguauauaugcauacauguauauauucaua

SEQ ID NO: 297674 - RNA, 64 nt, hsa
gagugauucauacagagauguauauaugcauacauguauauauucauaaggaauauaagcuucc

SEQ ID NO: 297675 - RNA, 64 nt, hsa
uauuguguauuagcuaagguucugaaauauucuauguauauaucauuuacaggugguauaaaau

SEQ ID NO: 297676 - RNA, 64 nt, hsa
auauucaauauauuucccaccaaguaccuauauauguauauaaacaaacacauuaucuauauau

SEQ ID NO: 297677 - RNA, 64 nt, hsa
cuguccauuaucuauauaguccugucuugucuauuguauauauaaucuauaugauuaaagaaaa

SEQ ID NO: 297678 - RNA, 64 nt, hsa
ggggcauuagugcugauagcuguguguguuagcuuguauauauauuuuuaaaaaucuaccuguu

SEQ ID NO: 297679 - RNA, 64 nt, hsa
cucuuagugguuacauugccauuugguagcaucauguauauauuuaugcuuauaaguuugcauu

SEQ ID NO: 297680 - RNA, 64 nt, hsa
uaaaacagaacuguguacuguauaucuguauauauguauauauguauguauauuuaaggaaguc

SEQ ID NO: 297681 - RNA, 64 nt, hsa
agggguauuaaaacagaacuguguacuguauaucuguauauauguauauauguauguauauuua

SEQ ID NO: 297682 - RNA, 64 nt, hsa
caccauuuacgcuacaugugauuuuuuuaauguauguauauauauauauucucaaauugcucua

SEQ ID NO: 297683 - RNA, 64 nt, hsa
aaaauaggaacgacucuaauuaauaggcuuucuguguauauaauuaaauuuagcugcugcaacc

SEQ ID NO: 297684 - RNA, 64 nt, hsa
ugauuugccuguaauuuuggaugauuaaaaaauguguauauauauuagcuaauuagaaauauuc

SEQ ID NO: 297685 - RNA, 64 nt, hsa
gauacuucccaaagcccuuauguuuaaucagcgauguauauaagccaguucacuuagacaacuu

SEQ ID NO: 297686 - RNA, 64 nt, hsa
gcauuguugaaagacaaccagaauaucaagaaaauguauauaggaauaugcuacuugccuccuc

SEQ ID NO: 297687 - RNA, 64 nt, hsa
auguuaucccuauggugaaaauaaauuaauuuguuguauauaguuccucaaucucugaaguaaa

SEQ ID NO: 297688 - RNA, 64 nt, hsa
uucuuuacuaucuaaaaguuuaucgguaucuugauguauauauauauuaagguguggcuguuua

SEQ ID NO: 297689 - RNA, 64 nt, hsa
ugguguuuugccuauauauugcuccaaacuacuguguauauauguauguguguuaaaucaccaa

SEQ ID NO: 297690 - RNA, 64 nt, hsa
aucuauuguacaagauguguuacuggcauuuccauguauauauguauauaaaugcaggaaacca

SEQ ID NO: 297691 - RNA, 64 nt, hsa
uacaagauguguuacuggcauuuccauguauauauguauauaaaugcaggaaaccaacauguca

SEQ ID NO: 297692 - RNA, 64 nt, hsa
ccugagaagcauguaauguuaauguuauaucauauguauauauauauaugcacuauguauauac

SEQ ID NO: 297693 - RNA, 64 nt, hsa
auguuauaucauauguauauauauauaugcacuauguauauacauauauauuaauacugguauu

SEQ ID NO: 297694 - RNA, 64 nt, hsa
uacaaaauuuuccucuuuuguuuauugacuagauuguauauaauuuucuuuuuuccaaaauauu

SEQ ID NO: 297695 - RNA, 64 nt, hsa
gguuauaaagggagguaccuaaauacucaaauaauguauauauucuuuuucauaacauauggaa

SEQ ID NO: 297696 - RNA, 64 nt, hsa
agagcagaguucccuauuccccuggcauaaagaauguauauauauuuugaaauauggcugagaa

SEQ ID NO: 297697 - RNA, 64 nt, hsa
ucaaccuguaaaacaccacuccuccuuccaaaguuguauauauaauauugcagguuaaauuacu

SEQ ID NO: 297698 - RNA, 64 nt, hsa
cauuggaacuugcauccuguauuguaaauauaaauguauauauuaugcauuaaaucacucugca

SEQ ID NO: 297699 - RNA, 64 nt, hsa
auuuggagaauaaguguguacagaucacaaaacauguauauacauuauuuagaaaagaucucaa

SEQ ID NO: 297700 - RNA, 64 nt, hsa
uuauuuuguaaacauuuuguggguacauaguacauguauauauuuacgggguaugugagauguu

SEQ ID NO: 297701 - RNA, 64 nt, hsa
uagguauauguagauagaugugcauguauguguuuguauauauaauuuuauaaguuucacgcau

SEQ ID NO: 297702 - RNA, 64 nt, hsa
augccugugugcauacauauguaugggauauauuuguauauauauguacagguaauaaacaucc

SEQ ID NO: 297703 - RNA, 64 nt, hsa
gugcauguccauagugaggcuacagauggcuuauuguauauaauuacaauguaaauagcuuuuu

SEQ ID NO: 297704 - RNA, 64 nt, hsa
ucuccuuguccaugccauagcugguuucuacuuauguauauaaagggggguggggggaggggcu

SEQ ID NO: 297705 - RNA, 64 nt, hsa
agccugagcacacuuauuuuugaaaaugauauaauguauauauaugggaggaaaggccacauuu

SEQ ID NO: 297706 - RNA, 64 nt, hsa
uguauauacacauauauauguguauguauauauauguauauauauauggcuuuccaauaaccac

SEQ ID NO: 297707 - RNA, 64 nt, hsa
cacacacacauguauauacacauauauauguguauguauauauauguauauauauauggcuuuc

SEQ ID NO: 297708 - RNA, 64 nt, hsa
cagcuggagguguguauauauacacacacacacauguauauacacauauauauguguauguaua

SEQ ID NO: 297709 - RNA, 64 nt, hsa
cugcugagcucugguuagguuacagcuggagguguguauauauacacacacacacauguauaua

SEQ ID NO: 297710 - RNA, 64 nt, hsa
gauccauaguauccuaugccuauacacuuuaaaauguauauacauuuuagacaaaaaugcacac

SEQ ID NO: 297711 - RNA, 64 nt, hsa
aaaaaaauacccuuuuacaauaugaaugcauugcuguauauacuguaagacugaaagcuuugau

SEQ ID NO: 297712 - RNA, 64 nt, hsa
ucauuuauugaauaccagggucauaucuuagaauuguauauaaaacaacauguaacccauucau

SEQ ID NO: 297713 - RNA, 64 nt, hsa
auauguacaugaauauauauauauucauguaucuuguauauaaaauauaggcauauaccucaua

SEQ ID NO: 297714 - RNA, 64 nt, hsa
uacucauucuucacaaaauucugagauuauaaaauguauauaguuaauauuuguuugagcuugu

SEQ ID NO: 297715 - RNA, 64 nt, hsa
agacuuuaaaaaguuaucuugguacaacaccguguguauauacacuuggaagcuuaaaaaggug

SEQ ID NO: 297716 - RNA, 64 nt, hsa
uaacuaauacuugaacauuuuguauauauuucuuuguauauaauuuugugcaguaccaaugaca

SEQ ID NO: 297717 - RNA, 64 nt, hsa
cuugaauugaaauuuaacuaauacuugaacauuuuguauauauuucuuuguauauaauuuugug

SEQ ID NO: 297718 - RNA, 64 nt, hsa
uauauauguguguauauauauaauauaauauauguguauauauauauuauauauauaauauaua

SEQ ID NO: 297719 - RNA, 64 nt, hsa
aggauuguuucuccauauauauauuauauauguguguauauauauaauauaauauauguguaua

SEQ ID NO: 297720 - RNA, 64 nt, hsa
uguaaauuugcaaauuguuuccuuuauauauguauguauauauauauaugaaaauauauauaua

SEQ ID NO: 297721 - RNA, 64 nt, hsa
ugugugucugucuguguguaugcauacauauguguguauauaugguuuugucagguguguaaau

SEQ ID NO: 297722 - RNA, 64 nt, hsa
guguaaguggauguauauguacuuaaacuggcuuuguauauauguauaaaugcuggugguggug

SEQ ID NO: 297723 - RNA, 64 nt, hsa
uaagcuuuccauuuuauucauaaucuaauguguguguauauauguauguguguaugugugugua

SEQ ID NO: 297724 - RNA, 64 nt, hsa
aauguguguguauauauguauguguguauguguguguauauauagauguauauauauacacaca

SEQ ID NO: 297725 - RNA, 64 nt, hsa
uauauguauguguguauguguguguauauauagauguauauauauacacacacagagauauaua

SEQ ID NO: 297726 - RNA, 64 nt, hsa
ucucucucucucuccauauauauauguguguguguguauauauauauauaugugugugugugug

SEQ ID NO: 297727 - RNA, 64 nt, hsa
uacacauauauacacacacacauacauauacauguguauauauauaccaucccauauauaugug

SEQ ID NO: 297728 - RNA, 64 nt, hsa
gcaguauauuuuuuacauugaacuuuucuucacuuguauauaaagauuauauauaaguacuuau

SEQ ID NO: 297729 - RNA, 64 nt, hsa
acugauuuuguuuuaauuguaaguuguuaacuccuguauauaucauuaaaauaaaucugaaguu

SEQ ID NO: 297730 - RNA, 64 nt, hsa
gacagauccuagaccaauguaaagaauguguaucuguauauaaauaauuuaucaaauaguuuuc

SEQ ID NO: 297731 - RNA, 64 nt, hsa
cccgccccuugccuuaguaagaggagcagugaaauguauauaguugauguucaguauuuccaag

SEQ ID NO: 297732 - RNA, 64 nt, hsa
aucaguggcuaaaguugaaaagggguugguuuccuguauauauauguauguauauacacacgua

SEQ ID NO: 297733 - RNA, 64 nt, hsa
uugaaaagggguugguuuccuguauauauauguauguauauacacacguacauacauucauaua

SEQ ID NO: 297734 - RNA, 64 nt, hsa
ccuuuuaaaauauauauauauauacacauauauauguauauauacacauauauguauguauaca

SEQ ID NO: 297735 - RNA, 64 nt, hsa
uauacacauauauguauguauacacauauacacauguauauauacauguguguauguauacaug

SEQ ID NO: 297736 - RNA, 64 nt, hsa
uacacauguauauauacauguguguauguauacauguauauauauauacauacacauauaugua

SEQ ID NO: 297737 - RNA, 64 nt, hsa
gaagaccuuugagaaccuggguguauuaacuuuguguauauaguguaaauauccccacuguacu

SEQ ID NO: 297738 - RNA, 64 nt, hsa
guauauaaugucagguuugggucuuggguucaaguguauauauuccuguaaguuucuuaacugc

SEQ ID NO: 297739 - RNA, 64 nt, hsa
uauauugucuguccauauguauuuguaaauagguuguauauaaugucagguuugggucuugggu

SEQ ID NO: 297740 - RNA, 64 nt, hsa
uccaugcuacauguacaauaagaacuucuauaauuguauauaugccuuugauguauuuuccccu

SEQ ID NO: 297741 - RNA, 64 nt, hsa
uaguuuugcauaauuucagcuucuauauauuguauguauauauuuuuuaaaaaucuauauuuug

SEQ ID NO: 297742 - RNA, 64 nt, hsa
gcaucacccaaucaauaaaaaacaaauauauauauguauauauauguauguaugugugugugua

SEQ ID NO: 297743 - RNA, 64 nt, hsa
uauauauauguauauauauguauguauguguguguguauauauauauauauauauauauauaua

SEQ ID NO: 297744 - RNA, 64 nt, hsa
uaaaauuggaugcuagagaaucaaguuuauuuuauguauauauuuuucugauuauaagaguaau

SEQ ID NO: 297745 - RNA, 64 nt, hsa
auuuccuacguauuuuauuuuacauagaucauauuguauauaguuaguaucuuuauuaauuuuu

SEQ ID NO: 297746 - RNA, 64 nt, hsa
uccucuuguguucuugagaaggaucuaauuuuucuguauauagcccacaucacacuugcuuugu

SEQ ID NO: 297747 - RNA, 64 nt, hsa
aaagauuuucagauccuggugugcuuucaaguuuuguauauaagcaguagauacagauuguauu

SEQ ID NO: 297748 - RNA, 64 nt, hsa
uguuuuuaaccuguacauuguguaauguaauguuuguauauaaugaaauuuuguuauauuuuua

SEQ ID NO: 297749 - RNA, 64 nt, hsa
gagaagccccuaaguuauugaccgguuucaguguuguauauauaaauaugcaagaugugccuua

SEQ ID NO: 297750 - RNA, 64 nt, hsa
cccaacauggauauaaguuuuuuaaaaaaauaguuguauauaacauacauaucugccccagugu

SEQ ID NO: 297751 - RNA, 64 nt, hsa
uuaauuaguggcuuuuaaauuguaguuauaucaguguauauacacgaggggaacuguauaaaga

SEQ ID NO: 297752 - RNA, 64 nt, hsa
gucuucucuuucaaaccagagccauauauaugucuguauauaugggaccuacugcuucucugag

SEQ ID NO: 297753 - RNA, 64 nt, hsa
gacaguuuuauucuuagacucaugugauccaagcuguauauaccauauauaaacauuuuacaug

SEQ ID NO: 297754 - RNA, 64 nt, hsa
uggagguggauuucaugcccugugguguuuacaguguauauaaugguuguguuuucauggggcu

SEQ ID NO: 297755 - RNA, 64 nt, hsa
ggccccucugugaauagcacgauuaaaauccaguuguauauaauggacagcuaacggaacaaua

SEQ ID NO: 297756 - RNA, 64 nt, hsa
ugaaugugugaacguguguauguaaauguauguguguauauauuaaaaaauguauauagauguc

SEQ ID NO: 297757 - RNA, 64 nt, hsa
uguauguaaauguauguguguauauauuaaaaaauguauauagaugucugaguguugucuggag

SEQ ID NO: 297758 - RNA, 64 nt, hsa
uugauugcuuaaacuauugacuugguaagucuacuguauauaacaucuaauauauauauauuau

SEQ ID NO: 297759 - RNA, 64 nt, hsa
uugauugcuuaaacuauugacuugguaagucuacuguauauaacaucuaauauauauauuacag

SEQ ID NO: 297760 - RNA, 64 nt, hsa
ucugcaggauauuugggauccucuuuucuauguauguauauauauaaaaaacuaugaaucacuc

SEQ ID NO: 297761 - RNA, 64 nt, hsa
aacucgguuucacaugauuuuguucuaguuuuuguguauauauguguuuauuagacauggcaug

SEQ ID NO: 297762 - RNA, 64 nt, hsa
gcuuuuuucuuuugccccagaucaaacugaacaauguauauaacacuaucugucuguaaaauac

SEQ ID NO: 297763 - RNA, 64 nt, hsa
uauauuuauaugacagcuugaacugacaacauuguguauauagaucaucuugaaguauuauuuc

SEQ ID NO: 297764 - RNA, 64 nt, hsa
uggcuauauaggaaaaugcuguggaaaugaacuguguauauacuucugggaggaacaaauuuaa

SEQ ID NO: 297765 - RNA, 64 nt, hsa
aaggguauugcuaaaaggauguuuccaaaaaucuuguauauaagauagcaacagugauugauga

SEQ ID NO: 297766 - RNA, 64 nt, hsa
aaacaugacuauacagaaauuuaaauagaaauaguguauauacauauaaaauacaagcuauguu

SEQ ID NO: 297767 - RNA, 64 nt, hsa
uaauagcugacuguguguacauauguauauaauauguauauacaauaucaggcaugcauguggc

SEQ ID NO: 297768 - RNA, 64 nt, hsa
aguggcuuaaauaauagcugacuguguguacauauguauauaauauguauauacaauaucaggc

SEQ ID NO: 297769 - RNA, 64 nt, hsa
gauuuaagaggguaggaauuaggguuuguauauauguauauaugggacauuuuaucuucuggcc

SEQ ID NO: 297770 - RNA, 64 nt, hsa
aacuagaggauuuaagaggguaggaauuaggguuuguauauauguauauaugggacauuuuauc

SEQ ID NO: 297771 - RNA, 64 nt, hsa
gguuaaacugauugucaugaauacccaaagaucauguauauaaucgaaguguauuaguaccauc

SEQ ID NO: 297772 - RNA, 64 nt, hsa
ggucagagaagccuuuaggagaagaaucagaucauguauauaauuguaacaucacauugauuuu

SEQ ID NO: 297773 - RNA, 64 nt, hsa
ugcugcaaacagcuaaacugucauauugcugucuuguauauacagcuuuuccuucuuuuguuua

SEQ ID NO: 297774 - RNA, 64 nt, hsa
aaaggcacuuaaauugguuacuuucauguccagcuguauauaaguccaguguguucaucuagau

SEQ ID NO: 297775 - RNA, 64 nt, hsa
auauugacacaauuuuaaaaaaucaguaaaggaauguauauaauauugcucucguguuuuacag

SEQ ID NO: 297776 - RNA, 64 nt, hsa
ccuguguaccccucuauauauauguuacauagaauguauauauguugggaacaugcucgcuucu

SEQ ID NO: 297777 - RNA, 64 nt, hsa
aaacguguguauuauaucuggccucguuauauaguguauauauauguauacauauacauauaua

SEQ ID NO: 297778 - RNA, 64 nt, hsa
cuggcaaugacuuguauuggccaccaacuguagauguauauauggugcccuucugaugcuaaga

SEQ ID NO: 297779 - RNA, 64 nt, hsa
agcaguggagguggggguugcuguugauugaagauguauauaauaucuccgguuuauaaaaccu

SEQ ID NO: 297780 - RNA, 64 nt, hsa
uccccagcgggcaggcgggcggagccuguauauauguauauacucagugccucaguucagcuuc

SEQ ID NO: 297781 - RNA, 64 nt, hsa
gccccaucuccccagcgggcaggcgggcggagccuguauauauguauauacucagugccucagu

SEQ ID NO: 297782 - RNA, 64 nt, hsa
auuaugcacgugucuggguaucuuuguauauauguguauauaugugugcccuggacuguuucaa

SEQ ID NO: 297783 - RNA, 64 nt, hsa
uggagccugcauuaugcacgugucuggguaucuuuguauauauguguauauaugugugcccugg

SEQ ID NO: 297784 - RNA, 64 nt, hsa
cauccuuauauuauuuuuuucuuaugcaugauuuuguauauaugguuauuuuucuuuccauaaa

SEQ ID NO: 297785 - RNA, 64 nt, hsa
gguuauuuuucuuuccauaaaaaugguauuaaacuguauauacuguuuuguagccuacauauuu

SEQ ID NO: 297786 - RNA, 64 nt, hsa
caucucaguuuagaaauuuauucaaagcuaaagauguauauauacauauacuuuuguguguaua

SEQ ID NO: 297787 - RNA, 64 nt, hsa
aagcuaaagauguauauauacauauacuuuuguguguauauauacacauauguguguaugcagu

SEQ ID NO: 297788 - RNA, 64 nt, hsa
gaaaaguaauaacuauggcacaaauguucaggaguguauauaaaaauaugugggcucucgauuu

SEQ ID NO: 297789 - RNA, 64 nt, hsa
auuuuguaugaauuguuucuaacaaaccuugaucuguauauacuugugagggguuguuugguug

SEQ ID NO: 297790 - RNA, 64 nt, hsa
auacaaaugaaguauggagguguguauguuuauauguauauaacaaaauauuuucauugugacc

SEQ ID NO: 297791 - RNA, 64 nt, hsa
uaaggacuucacugcaaguuuuaguuaagagguuuguauauaaaucuguuauagaacaggcuga

SEQ ID NO: 297792 - RNA, 64 nt, hsa
gugaaacuauauguauucacaguugauacauaguuguauauagaaaaugcuaaagaauccauaa

SEQ ID NO: 297793 - RNA, 64 nt, hsa
aaguauuaaaacaguauuugaguuuaaaagaguuuguauauauuuaaaugaauaacuuuuuaua

SEQ ID NO: 297794 - RNA, 64 nt, hsa
uuuuuuuuuuuuuuuaagaaaaggaauucuuuuguguauauauagauacuugcaugauauacug

SEQ ID NO: 297795 - RNA, 64 nt, hsa
aagugaauuauuccuuuuuuuuguuuuauguaaguguauauauucuuaguuuuucuugaaauca

SEQ ID NO: 297796 - RNA, 64 nt, hsa
uuucauuuugguggaguuuaguuuuagguuuuauuguauauaaaauccugcacugaaucugugu

SEQ ID NO: 297797 - RNA, 64 nt, hsa
uaaauuucccaguuaaagauuauugugacuucacuguauauaaacauauuuuuauacuuuauug

SEQ ID NO: 297798 - RNA, 64 nt, hsa
gcacuaaccaaugccuuuuuagauguauuuuugauguauauaucuauuauucaaaaaaucaugu

SEQ ID NO: 297799 - RNA, 64 nt, hsa
uccuuauuguuaaaaacauguuagaagcaaugaauguauauaaaagccucaacuagucauuuuu

SEQ ID NO: 297800 - RNA, 64 nt, hsa
uuguucaaacgggauucacagaguauuugaaaaauguauauauauuaagaggucacgggggcua

SEQ ID NO: 297801 - RNA, 64 nt, hsa
uagaaaauaauacaaacagauuugucuaaacauuuguauauaacuuuaaaaauagaauauuuuu

SEQ ID NO: 297802 - RNA, 64 nt, hsa
uuauuuuucuuaauuuuuguggauacauaauauguguauauauguaugccauauaugguauauu

SEQ ID NO: 297803 - RNA, 64 nt, hsa
uaggacaauauuuuaugugugugugugcgccuuauguauauaagcauauauauaauauauaagc

SEQ ID NO: 297804 - RNA, 64 nt, hsa
aaccuguauguacguauauuucuguaucuauguauguauauauaugcauaugcagacauaugua

SEQ ID NO: 297805 - RNA, 64 nt, hsa
guaaauuuuacauaaucuguacguaguucuaaucuguauauagucuuggagguuaugauuugcc

SEQ ID NO: 297806 - RNA, 64 nt, hsa
auuauguaaaacuaaagaauggauugaaaggauauguauauacucaguucccaaaaguggagug

SEQ ID NO: 297807 - RNA, 64 nt, hsa
auauauauauauacacacacacacacacaauauauguauauauaguauauacacuauauacugg

SEQ ID NO: 297808 - RNA, 64 nt, hsa
auguauacuauacauaucacauauacuauauguguguauauagugugugauguauaugugugug

SEQ ID NO: 297809 - RNA, 64 nt, hsa
acacuauauacauauaguguauauacacauauaguguauauaguguaugugugauguauacuau

SEQ ID NO: 297810 - RNA, 64 nt, hsa
cacacacacacacacacacacuauauacauauaguguauauacacauauaguguauauagugua

SEQ ID NO: 297811 - RNA, 64 nt, hsa
auuccauauauguauauauuccauauaccauauauguauauauuccacauauguauuccauaua

SEQ ID NO: 297812 - RNA, 64 nt, hsa
uuccauguauguaugcauauauguauuccauauauguauauauuccauauaccauauauguaua

SEQ ID NO: 297813 - RNA, 64 nt, hsa
uguauauaguccccauauguauacauuccacguguguauauauuccacauauguauacauucca

SEQ ID NO: 297814 - RNA, 64 nt, hsa
uguauauauuccacauauguauacauuccacguguguauauaguccccauauguauacauucca

SEQ ID NO: 297815 - RNA, 64 nt, hsa
cauguguauauauuccacguguauguauuccacauguauauauuccacauauguauacauucca

SEQ ID NO: 297816 - RNA, 64 nt, hsa
uccacauguguguauguggaauauauuccacauguguauauauuccacguguauguauuccaca

SEQ ID NO: 297817 - RNA, 64 nt, hsa
ggaggguauuuuuuauuuguggguucaaaaaaucuguauauacagucuauguguuuagaauuug

SEQ ID NO: 297818 - RNA, 64 nt, hsa
ccuuugccugaacacccauguagcugcuguguuguguauauauuacucuuaagaggagugugug

SEQ ID NO: 297819 - RNA, 64 nt, hsa
aaauauauauacauauguagacuauauacauguguguauauauguguauauauacauacacuug

SEQ ID NO: 297820 - RNA, 64 nt, hsa
acauauguagacuauauacauguguguauauauguguauauauacauacacuuguauaaaugua

SEQ ID NO: 297821 - RNA, 64 nt, hsa
uauauauguguauauauacauacacuuguauaaauguauauacacauauaccuauaaugugugu

SEQ ID NO: 297822 - RNA, 64 nt, hsa
ccguuucuuaaaaaacauauauguguguggcguguguauauauauguauauauauuuuuucauu

SEQ ID NO: 297823 - RNA, 64 nt, hsa
aaaaacauauauguguguggcguguguauauauauguauauauauuuuuucauuguauuauuac

SEQ ID NO: 297824 - RNA, 64 nt, hsa
gacagaaaccuuauccuacaccauugcugguuuguguauauaugacuguugcagauuccuucag

SEQ ID NO: 297825 - RNA, 64 nt, hsa
aaucucuuagauuuuaauuuauccuguaaauuucuguauauauaauuuaauaacagaagccucc

SEQ ID NO: 297826 - RNA, 64 nt, hsa
cauguagagcuacagauccagauacacacacuuguguauauauguacauacagacauacugaag

SEQ ID NO: 297827 - RNA, 64 nt, hsa
uguguauauauguaugugugcauaugucuguagcuguauauaaagcgcauguagagcuacagau

SEQ ID NO: 297828 - RNA, 64 nt, hsa
gauacacacacaugcacagguucucaaccacguguguauauauguaugugugcauaugucugua

SEQ ID NO: 297829 - RNA, 64 nt, hsa
gggacuuuuagagccagcaggccccacuguauuauguauauauuuuucaaggucuguuuuucua

SEQ ID NO: 297830 - RNA, 64 nt, hsa
gugcccguggcgucugcuucccauccugggaguguguauauauguagcauaucaugggggacug

SEQ ID NO: 297831 - RNA, 64 nt, hsa
uguacuucagaaaaaaauaauaauuuccauguuuuguauauaucugacaaaacuggcaacaucu

SEQ ID NO: 297832 - RNA, 64 nt, hsa
aucugauuauauauauuuuauauauacuuauguauguauauauaauauauauagaaaucuggau

SEQ ID NO: 297833 - RNA, 64 nt, hsa
gcuuuugggggucagcauccagugugagauacuguguauauaaacuauauauaauguauauaaa

SEQ ID NO: 297834 - RNA, 64 nt, hsa
agugugagauacuguguauauaaacuauauauaauguauauaaacugggauguaaguuugugua

SEQ ID NO: 297835 - RNA, 64 nt, hsa
agcuaaaauaguuacuucaaauuuucagaaaagauguauauagucaaaauuuaagauacaauuc

SEQ ID NO: 297836 - RNA, 64 nt, hsa
uaccuuauuccaauacuauauuguugauaaaauuuguauauacauuuucaauaaagaauaugua

SEQ ID NO: 297837 - RNA, 64 nt, hsa
uucuuuucagauaggcuuaacaaauggagcuuucuguauauaaauguggagauuagaguuaauc

SEQ ID NO: 297838 - RNA, 64 nt, hsa
uucaugugaguuuuuaccguuaggaugauuaagauguauauaggacaaaauguuaagucuuucc

SEQ ID NO: 297839 - RNA, 64 nt, hsa
acgggcuaagguaggguagaguggguguagugaguguauauaaugugauuuggcccuguguauu

SEQ ID NO: 297840 - RNA, 64 nt, hsa
aggggcuaguauaucaguaggauauacuaugggauguauauauaucauugcuguuagagaaaug

SEQ ID NO: 297841 - RNA, 64 nt, hsa
uaugguuauuggcuagaaauccugaguuuucaacuguauauaucuauaguuuguaaaaagaaca

SEQ ID NO: 297842 - RNA, 64 nt, hsa
ggggcauccauuuagcuucagguugucuuguuucuguauauagugacauagcauucugcugcca

SEQ ID NO: 297843 - RNA, 64 nt, hsa
ugcuuaucuuggguuaaauuugagagugauucucuguauauaaauaugugaaauauuauuaucu

SEQ ID NO: 297844 - RNA, 64 nt, hsa
aacuauauuuaagagacuuuguaaaaaagaaaaauguauauagcugugaguuuaaacaaaaacc

SEQ ID NO: 297845 - RNA, 64 nt, hsa
uguguauauauaugcaaauauauguacauauacauguauauacacacagacacaugcauauaca

SEQ ID NO: 297846 - RNA, 64 nt, hsa
uagauaugcaugucuauauaauuauaaaugcauguguauauauaugcaaauauauguacauaua

SEQ ID NO: 297847 - RNA, 64 nt, hsa
gagcugaaucuuuucuuucauguagaaaucuacauguauauacaagaaauguauuuuuaucugc

SEQ ID NO: 297848 - RNA, 64 nt, hsa
caaaaacaaaacaaaacagugacacucacuuguguguauauaaacucuagagacaucuuaggcc

SEQ ID NO: 297849 - RNA, 64 nt, hsa; identical to SEQ ID NO: 297835

SEQ ID NO: 297850 - RNA, 64 nt, hsa; identical to SEQ ID NO: 297836

SEQ ID NO: 297851 - RNA, 64 nt, hsa
uuaucuuuuucccuguuacaccauuuucaucuuaagacugcaugucacucucuuccuuuuugua

SEQ ID NO: 297852 - RNA, 64 nt, hsa
uggagaaugaggaacugaagaaacugccgcucugagacugcacauccaggaaaaaagacuagga

SEQ ID NO: 297853 - RNA, 64 nt, hsa
acuguauccaugcaugcaugauaaugcguggcagagacugcaacagggauuguguguucagaga

SEQ ID NO: 297854 - RNA, 64 nt, hsa
cuguccguuuccaauagguaaagccauaucaguuagacugcaauacuuuaaacacgagacaaaa

SEQ ID NO: 297855 - RNA, 64 nt, hsa
uccaagcaaguauuagaauaccacaggaaccacaagacugcacaucaaaauaugccccauucaa

SEQ ID NO: 297856 - RNA, 64 nt, hsa
cacugccuucucaacuccaaacugacucuuaagaagacugcauuauauuuauuacuguaagaaa

SEQ ID NO: 297857 - RNA, 64 nt, hsa
acacuuaagugugaauuuuuaaauauaguugaguagacugcaucaucugaguuagaagccuauu

SEQ ID NO: 297858 - RNA, 64 nt, hsa
gacauaggacaagcacagguuugugauccucaggagacugcagacagagugaggugagcaccau

SEQ ID NO: 297859 - RNA, 64 nt, hsa
cgggguacuuuccuuaugguaaauguaaacauguagacugcauucgaggugaccuaaaguagag

SEQ ID NO: 297860 - RNA, 64 nt, hsa
cuaacuuggcaugggcaaguugaaguucauccuuagacugcagcguucugagcauggcugaagu

SEQ ID NO: 297861 - RNA, 64 nt, hsa
ugagacagagcagccacaggcagggagagccuucagacugcaacgcuggccugauacgugucaa

SEQ ID NO: 297862 - RNA, 64 nt, hsa
gagggauagaggaggauugaauagaaggagacuaagacugcagcucuaagaaagucucagccaa

SEQ ID NO: 297863 - RNA, 64 nt, hsa
cuuaggcuuggagagccccagauuggaggcagacagacugcaccaccccuucccccccugcauc

SEQ ID NO: 297864 - RNA, 64 nt, hsa
gggcaccuguuuccccagugacucagagagagcaagacugcaggaacggagggguccugcaggg

SEQ ID NO: 297865 - RNA, 64 nt, hsa
acugugccucucaucaggugucacgauuuuucugccacuucaccuuagggagcuuccagugauu

SEQ ID NO: 297866 - RNA, 64 nt, hsa
ggccuuggccacaucccuauuaacagaggcagcuccacuucagacagggacaaggcuuccugcu

SEQ ID NO: 297867 - RNA, 64 nt, hsa
aacccuguggucugcacuacaugugaauggccuuccacuucagucuuaggcagauuugaccuuu

SEQ ID NO: 297868 - RNA, 64 nt, hsa
ccaguagaagacagaaggaacguauguuuacaaaccacuucacuggaagacgucaaacaagcug

SEQ ID NO: 297869 - RNA, 64 nt, hsa
auuaagcuuuuguaauuauuuuucaguagucccaccacuucauagguggaaggaguuugggguu

SEQ ID NO: 297870 - RNA, 64 nt, hsa
ggcacagaccagugucuggaucccagcaucuucuccacuucagcgcugaguucaguauacacaa

SEQ ID NO: 297871 - RNA, 64 nt, hsa
agaaacuuaguuuuuagaauaaauauuaauuuuuccacuucaguuuuauucuagaaaauacccu

SEQ ID NO: 297872 - RNA, 64 nt, hsa
uuacaauuauguugacuagaaacugccuuuuucuccacuucauuucuagcaauuauuuaccaag

SEQ ID NO: 297873 - RNA, 64 nt, hsa
aauauuuuauuuucauggugagucuagaaaacgcccacuucauucugauuaaaaauucuuccau

SEQ ID NO: 297874 - RNA, 64 nt, hsa
uucuuuaacucagauauuuuuguuagugucuaggccacuucauuuauuuuucgucaugguacuu

SEQ ID NO: 297875 - RNA, 64 nt, hsa
uuuuuaaacaagguccaacccugcaaugaagcagccacuucagcccagagagauuauaagaacu

SEQ ID NO: 297876 - RNA, 64 nt, hsa
gcugggcucuguucccagcguuugccagagguggccacuucagccaagcccagagaaguguggg

SEQ ID NO: 297877 - RNA, 64 nt, hsa
cgaguaacuuucugcugaugaacaaaucugcaccccacuucagaccucggugggcauucacacc

SEQ ID NO: 297878 - RNA, 64 nt, hsa
cacuuguggcuauuagagcuggaggcacccuuagccacuucauuccccugaugggcccugacuc

SEQ ID NO: 297879 - RNA, 64 nt, hsa
aucuacaaaaugggccucauggaauggaaugucuccacuucacuccagcaucaacaagugggga

SEQ ID NO: 297880 - RNA, 64 nt, hsa
uuccuucaagccaagucauccccuugggcucucaccacuucaguuuauaccuugccuguagucc

SEQ ID NO: 297881 - RNA, 64 nt, hsa
gucccucaccaacaagccaacugccacagaugacccacuucauaccacauucacaucuuuccac

SEQ ID NO: 297882 - RNA, 64 nt, hsa
gcuguucuugaacuccuggccucaaaugaucuucccacuucagccucccaaagugcagggauua

SEQ ID NO: 297883 - RNA, 64 nt, hsa
agucccccuaacaaacagcccuucacuuccucucccacuucagcaauuuguauuuugaugccau

SEQ ID NO: 297884 - RNA, 64 nt, hsa
uuuuacucucacccugcuccuguaccagcaggggccacuucaaagccaagguacagggugauaa

SEQ ID NO: 297885 - RNA, 64 nt, hsa
guagcuggugauacccuguccuguggaaggacuuccacuucaacacuuccacuucaacaguucc

SEQ ID NO: 297886 - RNA, 64 nt, hsa
ccuguccuguggaaggacuuccacuucaacacuuccacuucaacaguucccgcacggccugaac

SEQ ID NO: 297887 - RNA, 64 nt, hsa
acgagugacucuggguggacaguggugucaugacccacuucaaggggccuaccuccugccaguu

SEQ ID NO: 297888 - RNA, 64 nt, hsa
gaagugccaucaggguggccgcagcugcagagagccacuucaccugagaccacgcccuuccugg

SEQ ID NO: 297889 - RNA, 64 nt, hsa
cuguaaauauugcauauuuuauguauuuggaccaaaagguuacaaguaauuagacaaaaguggu

SEQ ID NO: 297890 - RNA, 64 nt, hsa
caccauacuguaagcauuuuagguagauugccuuaaagguuaugggagggcaugagggaacacu

SEQ ID NO: 297891 - RNA, 64 nt, hsa
ggcuggaugccagaagguucuuugagccaguuucaaagguuacuuguuuuuuuuuuuuuuuuuu

SEQ ID NO: 297892 - RNA, 64 nt, hsa
ccuucuuucugcaaggcagaggaauaauauuuuuaaagguuauuuuguuuuaguuuuaaauagc

SEQ ID NO: 297893 - RNA, 64 nt, hsa
uggcaaaaccaauauuuucuauauugugaagggcaaagguuacagaaacggucccaagaaaauc

SEQ ID NO: 297894 - RNA, 64 nt, hsa
aggucuguaacugguuuugucuguaaaauggggaaaagguuaccuuuucugccacaugaaguag

SEQ ID NO: 297895 - RNA, 64 nt, hsa
ugacaugaugcaaauagacugauacauaauuuggaaagguuauuuacauggcagaauacaugua

SEQ ID NO: 297896 - RNA, 64 nt, hsa
uauuuucucugucugaagaaccagccauuuuuaaaaagguuauuauugacaucccaauauuuug

SEQ ID NO: 297897 - RNA, 64 nt, hsa
auuggugacaaugucacauaaugaaugcuauugaaaagguuaacagauacagcucggaguugug

SEQ ID NO: 297898 - RNA, 64 nt, hsa
uguagaguggcccagaauugcauucugaaugaauaaagguuaaaaaaaaauccccagugcaugu

SEQ ID NO: 297899 - RNA, 64 nt, hsa
cuuuuuaauuauuuaaaacucuagaaagaugaacaaagguuaauuuaaacuuaccuaagaagau

SEQ ID NO: 297900 - RNA, 64 nt, hsa
agacguguuuuuaaaauuccacuaucccuuuucuaaagguuaaaggucugaagcagcuguuuag

SEQ ID NO: 297901 - RNA, 64 nt, hsa
ggcuuccacauuccugaagcacacagaucucaggaaagguuauuuuugcacuucauauuuguuu

SEQ ID NO: 297902 - RNA, 64 nt, hsa
auuucuaauuuuuuucacauaaaacaauuauccuaaagguuaauaguugaucgaaacagaauaa

SEQ ID NO: 297903 - RNA, 64 nt, hsa
guucugacacuuuccccaggaggaaaacaaguacaaagguuacgguggaggcauaaguagaaga

SEQ ID NO: 297904 - RNA, 64 nt, hsa
gauugcauuacuucuguauguugcuugcuauuaaaaagguuaagaggccagguuacccaccagu

SEQ ID NO: 297905 - RNA, 64 nt, hsa
uaccuauauuuuauacuguuucaauguacaggagaaagguuacuguaaacuguguuauguuggu

SEQ ID NO: 297906 - RNA, 64 nt, hsa
aucccuaauauuuaaaaaaaaaaacaaaacaaaaaaagguuacaaaguuuguuaacuugcuauc

SEQ ID NO: 297907 - RNA, 64 nt, hsa
auuaaguccuauugcuagaauagguuacuacaaaaaagguuauauucugaaagaaaaauaacug

SEQ ID NO: 297908 - RNA, 64 nt, hsa
aaguaugacagagcagggccuuaaucccaagggaaaagguuauggaacuggagggggugagcuu

SEQ ID NO: 297909 - RNA, 64 nt, hsa
uuaucuauauauuuaaaguuuucuaaaaaugauaaaagguuauuacgaauuuuguuguacaaaa

SEQ ID NO: 297910 - RNA, 64 nt, hsa
uuagccagcuaaguucaucuuuuuaauaccauaaaaagguuauauguacaguuccuauuuuagc

SEQ ID NO: 297911 - RNA, 64 nt, hsa
ucauuaggaucacacagaguuaaauauagaaaaaugaaaccaucauuauauucuuucguguuuu

SEQ ID NO: 297912 - RNA, 64 nt, hsa
uuagcugacguaaccagcuugguuaagcagcuuaugaaaccauauaaagaauucuuuugaggau

SEQ ID NO: 297913 - RNA, 64 nt, hsa
aggaaucaaaagagaaaaaaguuucugaaaacaaugaaaccauaaaagauaauauucuaaaaac

SEQ ID NO: 297914 - RNA, 64 nt, hsa
guggaaguuaagguguugaccacugugccugaaaugaaaccacaaggcuugagaauagaaauua

SEQ ID NO: 297915 - RNA, 64 nt, hsa
aguccaggaguccaaguagaucucgaaguaaaucugaaaccaaaucaagacacagaacaagguc

SEQ ID NO: 297916 - RNA, 64 nt, hsa
gcuaaucuauagacaccacaguuucuaaauucuuugaaaccacuuuacuacuuuuuuuaaacuu

SEQ ID NO: 297917 - RNA, 64 nt, hsa
cauaugucugaggcacaaguuggcuguucaucuuugaaaccaggggaugcacagucuaaaugaa

SEQ ID NO: 297918 - RNA, 64 nt, hsa
gaauccaagugacugugaaaaggucucauuacaaugaaaccaauccuaaauaauuacaccaacu

SEQ ID NO: 297919 - RNA, 64 nt, hsa
uuuugaaguguugaaguauuuuuaauuuuuuaaaugaaaccauauuuuaaguguuaaaugaauc

SEQ ID NO: 297920 - RNA, 64 nt, hsa
cuuuggggaauuuuggccaggagacccugaaacaugaaaccaaacaggcuuugauauuuuuuuu

SEQ ID NO: 297921 - RNA, 64 nt, hsa
gcuguggcuuugagaaguuaacuuuuguggaauaugaaaccaaaggaagaauuuccauguagau

SEQ ID NO: 297922 - RNA, 64 nt, hsa
ucaugggaauuacauaaggauaaugaggcccaacugaaaccaaguuucagucugccuuaccuuu

SEQ ID NO: 297923 - RNA, 64 nt, hsa
cuaagccugaugaaaugugcuccuucaaucuccaugaaaccaucguaacauggaggccucagcu

SEQ ID NO: 297924 - RNA, 64 nt, hsa
acuaaaaggauucagaugcaauuuucaacuauucugaaaccagcaggacacaccugacuuuaau

SEQ ID NO: 297925 - RNA, 64 nt, hsa
gcagaucugacugggccuaaauuaaguagcuuaaugaaaccauguaauuacuuguucuccuuuc

SEQ ID NO: 297926 - RNA, 64 nt, hsa
cagcuccucaggaggcugaggcaggagaauugcuugaaaccaggaggcggagguugcagugagc

SEQ ID NO: 297927 - RNA, 64 nt, hsa
gccgauggagguuucaaagauguagcuagcauuuugaaaccauaugggcaaaacccggcaacca

SEQ ID NO: 297928 - RNA, 64 nt, hsa
gacaaccgugggggaacacaccacuuuuuacuguugaaaccaacacaacguugaaauccaggcu

SEQ ID NO: 297929 - RNA, 64 nt, hsa
caaugugguugacuaccuuuugauaagcaaaauuugaaaccauuuaaagaccacuguauuuuaa

SEQ ID NO: 297930 - RNA, 64 nt, hsa
uggcccuucugaaacuuauggucaucucucccacugaaaccaaggucuuuucaaauguggcuaa

SEQ ID NO: 297931 - RNA, 64 nt, hsa
ucuaaccugcuuaaauaagaguuuggugagaaagugaaaccaccugaucuugaaucaauguuga

SEQ ID NO: 297932 - RNA, 64 nt, hsa
acagggugaggcccugcuucuuuuccuaagagucugaaaccauuccauuucauuuuggugaaau

SEQ ID NO: 297933 - RNA, 64 nt, hsa
acugccgcaagaccacuacaugacuuagggaacuugaaaccaacuggcucauggagaaaacaaa

SEQ ID NO: 297934 - RNA, 64 nt, hsa
uuguagauaaccccaaagaugugaagaucgcuugugaaaccauuuugaaugaauagauugguuu

SEQ ID NO: 297935 - RNA, 64 nt, hsa
gcccaugguuuuauuucagaagcacaugagggugugaaaccacucuguuaccuuucuguauugu

SEQ ID NO: 297936 - RNA, 64 nt, hsa
cuggguaucuagcuuacuguuuuaacaucauuguugaaaccagacccuguaguccaguggugcu

SEQ ID NO: 297937 - RNA, 64 nt, hsa
uaaaaugugcuguuucagcauguguguacaccuaugaaaccaccacagucaagauauccaacac

SEQ ID NO: 297938 - RNA, 64 nt, hsa
aagcaacagcaagcauuuucuauaauuuuauaaaugaaaccauaugguguguacuuuuuagggg

SEQ ID NO: 297939 - RNA, 64 nt, hsa
uacugauugcugucucgugugucuguaaaaugugugaaaccaaacugcagccucaacaccaugg

SEQ ID NO: 297940 - RNA, 64 nt, hsa
gccccgguacucaagaccagccugggcagaauggugaaaccaccuucucuacaaaaaauacaua

SEQ ID NO: 297941 - RNA, 64 nt, hsa
cacagcaucuucaccaggaguaaauuccaccucaugaaaccacuuucgaggcuccuucuggacu

SEQ ID NO: 297942 - RNA, 64 nt, hsa
gccaaggcaggaagauugcuugagcucaggaguuugaaaccagccuggacaacauauagcaaga

SEQ ID NO: 297943 - RNA, 64 nt, hsa
uuuuacaugggguuguagaucgaguucucaaaggugaaaccagaugaucauucugauaaaggaa

SEQ ID NO: 297944 - RNA, 64 nt, hsa
ggccccuucugccuuccaggagaggucuugcuuuugaaaccaaaaucauguucuucuaaagugu

SEQ ID NO: 297945 - RNA, 64 nt, hsa; identical to SEQ ID NO: 124124

SEQ ID NO: 297946 - RNA, 64 nt, hsa; identical to SEQ ID NO: 124125

SEQ ID NO: 297947 - RNA, 64 nt, hsa; identical to SEQ ID NO: 124126

SEQ ID NO: 297948 - RNA, 64 nt, hsa; identical to SEQ ID NO: 124127

SEQ ID NO: 297949 - RNA, 64 nt, hsa; identical to SEQ ID NO: 124128

SEQ ID NO: 297950 - RNA, 64 nt, hsa; identical to SEQ ID NO: 124129

SEQ ID NO: 297951 - RNA, 64 nt, hsa; identical to SEQ ID NO: 124130

SEQ ID NO: 297952 - RNA, 64 nt, hsa; identical to SEQ ID NO: 124131

SEQ ID NO: 297953 - RNA, 64 nt, hsa; identical to SEQ ID NO: 124132

SEQ ID NO: 297954 - RNA, 64 nt, hsa; identical to SEQ ID NO: 124133

SEQ ID NO: 297955 - RNA, 64 nt, hsa; identical to SEQ ID NO: 124134

SEQ ID NO: 297956 - RNA, 64 nt, hsa; identical to SEQ ID NO: 124135

SEQ ID NO: 297957 - RNA, 64 nt, hsa; identical to SEQ ID NO: 124136

SEQ ID NO: 297958 - RNA, 64 nt, hsa; identical to SEQ ID NO: 124137

SEQ ID NO: 297959 - RNA, 64 nt, hsa; identical to SEQ ID NO: 124138

SEQ ID NO: 297960 - RNA, 64 nt, hsa; identical to SEQ ID NO: 124139

SEQ ID NO: 297961 - RNA, 64 nt, hsa; identical to SEQ ID NO: 124140

SEQ ID NO: 297962 - RNA, 64 nt, hsa; identical to SEQ ID NO: 124141

SEQ ID NO: 297963 - RNA, 64 nt, hsa; identical to SEQ ID NO: 124142

SEQ ID NO: 297964 - RNA, 64 nt, hsa; identical to SEQ ID NO: 124143

SEQ ID NO: 297965 - RNA, 64 nt, hsa; identical to SEQ ID NO: 124144

SEQ ID NO: 297966 - RNA, 61 nt, hsa; identical to SEQ ID NO: 124145

SEQ ID NO: 297967 - RNA, 64 nt, hsa; identical to SEQ ID NO: 124146

SEQ ID NO: 297968 - RNA, 64 nt, hsa; identical to SEQ ID NO: 124147

SEQ ID NO: 297969 - RNA, 64 nt, hsa
ucuucccuguaacugaaaguuuuaagaauuguuccuuggggaaaaauuuuuuuaaaauucaccu

SEQ ID NO: 297970 - RNA, 64 nt, hsa
uuauggcaguuuauaauauaggaacaaauuuguacuuggggauugguaaagauugugaguaaau

SEQ ID NO: 297971 - RNA, 64 nt, hsa
ccaguguccccagcacuuuuaggucauuuggacacuuggggaaaagugaggccagucugcccgg

SEQ ID NO: 297972 - RNA, 64 nt, hsa
caggguguuuggaucagaucaaauuuuguccucucuuggggacugcuuuuuaucugaauuauca

SEQ ID NO: 297973 - RNA, 64 nt, hsa
ugggcuuguucuuguggcuucugaugauuucugacuuggggaaaaauggggaagaguugaaaua

SEQ ID NO: 297974 - RNA, 64 nt, hsa
uggagggugagggcugagugcccuggcuuccucacuuggggagaccaugggucucuguagaaau

SEQ ID NO: 297975 - RNA, 64 nt, hsa
caggcccugcagccacaguguucuguuggagaaacuuggggaaguguuuucugaaccaguucuu

SEQ ID NO: 297976 - RNA, 64 nt, hsa
uaaaauagugcuuuuuugaaauggagaggaaaaacuuggggaggaagaggccugcugugggggc

SEQ ID NO: 297977 - RNA, 64 nt, hsa
acuccuccgagacccaggagacaaacagcccuuccuuggggaaacuugggaaucauucuggcuu

SEQ ID NO: 297978 - RNA, 64 nt, hsa
aggcacaacuucagcaggggauggcgcuaggggacuuggggauuucuggucaaccccacaagca

SEQ ID NO: 297979 - RNA, 64 nt, hsa
gagucuguguuugagagggggucugccauuccugcuuggggacugguggggaagagggccagga

SEQ ID NO: 297980 - RNA, 64 nt, hsa
gaggcuccaccuccaagcucagacagggcccaggcuuggggaacagagagagcagguguacacc

SEQ ID NO: 297981 - RNA, 64 nt, hsa
cgcccccauccucucacgucccgccccgccuccacuuggggacccugccucgugucgucuuuau

SEQ ID NO: 297982 - RNA, 64 nt, hsa
ggucucgugguggagccaugaucugggcugcucucuuggggacacuggguggugguuacacagu

SEQ ID NO: 297983 - RNA, 64 nt, hsa
uauuaucagcaucauaguuucucuaaaaagaaaacuuggggaucauagccgauagagagacuug

SEQ ID NO: 297984 - RNA, 64 nt, hsa
auuugggaauauuugcauguacauaaugagguaucuuggggaugagauccaagucuaaacacaa

SEQ ID NO: 297985 - RNA, 64 nt, hsa
aagcaauuucuaucuguccccuucacuuucaggccuuggggagucucugcuccuaccugacucu

SEQ ID NO: 297986 - RNA, 64 nt, hsa
gggggcagcagcagccuccugaccaaugcccgcucuuggggagugaggauucugcacguggaug

SEQ ID NO: 297987 - RNA, 64 nt, hsa
gagucaggagaacuguuccuugugguuuccgucccuuggggaccacaggcaucagcagucccau

SEQ ID NO: 297988 - RNA, 64 nt, hsa
gguuaucaccagacugugaguuucuggcaaguagcuuggggaagcugaauaaacucuaggccca

SEQ ID NO: 297989 - RNA, 64 nt, hsa
cagaaaagcuguauuuaacucuugcuauuuguaacuuggggauggucuccccugccccagggca

SEQ ID NO: 297990 - RNA, 64 nt, hsa
aaaugacacccuuccucgccuguuggugcuggcccuuggggagcuggagcccagcaugcugggg

SEQ ID NO: 297991 - RNA, 64 nt, hsa
cagcgcccagguccaagucugagccugaccuccccuuggggaccuagccuggagucaggacaaa

SEQ ID NO: 297992 - RNA, 64 nt, hsa
ccacguggaacagacagccccugugucucugucucuuggggaccugaguuugggugggguggca

SEQ ID NO: 297993 - RNA, 64 nt, hsa
acuucagcugcugguguucugauggagccagaggcuuggggaaucuggaacuugccugcuaaau

SEQ ID NO: 297994 - RNA, 58 nt, hsa
ggaguaugccaagaacucacgggccucccuccggaagugcucagucauguucauaggu

SEQ ID NO: 297995 - RNA, 58 nt, hsa
aguccuguggugaagagacuuguuucaucuccggaaaugcaaaaccauuuauagcaug

SEQ ID NO: 297996 - RNA, 58 nt, hsa
guguccugcuagccagccgaacacuucucuccggaagcaggcugguucgacugugagg

SEQ ID NO: 297997 - RNA, 58 nt, hsa
cguccgccccgggcuuggacgcgcccuucuccggaaggcucuggccccaagcuggccg

SEQ ID NO: 297998 - RNA, 58 nt, hsa
agcugagcccgggacuccgccuugcaggcuccggaacccucgcuguggcucccccgcu

SEQ ID NO: 297999 - RNA, 58 nt, hsa
uguguaaccuguaagauguacugugugccuccggaagacaccaccuuucccuucagca

SEQ ID NO: 298000 - RNA, 58 nt, hsa
cggggcgggggaggggagguaggacccgcuccggaaggcgcuguuugaagcuugucgg

SEQ ID NO: 298001 - RNA, 58 nt, hsa
gccaagggaacggauucuccucuagagucuccggaaggaacacagcucuugacacaug

SEQ ID NO: 298002 - RNA, 58 nt, hsa
gaaucugaaugcuauacuggauacucugcuccggaaagaugagcuuuuuauucuacua

SEQ ID NO: 298003 - RNA, 58 nt, hsa
aagccccguuccuccgcagacccaggcccuccggaaggggugaguggggaggggcuuu

SEQ ID NO: 298004 - RNA, 58 nt, hsa
cuggcaucugcuugguuucuggggaggccuccggaagcuuauagucaugacagaaggu

SEQ ID NO: 298005 - RNA, 58 nt, hsa
agccaugacacgauggccagaucauggacuccggaaagcuuucuguuuuuacuggaaa

SEQ ID NO: 298006 - RNA, 58 nt, hsa
uuccuaccacugcugcaugaguauaaugcuccggaauuaucagaaagcauaaugcaga

SEQ ID NO: 298007 - RNA, 58 nt, hsa
ccuggggaagcagucccggcccccaccccuccggaaucucccaccccccacccuccuc

SEQ ID NO: 298008 - RNA, 58 nt, hsa
ggccaaggcgccagaugcagacccaggacuccggaaaagccguccgcgcuccgcucug

SEQ ID NO: 298009 - RNA, 58 nt, hsa
caauauguaagguuuucaguaguuuacccuccggaacccaaguuguauguauguauac

SEQ ID NO: 298010 - RNA, 58 nt, hsa
ggaaugcuagcagggcauggcacgugagcuccggaauagaugucuucaucacuucuuc

SEQ ID NO: 298011 - RNA, 58 nt, hsa
cuaaacaagauacuucuugguuaaggcccuccggaagggaaaggcuacggggcaugug

SEQ ID NO: 298012 - RNA, 58 nt, hsa
gaguacaugugagacuaugggaggaaagcuccggaagaaggagaaacauugcaguggc

SEQ ID NO: 298013 - RNA, 58 nt, hsa
cuccagugauggauggauggacugauaacuccggaagaaugacucuccuguggccuca

SEQ ID NO: 298014 - RNA, 58 nt, hsa
gugcuguccuggagugccugguguuguccuccggaaugcuggugccggaacucgcuau

SEQ ID NO: 298015 - RNA, 58 nt, hsa
ccacucaggcuucauccugcacaauaaacuccggaagcaagucaguagagcuggcucc

SEQ ID NO: 298016 - RNA, 58 nt, hsa
ugugggcauuucuugcgagccucgcagccuccggaagcugucgacuucaugacaagca

SEQ ID NO: 298017 - RNA, 58 nt, hsa
ugcccugguggugggggggccagaccaccuccggaauccugccaccugugacugucug

SEQ ID NO: 298018 - RNA, 58 nt, hsa
gggcgaggccugagcugcgggcugcccucuccggaagugccuugcacaaauaggcgcu

SEQ ID NO: 298019 - RNA, 58 nt, hsa
guggcggcuccggcggaugucaggaaugcuccggaauucauaccuaguggcuguguag

SEQ ID NO: 298020 - RNA, 58 nt, hsa
ccacugggcccugccuucagccuccucacuccggaaaugcauguuuccuugaugcagg

SEQ ID NO: 298021 - RNA, 58 nt, hsa
gcagugagagagggaagggacuaacgugcuccggaaggguggagguuucucuucuaag

SEQ ID NO: 298022 - RNA, 58 nt, hsa
gugccucacugccaccaggcacagccgccuccggaaugcacaggcgagucccugcccu

SEQ ID NO: 298023 - RNA, 58 nt, hsa
ccucuaggcccugccuucagcuuccucacuccggaaacauguguuuccuugaugcagg

SEQ ID NO: 298024 - RNA, 58 nt, hsa
cauucaucccagcacaggcagcgcauggcuccggaagcagacacaggccaggccuggg

SEQ ID NO: 298025 - RNA, 58 nt, hsa
auuauagcuaaguuuugucagcagcauacuccggaaagucucauacuucuugggaguc

SEQ ID NO: 298026 - RNA, 58 nt, hsa
uaucuagauaaguuuguuuacuuaugcccuccggaaaucaugcaagacugcucccugc

SEQ ID NO: 298027 - RNA, 58 nt, hsa
gcugcccccagccagcucccagcagcuucuccggaagcugcucuugccauaaucaacu

SEQ ID NO: 298028 - RNA, 58 nt, hsa
aucuuuuaauaugcuguggggcauagaacuccggaaugaccagcaugauauuuucaga

SEQ ID NO: 298029 - RNA, 58 nt, hsa
gcugcugcuaucuuccaagagaacgggacuccggaagaagacgucuccacggagcccu

SEQ ID NO: 298030 - RNA, 58 nt, hsa
gauuuuuuguuucucuagguaaagaauucuccggaaauccuaucaaggucucauuugc

SEQ ID NO: 298031 - RNA, 58 nt, hsa
cacacaaaugaguggguugcugugcugucuccggaagauucugucguugcccuuggcc

SEQ ID NO: 298032 - RNA, 58 nt, hsa
caagcugccacuggucggccaguacagccuccggaagcagcccuacaacaaccugaag

SEQ ID NO: 298033 - RNA, 58 nt, hsa
aaugaucuguuaacaaaggacugcccaccuccggaacuucugaccucuguuuccuccg

SEQ ID NO: 298034 - RNA, 58 nt, hsa
cacugaaccgagaagggacggucaucugcuccggaaggaaagagaacgggccaagacu

SEQ ID NO: 298035 - RNA, 58 nt, hsa
ccaggccuuccuggacuccucccuccagcuccggaaccugagcuccccuucccuucuc

SEQ ID NO: 298036 - RNA, 58 nt, hsa
ugguggcacaugccuguaaucccagcuacuccggaagcugaggcaggagaauggcuug

SEQ ID NO: 298037 - RNA, 58 nt, hsa
ggccuuucccugcgccgugcccacccuccuccggaaucucccuucccuuccuggccac

SEQ ID NO: 298038 - RNA, 58 nt, hsa
cccccacgaccuucuguacggauuugcucuccggaaggaauucugguuucgcgugauc

SEQ ID NO: 298039 - RNA, 58 nt, hsa
guggccggaggacccgcccccuccuuugcuccggaaucucuccucccucgcccggccc

SEQ ID NO: 298040 - RNA, 58 nt, hsa
cuuuuuaauuuauggacuagucucauuacuccggaauuaugcucuuguaccugugugg

SEQ ID NO: 298041 - RNA, 58 nt, hsa
ugguagguaauaaaucuguaucagaugacuccggaaaugugggaggagagaauuacug

SEQ ID NO: 298042 - RNA, 58 nt, hsa
cacuuacccucuggggccucagcuuucccuccggaaggcugggaggaggugggcuaga

SEQ ID NO: 298043 - RNA, 58 nt, hsa
uguugcagccugcagcaagugcuuccgucuccggaauccuuggggagcacuuguccac

SEQ ID NO: 298044 - RNA, 58 nt, hsa
ugggcuggggaacccuggagagccucgacuccggaagucucaaggugccuccuccucu

SEQ ID NO: 298045 - RNA, 58 nt, hsa
gccaggcccucucugcaguccucggcagcuccggaaggacacagucaggggccgggca

SEQ ID NO: 298046 - RNA, 58 nt, hsa
caccaccaccacucaccaccaucaucaccuccggaaaguguaguccugcccuaaccca

SEQ ID NO: 298047 - RNA, 64 nt, hsa; identical to SEQ ID NO: 211620

SEQ ID NO: 298048 - RNA, 64 nt, hsa; identical to SEQ ID NO: 211621

SEQ ID NO: 298049 - RNA, 64 nt, hsa; identical to SEQ ID NO: 211622

SEQ ID NO: 298050 - RNA, 64 nt, hsa; identical to SEQ ID NO: 211623

SEQ ID NO: 298051 - RNA, 64 nt, hsa; identical to SEQ ID NO: 211624

SEQ ID NO: 298052 - RNA, 64 nt, hsa; identical to SEQ ID NO: 211625

SEQ ID NO: 298053 - RNA, 64 nt, hsa; identical to SEQ ID NO: 211626

SEQ ID NO: 298054 - RNA, 64 nt, hsa; identical to SEQ ID NO: 211627

SEQ ID NO: 298055 - RNA, 64 nt, hsa; identical to SEQ ID NO: 211628

SEQ ID NO: 298056 - RNA, 64 nt, hsa; identical to SEQ ID NO: 211629

SEQ ID NO: 298057 - RNA, 64 nt, hsa; identical to SEQ ID NO: 211630

SEQ ID NO: 298058 - RNA, 64 nt, hsa; identical to SEQ ID NO: 211631

SEQ ID NO: 298059 - RNA, 64 nt, hsa; identical to SEQ ID NO: 211632

SEQ ID NO: 298060 - RNA, 64 nt, hsa; identical to SEQ ID NO: 211633

SEQ ID NO: 298061 - RNA, 64 nt, hsa; identical to SEQ ID NO: 211634

SEQ ID NO: 298062 - RNA, 64 nt, hsa; identical to SEQ ID NO: 211635

SEQ ID NO: 298063 - RNA, 64 nt, hsa; identical to SEQ ID NO: 211636

SEQ ID NO: 298064 - RNA, 64 nt, hsa; identical to SEQ ID NO: 211637

SEQ ID NO: 298065 - RNA, 64 nt, hsa; identical to SEQ ID NO: 211638

SEQ ID NO: 298066 - RNA, 64 nt, hsa; identical to SEQ ID NO: 91879

SEQ ID NO: 298067 - RNA, 64 nt, hsa; identical to SEQ ID NO: 91880

SEQ ID NO: 298068 - RNA, 64 nt, hsa; identical to SEQ ID NO: 91881

SEQ ID NO: 298069 - RNA, 64 nt, hsa; identical to SEQ ID NO: 91882

SEQ ID NO: 298070 - RNA, 64 nt, hsa; identical to SEQ ID NO: 91883

SEQ ID NO: 298071 - RNA, 64 nt, hsa; identical to SEQ ID NO: 91884

SEQ ID NO: 298072 - RNA, 64 nt, hsa; identical to SEQ ID NO: 91885

SEQ ID NO: 298073 - RNA, 64 nt, hsa; identical to SEQ ID NO: 91886

SEQ ID NO: 298074 - RNA, 64 nt, hsa; identical to SEQ ID NO: 91887

SEQ ID NO: 298075 - RNA, 64 nt, hsa; identical to SEQ ID NO: 91888

SEQ ID NO: 298076 - RNA, 64 nt, hsa; identical to SEQ ID NO: 91889

SEQ ID NO: 298077 - RNA, 64 nt, hsa; identical to SEQ ID NO: 91890

SEQ ID NO: 298078 - RNA, 64 nt, hsa; identical to SEQ ID NO: 91891

SEQ ID NO: 298079 - RNA, 64 nt, hsa; identical to SEQ ID NO: 91892

SEQ ID NO: 298080 - RNA, 64 nt, hsa; identical to SEQ ID NO: 91893

SEQ ID NO: 298081 - RNA, 64 nt, hsa; identical to SEQ ID NO: 91894

SEQ ID NO: 298082 - RNA, 64 nt, hsa; identical to SEQ ID NO: 91895

SEQ ID NO: 298083 - RNA, 64 nt, hsa; identical to SEQ ID NO: 91896

SEQ ID NO: 298084 - RNA, 64 nt, hsa
auuaauacugguucauuuguaaauuauuauucauauagaccacuguaguagauaaaacucuaug

SEQ ID NO: 298085 - RNA, 64 nt, hsa
cagacuuuuuuggaaguuuccgagaggagggucuauagaccauuugucagaaaucagaucagcc

SEQ ID NO: 298086 - RNA, 64 nt, hsa
ucuuuggauaauuuucaucgcauauccagcaacuauagaccaaaguuugcuuaagguuugaccc

SEQ ID NO: 298087 - RNA, 64 nt, hsa
aaggaaaguuaugauccuccaagacccuuaauugauagaccauaccagguucugcaggucagca

SEQ ID NO: 298088 - RNA, 64 nt, hsa
ucuugaggugacuuauuuugcauagaggauauggauagaccaacaguaaggguuguggguuaua

SEQ ID NO: 298089 - RNA, 64 nt, hsa
ucucuaaagaaucuuuaguuuccgacguugaauuauagaccaguuugaguaaguacugcuuuuu

SEQ ID NO: 298090 - RNA, 64 nt, hsa
guguaacaggcuauauacauaucaucagggucuguguaaguauacucugugauguucauacagu

SEQ ID NO: 298091 - RNA, 64 nt, hsa
acaugauuuauaauuucacugauugagauuacuuuguaaguagcuguucagaagaauaaaauau

SEQ ID NO: 298092 - RNA, 64 nt, hsa
ugcuguuuaagugcaggcugagacccagccucuuuguaaguacaguaaaauaauccaccguuuu

SEQ ID NO: 298093 - RNA, 64 nt, hsa
gaucuguuaugcuagugguuuaauaggcuugcuauguaaguagaacguggcucaacuagauauc

SEQ ID NO: 298094 - RNA, 64 nt, hsa
uaucauacugugguuucugccuaaaauuggcacauguaaguauugaagaaaaugguuauauaau

SEQ ID NO: 298095 - RNA, 64 nt, hsa
cuuuuuucuuuuuuuuuuuuuaauugccuuguauuguaaguauucuucccugcaguccaaguga

SEQ ID NO: 298096 - RNA, 64 nt, hsa
auuaucaguguuuuagaaacaugaguccggacuguguaaguaaaaguacaaacauuauuuccac

SEQ ID NO: 298097 - RNA, 64 nt, hsa
caaauuugagaugcauuauuccuauuacuaaugauguaaguacgaggauaaauccaagaaacuu

SEQ ID NO: 298098 - RNA, 64 nt, hsa
ccuagagugaauacuaccccuuucuuauaauugcuguaaguauuauauuucuggaauuucacac

SEQ ID NO: 298099 - RNA, 64 nt, hsa
uauauuuuuauuuugggaaaaacguuugcagaaauguaaguaaagccaaucugcaaaacuguau

SEQ ID NO: 298100 - RNA, 64 nt, hsa
aggaucccuagcuuguuuucugucagucauucauuguaaguagcacauugcaacaacaaucaug

SEQ ID NO: 298101 - RNA, 64 nt, hsa
aaauaguucucagauauuaagaaguuguaugaguuguaaguaaucuugccaaagguaaaggggc

SEQ ID NO: 298102 - RNA, 64 nt, hsa
uacuguuuucaccuuuuguuuauauguaaauguuuguaaguauaugggccuaucuguaagugga

SEQ ID NO: 298103 - RNA, 64 nt, hsa
ggauaaggacaaugaugagguuacugguuuggauuguaaguagaggacuuuuauuaauugguuu

SEQ ID NO: 298104 - RNA, 64 nt, hsa
cauuaaaauacucacugaagagaagcccuaugaauguaaguaacgugggaaagcaugaaauucu

SEQ ID NO: 298105 - RNA, 64 nt, hsa
uacaugaaagaauucuagagagaagccauauacauguaaguaacaugggaaagcuuucaaucau

SEQ ID NO: 298106 - RNA, 64 nt, hsa
uuugaaaacuucuaauacagcaaaauccuauaaauguaaguacuucaaaaagccucaugcauag

SEQ ID NO: 298107 - RNA, 64 nt, hsa
aaucucacaaagaaauguuaaauugauauaauccuguaaguaaucugaaagcaauagugcauga

SEQ ID NO: 298108 - RNA, 64 nt, hsa
cuguauauacagucuauguguuuagaauuuguguuguaaguaaacuacagcuuugaguuggaaa

SEQ ID NO: 298109 - RNA, 64 nt, hsa
gccuucuaugcauccacaccaaaauccugcagaauguaaguaagcucugcuuuauaagaugggu

SEQ ID NO: 298110 - RNA, 64 nt, hsa
aauuggacaauggcucuuuagagaguuaucugaguguaaguaaauuaauguucucauuuagauu

SEQ ID NO: 298111 - RNA, 64 nt, hsa
uugguccaaacugaacauauggaaauagauuuauuguaaguauuuacuuagagcuuuuucuuaa

SEQ ID NO: 298112 - RNA, 64 nt, hsa; identical to SEQ ID NO: 115740

SEQ ID NO: 298113 - RNA, 64 nt, hsa; identical to SEQ ID NO: 115741

SEQ ID NO: 298114 - RNA, 64 nt, hsa; identical to SEQ ID NO: 115742

SEQ ID NO: 298115 - RNA, 64 nt, hsa; identical to SEQ ID NO: 115743

SEQ ID NO: 298116 - RNA, 64 nt, hsa; identical to SEQ ID NO: 115744

SEQ ID NO: 298117 - RNA, 64 nt, hsa; identical to SEQ ID NO: 115745

SEQ ID NO: 298118 - RNA, 64 nt, hsa; identical to SEQ ID NO: 115746

SEQ ID NO: 298119 - RNA, 64 nt, hsa; identical to SEQ ID NO: 115747

SEQ ID NO: 298120 - RNA, 64 nt, hsa; identical to SEQ ID NO: 115748

SEQ ID NO: 298121 - RNA, 64 nt, hsa; identical to SEQ ID NO: 115749

SEQ ID NO: 298122 - RNA, 64 nt, hsa; identical to SEQ ID NO: 115750

SEQ ID NO: 298123 - RNA, 64 nt, hsa; identical to SEQ ID NO: 115751

SEQ ID NO: 298124 - RNA, 64 nt, hsa; identical to SEQ ID NO: 115752

SEQ ID NO: 298125 - RNA, 64 nt, hsa; identical to SEQ ID NO: 115753

SEQ ID NO: 298126 - RNA, 64 nt, hsa; identical to SEQ ID NO: 115754

SEQ ID NO: 298127 - RNA, 64 nt, hsa; identical to SEQ ID NO: 115755

SEQ ID NO: 298128 - RNA, 64 nt, hsa; identical to SEQ ID NO: 115756

SEQ ID NO: 298129 - RNA, 64 nt, hsa; identical to SEQ ID NO: 115757

SEQ ID NO: 298130 - RNA, 64 nt, hsa; identical to SEQ ID NO: 115758

SEQ ID NO: 298131 - RNA, 64 nt, hsa; identical to SEQ ID NO: 115759

SEQ ID NO: 298132 - RNA, 64 nt, hsa; identical to SEQ ID NO: 115760

SEQ ID NO: 298133 - RNA, 64 nt, hsa; identical to SEQ ID NO: 115761

SEQ ID NO: 298134 - RNA, 64 nt, hsa; identical to SEQ ID NO: 115762

SEQ ID NO: 298135 - RNA, 64 nt, hsa; identical to SEQ ID NO: 115763

SEQ ID NO: 298136 - RNA, 64 nt, hsa; identical to SEQ ID NO: 115764

SEQ ID NO: 298137 - RNA, 64 nt, hsa; identical to SEQ ID NO: 115765

SEQ ID NO: 298138 - RNA, 64 nt, hsa; identical to SEQ ID NO: 115766

SEQ ID NO: 298139 - RNA, 64 nt, hsa; identical to SEQ ID NO: 115767

SEQ ID NO: 298140 - RNA, 64 nt, hsa; identical to SEQ ID NO: 115768

SEQ ID NO: 298141 - RNA, 64 nt, hsa; identical to SEQ ID NO: 115769

SEQ ID NO: 298142 - RNA, 64 nt, hsa; identical to SEQ ID NO: 115770

SEQ ID NO: 298143 - RNA, 64 nt, hsa; identical to SEQ ID NO: 115771

SEQ ID NO: 298144 - RNA, 64 nt, hsa; identical to SEQ ID NO: 115772

SEQ ID NO: 298145 - RNA, 64 nt, hsa; identical to SEQ ID NO: 115773

SEQ ID NO: 298146 - RNA, 64 nt, hsa; identical to SEQ ID NO: 115774

SEQ ID NO: 298147 - RNA, 64 nt, hsa; identical to SEQ ID NO: 115775

SEQ ID NO: 298148 - RNA, 64 nt, hsa; identical to SEQ ID NO: 115776

SEQ ID NO: 298149 - RNA, 64 nt, hsa; identical to SEQ ID NO: 115777

SEQ ID NO: 298150 - RNA, 64 nt, hsa
ccacacaggcacugccccaggacaacacaacaaggacagucacaacaaggacaacaaggacaca

SEQ ID NO: 298151 - RNA, 64 nt, hsa
aggacaacaaggacacaacacaacacacaacaaggacagucacaacaagccuagagccagaaag

SEQ ID NO: 298152 - RNA, 64 nt, hsa
gucaggggaaggaaggagccugugucccugggacgacagucaacuggagcuagguguugaccuc

SEQ ID NO: 298153 - RNA, 64 nt, hsa
ucuguuucuaggugcuguuuucaaaaccccagaugacagucauagaaaauuuggaacuuaggaa

SEQ ID NO: 298154 - RNA, 64 nt, hsa
gagugaaacugucucaaaaaagagagacuuccgggacagucauuaucagauaggccccaaaccu

SEQ ID NO: 298155 - RNA, 64 nt, hsa
cggugucacagauugcaggguucugacaaggcaggacagucaagaguggggacacuuucagcuu

SEQ ID NO: 298156 - RNA, 64 nt, hsa
aucgcuggugcugagcccugcccugggccccacggacagucagccugccggccucccugcagcu

SEQ ID NO: 298157 - RNA, 64 nt, hsa
aaguaacaugugcaaaagcuccccguccagcuuugacagucaguuuugaugucagcuccucggc

SEQ ID NO: 298158 - RNA, 64 nt, hsa
cauguagaagcuaaaaguuuagagggagugaggguuuucucaagaccuuccucaagcauuuuau

SEQ ID NO: 298159 - RNA, 64 nt, hsa
cuauauaaaagaaagauaaaacacaggucaccaauuuucucauuucaccccauuuaccuuguau

SEQ ID NO: 298160 - RNA, 64 nt, hsa
ucugaguuucuugaaaugucuuuaaaacagacauuuuucucaccaaacaguuugaguaucuuua

SEQ ID NO: 298161 - RNA, 64 nt, hsa
auccaaacuuuuauaaaauauuaauuauucuuguuuuucucacacaggcauacuccaaaugcuu

SEQ ID NO: 298162 - RNA, 64 nt, hsa
uuuagguguaauaucgaaguccuggcuuuucucguuuucucacuugcucucuuguucucuguuu

SEQ ID NO: 298163 - RNA, 64 nt, hsa
acccuuucuguauugagugcaguguuuuuuacucuuuucucaugcacauguuacguuggagaaa

SEQ ID NO: 298164 - RNA, 64 nt, hsa
aauauaguuauaaucaggcuacauucacauuuucuuuucucaucuuaaaacccuuuauguucaa

SEQ ID NO: 298165 - RNA, 64 nt, hsa
uucccuaauuucccaguccuugucuugaacaaucuuuucucaguacaacagccauagugauucu

SEQ ID NO: 298166 - RNA, 64 nt, hsa
ggggugauauuuuuauagaagugggcaaaaauuauuuucucaauuuuacugaguaggcacagaa

SEQ ID NO: 298167 - RNA, 64 nt, hsa
cuguuaacaugggagucacacaagccgccugacuuuuucucauugccauuaguaaugacugaug

SEQ ID NO: 298168 - RNA, 64 nt, hsa
uuggcuagguggaugacuaguuuuauucaaagccuuuucucaaagcccuuucaguuacaaccac

SEQ ID NO: 298169 - RNA, 64 nt, hsa
gaaacugacgcuuggcuccuuucuuguggauggauuuucucaaaguacacagauaaagcauggu

SEQ ID NO: 298170 - RNA, 64 nt, hsa
aaaaugugucaugccaguaagagauguuauauucuuuucucauuucuuccccacccaaaaauaa

SEQ ID NO: 298171 - RNA, 64 nt, hsa
gaagauuauaccccccaauuguuuuucaauccccuuuucucaaauaauaaauuaguuaaaucag

SEQ ID NO: 298172 - RNA, 64 nt, hsa
uaagauauguauaaugcuggccauuuuaaagggguuuucucaaaaguuaaacuuuugcuaugac

SEQ ID NO: 298173 - RNA, 64 nt, hsa
uuuccaguguuuucugcauguucucauuuguucuuuuucucaguugaaugcaccaacugguuug

SEQ ID NO: 298174 - RNA, 64 nt, hsa
gcuggacuuuaaaaaaacaauucaggaccaaauuuuuucucaguguguguguuuauuccuuaua

SEQ ID NO: 298175 - RNA, 64 nt, hsa
aaaaaaagacaagagagaugaaaacguuugauuauuuucucaguguauuuuuguaaaaaauaua

SEQ ID NO: 298176 - RNA, 64 nt, hsa
auggaaagauccuggccugugguagugguagcaguuuucucaaauaauguggugacagucacua

SEQ ID NO: 298177 - RNA, 64 nt, hsa
guuuuuuguuguuguuuuuuguuuuuguuuuuguuuuucucagucuuaccugugauguuguuua

SEQ ID NO: 298178 - RNA, 64 nt, hsa
augaucauuucuuccugcagugauucuuggauuguuuucucauguauuugaaaaaaaaaaaaug

SEQ ID NO: 298179 - RNA, 64 nt, hsa
auauuugcugcauuuuuuucauuguuuauuuuccuuuucucaugguggacauacaauuuuacug

SEQ ID NO: 298180 - RNA, 64 nt, hsa
uuguauaaaaaacaccagugcucuuucguuguauuuuucucauuuuugcuuuuuaaaauuccuu

SEQ ID NO: 298181 - RNA, 64 nt, hsa
cugcauuucuuuugcguauauaauugcuuacagcuuuucucauuugauauauagcauuguacau

SEQ ID NO: 298182 - RNA, 64 nt, hsa
cuggaguuuucuggaauaaauuuucagcaccugcuuuucucagcuuggcccuuccccgggugag

SEQ ID NO: 298183 - RNA, 64 nt, hsa
ucucuaaacagaucugauauugcugcuccugugguuuucucaaaauuaacuuugccgugguuuu

SEQ ID NO: 298184 - RNA, 64 nt, hsa
gagggggaaaugacuucuuuucuccuucugucccuuuucucaaaagcaucuuucccccaaaugu

SEQ ID NO: 298185 - RNA, 64 nt, hsa
cccuggguggacagaauuuaauuucucgagcuguuuuucucauccaggguaaguuuccccugag

SEQ ID NO: 298186 - RNA, 64 nt, hsa
ggauuacaggugugagccaccacguccggccaauuuuucucauuucuaugccuccuauauuaag

SEQ ID NO: 298187 - RNA, 64 nt, hsa
uaacuuagguuuaauuuuuuuucagguuuaaaauuuuucucauuuauuuuuucugagacggagu

SEQ ID NO: 298188 - RNA, 64 nt, hsa
ccaaggugauuccugcgacugcaggcacuggucauuuucucauguagcugucuuuucaguuaug

SEQ ID NO: 298189 - RNA, 64 nt, hsa
acagacagguuugccaguuugcagaaacuaacucuuuucucacaucaacauuuguaaaauugau

SEQ ID NO: 298190 - RNA, 64 nt, hsa
ugccauuugggugaggauuugauuccacuguuuauuuucucauuguaucaaguugaauuucugc

SEQ ID NO: 298191 - RNA, 64 nt, hsa
ccuuaggugcugaguuucauuaaguacugucacguuuucucaugcaaaacucucuggugauuuu

SEQ ID NO: 298192 - RNA, 64 nt, hsa
aggccaggaccagcucaugcguucucauucuuccuuuucucacucuuucucucaucacucaccu

SEQ ID NO: 298193 - RNA, 64 nt, hsa
auguaugccuuuuuauuuucauucaauuuuuuuuuuuucucagacagacauaguaguaucaacu

SEQ ID NO: 298194 - RNA, 64 nt, hsa
cugccuuguacuuuucauuuuggcucaccguggauuuucucauaggaaguuuggucagagugaa

SEQ ID NO: 298195 - RNA, 64 nt, hsa
ggagaagcugauccaguuuccggaaacaaaauccuuuucucauuuggggagggggguaauagug

SEQ ID NO: 298196 - RNA, 64 nt, hsa
cauuauaaaaauugacaaugauuuauuaaauauguuuucucaauuguaacgacuucuccaucuc

SEQ ID NO: 298197 - RNA, 64 nt, hsa
uguggaugcuucaugugcugccugcaagcuucuuuuuucucauuaaauauaaaauauuuuguaa

SEQ ID NO: 298198 - RNA, 64 nt, hsa
caaaugccucuuuuguacauguucauguuuaguguuuucucagaaucagcaacucaagguacua

SEQ ID NO: 298199 - RNA, 64 nt, hsa
ucucagaaucagcaacucaagguacuaugaggauuuuucucacugacauaauuugauuacauac

SEQ ID NO: 298200 - RNA, 64 nt, hsa
uuuuuuuaacuuaaaauucaagagacugaaucacuuuucucauugauuaaauguaaagauuauu

SEQ ID NO: 298201 - RNA, 64 nt, hsa
ugagaaaccuauaguaaaugaaauuugugagauguuuucucaaauauaugcugugccuguacuu

SEQ ID NO: 298202 - RNA, 64 nt, hsa
augugauaaugaguaaacuaaaacuauuuucagcuuuucucaauuaacauuuugguaguauacu

SEQ ID NO: 298203 - RNA, 64 nt, hsa
gaaaaaucuggauuaaaaaauuaccucuucaguguuuucucaugcaaaauuuucuucuagcaug

SEQ ID NO: 298204 - RNA, 64 nt, hsa
auuauaaguuaucaucaucuuauucuucaaauuuuuuucucacaauuucucuaaucuuuacuca

SEQ ID NO: 298205 - RNA, 64 nt, hsa
acagucugaaaauugauagcauuuagcauuucuuuuuucucaaaaagaaacuguaggaaauaca

SEQ ID NO: 298206 - RNA, 64 nt, hsa
auuuucuaaaaugggucacuuugaaaagaauucuuuuucucacuauuaaugcuuuagaagcaag

SEQ ID NO: 298207 - RNA, 64 nt, hsa
gcuuccauuuagcaaauguuugaaaacucuagauuuuucucauaucaggugauauaaugauggu

SEQ ID NO: 298208 - RNA, 64 nt, hsa
uugggaggccugagguagaggggagugguauguguuuucucaguggaagcagcacaugaguggg

SEQ ID NO: 298209 - RNA, 64 nt, hsa
aauaugggaagggucuccuauuuauucaauagaguuuucucaguuauuuuccucccuugcccuu

SEQ ID NO: 298210 - RNA, 64 nt, hsa
caguaucuaagucacauacaugaugucuugggcauuuucucagccauggagaacucugaaagga

SEQ ID NO: 298211 - RNA, 64 nt, hsa
agccauggagaacucugaaaggaagaaucgcugcuuuucucaagcaaaucgguuucuugauguc

SEQ ID NO: 298212 - RNA, 64 nt, hsa
aauuuugugaccaugaauuucuuucuuuuauaaauuuucucauuuaaaaaucaaaaaucuugca

SEQ ID NO: 298213 - RNA, 64 nt, hsa
auaaaucuucuuacuuaaauuuugaauauuuaguuuuucucaguuacccauuugugugugugug

SEQ ID NO: 298214 - RNA, 64 nt, hsa
agccuagaaaaugaucccuaucugcagaucaagauuuucucauuagaacaaugaauuauccagc

SEQ ID NO: 298215 - RNA, 64 nt, hsa
cagaaggcuaggaauuuuagcaguccugguuucuuuuucucauggaagaaaugaacaucugcca

SEQ ID NO: 298216 - RNA, 64 nt, hsa
uuaaauaauucgagguuacaucguagguuuugauuuuucucaauuuaagauacagaaauacagc

SEQ ID NO: 298217 - RNA, 64 nt, hsa
aauuuagaaaaauuauacuaaagugagaugcauuuuuucucauuuucagcaagacuccucuaag

SEQ ID NO: 298218 - RNA, 64 nt, hsa
ucuguagacauguguucauauuaaugaacacauuuuuucucaacauuguagcagaaaucauuuu

SEQ ID NO: 298219 - RNA, 64 nt, hsa
uuucaaacagaaagagggaauaagauccugugauuuuucucaccugcuuuuccacgcacugugg

SEQ ID NO: 298220 - RNA, 64 nt, hsa
gcaguucccuuaggggagcugaaauaaauucacauuuucucaaagucucauagcuuuggaggag

SEQ ID NO: 298221 - RNA, 64 nt, hsa
ucaguuaucuaaacuagauuagauccaagccaaguuuucucaacagagagcaaagggccaggca

SEQ ID NO: 298222 - RNA, 64 nt, hsa
cucuaaucagcauuucaauguauuuauuuuuaaauuuucucaaaaaguaacuaaaaaauugugu

SEQ ID NO: 298223 - RNA, 64 nt, hsa
gaaauuggaaugugauuuaaggaagaaaacagacuuuucucaaauggaccacaucaucucucac

SEQ ID NO: 298224 - RNA, 64 nt, hsa
gauuucauuaacuuuuaaauauuacauauauguguuuucucagauuagugaaaauugugaccuu

SEQ ID NO: 298225 - RNA, 64 nt, hsa
auagaugauaugauuuauuaccuuucaauuauauuuuucucaguuauacuagaaaauuucauaa

SEQ ID NO: 298226 - RNA, 64 nt, hsa
uggacuuggaccagggacaccaucagggccuugguuuucucacgcauaaaauggagaguggauu

SEQ ID NO: 298227 - RNA, 64 nt, hsa
ggaaaagaguccccgagcccggaucuugugcugcuuuucucacugacguguugccuuuuuucuu

SEQ ID NO: 298228 - RNA, 64 nt, hsa
ucaguacuaccacagaacuauaauauacauugccuuuucucagcagcauuugaauucaacuuau

SEQ ID NO: 298229 - RNA, 64 nt, hsa
aucauaugguguuggagacuauuagcuauuagauuuuucucaaaauaugaguuuuguacaaugg

SEQ ID NO: 298230 - RNA, 56 nt, hsa
gucggucaguaucuucuuaaagacaauuuucucaccucuguaaauuuuagucucaa

SEQ ID NO: 298231 - RNA, 64 nt, hsa
guguucucugccugucuuugucacaaaauuucauuuuucucauaguuaauuucaucucuccggu

SEQ ID NO: 298232 - RNA, 64 nt, hsa
agcagcaaacauucuuccuaaaaggaagacuucauuuucucaagaaaugggauuaguugggggu

SEQ ID NO: 298233 - RNA, 64 nt, hsa
aaguuuuuagucaacuuuugggacuuggggugcauuuucucacagaaagaauaguaguuagguu

SEQ ID NO: 298234 - RNA, 64 nt, hsa
uucuuucuuggccauuuaaaaaaacaaauuuuuuuuuucucacuuguaagucaccgccaguacc

SEQ ID NO: 298235 - RNA, 64 nt, hsa
aaucuaaagauguuagacagaugcugagugugcguuuucucaaccgcuucaacauuguaagcga

SEQ ID NO: 298236 - RNA, 64 nt, hsa
auucucuuauuuuuugcuuccucugaggacaucuuuuucucaccuucauucucagugauguuuu

SEQ ID NO: 298237 - RNA, 64 nt, hsa
cuaggcacuuuaucaccauuuagauccuauuaccuuuucucaucuaggauauaguuaucuucua

SEQ ID NO: 298238 - RNA, 64 nt, hsa
acagguauguuuuuguuucagaaauauguauugcuuuucucauauuuuuugcaaauuguauugu

SEQ ID NO: 298239 - RNA, 63 nt, hsa
ccuguucuuaauguaacaguaaaaguuuucacauuuuucucagaacuguuaucuggaagcucu

SEQ ID NO: 298240 - RNA, 64 nt, hsa
gaacuagguuugggguagaaaugaauugacauuauuuucucauuugcuuuguaugguaugaagg

SEQ ID NO: 298241 - RNA, 64 nt, hsa
aaggggagauaggugagaugauaugaaaaacaaauuuucucacugucauaaaaggcucuaauua

SEQ ID NO: 298242 - RNA, 64 nt, hsa
auaagcuccuaaauuauagagccucaauuuugguuuuucucauuugaaauguuuuugauuuauc

SEQ ID NO: 298243 - RNA, 64 nt, hsa
agguuguccuauuggcauaaaacaaaccagcaacuuuucucauguguuuggaguuaaaaugugu

SEQ ID NO: 298244 - RNA, 64 nt, hsa
acuauggcgacaaaggggaaaaggccaccacucguuuucucacugauucaugccaauuaagccu

SEQ ID NO: 298245 - RNA, 64 nt, hsa
uaagaagaaaggaagaaagccccagacgcuugguuuuucucagaacccccaaaagaugugcaau

SEQ ID NO: 298246 - RNA, 64 nt, hsa
ugauuuuaucacucuauuauuuguuuguauguuuuuuucucauuucguuuguggguuuuuuuuu

SEQ ID NO: 298247 - RNA, 64 nt, hsa
uauguggccacugguuuaagaagugcugacuuuguuuucucauucaguuuugggaggaaaaggg

SEQ ID NO: 298248 - RNA, 64 nt, hsa
uagauuuuaucuuaucuuuugguguugucuugguuuuucucauagacuuuauaaguuugaacug

SEQ ID NO: 298249 - RNA, 64 nt, hsa
acagaccuccaagacuuucuucuccaccucuucuuuuucucaugcccugccuucaucugucucc

SEQ ID NO: 298250 - RNA, 64 nt, hsa; identical to SEQ ID NO: 104452

SEQ ID NO: 298251 - RNA, 64 nt, hsa; identical to SEQ ID NO: 104453

SEQ ID NO: 298252 - RNA, 64 nt, hsa; identical to SEQ ID NO: 104454

SEQ ID NO: 298253 - RNA, 64 nt, hsa; identical to SEQ ID NO: 104455

SEQ ID NO: 298254 - RNA, 64 nt, hsa; identical to SEQ ID NO: 104456

SEQ ID NO: 298255 - RNA, 64 nt, hsa; identical to SEQ ID NO: 104457

SEQ ID NO: 298256 - RNA, 64 nt, hsa; identical to SEQ ID NO: 104458

SEQ ID NO: 298257 - RNA, 64 nt, hsa; identical to SEQ ID NO: 104459

SEQ ID NO: 298258 - RNA, 64 nt, hsa; identical to SEQ ID NO: 104460

SEQ ID NO: 298259 - RNA, 64 nt, hsa; identical to SEQ ID NO: 104461

SEQ ID NO: 298260 - RNA, 64 nt, hsa; identical to SEQ ID NO: 104462

SEQ ID NO: 298261 - RNA, 64 nt, hsa; identical to SEQ ID NO: 104463

SEQ ID NO: 298262 - RNA, 64 nt, hsa; identical to SEQ ID NO: 104464

SEQ ID NO: 298263 - RNA, 64 nt, hsa; identical to SEQ ID NO: 104465

SEQ ID NO: 298264 - RNA, 64 nt, hsa; identical to SEQ ID NO: 104466

SEQ ID NO: 298265 - RNA, 64 nt, hsa; identical to SEQ ID NO: 104467

SEQ ID NO: 298266 - RNA, 64 nt, hsa; identical to SEQ ID NO: 104468

SEQ ID NO: 298267 - RNA, 64 nt, hsa; identical to SEQ ID NO: 104469

SEQ ID NO: 298268 - RNA, 64 nt, hsa; identical to SEQ ID NO: 104470

SEQ ID NO: 298269 - RNA, 64 nt, hsa; identical to SEQ ID NO: 104471

SEQ ID NO: 298270 - RNA, 64 nt, hsa; identical to SEQ ID NO: 104472

SEQ ID NO: 298271 - RNA, 64 nt, hsa; identical to SEQ ID NO: 104473

SEQ ID NO: 298272 - RNA, 64 nt, hsa; identical to SEQ ID NO: 104474

SEQ ID NO: 298273 - RNA, 64 nt, hsa; identical to SEQ ID NO: 104475

SEQ ID NO: 298274 - RNA, 64 nt, hsa; identical to SEQ ID NO: 104476

SEQ ID NO: 298275 - RNA, 64 nt, hsa; identical to SEQ ID NO: 104477

SEQ ID NO: 298276 - RNA, 64 nt, hsa; identical to SEQ ID NO: 104478

SEQ ID NO: 298277 - RNA, 64 nt, hsa; identical to SEQ ID NO: 104479

SEQ ID NO: 298278 - RNA, 64 nt, hsa; identical to SEQ ID NO: 104480

SEQ ID NO: 298279 - RNA, 64 nt, hsa; identical to SEQ ID NO: 39289

SEQ ID NO: 298280 - RNA, 64 nt, hsa; identical to SEQ ID NO: 39290

SEQ ID NO: 298281 - RNA, 64 nt, hsa; identical to SEQ ID NO: 39291

SEQ ID NO: 298282 - RNA, 64 nt, hsa; identical to SEQ ID NO: 39292

SEQ ID NO: 298283 - RNA, 64 nt, hsa; identical to SEQ ID NO: 39293

SEQ ID NO: 298284 - RNA, 64 nt, hsa; identical to SEQ ID NO: 39294

SEQ ID NO: 298285 - RNA, 64 nt, hsa; identical to SEQ ID NO: 39295

SEQ ID NO: 298286 - RNA, 64 nt, hsa; identical to SEQ ID NO: 39296

SEQ ID NO: 298287 - RNA, 64 nt, hsa; identical to SEQ ID NO: 39297

SEQ ID NO: 298288 - RNA, 64 nt, hsa; identical to SEQ ID NO: 39298

SEQ ID NO: 298289 - RNA, 64 nt, hsa; identical to SEQ ID NO: 39299

SEQ ID NO: 298290 - RNA, 64 nt, hsa; identical to SEQ ID NO: 39300

SEQ ID NO: 298291 - RNA, 64 nt, hsa; identical to SEQ ID NO: 39301

SEQ ID NO: 298292 - RNA, 64 nt, hsa; identical to SEQ ID NO: 39302

SEQ ID NO: 298293 - RNA, 64 nt, hsa; identical to SEQ ID NO: 39303

SEQ ID NO: 298294 - RNA, 64 nt, hsa; identical to SEQ ID NO: 39304

SEQ ID NO: 298295 - RNA, 64 nt, hsa; identical to SEQ ID NO: 39305

SEQ ID NO: 298296 - RNA, 64 nt, hsa; identical to SEQ ID NO: 39306

SEQ ID NO: 298297 - RNA, 64 nt, hsa; identical to SEQ ID NO: 39307

SEQ ID NO: 298298 - RNA, 64 nt, hsa; identical to SEQ ID NO: 39308

SEQ ID NO: 298299 - RNA, 64 nt, hsa; identical to SEQ ID NO: 39309

SEQ ID NO: 298300 - RNA, 64 nt, hsa; identical to SEQ ID NO: 39310

SEQ ID NO: 298301 - RNA, 64 nt, hsa; identical to SEQ ID NO: 39311

SEQ ID NO: 298302 - RNA, 64 nt, hsa; identical to SEQ ID NO: 39312

SEQ ID NO: 298303 - RNA, 64 nt, hsa; identical to SEQ ID NO: 39313

SEQ ID NO: 298304 - RNA, 64 nt, hsa; identical to SEQ ID NO: 39314

SEQ ID NO: 298305 - RNA, 64 nt, hsa; identical to SEQ ID NO: 39315

SEQ ID NO: 298306 - RNA, 64 nt, hsa; identical to SEQ ID NO: 39316

SEQ ID NO: 298307 - RNA, 64 nt, hsa; identical to SEQ ID NO: 39317

SEQ ID NO: 298308 - RNA, 64 nt, hsa; identical to SEQ ID NO: 39318

SEQ ID NO: 298309 - RNA, 64 nt, hsa; identical to SEQ ID NO: 39319

SEQ ID NO: 298310 - RNA, 64 nt, hsa; identical to SEQ ID NO: 39320

SEQ ID NO: 298311 - RNA, 64 nt, hsa; identical to SEQ ID NO: 39321

SEQ ID NO: 298312 - RNA, 64 nt, hsa; identical to SEQ ID NO: 39322

SEQ ID NO: 298313 - RNA, 64 nt, hsa; identical to SEQ ID NO: 39323

SEQ ID NO: 298314 - RNA, 64 nt, hsa; identical to SEQ ID NO: 39324

SEQ ID NO: 298315 - RNA, 64 nt, hsa; identical to SEQ ID NO: 39325

SEQ ID NO: 298316 - RNA, 64 nt, hsa; identical to SEQ ID NO: 39326

SEQ ID NO: 298317 - RNA, 64 nt, hsa; identical to SEQ ID NO: 39327

SEQ ID NO: 298318 - RNA, 64 nt, hsa; identical to SEQ ID NO: 39328

SEQ ID NO: 298319 - RNA, 64 nt, hsa; identical to SEQ ID NO: 39329

SEQ ID NO: 298320 - RNA, 64 nt, hsa; identical to SEQ ID NO: 39330

SEQ ID NO: 298321 - RNA, 64 nt, hsa; identical to SEQ ID NO: 39331

SEQ ID NO: 298322 - RNA, 64 nt, hsa; identical to SEQ ID NO: 39332

SEQ ID NO: 298323 - RNA, 61 nt, hsa; identical to SEQ ID NO: 39333

SEQ ID NO: 298324 - RNA, 64 nt, hsa; identical to SEQ ID NO: 39334

SEQ ID NO: 298325 - RNA, 64 nt, hsa; identical to SEQ ID NO: 39335

SEQ ID NO: 298326 - RNA, 64 nt, hsa; identical to SEQ ID NO: 39336

SEQ ID NO: 298327 - RNA, 64 nt, hsa; identical to SEQ ID NO: 39337

SEQ ID NO: 298328 - RNA, 64 nt, hsa; identical to SEQ ID NO: 39338

SEQ ID NO: 298329 - RNA, 64 nt, hsa; identical to SEQ ID NO: 39339

SEQ ID NO: 298330 - RNA, 64 nt, hsa; identical to SEQ ID NO: 39340

SEQ ID NO: 298331 - RNA, 64 nt, hsa; identical to SEQ ID NO: 39341

SEQ ID NO: 298332 - RNA, 64 nt, hsa; identical to SEQ ID NO: 39342

SEQ ID NO: 298333 - RNA, 64 nt, hsa; identical to SEQ ID NO: 39343

SEQ ID NO: 298334 - RNA, 64 nt, hsa; identical to SEQ ID NO: 39344

SEQ ID NO: 298335 - RNA, 64 nt, hsa; identical to SEQ ID NO: 39345

SEQ ID NO: 298336 - RNA, 64 nt, hsa; identical to SEQ ID NO: 39346

SEQ ID NO: 298337 - RNA, 64 nt, hsa; identical to SEQ ID NO: 144314

SEQ ID NO: 298338 - RNA, 64 nt, hsa; identical to SEQ ID NO: 144315

SEQ ID NO: 298339 - RNA, 64 nt, hsa; identical to SEQ ID NO: 144316

SEQ ID NO: 298340 - RNA, 64 nt, hsa; identical to SEQ ID NO: 144317

SEQ ID NO: 298341 - RNA, 64 nt, hsa; identical to SEQ ID NO: 144318

SEQ ID NO: 298342 - RNA, 64 nt, hsa; identical to SEQ ID NO: 144319

SEQ ID NO: 298343 - RNA, 64 nt, hsa; identical to SEQ ID NO: 144320

SEQ ID NO: 298344 - RNA, 64 nt, hsa; identical to SEQ ID NO: 144321

SEQ ID NO: 298345 - RNA, 64 nt, hsa
uacuccccauggcagcauggaggaggcaagaccugugggucaauuuugaacuggccuuacuuug

SEQ ID NO: 298346 - RNA, 64 nt, hsa
aaauuuugacagcucuuuaagcccacaugcagcagugggucagauaacccuguggcagugacac

SEQ ID NO: 298347 - RNA, 64 nt, hsa
guuccccauguccuugccgugggucauccuugcugugggucauccuugcuguggagauccauuc

SEQ ID NO: 298348 - RNA, 64 nt, hsa
gguggcugugauacagguuccccauguccuugccgugggucauccuugcugugggucauccuug

SEQ ID NO: 298349 - RNA, 64 nt, hsa
aggaauacuuugcuaugccucacugcccaauagggugggucaucaauuaggagaaaucccaaau

SEQ ID NO: 298350 - RNA, 64 nt, hsa
ccaaaagaccucuuacuuugggaggccaaggugggugggucacuugaacccaggaguuugacau

SEQ ID NO: 298351 - RNA, 64 nt, hsa
auuuauccggugggugggacaggaguguguucaagugggucauguuuuugcuguggugacacau

SEQ ID NO: 298352 - RNA, 64 nt, hsa
ggugugacaugaggaccguuccuaggaugggacagugggucaggcaggacaaggagaaagcagg

SEQ ID NO: 298353 - RNA, 64 nt, hsa; identical to SEQ ID NO: 218440

SEQ ID NO: 298354 - RNA, 64 nt, hsa; identical to SEQ ID NO: 218441

SEQ ID NO: 298355 - RNA, 57 nt, hsa; identical to SEQ ID NO: 54899

SEQ ID NO: 298356 - RNA, 64 nt, hsa; identical to SEQ ID NO: 218443

SEQ ID NO: 298357 - RNA, 64 nt, hsa; identical to SEQ ID NO: 218444

SEQ ID NO: 298358 - RNA, 64 nt, hsa; identical to SEQ ID NO: 218445

SEQ ID NO: 298359 - RNA, 64 nt, hsa; identical to SEQ ID NO: 218446

SEQ ID NO: 298360 - RNA, 64 nt, hsa; identical to SEQ ID NO: 218447

SEQ ID NO: 298361 - RNA, 64 nt, hsa; identical to SEQ ID NO: 218448

SEQ ID NO: 298362 - RNA, 64 nt, hsa; identical to SEQ ID NO: 218449

SEQ ID NO: 298363 - RNA, 64 nt, hsa; identical to SEQ ID NO: 218450

SEQ ID NO: 298364 - RNA, 64 nt, hsa; identical to SEQ ID NO: 218451

SEQ ID NO: 298365 - RNA, 64 nt, hsa; identical to SEQ ID NO: 218452

SEQ ID NO: 298366 - RNA, 64 nt, hsa; identical to SEQ ID NO: 218453

SEQ ID NO: 298367 - RNA, 64 nt, hsa; identical to SEQ ID NO: 218454

SEQ ID NO: 298368 - RNA, 64 nt, hsa; identical to SEQ ID NO: 218455

SEQ ID NO: 298369 - RNA, 64 nt, hsa; identical to SEQ ID NO: 218456

SEQ ID NO: 298370 - RNA, 64 nt, hsa; identical to SEQ ID NO: 218457

SEQ ID NO: 298371 - RNA, 64 nt, hsa; identical to SEQ ID NO: 218458

SEQ ID NO: 298372 - RNA, 64 nt, hsa; identical to SEQ ID NO: 218459

SEQ ID NO: 298373 - RNA, 64 nt, hsa; identical to SEQ ID NO: 218460

SEQ ID NO: 298374 - RNA, 64 nt, hsa; identical to SEQ ID NO: 218461

SEQ ID NO: 298375 - RNA, 64 nt, hsa; identical to SEQ ID NO: 218462

SEQ ID NO: 298376 - RNA, 64 nt, hsa; identical to SEQ ID NO: 218463

SEQ ID NO: 298377 - RNA, 64 nt, hsa; identical to SEQ ID NO: 218464

SEQ ID NO: 298378 - RNA, 64 nt, hsa; identical to SEQ ID NO: 218465

SEQ ID NO: 298379 - RNA, 64 nt, hsa; identical to SEQ ID NO: 218466

SEQ ID NO: 298380 - RNA, 64 nt, hsa; identical to SEQ ID NO: 218467

SEQ ID NO: 298381 - RNA, 64 nt, hsa; identical to SEQ ID NO: 218468

SEQ ID NO: 298382 - RNA, 64 nt, hsa; identical to SEQ ID NO: 218469

SEQ ID NO: 298383 - RNA, 64 nt, hsa; identical to SEQ ID NO: 218470

SEQ ID NO: 298384 - RNA, 64 nt, hsa; identical to SEQ ID NO: 218471

SEQ ID NO: 298385 - RNA, 64 nt, hsa; identical to SEQ ID NO: 218472

SEQ ID NO: 298386 - RNA, 64 nt, hsa; identical to SEQ ID NO: 218473

SEQ ID NO: 298387 - RNA, 64 nt, hsa; identical to SEQ ID NO: 218474

SEQ ID NO: 298388 - RNA, 64 nt, hsa; identical to SEQ ID NO: 218475

SEQ ID NO: 298389 - RNA, 64 nt, hsa; identical to SEQ ID NO: 218476

SEQ ID NO: 298390 - RNA, 64 nt, hsa; identical to SEQ ID NO: 218477

SEQ ID NO: 298391 - RNA, 64 nt, hsa; identical to SEQ ID NO: 218478

SEQ ID NO: 298392 - RNA, 64 nt, hsa; identical to SEQ ID NO: 218479

SEQ ID NO: 298393 - RNA, 64 nt, hsa; identical to SEQ ID NO: 218480

SEQ ID NO: 298394 - RNA, 64 nt, hsa; identical to SEQ ID NO: 218481

SEQ ID NO: 298395 - RNA, 64 nt, hsa; identical to SEQ ID NO: 218482

SEQ ID NO: 298396 - RNA, 64 nt, hsa; identical to SEQ ID NO: 218483

SEQ ID NO: 298397 - RNA, 64 nt, hsa; identical to SEQ ID NO: 218484

SEQ ID NO: 298398 - RNA, 64 nt, hsa; identical to SEQ ID NO: 218485

SEQ ID NO: 298399 - RNA, 64 nt, hsa; identical to SEQ ID NO: 218486

SEQ ID NO: 298400 - RNA, 64 nt, hsa; identical to SEQ ID NO: 218487

SEQ ID NO: 298401 - RNA, 64 nt, hsa; identical to SEQ ID NO: 218488

SEQ ID NO: 298402 - RNA, 64 nt, hsa; identical to SEQ ID NO: 218489

SEQ ID NO: 298403 - RNA, 64 nt, hsa; identical to SEQ ID NO: 218490

SEQ ID NO: 298404 - RNA, 64 nt, hsa; identical to SEQ ID NO: 218491

SEQ ID NO: 298405 - RNA, 64 nt, hsa; identical to SEQ ID NO: 150627

SEQ ID NO: 298406 - RNA, 64 nt, hsa; identical to SEQ ID NO: 150628

SEQ ID NO: 298407 - RNA, 64 nt, hsa; identical to SEQ ID NO: 150629

SEQ ID NO: 298408 - RNA, 64 nt, hsa; identical to SEQ ID NO: 150630

SEQ ID NO: 298409 - RNA, 64 nt, hsa; identical to SEQ ID NO: 150631

SEQ ID NO: 298410 - RNA, 64 nt, hsa; identical to SEQ ID NO: 150632

SEQ ID NO: 298411 - RNA, 64 nt, hsa; identical to SEQ ID NO: 150633

SEQ ID NO: 298412 - RNA, 64 nt, hsa; identical to SEQ ID NO: 150634

SEQ ID NO: 298413 - RNA, 64 nt, hsa; identical to SEQ ID NO: 150635

SEQ ID NO: 298414 - RNA, 64 nt, hsa; identical to SEQ ID NO: 150636

SEQ ID NO: 298415 - RNA, 64 nt, hsa; identical to SEQ ID NO: 150637

SEQ ID NO: 298416 - RNA, 64 nt, hsa; identical to SEQ ID NO: 150638

SEQ ID NO: 298417 - RNA, 64 nt, hsa; identical to SEQ ID NO: 150639

SEQ ID NO: 298418 - RNA, 64 nt, hsa; identical to SEQ ID NO: 150640

SEQ ID NO: 298419 - RNA, 64 nt, hsa; identical to SEQ ID NO: 150641

SEQ ID NO: 298420 - RNA, 64 nt, hsa; identical to SEQ ID NO: 150642

SEQ ID NO: 298421 - RNA, 64 nt, hsa; identical to SEQ ID NO: 150643

SEQ ID NO: 298422 - RNA, 64 nt, hsa; identical to SEQ ID NO: 150644

SEQ ID NO: 298423 - RNA, 64 nt, hsa; identical to SEQ ID NO: 150645

SEQ ID NO: 298424 - RNA, 64 nt, hsa; identical to SEQ ID NO: 150646

SEQ ID NO: 298425 - RNA, 64 nt, hsa; identical to SEQ ID NO: 150647

SEQ ID NO: 298426 - RNA, 64 nt, hsa; identical to SEQ ID NO: 150648

SEQ ID NO: 298427 - RNA, 64 nt, hsa; identical to SEQ ID NO: 150649

SEQ ID NO: 298428 - RNA, 64 nt, hsa; identical to SEQ ID NO: 150650

SEQ ID NO: 298429 - RNA, 64 nt, hsa; identical to SEQ ID NO: 150651

SEQ ID NO: 298430 - RNA, 64 nt, hsa; identical to SEQ ID NO: 150652

SEQ ID NO: 298431 - RNA, 64 nt, hsa; identical to SEQ ID NO: 150653

SEQ ID NO: 298432 - RNA, 64 nt, hsa; identical to SEQ ID NO: 150654

SEQ ID NO: 298433 - RNA, 64 nt, hsa; identical to SEQ ID NO: 150655

SEQ ID NO: 298434 - RNA, 64 nt, hsa; identical to SEQ ID NO: 150656

SEQ ID NO: 298435 - RNA, 64 nt, hsa; identical to SEQ ID NO: 150657

SEQ ID NO: 298436 - RNA, 64 nt, hsa; identical to SEQ ID NO: 150658

SEQ ID NO: 298437 - RNA, 64 nt, hsa; identical to SEQ ID NO: 150659

SEQ ID NO: 298438 - RNA, 64 nt, hsa; identical to SEQ ID NO: 150660

SEQ ID NO: 298439 - RNA, 64 nt, hsa; identical to SEQ ID NO: 150661

SEQ ID NO: 298440 - RNA, 64 nt, hsa; identical to SEQ ID NO: 150662

SEQ ID NO: 298441 - RNA, 64 nt, hsa; identical to SEQ ID NO: 150663

SEQ ID NO: 298442 - RNA, 64 nt, hsa; identical to SEQ ID NO: 150664

SEQ ID NO: 298443 - RNA, 64 nt, hsa; identical to SEQ ID NO: 150665

SEQ ID NO: 298444 - RNA, 64 nt, hsa; identical to SEQ ID NO: 150666

SEQ ID NO: 298445 - RNA, 64 nt, hsa; identical to SEQ ID NO: 150667

SEQ ID NO: 298446 - RNA, 64 nt, hsa; identical to SEQ ID NO: 150668

SEQ ID NO: 298447 - RNA, 64 nt, hsa; identical to SEQ ID NO: 150669

SEQ ID NO: 298448 - RNA, 64 nt, hsa; identical to SEQ ID NO: 150670

SEQ ID NO: 298449 - RNA, 64 nt, hsa; identical to SEQ ID NO: 150671

SEQ ID NO: 298450 - RNA, 64 nt, hsa; identical to SEQ ID NO: 150672

SEQ ID NO: 298451 - RNA, 64 nt, hsa; identical to SEQ ID NO: 150673

SEQ ID NO: 298452 - RNA, 64 nt, hsa; identical to SEQ ID NO: 150674

SEQ ID NO: 298453 - RNA, 64 nt, hsa; identical to SEQ ID NO: 150675

SEQ ID NO: 298454 - RNA, 64 nt, hsa; identical to SEQ ID NO: 150676

SEQ ID NO: 298455 - RNA, 64 nt, hsa; identical to SEQ ID NO: 150677

SEQ ID NO: 298456 - RNA, 64 nt, hsa; identical to SEQ ID NO: 150678

SEQ ID NO: 298457 - RNA, 64 nt, hsa; identical to SEQ ID NO: 150679

SEQ ID NO: 298458 - RNA, 64 nt, hsa; identical to SEQ ID NO: 150680

SEQ ID NO: 298459 - RNA, 64 nt, hsa; identical to SEQ ID NO: 150681

SEQ ID NO: 298460 - RNA, 64 nt, hsa; identical to SEQ ID NO: 150682

SEQ ID NO: 298461 - RNA, 64 nt, hsa; identical to SEQ ID NO: 150683

SEQ ID NO: 298462 - RNA, 64 nt, hsa; identical to SEQ ID NO: 150684

SEQ ID NO: 298463 - RNA, 64 nt, hsa; identical to SEQ ID NO: 150685

SEQ ID NO: 298464 - RNA, 64 nt, hsa; identical to SEQ ID NO: 150686

SEQ ID NO: 298465 - RNA, 64 nt, hsa; identical to SEQ ID NO: 150687

SEQ ID NO: 298466 - RNA, 64 nt, hsa; identical to SEQ ID NO: 150688

SEQ ID NO: 298467 - RNA, 64 nt, hsa; identical to SEQ ID NO: 150689

SEQ ID NO: 298468 - RNA, 64 nt, hsa; identical to SEQ ID NO: 150690

SEQ ID NO: 298469 - RNA, 64 nt, hsa; identical to SEQ ID NO: 150691

SEQ ID NO: 298470 - RNA, 64 nt, hsa; identical to SEQ ID NO: 150692

SEQ ID NO: 298471 - RNA, 64 nt, hsa; identical to SEQ ID NO: 150693

SEQ ID NO: 298472 - RNA, 64 nt, hsa; identical to SEQ ID NO: 150694

SEQ ID NO: 298473 - RNA, 64 nt, hsa; identical to SEQ ID NO: 150695

SEQ ID NO: 298474 - RNA, 64 nt, hsa
augcaacaguggaauccauguaaaacucucugugcaucuaaauacuucuggagggcgacagauu

SEQ ID NO: 298475 - RNA, 64 nt, hsa
cuuguuccucugucuacuguguguuugggggugacaucuaaauuccauuucuucuucuuguuua

SEQ ID NO: 298476 - RNA, 64 nt, hsa
auaucaaauaaaauuauuugguuaugguuauguucaucuaaacacaacaauaacuuuuauauua

SEQ ID NO: 298477 - RNA, 64 nt, hsa
uucuacaccuccuuuaagauuuacuuaauugcuacaucuaaauucugauaauuuaaaauccauu

SEQ ID NO: 298478 - RNA, 64 nt, hsa
ugaagugagaggaccaaguauaguaaaaugcugacaucuaaaacuaaauaaauagaaaacacca

SEQ ID NO: 298479 - RNA, 64 nt, hsa
uuuuuuauuuauccaguuauaucuacauaucugucaucuaaauaaauggcuuucaaacaaagca

SEQ ID NO: 298480 - RNA, 64 nt, hsa
acacacauuucuuauccccauuuuacaaccaaggcaucuaaagcaacaagaaaugaacuugccc

SEQ ID NO: 298481 - RNA, 64 nt, hsa
auacuuuuagauauauuuaaaauuuuaacauuggcaucuaaaguguuauuugaaaauaaaauua

SEQ ID NO: 298482 - RNA, 64 nt, hsa
gggagacaggugcagaugaggugaagaucacugucaucuaaaagcaggccaccaaauuuaaaaa

SEQ ID NO: 298483 - RNA, 64 nt, hsa
acugagcucaggagagcaagaugaagguaacaaucaucuaaaagccagccacugucagcaaagc

SEQ ID NO: 298484 - RNA, 64 nt, hsa
ugcuauggauuuaccauuccuuauuaucacuaaucaucuaaacaacucacuggaaauccaauua

SEQ ID NO: 298485 - RNA, 64 nt, hsa
uacuugcccuuacagguggaguaucuucgucacacaucuaaaugagaaaucagugacaacaagu

SEQ ID NO: 298486 - RNA, 64 nt, hsa
uggaauuuaucccaggaauucaagguugguucaacaucuaaaaaucaaauaagcuaauauacag

SEQ ID NO: 298487 - RNA, 64 nt, hsa
cagcaguuagguuaggaauucaagguuuguucaacaucuaaaaaucaaauaagcuaauaaagaa

SEQ ID NO: 298488 - RNA, 64 nt, hsa
caauccucccuaacaauucguuguguggacuucucaucuaaaagguuaguggcuuuugcuuggg

SEQ ID NO: 298489 - RNA, 64 nt, hsa
cuucuugcauguugaagauauuugagcuauuuuucaucuaaaagaguaagguauuaggcccuuu

SEQ ID NO: 298490 - RNA, 64 nt, hsa; identical to SEQ ID NO: 21144

SEQ ID NO: 298491 - RNA, 64 nt, hsa; identical to SEQ ID NO: 21145

SEQ ID NO: 298492 - RNA, 64 nt, hsa; identical to SEQ ID NO: 21146

SEQ ID NO: 298493 - RNA, 64 nt, hsa; identical to SEQ ID NO: 21147

SEQ ID NO: 298494 - RNA, 64 nt, hsa; identical to SEQ ID NO: 21148

SEQ ID NO: 298495 - RNA, 64 nt, hsa; identical to SEQ ID NO: 21149

SEQ ID NO: 298496 - RNA, 64 nt, hsa; identical to SEQ ID NO: 183939

SEQ ID NO: 298497 - RNA, 64 nt, hsa; identical to SEQ ID NO: 183940

SEQ ID NO: 298498 - RNA, 64 nt, hsa; identical to SEQ ID NO: 183941

SEQ ID NO: 298499 - RNA, 64 nt, hsa; identical to SEQ ID NO: 183942

SEQ ID NO: 298500 - RNA, 64 nt, hsa; identical to SEQ ID NO: 183943

SEQ ID NO: 298501 - RNA, 64 nt, hsa; identical to SEQ ID NO: 183944

SEQ ID NO: 298502 - RNA, 64 nt, hsa; identical to SEQ ID NO: 183945

SEQ ID NO: 298503 - RNA, 64 nt, hsa; identical to SEQ ID NO: 183946

SEQ ID NO: 298504 - RNA, 64 nt, hsa; identical to SEQ ID NO: 183947

SEQ ID NO: 298505 - RNA, 64 nt, hsa; identical to SEQ ID NO: 183948

SEQ ID NO: 298506 - RNA, 64 nt, hsa; identical to SEQ ID NO: 183949

SEQ ID NO: 298507 - RNA, 64 nt, hsa; identical to SEQ ID NO: 183950

SEQ ID NO: 298508 - RNA, 64 nt, hsa; identical to SEQ ID NO: 183951

SEQ ID NO: 298509 - RNA, 64 nt, hsa; identical to SEQ ID NO: 183952

SEQ ID NO: 298510 - RNA, 64 nt, hsa; identical to SEQ ID NO: 183953

SEQ ID NO: 298511 - RNA, 64 nt, hsa; identical to SEQ ID NO: 183954

SEQ ID NO: 298512 - RNA, 64 nt, hsa; identical to SEQ ID NO: 183955

SEQ ID NO: 298513 - RNA, 64 nt, hsa; identical to SEQ ID NO: 183956

SEQ ID NO: 298514 - RNA, 64 nt, hsa; identical to SEQ ID NO: 183957

SEQ ID NO: 298515 - RNA, 64 nt, hsa; identical to SEQ ID NO: 183958

SEQ ID NO: 298516 - RNA, 64 nt, hsa; identical to SEQ ID NO: 183959

SEQ ID NO: 298517 - RNA, 64 nt, hsa; identical to SEQ ID NO: 183960

SEQ ID NO: 298518 - RNA, 64 nt, hsa; identical to SEQ ID NO: 183961

SEQ ID NO: 298519 - RNA, 64 nt, hsa; identical to SEQ ID NO: 183962

SEQ ID NO: 298520 - RNA, 64 nt, hsa; identical to SEQ ID NO: 183963

SEQ ID NO: 298521 - RNA, 64 nt, hsa; identical to SEQ ID NO: 183964

SEQ ID NO: 298522 - RNA, 64 nt, hsa; identical to SEQ ID NO: 183965

SEQ ID NO: 298523 - RNA, 64 nt, hsa; identical to SEQ ID NO: 183966

SEQ ID NO: 298524 - RNA, 60 nt, hsa
ugaagagaugccuugcgguguggccagcugugaggagaaagcagcuggcaguguuaggac

SEQ ID NO: 298525 - RNA, 60 nt, hsa
cauuuaaacaccuuuuguguuuuacuucagugaggagauuggagucugaauggaucuguu

SEQ ID NO: 298526 - RNA, 60 nt, hsa
ugugucggacaagcaacuucuuuuccucugugaggagacaagacuuggagacucagcgau

SEQ ID NO: 298527 - RNA, 60 nt, hsa
uuuguagguauuuuuuuauaaccccagugcugaggagaaaggaggggcaguggcuucccc

SEQ ID NO: 298528 - RNA, 60 nt, hsa
ggaagaagaagaggaaguaguugaaaaugaugaggagauagccuuuucaggcaaggacaa

SEQ ID NO: 298529 - RNA, 60 nt, hsa
aggcaaggacaagccagcuucagagaauagugaggagaagcugaucaguaaguuugacaa

SEQ ID NO: 298530 - RNA, 60 nt, hsa
uaguuuuuaaaaauguuuuuaguuaaacguugaggagaaaaaaaaaaaaggcuuuucccc

SEQ ID NO: 298531 - RNA, 60 nt, hsa
uguguuggggggaugcuuggcagcugggggugaggagacaacaaaccucgggaacuggag

SEQ ID NO: 298532 - RNA, 60 nt, hsa
agauagggggcugugguccuuccuuucuccugaggagaaaguccuugcucuggugaccug

SEQ ID NO: 298533 - RNA, 60 nt, hsa
ucugacaugauuuacuuuuaaggaaaguuaugaggagagaauacaaaaagcaugcaccaa

SEQ ID NO: 298534 - RNA, 60 nt, hsa
augaugucacccuggccauguguacugacuugaggagaucuugcaacauggccaugugca

SEQ ID NO: 298535 - RNA, 60 nt, hsa
gccaacuaaacuacucuuuaggcagccuucugaggagaaaagcaacccuguuucaaaucc

SEQ ID NO: 298536 - RNA, 60 nt, hsa
caugugaaagcgucucuuugucuggagcuuugaggagauguuuuccuucacuuuaguuuc

SEQ ID NO: 298537 - RNA, 60 nt, hsa
ccgcaagaagccaggcccggcccuggccuuugaggagaagugcucuacacugaagguacc

SEQ ID NO: 298538 - RNA, 60 nt, hsa
uguuguauugcuuaccauguccccauacuaugaggagaaguuuuguggugccgcugguga

SEQ ID NO: 298539 - RNA, 60 nt, hsa
uucuugguucugcaggaacuucucaagggaugaggagacagaaccccuacuuccaagugc

SEQ ID NO: 298540 - RNA, 60 nt, hsa
ggaccaagucgugggggaggggggcgguguugaggagagguauuuuuaaagaucuggcaa

SEQ ID NO: 298541 - RNA, 60 nt, hsa
aaaaggagggaagcuguagcuguuuggaugugaggagaaugaaacuacaaaaaaaaauaa

SEQ ID NO: 298542 - RNA, 60 nt, hsa
cuucuuggugauucaaagguuaauagaggcugaggagauugcaggggaaacacccuugcu

SEQ ID NO: 298543 - RNA, 60 nt, hsa
gcaaugggaaagugaugagugcgggaguccugaggagauguggccugcagacaacaugca

SEQ ID NO: 298544 - RNA, 60 nt, hsa
gggcuaguuaguucuuggagcagcugcuuuugaggagaaaauauauagcuuuggacacga

SEQ ID NO: 298545 - RNA, 60 nt, hsa
cuggaucuaaagaaauuacccagugagcagugaggagaaacaaggagcuagaaaacauug

SEQ ID NO: 298546 - RNA, 60 nt, hsa
aaugggacucaucuuuuccugccuugcuuuugaggagaugguugaauuuaagcuaacagg

SEQ ID NO: 298547 - RNA, 60 nt, hsa
cuggcaagaugcuuuaggaagauaaaaguuugaggagaacaaacaggaauucugaauuaa

SEQ ID NO: 298548 - RNA, 60 nt, hsa
gucauaaauggauaaaaggaauuuacaacuugaggagaaaaccuuuacaauuuccuaugg

SEQ ID NO: 298549 - RNA, 60 nt, hsa
cuucucuuuagucagggcaugcuuuauuagugaggagaaaacaauuccuuagaagucuua

SEQ ID NO: 298550 - RNA, 60 nt, hsa
uuccguaccccugaggaaacaaaaaggaaaugaggagagaaaguuacuguuaaggguggu

SEQ ID NO: 298551 - RNA, 60 nt, hsa
gguuuuaguccauugguagcauuguguguaugaggagauucaacaccacagacagcugca

SEQ ID NO: 298552 - RNA, 60 nt, hsa
uuugaugaaagauggaggauaaaggggaagugaggagaauuucuuucaagauuaucuaaa

SEQ ID NO: 298553 - RNA, 60 nt, hsa
aggggucucggaugacacccuggccugaacugaggagaugaccagggaugcugggcuggg

SEQ ID NO: 298554 - RNA, 60 nt, hsa
uugccaaagcccucauaaagcccuccggcuugaggagagaguguauagucauggguucug

SEQ ID NO: 298555 - RNA, 60 nt, hsa
guuaggaaaauuacauuccugguucuguauugaggagaaggauguauaaagcaacaugaa

SEQ ID NO: 298556 - RNA, 60 nt, hsa
ugauggaaccacccuccccagaggcugcauugaggagacuccacagacugaaaagugagu

SEQ ID NO: 298557 - RNA, 60 nt, hsa
caugccugaucucuucuuuacugccagccuugaggagagcagaagccuccauuuuuaaag

SEQ ID NO: 298558 - RNA, 60 nt, hsa
gcugaccccuggggcucuugggcagaaagaugaggagacagagguccaggguggguuaca

SEQ ID NO: 298559 - RNA, 60 nt, hsa
aaaggguuaauagccagauaguagaaccagugaggagaugcggccaaagauucuuuauau

SEQ ID NO: 298560 - RNA, 60 nt, hsa
gugcccccaacccugggcauccucaggcuuugaggagaauacacaggauuugaagucaga

SEQ ID NO: 298561 - RNA, 60 nt, hsa
gauuaguuaaagggauaauuaauuuaaugcugaggagaguuugacagauuuugaaaauga

SEQ ID NO: 298562 - RNA, 60 nt, hsa
ccagaacucagcaacccagcucuuuuaucaugaggagagguagccaugcugacucaugaa

SEQ ID NO: 298563 - RNA, 60 nt, hsa
acuacagaggggaaccauuugagggauacaugaggagagaguaaauugagguuuggggau

SEQ ID NO: 298564 - RNA, 60 nt, hsa
gaggagggagagcaggguugggggagaggcugaggagagugugacauguggggagaggac

SEQ ID NO: 298565 - RNA, 60 nt, hsa
acuggggggaauguucucagcagagaagaaugaggagaaguuuaauauuuugcccuugaa

SEQ ID NO: 298566 - RNA, 60 nt, hsa
gagggucacauagguagaugguaaagagaaugaggagaaaaaggagaaaagggaaaagca

SEQ ID NO: 298567 - RNA, 60 nt, hsa
cccuacccccacuucucucaguuccuggcaugaggagagaagacccugcucugguggagc

SEQ ID NO: 298568 - RNA, 60 nt, hsa
gacgcaucucagccuggaaccaacaggggcugaggagagagggcacaggagagagggcag

SEQ ID NO: 298569 - RNA, 60 nt, hsa
gcacauuuggagggaaagacaagagagccaugaggagagggcugaggagggcagaagggc

SEQ ID NO: 298570 - RNA, 60 nt, hsa
uuuggagcacuguucugggacuccaggucuugaggagagagacagagagagagaauggau

SEQ ID NO: 298571 - RNA, 60 nt, hsa
auccaagugcagagcucuuugcuccaggagugaggagacugggaggugaaauggggaaau

SEQ ID NO: 298572 - RNA, 60 nt, hsa
uguuuauacagcucagcuuuuugucuuuucugaggagaaacaaauaagaccauaaaggga

SEQ ID NO: 298573 - RNA, 60 nt, hsa
ugaggccaguuucuaugaagagcaaguagcugaggagaggucgaauuuacugcuuuuucc

SEQ ID NO: 298574 - RNA, 60 nt, hsa
acccaggaugauuuccuggggcacagugggugaggagauggggacaggugaauggaggag

SEQ ID NO: 298575 - RNA, 60 nt, hsa
uuaaagaccaacuucccuuugauggcugugugaggagaguccccuaagaggugaaagaga

SEQ ID NO: 298576 - RNA, 60 nt, hsa
gcaaugucugaauggaauuggcaaaugaggugaggagaugggguaacugccuuuaggucc

SEQ ID NO: 298577 - RNA, 60 nt, hsa
cuaaggaguaaacagcuuauuuauacauuuugaggagaaaacaaaguguuucacuaggaa

SEQ ID NO: 298578 - RNA, 60 nt, hsa
caggguuggugugaugccaaggcaaaguggugaggagaaaacaggaaacgggcuuucucu

SEQ ID NO: 298579 - RNA, 60 nt, hsa
gcuccaagcguacaggagaugggccauaccugaggagagaauguaugagaucaaaaaaga

SEQ ID NO: 298580 - RNA, 60 nt, hsa
caauacuggaaccaccgggugcgauggcagugaggagacugcccagugccuuuggggcug

SEQ ID NO: 298581 - RNA, 60 nt, hsa
uaauauuuuaaauuuucaaaaacccauuccugaggagaacuacuucuagcauuccuuuuc

SEQ ID NO: 298582 - RNA, 60 nt, hsa
gcaaaugugauuauguuaaggaucuugaaaugaggagacaauccuggguuauccuugugg

SEQ ID NO: 298583 - RNA, 60 nt, hsa
cuaaaugccuucuauagaaguaauuuuugaugaggagaaaugguacaauacuaauuaaca

SEQ ID NO: 298584 - RNA, 60 nt, hsa
gaaaccaaccauacagacgagccgaugcggugaggagaagcgucaggcggcgcuuugaug

SEQ ID NO: 298585 - RNA, 60 nt, hsa
uguugggaugugaaauuuauuuucuaaaauugaggagaaggaaguuauauauuugcagaa

SEQ ID NO: 298586 - RNA, 60 nt, hsa
caacucugcccagccgccccgucugagaagugaggagacccuccgccuggcaaccgcccc

SEQ ID NO: 298587 - RNA, 60 nt, hsa
caaaucucugucaccaguggacuguaucccugaggagaacaacucagcccacccuuccuu

SEQ ID NO: 298588 - RNA, 60 nt, hsa
guaaacaaacccuguuaugcuguauuauuaugaggagauucuucauuguuuucuuuccuu

SEQ ID NO: 298589 - RNA, 60 nt, hsa
uacuacacuuugcuccucuggcccaaggcaugaggagagaggcugugucagaaacugaag

SEQ ID NO: 298590 - RNA, 60 nt, hsa
gaauggaguaaugaaauucuugccaugugcugaggagauagccagcauuaggugacaauc

SEQ ID NO: 298591 - RNA, 54 nt, hsa
uauccugcugcucacugugaguccugaggagagguugcagaggcugcagggccg

SEQ ID NO: 298592 - RNA, 60 nt, hsa
uucugaauucugaguuuugaaaauauauuuugaggagaaaaagacauagucuaauuugau

SEQ ID NO: 298593 - RNA, 60 nt, hsa
uugcugagcagcuuuuaauacaccucugcuugaggagaaagucuaguucauugcuacugc

SEQ ID NO: 298594 - RNA, 60 nt, hsa
gugagggugaguaaagagguagaggagguuugaggagagagaacugcucggaagacauug

SEQ ID NO: 298595 - RNA, 60 nt, hsa
guugcuguuuuuauuaccagcugacacugcugaggagaaacccaauggcuaccuagacua

SEQ ID NO: 298596 - RNA, 60 nt, hsa
agccauccuggaguugauauucaccauuugugaggagaaauacuaacuggacugacccua

SEQ ID NO: 298597 - RNA, 60 nt, hsa
aucuucccaggcaaucuugugucguuauaaugaggagagucaaaaacaugcagccuuaag

SEQ ID NO: 298598 - RNA, 60 nt, hsa
uuuaaaagagaagaaacacugaagauguccugaggagaaaagcuggacauauacugggcu

SEQ ID NO: 298599 - RNA, 60 nt, hsa
ggcagacccagggggaagaaaggagggcugugaggagauaccucauuaaacuuggcuuag

SEQ ID NO: 298600 - RNA, 60 nt, hsa
cagccaucgaguacuguauguauuuccaccugaggagaaggccuggggaggccacagugc

SEQ ID NO: 298601 - RNA, 60 nt, hsa
cauccccuuggccacagagccauugugauaugaggagauacuggcucuucuggaaaagag

SEQ ID NO: 298602 - RNA, 60 nt, hsa
agaauggaacaguggggagcuaacugugaaugaggagaguaccugcugcaggaccuggag

SEQ ID NO: 298603 - RNA, 60 nt, hsa
ggauguucaaacagggaacacugucagggcugaggagaacagaagcucugguaagcgaau

SEQ ID NO: 298604 - RNA, 60 nt, hsa
ugaaaaaugauacuuagagaugaggcgacaugaggagauauauuauucaucauagauggc

SEQ ID NO: 298605 - RNA, 60 nt, hsa
uagaaaucauucuuuacaguuuugcauugcugaggagagagaaaaaacaauuuuuuugca

SEQ ID NO: 298606 - RNA, 60 nt, hsa
agccacgguggggcuuuuuucuccucaguuugaggagaaaaaucuugaugucauuacucc

SEQ ID NO: 298607 - RNA, 60 nt, hsa
accccuggaacuggcggguauucuggucauugaggagacaccauaguggaaacuggggcu

SEQ ID NO: 298608 - RNA, 60 nt, hsa
ugggugcugaagcaagaaaccgacagauguugaggagaauggugugaccuaggagucagc

SEQ ID NO: 298609 - RNA, 60 nt, hsa
aaaagagauggagggagaucuucauuucuuugaggagaucaguauuguaacguaugugaa

SEQ ID NO: 298610 - RNA, 60 nt, hsa
agcagggagguuuguaggccauggaggaaaugaggagacaccaccuaguggagacauugg

SEQ ID NO: 298611 - RNA, 60 nt, hsa
acgcccugccgcuacuucaccugagggccgugaggagaaggugggcugcgccccacagaa

SEQ ID NO: 298612 - RNA, 60 nt, hsa
uagaaauauuggccaagguguugcuuuaacugaggagaaaagaaagcacacugccuaaau

SEQ ID NO: 298613 - RNA, 60 nt, hsa
ugguggucucuugaauuuuguaaguucaucugaggagaaaagauuuuucagguguagcua

SEQ ID NO: 298614 - RNA, 60 nt, hsa
aaacacuugaacacuugaugacuuuagcuuugaggagauaccaucuccaggugugcuuuc

SEQ ID NO: 298615 - RNA, 60 nt, hsa
accucgugagccagccaccccugacccaaaugaggagagcucugauucucccauccggga

SEQ ID NO: 298616 - RNA, 60 nt, hsa
ccacucccuuggaggaacugaaguugggguugaggagagccagauggcuggaguggguau

SEQ ID NO: 298617 - RNA, 60 nt, hsa
caaaucaguguuggauggaccacccaagggugaggagaggggcuggaagcccugggcauu

SEQ ID NO: 298618 - RNA, 60 nt, hsa
aguucacuucuggaugcuggaagcugucguugaggagaaggaguaguaagcagaacuaag

SEQ ID NO: 298619 - RNA, 60 nt, hsa
ucucagcuacuccagggcaccugacugcucugaggagagggaagaaggccugcuggggcu

SEQ ID NO: 298620 - RNA, 60 nt, hsa
gauggcagaacccccaagcgaaugcccuauugaggagaaggacaucacuguauuuggaau

SEQ ID NO: 298621 - RNA, 60 nt, hsa
aguagugcucucguugaugaagcacauguaugaggagaccagcagcaaaacauaaccaua

SEQ ID NO: 298622 - RNA, 60 nt, hsa
ggaacgugcagucaucaauggucaguuauaugaggagagugagaaucaagacgaggaccc

SEQ ID NO: 298623 - RNA, 60 nt, hsa
uuuuuuucuuugauacauagagagccacacugaggagaagcacucugaauucaguggcag

SEQ ID NO: 298624 - RNA, 60 nt, hsa
uagaugauauaacaaagaaagcaugcuuucugaggagauaguggggauaaucccugaaga

SEQ ID NO: 298625 - RNA, 60 nt, hsa
uaccuugaacuugcccugcagagucucuugugaggagaauccacauccuauaaagaagcc

SEQ ID NO: 298626 - RNA, 60 nt, hsa
caauggcuccaccauucccccagggagcccugaggagaugcuuuuccacuuuggaaugac

SEQ ID NO: 298627 - RNA, 60 nt, hsa
ggaagugacaggacuuucauuguucuuggcugaggagaagcgggaguggcugauggaagc

SEQ ID NO: 298628 - RNA, 60 nt, hsa
acaacuguauuuauuaacgcuuacuagaugugaggagagucugaauauuuucagugaucu

SEQ ID NO: 298629 - RNA, 60 nt, hsa
aaaccagcaggauacaaguugcaaaugaaaugaggagaaacaguuucaacucugaaagug

SEQ ID NO: 298630 - RNA, 60 nt, hsa
cuucaauaauguucaacugaaucucacagaugaggagagagaagaaacggaagaggaagu

SEQ ID NO: 298631 - RNA, 60 nt, hsa
aaacaucaaccgggucucaaccuguuacagugaggagaucacagugugugguaagagcug

SEQ ID NO: 298632 - RNA, 60 nt, hsa
aauggauuguuuguaacacaaauaaaugcuugaggagauggacaccccauauuacaugau

SEQ ID NO: 298633 - RNA, 60 nt, hsa
cuugcuuggaaaccccacaugcaaacgucaugaggagaauuaaaggaguauuaucaguaa

SEQ ID NO: 298634 - RNA, 60 nt, hsa
gauaucagaguuauuuaaaaauuguuuauuugaggagauaacauuucaacuuuguuccua

SEQ ID NO: 298635 - RNA, 60 nt, hsa
uguuaguuuauccaaaguuugggcuagaagugaggagaaucccuaaacucgagguggugu

SEQ ID NO: 298636 - RNA, 60 nt, hsa
cucugugugaacaggaaacuuuagggcagaugaggagaaugaauugguuaucagagugga

SEQ ID NO: 298637 - RNA, 60 nt, hsa
gcuuugcucuuugucugcauuaagagaggaugaggagagcuggucaaacauuccuugugu

SEQ ID NO: 298638 - RNA, 60 nt, hsa
auguuuacguuuucaaagaaaucaaguauaugaggagagcgagcgagcgugagagaacac

SEQ ID NO: 298639 - RNA, 50 nt, hsa
ccaucguucacacucuaugaugaggagauucagacuccacaguguauaua

SEQ ID NO: 298640 - RNA, 60 nt, hsa
aauuuuuauugaaugaacaaaugagguguaugaggagagaugguuuucuccugcucagcu

SEQ ID NO: 298641 - RNA, 60 nt, hsa
cuuccauuauugaguuccuccuaaggaaauugaggagagggacugaauagaagcccaaau

SEQ ID NO: 298642 - RNA, 60 nt, hsa
ccugauccggucuguggggacgagggacacugaggagaggugcugggcaccaggacgcug

SEQ ID NO: 298643 - RNA, 60 nt, hsa
gccauuggggagcacagggccaggcuggggugaggagagcuccccuguuuucuguuuaau

SEQ ID NO: 298644 - RNA, 60 nt, hsa
caaaagggauccuuucauaggagaacacacugaggagauacuugaagaauuuggauucag

SEQ ID NO: 298645 - RNA, 60 nt, hsa
cauauaguucugauuggauuucguuccuccugaggagaccaugccguugagcuuggcuac

SEQ ID NO: 298646 - RNA, 60 nt, hsa
ccauagggauguuuuuaggauguaaguuucugaggagaaagcuagcucuagcaugaagcu

SEQ ID NO: 298647 - RNA, 60 nt, hsa
uuuuggugcauuacuuggucaauucaggguugaggagacuguuggggggcauuuauaaug

SEQ ID NO: 298648 - RNA, 60 nt, hsa
cagccauauguauggggcuuccauuuggggugaggagaaaguucuggaacuagauagugg

SEQ ID NO: 298649 - RNA, 60 nt, hsa
uggaccugucucuaccuaaggacaagacacugaggagauacugaacauuuugcaaaacuu

SEQ ID NO: 298650 - RNA, 60 nt, hsa
ugggaagguccuggaagaggguggcuucuuugaggagaagggcgccaucuucugcccacc

SEQ ID NO: 298651 - RNA, 60 nt, hsa
ucccugcucagcgcuccccugggaagggggugaggagaugaaaaugaaacuaugagcugu

SEQ ID NO: 298652 - RNA, 60 nt, hsa
auucagaaguggagauuucaguucagcgguugaggagaauugcggcgagacaagcaugga

SEQ ID NO: 298653 - RNA, 60 nt, hsa
acugccaugagaaacacaggggaaaccugaugaggagaaggauaagacugcguaaggaga

SEQ ID NO: 298654 - RNA, 60 nt, hsa
cggccugccucccaccuggaagucugggaaugaggagauugagauaaacuuuugaaaucc

SEQ ID NO: 298655 - RNA, 60 nt, hsa
aguagaagcuuuccucuccccuucucaccuugaggagauaaaaauucucuaggcaggaaa

SEQ ID NO: 298656 - RNA, 60 nt, hsa
gacuauucaacaacuucuuugcugaagcacugaggagauuuguaauacuccuaaaggaag

SEQ ID NO: 298657 - RNA, 60 nt, hsa
uuacuuaaaguugauuuugaacuuuuuauuugaggagacgaagugaaaacaaaucuauaa

SEQ ID NO: 298658 - RNA, 60 nt, hsa
gggcugugucccccucagacuggggcugccugaggagaugaaugaaacuuacuaagaaua

SEQ ID NO: 298659 - RNA, 60 nt, hsa
ugauggagggagggagccccccaaccucagugaggagagccccgagccggccccggggca

SEQ ID NO: 298660 - RNA, 60 nt, hsa
caaguuuuuccaggccagcuccaguuucagugaggagagugugggcuuucuauuccccaa

SEQ ID NO: 298661 - RNA, 60 nt, hsa
auaauuuugaaccaauuuauuauuguguacugaggagaaauaauguauaguagaggacag

SEQ ID NO: 298662 - RNA, 60 nt, hsa
gcaauggaguggagugucuccuggagagagugaggagagugugugauagcuagaaagaga

SEQ ID NO: 298663 - RNA, 60 nt, hsa
aguaacuuucauuggagguugggaaggaagugaggagaaaguguucuuguuuaguguuuu

SEQ ID NO: 298664 - RNA, 60 nt, hsa
cgugacagaugaagaaaccaagggggcugcugaggagaccuggugcagggacuaauccug

SEQ ID NO: 298665 - RNA, 60 nt, hsa
uguggaaagugagaaaaaccuccauuguggugaggagaauacuucaaugucccuuguccu

SEQ ID NO: 298666 - RNA, 60 nt, hsa
aacagaugcagacauguguguugguaguagugaggagauugguauuagcaucaagucuuc

SEQ ID NO: 298667 - RNA, 60 nt, hsa
uagugggguggaggcugcuggaggugggagugaggagaugagggcagggucucaaacagu

SEQ ID NO: 298668 - RNA, 60 nt, hsa
uaagcgcucauuaagcagaggagcccacuuugaggagagcaaagcacaagcuugccugaa

SEQ ID NO: 298669 - RNA, 60 nt, hsa
auauaguacuggacacaguacuggugaaacugaggagagcauugcuuguaaaauccugag

SEQ ID NO: 298670 - RNA, 60 nt, hsa
cuuuugcaggggaucugggcaccugugccuugaggagaugcugccaggagcaugggacuc

SEQ ID NO: 298671 - RNA, 60 nt, hsa
caggguucaauagaaauccucaauuuagggugaggagacuuuuuuuugguuuugggguuu

SEQ ID NO: 298672 - RNA, 60 nt, hsa
aaugguauguauuaauaacugaucauaggcugaggagaaaaaauguagcuggcugcaaac

SEQ ID NO: 298673 - RNA, 60 nt, hsa
cuucauauauguuuaagguugucuuucuagugaggagauacauaucagagaacauuugua

SEQ ID NO: 298674 - RNA, 60 nt, hsa
aaauguucaagucaugccugagucaagaguugaggagacauuacaauguguaauggaaac

SEQ ID NO: 298675 - RNA, 60 nt, hsa
auccuccccugcuucauccuaccuggcugcugaggagaguccuuuggagugacagguaug

SEQ ID NO: 298676 - RNA, 60 nt, hsa
gagaaugauaauccuggacaugggugaacaugaggagaaccagcaaaaucugugguguuu

SEQ ID NO: 298677 - RNA, 60 nt, hsa
aaaaaaaaaaccacaccuaaaauagaccacugaggagaccauagagcggaugcuuucaug

SEQ ID NO: 298678 - RNA, 60 nt, hsa
uuaucaagggcugguggggcaguggaggauugaggagauauuggucaaaauuuacaaaau

SEQ ID NO: 298679 - RNA, 60 nt, hsa
gauuauaaauguaauaagcauguaugugugugaggagauucagucauaacccaacgcuca

SEQ ID NO: 298680 - RNA, 60 nt, hsa
uuuaaggcauggagcugagaagucugggagugaggagaucccaguccggcuaagcuuggu

SEQ ID NO: 298681 - RNA, 60 nt, hsa
cacauuacguggaccuggucccaggcucagugaggagauggccucagcuguggggcuggu

SEQ ID NO: 298682 - RNA, 60 nt, hsa
aagcuuccuucaaccugcauagccggugggugaggagauucccaccuuccauagccucca

SEQ ID NO: 298683 - RNA, 60 nt, hsa
aucugacuuugagucacagaaaccuuaaacugaggagacaauaguucagaaccuuuuuaa

SEQ ID NO: 298684 - RNA, 60 nt, hsa
uuugcucuugccaaagugagauagauguacugaggagauaauugaaaagucagacucugu

SEQ ID NO: 298685 - RNA, 60 nt, hsa
aaaagggacaggacccuucggaggugccugugaggagaggggagcaggaccucucccucc

SEQ ID NO: 298686 - RNA, 60 nt, hsa
uuagaaucaguguaucagugaccuaugacuugaggagaaacuuuuaauucgaagauuuua

SEQ ID NO: 298687 - RNA, 60 nt, hsa
caguggguggaaucuguccccaccuggcacugaggagaaugguagagaggagaggagaga

SEQ ID NO: 298688 - RNA, 60 nt, hsa
uuguuaugucuagaaaguaagaaaacaauaugaggagacauucugucuuucaaaagguaa

SEQ ID NO: 298689 - RNA, 60 nt, hsa
cuucccuguuauaaaaugguuugaacuuacugaggagauauuccuaucauuaacaaaaau

SEQ ID NO: 298690 - RNA, 60 nt, hsa
cuggggcaguaucuucugauggugugcaugugaggagaagaugagguuaggacugagaag

SEQ ID NO: 298691 - RNA, 60 nt, hsa
ccaggucugcuuaggggaccugcgugcaggugaggagagaaggggacacucgaguccagg

SEQ ID NO: 298692 - RNA, 60 nt, hsa
ggcuguuuugccuccccacggaaggcgggcugaggagacaaccagaucaggagagcaagg

SEQ ID NO: 298693 - RNA, 60 nt, hsa
ccagugcagugcccucuucccuuccugcacugaggagauuaacugaagugacagauuaga

SEQ ID NO: 298694 - RNA, 60 nt, hsa
uugcagagcaaacaaagcagaggcaagaacugaggagaaguaucagagacaaacgggacu

SEQ ID NO: 298695 - RNA, 60 nt, hsa
caccucaugaugcaguggcuccucucugguugaggagagggaaaauuggaaaaacugguc

SEQ ID NO: 298696 - RNA, 60 nt, hsa
ccacucccaagaaauucaggaaagaaagacugaggagaaggugugggaacauucuggaug

SEQ ID NO: 298697 - RNA, 60 nt, hsa
augauuguuaccauaaauuagugcuaaugcugaggagaacuacaguuuuucuuuugaauu

SEQ ID NO: 298698 - RNA, 60 nt, hsa
ugaaauugugcgauguauuugugagauggaugaggagaauggcuucaugauccagguaau

SEQ ID NO: 298699 - RNA, 60 nt, hsa
uacagcugguaaugccgcugucaucaaauaugaggagaaaccuccaaaaccagcauuuca

SEQ ID NO: 298700 - RNA, 60 nt, hsa
agagaaaaaaaagucucccucagaaaguacugaggagaaagcuaacggaacacauccaaa

SEQ ID NO: 298701 - RNA, 60 nt, hsa
cugcccuccugccaaaagaucuggggagugugaggagaggguggcaucaggagcugcuca

SEQ ID NO: 298702 - RNA, 60 nt, hsa
accuggacauugagccuccaggcaccauguugaggagagaugaaaaccagggcgguagaa

SEQ ID NO: 298703 - RNA, 60 nt, hsa
ugauguguuuaucaaaugauaacuggaagcugaggagaauaugccucaaaaagaguagcu

SEQ ID NO: 298704 - RNA, 60 nt, hsa
aagacugucuuccuaucugcuucuugcggcugaggagaggagcaguucaguuuacaaaac

SEQ ID NO: 298705 - RNA, 60 nt, hsa
cauagaugcaggaggcucaggugaucuguuugaggagagcacccuaggcagccugcaggg

SEQ ID NO: 298706 - RNA, 60 nt, hsa
gcacagcagcucccucaaggaggagaagagugaggagaaaggaaacucaagucucaccau

SEQ ID NO: 298707 - RNA, 60 nt, hsa
aguuguaucugcugugcauucacucuaagaugaggagaacaaaagaaguguauucucuug

SEQ ID NO: 298708 - RNA, 60 nt, hsa
auuaaccuaagacacagaaggcagacugggugaggagaccuagcaugcccuauuggcagu

SEQ ID NO: 298709 - RNA, 60 nt, hsa
gcauaagugccauccuuuaaucauagacuuugaggagagaaagcauaaaaauauagcaua

SEQ ID NO: 298710 - RNA, 60 nt, hsa
uuuugcuacauagucuacucaaaaauuacaugaggagaaauccuuuuucccuuuguuuuu

SEQ ID NO: 298711 - RNA, 60 nt, hsa
cagccgcccacuucccguuuccucuuuaacugaggagaagcugauccaguuuccggaaac

SEQ ID NO: 298712 - RNA, 60 nt, hsa
gcuuuguaccagagcaccuccaaacugcauugaggagaaguuccagaaccauccccuuuu

SEQ ID NO: 298713 - RNA, 60 nt, hsa
auuuucugugcguuuugacccugaggcaucugaggagaggccacaucuuguguaugcccu

SEQ ID NO: 298714 - RNA, 60 nt, hsa
cagguaccuauuauuguucccuggugaaacugaggagaaaaguuaaucaaccagguuacu

SEQ ID NO: 298715 - RNA, 60 nt, hsa
accaucguaacauggaggccucagcugcucugaggagagaaaucagacuuuguuuuuuga

SEQ ID NO: 298716 - RNA, 60 nt, hsa
ccccagcugcaaacugagugugccggacccugaggagaggcuggacucggggcaugugug

SEQ ID NO: 298717 - RNA, 60 nt, hsa
agcccaagauggccaauggggagccccaggugaggagagaagcaucugggggcacuccaa

SEQ ID NO: 298718 - RNA, 60 nt, hsa
gcuuugauccugagaaccuugcuguugcucugaggagauauaauucugggagaaagaauc

SEQ ID NO: 298719 - RNA, 60 nt, hsa
ugugcucucaggacagccccauuuuagggaugaggagacuucaccacgcccuccccuccc

SEQ ID NO: 298720 - RNA, 60 nt, hsa
ugaauguccucauuuuacagaugaggacauugaggagaagagacuuacccaggcucacac

SEQ ID NO: 298721 - RNA, 60 nt, hsa
gccucugcuccccugaaccugggagacagaugaggagacuggcucagcaaggccccugga

SEQ ID NO: 298722 - RNA, 60 nt, hsa
uccccacgugaacaaaaugggaaggagccgugaggagaggagugaggcaacaggcacccg

SEQ ID NO: 298723 - RNA, 60 nt, hsa
guagcugggccagacuucucauuucacaggugaggagacuggugccccacagggauuaag

SEQ ID NO: 298724 - RNA, 60 nt, hsa
cagugcccggaauggcccuaggaggcccucugaggagagcuagagucccagcaaagggug

SEQ ID NO: 298725 - RNA, 60 nt, hsa
uugugcccgggcccauggggaggacgauggugaggagauccuguuggacacccagugcca

SEQ ID NO: 298726 - RNA, 60 nt, hsa
cccauuuccuccuucauccuguggagucugugaggagaacaggugggcgugcuggugacc

SEQ ID NO: 298727 - RNA, 60 nt, hsa
ugggugccaagugucccuccuuggugaauuugaggagagauggauucacacugggcccau

SEQ ID NO: 298728 - RNA, 60 nt, hsa
acaggaugcuggccuuugcucuuacuacacugaggagagauucccgcggguuccgcaggc

SEQ ID NO: 298729 - RNA, 60 nt, hsa
uaagauucacauccauagcccccauggcuuugaggagaauccucucugccauucuuccaa

SEQ ID NO: 298730 - RNA, 60 nt, hsa
ggaagcugguuucagcccaggacccaccacugaggagaggaucuagacaggugggccuaa

SEQ ID NO: 298731 - RNA, 60 nt, hsa
acaaaauuacauggaggccagcugguuuugugaggagauuguuuauuuuuuaauucuuuu

SEQ ID NO: 298732 - RNA, 60 nt, hsa
ccuuuugugaaagugucaucacggguccccugaggagacaaggcagguccagcgcacauc

SEQ ID NO: 298733 - RNA, 60 nt, hsa
gaggaaugugaggcacauuauuggggaaauugaggagacagccuagacacuggcuggccu

SEQ ID NO: 298734 - RNA, 60 nt, hsa
augcaaauaagguuauguuagaauuuacacugaggagaaaauugucaauuuaagaaaucu

SEQ ID NO: 298735 - RNA, 60 nt, hsa
cauuagagaagguauuuauaaaaauaggaaugaggagagcuagaaaaccuggaguguggc

SEQ ID NO: 298736 - RNA, 60 nt, hsa
guaauauuuuggacugcuguuuuccauuaaugaggagagcaacaggccccugauuauaca

SEQ ID NO: 298737 - RNA, 60 nt, hsa
gaggccuugagcucuuuguuuuuauauuaaugaggagaaaaguaugaaaacaagaagucu

SEQ ID NO: 298738 - RNA, 60 nt, hsa
cugaagccuucacacaugugagauccaugcugaggagaagcaaaauggcacagggcuagu

SEQ ID NO: 298739 - RNA, 60 nt, hsa
uggggaggaaccaugcuaagccaugaccagugaggagaagcaacagagccugucuguccc

SEQ ID NO: 298740 - RNA, 60 nt, hsa
caguguugugccccuucacucauuuuuuuuugaggagaagggggucucuguuaacaucua

SEQ ID NO: 298741 - RNA, 60 nt, hsa
acaccuuauggagauaaugccucugcugcgugaggagacagagaacuuuaguuggacuac

SEQ ID NO: 298742 - RNA, 60 nt, hsa
uccgcauucccucccccuugaaaaccugacugaggagacauucuggaagguuccgguccc

SEQ ID NO: 298743 - RNA, 60 nt, hsa
cuacaaauaggauuauguuagcauuuacacugaggagaaaauugucaauuuaagaaaucu

SEQ ID NO: 298744 - RNA, 60 nt, hsa
ccucugaauaugauaacagccuguuucacaugaggagauguuaccaaucccguucgcucu

SEQ ID NO: 298745 - RNA, 60 nt, hsa
ccugcucugccugggcugggccaggggcuuugaggagaggguaaacauaggcccggagau

SEQ ID NO: 298746 - RNA, 60 nt, hsa
ccugggggccauccugguggccugggagcgugaggagaggcccccugugugcugggugag

SEQ ID NO: 298747 - RNA, 60 nt, hsa
gguggcccagguggugcagguagaacagggugaggagagggggucggcucagcaggagga

SEQ ID NO: 298748 - RNA, 60 nt, hsa
guguuuuucucuucuuucucucuuuuucuuugaggagaaugauggucaccaccacaauua

SEQ ID NO: 298749 - RNA, 60 nt, hsa
gacugggugggugaagcaccguguccucgcugaggagagaaagggaggcgugccugagaa

SEQ ID NO: 298750 - RNA, 60 nt, hsa
ucugguguuggacaagcuucugagacgucaugaggagauucugccuuugccaggugacug

SEQ ID NO: 298751 - RNA, 60 nt, hsa
ccauuaugugggacccauuccucaccaaaaugaggagagacagugacuguuccugccaca

SEQ ID NO: 298752 - RNA, 60 nt, hsa
gcgggacuggugacccauggcugggggugcugaggagagccgaguuggacuggcuacccc

SEQ ID NO: 298753 - RNA, 60 nt, hsa
uagagggccuucugcccucugaauauauggugaggagaaugggguaucuggaaaaggaaa

SEQ ID NO: 298754 - RNA, 60 nt, hsa
aucagacuggaaaaaaggaugacuauaugaugaggagaaacugggguggcagggagggag

SEQ ID NO: 298755 - RNA, 60 nt, hsa
gaguacuugguagaagauucuuuaacaaauugaggagauugauucauaauucacauguca

SEQ ID NO: 298756 - RNA, 60 nt, hsa
cuuucaccucagauuuucuggacuuagucaugaggagagggugaggcccacucuguuccu

SEQ ID NO: 298757 - RNA, 60 nt, hsa
auuucuuuugggucaauauuuuuaagugugugaggagaugcucaguagcagcagccuaug

SEQ ID NO: 298758 - RNA, 60 nt, hsa
acccucuguauugacugcaauguaagcugcugaggagacugguucuguuggucagucagg

SEQ ID NO: 298759 - RNA, 60 nt, hsa
ugguagggcaauccuaccaauugaugggggugaggagacuguugggcccuuauucucuua

SEQ ID NO: 298760 - RNA, 60 nt, hsa
ggaguuuguucaugaaugcugaucccagggugaggagaagauugggacauagaaaggaaa

SEQ ID NO: 298761 - RNA, 60 nt, hsa
cuggaagcugaaguuuagaugagacagaaaugaggagacacaccugaggcugguuucuuu

SEQ ID NO: 298762 - RNA, 60 nt, hsa
ccugccuaccuccugccuguccccagaggcugaggagaggggguacugugcccaccacac

SEQ ID NO: 298763 - RNA, 60 nt, hsa
ggcagugcccauuccuguggggucccugggugaggagacggcuggagccccaccaugccc

SEQ ID NO: 298764 - RNA, 60 nt, hsa
gcaccuugacccagggaugugaugguuuauugaggagagauaggaguugaagggagagga

SEQ ID NO: 298765 - RNA, 60 nt, hsa
ggcggcaggaucagagugaaagcagaggcgugaggagaggaaagcagggaggucuccugg

SEQ ID NO: 298766 - RNA, 60 nt, hsa
cuguguuugaggaccaauaucuguucguguugaggagaugaggugcagacuccacacugg

SEQ ID NO: 298767 - RNA, 60 nt, hsa
ugaaaguuugggaggagauucaccaauaucugaggagaagauggagugaagggaauucuu

SEQ ID NO: 298768 - RNA, 60 nt, hsa
ugcuuugcaaggcuucaggaaacagaguugugaggagaaagaagaaaauggcugcccauu

SEQ ID NO: 298769 - RNA, 60 nt, hsa
ccaagauaucaggaaugaggaauaggggccugaggagagaggggaaggguacagagaaac

SEQ ID NO: 298770 - RNA, 60 nt, hsa
ccaaacugucugacucuguguuuccugcccugaggagagaggggucagauugcagcgggc

SEQ ID NO: 298771 - RNA, 60 nt, hsa
cugacccccuccccccaaucccucaaaccuugaggagaaguggggaccccaccccucauc

SEQ ID NO: 298772 - RNA, 60 nt, hsa
cacuucuuaccaugcacuuuccuuugaugcugaggagaaauggaagugggcgaaaaaucu

SEQ ID NO: 298773 - RNA, 60 nt, hsa
cagaaaagaccuccuagcuagguccccaugugaggagaucugcuuucagcccucaccuaa

SEQ ID NO: 298774 - RNA, 60 nt, hsa
aguucauaggaguggcaguaaucuacugugugaggagagagggcaauuaaaaagcugaaa

SEQ ID NO: 298775 - RNA, 60 nt, hsa
uagcucuauauaugucccuuuacaguccccugaggagaacuuucuuaaauugaaaccuua

SEQ ID NO: 298776 - RNA, 60 nt, hsa
auugcuggaagugugacggagcaggcgggcugaggagaguggaaaaggaagcgacccaga

SEQ ID NO: 298777 - RNA, 60 nt, hsa
ggcggcagugaggugucaccccccuccagcugaggagaccaggcccaguggcagggguuu

SEQ ID NO: 298778 - RNA, 60 nt, hsa
gggaagugagaggaaagaggcgggggcgggugaggagacuggccccaggccccagccacg

SEQ ID NO: 298779 - RNA, 60 nt, hsa
cugggggcuauguauagucuguauacguuuugaggagaaauuugauaaugacacuguuuc

SEQ ID NO: 298780 - RNA, 60 nt, hsa
aaggucuuuucaaauguggcuaaauggggaugaggagacacggguaggacuuucuuggug

SEQ ID NO: 298781 - RNA, 60 nt, hsa
agacucacuuuucugaaaaaucuccauuguugaggagaggcugcucaaucgacaccccga

SEQ ID NO: 298782 - RNA, 60 nt, hsa
cccagcaguugccccacccuguguaguuguugaggagaagaagccucaacuuacccagga

SEQ ID NO: 298783 - RNA, 60 nt, hsa
uccucugccggaagcagaagcugggaaaauugaggagaguccuuucagugucgagguaua

SEQ ID NO: 298784 - RNA, 60 nt, hsa
cuagaucagaaaucugacuagauuggauucugaggagaagaaccuacuacaaggcaagga

SEQ ID NO: 298785 - RNA, 60 nt, hsa
cgacugugacagccugacuugggaggagacugaggagacccugcugcuuugggaggauuu

SEQ ID NO: 298786 - RNA, 60 nt, hsa
uaagaugauccauuaaaaacugaacaagguugaggagaaauagugcuuacguugaaaaau

SEQ ID NO: 298787 - RNA, 60 nt, hsa
gcaggcacugcccuguggucuuccccagguugaggagagaaguggaagccccauggaaga

SEQ ID NO: 298788 - RNA, 60 nt, hsa
gggaguccuuggguucuuucaaaaaauucgugaggagagcugucuacaguggaauagggg

SEQ ID NO: 298789 - RNA, 60 nt, hsa
cagagggugcgauugaaugaguauugagacugaggagaaugauagagagugaagcagaaa

SEQ ID NO: 298790 - RNA, 60 nt, hsa
ccccagcccaucuuacugcaagcagcguccugaggagacagcggcacguucuagcugcgu

SEQ ID NO: 298791 - RNA, 60 nt, hsa
ugaaagaggagccaggccuugggcuccugaugaggagaaaggggccccaccggggucuaa

SEQ ID NO: 298792 - RNA, 60 nt, hsa
gcuggaaccugcaaaaaauacuuuuucuaaugaggagagaaaauauauguauuuuuauau

SEQ ID NO: 298793 - RNA, 60 nt, hsa
aauucuuguaaaguuucuuaacuguuuuuuugaggagaaagaacagauuuauuuauagac

SEQ ID NO: 298794 - RNA, 60 nt, hsa
gacaguaaagacauuacucccauaaaaaugugaggagagagacucaguucagcaacuguu

SEQ ID NO: 298795 - RNA, 60 nt, hsa
agaagaaaaaggagagaugaaaaaggaggaugaggagaagaauuaccuuuugacaaucug

SEQ ID NO: 298796 - RNA, 60 nt, hsa
aaaaaccuagucaaacaaggaagcuguaggugaggagaucuguauaauauucuaauuuaa

SEQ ID NO: 298797 - RNA, 60 nt, hsa
uacuuuuucccaucuggcuuuuucugccacugaggagacagaaagccuccgcugggcuuc

SEQ ID NO: 298798 - RNA, 60 nt, hsa
agaaagcugagaagaaugaaaaugcaguccugaggagaggaguuuucuccauaucaaaac

SEQ ID NO: 298799 - RNA, 60 nt, hsa
ggacuggaggcaguugcuuugcaagauggcugaggagaaagcacacugggaacacaaucc

SEQ ID NO: 298800 - RNA, 60 nt, hsa
ccagggagcuugccacacucuucuucaaguugaggagaguucuuuuuugcuuaaagcccc

SEQ ID NO: 298801 - RNA, 60 nt, hsa
aaugccugaggaaauguuccugagucacgcugaggagaggcuucacucaggaguucaugc

SEQ ID NO: 298802 - RNA, 60 nt, hsa
acaaagcagagauggaaauaaugcgccucuugaggagaaaagcaauaaugaauaaaagga

SEQ ID NO: 298803 - RNA, 60 nt, hsa
ccuaaaccgccuuacagcugaguuagaagaugaggagaggcagcagggauuucccugccu

SEQ ID NO: 298804 - RNA, 60 nt, hsa
aaguuauuacauuuacuguauugggaaacuugaggagaacucuuuaguucauaaagcuuc

SEQ ID NO: 298805 - RNA, 60 nt, hsa
cugaagaggccuggaaacgagagucuuaauugaggagaugggagacucgaacucuagccc

SEQ ID NO: 298806 - RNA, 60 nt, hsa
cauuaaucuuguuucagagcuuuagcugccugaggagauagguuuuccuuaagccuugau

SEQ ID NO: 298807 - RNA, 60 nt, hsa
uagaggugcccauuccauacccugggagacugaggagagcauuggcugaagcccaguucc

SEQ ID NO: 298808 - RNA, 60 nt, hsa
augaagagcaaugagaccaggucccugcucugaggagacgugugccagcgaaguuucucu

SEQ ID NO: 298809 - RNA, 60 nt, hsa
gcugcgacucaagaauaauaugggagcccaugaggagaaaaaggaagacuggaauaaugu

SEQ ID NO: 298810 - RNA, 60 nt, hsa
cuggggcccuggauggcacaugacucccagugaggagaauucuggugaucucuguggagg

SEQ ID NO: 298811 - RNA, 60 nt, hsa
ccgcagacacccuggcaucucaagagggagugaggagaggauugcagggacuuuucccug

SEQ ID NO: 298812 - RNA, 60 nt, hsa
acccaguacuguggcucaggauaugaugcgugaggagagggagggaacagagaugaccuu

SEQ ID NO: 298813 - RNA, 57 nt, hsa
uugaagcagaccgaagguaaacuuccuugaggagaagugaaguuucacugugguaug

SEQ ID NO: 298814 - RNA, 60 nt, hsa
ccuugccagagguugagccgccccaggguaugaggagaugaauaacuccacagcuccucc

SEQ ID NO: 298815 - RNA, 60 nt, hsa
ugaaacccucuacaaugagcacaagagcugugaggagaagucagugaagaacaccagcau

SEQ ID NO: 298816 - RNA, 60 nt, hsa
ccaagcagaugacaggcacaggccaccgcaugaggagauggagggcgggacugggccgcc

SEQ ID NO: 298817 - RNA, 60 nt, hsa
aacauuuauuuccauugcaauuucuguggcugaggagacuuaaacuuuacaaguauuauc

SEQ ID NO: 298818 - RNA, 60 nt, hsa
aucccuggcuugcugugcuucucuuggauuugaggagaguuuaugaauccaucccccugu

SEQ ID NO: 298819 - RNA, 60 nt, hsa
gauacuauggaggagagagugauggagggcugaggagaggccucagguuguuauuugguu

SEQ ID NO: 298820 - RNA, 60 nt, hsa
uccacugugcuucuuaauguguaauuaaagugaggagaaauuaaauacucugagggcguu

SEQ ID NO: 298821 - RNA, 60 nt, hsa
aaaucugaacaagcccaagucuuccaguucugaggagaggaggucuucaguacuauugaa

SEQ ID NO: 298822 - RNA, 60 nt, hsa
guccuauaaugaacaaaggugaagcugccuugaggagacaagugaaaaauuuuugcuuca

SEQ ID NO: 298823 - RNA, 60 nt, hsa
agacaaagugcguuccuuaaagacagacauugaggagagcaaauaccgacagcgccaccu

SEQ ID NO: 298824 - RNA, 60 nt, hsa
cucgcuucccccauuuucaacuugauccacugaggagagggaagggggugacuuucccuu

SEQ ID NO: 298825 - RNA, 60 nt, hsa
acgaccaccucgaccugaugcagagccuucugaggagaggcaacaggaggcauucugugg

SEQ ID NO: 298826 - RNA, 60 nt, hsa
gugguggcgcaugcccauaaucccagcuacugaggagacuugagguaggagaaucacuug

SEQ ID NO: 298827 - RNA, 60 nt, hsa
cugccucugaccuggcuugcaaugcauaggugaggagaagcagagagcuugucauaugca

SEQ ID NO: 298828 - RNA, 60 nt, hsa
accugcuggagcccagccugugccgcccucugaggagaggccuggggggacagcugggca

SEQ ID NO: 298829 - RNA, 60 nt, hsa
gcccauccaaauaaaucuccaugagaaacuugaggagacuucauaacaagaaucuggcau

SEQ ID NO: 298830 - RNA, 60 nt, hsa
uuaguuucaucaccuguuaucuguguuugcugaggagaguggaacagaagggguggaguu

SEQ ID NO: 298831 - RNA, 60 nt, hsa
cacacauguguaccugaacauucuugcuuuugaggagacagacucccagugguacuacua

SEQ ID NO: 298832 - RNA, 60 nt, hsa
aucaggaaagucagucacgcguagggauggugaggagacgcguagggauggugaggaggg

SEQ ID NO: 298833 - RNA, 60 nt, hsa
ucaguuacggacaaaauguuggcuacaacuugaggagaaaaaucacccccaaaggagugg

SEQ ID NO: 298834 - RNA, 60 nt, hsa
aucuggggaccuagcaguuaggcuugacuuugaggagaggcugugauguuuaugaucccu

SEQ ID NO: 298835 - RNA, 60 nt, hsa
gcccccagagccucacuggccccggcgggaugaggagaccaugccgggcgcgcacacacg

SEQ ID NO: 298836 - RNA, 60 nt, hsa
gggcugccucaguccuguccccuugggcacugaggagaggggcccauucaccuuucuccu

SEQ ID NO: 298837 - RNA, 60 nt, hsa
aaaccucuuccccacaagccagauuguuucugaggagagagcuagcuaggggcugggaaa

SEQ ID NO: 298838 - RNA, 60 nt, hsa
gacaaauggauacagccuugacccucccagugaggagaccccaauucagcaauaagucuc

SEQ ID NO: 298839 - RNA, 60 nt, hsa
uggcuguggucaagcccagcugcugucaugugaggagaugcucacuguggucuuguugag

SEQ ID NO: 298840 - RNA, 60 nt, hsa
uucauaugguggguaugucccgcagcagagugaggagaugaagcuuacguguccugacgu

SEQ ID NO: 298841 - RNA, 60 nt, hsa
cgucucugucuggccaccccgucugagaagugaggagaccuccgcccggcagccgcccug

SEQ ID NO: 298842 - RNA, 60 nt, hsa
caguaucagcuugaccuugcaaggucaagcugaggagacuaaguuagccaugugggcagu

SEQ ID NO: 298843 - RNA, 60 nt, hsa
gggaguugcagaaagagagggcagugagggugaggagaggggaucuggggacuugggugu

SEQ ID NO: 298844 - RNA, 60 nt, hsa
gguucugcgaagaggcaguggaagaaggcaugaggagagggucucuugagaauuugccaa

SEQ ID NO: 298845 - RNA, 60 nt, hsa
ggcuccuggagcugacaagcgaccccguggugaggagaaaugggggccuugaugcucacc

SEQ ID NO: 298846 - RNA, 60 nt, hsa
aauucuuccugaauaaugucuucaguuucuugaggagacuccuaguuuugguuuucaaau

SEQ ID NO: 298847 - RNA, 60 nt, hsa
uguuguaaaaggcagccuggccuuugcuacugaggagaaagauggagccugggucucaag

SEQ ID NO: 298848 - RNA, 60 nt, hsa
uuugaccagcaaccaaguaaaaucaguaauugaggagagcagggcacaaaggggcugcag

SEQ ID NO: 298849 - RNA, 60 nt, hsa
uccauagagcaugacagcaucgauucucauugaggagaaaccuugggcagcuccggccag

SEQ ID NO: 298850 - RNA, 60 nt, hsa
auuggggaaacggggugaacuucagguggaugaggagacagaauagagugauaggaagcg

SEQ ID NO: 298851 - RNA, 60 nt, hsa
ugcacggccgcacccucccagagaacuccuugaggagaacaagugcccuuggggacagcc

SEQ ID NO: 298852 - RNA, 60 nt, hsa
ucuaauaccugagccaagaauggaagcuugugaggagacggacucuauguugcccaggcu

SEQ ID NO: 298853 - RNA, 60 nt, hsa
ugccgucaccaguuagaggccaccauggugugaggagaccaucaccucgaccagaacucc

SEQ ID NO: 298854 - RNA, 60 nt, hsa
ggaugccccccacccucucuccugggccacugaggagaggggagagagcuggugauucca

SEQ ID NO: 298855 - RNA, 60 nt, hsa
ccacucaaugcagcugguaucucugagcucugaggagaguccuguggggauggugccccc

SEQ ID NO: 298856 - RNA, 60 nt, hsa
aaagagagguggggagaggggagagagauaugaggagagagagacagaggaggcagagag

SEQ ID NO: 298857 - RNA, 54 nt, hsa
agcccacauguugcccaugagggcugaggagacuguucagagacugcccagccc

SEQ ID NO: 298858 - RNA, 60 nt, hsa
guccuuucucugugcagcuggagacgcuggugaggagagccggguccagguucuuaagaa

SEQ ID NO: 298859 - RNA, 60 nt, hsa
uucaaaauuuccucuccaucugcuggcaccugaggagagugagcagccuggaccacaagc

SEQ ID NO: 298860 - RNA, 60 nt, hsa
gucugugccaugucccgucucuauggugguugaggagaaaggcggggaagcuuccucagc

SEQ ID NO: 298861 - RNA, 60 nt, hsa
guugucccgaaaccccaagaaaaaucagaaugaggagagucaaggacagcaacucagcug

SEQ ID NO: 298862 - RNA, 60 nt, hsa
gauuuggguugguggauuaacagauggaauugaggagagaguaggaugcugauuuuccua

SEQ ID NO: 298863 - RNA, 60 nt, hsa
cucuuguuugucccuggacuggccaugaagugaggagaugguuauuuaaagagaauuccc

SEQ ID NO: 298864 - RNA, 60 nt, hsa
caagggggugucuugugggcagugagggggugaggagaggcuggcaugagguucagucau

SEQ ID NO: 298865 - RNA, 60 nt, hsa
ugugcucuaaacccugcucaggauuccuguugaggagaugccucccuagcccagauggca

SEQ ID NO: 298866 - RNA, 60 nt, hsa
uaucugacaaugcugagguuaugaacaaagugaggagaaugaaauguaugugcucuuagc

SEQ ID NO: 298867 - RNA, 60 nt, hsa
cuucuaguuuuuuuguacacauucuuucugugaggagauugaguacucugcagcuggcga

SEQ ID NO: 298868 - RNA, 60 nt, hsa
aucagaaaaaguauuuuuauguuucuagcuugaggagaagggcuuuagggcuaaccagag

SEQ ID NO: 298869 - RNA, 60 nt, hsa
augcuucccagaagaaaggaaagaaggaggugaggagaggacgagcaaggacgggacgga

SEQ ID NO: 298870 - RNA, 60 nt, hsa
acaauagcuuugaggagcucacaaucuagcugaggagacaagacacauccaaugcugcaa

SEQ ID NO: 298871 - RNA, 60 nt, hsa
aauccucaguuggaaucauugcuaauauuuugaggagaaguguaugugugaauuaagaau

SEQ ID NO: 298872 - RNA, 60 nt, hsa
augcacggggagaagggcgacuuucaggccugaggagaggcccucuggccgccucaacgc

SEQ ID NO: 298873 - RNA, 60 nt, hsa
aucagaaggacauggugaaggcugggaacgugaggagaggcaauggccacggcccauuuu

SEQ ID NO: 298874 - RNA, 60 nt, hsa
caaccccacuuuuauuuuucuugcugggguugaggagagaaaauauagaauuccuggaua

SEQ ID NO: 298875 - RNA, 60 nt, hsa
uuuaagaugauucagauuauccuuguacuuugaggagaaguuucuuauuuggagucuuuu

SEQ ID NO: 298876 - RNA, 60 nt, hsa
gacggcaccugguaugcgggaggaacagagugaggagaggagggcagggcgugcagggcc

SEQ ID NO: 298877 - RNA, 60 nt, hsa
aagcacaaagggacuccgauguggguggggugaggagagaggcagccccggccugaccgg

SEQ ID NO: 298878 - RNA, 60 nt, hsa
cugaugggugggcccagggcggccucucucugaggagaccucacccacuccucgcucagu

SEQ ID NO: 298879 - RNA, 60 nt, hsa
uugggauuucugugaaucuauagaucaaucugaggagacuuaauaaugauauugauucuc

SEQ ID NO: 298880 - RNA, 60 nt, hsa
uauuccucaaaggucuggucugugggccucugaggagaaaacaggucuagccaagacagg

SEQ ID NO: 298881 - RNA, 60 nt, hsa
aaagagauucaagauggcagguaggcccuuugaggagagauggggacagggcagugggug

SEQ ID NO: 298882 - RNA, 60 nt, hsa
agcccauaaaagacccagacucagcugcagugaggagagaaaucacccugcugugggggu

SEQ ID NO: 298883 - RNA, 60 nt, hsa
agcugaagcucccacacugucuuccagggcugaggagaugcucuccuuuucuacugacca

SEQ ID NO: 298884 - RNA, 60 nt, hsa
agccugagccagagaaccagcucugaguccugaggagacacaggccuggggacaggaagg

SEQ ID NO: 298885 - RNA, 60 nt, hsa
gcugccgcagcaucucacaccccgagggccugaggagagggagcugugggccacgccugg

SEQ ID NO: 298886 - RNA, 60 nt, hsa
aaaacugguaagugugacccagaucaagugugaggagaugaggcuggggauagucagggg

SEQ ID NO: 298887 - RNA, 60 nt, hsa
uguccucccucgcccuaccaagagggcaccugaggagacuuuggggacagggcaggggca

SEQ ID NO: 298888 - RNA, 51 nt, hsa
ccggauuugaugcaccaugaaugaggagaaauggccucccgucuugugaac

SEQ ID NO: 298889 - RNA, 60 nt, hsa
cuuucaacccacaugagucuccucgagaagugaggagaggcaguuuggagcagaauggag

SEQ ID NO: 298890 - RNA, 60 nt, hsa
aaagaccaaagguagauaaauucacgaagaugaggagaaaccagugcaaaaagccugaaa

SEQ ID NO: 298891 - RNA, 60 nt, hsa
acugcugagaaggcuguccuuccuaacuugugaggagaugaauccuuaauaauaaguaaa

SEQ ID NO: 298892 - RNA, 60 nt, hsa
gugaggacauucccaaaaccaaaggacaacugaggagacugcccagcacauaaugaauaa

SEQ ID NO: 298893 - RNA, 60 nt, hsa
guguggugugucuacugugagggugggcccugaggagaccugugggccaccuauugucua

SEQ ID NO: 298894 - RNA, 60 nt, hsa
uggugucuuucuccugggcuucuaucccugugaggagaggugcugucugcuggagccucu

SEQ ID NO: 298895 - RNA, 60 nt, hsa
agccugagccagagaaccagcucugaguccugaggagacacaggccuggggacagggagg

SEQ ID NO: 298896 - RNA, 60 nt, hsa
guuuggcaaucucacuaaccaccauuaaacugaggagagaacaaguguuugggguggcug

SEQ ID NO: 298897 - RNA, 60 nt, hsa
uccuuuucacccaccaccccgaucccuaggugaggagaagcggcuugaagcagggcucca

SEQ ID NO: 298898 - RNA, 60 nt, hsa
caaugacgugccuaccucuuagacauguugugaggagacuaugauauaacauguguaugu

SEQ ID NO: 298899 - RNA, 60 nt, hsa
ccuagagucucaggaacaagacaggugcacugaggagaugaaggccgggacccccugccc

SEQ ID NO: 298900 - RNA, 60 nt, hsa
ccagucagccuggaccccuaacacagaccaugaggagacgcugggaacuugugggacuca

SEQ ID NO: 298901 - RNA, 60 nt, hsa
ccagucagccuggaccccuaacaaagaccaugaggagaugcugggaacuuugggacucac

SEQ ID NO: 298902 - RNA, 60 nt, hsa
ggauucggcccaaacucagaacuguuccccugaggagaagcgguggccucuuugcagauc

SEQ ID NO: 298903 - RNA, 60 nt, hsa
uuggguguuuuguguugagacuggcugaaaugaggagacuuugaccaugugacgugucaa

SEQ ID NO: 298904 - RNA, 60 nt, hsa
uccagcuccagccaccaccaggcugagcagugaggagagaaaguuucugccuggcccugc

SEQ ID NO: 298905 - RNA, 60 nt, hsa
uccaaagcucagcacaguuuccuccugggaugaggagaggaaucagaaaccccacuuugg

SEQ ID NO: 298906 - RNA, 60 nt, hsa
acuaacccuugccuagauuuaaggccacugugaggagagggguugccccagaaggcaggg

SEQ ID NO: 298907 - RNA, 60 nt, hsa
cuuugaguaccaaauccacaagccauuuuuugaggagagugaaagagaguaccaugcugg

SEQ ID NO: 298908 - RNA, 60 nt, hsa
gcgggcccugagccugcggcucuuccagacugaggagaagaucgagcgaacccagcggga

SEQ ID NO: 298909 - RNA, 60 nt, hsa
uauuuuuaaauaaaagacgucguucugagcugaggagagucccguggacaucggagguca

SEQ ID NO: 298910 - RNA, 60 nt, hsa
gaauguaaguuuggcgauaaaauaguguguugaggagacuuaauuguauccaaggcaggu

SEQ ID NO: 298911 - RNA, 60 nt, hsa
uauugcugcugggcacaucugugcucuuggugaggagagcaagaggaaccagaagaaguc

SEQ ID NO: 298912 - RNA, 60 nt, hsa
gaaaaugaugcaauguaugaaaaacugcuuugaggagaaaaacaacacaguguguuuuug

SEQ ID NO: 298913 - RNA, 60 nt, hsa
gagugcuucaagcagagcauggugggucauugaggagacccaggaaucucaucugagaac

SEQ ID NO: 298914 - RNA, 60 nt, hsa
ugguguaggaaaugagacccucucugaagcugaggagagcacguugaucugaacuuuaaa

SEQ ID NO: 298915 - RNA, 60 nt, hsa
agaaggugcagauucaaagugagcggcuccugaggagagccgccaaggcugcucgccuuc

SEQ ID NO: 298916 - RNA, 60 nt, hsa
gagcaguugacucacugaugaaggcccuggugaggagaaagcacucuguucuucgccuac

SEQ ID NO: 298917 - RNA, 60 nt, hsa
uaaugcucuuccgaauaaagugcugaacugugaggagagaggcggacugugaggcagcca

SEQ ID NO: 298918 - RNA, 60 nt, hsa
cacccacuguggacuggggcagagagauuuugaggagaaugaaauccagaaacucugugu

SEQ ID NO: 298919 - RNA, 60 nt, hsa
aacacagggaagucgguuugacuuuugucaugaggagaacugaccagcccucaucauucc

SEQ ID NO: 298920 - RNA, 60 nt, hsa
aucuacggagucuucuaagagauuuugcaaugaggagaagcauuguuuucaaacuauaua

SEQ ID NO: 298921 - RNA, 60 nt, hsa
ucccagcugcccgcaggggguucccccugcugaggagagaccagguggaccccagcugcc

SEQ ID NO: 298922 - RNA, 60 nt, hsa
acgaguccugaggagagaaccggugcguccugaggagagaaccggcgcugggcaacacgg

SEQ ID NO: 298923 - RNA, 60 nt, hsa
ccagggcgcgggggccgccagccgcacuucugaggagaccagcagucaugcaucgugcac

SEQ ID NO: 298924 - RNA, 60 nt, hsa
agcuauguaucgggaaccaugaucuauuuaugaggagaaggaaagccgauucuuuggaag

SEQ ID NO: 298925 - RNA, 60 nt, hsa
aacaauggccaacgaagcacugaugcggucugaggagacagcugaccuguuggcugaaaa

SEQ ID NO: 298926 - RNA, 60 nt, hsa
guaggguuccuuagagaagugacauggccuugaggagauucagggcaccuuuccucagug

SEQ ID NO: 298927 - RNA, 60 nt, hsa
ccccugcccuacgugcacuacaggaaggggugaggagagcagccagaggaaaaccagccc

SEQ ID NO: 298928 - RNA, 60 nt, hsa
ucuuucucagccagguuucccaggaugcccugaggagaaccaucuucccucuggggggau

SEQ ID NO: 298929 - RNA, 60 nt, hsa
cacuguggcuccaggaggcccuugggagcaugaggagagcuggacucgcucaucuguucu

SEQ ID NO: 298930 - RNA, 60 nt, hsa
aaaaagaauguucgauuugauacuuaaacuugaggagaggcagagagaggucugggaacu

SEQ ID NO: 298931 - RNA, 60 nt, hsa; identical to SEQ ID NO: 298921

SEQ ID NO: 298932 - RNA, 60 nt, hsa
gcgggaccuccaggggcgacucuaguggccugaggagauguauuuauaggcccccagcag

SEQ ID NO: 298933 - RNA, 60 nt, hsa
agcuaggacaggucuggcagggccuuugccugaggagaguguguagggucucccaacguc

SEQ ID NO: 298934 - RNA, 60 nt, hsa
guaggcaaccaccuucaccuucacacagauugaggagacacuggacuuuuuacccauuuu

SEQ ID NO: 298935 - RNA, 60 nt, hsa
cagggggccuuggccaggucaaggguucugugaggagaggacccaggagugugggggcau

SEQ ID NO: 298936 - RNA, 60 nt, hsa
ccaugugggucagauguacucucugucacaugaggagagugcuaguucauguguucucca

SEQ ID NO: 298937 - RNA, 60 nt, hsa
gcucaaaugcgaugacccccucuguccuccugaggagaggcuguaggcugugccugucgc

SEQ ID NO: 298938 - RNA, 60 nt, hsa
gacacaccuguaucccagagagcaaagugaugaggagacugagcguccccagccccaccu

SEQ ID NO: 298939 - RNA, 60 nt, hsa
aguuguacugguuagauucauuagguugaaugaggagaggggcuuaccuguucucuaguu

SEQ ID NO: 298940 - RNA, 60 nt, hsa
cauguaacgaaacacuucaauaauuguccaugaggagaaaaaaagcaugugucaugcaug

SEQ ID NO: 298941 - RNA, 60 nt, hsa
caauuuucuugaugccucugcaagauacugugaggagaauugacagcaaaaguucaccac

SEQ ID NO: 298942 - RNA, 60 nt, hsa
augggguugaagcagcccacugagccaaguugaggagacuggaggaaaagagagcugguc

SEQ ID NO: 298943 - RNA, 60 nt, hsa
gagaggacugguucugaggccagaaaggugugaggagagaggaggaaaagucuuccuaau

SEQ ID NO: 298944 - RNA, 60 nt, hsa
auuaaaauuugaacauuauggugauuauggugaggagaaugggauauuaacauaaaauua

SEQ ID NO: 298945 - RNA, 60 nt, hsa
aauuuaaaaugcuguugaauaugauacuuuugaggagagagugugcucagaacuuagacg

SEQ ID NO: 298946 - RNA, 60 nt, hsa
uccagaugcuacuaucauucacgauggccaugaggagaagauggaaaauggucagaucac

SEQ ID NO: 298947 - RNA, 60 nt, hsa
ccugccugggucuccacauccccagcuguaugaggagagcuucaggccccaggacugugg

SEQ ID NO: 298948 - RNA, 60 nt, hsa
ugagcuccuggaaauaguagaauuaagaccugaggagaugacucgucaucucuuaugcuu

SEQ ID NO: 298949 - RNA, 60 nt, hsa
gguaggauguuuccuagaccauuuggggucugaggagaaacaggcuggggccucgagaag

SEQ ID NO: 298950 - RNA, 60 nt, hsa
uucaucccccgcuagagcuggaaggcaggaugaggagagguaugaaggagccugagccau

SEQ ID NO: 298951 - RNA, 57 nt, hsa
cccugauuucagacacuuagccugugaugaggagagaguggaagaagcaaaacugcu

SEQ ID NO: 298952 - RNA, 60 nt, hsa
auggcuguggaaaaacgaauuaaaauguuuugaggagaaagacuuuuucacuucuuuguu

SEQ ID NO: 298953 - RNA, 60 nt, hsa
acaccccaaaugcauaaucucguuaaugauugaggagagaaaaggaucagauugcuguuu

SEQ ID NO: 298954 - RNA, 60 nt, hsa
caugauugcaauggagggcaaaugcgucccugaggagaaaaucugggaggagcugagugu

SEQ ID NO: 298955 - RNA, 60 nt, hsa
cacagggcuuuguuagcagagagaagccccugaggagaagggacgcuuuucuuccuucug

SEQ ID NO: 298956 - RNA, 60 nt, hsa
ccuucucucgcgcgccuauugauuuguuucugaggagaguacaccguucacuauuguaga

SEQ ID NO: 298957 - RNA, 60 nt, hsa
gaccaucuuguuccagccucugaagacaguugaggagaucaagcccagcaaugguggcag

SEQ ID NO: 298958 - RNA, 60 nt, hsa
uuccuuccaauauaacuaggcaaaaagaagugaggagaaaccugcaugaaagcauucuuc

SEQ ID NO: 298959 - RNA, 64 nt, hsa; identical to SEQ ID NO: 254984

SEQ ID NO: 298960 - RNA, 64 nt, hsa; identical to SEQ ID NO: 254985

SEQ ID NO: 298961 - RNA, 64 nt, hsa; identical to SEQ ID NO: 255009

SEQ ID NO: 298962 - RNA, 64 nt, hsa; identical to SEQ ID NO: 255010

SEQ ID NO: 298963 - RNA, 64 nt, hsa; identical to SEQ ID NO: 255053

SEQ ID NO: 298964 - RNA, 64 nt, hsa; identical to SEQ ID NO: 255054

SEQ ID NO: 298965 - RNA, 64 nt, hsa; identical to SEQ ID NO: 255069

SEQ ID NO: 298966 - RNA, 64 nt, hsa; identical to SEQ ID NO: 255070

SEQ ID NO: 298967 - RNA, 64 nt, hsa; identical to SEQ ID NO: 255075

SEQ ID NO: 298968 - RNA, 64 nt, hsa; identical to SEQ ID NO: 255076

SEQ ID NO: 298969 - RNA, 64 nt, hsa; identical to SEQ ID NO: 255122

SEQ ID NO: 298970 - RNA, 64 nt, hsa; identical to SEQ ID NO: 255123

SEQ ID NO: 298971 - RNA, 64 nt, hsa; identical to SEQ ID NO: 255160

SEQ ID NO: 298972 - RNA, 64 nt, hsa; identical to SEQ ID NO: 255161

SEQ ID NO: 298973 - RNA, 64 nt, hsa; identical to SEQ ID NO: 255171

SEQ ID NO: 298974 - RNA, 64 nt, hsa; identical to SEQ ID NO: 255172

SEQ ID NO: 298975 - RNA, 64 nt, hsa
uccucccuuuuuccuuguccccacacuccuacaccuaacucaccuaacucauacugugcuggag

SEQ ID NO: 298976 - RNA, 64 nt, hsa
uuuccuuguccccacacuccuacaccuaacucaccuaacucauacugugcuggagccacuaacu

SEQ ID NO: 298977 - RNA, 64 nt, hsa
agucaguaauucucuuacauccuucccaaaaaucagugucuagggacuaguugaucuggaugag

SEQ ID NO: 298978 - RNA, 64 nt, hsa
gucaguaauucucuaaaaauccuucccaaaaaucagugucuagggacugguugaucuagaugag

SEQ ID NO: 298979 - RNA, 64 nt, hsa; identical to SEQ ID NO: 179944

SEQ ID NO: 298980 - RNA, 64 nt, hsa; identical to SEQ ID NO: 179945

SEQ ID NO: 298981 - RNA, 64 nt, hsa
accuggagaauguuuuugcgugggaugaugugcuggucaggagccccuugggcaucgcuucccc

SEQ ID NO: 298982 - RNA, 64 nt, hsa
cacagugagcagguggccccagcuggguuucccaggucaggaaugugggccccaggcaaggugc

SEQ ID NO: 298983 - RNA, 64 nt, hsa
ccuucccagagucccccgggugcuccccugccgaggucaggagcugaccaagccuuggcccggu

SEQ ID NO: 298984 - RNA, 64 nt, hsa
gagggccugccugggacugagggggccagggcugggucaggauucaccagcuuguguugcagac

SEQ ID NO: 298985 - RNA, 64 nt, hsa
agcacuuugggaggccgaggcggguggaucacgaggucaggagaucgagaccauccuggcuaac

SEQ ID NO: 298986 - RNA, 64 nt, hsa
agcacuuugggaggccaaggugggcggaucacaaggucaggagaucgagaccauccuggcgaac

SEQ ID NO: 298987 - RNA, 64 nt, hsa
uacuuugggaggccgaggcagguggaucaccugaggucaggaguucgagaccagccugaccaac

SEQ ID NO: 298988 - RNA, 64 nt, hsa
gcacucugggaggccaaggcagaugaucaccugaggucaggaguucuagaccagccuggcuaac

SEQ ID NO: 298989 - RNA, 64 nt, hsa
agcacuuugggaggccgaggugggcagaucacgaggucaggaguuugagaccagccugaccaac

SEQ ID NO: 298990 - RNA, 64 nt, hsa
cacuuugggaggcugaggcgggcagaucgcuugaggucaggaguucaagaccagcccgggcaac

SEQ ID NO: 298991 - RNA, 64 nt, hsa
uacuuugggaggccgagucagguggaucaccugaggucaggaguucaagaccagccuggccaac

SEQ ID NO: 298992 - RNA, 64 nt, hsa
agcacuuugggaggccgagaugggugaaucaugaggucaggaguucgagaccagccuaaacaac

SEQ ID NO: 298993 - RNA, 64 nt, hsa
ucagcuggcugggucaaggcaccauguguuacuuggucaggacagagacaaaaaugaggaaaac

SEQ ID NO: 298994 - RNA, 64 nt, hsa
ccagcaucucccacccacccagcuagggcagaggggucaggaugucuguuugccucuuagagac

SEQ ID NO: 298995 - RNA, 64 nt, hsa
guggaggccacguagaagggggcagaggagggguggucaggaugggcuggggggcccacuagca

SEQ ID NO: 298996 - RNA, 64 nt, hsa
cacuguaggcggccgaggugggugaaucacaugaggucaggaguucaagaccagccugaccaac

SEQ ID NO: 298997 - RNA, 64 nt, hsa
cacuaugggaggccagggagggaggaucuccagaggucaggaguucgagaccagccuggccaac

SEQ ID NO: 298998 - RNA, 64 nt, hsa
cacuuugggaggccgaggcaggaggaucaccugaggucaggaguuugagaccagucuggccaaa

SEQ ID NO: 298999 - RNA, 64 nt, hsa
ucucccugccucucucucugggggcgauggggaaggucaggaguccagcccauucccagggugu

SEQ ID NO: 299000 - RNA, 64 nt, hsa
cacuuugggaggccgaggcagacagaucaccugaggucaggaguuugagaccagccuggccaac

SEQ ID NO: 299001 - RNA, 64 nt, hsa
agcacuuugggaggccaaggcgggcagaucacgaggucaggaguuucagaccaauauggugaaa

SEQ ID NO: 299002 - RNA, 64 nt, hsa
augcggucgugcacacgcgcuagguagcagcgucggucaggacugucucgaggccacacucgcu

SEQ ID NO: 299003 - RNA, 64 nt, hsa
gcaggauuaugcgaucacggaucagucagagcagggucaggagacggggcugacggcacgggug

SEQ ID NO: 299004 - RNA, 64 nt, hsa
cacuuugggaggcaggggcggguggaucaccugaggucaggaguucaagacuagccuggccaac

SEQ ID NO: 299005 - RNA, 64 nt, hsa
cacuuugagaggcugaggugguaggaucaccugaggucaggaguucaagaccagccuguccaac

SEQ ID NO: 299006 - RNA, 64 nt, hsa
agauaccuauggagaggggaaguaaaacaccuuaggucaggaauaauaaaccaaugaguuagcu

SEQ ID NO: 299007 - RNA, 64 nt, hsa
cccuuugggaggcugagguggguguaucacuugaggucaggaguucaagaccaaucuggccaac

SEQ ID NO: 299008 - RNA, 64 nt, hsa
uugggaggcugaggcgggugaaucacuugauugaggucaggaguucgagaccagccuggccaac

SEQ ID NO: 299009 - RNA, 64 nt, hsa
cacuuugcaaggccgaggaggguggaucacuugaggucaggaguucgagaccagccugaccaac

SEQ ID NO: 299010 - RNA, 64 nt, hsa
cacuuugguagaccgaagugggcagaucaccugaggucaggaguucacgaccagccuggccaac

SEQ ID NO: 299011 - RNA, 64 nt, hsa
agcacuuugggaggcugaggugaguggauuacaaggucaggaguuccagaccagccuggcuaau

SEQ ID NO: 299012 - RNA, 64 nt, hsa
aacagacucaaugucccccucacccccaccucaaggucaggaugagaacacacugagugaggag

SEQ ID NO: 299013 - RNA, 64 nt, hsa
cacuuugggaagcugaggcaggaggauccccugaggucaggaguucgagagcagccuggccaac

SEQ ID NO: 299014 - RNA, 64 nt, hsa
cacuuugggaggccaaggcugguggaucaccugaggucaggaguucgagaccagccuggccaac

SEQ ID NO: 299015 - RNA, 64 nt, hsa
cacuuugggaggcuuaggcggcuggaucaccugaggucaggaguucaagaccagccuggucaac

SEQ ID NO: 299016 - RNA, 64 nt, hsa
cacuuuggcaggccgagaugggcggaucuuuugaggucaggaguuugagaccagccuggccaac

SEQ ID NO: 299017 - RNA, 64 nt, hsa
agacuuuggaaauuuccuuucucuuuuaggacagggucaggauuuaggacucauagccugaaag

SEQ ID NO: 299018 - RNA, 64 nt, hsa
ccuugguggggucugucuuuuccuugaggucagaggucaggagcagggcuggggucaggaugac

SEQ ID NO: 299019 - RNA, 64 nt, hsa
uuuccuugaggucagaggucaggagcagggcuggggucaggaugacgaggccugggguccuggu

SEQ ID NO: 299020 - RNA, 64 nt, hsa
cacuuugggaggcugaggcaggcggaucacuugaggucaggagcucgagaccagccuggccaac

SEQ ID NO: 299021 - RNA, 64 nt, hsa
cauuuugggaggccaaggcgggcggaucacuugaggucaggagcucaagaccagccuggccaac

SEQ ID NO: 299022 - RNA, 64 nt, hsa
agcacuuugggaggccgaggcagguggaucacaaggucaggagauagagaccaucauugcuaac

SEQ ID NO: 299023 - RNA, 64 nt, hsa
gagacuucagggcuugucacuuucagaguguggaggucaggauggcugcgggcaaugaagccuu

SEQ ID NO: 299024 - RNA, 64 nt, hsa
cacuuuaggaguccaaggcgggcggaucacuugaggucaggaguucaagaccagcuuggccaag

SEQ ID NO: 299025 - RNA, 64 nt, hsa
agcacuuugggaggccaaggugggcggaucacaaggucaggaguucgagaccagccuggccaau

SEQ ID NO: 299026 - RNA, 64 nt, hsa
agcacuuugggaggccgaggcgggcggaucacaaggucaggaguucgagaccauccugucuaac

SEQ ID NO: 299027 - RNA, 64 nt, hsa
cacauugggaggcugaggugggcggaucaccugaggucaggaguucaagaccagccuggccaac

SEQ ID NO: 299028 - RNA, 64 nt, hsa
cacuuugggaggccaaggcgggcggaucagcugaggucaggaguuggagaccagcguggccaac

SEQ ID NO: 299029 - RNA, 64 nt, hsa
aacacuuugggaggcugaggcaggcggaucacgaggucaggagaucgagaccauccuggccaac

SEQ ID NO: 299030 - RNA, 64 nt, hsa
ucacucugaagccaaagcugggcucaguggggaaggucaggaauggagaaauugccuuuucucg

SEQ ID NO: 299031 - RNA, 64 nt, hsa
cacuuugggaggccaaggcggacagaccaccugaggucaggaguucgaaaccagccuggccaac

SEQ ID NO: 299032 - RNA, 64 nt, hsa
agcucuuugggaggccgaggugggcagaucacgaggucaggagaucgagaccauccuggcuaac

SEQ ID NO: 299033 - RNA, 64 nt, hsa
gcuccugucuucccagacccaccaugccuggagaggucaggauggaacuaccucauucggcaaa

SEQ ID NO: 299034 - RNA, 64 nt, hsa
ucacgccuguaaucccagcacuuugggaggccgaggucaggaguuagagaccauucugaccaau

SEQ ID NO: 299035 - RNA, 64 nt, hsa
agcacuuugggaggccgaggcgggcggaucacuaggucaggaaauggagaccauccuggccaac

SEQ ID NO: 299036 - RNA, 64 nt, hsa
uuugggaggucgggggggugggggaggaucacggggucaggagaucgagaccauccuggccaac

SEQ ID NO: 299037 - RNA, 64 nt, hsa
agcacuaugggaggccgagacgggcggaucacgaggucaggagacugagaccauccuggcuaac

SEQ ID NO: 299038 - RNA, 64 nt, hsa
agcacuuugggagacugaggcgggcggaucaugaggucaggagaucgcgaccauccuggcuaac

SEQ ID NO: 299039 - RNA, 64 nt, hsa
agcucuuugggaggccaaggcagguagaucacaaggucaggaaauugagaccauccuggcuaau

SEQ ID NO: 299040 - RNA, 64 nt, hsa
cugggcgguggccgggcgugguggcucacgcugaggucaggaguucgagaccagccuggccaac

SEQ ID NO: 299041 - RNA, 64 nt, hsa
cacuuugggaggccgaggugggcagaucagcugaggucaggagaucgagaccagccuggccaac

SEQ ID NO: 299042 - RNA, 64 nt, hsa
gggcuaggacugugggcuuuuagcagcccacaggugauccuaacauaucaggccauggacucag

SEQ ID NO: 299043 - RNA, 64 nt, hsa
uuuuguucuggccuucuguacugaucuguguuccugauccuaauuccuaucugucuaacgugga

SEQ ID NO: 299044 - RNA, 64 nt, hsa
aguuccucauuagcauuuugcuaaaugugaaugaugauccuaggcauuugcugaauacagaggc

SEQ ID NO: 299045 - RNA, 64 nt, hsa
uugaggguggcugggaaugugauauacagcacccugauccuaacaggugugauuguuacguaag

SEQ ID NO: 299046 - RNA, 64 nt, hsa
agguaacuuggguccucuuccauugcaguccugaugauccuaaccugcagcacggugguuuuac

SEQ ID NO: 299047 - RNA, 64 nt, hsa
ccgcgcccggcccaaucauguguuuuuguugaaaugauccuaccagugauuaguggcuauugag

SEQ ID NO: 299048 - RNA, 64 nt, hsa
agagacacacuggcagguuaggcaguccuucuggugauccuauuccauucccuccugcugcggu

SEQ ID NO: 299049 - RNA, 64 nt, hsa
aaaaugacuggcgugaugccuggaaccaaggugcugauccuaccaccuacugcuaccuuccuua

SEQ ID NO: 299050 - RNA, 64 nt, hsa
ggaauucacuuauugagaaugaaagugaaggggaugauccuaaugucuuagaaagcuagauuac

SEQ ID NO: 299051 - RNA, 64 nt, hsa
cacacagaaacauugcugguuucaagaaaugaggugauccuauuaucaaauucaaucugauguc

SEQ ID NO: 299052 - RNA, 64 nt, hsa
aaauagaagugauaguaguagguaaaaguuagagugauccuacuauaugacggaaacuuuggcu

SEQ ID NO: 299053 - RNA, 64 nt, hsa
cugugccccaccuguuguccugaacugugaguccugauccuaacccugggcucccuggaggacu

SEQ ID NO: 299054 - RNA, 64 nt, hsa
ucuauucaucugcacaaaauucugaagagucacaugauccuaagaggaaaguucuguucuauuu

SEQ ID NO: 299055 - RNA, 64 nt, hsa
aaguuaaacaaauugauuuacuucagagcaaauaugauccuauuaaaauaauauaggguaaaua

SEQ ID NO: 299056 - RNA, 64 nt, hsa
ccauauguuuugagaauuuguaaagugagagacaugauccuauuaaaauaagaaggcaaaaaug

SEQ ID NO: 299057 - RNA, 64 nt, hsa
gcaugcagcuugcagccccucuuucucacacgugugauccuagcgugagaggucauccugcccu

SEQ ID NO: 299058 - RNA, 64 nt, hsa
aucagcaaauguggugccugauuauagaaauuugugauccuauauacaauauaggacuuuuaaa

SEQ ID NO: 299059 - RNA, 64 nt, hsa
cuuuuuaucuugggugccuagcauucuguuuuuuugauccuaugucauaauuuuuugagaaaau

SEQ ID NO: 299060 - RNA, 64 nt, hsa
gauggcuccauucccaaguaccccaacucacugcugauccuauuaaaggaaugaguccugcuac

SEQ ID NO: 299061 - RNA, 64 nt, hsa
gacaguucuaaaucggggcuugauuuuucaucuaugauccuagauguucuccugaaagaaugac

SEQ ID NO: 299062 - RNA, 64 nt, hsa
aagacuaaauuuugauaacuaauauuauccuuauugauccuauugaucuuaagguauuuacaug

SEQ ID NO: 299063 - RNA, 64 nt, hsa
auuuuaaauauccacaguacucacuuuuuccaaaugauccuaguaauugccuagaaauaucuuu

SEQ ID NO: 299064 - RNA, 64 nt, hsa
gacagagcagaacuuucaccuucauauauuuguaugauccuaaugaaugcauaaaauguuaagu

SEQ ID NO: 299065 - RNA, 64 nt, hsa
gucacaguauagagccugcagucucaacucauugugauccuaauggucugggugauuggauggu

SEQ ID NO: 299066 - RNA, 64 nt, hsa
auuggugggaccaaggauguuuugcaggaugcccugauccuaagaagggggccugggggugcgu

SEQ ID NO: 299067 - RNA, 64 nt, hsa
uuucuauaaauauauuuuuaggaaaaaaagucagugauccuaauuguaucacauuauaagaaag

SEQ ID NO: 299068 - RNA, 64 nt, hsa
ucaugcuuaaguacaaauuccaugaaaagcucacugauccuaauucuuucccuuugaggucucu

SEQ ID NO: 299069 - RNA, 64 nt, hsa
ugagccuguuuccacaccuguaaaguggggaugaugauccuaucucacugcuuuugugaggauu

SEQ ID NO: 299070 - RNA, 64 nt, hsa
aucuuaaucuaagcuccaaaguugucuacuuuuuugauccuagggugcuccuuuuguuuuacag

SEQ ID NO: 299071 - RNA, 64 nt, hsa
cuggaccuccauuuuucccuguaaauucuccaacugauccuacccucccuacuccugcacccca

SEQ ID NO: 299072 - RNA, 64 nt, hsa
aaauucuuugaauauuuuguuucuuggaacccaaugauccuaagaaaauuauguacuuuuaccu

SEQ ID NO: 299073 - RNA, 64 nt, hsa
aauauuguuuaaugucugaauaugaaagaguucuugauccuaaagaaauuuaguggcacagaaa

SEQ ID NO: 299074 - RNA, 64 nt, hsa
uggucauuaacagggacaugccucaugauccuuuugauccuaugacugacaucaacuaaaauuu

SEQ ID NO: 299075 - RNA, 64 nt, hsa
agaugauaaccuaacacuaucauaguuauuaaugugauccuaaaauuguuuccuaaaucagcau

SEQ ID NO: 299076 - RNA, 64 nt, hsa
uagauaaaaacaucuccaaaaaggauuuugaagcugauccuauuuaguuaaaaagauaauuuug

SEQ ID NO: 299077 - RNA, 64 nt, hsa
aauucugauuagccugcguccacacagugaucgaugauccuaugugccuagaaaggacacugug

SEQ ID NO: 299078 - RNA, 64 nt, hsa
agaauuuuucagcacuuaacuacuuuguuggcauugauccuagugucuuuaaauacuucaugag

SEQ ID NO: 299079 - RNA, 64 nt, hsa
ucuagguaaaaagauggaaaaaaauuguauuaugugauccuaaggacaggaauagcagaccagc

SEQ ID NO: 299080 - RNA, 64 nt, hsa
gcaaguuaacuuggaaaucaguagaaagcuaaagugauccuaaauaugacagugggcagcaccu

SEQ ID NO: 299081 - RNA, 64 nt, hsa
aaggagccacggaagaaaugauaaucucuaaauaugauccuaucuuuugaaaaccacuuuuaga

SEQ ID NO: 299082 - RNA, 64 nt, hsa
ucacguacaacuuucuuugccuuccaaguagaggugauccuaacaauuggcaugaugcuuuucu

SEQ ID NO: 299083 - RNA, 64 nt, hsa
gaauucaaagaugucgguugggagaaacuagcucugauccuaacaggccacguuaaacugccca

SEQ ID NO: 299084 - RNA, 64 nt, hsa
caaguacaugccaauguuguuuaagaaacaguuaugauccuaaacuuuuuggauaaucuuuuau

SEQ ID NO: 299085 - RNA, 64 nt, hsa
uuaaaaauuauccagguguaauggugugcaccugugauccuagcuacuugggaggcugaggugg

SEQ ID NO: 299086 - RNA, 64 nt, hsa
ugaaaaaugucucauacauauuuugcagcuaucaugauccuaguucaaugcuaggcaaauaaug

SEQ ID NO: 299087 - RNA, 64 nt, hsa
ucagaucacuuucaaauugcccaaggaaauauugugauccuaagaauauuaagauaauuuuagg

SEQ ID NO: 299088 - RNA, 64 nt, hsa
augguaaaaauaacuugcauuugccuuaccaucaugauccuacuguugaguuaggaaaauaugg

SEQ ID NO: 299089 - RNA, 64 nt, hsa
uuagauugaugacuucugugaauagaaaucauccugauccuauuuuaccuggccuccagggccu

SEQ ID NO: 299090 - RNA, 51 nt, hsa
gugaguauggcaaaacuuaauugauccuacaagcuuacuacacauaggaaa

SEQ ID NO: 299091 - RNA, 64 nt, hsa
auggaacguauuuauuugaaagcauuaaaauaaaugauccuagagcaugugcauaaugagagga

SEQ ID NO: 299092 - RNA, 64 nt, hsa
aaagaucagaugaaacagaagaugauaguaaaagugauccuaaguaagaacauaauguaaaauu

SEQ ID NO: 299093 - RNA, 64 nt, hsa
uugggcggcaucgcaucaacgcgcagaccuaaacugauccuaaagcccccgguucccuuguggg

SEQ ID NO: 299094 - RNA, 64 nt, hsa
aacaagacugacugggcgugguggcucaugccugugauccuagcacuuugcgaggccgaggugg

SEQ ID NO: 299095 - RNA, 64 nt, hsa
gacuacaugaaauugugugccccuauuuucuuucugauccuaaaucauuuuguuuuauaaauca

SEQ ID NO: 299096 - RNA, 64 nt, hsa
uguuucuccuauacuuuguccuuaacaucuuucuugauccuaaauauauaucucguaacaagau

SEQ ID NO: 299097 - RNA, 64 nt, hsa
uaccgggcauucccugaagcccccucauaggcagugauccuagaccaaacucuuaaauagaauc

SEQ ID NO: 299098 - RNA, 64 nt, hsa
accccaacuguuuauauuuggauucuaugcacugugauccuaagguuaacagcaugaauuaaca

SEQ ID NO: 299099 - RNA, 64 nt, hsa
gaccuuugagaggauuugaaauugcuucauauugugauccuaaauuuuauauucacuauauucc

SEQ ID NO: 299100 - RNA, 64 nt, hsa
cugcuguucguacacagaaacaggacugcucaaaugauccuauuuguauuuucugaugcuauca

SEQ ID NO: 299101 - RNA, 64 nt, hsa
uauuagcaagaaauaagaauaguauuagaagaauugauccuauuuugaaccccucuccaguauc

SEQ ID NO: 299102 - RNA, 64 nt, hsa
uucuugagcgaucuaauguuucuuguaauauugaugauccuacuaauuauccugcuguucuuua

SEQ ID NO: 299103 - RNA, 64 nt, hsa
gaucauacaaauaaucuaagauuauacagucuagugauccuagauuacacaaguaaucuaagcu

SEQ ID NO: 299104 - RNA, 64 nt, hsa
aggguuauugacacuagagaaaugaauucucauuugauccuaauuuuccccguauucuacuuga

SEQ ID NO: 299105 - RNA, 64 nt, hsa
cuguuauuacauuaguauauuacguuauuuauuaugauccuaguugauggccuaaauaaacacc

SEQ ID NO: 299106 - RNA, 64 nt, hsa
ugcuaauaccaaaagugaaagaggccaucauagcugauccuauggucaccaaaaggauuagaaa

SEQ ID NO: 299107 - RNA, 64 nt, hsa
acggugaaaauaaaagaguuuuacuucucuggacugauccuauucacagcuuccucaugaacuu

SEQ ID NO: 299108 - RNA, 64 nt, hsa
uucgucgguggcuuaaaguaacaucuauuuccauugauccuagguucuuccugacugcuuucuc

SEQ ID NO: 299109 - RNA, 64 nt, hsa
ccugcaugugggcuccucaguuauugaguuuuugugauccuaucucagucugggggggaacauu

SEQ ID NO: 299110 - RNA, 64 nt, hsa
uuuggaaaucagcaucgugggcacugcugaggaaugauccuagugguaggucagaagaagaugc

SEQ ID NO: 299111 - RNA, 64 nt, hsa
aagaaauuugggaugcaaaguaccuaaagaucucugauccuaagaaguuacuucuggccaggcg

SEQ ID NO: 299112 - RNA, 64 nt, hsa
uagggagauucugacaaacuucuacucuugauugugauccuaauucaaggaauaucaaguccca

SEQ ID NO: 299113 - RNA, 64 nt, hsa
acaacggaacccccuuucccugcccuccagagacugauccuagccaggcaccuuaggaguauag

SEQ ID NO: 299114 - RNA, 64 nt, hsa
gaaguuaucaguggcuagugaggucccagcucccugauccuaugcucuauuuaaaagauaaccu

SEQ ID NO: 299115 - RNA, 64 nt, hsa
aaaaagucaugcaacauguuucuggacacguuccugauccuauugcgauaauguaugugugccc

SEQ ID NO: 299116 - RNA, 64 nt, hsa
uagggacagagccuagugguaaauccaagagaaaugauccuauccaaagcugauucacaaaccc

SEQ ID NO: 299117 - RNA, 64 nt, hsa
caucaaaaagguaucaaaugccuuggaagcucccugauccuacaaaacaaaaaaaugcuuauuu

SEQ ID NO: 299118 - RNA, 64 nt, hsa
auuccagauacauuccuuuuacugaaccuugaauugauccuaagauugguaguaaagguauuau

SEQ ID NO: 299119 - RNA, 64 nt, hsa
gaaaaagaaaaaaagcuuaagucuguagucuuuaugauccuaaaagggaaaauugccuugguaa

SEQ ID NO: 299120 - RNA, 64 nt, hsa
auuuacaaaguccuuuuacaucuguuuuuucauuugauccuaucgacaaucauaauaauaauaa

SEQ ID NO: 299121 - RNA, 64 nt, hsa
uuuuauacuucuuccauuauuaaucuuuaaaucaugauccuaauuagcuguccuuacuuuaacu

SEQ ID NO: 299122 - RNA, 64 nt, hsa
acauauuagugcaauccaguccagauuggaccuuugauccuauguggaagggcuguuuuuuaag

SEQ ID NO: 299123 - RNA, 64 nt, hsa
aggaacaagcagaagaugccugcagguaucacuuugauccuaugugggagcgacugaaaauaga

SEQ ID NO: 299124 - RNA, 64 nt, hsa
gcuuucugaguacgucucuuggggucgcuggaggugauccuaggaucugucucugagaccaaug

SEQ ID NO: 299125 - RNA, 64 nt, hsa
gcuggguuggggacagggaguaucacuccauaagugauccuaaaagguagccucuucauaggaa

SEQ ID NO: 299126 - RNA, 64 nt, hsa
ggucuacacugugcugagucugaaggcuggguucugauccuaguuccaccaucaagccaccaac

SEQ ID NO: 299127 - RNA, 64 nt, hsa
gggcccugugcugucagaauucugccuugggaaaugauccuauagcugcugcuuuuucuugguc

SEQ ID NO: 299128 - RNA, 64 nt, hsa
gacucaggagucugccacuugucaaagaaggugcugauccuaagaauuuuucauucucagaauu

SEQ ID NO: 299129 - RNA, 64 nt, hsa
ggaggccucccacgaagggcgaagauggccgagaugauccuaaaaauaaccgaagaaagagagg

SEQ ID NO: 299130 - RNA, 64 nt, hsa
aucccaaaacuaccuuggcagguaguuuuaacucugauccuaacuuaacucaauagccauagau

SEQ ID NO: 299131 - RNA, 64 nt, hsa
auggaucuuggaagaaauuuugaaaucuucaauuugauccuaauauggauacauguuaaucuuc

SEQ ID NO: 299132 - RNA, 64 nt, hsa
auuauauggauuucuuuaaaaggauaugcccauuugauccuaaccuuuuagccugcucucuaga

SEQ ID NO: 299133 - RNA, 64 nt, hsa
aaaucaacuacaaguacaugggacuggugauaaaugauccuaaacuaucaagucaguuucaauu

SEQ ID NO: 299134 - RNA, 64 nt, hsa
cucuuucucaccuuucccaccucucuccccaaagugauccuaagaauguacaguugagcucagg

SEQ ID NO: 299135 - RNA, 64 nt, hsa
acuggagagacuguuccaaaccccaagaguugucugauccuagucuguucccuucugcuucuua

SEQ ID NO: 299136 - RNA, 64 nt, hsa
ugccggggcccacaggcagcccugccaccaguggugauccuauccaaagcggccuacagucucc

SEQ ID NO: 299137 - RNA, 64 nt, hsa
cuuccacuucagaagcuucugagagggaaugggaugauccuaccaguugccuuuucagaccuga

SEQ ID NO: 299138 - RNA, 64 nt, hsa
ccauguggccugcagagcccaaauaucuacugucugauccuacacagaaaaugugugugauccc

SEQ ID NO: 299139 - RNA, 64 nt, hsa
aaaaaauuuggccuggugugguggcucaugccugugauccuagcacuuugggaguuaaaauaca

SEQ ID NO: 299140 - RNA, 64 nt, hsa
acaggccuguagugguggagacacgcccaguggaugauccuacugcucccagcaaccucuacau

SEQ ID NO: 299141 - RNA, 64 nt, hsa
auaugucucgcuagugauguuuuuaugauaucccugauccuaacugaagagacaguuauuuaua

SEQ ID NO: 299142 - RNA, 64 nt, hsa
uauaauauauguaugcuaucuugauucaugaacuugauccuauuaauuuauaugcugauauugu

SEQ ID NO: 299143 - RNA, 64 nt, hsa
aaagucauccuccgucuaccagagcgugcacuugugauccuaaaauaagcuucaucuccgggcu

SEQ ID NO: 299144 - RNA, 64 nt, hsa
gucucacuguuacccaggcuggagugcaguggcgugauccuagcucacugcaaccuugaacuuc

SEQ ID NO: 299145 - RNA, 64 nt, hsa
uauaaguuuuccuuuuguccugggggugccugauugauccuaucucuucacccuucauucuuuc

SEQ ID NO: 299146 - RNA, 64 nt, hsa
uguagggugggcuuuuccauuuaaaggaaugugaugauccuagguucugaugagugauaggugg

SEQ ID NO: 299147 - RNA, 64 nt, hsa
ugacucacauuucuuuuacugugacacaauaaugugauccuaaaacuggcuuauccuugagugu

SEQ ID NO: 299148 - RNA, 64 nt, hsa
ugaaaauuauuucuuggggaugccuuuuaauauuugauccuauuaugugagagauuuuccugau

SEQ ID NO: 299149 - RNA, 64 nt, hsa
gcccagccccaguacacucuucucuggaccagaucugucccaguccuggaugccuccuccuacu

SEQ ID NO: 299150 - RNA, 64 nt, hsa
uuccuccuccuuucuuugggaucccuggguugcccugucccaaccuccuuguuaggugcuuucc

SEQ ID NO: 299151 - RNA, 64 nt, hsa
gagcgucugucuuuguauuucugcucuguucauucugucccacuuucuucauagacuccuuuuc

SEQ ID NO: 299152 - RNA, 64 nt, hsa
aggggcuugucugaaaagccacucuggaccuagccugucccagaagaggagaaugcacaagugu

SEQ ID NO: 299153 - RNA, 64 nt, hsa
aaggcaugcaugcgucacugguaguaggaggagccugucccagcuucaucuuguccugagauuu

SEQ ID NO: 299154 - RNA, 64 nt, hsa
caggguuccgugacuccagugggccagugguagccugucccagacaacuccgucaccccagcuc

SEQ ID NO: 299155 - RNA, 64 nt, hsa
guggaaaagaaaguacagaacaaacccugugucacugucccaaguugcuaagugaacagaacua

SEQ ID NO: 299156 - RNA, 64 nt, hsa
aaauugaaguuucagagcuacacaaacacuuuuucugucccaaccguucccucacagcaaagca

SEQ ID NO: 299157 - RNA, 64 nt, hsa
cuacuuucaaagcaaagaucagcagaaaaauuggcugucccaccuguggcaaaugcuggagccu

SEQ ID NO: 299158 - RNA, 64 nt, hsa
cuggcaaggcccuguugacuagcaauggccuuagcugucccacacaacucaguggccugaacac

SEQ ID NO: 299159 - RNA, 64 nt, hsa
cuacacacucgaaaaagagaaaccagcugcgguacugucccauuuuugucaucagcaccagugu

SEQ ID NO: 299160 - RNA, 64 nt, hsa
aacuuguaugcuaggcacuuuuguccagagccugcugucccauggagaaaaaguuuuaagcacu

SEQ ID NO: 299161 - RNA, 64 nt, hsa
agcuucugccaggcaccucagagcaccagcuccccugucccagggccuaaccacagauccugga

SEQ ID NO: 299162 - RNA, 64 nt, hsa
gaacugggagugaggcucagagaaguugagggaccugucccagcaucacauggcugaugacaag

SEQ ID NO: 299163 - RNA, 64 nt, hsa
ugcgugcagugucuugccuugcuuucucuucuuacugucccacagcuugguuucauguuacaaa

SEQ ID NO: 299164 - RNA, 64 nt, hsa
cugucaccuugaagcauccuguucuccuucugugcugucccaggaagugucuggcgggcguggg

SEQ ID NO: 299165 - RNA, 64 nt, hsa
acuuccaucgcgucugucggguauuguuccuuaacugucccaucugugcagaguccauugcccc

SEQ ID NO: 299166 - RNA, 64 nt, hsa
aggacgaacaggugggacuuugcgagcucugugacugucccacguccaggagacaaggaaggua

SEQ ID NO: 299167 - RNA, 64 nt, hsa
uucuucccauugagguccuaggauuugcacaccacugucccacaagagcuuuccugccuaauga

SEQ ID NO: 299168 - RNA, 64 nt, hsa
gaggaggaauuucugcauggggcgugaaggcacacugucccaccacaacugaaccagaagagag

SEQ ID NO: 299169 - RNA, 64 nt, hsa
gaagaaccacugucuagagcaacuuuucuuggaacugucccagcuaccaagucagacaccaagg

SEQ ID NO: 299170 - RNA, 64 nt, hsa
auucaaggcucagaaggaauggugcguggcuucccugucccaguuguggcaacuaaaccaaucg

SEQ ID NO: 299171 - RNA, 64 nt, hsa
agaggagugcagccuucuccauaucuccauggcccugucccaggccggcccagauguguccccc

SEQ ID NO: 299172 - RNA, 64 nt, hsa
gagccgcggggaagcuggcuuugaaaccucagggcugucccagccccggcaagccacaggaagg

SEQ ID NO: 299173 - RNA, 64 nt, hsa
gggguacagccccucucuuccaaccgagaaguuccugucccagaauggacccagggacaagaga

SEQ ID NO: 299174 - RNA, 64 nt, hsa
cccucagagccccagcgcgccccuggcccugguucugucccagcugauggauggcuucuccaug

SEQ ID NO: 299175 - RNA, 64 nt, hsa
gccccagcagauggggcugggucaggaaccaucucugucccaggugcucagcccucauaugcau

SEQ ID NO: 299176 - RNA, 64 nt, hsa
ggaggccuuggaaccugagcugccaaugccagcccugucccaucugcagccacacuacucgcuc

SEQ ID NO: 299177 - RNA, 64 nt, hsa
ugacccuccuuuaucuugcaaaccccugccccugcugucccagggaggacgggcuucuguagag

SEQ ID NO: 299178 - RNA, 64 nt, hsa
auguugcugucgcuccuguuuuuaaccauauguucugucccauagcagucauucacacauguga

SEQ ID NO: 299179 - RNA, 64 nt, hsa
aaugugggcagagauuggaaugggcagcucaucucugucccacuuggcaucagcuggcgucaug

SEQ ID NO: 299180 - RNA, 64 nt, hsa
accaggcaaagcaagugauugggacagagguuaucugucccagguuaucugggcauagaugcag

SEQ ID NO: 299181 - RNA, 64 nt, hsa
guucucuccgucucaucggcaguauggggggcagcugucccagugucaauguuuacucaagggu

SEQ ID NO: 299182 - RNA, 64 nt, hsa
cagcauuuggccauguucuuuuguuuuucuauuccugucccaaaucaaagagcaugguucucag

SEQ ID NO: 299183 - RNA, 64 nt, hsa
gcccacacuucaggggcccagacuuacacccugacugucccaccuucuguccuuguccuggacc

SEQ ID NO: 299184 - RNA, 64 nt, hsa
cuccaagaccuggugucucccacugugagcccagcugucccacaggcaguccccauggaccuag

SEQ ID NO: 299185 - RNA, 64 nt, hsa
ccuugccucuaugaaccucugcugggcccagccccugucccagcucccgaccugcacuuccugc

SEQ ID NO: 299186 - RNA, 64 nt, hsa
ccagggcuauagggugugaugaagucaccccuuucugucccacuacaucugggacugacuuucc

SEQ ID NO: 299187 - RNA, 64 nt, hsa
uccugcgcccugugcccgacugacuggaggaggccugucccaauucugcccgcuccauggaaaa

SEQ ID NO: 299188 - RNA, 64 nt, hsa
uccuucagugagcagaaucacuguggucagucuccugucccagcuucaguucaugaauacuccu

SEQ ID NO: 299189 - RNA, 64 nt, hsa
guaucugaagugggagaagaagcagguagaccaccugucccaggcuguggugccacccucucug

SEQ ID NO: 299190 - RNA, 64 nt, hsa
aaaggggaaugaagccauucacuucacucaguuccugucccauuuaaccgccccgauccuugau

SEQ ID NO: 299191 - RNA, 64 nt, hsa
ccuccaggugucugcagugguuguccccucaaagcugucccacacccuccuccgaggacccuuu

SEQ ID NO: 299192 - RNA, 64 nt, hsa
cagaaaaaguuugcugacuugugauugagaccuacugucccauugugagguggccugaagaauc

SEQ ID NO: 299193 - RNA, 64 nt, hsa
ugggugacuugguaccugcucaggaccccccgcacugucccaaucccacucaggcccaccucca

SEQ ID NO: 299194 - RNA, 64 nt, hsa
cgcuggugacuucguaccugcucaggagcccccacugucccagucccacucaggcccaucucug

SEQ ID NO: 299195 - RNA, 64 nt, hsa
cccugcacugcuacccucuauuucccacucagggcugucccagagagaaggcagccgaacugag

SEQ ID NO: 299196 - RNA, 64 nt, hsa
guguucucuggucuucucucacaaugcugcaucccugucccauuuuuagggucccugucuauca

SEQ ID NO: 299197 - RNA, 64 nt, hsa
cagcaggugccccauccucugcccacagcagacucugucccauggcucuccgggcaguagagug

SEQ ID NO: 299198 - RNA, 64 nt, hsa
ugaacccugaguguugcaggcccagcagacccugcugucccaagcccaccccuccucccaccau

SEQ ID NO: 299199 - RNA, 64 nt, hsa
aauaccaccaccaaccaccuucuuccucucaacucugucccacaggccugucugguauuugugg

SEQ ID NO: 299200 - RNA, 64 nt, hsa
agugaaacuguuuacaauaaccucauacaaccuucugucccaucuccugguucagccuaggugu

SEQ ID NO: 299201 - RNA, 64 nt, hsa
cuaggaucacuuuuuaaaaaaucaccacuuguggcugucccagagugcgguuguacauccuccc

SEQ ID NO: 299202 - RNA, 64 nt, hsa
ccgacccaagggagugucagccuugggcucucuucugucccagggcuuucuggaggacgcgcug

SEQ ID NO: 299203 - RNA, 64 nt, hsa
augccaaagggguuccccugcggaguuccccugucugucccaggccgacccaagggagugucag

SEQ ID NO: 299204 - RNA, 64 nt, hsa
cagccauggccuggguggaggcaccugaagacgucugucccaaacucccccagcccugagcugg

SEQ ID NO: 299205 - RNA, 64 nt, hsa
ugugacuguccugugcgggccauagggcagggcccugucccagcagaugggcuugggagggggc

SEQ ID NO: 299206 - RNA, 64 nt, hsa
auacagcccugucacauugagaucauaaucccuccugucccacuccucucuaccaaccccaccc

SEQ ID NO: 299207 - RNA, 64 nt, hsa
ccaagaaucugucugaaacuuguacagcuaguuccugucccacaacuauuaagugguuuauuaa

SEQ ID NO: 299208 - RNA, 64 nt, hsa
ucaccagcaacaucucgagcccccuggauguccccugucccaccaacucugcacuccauggcca

SEQ ID NO: 299209 - RNA, 64 nt, hsa
cccaacagaaggaaggaggagggcgcccauucgucugucccagagcuuauuggccacugggucu

SEQ ID NO: 299210 - RNA, 64 nt, hsa
uuuuguaguguucuccacuaauacugguuauccugugcuacagagaaaaucaaagcagucauaa

SEQ ID NO: 299211 - RNA, 64 nt, hsa
augaggcaguuaaauaauaauaguuaaugaaggugugcuacagaaaauaaucugguguucuugc

SEQ ID NO: 299212 - RNA, 64 nt, hsa
ucaccugcuugcugaugucuaugguguuacagaagugcuacacgggcuacagcugaagauugga

SEQ ID NO: 299213 - RNA, 64 nt, hsa
cugccaguacucaugugaguuguaugugcccccagugcuacauacgcagguaugcguaagugug

SEQ ID NO: 299214 - RNA, 64 nt, hsa
ggccaacaauucuaguauggcuuguuggcaaagagugcuacaccguuucaaugaaacaauguau

SEQ ID NO: 299215 - RNA, 64 nt, hsa
uaaagacccuuauggaacuggaagacgucuuguagugcuacauugggugaaaccguugguccau

SEQ ID NO: 299216 - RNA, 64 nt, hsa
ucagugaaacaggucuuugccauaacuuuaugaagugcuacagaaagcacaaagaauugauuca

SEQ ID NO: 299217 - RNA, 64 nt, hsa
uuauuuuaauugguuuaaagucccuuuauaaagagugcuacaugguuuagauaaaggaaacaua

SEQ ID NO: 299218 - RNA, 64 nt, hsa
caaaagugucuguacagcagccauccaaguugccccuacuuaguggcuugcccucugccugccu

SEQ ID NO: 299219 - RNA, 64 nt, hsa
gcacacaaguauaagacuuuuuguauuacugcucccuacuuaacauacuugaauucucaaauuu

SEQ ID NO: 299220 - RNA, 64 nt, hsa
caacuggauguugacuguuaacuagaagcucuguccuacuuacagcacuuuggaucaucaaaaa

SEQ ID NO: 299221 - RNA, 64 nt, hsa
uauauuuuccuguuacuacuguauaaagcuuaaaccuacuuaaacaacuacaagcuuuaagguu

SEQ ID NO: 299222 - RNA, 64 nt, hsa
aaacucucucauuuggagggaucaugugaguuggccuacuuacaaguagugaaaguucccuuuu

SEQ ID NO: 299223 - RNA, 64 nt, hsa
gggcuuccuuauggcuuugcuucccacugggauuccuacuuaggugucugcccucaggggucca

SEQ ID NO: 299224 - RNA, 64 nt, hsa
ugucucacaccagccucauuuccaacuccgacuuccuacuuagaauguggcaguggcuuuguga

SEQ ID NO: 299225 - RNA, 64 nt, hsa
guccucugcaagcuucuugcugaucagaguuccuccuacuuacaacccagggugugaacauguu

SEQ ID NO: 299226 - RNA, 64 nt, hsa
aagugagacaaacaguuguaaagaugaguuuccaccuacuuauaccagagugcuaagaggaaau

SEQ ID NO: 299227 - RNA, 64 nt, hsa
guugaaugccugaggacgugugggaaccccguucccuacuuagcaugauccuugagucuccucu

SEQ ID NO: 299228 - RNA, 64 nt, hsa
aaauaagacugcucaguuuccaaggguuuucaagccuacuuaccuuuauaaagguucucuaguc

SEQ ID NO: 299229 - RNA, 64 nt, hsa
ccugccguuuccacaguaaccuuuccagaugguuccuacuuaaaugauuucauaaggaaaacca

SEQ ID NO: 299230 - RNA, 64 nt, hsa
cucuccaaggaaugggcuugugcuagaccgcugcccuacuuaacagcugccucauugcaagggc

SEQ ID NO: 299231 - RNA, 64 nt, hsa
auaaguaaaauuucaaaauugauuuuguucauuaccuacuuaauauuuccuuuaaauauauacu

SEQ ID NO: 299232 - RNA, 64 nt, hsa
auaauuuacauucgauaguguuacugauaacaaaccuacuuaagagauauguugcuuuuuacuu

SEQ ID NO: 299233 - RNA, 64 nt, hsa
gcacacacaaugcacacaacuccuaugacuggcuccuacuuacauucaaguuaaaaaggcugau

SEQ ID NO: 299234 - RNA, 64 nt, hsa
aagccgaaaguaaaaacacaaaaacagauaccccccuacuuaauguaauucaggacuccaacca

SEQ ID NO: 299235 - RNA, 64 nt, hsa
aaaaaaaagaaaaaagagggaggaaaaaaaagaaccuacuuaagauagaacaugguuuuggcua

SEQ ID NO: 299236 - RNA, 64 nt, hsa
uuuugugacuuuguuucucaggaaaaaaaauauuccuacuuaaauuuuaagucuauaauucaau

SEQ ID NO: 299237 - RNA, 64 nt, hsa
ccacacauuucaaaguugcccuauggaaaugaauccuacuuagugacaagucaucaaauguuug

SEQ ID NO: 299238 - RNA, 64 nt, hsa
ugcuggccacugauuccuuugagucucacaaaacccuacuuaggucaucagggcaggaguucuc

SEQ ID NO: 299239 - RNA, 64 nt, hsa
cccaugaaaaagugcucaugacauauugagaagaccuacuuacaaaguggcauauauugcaauu

SEQ ID NO: 299240 - RNA, 64 nt, hsa
cgaccuucaacuuugcuguaaaccuuuugguuuuccuacuuacucuucuucuguggaguuaucc

SEQ ID NO: 299241 - RNA, 64 nt, hsa
accaaaaaauucuuaccguaauauuauaucuugcccuacuuauuuacaaaauaauauguuucug

SEQ ID NO: 299242 - RNA, 64 nt, hsa
acuguuuuggauccaaggaccuguggacagucggccuacuuacucugagcugagggaacacuga

SEQ ID NO: 299243 - RNA, 55 nt, hsa; identical to SEQ ID NO: 143234

SEQ ID NO: 299244 - RNA, 64 nt, hsa
gacaaauguauauaaaauucucuguuggaauuugccuacuuaccuauaaacagcucacuacacu

SEQ ID NO: 299245 - RNA, 64 nt, hsa
cuagugucauauguaaaauggaauagaaucccugccuacuuaaguaacuguuggacaaaugaua

SEQ ID NO: 299246 - RNA, 64 nt, hsa
aaaagcuucauucucuucagugucuucuagaugcccuacuuaaagagaacauuuucuuaugucu

SEQ ID NO: 299247 - RNA, 64 nt, hsa
uuuuacuuuuuauaaaguuuuuuuuccuuagucuccuacuuagagauauucuagaaaaugucac

SEQ ID NO: 299248 - RNA, 64 nt, hsa
ggcuuucaucauucauucauguauuuauugagcaccuacuuauuauggugcucaacacuuguua

SEQ ID NO: 299249 - RNA, 64 nt, hsa
aauaaaauuugauuguuaagauacaguaguggacccuacuuauucagucaauuaagaguaaguu

SEQ ID NO: 299250 - RNA, 64 nt, hsa
cuucuaccucugccguuuuccugcaauuccgcuuccuacuuaggcaguucagagagaacaauuc

SEQ ID NO: 299251 - RNA, 64 nt, hsa
ccauucauaauuauuuuacauuuaaauuacuguuccuacuuaaguggugagcuugguaaccauu

SEQ ID NO: 299252 - RNA, 64 nt, hsa
ucugucaauaacugugcauggucugagauuuuacccuacuuauaagcuaacaaguuagccuguu

SEQ ID NO: 299253 - RNA, 64 nt, hsa
gcacugacggguuaacagaaaugcuuugguaauaccuacuuaguuaauuggaggaaguaguaaa

SEQ ID NO: 299254 - RNA, 64 nt, hsa
aacacagaaguuuuuauuuuauuaaaaaguauagccuacuuaaacgcgagaugacauauauaga

SEQ ID NO: 299255 - RNA, 64 nt, hsa
uuuauaaaucaauuguuuugcaaagaaguuauggccuacuuagaaucuaaaauuuguuauucaa

SEQ ID NO: 299256 - RNA, 64 nt, hsa
cagauauuuuugggagugacaaacauucucucauccuacuuagccuaccuagauuucucaugac

SEQ ID NO: 299257 - RNA, 64 nt, hsa
gagcaucuccaggcaaugaguuuuucaaagaaugccuacuuaguaguaagaugaagcucaggau

SEQ ID NO: 299258 - RNA, 64 nt, hsa
cagcuucaaucacugucauuauucuaauccuacuccuacuuaaauuuuaaguuaugagguuuau

SEQ ID NO: 299259 - RNA, 64 nt, hsa
guagcuaaaauggucagucuuuuuuagauguuuuccuacuuaguaucuccuaauaacguuuugc

SEQ ID NO: 299260 - RNA, 64 nt, hsa
aggagauacugaacauuuugcaaaacuuaucacgccuacuuaagagugcuguguaacccccagu

SEQ ID NO: 299261 - RNA, 64 nt, hsa
auuuauguucaaauuuuaguugggaguuuuguuuccuacuuaagcucaggacuugauacccucu

SEQ ID NO: 299262 - RNA, 64 nt, hsa
agaugaaugcaaaucagaaccaaugaucccuuggccuacuuaguuaaaaccaguucauacaucc

SEQ ID NO: 299263 - RNA, 64 nt, hsa
uguuugugaguuuccaguugauuuguagcaaaugccuacuuaguucuuuguggauuguucuaga

SEQ ID NO: 299264 - RNA, 64 nt, hsa
aaagcacuuacuucguguccgacucuucugagcaccuacuuacaugcauuacugcaugcacuuc

SEQ ID NO: 299265 - RNA, 64 nt, hsa
ugcugcagcucccuggcuucuguggggccccucaccuacuuacccaggugggucccggcucugu

SEQ ID NO: 299266 - RNA, 64 nt, hsa
auaacuuaagaauuuuuauaccaucuacaucuauccuacuuaugcagaaaaauaggcaauaaga

SEQ ID NO: 299267 - RNA, 64 nt, hsa
augaauuuugcaguaacugguauucuuggguuuuccuacuuaauacacaguaauucagaacuug

SEQ ID NO: 299268 - RNA, 64 nt, hsa
uccccaaauauagaucuuauuucugcucauuuccccuacuuauuaaaaucacaccaaacacuua

SEQ ID NO: 299269 - RNA, 64 nt, hsa
aggcauaaacaguuacuuggggauuugcgaaaauccuacuuaguuacugcguuuacaguucuuu

SEQ ID NO: 299270 - RNA, 64 nt, hsa
aauuaauuggacgggagacagagugaagcaucaaccuacuuagaagcugaaacguggguaagga

SEQ ID NO: 299271 - RNA, 64 nt, hsa
gauaauuuaucguguuaggagaagaacgaugauaccuacuuaacaccucagcaucugcgucgug

SEQ ID NO: 299272 - RNA, 64 nt, hsa
agauuuuuuuaaaagccaccuggguugacaccuuccuacuuauccacuagaugucaucagaggu

SEQ ID NO: 299273 - RNA, 64 nt, hsa
augugguguaaucaaacccgaugcuuucagaugaccuacuuacaucuucaauguggauaagaua

SEQ ID NO: 299274 - RNA, 64 nt, hsa
auacgguaccaauccuaggaacuguauacuaguuccuacuuagaacaaaaguaucaaguuugca

SEQ ID NO: 299275 - RNA, 64 nt, hsa
cgauguuagaauaagacuaccauucuaaauaucaccuacuuaugaauaacauguaauaauuuuu

SEQ ID NO: 299276 - RNA, 64 nt, hsa
uuuauuaaugcuaucaucucgaccaagcucaaagccuacuuauuagaaacaaugaaguucacaa

SEQ ID NO: 299277 - RNA, 64 nt, hsa
cuccgcauuuccaguuguauuagccaauagauuuccuacuuauuuaagcuauuugagcuccggg

SEQ ID NO: 299278 - RNA, 64 nt, hsa
aaaauucuaucuuugauaaauuuuauuuuuaugcccuacuuaauauuugcaucaguauaauaua

SEQ ID NO: 299279 - RNA, 64 nt, hsa
uaguuaccaaguccuauuuggacauaaagaaaauccuacuuauagaaaaggagaaaauaauuaa

SEQ ID NO: 299280 - RNA, 64 nt, hsa
aagacaaauaaacuauuuuguagaagaucagacuccuacuuaacuggaagagaaaugucuauua

SEQ ID NO: 299281 - RNA, 64 nt, hsa
ggugaagucgcugcauaugugacugucaugagauccuacuuaguaugauccuggcuagaaugau

SEQ ID NO: 299282 - RNA, 64 nt, hsa
uuucagauccuagcucaucaucagugaaguccagccuacuuacuuguaacuauuaaccuuucua

SEQ ID NO: 299283 - RNA, 64 nt, hsa
aaguaucuucucagcccugcuacugucugcugcuccuacuuagaaguugcaggcaauauccugu

SEQ ID NO: 299284 - RNA, 64 nt, hsa
ugucuguuuugagcuuauuuagaguccuaguuuuccuacuuauaaaguagaaauggugagauug

SEQ ID NO: 299285 - RNA, 64 nt, hsa
ggucucccaauacaggcaugaaccacugcacccaccuacuuagauauuucaugugcuauagaca

SEQ ID NO: 299286 - RNA, 64 nt, hsa
ugaagaaaauuuaguuguuaguugcuuugggaagccuacuuauggaguggaaaccaggagguua

SEQ ID NO: 299287 - RNA, 64 nt, hsa
uggaaaacaagaaggaaaugaaaauauuuuuaugccuacuuaggaaaaaaaggguagcacuuau

SEQ ID NO: 299288 - RNA, 64 nt, hsa
uuaaaauuuuaggauaaugaagaguacauaauguccuacuuaauauuuauguuaauaggacuua

SEQ ID NO: 299289 - RNA, 64 nt, hsa
ccggcugccccagaggacaguggguggagugguaccuacuuauuaaaugucucagaccccucuc

SEQ ID NO: 299290 - RNA, 64 nt, hsa
aauaugaucuuggaaaauuuuaaagaaaaauaauccuacuuauaaacuacuuuuuuauaauugu

SEQ ID NO: 299291 - RNA, 64 nt, hsa
uguuuacucuaaucaaggcaggagaugcagcaguccuacuuauugccauguggacuugugggaa

SEQ ID NO: 299292 - RNA, 64 nt, hsa
gccagagaaaaaaaucguauugaauggccauuucccuacuuauaagaugucucaaucugaauuu

SEQ ID NO: 299293 - RNA, 64 nt, hsa
uggcccugcaaauguuuacagaaaugaaauucuuccuacuuauauaagaaaucucacacugaga

SEQ ID NO: 299294 - RNA, 64 nt, hsa
uguguguguguguguguccacacuggccagccucccuacuuaccaagguucuccacugcuuacc

SEQ ID NO: 299295 - RNA, 64 nt, hsa
uucuuaaaccaggugaaagagcaaaguucaagugccuacuuaugugucauucgcucauguaaga

SEQ ID NO: 299296 - RNA, 64 nt, hsa
uuagaugaauuauugaucuuccuaauaucaggcgccuacuuaaccuaugguguguacuuuuugu

SEQ ID NO: 299297 - RNA, 64 nt, hsa
ucaguucgauauuuuacuuuagaaccuggaaucuccuacuuaauauaugaccaugacuuugaaa

SEQ ID NO: 299298 - RNA, 64 nt, hsa
acauuuuuaggagaaaguaaguugcuuugcaccgccuacuuaauucuuuuccauauauugugau

SEQ ID NO: 299299 - RNA, 64 nt, hsa
cuuaucuaugauugaguguccguguaaauaaauuccuacuuagacuuaccacuuugugugugcu

SEQ ID NO: 299300 - RNA, 64 nt, hsa
uggccaccauacaguggccucaaagcaaccauggccuacuuaaaaaccaaaccaaaaauaaaga

SEQ ID NO: 299301 - RNA, 64 nt, hsa
cugagcaugccauuuugaggggaggguaguugugccuacuuauccccuggcagaggggaugcca

SEQ ID NO: 299302 - RNA, 64 nt, hsa
aauacucuuccaaaagccugcaucggggauuccaccuacuuauuucagauucaccuccauuaac

SEQ ID NO: 299303 - RNA, 64 nt, hsa
ccuuucuuuagaaugcuguuuaaacaccauuuacccuacuuaucccucaaugcacaugauugau

SEQ ID NO: 299304 - RNA, 64 nt, hsa
caguuaacgggugaugaagcaagaaaucuuccuuccuacuuaugucuuaaagauggacagccug

SEQ ID NO: 299305 - RNA, 64 nt, hsa
aauacugccccacuuuaauauauguaagcaacuuccuacuuauacacgacguguuccuaaaaca

SEQ ID NO: 299306 - RNA, 64 nt, hsa
gaaagguguggugcuggaacaucgaugaaggagcccuacuuacugagcuuaguuauggacuuuu

SEQ ID NO: 299307 - RNA, 64 nt, hsa
ucuuuaaugaggaauaauaugcauguagaaaagaccuacuuaaagucuucauuuauauucuuuc

SEQ ID NO: 299308 - RNA, 64 nt, hsa
auuuacuuaaacguacuuucaggagugagcaaguccuacuuauaaaccuauauuaacuuuauuu

SEQ ID NO: 299309 - RNA, 64 nt, hsa
cuguaagagaaaugcagucaggagcacagcauccccuacuuacuaucacuacaagaaaacugag

SEQ ID NO: 299310 - RNA, 64 nt, hsa
cuguugcucauuugcccuuuuccauguauuuuuuccuacuuaggauuuuccacucuaucuuugu

SEQ ID NO: 299311 - RNA, 64 nt, hsa
aagugaaaaacuguguugggggggagacacuacuccuacuuaucuugcucauaaagccuuuucu

SEQ ID NO: 299312 - RNA, 64 nt, hsa
guuuucagaggcauucccagcccuucacuuaacuccuacuuagcuccaaaauaccuguauccaa

SEQ ID NO: 299313 - RNA, 64 nt, hsa
aaugaaauguggcaguccucucagggguaccccaccuacuuagggaucugaguucuucaguucc

SEQ ID NO: 299314 - RNA, 64 nt, hsa
uuucaauguaucuacaggcuuguuauugaaacuuccuacuuauuugaugugauuuauuaauaua

SEQ ID NO: 299315 - RNA, 64 nt, hsa
aauuagggaacuucaaauagugcguagacuuuucccuacuuaccauuggguucaauugauguag

SEQ ID NO: 299316 - RNA, 50 nt, hsa; identical to SEQ ID NO: 143307

SEQ ID NO: 299317 - RNA, 64 nt, hsa
acagguuaaaugaaccccugggcuuaauuuucccccuacuuaguucuguggcagcaaagaaaag

SEQ ID NO: 299318 - RNA, 64 nt, hsa
ccugugaggaacaggccucaggcccuugccacgaccuacuuaggcuacaauuuccuuuaaggca

SEQ ID NO: 299319 - RNA, 64 nt, hsa
cuguuaaaugcaguuuuaaauuuauaucguaacaccuacuuaagugccugacacaguagguauu

SEQ ID NO: 299320 - RNA, 64 nt, hsa
uggaagaugaacacuugaggacuucagcuucucaccuacuuaguacaguugggaaccauacacu

SEQ ID NO: 299321 - RNA, 64 nt, hsa
agacuccaucucaaaacaaaacaaaaaaaauuagccuacuuaaaggcacaacuaaaugcuuuau

SEQ ID NO: 299322 - RNA, 64 nt, hsa
gccauacauacauuucauuuaauuauccaauaauccuacuuacuauuguuuauucucaauuuac

SEQ ID NO: 299323 - RNA, 64 nt, hsa
guuggacagagcagcuuggcuuuucaugugcccaccuacuuaccuacuaccugcgacuuucuuu

SEQ ID NO: 299324 - RNA, 64 nt, hsa
gccuguccagcggccucuuuggcugcauucagccccuacuuaccuggggaccccggcuggggca

SEQ ID NO: 299325 - RNA, 64 nt, hsa
uggagggugccaucgagggcuccggaucccuuauccuacuuagcaguguuggucucuggggcug

SEQ ID NO: 299326 - RNA, 64 nt, hsa
gauucaaggaaggaagugggaacaagguuggaugccuacuuaugagcuugaccaucacagcuau

SEQ ID NO: 299327 - RNA, 64 nt, hsa
cacggccaccacugcagccgggggcuggccuucuccuacuuagggaagaaaaagcaaguguuca

SEQ ID NO: 299328 - RNA, 64 nt, hsa
cuggaaaugcuuuucugaaaguaugaguguugugccuacuuaauucugauaaaccugucuaagc

SEQ ID NO: 299329 - RNA, 64 nt, hsa
aaagaagauuaauuaauuuccuauccuaaucccuccuacuuauacuuccccaaaaaacaagcuu

SEQ ID NO: 299330 - RNA, 64 nt, hsa
uggaggucagcccguuacccccauaacugauuuaccuacuuaccauacugggagguagaagaga

SEQ ID NO: 299331 - RNA, 64 nt, hsa
uuuuguuuuccaguaggggauuagaauguuuaguccuacuuaguaagaaaaauauuguauuuuu

SEQ ID NO: 299332 - RNA, 64 nt, hsa
uuugauccuaaccuuuuagccugcucucuagaacccuacuuacaguugaccaagcugcuuaaag

SEQ ID NO: 299333 - RNA, 64 nt, hsa
uaccauaauccccaccgcuuccugucucagcggaccuacuuaaguuguucacuuuacuugccug

SEQ ID NO: 299334 - RNA, 64 nt, hsa
uugguccugcugggagcucccccugccucuuuccccuacuuagcuccuuagcaaagagacccug

SEQ ID NO: 299335 - RNA, 64 nt, hsa
cacccccaggacugcugcuggagccuggacacguccuacuuaagaaaaugccuuuuacucaggg

SEQ ID NO: 299336 - RNA, 64 nt, hsa
guuggauucugcagacugaaacgaguaaagcuugccuacuuaauacacucaaguguggggaguc

SEQ ID NO: 299337 - RNA, 64 nt, hsa
uacuugauucuuuuagcaaaucaaugcacguuauccuacuuaauccuuaaauaaguuuagauuu

SEQ ID NO: 299338 - RNA, 64 nt, hsa
gccucuccaccucucacccacucucuccuaauccccuacuuaaguagggcuugccccacuucag

SEQ ID NO: 299339 - RNA, 64 nt, hsa
uauaacacaucacaucuaagaauaaaggcugccuccuacuuaauugcuauauaacaauugucca

SEQ ID NO: 299340 - RNA, 64 nt, hsa
acguuguccuaguuucuggaaucaccgaauaauuccuacuuacugauauaccuuguauauuuac

SEQ ID NO: 299341 - RNA, 64 nt, hsa
auuuaugcaugagaacuaaauagauuuuuagauuccuacuuaaacaaaaacuuuccaugacagu

SEQ ID NO: 299342 - RNA, 64 nt, hsa
ugcagaaugagcccaccuggcuuugaaucugggcccuacuuaacuuaucagcuaugugguuuug

SEQ ID NO: 299343 - RNA, 64 nt, hsa
cagcugccagccuucuguccugggcaaacuacucccuacuuaagggaauaggccaggcuccauc

SEQ ID NO: 299344 - RNA, 64 nt, hsa
aacuccuuguuugcacauuauuauggaacacuuuccuacuuaggcaguuacucuuccauguuua

SEQ ID NO: 299345 - RNA, 64 nt, hsa
aaaagcagcaccugugggccauacuaaaagauccccuacuuacguucugguugucauguuuccc

SEQ ID NO: 299346 - RNA, 64 nt, hsa
augaauucuuccuagauagucgcccacuccaccuccuacuuaaccugagacucauuauuuagcu

SEQ ID NO: 299347 - RNA, 64 nt, hsa
uuugguaccuaugaaccuagaacuugaagugacuccuacuuaucacguaaauuuuuaugucuga

SEQ ID NO: 299348 - RNA, 64 nt, hsa
augagaauguacuuauauuuuguuuugcuauuaaccuacuuacgggguuagggauuugcggggg

SEQ ID NO: 299349 - RNA, 64 nt, hsa
cauauccuucaaaagaaccacacuagggucuccaccuacuuauacaaugcggaugcccaacugu

SEQ ID NO: 299350 - RNA, 64 nt, hsa
acaccaguccacgccgggucgccugcccugucucccuacuuagacccagucauucuagagggau

SEQ ID NO: 299351 - RNA, 64 nt, hsa
uguguuuuuaguuacacacacacacacacacacaccuacuuaaauggaaucuaaacauuuuuag

SEQ ID NO: 299352 - RNA, 64 nt, hsa
auuccauuuuaauugauaugaggguguuaaaguaccuacuuaauggguugauuacuaucaaaau

SEQ ID NO: 299353 - RNA, 64 nt, hsa
uuuccaccuaccgcuuaccugaaaugcaggaucaccuacuuacuguauucuacauuauuauaug

SEQ ID NO: 299354 - RNA, 64 nt, hsa
auucaucgagcucuaucaacacugguaacuaagaccuacuuaugccacauaagagaugcauuuu

SEQ ID NO: 299355 - RNA, 64 nt, hsa
uaagggagacauuuuagucaguaagacgauauaaccuacuuacuccguaaggggaaaugaaggc

SEQ ID NO: 299356 - RNA, 64 nt, hsa
ggggaaauuauauaccgugacugaaaacuagaguccuacuuacauaguugaaauaucaaggagg

SEQ ID NO: 299357 - RNA, 64 nt, hsa; identical to SEQ ID NO: 235738

SEQ ID NO: 299358 - RNA, 64 nt, hsa; identical to SEQ ID NO: 235739

SEQ ID NO: 299359 - RNA, 64 nt, hsa
ucagucagucucuguaguuaaaacuuuuucuuuaaaauucaauuaagguacuucucccucaggg

SEQ ID NO: 299360 - RNA, 64 nt, hsa
ucagucagucucuguaguuaaaacuuuuucuuuaaaauucaauuaaguuacaccagaauuuaca

SEQ ID NO: 299361 - RNA, 64 nt, hsa
ugcuguguauuguauuuuucaaauaaaaauuuaaaaauucaauugaaaacugaauuuugacuuu

SEQ ID NO: 299362 - RNA, 64 nt, hsa
aaucacaaacuaguaagagacauaguugaagcuuaaauucaaguuuucuggcccugaacucaua

SEQ ID NO: 299363 - RNA, 64 nt, hsa
uagucaguaaaauguuagaaaucaaacuauaagaaaauucaaguccuuuauuuugugucuuggg

SEQ ID NO: 299364 - RNA, 64 nt, hsa
aucauuauuuaacaacaagugaagaucaacagaaaaauucaaguagcuuugcaaauacuaguug

SEQ ID NO: 299365 - RNA, 64 nt, hsa
uaaaaaaccaguauauauagucuguucauauguaaaauucaauggaagagagguggaacagugc

SEQ ID NO: 299366 - RNA, 64 nt, hsa
aggguuaugcaauucccggccuggagcauuuuugaaauucaaauugucuguccuguggagcagg

SEQ ID NO: 299367 - RNA, 64 nt, hsa
cucugauuguccucagccuccacuuccccagaguaaauucaaauugaaucgagcucugcugcuc

SEQ ID NO: 299368 - RNA, 64 nt, hsa
uuaagacaaggucaugcuggaugaagguagaccuaaauucaauaugacugguuuccuuguauga

SEQ ID NO: 299369 - RNA, 64 nt, hsa
uuuuugugucuguuuuuuuuuuuuuucuuggacuaaauucaacugcauggaagcgguggucaga

SEQ ID NO: 299370 - RNA, 64 nt, hsa
uauguaugguuugaaaauauuuucauuauacaugaaauucaacuuuccaaauaaaaguucuacu

SEQ ID NO: 299371 - RNA, 64 nt, hsa
auaauuguggauauaaaagaacaccagagaucagaaauucaaaaacucagaauaaaaaugaaaa

SEQ ID NO: 299372 - RNA, 64 nt, hsa
aaaagauaagacaguggcauagaguuaauauuuaaaauucaaauauuaaaacucaaauaaaccc

SEQ ID NO: 299373 - RNA, 64 nt, hsa
uuaaacuaauuguauucugagguaaccacaaaauaaauucaaccaaacugggguccaccaagug

SEQ ID NO: 299374 - RNA, 64 nt, hsa
ugguuuggcagugcaagaauucuguaacauuaacaaauucaauaaaaaguaaauauauggauuu

SEQ ID NO: 299375 - RNA, 64 nt, hsa
cacaagcuaccaucucagauauauauauauauauaaauucaauaaagcuuucuguuuguguucc

SEQ ID NO: 299376 - RNA, 64 nt, hsa
uuuaucacauguagcucuuuugcaugcuaaaugaaaauucaaaacuugccaauaaaugaauagc

SEQ ID NO: 299377 - RNA, 64 nt, hsa
auuuugcuuuccuggcuaauuauuugauccuuuuaaauucaaauuugaaucauuugucauguau

SEQ ID NO: 299378 - RNA, 64 nt, hsa
aauacaguugucuagccaagccaucaagugucugaaauucaauauugguuuaugcaaauacagc

SEQ ID NO: 299379 - RNA, 64 nt, hsa
ggaauaagaaaggauuaaacaguuacaagccuccaaauucaaauaaaauuaaaucacaguucag

SEQ ID NO: 299380 - RNA, 64 nt, hsa
acggucucaccgaugcaguuuucauggacauagaaaauucaaauagaauauauaauauugaauu

SEQ ID NO: 299381 - RNA, 64 nt, hsa
gaauuuguaacauuguuaaugcacuaagugauuuaaauucaauugaugaagaugugauuuuaca

SEQ ID NO: 299382 - RNA, 64 nt, hsa
uagcucaauuuugagauaauggaaaauugacuggaaauucaaaacucaaacuacuaucuuuaga

SEQ ID NO: 299383 - RNA, 64 nt, hsa
guuugugcucaauuucagacacucauuuauaaacaaauucaaccaagggauauuuacugcuuua

SEQ ID NO: 299384 - RNA, 64 nt, hsa
aauuauuuugcauuaauacaguauacacauuuguaaauucaacaggaaauuauugaguuuugga

SEQ ID NO: 299385 - RNA, 64 nt, hsa
uuuaacuaguucucgaacuuuacuaugcauaagaaaauucaaacuggagagaaacucuacaaau

SEQ ID NO: 299386 - RNA, 64 nt, hsa
acauaagauaauuuauacuggagcaaaaccuuggaaauucaaagaaugugguaaaacuuacaau

SEQ ID NO: 299387 - RNA, 64 nt, hsa
ucauuuggaggauuuucuucuuuguaauguaaagaaauucaaaguuaucaaaguuccuuaaaug

SEQ ID NO: 299388 - RNA, 64 nt, hsa
gaccuguaauauccacauugugaagcuguguaugaaauucaacuauaauaugaauaaauuugaa

SEQ ID NO: 299389 - RNA, 64 nt, hsa
guuuauuuuuuuuuucuuggauugaaaaguacugaaauucaaugugacauuaaaaugcaaauuu

SEQ ID NO: 299390 - RNA, 64 nt, hsa
auauuucauuagcuugaauuguauagauuuuuaaaaauucaaugaaagcauguuguuuaauuuc

SEQ ID NO: 299391 - RNA, 64 nt, hsa
aagaacaaacagaaacgagauuugccaaaaacuaaaauucaacaaaugauguugagugggagau

SEQ ID NO: 299392 - RNA, 64 nt, hsa
ucguucugggucagcuugaauguccccauucuauaaauucaacacuuauuuucugaauucauaa

SEQ ID NO: 299393 - RNA, 64 nt, hsa
uugugucaaaaugauauagcuuaguauaaaaauaaaauucaacguuuuggccaaaauguuuguu

SEQ ID NO: 299394 - RNA, 64 nt, hsa
aaauguuuguuuuucacuggauucugaauauaauaaauucaaaguacccuuuuuuuagaguuuc

SEQ ID NO: 299395 - RNA, 64 nt, hsa
cugcuguuggaaaacgcuauggagguucgucacaaaauucaacauagaauuacccuaugauuca

SEQ ID NO: 299396 - RNA, 64 nt, hsa
cauccacaaaaauaugcaauggauguagaaaauaaaauucaagaaaagaacguugaaccaaaua

SEQ ID NO: 299397 - RNA, 64 nt, hsa
aguuucuauuaucuccaaccucucuuggcauuccaaauucaaggcuacgauauuuucuuauugc

SEQ ID NO: 299398 - RNA, 64 nt, hsa
ugggagucguuuuuuuuaaaaaaauuuuuuaauuaaauucaagucaaauuugcagaacccugua

SEQ ID NO: 299399 - RNA, 64 nt, hsa
ucuggauaguaggauuuuaauaggcgagcaaauaaaauucaaaucaauuucaaggaaaaacauc

SEQ ID NO: 299400 - RNA, 64 nt, hsa
uuuagacucauggaauaugagaaaggcuuagggaaaauucaagucauggggagauuccugcuag

SEQ ID NO: 299401 - RNA, 64 nt, hsa
aacccaaguggaaucaucacuuaauuacuuacucaaauucaaugaaucaaauccaauccaauca

SEQ ID NO: 299402 - RNA, 64 nt, hsa
gugagaauauacuuagaaaaucacacuuaucuggaaauucaauaagucauauuaaaaauauaca

SEQ ID NO: 299403 - RNA, 64 nt, hsa
uaggaaauucuugaaaauauaaguggugcuuagaaaauucaagcauuuaggaaugugaccuuua

SEQ ID NO: 299404 - RNA, 64 nt, hsa
ccuucuucuaguuuuaugcgacagcuuuacuuuaaaauucaaguuauacaucuugggaguacaa

SEQ ID NO: 299405 - RNA, 64 nt, hsa
uauuguuuaguacagagacugagcaaauacuacaaaauucaacuuaaccuucauuucauugguu

SEQ ID NO: 299406 - RNA, 64 nt, hsa
gacuucccugacuacuaccuucauauuucauuucaaauucaaacuucugagguugcagcauaua

SEQ ID NO: 299407 - RNA, 64 nt, hsa
auggacaccucugcugugaauguuuuagagaaggaaauucaaaaaauguuguaacugaaagcac

SEQ ID NO: 299408 - RNA, 64 nt, hsa
uuuuaugauguucaucacagugugguaagguugcaaauucaaaacaugucacccaagcucuguu

SEQ ID NO: 299409 - RNA, 64 nt, hsa
ggcacuguauucauugccaauguuccaaauuaucaaauucaagugaauuuauuuguguguucuu

SEQ ID NO: 299410 - RNA, 64 nt, hsa
aucugauaaaaaaauuuucuugucuuaguuauaaaaauucaaagaaauguguuacaaagauacu

SEQ ID NO: 299411 - RNA, 64 nt, hsa
auuucagcuagauuuggaaaaggaaagguacuacaaauucaaaagauuucacuuuuaacacugg

SEQ ID NO: 299412 - RNA, 64 nt, hsa
aucaucucaauagauacagaaaaggcuuuugauaaaauucaacuugacuucauguuaaaaaccc

SEQ ID NO: 299413 - RNA, 64 nt, hsa
uuccauauguuacugaaucugaaaaacaucuuuaaaauucaaacaguuccauuuucucucuugu

SEQ ID NO: 299414 - RNA, 64 nt, hsa
uacaguacugaaguaaucugauuuuauucuuuggaaauucaaugcauuggucacacuaauaaca

SEQ ID NO: 299415 - RNA, 64 nt, hsa
cuuaaauaaagaaagugugaggucuacuuuaaaaaaauucaaaugaagagaaaaagaaaaacag

SEQ ID NO: 299416 - RNA, 64 nt, hsa
uugcucuguuuugcuuuuccauauagcucgagcaaaauucaaaaagaacuaaauaugcaauaua

SEQ ID NO: 299417 - RNA, 64 nt, hsa
gaugcccuguugguuucacagauaacauaaauaaaaauucaaccacagauuuauacaaggguua

SEQ ID NO: 299418 - RNA, 64 nt, hsa
auauauuuacuguuauauagauugccacauucuaaaauucaaauacggugcuuaagguuucaug

SEQ ID NO: 299419 - RNA, 64 nt, hsa
aaauauuguaucccuuugucaaaccuuguuucccaaauucaauuaaagagaggagagaauugaa

SEQ ID NO: 299420 - RNA, 64 nt, hsa
ccuuuacuccuuaaaaaagaaaggaaagaucucuaaauucaaagcuagauuguaaauaggcauu

SEQ ID NO: 299421 - RNA, 64 nt, hsa
ucuccuuuuuucggaauugaaacauuuuaauuucaaauucaaauagaacauuuaaaaugauuuc

SEQ ID NO: 299422 - RNA, 64 nt, hsa
auugaguuauugagcacugaaauguggcuaguccaaauucaaaugguguuuuuuuguaaaacac

SEQ ID NO: 299423 - RNA, 64 nt, hsa
uuuaagccucaagagccaacucccaguuuagagaaaauucaaggaauggaagaguaaauuacau

SEQ ID NO: 299424 - RNA, 64 nt, hsa
gcugcagguggagcuggagcaagaauaccaagacaaauucaaaagacugccccucgagauuuug

SEQ ID NO: 299425 - RNA, 64 nt, hsa
auguaugugagauuuuuguuuucuuuccaauagcaaauucaaagcaagcaacuugcaggcucca

SEQ ID NO: 299426 - RNA, 64 nt, hsa
ccaccccuguauuucaagaucauugauaagcccuaaauucaaauucuuaagauauggaccuuuu

SEQ ID NO: 299427 - RNA, 64 nt, hsa
auuuaaagcuaccauaaugcuuuuaauuaguucuaaauucaaccaaaaaauguuuuacucuuau

SEQ ID NO: 299428 - RNA, 64 nt, hsa; identical to SEQ ID NO: 21903

SEQ ID NO: 299429 - RNA, 64 nt, hsa; identical to SEQ ID NO: 21904

SEQ ID NO: 299430 - RNA, 64 nt, hsa; identical to SEQ ID NO: 21905

SEQ ID NO: 299431 - RNA, 64 nt, hsa; identical to SEQ ID NO: 21906

SEQ ID NO: 299432 - RNA, 64 nt, hsa; identical to SEQ ID NO: 21907

SEQ ID NO: 299433 - RNA, 64 nt, hsa; identical to SEQ ID NO: 21908

SEQ ID NO: 299434 - RNA, 64 nt, hsa; identical to SEQ ID NO: 21909

SEQ ID NO: 299435 - RNA, 64 nt, hsa; identical to SEQ ID NO: 21910

SEQ ID NO: 299436 - RNA, 64 nt, hsa; identical to SEQ ID NO: 21911

SEQ ID NO: 299437 - RNA, 64 nt, hsa; identical to SEQ ID NO: 21912

SEQ ID NO: 299438 - RNA, 64 nt, hsa; identical to SEQ ID NO: 21913

SEQ ID NO: 299439 - RNA, 64 nt, hsa; identical to SEQ ID NO: 21914

SEQ ID NO: 299440 - RNA, 64 nt, hsa; identical to SEQ ID NO: 21915

SEQ ID NO: 299441 - RNA, 64 nt, hsa; identical to SEQ ID NO: 21916

SEQ ID NO: 299442 - RNA, 64 nt, hsa; identical to SEQ ID NO: 21917

SEQ ID NO: 299443 - RNA, 64 nt, hsa; identical to SEQ ID NO: 21918

SEQ ID NO: 299444 - RNA, 64 nt, hsa; identical to SEQ ID NO: 21919

SEQ ID NO: 299445 - RNA, 64 nt, hsa; identical to SEQ ID NO: 21920

SEQ ID NO: 299446 - RNA, 64 nt, hsa; identical to SEQ ID NO: 21921

SEQ ID NO: 299447 - RNA, 64 nt, hsa; identical to SEQ ID NO: 21922

SEQ ID NO: 299448 - RNA, 64 nt, hsa; identical to SEQ ID NO: 21923

SEQ ID NO: 299449 - RNA, 64 nt, hsa; identical to SEQ ID NO: 21924

SEQ ID NO: 299450 - RNA, 64 nt, hsa; identical to SEQ ID NO: 21925

SEQ ID NO: 299451 - RNA, 64 nt, hsa; identical to SEQ ID NO: 21926

SEQ ID NO: 299452 - RNA, 64 nt, hsa; identical to SEQ ID NO: 21927

SEQ ID NO: 299453 - RNA, 64 nt, hsa; identical to SEQ ID NO: 21928

SEQ ID NO: 299454 - RNA, 64 nt, hsa; identical to SEQ ID NO: 21929

SEQ ID NO: 299455 - RNA, 64 nt, hsa; identical to SEQ ID NO: 21930

SEQ ID NO: 299456 - RNA, 64 nt, hsa; identical to SEQ ID NO: 21931

SEQ ID NO: 299457 - RNA, 64 nt, hsa; identical to SEQ ID NO: 21932

SEQ ID NO: 299458 - RNA, 64 nt, hsa; identical to SEQ ID NO: 21933

SEQ ID NO: 299459 - RNA, 64 nt, hsa; identical to SEQ ID NO: 21934

SEQ ID NO: 299460 - RNA, 64 nt, hsa; identical to SEQ ID NO: 21935

SEQ ID NO: 299461 - RNA, 64 nt, hsa; identical to SEQ ID NO: 21936

SEQ ID NO: 299462 - RNA, 64 nt, hsa
uuagagacauuggcauugccaugcccucuuuggaggguagaagaggcaaaacacuuuuuucacc

SEQ ID NO: 299463 - RNA, 64 nt, hsa
aaaacacuuuuuucacccuuuggaaucauaguauggguagaaguuaugauuuaucuugaaauaa

SEQ ID NO: 299464 - RNA, 64 nt, hsa
uuguugcccuggggcuuaucugauuaugggacgaggguagaaaguaagaagcacuuuugaauuu

SEQ ID NO: 299465 - RNA, 64 nt, hsa
aggguagaaaguaagaagcacuuuugaauuugugggguagaacuucaacaauaagucaguucua

SEQ ID NO: 299466 - RNA, 64 nt, hsa
uagcagauuggaugggcagguggagaaugccuggggguagaaauguuagaucuugcaacaucag

SEQ ID NO: 299467 - RNA, 64 nt, hsa
guaaacuauccuagguaauuucagguacuuucucuuaugcaauuaauuuuauuaacugauuucu

SEQ ID NO: 299468 - RNA, 64 nt, hsa
gaccccagccccaucccaaucucuagcgaaaggguuaugcaaaucucaggguguugccucuaaa

SEQ ID NO: 299469 - RNA, 64 nt, hsa
guuucggaagauaucauaaucauucuguguaacauuaugcaaacuucuaagcccaaacaugacu

SEQ ID NO: 299470 - RNA, 64 nt, hsa
uguacuugugaaaacaguaaaauaguuuggauaguuaugcaaaugcaccuauguguaacuuccc

SEQ ID NO: 299471 - RNA, 64 nt, hsa
acuaaauuaguuuaaaaugaagcaauuuauaucuuuaugcaaaaacauaugucugucuuugcaa

SEQ ID NO: 299472 - RNA, 64 nt, hsa
gcaacauuaccuugucuuucaaaagacaccugccuuaugcaaggggaaaccugugaaagcugca

SEQ ID NO: 299473 - RNA, 64 nt, hsa
uacagaaauuuaauucagaaccccaacuacuguguuaugcaaaagcaagcugauuaaaugacac

SEQ ID NO: 299474 - RNA, 64 nt, hsa
agggagaagugacauugcaucaaagcaucuugcauuaugcaauuuuuauauuaaccagauauau

SEQ ID NO: 299475 - RNA, 64 nt, hsa
uuauaaugggaucauguuaaguagaaguagcuuuuuaugcaaauacaugcauuuaugcaauauu

SEQ ID NO: 299476 - RNA, 64 nt, hsa
aaguagaaguagcuuuuuaugcaaauacaugcauuuaugcaauauuaauguaagggcucuaaaa

SEQ ID NO: 299477 - RNA, 64 nt, hsa
ugugugugaauauguguuacaccuaggaugggcauuaugcaaaagcacaaagauuauauaugac

SEQ ID NO: 299478 - RNA, 64 nt, hsa
cguuuucugucaaaguuccuuuugcaugaaacaauuaugcaaacuuauaauuauuagugcugaa

SEQ ID NO: 299479 - RNA, 64 nt, hsa
cuuggaucgcuaagcuggcucuguuugaugcuauuuaugcaaguuagggucuauguauuuauga

SEQ ID NO: 299480 - RNA, 64 nt, hsa
uuuaagcuccuugaguaaaaaggugguauguaauuuaugcaagguauuucuccaguugggacuc

SEQ ID NO: 299481 - RNA, 64 nt, hsa
aucagagauggagcaaaccagugccauccagucuuuaugcaaaugaaaugcugcaaagggaagc

SEQ ID NO: 299482 - RNA, 64 nt, hsa
uaccuaggagaaucuaagcuauagcagggaugauuuaugcaaauuugaacuagcuucuuuguuc

SEQ ID NO: 299483 - RNA, 64 nt, hsa; identical to SEQ ID NO: 146945

SEQ ID NO: 299484 - RNA, 64 nt, hsa; identical to SEQ ID NO: 146946

SEQ ID NO: 299485 - RNA, 64 nt, hsa; identical to SEQ ID NO: 146947

SEQ ID NO: 299486 - RNA, 64 nt, hsa; identical to SEQ ID NO: 146948

SEQ ID NO: 299487 - RNA, 64 nt, hsa; identical to SEQ ID NO: 146949

SEQ ID NO: 299488 - RNA, 64 nt, hsa; identical to SEQ ID NO: 146950

SEQ ID NO: 299489 - RNA, 64 nt, hsa; identical to SEQ ID NO: 146951

SEQ ID NO: 299490 - RNA, 64 nt, hsa; identical to SEQ ID NO: 146952

SEQ ID NO: 299491 - RNA, 64 nt, hsa; identical to SEQ ID NO: 146953

SEQ ID NO: 299492 - RNA, 64 nt, hsa; identical to SEQ ID NO: 146954

SEQ ID NO: 299493 - RNA, 64 nt, hsa; identical to SEQ ID NO: 146955

SEQ ID NO: 299494 - RNA, 64 nt, hsa; identical to SEQ ID NO: 146956

SEQ ID NO: 299495 - RNA, 64 nt, hsa; identical to SEQ ID NO: 146957

SEQ ID NO: 299496 - RNA, 64 nt, hsa; identical to SEQ ID NO: 146958

SEQ ID NO: 299497 - RNA, 64 nt, hsa; identical to SEQ ID NO: 146959

SEQ ID NO: 299498 - RNA, 64 nt, hsa; identical to SEQ ID NO: 146960

SEQ ID NO: 299499 - RNA, 64 nt, hsa; identical to SEQ ID NO: 146961

SEQ ID NO: 299500 - RNA, 64 nt, hsa; identical to SEQ ID NO: 146962

SEQ ID NO: 299501 - RNA, 64 nt, hsa; identical to SEQ ID NO: 146963

SEQ ID NO: 299502 - RNA, 64 nt, hsa; identical to SEQ ID NO: 56583

SEQ ID NO: 299503 - RNA, 64 nt, hsa; identical to SEQ ID NO: 56584

SEQ ID NO: 299504 - RNA, 64 nt, hsa; identical to SEQ ID NO: 56585

SEQ ID NO: 299505 - RNA, 64 nt, hsa; identical to SEQ ID NO: 56586

SEQ ID NO: 299506 - RNA, 64 nt, hsa; identical to SEQ ID NO: 56587

SEQ ID NO: 299507 - RNA, 64 nt, hsa; identical to SEQ ID NO: 56588

SEQ ID NO: 299508 - RNA, 64 nt, hsa; identical to SEQ ID NO: 56589

SEQ ID NO: 299509 - RNA, 64 nt, hsa; identical to SEQ ID NO: 56590

SEQ ID NO: 299510 - RNA, 64 nt, hsa; identical to SEQ ID NO: 56591

SEQ ID NO: 299511 - RNA, 64 nt, hsa; identical to SEQ ID NO: 56592

SEQ ID NO: 299512 - RNA, 64 nt, hsa; identical to SEQ ID NO: 56593

SEQ ID NO: 299513 - RNA, 64 nt, hsa; identical to SEQ ID NO: 56594

SEQ ID NO: 299514 - RNA, 64 nt, hsa; identical to SEQ ID NO: 56595

SEQ ID NO: 299515 - RNA, 64 nt, hsa; identical to SEQ ID NO: 56596

SEQ ID NO: 299516 - RNA, 64 nt, hsa; identical to SEQ ID NO: 56597

SEQ ID NO: 299517 - RNA, 64 nt, hsa; identical to SEQ ID NO: 56598

SEQ ID NO: 299518 - RNA, 64 nt, hsa; identical to SEQ ID NO: 146945

SEQ ID NO: 299519 - RNA, 64 nt, hsa; identical to SEQ ID NO: 146946

SEQ ID NO: 299520 - RNA, 64 nt, hsa; identical to SEQ ID NO: 146947

SEQ ID NO: 299521 - RNA, 64 nt, hsa; identical to SEQ ID NO: 146948

SEQ ID NO: 299522 - RNA, 64 nt, hsa; identical to SEQ ID NO: 146949

SEQ ID NO: 299523 - RNA, 64 nt, hsa; identical to SEQ ID NO: 146950

SEQ ID NO: 299524 - RNA, 64 nt, hsa; identical to SEQ ID NO: 146951

SEQ ID NO: 299525 - RNA, 64 nt, hsa; identical to SEQ ID NO: 146952

SEQ ID NO: 299526 - RNA, 64 nt, hsa; identical to SEQ ID NO: 146953

SEQ ID NO: 299527 - RNA, 64 nt, hsa; identical to SEQ ID NO: 146954

SEQ ID NO: 299528 - RNA, 64 nt, hsa; identical to SEQ ID NO: 146955

SEQ ID NO: 299529 - RNA, 64 nt, hsa; identical to SEQ ID NO: 146956

SEQ ID NO: 299530 - RNA, 64 nt, hsa; identical to SEQ ID NO: 146957

SEQ ID NO: 299531 - RNA, 64 nt, hsa; identical to SEQ ID NO: 146958

SEQ ID NO: 299532 - RNA, 64 nt, hsa; identical to SEQ ID NO: 146959

SEQ ID NO: 299533 - RNA, 64 nt, hsa; identical to SEQ ID NO: 146960

SEQ ID NO: 299534 - RNA, 64 nt, hsa; identical to SEQ ID NO: 146961

SEQ ID NO: 299535 - RNA, 64 nt, hsa; identical to SEQ ID NO: 146962

SEQ ID NO: 299536 - RNA, 64 nt, hsa; identical to SEQ ID NO: 146963

SEQ ID NO: 299537 - RNA, 63 nt, hsa
acaucaagccagcuucauucacucacuuuacuuagaacagagauauaagggccugggaugcau

SEQ ID NO: 299538 - RNA, 63 nt, hsa
gugagacacaagaucucucuuuuaccaaaguugagaacagagcugguggauuaauuaauaguc

SEQ ID NO: 299539 - RNA, 63 nt, hsa
ggcaacuuaaauaacuccugagcaguuggcacuagaacagaauacuuggaaugacaccaaagu

SEQ ID NO: 299540 - RNA, 63 nt, hsa
gcaaagaucaugauuaacugucaagacacugguagaacagaacaagcaaaagauuaagaguuc

SEQ ID NO: 299541 - RNA, 63 nt, hsa
gggauuucagugaggccuuuugaucuguccaggagaacagaagggaaaaaaagauacuugaaa

SEQ ID NO: 299542 - RNA, 63 nt, hsa
acuaaaggccgaaagaaucucuugcugcugcaaagaacagauuuuauauuucuuccucuaauc

SEQ ID NO: 299543 - RNA, 63 nt, hsa
gauuacaggugugagccacugugcccggccaaaagaacagaaauuauuuuauccugaaguaag

SEQ ID NO: 299544 - RNA, 63 nt, hsa
gcugguguguuugccagagacccagcagggaccagaacagaugaaaauccugccaucuuggau

SEQ ID NO: 299545 - RNA, 63 nt, hsa
cuuuuguaacuuacuguggcuuuaaacauauucagaacagaugcuugaaauaugcacuuagca

SEQ ID NO: 299546 - RNA, 63 nt, hsa
cagggaagccugugcagaugcagucaccuggaaagaacagagauuacccuuucaccuaccuca

SEQ ID NO: 299547 - RNA, 61 nt, hsa
auaaaauuuuuauuuauucaauaaaauaugcacagaacagaugcaaauguguuauauacaa

SEQ ID NO: 299548 - RNA, 63 nt, hsa
uuuuuugaucaguguagcucaauugugacuuaaagaacagaaucuguccuucacuguaagagc

SEQ ID NO: 299549 - RNA, 63 nt, hsa
ggcuuucaaugaguuccuauguggauuuuuaaaagaacagaacaguaaugaaauauuugaagu

SEQ ID NO: 299550 - RNA, 63 nt, hsa
aaaagcuauaugcagaguuuuguauaaaacaauagaacagaaauuugggacauuuuucuagga

SEQ ID NO: 299551 - RNA, 63 nt, hsa
ucucacaccuccuuagcuguaagagucuggcuuagaacagaccucucugugcaauaacuugug

SEQ ID NO: 299552 - RNA, 63 nt, hsa
gcugucugagucuaaagcaccguaucuuggugcagaacagauaauuauacagagauggaaugg

SEQ ID NO: 299553 - RNA, 63 nt, hsa
gaccagaaacagggacaaagaaauccccccuucagaacagaggcauuuaaaauggaaaagaga

SEQ ID NO: 299554 - RNA, 63 nt, hsa
uucuuugcagagccuuuuaccccugcacaguuuagaacagagggaccaaauugcuucuaggag

SEQ ID NO: 299555 - RNA, 63 nt, hsa
aaaauuccaugauuuuguauuuaauucuuccugagaacagaagaggggaaagcaagagaggac

SEQ ID NO: 299556 - RNA, 63 nt, hsa
guaaaaacacuauuaccuguuucuagucacuuuagaacagauggcacuaaaaaaauuuuuuuu

SEQ ID NO: 299557 - RNA, 63 nt, hsa
gaauaauuauugcauaguagaauuuauuacuccagaacagaaagaccuuacuucauuucaaau

SEQ ID NO: 299558 - RNA, 63 nt, hsa
aaauugacucuucaaacccucgguuuuugccacagaacagagaucuuucaggggaaaguagau

SEQ ID NO: 299559 - RNA, 63 nt, hsa
gagaauucagcagcucaacaguaaugaaagugaagaacagaguccauuuuccuuccuggggcc

SEQ ID NO: 299560 - RNA, 63 nt, hsa
ugccagucucuccagugugggcaccagccggccagaacagaugcgagcaguccaugacucugg

SEQ ID NO: 299561 - RNA, 63 nt, hsa
cuagguguggcugggggccaggagagcaggaacagaacagagaaaugcccuuggaagaagugg

SEQ ID NO: 299562 - RNA, 63 nt, hsa
cacuauuuuacuuuuuuaaaaucauaaaacggcagaacagauuugguuaguuuagaagaaaag

SEQ ID NO: 299563 - RNA, 63 nt, hsa
acagguuauauguggcauagcauaaccacaguaagaacagaacagauauucagcagaaaacuu

SEQ ID NO: 299564 - RNA, 63 nt, hsa
uuauauguggcauagcauaaccacaguaagaacagaacagauauucagcagaaaacuuuuuau

SEQ ID NO: 299565 - RNA, 63 nt, hsa
gcagaaguguggcaaaugcaucaggaaccgguuagaacagaacagagaaacccugacugucua

SEQ ID NO: 299566 - RNA, 63 nt, hsa
aguguggcaaaugcaucaggaaccgguuagaacagaacagagaaacccugacugucuacagau

SEQ ID NO: 299567 - RNA, 63 nt, hsa
ccugauuggaaauagaagacauuuccgguugagagaacagauucguuggaagcuuaacuuuug

SEQ ID NO: 299568 - RNA, 63 nt, hsa
ugcuaacugcuuuuugucucgguugcuauuccaagaacagaaggaggaaguuggccaauuaca

SEQ ID NO: 299569 - RNA, 63 nt, hsa
gguacugguaccaaaacagagauauagaucaauagaacagaacagagcccucagaaauaaugc

SEQ ID NO: 299570 - RNA, 63 nt, hsa
ugguaccaaaacagagauauagaucaauagaacagaacagagcccucagaaauaaugccacau

SEQ ID NO: 299571 - RNA, 63 nt, hsa
uuuauuccuguaaauauuucugugaaaacuaggagaacagagaugagauuugacaaaaaaaaa

SEQ ID NO: 299572 - RNA, 63 nt, hsa
ucuccugugggcuuuuuaccaccacugugcaggagaacagacagaggaaaugugucucccucc

SEQ ID NO: 299573 - RNA, 63 nt, hsa
ccaaaacccuuacucacaugaggauggaggaacagaacagaggacuugggaaaagucucaacu

SEQ ID NO: 299574 - RNA, 63 nt, hsa
auguacuuagaauagguuuugaaugggagagguagaacagagagagaauuaagaagggaucug

SEQ ID NO: 299575 - RNA, 64 nt, hsa; identical to SEQ ID NO: 146945

SEQ ID NO: 299576 - RNA, 64 nt, hsa; identical to SEQ ID NO: 146946

SEQ ID NO: 299577 - RNA, 64 nt, hsa; identical to SEQ ID NO: 146947

SEQ ID NO: 299578 - RNA, 64 nt, hsa; identical to SEQ ID NO: 146948

SEQ ID NO: 299579 - RNA, 64 nt, hsa; identical to SEQ ID NO: 146949

SEQ ID NO: 299580 - RNA, 64 nt, hsa; identical to SEQ ID NO: 146950

SEQ ID NO: 299581 - RNA, 64 nt, hsa; identical to SEQ ID NO: 146951

SEQ ID NO: 299582 - RNA, 64 nt, hsa; identical to SEQ ID NO: 146952

SEQ ID NO: 299583 - RNA, 64 nt, hsa; identical to SEQ ID NO: 146953

SEQ ID NO: 299584 - RNA, 64 nt, hsa; identical to SEQ ID NO: 146954

SEQ ID NO: 299585 - RNA, 64 nt, hsa; identical to SEQ ID NO: 146955

SEQ ID NO: 299586 - RNA, 64 nt, hsa; identical to SEQ ID NO: 146956

SEQ ID NO: 299587 - RNA, 64 nt, hsa; identical to SEQ ID NO: 146957

SEQ ID NO: 299588 - RNA, 64 nt, hsa; identical to SEQ ID NO: 146958

SEQ ID NO: 299589 - RNA, 64 nt, hsa; identical to SEQ ID NO: 146959

SEQ ID NO: 299590 - RNA, 64 nt, hsa; identical to SEQ ID NO: 146960

SEQ ID NO: 299591 - RNA, 64 nt, hsa; identical to SEQ ID NO: 146961

SEQ ID NO: 299592 - RNA, 64 nt, hsa; identical to SEQ ID NO: 146962

SEQ ID NO: 299593 - RNA, 64 nt, hsa; identical to SEQ ID NO: 146963

SEQ ID NO: 299594 - RNA, 63 nt, hsa; identical to SEQ ID NO: 299537

SEQ ID NO: 299595 - RNA, 63 nt, hsa; identical to SEQ ID NO: 299538

SEQ ID NO: 299596 - RNA, 63 nt, hsa; identical to SEQ ID NO: 299539

SEQ ID NO: 299597 - RNA, 63 nt, hsa; identical to SEQ ID NO: 299540

SEQ ID NO: 299598 - RNA, 63 nt, hsa; identical to SEQ ID NO: 299541

SEQ ID NO: 299599 - RNA, 63 nt, hsa; identical to SEQ ID NO: 299542

SEQ ID NO: 299600 - RNA, 63 nt, hsa; identical to SEQ ID NO: 299543

SEQ ID NO: 299601 - RNA, 63 nt, hsa; identical to SEQ ID NO: 299544

SEQ ID NO: 299602 - RNA, 63 nt, hsa; identical to SEQ ID NO: 299545

SEQ ID NO: 299603 - RNA, 63 nt, hsa; identical to SEQ ID NO: 299546

SEQ ID NO: 299604 - RNA, 61 nt, hsa; identical to SEQ ID NO: 299547

SEQ ID NO: 299605 - RNA, 63 nt, hsa; identical to SEQ ID NO: 299548

SEQ ID NO: 299606 - RNA, 63 nt, hsa; identical to SEQ ID NO: 299549

SEQ ID NO: 299607 - RNA, 63 nt, hsa; identical to SEQ ID NO: 299550

SEQ ID NO: 299608 - RNA, 63 nt, hsa; identical to SEQ ID NO: 299551

SEQ ID NO: 299609 - RNA, 63 nt, hsa; identical to SEQ ID NO: 299552

SEQ ID NO: 299610 - RNA, 63 nt, hsa; identical to SEQ ID NO: 299553

SEQ ID NO: 299611 - RNA, 63 nt, hsa; identical to SEQ ID NO: 299554

SEQ ID NO: 299612 - RNA, 63 nt, hsa; identical to SEQ ID NO: 299555

SEQ ID NO: 299613 - RNA, 63 nt, hsa; identical to SEQ ID NO: 299556

SEQ ID NO: 299614 - RNA, 63 nt, hsa; identical to SEQ ID NO: 299557

SEQ ID NO: 299615 - RNA, 63 nt, hsa; identical to SEQ ID NO: 299558

SEQ ID NO: 299616 - RNA, 63 nt, hsa; identical to SEQ ID NO: 299559

SEQ ID NO: 299617 - RNA, 63 nt, hsa; identical to SEQ ID NO: 299560

SEQ ID NO: 299618 - RNA, 63 nt, hsa; identical to SEQ ID NO: 299561

SEQ ID NO: 299619 - RNA, 63 nt, hsa; identical to SEQ ID NO: 299562

SEQ ID NO: 299620 - RNA, 63 nt, hsa; identical to SEQ ID NO: 299563

SEQ ID NO: 299621 - RNA, 63 nt, hsa; identical to SEQ ID NO: 299564

SEQ ID NO: 299622 - RNA, 63 nt, hsa; identical to SEQ ID NO: 299565

SEQ ID NO: 299623 - RNA, 63 nt, hsa; identical to SEQ ID NO: 299566

SEQ ID NO: 299624 - RNA, 63 nt, hsa; identical to SEQ ID NO: 299567

SEQ ID NO: 299625 - RNA, 63 nt, hsa; identical to SEQ ID NO: 299568

SEQ ID NO: 299626 - RNA, 63 nt, hsa; identical to SEQ ID NO: 299569

SEQ ID NO: 299627 - RNA, 63 nt, hsa; identical to SEQ ID NO: 299570

SEQ ID NO: 299628 - RNA, 63 nt, hsa; identical to SEQ ID NO: 299571

SEQ ID NO: 299629 - RNA, 63 nt, hsa; identical to SEQ ID NO: 299572

SEQ ID NO: 299630 - RNA, 63 nt, hsa; identical to SEQ ID NO: 299573

SEQ ID NO: 299631 - RNA, 63 nt, hsa; identical to SEQ ID NO: 299574

SEQ ID NO: 299632 - RNA, 64 nt, hsa
aaccagacaccugagacaggagccuguaugcagcccagugcagccuugcagaggacaaggcugg

SEQ ID NO: 299633 - RNA, 64 nt, hsa
aagaaaacuguggguaaucaaacuggcauaaaauccagugcacucccuaggaaauccgggaggu

SEQ ID NO: 299634 - RNA, 51 nt, hsa
ccacucugcuggcucuguaacccagugcaccucccuccccagcuccggagg

SEQ ID NO: 299635 - RNA, 64 nt, hsa
agugcuuucucuuuuacacuccccuguccccaccccagugcacucuucuggcccaggcagcaag

SEQ ID NO: 299636 - RNA, 64 nt, hsa
cugcagcaccgaggggccuuuguucuggggggacccagugcagaauguaagugggcccacccgg

SEQ ID NO: 299637 - RNA, 64 nt, hsa
agggccauggcucaggguggucucuucuuggggcccagugcaugguggccagaggugucaccca

SEQ ID NO: 299638 - RNA, 64 nt, hsa
accucaagaacugccuguggaccgaggcccccuaccagugcaugagacacacaccuacccuccc

SEQ ID NO: 299639 - RNA, 64 nt, hsa
augcaagcguuuccauugccacugcagaaugaagccagugcacaugguauuagucaucagccag

SEQ ID NO: 299640 - RNA, 64 nt, hsa
aacauggacacucaugagucauccuccaggacgaccagugcauccucaagcucugcuccuucag

SEQ ID NO: 299641 - RNA, 64 nt, hsa
agcccucucagaacagagggguagggagggugcaccagugcaccaggaaggcugugugggucug

SEQ ID NO: 299642 - RNA, 64 nt, hsa
aggugauucacacguacacacauaaacacacccaccagugcagccugaaguaacucccacagaa

SEQ ID NO: 299643 - RNA, 64 nt, hsa
gagagacccgagcauccuccccacccccauagcuccagugcacgccacccccgucuugccuggg

SEQ ID NO: 299644 - RNA, 64 nt, hsa
ccccagaggaccgggaggcaccccacccuccccaccagugcaacagaaaccaccugcguccaca

SEQ ID NO: 299645 - RNA, 64 nt, hsa
uugucuuucaaacacccugagccuuccuaaacagccagugcagacguucucucugggccacgaa

SEQ ID NO: 299646 - RNA, 64 nt, hsa
ccaagaggggucugagugggaccucaaagcauggccagugcaauucugaggcuaggggaauagg

SEQ ID NO: 299647 - RNA, 64 nt, hsa
agggcccccugcuggggcuggacaucacugcaguccagugcaaagccgcccccagagcccaggu

SEQ ID NO: 299648 - RNA, 64 nt, hsa
ccugccccgcaagcaaaccugcccccucugccucccagugcacccaaugacccccucccuuggg

SEQ ID NO: 299649 - RNA, 64 nt, hsa; identical to SEQ ID NO: 257800

SEQ ID NO: 299650 - RNA, 64 nt, hsa; identical to SEQ ID NO: 257801

SEQ ID NO: 299651 - RNA, 64 nt, hsa; identical to SEQ ID NO: 257802

SEQ ID NO: 299652 - RNA, 64 nt, hsa; identical to SEQ ID NO: 257803

SEQ ID NO: 299653 - RNA, 64 nt, hsa; identical to SEQ ID NO: 257804

SEQ ID NO: 299654 - RNA, 64 nt, hsa; identical to SEQ ID NO: 257805

SEQ ID NO: 299655 - RNA, 64 nt, hsa; identical to SEQ ID NO: 257806

SEQ ID NO: 299656 - RNA, 64 nt, hsa; identical to SEQ ID NO: 257807

SEQ ID NO: 299657 - RNA, 64 nt, hsa; identical to SEQ ID NO: 257808

SEQ ID NO: 299658 - RNA, 64 nt, hsa; identical to SEQ ID NO: 257809

SEQ ID NO: 299659 - RNA, 64 nt, hsa; identical to SEQ ID NO: 257810

SEQ ID NO: 299660 - RNA, 64 nt, hsa; identical to SEQ ID NO: 257811

SEQ ID NO: 299661 - RNA, 64 nt, hsa; identical to SEQ ID NO: 257812

SEQ ID NO: 299662 - RNA, 64 nt, hsa; identical to SEQ ID NO: 257813

SEQ ID NO: 299663 - RNA, 64 nt, hsa; identical to SEQ ID NO: 257814

SEQ ID NO: 299664 - RNA, 64 nt, hsa; identical to SEQ ID NO: 257815

SEQ ID NO: 299665 - RNA, 64 nt, hsa; identical to SEQ ID NO: 257816

SEQ ID NO: 299666 - RNA, 64 nt, hsa; identical to SEQ ID NO: 257817

SEQ ID NO: 299667 - RNA, 64 nt, hsa; identical to SEQ ID NO: 257818

SEQ ID NO: 299668 - RNA, 64 nt, hsa; identical to SEQ ID NO: 257819

SEQ ID NO: 299669 - RNA, 64 nt, hsa; identical to SEQ ID NO: 257820

SEQ ID NO: 299670 - RNA, 64 nt, hsa; identical to SEQ ID NO: 257821

SEQ ID NO: 299671 - RNA, 64 nt, hsa; identical to SEQ ID NO: 257822

SEQ ID NO: 299672 - RNA, 64 nt, hsa; identical to SEQ ID NO: 257823

SEQ ID NO: 299673 - RNA, 64 nt, hsa; identical to SEQ ID NO: 257824

SEQ ID NO: 299674 - RNA, 64 nt, hsa; identical to SEQ ID NO: 257825

SEQ ID NO: 299675 - RNA, 64 nt, hsa; identical to SEQ ID NO: 257826

SEQ ID NO: 299676 - RNA, 64 nt, hsa; identical to SEQ ID NO: 257827

SEQ ID NO: 299677 - RNA, 64 nt, hsa; identical to SEQ ID NO: 257828

SEQ ID NO: 299678 - RNA, 64 nt, hsa; identical to SEQ ID NO: 257829

SEQ ID NO: 299679 - RNA, 64 nt, hsa; identical to SEQ ID NO: 257830

SEQ ID NO: 299680 - RNA, 64 nt, hsa; identical to SEQ ID NO: 257831

SEQ ID NO: 299681 - RNA, 64 nt, hsa
acugccuugugaggucaaggugguggccaaggacaccagccaccccacugacccucugaccucc

SEQ ID NO: 299682 - RNA, 64 nt, hsa
cgcuuccuaacugcugcuucucagggaauccgacaccagccaaccauuuuaagccucuaaaaga

SEQ ID NO: 299683 - RNA, 64 nt, hsa
gugccgccacccuggcaugccccacaaacagaucaccagccagcuuacacaggcauuaacucuc

SEQ ID NO: 299684 - RNA, 64 nt, hsa
caauauuuugcacaccuguaauaggccauggcacaccagccaagaugcucugcucacagucagu

SEQ ID NO: 299685 - RNA, 64 nt, hsa
uacugcuguguaaugguuacacuaaccaaaagacaccagccacucagaguucuauacuguaaag

SEQ ID NO: 299686 - RNA, 64 nt, hsa
gacacugucuuauggauucauuuauaagaagagaaccagccauauacacuuggggagauuugcc

SEQ ID NO: 299687 - RNA, 64 nt, hsa
ucaguggcuucaucugucaagugggaucugucacaccagccauacuuaucucucugugcugugg

SEQ ID NO: 299688 - RNA, 64 nt, hsa
cacggacucuuacugcuaacuuuuguguaucguaaccagccagauccucuugguuauuuguuua

SEQ ID NO: 299689 - RNA, 64 nt, hsa
ggcccagcuggcuggaguccaggcagccaaggugaccagccagcugaucccucugugccaccac

SEQ ID NO: 299690 - RNA, 64 nt, hsa
uugcagaguuauuuuugauguuccccaauuccccaccagccaauccaagcauuuucuccuggga

SEQ ID NO: 299691 - RNA, 64 nt, hsa
aggacagcaggaggggcccacaccucaagccuggaccagccaccucaaggccuuggggagcuua

SEQ ID NO: 299692 - RNA, 64 nt, hsa
uuuuggcuuggccccaggaauuuccugugacuccaccagccaucaugggugccagccagggucc

SEQ ID NO: 299693 - RNA, 53 nt, hsa
aguuugagauggacauuuaaagcaccagccaucguguggagcacuaccaaggg

SEQ ID NO: 299694 - RNA, 64 nt, hsa
aggggccccucagggccuuccugggaggagucccaccagccaggccuuaugaaagugaucauac

SEQ ID NO: 299695 - RNA, 64 nt, hsa
uucccuaggacuagaugcauaccguuuugugaaaaccagccauaggaaaacaugugagcaacaa

SEQ ID NO: 299696 - RNA, 64 nt, hsa
ccaaauuuugugcauauauuuuuuauuuaaucugaccagccacccaaaccauggguauuuuugu

SEQ ID NO: 299697 - RNA, 64 nt, hsa
ugccccccaguaugggaaccagcaccucccaccaaccagccacacccggugggggcacagcaca

SEQ ID NO: 299698 - RNA, 64 nt, hsa
ugccccccggugugggaaccagcaccucccaccaaccagccacacccagugggggcacagcaca

SEQ ID NO: 299699 - RNA, 64 nt, hsa
ggcccccgggugcagaaaacagcaccucccaccaaccagccacucccgguggggacacagcaca
